United States Patent 11,640,849 (METHODS FOR HISTOLOGICAL DIAGNOSIS AND TREATMENT OF DISEASES) - sequence listing, part 29

SEQ ID NO: 1126382 - protein, 31 aa, Mycobacterium
PARRRGEAQSNQGAAHFCVVLATHRHAVEAT

SEQ ID NO: 1126383 - protein, 19 aa, Mycobacterium
PARRSSTHGRRHWIEVRGL

SEQ ID NO: 1126384 - protein, 24 aa, Mycobacterium
PARVREVIELNGPDIYRSTTVTRE

SEQ ID NO: 1126385 - protein, 24 aa, Mycobacterium
PARYLALFLAMLIGAYLLVFLTGD

SEQ ID NO: 1126386 - protein, 24 aa, Mycobacterium
PASDINFVLALALFVFICYHAAGI

SEQ ID NO: 1126387 - protein, 24 aa, Mycobacterium
PATAAWLRDRGCDMAQGYYFGKPI

SEQ ID NO: 1126388 - protein, 19 aa, Mycobacterium
PATPPRFRRPSLLTLVIVL

SEQ ID NO: 1126389 - protein, 17 aa, Mycobacterium
PATRWAAQVQWALVGIA

SEQ ID NO: 1126390 - protein, 19 aa, Mycobacterium
PATVSKLLIRVAETSDAPQ

SEQ ID NO: 1126391 - protein, 20 aa, Mycobacterium
PAVAFRPVRLLVICVALAAV

SEQ ID NO: 1126392 - protein, 18 aa, Mycobacterium
PAVGLVVLFSAARMATGS

SEQ ID NO: 1126393 - protein, 22 aa, Mycobacterium
PAVPRWRKFVEQFRDPLIYLLF

SEQ ID NO: 1126394 - protein, 30 aa, Mycobacterium
PAWRARAVGTYRLWRDGGFAVGALVAGVVA

SEQ ID NO: 1126395 - protein, 17 aa, Mycobacterium
PAWSRRLTGRGWPKPVA

SEQ ID NO: 1126396 - protein, 19 aa, Mycobacterium
PAYGETWVMVGVTMVLVVL

SEQ ID NO: 1126397 - protein, 19 aa, Mycobacterium
PAYHALTYGWLVSGLARAV

SEQ ID NO: 1126398 - protein, 19 aa, Mycobacterium
PCALPRKRIEHHNDSRRHG

SEQ ID NO: 1126399 - protein, 19 aa, Mycobacterium
PCEGEWRVFTTLFQGTPLC

SEQ ID NO: 1126400 - protein, 19 aa, Mycobacterium
PCGAGPIIGVAGQFVPTRV

SEQ ID NO: 1126401 - protein, 19 aa, Mycobacterium
PCTTGFLPVQQMRPAAELD

SEQ ID NO: 1126402 - protein, 17 aa, Mycobacterium
PDAEVMYVLSMHPAVLA

SEQ ID NO: 1126403 - protein, 28 aa, Mycobacterium
PDAPPRWLPDWLRPRPLVNSARQATARV

SEQ ID NO: 1126404 - protein, 33 aa, Mycobacterium
PDAPTARLMMAWTVLGDTIWVAGGMSHGESLQT

SEQ ID NO: 1126405 - protein, 18 aa, Mycobacterium
PDDLAGAVRTFANNLEYI

SEQ ID NO: 1126406 - protein, 20 aa, Mycobacterium
PDDVFWSFIQAVIISVIVML

SEQ ID NO: 1126407 - protein, 19 aa, Mycobacterium
PDGALYWGVGDNATGANAQ

SEQ ID NO: 1126408 - protein, 21 aa, Mycobacterium
PDGGAAFIRRLLTLATTLLLV

SEQ ID NO: 1126409 - protein, 20 aa, Mycobacterium
PDGRAARRTALAVIALLSLF

SEQ ID NO: 1126410 - protein, 21 aa, Mycobacterium
PDHRPPRAPVWVFVYGVTSVL

SEQ ID NO: 1126411 - protein, 25 aa, Mycobacterium
PDILDPALLRPGRFDRQIPVSNPDL

SEQ ID NO: 1126412 - protein, 20 aa, Mycobacterium
PDIWSAATFITLALFLGIGT

SEQ ID NO: 1126413 - protein, 22 aa, Mycobacterium
PDKAVPVFAVLVFVVACIVGSL

SEQ ID NO: 1126414 - protein, 20 aa, Mycobacterium
PDLAERLAIVELRRIDRSMR

SEQ ID NO: 1126415 - protein, 19 aa, Mycobacterium
PDLERLDALMPQLIALLPS

SEQ ID NO: 1126416 - protein, 20 aa, Mycobacterium
PDLERMAAIMPELIALMPQQ

SEQ ID NO: 1126417 - protein, 18 aa, Mycobacterium
PDLLDLVAGQPLLYGASD

SEQ ID NO: 1126418 - protein, 19 aa, Mycobacterium
PDLPAAPLPFVDELAPPGT

SEQ ID NO: 1126419 - protein, 22 aa, Mycobacterium
PDLVPPPGFGGAHRRPSEAEPH

SEQ ID NO: 1126420 - protein, 27 aa, Mycobacterium
PDPESRPRLILGFAMVALPALGLWHLW

SEQ ID NO: 1126421 - protein, 24 aa, Mycobacterium
PDPTLRWMYWWGLLITAADILIAL

SEQ ID NO: 1126422 - protein, 18 aa, Mycobacterium
PDQFDWFSAYLRDRGLQV

SEQ ID NO: 1126423 - protein, 19 aa, Mycobacterium
PDREWRSILDQLLDPPKPS

SEQ ID NO: 1126424 - protein, 21 aa, Mycobacterium
PDRRTAVVVPLSIVITALAGF

SEQ ID NO: 1126425 - protein, 21 aa, Mycobacterium
PDSEVYFVEFLDFECEGCRAL

SEQ ID NO: 1126426 - protein, 21 aa, Mycobacterium
PDSVVWSFLLAVTMAVVIMLV

SEQ ID NO: 1126427 - protein, 19 aa, Mycobacterium
PDTLHQFRDQFALNGFGSE

SEQ ID NO: 1126428 - protein, 26 aa, Mycobacterium
PDTPAWRLALPLTMVGAAGAFTWEPL

SEQ ID NO: 1126429 - protein, 22 aa, Mycobacterium
PDTQRWAYPLLLVLSGVALGVS

SEQ ID NO: 1126430 - protein, 20 aa, Mycobacterium
PDTTLSRWLPASAPGGPSAL

SEQ ID NO: 1126431 - protein, 21 aa, Mycobacterium
PDTYRVMLRQGLYGNYFTFYL

SEQ ID NO: 1126432 - protein, 19 aa, Mycobacterium
PDYYRLRFGRSVEVGASLL

SEQ ID NO: 1126433 - protein, 25 aa, Mycobacterium
PEAKLWPLVLGRLVAAAVVLFAALV

SEQ ID NO: 1126434 - protein, 21 aa, Mycobacterium
PEARSVFVIAALAAFAGFAVT

SEQ ID NO: 1126435 - protein, 19 aa, Mycobacterium
PEASAVVARLAALGVTNTV

SEQ ID NO: 1126436 - protein, 24 aa, Mycobacterium
PEDPAWAWLKWLPHLQHETDTDAA

SEQ ID NO: 1126437 - protein, 20 aa, Mycobacterium
PEDRSYLAFDEIETLGTSDE

SEQ ID NO: 1126438 - protein, 20 aa, Mycobacterium
PEEERAAVFERFHRGTTASR

SEQ ID NO: 1126439 - protein, 22 aa, Mycobacterium
PEFAQPYLPIAVVAALDAVFGG

SEQ ID NO: 1126440 - protein, 26 aa, Mycobacterium
PEFASYAPALWRYWAQHLDPDRARRD

SEQ ID NO: 1126441 - protein, 25 aa, Mycobacterium
PEGLPAIMSVVLALGVRRMAARNAI

SEQ ID NO: 1126442 - protein, 17 aa, Mycobacterium
PEGLPLVATLAQLASAR

SEQ ID NO: 1126443 - protein, 21 aa, Mycobacterium
PEGPGSLPDRRFDLAHTEVPY

SEQ ID NO: 1126444 - protein, 26 aa, Mycobacterium
PEGRRRWWHSTARRAAVVATIVAVAV

SEQ ID NO: 1126445 - protein, 19 aa, Mycobacterium
PEGRSIVVFAKQEYGLRAR

SEQ ID NO: 1126446 - protein, 20 aa, Mycobacterium
PEITTSPVLRDKALYTTTFV

SEQ ID NO: 1126447 - protein, 19 aa, Mycobacterium
PEKLWQIKELQFAALSGVF

SEQ ID NO: 1126448 - protein, 22 aa, Mycobacterium
PELAAAFPFYGPTPDNPDFAAS

SEQ ID NO: 1126449 - protein, 20 aa, Mycobacterium
PELLDGIGARVLRWINSVRG

SEQ ID NO: 1126450 - protein, 25 aa, Mycobacterium
PELPLPRLPIAEYDPATGTYLAPDG

SEQ ID NO: 1126451 - protein, 19 aa, Mycobacterium
PELPMRPTVLEAKDDIPVS

SEQ ID NO: 1126452 - protein, 23 aa, Mycobacterium
PELSMDITLRFDALAAVMSVLVL

SEQ ID NO: 1126453 - protein, 23 aa, Mycobacterium
PENDKRVAVGIVLLSALTAATAL

SEQ ID NO: 1126454 - protein, 21 aa, Mycobacterium
PENRMRVAVLTAATIAILVVA

SEQ ID NO: 1126455 - protein, 17 aa, Mycobacterium
PEPAALVSIPGTRRQWE

SEQ ID NO: 1126456 - protein, 23 aa, Mycobacterium
PEPARFPIISVLAPLIMGLILFA

SEQ ID NO: 1126457 - protein, 24 aa, Mycobacterium
PEPEVKGLGLAAGAKRPGAKKTPA

SEQ ID NO: 1126458 - protein, 25 aa, Mycobacterium
PEPNRLDLDAGFFLSQEPYADGTAP

SEQ ID NO: 1126459 - protein, 26 aa, Mycobacterium
PEPRPEPRRDGVFSAYGIASAVLGVV

SEQ ID NO: 1126460 - protein, 24 aa, Mycobacterium
PEPTEGGLVRTARIGGITVSTPAE

SEQ ID NO: 1126461 - protein, 18 aa, Mycobacterium
PEPTELNLALAVPVTLVL

SEQ ID NO: 1126462 - protein, 20 aa, Mycobacterium
PEPTPTPVQRRFWYRCATTV

SEQ ID NO: 1126463 - protein, 22 aa, Mycobacterium
PEPYPGPGLGLITAWFAVILLT

SEQ ID NO: 1126464 - protein, 23 aa, Mycobacterium
PEQIDVGMRWLRRSAPDLLRVPI

SEQ ID NO: 1126465 - protein, 20 aa, Mycobacterium
PERQRAAAIELMRSTLTDRG

SEQ ID NO: 1126466 - protein, 31 aa, Mycobacterium
PERTGEFSPRLAALGRFTLRHKALVIGAWLG

SEQ ID NO: 1126467 - protein, 25 aa, Mycobacterium
PERVRLRAFIPLFVANAVFWSLFQQ

SEQ ID NO: 1126468 - protein, 20 aa, Mycobacterium
PESIVICAGVRHAVELLTRA

SEQ ID NO: 1126469 - protein, 20 aa, Mycobacterium
PEVFWPLRRVGAAFHSAQDG

SEQ ID NO: 1126470 - protein, 21 aa, Mycobacterium
PEVFWPLRRVGVEFHAAQDGK

SEQ ID NO: 1126471 - protein, 20 aa, Mycobacterium
PEVGESLPGTKGTRPVIDPG

SEQ ID NO: 1126472 - protein, 20 aa, Mycobacterium
PEVGKSVGVLGTMFVALIKM

SEQ ID NO: 1126473 - protein, 27 aa, Mycobacterium
PEVRILNYFFCWAAIYQLGIAWHGALV

SEQ ID NO: 1126474 - protein, 18 aa, Mycobacterium
PEYWQAAEDLGFGQLNLL

SEQ ID NO: 1126475 - protein, 19 aa, Mycobacterium
PFAEMGLNSVMAMSIRREV

SEQ ID NO: 1126476 - protein, 28 aa, Mycobacterium
PFAVGKRLWEIVGLVAPGRGGHEDDKQT

SEQ ID NO: 1126477 - protein, 29 aa, Mycobacterium
PFAWQEFLRQSWFVARVSLLPTLLLAIPF

SEQ ID NO: 1126478 - protein, 24 aa, Mycobacterium
PFEAADVRQVWSAHMFAPPPRPSI

SEQ ID NO: 1126479 - protein, 21 aa, Mycobacterium
PFGALTFTGLQAMLDPPRAAA

SEQ ID NO: 1126480 - protein, 18 aa, Mycobacterium
PFGWYYDLLALWSQVSTA

SEQ ID NO: 1126481 - protein, 19 aa, Mycobacterium
PFIGFVPWIIYWVVADGPS

SEQ ID NO: 1126482 - protein, 24 aa, Mycobacterium
PFLDLRFFRSIPFTTATVIAISAF

SEQ ID NO: 1126483 - protein, 24 aa, Mycobacterium
PFNPVQFPIALLLNVTNPIRAEFG

SEQ ID NO: 1126484 - protein, 18 aa, Mycobacterium
PFQYWGWANFASVVCAIG

SEQ ID NO: 1126485 - protein, 18 aa, Mycobacterium
PFRQAPRDADSWATAASG

SEQ ID NO: 1126486 - protein, 26 aa, Mycobacterium
PFVLFGLPLLMGWLLIRRRQGRPAFT

SEQ ID NO: 1126487 - protein, 26 aa, Mycobacterium
PFVMLGAAILWFGWFGFNVGSEGAAD

SEQ ID NO: 1126488 - protein, 23 aa, Mycobacterium
PFWFPEVHAGAMAPIGIGALAAL

SEQ ID NO: 1126489 - protein, 30 aa, Mycobacterium
PGAAGILMLTGLGGLVGYRQARAGLALRTE

SEQ ID NO: 1126490 - protein, 20 aa, Mycobacterium
PGAARFTLRTAFVGLVTVVG

SEQ ID NO: 1126491 - protein, 19 aa, Mycobacterium
PGAEITWDGLRLKAEGGPD

SEQ ID NO: 1126492 - protein, 17 aa, Mycobacterium
PGAFRLAVLVVIVVALV

SEQ ID NO: 1126493 - protein, 25 aa, Mycobacterium
PGASRATLIIGVIVVVLAVVGAVLG

SEQ ID NO: 1126494 - protein, 18 aa, Mycobacterium
PGCDAPATRCDIDHTVPW

SEQ ID NO: 1126495 - protein, 20 aa, Mycobacterium
PGCQKVLEGTGFVVSPNRVM

SEQ ID NO: 1126496 - protein, 24 aa, Mycobacterium
PGDKERWLIRHKRGVDYFDPDDPY

SEQ ID NO: 1126497 - protein, 30 aa, Mycobacterium
PGDYRPNLFVTYWAFRAMIGLLLVPVAFAL

SEQ ID NO: 1126498 - protein, 34 aa, Mycobacterium
PGEKSMVFGMILTVFAMRCAAAIGFLQMKRWGHQ

SEQ ID NO: 1126499 - protein, 20 aa, Mycobacterium
PGELRITLMRADVLAEPIAL

SEQ ID NO: 1126500 - protein, 19 aa, Mycobacterium
PGEPGIRRSGGWAAIVGTG

SEQ ID NO: 1126501 - protein, 19 aa, Mycobacterium
PGEPSPWGADVFVRDLESV

SEQ ID NO: 1126502 - protein, 17 aa, Mycobacterium
PGFSSDVRVTRPELEQL

SEQ ID NO: 1126503 - protein, 25 aa, Mycobacterium
PGGFLEYLGAILFSLGGLAFGFLVP

SEQ ID NO: 1126504 - protein, 24 aa, Mycobacterium
PGGKVKLRGVVVGRVSEITGGNDP

SEQ ID NO: 1126505 - protein, 20 aa, Mycobacterium
PGGRAVRKLVRFYWRHPECR

SEQ ID NO: 1126506 - protein, 24 aa, Mycobacterium
PGGRGIGLALVRLVTAQHGGTIEV

SEQ ID NO: 1126507 - protein, 17 aa, Mycobacterium
PGIAPGFTAGALAVFIG

SEQ ID NO: 1126508 - protein, 29 aa, Mycobacterium
PGISRWARRPRVWWLTAIGNSGAMTLYLW

SEQ ID NO: 1126509 - protein, 24 aa, Mycobacterium
PGLAELLHRCWLALHAGPPGQVDT

SEQ ID NO: 1126510 - protein, 23 aa, Mycobacterium
PGLHTALSWAISIGRSLPFLILM

SEQ ID NO: 1126511 - protein, 19 aa, Mycobacterium
PGLRRAVGNVVALRPAADQ

SEQ ID NO: 1126512 - protein, 23 aa, Mycobacterium
PGMLERQLADWLRQELSISDLTW

SEQ ID NO: 1126513 - protein, 26 aa, Mycobacterium
PGNTETGWKLGFYAASRASQLRRMRA

SEQ ID NO: 1126514 - protein, 24 aa, Mycobacterium
PGNYRKLVRLGAYGSWLNQYLCGL

SEQ ID NO: 1126515 - protein, 29 aa, Mycobacterium
PGNYRPNLFVTYWAFRAMIGLLLVPVAFA

SEQ ID NO: 1126516 - protein, 21 aa, Mycobacterium
PGPDHRPRNSALLAGAAVLLV

SEQ ID NO: 1126517 - protein, 17 aa, Mycobacterium
PGPGLGLLLAYMAFGRG

SEQ ID NO: 1126518 - protein, 23 aa, Mycobacterium
PGPLPRTTVFFSPGNEEAAATVA

SEQ ID NO: 1126519 - protein, 26 aa, Mycobacterium
PGPYPAVVFAHGFSGTMDWILPDFAS

SEQ ID NO: 1126520 - protein, 20 aa, Mycobacterium
PGRQLPAWVSRAVDSPTARW

SEQ ID NO: 1126521 - protein, 18 aa, Mycobacterium
PGSATFRALAWSQDDTTS

SEQ ID NO: 1126522 - protein, 25 aa, Mycobacterium
PGSGYRVPPALVRRADGQTVQLTPL

SEQ ID NO: 1126523 - protein, 24 aa, Mycobacterium
PGSPCSYTPPADGLPRPGNPLPCA

SEQ ID NO: 1126524 - protein, 19 aa, Mycobacterium
PGSVLTPAELFEWSKERVP

SEQ ID NO: 1126525 - protein, 22 aa, Mycobacterium
PGTAARPSVDFAGQDDTYTDEL

SEQ ID NO: 1126526 - protein, 19 aa, Mycobacterium
PGVALSALLGFDVLVGGFV

SEQ ID NO: 1126527 - protein, 23 aa, Mycobacterium
PGVGVLALLAWLRVRVPEPARYE

SEQ ID NO: 1126528 - protein, 20 aa, Mycobacterium
PGVHNRGGFPVLPMAFTPDF

SEQ ID NO: 1126529 - protein, 24 aa, Mycobacterium
PGVMGFGVYLVWPAFYTDVTDSYR

SEQ ID NO: 1126530 - protein, 19 aa, Mycobacterium
PGYMLYNFGVALYVGVLQT

SEQ ID NO: 1126531 - protein, 17 aa, Mycobacterium
PHCRHPVLTHPLYAVHH

SEQ ID NO: 1126532 - protein, 25 aa, Mycobacterium
PHLTPRSRKVFLMGLGLLAAALAVA

SEQ ID NO: 1126533 - protein, 25 aa, Mycobacterium
PHMVFAVALVWTWVGTSGVFYGTRW

SEQ ID NO: 1126534 - protein, 22 aa, Mycobacterium
PHQRGGGFLRQFWSKLRLRDSE

SEQ ID NO: 1126535 - protein, 25 aa, Mycobacterium
PHRVMRELYEQFIAYSREYAERIRS

SEQ ID NO: 1126536 - protein, 21 aa, Mycobacterium
PHSLWVWIGVFGIAVVVLVVG

SEQ ID NO: 1126537 - protein, 22 aa, Mycobacterium
PHSLWVWIGVFGIAVVVLVVGW

SEQ ID NO: 1126538 - protein, 22 aa, Mycobacterium
PHTFELLDRIGFEAMSLPNLRY

SEQ ID NO: 1126539 - protein, 18 aa, Mycobacterium
PHVIPYFGLIPLALGLWA

SEQ ID NO: 1126540 - protein, 18 aa, Mycobacterium
PIASWLGQSLGWRAAFGL

SEQ ID NO: 1126541 - protein, 20 aa, Mycobacterium
PIDAILPFMTMFAVSNTALI

SEQ ID NO: 1126542 - protein, 22 aa, Mycobacterium
PIDLLWSFLQAVLMAIAILLVH

SEQ ID NO: 1126543 - protein, 19 aa, Mycobacterium
PIGSLWYTVVCFVIAGLSL

SEQ ID NO: 1126544 - protein, 18 aa, Mycobacterium
PIGSWVFVTRPAFVRGGD

SEQ ID NO: 1126545 - protein, 19 aa, Mycobacterium
PIIVGMVLLILPLGKITLG

SEQ ID NO: 1126546 - protein, 19 aa, Mycobacterium
PINLLSYFGTWALIGLLVV

SEQ ID NO: 1126547 - protein, 18 aa, Mycobacterium
PIPHLAKLAVVFASLPLH

SEQ ID NO: 1126548 - protein, 23 aa, Mycobacterium
PIPQEWAQFLPGYGVTRLLFDTS

SEQ ID NO: 1126549 - protein, 34 aa, Mycobacterium
PIRNYFYWEPHCYNIPLCWSFRSLFDSMDGISVM

SEQ ID NO: 1126550 - protein, 20 aa, Mycobacterium
PISWAHHWVWVVPLTIWLLH

SEQ ID NO: 1126551 - protein, 22 aa, Mycobacterium
PITLWSPMGRDMFGFTLPAPFG

SEQ ID NO: 1126552 - protein, 21 aa, Mycobacterium
PIVAIIPLFFLLRHAGLTNSV

SEQ ID NO: 1126553 - protein, 24 aa, Mycobacterium
PIYMRLEMTAPIYIWALLMALALN

SEQ ID NO: 1126554 - protein, 18 aa, Mycobacterium
PKALIARVPFVVLVIGSL

SEQ ID NO: 1126555 - protein, 32 aa, Mycobacterium
PKASVMTHYRWLRALAGFGGLGLRLNSSDTLY

SEQ ID NO: 1126556 - protein, 19 aa, Mycobacterium
PKDGPSRNPLVFVINYLKE

SEQ ID NO: 1126557 - protein, 17 aa, Mycobacterium
PKGWPIGSYSTYAEAQR

SEQ ID NO: 1126558 - protein, 26 aa, Mycobacterium
PKKIIPRATLIAVIGLGLFYTFISAM

SEQ ID NO: 1126559 - protein, 20 aa, Mycobacterium
PKLAAPLSVGDDAARVKLAE

SEQ ID NO: 1126560 - protein, 24 aa, Mycobacterium
PKLSPAEANAWCDANRLGVNDCFA

SEQ ID NO: 1126561 - protein, 18 aa, Mycobacterium
PKMMAFNFVVALLTSTVL

SEQ ID NO: 1126562 - protein, 24 aa, Mycobacterium
PKRGRKRLLWAVVVAVVVATLVGV

SEQ ID NO: 1126563 - protein, 18 aa, Mycobacterium
PKRSIKMEVFDGPGTPEV

SEQ ID NO: 1126564 - protein, 21 aa, Mycobacterium
PKSLCIVALIWYLAEAVGIAF

SEQ ID NO: 1126565 - protein, 20 aa, Mycobacterium
PKVNFADIWRRADLPRDGRA

SEQ ID NO: 1126566 - protein, 27 aa, Mycobacterium
PLAACATVIAALAWALTRYQRRQGQWR

SEQ ID NO: 1126567 - protein, 17 aa, Mycobacterium
PLAALLGCIAFTTNGAY

SEQ ID NO: 1126568 - protein, 24 aa, Mycobacterium
PLAGKEIRANWPVKKPPTKLREVR

SEQ ID NO: 1126569 - protein, 25 aa, Mycobacterium
PLATQMGWRAALLVTPALAAVALAL

SEQ ID NO: 1126570 - protein, 29 aa, Mycobacterium
PLAWPRGRQQWQRWYPLTMLITGAVLITL

SEQ ID NO: 1126571 - protein, 21 aa, Mycobacterium
PLCAIADVGAREIGPVSSITL

SEQ ID NO: 1126572 - protein, 18 aa, Mycobacterium
PLDGPVLVLTSYCVPAHN

SEQ ID NO: 1126573 - protein, 17 aa, Mycobacterium
PLDGVFVALEEALARNS

SEQ ID NO: 1126574 - protein, 25 aa, Mycobacterium
PLDKERRKQAAISFDSDNSGISEAF

SEQ ID NO: 1126575 - protein, 25 aa, Mycobacterium
PLDKERRTQPAIAFDRENSPIAEAF

SEQ ID NO: 1126576 - protein, 17 aa, Mycobacterium
PLDPERTKPAASQSNPD

SEQ ID NO: 1126577 - protein, 24 aa, Mycobacterium
PLDQPRIYFGPVIANTPADYAIVG

SEQ ID NO: 1126578 - protein, 19 aa, Mycobacterium
PLEAGTWFEPRAFTAEEAA

SEQ ID NO: 1126579 - protein, 26 aa, Mycobacterium
PLGRARLRLAGAAGLFVAGFTAVFLM

SEQ ID NO: 1126580 - protein, 25 aa, Mycobacterium
PLGVPRVRCASGSPLAPPDNDTLAH

SEQ ID NO: 1126581 - protein, 32 aa, Mycobacterium; identical to SEQ ID NO: 14092

SEQ ID NO: 1126582 - protein, 24 aa, Mycobacterium
PLIACLVAGCGTWLVYRITRNVMK

SEQ ID NO: 1126583 - protein, 20 aa, Mycobacterium
PLICAAGLYRLARVMFGRYV

SEQ ID NO: 1126584 - protein, 18 aa, Mycobacterium
PLIIGIADFTWSAGGLTF

SEQ ID NO: 1126585 - protein, 26 aa, Mycobacterium
PLIKPAILVALLFRTLDAFRIFDNIY

SEQ ID NO: 1126586 - protein, 25 aa, Mycobacterium
PLIPYLLGYESLWVGLLFGGVGLLI

SEQ ID NO: 1126587 - protein, 19 aa, Mycobacterium
PLIWLSLAFGWGLLGIWAG

SEQ ID NO: 1126588 - protein, 30 aa, Mycobacterium
PLLAYLLWVVWCRRTWRPVRLLGGLVAMAA

SEQ ID NO: 1126589 - protein, 18 aa, Mycobacterium
PLLFPFQPIHVTIAAWFT

SEQ ID NO: 1126590 - protein, 20 aa, Mycobacterium
PLMLACFAFGTKRFFRGETL

SEQ ID NO: 1126591 - protein, 22 aa, Mycobacterium
PLPAEVALGFDLAEPPTIARVF

SEQ ID NO: 1126592 - protein, 24 aa, Mycobacterium
PLPGPGCYPYREPLPAPPPGGPPP

SEQ ID NO: 1126593 - protein, 28 aa, Mycobacterium
PLPRQIYWRRRALALGIAALVIGIVVAV

SEQ ID NO: 1126594 - protein, 25 aa, Mycobacterium
PLQMPDAILGRYGDRTYVIWEGHRS

SEQ ID NO: 1126595 - protein, 23 aa, Mycobacterium
PLRARLPSIPVRQGVEATLAGLG

SEQ ID NO: 1126596 - protein, 27 aa, Mycobacterium
PLRAYALCIIAGIIVALVLGDRRWEAR

SEQ ID NO: 1126597 - protein, 20 aa, Mycobacterium
PLRTGIFGIALVTCLVLVSF

SEQ ID NO: 1126598 - protein, 27 aa, Mycobacterium
PLSWPDSRLSYLFVFLALALAPVATAV

SEQ ID NO: 1126599 - protein, 25 aa, Mycobacterium
PLTAAMSQLWGWRTAVVVVTAAAAT

SEQ ID NO: 1126600 - protein, 24 aa, Mycobacterium
PLTAMGVAMAFIWSPLAATATRNL

SEQ ID NO: 1126601 - protein, 24 aa, Mycobacterium
PLVGRWDALGFLQDFFAVAVLLGI

SEQ ID NO: 1126602 - protein, 25 aa, Mycobacterium
PLVISGWTLVVWMLVAIGSGIGYFA

SEQ ID NO: 1126603 - protein, 17 aa, Mycobacterium
PLVPGVMIAAALIAVIG

SEQ ID NO: 1126604 - protein, 19 aa, Mycobacterium
PLVVVLIALFVQWRRTDDR

SEQ ID NO: 1126605 - protein, 17 aa, Mycobacterium
PLYAIAVILSFLASQFV

SEQ ID NO: 1126606 - protein, 22 aa, Mycobacterium
PLYALSVLAAFFAARFTTVYIN

SEQ ID NO: 1126607 - protein, 18 aa, Mycobacterium
PLYFAFGVVAALLGELAV

SEQ ID NO: 1126608 - protein, 31 aa, Mycobacterium
PLYSLSVLAAFFAARFTTVFINGQSAGLYDH

SEQ ID NO: 1126609 - protein, 17 aa, Mycobacterium
PLYSVAVILSFLASRYT

SEQ ID NO: 1126610 - protein, 23 aa, Mycobacterium
PLYVLCLAVSYLTTQIVVQIISG

SEQ ID NO: 1126611 - protein, 25 aa, Mycobacterium
PMASGIGIWSRHPIVHSGRVDGYAL

SEQ ID NO: 1126612 - protein, 20 aa, Mycobacterium
PMFLFFPAMMLVSSIGTLAY

SEQ ID NO: 1126613 - protein, 19 aa, Mycobacterium
PMFLGAMIMGPLGGWCMKK

SEQ ID NO: 1126614 - protein, 17 aa, Mycobacterium
PMGHVMTAEDAAIALGR

SEQ ID NO: 1126615 - protein, 18 aa, Mycobacterium
PMGRRIRAVVQNRDLAET

SEQ ID NO: 1126616 - protein, 17 aa, Mycobacterium
PMINRGGKVLGVVFGAA

SEQ ID NO: 1126617 - protein, 17 aa, Mycobacterium
PMLLWIAGVYDVLRNLR

SEQ ID NO: 1126618 - protein, 19 aa, Mycobacterium
PMNRAVEINPRFTSADGAF

SEQ ID NO: 1126619 - protein, 18 aa, Mycobacterium
PMQLKLAITAGIGLFILF

SEQ ID NO: 1126620 - protein, 19 aa, Mycobacterium
PMSGRVVVFASAKGFSEVS

SEQ ID NO: 1126621 - protein, 25 aa, Mycobacterium
PMTTGRRLGVTFAVAAALFVLIALS

SEQ ID NO: 1126622 - protein, 22 aa, Mycobacterium
PNARMAFGGTVVVPAALQWLSS

SEQ ID NO: 1126623 - protein, 23 aa, Mycobacterium
PNDDLPVRMAVLLIHGVAPVLVT

SEQ ID NO: 1126624 - protein, 26 aa, Mycobacterium
PNEPLWFGLDAWRWMFLAMALPAVLY

SEQ ID NO: 1126625 - protein, 21 aa, Mycobacterium
PNEWPWAYAMMLGIHLVLLLA

SEQ ID NO: 1126626 - protein, 17 aa, Mycobacterium
PNGMPPDVVVRIITAVA

SEQ ID NO: 1126627 - protein, 25 aa, Mycobacterium
PNGYLRQMIYPFTRRGGCASEATTT

SEQ ID NO: 1126628 - protein, 20 aa, Mycobacterium
PNHHGGALGFGPDGALYWGV

SEQ ID NO: 1126629 - protein, 21 aa, Mycobacterium
PNIAGIPWWGAILTAVIASAI

SEQ ID NO: 1126630 - protein, 18 aa, Mycobacterium
PNLEVRRTRYAWLVSLLD

SEQ ID NO: 1126631 - protein, 23 aa, Mycobacterium
PNPSELLGSLAARKVVNELRAQF

SEQ ID NO: 1126632 - protein, 18 aa, Mycobacterium
PNSYLRQMIYPFTGRGGC

SEQ ID NO: 1126633 - protein, 17 aa, Mycobacterium
PPAELPPPVTTVTVGAD

SEQ ID NO: 1126634 - protein, 18 aa, Mycobacterium
PPARPAAEPIGFAHNGFH

SEQ ID NO: 1126635 - protein, 18 aa, Mycobacterium
PPCVTGFLPPQQRRNPTL

SEQ ID NO: 1126636 - protein, 19 aa, Mycobacterium
PPDIESVVAPAPDSMTDTG

SEQ ID NO: 1126637 - protein, 19 aa, Mycobacterium
PPDTHRLGPILKALLVTVE

SEQ ID NO: 1126638 - protein, 27 aa, Mycobacterium
PPDTTRPVGLTVFWPLADRPRLAAGAP

SEQ ID NO: 1126639 - protein, 17 aa, Mycobacterium
PPFYAFVVVGYVAAFTL

SEQ ID NO: 1126640 - protein, 20 aa, Mycobacterium
PPFYPPGWFWIGGRLAALTG

SEQ ID NO: 1126641 - protein, 20 aa, Mycobacterium
PPGPREWLLAALHSRYSQVV

SEQ ID NO: 1126642 - protein, 24 aa, Mycobacterium
PPGRMSIAVFGARVLVGSLQPGTY

SEQ ID NO: 1126643 - protein, 28 aa, Mycobacterium
PPGSPGVRVRLVLTWVVCTALPGSAIAV

SEQ ID NO: 1126644 - protein, 18 aa, Mycobacterium
PPIFAGLSRSDSRRGELF

SEQ ID NO: 1126645 - protein, 22 aa, Mycobacterium
PPKERGSLLAKVKDMFSDPLSI

SEQ ID NO: 1126646 - protein, 23 aa, Mycobacterium
PPKRAWWLRHYTFFGTATGLVFV

SEQ ID NO: 1126647 - protein, 18 aa, Mycobacterium
PPLAGSIDQLNRVAPLLE

SEQ ID NO: 1126648 - protein, 43 aa, Mycobacterium
PPLAQRLPWRWLPWLSWTVSCAWAFSLAMVDGWQRGFAGRLTA

SEQ ID NO: 1126649 - protein, 20 aa, Mycobacterium
PPLFREHLHMAGVAVDSLEE

SEQ ID NO: 1126650 - protein, 19 aa, Mycobacterium
PPLFREHLHQAGVAAGSAE

SEQ ID NO: 1126651 - protein, 32 aa, Mycobacterium
PPLLALWLARWLLFRVEFGAGLIKMRGDPCWR

SEQ ID NO: 1126652 - protein, 24 aa, Mycobacterium
PPLMQRLRDMMNFSDNVMAEAIGR

SEQ ID NO: 1126653 - protein, 28 aa, Mycobacterium
PPLRALSQAGTWSWHLTRDFVAEMRTNL

SEQ ID NO: 1126654 - protein, 17 aa, Mycobacterium
PPLRVLEDLPRRIRASD

SEQ ID NO: 1126655 - protein, 22 aa, Mycobacterium
PPMRWLGFALIWLALLVFTGDA

SEQ ID NO: 1126656 - protein, 17 aa, Mycobacterium
PPPALGKQVSRVDMTDV

SEQ ID NO: 1126657 - protein, 19 aa, Mycobacterium
PPPALPTVMMIGGEFNTPA

SEQ ID NO: 1126658 - protein, 18 aa, Mycobacterium
PPPARIVLFSDGKETVPS

SEQ ID NO: 1126659 - protein, 17 aa, Mycobacterium
PPPDIWSAATFITLALF

SEQ ID NO: 1126660 - protein, 22 aa, Mycobacterium
PPPDLWSAATFITLAVFLGVGT

SEQ ID NO: 1126661 - protein, 48 aa, Mycobacterium
PPPEEPQPWYRKPGALIALGAIAALLVAVIVWLVVQLVSGDDSGESTT

SEQ ID NO: 1126662 - protein, 48 aa, Mycobacterium
PPPGEPQPWYRKPGALIALGAIAALLVAVIVWLVVQLVSGDDSGESTT

SEQ ID NO: 1126663 - protein, 27 aa, Mycobacterium
PPPPDNRLPRFIAFGVGIVAIAAAIIA

SEQ ID NO: 1126664 - protein, 28 aa, Mycobacterium
PPPPDNRLPRFIAFGVGIVAIAAAIIAV

SEQ ID NO: 1126665 - protein, 24 aa, Mycobacterium
PPPPEKRRAGFFNRQTVPLLAIIV

SEQ ID NO: 1126666 - protein, 25 aa, Mycobacterium
PPPRRQPHRKLVAAVALGVLALALA

SEQ ID NO: 1126667 - protein, 24 aa, Mycobacterium
PPQERALVFERFFRSTSARSMPGS

SEQ ID NO: 1126668 - protein, 22 aa, Mycobacterium
PPRAALIASLIVAVGGLVAVLV

SEQ ID NO: 1126669 - protein, 26 aa, Mycobacterium
PPRAEVLWPHTWDRVLGRSVDGVAWM

SEQ ID NO: 1126670 - protein, 21 aa, Mycobacterium
PPRLWRMRIGVQQVGQSTKVS

SEQ ID NO: 1126671 - protein, 19 aa, Mycobacterium
PPRRRPWRQRGQDTARSAF

SEQ ID NO: 1126672 - protein, 17 aa, Mycobacterium
PPRRRRALNLALRGRRD

SEQ ID NO: 1126673 - protein, 18 aa, Mycobacterium
PPRSWQLRVELQRDADRI

SEQ ID NO: 1126674 - protein, 17 aa, Mycobacterium
PPSRKAPLVWAIGAAIP

SEQ ID NO: 1126675 - protein, 25 aa, Mycobacterium
PPTEAGALPEFVAAEGLGSDCQYPK

SEQ ID NO: 1126676 - protein, 18 aa, Mycobacterium
PPTEQWYRRLMVNDRALA

SEQ ID NO: 1126677 - protein, 26 aa, Mycobacterium
PPVQYPKRRRPWIIAVVAAVAVLAVV

SEQ ID NO: 1126678 - protein, 17 aa, Mycobacterium
PPVSRPGPATVVVVLLR

SEQ ID NO: 1126679 - protein, 19 aa, Mycobacterium
PPWVALPIAMFIASIICAL

SEQ ID NO: 1126680 - protein, 17 aa, Mycobacterium
PPYGRPPLAPPPAPPAP

SEQ ID NO: 1126681 - protein, 25 aa, Mycobacterium
PQAFLKLMLRWLNAFVPKPGQTIPG

SEQ ID NO: 1126682 - protein, 17 aa, Mycobacterium
PQAFTHARRARRIMLQN

SEQ ID NO: 1126683 - protein, 30 aa, Mycobacterium
PQAGRRLDVDAATELLKRDWATGSTVDLPM

SEQ ID NO: 1126684 - protein, 19 aa, Mycobacterium
PQGDAYGAIGFAYNGGAVN

SEQ ID NO: 1126685 - protein, 18 aa, Mycobacterium
PQLAIPVLTMLMAVAMVA

SEQ ID NO: 1126686 - protein, 21 aa, Mycobacterium
PQLSRQDWRLRIHGMVDREVT

SEQ ID NO: 1126687 - protein, 18 aa, Mycobacterium
PQLVPGRNTLSVYGPPTA

SEQ ID NO: 1126688 - protein, 23 aa, Mycobacterium
PQLWPHNWPFVAQVLAAILIADF

SEQ ID NO: 1126689 - protein, 28 aa, Mycobacterium
PQNGLRSASFVFRHRAGNAVIFLLLVVA

SEQ ID NO: 1126690 - protein, 22 aa, Mycobacterium
PQPIFWWIGIYLFFVPLNMMGV

SEQ ID NO: 1126691 - protein, 21 aa, Mycobacterium
PQPRGPFRYLGLLPAVGAVAA

SEQ ID NO: 1126692 - protein, 24 aa, Mycobacterium
PQPWFDWPTRPVWLYRFTQGLHVA

SEQ ID NO: 1126693 - protein, 26 aa, Mycobacterium
PQQLWSMATSVRYQAVFAESGGLAAG

SEQ ID NO: 1126694 - protein, 17 aa, Mycobacterium
PQQPQWPGSGSGAGSGS

SEQ ID NO: 1126695 - protein, 17 aa, Mycobacterium
PQRVRTRPVPAPWPRPG

SEQ ID NO: 1126696 - protein, 19 aa, Mycobacterium
PQRWRSRAAAVATVANIGG

SEQ ID NO: 1126697 - protein, 41 aa, Mycobacterium
PQTQPRSALRLVLDNLWPLARAALTMTIPLTIISFVIGLVI

SEQ ID NO: 1126698 - protein, 17 aa, Mycobacterium
PQTRSTRSFDLQFRDDE

SEQ ID NO: 1126699 - protein, 24 aa, Mycobacterium
PQVGRLADRFGRRPVYIAGAMLAA

SEQ ID NO: 1126700 - protein, 19 aa, Mycobacterium
PQVRMLAAVLCDRDLSVVV

SEQ ID NO: 1126701 - protein, 20 aa, Mycobacterium
PQWIDPRAAIVTTVSAAADR

SEQ ID NO: 1126702 - protein, 17 aa, Mycobacterium
PQYGELKGPSCFTAPLV

SEQ ID NO: 1126703 - protein, 18 aa, Mycobacterium
PRAAVLVPLVQTATTLPV

SEQ ID NO: 1126704 - protein, 17 aa, Mycobacterium
PRAEFPLPYNGILGGSR

SEQ ID NO: 1126705 - protein, 20 aa, Mycobacterium
PRAESPQCRALVDALPDQLG

SEQ ID NO: 1126706 - protein, 18 aa, Mycobacterium
PRAQLSWFDPRSGARTPL

SEQ ID NO: 1126707 - protein, 25 aa, Mycobacterium
PRAVLYLPEYLLFRIVRSYFTLAAV

SEQ ID NO: 1126708 - protein, 27 aa, Mycobacterium
PRAVLYLPEYLLFRIVRSYFTLAAVLS

SEQ ID NO: 1126709 - protein, 27 aa, Mycobacterium
PRAVLYLPEYLVFRIVRSYFTLAAVLS

SEQ ID NO: 1126710 - protein, 24 aa, Mycobacterium
PRESDIWLLGAIGPRMVYSTNLDA

SEQ ID NO: 1126711 - protein, 19 aa, Mycobacterium
PRFRRPSLLTLVIVLVVGG

SEQ ID NO: 1126712 - protein, 17 aa, Mycobacterium
PRFSGVVAANLLSVLGL

SEQ ID NO: 1126713 - protein, 27 aa, Mycobacterium
PRGDLMVDAPLWFHIHVMLGLTLFCLW

SEQ ID NO: 1126714 - protein, 22 aa, Mycobacterium
PRGRVRIGTVLVSPVEPAPDTA

SEQ ID NO: 1126715 - protein, 17 aa, Mycobacterium
PRIAAVVATVPALDMYV

SEQ ID NO: 1126716 - protein, 17 aa, Mycobacterium
PRIGRAVLTSRPSLLFA

SEQ ID NO: 1126717 - protein, 18 aa, Mycobacterium
PRLAGRAANATWVAVTGI

SEQ ID NO: 1126718 - protein, 20 aa, Mycobacterium
PRLAQQIGRPVGALGRIGDH

SEQ ID NO: 1126719 - protein, 19 aa, Mycobacterium
PRLDTMGLLISARRIIPVH

SEQ ID NO: 1126720 - protein, 17 aa, Mycobacterium
PRLFERFYRADTARDRE

SEQ ID NO: 1126721 - protein, 19 aa, Mycobacterium
PRLGEPRMDELVALLRAQL

SEQ ID NO: 1126722 - protein, 18 aa, Mycobacterium
PRLLRTFAADQVVQRTLA

SEQ ID NO: 1126723 - protein, 23 aa, Mycobacterium
PRLWPHSWPFVAQVLTAILVADF

SEQ ID NO: 1126724 - protein, 19 aa, Mycobacterium
PRMADFCRTLAAVDEILST

SEQ ID NO: 1126725 - protein, 27 aa, Mycobacterium
PRMLAAQFRLELRLLLRNGEQLLLTMF

SEQ ID NO: 1126726 - protein, 19 aa, Mycobacterium
PRMQLPMSGFYVVGAAYYV

SEQ ID NO: 1126727 - protein, 19 aa, Mycobacterium
PRNAFPLTVPGYGSPARRF

SEQ ID NO: 1126728 - protein, 17 aa, Mycobacterium
PRPAPVPRMLAAQFRLE

SEQ ID NO: 1126729 - protein, 20 aa, Mycobacterium
PRPDQGAAYASEIPDLSGPR

SEQ ID NO: 1126730 - protein, 19 aa, Mycobacterium
PRPDQVLMRQHLMLYMALM

SEQ ID NO: 1126731 - protein, 20 aa, Mycobacterium
PRPEAAAAIAEARGAGIRVV

SEQ ID NO: 1126732 - protein, 36 aa, Mycobacterium
PRPHLLRDLRDGWVFMLRTPWLLWTLLFASLFVLVV

SEQ ID NO: 1126733 - protein, 30 aa, Mycobacterium
PRPPKKKRNWGWVVAIVLVVAALAAVAILG

SEQ ID NO: 1126734 - protein, 25 aa, Mycobacterium
PRPQWTPPKPAWTWPTQTVEPDEPD

SEQ ID NO: 1126735 - protein, 17 aa, Mycobacterium
PRQPVRKTARRGVEAAP

SEQ ID NO: 1126736 - protein, 19 aa, Mycobacterium
PRRASTVALIGLVYTQLVQ

SEQ ID NO: 1126737 - protein, 18 aa, Mycobacterium
PRRATWLVVVVALLVDLI

SEQ ID NO: 1126738 - protein, 19 aa, Mycobacterium
PRREVLKVLQPEHANGDHV

SEQ ID NO: 1126739 - protein, 23 aa, Mycobacterium
PRRLEAFALFNVFYQGGILAGPL

SEQ ID NO: 1126740 - protein, 25 aa, Mycobacterium
PRRLRTEVLGGLVVALALIPEAISF

SEQ ID NO: 1126741 - protein, 31 aa, Mycobacterium
PRRREARSLLYLLLRPYRWVVLALAVVVVVE

SEQ ID NO: 1126742 - protein, 25 aa, Mycobacterium
PRRSEPRGKFHLCNYVTAVTDGANV

SEQ ID NO: 1126743 - protein, 25 aa, Mycobacterium
PRRTNWWAVVSLIFGVIGGVLISLV

SEQ ID NO: 1126744 - protein, 19 aa, Mycobacterium
PRRVARFAERFAEMAPQAL

SEQ ID NO: 1126745 - protein, 22 aa, Mycobacterium
PRRVEAFAVFNVFYQAGILAGP

SEQ ID NO: 1126746 - protein, 19 aa, Mycobacterium
PRSGAVLWLPATEPLAYSL

SEQ ID NO: 1126747 - protein, 20 aa, Mycobacterium
PRSLWVWIGVFGVAVVVLMV

SEQ ID NO: 1126748 - protein, 21 aa, Mycobacterium
PRTAFTLAAGLLFGPVLGIPI

SEQ ID NO: 1126749 - protein, 20 aa, Mycobacterium
PRTLGLGAQHVVAMFGATFL

SEQ ID NO: 1126750 - protein, 18 aa, Mycobacterium
PRTLVLACAVGIGPFALT

SEQ ID NO: 1126751 - protein, 17 aa, Mycobacterium
PRTMWRNPVMFIVEIGA

SEQ ID NO: 1126752 - protein, 21 aa, Mycobacterium
PRTPDAPWYDNWIVALSAAVV

SEQ ID NO: 1126753 - protein, 22 aa, Mycobacterium
PRTRESGTILWLILLLSAFSWM

SEQ ID NO: 1126754 - protein, 26 aa, Mycobacterium
PRTVELPGLGWYRMESRAGDGDEVLV

SEQ ID NO: 1126755 - protein, 17 aa, Mycobacterium
PRVLLLVDAIGPFREQY

SEQ ID NO: 1126756 - protein, 17 aa, Mycobacterium
PRVPAAATAAVFAAALV

SEQ ID NO: 1126757 - protein, 18 aa, Mycobacterium
PRVPAEPGGDFVDQAGNG

SEQ ID NO: 1126758 - protein, 18 aa, Mycobacterium
PRVVSLIFIPWQALMWVL

SEQ ID NO: 1126759 - protein, 39 aa, Mycobacterium
PRYMPGGRVRTSTLGLIVAFIALFWLYQVYEPPVRPAQN

SEQ ID NO: 1126760 - protein, 18 aa, Mycobacterium
PRYPEIKADLAMSNAAYG

SEQ ID NO: 1126761 - protein, 18 aa, Mycobacterium
PSAAEWRDSLLRLQLTTC

SEQ ID NO: 1126762 - protein, 24 aa, Mycobacterium
PSAFGRGPLKWIYLTLGGLMAATM

SEQ ID NO: 1126763 - protein, 17 aa, Mycobacterium
PSAHVFVDMVTEIVLIV

SEQ ID NO: 1126764 - protein, 18 aa, Mycobacterium
PSAQVAFMAGAPFGLGVD

SEQ ID NO: 1126765 - protein, 24 aa, Mycobacterium
PSARSFTGAAIWLGMASLVVAGII

SEQ ID NO: 1126766 - protein, 27 aa, Mycobacterium
PSDGAVFCAFLLLLLAVGFVIKYIWWF

SEQ ID NO: 1126767 - protein, 21 aa, Mycobacterium
PSDLLWSFLQAIVMSIAVMLV

SEQ ID NO: 1126768 - protein, 19 aa, Mycobacterium
PSDYRALPGGTYVMSTVAD

SEQ ID NO: 1126769 - protein, 18 aa, Mycobacterium
PSEIGMEGRVRWRHDLDQ

SEQ ID NO: 1126770 - protein, 25 aa, Mycobacterium
PSGRLNKAALWVGIVAGSVFIVAAI

SEQ ID NO: 1126771 - protein, 21 aa, Mycobacterium
PSIPVLLALMALTAVLRLINI

SEQ ID NO: 1126772 - protein, 20 aa, Mycobacterium
PSIYYRTLDPFVTLAAAAAV

SEQ ID NO: 1126773 - protein, 18 aa, Mycobacterium
PSKRKWGVRESGATITWP

SEQ ID NO: 1126774 - protein, 24 aa, Mycobacterium
PSLIGCVRIRASITVSPDDRVSGQ

SEQ ID NO: 1126775 - protein, 19 aa, Mycobacterium
PSLLLAVVVLYVFSPSAAN

SEQ ID NO: 1126776 - protein, 20 aa, Mycobacterium
PSLLPRGPLFQGLVSGGAGA

SEQ ID NO: 1126777 - protein, 23 aa, Mycobacterium
PSLLPRGPLFQGLVSGGAGAIGY

SEQ ID NO: 1126778 - protein, 18 aa, Mycobacterium
PSLLTLVCSRSVAIGELD

SEQ ID NO: 1126779 - protein, 21 aa, Mycobacterium
PSLSAMLGWLPPPVPILPVSA

SEQ ID NO: 1126780 - protein, 21 aa, Mycobacterium
PSNFFAWALSVMFLVFTLRAI

SEQ ID NO: 1126781 - protein, 19 aa, Mycobacterium
PSPLLKGGLAFVDTPGVGG

SEQ ID NO: 1126782 - protein, 21 aa, Mycobacterium
PSPPQRRLALGLTALNLCVIA

SEQ ID NO: 1126783 - protein, 19 aa, Mycobacterium
PSQPYRLRVIVHEDDNGHM

SEQ ID NO: 1126784 - protein, 31 aa, Mycobacterium
PSRRLRLPVPVCGALLCAVTALLLSPAAVLA

SEQ ID NO: 1126785 - protein, 23 aa, Mycobacterium
PSRVAQMLLLFWGFGAALLTLLY

SEQ ID NO: 1126786 - protein, 23 aa, Mycobacterium
PSTRLRKELNWWDLTVFGVSVVI

SEQ ID NO: 1126787 - protein, 26 aa, Mycobacterium
PSTSLFRRMFLINGLIFTLGTLALAL

SEQ ID NO: 1126788 - protein, 17 aa, Mycobacterium
PSTWMFGAVCAVIATLI

SEQ ID NO: 1126789 - protein, 24 aa, Mycobacterium
PSVRPRPSDTLTYPDHKNRSSLRR

SEQ ID NO: 1126790 - protein, 18 aa, Mycobacterium
PSWPNPWQPKPQTPPKQD

SEQ ID NO: 1126791 - protein, 27 aa, Mycobacterium
PTAALKRRLLICVALSVPVIAMAMVPV

SEQ ID NO: 1126792 - protein, 18 aa, Mycobacterium
PTADYLRFVLSRITLPGS

SEQ ID NO: 1126793 - protein, 21 aa, Mycobacterium
PTAEAQPGWRPIADSRIPLAA

SEQ ID NO: 1126794 - protein, 20 aa, Mycobacterium
PTAGHVISAYALGVVVGAPV

SEQ ID NO: 1126795 - protein, 23 aa, Mycobacterium
PTARLMMAYTVLDDQIWIAGGIR

SEQ ID NO: 1126796 - protein, 27 aa, Mycobacterium
PTARWSAPLQLMFSFLFTPLIRLTNGT

SEQ ID NO: 1126797 - protein, 18 aa, Mycobacterium
PTDFWLNLYWLMLCGMLI

SEQ ID NO: 1126798 - protein, 18 aa, Mycobacterium
PTDLPWGLEIYYRRDPAG

SEQ ID NO: 1126799 - protein, 18 aa, Mycobacterium
PTDLVWSFLQSVAITVVV

SEQ ID NO: 1126800 - protein, 17 aa, Mycobacterium
PTEGFLFAVGVTVAVVP

SEQ ID NO: 1126801 - protein, 24 aa, Mycobacterium
PTFLRNIKPILGLGVGLVVVTAFT

SEQ ID NO: 1126802 - protein, 18 aa, Mycobacterium
PTGARAGLGLAALTALVV

SEQ ID NO: 1126803 - protein, 32 aa, Mycobacterium
PTGVVVRLCLWYPERAWLLLAIYTALALLAVI

SEQ ID NO: 1126804 - protein, 27 aa, Mycobacterium
PTIPWYQEFLRYYFLTVEESVDGSLTR

SEQ ID NO: 1126805 - protein, 17 aa, Mycobacterium
PTKIGALVHSITGGERD

SEQ ID NO: 1126806 - protein, 24 aa, Mycobacterium
PTLEIAPGITIPWGPPTTVPVAPP

SEQ ID NO: 1126807 - protein, 22 aa, Mycobacterium
PTLLKLLAMIVGIAMTLVSLCA

SEQ ID NO: 1126808 - protein, 19 aa, Mycobacterium
PTLPLPLAPVAPRDDRDEP

SEQ ID NO: 1126809 - protein, 21 aa, Mycobacterium
PTNELGSFVLLDPAETRIEAT

SEQ ID NO: 1126810 - protein, 18 aa, Mycobacterium
PTNLRWVLYALGTIAVIV

SEQ ID NO: 1126811 - protein, 17 aa, Mycobacterium
PTPAVPLVGAVLIPVAI

SEQ ID NO: 1126812 - protein, 19 aa, Mycobacterium
PTPPADRRPAATGAGAATA

SEQ ID NO: 1126813 - protein, 18 aa, Mycobacterium
PTPWTALGAVCFAVSDAM

SEQ ID NO: 1126814 - protein, 17 aa, Mycobacterium
PTQPWPGQQPEQGTDQP

SEQ ID NO: 1126815 - protein, 26 aa, Mycobacterium
PTRVLARWQPSWLRYSPLTFTGLLMI

SEQ ID NO: 1126816 - protein, 20 aa, Mycobacterium
PTSLPVRVALMFAAVLLNAF

SEQ ID NO: 1126817 - protein, 25 aa, Mycobacterium
PTTWRVPVTVISVLIALVITGAVSA

SEQ ID NO: 1126818 - protein, 24 aa, Mycobacterium
PTVKKGDTFNCEVSIDGTKRQVTV

SEQ ID NO: 1126819 - protein, 17 aa, Mycobacterium
PTVRLSALFALAVGIVF

SEQ ID NO: 1126820 - protein, 43 aa, Mycobacterium
PTVVRGARNYPCMEFPGKRAPTVALCRDPKGFVPIGSNPWRGP

SEQ ID NO: 1126821 - protein, 21 aa, Mycobacterium
PTWPQCFPGSFTPVPHAEVPG

SEQ ID NO: 1126822 - protein, 22 aa, Mycobacterium
PTWPQCFPGSFTPVPHPEVAGI

SEQ ID NO: 1126823 - protein, 20 aa, Mycobacterium
PTWWPSGRADVVAAAGRAMT

SEQ ID NO: 1126824 - protein, 20 aa, Mycobacterium
PTYIPPELCHTVGVDPQLPG

SEQ ID NO: 1126825 - protein, 22 aa, Mycobacterium
PVADVPSALSFGFSNTLGSVAL

SEQ ID NO: 1126826 - protein, 28 aa, Mycobacterium
PVAEAIWSMVWWLPLSILLEFLIGLLWS

SEQ ID NO: 1126827 - protein, 24 aa, Mycobacterium
PVAFAVCALFPLLAIPSVPLTVKP

SEQ ID NO: 1126828 - protein, 26 aa, Mycobacterium
PVALLSRLGDHVLFYGRAIGGVPHAA

SEQ ID NO: 1126829 - protein, 24 aa, Mycobacterium
PVALSRLRVPAVIVSVLTLMIRYI

SEQ ID NO: 1126830 - protein, 18 aa, Mycobacterium
PVAMLLLMLGRRWILTLV

SEQ ID NO: 1126831 - protein, 19 aa, Mycobacterium
PVANIGIFSLFVVVTMIVV

SEQ ID NO: 1126832 - protein, 23 aa, Mycobacterium
PVDFRFLPDGRILVAEKAGAIRV

SEQ ID NO: 1126833 - protein, 25 aa, Mycobacterium
PVDHFRSGLMLAVGSAFAFGMSGPL

SEQ ID NO: 1126834 - protein, 17 aa, Mycobacterium
PVDYFAVDLPRIIGNAL

SEQ ID NO: 1126835 - protein, 24 aa, Mycobacterium
PVFLTGVDWIRWWATITYNLGIVF

SEQ ID NO: 1126836 - protein, 25 aa, Mycobacterium
PVGRWLDRVGPRWIMTAGSALGCVS

SEQ ID NO: 1126837 - protein, 23 aa, Mycobacterium
PVGTARCPWCAISEERLARRGAP

SEQ ID NO: 1126838 - protein, 20 aa, Mycobacterium
PVGWAHRLARRRVLMAVLAV

SEQ ID NO: 1126839 - protein, 18 aa, Mycobacterium
PVHPWRPRPLAIAAGTAA

SEQ ID NO: 1126840 - protein, 17 aa, Mycobacterium
PVIGPFFHRGIMLLDFE

SEQ ID NO: 1126841 - protein, 20 aa, Mycobacterium
PVIVGRGLQGFGMPIIPLGI

SEQ ID NO: 1126842 - protein, 20 aa, Mycobacterium
PVKGSIMLFWAPRGSKVIAD

SEQ ID NO: 1126843 - protein, 18 aa, Mycobacterium
PVLAAVIDRAMSRDPRRR

SEQ ID NO: 1126844 - protein, 34 aa, Mycobacterium
PVLAHWRPVVAFAFFEIIAAWLLLSDAERHITSS

SEQ ID NO: 1126845 - protein, 18 aa, Mycobacterium
PVLALICVAMFGLVVSPV

SEQ ID NO: 1126846 - protein, 18 aa, Mycobacterium
PVLALVCVAMFGLVVSPV

SEQ ID NO: 1126847 - protein, 18 aa, Mycobacterium
PVLMIGFAVVMVVAGIRM

SEQ ID NO: 1126848 - protein, 25 aa, Mycobacterium
PVLPIRLFASPVFTVCCILSFIVGF

SEQ ID NO: 1126849 - protein, 18 aa, Mycobacterium
PVLSIFRIVFGLLFTLHG

SEQ ID NO: 1126850 - protein, 19 aa, Mycobacterium
PVMIVCGFLLGAAGQVVKL

SEQ ID NO: 1126851 - protein, 23 aa, Mycobacterium
PVMLHELGHALGLGHSDDRDAMM

SEQ ID NO: 1126852 - protein, 24 aa, Mycobacterium
PVPIEHVGWVAAAGLVGFIGNELV

SEQ ID NO: 1126853 - protein, 18 aa, Mycobacterium
PVQGLWWALYLVFIALLS

SEQ ID NO: 1126854 - protein, 32 aa, Mycobacterium
PVRNYFYWEPHCYNIPVCATMRSVFDTLDGIN

SEQ ID NO: 1126855 - protein, 18 aa, Mycobacterium
PVSPCGVVTVSIGVATVS

SEQ ID NO: 1126856 - protein, 20 aa, Mycobacterium
PVSWSHHWVWALPTVLVTAV

SEQ ID NO: 1126857 - protein, 20 aa, Mycobacterium
PVTARAGLDAVLAGTRTLSI

SEQ ID NO: 1126858 - protein, 27 aa, Mycobacterium
PVTARTGPRWWIVTAAVLALLALVGAG

SEQ ID NO: 1126859 - protein, 24 aa, Mycobacterium
PVTPDRVSMLLAMQGQRGTDPNDV

SEQ ID NO: 1126860 - protein, 20 aa, Mycobacterium
PVVLATRMIPAVPFSVLNYA

SEQ ID NO: 1126861 - protein, 26 aa, Mycobacterium
PVVVTFAIGVAVLWSVQYLAVTFGWI

SEQ ID NO: 1126862 - protein, 17 aa, Mycobacterium
PVVYPRGTLAMANAGPG

SEQ ID NO: 1126863 - protein, 25 aa, Mycobacterium
PVWMGPAPVAWRPPPTVIDADVEGE

SEQ ID NO: 1126864 - protein, 17 aa, Mycobacterium
PVWSRRLTGRGWPKPVA

SEQ ID NO: 1126865 - protein, 30 aa, Mycobacterium
PVYGISLVWLFGHWQSVFWVNVPLAVIAMV

SEQ ID NO: 1126866 - protein, 26 aa, Mycobacterium
PVYRAVINFKFGWDIYNENFGHVDPH

SEQ ID NO: 1126867 - protein, 20 aa, Mycobacterium
PWKSFRGVMAGTLILEAIVV

SEQ ID NO: 1126868 - protein, 26 aa, Mycobacterium
PWLTFLRALPPLAYFFLLVIWLGIDE

SEQ ID NO: 1126869 - protein, 18 aa, Mycobacterium
PWLWVAIAVSALLQVAVV

SEQ ID NO: 1126870 - protein, 22 aa, Mycobacterium
PWPTERQSVAFAVYADVAVVAV

SEQ ID NO: 1126871 - protein, 22 aa, Mycobacterium
PWQIIVYLCIYRAIKNQPVHEL

SEQ ID NO: 1126872 - protein, 18 aa, Mycobacterium
PWTALTLLVVGVYGLCFE

SEQ ID NO: 1126873 - protein, 18 aa, Mycobacterium
PWTALTLLVVGVYGLCLK

SEQ ID NO: 1126874 - protein, 32 aa, Mycobacterium
PWVAVPALAAFAVVCWWVFFEKGLASAAHDAF

SEQ ID NO: 1126875 - protein, 25 aa, Mycobacterium
PWVSVAAPGWRIMGLSNTNGAAVNA

SEQ ID NO: 1126876 - protein, 17 aa, Mycobacterium
PYALGLLILVVTVLRPG

SEQ ID NO: 1126877 - protein, 20 aa, Mycobacterium
PYALRFYRRDILRLIAEISM

SEQ ID NO: 1126878 - protein, 32 aa, Mycobacterium
PYAMYKQKTWKRVAVLFAGPAMNFVIGLVLIY

SEQ ID NO: 1126879 - protein, 17 aa, Mycobacterium
PYDRYTATVGRFLPGLG

SEQ ID NO: 1126880 - protein, 26 aa, Mycobacterium
PYFKVMLANLAPYWILQPFVDAAFKK

SEQ ID NO: 1126881 - protein, 19 aa, Mycobacterium
PYGICLVEDITSRKRAEAD

SEQ ID NO: 1126882 - protein, 20 aa, Mycobacterium
PYLTHWDAGAVVLELYEHLV

SEQ ID NO: 1126883 - protein, 18 aa, Mycobacterium
PYLVQRALVETKLNIART

SEQ ID NO: 1126884 - protein, 23 aa, Mycobacterium
PYMLMMPMMVVMGAVGMMAGGGS

SEQ ID NO: 1126885 - protein, 18 aa, Mycobacterium
PYPFLRPSVTGWPTVAGA

SEQ ID NO: 1126886 - protein, 24 aa, Mycobacterium
PYRGSPMLWRIHLTSVLLVVPQVM

SEQ ID NO: 1126887 - protein, 20 aa, Mycobacterium
PYRPDFPGLDSFSGTVVHPQ

SEQ ID NO: 1126888 - protein, 23 aa, Mycobacterium
PYTFELLDRIGFASMRLPHLRYV

SEQ ID NO: 1126889 - protein, 17 aa, Mycobacterium
PYTNIYGLLALIGTAAI

SEQ ID NO: 1126890 - protein, 17 aa, Mycobacterium
PYYDPSAPYGRHPMTGE

SEQ ID NO: 1126891 - protein, 20 aa, Mycobacterium
QAAFTMMVLIFFNLIAPTGW

SEQ ID NO: 1126892 - protein, 18 aa, Mycobacterium
QAAGLLFFAFAGYARIAT

SEQ ID NO: 1126893 - protein, 20 aa, Mycobacterium
QAAPARRRLSPTATLASVLA

SEQ ID NO: 1126894 - protein, 21 aa, Mycobacterium
QAAPMPTPRQLLAAASDGELV

SEQ ID NO: 1126895 - protein, 23 aa, Mycobacterium
QAASTRRALLLTALGGLLIAGVI

SEQ ID NO: 1126896 - protein, 18 aa, Mycobacterium
QAAYRAAGEIVREATAGT

SEQ ID NO: 1126897 - protein, 18 aa, Mycobacterium
QADMDRWLFGGTMPTVWL

SEQ ID NO: 1126898 - protein, 25 aa, Mycobacterium
QAEKWNFPIVLVILLAVFGSLAAAA

SEQ ID NO: 1126899 - protein, 25 aa, Mycobacterium
QAGTQDWKAWLFGSLDAGNAITVDK

SEQ ID NO: 1126900 - protein, 25 aa, Mycobacterium
QAKILECSTGDFGVQAGLYGGLLVD

SEQ ID NO: 1126901 - protein, 23 aa, Mycobacterium
QALGPICAIILITGAGGMFGGVL

SEQ ID NO: 1126902 - protein, 17 aa, Mycobacterium
QALRADMRRSFVATTAV

SEQ ID NO: 1126903 - protein, 19 aa, Mycobacterium
QALTAPAWQAIQPDLVPAH

SEQ ID NO: 1126904 - protein, 23 aa, Mycobacterium
QAMKEISASLVLYPPGQPVIPVA

SEQ ID NO: 1126905 - protein, 19 aa, Mycobacterium
QANLFAWDQERMMRFSFAP

SEQ ID NO: 1126906 - protein, 17 aa, Mycobacterium
QAPKMTVIAGRRLPLPP

SEQ ID NO: 1126907 - protein, 26 aa, Mycobacterium
QAPRRRGRVSEMAWQVVAAVLVATVF

SEQ ID NO: 1126908 - protein, 25 aa, Mycobacterium
QAQSGSIGLGFAIPVDQAKRIADEL

SEQ ID NO: 1126909 - protein, 18 aa, Mycobacterium
QARAGLALRTESIARFMN

SEQ ID NO: 1126910 - protein, 40 aa, Mycobacterium
QARIDGLHWRVFWICAGVILSTLLIGWVIGLIMVNPFRLL

SEQ ID NO: 1126911 - protein, 23 aa, Mycobacterium
QARLLAWVSLVWMGAEGAIGLWQ

SEQ ID NO: 1126912 - protein, 23 aa, Mycobacterium
QARWRLILTVLIAAASVGLAVVL

SEQ ID NO: 1126913 - protein, 18 aa, Mycobacterium
QATRCGQEDVLAGNDDPN

SEQ ID NO: 1126914 - protein, 19 aa, Mycobacterium
QAVSWVGASILYPSLLLLP

SEQ ID NO: 1126915 - protein, 25 aa, Mycobacterium
QAYASCESCAAVAVAYQVIFVVDTD

SEQ ID NO: 1126916 - protein, 20 aa, Mycobacterium
QDAIGALLWRSLNPDIGPRT

SEQ ID NO: 1126917 - protein, 23 aa, Mycobacterium
QDIGDFLGGLSPVVLTADTRVTN

SEQ ID NO: 1126918 - protein, 18 aa, Mycobacterium
QDLARFALAQAKFQLTGR

SEQ ID NO: 1126919 - protein, 23 aa, Mycobacterium
QDPLARRKIGALTEGRQEKVPAA

SEQ ID NO: 1126920 - protein, 20 aa, Mycobacterium
QDSLDCRLLGVGDMRPSERA

SEQ ID NO: 1126921 - protein, 28 aa, Mycobacterium
QDSPIGVRGTRNFPCIEQPGKAGADGRD

SEQ ID NO: 1126922 - protein, 24 aa, Mycobacterium
QDTLRAMLTWSFVSLGVVGVVAGG

SEQ ID NO: 1126923 - protein, 25 aa, Mycobacterium
QEAALKYFLLGAFSSAFFLYGVAML

SEQ ID NO: 1126924 - protein, 24 aa, Mycobacterium
QEASLKYFLLGAFSSAIFLYGAAM

SEQ ID NO: 1126925 - protein, 26 aa, Mycobacterium
QEEAATPVFRWGFGIWSDKYTDVNQL

SEQ ID NO: 1126926 - protein, 20 aa, Mycobacterium
QELGDFGILVHSGWSASRAL

SEQ ID NO: 1126927 - protein, 25 aa, Mycobacterium
QELIPYIVQFPRFFSGEITLGQLSQ

SEQ ID NO: 1126928 - protein, 22 aa, Mycobacterium
QEPRAWRMRLTVQKVGEDMKVS

SEQ ID NO: 1126929 - protein, 26 aa, Mycobacterium
QEPRTWRLSVSLKREDGQIKMAKVEF

SEQ ID NO: 1126930 - protein, 24 aa, Mycobacterium
QFEQPGLAQHLWKLRADQSRRISR

SEQ ID NO: 1126931 - protein, 24 aa, Mycobacterium
QFFRHAIEVLVYIIFVSVMGLAVE

SEQ ID NO: 1126932 - protein, 28 aa, Mycobacterium
QFMALGWKILIPVSLGWIMIVAITHSLR

SEQ ID NO: 1126933 - protein, 30 aa, Mycobacterium
QFPRLRRKVDGWVNGWNRIGTQTQFYGETI

SEQ ID NO: 1126934 - protein, 17 aa, Mycobacterium
QFPWLKSQFARVADPWN

SEQ ID NO: 1126935 - protein, 36 aa, Mycobacterium
QFRPLRNYFYWEPHCYNIPMCWALRSVFDSLDGIST

SEQ ID NO: 1126936 - protein, 37 aa, Mycobacterium
QFVMPDLRGQFWADAEPRLRALGWTGVLDKGADVPNS

SEQ ID NO: 1126937 - protein, 21 aa, Mycobacterium
QFWERFPKFVLGFIAASIVGT

SEQ ID NO: 1126938 - protein, 20 aa, Mycobacterium
QGAVINWATLIALGIGDVVA

SEQ ID NO: 1126939 - protein, 22 aa, Mycobacterium
QGEPIPSFGSALVLMGAVGVVA

SEQ ID NO: 1126940 - protein, 19 aa, Mycobacterium
QGFCGTCRTRVLAGSVEHR

SEQ ID NO: 1126941 - protein, 25 aa, Mycobacterium
QGGLSTVWLLSGFFFLIPVVVARKK

SEQ ID NO: 1126942 - protein, 23 aa, Mycobacterium
QGLRMVAVLAVFADHLWGWPGGG

SEQ ID NO: 1126943 - protein, 36 aa, Mycobacterium
QGLRMVAVLAVFAHHLWGWPGGGFVGIDVFFVVSGF

SEQ ID NO: 1126944 - protein, 19 aa, Mycobacterium
QGNAWGWGSGRTLACALGG

SEQ ID NO: 1126945 - protein, 23 aa, Mycobacterium
QGPSLRPVAEWLHLIPRDTTREI

SEQ ID NO: 1126946 - protein, 46 aa, Mycobacterium
QGREFLEQSWFVARVSLMPTLLVAIPFTVLVSFTLNILLRELGAAD

SEQ ID NO: 1126947 - protein, 18 aa, Mycobacterium
QGRRLAWTAAVCALMGAF

SEQ ID NO: 1126948 - protein, 17 aa, Mycobacterium
QHPQPWFDWPTRPVWLY

SEQ ID NO: 1126949 - protein, 23 aa, Mycobacterium
QHSGARLFGVFAVSAVLNITHLV

SEQ ID NO: 1126950 - protein, 19 aa, Mycobacterium
QIKELQFAAVSGVFLLAAV

SEQ ID NO: 1126951 - protein, 21 aa, Mycobacterium
QIPEMVRLMLKGEKSPSGVSS

SEQ ID NO: 1126952 - protein, 18 aa, Mycobacterium
QIRRDVRGLADLGEVYAN

SEQ ID NO: 1126953 - protein, 22 aa, Mycobacterium
QIVMPPLMWNLAPADAQAVLTA

SEQ ID NO: 1126954 - protein, 21 aa, Mycobacterium
QIWPGLRLKRPVVHRRVGRLY

SEQ ID NO: 1126955 - protein, 24 aa, Mycobacterium
QKLRDIRKLLGFTIAGRTGTEEDS

SEQ ID NO: 1126956 - protein, 23 aa, Mycobacterium
QKLVFKVLVMILWLAPIGAFGAI

SEQ ID NO: 1126957 - protein, 19 aa, Mycobacterium
QKRAEPFLQVVKEAKSKSV

SEQ ID NO: 1126958 - protein, 21 aa, Mycobacterium
QKRALAVLTVIALAFAAYFLR

SEQ ID NO: 1126959 - protein, 21 aa, Mycobacterium
QKRYGWLLGLVIPTLVPMSWA

SEQ ID NO: 1126960 - protein, 19 aa, Mycobacterium
QKTRFPGLTVLTSGTIPPN

SEQ ID NO: 1126961 - protein, 18 aa, Mycobacterium
QKVLEGTGFVVAPNRVMS

SEQ ID NO: 1126962 - protein, 18 aa, Mycobacterium
QKVLPLAACATVIAALAW

SEQ ID NO: 1126963 - protein, 20 aa, Mycobacterium
QLAASFLDWDLYKQAIPDLF

SEQ ID NO: 1126964 - protein, 18 aa, Mycobacterium
QLALGSDENVAWARVDDT

SEQ ID NO: 1126965 - protein, 24 aa, Mycobacterium
QLASRIAQMPGITRVSGVTRPTGD

SEQ ID NO: 1126966 - protein, 25 aa, Mycobacterium
QLDMLNLQSVWPLTRGAGQTVAVID

SEQ ID NO: 1126967 - protein, 24 aa, Mycobacterium
QLFDRICRVGRSLRVHLLLATQSL

SEQ ID NO: 1126968 - protein, 21 aa, Mycobacterium
QLGITVCSILLGRVAEPAVAH

SEQ ID NO: 1126969 - protein, 17 aa, Mycobacterium
QLGLALRLGAVVVALIG

SEQ ID NO: 1126970 - protein, 20 aa, Mycobacterium
QLHPVLNLTSARLIAGRPDN

SEQ ID NO: 1126971 - protein, 17 aa, Mycobacterium
QLIRQLRSGLGSESVQK

SEQ ID NO: 1126972 - protein, 17 aa, Mycobacterium
QLKKGSAGWILLAGLGI

SEQ ID NO: 1126973 - protein, 17 aa, Mycobacterium
QLLLCGIVVPRAQLPDW

SEQ ID NO: 1126974 - protein, 19 aa, Mycobacterium
QLLQGRLPLHLNDPATEMT

SEQ ID NO: 1126975 - protein, 24 aa, Mycobacterium
QLLTGQRSAIVTSLNNIITAVNTI

SEQ ID NO: 1126976 - protein, 18 aa, Mycobacterium
QLLWARLVLARTTTPVLA

SEQ ID NO: 1126977 - protein, 17 aa, Mycobacterium
QLLWARLVLTRTTTPVL

SEQ ID NO: 1126978 - protein, 19 aa, Mycobacterium
QLMQHGWGKALLILVGLGV

SEQ ID NO: 1126979 - protein, 19 aa, Mycobacterium
QLPSLAIVVLAEVWKTTPF

SEQ ID NO: 1126980 - protein, 31 aa, Mycobacterium
QLRAHLVAALALCIYGGFFTAAATMRLYDGK

SEQ ID NO: 1126981 - protein, 33 aa, Mycobacterium
QLRNPSWRVGAWICSIIVVAAWGSILLMGVTDP

SEQ ID NO: 1126982 - protein, 26 aa, Mycobacterium
QLRREFSLGSAFAFAFAFISPIVALY

SEQ ID NO: 1126983 - protein, 22 aa, Mycobacterium
QLSEALPALAGALTVNTIAMIE

SEQ ID NO: 1126984 - protein, 18 aa, Mycobacterium
QLSGLGFTLPREAVQPAL

SEQ ID NO: 1126985 - protein, 19 aa, Mycobacterium
QLSTIARRQIRLVISDRGY

SEQ ID NO: 1126986 - protein, 18 aa, Mycobacterium
QLTGLRVVRAFAREPFER

SEQ ID NO: 1126987 - protein, 23 aa, Mycobacterium
QLTLTIGFGPSFFVKDGVDRFGI

SEQ ID NO: 1126988 - protein, 24 aa, Mycobacterium
QLTRPESWHPPWPASTEQTIATAK

SEQ ID NO: 1126989 - protein, 28 aa, Mycobacterium
QLVAMMFALRYRWWVVLSAITAATAVVH

SEQ ID NO: 1126990 - protein, 18 aa, Mycobacterium
QMAMQRMLVNSGAELPEP

SEQ ID NO: 1126991 - protein, 32 aa, Mycobacterium
QMLRRFEWSVADGYRIPLTWGTGPTPADDLPI

SEQ ID NO: 1126992 - protein, 27 aa, Mycobacterium
QMRPFVELRWWPLALLSALSLTLVAIA

SEQ ID NO: 1126993 - protein, 27 aa, Mycobacterium
QMRPWWLPVVYLTMLAVYVVPRLNRAA

SEQ ID NO: 1126994 - protein, 21 aa, Mycobacterium
QMRRGDMLFWGPNASQHVALY

SEQ ID NO: 1126995 - protein, 18 aa, Mycobacterium
QMVRRYGPVVALPVLGFG

SEQ ID NO: 1126996 - protein, 17 aa, Mycobacterium
QNGMCGLGDHPPCERGW

SEQ ID NO: 1126997 - protein, 18 aa, Mycobacterium
QNGSFGLGLAIVASIVES

SEQ ID NO: 1126998 - protein, 25 aa, Mycobacterium
QNLRMILLPQAFRSVIIPLGSVLIA

SEQ ID NO: 1126999 - protein, 24 aa, Mycobacterium
QNRREWRILAPTGLTLSVLFGLGA

SEQ ID NO: 1127000 - protein, 17 aa, Mycobacterium
QPAIGWLVGDVHNGIAQ

SEQ ID NO: 1127001 - protein, 24 aa, Mycobacterium
QPAPIEVLRDGRPVTLTVTPNGDD

SEQ ID NO: 1127002 - protein, 20 aa, Mycobacterium
QPAPSGPGWVAVRAPSDGAA

SEQ ID NO: 1127003 - protein, 30 aa, Mycobacterium
QPAQLLQPFLDYAFGFRNGVDIGQPPDNAG

SEQ ID NO: 1127004 - protein, 17 aa, Mycobacterium
QPELKRVMGPGLLLLFV

SEQ ID NO: 1127005 - protein, 32 aa, Mycobacterium
QPETMFQTGLRRFSYLLLRVALTLTVVIVVTN

SEQ ID NO: 1127006 - protein, 24 aa, Mycobacterium
QPGERRFTAPSGFDAGSTQVINRP

SEQ ID NO: 1127007 - protein, 25 aa, Mycobacterium
QPHAGEVFAVLTMRDGDFPGQAAVE

SEQ ID NO: 1127008 - protein, 18 aa, Mycobacterium
QPHEFDWTARYFRARGLL

SEQ ID NO: 1127009 - protein, 17 aa, Mycobacterium
QPLLAGLLTLSGATTPA

SEQ ID NO: 1127010 - protein, 17 aa, Mycobacterium
QPLRVAVWALFWLGWAI

SEQ ID NO: 1127011 - protein, 23 aa, Mycobacterium
QPPATSWWRPHVAVFAVMAACGV

SEQ ID NO: 1127012 - protein, 24 aa, Mycobacterium
QPPPRPDRPYVITLQLDFENTGAV

SEQ ID NO: 1127013 - protein, 21 aa, Mycobacterium
QPPSVRVRHGGVVGDPTLTPE

SEQ ID NO: 1127014 - protein, 19 aa, Mycobacterium
QPRPTQKRSRAGALTVGAL

SEQ ID NO: 1127015 - protein, 27 aa, Mycobacterium
QPSPPRRLRLLLTVAGVVLVLDIVTKV

SEQ ID NO: 1127016 - protein, 21 aa, Mycobacterium
QPVERARALGIWGGVTGISMA

SEQ ID NO: 1127017 - protein, 24 aa, Mycobacterium
QPVQRPSRRWVTVRVDAGESDDAE

SEQ ID NO: 1127018 - protein, 17 aa, Mycobacterium
QQDRPSFGSSITGAAPS

SEQ ID NO: 1127019 - protein, 19 aa, Mycobacterium
QQKKPVWLIAAAVLGVVVF

SEQ ID NO: 1127020 - protein, 21 aa, Mycobacterium
QQLAFGRLRAVEHDRYVVVAG

SEQ ID NO: 1127021 - protein, 23 aa, Mycobacterium
QQQRPGYPTPYGGYPGSGPGTGG

SEQ ID NO: 1127022 - protein, 29 aa, Mycobacterium
QQVQQLIEQGDWAGAQAKLEAVTTTVATV

SEQ ID NO: 1127023 - protein, 18 aa, Mycobacterium
QRAFGRPTGVNGSFLGAD

SEQ ID NO: 1127024 - protein, 22 aa, Mycobacterium
QRDFPPERALAALSAGGRYIRS

SEQ ID NO: 1127025 - protein, 27 aa, Mycobacterium
QRFPRLVDHLGRPVALLSRLGDHVLFY

SEQ ID NO: 1127026 - protein, 20 aa, Mycobacterium
QRGGLWAVVGQRWIPGINDA

SEQ ID NO: 1127027 - protein, 17 aa, Mycobacterium
QRIGGVVTIVMGLVFMG

SEQ ID NO: 1127028 - protein, 18 aa, Mycobacterium
QRLALVMGSVAAVTMGAL

SEQ ID NO: 1127029 - protein, 24 aa, Mycobacterium
QRLRPAIDAAEAWGVDVTVDTGSD

SEQ ID NO: 1127030 - protein, 19 aa, Mycobacterium
QRLWGASPLVASWQLVMSG

SEQ ID NO: 1127031 - protein, 19 aa, Mycobacterium
QRMLPRLGLTPGAPPEAVS

SEQ ID NO: 1127032 - protein, 23 aa, Mycobacterium
QRPESQWWIAILGLAVAYSPYLV

SEQ ID NO: 1127033 - protein, 17 aa, Mycobacterium
QRQFWYRSTKFVMHRAV

SEQ ID NO: 1127034 - protein, 24 aa, Mycobacterium
QRRVPPELLGRVSSLDFFVSLAFM

SEQ ID NO: 1127035 - protein, 23 aa, Mycobacterium
QRRWPRWLNVAGLAGCLILTATL

SEQ ID NO: 1127036 - protein, 17 aa, Mycobacterium
QRSGGALRQLWRKLRLR

SEQ ID NO: 1127037 - protein, 23 aa, Mycobacterium
QRSPLFAALFVWELARPPLWLLL

SEQ ID NO: 1127038 - protein, 19 aa, Mycobacterium
QRVFGRPRGVSGSFLGVDQ

SEQ ID NO: 1127039 - protein, 22 aa, Mycobacterium
QRYAWTGTLVFFGGLLFFEKSA

SEQ ID NO: 1127040 - protein, 23 aa, Mycobacterium
QSALLKRTLPFAAVGGVTGAVLL

SEQ ID NO: 1127041 - protein, 24 aa, Mycobacterium
QSALRLKGRLLFEPNVMVTSVPWQ

SEQ ID NO: 1127042 - protein, 27 aa, Mycobacterium
QSDSGFPFFLPGGFEFQVTLIVIAAAL

SEQ ID NO: 1127043 - protein, 31 aa, Mycobacterium
QSESPWKLLARFGYHFSSLVAIVVLLAAGMS

SEQ ID NO: 1127044 - protein, 22 aa, Mycobacterium
QSFTMWLIIGVIYFIVIMALTK

SEQ ID NO: 1127045 - protein, 25 aa, Mycobacterium
QSGERRMLCGLQLPGPNNQQLAFQG

SEQ ID NO: 1127046 - protein, 17 aa, Mycobacterium
QSLAIAWLTLIVAEQIN

SEQ ID NO: 1127047 - protein, 20 aa, Mycobacterium
QSQLSRLLADPVIPADKRVA

SEQ ID NO: 1127048 - protein, 19 aa, Mycobacterium
QSSNLLLRALRIEPVHDVE

SEQ ID NO: 1127049 - protein, 22 aa, Mycobacterium
QSSNMLLRLLRIEPVHDVEHSA

SEQ ID NO: 1127050 - protein, 18 aa, Mycobacterium
QSSRRVVGAVGMAVLAIA

SEQ ID NO: 1127051 - protein, 18 aa, Mycobacterium
QSTAPWYLSLAVLAALVL

SEQ ID NO: 1127052 - protein, 17 aa, Mycobacterium
QSVPVWAGLAALLLSSI

SEQ ID NO: 1127053 - protein, 19 aa, Mycobacterium
QTDELNWSPLPMFHLNVLA

SEQ ID NO: 1127054 - protein, 22 aa, Mycobacterium
QTDRTLLLWAIPLLIAPPMYSK

SEQ ID NO: 1127055 - protein, 22 aa, Mycobacterium
QTGGRMGFGFGKSRAKQLTKDM

SEQ ID NO: 1127056 - protein, 23 aa, Mycobacterium
QTGGRMGFGFGKSRAKQLTKDMP

SEQ ID NO: 1127057 - protein, 21 aa, Mycobacterium
QTGKLGVRDVLFGRKVSYVGL

SEQ ID NO: 1127058 - protein, 26 aa, Mycobacterium
QTLQWRPEDQITFLSSGAMRFDPPGG

SEQ ID NO: 1127059 - protein, 22 aa, Mycobacterium
QTPDALHAFGYVFTVHAIGAVL

SEQ ID NO: 1127060 - protein, 23 aa, Mycobacterium
QTPDPRGAGLIYDTVGGNGPLSF

SEQ ID NO: 1127061 - protein, 22 aa, Mycobacterium
QTRAVPPRRRWTATLETSVALR

SEQ ID NO: 1127062 - protein, 19 aa, Mycobacterium
QTRGLRPEELRVMYDHHDA

SEQ ID NO: 1127063 - protein, 20 aa, Mycobacterium
QTVAQRWLLGVAIAVVVVLF

SEQ ID NO: 1127064 - protein, 17 aa, Mycobacterium
QTWAGFGAAALVLFVVA

SEQ ID NO: 1127065 - protein, 17 aa, Mycobacterium
QTWAGFGVAALLLFAVA

SEQ ID NO: 1127066 - protein, 27 aa, Mycobacterium
QTWFVARVALFPTIMLAIPFTVLTVFT

SEQ ID NO: 1127067 - protein, 24 aa, Mycobacterium
QVDGRAVLLGRLRLLADRSHEIPS

SEQ ID NO: 1127068 - protein, 23 aa, Mycobacterium
QVDWRRCAPRSIGAGLLVGVLTG

SEQ ID NO: 1127069 - protein, 24 aa, Mycobacterium
QVEQEFRFAVGLAVSTAAPTASAT

SEQ ID NO: 1127070 - protein, 26 aa, Mycobacterium
QVIPSWIGTFIYRIDINLRMSVVLGF

SEQ ID NO: 1127071 - protein, 24 aa, Mycobacterium
QVMVWTFTLVWLISEHRWSPESAG

SEQ ID NO: 1127072 - protein, 39 aa, Mycobacterium
QVRREGRIPWPDALRIGVKLCGALETAHRTGTLHRDIKP

SEQ ID NO: 1127073 - protein, 29 aa, Mycobacterium
QVSGWRFLLRRVEHAIVRRDTRMFDDPLQ

SEQ ID NO: 1127074 - protein, 25 aa, Mycobacterium
QVVDRVGGCGAAWSAAVNRGAPDGP

SEQ ID NO: 1127075 - protein, 26 aa, Mycobacterium
QVVHPTFLYELLWNLLVFAVLILVDR

SEQ ID NO: 1127076 - protein, 25 aa, Mycobacterium
QVVPSWIGTFVYRIDINLRMSVVLG

SEQ ID NO: 1127077 - protein, 24 aa, Mycobacterium
QVYRKGEWRKLPSRRQRMLARYTL

SEQ ID NO: 1127078 - protein, 23 aa, Mycobacterium
QVYVVMGAGWVWHRRHQGEPIPA

SEQ ID NO: 1127079 - protein, 23 aa, Mycobacterium
QWARVVLALGWGFLIWGLAMYLW

SEQ ID NO: 1127080 - protein, 24 aa, Mycobacterium
QWPGDLGERPALWIPASSVSGARL

SEQ ID NO: 1127081 - protein, 25 aa, Mycobacterium
QWPLRLLGLLIGWGFFTAALTKVMT

SEQ ID NO: 1127082 - protein, 22 aa, Mycobacterium
QWRCARVTVGMAPRASIRIGRA

SEQ ID NO: 1127083 - protein, 18 aa, Mycobacterium
QYDAFRAYVLFSEQSTKA

SEQ ID NO: 1127084 - protein, 28 aa, Mycobacterium
QYGIPRVRCMCGNPLRPPDAIEGDVRYR

SEQ ID NO: 1127085 - protein, 19 aa, Mycobacterium
QYPGAPGAPGYPAPGSEEG

SEQ ID NO: 1127086 - protein, 18 aa, Mycobacterium
RAAAALLAVLALVLTGGA

SEQ ID NO: 1127087 - protein, 24 aa, Mycobacterium
RAAAPPRSLLRQAVRFGTVGIAST

SEQ ID NO: 1127088 - protein, 18 aa, Mycobacterium
RAADLGARRKLVLLETRN

SEQ ID NO: 1127089 - protein, 17 aa, Mycobacterium
RAAGMTMTIRTDGGETA

SEQ ID NO: 1127090 - protein, 17 aa, Mycobacterium
RAAKPAAERTRSSRDAA

SEQ ID NO: 1127091 - protein, 23 aa, Mycobacterium
RAALRSAGELSLLLAGAQLGITV

SEQ ID NO: 1127092 - protein, 24 aa, Mycobacterium
RAAPRLPGPLIAVLGAAAVVAVWS

SEQ ID NO: 1127093 - protein, 19 aa, Mycobacterium
RAARPRFVIWPENSSDIDP

SEQ ID NO: 1127094 - protein, 30 aa, Mycobacterium
RAASGRMRNVWVCFAIAFGGWTAGEVLFGY

SEQ ID NO: 1127095 - protein, 25 aa, Mycobacterium
RAATVGLLMRHCVNAGVAAIALAEP

SEQ ID NO: 1127096 - protein, 18 aa, Mycobacterium
RAAVVATIVAVAVGLAVL

SEQ ID NO: 1127097 - protein, 20 aa, Mycobacterium
RADETLSLIRRGDENLRKQS

SEQ ID NO: 1127098 - protein, 19 aa, Mycobacterium
RADHPLLFEIRSLIEAAED

SEQ ID NO: 1127099 - protein, 21 aa, Mycobacterium
RADHTLTRMRIVPGSAPTTTV

SEQ ID NO: 1127100 - protein, 19 aa, Mycobacterium
RADLVDWPALGPIVRIMKV

SEQ ID NO: 1127101 - protein, 26 aa, Mycobacterium
RADWDRRLRPMLARQFELATGQRKAR

SEQ ID NO: 1127102 - protein, 21 aa, Mycobacterium
RAERTVAYWFLLAGFSGLALL

SEQ ID NO: 1127103 - protein, 23 aa, Mycobacterium
RAEVAGALRAWIAQAVTWHDPSV

SEQ ID NO: 1127104 - protein, 23 aa, Mycobacterium
RAEVEKGFWGRLVNVVMKRPIAF

SEQ ID NO: 1127105 - protein, 19 aa, Mycobacterium
RAEVLRRQKRGLLPGQQPT

SEQ ID NO: 1127106 - protein, 21 aa, Mycobacterium
RAFDGDFNTAWICTRAQNQDG

SEQ ID NO: 1127107 - protein, 20 aa, Mycobacterium
RAFNAYKMAVICLIGAMLFD

SEQ ID NO: 1127108 - protein, 18 aa, Mycobacterium
RAGARWAAASIVTGIAAA

SEQ ID NO: 1127109 - protein, 17 aa, Mycobacterium
RAGASWLFLVAATVLSW

SEQ ID NO: 1127110 - protein, 31 aa, Mycobacterium
RAGCAQSPTGTRCAAAMALAAEEPVNLSRTL

SEQ ID NO: 1127111 - protein, 19 aa, Mycobacterium
RAGGAAYCVADESVDAFRR

SEQ ID NO: 1127112 - protein, 17 aa, Mycobacterium
RAGGVAMTYVQINTQSE

SEQ ID NO: 1127113 - protein, 17 aa, Mycobacterium
RAGLLVVRTRTVDFLTT

SEQ ID NO: 1127114 - protein, 20 aa, Mycobacterium
RAGQPDGWAFNGMAAQYDHA

SEQ ID NO: 1127115 - protein, 23 aa, Mycobacterium
RAGRVRWGVALPFGGAAMTGALG

SEQ ID NO: 1127116 - protein, 18 aa, Mycobacterium
RAGTPVVVALEVVALVAF

SEQ ID NO: 1127117 - protein, 20 aa, Mycobacterium
RAGVVALGVIGIVAVLVTVL

SEQ ID NO: 1127118 - protein, 20 aa, Mycobacterium
RAIDAGTVNAVWDGRAGVLL

SEQ ID NO: 1127119 - protein, 20 aa, Mycobacterium
RAIDIIDGFVGRGSCDFMAD

SEQ ID NO: 1127120 - protein, 23 aa, Mycobacterium
RAIDVIRIVALVGVVVGHTVMAT

SEQ ID NO: 1127121 - protein, 19 aa, Mycobacterium
RAKSVGLAIANFAIAFSAL

SEQ ID NO: 1127122 - protein, 21 aa, Mycobacterium
RAKTFLLLVLFSGLIVGVGAL

SEQ ID NO: 1127123 - protein, 20 aa, Mycobacterium
RAKVLVKRLVCIEDLGDIDI

SEQ ID NO: 1127124 - protein, 20 aa, Mycobacterium
RALDGGARGERKNFGPPKQP

SEQ ID NO: 1127125 - protein, 24 aa, Mycobacterium
RALEYLKITFGWSLMSVVVFSVLL

SEQ ID NO: 1127126 - protein, 26 aa, Mycobacterium
RALFDRLQPTLPIVLANLVSIEPVLV

SEQ ID NO: 1127127 - protein, 19 aa, Mycobacterium
RALFGIAVRRADGRPVGVL

SEQ ID NO: 1127128 - protein, 18 aa, Mycobacterium
RALFVFTVGIVLIVLASA

SEQ ID NO: 1127129 - protein, 19 aa, Mycobacterium
RALGIVCVILAVISAMELL

SEQ ID NO: 1127130 - protein, 20 aa, Mycobacterium
RALLELAPPLAVVLRDGEPV

SEQ ID NO: 1127131 - protein, 23 aa, Mycobacterium
RALNPAKQWGFFILLILLIAPPL

SEQ ID NO: 1127132 - protein, 25 aa, Mycobacterium
RALPFAVSLSRRCSRVIKQNLWASL

SEQ ID NO: 1127133 - protein, 17 aa, Mycobacterium
RALPLGLAVVVLLLVLG

SEQ ID NO: 1127134 - protein, 17 aa, Mycobacterium
RALRAMLGYSRGTLADM

SEQ ID NO: 1127135 - protein, 17 aa, Mycobacterium
RALSRFYRQIGQFERLL

SEQ ID NO: 1127136 - protein, 18 aa, Mycobacterium
RALVETKLNIARTATDAI

SEQ ID NO: 1127137 - protein, 20 aa, Mycobacterium
RAMMLPLLLFGLLIFGLFQK

SEQ ID NO: 1127138 - protein, 20 aa, Mycobacterium
RAMMLPLLLFGLLIFGLFRE

SEQ ID NO: 1127139 - protein, 21 aa, Mycobacterium
RAMPIPALTPLASRMTASMYR

SEQ ID NO: 1127140 - protein, 19 aa, Mycobacterium
RAMSLASLVGSLGVVLLAT

SEQ ID NO: 1127141 - protein, 17 aa, Mycobacterium
RANELRALLAERIAALK

SEQ ID NO: 1127142 - protein, 17 aa, Mycobacterium
RAPLKVAGEYSPVIGCV

SEQ ID NO: 1127143 - protein, 21 aa, Mycobacterium
RAPMSVRLIAPEAGRTDDVDP

SEQ ID NO: 1127144 - protein, 20 aa, Mycobacterium
RAPMSVRLVAPEAGRTDEVD

SEQ ID NO: 1127145 - protein, 22 aa, Mycobacterium
RAQRLCRPVFWYLAAWAAVLLV

SEQ ID NO: 1127146 - protein, 23 aa, Mycobacterium
RAQRLYRPVFWYLAAWSVGLLAA

SEQ ID NO: 1127147 - protein, 20 aa, Mycobacterium
RAQRMARSRLGVENTSDRDF

SEQ ID NO: 1127148 - protein, 18 aa, Mycobacterium
RARCEVLPDVASTVELFR

SEQ ID NO: 1127149 - protein, 24 aa, Mycobacterium
RARPRVEFLYRIAVGVIGLLVLVL

SEQ ID NO: 1127150 - protein, 19 aa, Mycobacterium
RARRRGFQVIPDLGAPFAV

SEQ ID NO: 1127151 - protein, 18 aa, Mycobacterium
RARTGSRRRSRWQTAAGV

SEQ ID NO: 1127152 - protein, 25 aa, Mycobacterium
RARTRYRWLFAFGFLLIGFGLEYAV

SEQ ID NO: 1127153 - protein, 29 aa, Mycobacterium
RASTAGLILAFLALFWVNQNYQPELPAPT

SEQ ID NO: 1127154 - protein, 17 aa, Mycobacterium
RATAIVVVPVMLSRMLD

SEQ ID NO: 1127155 - protein, 20 aa, Mycobacterium
RATAMLGGWLAVAAGAWFVV

SEQ ID NO: 1127156 - protein, 25 aa, Mycobacterium
RATLPRMRYDQFMALGWKILIPVSL

SEQ ID NO: 1127157 - protein, 17 aa, Mycobacterium
RATTVPWGLEIYERVDA

SEQ ID NO: 1127158 - protein, 19 aa, Mycobacterium
RAVCKAAGLTERYFYESFT

SEQ ID NO: 1127159 - protein, 20 aa, Mycobacterium
RAVEALMRMSAATATVIRDG

SEQ ID NO: 1127160 - protein, 17 aa, Mycobacterium
RAVFGRRGAYVPAAVQA

SEQ ID NO: 1127161 - protein, 19 aa, Mycobacterium
RAVIKVTTILGSRYLSLEP

SEQ ID NO: 1127162 - protein, 17 aa, Mycobacterium
RAVNAWQRAQLTRWRAG

SEQ ID NO: 1127163 - protein, 20 aa, Mycobacterium
RAVPELILAVVFVAALGLGP

SEQ ID NO: 1127164 - protein, 20 aa, Mycobacterium
RAVRPHVWLVIMVAMTAIVA

SEQ ID NO: 1127165 - protein, 21 aa, Mycobacterium
RAVSERRIAVWSAVPEEQALL

SEQ ID NO: 1127166 - protein, 17 aa, Mycobacterium
RAVVLLTLLALVGIAVA

SEQ ID NO: 1127167 - protein, 20 aa, Mycobacterium
RAVVPICVAAVLGVAAVVAI

SEQ ID NO: 1127168 - protein, 25 aa, Mycobacterium
RAWPLLGSRAPRIALAVMFGVLALG

SEQ ID NO: 1127169 - protein, 18 aa, Mycobacterium
RAWYESRFLPVIGPWALY

SEQ ID NO: 1127170 - protein, 17 aa, Mycobacterium
RCAELCGTYHAMMNFEV

SEQ ID NO: 1127171 - protein, 19 aa, Mycobacterium
RCATTVMRRALPLGLAVVV

SEQ ID NO: 1127172 - protein, 25 aa, Mycobacterium
RCRASRIVLHPGFTIPVFLLSYYGL

SEQ ID NO: 1127173 - protein, 22 aa, Mycobacterium
RCTRLYRPVFYYLAFWAVALVV

SEQ ID NO: 1127174 - protein, 18 aa, Mycobacterium
RCTRRARLADSRRRPPVR

SEQ ID NO: 1127175 - protein, 21 aa, Mycobacterium
RDADSWATAASGSWVVALDNL

SEQ ID NO: 1127176 - protein, 19 aa, Mycobacterium
RDAFLPFQAGRPFAAAIVG

SEQ ID NO: 1127177 - protein, 18 aa, Mycobacterium
RDDFAYLVDFGIANAVTD

SEQ ID NO: 1127178 - protein, 19 aa, Mycobacterium
RDDIMLCVGAPAGDEATSR

SEQ ID NO: 1127179 - protein, 18 aa, Mycobacterium
RDEARSAAMLSHPNIVAV

SEQ ID NO: 1127180 - protein, 19 aa, Mycobacterium
RDGAELSFPMLQFTLLGAL

SEQ ID NO: 1127181 - protein, 22 aa, Mycobacterium
RDGDGVFYFIGRTGTMIKTAGA

SEQ ID NO: 1127182 - protein, 25 aa, Mycobacterium
RDKARAAITQGLFPAVAVVLLVAGL

SEQ ID NO: 1127183 - protein, 24 aa, Mycobacterium
RDKELRAKLTPDYDFGCKRPTFSN

SEQ ID NO: 1127184 - protein, 17 aa, Mycobacterium
RDKRALADITFDFQQRV

SEQ ID NO: 1127185 - protein, 17 aa, Mycobacterium
RDLLRRRTIAATIGATG

SEQ ID NO: 1127186 - protein, 39 aa, Mycobacterium
RDMFWSMAPLVVACVVLAGLLGMCSFAPTGPGPGPAPDY

SEQ ID NO: 1127187 - protein, 24 aa, Mycobacterium
RDMRNRFLVALALSIPIMLWSPMG

SEQ ID NO: 1127188 - protein, 20 aa, Mycobacterium
RDMSPWANFSLGFTYLSPVV

SEQ ID NO: 1127189 - protein, 21 aa, Mycobacterium
RDMSTTVFLATWVPLFASFGV

SEQ ID NO: 1127190 - protein, 25 aa, Mycobacterium
RDPQCRGRINGWTAVCAGLLAVYLA

SEQ ID NO: 1127191 - protein, 27 aa, Mycobacterium
RDPRSAWVLRLGCLTPFVNLFWAPVYV

SEQ ID NO: 1127192 - protein, 35 aa, Mycobacterium
RDPTPVARWIRRLAIPIILGWVLLVAALNLLVPQL

SEQ ID NO: 1127193 - protein, 24 aa, Mycobacterium
RDQTRRLVRFSGDVAALARAEESA

SEQ ID NO: 1127194 - protein, 18 aa, Mycobacterium
RDRPRFELWDSPPQVVVG

SEQ ID NO: 1127195 - protein, 19 aa, Mycobacterium
RDRVTHILAALTERGHRVG

SEQ ID NO: 1127196 - protein, 18 aa, Mycobacterium
RDVIALGVLVSALGKAAQ

SEQ ID NO: 1127197 - protein, 18 aa, Mycobacterium
RDVLEAQAAPALAEAARN

SEQ ID NO: 1127198 - protein, 23 aa, Mycobacterium
RDVLFGRKVSYVGLAILLLTALM

SEQ ID NO: 1127199 - protein, 19 aa, Mycobacterium
RDWHPRGATVVILEIIMTL

SEQ ID NO: 1127200 - protein, 21 aa, Mycobacterium
RDYQFAAGRLAEFSRGGPAVP

SEQ ID NO: 1127201 - protein, 17 aa, Mycobacterium
REAAVTFWASAFLGAVV

SEQ ID NO: 1127202 - protein, 17 aa, Mycobacterium
REAELLALFAGAVLRGA

SEQ ID NO: 1127203 - protein, 18 aa, Mycobacterium
REALGVGIAAKIDEKGAE

SEQ ID NO: 1127204 - protein, 18 aa, Mycobacterium
REALLHSIREGVIAVNND

SEQ ID NO: 1127205 - protein, 24 aa, Mycobacterium
REECGRRGIVFAMARVKQDLRDAL

SEQ ID NO: 1127206 - protein, 21 aa, Mycobacterium
REFIPVLGWSMFALVVAAQGL

SEQ ID NO: 1127207 - protein, 19 aa, Mycobacterium
REFWLEMTHFTGVGALIMF

SEQ ID NO: 1127208 - protein, 30 aa, Mycobacterium
REGQLRTVPSRELVCGDILVLNEGDAVGAD

SEQ ID NO: 1127209 - protein, 20 aa, Mycobacterium
REGVAPRIVIDVAQSGDDDA

SEQ ID NO: 1127210 - protein, 26 aa, Mycobacterium
REHISEALKRLPAYATALGEVVGSGP

SEQ ID NO: 1127211 - protein, 20 aa, Mycobacterium
REIAVVAPLIALLLVLGVYP

SEQ ID NO: 1127212 - protein, 21 aa, Mycobacterium
REITRPVLDYVKRVGKDSPRT

SEQ ID NO: 1127213 - protein, 23 aa, Mycobacterium
RELYLKKMDVVISRVADIVGADL

SEQ ID NO: 1127214 - protein, 20 aa, Mycobacterium
REPERLWQIKELQFAALSGV

SEQ ID NO: 1127215 - protein, 21 aa, Mycobacterium
REPERLWQIKELQFAAVSGVF

SEQ ID NO: 1127216 - protein, 25 aa, Mycobacterium
RERDRLRDLFGRHVGEEVARRAFEQ

SEQ ID NO: 1127217 - protein, 26 aa, Mycobacterium
REREAGLLSRFWVVPVHRAAGLLARL

SEQ ID NO: 1127218 - protein, 26 aa, Mycobacterium
RERMVAIKLLRPEMAADHSFQERFRR

SEQ ID NO: 1127219 - protein, 21 aa, Mycobacterium
RERSFWFGYVHIVVFASIVGT

SEQ ID NO: 1127220 - protein, 27 aa, Mycobacterium
RESPFENSITLPFIRLPSAGEIPMGSW

SEQ ID NO: 1127221 - protein, 17 aa, Mycobacterium
RETIELNGPDIYRKTTV

SEQ ID NO: 1127222 - protein, 25 aa, Mycobacterium
REVIPRLGSAVKHSRAAAWTAAGLF

SEQ ID NO: 1127223 - protein, 21 aa, Mycobacterium
REVLPRLGPAVSGSRAALWAA

SEQ ID NO: 1127224 - protein, 20 aa, Mycobacterium
REVMVPRTEMVWIEYDKTAG

SEQ ID NO: 1127225 - protein, 23 aa, Mycobacterium
REVREISALVIVQFVETMTGIKA

SEQ ID NO: 1127226 - protein, 25 aa, Mycobacterium
REVYEIDYADGLRIARTLRTEVAPG

SEQ ID NO: 1127227 - protein, 18 aa, Mycobacterium
RFAGKMVDEAHRLADMIG

SEQ ID NO: 1127228 - protein, 18 aa, Mycobacterium
RFAIEARAAAALNHPHVV

SEQ ID NO: 1127229 - protein, 24 aa, Mycobacterium
RFCDEARSAAALSHPNIVAVHDFG

SEQ ID NO: 1127230 - protein, 20 aa, Mycobacterium
RFDLPGVVLSGVALFLIVFA

SEQ ID NO: 1127231 - protein, 23 aa, Mycobacterium
RFDRAEAYWTRLGWSARGPIKTE

SEQ ID NO: 1127232 - protein, 18 aa, Mycobacterium
RFGAWFVVFQVSFALLLV

SEQ ID NO: 1127233 - protein, 26 aa, Mycobacterium
RFGDGRPRWVTAWDVLCTLLGPGAFR

SEQ ID NO: 1127234 - protein, 22 aa, Mycobacterium
RFHHLKWAGVGDVNFGLFTLVW

SEQ ID NO: 1127235 - protein, 18 aa, Mycobacterium
RFIAHPWTALTLLVVGVY

SEQ ID NO: 1127236 - protein, 19 aa, Mycobacterium
RFIAHPWTALTLLVVGVYG

SEQ ID NO: 1127237 - protein, 22 aa, Mycobacterium
RFIDRYGARRVLVVAAMAGVVG

SEQ ID NO: 1127238 - protein, 19 aa, Mycobacterium
RFIYLKLGLALVLVWVGVK

SEQ ID NO: 1127239 - protein, 22 aa, Mycobacterium
RFLKDLNPVCSQWLNTAKQFGD

SEQ ID NO: 1127240 - protein, 22 aa, Mycobacterium
RFLSGGACIQGFLLAALTTLAI

SEQ ID NO: 1127241 - protein, 22 aa, Mycobacterium
RFLTPLRVMMIIALVFLALGYS

SEQ ID NO: 1127242 - protein, 20 aa, Mycobacterium
RFPSEWTYAQGLLFIVVVGF

SEQ ID NO: 1127243 - protein, 21 aa, Mycobacterium
RFQWQEFIRQGAFMAGTAVLP

SEQ ID NO: 1127244 - protein, 38 aa, Mycobacterium
RFRGGEGAPFTWRMVLVMVGALLVWLLVVLTLMRISGW

SEQ ID NO: 1127245 - protein, 23 aa, Mycobacterium
RFRVPRAALAVAVGATVTTLAAF

SEQ ID NO: 1127246 - protein, 30 aa, Mycobacterium
RFTDLVTLPAGWAWLENGWVMAIVAVLLVV

SEQ ID NO: 1127247 - protein, 21 aa, Mycobacterium
RFTDVLLLVSYWIPAFVAVVV

SEQ ID NO: 1127248 - protein, 18 aa, Mycobacterium
RFVARRLLFSAVVMIGVL

SEQ ID NO: 1127249 - protein, 18 aa, Mycobacterium
RFVFGAFGRKGLPHPSTR

SEQ ID NO: 1127250 - protein, 25 aa, Mycobacterium
RFVFPMTAVFLVWYAVYVLLGAFAT

SEQ ID NO: 1127251 - protein, 18 aa, Mycobacterium
RFVGDALSGRSDVAAARC

SEQ ID NO: 1127252 - protein, 18 aa, Mycobacterium
RFVLSRITLPGSIYLGII

SEQ ID NO: 1127253 - protein, 17 aa, Mycobacterium
RFWGWDPKETVSFIAWV

SEQ ID NO: 1127254 - protein, 22 aa, Mycobacterium
RFYVLCGYPLVAVAAYALTAAP

SEQ ID NO: 1127255 - protein, 23 aa, Mycobacterium
RGAAYRTLLERFGEEPGGATSVI

SEQ ID NO: 1127256 - protein, 24 aa, Mycobacterium
RGAVDRCRLAALPAGRSFAHSEGG

SEQ ID NO: 1127257 - protein, 28 aa, Mycobacterium
RGAVGLGVESARSSAVWAGNKYRRSKMA

SEQ ID NO: 1127258 - protein, 23 aa, Mycobacterium
RGDARFRLATLALGFAAVVVVGM

SEQ ID NO: 1127259 - protein, 27 aa, Mycobacterium
RGDYYFSITLPPDFSERVASPSGDDPQ

SEQ ID NO: 1127260 - protein, 17 aa, Mycobacterium
RGEPVKPLRLFLQSNNY

SEQ ID NO: 1127261 - protein, 19 aa, Mycobacterium
RGEQMFWYRSTKFVMRRAL

SEQ ID NO: 1127262 - protein, 21 aa, Mycobacterium
RGETMSAFYLLAYSAMAVPTL

SEQ ID NO: 1127263 - protein, 21 aa, Mycobacterium
RGEYEGRLWISMDHVEGTDAA

SEQ ID NO: 1127264 - protein, 24 aa, Mycobacterium
RGFDDEYIRLGMTILSMSFVPLLV

SEQ ID NO: 1127265 - protein, 19 aa, Mycobacterium
RGFGAYPTRTWARPSRFGA

SEQ ID NO: 1127266 - protein, 20 aa, Mycobacterium
RGFGAYPTRTWARPSRFGAG

SEQ ID NO: 1127267 - protein, 23 aa, Mycobacterium
RGFGDQRLAALLHEETFAVYAAR

SEQ ID NO: 1127268 - protein, 18 aa, Mycobacterium
RGGEEVLHGISFTARPGQ

SEQ ID NO: 1127269 - protein, 20 aa, Mycobacterium
RGGGGVVYRCHQQSLGRTVA

SEQ ID NO: 1127270 - protein, 19 aa, Mycobacterium
RGIEWWRMLQASAQILQAA

SEQ ID NO: 1127271 - protein, 19 aa, Mycobacterium
RGIQWLSNINMVLAVMLAL

SEQ ID NO: 1127272 - protein, 26 aa, Mycobacterium
RGLARTRPWLAAALVVALLGLVGTPP

SEQ ID NO: 1127273 - protein, 17 aa, Mycobacterium
RGLGRYVVISALGGLRC

SEQ ID NO: 1127274 - protein, 21 aa, Mycobacterium
RGLLPVLRWLIAGIGATMGVL

SEQ ID NO: 1127275 - protein, 19 aa, Mycobacterium
RGLNEVAFPHFLESDQHPE

SEQ ID NO: 1127276 - protein, 17 aa, Mycobacterium
RGLVHALAVPAALSAIV

SEQ ID NO: 1127277 - protein, 21 aa, Mycobacterium
RGPAYAVLGVALWVALYLAGI

SEQ ID NO: 1127278 - protein, 18 aa, Mycobacterium
RGPLFQGLVSGGAGAAGY

SEQ ID NO: 1127279 - protein, 25 aa, Mycobacterium
RGPMPPHAVAAVLRPVLSGLAAAHS

SEQ ID NO: 1127280 - protein, 20 aa, Mycobacterium
RGQGRWIWPGLAAVGVLSLT

SEQ ID NO: 1127281 - protein, 20 aa, Mycobacterium
RGRARIPVVAILVTTVIGAG

SEQ ID NO: 1127282 - protein, 20 aa, Mycobacterium
RGRIALLLTAAAWALLYLIH

SEQ ID NO: 1127283 - protein, 21 aa, Mycobacterium
RGRIMALWLVGFLGSRPIAAA

SEQ ID NO: 1127284 - protein, 24 aa, Mycobacterium
RGRIPNQRWYGWAGVLTIPTPFLA

SEQ ID NO: 1127285 - protein, 20 aa, Mycobacterium
RGRLVTMLLVGVVLLAAGYS

SEQ ID NO: 1127286 - protein, 17 aa, Mycobacterium
RGRRMLFVLRDWLPFAL

SEQ ID NO: 1127287 - protein, 27 aa, Mycobacterium
RGRRRLGRLTLWLMIGIVGALTVSFAA

SEQ ID NO: 1127288 - protein, 21 aa, Mycobacterium
RGSASPARTYGWHRAEVFTAV

SEQ ID NO: 1127289 - protein, 18 aa, Mycobacterium
RGSDGVVIPGSYRNRHDA

SEQ ID NO: 1127290 - protein, 24 aa, Mycobacterium
RGTDAGVLLSVWGVLVCTTLAAVA

SEQ ID NO: 1127291 - protein, 19 aa, Mycobacterium
RGTLRKMRQNLAWAVGYNV

SEQ ID NO: 1127292 - protein, 20 aa, Mycobacterium
RGTLRKMRQNLGWAVGYNVI

SEQ ID NO: 1127293 - protein, 21 aa, Mycobacterium
RGTPLILQLVFVFTALPHIGI

SEQ ID NO: 1127294 - protein, 19 aa, Mycobacterium
RGVEVTVHFDGDLPPYDPA

SEQ ID NO: 1127295 - protein, 24 aa, Mycobacterium
RGVFAWNGAIAWWINMVVFLLYTA

SEQ ID NO: 1127296 - protein, 33 aa, Mycobacterium
RGWTQRFVAGVAFGVAILTIWQVFRPLSQGSQY

SEQ ID NO: 1127297 - protein, 27 aa, Mycobacterium
RHALPWRGAVFTGKWVFYGVLGACTAA

SEQ ID NO: 1127298 - protein, 19 aa, Mycobacterium
RHIEPLGLALLVGAMTIGA

SEQ ID NO: 1127299 - protein, 22 aa, Mycobacterium
RHLDMAESLLVSSLVTLVGAVV

SEQ ID NO: 1127300 - protein, 19 aa, Mycobacterium
RHLGALAGRHVVLPVPAGR

SEQ ID NO: 1127301 - protein, 17 aa, Mycobacterium
RHLGALLALQSEGPYTL

SEQ ID NO: 1127302 - protein, 26 aa, Mycobacterium
RHLGSRPRPWLSVALGVEVVALMVLA

SEQ ID NO: 1127303 - protein, 19 aa, Mycobacterium
RHMGVVPEDTWLSRYAYTL

SEQ ID NO: 1127304 - protein, 20 aa, Mycobacterium
RHQRKMLWVIAGVFIAVFIA

SEQ ID NO: 1127305 - protein, 17 aa, Mycobacterium
RHRVVWPGLAAVGVVLL

SEQ ID NO: 1127306 - protein, 20 aa, Mycobacterium
RHSWVPAAAGWTVGVIATLS

SEQ ID NO: 1127307 - protein, 23 aa, Mycobacterium
RHTPRLVDIFGEQALFYGQSLAS

SEQ ID NO: 1127308 - protein, 19 aa, Mycobacterium
RHVIDCVFVMVVLVLVQVT

SEQ ID NO: 1127309 - protein, 22 aa, Mycobacterium
RHVPPVTMSVRLAAAATVAAIA

SEQ ID NO: 1127310 - protein, 19 aa, Mycobacterium
RHWVVVLVLTVVGWTFAAL

SEQ ID NO: 1127311 - protein, 24 aa, Mycobacterium
RIACAAGLLLIWAVAGAEMRASPR

SEQ ID NO: 1127312 - protein, 21 aa, Mycobacterium
RIAEPQWGPPVGRVLSTLLVE

SEQ ID NO: 1127313 - protein, 17 aa, Mycobacterium
RIAGALGAVAARALLGA

SEQ ID NO: 1127314 - protein, 19 aa, Mycobacterium
RIALAVMFGVLALGSALGL

SEQ ID NO: 1127315 - protein, 18 aa, Mycobacterium
RIALGILIVQDIVVVVVM

SEQ ID NO: 1127316 - protein, 21 aa, Mycobacterium
RIALPLLAYFAIMWGGGYLLG

SEQ ID NO: 1127317 - protein, 17 aa, Mycobacterium
RIAMLLFALSQFVIAGV

SEQ ID NO: 1127318 - protein, 20 aa, Mycobacterium
RIAMNYPPLLFHPINSITAY

SEQ ID NO: 1127319 - protein, 29 aa, Mycobacterium
RIASADVAHAFWVPEFLFKRDVYPNPEQN

SEQ ID NO: 1127320 - protein, 27 aa, Mycobacterium
RIAVLPADSGVGLWTFDGVQGRSAVSV

SEQ ID NO: 1127321 - protein, 33 aa, Mycobacterium
RIDKRYIAADGHIVWCALTVVLVHAPRDQPRCF

SEQ ID NO: 1127322 - protein, 24 aa, Mycobacterium
RIFVGNFFPFQGYTGGGGKQIIDG

SEQ ID NO: 1127323 - protein, 26 aa, Mycobacterium
RIGHRKLLLCGATAFAVISAVTAYST

SEQ ID NO: 1127324 - protein, 18 aa, Mycobacterium
RIGPKHTLLLGLVVIIAG

SEQ ID NO: 1127325 - protein, 17 aa, Mycobacterium
RIGPKRTLLLGLVVIIA

SEQ ID NO: 1127326 - protein, 19 aa, Mycobacterium
RIGPRRVLRTGLLLMAAGQ

SEQ ID NO: 1127327 - protein, 20 aa, Mycobacterium
RIGRCLSRLRARSHEHARAA

SEQ ID NO: 1127328 - protein, 20 aa, Mycobacterium
RIHNAWWTAILLVMVAVFLV

SEQ ID NO: 1127329 - protein, 20 aa, Mycobacterium
RIHWWVWRVGALNTVAVAFP

SEQ ID NO: 1127330 - protein, 18 aa, Mycobacterium
RIIAVGGQTVQCRVDTGL

SEQ ID NO: 1127331 - protein, 18 aa, Mycobacterium
RIIFGFPGIVLASIFVTV

SEQ ID NO: 1127332 - protein, 36 aa, Mycobacterium
RIKDEIREGRSFRSAVPRGWARARKTIVSGNAVTLL

SEQ ID NO: 1127333 - protein, 21 aa, Mycobacterium
RILPITFTALGLVALVGGALL

SEQ ID NO: 1127334 - protein, 22 aa, Mycobacterium
RILPITFTAVGLVLLVGGALLG

SEQ ID NO: 1127335 - protein, 17 aa, Mycobacterium
RIMPDRFGAEANSPVMD

SEQ ID NO: 1127336 - protein, 17 aa, Mycobacterium
RIMRQGRAYHMFLQLVG

SEQ ID NO: 1127337 - protein, 18 aa, Mycobacterium
RIMVQNIAFSLAIIAVLI

SEQ ID NO: 1127338 - protein, 17 aa, Mycobacterium
RIPALREYRVWFFHRLL

SEQ ID NO: 1127339 - protein, 26 aa, Mycobacterium
RIPALREYRVWFFHRLLLVTPVVTLY

SEQ ID NO: 1127340 - protein, 26 aa, Mycobacterium
RIPELLRPVLSWAGVALVVAAVFLID

SEQ ID NO: 1127341 - protein, 20 aa, Mycobacterium
RIPPKYVVLTSFAGTAALAF

SEQ ID NO: 1127342 - protein, 20 aa, Mycobacterium
RIQLLIGFMCVALVVYFVLL

SEQ ID NO: 1127343 - protein, 20 aa, Mycobacterium
RIQTELSRPLTLIGGQSYDQ

SEQ ID NO: 1127344 - protein, 19 aa, Mycobacterium
RIRDLERPLADQAAANELG

SEQ ID NO: 1127345 - protein, 22 aa, Mycobacterium
RIRGGMMGIIILVLVIGVGQSF

SEQ ID NO: 1127346 - protein, 17 aa, Mycobacterium
RIRHLRTTIAWIAIPSA

SEQ ID NO: 1127347 - protein, 33 aa, Mycobacterium
RISGVFVPIVIALSVATLGFWIGSGFPVAAAFT

SEQ ID NO: 1127348 - protein, 23 aa, Mycobacterium
RITDARSGDQLWAQGAGVPMQPA

SEQ ID NO: 1127349 - protein, 18 aa, Mycobacterium
RITDDWYAPVGGIVMAGC

SEQ ID NO: 1127350 - protein, 17 aa, Mycobacterium
RITDHWHAPVGGLVMAG

SEQ ID NO: 1127351 - protein, 26 aa, Mycobacterium
RITMNFPPLLAHPINSITAYKGQILY

SEQ ID NO: 1127352 - protein, 19 aa, Mycobacterium
RIVDLMLASALALPSPPYY

SEQ ID NO: 1127353 - protein, 28 aa, Mycobacterium
RIVLDQMSWFTPARWGFAASASTVDLIR

SEQ ID NO: 1127354 - protein, 25 aa, Mycobacterium
RIVQPFGEYLPWRGFFSKLSPYADR

SEQ ID NO: 1127355 - protein, 18 aa, Mycobacterium
RIVVREALTGLSMGILLA

SEQ ID NO: 1127356 - protein, 25 aa, Mycobacterium
RIYEGRLGRRGLFLIWGAEVLASCV

SEQ ID NO: 1127357 - protein, 19 aa, Mycobacterium
RKAATLGLRPDIAVPTLTV

SEQ ID NO: 1127358 - protein, 30 aa, Mycobacterium
RKAKAPKVVRPPLRERLLIKLSTIELNPKA

SEQ ID NO: 1127359 - protein, 21 aa, Mycobacterium
RKAPLVWAIGAAIPWMFAVAA

SEQ ID NO: 1127360 - protein, 24 aa, Mycobacterium
RKAPRFSRKIIRAVAKHYLPEGYP

SEQ ID NO: 1127361 - protein, 18 aa, Mycobacterium
RKAVDFDTVVGFMEAGGW

SEQ ID NO: 1127362 - protein, 17 aa, Mycobacterium
RKDLVALRRVVLPMREV

SEQ ID NO: 1127363 - protein, 20 aa, Mycobacterium
RKEIIRLVAEISMGAGTLAM

SEQ ID NO: 1127364 - protein, 21 aa, Mycobacterium
RKETIRLIAEMSMGTGALVMI

SEQ ID NO: 1127365 - protein, 20 aa, Mycobacterium
RKEYLRYLAGLRTRVTSSAS

SEQ ID NO: 1127366 - protein, 19 aa, Mycobacterium
RKHLQRRTLPAGADHEALW

SEQ ID NO: 1127367 - protein, 28 aa, Mycobacterium
RKISTPLVRLGHMLVFFVRALHGLPVAL

SEQ ID NO: 1127368 - protein, 21 aa, Mycobacterium
RKLMRRVIAPQAFRSMVPALG

SEQ ID NO: 1127369 - protein, 23 aa, Mycobacterium
RKLPRDRRPRIIAVDAVPDSVGT

SEQ ID NO: 1127370 - protein, 17 aa, Mycobacterium
RKPLLLAGSIGFAVFAY

SEQ ID NO: 1127371 - protein, 26 aa, Mycobacterium
RKRNPLLGLRFRYAVTDADRTRRLTD

SEQ ID NO: 1127372 - protein, 26 aa, Mycobacterium
RKRSGSLLAPIALHWSLNGMGALAAA

SEQ ID NO: 1127373 - protein, 19 aa, Mycobacterium
RKRVPAPVVPKGTITIEPP

SEQ ID NO: 1127374 - protein, 27 aa, Mycobacterium
RKSVLALKEAGWWRLGIPEDIGSTLAP

SEQ ID NO: 1127375 - protein, 26 aa, Mycobacterium
RKVFPARLAFHLVRLYNLAFIVSTYA

SEQ ID NO: 1127376 - protein, 25 aa, Mycobacterium
RKVLDLTIRLAEVMLSSGSGTADVV

SEQ ID NO: 1127377 - protein, 18 aa, Mycobacterium
RKWTAVTLSSTWAGEQLL

SEQ ID NO: 1127378 - protein, 25 aa, Mycobacterium
RLADRYAAYFLPLALLMAGSAWLAS

SEQ ID NO: 1127379 - protein, 17 aa, Mycobacterium
RLAFGRDTSSGWLPWAL

SEQ ID NO: 1127380 - protein, 18 aa, Mycobacterium
RLAGAQHAKSIIVATNRD

SEQ ID NO: 1127381 - protein, 26 aa, Mycobacterium
RLAGFGAPAHRVWLPPLSRAPALDAV

SEQ ID NO: 1127382 - protein, 26 aa, Mycobacterium
RLAGFGAPAHRVWLPPLSRASALDAV

SEQ ID NO: 1127383 - protein, 18 aa, Mycobacterium
RLAKGRIGVGTLMTIAAV

SEQ ID NO: 1127384 - protein, 20 aa, Mycobacterium
RLALERTLMAWIRTATALIA

SEQ ID NO: 1127385 - protein, 20 aa, Mycobacterium
RLANPILGWIIGWISFTFLA

SEQ ID NO: 1127386 - protein, 18 aa, Mycobacterium
RLARHGYRTLILDSVTLE

SEQ ID NO: 1127387 - protein, 22 aa, Mycobacterium
RLARRGAPTGPRPVVRAAPAVR

SEQ ID NO: 1127388 - protein, 27 aa, Mycobacterium
RLASFAVSVLVSWSLFTWMIARLPRES

SEQ ID NO: 1127389 - protein, 24 aa, Mycobacterium
RLAWLGDRSRPLLIVGCAAAASMA

SEQ ID NO: 1127390 - protein, 19 aa, Mycobacterium
RLAWTVTLFFGCQSLLAYV

SEQ ID NO: 1127391 - protein, 24 aa, Mycobacterium
RLDGRSAVSIGLPLPGWDLAVVDK

SEQ ID NO: 1127392 - protein, 25 aa, Mycobacterium
RLDRRLDEAAGFAIPLLPRSLDEIP

SEQ ID NO: 1127393 - protein, 25 aa, Mycobacterium
RLDSAALAWVCIDSAPVGAVLLRDP

SEQ ID NO: 1127394 - protein, 17 aa, Mycobacterium
RLDWMMWFAALSPAYAR

SEQ ID NO: 1127395 - protein, 19 aa, Mycobacterium
RLEDARLVLGGRTQAATSG

SEQ ID NO: 1127396 - protein, 19 aa, Mycobacterium
RLEDARLVLGGRTQAPTSG

SEQ ID NO: 1127397 - protein, 20 aa, Mycobacterium
RLFANPRFSGVVAANLLSVL

SEQ ID NO: 1127398 - protein, 17 aa, Mycobacterium
RLFGFGMGADIAWLLPA

SEQ ID NO: 1127399 - protein, 19 aa, Mycobacterium
RLGAAHPKHASPYVASLAQ

SEQ ID NO: 1127400 - protein, 24 aa, Mycobacterium
RLGDSRTDLFGTIRNLQILVDALS

SEQ ID NO: 1127401 - protein, 19 aa, Mycobacterium
RLGDTFRWKGENVATTEVE

SEQ ID NO: 1127402 - protein, 23 aa, Mycobacterium
RLGKLHFWLTFIGFHTTFLVQHW

SEQ ID NO: 1127403 - protein, 24 aa, Mycobacterium
RLGLGDAASRCRIRLSDNDSAEIE

SEQ ID NO: 1127404 - protein, 27 aa, Mycobacterium
RLGPERYAEMLKMFGLGQRTGVGLPGE

SEQ ID NO: 1127405 - protein, 19 aa, Mycobacterium
RLGTRFGPYELQSVIGVGG

SEQ ID NO: 1127406 - protein, 21 aa, Mycobacterium
RLGYQRMVRHLSVVPRTALIM

SEQ ID NO: 1127407 - protein, 20 aa, Mycobacterium
RLHPWIGRIYVCTAIPAAVS

SEQ ID NO: 1127408 - protein, 20 aa, Mycobacterium
RLHQAMLRFKHLGERGEYTW

SEQ ID NO: 1127409 - protein, 18 aa, Mycobacterium
RLIEACGAVVIMIGAVVA

SEQ ID NO: 1127410 - protein, 20 aa, Mycobacterium
RLIVIQVLLLAAACAGIAVA

SEQ ID NO: 1127411 - protein, 21 aa, Mycobacterium
RLLDERAWEAAQHTLSTGEDV

SEQ ID NO: 1127412 - protein, 18 aa, Mycobacterium
RLLGKGGMGEVYEAEDTV

SEQ ID NO: 1127413 - protein, 18 aa, Mycobacterium
RLLISSLVLNWVFGPALM

SEQ ID NO: 1127414 - protein, 20 aa, Mycobacterium
RLLLVRPGFVVGRMTQGMSP

SEQ ID NO: 1127415 - protein, 19 aa, Mycobacterium
RLLRTELPDTIVVSVSHRS

SEQ ID NO: 1127416 - protein, 26 aa, Mycobacterium
RLLRTPRPYLYAGILFFATLGAFAVN

SEQ ID NO: 1127417 - protein, 28 aa, Mycobacterium
RLLSASPLPGWLPDAFRAAAAGVLALMG

SEQ ID NO: 1127418 - protein, 19 aa, Mycobacterium
RLLVRPGITGLWQVSGRSD

SEQ ID NO: 1127419 - protein, 25 aa, Mycobacterium
RLMAEPVLMIGMIYIWMPLAMGKLA

SEQ ID NO: 1127420 - protein, 21 aa, Mycobacterium
RLMPKRGRIAMLLFALSQFVI

SEQ ID NO: 1127421 - protein, 18 aa, Mycobacterium
RLNLAGNRWSWFYRHLFD

SEQ ID NO: 1127422 - protein, 24 aa, Mycobacterium
RLPLVCCLVAFILTFFITRTIVRY

SEQ ID NO: 1127423 - protein, 20 aa, Mycobacterium
RLPTSVSLWLPYLPLLVGGT

SEQ ID NO: 1127424 - protein, 25 aa, Mycobacterium
RLQTLRWIVVPSLVPWLITGLRLSI

SEQ ID NO: 1127425 - protein, 20 aa, Mycobacterium
RLRAWAAFGRNDLRGTYRDP

SEQ ID NO: 1127426 - protein, 18 aa, Mycobacterium
RLRGGTLREPLLVRAFGG

SEQ ID NO: 1127427 - protein, 18 aa, Mycobacterium
RLRIHGMVDREVTYRYED

SEQ ID NO: 1127428 - protein, 21 aa, Mycobacterium
RLRQMLPRRVTVLRDGRRTEI

SEQ ID NO: 1127429 - protein, 25 aa, Mycobacterium
RLRRRGDAWPIGRVVAWLLGCLVLL

SEQ ID NO: 1127430 - protein, 18 aa, Mycobacterium
RLRRRLGADGHADTGDDE

SEQ ID NO: 1127431 - protein, 19 aa, Mycobacterium
RLRSAMAIESAVLVGVLAA

SEQ ID NO: 1127432 - protein, 20 aa, Mycobacterium
RLRSRPGARARLFGMTESFG

SEQ ID NO: 1127433 - protein, 18 aa, Mycobacterium
RLRTELRALAAHTDAMTE

SEQ ID NO: 1127434 - protein, 29 aa, Mycobacterium
RLSALFALAVGIVFTWLFMYGMVPVMQGP

SEQ ID NO: 1127435 - protein, 18 aa, Mycobacterium
RLSDALVRISSQFGVSIP

SEQ ID NO: 1127436 - protein, 20 aa, Mycobacterium
RLSLLGKFLCFAIVAVGIGL

SEQ ID NO: 1127437 - protein, 17 aa, Mycobacterium
RLSRFDQSLAEMPVHSL

SEQ ID NO: 1127438 - protein, 20 aa, Mycobacterium
RLSRIDMPGVARVLDVVSTG

SEQ ID NO: 1127439 - protein, 18 aa, Mycobacterium
RLSVPLLVQKGIDDGIPP

SEQ ID NO: 1127440 - protein, 25 aa, Mycobacterium
RLTASAAKFPGGWYTVAVLLVLLVV

SEQ ID NO: 1127441 - protein, 25 aa, Mycobacterium
RLTGFARIVLLAAILGAALSSAFTV

SEQ ID NO: 1127442 - protein, 18 aa, Mycobacterium
RLTGRGWPKPVADAVGVA

SEQ ID NO: 1127443 - protein, 19 aa, Mycobacterium
RLTGRGWPKPVADAVSVAV

SEQ ID NO: 1127444 - protein, 22 aa, Mycobacterium
RLTYRFTAHHAGAWLYHCSTMP

SEQ ID NO: 1127445 - protein, 18 aa, Mycobacterium
RLVCIEDLGDIDILVTDK

SEQ ID NO: 1127446 - protein, 24 aa, Mycobacterium
RLVDLLPLPSLRVQRAIAIAVILT

SEQ ID NO: 1127447 - protein, 19 aa, Mycobacterium
RLVLPVATGWTLGRALFGI

SEQ ID NO: 1127448 - protein, 18 aa, Mycobacterium
RLVVPRFAAAIMIGVALT

SEQ ID NO: 1127449 - protein, 25 aa, Mycobacterium
RLWVIAAAVAVGWFLPLLGLSLAAF

SEQ ID NO: 1127450 - protein, 19 aa, Mycobacterium
RLWWDKPWPMRIAAIARLP

SEQ ID NO: 1127451 - protein, 20 aa, Mycobacterium
RLYALHILLIPGIILALIGV

SEQ ID NO: 1127452 - protein, 26 aa, Mycobacterium
RLYNEERIRLWVVFVDDFSGQDAQTW

SEQ ID NO: 1127453 - protein, 19 aa, Mycobacterium
RMAPFHHHFELVGWAETTV

SEQ ID NO: 1127454 - protein, 26 aa, Mycobacterium
RMLFVLRDWLPFALVLLAYDLSRGAA

SEQ ID NO: 1127455 - protein, 18 aa, Mycobacterium
RMLIEQWDRTTLLEQERV

SEQ ID NO: 1127456 - protein, 20 aa, Mycobacterium
RMMHGAPRLTLRSWMVIPGI

SEQ ID NO: 1127457 - protein, 29 aa, Mycobacterium
RMMPYLLPYRGRWIVMIVVALASLAATIS

SEQ ID NO: 1127458 - protein, 24 aa, Mycobacterium
RMMQPRTPPSLVLKLPEEKEVSAI

SEQ ID NO: 1127459 - protein, 18 aa, Mycobacterium
RMRTLRNAVLLAMAVTFA

SEQ ID NO: 1127460 - protein, 21 aa, Mycobacterium
RMTRERLWQTIGFLSIVALVF

SEQ ID NO: 1127461 - protein, 18 aa, Mycobacterium
RMTVFPYGRSGMIAASML

SEQ ID NO: 1127462 - protein, 35 aa, Mycobacterium
RMVLLPAFMHLMGRWNWWAPAPLARWHARRTGTAE

SEQ ID NO: 1127463 - protein, 19 aa, Mycobacterium
RMYTGLMRMRWFALAMLGI

SEQ ID NO: 1127464 - protein, 18 aa, Mycobacterium
RNAELFLLGFAALITTVA

SEQ ID NO: 1127465 - protein, 19 aa, Mycobacterium
RNAKRWQDVEELLAAGITV

SEQ ID NO: 1127466 - protein, 19 aa, Mycobacterium
RNAVLLAMAVTFAVTVVAL

SEQ ID NO: 1127467 - protein, 22 aa, Mycobacterium
RNDLPVPIRVRLAVNAPPGMTV

SEQ ID NO: 1127468 - protein, 20 aa, Mycobacterium
RNDLPVPIRVRLDIDAPPGM

SEQ ID NO: 1127469 - protein, 17 aa, Mycobacterium
RNDREWYETAAELGVAL

SEQ ID NO: 1127470 - protein, 21 aa, Mycobacterium
RNILPPNKFPMIPPQVDPDPG

SEQ ID NO: 1127471 - protein, 17 aa, Mycobacterium
RNIMFGVALGLLLGFGV

SEQ ID NO: 1127472 - protein, 26 aa, Mycobacterium
RNKVALGCGLLFVLIVAVCLAAPLWA

SEQ ID NO: 1127473 - protein, 21 aa, Mycobacterium
RNLFFRGVFPLLGGLSMLAAF

SEQ ID NO: 1127474 - protein, 22 aa, Mycobacterium
RNLFTLLPIIPFIGGLLGVIAI

SEQ ID NO: 1127475 - protein, 31 aa, Mycobacterium
RNLHKLDPLLRLPLALGLAHLLGRIPLPGSV

SEQ ID NO: 1127476 - protein, 24 aa, Mycobacterium
RNPWYLAWLRLRRNKVALGCGLLF

SEQ ID NO: 1127477 - protein, 17 aa, Mycobacterium
RNRATAMLGGWLAVAAG

SEQ ID NO: 1127478 - protein, 19 aa, Mycobacterium
RNRDVYGGFVMPAQPGQPP

SEQ ID NO: 1127479 - protein, 18 aa, Mycobacterium
RNRFLVALALSIPITLWS

SEQ ID NO: 1127480 - protein, 24 aa, Mycobacterium
RNRRARIAVAALFLTNGALFANLL

SEQ ID NO: 1127481 - protein, 17 aa, Mycobacterium
RNSSDFLILDRLAKRVF

SEQ ID NO: 1127482 - protein, 24 aa, Mycobacterium
RNTVWLNGIALWFADRTQRTKTRR

SEQ ID NO: 1127483 - protein, 22 aa, Mycobacterium
RPAPELHPDLALLLSTSGSTGS

SEQ ID NO: 1127484 - protein, 18 aa, Mycobacterium
RPAPLALSNWPVRVKVLA

SEQ ID NO: 1127485 - protein, 39 aa, Mycobacterium
RPAYLWAWRLLRLDFIGVAFGALFFCLSLTPSLLPRDWL

SEQ ID NO: 1127486 - protein, 24 aa, Mycobacterium
RPDDAAGWPQWLLYIVMTVISLLL

SEQ ID NO: 1127487 - protein, 24 aa, Mycobacterium
RPDEPGLGAGFWGTSFSAAYVSGV

SEQ ID NO: 1127488 - protein, 18 aa, Mycobacterium
RPDLYARIGSTVFDDKPT

SEQ ID NO: 1127489 - protein, 20 aa, Mycobacterium
RPDPQLLRFAIRADATLCAG

SEQ ID NO: 1127490 - protein, 21 aa, Mycobacterium
RPEAVAAVQECHRAGIRVKMI

SEQ ID NO: 1127491 - protein, 20 aa, Mycobacterium
RPEGVPSVRPLPGGVIRPGI

SEQ ID NO: 1127492 - protein, 19 aa, Mycobacterium
RPELPDVLLPQNYQPPADL

SEQ ID NO: 1127493 - protein, 29 aa, Mycobacterium
RPETAHTYTRCVGRVAGTLVGIVTASAVL

SEQ ID NO: 1127494 - protein, 32 aa, Mycobacterium
RPFQWREFILQAWFLFRVSFLPTVAVSVPLTV

SEQ ID NO: 1127495 - protein, 19 aa, Mycobacterium
RPFVPLIPTLGIPGDIADA

SEQ ID NO: 1127496 - protein, 23 aa, Mycobacterium
RPGEYRAAVIYTFVVVVLAAIAF

SEQ ID NO: 1127497 - protein, 21 aa, Mycobacterium
RPGGPDWLSLMGIDDPEQIDV

SEQ ID NO: 1127498 - protein, 22 aa, Mycobacterium
RPGIGMRLLIAQTMVLLAGAIT

SEQ ID NO: 1127499 - protein, 17 aa, Mycobacterium
RPGKRAPTVKMCESDEE

SEQ ID NO: 1127500 - protein, 26 aa, Mycobacterium
RPGPATVVVVLLRLLALSFTLTLLLS

SEQ ID NO: 1127501 - protein, 17 aa, Mycobacterium
RPGPGLFRQAGSVALGM

SEQ ID NO: 1127502 - protein, 20 aa, Mycobacterium
RPGRASRFLAHFSTAIEGLV

SEQ ID NO: 1127503 - protein, 20 aa, Mycobacterium
RPGRPLPQWVTRAVDAPATR

SEQ ID NO: 1127504 - protein, 20 aa, Mycobacterium
RPGSALLFPTLCTPTAEAPI

SEQ ID NO: 1127505 - protein, 25 aa, Mycobacterium
RPHPYPRWVATAGWAGFALGIAMLL

SEQ ID NO: 1127506 - protein, 20 aa, Mycobacterium
RPKLKAFMADLCWIENIGAR

SEQ ID NO: 1127507 - protein, 21 aa, Mycobacterium
RPKRAISRLLALIRNTWRTLT

SEQ ID NO: 1127508 - protein, 17 aa, Mycobacterium
RPKSWLALTISIVAVVA

SEQ ID NO: 1127509 - protein, 25 aa, Mycobacterium
RPLGLGIAVAAGFLAAEVLAVFALK

SEQ ID NO: 1127510 - protein, 25 aa, Mycobacterium
RPLRLLRLVTLVAVLQRAVGHAIRG

SEQ ID NO: 1127511 - protein, 20 aa, Mycobacterium
RPMPRRGRIAMLLFALSQFV

SEQ ID NO: 1127512 - protein, 31 aa, Mycobacterium
RPPSESLLSRYFMWRVVMVSVLMAGGALTMF

SEQ ID NO: 1127513 - protein, 18 aa, Mycobacterium
RPPVRAFGAVTARVALPG

SEQ ID NO: 1127514 - protein, 20 aa, Mycobacterium
RPPVRGGMRGLSPVVRLWVI

SEQ ID NO: 1127515 - protein, 27 aa, Mycobacterium
RPQWLALFVVVLAFAYLCFTVLAPWQL

SEQ ID NO: 1127516 - protein, 25 aa, Mycobacterium
RPRGLRVADTIPRKELSPPIFDGEG

SEQ ID NO: 1127517 - protein, 24 aa, Mycobacterium
RPRIVDIAFWCFIAGAVIMIVGGL

SEQ ID NO: 1127518 - protein, 17 aa, Mycobacterium
RPRKVWVEAHAASDELV

SEQ ID NO: 1127519 - protein, 20 aa, Mycobacterium
RPRNPRLLTLAALTLLGVTG

SEQ ID NO: 1127520 - protein, 22 aa, Mycobacterium
RPRPTGLAFLVGWLVGLAALTA

SEQ ID NO: 1127521 - protein, 20 aa, Mycobacterium
RPRPVLQLLSFLAGGFVMGT

SEQ ID NO: 1127522 - protein, 25 aa, Mycobacterium
RPRQRPRGLGGIDITALRRPVHHSD

SEQ ID NO: 1127523 - protein, 31 aa, Mycobacterium
RPRRVKLSKAERLNVVFVLAMSQVVQVLTVS

SEQ ID NO: 1127524 - protein, 20 aa, Mycobacterium
RPRVVEFGFWALVAGAALLV

SEQ ID NO: 1127525 - protein, 18 aa, Mycobacterium
RPSFGSSITGAAPSVPAA

SEQ ID NO: 1127526 - protein, 24 aa, Mycobacterium
RPSQSRPGIPAGLDDVISRGMAKR

SEQ ID NO: 1127527 - protein, 21 aa, Mycobacterium
RPTEAMAFLAIAAILDALDGR

SEQ ID NO: 1127528 - protein, 28 aa, Mycobacterium
RPTPLSARASTLWGYAWPLAYLAGIGIL

SEQ ID NO: 1127529 - protein, 18 aa, Mycobacterium
RPTVIPLHLEPGDRVAVV

SEQ ID NO: 1127530 - protein, 24 aa, Mycobacterium
RPVDEGRKPFLLVGSALTSLFVIG

SEQ ID NO: 1127531 - protein, 17 aa, Mycobacterium
RPVRGLVTAILLAVALL

SEQ ID NO: 1127532 - protein, 30 aa, Mycobacterium
RPVVPAEAFAAWDFVTRFDVAQVVMAPMQS

SEQ ID NO: 1127533 - protein, 19 aa, Mycobacterium
RPWYLAWAGLVYIVATLAT

SEQ ID NO: 1127534 - protein, 18 aa, Mycobacterium
RPWYRAFNAYKMAVICLI

SEQ ID NO: 1127535 - protein, 23 aa, Mycobacterium
RPYPSAPRPSAPPTYPTPQPSRP

SEQ ID NO: 1127536 - protein, 26 aa, Mycobacterium
RQAGERRMLCGLQLPGPNNQQLAFTG

SEQ ID NO: 1127537 - protein, 27 aa, Mycobacterium
RQARDLLRVAFGPSLVALVIIAAVVLL

SEQ ID NO: 1127538 - protein, 19 aa, Mycobacterium
RQARFALANGGVFGDGLGQ

SEQ ID NO: 1127539 - protein, 17 aa, Mycobacterium
RQATRLRSAMAIESAVL

SEQ ID NO: 1127540 - protein, 18 aa, Mycobacterium
RQDGMWWFMIRDDGCGGA

SEQ ID NO: 1127541 - protein, 22 aa, Mycobacterium
RQEFPWPVLEEAAARGFYSPLF

SEQ ID NO: 1127542 - protein, 18 aa, Mycobacterium
RQFWDWAQPTLIFVSHLI

SEQ ID NO: 1127543 - protein, 20 aa, Mycobacterium
RQGNDLVGEFVVRRASFHAM

SEQ ID NO: 1127544 - protein, 26 aa, Mycobacterium
RQLDMLNLQSVWPLTRGAGQTVAVID

SEQ ID NO: 1127545 - protein, 17 aa, Mycobacterium
RQLLACGVALLVIALVV

SEQ ID NO: 1127546 - protein, 18 aa, Mycobacterium
RQLLGFGAKHGMTTLFGH

SEQ ID NO: 1127547 - protein, 26 aa, Mycobacterium
RQLVVPRFLALLLISPLLCIFIVASG

SEQ ID NO: 1127548 - protein, 18 aa, Mycobacterium
RQMIYPFTGRGGCASEAT

SEQ ID NO: 1127549 - protein, 17 aa, Mycobacterium
RQMIYPFTRGGGCTLTP

SEQ ID NO: 1127550 - protein, 19 aa, Mycobacterium
RQMRLIVSDRGYFIFLALL

SEQ ID NO: 1127551 - protein, 22 aa, Mycobacterium
RQPDHFDWLSGYLQTRGMATAM

SEQ ID NO: 1127552 - protein, 18 aa, Mycobacterium
RQPLLAGLLTLSGATTPA

SEQ ID NO: 1127553 - protein, 24 aa, Mycobacterium
RQPRAVLYIPEYLVFRVVRSYFTL

SEQ ID NO: 1127554 - protein, 17 aa, Mycobacterium
RQPSTFSDREWILEIAR

SEQ ID NO: 1127555 - protein, 27 aa, Mycobacterium
RQRDEYQWRIGFLRSRGLLPVLRWLIA

SEQ ID NO: 1127556 - protein, 18 aa, Mycobacterium
RQRFPELTPAQIINRITA

SEQ ID NO: 1127557 - protein, 21 aa, Mycobacterium
RQRFYALGLYVVMLVGAIVAA

SEQ ID NO: 1127558 - protein, 29 aa, Mycobacterium
RQRGGRYWFARGWNFRGLGAWLVSAALSL

SEQ ID NO: 1127559 - protein, 27 aa, Mycobacterium
RQRHAVSWLAALAVPGAICAATVLLLD

SEQ ID NO: 1127560 - protein, 28 aa, Mycobacterium
RQRLSRRTRRWIAIGLTALVVVTGVALA

SEQ ID NO: 1127561 - protein, 26 aa, Mycobacterium
RQRVSLRPLWGIDARLKKFGMMAVAM

SEQ ID NO: 1127562 - protein, 17 aa, Mycobacterium
RQSLQLGGGEWGSLFTE

SEQ ID NO: 1127563 - protein, 20 aa, Mycobacterium
RQSQPPAKWRSRIDNRALSW

SEQ ID NO: 1127564 - protein, 20 aa, Mycobacterium
RQTHGLRPDELRVMYEHHDA

SEQ ID NO: 1127565 - protein, 18 aa, Mycobacterium
RQWAWKRTASFLAGCIAL

SEQ ID NO: 1127566 - protein, 17 aa, Mycobacterium
RQYPALFVAPTARLAQV

SEQ ID NO: 1127567 - protein, 21 aa, Mycobacterium
RQYRILKALADTAVRVPRVMW

SEQ ID NO: 1127568 - protein, 22 aa, Mycobacterium
RRAEVRDAAALDYVRSFMTSYT

SEQ ID NO: 1127569 - protein, 22 aa, Mycobacterium
RRAFPQESPVALVRAIVDAPPP

SEQ ID NO: 1127570 - protein, 25 aa, Mycobacterium
RRAGTQIGVPYSWGGGSLTGPTRGV

SEQ ID NO: 1127571 - protein, 18 aa, Mycobacterium
RRALPVTFVTFGLGYLAI

SEQ ID NO: 1127572 - protein, 25 aa, Mycobacterium
RRAMSQMGVPYSWGGGNAAGPSRGI

SEQ ID NO: 1127573 - protein, 35 aa, Mycobacterium
RRAPRTCAVRASLLLWGGWVLVTGVVFSFMDGIIH

SEQ ID NO: 1127574 - protein, 24 aa, Mycobacterium
RRARPSAHVALGRWHRDRALSGSA

SEQ ID NO: 1127575 - protein, 21 aa, Mycobacterium
RRASAGSGWLARTVRSPSAVV

SEQ ID NO: 1127576 - protein, 23 aa, Mycobacterium
RRAVEHRALMALAVGDLGMANTS

SEQ ID NO: 1127577 - protein, 17 aa, Mycobacterium
RRCSRVIKQNLWASLGI

SEQ ID NO: 1127578 - protein, 19 aa, Mycobacterium
RRDFTLYAFDATHAHAIGL

SEQ ID NO: 1127579 - protein, 24 aa, Mycobacterium
RREESRMATEFARYLDKKHDLASA

SEQ ID NO: 1127580 - protein, 22 aa, Mycobacterium
RREHIGEALRRLPPYATALGEV

SEQ ID NO: 1127581 - protein, 27 aa, Mycobacterium
RRELSAGAIGEIWVRGENVCLGYWGKP

SEQ ID NO: 1127582 - protein, 24 aa, Mycobacterium
RRETARLIAEMAFGAGGLLVIGGT

SEQ ID NO: 1127583 - protein, 17 aa, Mycobacterium
RRFFGYLNLFLAAMLLL

SEQ ID NO: 1127584 - protein, 17 aa, Mycobacterium
RRFKRPPWVALPIAMFI

SEQ ID NO: 1127585 - protein, 17 aa, Mycobacterium
RRFMSFGLIFLMLNVLQ

SEQ ID NO: 1127586 - protein, 25 aa, Mycobacterium
RRFVLYGVIVAPAFAGTVGALSVLV

SEQ ID NO: 1127587 - protein, 26 aa, Mycobacterium
RRGAPRGGAVALVLLSGFALFGGLLA

SEQ ID NO: 1127588 - protein, 25 aa, Mycobacterium
RRGDPKFRRATIGLSLAIAVVLVLL

SEQ ID NO: 1127589 - protein, 22 aa, Mycobacterium
RRGGQIAPRFGSRIRVTAALAT

SEQ ID NO: 1127590 - protein, 22 aa, Mycobacterium
RRGGSLWFRLLVNDRVAATAAC

SEQ ID NO: 1127591 - protein, 17 aa, Mycobacterium
RRGLIMGVFVFCAFATP

SEQ ID NO: 1127592 - protein, 20 aa, Mycobacterium
RRGSLPGAVNGPVWRLAGTT

SEQ ID NO: 1127593 - protein, 27 aa, Mycobacterium
RRGVRWFLAIAFLGAWIPWAAVHSLGG

SEQ ID NO: 1127594 - protein, 21 aa, Mycobacterium
RRGWLEALLGHFCDPAVALVA

SEQ ID NO: 1127595 - protein, 18 aa, Mycobacterium
RRHAPALRTLGWVVEDDG

SEQ ID NO: 1127596 - protein, 23 aa, Mycobacterium
RRHITRLALFGAVLAVLYYLTAV

SEQ ID NO: 1127597 - protein, 17 aa, Mycobacterium
RRHLHPYLGRPGRERSG

SEQ ID NO: 1127598 - protein, 22 aa, Mycobacterium
RRHMLQWLVARSHHLTLVGLVL

SEQ ID NO: 1127599 - protein, 17 aa, Mycobacterium
RRHPYGRVFAALIAPRL

SEQ ID NO: 1127600 - protein, 26 aa, Mycobacterium
RRHVRWRHRICLTAAITAMLATPALI

SEQ ID NO: 1127601 - protein, 22 aa, Mycobacterium
RRIEAACKVWSAGVSASPLGRD

SEQ ID NO: 1127602 - protein, 18 aa, Mycobacterium
RRILMAAIVVAAFSVAAS

SEQ ID NO: 1127603 - protein, 19 aa, Mycobacterium
RRILVIVGIVLAVLLLAGV

SEQ ID NO: 1127604 - protein, 24 aa, Mycobacterium
RRITACFFGDGAVAEGVFHESLNM

SEQ ID NO: 1127605 - protein, 24 aa, Mycobacterium
RRKRWLIEIVDLLAAAVTAALRRA

SEQ ID NO: 1127606 - protein, 18 aa, Mycobacterium
RRLFALVLLLLVVAPSLI

SEQ ID NO: 1127607 - protein, 18 aa, Mycobacterium
RRLGLTGALGTVAESIDG

SEQ ID NO: 1127608 - protein, 27 aa, Mycobacterium
RRLHPPAPRPARRGLVHALAVPAALSA

SEQ ID NO: 1127609 - protein, 19 aa, Mycobacterium
RRLLVRPGITGLWQVSGRS

SEQ ID NO: 1127610 - protein, 22 aa, Mycobacterium
RRLPRRYLTVMMAMWSVGSVPL

SEQ ID NO: 1127611 - protein, 24 aa, Mycobacterium
RRLRKAGFDRLVMLTGDRAEPARE

SEQ ID NO: 1127612 - protein, 24 aa, Mycobacterium
RRLRTEVLAGLVVALALIPEAISF

SEQ ID NO: 1127613 - protein, 20 aa, Mycobacterium
RRLSPNVLRGVIVVVGLIGL

SEQ ID NO: 1127614 - protein, 19 aa, Mycobacterium
RRLSVPIPEGGGRGALGVR

SEQ ID NO: 1127615 - protein, 17 aa, Mycobacterium
RRLVAFVSHDLRTPLAG

SEQ ID NO: 1127616 - protein, 20 aa, Mycobacterium
RRLVGRLTIGLLGVATALLL

SEQ ID NO: 1127617 - protein, 19 aa, Mycobacterium
RRMAPRPVERPPVDPAAQR

SEQ ID NO: 1127618 - protein, 17 aa, Mycobacterium
RRMPKSETLVMVSTVAV

SEQ ID NO: 1127619 - protein, 26 aa, Mycobacterium
RRNVPGWLAAVRRWRRSRRGKYPAAA

SEQ ID NO: 1127620 - protein, 18 aa, Mycobacterium
RRPAEFVPSIIVNDRPLI

SEQ ID NO: 1127621 - protein, 19 aa, Mycobacterium
RRPAISLLRALGAKRRQIV

SEQ ID NO: 1127622 - protein, 20 aa, Mycobacterium
RRPATRARRYVVGAAAVMTA

SEQ ID NO: 1127623 - protein, 20 aa, Mycobacterium
RRPGTRWLALALRAVAVAGT

SEQ ID NO: 1127624 - protein, 20 aa, Mycobacterium
RRPLESYHSAWLGFAAVAVV

SEQ ID NO: 1127625 - protein, 18 aa, Mycobacterium
RRPLRLSVPDALYLGWFG

SEQ ID NO: 1127626 - protein, 18 aa, Mycobacterium
RRPMLSKYLDLVAPVGFS

SEQ ID NO: 1127627 - protein, 25 aa, Mycobacterium
RRPPRQGCRYRLHNGALCVDGAQWS

SEQ ID NO: 1127628 - protein, 25 aa, Mycobacterium
RRPVAHLVGSLAVLIVLAACAGFIK

SEQ ID NO: 1127629 - protein, 20 aa, Mycobacterium
RRPVLALSIMVVIEFANLSG

SEQ ID NO: 1127630 - protein, 19 aa, Mycobacterium
RRPVVGYIWAWVHANDRRW

SEQ ID NO: 1127631 - protein, 17 aa, Mycobacterium
RRQAAITLAPWLLTAAI

SEQ ID NO: 1127632 - protein, 33 aa, Mycobacterium
RRQIRLVISDRGYFAFLMLLPFIMGVLSLSVPG

SEQ ID NO: 1127633 - protein, 19 aa, Mycobacterium
RRRAEVAAFLAVIALALTI

SEQ ID NO: 1127634 - protein, 25 aa, Mycobacterium
RRRAGARALRWGWLALTLIGVPWLL

SEQ ID NO: 1127635 - protein, 19 aa, Mycobacterium
RRRALNLALRGRRDPASGA

SEQ ID NO: 1127636 - protein, 24 aa, Mycobacterium
RRRDCIAGPGIIGWTVQQTFFQRR

SEQ ID NO: 1127637 - protein, 22 aa, Mycobacterium
RRRELPGLFAHSLIPIVIGYVF

SEQ ID NO: 1127638 - protein, 26 aa, Mycobacterium
RRRELTCPRWLAVLATVSFGLYLGWS

SEQ ID NO: 1127639 - protein, 17 aa, Mycobacterium
RRRFFAYLNLFLAAMLL

SEQ ID NO: 1127640 - protein, 34 aa, Mycobacterium
RRRHIALGGLFVLLVFVAFGCWLAVRAVQAKSNL

SEQ ID NO: 1127641 - protein, 22 aa, Mycobacterium
RRRIRIQVILTFLLLFTNILGI

SEQ ID NO: 1127642 - protein, 26 aa, Mycobacterium
RRRPPERPMRVTAAPAARAVRVTAAA

SEQ ID NO: 1127643 - protein, 17 aa, Mycobacterium
RRRPVVAPVPLRAGDRV

SEQ ID NO: 1127644 - protein, 24 aa, Mycobacterium
RRRQARLYSGWALIAGAAFMAAIA

SEQ ID NO: 1127645 - protein, 25 aa, Mycobacterium
RRRRAEGTIDWLGAVGLAAGLSALL

SEQ ID NO: 1127646 - protein, 21 aa, Mycobacterium
RRRRARWWTTTALAAAAVLLA

SEQ ID NO: 1127647 - protein, 19 aa, Mycobacterium
RRRRLTWGLLFLVNSMLVY

SEQ ID NO: 1127648 - protein, 17 aa, Mycobacterium
RRRRTVVIAGDGSFFMH

SEQ ID NO: 1127649 - protein, 21 aa, Mycobacterium
RRRRVGVFPPDLVRRRYVESV

SEQ ID NO: 1127650 - protein, 20 aa, Mycobacterium
RRRTGGWFTAIAVAIPTLIF

SEQ ID NO: 1127651 - protein, 24 aa, Mycobacterium
RRRTRAAVVALTLSVLLFTTVVVA

SEQ ID NO: 1127652 - protein, 18 aa, Mycobacterium
RRRVGPLDQRRNERVSAS

SEQ ID NO: 1127653 - protein, 27 aa, Mycobacterium
RRRVRIWRGWPLWGALLWILSQMVLIR

SEQ ID NO: 1127654 - protein, 20 aa, Mycobacterium
RRSAAAWLLVAVLLLSVIVS

SEQ ID NO: 1127655 - protein, 25 aa, Mycobacterium
RRSLLRSPLAWTITVFFGSQAFMAY

SEQ ID NO: 1127656 - protein, 17 aa, Mycobacterium
RRSLSYHYRGGWGEPTG

SEQ ID NO: 1127657 - protein, 20 aa, Mycobacterium
RRSQLWQAFQMQRKEDKRLL

SEQ ID NO: 1127658 - protein, 19 aa, Mycobacterium
RRSRRVVVVAAVLDGVFDW

SEQ ID NO: 1127659 - protein, 17 aa, Mycobacterium
RRSRSLVDQQLSLIDRL

SEQ ID NO: 1127660 - protein, 20 aa, Mycobacterium
RRSRTPALDAGRALAVALRV

SEQ ID NO: 1127661 - protein, 23 aa, Mycobacterium
RRSVLLTLCLTEITSWGVLYYAF

SEQ ID NO: 1127662 - protein, 17 aa, Mycobacterium
RRTALAAAFIVEVVNWV

SEQ ID NO: 1127663 - protein, 18 aa, Mycobacterium
RRTGAPALPARRELFHFF

SEQ ID NO: 1127664 - protein, 26 aa, Mycobacterium
RRTGRLWPLIIAHGVINTVAYVGYAL

SEQ ID NO: 1127665 - protein, 19 aa, Mycobacterium
RRTLAKWVALAVSSVALAV

SEQ ID NO: 1127666 - protein, 18 aa, Mycobacterium
RRTRYAAVGALVLIAIGL

SEQ ID NO: 1127667 - protein, 20 aa, Mycobacterium
RRVALAASFSLRTVLAVVLI

SEQ ID NO: 1127668 - protein, 20 aa, Mycobacterium
RRVATLVARGAPLSEVYDVA

SEQ ID NO: 1127669 - protein, 26 aa, Mycobacterium
RRVLWRRRIWLPFAGIAGRTPAEKIE

SEQ ID NO: 1127670 - protein, 22 aa, Mycobacterium
RRVPPERLPAAVAVPGLGRDLR

SEQ ID NO: 1127671 - protein, 25 aa, Mycobacterium
RRVTRAEWAWAVLLTLALAVFVVLA

SEQ ID NO: 1127672 - protein, 22 aa, Mycobacterium
RRVVGAVGMAVLAIALIASVGA

SEQ ID NO: 1127673 - protein, 23 aa, Mycobacterium
RRWGEFGMIPALNARRYPHRAAV

SEQ ID NO: 1127674 - protein, 20 aa, Mycobacterium
RRWREARRAVLAFDAATLVW

SEQ ID NO: 1127675 - protein, 17 aa, Mycobacterium
RRWVVRAVLLGVATISG

SEQ ID NO: 1127676 - protein, 22 aa, Mycobacterium
RRWWHSTARRAAVVATIVAVAV

SEQ ID NO: 1127677 - protein, 18 aa, Mycobacterium
RRWWWKTLPYETGFATLD

SEQ ID NO: 1127678 - protein, 26 aa, Mycobacterium
RRWYRTFPAVVGFVAVAVVIIASGIV

SEQ ID NO: 1127679 - protein, 19 aa, Mycobacterium
RRYADYLPTDGFTTLNVIS

SEQ ID NO: 1127680 - protein, 19 aa, Mycobacterium
RRYADYLPTDGFTTLNVVS

SEQ ID NO: 1127681 - protein, 26 aa, Mycobacterium
RRYPGELLRLIAQMGLGTGALAVVGG

SEQ ID NO: 1127682 - protein, 27 aa, Mycobacterium
RRYWNRIAVTVVRRPKPLLAGSLVVLL

SEQ ID NO: 1127683 - protein, 18 aa, Mycobacterium
RSAALMWIVDLLLVVPSF

SEQ ID NO: 1127684 - protein, 17 aa, Mycobacterium
RSAAMLSHPNIVAVHDY

SEQ ID NO: 1127685 - protein, 17 aa, Mycobacterium
RSAMATMRIAFLSALVL

SEQ ID NO: 1127686 - protein, 23 aa, Mycobacterium
RSAMATWPVGRPMRMLDAARELT

SEQ ID NO: 1127687 - protein, 24 aa, Mycobacterium
RSARIPMRRRLPRRAAAVTGVVLV

SEQ ID NO: 1127688 - protein, 27 aa, Mycobacterium
RSARNRMAFLAGVLFILALCFASTNGW

SEQ ID NO: 1127689 - protein, 18 aa, Mycobacterium
RSASEGPGPGASVGDPAE

SEQ ID NO: 1127690 - protein, 18 aa, Mycobacterium
RSASRIAERFAEGHLSER

SEQ ID NO: 1127691 - protein, 19 aa, Mycobacterium
RSATKLTRVMAAVAAITGI

SEQ ID NO: 1127692 - protein, 17 aa, Mycobacterium
RSCTKRFVLLCGGAATA

SEQ ID NO: 1127693 - protein, 20 aa, Mycobacterium
RSDLAMTWLLTGLFAGIVSG

SEQ ID NO: 1127694 - protein, 22 aa, Mycobacterium
RSEAVFGMGIPVPPRALSHYTG

SEQ ID NO: 1127695 - protein, 21 aa, Mycobacterium
RSEAVVSRIVYARMSPEHKID

SEQ ID NO: 1127696 - protein, 24 aa, Mycobacterium
RSFSYPAMFGFGAFAAAVCLLVAV

SEQ ID NO: 1127697 - protein, 32 aa, Mycobacterium
RSGDGPARIGLGRICWRRDLLGGVGLAMLIGV

SEQ ID NO: 1127698 - protein, 25 aa, Mycobacterium
RSGIPVPEITLWLFGGVARLAGEAK

SEQ ID NO: 1127699 - protein, 23 aa, Mycobacterium
RSGRPRLRRPSGTRCCDVGSVDG

SEQ ID NO: 1127700 - protein, 17 aa, Mycobacterium
RSLGHRVGGGWLVARAG

SEQ ID NO: 1127701 - protein, 24 aa, Mycobacterium
RSPDIPASLWLIGCLVVLLCTLAM

SEQ ID NO: 1127702 - protein, 23 aa, Mycobacterium
RSQLDRTLLLWALPLLIAPPMYS

SEQ ID NO: 1127703 - protein, 25 aa, Mycobacterium
RSRRRKRPLLLAGIAVVVLAGGAVT

SEQ ID NO: 1127704 - protein, 26 aa, Mycobacterium
RSRTQRNVYIPWSLTVTPISQSEVGS

SEQ ID NO: 1127705 - protein, 24 aa, Mycobacterium
RSRWLRTALVGVLVATLAIGAYLV

SEQ ID NO: 1127706 - protein, 20 aa, Mycobacterium
RSTIRWRLTVLYGSAFFIAG

SEQ ID NO: 1127707 - protein, 21 aa, Mycobacterium
RSTKFVMHRAVPVGLAGIAVL

SEQ ID NO: 1127708 - protein, 17 aa, Mycobacterium
RSVPNRLSALWETAGLH

SEQ ID NO: 1127709 - protein, 21 aa, Mycobacterium
RSVTTFPWVFLFPAGVLVLIV

SEQ ID NO: 1127710 - protein, 17 aa, Mycobacterium
RSWAIPVAVVGLVVLAG

SEQ ID NO: 1127711 - protein, 20 aa, Mycobacterium
RTADGLPLGEPVRLSVHSNA

SEQ ID NO: 1127712 - protein, 17 aa, Mycobacterium
RTAERIASEAGMLAEWM

SEQ ID NO: 1127713 - protein, 18 aa, Mycobacterium
RTAGRLFAATVFGLSHVP

SEQ ID NO: 1127714 - protein, 20 aa, Mycobacterium
RTALVISGPFGWVRNPIFTA

SEQ ID NO: 1127715 - protein, 19 aa, Mycobacterium
RTAPAFITVLGVLLLPFVL

SEQ ID NO: 1127716 - protein, 17 aa, Mycobacterium
RTARSGAFIALVAVFAL

SEQ ID NO: 1127717 - protein, 23 aa, Mycobacterium
RTASMRWYPIITFWQVAADMTNA

SEQ ID NO: 1127718 - protein, 27 aa, Mycobacterium
RTELQADCYAGIWAHYASITKQEGTDV

SEQ ID NO: 1127719 - protein, 17 aa, Mycobacterium
RTELVFAGLAGALLLTG

SEQ ID NO: 1127720 - protein, 18 aa, Mycobacterium
RTFFAGWLAVYVIEFPLE

SEQ ID NO: 1127721 - protein, 18 aa, Mycobacterium
RTFTVVWLAAAPQLVALL

SEQ ID NO: 1127722 - protein, 25 aa, Mycobacterium
RTGIEGWELFALRCAATVAVAAVSW

SEQ ID NO: 1127723 - protein, 25 aa, Mycobacterium
RTGRLWPLIIAHGVINTVAYVGYAL

SEQ ID NO: 1127724 - protein, 22 aa, Mycobacterium
RTGRLWPLIIAHTLIDAVAFVG

SEQ ID NO: 1127725 - protein, 19 aa, Mycobacterium
RTIPRAVALALVIALMVYA

SEQ ID NO: 1127726 - protein, 17 aa, Mycobacterium
RTLDLVLPPGDYETVAG

SEQ ID NO: 1127727 - protein, 19 aa, Mycobacterium
RTLKAWRLGQWTTEGVHHG

SEQ ID NO: 1127728 - protein, 19 aa, Mycobacterium
RTLPAGADHEALWRLISEL

SEQ ID NO: 1127729 - protein, 19 aa, Mycobacterium
RTLRAWRLGQWEREAAVHG

SEQ ID NO: 1127730 - protein, 23 aa, Mycobacterium
RTLSPRGSLGWSALTATDIGYLM

SEQ ID NO: 1127731 - protein, 23 aa, Mycobacterium
RTLSPRGSLGWSALTATDVGYLM

SEQ ID NO: 1127732 - protein, 19 aa, Mycobacterium
RTLTFPAPVIVAATGPAIA

SEQ ID NO: 1127733 - protein, 20 aa, Mycobacterium
RTQPEFAAACALRTAQRPGV

SEQ ID NO: 1127734 - protein, 23 aa, Mycobacterium
RTQSEALDAIWFNISAVSEQLRG

SEQ ID NO: 1127735 - protein, 23 aa, Mycobacterium
RTQSRSVLVGALILVTGLIGCFL

SEQ ID NO: 1127736 - protein, 18 aa, Mycobacterium
RTQVLIGLMCVALVVYFL

SEQ ID NO: 1127737 - protein, 21 aa, Mycobacterium
RTRASLILWAGWLVVTALVFS

SEQ ID NO: 1127738 - protein, 20 aa, Mycobacterium
RTRISTFLAGAFLLGLVVGL

SEQ ID NO: 1127739 - protein, 18 aa, Mycobacterium
RTRRGRALFVFTVGIVLI

SEQ ID NO: 1127740 - protein, 35 aa, Mycobacterium
RTTAWEAVRTALRDGRLEPGWHRLSGIRGAGRSGK

SEQ ID NO: 1127741 - protein, 29 aa, Mycobacterium
RTTDSVTIWLLDWDDVIDRTALGFDQLKP

SEQ ID NO: 1127742 - protein, 17 aa, Mycobacterium
RTTIAWIAIPSALWVAF

SEQ ID NO: 1127743 - protein, 18 aa, Mycobacterium
RTTMLVRAGDRWLGAIGL

SEQ ID NO: 1127744 - protein, 18 aa, Mycobacterium
RTTMLVRAGERWLGAIGL

SEQ ID NO: 1127745 - protein, 30 aa, Mycobacterium
RTTPWAFHDALYFAKRVQIRAAEQGYSSEN

SEQ ID NO: 1127746 - protein, 27 aa, Mycobacterium
RTTQWPVVVGGSLSFAVASAGVLAGAI

SEQ ID NO: 1127747 - protein, 20 aa, Mycobacterium
RTVDLRRKILFTLGIVILYR

SEQ ID NO: 1127748 - protein, 18 aa, Mycobacterium
RTVLARLGAPVFLSAFAV

SEQ ID NO: 1127749 - protein, 19 aa, Mycobacterium
RTVMFSAVILVASSVPLLL

SEQ ID NO: 1127750 - protein, 19 aa, Mycobacterium
RTVSLAAFSAVLAGAVTAY

SEQ ID NO: 1127751 - protein, 24 aa, Mycobacterium
RTVSWVIGCLALLFATSSGLGMYM

SEQ ID NO: 1127752 - protein, 25 aa, Mycobacterium
RVAASSRGAGPMGFTGTAPGAADAR

SEQ ID NO: 1127753 - protein, 18 aa, Mycobacterium
RVADLYYLVAGWVATTVI

SEQ ID NO: 1127754 - protein, 24 aa, Mycobacterium
RVAPCLPGATLLSIDGDTFNGAVK

SEQ ID NO: 1127755 - protein, 25 aa, Mycobacterium
RVDMLEMLPTPWGLVRSGVAPDHPK

SEQ ID NO: 1127756 - protein, 23 aa, Mycobacterium
RVDTPWLYLSFIGIGWLVGYLMR

SEQ ID NO: 1127757 - protein, 17 aa, Mycobacterium
RVEELGFTHLLAYDHVV

SEQ ID NO: 1127758 - protein, 19 aa, Mycobacterium
RVFSGLFAAAAVVLALVRR

SEQ ID NO: 1127759 - protein, 19 aa, Mycobacterium
RVGALLFWIALAGLTPTGL

SEQ ID NO: 1127760 - protein, 19 aa, Mycobacterium
RVGQPKSRCQAIEVAIGMT

SEQ ID NO: 1127761 - protein, 21 aa, Mycobacterium
RVGRDGVVFDCLKFRSMRPAP

SEQ ID NO: 1127762 - protein, 25 aa, Mycobacterium
RVGRVLNRWGTPFFFQQAAGAFIAT

SEQ ID NO: 1127763 - protein, 20 aa, Mycobacterium
RVIAAFERWTVPPTVAVLVA

SEQ ID NO: 1127764 - protein, 22 aa, Mycobacterium
RVIKQNLWASLGIVAVLIPATV

SEQ ID NO: 1127765 - protein, 23 aa, Mycobacterium
RVIKQNLWASLGIVAVLIPATVF

SEQ ID NO: 1127766 - protein, 20 aa, Mycobacterium
RVISGLLLIIAIGFLTSVFV

SEQ ID NO: 1127767 - protein, 18 aa, Mycobacterium
RVKGRSLLRNRLAWTVTL

SEQ ID NO: 1127768 - protein, 26 aa, Mycobacterium
RVLALSRRATTSGGRRIGTVTTMRDS

SEQ ID NO: 1127769 - protein, 21 aa, Mycobacterium
RVLDVIWAFPVLLLGIALGTA

SEQ ID NO: 1127770 - protein, 18 aa, Mycobacterium
RVLGRFDLAVAVFFALSG

SEQ ID NO: 1127771 - protein, 17 aa, Mycobacterium
RVLGRSVDGVAWMVGLT

SEQ ID NO: 1127772 - protein, 18 aa, Mycobacterium
RVLGSAWASLRTQREVFV

SEQ ID NO: 1127773 - protein, 20 aa, Mycobacterium
RVLIVVALLLVYTAPSADAV

SEQ ID NO: 1127774 - protein, 17 aa, Mycobacterium
RVLRGLYYFFLGVVVLQ

SEQ ID NO: 1127775 - protein, 26 aa, Mycobacterium
RVLVLRPAGRESLGAMGVIPLSRTGS

SEQ ID NO: 1127776 - protein, 18 aa, Mycobacterium
RVMCALTHGLMWSVIAPI

SEQ ID NO: 1127777 - protein, 21 aa, Mycobacterium
RVMCALTHGLMWSVIAPIGVR

SEQ ID NO: 1127778 - protein, 22 aa, Mycobacterium
RVMCALTHGLMWSVIAPIGVRL

SEQ ID NO: 1127779 - protein, 18 aa, Mycobacterium
RVMGPGLLLLFVVGDILG

SEQ ID NO: 1127780 - protein, 20 aa, Mycobacterium
RVMGPGLLLLFVVGDILGTG

SEQ ID NO: 1127781 - protein, 18 aa, Mycobacterium
RVNSRLTTFGLLGGTMIG

SEQ ID NO: 1127782 - protein, 17 aa, Mycobacterium
RVNSRLTTFGLLGGTVV

SEQ ID NO: 1127783 - protein, 34 aa, Mycobacterium
RVPDRKLAAVGFCMGGGMVWRLLAAGEPRLAAAV

SEQ ID NO: 1127784 - protein, 18 aa, Mycobacterium
RVPERDPRTEVGRLSLAL

SEQ ID NO: 1127785 - protein, 17 aa, Mycobacterium
RVPGNGADAMFVNVGTY

SEQ ID NO: 1127786 - protein, 27 aa, Mycobacterium
RVPPRKLGYRLAWLYNVLFIVSVYGIA

SEQ ID NO: 1127787 - protein, 20 aa, Mycobacterium
RVPRPWLGTFRRDVGPSLYA

SEQ ID NO: 1127788 - protein, 19 aa, Mycobacterium
RVRDFRVAAVIGGLIPIPL

SEQ ID NO: 1127789 - protein, 19 aa, Mycobacterium
RVREAYVLQYGEIFTITAV

SEQ ID NO: 1127790 - protein, 31 aa, Mycobacterium
RVRKYLTLMSFRIPALILAAVAYGIWHNGLI

SEQ ID NO: 1127791 - protein, 30 aa, Mycobacterium
RVRKYLTLMSFRIPALILAAVAYSIWENGL

SEQ ID NO: 1127792 - protein, 24 aa, Mycobacterium
RVRVLEIVPFFSLLGGVVSMSLTL

SEQ ID NO: 1127793 - protein, 19 aa, Mycobacterium
RVSNLFLTKTVYSVLLAVL

SEQ ID NO: 1127794 - protein, 23 aa, Mycobacterium
RVSRGEGGLMVAAYLAYLAFVIT

SEQ ID NO: 1127795 - protein, 18 aa, Mycobacterium
RVTVVVDDAMTWLRSVDR

SEQ ID NO: 1127796 - protein, 21 aa, Mycobacterium
RVTYRRGFVTRHQVTGWRFVM

SEQ ID NO: 1127797 - protein, 22 aa, Mycobacterium
RVVCAVCAIAALLLAVTAGSDL

SEQ ID NO: 1127798 - protein, 25 aa, Mycobacterium
RVVKRRGQESFNFGELFAYTKVCSH

SEQ ID NO: 1127799 - protein, 20 aa, Mycobacterium
RVVPLPRRLSGLLEAESGFN

SEQ ID NO: 1127800 - protein, 17 aa, Mycobacterium
RVVPRAMWQAVLASGVL

SEQ ID NO: 1127801 - protein, 26 aa, Mycobacterium
RVWRAVFGTAIGFLFGAVLISLVGVN

SEQ ID NO: 1127802 - protein, 17 aa, Mycobacterium
RVYKPYPYILAIVDELA

SEQ ID NO: 1127803 - protein, 22 aa, Mycobacterium
RVYRTRLWLRSERNISVIENGS

SEQ ID NO: 1127804 - protein, 26 aa, Mycobacterium
RWAGLGKRYPVVGIVFSLFLLAFAGI

SEQ ID NO: 1127805 - protein, 20 aa, Mycobacterium
RWAVFAVWLLLLVPSIYLAL

SEQ ID NO: 1127806 - protein, 18 aa, Mycobacterium
RWLAPLSFAGIFVTALVG

SEQ ID NO: 1127807 - protein, 18 aa, Mycobacterium
RWLPKRPSAAILAAGVGG

SEQ ID NO: 1127808 - protein, 26 aa, Mycobacterium
RWLRRPVVQAKLWLQDAIAGMPKFPD

SEQ ID NO: 1127809 - protein, 22 aa, Mycobacterium
RWQAQWPAIAAVGLGALAVSLL

SEQ ID NO: 1127810 - protein, 19 aa, Mycobacterium
RWRTLTAVDGVVVGGFALW

SEQ ID NO: 1127811 - protein, 19 aa, Mycobacterium
RWSALGFAVFGGGLYIAYA

SEQ ID NO: 1127812 - protein, 18 aa, Mycobacterium
RWVFVPLVPVALAGLIGT

SEQ ID NO: 1127813 - protein, 20 aa, Mycobacterium
RYASEQFWRIPGGMAGVWTA

SEQ ID NO: 1127814 - protein, 19 aa, Mycobacterium
RYDKMLFLVLKTVTYVEHD

SEQ ID NO: 1127815 - protein, 17 aa, Mycobacterium
RYFRARGLLRLHQVFIG

SEQ ID NO: 1127816 - protein, 17 aa, Mycobacterium
RYLSIPRWGLVERFDVP

SEQ ID NO: 1127817 - protein, 28 aa, Mycobacterium
RYPAAEVRRTWRPVTVLLLVAMPLMAVV

SEQ ID NO: 1127818 - protein, 25 aa, Mycobacterium
RYPHGMPPALVIRIVTAVGEALDYA

SEQ ID NO: 1127819 - protein, 21 aa, Mycobacterium
RYPHRRSRMVLAIITSNAVVW

SEQ ID NO: 1127820 - protein, 37 aa, Mycobacterium
RYRAEEYVRLAARRQWPVLVGRWLFHGALGAVVAVAA

SEQ ID NO: 1127821 - protein, 18 aa, Mycobacterium
RYRVHRWDLDATAVYTRS

SEQ ID NO: 1127822 - protein, 19 aa, Mycobacterium
SAAANWGVVGWSMGGTCAV

SEQ ID NO: 1127823 - protein, 22 aa, Mycobacterium
SAADSGTPWVLYTIIGISAAVI

SEQ ID NO: 1127824 - protein, 18 aa, Mycobacterium
SAAIPVRVFLLLIASAVA

SEQ ID NO: 1127825 - protein, 22 aa, Mycobacterium
SAALCALAVLALGVPVWTIVRW

SEQ ID NO: 1127826 - protein, 41 aa, Mycobacterium
SAALTYLLHGRWRSRVDLRHPAVVRALRLDGVVPQPVSPAL

SEQ ID NO: 1127827 - protein, 19 aa, Mycobacterium
SAAPAPRVAAPAVPSLPAE

SEQ ID NO: 1127828 - protein, 22 aa, Mycobacterium
SAAPGPLLIGWVVTGVGMLMLA

SEQ ID NO: 1127829 - protein, 17 aa, Mycobacterium
SAARFTRKPIAFAGIRQ

SEQ ID NO: 1127830 - protein, 19 aa, Mycobacterium
SAATGRLWGFTAALTTDER

SEQ ID NO: 1127831 - protein, 26 aa, Mycobacterium
SAAVLLIGMGRWYLGMSSRHATGTSA

SEQ ID NO: 1127832 - protein, 20 aa, Mycobacterium
SAAVYLGLLISWYAGTAGGA

SEQ ID NO: 1127833 - protein, 21 aa, Mycobacterium
SACGFSLGLVYAFTTVATQAV

SEQ ID NO: 1127834 - protein, 23 aa, Mycobacterium
SADGFAAALFRLLAIATGLFAAT

SEQ ID NO: 1127835 - protein, 25 aa, Mycobacterium
SADGHVVTGAWSYRVLAAGPTPPAA

SEQ ID NO: 1127836 - protein, 20 aa, Mycobacterium
SADLARVMLRAPALGPALED

SEQ ID NO: 1127837 - protein, 25 aa, Mycobacterium
SADRKAWYLPVGVTGTLGDPTAAES

SEQ ID NO: 1127838 - protein, 18 aa, Mycobacterium
SADTRMSTVTIRLANEAP

SEQ ID NO: 1127839 - protein, 25 aa, Mycobacterium
SADVIHGFWVPEFLFKRDVMPNPEE

SEQ ID NO: 1127840 - protein, 18 aa, Mycobacterium
SAFAGITVNTEWYNTALG

SEQ ID NO: 1127841 - protein, 17 aa, Mycobacterium
SAFARTEFQAVQFMPLV

SEQ ID NO: 1127842 - protein, 18 aa, Mycobacterium
SAFGELTGSSFGVILAVI

SEQ ID NO: 1127843 - protein, 25 aa, Mycobacterium
SAFIPRFLFAVGFPGIVVATACYMI

SEQ ID NO: 1127844 - protein, 19 aa, Mycobacterium
SAGFCMSVLLLRLVADRAL

SEQ ID NO: 1127845 - protein, 28 aa, Mycobacterium
SAGGALARYGLVVVIAWIGALKFTEYEA

SEQ ID NO: 1127846 - protein, 18 aa, Mycobacterium
SAGGPRPDQVLMRQHLML

SEQ ID NO: 1127847 - protein, 29 aa, Mycobacterium
SAGLDPYLREGWSVVAMRLTTDAASLAGP

SEQ ID NO: 1127848 - protein, 19 aa, Mycobacterium
SAHELRTPLTAMRTNVEVL

SEQ ID NO: 1127849 - protein, 18 aa, Mycobacterium
SAHLHPALMLLAVFAGLQ

SEQ ID NO: 1127850 - protein, 19 aa, Mycobacterium
SAICIFSVGLLRDHGGDVL

SEQ ID NO: 1127851 - protein, 19 aa, Mycobacterium
SAIGMWAGYYRGWRETLAM

SEQ ID NO: 1127852 - protein, 19 aa, Mycobacterium
SAIGQRFGPAGLLGVVTPA

SEQ ID NO: 1127853 - protein, 17 aa, Mycobacterium
SAIPSFWALPSRFLTGA

SEQ ID NO: 1127854 - protein, 25 aa, Mycobacterium
SAIVLCLGLPWVIYLPICYALPGPA

SEQ ID NO: 1127855 - protein, 20 aa, Mycobacterium
SAKQTWKTQPLFQVSAPMTK

SEQ ID NO: 1127856 - protein, 21 aa, Mycobacterium
SALCFVGAAVLLYVDLDRRRG

SEQ ID NO: 1127857 - protein, 18 aa, Mycobacterium
SALDFRMTALTAGIITLS

SEQ ID NO: 1127858 - protein, 27 aa, Mycobacterium
SALDHRFGWSSAPAWVVVVGNTLVALG

SEQ ID NO: 1127859 - protein, 21 aa, Mycobacterium
SALGLRVVKSFGREDYVYDRF

SEQ ID NO: 1127860 - protein, 26 aa, Mycobacterium
SALLGIPVGRWLDRHGPRWIMTGGSV

SEQ ID NO: 1127861 - protein, 24 aa, Mycobacterium
SALLLYRLARRGRDDVAVPVVGGI

SEQ ID NO: 1127862 - protein, 18 aa, Mycobacterium
SALMVGMVGVVQFAPQLI

SEQ ID NO: 1127863 - protein, 18 aa, Mycobacterium
SALQFAYYPVLFVALVVS

SEQ ID NO: 1127864 - protein, 18 aa, Mycobacterium
SALSGLTWEDGNDGARYG

SEQ ID NO: 1127865 - protein, 26 aa, Mycobacterium
SALWGKSLIGSVIFLVDFLGNFFQYH

SEQ ID NO: 1127866 - protein, 23 aa, Mycobacterium
SALYLILGAYSFPGADPTRVAAQ

SEQ ID NO: 1127867 - protein, 18 aa, Mycobacterium
SAMARWAGLGKRYPVVGI

SEQ ID NO: 1127868 - protein, 24 aa, Mycobacterium
SAMNSAWGFSKWWVAVGTVIVLAF

SEQ ID NO: 1127869 - protein, 25 aa, Mycobacterium
SAPERRTTVIAWYFGVGFAVAAPLP

SEQ ID NO: 1127870 - protein, 18 aa, Mycobacterium
SAPLLAAAVVVWCVTAVV

SEQ ID NO: 1127871 - protein, 23 aa, Mycobacterium
SAPRIETVRRWTIGWDGAMASEG

SEQ ID NO: 1127872 - protein, 25 aa, Mycobacterium
SAQEWLKSAVPFGGFPWGTVAFSQT

SEQ ID NO: 1127873 - protein, 23 aa, Mycobacterium
SARIPTPVILVVVATLLFGVFAN

SEQ ID NO: 1127874 - protein, 23 aa, Mycobacterium
SARSMPGSGLGLAIVKQVVLKHG

SEQ ID NO: 1127875 - protein, 18 aa, Mycobacterium
SASGLGFAIPVNEVKQVV

SEQ ID NO: 1127876 - protein, 19 aa, Mycobacterium
SASGLGFAIPVNEVKTVVE

SEQ ID NO: 1127877 - protein, 25 aa, Mycobacterium
SASRFWPEIERTGARVVNLIGGLPA

SEQ ID NO: 1127878 - protein, 22 aa, Mycobacterium
SASRLRPGDIIEVHADEVVPAD

SEQ ID NO: 1127879 - protein, 29 aa, Mycobacterium
SATHWFRGDPWLTFDMIQGGHCLRYNERR

SEQ ID NO: 1127880 - protein, 26 aa, Mycobacterium
SATLLALPMRGFMFVTRPLLRGLNAA

SEQ ID NO: 1127881 - protein, 30 aa, Mycobacterium
SATPAWGESALRWLLFAGLAAAVGGLIGRH

SEQ ID NO: 1127882 - protein, 23 aa, Mycobacterium
SATPTEAVVLLFVNQTVSVGADV

SEQ ID NO: 1127883 - protein, 19 aa, Mycobacterium
SATRARGLIWLAIAAALAP

SEQ ID NO: 1127884 - protein, 24 aa, Mycobacterium
SATSGRMLYAFGRDGFGPKALAHI

SEQ ID NO: 1127885 - protein, 34 aa, Mycobacterium
SAVARRPQGPAAWMLGAATGWLAAAVVYEAGRLL

SEQ ID NO: 1127886 - protein, 18 aa, Mycobacterium
SAVLAQRLVALGAGKGTH

SEQ ID NO: 1127887 - protein, 26 aa, Mycobacterium
SAVLMAVVSGALWGLFAVLTKAVVHR

SEQ ID NO: 1127888 - protein, 20 aa, Mycobacterium
SAVLMLYTIVIIRGLRTAIA

SEQ ID NO: 1127889 - protein, 18 aa, Mycobacterium
SAVLSWLLLTVFAVACSR

SEQ ID NO: 1127890 - protein, 22 aa, Mycobacterium
SAVRAAAEWAPATLLIVATLTI

SEQ ID NO: 1127891 - protein, 22 aa, Mycobacterium
SAVRAAAEWAPATLLLVATLTI

SEQ ID NO: 1127892 - protein, 18 aa, Mycobacterium
SAVSSREGVEIAIDDDGV

SEQ ID NO: 1127893 - protein, 20 aa, Mycobacterium
SAVWCGPCAGVRRVVDQVCA

SEQ ID NO: 1127894 - protein, 17 aa, Mycobacterium
SAWMGSVVFGWWLAVVV

SEQ ID NO: 1127895 - protein, 27 aa, Mycobacterium
SAYDVALFYRYAWRNPTFTEIVATRTY

SEQ ID NO: 1127896 - protein, 20 aa, Mycobacterium
SAYLLAKVVVFTAFAIVQAA

SEQ ID NO: 1127897 - protein, 17 aa, Mycobacterium
SCLIKGSTLIDPPWPED

SEQ ID NO: 1127898 - protein, 18 aa, Mycobacterium
SCRWEVAATLNIALQLGA

SEQ ID NO: 1127899 - protein, 21 aa, Mycobacterium
SCSIGATLGNGGWSTLLNSAK

SEQ ID NO: 1127900 - protein, 25 aa, Mycobacterium
SDAVLRPLSRYAFALLAYAFAVTMV

SEQ ID NO: 1127901 - protein, 26 aa, Mycobacterium
SDAVPRPLSRYAFALLAYAFAVTMVG

SEQ ID NO: 1127902 - protein, 26 aa, Mycobacterium
SDDLRASLPLLTRGLIGRRRPRGLRV

SEQ ID NO: 1127903 - protein, 20 aa, Mycobacterium
SDERMNWSIFGWTAPSNWIG

SEQ ID NO: 1127904 - protein, 17 aa, Mycobacterium
SDFRLSLLGKFLCFAIV

SEQ ID NO: 1127905 - protein, 18 aa, Mycobacterium
SDGLKQLLFGPIDGPPRN

SEQ ID NO: 1127906 - protein, 19 aa, Mycobacterium
SDGRTAVVVGWDGQARGVL

SEQ ID NO: 1127907 - protein, 18 aa, Mycobacterium
SDGSRYDLLIAVISALCL

SEQ ID NO: 1127908 - protein, 19 aa, Mycobacterium
SDHIGWFIVYVTVVIGVSL

SEQ ID NO: 1127909 - protein, 20 aa, Mycobacterium
SDILWSLFQAVLMGFVVMLV

SEQ ID NO: 1127910 - protein, 26 aa, Mycobacterium
SDITAGVPVALCWPAQNGDGPLHGDR

SEQ ID NO: 1127911 - protein, 18 aa, Mycobacterium
SDLLLGRLTRGYLHRRWE

SEQ ID NO: 1127912 - protein, 21 aa, Mycobacterium
SDLRVGQDVVAIGSPLGLEGT

SEQ ID NO: 1127913 - protein, 24 aa, Mycobacterium
SDPSRVRRSGGTGLGLAISIEDAR

SEQ ID NO: 1127914 - protein, 20 aa, Mycobacterium
SDPTQNWAAIGAELEDAIAT

SEQ ID NO: 1127915 - protein, 21 aa, Mycobacterium
SDRHKVVIIGSGFGGLTAAKT

SEQ ID NO: 1127916 - protein, 21 aa, Mycobacterium
SDSASGLGFAIPVNEVKTVVE

SEQ ID NO: 1127917 - protein, 33 aa, Mycobacterium
SDTELPRQFGYNMPLELVLTVIPFLIISVLFYF

SEQ ID NO: 1127918 - protein, 17 aa, Mycobacterium
SDTVPLYTAELLNLGKF

SEQ ID NO: 1127919 - protein, 21 aa, Mycobacterium
SDVIAGWALGYAYFVACLLLV

SEQ ID NO: 1127920 - protein, 18 aa, Mycobacterium
SDYGQSWDSGRYAATDVE

SEQ ID NO: 1127921 - protein, 20 aa, Mycobacterium
SEAPGTFGYLIGFYGAAGIM

SEQ ID NO: 1127922 - protein, 23 aa, Mycobacterium
SEDGKAWFLPVGIVGTLGDPQAA

SEQ ID NO: 1127923 - protein, 24 aa, Mycobacterium
SEERFRLAFDTAPVGMFMFDVTPD

SEQ ID NO: 1127924 - protein, 20 aa, Mycobacterium
SEGMVAWIVGMVAIIAAALW

SEQ ID NO: 1127925 - protein, 29 aa, Mycobacterium
SEGPKRYAGWSSCFRREAGSYGKDTRGII

SEQ ID NO: 1127926 - protein, 26 aa, Mycobacterium
SEHPLAAAIVRYAAERGVTPLPLSAF

SEQ ID NO: 1127927 - protein, 24 aa, Mycobacterium
SEPALRPLVDLLPIAGGSGTLSNR

SEQ ID NO: 1127928 - protein, 20 aa, Mycobacterium
SERKLQLALLIPILPFGFAF

SEQ ID NO: 1127929 - protein, 20 aa, Mycobacterium
SESLFFKMIPYILLTLLFGS

SEQ ID NO: 1127930 - protein, 28 aa, Mycobacterium
SESSGLKWTWWWLLAIVPVLLLAGLAAF

SEQ ID NO: 1127931 - protein, 18 aa, Mycobacterium
SESSRTALLLSLKTATAS

SEQ ID NO: 1127932 - protein, 26 aa, Mycobacterium
SESVSGRTALHAALGCLALTACVAVV

SEQ ID NO: 1127933 - protein, 18 aa, Mycobacterium
SETGTAFRRLFANPWLWV

SEQ ID NO: 1127934 - protein, 25 aa, Mycobacterium
SETLGIAHFDIWPGDDVPPAVVPAG

SEQ ID NO: 1127935 - protein, 21 aa, Mycobacterium
SEVPGRIATRLRELGIRSAAG

SEQ ID NO: 1127936 - protein, 18 aa, Mycobacterium
SFACALAFHNAASRYLFA

SEQ ID NO: 1127937 - protein, 19 aa, Mycobacterium
SFELPELPFGGGLFGSGSN

SEQ ID NO: 1127938 - protein, 19 aa, Mycobacterium
SFFFVGWFLYNAMPTGFIE

SEQ ID NO: 1127939 - protein, 20 aa, Mycobacterium
SFFQCVAMTVVIMLVHTYYG

SEQ ID NO: 1127940 - protein, 20 aa, Mycobacterium
SFGWPSRMLMINQFGINLGF

SEQ ID NO: 1127941 - protein, 33 aa, Mycobacterium
SFLHFAAAMSLPWLAAIAVEFVLLRWFFAKDLA

SEQ ID NO: 1127942 - protein, 18 aa, Mycobacterium
SFLLNWPIWADGIVFLLV

SEQ ID NO: 1127943 - protein, 23 aa, Mycobacterium
SFMPAELDGPVLFVLLDQYAPAG

SEQ ID NO: 1127944 - protein, 18 aa, Mycobacterium
SFSASRFWDDVIRYDATA

SEQ ID NO: 1127945 - protein, 18 aa, Mycobacterium
SFTGWRGFDPELGFWEPP

SEQ ID NO: 1127946 - protein, 18 aa, Mycobacterium
SFVDVPRLAHHCAAAAQE

SEQ ID NO: 1127947 - protein, 25 aa, Mycobacterium
SGAEAISVGGVRIGPNVTMRQAGGG

SEQ ID NO: 1127948 - protein, 25 aa, Mycobacterium
SGAELPEPLLRSAMVTIAGTEPATV

SEQ ID NO: 1127949 - protein, 25 aa, Mycobacterium
SGARAVADVRFDFPITVDAPRVVQV

SEQ ID NO: 1127950 - protein, 20 aa, Mycobacterium
SGAVAWFIGIFYKNLYVEGL

SEQ ID NO: 1127951 - protein, 20 aa, Mycobacterium
SGAVCGVVLILLVARIARRI

SEQ ID NO: 1127952 - protein, 38 aa, Mycobacterium
SGAYTVPDFAEFRLGSPRLRKVAMLVVVVICIFYLVPQ

SEQ ID NO: 1127953 - protein, 23 aa, Mycobacterium
SGCSWSEVLGLGWPNGITPEAHL

SEQ ID NO: 1127954 - protein, 22 aa, Mycobacterium
SGDARGGILVIHENKGLNDWVR

SEQ ID NO: 1127955 - protein, 19 aa, Mycobacterium
SGFFAAASLLKFGDSPENR

SEQ ID NO: 1127956 - protein, 17 aa, Mycobacterium
SGFLAAYLAGVVLANSG

SEQ ID NO: 1127957 - protein, 24 aa, Mycobacterium
SGGARFFVDLSVAAFRRSRSAAGR

SEQ ID NO: 1127958 - protein, 22 aa, Mycobacterium
SGGRARWERLALLTLLAATAVL

SEQ ID NO: 1127959 - protein, 18 aa, Mycobacterium
SGGSRFYLSLVIFVGAAF

SEQ ID NO: 1127960 - protein, 22 aa, Mycobacterium
SGGVPIGNWLTRSVFAAKYAER

SEQ ID NO: 1127961 - protein, 24 aa, Mycobacterium
SGKSEFLQSWIMGMAAAHSPDRVS

SEQ ID NO: 1127962 - protein, 18 aa, Mycobacterium
SGLAPLGLVATGFALVAA

SEQ ID NO: 1127963 - protein, 19 aa, Mycobacterium
SGLFAYIAGASFVLQGRFG

SEQ ID NO: 1127964 - protein, 17 aa, Mycobacterium
SGLIKGAAEWPALDDSD

SEQ ID NO: 1127965 - protein, 19 aa, Mycobacterium
SGLISRPAPKYVCPPDCGS

SEQ ID NO: 1127966 - protein, 24 aa, Mycobacterium
SGLLLEGDRPIGFVMPRVDTATAV

SEQ ID NO: 1127967 - protein, 19 aa, Mycobacterium
SGLMAAASLAFINTIGLIG

SEQ ID NO: 1127968 - protein, 19 aa, Mycobacterium
SGLMSLVMGGLVLVIVAVV

SEQ ID NO: 1127969 - protein, 21 aa, Mycobacterium
SGLSRRKLFGAAGVTAAVVGA

SEQ ID NO: 1127970 - protein, 17 aa, Mycobacterium
SGNTFTCLVRFALANIR

SEQ ID NO: 1127971 - protein, 26 aa, Mycobacterium
SGPFFKAYVANLLPGQFVQPFIDAAF

SEQ ID NO: 1127972 - protein, 33 aa, Mycobacterium
SGPFFKTYVANLLPGQFLQPFIDSAFSDLGVDP

SEQ ID NO: 1127973 - protein, 25 aa, Mycobacterium
SGPLADRTGRFWTWTIGGYFLTVVT

SEQ ID NO: 1127974 - protein, 30 aa, Mycobacterium
SGPRYLLSSWPWRALVWTMFGGVLSAVLLI

SEQ ID NO: 1127975 - protein, 18 aa, Mycobacterium
SGPVPADEQASMTLESGR

SEQ ID NO: 1127976 - protein, 29 aa, Mycobacterium
SGPWLPARWRHWWWALLLAFVPIHLVVSA

SEQ ID NO: 1127977 - protein, 25 aa, Mycobacterium
SGQLRPVYNLTSARLILGDGKTPVA

SEQ ID NO: 1127978 - protein, 25 aa, Mycobacterium
SGRFIDRFGARPVLVVAALAGIAGF

SEQ ID NO: 1127979 - protein, 22 aa, Mycobacterium
SGRRRFPGFEWLRQPESYSDRE

SEQ ID NO: 1127980 - protein, 19 aa, Mycobacterium
SGSAVVRALYTWRWSLVTL

SEQ ID NO: 1127981 - protein, 19 aa, Mycobacterium
SGSTHGYSAVFADSSSLES

SEQ ID NO: 1127982 - protein, 17 aa, Mycobacterium
SGTLALRVAARGRPPFY

SEQ ID NO: 1127983 - protein, 25 aa, Mycobacterium
SGTLLFKLTPWIVVGLFALGAAMAL

SEQ ID NO: 1127984 - protein, 28 aa, Mycobacterium
SGTSIVMCIALLFGVAFLFFGPREALFP

SEQ ID NO: 1127985 - protein, 33 aa, Mycobacterium
SGYVTRLIPDFTRWSPCQVLALVGNMRLLSQTA

SEQ ID NO: 1127986 - protein, 20 aa, Mycobacterium
SHARRARRIMLQNVGLSLAL

SEQ ID NO: 1127987 - protein, 21 aa, Mycobacterium
SHARRARRIMLQNVGLSLALI

SEQ ID NO: 1127988 - protein, 23 aa, Mycobacterium
SHELRTPLTTVRMAADLIHDHSD

SEQ ID NO: 1127989 - protein, 17 aa, Mycobacterium
SHGRWMRVGLAALLVVT

SEQ ID NO: 1127990 - protein, 25 aa, Mycobacterium
SHISGPRTKLFVTLFLILALVVIGE

SEQ ID NO: 1127991 - protein, 20 aa, Mycobacterium
SHKIGVLWRFHAVHHSITRF

SEQ ID NO: 1127992 - protein, 19 aa, Mycobacterium
SHKIGVLWRFHAVHHSVTR

SEQ ID NO: 1127993 - protein, 23 aa, Mycobacterium
SHLADHGWICVSIDYRVSPRNTW

SEQ ID NO: 1127994 - protein, 23 aa, Mycobacterium
SHLQRGYCRLMLRSLGVRMSVSG

SEQ ID NO: 1127995 - protein, 17 aa, Mycobacterium
SHPLLSLGLPVLFIALG

SEQ ID NO: 1127996 - protein, 20 aa, Mycobacterium
SHRRVVLLIYLWVGIAALGA

SEQ ID NO: 1127997 - protein, 25 aa, Mycobacterium
SHTTALWLIPLVVVGAIVAGAVAVV

SEQ ID NO: 1127998 - protein, 17 aa, Mycobacterium
SHVRIAAAIMASIIVAA

SEQ ID NO: 1127999 - protein, 21 aa, Mycobacterium
SIAAGVLYFFFVLPRTPELVG

SEQ ID NO: 1128000 - protein, 21 aa, Mycobacterium
SIAARLAWTYLVPNGANFVDL

SEQ ID NO: 1128001 - protein, 23 aa, Mycobacterium
SIAFAVGVIRLGRRQCLVNELPA

SEQ ID NO: 1128002 - protein, 25 aa, Mycobacterium
SIAGALCRPAAAAVPMGLVLLGLAR

SEQ ID NO: 1128003 - protein, 20 aa, Mycobacterium
SIASMYAFTAILWNLSGPVT

SEQ ID NO: 1128004 - protein, 18 aa, Mycobacterium
SIDYLAALALIVASGAAA

SEQ ID NO: 1128005 - protein, 26 aa, Mycobacterium
SIGLADEVLYFFLVESAIVFLAAYVV

SEQ ID NO: 1128006 - protein, 19 aa, Mycobacterium
SIGLLVWNRRCRPWVLAAG

SEQ ID NO: 1128007 - protein, 25 aa, Mycobacterium
SIIANRVSYYFDLRGPSVTIDTACS

SEQ ID NO: 1128008 - protein, 24 aa, Mycobacterium
SIIVVWRFTGAWTLSETAERRSQQ

SEQ ID NO: 1128009 - protein, 24 aa, Mycobacterium
SIMARLPIVLGIIAVITFVLLFLL

SEQ ID NO: 1128010 - protein, 18 aa, Mycobacterium
SISMGGFPAALRDTRDYY

SEQ ID NO: 1128011 - protein, 17 aa, Mycobacterium
SISMGGFPASLRDTRDY

SEQ ID NO: 1128012 - protein, 19 aa, Mycobacterium
SKASTVWQRAAVTAVLVVG

SEQ ID NO: 1128013 - protein, 20 aa, Mycobacterium
SKDKLAAWIPPGPTATADFP

SEQ ID NO: 1128014 - protein, 18 aa, Mycobacterium
SKDKVVVLLFVDQSVSNT

SEQ ID NO: 1128015 - protein, 23 aa, Mycobacterium
SKILECSTGEFGVQAGLFSSVLA

SEQ ID NO: 1128016 - protein, 20 aa, Mycobacterium
SKLIAERVVDAFDEPFVLHG

SEQ ID NO: 1128017 - protein, 18 aa, Mycobacterium
SKVALYLLITIAPFAVIA

SEQ ID NO: 1128018 - protein, 23 aa, Mycobacterium
SKVRGPKLLWRTLSVVQPVGPLA

SEQ ID NO: 1128019 - protein, 21 aa, Mycobacterium
SKWYRRLRKPGFQPPRAAFPI

SEQ ID NO: 1128020 - protein, 24 aa, Mycobacterium
SLAELRLHLPAPRDGVTARQALGG

SEQ ID NO: 1128021 - protein, 23 aa, Mycobacterium
SLAGLLTRFNWVPPWPQAYSRSS

SEQ ID NO: 1128022 - protein, 26 aa, Mycobacterium
SLAILWGFAGIVFISFYSANLSATLT

SEQ ID NO: 1128023 - protein, 24 aa, Mycobacterium
SLALALLFWQWRKIPFVVWDVTYQ

SEQ ID NO: 1128024 - protein, 17 aa, Mycobacterium
SLANRWVPQISAKKSGL

SEQ ID NO: 1128025 - protein, 29 aa, Mycobacterium
SLATIWIRTGLMPRWTAVITYLVAALLIV

SEQ ID NO: 1128026 - protein, 20 aa, Mycobacterium
SLAVYVGLLISWHAERPEGR

SEQ ID NO: 1128027 - protein, 25 aa, Mycobacterium
SLFAGFPALLIVVALLIGSALLSHP

SEQ ID NO: 1128028 - protein, 20 aa, Mycobacterium
SLFYYLRWIIPAFGRPHETG

SEQ ID NO: 1128029 - protein, 20 aa, Mycobacterium
SLGPRGNDTFDHAKSGDCLN

SEQ ID NO: 1128030 - protein, 18 aa, Mycobacterium
SLGSMAGQGAFDWLPDIP

SEQ ID NO: 1128031 - protein, 18 aa, Mycobacterium
SLHARGVEEVMIIGRRGP

SEQ ID NO: 1128032 - protein, 17 aa, Mycobacterium
SLIAAVFVILFASLAIY

SEQ ID NO: 1128033 - protein, 17 aa, Mycobacterium
SLIACYKGISVGGGPQG

SEQ ID NO: 1128034 - protein, 32 aa, Mycobacterium
SLIASVSPLVRWIIRVPREFVNDYIFNFPDTS

SEQ ID NO: 1128035 - protein, 18 aa, Mycobacterium
SLIAVLVMLGLSMAVIAV

SEQ ID NO: 1128036 - protein, 18 aa, Mycobacterium
SLIEPDPSLGVTRADPAA

SEQ ID NO: 1128037 - protein, 18 aa, Mycobacterium
SLLAMAAAALGWLPPAAG

SEQ ID NO: 1128038 - protein, 21 aa, Mycobacterium
SLLNDMAWFFFIAPVGSIAVQ

SEQ ID NO: 1128039 - protein, 20 aa, Mycobacterium
SLLVALGFALLAVRAPRPVL

SEQ ID NO: 1128040 - protein, 19 aa, Mycobacterium
SLLVTLAIAIAVDYAIFLV

SEQ ID NO: 1128041 - protein, 19 aa, Mycobacterium
SLMTVRGAVAFLGFHDIIG

SEQ ID NO: 1128042 - protein, 28 aa, Mycobacterium
SLNMAALWRLPVLFCCENNLYAMGTALE

SEQ ID NO: 1128043 - protein, 19 aa, Mycobacterium
SLNPVLSCGSVMVTPQAAL

SEQ ID NO: 1128044 - protein, 19 aa, Mycobacterium
SLPALRQAVATAFEDPTLF

SEQ ID NO: 1128045 - protein, 28 aa, Mycobacterium
SLPDLDAAVGYTEYYLAAKIPLQQQIFA

SEQ ID NO: 1128046 - protein, 19 aa, Mycobacterium
SLPDVSKNWPVRHLVTDTG

SEQ ID NO: 1128047 - protein, 17 aa, Mycobacterium
SLPRSFWTYAGFSAATM

SEQ ID NO: 1128048 - protein, 18 aa, Mycobacterium
SLPSLLIPDVPLTFDTLR

SEQ ID NO: 1128049 - protein, 18 aa, Mycobacterium
SLRASRLQTLRWIVVPSL

SEQ ID NO: 1128050 - protein, 20 aa, Mycobacterium
SLRIEGRGAGWIATTAALGS

SEQ ID NO: 1128051 - protein, 25 aa, Mycobacterium
SLRRDGGVRWLEWNVVSDRGVLLGG

SEQ ID NO: 1128052 - protein, 19 aa, Mycobacterium
SLRSRLIVIQVLLLAAACA

SEQ ID NO: 1128053 - protein, 23 aa, Mycobacterium
SLRTRVAFATAIAAAIVVGIVGT

SEQ ID NO: 1128054 - protein, 25 aa, Mycobacterium
SLSRPAGDETFIWLTLALAGVWAAG

SEQ ID NO: 1128055 - protein, 30 aa, Mycobacterium
SLTRRFSVLILLLCLFGVLMVLLRRGSLPG

SEQ ID NO: 1128056 - protein, 25 aa, Mycobacterium
SLTVLRWSWTPALLAGGLVTLMPLA

SEQ ID NO: 1128057 - protein, 22 aa, Mycobacterium
SLVHSYPWWKGSPDNGRIVKSV

SEQ ID NO: 1128058 - protein, 18 aa, Mycobacterium
SLVLNWVFGPALMFALAW

SEQ ID NO: 1128059 - protein, 18 aa, Mycobacterium
SLVPLFAVAAVQISRTAT

SEQ ID NO: 1128060 - protein, 17 aa, Mycobacterium
SLVSADWLWVLAAAAAA

SEQ ID NO: 1128061 - protein, 25 aa, Mycobacterium
SLYRIGALCPYCMVVWAVTIPLLVV

SEQ ID NO: 1128062 - protein, 23 aa, Mycobacterium
SMAALPPFFGFVAKEADFETVLH

SEQ ID NO: 1128063 - protein, 42 aa, Mycobacterium
SMDLAHWAVALAMASTVLWFDELRKLALRALRRSGTPATERT

SEQ ID NO: 1128064 - protein, 24 aa, Mycobacterium
SMNFSARLMPEFAGAATKTGLTIG

SEQ ID NO: 1128065 - protein, 30 aa, Mycobacterium
SMQLSLPAWVRARGLSVYQLIFMGGQAIGS

SEQ ID NO: 1128066 - protein, 22 aa, Mycobacterium
SNAFAILGLRAMYFLLADLMHR

SEQ ID NO: 1128067 - protein, 18 aa, Mycobacterium
SNFWGRHLVMGLPMAAAL

SEQ ID NO: 1128068 - protein, 25 aa, Mycobacterium
SNGLNRFRTFFGFALNDPVNRRMLY

SEQ ID NO: 1128069 - protein, 26 aa, Mycobacterium
SNGRFVFGVGAGWNLEELRHHGTDPK

SEQ ID NO: 1128070 - protein, 25 aa, Mycobacterium
SNLLPGPAIQPFLDYALGYRRGVDA

SEQ ID NO: 1128071 - protein, 25 aa, Mycobacterium
SNLTAHGGFMPMGFGVITVGIVTVI

SEQ ID NO: 1128072 - protein, 18 aa, Mycobacterium
SNLVAIAALVGWAIALRY

SEQ ID NO: 1128073 - protein, 24 aa, Mycobacterium
SNQGYKLLDRHFAKDSVITQFLLV

SEQ ID NO: 1128074 - protein, 21 aa, Mycobacterium
SPDPRFGENLYYIDPQGVRYG

SEQ ID NO: 1128075 - protein, 21 aa, Mycobacterium
SPEPQFPWLPPAPPPRPQPRT

SEQ ID NO: 1128076 - protein, 22 aa, Mycobacterium
SPEVLRPEFLDIFADGFVADLE

SEQ ID NO: 1128077 - protein, 18 aa, Mycobacterium
SPEYTCLLQGAKLALDRG

SEQ ID NO: 1128078 - protein, 18 aa, Mycobacterium
SPGSFLLASRAFAIATLG

SEQ ID NO: 1128079 - protein, 20 aa, Mycobacterium
SPIAGMPVLTVWNADNVIVF

SEQ ID NO: 1128080 - protein, 22 aa, Mycobacterium
SPITVKHRIIFAVVALLGAVSW

SEQ ID NO: 1128081 - protein, 17 aa, Mycobacterium
SPKIPERVLEAPEPPVV

SEQ ID NO: 1128082 - protein, 24 aa, Mycobacterium
SPLLRHIKTGLVVTGERVIVRHPQ

SEQ ID NO: 1128083 - protein, 26 aa, Mycobacterium
SPLSGRLVGRYGARPSLVIAGVTITA

SEQ ID NO: 1128084 - protein, 17 aa, Mycobacterium
SPLSLGPINDLLFAAFR

SEQ ID NO: 1128085 - protein, 21 aa, Mycobacterium
SPMDMLYDWIEQLLYRLTASA

SEQ ID NO: 1128086 - protein, 26 aa, Mycobacterium
SPMNVRGARNYPCIEHPGKRAPTVEL

SEQ ID NO: 1128087 - protein, 17 aa, Mycobacterium
SPNPVFKSVAWVYLWIF

SEQ ID NO: 1128088 - protein, 20 aa, Mycobacterium
SPPPDQWPAPPPPPTGPPQG

SEQ ID NO: 1128089 - protein, 19 aa, Mycobacterium
SPPPVMPPQLAWWATTLAL

SEQ ID NO: 1128090 - protein, 18 aa, Mycobacterium
SPQARPALVGALGATLIT

SEQ ID NO: 1128091 - protein, 21 aa, Mycobacterium
SPQRISWRAGGMIAAVGSVLI

SEQ ID NO: 1128092 - protein, 33 aa, Mycobacterium
SPSQGVWHLGPFPVRAYALFIIVGIIAALVIGD

SEQ ID NO: 1128093 - protein, 28 aa, Mycobacterium
SPSRRPGGAPVRYRGTGVLVSRAPHRRR

SEQ ID NO: 1128094 - protein, 24 aa, Mycobacterium
SPVIGCVLKGTAVAVERFAPIIGG

SEQ ID NO: 1128095 - protein, 21 aa, Mycobacterium
SPVYRALWIAQFVSNLGTWMQ

SEQ ID NO: 1128096 - protein, 21 aa, Mycobacterium
SQEWAQFLPGYGVTRLLFDTS

SEQ ID NO: 1128097 - protein, 19 aa, Mycobacterium
SQGHTPVWVAWDGAVRGVI

SEQ ID NO: 1128098 - protein, 20 aa, Mycobacterium
SQGHTPVWVAWDGAVRGVIV

SEQ ID NO: 1128099 - protein, 23 aa, Mycobacterium
SQGPEWMRFPVGLDESGQVVDLD

SEQ ID NO: 1128100 - protein, 20 aa, Mycobacterium
SQQAPWPLIRAFAPGPALTR

SEQ ID NO: 1128101 - protein, 17 aa, Mycobacterium
SQQGMGMHSLFIGTTGA

SEQ ID NO: 1128102 - protein, 37 aa, Mycobacterium
SQRRRFSLAVVGSVAAAVLCLGGFGSVVYGAGPGDPL

SEQ ID NO: 1128103 - protein, 17 aa, Mycobacterium
SQSGGLLRRMLRRRRSR

SEQ ID NO: 1128104 - protein, 21 aa, Mycobacterium
SQTLRLGWMALPDNLIDAVLA

SEQ ID NO: 1128105 - protein, 21 aa, Mycobacterium
SQWPGMARQLLADEPAFANAL

SEQ ID NO: 1128106 - protein, 23 aa, Mycobacterium
SQYGLEFFAGWLTEYSLSVDNLF

SEQ ID NO: 1128107 - protein, 17 aa, Mycobacterium
SRAHYVYVGLELVKVIA

SEQ ID NO: 1128108 - protein, 19 aa, Mycobacterium
SRARLPFNLDPARTPVLGS

SEQ ID NO: 1128109 - protein, 20 aa, Mycobacterium
SRDDVIKMLADWTEMAERMT

SEQ ID NO: 1128110 - protein, 20 aa, Mycobacterium
SREKPWGVANIRSGATAAVI

SEQ ID NO: 1128111 - protein, 18 aa, Mycobacterium
SRFEVVEKVVTLTCVSNP

SEQ ID NO: 1128112 - protein, 24 aa, Mycobacterium
SRFLPVIGPWALYGLLFTIVILFA

SEQ ID NO: 1128113 - protein, 19 aa, Mycobacterium
SRGGMVFTLVCVAAVVIVV

SEQ ID NO: 1128114 - protein, 26 aa, Mycobacterium
SRGLMPRIALITIILMPLLYGAMYLW

SEQ ID NO: 1128115 - protein, 25 aa, Mycobacterium
SRHWLIEVPIRIVAYLTVALVIRFV

SEQ ID NO: 1128116 - protein, 19 aa, Mycobacterium
SRIAERFAEGHLSERMPVR

SEQ ID NO: 1128117 - protein, 25 aa, Mycobacterium
SRISDCLVEPGTLVWADVYASDHAI

SEQ ID NO: 1128118 - protein, 22 aa, Mycobacterium
SRKAPRLVRRFIRNQAAKTLPE

SEQ ID NO: 1128119 - protein, 20 aa, Mycobacterium
SRKAPTLALIVPGVIGFLLS

SEQ ID NO: 1128120 - protein, 25 aa, Mycobacterium
SRKKPRKEPALSLDRVVEGPYTLPP

SEQ ID NO: 1128121 - protein, 22 aa, Mycobacterium
SRLAASCRRIAEGNFGERIVPQ

SEQ ID NO: 1128122 - protein, 17 aa, Mycobacterium
SRLGAGLAAMLPGLVAF

SEQ ID NO: 1128123 - protein, 25 aa, Mycobacterium
SRLNSHHWIEICGLSGPDADAIADE

SEQ ID NO: 1128124 - protein, 20 aa, Mycobacterium
SRLQDLLSETFKAFNGSGPE

SEQ ID NO: 1128125 - protein, 19 aa, Mycobacterium
SRMLFAFSRDRAVPGHQLW

SEQ ID NO: 1128126 - protein, 23 aa, Mycobacterium
SRMNADHPHYKWIVLSNTTLGTL

SEQ ID NO: 1128127 - protein, 21 aa, Mycobacterium
SRMVLGAAILTVFFIVELSTA

SEQ ID NO: 1128128 - protein, 23 aa, Mycobacterium
SRNRATALFGAWLGVVAGAWLVV

SEQ ID NO: 1128129 - protein, 24 aa, Mycobacterium
SRNRATALFGAWLGVVAGAWLVVG

SEQ ID NO: 1128130 - protein, 24 aa, Mycobacterium
SRNRATALFGAWLGVVAGSWLVVG

SEQ ID NO: 1128131 - protein, 19 aa, Mycobacterium
SRPAVQVGALLAAGAGIGL

SEQ ID NO: 1128132 - protein, 18 aa, Mycobacterium
SRPLTLIGGQSYDQLSAS

SEQ ID NO: 1128133 - protein, 31 aa, Mycobacterium
SRRTAAALASRWRLLAVSVLIASAAVLTTLY

SEQ ID NO: 1128134 - protein, 21 aa, Mycobacterium
SRRTHAWEAVRAALDADSMSP

SEQ ID NO: 1128135 - protein, 26 aa, Mycobacterium
SRSARVWRRIRIGIVVAACLVTLQSV

SEQ ID NO: 1128136 - protein, 33 aa, Mycobacterium
SRSGKWSLLVSGWRLIGKCLRPLPDKWKGLTDQ

SEQ ID NO: 1128137 - protein, 17 aa, Mycobacterium
SRSIWLRAIGTTYVDIF

SEQ ID NO: 1128138 - protein, 30 aa, Mycobacterium
SRSPTAPSHPRWWFLWTTPGRILSIGMVLA

SEQ ID NO: 1128139 - protein, 26 aa, Mycobacterium
SRSSGDVVFQRGFQLPPLPPGTDTVM

SEQ ID NO: 1128140 - protein, 17 aa, Mycobacterium
SRTALLLSLKTATASTV

SEQ ID NO: 1128141 - protein, 22 aa, Mycobacterium
SRTEMRRALAMAPDKSREIGLQ

SEQ ID NO: 1128142 - protein, 19 aa, Mycobacterium
SRTLIDILYDTARRYPDAP

SEQ ID NO: 1128143 - protein, 21 aa, Mycobacterium
SRVADLCWVAGTVVAVVPAVL

SEQ ID NO: 1128144 - protein, 21 aa, Mycobacterium
SRVDHAHLLLAGRAQVAEAST

SEQ ID NO: 1128145 - protein, 22 aa, Mycobacterium
SRWWLIAAGVAIGFGFLTKMLQ

SEQ ID NO: 1128146 - protein, 21 aa, Mycobacterium
SRYDLLIAVISALCLVLMIML

SEQ ID NO: 1128147 - protein, 26 aa, Mycobacterium
SSAALCRLARYRLGRRILCDENGAAR

SEQ ID NO: 1128148 - protein, 19 aa, Mycobacterium
SSAGRMRRGLPLGDEPLLD

SEQ ID NO: 1128149 - protein, 25 aa, Mycobacterium
SSALPAAGGGYTFARRALGPWGGFA

SEQ ID NO: 1128150 - protein, 28 aa, Mycobacterium
SSAPEMLPRGWGEVGQWFPQGATATLLR

SEQ ID NO: 1128151 - protein, 23 aa, Mycobacterium
SSASGLRPGQFVRASGVEVGKVK

SEQ ID NO: 1128152 - protein, 19 aa, Mycobacterium
SSASRAVAQIVLLDNKFAT

SEQ ID NO: 1128153 - protein, 27 aa, Mycobacterium
SSDPVLLDWLVGLAFPCQRPFGHRNGV

SEQ ID NO: 1128154 - protein, 17 aa, Mycobacterium
SSDTLYCCLPLYHNNAL

SEQ ID NO: 1128155 - protein, 26 aa, Mycobacterium
SSELWTSLLWIGRAWVVAAVITLVIL

SEQ ID NO: 1128156 - protein, 24 aa, Mycobacterium
SSFSADPMWSWSLGALLFLCGVFI

SEQ ID NO: 1128157 - protein, 20 aa, Mycobacterium
SSGRIVGLVAAGILQQSLAD

SEQ ID NO: 1128158 - protein, 25 aa, Mycobacterium
SSGSYPLLVVFGFFLGVAGTVFAVG

SEQ ID NO: 1128159 - protein, 17 aa, Mycobacterium
SSILGLIAHEPVPRSDA

SEQ ID NO: 1128160 - protein, 18 aa, Mycobacterium
SSIMSRLAGQGAVALVEL

SEQ ID NO: 1128161 - protein, 20 aa, Mycobacterium
SSIPSVIGFILAAVVFIYLV

SEQ ID NO: 1128162 - protein, 19 aa, Mycobacterium
SSLLLNWVLGPALMFALAW

SEQ ID NO: 1128163 - protein, 25 aa, Mycobacterium
SSLVRAGFIGAVLIALVIVVGLQPQ

SEQ ID NO: 1128164 - protein, 17 aa, Mycobacterium
SSLVTIHLACQSLRSGD

SEQ ID NO: 1128165 - protein, 24 aa, Mycobacterium
SSMDWFGLAVLAVWGAVAGLCALR

SEQ ID NO: 1128166 - protein, 19 aa, Mycobacterium
SSNFPGRDGAGYPIENDNK

SEQ ID NO: 1128167 - protein, 18 aa, Mycobacterium
SSPIVRRILLRTVLFIAP

SEQ ID NO: 1128168 - protein, 26 aa, Mycobacterium
SSSVVEWKLRPGVVSTMNAQARYTDP

SEQ ID NO: 1128169 - protein, 22 aa, Mycobacterium
SSTGRDWWWAVALGVLGAGLMG

SEQ ID NO: 1128170 - protein, 22 aa, Mycobacterium
SSTNIFSGMVAKTWVTPQGQII

SEQ ID NO: 1128171 - protein, 25 aa, Mycobacterium
SSVKPSRFLGRLFARASHSVKPEPA

SEQ ID NO: 1128172 - protein, 18 aa, Mycobacterium
SSVLPAIGLFIVTNIDDI

SEQ ID NO: 1128173 - protein, 23 aa, Mycobacterium
SSVLPVCAPPAPPSTTRPPAPSP

SEQ ID NO: 1128174 - protein, 38 aa, Mycobacterium
SSVRRTHYRGAPEVWAMEKEHILPFAVGKRLWEIVGLV

SEQ ID NO: 1128175 - protein, 24 aa, Mycobacterium
SSYPRLIRVAMMYNDQIGYGPTVR

SEQ ID NO: 1128176 - protein, 19 aa, Mycobacterium
STAVFYFDFVRLRRIPALR

SEQ ID NO: 1128177 - protein, 18 aa, Mycobacterium
STDAAAVFSVLRVVPLPR

SEQ ID NO: 1128178 - protein, 27 aa, Mycobacterium
STDPKTRVCSAFELVRGAVSLQTNANL

SEQ ID NO: 1128179 - protein, 17 aa, Mycobacterium
STELMVSELDRFETLLS

SEQ ID NO: 1128180 - protein, 19 aa, Mycobacterium
STENYRFYQIGGLLAAGFL

SEQ ID NO: 1128181 - protein, 17 aa, Mycobacterium
STFDYFSIYFATAVMYL

SEQ ID NO: 1128182 - protein, 21 aa, Mycobacterium
STFEWHYPLLVVHVALAGVAM

SEQ ID NO: 1128183 - protein, 17 aa, Mycobacterium
STGRTAVLIAIDGRGVG

SEQ ID NO: 1128184 - protein, 19 aa, Mycobacterium
STGRTAVLIAIDGRGVGVI

SEQ ID NO: 1128185 - protein, 26 aa, Mycobacterium
STITRPRLWVALLFLMLIAVTFLVSS

SEQ ID NO: 1128186 - protein, 20 aa, Mycobacterium
STKMSSEWSKDQVLQSYLNI

SEQ ID NO: 1128187 - protein, 18 aa, Mycobacterium
STLSYFVRRCFHEGRSKA

SEQ ID NO: 1128188 - protein, 17 aa, Mycobacterium
STMELLARLGLAVLLFL

SEQ ID NO: 1128189 - protein, 20 aa, Mycobacterium
STPDLPLAVLGLAVADLPWR

SEQ ID NO: 1128190 - protein, 18 aa, Mycobacterium
STPLRGVVLLAFVLTGVG

SEQ ID NO: 1128191 - protein, 17 aa, Mycobacterium
STPRAFGKVILPLSMPG

SEQ ID NO: 1128192 - protein, 19 aa, Mycobacterium
STPYVGITVAWVARAEHPE

SEQ ID NO: 1128193 - protein, 21 aa, Mycobacterium
STRDEFRYTESLVYPALGQGA

SEQ ID NO: 1128194 - protein, 23 aa, Mycobacterium
STTADALQAYGFNVTTPDDYPGP

SEQ ID NO: 1128195 - protein, 22 aa, Mycobacterium
STTFGWFRFYLLAIPLVICVAL

SEQ ID NO: 1128196 - protein, 19 aa, Mycobacterium
STVGLGWALLISLATFVLG

SEQ ID NO: 1128197 - protein, 19 aa, Mycobacterium
STYPWSSPVIIGLFVGSGV

SEQ ID NO: 1128198 - protein, 22 aa, Mycobacterium
SVADLRIGDIVVVRPNMRLAAD

SEQ ID NO: 1128199 - protein, 23 aa, Mycobacterium
SVAGERLVLYLGLAAALGLVASW

SEQ ID NO: 1128200 - protein, 18 aa, Mycobacterium
SVALDCIDDPLALLDERP

SEQ ID NO: 1128201 - protein, 25 aa, Mycobacterium
SVDRKAWYLPVGVAGTLGDPTAAES

SEQ ID NO: 1128202 - protein, 26 aa, Mycobacterium
SVEGPLRPGHWVMFAAVSVSALAAMV

SEQ ID NO: 1128203 - protein, 23 aa, Mycobacterium
SVGGGWWKTLFAAVIPQSMPALV

SEQ ID NO: 1128204 - protein, 17 aa, Mycobacterium
SVGYLAFVRWRIRLKSA

SEQ ID NO: 1128205 - protein, 17 aa, Mycobacterium
SVLEPWLTFLRALPPLA

SEQ ID NO: 1128206 - protein, 17 aa, Mycobacterium
SVLERSPGFPLQYAPPP

SEQ ID NO: 1128207 - protein, 20 aa, Mycobacterium
SVLLGPVWRVLSPVRALHRF

SEQ ID NO: 1128208 - protein, 25 aa, Mycobacterium
SVLLLPVSRLLVLIGNALTPGRGFR

SEQ ID NO: 1128209 - protein, 23 aa, Mycobacterium
SVLLWQHVVGIPLGWMVLPMSVI

SEQ ID NO: 1128210 - protein, 20 aa, Mycobacterium
SVPAAVRITADRAARDPRVD

SEQ ID NO: 1128211 - protein, 31 aa, Mycobacterium
SVPRRISSVLPDSVVGAALWLTTSTVVALIA

SEQ ID NO: 1128212 - protein, 24 aa, Mycobacterium
SVQYLAVTFGWIWAGLAAGPILLT

SEQ ID NO: 1128213 - protein, 26 aa, Mycobacterium
SVRNRLWHRVPWLVVGLLGAMVSAVL

SEQ ID NO: 1128214 - protein, 26 aa, Mycobacterium
SVRPLPGGVIRPGIEPPVAEPEDPGV

SEQ ID NO: 1128215 - protein, 23 aa, Mycobacterium
SVRRYAWHRVRRIMPAYVVTVVA

SEQ ID NO: 1128216 - protein, 18 aa, Mycobacterium
SVSAKFWTLLEIIPNLTL

SEQ ID NO: 1128217 - protein, 17 aa, Mycobacterium
SVSRVRGGRVLGLVVEL

SEQ ID NO: 1128218 - protein, 19 aa, Mycobacterium
SVVLMQWWLMPAATGLFRR

SEQ ID NO: 1128219 - protein, 25 aa, Mycobacterium
SVVRGARNYPCQEFPGKRAPTVQLC

SEQ ID NO: 1128220 - protein, 24 aa, Mycobacterium
SWAGGWAGGWWLDPVIGLVIAAWS

SEQ ID NO: 1128221 - protein, 21 aa, Mycobacterium
SWATAIRYQALFAEAGGLTVG

SEQ ID NO: 1128222 - protein, 20 aa, Mycobacterium
SWFDAARPVGAWIDTTVRIV

SEQ ID NO: 1128223 - protein, 19 aa, Mycobacterium
SWFVTRWVVASALGGPVLI

SEQ ID NO: 1128224 - protein, 18 aa, Mycobacterium
SWHWVFAALVVVAGALLV

SEQ ID NO: 1128225 - protein, 26 aa, Mycobacterium
SWKPWLRGTAFGFPFGALPAGGAELP

SEQ ID NO: 1128226 - protein, 18 aa, Mycobacterium
SWVVALLVVLVSGGLMGV

SEQ ID NO: 1128227 - protein, 25 aa, Mycobacterium
SYDPWDQRLCLILSGDFYDAIAKGR

SEQ ID NO: 1128228 - protein, 18 aa, Mycobacterium
SYFNPGICGEGTDRPCPN

SEQ ID NO: 1128229 - protein, 23 aa, Mycobacterium
SYGVNPPFLWQHLTGRYTNITVH

SEQ ID NO: 1128230 - protein, 30 aa, Mycobacterium
SYPQRWGYWPAAFGLFAFVWLELASPDPGS

SEQ ID NO: 1128231 - protein, 26 aa, Mycobacterium
SYQFLKRWLFALVLSAVWVVAAAVGA

SEQ ID NO: 1128232 - protein, 19 aa, Mycobacterium
SYSGAFAKPTLHHMTVAVA

SEQ ID NO: 1128233 - protein, 27 aa, Mycobacterium
TAAAALCWLWPAGAGLLIRFTGPPLWW

SEQ ID NO: 1128234 - protein, 24 aa, Mycobacterium
TAAALRATNSFGLIEPPSLESSAV

SEQ ID NO: 1128235 - protein, 26 aa, Mycobacterium
TAAARPRPAGVLIQLQRSAGNAAVNA

SEQ ID NO: 1128236 - protein, 17 aa, Mycobacterium
TAAEFLRGMGIAATETD

SEQ ID NO: 1128237 - protein, 24 aa, Mycobacterium
TAAGWLLVRAWRRPTSLIPTGLVV

SEQ ID NO: 1128238 - protein, 24 aa, Mycobacterium
TAAPRLTIRRALLLYRLKGLRAML

SEQ ID NO: 1128239 - protein, 24 aa, Mycobacterium
TAAPTHWHLWCAAALSGSAAVGAV

SEQ ID NO: 1128240 - protein, 19 aa, Mycobacterium
TAARLKLGHPARLVVRCAT

SEQ ID NO: 1128241 - protein, 22 aa, Mycobacterium
TAAVCAVVAWLVVPGQMLVCAF

SEQ ID NO: 1128242 - protein, 26 aa, Mycobacterium
TADDRLFCNSPFFWIGGFAFGLLATL

SEQ ID NO: 1128243 - protein, 24 aa, Mycobacterium
TADFPTVLLAGDWLSQEQVTAASE

SEQ ID NO: 1128244 - protein, 18 aa, Mycobacterium
TADFTWSVFRVFPDDDAV

SEQ ID NO: 1128245 - protein, 27 aa, Mycobacterium
TADLPGYRGEIRLTRAELEELMARPLD

SEQ ID NO: 1128246 - protein, 17 aa, Mycobacterium
TADSFVVFFERIKDEIR

SEQ ID NO: 1128247 - protein, 23 aa, Mycobacterium
TAEDAAIALGRVTKPPRRRLSLA

SEQ ID NO: 1128248 - protein, 24 aa, Mycobacterium
TAERVRAPARWPRTPAADRAATAG

SEQ ID NO: 1128249 - protein, 22 aa, Mycobacterium
TAETRPAQRLIITLTVVLVTAT

SEQ ID NO: 1128250 - protein, 24 aa, Mycobacterium
TAFTSALPWLAGRIGTPGVPQIDL

SEQ ID NO: 1128251 - protein, 25 aa, Mycobacterium
TAGADGWAAPGVRAAQAVARSPGTA

SEQ ID NO: 1128252 - protein, 23 aa, Mycobacterium
TAGAHCRSAVVVPETLPLPNVVR

SEQ ID NO: 1128253 - protein, 17 aa, Mycobacterium
TAGFTTLVFAQFFNVFN

SEQ ID NO: 1128254 - protein, 17 aa, Mycobacterium
TAGGFYLAFLFPLIGFL

SEQ ID NO: 1128255 - protein, 18 aa, Mycobacterium
TAGPRWDVAEWLDALGST

SEQ ID NO: 1128256 - protein, 25 aa, Mycobacterium
TAGRAATFLAPWLFSLSIDVFDSPR

SEQ ID NO: 1128257 - protein, 25 aa, Mycobacterium
TAHIRTGTLLGERVLALESEGSGTL

SEQ ID NO: 1128258 - protein, 33 aa, Mycobacterium
TAHPPELLNLVLVDFKGGATFLGKKSQYQRLYF

SEQ ID NO: 1128259 - protein, 21 aa, Mycobacterium
TAHPPPSGWDPVVGHGVVDAL

SEQ ID NO: 1128260 - protein, 27 aa, Mycobacterium
TAIGRRTRRWRLVWVPWSALIGVVLAV

SEQ ID NO: 1128261 - protein, 23 aa, Mycobacterium
TAKEARRSVVWAIALIGAFYLFT

SEQ ID NO: 1128262 - protein, 19 aa, Mycobacterium
TALARWAHAHFPPVSTHDA

SEQ ID NO: 1128263 - protein, 23 aa, Mycobacterium
TALHYWPYLFFAVGVLSITFVSL

SEQ ID NO: 1128264 - protein, 17 aa, Mycobacterium
TALPVWGIIAGKSLAVG

SEQ ID NO: 1128265 - protein, 26 aa, Mycobacterium
TALQYRLPITFCLFDNHAHAMCVTRE

SEQ ID NO: 1128266 - protein, 23 aa, Mycobacterium
TALRELALLWLADQVDSALEKYR

SEQ ID NO: 1128267 - protein, 29 aa, Mycobacterium
TALSAFFTPRFVKWFGLFTTHVIIAAALA

SEQ ID NO: 1128268 - protein, 20 aa, Mycobacterium
TALVLTDFDLGNGFGPDGLP

SEQ ID NO: 1128269 - protein, 19 aa, Mycobacterium
TAMAARRAPLIVGVTTVGS

SEQ ID NO: 1128270 - protein, 18 aa, Mycobacterium
TAMVVCYSLWAFERDGAN

SEQ ID NO: 1128271 - protein, 23 aa, Mycobacterium
TANLLCFVGSWFFTTAAWMQLTL

SEQ ID NO: 1128272 - protein, 26 aa, Mycobacterium
TAPAVVAWGAMLGWIDVADKWSEWMA

SEQ ID NO: 1128273 - protein, 17 aa, Mycobacterium
TAPDIGSLARATIVRLQ

SEQ ID NO: 1128274 - protein, 17 aa, Mycobacterium
TAPEPYPGPGLGLITAW

SEQ ID NO: 1128275 - protein, 24 aa, Mycobacterium
TAPYAAVFTDVFGLREGDDVRMAG

SEQ ID NO: 1128276 - protein, 19 aa, Mycobacterium
TAQAWARKHRQLRAALTNL

SEQ ID NO: 1128277 - protein, 17 aa, Mycobacterium
TARERMVAIKLLRPEMA

SEQ ID NO: 1128278 - protein, 17 aa, Mycobacterium
TARHGIFRYWDVANPNS

SEQ ID NO: 1128279 - protein, 22 aa, Mycobacterium
TARQRYGELVSRLQSEGDHVLL

SEQ ID NO: 1128280 - protein, 20 aa, Mycobacterium
TARTRGPIRIARPAVPAEIR

SEQ ID NO: 1128281 - protein, 19 aa, Mycobacterium
TARVPTLWIVLGPLGQSIT

SEQ ID NO: 1128282 - protein, 24 aa, Mycobacterium
TASALEFLGPLGVAVVRGSGLARV

SEQ ID NO: 1128283 - protein, 34 aa, Mycobacterium
TASIGLLMVRWSRRARFAPPLAVMVPAHNEAHDI

SEQ ID NO: 1128284 - protein, 24 aa, Mycobacterium
TASMYRCVVALIVSVACGYVIGFR

SEQ ID NO: 1128285 - protein, 24 aa, Mycobacterium
TATALEFLGPLAVAVVHGSGRHRV

SEQ ID NO: 1128286 - protein, 18 aa, Mycobacterium
TATAWEWAMGNAWALAAV

SEQ ID NO: 1128287 - protein, 20 aa, Mycobacterium
TATFLVWWAVGAGVQSALLF

SEQ ID NO: 1128288 - protein, 19 aa, Mycobacterium
TATGLVFVWFSLTPSLLPR

SEQ ID NO: 1128289 - protein, 18 aa, Mycobacterium
TAVCAGLLAVYLATQAVA

SEQ ID NO: 1128290 - protein, 18 aa, Mycobacterium
TAVLIAIDGRGVGVIALA

SEQ ID NO: 1128291 - protein, 29 aa, Mycobacterium
TAVQRIGDRRVWRTPYWLTELPGGRVPRE

SEQ ID NO: 1128292 - protein, 19 aa, Mycobacterium
TAVRRWKTVGAQWLMVVSG

SEQ ID NO: 1128293 - protein, 20 aa, Mycobacterium
TAVTRCYDGVLARYTDDGRT

SEQ ID NO: 1128294 - protein, 23 aa, Mycobacterium
TAYELGMALGIAMLGSIVTAVYR

SEQ ID NO: 1128295 - protein, 17 aa, Mycobacterium
TAYPLKWTCVSQNSPYV

SEQ ID NO: 1128296 - protein, 25 aa, Mycobacterium
TCFPSFPRFAGAVFAEGEDKELARL

SEQ ID NO: 1128297 - protein, 20 aa, Mycobacterium
TDAAWLLAERYPHGMPPALV

SEQ ID NO: 1128298 - protein, 19 aa, Mycobacterium
TDAITTWARSLAGITRQIA

SEQ ID NO: 1128299 - protein, 18 aa, Mycobacterium
TDDHPFRALWVMMVGFFL

SEQ ID NO: 1128300 - protein, 32 aa, Mycobacterium
TDELAPLPWYKRPPVLFGVAAAAALLAAGGLA

SEQ ID NO: 1128301 - protein, 18 aa, Mycobacterium
TDFPKLAAPLSVGDDAAR

SEQ ID NO: 1128302 - protein, 24 aa, Mycobacterium
TDGDPRPGVEIRLTGDGEILSRGP

SEQ ID NO: 1128303 - protein, 25 aa, Mycobacterium
TDGNVRPGVEIRLGEDGEIFSRGPD

SEQ ID NO: 1128304 - protein, 20 aa, Mycobacterium
TDGTRLLLRVADTGEGIAAE

SEQ ID NO: 1128305 - protein, 23 aa, Mycobacterium
TDLFARGGIEWAGTTALALTTGL

SEQ ID NO: 1128306 - protein, 19 aa, Mycobacterium
TDLLDRLGTHLTRHLGPGV

SEQ ID NO: 1128307 - protein, 24 aa, Mycobacterium
TDLLLRASVMSTYLSNDWGQDWGS

SEQ ID NO: 1128308 - protein, 20 aa, Mycobacterium
TDLLWSFLQAIAMSIAVMLV

SEQ ID NO: 1128309 - protein, 23 aa, Mycobacterium
TDLPGLQPFMPPYVPGGGSKPHY

SEQ ID NO: 1128310 - protein, 22 aa, Mycobacterium
TDLPRSVSYLTLAGTRMASDPA

SEQ ID NO: 1128311 - protein, 25 aa, Mycobacterium
TDMGEIVLPPGFLPLKVPIEVHFTQ

SEQ ID NO: 1128312 - protein, 20 aa, Mycobacterium
TDNPWWIGIPLGLMLVITGT

SEQ ID NO: 1128313 - protein, 21 aa, Mycobacterium
TDPALRPGVLVTVAAALAGMA

SEQ ID NO: 1128314 - protein, 23 aa, Mycobacterium
TDPQFGLDLGFYAFDLPFYRLVL

SEQ ID NO: 1128315 - protein, 21 aa, Mycobacterium
TDPRFPLLYFSVNSAVLAAVA

SEQ ID NO: 1128316 - protein, 24 aa, Mycobacterium
TDRDRLRIPFGHELKTGDVMYLDI

SEQ ID NO: 1128317 - protein, 24 aa, Mycobacterium
TDRDRRLLGVAAFRDLVLADPGRH

SEQ ID NO: 1128318 - protein, 17 aa, Mycobacterium
TDRIVLDQMSWFTPARW

SEQ ID NO: 1128319 - protein, 19 aa, Mycobacterium
TDRLTGWAQAFDELGRLKQ

SEQ ID NO: 1128320 - protein, 22 aa, Mycobacterium
TDSRLAARLAALASLGAAVIHF

SEQ ID NO: 1128321 - protein, 22 aa, Mycobacterium
TDSRLAARLAALASLGASVIHF

SEQ ID NO: 1128322 - protein, 19 aa, Mycobacterium
TDTILGRRNLEIDPRGSEP

SEQ ID NO: 1128323 - protein, 22 aa, Mycobacterium
TDTPVTFVFYWVIPFLLVAAGA

SEQ ID NO: 1128324 - protein, 23 aa, Mycobacterium
TDVDTPDGLYCKLPQDSPIGVRG

SEQ ID NO: 1128325 - protein, 18 aa, Mycobacterium
TDYSVFFISRYHEQRRLG

SEQ ID NO: 1128326 - protein, 48 aa, Mycobacterium
TEADSATPWYRKPVALVSFGAVGALLIALVVFGLARAITGDSTSDTTT

SEQ ID NO: 1128327 - protein, 21 aa, Mycobacterium
TEAPPRVSATFNEAMQPAFAA

SEQ ID NO: 1128328 - protein, 18 aa, Mycobacterium
TEAWIRFVTSAPKHAAGM

SEQ ID NO: 1128329 - protein, 25 aa, Mycobacterium
TEGTRFRFTLPMTLDDTATPLLEGS

SEQ ID NO: 1128330 - protein, 17 aa, Mycobacterium
TEHIGRLLAEIADLRGE

SEQ ID NO: 1128331 - protein, 21 aa, Mycobacterium
TEIATVWAGVLCLDAVGRDEN

SEQ ID NO: 1128332 - protein, 19 aa, Mycobacterium
TEIDYAATVIKAYVHELDD

SEQ ID NO: 1128333 - protein, 21 aa, Mycobacterium
TEIPVLVVPAGKRIEFEIASA

SEQ ID NO: 1128334 - protein, 19 aa, Mycobacterium
TEISTALLIPKFTVIEDGA

SEQ ID NO: 1128335 - protein, 20 aa, Mycobacterium
TEKPGGWSLSVPTLSGSPFS

SEQ ID NO: 1128336 - protein, 25 aa, Mycobacterium
TELLRTPELYAWAVVALLGTSTQQA

SEQ ID NO: 1128337 - protein, 17 aa, Mycobacterium
TELNLALAVPVTLVLIA

SEQ ID NO: 1128338 - protein, 17 aa, Mycobacterium
TELRAGSLDALLPPRLR

SEQ ID NO: 1128339 - protein, 21 aa, Mycobacterium
TELRKWFARKSFYGSSAAPLT

SEQ ID NO: 1128340 - protein, 22 aa, Mycobacterium
TEMRRAMALAPERAREIGLHRQ

SEQ ID NO: 1128341 - protein, 20 aa, Mycobacterium
TEPAPAPRNARTEVVRTEGN

SEQ ID NO: 1128342 - protein, 26 aa, Mycobacterium
TEPMPRWLRVIAEWNPVSSLAQAMRE

SEQ ID NO: 1128343 - protein, 19 aa, Mycobacterium
TEPVVLFFGVWAKYKGIEV

SEQ ID NO: 1128344 - protein, 22 aa, Mycobacterium
TERRREFGIMSSIGLADEVLYF

SEQ ID NO: 1128345 - protein, 23 aa, Mycobacterium
TERSRLAKRLLIGFLSAGALILA

SEQ ID NO: 1128346 - protein, 27 aa, Mycobacterium
TESIPTYLSGDWYRDWGSLERYLRVVP

SEQ ID NO: 1128347 - protein, 18 aa, Mycobacterium
TESLRLALEHLIESGDYR

SEQ ID NO: 1128348 - protein, 18 aa, Mycobacterium
TETMIGWSEASRADWDRR

SEQ ID NO: 1128349 - protein, 25 aa, Mycobacterium
TEVFPLTLFAIGGMLLFPAANDLLT

SEQ ID NO: 1128350 - protein, 23 aa, Mycobacterium
TEVFPLTMFAVAGMLLFPAADDL

SEQ ID NO: 1128351 - protein, 20 aa, Mycobacterium
TFALAWGLGGYLWATVAGST

SEQ ID NO: 1128352 - protein, 29 aa, Mycobacterium
TFDGIRPSFPMLAANLANFGRIGVIYHKS

SEQ ID NO: 1128353 - protein, 20 aa, Mycobacterium
TFGCLVRFALANIRRRPARF

SEQ ID NO: 1128354 - protein, 21 aa, Mycobacterium
TFGCLVRFALANIRRRPARFM

SEQ ID NO: 1128355 - protein, 20 aa, Mycobacterium
TFGFGVIFGAIWAEETWGRF

SEQ ID NO: 1128356 - protein, 21 aa, Mycobacterium
TFGFGVIFGAIWAEETWGRFW

SEQ ID NO: 1128357 - protein, 20 aa, Mycobacterium
TFHPSRRLKVLRGTVETFRF

SEQ ID NO: 1128358 - protein, 24 aa, Mycobacterium
TFIGLWIFGWSRLPRLVHLACIWI

SEQ ID NO: 1128359 - protein, 25 aa, Mycobacterium
TFLFLMRQGYRWARTLLTGGAIATV

SEQ ID NO: 1128360 - protein, 17 aa, Mycobacterium
TFLGADFRPVGLTAGSR

SEQ ID NO: 1128361 - protein, 18 aa, Mycobacterium
TFRFVPVVVTFAIGVAVL

SEQ ID NO: 1128362 - protein, 27 aa, Mycobacterium
TFRPPPPPWYRTRQAVTALMIVALAAI

SEQ ID NO: 1128363 - protein, 21 aa, Mycobacterium
TFSDREWILEIARQYRTLTAD

SEQ ID NO: 1128364 - protein, 42 aa, Mycobacterium
TFVAMFQPPFAWREFISQAWFVARVSILPTLLLTIPYTVLLT

SEQ ID NO: 1128365 - protein, 24 aa, Mycobacterium
TFVLTAVITVCFDLIEAVEIGILV

SEQ ID NO: 1128366 - protein, 25 aa, Mycobacterium
TFYDYSRGWPLALLAAAFAVVVVAV

SEQ ID NO: 1128367 - protein, 29 aa, Mycobacterium
TGAAAWLEAASWWKALLALVVAVALIIGV

SEQ ID NO: 1128368 - protein, 17 aa, Mycobacterium
TGAGYRPDGRIELDGDP

SEQ ID NO: 1128369 - protein, 18 aa, Mycobacterium
TGAVGGFVRVRVLVSAPD

SEQ ID NO: 1128370 - protein, 19 aa, Mycobacterium
TGAWAAWRRRASAEEDPHV

SEQ ID NO: 1128371 - protein, 19 aa, Mycobacterium
TGDGALRGWAIPTATDIAF

SEQ ID NO: 1128372 - protein, 18 aa, Mycobacterium
TGDLPIVILPGGPSGGGG

SEQ ID NO: 1128373 - protein, 24 aa, Mycobacterium
TGDPRPLPAGSVIPLERSEASFDV

SEQ ID NO: 1128374 - protein, 24 aa, Mycobacterium
TGEDYRLGQLVPLRGSASAVPAVP

SEQ ID NO: 1128375 - protein, 21 aa, Mycobacterium
TGETRLPLIIQNTHRYFFYIA

SEQ ID NO: 1128376 - protein, 27 aa, Mycobacterium
TGFAHEVWAVVLFRIVGGIGVGVASVI

SEQ ID NO: 1128377 - protein, 20 aa, Mycobacterium
TGGPPMIWSLVIVGVGQLLV

SEQ ID NO: 1128378 - protein, 18 aa, Mycobacterium
TGGRAGMVAIQLKEGHEL

SEQ ID NO: 1128379 - protein, 21 aa, Mycobacterium
TGGRMGFGFGKSKAKMLGKDM

SEQ ID NO: 1128380 - protein, 21 aa, Mycobacterium
TGGRMGFGFGKSKAKQLSKDM

SEQ ID NO: 1128381 - protein, 25 aa, Mycobacterium
TGGTRWMVLVGIVLGFAFLTKMLQA

SEQ ID NO: 1128382 - protein, 20 aa, Mycobacterium
TGGTSRYAAPSARRATATEQ

SEQ ID NO: 1128383 - protein, 21 aa, Mycobacterium
TGGVVGFVLVWIFWLSTGIPL

SEQ ID NO: 1128384 - protein, 17 aa, Mycobacterium
TGHLRLLVRDGTATVGV

SEQ ID NO: 1128385 - protein, 19 aa, Mycobacterium
TGIGLPSLLLFLGVGVLVG

SEQ ID NO: 1128386 - protein, 25 aa, Mycobacterium
TGIKFFNWLGTMWKGQLTFETPMLF

SEQ ID NO: 1128387 - protein, 21 aa, Mycobacterium
TGISGPIKLSGYDAVQVEGTY

SEQ ID NO: 1128388 - protein, 20 aa, Mycobacterium
TGKLGVRDVLFGRKVSYVGL

SEQ ID NO: 1128389 - protein, 17 aa, Mycobacterium
TGKPYSLTFLRGSTVSL

SEQ ID NO: 1128390 - protein, 29 aa, Mycobacterium
TGLDLRPNPGIAHPWWGNFLPVTRAVPEP

SEQ ID NO: 1128391 - protein, 26 aa, Mycobacterium
TGLGLREAWEFAAYTAPGRAGLLTVL

SEQ ID NO: 1128392 - protein, 30 aa, Mycobacterium
TGLGRAVTFIPWPVIEGFTLGIAAIIFLQQ

SEQ ID NO: 1128393 - protein, 17 aa, Mycobacterium
TGLILALSLVFVGILVA

SEQ ID NO: 1128394 - protein, 17 aa, Mycobacterium
TGLIRILAVGLAISALS

SEQ ID NO: 1128395 - protein, 24 aa, Mycobacterium
TGLPAFRYAAAVAYLGLLCTWLLV

SEQ ID NO: 1128396 - protein, 18 aa, Mycobacterium
TGLSNAFRPRTSPPGVAT

SEQ ID NO: 1128397 - protein, 21 aa, Mycobacterium
TGLYAAWGIVVKGTLGVAASL

SEQ ID NO: 1128398 - protein, 21 aa, Mycobacterium
TGMKVRRYFVGFGPTLWSTWR

SEQ ID NO: 1128399 - protein, 26 aa, Mycobacterium
TGPDFGKASPFGLIIVVLLLIAVFGL

SEQ ID NO: 1128400 - protein, 23 aa, Mycobacterium
TGPESLIVWLWLAVILLLVILSV

SEQ ID NO: 1128401 - protein, 22 aa, Mycobacterium
TGPLPYIVMEYVDGVTLRDIVH

SEQ ID NO: 1128402 - protein, 21 aa, Mycobacterium
TGQQAAVDWLNRLKALARRMC

SEQ ID NO: 1128403 - protein, 18 aa, Mycobacterium
TGRLHRIRPMSGRDPHEQ

SEQ ID NO: 1128404 - protein, 22 aa, Mycobacterium
TGRLSWPKVLGGGVLTGAWLGL

SEQ ID NO: 1128405 - protein, 21 aa, Mycobacterium
TGRLWPLIIAHTLIDAVAFVG

SEQ ID NO: 1128406 - protein, 24 aa, Mycobacterium
TGRRIRVGLQAGRGYSFTVPVDRA

SEQ ID NO: 1128407 - protein, 18 aa, Mycobacterium
TGRSPRSGAVLWLPATEP

SEQ ID NO: 1128408 - protein, 22 aa, Mycobacterium
TGRVDIGGALLLGGGLGAVLAY

SEQ ID NO: 1128409 - protein, 22 aa, Mycobacterium
TGSRRRSRWQTAAGVVAVLCSV

SEQ ID NO: 1128410 - protein, 26 aa, Mycobacterium
TGTIRLPEQGRWFVYVEFGRAGETIE

SEQ ID NO: 1128411 - protein, 28 aa, Mycobacterium
TGTYLGQGYLRWSIRAEQAPPRLADAHD

SEQ ID NO: 1128412 - protein, 24 aa, Mycobacterium
TGVFAAACLGEYGYLSTVDLGDVD

SEQ ID NO: 1128413 - protein, 18 aa, Mycobacterium
TGVGGLVVSEWIRGGSLA

SEQ ID NO: 1128414 - protein, 23 aa, Mycobacterium
TGVLELLGAVGLLYPPTRAAAAC

SEQ ID NO: 1128415 - protein, 28 aa, Mycobacterium
TGVPVVRCACGNPLAPPAALAAPVSKLR

SEQ ID NO: 1128416 - protein, 17 aa, Mycobacterium
TGVSRTPAWNVMVRETA

SEQ ID NO: 1128417 - protein, 22 aa, Mycobacterium
TGVSWLPVFHDMGLIAGVLLPI

SEQ ID NO: 1128418 - protein, 25 aa, Mycobacterium
TGWALPVVCAMFLAYGYYGGLMPQG

SEQ ID NO: 1128419 - protein, 26 aa, Mycobacterium
TGWLCPACGGLRMTHDLLHGDLAAAF

SEQ ID NO: 1128420 - protein, 25 aa, Mycobacterium
TGWTGWPLLIARCAATLAVAVLSYW

SEQ ID NO: 1128421 - protein, 21 aa, Mycobacterium
TGYGCGAIFAFHGAPDLALTQ

SEQ ID NO: 1128422 - protein, 18 aa, Mycobacterium
THIGFGFGDHHFEMTVKH

SEQ ID NO: 1128423 - protein, 25 aa, Mycobacterium
THQLTPFWLFFVLAALAVFRQMRPW

SEQ ID NO: 1128424 - protein, 28 aa, Mycobacterium
THSVPWNIASVIPWLGSPFKTGQQISDV

SEQ ID NO: 1128425 - protein, 26 aa, Mycobacterium
THVISRPRVVTWMRRTFAATYVALAA

SEQ ID NO: 1128426 - protein, 17 aa, Mycobacterium
TIAGIVIVIYSFVPMLW

SEQ ID NO: 1128427 - protein, 28 aa, Mycobacterium
TIARVFVEWRFDLIFGTAAFVIAGIYLV

SEQ ID NO: 1128428 - protein, 32 aa, Mycobacterium
TIGEAWRRLRPRLWALIGFTVLKTLALIVWFG

SEQ ID NO: 1128429 - protein, 23 aa, Mycobacterium
TIGIGIAVMAAFLYWQSVNTGEP

SEQ ID NO: 1128430 - protein, 29 aa, Mycobacterium
TIGPRTGFFSGFAMLGAYWGFSIGTLALT

SEQ ID NO: 1128431 - protein, 19 aa, Mycobacterium
TIPLWVLFMYPVFWGPAIL

SEQ ID NO: 1128432 - protein, 20 aa, Mycobacterium
TIRLGRPGWLDAGALADAVV

SEQ ID NO: 1128433 - protein, 19 aa, Mycobacterium
TIVAIVGWFLSLIVTAAIQ

SEQ ID NO: 1128434 - protein, 24 aa, Mycobacterium
TIVDGRYRLLVSHGGPAHLQFWQA

SEQ ID NO: 1128435 - protein, 23 aa, Mycobacterium
TKAFGPWIGWIGGWGLAVSAIIV

SEQ ID NO: 1128436 - protein, 18 aa, Mycobacterium
TKFLEAGPKIIEWERPDT

SEQ ID NO: 1128437 - protein, 17 aa, Mycobacterium
TKIARAMVTEYGMSSKL

SEQ ID NO: 1128438 - protein, 18 aa, Mycobacterium
TKIARAMVTEYGMSSKLG

SEQ ID NO: 1128439 - protein, 19 aa, Mycobacterium
TKIRTAIGPSQEWWTENLR

SEQ ID NO: 1128440 - protein, 18 aa, Mycobacterium
TKLSDLLALVSTFLALAV

SEQ ID NO: 1128441 - protein, 19 aa, Mycobacterium
TKRALPFSVGGGALVGLLS

SEQ ID NO: 1128442 - protein, 17 aa, Mycobacterium
TKVSRMVLGAAILTVFF

SEQ ID NO: 1128443 - protein, 21 aa, Mycobacterium
TKYPTGYGVPLFEALQAKNTK

SEQ ID NO: 1128444 - protein, 22 aa, Mycobacterium
TLALTVPVAWLLNRVTRPQIKA

SEQ ID NO: 1128445 - protein, 20 aa, Mycobacterium
TLAPEVDRAVALSGADLAEL

SEQ ID NO: 1128446 - protein, 17 aa, Mycobacterium
TLAQALDAMAGLVDGGA

SEQ ID NO: 1128447 - protein, 25 aa, Mycobacterium
TLASRGRWALVPLAVVIAADGIRSH

SEQ ID NO: 1128448 - protein, 19 aa, Mycobacterium
TLDRIAYRTTIFAFPVFGF

SEQ ID NO: 1128449 - protein, 17 aa, Mycobacterium
TLEGGLQIIVPVHDTRP

SEQ ID NO: 1128450 - protein, 33 aa, Mycobacterium
TLEKQRISAFVLPRGLITVRLSNGFDIDEVSRR

SEQ ID NO: 1128451 - protein, 35 aa, Mycobacterium
TLEMARCFGQIRMVHAVPFPPALQEIWRNRFGVKV

SEQ ID NO: 1128452 - protein, 24 aa, Mycobacterium
TLFPIGQLFAGAWVVAFFVLADML

SEQ ID NO: 1128453 - protein, 17 aa, Mycobacterium
TLFSHGNHEPGWVVAPG

SEQ ID NO: 1128454 - protein, 23 aa, Mycobacterium
TLGARLIPAIGLVGCLVLAFTLP

SEQ ID NO: 1128455 - protein, 17 aa, Mycobacterium
TLGWLAGLWREVLAAPV

SEQ ID NO: 1128456 - protein, 26 aa, Mycobacterium
TLHKYLDLVGAVGFSTVLSGGVGLAD

SEQ ID NO: 1128457 - protein, 26 aa, Mycobacterium
TLIMFPILACIYARLARTEERAVAKQ

SEQ ID NO: 1128458 - protein, 33 aa, Mycobacterium
TLITVLVAWDLIGHLPLPLGVAGHEGSTIVVGL

SEQ ID NO: 1128459 - protein, 25 aa, Mycobacterium
TLLAMALMFVLSWFKPAGQVGQSAI

SEQ ID NO: 1128460 - protein, 22 aa, Mycobacterium
TLLGAGLLWAGWYAFNGGSALA

SEQ ID NO: 1128461 - protein, 21 aa, Mycobacterium
TLLGVFSRLYVPQLLITGTAD

SEQ ID NO: 1128462 - protein, 20 aa, Mycobacterium
TLLGVPVWLGPLAVGAIVIM

SEQ ID NO: 1128463 - protein, 23 aa, Mycobacterium
TLLLFPVVQPWYVLWAIIPLAAW

SEQ ID NO: 1128464 - protein, 26 aa, Mycobacterium
TLLMGLACWWVISREVIPRLGSAVKH

SEQ ID NO: 1128465 - protein, 28 aa, Mycobacterium
TLLPAILVLAGPRGWVKPRRELTARFWR

SEQ ID NO: 1128466 - protein, 32 aa, Mycobacterium
TLLPDESFLSWGWRIPFLVSLLLLAVGIYVRL

SEQ ID NO: 1128467 - protein, 19 aa, Mycobacterium
TLLPPVLSLAAKRGIGEPK

SEQ ID NO: 1128468 - protein, 19 aa, Mycobacterium
TLLPPVMALAAKRGIAEPR

SEQ ID NO: 1128469 - protein, 23 aa, Mycobacterium
TLLYFCLAQLILAIFARSETALF

SEQ ID NO: 1128470 - protein, 17 aa, Mycobacterium
TLMAAGIAAVIAALGGA

SEQ ID NO: 1128471 - protein, 18 aa, Mycobacterium
TLMMAAAVLLCVVAVERA

SEQ ID NO: 1128472 - protein, 27 aa, Mycobacterium
TLMTPNWKSAMLVLLVLYPTVMLLSRF

SEQ ID NO: 1128473 - protein, 28 aa, Mycobacterium
TLNAADVRFCKSCDAFLDPQPAPEPGPV

SEQ ID NO: 1128474 - protein, 25 aa, Mycobacterium
TLNCPMLAMAFAFLVYAVVQAVRAG

SEQ ID NO: 1128475 - protein, 19 aa, Mycobacterium
TLNLPFAMRSGTLSVTQDD

SEQ ID NO: 1128476 - protein, 19 aa, Mycobacterium
TLPLGLLFGWLGKRMAVAH

SEQ ID NO: 1128477 - protein, 18 aa, Mycobacterium
TLPSRFHLFSVLEAVNGV

SEQ ID NO: 1128478 - protein, 21 aa, Mycobacterium
TLPWLIDGMLFTLQLTLYGFT

SEQ ID NO: 1128479 - protein, 24 aa, Mycobacterium
TLQIGLGIGRRVFRALNACEGVLA

SEQ ID NO: 1128480 - protein, 26 aa, Mycobacterium
TLRMLIPVMRWQRREMLLGDRDPAET

SEQ ID NO: 1128481 - protein, 22 aa, Mycobacterium
TLRRLSAQAAREMKRHPVASLD

SEQ ID NO: 1128482 - protein, 30 aa, Mycobacterium
TLRSVKTVWLRPGTRLGFFTHMGTQFSVTV

SEQ ID NO: 1128483 - protein, 22 aa, Mycobacterium
TLRYLPDLVVVLALLAAVGLCA

SEQ ID NO: 1128484 - protein, 22 aa, Mycobacterium
TLSAQYRRAYVSALTTYQPADN

SEQ ID NO: 1128485 - protein, 28 aa, Mycobacterium
TLSEPRVVAALLRSTWLATLTVLIVAAV

SEQ ID NO: 1128486 - protein, 17 aa, Mycobacterium
TLSMLFWSYASELDYAA

SEQ ID NO: 1128487 - protein, 26 aa, Mycobacterium
TLSNDAFLSWGWRVAFWLSAVVVLVG

SEQ ID NO: 1128488 - protein, 26 aa, Mycobacterium
TLSTIKGNLFWAFAYNVAALPLAAAG

SEQ ID NO: 1128489 - protein, 25 aa, Mycobacterium
TLSTIKTNLFWAFAYNVAAIPVAAL

SEQ ID NO: 1128490 - protein, 26 aa, Mycobacterium
TLSTIKTNLFWAFAYNVAAIPVAALG

SEQ ID NO: 1128491 - protein, 26 aa, Mycobacterium
TLTHAVPKLSSALVHAYPAGGSTEPE

SEQ ID NO: 1128492 - protein, 17 aa, Mycobacterium
TLTSVGWIGYIIIGAIA

SEQ ID NO: 1128493 - protein, 22 aa, Mycobacterium
TLVACAGLGWVLTVTTDASPLD

SEQ ID NO: 1128494 - protein, 30 aa, Mycobacterium
TLVAPHPWPAVAVMFALGVVVTFSGVLSET

SEQ ID NO: 1128495 - protein, 19 aa, Mycobacterium
TLVGAFAAWGVRREARAGR

SEQ ID NO: 1128496 - protein, 22 aa, Mycobacterium
TLVLCVIALFAVNVVLTTIGVR

SEQ ID NO: 1128497 - protein, 17 aa, Mycobacterium
TLVLLQLRVFYAREEPW

SEQ ID NO: 1128498 - protein, 21 aa, Mycobacterium
TLVVASAYLFFGALQVNPLAS

SEQ ID NO: 1128499 - protein, 25 aa, Mycobacterium
TLWRSVRALPEFRRLLELRAVSQFG

SEQ ID NO: 1128500 - protein, 25 aa, Mycobacterium
TLYLWHIPLLLGMHLTFDYLGHPRF

SEQ ID NO: 1128501 - protein, 18 aa, Mycobacterium
TMCANVFIYGAAFLIPTL

SEQ ID NO: 1128502 - protein, 18 aa, Mycobacterium
TMLYGCYAMFGLSLVASL

SEQ ID NO: 1128503 - protein, 19 aa, Mycobacterium
TMPARGRLVTMLLVGVVLL

SEQ ID NO: 1128504 - protein, 17 aa, Mycobacterium
TMPEDWRGAARRVAGQR

SEQ ID NO: 1128505 - protein, 18 aa, Mycobacterium
TMTGIKAVQAYRREPRNQ

SEQ ID NO: 1128506 - protein, 19 aa, Mycobacterium
TMTRYYAAQRTFWVDPVSG

SEQ ID NO: 1128507 - protein, 24 aa, Mycobacterium
TNDILRLVLATALLAIVVTSSFIT

SEQ ID NO: 1128508 - protein, 18 aa, Mycobacterium
TNLEILFDADLAHRPALE

SEQ ID NO: 1128509 - protein, 27 aa, Mycobacterium
TNLFGVELWERFSFYGMLTILGYYLYY

SEQ ID NO: 1128510 - protein, 38 aa, Mycobacterium
TNLRGRRALAVSLTLPLAMPSYLLAYLWVSAYPTITGF

SEQ ID NO: 1128511 - protein, 24 aa, Mycobacterium
TNPSEFKMSVVFNDGTEVPANLVG

SEQ ID NO: 1128512 - protein, 17 aa, Mycobacterium
TNREVFLQTSFRERALS

SEQ ID NO: 1128513 - protein, 29 aa, Mycobacterium
TNRVELLKLAVILALWAAVVAAFVSVIYR

SEQ ID NO: 1128514 - protein, 27 aa, Mycobacterium
TPDWQPWLRWVVLIGSIVAAAVIAVGA

SEQ ID NO: 1128515 - protein, 24 aa, Mycobacterium
TPFSALCFLPLIGLSQPGVLVLGL

SEQ ID NO: 1128516 - protein, 23 aa, Mycobacterium
TPGAPLAERACMLYAGTTLVAGT

SEQ ID NO: 1128517 - protein, 25 aa, Mycobacterium
TPGRLDWAGTLTFGIGLTVLLIGIT

SEQ ID NO: 1128518 - protein, 24 aa, Mycobacterium
TPIPPELHAAVLAVVRESLSNVVR

SEQ ID NO: 1128519 - protein, 23 aa, Mycobacterium
TPLELLFDLTFVIAFGIAASEFA

SEQ ID NO: 1128520 - protein, 17 aa, Mycobacterium
TPLPWQFFAALVALTIG

SEQ ID NO: 1128521 - protein, 23 aa, Mycobacterium
TPLTTEFMREWALLGGVGPGIFL

SEQ ID NO: 1128522 - protein, 18 aa, Mycobacterium
TPMLFSVGFIATFLLGGL

SEQ ID NO: 1128523 - protein, 21 aa, Mycobacterium
TPMQRRDLLTRVIVAAAKADR

SEQ ID NO: 1128524 - protein, 27 aa, Mycobacterium
TPNSPVCDREKMDLFLGEHPDKAEAFR

SEQ ID NO: 1128525 - protein, 24 aa, Mycobacterium
TPPPRVGFIGAYRRLWHDLRAEWR

SEQ ID NO: 1128526 - protein, 28 aa, Mycobacterium
TPPRRSRGRWRRSAVVLAVMLLLFGVPW

SEQ ID NO: 1128527 - protein, 17 aa, Mycobacterium
TPQRGMTVAVMLLGVGG

SEQ ID NO: 1128528 - protein, 19 aa, Mycobacterium
TPSSFTMAGPWVGIAAPGE

SEQ ID NO: 1128529 - protein, 23 aa, Mycobacterium
TPWCAVGLVALPLAVRAAKPVRN

SEQ ID NO: 1128530 - protein, 18 aa, Mycobacterium
TPWFSREVPVRWWEYPTL

SEQ ID NO: 1128531 - protein, 17 aa, Mycobacterium
TPYELADTIARRLGLTG

SEQ ID NO: 1128532 - protein, 23 aa, Mycobacterium
TQADSWGWGSPRTVGSAGGGVAV

SEQ ID NO: 1128533 - protein, 23 aa, Mycobacterium
TQAWQAGLAWAFLIGVIVMIGAF

SEQ ID NO: 1128534 - protein, 27 aa, Mycobacterium
TQHLRIPLPRRPWLPPLQATYALEDLA

SEQ ID NO: 1128535 - protein, 25 aa, Mycobacterium
TQIVTRLLLFLAVAVVFGAVVFAAM

SEQ ID NO: 1128536 - protein, 21 aa, Mycobacterium
TQLGARLSAVGARLQQVTQRG

SEQ ID NO: 1128537 - protein, 22 aa, Mycobacterium
TQMPVAMTIGFAAHRPGDGRSI

SEQ ID NO: 1128538 - protein, 23 aa, Mycobacterium
TQRSGRLPEHFSAAFPVDLRAAT

SEQ ID NO: 1128539 - protein, 25 aa, Mycobacterium
TQSKFWSRWTGWVMRRPWVSATAAA

SEQ ID NO: 1128540 - protein, 24 aa, Mycobacterium
TQSRQVYQIQRWRSRLRNHIIIVG

SEQ ID NO: 1128541 - protein, 18 aa, Mycobacterium
TQYCGPDTPRACPDGTLF

SEQ ID NO: 1128542 - protein, 20 aa, Mycobacterium
TRAAALWTALTLGFLILIVL

SEQ ID NO: 1128543 - protein, 18 aa, Mycobacterium
TRAAVWLSATAFLALLVL

SEQ ID NO: 1128544 - protein, 25 aa, Mycobacterium
TRCDIDHTVPWPAGPTCAANLKCLC

SEQ ID NO: 1128545 - protein, 19 aa, Mycobacterium
TRKQSKRSLTISILGFAIV

SEQ ID NO: 1128546 - protein, 19 aa, Mycobacterium
TRKVWEIVVGVVVLFVYGS

SEQ ID NO: 1128547 - protein, 24 aa, Mycobacterium
TRLEHSRTALLTAVEQERRRIESD

SEQ ID NO: 1128548 - protein, 19 aa, Mycobacterium
TRLLAGMIVVIPLYCVAVL

SEQ ID NO: 1128549 - protein, 24 aa, Mycobacterium
TRLPGAVERILFGGGADAAREVLS

SEQ ID NO: 1128550 - protein, 21 aa, Mycobacterium
TRLPSAPPRPPAAPEEEPQTT

SEQ ID NO: 1128551 - protein, 17 aa, Mycobacterium
TRLRELGIRSAAGSPLT

SEQ ID NO: 1128552 - protein, 21 aa, Mycobacterium
TRLSSWRLLAGNPVTLVSALV

SEQ ID NO: 1128553 - protein, 18 aa, Mycobacterium
TRLTVVVISHDFGGLERL

SEQ ID NO: 1128554 - protein, 17 aa, Mycobacterium
TRNVRLLSAVSFLQDAA

SEQ ID NO: 1128555 - protein, 33 aa, Mycobacterium
TRPPAHTLPKPRLRPSGRIAVVGRVAAALVAVL

SEQ ID NO: 1128556 - protein, 19 aa, Mycobacterium
TRRALTWYAVQLVLNTAWT

SEQ ID NO: 1128557 - protein, 17 aa, Mycobacterium
TRRSLIYLGPGTLRTPG

SEQ ID NO: 1128558 - protein, 17 aa, Mycobacterium
TRSEAPGTFGYLIGFYG

SEQ ID NO: 1128559 - protein, 24 aa, Mycobacterium
TRSFAEGAGWLAQIGVFVILGLLV

SEQ ID NO: 1128560 - protein, 17 aa, Mycobacterium
TRSWWSGPEIYVVIDDY

SEQ ID NO: 1128561 - protein, 19 aa, Mycobacterium
TRTLWRVTLRLTAPAAAAG

SEQ ID NO: 1128562 - protein, 18 aa, Mycobacterium
TRVARFMLSDGLGNLGGP

SEQ ID NO: 1128563 - protein, 28 aa, Mycobacterium
TRWVVASALGGPVLIAAICLAVIHDAAS

SEQ ID NO: 1128564 - protein, 21 aa, Mycobacterium
TSADISWLLPLIYVLLAMSLV

SEQ ID NO: 1128565 - protein, 17 aa, Mycobacterium
TSAEWAAPWGSLRLSAT

SEQ ID NO: 1128566 - protein, 25 aa, Mycobacterium
TSAFRHLFSNGWLWASVGLGVALQI

SEQ ID NO: 1128567 - protein, 17 aa, Mycobacterium
TSAMNRFRRDFLAAYMS

SEQ ID NO: 1128568 - protein, 20 aa, Mycobacterium
TSESELALAVEEFGEQDTAP

SEQ ID NO: 1128569 - protein, 23 aa, Mycobacterium
TSLDPRFRFFGNVDVGEHVHPSE

SEQ ID NO: 1128570 - protein, 17 aa, Mycobacterium
TSLSLAIICETSDGDYY

SEQ ID NO: 1128571 - protein, 27 aa, Mycobacterium
TSMLQRKLRVGFAKAGRLMDLMETRGI

SEQ ID NO: 1128572 - protein, 20 aa, Mycobacterium
TSPEHKLRLVRALQATGEVV

SEQ ID NO: 1128573 - protein, 23 aa, Mycobacterium
TSPPSLWAMLGWLPPPVPILPVL

SEQ ID NO: 1128574 - protein, 19 aa, Mycobacterium
TSQMGRSFLQKIGLLPTPT

SEQ ID NO: 1128575 - protein, 24 aa, Mycobacterium
TSVPRLAALPLWTWLATVLLCMVF

SEQ ID NO: 1128576 - protein, 26 aa, Mycobacterium
TTAHIRTGTLLGERVLALDSDGSGTL

SEQ ID NO: 1128577 - protein, 28 aa, Mycobacterium
TTAILTFFFCWNDFLFAISLTSTDSART

SEQ ID NO: 1128578 - protein, 20 aa, Mycobacterium
TTASLHQMWALRSDEVVLTL

SEQ ID NO: 1128579 - protein, 18 aa, Mycobacterium
TTEMFTGAPQLVFHPGEQ

SEQ ID NO: 1128580 - protein, 23 aa, Mycobacterium
TTFLNPLDLVWSFVQAIAMAVTV

SEQ ID NO: 1128581 - protein, 25 aa, Mycobacterium
TTFQRFGNWVLAMALSILACGIAWL

SEQ ID NO: 1128582 - protein, 25 aa, Mycobacterium
TTGAWLFDMGMLLAISVGYLAFVRW

SEQ ID NO: 1128583 - protein, 17 aa, Mycobacterium
TTHFPWTPFSIVVVSAV

SEQ ID NO: 1128584 - protein, 24 aa, Mycobacterium
TTIDTPDGLYCKLPQDSPMNVRGA

SEQ ID NO: 1128585 - protein, 23 aa, Mycobacterium
TTIGCGIARGGPYEYVGQELPQK

SEQ ID NO: 1128586 - protein, 18 aa, Mycobacterium
TTLAMARDRYLPAGLAAV

SEQ ID NO: 1128587 - protein, 20 aa, Mycobacterium
TTLGALMLIPGVPGSGPESV

SEQ ID NO: 1128588 - protein, 26 aa, Mycobacterium
TTLPGLCFAAAGLTAPWLSRRFGLSR

SEQ ID NO: 1128589 - protein, 25 aa, Mycobacterium
TTLSFPVAPGLRPATLNATLNLPFA

SEQ ID NO: 1128590 - protein, 23 aa, Mycobacterium
TTLVNLLMRFYDVDSGRILLDGV

SEQ ID NO: 1128591 - protein, 17 aa, Mycobacterium
TTMQVCALLPFALPFVV

SEQ ID NO: 1128592 - protein, 18 aa, Mycobacterium
TTPLFAFLFLVALGVDYT

SEQ ID NO: 1128593 - protein, 18 aa, Mycobacterium
TTPPRVSDRLSWASPQLD

SEQ ID NO: 1128594 - protein, 18 aa, Mycobacterium
TTPWHHTHHWAIRKHTAS

SEQ ID NO: 1128595 - protein, 24 aa, Mycobacterium
TTRPSGRSARRWLAVAAATFAIAW

SEQ ID NO: 1128596 - protein, 23 aa, Mycobacterium
TTSRVIGALAYALSPRVLTTIGA

SEQ ID NO: 1128597 - protein, 29 aa, Mycobacterium
TTTARPDALKEFGDGVAKAVNDTRITLKK

SEQ ID NO: 1128598 - protein, 29 aa, Mycobacterium
TTTARPNALKEFGDGVAKAVNDTRITLKK

SEQ ID NO: 1128599 - protein, 25 aa, Mycobacterium
TTVIIRFWLLTAIACGLGVALFYSE

SEQ ID NO: 1128600 - protein, 19 aa, Mycobacterium
TTVPWGLEIYERVDASGAR

SEQ ID NO: 1128601 - protein, 27 aa, Mycobacterium
TTWTNWIEIFLLLVIAFSLPRTFGRMV

SEQ ID NO: 1128602 - protein, 19 aa, Mycobacterium
TVAAAFRRVVLPLLLPGIV

SEQ ID NO: 1128603 - protein, 21 aa, Mycobacterium
TVAAGCWQAAQAVGRRNAQQS

SEQ ID NO: 1128604 - protein, 22 aa, Mycobacterium
TVADFLPPVLRTVTIGLPETPT

SEQ ID NO: 1128605 - protein, 23 aa, Mycobacterium
TVALCSFLLAWIFALDRVYEAYR

SEQ ID NO: 1128606 - protein, 25 aa, Mycobacterium
TVALLGASGYMVWTHRGAEKLRQQN

SEQ ID NO: 1128607 - protein, 21 aa, Mycobacterium
TVALVIRFVVHRMIDRATTSR

SEQ ID NO: 1128608 - protein, 24 aa, Mycobacterium
TVATACACGGLLSVDPSMRIADEL

SEQ ID NO: 1128609 - protein, 26 aa, Mycobacterium
TVCCILSFIVGFAMLGALTFLPTFMQ

SEQ ID NO: 1128610 - protein, 18 aa, Mycobacterium
TVCSVSIAAGCLAIQDPY

SEQ ID NO: 1128611 - protein, 24 aa, Mycobacterium
TVDRMSAAFGEEGSKTMVFVAMED

SEQ ID NO: 1128612 - protein, 17 aa, Mycobacterium
TVFGLGIGPAVLIHEGS

SEQ ID NO: 1128613 - protein, 19 aa, Mycobacterium
TVGALLPLIAILLPPTTWR

SEQ ID NO: 1128614 - protein, 25 aa, Mycobacterium
TVHPRRLTPWVAILFTTLIAFGLIF

SEQ ID NO: 1128615 - protein, 29 aa, Mycobacterium
TVIALAVLGWYYLRVPSLVGIGQYTLHAE

SEQ ID NO: 1128616 - protein, 17 aa, Mycobacterium
TVIGLLTILGFSLYDTV

SEQ ID NO: 1128617 - protein, 26 aa, Mycobacterium
TVIRMFLVPALMKWLGDECWWAPQWM

SEQ ID NO: 1128618 - protein, 19 aa, Mycobacterium
TVIVGAEWALPGVNAAPTH

SEQ ID NO: 1128619 - protein, 19 aa, Mycobacterium
TVIVGRAVFGADITIGEAW

SEQ ID NO: 1128620 - protein, 25 aa, Mycobacterium
TVKVPLRICSLRDLAKFAETQVALV

SEQ ID NO: 1128621 - protein, 23 aa, Mycobacterium
TVLDAKMPGAFEVTFYPGEAALA

SEQ ID NO: 1128622 - protein, 17 aa, Mycobacterium
TVLFSALTVALSMAAML

SEQ ID NO: 1128623 - protein, 18 aa, Mycobacterium
TVLGERVLVLRPAGRESL

SEQ ID NO: 1128624 - protein, 25 aa, Mycobacterium
TVLPDRWMAVFGFVSLLAFIATAVL

SEQ ID NO: 1128625 - protein, 19 aa, Mycobacterium
TVLTAGWLLGGTVGVGTVV

SEQ ID NO: 1128626 - protein, 26 aa, Mycobacterium
TVLVAIPFTVLVSFTLNILLRELGAA

SEQ ID NO: 1128627 - protein, 19 aa, Mycobacterium
TVMLLSRFLGPILDNAGAA

SEQ ID NO: 1128628 - protein, 19 aa, Mycobacterium
TVMTLRSSVLGIIDTQLSV

SEQ ID NO: 1128629 - protein, 25 aa, Mycobacterium
TVNDLRTWFLIFAFVAIGLEFSLRG

SEQ ID NO: 1128630 - protein, 19 aa, Mycobacterium
TVNRGCVVQTHLFHDRIMR

SEQ ID NO: 1128631 - protein, 19 aa, Mycobacterium
TVNTEWYNTALGLAMVFGR

SEQ ID NO: 1128632 - protein, 18 aa, Mycobacterium
TVPFLRVQIDNITPDVVT

SEQ ID NO: 1128633 - protein, 20 aa, Mycobacterium
TVPLLRRVSVLAPRTGEGPQ

SEQ ID NO: 1128634 - protein, 21 aa, Mycobacterium
TVPLSLWVTRSIAKRSRTLFV

SEQ ID NO: 1128635 - protein, 24 aa, Mycobacterium
TVPMCLLSVLLVVNLWTGYFPTVQ

SEQ ID NO: 1128636 - protein, 27 aa, Mycobacterium
TVPVCIVLGVGAAWLVERSDIPGRAIW

SEQ ID NO: 1128637 - protein, 17 aa, Mycobacterium
TVRAGGVAMTYVQINTQ

SEQ ID NO: 1128638 - protein, 26 aa, Mycobacterium
TVRTLRRGMPFALTWWSLTFPVGTFV

SEQ ID NO: 1128639 - protein, 18 aa, Mycobacterium
TVSEKCCAAIPAGSSLAD

SEQ ID NO: 1128640 - protein, 17 aa, Mycobacterium
TVSIMRGVQGSFLGVSL

SEQ ID NO: 1128641 - protein, 21 aa, Mycobacterium
TVSPVEFWQYPTINALAKFLT

SEQ ID NO: 1128642 - protein, 25 aa, Mycobacterium
TVTVFSPRAGLVMETDAKVKYRGIQ

SEQ ID NO: 1128643 - protein, 26 aa, Mycobacterium
TVVALCLPWLLHRLGRDPAFGSGPLA

SEQ ID NO: 1128644 - protein, 18 aa, Mycobacterium
TVVFSFMALFVINVVVTA

SEQ ID NO: 1128645 - protein, 17 aa, Mycobacterium
TVVMPRLSRNAAADDAP

SEQ ID NO: 1128646 - protein, 34 aa, Mycobacterium
TVVVIKRGLLKWAWIPGVPLLWDLVITMTASWQK

SEQ ID NO: 1128647 - protein, 18 aa, Mycobacterium
TWDGGDWTGSHRAVTPGR

SEQ ID NO: 1128648 - protein, 19 aa, Mycobacterium
TWMSCAFVVVAGRLRRWAA

SEQ ID NO: 1128649 - protein, 20 aa, Mycobacterium
TWMTWVGGISLGMFALGLTV

SEQ ID NO: 1128650 - protein, 17 aa, Mycobacterium
TWPVKRMRRADVRTSVL

SEQ ID NO: 1128651 - protein, 19 aa, Mycobacterium
TWWPYLIGGVVFNAAAGWP

SEQ ID NO: 1128652 - protein, 19 aa, Mycobacterium
TWWRQPHEFDWTARYFRAR

SEQ ID NO: 1128653 - protein, 27 aa, Mycobacterium
TYAFYDFERAWPLTVLAAVFAIVIVAV

SEQ ID NO: 1128654 - protein, 22 aa, Mycobacterium
TYFPPLWRRMMDHRVLAHYGGD

SEQ ID NO: 1128655 - protein, 18 aa, Mycobacterium
TYIGQWFSLVIIFTAIVS

SEQ ID NO: 1128656 - protein, 23 aa, Mycobacterium
TYLCYEGAEKVWGMIRGHEKHGA

SEQ ID NO: 1128657 - protein, 25 aa, Mycobacterium
TYLGFGSIALWAFRFAWVQLGALGT

SEQ ID NO: 1128658 - protein, 18 aa, Mycobacterium
TYLHSAWWLSFIPGLAIV

SEQ ID NO: 1128659 - protein, 18 aa, Mycobacterium
TYLYIPFQYASVIMGAYL

SEQ ID NO: 1128660 - protein, 21 aa, Mycobacterium
TYRLVGGALRKRLPAEDLTPF

SEQ ID NO: 1128661 - protein, 19 aa, Mycobacterium
TYSGFTIVKTFGHRAAAQQ

SEQ ID NO: 1128662 - protein, 19 aa, Mycobacterium
TYTAQGWLYKTLVEVAILP

SEQ ID NO: 1128663 - protein, 28 aa, Mycobacterium
TYVRCTRCNRFICPECMHDAAVGHQCPD

SEQ ID NO: 1128664 - protein, 36 aa, Mycobacterium
TYWQWASLTLAAPVVVWAAWPFHRAAWANLRHGTAT

SEQ ID NO: 1128665 - protein, 19 aa, Mycobacterium
VAAAVLWAGSWAFGPHSAL

SEQ ID NO: 1128666 - protein, 23 aa, Mycobacterium
VAACAACGLVYELALLTLSSSIH

SEQ ID NO: 1128667 - protein, 22 aa, Mycobacterium
VAACAALLVWFWPRLLEQGMAL

SEQ ID NO: 1128668 - protein, 26 aa, Mycobacterium
VAACATAAALLVRWEPLAVGSGIPHV

SEQ ID NO: 1128669 - protein, 24 aa, Mycobacterium
VAAEPPLRLPTYLTDNAGALDTAG

SEQ ID NO: 1128670 - protein, 18 aa, Mycobacterium
VAAFAAQCALTFTGAYEV

SEQ ID NO: 1128671 - protein, 18 aa, Mycobacterium
VAAFRRSRSAAGRTTVAS

SEQ ID NO: 1128672 - protein, 25 aa, Mycobacterium
VAAFVDLRGAIGFSSFGVLLYYAIA

SEQ ID NO: 1128673 - protein, 20 aa, Mycobacterium
VAAFVLALTYRSYRINTIEE

SEQ ID NO: 1128674 - protein, 18 aa, Mycobacterium
VAAGGGWAAQNLSPRPPA

SEQ ID NO: 1128675 - protein, 22 aa, Mycobacterium
VAAHVSRFGYWALLAPIAAAGT

SEQ ID NO: 1128676 - protein, 19 aa, Mycobacterium
VAAIAKWLVVGRITAIEHP

SEQ ID NO: 1128677 - protein, 29 aa, Mycobacterium
VAAIGFCMGGGLVWRLLAAGSPELAAAFP

SEQ ID NO: 1128678 - protein, 27 aa, Mycobacterium
VAAITSRLPLVLGLIAVSTFCLLFLLT

SEQ ID NO: 1128679 - protein, 20 aa, Mycobacterium
VAAKLYPLLLLVPLALLAVR

SEQ ID NO: 1128680 - protein, 17 aa, Mycobacterium
VAAKLYPLLLLVPLTLL

SEQ ID NO: 1128681 - protein, 22 aa, Mycobacterium
VAALGVAVWALISSPSSSETSS

SEQ ID NO: 1128682 - protein, 26 aa, Mycobacterium
VAALLRRLHFYAGVFVGPFLLIAAVS

SEQ ID NO: 1128683 - protein, 19 aa, Mycobacterium
VAALMGRRRTGVTGRGSGL

SEQ ID NO: 1128684 - protein, 20 aa, Mycobacterium
VAALTFPIGVGLAVAAQPLV

SEQ ID NO: 1128685 - protein, 18 aa, Mycobacterium
VAALTTWLTAPRPGGHLD

SEQ ID NO: 1128686 - protein, 19 aa, Mycobacterium
VAAMMLLRYIRADLSAERP

SEQ ID NO: 1128687 - protein, 18 aa, Mycobacterium
VAAPIWDIGANIKNQGIQ

SEQ ID NO: 1128688 - protein, 19 aa, Mycobacterium
VAAPIWDIGANIKNQGIQF

SEQ ID NO: 1128689 - protein, 32 aa, Mycobacterium
VAAPVHAPWLCACAAVLCVLAVRGAGSPASPN

SEQ ID NO: 1128690 - protein, 17 aa, Mycobacterium
VAARGATVFALARNAEA

SEQ ID NO: 1128691 - protein, 18 aa, Mycobacterium
VAARVGRFGQLARRPQTG

SEQ ID NO: 1128692 - protein, 18 aa, Mycobacterium
VAASALWFTGLGFGAKRL

SEQ ID NO: 1128693 - protein, 21 aa, Mycobacterium
VAASPCALAISVPVTVVAAIG

SEQ ID NO: 1128694 - protein, 17 aa, Mycobacterium
VAASVLPPSAFGRGPLK

SEQ ID NO: 1128695 - protein, 21 aa, Mycobacterium
VAATRAAGRLVVYETVTSDTT

SEQ ID NO: 1128696 - protein, 31 aa, Mycobacterium
VAAVARWGVPEPRWAASWLGLQRAAHLLVGA

SEQ ID NO: 1128697 - protein, 18 aa, Mycobacterium
VAAVGAYHVYKGVSEKFL

SEQ ID NO: 1128698 - protein, 17 aa, Mycobacterium
VAAWLVWRTGPSPETRR

SEQ ID NO: 1128699 - protein, 19 aa, Mycobacterium
VACAVGAVYFGSRASMGVG

SEQ ID NO: 1128700 - protein, 21 aa, Mycobacterium
VACGLLAGRLLRLPSAAILGP

SEQ ID NO: 1128701 - protein, 19 aa, Mycobacterium
VACQVPVYLMRSSRFTALE

SEQ ID NO: 1128702 - protein, 18 aa, Mycobacterium
VADGGIALRVQQVTGLGF

SEQ ID NO: 1128703 - protein, 18 aa, Mycobacterium
VADGRRVVLGAADTFRAA

SEQ ID NO: 1128704 - protein, 23 aa, Mycobacterium
VAEAAVSLLTRWLSSTIGEGLIL

SEQ ID NO: 1128705 - protein, 20 aa, Mycobacterium
VAEARRTRPRVVSVDDDGLR

SEQ ID NO: 1128706 - protein, 22 aa, Mycobacterium
VAEGRYGIRVSPPHLGEDFDSL

SEQ ID NO: 1128707 - protein, 22 aa, Mycobacterium
VAELQRAGAVAVHTVGFDADDL

SEQ ID NO: 1128708 - protein, 25 aa, Mycobacterium
VAELSWPAHRPIAASVDAATGADRL

SEQ ID NO: 1128709 - protein, 23 aa, Mycobacterium
VAEPVIFRAPLVTVPRAGTVAGK

SEQ ID NO: 1128710 - protein, 17 aa, Mycobacterium
VAERVCTELGLASKGTL

SEQ ID NO: 1128711 - protein, 18 aa, Mycobacterium
VAFEQRYLDWSVWIGVVV

SEQ ID NO: 1128712 - protein, 18 aa, Mycobacterium
VAFEVFKQLGSVYLRSVV

SEQ ID NO: 1128713 - protein, 17 aa, Mycobacterium
VAFGYGWNDWVPAGAIA

SEQ ID NO: 1128714 - protein, 17 aa, Mycobacterium
VAFITMMLSLVWPIASL

SEQ ID NO: 1128715 - protein, 18 aa, Mycobacterium
VAFITMMLSLVWPIASLG

SEQ ID NO: 1128716 - protein, 18 aa, Mycobacterium
VAFMRMFGVGLTLAILAD

SEQ ID NO: 1128717 - protein, 19 aa, Mycobacterium
VAFPGVLGILARRLPIQDL

SEQ ID NO: 1128718 - protein, 20 aa, Mycobacterium
VAFVAVWIWLQIWQGLTGNT

SEQ ID NO: 1128719 - protein, 20 aa, Mycobacterium
VAFVIGRPIITLSFNNEKFN

SEQ ID NO: 1128720 - protein, 19 aa, Mycobacterium
VAGALAWSYGEPVALLTTV

SEQ ID NO: 1128721 - protein, 17 aa, Mycobacterium
VAGFLKWQDTAATQAEV

SEQ ID NO: 1128722 - protein, 21 aa, Mycobacterium
VAGGFGWLMAGRALAPLQDVT

SEQ ID NO: 1128723 - protein, 19 aa, Mycobacterium
VAGGIRLASGISFLVDPLR

SEQ ID NO: 1128724 - protein, 17 aa, Mycobacterium
VAGGLLGIRAWLQKPAP

SEQ ID NO: 1128725 - protein, 17 aa, Mycobacterium
VAGISVQLLWFLGAYVL

SEQ ID NO: 1128726 - protein, 21 aa, Mycobacterium
VAGLFGWGAWQRRWIADDGLI

SEQ ID NO: 1128727 - protein, 20 aa, Mycobacterium
VAGLGGWLGWLVPLLTVRCW

SEQ ID NO: 1128728 - protein, 26 aa, Mycobacterium
VAGNWPDPLPLLGWVLAAAAVATFVV

SEQ ID NO: 1128729 - protein, 18 aa, Mycobacterium
VAGPDHAWELDLPDEPVT

SEQ ID NO: 1128730 - protein, 19 aa, Mycobacterium
VAGRLPGHMNVLLAEAKVP

SEQ ID NO: 1128731 - protein, 17 aa, Mycobacterium
VAGRPGVLLLLPGASAG

SEQ ID NO: 1128732 - protein, 24 aa, Mycobacterium
VAGSVCLMVCYLLVEIAAAYFVGA

SEQ ID NO: 1128733 - protein, 20 aa, Mycobacterium
VAGSVFAVWPGVGGDGSASP

SEQ ID NO: 1128734 - protein, 28 aa, Mycobacterium
VAGTMLLRLCMLPGLALLIWAVPRVARH

SEQ ID NO: 1128735 - protein, 21 aa, Mycobacterium
VAGVLALYLLGWVMIGISRVH

SEQ ID NO: 1128736 - protein, 21 aa, Mycobacterium
VAIALRIGRGTLRKMRQNLGW

SEQ ID NO: 1128737 - protein, 18 aa, Mycobacterium
VAIAVCLVTGLISHLIQH

SEQ ID NO: 1128738 - protein, 17 aa, Mycobacterium
VAIGFGFLTKMLQALLV

SEQ ID NO: 1128739 - protein, 19 aa, Mycobacterium
VAIGSRFGLFDPKRAISSR

SEQ ID NO: 1128740 - protein, 25 aa, Mycobacterium
VAIHLLVSMAMVWLAVLLFVKIGEP

SEQ ID NO: 1128741 - protein, 26 aa, Mycobacterium
VAIHLLVSMAMVWLAVLLYVKIGEPD

SEQ ID NO: 1128742 - protein, 17 aa, Mycobacterium
VAILGGRPAMISAATGA

SEQ ID NO: 1128743 - protein, 20 aa, Mycobacterium
VAILMLLPLAAFEATGALPG

SEQ ID NO: 1128744 - protein, 17 aa, Mycobacterium
VAIVFDFIMEGLILLPI

SEQ ID NO: 1128745 - protein, 18 aa, Mycobacterium
VAIVRDLLDNTVKDRKTL

SEQ ID NO: 1128746 - protein, 20 aa, Mycobacterium
VAKLMRFVPRSVMVGFVNAL

SEQ ID NO: 1128747 - protein, 19 aa, Mycobacterium
VALALASMVFARLSVFQGV

SEQ ID NO: 1128748 - protein, 21 aa, Mycobacterium
VALALFVRVELRAEEPVLPIR

SEQ ID NO: 1128749 - protein, 20 aa, Mycobacterium
VALALLRLLRRIKRLIWAAV

SEQ ID NO: 1128750 - protein, 22 aa, Mycobacterium
VALAWKHPRFDPAKPGRQLPAW

SEQ ID NO: 1128751 - protein, 23 aa, Mycobacterium
VALFCISAAPILSVLFHELIAAQ

SEQ ID NO: 1128752 - protein, 27 aa, Mycobacterium
VALGGVGAWIGCRRRGIALPAFGDAVA

SEQ ID NO: 1128753 - protein, 26 aa, Mycobacterium
VALGLAIGGSASWTGGLWTFALAAVG

SEQ ID NO: 1128754 - protein, 19 aa, Mycobacterium
VALGLPLTITFVIACVAER

SEQ ID NO: 1128755 - protein, 25 aa, Mycobacterium
VALGQQCARHPLPMPAALAKVLTAA

SEQ ID NO: 1128756 - protein, 24 aa, Mycobacterium
VALIKMMIAPVIFCTIVLGIGSVR

SEQ ID NO: 1128757 - protein, 19 aa, Mycobacterium
VALIPRLGVSVAVLSAIAV

SEQ ID NO: 1128758 - protein, 31 aa, Mycobacterium; identical to SEQ ID NO: 332944

SEQ ID NO: 1128759 - protein, 25 aa, Mycobacterium
VALLALPLIGVWVMVSTLQAGFAHQ

SEQ ID NO: 1128760 - protein, 24 aa, Mycobacterium
VALLALVGVLGWLVGTSAGRADSR

SEQ ID NO: 1128761 - protein, 23 aa, Mycobacterium
VALLASAGMAGWLYLNDYRPDQQ

SEQ ID NO: 1128762 - protein, 18 aa, Mycobacterium
VALLKKVLDSGGGVNPIA

SEQ ID NO: 1128763 - protein, 17 aa, Mycobacterium
VALLSVLVWLRRAIPAL

SEQ ID NO: 1128764 - protein, 17 aa, Mycobacterium
VALLWFLGVYLIALAFV

SEQ ID NO: 1128765 - protein, 18 aa, Mycobacterium
VALLWFLGVYVVTLAFVP

SEQ ID NO: 1128766 - protein, 27 aa, Mycobacterium
VALMLLSAGLFKGSFRSFVPVTLTSDR

SEQ ID NO: 1128767 - protein, 25 aa, Mycobacterium
VALMLMAWLWLGRRVVDRTATEYTM

SEQ ID NO: 1128768 - protein, 17 aa, Mycobacterium
VALRPVPEVTRLIRRLL

SEQ ID NO: 1128769 - protein, 17 aa, Mycobacterium
VALSMVAMVLFPMYFLK

SEQ ID NO: 1128770 - protein, 23 aa, Mycobacterium
VALTDWYPLDPIVALAVGVNILW

SEQ ID NO: 1128771 - protein, 26 aa, Mycobacterium
VALTGVVCFVGFLASYLFNVYFQNGA

SEQ ID NO: 1128772 - protein, 40 aa, Mycobacterium
VALVTAIGWRTRRWRLLWIPWAVVVGGAFAVTAYEFVASE

SEQ ID NO: 1128773 - protein, 17 aa, Mycobacterium
VAMGFRFWSLRVEESRV

SEQ ID NO: 1128774 - protein, 19 aa, Mycobacterium
VAMIPLVWLIYTVLAKGVA

SEQ ID NO: 1128775 - protein, 18 aa, Mycobacterium
VAMLYGYAGTLDLRGIAA

SEQ ID NO: 1128776 - protein, 24 aa, Mycobacterium
VANIPVLLWRALCSPDCGPNRVRL

SEQ ID NO: 1128777 - protein, 23 aa, Mycobacterium
VANRRLAAIVVIFAGAVVGALLM

SEQ ID NO: 1128778 - protein, 17 aa, Mycobacterium
VAPIHGWVYFAYLLFTA

SEQ ID NO: 1128779 - protein, 25 aa, Mycobacterium
VAPLKFAQLVGFAFAVVGVLGFASG

SEQ ID NO: 1128780 - protein, 25 aa, Mycobacterium
VAPLLGVLCSVGWQPRPPGVSVSTS

SEQ ID NO: 1128781 - protein, 23 aa, Mycobacterium
VAPPKAGKSWMVAGIGLACAIGG

SEQ ID NO: 1128782 - protein, 24 aa, Mycobacterium
VAPRRWPRALPIAAAAVTVAVLAA

SEQ ID NO: 1128783 - protein, 20 aa, Mycobacterium
VAPSRARMIAVLGALVALGP

SEQ ID NO: 1128784 - protein, 18 aa, Mycobacterium
VAQIAFLVVAAFLLTNKV

SEQ ID NO: 1128785 - protein, 21 aa, Mycobacterium
VAQLRRDGFHIAMLTGDNRTT

SEQ ID NO: 1128786 - protein, 19 aa, Mycobacterium
VAQRQGRRLAWTAAVCALM

SEQ ID NO: 1128787 - protein, 17 aa, Mycobacterium
VAQRQPRQFRFFYSSAD

SEQ ID NO: 1128788 - protein, 17 aa, Mycobacterium
VAQSYWVRIQLFLHGGE

SEQ ID NO: 1128789 - protein, 17 aa, Mycobacterium
VAQTFARMHLPEHLGMG

SEQ ID NO: 1128790 - protein, 17 aa, Mycobacterium
VARAARAGILMKGGAAL

SEQ ID NO: 1128791 - protein, 25 aa, Mycobacterium
VARPYEWWRVALVAVSGLAYVVIFS

SEQ ID NO: 1128792 - protein, 17 aa, Mycobacterium
VARRPVLALSIMVVIEF

SEQ ID NO: 1128793 - protein, 21 aa, Mycobacterium
VARRWRVVGWSATIAALTLAG

SEQ ID NO: 1128794 - protein, 20 aa, Mycobacterium
VASAGLRPVGRLTQAAERVA

SEQ ID NO: 1128795 - protein, 20 aa, Mycobacterium
VASAVWLTAWVFTAAPAAIP

SEQ ID NO: 1128796 - protein, 23 aa, Mycobacterium
VASDPRAAAVVRAVIDLTHDLGS

SEQ ID NO: 1128797 - protein, 31 aa, Mycobacterium
VASFVFLALVLKRGMGLGVAYGIWGATGVAL

SEQ ID NO: 1128798 - protein, 34 aa, Mycobacterium
VASGAVMLFGLMLPWLGAVAILGAVIFGTVWLAQ

SEQ ID NO: 1128799 - protein, 28 aa, Mycobacterium
VASGTGLAGWLLLRMRLNRMRFQAWDRE

SEQ ID NO: 1128800 - protein, 28 aa, Mycobacterium
VASPATHWDWLKWLPHRCDTPSARHHVV

SEQ ID NO: 1128801 - protein, 20 aa, Mycobacterium
VASPLTAVVLNFSEEINPAF

SEQ ID NO: 1128802 - protein, 25 aa, Mycobacterium
VASSIRAGLAVPRPLTALIDEATSA

SEQ ID NO: 1128803 - protein, 18 aa, Mycobacterium
VATLAAWLLTGHSATVAF

SEQ ID NO: 1128804 - protein, 18 aa, Mycobacterium
VATLAVWLLTGHSATVAF

SEQ ID NO: 1128805 - protein, 17 aa, Mycobacterium
VATVFGLAWTQARDTAS

SEQ ID NO: 1128806 - protein, 21 aa, Mycobacterium
VAVAALVVFVSWAVNENDKRL

SEQ ID NO: 1128807 - protein, 17 aa, Mycobacterium
VAVAGLVGFVGNELVAL

SEQ ID NO: 1128808 - protein, 18 aa, Mycobacterium
VAVAGVLIVAGVSGGVAA

SEQ ID NO: 1128809 - protein, 17 aa, Mycobacterium
VAVCAGVTVIVRESPGE

SEQ ID NO: 1128810 - protein, 24 aa, Mycobacterium
VAVDRAVRRWALILIPLGVAVFAV

SEQ ID NO: 1128811 - protein, 22 aa, Mycobacterium
VAVFILVRPGWFETPFQEGPPP

SEQ ID NO: 1128812 - protein, 35 aa, Mycobacterium
VAVGGLAPTVWGWRKVPVWRWFVLGAGVGVAGAWV

SEQ ID NO: 1128813 - protein, 21 aa, Mycobacterium
VAVGIGLAWGRGGMLVLGQGV

SEQ ID NO: 1128814 - protein, 25 aa, Mycobacterium
VAVGKRGELSYSFDELRAGGVALVL

SEQ ID NO: 1128815 - protein, 23 aa, Mycobacterium
VAVGNFLFVWLIPVALGVAYARR

SEQ ID NO: 1128816 - protein, 23 aa, Mycobacterium
VAVGRKLGLPKRVMSILTGESLI

SEQ ID NO: 1128817 - protein, 17 aa, Mycobacterium
VAVGVLFGVVAVLTKLV

SEQ ID NO: 1128818 - protein, 18 aa, Mycobacterium
VAVIGALWWLGREETTRE

SEQ ID NO: 1128819 - protein, 18 aa, Mycobacterium
VAVLACVIVATRIAGWIR

SEQ ID NO: 1128820 - protein, 17 aa, Mycobacterium
VAVLIGAMLLIKGADVG

SEQ ID NO: 1128821 - protein, 23 aa, Mycobacterium
VAVPAATVWDVFTDVERVAPCLP

SEQ ID NO: 1128822 - protein, 17 aa, Mycobacterium
VAVQMHWYYGGRSDGVA

SEQ ID NO: 1128823 - protein, 18 aa, Mycobacterium
VAVTIAIWNPYVAERLLQ

SEQ ID NO: 1128824 - protein, 23 aa, Mycobacterium
VAVTMCAIGTWAAFSLNTTVTYS

SEQ ID NO: 1128825 - protein, 20 aa, Mycobacterium
VAVVAACRRGVPAAAGSTLG

SEQ ID NO: 1128826 - protein, 19 aa, Mycobacterium
VAVVFFSGFFIGRATDGFG

SEQ ID NO: 1128827 - protein, 22 aa, Mycobacterium
VAVVVAVRIARRAMRSDRSTGP

SEQ ID NO: 1128828 - protein, 18 aa, Mycobacterium
VAVWALFWLGWAIVLAAT

SEQ ID NO: 1128829 - protein, 23 aa, Mycobacterium
VAVYRIRVGRQIGSAALIADGLH

SEQ ID NO: 1128830 - protein, 28 aa, Mycobacterium
VAVYRLSRRGAPWSTRRTVSWLIGCLAL

SEQ ID NO: 1128831 - protein, 26 aa, Mycobacterium
VAWFLRFLVRHSMYWFVGYRIVLGTV

SEQ ID NO: 1128832 - protein, 34 aa, Mycobacterium
VAWRQRRLAPTWPFQVGLLLAGWGIFNLVEGLID

SEQ ID NO: 1128833 - protein, 18 aa, Mycobacterium
VAYLAYLAVRQWRTAAID

SEQ ID NO: 1128834 - protein, 19 aa, Mycobacterium
VAYSRLIFVSGLERHLPRI

SEQ ID NO: 1128835 - protein, 20 aa, Mycobacterium
VCAFAAFAGVLLVRMSVQRR

SEQ ID NO: 1128836 - protein, 21 aa, Mycobacterium
VCAGIPLLVADPGFYLTNSAP

SEQ ID NO: 1128837 - protein, 19 aa, Mycobacterium
VCIAGAWLYTGGSKPYGYS

SEQ ID NO: 1128838 - protein, 20 aa, Mycobacterium
VCPGNIQSPGPWRRNDTPAV

SEQ ID NO: 1128839 - protein, 17 aa, Mycobacterium
VCSAAYAVWAWLQPGSF

SEQ ID NO: 1128840 - protein, 21 aa, Mycobacterium
VCYAWPFYALVDMGSVPLLTV

SEQ ID NO: 1128841 - protein, 20 aa, Mycobacterium
VDAAARCLLAAVGAAVVIGT

SEQ ID NO: 1128842 - protein, 17 aa, Mycobacterium
VDALGCYGPPERALAVM

SEQ ID NO: 1128843 - protein, 23 aa, Mycobacterium
VDAMPVRIGVGVIGAVIVFSLIM

SEQ ID NO: 1128844 - protein, 23 aa, Mycobacterium
VDAPARRRRALAILTGLVVMLTA

SEQ ID NO: 1128845 - protein, 23 aa, Mycobacterium
VDARLADGMAVFAVLYGVPVWGF

SEQ ID NO: 1128846 - protein, 21 aa, Mycobacterium
VDEVLRLLPRPPQEHLEEGRR

SEQ ID NO: 1128847 - protein, 24 aa, Mycobacterium
VDFLSIGWWPVFNVADPSVVGGAI

SEQ ID NO: 1128848 - protein, 24 aa, Mycobacterium
VDGEPRAKIILDVNPKYLDLIPSN

SEQ ID NO: 1128849 - protein, 17 aa, Mycobacterium
VDGLGCYGAPERALRVM

SEQ ID NO: 1128850 - protein, 19 aa, Mycobacterium
VDGLTRFTAFRLVVLPQVY

SEQ ID NO: 1128851 - protein, 17 aa, Mycobacterium
VDGRGVGVIALADAARE

SEQ ID NO: 1128852 - protein, 17 aa, Mycobacterium
VDGRGVGVIALADAVRE

SEQ ID NO: 1128853 - protein, 18 aa, Mycobacterium
VDGVRWVVYEGGEVDGKP

SEQ ID NO: 1128854 - protein, 24 aa, Mycobacterium
VDLEIAPGVVTTWMKLAVRDRIVD

SEQ ID NO: 1128855 - protein, 27 aa, Mycobacterium
VDLLLTQRFMLRWRTWLTDRLTGDWLD

SEQ ID NO: 1128856 - protein, 20 aa, Mycobacterium
VDLLMLVAMLTRIAEFGVTP

SEQ ID NO: 1128857 - protein, 19 aa, Mycobacterium
VDLRVSYTGAMTVADQDRI

SEQ ID NO: 1128858 - protein, 18 aa, Mycobacterium
VDMLVWVPRMLYLFGEQK

SEQ ID NO: 1128859 - protein, 27 aa, Mycobacterium
VDPAPRPRRRLGLLLSVAAVILVLDVV

SEQ ID NO: 1128860 - protein, 25 aa, Mycobacterium
VDPDALRRLFGWFVLLMASVILAQE

SEQ ID NO: 1128861 - protein, 25 aa, Mycobacterium
VDPGRFTHALGFAVAERGATMLSGE

SEQ ID NO: 1128862 - protein, 18 aa, Mycobacterium
VDPVRQLVVPRFLALLLI

SEQ ID NO: 1128863 - protein, 23 aa, Mycobacterium
VDQAKRIADELIQNGSASHASLG

SEQ ID NO: 1128864 - protein, 26 aa, Mycobacterium
VDQQRWSFDLAMTWDLLSRSFTHGIA

SEQ ID NO: 1128865 - protein, 26 aa, Mycobacterium
VDRAHPRPVVGFGFGLLTAGLIWLAV

SEQ ID NO: 1128866 - protein, 17 aa, Mycobacterium
VDRAVALSGADLAELLG

SEQ ID NO: 1128867 - protein, 26 aa, Mycobacterium
VDRSHPRPVVGFGFALMAIGLTWLSI

SEQ ID NO: 1128868 - protein, 28 aa, Mycobacterium
VDRYAEGAYGFWIPLTVLMVLRPETAHT

SEQ ID NO: 1128869 - protein, 19 aa, Mycobacterium
VDSLGWQWIFIVNLPVGVL

SEQ ID NO: 1128870 - protein, 22 aa, Mycobacterium
VDSWMCAISGRAKQFGMIEYLK

SEQ ID NO: 1128871 - protein, 23 aa, Mycobacterium
VDSYRTGSFIDLGWAVALVAICA

SEQ ID NO: 1128872 - protein, 18 aa, Mycobacterium
VDTAFWLWVAALPLLAIG

SEQ ID NO: 1128873 - protein, 18 aa, Mycobacterium
VDVASALALAVAIQLLLQ

SEQ ID NO: 1128874 - protein, 17 aa, Mycobacterium
VDVISLVTALGCVAVSV

SEQ ID NO: 1128875 - protein, 24 aa, Mycobacterium
VDVNRMTDIYAWADPVLRSLDNSP

SEQ ID NO: 1128876 - protein, 22 aa, Mycobacterium
VDYKGGTAFADCVGLPHTVGLV

SEQ ID NO: 1128877 - protein, 18 aa, Mycobacterium
VEAAHRFGRFFTGQVTAA

SEQ ID NO: 1128878 - protein, 17 aa, Mycobacterium
VEAGGRMSAFLRGAWIV

SEQ ID NO: 1128879 - protein, 17 aa, Mycobacterium
VEALACLALDMAEAVAD

SEQ ID NO: 1128880 - protein, 20 aa, Mycobacterium
VEALARWTAPNGIDISPETF

SEQ ID NO: 1128881 - protein, 26 aa, Mycobacterium
VEALLRWPHPRLGMLSPDAFLPLVRQ

SEQ ID NO: 1128882 - protein, 17 aa, Mycobacterium
VEALVGLGFAQKQAEEA

SEQ ID NO: 1128883 - protein, 17 aa, Mycobacterium
VEAVAPWLTTDTAVYPA

SEQ ID NO: 1128884 - protein, 17 aa, Mycobacterium
VEEVMIIGRRGPLQAPF

SEQ ID NO: 1128885 - protein, 23 aa, Mycobacterium
VEGLAALIFTKYLWAFELTGALL

SEQ ID NO: 1128886 - protein, 17 aa, Mycobacterium
VEGPPGLRRAVGNVVAL

SEQ ID NO: 1128887 - protein, 17 aa, Mycobacterium
VEIGKQLLITRGALTTF

SEQ ID NO: 1128888 - protein, 20 aa, Mycobacterium
VEITALRLLAPYLGLTLETS

SEQ ID NO: 1128889 - protein, 25 aa, Mycobacterium
VELGPEFTDMYGFTNPLSDFRNSNL

SEQ ID NO: 1128890 - protein, 24 aa, Mycobacterium
VELIPRPGGDMTPLRDGDVIPADR

SEQ ID NO: 1128891 - protein, 17 aa, Mycobacterium
VEMGRAEEAITFATAGL

SEQ ID NO: 1128892 - protein, 17 aa, Mycobacterium
VEMSFYLALPLLALLAR

SEQ ID NO: 1128893 - protein, 17 aa, Mycobacterium
VEPNWSMTLVERLDGAA

SEQ ID NO: 1128894 - protein, 20 aa, Mycobacterium
VEQGGGVLMSIGIRADSILL

SEQ ID NO: 1128895 - protein, 19 aa, Mycobacterium
VETPIAMPLILGGLRTATL

SEQ ID NO: 1128896 - protein, 17 aa, Mycobacterium
VEVARRLAPGATVVLAA

SEQ ID NO: 1128897 - protein, 19 aa, Mycobacterium
VEVCQQILSASGFTKSVPV

SEQ ID NO: 1128898 - protein, 27 aa, Mycobacterium
VFADHLWGWPGGGFVGIDVFFVVSGYL

SEQ ID NO: 1128899 - protein, 23 aa, Mycobacterium
VFAQLRFEREQRYTAVFANVSGL

SEQ ID NO: 1128900 - protein, 18 aa, Mycobacterium
VFAVKSGAFFAMTVGVLG

SEQ ID NO: 1128901 - protein, 26 aa, Mycobacterium
VFAVLAVCFVVRLLADMYLTQRFMMR

SEQ ID NO: 1128902 - protein, 18 aa, Mycobacterium
VFDFSDPYFESGVQMAVL

SEQ ID NO: 1128903 - protein, 24 aa, Mycobacterium
VFDIEIVFLYPWAVAFDNLGLFAL

SEQ ID NO: 1128904 - protein, 17 aa, Mycobacterium
VFGESLGSFGGEAPFLA

SEQ ID NO: 1128905 - protein, 23 aa, Mycobacterium
VFGFGVIFGAIWAEEAWGRYWGW

SEQ ID NO: 1128906 - protein, 18 aa, Mycobacterium
VFGMLIWVDRRFRIGHGR

SEQ ID NO: 1128907 - protein, 18 aa, Mycobacterium
VFGVDAWVLAAVGASVLT

SEQ ID NO: 1128908 - protein, 21 aa, Mycobacterium
VFGWWGGPGLDGFRDTLTEVG

SEQ ID NO: 1128909 - protein, 17 aa, Mycobacterium
VFHDFPLGLYLIAGVTA

SEQ ID NO: 1128910 - protein, 18 aa, Mycobacterium
VFIICWITGSSVMAGGGW

SEQ ID NO: 1128911 - protein, 17 aa, Mycobacterium
VFLFPAGVLVLIVFCAN

SEQ ID NO: 1128912 - protein, 18 aa, Mycobacterium
VFLQTSFRERALSSASQG

SEQ ID NO: 1128913 - protein, 17 aa, Mycobacterium
VFPALALGAEPPDRRTL

SEQ ID NO: 1128914 - protein, 22 aa, Mycobacterium
VFSACGDFLLAIPWWEPSFVLG

SEQ ID NO: 1128915 - protein, 17 aa, Mycobacterium
VFTTLFALGLVLISVTP

SEQ ID NO: 1128916 - protein, 20 aa, Mycobacterium
VFTWLRKRSGSLLAPIALHW

SEQ ID NO: 1128917 - protein, 19 aa, Mycobacterium
VFVAFTFRPRIPKRRQKRR

SEQ ID NO: 1128918 - protein, 18 aa, Mycobacterium
VFVFCAFATPGSDPFSML

SEQ ID NO: 1128919 - protein, 17 aa, Mycobacterium
VFVSFTFSQIGMVRHWT

SEQ ID NO: 1128920 - protein, 26 aa, Mycobacterium
VFVYLQAPVLFGFGRIAVKLHLPATG

SEQ ID NO: 1128921 - protein, 19 aa, Mycobacterium
VFYGTRWILLAAYVALLLP

SEQ ID NO: 1128922 - protein, 18 aa, Mycobacterium
VGAALVFAGVGPMLAAAV

SEQ ID NO: 1128923 - protein, 19 aa, Mycobacterium
VGAATMWLSLIVLLPLAAI

SEQ ID NO: 1128924 - protein, 29 aa, Mycobacterium
VGAATRDGRRLVAVLLRGTRQPIAPWEQA

SEQ ID NO: 1128925 - protein, 26 aa, Mycobacterium
VGAFLRLPYTFAVPVFGGRNWTVISA

SEQ ID NO: 1128926 - protein, 27 aa, Mycobacterium
VGAFVLEVTIAFSLAISWATYAADFSR

SEQ ID NO: 1128927 - protein, 21 aa, Mycobacterium
VGALADWFAVTALFKHPLGIP

SEQ ID NO: 1128928 - protein, 24 aa, Mycobacterium
VGALLMRIHIAVPFGLAAATTAAV

SEQ ID NO: 1128929 - protein, 17 aa, Mycobacterium
VGAPFALGAVIFGFAAV

SEQ ID NO: 1128930 - protein, 25 aa, Mycobacterium
VGARQWRWPLGEIDRPFEMRRDPLI

SEQ ID NO: 1128931 - protein, 20 aa, Mycobacterium
VGARRWKAAVFSAVVFAGTV

SEQ ID NO: 1128932 - protein, 18 aa, Mycobacterium
VGASKGYFLLGIWMSLFW

SEQ ID NO: 1128933 - protein, 24 aa, Mycobacterium
VGASLAWRGHRLWRRRSESDESVT

SEQ ID NO: 1128934 - protein, 26 aa, Mycobacterium
VGASLLLVVAFCMLVAGNLVAGGLLF

SEQ ID NO: 1128935 - protein, 19 aa, Mycobacterium
VGATRWYTQLPFLLEAMLA

SEQ ID NO: 1128936 - protein, 17 aa, Mycobacterium
VGAVCILFAAYVYTSWI

SEQ ID NO: 1128937 - protein, 17 aa, Mycobacterium
VGDNGWWVVRAPAGEQQ

SEQ ID NO: 1128938 - protein, 25 aa, Mycobacterium
VGEALRRWAAVLVMTIFVVVMPLTV

SEQ ID NO: 1128939 - protein, 18 aa, Mycobacterium
VGEEVIAAGAPLGLRSTV

SEQ ID NO: 1128940 - protein, 28 aa, Mycobacterium
VGEVLAGLLRRWAWLVLIVGFAVIVTYT

SEQ ID NO: 1128941 - protein, 19 aa, Mycobacterium
VGFAVTFGAWVAEAAAGRF

SEQ ID NO: 1128942 - protein, 25 aa, Mycobacterium
VGFELPKAMFVIGIVYILFATVVAF

SEQ ID NO: 1128943 - protein, 17 aa, Mycobacterium
VGFEVLLTASFVLLTIG

SEQ ID NO: 1128944 - protein, 32 aa, Mycobacterium
VGFGNTGGDVFERGGPYLARGAEDLVPTTALL

SEQ ID NO: 1128945 - protein, 24 aa, Mycobacterium
VGFKTKIVTLLSWTVTFLSTKRGQ

SEQ ID NO: 1128946 - protein, 25 aa, Mycobacterium
VGGAFLASLSWQWGAAAIGRRRRRG

SEQ ID NO: 1128947 - protein, 22 aa, Mycobacterium
VGGAIASVWFWVPLGILVIAVS

SEQ ID NO: 1128948 - protein, 24 aa, Mycobacterium
VGGEPRFQPVLGNRVSTYVGDLSY

SEQ ID NO: 1128949 - protein, 29 aa, Mycobacterium
VGGLLTGTVGWRWIFWLNVPLALASFVLG

SEQ ID NO: 1128950 - protein, 18 aa, Mycobacterium
VGGPPARRSSTHGRRHWI

SEQ ID NO: 1128951 - protein, 22 aa, Mycobacterium
VGGPRRKSRIISEHEKKITAYH

SEQ ID NO: 1128952 - protein, 21 aa, Mycobacterium
VGGRMLPFWLVGGALMGAAVD

SEQ ID NO: 1128953 - protein, 19 aa, Mycobacterium
VGGVAWLLTMSTLNASMQL

SEQ ID NO: 1128954 - protein, 17 aa, Mycobacterium
VGGVSARLLSLYIAGGM

SEQ ID NO: 1128955 - protein, 23 aa, Mycobacterium
VGIAWPHLSAWAMSKVDDPAEGP

SEQ ID NO: 1128956 - protein, 28 aa, Mycobacterium
VGIGAVIHGWVPADFFVRFAGPGNPFAV

SEQ ID NO: 1128957 - protein, 20 aa, Mycobacterium
VGIGLWVWAPWRHDAGAPLP

SEQ ID NO: 1128958 - protein, 27 aa, Mycobacterium
VGIGVRPRGPLAFRVAERMSLISDALF

SEQ ID NO: 1128959 - protein, 23 aa, Mycobacterium
VGIKRYEVTSAQSPRSAPTSPRT

SEQ ID NO: 1128960 - protein, 20 aa, Mycobacterium
VGILFTWMFMFGMTPLLQGP

SEQ ID NO: 1128961 - protein, 18 aa, Mycobacterium
VGLASYLLIGFWSHKPSA

SEQ ID NO: 1128962 - protein, 18 aa, Mycobacterium
VGLAVRWSVGTWLLALLA

SEQ ID NO: 1128963 - protein, 25 aa, Mycobacterium
VGLIAQYTSFGWAFLISGVILAVAA

SEQ ID NO: 1128964 - protein, 18 aa, Mycobacterium
VGLLAAWAALGADSAAGL

SEQ ID NO: 1128965 - protein, 17 aa, Mycobacterium
VGLLPFVAVIVVSRYPG

SEQ ID NO: 1128966 - protein, 18 aa, Mycobacterium
VGLTFRFLLNDQLGAIPA

SEQ ID NO: 1128967 - protein, 21 aa, Mycobacterium
VGLTVAFGILALLWFRSVLER

SEQ ID NO: 1128968 - protein, 28 aa, Mycobacterium
VGLVTLTALWCWLPFQLKFMRATSPLTE

SEQ ID NO: 1128969 - protein, 27 aa, Mycobacterium
VGLWLLCAGCGVLAFGTVTPVAVAGFW

SEQ ID NO: 1128970 - protein, 17 aa, Mycobacterium
VGLWPLLAPLLAAGTVV

SEQ ID NO: 1128971 - protein, 29 aa, Mycobacterium
VGLYLCFAVPIYLRWRMGDDFEVGTWNLR

SEQ ID NO: 1128972 - protein, 18 aa, Mycobacterium
VGMLTRLAALPMIVNMVG

SEQ ID NO: 1128973 - protein, 31 aa, Mycobacterium
VGPGRYGLDAGRGWARRPFVGSFAALLLGIG

SEQ ID NO: 1128974 - protein, 17 aa, Mycobacterium
VGPSIEVFGRMFPPNFG

SEQ ID NO: 1128975 - protein, 17 aa, Mycobacterium
VGPTIPWYQEFLRYYFL

SEQ ID NO: 1128976 - protein, 25 aa, Mycobacterium
VGPVLLTWLASVAVVFVGALLCGVG

SEQ ID NO: 1128977 - protein, 21 aa, Mycobacterium
VGPYRLRRLLGKGGMGEVYEA

SEQ ID NO: 1128978 - protein, 24 aa, Mycobacterium
VGRFLQGAAFAAVFLTVALARQIC

SEQ ID NO: 1128979 - protein, 20 aa, Mycobacterium
VGRFSERIARFLGTGRYLAI

SEQ ID NO: 1128980 - protein, 19 aa, Mycobacterium
VGRKPLWWFSLIGLFVAGV

SEQ ID NO: 1128981 - protein, 21 aa, Mycobacterium
VGRQPVIRRSVLTLYGHSAPE

SEQ ID NO: 1128982 - protein, 18 aa, Mycobacterium
VGSVLSWLAASATVTVAP

SEQ ID NO: 1128983 - protein, 30 aa, Mycobacterium
VGSVLWIIGASWGWHGAGWMLTKLGFHDVG

SEQ ID NO: 1128984 - protein, 19 aa, Mycobacterium
VGTLIGWGLLELFPGSLAR

SEQ ID NO: 1128985 - protein, 18 aa, Mycobacterium
VGTWTSVIGASWAYVGVI

SEQ ID NO: 1128986 - protein, 25 aa, Mycobacterium
VGTYEFARAVGMTRLSEEVSLSAQG

SEQ ID NO: 1128987 - protein, 23 aa, Mycobacterium
VGVAAASYLVRWLASVDGRTFTV

SEQ ID NO: 1128988 - protein, 21 aa, Mycobacterium
VGVACVLSGIGFIAMAAAVTA

SEQ ID NO: 1128989 - protein, 19 aa, Mycobacterium
VGVALGVAIAVCLVTGLIS

SEQ ID NO: 1128990 - protein, 24 aa, Mycobacterium
VGVDRPWLAAAMMIVPVAALLTAT

SEQ ID NO: 1128991 - protein, 30 aa, Mycobacterium
VGVEALARFPCEPFRPDAFFQQAAQLGLDI

SEQ ID NO: 1128992 - protein, 18 aa, Mycobacterium
VGVIARAATILPRVDEVP

SEQ ID NO: 1128993 - protein, 24 aa, Mycobacterium
VGVLGFALAVWLVPSLPTARAQRF

SEQ ID NO: 1128994 - protein, 17 aa, Mycobacterium
VGVRVGRLHKPRPYDGR

SEQ ID NO: 1128995 - protein, 19 aa, Mycobacterium
VGVTCALAGYLALRAGVTA

SEQ ID NO: 1128996 - protein, 25 aa, Mycobacterium
VGWAPHAPGGWVLLPVWMGPAPVAW

SEQ ID NO: 1128997 - protein, 18 aa, Mycobacterium
VGYADEWGNEIPRTEDMQ

SEQ ID NO: 1128998 - protein, 24 aa, Mycobacterium
VGYALRPAPTPSTAEQVFAAPDVR

SEQ ID NO: 1128999 - protein, 24 aa, Mycobacterium
VGYGAACYLLFLAVFLYAIGFVGD

SEQ ID NO: 1129000 - protein, 23 aa, Mycobacterium
VGYSAGFLPWFADIDRQMYFFYA

SEQ ID NO: 1129001 - protein, 17 aa, Mycobacterium
VGYTATALFFIDRDAAT

SEQ ID NO: 1129002 - protein, 19 aa, Mycobacterium
VHDLHVWTLVPGKDMVTAH

SEQ ID NO: 1129003 - protein, 27 aa, Mycobacterium
VHDWFLHRGLPLVLTRRVRARKLVQRS

SEQ ID NO: 1129004 - protein, 24 aa, Mycobacterium
VHERAADVLRGWNTRRRNSAWEQL

SEQ ID NO: 1129005 - protein, 18 aa, Mycobacterium
VHLACIWIVAFGVNASAY

SEQ ID NO: 1129006 - protein, 18 aa, Mycobacterium
VHLHCLRDGDQVKIAVAD

SEQ ID NO: 1129007 - protein, 17 aa, Mycobacterium
VHSNAYGKVLFFITLTG

SEQ ID NO: 1129008 - protein, 18 aa, Mycobacterium
VHSSRWWWSGLLVGLAAG

SEQ ID NO: 1129009 - protein, 18 aa, Mycobacterium
VIAAIVALAVLDRASGRR

SEQ ID NO: 1129010 - protein, 17 aa, Mycobacterium
VIAARSSIMSRLAGQGA

SEQ ID NO: 1129011 - protein, 17 aa, Mycobacterium
VIACVVAALLLVELTSG

SEQ ID NO: 1129012 - protein, 25 aa, Mycobacterium
VIAFYDWKSALIVTIALPLIPVFMV

SEQ ID NO: 1129013 - protein, 24 aa, Mycobacterium
VIAGRPAPHDAFIGVAPNARILSL

SEQ ID NO: 1129014 - protein, 19 aa, Mycobacterium
VIAPQAFRSMVPALGNEFI

SEQ ID NO: 1129015 - protein, 19 aa, Mycobacterium
VIATLRLVGAAALDAIRGR

SEQ ID NO: 1129016 - protein, 24 aa, Mycobacterium
VIAVGLLLPWTRPMFMNNNYATIS

SEQ ID NO: 1129017 - protein, 35 aa, Mycobacterium
VIAVLICLGAVLLAYFKPLGKRGGDTLLVDRTTNQ

SEQ ID NO: 1129018 - protein, 22 aa, Mycobacterium
VICRPRRSHVMFQGYWRRPDAM

SEQ ID NO: 1129019 - protein, 18 aa, Mycobacterium
VICRTVFGVLGANIPAII

SEQ ID NO: 1129020 - protein, 22 aa, Mycobacterium
VICSPLRFIEYLSVKILVLTGV

SEQ ID NO: 1129021 - protein, 25 aa, Mycobacterium
VIFELGPPPPPGMRPPPMPPPGAMV

SEQ ID NO: 1129022 - protein, 19 aa, Mycobacterium
VIFGTVWLAQRRKTPAAVP

SEQ ID NO: 1129023 - protein, 19 aa, Mycobacterium
VIFLVDFLGNFFQYHLPGV

SEQ ID NO: 1129024 - protein, 33 aa, Mycobacterium
VIGAVIAVRCLLTRPVGMLVDRVKRVADGDYDR

SEQ ID NO: 1129025 - protein, 18 aa, Mycobacterium
VIGFGMVVGVLFAVAYAM

SEQ ID NO: 1129026 - protein, 24 aa, Mycobacterium
VIGIFCFVGLFGVLAALLPVPAIV

SEQ ID NO: 1129027 - protein, 17 aa, Mycobacterium
VIGTAFTGLVTAFTNAV

SEQ ID NO: 1129028 - protein, 17 aa, Mycobacterium
VIGVWVMVATLKAGLAH

SEQ ID NO: 1129029 - protein, 20 aa, Mycobacterium
VIIAVAWMLAMSINRARSPR

SEQ ID NO: 1129030 - protein, 25 aa, Mycobacterium
VILSVRLSVLFSFQGNDMMTSFQVI

SEQ ID NO: 1129031 - protein, 28 aa, Mycobacterium
VIMTIQVAIAWFGYRVIAAFERWTVPPT

SEQ ID NO: 1129032 - protein, 29 aa, Mycobacterium
VINEKSWLLFGPFAGWSPKFLKQGKVTDL

SEQ ID NO: 1129033 - protein, 24 aa, Mycobacterium
VINGFGFLVVYALVGIPIARISDR

SEQ ID NO: 1129034 - protein, 24 aa, Mycobacterium
VINTVLPSVLWKKASALVSAMWGV

SEQ ID NO: 1129035 - protein, 23 aa, Mycobacterium
VIPFLIISVLFYFTVVVQEQMVG

SEQ ID NO: 1129036 - protein, 18 aa, Mycobacterium
VIPRLFVWPPARSIAQLL

SEQ ID NO: 1129037 - protein, 17 aa, Mycobacterium
VIPTRWRTLTAVDGVVV

SEQ ID NO: 1129038 - protein, 21 aa, Mycobacterium
VIQKLSGLHVNRFMAVDFVGF

SEQ ID NO: 1129039 - protein, 23 aa, Mycobacterium
VIRFTYGFIGFVYAFFVGFVVSS

SEQ ID NO: 1129040 - protein, 27 aa, Mycobacterium
VIRRASIPIILSWIALAAFLNISVPQL

SEQ ID NO: 1129041 - protein, 24 aa, Mycobacterium
VISYEIAMALSFAAVFIYAGTMST

SEQ ID NO: 1129042 - protein, 22 aa, Mycobacterium
VITMWMPIMLFFYMGFEHSVVN

SEQ ID NO: 1129043 - protein, 18 aa, Mycobacterium
VITNRVWSPVLFVVLMPL

SEQ ID NO: 1129044 - protein, 17 aa, Mycobacterium
VITSRWLMSTNREAGLA

SEQ ID NO: 1129045 - protein, 40 aa, Mycobacterium; identical to SEQ ID NO: 334190

SEQ ID NO: 1129046 - protein, 17 aa, Mycobacterium
VIVELPDAAGLYATGNV

SEQ ID NO: 1129047 - protein, 17 aa, Mycobacterium
VIVGRAVFGADITIGEA

SEQ ID NO: 1129048 - protein, 18 aa, Mycobacterium
VIVGRAVFGADITIGEAW

SEQ ID NO: 1129049 - protein, 18 aa, Mycobacterium
VIVLAAFGPDWMRRQPVA

SEQ ID NO: 1129050 - protein, 18 aa, Mycobacterium
VIVTGAIGIVCYAWPFYA

SEQ ID NO: 1129051 - protein, 23 aa, Mycobacterium
VIVTGFGWRAVFLALAVLNLATL

SEQ ID NO: 1129052 - protein, 18 aa, Mycobacterium
VIWMSLAVLFGYLSAVHA

SEQ ID NO: 1129053 - protein, 21 aa, Mycobacterium
VKADTKTGLYWTPESDDYHEA

SEQ ID NO: 1129054 - protein, 18 aa, Mycobacterium
VKADVPRCGAFQSPTTPR

SEQ ID NO: 1129055 - protein, 21 aa, Mycobacterium
VKAHLEHLVSLPVSAPDDAEL

SEQ ID NO: 1129056 - protein, 24 aa, Mycobacterium
VKAPLWPFHRWLPDAAVEATPASA

SEQ ID NO: 1129057 - protein, 19 aa, Mycobacterium
VKAVMLVGTPAMWFIAAPV

SEQ ID NO: 1129058 - protein, 19 aa, Mycobacterium
VKAVMLVGTPAMWFLAVPV

SEQ ID NO: 1129059 - protein, 18 aa, Mycobacterium
VKDADSWSAAPMLGLYWC

SEQ ID NO: 1129060 - protein, 18 aa, Mycobacterium
VKDRGRFAGKPVVASGVK

SEQ ID NO: 1129061 - protein, 21 aa, Mycobacterium
VKGGAALEGLGRIRGVALDKT

SEQ ID NO: 1129062 - protein, 22 aa, Mycobacterium
VKGKAEAVKDFFTVKEKFTVDG

SEQ ID NO: 1129063 - protein, 18 aa, Mycobacterium
VKKELFFRAPESRQFLRD

SEQ ID NO: 1129064 - protein, 19 aa, Mycobacterium
VKLPDALAIIGRSGGVYGD

SEQ ID NO: 1129065 - protein, 21 aa, Mycobacterium
VKLRTGAGLWRGGRDGNGSTV

SEQ ID NO: 1129066 - protein, 17 aa, Mycobacterium
VKRRGRGTPTVFVAALV

SEQ ID NO: 1129067 - protein, 21 aa, Mycobacterium
VKRVLWLTTLIRSGQPMSEGN

SEQ ID NO: 1129068 - protein, 27 aa, Mycobacterium
VKSDRRDALKWVWLGVGAAIALTLTVF

SEQ ID NO: 1129069 - protein, 21 aa, Mycobacterium
VKVALIAGLVGVLALAGLTAW

SEQ ID NO: 1129070 - protein, 21 aa, Mycobacterium
VKVTFSIRAGSFVEAQTVKVP

SEQ ID NO: 1129071 - protein, 26 aa, Mycobacterium
VKVWLFLFFFMWLRATLPRMRYDQFM

SEQ ID NO: 1129072 - protein, 20 aa, Mycobacterium
VLAAGIGVYFGRKRLRRARA

SEQ ID NO: 1129073 - protein, 20 aa, Mycobacterium
VLAAGLIFIWALILGVWKYR

SEQ ID NO: 1129074 - protein, 30 aa, Mycobacterium
VLAASRWADLRPALKDQLGTRIELRLGDPA

SEQ ID NO: 1129075 - protein, 22 aa, Mycobacterium
VLACPVWLHQVWAFITPGLYRN

SEQ ID NO: 1129076 - protein, 18 aa, Mycobacterium
VLAEIKALLFGVVAGLVG

SEQ ID NO: 1129077 - protein, 26 aa, Mycobacterium
VLAFTVSTLHEWRPFTIAGLGIGVFG

SEQ ID NO: 1129078 - protein, 26 aa, Mycobacterium
VLAIACGLLAGWLHFRMDYAGHTEVA

SEQ ID NO: 1129079 - protein, 22 aa, Mycobacterium
VLALCLTGFPGFREPGDTRRSL

SEQ ID NO: 1129080 - protein, 17 aa, Mycobacterium
VLALGARDRPRFELWDS

SEQ ID NO: 1129081 - protein, 19 aa, Mycobacterium
VLALGVRRMAARNAIVKDL

SEQ ID NO: 1129082 - protein, 18 aa, Mycobacterium
VLALGYRRSRQITDSPVI

SEQ ID NO: 1129083 - protein, 30 aa, Mycobacterium
VLALIVCTVLWPPVRWLRGKGVPPAAAVLL

SEQ ID NO: 1129084 - protein, 25 aa, Mycobacterium
VLALLRGRIAPGWVSSVGLWLLCAG

SEQ ID NO: 1129085 - protein, 19 aa, Mycobacterium
VLALVLFLGHLVRQIRIET

SEQ ID NO: 1129086 - protein, 27 aa, Mycobacterium
VLARRWVTRLGAFNGVLAAAGAYAAAM

SEQ ID NO: 1129087 - protein, 24 aa, Mycobacterium
VLAWATSGINGWFYVGNYGVPWFD

SEQ ID NO: 1129088 - protein, 18 aa, Mycobacterium
VLCFRYWPQLAACYLLGL

SEQ ID NO: 1129089 - protein, 17 aa, Mycobacterium
VLCYGLWAFGRDDQGGT

SEQ ID NO: 1129090 - protein, 20 aa, Mycobacterium
VLDDQIWIAGGIREGETLDT

SEQ ID NO: 1129091 - protein, 24 aa, Mycobacterium
VLDELFPPGSLDFLYLAASAGAVF

SEQ ID NO: 1129092 - protein, 26 aa, Mycobacterium
VLDGQRSGTHLAFAMLDLDRFKVLND

SEQ ID NO: 1129093 - protein, 18 aa, Mycobacterium
VLEGFDFGVGMLMAPMGM

SEQ ID NO: 1129094 - protein, 17 aa, Mycobacterium
VLERIRTSGFLILTVFV

SEQ ID NO: 1129095 - protein, 18 aa, Mycobacterium
VLERRRELGMLRAMGSSR

SEQ ID NO: 1129096 - protein, 19 aa, Mycobacterium
VLFGRGEVLPPLPQATTAA

SEQ ID NO: 1129097 - protein, 20 aa, Mycobacterium
VLFMYPVFWGPAILYLVTRL

SEQ ID NO: 1129098 - protein, 17 aa, Mycobacterium
VLFWPAGTFDYWQAWVF

SEQ ID NO: 1129099 - protein, 19 aa, Mycobacterium
VLGAFPYQLLLAAAAVRSV

SEQ ID NO: 1129100 - protein, 30 aa, Mycobacterium
VLGDEQMHAWGWRLPFLVAAPLGLIGLYLR

SEQ ID NO: 1129101 - protein, 17 aa, Mycobacterium
VLGEAFGPVGSKIILVI

SEQ ID NO: 1129102 - protein, 19 aa, Mycobacterium
VLGFLRFGLPPEDRIQLQD

SEQ ID NO: 1129103 - protein, 21 aa, Mycobacterium
VLGFWFAFVMLRIVRGRGPLR

SEQ ID NO: 1129104 - protein, 20 aa, Mycobacterium
VLGLGFWLGLLAMVIGTVLG

SEQ ID NO: 1129105 - protein, 26 aa, Mycobacterium
VLGSFPIIFGLSFRDALLATLLGVVA

SEQ ID NO: 1129106 - protein, 23 aa, Mycobacterium
VLGWPLWTAYVVVFVLTLMIGAR

SEQ ID NO: 1129107 - protein, 18 aa, Mycobacterium
VLHGALDRAWGWRGVAAA

SEQ ID NO: 1129108 - protein, 19 aa, Mycobacterium
VLIACLAMVFAIQNATARQ

SEQ ID NO: 1129109 - protein, 26 aa, Mycobacterium
VLIAGGLGWLLAGPAIRPLRKLTEQT

SEQ ID NO: 1129110 - protein, 28 aa, Mycobacterium
VLIALAWRNRELWLPAARTHRSTAAVSR

SEQ ID NO: 1129111 - protein, 26 aa, Mycobacterium
VLIASRAATAIGLWMSKVPRQSFESI

SEQ ID NO: 1129112 - protein, 25 aa, Mycobacterium
VLIEAFLPRRSRYAAQLTLALGATV

SEQ ID NO: 1129113 - protein, 18 aa, Mycobacterium
VLIFGMPLLIPVAIAIKL

SEQ ID NO: 1129114 - protein, 17 aa, Mycobacterium
VLIGAAVLVLTVAVLLG

SEQ ID NO: 1129115 - protein, 25 aa, Mycobacterium
VLIGWSAACATAYLQGFGRRPAWVL

SEQ ID NO: 1129116 - protein, 17 aa, Mycobacterium
VLILLAVSGRWLYTNAA

SEQ ID NO: 1129117 - protein, 19 aa, Mycobacterium
VLIMLMWVGTALVISTSDS

SEQ ID NO: 1129118 - protein, 19 aa, Mycobacterium
VLIVWFYRLYVYSPVSAGY

SEQ ID NO: 1129119 - protein, 20 aa, Mycobacterium
VLIYTELYAGFTTITAILIL

SEQ ID NO: 1129120 - protein, 17 aa, Mycobacterium
VLLPFFSFMTFLIAVPT

SEQ ID NO: 1129121 - protein, 22 aa, Mycobacterium
VLLPQWRVTWVLIGVLTAVCAL

SEQ ID NO: 1129122 - protein, 42 aa, Mycobacterium
VLLRGLTGWPLWWAAWWAAVEWLKSVIPFGGFPWGVVGYSQA

SEQ ID NO: 1129123 - protein, 24 aa, Mycobacterium
VLLTAAAIGFGWSVPDVGDEGQLP

SEQ ID NO: 1129124 - protein, 25 aa, Mycobacterium
VLLVAVICTLVILGGGDSGSVSATV

SEQ ID NO: 1129125 - protein, 17 aa, Mycobacterium
VLLVFTFNILLKEFGAA

SEQ ID NO: 1129126 - protein, 22 aa, Mycobacterium
VLLVGGGLAWLARAHHKVQKKQ

SEQ ID NO: 1129127 - protein, 17 aa, Mycobacterium
VLLVPTMIWVRLRAPWA

SEQ ID NO: 1129128 - protein, 27 aa, Mycobacterium
VLLVQAGYMLIGWQAGLAFTRESLKSV

SEQ ID NO: 1129129 - protein, 25 aa, Mycobacterium
VLLWQHIIGLALHWMVLPMAVILLL

SEQ ID NO: 1129130 - protein, 30 aa, Mycobacterium
VLLYAVCIVLRLARFNAMLDVEQPAYEKKY

SEQ ID NO: 1129131 - protein, 26 aa, Mycobacterium
VLMVGWRGAGWWRRAVSIATVPMCLL

SEQ ID NO: 1129132 - protein, 19 aa, Mycobacterium
VLMVLLRRGSLPGAVNGPV

SEQ ID NO: 1129133 - protein, 23 aa, Mycobacterium
VLNLPLAPLWARLLRTPRPYLYA

SEQ ID NO: 1129134 - protein, 19 aa, Mycobacterium
VLNPAIDWLTSRHKPPQPV

SEQ ID NO: 1129135 - protein, 21 aa, Mycobacterium
VLNSAFGWSWADSVAALVIAA

SEQ ID NO: 1129136 - protein, 23 aa, Mycobacterium
VLPALLRLFGKKLFWPLIPKEGA

SEQ ID NO: 1129137 - protein, 25 aa, Mycobacterium
VLPEVPSDLPLPALLSPDATPPSDG

SEQ ID NO: 1129138 - protein, 17 aa, Mycobacterium
VLPPRFGAGQLIVLLAS

SEQ ID NO: 1129139 - protein, 24 aa, Mycobacterium
VLPTIPAWLWFLLLLGAVTAAFAG

SEQ ID NO: 1129140 - protein, 20 aa, Mycobacterium
VLRCAAAVLQISRPADRDAA

SEQ ID NO: 1129141 - protein, 18 aa, Mycobacterium
VLRCGAQVVLPADADGHA

SEQ ID NO: 1129142 - protein, 23 aa, Mycobacterium
VLRREALMRLGIRGYVRAVEEGV

SEQ ID NO: 1129143 - protein, 20 aa, Mycobacterium
VLRRPQYRALWVFVLVPVLI

SEQ ID NO: 1129144 - protein, 23 aa, Mycobacterium
VLSELRTKFDYVIVDSTPLLAVT

SEQ ID NO: 1129145 - protein, 30 aa, Mycobacterium
VLSITFVSLVGWWALSRVLGRLLGVPDVHK

SEQ ID NO: 1129146 - protein, 20 aa, Mycobacterium
VLSLAAGVGLGWLNALAAGN

SEQ ID NO: 1129147 - protein, 26 aa, Mycobacterium
VLSLPLYLLCGLARRRRLLSQEAALK

SEQ ID NO: 1129148 - protein, 21 aa, Mycobacterium
VLSQRAGLVMNADAKVKLHGA

SEQ ID NO: 1129149 - protein, 22 aa, Mycobacterium
VLSRGGLKPAMRNLARRSTVPV

SEQ ID NO: 1129150 - protein, 22 aa, Mycobacterium
VLTGGAWQWQSAKNNLLNRVSA

SEQ ID NO: 1129151 - protein, 25 aa, Mycobacterium
VLTQPEFKKAANLFVSKDGHTARYL

SEQ ID NO: 1129152 - protein, 35 aa, Mycobacterium
VLTVPLSLLAIRWITRRSQRLFVAQWRNTGRLNAH

SEQ ID NO: 1129153 - protein, 17 aa, Mycobacterium
VLVAYPLVMAFTLVYTA

SEQ ID NO: 1129154 - protein, 25 aa, Mycobacterium
VLVEAFVPRGRRYAVQVTLSIAALV

SEQ ID NO: 1129155 - protein, 17 aa, Mycobacterium
VLVGLILGTMVTYILDK

SEQ ID NO: 1129156 - protein, 24 aa, Mycobacterium
VLVIRPLSVFAMFGRGVLARQVER

SEQ ID NO: 1129157 - protein, 19 aa, Mycobacterium
VLVLLVGRRLWHRFRGQPD

SEQ ID NO: 1129158 - protein, 18 aa, Mycobacterium
VLVPLVLAGVFGGARIAA

SEQ ID NO: 1129159 - protein, 25 aa, Mycobacterium
VLVRPEIMSGTGFLGAHADEVYRVE

SEQ ID NO: 1129160 - protein, 24 aa, Mycobacterium
VLVVAVLVAGRFLFFGKAQSANEI

SEQ ID NO: 1129161 - protein, 19 aa, Mycobacterium
VLYPCALGMMVLSKSFSVL

SEQ ID NO: 1129162 - protein, 18 aa, Mycobacterium
VLYPTVMLLSRFLGPILD

SEQ ID NO: 1129163 - protein, 24 aa, Mycobacterium
VMAGGGWTAIPMWVLGILTFLIPA

SEQ ID NO: 1129164 - protein, 25 aa, Mycobacterium
VMAYSFAVAFAIAFILKKTVGIRIS

SEQ ID NO: 1129165 - protein, 23 aa, Mycobacterium
VMESLTWTSPRTRAVFGTTEQEA

SEQ ID NO: 1129166 - protein, 26 aa, Mycobacterium
VMFILCGYLLWKSGWHVSLSLGGEKQ

SEQ ID NO: 1129167 - protein, 25 aa, Mycobacterium
VMFPLISAFAIWALTGWVVSGELFA

SEQ ID NO: 1129168 - protein, 27 aa, Mycobacterium
VMGAASYALIGFWWREQYRVSDGLTAF

SEQ ID NO: 1129169 - protein, 18 aa, Mycobacterium
VMGGGLLGGLALLVIAVA

SEQ ID NO: 1129170 - protein, 24 aa, Mycobacterium
VMGYIALVGFMFIGRMTGDRLVDR

SEQ ID NO: 1129171 - protein, 28 aa, Mycobacterium
VMIGGCLYCAHDLWVAGSVRAWLVVALM

SEQ ID NO: 1129172 - protein, 25 aa, Mycobacterium
VMIPRWKFELARFGAWFVVFQVSFA

SEQ ID NO: 1129173 - protein, 25 aa, Mycobacterium
VMPYRFRGVAMFFALTWAVGIGAYT

SEQ ID NO: 1129174 - protein, 18 aa, Mycobacterium
VMYVLSMHPAVLATLKVG

SEQ ID NO: 1129175 - protein, 22 aa, Mycobacterium
VNADGFSGPALIVGSPTATSES

SEQ ID NO: 1129176 - protein, 36 aa, Mycobacterium
VNELGLSMGISFAAVRDMFGWIGPVLAALHGNAVCD

SEQ ID NO: 1129177 - protein, 24 aa, Mycobacterium
VNFALHSTFRWLLSAAAALWIVAT

SEQ ID NO: 1129178 - protein, 26 aa, Mycobacterium
VNFLIVAAVIYFVIVVPFKKLKERDK

SEQ ID NO: 1129179 - protein, 20 aa, Mycobacterium
VNGPVWRLAGTTAIGLLLLT

SEQ ID NO: 1129180 - protein, 26 aa, Mycobacterium
VNGPWGKVIDMLAIFATLFGSAASLG

SEQ ID NO: 1129181 - protein, 24 aa, Mycobacterium
VNIGCGVVFLAIPRLCPLGELIAP

SEQ ID NO: 1129182 - protein, 26 aa, Mycobacterium
VNIGRSLPFLILMAAIIPVTRFIVGT

SEQ ID NO: 1129183 - protein, 19 aa, Mycobacterium
VNIGTLFAFVLVSAGVLVL

SEQ ID NO: 1129184 - protein, 29 aa, Mycobacterium
VNIPANRKRVVAVSFPRDLEIEPMKCEPW

SEQ ID NO: 1129185 - protein, 17 aa, Mycobacterium
VNLAGPSGVCIGGQPVQ

SEQ ID NO: 1129186 - protein, 19 aa, Mycobacterium
VNLIPLLPLDGGHISIALY

SEQ ID NO: 1129187 - protein, 20 aa, Mycobacterium
VNLMIYWRLWAKYKASTELA

SEQ ID NO: 1129188 - protein, 18 aa, Mycobacterium
VNLSKDWARAVIDIPVPT

SEQ ID NO: 1129189 - protein, 25 aa, Mycobacterium
VNPDSLRKAFGWFVLAMSSVILGQE

SEQ ID NO: 1129190 - protein, 24 aa, Mycobacterium
VNPEAAGVLRVWGAALTLILIIAA

SEQ ID NO: 1129191 - protein, 26 aa, Mycobacterium
VNPVLLWLLMPVVVFGSAYVPEIASF

SEQ ID NO: 1129192 - protein, 26 aa, Mycobacterium
VNPYTARHMGLFVVGRLAASHGLVVR

SEQ ID NO: 1129193 - protein, 25 aa, Mycobacterium
VNVSGLKAGEFVRIAGVEVGKVKRI

SEQ ID NO: 1129194 - protein, 25 aa, Mycobacterium
VNVVMKRPIAFAAPILIVMILLVIP

SEQ ID NO: 1129195 - protein, 37 aa, Mycobacterium
VNVWLQSWTIFYWAWWVSWTPFVGMFIARISRGRTIR

SEQ ID NO: 1129196 - protein, 22 aa, Mycobacterium
VPAARLRPGDIIEVHPDEVVPA

SEQ ID NO: 1129197 - protein, 17 aa, Mycobacterium
VPAEGQWIPAGEPGSHW

SEQ ID NO: 1129198 - protein, 24 aa, Mycobacterium
VPAGELRVDFGLQLDQLSMCFVLL

SEQ ID NO: 1129199 - protein, 26 aa, Mycobacterium
VPAGFPADLLYEFRLQSALTAAVMWM

SEQ ID NO: 1129200 - protein, 22 aa, Mycobacterium
VPALLARASWPLRAPRAAIVLW

SEQ ID NO: 1129201 - protein, 23 aa, Mycobacterium
VPAVDLRDGQSLNIGNPDGPQLT

SEQ ID NO: 1129202 - protein, 17 aa, Mycobacterium
VPCAMLYGSTLDRGIPY

SEQ ID NO: 1129203 - protein, 18 aa, Mycobacterium
VPDGGRFGGGAAVAALLV

SEQ ID NO: 1129204 - protein, 18 aa, Mycobacterium
VPDPGMVPWMGRPSGPVH

SEQ ID NO: 1129205 - protein, 23 aa, Mycobacterium
VPDPRIDRSRVKMTMEYVDGRWR

SEQ ID NO: 1129206 - protein, 26 aa, Mycobacterium
VPDQMFGIWRAVWLVLLVPLAVLLVL

SEQ ID NO: 1129207 - protein, 17 aa, Mycobacterium
VPDVLERMARGHTRYPV

SEQ ID NO: 1129208 - protein, 23 aa, Mycobacterium
VPEGLPAILSVVLAIGVQQLARR

SEQ ID NO: 1129209 - protein, 21 aa, Mycobacterium
VPEHLREAIFARGITSKPEVP

SEQ ID NO: 1129210 - protein, 17 aa, Mycobacterium
VPETLPLPNVVRELAQT

SEQ ID NO: 1129211 - protein, 22 aa, Mycobacterium
VPFLRSRPAAALVLATGAVIVT

SEQ ID NO: 1129212 - protein, 23 aa, Mycobacterium
VPGARPPLPPAPPGARTVPLEPQ

SEQ ID NO: 1129213 - protein, 19 aa, Mycobacterium
VPGFAWWAAGLNSLPMLAA

SEQ ID NO: 1129214 - protein, 25 aa, Mycobacterium
VPGKRAPTVRLCESDEQFVPLNDGF

SEQ ID NO: 1129215 - protein, 21 aa, Mycobacterium
VPGPPAGSAVGLWDLGSELLG

SEQ ID NO: 1129216 - protein, 23 aa, Mycobacterium
VPGPPAGSAVGLWDLGSELLGRQ

SEQ ID NO: 1129217 - protein, 24 aa, Mycobacterium
VPGPPAGSAVGLWDLGSELLGRQG

SEQ ID NO: 1129218 - protein, 35 aa, Mycobacterium
VPGSEHRLRIAVVLMPFAGIAFLWFIGVVRDGLGA

SEQ ID NO: 1129219 - protein, 22 aa, Mycobacterium
VPHLLGVPWLVYPMVAVGILVI

SEQ ID NO: 1129220 - protein, 20 aa, Mycobacterium
VPIALRIGRGTLRKMRQNLA

SEQ ID NO: 1129221 - protein, 20 aa, Mycobacterium
VPIGRVERLDITPAGVNAVV

SEQ ID NO: 1129222 - protein, 22 aa, Mycobacterium
VPIGVLGTVWAMRSLREGGERS

SEQ ID NO: 1129223 - protein, 21 aa, Mycobacterium
VPKLRRWLATAVRPRVKEVAN

SEQ ID NO: 1129224 - protein, 17 aa, Mycobacterium
VPLAYAWSKSQFGNIQP

SEQ ID NO: 1129225 - protein, 18 aa, Mycobacterium
VPLLIRRRTALPLLVVAA

SEQ ID NO: 1129226 - protein, 26 aa, Mycobacterium
VPLLLACVFGGLRIYSSATEAAELRH

SEQ ID NO: 1129227 - protein, 17 aa, Mycobacterium
VPLLVQRGIDHGIPPLL

SEQ ID NO: 1129228 - protein, 17 aa, Mycobacterium
VPLQEFEASAALDMGEG

SEQ ID NO: 1129229 - protein, 19 aa, Mycobacterium
VPLRIGMASGPVVAGVVGA

SEQ ID NO: 1129230 - protein, 17 aa, Mycobacterium
VPLWDWTYKHLAVVDYL

SEQ ID NO: 1129231 - protein, 23 aa, Mycobacterium
VPNFLKPFFSWFANINFTACFFG

SEQ ID NO: 1129232 - protein, 27 aa, Mycobacterium
VPNMAWCVGYINASWTLRADLTARAVA

SEQ ID NO: 1129233 - protein, 24 aa, Mycobacterium
VPNSGRFGAVAAIVALLVSAALLA

SEQ ID NO: 1129234 - protein, 28 aa, Mycobacterium
VPPFPTRSTFPGVFSDGGPVDYFAVDLP

SEQ ID NO: 1129235 - protein, 24 aa, Mycobacterium
VPPPQPGTVYQMWLVDADGSHSAG

SEQ ID NO: 1129236 - protein, 23 aa, Mycobacterium
VPQERPGILQRIRDRLSNVGPDD

SEQ ID NO: 1129237 - protein, 19 aa, Mycobacterium
VPQIAVTVAYLLAMASVLA

SEQ ID NO: 1129238 - protein, 20 aa, Mycobacterium
VPSAWALNRLTWRPADNSPD

SEQ ID NO: 1129239 - protein, 26 aa, Mycobacterium
VPTGIKFFNWIGTMWKGQLTFETPML

SEQ ID NO: 1129240 - protein, 25 aa, Mycobacterium
VPTLGEFLEALQIVPSPAPPPGPAI

SEQ ID NO: 1129241 - protein, 19 aa, Mycobacterium
VPTRLSGLLDTSGLPEVLE

SEQ ID NO: 1129242 - protein, 25 aa, Mycobacterium
VPTYDMIGMWAPFLLVLLRMIQGFS

SEQ ID NO: 1129243 - protein, 17 aa, Mycobacterium
VPVAFNLAAWPLISDPM

SEQ ID NO: 1129244 - protein, 32 aa, Mycobacterium
VPVCAGILGALGYRWYSGLGVETARRTDSHAT

SEQ ID NO: 1129245 - protein, 22 aa, Mycobacterium
VPVLPAPAFRPPVVLPPPVIRL

SEQ ID NO: 1129246 - protein, 41 aa, Mycobacterium
VPVLQFTYWQWLSLTLAAPVVVWGAWPFHQAAWTNLRHGTA

SEQ ID NO: 1129247 - protein, 24 aa, Mycobacterium
VPVPEIPTLLSLGVIVVTLILTTI

SEQ ID NO: 1129248 - protein, 19 aa, Mycobacterium
VPVPSGWAGVGLVAAGGIA

SEQ ID NO: 1129249 - protein, 27 aa, Mycobacterium
VPVSVALWLSMRFPPRLLGPDDSARAV

SEQ ID NO: 1129250 - protein, 26 aa, Mycobacterium
VPVTGAPAWETFGLFTARNGATALIG

SEQ ID NO: 1129251 - protein, 19 aa, Mycobacterium
VPVVIASFFIQRKLVQGIS

SEQ ID NO: 1129252 - protein, 18 aa, Mycobacterium
VPWLLSFAQPTIWVIPRP

SEQ ID NO: 1129253 - protein, 18 aa, Mycobacterium
VPYVLPFLAESKFSGVTL

SEQ ID NO: 1129254 - protein, 27 aa, Mycobacterium
VQAGLYGGLLVDAYRAANVQVQVSDMR

SEQ ID NO: 1129255 - protein, 19 aa, Mycobacterium
VQAGWGIKAAIAGVLVVLG

SEQ ID NO: 1129256 - protein, 18 aa, Mycobacterium
VQASARIGLAVKALAPGA

SEQ ID NO: 1129257 - protein, 18 aa, Mycobacterium
VQASSLFMVSRLNCSITT

SEQ ID NO: 1129258 - protein, 19 aa, Mycobacterium
VQEAVSFAEAGTWEDIGDL

SEQ ID NO: 1129259 - protein, 24 aa, Mycobacterium
VQESLKLLHPFMLSLGESVSAGPF

SEQ ID NO: 1129260 - protein, 19 aa, Mycobacterium
VQFICGGTFDAAATTDNYK

SEQ ID NO: 1129261 - protein, 19 aa, Mycobacterium
VQFICGGTFDAAVTTDNYK

SEQ ID NO: 1129262 - protein, 21 aa, Mycobacterium
VQIATGVLLAWHYGVTWASLL

SEQ ID NO: 1129263 - protein, 18 aa, Mycobacterium
VQIIKAVLLIAGAGFMTV

SEQ ID NO: 1129264 - protein, 23 aa, Mycobacterium
VQIPREAAGYGFGASVLQSSVVY

SEQ ID NO: 1129265 - protein, 17 aa, Mycobacterium
VQLGRGEVWLGGNPSTA

SEQ ID NO: 1129266 - protein, 26 aa, Mycobacterium
VQMWLIELFFALPLTFFIAKVIDIRG

SEQ ID NO: 1129267 - protein, 26 aa, Mycobacterium
VQRKLRLQLFMTFVWTLTVVGGSLIA

SEQ ID NO: 1129268 - protein, 17 aa, Mycobacterium
VQRMIAFAVILTQGGIS

SEQ ID NO: 1129269 - protein, 17 aa, Mycobacterium
VQTRPVLLVGEAQQFCG

SEQ ID NO: 1129270 - protein, 17 aa, Mycobacterium
VQTWGVWDAGDRYPEAA

SEQ ID NO: 1129271 - protein, 18 aa, Mycobacterium
VQVMPLFFLAGGAAGAYG

SEQ ID NO: 1129272 - protein, 21 aa, Mycobacterium
VQVVDAVEWFRVGEAGAGNDR

SEQ ID NO: 1129273 - protein, 17 aa, Mycobacterium
VQVVHRVDAVIGDFQER

SEQ ID NO: 1129274 - protein, 23 aa, Mycobacterium
VQYLRRRYDALVTNPLFATMEYI

SEQ ID NO: 1129275 - protein, 19 aa, Mycobacterium
VRADRGVRVVSGRQPGLYG

SEQ ID NO: 1129276 - protein, 26 aa, Mycobacterium
VRAHFGDDLLYVWRHFPLERAHPRAF

SEQ ID NO: 1129277 - protein, 27 aa, Mycobacterium
VRAMLQRGVPLWRILLAKNLAMAALVT

SEQ ID NO: 1129278 - protein, 17 aa, Mycobacterium
VRARIGEDLVEVGNPTL

SEQ ID NO: 1129279 - protein, 37 aa, Mycobacterium
VRASMQIRRVDPWSTLKVSLLLSVVLFFVWMIAVAFL

SEQ ID NO: 1129280 - protein, 22 aa, Mycobacterium
VRDGEITWPPPPVQVSAAPVAA

SEQ ID NO: 1129281 - protein, 19 aa, Mycobacterium
VRDLARWQPDFVVNTGDNL

SEQ ID NO: 1129282 - protein, 18 aa, Mycobacterium
VRDWLPFALVLIAYDFSR

SEQ ID NO: 1129283 - protein, 17 aa, Mycobacterium
VRFRTGQQLSAWMRSEE

SEQ ID NO: 1129284 - protein, 18 aa, Mycobacterium
VRFTTWGRQFWRVTRGYF

SEQ ID NO: 1129285 - protein, 17 aa, Mycobacterium
VRFTTWGSQFWRVTRGY

SEQ ID NO: 1129286 - protein, 26 aa, Mycobacterium
VRGADPWPALWALLIGFFMILVDATI

SEQ ID NO: 1129287 - protein, 26 aa, Mycobacterium
VRGESPEVLGLLLIPATVLAAVAATT

SEQ ID NO: 1129288 - protein, 23 aa, Mycobacterium
VRGLKVLMWTALTAVLVVALGLL

SEQ ID NO: 1129289 - protein, 17 aa, Mycobacterium
VRITRWVATIAGLLGFV

SEQ ID NO: 1129290 - protein, 21 aa, Mycobacterium
VRKLVRFYWRHPECRGELTDA

SEQ ID NO: 1129291 - protein, 19 aa, Mycobacterium
VRLIYGTALTAYAIANLVT

SEQ ID NO: 1129292 - protein, 24 aa, Mycobacterium
VRLLAVPIVVFWALLAVSTNTFMP

SEQ ID NO: 1129293 - protein, 32 aa, Mycobacterium
VRLSEATDALARRIAKLMGYRTTAVCVIEPEQ

SEQ ID NO: 1129294 - protein, 19 aa, Mycobacterium
VRLTCNWLYAFPGLHHEDW

SEQ ID NO: 1129295 - protein, 19 aa, Mycobacterium
VRMLGSGGMGKVYLAKHPR

SEQ ID NO: 1129296 - protein, 21 aa, Mycobacterium
VRMVLVPAFMHLMGGLNWWAP

SEQ ID NO: 1129297 - protein, 17 aa, Mycobacterium
VRPGEPINVALWLIDTP

SEQ ID NO: 1129298 - protein, 20 aa, Mycobacterium
VRPRALRALDRVDAVVIDPR

SEQ ID NO: 1129299 - protein, 17 aa, Mycobacterium
VRPSLRWLDSGRPPTPA

SEQ ID NO: 1129300 - protein, 17 aa, Mycobacterium
VRQEPRIAATERGAGPM

SEQ ID NO: 1129301 - protein, 23 aa, Mycobacterium
VRQLFTVRIGLRLTEATQTTMVL

SEQ ID NO: 1129302 - protein, 19 aa, Mycobacterium
VRQRWRGQRAVDTFLVIPL

SEQ ID NO: 1129303 - protein, 18 aa, Mycobacterium
VRQVHHWAALLFAASIMV

SEQ ID NO: 1129304 - protein, 20 aa, Mycobacterium
VRQVPEERWESFQINTPEAA

SEQ ID NO: 1129305 - protein, 21 aa, Mycobacterium
VRRHIRFGVTVGGARWDDDAQ

SEQ ID NO: 1129306 - protein, 18 aa, Mycobacterium
VRRILLRTVLFIAPASAL

SEQ ID NO: 1129307 - protein, 20 aa, Mycobacterium
VRRLAVIVATTSVVTAGVYV

SEQ ID NO: 1129308 - protein, 17 aa, Mycobacterium
VRRRRVWVRLAPGAAGT

SEQ ID NO: 1129309 - protein, 32 aa, Mycobacterium
VRRSEAVAADLGRRVHAIGVTWSDDADTEASL

SEQ ID NO: 1129310 - protein, 19 aa, Mycobacterium
VRSAPWPATVLLASSAGFC

SEQ ID NO: 1129311 - protein, 35 aa, Mycobacterium
VRSEAVFGMRIGRPFRRMTEYTGFQGWLHQLWLDV

SEQ ID NO: 1129312 - protein, 36 aa, Mycobacterium
VRSEAVFGMRIGRPFRRMTEYTGFQGWLHQLWLDVS

SEQ ID NO: 1129313 - protein, 39 aa, Mycobacterium
VRSEAVFGMRIGRPFRRMTQYTGFQGWLHQLWLDVSSAR

SEQ ID NO: 1129314 - protein, 17 aa, Mycobacterium
VRSIPRVMTVSAVLGSL

SEQ ID NO: 1129315 - protein, 38 aa, Mycobacterium
VRSPRPAAPPPRRQPHRRLVAAVALGGLAVVLAAVTTL

SEQ ID NO: 1129316 - protein, 21 aa, Mycobacterium
VRSVPELILAVVFVAALGLGP

SEQ ID NO: 1129317 - protein, 17 aa, Mycobacterium
VRTAFVLVTLMMAAVSA

SEQ ID NO: 1129318 - protein, 30 aa, Mycobacterium
VRTLLRVPFFRNWKPMRVYLEWLAEKTQKT

SEQ ID NO: 1129319 - protein, 24 aa, Mycobacterium
VRTRVFHNLAFPAAYLLMAVGAAT

SEQ ID NO: 1129320 - protein, 22 aa, Mycobacterium
VRVAEGLPPLWADEQRLAQVVG

SEQ ID NO: 1129321 - protein, 17 aa, Mycobacterium
VRVALMFAAVLLNAFST

SEQ ID NO: 1129322 - protein, 22 aa, Mycobacterium
VRVEAYEALTMIEVTGKPYSLT

SEQ ID NO: 1129323 - protein, 18 aa, Mycobacterium
VRVMPVFAVKSGAFFAMT

SEQ ID NO: 1129324 - protein, 25 aa, Mycobacterium
VRWAVAGRMAVAWLITLPAAGIVGA

SEQ ID NO: 1129325 - protein, 20 aa, Mycobacterium
VRWWEYPTLIAMGILTTVWM

SEQ ID NO: 1129326 - protein, 24 aa, Mycobacterium
VRYVLRDRPLLLALVAVTTVGIVS

SEQ ID NO: 1129327 - protein, 18 aa, Mycobacterium
VSAAVWLLTELVRMVVVS

SEQ ID NO: 1129328 - protein, 23 aa, Mycobacterium
VSACAMALIVVNLSWPWWAALLV

SEQ ID NO: 1129329 - protein, 22 aa, Mycobacterium
VSAFAGWGAFLFMMSLYLQGER

SEQ ID NO: 1129330 - protein, 21 aa, Mycobacterium
VSAFCGCLYAGAIAVPAALPQ

SEQ ID NO: 1129331 - protein, 21 aa, Mycobacterium
VSAFLWSLYALFLGSAGTPGM

SEQ ID NO: 1129332 - protein, 17 aa, Mycobacterium
VSAGWGFGLSIATSLAS

SEQ ID NO: 1129333 - protein, 17 aa, Mycobacterium
VSAKFWTLLEIIPNLTL

SEQ ID NO: 1129334 - protein, 22 aa, Mycobacterium
VSAKSAALVGVFISVTTVPAAG

SEQ ID NO: 1129335 - protein, 17 aa, Mycobacterium
VSALAVLRRQLSNAVLG

SEQ ID NO: 1129336 - protein, 18 aa, Mycobacterium
VSALPWLVAAAVSGSLAV

SEQ ID NO: 1129337 - protein, 17 aa, Mycobacterium
VSALVVMCVVAAAFTAV

SEQ ID NO: 1129338 - protein, 23 aa, Mycobacterium
VSAMLSVAYAWVGFKMVMPSTRT

SEQ ID NO: 1129339 - protein, 27 aa, Mycobacterium
VSAVFVPIVLALSVATLAAWLLTGHSA

SEQ ID NO: 1129340 - protein, 27 aa, Mycobacterium
VSAVFVPIVLALSVATLAVWLLTGHSA

SEQ ID NO: 1129341 - protein, 18 aa, Mycobacterium
VSCFSLVVSVLVGRLLIR

SEQ ID NO: 1129342 - protein, 20 aa, Mycobacterium
VSCVVGFAGAKAWYLVASRK

SEQ ID NO: 1129343 - protein, 26 aa, Mycobacterium
VSDAPSVWDWTKWLPHIQHHSKRDGC

SEQ ID NO: 1129344 - protein, 17 aa, Mycobacterium
VSDFLPGYLDEIVIRVG

SEQ ID NO: 1129345 - protein, 24 aa, Mycobacterium
VSDPQFGIDLGFYAFDLPFYRLML

SEQ ID NO: 1129346 - protein, 18 aa, Mycobacterium
VSDRLSWASPQLDSVIAK

SEQ ID NO: 1129347 - protein, 24 aa, Mycobacterium
VSDSGLRPRYRGVEIYRVDRPGSL

SEQ ID NO: 1129348 - protein, 22 aa, Mycobacterium
VSEGYPSTWALLTRAGEGLLVY

SEQ ID NO: 1129349 - protein, 19 aa, Mycobacterium
VSELDRFETLLSDLLEISR

SEQ ID NO: 1129350 - protein, 22 aa, Mycobacterium
VSEPYPSVWQLLSVAGERLVLY

SEQ ID NO: 1129351 - protein, 27 aa, Mycobacterium
VSFGAFLGDWARYIPRDTPPWKPMAAA

SEQ ID NO: 1129352 - protein, 25 aa, Mycobacterium
VSFIGIVLVLISWRRPAVQRDFPPE

SEQ ID NO: 1129353 - protein, 23 aa, Mycobacterium
VSFMRMFGVGFTLAVLADATLIR

SEQ ID NO: 1129354 - protein, 27 aa, Mycobacterium
VSFPVVVYRSWRWWVASGVVFYAVAAV

SEQ ID NO: 1129355 - protein, 19 aa, Mycobacterium
VSFTLRLLVFATYIVVMFL

SEQ ID NO: 1129356 - protein, 19 aa, Mycobacterium
VSGLLAWLTTRYVEEPLRS

SEQ ID NO: 1129357 - protein, 18 aa, Mycobacterium
VSGLSFGLSVPVLLVQAG

SEQ ID NO: 1129358 - protein, 18 aa, Mycobacterium
VSGVAALVRSRFPDLTAR

SEQ ID NO: 1129359 - protein, 19 aa, Mycobacterium
VSIAIMFHISYLVLCSAPV

SEQ ID NO: 1129360 - protein, 25 aa, Mycobacterium
VSIPVLRWSWTPVLFAGSLLTLLPL

SEQ ID NO: 1129361 - protein, 17 aa, Mycobacterium
VSLDWVAWQGLGFGSEA

SEQ ID NO: 1129362 - protein, 21 aa, Mycobacterium
VSLGPRRVWELLARPRVLELF

SEQ ID NO: 1129363 - protein, 24 aa, Mycobacterium
VSLIKATLFGAAAGLIACYKGVYV

SEQ ID NO: 1129364 - protein, 25 aa, Mycobacterium
VSLLVSWLLFTWIIARLPRESITLR

SEQ ID NO: 1129365 - protein, 24 aa, Mycobacterium
VSLPCGRGPVIGVAGEFVQTSVTT

SEQ ID NO: 1129366 - protein, 17 aa, Mycobacterium
VSLPIALGLLIMMYPVL

SEQ ID NO: 1129367 - protein, 17 aa, Mycobacterium
VSLRRTRLFGATGTVLM

SEQ ID NO: 1129368 - protein, 17 aa, Mycobacterium
VSLWGRILPITFTALGL

SEQ ID NO: 1129369 - protein, 31 aa, Mycobacterium; identical to SEQ ID NO: 335546

SEQ ID NO: 1129370 - protein, 20 aa, Mycobacterium
VSMAVAWLMFAVDYVVRLNL

SEQ ID NO: 1129371 - protein, 34 aa, Mycobacterium
VSMPHFPNFLSLASPFAFLGLNFFNTVEYQMRHM

SEQ ID NO: 1129372 - protein, 22 aa, Mycobacterium
VSMVSSLVFLFGIALVYATTGT

SEQ ID NO: 1129373 - protein, 22 aa, Mycobacterium
VSNIAVGFLRGFPVSSSGSRTA

SEQ ID NO: 1129374 - protein, 17 aa, Mycobacterium
VSPATGLLLSFATFGVG

SEQ ID NO: 1129375 - protein, 26 aa, Mycobacterium
VSPFDIGPTPSWRNLRYPRAQIPADA

SEQ ID NO: 1129376 - protein, 22 aa, Mycobacterium
VSPGMEWIPVVTFLQVSADMAV

SEQ ID NO: 1129377 - protein, 18 aa, Mycobacterium
VSPGWYFLPVCLIALIGG

SEQ ID NO: 1129378 - protein, 33 aa, Mycobacterium
VSPLVRKAAAWSWRLLIIFGALVAVLWLVARLE

SEQ ID NO: 1129379 - protein, 32 aa, Mycobacterium
VSPLVRKAAAWSWRLLLILGAIVTLLWLILRL

SEQ ID NO: 1129380 - protein, 24 aa, Mycobacterium
VSRAEGWRRRGPLLPALIFMIVVT

SEQ ID NO: 1129381 - protein, 21 aa, Mycobacterium
VSRIAWSELFGTMKTSVKGAT

SEQ ID NO: 1129382 - protein, 23 aa, Mycobacterium
VSRLRPLIEPALVVLTVAALAAG

SEQ ID NO: 1129383 - protein, 28 aa, Mycobacterium
VSRSYFPGIFQSFSWGIGSLVGKNSTAA

SEQ ID NO: 1129384 - protein, 22 aa, Mycobacterium
VSSIPSVIGFLLAGVVFIYLIR

SEQ ID NO: 1129385 - protein, 21 aa, Mycobacterium
VSSLVAPYFVKVLWPPENSAW

SEQ ID NO: 1129386 - protein, 19 aa, Mycobacterium
VSSVALIWFGGMRIDTGHM

SEQ ID NO: 1129387 - protein, 27 aa, Mycobacterium
VSTFRVVKDSMPLPRTLTSVVIDTGSV

SEQ ID NO: 1129388 - protein, 18 aa, Mycobacterium
VSVARPSAQVAFMAGAPF

SEQ ID NO: 1129389 - protein, 21 aa, Mycobacterium
VSVASFSEWLGFSSEVGAFLA

SEQ ID NO: 1129390 - protein, 22 aa, Mycobacterium
VSVGALVMFLAHLVRQIRVESL

SEQ ID NO: 1129391 - protein, 20 aa, Mycobacterium
VSVGLAVLWMAALSINNSRS

SEQ ID NO: 1129392 - protein, 18 aa, Mycobacterium
VSVGLGFVNEYRAERASA

SEQ ID NO: 1129393 - protein, 23 aa, Mycobacterium
VSVIPAHVFWLIERRDEDPVVSR

SEQ ID NO: 1129394 - protein, 17 aa, Mycobacterium
VSVRVVVVLSVIVLAAF

SEQ ID NO: 1129395 - protein, 20 aa, Mycobacterium
VSVTLGWMFLHLARNDGDRE

SEQ ID NO: 1129396 - protein, 17 aa, Mycobacterium
VSVWAGLAFSAMFNLPP

SEQ ID NO: 1129397 - protein, 24 aa, Mycobacterium
VSWEREGAELALRVADNGAGIAAE

SEQ ID NO: 1129398 - protein, 18 aa, Mycobacterium
VSWSHHWVWSLPTVLVTL

SEQ ID NO: 1129399 - protein, 24 aa, Mycobacterium
VTAAAYRPSYSYVRDYISELGAPG

SEQ ID NO: 1129400 - protein, 24 aa, Mycobacterium
VTAGRVAALVACRRGIPAAEGSAL

SEQ ID NO: 1129401 - protein, 19 aa, Mycobacterium
VTAGVYALVGFEVTPATVI

SEQ ID NO: 1129402 - protein, 19 aa, Mycobacterium
VTARAGLDAALAAVPTFSV

SEQ ID NO: 1129403 - protein, 21 aa, Mycobacterium
VTARLTWIWVGVFAAMAVSAA

SEQ ID NO: 1129404 - protein, 30 aa, Mycobacterium
VTASGFWGLLALRALVFSVVMFALFRLLAP

SEQ ID NO: 1129405 - protein, 25 aa, Mycobacterium
VTASMPLVVAFVYHPDKSHPSADMA

SEQ ID NO: 1129406 - protein, 21 aa, Mycobacterium
VTAVGCYFAFKGASRRFRDDL

SEQ ID NO: 1129407 - protein, 19 aa, Mycobacterium
VTAVVGAFAAHRGWRAWRS

SEQ ID NO: 1129408 - protein, 32 aa, Mycobacterium
VTDELWRRIGVSLRLVIIGSIVGTFLGVVAGA

SEQ ID NO: 1129409 - protein, 20 aa, Mycobacterium
VTEARRTKPRVVSIADDGLR

SEQ ID NO: 1129410 - protein, 25 aa, Mycobacterium
VTEPVRRRWLTWSRYARTWESTCTL

SEQ ID NO: 1129411 - protein, 17 aa, Mycobacterium
VTETAPPPPARGIDAPT

SEQ ID NO: 1129412 - protein, 26 aa, Mycobacterium
VTFDPRKAATLGLRPQLAIPVLTMLM

SEQ ID NO: 1129413 - protein, 18 aa, Mycobacterium
VTGASIGNAVEWFDFAIY

SEQ ID NO: 1129414 - protein, 23 aa, Mycobacterium
VTGEYRSGLIATTFMATPHRTLV

SEQ ID NO: 1129415 - protein, 17 aa, Mycobacterium
VTGLRRLVFDAVPMQLK

SEQ ID NO: 1129416 - protein, 21 aa, Mycobacterium
VTHHFRWTRLALMADEPTSES

SEQ ID NO: 1129417 - protein, 17 aa, Mycobacterium
VTIPAAVMLARYQARRM

SEQ ID NO: 1129418 - protein, 18 aa, Mycobacterium
VTIPGAVMLGRYQARRTV

SEQ ID NO: 1129419 - protein, 17 aa, Mycobacterium
VTIPPAWLLHRFTRVRS

SEQ ID NO: 1129420 - protein, 25 aa, Mycobacterium
VTIVNGFFGLLVAWVLTRDEFPGKR

SEQ ID NO: 1129421 - protein, 18 aa, Mycobacterium
VTLIAWGYVVDRVGERVV

SEQ ID NO: 1129422 - protein, 25 aa, Mycobacterium
VTLLVCLYPILPVRIGAGGGGYNAF

SEQ ID NO: 1129423 - protein, 23 aa, Mycobacterium
VTLMTAAVAWRWRQRPCAAGQCG

SEQ ID NO: 1129424 - protein, 17 aa, Mycobacterium
VTLSIQFALLAGQVGAT

SEQ ID NO: 1129425 - protein, 20 aa, Mycobacterium
VTMGVAWSVLYIPIGGVGTI

SEQ ID NO: 1129426 - protein, 25 aa, Mycobacterium
VTMSVWKFLALLGYAALYAYVAPWQ

SEQ ID NO: 1129427 - protein, 18 aa, Mycobacterium
VTNLELYLIFPLNNEDST

SEQ ID NO: 1129428 - protein, 23 aa, Mycobacterium
VTNLELYLIFPLNNEESTISLVR

SEQ ID NO: 1129429 - protein, 18 aa, Mycobacterium
VTNSRKAPTLALIVPGVI

SEQ ID NO: 1129430 - protein, 51 aa, Mycobacterium
VTPKRDGKWARLTAFVLLPALALVLALGAGYLKWQDTTFRSGAIEASPSGR

SEQ ID NO: 1129431 - protein, 27 aa, Mycobacterium
VTPNPRFPRLFPGGDFVQGLPDGGLTD

SEQ ID NO: 1129432 - protein, 23 aa, Mycobacterium
VTQRLTDLGLFVFRSYGSTEHPS

SEQ ID NO: 1129433 - protein, 25 aa, Mycobacterium
VTREDPSRPAVCIVRARSKDGSETG

SEQ ID NO: 1129434 - protein, 24 aa, Mycobacterium
VTRFLAGLAPEFATAALTAGAAIG

SEQ ID NO: 1129435 - protein, 20 aa, Mycobacterium
VTRLRVGDELLIVTTSVTRD

SEQ ID NO: 1129436 - protein, 23 aa, Mycobacterium
VTRTVCLAIDPDLLITVNAMTAG

SEQ ID NO: 1129437 - protein, 18 aa, Mycobacterium
VTRVMKRPLIYAIPIIVG

SEQ ID NO: 1129438 - protein, 26 aa, Mycobacterium
VTSEPAWLRRCWLAAAIVAPAVLYLE

SEQ ID NO: 1129439 - protein, 19 aa, Mycobacterium
VTTIYEWTSAPAGLVFASL

SEQ ID NO: 1129440 - protein, 24 aa, Mycobacterium
VTTMPALLMAIPIGAITTIVTSGL

SEQ ID NO: 1129441 - protein, 23 aa, Mycobacterium
VTTRWPYADVVVAVLVALWVLPR

SEQ ID NO: 1129442 - protein, 17 aa, Mycobacterium
VTTTWRPPRTSTTTTTP

SEQ ID NO: 1129443 - protein, 24 aa, Mycobacterium
VTVGLAVAAAGLFFAPLATADPAT

SEQ ID NO: 1129444 - protein, 24 aa, Mycobacterium
VTVGSMLRNWGLVFVGNFLGALTV

SEQ ID NO: 1129445 - protein, 30 aa, Mycobacterium
VTVIVRGYLMWWRRRPTRGAGPVGDPPERG

SEQ ID NO: 1129446 - protein, 25 aa, Mycobacterium
VTVPIWVVFLAWASFFFVGGGPAGW

SEQ ID NO: 1129447 - protein, 17 aa, Mycobacterium
VTVPTYLKDAWYRDWGA

SEQ ID NO: 1129448 - protein, 24 aa, Mycobacterium
VTVREAAAWSAVWVTLGLAFGAIV

SEQ ID NO: 1129449 - protein, 25 aa, Mycobacterium
VTVSDARSGFHIHGAAGLLNLFTFG

SEQ ID NO: 1129450 - protein, 22 aa, Mycobacterium
VTVVSAFIWRYAFAIDSGFVNQ

SEQ ID NO: 1129451 - protein, 24 aa, Mycobacterium
VTYLDIRNAQGFNVIQTVAIFNQA

SEQ ID NO: 1129452 - protein, 25 aa, Mycobacterium
VTYLEAGTQWARRPGTALGPASACG

SEQ ID NO: 1129453 - protein, 23 aa, Mycobacterium
VVAALCLAALAAGGPWWFHVAAL

SEQ ID NO: 1129454 - protein, 17 aa, Mycobacterium
VVACALVAGALFGVAVV

SEQ ID NO: 1129455 - protein, 37 aa, Mycobacterium
VVAGICALLALPALRGRPWIPVWLNLATLAGVMLTQM

SEQ ID NO: 1129456 - protein, 24 aa, Mycobacterium
VVAIAALCHFHISLTAAILGVTLV

SEQ ID NO: 1129457 - protein, 26 aa, Mycobacterium
VVALAALVLVAALVWAARNKRNQSRH

SEQ ID NO: 1129458 - protein, 17 aa, Mycobacterium
VVALAWRTPRFDAARPG

SEQ ID NO: 1129459 - protein, 20 aa, Mycobacterium
VVALMFGLILMWLLSWLIAT

SEQ ID NO: 1129460 - protein, 19 aa, Mycobacterium
VVAPLWRYRVHRWDLDATA

SEQ ID NO: 1129461 - protein, 29 aa, Mycobacterium
VVASLYLGALLRLPGWLLDLSPVAQTSYP

SEQ ID NO: 1129462 - protein, 17 aa, Mycobacterium
VVASVYIMRLRTVADRD

SEQ ID NO: 1129463 - protein, 32 aa, Mycobacterium
VVATLLFGVFANRWLAKRTRRRVNIGFVAGGL

SEQ ID NO: 1129464 - protein, 24 aa, Mycobacterium
VVAVPVPLLLIWAPSWSWVLAANV

SEQ ID NO: 1129465 - protein, 19 aa, Mycobacterium
VVDFLDRRGAPRGGAVALV

SEQ ID NO: 1129466 - protein, 27 aa, Mycobacterium
VVDGLRSRLWPVPALGVVAAVLAGISI

SEQ ID NO: 1129467 - protein, 25 aa, Mycobacterium
VVDRLRITPEYGLRPIGLVDDDLPS

SEQ ID NO: 1129468 - protein, 17 aa, Mycobacterium
VVDWWRRAEGRPTVDPA

SEQ ID NO: 1129469 - protein, 23 aa, Mycobacterium
VVEVGLRLVLGYVVIGFVYTVLH

SEQ ID NO: 1129470 - protein, 19 aa, Mycobacterium
VVEWLEYLGYALIVPFAAW

SEQ ID NO: 1129471 - protein, 25 aa, Mycobacterium
VVFALVVTRAIRWAAERVSRRIADG

SEQ ID NO: 1129472 - protein, 19 aa, Mycobacterium
VVFAWPGLGRLVFNAVAAR

SEQ ID NO: 1129473 - protein, 19 aa, Mycobacterium
VVFGEFRFASEDKYHATFT

SEQ ID NO: 1129474 - protein, 23 aa, Mycobacterium
VVFICAILFTIVWWHVEHTRSNW

SEQ ID NO: 1129475 - protein, 17 aa, Mycobacterium
VVFTFLPTYFIKTLRFS

SEQ ID NO: 1129476 - protein, 24 aa, Mycobacterium
VVFTRVLFRKDLRTDDIHLDEVMA

SEQ ID NO: 1129477 - protein, 18 aa, Mycobacterium
VVGELRKVIWPNRKEMAT

SEQ ID NO: 1129478 - protein, 19 aa, Mycobacterium
VVGFFGYVFHFGRRAVRAG

SEQ ID NO: 1129479 - protein, 18 aa, Mycobacterium
VVGKRAAVDEVLLVLDAT

SEQ ID NO: 1129480 - protein, 25 aa, Mycobacterium
VVGLAYPVLIWLVAQLPGLRDNADG

SEQ ID NO: 1129481 - protein, 24 aa, Mycobacterium
VVGRPLIGVVWAWMTGRDDTWRRT

SEQ ID NO: 1129482 - protein, 27 aa, Mycobacterium
VVGSLTWPEAMGLVVINGLIIVLLAVT

SEQ ID NO: 1129483 - protein, 24 aa, Mycobacterium
VVGVARFGYRRRAWLSTAALIMTL

SEQ ID NO: 1129484 - protein, 19 aa, Mycobacterium
VVGVGLIGFGGYRWVTRKK

SEQ ID NO: 1129485 - protein, 17 aa, Mycobacterium
VVGVVAGGFGWLMAGRA

SEQ ID NO: 1129486 - protein, 18 aa, Mycobacterium
VVHRAWVGPMILLVLDDP

SEQ ID NO: 1129487 - protein, 30 aa, Mycobacterium
VVIAAVLVLGFWKPGFFVTTKLDVNAAQNG

SEQ ID NO: 1129488 - protein, 24 aa, Mycobacterium
VVIACASLYVAHLLGGGLTFTAIA

SEQ ID NO: 1129489 - protein, 19 aa, Mycobacterium
VVIGTAFTGLVTAFTNAVI

SEQ ID NO: 1129490 - protein, 19 aa, Mycobacterium
VVIGVVVWLLVPSGDGGST

SEQ ID NO: 1129491 - protein, 18 aa, Mycobacterium
VVISLPPPGPYFVDATTG

SEQ ID NO: 1129492 - protein, 23 aa, Mycobacterium
VVKDLVFIGGLLILAVALIVYLV

SEQ ID NO: 1129493 - protein, 19 aa, Mycobacterium
VVLARRWVAKLGAFNGALA

SEQ ID NO: 1129494 - protein, 18 aa, Mycobacterium
VVLASYWPGLLVAVCQVV

SEQ ID NO: 1129495 - protein, 28 aa, Mycobacterium
VVLAVRPELKPALAQQNWGTLPGLQTNP

SEQ ID NO: 1129496 - protein, 18 aa, Mycobacterium
VVLFFVWMIAVAFLYLVL

SEQ ID NO: 1129497 - protein, 20 aa, Mycobacterium
VVLGHGIGGYIAYDALTTLW

SEQ ID NO: 1129498 - protein, 25 aa, Mycobacterium
VVLGLAYPLLIWLIAQAPFLSDKAD

SEQ ID NO: 1129499 - protein, 23 aa, Mycobacterium
VVLLCTLAMIAGISWGAGRINNS

SEQ ID NO: 1129500 - protein, 17 aa, Mycobacterium
VVLLTLLALVGIAVAGA

SEQ ID NO: 1129501 - protein, 17 aa, Mycobacterium
VVLPELEPGYADTYVDG

SEQ ID NO: 1129502 - protein, 17 aa, Mycobacterium
VVLPQLRLAVLGGGLLI

SEQ ID NO: 1129503 - protein, 36 aa, Mycobacterium
VVLSRLALRDALSGGFRTEFFIKTGLVLLGASINLK

SEQ ID NO: 1129504 - protein, 23 aa, Mycobacterium
VVLTGLLALFGYLKVRRIRGPQK

SEQ ID NO: 1129505 - protein, 17 aa, Mycobacterium
VVLVGLWAFTGGADVDF

SEQ ID NO: 1129506 - protein, 17 aa, Mycobacterium
VVMALIRGRRRNVEHAE

SEQ ID NO: 1129507 - protein, 22 aa, Mycobacterium
VVMAVWALMTWPWERMRRPADH

SEQ ID NO: 1129508 - protein, 30 aa, Mycobacterium
VVMAWLEFWYPVPSCLIVAALVALSGAIRL

SEQ ID NO: 1129509 - protein, 19 aa, Mycobacterium
VVMRNRLAAVLLVGVTGYG

SEQ ID NO: 1129510 - protein, 25 aa, Mycobacterium
VVNDEARRLLSLPAGEVARSDLPEF

SEQ ID NO: 1129511 - protein, 21 aa, Mycobacterium
VVNLSWPWWAALLVGIACGAL

SEQ ID NO: 1129512 - protein, 18 aa, Mycobacterium
VVPETLPLPNVVRELAQT

SEQ ID NO: 1129513 - protein, 19 aa, Mycobacterium
VVPETLPLPNVVRELAQTG

SEQ ID NO: 1129514 - protein, 23 aa, Mycobacterium
VVPRLNRAAKFDVFSGFNPLKNS

SEQ ID NO: 1129515 - protein, 23 aa, Mycobacterium
VVPRLSVALAQRYDFDLVPYYPL

SEQ ID NO: 1129516 - protein, 27 aa, Mycobacterium
VVQALRVALPMARRGSISAQRQRIPGT

SEQ ID NO: 1129517 - protein, 17 aa, Mycobacterium
VVQKSGRIDVHMVTHEQ

SEQ ID NO: 1129518 - protein, 22 aa, Mycobacterium
VVRHPLMLGFLIAFWSAPTMTA

SEQ ID NO: 1129519 - protein, 26 aa, Mycobacterium
VVRPRALRHLDRLDAIVIDPRALYTD

SEQ ID NO: 1129520 - protein, 22 aa, Mycobacterium
VVRPRVGELLLNTVALVAVTVP

SEQ ID NO: 1129521 - protein, 19 aa, Mycobacterium
VVRQIPVLVGSLVLGSATG

SEQ ID NO: 1129522 - protein, 17 aa, Mycobacterium
VVSAIAALVRARSPGLT

SEQ ID NO: 1129523 - protein, 26 aa, Mycobacterium
VVSMSLTLLREWYARPGSTVLAVNFT

SEQ ID NO: 1129524 - protein, 17 aa, Mycobacterium
VVTAILLSMYWPLGVVV

SEQ ID NO: 1129525 - protein, 23 aa, Mycobacterium
VVTHITLLIVFSFVAGASADLSK

SEQ ID NO: 1129526 - protein, 31 aa, Mycobacterium
VVTIRGRRLTGWVAALFAWRRRHRQPPPTPS

SEQ ID NO: 1129527 - protein, 23 aa, Mycobacterium
VVTLGLAAAVGWFVPLLGLSLVG

SEQ ID NO: 1129528 - protein, 26 aa, Mycobacterium
VVTSNELIAWVCIVASVIGVVLLIVD

SEQ ID NO: 1129529 - protein, 28 aa, Mycobacterium
VVTVLRPGYLPVPFVIAALPLIALLAAG

SEQ ID NO: 1129530 - protein, 25 aa, Mycobacterium
VVVALASTIGFGWTVLLLAGAFLLG

SEQ ID NO: 1129531 - protein, 24 aa, Mycobacterium
VVVALEVVALVAFIGLPPARFGWW

SEQ ID NO: 1129532 - protein, 21 aa, Mycobacterium
VVVFQWGWLADLGFKQISSLD

SEQ ID NO: 1129533 - protein, 18 aa, Mycobacterium
VVVGAEWALPGIESAHAH

SEQ ID NO: 1129534 - protein, 20 aa, Mycobacterium
VVVGTWWRYRYDKFGWTTRS

SEQ ID NO: 1129535 - protein, 17 aa, Mycobacterium
VVVGWTAIWIFVGTAVH

SEQ ID NO: 1129536 - protein, 18 aa, Mycobacterium
VVVIGVWPLTTVGIALTL

SEQ ID NO: 1129537 - protein, 17 aa, Mycobacterium
VVVKLWSVWPKLFDRPV

SEQ ID NO: 1129538 - protein, 32 aa, Mycobacterium
VVVMTVLYWRVAHIRPSLGFDSRVCRELIRFG

SEQ ID NO: 1129539 - protein, 18 aa, Mycobacterium
VVVQGHFFLHSMIVAGLV

SEQ ID NO: 1129540 - protein, 18 aa, Mycobacterium
VVVQGHFFVHSLIVAGLV

SEQ ID NO: 1129541 - protein, 18 aa, Mycobacterium
VVVTAILLSMYWPLGVVV

SEQ ID NO: 1129542 - protein, 29 aa, Mycobacterium
VVVTAILLSMYWPLGVVVLVSIVPITLTV

SEQ ID NO: 1129543 - protein, 21 aa, Mycobacterium
VVVTCPHCFNTLGREYPQLGG

SEQ ID NO: 1129544 - protein, 20 aa, Mycobacterium
VVVVICIFYLVPQYQGAGLA

SEQ ID NO: 1129545 - protein, 19 aa, Mycobacterium
VVVVLSVIVLAAFGPDWMR

SEQ ID NO: 1129546 - protein, 19 aa, Mycobacterium
VVVVQACSRMYFLRRSGRI

SEQ ID NO: 1129547 - protein, 18 aa, Mycobacterium
VVWFWIPLGLLVLGTSSI

SEQ ID NO: 1129548 - protein, 37 aa, Mycobacterium
VVWLLCHRPNRTWWRFVAWWLPCVALAVTWWVVALLH

SEQ ID NO: 1129549 - protein, 31 aa, Mycobacterium
VVYRPSPLAMLFACAAFGLTLLGAVPPAVRA

SEQ ID NO: 1129550 - protein, 24 aa, Mycobacterium
VWAVDGASGWPVDAVVIAAIVVAN

SEQ ID NO: 1129551 - protein, 25 aa, Mycobacterium
VWAVVSLLALMVWIPATGRHRGAWA

SEQ ID NO: 1129552 - protein, 18 aa, Mycobacterium
VWCLLATSLSAPTVATAC

SEQ ID NO: 1129553 - protein, 24 aa, Mycobacterium
VWERLRPVWRRVLRTRDRLREWWA

SEQ ID NO: 1129554 - protein, 18 aa, Mycobacterium
VWESLRHADTWIMSLLYI

SEQ ID NO: 1129555 - protein, 18 aa, Mycobacterium
VWFVIDPQLWLLVVVTVL

SEQ ID NO: 1129556 - protein, 32 aa, Mycobacterium
VWIATSGPFAWDGLMTFWFAMALYVPWQIIVY

SEQ ID NO: 1129557 - protein, 34 aa, Mycobacterium
VWLILVGWLSIWPFLNWWTTHFVITDRRVMYRHG

SEQ ID NO: 1129558 - protein, 19 aa, Mycobacterium
VWLTRRGRIPNQRWYGWAG

SEQ ID NO: 1129559 - protein, 20 aa, Mycobacterium
VWMIAVAFLYLVLGGMGVWS

SEQ ID NO: 1129560 - protein, 19 aa, Mycobacterium
VWQRSCDLAGMLHAGGVGA

SEQ ID NO: 1129561 - protein, 18 aa, Mycobacterium
VWRNKVLRTLALVDLVAT

SEQ ID NO: 1129562 - protein, 27 aa, Mycobacterium
VWRQGRLARNWSFHLGLLSLGWGVFNV

SEQ ID NO: 1129563 - protein, 24 aa, Mycobacterium
VWRVARIPLAWILPRMLIEAPFIV

SEQ ID NO: 1129564 - protein, 25 aa, Mycobacterium
VWSVLMLLLMRWASPGVVDDAPPPA

SEQ ID NO: 1129565 - protein, 21 aa, Mycobacterium
VWVPRMLYLFGEQKMGLPEQA

SEQ ID NO: 1129566 - protein, 25 aa, Mycobacterium
VYAVWLLYAGGWQYLLMAAVFYLVG

SEQ ID NO: 1129567 - protein, 20 aa, Mycobacterium
VYCEGQRLPGKYTHAAALAK

SEQ ID NO: 1129568 - protein, 20 aa, Mycobacterium
VYDDPRWLPSAADAAKVPRD

SEQ ID NO: 1129569 - protein, 18 aa, Mycobacterium
VYDGSGWTQAAPMPTPRQ

SEQ ID NO: 1129570 - protein, 26 aa, Mycobacterium
VYEGFPADVLYEFRLYSLGTQVVIYT

SEQ ID NO: 1129571 - protein, 25 aa, Mycobacterium
VYEGFPADVLYYFRLYALGTLRGTR

SEQ ID NO: 1129572 - protein, 25 aa, Mycobacterium
VYEGFPADVLYYFRLYALGTQVVIY

SEQ ID NO: 1129573 - protein, 21 aa, Mycobacterium
VYGFRAARRAIYTGFAMNALA

SEQ ID NO: 1129574 - protein, 17 aa, Mycobacterium
VYGLCFEVVFDAAVSEH

SEQ ID NO: 1129575 - protein, 18 aa, Mycobacterium
VYGSFTVAFLFVGYGVDM

SEQ ID NO: 1129576 - protein, 18 aa, Mycobacterium
VYHKPHFVQKVVNAEGTV

SEQ ID NO: 1129577 - protein, 19 aa, Mycobacterium
VYIPARLLIHTAPAQYGGR

SEQ ID NO: 1129578 - protein, 25 aa, Mycobacterium
VYLLLERNLTRMLLGLLLISNAINL

SEQ ID NO: 1129579 - protein, 17 aa, Mycobacterium
VYNGRFRAYVPVSLTSD

SEQ ID NO: 1129580 - protein, 28 aa, Mycobacterium
VYQPIVDLRSGFIVGVEALLRWPHPRLG

SEQ ID NO: 1129581 - protein, 31 aa, Mycobacterium
VYQYRYIVIGVMVALCLGGGVYGISLGQHVT

SEQ ID NO: 1129582 - protein, 22 aa, Mycobacterium
VYRFGAERAWDGQDLYSVGLTG

SEQ ID NO: 1129583 - protein, 22 aa, Mycobacterium
VYRSAVTMLLPLVTIGSSLVIA

SEQ ID NO: 1129584 - protein, 23 aa, Mycobacterium
VYTSKWWLSGLVVGLAAGVKLTP

SEQ ID NO: 1129585 - protein, 18 aa, Mycobacterium
WAAAALIIAERVGKAVRS

SEQ ID NO: 1129586 - protein, 18 aa, Mycobacterium
WAAIELAHLTGLSEDQNN

SEQ ID NO: 1129587 - protein, 20 aa, Mycobacterium
WAAIGAELEDAIATAVGDNF

SEQ ID NO: 1129588 - protein, 20 aa, Mycobacterium
WAALLVGIACGALIGLAIGL

SEQ ID NO: 1129589 - protein, 18 aa, Mycobacterium
WAALPPLLIYAILGSSRQ

SEQ ID NO: 1129590 - protein, 25 aa, Mycobacterium
WAALRALLFFTVVLGLAYPLLIWLI

SEQ ID NO: 1129591 - protein, 18 aa, Mycobacterium
WADGTAFEGVAKSVEFPV

SEQ ID NO: 1129592 - protein, 21 aa, Mycobacterium
WAEEAWGRYWGWDPKETVSFI

SEQ ID NO: 1129593 - protein, 28 aa, Mycobacterium
WAGFALGIAMLLGGSWLTWILAAVSSAL

SEQ ID NO: 1129594 - protein, 28 aa, Mycobacterium
WAGFALGIAMLLGGSWLTWILAAVSSTL

SEQ ID NO: 1129595 - protein, 27 aa, Mycobacterium
WAGFALGIAMLLGGTWLTCILAAGTSV

SEQ ID NO: 1129596 - protein, 25 aa, Mycobacterium
WAGIIEGLRFVWRNKVLRTLALVDL

SEQ ID NO: 1129597 - protein, 23 aa, Mycobacterium
WAGLRGAVPIVLCTYPIVAGVPD

SEQ ID NO: 1129598 - protein, 20 aa, Mycobacterium
WAGPAGELQGAWAPAGASEA

SEQ ID NO: 1129599 - protein, 17 aa, Mycobacterium
WAGRRFGKGQSRAITAE

SEQ ID NO: 1129600 - protein, 19 aa, Mycobacterium
WAKDLTRSMLLAPMFITPI

SEQ ID NO: 1129601 - protein, 28 aa, Mycobacterium
WAKHRIVTKLEVWFPKDLRRDPVTIDTG

SEQ ID NO: 1129602 - protein, 24 aa, Mycobacterium
WAKRPPDRRPRLLLYGESLGSMAG

SEQ ID NO: 1129603 - protein, 24 aa, Mycobacterium
WALGNLWALAAMVSFVSGFEALNR

SEQ ID NO: 1129604 - protein, 18 aa, Mycobacterium
WALIRLASPFILLAVWQL

SEQ ID NO: 1129605 - protein, 26 aa, Mycobacterium
WALWTGRRWGRGIAVFAQLLLLPVTW

SEQ ID NO: 1129606 - protein, 30 aa, Mycobacterium
WAMFTCIELLPVLIKLLMNMGASSAYDRVQ

SEQ ID NO: 1129607 - protein, 17 aa, Mycobacterium
WAPRGEAGGAHRRSAEQ

SEQ ID NO: 1129608 - protein, 31 aa, Mycobacterium
WAPTLAWRTFCLLTLAALGWAGWRLLGETPY

SEQ ID NO: 1129609 - protein, 18 aa, Mycobacterium
WAQPQLAGMVAVHAAEVG

SEQ ID NO: 1129610 - protein, 25 aa, Mycobacterium
WARVFDWLPIFVVITGIVGWVSDST

SEQ ID NO: 1129611 - protein, 26 aa, Mycobacterium
WASEVTGLVGRWSEWTQLPAVGAVSP

SEQ ID NO: 1129612 - protein, 26 aa, Mycobacterium
WASFGLRIALVPLFIVEVLGQSPGAA

SEQ ID NO: 1129613 - protein, 18 aa, Mycobacterium
WATLIALGIGDVVAIDFM

SEQ ID NO: 1129614 - protein, 17 aa, Mycobacterium
WATLYLRDSLGAPGAVA

SEQ ID NO: 1129615 - protein, 21 aa, Mycobacterium
WATSVGSWFPLAFFAAHVVVT

SEQ ID NO: 1129616 - protein, 17 aa, Mycobacterium
WAVGLQRSDRAVLEHGV

SEQ ID NO: 1129617 - protein, 17 aa, Mycobacterium
WAVVAVVALVFWILASR

SEQ ID NO: 1129618 - protein, 19 aa, Mycobacterium
WAVVWLAGWGPNSVHSLIG

SEQ ID NO: 1129619 - protein, 21 aa, Mycobacterium
WAWLSCVPLAMAVTALSGLIL

SEQ ID NO: 1129620 - protein, 18 aa, Mycobacterium
WCDANRLGVNDCFAKFVS

SEQ ID NO: 1129621 - protein, 19 aa, Mycobacterium
WDDIDGLRFGRTAWAVAQR

SEQ ID NO: 1129622 - protein, 21 aa, Mycobacterium
WDELPDGAKIALRDDPAGQAI

SEQ ID NO: 1129623 - protein, 19 aa, Mycobacterium
WDGGLGIWGAVALGGVGAW

SEQ ID NO: 1129624 - protein, 24 aa, Mycobacterium
WDGLPSDRPFFLFGNPPSGVDVPV

SEQ ID NO: 1129625 - protein, 26 aa, Mycobacterium
WDSASCKAWLLAQPFLMSAVLLGIFA

SEQ ID NO: 1129626 - protein, 17 aa, Mycobacterium
WDSGRYAATDVEDPDYE

SEQ ID NO: 1129627 - protein, 23 aa, Mycobacterium
WDSSVRWYAYFNPIFAVSLAILL

SEQ ID NO: 1129628 - protein, 18 aa, Mycobacterium
WDVLSIGGSIVFVAWIVR

SEQ ID NO: 1129629 - protein, 21 aa, Mycobacterium
WDYLDSWPKAVAVGLAAMFVL

SEQ ID NO: 1129630 - protein, 19 aa, Mycobacterium
WEAPILVVAVVWLAFELAL

SEQ ID NO: 1129631 - protein, 24 aa, Mycobacterium
WEGVDSRLGRRVAIKVLKAEYSTD

SEQ ID NO: 1129632 - protein, 18 aa, Mycobacterium
WELLARPRVLELFVNTVG

SEQ ID NO: 1129633 - protein, 18 aa, Mycobacterium
WEPGWAGLQALRDKTLDV

SEQ ID NO: 1129634 - protein, 25 aa, Mycobacterium
WERRTEWPLAAMAVVFLAAYTVDVL

SEQ ID NO: 1129635 - protein, 27 aa, Mycobacterium
WEWAMGNAWALAAVMSFVAGFTALNGV

SEQ ID NO: 1129636 - protein, 24 aa, Mycobacterium
WFAKRWGAGRSLMIGMLILAVSFV

SEQ ID NO: 1129637 - protein, 24 aa, Mycobacterium
WFGDRWSAIFVICLSEIWKTTPFI

SEQ ID NO: 1129638 - protein, 24 aa, Mycobacterium
WFGGVLRPLFGPGIREIAVSGNRP

SEQ ID NO: 1129639 - protein, 34 aa, Mycobacterium
WFIAAPVLGWAVWRAFVKRDWRYAVVLVGYSAGF

SEQ ID NO: 1129640 - protein, 24 aa, Mycobacterium
WFTAILAFAVFGWVLTRNSTTVAG

SEQ ID NO: 1129641 - protein, 24 aa, Mycobacterium
WFVARVSLVPTLMLSIPFTVLTVF

SEQ ID NO: 1129642 - protein, 24 aa, Mycobacterium
WFVARVSVLPALMLTMPYSVLLVF

SEQ ID NO: 1129643 - protein, 18 aa, Mycobacterium
WFVFAAICTYVIGFRFYA

SEQ ID NO: 1129644 - protein, 25 aa, Mycobacterium
WGAAGSLLRLLALGLVMVPIIAAVM

SEQ ID NO: 1129645 - protein, 17 aa, Mycobacterium
WGDARVGAALLVALASH

SEQ ID NO: 1129646 - protein, 20 aa, Mycobacterium
WGEFIPGWIDNGGVNPQPIF

SEQ ID NO: 1129647 - protein, 24 aa, Mycobacterium
WGLAAAVCAACYFLMSDKAGAEST

SEQ ID NO: 1129648 - protein, 24 aa, Mycobacterium
WGLITALFIEQGWLQGIFAELKNP

SEQ ID NO: 1129649 - protein, 17 aa, Mycobacterium
WGLLELFPGSLARSDRF

SEQ ID NO: 1129650 - protein, 19 aa, Mycobacterium
WGLLRRLRHDVDFKVWVPL

SEQ ID NO: 1129651 - protein, 25 aa, Mycobacterium
WGNMYEFINLTSFCGLVAAAWVLRR

SEQ ID NO: 1129652 - protein, 19 aa, Mycobacterium
WGPLLSAVAYQVFTNLVGW

SEQ ID NO: 1129653 - protein, 22 aa, Mycobacterium
WGRLTIPALILIIASAAAAFLA

SEQ ID NO: 1129654 - protein, 22 aa, Mycobacterium
WGRVLIFGALPGLALVLTLVAG

SEQ ID NO: 1129655 - protein, 22 aa, Mycobacterium
WGTAGLLGFAAFWIFLSANSSA

SEQ ID NO: 1129656 - protein, 32 aa, Mycobacterium
WHFMEVRNSPGWLRAVMHLWLAALFALLLGVY

SEQ ID NO: 1129657 - protein, 18 aa, Mycobacterium
WHGVNLPLLLSVLVLAAG

SEQ ID NO: 1129658 - protein, 23 aa, Mycobacterium
WHSRLAAVLVFVMVVSFERRNPF

SEQ ID NO: 1129659 - protein, 18 aa, Mycobacterium
WIGDRIGRRRVYCASMIG

SEQ ID NO: 1129660 - protein, 19 aa, Mycobacterium
WILAAVCFIVIWRRHGAPW

SEQ ID NO: 1129661 - protein, 22 aa, Mycobacterium
WIPAFVAVVVVDWWRRAEGRPT

SEQ ID NO: 1129662 - protein, 20 aa, Mycobacterium
WIRHLTARVAHRVADSPATA

SEQ ID NO: 1129663 - protein, 18 aa, Mycobacterium
WITGQGFADSGLRLNWRS

SEQ ID NO: 1129664 - protein, 26 aa, Mycobacterium
WITVIWRPDGAHGMYSWGHVLLSLSC

SEQ ID NO: 1129665 - protein, 18 aa, Mycobacterium
WIVGRFGGYEGVVEAVEL

SEQ ID NO: 1129666 - protein, 21 aa, Mycobacterium
WKGGEALPVPVQRAMSVTWQD

SEQ ID NO: 1129667 - protein, 17 aa, Mycobacterium
WKRAKSVGLAIANFAIA

SEQ ID NO: 1129668 - protein, 19 aa, Mycobacterium
WKRFDLSRRGWLRGKSVKW

SEQ ID NO: 1129669 - protein, 17 aa, Mycobacterium
WKTQPLFQVSAPMTKGM

SEQ ID NO: 1129670 - protein, 17 aa, Mycobacterium
WLAAGVGGGLTFAAVSN

SEQ ID NO: 1129671 - protein, 17 aa, Mycobacterium
WLAGRLRTPEVVATPLP

SEQ ID NO: 1129672 - protein, 18 aa, Mycobacterium
WLAGRLRTPEVVATPLPG

SEQ ID NO: 1129673 - protein, 21 aa, Mycobacterium
WLAHVWWKVPPDFGEARRTGL

SEQ ID NO: 1129674 - protein, 17 aa, Mycobacterium
WLAQRRKTPAAVPVATD

SEQ ID NO: 1129675 - protein, 17 aa, Mycobacterium
WLASRQGAGTWVADVTT

SEQ ID NO: 1129676 - protein, 20 aa, Mycobacterium
WLATVLLCMVFKPGDDIVFG

SEQ ID NO: 1129677 - protein, 18 aa, Mycobacterium
WLATVVKMDGRRIDQLRL

SEQ ID NO: 1129678 - protein, 18 aa, Mycobacterium
WLEERSTPYVGITVAWVA

SEQ ID NO: 1129679 - protein, 22 aa, Mycobacterium
WLEVLPGLVAVFGGLLLFVSRN

SEQ ID NO: 1129680 - protein, 22 aa, Mycobacterium
WLGDECWWAPQWMKRIQQRIGL

SEQ ID NO: 1129681 - protein, 27 aa, Mycobacterium
WLGFEGGLSWPAKIGLALSVGLLGGVG

SEQ ID NO: 1129682 - protein, 18 aa, Mycobacterium
WLGSPFKTGQQISDVVLG

SEQ ID NO: 1129683 - protein, 18 aa, Mycobacterium
WLGSPPVRLRRKPTAADA

SEQ ID NO: 1129684 - protein, 18 aa, Mycobacterium
WLGSPPVRLRRRPTAADA

SEQ ID NO: 1129685 - protein, 24 aa, Mycobacterium
WLHRPIVVWWLFWVASTTVTTFAF

SEQ ID NO: 1129686 - protein, 21 aa, Mycobacterium
WLIALCAFDIRQRRLPNMLTV

SEQ ID NO: 1129687 - protein, 18 aa, Mycobacterium
WLIGCLALLFATSSGLGM

SEQ ID NO: 1129688 - protein, 26 aa, Mycobacterium
WLITGLRLSIGIALIGAVIAELIAAS

SEQ ID NO: 1129689 - protein, 17 aa, Mycobacterium
WLITRAWQMPPVLDLSV

SEQ ID NO: 1129690 - protein, 17 aa, Mycobacterium
WLLDGRGSREWLAGVAI

SEQ ID NO: 1129691 - protein, 25 aa, Mycobacterium
WLLFAVLRGRLHPVGGLGVALGATL

SEQ ID NO: 1129692 - protein, 18 aa, Mycobacterium
WLLGVAIAVVVVLFASWR

SEQ ID NO: 1129693 - protein, 19 aa, Mycobacterium
WLLTGVLLWSLLRTVTRSQ

SEQ ID NO: 1129694 - protein, 24 aa, Mycobacterium
WLPDIPRMGFSSVLWVGPPNASPL

SEQ ID NO: 1129695 - protein, 24 aa, Mycobacterium
WLPFYHDMGLLLGVFAPILAGWPT

SEQ ID NO: 1129696 - protein, 18 aa, Mycobacterium
WLPSAADAAKVPRDDLTL

SEQ ID NO: 1129697 - protein, 26 aa, Mycobacterium
WLQAAGMVAAFIPAMAIVGALVPVHR

SEQ ID NO: 1129698 - protein, 17 aa, Mycobacterium
WLQGAALTAMFLPAMAI

SEQ ID NO: 1129699 - protein, 17 aa, Mycobacterium
WLRDNALQMTNSIAESR

SEQ ID NO: 1129700 - protein, 17 aa, Mycobacterium
WLRDNALQMTNTIAESR

SEQ ID NO: 1129701 - protein, 19 aa, Mycobacterium
WLRRARPEVYAEIGRTVME

SEQ ID NO: 1129702 - protein, 25 aa, Mycobacterium
WLSSELMFFAGLFAMYFTARAQAHG

SEQ ID NO: 1129703 - protein, 19 aa, Mycobacterium
WLSSIAWDALVGLFGGEAL

SEQ ID NO: 1129704 - protein, 20 aa, Mycobacterium
WLVFGGLWLALGYLLAAIIC

SEQ ID NO: 1129705 - protein, 18 aa, Mycobacterium
WLVVVGVSCFSLVVSVLV

SEQ ID NO: 1129706 - protein, 20 aa, Mycobacterium
WLVVVPLTFATALVLGAVVA

SEQ ID NO: 1129707 - protein, 18 aa, Mycobacterium
WMGDPAISSKGFEWDTAC

SEQ ID NO: 1129708 - protein, 27 aa, Mycobacterium
WMGRPSGPVHTGWGALSIQGLMKAASD

SEQ ID NO: 1129709 - protein, 25 aa, Mycobacterium
WMIARVSLVPTLLVAIPFTVLVAFT

SEQ ID NO: 1129710 - protein, 18 aa, Mycobacterium
WMLILGLAMSGITSYVTL

SEQ ID NO: 1129711 - protein, 32 aa, Mycobacterium
WMRLPDLVCALVCWLLLSREVLPRLGPAVSGS

SEQ ID NO: 1129712 - protein, 17 aa, Mycobacterium
WMVFFAFSVSLIYQFWI

SEQ ID NO: 1129713 - protein, 17 aa, Mycobacterium
WMVGLTVAFGILALLWF

SEQ ID NO: 1129714 - protein, 17 aa, Mycobacterium
WNGPAWSISAEWLAYLL

SEQ ID NO: 1129715 - protein, 53 aa, Mycobacterium
WNLLVFAVLILVDRRFKIGHGRLFALYVAGYCVGRFWIELMRSDTATLLAGIR

SEQ ID NO: 1129716 - protein, 25 aa, Mycobacterium
WNLPVWVLFLAWASFFFVGSGMPGL

SEQ ID NO: 1129717 - protein, 28 aa, Mycobacterium
WNNGGPASIAWGWPIVAVFILLIGLCMS

SEQ ID NO: 1129718 - protein, 17 aa, Mycobacterium
WNRYWRRHSARQVVTTG

SEQ ID NO: 1129719 - protein, 27 aa, Mycobacterium
WNSVAVAVVRRPVPLLIVSLVILLALS

SEQ ID NO: 1129720 - protein, 17 aa, Mycobacterium
WPADLKVGPDGLGNSPE

SEQ ID NO: 1129721 - protein, 20 aa, Mycobacterium
WPAGTFDYWQAWVFLAVFIV

SEQ ID NO: 1129722 - protein, 30 aa, Mycobacterium
WPAPAGRPRRAGVSSFGFGGTNAHVVIEQA

SEQ ID NO: 1129723 - protein, 17 aa, Mycobacterium
WPARWAQRVGHEKPDVV

SEQ ID NO: 1129724 - protein, 20 aa, Mycobacterium
WPFYALVDMRSQAYLTAAMV

SEQ ID NO: 1129725 - protein, 17 aa, Mycobacterium
WPILGAGVGVLAHALPI

SEQ ID NO: 1129726 - protein, 17 aa, Mycobacterium
WPILLVGLFLVAAFILV

SEQ ID NO: 1129727 - protein, 17 aa, Mycobacterium
WPKESRPYIGGSQTNSI

SEQ ID NO: 1129728 - protein, 18 aa, Mycobacterium
WPLADRPRLAAGAPGGTT

SEQ ID NO: 1129729 - protein, 22 aa, Mycobacterium
WPLEGSIYQWSRRLLGSTYGWF

SEQ ID NO: 1129730 - protein, 21 aa, Mycobacterium
WPLWDRRRRTFADLLAGTEVY

SEQ ID NO: 1129731 - protein, 17 aa, Mycobacterium
WPRRPGIVQAHHGGISR

SEQ ID NO: 1129732 - protein, 23 aa, Mycobacterium
WPRSARAFWLMTRRFRPRDYTFD

SEQ ID NO: 1129733 - protein, 19 aa, Mycobacterium
WPRVIGCAVTALVAAAIGA

SEQ ID NO: 1129734 - protein, 17 aa, Mycobacterium
WPSIVVVVVTALCLILR

SEQ ID NO: 1129735 - protein, 34 aa, Mycobacterium
WPVAGIAVGLGIRFPRRHVWAPAAAVAAITLPLL

SEQ ID NO: 1129736 - protein, 19 aa, Mycobacterium
WQAGLAFTRESLKSVGRLL

SEQ ID NO: 1129737 - protein, 17 aa, Mycobacterium
WQEVQTIVSPAWYSPLV

SEQ ID NO: 1129738 - protein, 20 aa, Mycobacterium
WQFSGSTGRSSELGAVGEWR

SEQ ID NO: 1129739 - protein, 19 aa, Mycobacterium
WQIAKSVLIFLGIPLAAGY

SEQ ID NO: 1129740 - protein, 19 aa, Mycobacterium
WQIAKSVLIFLGIPLLAGY

SEQ ID NO: 1129741 - protein, 23 aa, Mycobacterium
WQTRYLPVFGVWAAVALVVIPPA

SEQ ID NO: 1129742 - protein, 19 aa, Mycobacterium
WQVVAAVLVATVFGLAWTQ

SEQ ID NO: 1129743 - protein, 18 aa, Mycobacterium
WRAPDAIAAVLGFVVTGS

SEQ ID NO: 1129744 - protein, 20 aa, Mycobacterium
WRDIDAFQFFYLVLPLIRGA

SEQ ID NO: 1129745 - protein, 20 aa, Mycobacterium
WRDIDAFQFFYLVLPLLRGA

SEQ ID NO: 1129746 - protein, 25 aa, Mycobacterium
WREGWPSQRQSAGFVVAAALAIGVG

SEQ ID NO: 1129747 - protein, 18 aa, Mycobacterium
WRHPECRGELTDARAARR

SEQ ID NO: 1129748 - protein, 18 aa, Mycobacterium
WRLMGVIFATIFFLMFTP

SEQ ID NO: 1129749 - protein, 18 aa, Mycobacterium
WRLWAKYKASTELAGGAW

SEQ ID NO: 1129750 - protein, 19 aa, Mycobacterium
WRPFTIAGLGIGVFGTSIF

SEQ ID NO: 1129751 - protein, 18 aa, Mycobacterium
WRPILQIIGLVVVHNVGF

SEQ ID NO: 1129752 - protein, 27 aa, Mycobacterium
WRPRKIGVLRIDPLLARKHREHHVEPR

SEQ ID NO: 1129753 - protein, 21 aa, Mycobacterium
WRPTLLLTRSFITDYVRNPVN

SEQ ID NO: 1129754 - protein, 20 aa, Mycobacterium
WRPVGFGASVLRQAVHLLDA

SEQ ID NO: 1129755 - protein, 20 aa, Mycobacterium
WRQIIQVIGLFIVFNIGYYV

SEQ ID NO: 1129756 - protein, 24 aa, Mycobacterium
WRQLVGGSYLWWALAVIVVSATVT

SEQ ID NO: 1129757 - protein, 23 aa, Mycobacterium
WRQPDHYYWLTAFLAARGAQRGI

SEQ ID NO: 1129758 - protein, 24 aa, Mycobacterium
WRRQLGSLFSPGAVERLESTVRQR

SEQ ID NO: 1129759 - protein, 25 aa, Mycobacterium
WRRVGLPVLFPFLLSGWVLTFAWSL

SEQ ID NO: 1129760 - protein, 22 aa, Mycobacterium
WRSAARKCLVLIAVWCGGSAVL

SEQ ID NO: 1129761 - protein, 17 aa, Mycobacterium
WRSAYLVLAVVMAVITI

SEQ ID NO: 1129762 - protein, 18 aa, Mycobacterium
WRSQVPTIAAVTLAAVVV

SEQ ID NO: 1129763 - protein, 19 aa, Mycobacterium
WRSRMAGLQTMALVSTGSA

SEQ ID NO: 1129764 - protein, 32 aa, Mycobacterium
WRTRRWRLVWIPWAVVVGGAFAVAAYEFVASE

SEQ ID NO: 1129765 - protein, 17 aa, Mycobacterium
WRTVGLLVGLFVMLIVL

SEQ ID NO: 1129766 - protein, 26 aa, Mycobacterium
WRVLAPFRYREYRLLIAAVSLSIFAE

SEQ ID NO: 1129767 - protein, 18 aa, Mycobacterium
WRVLELHSASALIDQGQA

SEQ ID NO: 1129768 - protein, 20 aa, Mycobacterium
WRVTPGVAATGHFDAVHRVI

SEQ ID NO: 1129769 - protein, 17 aa, Mycobacterium
WRYHDGFHHGGQQWAPG

SEQ ID NO: 1129770 - protein, 17 aa, Mycobacterium
WSARADHTLTRMRIVPG

SEQ ID NO: 1129771 - protein, 28 aa, Mycobacterium
WSGVTAVAIPAWWQQYVLSVGSLAPDGT

SEQ ID NO: 1129772 - protein, 24 aa, Mycobacterium
WSLRNCLEYYFWFRSRLHFHADQR

SEQ ID NO: 1129773 - protein, 21 aa, Mycobacterium
WSMGGTCAVDLSVMHPELFST

SEQ ID NO: 1129774 - protein, 18 aa, Mycobacterium
WSNLDCAPSNETLVKTFA

SEQ ID NO: 1129775 - protein, 20 aa, Mycobacterium
WSPPGGRVGVGLTQIDALHA

SEQ ID NO: 1129776 - protein, 18 aa, Mycobacterium
WSTLVVGGAAWPTAVAVA

SEQ ID NO: 1129777 - protein, 18 aa, Mycobacterium
WSTRVRVALLVLAFAVAV

SEQ ID NO: 1129778 - protein, 17 aa, Mycobacterium
WSVGLFAAGLAFGSMTK

SEQ ID NO: 1129779 - protein, 17 aa, Mycobacterium
WSVGLLAAWAALGADSA

SEQ ID NO: 1129780 - protein, 19 aa, Mycobacterium
WSVLAVYYFALQWVTASLI

SEQ ID NO: 1129781 - protein, 18 aa, Mycobacterium
WSVYRLATRSQLWQFTAA

SEQ ID NO: 1129782 - protein, 20 aa, Mycobacterium
WSWVLDGMVEIGALSPEDRA

SEQ ID NO: 1129783 - protein, 22 aa, Mycobacterium
WTAAGLFLAFWLPLNNGLRPEP

SEQ ID NO: 1129784 - protein, 19 aa, Mycobacterium
WTALATWAVVVVWRTVTDG

SEQ ID NO: 1129785 - protein, 19 aa, Mycobacterium
WTERTDAWVGPRPVTDDGK

SEQ ID NO: 1129786 - protein, 20 aa, Mycobacterium
WTGDSVMVFDGSGLRYKYTV

SEQ ID NO: 1129787 - protein, 17 aa, Mycobacterium
WTGENGWRDEQFTDATI

SEQ ID NO: 1129788 - protein, 18 aa, Mycobacterium
WTIPLAVVHWWLGRRRAR

SEQ ID NO: 1129789 - protein, 18 aa, Mycobacterium
WTITAGKELSRWIGDARV

SEQ ID NO: 1129790 - protein, 18 aa, Mycobacterium
WTLPLLIRRLKLSADADQ

SEQ ID NO: 1129791 - protein, 17 aa, Mycobacterium
WTLPRLVGTAWASLNKQ

SEQ ID NO: 1129792 - protein, 21 aa, Mycobacterium
WTMIEEVPPPGVEPEARTFRP

SEQ ID NO: 1129793 - protein, 17 aa, Mycobacterium
WTQGRGWLEVLPGLVAV

SEQ ID NO: 1129794 - protein, 18 aa, Mycobacterium
WTVPGMAFLVLVAVGADY

SEQ ID NO: 1129795 - protein, 17 aa, Mycobacterium
WTVPWMMFLAVYAVQIV

SEQ ID NO: 1129796 - protein, 27 aa, Mycobacterium
WVAGTVVAVVPAVLWVLVALRSGRLGV

SEQ ID NO: 1129797 - protein, 25 aa, Mycobacterium
WVALRYSTTVSTVFLLVAAAWIIYS

SEQ ID NO: 1129798 - protein, 18 aa, Mycobacterium
WVARGGESGVIYDIALWA

SEQ ID NO: 1129799 - protein, 17 aa, Mycobacterium
WVATAIKEGQQWKISNL

SEQ ID NO: 1129800 - protein, 19 aa, Mycobacterium
WVATIAGLLGFVLAVSIPL

SEQ ID NO: 1129801 - protein, 30 aa, Mycobacterium
WVATTVIRMMSWRIAGAVDRAHDERQAAEI

SEQ ID NO: 1129802 - protein, 23 aa, Mycobacterium
WVIGSLLLILAMFEGFFGYSLPD

SEQ ID NO: 1129803 - protein, 19 aa, Mycobacterium
WVIPRPWYLAWAGLVYIVA

SEQ ID NO: 1129804 - protein, 28 aa, Mycobacterium
WVISLWPPLRWRNQRKALVAAYRSLAAD

SEQ ID NO: 1129805 - protein, 26 aa, Mycobacterium
WVKPIDWWWILGGFLLFVTPPGRMSI

SEQ ID NO: 1129806 - protein, 17 aa, Mycobacterium
WVKPRRELTARFWRRSG

SEQ ID NO: 1129807 - protein, 18 aa, Mycobacterium
WVLFKTKIGNWIFAVGGD

SEQ ID NO: 1129808 - protein, 26 aa, Mycobacterium
WVLLNLGAFAWQWDPYPFILLNLAFS

SEQ ID NO: 1129809 - protein, 18 aa, Mycobacterium
WVNNAWVTAQCIAMSVLL

SEQ ID NO: 1129810 - protein, 20 aa, Mycobacterium
WVRARQGPRLAELIRQPDTT

SEQ ID NO: 1129811 - protein, 19 aa, Mycobacterium
WVRGENVCLGYWGKPEQTE

SEQ ID NO: 1129812 - protein, 17 aa, Mycobacterium
WVRGRQGPNLADLIAQP

SEQ ID NO: 1129813 - protein, 25 aa, Mycobacterium
WVSPWAAVMLVHWFGVARRQVDAAT

SEQ ID NO: 1129814 - protein, 23 aa, Mycobacterium
WVTAQCIAMSVLLGIPIPYILFQ

SEQ ID NO: 1129815 - protein, 18 aa, Mycobacterium
WWAGVSIGLTLVVKPLLA

SEQ ID NO: 1129816 - protein, 19 aa, Mycobacterium
WWDILRKPSYLAIVAGAAS

SEQ ID NO: 1129817 - protein, 20 aa, Mycobacterium
WWFWIGFALVTLVVAGGVSY

SEQ ID NO: 1129818 - protein, 17 aa, Mycobacterium
WWLGGRLGLEDKLRALL

SEQ ID NO: 1129819 - protein, 19 aa, Mycobacterium
WWLNGRPGGRVGAIALVAT

SEQ ID NO: 1129820 - protein, 17 aa, Mycobacterium
WWLTWILFIPALFQVIF

SEQ ID NO: 1129821 - protein, 17 aa, Mycobacterium
WWPQRVRTRPVPAPWPR

SEQ ID NO: 1129822 - protein, 32 aa, Mycobacterium; identical to SEQ ID NO: 337557

SEQ ID NO: 1129823 - protein, 19 aa, Mycobacterium
WWREQYRVSDGLTAFVTTR

SEQ ID NO: 1129824 - protein, 20 aa, Mycobacterium
WWTAILLVVIVALMLLSAGL

SEQ ID NO: 1129825 - protein, 22 aa, Mycobacterium
WWTENLRYYYLVLPTTDGAIAR

SEQ ID NO: 1129826 - protein, 19 aa, Mycobacterium
WWVVLAGFVLFVSPVGRMG

SEQ ID NO: 1129827 - protein, 17 aa, Mycobacterium
WYARPGSTVLAVNFTPG

SEQ ID NO: 1129828 - protein, 18 aa, Mycobacterium
WYQLPAGWNDRKRSDSLL

SEQ ID NO: 1129829 - protein, 17 aa, Mycobacterium
YAAAAWAHAARIAGDPV

SEQ ID NO: 1129830 - protein, 18 aa, Mycobacterium
YAALSLPFLLLFRLTCYY

SEQ ID NO: 1129831 - protein, 28 aa, Mycobacterium
YAATIDSRWKWIAGVAGAVLLVAVICTL

SEQ ID NO: 1129832 - protein, 26 aa, Mycobacterium
YADQQRAALQWSHPEPAALVSIPGTR

SEQ ID NO: 1129833 - protein, 23 aa, Mycobacterium
YAGLMPALARLFLRRPGHVPDQM

SEQ ID NO: 1129834 - protein, 26 aa, Mycobacterium
YAGWDPDWFKFFLGAMLLFAVIANNA

SEQ ID NO: 1129835 - protein, 27 aa, Mycobacterium
YAIARYRAGGTLTRFGMLAAQVLPPAV

SEQ ID NO: 1129836 - protein, 19 aa, Mycobacterium
YALLVNRWPLPETGEPSGL

SEQ ID NO: 1129837 - protein, 20 aa, Mycobacterium
YALVRLRDAAEAVAFYRGEI

SEQ ID NO: 1129838 - protein, 23 aa, Mycobacterium
YAPEEIFLVLSVAGLAAYSMAPW

SEQ ID NO: 1129839 - protein, 18 aa, Mycobacterium
YAREALKPEVTFVDYTVT

SEQ ID NO: 1129840 - protein, 19 aa, Mycobacterium
YARHRADDVLVGIAECVVQ

SEQ ID NO: 1129841 - protein, 17 aa, Mycobacterium
YASDPPPALPTVMMIGG

SEQ ID NO: 1129842 - protein, 27 aa, Mycobacterium
YASLLRDPRFVVLVLVAALGMSGLFAY

SEQ ID NO: 1129843 - protein, 36 aa, Mycobacterium
YATDRGEAELAHLLAGWRDDVRETPMGHVMTAEDAA

SEQ ID NO: 1129844 - protein, 17 aa, Mycobacterium
YATEMVRRLVAAEAVDL

SEQ ID NO: 1129845 - protein, 26 aa, Mycobacterium
YAVCSSVLCWLRLFARRTPRPVARIR

SEQ ID NO: 1129846 - protein, 22 aa, Mycobacterium
YAWPYRRLLSVVAALQVISTLA

SEQ ID NO: 1129847 - protein, 25 aa, Mycobacterium
YAYGLRNPFRLTFTPTGQLLVADVG

SEQ ID NO: 1129848 - protein, 26 aa, Mycobacterium
YCCAAIPAALCALVIGVATPFGTVLA

SEQ ID NO: 1129849 - protein, 18 aa, Mycobacterium
YCIAVMMAFLAARTGTTV

SEQ ID NO: 1129850 - protein, 19 aa, Mycobacterium
YCVAVLMSFVAARVGTTAI

SEQ ID NO: 1129851 - protein, 28 aa, Mycobacterium
YCYGEGKAEAILALADREGYALEHCYAY

SEQ ID NO: 1129852 - protein, 17 aa, Mycobacterium
YCYGLSVVHSHLLVGAA

SEQ ID NO: 1129853 - protein, 18 aa, Mycobacterium
YDAYAATIDSRWKWIAGV

SEQ ID NO: 1129854 - protein, 22 aa, Mycobacterium
YDDARLVPRVGVASVIAEGFLV

SEQ ID NO: 1129855 - protein, 25 aa, Mycobacterium
YDFGCKRPTFSNSYYRTFTKPHVHL

SEQ ID NO: 1129856 - protein, 28 aa, Mycobacterium
YDSGEAELAYLLAGWRDEIRQPPMAGVV

SEQ ID NO: 1129857 - protein, 18 aa, Mycobacterium
YDTVKIFLLLTGLMFVVG

SEQ ID NO: 1129858 - protein, 20 aa, Mycobacterium
YEALLARRAFPQESPVALVR

SEQ ID NO: 1129859 - protein, 17 aa, Mycobacterium
YEGFGLPVLEAQILGCP

SEQ ID NO: 1129860 - protein, 23 aa, Mycobacterium
YELADTIARRLGLTGALGTVAES

SEQ ID NO: 1129861 - protein, 23 aa, Mycobacterium
YERDIRFIIIAALIVVLVTLSVL

SEQ ID NO: 1129862 - protein, 26 aa, Mycobacterium
YEVFLLARIREFWLAGGRRDNDESVA

SEQ ID NO: 1129863 - protein, 19 aa, Mycobacterium
YFAPQAWALVLGFGLLGLL

SEQ ID NO: 1129864 - protein, 23 aa, Mycobacterium
YFFAKGMWRKGLTLLGVVGAVVA

SEQ ID NO: 1129865 - protein, 24 aa, Mycobacterium
YFFGRGQIGLGMLLARYSSRLQSA

SEQ ID NO: 1129866 - protein, 17 aa, Mycobacterium
YFLLGIWMSLFWAVVFT

SEQ ID NO: 1129867 - protein, 19 aa, Mycobacterium
YFLPVCLIALIGGMSTGTT

SEQ ID NO: 1129868 - protein, 17 aa, Mycobacterium
YFNPGICGEGTDRPCPN

SEQ ID NO: 1129869 - protein, 21 aa, Mycobacterium
YFPIGDLRTAVSYPQPPGTYD

SEQ ID NO: 1129870 - protein, 25 aa, Mycobacterium
YFQSMGVPCAVGILAGVAVALTLGP

SEQ ID NO: 1129871 - protein, 24 aa, Mycobacterium
YFTPKLARRVLHQLYLGFPDSAAA

SEQ ID NO: 1129872 - protein, 19 aa, Mycobacterium
YGAFVPWGALARRIGELRS

SEQ ID NO: 1129873 - protein, 24 aa, Mycobacterium
YGAHPLHLLTLIAGFALFGYAIVT

SEQ ID NO: 1129874 - protein, 23 aa, Mycobacterium
YGAHSPGGWTLWAVLIAEIVLTF

SEQ ID NO: 1129875 - protein, 18 aa, Mycobacterium
YGAPAGWHAPGWPPQAGG

SEQ ID NO: 1129876 - protein, 17 aa, Mycobacterium
YGDAAGLGRAVLNLLDN

SEQ ID NO: 1129877 - protein, 34 aa, Mycobacterium
YGEPRRMSSFVHGLWIVGQCIIAVIFGAGLFVAF

SEQ ID NO: 1129878 - protein, 20 aa, Mycobacterium
YGHPFHPILVTVPIGAWASS

SEQ ID NO: 1129879 - protein, 17 aa, Mycobacterium
YGLAALAMTFGWVSLGA

SEQ ID NO: 1129880 - protein, 27 aa, Mycobacterium
YGLCAVLSGLFVWRWVMETKGVSLEDM

SEQ ID NO: 1129881 - protein, 20 aa, Mycobacterium
YGLCLKVVFDAAVSEHASHM

SEQ ID NO: 1129882 - protein, 22 aa, Mycobacterium
YGLRPAPFLLGLAFAALGLGLS

SEQ ID NO: 1129883 - protein, 26 aa, Mycobacterium
YGLVGILGVRIWLTNHVDFSKPINQM

SEQ ID NO: 1129884 - protein, 19 aa, Mycobacterium
YGPGMCGPGGPGMYGPGMQ

SEQ ID NO: 1129885 - protein, 18 aa, Mycobacterium
YGPVVALPVLGFGKVVAV

SEQ ID NO: 1129886 - protein, 20 aa, Mycobacterium
YGRADPAKFVELVRNGADLI

SEQ ID NO: 1129887 - protein, 18 aa, Mycobacterium
YGSEQAFADLMSRHVSCV

SEQ ID NO: 1129888 - protein, 19 aa, Mycobacterium
YGSLVVVFQWGWLADLGFK

SEQ ID NO: 1129889 - protein, 20 aa, Mycobacterium
YGVYRKGRLQLISSAFEPLI

SEQ ID NO: 1129890 - protein, 23 aa, Mycobacterium
YHGPHPDDLLSIIGTHRQWSRPA

SEQ ID NO: 1129891 - protein, 21 aa, Mycobacterium
YHPVRSRSGWQLWATERLMDA

SEQ ID NO: 1129892 - protein, 18 aa, Mycobacterium
YHVITDWQTYFGPDGAGL

SEQ ID NO: 1129893 - protein, 22 aa, Mycobacterium
YILFATVVAFVIGRPIITLSFN

SEQ ID NO: 1129894 - protein, 21 aa, Mycobacterium
YIRKLTPRAAMLGTLAGISIT

SEQ ID NO: 1129895 - protein, 17 aa, Mycobacterium
YIRLRLDDTPEFAALSE

SEQ ID NO: 1129896 - protein, 25 aa, Mycobacterium
YKMAVICLIGAMLFDEGRSDDMKLV

SEQ ID NO: 1129897 - protein, 17 aa, Mycobacterium
YKMTVVFNDGKEVPANL

SEQ ID NO: 1129898 - protein, 18 aa, Mycobacterium
YLAGALIAVMLSGGRALD

SEQ ID NO: 1129899 - protein, 17 aa, Mycobacterium
YLARAGFAASGVLHLLV

SEQ ID NO: 1129900 - protein, 19 aa, Mycobacterium
YLASTRLLAGMIVVIPLYC

SEQ ID NO: 1129901 - protein, 30 aa, Mycobacterium
YLDARPDPIFPRWVAHFNIAIAALLIPGAF

SEQ ID NO: 1129902 - protein, 19 aa, Mycobacterium
YLDLLFSRTMLIWLSAAIV

SEQ ID NO: 1129903 - protein, 36 aa, Mycobacterium
YLDRMGESWSTRSTLRFLWLRLARVWPVYLVTMHLA

SEQ ID NO: 1129904 - protein, 17 aa, Mycobacterium
YLFAFGRDGLLPRRLGA

SEQ ID NO: 1129905 - protein, 17 aa, Mycobacterium
YLFPHGTFFLAGDVLGV

SEQ ID NO: 1129906 - protein, 24 aa, Mycobacterium
YLGGWRVIRTLGKGLVEIESPQGL

SEQ ID NO: 1129907 - protein, 18 aa, Mycobacterium
YLGRRWASKLGAWNAAVA

SEQ ID NO: 1129908 - protein, 18 aa, Mycobacterium
YLGWWTAILLVVIVALML

SEQ ID NO: 1129909 - protein, 18 aa, Mycobacterium
YLHCLPVHIVKLDRSLAV

SEQ ID NO: 1129910 - protein, 30 aa, Mycobacterium
YLLLVVLCRRRWRPGLLLAGLAVLAAVSPA

SEQ ID NO: 1129911 - protein, 24 aa, Mycobacterium
YLLLYCIRALLILRTDPRSRQVAN

SEQ ID NO: 1129912 - protein, 19 aa, Mycobacterium
YLLMAVAAWLVWRTGPSPE

SEQ ID NO: 1129913 - protein, 31 aa, Mycobacterium
YLMIALPAGLLFLGFFRWVARQMVARAREKH

SEQ ID NO: 1129914 - protein, 18 aa, Mycobacterium
YLPPEAFQTADFQRGIKL

SEQ ID NO: 1129915 - protein, 18 aa, Mycobacterium
YLPTDGFTTLNVVSTIGA

SEQ ID NO: 1129916 - protein, 19 aa, Mycobacterium
YLREMVNAVLPQVIPSWIG

SEQ ID NO: 1129917 - protein, 19 aa, Mycobacterium
YLRRKHRFGAPALIVGSGP

SEQ ID NO: 1129918 - protein, 21 aa, Mycobacterium
YLRRKHRFGAPALIVGSGPIT

SEQ ID NO: 1129919 - protein, 19 aa, Mycobacterium
YLSQGVFAYICVAYLVSYA

SEQ ID NO: 1129920 - protein, 28 aa, Mycobacterium
YLTHPRWGRPLLVLGVLHTLALLATVTA

SEQ ID NO: 1129921 - protein, 25 aa, Mycobacterium
YLWAFELTGALLITAALGAMVLAHR

SEQ ID NO: 1129922 - protein, 18 aa, Mycobacterium
YMAIAALATLVFDLLVTA

SEQ ID NO: 1129923 - protein, 24 aa, Mycobacterium
YMITEFALRPVAAQALEAGRPPRR

SEQ ID NO: 1129924 - protein, 19 aa, Mycobacterium
YMMGACVIGAIALIKVPET

SEQ ID NO: 1129925 - protein, 18 aa, Mycobacterium
YMSNYFRWFGSPEDPFGW

SEQ ID NO: 1129926 - protein, 18 aa, Mycobacterium
YMVRRLRRTPARQPEPAA

SEQ ID NO: 1129927 - protein, 17 aa, Mycobacterium
YMYLGWLCGEREDTAAL

SEQ ID NO: 1129928 - protein, 18 aa, Mycobacterium
YNALYFPYVVGVRAYAQN

SEQ ID NO: 1129929 - protein, 17 aa, Mycobacterium
YNLGIVFILYATRQPEL

SEQ ID NO: 1129930 - protein, 17 aa, Mycobacterium
YPAAVSVPLAFATMLAV

SEQ ID NO: 1129931 - protein, 24 aa, Mycobacterium
YPADVPALGWFVMCCAAAALTVFA

SEQ ID NO: 1129932 - protein, 21 aa, Mycobacterium
YPARLVVPGLYGYVSATKWVT

SEQ ID NO: 1129933 - protein, 17 aa, Mycobacterium
YPDNLPIVGAKGGPGGK

SEQ ID NO: 1129934 - protein, 17 aa, Mycobacterium
YPGAPPYGAPQYAPDGT

SEQ ID NO: 1129935 - protein, 18 aa, Mycobacterium
YPGEAALADAIRNRDVYG

SEQ ID NO: 1129936 - protein, 19 aa, Mycobacterium
YPGRGMRPPLLGIDHILTK

SEQ ID NO: 1129937 - protein, 19 aa, Mycobacterium
YPLAAAISVVTLFVLVEIG

SEQ ID NO: 1129938 - protein, 22 aa, Mycobacterium
YPLMYGIGWLYVRLAEQGERDF

SEQ ID NO: 1129939 - protein, 17 aa, Mycobacterium
YPLRSGVPSSMRIDNPG

SEQ ID NO: 1129940 - protein, 18 aa, Mycobacterium
YPLWCGFATALSSRIWWL

SEQ ID NO: 1129941 - protein, 19 aa, Mycobacterium
YPRGVFTAMGLRFAENIMY

SEQ ID NO: 1129942 - protein, 21 aa, Mycobacterium
YPSGYLRQMIYPFTRGGGCTL

SEQ ID NO: 1129943 - protein, 17 aa, Mycobacterium
YPSQVFLTLFGLPLEDR

SEQ ID NO: 1129944 - protein, 18 aa, Mycobacterium
YPTLIAMGILTTVWMGIA

SEQ ID NO: 1129945 - protein, 18 aa, Mycobacterium
YPYREPLPAPAPGGPPPG

SEQ ID NO: 1129946 - protein, 24 aa, Mycobacterium
YPYREPRPAPSPGGPPPGPPAGTT

SEQ ID NO: 1129947 - protein, 18 aa, Mycobacterium
YQARRMVWEAEIRDSEAA

SEQ ID NO: 1129948 - protein, 20 aa, Mycobacterium
YQGIRLRDGAALQLDDVRPM

SEQ ID NO: 1129949 - protein, 25 aa, Mycobacterium
YQLGLDLYSVWGLVVTYIYFILPLY

SEQ ID NO: 1129950 - protein, 25 aa, Mycobacterium
YQLNLPRLWSGFQIIGDGSGEYDYA

SEQ ID NO: 1129951 - protein, 25 aa, Mycobacterium
YQRAEALAAEVARTFREAGLDAVRM

SEQ ID NO: 1129952 - protein, 18 aa, Mycobacterium
YQYYAREALKPEVTFVDY

SEQ ID NO: 1129953 - protein, 21 aa, Mycobacterium
YRAFGGLGPELARIVEGSTRL

SEQ ID NO: 1129954 - protein, 17 aa, Mycobacterium
YRDGYGEVFLLIDNLYA

SEQ ID NO: 1129955 - protein, 18 aa, Mycobacterium
YRDRKVIWVLGGDAAANG

SEQ ID NO: 1129956 - protein, 18 aa, Mycobacterium
YREQIFRSFGYAFAATVL

SEQ ID NO: 1129957 - protein, 28 aa, Mycobacterium
YRERLTVPLWWWLPGLGVAALIALEINQ

SEQ ID NO: 1129958 - protein, 24 aa, Mycobacterium
YRFRARTIAVMAVLLLASAVAAFT

SEQ ID NO: 1129959 - protein, 25 aa, Mycobacterium
YRGALSIDLGKFFTYTGVFLILVAA

SEQ ID NO: 1129960 - protein, 20 aa, Mycobacterium
YRGGWLDTVLMRIVDVMFAF

SEQ ID NO: 1129961 - protein, 22 aa, Mycobacterium
YRGQTWPGFELEQTVVVHNETD

SEQ ID NO: 1129962 - protein, 25 aa, Mycobacterium
YRGWLHRMMLYFGWNVSVSQTINPL

SEQ ID NO: 1129963 - protein, 22 aa, Mycobacterium
YRKETIRLIAEMTMGAGALVMI

SEQ ID NO: 1129964 - protein, 25 aa, Mycobacterium
YRKETIRLIAEMTMGAGALVMIGGT

SEQ ID NO: 1129965 - protein, 26 aa, Mycobacterium
YRKETIRLIAEMTMGAGALVMIGGTV

SEQ ID NO: 1129966 - protein, 21 aa, Mycobacterium
YRKLVRLGSYGSWLNLYICGV

SEQ ID NO: 1129967 - protein, 17 aa, Mycobacterium
YRLATRSQLWQFTAADF

SEQ ID NO: 1129968 - protein, 19 aa, Mycobacterium
YRLFSAFMFQHLTLSILVP

SEQ ID NO: 1129969 - protein, 25 aa, Mycobacterium
YRLSRRGSPWSTRRTVSWVIGCLAL

SEQ ID NO: 1129970 - protein, 19 aa, Mycobacterium
YRPELGVLYPSELEDGMRI

SEQ ID NO: 1129971 - protein, 19 aa, Mycobacterium
YRPGLDLVRQGGVDDPAGG

SEQ ID NO: 1129972 - protein, 22 aa, Mycobacterium
YRPLRKRNARSLTFLITAIGMS

SEQ ID NO: 1129973 - protein, 23 aa, Mycobacterium
YRQWKGGGGWTAWQGAGWFLLLL

SEQ ID NO: 1129974 - protein, 20 aa, Mycobacterium
YRREMLRLIAEIGMGTGAMA

SEQ ID NO: 1129975 - protein, 25 aa, Mycobacterium
YRTELLRLIAQMGLGSGALVVVGGT

SEQ ID NO: 1129976 - protein, 20 aa, Mycobacterium
YRTEVVRLIAQMSLGVGALA

SEQ ID NO: 1129977 - protein, 27 aa, Mycobacterium
YRVCASVLCWLTLTLVHRGRPSAPRRH

SEQ ID NO: 1129978 - protein, 17 aa, Mycobacterium
YRVEPDAAFGGWLMPVV

SEQ ID NO: 1129979 - protein, 22 aa, Mycobacterium
YRVTVELPESAGLLPNQNVTMR

SEQ ID NO: 1129980 - protein, 17 aa, Mycobacterium
YRYPDNLPIVGAKGGPG

SEQ ID NO: 1129981 - protein, 17 aa, Mycobacterium
YSDMNAMFYIPGRSKYT

SEQ ID NO: 1129982 - protein, 17 aa, Mycobacterium
YSIARVITGSSFETLPV

SEQ ID NO: 1129983 - protein, 21 aa, Mycobacterium
YSLACTLFRLLTGEHPYPTDA

SEQ ID NO: 1129984 - protein, 18 aa, Mycobacterium
YSLFILMRFREELRAGRE

SEQ ID NO: 1129985 - protein, 26 aa, Mycobacterium
YSLLYYRLLGVLIALSLVASGAMVFA

SEQ ID NO: 1129986 - protein, 21 aa, Mycobacterium
YSLPMRRLLGFVAAAVDASVI

SEQ ID NO: 1129987 - protein, 22 aa, Mycobacterium
YSNGWANIRAFAGGCGLADDVL

SEQ ID NO: 1129988 - protein, 17 aa, Mycobacterium
YSPRLLRTFAADQVVQR

SEQ ID NO: 1129989 - protein, 20 aa, Mycobacterium
YSVAVILSFLASRYTTVVLL

SEQ ID NO: 1129990 - protein, 17 aa, Mycobacterium
YTCRAEHATESEVLERQ

SEQ ID NO: 1129991 - protein, 24 aa, Mycobacterium
YTFTGTAVGFVFLWLSLTPSLLPR

SEQ ID NO: 1129992 - protein, 21 aa, Mycobacterium
YTKVCSHLGCPSSLYEQQTYR

SEQ ID NO: 1129993 - protein, 23 aa, Mycobacterium
YTLRIMTWASLTLLPLVLAYQAW

SEQ ID NO: 1129994 - protein, 20 aa, Mycobacterium
YTSVGFICYTIGTGSGLQFY

SEQ ID NO: 1129995 - protein, 17 aa, Mycobacterium
YTTRPGSALLFPTLCTP

SEQ ID NO: 1129996 - protein, 22 aa, Mycobacterium
YVAEPLIGRGLEILLGGAGIPT

SEQ ID NO: 1129997 - protein, 24 aa, Mycobacterium
YVALRMPVAVMRRFAFAGFAFSVV

SEQ ID NO: 1129998 - protein, 20 aa, Mycobacterium
YVARDAWTSLAMGLVSVGTM

SEQ ID NO: 1129999 - protein, 22 aa, Mycobacterium
YVARPVGGIVFGHFGDRIGRKS

SEQ ID NO: 1130000 - protein, 18 aa, Mycobacterium
YVDLLWPLLLMGSGLGLC

SEQ ID NO: 1130001 - protein, 18 aa, Mycobacterium
YVELPATLCIPLLLAAFS

SEQ ID NO: 1130002 - protein, 25 aa, Mycobacterium
YVKLSRPVARGALKLGLSPDSVTIL

SEQ ID NO: 1130003 - protein, 19 aa, Mycobacterium
YVKRFPMLKPLDMSDAVCR

SEQ ID NO: 1130004 - protein, 24 aa, Mycobacterium
YVMSRGEPFWTISGGLAGVIAIAA

SEQ ID NO: 1130005 - protein, 21 aa, Mycobacterium
YVSAIGIGVLFFQFILGQELS

SEQ ID NO: 1130006 - protein, 23 aa, Mycobacterium
YVSLMLACWLWSGGGGVAMSDVD

SEQ ID NO: 1130007 - protein, 17 aa, Mycobacterium
YVTGGWEPGWAGLQALR

SEQ ID NO: 1130008 - protein, 17 aa, Mycobacterium
YVVLTSFAGTAALAFVA

SEQ ID NO: 1130009 - protein, 20 aa, Mycobacterium
YVVTCFVFFLIGGIMALFIR

SEQ ID NO: 1130010 - protein, 32 aa, Mycobacterium
YVYGRERLGPFWGHAAGWSFIVGKTASCAAMA

SEQ ID NO: 1130011 - protein, 27 aa, Mycobacterium
YWARQRSRRVLFFWVVAVITLAALAAA

SEQ ID NO: 1130012 - protein, 23 aa, Mycobacterium
YWLMLCGMLIYLLLYCIRALLIL

SEQ ID NO: 1130013 - protein, 18 aa, Mycobacterium
YWMSAWVGNVAYLVLLFS

SEQ ID NO: 1130014 - protein, 29 aa, Mycobacterium
YWNSVAVAVVRRPVPLLIVSLVILLALSA

SEQ ID NO: 1130015 - protein, 18 aa, Mycobacterium
YWPGLLVAVCQVVVMYAV

SEQ ID NO: 1130016 - protein, 20 aa, Mycobacterium
YWTRARRILPVAAVVLAATY

SEQ ID NO: 1130017 - protein, 23 aa, Mycobacterium
YWVAGFCGAALFAAGLLAHELAH

SEQ ID NO: 1130018 - protein, 18 aa, Mycobacterium
YYLAAKIPLQQQIFAPPA

SEQ ID NO: 1130019 - protein, 18 aa, Mycobacterium
YYLVAGWVATTVIRMMSW

SEQ ID NO: 1130020 - protein, 20 aa, Mycobacterium
YYSAPWMLILGLAMSGITSY

SEQ ID NO: 1130021 - protein, 24 aa, Mycobacterium
YYSTWCTYNAWLFNQGSWAPHIPG

SEQ ID NO: 1130022 - protein, 26 aa, Mycobacterium
YYYMAETNLRFLLGRAATIEVPLIRG

SEQ ID NO: 1130023 - protein, 18 aa, Mycobacterium
LVAIPFTVLVSFTLNILL

SEQ ID NO: 1130024 - protein, 18 aa, Mycobacterium
FTVLVSFTLNILLRELGA

SEQ ID NO: 1130025 - protein, 19 aa, Mycobacterium
AGHLCSWAKFSPGIQSSAG

SEQ ID NO: 1130026 - protein, 17 aa, Mycobacterium
GKLHFWLTFIGFHTTFL

SEQ ID NO: 1130027 - protein, 20 aa, Mycobacterium
VLLFCIAFGLSMDYEVFLMS

SEQ ID NO: 1130028 - protein, 24 aa, Mycobacterium
ACGLAALCYAEFASTVPVAGSAYT

SEQ ID NO: 1130029 - protein, 19 aa, Mycobacterium
ASVALELLTGPSLLILDEP

SEQ ID NO: 1130030 - protein, 19 aa, Mycobacterium
ASVLPVWLLLAPRDYLSTF

SEQ ID NO: 1130031 - protein, 17 aa, Mycobacterium
ATMIAVLGVGLFYVFVS

SEQ ID NO: 1130032 - protein, 18 aa, Mycobacterium
AVGGEWGGAVLLVAEHSP

SEQ ID NO: 1130033 - protein, 17 aa, Mycobacterium
AVVLFRIVGGIGVGVAS

SEQ ID NO: 1130034 - protein, 20 aa, Mycobacterium
CLSFTRLPYFQTLGVPLAIG

SEQ ID NO: 1130035 - protein, 23 aa, Mycobacterium
DDLRFAVAGIARFSETLNQRDAQ

SEQ ID NO: 1130036 - protein, 18 aa, Mycobacterium
EGRSFRSAVPRGWARARK

SEQ ID NO: 1130037 - protein, 18 aa, Mycobacterium
ESEFPGELGVLFKNLETK

SEQ ID NO: 1130038 - protein, 19 aa, Mycobacterium
FKGGSTFLGMEKLPHTAAV

SEQ ID NO: 1130039 - protein, 18 aa, Mycobacterium
FLIWMAIGVVVYFLYGRR

SEQ ID NO: 1130040 - protein, 18 aa, Mycobacterium
FPGELGVLFKNLETKGNP

SEQ ID NO: 1130041 - protein, 17 aa, Mycobacterium
FVDDVAFVVGKESRDRL

SEQ ID NO: 1130042 - protein, 20 aa, Mycobacterium
GFAHEVWAVVLFRIVGGIGV

SEQ ID NO: 1130043 - protein, 17 aa, Mycobacterium
GLGCGFGPLNNRFFPPM

SEQ ID NO: 1130044 - protein, 19 aa, Mycobacterium
GLTWIRFLIWMAIGVVVYF

SEQ ID NO: 1130045 - protein, 18 aa, Mycobacterium
GRSLPFLILMAAIIPVTR

SEQ ID NO: 1130046 - protein, 17 aa, Mycobacterium
GVIPVIFASSLIYIPHL

SEQ ID NO: 1130047 - protein, 18 aa, Mycobacterium
IIPNLTLIVVLGFGAYAA

SEQ ID NO: 1130048 - protein, 17 aa, Mycobacterium
IKFFNWIGTMWKGQLTF

SEQ ID NO: 1130049 - protein, 20 aa, Mycobacterium
KRAPFALGVAALLFGFPIFF

SEQ ID NO: 1130050 - protein, 22 aa, Mycobacterium
LGLMMCFDLGGPVNKAAYAFAT

SEQ ID NO: 1130051 - protein, 23 aa, Mycobacterium
LGPACAIAVLFGFLATVTLLPPV

SEQ ID NO: 1130052 - protein, 22 aa, Mycobacterium
LIGWASGLGFGWLFTLGTANVV

SEQ ID NO: 1130053 - protein, 18 aa, Mycobacterium
LSLTPSLLPRDWLFQGLI

SEQ ID NO: 1130054 - protein, 17 aa, Mycobacterium
LYGLYALLRLHFVQEEE

SEQ ID NO: 1130055 - protein, 24 aa, Mycobacterium
NGLRPEPIIALGILLTWCSVERGV

SEQ ID NO: 1130056 - protein, 28 aa, Mycobacterium
PVARLWRWLLVFFSRWWQLETLYRSNMK

SEQ ID NO: 1130057 - protein, 22 aa, Mycobacterium
PWYQEFLRYYFLTVEESVDGSL

SEQ ID NO: 1130058 - protein, 19 aa, Mycobacterium
RKLRVGFAKAGRLMDLMET

SEQ ID NO: 1130059 - protein, 20 aa, Mycobacterium
RRFGGSLLLYAFPAAGAFAA

SEQ ID NO: 1130060 - protein, 18 aa, Mycobacterium
RRMLCGLQLPGPNNQQLA

SEQ ID NO: 1130061 - protein, 17 aa, Mycobacterium
SAVPRGWARARKTIVSG

SEQ ID NO: 1130062 - protein, 18 aa, Mycobacterium
TVARRFGGSLLLYAFPAA

SEQ ID NO: 1130063 - protein, 19 aa, Mycobacterium
VAFGMSWGPVVWVLLGEMF

SEQ ID NO: 1130064 - protein, 17 aa, Mycobacterium
VIQGVAIGGEWGGATLM

SEQ ID NO: 1130065 - protein, 19 aa, Mycobacterium
AAALICFAVLVPPVGSRTS

SEQ ID NO: 1130066 - protein, 22 aa, Mycobacterium
AAARTELYWLLCLLAAGLLLGE

SEQ ID NO: 1130067 - protein, 17 aa, Mycobacterium
AADRAERRWPFLFAVVF

SEQ ID NO: 1130068 - protein, 17 aa, Mycobacterium
AAISRTLRSFLHQATGV

SEQ ID NO: 1130069 - protein, 17 aa, Mycobacterium
AAKVDWPRFTALVTSES

SEQ ID NO: 1130070 - protein, 17 aa, Mycobacterium
AALIVRWVPLAAGSGIQ

SEQ ID NO: 1130071 - protein, 19 aa, Mycobacterium
AALKYVWRDKPLFLALLAV

SEQ ID NO: 1130072 - protein, 17 aa, Mycobacterium
AALSFATVNGWWYVSNF

SEQ ID NO: 1130073 - protein, 17 aa, Mycobacterium
AAPLCRLTSAAASSSAV

SEQ ID NO: 1130074 - protein, 17 aa, Mycobacterium
AAVAWITGRSKDFYLPG

SEQ ID NO: 1130075 - protein, 20 aa, Mycobacterium
ACARLSYRDGRRAALTVNVI

SEQ ID NO: 1130076 - protein, 24 aa, Mycobacterium
ACLVVPFILGLVWRKGTSTAALAS

SEQ ID NO: 1130077 - protein, 22 aa, Mycobacterium
ACYVLGCLLAVLAVRQAGLFTA

SEQ ID NO: 1130078 - protein, 25 aa, Mycobacterium
ADAPRSWLTWRIPALTSVLVAAVVT

SEQ ID NO: 1130079 - protein, 20 aa, Mycobacterium
ADPGWKWLWWQYALADTRYV

SEQ ID NO: 1130080 - protein, 17 aa, Mycobacterium
ADVLYDFRLYSLGTQVV

SEQ ID NO: 1130081 - protein, 23 aa, Mycobacterium
AESGDLWAGVGFTLGPLIIAFAV

SEQ ID NO: 1130082 - protein, 25 aa, Mycobacterium
AFDQLWKWNNIVALVLSVLVILGLV

SEQ ID NO: 1130083 - protein, 17 aa, Mycobacterium
AFGEGWAFIPLGALLVD

SEQ ID NO: 1130084 - protein, 23 aa, Mycobacterium
AFIPRFLFAVGFPGIVVATACYL

SEQ ID NO: 1130085 - protein, 24 aa, Mycobacterium
AFLGWRWNLPLGVAILLAAVCGGL

SEQ ID NO: 1130086 - protein, 22 aa, Mycobacterium
AFSTMFAMLIGYRLPDFPGARW

SEQ ID NO: 1130087 - protein, 19 aa, Mycobacterium
AGERLRLLIQPGLVLVVGA

SEQ ID NO: 1130088 - protein, 23 aa, Mycobacterium
AGFWLAGLGFGWAMTGLSTVVQE

SEQ ID NO: 1130089 - protein, 18 aa, Mycobacterium
AGLALPRPLREVIAEGDA

SEQ ID NO: 1130090 - protein, 18 aa, Mycobacterium
AGLLQLVGLLGIVGIGRM

SEQ ID NO: 1130091 - protein, 23 aa, Mycobacterium
AGPWKRLVKVILPLIKPAILVAL

SEQ ID NO: 1130092 - protein, 17 aa, Mycobacterium
AGRVQWRTGLIFGAAGM

SEQ ID NO: 1130093 - protein, 26 aa, Mycobacterium
AGVARWWRLLVIAAMGSWLVAEMVWF

SEQ ID NO: 1130094 - protein, 17 aa, Mycobacterium
AILFRPLTALPFVVAGV

SEQ ID NO: 1130095 - protein, 17 aa, Mycobacterium
AIQRLRAPLKVAGEYSP

SEQ ID NO: 1130096 - protein, 22 aa, Mycobacterium
AKYRAGGSLTRFGMLAAQVVPP

SEQ ID NO: 1130097 - protein, 17 aa, Mycobacterium
ALAERLDLRAGRLVVAE

SEQ ID NO: 1130098 - protein, 17 aa, Mycobacterium
ALARPRGWPEAVAAVPA

SEQ ID NO: 1130099 - protein, 17 aa, Mycobacterium
ALGLAIGGSASWTGGLW

SEQ ID NO: 1130100 - protein, 20 aa, Mycobacterium
ALGRRIVARFGWRRPQTLLA

SEQ ID NO: 1130101 - protein, 18 aa, Mycobacterium
ALIARYVLHRMIDRAATG

SEQ ID NO: 1130102 - protein, 20 aa, Mycobacterium
ALLDRWDRRLVLIGANSARL

SEQ ID NO: 1130103 - protein, 18 aa, Mycobacterium
ALPPLAYFFLLVIWLGID

SEQ ID NO: 1130104 - protein, 25 aa, Mycobacterium
ALQWPMFAGFCVYAYYKFVRYEEAP

SEQ ID NO: 1130105 - protein, 24 aa, Mycobacterium
ALSKSAIVPLHFWLPGAMAAPTPV

SEQ ID NO: 1130106 - protein, 19 aa, Mycobacterium
ALTEVSWRLAFLVNAPIGL

SEQ ID NO: 1130107 - protein, 18 aa, Mycobacterium
ALVLAVLCFLNLSESIDL

SEQ ID NO: 1130108 - protein, 24 aa, Mycobacterium
ALVRSRWPHLTARQVMQRIEDTAH

SEQ ID NO: 1130109 - protein, 28 aa, Mycobacterium
AMFDRWNWWLPKWLDRVLPSVDFEKPLP

SEQ ID NO: 1130110 - protein, 21 aa, Mycobacterium
AMLLACLWKAAMLVSTVPFAA

SEQ ID NO: 1130111 - protein, 21 aa, Mycobacterium
APLWREFLRFWTVSFPVVAYR

SEQ ID NO: 1130112 - protein, 20 aa, Mycobacterium
APRWMKRLQERLGLGEVELP

SEQ ID NO: 1130113 - protein, 21 aa, Mycobacterium
APTRWLILRIPLGTVWAEELA

SEQ ID NO: 1130114 - protein, 23 aa, Mycobacterium
ARFIAWPPGRWGGVGSVNPQTAA

SEQ ID NO: 1130115 - protein, 17 aa, Mycobacterium
ARLALLVRAERNDETSE

SEQ ID NO: 1130116 - protein, 18 aa, Mycobacterium
ARLLTWRASWMAATGVPF

SEQ ID NO: 1130117 - protein, 17 aa, Mycobacterium
ARPARWMQMVAGSPLAI

SEQ ID NO: 1130118 - protein, 17 aa, Mycobacterium
ARWSRRIAVQSAVVGMS

SEQ ID NO: 1130119 - protein, 19 aa, Mycobacterium
ASDAFPFYPSIKHLLLEQA

SEQ ID NO: 1130120 - protein, 23 aa, Mycobacterium
ASLRPGRTFRLFSRVIGGFGLAS

SEQ ID NO: 1130121 - protein, 19 aa, Mycobacterium
ASPENAVRCAIALQHSLRR

SEQ ID NO: 1130122 - protein, 18 aa, Mycobacterium
ASPVVVWGAWPFHRAAWM

SEQ ID NO: 1130123 - protein, 19 aa, Mycobacterium
ASWRRWWWALLLAFVPIHL

SEQ ID NO: 1130124 - protein, 22 aa, Mycobacterium
ATRTRLLPRLGLPANAQPPAVV

SEQ ID NO: 1130125 - protein, 26 aa, Mycobacterium
AVAAYLVAPWAWWLCGAVGAVTVLYL

SEQ ID NO: 1130126 - protein, 25 aa, Mycobacterium
AVASRAGDLITWWTGDSVMVFDGSG

SEQ ID NO: 1130127 - protein, 26 aa, Mycobacterium
AVATRRSIPWERVFAYGVVPALALVL

SEQ ID NO: 1130128 - protein, 22 aa, Mycobacterium
AVETCRLIPVIVTFAIGVGVLL

SEQ ID NO: 1130129 - protein, 17 aa, Mycobacterium
AVFCVLGVLPLIVLTQL

SEQ ID NO: 1130130 - protein, 17 aa, Mycobacterium
AVFWINLPICAAAIILT

SEQ ID NO: 1130131 - protein, 19 aa, Mycobacterium
AVIVLGWVAYRIFEAVEKS

SEQ ID NO: 1130132 - protein, 18 aa, Mycobacterium
AVLAFALLLLFGFGMIWF

SEQ ID NO: 1130133 - protein, 24 aa, Mycobacterium
AVLRLPIAVAFRRHWRQILLVAGA

SEQ ID NO: 1130134 - protein, 18 aa, Mycobacterium
AVLTRLGRHSALGTYADG

SEQ ID NO: 1130135 - protein, 24 aa, Mycobacterium
AVRRRLWHRLPWLVLGLLGAMVSA

SEQ ID NO: 1130136 - protein, 25 aa, Mycobacterium
AVWWAARIPPRWALPRMLIEAPFVV

SEQ ID NO: 1130137 - protein, 20 aa, Mycobacterium
AWLALHLVYLVGFKTKIVTL

SEQ ID NO: 1130138 - protein, 22 aa, Mycobacterium
AWLGDRSRPMLIIAVGATASMA

SEQ ID NO: 1130139 - protein, 18 aa, Mycobacterium
AWLRLAWAGLLFLVFLRP

SEQ ID NO: 1130140 - protein, 20 aa, Mycobacterium
AWRNRSRWLPAARTHRASAG

SEQ ID NO: 1130141 - protein, 19 aa, Mycobacterium
AWTGDWPAWAFFSLPTRAW

SEQ ID NO: 1130142 - protein, 24 aa, Mycobacterium
AYLSLRLLIPVIRWQRRDTLLADG

SEQ ID NO: 1130143 - protein, 18 aa, Mycobacterium
AYVLLRFSLRTPPVIGGN

SEQ ID NO: 1130144 - protein, 20 aa, Mycobacterium
AYVWWGLCPGFFLLLLPAGS

SEQ ID NO: 1130145 - protein, 19 aa, Mycobacterium
CFVSAGAVAARFGAAAVAA

SEQ ID NO: 1130146 - protein, 17 aa, Mycobacterium
CGARTRISTFLAGALLL

SEQ ID NO: 1130147 - protein, 18 aa, Mycobacterium
CLGCKLYPLAARLRRVPT

SEQ ID NO: 1130148 - protein, 20 aa, Mycobacterium
CLSFTRLPYFQSLGVPLAVG

SEQ ID NO: 1130149 - protein, 17 aa, Mycobacterium
CSYADRVCFGWVAGAEV

SEQ ID NO: 1130150 - protein, 17 aa, Mycobacterium
CTVGFLPPSSWRSPDDE

SEQ ID NO: 1130151 - protein, 18 aa, Mycobacterium
DAAVIEWIQQYWNQLVLW

SEQ ID NO: 1130152 - protein, 17 aa, Mycobacterium
DAFPASFVVKLVDPEQH

SEQ ID NO: 1130153 - protein, 20 aa, Mycobacterium
DAGLSWLLLVSIPVLAVANY

SEQ ID NO: 1130154 - protein, 21 aa, Mycobacterium
DALELRGRILGAFEQAERSSD

SEQ ID NO: 1130155 - protein, 18 aa, Mycobacterium
DALRALLYALPRGHEPGA

SEQ ID NO: 1130156 - protein, 19 aa, Mycobacterium
DCWWAPRWMKRLQERLGLG

SEQ ID NO: 1130157 - protein, 19 aa, Mycobacterium
DEVLYFFLVESALVFVAAY

SEQ ID NO: 1130158 - protein, 20 aa, Mycobacterium
DFATALDYWPLVIGGSGILS

SEQ ID NO: 1130159 - protein, 22 aa, Mycobacterium
DFKGSALRLVRRLTPQRTLTAS

SEQ ID NO: 1130160 - protein, 24 aa, Mycobacterium
DGAVWWKALLAFVVAVALIIGVNY

SEQ ID NO: 1130161 - protein, 21 aa, Mycobacterium
DLWALTVIHLRLSLIPIVLGL

SEQ ID NO: 1130162 - protein, 18 aa, Mycobacterium
DMSRRYGADFGFVSYDPA

SEQ ID NO: 1130163 - protein, 19 aa, Mycobacterium
DNFFAWALSVMFLVFTLRA

SEQ ID NO: 1130164 - protein, 24 aa, Mycobacterium
DPVLLDWLVGLAFPCQRPFDHRNG

SEQ ID NO: 1130165 - protein, 20 aa, Mycobacterium
DPWSALKVSLVLSVALFFVW

SEQ ID NO: 1130166 - protein, 23 aa, Mycobacterium
DQKRWSFDLAMTWDLLARSITHA

SEQ ID NO: 1130167 - protein, 20 aa, Mycobacterium
DRAAGWLFWFALATAAVTAV

SEQ ID NO: 1130168 - protein, 24 aa, Mycobacterium
DRAERRWPFLFAVVFLAAGLALRY

SEQ ID NO: 1130169 - protein, 24 aa, Mycobacterium
DRAHPRPIVGFGFSALAIGLTWLS

SEQ ID NO: 1130170 - protein, 20 aa, Mycobacterium
DRLKIPFGHELRTGDIMYLD

SEQ ID NO: 1130171 - protein, 18 aa, Mycobacterium
DRVCFGWVAGAEVMPDIA

SEQ ID NO: 1130172 - protein, 21 aa, Mycobacterium
DSYGWRIPFLIAGVLGGVGLY

SEQ ID NO: 1130173 - protein, 24 aa, Mycobacterium
DTRLYLPMPFFWVGGFGSGVLSAL

SEQ ID NO: 1130174 - protein, 23 aa, Mycobacterium
DTSKPVRLTMFWPLADKPRLAAG

SEQ ID NO: 1130175 - protein, 24 aa, Mycobacterium
DTTQSRFWTRWTGWVMRRPWVAAT

SEQ ID NO: 1130176 - protein, 24 aa, Mycobacterium
DTWWRIPVLLAMSFANGWAEEIIV

SEQ ID NO: 1130177 - protein, 19 aa, Mycobacterium
DVASAWRWTALLAAVVTLA

SEQ ID NO: 1130178 - protein, 20 aa, Mycobacterium
DVMVRIWLCAAILVPAVRLM

SEQ ID NO: 1130179 - protein, 20 aa, Mycobacterium
DVSLRPALWVARQQPDAAGD

SEQ ID NO: 1130180 - protein, 22 aa, Mycobacterium
DYRPNLFVTYWAFRAMIGLLLV

SEQ ID NO: 1130181 - protein, 18 aa, Mycobacterium
EAFLPRRSRYAAQLTLAL

SEQ ID NO: 1130182 - protein, 17 aa, Mycobacterium
EALARWTAPNGMQISPE

SEQ ID NO: 1130183 - protein, 19 aa, Mycobacterium
EAVDSRLGRRVAIKVLKAE

SEQ ID NO: 1130184 - protein, 22 aa, Mycobacterium
ECANCLTYALARQVFITLDEPL

SEQ ID NO: 1130185 - protein, 29 aa, Mycobacterium
EDDGEWLSWRWNWWWLLALIPVLLVVGLI

SEQ ID NO: 1130186 - protein, 20 aa, Mycobacterium
EGRPVWKLRPLQLVLTFAAL

SEQ ID NO: 1130187 - protein, 24 aa, Mycobacterium
EIVHPTFLYELVWNLLVFAVLIWA

SEQ ID NO: 1130188 - protein, 19 aa, Mycobacterium
ELAARFGFLLAIPAVFASG

SEQ ID NO: 1130189 - protein, 18 aa, Mycobacterium
ELADAHWVEFSATTRMSG

SEQ ID NO: 1130190 - protein, 22 aa, Mycobacterium
ELDVARLWALLQIYRHNQVFGS

SEQ ID NO: 1130191 - protein, 19 aa, Mycobacterium
ELGQPLAIEYVWGRQIGEN

SEQ ID NO: 1130192 - protein, 19 aa, Mycobacterium
ELIAGVIAFLPRLLVAVII

SEQ ID NO: 1130193 - protein, 19 aa, Mycobacterium
ELSAGAIGEIWVRGENVCL

SEQ ID NO: 1130194 - protein, 22 aa, Mycobacterium
EPEGFSVFGVFWGAFGLASGAA

SEQ ID NO: 1130195 - protein, 27 aa, Mycobacterium
EQAPPRWPWVVGVTAIIAAISLVVSVA

SEQ ID NO: 1130196 - protein, 23 aa, Mycobacterium
ERDGRRLVAVLLRGTRQPIAPWE

SEQ ID NO: 1130197 - protein, 17 aa, Mycobacterium
ERISLRPLWGIDDRLKK

SEQ ID NO: 1130198 - protein, 21 aa, Mycobacterium
ERLGPFWGYLAGWGFVAGKTA

SEQ ID NO: 1130199 - protein, 20 aa, Mycobacterium
ESRIRCLWVAFAGCAVLMSS

SEQ ID NO: 1130200 - protein, 20 aa, Mycobacterium
EVLDGLLLIFIFVELLYAVR

SEQ ID NO: 1130201 - protein, 19 aa, Mycobacterium
EVLPRLGPAVIASRPALWA

SEQ ID NO: 1130202 - protein, 26 aa, Mycobacterium
EWDAVLRFGYWPALFLSLLVAVNILY

SEQ ID NO: 1130203 - protein, 20 aa, Mycobacterium
EYDGRLWISMDFVDGHDAAR

SEQ ID NO: 1130204 - protein, 30 aa, Mycobacterium
FAAELLDTWLWRWASFLIVFGVMVLVTALL

SEQ ID NO: 1130205 - protein, 17 aa, Mycobacterium
FACVITFLSDHRMLARY

SEQ ID NO: 1130206 - protein, 23 aa, Mycobacterium
FALFAIAAAWAFWLHLTPRPESR

SEQ ID NO: 1130207 - protein, 17 aa, Mycobacterium
FAWDWEHCLGSEPRWGR

SEQ ID NO: 1130208 - protein, 18 aa, Mycobacterium
FCAIVLRPALSAVDDRAL

SEQ ID NO: 1130209 - protein, 19 aa, Mycobacterium
FCIAVAPAIQFGVIGPFFH

SEQ ID NO: 1130210 - protein, 19 aa, Mycobacterium
FDGTGWRLGAAMPTPRQMS

SEQ ID NO: 1130211 - protein, 21 aa, Mycobacterium
FDPARPVAVNVIDFGDDPDRG

SEQ ID NO: 1130212 - protein, 19 aa, Mycobacterium
FELAPGFVPEITWPSATCS

SEQ ID NO: 1130213 - protein, 17 aa, Mycobacterium
FELTGALLITAALGAMV

SEQ ID NO: 1130214 - protein, 19 aa, Mycobacterium
FEPRLARWLDRPRGPGPSR

SEQ ID NO: 1130215 - protein, 18 aa, Mycobacterium
FFTMWGFFILASVYLEAY

SEQ ID NO: 1130216 - protein, 17 aa, Mycobacterium
FGAGIGVAFGRRRRTVV

SEQ ID NO: 1130217 - protein, 17 aa, Mycobacterium
FGALAWSDADDIPDVAP

SEQ ID NO: 1130218 - protein, 18 aa, Mycobacterium
FGALCAVLSAVILGIAMG

SEQ ID NO: 1130219 - protein, 18 aa, Mycobacterium
FGHDPWWLILAKAVGVFV

SEQ ID NO: 1130220 - protein, 18 aa, Mycobacterium
FGKASPFGLLIVAALLVA

SEQ ID NO: 1130221 - protein, 23 aa, Mycobacterium
FGLSMPGWVWWLILYAIFVGLNS

SEQ ID NO: 1130222 - protein, 18 aa, Mycobacterium
FGPYELRSLIGVGGMGEV

SEQ ID NO: 1130223 - protein, 17 aa, Mycobacterium
FGWLAFLIVFGFFTRKA

SEQ ID NO: 1130224 - protein, 17 aa, Mycobacterium
FKNGVGLMLELPQPTTI

SEQ ID NO: 1130225 - protein, 20 aa, Mycobacterium
FKSDAAKIWADFTAANVGTQ

SEQ ID NO: 1130226 - protein, 18 aa, Mycobacterium
FLCPACGNFERQFGPTIN

SEQ ID NO: 1130227 - protein, 19 aa, Mycobacterium
FLGAISWLFGNVIVAGGNA

SEQ ID NO: 1130228 - protein, 24 aa, Mycobacterium
FLLLFRLTCYYYRKAYYRSVWQSP

SEQ ID NO: 1130229 - protein, 22 aa, Mycobacterium
FLLTARTGFWIGVLPIALYSLL

SEQ ID NO: 1130230 - protein, 22 aa, Mycobacterium
FLPRLAILVVVAFFITVAVYGV

SEQ ID NO: 1130231 - protein, 18 aa, Mycobacterium
FLSFVVNWLLQWAADGPN

SEQ ID NO: 1130232 - protein, 18 aa, Mycobacterium
FLTWGWRVPFLLSAVMVA

SEQ ID NO: 1130233 - protein, 19 aa, Mycobacterium
FLVGLRLGLSSAWLSLIFA

SEQ ID NO: 1130234 - protein, 18 aa, Mycobacterium
FNVALPWSKQVELPSPAR

SEQ ID NO: 1130235 - protein, 17 aa, Mycobacterium
FPADVLYDFRLYSLGTQ

SEQ ID NO: 1130236 - protein, 22 aa, Mycobacterium
FPGKRLLVGVALLIAMFPQISL

SEQ ID NO: 1130237 - protein, 19 aa, Mycobacterium
FPVGFCLLYLLGFDLLTGV

SEQ ID NO: 1130238 - protein, 19 aa, Mycobacterium
FRAGRLRPLYGPGVKFLIP

SEQ ID NO: 1130239 - protein, 17 aa, Mycobacterium
FRRHWRQILLVAGAYLS

SEQ ID NO: 1130240 - protein, 17 aa, Mycobacterium
FSLEYDQWFGVVLPAVE

SEQ ID NO: 1130241 - protein, 23 aa, Mycobacterium
FTIASILCGIAWDEVTLVIARLL

SEQ ID NO: 1130242 - protein, 19 aa, Mycobacterium
FTPVGAALLCDWTDDDSGL

SEQ ID NO: 1130243 - protein, 23 aa, Mycobacterium
FVSAFVCGIAFKYLRHSDDLRGD

SEQ ID NO: 1130244 - protein, 19 aa, Mycobacterium
FVVSYRWGHHVGRLVVHPD

SEQ ID NO: 1130245 - protein, 19 aa, Mycobacterium
FWALLALRAVVFAVVMALL

SEQ ID NO: 1130246 - protein, 17 aa, Mycobacterium
FWIGRPIITLSFNNEKF

SEQ ID NO: 1130247 - protein, 18 aa, Mycobacterium
FWWELALLIVIMLLGHWV

SEQ ID NO: 1130248 - protein, 18 aa, Mycobacterium
FYTAHYFGAWVFIAGFLV

SEQ ID NO: 1130249 - protein, 21 aa, Mycobacterium
GAALSFKFALVVAIISIGILV

SEQ ID NO: 1130250 - protein, 20 aa, Mycobacterium
GAATVRWPGPILIATIALSL

SEQ ID NO: 1130251 - protein, 17 aa, Mycobacterium
GAAVVFWAFNRDLTATQ

SEQ ID NO: 1130252 - protein, 19 aa, Mycobacterium
GAIGEIWVRGENVCLGYWG

SEQ ID NO: 1130253 - protein, 18 aa, Mycobacterium
GALADWFAVTALFKHPLG

SEQ ID NO: 1130254 - protein, 17 aa, Mycobacterium
GALCFLAAALLVLPPKR

SEQ ID NO: 1130255 - protein, 17 aa, Mycobacterium
GARAYGFILAFFGVGSA

SEQ ID NO: 1130256 - protein, 19 aa, Mycobacterium
GARNYPCIEHPGKRAPTVE

SEQ ID NO: 1130257 - protein, 19 aa, Mycobacterium
GARNYPCMGQPGKRAATAE

SEQ ID NO: 1130258 - protein, 17 aa, Mycobacterium
GDDCWWAPRWMKRLQER

SEQ ID NO: 1130259 - protein, 21 aa, Mycobacterium
GELRPVYNLTSARLVLGNPGT

SEQ ID NO: 1130260 - protein, 27 aa, Mycobacterium
GFFTDHLSWRWAFWINVPVGIVVFFVA

SEQ ID NO: 1130261 - protein, 19 aa, Mycobacterium
GFGWFFYDFGTAVSFIEDD

SEQ ID NO: 1130262 - protein, 21 aa, Mycobacterium
GGAAWLPFLVAFLIATITAFS

SEQ ID NO: 1130263 - protein, 17 aa, Mycobacterium
GGGRTRWRWAVANYGYL

SEQ ID NO: 1130264 - protein, 18 aa, Mycobacterium
GGMTCASCAARVEKKLNR

SEQ ID NO: 1130265 - protein, 19 aa, Mycobacterium
GGSIGRWIAAVAVLAVLTV

SEQ ID NO: 1130266 - protein, 19 aa, Mycobacterium
GGVILWRFFGDALSERSDA

SEQ ID NO: 1130267 - protein, 22 aa, Mycobacterium
GGWASVHLFGFPALDDTTPLFA

SEQ ID NO: 1130268 - protein, 24 aa, Mycobacterium
GIAARAGHPISFWRFTRYGIVVTL

SEQ ID NO: 1130269 - protein, 19 aa, Mycobacterium
GILEFPYRRFLAFDAVAAV

SEQ ID NO: 1130270 - protein, 17 aa, Mycobacterium
GITVWLGLVANLGGVAG

SEQ ID NO: 1130271 - protein, 17 aa, Mycobacterium
GKFASFAVAFAFVSIAT

SEQ ID NO: 1130272 - protein, 23 aa, Mycobacterium
GLAATGWPPVRWIPKIRPDPLRR

SEQ ID NO: 1130273 - protein, 22 aa, Mycobacterium
GLACAIGGYAFGKIPVKQRPVL

SEQ ID NO: 1130274 - protein, 17 aa, Mycobacterium
GLACLRSGTAQLLARAA

SEQ ID NO: 1130275 - protein, 18 aa, Mycobacterium
GLAGCLLLAFALPWTSVL

SEQ ID NO: 1130276 - protein, 18 aa, Mycobacterium
GLCTVPLTLVASVFGLWA

SEQ ID NO: 1130277 - protein, 17 aa, Mycobacterium
GLGFVWRTPVLRTLAVV

SEQ ID NO: 1130278 - protein, 22 aa, Mycobacterium
GLIAQYTSFGWAFLISGVILGV

SEQ ID NO: 1130279 - protein, 17 aa, Mycobacterium
GLLVCFALAVLLPLSPD

SEQ ID NO: 1130280 - protein, 20 aa, Mycobacterium
GLMTRSEMISRLVFAMGGRA

SEQ ID NO: 1130281 - protein, 17 aa, Mycobacterium
GLPNRWASLTGDVVATG

SEQ ID NO: 1130282 - protein, 17 aa, Mycobacterium
GLRDEFFDNLGVVAALA

SEQ ID NO: 1130283 - protein, 17 aa, Mycobacterium
GMAAWIIGMVAVIGAAL

SEQ ID NO: 1130284 - protein, 23 aa, Mycobacterium
GMIGRLAIFLAVLIGYLLALAMG

SEQ ID NO: 1130285 - protein, 19 aa, Mycobacterium
GNDHFAEWAPGMKSIDDAL

SEQ ID NO: 1130286 - protein, 17 aa, Mycobacterium
GPAKWIRRFAIPIILGW

SEQ ID NO: 1130287 - protein, 21 aa, Mycobacterium
GPGALFWMWAVAFLGASTSFV

SEQ ID NO: 1130288 - protein, 19 aa, Mycobacterium
GPKAPRLWLPPLDEPIRLV

SEQ ID NO: 1130289 - protein, 22 aa, Mycobacterium
GPKAVLWTSGWTPRFTGETIFL

SEQ ID NO: 1130290 - protein, 18 aa, Mycobacterium
GPMPPKRALEVIADACQA

SEQ ID NO: 1130291 - protein, 19 aa, Mycobacterium
GPNKLPAYLLMVVAALGLL

SEQ ID NO: 1130292 - protein, 19 aa, Mycobacterium
GPTRELWMVLALAVGAAVA

SEQ ID NO: 1130293 - protein, 19 aa, Mycobacterium
GQPATGWTLNWARNLIESA

SEQ ID NO: 1130294 - protein, 17 aa, Mycobacterium
GRFAWFVKVHHTVMDGV

SEQ ID NO: 1130295 - protein, 17 aa, Mycobacterium
GRGIGLALVRLVTAQHG

SEQ ID NO: 1130296 - protein, 21 aa, Mycobacterium
GRLHKHWGFGGGPHRCLGAHL

SEQ ID NO: 1130297 - protein, 20 aa, Mycobacterium
GRLPGTFGGPVWRLAGTTAI

SEQ ID NO: 1130298 - protein, 25 aa, Mycobacterium
GRSDLRWWHPWAWLAYPGCYVVIAL

SEQ ID NO: 1130299 - protein, 18 aa, Mycobacterium
GRTRWRWAVANYGYLLAA

SEQ ID NO: 1130300 - protein, 22 aa, Mycobacterium
GTELPRRATIPFTSERQCMATL

SEQ ID NO: 1130301 - protein, 17 aa, Mycobacterium
GTVYQMWLVGSDGPHSA

SEQ ID NO: 1130302 - protein, 22 aa, Mycobacterium
GVDPRVGLFASFTMAVTVAILG

SEQ ID NO: 1130303 - protein, 23 aa, Mycobacterium
GVLAWLVGLGFFFPVFWMILTSF

SEQ ID NO: 1130304 - protein, 24 aa, Mycobacterium
GVRHVVRMWPLWIFAASFVSPLPW

SEQ ID NO: 1130305 - protein, 25 aa, Mycobacterium
GVVVGGPFLPLAVIMYWLANNIWTY

SEQ ID NO: 1130306 - protein, 19 aa, Mycobacterium
GWEIRDFRTARKAARIGVP

SEQ ID NO: 1130307 - protein, 19 aa, Mycobacterium
GWGALKLALPRSGNADASY

SEQ ID NO: 1130308 - protein, 20 aa, Mycobacterium
GWVTQRLWWALLLTVGFWGV

SEQ ID NO: 1130309 - protein, 23 aa, Mycobacterium
GYGAKNVRDVKCNNGESPEVKKG

SEQ ID NO: 1130310 - protein, 24 aa, Mycobacterium
GYLPRRLSVVNSRKAPTLALVVPG

SEQ ID NO: 1130311 - protein, 17 aa, Mycobacterium
HAPWARWRYTNRPRKMH

SEQ ID NO: 1130312 - protein, 18 aa, Mycobacterium
HGCPGCVGDRIMVDKVTY

SEQ ID NO: 1130313 - protein, 21 aa, Mycobacterium
HIRTGTLLGERVLALESEGSG

SEQ ID NO: 1130314 - protein, 22 aa, Mycobacterium
HLCDRLWLIAAIEHYTAVMGDF

SEQ ID NO: 1130315 - protein, 19 aa, Mycobacterium
HLFWFFGHPEVYIIALPFF

SEQ ID NO: 1130316 - protein, 18 aa, Mycobacterium
HLFWFFGHPEVYVIALPF

SEQ ID NO: 1130317 - protein, 18 aa, Mycobacterium
HRAKGGGLSTLFGGGVQS

SEQ ID NO: 1130318 - protein, 19 aa, Mycobacterium
HRPSAKAPLLWAASAALPW

SEQ ID NO: 1130319 - protein, 17 aa, Mycobacterium
HTARLALLVRAERNDET

SEQ ID NO: 1130320 - protein, 19 aa, Mycobacterium
HTKWGVGIALLFVTLPFVV

SEQ ID NO: 1130321 - protein, 18 aa, Mycobacterium
HTTHWGLYIDDFWWTAVW

SEQ ID NO: 1130322 - protein, 21 aa, Mycobacterium
HVGTDTGGLWTWRETDTVDLG

SEQ ID NO: 1130323 - protein, 19 aa, Mycobacterium
HVILGWRPVLLLPLTFALF

SEQ ID NO: 1130324 - protein, 17 aa, Mycobacterium
HWPWAQQWLTLWRNTIG

SEQ ID NO: 1130325 - protein, 21 aa, Mycobacterium
IAAIIACVWLMLNLTGLTWIR

SEQ ID NO: 1130326 - protein, 22 aa, Mycobacterium
IAALLGRWFWWPQRVRQRPATT

SEQ ID NO: 1130327 - protein, 17 aa, Mycobacterium
IAAMFAILVALTGVMFV

SEQ ID NO: 1130328 - protein, 18 aa, Mycobacterium
IACSLVFPAAVGALVYAM

SEQ ID NO: 1130329 - protein, 17 aa, Mycobacterium
IAFGLSMDYEVFLMARI

SEQ ID NO: 1130330 - protein, 17 aa, Mycobacterium
IAFGLSMDYEVFLMSRI

SEQ ID NO: 1130331 - protein, 19 aa, Mycobacterium
IAFLPRLLVAVIIIVVAAA

SEQ ID NO: 1130332 - protein, 17 aa, Mycobacterium
IAGLGRTVTFIPWPVIE

SEQ ID NO: 1130333 - protein, 17 aa, Mycobacterium
IAIAVLFVGGWQLSSER

SEQ ID NO: 1130334 - protein, 22 aa, Mycobacterium
IATGCPFCRVMITDGVDDVAAT

SEQ ID NO: 1130335 - protein, 17 aa, Mycobacterium
ICALAVLLTAIFVPESK

SEQ ID NO: 1130336 - protein, 17 aa, Mycobacterium
ICSHLGCPSSLYEQQTH

SEQ ID NO: 1130337 - protein, 23 aa, Mycobacterium
IDVLRRLWPPVVIGALVLVGVAA

SEQ ID NO: 1130338 - protein, 17 aa, Mycobacterium
IELPLAVPVLIASLRVV

SEQ ID NO: 1130339 - protein, 18 aa, Mycobacterium
IFLYNVLPQWGWQLSSET

SEQ ID NO: 1130340 - protein, 18 aa, Mycobacterium
IGFAEGWHDFWHGDIGVW

SEQ ID NO: 1130341 - protein, 17 aa, Mycobacterium
IGGRAMLFGGIFPPFWL

SEQ ID NO: 1130342 - protein, 17 aa, Mycobacterium
IGMGRWYLGMSSRHATG

SEQ ID NO: 1130343 - protein, 23 aa, Mycobacterium
IGPRAGFFSGFAMLGAYVGFSIG

SEQ ID NO: 1130344 - protein, 19 aa, Mycobacterium
IHDCPKLLQLRSFPTIAIG

SEQ ID NO: 1130345 - protein, 18 aa, Mycobacterium
IIVLLALAAWIFITGPQS

SEQ ID NO: 1130346 - protein, 18 aa, Mycobacterium
IIYEPLRAYLLYASAYRA

SEQ ID NO: 1130347 - protein, 19 aa, Mycobacterium
IPGIAHFFTMWGFFILASV

SEQ ID NO: 1130348 - protein, 17 aa, Mycobacterium
IPGLIASIMLMFTVVSL

SEQ ID NO: 1130349 - protein, 23 aa, Mycobacterium
IPLPGSAPRPVWLHAFAHPEKDR

SEQ ID NO: 1130350 - protein, 19 aa, Mycobacterium
IPVKQRPVLYLALEDGHRR

SEQ ID NO: 1130351 - protein, 21 aa, Mycobacterium
IPVLLSHQWPLVFVAAALLGA

SEQ ID NO: 1130352 - protein, 18 aa, Mycobacterium
IPVVAVAVVWLAFELALF

SEQ ID NO: 1130353 - protein, 18 aa, Mycobacterium
IRDAFDPARPVAVNVIDF

SEQ ID NO: 1130354 - protein, 24 aa, Mycobacterium
IRGSLRILLPLSIIGAIILVSGGV

SEQ ID NO: 1130355 - protein, 19 aa, Mycobacterium
IRIGIPFGPSFFEMNLQGL

SEQ ID NO: 1130356 - protein, 22 aa, Mycobacterium
IRRPAVGVVWAWFTGRDGSWRR

SEQ ID NO: 1130357 - protein, 19 aa, Mycobacterium
ISPLLWVVAAGFLFYFARS

SEQ ID NO: 1130358 - protein, 22 aa, Mycobacterium
ISRSRLLRWPARVYTDIFRGLP

SEQ ID NO: 1130359 - protein, 24 aa, Mycobacterium
ITGFLRIVLLAAILGAALSSSFTV

SEQ ID NO: 1130360 - protein, 19 aa, Mycobacterium
IVARFGWRRPQTLLAAGLL

SEQ ID NO: 1130361 - protein, 17 aa, Mycobacterium
IVGVSFPRGARWARVDL

SEQ ID NO: 1130362 - protein, 24 aa, Mycobacterium
IVIAFAVLCAVVLIVYIDRDGYRD

SEQ ID NO: 1130363 - protein, 18 aa, Mycobacterium
KAGYRPALIVGDPDRMSA

SEQ ID NO: 1130364 - protein, 24 aa, Mycobacterium
KAIFAAAILVCLTVSALALAAEPF

SEQ ID NO: 1130365 - protein, 19 aa, Mycobacterium
KGVGLGLMVGWALVSLVTV

SEQ ID NO: 1130366 - protein, 20 aa, Mycobacterium
KHGLARRFAFRILALPRAGQ

SEQ ID NO: 1130367 - protein, 24 aa, Mycobacterium
KIIGRAGGVYGDFFNFYACDVTLK

SEQ ID NO: 1130368 - protein, 22 aa, Mycobacterium
KKELWFAWWVMVVFYQLYGVLF

SEQ ID NO: 1130369 - protein, 21 aa, Mycobacterium
KKGLGKWALVPGIPLLWDLVI

SEQ ID NO: 1130370 - protein, 19 aa, Mycobacterium
KKSKLWLILGLVALTVVVI

SEQ ID NO: 1130371 - protein, 28 aa, Mycobacterium
KLFSREWLGAMALRYAMFIILLMVIFYF

SEQ ID NO: 1130372 - protein, 24 aa, Mycobacterium
KLSGSRTAQAWARRHATLRAELTR

SEQ ID NO: 1130373 - protein, 20 aa, Mycobacterium
KRFERCVDFARALEHRIGSD

SEQ ID NO: 1130374 - protein, 20 aa, Mycobacterium
KSVGCGNALISDTSGAEAAN

SEQ ID NO: 1130375 - protein, 27 aa, Mycobacterium
KWIRRFAIPIILGWILLVAVLSLTVPQ

SEQ ID NO: 1130376 - protein, 21 aa, Mycobacterium
LAALVLVAALVWAARNKRNQS

SEQ ID NO: 1130377 - protein, 17 aa, Mycobacterium
LADEVLYFFLVESALVF

SEQ ID NO: 1130378 - protein, 17 aa, Mycobacterium
LAGLCERVQLLPGSDER

SEQ ID NO: 1130379 - protein, 18 aa, Mycobacterium
LAIIAAGIAFRARMGGTE

SEQ ID NO: 1130380 - protein, 27 aa, Mycobacterium
LALGWPLWWVSVCSVLCLLIVQGVIVN

SEQ ID NO: 1130381 - protein, 23 aa, Mycobacterium
LALPFLVLWPFWLVTKWLGGRWT

SEQ ID NO: 1130382 - protein, 24 aa, Mycobacterium
LALVLAVAGGYLFWRNYTADAAEQ

SEQ ID NO: 1130383 - protein, 23 aa, Mycobacterium
LALWLVAVGFEWTQPGAGHPHHG

SEQ ID NO: 1130384 - protein, 17 aa, Mycobacterium
LAPKAWRARGAVPLAGL

SEQ ID NO: 1130385 - protein, 19 aa, Mycobacterium
LARRVEWRVLPAYWLTQVI

SEQ ID NO: 1130386 - protein, 17 aa, Mycobacterium
LATFAAVFLAGGVMFTL

SEQ ID NO: 1130387 - protein, 17 aa, Mycobacterium
LAVALLAIWQGRRLGPL

SEQ ID NO: 1130388 - protein, 19 aa, Mycobacterium
LAVIMYWLANNIWTYGQQH

SEQ ID NO: 1130389 - protein, 19 aa, Mycobacterium
LCAAVAVAGLGLWLLTRPR

SEQ ID NO: 1130390 - protein, 17 aa, Mycobacterium
LCAAVAWITGRSKDFYL

SEQ ID NO: 1130391 - protein, 19 aa, Mycobacterium
LCADRFGRRRTLLVVTAGI

SEQ ID NO: 1130392 - protein, 21 aa, Mycobacterium
LDAGPFLSYGIQWIAFGIIAP

SEQ ID NO: 1130393 - protein, 17 aa, Mycobacterium
LDAKRAASIIAQVAAAL

SEQ ID NO: 1130394 - protein, 22 aa, Mycobacterium
LDAQVFPPLEWAVEGIVPEGFG

SEQ ID NO: 1130395 - protein, 18 aa, Mycobacterium
LDNTRLWSNLDCAPSNET

SEQ ID NO: 1130396 - protein, 20 aa, Mycobacterium
LDQPRIYFGPVIANTASDYA

SEQ ID NO: 1130397 - protein, 24 aa, Mycobacterium
LDRGKEVPFTFAYPIRAADGPSLR

SEQ ID NO: 1130398 - protein, 20 aa, Mycobacterium
LEFGGFIAWLAWLALHLVYL

SEQ ID NO: 1130399 - protein, 17 aa, Mycobacterium
LEYARPGPDGAPVPAGR

SEQ ID NO: 1130400 - protein, 18 aa, Mycobacterium
LFDTWPGLIIPYITFALP

SEQ ID NO: 1130401 - protein, 18 aa, Mycobacterium
LFGLIVLLLRRGRLPGTF

SEQ ID NO: 1130402 - protein, 17 aa, Mycobacterium
LFWFFGHPEVYIIALPF

SEQ ID NO: 1130403 - protein, 18 aa, Mycobacterium
LGDLPWWVTGVILARELG

SEQ ID NO: 1130404 - protein, 17 aa, Mycobacterium
LGEILGFGGMSEVHLAR

SEQ ID NO: 1130405 - protein, 21 aa, Mycobacterium
LGELIRPGAGMVFDGELDSEL

SEQ ID NO: 1130406 - protein, 18 aa, Mycobacterium
LGETLPLDAGKILGVGLA

SEQ ID NO: 1130407 - protein, 17 aa, Mycobacterium
LGLPWVIYLPICYALPG

SEQ ID NO: 1130408 - protein, 24 aa, Mycobacterium
LGLREFPLVIAILFALVIALPLGI

SEQ ID NO: 1130409 - protein, 17 aa, Mycobacterium
LGRALCGIRVLRRDGGE

SEQ ID NO: 1130410 - protein, 22 aa, Mycobacterium
LGRLRFGALYALSALGGSVLVY

SEQ ID NO: 1130411 - protein, 20 aa, Mycobacterium
LGRLTLWLMIGIVGALTVSF

SEQ ID NO: 1130412 - protein, 23 aa, Mycobacterium
LGSDWPFVVGIAVATLLLSVAAG

SEQ ID NO: 1130413 - protein, 21 aa, Mycobacterium
LHHELEFWWELALLIVIMLLG

SEQ ID NO: 1130414 - protein, 25 aa, Mycobacterium
LIATAALILSVWTWWQARPPSYDAA

SEQ ID NO: 1130415 - protein, 18 aa, Mycobacterium
LIDGGLLALRIALLSLII

SEQ ID NO: 1130416 - protein, 22 aa, Mycobacterium
LIPACIAIFVPLDLLWVGVTVS

SEQ ID NO: 1130417 - protein, 18 aa, Mycobacterium
LLAFEIIVLLALAAWIFI

SEQ ID NO: 1130418 - protein, 19 aa, Mycobacterium
LLAKVCIYAVFAILQSTIV

SEQ ID NO: 1130419 - protein, 18 aa, Mycobacterium
LLEHFWWGSVFLINAPVM

SEQ ID NO: 1130420 - protein, 18 aa, Mycobacterium
LLGEISWRGPFFGVSALM

SEQ ID NO: 1130421 - protein, 19 aa, Mycobacterium
LLIIMGAFMFFASRRQKKA

SEQ ID NO: 1130422 - protein, 20 aa, Mycobacterium
LLIRPVCVFAMFGRGVLSRK

SEQ ID NO: 1130423 - protein, 18 aa, Mycobacterium
LLLAFALPWTSVLAGVAV

SEQ ID NO: 1130424 - protein, 18 aa, Mycobacterium
LLLAYPLAYVIAFKAGRF

SEQ ID NO: 1130425 - protein, 18 aa, Mycobacterium
LLLLRFLIALPIGALLGG

SEQ ID NO: 1130426 - protein, 19 aa, Mycobacterium
LLLLVALFVFFSRMQTGGR

SEQ ID NO: 1130427 - protein, 24 aa, Mycobacterium
LLPDEQFLSWGWRIPFLASAVLIV

SEQ ID NO: 1130428 - protein, 27 aa, Mycobacterium
LLRKRRWALRLGLFFTVTSVFWILVTA

SEQ ID NO: 1130429 - protein, 18 aa, Mycobacterium
LLRRIWRFAGRHHRRLAA

SEQ ID NO: 1130430 - protein, 21 aa, Mycobacterium
LLRRTYPLLVRRLVTLVPALA

SEQ ID NO: 1130431 - protein, 17 aa, Mycobacterium
LLTLAGWLLVGGPVSAA

SEQ ID NO: 1130432 - protein, 23 aa, Mycobacterium
LLVFGVGVAIYFAKAGPRDGAVT

SEQ ID NO: 1130433 - protein, 17 aa, Mycobacterium
LLWVVWCRRTWRPVRLL

SEQ ID NO: 1130434 - protein, 19 aa, Mycobacterium
LMACFMGSIGFVYANATAL

SEQ ID NO: 1130435 - protein, 20 aa, Mycobacterium
LMALACWWVISREVIPRLGH

SEQ ID NO: 1130436 - protein, 18 aa, Mycobacterium
LMFFAGLFAMYFTARAQA

SEQ ID NO: 1130437 - protein, 29 aa, Mycobacterium
LMPDESFMSWGWRVPFLVSLLLLGLGIYV

SEQ ID NO: 1130438 - protein, 18 aa, Mycobacterium
LMRAVAGVSIFKLVRYLA

SEQ ID NO: 1130439 - protein, 24 aa, Mycobacterium
LNAVEWLDGLTFQWWMYPVGVMAI

SEQ ID NO: 1130440 - protein, 18 aa, Mycobacterium
LNRADNWLHFALGVVMLV

SEQ ID NO: 1130441 - protein, 24 aa, Mycobacterium
LPAPRFPPPPGFPHRRIIRDDSGP

SEQ ID NO: 1130442 - protein, 24 aa, Mycobacterium
LPAYGETWLMVGITMALVVTIGIP

SEQ ID NO: 1130443 - protein, 20 aa, Mycobacterium
LPAYLLMVVAALGLLVYLCN

SEQ ID NO: 1130444 - protein, 19 aa, Mycobacterium
LPIDTLFPFISMFAVSNTA

SEQ ID NO: 1130445 - protein, 17 aa, Mycobacterium
LPLVLPFKYLGVPKDTL

SEQ ID NO: 1130446 - protein, 20 aa, Mycobacterium
LPRWFELMGSTSPTLGTVLR

SEQ ID NO: 1130447 - protein, 21 aa, Mycobacterium
LPSPARSSARISIINVGRDVT

SEQ ID NO: 1130448 - protein, 24 aa, Mycobacterium
LPYIGFLCIIGLLSYHLLIGRDMP

SEQ ID NO: 1130449 - protein, 22 aa, Mycobacterium
LQADCYAGVWAHYAAVTTQEST

SEQ ID NO: 1130450 - protein, 17 aa, Mycobacterium
LQARLTVLAVDDAGMST

SEQ ID NO: 1130451 - protein, 18 aa, Mycobacterium
LQERYVWNSVDVMLEAFV

SEQ ID NO: 1130452 - protein, 21 aa, Mycobacterium
LQMAFRFWAFRRWVFPEEFGR

SEQ ID NO: 1130453 - protein, 22 aa, Mycobacterium
LRADVPGGVWARGLRARKRLER

SEQ ID NO: 1130454 - protein, 19 aa, Mycobacterium
LRAPWARRPVEFLCLLPLT

SEQ ID NO: 1130455 - protein, 17 aa, Mycobacterium
LRHRWWVVLSGVGIAAV

SEQ ID NO: 1130456 - protein, 18 aa, Mycobacterium
LRKDLSWWDLTVFGVSVV

SEQ ID NO: 1130457 - protein, 21 aa, Mycobacterium
LRKLKDPSWRVGAWACSVIVV

SEQ ID NO: 1130458 - protein, 20 aa, Mycobacterium
LRKPIIVWWILWVLSTVVSV

SEQ ID NO: 1130459 - protein, 21 aa, Mycobacterium
LRLPLALGVIHLLARIPLPGS

SEQ ID NO: 1130460 - protein, 26 aa, Mycobacterium
LRRALRPALGWSIGIATYFLLLGAML

SEQ ID NO: 1130461 - protein, 18 aa, Mycobacterium
LRRDRTSFIIAHRLSTIR

SEQ ID NO: 1130462 - protein, 24 aa, Mycobacterium
LRRRRFRWCVAAAYLSGVSTVAGV

SEQ ID NO: 1130463 - protein, 23 aa, Mycobacterium
LRSRIGMVLQDTWLFAGTIYDNI

SEQ ID NO: 1130464 - protein, 19 aa, Mycobacterium
LRTDLFVKFSRDFDDPVRD

SEQ ID NO: 1130465 - protein, 17 aa, Mycobacterium
LRTPRPYLYAGILFFAT

SEQ ID NO: 1130466 - protein, 22 aa, Mycobacterium
LSAFKVPTIWLLLDDDDAVPRK

SEQ ID NO: 1130467 - protein, 17 aa, Mycobacterium
LSALMLMVSSIVLLAVV

SEQ ID NO: 1130468 - protein, 19 aa, Mycobacterium
LSDRFGRRPVYVVGAVLGA

SEQ ID NO: 1130469 - protein, 25 aa, Mycobacterium
LSLLAMVVAAFGWLPPAAGALLQEG

SEQ ID NO: 1130470 - protein, 20 aa, Mycobacterium
LSVITPIRWVCAVIVEFFRA

SEQ ID NO: 1130471 - protein, 18 aa, Mycobacterium
LSVLFSFQGNDMMTSFQV

SEQ ID NO: 1130472 - protein, 17 aa, Mycobacterium
LSWVAGVGLGWLTALAA

SEQ ID NO: 1130473 - protein, 18 aa, Mycobacterium
LTALAWRNRSRWLPAART

SEQ ID NO: 1130474 - protein, 17 aa, Mycobacterium
LTALTWPVVANFAVDAA

SEQ ID NO: 1130475 - protein, 24 aa, Mycobacterium
LTAPHPWLGVALMFVLGVVVTFSG

SEQ ID NO: 1130476 - protein, 22 aa, Mycobacterium
LTGACLTFGWSVPTVGDEGELP

SEQ ID NO: 1130477 - protein, 17 aa, Mycobacterium
LTIPVLLSHQWPLVFVA

SEQ ID NO: 1130478 - protein, 18 aa, Mycobacterium
LTISDPVACTVGFLPPSQ

SEQ ID NO: 1130479 - protein, 18 aa, Mycobacterium
LTPVAAWILTCSVMTGAI

SEQ ID NO: 1130480 - protein, 17 aa, Mycobacterium
LTVEAWTFLQLGSRQQT

SEQ ID NO: 1130481 - protein, 18 aa, Mycobacterium
LVASWLLSRRIKRHTRGL

SEQ ID NO: 1130482 - protein, 17 aa, Mycobacterium
LVGCFAFGWGFTAATSS

SEQ ID NO: 1130483 - protein, 21 aa, Mycobacterium
LVGVIGFACVITFLSDHRMLA

SEQ ID NO: 1130484 - protein, 21 aa, Mycobacterium
LVICDRLRIAPQPYLIAEVLA

SEQ ID NO: 1130485 - protein, 17 aa, Mycobacterium
LVIRLARRFLRTTDDYD

SEQ ID NO: 1130486 - protein, 19 aa, Mycobacterium
LVLAWRIMRAPAYVPQELE

SEQ ID NO: 1130487 - protein, 17 aa, Mycobacterium
LVPEWGVALVLVASAAL

SEQ ID NO: 1130488 - protein, 17 aa, Mycobacterium
LVVPIAVLVCFRAAQSP

SEQ ID NO: 1130489 - protein, 17 aa, Mycobacterium
LVWMQFRGAFTPEVKLR

SEQ ID NO: 1130490 - protein, 18 aa, Mycobacterium
LWAFELTGALLITAALGA

SEQ ID NO: 1130491 - protein, 18 aa, Mycobacterium
LWHWPVLILAPAMFGTDL

SEQ ID NO: 1130492 - protein, 17 aa, Mycobacterium
LWLILGLVALTVVVIAI

SEQ ID NO: 1130493 - protein, 19 aa, Mycobacterium
LWLRCALVIAIAMGAAMIA

SEQ ID NO: 1130494 - protein, 17 aa, Mycobacterium
LWSLIGLVPQRGYLFTG

SEQ ID NO: 1130495 - protein, 18 aa, Mycobacterium
LWSSFVWRNEVSDTFVET

SEQ ID NO: 1130496 - protein, 17 aa, Mycobacterium
LWTSLLWIGRAWVVAAV

SEQ ID NO: 1130497 - protein, 17 aa, Mycobacterium
LYAIPALVAAMITVVAI

SEQ ID NO: 1130498 - protein, 18 aa, Mycobacterium
MALACRWGGTVKAFLIAG

SEQ ID NO: 1130499 - protein, 20 aa, Mycobacterium
MAVFPMYFLRSFAYAGVAVV

SEQ ID NO: 1130500 - protein, 19 aa, Mycobacterium
MAVICLIGAMLFDEGRSDD

SEQ ID NO: 1130501 - protein, 17 aa, Mycobacterium
MAVWKFGALIGYAALYA

SEQ ID NO: 1130502 - protein, 25 aa, Mycobacterium
MCAILSGLFVWRWVRETKGVSLEDM

SEQ ID NO: 1130503 - protein, 17 aa, Mycobacterium
MFLVPAIMKMLGDDCWW

SEQ ID NO: 1130504 - protein, 23 aa, Mycobacterium
MGSWLVAEMVWFFGGAGRGGDEA

SEQ ID NO: 1130505 - protein, 23 aa, Mycobacterium
MHLMGRWNWWAPKPLARLHERFG

SEQ ID NO: 1130506 - protein, 24 aa, Mycobacterium
MITLPALGLWHLWSGSPQAPGERQ

SEQ ID NO: 1130507 - protein, 18 aa, Mycobacterium
MLFRPRYGALGLVALPYA

SEQ ID NO: 1130508 - protein, 18 aa, Mycobacterium
MLLVPAFMHLMGRWNWWA

SEQ ID NO: 1130509 - protein, 24 aa, Mycobacterium
MMMPRYRISWGIAINVVGGMAVIY

SEQ ID NO: 1130510 - protein, 25 aa, Mycobacterium
MPELPWFMALACFKSAATWSLIVKH

SEQ ID NO: 1130511 - protein, 26 aa, Mycobacterium
MPLVRLTASWPRRRTLLLTLVCLTAS

SEQ ID NO: 1130512 - protein, 18 aa, Mycobacterium
MTGPRPGGFGQLNDRTFE

SEQ ID NO: 1130513 - protein, 17 aa, Mycobacterium
MVFARLSVFAALGPACA

SEQ ID NO: 1130514 - protein, 19 aa, Mycobacterium
MVTLIGWWALSRVLGRLVN

SEQ ID NO: 1130515 - protein, 18 aa, Mycobacterium
NAALRWTLLTGAACNDAA

SEQ ID NO: 1130516 - protein, 19 aa, Mycobacterium
NACGLRVGVAYSVIQETDE

SEQ ID NO: 1130517 - protein, 18 aa, Mycobacterium
NAVIAWVCIAASAVGVIL

SEQ ID NO: 1130518 - protein, 17 aa, Mycobacterium
NCSWLFAWHHNRFPLSM

SEQ ID NO: 1130519 - protein, 20 aa, Mycobacterium
NEGRAAFVWIGLHEPDDHQM

SEQ ID NO: 1130520 - protein, 21 aa, Mycobacterium
NERKIRLWVVFVEDFSGQGAV

SEQ ID NO: 1130521 - protein, 23 aa, Mycobacterium
NKPLWFGVDAWRWMFLAMAVPAV

SEQ ID NO: 1130522 - protein, 24 aa, Mycobacterium
NKPSEASIGWALYALIVLSLLQAG

SEQ ID NO: 1130523 - protein, 26 aa, Mycobacterium
NNGLRPEPLIAFAVIAVWMLVENTIG

SEQ ID NO: 1130524 - protein, 18 aa, Mycobacterium
NSPFCWIGGIAFSVLATL

SEQ ID NO: 1130525 - protein, 22 aa, Mycobacterium
NVFMMFCVITLFVGHADLGLAE

SEQ ID NO: 1130526 - protein, 24 aa, Mycobacterium
NYFYWEPHCFNIPVCASMRSVFDA

SEQ ID NO: 1130527 - protein, 18 aa, Mycobacterium
NYFYWEPHCYNIPVCFAI

SEQ ID NO: 1130528 - protein, 20 aa, Mycobacterium
PAAICALTVLLLDPLLGVAG

SEQ ID NO: 1130529 - protein, 26 aa, Mycobacterium
PALAAFAAVCWWVFFEKGLASAAHDA

SEQ ID NO: 1130530 - protein, 21 aa, Mycobacterium
PAVALCFAIGLLASGLASTSV

SEQ ID NO: 1130531 - protein, 22 aa, Mycobacterium
PDPMLEWMFWTGLLVTAADVLI

SEQ ID NO: 1130532 - protein, 19 aa, Mycobacterium
PEAHLSLIWFTVCSSVVHA

SEQ ID NO: 1130533 - protein, 17 aa, Mycobacterium
PEEVLRPAYGLAEATLY

SEQ ID NO: 1130534 - protein, 18 aa, Mycobacterium
PEGIPVDVCAAIEKAMSR

SEQ ID NO: 1130535 - protein, 22 aa, Mycobacterium
PELHSPWGYPAVLLVMLTICSL

SEQ ID NO: 1130536 - protein, 23 aa, Mycobacterium
PELRGQGGWLRRIVPAAALGGVA

SEQ ID NO: 1130537 - protein, 26 aa, Mycobacterium
PELRPGRLQAVATWGPWVSIGLAVLT

SEQ ID NO: 1130538 - protein, 19 aa, Mycobacterium
PFLDYAFGFRRGMDAGQPP

SEQ ID NO: 1130539 - protein, 19 aa, Mycobacterium
PFPNFKNGVGLMLELPQPT

SEQ ID NO: 1130540 - protein, 17 aa, Mycobacterium
PGGFARRRGTASLRVGV

SEQ ID NO: 1130541 - protein, 22 aa, Mycobacterium
PGLPTRGLIALCDFGGSGTSIT

SEQ ID NO: 1130542 - protein, 18 aa, Mycobacterium
PGQRPLAVGVTWTESVTE

SEQ ID NO: 1130543 - protein, 24 aa, Mycobacterium
PGRLDWAGAVTLGLGLTVLLTGIT

SEQ ID NO: 1130544 - protein, 23 aa, Mycobacterium
PGVRGRLVLMWTVCTALPGAGIV

SEQ ID NO: 1130545 - protein, 17 aa, Mycobacterium
PIAAGLFNAIPEAPPLA

SEQ ID NO: 1130546 - protein, 25 aa, Mycobacterium
PIPRRAVRGLKVLVWSALLSVAAVG

SEQ ID NO: 1130547 - protein, 19 aa, Mycobacterium
PKLLQLRSFPTIAIGGDPD

SEQ ID NO: 1130548 - protein, 21 aa, Mycobacterium
PKSPMWLWVLAGAVVLLVVAL

SEQ ID NO: 1130549 - protein, 19 aa, Mycobacterium
PLKFAQLVGFVFAAVGTIG

SEQ ID NO: 1130550 - protein, 21 aa, Mycobacterium
PLRHPWRWVAAVVIVVLVGLF

SEQ ID NO: 1130551 - protein, 17 aa, Mycobacterium
PLRRADLLAAYGTAFSL

SEQ ID NO: 1130552 - protein, 19 aa, Mycobacterium
PLWPLHRWLPDAAVEATPA

SEQ ID NO: 1130553 - protein, 19 aa, Mycobacterium
PNSRFTISMMWSGDKAWRQ

SEQ ID NO: 1130554 - protein, 26 aa, Mycobacterium
PPPPSRWRQLPGRTRKAIFAAAILVC

SEQ ID NO: 1130555 - protein, 19 aa, Mycobacterium
PRFLPARLHRWWLYRRLAD

SEQ ID NO: 1130556 - protein, 19 aa, Mycobacterium
PRLRRWVLTTVRPRLVEVL

SEQ ID NO: 1130557 - protein, 21 aa, Mycobacterium
PRLRYDQFMAIGWKMLIPVSL

SEQ ID NO: 1130558 - protein, 20 aa, Mycobacterium
PRWVPVVGWLLVLSAISGLF

SEQ ID NO: 1130559 - protein, 21 aa, Mycobacterium
PSLRYLSYRLTMERDGADWLI

SEQ ID NO: 1130560 - protein, 22 aa, Mycobacterium
PSPRPAQVFVVAWAGMRGVVSL

SEQ ID NO: 1130561 - protein, 18 aa, Mycobacterium
PSTVWWRVSLPLLAPGLV

SEQ ID NO: 1130562 - protein, 18 aa, Mycobacterium
PSTWKFGALCAVLSAVIL

SEQ ID NO: 1130563 - protein, 26 aa, Mycobacterium
PTILYSLYWRRFNTRGALWSMYGGLI

SEQ ID NO: 1130564 - protein, 24 aa, Mycobacterium
PTIWEIGRPWYLAWAGLIYIVATL

SEQ ID NO: 1130565 - protein, 21 aa, Mycobacterium
PTQIYWRRRALALGVAVVVIG

SEQ ID NO: 1130566 - protein, 20 aa, Mycobacterium
PVERSFWYRAARAVTRRGGA

SEQ ID NO: 1130567 - protein, 17 aa, Mycobacterium
PVLRLPLALGVIHLLAR

SEQ ID NO: 1130568 - protein, 17 aa, Mycobacterium
PVLRWAWTPPLFAGSLL

SEQ ID NO: 1130569 - protein, 17 aa, Mycobacterium
PVTFVFYWVIPFLLVAA

SEQ ID NO: 1130570 - protein, 17 aa, Mycobacterium
PWHLVKWQLAAMAMLVV

SEQ ID NO: 1130571 - protein, 18 aa, Mycobacterium
PYLYAGILFFATLGALAV

SEQ ID NO: 1130572 - protein, 23 aa, Mycobacterium
QAAQLSAMWARFPLPVIPAPGDP

SEQ ID NO: 1130573 - protein, 23 aa, Mycobacterium
QAEAASALGLRWGQTQRSILLPQ

SEQ ID NO: 1130574 - protein, 21 aa, Mycobacterium
QANRIAHRWMFSDGVPQANAD

SEQ ID NO: 1130575 - protein, 21 aa, Mycobacterium
QCSVGYGVGRACDLTTTGRTV

SEQ ID NO: 1130576 - protein, 20 aa, Mycobacterium
QDVSRWAWYVVVAVAAGAVL

SEQ ID NO: 1130577 - protein, 26 aa, Mycobacterium
QELAHWDFYMGLAYFKLAIIAAGIAF

SEQ ID NO: 1130578 - protein, 17 aa, Mycobacterium
QFLRYGPRWVFKLNEPW

SEQ ID NO: 1130579 - protein, 20 aa, Mycobacterium
QIRRVDPWSALKVSLVLSVA

SEQ ID NO: 1130580 - protein, 23 aa, Mycobacterium
QLPGLRPGTGLTIVTWLLRIGFL

SEQ ID NO: 1130581 - protein, 22 aa, Mycobacterium
QLPHRRLPFWVALAMSVALVGP

SEQ ID NO: 1130582 - protein, 18 aa, Mycobacterium
QPEHFYWLTSFLAAREAQ

SEQ ID NO: 1130583 - protein, 18 aa, Mycobacterium
QRAEALAAEVARTFMEAG

SEQ ID NO: 1130584 - protein, 18 aa, Mycobacterium
QRGRPGARARLFGMTEAF

SEQ ID NO: 1130585 - protein, 20 aa, Mycobacterium
QRINLEFDLTFSPRQLCSPT

SEQ ID NO: 1130586 - protein, 21 aa, Mycobacterium
QSWTIFYWAWWISWTPFVGMF

SEQ ID NO: 1130587 - protein, 26 aa, Mycobacterium
QTFWRITLPSIRWGLTYGVVLTIART

SEQ ID NO: 1130588 - protein, 19 aa, Mycobacterium
QTVRWTLRLDVSDVDGKLM

SEQ ID NO: 1130589 - protein, 20 aa, Mycobacterium
RAVAFLAPWLFFMFIDLFDS

SEQ ID NO: 1130590 - protein, 22 aa, Mycobacterium
RDRLPIEIAIAVLVLGVLLLVY

SEQ ID NO: 1130591 - protein, 18 aa, Mycobacterium
REGCSLAFRVNEVPSGAK

SEQ ID NO: 1130592 - protein, 25 aa, Mycobacterium
REGRIAWPEALRIGVKLCGALETAH

SEQ ID NO: 1130593 - protein, 23 aa, Mycobacterium
RELTCPRWLAVLATVSFGLYLGW

SEQ ID NO: 1130594 - protein, 19 aa, Mycobacterium
REVIGYWAAVILIAARLLQ

SEQ ID NO: 1130595 - protein, 19 aa, Mycobacterium
REVWTRLAAAVVFSGVAAW

SEQ ID NO: 1130596 - protein, 25 aa, Mycobacterium
RFAFHRPWHVIAGWIVLIAVVAGVL

SEQ ID NO: 1130597 - protein, 20 aa, Mycobacterium
RFAPELMVIVPLFVIYNQIG

SEQ ID NO: 1130598 - protein, 19 aa, Mycobacterium
RFGEKRAPFALGVAALLFG

SEQ ID NO: 1130599 - protein, 17 aa, Mycobacterium
RGGLFVRQIHHWAALLF

SEQ ID NO: 1130600 - protein, 18 aa, Mycobacterium
RGLMPVVIIPLFASLVVG

SEQ ID NO: 1130601 - protein, 19 aa, Mycobacterium
RGRMAALVIGTFLVGVYGG

SEQ ID NO: 1130602 - protein, 24 aa, Mycobacterium
RGRYRGRLWISMDFVDGTDVGRLL

SEQ ID NO: 1130603 - protein, 19 aa, Mycobacterium
RHCVRRFGGITGDVLGAAI

SEQ ID NO: 1130604 - protein, 21 aa, Mycobacterium
RILFDWRFDLILGSAAIILAL

SEQ ID NO: 1130605 - protein, 28 aa, Mycobacterium
RIRGWRRLGAAVVRWPGPILLLTIALSL

SEQ ID NO: 1130606 - protein, 18 aa, Mycobacterium
RKRVVAVSFPRDLSIDPM

SEQ ID NO: 1130607 - protein, 18 aa, Mycobacterium
RLAQGFAVGGEWGGATLM

SEQ ID NO: 1130608 - protein, 19 aa, Mycobacterium
RLDDARFLLPVLGVPSEPG

SEQ ID NO: 1130609 - protein, 17 aa, Mycobacterium
RLGTRFGPYELRSLIGV

SEQ ID NO: 1130610 - protein, 19 aa, Mycobacterium
RLRRPGWSTVVAVLAVFVT

SEQ ID NO: 1130611 - protein, 18 aa, Mycobacterium
RLTGWVAALFSWRRRHLS

SEQ ID NO: 1130612 - protein, 20 aa, Mycobacterium
RLVGRFGARPSLLIAGVFIT

SEQ ID NO: 1130613 - protein, 18 aa, Mycobacterium
RNTDWVAIAWEWQAGNVF

SEQ ID NO: 1130614 - protein, 17 aa, Mycobacterium
RPAGRRLLIAAAAASVV

SEQ ID NO: 1130615 - protein, 21 aa, Mycobacterium
RPAWLALFVVVLAFAYLCFTV

SEQ ID NO: 1130616 - protein, 24 aa, Mycobacterium
RPDQPRPAGAFPYSDGRSARPVRR

SEQ ID NO: 1130617 - protein, 19 aa, Mycobacterium
RPLFWARVRRGALFKAAGV

SEQ ID NO: 1130618 - protein, 26 aa, Mycobacterium
RPPQQGRRSWGWVVAVVLVIAALVAI

SEQ ID NO: 1130619 - protein, 19 aa, Mycobacterium
RPRYINLIVLLRIACEVTA

SEQ ID NO: 1130620 - protein, 19 aa, Mycobacterium
RPSPRWRALLLAAVAACAA

SEQ ID NO: 1130621 - protein, 19 aa, Mycobacterium
RPTALAFMAGWLIGLGALT

SEQ ID NO: 1130622 - protein, 18 aa, Mycobacterium
RPYEWWRVALVAVSALAY

SEQ ID NO: 1130623 - protein, 19 aa, Mycobacterium
RQIAWGGLLFALGVIVLAV

SEQ ID NO: 1130624 - protein, 25 aa, Mycobacterium
RQLKRTAGFWGLWGIGVAAVISGDF

SEQ ID NO: 1130625 - protein, 18 aa, Mycobacterium
RQVKRWGSQWGHVRLEDD

SEQ ID NO: 1130626 - protein, 17 aa, Mycobacterium
RREFIAFLQKFVVKKRI

SEQ ID NO: 1130627 - protein, 20 aa, Mycobacterium
RRFGPGAARSVLPFAAVLSA

SEQ ID NO: 1130628 - protein, 19 aa, Mycobacterium
RRGLCWTELGLGREHWRSG

SEQ ID NO: 1130629 - protein, 20 aa, Mycobacterium
RRGTAGLGLWIVQQIIDALG

SEQ ID NO: 1130630 - protein, 21 aa, Mycobacterium
RRLDEAAGFAIPFLPRGLDTI

SEQ ID NO: 1130631 - protein, 19 aa, Mycobacterium
RRLGPMEAIPVSRTSSPYS

SEQ ID NO: 1130632 - protein, 20 aa, Mycobacterium
RRLLLCGATLFAAVSVVTAY

SEQ ID NO: 1130633 - protein, 19 aa, Mycobacterium
RRRGWPSVIALRLIPAVPF

SEQ ID NO: 1130634 - protein, 18 aa, Mycobacterium
RRRTLLLTLVCLTASQAV

SEQ ID NO: 1130635 - protein, 18 aa, Mycobacterium
RRTASSGGEWIGTVTTMR

SEQ ID NO: 1130636 - protein, 24 aa, Mycobacterium
RRTQRNVYIPWSLTVTPISQSEVG

SEQ ID NO: 1130637 - protein, 18 aa, Mycobacterium
RRWIARIAVTWGTLSALM

SEQ ID NO: 1130638 - protein, 25 aa, Mycobacterium
RRWWMLPDHFDWVTGYLRSRGMMVA

SEQ ID NO: 1130639 - protein, 20 aa, Mycobacterium
RSDYPRSRFEVVAVNDGSTD

SEQ ID NO: 1130640 - protein, 19 aa, Mycobacterium
RSGPMWSGCLIDGLDDGRF

SEQ ID NO: 1130641 - protein, 19 aa, Mycobacterium
RSLGVIGGILGALVLLIVI

SEQ ID NO: 1130642 - protein, 28 aa, Mycobacterium
RSLTRSAWRIGLFTNRWLIAGVAVQAVA

SEQ ID NO: 1130643 - protein, 17 aa, Mycobacterium
RSPRWVPVVGWLLVLSA

SEQ ID NO: 1130644 - protein, 24 aa, Mycobacterium
RTDQLFCVAIGFLTTISAAASIGG

SEQ ID NO: 1130645 - protein, 23 aa, Mycobacterium
RTHFGDDLLYVWRHFPLERAHPR

SEQ ID NO: 1130646 - protein, 23 aa, Mycobacterium
RTIKGNLFWAFAYNVAALPLAAF

SEQ ID NO: 1130647 - protein, 22 aa, Mycobacterium
RTRLAEVLGRIYGRPASLQLHI

SEQ ID NO: 1130648 - protein, 21 aa, Mycobacterium
RTVIIPALFTLIGPKIWWPAL

SEQ ID NO: 1130649 - protein, 17 aa, Mycobacterium
RVFLPFGLDPDRTPVMG

SEQ ID NO: 1130650 - protein, 20 aa, Mycobacterium
RVNSFTSMFVFIGAVVYLMA

SEQ ID NO: 1130651 - protein, 18 aa, Mycobacterium
RVRFVRRKWTAITLAATP

SEQ ID NO: 1130652 - protein, 19 aa, Mycobacterium
RVTRGEWLWALLLTAALTV

SEQ ID NO: 1130653 - protein, 20 aa, Mycobacterium
RVTRWEWLWAALLAGAVAVI

SEQ ID NO: 1130654 - protein, 18 aa, Mycobacterium
RWAVFGAWVLLLVPAIYL

SEQ ID NO: 1130655 - protein, 20 aa, Mycobacterium
RWIYVPAVAGALFVGLPVVS

SEQ ID NO: 1130656 - protein, 20 aa, Mycobacterium
RWSVMFLVAVGFWNFLGAGV

SEQ ID NO: 1130657 - protein, 23 aa, Mycobacterium
RYGGLRKALPITFATFGLGYLAI

SEQ ID NO: 1130658 - protein, 19 aa, Mycobacterium
SAGFLPWFVDIDRQMYFFY

SEQ ID NO: 1130659 - protein, 18 aa, Mycobacterium
SAISVLWPPTGMVAAISA

SEQ ID NO: 1130660 - protein, 23 aa, Mycobacterium
SALRLKGRLLFMPNVMVTSVPWQ

SEQ ID NO: 1130661 - protein, 20 aa, Mycobacterium
SAPCKAWLLAHPLLLGVVLL

SEQ ID NO: 1130662 - protein, 19 aa, Mycobacterium
SAVSSRAGVEIAIDDDGVG

SEQ ID NO: 1130663 - protein, 21 aa, Mycobacterium
SELRVKMWLFPVLSVLTAVGI

SEQ ID NO: 1130664 - protein, 19 aa, Mycobacterium
SFIGIVMVLLWWRRPVEEA

SEQ ID NO: 1130665 - protein, 20 aa, Mycobacterium
SFLSWGWRVAFWLSAVVVLI

SEQ ID NO: 1130666 - protein, 18 aa, Mycobacterium
SFMLLWVLQACVFWRGME

SEQ ID NO: 1130667 - protein, 18 aa, Mycobacterium
SFPTRVGLMTGVYTAALQ

SEQ ID NO: 1130668 - protein, 23 aa, Mycobacterium
SFPVVAYRSWRWWLGSAAAFFLV

SEQ ID NO: 1130669 - protein, 21 aa, Mycobacterium
SFVLQEFVHFILPKIIKGYGG

SEQ ID NO: 1130670 - protein, 25 aa, Mycobacterium
SGDIAIAVPAHWGTATVYALRNALR

SEQ ID NO: 1130671 - protein, 18 aa, Mycobacterium
SGLGPVFGRALAKSPDKR

SEQ ID NO: 1130672 - protein, 19 aa, Mycobacterium
SGMDLGPWLVSRDITVVST

SEQ ID NO: 1130673 - protein, 22 aa, Mycobacterium
SGYRVPPSLVRRADGQTVQLTP

SEQ ID NO: 1130674 - protein, 24 aa, Mycobacterium
SITSRLPLVLGIIAGISFVLLFLL

SEQ ID NO: 1130675 - protein, 17 aa, Mycobacterium
SLIPIVIGYVFAHYLTY

SEQ ID NO: 1130676 - protein, 18 aa, Mycobacterium
SLPMRRLVGFAATAVDAS

SEQ ID NO: 1130677 - protein, 24 aa, Mycobacterium
SLVGRLGDHILFYGRALAGTPHAA

SEQ ID NO: 1130678 - protein, 18 aa, Mycobacterium
SLVRSGMDLGPWLVSRDI

SEQ ID NO: 1130679 - protein, 21 aa, Mycobacterium
SLVVGAGWPLVVEQFSVKPNA

SEQ ID NO: 1130680 - protein, 23 aa, Mycobacterium
SPEVKKGATFDCEVSIDGTKREV

SEQ ID NO: 1130681 - protein, 18 aa, Mycobacterium
SPVSIGLPLPGWDLAVVD

SEQ ID NO: 1130682 - protein, 20 aa, Mycobacterium
SRAAADIADWVQARYPGRTV

SEQ ID NO: 1130683 - protein, 40 aa, Mycobacterium
SRIKPTLLGALPWRWGDPHARLLKPWARIVVTVWVVVVVP

SEQ ID NO: 1130684 - protein, 17 aa, Mycobacterium
SSLRPGSLEALLPPDQR

SEQ ID NO: 1130685 - protein, 20 aa, Mycobacterium
STDSLLRFALRADATLCAAL

SEQ ID NO: 1130686 - protein, 18 aa, Mycobacterium
STTLKWRGSAVLRAVLFT

SEQ ID NO: 1130687 - protein, 20 aa, Mycobacterium
SVGWLYWYFWVIVVGFEAIA

SEQ ID NO: 1130688 - protein, 21 aa, Mycobacterium
SVKSYGEFEFWFAGIKVAAIV

SEQ ID NO: 1130689 - protein, 21 aa, Mycobacterium
SVSIPSWWQPYVLSVGSLTST

SEQ ID NO: 1130690 - protein, 22 aa, Mycobacterium
SVWKRIAAVLLRIEPWLPKALF

SEQ ID NO: 1130691 - protein, 24 aa, Mycobacterium
SYHLTVWQRIRWIQLPSMLPYLAT

SEQ ID NO: 1130692 - protein, 18 aa, Mycobacterium
TAAAYRPSYSYVRDYISE

SEQ ID NO: 1130693 - protein, 21 aa, Mycobacterium
TAAYLWSLWALFFTHAGMPGM

SEQ ID NO: 1130694 - protein, 24 aa, Mycobacterium
TAKDRLRAGLAIVFQQFNLFQHMT

SEQ ID NO: 1130695 - protein, 19 aa, Mycobacterium
TAVTCLKPHIGVFVVIILI

SEQ ID NO: 1130696 - protein, 23 aa, Mycobacterium
TDGLIRLWPAWEFYIGNYTIPQP

SEQ ID NO: 1130697 - protein, 24 aa, Mycobacterium
TDRLWPLRWLRNAALLFTFLNAFV

SEQ ID NO: 1130698 - protein, 21 aa, Mycobacterium
TESRQAFKIQQWRNKVRNHTV

SEQ ID NO: 1130699 - protein, 19 aa, Mycobacterium
TFAASFGFMLPVSTPQNAI

SEQ ID NO: 1130700 - protein, 22 aa, Mycobacterium
TFLRNIRPILGLGVGLVVITTF

SEQ ID NO: 1130701 - protein, 19 aa, Mycobacterium
TGDRFGRRRVFQIGLTVFA

SEQ ID NO: 1130702 - protein, 19 aa, Mycobacterium
TGIAGWVFAWLAERSGSLV

SEQ ID NO: 1130703 - protein, 18 aa, Mycobacterium
TGLMPRPLVYVTYLVAVA

SEQ ID NO: 1130704 - protein, 25 aa, Mycobacterium
TGTPAWEMFKPWSIISIAVAVVLAF

SEQ ID NO: 1130705 - protein, 24 aa, Mycobacterium
TGVLPRWSAGLAVFGVLPLLHTWV

SEQ ID NO: 1130706 - protein, 20 aa, Mycobacterium
TGWEQLRILGLIGAAAAVGN

SEQ ID NO: 1130707 - protein, 25 aa, Mycobacterium
TIRALAVPIILVWIAIVAVLNVIVP

SEQ ID NO: 1130708 - protein, 18 aa, Mycobacterium
TLCPLLVLGIWWRGLTAV

SEQ ID NO: 1130709 - protein, 17 aa, Mycobacterium
TLFPHAWVQTKRLLMRF

SEQ ID NO: 1130710 - protein, 17 aa, Mycobacterium
TLLRIRLPQALRVITPA

SEQ ID NO: 1130711 - protein, 20 aa, Mycobacterium
TLPFLWNIFRSWRYGEPVTV

SEQ ID NO: 1130712 - protein, 18 aa, Mycobacterium
TLPLGLVFGWLGKRLAVA

SEQ ID NO: 1130713 - protein, 24 aa, Mycobacterium
TMLLRLCMLPGLILLIWAAPRVAR

SEQ ID NO: 1130714 - protein, 21 aa, Mycobacterium
TPAHPRWFFLWTTPGRILTIG

SEQ ID NO: 1130715 - protein, 17 aa, Mycobacterium
TPDGLYCKLPQDSPIGV

SEQ ID NO: 1130716 - protein, 19 aa, Mycobacterium
TPWSWLPRIVMQFTAGAFA

SEQ ID NO: 1130717 - protein, 18 aa, Mycobacterium
TRRAASWLAALAVPAAIC

SEQ ID NO: 1130718 - protein, 23 aa, Mycobacterium
TSRFWRRSGIRIVRRPVPHLIAS

SEQ ID NO: 1130719 - protein, 18 aa, Mycobacterium
TVMSRLMLVLGVAPVLAP

SEQ ID NO: 1130720 - protein, 24 aa, Mycobacterium
TVPLSLLAIRWITRRSQRLFVAQW

SEQ ID NO: 1130721 - protein, 20 aa, Mycobacterium
TVPVPTGFAAIRLRGLIHAP

SEQ ID NO: 1130722 - protein, 23 aa, Mycobacterium
TWLGRFVSTYGWRAYALPILAVL

SEQ ID NO: 1130723 - protein, 19 aa, Mycobacterium
TWLIYRITRRVGRKQRESG

SEQ ID NO: 1130724 - protein, 17 aa, Mycobacterium
TYFYGLGALIVFLGALA

SEQ ID NO: 1130725 - protein, 18 aa, Mycobacterium
VAAGGLLIALGFLFAGYD

SEQ ID NO: 1130726 - protein, 18 aa, Mycobacterium
VAFQACFVSAGAVAARFG

SEQ ID NO: 1130727 - protein, 22 aa, Mycobacterium
VAGSWWLFEWELAHGAEVTEAR

SEQ ID NO: 1130728 - protein, 21 aa, Mycobacterium
VAGWLAGWVYMWALVIIMATV

SEQ ID NO: 1130729 - protein, 19 aa, Mycobacterium
VAIAWEWQAGNVFQRVTIV

SEQ ID NO: 1130730 - protein, 17 aa, Mycobacterium
VALAFLAMVFARLSVFA

SEQ ID NO: 1130731 - protein, 21 aa, Mycobacterium
VALILFRWIARRVVASVREKY

SEQ ID NO: 1130732 - protein, 22 aa, Mycobacterium
VAPCLPGATLLSVDGDEFTGAV

SEQ ID NO: 1130733 - protein, 18 aa, Mycobacterium
VAQLGVACAVAIAVDATI

SEQ ID NO: 1130734 - protein, 26 aa, Mycobacterium
VAVAITGLWLWIGYDALLLIVATQIL

SEQ ID NO: 1130735 - protein, 18 aa, Mycobacterium
VAVARWRGLRALVGIVVA

SEQ ID NO: 1130736 - protein, 20 aa, Mycobacterium
VAVYLWRMWVSRGRPGGVAA

SEQ ID NO: 1130737 - protein, 18 aa, Mycobacterium
VCMIWRLVGQGLKHTPQN

SEQ ID NO: 1130738 - protein, 19 aa, Mycobacterium
VDAGLWVAFWFFLAQLNFV

SEQ ID NO: 1130739 - protein, 17 aa, Mycobacterium
VDALRLTAGFAKVDPVG

SEQ ID NO: 1130740 - protein, 20 aa, Mycobacterium
VDAPDFWALLALRAVVFAVV

SEQ ID NO: 1130741 - protein, 18 aa, Mycobacterium
VDVCAAIEKAMSREPADR

SEQ ID NO: 1130742 - protein, 23 aa, Mycobacterium
VEGPLRPGHWVMFAAVSVSALAA

SEQ ID NO: 1130743 - protein, 21 aa, Mycobacterium
VGACLRIPYTLATARFGGRNW

SEQ ID NO: 1130744 - protein, 19 aa, Mycobacterium
VGLKTRFGYDDSLDVVGVH

SEQ ID NO: 1130745 - protein, 17 aa, Mycobacterium
VGMVAAWAVLLTAQRSS

SEQ ID NO: 1130746 - protein, 19 aa, Mycobacterium
VGVLVGWGLLELFPGDLER

SEQ ID NO: 1130747 - protein, 23 aa, Mycobacterium
VHLRISVGLTRFIGWCQWASVVG

SEQ ID NO: 1130748 - protein, 17 aa, Mycobacterium
VHRARPGLITPWRRRRT

SEQ ID NO: 1130749 - protein, 23 aa, Mycobacterium
VIRLPRPQLPPIFRDDDEPERPS

SEQ ID NO: 1130750 - protein, 19 aa, Mycobacterium
VIVAICLRQFVASWENRRL

SEQ ID NO: 1130751 - protein, 21 aa, Mycobacterium
VKALLTFQPWWTAMRSGSRTA

SEQ ID NO: 1130752 - protein, 30 aa, Mycobacterium
VKLGLMCLAAFPILVALVWWFRNESAKTYR

SEQ ID NO: 1130753 - protein, 17 aa, Mycobacterium
VLACGWGFLGWGMALYL

SEQ ID NO: 1130754 - protein, 19 aa, Mycobacterium
VLATLCLRASDGFRKKVWM

SEQ ID NO: 1130755 - protein, 18 aa, Mycobacterium
VLFGRLGDMFGRVRIYNL

SEQ ID NO: 1130756 - protein, 19 aa, Mycobacterium
VLFPMYFLKSFAYAGLAVV

SEQ ID NO: 1130757 - protein, 17 aa, Mycobacterium
VLGVLPLIVLTQLGIIV

SEQ ID NO: 1130758 - protein, 20 aa, Mycobacterium
VLLFCIAFGLSMDYEVFLMA

SEQ ID NO: 1130759 - protein, 19 aa, Mycobacterium
VLLHASWQWVFAALVVLAG

SEQ ID NO: 1130760 - protein, 23 aa, Mycobacterium
VLRNWPAWLAVYGFMTMDRWLMW

SEQ ID NO: 1130761 - protein, 19 aa, Mycobacterium
VLSRMPLVLGIIGLTSLVL

SEQ ID NO: 1130762 - protein, 20 aa, Mycobacterium
VLVLGFWKPGFFVTTKLDVN

SEQ ID NO: 1130763 - protein, 17 aa, Mycobacterium
VMLRRAWTPGAFSLGRA

SEQ ID NO: 1130764 - protein, 19 aa, Mycobacterium
VNVSLPWSKTVVLDPGVEL

SEQ ID NO: 1130765 - protein, 18 aa, Mycobacterium
VPGCRDAAMVDFRDTIWL

SEQ ID NO: 1130766 - protein, 17 aa, Mycobacterium
VPICALAVLLTAIFVPE

SEQ ID NO: 1130767 - protein, 24 aa, Mycobacterium
VPPPDRGPITWVVVIGAGLTLVLG

SEQ ID NO: 1130768 - protein, 19 aa, Mycobacterium
VQLGKDWLWLHAARTAAVT

SEQ ID NO: 1130769 - protein, 18 aa, Mycobacterium
VRAQRWWLALNVLGALLI

SEQ ID NO: 1130770 - protein, 18 aa, Mycobacterium
VREYDLKLILAFGTVSQL

SEQ ID NO: 1130771 - protein, 20 aa, Mycobacterium
VRGARRWRDRLGYAFGPPGW

SEQ ID NO: 1130772 - protein, 22 aa, Mycobacterium
VRGTPKWGDWSLRIVAGLVLLY

SEQ ID NO: 1130773 - protein, 28 aa, Mycobacterium
VRKAAAWSWRLLIIFGALVAVLWLVARL

SEQ ID NO: 1130774 - protein, 19 aa, Mycobacterium
VRVIFGVGMVAAWAVLLTA

SEQ ID NO: 1130775 - protein, 19 aa, Mycobacterium
VSAIMWVWYKAFAFLLGPD

SEQ ID NO: 1130776 - protein, 18 aa, Mycobacterium
VSLIPTLLVAIPFTVLVA

SEQ ID NO: 1130777 - protein, 19 aa, Mycobacterium
VSLVLSVALFFVWMIAVAF

SEQ ID NO: 1130778 - protein, 25 aa, Mycobacterium
VSSQFGVSVPDFWLGILLIALFSST

SEQ ID NO: 1130779 - protein, 18 aa, Mycobacterium
VTFIPWPVIEGFTLGIAV

SEQ ID NO: 1130780 - protein, 18 aa, Mycobacterium
VTGFGWRAVFLALAVLNL

SEQ ID NO: 1130781 - protein, 19 aa, Mycobacterium
VTGTACWYALFFAISQIPL

SEQ ID NO: 1130782 - protein, 23 aa, Mycobacterium
VTLELPAAGGLYRFSNVTYRGVQ

SEQ ID NO: 1130783 - protein, 17 aa, Mycobacterium
VTPKFTRMIVAGLFGVL

SEQ ID NO: 1130784 - protein, 17 aa, Mycobacterium
VVAYCFLEVWRVQILVY

SEQ ID NO: 1130785 - protein, 17 aa, Mycobacterium
VVQAKLWLQDAIAGMPR

SEQ ID NO: 1130786 - protein, 19 aa, Mycobacterium
VWGAWPFHRAAWMNLRHGA

SEQ ID NO: 1130787 - protein, 23 aa, Mycobacterium
VYYWVICLVLSFGQGRIERRLER

SEQ ID NO: 1130788 - protein, 17 aa, Mycobacterium
WAAMLGWIVLDGTWAQW

SEQ ID NO: 1130789 - protein, 25 aa, Mycobacterium
WADRRFNLGHGRLFALYVAGYCLGR

SEQ ID NO: 1130790 - protein, 17 aa, Mycobacterium
WAFSLAMVDGWQRGFAG

SEQ ID NO: 1130791 - protein, 24 aa, Mycobacterium
WAGACLPLGLALCLLFTGLFFAKP

SEQ ID NO: 1130792 - protein, 19 aa, Mycobacterium
WALVPGIPLLWDLVITLTA

SEQ ID NO: 1130793 - protein, 19 aa, Mycobacterium
WAPGRFALWVAFWAGWATV

SEQ ID NO: 1130794 - protein, 25 aa, Mycobacterium
WARQRAKRALLFWVVAVITLAGLLA

SEQ ID NO: 1130795 - protein, 17 aa, Mycobacterium
WCAGVVWGAARARELLS

SEQ ID NO: 1130796 - protein, 20 aa, Mycobacterium
WEISRPWYLAWAEMVYIVAS

SEQ ID NO: 1130797 - protein, 22 aa, Mycobacterium
WEISRPWYLAWAGLAYVVAAVA

SEQ ID NO: 1130798 - protein, 24 aa, Mycobacterium
WEPHCYNIPVCFAIRSVFDTLDGI

SEQ ID NO: 1130799 - protein, 20 aa, Mycobacterium
WFLRFLVRHGMYWFVGYRVV

SEQ ID NO: 1130800 - protein, 25 aa, Mycobacterium
WGNCTIKVMVGFLFLYPAFVAKSHD

SEQ ID NO: 1130801 - protein, 17 aa, Mycobacterium
WGPTHIRRAAAAAVVGL

SEQ ID NO: 1130802 - protein, 21 aa, Mycobacterium
WGWRNRPVWRWFAFGAAVGVA

SEQ ID NO: 1130803 - protein, 18 aa, Mycobacterium
WIHRRGRRLLAHAASMVF

SEQ ID NO: 1130804 - protein, 20 aa, Mycobacterium
WILCAAIAYNLLRAVGVLAG

SEQ ID NO: 1130805 - protein, 17 aa, Mycobacterium
WKCTLCYDRLHDGLEPA

SEQ ID NO: 1130806 - protein, 19 aa, Mycobacterium
WKPVGGFPVTAGWIHAVRR

SEQ ID NO: 1130807 - protein, 17 aa, Mycobacterium
WLWWQYALADTRYVSGN

SEQ ID NO: 1130808 - protein, 19 aa, Mycobacterium
WNIFRSWRYGEPVTVDDPW

SEQ ID NO: 1130809 - protein, 18 aa, Mycobacterium
WNRRRYRLPSALPGVALL

SEQ ID NO: 1130810 - protein, 18 aa, Mycobacterium
WPSAPRWVGVPLYLMLGY

SEQ ID NO: 1130811 - protein, 21 aa, Mycobacterium
WPSVIALRLIPAVPFAVLNYA

SEQ ID NO: 1130812 - protein, 17 aa, Mycobacterium
WPYILVAVIFRFMDNLK

SEQ ID NO: 1130813 - protein, 18 aa, Mycobacterium
WQFAFKYALGRTIAALGV

SEQ ID NO: 1130814 - protein, 25 aa, Mycobacterium
WQRVKGRLLALLGFTALEAVAVLLL

SEQ ID NO: 1130815 - protein, 21 aa, Mycobacterium
WRAAQVFRLLSWVYALGFQLS

SEQ ID NO: 1130816 - protein, 17 aa, Mycobacterium
WRIWLSRNLIDDWLDHH

SEQ ID NO: 1130817 - protein, 20 aa, Mycobacterium
WRNLRFPLAWAPPEANVARI

SEQ ID NO: 1130818 - protein, 19 aa, Mycobacterium
WRSPAAATRAEWIAGAAVG

SEQ ID NO: 1130819 - protein, 20 aa, Mycobacterium
WRWFGSINWAAWWIAVPLVI

SEQ ID NO: 1130820 - protein, 18 aa, Mycobacterium
WSSPFWQTWDLLLLWLAQ

SEQ ID NO: 1130821 - protein, 18 aa, Mycobacterium
WVMGGCMLGMISIMIFTG

SEQ ID NO: 1130822 - protein, 18 aa, Mycobacterium
WVQTKRLLMRFLRDPMTF

SEQ ID NO: 1130823 - protein, 19 aa, Mycobacterium
WVVAAGFLFYFARSWIETL

SEQ ID NO: 1130824 - protein, 18 aa, Mycobacterium
WWALSRVLGRLVNIPDVH

SEQ ID NO: 1130825 - protein, 17 aa, Mycobacterium
WWAYPLLLAFCTFDAVV

SEQ ID NO: 1130826 - protein, 17 aa, Mycobacterium
WYFWPIWPILGAGIGVL

SEQ ID NO: 1130827 - protein, 20 aa, Mycobacterium
YAVCSRRWWLSGLLVGLAAG

SEQ ID NO: 1130828 - protein, 19 aa, Mycobacterium
YDIERLWSLIGLVPQRGYL

SEQ ID NO: 1130829 - protein, 18 aa, Mycobacterium
YEGFPADVLYDFRLYSLG

SEQ ID NO: 1130830 - protein, 17 aa, Mycobacterium
YFTYGDVLGFVYAQAKF

SEQ ID NO: 1130831 - protein, 17 aa, Mycobacterium
YGADFGFVSYDPAWVEG

SEQ ID NO: 1130832 - protein, 23 aa, Mycobacterium
YGARSSWFAALAVVALGLFIGGL

SEQ ID NO: 1130833 - protein, 19 aa, Mycobacterium
YGPRWVFKLNEPWWGLIHV

SEQ ID NO: 1130834 - protein, 20 aa, Mycobacterium
YIGIRYERWMAIAAMATLLF

SEQ ID NO: 1130835 - protein, 19 aa, Mycobacterium
YLDLPRLWQILLIVGLFLW

SEQ ID NO: 1130836 - protein, 17 aa, Mycobacterium
YLFMAGMFVMLGWGLFQ

SEQ ID NO: 1130837 - protein, 18 aa, Mycobacterium
YNTALGLAMVFGRFLPII

SEQ ID NO: 1130838 - protein, 17 aa, Mycobacterium
YPGPGIGLIIGWLAVIV

SEQ ID NO: 1130839 - protein, 22 aa, Mycobacterium
YRIGALCPYCMVVWAVTVPLLV

SEQ ID NO: 1130840 - protein, 21 aa, Mycobacterium
YRKEVLRLIAEIGMGTGAMAV

SEQ ID NO: 1130841 - protein, 20 aa, Mycobacterium
YRLSDPGLRRPVVYPRGTLV

SEQ ID NO: 1130842 - protein, 19 aa, Mycobacterium
YRLVSWIFLAAIGWVVFFF

SEQ ID NO: 1130843 - protein, 17 aa, Mycobacterium
YRVRAALKYVWRDKPLF

SEQ ID NO: 1130844 - protein, 18 aa, Mycobacterium
YRVWKFRGTWPIWHGAGW

SEQ ID NO: 1130845 - protein, 21 aa, Mycobacterium
YSDDTWRLWSYSWEAKEPGRY

SEQ ID NO: 1130846 - protein, 19 aa, Mycobacterium
YWPAAFGLFAFVWLELASP

SEQ ID NO: 1130847 - protein, 17 aa, Mycobacterium
YWTKLGWSERGPIKTQS

SEQ ID NO: 1130848 - protein, 22 aa, Mycobacterium
YYMAETNLRFILGKSSTVEIPF

SEQ ID NO: 1130849 - protein, 18 aa, Mycobacterium
AAAAREWEWLKWTPHHRS

SEQ ID NO: 1130850 - protein, 22 aa, Mycobacterium
AAEPLFGSWGVRLTVAVAVVAT

SEQ ID NO: 1130851 - protein, 19 aa, Mycobacterium
AAFAERWLAPLSFAGIFVT

SEQ ID NO: 1130852 - protein, 25 aa, Mycobacterium
AAIDSRWKWIAGVAGAVLLVAVICT

SEQ ID NO: 1130853 - protein, 19 aa, Mycobacterium
AALICLGAALLLTRRTPRT

SEQ ID NO: 1130854 - protein, 23 aa, Mycobacterium
AALRAWCGMAGYILATQYWLLPS

SEQ ID NO: 1130855 - protein, 17 aa, Mycobacterium
AALVACRRGIPAAEGSA

SEQ ID NO: 1130856 - protein, 17 aa, Mycobacterium
AARGMLGVARWNLASST

SEQ ID NO: 1130857 - protein, 17 aa, Mycobacterium
AATLWVVRWPTRAQSVA

SEQ ID NO: 1130858 - protein, 18 aa, Mycobacterium
ACGGLRMTHDLLHGDLAA

SEQ ID NO: 1130859 - protein, 17 aa, Mycobacterium
ACLRAGVIALVLLAILA

SEQ ID NO: 1130860 - protein, 17 aa, Mycobacterium
ACRRRGIPLPAFGDAIA

SEQ ID NO: 1130861 - protein, 23 aa, Mycobacterium
ADEVPRTLALDGLGRYRVIALPA

SEQ ID NO: 1130862 - protein, 20 aa, Mycobacterium
ADFWRFWVVHLWVEDFLELF

SEQ ID NO: 1130863 - protein, 19 aa, Mycobacterium
AEGSIDWLGAVGLAAGLSA

SEQ ID NO: 1130864 - protein, 21 aa, Mycobacterium
AEIVFACFLYRAWNLPVAVLA

SEQ ID NO: 1130865 - protein, 23 aa, Mycobacterium
AENYLRLNALGAYGSFFNIFYCS

SEQ ID NO: 1130866 - protein, 24 aa, Mycobacterium
AENYLRLNALGAYGSFFNIFYCST

SEQ ID NO: 1130867 - protein, 17 aa, Mycobacterium
AESWRWIVLGAVAVVAI

SEQ ID NO: 1130868 - protein, 21 aa, Mycobacterium
AFLSYGWRIAFLVSVVLVIFG

SEQ ID NO: 1130869 - protein, 21 aa, Mycobacterium
AFMRVLGRWNWWSPKPLARLH

SEQ ID NO: 1130870 - protein, 19 aa, Mycobacterium
AFRIWEGGLGIWGAVALGG

SEQ ID NO: 1130871 - protein, 23 aa, Mycobacterium
AFRRVVLPLLWPGIVAALLVVFF

SEQ ID NO: 1130872 - protein, 24 aa, Mycobacterium
AFVALRWWPLVLLVAVTVALVALA

SEQ ID NO: 1130873 - protein, 25 aa, Mycobacterium
AGALVIRLARTWSLAVSMVVLVLIP

SEQ ID NO: 1130874 - protein, 22 aa, Mycobacterium
AGDPRAAYEWHMRSAAWSRQRD

SEQ ID NO: 1130875 - protein, 17 aa, Mycobacterium
AGDRAKLTLAIRSDEMK

SEQ ID NO: 1130876 - protein, 19 aa, Mycobacterium
AGGAAVFAERAFKRPVVSF

SEQ ID NO: 1130877 - protein, 18 aa, Mycobacterium
AGIGVAFGRRRRTVVIAG

SEQ ID NO: 1130878 - protein, 22 aa, Mycobacterium
AGMPGMRMAFSLLPDAGSETEH

SEQ ID NO: 1130879 - protein, 17 aa, Mycobacterium
AGQARSPMFGFFPVMMV

SEQ ID NO: 1130880 - protein, 19 aa, Mycobacterium
AGRQPLWWHYAVAAALILA

SEQ ID NO: 1130881 - protein, 19 aa, Mycobacterium
AGVAYAWWPDEAAYRPIQP

SEQ ID NO: 1130882 - protein, 18 aa, Mycobacterium
AIAALLVAVIVWLVVQLV

SEQ ID NO: 1130883 - protein, 21 aa, Mycobacterium
AIAALVGRANWWPSRVTASPG

SEQ ID NO: 1130884 - protein, 19 aa, Mycobacterium
AITSRLPLVLGLIAVSTFC

SEQ ID NO: 1130885 - protein, 23 aa, Mycobacterium
AIVGLGGVAGWLGYRIVDDRRAQ

SEQ ID NO: 1130886 - protein, 18 aa, Mycobacterium
ALGCGLALDGWRRGYQLW

SEQ ID NO: 1130887 - protein, 18 aa, Mycobacterium
ALRWRRGLVAGGCAEHGE

SEQ ID NO: 1130888 - protein, 24 aa, Mycobacterium
ALVVLWRWRWVRLAAGAAVLGLVA

SEQ ID NO: 1130889 - protein, 19 aa, Mycobacterium
APKRLAMQYARRWALVVAS

SEQ ID NO: 1130890 - protein, 18 aa, Mycobacterium
APVLGWWAGVLVQILPQR

SEQ ID NO: 1130891 - protein, 23 aa, Mycobacterium
AQFGSWRWAFGVLVGLTVAMGVL

SEQ ID NO: 1130892 - protein, 17 aa, Mycobacterium
AQYSWFIGCGVAFALYY

SEQ ID NO: 1130893 - protein, 20 aa, Mycobacterium
ARLRPRFASLVGLSEVLFAV

SEQ ID NO: 1130894 - protein, 23 aa, Mycobacterium
ARSPMFGFFPVMMVMSLVGTLAF

SEQ ID NO: 1130895 - protein, 18 aa, Mycobacterium
ARYLSLFLVLLVGAFLLV

SEQ ID NO: 1130896 - protein, 20 aa, Mycobacterium
ASCDSCAAVAVAYQVVFVID

SEQ ID NO: 1130897 - protein, 20 aa, Mycobacterium
ATIIRMFLVPAIMKMLGDDC

SEQ ID NO: 1130898 - protein, 19 aa, Mycobacterium
AVAALVCAFLFAPLGIVFG

SEQ ID NO: 1130899 - protein, 21 aa, Mycobacterium
AVDLPRIIGNALKPATPALAK

SEQ ID NO: 1130900 - protein, 17 aa, Mycobacterium
AVFWGVQTWDVWDAGDR

SEQ ID NO: 1130901 - protein, 17 aa, Mycobacterium
AVLSYWLLERPIRRWRP

SEQ ID NO: 1130902 - protein, 22 aa, Mycobacterium
AVRDMFGWIGPVLMALNGNAVC

SEQ ID NO: 1130903 - protein, 23 aa, Mycobacterium
AVRPELKPALAQQNWGTLPDLQT

SEQ ID NO: 1130904 - protein, 22 aa, Mycobacterium
AVSPRRPRRWGLPLIATVAALL

SEQ ID NO: 1130905 - protein, 22 aa, Mycobacterium
AVTAWGWRIGFFIGGIAALVVL

SEQ ID NO: 1130906 - protein, 18 aa, Mycobacterium
AVTGWFGYQAYRSDQDTK

SEQ ID NO: 1130907 - protein, 25 aa, Mycobacterium
AYDIALFYRYAWRNPTFTEIVATRT

SEQ ID NO: 1130908 - protein, 23 aa, Mycobacterium
CDVVLCALPARYLTPTSDKKPAP

SEQ ID NO: 1130909 - protein, 20 aa, Mycobacterium
CGAGFALASAHSWRIKTKWF

SEQ ID NO: 1130910 - protein, 19 aa, Mycobacterium
CNPDHEIGALVMLDPEATR

SEQ ID NO: 1130911 - protein, 20 aa, Mycobacterium
DDLRASLPLLTRGLIGRRRP

SEQ ID NO: 1130912 - protein, 24 aa, Mycobacterium
DDQMHDWGWRLPFLLAAPLGLVGV

SEQ ID NO: 1130913 - protein, 32 aa, Mycobacterium
DGARFTWRMVLVMVGALLVWLLVVLTLMRISG

SEQ ID NO: 1130914 - protein, 23 aa, Mycobacterium
DGARPDTALSRWLPDTATPTGPG

SEQ ID NO: 1130915 - protein, 18 aa, Mycobacterium
DLGREFIDMYGFTNPTTD

SEQ ID NO: 1130916 - protein, 19 aa, Mycobacterium
DMYRYAVAIGLDIEQFDQD

SEQ ID NO: 1130917 - protein, 24 aa, Mycobacterium
DPAPRPRRRLGLLLSVAAVVLVLD

SEQ ID NO: 1130918 - protein, 17 aa, Mycobacterium
DRFDAFNANTWTFRPPP

SEQ ID NO: 1130919 - protein, 19 aa, Mycobacterium
DSGFPFFLPSGFEFQVTLI

SEQ ID NO: 1130920 - protein, 22 aa, Mycobacterium
DSLRKAFGWFVLAMSWVILGQE

SEQ ID NO: 1130921 - protein, 20 aa, Mycobacterium
DTRTGLYWVPGSRGYDDAVA

SEQ ID NO: 1130922 - protein, 20 aa, Mycobacterium
EARPRLILGAAMITLPALGL

SEQ ID NO: 1130923 - protein, 18 aa, Mycobacterium
EIEGLRFSKANWARATRK

SEQ ID NO: 1130924 - protein, 24 aa, Mycobacterium
EIKKHKRWPWIAGAVVAVLAVTGG

SEQ ID NO: 1130925 - protein, 20 aa, Mycobacterium
ELGQPIAIEYVWGRQIGENT

SEQ ID NO: 1130926 - protein, 18 aa, Mycobacterium
EPVRRRWLTWSRYTRTWE

SEQ ID NO: 1130927 - protein, 18 aa, Mycobacterium
ESLFRLDHLAARMRRNGA

SEQ ID NO: 1130928 - protein, 17 aa, Mycobacterium
ETWWAWQASGLFLITLM

SEQ ID NO: 1130929 - protein, 20 aa, Mycobacterium
EVCTRLPIRAILMVVAATVA

SEQ ID NO: 1130930 - protein, 17 aa, Mycobacterium
FATALPWLAGRLRTPEV

SEQ ID NO: 1130931 - protein, 19 aa, Mycobacterium
FIAWLAWLALHLVYLVGFK

SEQ ID NO: 1130932 - protein, 20 aa, Mycobacterium
FKPPFQWREFLLQTWFVARV

SEQ ID NO: 1130933 - protein, 18 aa, Mycobacterium
FLEQSWFVARVSLVPTLM

SEQ ID NO: 1130934 - protein, 25 aa, Mycobacterium
FLQQELPALFVPGSPALVVMVMPAV

SEQ ID NO: 1130935 - protein, 18 aa, Mycobacterium
FLVRTVIIPALFTLIGPK

SEQ ID NO: 1130936 - protein, 26 aa, Mycobacterium
FMEAGGWRLPGLAAFMVTASETLGGI

SEQ ID NO: 1130937 - protein, 17 aa, Mycobacterium
FPMYFLKSFAYAGVATV

SEQ ID NO: 1130938 - protein, 17 aa, Mycobacterium
FPRRQVWAPAAAVAAIT

SEQ ID NO: 1130939 - protein, 17 aa, Mycobacterium
FPTRSTFPGVFSDGGPV

SEQ ID NO: 1130940 - protein, 17 aa, Mycobacterium
FQPDLCADVPIVGLVGE

SEQ ID NO: 1130941 - protein, 18 aa, Mycobacterium
FQTYSVVVDAEIPKAANS

SEQ ID NO: 1130942 - protein, 20 aa, Mycobacterium
FRKRMVTSMAVALLASAVAA

SEQ ID NO: 1130943 - protein, 20 aa, Mycobacterium
FTDRFQRVFVPVILVGVVLL

SEQ ID NO: 1130944 - protein, 23 aa, Mycobacterium
FTGPPLWWLLRVADWAAAVPGAS

SEQ ID NO: 1130945 - protein, 18 aa, Mycobacterium
FTTGFGYGAAFVLMALTL

SEQ ID NO: 1130946 - protein, 17 aa, Mycobacterium
FTVLVSFTLNILLRELG

SEQ ID NO: 1130947 - protein, 18 aa, Mycobacterium
GATAWLYFFQFRPDQETD

SEQ ID NO: 1130948 - protein, 17 aa, Mycobacterium
GDPRPGVEIRLTDDGEI

SEQ ID NO: 1130949 - protein, 17 aa, Mycobacterium
GGRLMFRAVLHAVDGRP

SEQ ID NO: 1130950 - protein, 17 aa, Mycobacterium
GIIGVVLMILVIMIGLQ

SEQ ID NO: 1130951 - protein, 18 aa, Mycobacterium
GIKFFNWIGTMWKGQLTF

SEQ ID NO: 1130952 - protein, 17 aa, Mycobacterium
GLAYPVLIWLVAQLPGL

SEQ ID NO: 1130953 - protein, 18 aa, Mycobacterium
GLLHFGLSINQPPPCLTG

SEQ ID NO: 1130954 - protein, 17 aa, Mycobacterium
GLLLPWTRPMFMNNNYA

SEQ ID NO: 1130955 - protein, 23 aa, Mycobacterium
GLPLRAIVMVLLFLGIVFLLVGF

SEQ ID NO: 1130956 - protein, 25 aa, Mycobacterium
GLWLLCAGCAVLAFGTVTPVAVAGF

SEQ ID NO: 1130957 - protein, 17 aa, Mycobacterium
GPVWRLAGTTAIGLLLL

SEQ ID NO: 1130958 - protein, 20 aa, Mycobacterium
GQGVLPTLVILLDFLQQELP

SEQ ID NO: 1130959 - protein, 20 aa, Mycobacterium
GRLRRWRRPTAMRMAFALGM

SEQ ID NO: 1130960 - protein, 18 aa, Mycobacterium
GRLWPLIIAHGVINTVAY

SEQ ID NO: 1130961 - protein, 23 aa, Mycobacterium
GRVELRLVWPSILSAMRIGTQMS

SEQ ID NO: 1130962 - protein, 18 aa, Mycobacterium
GRVLARWQPAWLRYSPLS

SEQ ID NO: 1130963 - protein, 17 aa, Mycobacterium
GRWLDRVGPRWIMTAGS

SEQ ID NO: 1130964 - protein, 19 aa, Mycobacterium
GSALSWFSPIAWAQQMRAF

SEQ ID NO: 1130965 - protein, 17 aa, Mycobacterium
GSLLAPIALHWSLNGMG

SEQ ID NO: 1130966 - protein, 18 aa, Mycobacterium
GSSFKVFALVAALQQGIG

SEQ ID NO: 1130967 - protein, 17 aa, Mycobacterium
GSWFFGRFADRRGRKAA

SEQ ID NO: 1130968 - protein, 19 aa, Mycobacterium
GTFAFPIIVVMILLIIPLG

SEQ ID NO: 1130969 - protein, 19 aa, Mycobacterium
GTPEQRRWAAVAMERGWAG

SEQ ID NO: 1130970 - protein, 23 aa, Mycobacterium
GTYLGQGYLRWSIRAQQAPPRLA

SEQ ID NO: 1130971 - protein, 25 aa, Mycobacterium
GWPTWAMIFASPFLLAALIPLGIAG

SEQ ID NO: 1130972 - protein, 17 aa, Mycobacterium
GWSMRWRSPLAWAAAIV

SEQ ID NO: 1130973 - protein, 17 aa, Mycobacterium
GYGGQRRPPGPPPEEPV

SEQ ID NO: 1130974 - protein, 20 aa, Mycobacterium
HALEGYAMGRARRAIEALAE

SEQ ID NO: 1130975 - protein, 22 aa, Mycobacterium
HEGGHTLAAWAMPDIEPIYKVT

SEQ ID NO: 1130976 - protein, 26 aa, Mycobacterium
HLYRRIGASVVRWPVPILAASTAVVM

SEQ ID NO: 1130977 - protein, 17 aa, Mycobacterium
HPARYLSLFLVLLVGAF

SEQ ID NO: 1130978 - protein, 19 aa, Mycobacterium
HWFGFRFTTGFGYGAAFVL

SEQ ID NO: 1130979 - protein, 17 aa, Mycobacterium
IAGFAWRHADYPQQAAV

SEQ ID NO: 1130980 - protein, 20 aa, Mycobacterium
IALTVMFAREVGAGDLFECL

SEQ ID NO: 1130981 - protein, 20 aa, Mycobacterium
IGILCFIGLFGVLDALLPVP

SEQ ID NO: 1130982 - protein, 19 aa, Mycobacterium
ILLSMYWPLGVVVLVSIVP

SEQ ID NO: 1130983 - protein, 17 aa, Mycobacterium
INCGYPLIERFPLMFFT

SEQ ID NO: 1130984 - protein, 17 aa, Mycobacterium
IPIEIDEAAVIDGLTVA

SEQ ID NO: 1130985 - protein, 19 aa, Mycobacterium
IPPYLPVYIDRDWVAQAEV

SEQ ID NO: 1130986 - protein, 18 aa, Mycobacterium
IRAAALAGVLLLAGLIVG

SEQ ID NO: 1130987 - protein, 20 aa, Mycobacterium
IRFIIGFTLLVVFLVLCLLL

SEQ ID NO: 1130988 - protein, 17 aa, Mycobacterium
IRRRLMRQTHGLRPDEL

SEQ ID NO: 1130989 - protein, 17 aa, Mycobacterium
IRVPREFVDDYIFNFPD

SEQ ID NO: 1130990 - protein, 17 aa, Mycobacterium
IRWGNLLTLPVGPGGLL

SEQ ID NO: 1130991 - protein, 24 aa, Mycobacterium
ISDCLAEPGTLVWADVYASDHAIL

SEQ ID NO: 1130992 - protein, 18 aa, Mycobacterium
ISGPRTKLFAALFLILAL

SEQ ID NO: 1130993 - protein, 22 aa, Mycobacterium
ITQRFIMRWRIWLSRNLIDDWL

SEQ ID NO: 1130994 - protein, 19 aa, Mycobacterium
ITRRSQRLFVAQWRNTGRL

SEQ ID NO: 1130995 - protein, 18 aa, Mycobacterium
IVGACVAVGAAALWAARR

SEQ ID NO: 1130996 - protein, 17 aa, Mycobacterium
IVLHRWRVPLGWITAAF

SEQ ID NO: 1130997 - protein, 19 aa, Mycobacterium
IYVVMGASWVWYRGLQGEP

SEQ ID NO: 1130998 - protein, 19 aa, Mycobacterium
KAAGWLFWFALITAAITAA

SEQ ID NO: 1130999 - protein, 24 aa, Mycobacterium
KLDRLRARYGWFDHVMRAQERYKE

SEQ ID NO: 1131000 - protein, 17 aa, Mycobacterium
KMSGEWSKDQVLQSYLN

SEQ ID NO: 1131001 - protein, 18 aa, Mycobacterium
KRDFWRVLGIWILAALAA

SEQ ID NO: 1131002 - protein, 23 aa, Mycobacterium
KRGRKRLLWAVAVAVVVATLVGV

SEQ ID NO: 1131003 - protein, 18 aa, Mycobacterium
KSVWDHGWSAAAAADEAP

SEQ ID NO: 1131004 - protein, 21 aa, Mycobacterium
KTVWLRPGTRLGFFTHMGTQF

SEQ ID NO: 1131005 - protein, 19 aa, Mycobacterium
KVELFRLVAQMSLGVGALA

SEQ ID NO: 1131006 - protein, 18 aa, Mycobacterium
LAAAVVFSGVAAWTITAL

SEQ ID NO: 1131007 - protein, 18 aa, Mycobacterium
LAAPVIVWAAWPFHRAAW

SEQ ID NO: 1131008 - protein, 21 aa, Mycobacterium
LAARKRIAWWILLLYMVAAAG

SEQ ID NO: 1131009 - protein, 31 aa, Mycobacterium
LAIRCTAAWWLGRPGWRRDFDRAVAMAAEAD

SEQ ID NO: 1131010 - protein, 19 aa, Mycobacterium
LALDGWRRGYQLWAAAGLG

SEQ ID NO: 1131011 - protein, 17 aa, Mycobacterium
LALPLIGVWVMVSTLQA

SEQ ID NO: 1131012 - protein, 19 aa, Mycobacterium
LAMQYARRWALVVASPLSA

SEQ ID NO: 1131013 - protein, 20 aa, Mycobacterium
LAVFVLWVWAQRRRRKRRAA

SEQ ID NO: 1131014 - protein, 17 aa, Mycobacterium
LCIIAGIIVALVLGDRR

SEQ ID NO: 1131015 - protein, 19 aa, Mycobacterium
LCVVIGVGVAWLVERTDLP

SEQ ID NO: 1131016 - protein, 23 aa, Mycobacterium
LDIRPNPGIGFPGWANYFPVTKA

SEQ ID NO: 1131017 - protein, 26 aa, Mycobacterium
LFALYVAGYCLGRFWIELLRSDMATE

SEQ ID NO: 1131018 - protein, 19 aa, Mycobacterium
LFFRGALYTSLGNRWNGWW

SEQ ID NO: 1131019 - protein, 19 aa, Mycobacterium
LFRPFQWREFILQAWFLFR

SEQ ID NO: 1131020 - protein, 18 aa, Mycobacterium
LGALLCVLLGVAIVTQVR

SEQ ID NO: 1131021 - protein, 17 aa, Mycobacterium
LGPVVVRRAPAGPMRIL

SEQ ID NO: 1131022 - protein, 20 aa, Mycobacterium
LGSRPRPWLSVALGVEVVAL

SEQ ID NO: 1131023 - protein, 23 aa, Mycobacterium
LGVSAAYLWSLWALFIGHAGMPG

SEQ ID NO: 1131024 - protein, 17 aa, Mycobacterium
LGYESLWVGLLFGGVGL

SEQ ID NO: 1131025 - protein, 24 aa, Mycobacterium
LHHELEFWWELALLIVIMLLGHWV

SEQ ID NO: 1131026 - protein, 21 aa, Mycobacterium
LILNGSWSWLFFNRHKLAVSA

SEQ ID NO: 1131027 - protein, 19 aa, Mycobacterium
LLGLPGWVTQRLWWALLLT

SEQ ID NO: 1131028 - protein, 17 aa, Mycobacterium
LLGWCSFMLLWVLQACV

SEQ ID NO: 1131029 - protein, 24 aa, Mycobacterium
LLIKYLWPMRRMRAADVRTMSLVA

SEQ ID NO: 1131030 - protein, 17 aa, Mycobacterium
LLLRAVVAPIYLVASVV

SEQ ID NO: 1131031 - protein, 23 aa, Mycobacterium
LLNELRAQFDYVIVDSTPLLAVT

SEQ ID NO: 1131032 - protein, 23 aa, Mycobacterium
LLRRFAPQQIMVWALAVASLAGV

SEQ ID NO: 1131033 - protein, 18 aa, Mycobacterium
LLRRLHFYAGVLVGPFLL

SEQ ID NO: 1131034 - protein, 17 aa, Mycobacterium
LLTRMWVMPVHRTAPLT

SEQ ID NO: 1131035 - protein, 18 aa, Mycobacterium
LLVALGVCLVRQPRAVLY

SEQ ID NO: 1131036 - protein, 23 aa, Mycobacterium
LLVVVVGFGSWLALRAVEAKANL

SEQ ID NO: 1131037 - protein, 20 aa, Mycobacterium
LMGSRLGPVVVRRAPAGPMR

SEQ ID NO: 1131038 - protein, 20 aa, Mycobacterium
LMMAWTVLGDTVWVAGGMSH

SEQ ID NO: 1131039 - protein, 19 aa, Mycobacterium
LMPMDFPLVMSVAGGHWQV

SEQ ID NO: 1131040 - protein, 23 aa, Mycobacterium
LMYKRPDGQFAYRGDGGLLNFVQ

SEQ ID NO: 1131041 - protein, 17 aa, Mycobacterium
LNLCMAMGLALAIDYTL

SEQ ID NO: 1131042 - protein, 23 aa, Mycobacterium
LPAEQSGGVVLDGFVERVGDPVP

SEQ ID NO: 1131043 - protein, 19 aa, Mycobacterium
LPAPWPRIMREAARSRADA

SEQ ID NO: 1131044 - protein, 22 aa, Mycobacterium
LPDGRAAIRLAMDPSQLAIIPS

SEQ ID NO: 1131045 - protein, 17 aa, Mycobacterium
LPFLWNIFKSWRYGEVV

SEQ ID NO: 1131046 - protein, 20 aa, Mycobacterium
LPGLCFAAAGLTAPWLSRRF

SEQ ID NO: 1131047 - protein, 18 aa, Mycobacterium
LPGWCPGLTCDTWNKSVG

SEQ ID NO: 1131048 - protein, 18 aa, Mycobacterium
LPLAAAVATAVLVLLAVL

SEQ ID NO: 1131049 - protein, 18 aa, Mycobacterium
LPLVLGLIAVSTFCLLFL

SEQ ID NO: 1131050 - protein, 21 aa, Mycobacterium
LPWRFITGWLNRYGVRADVLT

SEQ ID NO: 1131051 - protein, 17 aa, Mycobacterium
LQERLGLGEVELPDERK

SEQ ID NO: 1131052 - protein, 18 aa, Mycobacterium
LRDPRFVVLVLVAALGMS

SEQ ID NO: 1131053 - protein, 21 aa, Mycobacterium
LRMILLPQAFRSVVIPLGSVL

SEQ ID NO: 1131054 - protein, 17 aa, Mycobacterium
LSLARLNYFHTMGPAVA

SEQ ID NO: 1131055 - protein, 20 aa, Mycobacterium
LTAARWGRYPVRANVRVAGR

SEQ ID NO: 1131056 - protein, 19 aa, Mycobacterium
LTAIPLWVAFVVGTKAATR

SEQ ID NO: 1131057 - protein, 17 aa, Mycobacterium
LTCAVFVFGVLGALMRA

SEQ ID NO: 1131058 - protein, 27 aa, Mycobacterium
LTLDLLRPRLGRLLLAIGLGVLSLGSA

SEQ ID NO: 1131059 - protein, 22 aa, Mycobacterium
LTVWPFLNWWTTHFVITDRRVM

SEQ ID NO: 1131060 - protein, 19 aa, Mycobacterium
LVAFCPWATTVLVTALLDR

SEQ ID NO: 1131061 - protein, 17 aa, Mycobacterium
LVVAFVYHPDKSHPSAG

SEQ ID NO: 1131062 - protein, 17 aa, Mycobacterium
LVVVFPWFAVAVATACV

SEQ ID NO: 1131063 - protein, 20 aa, Mycobacterium
LWSRLSFLRYIPLLDVSFGP

SEQ ID NO: 1131064 - protein, 24 aa, Mycobacterium
LYLSMDIAIHWGLLRRLRHDVDFK

SEQ ID NO: 1131065 - protein, 19 aa, Mycobacterium
MDITGWKVSTVVPVSTPAD

SEQ ID NO: 1131066 - protein, 23 aa, Mycobacterium
MGVGITEAVLWFIRRWLVSRATM

SEQ ID NO: 1131067 - protein, 17 aa, Mycobacterium
NALAIWSLVASLIGFVC

SEQ ID NO: 1131068 - protein, 18 aa, Mycobacterium
NDVLNAWAMSVVFYGALI

SEQ ID NO: 1131069 - protein, 24 aa, Mycobacterium
NEYPGDPWKWWAVLSSAVGVAVAI

SEQ ID NO: 1131070 - protein, 23 aa, Mycobacterium
NGACFRLTLPLVRGHKVTTSPLP

SEQ ID NO: 1131071 - protein, 17 aa, Mycobacterium
NRRCRPWVLAAGVVLHL

SEQ ID NO: 1131072 - protein, 22 aa, Mycobacterium
NRWRHLPAILLVASLVLLTVAM

SEQ ID NO: 1131073 - protein, 19 aa, Mycobacterium
NTESGWKLGFYAASRASQL

SEQ ID NO: 1131074 - protein, 22 aa, Mycobacterium
PAAALFRRVFLINGLIFTLGTL

SEQ ID NO: 1131075 - protein, 17 aa, Mycobacterium
PAARCWPGPGTQLDDQA

SEQ ID NO: 1131076 - protein, 20 aa, Mycobacterium
PAHWQEWMPAGLFFAAIALF

SEQ ID NO: 1131077 - protein, 17 aa, Mycobacterium
PDIPLEVPKGAMVTSVR

SEQ ID NO: 1131078 - protein, 20 aa, Mycobacterium
PDQSRLPLAAAVATAVLVLL

SEQ ID NO: 1131079 - protein, 17 aa, Mycobacterium
PDTATPTGPGWVAAVRA

SEQ ID NO: 1131080 - protein, 20 aa, Mycobacterium
PDVYRPAALLPTPRETATFL

SEQ ID NO: 1131081 - protein, 19 aa, Mycobacterium
PELRDDWRPVLWAVAILTM

SEQ ID NO: 1131082 - protein, 18 aa, Mycobacterium
PEMLPRGWGEVGQLFPQG

SEQ ID NO: 1131083 - protein, 20 aa, Mycobacterium
PEVANPALWILAGAVAGLIA

SEQ ID NO: 1131084 - protein, 17 aa, Mycobacterium
PGLGWPDLRAGRVRVLR

SEQ ID NO: 1131085 - protein, 24 aa, Mycobacterium
PGRYGFDAGRGWARRPFVGSVVAL

SEQ ID NO: 1131086 - protein, 22 aa, Mycobacterium
PHPYPRWVATAGWAGFALGIAM

SEQ ID NO: 1131087 - protein, 29 aa, Mycobacterium
PHWRERVNWRWVRRGLIAAAVVLIVLPLV

SEQ ID NO: 1131088 - protein, 18 aa, Mycobacterium
PIPLPGWCPGLTCDTWNK

SEQ ID NO: 1131089 - protein, 20 aa, Mycobacterium
PLARRPIVWWLHWLAEKTQK

SEQ ID NO: 1131090 - protein, 18 aa, Mycobacterium
PLPIPWSVLSLFAPGPTL

SEQ ID NO: 1131091 - protein, 21 aa, Mycobacterium
PNWAEAAMAFWASAFLGAVVV

SEQ ID NO: 1131092 - protein, 24 aa, Mycobacterium
PPDNRLPRFIAFGVGIVAIAAAII

SEQ ID NO: 1131093 - protein, 17 aa, Mycobacterium
PPVWPFIVGACVAVGAA

SEQ ID NO: 1131094 - protein, 20 aa, Mycobacterium
PRFIDTYVNWLWFGELGYRS

SEQ ID NO: 1131095 - protein, 19 aa, Mycobacterium
PRLHAVAVVAAILPNLAQW

SEQ ID NO: 1131096 - protein, 19 aa, Mycobacterium
PRMRPDLLGGLGLAVLIGL

SEQ ID NO: 1131097 - protein, 25 aa, Mycobacterium
PRRPLGGLLRRGRSQVLFGALGALL

SEQ ID NO: 1131098 - protein, 17 aa, Mycobacterium
PRSWRMRVGVEQTGDAA

SEQ ID NO: 1131099 - protein, 19 aa, Mycobacterium
PRTKLFAALFLILALVVIG

SEQ ID NO: 1131100 - protein, 24 aa, Mycobacterium
PTHWQEWMPAGLFFASFALFQLLW

SEQ ID NO: 1131101 - protein, 26 aa, Mycobacterium
PVAVLAMACGVGFLKWQANSIGTSQA

SEQ ID NO: 1131102 - protein, 22 aa, Mycobacterium
QEVPAATAWRGEGAIILHVIRD

SEQ ID NO: 1131103 - protein, 25 aa, Mycobacterium
QFRGDFTPREKLTMMAARAGLNLDP

SEQ ID NO: 1131104 - protein, 19 aa, Mycobacterium
QLNLPRLWSGFQIVGDGSG

SEQ ID NO: 1131105 - protein, 24 aa, Mycobacterium
QPRAWRLSVDIVRDVGRLKMSKME

SEQ ID NO: 1131106 - protein, 17 aa, Mycobacterium
QPSGFTMAGPWVGIAAP

SEQ ID NO: 1131107 - protein, 49 aa, Mycobacterium
QRRPPGPPPEEPVPWYRTPAAMFAAGVLLTLVLVLLVWAVFGSSSDEAD

SEQ ID NO: 1131108 - protein, 24 aa, Mycobacterium
QSRRRLVGAVGMAVLAIALIASVG

SEQ ID NO: 1131109 - protein, 23 aa, Mycobacterium
QVLRLPARFVLGALAGLRTVGLL

SEQ ID NO: 1131110 - protein, 18 aa, Mycobacterium
QVQRELLELFNISEQQLN

SEQ ID NO: 1131111 - protein, 19 aa, Mycobacterium
QVSEIRAAALAGVLLLAGL

SEQ ID NO: 1131112 - protein, 18 aa, Mycobacterium
RAGRVQWRTGLIFGAAGM

SEQ ID NO: 1131113 - protein, 18 aa, Mycobacterium
RAVVAPIYLVASVVLSYV

SEQ ID NO: 1131114 - protein, 22 aa, Mycobacterium
RAWRNRMPPQRLALVMGSVAAV

SEQ ID NO: 1131115 - protein, 19 aa, Mycobacterium
RDAKWMVCDAVGGPDAGTT

SEQ ID NO: 1131116 - protein, 18 aa, Mycobacterium
RDLTAFFAWSAWASAAER

SEQ ID NO: 1131117 - protein, 20 aa, Mycobacterium
RDYRFAVVVTLGWMAFTFAF

SEQ ID NO: 1131118 - protein, 19 aa, Mycobacterium
REKRWGPTHIRRAAAAAVV

SEQ ID NO: 1131119 - protein, 25 aa, Mycobacterium
RFGRRVAAMLVDWFIAYGLAALAMT

SEQ ID NO: 1131120 - protein, 18 aa, Mycobacterium
RFVKMYGLRIDLQRLETA

SEQ ID NO: 1131121 - protein, 18 aa, Mycobacterium
RGAINWRQVAVLSVAGCG

SEQ ID NO: 1131122 - protein, 17 aa, Mycobacterium
RGHVWVRLWTLFGSMFV

SEQ ID NO: 1131123 - protein, 23 aa, Mycobacterium
RHNGIRLAVAFSVVAIVGLGGVA

SEQ ID NO: 1131124 - protein, 18 aa, Mycobacterium
RLADLGLFVFRSYGSTEH

SEQ ID NO: 1131125 - protein, 18 aa, Mycobacterium
RLLTRLGLTVAMLTGDNA

SEQ ID NO: 1131126 - protein, 24 aa, Mycobacterium
RLPGCAHAKCSNCLKWALRWRRGL

SEQ ID NO: 1131127 - protein, 20 aa, Mycobacterium
RLPGWPLWFAALWVAQEWLK

SEQ ID NO: 1131128 - protein, 19 aa, Mycobacterium
RLYLDGGLQFSTRDEFRYT

SEQ ID NO: 1131129 - protein, 21 aa, Mycobacterium
RMRNVWVCFAVAFGGWTAGEV

SEQ ID NO: 1131130 - protein, 19 aa, Mycobacterium
RPGGPWWPLGEIDRPRQLN

SEQ ID NO: 1131131 - protein, 26 aa, Mycobacterium
RPNRLWWRFTAWWFGCAALAVLWWVV

SEQ ID NO: 1131132 - protein, 33 aa, Mycobacterium
RPSRWSPANWPVRWKVLAIVLVPLVLAGVFGGA

SEQ ID NO: 1131133 - protein, 19 aa, Mycobacterium
RQPDHFDWITGYLAARGML

SEQ ID NO: 1131134 - protein, 18 aa, Mycobacterium
RRAETRPGVAVRMLTSGT

SEQ ID NO: 1131135 - protein, 17 aa, Mycobacterium
RREVPKHVVWLWAVAIV

SEQ ID NO: 1131136 - protein, 17 aa, Mycobacterium
RRIPIEIDEAAVIDGLT

SEQ ID NO: 1131137 - protein, 20 aa, Mycobacterium
RRKRRMAGALSLALLIVVVV

SEQ ID NO: 1131138 - protein, 19 aa, Mycobacterium
RRLEGLIAPGSWNIDPSAT

SEQ ID NO: 1131139 - protein, 23 aa, Mycobacterium
RRPMLHKYLGLVGPVGFSTVLSG

SEQ ID NO: 1131140 - protein, 23 aa, Mycobacterium
RRPRLPLKAGWGVKAAMAVVLVV

SEQ ID NO: 1131141 - protein, 22 aa, Mycobacterium
RRPVEFLCLLPLTIPALVIVVG

SEQ ID NO: 1131142 - protein, 18 aa, Mycobacterium
RRRGRFLVALGMGGMGYS

SEQ ID NO: 1131143 - protein, 20 aa, Mycobacterium
RRWEARGGERGVIYDIALWA

SEQ ID NO: 1131144 - protein, 21 aa, Mycobacterium
RRWLARIAVSWGLVVVAIGFA

SEQ ID NO: 1131145 - protein, 20 aa, Mycobacterium
RSRCYAAGACRWALTLSGSC

SEQ ID NO: 1131146 - protein, 19 aa, Mycobacterium
RTTVMARLRLFGFGVPAFI

SEQ ID NO: 1131147 - protein, 26 aa, Mycobacterium
RVELLKLAVILALWAAVAAAFVSVIY

SEQ ID NO: 1131148 - protein, 24 aa, Mycobacterium
RVLLAAACLLAWALLLLVLTSTWV

SEQ ID NO: 1131149 - protein, 17 aa, Mycobacterium
RWLPDWLRPTGQRVRVD

SEQ ID NO: 1131150 - protein, 18 aa, Mycobacterium
RWRGLRALVGIVVAFAVL

SEQ ID NO: 1131151 - protein, 22 aa, Mycobacterium
SADLKNRFRAFTLPHARPDRPS

SEQ ID NO: 1131152 - protein, 25 aa, Mycobacterium
SAFFTPRFVNWFGLFTTHLVIAIAL

SEQ ID NO: 1131153 - protein, 18 aa, Mycobacterium
SAFLRGAWIVGQCIIAVA

SEQ ID NO: 1131154 - protein, 18 aa, Mycobacterium
SALPRWIYVPAVAGALFV

SEQ ID NO: 1131155 - protein, 23 aa, Mycobacterium
SDLWRLLPYLMPYRVRWIAMFVV

SEQ ID NO: 1131156 - protein, 21 aa, Mycobacterium
SDPNLRPAIVGVFTDLTGPAP

SEQ ID NO: 1131157 - protein, 29 aa, Mycobacterium
SFVVPCLLRIMGPWFWWPTLVRTRPLRQV

SEQ ID NO: 1131158 - protein, 19 aa, Mycobacterium
SFWSLNIGLAWMVFATLLP

SEQ ID NO: 1131159 - protein, 19 aa, Mycobacterium
SFYGAMPGFDPAAVPPSQN

SEQ ID NO: 1131160 - protein, 24 aa, Mycobacterium
SGEAELAYLLAGWRDEIRQPPMAS

SEQ ID NO: 1131161 - protein, 18 aa, Mycobacterium
SKDRRKQAAIGFESDNSG

SEQ ID NO: 1131162 - protein, 19 aa, Mycobacterium
SNALLGYAYGRRLEYSEVM

SEQ ID NO: 1131163 - protein, 20 aa, Mycobacterium
SPLLARFVVWASRRLSRHAG

SEQ ID NO: 1131164 - protein, 17 aa, Mycobacterium
SQLWGWRTAVVVVTAAA

SEQ ID NO: 1131165 - protein, 25 aa, Mycobacterium
SRLYAERWCAWALLAVTVIVPTGVM

SEQ ID NO: 1131166 - protein, 21 aa, Mycobacterium
SRPSLLFAHGSFRDDAMRKQR

SEQ ID NO: 1131167 - protein, 24 aa, Mycobacterium
SRSPRWWRFFGALQWLLIAVAVAG

SEQ ID NO: 1131168 - protein, 22 aa, Mycobacterium
SVAAAVLCLGGFGSVVYGAGPG

SEQ ID NO: 1131169 - protein, 19 aa, Mycobacterium
SVADGYRIPLTWGTGPTPA

SEQ ID NO: 1131170 - protein, 23 aa, Mycobacterium
SVGEQFWLVWPLLLLLVGLLKAR

SEQ ID NO: 1131171 - protein, 20 aa, Mycobacterium
SYGWRIPFLIAAPLGLVGLY

SEQ ID NO: 1131172 - protein, 23 aa, Mycobacterium
TALGRALSLVWRRSLQVRVVSLT

SEQ ID NO: 1131173 - protein, 25 aa, Mycobacterium
TGRFWRRSGIHIVRRPVVHLVGSLT

SEQ ID NO: 1131174 - protein, 19 aa, Mycobacterium
TLAPMPMVWAVREILHSAN

SEQ ID NO: 1131175 - protein, 17 aa, Mycobacterium
TLGGIGLVLGVLTPLAA

SEQ ID NO: 1131176 - protein, 20 aa, Mycobacterium
TLPFLWNIFRSWRYGEPVVV

SEQ ID NO: 1131177 - protein, 27 aa, Mycobacterium
TLPLYLPKVGLRFAVTVGLLLLATGLF

SEQ ID NO: 1131178 - protein, 20 aa, Mycobacterium
TMGALTSWLGFQTHQAHQAS

SEQ ID NO: 1131179 - protein, 17 aa, Mycobacterium
TNLFWAFAYNVAAIPVA

SEQ ID NO: 1131180 - protein, 19 aa, Mycobacterium
TNLVGWPTWAMIFASPFLL

SEQ ID NO: 1131181 - protein, 18 aa, Mycobacterium
TNVRRFVDDVAFVVGKES

SEQ ID NO: 1131182 - protein, 18 aa, Mycobacterium
TPQWRMLVAFAVFGVGTS

SEQ ID NO: 1131183 - protein, 17 aa, Mycobacterium
TRLMMLLGAGFGLGVAL

SEQ ID NO: 1131184 - protein, 19 aa, Mycobacterium
TRLVAWVLLLLMLPMVVGC

SEQ ID NO: 1131185 - protein, 18 aa, Mycobacterium
TRPGVAVRMLTSGTTGPP

SEQ ID NO: 1131186 - protein, 17 aa, Mycobacterium
TRSTFPGVFSDGGPVDY

SEQ ID NO: 1131187 - protein, 17 aa, Mycobacterium
TRWFPTHFVTLWMVDTP

SEQ ID NO: 1131188 - protein, 23 aa, Mycobacterium
TVMEIVGWRALWGLGNALFIATA

SEQ ID NO: 1131189 - protein, 25 aa, Mycobacterium
TVVRGARNYPCMEFPGKRAATIQQC

SEQ ID NO: 1131190 - protein, 24 aa, Mycobacterium
TWEVPEGPTAIPYRVKQLPPPVYV

SEQ ID NO: 1131191 - protein, 17 aa, Mycobacterium
TYWSNDVLNAWAMSVVF

SEQ ID NO: 1131192 - protein, 26 aa, Mycobacterium
VAGIAVGLGIRFPRRQVWAPAAAVAA

SEQ ID NO: 1131193 - protein, 17 aa, Mycobacterium
VAIALTVMFAREVGAGD

SEQ ID NO: 1131194 - protein, 18 aa, Mycobacterium
VAIGGEWGGATLMVTEHA

SEQ ID NO: 1131195 - protein, 21 aa, Mycobacterium
VALGGVGAWIACRRRGIPLPA

SEQ ID NO: 1131196 - protein, 19 aa, Mycobacterium
VATQCARRGFNVVWIDPKG

SEQ ID NO: 1131197 - protein, 19 aa, Mycobacterium
VAVICTLVILGGGDSGSVS

SEQ ID NO: 1131198 - protein, 25 aa, Mycobacterium
VAVTVSVWWRPAAVVAVVLTVSAVV

SEQ ID NO: 1131199 - protein, 17 aa, Mycobacterium
VDFKGGATFLGLERTAH

SEQ ID NO: 1131200 - protein, 21 aa, Mycobacterium
VDSFWPRRVVDSALRNYDPED

SEQ ID NO: 1131201 - protein, 23 aa, Mycobacterium
VFGEFRFASGNSYHANFTEASRL

SEQ ID NO: 1131202 - protein, 23 aa, Mycobacterium
VFPARIAFHLVRLYNLAFIVSTY

SEQ ID NO: 1131203 - protein, 24 aa, Mycobacterium
VGVCVGALLGGLAFAAMGTDTTAT

SEQ ID NO: 1131204 - protein, 18 aa, Mycobacterium
VGVGWFWILFIAVPAVAI

SEQ ID NO: 1131205 - protein, 17 aa, Mycobacterium
VIFAIRWRRDEESESKK

SEQ ID NO: 1131206 - protein, 17 aa, Mycobacterium
VKFELGLPPGRGFALAI

SEQ ID NO: 1131207 - protein, 20 aa, Mycobacterium
VKKALPWVFGVVIVGMVVMM

SEQ ID NO: 1131208 - protein, 17 aa, Mycobacterium
VKRALAWIKEHIAEYGG

SEQ ID NO: 1131209 - protein, 17 aa, Mycobacterium
VLFPMYFLKSFAYAGVA

SEQ ID NO: 1131210 - protein, 18 aa, Mycobacterium
VLGDTVWVAGGMSHGESL

SEQ ID NO: 1131211 - protein, 20 aa, Mycobacterium
VLQACVFWRGMESIRKFIDF

SEQ ID NO: 1131212 - protein, 19 aa, Mycobacterium
VLVPAFMRVLGRWNWWSPK

SEQ ID NO: 1131213 - protein, 18 aa, Mycobacterium
VLYLPEYLLFRIVRSYFT

SEQ ID NO: 1131214 - protein, 19 aa, Mycobacterium
VRWPWVVIGVWVAMAVALP

SEQ ID NO: 1131215 - protein, 21 aa, Mycobacterium
VRYMLRIGVFHWFRHGVLGAL

SEQ ID NO: 1131216 - protein, 21 aa, Mycobacterium
VSPLVRWIIRVPREFVDDYIF

SEQ ID NO: 1131217 - protein, 23 aa, Mycobacterium
VSSARFWKTFAHHYLRMIYDILA

SEQ ID NO: 1131218 - protein, 19 aa, Mycobacterium
VSSIGMWLIRRRLMRQTHG

SEQ ID NO: 1131219 - protein, 19 aa, Mycobacterium
VSTLHEWRPFTIAGLGIGV

SEQ ID NO: 1131220 - protein, 18 aa, Mycobacterium
VVAICWAAAGAVLVALAA

SEQ ID NO: 1131221 - protein, 17 aa, Mycobacterium
VVCSLTFAGAFRRDVPV

SEQ ID NO: 1131222 - protein, 25 aa, Mycobacterium
VVCTVLWPPVRWLRGKGVPPAAAVL

SEQ ID NO: 1131223 - protein, 18 aa, Mycobacterium
VVLAGALVIRLARTWSLA

SEQ ID NO: 1131224 - protein, 22 aa, Mycobacterium
VVLAGLLGMCSFQGRGPTEGPA

SEQ ID NO: 1131225 - protein, 19 aa, Mycobacterium
VVLLLGWSFFYFSDDTRGF

SEQ ID NO: 1131226 - protein, 22 aa, Mycobacterium
VVPWYRRTPVALAIGAAAVLAA

SEQ ID NO: 1131227 - protein, 24 aa, Mycobacterium
VWERLRPVWRWVLRTRDRLREWWA

SEQ ID NO: 1131228 - protein, 18 aa, Mycobacterium
VYVTNAFFNGFVPPFPTR

SEQ ID NO: 1131229 - protein, 19 aa, Mycobacterium
WAVPLNWWVMLAGFVLFVS

SEQ ID NO: 1131230 - protein, 19 aa, Mycobacterium
WEGGLGIWGAVALGGVGAW

SEQ ID NO: 1131231 - protein, 26 aa, Mycobacterium
WEPHCFNIPICWAFRSLFDGLDNIDA

SEQ ID NO: 1131232 - protein, 18 aa, Mycobacterium
WFAWPGYLWFGMAAYLLL

SEQ ID NO: 1131233 - protein, 22 aa, Mycobacterium
WHHNRFPLSMLLMLVLLGTLIV

SEQ ID NO: 1131234 - protein, 19 aa, Mycobacterium
WKTSRGRGVAVAVIDSGVT

SEQ ID NO: 1131235 - protein, 23 aa, Mycobacterium
WLPAAPALLAWWLVVATITVTVL

SEQ ID NO: 1131236 - protein, 18 aa, Mycobacterium
WLRCHPVYVAPRTAKKTD

SEQ ID NO: 1131237 - protein, 19 aa, Mycobacterium
WNIFKSWRYGEVVTVDDPW

SEQ ID NO: 1131238 - protein, 19 aa, Mycobacterium
WNIFRSWRYGEPVVVDDPW

SEQ ID NO: 1131239 - protein, 25 aa, Mycobacterium
WREFILQAWFLFRVSFLPTVAVSVP

SEQ ID NO: 1131240 - protein, 17 aa, Mycobacterium
WRPAVALMLALWLVAVG

SEQ ID NO: 1131241 - protein, 20 aa, Mycobacterium
WRPTLLLTRSFIADYVRNPV

SEQ ID NO: 1131242 - protein, 21 aa, Mycobacterium
WRQIPTRTRMGVVVAVVAIAG

SEQ ID NO: 1131243 - protein, 18 aa, Mycobacterium
WSLLVGYGCLPWVATAVL

SEQ ID NO: 1131244 - protein, 18 aa, Mycobacterium
WSPAVLLRWCGRHRLITT

SEQ ID NO: 1131245 - protein, 17 aa, Mycobacterium
WYLPVGVTGTLGDPTAA

SEQ ID NO: 1131246 - protein, 17 aa, Mycobacterium
YAAVYGYDERAMAKIVV

SEQ ID NO: 1131247 - protein, 17 aa, Mycobacterium
YALCIIAGIIVALVLGD

SEQ ID NO: 1131248 - protein, 17 aa, Mycobacterium
YAVAIGLDIEQFDQDVR

SEQ ID NO: 1131249 - protein, 21 aa, Mycobacterium
YAVCIVLRLARFNAMLAEDLP

SEQ ID NO: 1131250 - protein, 20 aa, Mycobacterium
YCVAVLSAFWAARFGTIAIY

SEQ ID NO: 1131251 - protein, 18 aa, Mycobacterium
YDHPRLGSLAGYLDELAP

SEQ ID NO: 1131252 - protein, 26 aa, Mycobacterium
YGAFFPYYICGITFRASDLEGRTVVF

SEQ ID NO: 1131253 - protein, 21 aa, Mycobacterium
YLMPYRVRWIAMFVVAIASLG

SEQ ID NO: 1131254 - protein, 17 aa, Mycobacterium
YNMPLELVLTVIPFLII

SEQ ID NO: 1131255 - protein, 17 aa, Mycobacterium
YPLLLVFGFFLGIAGTV

SEQ ID NO: 1131256 - protein, 18 aa, Mycobacterium
YRPRICNPYRNPLRVVYY

SEQ ID NO: 1131257 - protein, 17 aa, Mycobacterium
YSWFIGCGVAFALYYVL

SEQ ID NO: 1131258 - protein, 19 aa, Mycobacterium
AAACLYCAYELWRFDTVRS

SEQ ID NO: 1131259 - protein, 26 aa, Mycobacterium
AAALASRWRLLAVSVLIASAAVLTTL

SEQ ID NO: 1131260 - protein, 23 aa, Mycobacterium
AAALCWLWPAGAGLLIRFTGPPL

SEQ ID NO: 1131261 - protein, 17 aa, Mycobacterium
AAAMLRAGKPVRHHLSR

SEQ ID NO: 1131262 - protein, 26 aa, Mycobacterium
AAAMSLPWLAAIAVEFVLLRWFFAKD

SEQ ID NO: 1131263 - protein, 24 aa, Mycobacterium
AAARPRPAGVLIQLQRSAGNAAVN

SEQ ID NO: 1131264 - protein, 17 aa, Mycobacterium
AAAVVFSGVAAWTITAL

SEQ ID NO: 1131265 - protein, 23 aa, Mycobacterium
AADVRFCKSCDAFLDPQPAPEPG

SEQ ID NO: 1131266 - protein, 21 aa, Mycobacterium
AAEIPAIISLIFSSAFGVDSA

SEQ ID NO: 1131267 - protein, 18 aa, Mycobacterium
AAFPIAWNVLYTDIAAVS

SEQ ID NO: 1131268 - protein, 24 aa, Mycobacterium
AAGEPRLAAAVPFYGPTPENPDFS

SEQ ID NO: 1131269 - protein, 19 aa, Mycobacterium
AAGFMTVWARMYAPDGAAF

SEQ ID NO: 1131270 - protein, 17 aa, Mycobacterium
AAGVVRPQLSAVYLEEA

SEQ ID NO: 1131271 - protein, 22 aa, Mycobacterium
AAIGIAAYWLGTRRRATGGGSP

SEQ ID NO: 1131272 - protein, 18 aa, Mycobacterium
AAKRSSYLHWGRGVEATQ

SEQ ID NO: 1131273 - protein, 26 aa, Mycobacterium
AALFACLAIAALLVWVIALSRPPEVQ

SEQ ID NO: 1131274 - protein, 20 aa, Mycobacterium
AALFRRVFLINGLIFTLGTL

SEQ ID NO: 1131275 - protein, 18 aa, Mycobacterium
AALICLGAALLLTRRTPR

SEQ ID NO: 1131276 - protein, 24 aa, Mycobacterium
AALKRRLLICVALSVPVIAMAMVP

SEQ ID NO: 1131277 - protein, 19 aa, Mycobacterium
AAMLVDWFIAYGLAALAMT

SEQ ID NO: 1131278 - protein, 17 aa, Mycobacterium
AAPEGWTATHVVSGLVE

SEQ ID NO: 1131279 - protein, 19 aa, Mycobacterium
AAPTFEFFALYGTAAVYYW

SEQ ID NO: 1131280 - protein, 21 aa, Mycobacterium
AAQLPFSFWLSRAMSGPSPVS

SEQ ID NO: 1131281 - protein, 18 aa, Mycobacterium
AAQYSWFIGCGVAFALYY

SEQ ID NO: 1131282 - protein, 17 aa, Mycobacterium
AARKCLVLIAVWCGGSA

SEQ ID NO: 1131283 - protein, 22 aa, Mycobacterium
AARKRIAWWILVGYMIAAAGWN

SEQ ID NO: 1131284 - protein, 19 aa, Mycobacterium
AARLLTWRASWMAATGVPF

SEQ ID NO: 1131285 - protein, 21 aa, Mycobacterium
AASPRRPRRWGLPLIATVAAL

SEQ ID NO: 1131286 - protein, 18 aa, Mycobacterium
AATAIGLWMSKVPRQSFE

SEQ ID NO: 1131287 - protein, 19 aa, Mycobacterium
AATFLAPWLFSLSIDVFDS

SEQ ID NO: 1131288 - protein, 21 aa, Mycobacterium
AATPVFRWGFGIWSDKYTDVN

SEQ ID NO: 1131289 - protein, 19 aa, Mycobacterium
AATRWDLAAVFPWFAGVVA

SEQ ID NO: 1131290 - protein, 17 aa, Mycobacterium
AAVARWGVPEPRWAASW

SEQ ID NO: 1131291 - protein, 18 aa, Mycobacterium
AAVATVWLLAARRFSRWQ

SEQ ID NO: 1131292 - protein, 21 aa, Mycobacterium
AAVGCLLAFLWVERTAENPVV

SEQ ID NO: 1131293 - protein, 23 aa, Mycobacterium
AAVRDMFGWIGPVLMALNGNAVC

SEQ ID NO: 1131294 - protein, 19 aa, Mycobacterium
AAVTGWFGYQAYRSDQDTK

SEQ ID NO: 1131295 - protein, 24 aa, Mycobacterium
AAWDGRYAWLAVVVFVNTLVSLFY

SEQ ID NO: 1131296 - protein, 19 aa, Mycobacterium
AAWLRLAWAGILFLVIVRP

SEQ ID NO: 1131297 - protein, 18 aa, Mycobacterium
ACAIAVLIGFLATVTLLP

SEQ ID NO: 1131298 - protein, 20 aa, Mycobacterium
ACFISAGAVAARFGAAAVAA

SEQ ID NO: 1131299 - protein, 17 aa, Mycobacterium
ACLCSLVGCWVLLRGNV

SEQ ID NO: 1131300 - protein, 18 aa, Mycobacterium
ACLRAGVIALVLLAILAL

SEQ ID NO: 1131301 - protein, 20 aa, Mycobacterium
ACRRRGIPLPAFGDAIAPGI

SEQ ID NO: 1131302 - protein, 18 aa, Mycobacterium
ACVRRLAASAGRVAQAPV

SEQ ID NO: 1131303 - protein, 17 aa, Mycobacterium
ADARPVWARALGLRLPP

SEQ ID NO: 1131304 - protein, 21 aa, Mycobacterium
ADELFNIFLIIALVTAMLGAL

SEQ ID NO: 1131305 - protein, 20 aa, Mycobacterium
ADLFLRARVNSFTSYRKSTG

SEQ ID NO: 1131306 - protein, 19 aa, Mycobacterium
ADLLYEFRLQSALTAAVMW

SEQ ID NO: 1131307 - protein, 18 aa, Mycobacterium
ADPWPALWALLIGFFMIL

SEQ ID NO: 1131308 - protein, 20 aa, Mycobacterium
ADSGVGLWTFDGVQGRSAVS

SEQ ID NO: 1131309 - protein, 20 aa, Mycobacterium
AEHRCTIAFIAPPVAVALAK

SEQ ID NO: 1131310 - protein, 19 aa, Mycobacterium
AEILAAFWTTIQLTVLAAI

SEQ ID NO: 1131311 - protein, 23 aa, Mycobacterium
AEIVFACFLYRAWNLPVAVLAGA

SEQ ID NO: 1131312 - protein, 28 aa, Mycobacterium
AELAPPPRWPWVVGIVAIVAAIALVVSV

SEQ ID NO: 1131313 - protein, 22 aa, Mycobacterium
AENGGRTWLLWDGKRSPIDLAD

SEQ ID NO: 1131314 - protein, 20 aa, Mycobacterium
AEPVLMIGMIYIWMPLAMGK

SEQ ID NO: 1131315 - protein, 18 aa, Mycobacterium
AETLRLKGFLIMSRNTAR

SEQ ID NO: 1131316 - protein, 19 aa, Mycobacterium
AFATALPWLAGRLRTPEVV

SEQ ID NO: 1131317 - protein, 25 aa, Mycobacterium
AFDQLWKWNNIIALVLSVLVILGLV

SEQ ID NO: 1131318 - protein, 19 aa, Mycobacterium
AFGVLVVFLLPALRDGAPA

SEQ ID NO: 1131319 - protein, 22 aa, Mycobacterium
AFIPRFLFAVGFPGIVVATACY

SEQ ID NO: 1131320 - protein, 20 aa, Mycobacterium
AFLGDWARYIPRDTPPWKPM

SEQ ID NO: 1131321 - protein, 21 aa, Mycobacterium
AFNLYWRTRFVLPQIGNAETG

SEQ ID NO: 1131322 - protein, 19 aa, Mycobacterium
AFVDLRGAIGFSSFGVLLY

SEQ ID NO: 1131323 - protein, 31 aa, Mycobacterium
AFVLMICGFFRWGFPATMWALPFAAFFLFSA

SEQ ID NO: 1131324 - protein, 26 aa, Mycobacterium
AFVQMFRPPFAWREFLLQTWFVARVA

SEQ ID NO: 1131325 - protein, 19 aa, Mycobacterium
AGEVFAVLTMRDGDFPGQA

SEQ ID NO: 1131326 - protein, 18 aa, Mycobacterium
AGGQALKWGDRFGATAAA

SEQ ID NO: 1131327 - protein, 17 aa, Mycobacterium
AGIGVAFGRRRRTVVIA

SEQ ID NO: 1131328 - protein, 18 aa, Mycobacterium
AGIIGVVLMILVIMIGLQ

SEQ ID NO: 1131329 - protein, 18 aa, Mycobacterium
AGLAVPRPLTALIDEATS

SEQ ID NO: 1131330 - protein, 18 aa, Mycobacterium
AGLIAAMLALIMNWTGQD

SEQ ID NO: 1131331 - protein, 24 aa, Mycobacterium
AGLILAFLALFWVNQNYQPELPAP

SEQ ID NO: 1131332 - protein, 20 aa, Mycobacterium
AGLVEWPVLVTVGGAALVMH

SEQ ID NO: 1131333 - protein, 17 aa, Mycobacterium
AGMPRGLVPLALMMFGL

SEQ ID NO: 1131334 - protein, 24 aa, Mycobacterium
AGNWPDPLPLLGWVLAAAAVATFV

SEQ ID NO: 1131335 - protein, 21 aa, Mycobacterium
AGPARTFFKVTLPLIVPGIVA

SEQ ID NO: 1131336 - protein, 19 aa, Mycobacterium
AGPMGFAGTVSRDAAQAGG

SEQ ID NO: 1131337 - protein, 20 aa, Mycobacterium
AGTQDWKAWLFGSLDAGNAI

SEQ ID NO: 1131338 - protein, 18 aa, Mycobacterium
AGVAVLWIRKLADRHHHR

SEQ ID NO: 1131339 - protein, 18 aa, Mycobacterium
AGVAYAWWPDEAAYRPIQ

SEQ ID NO: 1131340 - protein, 22 aa, Mycobacterium
AGYAGTCFVRLAPSVPPPSPHD

SEQ ID NO: 1131341 - protein, 23 aa, Mycobacterium
AGYCVGRFWIELMRSDTATLLAG

SEQ ID NO: 1131342 - protein, 18 aa, Mycobacterium
AGYLKWQDTTFRSGAIEA

SEQ ID NO: 1131343 - protein, 19 aa, Mycobacterium
AGYVLWWAVLFPAISLPII

SEQ ID NO: 1131344 - protein, 22 aa, Mycobacterium
AHDRAVVIPAILVVVLLVLYLL

SEQ ID NO: 1131345 - protein, 22 aa, Mycobacterium
AHIRTGTLLGERVLALDSDGSG

SEQ ID NO: 1131346 - protein, 17 aa, Mycobacterium
AHRLDWQPWTPAADAGP

SEQ ID NO: 1131347 - protein, 20 aa, Mycobacterium
AIAALVGRANWWPSKVGPQQ

SEQ ID NO: 1131348 - protein, 25 aa, Mycobacterium
AIAPRAISAPGLRYHGCGSPGGGWS

SEQ ID NO: 1131349 - protein, 23 aa, Mycobacterium
AIATLLGRWFWWPLVVRSRPLRL

SEQ ID NO: 1131350 - protein, 17 aa, Mycobacterium
AIGGEWGGATLMVTEHA

SEQ ID NO: 1131351 - protein, 17 aa, Mycobacterium
AIMSVVLALGVRRMAAR

SEQ ID NO: 1131352 - protein, 18 aa, Mycobacterium
AINCGYPLIERFPLMFFT

SEQ ID NO: 1131353 - protein, 19 aa, Mycobacterium
AISVPSYWSPATTAALADT

SEQ ID NO: 1131354 - protein, 18 aa, Mycobacterium
AITQGLFPAVAVVLLVAG

SEQ ID NO: 1131355 - protein, 24 aa, Mycobacterium
AITRWNVPFARLFDQLTIIPAYIP

SEQ ID NO: 1131356 - protein, 24 aa, Mycobacterium
AITSRLPLVLGLIAVSTFCLLFLL

SEQ ID NO: 1131357 - protein, 20 aa, Mycobacterium
AKAPVPMWRKVVRQFQDPLI

SEQ ID NO: 1131358 - protein, 21 aa, Mycobacterium
AKERRFAVAFVMVGAVLFVAG

SEQ ID NO: 1131359 - protein, 18 aa, Mycobacterium
AKLWPLVLGRLVAAAVVL

SEQ ID NO: 1131360 - protein, 19 aa, Mycobacterium
ALARYGLVVVIAWIGALKF

SEQ ID NO: 1131361 - protein, 26 aa, Mycobacterium
ALCAALALIIFICWSLFAGTFRSYVP

SEQ ID NO: 1131362 - protein, 17 aa, Mycobacterium
ALCLPWLLHRLGRDPAF

SEQ ID NO: 1131363 - protein, 24 aa, Mycobacterium
ALEGKVLSVDFGKSFMVSGVEVTP

SEQ ID NO: 1131364 - protein, 17 aa, Mycobacterium
ALFALAVGIVFTWLFMY

SEQ ID NO: 1131365 - protein, 18 aa, Mycobacterium
ALGARWLPVSGHPSLIVA

SEQ ID NO: 1131366 - protein, 17 aa, Mycobacterium
ALIGFWWREQYRVSDGL

SEQ ID NO: 1131367 - protein, 24 aa, Mycobacterium
ALIGICVVELWRGRRHFAPRTTLA

SEQ ID NO: 1131368 - protein, 19 aa, Mycobacterium
ALLMRIHIAVPFGLAAATT

SEQ ID NO: 1131369 - protein, 18 aa, Mycobacterium
ALMWGEWGFVLLFGVLAV

SEQ ID NO: 1131370 - protein, 18 aa, Mycobacterium
ALNLCMAMGLALAIDYTL

SEQ ID NO: 1131371 - protein, 21 aa, Mycobacterium
ALPGLAGLIFLTFSGGVIGYR

SEQ ID NO: 1131372 - protein, 20 aa, Mycobacterium
ALQFMVMFGVAYLIVQYVQL

SEQ ID NO: 1131373 - protein, 20 aa, Mycobacterium
ALRGALRAAPRLSPNGIPPA

SEQ ID NO: 1131374 - protein, 17 aa, Mycobacterium
ALRRDRVRLSVWISVLT

SEQ ID NO: 1131375 - protein, 18 aa, Mycobacterium
ALSLPPLLLGMLGSLAYV

SEQ ID NO: 1131376 - protein, 17 aa, Mycobacterium
ALSRRATTSGGRRIGTV

SEQ ID NO: 1131377 - protein, 17 aa, Mycobacterium
ALTELWRSYDVHPDAVI

SEQ ID NO: 1131378 - protein, 21 aa, Mycobacterium
ALTEVSWRLAFLVNVPIGLIM

SEQ ID NO: 1131379 - protein, 22 aa, Mycobacterium
ALVRLSAWYVFRFGRRRLDEQI

SEQ ID NO: 1131380 - protein, 17 aa, Mycobacterium
AMFIFFGLWTLRGDSLT

SEQ ID NO: 1131381 - protein, 18 aa, Mycobacterium
AMLLPAFVALFGVIAALF

SEQ ID NO: 1131382 - protein, 18 aa, Mycobacterium
AMLTWSFVSLGVVGVVAG

SEQ ID NO: 1131383 - protein, 21 aa, Mycobacterium
ANEAQGLWLLERAGLITLNPA

SEQ ID NO: 1131384 - protein, 19 aa, Mycobacterium
ANLKCLCRKHHLLKTFWTG

SEQ ID NO: 1131385 - protein, 20 aa, Mycobacterium
ANLVGGWVLMWLIMTALPRL

SEQ ID NO: 1131386 - protein, 18 aa, Mycobacterium
ANVRRFVDDVAFVVGKES

SEQ ID NO: 1131387 - protein, 19 aa, Mycobacterium
APARLARPFAMLVDLLAAV

SEQ ID NO: 1131388 - protein, 18 aa, Mycobacterium
APGWLRRVHERLGFTEAP

SEQ ID NO: 1131389 - protein, 23 aa, Mycobacterium
APKRLAMQYARRWALVVASPLSA

SEQ ID NO: 1131390 - protein, 24 aa, Mycobacterium
APKRLGMQYARRWAALVAPVLRAL

SEQ ID NO: 1131391 - protein, 20 aa, Mycobacterium
APLKFAQLVGFAFAVVGVLG

SEQ ID NO: 1131392 - protein, 24 aa, Mycobacterium
APLLGVLCSVGWQPRPPGVSVSTS

SEQ ID NO: 1131393 - protein, 18 aa, Mycobacterium
APLSWDIGFLIFGALLVA

SEQ ID NO: 1131394 - protein, 24 aa, Mycobacterium
APPRWLPDWLRPRPLVNSARQATA

SEQ ID NO: 1131395 - protein, 18 aa, Mycobacterium
APRFSRKIIRAVAKHYLP

SEQ ID NO: 1131396 - protein, 18 aa, Mycobacterium
APRLPGPLIAVLGAAAVV

SEQ ID NO: 1131397 - protein, 18 aa, Mycobacterium
APVLGWWAGVLVQVLPQR

SEQ ID NO: 1131398 - protein, 20 aa, Mycobacterium
APWAKGLVEFMCLLPLTIPA

SEQ ID NO: 1131399 - protein, 23 aa, Mycobacterium
AQANRIAHRWMFTGAVPSGNSTD

SEQ ID NO: 1131400 - protein, 17 aa, Mycobacterium
AQCSVGFGVGRECDELT

SEQ ID NO: 1131401 - protein, 23 aa, Mycobacterium
AQVGSWRWAFGVLVGLTVAMGVL

SEQ ID NO: 1131402 - protein, 18 aa, Mycobacterium
AQVPRWADGTAFEGVAKS

SEQ ID NO: 1131403 - protein, 17 aa, Mycobacterium
AQYSWFIGCGVAFAIYY

SEQ ID NO: 1131404 - protein, 21 aa, Mycobacterium
ARAGFIGVVLIILVIAVGLQP

SEQ ID NO: 1131405 - protein, 19 aa, Mycobacterium
ARALLRAMVCQLAAFHSPA

SEQ ID NO: 1131406 - protein, 20 aa, Mycobacterium
ARFLFHCWVALTVLIAVLTV

SEQ ID NO: 1131407 - protein, 23 aa, Mycobacterium
ARGQRVPFRLAYPLRSGVPSSMR

SEQ ID NO: 1131408 - protein, 17 aa, Mycobacterium
ARIDAGVGMVFQHFNLF

SEQ ID NO: 1131409 - protein, 18 aa, Mycobacterium
ARIREFWLAGGRRDNDES

SEQ ID NO: 1131410 - protein, 21 aa, Mycobacterium
ARLRPRFASLVGLSEVLFAVL

SEQ ID NO: 1131411 - protein, 24 aa, Mycobacterium
ARQRSRRVLFFWVVAVITLAALAA

SEQ ID NO: 1131412 - protein, 22 aa, Mycobacterium
ARRFSGLALWCFAAMAVSGIVN

SEQ ID NO: 1131413 - protein, 19 aa, Mycobacterium
ARRLLSLPAGEVARSDLPE

SEQ ID NO: 1131414 - protein, 18 aa, Mycobacterium
ARRPRVWWLTAIGNSGAM

SEQ ID NO: 1131415 - protein, 18 aa, Mycobacterium
ARRQWPVLVGRWLFHGAL

SEQ ID NO: 1131416 - protein, 17 aa, Mycobacterium
ARRRIVFRFRTSPIEIK

SEQ ID NO: 1131417 - protein, 19 aa, Mycobacterium
ARSLLGLAVGWFVGALVVL

SEQ ID NO: 1131418 - protein, 23 aa, Mycobacterium
ARVFVEWRFDLIFGTAAFVIAGI

SEQ ID NO: 1131419 - protein, 19 aa, Mycobacterium
ARVWRRIRIGIVVAACLVT

SEQ ID NO: 1131420 - protein, 20 aa, Mycobacterium
ARWRGLRALVGIVIAFGVLV

SEQ ID NO: 1131421 - protein, 19 aa, Mycobacterium
ARWRGLRALVGIVVAFAVL

SEQ ID NO: 1131422 - protein, 19 aa, Mycobacterium
ARYLALFLAMLIGAYLLVF

SEQ ID NO: 1131423 - protein, 17 aa, Mycobacterium
ASFAVNWLLQWAAGGPN

SEQ ID NO: 1131424 - protein, 18 aa, Mycobacterium
ASLLADWVAHLSVHEQTP

SEQ ID NO: 1131425 - protein, 18 aa, Mycobacterium
ASLSWQWGAAAIGRRRRR

SEQ ID NO: 1131426 - protein, 18 aa, Mycobacterium
ASREKLTMMAARAGLNLD

SEQ ID NO: 1131427 - protein, 19 aa, Mycobacterium
ASRGRWALVPLAVVIAADG

SEQ ID NO: 1131428 - protein, 20 aa, Mycobacterium
ASRLLGRMCALPLTVGMLMS

SEQ ID NO: 1131429 - protein, 22 aa, Mycobacterium
ASVMTHYRWLRALAGFGGLGLR

SEQ ID NO: 1131430 - protein, 28 aa, Mycobacterium
ATDRGEAELAHLLAGWRDDVRETPMGHV

SEQ ID NO: 1131431 - protein, 26 aa, Mycobacterium
ATGADPMMRWMFWTGLLVTAIDVLIA

SEQ ID NO: 1131432 - protein, 19 aa, Mycobacterium
ATGCPFCRVMMTDGVDDVS

SEQ ID NO: 1131433 - protein, 25 aa, Mycobacterium
ATIDSRWKWIAGVAGAVLLVAVICT

SEQ ID NO: 1131434 - protein, 23 aa, Mycobacterium
ATIIRMFLVPAIMKLLGDDCWWA

SEQ ID NO: 1131435 - protein, 18 aa, Mycobacterium
ATLIAVIGLGLFYTFISA

SEQ ID NO: 1131436 - protein, 24 aa, Mycobacterium
ATLPVAVTIGVLWGVVILLIDRAL

SEQ ID NO: 1131437 - protein, 19 aa, Mycobacterium
ATLWVLMRFVLPWLMPQIA

SEQ ID NO: 1131438 - protein, 18 aa, Mycobacterium
ATQMGWRAALLVTPALAA

SEQ ID NO: 1131439 - protein, 23 aa, Mycobacterium
ATVLCLVGLLALPGYHTNYNDRI

SEQ ID NO: 1131440 - protein, 17 aa, Mycobacterium
ATVNGWWYVSNFGVPWS

SEQ ID NO: 1131441 - protein, 17 aa, Mycobacterium
AVAADLGRRVHAIGVTW

SEQ ID NO: 1131442 - protein, 17 aa, Mycobacterium
AVADVRFDFPITVDAPR

SEQ ID NO: 1131443 - protein, 20 aa, Mycobacterium
AVAIPAWWQQYVLSVGSLAP

SEQ ID NO: 1131444 - protein, 19 aa, Mycobacterium
AVCFVVRLLADMYLTQRFM

SEQ ID NO: 1131445 - protein, 20 aa, Mycobacterium
AVCIVLRLARFNAMLAEDLP

SEQ ID NO: 1131446 - protein, 22 aa, Mycobacterium
AVCIVLRLARFNAMLDVEQPAY

SEQ ID NO: 1131447 - protein, 18 aa, Mycobacterium
AVEQRWGRWVAFGVTTVV

SEQ ID NO: 1131448 - protein, 18 aa, Mycobacterium
AVEWLKSVIPFGGFPWGV

SEQ ID NO: 1131449 - protein, 17 aa, Mycobacterium
AVFCVLGVLPLIVLTQV

SEQ ID NO: 1131450 - protein, 19 aa, Mycobacterium
AVFVLWVWAQRRRRKRRAA

SEQ ID NO: 1131451 - protein, 17 aa, Mycobacterium
AVICLAAGFVLTRGRPR

SEQ ID NO: 1131452 - protein, 22 aa, Mycobacterium
AVILCIFIYWGWDACLAVGEET

SEQ ID NO: 1131453 - protein, 17 aa, Mycobacterium
AVLAFALLLLFGFGMIW

SEQ ID NO: 1131454 - protein, 18 aa, Mycobacterium
AVLICLGAVLLAYFKPLG

SEQ ID NO: 1131455 - protein, 20 aa, Mycobacterium
AVLLPWNIATGITIAGSPGW

SEQ ID NO: 1131456 - protein, 18 aa, Mycobacterium
AVLPADSGVGLWTFDGVQ

SEQ ID NO: 1131457 - protein, 18 aa, Mycobacterium
AVLSYWLLERPIRRWRPA

SEQ ID NO: 1131458 - protein, 24 aa, Mycobacterium
AVRPELKPALAQQNWGTLPGLQTN

SEQ ID NO: 1131459 - protein, 21 aa, Mycobacterium
AVTAWGWRIGFFIGGIAALVV

SEQ ID NO: 1131460 - protein, 17 aa, Mycobacterium
AVVALTLSVLLFTTVVV

SEQ ID NO: 1131461 - protein, 23 aa, Mycobacterium
AVVFRIGRALGRMRTHTFAHADA

SEQ ID NO: 1131462 - protein, 20 aa, Mycobacterium
AVVLLLGWSFFYFSDDTRGF

SEQ ID NO: 1131463 - protein, 20 aa, Mycobacterium
AVVLLLGWSFFYFSDDTRGY

SEQ ID NO: 1131464 - protein, 18 aa, Mycobacterium
AVVMAMLYEPGRPYRKNY

SEQ ID NO: 1131465 - protein, 22 aa, Mycobacterium
AVVPHVRWPMWLRTLLAVVALA

SEQ ID NO: 1131466 - protein, 20 aa, Mycobacterium
AVVSGALWGLFAVLTKAVVH

SEQ ID NO: 1131467 - protein, 18 aa, Mycobacterium
AVVWYFWVRKTHRGNVLT

SEQ ID NO: 1131468 - protein, 21 aa, Mycobacterium
AWLVLHLVYLVGFKTKIVTLL

SEQ ID NO: 1131469 - protein, 25 aa, Mycobacterium
AWRRVGATVVRWPGPILVASLALAL

SEQ ID NO: 1131470 - protein, 25 aa, Mycobacterium
AWSRSIPRVMLLSALIGSAAVYLGL

SEQ ID NO: 1131471 - protein, 18 aa, Mycobacterium
AYELWRFDTVRSWVLVAV

SEQ ID NO: 1131472 - protein, 23 aa, Mycobacterium
AYSGDTWRLWSFPWDARETGFHT

SEQ ID NO: 1131473 - protein, 19 aa, Mycobacterium
AYTEYKLNSAFAVGGPKCL

SEQ ID NO: 1131474 - protein, 17 aa, Mycobacterium
CAHDLWVAGSVRAWLVV

SEQ ID NO: 1131475 - protein, 17 aa, Mycobacterium
CAVGERLRRCVGPSDTL

SEQ ID NO: 1131476 - protein, 20 aa, Mycobacterium
CEPGWPWPWPWPDDPDDRPK

SEQ ID NO: 1131477 - protein, 17 aa, Mycobacterium
CFLYRAWNLPVAVLAGA

SEQ ID NO: 1131478 - protein, 19 aa, Mycobacterium
CGAGFALASAHSWRIKTKW

SEQ ID NO: 1131479 - protein, 25 aa, Mycobacterium
CGNGLRPAIWDAFTERFGIKRVCEF

SEQ ID NO: 1131480 - protein, 19 aa, Mycobacterium
CGQCGSPIGVVAFPDDDAV

SEQ ID NO: 1131481 - protein, 27 aa, Mycobacterium
CHRPNRTWWRFVAWWLPCVALAVTWWV

SEQ ID NO: 1131482 - protein, 18 aa, Mycobacterium
CILLRAVIAPIYLVASVV

SEQ ID NO: 1131483 - protein, 24 aa, Mycobacterium
CLHFTRLPYFQSMGFPLAVGMIIV

SEQ ID NO: 1131484 - protein, 21 aa, Mycobacterium
CLSFTRLPYFQSLGVPLALGM

SEQ ID NO: 1131485 - protein, 21 aa, Mycobacterium
CLSFTRLPYFQTMGVPCAVGT

SEQ ID NO: 1131486 - protein, 18 aa, Mycobacterium
CPLGELIAPLTFVVFAYT

SEQ ID NO: 1131487 - protein, 17 aa, Mycobacterium
CSPLRFIEYLSVKILVL

SEQ ID NO: 1131488 - protein, 17 aa, Mycobacterium
CSVGFLPPSSWRSPADL

SEQ ID NO: 1131489 - protein, 17 aa, Mycobacterium
CTSCGAVNVGGTWHESA

SEQ ID NO: 1131490 - protein, 17 aa, Mycobacterium
CVRRLAASAGRVAQAPV

SEQ ID NO: 1131491 - protein, 24 aa, Mycobacterium
CVVLAGLLGMCSFQGRGPTEGPAP

SEQ ID NO: 1131492 - protein, 18 aa, Mycobacterium
DAAVIEWVSQYWNQFLLW

SEQ ID NO: 1131493 - protein, 21 aa, Mycobacterium
DAFLSWGWRVAFWLSAVVVLV

SEQ ID NO: 1131494 - protein, 22 aa, Mycobacterium
DAFLSYGWRIAFLVSVVLVIFG

SEQ ID NO: 1131495 - protein, 25 aa, Mycobacterium
DAIPLKHPWRWLAAAAIIVLVGLFL

SEQ ID NO: 1131496 - protein, 23 aa, Mycobacterium
DALARRIAKLMGYRTTAVCVIEP

SEQ ID NO: 1131497 - protein, 23 aa, Mycobacterium
DALELRGRILGAFEQAERSSDPA

SEQ ID NO: 1131498 - protein, 20 aa, Mycobacterium
DALLGWAHLLLWAMFTCIEL

SEQ ID NO: 1131499 - protein, 19 aa, Mycobacterium
DALYGLRTMLFGEQAQTRD

SEQ ID NO: 1131500 - protein, 21 aa, Mycobacterium
DAPSVWDWTKWLPHIQHHSKR

SEQ ID NO: 1131501 - protein, 20 aa, Mycobacterium
DARSGFHIHGAAGLLNLFTF

SEQ ID NO: 1131502 - protein, 17 aa, Mycobacterium
DAVACARRLARYRPGAG

SEQ ID NO: 1131503 - protein, 23 aa, Mycobacterium
DAVPRPLSRYAFALLAYAFAVTM

SEQ ID NO: 1131504 - protein, 18 aa, Mycobacterium
DAWGWRWVFVPLVPVALA

SEQ ID NO: 1131505 - protein, 17 aa, Mycobacterium
DAWSWLKWLPHTDVPGQ

SEQ ID NO: 1131506 - protein, 23 aa, Mycobacterium
DDQMHDWGWRLPFLLAAPLGLVG

SEQ ID NO: 1131507 - protein, 18 aa, Mycobacterium
DDRFDAFNANTWTFRPPP

SEQ ID NO: 1131508 - protein, 19 aa, Mycobacterium
DDRLEVADSLTFGRLDDRA

SEQ ID NO: 1131509 - protein, 20 aa, Mycobacterium
DEVLYFFLVESAIVFLAAYV

SEQ ID NO: 1131510 - protein, 24 aa, Mycobacterium
DEWNWWLPRWLDRILPSVDFEKPL

SEQ ID NO: 1131511 - protein, 21 aa, Mycobacterium
DEYQWRIGFLRSRGLLPVLRW

SEQ ID NO: 1131512 - protein, 24 aa, Mycobacterium
DFAEFRLGSPRLRKVAMLVVVVIC

SEQ ID NO: 1131513 - protein, 17 aa, Mycobacterium
DGGLRWLYLATVGCSIS

SEQ ID NO: 1131514 - protein, 19 aa, Mycobacterium
DGGVRWLEWNVVSDRGVLL

SEQ ID NO: 1131515 - protein, 27 aa, Mycobacterium
DGPARIGLGRICWRRDLLGGVGLAMLI

SEQ ID NO: 1131516 - protein, 18 aa, Mycobacterium
DGSWRWFVTHTRRAARGL

SEQ ID NO: 1131517 - protein, 23 aa, Mycobacterium
DHMPELHWTFGYPAVLMVMISVC

SEQ ID NO: 1131518 - protein, 17 aa, Mycobacterium
DHPRLGSLAGYLDELAP

SEQ ID NO: 1131519 - protein, 17 aa, Mycobacterium
DHPRLGSLAGYLDELDP

SEQ ID NO: 1131520 - protein, 20 aa, Mycobacterium
DHRFGWSSAPAWVVVVGNTL

SEQ ID NO: 1131521 - protein, 17 aa, Mycobacterium
DHTVPWPAGPTCAANLK

SEQ ID NO: 1131522 - protein, 20 aa, Mycobacterium
DISVRVSLWLGVAVVAGLFG

SEQ ID NO: 1131523 - protein, 22 aa, Mycobacterium
DLIGHLPLPLGVAGHEGSTIVV

SEQ ID NO: 1131524 - protein, 17 aa, Mycobacterium
DLQRAPLLASYRSVARF

SEQ ID NO: 1131525 - protein, 19 aa, Mycobacterium
DLRASLPLLTRGLIGRRRP

SEQ ID NO: 1131526 - protein, 20 aa, Mycobacterium
DLRLQWSWRSAGIGLLFGIL

SEQ ID NO: 1131527 - protein, 21 aa, Mycobacterium
DLRRLEGLIAPGSWNIDPSAQ

SEQ ID NO: 1131528 - protein, 21 aa, Mycobacterium
DMYRYAVAIGLDIEQFDQDVR

SEQ ID NO: 1131529 - protein, 24 aa, Mycobacterium
DPAPRPRRRLGLLLSVAAVILVLD

SEQ ID NO: 1131530 - protein, 19 aa, Mycobacterium
DPDALRRLFGWFVLLMASV

SEQ ID NO: 1131531 - protein, 21 aa, Mycobacterium
DPEVLGGLLITVGDEVIDGSI

SEQ ID NO: 1131532 - protein, 23 aa, Mycobacterium
DPKTRVCSAFELVRGAVSLQTNA

SEQ ID NO: 1131533 - protein, 22 aa, Mycobacterium
DPLRRRACLTYALWITIAQIGW

SEQ ID NO: 1131534 - protein, 20 aa, Mycobacterium
DPNLRPAIVGVFTDLTGPAP

SEQ ID NO: 1131535 - protein, 23 aa, Mycobacterium
DPTLRWMYWWGLLITAADILIAL

SEQ ID NO: 1131536 - protein, 23 aa, Mycobacterium
DPVALRLLWTVPLLSFFAAGAGV

SEQ ID NO: 1131537 - protein, 24 aa, Mycobacterium
DPVLLDWLVGLAFPCQRPFGHRNG

SEQ ID NO: 1131538 - protein, 17 aa, Mycobacterium
DQMSWFTPARWGFAASA

SEQ ID NO: 1131539 - protein, 24 aa, Mycobacterium
DQQRWSFDLAMTWDLLSRSFTHGI

SEQ ID NO: 1131540 - protein, 24 aa, Mycobacterium
DRAHPRPVVGFGFGLLTAGLIWLA

SEQ ID NO: 1131541 - protein, 19 aa, Mycobacterium
DRLRIPFGHELKTGDVMYL

SEQ ID NO: 1131542 - protein, 24 aa, Mycobacterium
DRSHPRPVVGFGFALMAIGLTWLS

SEQ ID NO: 1131543 - protein, 18 aa, Mycobacterium
DSLAPALIIFLTLALLTN

SEQ ID NO: 1131544 - protein, 20 aa, Mycobacterium
DSLRKTFGWFVLVMSSVILA

SEQ ID NO: 1131545 - protein, 19 aa, Mycobacterium
DSLRSWRRFVLYGVIVAPA

SEQ ID NO: 1131546 - protein, 18 aa, Mycobacterium
DSSLRWVDVLGMSMLAGI

SEQ ID NO: 1131547 - protein, 20 aa, Mycobacterium
DTGPPWPLWAVIFITSGMVL

SEQ ID NO: 1131548 - protein, 23 aa, Mycobacterium
DTPAWRLALPLTMVGAAGAFTWE

SEQ ID NO: 1131549 - protein, 23 aa, Mycobacterium
DTRLYLPMPFFWIGGLGGGLLSA

SEQ ID NO: 1131550 - protein, 17 aa, Mycobacterium
DTSSGWLPWALGGLFVA

SEQ ID NO: 1131551 - protein, 18 aa, Mycobacterium
DVPALGWFVMCCAAAALT

SEQ ID NO: 1131552 - protein, 22 aa, Mycobacterium
DWDRRLRPMLARQFELATGQRK

SEQ ID NO: 1131553 - protein, 23 aa, Mycobacterium
EAAEPLFGSWGVRLTVAVAVVAT

SEQ ID NO: 1131554 - protein, 18 aa, Mycobacterium
EAASWWKALLALVVAVAL

SEQ ID NO: 1131555 - protein, 31 aa, Mycobacterium
EADSATPWYRKPVALVSFGAVGALLIALVVF

SEQ ID NO: 1131556 - protein, 20 aa, Mycobacterium
EALRRWAAVLVMTIFVVVMP

SEQ ID NO: 1131557 - protein, 22 aa, Mycobacterium
EAQSNQGAAHFCVVLATHRHAV

SEQ ID NO: 1131558 - protein, 25 aa, Mycobacterium
EARSLLYLLLRPYRWVVLALAVVVV

SEQ ID NO: 1131559 - protein, 28 aa, Mycobacterium
EEPQPWYRKPGALIALGAIAALLVAVIV

SEQ ID NO: 1131560 - protein, 25 aa, Mycobacterium
EERLDRRWMWIAGVAGAILFVAVIT

SEQ ID NO: 1131561 - protein, 22 aa, Mycobacterium
EFSPRLAALGRFTLRHKALVIG

SEQ ID NO: 1131562 - protein, 19 aa, Mycobacterium
EGLLHFGLSINQPPPCLTG

SEQ ID NO: 1131563 - protein, 17 aa, Mycobacterium
EGLRFVWRNKVLRTLAL

SEQ ID NO: 1131564 - protein, 17 aa, Mycobacterium
EGTIDWLGAVGLAAGLS

SEQ ID NO: 1131565 - protein, 19 aa, Mycobacterium
EGVDSRLGRRVAIKVLKAE

SEQ ID NO: 1131566 - protein, 17 aa, Mycobacterium
EGVPTWWIAGGVVAAAA

SEQ ID NO: 1131567 - protein, 20 aa, Mycobacterium
EIPRWLRFVLASDRAGSAWY

SEQ ID NO: 1131568 - protein, 17 aa, Mycobacterium
EKLRNGVVLTMCAGAVV

SEQ ID NO: 1131569 - protein, 19 aa, Mycobacterium
EKQRISAFVLPRGLITVRL

SEQ ID NO: 1131570 - protein, 29 aa, Mycobacterium
ELAPLPWYKRPPVLFGVAAAAALLAAGGL

SEQ ID NO: 1131571 - protein, 24 aa, Mycobacterium
ELGYRSVFTTVLFTRVVVFLVVSL

SEQ ID NO: 1131572 - protein, 22 aa, Mycobacterium
ELLRTPELYAWAVVALLGTSTQ

SEQ ID NO: 1131573 - protein, 23 aa, Mycobacterium
ELQADCYAGIWAHYASITKQEGT

SEQ ID NO: 1131574 - protein, 20 aa, Mycobacterium
ELQNLPAPSRRWWQFWGSTL

SEQ ID NO: 1131575 - protein, 18 aa, Mycobacterium
ELRDDWRPVLWAVAILTM

SEQ ID NO: 1131576 - protein, 18 aa, Mycobacterium
ELSWPAHRPIAASVDAAT

SEQ ID NO: 1131577 - protein, 18 aa, Mycobacterium
ELVAEGWLASRQGAGTWV

SEQ ID NO: 1131578 - protein, 20 aa, Mycobacterium
EMLPRGWGEVGQWFPQGATA

SEQ ID NO: 1131579 - protein, 25 aa, Mycobacterium
EPHCYNIPLCWSFRSLFDSMDGISV

SEQ ID NO: 1131580 - protein, 20 aa, Mycobacterium
EPHCYNIPMCWALRSVFDSL

SEQ ID NO: 1131581 - protein, 25 aa, Mycobacterium
EPHCYNIPVCHSMRSLFDLIDGTNL

SEQ ID NO: 1131582 - protein, 18 aa, Mycobacterium
EPPLRLPTYLTDNAGALD

SEQ ID NO: 1131583 - protein, 21 aa, Mycobacterium
EPRTWRLSVSLKREDGQIKMA

SEQ ID NO: 1131584 - protein, 21 aa, Mycobacterium
EPSWFAWLIVVWLWLTVLFAN

SEQ ID NO: 1131585 - protein, 24 aa, Mycobacterium
EPVLARSGARWMPNFIDLLQRNLT

SEQ ID NO: 1131586 - protein, 18 aa, Mycobacterium
EPVRRRWLTWSRYARTWE

SEQ ID NO: 1131587 - protein, 24 aa, Mycobacterium
EQMHAWGWRLPFLVAAPLGLIGLY

SEQ ID NO: 1131588 - protein, 23 aa, Mycobacterium
EQMRKRFGSTMGYELDIRADTAS

SEQ ID NO: 1131589 - protein, 19 aa, Mycobacterium
ERDIRFIIIAALIVVLVTL

SEQ ID NO: 1131590 - protein, 21 aa, Mycobacterium
EREKLRYGVVLTMCAGAVVGA

SEQ ID NO: 1131591 - protein, 17 aa, Mycobacterium
ERFRLAFDTAPVGMFMF

SEQ ID NO: 1131592 - protein, 22 aa, Mycobacterium
ERLGPFWGHAAGWSFIVGKTAS

SEQ ID NO: 1131593 - protein, 17 aa, Mycobacterium
ERPNPYALSGAYETEVV

SEQ ID NO: 1131594 - protein, 23 aa, Mycobacterium
ERVFEVLDLVPLIRERPGAVEVP

SEQ ID NO: 1131595 - protein, 19 aa, Mycobacterium
ERWEHVLFPIVLIALGLFI

SEQ ID NO: 1131596 - protein, 19 aa, Mycobacterium
ESLFRLDHLAARMRRNGAN

SEQ ID NO: 1131597 - protein, 18 aa, Mycobacterium
ESLFRLDHLAARMRRNGS

SEQ ID NO: 1131598 - protein, 26 aa, Mycobacterium
ESSGLKWTWWWLLAIVPVLLLAGLAA

SEQ ID NO: 1131599 - protein, 20 aa, Mycobacterium
ETMLLFLPMVAWLVWTKTAP

SEQ ID NO: 1131600 - protein, 18 aa, Mycobacterium
EVLFFRWLLDGNRSHEWW

SEQ ID NO: 1131601 - protein, 20 aa, Mycobacterium
EVNIWFLVQFLERPFVPLIP

SEQ ID NO: 1131602 - protein, 24 aa, Mycobacterium
EVRILNYFFCWAAIYQLGIAWHGA

SEQ ID NO: 1131603 - protein, 19 aa, Mycobacterium
EWLRLDPVLPLLAAPIALS

SEQ ID NO: 1131604 - protein, 17 aa, Mycobacterium
EYLPWRGFFRHFSGYAD

SEQ ID NO: 1131605 - protein, 20 aa, Mycobacterium
FAAACLGEYGYLSTVDLGDV

SEQ ID NO: 1131606 - protein, 18 aa, Mycobacterium
FAAFQLWMARGLALIVTH

SEQ ID NO: 1131607 - protein, 24 aa, Mycobacterium
FAAFREFERLLGLDQPPAVQPEVP

SEQ ID NO: 1131608 - protein, 22 aa, Mycobacterium
FAAVRDMFGWIGPVLAALHGNA

SEQ ID NO: 1131609 - protein, 19 aa, Mycobacterium
FAEGAGWLAQIGVFVILGL

SEQ ID NO: 1131610 - protein, 17 aa, Mycobacterium
FAGFPALLIVVALLIGS

SEQ ID NO: 1131611 - protein, 19 aa, Mycobacterium
FALGIAMLLGGTWLTCILA

SEQ ID NO: 1131612 - protein, 25 aa, Mycobacterium
FALYVAGYCLGRFWIELLRSDMATE

SEQ ID NO: 1131613 - protein, 25 aa, Mycobacterium
FAQYSSWRWAFGILVVMTTAMSALV

SEQ ID NO: 1131614 - protein, 17 aa, Mycobacterium
FARADWAPEALVLVGSA

SEQ ID NO: 1131615 - protein, 17 aa, Mycobacterium
FCVAELLANVSKHSGAG

SEQ ID NO: 1131616 - protein, 18 aa, Mycobacterium
FCVVELRVAQPMVNVRLF

SEQ ID NO: 1131617 - protein, 17 aa, Mycobacterium
FDFKAQGVWSFARPGAP

SEQ ID NO: 1131618 - protein, 18 aa, Mycobacterium
FFTMWGFFVLATVYIEAF

SEQ ID NO: 1131619 - protein, 17 aa, Mycobacterium
FGAGIGMGFHRRRPAVV

SEQ ID NO: 1131620 - protein, 25 aa, Mycobacterium
FGAVGALLIALVVFGLARAITGDST

SEQ ID NO: 1131621 - protein, 18 aa, Mycobacterium
FGCKRPTFSNSYYRTFTK

SEQ ID NO: 1131622 - protein, 17 aa, Mycobacterium
FGHDPWWLVLAKSLGIF

SEQ ID NO: 1131623 - protein, 19 aa, Mycobacterium
FGLALARYVPLARRPIVWW

SEQ ID NO: 1131624 - protein, 17 aa, Mycobacterium
FGLDAWRWMFLAMALPA

SEQ ID NO: 1131625 - protein, 19 aa, Mycobacterium
FGMPRFDIVAIITMIIVMM

SEQ ID NO: 1131626 - protein, 20 aa, Mycobacterium
FGNDHFAEWAPGMKSIDDAL

SEQ ID NO: 1131627 - protein, 19 aa, Mycobacterium
FGQAIAWPVPLLAFILLVA

SEQ ID NO: 1131628 - protein, 18 aa, Mycobacterium
FGRRRVFQIGLAVFALGS

SEQ ID NO: 1131629 - protein, 17 aa, Mycobacterium
FGWLAFLIVFGFFTRKV

SEQ ID NO: 1131630 - protein, 17 aa, Mycobacterium
FGYHFSSLVAIVVLLAA

SEQ ID NO: 1131631 - protein, 19 aa, Mycobacterium
FKAQGVWSFARPGAPPIKL

SEQ ID NO: 1131632 - protein, 17 aa, Mycobacterium
FKGGATFLGLERTAHVS

SEQ ID NO: 1131633 - protein, 18 aa, Mycobacterium
FKGGATFLGLERTAHVSA

SEQ ID NO: 1131634 - protein, 19 aa, Mycobacterium
FKLEIARGYLMIALPAGLL

SEQ ID NO: 1131635 - protein, 17 aa, Mycobacterium
FKNGVGLMLQLPEPAKI

SEQ ID NO: 1131636 - protein, 17 aa, Mycobacterium
FLALLLISPLLCIFIVA

SEQ ID NO: 1131637 - protein, 17 aa, Mycobacterium
FLCLLPLTIPALVIVVG

SEQ ID NO: 1131638 - protein, 17 aa, Mycobacterium
FLEQCWFVARVSMAPTL

SEQ ID NO: 1131639 - protein, 24 aa, Mycobacterium
FLFLMRQGYRWARTLLTGGAIATV

SEQ ID NO: 1131640 - protein, 22 aa, Mycobacterium
FLVAFACYFVWHVVKAAVQAML

SEQ ID NO: 1131641 - protein, 17 aa, Mycobacterium
FLVRTVIIPALFTLIGP

SEQ ID NO: 1131642 - protein, 18 aa, Mycobacterium
FMLMWPFWLLAKWLGVPW

SEQ ID NO: 1131643 - protein, 19 aa, Mycobacterium
FPADVLYYFRLYALGTQVV

SEQ ID NO: 1131644 - protein, 17 aa, Mycobacterium
FPIALLLNVTNPLRAEF

SEQ ID NO: 1131645 - protein, 20 aa, Mycobacterium
FPIIFGLSFRDALLATLLGV

SEQ ID NO: 1131646 - protein, 17 aa, Mycobacterium
FPIVLVILLAVFGSLAA

SEQ ID NO: 1131647 - protein, 17 aa, Mycobacterium
FPRSQWLASTRRALGGA

SEQ ID NO: 1131648 - protein, 18 aa, Mycobacterium
FPVVVALLFAMVIGLPLG

SEQ ID NO: 1131649 - protein, 17 aa, Mycobacterium
FQSFSWGIGSLVGKNST

SEQ ID NO: 1131650 - protein, 20 aa, Mycobacterium
FRHRAYRAALFSNFATGWAS

SEQ ID NO: 1131651 - protein, 19 aa, Mycobacterium
FRKRMVTSMAVALLASAVA

SEQ ID NO: 1131652 - protein, 18 aa, Mycobacterium
FRSGLLIVVALAAVLVIA

SEQ ID NO: 1131653 - protein, 18 aa, Mycobacterium
FRYREYRLLIAAVSLSIF

SEQ ID NO: 1131654 - protein, 21 aa, Mycobacterium
FSGTKAALWLSITAFLALVVL

SEQ ID NO: 1131655 - protein, 17 aa, Mycobacterium
FSRKIIRAVAKHYLPEG

SEQ ID NO: 1131656 - protein, 18 aa, Mycobacterium
FSVFGVFWGAFGLASGAA

SEQ ID NO: 1131657 - protein, 25 aa, Mycobacterium
FTDLVTLPAGWAWLENGWVMAIVAV

SEQ ID NO: 1131658 - protein, 23 aa, Mycobacterium
FTERFGIKRVCEFYAASEGNTAF

SEQ ID NO: 1131659 - protein, 17 aa, Mycobacterium
FTFYLCDLLLKVNGKGG

SEQ ID NO: 1131660 - protein, 18 aa, Mycobacterium
FTHALGFAVAERGATMLS

SEQ ID NO: 1131661 - protein, 24 aa, Mycobacterium
FTIASVLCGIAWDEATLVIARLLQ

SEQ ID NO: 1131662 - protein, 25 aa, Mycobacterium
FVAMFQPPFAWREFISQAWFVARVS

SEQ ID NO: 1131663 - protein, 20 aa, Mycobacterium
FVFGVGAGWNLEELRHHGTD

SEQ ID NO: 1131664 - protein, 25 aa, Mycobacterium
FVIKQGLKLAGPIIRGLKGIGKKVK

SEQ ID NO: 1131665 - protein, 22 aa, Mycobacterium
FVLRYFPLRSHFNAERAARAVE

SEQ ID NO: 1131666 - protein, 19 aa, Mycobacterium
FVSLVGWWALSRVLGRLLG

SEQ ID NO: 1131667 - protein, 17 aa, Mycobacterium
FVVTLAFFLGLQGVTLK

SEQ ID NO: 1131668 - protein, 25 aa, Mycobacterium
FWRITLPSIRWGLTYGIVLTIARTL

SEQ ID NO: 1131669 - protein, 18 aa, Mycobacterium
GAASYALIGFWWREQYRV

SEQ ID NO: 1131670 - protein, 18 aa, Mycobacterium
GAFLRLPYTFAVPVFGGR

SEQ ID NO: 1131671 - protein, 23 aa, Mycobacterium
GAGPRFPLSVIGVVAALALLAVG

SEQ ID NO: 1131672 - protein, 20 aa, Mycobacterium
GAKNYPCLTVPGKRAPSVKM

SEQ ID NO: 1131673 - protein, 27 aa, Mycobacterium
GALAVSLLGGWGIRRRLMRQTRGLRPE

SEQ ID NO: 1131674 - protein, 18 aa, Mycobacterium
GALGPRWLVVVGVSCFSL

SEQ ID NO: 1131675 - protein, 18 aa, Mycobacterium
GALIRYALAQAWPQPKQL

SEQ ID NO: 1131676 - protein, 18 aa, Mycobacterium
GALPEFVAAEGLGSDCQY

SEQ ID NO: 1131677 - protein, 20 aa, Mycobacterium
GALRRPQVWLALLVGMIGFG

SEQ ID NO: 1131678 - protein, 17 aa, Mycobacterium
GANCGRLVVILVVGALL

SEQ ID NO: 1131679 - protein, 31 aa, Mycobacterium
GAPFTWRMVLVMVGALLVWLLVVLTLMRISG

SEQ ID NO: 1131680 - protein, 17 aa, Mycobacterium
GAPRGGAVALVLLSGIA

SEQ ID NO: 1131681 - protein, 24 aa, Mycobacterium
GAPVAIAVPAHWGPGTVGALRGAL

SEQ ID NO: 1131682 - protein, 18 aa, Mycobacterium
GATRWDLERQVRLVAGSL

SEQ ID NO: 1131683 - protein, 19 aa, Mycobacterium
GATRWDLERQVRLVAGSLV

SEQ ID NO: 1131684 - protein, 24 aa, Mycobacterium
GAVALGGIGAWIACRRRGIPLPAF

SEQ ID NO: 1131685 - protein, 19 aa, Mycobacterium
GAVFCAFLLLLLAVGFVIK

SEQ ID NO: 1131686 - protein, 18 aa, Mycobacterium
GAVMLFGLMLPWLGAVAI

SEQ ID NO: 1131687 - protein, 19 aa, Mycobacterium
GAVVLSGFVERVGDPVPLV

SEQ ID NO: 1131688 - protein, 24 aa, Mycobacterium
GCAVWRWRRKRPVFALGILAFSSF

SEQ ID NO: 1131689 - protein, 20 aa, Mycobacterium
GDFFSFYLCDLIVKVNGKGG

SEQ ID NO: 1131690 - protein, 18 aa, Mycobacterium
GDIKAIDRRTWLLLVAAA

SEQ ID NO: 1131691 - protein, 19 aa, Mycobacterium
GDYYFSITLPPDFSERVAS

SEQ ID NO: 1131692 - protein, 17 aa, Mycobacterium
GEITLVLPPELARRLTV

SEQ ID NO: 1131693 - protein, 17 aa, Mycobacterium
GELRVDFGLQLDQLSMC

SEQ ID NO: 1131694 - protein, 20 aa, Mycobacterium
GELWFKGPNVMAGYLNNDEA

SEQ ID NO: 1131695 - protein, 22 aa, Mycobacterium
GEPAILFCFGFLLLVAMGAGAW

SEQ ID NO: 1131696 - protein, 28 aa, Mycobacterium
GEPQPWYRKPGALIALGAIAALLVAVIV

SEQ ID NO: 1131697 - protein, 17 aa, Mycobacterium
GEPRLTLPDAITGNPGD

SEQ ID NO: 1131698 - protein, 22 aa, Mycobacterium
GESRGWPTYLLGGRIRASTAGL

SEQ ID NO: 1131699 - protein, 17 aa, Mycobacterium
GEYCGLCGVPLAEHSGD

SEQ ID NO: 1131700 - protein, 23 aa, Mycobacterium
GFRAGQLIFAWTVLSVRLLAARP

SEQ ID NO: 1131701 - protein, 19 aa, Mycobacterium
GFRTEFFIKTGLVLLGASI

SEQ ID NO: 1131702 - protein, 24 aa, Mycobacterium
GGAAWLPFLVAFAIATVTAFSYLE

SEQ ID NO: 1131703 - protein, 23 aa, Mycobacterium
GGFLEYLGAILFSLGGLAFGFLV

SEQ ID NO: 1131704 - protein, 22 aa, Mycobacterium
GGFPDRGTLEWDYGPSERYAER

SEQ ID NO: 1131705 - protein, 20 aa, Mycobacterium
GGIHEIYFPYVLMKPKLIVA

SEQ ID NO: 1131706 - protein, 22 aa, Mycobacterium
GGPGALFWMWAVAFLGASTSFV

SEQ ID NO: 1131707 - protein, 22 aa, Mycobacterium
GGTRWMVLVGIVLGFAFLTKML

SEQ ID NO: 1131708 - protein, 23 aa, Mycobacterium
GGVKRCIGAAFAMRELTTTLHTV

SEQ ID NO: 1131709 - protein, 17 aa, Mycobacterium
GGVYPWARRLWGRRYAW

SEQ ID NO: 1131710 - protein, 19 aa, Mycobacterium
GGWCMKKLDALWEGKIRPG

SEQ ID NO: 1131711 - protein, 17 aa, Mycobacterium
GGWRVIRTLGKGLVEIE

SEQ ID NO: 1131712 - protein, 25 aa, Mycobacterium
GHAVAKRLGCKVVQGYGMSELSPVS

SEQ ID NO: 1131713 - protein, 18 aa, Mycobacterium
GIAAEFTDKVFVIFQRLH

SEQ ID NO: 1131714 - protein, 18 aa, Mycobacterium
GIFVVVCALGAFALIAVF

SEQ ID NO: 1131715 - protein, 18 aa, Mycobacterium
GIGFIPFVIALGIGLGLS

SEQ ID NO: 1131716 - protein, 19 aa, Mycobacterium
GILRPEFRVAAGAVLAGAL

SEQ ID NO: 1131717 - protein, 25 aa, Mycobacterium
GISKSRWLRWPARIYTDIFRGLPEV

SEQ ID NO: 1131718 - protein, 18 aa, Mycobacterium
GISLVWLFGHWQSVFWVN

SEQ ID NO: 1131719 - protein, 24 aa, Mycobacterium
GKGACFRLTLPLVRGHKVTSSPLP

SEQ ID NO: 1131720 - protein, 24 aa, Mycobacterium
GKGGRFRCTFGFTFDVTEGQDRYV

SEQ ID NO: 1131721 - protein, 21 aa, Mycobacterium
GKRLWEIVGLVAPGRGGHEDD

SEQ ID NO: 1131722 - protein, 19 aa, Mycobacterium
GKYWWLRWALIALAVIVLT

SEQ ID NO: 1131723 - protein, 19 aa, Mycobacterium
GLARWRPYLEPALVVLTFG

SEQ ID NO: 1131724 - protein, 17 aa, Mycobacterium
GLCGVPLAEHSGDGPHW

SEQ ID NO: 1131725 - protein, 24 aa, Mycobacterium
GLDLRPNPGIAHPWWGNFLPVTRA

SEQ ID NO: 1131726 - protein, 25 aa, Mycobacterium
GLDLRPNPGIGFPGWANYFPVTRGV

SEQ ID NO: 1131727 - protein, 18 aa, Mycobacterium
GLFYRYAWQNPVFTDIVA

SEQ ID NO: 1131728 - protein, 18 aa, Mycobacterium
GLGAGFWGTSFSAAYVSG

SEQ ID NO: 1131729 - protein, 24 aa, Mycobacterium
GLHWRVFWICAGVILSTLLIGWVI

SEQ ID NO: 1131730 - protein, 20 aa, Mycobacterium
GLLAAHSWLGLPGWVAVHAL

SEQ ID NO: 1131731 - protein, 17 aa, Mycobacterium
GLLAAVAFEVFKQLGSV

SEQ ID NO: 1131732 - protein, 18 aa, Mycobacterium
GLLLPWTRPMFMNNNYAT

SEQ ID NO: 1131733 - protein, 19 aa, Mycobacterium
GLLMVRWSRRARFAPPLAV

SEQ ID NO: 1131734 - protein, 18 aa, Mycobacterium
GLLSRFWVVPVHRAAGLL

SEQ ID NO: 1131735 - protein, 23 aa, Mycobacterium
GLLTGTVGWRWIFWLNVPLALAS

SEQ ID NO: 1131736 - protein, 18 aa, Mycobacterium
GLMAWLNIIGIIILQQPA

SEQ ID NO: 1131737 - protein, 23 aa, Mycobacterium
GLRSRLWPVPALGVVAAVLAGIS

SEQ ID NO: 1131738 - protein, 17 aa, Mycobacterium
GLSRKFFDEVWMHDRDV

SEQ ID NO: 1131739 - protein, 19 aa, Mycobacterium
GLVASWLLSRRIKRHTRGL

SEQ ID NO: 1131740 - protein, 20 aa, Mycobacterium
GLVQAFGVWWFYAALGSGPI

SEQ ID NO: 1131741 - protein, 25 aa, Mycobacterium
GLWLLCAGCGVLAFGTVTPVAVAGF

SEQ ID NO: 1131742 - protein, 18 aa, Mycobacterium
GMDLGPWLVSRDITVVST

SEQ ID NO: 1131743 - protein, 18 aa, Mycobacterium
GMIGRLAIFVAVATGYVL

SEQ ID NO: 1131744 - protein, 17 aa, Mycobacterium
GNAWALAAVMSFVAGFT

SEQ ID NO: 1131745 - protein, 24 aa, Mycobacterium
GNIDRWVDVPGRLVARYTSVVVGL

SEQ ID NO: 1131746 - protein, 17 aa, Mycobacterium
GPATVVVVLLRLLALSF

SEQ ID NO: 1131747 - protein, 23 aa, Mycobacterium
GPERYAEMLKMFGLGQRTGVGLP

SEQ ID NO: 1131748 - protein, 21 aa, Mycobacterium
GPKAVLWTSGWTPRFHGETIY

SEQ ID NO: 1131749 - protein, 22 aa, Mycobacterium
GPLLEMLDRVAGLSLNPDEVAV

SEQ ID NO: 1131750 - protein, 22 aa, Mycobacterium
GPRFIDTYVNWLWFGELGYRSV

SEQ ID NO: 1131751 - protein, 31 aa, Mycobacterium
GPRRSLREQINWKWVRRGSIIAAAVLILLPL

SEQ ID NO: 1131752 - protein, 18 aa, Mycobacterium
GPSFWWGFALVFAGQFLV

SEQ ID NO: 1131753 - protein, 19 aa, Mycobacterium
GPVHTGWGALSIQGLMKAA

SEQ ID NO: 1131754 - protein, 18 aa, Mycobacterium
GPYPAVVFAHGFSGTMDW

SEQ ID NO: 1131755 - protein, 19 aa, Mycobacterium
GQTWPGFELEQTVVVHNET

SEQ ID NO: 1131756 - protein, 20 aa, Mycobacterium
GRALFTLAFIDVWQWTPFMV

SEQ ID NO: 1131757 - protein, 19 aa, Mycobacterium
GRAWEIFIGVISLIAGVVM

SEQ ID NO: 1131758 - protein, 19 aa, Mycobacterium
GRFERRWTFGGSAPGPTLH

SEQ ID NO: 1131759 - protein, 24 aa, Mycobacterium
GRFWRRSGVHIVRRPVAHLVGSLA

SEQ ID NO: 1131760 - protein, 19 aa, Mycobacterium
GRGGLQFMLIIWLQGIWLP

SEQ ID NO: 1131761 - protein, 18 aa, Mycobacterium
GRGPVIGVAGEFVQTSVT

SEQ ID NO: 1131762 - protein, 20 aa, Mycobacterium
GRHVPGRVGLLFLDLDGFKP

SEQ ID NO: 1131763 - protein, 20 aa, Mycobacterium
GRIAKARIDAGVGMVFQHFN

SEQ ID NO: 1131764 - protein, 17 aa, Mycobacterium
GRISAFVRWVARTPWPV

SEQ ID NO: 1131765 - protein, 19 aa, Mycobacterium
GRLDWAGTLTFGIGLTVLL

SEQ ID NO: 1131766 - protein, 17 aa, Mycobacterium
GRLRAAYTLALTAYAII

SEQ ID NO: 1131767 - protein, 18 aa, Mycobacterium
GRPRLRRPSGTRCCDVGS

SEQ ID NO: 1131768 - protein, 21 aa, Mycobacterium
GRPRRAGVSSFGFGGTNAHVV

SEQ ID NO: 1131769 - protein, 22 aa, Mycobacterium
GRPRYRLDLLGGIGLAALIGLP

SEQ ID NO: 1131770 - protein, 19 aa, Mycobacterium
GRPSGPVHTGWGALSIQGL

SEQ ID NO: 1131771 - protein, 22 aa, Mycobacterium
GRRSRFVKMYGLRIDLQQLENT

SEQ ID NO: 1131772 - protein, 18 aa, Mycobacterium
GRSRWRCAGLSLAASMIA

SEQ ID NO: 1131773 - protein, 23 aa, Mycobacterium
GRVELRLVWPSILSAMRISTQMS

SEQ ID NO: 1131774 - protein, 17 aa, Mycobacterium
GRVGLLFLDLDGFKPVN

SEQ ID NO: 1131775 - protein, 18 aa, Mycobacterium
GSALSWFSPIAWAQQMRA

SEQ ID NO: 1131776 - protein, 23 aa, Mycobacterium
GSAPKLAALFAVGAFASLGLPGF

SEQ ID NO: 1131777 - protein, 19 aa, Mycobacterium
GSARAVAGLGWLRRHTRTI

SEQ ID NO: 1131778 - protein, 22 aa, Mycobacterium
GSEHRLRIAVVLMPFAGIAFLW

SEQ ID NO: 1131779 - protein, 18 aa, Mycobacterium
GSGCYFARPAWRDGDNVL

SEQ ID NO: 1131780 - protein, 19 aa, Mycobacterium
GSLGRWLIAVAILAVLTVV

SEQ ID NO: 1131781 - protein, 17 aa, Mycobacterium
GSLWFRLLVNDRVAATA

SEQ ID NO: 1131782 - protein, 22 aa, Mycobacterium
GSPSWPLTLLVVLSYPSGIDVG

SEQ ID NO: 1131783 - protein, 18 aa, Mycobacterium
GSSFKVFALVAALQQGMG

SEQ ID NO: 1131784 - protein, 19 aa, Mycobacterium
GSSRRFALRTVLAEAAGIG

SEQ ID NO: 1131785 - protein, 18 aa, Mycobacterium
GSVLSWFSPIAWAQQMRP

SEQ ID NO: 1131786 - protein, 26 aa, Mycobacterium
GSVLWIIGASWGWHGAGWMLTKLGFH

SEQ ID NO: 1131787 - protein, 18 aa, Mycobacterium
GSWFFGRFADRRGRKAAL

SEQ ID NO: 1131788 - protein, 24 aa, Mycobacterium
GTEMNAYFSMCWLVVNTLGVLVGA

SEQ ID NO: 1131789 - protein, 26 aa, Mycobacterium
GTGIDWRPNPGIGFPAWANYLPTTRA

SEQ ID NO: 1131790 - protein, 24 aa, Mycobacterium
GTMLLRLCMLPGLALLIWAVPRVA

SEQ ID NO: 1131791 - protein, 19 aa, Mycobacterium
GTRNFPCIEQPGKAGADGR

SEQ ID NO: 1131792 - protein, 17 aa, Mycobacterium
GTVVAVVPAVLWVLVAL

SEQ ID NO: 1131793 - protein, 24 aa, Mycobacterium
GTYLGQGYLRWSIRAEQAPPRLAD

SEQ ID NO: 1131794 - protein, 17 aa, Mycobacterium
GVDAYGNVVGWDFKQSP

SEQ ID NO: 1131795 - protein, 22 aa, Mycobacterium
GVDPRVGLFASFTMAVTIAIVG

SEQ ID NO: 1131796 - protein, 19 aa, Mycobacterium
GVEIFKLIATGGVAALWQM

SEQ ID NO: 1131797 - protein, 24 aa, Mycobacterium
GVETLRWAGPRVKALLRVLAVTGF

SEQ ID NO: 1131798 - protein, 17 aa, Mycobacterium
GVIRPGIEPPVAEPEDP

SEQ ID NO: 1131799 - protein, 20 aa, Mycobacterium
GVLRLEWRDMPIFGEQSMRA

SEQ ID NO: 1131800 - protein, 17 aa, Mycobacterium
GVLRPLFGPGIREIAVS

SEQ ID NO: 1131801 - protein, 18 aa, Mycobacterium
GVLVSGWRGARWWRRTAA

SEQ ID NO: 1131802 - protein, 21 aa, Mycobacterium
GVPRVRCASGSPLAPPDNDTL

SEQ ID NO: 1131803 - protein, 18 aa, Mycobacterium
GVSVIRRLVVPRFAAAIM

SEQ ID NO: 1131804 - protein, 17 aa, Mycobacterium
GVVPEWLAYTLAVVLGV

SEQ ID NO: 1131805 - protein, 24 aa, Mycobacterium
GVVVGGPFLPLAIILYWFANNIWT

SEQ ID NO: 1131806 - protein, 18 aa, Mycobacterium
GWAGWRFFVMYGATEATA

SEQ ID NO: 1131807 - protein, 22 aa, Mycobacterium
GWDPDWFKFFLGAMLLFAVIAN

SEQ ID NO: 1131808 - protein, 21 aa, Mycobacterium
GWKPTLAWRLFQLLTFAALAA

SEQ ID NO: 1131809 - protein, 22 aa, Mycobacterium
GWLHRMMLYFGWNVSVSQTINP

SEQ ID NO: 1131810 - protein, 19 aa, Mycobacterium
GWLSSVFARADWAPEALVL

SEQ ID NO: 1131811 - protein, 23 aa, Mycobacterium
GWLSTCRRIRELVLPIVTTATGA

SEQ ID NO: 1131812 - protein, 25 aa, Mycobacterium
GWRKIGAAVVRWPGPILVATLAITL

SEQ ID NO: 1131813 - protein, 25 aa, Mycobacterium
GWRKLGSATVRWPGAVLVMATVLCL

SEQ ID NO: 1131814 - protein, 32 aa, Mycobacterium
GWRTRRWRLLWIPWAVVVGGAFAVTAYEFVAS

SEQ ID NO: 1131815 - protein, 19 aa, Mycobacterium
GWVRWMFIVALAVTFFLMA

SEQ ID NO: 1131816 - protein, 27 aa, Mycobacterium
GYFTDHLTWRWAFWINVPIGIVVLIVA

SEQ ID NO: 1131817 - protein, 19 aa, Mycobacterium
GYGCLPWVAAAVLRLRDGS

SEQ ID NO: 1131818 - protein, 17 aa, Mycobacterium
GYGIQWVVPGLFFVLVS

SEQ ID NO: 1131819 - protein, 19 aa, Mycobacterium
GYMLIGWQAGLAFTRESLK

SEQ ID NO: 1131820 - protein, 31 aa, Mycobacterium
GYVTRLIPDFTRWSPCQVLALVGNMRLLSQT

SEQ ID NO: 1131821 - protein, 20 aa, Mycobacterium
GYWPAAFGLFAFVWLELASP

SEQ ID NO: 1131822 - protein, 17 aa, Mycobacterium
HAAGWSFIVGKTASCAA

SEQ ID NO: 1131823 - protein, 24 aa, Mycobacterium
HAEALRFGQELGFWRAATPMVLAD

SEQ ID NO: 1131824 - protein, 25 aa, Mycobacterium
HARHVGRVGALAFALGVGGAVLTGT

SEQ ID NO: 1131825 - protein, 22 aa, Mycobacterium
HEGGHTLAAWAMPDIDPIYKVT

SEQ ID NO: 1131826 - protein, 22 aa, Mycobacterium
HISGPRTKLFVTLFLILALVVI

SEQ ID NO: 1131827 - protein, 18 aa, Mycobacterium
HKYLDLVGAVGFSTVLSG

SEQ ID NO: 1131828 - protein, 17 aa, Mycobacterium
HLFSNGWLWASVGLGVA

SEQ ID NO: 1131829 - protein, 21 aa, Mycobacterium
HLRIPLPRRPWLPPLQATYAL

SEQ ID NO: 1131830 - protein, 23 aa, Mycobacterium
HLVPVVAGALVWGAAVGIQESTL

SEQ ID NO: 1131831 - protein, 24 aa, Mycobacterium
HLWRKRIGWLLLLFVAEAYTGTVL

SEQ ID NO: 1131832 - protein, 19 aa, Mycobacterium
HPLWSAFVWRNEVSDTFVE

SEQ ID NO: 1131833 - protein, 17 aa, Mycobacterium
HPRRLTPWVAIVFTTLI

SEQ ID NO: 1131834 - protein, 21 aa, Mycobacterium
HPRRLTPWVAIVFTTLIAFGL

SEQ ID NO: 1131835 - protein, 21 aa, Mycobacterium
HPTFLYELLWNLLVFAVLILV

SEQ ID NO: 1131836 - protein, 20 aa, Mycobacterium
HPYPRWVATAGWAGFALGIA

SEQ ID NO: 1131837 - protein, 17 aa, Mycobacterium
HRAKGGGLSSLFGGGVQ

SEQ ID NO: 1131838 - protein, 25 aa, Mycobacterium
HSVLTRLGPRWAYLLGLTVFGLGSL

SEQ ID NO: 1131839 - protein, 20 aa, Mycobacterium
HTKWGVGIALLFVTLPFVVR

SEQ ID NO: 1131840 - protein, 18 aa, Mycobacterium
HTTHWGLSIDDFWWTAIW

SEQ ID NO: 1131841 - protein, 20 aa, Mycobacterium
HVLGRWNWWAPKPLARLHER

SEQ ID NO: 1131842 - protein, 23 aa, Mycobacterium
HVRWRHRICLTAAITAMLATPAL

SEQ ID NO: 1131843 - protein, 23 aa, Mycobacterium
HVSDIRSAMNWQRPQLDSTLAGH

SEQ ID NO: 1131844 - protein, 19 aa, Mycobacterium
HVVTGAWSYRVLAAGPTPP

SEQ ID NO: 1131845 - protein, 21 aa, Mycobacterium
HWFRGDPWLTFDMIQGGHCLR

SEQ ID NO: 1131846 - protein, 18 aa, Mycobacterium
HYFRLEAGLIVYEICVTA

SEQ ID NO: 1131847 - protein, 17 aa, Mycobacterium
IAALAWALTRYQRRQGQ

SEQ ID NO: 1131848 - protein, 23 aa, Mycobacterium
IAFASRPAIEWPLSEDTWSLAPV

SEQ ID NO: 1131849 - protein, 17 aa, Mycobacterium
IAFGLSMDYEVFLVSRI

SEQ ID NO: 1131850 - protein, 21 aa, Mycobacterium
IAGAVLICLMYVFLQQSLHNR

SEQ ID NO: 1131851 - protein, 19 aa, Mycobacterium
IAGAWRWTALLAVLVTVVS

SEQ ID NO: 1131852 - protein, 17 aa, Mycobacterium
IAGGFLFMATFVGGVVG

SEQ ID NO: 1131853 - protein, 18 aa, Mycobacterium
IAGSPGWIMGLLIVAALT

SEQ ID NO: 1131854 - protein, 18 aa, Mycobacterium
IAIGSLRNKIVFILPAAL

SEQ ID NO: 1131855 - protein, 18 aa, Mycobacterium
IALLFGVAFLFFGPREAL

SEQ ID NO: 1131856 - protein, 25 aa, Mycobacterium
IALVVLWRWRWVRLAAGAAVLGLVA

SEQ ID NO: 1131857 - protein, 18 aa, Mycobacterium
IAMALSFAAVFIYAGTMS

SEQ ID NO: 1131858 - protein, 17 aa, Mycobacterium
IAQMPGITRVSGVTRPT

SEQ ID NO: 1131859 - protein, 17 aa, Mycobacterium
IAQYTSFGWAFLISGVI

SEQ ID NO: 1131860 - protein, 18 aa, Mycobacterium
IARWSRRIAVQSAGVGMG

SEQ ID NO: 1131861 - protein, 24 aa, Mycobacterium
IARYRAGGTLTRFGMLAAQVLPPA

SEQ ID NO: 1131862 - protein, 17 aa, Mycobacterium
IAVESYGLFVFRDAIAA

SEQ ID NO: 1131863 - protein, 17 aa, Mycobacterium
IAWLAWLALHLVYLVGF

SEQ ID NO: 1131864 - protein, 31 aa, Mycobacterium
ICALLALPALRGRPWIPVWLNLATLAGVMLT

SEQ ID NO: 1131865 - protein, 18 aa, Mycobacterium
IEQGDWAGAQAKLEAVTT

SEQ ID NO: 1131866 - protein, 18 aa, Mycobacterium
IEVPIRIVAYLTVALVIR

SEQ ID NO: 1131867 - protein, 23 aa, Mycobacterium
IFAALLFWWTWYRLETKRRSDLT

SEQ ID NO: 1131868 - protein, 18 aa, Mycobacterium
IFAQLRFAPSNHYDAQFV

SEQ ID NO: 1131869 - protein, 17 aa, Mycobacterium
IFFGWGVALAFTSVVVA

SEQ ID NO: 1131870 - protein, 17 aa, Mycobacterium
IFPPFWLAGTAMLGLSK

SEQ ID NO: 1131871 - protein, 24 aa, Mycobacterium
IGFCMGGGLVWRLLAAGSPELAAA

SEQ ID NO: 1131872 - protein, 20 aa, Mycobacterium
IGGCLYCAHDLWVAGSVRAW

SEQ ID NO: 1131873 - protein, 21 aa, Mycobacterium
IGGCLYCAHDLWVAGSVRAWL

SEQ ID NO: 1131874 - protein, 23 aa, Mycobacterium
IGGCLYCAHDLWVAGSVRAWLVV

SEQ ID NO: 1131875 - protein, 20 aa, Mycobacterium
IGIFCFVGLFGVLAALLPVP

SEQ ID NO: 1131876 - protein, 17 aa, Mycobacterium
IGLKGFWIRRARRLLPA

SEQ ID NO: 1131877 - protein, 23 aa, Mycobacterium
IGLPPARFGWWPAAVITAVALLL

SEQ ID NO: 1131878 - protein, 23 aa, Mycobacterium
IGPRTGFFSGFAMLGAYWGFSIG

SEQ ID NO: 1131879 - protein, 18 aa, Mycobacterium
IGPTPSWRNLRYPRAQIP

SEQ ID NO: 1131880 - protein, 18 aa, Mycobacterium
IGRPFRRMTEYTGFQGWL

SEQ ID NO: 1131881 - protein, 24 aa, Mycobacterium
IGVALGWPLWWVSVCSVLCVLVAE

SEQ ID NO: 1131882 - protein, 17 aa, Mycobacterium
IGWSAACATAYLQGFGR

SEQ ID NO: 1131883 - protein, 23 aa, Mycobacterium
IGYSLGVFAVWLVRFMRSKDTSP

SEQ ID NO: 1131884 - protein, 18 aa, Mycobacterium
IHLLAVPIVLGWIALTVL

SEQ ID NO: 1131885 - protein, 17 aa, Mycobacterium
IIGNALKPATPALAKVA

SEQ ID NO: 1131886 - protein, 17 aa, Mycobacterium
IIGRSGGVYGDFFNFYA

SEQ ID NO: 1131887 - protein, 21 aa, Mycobacterium
IKGNLFWAFAYNVAALPLAAA

SEQ ID NO: 1131888 - protein, 21 aa, Mycobacterium
IKKRRRRPWIAGAAAAVVVIA

SEQ ID NO: 1131889 - protein, 17 aa, Mycobacterium
IKRRKMIGLSLGIGFGA

SEQ ID NO: 1131890 - protein, 20 aa, Mycobacterium
IKTNLFWAFAYNVAAIPVAA

SEQ ID NO: 1131891 - protein, 17 aa, Mycobacterium
ILACIYARLARTEERAV

SEQ ID NO: 1131892 - protein, 18 aa, Mycobacterium
ILAHRVIWSFAMMVVVVA

SEQ ID NO: 1131893 - protein, 20 aa, Mycobacterium
ILLSMYWPLGVVVLVSIVPI

SEQ ID NO: 1131894 - protein, 24 aa, Mycobacterium
ILMEGLRLTLILTVVSIAIALVLG

SEQ ID NO: 1131895 - protein, 18 aa, Mycobacterium
ILRARWITVAVTLVLAVL

SEQ ID NO: 1131896 - protein, 24 aa, Mycobacterium
ILTFFFCWNDFLFAISLTSTDSAR

SEQ ID NO: 1131897 - protein, 25 aa, Mycobacterium
ILTHLRKGLMGWLFGALAEGGVELP

SEQ ID NO: 1131898 - protein, 26 aa, Mycobacterium
ILVDRRFKIGHGRLFALYVAGYCVGR

SEQ ID NO: 1131899 - protein, 19 aa, Mycobacterium
ILWGFAGIVFISFYSANLS

SEQ ID NO: 1131900 - protein, 17 aa, Mycobacterium
IMARLPIVLGIIAVITF

SEQ ID NO: 1131901 - protein, 21 aa, Mycobacterium
IMGGLWARFGLPRWITRRVPH

SEQ ID NO: 1131902 - protein, 17 aa, Mycobacterium
IMSGTGFLGAHADEVYR

SEQ ID NO: 1131903 - protein, 25 aa, Mycobacterium
INPEEFWRNAGLPAFRFPDPNGVGF

SEQ ID NO: 1131904 - protein, 17 aa, Mycobacterium
IPARRIGTAMARLSREA

SEQ ID NO: 1131905 - protein, 18 aa, Mycobacterium
IPASLWLIGCLVVLLCTL

SEQ ID NO: 1131906 - protein, 19 aa, Mycobacterium
IPEARRVLSMLLGKKNLEI

SEQ ID NO: 1131907 - protein, 21 aa, Mycobacterium
IPHRRLPFWVALALSVALVGP

SEQ ID NO: 1131908 - protein, 22 aa, Mycobacterium
IPKRFANVHPRYMTPAFGTIVM

SEQ ID NO: 1131909 - protein, 25 aa, Mycobacterium
IPLPGSVPRPVWRDAFAHPENDKRV

SEQ ID NO: 1131910 - protein, 17 aa, Mycobacterium
IPMCWALRSVFDSLDGI

SEQ ID NO: 1131911 - protein, 20 aa, Mycobacterium
IPPYLPVYIDRDWVAQAEVA

SEQ ID NO: 1131912 - protein, 18 aa, Mycobacterium
IPVCWALRSVFDTLDGIN

SEQ ID NO: 1131913 - protein, 19 aa, Mycobacterium
IPVLRWSWTPVLFAGSLLT

SEQ ID NO: 1131914 - protein, 17 aa, Mycobacterium
IPVMRWQRREMLLGDRD

SEQ ID NO: 1131915 - protein, 17 aa, Mycobacterium
IQLLIGFMCVALVVYFV

SEQ ID NO: 1131916 - protein, 18 aa, Mycobacterium
IRAAQRAAVWSGRLARDF

SEQ ID NO: 1131917 - protein, 17 aa, Mycobacterium
IRAHMGFLFGLVNQLLL

SEQ ID NO: 1131918 - protein, 19 aa, Mycobacterium
IRDLTAFFAWSAWASAAER

SEQ ID NO: 1131919 - protein, 18 aa, Mycobacterium
IREFPVVVALLFAMVIGL

SEQ ID NO: 1131920 - protein, 18 aa, Mycobacterium
IREYDLKLILAFGTVSQL

SEQ ID NO: 1131921 - protein, 26 aa, Mycobacterium
IRFTGPPLWWLLRVADWAAAVPGASV

SEQ ID NO: 1131922 - protein, 20 aa, Mycobacterium
IRLARTWSLAVSMVVLVLIP

SEQ ID NO: 1131923 - protein, 18 aa, Mycobacterium
IRLEFGRLSGRRSDPDLD

SEQ ID NO: 1131924 - protein, 17 aa, Mycobacterium
IRMLLVPAFMHLMGRWN

SEQ ID NO: 1131925 - protein, 20 aa, Mycobacterium
IRMMSWRIAGAVDRAHDERQ

SEQ ID NO: 1131926 - protein, 19 aa, Mycobacterium
IRPSFPMLAANLANFGRIG

SEQ ID NO: 1131927 - protein, 17 aa, Mycobacterium
IRPSLGFDSRVCRELIR

SEQ ID NO: 1131928 - protein, 17 aa, Mycobacterium
IRREVERLVGLELSATM

SEQ ID NO: 1131929 - protein, 18 aa, Mycobacterium
IRRRLMRQTHGLRPDELR

SEQ ID NO: 1131930 - protein, 18 aa, Mycobacterium
IRVPREFVNDYIFNFPDT

SEQ ID NO: 1131931 - protein, 19 aa, Mycobacterium
ISDCLVEPGTLVWADVYAS

SEQ ID NO: 1131932 - protein, 23 aa, Mycobacterium
ISDRGYFAFLMLLPFIMGVLSLS

SEQ ID NO: 1131933 - protein, 22 aa, Mycobacterium
ISGPRTKLFAALFLILALVVIG

SEQ ID NO: 1131934 - protein, 19 aa, Mycobacterium
ISMPVFWLAAILLYFLSFK

SEQ ID NO: 1131935 - protein, 17 aa, Mycobacterium
ITAGVPVALCWPAQNGD

SEQ ID NO: 1131936 - protein, 18 aa, Mycobacterium
ITPEYGLRPIGLVDDDLP

SEQ ID NO: 1131937 - protein, 25 aa, Mycobacterium
IVCTVLWPPVRWLRGKGVPPAAAVL

SEQ ID NO: 1131938 - protein, 18 aa, Mycobacterium
IVFGFTWWLGGRLGLEDK

SEQ ID NO: 1131939 - protein, 17 aa, Mycobacterium
IVGACVAVGAAALWAAR

SEQ ID NO: 1131940 - protein, 18 aa, Mycobacterium
IVGVAVMLFAYMQVPTLL

SEQ ID NO: 1131941 - protein, 18 aa, Mycobacterium
IVLHRWRVPLGWITAAFF

SEQ ID NO: 1131942 - protein, 17 aa, Mycobacterium
IVLTFTFLLVILGSTDD

SEQ ID NO: 1131943 - protein, 17 aa, Mycobacterium
IWAAFLFGLSISPVLFS

SEQ ID NO: 1131944 - protein, 17 aa, Mycobacterium
IYFGPVIANTASDYAIV

SEQ ID NO: 1131945 - protein, 17 aa, Mycobacterium
IYQKMLSEWLVDPHELS

SEQ ID NO: 1131946 - protein, 24 aa, Mycobacterium
KATLRPPFQWREFILQSWFLMRVA

SEQ ID NO: 1131947 - protein, 19 aa, Mycobacterium
KDRYSGWLGGWRWAKDKLF

SEQ ID NO: 1131948 - protein, 17 aa, Mycobacterium
KEPALSLDRVVEGPYTL

SEQ ID NO: 1131949 - protein, 17 aa, Mycobacterium
KFGTWLLFGGIWVTLVY

SEQ ID NO: 1131950 - protein, 17 aa, Mycobacterium
KGARRRIVFRFRTSPIE

SEQ ID NO: 1131951 - protein, 18 aa, Mycobacterium
KGDTFNCEVSIDGTKRQV

SEQ ID NO: 1131952 - protein, 22 aa, Mycobacterium
KGLMTRSEMIARLVFAMGGRAA

SEQ ID NO: 1131953 - protein, 17 aa, Mycobacterium
KIIPRATLIAVIGLGLF

SEQ ID NO: 1131954 - protein, 17 aa, Mycobacterium
KKAAAALAWLVEEMEQR

SEQ ID NO: 1131955 - protein, 20 aa, Mycobacterium
KKRNWGWVVAIVLVVAALAA

SEQ ID NO: 1131956 - protein, 24 aa, Mycobacterium
KLDRLRARYGWFDHVMRAQERYKD

SEQ ID NO: 1131957 - protein, 18 aa, Mycobacterium
KLLLCGATAFAVISAVTA

SEQ ID NO: 1131958 - protein, 20 aa, Mycobacterium
KPAKPRSFRRLWLLLTAPFA

SEQ ID NO: 1131959 - protein, 26 aa, Mycobacterium
KRAEICRQRMGPVFKRIAMNYPPLLF

SEQ ID NO: 1131960 - protein, 22 aa, Mycobacterium
KRDFSNPVGLNWTQDGTDVDFG

SEQ ID NO: 1131961 - protein, 19 aa, Mycobacterium
KRDFWRVLGIWILAALAAA

SEQ ID NO: 1131962 - protein, 28 aa, Mycobacterium
KRDGKWARLTAFVLLPALALVLALGAGY

SEQ ID NO: 1131963 - protein, 19 aa, Mycobacterium
KRFGSTMGYELDIRADTAS

SEQ ID NO: 1131964 - protein, 17 aa, Mycobacterium
KRLLWAVVVAVVVATLV

SEQ ID NO: 1131965 - protein, 20 aa, Mycobacterium
KRPDGQFAYRGDGGMLNFVQ

SEQ ID NO: 1131966 - protein, 19 aa, Mycobacterium
KRPTFSNSYYRTFTKPHVH

SEQ ID NO: 1131967 - protein, 21 aa, Mycobacterium
KSAIVPMHFWLPGAMAAPTPV

SEQ ID NO: 1131968 - protein, 19 aa, Mycobacterium
KSDAAKVWADFTAANVGTQ

SEQ ID NO: 1131969 - protein, 18 aa, Mycobacterium
KTNLFWAFAYNVAAIPVA

SEQ ID NO: 1131970 - protein, 22 aa, Mycobacterium
KTVWLRPGTRLGFFTHMGTQFS

SEQ ID NO: 1131971 - protein, 23 aa, Mycobacterium
KVFPARLAFHLVRLYNLAFIVST

SEQ ID NO: 1131972 - protein, 17 aa, Mycobacterium
KVIWLQRFAGVSFIGDM

SEQ ID NO: 1131973 - protein, 20 aa, Mycobacterium
KVLFDWRFDLIFGTAAIVFA

SEQ ID NO: 1131974 - protein, 22 aa, Mycobacterium
KVLKRLGTVLLIVGGLGVAVAA

SEQ ID NO: 1131975 - protein, 20 aa, Mycobacterium
KVSLLLSVVLFFVWMIAVAF

SEQ ID NO: 1131976 - protein, 18 aa, Mycobacterium
LAAAFPFYGPTPDNPDFA

SEQ ID NO: 1131977 - protein, 18 aa, Mycobacterium
LAALIFTKYLWAFELTGA

SEQ ID NO: 1131978 - protein, 21 aa, Mycobacterium
LAARKRIAWWILLLYMVAAVG

SEQ ID NO: 1131979 - protein, 20 aa, Mycobacterium
LAAVALRFAPRVGTWTSVIG

SEQ ID NO: 1131980 - protein, 18 aa, Mycobacterium
LAAVFPWFAGVVAAACMG

SEQ ID NO: 1131981 - protein, 18 aa, Mycobacterium
LAAVLVFVMVVSFERRNP

SEQ ID NO: 1131982 - protein, 29 aa, Mycobacterium
LAEAVGIAFLAPVLLRWNRYWRRHSARQV

SEQ ID NO: 1131983 - protein, 17 aa, Mycobacterium
LAFLCFVPLAGITAVPA

SEQ ID NO: 1131984 - protein, 18 aa, Mycobacterium
LAFSNGILFLAFGAIAFV

SEQ ID NO: 1131985 - protein, 24 aa, Mycobacterium
LAGFGAPAHRVWLPPLSRAPALDA

SEQ ID NO: 1131986 - protein, 24 aa, Mycobacterium
LAGFGAPAHRVWLPPLSRASALDA

SEQ ID NO: 1131987 - protein, 17 aa, Mycobacterium
LAGLGAWLDGLPQGLST

SEQ ID NO: 1131988 - protein, 21 aa, Mycobacterium
LAGLLRRWAWLVLIVGFAVIV

SEQ ID NO: 1131989 - protein, 22 aa, Mycobacterium
LAGLLRRWAWLVLIVGFAVIVT

SEQ ID NO: 1131990 - protein, 20 aa, Mycobacterium
LAGSLPLVFLAYRSGIRSSR

SEQ ID NO: 1131991 - protein, 18 aa, Mycobacterium
LAGVCLWGARARRGSRLF

SEQ ID NO: 1131992 - protein, 18 aa, Mycobacterium
LAGWLLLRMRLNRMRFQA

SEQ ID NO: 1131993 - protein, 19 aa, Mycobacterium
LAHVWWKVPPDFGEARRTG

SEQ ID NO: 1131994 - protein, 20 aa, Mycobacterium
LAILLALPWWRAFRSTLAIA

SEQ ID NO: 1131995 - protein, 20 aa, Mycobacterium
LALAGLTAWMGYRTYEANRD

SEQ ID NO: 1131996 - protein, 17 aa, Mycobacterium
LALFPVWIRACYTAFLN

SEQ ID NO: 1131997 - protein, 20 aa, Mycobacterium
LALGLWAAWRAWRGNDDDDD

SEQ ID NO: 1131998 - protein, 21 aa, Mycobacterium
LALNAGWSWVFFNRRMLGPAA

SEQ ID NO: 1131999 - protein, 20 aa, Mycobacterium
LALWLARWLLFRVEFGAGLI

SEQ ID NO: 1132000 - protein, 18 aa, Mycobacterium
LANLAPYWILQPFVDAAF

SEQ ID NO: 1132001 - protein, 18 aa, Mycobacterium
LAPMPMVWAVREILHSAN

SEQ ID NO: 1132002 - protein, 19 aa, Mycobacterium
LAPTWPFQVGLLLAGWGIF

SEQ ID NO: 1132003 - protein, 37 aa, Mycobacterium
LAQRLPWRWLPWLSWTVSCAWAFSLAMVDGWQRGFAG

SEQ ID NO: 1132004 - protein, 20 aa, Mycobacterium
LARFPCEPFRPDAFFQQAAQ

SEQ ID NO: 1132005 - protein, 18 aa, Mycobacterium
LARTRPWLAAALVVALLG

SEQ ID NO: 1132006 - protein, 20 aa, Mycobacterium
LASGRAMRALGWLRRNARRI

SEQ ID NO: 1132007 - protein, 20 aa, Mycobacterium
LASGRAMRALGWLRRNTRRI

SEQ ID NO: 1132008 - protein, 17 aa, Mycobacterium
LASLPVYVTNAFFNGFV

SEQ ID NO: 1132009 - protein, 20 aa, Mycobacterium
LASPFAFLGLNFFNTVEYQM

SEQ ID NO: 1132010 - protein, 19 aa, Mycobacterium
LATLAFLRYRWLRGEPLPP

SEQ ID NO: 1132011 - protein, 20 aa, Mycobacterium
LAVALLAWWKGRRVGPLVAE

SEQ ID NO: 1132012 - protein, 22 aa, Mycobacterium
LAVCVPLGWLAGVAIKSVLVNL

SEQ ID NO: 1132013 - protein, 21 aa, Mycobacterium
LAVGVNILWTGYRLLRGSMSS

SEQ ID NO: 1132014 - protein, 23 aa, Mycobacterium
LAVIKFRRCVIINGIDVGAIRPD

SEQ ID NO: 1132015 - protein, 19 aa, Mycobacterium
LAVPFILGLYWRRGTVKAA

SEQ ID NO: 1132016 - protein, 17 aa, Mycobacterium
LAVPIWWAYAASLLLIT

SEQ ID NO: 1132017 - protein, 17 aa, Mycobacterium
LAVPIWWAYATSLLLIT

SEQ ID NO: 1132018 - protein, 20 aa, Mycobacterium
LCAATLWVVRWPTRAQSVAY

SEQ ID NO: 1132019 - protein, 21 aa, Mycobacterium
LCASFPPIGWWFTAILAFAVF

SEQ ID NO: 1132020 - protein, 21 aa, Mycobacterium
LCLLLAFPLAYVIAFKAGRFK

SEQ ID NO: 1132021 - protein, 18 aa, Mycobacterium
LCSGLLLQWWSWESIFIG

SEQ ID NO: 1132022 - protein, 18 aa, Mycobacterium
LDAGLFFIAFVRNPVTQF

SEQ ID NO: 1132023 - protein, 20 aa, Mycobacterium
LDASMPWPVRRGGVALRFYE

SEQ ID NO: 1132024 - protein, 18 aa, Mycobacterium
LDEAAGFAIPLLPRSLDE

SEQ ID NO: 1132025 - protein, 18 aa, Mycobacterium
LDGPRVLVTFKILGNINL

SEQ ID NO: 1132026 - protein, 19 aa, Mycobacterium
LDKERRKQAAISFDSDNSG

SEQ ID NO: 1132027 - protein, 23 aa, Mycobacterium
LDKERRTQPAIAFDRENSPIAEA

SEQ ID NO: 1132028 - protein, 18 aa, Mycobacterium
LDNQRLWSNLDCAPSNET

SEQ ID NO: 1132029 - protein, 25 aa, Mycobacterium
LDPLLRLPLALGLAHLLGRIPLPGS

SEQ ID NO: 1132030 - protein, 20 aa, Mycobacterium
LDQPRIYFGPVIANTPADYA

SEQ ID NO: 1132031 - protein, 21 aa, Mycobacterium
LDRLQAFDVFSSFWFTAIYVL

SEQ ID NO: 1132032 - protein, 24 aa, Mycobacterium
LDSSRLPIVAALVAGVLALVVILL

SEQ ID NO: 1132033 - protein, 19 aa, Mycobacterium
LDTLAVFVGWLWPLWDRRR

SEQ ID NO: 1132034 - protein, 23 aa, Mycobacterium
LDVAEPLAYCLPGVRSRVVVSEG

SEQ ID NO: 1132035 - protein, 17 aa, Mycobacterium
LDVDAATELLKRDWATG

SEQ ID NO: 1132036 - protein, 23 aa, Mycobacterium
LEGGDLWGGIGLIIGPMVIAFAM

SEQ ID NO: 1132037 - protein, 25 aa, Mycobacterium
LEIKKRKRWPWIAGAVVAVLAVTGG

SEQ ID NO: 1132038 - protein, 21 aa, Mycobacterium
LELGQPIAIEYVWGRQIGENT

SEQ ID NO: 1132039 - protein, 18 aa, Mycobacterium
LFALRVGLHLALLHEAQD

SEQ ID NO: 1132040 - protein, 20 aa, Mycobacterium
LFALYVAGYCVGRFWIELMR

SEQ ID NO: 1132041 - protein, 26 aa, Mycobacterium
LFGLMLPWLGAVAILGAVIFGTVWLA

SEQ ID NO: 1132042 - protein, 23 aa, Mycobacterium
LFGVELWERFSFYGMLTILGYYL

SEQ ID NO: 1132043 - protein, 24 aa, Mycobacterium
LFTALCLFSSLFIMLRRKRVPGVA

SEQ ID NO: 1132044 - protein, 18 aa, Mycobacterium
LFTMRWELVAFVAPLLGV

SEQ ID NO: 1132045 - protein, 17 aa, Mycobacterium
LGALAIVIAILIVLNAQ

SEQ ID NO: 1132046 - protein, 21 aa, Mycobacterium
LGDDCWWAPRWMKRVQEKLGL

SEQ ID NO: 1132047 - protein, 18 aa, Mycobacterium
LGDHVLFYGRAIGGVPHA

SEQ ID NO: 1132048 - protein, 18 aa, Mycobacterium
LGETLPLDAGKILGAGLT

SEQ ID NO: 1132049 - protein, 17 aa, Mycobacterium
LGFFRWVARQMVARARE

SEQ ID NO: 1132050 - protein, 23 aa, Mycobacterium
LGGFLIGAGIGWLVQRRRGDAGS

SEQ ID NO: 1132051 - protein, 20 aa, Mycobacterium
LGIAHFDIWPGDDVPPAVVP

SEQ ID NO: 1132052 - protein, 20 aa, Mycobacterium
LGIPSFVVTLAFFLGLQGVT

SEQ ID NO: 1132053 - protein, 17 aa, Mycobacterium
LGLALAVAVTHLFPVEH

SEQ ID NO: 1132054 - protein, 24 aa, Mycobacterium
LGLARRLGVDWSMVYTGRSVDSLP

SEQ ID NO: 1132055 - protein, 19 aa, Mycobacterium
LGLTAVSAWLITRAWEMPP

SEQ ID NO: 1132056 - protein, 23 aa, Mycobacterium
LGPRLVDTYVNWLWFGELGYRSV

SEQ ID NO: 1132057 - protein, 19 aa, Mycobacterium
LGQQCARHPLPMPAALAKV

SEQ ID NO: 1132058 - protein, 20 aa, Mycobacterium
LGRLRFVALYLFSALGGSVL

SEQ ID NO: 1132059 - protein, 18 aa, Mycobacterium
LGRPVHAIGLTWTVEAER

SEQ ID NO: 1132060 - protein, 18 aa, Mycobacterium
LGRRVHAIGVTWSDDADT

SEQ ID NO: 1132061 - protein, 21 aa, Mycobacterium
LGRSGLPVVHDWQASPARQAT

SEQ ID NO: 1132062 - protein, 25 aa, Mycobacterium
LGRYRVVAFPAHIPGQVVVAGLPTG

SEQ ID NO: 1132063 - protein, 18 aa, Mycobacterium
LGSFPIIFGLSFRDALLA

SEQ ID NO: 1132064 - protein, 23 aa, Mycobacterium
LGSRPRHWLSVALGVEVVALMVL

SEQ ID NO: 1132065 - protein, 24 aa, Mycobacterium
LHARARLVIMPSFDLGEFLGNIAE

SEQ ID NO: 1132066 - protein, 18 aa, Mycobacterium
LHSTFRWLLSAAAALWIV

SEQ ID NO: 1132067 - protein, 19 aa, Mycobacterium
LIAWWFWERRAARPLVSTR

SEQ ID NO: 1132068 - protein, 23 aa, Mycobacterium
LIDREMWRGIVFIGLVMGFATLL

SEQ ID NO: 1132069 - protein, 23 aa, Mycobacterium
LIFLLLCGLSFYLWWRAQQQKVD

SEQ ID NO: 1132070 - protein, 23 aa, Mycobacterium
LIGAALLVWRLRWAAQPFWLSPA

SEQ ID NO: 1132071 - protein, 23 aa, Mycobacterium
LIGGAWLAFIGWFLLTAARDENA

SEQ ID NO: 1132072 - protein, 23 aa, Mycobacterium
LIKYLWPMRRMRAADVRTMSLVA

SEQ ID NO: 1132073 - protein, 22 aa, Mycobacterium
LILNGSWSWLFFNRHKLAVSAV

SEQ ID NO: 1132074 - protein, 18 aa, Mycobacterium
LIPRPGGDMTPLRDGDVI

SEQ ID NO: 1132075 - protein, 18 aa, Mycobacterium
LISAFAIWALTGWVVSGE

SEQ ID NO: 1132076 - protein, 19 aa, Mycobacterium
LIVGAGWPLVVEQISVRPN

SEQ ID NO: 1132077 - protein, 17 aa, Mycobacterium
LIVLAGRRGWLTPRKDL

SEQ ID NO: 1132078 - protein, 21 aa, Mycobacterium
LKGFWIRRARRLLPALLVMVL

SEQ ID NO: 1132079 - protein, 18 aa, Mycobacterium
LKLCQAYGWAPGVMGASA

SEQ ID NO: 1132080 - protein, 17 aa, Mycobacterium
LKYKFGYDDSLDVVGVH

SEQ ID NO: 1132081 - protein, 20 aa, Mycobacterium
LLAGLGWQWIFFVNAPIGAI

SEQ ID NO: 1132082 - protein, 18 aa, Mycobacterium
LLALPLIGVWVMVSTLQA

SEQ ID NO: 1132083 - protein, 17 aa, Mycobacterium
LLALPMRGFMFVTRPLL

SEQ ID NO: 1132084 - protein, 17 aa, Mycobacterium
LLARLGLAVLLFLVGLR

SEQ ID NO: 1132085 - protein, 26 aa, Mycobacterium
LLATVVRFVLLRGWVFHPRRTHTEGS

SEQ ID NO: 1132086 - protein, 18 aa, Mycobacterium
LLDRWDRRLVLIGANCGR

SEQ ID NO: 1132087 - protein, 17 aa, Mycobacterium
LLEALPLDRAKYVISAI

SEQ ID NO: 1132088 - protein, 21 aa, Mycobacterium
LLEHFWWGSVFLINIPVMVIL

SEQ ID NO: 1132089 - protein, 22 aa, Mycobacterium
LLFGGVCVAFWFLPGAKEPVVV

SEQ ID NO: 1132090 - protein, 19 aa, Mycobacterium
LLGGFGILRFDNGVPFVDD

SEQ ID NO: 1132091 - protein, 18 aa, Mycobacterium
LLGLPGWVTQRLWWALLL

SEQ ID NO: 1132092 - protein, 18 aa, Mycobacterium
LLGTAWLVIYARSSTRAG

SEQ ID NO: 1132093 - protein, 17 aa, Mycobacterium
LLHRCWLALHAGPPGQV

SEQ ID NO: 1132094 - protein, 19 aa, Mycobacterium
LLIIMGAFMYFASRRQKKA

SEQ ID NO: 1132095 - protein, 19 aa, Mycobacterium
LLLACVFGGLRIYSSATEA

SEQ ID NO: 1132096 - protein, 28 aa, Mycobacterium
LLLLELPLRIGVFFNLPLNCEVVVIVII

SEQ ID NO: 1132097 - protein, 19 aa, Mycobacterium
LLLLVGLFVMFSRMQTGGR

SEQ ID NO: 1132098 - protein, 18 aa, Mycobacterium
LLLPVSRLLVLIGNALTP

SEQ ID NO: 1132099 - protein, 17 aa, Mycobacterium
LLMRLGPRRAYWSGLSV

SEQ ID NO: 1132100 - protein, 17 aa, Mycobacterium
LLNLGAFAWQWDPYPFI

SEQ ID NO: 1132101 - protein, 29 aa, Mycobacterium
LLPDESFLSWGWRIPFLVSLLLLAVGIYV

SEQ ID NO: 1132102 - protein, 17 aa, Mycobacterium
LLQWWSWESIFIGFAAA

SEQ ID NO: 1132103 - protein, 19 aa, Mycobacterium
LLRDPRFVVLVLVAALGMS

SEQ ID NO: 1132104 - protein, 25 aa, Mycobacterium
LLRKRRWALRLGVFFTLSTVLWVGV

SEQ ID NO: 1132105 - protein, 19 aa, Mycobacterium
LLRRLHFYAGVFVGPFLLI

SEQ ID NO: 1132106 - protein, 22 aa, Mycobacterium
LLRVVSGVSIFKLVRYLAREYL

SEQ ID NO: 1132107 - protein, 17 aa, Mycobacterium
LLSRLGDHVLFYGRAIG

SEQ ID NO: 1132108 - protein, 17 aa, Mycobacterium
LLSVLLVVNLWTGYFPT

SEQ ID NO: 1132109 - protein, 20 aa, Mycobacterium
LLVAIPFTVLVSFTLNILLR

SEQ ID NO: 1132110 - protein, 17 aa, Mycobacterium
LLVALGVCLVRQPRAVL

SEQ ID NO: 1132111 - protein, 18 aa, Mycobacterium
LLVAWAVVMAMLYEPGRP

SEQ ID NO: 1132112 - protein, 18 aa, Mycobacterium
LLVQAGYMLIGWQAGLAF

SEQ ID NO: 1132113 - protein, 17 aa, Mycobacterium
LLWRALCSPDCGPNRVR

SEQ ID NO: 1132114 - protein, 23 aa, Mycobacterium
LMGGLNWWAPGWLRRVHERLGFT

SEQ ID NO: 1132115 - protein, 20 aa, Mycobacterium
LMGLACWWVISREVIPRLGS

SEQ ID NO: 1132116 - protein, 18 aa, Mycobacterium
LMGPHMLTMAVISPVMVA

SEQ ID NO: 1132117 - protein, 19 aa, Mycobacterium
LMGSRLGPMVVRRAPAGPM

SEQ ID NO: 1132118 - protein, 22 aa, Mycobacterium
LMLLKAVAYWLDRYELLSHTRG

SEQ ID NO: 1132119 - protein, 20 aa, Mycobacterium
LMMAWTVLGDTIWVAGGMSH

SEQ ID NO: 1132120 - protein, 18 aa, Mycobacterium
LMMPRYRVLWGIAINVVG

SEQ ID NO: 1132121 - protein, 17 aa, Mycobacterium
LMVGALGGWVGNKTAET

SEQ ID NO: 1132122 - protein, 18 aa, Mycobacterium
LMYKRPDGQFAYRGDGGM

SEQ ID NO: 1132123 - protein, 18 aa, Mycobacterium
LNGLRLLRDAAWPSTRGT

SEQ ID NO: 1132124 - protein, 17 aa, Mycobacterium
LNWKSVWDHGWSAAEAA

SEQ ID NO: 1132125 - protein, 22 aa, Mycobacterium
LPAEQSGGVVLDGFVERVGDPV

SEQ ID NO: 1132126 - protein, 19 aa, Mycobacterium
LPAFRYAAAVAYLGLLCTW

SEQ ID NO: 1132127 - protein, 17 aa, Mycobacterium
LPALCFAGAGFAAPWLA

SEQ ID NO: 1132128 - protein, 24 aa, Mycobacterium
LPDAYRVLGRQGIYGDFFAFYLCD

SEQ ID NO: 1132129 - protein, 22 aa, Mycobacterium
LPDGRAAIHLAMDPSYMDIIPS

SEQ ID NO: 1132130 - protein, 17 aa, Mycobacterium
LPDRWMAVFGFVSLLAF

SEQ ID NO: 1132131 - protein, 18 aa, Mycobacterium
LPEPLLRSAMVTIAGTEP

SEQ ID NO: 1132132 - protein, 17 aa, Mycobacterium
LPFLWNVFKSWRYGEVV

SEQ ID NO: 1132133 - protein, 21 aa, Mycobacterium
LPFSHVWRHVSPKSKAPTYAV

SEQ ID NO: 1132134 - protein, 20 aa, Mycobacterium
LPFYRLMLTYLFAATFLAFI

SEQ ID NO: 1132135 - protein, 19 aa, Mycobacterium
LPGAIRWTAGAVRQARDYV

SEQ ID NO: 1132136 - protein, 19 aa, Mycobacterium
LPGLCFAAAGLTAPWLSRR

SEQ ID NO: 1132137 - protein, 23 aa, Mycobacterium
LPGMAVFRAVFYFAVERDFAAGM

SEQ ID NO: 1132138 - protein, 17 aa, Mycobacterium
LPICAAAIILTAVFVPE

SEQ ID NO: 1132139 - protein, 17 aa, Mycobacterium
LPICAAAILLTAIFVPE

SEQ ID NO: 1132140 - protein, 18 aa, Mycobacterium
LPIVLGIIAVITFVLLFL

SEQ ID NO: 1132141 - protein, 17 aa, Mycobacterium
LPPLAYFFLLVIWLGID

SEQ ID NO: 1132142 - protein, 18 aa, Mycobacterium
LPPSSWRSPADLTDVDTP

SEQ ID NO: 1132143 - protein, 18 aa, Mycobacterium
LPTIPAWLWFLLLLGAVT

SEQ ID NO: 1132144 - protein, 18 aa, Mycobacterium
LPTVLAVIAAITFVLLFL

SEQ ID NO: 1132145 - protein, 20 aa, Mycobacterium
LPVTWEMSFLYAVVFGGFVA

SEQ ID NO: 1132146 - protein, 21 aa, Mycobacterium
LPWRGAVFTGKWVFYGVLGAC

SEQ ID NO: 1132147 - protein, 19 aa, Mycobacterium
LPWWRAFRSTLAIATLFHL

SEQ ID NO: 1132148 - protein, 19 aa, Mycobacterium
LQACVFWRGMESIRKFIDF

SEQ ID NO: 1132149 - protein, 20 aa, Mycobacterium
LQMAFRFWAFRRFVFPDEFA

SEQ ID NO: 1132150 - protein, 22 aa, Mycobacterium
LQPFLDYAFGFRNGVDIGQPPD

SEQ ID NO: 1132151 - protein, 18 aa, Mycobacterium
LQPTLPIVLANLVSIEPV

SEQ ID NO: 1132152 - protein, 17 aa, Mycobacterium
LQRRLRLAVASQIVLGI

SEQ ID NO: 1132153 - protein, 23 aa, Mycobacterium
LQSWTIFYWAWWVSWTPFVGMFI

SEQ ID NO: 1132154 - protein, 17 aa, Mycobacterium
LRAAYTLALTAYAIIGL

SEQ ID NO: 1132155 - protein, 19 aa, Mycobacterium
LRAGTGLTVLTWLMRVGFL

SEQ ID NO: 1132156 - protein, 20 aa, Mycobacterium
LRALLFFTVVLGLAYPLLIW

SEQ ID NO: 1132157 - protein, 18 aa, Mycobacterium
LRAQFDYVVIDSTPLVAV

SEQ ID NO: 1132158 - protein, 19 aa, Mycobacterium
LRDALRLAGLGAWLDGLPQ

SEQ ID NO: 1132159 - protein, 17 aa, Mycobacterium
LRGAIGFSSFGVLLYYA

SEQ ID NO: 1132160 - protein, 18 aa, Mycobacterium
LRGQFWADAEPRLRALGW

SEQ ID NO: 1132161 - protein, 17 aa, Mycobacterium
LRISPWALVTWVGPSIE

SEQ ID NO: 1132162 - protein, 19 aa, Mycobacterium
LRLKGRLLFEPNVMVTSVP

SEQ ID NO: 1132163 - protein, 17 aa, Mycobacterium
LRLLLTVAGVVLVLDIV

SEQ ID NO: 1132164 - protein, 21 aa, Mycobacterium
LRLLTVPGFLLVAAGLYLTSR

SEQ ID NO: 1132165 - protein, 21 aa, Mycobacterium
LRLPYTFAVPVFGGRNWTVIS

SEQ ID NO: 1132166 - protein, 21 aa, Mycobacterium
LRMILLPQAFRSVIIPLGSVL

SEQ ID NO: 1132167 - protein, 18 aa, Mycobacterium
LRPLFGWATRHTKAAAED

SEQ ID NO: 1132168 - protein, 20 aa, Mycobacterium
LRPLSRYAFALLAYAFAVTM

SEQ ID NO: 1132169 - protein, 18 aa, Mycobacterium
LRPPMLWRGLQWGSAAVA

SEQ ID NO: 1132170 - protein, 22 aa, Mycobacterium
LRRFAPQQIMVWALAVASLAGV

SEQ ID NO: 1132171 - protein, 17 aa, Mycobacterium
LRRLFGWFVLLMASVIL

SEQ ID NO: 1132172 - protein, 19 aa, Mycobacterium
LRSPLTWGVVAGLVIGKFV

SEQ ID NO: 1132173 - protein, 18 aa, Mycobacterium
LRTPRPYLYAGILFFATL

SEQ ID NO: 1132174 - protein, 17 aa, Mycobacterium
LRTVIDLTPGSLVGLLD

SEQ ID NO: 1132175 - protein, 17 aa, Mycobacterium
LRVRATRAVDGWTGEQV

SEQ ID NO: 1132176 - protein, 23 aa, Mycobacterium
LRWLNDDPRGWSRLRGNAVVAIE

SEQ ID NO: 1132177 - protein, 18 aa, Mycobacterium
LRWRNQRKALVAAYRSLA

SEQ ID NO: 1132178 - protein, 26 aa, Mycobacterium
LSAFFTPRFVKWFGLFTTHVIIAAAL

SEQ ID NO: 1132179 - protein, 20 aa, Mycobacterium
LSAWRFVTTFGVVSLLADIV

SEQ ID NO: 1132180 - protein, 17 aa, Mycobacterium
LSLIPILLGLLIAVPLG

SEQ ID NO: 1132181 - protein, 22 aa, Mycobacterium
LSLLGWCSFLLLWVLQACVFWR

SEQ ID NO: 1132182 - protein, 17 aa, Mycobacterium
LSLLRLVATVAYYLVVS

SEQ ID NO: 1132183 - protein, 18 aa, Mycobacterium
LSMGISFAAVRDMFGWIG

SEQ ID NO: 1132184 - protein, 20 aa, Mycobacterium
LSPAEANAWCDANRLGVNDC

SEQ ID NO: 1132185 - protein, 24 aa, Mycobacterium
LSRARIPFYVGVGVVTVLIAGVLG

SEQ ID NO: 1132186 - protein, 18 aa, Mycobacterium
LSSLRAGLIAGVVGLVAV

SEQ ID NO: 1132187 - protein, 20 aa, Mycobacterium
LSVLRLVATVAYWLVVSSIQ

SEQ ID NO: 1132188 - protein, 17 aa, Mycobacterium
LSVRLSVLFSFQGNDMM

SEQ ID NO: 1132189 - protein, 18 aa, Mycobacterium
LTAALLIAVKPWWPKLSI

SEQ ID NO: 1132190 - protein, 20 aa, Mycobacterium
LTAIPLWVAFVVGTKAATRR

SEQ ID NO: 1132191 - protein, 21 aa, Mycobacterium
LTALWCWLPFQLKFMRATSPL

SEQ ID NO: 1132192 - protein, 18 aa, Mycobacterium
LTAVPLWIAFALSTKAAT

SEQ ID NO: 1132193 - protein, 17 aa, Mycobacterium
LTFWDYPLAAAISVVTL

SEQ ID NO: 1132194 - protein, 17 aa, Mycobacterium
LTIPVLLTHQWQLVFVA

SEQ ID NO: 1132195 - protein, 17 aa, Mycobacterium
LTPWVAIVFTTLIAFGL

SEQ ID NO: 1132196 - protein, 23 aa, Mycobacterium
LTVLRWSWTPALLAGGLVTLMPL

SEQ ID NO: 1132197 - protein, 19 aa, Mycobacterium
LTVPLWWWLPGLGVAALIA

SEQ ID NO: 1132198 - protein, 18 aa, Mycobacterium
LTVVSWRLAFLINVPIGI

SEQ ID NO: 1132199 - protein, 21 aa, Mycobacterium
LTVWPFLNWWTTHFVITDRRV

SEQ ID NO: 1132200 - protein, 21 aa, Mycobacterium
LVAFACYFVWHVVKAAVQAML

SEQ ID NO: 1132201 - protein, 24 aa, Mycobacterium
LVAPHPWPAVAVMFALGVVVTFSG

SEQ ID NO: 1132202 - protein, 24 aa, Mycobacterium
LVASCVGLFCCIGSIAGIAMGVIA

SEQ ID NO: 1132203 - protein, 17 aa, Mycobacterium
LVATVAYWLVVSSIQVA

SEQ ID NO: 1132204 - protein, 20 aa, Mycobacterium
LVAVIVWLVVQLVSGDDSGE

SEQ ID NO: 1132205 - protein, 21 aa, Mycobacterium
LVAVIVWLVVQLVSGDDSGES

SEQ ID NO: 1132206 - protein, 23 aa, Mycobacterium
LVERLRPSLPVLLANLTGIADVA

SEQ ID NO: 1132207 - protein, 19 aa, Mycobacterium
LVGVLALAGLTAWMGYRTY

SEQ ID NO: 1132208 - protein, 24 aa, Mycobacterium
LVIFRSRWARWVAWSLPAVGLVVL

SEQ ID NO: 1132209 - protein, 19 aa, Mycobacterium
LVIGVAGGWVGRTTAEVVS

SEQ ID NO: 1132210 - protein, 17 aa, Mycobacterium
LVLSGFVERVGDPVPLV

SEQ ID NO: 1132211 - protein, 17 aa, Mycobacterium
LVLTDFDLGNGFGPDGL

SEQ ID NO: 1132212 - protein, 30 aa, Mycobacterium
LVPTLAHFRGWLQPMSFVWDGLPSDRPFFL

SEQ ID NO: 1132213 - protein, 18 aa, Mycobacterium
LVRPEIMSGTGFLGAHAD

SEQ ID NO: 1132214 - protein, 17 aa, Mycobacterium
LVTRLSWRGTRASLDGY

SEQ ID NO: 1132215 - protein, 17 aa, Mycobacterium
LVVAFVYHPDKSHPSAD

SEQ ID NO: 1132216 - protein, 22 aa, Mycobacterium
LVVAGALAWAAVRLIRRRRARQ

SEQ ID NO: 1132217 - protein, 18 aa, Mycobacterium
LWEGVKFQLWQREASGSI

SEQ ID NO: 1132218 - protein, 19 aa, Mycobacterium
LWPPLRWRNQRKALVAAYR

SEQ ID NO: 1132219 - protein, 20 aa, Mycobacterium
LWQHIIGLALHWMVLPMAVI

SEQ ID NO: 1132220 - protein, 17 aa, Mycobacterium
LWSGFQIIGDGSGEYDY

SEQ ID NO: 1132221 - protein, 24 aa, Mycobacterium
LWSQWRFAFEPMFVVAVSTLLRSS

SEQ ID NO: 1132222 - protein, 18 aa, Mycobacterium
LWVALLFLMLIAVTFLVS

SEQ ID NO: 1132223 - protein, 17 aa, Mycobacterium
LYHCSTMPMALHIANGM

SEQ ID NO: 1132224 - protein, 25 aa, Mycobacterium
LYLCFAVPIYLRWRMGDDFEVGTWN

SEQ ID NO: 1132225 - protein, 23 aa, Mycobacterium
LYLSMDIAIHWGLLRRLRHDVDF

SEQ ID NO: 1132226 - protein, 24 aa, Mycobacterium
LYLTQRFIMRWRIWLSRNLIDDWL

SEQ ID NO: 1132227 - protein, 17 aa, Mycobacterium
LYPILPVRIGAGGGGYN

SEQ ID NO: 1132228 - protein, 17 aa, Mycobacterium
LYSVWGLVVTYIYFILP

SEQ ID NO: 1132229 - protein, 18 aa, Mycobacterium
LYVLCLAVSYLTTQIVVQ

SEQ ID NO: 1132230 - protein, 18 aa, Mycobacterium
MALACRWGGTVKAFVVAS

SEQ ID NO: 1132231 - protein, 27 aa, Mycobacterium
MASTVLWFDELRKLALRALRRSGTPAT

SEQ ID NO: 1132232 - protein, 25 aa, Mycobacterium
MEAGGWRLPGLAAFMVTASETLGGI

SEQ ID NO: 1132233 - protein, 21 aa, Mycobacterium
MFALRYRWWVVLSAITAATAV

SEQ ID NO: 1132234 - protein, 19 aa, Mycobacterium
MGALTSWLGFQTHQAHQAS

SEQ ID NO: 1132235 - protein, 17 aa, Mycobacterium
MGEGFGMPSTDTPEKML

SEQ ID NO: 1132236 - protein, 19 aa, Mycobacterium
MGGGMVWRLLAAGEPRLAA

SEQ ID NO: 1132237 - protein, 17 aa, Mycobacterium
MGPWPVYLLVGFTLVAA

SEQ ID NO: 1132238 - protein, 18 aa, Mycobacterium
MGRWNWWAPAPLARWHAR

SEQ ID NO: 1132239 - protein, 24 aa, Mycobacterium
MGVGITEAVLWFIRRWLVSRATMG

SEQ ID NO: 1132240 - protein, 21 aa, Mycobacterium
MLEMLPTPWGLVRSGVAPDHP

SEQ ID NO: 1132241 - protein, 24 aa, Mycobacterium
MLGLTLFCLWPFTRLVHAFSAPIG

SEQ ID NO: 1132242 - protein, 20 aa, Mycobacterium
MMPWLFLRVRFFRRKWTAVT

SEQ ID NO: 1132243 - protein, 20 aa, Mycobacterium
MPYLRASPWHLWRKRIGWLL

SEQ ID NO: 1132244 - protein, 19 aa, Mycobacterium
MRIFAEFMPVHFFAQPVVT

SEQ ID NO: 1132245 - protein, 17 aa, Mycobacterium
MRRAMALAPERAREIGL

SEQ ID NO: 1132246 - protein, 19 aa, Mycobacterium
MRTRHGVVILTGFWLAAAA

SEQ ID NO: 1132247 - protein, 19 aa, Mycobacterium
MSAFLRGAWIVGQCIIAVA

SEQ ID NO: 1132248 - protein, 21 aa, Mycobacterium
MSLTLLREWYARPGSTVLAVN

SEQ ID NO: 1132249 - protein, 19 aa, Mycobacterium
MSVSPVFRYTIIVGATTGA

SEQ ID NO: 1132250 - protein, 18 aa, Mycobacterium
MTALRSPLTWGVVAGLVI

SEQ ID NO: 1132251 - protein, 21 aa, Mycobacterium
MTIQVAIAWFGYRVIAAFERW

SEQ ID NO: 1132252 - protein, 24 aa, Mycobacterium
MTPNWKSAMLVLLVLYPTVMLLSR

SEQ ID NO: 1132253 - protein, 18 aa, Mycobacterium
MVALCLGGGVYGISLGQH

SEQ ID NO: 1132254 - protein, 18 aa, Mycobacterium
MVAVLAVFAHHLWGWPGG

SEQ ID NO: 1132255 - protein, 18 aa, Mycobacterium
MVFARLSVFAALGPACAI

SEQ ID NO: 1132256 - protein, 21 aa, Mycobacterium
MVGWRGAGWWRRAVSIATVPM

SEQ ID NO: 1132257 - protein, 22 aa, Mycobacterium
MVIGAAIGVVWFWIPLGLLVLG

SEQ ID NO: 1132258 - protein, 22 aa, Mycobacterium
MVLFPMHFLKSFAYAGVATVAF

SEQ ID NO: 1132259 - protein, 20 aa, Mycobacterium
MVLFPMYFLKSFAYAGIAVV

SEQ ID NO: 1132260 - protein, 17 aa, Mycobacterium
MVLQDTWLFAGTVYENI

SEQ ID NO: 1132261 - protein, 18 aa, Mycobacterium
MWGGWGWGGWILMGVVMV

SEQ ID NO: 1132262 - protein, 18 aa, Mycobacterium
MWLIMSLRIAFVVLGAAA

SEQ ID NO: 1132263 - protein, 18 aa, Mycobacterium
NAGFRYALVRVRDAGAAI

SEQ ID NO: 1132264 - protein, 20 aa, Mycobacterium
NAGVFSALWLGFRSGTSIFE

SEQ ID NO: 1132265 - protein, 21 aa, Mycobacterium
NCPMLAMAFAFLVYAVVQAVR

SEQ ID NO: 1132266 - protein, 17 aa, Mycobacterium
NDFGWRIIFGFPGIVLA

SEQ ID NO: 1132267 - protein, 17 aa, Mycobacterium
NELRAQFDYVVIDSTPL

SEQ ID NO: 1132268 - protein, 19 aa, Mycobacterium
NEPLWFGLDAWRWMFLAMA

SEQ ID NO: 1132269 - protein, 24 aa, Mycobacterium
NGACFRLTLPLVRGHKVTTSPLPL

SEQ ID NO: 1132270 - protein, 18 aa, Mycobacterium
NHEPGWVVAPGMQGVEVQ

SEQ ID NO: 1132271 - protein, 24 aa, Mycobacterium
NKPAEASIGWGLYLVIAFILLQAA

SEQ ID NO: 1132272 - protein, 28 aa, Mycobacterium
NNGLRPEPLIAFGVVAAWILTERALATR

SEQ ID NO: 1132273 - protein, 26 aa, Mycobacterium
NPGLDRRGVAVLLDFGGGGTSITLVD

SEQ ID NO: 1132274 - protein, 21 aa, Mycobacterium
NPRFPRLFPGGDFVQGLPDGG

SEQ ID NO: 1132275 - protein, 19 aa, Mycobacterium
NPTEFPIALLLNVTNPLRA

SEQ ID NO: 1132276 - protein, 17 aa, Mycobacterium
NRCPLTSYVLVGFSQGA

SEQ ID NO: 1132277 - protein, 18 aa, Mycobacterium
NRLNRIAALVGIVAGVVF

SEQ ID NO: 1132278 - protein, 21 aa, Mycobacterium
NRLRVKAVRPIDGFTEEQALD

SEQ ID NO: 1132279 - protein, 17 aa, Mycobacterium
NRMAFLAGVLFILALCF

SEQ ID NO: 1132280 - protein, 18 aa, Mycobacterium
NRVSYYFDLRGPSVTIDT

SEQ ID NO: 1132281 - protein, 23 aa, Mycobacterium
NRWRHLPAILLVASLVLLTVAMA

SEQ ID NO: 1132282 - protein, 21 aa, Mycobacterium
NSFGWRIPFLIAGALGAVGLY

SEQ ID NO: 1132283 - protein, 24 aa, Mycobacterium
NSPVCDREKMDLFLGEHPDKAEAF

SEQ ID NO: 1132284 - protein, 20 aa, Mycobacterium
NSREAVHILALFSSAVLILM

SEQ ID NO: 1132285 - protein, 18 aa, Mycobacterium
NTETGWKLGFYAASRASQ

SEQ ID NO: 1132286 - protein, 22 aa, Mycobacterium
NWLWKWASYLIVFGIMVVLTGL

SEQ ID NO: 1132287 - protein, 18 aa, Mycobacterium
NYFYWEPHCFNIPICWAF

SEQ ID NO: 1132288 - protein, 18 aa, Mycobacterium
NYKFCGQCGSPIGVVAFP

SEQ ID NO: 1132289 - protein, 19 aa, Mycobacterium
PACGGLRMTHDLLHGDLAA

SEQ ID NO: 1132290 - protein, 20 aa, Mycobacterium
PADRLIVIYADFKGEAGADI

SEQ ID NO: 1132291 - protein, 20 aa, Mycobacterium
PAEAKALVIAPNLVSARFIQ

SEQ ID NO: 1132292 - protein, 19 aa, Mycobacterium
PAGDETFIWLTLALAGVWA

SEQ ID NO: 1132293 - protein, 19 aa, Mycobacterium
PAGLFSLGCFYVFGSLEHL

SEQ ID NO: 1132294 - protein, 19 aa, Mycobacterium
PAGLLFLGFFRWVARQMVA

SEQ ID NO: 1132295 - protein, 18 aa, Mycobacterium
PAGLRLVIDNAIANAVKH

SEQ ID NO: 1132296 - protein, 24 aa, Mycobacterium
PAIAALVGRANWWPSRVTASPGAE

SEQ ID NO: 1132297 - protein, 20 aa, Mycobacterium
PAPIPVVWLAFYAVSVLGAA

SEQ ID NO: 1132298 - protein, 18 aa, Mycobacterium
PAPRPARRGLVHALAVPA

SEQ ID NO: 1132299 - protein, 18 aa, Mycobacterium
PAPWPRIMREAARSRADA

SEQ ID NO: 1132300 - protein, 17 aa, Mycobacterium
PARRFGFGRFGRKSSTV

SEQ ID NO: 1132301 - protein, 23 aa, Mycobacterium
PAVLRPGVLVQRVWTRSAPALAA

SEQ ID NO: 1132302 - protein, 19 aa, Mycobacterium
PAWAWLKWLPHLQHETDTD

SEQ ID NO: 1132303 - protein, 19 aa, Mycobacterium
PDALKEFGDGVAKAVNDTR

SEQ ID NO: 1132304 - protein, 21 aa, Mycobacterium
PDFGKASPFGLIIVVLLLIAV

SEQ ID NO: 1132305 - protein, 17 aa, Mycobacterium
PDGLPFLSLTSMSAGLL

SEQ ID NO: 1132306 - protein, 17 aa, Mycobacterium
PDGLYCKLPQDSPMNVR

SEQ ID NO: 1132307 - protein, 26 aa, Mycobacterium
PDPESRPRLILGFAMVALPALGLWHL

SEQ ID NO: 1132308 - protein, 19 aa, Mycobacterium
PDPIFPRWVAHFNIAIAAL

SEQ ID NO: 1132309 - protein, 21 aa, Mycobacterium
PDPNLRPAIVGVFTDLTGPAP

SEQ ID NO: 1132310 - protein, 23 aa, Mycobacterium
PDQSRLPLAAAVATAVLVLLAVL

SEQ ID NO: 1132311 - protein, 20 aa, Mycobacterium
PDSLRKAFGWFVLAMSSVIL

SEQ ID NO: 1132312 - protein, 21 aa, Mycobacterium
PDSLRKTFGWFVLVMSSVILA

SEQ ID NO: 1132313 - protein, 19 aa, Mycobacterium
PDSWMAWTLHAMETMAFNV

SEQ ID NO: 1132314 - protein, 17 aa, Mycobacterium
PDSWRLLNIVFILVVLF

SEQ ID NO: 1132315 - protein, 24 aa, Mycobacterium
PDTTRPVGLTVFWPLADRPRLAAG

SEQ ID NO: 1132316 - protein, 21 aa, Mycobacterium
PEARPRLILGAAMITLPALGL

SEQ ID NO: 1132317 - protein, 17 aa, Mycobacterium
PEIPTLLSLGVIVVTLI

SEQ ID NO: 1132318 - protein, 19 aa, Mycobacterium
PELHAAVLAVVRESLSNVV

SEQ ID NO: 1132319 - protein, 17 aa, Mycobacterium
PELLNLVLVDFKGGATF

SEQ ID NO: 1132320 - protein, 24 aa, Mycobacterium
PELVWLPLFLVFGVLTGFLGAGYN

SEQ ID NO: 1132321 - protein, 18 aa, Mycobacterium
PERFRQALFRALAGVIEL

SEQ ID NO: 1132322 - protein, 17 aa, Mycobacterium
PEVLGLLLIPATVLAAV

SEQ ID NO: 1132323 - protein, 19 aa, Mycobacterium
PFARITSTLTWIWIAAFGG

SEQ ID NO: 1132324 - protein, 18 aa, Mycobacterium
PFLARAVVWAGRRFGKGQ

SEQ ID NO: 1132325 - protein, 23 aa, Mycobacterium
PFLLLFRLTCYYYRGAYYRTVWQ

SEQ ID NO: 1132326 - protein, 21 aa, Mycobacterium
PFSALCFLPLIGLSQPGVLVL

SEQ ID NO: 1132327 - protein, 21 aa, Mycobacterium
PFVELRWWPLALLSALSLTLV

SEQ ID NO: 1132328 - protein, 18 aa, Mycobacterium
PGAVLVMATVLCLVGLLA

SEQ ID NO: 1132329 - protein, 17 aa, Mycobacterium
PGGFGALNDRTYEICAR

SEQ ID NO: 1132330 - protein, 20 aa, Mycobacterium
PGLRDDWRPVLWAIAILTMV

SEQ ID NO: 1132331 - protein, 18 aa, Mycobacterium
PGRRPGRPRPGGGAIAVL

SEQ ID NO: 1132332 - protein, 25 aa, Mycobacterium
PGRYGFDAGRGWARRPFVGSVVALL

SEQ ID NO: 1132333 - protein, 25 aa, Mycobacterium
PGRYGLDAGRGWARRPFVGSFAALL

SEQ ID NO: 1132334 - protein, 22 aa, Mycobacterium
PGSPGVRVRLVLTWVVCTALPG

SEQ ID NO: 1132335 - protein, 21 aa, Mycobacterium
PGTHFCPYCAHPVDGGAAQQS

SEQ ID NO: 1132336 - protein, 23 aa, Mycobacterium
PHLDAGPFLSYGIQWIAFGIIAP

SEQ ID NO: 1132337 - protein, 25 aa, Mycobacterium
PHLLRDLRDGWVFMLRTPWLLWTLL

SEQ ID NO: 1132338 - protein, 22 aa, Mycobacterium
PHPYPRWIATAGWAGFALGIAM

SEQ ID NO: 1132339 - protein, 20 aa, Mycobacterium
PHYRPSAALQDFVRCRDLTC

SEQ ID NO: 1132340 - protein, 19 aa, Mycobacterium
PIVDLRSGFIVGVEALLRW

SEQ ID NO: 1132341 - protein, 18 aa, Mycobacterium
PKLPRFIRTFAVPIVLAW

SEQ ID NO: 1132342 - protein, 21 aa, Mycobacterium
PKPRLRPSGRIAVVGRVAAAL

SEQ ID NO: 1132343 - protein, 21 aa, Mycobacterium
PLALGLWAAWGAWRGNDDDDD

SEQ ID NO: 1132344 - protein, 21 aa, Mycobacterium
PLALGLWAAWQAWRDDDDDDD

SEQ ID NO: 1132345 - protein, 17 aa, Mycobacterium
PLARRPIVWWLHWLAEK

SEQ ID NO: 1132346 - protein, 20 aa, Mycobacterium
PLCVVIGVGVAWLVERTDLP

SEQ ID NO: 1132347 - protein, 24 aa, Mycobacterium
PLEFEGFVAWLAWLVLHLVYLVGF

SEQ ID NO: 1132348 - protein, 19 aa, Mycobacterium
PLPSWRWALELDRISATLA

SEQ ID NO: 1132349 - protein, 20 aa, Mycobacterium
PLWPHSWPFIAQVLAAILVA

SEQ ID NO: 1132350 - protein, 18 aa, Mycobacterium
PLWREFTRFWTVSFPVVV

SEQ ID NO: 1132351 - protein, 23 aa, Mycobacterium
PLYCVGVLMAFWAARFGTTVIYG

SEQ ID NO: 1132352 - protein, 17 aa, Mycobacterium
PMPRWLRVIAEWNPVSS

SEQ ID NO: 1132353 - protein, 17 aa, Mycobacterium
PMSVRLIAPEAGRTDDV

SEQ ID NO: 1132354 - protein, 19 aa, Mycobacterium
PNALKEFGDGVAKAVNDTR

SEQ ID NO: 1132355 - protein, 25 aa, Mycobacterium
PNRLWWRFTAWWFGCAALAVLWWVV

SEQ ID NO: 1132356 - protein, 22 aa, Mycobacterium
PNSRFTISMLWSGDKAWRQSGE

SEQ ID NO: 1132357 - protein, 22 aa, Mycobacterium
PNWAEAAMAFWASAFLGAVVVP

SEQ ID NO: 1132358 - protein, 23 aa, Mycobacterium
PPAPRRAWPVLGVIGVIGMVIMV

SEQ ID NO: 1132359 - protein, 17 aa, Mycobacterium
PPLRERLLIKLSTIELN

SEQ ID NO: 1132360 - protein, 19 aa, Mycobacterium
PPRRLRLLLTVAGVVLVLD

SEQ ID NO: 1132361 - protein, 24 aa, Mycobacterium
PPRSARWWLALNVIGALAINHLIL

SEQ ID NO: 1132362 - protein, 21 aa, Mycobacterium
PQGPAAWMLGAATGWLAAAVV

SEQ ID NO: 1132363 - protein, 19 aa, Mycobacterium
PQMFATLFISWAARAARDA

SEQ ID NO: 1132364 - protein, 18 aa, Mycobacterium
PQWTPPKPAWTWPTQTVE

SEQ ID NO: 1132365 - protein, 17 aa, Mycobacterium
PRAWRMRISVEKIGDDA

SEQ ID NO: 1132366 - protein, 19 aa, Mycobacterium
PRGKFHLCNYVTAVTDGAN

SEQ ID NO: 1132367 - protein, 19 aa, Mycobacterium
PRGPLAFRVAERMSLISDA

SEQ ID NO: 1132368 - protein, 26 aa, Mycobacterium
PRGRLRRAVLPAAFSGVIVASVVAAG

SEQ ID NO: 1132369 - protein, 25 aa, Mycobacterium
PRGRLRRAVLPAAFSSVIVASVVAA

SEQ ID NO: 1132370 - protein, 17 aa, Mycobacterium
PRKEPALSLDRVVEGPY

SEQ ID NO: 1132371 - protein, 19 aa, Mycobacterium
PRLHAVAVVAALLPNLAEW

SEQ ID NO: 1132372 - protein, 25 aa, Mycobacterium
PRPPCCKDGDKDCEPGWPWPWPWPD

SEQ ID NO: 1132373 - protein, 19 aa, Mycobacterium
PRRASCLAGLGYAPTLEVL

SEQ ID NO: 1132374 - protein, 19 aa, Mycobacterium
PRRMSSFVHGLWIVGQCII

SEQ ID NO: 1132375 - protein, 24 aa, Mycobacterium
PRRPRLPLKAGWGVKAAMAVVLVV

SEQ ID NO: 1132376 - protein, 18 aa, Mycobacterium
PRRPSRLGTGWVATICVV

SEQ ID NO: 1132377 - protein, 18 aa, Mycobacterium
PRRRGRVSEMAWQVVAAV

SEQ ID NO: 1132378 - protein, 18 aa, Mycobacterium
PRSALRLVLDNLWPLARA

SEQ ID NO: 1132379 - protein, 19 aa, Mycobacterium
PRTLTLDGLGRYRVIALPA

SEQ ID NO: 1132380 - protein, 20 aa, Mycobacterium
PRTVRWTLRLDVTDVDGRLA

SEQ ID NO: 1132381 - protein, 18 aa, Mycobacterium
PRVLVTFKILGNINLGEQ

SEQ ID NO: 1132382 - protein, 20 aa, Mycobacterium
PRVRCMCGNPLRPPDAIEGD

SEQ ID NO: 1132383 - protein, 18 aa, Mycobacterium
PRWLPDWLRPTGQRVRVD

SEQ ID NO: 1132384 - protein, 24 aa, Mycobacterium
PRYLLSSWPWRALVWTMFGGVLSA

SEQ ID NO: 1132385 - protein, 20 aa, Mycobacterium
PRYRVLWGIAINVVGGMAVI

SEQ ID NO: 1132386 - protein, 17 aa, Mycobacterium
PSAHVALGRWHRDRALS

SEQ ID NO: 1132387 - protein, 17 aa, Mycobacterium
PSDVAISVPSYWSPATT

SEQ ID NO: 1132388 - protein, 17 aa, Mycobacterium
PSQGVVVLVDLGGSGSS

SEQ ID NO: 1132389 - protein, 19 aa, Mycobacterium
PSWWAKFVVLGLILFAGVA

SEQ ID NO: 1132390 - protein, 24 aa, Mycobacterium
PTAPSHPRWWFLWTTPGRILSIGM

SEQ ID NO: 1132391 - protein, 18 aa, Mycobacterium
PTEGGLVRTARIGGITVS

SEQ ID NO: 1132392 - protein, 19 aa, Mycobacterium
PTHWHLWCAAALSGSAAVG

SEQ ID NO: 1132393 - protein, 20 aa, Mycobacterium
PTHWQEWMPAGLFFATIALF

SEQ ID NO: 1132394 - protein, 26 aa, Mycobacterium
PTIIYSLYWRRFNTRGALWSMYGGLI

SEQ ID NO: 1132395 - protein, 25 aa, Mycobacterium
PTPLSARASTLWGYAWPLAYLAGIG

SEQ ID NO: 1132396 - protein, 19 aa, Mycobacterium
PTVSRWGLWSSDRTIAVRR

SEQ ID NO: 1132397 - protein, 18 aa, Mycobacterium
PVAPGLRPATLNATLNLP

SEQ ID NO: 1132398 - protein, 23 aa, Mycobacterium
PVGLRLLWTVPILAFFAAALGVG

SEQ ID NO: 1132399 - protein, 18 aa, Mycobacterium
PVLLTWLASVAVVFVGAL

SEQ ID NO: 1132400 - protein, 17 aa, Mycobacterium
PVQYAKRMVGRKMYGGT

SEQ ID NO: 1132401 - protein, 24 aa, Mycobacterium
PVQYPKRRRPWIIAVVAAVAVLAV

SEQ ID NO: 1132402 - protein, 26 aa, Mycobacterium
PVVPAEAFAAWDFVTRFDVAQVVMAP

SEQ ID NO: 1132403 - protein, 17 aa, Mycobacterium
PWSNSFPEWKFGFTTML

SEQ ID NO: 1132404 - protein, 19 aa, Mycobacterium
PWSTLKVSLLLSVVLFFVW

SEQ ID NO: 1132405 - protein, 18 aa, Mycobacterium
PWSWLPRIVMQFTAGALA

SEQ ID NO: 1132406 - protein, 20 aa, Mycobacterium
PYLREGWSVVAMRLTTDAAS

SEQ ID NO: 1132407 - protein, 18 aa, Mycobacterium
PYLYAGILFFATLGAFAV

SEQ ID NO: 1132408 - protein, 21 aa, Mycobacterium
QARWRLILTVLIAAASVGLAV

SEQ ID NO: 1132409 - protein, 18 aa, Mycobacterium
QDLAMAWLLAGLFAGVVS

SEQ ID NO: 1132410 - protein, 17 aa, Mycobacterium
QDLRAAFTERGWLDMTH

SEQ ID NO: 1132411 - protein, 22 aa, Mycobacterium
QDRLPIEIAIAVLVLGVLLLVY

SEQ ID NO: 1132412 - protein, 21 aa, Mycobacterium
QELPTLCWAWQRVAGDQAPKM

SEQ ID NO: 1132413 - protein, 25 aa, Mycobacterium
QGVWHLGPFPVRAYALFIIVGIIAA

SEQ ID NO: 1132414 - protein, 24 aa, Mycobacterium
QGWGGLRLALPLGDDSDASYLAAE

SEQ ID NO: 1132415 - protein, 20 aa, Mycobacterium
QHLFWYFGHPEVYVIALPFF

SEQ ID NO: 1132416 - protein, 19 aa, Mycobacterium
QIRGPHVMRGICRRSREEV

SEQ ID NO: 1132417 - protein, 18 aa, Mycobacterium
QIVTRLLLFLAVAVVFGA

SEQ ID NO: 1132418 - protein, 22 aa, Mycobacterium
QIYIVMGASWVWYRGLQGQPVP

SEQ ID NO: 1132419 - protein, 23 aa, Mycobacterium
QKAWRNLRFPLEWAPPEANVARI

SEQ ID NO: 1132420 - protein, 17 aa, Mycobacterium
QKMLSEWLVDPHELSHS

SEQ ID NO: 1132421 - protein, 17 aa, Mycobacterium
QKYIRRRFPALSGEDHN

SEQ ID NO: 1132422 - protein, 19 aa, Mycobacterium
QLKWWARAVVTLWVILVVP

SEQ ID NO: 1132423 - protein, 20 aa, Mycobacterium
QLNLPRLWSGFQIIGDGSGE

SEQ ID NO: 1132424 - protein, 18 aa, Mycobacterium
QLRPVYNLTSARLILGDG

SEQ ID NO: 1132425 - protein, 20 aa, Mycobacterium
QLVVPRFLALLLISPLLCIF

SEQ ID NO: 1132426 - protein, 18 aa, Mycobacterium
QMRKRFGSTMGYELDIRA

SEQ ID NO: 1132427 - protein, 22 aa, Mycobacterium
QMRKRFGSTMGYELDIRADTAS

SEQ ID NO: 1132428 - protein, 23 aa, Mycobacterium
QPGKLRALATWGPWVSIGAAVVT

SEQ ID NO: 1132429 - protein, 18 aa, Mycobacterium
QPIREWRPAFVPMLPLAA

SEQ ID NO: 1132430 - protein, 20 aa, Mycobacterium
QPPFAWREFIFQMWFVARVS

SEQ ID NO: 1132431 - protein, 24 aa, Mycobacterium
QPRAWRLSVDIVRDAGRLKMSKME

SEQ ID NO: 1132432 - protein, 23 aa, Mycobacterium
QQLGRKRLILWAAVLTLANVLAD

SEQ ID NO: 1132433 - protein, 19 aa, Mycobacterium
QQQPYDWRYAAQPQQQFRA

SEQ ID NO: 1132434 - protein, 18 aa, Mycobacterium
QRAEALAAEVARTFREAG

SEQ ID NO: 1132435 - protein, 19 aa, Mycobacterium
QRFMMRWRVWLSRRFIDDW

SEQ ID NO: 1132436 - protein, 18 aa, Mycobacterium
QRFPRLVDHLGRPVALLS

SEQ ID NO: 1132437 - protein, 19 aa, Mycobacterium
QRGPFAIVVARFVPIVRTL

SEQ ID NO: 1132438 - protein, 17 aa, Mycobacterium
QRLRGIATIEAMLAADP

SEQ ID NO: 1132439 - protein, 25 aa, Mycobacterium
QRVGYRLRATMAFDEGQYRISSLDQ

SEQ ID NO: 1132440 - protein, 21 aa, Mycobacterium
QSGSIGLGFAIPVDQAKRIAD

SEQ ID NO: 1132441 - protein, 25 aa, Mycobacterium
QTHLFRTGLLFAIGSAFAFGSSGPF

SEQ ID NO: 1132442 - protein, 22 aa, Mycobacterium
QVLRLPARFVLGALAGLRTVGL

SEQ ID NO: 1132443 - protein, 18 aa, Mycobacterium
QWGRAGEITLVLPPELAR

SEQ ID NO: 1132444 - protein, 26 aa, Mycobacterium
QWREFILQAWFLFRVSFLPTVAVSVP

SEQ ID NO: 1132445 - protein, 22 aa, Mycobacterium
QYRLPITFCLFDNHAHAMCVTR

SEQ ID NO: 1132446 - protein, 18 aa, Mycobacterium
QYTSFGWAFLISGVILAV

SEQ ID NO: 1132447 - protein, 18 aa, Mycobacterium
RAAAPLSRDDAWIIFTSG

SEQ ID NO: 1132448 - protein, 20 aa, Mycobacterium
RAAVWSGRLARDFLSEMRNN

SEQ ID NO: 1132449 - protein, 18 aa, Mycobacterium
RADFGWNRLEVAKPQSAV

SEQ ID NO: 1132450 - protein, 21 aa, Mycobacterium
RADTALARFLLRFAANCRPSA

SEQ ID NO: 1132451 - protein, 22 aa, Mycobacterium
RAEEYVRLAARRQWPVLVGRWL

SEQ ID NO: 1132452 - protein, 25 aa, Mycobacterium
RAFVALRWWPLVLLVAVTVALVALA

SEQ ID NO: 1132453 - protein, 17 aa, Mycobacterium
RAGEITLVLPPELARRL

SEQ ID NO: 1132454 - protein, 17 aa, Mycobacterium
RAGERWLGAIGLMDLPR

SEQ ID NO: 1132455 - protein, 23 aa, Mycobacterium
RAHFGDDLLYVWRHFPLERAHPR

SEQ ID NO: 1132456 - protein, 19 aa, Mycobacterium
RAHPGFVRRVMTSALPSGI

SEQ ID NO: 1132457 - protein, 17 aa, Mycobacterium
RAKIILDVNPKYLDLIP

SEQ ID NO: 1132458 - protein, 20 aa, Mycobacterium
RALLFGGIFPPFWLAGTAML

SEQ ID NO: 1132459 - protein, 23 aa, Mycobacterium
RAMSQMGVPYSWGGGNAAGPSRG

SEQ ID NO: 1132460 - protein, 19 aa, Mycobacterium
RAPTVQLCRDPRGYVPVGN

SEQ ID NO: 1132461 - protein, 19 aa, Mycobacterium
RARLPFGLDPAGTPVLGSW

SEQ ID NO: 1132462 - protein, 18 aa, Mycobacterium
RARMPWFDHVMRAQERYK

SEQ ID NO: 1132463 - protein, 18 aa, Mycobacterium
RAVFGTAIGFLFGAVLIS

SEQ ID NO: 1132464 - protein, 20 aa, Mycobacterium
RAVINFKFGWDIYNENFGHV

SEQ ID NO: 1132465 - protein, 20 aa, Mycobacterium
RAVSTAVRWVLASYVRLALV

SEQ ID NO: 1132466 - protein, 18 aa, Mycobacterium
RCGLRPYYLPVYGPLGHA

SEQ ID NO: 1132467 - protein, 17 aa, Mycobacterium
RCGRFICPECMRSAAVG

SEQ ID NO: 1132468 - protein, 19 aa, Mycobacterium
RDAFPASFVVKLNDPEQHQ

SEQ ID NO: 1132469 - protein, 19 aa, Mycobacterium
RDNMLPFSHVWRHVSPKSK

SEQ ID NO: 1132470 - protein, 21 aa, Mycobacterium
RDYRFAVVVTLGWMAFTFAFN

SEQ ID NO: 1132471 - protein, 18 aa, Mycobacterium
REAWEFAAYTAPGRAGLL

SEQ ID NO: 1132472 - protein, 22 aa, Mycobacterium
REDPSRPAVCIVRARSKDGSET

SEQ ID NO: 1132473 - protein, 19 aa, Mycobacterium
REFPGPWALVPVGATLLFI

SEQ ID NO: 1132474 - protein, 17 aa, Mycobacterium
REFSLWSAFAFAFAFIS

SEQ ID NO: 1132475 - protein, 25 aa, Mycobacterium
REGRIPWPDALRIGVKLCGALETAH

SEQ ID NO: 1132476 - protein, 24 aa, Mycobacterium
REICRQRMGPVFKRITMNFPPLLA

SEQ ID NO: 1132477 - protein, 20 aa, Mycobacterium
REKLRYGVVLTMCAGAVVGA

SEQ ID NO: 1132478 - protein, 17 aa, Mycobacterium
REKRWGPTHIRRAAAAA

SEQ ID NO: 1132479 - protein, 20 aa, Mycobacterium
RELAARFGFLLAIPAVFASG

SEQ ID NO: 1132480 - protein, 23 aa, Mycobacterium
REMWVCGPLGWLTVLLAGLCGAL

SEQ ID NO: 1132481 - protein, 27 aa, Mycobacterium
REPWPGLRWRPLLIAAAALLVWSVLML

SEQ ID NO: 1132482 - protein, 18 aa, Mycobacterium
REVIELNGPDIYRSTTVT

SEQ ID NO: 1132483 - protein, 21 aa, Mycobacterium
REVRLQLRLPLIGEEARWMVQ

SEQ ID NO: 1132484 - protein, 20 aa, Mycobacterium
REVWTGFAAAVVFSGVAGVT

SEQ ID NO: 1132485 - protein, 18 aa, Mycobacterium
RFGEKRAPFALGVAALLF

SEQ ID NO: 1132486 - protein, 18 aa, Mycobacterium
RFGNWVLAMALSILACGI

SEQ ID NO: 1132487 - protein, 24 aa, Mycobacterium
RFGRRIAALLVDWLVSYGLAALAM

SEQ ID NO: 1132488 - protein, 17 aa, Mycobacterium
RFIAWPPGRWGGVSSVN

SEQ ID NO: 1132489 - protein, 26 aa, Mycobacterium
RFIRTFAVPIVLAWVAIVALLNTVVP

SEQ ID NO: 1132490 - protein, 17 aa, Mycobacterium
RFLLRRVEHAIVRRDTR

SEQ ID NO: 1132491 - protein, 24 aa, Mycobacterium
RFTGPEVWWLLGVARWAAGLPIAA

SEQ ID NO: 1132492 - protein, 19 aa, Mycobacterium
RFVKMYGLRIDLQRLETAL

SEQ ID NO: 1132493 - protein, 19 aa, Mycobacterium
RGAINWRQVAVLSVAGCGP

SEQ ID NO: 1132494 - protein, 19 aa, Mycobacterium
RGAPGFCPNCGAPLEVSPE

SEQ ID NO: 1132495 - protein, 19 aa, Mycobacterium
RGDAWPIGRVVAWLLGCLV

SEQ ID NO: 1132496 - protein, 17 aa, Mycobacterium
RGGLFVRQVHHWAALLF

SEQ ID NO: 1132497 - protein, 23 aa, Mycobacterium
RGLMPRIALITIILMPLLYGAMY

SEQ ID NO: 1132498 - protein, 17 aa, Mycobacterium
RGLRWALAAVVAIVAVA

SEQ ID NO: 1132499 - protein, 27 aa, Mycobacterium
RGLTGWPLWWAAWWAAVEWLKSVIPFG

SEQ ID NO: 1132500 - protein, 23 aa, Mycobacterium
RGMWVCGPLGWLTVLLAGLCGAL

SEQ ID NO: 1132501 - protein, 19 aa, Mycobacterium
RGTGFWGPPFRVFAPSEIT

SEQ ID NO: 1132502 - protein, 26 aa, Mycobacterium
RGTVWIPAPLVLLAFAFRTMPRFVWR

SEQ ID NO: 1132503 - protein, 25 aa, Mycobacterium
RGWRKIGAVTVRWPGAILVASVAVS

SEQ ID NO: 1132504 - protein, 20 aa, Mycobacterium
RHVGRVGALALTLGVGLAVT

SEQ ID NO: 1132505 - protein, 18 aa, Mycobacterium
RHWPAYLVTFAFFQYVPA

SEQ ID NO: 1132506 - protein, 19 aa, Mycobacterium
RIAALVGIVAGVVFIIAAI

SEQ ID NO: 1132507 - protein, 17 aa, Mycobacterium
RIARALQRRGHVVAMTG

SEQ ID NO: 1132508 - protein, 21 aa, Mycobacterium
RIGDRRVWRTPYWLTELPGGR

SEQ ID NO: 1132509 - protein, 18 aa, Mycobacterium
RIGEFHWFRHGVLGALGS

SEQ ID NO: 1132510 - protein, 18 aa, Mycobacterium
RIGLRLLTVPGFLLVAAG

SEQ ID NO: 1132511 - protein, 31 aa, Mycobacterium
RIKPTLLGVLPWRWGDPQARQLKWWARAVVT

SEQ ID NO: 1132512 - protein, 21 aa, Mycobacterium
RIRGGMMGIIILVLVIGVGQS

SEQ ID NO: 1132513 - protein, 18 aa, Mycobacterium
RIRWGNLLTLPVGPGGLL

SEQ ID NO: 1132514 - protein, 23 aa, Mycobacterium
RKAAAWSWRLLLILGAIVTLLWL

SEQ ID NO: 1132515 - protein, 23 aa, Mycobacterium
RKLRLQLFMTFVWTLTVVGGSLI

SEQ ID NO: 1132516 - protein, 18 aa, Mycobacterium
RKRVVAVSFPRDLEIEPM

SEQ ID NO: 1132517 - protein, 17 aa, Mycobacterium
RKSEIWAAFLFGLSISP

SEQ ID NO: 1132518 - protein, 18 aa, Mycobacterium
RLAAGVVRPELQPVYLEE

SEQ ID NO: 1132519 - protein, 21 aa, Mycobacterium
RLAIFVTVCGLTLFGLYAVFG

SEQ ID NO: 1132520 - protein, 17 aa, Mycobacterium
RLDDSRFLLPVLGVPPE

SEQ ID NO: 1132521 - protein, 24 aa, Mycobacterium
RLDGEQWPAFSLQTVVAVKYAATD

SEQ ID NO: 1132522 - protein, 18 aa, Mycobacterium
RLGRGWLTAICAVLLLLG

SEQ ID NO: 1132523 - protein, 22 aa, Mycobacterium
RLKGLRAMLARFLFHCWVALTV

SEQ ID NO: 1132524 - protein, 17 aa, Mycobacterium
RLLEFADILVAAPPNIA

SEQ ID NO: 1132525 - protein, 25 aa, Mycobacterium
RLPDLVCALVCWLLLSREVLPRLGP

SEQ ID NO: 1132526 - protein, 19 aa, Mycobacterium
RLPGWPLWFAALWAAQEWL

SEQ ID NO: 1132527 - protein, 18 aa, Mycobacterium
RLPREWMTEPGLGVVGVV

SEQ ID NO: 1132528 - protein, 20 aa, Mycobacterium
RLQAEFPRSATLPFASENRI

SEQ ID NO: 1132529 - protein, 21 aa, Mycobacterium
RLRTKLRLFGFDTVETVSEEA

SEQ ID NO: 1132530 - protein, 19 aa, Mycobacterium
RLTGWVAALFAWRRRHRQP

SEQ ID NO: 1132531 - protein, 19 aa, Mycobacterium
RLVDHLGRPVALLSRLGDH

SEQ ID NO: 1132532 - protein, 21 aa, Mycobacterium
RLWGRRYAWMTGWVYLVALLV

SEQ ID NO: 1132533 - protein, 23 aa, Mycobacterium
RLYAERWCAWALLAVTVIVPTGV

SEQ ID NO: 1132534 - protein, 23 aa, Mycobacterium
RLYAERWCAWALMAAAVAVPTGV

SEQ ID NO: 1132535 - protein, 20 aa, Mycobacterium
RLYLDGGLQFSTRDEFRYTE

SEQ ID NO: 1132536 - protein, 19 aa, Mycobacterium
RMCALPLTVGMLMSAALWS

SEQ ID NO: 1132537 - protein, 24 aa, Mycobacterium
RMMPYLLPYRGRWIVMIVVALASL

SEQ ID NO: 1132538 - protein, 21 aa, Mycobacterium
RMRNVWVCFAIAFGGWTAGEV

SEQ ID NO: 1132539 - protein, 17 aa, Mycobacterium
RMVAIKLLRPEMAADHS

SEQ ID NO: 1132540 - protein, 20 aa, Mycobacterium
RNPWYLAWLRLRRNKVALGC

SEQ ID NO: 1132541 - protein, 19 aa, Mycobacterium
RNSPGWLRAVMHLWLAALF

SEQ ID NO: 1132542 - protein, 18 aa, Mycobacterium
RNYFYWEPHCYNIPMCWA

SEQ ID NO: 1132543 - protein, 20 aa, Mycobacterium
RNYFYWEPHCYNIPVCATMR

SEQ ID NO: 1132544 - protein, 24 aa, Mycobacterium
RPAYLWAWRLLRLDFIGVAFGALF

SEQ ID NO: 1132545 - protein, 21 aa, Mycobacterium
RPEPLARWLAWSTTLYLKVFG

SEQ ID NO: 1132546 - protein, 31 aa, Mycobacterium
RPFIPRMIRLFAVPIILGWIALIVILNVTVP

SEQ ID NO: 1132547 - protein, 18 aa, Mycobacterium
RPFQWREFILQAWFLFRV

SEQ ID NO: 1132548 - protein, 23 aa, Mycobacterium
RPGSLDWFAGVGFLVAIAVAVAA

SEQ ID NO: 1132549 - protein, 20 aa, Mycobacterium
RPHAPWARWRYTKRPRKMHR

SEQ ID NO: 1132550 - protein, 23 aa, Mycobacterium
RPHGIDLPSVWALTRGAGQTVAV

SEQ ID NO: 1132551 - protein, 18 aa, Mycobacterium
RPLPGGVIRPGIEPPVAE

SEQ ID NO: 1132552 - protein, 19 aa, Mycobacterium
RPNPGIGHPCWANYFPVTR

SEQ ID NO: 1132553 - protein, 18 aa, Mycobacterium
RPPLRERLLIKLSTIELN

SEQ ID NO: 1132554 - protein, 20 aa, Mycobacterium
RPQWLALFVVVLAFAYLCFT

SEQ ID NO: 1132555 - protein, 19 aa, Mycobacterium
RPRVFRLRADLPVPQALTA

SEQ ID NO: 1132556 - protein, 20 aa, Mycobacterium
RPSLLFAHGSFRDDAMRKQR

SEQ ID NO: 1132557 - protein, 19 aa, Mycobacterium
RPTGLAFLVGWLVGLAALT

SEQ ID NO: 1132558 - protein, 17 aa, Mycobacterium
RPVDVIPVGRPWMSKQD

SEQ ID NO: 1132559 - protein, 18 aa, Mycobacterium
RPYEWWRVALVAVSGLAY

SEQ ID NO: 1132560 - protein, 24 aa, Mycobacterium
RQIYWRRRALALGIAALVIGIVVA

SEQ ID NO: 1132561 - protein, 19 aa, Mycobacterium
RQPDHFDWLSGYLQTRGMA

SEQ ID NO: 1132562 - protein, 17 aa, Mycobacterium
RQPHRRLVAAVALGGLA

SEQ ID NO: 1132563 - protein, 23 aa, Mycobacterium
RRASIPIILSWIALAAFLNISVP

SEQ ID NO: 1132564 - protein, 17 aa, Mycobacterium
RRDGRFLVALGMGGMGY

SEQ ID NO: 1132565 - protein, 17 aa, Mycobacterium
RRDILRLIAEISMGAGT

SEQ ID NO: 1132566 - protein, 18 aa, Mycobacterium
RREFSLGSAFAFAFAFIS

SEQ ID NO: 1132567 - protein, 18 aa, Mycobacterium
RREFSLWSAFAFAFAFIS

SEQ ID NO: 1132568 - protein, 20 aa, Mycobacterium
RRFSGLALWCFAAMAVSGFV

SEQ ID NO: 1132569 - protein, 17 aa, Mycobacterium
RRFSLAVVGSVAAAVLC

SEQ ID NO: 1132570 - protein, 17 aa, Mycobacterium
RRHPFALAIGFLAFGMA

SEQ ID NO: 1132571 - protein, 21 aa, Mycobacterium
RRHRFGWCVAAAYLSGVSTVV

SEQ ID NO: 1132572 - protein, 19 aa, Mycobacterium
RRIPIEIDEAAVIDGLTVA

SEQ ID NO: 1132573 - protein, 25 aa, Mycobacterium
RRIPRPGWKAAVATVVALATVALLG

SEQ ID NO: 1132574 - protein, 18 aa, Mycobacterium
RRKMIGLSLGIGFGAFGL

SEQ ID NO: 1132575 - protein, 21 aa, Mycobacterium
RRKVDGWVNGWNRIGTQTQFY

SEQ ID NO: 1132576 - protein, 17 aa, Mycobacterium
RRLDEAAGFAIPLLPRS

SEQ ID NO: 1132577 - protein, 20 aa, Mycobacterium
RRLPGWPLWFAGLWSAQEWL

SEQ ID NO: 1132578 - protein, 19 aa, Mycobacterium
RRLSDLGLFVFRSYGSTEH

SEQ ID NO: 1132579 - protein, 22 aa, Mycobacterium
RRLSWEIAWKPVLVLIVLIYAI

SEQ ID NO: 1132580 - protein, 17 aa, Mycobacterium
RRLTPWVAIVFTTLIAF

SEQ ID NO: 1132581 - protein, 18 aa, Mycobacterium
RRLVLIGANCGRLVVILV

SEQ ID NO: 1132582 - protein, 19 aa, Mycobacterium
RRMEAYSWGGLTSRKATRA

SEQ ID NO: 1132583 - protein, 17 aa, Mycobacterium
RRPIVWWLHWLAEKTQK

SEQ ID NO: 1132584 - protein, 21 aa, Mycobacterium
RRPPERPMRVTAAPAARAVRV

SEQ ID NO: 1132585 - protein, 17 aa, Mycobacterium
RRPQGPAAWMLGAATGW

SEQ ID NO: 1132586 - protein, 20 aa, Mycobacterium
RRPVEFLCLLPLTIPALVIV

SEQ ID NO: 1132587 - protein, 17 aa, Mycobacterium
RRPVPHLIASVLVLLLL

SEQ ID NO: 1132588 - protein, 17 aa, Mycobacterium
RRRGRFLVALGMGGMGY

SEQ ID NO: 1132589 - protein, 24 aa, Mycobacterium
RRRVRARRGVMRIAVAVLGAAAAA

SEQ ID NO: 1132590 - protein, 20 aa, Mycobacterium
RRSDFPPGRGVLIERGKGVW

SEQ ID NO: 1132591 - protein, 17 aa, Mycobacterium
RRSVLLTLCLTEITSWG

SEQ ID NO: 1132592 - protein, 19 aa, Mycobacterium
RRTGLSFVRYAEPIDWNGK

SEQ ID NO: 1132593 - protein, 17 aa, Mycobacterium
RRTPVALAIGAAAVLAA

SEQ ID NO: 1132594 - protein, 17 aa, Mycobacterium
RRVDPWSTLKVSLLLSV

SEQ ID NO: 1132595 - protein, 17 aa, Mycobacterium
RRVGLGIGFTAGGVGAA

SEQ ID NO: 1132596 - protein, 21 aa, Mycobacterium
RRVGLPVLFPFLLSGWVLTFA

SEQ ID NO: 1132597 - protein, 21 aa, Mycobacterium
RRVRTGPCGDRHRPLTLPGDD

SEQ ID NO: 1132598 - protein, 19 aa, Mycobacterium
RRWAPRGALAFLALSVVLV

SEQ ID NO: 1132599 - protein, 19 aa, Mycobacterium
RRWEARGGERGVIYDIALW

SEQ ID NO: 1132600 - protein, 21 aa, Mycobacterium
RRWLARIAVSWGLVVVAVGFA

SEQ ID NO: 1132601 - protein, 21 aa, Mycobacterium
RSADYWLGWWVIIGTIPISVV

SEQ ID NO: 1132602 - protein, 19 aa, Mycobacterium
RSATVPFILAQPAQAPPPA

SEQ ID NO: 1132603 - protein, 19 aa, Mycobacterium
RSGALGSLMSFIGVVLGAV

SEQ ID NO: 1132604 - protein, 19 aa, Mycobacterium
RSGGVYGDFFNFYACDVTL

SEQ ID NO: 1132605 - protein, 20 aa, Mycobacterium
RSGTHLAFAMLDLDRFKVLN

SEQ ID NO: 1132606 - protein, 23 aa, Mycobacterium
RSPRWWRFFGALQWLLIAVAVAG

SEQ ID NO: 1132607 - protein, 19 aa, Mycobacterium
RSRWLRTALVGVLVATLAI

SEQ ID NO: 1132608 - protein, 18 aa, Mycobacterium
RSTIRWRLTVLYGSAFFI

SEQ ID NO: 1132609 - protein, 18 aa, Mycobacterium
RTAVRVLLILAAAALVLG

SEQ ID NO: 1132610 - protein, 17 aa, Mycobacterium
RTEWPLAAMAVVFLAAY

SEQ ID NO: 1132611 - protein, 17 aa, Mycobacterium
RTFCLLTLAALGWAGWR

SEQ ID NO: 1132612 - protein, 23 aa, Mycobacterium
RTIKGNLFWAFAYNVAALPLAAL

SEQ ID NO: 1132613 - protein, 23 aa, Mycobacterium
RTQRNVYIPWSLTVTPISQSEVG

SEQ ID NO: 1132614 - protein, 19 aa, Mycobacterium
RTRELLPWGNLRRLLRTAH

SEQ ID NO: 1132615 - protein, 22 aa, Mycobacterium
RTRLTEVLSRIYGTPVSIQLEV

SEQ ID NO: 1132616 - protein, 29 aa, Mycobacterium
RTVIIPALFTLIGPRIWWPALREDGPSRG

SEQ ID NO: 1132617 - protein, 20 aa, Mycobacterium
RVALFPTIMLAIPFTVLTVF

SEQ ID NO: 1132618 - protein, 25 aa, Mycobacterium
RVELLKLAVILALWAAVAAAFVSVI

SEQ ID NO: 1132619 - protein, 17 aa, Mycobacterium
RVGTWWRRMEAYSWGGL

SEQ ID NO: 1132620 - protein, 21 aa, Mycobacterium
RVIPPSLLRRALPYLIVILIV

SEQ ID NO: 1132621 - protein, 21 aa, Mycobacterium
RVLAAEMVHFFAVLFWAAGVL

SEQ ID NO: 1132622 - protein, 18 aa, Mycobacterium
RVLARWQPSWLRYSPLTF

SEQ ID NO: 1132623 - protein, 18 aa, Mycobacterium
RVLIVVALLLVYTAPSAD

SEQ ID NO: 1132624 - protein, 18 aa, Mycobacterium
RVRFFRRKWTAVTLSSTW

SEQ ID NO: 1132625 - protein, 23 aa, Mycobacterium
RVRRLAGLGGWAGWRFFVMYGAT

SEQ ID NO: 1132626 - protein, 18 aa, Mycobacterium
RVSEMAWQVVAAVLVATV

SEQ ID NO: 1132627 - protein, 20 aa, Mycobacterium
RVSLMPTLLVAIPFTVLVSF

SEQ ID NO: 1132628 - protein, 17 aa, Mycobacterium
RWALVPLAVVIAADGIR

SEQ ID NO: 1132629 - protein, 17 aa, Mycobacterium
RWEHVLFPIVLIALGIF

SEQ ID NO: 1132630 - protein, 18 aa, Mycobacterium
RWGRKWMIAGGMWLQAIA

SEQ ID NO: 1132631 - protein, 17 aa, Mycobacterium
RWLFALVLSAVWVVAAA

SEQ ID NO: 1132632 - protein, 19 aa, Mycobacterium
RWLFGGTMPTVWLQERLKL

SEQ ID NO: 1132633 - protein, 18 aa, Mycobacterium
RWLIEIVDLLAAAVTAAL

SEQ ID NO: 1132634 - protein, 18 aa, Mycobacterium
RWRPAVALMLALWLVAVG

SEQ ID NO: 1132635 - protein, 23 aa, Mycobacterium
RYIAADGHIVWCALTVVLVHAPR

SEQ ID NO: 1132636 - protein, 18 aa, Mycobacterium
RYPVFAVIGVNPLPTPTS

SEQ ID NO: 1132637 - protein, 17 aa, Mycobacterium
RYYLKVEPYIRLEMNHG

SEQ ID NO: 1132638 - protein, 25 aa, Mycobacterium
SAFFTPRFVNWFGLFTTHLVVAIAL

SEQ ID NO: 1132639 - protein, 18 aa, Mycobacterium
SALCFVGAAVLLYVDLDR

SEQ ID NO: 1132640 - protein, 18 aa, Mycobacterium
SAQLSWRSAYLVLAVVMA

SEQ ID NO: 1132641 - protein, 19 aa, Mycobacterium
SARWWWLRNRRHAGNRIER

SEQ ID NO: 1132642 - protein, 20 aa, Mycobacterium
SASPLPGWLPDAFRAAAAGV

SEQ ID NO: 1132643 - protein, 17 aa, Mycobacterium
SAVALWCFVAMAFSGVI

SEQ ID NO: 1132644 - protein, 17 aa, Mycobacterium
SAVSIGLPLPGWDLAVV

SEQ ID NO: 1132645 - protein, 19 aa, Mycobacterium
SAWLFRRLLGKRARAGFVV

SEQ ID NO: 1132646 - protein, 19 aa, Mycobacterium
SCDSCAAVAVAYQVVFVID

SEQ ID NO: 1132647 - protein, 19 aa, Mycobacterium
SCSSIPLFIGFVAAGIPLS

SEQ ID NO: 1132648 - protein, 20 aa, Mycobacterium
SDGLPVWPFVAAATVIVAAG

SEQ ID NO: 1132649 - protein, 22 aa, Mycobacterium
SDHPRTSVVIIRMSQLGMLDAT

SEQ ID NO: 1132650 - protein, 23 aa, Mycobacterium
SDRRDALKWVWLGVGAAIALTLT

SEQ ID NO: 1132651 - protein, 21 aa, Mycobacterium
SEAVFGMRIGRPFRRMTEYTG

SEQ ID NO: 1132652 - protein, 22 aa, Mycobacterium
SEAVFGMRIGRPFRRMTEYTGF

SEQ ID NO: 1132653 - protein, 22 aa, Mycobacterium
SEAVFGMRIGRPFRRMTQYTGF

SEQ ID NO: 1132654 - protein, 17 aa, Mycobacterium
SEIRKLLLRVLDHRRHV

SEQ ID NO: 1132655 - protein, 17 aa, Mycobacterium
SEIWAAFLFGLSISPVL

SEQ ID NO: 1132656 - protein, 22 aa, Mycobacterium
SESPWKLLARFGYHFSSLVAIV

SEQ ID NO: 1132657 - protein, 18 aa, Mycobacterium
SFPARIGLMTGIYTAALQ

SEQ ID NO: 1132658 - protein, 18 aa, Mycobacterium
SFQPDLCANVPIVGLVGE

SEQ ID NO: 1132659 - protein, 18 aa, Mycobacterium
SFWSLNIGLAWMVFATLL

SEQ ID NO: 1132660 - protein, 24 aa, Mycobacterium
SFYRPEMRAGYLFRGAAWLIGPQP

SEQ ID NO: 1132661 - protein, 24 aa, Mycobacterium
SGEAELAYLLAGWRDEIRQPPMAG

SEQ ID NO: 1132662 - protein, 18 aa, Mycobacterium
SGFPFFLPGGFEFQVTLI

SEQ ID NO: 1132663 - protein, 24 aa, Mycobacterium
SGGRLRFGVGVGWNAVEYEALGEQ

SEQ ID NO: 1132664 - protein, 17 aa, Mycobacterium
SGIPPWLSDSLCRAATG

SEQ ID NO: 1132665 - protein, 21 aa, Mycobacterium
SGYRVPPALVRRADGQTVQLT

SEQ ID NO: 1132666 - protein, 23 aa, Mycobacterium
SIAALLGRWFWWPQQIRTRPAPS

SEQ ID NO: 1132667 - protein, 18 aa, Mycobacterium
SKFWSRWTGWVMRRPWVS

SEQ ID NO: 1132668 - protein, 24 aa, Mycobacterium
SKWHWSNDVLNAWAMSVVFYGALI

SEQ ID NO: 1132669 - protein, 24 aa, Mycobacterium
SKWHWSNDVLNAWAMSVVLYGALI

SEQ ID NO: 1132670 - protein, 17 aa, Mycobacterium
SLIGCVRIRASITVSPD

SEQ ID NO: 1132671 - protein, 23 aa, Mycobacterium
SLLSRYFMWRVVMVSVLMAGGAL

SEQ ID NO: 1132672 - protein, 18 aa, Mycobacterium
SLLVSWLLFTWIIARLPR

SEQ ID NO: 1132673 - protein, 18 aa, Mycobacterium
SLSARGRLALGILLMTSG

SEQ ID NO: 1132674 - protein, 24 aa, Mycobacterium
SLTVLRWSWTPALLAGGLMTLMPL

SEQ ID NO: 1132675 - protein, 17 aa, Mycobacterium
SLTWPEAMGLVVINGLI

SEQ ID NO: 1132676 - protein, 17 aa, Mycobacterium
SLVPTLLVAIPFTVLVA

SEQ ID NO: 1132677 - protein, 24 aa, Mycobacterium
SLYLGALLRLPGWLLDLSPVAQTS

SEQ ID NO: 1132678 - protein, 21 aa, Mycobacterium
SMTGPRPGGFGALNDRTYEIC

SEQ ID NO: 1132679 - protein, 23 aa, Mycobacterium
SMVIGAAIGVVWFWIPLGLLVLG

SEQ ID NO: 1132680 - protein, 21 aa, Mycobacterium
SNELIAWVCIVASVIGVVLLI

SEQ ID NO: 1132681 - protein, 21 aa, Mycobacterium
SNSFPEWKFGFTTMLLGLSVV

SEQ ID NO: 1132682 - protein, 21 aa, Mycobacterium
SNWPVRVKVLAIVVVPLLLAC

SEQ ID NO: 1132683 - protein, 17 aa, Mycobacterium
SPEHKLRLVRALQATGE

SEQ ID NO: 1132684 - protein, 18 aa, Mycobacterium
SPFWQTWDLLLLWLAQLH

SEQ ID NO: 1132685 - protein, 20 aa, Mycobacterium
SPLLARFVVWASRRLSRHPA

SEQ ID NO: 1132686 - protein, 25 aa, Mycobacterium
SPQSRASWQWLEWMPHTGSIHSPLS

SEQ ID NO: 1132687 - protein, 18 aa, Mycobacterium
SQAGTWSWHLTRDFVAEM

SEQ ID NO: 1132688 - protein, 17 aa, Mycobacterium
SQRRLSWEIAWKPVLVL

SEQ ID NO: 1132689 - protein, 21 aa, Mycobacterium
SRATLIIGVIVVVLAVVGAVL

SEQ ID NO: 1132690 - protein, 22 aa, Mycobacterium
SRFANEVFPDFLLVMQRSDATT

SEQ ID NO: 1132691 - protein, 19 aa, Mycobacterium
SRIGMVLQDTWLFAGTVYE

SEQ ID NO: 1132692 - protein, 20 aa, Mycobacterium
SRKFFDEVWMHDRDVGNMRV

SEQ ID NO: 1132693 - protein, 17 aa, Mycobacterium
SRMATEFARYLDKKHDL

SEQ ID NO: 1132694 - protein, 17 aa, Mycobacterium
SRPAGDETFIWLTLALA

SEQ ID NO: 1132695 - protein, 21 aa, Mycobacterium
SRRPGGAPVRYRGTGVLVSRA

SEQ ID NO: 1132696 - protein, 20 aa, Mycobacterium
SRVCRELIRFGLPVTAVTLL

SEQ ID NO: 1132697 - protein, 22 aa, Mycobacterium
SRWFAWPGYLWFGMAAYLLLTL

SEQ ID NO: 1132698 - protein, 22 aa, Mycobacterium
SRWRHLPAVLLILSLMSFTVAM

SEQ ID NO: 1132699 - protein, 21 aa, Mycobacterium
SSARFWKTFAHHYLRMIYDIL

SEQ ID NO: 1132700 - protein, 20 aa, Mycobacterium
SSGWLPWALGGLFVAGLAGL

SEQ ID NO: 1132701 - protein, 24 aa, Mycobacterium
SSQFGVSIPDFWMGILLIALFSTV

SEQ ID NO: 1132702 - protein, 19 aa, Mycobacterium
SSRGWRAAAPLSRDDAWII

SEQ ID NO: 1132703 - protein, 27 aa, Mycobacterium
SSRGWRRIGVSVVRWPGPVLAATLALA

SEQ ID NO: 1132704 - protein, 20 aa, Mycobacterium
SSVLCWLRLFARRTPRPVAR

SEQ ID NO: 1132705 - protein, 22 aa, Mycobacterium
SSVVEWKLRPGVVSTMNAQARY

SEQ ID NO: 1132706 - protein, 21 aa, Mycobacterium
STDILKRWKRGVMSTVGDVTA

SEQ ID NO: 1132707 - protein, 17 aa, Mycobacterium
STFPILMEGLRLTLILT

SEQ ID NO: 1132708 - protein, 17 aa, Mycobacterium
STIKTNLFWAFAYNVAA

SEQ ID NO: 1132709 - protein, 19 aa, Mycobacterium
STTFARPGHRAHHATDDAI

SEQ ID NO: 1132710 - protein, 18 aa, Mycobacterium
SVAELPPIRAAQRAAVWS

SEQ ID NO: 1132711 - protein, 24 aa, Mycobacterium
SVGEQFWLVWPLLFLLVGLLKARK

SEQ ID NO: 1132712 - protein, 18 aa, Mycobacterium
SVGRWRFVLVVAGMWIVA

SEQ ID NO: 1132713 - protein, 18 aa, Mycobacterium
SVLRPEWWEAVQTAGGTR

SEQ ID NO: 1132714 - protein, 24 aa, Mycobacterium
SVPWNIASVIPWLGSPFKTGQQIS

SEQ ID NO: 1132715 - protein, 17 aa, Mycobacterium
SVQIDWSVALAVTGAAV

SEQ ID NO: 1132716 - protein, 25 aa, Mycobacterium
SVQSWRPGASWGNWLMRRCTRLYRP

SEQ ID NO: 1132717 - protein, 18 aa, Mycobacterium
SVSWLPLFHDMGLLMIMF

SEQ ID NO: 1132718 - protein, 23 aa, Mycobacterium
SVVALCMPVSFAAGLNVLIGALL

SEQ ID NO: 1132719 - protein, 23 aa, Mycobacterium
SWPDSRLSYLFVFLALALAPVAT

SEQ ID NO: 1132720 - protein, 19 aa, Mycobacterium
SWYFWPVWPILGAGVGVLA

SEQ ID NO: 1132721 - protein, 17 aa, Mycobacterium
SYAPALWRYWAQHLDPD

SEQ ID NO: 1132722 - protein, 18 aa, Mycobacterium
SYFPGIFQSFSWGIGSLV

SEQ ID NO: 1132723 - protein, 27 aa, Mycobacterium
SYGAFFPYYICGITFRASDLEGRTVVF

SEQ ID NO: 1132724 - protein, 18 aa, Mycobacterium
SYGWRIPFLIAAPLGLVG

SEQ ID NO: 1132725 - protein, 19 aa, Mycobacterium
TAAALLVRWEPLAVGSGIP

SEQ ID NO: 1132726 - protein, 19 aa, Mycobacterium
TALIDIMAWIVVFVAGVAL

SEQ ID NO: 1132727 - protein, 19 aa, Mycobacterium
TALWLIKFVLDFQWMSLFT

SEQ ID NO: 1132728 - protein, 20 aa, Mycobacterium
TALWLIKFVLDFQWMSLFTV

SEQ ID NO: 1132729 - protein, 23 aa, Mycobacterium
TARFWRRSGIRIVRRPVPHLVAS

SEQ ID NO: 1132730 - protein, 17 aa, Mycobacterium
TASAAKFPGGWYTVAVL

SEQ ID NO: 1132731 - protein, 19 aa, Mycobacterium
TASSIRWVLVDGATGEESV

SEQ ID NO: 1132732 - protein, 22 aa, Mycobacterium
TCRRSAYCPVRRLIPRMQPVAA

SEQ ID NO: 1132733 - protein, 23 aa, Mycobacterium
TDGLIRLWPAWEFYPFGHTIPQG

SEQ ID NO: 1132734 - protein, 23 aa, Mycobacterium
TDPLFCVAMGFLAAVSAAASISG

SEQ ID NO: 1132735 - protein, 23 aa, Mycobacterium
TEAGWRLPAFAAFMVTATETLSG

SEQ ID NO: 1132736 - protein, 18 aa, Mycobacterium
TELLRLIAQMGLGSGALV

SEQ ID NO: 1132737 - protein, 22 aa, Mycobacterium
TERPRWMWPALLALLGATAVLY

SEQ ID NO: 1132738 - protein, 17 aa, Mycobacterium
TESGWKLGFYAASRASQ

SEQ ID NO: 1132739 - protein, 17 aa, Mycobacterium
TEVLGGLVVALALIPEA

SEQ ID NO: 1132740 - protein, 17 aa, Mycobacterium
TFAFPIIVVMILLIIPL

SEQ ID NO: 1132741 - protein, 19 aa, Mycobacterium
TFDTLRIIAPYALAMALVG

SEQ ID NO: 1132742 - protein, 18 aa, Mycobacterium
TFTLVWLISEHRWSPESA

SEQ ID NO: 1132743 - protein, 19 aa, Mycobacterium
TGDRFGRRRVFQIGLAVFA

SEQ ID NO: 1132744 - protein, 18 aa, Mycobacterium
TGFAPFFMPLALFIGALI

SEQ ID NO: 1132745 - protein, 18 aa, Mycobacterium
TGFARIVLLAAILGAALS

SEQ ID NO: 1132746 - protein, 24 aa, Mycobacterium
TGGGFRPNPGIGHPWYVNYFPVTR

SEQ ID NO: 1132747 - protein, 22 aa, Mycobacterium
TGHIWQVFGALWLYSMAVAGAV

SEQ ID NO: 1132748 - protein, 22 aa, Mycobacterium
TGIEGWELFALRCAATVAVAAV

SEQ ID NO: 1132749 - protein, 23 aa, Mycobacterium
TGTPAWEMFKPWSVVSIAVAIVL

SEQ ID NO: 1132750 - protein, 20 aa, Mycobacterium
TGVVCFVGFLASYLFNVYFQ

SEQ ID NO: 1132751 - protein, 25 aa, Mycobacterium
TIARVFFEWRFDLIFGTAAVVMAGI

SEQ ID NO: 1132752 - protein, 19 aa, Mycobacterium
TIIRMFLVPAIMKMLGDDC

SEQ ID NO: 1132753 - protein, 22 aa, Mycobacterium
TIKGNLFWAFAYNVAALPLAAL

SEQ ID NO: 1132754 - protein, 17 aa, Mycobacterium
TIRRTGLSFVRYAEPID

SEQ ID NO: 1132755 - protein, 17 aa, Mycobacterium
TKLRPGDAIPLDRTAPA

SEQ ID NO: 1132756 - protein, 18 aa, Mycobacterium
TLCPLLVLGIWWRGLTAT

SEQ ID NO: 1132757 - protein, 18 aa, Mycobacterium
TLFICSATGFLILSTGAY

SEQ ID NO: 1132758 - protein, 17 aa, Mycobacterium
TLIRMLLVPAFMHLMGR

SEQ ID NO: 1132759 - protein, 24 aa, Mycobacterium
TLPFLWNIFRSWRYGEPVVVDDPW

SEQ ID NO: 1132760 - protein, 28 aa, Mycobacterium
TLPLYLPKVGLRFAVTVGLLLLATGLFL

SEQ ID NO: 1132761 - protein, 24 aa, Mycobacterium
TLWRSVRALPEFRRLLELRAVSQF

SEQ ID NO: 1132762 - protein, 29 aa, Mycobacterium
TNLVGWPTWAMIFASPFLLAALIPLGIAG

SEQ ID NO: 1132763 - protein, 17 aa, Mycobacterium
TNVRRFVDDVAFVVGKE

SEQ ID NO: 1132764 - protein, 19 aa, Mycobacterium
TNWIEIFLLLVIAFSLPRT

SEQ ID NO: 1132765 - protein, 25 aa, Mycobacterium
TPDRTALRLSEAWTHSRGEGQTVAV

SEQ ID NO: 1132766 - protein, 18 aa, Mycobacterium
TPEQRRWAAVAMERGWAG

SEQ ID NO: 1132767 - protein, 23 aa, Mycobacterium
TPIRARWGRWVARLLSVVGLAGL

SEQ ID NO: 1132768 - protein, 22 aa, Mycobacterium
TPIRARWGRWVARVLSVVGLAG

SEQ ID NO: 1132769 - protein, 23 aa, Mycobacterium
TPIRARWGRWVARVLSVVGLAGL

SEQ ID NO: 1132770 - protein, 21 aa, Mycobacterium
TPLRRLDLLAAYGTAFALAAA

SEQ ID NO: 1132771 - protein, 19 aa, Mycobacterium
TPLVRLGHMLVFFVRALHG

SEQ ID NO: 1132772 - protein, 31 aa, Mycobacterium
TPVARWIRRLAIPIILGWVLLVAALNLLVPQ

SEQ ID NO: 1132773 - protein, 17 aa, Mycobacterium
TQPEFKKAANLFVSKDG

SEQ ID NO: 1132774 - protein, 20 aa, Mycobacterium
TQSWGRRVGLGIGFTAGGVG

SEQ ID NO: 1132775 - protein, 17 aa, Mycobacterium
TRAEWAWAVLLTLALAV

SEQ ID NO: 1132776 - protein, 23 aa, Mycobacterium
TRDGRRLVAVLLRGTRQPIAPWE

SEQ ID NO: 1132777 - protein, 20 aa, Mycobacterium
TRLLLFLAVAVVFGAVVFAA

SEQ ID NO: 1132778 - protein, 20 aa, Mycobacterium
TRLQERFVWNSVDVLLEVFV

SEQ ID NO: 1132779 - protein, 17 aa, Mycobacterium
TRLSSWRLLAGNPVTLV

SEQ ID NO: 1132780 - protein, 17 aa, Mycobacterium
TRPRLWVALLFLMLIAV

SEQ ID NO: 1132781 - protein, 18 aa, Mycobacterium
TRRSQRLFVAQWRNTGRL

SEQ ID NO: 1132782 - protein, 19 aa, Mycobacterium
TRTGLYWVPGSRGYDDAVA

SEQ ID NO: 1132783 - protein, 21 aa, Mycobacterium
TRTPLSFLCYWVVPFSLLGVA

SEQ ID NO: 1132784 - protein, 18 aa, Mycobacterium
TRWFPTHFVTLWMVGTPS

SEQ ID NO: 1132785 - protein, 18 aa, Mycobacterium
TSISMVFGELVPKNLAVA

SEQ ID NO: 1132786 - protein, 19 aa, Mycobacterium
TSIVMCIALLFGVAFLFFG

SEQ ID NO: 1132787 - protein, 17 aa, Mycobacterium
TSVGSWFPLAFFAAHVV

SEQ ID NO: 1132788 - protein, 18 aa, Mycobacterium
TTVMARLRLFGFGVPAFI

SEQ ID NO: 1132789 - protein, 18 aa, Mycobacterium
TVALAFLAMVFARLSVFA

SEQ ID NO: 1132790 - protein, 18 aa, Mycobacterium
TVELPGLGWYRMESRAGD

SEQ ID NO: 1132791 - protein, 17 aa, Mycobacterium
TVIVWRFVGDALSGRSD

SEQ ID NO: 1132792 - protein, 17 aa, Mycobacterium
TVLCLLLAFPLAYVIAF

SEQ ID NO: 1132793 - protein, 23 aa, Mycobacterium
TVLRPGYLPVPFVIAALPLIALL

SEQ ID NO: 1132794 - protein, 24 aa, Mycobacterium
TVMEIVGWRALWGLGNALFIATAL

SEQ ID NO: 1132795 - protein, 17 aa, Mycobacterium
TVSDARSGFHIHGAAGL

SEQ ID NO: 1132796 - protein, 21 aa, Mycobacterium
TVSTLHEWRPFTIAGLGIGVF

SEQ ID NO: 1132797 - protein, 25 aa, Mycobacterium
TVVRGARNYPCMEFPGKRAPTVALC

SEQ ID NO: 1132798 - protein, 20 aa, Mycobacterium
TVWLRPGTRLGFFTHMGTQF

SEQ ID NO: 1132799 - protein, 24 aa, Mycobacterium
TWEVPEGPTAIPYRVKQLPPPVHV

SEQ ID NO: 1132800 - protein, 19 aa, Mycobacterium
TWWRIPILILVSFANAWAE

SEQ ID NO: 1132801 - protein, 19 aa, Mycobacterium
TWWRIPLLLLLSFGNGWAE

SEQ ID NO: 1132802 - protein, 18 aa, Mycobacterium
VAAAVARRPARVAIVSIG

SEQ ID NO: 1132803 - protein, 18 aa, Mycobacterium
VAAGGLLIALGFLFAGYE

SEQ ID NO: 1132804 - protein, 23 aa, Mycobacterium
VAALCCLVVFAAFMAYFGIYSRH

SEQ ID NO: 1132805 - protein, 24 aa, Mycobacterium
VAALLGRWFWWPQKVRSHASQRRL

SEQ ID NO: 1132806 - protein, 19 aa, Mycobacterium
VAAPGWRIMGLSNTNGAAV

SEQ ID NO: 1132807 - protein, 21 aa, Mycobacterium
VADFWRFWVVHLWVEDFLELF

SEQ ID NO: 1132808 - protein, 20 aa, Mycobacterium
VAGIAVGLGIRFPRRHVWAP

SEQ ID NO: 1132809 - protein, 20 aa, Mycobacterium
VAGICAWLMVRAHRRGGEEV

SEQ ID NO: 1132810 - protein, 17 aa, Mycobacterium
VAGLFAFLGLATVIAAA

SEQ ID NO: 1132811 - protein, 17 aa, Mycobacterium
VAHAFWVPEFLFKRDVY

SEQ ID NO: 1132812 - protein, 20 aa, Mycobacterium
VAHCVRRFGGITGDVLGAAL

SEQ ID NO: 1132813 - protein, 22 aa, Mycobacterium
VAIALTVMFAREVGAGDLFECL

SEQ ID NO: 1132814 - protein, 19 aa, Mycobacterium
VAIEVIWWVQGRVLGEHRR

SEQ ID NO: 1132815 - protein, 17 aa, Mycobacterium
VAIPFTVLVAFTLNILL

SEQ ID NO: 1132816 - protein, 21 aa, Mycobacterium
VALGGIGAWIACRRRGIPLPA

SEQ ID NO: 1132817 - protein, 23 aa, Mycobacterium
VALPALGLWHLWSGAPQDPTARQ

SEQ ID NO: 1132818 - protein, 17 aa, Mycobacterium
VALVIGVAGGWVGRTTA

SEQ ID NO: 1132819 - protein, 18 aa, Mycobacterium
VANALRLLGMPMQSINPA

SEQ ID NO: 1132820 - protein, 18 aa, Mycobacterium
VANALRLLGMPMQSVTPA

SEQ ID NO: 1132821 - protein, 25 aa, Mycobacterium
VAPMLGVLCSVGWQPRPPGVSVSTS

SEQ ID NO: 1132822 - protein, 18 aa, Mycobacterium
VAPRHGIKVGFRGLADSN

SEQ ID NO: 1132823 - protein, 17 aa, Mycobacterium
VAQLGVACAVAIAVDAT

SEQ ID NO: 1132824 - protein, 25 aa, Mycobacterium
VARLRPRFASLVGLSEVMFAVLAAW

SEQ ID NO: 1132825 - protein, 24 aa, Mycobacterium
VATLAIGAYLVWPNRAGHKVTAYF

SEQ ID NO: 1132826 - protein, 18 aa, Mycobacterium
VAVARWRGLRALVGIVIA

SEQ ID NO: 1132827 - protein, 20 aa, Mycobacterium
VAVICTLVILGGGDSGSVSA

SEQ ID NO: 1132828 - protein, 17 aa, Mycobacterium
VAVMLFAYMQVPTLLGV

SEQ ID NO: 1132829 - protein, 17 aa, Mycobacterium
VAVPAATVWDVFTDVER

SEQ ID NO: 1132830 - protein, 23 aa, Mycobacterium
VAVTVSVWWRPAAVVAVVLTVSA

SEQ ID NO: 1132831 - protein, 17 aa, Mycobacterium
VAWRAVSTAVRWVLASY

SEQ ID NO: 1132832 - protein, 25 aa, Mycobacterium
VCAGILGALGYRWYSGLGVETARRT

SEQ ID NO: 1132833 - protein, 20 aa, Mycobacterium
VCALGAFALIAVFAQLRFER

SEQ ID NO: 1132834 - protein, 19 aa, Mycobacterium
VCAPEHRWLTSVPDELVNV

SEQ ID NO: 1132835 - protein, 18 aa, Mycobacterium
VCGLTLFGLYAVFGQWRF

SEQ ID NO: 1132836 - protein, 19 aa, Mycobacterium
VCIVLGVGAAWLVERSDIP

SEQ ID NO: 1132837 - protein, 17 aa, Mycobacterium
VCLIGLSGGYVFSVFLQ

SEQ ID NO: 1132838 - protein, 17 aa, Mycobacterium
VCSSVLCWLRLFARRTP

SEQ ID NO: 1132839 - protein, 19 aa, Mycobacterium
VCTRLPIRAILMVVAATVA

SEQ ID NO: 1132840 - protein, 24 aa, Mycobacterium
VDGPLRLGHWVMFAAVSLPSVGAM

SEQ ID NO: 1132841 - protein, 20 aa, Mycobacterium
VDLRHPAVVRALRLDGVVPQ

SEQ ID NO: 1132842 - protein, 19 aa, Mycobacterium
VEGRVAVAVPAQWTDERVT

SEQ ID NO: 1132843 - protein, 25 aa, Mycobacterium
VELLKLAVILALWAAVVAAFVSVIY

SEQ ID NO: 1132844 - protein, 22 aa, Mycobacterium
VEQEFRFAVGLAVSTAAPTASA

SEQ ID NO: 1132845 - protein, 17 aa, Mycobacterium
VESYGLFVFRDAIAAAG

SEQ ID NO: 1132846 - protein, 18 aa, Mycobacterium
VEVLPWLLGQAVVGICLL

SEQ ID NO: 1132847 - protein, 19 aa, Mycobacterium
VFCGLLWWAAFGLHSTGLV

SEQ ID NO: 1132848 - protein, 18 aa, Mycobacterium
VFQWGLGHEIAWPVPLLA

SEQ ID NO: 1132849 - protein, 25 aa, Mycobacterium
VFQWGLGHEIAWPVPLLAFIILVAV

SEQ ID NO: 1132850 - protein, 17 aa, Mycobacterium
VFVGWLWPLWDRRRRTF

SEQ ID NO: 1132851 - protein, 18 aa, Mycobacterium
VGAPPWLYWTLYLACYVT

SEQ ID NO: 1132852 - protein, 19 aa, Mycobacterium
VGATAWLYFFQFRPDQETD

SEQ ID NO: 1132853 - protein, 17 aa, Mycobacterium
VGAVGMAVLAIALIASV

SEQ ID NO: 1132854 - protein, 22 aa, Mycobacterium
VGGVDSRLWIAIAVLAGLLVAS

SEQ ID NO: 1132855 - protein, 17 aa, Mycobacterium
VGIYRLWRDSGYAAGAV

SEQ ID NO: 1132856 - protein, 17 aa, Mycobacterium
VGLGIGFTAGGVGAAGV

SEQ ID NO: 1132857 - protein, 20 aa, Mycobacterium
VGLGIRFPRRHVWAPAAAVA

SEQ ID NO: 1132858 - protein, 20 aa, Mycobacterium
VGLLLCWTVAGGVLLGIAAI

SEQ ID NO: 1132859 - protein, 25 aa, Mycobacterium
VGSVAAAVLCLGGFGSVVYGAGPGD

SEQ ID NO: 1132860 - protein, 19 aa, Mycobacterium
VGTYRLWRDGGFAVGALVA

SEQ ID NO: 1132861 - protein, 17 aa, Mycobacterium
VGVNLFWVIFDLLILSV

SEQ ID NO: 1132862 - protein, 22 aa, Mycobacterium
VGVTEAVLWFIRRWLVARATMG

SEQ ID NO: 1132863 - protein, 25 aa, Mycobacterium
VGWLSIWPFLNWWTTHFVITDRRVM

SEQ ID NO: 1132864 - protein, 23 aa, Mycobacterium
VIALALAALVLWQRRRRRKRREA

SEQ ID NO: 1132865 - protein, 18 aa, Mycobacterium
VIALSVATLGFWIGSGFP

SEQ ID NO: 1132866 - protein, 18 aa, Mycobacterium
VIRLEIGELIPADVRLIE

SEQ ID NO: 1132867 - protein, 24 aa, Mycobacterium
VIRMFLVPALMKWLGDECWWAPQW

SEQ ID NO: 1132868 - protein, 22 aa, Mycobacterium
VISRPRVVTWMRRTFAATYVAL

SEQ ID NO: 1132869 - protein, 18 aa, Mycobacterium
VITGLWLWLRYDALLLVV

SEQ ID NO: 1132870 - protein, 17 aa, Mycobacterium
VKGEVKGLVTQGKEGQT

SEQ ID NO: 1132871 - protein, 18 aa, Mycobacterium
VKGLGLAAGAKRPGAKKT

SEQ ID NO: 1132872 - protein, 29 aa, Mycobacterium
VKLGLMCLAAFPILVLLVMWFRRESSKTY

SEQ ID NO: 1132873 - protein, 19 aa, Mycobacterium
VKPWWPKLSIIGSVIAVGL

SEQ ID NO: 1132874 - protein, 22 aa, Mycobacterium
VLAGLLRRWAWLVLIVGFAVIV

SEQ ID NO: 1132875 - protein, 26 aa, Mycobacterium
VLAHWRPVVAFAFFEIIAAWLLLSDA

SEQ ID NO: 1132876 - protein, 17 aa, Mycobacterium
VLALSVATLAAWLLTGH

SEQ ID NO: 1132877 - protein, 17 aa, Mycobacterium
VLALSVATLAVWLLTGH

SEQ ID NO: 1132878 - protein, 21 aa, Mycobacterium
VLCAFGIDWAPLIWLPAAAAF

SEQ ID NO: 1132879 - protein, 21 aa, Mycobacterium
VLCRRRWRPGLLLAGLAVLAA

SEQ ID NO: 1132880 - protein, 19 aa, Mycobacterium
VLDVAGPFPKEAVQSALDD

SEQ ID NO: 1132881 - protein, 23 aa, Mycobacterium
VLFGLPLLMGWLLIRRRQGRPAF

SEQ ID NO: 1132882 - protein, 17 aa, Mycobacterium
VLFPIVWIALASLKTPE

SEQ ID NO: 1132883 - protein, 19 aa, Mycobacterium
VLFPMYFLKSFAYAGVATV

SEQ ID NO: 1132884 - protein, 22 aa, Mycobacterium
VLGDLPWWVTVVILVRELGVTL

SEQ ID NO: 1132885 - protein, 18 aa, Mycobacterium
VLGDTIWVAGGMSHGESL

SEQ ID NO: 1132886 - protein, 18 aa, Mycobacterium
VLGVLPLIVLTQVGIIVG

SEQ ID NO: 1132887 - protein, 19 aa, Mycobacterium
VLGVPGWVTQRLWWALLLV

SEQ ID NO: 1132888 - protein, 19 aa, Mycobacterium
VLLFCIAFGLSMDYEVFLL

SEQ ID NO: 1132889 - protein, 20 aa, Mycobacterium
VLLFCIAFGLSMDYEVFLVS

SEQ ID NO: 1132890 - protein, 22 aa, Mycobacterium
VLLFCIAFGLSMDYEVFLVSRI

SEQ ID NO: 1132891 - protein, 24 aa, Mycobacterium
VLLKRFAPQQIMVWALVAASLSGA

SEQ ID NO: 1132892 - protein, 20 aa, Mycobacterium
VLLRIDWPNFLPLITSESSR

SEQ ID NO: 1132893 - protein, 18 aa, Mycobacterium
VLLTHQWQLVFVAAALLG

SEQ ID NO: 1132894 - protein, 19 aa, Mycobacterium
VLQACVFWRGMESIRKFID

SEQ ID NO: 1132895 - protein, 21 aa, Mycobacterium
VLSSFKVPTVWLLLDSQDGVP

SEQ ID NO: 1132896 - protein, 19 aa, Mycobacterium
VLVAWDLIGHLPLPLGVAG

SEQ ID NO: 1132897 - protein, 18 aa, Mycobacterium
VLVEFRFVYVRTRELRRS

SEQ ID NO: 1132898 - protein, 19 aa, Mycobacterium
VLVLGFWKPGFFVTTKLDV

SEQ ID NO: 1132899 - protein, 17 aa, Mycobacterium
VLYIPEYLVFRVVRSYF

SEQ ID NO: 1132900 - protein, 18 aa, Mycobacterium
VLYLPEYLVFRIVRSYFT

SEQ ID NO: 1132901 - protein, 18 aa, Mycobacterium
VMCWIDLPAAVTMAAVVG

SEQ ID NO: 1132902 - protein, 18 aa, Mycobacterium
VNDEARRLLSLPAGEVAR

SEQ ID NO: 1132903 - protein, 25 aa, Mycobacterium
VNEYPGDPWKWWAVLSSAVGVAVAI

SEQ ID NO: 1132904 - protein, 19 aa, Mycobacterium
VNIWFLVQFLERPFVPLIP

SEQ ID NO: 1132905 - protein, 17 aa, Mycobacterium
VNNEFFYWMSIALMMLI

SEQ ID NO: 1132906 - protein, 17 aa, Mycobacterium
VNWLLQWAAGGPNEPLW

SEQ ID NO: 1132907 - protein, 26 aa, Mycobacterium
VPALAAFAVVCWWVFFEKGLASAAHD

SEQ ID NO: 1132908 - protein, 17 aa, Mycobacterium
VPCAVGILAGVAVALTL

SEQ ID NO: 1132909 - protein, 17 aa, Mycobacterium
VPDLPSFELPELPFGGG

SEQ ID NO: 1132910 - protein, 23 aa, Mycobacterium
VPFGRLGDMFGRVRIYNVGFAVF

SEQ ID NO: 1132911 - protein, 20 aa, Mycobacterium
VPGIAHFFTMWGFFVLATVY

SEQ ID NO: 1132912 - protein, 17 aa, Mycobacterium
VPIVLGWIALTVLTNVA

SEQ ID NO: 1132913 - protein, 17 aa, Mycobacterium
VPIVVFWALLAVSTNTF

SEQ ID NO: 1132914 - protein, 19 aa, Mycobacterium
VPLRICSLRDLAKFAETQV

SEQ ID NO: 1132915 - protein, 20 aa, Mycobacterium
VPSLREWLRLVFIVLGGYAV

SEQ ID NO: 1132916 - protein, 19 aa, Mycobacterium
VPSLRGWLRLVFIVLGGYA

SEQ ID NO: 1132917 - protein, 18 aa, Mycobacterium
VPSRELVCGDILVLNEGD

SEQ ID NO: 1132918 - protein, 21 aa, Mycobacterium
VPTHWQEWMPAGLFFATIALF

SEQ ID NO: 1132919 - protein, 22 aa, Mycobacterium
VPWNIASAVPWLGDPFTTGQEI

SEQ ID NO: 1132920 - protein, 25 aa, Mycobacterium
VQALRVALPMARRGSISAQRQRIPG

SEQ ID NO: 1132921 - protein, 17 aa, Mycobacterium
VQRMPVAFFTRTRTGAL

SEQ ID NO: 1132922 - protein, 19 aa, Mycobacterium
VRCACGNPLAPPAALAAPV

SEQ ID NO: 1132923 - protein, 21 aa, Mycobacterium
VRGARNYPCIEHPGKRAPTVE

SEQ ID NO: 1132924 - protein, 18 aa, Mycobacterium
VRGPKLLWRTLSVVQPVG

SEQ ID NO: 1132925 - protein, 19 aa, Mycobacterium
VRGWRAPRSSAWSLPEVRW

SEQ ID NO: 1132926 - protein, 20 aa, Mycobacterium
VRLSVLFSFQGNDMMTSFQV

SEQ ID NO: 1132927 - protein, 23 aa, Mycobacterium
VRNRLWHRVPWLVVGLLGAMVSA

SEQ ID NO: 1132928 - protein, 17 aa, Mycobacterium
VRRLAVIVATTSVVTAG

SEQ ID NO: 1132929 - protein, 21 aa, Mycobacterium
VRTALRDGRLEPGWHRLSGIR

SEQ ID NO: 1132930 - protein, 22 aa, Mycobacterium
VRVLEIVPFFSLLGGVVSMSLT

SEQ ID NO: 1132931 - protein, 21 aa, Mycobacterium
VRWSRRARFAPPLAVMVPAHN

SEQ ID NO: 1132932 - protein, 19 aa, Mycobacterium
VSAIMWVWYKAFAFLIGLI

SEQ ID NO: 1132933 - protein, 23 aa, Mycobacterium
VSGSRFYFLTGFGALLQLGLFQL

SEQ ID NO: 1132934 - protein, 19 aa, Mycobacterium
VSIFPTVMLSIPFTVLSVF

SEQ ID NO: 1132935 - protein, 20 aa, Mycobacterium
VSLTIGAIVLWSSFIASILP

SEQ ID NO: 1132936 - protein, 17 aa, Mycobacterium
VSMAMVWLAVLLYVKIG

SEQ ID NO: 1132937 - protein, 17 aa, Mycobacterium
VSMLLAMQGQRGTDPND

SEQ ID NO: 1132938 - protein, 22 aa, Mycobacterium
VSPKPPVRWGLPLVSVIVAVVM

SEQ ID NO: 1132939 - protein, 21 aa, Mycobacterium
VSPLVRWIIRVPREFVNDYIF

SEQ ID NO: 1132940 - protein, 20 aa, Mycobacterium
VSSIGMWLIRRRLMRQTHGL

SEQ ID NO: 1132941 - protein, 19 aa, Mycobacterium
VSVLVSWSLFTWMIARLPR

SEQ ID NO: 1132942 - protein, 18 aa, Mycobacterium
VTAALVWWTSDARATISQ

SEQ ID NO: 1132943 - protein, 18 aa, Mycobacterium
VTFIPWPVIEGFTLGIAA

SEQ ID NO: 1132944 - protein, 18 aa, Mycobacterium
VTIAFSLAISWATYAADF

SEQ ID NO: 1132945 - protein, 24 aa, Mycobacterium
VTKPPRRRLSLAVIGSAAAAVLAI

SEQ ID NO: 1132946 - protein, 18 aa, Mycobacterium
VTPKFTRMIVAGLFGVVA

SEQ ID NO: 1132947 - protein, 17 aa, Mycobacterium
VTVELPESAGLLPNQNV

SEQ ID NO: 1132948 - protein, 19 aa, Mycobacterium
VTYRVIAFIKHREPSYQPL

SEQ ID NO: 1132949 - protein, 24 aa, Mycobacterium
VVAWAALVIYAWRTSRGPKFAPEP

SEQ ID NO: 1132950 - protein, 24 aa, Mycobacterium
VVDPILRLFGFGALAAAPLAAVEA

SEQ ID NO: 1132951 - protein, 24 aa, Mycobacterium
VVFGEFRFASGNSYHANFTEASRL

SEQ ID NO: 1132952 - protein, 19 aa, Mycobacterium
VVGVARFGYRRRAWLSTAA

SEQ ID NO: 1132953 - protein, 21 aa, Mycobacterium
VVGWRGAGWWRRAVSVATVPM

SEQ ID NO: 1132954 - protein, 22 aa, Mycobacterium
VVGWRGAGWWRRAVSVATVPMC

SEQ ID NO: 1132955 - protein, 23 aa, Mycobacterium
VVLAGLLGMCSFAPTGPGPGPAP

SEQ ID NO: 1132956 - protein, 22 aa, Mycobacterium
VVPAHWQEWMLAGVFFAGIALF

SEQ ID NO: 1132957 - protein, 20 aa, Mycobacterium
VVPWYRRTPVALAIGAAAVL

SEQ ID NO: 1132958 - protein, 18 aa, Mycobacterium
VVQAKLWLQDAIAGMPKF

SEQ ID NO: 1132959 - protein, 24 aa, Mycobacterium
VVTLAVGIYLVWPSRTGNKITAYF

SEQ ID NO: 1132960 - protein, 30 aa, Mycobacterium
VVVIKRGLLKWAWIPGVPLLWDLVITMTAS

SEQ ID NO: 1132961 - protein, 25 aa, Mycobacterium
VVVRLCLWYPERAWLLLAIYTALAL

SEQ ID NO: 1132962 - protein, 24 aa, Mycobacterium
VVVTFAIGVAVLWSVQYLAVTFGW

SEQ ID NO: 1132963 - protein, 22 aa, Mycobacterium
VVVVAFGLWLGVRALDAKSSLE

SEQ ID NO: 1132964 - protein, 19 aa, Mycobacterium
VVYRSWRWWVASGVVFYAV

SEQ ID NO: 1132965 - protein, 25 aa, Mycobacterium
VWAGAWAVVLAHLWIGDQADNRNVL

SEQ ID NO: 1132966 - protein, 25 aa, Mycobacterium
VWAGAWAVVLAHLWIGDQADTRNVL

SEQ ID NO: 1132967 - protein, 23 aa, Mycobacterium
VWELARPPLWLLLVFAVGAYAAY

SEQ ID NO: 1132968 - protein, 18 aa, Mycobacterium
VWLFGHWQSVFWVNVPLA

SEQ ID NO: 1132969 - protein, 18 aa, Mycobacterium
VWLFLFFFMWLRATLPRM

SEQ ID NO: 1132970 - protein, 18 aa, Mycobacterium
VYAYFKFVRYEEAPPEPH

SEQ ID NO: 1132971 - protein, 24 aa, Mycobacterium
VYYWVICLVLSFGQARFERRLERY

SEQ ID NO: 1132972 - protein, 18 aa, Mycobacterium
WAALRALLFFTVVLGLAY

SEQ ID NO: 1132973 - protein, 17 aa, Mycobacterium
WAAVLVMTIFVVVMPLT

SEQ ID NO: 1132974 - protein, 20 aa, Mycobacterium
WAAVMLVHWFGVARRQVDAA

SEQ ID NO: 1132975 - protein, 17 aa, Mycobacterium
WAHLLLWAMFTCIELLP

SEQ ID NO: 1132976 - protein, 17 aa, Mycobacterium
WALAAVVAIVAVAALTT

SEQ ID NO: 1132977 - protein, 19 aa, Mycobacterium
WAVALAMASTVLWFDELRK

SEQ ID NO: 1132978 - protein, 19 aa, Mycobacterium
WAVCIAMASTVLWVSEIRK

SEQ ID NO: 1132979 - protein, 17 aa, Mycobacterium
WAVFAVWLLLLVPSIYL

SEQ ID NO: 1132980 - protein, 19 aa, Mycobacterium
WDARVAWRRHEPRLAAYPP

SEQ ID NO: 1132981 - protein, 19 aa, Mycobacterium
WDGGLGIWGAVALGGIGAW

SEQ ID NO: 1132982 - protein, 18 aa, Mycobacterium
WDQRLCLILSGDFYDAIA

SEQ ID NO: 1132983 - protein, 18 aa, Mycobacterium
WEGGLGIWGAVALGGIGA

SEQ ID NO: 1132984 - protein, 19 aa, Mycobacterium
WEPHCYNIPVCATMRSVFD

SEQ ID NO: 1132985 - protein, 22 aa, Mycobacterium
WEPHCYNIPVCWALRSVFDTLD

SEQ ID NO: 1132986 - protein, 17 aa, Mycobacterium
WFIGCGVAFAIYYLVAK

SEQ ID NO: 1132987 - protein, 19 aa, Mycobacterium
WFLRFLVRHSMYWFVGYRI

SEQ ID NO: 1132988 - protein, 18 aa, Mycobacterium
WGAMLGWIDVADKWSEWM

SEQ ID NO: 1132989 - protein, 23 aa, Mycobacterium
WGDRAERRWPFGVAAAFLALGMA

SEQ ID NO: 1132990 - protein, 22 aa, Mycobacterium
WGESALRWLLFAGLAAAVGGLI

SEQ ID NO: 1132991 - protein, 17 aa, Mycobacterium
WGIRAHMGFLFGLVNQL

SEQ ID NO: 1132992 - protein, 22 aa, Mycobacterium
WGLGHEIAWPVPLLAFIILVAV

SEQ ID NO: 1132993 - protein, 24 aa, Mycobacterium
WGNCTVKVMVGFLFLYPAFVAKAH

SEQ ID NO: 1132994 - protein, 17 aa, Mycobacterium
WGVALVLVASAALVAAG

SEQ ID NO: 1132995 - protein, 20 aa, Mycobacterium
WGVPEPRWAASWLGLQRAAH

SEQ ID NO: 1132996 - protein, 22 aa, Mycobacterium
WHHNRFPLSMLLMLVLLGALIV

SEQ ID NO: 1132997 - protein, 19 aa, Mycobacterium
WHWSLPLGVAILFAAVAGG

SEQ ID NO: 1132998 - protein, 17 aa, Mycobacterium
WIGGIAFSVLATLVAGA

SEQ ID NO: 1132999 - protein, 17 aa, Mycobacterium
WIRRARRLLPALLAMVA

SEQ ID NO: 1133000 - protein, 18 aa, Mycobacterium
WKFELARFGAWFVVFQVS

SEQ ID NO: 1133001 - protein, 19 aa, Mycobacterium
WKILIPVSLGWIMIVAITH

SEQ ID NO: 1133002 - protein, 19 aa, Mycobacterium
WKSVWDHGWSAAAAADEAP

SEQ ID NO: 1133003 - protein, 17 aa, Mycobacterium
WLARLEWELVLAVVTAG

SEQ ID NO: 1133004 - protein, 19 aa, Mycobacterium
WLCACAAVLCVLAVRGAGS

SEQ ID NO: 1133005 - protein, 17 aa, Mycobacterium
WLGARPVRRFGVRFREQ

SEQ ID NO: 1133006 - protein, 24 aa, Mycobacterium
WLGGWRWAKDKLFGMPDKVNTFYT

SEQ ID NO: 1133007 - protein, 17 aa, Mycobacterium
WLGVAVILAVVFPQLET

SEQ ID NO: 1133008 - protein, 17 aa, Mycobacterium
WLGVPLYILLGWVAVWF

SEQ ID NO: 1133009 - protein, 22 aa, Mycobacterium
WLPARWRHWWWALLLAFVPIHL

SEQ ID NO: 1133010 - protein, 17 aa, Mycobacterium
WLRRCWLAAAIVAPAVL

SEQ ID NO: 1133011 - protein, 20 aa, Mycobacterium
WLTAICAVLLLLGAGAGVGG

SEQ ID NO: 1133012 - protein, 17 aa, Mycobacterium
WLWLRYDALLLVVATQI

SEQ ID NO: 1133013 - protein, 18 aa, Mycobacterium
WMAVFGFVSLLAFIATAV

SEQ ID NO: 1133014 - protein, 21 aa, Mycobacterium
WMLGAATGWLAAAVVYEAGRL

SEQ ID NO: 1133015 - protein, 17 aa, Mycobacterium
WNFPIVLVILLAVFGSL

SEQ ID NO: 1133016 - protein, 21 aa, Mycobacterium
WNIAFIRRFMLTFGPVSSLFD

SEQ ID NO: 1133017 - protein, 17 aa, Mycobacterium
WNIKRLAAVRPAEEPIK

SEQ ID NO: 1133018 - protein, 19 aa, Mycobacterium
WNRRCRPWVLAAGVVLHLS

SEQ ID NO: 1133019 - protein, 19 aa, Mycobacterium
WNVFKSWRYGEVVTVDDPW

SEQ ID NO: 1133020 - protein, 17 aa, Mycobacterium
WPARVAVLAAALSLLLG

SEQ ID NO: 1133021 - protein, 19 aa, Mycobacterium
WPSSPRWLGVPLYILLGWV

SEQ ID NO: 1133022 - protein, 18 aa, Mycobacterium
WPTLACLLLYGAAFMLLA

SEQ ID NO: 1133023 - protein, 20 aa, Mycobacterium
WPVLVGRWLFHGALGAVVAV

SEQ ID NO: 1133024 - protein, 20 aa, Mycobacterium
WPVLVTVGGAALVMHQLGQR

SEQ ID NO: 1133025 - protein, 20 aa, Mycobacterium
WPVVVGGSLSFAVASAGVLA

SEQ ID NO: 1133026 - protein, 17 aa, Mycobacterium
WPYRLTTMLQMVGVIVL

SEQ ID NO: 1133027 - protein, 22 aa, Mycobacterium
WQEFLRQSWFVARVSLLPTLLL

SEQ ID NO: 1133028 - protein, 18 aa, Mycobacterium
WQPITRDLWPAPFLVLDT

SEQ ID NO: 1133029 - protein, 21 aa, Mycobacterium
WQPWLRWVVLIGSIVAAAVIA

SEQ ID NO: 1133030 - protein, 17 aa, Mycobacterium
WRIPFLIAAPLGLVGLY

SEQ ID NO: 1133031 - protein, 17 aa, Mycobacterium
WRIPFLIAGPLGLVGLY

SEQ ID NO: 1133032 - protein, 18 aa, Mycobacterium
WRKRWRLAAVTALCPPVA

SEQ ID NO: 1133033 - protein, 19 aa, Mycobacterium
WRLLYVAALVSWVSGQILW

SEQ ID NO: 1133034 - protein, 18 aa, Mycobacterium
WRNRELWLPAARTHRSTA

SEQ ID NO: 1133035 - protein, 20 aa, Mycobacterium
WRNRMPPQRLALVMGSVAAV

SEQ ID NO: 1133036 - protein, 17 aa, Mycobacterium
WRPAAVVAVVLTVSAVV

SEQ ID NO: 1133037 - protein, 20 aa, Mycobacterium
WRPTLLLTRSFITDYVRNPV

SEQ ID NO: 1133038 - protein, 18 aa, Mycobacterium
WRPVLLVPLTFALFTPLA

SEQ ID NO: 1133039 - protein, 26 aa, Mycobacterium
WRRLRPRLWALIGFTVLKTLALIVWF

SEQ ID NO: 1133040 - protein, 20 aa, Mycobacterium
WRSGALGSLMSFIGVVLGAV

SEQ ID NO: 1133041 - protein, 20 aa, Mycobacterium
WRSVFWINLPICAAAILLTA

SEQ ID NO: 1133042 - protein, 31 aa, Mycobacterium
WRTRRWRLVWIPWAVVVGGAFAVAAYEFVAS

SEQ ID NO: 1133043 - protein, 20 aa, Mycobacterium
WRVAHIRPSLGFDSRVCREL

SEQ ID NO: 1133044 - protein, 20 aa, Mycobacterium
WRWALELDRISATLAAEPLP

SEQ ID NO: 1133045 - protein, 20 aa, Mycobacterium
WSAACATAYLQGFGRRPAWV

SEQ ID NO: 1133046 - protein, 20 aa, Mycobacterium
WSAPLQLMFSFLFTPLIRLT

SEQ ID NO: 1133047 - protein, 17 aa, Mycobacterium
WSGVLGFLIGSVTVTLL

SEQ ID NO: 1133048 - protein, 18 aa, Mycobacterium
WSLLVGYGCLPWVAAAVL

SEQ ID NO: 1133049 - protein, 28 aa, Mycobacterium
WSLLVGYGCLPWVALCFAPKLHSSSGSA

SEQ ID NO: 1133050 - protein, 21 aa, Mycobacterium
WSLPEVRWALIATVLFVVGGL

SEQ ID NO: 1133051 - protein, 20 aa, Mycobacterium
WSPSMWYICGAVGTVTALYL

SEQ ID NO: 1133052 - protein, 17 aa, Mycobacterium
WSSAPAWVVVVGNTLVA

SEQ ID NO: 1133053 - protein, 17 aa, Mycobacterium
WSSPFWQTWDLLLLWLA

SEQ ID NO: 1133054 - protein, 20 aa, Mycobacterium
WSVADGYRIPLTWGTGPTPA

SEQ ID NO: 1133055 - protein, 19 aa, Mycobacterium
WSVLRFTRRRARLRSVQEL

SEQ ID NO: 1133056 - protein, 20 aa, Mycobacterium
WSWFYRHLFDLAIVVLPLLR

SEQ ID NO: 1133057 - protein, 17 aa, Mycobacterium
WTLVVWMLVAIGSGIGY

SEQ ID NO: 1133058 - protein, 18 aa, Mycobacterium
WVDRRFRIGHGRLFALYV

SEQ ID NO: 1133059 - protein, 18 aa, Mycobacterium
WVDVLGMSMLAGIGFTVS

SEQ ID NO: 1133060 - protein, 19 aa, Mycobacterium
WVLGCIVVALALHTWVSRK

SEQ ID NO: 1133061 - protein, 25 aa, Mycobacterium
WVLLCVEILRLPALENVMPKALAKE

SEQ ID NO: 1133062 - protein, 24 aa, Mycobacterium
WVTQRLWWALLLVVGFWGMLRLAE

SEQ ID NO: 1133063 - protein, 19 aa, Mycobacterium
WWFWIGFALVTLVVAGGVS

SEQ ID NO: 1133064 - protein, 22 aa, Mycobacterium
WWICAIAGLALLAWVLADPFTR

SEQ ID NO: 1133065 - protein, 18 aa, Mycobacterium
WWKGRRVGPLVAEALPVV

SEQ ID NO: 1133066 - protein, 20 aa, Mycobacterium
WYNTALGLAMVFGRFLPIIL

SEQ ID NO: 1133067 - protein, 18 aa, Mycobacterium
WYRTFPAVVGFVAVAVVI

SEQ ID NO: 1133068 - protein, 23 aa, Mycobacterium
YAILILCIFLNFLIRQKKNKLDW

SEQ ID NO: 1133069 - protein, 27 aa, Mycobacterium
YAMQWPLFAGFCVYAYFKFVRYEEAPP

SEQ ID NO: 1133070 - protein, 21 aa, Mycobacterium
YASCESCAAVAVAYQVIFVVD

SEQ ID NO: 1133071 - protein, 18 aa, Mycobacterium
YDMIGMWAPFLLVLLRMI

SEQ ID NO: 1133072 - protein, 17 aa, Mycobacterium
YDRPIIRPGLRETAEIA

SEQ ID NO: 1133073 - protein, 24 aa, Mycobacterium
YDVALFYRYAWRNPTFTEIVATRT

SEQ ID NO: 1133074 - protein, 23 aa, Mycobacterium
YEGFPADVLYEFRLYSLGTQVVI

SEQ ID NO: 1133075 - protein, 18 aa, Mycobacterium
YEGFPADVLYYFRLYALG

SEQ ID NO: 1133076 - protein, 19 aa, Mycobacterium
YEGRLGRRGLFLIWGAEVL

SEQ ID NO: 1133077 - protein, 20 aa, Mycobacterium
YETIGGLVLEKLGHIPEEGE

SEQ ID NO: 1133078 - protein, 17 aa, Mycobacterium
YFYWEPHCFNIPICWAF

SEQ ID NO: 1133079 - protein, 17 aa, Mycobacterium
YFYWEPHCYNIPVCHSM

SEQ ID NO: 1133080 - protein, 20 aa, Mycobacterium
YGAACYLLFLAVFLYAIGFV

SEQ ID NO: 1133081 - protein, 24 aa, Mycobacterium
YGDWPSFFALMAWFSSVSGVDSLT

SEQ ID NO: 1133082 - protein, 27 aa, Mycobacterium
YGEGGLLEFARRVGFSVAQAATPGHNG

SEQ ID NO: 1133083 - protein, 26 aa, Mycobacterium
YGELLRFLFEPIFDFLRDPLGNTIKL

SEQ ID NO: 1133084 - protein, 17 aa, Mycobacterium
YGRERLGPFWGHAAGWS

SEQ ID NO: 1133085 - protein, 24 aa, Mycobacterium
YGRERLGPWWGFIAGWGFVVGKTA

SEQ ID NO: 1133086 - protein, 17 aa, Mycobacterium
YGWRIPFLIAGPLGLVG

SEQ ID NO: 1133087 - protein, 24 aa, Mycobacterium
YHEGGHTLAAWAMPDIEPIYKVTI

SEQ ID NO: 1133088 - protein, 19 aa, Mycobacterium
YIRRRFPALSGEDHNDVIR

SEQ ID NO: 1133089 - protein, 20 aa, Mycobacterium
YKLNSAFAVGGPKCLVKVIQ

SEQ ID NO: 1133090 - protein, 17 aa, Mycobacterium
YLDSWPKAVAVGLAAMF

SEQ ID NO: 1133091 - protein, 20 aa, Mycobacterium
YLTCAIFVFGVLGALLRVVS

SEQ ID NO: 1133092 - protein, 26 aa, Mycobacterium
YLTHPRWGRPLLVLGVLHTLALLATV

SEQ ID NO: 1133093 - protein, 17 aa, Mycobacterium
YLWHIPLLLGMHLTFDY

SEQ ID NO: 1133094 - protein, 19 aa, Mycobacterium
YLWHWPIFLVLNGERTGIE

SEQ ID NO: 1133095 - protein, 23 aa, Mycobacterium
YNCVNCLTYALARQIFVTLDDPL

SEQ ID NO: 1133096 - protein, 22 aa, Mycobacterium
YNEERIRLWVVFVDDFSGQDAQ

SEQ ID NO: 1133097 - protein, 18 aa, Mycobacterium
YNMPLELTLTVIPFIIIS

SEQ ID NO: 1133098 - protein, 18 aa, Mycobacterium
YNMPLELVLTVIPFLIIS

SEQ ID NO: 1133099 - protein, 21 aa, Mycobacterium
YPGELLRLIAQMGLGTGALAV

SEQ ID NO: 1133100 - protein, 17 aa, Mycobacterium
YPGPGLGLITAWFAVIL

SEQ ID NO: 1133101 - protein, 17 aa, Mycobacterium
YPVFAVIGVNPLPTPTS

SEQ ID NO: 1133102 - protein, 19 aa, Mycobacterium
YRAEALLVEALDAMTEAVG

SEQ ID NO: 1133103 - protein, 22 aa, Mycobacterium
YRIGALCPYCMVVWAVTIPLLV

SEQ ID NO: 1133104 - protein, 21 aa, Mycobacterium
YRPNLFVTYWAFRAMIGLLLV

SEQ ID NO: 1133105 - protein, 17 aa, Mycobacterium
YRPRICNPYRNPLRVVY

SEQ ID NO: 1133106 - protein, 26 aa, Mycobacterium
YRTAVMARLRLVGIGVPVAVGLLAGL

SEQ ID NO: 1133107 - protein, 17 aa, Mycobacterium
YRWLFAFGFLLIGFGLE

SEQ ID NO: 1133108 - protein, 21 aa, Mycobacterium
YSEERLRPPPGYKDTTVPGIF

SEQ ID NO: 1133109 - protein, 20 aa, Mycobacterium
YSERLAALARFTLRHKALVI

SEQ ID NO: 1133110 - protein, 19 aa, Mycobacterium
YSVGDAFNWAWNKFSKNAM

SEQ ID NO: 1133111 - protein, 20 aa, Mycobacterium
YVILGWRPVLLVPLTFALFT

SEQ ID NO: 1133112 - protein, 17 aa, Mycobacterium
YVLLRFSLRTPLTLVRG

SEQ ID NO: 1133113 - protein, 17 aa, Mycobacterium
YWFARGWNFRGLGAWLV

SEQ ID NO: 1133114 - protein, 22 aa, Mycobacterium
YWNRIAVTVVRRPKPLLAGSLV

SEQ ID NO: 1133115 - protein, 22 aa, Mycobacterium
YYMAETNLRFLLGRAATIEVPL

SEQ ID NO: 1133116 - protein, 24 aa, Mycobacterium
AVLLPFFSFMTFLIAVPTGIKFFN

SEQ ID NO: 1133117 - protein, 25 aa, Mycobacterium
VSAQPLWLVFAGVGVLIFTLGVYST

SEQ ID NO: 1133118 - protein, 18 aa, Mycobacterium
FDAGYFWHYNELWLGGAA

SEQ ID NO: 1133119 - protein, 26 aa, Mycobacterium
GGVLLWQHLFWFFGHPEVYIIALPFF

SEQ ID NO: 1133120 - protein, 27 aa, Mycobacterium
ERQMLRPSFVPPPPIRQLRDLTRYRID

SEQ ID NO: 1133121 - protein, 32 aa, Mycobacterium
MEATSDYWKPVFYLLEAHGLDPWLVNARDVKH

SEQ ID NO: 1133122 - protein, 17 aa, Mycobacterium
SYRKMKQNLWWGAGYNL

SEQ ID NO: 1133123 - protein, 26 aa, Mycobacterium
VAVGRSILVIIWHLLTDPDATFIDLG

SEQ ID NO: 1133124 - protein, 23 aa, Mycobacterium
AASPLLAFVFVVPALNLGGIPPF

SEQ ID NO: 1133125 - protein, 24 aa, Mycobacterium
AASVLPVWLLLAPRDYLSTFMKVG

SEQ ID NO: 1133126 - protein, 19 aa, Mycobacterium
ADPLLLPVVALLNGLGLVM

SEQ ID NO: 1133127 - protein, 23 aa, Mycobacterium
ADYSFLSYYPYYGFQGLTSHYAN

SEQ ID NO: 1133128 - protein, 29 aa, Mycobacterium
AFGGPGALFWMWAVAFLGASTSFVECTLG

SEQ ID NO: 1133129 - protein, 19 aa, Mycobacterium
AFLTKMLQAFLVMPGLALA

SEQ ID NO: 1133130 - protein, 19 aa, Mycobacterium
AFVADMRRWGEFGMIPALN

SEQ ID NO: 1133131 - protein, 17 aa, Mycobacterium
AGQWAANWLITVTFPGL

SEQ ID NO: 1133132 - protein, 23 aa, Mycobacterium
ALLTFVWLDRIGLGGGAWAGLLC

SEQ ID NO: 1133133 - protein, 29 aa, Mycobacterium
ALVIEGAFTLPFMAVYYGYPTLSLTEICS

SEQ ID NO: 1133134 - protein, 20 aa, Mycobacterium
ANLVPGQFIQPFVDAAFSDL

SEQ ID NO: 1133135 - protein, 25 aa, Mycobacterium
ARTTHHLFQPLLYQVATGIISEGEI

SEQ ID NO: 1133136 - protein, 26 aa, Mycobacterium
ATPIAFLLFAFFLGFAIMIGAELNAA

SEQ ID NO: 1133137 - protein, 23 aa, Mycobacterium
ATTGFWLAPLLLSVPVFSRDTYS

SEQ ID NO: 1133138 - protein, 17 aa, Mycobacterium
AVFVGIALGLLGGGGSI

SEQ ID NO: 1133139 - protein, 20 aa, Mycobacterium
AVGDNFVWAYQRAEALAAEV

SEQ ID NO: 1133140 - protein, 17 aa, Mycobacterium
AVVLFRIVGGIGVGVAS

SEQ ID NO: 1133141 - protein, 18 aa, Mycobacterium
DIIALKFHISLNATTWIG

SEQ ID NO: 1133142 - protein, 28 aa, Mycobacterium
DRVGRKPLWWFSLIGLFVAGVPMFLLMG

SEQ ID NO: 1133143 - protein, 24 aa, Mycobacterium
DVLPRRGWLEALLGHFCDPAVALV

SEQ ID NO: 1133144 - protein, 25 aa, Mycobacterium
DVTAQPIMFVLLFAFVFGASITNTG

SEQ ID NO: 1133145 - protein, 18 aa, Mycobacterium
ELIALLHSFVGLAAVLVG

SEQ ID NO: 1133146 - protein, 17 aa, Mycobacterium
EPNLTYRIALRTTSSAE

SEQ ID NO: 1133147 - protein, 18 aa, Mycobacterium
EVWAVVLFRIVGGIGVGV

SEQ ID NO: 1133148 - protein, 22 aa, Mycobacterium
FAAAFFMRPLGGFFFGPLGDRI

SEQ ID NO: 1133149 - protein, 26 aa, Mycobacterium
FAIMHLLTHGFFKAGLFLGAGSVMHA

SEQ ID NO: 1133150 - protein, 25 aa, Mycobacterium
FERPGLLILVFVVTIVSAGFHEFGH

SEQ ID NO: 1133151 - protein, 27 aa, Mycobacterium
FFAVAVLLGIITFAIIRIVREPKKHGR

SEQ ID NO: 1133152 - protein, 25 aa, Mycobacterium
FGEFVAWIIGWDLILEFAVAAAVVA

SEQ ID NO: 1133153 - protein, 27 aa, Mycobacterium
FGETIAAGPFFNAYLANLVPGQFIQPF

SEQ ID NO: 1133154 - protein, 17 aa, Mycobacterium
FVISLWAGSSAISAFVD

SEQ ID NO: 1133155 - protein, 20 aa, Mycobacterium
GIILALIFRGIFIALGAVAI

SEQ ID NO: 1133156 - protein, 26 aa, Mycobacterium
GLQDSAFIPRFLFAVGFPGIVVATAC

SEQ ID NO: 1133157 - protein, 24 aa, Mycobacterium
GQFAEAALLGILFSIAEGLEHYAV

SEQ ID NO: 1133158 - protein, 24 aa, Mycobacterium
GRISAFVRWVARTPWPVFTLGMLQ

SEQ ID NO: 1133159 - protein, 21 aa, Mycobacterium
GSLFPFLFITIACGALSGFHS

SEQ ID NO: 1133160 - protein, 19 aa, Mycobacterium
GYLSWVPVILNAASSPAVV

SEQ ID NO: 1133161 - protein, 22 aa, Mycobacterium
IDSAIFFTLKLTILEPKPVTAK

SEQ ID NO: 1133162 - protein, 19 aa, Mycobacterium
IGMLYVVYLLWEHKESAAG

SEQ ID NO: 1133163 - protein, 17 aa, Mycobacterium
IIALPFFGIVSEIFPVF

SEQ ID NO: 1133164 - protein, 29 aa, Mycobacterium
ILVASSVPLLLFPQGFLKSITYAIIASVM

SEQ ID NO: 1133165 - protein, 21 aa, Mycobacterium
ISATFPAMFPTQVRYAGFAIA

SEQ ID NO: 1133166 - protein, 18 aa, Mycobacterium
IVGFAMLGALTFLPTFMQ

SEQ ID NO: 1133167 - protein, 18 aa, Mycobacterium
IVSIPLAFILGIVGTLTS

SEQ ID NO: 1133168 - protein, 25 aa, Mycobacterium
LAGMTLLPAILVLAGPRGWVKPRRE

SEQ ID NO: 1133169 - protein, 23 aa, Mycobacterium
LAKVIVFVIIVIFLQARPQGLFT

SEQ ID NO: 1133170 - protein, 22 aa, Mycobacterium
LGVFPLIVMFLITSITMQRERV

SEQ ID NO: 1133171 - protein, 32 aa, Mycobacterium
LISVLPIIALMVIAVWLLGVGTLMDLALVQLV

SEQ ID NO: 1133172 - protein, 24 aa, Mycobacterium
LLTGVSYMIPFVAAGGLLIALGFL

SEQ ID NO: 1133173 - protein, 18 aa, Mycobacterium
LTLYVVARVWTKAFWRSR

SEQ ID NO: 1133174 - protein, 17 aa, Mycobacterium
LVLAYAGSALPLLLLFS

SEQ ID NO: 1133175 - protein, 17 aa, Mycobacterium
LVTFTVADGIRLGDRTE

SEQ ID NO: 1133176 - protein, 28 aa, Mycobacterium
MFRMPIFTWNILVTSILVLLAFPLLTAA

SEQ ID NO: 1133177 - protein, 31 aa, Mycobacterium
NLTGLTWIRFLIWMAIGVVVYFLYGRRHSLV

SEQ ID NO: 1133178 - protein, 18 aa, Mycobacterium
PAPPPGGPPPGPPAPPPP

SEQ ID NO: 1133179 - protein, 31 aa, Mycobacterium
PFALGVAALLFGFPIFFDAGLVVFLPIIMTV

SEQ ID NO: 1133180 - protein, 26 aa, Mycobacterium
PFVELRFFRSIPFASATAIAVCAFAA

SEQ ID NO: 1133181 - protein, 29 aa, Mycobacterium
PHNVPLTLLGAGLLWAGWYAFNGGSALAA

SEQ ID NO: 1133182 - protein, 31 aa, Mycobacterium
QAGLIIGFGLLLDTFLVRTLTVPAIATLLRE

SEQ ID NO: 1133183 - protein, 21 aa, Mycobacterium
QGRLFTPFFITVGLVEAAYFI

SEQ ID NO: 1133184 - protein, 24 aa, Mycobacterium
QMLQWAPECFGTPGDLKLAALAIS

SEQ ID NO: 1133185 - protein, 24 aa, Mycobacterium
QQFVGINVIFYYSNVLWQAVGFSA

SEQ ID NO: 1133186 - protein, 19 aa, Mycobacterium
QWAANWLITVTFPGLREHL

SEQ ID NO: 1133187 - protein, 25 aa, Mycobacterium
RFGGSLLLYAFPAAGAFAAMHALVP

SEQ ID NO: 1133188 - protein, 27 aa, Mycobacterium
RRNLALYVTALLFVLAWATSGINGWFY

SEQ ID NO: 1133189 - protein, 31 aa, Mycobacterium; identical to SEQ ID NO: 368485

SEQ ID NO: 1133190 - protein, 24 aa, Mycobacterium
SAGLGLFFAFWSWVGFESTAMYGE

SEQ ID NO: 1133191 - protein, 25 aa, Mycobacterium
SMDYEIFLLTRIRERFLQTGNTRDA

SEQ ID NO: 1133192 - protein, 26 aa, Mycobacterium
TAGYLGLLLFVAAPLRRSGAYTVPDF

SEQ ID NO: 1133193 - protein, 29 aa, Mycobacterium
THINAYDLDLYLRIAPELYLKRLCVGGVE

SEQ ID NO: 1133194 - protein, 26 aa, Mycobacterium
TIGLGLLFDTLVIRAFMTPSIAALLG

SEQ ID NO: 1133195 - protein, 21 aa, Mycobacterium
TLDGQWVLVTFTVADGIRLGD

SEQ ID NO: 1133196 - protein, 20 aa, Mycobacterium
TLVFGVLRLINFAHSEIFML

SEQ ID NO: 1133197 - protein, 24 aa, Mycobacterium
TVVYAFICLFVINVIMTAVGVRVL

SEQ ID NO: 1133198 - protein, 23 aa, Mycobacterium
VAVFFALSGFLLWRGHAAAARGL

SEQ ID NO: 1133199 - protein, 18 aa, Mycobacterium
VFNVLVAALIVYVGDQLG

SEQ ID NO: 1133200 - protein, 26 aa, Mycobacterium
VGQPGTPALPIPYPRTGQGGDPKLTL

SEQ ID NO: 1133201 - protein, 17 aa, Mycobacterium
VLLIATALAFDFTNGFH

SEQ ID NO: 1133202 - protein, 20 aa, Mycobacterium
VNHALAWSGIAAAAVFIVAV

SEQ ID NO: 1133203 - protein, 18 aa, Mycobacterium
VRSGMDLGPWLVSRDITV

SEQ ID NO: 1133204 - protein, 40 aa, Mycobacterium
VRSVLEPWLTFLRALPPLAYFFLLVIWLGIDEAPKITLLA

SEQ ID NO: 1133205 - protein, 25 aa, Mycobacterium
VYGDFFNFYACDVTLKLNGLQPGGP

SEQ ID NO: 1133206 - protein, 21 aa, Mycobacterium
YGADALWYPVGFTAGYLGLLL

SEQ ID NO: 1133207 - protein, 27 aa, Mycobacterium
AAAGACIGFLWWNAAPAKIFMGDTGSL

SEQ ID NO: 1133208 - protein, 18 aa, Mycobacterium
AAALAWLVEEMEQRYQDM

SEQ ID NO: 1133209 - protein, 24 aa, Mycobacterium
AAALYVTFAFIGGSTWVLVVGTAL

SEQ ID NO: 1133210 - protein, 25 aa, Mycobacterium
AAARPLWFVLVGFGLIITALAVYST

SEQ ID NO: 1133211 - protein, 23 aa, Mycobacterium
AAASLLFVIVFRDQTLATVAESV

SEQ ID NO: 1133212 - protein, 25 aa, Mycobacterium
AAAVFIVAVVFFSGFFIGRATDGFG

SEQ ID NO: 1133213 - protein, 23 aa, Mycobacterium
AAAVLLILLVALGLLSGLVAAVA

SEQ ID NO: 1133214 - protein, 30 aa, Mycobacterium
AAAWLDGAVWWKALLAFVVAVALIIGVNYA

SEQ ID NO: 1133215 - protein, 30 aa, Mycobacterium
AAAWSWRLLIIFGALVAVLWLVARLEIIVV

SEQ ID NO: 1133216 - protein, 28 aa, Mycobacterium
AACAFAETYWQLLLFRSLGGVGSAMFTV

SEQ ID NO: 1133217 - protein, 25 aa, Mycobacterium
AAELLDTWLWRWASFLIVFGVMVLV

SEQ ID NO: 1133218 - protein, 22 aa, Mycobacterium
AAEPIYLLFDLAVVGRLGALSL

SEQ ID NO: 1133219 - protein, 24 aa, Mycobacterium
AAERLYPYRWVVAVVLVVAIATAV

SEQ ID NO: 1133220 - protein, 26 aa, Mycobacterium
AAFLGANFMLLPRWAFGADDAGASAI

SEQ ID NO: 1133221 - protein, 31 aa, Mycobacterium
AAGAMFPATLLLLRYRWLRAEPLPPARSRAS

SEQ ID NO: 1133222 - protein, 20 aa, Mycobacterium
AAGLWPLVFARVAATALVVL

SEQ ID NO: 1133223 - protein, 28 aa, Mycobacterium
AAGPEVALPWRTLGLPGDITLVGADTNQ

SEQ ID NO: 1133224 - protein, 23 aa, Mycobacterium
AAGSLLFGLWHIATSLGLTSSNV

SEQ ID NO: 1133225 - protein, 22 aa, Mycobacterium
AAGVLAPIGFVLPMSVGAILMS

SEQ ID NO: 1133226 - protein, 29 aa, Mycobacterium
AAGVMTILFGLIARLPFAFAAGLGINSFL

SEQ ID NO: 1133227 - protein, 23 aa, Mycobacterium
AAGVWIIRRQLAPLSRVSAAARE

SEQ ID NO: 1133228 - protein, 25 aa, Mycobacterium
AAILVCIGAYVLLRFSLRTPPVIGG

SEQ ID NO: 1133229 - protein, 33 aa, Mycobacterium
AALAPLTLGLWWALYMVFIAVLSGGLAVLIERE

SEQ ID NO: 1133230 - protein, 25 aa, Mycobacterium
AALGFITLWIRRRLANPGLETIQGL

SEQ ID NO: 1133231 - protein, 32 aa, Mycobacterium
AALQVHLTVFALAIVIGYYVIGNVHHALHTPL

SEQ ID NO: 1133232 - protein, 34 aa, Mycobacterium
AALRKLDPRTLWRNPVMLIVEIGALWSTALALID

SEQ ID NO: 1133233 - protein, 24 aa, Mycobacterium
AALSTWRDVFWINVPLAAIAMVLI

SEQ ID NO: 1133234 - protein, 30 aa, Mycobacterium
AALTLVAELTRLYRPMPVRIDLDTSGAPSA

SEQ ID NO: 1133235 - protein, 25 aa, Mycobacterium
AALVFAVFAPVHWVAVIPLGAGCLM

SEQ ID NO: 1133236 - protein, 24 aa, Mycobacterium
AAMATLLFDLVVTAGVYSLVGFEV

SEQ ID NO: 1133237 - protein, 24 aa, Mycobacterium
AAMGLVFGYYWHRTGRLWPLIIAH

SEQ ID NO: 1133238 - protein, 32 aa, Mycobacterium
AAPGPVFFDRTGKRLYYFAAGVIVLAVIVAVL

SEQ ID NO: 1133239 - protein, 26 aa, Mycobacterium
AAPICLLMFAILAVVLLLLNKPELKH

SEQ ID NO: 1133240 - protein, 19 aa, Mycobacterium
AAPKLKWVAGAIGGGLTFA

SEQ ID NO: 1133241 - protein, 25 aa, Mycobacterium
AAPLLGLYWCAIGLIIALAASGIAK

SEQ ID NO: 1133242 - protein, 17 aa, Mycobacterium
AAPTFEFFALYGTAAVY

SEQ ID NO: 1133243 - protein, 20 aa, Mycobacterium
AARLLDYGFGLPQGTKVGSL

SEQ ID NO: 1133244 - protein, 26 aa, Mycobacterium
AARTELYWLLCLLAAGLLLGEIWLSV

SEQ ID NO: 1133245 - protein, 27 aa, Mycobacterium
AASGVLHLLVGYIILQIALGSGGNADQ

SEQ ID NO: 1133246 - protein, 17 aa, Mycobacterium
AASLLAGLLAHVADQLL

SEQ ID NO: 1133247 - protein, 30 aa, Mycobacterium
AASPVIFAVFAWWQLRAPAPIVDLRTTVRR

SEQ ID NO: 1133248 - protein, 19 aa, Mycobacterium
AASYSWYYAWTPGTGYLAN

SEQ ID NO: 1133249 - protein, 23 aa, Mycobacterium
AATRAPLGLRPPALRGGLGAGAT

SEQ ID NO: 1133250 - protein, 26 aa, Mycobacterium
AATTWELVVVFPWFAVAVATACVGAA

SEQ ID NO: 1133251 - protein, 20 aa, Mycobacterium
AAVEALFPALFALAAVTVRR

SEQ ID NO: 1133252 - protein, 25 aa, Mycobacterium
AAVFVLMWIGYAHWAWLFEADLAVL

SEQ ID NO: 1133253 - protein, 25 aa, Mycobacterium
AAVLLHASWQWVFAALVVLAGGLLL

SEQ ID NO: 1133254 - protein, 28 aa, Mycobacterium
ACEPDARRWWLIAAGVAVGFGFLAKMLQ

SEQ ID NO: 1133255 - protein, 35 aa, Mycobacterium
ADGLTAWIAAPLLFIGVLFGLLLVTGTTIREVPET

SEQ ID NO: 1133256 - protein, 20 aa, Mycobacterium
ADILTALPRAVRAAFSGGPA

SEQ ID NO: 1133257 - protein, 18 aa, Mycobacterium
ADKPWPNDYLQLAEAQKF

SEQ ID NO: 1133258 - protein, 25 aa, Mycobacterium
ADNQSWPTTLWATNAVISAAILRGP

SEQ ID NO: 1133259 - protein, 24 aa, Mycobacterium
ADNWLHFALGVVMLVLALTLAAQH

SEQ ID NO: 1133260 - protein, 25 aa, Mycobacterium
ADTNNLHRRVIIICALAVGAATLLG

SEQ ID NO: 1133261 - protein, 34 aa, Mycobacterium
ADVGLVFWFLFSLFPIFWMLMLALKNAEQQTTTY

SEQ ID NO: 1133262 - protein, 22 aa, Mycobacterium
ADYRLGWYVIIGTIPIGVIGLL

SEQ ID NO: 1133263 - protein, 27 aa, Mycobacterium
AEAGLFPGVILYLSRWFPTAYRARVVA

SEQ ID NO: 1133264 - protein, 25 aa, Mycobacterium
AEAVGLVTLWVLFTRARGEADELRA

SEQ ID NO: 1133265 - protein, 25 aa, Mycobacterium
AEDGLPFWIIASCALAIGLGTYLGG

SEQ ID NO: 1133266 - protein, 18 aa, Mycobacterium
AELAWLYRNSRALVFPSK

SEQ ID NO: 1133267 - protein, 33 aa, Mycobacterium
AELLAAFFWTAYLFGAFLIYTAYKMAFQHDKDL

SEQ ID NO: 1133268 - protein, 25 aa, Mycobacterium
AEQWNLPIVLIVLLAVFGSFAAAAM

SEQ ID NO: 1133269 - protein, 29 aa, Mycobacterium
AERLKRDFATALDYWPLVIGGSGILSITM

SEQ ID NO: 1133270 - protein, 26 aa, Mycobacterium
AEWLAYLLFGVLILVIFRVARVSRAR

SEQ ID NO: 1133271 - protein, 30 aa, Mycobacterium
AFATWLLVNLPIMVLFPRGWSEFFRLNTRR

SEQ ID NO: 1133272 - protein, 18 aa, Mycobacterium
AFFLPLRIGVAPFPLSAF

SEQ ID NO: 1133273 - protein, 20 aa, Mycobacterium
AFGGYFYWDDLILIGRAGTQ

SEQ ID NO: 1133274 - protein, 21 aa, Mycobacterium
AFGIVWPMLYADIAAVSAATI

SEQ ID NO: 1133275 - protein, 19 aa, Mycobacterium
AFLAVLSPTLAPAARRWAI

SEQ ID NO: 1133276 - protein, 24 aa, Mycobacterium
AFLSYGWRIAFLVSVVLVIFGVVV

SEQ ID NO: 1133277 - protein, 25 aa, Mycobacterium
AFMHVMGPANWWAPAPLARLHRRFG

SEQ ID NO: 1133278 - protein, 44 aa, Mycobacterium
AFPPQKPPHRGFIPRTIRALAVPIILVWIAIVAVLNVIVPQLEE

SEQ ID NO: 1133279 - protein, 25 aa, Mycobacterium
AFRDLLARYWRPILKLGGMVVALNV

SEQ ID NO: 1133280 - protein, 34 aa, Mycobacterium
AFRHPHTFRRLFVAFYFVMYMLLARTARQVVTVS

SEQ ID NO: 1133281 - protein, 21 aa, Mycobacterium
AFWIFAVFYVVASAVTWVMYV

SEQ ID NO: 1133282 - protein, 24 aa, Mycobacterium
AGAAAGLAVAVWVVGIRGLLHDRG

SEQ ID NO: 1133283 - protein, 23 aa, Mycobacterium
AGAAVGFLIGRRRRRAHPAAVLA

SEQ ID NO: 1133284 - protein, 26 aa, Mycobacterium
AGAEYLLNLFHLPGALYVIVAATIAG

SEQ ID NO: 1133285 - protein, 26 aa, Mycobacterium
AGAKFPWIVYAIPVLPVAAIALTLLP

SEQ ID NO: 1133286 - protein, 19 aa, Mycobacterium
AGAPWMVYYARALGNSVGK

SEQ ID NO: 1133287 - protein, 27 aa, Mycobacterium
AGARALRWGWLALTLIGVPWLLSFAQP

SEQ ID NO: 1133288 - protein, 25 aa, Mycobacterium
AGAVAVLLFLIIKVKLHAFVALVLV

SEQ ID NO: 1133289 - protein, 17 aa, Mycobacterium
AGAWWLIGWRVVQGVGG

SEQ ID NO: 1133290 - protein, 19 aa, Mycobacterium
AGFVFTWLRKRSGSLLAPI

SEQ ID NO: 1133291 - protein, 20 aa, Mycobacterium
AGFVLFALTFVVNALARAAA

SEQ ID NO: 1133292 - protein, 29 aa, Mycobacterium
AGGFLFNYFLGIPYWLGTVVIAALAVAYT

SEQ ID NO: 1133293 - protein, 28 aa, Mycobacterium
AGGFYLAFLFPLVGFLVVMLRRAWTPGA

SEQ ID NO: 1133294 - protein, 26 aa, Mycobacterium
AGGLAVLIMVLWVGTALTISTTDSRS

SEQ ID NO: 1133295 - protein, 23 aa, Mycobacterium
AGGLLIALGFLFAGYDIANTPDG

SEQ ID NO: 1133296 - protein, 18 aa, Mycobacterium
AGIGGWATMLPYVQRWPT

SEQ ID NO: 1133297 - protein, 22 aa, Mycobacterium
AGKHFLWMDLPRPRDLAPLLAA

SEQ ID NO: 1133298 - protein, 18 aa, Mycobacterium
AGLAFSIGFLALLLGRSE

SEQ ID NO: 1133299 - protein, 21 aa, Mycobacterium
AGLAILTWIVASVGFGFYVAN

SEQ ID NO: 1133300 - protein, 25 aa, Mycobacterium
AGLALKTLLGMPVWIGPVVVGGIVI

SEQ ID NO: 1133301 - protein, 27 aa, Mycobacterium
AGLGRTVTFIPWPVIEGFTLGIAVIIF

SEQ ID NO: 1133302 - protein, 20 aa, Mycobacterium
AGLLAVAVLLLATRGMHIDG

SEQ ID NO: 1133303 - protein, 21 aa, Mycobacterium
AGLPCLPWFIDSAWNLAFGVL

SEQ ID NO: 1133304 - protein, 24 aa, Mycobacterium
AGLSRFIYATAIVWILGGLGTWLI

SEQ ID NO: 1133305 - protein, 21 aa, Mycobacterium
AGLTWLILVAATVVSWLVGAD

SEQ ID NO: 1133306 - protein, 21 aa, Mycobacterium
AGMVPPLAMALASTVRPGLFT

SEQ ID NO: 1133307 - protein, 23 aa, Mycobacterium
AGPLPYIVMEYVDGVTLRDIVHS

SEQ ID NO: 1133308 - protein, 27 aa, Mycobacterium
AGRMAVAWLITLPAAGLVGALAFWVSH

SEQ ID NO: 1133309 - protein, 40 aa, Mycobacterium
AGRYRVRLLLDGLVFALSLFLLAWVLVLRGVYESFRDDKV

SEQ ID NO: 1133310 - protein, 25 aa, Mycobacterium
AGSALPLLLLFSVANRSLVDVLTSE

SEQ ID NO: 1133311 - protein, 19 aa, Mycobacterium
AGSIAVVGWLVAGGALIGL

SEQ ID NO: 1133312 - protein, 26 aa, Mycobacterium
AGSVRAWLVVALMNIAMIALHLPAPA

SEQ ID NO: 1133313 - protein, 33 aa, Mycobacterium
AGTVVVGWVMWLIMINPFRLLAQQARAINAQSK

SEQ ID NO: 1133314 - protein, 38 aa, Mycobacterium
AGVALKMLWPSAPRWVGVPLYLMLGYVALLFAEALLIG

SEQ ID NO: 1133315 - protein, 33 aa, Mycobacterium
AGVIFPVVGWWLYDIFYITPFLAIPYLHTVNRE

SEQ ID NO: 1133316 - protein, 29 aa, Mycobacterium
AGVLVTTLSYFPFMYLPAAATLRRLDPAV

SEQ ID NO: 1133317 - protein, 21 aa, Mycobacterium
AGVPDFRVSLTSPLTIRDGCG

SEQ ID NO: 1133318 - protein, 19 aa, Mycobacterium
AGVQNPLFFRDNTQMLFGD

SEQ ID NO: 1133319 - protein, 24 aa, Mycobacterium
AGVTTFILAGRYFEKRSKRQAGAA

SEQ ID NO: 1133320 - protein, 24 aa, Mycobacterium
AGVVFIVAVVFFSGFVLGKNSGDG

SEQ ID NO: 1133321 - protein, 23 aa, Mycobacterium
AGVYLAVMAVLWLTALPAFFGAV

SEQ ID NO: 1133322 - protein, 21 aa, Mycobacterium
AGWFFAAFGVYLLISGFRRTA

SEQ ID NO: 1133323 - protein, 18 aa, Mycobacterium
AGWVLWLPSIAFACDAVE

SEQ ID NO: 1133324 - protein, 18 aa, Mycobacterium
AHAFWVPEFLFKRDVYPN

SEQ ID NO: 1133325 - protein, 26 aa, Mycobacterium
AHNDILPLLVLVAVPPLIGAAALATA

SEQ ID NO: 1133326 - protein, 18 aa, Mycobacterium
AIARILPAALALIAVLGV

SEQ ID NO: 1133327 - protein, 29 aa, Mycobacterium
AIATVVALFLPWLLQRLGMDPAFGAGPLS

SEQ ID NO: 1133328 - protein, 28 aa, Mycobacterium
AIEADVPILPLIVWGAHRLWTKDHPRAL

SEQ ID NO: 1133329 - protein, 29 aa, Mycobacterium
AIEVGDDEFWLLLAGRKLAARDRRVLSAV

SEQ ID NO: 1133330 - protein, 23 aa, Mycobacterium
AIGMWAPFLLVLLRMIQGFSTGG

SEQ ID NO: 1133331 - protein, 24 aa, Mycobacterium
AIGYPLVCLIGLYLAAKAMFVRHV

SEQ ID NO: 1133332 - protein, 20 aa, Mycobacterium
AIHRPPPPRRTFSSGQRALL

SEQ ID NO: 1133333 - protein, 18 aa, Mycobacterium
AIITYFATGWVRVLATRL

SEQ ID NO: 1133334 - protein, 18 aa, Mycobacterium
AIKVLRADLARDPSFYLR

SEQ ID NO: 1133335 - protein, 25 aa, Mycobacterium
AILLGLPIPYILFQNAANLGLTGGL

SEQ ID NO: 1133336 - protein, 27 aa, Mycobacterium
AINQFSWVFYIFGLFLVYTAWNLARDT

SEQ ID NO: 1133337 - protein, 26 aa, Mycobacterium
AIQHRLPVTFVLFNNNAHGMCVTREQ

SEQ ID NO: 1133338 - protein, 23 aa, Mycobacterium
AISLAFFCFTTLVAYYYMAETNL

SEQ ID NO: 1133339 - protein, 21 aa, Mycobacterium
AITGLYFLGVRRWTAAAFSAV

SEQ ID NO: 1133340 - protein, 23 aa, Mycobacterium
AITLLFMAALDRIPMATASALEF

SEQ ID NO: 1133341 - protein, 23 aa, Mycobacterium
AIVDFGLYVLLLEAGLHVNVAKT

SEQ ID NO: 1133342 - protein, 35 aa, Mycobacterium
AIVLRDLRIPAIGVVLLLLSSLVVGAGWPLVVEQF

SEQ ID NO: 1133343 - protein, 19 aa, Mycobacterium
AIVVTFLVLLRQGYRWTRT

SEQ ID NO: 1133344 - protein, 24 aa, Mycobacterium
AKGRREVWIPRSLGAAVVVMRLMP

SEQ ID NO: 1133345 - protein, 23 aa, Mycobacterium
AKNVLFSVYAFSGLLAGLSGVML

SEQ ID NO: 1133346 - protein, 24 aa, Mycobacterium
AKRRRRRMRFMIKAEMEQVKIVGY

SEQ ID NO: 1133347 - protein, 25 aa, Mycobacterium
AKWPQGFTYLTNFAEPYLLWVPAVL

SEQ ID NO: 1133348 - protein, 18 aa, Mycobacterium
ALAAFMFVGRLIGDRLVD

SEQ ID NO: 1133349 - protein, 29 aa, Mycobacterium
ALACAALGPAWFWLGPAPPAGSTVRVALV

SEQ ID NO: 1133350 - protein, 20 aa, Mycobacterium
ALAIHRISAFVLPQGLITVR

SEQ ID NO: 1133351 - protein, 24 aa, Mycobacterium
ALANPAHYFILIGLFGIFVAGCTA

SEQ ID NO: 1133352 - protein, 22 aa, Mycobacterium
ALASFLTFTLTSLTFEPLDSLL

SEQ ID NO: 1133353 - protein, 18 aa, Mycobacterium
ALATVLYIGAGLGPGPRD

SEQ ID NO: 1133354 - protein, 31 aa, Mycobacterium
ALAVIALLGLFYLFPTLIGVFSRLYVPQLLI

SEQ ID NO: 1133355 - protein, 24 aa, Mycobacterium
ALAYPLLDLMVLAVAGLVLVRAVT

SEQ ID NO: 1133356 - protein, 24 aa, Mycobacterium
ALCLLFTGLFFAKPMNRMGLTSFP

SEQ ID NO: 1133357 - protein, 19 aa, Mycobacterium
ALFVPGPLLAGGSGLLFGP

SEQ ID NO: 1133358 - protein, 34 aa, Mycobacterium
ALGKPQLWWAALLAPLYWMLQSVAAVKAIYQLFA

SEQ ID NO: 1133359 - protein, 18 aa, Mycobacterium
ALGLLRRQDPVETFNAAV

SEQ ID NO: 1133360 - protein, 19 aa, Mycobacterium
ALGLYVVMLVFAVGTAPLL

SEQ ID NO: 1133361 - protein, 34 aa, Mycobacterium; identical to SEQ ID NO: 349921

SEQ ID NO: 1133362 - protein, 23 aa, Mycobacterium
ALGSLLALILGVSRTALAMARDR

SEQ ID NO: 1133363 - protein, 27 aa, Mycobacterium
ALGWSIGIATYFLLLGAMLTSILEFLT

SEQ ID NO: 1133364 - protein, 26 aa, Mycobacterium
ALHHGKQPLIILDTLGKVKPPKRPGE

SEQ ID NO: 1133365 - protein, 18 aa, Mycobacterium
ALHVLLDLLLAAGLLRLT

SEQ ID NO: 1133366 - protein, 17 aa, Mycobacterium
ALIGYRARSGRLRSAFD

SEQ ID NO: 1133367 - protein, 19 aa, Mycobacterium
ALIPFAMMLFGVSPEMKIF

SEQ ID NO: 1133368 - protein, 19 aa, Mycobacterium
ALITIPLFSALSDRVGRRA

SEQ ID NO: 1133369 - protein, 25 aa, Mycobacterium
ALLGARFINWVARRVTRRIDAEYQE

SEQ ID NO: 1133370 - protein, 21 aa, Mycobacterium
ALLGGLPMPIAVGTSLIVIAM

SEQ ID NO: 1133371 - protein, 23 aa, Mycobacterium
ALLIAALAMVRRLPSLRGPAYAV

SEQ ID NO: 1133372 - protein, 17 aa, Mycobacterium
ALLIFRGKGPHPASYKL

SEQ ID NO: 1133373 - protein, 25 aa, Mycobacterium
ALLIVCGVSVAWWPLHPATGTLDVT

SEQ ID NO: 1133374 - protein, 17 aa, Mycobacterium
ALLLYPLAVVWPSGWAW

SEQ ID NO: 1133375 - protein, 21 aa, Mycobacterium
ALLMSCVVYLAVWVRGRRPRQ

SEQ ID NO: 1133376 - protein, 18 aa, Mycobacterium
ALMNQFISLLKASSLVYF

SEQ ID NO: 1133377 - protein, 25 aa, Mycobacterium
ALPPATFQYWPYFALAVGGAMIAFV

SEQ ID NO: 1133378 - protein, 26 aa, Mycobacterium
ALPWVMGGCMLGMISIMIFTGVRQLS

SEQ ID NO: 1133379 - protein, 29 aa, Mycobacterium
ALQQLMSAHMFAPPPRPSIMRRGISRAFD

SEQ ID NO: 1133380 - protein, 17 aa, Mycobacterium
ALRMPFYRTVISVANWC

SEQ ID NO: 1133381 - protein, 29 aa, Mycobacterium
ALSLLLTIPVLLSHQWPLVFVAAALLGAT

SEQ ID NO: 1133382 - protein, 22 aa, Mycobacterium
ALSWFSPIAWAQQMRAFVALRW

SEQ ID NO: 1133383 - protein, 18 aa, Mycobacterium
ALTPLLKRPIVFGLVSGL

SEQ ID NO: 1133384 - protein, 25 aa, Mycobacterium
ALVAAGITVWLGLVANLGGVAGQQA

SEQ ID NO: 1133385 - protein, 21 aa, Mycobacterium
ALVFALILVNGLLAGSEAAFI

SEQ ID NO: 1133386 - protein, 36 aa, Mycobacterium
ALVFTNRVELLKLAVILALWAAVAAAFVSVIYRRQS

SEQ ID NO: 1133387 - protein, 21 aa, Mycobacterium
ALVPILLVFSNFGPKSTIGVV

SEQ ID NO: 1133388 - protein, 23 aa, Mycobacterium
ALWHGLNLPLLLSAVVIATGVTA

SEQ ID NO: 1133389 - protein, 41 aa, Mycobacterium
AMARERAWHLLVVPVYRIIYEPLRAYLLYASAYRAIKGTIV

SEQ ID NO: 1133390 - protein, 27 aa, Mycobacterium
AMASVLFLLFGLWMLFDAALGWRVVAL

SEQ ID NO: 1133391 - protein, 26 aa, Mycobacterium
AMATTLFHWTLHPWAIYAVVGLAIAY

SEQ ID NO: 1133392 - protein, 31 aa, Mycobacterium
AMEAIAFPLSFLVLVWVFGGLFAAMLPMAVG

SEQ ID NO: 1133393 - protein, 19 aa, Mycobacterium
AMIATGDTFLWWLAAASLL

SEQ ID NO: 1133394 - protein, 26 aa, Mycobacterium
AMLFGGIFPPFWLAGTAMLGLSKIID

SEQ ID NO: 1133395 - protein, 21 aa, Mycobacterium
AMQMGFLPGTIWIIIGAVFAG

SEQ ID NO: 1133396 - protein, 25 aa, Mycobacterium
AMRIRGWRRLGAAVVRWPGPILLLT

SEQ ID NO: 1133397 - protein, 21 aa, Mycobacterium
AMVFNLFFINLVTVGLHSYAG

SEQ ID NO: 1133398 - protein, 33 aa, Mycobacterium
AMVFYPLHLLPFGLLAFLWQIALIAAIYASIRI

SEQ ID NO: 1133399 - protein, 17 aa, Mycobacterium
ANALLLRSSLAPLDRLT

SEQ ID NO: 1133400 - protein, 31 aa, Mycobacterium
ANDIAKYFAIIPALFVGLFPGLDLLNVMRLH

SEQ ID NO: 1133401 - protein, 28 aa, Mycobacterium
ANFDDFFRPIRNYFYWEPHCYNIPVCFA

SEQ ID NO: 1133402 - protein, 26 aa, Mycobacterium
ANPAATGFTPYPPAAPRPPAKPQAKK

SEQ ID NO: 1133403 - protein, 26 aa, Mycobacterium
ANPVLGWIIGWISFTFLAIVVCAVDY

SEQ ID NO: 1133404 - protein, 38 aa, Mycobacterium
ANSGWWPLLWFTAKVWVFLFVYIWLRGTLPRLRYDQFM

SEQ ID NO: 1133405 - protein, 26 aa, Mycobacterium
APAIGLLVLLFLLTARTGFWIGVLPI

SEQ ID NO: 1133406 - protein, 21 aa, Mycobacterium
APALLAIMRFSQGLALGGEWS

SEQ ID NO: 1133407 - protein, 19 aa, Mycobacterium
APEVFWPLRRVGVEFHAAQ

SEQ ID NO: 1133408 - protein, 34 aa, Mycobacterium
APHGGIFVFFAIGNLAWFLVALAVGTAAGAGAVV

SEQ ID NO: 1133409 - protein, 24 aa, Mycobacterium
APHPLRTPYAVVAVLCLIVGAGLL

SEQ ID NO: 1133410 - protein, 30 aa, Mycobacterium
APKHAAGMLLLVPLFMHLPRRPRPAGPVET

SEQ ID NO: 1133411 - protein, 30 aa, Mycobacterium
APKLVAFLVILIIGWILAKLIAKAIDKILE

SEQ ID NO: 1133412 - protein, 24 aa, Mycobacterium
APKRLAMQYARRWALVVASPLSAM

SEQ ID NO: 1133413 - protein, 36 aa, Mycobacterium
APLVRLADRYAAWFLPLTLVLAGAAWLVSGSAVRAV

SEQ ID NO: 1133414 - protein, 21 aa, Mycobacterium
APMFHALGYLHATIGMMLGST

SEQ ID NO: 1133415 - protein, 29 aa, Mycobacterium
APNRPNRWRHLPAILLVASLVLLTVAMAG

SEQ ID NO: 1133416 - protein, 25 aa, Mycobacterium
APPPAPAAAAPAPAPAGPKLGLVDV

SEQ ID NO: 1133417 - protein, 27 aa, Mycobacterium
APPPEPGTPLPPPPPVTPVTTTPTTTT

SEQ ID NO: 1133418 - protein, 44 aa, Mycobacterium
APRELVWPYVVFGVIVVAVWWAARIPPRWALPRMLIEAPFVVLA

SEQ ID NO: 1133419 - protein, 25 aa, Mycobacterium
APSFSLAVLPMFLPAVVALIAENIG

SEQ ID NO: 1133420 - protein, 18 aa, Mycobacterium
APTFVIANLLILGALNAN

SEQ ID NO: 1133421 - protein, 18 aa, Mycobacterium
APTQLLHGSLLSSSFPAM

SEQ ID NO: 1133422 - protein, 28 aa, Mycobacterium
APWQVARMLLLFWGVGTALLTLLYGLQD

SEQ ID NO: 1133423 - protein, 24 aa, Mycobacterium
AQFGFLLVWVIVLANVMAGLVQYL

SEQ ID NO: 1133424 - protein, 18 aa, Mycobacterium
AQGQPPPRRRGLIVAGAI

SEQ ID NO: 1133425 - protein, 26 aa, Mycobacterium
AQHKVLFAVIAILLLASANLRGIRES

SEQ ID NO: 1133426 - protein, 29 aa, Mycobacterium
AQIGVLAPILLLLLRIAQGFALGGEWAGA

SEQ ID NO: 1133427 - protein, 27 aa, Mycobacterium
AQNQAYGYLFPHGTFFLAGDLLGLPGW

SEQ ID NO: 1133428 - protein, 24 aa, Mycobacterium
AQRMFARFPVAQRLLRLVTDAFAE

SEQ ID NO: 1133429 - protein, 26 aa, Mycobacterium
AQTSTWYVFLLLPSFLVYVTSMVGET

SEQ ID NO: 1133430 - protein, 33 aa, Mycobacterium
AQYSWFIGCGVAFALYYVLATRGPWRMTALRVA

SEQ ID NO: 1133431 - protein, 25 aa, Mycobacterium
AQYTSFGWAFLISGVILGVAAVGWI

SEQ ID NO: 1133432 - protein, 22 aa, Mycobacterium
ARAYGFILAFFGVGSALGALAV

SEQ ID NO: 1133433 - protein, 30 aa, Mycobacterium
ARDLPAAPTRWLILRIPLGTVWAEELAYRG

SEQ ID NO: 1133434 - protein, 26 aa, Mycobacterium
ARDVFALLSPFLLVVAVMFVPALDML

SEQ ID NO: 1133435 - protein, 31 aa, Mycobacterium
ARFDFAARKDLYTAYLPFAVAAGVAALWAKK

SEQ ID NO: 1133436 - protein, 42 aa, Mycobacterium
ARGLMPVVIIPLFASLVVGLLMFLLLGRPLAWLTTSLTDWLN

SEQ ID NO: 1133437 - protein, 21 aa, Mycobacterium
ARHAAREAELLALFAGAVLRG

SEQ ID NO: 1133438 - protein, 28 aa, Mycobacterium
ARLAVFAALVFGLFYLVAVERVIEVDAV

SEQ ID NO: 1133439 - protein, 21 aa, Mycobacterium
ARNLWAIAIALIVFSAVIAAA

SEQ ID NO: 1133440 - protein, 26 aa, Mycobacterium
ARNRMAFLAALLFVLALCFASTNGWW

SEQ ID NO: 1133441 - protein, 38 aa, Mycobacterium
ARPQRRAILHLPTHWPWAQQWLTLWRNTIGHSPPTAAT

SEQ ID NO: 1133442 - protein, 26 aa, Mycobacterium
ARRQNAIGSLLWRGLQPDTGPRTQIV

SEQ ID NO: 1133443 - protein, 22 aa, Mycobacterium
ARRRGFQVIPDLGAPFAVPKPV

SEQ ID NO: 1133444 - protein, 23 aa, Mycobacterium
ARTAALNLFVVVEAFYLFSCRSL

SEQ ID NO: 1133445 - protein, 37 aa, Mycobacterium
ARTGPAKWIRRFAIPIILGWILLVAVLSLTVPQLEVV

SEQ ID NO: 1133446 - protein, 23 aa, Mycobacterium
ARTLYAQCPTARGGVLLVIGASP

SEQ ID NO: 1133447 - protein, 23 aa, Mycobacterium
ARTRLLYQALLATAFALTLVLML

SEQ ID NO: 1133448 - protein, 30 aa, Mycobacterium
ARYSDLREPYWIALTVLLVLRPESAHTYTR

SEQ ID NO: 1133449 - protein, 27 aa, Mycobacterium
ASAALPWLVLVVAQVAWWVTDPASGWL

SEQ ID NO: 1133450 - protein, 28 aa, Mycobacterium
ASAGLHLIFAIFLLVVRFPAPPVRREGA

SEQ ID NO: 1133451 - protein, 29 aa, Mycobacterium
ASAICRHYWPIALLAALVSRRCRQAVLIA

SEQ ID NO: 1133452 - protein, 25 aa, Mycobacterium
ASALGQFIPVLWLGALGATLATLSS

SEQ ID NO: 1133453 - protein, 23 aa, Mycobacterium
ASALLMAVLLPVSGLLVDRFGAK

SEQ ID NO: 1133454 - protein, 27 aa, Mycobacterium
ASGLIFGWLAFLIVFGFFTRKAWEIVV

SEQ ID NO: 1133455 - protein, 32 aa, Mycobacterium; identical to SEQ ID NO: 23415

SEQ ID NO: 1133456 - protein, 29 aa, Mycobacterium
ASIIFTIPSLALFVVLPLIIPTRILDEAN

SEQ ID NO: 1133457 - protein, 32 aa, Mycobacterium
ASIVVPFMAVVYIVLALIIVLLNAGEVPGILQ

SEQ ID NO: 1133458 - protein, 26 aa, Mycobacterium
ASLALIFIIMLLITRSVVASAVIVGT

SEQ ID NO: 1133459 - protein, 21 aa, Mycobacterium
ASLVTALLLLGWRGVATALRH

SEQ ID NO: 1133460 - protein, 30 aa, Mycobacterium
ASPVVVWGAWPFHRAAWMNLRHGAATMDTL

SEQ ID NO: 1133461 - protein, 20 aa, Mycobacterium
ASRMFFLRRSGRIGQKVLLE

SEQ ID NO: 1133462 - protein, 38 aa, Mycobacterium
ASSFLPFGYLGIWAAVPFAIWFFLAIEGVPLAAEEAKD

SEQ ID NO: 1133463 - protein, 28 aa, Mycobacterium
ASTLCPLLVLGIWWRGLTAVGASCGLVV

SEQ ID NO: 1133464 - protein, 25 aa, Mycobacterium
ASVLAFTLSWALFRITDWISPPEPV

SEQ ID NO: 1133465 - protein, 24 aa, Mycobacterium
ASVVSLPIALWAAGGPSGLMRWLE

SEQ ID NO: 1133466 - protein, 19 aa, Mycobacterium
ASWLLPAALIGLAAGIWFT

SEQ ID NO: 1133467 - protein, 29 aa, Mycobacterium
ATAALIALALLLVWLALYAGVCLPINRRL

SEQ ID NO: 1133468 - protein, 24 aa, Mycobacterium
ATAARWLFAAFAGFVAVGVLASTR

SEQ ID NO: 1133469 - protein, 24 aa, Mycobacterium
ATFCLSFTRLPYFQSLGVPLAVGM

SEQ ID NO: 1133470 - protein, 25 aa, Mycobacterium
ATFCLSFTRLPYFQTLGVPLAIGMV

SEQ ID NO: 1133471 - protein, 24 aa, Mycobacterium
ATFLDLMWPMLLAASGIGLCTAPT

SEQ ID NO: 1133472 - protein, 33 aa, Mycobacterium
ATGMRLISPTMLFFPFVLLLAATAMYRGTDNKM

SEQ ID NO: 1133473 - protein, 23 aa, Mycobacterium
ATIALSLIGLLTLPGYRTNYNDR

SEQ ID NO: 1133474 - protein, 23 aa, Mycobacterium
ATKTDLYPHWRQVVDANAGHLHR

SEQ ID NO: 1133475 - protein, 60 aa, Mycobacterium
ATLTGCLAAVLWWACHRPNRLWWRFTAWWFGCAALAVLWWVVPLLLLGRISPPFLDFIES

SEQ ID NO: 1133476 - protein, 25 aa, Mycobacterium
ATPYPSQVFLTLFGLPLADRERLIA

SEQ ID NO: 1133477 - protein, 35 aa, Mycobacterium
ATQPLVFGFVALIAFLMLLISIRSVVLALKGVLMT

SEQ ID NO: 1133478 - protein, 23 aa, Mycobacterium
ATSAIAAARRAAGGALGPLGAKD

SEQ ID NO: 1133479 - protein, 25 aa, Mycobacterium
ATSQWLMLPQLIFGLISVGIQPAEN

SEQ ID NO: 1133480 - protein, 17 aa, Mycobacterium
ATSVGAWFPLVFLATHI

SEQ ID NO: 1133481 - protein, 26 aa, Mycobacterium
ATSYLRQLLLVQLWFEPYFDGTSWDG

SEQ ID NO: 1133482 - protein, 25 aa, Mycobacterium
ATTAIAFLGLAFTTLGVFATVGPAL

SEQ ID NO: 1133483 - protein, 23 aa, Mycobacterium
ATTALFLNFTAVIALAVCLASVG

SEQ ID NO: 1133484 - protein, 33 aa, Mycobacterium
ATVLLFPVVQPWYLLWAIIPLATWATRPGFRGA

SEQ ID NO: 1133485 - protein, 21 aa, Mycobacterium
ATVRWPGPILIATIALSLIGL

SEQ ID NO: 1133486 - protein, 28 aa, Mycobacterium
AVAAITLPLLLWAGRPAALATALAFAVA

SEQ ID NO: 1133487 - protein, 27 aa, Mycobacterium
AVAALSLVLPVWAAALIVALVLFVIAG

SEQ ID NO: 1133488 - protein, 25 aa, Mycobacterium
AVAGVSIFKLVRYLAREYLLIVSTS

SEQ ID NO: 1133489 - protein, 18 aa, Mycobacterium
AVAIAAVVIVLMRRRRRA

SEQ ID NO: 1133490 - protein, 29 aa, Mycobacterium
AVALVIPGIATPIAWLQAAGMVAAFIPAM

SEQ ID NO: 1133491 - protein, 24 aa, Mycobacterium
AVAVPAVLLYRVLTCWLPVFFGWQ

SEQ ID NO: 1133492 - protein, 25 aa, Mycobacterium
AVAWAVFLVLAWRIMRAPAYVPQEL

SEQ ID NO: 1133493 - protein, 47 aa, Mycobacterium
AVAYQVFTNLVGWPTWAMIFASPFLLAALIPLGIAGLVLIIDALKPE

SEQ ID NO: 1133494 - protein, 43 aa, Mycobacterium
AVDATIVRLVLVPALMAMFDRWNWWLPKWLDRVLPSVDFEKPL

SEQ ID NO: 1133495 - protein, 18 aa, Mycobacterium
AVDFVTYLEAGTLWAQRA

SEQ ID NO: 1133496 - protein, 24 aa, Mycobacterium
AVDRPAHPLLICDADRLDYGQAER

SEQ ID NO: 1133497 - protein, 24 aa, Mycobacterium
AVERPPAFPLQYAPPPGIGPVQAE

SEQ ID NO: 1133498 - protein, 41 aa, Mycobacterium
AVEWLDGLTFQWWMYPVGVMAILVGLWSLYSALRPRRRTGL

SEQ ID NO: 1133499 - protein, 25 aa, Mycobacterium
AVFLATWVPLFASFGALLIYPEDGA

SEQ ID NO: 1133500 - protein, 22 aa, Mycobacterium
AVFVALWVLPRAISLARAALRI

SEQ ID NO: 1133501 - protein, 19 aa, Mycobacterium
AVFYRGAPLALIRGPPRGL

SEQ ID NO: 1133502 - protein, 29 aa, Mycobacterium
AVGAPMPELPWFMALACFKSAATWSLIVK

SEQ ID NO: 1133503 - protein, 24 aa, Mycobacterium
AVGAVTFSIVRRSMKPEPSPLPPS

SEQ ID NO: 1133504 - protein, 19 aa, Mycobacterium
AVGMTALLVRHCVRRFGGI

SEQ ID NO: 1133505 - protein, 23 aa, Mycobacterium
AVHLRVWLAERLAAASGAENLAG

SEQ ID NO: 1133506 - protein, 24 aa, Mycobacterium
AVIAIVVFYVIGLLVFGFYGRHRL

SEQ ID NO: 1133507 - protein, 28 aa, Mycobacterium
AVIGLLGLLVCFALAVLLPLSPDRRRLR

SEQ ID NO: 1133508 - protein, 17 aa, Mycobacterium
AVIWGLPNLNPPTAAIV

SEQ ID NO: 1133509 - protein, 30 aa, Mycobacterium
AVLAFALLLLFGFGMIWFGILIGSLMRTVE

SEQ ID NO: 1133510 - protein, 22 aa, Mycobacterium
AVLIIFTVLTLVGYPLVFETAT

SEQ ID NO: 1133511 - protein, 21 aa, Mycobacterium
AVLMLYTILVIRGLRTAIAVR

SEQ ID NO: 1133512 - protein, 21 aa, Mycobacterium
AVLRFGYWPALFLSLLVAVNI

SEQ ID NO: 1133513 - protein, 27 aa, Mycobacterium
AVLTAALVFVLFPIAWVALASFKTPAQ

SEQ ID NO: 1133514 - protein, 20 aa, Mycobacterium
AVLTAVFALLTLASSRRRGK

SEQ ID NO: 1133515 - protein, 19 aa, Mycobacterium
AVLTSRPSLLFAHGSFRDD

SEQ ID NO: 1133516 - protein, 17 aa, Mycobacterium
AVLVPTMIWVRLRAPWA

SEQ ID NO: 1133517 - protein, 25 aa, Mycobacterium
AVLVVATPCPLLLAAPVAIVSGLSR

SEQ ID NO: 1133518 - protein, 25 aa, Mycobacterium
AVNILYRVSLPKPLPSHRLILGSIL

SEQ ID NO: 1133519 - protein, 26 aa, Mycobacterium
AVRASLLLWGGWLLVTGVVFSFMDGT

SEQ ID NO: 1133520 - protein, 20 aa, Mycobacterium
AVRFTFRRPFQAREFLEQSW

SEQ ID NO: 1133521 - protein, 23 aa, Mycobacterium
AVSILLTPVLIRLFTRQGFGHEI

SEQ ID NO: 1133522 - protein, 24 aa, Mycobacterium
AVSPLWLWLVHSVDWLPDGARLWL

SEQ ID NO: 1133523 - protein, 25 aa, Mycobacterium
AVSVPLTVLIIFTLNILLAEFGAAD

SEQ ID NO: 1133524 - protein, 21 aa, Mycobacterium
AVTAFHMLTGAPPFQNSRPTV

SEQ ID NO: 1133525 - protein, 37 aa, Mycobacterium
AVVALPVDIPWLPLAAPVALLVGYVLTLRPFSDFGVL

SEQ ID NO: 1133526 - protein, 27 aa, Mycobacterium
AVVAMGVMIFGYLQAPTLLGIGRMTVT

SEQ ID NO: 1133527 - protein, 25 aa, Mycobacterium
AVVFNALVIVALIPLALRGVRYTPG

SEQ ID NO: 1133528 - protein, 25 aa, Mycobacterium
AVVIGLLLLIILLAHHRPAPTVRTP

SEQ ID NO: 1133529 - protein, 27 aa, Mycobacterium
AVVLLLGWSFFYFSDDTRGFKPVDTSV

SEQ ID NO: 1133530 - protein, 21 aa, Mycobacterium
AVVVVFAVALVLYIVMSAEDK

SEQ ID NO: 1133531 - protein, 22 aa, Mycobacterium
AWEMFKPWSIISIAVAVVLAFV

SEQ ID NO: 1133532 - protein, 18 aa, Mycobacterium
AWFPLVFLATHIVVTTLP

SEQ ID NO: 1133533 - protein, 20 aa, Mycobacterium
AWGFSTWWVAVGTVIVLAFV

SEQ ID NO: 1133534 - protein, 21 aa, Mycobacterium
AWGWRIGFFIGGIAALVVLWM

SEQ ID NO: 1133535 - protein, 18 aa, Mycobacterium
AWIGLTGLLMLAIPPVVR

SEQ ID NO: 1133536 - protein, 17 aa, Mycobacterium
AWSLLSMLTTLAGTTLL

SEQ ID NO: 1133537 - protein, 27 aa, Mycobacterium
AWTAAGMFLAFWLPLNNGLRPEPIIAL

SEQ ID NO: 1133538 - protein, 27 aa, Mycobacterium
AYFGLYVFWMMPIFGLAIVLAVRSRRR

SEQ ID NO: 1133539 - protein, 20 aa, Mycobacterium
AYGQPYFPPPPPQPYAEMRP

SEQ ID NO: 1133540 - protein, 26 aa, Mycobacterium
AYRDPLLVMIVFAPVIWTSAVALLTP

SEQ ID NO: 1133541 - protein, 20 aa, Mycobacterium
AYSFLRFGGAAVAPWLAGVL

SEQ ID NO: 1133542 - protein, 26 aa, Mycobacterium
AYVSRYLTDMWLPQLSAKRVGLEAEG

SEQ ID NO: 1133543 - protein, 23 aa, Mycobacterium
CAGIGLAIVMPALALSAIGQAAS

SEQ ID NO: 1133544 - protein, 27 aa, Mycobacterium
CATKWSGLYFVAFFGVLTLALDIAARR

SEQ ID NO: 1133545 - protein, 27 aa, Mycobacterium
CLAAFPILVALVWWFRNESAKTYRKVR

SEQ ID NO: 1133546 - protein, 19 aa, Mycobacterium
CLGSIVFIVASWPVASKSA

SEQ ID NO: 1133547 - protein, 25 aa, Mycobacterium
CLRDLRWALHPYGVDLMVVPGVAAV

SEQ ID NO: 1133548 - protein, 18 aa, Mycobacterium
CLVTLQSALMVIGAWRND

SEQ ID NO: 1133549 - protein, 26 aa, Mycobacterium
CNSPFCWIGGIAFSVLATLVAGATLV

SEQ ID NO: 1133550 - protein, 17 aa, Mycobacterium
CRLIAMFVATLGAVPLA

SEQ ID NO: 1133551 - protein, 27 aa, Mycobacterium
CSADEIPPFAPFLAAGPPAAPDPATVH

SEQ ID NO: 1133552 - protein, 17 aa, Mycobacterium
CSLVFPAAVGALVYAMC

SEQ ID NO: 1133553 - protein, 25 aa, Mycobacterium
CVIGLLIFGSLFVAGAKFPWIVYAI

SEQ ID NO: 1133554 - protein, 19 aa, Mycobacterium
CVVAFWFLGFETAGSPLLV

SEQ ID NO: 1133555 - protein, 23 aa, Mycobacterium
CVVLFFVFGGVIAAALPGLIGGL

SEQ ID NO: 1133556 - protein, 23 aa, Mycobacterium
CVYRNPMFNYVHSDAAWTSELLP

SEQ ID NO: 1133557 - protein, 28 aa, Mycobacterium
CWQKVTRDLWPAPYLVLDTGASLAPYNH

SEQ ID NO: 1133558 - protein, 20 aa, Mycobacterium
CWWAPRWMKRLQERLGLGEV

SEQ ID NO: 1133559 - protein, 24 aa, Mycobacterium
DAAMFVPQLPYLPLGDLRTVVSYP

SEQ ID NO: 1133560 - protein, 24 aa, Mycobacterium
DAEDLGTVWGLPDGLRLAVDNLVR

SEQ ID NO: 1133561 - protein, 34 aa, Mycobacterium
DAFIRPYVYDEIAPWVPTLWRRELRAGHWSPMSH

SEQ ID NO: 1133562 - protein, 28 aa, Mycobacterium
DANAGHLHRAGITTPLIPASSTLRSHAV

SEQ ID NO: 1133563 - protein, 17 aa, Mycobacterium
DANLPTGILPAGGPFTE

SEQ ID NO: 1133564 - protein, 24 aa, Mycobacterium
DAQLPLHHPVLATVLWSLVLTAVF

SEQ ID NO: 1133565 - protein, 22 aa, Mycobacterium
DAQVFPPLEWAVEGIVPEGFGL

SEQ ID NO: 1133566 - protein, 27 aa, Mycobacterium
DARFLDALFPVWRYHPFFTDSDEPVDA

SEQ ID NO: 1133567 - protein, 22 aa, Mycobacterium
DARPVWARVLGRRLPRTGAADW

SEQ ID NO: 1133568 - protein, 22 aa, Mycobacterium
DAVLWRIHALSVLLVVPQAVVW

SEQ ID NO: 1133569 - protein, 24 aa, Mycobacterium
DAVRQFAMKLMQFGAAATAGAPDS

SEQ ID NO: 1133570 - protein, 26 aa, Mycobacterium
DCSGLTRFAFAGVGVLLPRWSGDQYD

SEQ ID NO: 1133571 - protein, 18 aa, Mycobacterium
DDPLQFYSRAVGAGIIIA

SEQ ID NO: 1133572 - protein, 26 aa, Mycobacterium
DDRPAVVPWYRRTPVALAIGAAAVLA

SEQ ID NO: 1133573 - protein, 26 aa, Mycobacterium
DDTLLTVLVIFCVVAAIALIGATAAG

SEQ ID NO: 1133574 - protein, 27 aa, Mycobacterium
DEALRPLLGMLPFDGLIGAPMLFGTRA

SEQ ID NO: 1133575 - protein, 23 aa, Mycobacterium
DEAPKITLLALAALPPAAVATTA

SEQ ID NO: 1133576 - protein, 17 aa, Mycobacterium
DEDGLLYVSGRDDEMIV

SEQ ID NO: 1133577 - protein, 23 aa, Mycobacterium
DEIIASKIWPGTRALAQMHLDAG

SEQ ID NO: 1133578 - protein, 17 aa, Mycobacterium
DFLIYGTAAALVFPRLF

SEQ ID NO: 1133579 - protein, 30 aa, Mycobacterium
DFMHGRVLLTPLFCLLLPVSVIPVVLPDGS

SEQ ID NO: 1133580 - protein, 21 aa, Mycobacterium
DGALLAWLTTAAVAIALLTLT

SEQ ID NO: 1133581 - protein, 23 aa, Mycobacterium
DGANQRFLTLNGPPPDQLATEDE

SEQ ID NO: 1133582 - protein, 32 aa, Mycobacterium
DGGLLALRIALLSLIIAWPAGLLLALISDSRW

SEQ ID NO: 1133583 - protein, 25 aa, Mycobacterium
DGLGLKFVLYLAFAGVLIGASVYQI

SEQ ID NO: 1133584 - protein, 24 aa, Mycobacterium
DGMATPRWLRRLPRRGWSAGLALG

SEQ ID NO: 1133585 - protein, 21 aa, Mycobacterium
DGNAALRWTLLTGAACNDAAV

SEQ ID NO: 1133586 - protein, 24 aa, Mycobacterium
DGNRPFIVMPYHARGSLAQRVRRE

SEQ ID NO: 1133587 - protein, 32 aa, Mycobacterium
DGPNKPLWFGVDAWRWMFLAMAVPAVVYGALA

SEQ ID NO: 1133588 - protein, 40 aa, Mycobacterium
DGSLTRRFSVLILLLCLFGLIVLLLRRGRLPGTFGGPVWR

SEQ ID NO: 1133589 - protein, 24 aa, Mycobacterium
DGVVFLLVSVLLLGVVRPVLRRRF

SEQ ID NO: 1133590 - protein, 24 aa, Mycobacterium
DHLAARGFAFYALDLHKCGRSHRD

SEQ ID NO: 1133591 - protein, 27 aa, Mycobacterium
DHRDTYDAMFDLFFPAALGGKTVLADD

SEQ ID NO: 1133592 - protein, 31 aa, Mycobacterium
DIAIAVPAHWGTATVYALRNALRTNPVFTSN

SEQ ID NO: 1133593 - protein, 19 aa, Mycobacterium
DIIITTALIPGRPAPRIIT

SEQ ID NO: 1133594 - protein, 31 aa, Mycobacterium
DINAVLPAKLILLAIAVICAVAVFSAIVLRD

SEQ ID NO: 1133595 - protein, 35 aa, Mycobacterium
DKRRRLRRPGWSTVVAVLAVFVTAASLAASGYVTW

SEQ ID NO: 1133596 - protein, 21 aa, Mycobacterium
DLASWVLYGLAAVITLAMPVA

SEQ ID NO: 1133597 - protein, 17 aa, Mycobacterium
DLDGPILLVLLDGYAPL

SEQ ID NO: 1133598 - protein, 21 aa, Mycobacterium
DLEGRLLAGLLAPYGDEPTPT

SEQ ID NO: 1133599 - protein, 18 aa, Mycobacterium
DLGGLYFNALVAVAITGL

SEQ ID NO: 1133600 - protein, 17 aa, Mycobacterium
DLHVWTLVPGKDVVTAH

SEQ ID NO: 1133601 - protein, 40 aa, Mycobacterium
DLIPDQVGWIVLQLSLAVALLAIWQGRRLGPLVAEQLPVV

SEQ ID NO: 1133602 - protein, 28 aa, Mycobacterium
DLPGRAFWRPLFVAPLAVPAFVNSYAWV

SEQ ID NO: 1133603 - protein, 28 aa, Mycobacterium
DNFFAWALSVMFLVFTLRAILYKPFVRQ

SEQ ID NO: 1133604 - protein, 17 aa, Mycobacterium
DPAGWLRHIVLPGLTVG

SEQ ID NO: 1133605 - protein, 23 aa, Mycobacterium
DPAQIWVLVFAMTMMAGLVVSLI

SEQ ID NO: 1133606 - protein, 28 aa, Mycobacterium
DPASIELPVLVLALVAVLLGLRTLIVVS

SEQ ID NO: 1133607 - protein, 38 aa, Mycobacterium
DPEARPRLILGAAMITLPALGLWHLWSGSPQAPGERQQ

SEQ ID NO: 1133608 - protein, 27 aa, Mycobacterium
DPFVELRFFRSIPFASATAIAVCAFAA

SEQ ID NO: 1133609 - protein, 18 aa, Mycobacterium
DPIAWWNPDLLFARPDWL

SEQ ID NO: 1133610 - protein, 17 aa, Mycobacterium
DPIIGLVITVAILAVLR

SEQ ID NO: 1133611 - protein, 24 aa, Mycobacterium
DPLRLRVGAALMLMLAYSASVGGL

SEQ ID NO: 1133612 - protein, 27 aa, Mycobacterium
DPLTDIGWMELLWMQPVGLTSHENALS

SEQ ID NO: 1133613 - protein, 20 aa, Mycobacterium
DPPRWLPDWLRPTGQRVRVD

SEQ ID NO: 1133614 - protein, 33 aa, Mycobacterium
DPSSPWYIGIYFALIIFFTYFYVSITFNPDERA

SEQ ID NO: 1133615 - protein, 29 aa, Mycobacterium
DPTGLSLPMFMEELFWGCAGIGLAIVMPA

SEQ ID NO: 1133616 - protein, 23 aa, Mycobacterium
DPVLLDWLVGLAFPCQRPFDHRN

SEQ ID NO: 1133617 - protein, 17 aa, Mycobacterium
DQAPPAAGLWPLVFARV

SEQ ID NO: 1133618 - protein, 25 aa, Mycobacterium
DQSFLPRLAILVVVAFFITVAVYGV

SEQ ID NO: 1133619 - protein, 18 aa, Mycobacterium
DQSSFIGYLLGLTGVAHL

SEQ ID NO: 1133620 - protein, 28 aa, Mycobacterium
DQTEAVLLLLRFLIALPIGALLGGWLAS

SEQ ID NO: 1133621 - protein, 20 aa, Mycobacterium
DRAWARLIGRHARSVQRHVR

SEQ ID NO: 1133622 - protein, 31 aa, Mycobacterium
DRHGRPFRRRNYVPGLLTIGALAVVALVVWV

SEQ ID NO: 1133623 - protein, 28 aa, Mycobacterium
DRKRNLFVQIGLTAVVVVFAVALVLYIV

SEQ ID NO: 1133624 - protein, 25 aa, Mycobacterium
DRKRYLWLMGLIAPTALFVMLPVVW

SEQ ID NO: 1133625 - protein, 20 aa, Mycobacterium
DRLIRLVDAFVWVLDPQKYA

SEQ ID NO: 1133626 - protein, 40 aa, Mycobacterium
DRSMRLIEMVTFTVIIVMLLLVYRSIVTVLLMLVTVVLSL

SEQ ID NO: 1133627 - protein, 25 aa, Mycobacterium
DRTSSMRWYPIVTFWQVGADMTNAS

SEQ ID NO: 1133628 - protein, 19 aa, Mycobacterium
DRVVALKVLPPHLAQDATF

SEQ ID NO: 1133629 - protein, 23 aa, Mycobacterium
DSALTIVVMLAVAVAVAALVDGA

SEQ ID NO: 1133630 - protein, 23 aa, Mycobacterium
DSKQTLLCTYLSAVLLAGLVLNS

SEQ ID NO: 1133631 - protein, 19 aa, Mycobacterium
DSLHHWLNLTLAAGGALVA

SEQ ID NO: 1133632 - protein, 19 aa, Mycobacterium
DSPWQVVVGLLMLAAAVGA

SEQ ID NO: 1133633 - protein, 28 aa, Mycobacterium
DSQGFVTLAWWMAVFPGAAIFVIVLAFN

SEQ ID NO: 1133634 - protein, 31 aa, Mycobacterium
DSVDLLKVVAVPLAKRFAPVVAGVAAGAAVG

SEQ ID NO: 1133635 - protein, 31 aa, Mycobacterium
DTDTPVTFVFYWVIPFLLVAAGALASRVLPE

SEQ ID NO: 1133636 - protein, 18 aa, Mycobacterium
DTFLWWLAAASLLGAGTA

SEQ ID NO: 1133637 - protein, 26 aa, Mycobacterium
DTGFWLWVAALPLLVIGYLIDNLMVP

SEQ ID NO: 1133638 - protein, 30 aa, Mycobacterium
DTKRVWLELTYFYGLGALIVFLGALALGRL

SEQ ID NO: 1133639 - protein, 21 aa, Mycobacterium
DTMARRLIGWAPGHPGTEEEV

SEQ ID NO: 1133640 - protein, 18 aa, Mycobacterium
DTPERPRRHPLLIRVWGL

SEQ ID NO: 1133641 - protein, 26 aa, Mycobacterium
DTRTGTWQPQPPLPIPLHHATAATYR

SEQ ID NO: 1133642 - protein, 25 aa, Mycobacterium
DTSDILWYLLVAHLIHFAVVPLVGW

SEQ ID NO: 1133643 - protein, 28 aa, Mycobacterium
DTSKPVRLTMFWPLADKPRLAAGIPGGT

SEQ ID NO: 1133644 - protein, 25 aa, Mycobacterium
DTTASWLAWVLALAVASPPILAVAM

SEQ ID NO: 1133645 - protein, 31 aa, Mycobacterium
DTVDAGLWVAFWFFLAQLNFVLGAVNLVPLL

SEQ ID NO: 1133646 - protein, 32 aa, Mycobacterium
DTWLQSWTIFYWAWWISWTPFVGMFIARISRG

SEQ ID NO: 1133647 - protein, 34 aa, Mycobacterium
DVAFPRLNAFSFWLFLFGALIALAGFITPGGAAD

SEQ ID NO: 1133648 - protein, 31 aa, Mycobacterium; identical to SEQ ID NO: 347550

SEQ ID NO: 1133649 - protein, 31 aa, Mycobacterium
DVAFPRLNALSFWLFVFGALIALAGFITPSG

SEQ ID NO: 1133650 - protein, 17 aa, Mycobacterium
DVDIIITTALIPGRPAP

SEQ ID NO: 1133651 - protein, 29 aa, Mycobacterium
DVGGVLWAPLLVALLLALLTAGSYAELVT

SEQ ID NO: 1133652 - protein, 23 aa, Mycobacterium
DVHWIIPALLMLALNAILTYFDV

SEQ ID NO: 1133653 - protein, 25 aa, Mycobacterium
DVKPENVLLNPDDFAYLVDFGIAHT

SEQ ID NO: 1133654 - protein, 17 aa, Mycobacterium
DVLFLTAGIVVGILAGL

SEQ ID NO: 1133655 - protein, 40 aa, Mycobacterium
DVLLSVVLPPLLYSAALSFSFPTFLRNIRPILGLGVGLVV

SEQ ID NO: 1133656 - protein, 40 aa, Mycobacterium
DVPGMPRLLRWLSPFIPLVAGPLPIPFFFGVLAGEEPIDH

SEQ ID NO: 1133657 - protein, 18 aa, Mycobacterium
DVPNLAWCVGYINASWTL

SEQ ID NO: 1133658 - protein, 39 aa, Mycobacterium
DVPSPWVRITKRIVIAFAVLCAVVLIVYIDRDGYRDTQT

SEQ ID NO: 1133659 - protein, 25 aa, Mycobacterium
DVRRFVRRILRRPPPTPRPVERSFW

SEQ ID NO: 1133660 - protein, 19 aa, Mycobacterium
DVTDFPKLAAPLSVGDDAA

SEQ ID NO: 1133661 - protein, 17 aa, Mycobacterium
DVVVAVFVALWVLPRAI

SEQ ID NO: 1133662 - protein, 17 aa, Mycobacterium
DVYTLVLASLLILAGAT

SEQ ID NO: 1133663 - protein, 22 aa, Mycobacterium
DWFEVERPDLARLAPHGRVAIL

SEQ ID NO: 1133664 - protein, 26 aa, Mycobacterium
DYADILYISPILLIVGVAMAGVTAYV

SEQ ID NO: 1133665 - protein, 33 aa, Mycobacterium
DYFGALVGGLLWPFLLLPHLGMIRGAAATGVIN

SEQ ID NO: 1133666 - protein, 51 aa, Mycobacterium
DYYERDIRFIIIVTLIVVLLTLAVLLRSLIAPLYLVGSVVLSYFAAIGIGV

SEQ ID NO: 1133667 - protein, 19 aa, Mycobacterium
EAALKYFLLGAFSSAFFLY

SEQ ID NO: 1133668 - protein, 28 aa, Mycobacterium
EAAQRGFYSPLFYRDLIGDPTGLSLPMF

SEQ ID NO: 1133669 - protein, 20 aa, Mycobacterium
EAELIGWIHAAADAGEPVVL

SEQ ID NO: 1133670 - protein, 22 aa, Mycobacterium
EAELLALFAGAVLRGADLTVLL

SEQ ID NO: 1133671 - protein, 35 aa, Mycobacterium
EAFYLFSCRSLTRSAWRIGLFTNRWLIAGVAVQAV

SEQ ID NO: 1133672 - protein, 28 aa, Mycobacterium
EASIGWALYALIVLSLLQAGSAVAALLF

SEQ ID NO: 1133673 - protein, 24 aa, Mycobacterium
EAVGLLIAVDWFAGIFRTFLNVNG

SEQ ID NO: 1133674 - protein, 31 aa, Mycobacterium
EAVNNGFYYNAFIGNLIPGGALQPFLDYALG

SEQ ID NO: 1133675 - protein, 18 aa, Mycobacterium
ECGHMWVARATGMKVRRY

SEQ ID NO: 1133676 - protein, 43 aa, Mycobacterium
EDAMDWLQAFLPYIGFLCIIGLLSYHLLIGRDMPKLVIAVAVV

SEQ ID NO: 1133677 - protein, 26 aa, Mycobacterium
EDGGPFLFIQALLRTATIPTYLSDDW

SEQ ID NO: 1133678 - protein, 24 aa, Mycobacterium
EDKFFATVFLGSGLLFLAMMFVAA

SEQ ID NO: 1133679 - protein, 29 aa, Mycobacterium
EDMLASFVFLRRLLLLAWMGTHSHSKESK

SEQ ID NO: 1133680 - protein, 17 aa, Mycobacterium
EDQWFGFTPPRVPVLQT

SEQ ID NO: 1133681 - protein, 18 aa, Mycobacterium
EEAFAMAGGWHAGLGLLA

SEQ ID NO: 1133682 - protein, 18 aa, Mycobacterium
EELFRRIFETSVAGMLIA

SEQ ID NO: 1133683 - protein, 20 aa, Mycobacterium
EELLFFIVIPLCGLFTYNAV

SEQ ID NO: 1133684 - protein, 24 aa, Mycobacterium
EFQAVQFMPLVIAPQLLLCGIIVP

SEQ ID NO: 1133685 - protein, 23 aa, Mycobacterium
EGFGLLVAPPKAGKSWMVAGIGL

SEQ ID NO: 1133686 - protein, 18 aa, Mycobacterium
EGKGMVLFWIVWGGALAG

SEQ ID NO: 1133687 - protein, 30 aa, Mycobacterium
EGLAALIFTRYLWAFELTGALLITAALGAM

SEQ ID NO: 1133688 - protein, 22 aa, Mycobacterium
EGLGFVWRTPVLRTLAVVDLVA

SEQ ID NO: 1133689 - protein, 25 aa, Mycobacterium
EGMGTTLTAILFAGNRLGLVHIGDS

SEQ ID NO: 1133690 - protein, 29 aa, Mycobacterium
EGTMLLRLCMLPGLILLIWAAPRVARHIG

SEQ ID NO: 1133691 - protein, 27 aa, Mycobacterium
EHRPSAKAPLLWAASAALPWLVLVVAQ

SEQ ID NO: 1133692 - protein, 26 aa, Mycobacterium
EIGVLPLWQIWTILGLLAVLGLRDKV

SEQ ID NO: 1133693 - protein, 22 aa, Mycobacterium
EIVMWLPLPLLGVPPWMVFAGF

SEQ ID NO: 1133694 - protein, 20 aa, Mycobacterium
EIWVRGENVCLGYWGKPEQT

SEQ ID NO: 1133695 - protein, 21 aa, Mycobacterium
EKKTYPLFDPIAQKAYDANYD

SEQ ID NO: 1133696 - protein, 31 aa, Mycobacterium
ELFGLSMPGWVWWLILYAIFVGLNSWGAALS

SEQ ID NO: 1133697 - protein, 19 aa, Mycobacterium
ELGQPIAIEYVWGRQIGEN

SEQ ID NO: 1133698 - protein, 19 aa, Mycobacterium
ELIHWLYDFAFLSFSGTMG

SEQ ID NO: 1133699 - protein, 20 aa, Mycobacterium
ELPGYWAPFASPAFTLLAIV

SEQ ID NO: 1133700 - protein, 21 aa, Mycobacterium
ELPLFVLVVLGLTLGGFAVTS

SEQ ID NO: 1133701 - protein, 20 aa, Mycobacterium
ELPRNPTGKILKRELREMDV

SEQ ID NO: 1133702 - protein, 22 aa, Mycobacterium
ELYDTWWRIPVLLAMSFANGWA

SEQ ID NO: 1133703 - protein, 30 aa, Mycobacterium
ENGLVLAYLGLLWWMLVCWSQGLRSPSGPG

SEQ ID NO: 1133704 - protein, 22 aa, Mycobacterium
EPEGFSVFGVFWGAFGLASGAA

SEQ ID NO: 1133705 - protein, 43 aa, Mycobacterium
EPHRRRRIILAGRAAAALLAVLALVLTGGAWQWQTSKNGLMNR

SEQ ID NO: 1133706 - protein, 21 aa, Mycobacterium
EPLIAFAVIAVWMLVENTIGT

SEQ ID NO: 1133707 - protein, 24 aa, Mycobacterium
EPMTRVLFYYFLLSTVLSVPIAAF

SEQ ID NO: 1133708 - protein, 43 aa, Mycobacterium
EPPPELPRLVPPSLLRRVLPYLIVLLIVGMIVALIATGMRLIS

SEQ ID NO: 1133709 - protein, 22 aa, Mycobacterium
EPRLRALGWTGVLDKGGDVQNS

SEQ ID NO: 1133710 - protein, 20 aa, Mycobacterium
EPYLLGCLNARNELSLISAG

SEQ ID NO: 1133711 - protein, 26 aa, Mycobacterium
EQFLSWGWRIPFLASAVLIVIGLVIR

SEQ ID NO: 1133712 - protein, 22 aa, Mycobacterium
EQIMPLLVVAVMSQLVFSGGMI

SEQ ID NO: 1133713 - protein, 24 aa, Mycobacterium
EQPPRAWRMRLTVQRVDDGAKVSQ

SEQ ID NO: 1133714 - protein, 24 aa, Mycobacterium
EQPWTPIIVIIVVTTVKVIASLAA

SEQ ID NO: 1133715 - protein, 19 aa, Mycobacterium
ERLIAWKDAIIAFSLTTDP

SEQ ID NO: 1133716 - protein, 34 aa, Mycobacterium
ERLTGWLIALALCVPAALFLFPPRHHDDLRRHAA

SEQ ID NO: 1133717 - protein, 39 aa, Mycobacterium
ERMKFATWLVFGGIWVTLVYFPLSHMVWGGGLLSGAENG

SEQ ID NO: 1133718 - protein, 26 aa, Mycobacterium
ERPHPYPRWVATAGWAGFALGIAMLL

SEQ ID NO: 1133719 - protein, 33 aa, Mycobacterium
ERPRRHPLLIRVWGLIRLDYTGIAFGALFFCLS

SEQ ID NO: 1133720 - protein, 25 aa, Mycobacterium
ERPRYINLIVLLRIACEVTATVLLA

SEQ ID NO: 1133721 - protein, 25 aa, Mycobacterium
ERRSARLARGLLALGAGKGTHVGLL

SEQ ID NO: 1133722 - protein, 21 aa, Mycobacterium
ERTFLAWIRTSLALIAGGIAV

SEQ ID NO: 1133723 - protein, 19 aa, Mycobacterium
ESDLDYAVRHTARLALLVR

SEQ ID NO: 1133724 - protein, 32 aa, Mycobacterium
ESESRRMGLLVEDLLLLARLDAQRPLERHRVD

SEQ ID NO: 1133725 - protein, 31 aa, Mycobacterium
ESFPGLHPERLLAVFLGLPLLVALGVCLVRQ

SEQ ID NO: 1133726 - protein, 29 aa, Mycobacterium
ESKSKVALYLLITIAPFAVIAPLIGPALD

SEQ ID NO: 1133727 - protein, 31 aa, Mycobacterium
ESLTIGLIWLAIGFLWLLGVTRGFRRPTPVL

SEQ ID NO: 1133728 - protein, 26 aa, Mycobacterium
ESVALLWFLGVYLIALAFVPALTRLR

SEQ ID NO: 1133729 - protein, 26 aa, Mycobacterium
ETAFALSPLAFPVLILGGTLPLYLPK

SEQ ID NO: 1133730 - protein, 22 aa, Mycobacterium
ETAMWLAVPYLVIGVGFTFLHP

SEQ ID NO: 1133731 - protein, 26 aa, Mycobacterium
ETERIWLPFTMWLVAAGALLPVRAQR

SEQ ID NO: 1133732 - protein, 30 aa, Mycobacterium
EVAELDLPAWWRQIAWLPHRPVLVPGTVRD

SEQ ID NO: 1133733 - protein, 26 aa, Mycobacterium
EVEDQLFRFSRILDSESRLSGVLSDY

SEQ ID NO: 1133734 - protein, 19 aa, Mycobacterium
EWIVYLALLGIGGGVLVGL

SEQ ID NO: 1133735 - protein, 36 aa, Mycobacterium
EWVETIALLLHIAVMLVFLLIVLHSKHLHIGLAPIN

SEQ ID NO: 1133736 - protein, 31 aa, Mycobacterium
EWVQTFSMWWGPLGALLYFTGVVAVVFVAAA

SEQ ID NO: 1133737 - protein, 26 aa, Mycobacterium
EYKFGFTTILLGFSVLALLAAAWFHF

SEQ ID NO: 1133738 - protein, 19 aa, Mycobacterium
EYQPYGSEGEFLYSLATPL

SEQ ID NO: 1133739 - protein, 25 aa, Mycobacterium
FAATDRFDAAWWALAATAAVVVVWV

SEQ ID NO: 1133740 - protein, 28 aa, Mycobacterium
FAAVAWFLRFLVRHGMYWFVGYRVVLGV

SEQ ID NO: 1133741 - protein, 17 aa, Mycobacterium
FADRRFTLAQTDSAATL

SEQ ID NO: 1133742 - protein, 18 aa, Mycobacterium
FAIFAVVAVALVGARLVT

SEQ ID NO: 1133743 - protein, 19 aa, Mycobacterium
FAILVLTVALYWPSPTMVN

SEQ ID NO: 1133744 - protein, 26 aa, Mycobacterium
FALALPFVLAWPFWALGKLCGVPWKV

SEQ ID NO: 1133745 - protein, 18 aa, Mycobacterium
FALDLTGTFVFGLNGALT

SEQ ID NO: 1133746 - protein, 25 aa, Mycobacterium
FAMQALAVLVLWTTVRLPGAPDYAN

SEQ ID NO: 1133747 - protein, 19 aa, Mycobacterium
FAMTMWKMLRRNPPPPPPD

SEQ ID NO: 1133748 - protein, 17 aa, Mycobacterium
FARFMREPDRMNELAKA

SEQ ID NO: 1133749 - protein, 30 aa, Mycobacterium
FARNAALFVLPFLTAYFAWKRQMSPRAAAA

SEQ ID NO: 1133750 - protein, 25 aa, Mycobacterium
FAVFAYPLFALFNTGSLLGAIAGHA

SEQ ID NO: 1133751 - protein, 19 aa, Mycobacterium
FAVGLGFFAVGYTGLGLTT

SEQ ID NO: 1133752 - protein, 21 aa, Mycobacterium
FDALHFAKPIFGPAARALAQL

SEQ ID NO: 1133753 - protein, 26 aa, Mycobacterium
FDTWPGLIIPYITFALPLAIYTLSAF

SEQ ID NO: 1133754 - protein, 25 aa, Mycobacterium
FEEYKRVLVATGKLLGLVAVVLLVT

SEQ ID NO: 1133755 - protein, 19 aa, Mycobacterium
FEGYEYLFWVGCAGAYEDR

SEQ ID NO: 1133756 - protein, 18 aa, Mycobacterium
FELALFRDSSFKEAWSYV

SEQ ID NO: 1133757 - protein, 20 aa, Mycobacterium
FETPMLFSVGFLLTFLLGGL

SEQ ID NO: 1133758 - protein, 20 aa, Mycobacterium
FFDTELLVLAERSGLRIHEV

SEQ ID NO: 1133759 - protein, 30 aa, Mycobacterium; identical to SEQ ID NO: 354239

SEQ ID NO: 1133760 - protein, 18 aa, Mycobacterium
FFGGRLLRMLLTQGAPLR

SEQ ID NO: 1133761 - protein, 35 aa, Mycobacterium
FFGTATGLVFVWFSLTPSLLPRGPLFQGLVSGGAG

SEQ ID NO: 1133762 - protein, 24 aa, Mycobacterium
FFPAYSAILPRILPAEALLAANGV

SEQ ID NO: 1133763 - protein, 17 aa, Mycobacterium
FFVLHGQDDSIIPVGEG

SEQ ID NO: 1133764 - protein, 24 aa, Mycobacterium
FGARRRGLLAVYAREHRSLSPLAT

SEQ ID NO: 1133765 - protein, 30 aa, Mycobacterium
FGATTALFQWGWFQQLIGLSATGPILSMLP

SEQ ID NO: 1133766 - protein, 17 aa, Mycobacterium
FGFTPPRVPVLQTASEF

SEQ ID NO: 1133767 - protein, 30 aa, Mycobacterium
FGGRNWTVFSAFVLLIPTLGTMVLLANPGL

SEQ ID NO: 1133768 - protein, 23 aa, Mycobacterium
FGHDPWWLILAKAVGVFVFLVLT

SEQ ID NO: 1133769 - protein, 25 aa, Mycobacterium
FGITTVYHFIFVPLTIGLAPILAVM

SEQ ID NO: 1133770 - protein, 19 aa, Mycobacterium
FGKLFLINFAIGVATGIVQ

SEQ ID NO: 1133771 - protein, 19 aa, Mycobacterium
FGLALAWLATVWATAMLAG

SEQ ID NO: 1133772 - protein, 23 aa, Mycobacterium
FGLHGWQWMFLIEGLVTVLVGVL

SEQ ID NO: 1133773 - protein, 40 aa, Mycobacterium
FGQTRLLRWSIPGIAHFFTMWGFFILASVYLEAYGLLFDH

SEQ ID NO: 1133774 - protein, 33 aa, Mycobacterium
FGTPVVMHLFYVVKILLYILGGWLFALATHGVD

SEQ ID NO: 1133775 - protein, 19 aa, Mycobacterium
FGTYALRPFGLQGSAILVP

SEQ ID NO: 1133776 - protein, 17 aa, Mycobacterium
FIDSAWNLAFGVLPPYW

SEQ ID NO: 1133777 - protein, 17 aa, Mycobacterium
FIELWMLAGGPAAVCSL

SEQ ID NO: 1133778 - protein, 18 aa, Mycobacterium
FIGTFWLVFGGCGSAVFA

SEQ ID NO: 1133779 - protein, 18 aa, Mycobacterium
FITLTYVLVDLVTGDFRV

SEQ ID NO: 1133780 - protein, 20 aa, Mycobacterium
FIYCVIVFTALIDWIVWHHP

SEQ ID NO: 1133781 - protein, 20 aa, Mycobacterium
FKLTPWIVVAIFVFGAAMAT

SEQ ID NO: 1133782 - protein, 23 aa, Mycobacterium
FLDQRINLEFDLTFSPRQLCSPT

SEQ ID NO: 1133783 - protein, 36 aa, Mycobacterium
FLDQTWMIARVSLIPTLLVAIPFTVLVAFTLNILLR

SEQ ID NO: 1133784 - protein, 17 aa, Mycobacterium
FLFTQRTLRPLMAVLTT

SEQ ID NO: 1133785 - protein, 25 aa, Mycobacterium
FLGLPINFLMFSILVVVTAAATVPV

SEQ ID NO: 1133786 - protein, 20 aa, Mycobacterium
FLLTVGMWFAFGVAAVAIFE

SEQ ID NO: 1133787 - protein, 24 aa, Mycobacterium
FLNDKLGWFFLFSEGNVSLAGGGT

SEQ ID NO: 1133788 - protein, 20 aa, Mycobacterium
FLPGFIPPDVDMNMVIADVG

SEQ ID NO: 1133789 - protein, 20 aa, Mycobacterium
FLSWGWRVAFWLSAVVVLIG

SEQ ID NO: 1133790 - protein, 19 aa, Mycobacterium
FLTWGWRVPFLLSAVMVAL

SEQ ID NO: 1133791 - protein, 18 aa, Mycobacterium
FLVALAIGLLLGLERERS

SEQ ID NO: 1133792 - protein, 27 aa, Mycobacterium
FLVETLVLVIFVLVLRTLPAEAEKAHI

SEQ ID NO: 1133793 - protein, 25 aa, Mycobacterium
FLVMPGLALAFLVAAPVALWRRIGT

SEQ ID NO: 1133794 - protein, 32 aa, Mycobacterium
FLYSLATPLYGLLFGLSILAIGIGAVLYQKRF

SEQ ID NO: 1133795 - protein, 19 aa, Mycobacterium
FMGTLLFNVSTGAAVWAHA

SEQ ID NO: 1133796 - protein, 35 aa, Mycobacterium
FNPGMPLSFLPFMPLVWVAIRLTTRELILLMLAIA

SEQ ID NO: 1133797 - protein, 17 aa, Mycobacterium
FPALFALAAVTVRRLPG

SEQ ID NO: 1133798 - protein, 26 aa, Mycobacterium
FPHYTFLAFWAIHLLVVWAAIYLTWG

SEQ ID NO: 1133799 - protein, 28 aa, Mycobacterium
FPYVDFLQMQLIAVLFFAAVLPLSGLCA

SEQ ID NO: 1133800 - protein, 24 aa, Mycobacterium
FQTPMLFSVGFLLTFLLGGLSGVL

SEQ ID NO: 1133801 - protein, 17 aa, Mycobacterium
FQYWGWANLASVVCAIG

SEQ ID NO: 1133802 - protein, 30 aa, Mycobacterium
FRAVPVLIMMIFAYFLYAFYDVFPSKHLAL

SEQ ID NO: 1133803 - protein, 24 aa, Mycobacterium
FRDTIWLPTKWLLAGGDPYDGAAY

SEQ ID NO: 1133804 - protein, 26 aa, Mycobacterium
FRRRLSAAVLLLVGLGVAGGVAATLT

SEQ ID NO: 1133805 - protein, 22 aa, Mycobacterium
FRRSWKPWLRGTAYGFPFGALP

SEQ ID NO: 1133806 - protein, 25 aa, Mycobacterium
FRVVLPQLRLAILGGALLIAVHLLA

SEQ ID NO: 1133807 - protein, 18 aa, Mycobacterium
FRWISLGAGLAILTWIVA

SEQ ID NO: 1133808 - protein, 26 aa, Mycobacterium
FSAADKPVIFWTPATGARVVRGAINA

SEQ ID NO: 1133809 - protein, 43 aa, Mycobacterium
FSDLVMMKYLAFGLLLALLLDATIIRMFLVPAIMKMLGDDCWW

SEQ ID NO: 1133810 - protein, 33 aa, Mycobacterium
FSGKVSRPALALLGVLALAVGLAGGWMGSKTAS

SEQ ID NO: 1133811 - protein, 27 aa, Mycobacterium
FSIVALLTRRWAIAWVALAGSAVASAM

SEQ ID NO: 1133812 - protein, 18 aa, Mycobacterium
FTAIVVTFFLLKDGPRFI

SEQ ID NO: 1133813 - protein, 29 aa, Mycobacterium
FTGPESVLVWAWLAGILLLVIVSVRLSVL

SEQ ID NO: 1133814 - protein, 19 aa, Mycobacterium
FTIEARALTFQPVKVRKQL

SEQ ID NO: 1133815 - protein, 24 aa, Mycobacterium
FTLKWRAWTWLLAGLASIVPLGTV

SEQ ID NO: 1133816 - protein, 19 aa, Mycobacterium
FTLPELIDGGLLALRIALL

SEQ ID NO: 1133817 - protein, 18 aa, Mycobacterium
FTLVWLMSERGWSAASAG

SEQ ID NO: 1133818 - protein, 24 aa, Mycobacterium
FTRINAILGVLFAIVLSTGSLING

SEQ ID NO: 1133819 - protein, 25 aa, Mycobacterium
FTVQDSLFWMAFIGAIAAAAVVIPA

SEQ ID NO: 1133820 - protein, 27 aa, Mycobacterium
FVAVVMVALPRLHPGAPASLLAVVGAT

SEQ ID NO: 1133821 - protein, 18 aa, Mycobacterium
FVGAELLAAFFWTAYLFG

SEQ ID NO: 1133822 - protein, 18 aa, Mycobacterium
FVIGLVLVYAIAVIWGLP

SEQ ID NO: 1133823 - protein, 24 aa, Mycobacterium
FVKPILLAFVIGFLASFLALQASG

SEQ ID NO: 1133824 - protein, 19 aa, Mycobacterium
FVLPLAAWPGPWLAVAWVI

SEQ ID NO: 1133825 - protein, 25 aa, Mycobacterium
FVPALDMLLAIIRRTRAGLSPFSPD

SEQ ID NO: 1133826 - protein, 32 aa, Mycobacterium
FVPVVIGLSLLTLAGWLLVGGPVSAAFTAAVA

SEQ ID NO: 1133827 - protein, 25 aa, Mycobacterium
FVTRHQVSGWRFVMRRTASGVALHD

SEQ ID NO: 1133828 - protein, 26 aa, Mycobacterium
FVVSGFLITGLLWRQVAAGGGVRLGA

SEQ ID NO: 1133829 - protein, 21 aa, Mycobacterium
FWDHPLTAVLAIVVLFALVEV

SEQ ID NO: 1133830 - protein, 18 aa, Mycobacterium
FYFFPEQLAMDRYRDADG

SEQ ID NO: 1133831 - protein, 31 aa, Mycobacterium
GAALINAFAWVFYLFALILLLTAGQLIKPDD

SEQ ID NO: 1133832 - protein, 21 aa, Mycobacterium
GAALTEIRRVLSPGGRLLVVE

SEQ ID NO: 1133833 - protein, 29 aa, Mycobacterium
GAAVVRWPGPILLLTIALSLIGLLTLPGY

SEQ ID NO: 1133834 - protein, 26 aa, Mycobacterium
GADFAWFPLANPGIVSIPLAFILGIV

SEQ ID NO: 1133835 - protein, 17 aa, Mycobacterium
GADILRKAGYRPALIVG

SEQ ID NO: 1133836 - protein, 17 aa, Mycobacterium
GADVWLLAALAAPLLTA

SEQ ID NO: 1133837 - protein, 23 aa, Mycobacterium
GAEVPLLMTLLQRGRTAGAADSG

SEQ ID NO: 1133838 - protein, 23 aa, Mycobacterium
GAGITAGAALYRAPARPGAGGRI

SEQ ID NO: 1133839 - protein, 32 aa, Mycobacterium
GAGVPGGWLTISVLVLLILVAVVVAVRIARRA

SEQ ID NO: 1133840 - protein, 37 aa, Mycobacterium
GAIARRVAFLFTALSLFASLFIMLRRKRIPGVARGPA

SEQ ID NO: 1133841 - protein, 49 aa, Mycobacterium
GAIGGAIFFVIVLIAMVPKPVWIAIGIGVAVIVLGWVAYRIFEAVEKSR

SEQ ID NO: 1133842 - protein, 29 aa, Mycobacterium
GAKIIQYWIDVPLWASSLVFMVLMTATNL

SEQ ID NO: 1133843 - protein, 21 aa, Mycobacterium
GAKRMQVLINDLLTFSRVGRL

SEQ ID NO: 1133844 - protein, 18 aa, Mycobacterium
GALCFLAAALLVLPPKRS

SEQ ID NO: 1133845 - protein, 25 aa, Mycobacterium
GALGSLVFLYPLYKTVWPLQTGIYG

SEQ ID NO: 1133846 - protein, 21 aa, Mycobacterium
GALLRIFYVALPELRDDWRPV

SEQ ID NO: 1133847 - protein, 24 aa, Mycobacterium
GALQSAGLLFFAFAGYARIATLGE

SEQ ID NO: 1133848 - protein, 24 aa, Mycobacterium
GALSAALVLLVTLLIRADGIETTT

SEQ ID NO: 1133849 - protein, 31 aa, Mycobacterium
GAMALRYAMFIILLMVIFYFSYRSARFSTVE

SEQ ID NO: 1133850 - protein, 25 aa, Mycobacterium
GAMALVVVLVVAIIVVVMRKPDTPD

SEQ ID NO: 1133851 - protein, 24 aa, Mycobacterium
GAMTLYLWHIPAIAIAAFSLHAVG

SEQ ID NO: 1133852 - protein, 25 aa, Mycobacterium
GANIPAIIRGLIAVAWYGIQTYLAS

SEQ ID NO: 1133853 - protein, 29 aa, Mycobacterium
GANNWTILTRIILPALLPSLLSGAGLAFS

SEQ ID NO: 1133854 - protein, 17 aa, Mycobacterium
GAPARLDDARFLLPVLG

SEQ ID NO: 1133855 - protein, 28 aa, Mycobacterium
GAPRSTWQLILDNLWPLARAALTMTIPL

SEQ ID NO: 1133856 - protein, 24 aa, Mycobacterium
GAQLSFPMLSFTLLGALCLVGTVW

SEQ ID NO: 1133857 - protein, 33 aa, Mycobacterium
GARFVNIVVITPLRVAFLIVLIGTTVETLTTES

SEQ ID NO: 1133858 - protein, 30 aa, Mycobacterium
GARYSSGGFIFLGPGFFPGSPSGGSGGSPG

SEQ ID NO: 1133859 - protein, 27 aa, Mycobacterium
GASAVHYLPVRRRGRFLVALGMGGMGY

SEQ ID NO: 1133860 - protein, 29 aa, Mycobacterium
GATLPILPTQILWINMTTAVALGLMLAFE

SEQ ID NO: 1133861 - protein, 19 aa, Mycobacterium
GATVSLLMWPRGASATVTA

SEQ ID NO: 1133862 - protein, 25 aa, Mycobacterium
GAVAAFVAFFVWERFARTRLIEPAG

SEQ ID NO: 1133863 - protein, 26 aa, Mycobacterium
GAVAAVGLLWVLFGFSMVFGTSYGGF

SEQ ID NO: 1133864 - protein, 31 aa, Mycobacterium
GAVLFTIGNLAFFFLVPALAGYIAFAIADRP

SEQ ID NO: 1133865 - protein, 20 aa, Mycobacterium
GAVSRWRWLLSAVAAAMLGA

SEQ ID NO: 1133866 - protein, 26 aa, Mycobacterium
GDAPFGYLDWLRWFGYTLVGNIVGGL

SEQ ID NO: 1133867 - protein, 23 aa, Mycobacterium
GDGLHRLRWPVDHPPVTELVEVG

SEQ ID NO: 1133868 - protein, 18 aa, Mycobacterium
GDHILFYGRALAGTPHAA

SEQ ID NO: 1133869 - protein, 31 aa, Mycobacterium
GDHVAQFRRLFWVNLVIAIPVVAFSTMFAML

SEQ ID NO: 1133870 - protein, 24 aa, Mycobacterium
GDLKYLFFGLALVVLMIFRPQGLF

SEQ ID NO: 1133871 - protein, 25 aa, Mycobacterium
GDTPWLLYGVIGISAAVIAAAVPLL

SEQ ID NO: 1133872 - protein, 24 aa, Mycobacterium
GDYTTIAGLVLSLLGRIPTVPGDR

SEQ ID NO: 1133873 - protein, 23 aa, Mycobacterium
GEAPVLDPLPRWVRAEVLSTGDL

SEQ ID NO: 1133874 - protein, 27 aa, Mycobacterium
GEEQAPPRWPWVVGVTAIIAAISLVVS

SEQ ID NO: 1133875 - protein, 17 aa, Mycobacterium
GEFLYSLATPLYGLLFG

SEQ ID NO: 1133876 - protein, 21 aa, Mycobacterium
GEFRSLAHLEAKPLKIGHKIV

SEQ ID NO: 1133877 - protein, 24 aa, Mycobacterium
GEIPLVLVLLALLIQWRRSDDRDA

SEQ ID NO: 1133878 - protein, 19 aa, Mycobacterium
GELDRWLDWYLGEGSNTMR

SEQ ID NO: 1133879 - protein, 27 aa, Mycobacterium
GEPIQDPRMILPQNKFPFIPPQVDPDP

SEQ ID NO: 1133880 - protein, 28 aa, Mycobacterium
GESAVFFVGVLLVALLGGVAPAALSAVL

SEQ ID NO: 1133881 - protein, 30 aa, Mycobacterium
GESKGYFLLGIWMSLFWASVFALSVLIRRP

SEQ ID NO: 1133882 - protein, 23 aa, Mycobacterium
GEWAITLFNILLVTGSFACGMAF

SEQ ID NO: 1133883 - protein, 25 aa, Mycobacterium
GFAAALFRLLAIATGLFAATRLAAL

SEQ ID NO: 1133884 - protein, 29 aa, Mycobacterium
GFADSPVWRPMIIILGLATMLLAGWRAVR

SEQ ID NO: 1133885 - protein, 22 aa, Mycobacterium
GFALFVFWLLLIARVVVEFIRS

SEQ ID NO: 1133886 - protein, 28 aa, Mycobacterium
GFATLWAVLVYFPVAHWVFAFDGVVTEN

SEQ ID NO: 1133887 - protein, 20 aa, Mycobacterium
GFDLVPYYPVILTGFLLLTS

SEQ ID NO: 1133888 - protein, 18 aa, Mycobacterium
GFEFQVTLIVIAAALILT

SEQ ID NO: 1133889 - protein, 25 aa, Mycobacterium
GFEHSVVNMFLFPSGLMLGGDFSIM

SEQ ID NO: 1133890 - protein, 21 aa, Mycobacterium
GFELTLAAPTFTWDQATYSDK

SEQ ID NO: 1133891 - protein, 17 aa, Mycobacterium
GFFLLLLPAGSLEILAH

SEQ ID NO: 1133892 - protein, 26 aa, Mycobacterium
GFGGPVGVLFAVVFLLTGRGNARLAA

SEQ ID NO: 1133893 - protein, 26 aa, Mycobacterium
GFGMGLDIAWLLPAALICLGAALLLT

SEQ ID NO: 1133894 - protein, 19 aa, Mycobacterium
GFLATFIAAKFFPAGNDTA

SEQ ID NO: 1133895 - protein, 30 aa, Mycobacterium
GFLHTLIAVSIVWWPFYARLVRGEITRLAA

SEQ ID NO: 1133896 - protein, 18 aa, Mycobacterium
GFLLAFFARETLPVYLVQ

SEQ ID NO: 1133897 - protein, 18 aa, Mycobacterium
GFVAWLIGVFYKNLYVEA

SEQ ID NO: 1133898 - protein, 20 aa, Mycobacterium
GFVLALAIVTFLHLVIGEMA

SEQ ID NO: 1133899 - protein, 21 aa, Mycobacterium
GFVVFVLWLALGRYGNIPLGR

SEQ ID NO: 1133900 - protein, 24 aa, Mycobacterium
GGAAALVAWWMWEKRRIHPLVSTR

SEQ ID NO: 1133901 - protein, 25 aa, Mycobacterium
GGAAWLPFLVAFLIATITAFSYLEL

SEQ ID NO: 1133902 - protein, 29 aa, Mycobacterium
GGALPSIPAFLWGLLFIGGLTATFGGGDP

SEQ ID NO: 1133903 - protein, 27 aa, Mycobacterium
GGDALKAFWYHFAIMFEALFILTTVDA

SEQ ID NO: 1133904 - protein, 34 aa, Mycobacterium
GGGMLLCVSFPPFGWWYCAFISAALLAWVLRQDS

SEQ ID NO: 1133905 - protein, 26 aa, Mycobacterium
GGIGGLLIVVVALFLGVDPGTVLPEQ

SEQ ID NO: 1133906 - protein, 20 aa, Mycobacterium
GGLAALAPAFRRLSDGRDSP

SEQ ID NO: 1133907 - protein, 22 aa, Mycobacterium
GGLAFVYFLVMSTFALAIGLVV

SEQ ID NO: 1133908 - protein, 17 aa, Mycobacterium
GGLAMLVGIIILGNLAG

SEQ ID NO: 1133909 - protein, 24 aa, Mycobacterium
GGLCAATLWVVRWPTRAQSVAYIL

SEQ ID NO: 1133910 - protein, 24 aa, Mycobacterium
GGLDLPFTYPPLAAIVFSPFAVMS

SEQ ID NO: 1133911 - protein, 18 aa, Mycobacterium
GGLFAAMLPMAVGALAIV

SEQ ID NO: 1133912 - protein, 27 aa, Mycobacterium
GGLIYNWIIFMILPLYVSLEKIDPRLI

SEQ ID NO: 1133913 - protein, 23 aa, Mycobacterium
GGPPYFVTSLLDHPDCTPEHIAR

SEQ ID NO: 1133914 - protein, 17 aa, Mycobacterium
GGQYLLDILDPATPPEL

SEQ ID NO: 1133915 - protein, 53 aa, Mycobacterium
GGSGWWIGLFNIVCATLFLGIPLLYRLGELIAPLTFFVLAYLSVTFICYSIGT

SEQ ID NO: 1133916 - protein, 23 aa, Mycobacterium
GGTFLFSHLFDMQSMTAVLALML

SEQ ID NO: 1133917 - protein, 25 aa, Mycobacterium
GGVAVYLWRMWVSRGRPGGVAAAAG

SEQ ID NO: 1133918 - protein, 21 aa, Mycobacterium
GGVLILLLFRDAFGAAVCACA

SEQ ID NO: 1133919 - protein, 26 aa, Mycobacterium
GGVLLWQHLFWFFGHPEVYVIALPFF

SEQ ID NO: 1133920 - protein, 17 aa, Mycobacterium
GGVPIGNWLTRSLFAAK

SEQ ID NO: 1133921 - protein, 20 aa, Mycobacterium
GGWATMLPYVQRWPTRVQSL

SEQ ID NO: 1133922 - protein, 25 aa, Mycobacterium
GHAWWAYPLLLAFCTFDAVVPVIPS

SEQ ID NO: 1133923 - protein, 22 aa, Mycobacterium
GHGFAVFFALLAAIFMAIGIVV

SEQ ID NO: 1133924 - protein, 19 aa, Mycobacterium
GHLIFGFVLGLAFLKAPRG

SEQ ID NO: 1133925 - protein, 24 aa, Mycobacterium
GHLQLFLQLLRDRQWWLGSTVAAL

SEQ ID NO: 1133926 - protein, 27 aa, Mycobacterium
GHNLWNWPPAFFSWFAAGMVLAELTVT

SEQ ID NO: 1133927 - protein, 29 aa, Mycobacterium
GIAALSLIFIIMLILTRALVAAAVIVGTV

SEQ ID NO: 1133928 - protein, 17 aa, Mycobacterium
GIALILVLGFFAAGMDP

SEQ ID NO: 1133929 - protein, 23 aa, Mycobacterium
GIAMFGFWGIVLGPVLMIIIVTT

SEQ ID NO: 1133930 - protein, 31 aa, Mycobacterium
GILVLGILGFLMTFLYALAERRLLRWCDPRR

SEQ ID NO: 1133931 - protein, 23 aa, Mycobacterium
GINTLFPLFGIANQLLAAIALTV

SEQ ID NO: 1133932 - protein, 22 aa, Mycobacterium
GIPYDEYIMRTGSDWFPGLDRQ

SEQ ID NO: 1133933 - protein, 26 aa, Mycobacterium
GISVPNFPNFLNLASPYAFTGASFFT

SEQ ID NO: 1133934 - protein, 22 aa, Mycobacterium
GIVFRVQQELGVPVKLVGLGEG

SEQ ID NO: 1133935 - protein, 24 aa, Mycobacterium
GIVLGWTAIALLCAAATVGGYQLR

SEQ ID NO: 1133936 - protein, 18 aa, Mycobacterium
GIWAGLSTFMVLRLVFVG

SEQ ID NO: 1133937 - protein, 19 aa, Mycobacterium
GKLLGLVAVVLLVTGSPLP

SEQ ID NO: 1133938 - protein, 27 aa, Mycobacterium
GKVIGMWMPIMLFFYMGFEHSVVNMFL

SEQ ID NO: 1133939 - protein, 35 aa, Mycobacterium
GLADEVLYFFLVESALVFVAAYLIGVLGAGVAVAL

SEQ ID NO: 1133940 - protein, 36 aa, Mycobacterium
GLAFHLAAVAFLLLARPLFWARVRRGALFKAAGVLA

SEQ ID NO: 1133941 - protein, 18 aa, Mycobacterium
GLAIANFAIAFSALQFAT

SEQ ID NO: 1133942 - protein, 21 aa, Mycobacterium
GLALGIFLEKAGFDDFTIFDR

SEQ ID NO: 1133943 - protein, 24 aa, Mycobacterium
GLALPFTVWIWMRQLRDRRGYGAP

SEQ ID NO: 1133944 - protein, 23 aa, Mycobacterium
GLARAVLNLLDNAAKWSPPGGRV

SEQ ID NO: 1133945 - protein, 24 aa, Mycobacterium
GLASWLVPSLTFGTALILGAVVAP

SEQ ID NO: 1133946 - protein, 26 aa, Mycobacterium
GLASYLLIGFWSYKPSAATAAKKAFV

SEQ ID NO: 1133947 - protein, 32 aa, Mycobacterium
GLDLGRDAWFTMLTFWFFAAGWAAAKATAPWQ

SEQ ID NO: 1133948 - protein, 29 aa, Mycobacterium
GLFNAIPEAPPLAAPPIPDAGAPPRFPLP

SEQ ID NO: 1133949 - protein, 18 aa, Mycobacterium
GLGLSAPFVIYGAALLVA

SEQ ID NO: 1133950 - protein, 26 aa, Mycobacterium
GLGVAFFVVAFALGIDRWSKVKAVSA

SEQ ID NO: 1133951 - protein, 24 aa, Mycobacterium
GLGVARLMRFVPRSVMVGFVNALA

SEQ ID NO: 1133952 - protein, 23 aa, Mycobacterium
GLIGGLFWRPLAIAAAIGLLLLL

SEQ ID NO: 1133953 - protein, 21 aa, Mycobacterium
GLILCVTVLLLPLGIPVLRLG

SEQ ID NO: 1133954 - protein, 22 aa, Mycobacterium
GLISTIVLIVFSPAVSGTATSM

SEQ ID NO: 1133955 - protein, 23 aa, Mycobacterium
GLIVSLWLDRLRRRGMTARLGVS

SEQ ID NO: 1133956 - protein, 23 aa, Mycobacterium
GLLAFEIIVLLALAAWIFITGPQ

SEQ ID NO: 1133957 - protein, 26 aa, Mycobacterium
GLLDRLIYLHFGLAAILAFIGVKLFL

SEQ ID NO: 1133958 - protein, 17 aa, Mycobacterium
GLLFDHDFHIPIIGTWD

SEQ ID NO: 1133959 - protein, 20 aa, Mycobacterium
GLLGPWLLRAGFGEQYQADG

SEQ ID NO: 1133960 - protein, 18 aa, Mycobacterium
GLLILIVLLIFIAQNTES

SEQ ID NO: 1133961 - protein, 17 aa, Mycobacterium
GLLLDNAKAPCTVNSFA

SEQ ID NO: 1133962 - protein, 29 aa, Mycobacterium
GLMGLGAALLIAALLLSTYTKGKISKVPL

SEQ ID NO: 1133963 - protein, 22 aa, Mycobacterium
GLMMRRFGLPVLPLIIGVILGP

SEQ ID NO: 1133964 - protein, 20 aa, Mycobacterium
GLNFVLIDQAPPAAGLWPLV

SEQ ID NO: 1133965 - protein, 23 aa, Mycobacterium
GLPTRGLIALCDFGGSGTSITVV

SEQ ID NO: 1133966 - protein, 21 aa, Mycobacterium
GLQGFGMPIIPLGISVLRAAV

SEQ ID NO: 1133967 - protein, 21 aa, Mycobacterium
GLSTWLADIGVVGALLVWHVV

SEQ ID NO: 1133968 - protein, 20 aa, Mycobacterium
GLSWGLFPILFATTGMPVDR

SEQ ID NO: 1133969 - protein, 23 aa, Mycobacterium
GLTAGLALVLRYLAGGRYELGET

SEQ ID NO: 1133970 - protein, 19 aa, Mycobacterium
GLTVGVIVLFVLRPALDSA

SEQ ID NO: 1133971 - protein, 35 aa, Mycobacterium
GLVALPYAALSLIVPLLFMPLTIVAAGMSLAAGNW

SEQ ID NO: 1133972 - protein, 29 aa, Mycobacterium
GLVGGILWNLLTWLFGIPSSSSHALFGGL

SEQ ID NO: 1133973 - protein, 25 aa, Mycobacterium
GLVGMFITPLLFVGALRLSRPHAPW

SEQ ID NO: 1133974 - protein, 20 aa, Mycobacterium
GLVLNSPWFDLQGSAVLRSA

SEQ ID NO: 1133975 - protein, 17 aa, Mycobacterium
GLVLVVWIFATTAVINR

SEQ ID NO: 1133976 - protein, 22 aa, Mycobacterium
GLVLVYAIAVIWGLPNLNPPTA

SEQ ID NO: 1133977 - protein, 17 aa, Mycobacterium
GLVLWALTLSDFDTALS

SEQ ID NO: 1133978 - protein, 25 aa, Mycobacterium
GLVQAALVWLRPPQRWRAQQRALTR

SEQ ID NO: 1133979 - protein, 17 aa, Mycobacterium
GLYFNALVAVAITGLWL

SEQ ID NO: 1133980 - protein, 23 aa, Mycobacterium
GMPIAIWWFLIRPWRRERRITLD

SEQ ID NO: 1133981 - protein, 22 aa, Mycobacterium
GMRHRRFLPSRWWSMTPLDGVV

SEQ ID NO: 1133982 - protein, 37 aa, Mycobacterium
GMSRSPRWWRFFGALQWLLIAVAVAGGVWLGALAVLA

SEQ ID NO: 1133983 - protein, 20 aa, Mycobacterium
GMVLFWIVWGGALAGVLLKM

SEQ ID NO: 1133984 - protein, 25 aa, Mycobacterium
GMVLQDTWLFAGTIYDNIAYGRPDA

SEQ ID NO: 1133985 - protein, 25 aa, Mycobacterium
GNAFVSFLHKYPTALSPRSSLLVLG

SEQ ID NO: 1133986 - protein, 34 aa, Mycobacterium
GNFLVPNGTFFFVLLIFLIVLGVIAKWVVPPISK

SEQ ID NO: 1133987 - protein, 20 aa, Mycobacterium
GPAVTYLLHAGRRSAVDLRD

SEQ ID NO: 1133988 - protein, 37 aa, Mycobacterium
GPAWRLMGIIFATIFFLMFTPTKWIHHFGLFAAVGAA

SEQ ID NO: 1133989 - protein, 24 aa, Mycobacterium
GPETSGYFRVLVVAALAGGVCVAV

SEQ ID NO: 1133990 - protein, 21 aa, Mycobacterium
GPILLVLLDGYAPLALTILVL

SEQ ID NO: 1133991 - protein, 24 aa, Mycobacterium
GPLGPARMLLAITAALLALVVLAL

SEQ ID NO: 1133992 - protein, 22 aa, Mycobacterium
GPRAELPFPINAIPQPGDLPDD

SEQ ID NO: 1133993 - protein, 27 aa, Mycobacterium
GPRFIDTYVNWLWFGELGYRSVFTTVL

SEQ ID NO: 1133994 - protein, 24 aa, Mycobacterium
GPSAFWVCGLLLCLFIGPTQSSAR

SEQ ID NO: 1133995 - protein, 18 aa, Mycobacterium
GPSLPLGPAAEMADRLLV

SEQ ID NO: 1133996 - protein, 24 aa, Mycobacterium
GPTPRYPTIPRWGLVEHFDTVDPS

SEQ ID NO: 1133997 - protein, 32 aa, Mycobacterium
GPWVPASWRRWWWALLLAFVPIHLVVSAVVPA

SEQ ID NO: 1133998 - protein, 23 aa, Mycobacterium
GPYTLPSLDLLIAGDPPKLRSTA

SEQ ID NO: 1133999 - protein, 22 aa, Mycobacterium
GQEIIDFLRDPLGNLQTLINDF

SEQ ID NO: 1134000 - protein, 33 aa, Mycobacterium
GQELAHWDFYMGLAYFKLAIIAAGIAFRARMGG

SEQ ID NO: 1134001 - protein, 26 aa, Mycobacterium
GQFSLTVLSLLYLPNVVVGAAAVAVG

SEQ ID NO: 1134002 - protein, 30 aa, Mycobacterium
GQITKKALIALAVFLVLASLYIGIRYERWM

SEQ ID NO: 1134003 - protein, 23 aa, Mycobacterium
GQLIRRLVVFLVRQLNRVAPPRV

SEQ ID NO: 1134004 - protein, 24 aa, Mycobacterium
GQPDMWLFVLFESLLFTGYLSVYL

SEQ ID NO: 1134005 - protein, 22 aa, Mycobacterium
GQPSVLYGLLAAPALLAKRPST

SEQ ID NO: 1134006 - protein, 18 aa, Mycobacterium
GQSGPLLEILQILKAHGI

SEQ ID NO: 1134007 - protein, 21 aa, Mycobacterium
GQSHYLPVLGLTALAITAESV

SEQ ID NO: 1134008 - protein, 17 aa, Mycobacterium
GQTVQLTPLLYAVLRAI

SEQ ID NO: 1134009 - protein, 24 aa, Mycobacterium
GQVLGRLGTVLLIVGGVGVAVAAI

SEQ ID NO: 1134010 - protein, 21 aa, Mycobacterium
GQWMVMAAPICLLMFAILAVV

SEQ ID NO: 1134011 - protein, 29 aa, Mycobacterium
GRFAFHRPWHVIAGWIVLIAVVAGVLTVN

SEQ ID NO: 1134012 - protein, 30 aa, Mycobacterium
GRGGLQFMLIIWLQGIWLPLRGYDFEATPL

SEQ ID NO: 1134013 - protein, 22 aa, Mycobacterium
GRGIGLALVRLVTAQHGGVVDV

SEQ ID NO: 1134014 - protein, 19 aa, Mycobacterium
GRGPLKWIYATLGLLMAAT

SEQ ID NO: 1134015 - protein, 17 aa, Mycobacterium
GRIGLLDRLLGDQAGET

SEQ ID NO: 1134016 - protein, 23 aa, Mycobacterium
GRLAIFLAVLIGYLLALAMGDVD

SEQ ID NO: 1134017 - protein, 19 aa, Mycobacterium
GRLWPLIIAHTLIDAVAFV

SEQ ID NO: 1134018 - protein, 25 aa, Mycobacterium
GRRRLGRLTLWLMIGIVGALTVSFA

SEQ ID NO: 1134019 - protein, 27 aa, Mycobacterium
GRSDLRWWHPWAWLAYPGCYVVIALAV

SEQ ID NO: 1134020 - protein, 18 aa, Mycobacterium
GRVDLRGFWIRRARRLLP

SEQ ID NO: 1134021 - protein, 25 aa, Mycobacterium
GRWSYGLFIWHLAALAMVFPMVGEF

SEQ ID NO: 1134022 - protein, 17 aa, Mycobacterium
GSEWPWPPLPQTLTRRR

SEQ ID NO: 1134023 - protein, 23 aa, Mycobacterium
GSGTLITFPTLVALGYPPVTATM

SEQ ID NO: 1134024 - protein, 32 aa, Mycobacterium
GSLSPLVAAGLFYLLLTIPLTHLVNYVDARLR

SEQ ID NO: 1134025 - protein, 24 aa, Mycobacterium
GSVDGLTWMLGLSALAALGGYVWT

SEQ ID NO: 1134026 - protein, 24 aa, Mycobacterium
GSVFLAWLVMVVTVFVGALLCGVG

SEQ ID NO: 1134027 - protein, 26 aa, Mycobacterium
GSVTTFPWVFLFPAGVLVLIILCANL

SEQ ID NO: 1134028 - protein, 19 aa, Mycobacterium
GSWLGHPVHPLLVTLPIGT

SEQ ID NO: 1134029 - protein, 21 aa, Mycobacterium
GTAVLLYAFVRRRARVPVTAV

SEQ ID NO: 1134030 - protein, 18 aa, Mycobacterium
GTGGLYRFSNVTYRGVEV

SEQ ID NO: 1134031 - protein, 24 aa, Mycobacterium
GTGKVLGLLLPLLGAVVIAVVLWF

SEQ ID NO: 1134032 - protein, 28 aa, Mycobacterium
GTIARRFALSPIPLYLLAGLAVGEGGLA

SEQ ID NO: 1134033 - protein, 17 aa, Mycobacterium
GTLLMLLVGFITSLPFA

SEQ ID NO: 1134034 - protein, 29 aa, Mycobacterium
GTLTAPHPWLGVALMFVLGVVVTFSGVLS

SEQ ID NO: 1134035 - protein, 24 aa, Mycobacterium
GTNPFALLLVSFLGPIAATVVRLA

SEQ ID NO: 1134036 - protein, 61 aa, Mycobacterium
GTTAVTWLPFYHDMGLLLGVFAPILAGWPTVFTTPLSFLARPARWMQMVAGSPLAITAGPN

SEQ ID NO: 1134037 - protein, 24 aa, Mycobacterium
GTVVAMLSLVPWGSNGASLDVMRR

SEQ ID NO: 1134038 - protein, 26 aa, Mycobacterium
GTWARLYSDWVPRALPPGWKPGSKAA

SEQ ID NO: 1134039 - protein, 22 aa, Mycobacterium
GTYALYVAILSTLATGAAYVPV

SEQ ID NO: 1134040 - protein, 25 aa, Mycobacterium
GVAAKLYPLLLLVPLALLAVRTGRW

SEQ ID NO: 1134041 - protein, 22 aa, Mycobacterium
GVAAMLLACLWKAAMLVSTVPF

SEQ ID NO: 1134042 - protein, 17 aa, Mycobacterium
GVAAWGIALLALAVRRV

SEQ ID NO: 1134043 - protein, 31 aa, Mycobacterium
GVAAWTITALLYYVLGSFDQNFWGVTAGLTL

SEQ ID NO: 1134044 - protein, 26 aa, Mycobacterium
GVAIALVPLTLWRLAETILGLHPSEH

SEQ ID NO: 1134045 - protein, 18 aa, Mycobacterium
GVAVLLAWIPLRNRPGVG

SEQ ID NO: 1134046 - protein, 25 aa, Mycobacterium
GVAYGLYALAFFLPSIIAGFREDFG

SEQ ID NO: 1134047 - protein, 23 aa, Mycobacterium
GVFAFYIPGLVLVVWIFATTAVI

SEQ ID NO: 1134048 - protein, 26 aa, Mycobacterium
GVFDNLTKFITWTLPTNIGEGLVILV

SEQ ID NO: 1134049 - protein, 25 aa, Mycobacterium
GVGFTLGPLIIAFAVLEVRPKPVTG

SEQ ID NO: 1134050 - protein, 26 aa, Mycobacterium
GVGGDGAFFLLLDEPEVYGLPPDPVV

SEQ ID NO: 1134051 - protein, 22 aa, Mycobacterium
GVGGTWHWNTYPGIAVDIPSFS

SEQ ID NO: 1134052 - protein, 27 aa, Mycobacterium
GVGVNLFWVIFDLLILSVVIQAVRFRG

SEQ ID NO: 1134053 - protein, 25 aa, Mycobacterium
GVIAITLFMGIIMLAKATGAKVAER

SEQ ID NO: 1134054 - protein, 17 aa, Mycobacterium
GVLEAFKRWTAEAPRDP

SEQ ID NO: 1134055 - protein, 26 aa, Mycobacterium
GVMGFGVYLVWPAFYTDVTDSYRLGR

SEQ ID NO: 1134056 - protein, 33 aa, Mycobacterium
GVMVRLCQWYPDDAWLVLAIYTALGAVALVVIG

SEQ ID NO: 1134057 - protein, 21 aa, Mycobacterium
GVPDWLFSAIALVAVANGALL

SEQ ID NO: 1134058 - protein, 27 aa, Mycobacterium
GVPIFFVLSGFLLFRPWVQAAARGGPP

SEQ ID NO: 1134059 - protein, 23 aa, Mycobacterium
GVPWPAYKVIALLVGLVAFLVVG

SEQ ID NO: 1134060 - protein, 17 aa, Mycobacterium
GVRAVKISLLALGATAV

SEQ ID NO: 1134061 - protein, 27 aa, Mycobacterium
GVSFLHIPWLLPVAMWILAVASVVTVL

SEQ ID NO: 1134062 - protein, 25 aa, Mycobacterium
GVSQGFGVWWFYAALGSGPISVVSP

SEQ ID NO: 1134063 - protein, 26 aa, Mycobacterium
GVSTVMLMTLLRRPVWWAGTGAAVAG

SEQ ID NO: 1134064 - protein, 26 aa, Mycobacterium
GVSVPDFWLGILLIALFSSTLGWLPT

SEQ ID NO: 1134065 - protein, 28 aa, Mycobacterium
GVTSVSIPSWWQPYVLSVGSLTSTGQPS

SEQ ID NO: 1134066 - protein, 17 aa, Mycobacterium
GVVPALALVLAVAGGYL

SEQ ID NO: 1134067 - protein, 28 aa, Mycobacterium
GVVSTLAYLLLFMLTRGWLGAQAANLIA

SEQ ID NO: 1134068 - protein, 25 aa, Mycobacterium
GVVTIIMGLVFIGLIPALQRQARFT

SEQ ID NO: 1134069 - protein, 37 aa, Mycobacterium
GVWAFVLLVRTPDWLPWLRWVVLALAILVAAILVVGA

SEQ ID NO: 1134070 - protein, 28 aa, Mycobacterium
GVWDLVQGWWGLVIALVLGLGGGIGQLA

SEQ ID NO: 1134071 - protein, 21 aa, Mycobacterium
GWASFGLRIALVPLFVVEVLG

SEQ ID NO: 1134072 - protein, 20 aa, Mycobacterium
GWGVGLFLGGLAFGSMTKSL

SEQ ID NO: 1134073 - protein, 26 aa, Mycobacterium
GWPASDAFPFYPSIKHLLLEQAAEVF

SEQ ID NO: 1134074 - protein, 26 aa, Mycobacterium
GWTAIPMWVLGILTFLIPAGMAVVEL

SEQ ID NO: 1134075 - protein, 25 aa, Mycobacterium
GYAVPLLDYGYTGGLIYFLIVGVVA

SEQ ID NO: 1134076 - protein, 26 aa, Mycobacterium
GYGLQPLVPGLFLVLVSGFLAVQVKA

SEQ ID NO: 1134077 - protein, 19 aa, Mycobacterium
GYIAYFVLPAVIGAALGRR

SEQ ID NO: 1134078 - protein, 19 aa, Mycobacterium
GYLAGPLGLAAWAIGLVLG

SEQ ID NO: 1134079 - protein, 23 aa, Mycobacterium
GYVGSLIALLTLALGVVALRDSA

SEQ ID NO: 1134080 - protein, 17 aa, Mycobacterium
HAAGLIHRDVKPSNILI

SEQ ID NO: 1134081 - protein, 24 aa, Mycobacterium
HALRYLLLLINRTVLLNPIVAGAA

SEQ ID NO: 1134082 - protein, 21 aa, Mycobacterium
HAPWPISLWEGANSGWWPLLW

SEQ ID NO: 1134083 - protein, 24 aa, Mycobacterium
HDCPKLLQLRSFPTIAIGGDPDGS

SEQ ID NO: 1134084 - protein, 33 aa, Mycobacterium
HDDSWWLIVVVAGYLGAFLLLTAVLRAGMAVGV

SEQ ID NO: 1134085 - protein, 20 aa, Mycobacterium
HDLPPLPTLFVVADEFTLML

SEQ ID NO: 1134086 - protein, 22 aa, Mycobacterium
HFFTSASLFVGLLSVVGVVAAV

SEQ ID NO: 1134087 - protein, 17 aa, Mycobacterium
HFYWTRARRILPVAAVV

SEQ ID NO: 1134088 - protein, 20 aa, Mycobacterium
HGLDYLIAAVILAGILQLVL

SEQ ID NO: 1134089 - protein, 27 aa, Mycobacterium
HGYPARLVVPGLYGYVSATKWVVDLEL

SEQ ID NO: 1134090 - protein, 22 aa, Mycobacterium
HHEALLFFGFSGVGVLLSMLPL

SEQ ID NO: 1134091 - protein, 17 aa, Mycobacterium
HHWPDVGAALTEIRRVL

SEQ ID NO: 1134092 - protein, 17 aa, Mycobacterium
HIRGLPNRWASLTGDVV

SEQ ID NO: 1134093 - protein, 30 aa, Mycobacterium
HLAGYLAMVVIVLTVWLAVGLAAGAWYFWP

SEQ ID NO: 1134094 - protein, 57 aa, Mycobacterium
HLRDFGAIVWFAALLAVLFGVRHVVRMWPLWIFAASFVSPLPWILVTAAAGGSDAAA

SEQ ID NO: 1134095 - protein, 20 aa, Mycobacterium
HLTQMYAMREAAIGAILLSG

SEQ ID NO: 1134096 - protein, 26 aa, Mycobacterium
HLVNDGLMAFFFFIVGLEVKSEFVIG

SEQ ID NO: 1134097 - protein, 30 aa, Mycobacterium
HLVWAPANGLYFLTLLYLCGVVTKGFAWAL

SEQ ID NO: 1134098 - protein, 20 aa, Mycobacterium
HMWVARATGMKVRRYFVGFG

SEQ ID NO: 1134099 - protein, 18 aa, Mycobacterium
HPFHPILVTVPIGAWASS

SEQ ID NO: 1134100 - protein, 26 aa, Mycobacterium
HPMLSLGLPVLFIALGGIGLPGGAVY

SEQ ID NO: 1134101 - protein, 25 aa, Mycobacterium
HRGQWARVLPRFSALALGCVGVLVL

SEQ ID NO: 1134102 - protein, 17 aa, Mycobacterium
HRREILSRRIRWFVTAT

SEQ ID NO: 1134103 - protein, 20 aa, Mycobacterium
HTGGHWPFGAVFGGLLGGVV

SEQ ID NO: 1134104 - protein, 25 aa, Mycobacterium
HTRTIQIFGGVLLLIVGAALVTGVW

SEQ ID NO: 1134105 - protein, 24 aa, Mycobacterium
HTTHWGLYIDDFWWTAVWAGIVLS

SEQ ID NO: 1134106 - protein, 24 aa, Mycobacterium
HVARFGYLALLAPILAAGTVTAIL

SEQ ID NO: 1134107 - protein, 25 aa, Mycobacterium
HVVMNIHFLLSGYLFYWVVIGVDPT

SEQ ID NO: 1134108 - protein, 17 aa, Mycobacterium
HVWTLVPGKDVVTAHLT

SEQ ID NO: 1134109 - protein, 18 aa, Mycobacterium
IAAAFFFPAYSAILPRIL

SEQ ID NO: 1134110 - protein, 22 aa, Mycobacterium
IAAAWAFWLHLTPRPESRIVDR

SEQ ID NO: 1134111 - protein, 20 aa, Mycobacterium
IAAGGYLLISKWPVDLLSAR

SEQ ID NO: 1134112 - protein, 26 aa, Mycobacterium
IAAIIACVWLMLNLTGLTWIRFLIWM

SEQ ID NO: 1134113 - protein, 23 aa, Mycobacterium
IAAVLSVLALLLVIAELINKPSE

SEQ ID NO: 1134114 - protein, 26 aa, Mycobacterium
IAAVLYFFFVLPRWFELMGSTSPTLG

SEQ ID NO: 1134115 - protein, 26 aa, Mycobacterium
IADGAIFAGLLWWAAFGMDSPALVVA

SEQ ID NO: 1134116 - protein, 17 aa, Mycobacterium
IAFLIAGMGGMMSVIDC

SEQ ID NO: 1134117 - protein, 24 aa, Mycobacterium
IAFLPPLPVILVLSALVGLVYGPI

SEQ ID NO: 1134118 - protein, 17 aa, Mycobacterium
IAGRRLPIAASALNTGI

SEQ ID NO: 1134119 - protein, 28 aa, Mycobacterium
IAGVIAFLPRLLVAVIIIVVAAAIAAAV

SEQ ID NO: 1134120 - protein, 23 aa, Mycobacterium
IAIIFSLVCIGLAAFSFLIDFDA

SEQ ID NO: 1134121 - protein, 21 aa, Mycobacterium
IAIIMIYLAYLMVTGPLLKKR

SEQ ID NO: 1134122 - protein, 23 aa, Mycobacterium
IALSCLAYPNPTGALTGCISFAT

SEQ ID NO: 1134123 - protein, 18 aa, Mycobacterium
IALVPLFVVEVLGRGPGA

SEQ ID NO: 1134124 - protein, 18 aa, Mycobacterium
IAMVLIHFSLPARLKPER

SEQ ID NO: 1134125 - protein, 17 aa, Mycobacterium
IANFAIAFSALQFATGG

SEQ ID NO: 1134126 - protein, 17 aa, Mycobacterium
IANLLILGALNANSWLG

SEQ ID NO: 1134127 - protein, 29 aa, Mycobacterium
IATAALILSVWTWWQARPPSYDAAAQAGA

SEQ ID NO: 1134128 - protein, 25 aa, Mycobacterium
IAVAAALWVLAWVVGKAWVILLPVV

SEQ ID NO: 1134129 - protein, 18 aa, Mycobacterium
IAVAFRRHWRQILLVAGA

SEQ ID NO: 1134130 - protein, 26 aa, Mycobacterium
IAVALIGMAIGWWREGWPSQRQSAGF

SEQ ID NO: 1134131 - protein, 33 aa, Mycobacterium
IAVVALLFGLILMWLLSWLIATPVRVVRAALKN

SEQ ID NO: 1134132 - protein, 21 aa, Mycobacterium
ICAGVAYAWWPDEAAYRPIQP

SEQ ID NO: 1134133 - protein, 18 aa, Mycobacterium
ICAVAVFSAIVLRDLRIP

SEQ ID NO: 1134134 - protein, 18 aa, Mycobacterium
ICPPPATTSRRPPPPPPP

SEQ ID NO: 1134135 - protein, 36 aa, Mycobacterium
IDAALSNYFRRGNLTALRELALLWLADQVDAALAKY

SEQ ID NO: 1134136 - protein, 21 aa, Mycobacterium
IDDRWGLDALTKFAGQLTAAS

SEQ ID NO: 1134137 - protein, 28 aa, Mycobacterium
IDFDDCGFGWFFYDFGTAVSFIEDDPAL

SEQ ID NO: 1134138 - protein, 17 aa, Mycobacterium
IDMDANVIGINTAGKSL

SEQ ID NO: 1134139 - protein, 26 aa, Mycobacterium
IDVWQWTPFMVLLILAGLESMPKQPM

SEQ ID NO: 1134140 - protein, 18 aa, Mycobacterium
IEDQAIFSLLVIVLVMTA

SEQ ID NO: 1134141 - protein, 24 aa, Mycobacterium
IELHFMVMAMAVIILLAVGADYNL

SEQ ID NO: 1134142 - protein, 23 aa, Mycobacterium
IELHWMVMAMSVIILLAVGADYN

SEQ ID NO: 1134143 - protein, 21 aa, Mycobacterium
IENPVLLFGYSALLGPVVGAA

SEQ ID NO: 1134144 - protein, 23 aa, Mycobacterium
IERLWSLIGLVPQRGYLFTGTVA

SEQ ID NO: 1134145 - protein, 32 aa, Mycobacterium
IEVVGVEPAVMWLLLPVVAFGSAYVPEIASFI

SEQ ID NO: 1134146 - protein, 28 aa, Mycobacterium
IEYSLAAFFIVYGLVVFGLSTLPSLHRA

SEQ ID NO: 1134147 - protein, 18 aa, Mycobacterium
IFAAAILVCLTVSALALA

SEQ ID NO: 1134148 - protein, 26 aa, Mycobacterium
IFAACSAFFFVFYNIPAQFFAMHQDP

SEQ ID NO: 1134149 - protein, 19 aa, Mycobacterium
IFGGLWLALGYAVAGILCF

SEQ ID NO: 1134150 - protein, 17 aa, Mycobacterium
IFRYWDVVNPNSPRIRQ

SEQ ID NO: 1134151 - protein, 25 aa, Mycobacterium
IGAALYALLVNRWPLPETGVPSGLA

SEQ ID NO: 1134152 - protein, 26 aa, Mycobacterium
IGAGLLLVLGLFTPVAAAVALAYLIN

SEQ ID NO: 1134153 - protein, 31 aa, Mycobacterium
IGALTGHTWQLLGALWLYAMAVGGAITGVAA

SEQ ID NO: 1134154 - protein, 43 aa, Mycobacterium
IGALWSTALALIDPTWFGGLTVAWLWLTVVFANLAEAVAEGRG

SEQ ID NO: 1134155 - protein, 29 aa, Mycobacterium
IGFAVIVFLLVRFVVPPVRRMMTAQQETV

SEQ ID NO: 1134156 - protein, 18 aa, Mycobacterium
IGFVCCLGSVAGIALGLV

SEQ ID NO: 1134157 - protein, 24 aa, Mycobacterium
IGFVFAFFIGFVVSATWGQINSAD

SEQ ID NO: 1134158 - protein, 26 aa, Mycobacterium
IGGGILPLLWIAWVAIKSFWQGRNTA

SEQ ID NO: 1134159 - protein, 17 aa, Mycobacterium
IGILAWSGGIILACLIP

SEQ ID NO: 1134160 - protein, 25 aa, Mycobacterium
IGLGLIFDTLVIRAFMTPSIAALLG

SEQ ID NO: 1134161 - protein, 18 aa, Mycobacterium
IGPVWRVLSPVRALFRVL

SEQ ID NO: 1134162 - protein, 24 aa, Mycobacterium
IGQKLMYWATMYSYLAGFAALAYI

SEQ ID NO: 1134163 - protein, 35 aa, Mycobacterium
IGRPLGPATMFTGLAIQVFCPGAVAALAYGKSPLP

SEQ ID NO: 1134164 - protein, 43 aa, Mycobacterium
IGSLRNKLLFILPAALLLSQFVPWLLTPILMLGATYLCFEGAE

SEQ ID NO: 1134165 - protein, 20 aa, Mycobacterium
IGVFSRLYVPQLLITGAADA

SEQ ID NO: 1134166 - protein, 23 aa, Mycobacterium
IHGWVYFAYLLFTANLAVKVRWP

SEQ ID NO: 1134167 - protein, 23 aa, Mycobacterium
IIALVLFCLWPFTRLVHVFSAPI

SEQ ID NO: 1134168 - protein, 24 aa, Mycobacterium
IIEELRLPPFRVPAPRHSAQHASA

SEQ ID NO: 1134169 - protein, 27 aa, Mycobacterium
IIGLTSLVLLFLLTGSVVLPLKAIVLN

SEQ ID NO: 1134170 - protein, 26 aa, Mycobacterium
IIPRLYALHILLIPGIMLALIAAHLA

SEQ ID NO: 1134171 - protein, 19 aa, Mycobacterium
IISTVVALLALWRLDRLDG

SEQ ID NO: 1134172 - protein, 30 aa, Mycobacterium
IIVAVVVALLIIAALAMMARKRRNEKRHLE

SEQ ID NO: 1134173 - protein, 27 aa, Mycobacterium
IIVLLAVTGLRRLVFDAVPMQLKLAIT

SEQ ID NO: 1134174 - protein, 32 aa, Mycobacterium
IIYYPVSAIMWVWYKAFAFLLGPDNFFAWALS

SEQ ID NO: 1134175 - protein, 26 aa, Mycobacterium
IKFFVVAFVILPLLPDRPMGPYGVLN

SEQ ID NO: 1134176 - protein, 20 aa, Mycobacterium
IKPAILVALLFRTLDAFRIF

SEQ ID NO: 1134177 - protein, 18 aa, Mycobacterium
IKRYEQEGWWTPETLGEL

SEQ ID NO: 1134178 - protein, 25 aa, Mycobacterium
ILAHRIVWSVVFLLLVLAVARRLGD

SEQ ID NO: 1134179 - protein, 23 aa, Mycobacterium
ILGGTLPLYLPKVGLRFAVTVGL

SEQ ID NO: 1134180 - protein, 41 aa, Mycobacterium
ILGGWLLPYMMALYSLPRVVLAPLFIIWFGVGLISKVTMVV

SEQ ID NO: 1134181 - protein, 17 aa, Mycobacterium
ILGLGLAGQLAAATAVV

SEQ ID NO: 1134182 - protein, 25 aa, Mycobacterium
ILGNLLQMAFRFWAFRRWVFPEEFG

SEQ ID NO: 1134183 - protein, 17 aa, Mycobacterium
ILGSFPVPREAESKPFS

SEQ ID NO: 1134184 - protein, 18 aa, Mycobacterium
ILGSIAAPKLKWVAGAIG

SEQ ID NO: 1134185 - protein, 20 aa, Mycobacterium
ILIAALFLGFLVLEGFDFGV

SEQ ID NO: 1134186 - protein, 25 aa, Mycobacterium
ILIAALPVALALLLSIRFAAHVLGP

SEQ ID NO: 1134187 - protein, 21 aa, Mycobacterium
ILLGLGYLAVVSFVTAGGAAL

SEQ ID NO: 1134188 - protein, 25 aa, Mycobacterium
ILLIAISMIFVFGTLPLFWSIAMAR

SEQ ID NO: 1134189 - protein, 21 aa, Mycobacterium
ILLPDFLVMAGYWLMFTAILI

SEQ ID NO: 1134190 - protein, 23 aa, Mycobacterium
ILNQHLYFTLNAPAAQTGGTAET

SEQ ID NO: 1134191 - protein, 19 aa, Mycobacterium
ILPFFVTFLIRTIAWKTIL

SEQ ID NO: 1134192 - protein, 30 aa, Mycobacterium
ILSITMVTLIGWWALSRVLGRLVNIPDVHK

SEQ ID NO: 1134193 - protein, 25 aa, Mycobacterium
ILTGTFQLFYFGFGTAGPAYLWSWP

SEQ ID NO: 1134194 - protein, 27 aa, Mycobacterium
ILTVPAFALLGLLIPLFGLGVVPSVAA

SEQ ID NO: 1134195 - protein, 29 aa, Mycobacterium
ILVALIALFPPWIMWAPNAIWKSFDLFVG

SEQ ID NO: 1134196 - protein, 25 aa, Mycobacterium
ILVASAISVLWPPTGMVAAISAAAF

SEQ ID NO: 1134197 - protein, 19 aa, Mycobacterium
ILVLLLGTPAAFALSLRPV

SEQ ID NO: 1134198 - protein, 17 aa, Mycobacterium
ILVVLLSALTIASFVYA

SEQ ID NO: 1134199 - protein, 17 aa, Mycobacterium
ILVYTYRVLTGGQVAPK

SEQ ID NO: 1134200 - protein, 27 aa, Mycobacterium
ILYGYLVILVIILAYVIHIPFAVRTER

SEQ ID NO: 1134201 - protein, 17 aa, Mycobacterium
IMMAVFAGFVFNADPMI

SEQ ID NO: 1134202 - protein, 24 aa, Mycobacterium
INERTFRLLAIFMPGVKLVGNITT

SEQ ID NO: 1134203 - protein, 28 aa, Mycobacterium
INMVLALLLALFIFVVGPTVFILNLLPT

SEQ ID NO: 1134204 - protein, 30 aa, Mycobacterium
IPALQFDNWQWLALTLASPVVVWGAWPFHR

SEQ ID NO: 1134205 - protein, 20 aa, Mycobacterium
IPFQVQLPPGAVAPGSRPAD

SEQ ID NO: 1134206 - protein, 20 aa, Mycobacterium
IPLGLLVPPVGIALGHIARK

SEQ ID NO: 1134207 - protein, 26 aa, Mycobacterium
IPLSFAVLVWVFGGLLAAALPVVVGL

SEQ ID NO: 1134208 - protein, 23 aa, Mycobacterium
IPRTAHLAVGFFTLGLLSIVLAN

SEQ ID NO: 1134209 - protein, 25 aa, Mycobacterium
IPVAALGMLNPMLAGAAMAFSSVFV

SEQ ID NO: 1134210 - protein, 17 aa, Mycobacterium
IPWLRRTVGNPAAPHVA

SEQ ID NO: 1134211 - protein, 20 aa, Mycobacterium
IPYPGPGWAIVFIGLGILAT

SEQ ID NO: 1134212 - protein, 27 aa, Mycobacterium
IQAGYLGLYMLPWNRRRYRLPSALPGV

SEQ ID NO: 1134213 - protein, 18 aa, Mycobacterium
IQAIFIVVFIVMAVAAVS

SEQ ID NO: 1134214 - protein, 21 aa, Mycobacterium
IQAQDLLFRKIIRDDGQTLDH

SEQ ID NO: 1134215 - protein, 17 aa, Mycobacterium
IRFARINRFLVPEWGVA

SEQ ID NO: 1134216 - protein, 18 aa, Mycobacterium
IRLGPPVDLMAMATGAPT

SEQ ID NO: 1134217 - protein, 24 aa, Mycobacterium
IRSGLLDPAMLWRSTPAALRKLDP

SEQ ID NO: 1134218 - protein, 18 aa, Mycobacterium
IRVRIGIHTGKSVRRGED

SEQ ID NO: 1134219 - protein, 36 aa, Mycobacterium
ISALVGFLPLIWLSLAFGWGLLGIWAGLSTFMVLRL

SEQ ID NO: 1134220 - protein, 27 aa, Mycobacterium
ISASSLPWAVPPSAPPPAPGPPPDGAA

SEQ ID NO: 1134221 - protein, 26 aa, Mycobacterium
ISDDELFIMGRLKDLLIVRGRNHYPD

SEQ ID NO: 1134222 - protein, 20 aa, Mycobacterium
ISLVAFPWLVLQRNGSAVDA

SEQ ID NO: 1134223 - protein, 28 aa, Mycobacterium
ISMLTTAPLFIGWWIAGARYLMKNDPTI

SEQ ID NO: 1134224 - protein, 20 aa, Mycobacterium
ISRSRLLRWPARVYTDIFRG

SEQ ID NO: 1134225 - protein, 23 aa, Mycobacterium
ISTLPFLWNIFRSWRYGEPVTVD

SEQ ID NO: 1134226 - protein, 22 aa, Mycobacterium
ISTLPFLWNIFRSWRYGEPVVV

SEQ ID NO: 1134227 - protein, 25 aa, Mycobacterium
ITAYVLTFGGLMLLGGRLGDTIGRK

SEQ ID NO: 1134228 - protein, 19 aa, Mycobacterium
ITEPADILTALPRAVRAAF

SEQ ID NO: 1134229 - protein, 29 aa, Mycobacterium
ITFVQAFQYWLKLTAIAIPAIALLGLFFT

SEQ ID NO: 1134230 - protein, 28 aa, Mycobacterium
ITLLLIAAGLLWPLLFDGGGSGGGTVDD

SEQ ID NO: 1134231 - protein, 17 aa, Mycobacterium
ITPATRWGPLVQALLVI

SEQ ID NO: 1134232 - protein, 24 aa, Mycobacterium
ITSAALIMIAVFIGFAFAGMPLVA

SEQ ID NO: 1134233 - protein, 17 aa, Mycobacterium
ITYRPELGVLYPSELET

SEQ ID NO: 1134234 - protein, 25 aa, Mycobacterium
IVAFIALGALFVVGLWPGKDADFSN

SEQ ID NO: 1134235 - protein, 24 aa, Mycobacterium
IVATQILQMLRQLAPLVRFDGYHV

SEQ ID NO: 1134236 - protein, 23 aa, Mycobacterium
IVCYAWPFYALVDMGSVPLLTVA

SEQ ID NO: 1134237 - protein, 22 aa, Mycobacterium
IVEQVMWGPLGKVFLVCIVIAV

SEQ ID NO: 1134238 - protein, 27 aa, Mycobacterium
IVFGLWGIFVLAPWLTPVATFLNDKLG

SEQ ID NO: 1134239 - protein, 29 aa, Mycobacterium
IVGVSVMIFAYMKVPTLLGIGRLTVTLEL

SEQ ID NO: 1134240 - protein, 19 aa, Mycobacterium
IVIAILIVLNAQDRKDRQL

SEQ ID NO: 1134241 - protein, 24 aa, Mycobacterium
IVKVDWPFLWLVAPIHGWVYFAYL

SEQ ID NO: 1134242 - protein, 17 aa, Mycobacterium
IVLLIFIAQNTESAAMA

SEQ ID NO: 1134243 - protein, 24 aa, Mycobacterium
IVLVSLLVCLIPTTIGALLSAIGI

SEQ ID NO: 1134244 - protein, 24 aa, Mycobacterium
IVQQKAWRNLRFPLAWAPPEANVA

SEQ ID NO: 1134245 - protein, 31 aa, Mycobacterium
IVRRPVPHLIASVLVLLLLGGAAGFARFNYD

SEQ ID NO: 1134246 - protein, 21 aa, Mycobacterium
IVSMQYSFLPSWLSFLVDKEN

SEQ ID NO: 1134247 - protein, 34 aa, Mycobacterium
IVTTTILMFLAFGSLVLPIKAALMSALTLGSTMG

SEQ ID NO: 1134248 - protein, 17 aa, Mycobacterium
IVVTFFLLKDGPRFIPW

SEQ ID NO: 1134249 - protein, 23 aa, Mycobacterium
IVVYVLMALLLLAPLVLKLFHRS

SEQ ID NO: 1134250 - protein, 18 aa, Mycobacterium
IWSVIYLGLIAYSVYLSL

SEQ ID NO: 1134251 - protein, 20 aa, Mycobacterium
IYLLKREVVELRRSVSPLTP

SEQ ID NO: 1134252 - protein, 23 aa, Mycobacterium
IYTDLWIGFTTITAVLILGLAQT

SEQ ID NO: 1134253 - protein, 18 aa, Mycobacterium
IYVLWMYQRMMTGPVRDG

SEQ ID NO: 1134254 - protein, 25 aa, Mycobacterium
KAAVKFLLYNLFGGLIMLAAVIGLY

SEQ ID NO: 1134255 - protein, 29 aa, Mycobacterium
KALFTTHWRALLLCFLITAGGTVAFYTYT

SEQ ID NO: 1134256 - protein, 18 aa, Mycobacterium
KAQRRLWLAQLAMWPTLI

SEQ ID NO: 1134257 - protein, 25 aa, Mycobacterium
KDEPVIFWTPDYGAVIVRGAMNAGW

SEQ ID NO: 1134258 - protein, 26 aa, Mycobacterium
KEDKRLLPYMIGAFVLIVGAAVAVGV

SEQ ID NO: 1134259 - protein, 18 aa, Mycobacterium
KEPDLRLTLLRPSDEEDV

SEQ ID NO: 1134260 - protein, 18 aa, Mycobacterium
KEPQTVRWTLRLDVSDVD

SEQ ID NO: 1134261 - protein, 27 aa, Mycobacterium
KESGTILWLILLLAAFSWMISSRIVRG

SEQ ID NO: 1134262 - protein, 22 aa, Mycobacterium
KGGFLALWGVAIALVPLTLWRL

SEQ ID NO: 1134263 - protein, 25 aa, Mycobacterium
KGIALTVLYLVIAMLFAMLVSGSAA

SEQ ID NO: 1134264 - protein, 23 aa, Mycobacterium
KGRSFRIHILFASQTLDVGKIKD

SEQ ID NO: 1134265 - protein, 17 aa, Mycobacterium
KGWQFAFKYALGRTIAA

SEQ ID NO: 1134266 - protein, 18 aa, Mycobacterium
KIFPVLGTAIMTVAFVLL

SEQ ID NO: 1134267 - protein, 27 aa, Mycobacterium
KLGAFSLVLLLFTAIIIVVFGQMRFDR

SEQ ID NO: 1134268 - protein, 20 aa, Mycobacterium
KLRGHRFSRLPAGRAMLLGD

SEQ ID NO: 1134269 - protein, 24 aa, Mycobacterium
KLTKPVWLAILGGGVLILLLFRDA

SEQ ID NO: 1134270 - protein, 26 aa, Mycobacterium
KLTPAVFLLYFLLRRDTRALLVSAAS

SEQ ID NO: 1134271 - protein, 20 aa, Mycobacterium
KLVTALFFDLGVYLIVVGLV

SEQ ID NO: 1134272 - protein, 25 aa, Mycobacterium
KNMPALVLLGFALVTFVAALAAHAT

SEQ ID NO: 1134273 - protein, 26 aa, Mycobacterium
KPRSKRRMIIAATLVVLVVLAGLAIA

SEQ ID NO: 1134274 - protein, 29 aa, Mycobacterium
KPSNILITDRDFVYLIDFGLARSAGEPGM

SEQ ID NO: 1134275 - protein, 24 aa, Mycobacterium
KQDDDYWPQRPTVPTVPQAPKPVV

SEQ ID NO: 1134276 - protein, 18 aa, Mycobacterium
KRLVKVILPLIKPAILVA

SEQ ID NO: 1134277 - protein, 21 aa, Mycobacterium
KRMLVYSLLIMGTATVLMGAL

SEQ ID NO: 1134278 - protein, 20 aa, Mycobacterium
KSEFLRTLILSLAATHHPDQ

SEQ ID NO: 1134279 - protein, 23 aa, Mycobacterium
KSGEVTLLPAPMFHALGYLHATI

SEQ ID NO: 1134280 - protein, 23 aa, Mycobacterium
KSTLAWIMAGLTVPTTGSCLLDG

SEQ ID NO: 1134281 - protein, 26 aa, Mycobacterium
KSTVSIVLLIWVVLAVLNVVGVNIAP

SEQ ID NO: 1134282 - protein, 32 aa, Mycobacterium
KTSMPWMFFFAGLAIPAFYAVGLLAGSDTHFS

SEQ ID NO: 1134283 - protein, 17 aa, Mycobacterium
KTTPFMALLLLSGLALV

SEQ ID NO: 1134284 - protein, 24 aa, Mycobacterium
KVALRVIAFSFFALAAFVTVDAVR

SEQ ID NO: 1134285 - protein, 24 aa, Mycobacterium
KVFAGQWPILVVGLIFVAAFALVI

SEQ ID NO: 1134286 - protein, 21 aa, Mycobacterium
KVPTIWLLLDDDDAVPRKATG

SEQ ID NO: 1134287 - protein, 18 aa, Mycobacterium
KVWAFAAIMLAVGAVLYG

SEQ ID NO: 1134288 - protein, 17 aa, Mycobacterium
KWIYATLGLLMAATMVD

SEQ ID NO: 1134289 - protein, 28 aa, Mycobacterium
KYVVGPTLPWYQEFLRYYFLTVEESVDG

SEQ ID NO: 1134290 - protein, 24 aa, Mycobacterium
LAALTLFPIGQLWWGAFAVAVFVL

SEQ ID NO: 1134291 - protein, 31 aa, Mycobacterium
LAAPIGVYLWRKKVIGWPYMVAGVLLLISNA

SEQ ID NO: 1134292 - protein, 22 aa, Mycobacterium
LAATAVLYLWGLGSSGWANEYY

SEQ ID NO: 1134293 - protein, 25 aa, Mycobacterium
LAEPLAPLLGFLGAGAQTAVSIAVV

SEQ ID NO: 1134294 - protein, 28 aa, Mycobacterium
LAETVVLLLLFVFISTNVAVLVLRRDHV

SEQ ID NO: 1134295 - protein, 24 aa, Mycobacterium
LAFQLYVWIRWVTGPHFERVPPGP

SEQ ID NO: 1134296 - protein, 20 aa, Mycobacterium
LAFVLVWPGILLLVNTFAEF

SEQ ID NO: 1134297 - protein, 28 aa, Mycobacterium
LAGALVPYIRWPMWLRSIVATVALAAIL

SEQ ID NO: 1134298 - protein, 18 aa, Mycobacterium
LAGAVVGHFLLKSSLRPP

SEQ ID NO: 1134299 - protein, 29 aa, Mycobacterium
LAGGFTMYTLIPLGIVLGALVAFIIFGRR

SEQ ID NO: 1134300 - protein, 26 aa, Mycobacterium
LAGRFLVFQLLVVAVVLPAVAAVSIA

SEQ ID NO: 1134301 - protein, 25 aa, Mycobacterium
LAGVLLKMFWPSAPAWVGVPLYLLL

SEQ ID NO: 1134302 - protein, 21 aa, Mycobacterium
LAGWQFMMICSGLPAIALGVV

SEQ ID NO: 1134303 - protein, 36 aa, Mycobacterium
LAGWSLLLDYLFLPMLNYLVIGLYLNAAVPAIPQWL

SEQ ID NO: 1134304 - protein, 24 aa, Mycobacterium
LAIAAWLVVMFEVVSLTLAMVTQY

SEQ ID NO: 1134305 - protein, 22 aa, Mycobacterium
LAIFFVWPLISLARTSLSSTSG

SEQ ID NO: 1134306 - protein, 36 aa, Mycobacterium
LAILIFVAQLPHLLDVPWLVYPLVAVGIAMIVLLPK

SEQ ID NO: 1134307 - protein, 19 aa, Mycobacterium
LALAFWRVPALTTTAHRFD

SEQ ID NO: 1134308 - protein, 24 aa, Mycobacterium
LALAIFVVAFWFIATERADKVKTV

SEQ ID NO: 1134309 - protein, 20 aa, Mycobacterium
LALILDGLLAFAVWLSVPGT

SEQ ID NO: 1134310 - protein, 27 aa, Mycobacterium
LALPAIAGLVLFLVYPTVYLAALALTD

SEQ ID NO: 1134311 - protein, 21 aa, Mycobacterium
LAMPVAPWWYLRELRALLESR

SEQ ID NO: 1134312 - protein, 27 aa, Mycobacterium
LAMVFGRFLPIILVLALAGSFARQGRT

SEQ ID NO: 1134313 - protein, 26 aa, Mycobacterium
LAPGLQALLGGGWLFAGVLTAMVIRK

SEQ ID NO: 1134314 - protein, 20 aa, Mycobacterium
LARFIPGTVLLIGFAVMMVA

SEQ ID NO: 1134315 - protein, 25 aa, Mycobacterium
LARLTPVAAWILTCSVMTGAIALLA

SEQ ID NO: 1134316 - protein, 18 aa, Mycobacterium
LARPFGMLVDLLAAVPSI

SEQ ID NO: 1134317 - protein, 28 aa, Mycobacterium
LASALQPALAALPPEGLILIVAAGAGIT

SEQ ID NO: 1134318 - protein, 17 aa, Mycobacterium
LASITLLPSLIVLAGRR

SEQ ID NO: 1134319 - protein, 27 aa, Mycobacterium
LATPTVLLLLLFLIGCGQALTTPAWQA

SEQ ID NO: 1134320 - protein, 21 aa, Mycobacterium
LATRLTMVTLIPIVAVMTVGG

SEQ ID NO: 1134321 - protein, 17 aa, Mycobacterium
LAVLLPLSPDRRRLRPM

SEQ ID NO: 1134322 - protein, 25 aa, Mycobacterium
LAVMGIRPIAYLASTRLLAGVIVVV

SEQ ID NO: 1134323 - protein, 19 aa, Mycobacterium
LAVPRLRRWVLTTVRPRLV

SEQ ID NO: 1134324 - protein, 24 aa, Mycobacterium
LAVQTIIVIVWIALNMFAISLQWD

SEQ ID NO: 1134325 - protein, 26 aa, Mycobacterium
LAVSVLAALAVSWYLSRRLQRSITEV

SEQ ID NO: 1134326 - protein, 20 aa, Mycobacterium
LAVVARPYEWWRVALVAVSA

SEQ ID NO: 1134327 - protein, 33 aa, Mycobacterium
LAYGFYGMCAILSGLFVWRWVRETKGVSLEDMH

SEQ ID NO: 1134328 - protein, 18 aa, Mycobacterium
LAYLWLDRWEPEPPRLLV

SEQ ID NO: 1134329 - protein, 24 aa, Mycobacterium
LCALLLQIYVVMGAGWVLYRGHFG

SEQ ID NO: 1134330 - protein, 44 aa, Mycobacterium
LCGIVGPIFLAIYFATGPDPMLEWMFWTGLLVTAADVLIALGIT

SEQ ID NO: 1134331 - protein, 33 aa, Mycobacterium
LDAYPLLDAAFKEILRMYAPAGTLFRQTTRDTD

SEQ ID NO: 1134332 - protein, 26 aa, Mycobacterium
LDDTTPLFAFLFLVALGVDYTIFLVT

SEQ ID NO: 1134333 - protein, 26 aa, Mycobacterium
LDGIFRVTVFLVAGLILLGIGAGYAR

SEQ ID NO: 1134334 - protein, 30 aa, Mycobacterium
LDGLRPFFTGYLPAVFLAGILTPAAVVAIA

SEQ ID NO: 1134335 - protein, 24 aa, Mycobacterium
LDGQYPFLVMELVEGGTLRELLRE

SEQ ID NO: 1134336 - protein, 17 aa, Mycobacterium
LDILDPATPPELADAVR

SEQ ID NO: 1134337 - protein, 17 aa, Mycobacterium
LDKVKWRRRRSRWMTSA

SEQ ID NO: 1134338 - protein, 29 aa, Mycobacterium
LDPDLVLYVVLPPLLWSAGLESSYVALRR

SEQ ID NO: 1134339 - protein, 17 aa, Mycobacterium
LDRPLIVQFFSYLGNAL

SEQ ID NO: 1134340 - protein, 29 aa, Mycobacterium
LDTVALFVGWLWPLWDRRNRTFADLLLRT

SEQ ID NO: 1134341 - protein, 27 aa, Mycobacterium
LDWTALPLHPLAWLALASAAAGQVLLA

SEQ ID NO: 1134342 - protein, 19 aa, Mycobacterium
LEAQILGCPVICSSAAALP

SEQ ID NO: 1134343 - protein, 18 aa, Mycobacterium
LEHVMATGEYRTIATMWG

SEQ ID NO: 1134344 - protein, 20 aa, Mycobacterium
LELTRFDRAQAYWTKLGWSE

SEQ ID NO: 1134345 - protein, 19 aa, Mycobacterium
LEPGIGILAWSGGIILACL

SEQ ID NO: 1134346 - protein, 18 aa, Mycobacterium
LERLPVSSYRRPLLGTGL

SEQ ID NO: 1134347 - protein, 26 aa, Mycobacterium
LEVLDGLLLIFIFVELLYAVRTCLRS

SEQ ID NO: 1134348 - protein, 22 aa, Mycobacterium
LEWNVFMMFCVITLFVGHADLG

SEQ ID NO: 1134349 - protein, 28 aa, Mycobacterium
LEYTAPLLVVAWLWLTTRRRPSNRTLAG

SEQ ID NO: 1134350 - protein, 18 aa, Mycobacterium
LFAAQAIVLTVGAATTSM

SEQ ID NO: 1134351 - protein, 21 aa, Mycobacterium
LFAILAIAGLPILAGARTGLV

SEQ ID NO: 1134352 - protein, 32 aa, Mycobacterium
LFDLAIVVLPLLRPLQLLRLVTLITVMQRAVG

SEQ ID NO: 1134353 - protein, 26 aa, Mycobacterium
LFEKEPLLIWTLIASLFIGNLLLLVL

SEQ ID NO: 1134354 - protein, 29 aa, Mycobacterium
LFGITDGWWVYLAVYLLFIGIHLSGVGEA

SEQ ID NO: 1134355 - protein, 18 aa, Mycobacterium
LFIALMFGQAVGATALGV

SEQ ID NO: 1134356 - protein, 18 aa, Mycobacterium
LFLMPMGLFTYPGAIQAL

SEQ ID NO: 1134357 - protein, 18 aa, Mycobacterium
LFSAPSTWRVLDALIAMI

SEQ ID NO: 1134358 - protein, 18 aa, Mycobacterium
LFSVGFLLTFLLGGLSGV

SEQ ID NO: 1134359 - protein, 17 aa, Mycobacterium
LFVIGFLASFLALQTSA

SEQ ID NO: 1134360 - protein, 23 aa, Mycobacterium
LGAALLIKYLWPMRRMRAADVRT

SEQ ID NO: 1134361 - protein, 36 aa, Mycobacterium
LGAGPVARLWRWLLVFFSRWWQLETLYRSNMKYQPQ

SEQ ID NO: 1134362 - protein, 27 aa, Mycobacterium
LGATLLGVLILFALFVVVVTLRTRLNP

SEQ ID NO: 1134363 - protein, 18 aa, Mycobacterium
LGAVVIAVVLWFNVKDAE

SEQ ID NO: 1134364 - protein, 27 aa, Mycobacterium
LGEIALYSFIILLITGVWLTLFFDPSM

SEQ ID NO: 1134365 - protein, 24 aa, Mycobacterium
LGFLLANGLFLGLILLLGHSNVTP

SEQ ID NO: 1134366 - protein, 24 aa, Mycobacterium
LGGSAVLILLPRRSAPAHPGHRPH

SEQ ID NO: 1134367 - protein, 19 aa, Mycobacterium
LGIAMLLGGSWLTWILAAV

SEQ ID NO: 1134368 - protein, 19 aa, Mycobacterium
LGIIFLDIILYSAGGVIGT

SEQ ID NO: 1134369 - protein, 26 aa, Mycobacterium
LGISLILQAFLISTLLRVAQGSATVA

SEQ ID NO: 1134370 - protein, 19 aa, Mycobacterium
LGIVVLSIPLPWMAVLIAN

SEQ ID NO: 1134371 - protein, 30 aa, Mycobacterium
LGKALFDRLLSLVLLVVAAPLFVVVAALIK

SEQ ID NO: 1134372 - protein, 26 aa, Mycobacterium
LGLQIPVLLMIIGIIALAVIMKRTTY

SEQ ID NO: 1134373 - protein, 17 aa, Mycobacterium
LGLSFTVREAALPVGDR

SEQ ID NO: 1134374 - protein, 27 aa, Mycobacterium
LGNLLKPYRMTVFLLALVVVVENLARL

SEQ ID NO: 1134375 - protein, 25 aa, Mycobacterium
LGQAPFGKFLLIVAAVGIAAFGAYS

SEQ ID NO: 1134376 - protein, 20 aa, Mycobacterium
LGRRKLLIFGLALAAVSTAL

SEQ ID NO: 1134377 - protein, 34 aa, Mycobacterium
LGRTIAALGVLLISPLFIGLALAVKLSSPGPIFF

SEQ ID NO: 1134378 - protein, 25 aa, Mycobacterium
LGSVLLVQALLVTSLLFALPINARL

SEQ ID NO: 1134379 - protein, 17 aa, Mycobacterium
LGSWLPAILWGVAFAVL

SEQ ID NO: 1134380 - protein, 29 aa, Mycobacterium
LGTGLLLNYFSWQSIFYMFAGGALLMFVA

SEQ ID NO: 1134381 - protein, 24 aa, Mycobacterium
LGTVFVHWLIFQSLYRIGALCPYC

SEQ ID NO: 1134382 - protein, 20 aa, Mycobacterium
LGTWLLLFHRENSLSVLFEG

SEQ ID NO: 1134383 - protein, 21 aa, Mycobacterium
LGTYLLLFHRHHGFDAILHGI

SEQ ID NO: 1134384 - protein, 27 aa, Mycobacterium
LGVAALFYTLLLAYAAFTLVIMAVVAA

SEQ ID NO: 1134385 - protein, 18 aa, Mycobacterium
LGVVRPVLRRRFYAGTGL

SEQ ID NO: 1134386 - protein, 35 aa, Mycobacterium
LHDMTYYGLPPFYPPGWFWLGGRLAALTGTPAWEM

SEQ ID NO: 1134387 - protein, 28 aa, Mycobacterium
LHGSGVHLLLVRPGFVIGRMTAGMDPAP

SEQ ID NO: 1134388 - protein, 17 aa, Mycobacterium
LHMIISITAVAMARERA

SEQ ID NO: 1134389 - protein, 21 aa, Mycobacterium
LHYGLAILLAFAGVKLILSET

SEQ ID NO: 1134390 - protein, 28 aa, Mycobacterium
LIAAAAALAVLLLVASGVYMVVTPRDDA

SEQ ID NO: 1134391 - protein, 18 aa, Mycobacterium
LIAAIASLALIFIIMLLI

SEQ ID NO: 1134392 - protein, 29 aa, Mycobacterium
LIAFGVTVFLWILPGIIALAFGNDSDIYS

SEQ ID NO: 1134393 - protein, 27 aa, Mycobacterium
LIALFSSTLGWLPTSGYRPLFDDPAGW

SEQ ID NO: 1134394 - protein, 35 aa, Mycobacterium
LIASLFIGNLLLLVLNLPLAPLWAKLLRTPRPYLY

SEQ ID NO: 1134395 - protein, 23 aa, Mycobacterium
LIASQMVILLVTLALYGQTGTFN

SEQ ID NO: 1134396 - protein, 30 aa, Mycobacterium
LIASVGATAWLYFFQFRPDQETDSEAAKVA

SEQ ID NO: 1134397 - protein, 19 aa, Mycobacterium
LIAVPLAAGVLAPIGFVLP

SEQ ID NO: 1134398 - protein, 24 aa, Mycobacterium
LIDWIVWHHPPTLYMYLGMALVIG

SEQ ID NO: 1134399 - protein, 17 aa, Mycobacterium
LIFFGWGVALAFTSVVV

SEQ ID NO: 1134400 - protein, 18 aa, Mycobacterium
LIGLGMAVLLPVAPYVLE

SEQ ID NO: 1134401 - protein, 17 aa, Mycobacterium
LIIMVMRMLAEMAVANP

SEQ ID NO: 1134402 - protein, 47 aa, Mycobacterium
LIKAGIIGVVLMILVIMIGLQPIRLLSWATALRYQALFTEAGGIAGG

SEQ ID NO: 1134403 - protein, 18 aa, Mycobacterium
LINRRWTFQAPPSRARFL

SEQ ID NO: 1134404 - protein, 19 aa, Mycobacterium
LITLAITALIVWVVYSRLD

SEQ ID NO: 1134405 - protein, 21 aa, Mycobacterium
LIVGLLMTGIVIALAAKRVLW

SEQ ID NO: 1134406 - protein, 19 aa, Mycobacterium
LIVVGLVLDVLRSLGAQVD

SEQ ID NO: 1134407 - protein, 28 aa, Mycobacterium
LLACLVVPFILGLVWRKGTSTAALASIV

SEQ ID NO: 1134408 - protein, 52 aa, Mycobacterium
LLALISDSRWFLPRLAVGVYIWVLRGTPILLQLIFLYNVLPQWGWQLSSETT

SEQ ID NO: 1134409 - protein, 23 aa, Mycobacterium
LLARKPRALILDEPLAGLDAASQ

SEQ ID NO: 1134410 - protein, 46 aa, Mycobacterium
LLASAVAAYLVAPWAWWLCGAVGAVTVLYLGYLRRQTRIEEQVRRR

SEQ ID NO: 1134411 - protein, 20 aa, Mycobacterium
LLATGLFLMRFLEADATFLD

SEQ ID NO: 1134412 - protein, 34 aa, Mycobacterium
LLDAARNYLFPLYASLLTPWWLRVLGAQVGSGTE

SEQ ID NO: 1134413 - protein, 17 aa, Mycobacterium
LLEILQILKAHGIGMNN

SEQ ID NO: 1134414 - protein, 23 aa, Mycobacterium
LLEKPFGLLGIPDAVLHTVSFVV

SEQ ID NO: 1134415 - protein, 24 aa, Mycobacterium
LLERVLANLIDNALRYAPDGPVRV

SEQ ID NO: 1134416 - protein, 19 aa, Mycobacterium
LLFALPAALAYPWQTDTDW

SEQ ID NO: 1134417 - protein, 21 aa, Mycobacterium
LLFGVPVLLVPFVILWNAPGE

SEQ ID NO: 1134418 - protein, 28 aa, Mycobacterium
LLGALALTALALYAVSPTAAMWTAGAGI

SEQ ID NO: 1134419 - protein, 19 aa, Mycobacterium
LLGIAGYNFGRFCLTPAPR

SEQ ID NO: 1134420 - protein, 18 aa, Mycobacterium
LLGLFGALALMAAAIVLF

SEQ ID NO: 1134421 - protein, 17 aa, Mycobacterium
LLGLWHLSNRRHPGWQV

SEQ ID NO: 1134422 - protein, 18 aa, Mycobacterium
LLGRISPPFLDFIESSGV

SEQ ID NO: 1134423 - protein, 22 aa, Mycobacterium
LLIIMGAFMFFASRRQKKAMQA

SEQ ID NO: 1134424 - protein, 18 aa, Mycobacterium
LLKLLVMFAGVALTVIAL

SEQ ID NO: 1134425 - protein, 28 aa, Mycobacterium
LLLGWAVFLNYGLVLMALPALAVLICSA

SEQ ID NO: 1134426 - protein, 19 aa, Mycobacterium
LLLVWVVLSALTVVYVWLD

SEQ ID NO: 1134427 - protein, 24 aa, Mycobacterium
LLLYASFLILLYVATDRISWVAIG

SEQ ID NO: 1134428 - protein, 27 aa, Mycobacterium
LLMAVLGSMLLSWLLPYSLATIRKGTW

SEQ ID NO: 1134429 - protein, 27 aa, Mycobacterium
LLNAVKPTLPVLLANLTTIGQVAVTYH

SEQ ID NO: 1134430 - protein, 17 aa, Mycobacterium
LLNYVVLLALASFLTFT

SEQ ID NO: 1134431 - protein, 23 aa, Mycobacterium
LLPFFAVLTIFLLIPTVTVVVNA

SEQ ID NO: 1134432 - protein, 17 aa, Mycobacterium
LLPVVALLNGLGLVMIH

SEQ ID NO: 1134433 - protein, 22 aa, Mycobacterium
LLQINPIWVLGPYKPSQVSAGS

SEQ ID NO: 1134434 - protein, 19 aa, Mycobacterium
LLTAKPLARLTPVAAWILT

SEQ ID NO: 1134435 - protein, 26 aa, Mycobacterium
LLTDGGFLVFPLTYVIGDVLSEVYGF

SEQ ID NO: 1134436 - protein, 26 aa, Mycobacterium
LLTIYTQLFTTDTGWRRAVLAMVGAL

SEQ ID NO: 1134437 - protein, 26 aa, Mycobacterium
LLTKGLVYALITLGLILAVQQLEGHV

SEQ ID NO: 1134438 - protein, 18 aa, Mycobacterium
LLTLLAATAVLYLWGLGS

SEQ ID NO: 1134439 - protein, 25 aa, Mycobacterium
LLTLMLGFYLTCAVFVFGVLGALMR

SEQ ID NO: 1134440 - protein, 20 aa, Mycobacterium
LLTVLLLGANAFFVASEFAL

SEQ ID NO: 1134441 - protein, 18 aa, Mycobacterium
LLVLFLDLGWATGYVTIV

SEQ ID NO: 1134442 - protein, 24 aa, Mycobacterium
LLVQAAYFVIGWQAGLAFTTESLR

SEQ ID NO: 1134443 - protein, 20 aa, Mycobacterium
LLVQLTCTMLITAPIMSVGG

SEQ ID NO: 1134444 - protein, 17 aa, Mycobacterium
LLYCFAFLALAGLGAGT

SEQ ID NO: 1134445 - protein, 24 aa, Mycobacterium
LMGLRQLFFLLGGLLKRLVYLSQG

SEQ ID NO: 1134446 - protein, 21 aa, Mycobacterium
LMLIGLIWLLVFQLAATNPVD

SEQ ID NO: 1134447 - protein, 19 aa, Mycobacterium
LMPFAGIAFLWFIGVIRDG

SEQ ID NO: 1134448 - protein, 19 aa, Mycobacterium
LMQHGWGKALLILVGLGVI

SEQ ID NO: 1134449 - protein, 31 aa, Mycobacterium
LMRRRRSVGTWPLLAPLLAAGTVVLAVVFAD

SEQ ID NO: 1134450 - protein, 20 aa, Mycobacterium
LMTRSEMISRLVFAMGGRAA

SEQ ID NO: 1134451 - protein, 47 aa, Mycobacterium
LNDAAAPRQIAWGGLLFALGVIVLAVFVLWVWAQRRRRKRRAAEIER

SEQ ID NO: 1134452 - protein, 28 aa, Mycobacterium
LNDPPACTVGFLPPSSWRSPDDESDIDT

SEQ ID NO: 1134453 - protein, 23 aa, Mycobacterium
LNEPMLVQFWNYLTGAVTGDLGT

SEQ ID NO: 1134454 - protein, 22 aa, Mycobacterium
LNHLCDRLWLIAAIEHYTAVMG

SEQ ID NO: 1134455 - protein, 25 aa, Mycobacterium
LNVAALMVYALFPAAPPWAAARCTA

SEQ ID NO: 1134456 - protein, 17 aa, Mycobacterium
LPAALIGLAAGIWFTRR

SEQ ID NO: 1134457 - protein, 24 aa, Mycobacterium
LPDGARLWLPTYLVWFVGGMLLAV

SEQ ID NO: 1134458 - protein, 33 aa, Mycobacterium
LPDVWWLPYAAFSLPFLLLFRLTCYYYRKAYYR

SEQ ID NO: 1134459 - protein, 19 aa, Mycobacterium
LPEQIGLLVFMIVASKGAA

SEQ ID NO: 1134460 - protein, 19 aa, Mycobacterium
LPGRSLVALCPITVRGREH

SEQ ID NO: 1134461 - protein, 20 aa, Mycobacterium
LPHDGLTYRFPFDTEKKTYP

SEQ ID NO: 1134462 - protein, 18 aa, Mycobacterium
LPLILVGGALMGSAVDTN

SEQ ID NO: 1134463 - protein, 36 aa, Mycobacterium
LPRAIGRVSYSWYLWHWPVLILAPAMFGTDLGLASR

SEQ ID NO: 1134464 - protein, 17 aa, Mycobacterium
LPSHRLILGSILATVVF

SEQ ID NO: 1134465 - protein, 18 aa, Mycobacterium
LPSRWWSMTPLDGVVTAV

SEQ ID NO: 1134466 - protein, 17 aa, Mycobacterium
LPVVLLSMIPALQFDNW

SEQ ID NO: 1134467 - protein, 26 aa, Mycobacterium
LPVVVGYLLVRFVAGPLSYSAAVPGG

SEQ ID NO: 1134468 - protein, 33 aa, Mycobacterium
LQAGAIVSLALLLTRLYAPLTALANARVEIASA

SEQ ID NO: 1134469 - protein, 29 aa, Mycobacterium
LQDLPAFNLAIFLGYLFVSFTVGAYLSLR

SEQ ID NO: 1134470 - protein, 21 aa, Mycobacterium
LQFYSRAVGAGIIIAVLICLG

SEQ ID NO: 1134471 - protein, 18 aa, Mycobacterium
LQHLILPAVVIAIGPAVA

SEQ ID NO: 1134472 - protein, 29 aa, Mycobacterium
LQKLVFKILVMILWLAPIGAFGAIANVVG

SEQ ID NO: 1134473 - protein, 28 aa, Mycobacterium
LQPANVTYLLWLLMGYMVVTAVLVVLFG

SEQ ID NO: 1134474 - protein, 19 aa, Mycobacterium
LQRTSAFITLTYVLVDLVT

SEQ ID NO: 1134475 - protein, 29 aa, Mycobacterium
LQTQFGISVPWWLFTFAALAYVCVLAYLG

SEQ ID NO: 1134476 - protein, 22 aa, Mycobacterium
LQVFELSMVVVFLSLSLAVGHE

SEQ ID NO: 1134477 - protein, 25 aa, Mycobacterium
LRADLARDPSFYLRFRREAQNAAAL

SEQ ID NO: 1134478 - protein, 33 aa, Mycobacterium
LRDGFRFMLRTPWLLSTLLFASMFVLVVLGPIE

SEQ ID NO: 1134479 - protein, 18 aa, Mycobacterium
LRDSAVFAGWLDGRPWTL

SEQ ID NO: 1134480 - protein, 26 aa, Mycobacterium
LREFGNIVFHFSLLGLLVAIAAGKLF

SEQ ID NO: 1134481 - protein, 20 aa, Mycobacterium
LRELCDAAMTELLAGARRAT

SEQ ID NO: 1134482 - protein, 18 aa, Mycobacterium
LRGNIDVGMLILAGLFTI

SEQ ID NO: 1134483 - protein, 18 aa, Mycobacterium
LRHRWWVVLSGVGIAAVL

SEQ ID NO: 1134484 - protein, 27 aa, Mycobacterium
LRKALPITFATFGLGYLAIIGVPPLAG

SEQ ID NO: 1134485 - protein, 31 aa, Mycobacterium
LRKRRWALRLGLFFTVTSVFWILVTAVLAAW

SEQ ID NO: 1134486 - protein, 28 aa, Mycobacterium
LRLRLGCLVPFVNLFFAPVYVLELAGVE

SEQ ID NO: 1134487 - protein, 45 aa, Mycobacterium
LRLTTGHLMWAAVLIPACIAIFVPLDLLWVGVTVSVLIALIAVVT

SEQ ID NO: 1134488 - protein, 23 aa, Mycobacterium
LRNTTLTLIYSTISLPSWAAGSH

SEQ ID NO: 1134489 - protein, 20 aa, Mycobacterium
LRSQLVLSLLSWGVVLLLYF

SEQ ID NO: 1134490 - protein, 22 aa, Mycobacterium
LRSVKTVWLRPGTRLGFFTHMG

SEQ ID NO: 1134491 - protein, 20 aa, Mycobacterium
LRTTIAWIAVPSVVWVVIAL

SEQ ID NO: 1134492 - protein, 20 aa, Mycobacterium
LRVEVPIALPLILGGLRTAT

SEQ ID NO: 1134493 - protein, 19 aa, Mycobacterium
LRVEVTVPSPLLKGGLAFV

SEQ ID NO: 1134494 - protein, 18 aa, Mycobacterium
LRWPARVYTDIFRGLPEV

SEQ ID NO: 1134495 - protein, 26 aa, Mycobacterium
LSAGAFSVILWQLSGPLTLFGLTLPR

SEQ ID NO: 1134496 - protein, 20 aa, Mycobacterium
LSALGLSMTGPRPGGFGQLN

SEQ ID NO: 1134497 - protein, 21 aa, Mycobacterium
LSALTVYDLRWRRLPNWLTLP

SEQ ID NO: 1134498 - protein, 24 aa, Mycobacterium
LSDSFLNWDLYRQAVPDLLKTGLP

SEQ ID NO: 1134499 - protein, 20 aa, Mycobacterium
LSEWHWQAIFWVGVPIGVLG

SEQ ID NO: 1134500 - protein, 26 aa, Mycobacterium
LSKSAIVPLHFWLPGAMAAPTPVSAY

SEQ ID NO: 1134501 - protein, 21 aa, Mycobacterium
LSLGSILLLAALGLSLTFGQM

SEQ ID NO: 1134502 - protein, 20 aa, Mycobacterium
LSLIPIVLGLLIAVPLGALV

SEQ ID NO: 1134503 - protein, 28 aa, Mycobacterium
LSLLGTVPMGLLAYRYRLRVLIAATVAG

SEQ ID NO: 1134504 - protein, 18 aa, Mycobacterium
LSLVTQPTALASTAWWPV

SEQ ID NO: 1134505 - protein, 25 aa, Mycobacterium
LSMDYEVFLMARIREYWLAPRDVPA

SEQ ID NO: 1134506 - protein, 18 aa, Mycobacterium
LSMIPALQFDNWQWLALT

SEQ ID NO: 1134507 - protein, 27 aa, Mycobacterium
LSMLPMAVFPMYFLRSFAYAGVAVVGF

SEQ ID NO: 1134508 - protein, 17 aa, Mycobacterium
LSNINMVLALLLALFIF

SEQ ID NO: 1134509 - protein, 23 aa, Mycobacterium
LSPDLLTLRMTLKTRPNAQWSVQ

SEQ ID NO: 1134510 - protein, 32 aa, Mycobacterium
LSPNPELILPLVLPPLLFAAARRTSWREFLDN

SEQ ID NO: 1134511 - protein, 24 aa, Mycobacterium
LSQGLAFILLFIGVKLFLHALHEN

SEQ ID NO: 1134512 - protein, 21 aa, Mycobacterium
LSVLGLSGLVFFLSQYFQLVQ

SEQ ID NO: 1134513 - protein, 26 aa, Mycobacterium
LSVLIWQHIIGIELHWMVMAMSVIIL

SEQ ID NO: 1134514 - protein, 20 aa, Mycobacterium
LTAPWQVVSLLVDGPVLSKQ

SEQ ID NO: 1134515 - protein, 26 aa, Mycobacterium
LTATPVGHFIGMVGAFLIPVLENAPI

SEQ ID NO: 1134516 - protein, 19 aa, Mycobacterium
LTAVLALLIFRGKGPHPAS

SEQ ID NO: 1134517 - protein, 25 aa, Mycobacterium
LTGNNPFPLGIAALGLMAAAYIGEI

SEQ ID NO: 1134518 - protein, 19 aa, Mycobacterium
LTHDGILAIRWRLPSGTEI

SEQ ID NO: 1134519 - protein, 46 aa, Mycobacterium
LTIVAVLVMMLTISPLLALLTVLTVPLSLLAIRWITRRSQRLFVAQ

SEQ ID NO: 1134520 - protein, 20 aa, Mycobacterium
LTLAVWLYHYSHIGSAALIF

SEQ ID NO: 1134521 - protein, 25 aa, Mycobacterium
LTLGLSLAVILVLGFVLTSQITDRI

SEQ ID NO: 1134522 - protein, 25 aa, Mycobacterium
LTMAAEHFLFATPALDLIPAINARF

SEQ ID NO: 1134523 - protein, 18 aa, Mycobacterium
LTQIKPTLPILLANLTSV

SEQ ID NO: 1134524 - protein, 29 aa, Mycobacterium
LTRVFTPLTILMLLVLLVAFAAAGTVVGV

SEQ ID NO: 1134525 - protein, 27 aa, Mycobacterium
LTVFQRTPIWVVPKVDFPIPAAAQRMF

SEQ ID NO: 1134526 - protein, 27 aa, Mycobacterium
LTVWQRIRWIQLPSMLPYLATAIRLAT

SEQ ID NO: 1134527 - protein, 46 aa, Mycobacterium
LVAFAALTVWFVIDPQLWLLVVVTVLALLLGWHLVASIGGGDMPVV

SEQ ID NO: 1134528 - protein, 20 aa, Mycobacterium
LVALYRIRVGRRIGSVALVA

SEQ ID NO: 1134529 - protein, 17 aa, Mycobacterium
LVANMFWLLGAFRPERA

SEQ ID NO: 1134530 - protein, 28 aa, Mycobacterium
LVDHLGWQWIFFVNVPVGVAGLALAFWR

SEQ ID NO: 1134531 - protein, 17 aa, Mycobacterium
LVDLLLVVPSFILIAIV

SEQ ID NO: 1134532 - protein, 24 aa, Mycobacterium
LVEIPLLCYLVAPERTRAALSALY

SEQ ID NO: 1134533 - protein, 21 aa, Mycobacterium
LVEMLLFMLTVFVAYAYVWRR

SEQ ID NO: 1134534 - protein, 22 aa, Mycobacterium
LVFGALAGVRWSPPKRVTGVLL

SEQ ID NO: 1134535 - protein, 27 aa, Mycobacterium
LVFGYVMFYFAPYFPSVWILRKLQAKK

SEQ ID NO: 1134536 - protein, 21 aa, Mycobacterium
LVFPRLFFPDVSPATGLLLSF

SEQ ID NO: 1134537 - protein, 19 aa, Mycobacterium
LVGCFAFGWGFTAATSSLI

SEQ ID NO: 1134538 - protein, 17 aa, Mycobacterium
LVGGPWDWQRWAPASPW

SEQ ID NO: 1134539 - protein, 26 aa, Mycobacterium
LVGGQATLWLTWPFGPAGALGGFAAT

SEQ ID NO: 1134540 - protein, 18 aa, Mycobacterium
LVGPFTGALCIALVLTVQ

SEQ ID NO: 1134541 - protein, 25 aa, Mycobacterium
LVIAYCLGLGIPFVLLAFGSARAVQ

SEQ ID NO: 1134542 - protein, 20 aa, Mycobacterium
LVLEDFAMAAYLPLLAVLAT

SEQ ID NO: 1134543 - protein, 18 aa, Mycobacterium
LVLMIRYVDLLVAEAGRM

SEQ ID NO: 1134544 - protein, 17 aa, Mycobacterium
LVLYAIYLQIDYLTRRA

SEQ ID NO: 1134545 - protein, 19 aa, Mycobacterium
LVMLLLRRRMSRLLVVVGC

SEQ ID NO: 1134546 - protein, 26 aa, Mycobacterium
LVPSAPVRILGLPAGLRLVIDNAIAN

SEQ ID NO: 1134547 - protein, 33 aa, Mycobacterium
LVPVIFAHLSFVLPLVTWFLIGFFEAVPASLEE

SEQ ID NO: 1134548 - protein, 27 aa, Mycobacterium
LVQDLLAGFFIITERQYGFGDLVQLNM

SEQ ID NO: 1134549 - protein, 25 aa, Mycobacterium
LVSGDAGAWLLWDGRRSPVDLANRA

SEQ ID NO: 1134550 - protein, 23 aa, Mycobacterium
LVSLVLTLVELLRQLMERQAIRR

SEQ ID NO: 1134551 - protein, 23 aa, Mycobacterium
LVSSLLLNWVLGPALMFALAWLL

SEQ ID NO: 1134552 - protein, 18 aa, Mycobacterium
LVVLVVLAGLAIAREIVR

SEQ ID NO: 1134553 - protein, 24 aa, Mycobacterium
LVVSLIIRRRRVWVRITPAGPGTV

SEQ ID NO: 1134554 - protein, 20 aa, Mycobacterium
LVVVVVLYLSLKVIPEYERG

SEQ ID NO: 1134555 - protein, 19 aa, Mycobacterium
LVWRQMILFAHNIIIFVVI

SEQ ID NO: 1134556 - protein, 18 aa, Mycobacterium
LVYDLQLDREISARREYE

SEQ ID NO: 1134557 - protein, 18 aa, Mycobacterium
LVYLCNFGPIFEVSASDF

SEQ ID NO: 1134558 - protein, 17 aa, Mycobacterium
LWCGALVGLLVTVAHRG

SEQ ID NO: 1134559 - protein, 25 aa, Mycobacterium
LWEISRPWYLAWAGLAYVVAAVATL

SEQ ID NO: 1134560 - protein, 22 aa, Mycobacterium
LWHRVHRGWRPVLVAYVLVMAF

SEQ ID NO: 1134561 - protein, 21 aa, Mycobacterium
LWLLTTVLLAAAVPAVWAQQN

SEQ ID NO: 1134562 - protein, 20 aa, Mycobacterium
LYIDMRLVEGASLKDVLQAG

SEQ ID NO: 1134563 - protein, 18 aa, Mycobacterium
LYLIYFSALTAGAGNGIS

SEQ ID NO: 1134564 - protein, 26 aa, Mycobacterium
LYNERKIRLWVVFVEDFSGQGAVNWA

SEQ ID NO: 1134565 - protein, 27 aa, Mycobacterium
LYPNGAEFLVGMLAAARIGAVVVPFST

SEQ ID NO: 1134566 - protein, 30 aa, Mycobacterium
LYSRIKPTLLGALPWRWGDPHARLLKPWAR

SEQ ID NO: 1134567 - protein, 27 aa, Mycobacterium
MAAAPLWFHIHVIIALVLFCLWPFTRL

SEQ ID NO: 1134568 - protein, 24 aa, Mycobacterium
MAAYLPLLAVLATGGTFLQALLGM

SEQ ID NO: 1134569 - protein, 27 aa, Mycobacterium
MAGLPFAMFFVVTIPAWFGGLGTRRTP

SEQ ID NO: 1134570 - protein, 30 aa, Mycobacterium
MAGYWLMFTAILIGGWWRITVPALQRAGWV

SEQ ID NO: 1134571 - protein, 20 aa, Mycobacterium
MAIGLIDDRWGLDALTKFAG

SEQ ID NO: 1134572 - protein, 22 aa, Mycobacterium
MAIGWKMLIPVSLAWIMIVATA

SEQ ID NO: 1134573 - protein, 17 aa, Mycobacterium
MATLRVAFLSALVLELL

SEQ ID NO: 1134574 - protein, 24 aa, Mycobacterium
MAVVDLFIVVQINIAMPVAIHVLV

SEQ ID NO: 1134575 - protein, 20 aa, Mycobacterium
MAYLAITLWVIVDVAPRAAN

SEQ ID NO: 1134576 - protein, 17 aa, Mycobacterium
MDGRDSILGSFPVPREA

SEQ ID NO: 1134577 - protein, 25 aa, Mycobacterium
MDSYGWRIPFLIAAPLGLVGLYIRL

SEQ ID NO: 1134578 - protein, 25 aa, Mycobacterium
MFAGCYLLPPLLPYSYTDLDYYALQ

SEQ ID NO: 1134579 - protein, 21 aa, Mycobacterium
MFAVLGWFYLSVLPGWIGLAQ

SEQ ID NO: 1134580 - protein, 18 aa, Mycobacterium
MFMGLTAVLLARRGSASP

SEQ ID NO: 1134581 - protein, 38 aa, Mycobacterium
MFRMPIFTWNILVTSILVLLIFPLLTAALFALAADRHL

SEQ ID NO: 1134582 - protein, 25 aa, Mycobacterium
MFTASIICALFGFIWDVSLHIGNGR

SEQ ID NO: 1134583 - protein, 23 aa, Mycobacterium
MGLSILVLMVVFRSIAVPLKATA

SEQ ID NO: 1134584 - protein, 23 aa, Mycobacterium
MGMSVLPVFALINTGRPGLFLLA

SEQ ID NO: 1134585 - protein, 25 aa, Mycobacterium
MHDWGWRLPFLLAAPLGLVGVYLRS

SEQ ID NO: 1134586 - protein, 17 aa, Mycobacterium
MIGLIIAVIWGLSTDYE

SEQ ID NO: 1134587 - protein, 25 aa, Mycobacterium
MIGSFPILSVIGFIVMFGGVVFAIT

SEQ ID NO: 1134588 - protein, 24 aa, Mycobacterium
MIGVLAAAFFALRNVAGRSSVTRE

SEQ ID NO: 1134589 - protein, 17 aa, Mycobacterium
MIIAVVALLFGLILMWL

SEQ ID NO: 1134590 - protein, 35 aa, Mycobacterium
MIPVTDRLVLDQLSWFTPARWGFAASASTVDLIKL

SEQ ID NO: 1134591 - protein, 17 aa, Mycobacterium
MLFGVSPEMKIFLIALG

SEQ ID NO: 1134592 - protein, 29 aa, Mycobacterium
MLQADIIGALFVLGFLRFGLPPEDRVQLQ

SEQ ID NO: 1134593 - protein, 19 aa, Mycobacterium
MLQRKLRVGFAKAGRLMDL

SEQ ID NO: 1134594 - protein, 29 aa, Mycobacterium
MLTSFAGLGMFNPLSLGAGFVLGRKAYKE

SEQ ID NO: 1134595 - protein, 24 aa, Mycobacterium
MNSLTLMSALALALVYGLGGVIAL

SEQ ID NO: 1134596 - protein, 23 aa, Mycobacterium
MNYPTSLRRIVLPQAARVAVPPL

SEQ ID NO: 1134597 - protein, 28 aa, Mycobacterium
MPARGRLITMLLVGVALLAAGYAGGLGS

SEQ ID NO: 1134598 - protein, 20 aa, Mycobacterium
MPDIEPIYKVTILARGRTGG

SEQ ID NO: 1134599 - protein, 35 aa, Mycobacterium
MPVKTLRRLAFPGFAFTIVLLILVLIPGIGKVANG

SEQ ID NO: 1134600 - protein, 24 aa, Mycobacterium
MRDSKLGLLPRYRKLFGANTLMYF

SEQ ID NO: 1134601 - protein, 18 aa, Mycobacterium
MREAAIGAILLSGGGARS

SEQ ID NO: 1134602 - protein, 22 aa, Mycobacterium
MRNWGLVFLGNFAGALTVAFMM

SEQ ID NO: 1134603 - protein, 27 aa, Mycobacterium
MSIAVVMIFVFFQRAAWYLVKRDPNTD

SEQ ID NO: 1134604 - protein, 30 aa, Mycobacterium
MSLSLLAMVVAAFGWLPPAAGALLQEGIDV

SEQ ID NO: 1134605 - protein, 32 aa, Mycobacterium
MSPISWVHHWAWVVPLVLWLLSGPWRNEPGAR

SEQ ID NO: 1134606 - protein, 27 aa, Mycobacterium
MSVQGQFYLAFLALIFVVGLPLRRVVR

SEQ ID NO: 1134607 - protein, 31 aa, Mycobacterium
MTAGRLWFVEVLVWTLVALAVLMAVPAADRA

SEQ ID NO: 1134608 - protein, 28 aa, Mycobacterium
MTIGTLTAFLLYLRMFFEPMQEISQFFN

SEQ ID NO: 1134609 - protein, 23 aa, Mycobacterium
MTNINAFYPQRLKGWALGLNAGG

SEQ ID NO: 1134610 - protein, 19 aa, Mycobacterium
MTRLVEDMLLLARLDDGRP

SEQ ID NO: 1134611 - protein, 21 aa, Mycobacterium
MTVIIAFIVKPMGWRVTREDE

SEQ ID NO: 1134612 - protein, 17 aa, Mycobacterium
MVFDGSGLRYKYTVTPS

SEQ ID NO: 1134613 - protein, 55 aa, Mycobacterium
MVFGELFPKNLAIARPEPLARWLALSTTIYLKLFGWLIWLFDQSSNMLLRLLRIE

SEQ ID NO: 1134614 - protein, 22 aa, Mycobacterium
MVGAFLIPVLENAPIDLCDVWD

SEQ ID NO: 1134615 - protein, 22 aa, Mycobacterium
MVGERPDFRWLMSSDVCKHCTH

SEQ ID NO: 1134616 - protein, 18 aa, Mycobacterium
MVGSLALVPILLVFSNFG

SEQ ID NO: 1134617 - protein, 23 aa, Mycobacterium
MVRPLPQLPASLPLPDALSRLRR

SEQ ID NO: 1134618 - protein, 28 aa, Mycobacterium
NAFSFIGIVMVLLWWRRPVEEATMPLER

SEQ ID NO: 1134619 - protein, 32 aa, Mycobacterium
NALVAVAITGLWLWIGYDALLLIVATQILQML

SEQ ID NO: 1134620 - protein, 32 aa, Mycobacterium
NANTWTFRPPPPPWYRTRQAVTALMIVALAAI

SEQ ID NO: 1134621 - protein, 20 aa, Mycobacterium
NAVIAWVCIAASAVGVILLI

SEQ ID NO: 1134622 - protein, 25 aa, Mycobacterium
NAYGKVLFIITMSAGAVLVLLAGRR

SEQ ID NO: 1134623 - protein, 29 aa, Mycobacterium
NCTIKVMVGFLFLYPAFVAKSHDATGWEQ

SEQ ID NO: 1134624 - protein, 24 aa, Mycobacterium
NDKYYRYCTYLYLPFQYASVVMGA

SEQ ID NO: 1134625 - protein, 21 aa, Mycobacterium
NDLPTLVHYLGALAGGHVVLP

SEQ ID NO: 1134626 - protein, 24 aa, Mycobacterium
NFHLWQLLVFIPIAAILGGQVGYW

SEQ ID NO: 1134627 - protein, 26 aa, Mycobacterium
NGEQLLLTMFIPITLLVGLILLPLGD

SEQ ID NO: 1134628 - protein, 26 aa, Mycobacterium
NGFEQLIPWIALAVLAVALGLACLRS

SEQ ID NO: 1134629 - protein, 27 aa, Mycobacterium
NGTVPLLHLLFGVAFLGVLLSLLRSAA

SEQ ID NO: 1134630 - protein, 18 aa, Mycobacterium
NHKISWLTSLADWSGRRF

SEQ ID NO: 1134631 - protein, 28 aa, Mycobacterium
NIQPAQLLQPFLDYAFGFRRGMDAGQPP

SEQ ID NO: 1134632 - protein, 20 aa, Mycobacterium
NIQYDYIFGFSFYTAHYFGA

SEQ ID NO: 1134633 - protein, 23 aa, Mycobacterium
NIVWAVLFHRLVVLAGVGLIVWA

SEQ ID NO: 1134634 - protein, 23 aa, Mycobacterium
NMLILYVFWETTTVLSFLLVGHY

SEQ ID NO: 1134635 - protein, 24 aa, Mycobacterium
NNPDALLVLLLVVAAYCMVRAIET

SEQ ID NO: 1134636 - protein, 30 aa, Mycobacterium
NNRFFPPMGSILYWLRPGTIRLPPWPDRVP

SEQ ID NO: 1134637 - protein, 18 aa, Mycobacterium
NNWDLLIAGIAALSLIFI

SEQ ID NO: 1134638 - protein, 25 aa, Mycobacterium
NPEDPNWSWLKWLPHVQHQSDVDAA

SEQ ID NO: 1134639 - protein, 20 aa, Mycobacterium
NPGDFLPMVRRHGLMGALTD

SEQ ID NO: 1134640 - protein, 32 aa, Mycobacterium
NPLTTAFAYLLLPQVLFYGLSSVFMAILNTRN

SEQ ID NO: 1134641 - protein, 27 aa, Mycobacterium
NPPGTSFYVMLPGRPLTPGGNGTAPVP

SEQ ID NO: 1134642 - protein, 17 aa, Mycobacterium
NPRVIHISLLLGAAFLL

SEQ ID NO: 1134643 - protein, 22 aa, Mycobacterium
NQPPPCLTGFLPASEWRAPADT

SEQ ID NO: 1134644 - protein, 35 aa, Mycobacterium
NQRWQPYFLGNPVYAFLLMVLFQYGVALHELETER

SEQ ID NO: 1134645 - protein, 20 aa, Mycobacterium
NRLHRDVAIKVLRADLARDP

SEQ ID NO: 1134646 - protein, 18 aa, Mycobacterium
NRLITFLVVLTAAAAVLA

SEQ ID NO: 1134647 - protein, 21 aa, Mycobacterium
NRLLTPMLLDMGSFAGLNVLI

SEQ ID NO: 1134648 - protein, 19 aa, Mycobacterium
NRRRKRLLMVGVGAGVLAV

SEQ ID NO: 1134649 - protein, 22 aa, Mycobacterium
NRWGTPFFFQQAAGAFIATMIA

SEQ ID NO: 1134650 - protein, 22 aa, Mycobacterium
NSAWILCAAIAYNLLRAVGVLA

SEQ ID NO: 1134651 - protein, 23 aa, Mycobacterium
NSIVQLLFFMTPIIWNEATLQAQ

SEQ ID NO: 1134652 - protein, 24 aa, Mycobacterium
NSVIVRILLFYVGSALLLVTILPW

SEQ ID NO: 1134653 - protein, 21 aa, Mycobacterium
NTIRYYAVLPDGLQPVPQVLA

SEQ ID NO: 1134654 - protein, 33 aa, Mycobacterium
NTNREILVLAGFLLLIWLPALRCPPGLTVIAGV

SEQ ID NO: 1134655 - protein, 23 aa, Mycobacterium
NTSTLWTYLITAGAWVGGSVQLE

SEQ ID NO: 1134656 - protein, 18 aa, Mycobacterium
NTYDLLIAAIASLALIFI

SEQ ID NO: 1134657 - protein, 20 aa, Mycobacterium
NVAMLLALQASLLSLSGVLM

SEQ ID NO: 1134658 - protein, 24 aa, Mycobacterium
NVARFYISIIRGTPLLVQLFIVFF

SEQ ID NO: 1134659 - protein, 25 aa, Mycobacterium
NVNMWWALLGLAVSALKYLGAAAAL

SEQ ID NO: 1134660 - protein, 18 aa, Mycobacterium
NVTFKRLPNGLGPLLPME

SEQ ID NO: 1134661 - protein, 23 aa, Mycobacterium
NVVAAILYFVIGALVLAAGFGLM

SEQ ID NO: 1134662 - protein, 27 aa, Mycobacterium
NWAEAAMAFWASAFLGAVVVPIVHFYG

SEQ ID NO: 1134663 - protein, 19 aa, Mycobacterium
NWGGWIGFLALVAFLSFFA

SEQ ID NO: 1134664 - protein, 28 aa, Mycobacterium
PADRLTMPILLLAIAALVIGLAGTVLVA

SEQ ID NO: 1134665 - protein, 24 aa, Mycobacterium
PAEFSKILLLIFFAAVLVDKRELF

SEQ ID NO: 1134666 - protein, 17 aa, Mycobacterium
PAIVKFLSEQVLARNTD

SEQ ID NO: 1134667 - protein, 30 aa, Mycobacterium
PALALVLAVAGGYLFWRNYTADAAEQARED

SEQ ID NO: 1134668 - protein, 18 aa, Mycobacterium
PALLFPQLMLATAAFRPQ

SEQ ID NO: 1134669 - protein, 26 aa, Mycobacterium
PALTLLRIRLPQALRVITPALASEAI

SEQ ID NO: 1134670 - protein, 17 aa, Mycobacterium
PAPAPAGPKLGLVDVLF

SEQ ID NO: 1134671 - protein, 32 aa, Mycobacterium
PAPAPLPAAPPAPVPAPIPAAPVPAPVPVLPA

SEQ ID NO: 1134672 - protein, 29 aa, Mycobacterium
PASRTLAAWAPMLVLLAGLWTVRFLAQWL

SEQ ID NO: 1134673 - protein, 23 aa, Mycobacterium
PAVFFGHTPLQIACSLVFPAAVG

SEQ ID NO: 1134674 - protein, 29 aa, Mycobacterium
PAVGLAGCLLLAFALPWTSVLAGVAVLAV

SEQ ID NO: 1134675 - protein, 22 aa, Mycobacterium
PAYLWSWPIVFVGQMSVALCFM

SEQ ID NO: 1134676 - protein, 24 aa, Mycobacterium
PDAGAPPRFPLPVAAPVGAVVAAF

SEQ ID NO: 1134677 - protein, 27 aa, Mycobacterium
PDAKSELASWLPPGPVATADYPTVLLS

SEQ ID NO: 1134678 - protein, 18 aa, Mycobacterium
PDDALIRLRQRAGELLMT

SEQ ID NO: 1134679 - protein, 18 aa, Mycobacterium
PDDFLMVNRLKALGLAVV

SEQ ID NO: 1134680 - protein, 23 aa, Mycobacterium
PDELSFAMYGDPVARHAFGESFL

SEQ ID NO: 1134681 - protein, 18 aa, Mycobacterium
PDHWIALTPPRIAELRSL

SEQ ID NO: 1134682 - protein, 29 aa, Mycobacterium
PDLKRGFKAPFVPLLPIAAIIACVWLMLN

SEQ ID NO: 1134683 - protein, 27 aa, Mycobacterium
PEAERRLVFERFYRSTAARAMPGSGLG

SEQ ID NO: 1134684 - protein, 20 aa, Mycobacterium
PEAPFGWYYDLLALWSQVST

SEQ ID NO: 1134685 - protein, 26 aa, Mycobacterium
PEELRGRIMALWLVGFLGSRPIAAAV

SEQ ID NO: 1134686 - protein, 19 aa, Mycobacterium
PEFWRLLELRAVSQFGEGL

SEQ ID NO: 1134687 - protein, 32 aa, Mycobacterium
PEPEPVLVPHRPAGRRLLIAAAAASVVFVGAG

SEQ ID NO: 1134688 - protein, 24 aa, Mycobacterium
PEPPRLLVFAFIWGTSAAVVISAV

SEQ ID NO: 1134689 - protein, 30 aa, Mycobacterium
PFEPLAMRQHVLGPYPFDPSLVAQGIPPDD

SEQ ID NO: 1134690 - protein, 20 aa, Mycobacterium
PFLKIPPYLPVYIDRDWVAQ

SEQ ID NO: 1134691 - protein, 20 aa, Mycobacterium
PFLLVGSALSSIFVVGVVAL

SEQ ID NO: 1134692 - protein, 19 aa, Mycobacterium
PFLPLAVIMYWLANNIWTY

SEQ ID NO: 1134693 - protein, 24 aa, Mycobacterium
PFLSYGIQWIAFGIIAPIGLGYFI

SEQ ID NO: 1134694 - protein, 19 aa, Mycobacterium
PFMALLLLSGLALVPQDLL

SEQ ID NO: 1134695 - protein, 19 aa, Mycobacterium
PFRALRHRGLLGTSITALL

SEQ ID NO: 1134696 - protein, 25 aa, Mycobacterium
PFVGFAPWIIYWVVADGPSTWKFGA

SEQ ID NO: 1134697 - protein, 28 aa, Mycobacterium
PGANDFYLYYFILTGLHLFHVAIGLTVL

SEQ ID NO: 1134698 - protein, 31 aa, Mycobacterium
PGCWQPITRDLWPAPYLVLDTGASLAPYNHL

SEQ ID NO: 1134699 - protein, 35 aa, Mycobacterium
PGFFRSPRWVPVVGWLLVLSAISGLFFGLLGIALG

SEQ ID NO: 1134700 - protein, 23 aa, Mycobacterium
PGGALQPFLDYALGYRRGVNAGQ

SEQ ID NO: 1134701 - protein, 25 aa, Mycobacterium
PGGEYVCYLVWTLAMPGFGMLMVGA

SEQ ID NO: 1134702 - protein, 23 aa, Mycobacterium
PGGFPVVAMFLATSLDLPFEAVG

SEQ ID NO: 1134703 - protein, 18 aa, Mycobacterium
PGIIGFILSLTGQGAMLL

SEQ ID NO: 1134704 - protein, 22 aa, Mycobacterium
PGIPLLWDLVITLTASWQKIFS

SEQ ID NO: 1134705 - protein, 33 aa, Mycobacterium
PGKTAPLVISGWTLVVWVLMAMGSCIGYLASML

SEQ ID NO: 1134706 - protein, 21 aa, Mycobacterium
PGLAVFRAVFFFAVDRNIPGG

SEQ ID NO: 1134707 - protein, 24 aa, Mycobacterium
PGRTFRLFSRVIGGFGLASLGALG

SEQ ID NO: 1134708 - protein, 25 aa, Mycobacterium
PGRWPWPTFTVNIVGAFLLGYFTTR

SEQ ID NO: 1134709 - protein, 24 aa, Mycobacterium
PGTKGLSMFFVPKHLFDPATMQIT

SEQ ID NO: 1134710 - protein, 26 aa, Mycobacterium
PGVRGRLVLMWTVCTALPGAGIVTLV

SEQ ID NO: 1134711 - protein, 18 aa, Mycobacterium
PGYFFVLLCTMLGCWVMR

SEQ ID NO: 1134712 - protein, 24 aa, Mycobacterium
PHLPLPATALFVGAALPVAVTLLY

SEQ ID NO: 1134713 - protein, 25 aa, Mycobacterium
PHLVALPVLIVLIATGYRTPPRGVG

SEQ ID NO: 1134714 - protein, 20 aa, Mycobacterium
PHVIPVHDFGDIGGVLYIDM

SEQ ID NO: 1134715 - protein, 25 aa, Mycobacterium
PIEALFGFMLLTAAVSWVLEIYPAL

SEQ ID NO: 1134716 - protein, 32 aa, Mycobacterium
PIGVAIVALLLVLGAPFLSIKWGFPDDRVLPQ

SEQ ID NO: 1134717 - protein, 20 aa, Mycobacterium
PIIVFVLIFQRRIVAGLTSG

SEQ ID NO: 1134718 - protein, 20 aa, Mycobacterium
PILRILMRRRRSVGTWPLLA

SEQ ID NO: 1134719 - protein, 25 aa, Mycobacterium
PILSMLPIMVIGVLYGLAMDYEVFL

SEQ ID NO: 1134720 - protein, 19 aa, Mycobacterium
PIPPGWSDAGPRAPSWAYS

SEQ ID NO: 1134721 - protein, 17 aa, Mycobacterium
PIYKVTILARGRTGGHA

SEQ ID NO: 1134722 - protein, 22 aa, Mycobacterium
PKLVIMNLRDHMFAKAPYILGD

SEQ ID NO: 1134723 - protein, 26 aa, Mycobacterium
PKPGTVYQMWLVGSDGPHSAGTMDDK

SEQ ID NO: 1134724 - protein, 27 aa, Mycobacterium
PKTNALAIWSLVASLIGFVCCLGSVAG

SEQ ID NO: 1134725 - protein, 18 aa, Mycobacterium
PLADPIIGLVITVAILAV

SEQ ID NO: 1134726 - protein, 28 aa, Mycobacterium
PLATLTALQWVVWLALLNNVAAEFSLVS

SEQ ID NO: 1134727 - protein, 29 aa, Mycobacterium
PLGVATALIFGLWLLPGSSWAVLLVIACI

SEQ ID NO: 1134728 - protein, 20 aa, Mycobacterium
PLLSFAVMLTGFALAALTEE

SEQ ID NO: 1134729 - protein, 22 aa, Mycobacterium
PLLSIFRIIFGLAFTLHGSMKL

SEQ ID NO: 1134730 - protein, 28 aa, Mycobacterium
PLPGVFYVLIWVGLVALSWAIGPVWRVL

SEQ ID NO: 1134731 - protein, 33 aa, Mycobacterium
PLPQVLGDPTLLTMLWQNLIGNAVKFRKPDTTP

SEQ ID NO: 1134732 - protein, 21 aa, Mycobacterium
PLPTQIYWRRRALALGVAVVV

SEQ ID NO: 1134733 - protein, 29 aa, Mycobacterium
PLRTGIFGIVLVTCLVLVSFGYTGLPFFP

SEQ ID NO: 1134734 - protein, 19 aa, Mycobacterium
PLVDILLFRITAFGMGNLA

SEQ ID NO: 1134735 - protein, 19 aa, Mycobacterium
PLVTLGLLFYINPGLQMAW

SEQ ID NO: 1134736 - protein, 30 aa, Mycobacterium
PMVGGVLLEHFWWGSVFLINAPVMAVLVIG

SEQ ID NO: 1134737 - protein, 23 aa, Mycobacterium
PNEIALNILLTSLTIVFVIAVAT

SEQ ID NO: 1134738 - protein, 26 aa, Mycobacterium
PNFALTPLLIIWMGIGEGPKIVLITL

SEQ ID NO: 1134739 - protein, 26 aa, Mycobacterium
PNFAYSILSVIIAVAWMLAMSINRAR

SEQ ID NO: 1134740 - protein, 32 aa, Mycobacterium
PNKLPAYLLMVVAALGLLVYLCNFGPIFEVSA

SEQ ID NO: 1134741 - protein, 21 aa, Mycobacterium
PNSVQWVQIAVALTRIGAVLV

SEQ ID NO: 1134742 - protein, 26 aa, Mycobacterium
PNTNGSQFFLVYKDSQLPPGYTVFGR

SEQ ID NO: 1134743 - protein, 19 aa, Mycobacterium
PPALPRMPSWWPLNMTWGG

SEQ ID NO: 1134744 - protein, 22 aa, Mycobacterium
PPAVGALLLLVLLLVALRRRRR

SEQ ID NO: 1134745 - protein, 26 aa, Mycobacterium
PPILAVAMPWVFLRVRFVRRKWTAIT

SEQ ID NO: 1134746 - protein, 26 aa, Mycobacterium
PPIVAIIPLFFLLRHAGLTNSVGGLI

SEQ ID NO: 1134747 - protein, 28 aa, Mycobacterium
PPKKSKLWLILGLVALTVVVIAIAVVLF

SEQ ID NO: 1134748 - protein, 31 aa, Mycobacterium
PPRRRGLIVAGAILAVILLVAAVVSVVAVSG

SEQ ID NO: 1134749 - protein, 24 aa, Mycobacterium
PQAVFFSFAVTVAAALVIMLIHTY

SEQ ID NO: 1134750 - protein, 49 aa, Mycobacterium
PQFGLDLGFYAFDLPFYRLVLSYLFVATFLAFIANLLGHYLFGGIRLTG

SEQ ID NO: 1134751 - protein, 19 aa, Mycobacterium
PQFSLWLVPLAVLALPHRR

SEQ ID NO: 1134752 - protein, 34 aa, Mycobacterium
PQQPPPEGPKSPMWLWVLAGAVVLLVVALVIALV

SEQ ID NO: 1134753 - protein, 18 aa, Mycobacterium
PQWVPRYACYEDARLIPR

SEQ ID NO: 1134754 - protein, 20 aa, Mycobacterium
PRKISFLPGMRYYAGNWDTT

SEQ ID NO: 1134755 - protein, 32 aa, Mycobacterium
PRLVERNRGGSIGRWIAAVAVLAVLTVVVAVA

SEQ ID NO: 1134756 - protein, 27 aa, Mycobacterium
PRMSPPPVMPPALAWWAGTLELSGLNG

SEQ ID NO: 1134757 - protein, 17 aa, Mycobacterium
PRQTLLIAIATGLGGCM

SEQ ID NO: 1134758 - protein, 19 aa, Mycobacterium
PRYDLKAADRKRNLFVQIG

SEQ ID NO: 1134759 - protein, 18 aa, Mycobacterium
PSFLLPDVPYTLDTLGVI

SEQ ID NO: 1134760 - protein, 23 aa, Mycobacterium
PSFWWGFLLVFAGQFLVALVFAT

SEQ ID NO: 1134761 - protein, 26 aa, Mycobacterium
PSGQQGGYWYPPPSPNPGWGEPPRQQ

SEQ ID NO: 1134762 - protein, 27 aa, Mycobacterium
PSIAALLGKWFWWPQRVRNQPVPSPWP

SEQ ID NO: 1134763 - protein, 27 aa, Mycobacterium
PSIAALLGRWFWWPQRVRQRPATTGSL

SEQ ID NO: 1134764 - protein, 45 aa, Mycobacterium
PSPPQGVWELGPFPLRAYALCIIAGIIVALVLGDRRWEARGGERG

SEQ ID NO: 1134765 - protein, 23 aa, Mycobacterium
PSSAHWFKTFLAPLMGGIGMLYV

SEQ ID NO: 1134766 - protein, 23 aa, Mycobacterium
PTALAFMAGWLIGLGALTAIFVA

SEQ ID NO: 1134767 - protein, 24 aa, Mycobacterium
PTFGDWGFALARRGPTPPAPTVPE

SEQ ID NO: 1134768 - protein, 21 aa, Mycobacterium
PTFPRWYGYLNLWVATLSMPG

SEQ ID NO: 1134769 - protein, 20 aa, Mycobacterium
PTLAALWHLRDFGAIVWFAA

SEQ ID NO: 1134770 - protein, 27 aa, Mycobacterium
PTLGVLLLGVLLWGLGLVGPTVALMLL

SEQ ID NO: 1134771 - protein, 18 aa, Mycobacterium
PTMLIFAVLWGVSSGIGA

SEQ ID NO: 1134772 - protein, 20 aa, Mycobacterium
PTSLLFGAIAVAALGFCVIR

SEQ ID NO: 1134773 - protein, 18 aa, Mycobacterium
PTWSPRWVDHLVGDRIHR

SEQ ID NO: 1134774 - protein, 22 aa, Mycobacterium
PVAALMFRFNNPDALLVLLLVV

SEQ ID NO: 1134775 - protein, 23 aa, Mycobacterium
PVAGVIYMLVRFVRRTVAGVWKS

SEQ ID NO: 1134776 - protein, 25 aa, Mycobacterium
PVALSWAIILYGLAASVLPVWLLLA

SEQ ID NO: 1134777 - protein, 25 aa, Mycobacterium
PVAVVAYFLPPVLSLAAMVVLARGG

SEQ ID NO: 1134778 - protein, 23 aa, Mycobacterium
PVDFDYWLFATLIFLNGVGGGVF

SEQ ID NO: 1134779 - protein, 25 aa, Mycobacterium
PVFGGLIGVFGYPAAFAVLAVLPLL

SEQ ID NO: 1134780 - protein, 27 aa, Mycobacterium
PVFKSVAWVYLWIFRGTPVYVQLVFWG

SEQ ID NO: 1134781 - protein, 20 aa, Mycobacterium
PVFTLGMLQADIIGALFVLG

SEQ ID NO: 1134782 - protein, 24 aa, Mycobacterium
PVGAVLLRDPLRRDAPRTMRRLRA

SEQ ID NO: 1134783 - protein, 24 aa, Mycobacterium
PVGGFPVTAGWIHAVRRGHARLHR

SEQ ID NO: 1134784 - protein, 23 aa, Mycobacterium
PVGRPLLSGFYRTFTHIVPQGSG

SEQ ID NO: 1134785 - protein, 25 aa, Mycobacterium
PVGRWIGFALIWLALALLAADAVRR

SEQ ID NO: 1134786 - protein, 26 aa, Mycobacterium
PVIRRILLRTVLFTAPASALWGLLAV

SEQ ID NO: 1134787 - protein, 37 aa, Mycobacterium
PVKEWAITVFGMADKLVLSILVLAVIAILAAAGASLQ

SEQ ID NO: 1134788 - protein, 20 aa, Mycobacterium
PVQRQFWYRSTKFVMHRAVP

SEQ ID NO: 1134789 - protein, 24 aa, Mycobacterium
PVRLGYWPAAFGLFAFVWLELASP

SEQ ID NO: 1134790 - protein, 17 aa, Mycobacterium
PVRLLPHDLAPEAIGPL

SEQ ID NO: 1134791 - protein, 25 aa, Mycobacterium
PVSRALLDALPENPPITAPAVPRAG

SEQ ID NO: 1134792 - protein, 30 aa, Mycobacterium
PVSWIHHWVWVIPLIIWLIHGPWRERAGAR

SEQ ID NO: 1134793 - protein, 38 aa, Mycobacterium
PVTAYSWDFFGRLIPFLVLNQLMFIIISRGTPTWRGQQ

SEQ ID NO: 1134794 - protein, 17 aa, Mycobacterium
PVTLALAADLWATRNRA

SEQ ID NO: 1134795 - protein, 20 aa, Mycobacterium
PVVTLPIPPGWSDAGPRAPS

SEQ ID NO: 1134796 - protein, 18 aa, Mycobacterium
PVWAGLAALLLSSIVLVR

SEQ ID NO: 1134797 - protein, 17 aa, Mycobacterium
PWHLVKWQLAAMAMLVV

SEQ ID NO: 1134798 - protein, 26 aa, Mycobacterium
PWSVFAKQVLWTVVGLVAFYAALRMP

SEQ ID NO: 1134799 - protein, 21 aa, Mycobacterium
PWVVYWILMGNVPFVVAGVAA

SEQ ID NO: 1134800 - protein, 19 aa, Mycobacterium
PYEWWRVALVAVSALAYVV

SEQ ID NO: 1134801 - protein, 17 aa, Mycobacterium
PYRWVHHPNYIAVAAEV

SEQ ID NO: 1134802 - protein, 23 aa, Mycobacterium
QAAFTMMVLIIFNVIAPTGWSVG

SEQ ID NO: 1134803 - protein, 24 aa, Mycobacterium
QAAPLALYPLWCGFATALSSRIWW

SEQ ID NO: 1134804 - protein, 25 aa, Mycobacterium
QAFNDLFWLWFIGIVGTIVIQNATL

SEQ ID NO: 1134805 - protein, 28 aa, Mycobacterium
QAGPVARLLALRPLVWLGTISYGVYLWH

SEQ ID NO: 1134806 - protein, 17 aa, Mycobacterium
QAIDAWLALCGTYGWAP

SEQ ID NO: 1134807 - protein, 20 aa, Mycobacterium
QAIFSLLVIVLVMTAGASLV

SEQ ID NO: 1134808 - protein, 19 aa, Mycobacterium
QALFVALLVGFALQAMGRS

SEQ ID NO: 1134809 - protein, 18 aa, Mycobacterium
QASLACVVAFWFLGFETA

SEQ ID NO: 1134810 - protein, 22 aa, Mycobacterium
QASSLFLVSKLNCSITTSDGTV

SEQ ID NO: 1134811 - protein, 29 aa, Mycobacterium
QETPPPKRAWWLRHYTFFGTATGLVFVWF

SEQ ID NO: 1134812 - protein, 20 aa, Mycobacterium
QFAFKYALGRTIAALGVLLI

SEQ ID NO: 1134813 - protein, 21 aa, Mycobacterium
QGAAVWRRWAYALGALGNAGT

SEQ ID NO: 1134814 - protein, 29 aa, Mycobacterium
QGAVLLMAALFLLINLIVDALYAVADPRI

SEQ ID NO: 1134815 - protein, 32 aa, Mycobacterium
QGLIITLVVIVVRFLWIFPVATIDERMHRRKA

SEQ ID NO: 1134816 - protein, 27 aa, Mycobacterium
QGQAQVQLLRQQLIRELRSHLGTESVA

SEQ ID NO: 1134817 - protein, 40 aa, Mycobacterium
QGRRSWGWVVAVVLVIAALVAIAILGTILLTRGSGSTASQ

SEQ ID NO: 1134818 - protein, 23 aa, Mycobacterium
QGYTFLLTYVFAFGVTKAATNYF

SEQ ID NO: 1134819 - protein, 19 aa, Mycobacterium
QHGFFVRLYTGTGAFEVVG

SEQ ID NO: 1134820 - protein, 22 aa, Mycobacterium
QIDAARLLTWRASWMAATGVPF

SEQ ID NO: 1134821 - protein, 20 aa, Mycobacterium
QILVLLNVGAIFMGTALTVR

SEQ ID NO: 1134822 - protein, 31 aa, Mycobacterium
QKLVHYFGIEWPWSTLIYSVIAVAWAVFLVL

SEQ ID NO: 1134823 - protein, 25 aa, Mycobacterium
QKSIPVAAFVVAVVVAVGVVVWRRR

SEQ ID NO: 1134824 - protein, 24 aa, Mycobacterium
QLNDILVRLPNALKIIGRAGGVYG

SEQ ID NO: 1134825 - protein, 20 aa, Mycobacterium
QLSMCFVLLITGVGSLIHVY

SEQ ID NO: 1134826 - protein, 33 aa, Mycobacterium
QLVGDGLIFLILVGTSFGLWWRAQQQKVDHRNV

SEQ ID NO: 1134827 - protein, 24 aa, Mycobacterium
QLVPILPPRILVISGGVLVLGAMI

SEQ ID NO: 1134828 - protein, 19 aa, Mycobacterium
QLVTMPLVVWILRSYFQDL

SEQ ID NO: 1134829 - protein, 18 aa, Mycobacterium
QMRRVVLAGLLARKPRAL

SEQ ID NO: 1134830 - protein, 23 aa, Mycobacterium
QNALLTRRLWTIPLIAAGVVAMV

SEQ ID NO: 1134831 - protein, 23 aa, Mycobacterium
QNDLLFFTTPRWITDNLLVSNVL

SEQ ID NO: 1134832 - protein, 25 aa, Mycobacterium
QNLLTRFFSLEYDQWFGVVLPAVEN

SEQ ID NO: 1134833 - protein, 25 aa, Mycobacterium
QPAADGGLPAFAPPAGLGADCQYPA

SEQ ID NO: 1134834 - protein, 23 aa, Mycobacterium
QPLDLALLLVFGLLGLMMRRFGL

SEQ ID NO: 1134835 - protein, 42 aa, Mycobacterium
QPLLTTALMGRILLVSGLLVAGSWWLFEWELAHGAEVTEART

SEQ ID NO: 1134836 - protein, 23 aa, Mycobacterium
QPLPFVYPPFAAILFRPLTALPF

SEQ ID NO: 1134837 - protein, 38 aa, Mycobacterium
QPMSMGRRLGITFAAAAALFVLIALSPAALQVHLTVFA

SEQ ID NO: 1134838 - protein, 24 aa, Mycobacterium
QPRLRDRIIERLPIINRFHEPQYP

SEQ ID NO: 1134839 - protein, 20 aa, Mycobacterium
QPVMLLALVPIAVGTVLLTR

SEQ ID NO: 1134840 - protein, 20 aa, Mycobacterium
QPVPSPWPSPGPGLPPKAPE

SEQ ID NO: 1134841 - protein, 17 aa, Mycobacterium
QRFYALGLYVVMLVFAV

SEQ ID NO: 1134842 - protein, 19 aa, Mycobacterium
QRFYAWVTTVYLVASVIAA

SEQ ID NO: 1134843 - protein, 30 aa, Mycobacterium
QRLADRAAGWLFWFALATAAVTAVVWTMAG

SEQ ID NO: 1134844 - protein, 20 aa, Mycobacterium
QRLSLARAILAAPRILVLDD

SEQ ID NO: 1134845 - protein, 23 aa, Mycobacterium
QRQRLTIARLLLGRSRVVVLDEA

SEQ ID NO: 1134846 - protein, 18 aa, Mycobacterium
QRRYAIVNLLANTSAMSQ

SEQ ID NO: 1134847 - protein, 29 aa, Mycobacterium
QSSDSVLVTGPWLAGVSSLIAVLRDRLPE

SEQ ID NO: 1134848 - protein, 29 aa, Mycobacterium
QTVSLGIILLALLWYAGLPLKVFLSSLFA

SEQ ID NO: 1134849 - protein, 29 aa, Mycobacterium
QVDDLLACLYGLYALLRLHFVQEEENYFT

SEQ ID NO: 1134850 - protein, 19 aa, Mycobacterium
QVDPRSTLTMRRGGPPLGG

SEQ ID NO: 1134851 - protein, 17 aa, Mycobacterium
QVFGWPGIGQYIAQSIP

SEQ ID NO: 1134852 - protein, 22 aa, Mycobacterium
QVLRVLLMLFASPLLARFVVWA

SEQ ID NO: 1134853 - protein, 21 aa, Mycobacterium
QVTLIVIAAALILTGPGRYGF

SEQ ID NO: 1134854 - protein, 23 aa, Mycobacterium
QVVFQRGFQLPKLPPGTETVEVN

SEQ ID NO: 1134855 - protein, 26 aa, Mycobacterium
QVVLIAAIIVMFGVAAVLAAILAFNG

SEQ ID NO: 1134856 - protein, 22 aa, Mycobacterium
QVVLQLWNFLALVLDSLAIAAQ

SEQ ID NO: 1134857 - protein, 21 aa, Mycobacterium
QWDPYPFILLNLAFSTQAAYA

SEQ ID NO: 1134858 - protein, 24 aa, Mycobacterium
RAAFALPRIDVPAPPIPAGVAPGG

SEQ ID NO: 1134859 - protein, 18 aa, Mycobacterium
RAAGLNRLVMLTGDRAEP

SEQ ID NO: 1134860 - protein, 32 aa, Mycobacterium
RAAMLLAAAWFLLFALPLLLTVPPHLPGADEV

SEQ ID NO: 1134861 - protein, 24 aa, Mycobacterium
RAAVLLVGLLLYGFSMALMVRAGL

SEQ ID NO: 1134862 - protein, 19 aa, Mycobacterium
RADYLRYLSVVRDNVRAHA

SEQ ID NO: 1134863 - protein, 27 aa, Mycobacterium
RAERRWPFLFAVVFLAAGLALRYDILG

SEQ ID NO: 1134864 - protein, 22 aa, Mycobacterium
RAGWLIAGLILIVAGVLAMGRV

SEQ ID NO: 1134865 - protein, 19 aa, Mycobacterium
RAIAPWYLVTAAANCSWLF

SEQ ID NO: 1134866 - protein, 25 aa, Mycobacterium
RALAALLIGFPIAMAVTAFGVMAGE

SEQ ID NO: 1134867 - protein, 17 aa, Mycobacterium
RALAYAGLGFNGAILIT

SEQ ID NO: 1134868 - protein, 30 aa, Mycobacterium
RALTGTWINLLGLIFLMLLQPLGGLLSDKV

SEQ ID NO: 1134869 - protein, 18 aa, Mycobacterium
RAPHPPRRRVPPGTPSAP

SEQ ID NO: 1134870 - protein, 19 aa, Mycobacterium
RAQAYWTKLGWSERGPIKT

SEQ ID NO: 1134871 - protein, 23 aa, Mycobacterium
RASVYPILTWQVCAAASLVGALP

SEQ ID NO: 1134872 - protein, 20 aa, Mycobacterium
RAWQWFVTEVPQRSLHNWQT

SEQ ID NO: 1134873 - protein, 42 aa, Mycobacterium
RDEYPDARLLWSGDWKTFDGRNFWITIVGLTSPDYTDVLAWC

SEQ ID NO: 1134874 - protein, 28 aa, Mycobacterium
RDGYITLPVFAFGWPTTEAAPLYLAGSM

SEQ ID NO: 1134875 - protein, 36 aa, Mycobacterium
RDKAPWWHSLQATPTRRALLLTALGGLLIAGFVTAL

SEQ ID NO: 1134876 - protein, 32 aa, Mycobacterium
RDPMTFFFGVVFPIFMLLVLDIVLGDAISAVT

SEQ ID NO: 1134877 - protein, 24 aa, Mycobacterium
RDPRDADFLVLRAGLHDTPLDTTL

SEQ ID NO: 1134878 - protein, 21 aa, Mycobacterium
RDTSPPAPKWAWVALVVVGVV

SEQ ID NO: 1134879 - protein, 29 aa, Mycobacterium
RDVLVFICTVLFTVVWWHVSHSRSNWLVM

SEQ ID NO: 1134880 - protein, 40 aa, Mycobacterium
RELAILVTIAIVLYYVMLTFVARPYLIPSESMEPTLHGCP

SEQ ID NO: 1134881 - protein, 30 aa, Mycobacterium
REPVLFAVPFFLLLLILEWTAARKLEHLES

SEQ ID NO: 1134882 - protein, 23 aa, Mycobacterium
REQLIPRYSLGCKRPSFHNSYLA

SEQ ID NO: 1134883 - protein, 25 aa, Mycobacterium
RERDTWVISLLYIGTFGSFIGFAFA

SEQ ID NO: 1134884 - protein, 25 aa, Mycobacterium
REVGFPLLTPAFLGSLLLLFANAFA

SEQ ID NO: 1134885 - protein, 23 aa, Mycobacterium
RFGFLLAIPAVFASGLFSLPDAF

SEQ ID NO: 1134886 - protein, 29 aa, Mycobacterium
RFKTFLLLVGMSALIVFVGSLFGRSIMAL

SEQ ID NO: 1134887 - protein, 21 aa, Mycobacterium
RFLHAAVFSGLIWLAVLLPLS

SEQ ID NO: 1134888 - protein, 20 aa, Mycobacterium
RFMREPDRMNELAKAGFRTQ

SEQ ID NO: 1134889 - protein, 31 aa, Mycobacterium
RFQKRLFDMVFASTVLLLGAPILIAVAIAVK

SEQ ID NO: 1134890 - protein, 21 aa, Mycobacterium
RFSAVALWCFVAMALSGVINA

SEQ ID NO: 1134891 - protein, 22 aa, Mycobacterium
RFSQILTVAILGLAAATFALGL

SEQ ID NO: 1134892 - protein, 42 aa, Mycobacterium
RGAASGFLLILLGLWGALIPFLGPYFDFAFTPDQPWTWTNAR

SEQ ID NO: 1134893 - protein, 19 aa, Mycobacterium
RGADLPPLPTLFVVVDEFA

SEQ ID NO: 1134894 - protein, 42 aa, Mycobacterium
RGAGTSMLLLALSIAPTLLTPLLPLVPRLRTGYNLPISNVPG

SEQ ID NO: 1134895 - protein, 25 aa, Mycobacterium
RGALGLMFDPVFGALFWGKMFSVVA

SEQ ID NO: 1134896 - protein, 21 aa, Mycobacterium
RGDAPRPPQQGRRSWGWVVAV

SEQ ID NO: 1134897 - protein, 27 aa, Mycobacterium
RGDARAPLLILLPAKFVGGVLSIGSGL

SEQ ID NO: 1134898 - protein, 19 aa, Mycobacterium
RGGPYFVRGTNDLIPVSET

SEQ ID NO: 1134899 - protein, 21 aa, Mycobacterium
RGHVVDFLSIGWWPVFNVADP

SEQ ID NO: 1134900 - protein, 17 aa, Mycobacterium
RGLPNRWASLTGDVVAT

SEQ ID NO: 1134901 - protein, 25 aa, Mycobacterium
RGMSRDFPFTPVGAALLCDWTDDDS

SEQ ID NO: 1134902 - protein, 31 aa, Mycobacterium; identical to SEQ ID NO: 367363

SEQ ID NO: 1134903 - protein, 26 aa, Mycobacterium
RGPAYAVLGFALWIALYLAHVHPTLA

SEQ ID NO: 1134904 - protein, 21 aa, Mycobacterium
RGPKLLWRTLSVVQPVGPLAY

SEQ ID NO: 1134905 - protein, 24 aa, Mycobacterium
RGQLQKMFAMRRYGPDKAAKAIVA

SEQ ID NO: 1134906 - protein, 20 aa, Mycobacterium
RGQWHRLRWQIPGSLLGAMA

SEQ ID NO: 1134907 - protein, 20 aa, Mycobacterium
RGRGTPTVFVAALVAGTAFG

SEQ ID NO: 1134908 - protein, 26 aa, Mycobacterium
RGRRLSLVTLGLFAAGGLAGAAGAVL

SEQ ID NO: 1134909 - protein, 26 aa, Mycobacterium
RGRRLTGWVAALFSWRRRHLSTPPAP

SEQ ID NO: 1134910 - protein, 30 aa, Mycobacterium
RGTPLLVQLFIVFFALPEFGIRIDPFPAAV

SEQ ID NO: 1134911 - protein, 26 aa, Mycobacterium
RGTRFGILGALFLLPLVTAPVLVGVA

SEQ ID NO: 1134912 - protein, 18 aa, Mycobacterium
RGVLDRWVADVTATLRSA

SEQ ID NO: 1134913 - protein, 29 aa, Mycobacterium
RGVVFRAGRLRPLYGPGVKFLIPVVDRLI

SEQ ID NO: 1134914 - protein, 24 aa, Mycobacterium
RGWAPVIGPFFHRGIMLLDFEEHR

SEQ ID NO: 1134915 - protein, 18 aa, Mycobacterium
RHAVLLVHGFTDYFFHTE

SEQ ID NO: 1134916 - protein, 35 aa, Mycobacterium
RHDAVLRLRPTPPALLEPYDLPRQYRILKALADTA

SEQ ID NO: 1134917 - protein, 17 aa, Mycobacterium
RHIPLARPPVDGAVIPA

SEQ ID NO: 1134918 - protein, 24 aa, Mycobacterium
RHPHWKRLIGAVLVLLFTSAAAAF

SEQ ID NO: 1134919 - protein, 23 aa, Mycobacterium
RIAFYPLAVVPLVSLVWVALNWP

SEQ ID NO: 1134920 - protein, 19 aa, Mycobacterium
RIAIAVLFVGGWQLSSERL

SEQ ID NO: 1134921 - protein, 20 aa, Mycobacterium
RIDLGWFLVNADPDTYRRPT

SEQ ID NO: 1134922 - protein, 17 aa, Mycobacterium
RIDYADILYISPILLIV

SEQ ID NO: 1134923 - protein, 18 aa, Mycobacterium
RIQLFVLLCGIVGPIFLA

SEQ ID NO: 1134924 - protein, 24 aa, Mycobacterium
RITGFLRIVLLAAILGAALSSSFT

SEQ ID NO: 1134925 - protein, 37 aa, Mycobacterium
RIVVTQLRPVLWVVAVIFAFQLLFTDWQRALVVCGIL

SEQ ID NO: 1134926 - protein, 24 aa, Mycobacterium
RKELAHIMATARPKVFITVAEFGR

SEQ ID NO: 1134927 - protein, 18 aa, Mycobacterium
RKIHTFSVPPNMVAPLLA

SEQ ID NO: 1134928 - protein, 18 aa, Mycobacterium
RKKLLQFSLLLVGAATFA

SEQ ID NO: 1134929 - protein, 21 aa, Mycobacterium
RKMKQNLWWGAGYNLIAVPLA

SEQ ID NO: 1134930 - protein, 35 aa, Mycobacterium
RKQTWLGRFVSTYGWRAYALPILAVLTVVVIYQTV

SEQ ID NO: 1134931 - protein, 23 aa, Mycobacterium
RKRVVAVSFPRDLSIDPMECEPW

SEQ ID NO: 1134932 - protein, 25 aa, Mycobacterium
RKYLFRKRMVTSMAVALLASAVAAY

SEQ ID NO: 1134933 - protein, 17 aa, Mycobacterium
RLARGLKYTAVGPVDVT

SEQ ID NO: 1134934 - protein, 19 aa, Mycobacterium
RLAWLSRDTAAPVPPDLRE

SEQ ID NO: 1134935 - protein, 19 aa, Mycobacterium
RLFVLFPTDETWSDGDRAV

SEQ ID NO: 1134936 - protein, 21 aa, Mycobacterium
RLHRHLHDHFPFPARITIADN

SEQ ID NO: 1134937 - protein, 34 aa, Mycobacterium
RLIVSDRGYFIFLALLPFIMGVLSLSVPGTVGFG

SEQ ID NO: 1134938 - protein, 18 aa, Mycobacterium
RLLDVVTIVFFFGVTMVA

SEQ ID NO: 1134939 - protein, 17 aa, Mycobacterium
RLLEAERVTLFRGWPDQ

SEQ ID NO: 1134940 - protein, 19 aa, Mycobacterium
RLLERLLLSWRNGFTGFEG

SEQ ID NO: 1134941 - protein, 18 aa, Mycobacterium
RLLPLWIGIAMAAGLLLG

SEQ ID NO: 1134942 - protein, 27 aa, Mycobacterium
RLMTPLRVMLIIAVVFLALGYSTKAAC

SEQ ID NO: 1134943 - protein, 21 aa, Mycobacterium
RLPRLVHLACIWIVAIAVNAS

SEQ ID NO: 1134944 - protein, 25 aa, Mycobacterium
RLSAALLTPWAVAAGVLIALNLRAG

SEQ ID NO: 1134945 - protein, 50 aa, Mycobacterium
RLSRATLRTIKGNLFWAFAYNVAALPLAAFGLLNPLIAGAAMAFSSVFVV

SEQ ID NO: 1134946 - protein, 17 aa, Mycobacterium
RLTLLRPSDEEDVPDIK

SEQ ID NO: 1134947 - protein, 25 aa, Mycobacterium
RLTTRELILLMLAIAVIASAGSAYG

SEQ ID NO: 1134948 - protein, 17 aa, Mycobacterium
RLVDLLPLPSLRVQRAI

SEQ ID NO: 1134949 - protein, 31 aa, Mycobacterium
RLVGASRWYTQLPFLLEAMLAALIGVVIAIA

SEQ ID NO: 1134950 - protein, 34 aa, Mycobacterium
RMKTVALGFLLGATVIFLVCTWAQSQGAAAPWIG

SEQ ID NO: 1134951 - protein, 18 aa, Mycobacterium
RMPSFHVPVARAVVDCAV

SEQ ID NO: 1134952 - protein, 19 aa, Mycobacterium
RMPSWWPLNMTWGGGLPSA

SEQ ID NO: 1134953 - protein, 25 aa, Mycobacterium
RNATQLVLGTSRRSRWARILDEGIG

SEQ ID NO: 1134954 - protein, 22 aa, Mycobacterium
RNLTRMLLGLLLIGNAINLLIL

SEQ ID NO: 1134955 - protein, 34 aa, Mycobacterium
RPAWLALFVVVLAFAYLCFTVLAPWQLGKNTTTS

SEQ ID NO: 1134956 - protein, 25 aa, Mycobacterium
RPDILDPALLRPGRFDRQIPVTSPD

SEQ ID NO: 1134957 - protein, 25 aa, Mycobacterium
RPDRNIGIPLAFHLGYHSLPFGLMR

SEQ ID NO: 1134958 - protein, 17 aa, Mycobacterium
RPEPLIAFAVIAVWMLV

SEQ ID NO: 1134959 - protein, 18 aa, Mycobacterium
RPEPRLVERNRGGSIGRW

SEQ ID NO: 1134960 - protein, 22 aa, Mycobacterium
RPGLFLLALVLVFGLAMAPAAG

SEQ ID NO: 1134961 - protein, 26 aa, Mycobacterium
RPGLSSVLFYLFAYGFSTLGAFAVVG

SEQ ID NO: 1134962 - protein, 32 aa, Mycobacterium
RPGTFAFPIIVVMILLIIPLGQLSLGGISEKY

SEQ ID NO: 1134963 - protein, 32 aa, Mycobacterium
RPHNIPFVMLGAALLWFGWFGFNVGSEGAADA

SEQ ID NO: 1134964 - protein, 18 aa, Mycobacterium
RPITPATTVLLALVAAGI

SEQ ID NO: 1134965 - protein, 19 aa, Mycobacterium
RPLRYVVFGFAVSAVLCPL

SEQ ID NO: 1134966 - protein, 17 aa, Mycobacterium
RPPQRWRAQQRALTRAH

SEQ ID NO: 1134967 - protein, 21 aa, Mycobacterium
RPQLVFLTFVVVVGTLLLHGL

SEQ ID NO: 1134968 - protein, 31 aa, Mycobacterium
RPQYRALWVFVLVPVLILLTVSGRWLYSHAA

SEQ ID NO: 1134969 - protein, 25 aa, Mycobacterium
RQEALIQLLADRAFEWSLNAGEVIE

SEQ ID NO: 1134970 - protein, 30 aa, Mycobacterium
RQILKTPVWNWMIAAYLFSGGLSAGSAMLG

SEQ ID NO: 1134971 - protein, 17 aa, Mycobacterium
RQLIDFVTVIYTDQQGA

SEQ ID NO: 1134972 - protein, 24 aa, Mycobacterium
RQRVLALVILLMSASTFAIGLLPS

SEQ ID NO: 1134973 - protein, 36 aa, Mycobacterium
RRAAEPILPMRLFASPVFTVCCILSFIVGFAMLGAL

SEQ ID NO: 1134974 - protein, 26 aa, Mycobacterium
RRAVRGLKVLVWSALLSVAAVGVGLL

SEQ ID NO: 1134975 - protein, 26 aa, Mycobacterium
RRERISLRPLWGIDDRLKKFGTMAAA

SEQ ID NO: 1134976 - protein, 26 aa, Mycobacterium
RRHDPFIDLRFFRSIPFSAATVTAVS

SEQ ID NO: 1134977 - protein, 27 aa, Mycobacterium
RRIRIQIILTFLILVTNILGIGVSLLL

SEQ ID NO: 1134978 - protein, 19 aa, Mycobacterium
RRITLITQVILPGAMPNFL

SEQ ID NO: 1134979 - protein, 29 aa, Mycobacterium
RRLDEAAGFAIPFLPRGLDTIPKSPNNQD

SEQ ID NO: 1134980 - protein, 21 aa, Mycobacterium
RRLWLAQLAMWPTLIVTGVAV

SEQ ID NO: 1134981 - protein, 17 aa, Mycobacterium
RRNPVVLTIVLAAALVY

SEQ ID NO: 1134982 - protein, 24 aa, Mycobacterium
RRPLTTLQFLWDAPGVRGLGLYDQ

SEQ ID NO: 1134983 - protein, 18 aa, Mycobacterium
RRRRRAHPAAVLAEDLQA

SEQ ID NO: 1134984 - protein, 29 aa, Mycobacterium
RRRTDRLWPLRWLRNAALLFTFLNAFVDF

SEQ ID NO: 1134985 - protein, 24 aa, Mycobacterium
RRRTETWWAWQASGLFLITLMVSA

SEQ ID NO: 1134986 - protein, 25 aa, Mycobacterium
RRRYRLPSALPGVALLLAKAPVIAA

SEQ ID NO: 1134987 - protein, 23 aa, Mycobacterium
RRSDLAMTWLLTGLFAGIVSGFV

SEQ ID NO: 1134988 - protein, 18 aa, Mycobacterium
RRSRWMTSAAVGLAAAVL

SEQ ID NO: 1134989 - protein, 37 aa, Mycobacterium
RRSVGLFAFGPPPPPLMLPAPRFPPPPGFPHRRIIRD

SEQ ID NO: 1134990 - protein, 22 aa, Mycobacterium
RRTNDILRLVLATALLAIVVTS

SEQ ID NO: 1134991 - protein, 23 aa, Mycobacterium
RRTYPLLVRRLVTLVPALAILAI

SEQ ID NO: 1134992 - protein, 26 aa, Mycobacterium
RRVEAFALFNIFYQAGILAGPLVGLA

SEQ ID NO: 1134993 - protein, 24 aa, Mycobacterium
RRWGEFGMIPALNARRTPDRNAVI

SEQ ID NO: 1134994 - protein, 21 aa, Mycobacterium
RRWWMLPDHFDWVTGYLRSRG

SEQ ID NO: 1134995 - protein, 31 aa, Mycobacterium
RSALARWAAMTLAVTLLLLATTRPALTASGD

SEQ ID NO: 1134996 - protein, 17 aa, Mycobacterium
RSAWYRLPPREDAGPLL

SEQ ID NO: 1134997 - protein, 36 aa, Mycobacterium
RSERDRVALWGRILPITFTAVGLVLLVGGALLGSFS

SEQ ID NO: 1134998 - protein, 30 aa, Mycobacterium
RSGINQILRFITYLLVPAGLLTIYTQLFTT

SEQ ID NO: 1134999 - protein, 27 aa, Mycobacterium
RSKDFYLPGIWMYLGLAVVFTLSVVIR

SEQ ID NO: 1135000 - protein, 46 aa, Mycobacterium
RSLGVIGGILGALVLLIVIVVLVLGFWKPGFFVTTKLDVNAAQSGV

SEQ ID NO: 1135001 - protein, 18 aa, Mycobacterium
RSPFAGLAPWILMAVVAG

SEQ ID NO: 1135002 - protein, 22 aa, Mycobacterium
RSQRLFVAQWRNTGRLNAHIEE

SEQ ID NO: 1135003 - protein, 25 aa, Mycobacterium
RSRKPGMMLLIGLAITVAFVASWGA

SEQ ID NO: 1135004 - protein, 17 aa, Mycobacterium
RSRPLDFGIGVSAGPVF

SEQ ID NO: 1135005 - protein, 22 aa, Mycobacterium
RSRPWWIRHQPPRGYGRLARMV

SEQ ID NO: 1135006 - protein, 19 aa, Mycobacterium
RSSVLPICPPPATTSRRPP

SEQ ID NO: 1135007 - protein, 17 aa, Mycobacterium
RSTAARAMPGSGLGLAI

SEQ ID NO: 1135008 - protein, 25 aa, Mycobacterium
RTDDDGLYYFLGRRGAMIKTAGANV

SEQ ID NO: 1135009 - protein, 26 aa, Mycobacterium
RTDDMRALFTAIINDDPLPGEKNPDN

SEQ ID NO: 1135010 - protein, 23 aa, Mycobacterium
RTDILPAGYFPPATQIAAAFVGE

SEQ ID NO: 1135011 - protein, 23 aa, Mycobacterium
RTELQADCYAGVWAHYAAVTTQE

SEQ ID NO: 1135012 - protein, 19 aa, Mycobacterium
RTKEQYLWARLLGSTVVGQ

SEQ ID NO: 1135013 - protein, 18 aa, Mycobacterium
RTLMWLVDLLLVVPSFIL

SEQ ID NO: 1135014 - protein, 17 aa, Mycobacterium
RTPWPVFTLGMLQADII

SEQ ID NO: 1135015 - protein, 17 aa, Mycobacterium
RTQIVVPPLVWSPRPDD

SEQ ID NO: 1135016 - protein, 42 aa, Mycobacterium
RTRRAASWLAALAVPAAICALTVLLLDPLLGVAGESAVFFVG

SEQ ID NO: 1135017 - protein, 22 aa, Mycobacterium
RTRSLLELGGMTVALTLAAALA

SEQ ID NO: 1135018 - protein, 25 aa, Mycobacterium
RTTSIVVQLLLLRSGLGMRAPPSAV

SEQ ID NO: 1135019 - protein, 24 aa, Mycobacterium
RTWHVQLSLFWTAAAFLAGGIFLT

SEQ ID NO: 1135020 - protein, 25 aa, Mycobacterium
RVDFQDRIYAPLQGTPLPPGAVPAG

SEQ ID NO: 1135021 - protein, 18 aa, Mycobacterium
RVDFVDWAHDLAGPGWLA

SEQ ID NO: 1135022 - protein, 27 aa, Mycobacterium
RVEWRVLPAYWLTQVIAGVAAGLVIYV

SEQ ID NO: 1135023 - protein, 18 aa, Mycobacterium
RVFGFHRAMDTFGAVVGP

SEQ ID NO: 1135024 - protein, 20 aa, Mycobacterium
RVGLVALVVFLLVSVGLTWQ

SEQ ID NO: 1135025 - protein, 21 aa, Mycobacterium
RVGNPPVIRRSTLSLFSDRTP

SEQ ID NO: 1135026 - protein, 20 aa, Mycobacterium
RVIHISLLLGAAFLLLMLRG

SEQ ID NO: 1135027 - protein, 19 aa, Mycobacterium
RVIPSMMFGGAITGALVMA

SEQ ID NO: 1135028 - protein, 18 aa, Mycobacterium
RVITLLSLLVLSAPTFVI

SEQ ID NO: 1135029 - protein, 20 aa, Mycobacterium
RVKMWLFPVLSVLTAVGIVA

SEQ ID NO: 1135030 - protein, 20 aa, Mycobacterium
RVMPMPIVSLRTIVIVAALS

SEQ ID NO: 1135031 - protein, 27 aa, Mycobacterium
RVRAALKYVWRDKPLFLALLAVTTVGF

SEQ ID NO: 1135032 - protein, 23 aa, Mycobacterium
RVRTQVTVLRRLAVAIVVVLGSA

SEQ ID NO: 1135033 - protein, 26 aa, Mycobacterium
RVTDTSWFADWPPAAKLAAWGIQLHM

SEQ ID NO: 1135034 - protein, 26 aa, Mycobacterium
RVTGLPLPAVLVPPMALSRLVLGVHY

SEQ ID NO: 1135035 - protein, 27 aa, Mycobacterium
RVTRGEWLWALLLTAALTVFVALAKSS

SEQ ID NO: 1135036 - protein, 30 aa, Mycobacterium
RVVLGIIKTLARWLIRRWRLSDEMALLIGT

SEQ ID NO: 1135037 - protein, 26 aa, Mycobacterium
RWAVFGAWVLLLVPAIYLALNHSSNL

SEQ ID NO: 1135038 - protein, 20 aa, Mycobacterium
RWWVPSLLTNLGLAAFVVYA

SEQ ID NO: 1135039 - protein, 18 aa, Mycobacterium
RYLVTDLGVLFGVPDDDT

SEQ ID NO: 1135040 - protein, 23 aa, Mycobacterium
RYPNPFLFVVNYIKQVVAELRKV

SEQ ID NO: 1135041 - protein, 24 aa, Mycobacterium
RYRLLVFHGGPPNLQFWQALDTAL

SEQ ID NO: 1135042 - protein, 49 aa, Mycobacterium
SAAEDDGEWLSWRWNWWWLLALIPVLLVVGLIVGAALWRRRRDDRDHHF

SEQ ID NO: 1135043 - protein, 22 aa, Mycobacterium
SAAFIMFAGIFYGGMYGGSTTS

SEQ ID NO: 1135044 - protein, 24 aa, Mycobacterium
SAAIILALVYLAGWWRLRRRGDAW

SEQ ID NO: 1135045 - protein, 25 aa, Mycobacterium
SAAKNVLSAFKVPTIWLLLDDDDAV

SEQ ID NO: 1135046 - protein, 22 aa, Mycobacterium
SAALVTWGPLLSAVAYQVFTNL

SEQ ID NO: 1135047 - protein, 27 aa, Mycobacterium
SAAMAFLGWRWNLPLGVAILLAAVCGG

SEQ ID NO: 1135048 - protein, 24 aa, Mycobacterium
SAAVLLIGMGRWYLGMSSRHATGT

SEQ ID NO: 1135049 - protein, 28 aa, Mycobacterium
SACGDFLLAIPWWEPSFVLGLASFLVAH

SEQ ID NO: 1135050 - protein, 25 aa, Mycobacterium
SAENPVVPFVLFKDRNRLATFAAVF

SEQ ID NO: 1135051 - protein, 26 aa, Mycobacterium
SAGAVLVLLAGRRLWHRFRGQPDPAD

SEQ ID NO: 1135052 - protein, 25 aa, Mycobacterium
SAGVIAILLLLPFVIEPLLGSIPRV

SEQ ID NO: 1135053 - protein, 25 aa, Mycobacterium
SAIPSFWALPSRFLTGAAAAGGIGL

SEQ ID NO: 1135054 - protein, 22 aa, Mycobacterium
SALAAMVLAVRRGVKPVPVVGF

SEQ ID NO: 1135055 - protein, 24 aa, Mycobacterium
SALWHLVGRLHAERLDRSGPMWSG

SEQ ID NO: 1135056 - protein, 29 aa, Mycobacterium
SAPAWVGVPLYLLLGWVAAWFIGPIMDGA

SEQ ID NO: 1135057 - protein, 18 aa, Mycobacterium
SARFLITATGYLSQPRIP

SEQ ID NO: 1135058 - protein, 29 aa, Mycobacterium
SARNLSYFLQQWWIPVMPGLGVLVLALVG

SEQ ID NO: 1135059 - protein, 25 aa, Mycobacterium
SAVLCPLLVYGWLGAPRMGLEGSAV

SEQ ID NO: 1135060 - protein, 20 aa, Mycobacterium
SAVLFVVAGAWFLIEHRRVK

SEQ ID NO: 1135061 - protein, 17 aa, Mycobacterium
SAVLVACALFLAGASDA

SEQ ID NO: 1135062 - protein, 19 aa, Mycobacterium
SAVPTRQWRWPLGEIDKPF

SEQ ID NO: 1135063 - protein, 25 aa, Mycobacterium
SAVVLLVVLLIRPVCVFAMFGRGVL

SEQ ID NO: 1135064 - protein, 34 aa, Mycobacterium
SDAPAWLTWGVVPAYMLVALLFGTAWITSHIVRS

SEQ ID NO: 1135065 - protein, 24 aa, Mycobacterium
SDFDDFFRPIRNYFYWEPHCFNIP

SEQ ID NO: 1135066 - protein, 24 aa, Mycobacterium
SDPTKLIEIVAIGKQLLITRGALT

SEQ ID NO: 1135067 - protein, 25 aa, Mycobacterium
SDSDIFTLSFPFERWTRPENVADGD

SEQ ID NO: 1135068 - protein, 28 aa, Mycobacterium
SDVYSLGCVLYEILTGEPPFVGDSPVAV

SEQ ID NO: 1135069 - protein, 27 aa, Mycobacterium
SEHGAWGWLYTILAYGFAGYAFARIFS

SEQ ID NO: 1135070 - protein, 32 aa, Mycobacterium
SEIEVLGWPLWLLYVVVFALTLLIGVRLIVSV

SEQ ID NO: 1135071 - protein, 41 aa, Mycobacterium
SEIFGTDPLLFPFQPIHVTIAAWFTIGIPAFVLSLAPNNER

SEQ ID NO: 1135072 - protein, 23 aa, Mycobacterium
SERVYKPYPYILAIVDELADLMM

SEQ ID NO: 1135073 - protein, 21 aa, Mycobacterium
SFRLPTVLTTLFAAAAAVGCM

SEQ ID NO: 1135074 - protein, 24 aa, Mycobacterium
SFTLMLVHALRQQFSRVRVFAFID

SEQ ID NO: 1135075 - protein, 17 aa, Mycobacterium
SGAMILLAGLLSDVIYA

SEQ ID NO: 1135076 - protein, 25 aa, Mycobacterium
SGATHLLGWVILAATIIPVADTVIV

SEQ ID NO: 1135077 - protein, 28 aa, Mycobacterium
SGGAIALLILAMLVAVIAALWVSRADAA

SEQ ID NO: 1135078 - protein, 17 aa, Mycobacterium
SGKLRGHRFSRLPAGRA

SEQ ID NO: 1135079 - protein, 24 aa, Mycobacterium
SGKTTLMLVLAGREPTAGTVERPG

SEQ ID NO: 1135080 - protein, 21 aa, Mycobacterium
SGLIWLAVLLPLSHGLRAAAE

SEQ ID NO: 1135081 - protein, 21 aa, Mycobacterium
SGLVFFLSQYFQLVQGYSPLG

SEQ ID NO: 1135082 - protein, 30 aa, Mycobacterium
SGQLVGALALLWFVIVLNAVIPFGVQTIVH

SEQ ID NO: 1135083 - protein, 24 aa, Mycobacterium
SGRLAALPLWAWLATLAVLTVGGP

SEQ ID NO: 1135084 - protein, 26 aa, Mycobacterium
SGTAFAIPTYLFMAGMFVMLGWGLFQ

SEQ ID NO: 1135085 - protein, 24 aa, Mycobacterium
SGTPVMNLWLRGLGAKIGRGVWCE

SEQ ID NO: 1135086 - protein, 20 aa, Mycobacterium
SGVTALLISAALLIVCGVSV

SEQ ID NO: 1135087 - protein, 18 aa, Mycobacterium
SHRRSVIYLGPPTLRAAD

SEQ ID NO: 1135088 - protein, 25 aa, Mycobacterium
SHRRVVLLIYMWVGIVALGAASTIF

SEQ ID NO: 1135089 - protein, 28 aa, Mycobacterium
SHSRSNWLVMFIVLIVLTVVAGAYAARG

SEQ ID NO: 1135090 - protein, 33 aa, Mycobacterium
SHTGGAWLILFMIFNVIWTYALVRGAAADVGNL

SEQ ID NO: 1135091 - protein, 26 aa, Mycobacterium
SIALFAGFVAALHMIISITAVAMARE

SEQ ID NO: 1135092 - protein, 31 aa, Mycobacterium
SIAPTVMKLIWRLLGLLPPQRRIASLTGPLG

SEQ ID NO: 1135093 - protein, 26 aa, Mycobacterium
SIDERFEIDRWLATAPPEVADAFTDE

SEQ ID NO: 1135094 - protein, 27 aa, Mycobacterium
SIGRWPVILLLVVVAVAVLYYATPNVQ

SEQ ID NO: 1135095 - protein, 22 aa, Mycobacterium
SIHSLFDRLPLMVTILIVTTTI

SEQ ID NO: 1135096 - protein, 20 aa, Mycobacterium
SIIIVARFIPGGRTPTMIAC

SEQ ID NO: 1135097 - protein, 21 aa, Mycobacterium
SILVLLAFPLLTAALFGLAAD

SEQ ID NO: 1135098 - protein, 20 aa, Mycobacterium
SIVAALFIFALWIATMGFEQ

SEQ ID NO: 1135099 - protein, 25 aa, Mycobacterium
SKNPLSLIFTLGGFAALLVLAQAVA

SEQ ID NO: 1135100 - protein, 26 aa, Mycobacterium
SLADRALLRRIWRFAGRHHRRLAAFV

SEQ ID NO: 1135101 - protein, 29 aa, Mycobacterium
SLAWTGDWPAWAFFSLPTRAWELAAGGLV

SEQ ID NO: 1135102 - protein, 35 aa, Mycobacterium
SLGVEEQFYLVWPLLIVGTAWLIARRFGPGAARSV

SEQ ID NO: 1135103 - protein, 30 aa, Mycobacterium
SLGVEEQFYLVWPLLLIAVVGVLAIRRSAP

SEQ ID NO: 1135104 - protein, 22 aa, Mycobacterium
SLIVVVTITLFISLAVYGASGN

SEQ ID NO: 1135105 - protein, 17 aa, Mycobacterium
SLLTQVCARSLAVARLE

SEQ ID NO: 1135106 - protein, 19 aa, Mycobacterium
SLTCLLYECLTGKPPFETG

SEQ ID NO: 1135107 - protein, 27 aa, Mycobacterium
SLVAVFQWGWLEPLGFEPIPSLDSTIP

SEQ ID NO: 1135108 - protein, 31 aa, Mycobacterium
SLVLSVALFFVWMIAVAFLYLVLGGMGVWSK

SEQ ID NO: 1135109 - protein, 28 aa, Mycobacterium
SLVRLAVLGLIMVPVIAGVLLAARVPEA

SEQ ID NO: 1135110 - protein, 17 aa, Mycobacterium
SLVYFLGLVADQRELFQ

SEQ ID NO: 1135111 - protein, 26 aa, Mycobacterium
SMATMVLFPMYFLKSFAYAGLAVVGF

SEQ ID NO: 1135112 - protein, 26 aa, Mycobacterium
SMTIPIALFMGVYLRFLRPGRVSEVS

SEQ ID NO: 1135113 - protein, 22 aa, Mycobacterium
SMWLVLTFPAWVLVVSALIYSR

SEQ ID NO: 1135114 - protein, 33 aa, Mycobacterium; identical to SEQ ID NO: 862182

SEQ ID NO: 1135115 - protein, 24 aa, Mycobacterium
SPDIPQSLWLIGCLVVLVCTLAMV

SEQ ID NO: 1135116 - protein, 24 aa, Mycobacterium
SPEMKIFLIALGCVWPVLLSTADG

SEQ ID NO: 1135117 - protein, 21 aa, Mycobacterium
SPNQLALNLSGAWRHSRGEGQ

SEQ ID NO: 1135118 - protein, 20 aa, Mycobacterium
SPTLLKLAVMTLGVLCVIAS

SEQ ID NO: 1135119 - protein, 19 aa, Mycobacterium
SPTRLLRLAPAAQTMLSGG

SEQ ID NO: 1135120 - protein, 18 aa, Mycobacterium
SQALAFTVEPPGGSQRPT

SEQ ID NO: 1135121 - protein, 41 aa, Mycobacterium
SQQWEYLDLPRLWQILLIVGLFLWIAIVWRGLRSSLKTSSK

SEQ ID NO: 1135122 - protein, 26 aa, Mycobacterium
SQRHWAFALTYYWGLVLSAQALISPV

SEQ ID NO: 1135123 - protein, 25 aa, Mycobacterium
SQSRIGWIVVLLYAVCIVLRLARFN

SEQ ID NO: 1135124 - protein, 23 aa, Mycobacterium
SRAGDLITWWTGDSVMVFDGSGL

SEQ ID NO: 1135125 - protein, 20 aa, Mycobacterium
SRFWRRSGIRIVRRPVPHLI

SEQ ID NO: 1135126 - protein, 20 aa, Mycobacterium
SRFYAAERTLWVDPVSGTIV

SEQ ID NO: 1135127 - protein, 36 aa, Mycobacterium
SRKFSVWGVLAWLVGLGFFFPVFWMILTSFKQEGDA

SEQ ID NO: 1135128 - protein, 20 aa, Mycobacterium
SRLELWRSDMVRMLSYGALD

SEQ ID NO: 1135129 - protein, 26 aa, Mycobacterium
SRPGQSLWYVKLKKPSFQPPSQAFGI

SEQ ID NO: 1135130 - protein, 31 aa, Mycobacterium
SRRVNITALLFLGGIYLFWNTVAGQAGIFMP

SEQ ID NO: 1135131 - protein, 26 aa, Mycobacterium
SSAPMFLLGILGLIVFYQQLGWVPAN

SEQ ID NO: 1135132 - protein, 23 aa, Mycobacterium
SSAPPPPVVTVTTAPPAPAPPPE

SEQ ID NO: 1135133 - protein, 22 aa, Mycobacterium
SSDFLPFGWVAVLYALPFAMWF

SEQ ID NO: 1135134 - protein, 22 aa, Mycobacterium
SSFAVLMYYAIANASAWTLGAR

SEQ ID NO: 1135135 - protein, 43 aa, Mycobacterium
SSFVMFAIGAIIPLIPYLLGYESLWVGLLFGGVGLLIAGASAA

SEQ ID NO: 1135136 - protein, 26 aa, Mycobacterium
SSGAIILFVYLLIAVSQIILRRRTPD

SEQ ID NO: 1135137 - protein, 18 aa, Mycobacterium
SSIGLLLIAGVTALILVL

SEQ ID NO: 1135138 - protein, 24 aa, Mycobacterium
SSLLANYLLLAILLRISHAARRPI

SEQ ID NO: 1135139 - protein, 26 aa, Mycobacterium
SSPVPAPWPVLARLPRGPELSRAAAS

SEQ ID NO: 1135140 - protein, 21 aa, Mycobacterium
SSSMRLVVIPQGVRRVLPALM

SEQ ID NO: 1135141 - protein, 24 aa, Mycobacterium
SSTLLYLIGGVLLGLVGVFLAVPR

SEQ ID NO: 1135142 - protein, 23 aa, Mycobacterium
SSYAQFLMPLVALQGISFAAITG

SEQ ID NO: 1135143 - protein, 30 aa, Mycobacterium
STAALITLLVTAIWVLAVVARPYEWWRVAL

SEQ ID NO: 1135144 - protein, 23 aa, Mycobacterium
STDFVAFLDSDVLPRRGWLEALL

SEQ ID NO: 1135145 - protein, 25 aa, Mycobacterium
STERLFYEPGASWAWLLAGPAAGGA

SEQ ID NO: 1135146 - protein, 22 aa, Mycobacterium
STMGILTWMFVDGHGSGLMNYT

SEQ ID NO: 1135147 - protein, 25 aa, Mycobacterium
STRGKYWWVRWAIITVAVVVLTVEV

SEQ ID NO: 1135148 - protein, 35 aa, Mycobacterium
STRIPAPVILVVLATLLFGLFANRWLARRTRRRVN

SEQ ID NO: 1135149 - protein, 25 aa, Mycobacterium
STRTTLRFLWLRLARVWPVYLVTMH

SEQ ID NO: 1135150 - protein, 24 aa, Mycobacterium
STSEAVVFWILGGIALIGALGVVS

SEQ ID NO: 1135151 - protein, 26 aa, Mycobacterium
STTYSYWFEPNPYWSRLHAPGAELKT

SEQ ID NO: 1135152 - protein, 29 aa, Mycobacterium
STVRALVWSQIGIGAAVLLVLGVAGYAVV

SEQ ID NO: 1135153 - protein, 27 aa, Mycobacterium
STYVGQWFSLLIIFTATVAAFGCHLAT

SEQ ID NO: 1135154 - protein, 26 aa, Mycobacterium
SVADFWRFWVVHLWVEDFLELFTTVM

SEQ ID NO: 1135155 - protein, 22 aa, Mycobacterium
SVARRFAVLTLLLALAVSVAMT

SEQ ID NO: 1135156 - protein, 21 aa, Mycobacterium
SVAWTLMRYLPETPGLHFSNY

SEQ ID NO: 1135157 - protein, 23 aa, Mycobacterium
SVDNLFIFIIIMASFNVPRKYQQ

SEQ ID NO: 1135158 - protein, 25 aa, Mycobacterium
SVDPVAALTWRVPSATAAAAVASKP

SEQ ID NO: 1135159 - protein, 27 aa, Mycobacterium
SVDTPALAWLPLFVVFGLLTGCLGAAY

SEQ ID NO: 1135160 - protein, 30 aa, Mycobacterium
SVGTLLLQGWTLPPLIRWLQPSFEHDRQSD

SEQ ID NO: 1135161 - protein, 30 aa, Mycobacterium
SVGVTAAYLWSLWALFFTHAGMPGMTMSFD

SEQ ID NO: 1135162 - protein, 23 aa, Mycobacterium
SVGWLRLGALVLALSALAALLLN

SEQ ID NO: 1135163 - protein, 26 aa, Mycobacterium
SVHMVAHMLLSMLVPILLVLGAPVTM

SEQ ID NO: 1135164 - protein, 32 aa, Mycobacterium
SVMLVVVLFVPAALPWYYTWPLAVVSALAQSR

SEQ ID NO: 1135165 - protein, 22 aa, Mycobacterium
SVPAIVWVAFQLTFAVITVALI

SEQ ID NO: 1135166 - protein, 31 aa, Mycobacterium
SVPSLWRETPAPYGPLFLWIGQTISSITGEN

SEQ ID NO: 1135167 - protein, 29 aa, Mycobacterium
SVRAGFIGLVLIVLVIVVGLQPQQLWSMA

SEQ ID NO: 1135168 - protein, 28 aa, Mycobacterium
SVSTIATLVLLVVLFGAAAVAAARPTGA

SEQ ID NO: 1135169 - protein, 20 aa, Mycobacterium
SVTFLALALPMLALGVAAVF

SEQ ID NO: 1135170 - protein, 23 aa, Mycobacterium
SVTVFALMWGVPYLTVSQGLSTS

SEQ ID NO: 1135171 - protein, 19 aa, Mycobacterium
SVVVLVLTLGTWVWIGVTN

SEQ ID NO: 1135172 - protein, 24 aa, Mycobacterium
SWAVVAVVALVFWILASRGIAGGQ

SEQ ID NO: 1135173 - protein, 19 aa, Mycobacterium
SWFVTRWVVASALGGPLLI

SEQ ID NO: 1135174 - protein, 17 aa, Mycobacterium
SWLRFGHGLVLSSVLLW

SEQ ID NO: 1135175 - protein, 17 aa, Mycobacterium
SWWPIMIALSFSTAAVG

SEQ ID NO: 1135176 - protein, 22 aa, Mycobacterium
TAAFGALVWIFQQGHLAALGTT

SEQ ID NO: 1135177 - protein, 19 aa, Mycobacterium
TACGVAVLHLLLSGRVTDG

SEQ ID NO: 1135178 - protein, 18 aa, Mycobacterium
TADEDMLASFVFLRRLLL

SEQ ID NO: 1135179 - protein, 18 aa, Mycobacterium
TADLIRFTVRQRSQDIPA

SEQ ID NO: 1135180 - protein, 23 aa, Mycobacterium
TAGFLLTVLATFGATTALFQWGW

SEQ ID NO: 1135181 - protein, 24 aa, Mycobacterium
TAGGYYLAFLFPLVTGLVARLRGT

SEQ ID NO: 1135182 - protein, 20 aa, Mycobacterium
TAGIPLLLGALLDGIPEQAV

SEQ ID NO: 1135183 - protein, 17 aa, Mycobacterium
TAGLIWLEPVRVALDLG

SEQ ID NO: 1135184 - protein, 22 aa, Mycobacterium
TAGPGFWWTFVIVGVGQFIVAL

SEQ ID NO: 1135185 - protein, 24 aa, Mycobacterium
TAGVLLIQFLLVAFSTPWAERVNN

SEQ ID NO: 1135186 - protein, 20 aa, Mycobacterium
TALLVRHCVRRFGGITGDVL

SEQ ID NO: 1135187 - protein, 29 aa, Mycobacterium
TASFVIAMIPLVWLLYTVVAKGVRAIVSS

SEQ ID NO: 1135188 - protein, 18 aa, Mycobacterium
TATAQIRLGPPVDLMAMA

SEQ ID NO: 1135189 - protein, 24 aa, Mycobacterium
TATRTRLLPRLGLPANAQPPAVVQ

SEQ ID NO: 1135190 - protein, 23 aa, Mycobacterium
TATTLPIMLLALPSGVLADLIDR

SEQ ID NO: 1135191 - protein, 23 aa, Mycobacterium
TAVDVDLPPLWGDEQRMSQVLAN

SEQ ID NO: 1135192 - protein, 17 aa, Mycobacterium
TAVVRALRLDGVTPRPV

SEQ ID NO: 1135193 - protein, 21 aa, Mycobacterium
TDAARLLAERYPNGMPPDVVV

SEQ ID NO: 1135194 - protein, 23 aa, Mycobacterium
TDARLLHRVLGLAVLRVSTGQEA

SEQ ID NO: 1135195 - protein, 18 aa, Mycobacterium
TDAYLAPIKLRNTTLTLI

SEQ ID NO: 1135196 - protein, 23 aa, Mycobacterium
TDDLRPIPVFGSDELARLTEAFN

SEQ ID NO: 1135197 - protein, 21 aa, Mycobacterium
TDFFDVLRDQFGSSGGPFAQE

SEQ ID NO: 1135198 - protein, 26 aa, Mycobacterium
TDGLSLLDCFYYATVSLSTTGYGDIT

SEQ ID NO: 1135199 - protein, 19 aa, Mycobacterium
TDIGWWRFNRLRMRDSKLG

SEQ ID NO: 1135200 - protein, 17 aa, Mycobacterium
TDLSWWAALSTNGIYVP

SEQ ID NO: 1135201 - protein, 23 aa, Mycobacterium
TDRTLLLWAIPLLIAPPMYSKDV

SEQ ID NO: 1135202 - protein, 34 aa, Mycobacterium
TDRVWRVVNSRWAELPPLLQPRAAASAAVVGERI

SEQ ID NO: 1135203 - protein, 34 aa, Mycobacterium
TDTGPPWSLWAVILLTSSLLLGCAIIYGVESAAS

SEQ ID NO: 1135204 - protein, 22 aa, Mycobacterium
TDTPTFLQLVNPLVAESVASAG

SEQ ID NO: 1135205 - protein, 18 aa, Mycobacterium
TDTVGIISALNRAVRLSA

SEQ ID NO: 1135206 - protein, 32 aa, Mycobacterium
TDVPPSRWQIARILLVLLLASMPILGISVDVF

SEQ ID NO: 1135207 - protein, 19 aa, Mycobacterium
TEMLRGTGSWTPFVAPTAT

SEQ ID NO: 1135208 - protein, 32 aa, Mycobacterium
TEPALDLDALIGGFRPLFRALDPEKVNNIARS

SEQ ID NO: 1135209 - protein, 22 aa, Mycobacterium
TESNWIIALMVAVPALAGIELL

SEQ ID NO: 1135210 - protein, 28 aa, Mycobacterium
TFAVIIVVLLIVYRSITTVLLVLGMVLL

SEQ ID NO: 1135211 - protein, 18 aa, Mycobacterium
TFFLLKDGPRFIPWLRRT

SEQ ID NO: 1135212 - protein, 37 aa, Mycobacterium
TFLNPVDLLWSFLQAILMALTVLFIHTYFGYFATGGP

SEQ ID NO: 1135213 - protein, 19 aa, Mycobacterium
TFLVLLRQGYRWTRTLLTA

SEQ ID NO: 1135214 - protein, 23 aa, Mycobacterium
TFMVLRLVFVGWRALSGRWLVPG

SEQ ID NO: 1135215 - protein, 29 aa, Mycobacterium
TFSSGQRALLWAAGVLGALAIVIAILIVL

SEQ ID NO: 1135216 - protein, 23 aa, Mycobacterium
TFVITAFAVMRLVGAPAAGLFVQ

SEQ ID NO: 1135217 - protein, 20 aa, Mycobacterium
TGAFLVVIVFGMSEGIRAQS

SEQ ID NO: 1135218 - protein, 47 aa, Mycobacterium
TGAHAPLWREFLRFWTVSFPVVAYRSWRWWLGSAAAFFLVAALIGFW

SEQ ID NO: 1135219 - protein, 18 aa, Mycobacterium
TGANVAMLLALQASLLSL

SEQ ID NO: 1135220 - protein, 31 aa, Mycobacterium
TGEANYGTWWFWLGLLLIVGILLLVGNLERS

SEQ ID NO: 1135221 - protein, 24 aa, Mycobacterium
TGFAAIRLRGLIHAPVDLGAGFVE

SEQ ID NO: 1135222 - protein, 22 aa, Mycobacterium
TGFGWRAVFLALAVLNLATLLG

SEQ ID NO: 1135223 - protein, 40 aa, Mycobacterium
TGIAFGALFFCLSLTPSLLPRDWLFQGLIGGANAAIGYGI

SEQ ID NO: 1135224 - protein, 23 aa, Mycobacterium
TGIAGWVFAWLAERSGSLVAPML

SEQ ID NO: 1135225 - protein, 20 aa, Mycobacterium
TGIVLVARIDADTAAQAVAL

SEQ ID NO: 1135226 - protein, 20 aa, Mycobacterium
TGLMLVLFVGLWAFTRGGDV

SEQ ID NO: 1135227 - protein, 25 aa, Mycobacterium
TGLQRQWYVVLPAVLPRVLVGVRIA

SEQ ID NO: 1135228 - protein, 28 aa, Mycobacterium
TGLTIVTWLLRIGFLASPPLVGLIADWT

SEQ ID NO: 1135229 - protein, 24 aa, Mycobacterium
TGRPSPRWRALLLAAVAACAACGL

SEQ ID NO: 1135230 - protein, 29 aa, Mycobacterium
TGRRVTRWEWLWAALLAGAVAVIVTVGNP

SEQ ID NO: 1135231 - protein, 22 aa, Mycobacterium
TGSDWFPGLDRQIVDYPAGQVQ

SEQ ID NO: 1135232 - protein, 28 aa, Mycobacterium
TGSVVLPLKALLLNVLSLSAAFGALVWI

SEQ ID NO: 1135233 - protein, 21 aa, Mycobacterium
TGTLLIVILALVLDAVLVLIG

SEQ ID NO: 1135234 - protein, 26 aa, Mycobacterium
TGTSWLFDWPIWADGVVFLLVSVLLL

SEQ ID NO: 1135235 - protein, 23 aa, Mycobacterium
TGVRFLLVPVFLAALFVGDGHET

SEQ ID NO: 1135236 - protein, 33 aa, Mycobacterium
TGVRQLSPYMLMMPLMMVMATVGFMAGGGSGAK

SEQ ID NO: 1135237 - protein, 24 aa, Mycobacterium
TGYGRILTAKLLVTAALTALAWRN

SEQ ID NO: 1135238 - protein, 20 aa, Mycobacterium
THGLMWSVIAPIGVRLVPAD

SEQ ID NO: 1135239 - protein, 24 aa, Mycobacterium
TIFVGMGLYFAFLGLTQFVQIPRE

SEQ ID NO: 1135240 - protein, 21 aa, Mycobacterium
TIGALAVVALVVWVIALNQPT

SEQ ID NO: 1135241 - protein, 33 aa, Mycobacterium
TILAVVLVVLYVLLRSALAPLILVAVTVLSALA

SEQ ID NO: 1135242 - protein, 17 aa, Mycobacterium
TIPMRKIHTFSVPPNMV

SEQ ID NO: 1135243 - protein, 28 aa, Mycobacterium
TISIILQLVILWTVIGLALAKLAANQRI

SEQ ID NO: 1135244 - protein, 29 aa, Mycobacterium
TIVSKIIYYALLLIVLQLAFGVFGPNPIS

SEQ ID NO: 1135245 - protein, 24 aa, Mycobacterium
TIYSLRFLWGAFSRKGLHEPSLRV

SEQ ID NO: 1135246 - protein, 18 aa, Mycobacterium
TLAALWPAEALEAVRLLI

SEQ ID NO: 1135247 - protein, 23 aa, Mycobacterium
TLERLFPGIGRLDDSFPGLGIDG

SEQ ID NO: 1135248 - protein, 21 aa, Mycobacterium
TLFRPLIITLAVVGIVYGAVV

SEQ ID NO: 1135249 - protein, 34 aa, Mycobacterium
TLGDPPRFLPARLHRWWLYRRLADVAALEHFTAV

SEQ ID NO: 1135250 - protein, 18 aa, Mycobacterium
TLGLVTFVFAFNPGMPLS

SEQ ID NO: 1135251 - protein, 27 aa, Mycobacterium
TLGSQWWQTFWRITLPSIRWGLTYGVV

SEQ ID NO: 1135252 - protein, 23 aa, Mycobacterium
TLKDYVAFPLLAGPFAPWVFTGN

SEQ ID NO: 1135253 - protein, 30 aa, Mycobacterium
TLLALPMRGFMFLTRPLLRGLNHAANWCLR

SEQ ID NO: 1135254 - protein, 22 aa, Mycobacterium
TLLVAIPFTVLVSFTLNILLRE

SEQ ID NO: 1135255 - protein, 20 aa, Mycobacterium
TLLVTFGVGLILQQIARDIF

SEQ ID NO: 1135256 - protein, 23 aa, Mycobacterium
TLNVTFVAFLTLACLIAAVGVVT

SEQ ID NO: 1135257 - protein, 17 aa, Mycobacterium
TLPILLANLTSVTQVLL

SEQ ID NO: 1135258 - protein, 28 aa, Mycobacterium
TLSAFTLIPYALVLLQLRVFYAREQPWT

SEQ ID NO: 1135259 - protein, 25 aa, Mycobacterium
TLSCLVIAGFWLRRRWPSRRQSGVF

SEQ ID NO: 1135260 - protein, 42 aa, Mycobacterium
TLTLTLGVMLAISWQITVVALVLVPVFVLPARRIGARMAHLS

SEQ ID NO: 1135261 - protein, 17 aa, Mycobacterium
TLTMRRGGPPLGGFGAV

SEQ ID NO: 1135262 - protein, 27 aa, Mycobacterium
TLVADALRALLYALPRGHEPGAPIGVT

SEQ ID NO: 1135263 - protein, 17 aa, Mycobacterium
TLVFFMGLFVMVAGLTH

SEQ ID NO: 1135264 - protein, 28 aa, Mycobacterium
TLVKRDFWRVLGIWILAALAAAVIAGAV

SEQ ID NO: 1135265 - protein, 26 aa, Mycobacterium
TLVPAPTVIIVGLPAGLRLAVDNAIA

SEQ ID NO: 1135266 - protein, 18 aa, Mycobacterium
TLYIYAIFAVTFVMRPVG

SEQ ID NO: 1135267 - protein, 22 aa, Mycobacterium
TMDRWLMWRWPTTGRFLEYMKV

SEQ ID NO: 1135268 - protein, 23 aa, Mycobacterium
TMGLPHVLVRFYTNPDGRVARRT

SEQ ID NO: 1135269 - protein, 22 aa, Mycobacterium
TMTIPLTVISFAIGLVIALGVA

SEQ ID NO: 1135270 - protein, 24 aa, Mycobacterium
TNGALFANLLPRFPEIKTDLALSN

SEQ ID NO: 1135271 - protein, 23 aa, Mycobacterium
TNKHWFIEVPIRIVAYTVVALIA

SEQ ID NO: 1135272 - protein, 24 aa, Mycobacterium
TPAEPLARWHVRAAALAVDVLPGL

SEQ ID NO: 1135273 - protein, 20 aa, Mycobacterium
TPFIVMERLPGRTLHDVMAD

SEQ ID NO: 1135274 - protein, 20 aa, Mycobacterium
TPIVLWFVVGLAYAGGRWRS

SEQ ID NO: 1135275 - protein, 25 aa, Mycobacterium
TPLWAAIYMLPLTFGFLVAGPLSGW

SEQ ID NO: 1135276 - protein, 25 aa, Mycobacterium
TPRPYLYAGILFFATLGALAVNIQP

SEQ ID NO: 1135277 - protein, 33 aa, Mycobacterium
TPTDFWLSAYWLMLCGMLIYLLGYGGRALLVLR

SEQ ID NO: 1135278 - protein, 25 aa, Mycobacterium
TPTMIACGILEFPYRRFLAFDAVAA

SEQ ID NO: 1135279 - protein, 24 aa, Mycobacterium
TPVAALMFRFNNPDALLVLLLVVA

SEQ ID NO: 1135280 - protein, 23 aa, Mycobacterium
TQAAQVVLTLPLATLTALQWVVW

SEQ ID NO: 1135281 - protein, 21 aa, Mycobacterium
TQIWRFLLTGGFAAIVDFGLY

SEQ ID NO: 1135282 - protein, 22 aa, Mycobacterium
TQPAAVVLVWLAAVAALAIPAT

SEQ ID NO: 1135283 - protein, 19 aa, Mycobacterium
TQPDYGAPAGWHAPGWPPQ

SEQ ID NO: 1135284 - protein, 25 aa, Mycobacterium
TQSRFWTRWTGWVMRRPWVAATSAA

SEQ ID NO: 1135285 - protein, 18 aa, Mycobacterium
TRHRIVFGLIALAGAIAW

SEQ ID NO: 1135286 - protein, 26 aa, Mycobacterium
TRIMAGFIVIIPLYAMAIIMSFLSAQ

SEQ ID NO: 1135287 - protein, 22 aa, Mycobacterium
TRLAEVLGRIYGRPASLQLHID

SEQ ID NO: 1135288 - protein, 20 aa, Mycobacterium
TRLDRAVAIKLLHPAMRAQP

SEQ ID NO: 1135289 - protein, 24 aa, Mycobacterium
TRNQIIQLVLIGALVYVAYPFLTA

SEQ ID NO: 1135290 - protein, 20 aa, Mycobacterium
TRRLLDGRSLWTAGIAGLGI

SEQ ID NO: 1135291 - protein, 26 aa, Mycobacterium
TRRSIPWERVFAYGVVPALALVLAVA

SEQ ID NO: 1135292 - protein, 20 aa, Mycobacterium
TRSPLWTLFAVVVVSLGFAV

SEQ ID NO: 1135293 - protein, 21 aa, Mycobacterium
TRSTWLLLGPAFVAAIAYVDP

SEQ ID NO: 1135294 - protein, 26 aa, Mycobacterium
TRVAPWSWVLPALSLVVLQLLASLAL

SEQ ID NO: 1135295 - protein, 31 aa, Mycobacterium
TRVGFLLLLWLFIWSVLRILRTDIYAPTGAV

SEQ ID NO: 1135296 - protein, 25 aa, Mycobacterium
TSAAWFERRYFFLILAAGAVGVGYS

SEQ ID NO: 1135297 - protein, 34 aa, Mycobacterium
TSADISWLLPLIYVLLAMSLVMWSGLRHSSRSRR

SEQ ID NO: 1135298 - protein, 18 aa, Mycobacterium
TSGWTPRFTGETIFLARA

SEQ ID NO: 1135299 - protein, 19 aa, Mycobacterium
TSLRIGLLTVPVAGLVIMV

SEQ ID NO: 1135300 - protein, 29 aa, Mycobacterium
TSRAWRNRMPPQRLALVMGSVAAVTMGAL

SEQ ID NO: 1135301 - protein, 35 aa, Mycobacterium
TSRLPLVLGIIAGISFVLLFLLTGSVVLPLKALLL

SEQ ID NO: 1135302 - protein, 28 aa, Mycobacterium
TSTLRKPIIVWWILWVLSTVVSVSSIAT

SEQ ID NO: 1135303 - protein, 25 aa, Mycobacterium
TTAAVFLAAWLPFNNGLRPEPLIAF

SEQ ID NO: 1135304 - protein, 17 aa, Mycobacterium
TTALITIPLFSALSDRV

SEQ ID NO: 1135305 - protein, 24 aa, Mycobacterium
TTDVRGQFWIWAGANIAPINWVLG

SEQ ID NO: 1135306 - protein, 25 aa, Mycobacterium
TTFGPGVFLWFTVIGGLTVVMSGGI

SEQ ID NO: 1135307 - protein, 24 aa, Mycobacterium
TTIEWYDFFLYATAASLVFNQAFF

SEQ ID NO: 1135308 - protein, 17 aa, Mycobacterium
TTMIALAVLYIAQEALF

SEQ ID NO: 1135309 - protein, 22 aa, Mycobacterium
TTPALYLLVLLGVGATLLQQSA

SEQ ID NO: 1135310 - protein, 24 aa, Mycobacterium
TTRAALLSWGGWLVVTAVVFSFAN

SEQ ID NO: 1135311 - protein, 25 aa, Mycobacterium
TTSRIPTPVVPLPTTPRSSTAPSTP

SEQ ID NO: 1135312 - protein, 35 aa, Mycobacterium
TTWRGWVDHTLVIALIATLTWLVTGLVKVAERQAI

SEQ ID NO: 1135313 - protein, 25 aa, Mycobacterium
TTWTNWVEIFLLSCIAFSLPRTFGR

SEQ ID NO: 1135314 - protein, 27 aa, Mycobacterium
TVAALAAGGIAWLAGWRSAADLCWIAG

SEQ ID NO: 1135315 - protein, 22 aa, Mycobacterium
TVALSVLWFAVAVLLAIFEPRL

SEQ ID NO: 1135316 - protein, 17 aa, Mycobacterium
TVALYWPSPTMVNAIVL

SEQ ID NO: 1135317 - protein, 18 aa, Mycobacterium
TVAWLLGCATLLITTSSG

SEQ ID NO: 1135318 - protein, 42 aa, Mycobacterium; identical to SEQ ID NO: 371865

SEQ ID NO: 1135319 - protein, 37 aa, Mycobacterium
TVGAGPLIRILRQFHHPLIYVLLVAGIVTALLREYVD

SEQ ID NO: 1135320 - protein, 24 aa, Mycobacterium
TVGGILLMLGLFTPLACSIVVGVM

SEQ ID NO: 1135321 - protein, 24 aa, Mycobacterium
TVGPWALYGLLFTIVILFALQGDQ

SEQ ID NO: 1135322 - protein, 21 aa, Mycobacterium
TVIQLGFVIGVGLLLDTFIVR

SEQ ID NO: 1135323 - protein, 17 aa, Mycobacterium
TVIVYRTLDARDAAVFF

SEQ ID NO: 1135324 - protein, 32 aa, Mycobacterium
TVLMRIVDVMFAFPVLLLALAVVAILGPGVTT

SEQ ID NO: 1135325 - protein, 24 aa, Mycobacterium
TVLTSPLPNWLPDAFRAAAAGVLA

SEQ ID NO: 1135326 - protein, 19 aa, Mycobacterium
TVMLVNIPANRKRVVAVSF

SEQ ID NO: 1135327 - protein, 20 aa, Mycobacterium
TVPSPLLKGGLAFVDTPGVG

SEQ ID NO: 1135328 - protein, 22 aa, Mycobacterium
TVPTLIFVITLLVTGVLVARRV

SEQ ID NO: 1135329 - protein, 17 aa, Mycobacterium
TVPVPTGFAAIRLRGLI

SEQ ID NO: 1135330 - protein, 20 aa, Mycobacterium
TVQLTPLLYAVLRAIDGRRS

SEQ ID NO: 1135331 - protein, 26 aa, Mycobacterium
TVSAVFFALFAIAAAWAFWLHLTPRP

SEQ ID NO: 1135332 - protein, 17 aa, Mycobacterium
TVSDFLPGYLDEIVIRV

SEQ ID NO: 1135333 - protein, 27 aa, Mycobacterium
TVSESWYMNWAFFVAMGAILALGAVII

SEQ ID NO: 1135334 - protein, 27 aa, Mycobacterium
TVTLVLLVATLAFFRGMIGRLAIFLAV

SEQ ID NO: 1135335 - protein, 20 aa, Mycobacterium
TVTPSGPSLPLGPAAEMADR

SEQ ID NO: 1135336 - protein, 18 aa, Mycobacterium
TVVAFWIGRPIITLSFNN

SEQ ID NO: 1135337 - protein, 29 aa, Mycobacterium
TVVVVVGGVILWRFFGDALSERSDAASAR

SEQ ID NO: 1135338 - protein, 24 aa, Mycobacterium
TVWLLSGFFFLFPVIIARRKYADR

SEQ ID NO: 1135339 - protein, 20 aa, Mycobacterium
TWEMSFLYAVVFGGFVAFSN

SEQ ID NO: 1135340 - protein, 18 aa, Mycobacterium
TWESLPDMPTPRGSYGAA

SEQ ID NO: 1135341 - protein, 18 aa, Mycobacterium
TWMQTVGAQWMLVGDPGA

SEQ ID NO: 1135342 - protein, 28 aa, Mycobacterium
TYHASIEQLLVLLPPYVAATQTVGVSRN

SEQ ID NO: 1135343 - protein, 30 aa, Mycobacterium
TYTPGHLALWLPFGALPWQAAVALAIMVNV

SEQ ID NO: 1135344 - protein, 26 aa, Mycobacterium
VAAAGWYLLLAELWPADSRPYIGGSQ

SEQ ID NO: 1135345 - protein, 25 aa, Mycobacterium
VAAAPVNYLKLMPATYVVLVVVVGY

SEQ ID NO: 1135346 - protein, 24 aa, Mycobacterium
VAAHTPYLAWLAQASANSAATAAQ

SEQ ID NO: 1135347 - protein, 24 aa, Mycobacterium
VAAITLLPALLGLVGERIASPKGR

SEQ ID NO: 1135348 - protein, 19 aa, Mycobacterium
VAALLLAAALTVSTLMLVS

SEQ ID NO: 1135349 - protein, 23 aa, Mycobacterium
VAAPILLTLLRLAQGFAVGGEWG

SEQ ID NO: 1135350 - protein, 24 aa, Mycobacterium
VAAPLLLLLLRCLQGFSAGGEYGS

SEQ ID NO: 1135351 - protein, 26 aa, Mycobacterium
VAAVGVGLLLYFTPIMSVRDIVVVGL

SEQ ID NO: 1135352 - protein, 26 aa, Mycobacterium
VAAYLVGIVLTWVLSRVARRSHVVKD

SEQ ID NO: 1135353 - protein, 24 aa, Mycobacterium
VACALLAGLWHRGDLPLLVIAAAA

SEQ ID NO: 1135354 - protein, 18 aa, Mycobacterium
VAELLAIAGVKYLVLGEG

SEQ ID NO: 1135355 - protein, 20 aa, Mycobacterium
VAFAVFPTWAGLIATVALAP

SEQ ID NO: 1135356 - protein, 25 aa, Mycobacterium
VAGCAILAVLRPQGGLGDAPIVMEA

SEQ ID NO: 1135357 - protein, 29 aa, Mycobacterium
VAGLVLLYLFIPIFVIVLFSFNDPKGKFN

SEQ ID NO: 1135358 - protein, 51 aa, Mycobacterium
VAKVGPLEFGGFIAWLAWLALHLVYLVGFKTKIVTLISWTVTFLSTKRGQL

SEQ ID NO: 1135359 - protein, 23 aa, Mycobacterium
VALGPLTIDMYLPALPSIADELS

SEQ ID NO: 1135360 - protein, 19 aa, Mycobacterium
VALLLLWYCATVMVSMVGF

SEQ ID NO: 1135361 - protein, 19 aa, Mycobacterium
VALMLLGIPPLLAGTYSGI

SEQ ID NO: 1135362 - protein, 18 aa, Mycobacterium
VALNSLLGFLAFIIASSS

SEQ ID NO: 1135363 - protein, 28 aa, Mycobacterium
VALTRIGAVLVPLSTLLAPRELVAQLRT

SEQ ID NO: 1135364 - protein, 22 aa, Mycobacterium
VALVMIFGFFIMGILAYRTYTA

SEQ ID NO: 1135365 - protein, 19 aa, Mycobacterium
VAMQYSYLPSWISFLGDQQ

SEQ ID NO: 1135366 - protein, 24 aa, Mycobacterium
VAMVVVLMSVAVYAVVSRALYDDI

SEQ ID NO: 1135367 - protein, 25 aa, Mycobacterium
VAPQGLDYLVAFLGSLQAGLIAVPL

SEQ ID NO: 1135368 - protein, 25 aa, Mycobacterium
VAPYVLELLALRRLTTAAFGTLMSL

SEQ ID NO: 1135369 - protein, 34 aa, Mycobacterium
VARTLALALGLYLVAALLVWIQARLLNVVVQRTM

SEQ ID NO: 1135370 - protein, 17 aa, Mycobacterium
VATLILVYTYRVLTGGQ

SEQ ID NO: 1135371 - protein, 27 aa, Mycobacterium
VATRVIFPLIMVLSAYFFFAGHNTPGG

SEQ ID NO: 1135372 - protein, 34 aa, Mycobacterium
VAVGFGFLAKMLQAFLVLPGFVAAYLLAGSRPVG

SEQ ID NO: 1135373 - protein, 25 aa, Mycobacterium
VAVGIAMIVLLPKVTTAIPAPLVAI

SEQ ID NO: 1135374 - protein, 28 aa, Mycobacterium
VAVLARNHRWFLVAVYGAARTGARIILL

SEQ ID NO: 1135375 - protein, 20 aa, Mycobacterium
VAVLFAAVRRVSGAGAGMVA

SEQ ID NO: 1135376 - protein, 17 aa, Mycobacterium
VAVLLGLRTLIVVSRSI

SEQ ID NO: 1135377 - protein, 20 aa, Mycobacterium
VAVPFACHLLLYAVDIDVDN

SEQ ID NO: 1135378 - protein, 25 aa, Mycobacterium
VAVRRPWVAWAAVTFIVVSLYLGAL

SEQ ID NO: 1135379 - protein, 26 aa, Mycobacterium
VAVYGLTSMLLGGLPLLALAAGLAVI

SEQ ID NO: 1135380 - protein, 21 aa, Mycobacterium
VCGFFGWGFATTMAGLPFAMF

SEQ ID NO: 1135381 - protein, 31 aa, Mycobacterium
VDGANWFYMFRKLMLPMLWPYILVAVIFRFM

SEQ ID NO: 1135382 - protein, 26 aa, Mycobacterium
VDRLPLLCCLVAFILTFFVTRTIVRY

SEQ ID NO: 1135383 - protein, 28 aa, Mycobacterium
VDTTRLQRWFAYLVFAVAAYVIVDTVFL

SEQ ID NO: 1135384 - protein, 24 aa, Mycobacterium
VDVASAWRWTALLAAVVTLAALPV

SEQ ID NO: 1135385 - protein, 25 aa, Mycobacterium
VDVFFVLSGFLITSLLLDELGRTGR

SEQ ID NO: 1135386 - protein, 17 aa, Mycobacterium
VDVKRILDSATGTFYDE

SEQ ID NO: 1135387 - protein, 22 aa, Mycobacterium
VDVTAFQWNWKFGYNKVNFADG

SEQ ID NO: 1135388 - protein, 24 aa, Mycobacterium
VDYSLFILMRFREELRAGRDAQQA

SEQ ID NO: 1135389 - protein, 32 aa, Mycobacterium
VEAVRRRLWHRLPWLVLGLLGAMVSAVLMSAF

SEQ ID NO: 1135390 - protein, 24 aa, Mycobacterium
VEHPWLLVVLAPMVGAGAFFFWQY

SEQ ID NO: 1135391 - protein, 25 aa, Mycobacterium
VELPKAMFWIGIVYILFATVVAFWI

SEQ ID NO: 1135392 - protein, 17 aa, Mycobacterium
VENTIGTRRLWPAAVAV

SEQ ID NO: 1135393 - protein, 32 aa, Mycobacterium
VEPAPTTVATFFPPVLQRLTIYAPIDADDAEE

SEQ ID NO: 1135394 - protein, 24 aa, Mycobacterium
VEQLWLRCALVIAIAMGAAMIAIG

SEQ ID NO: 1135395 - protein, 20 aa, Mycobacterium
VFALLTLASSRRRGKGLAAL

SEQ ID NO: 1135396 - protein, 18 aa, Mycobacterium
VFAQLLLLPVTWYVAVGS

SEQ ID NO: 1135397 - protein, 19 aa, Mycobacterium
VFIVASWPVASKSAPVVAV

SEQ ID NO: 1135398 - protein, 20 aa, Mycobacterium
VFLWLLFGAHANAWAVGVLM

SEQ ID NO: 1135399 - protein, 24 aa, Mycobacterium
VFSALYLPLLAILFGMILRIVGIE

SEQ ID NO: 1135400 - protein, 26 aa, Mycobacterium
VGAALWLPWLLVAGIVFVLVSAAGLV

SEQ ID NO: 1135401 - protein, 30 aa, Mycobacterium
VGAATLLGWLLAAFAVRPLKRLAEQTRQID

SEQ ID NO: 1135402 - protein, 34 aa, Mycobacterium
VGAGIIIAVLICLGAALMAYFKPLGKRGGDQLLV

SEQ ID NO: 1135403 - protein, 23 aa, Mycobacterium
VGAISLFYLHLPAAVGIGAYDVT

SEQ ID NO: 1135404 - protein, 26 aa, Mycobacterium
VGALAGAWLWREALASAVIVVAVNLA

SEQ ID NO: 1135405 - protein, 23 aa, Mycobacterium
VGALWGLLFVGVSGPLLPGDVAA

SEQ ID NO: 1135406 - protein, 19 aa, Mycobacterium
VGAPLGLLIALGTLAGLLV

SEQ ID NO: 1135407 - protein, 19 aa, Mycobacterium
VGGRTLPLILVGGALMGSA

SEQ ID NO: 1135408 - protein, 19 aa, Mycobacterium
VGHFLLKSSLRPPGGRMFD

SEQ ID NO: 1135409 - protein, 28 aa, Mycobacterium
VGLAAGAWYFWPIWPILGAGIGVLGHAL

SEQ ID NO: 1135410 - protein, 19 aa, Mycobacterium
VGLLLGMYFKYLASPSTEI

SEQ ID NO: 1135411 - protein, 28 aa, Mycobacterium
VGLQIGAVLLASWLLATPLTSSDQPSLA

SEQ ID NO: 1135412 - protein, 23 aa, Mycobacterium
VGLYATLGVFLWIAARRPEAHLS

SEQ ID NO: 1135413 - protein, 18 aa, Mycobacterium
VGPFIYCVIVFTALIDWI

SEQ ID NO: 1135414 - protein, 23 aa, Mycobacterium
VGPYVSFVVLPIFALANAGVHLD

SEQ ID NO: 1135415 - protein, 29 aa, Mycobacterium
VGQLTTPDFPWTALTIVLVIGVAAATAAT

SEQ ID NO: 1135416 - protein, 25 aa, Mycobacterium
VGRHGEPFRMWKFRSMQPEADARLA

SEQ ID NO: 1135417 - protein, 29 aa, Mycobacterium
VGSIFALGFIILTLPLGLVFGWLGKRLAV

SEQ ID NO: 1135418 - protein, 25 aa, Mycobacterium
VGSRRAWAIPVAVVGALIAVGAAVV

SEQ ID NO: 1135419 - protein, 29 aa, Mycobacterium
VGTLLLHGLTLPWLIRRLGVQGDEAHTDA

SEQ ID NO: 1135420 - protein, 20 aa, Mycobacterium
VGTLLVHEYLAGALVAVMLA

SEQ ID NO: 1135421 - protein, 23 aa, Mycobacterium
VGVDLLFYSYHRIAHRVRLVWAT

SEQ ID NO: 1135422 - protein, 31 aa, Mycobacterium
VGVLLSLQALVFHLGYLWAAVLGGVVLMVAG

SEQ ID NO: 1135423 - protein, 26 aa, Mycobacterium
VGVVAAVLLWQWRAHRGPVLVAALAA

SEQ ID NO: 1135424 - protein, 28 aa, Mycobacterium
VHDRGDFDGLLWISMDFVQGTDAARLLA

SEQ ID NO: 1135425 - protein, 19 aa, Mycobacterium
VHHAITPWLAGLGAPSWAA

SEQ ID NO: 1135426 - protein, 26 aa, Mycobacterium
VHNRGGFPVLPMAFTPDFDVAVDSPG

SEQ ID NO: 1135427 - protein, 23 aa, Mycobacterium
VHRETWVRVIFGVGMVAAWAVLL

SEQ ID NO: 1135428 - protein, 25 aa, Mycobacterium
VIAAFLLIVYVATSLVFTPALIVLE

SEQ ID NO: 1135429 - protein, 19 aa, Mycobacterium
VIAFGTSFIAAMYGLVRLA

SEQ ID NO: 1135430 - protein, 25 aa, Mycobacterium
VIALAAKRVLWLTKLIRSGAPTSEA

SEQ ID NO: 1135431 - protein, 18 aa, Mycobacterium
VIALPFFGIVSEIFPVFS

SEQ ID NO: 1135432 - protein, 28 aa, Mycobacterium
VIAQNFNWHVLFWFAAGLGAAALICFAV

SEQ ID NO: 1135433 - protein, 26 aa, Mycobacterium
VIAVAGWTLIYWAQMPEGFAYGTELD

SEQ ID NO: 1135434 - protein, 29 aa, Mycobacterium
VIAVRIVWVYLFAYLPRLVSPALRYREPS

SEQ ID NO: 1135435 - protein, 23 aa, Mycobacterium
VIFAVVWLMIVYLRAEVLRRQKR

SEQ ID NO: 1135436 - protein, 32 aa, Mycobacterium
VIGGIWLVLVGWLTVWPFLNWWTTHFVITDRR

SEQ ID NO: 1135437 - protein, 19 aa, Mycobacterium
VIGHILWLIAITLATNTSD

SEQ ID NO: 1135438 - protein, 26 aa, Mycobacterium
VIGKARFIAWPPGRWGGVGSVNPQTA

SEQ ID NO: 1135439 - protein, 27 aa, Mycobacterium
VIGYLASFYLLWLTLSLGLPVGIAYGV

SEQ ID NO: 1135440 - protein, 26 aa, Mycobacterium
VIKPKFPARLRIFLLTLAVVDDVGAL

SEQ ID NO: 1135441 - protein, 17 aa, Mycobacterium
VIPPMKGLYVGCTLAPN

SEQ ID NO: 1135442 - protein, 25 aa, Mycobacterium
VITIPAHFFGLRRPWPAVVTAHAVE

SEQ ID NO: 1135443 - protein, 25 aa, Mycobacterium
VITNFAWLFPILTGIPISQSTWNMQ

SEQ ID NO: 1135444 - protein, 28 aa, Mycobacterium
VIVGYPVTTIFLVLAIAGGILAGWLHFR

SEQ ID NO: 1135445 - protein, 27 aa, Mycobacterium
VIVNRVLLPSLIGWTLGRALCGIRVLR

SEQ ID NO: 1135446 - protein, 26 aa, Mycobacterium
VIVVVFVIAGFWWFDGYQLVQERYWQ

SEQ ID NO: 1135447 - protein, 24 aa, Mycobacterium
VIVVVPLYCVALLMSFFSVRVITT

SEQ ID NO: 1135448 - protein, 28 aa, Mycobacterium
VIWVTSAYLLAYAVPLLVAGRLGDRFGP

SEQ ID NO: 1135449 - protein, 25 aa, Mycobacterium
VKAPLWPLHRWLPDAAVEATPASAV

SEQ ID NO: 1135450 - protein, 18 aa, Mycobacterium
VKLGLMCLAAFPILVALV

SEQ ID NO: 1135451 - protein, 27 aa, Mycobacterium
VLAAWSTPFWVFIITGAIAAGAMFPAT

SEQ ID NO: 1135452 - protein, 29 aa, Mycobacterium
VLAFSAVSILFLFGLQLLQGRLPLHLNDP

SEQ ID NO: 1135453 - protein, 30 aa, Mycobacterium
VLAGPGIGWSWWVLTAVAAVALLAVIVNRV

SEQ ID NO: 1135454 - protein, 28 aa, Mycobacterium
VLALVLLPQWRVTWVLIGVLTAVCALAV

SEQ ID NO: 1135455 - protein, 23 aa, Mycobacterium
VLAVANLLWFVFAGLGALTLEGQ

SEQ ID NO: 1135456 - protein, 17 aa, Mycobacterium
VLAWLLGELIRPGAGMV

SEQ ID NO: 1135457 - protein, 28 aa, Mycobacterium
VLDEIGVPWWFLVGQLPVAGVVFALDGV

SEQ ID NO: 1135458 - protein, 36 aa, Mycobacterium
VLDQPLPPSAHYVLPPPPPSRWRQLPGRTRKAIFAA

SEQ ID NO: 1135459 - protein, 24 aa, Mycobacterium
VLFSLVMFTLVYGALAVVWFGLMR

SEQ ID NO: 1135460 - protein, 29 aa, Mycobacterium
VLFYGVIGALLFRLVFIFVGAELLAAFFW

SEQ ID NO: 1135461 - protein, 17 aa, Mycobacterium
VLGIIGLTSLVLLFLLT

SEQ ID NO: 1135462 - protein, 37 aa, Mycobacterium
VLGPTPYSPWWLWAAILLVLLVIAWYAVVFVATLPSD

SEQ ID NO: 1135463 - protein, 18 aa, Mycobacterium
VLGRLYSTEFYALVTRAL

SEQ ID NO: 1135464 - protein, 27 aa, Mycobacterium
VLLANPGLPLWPYLLCAALAGFGGGNF

SEQ ID NO: 1135465 - protein, 18 aa, Mycobacterium
VLLITLINGVLLQGFLAG

SEQ ID NO: 1135466 - protein, 20 aa, Mycobacterium
VLLTLLVLALIQLVIDTAWC

SEQ ID NO: 1135467 - protein, 20 aa, Mycobacterium
VLLTQALTLLRRRLRDRRPS

SEQ ID NO: 1135468 - protein, 19 aa, Mycobacterium
VLLVHGFTDYFFHTELADH

SEQ ID NO: 1135469 - protein, 22 aa, Mycobacterium
VLLVMLTICSLLYRTLRRNHWL

SEQ ID NO: 1135470 - protein, 17 aa, Mycobacterium
VLLWGGVAIMLAAWLWL

SEQ ID NO: 1135471 - protein, 26 aa, Mycobacterium
VLMDATLVRLILVPAFMHVMGPANWW

SEQ ID NO: 1135472 - protein, 27 aa, Mycobacterium
VLPLIGFVLTVWLWTSLSAESLTIGLI

SEQ ID NO: 1135473 - protein, 39 aa, Mycobacterium
VLRARVWDSAPCKAWLLAHPLLLGVVLLVLFAATDRFDA

SEQ ID NO: 1135474 - protein, 17 aa, Mycobacterium
VLSAIYVLWMYQRMMTG

SEQ ID NO: 1135475 - protein, 28 aa, Mycobacterium
VLSLLSWGVVLLLYFANKHFLKRRPTKA

SEQ ID NO: 1135476 - protein, 17 aa, Mycobacterium
VLSLYEDFLCPACGNFE

SEQ ID NO: 1135477 - protein, 20 aa, Mycobacterium
VLSRMPLVLGIIGLTSLVLL

SEQ ID NO: 1135478 - protein, 27 aa, Mycobacterium
VLVSFGYTGLPFFPQGKSYEAYFTDAG

SEQ ID NO: 1135479 - protein, 18 aa, Mycobacterium
VMALLFKLLAPLEHRPLP

SEQ ID NO: 1135480 - protein, 24 aa, Mycobacterium
VMARLRLFGFGVPAFIGILSGIVA

SEQ ID NO: 1135481 - protein, 25 aa, Mycobacterium
VMLEAFVFAYIGLQLRFVLEDLNEA

SEQ ID NO: 1135482 - protein, 24 aa, Mycobacterium
VMTNYRRWLNRTLLFIGWNVSMSQ

SEQ ID NO: 1135483 - protein, 17 aa, Mycobacterium
VMTPTMYGLDNTILYIP

SEQ ID NO: 1135484 - protein, 26 aa, Mycobacterium
VMTRGLQIALLVIGALLGARFINWVA

SEQ ID NO: 1135485 - protein, 20 aa, Mycobacterium
VMTSVLVLMIRYVDLLVAEA

SEQ ID NO: 1135486 - protein, 32 aa, Mycobacterium
VNALIPRVDALPPTTALGLWTFDAAAGNSQIT

SEQ ID NO: 1135487 - protein, 24 aa, Mycobacterium
VNASRHAHWLNPEPKHLWGSGDSA

SEQ ID NO: 1135488 - protein, 23 aa, Mycobacterium
VNAVLFCVLLLAIGLVLSFLADL

SEQ ID NO: 1135489 - protein, 31 aa, Mycobacterium
VNIGRSLPFLILMAAIIPVTRFIVGTTIGIQ

SEQ ID NO: 1135490 - protein, 29 aa, Mycobacterium
VNILVVIYALLPVLWILSLSLKPTSSVKD

SEQ ID NO: 1135491 - protein, 18 aa, Mycobacterium
VNIPARLARPQRRAILHL

SEQ ID NO: 1135492 - protein, 22 aa, Mycobacterium
VPAAAVGLLILVRRRGLCWTEL

SEQ ID NO: 1135493 - protein, 31 aa, Mycobacterium
VPAVMSMLGDRAWWLPKRLARVLPDLDIEGD

SEQ ID NO: 1135494 - protein, 25 aa, Mycobacterium
VPEPPLGPVWVALLIVGAAAAVAVG

SEQ ID NO: 1135495 - protein, 28 aa, Mycobacterium
VPGSVRALPLEGLVFRDLLDAQTIELAL

SEQ ID NO: 1135496 - protein, 19 aa, Mycobacterium
VPGVAWFAVLLELSRPPDT

SEQ ID NO: 1135497 - protein, 23 aa, Mycobacterium
VPLLVATLAYGLIIIVIQALTNT

SEQ ID NO: 1135498 - protein, 23 aa, Mycobacterium
VPSLVSLVWFCILGGAAIDTQQG

SEQ ID NO: 1135499 - protein, 37 aa, Mycobacterium
VPVKQWGFFILLILLLAPALNQWFFGAVYWLAELSGV

SEQ ID NO: 1135500 - protein, 17 aa, Mycobacterium
VPVLLIAALILVIVGPR

SEQ ID NO: 1135501 - protein, 36 aa, Mycobacterium
VQAFDVFSSFWFTAIYVLLFISLVGCLTPRLVEHVK

SEQ ID NO: 1135502 - protein, 20 aa, Mycobacterium
VQQPKFRWISLGAGLAILTW

SEQ ID NO: 1135503 - protein, 23 aa, Mycobacterium
VQRALLPGTLPPTPGWTSGAASV

SEQ ID NO: 1135504 - protein, 25 aa, Mycobacterium
VQTKRLLMRFLRDPMTFFFGVVFPI

SEQ ID NO: 1135505 - protein, 25 aa, Mycobacterium
VQVLTGFLLILPFQDRFGALDDGAR

SEQ ID NO: 1135506 - protein, 24 aa, Mycobacterium
VRAQRWWLALNVLGALLINHLILT

SEQ ID NO: 1135507 - protein, 18 aa, Mycobacterium
VRELIEITLVKNPGMRYR

SEQ ID NO: 1135508 - protein, 26 aa, Mycobacterium
VRETIMRRLLAFGSALTIIGAAGGFG

SEQ ID NO: 1135509 - protein, 24 aa, Mycobacterium
VRKYLTLMSFRIPALILAAVAYSI

SEQ ID NO: 1135510 - protein, 18 aa, Mycobacterium
VRRWSMLVLGVMSTMCAN

SEQ ID NO: 1135511 - protein, 18 aa, Mycobacterium
VRTARVYSLLGLGAISVG

SEQ ID NO: 1135512 - protein, 28 aa, Mycobacterium
VSALAYVVIFSIPWAQELFILDPTNPAI

SEQ ID NO: 1135513 - protein, 26 aa, Mycobacterium
VSALFGLFQLVLGGSGWWIGLFNIVC

SEQ ID NO: 1135514 - protein, 18 aa, Mycobacterium
VSANWWWVVAAVVASLAS

SEQ ID NO: 1135515 - protein, 17 aa, Mycobacterium
VSATKWVVDLELTRFDR

SEQ ID NO: 1135516 - protein, 31 aa, Mycobacterium
VSDAILPALLWTPVATVVAVLLYAALTVAGV

SEQ ID NO: 1135517 - protein, 24 aa, Mycobacterium
VSGIFLSFVVNWLLQWAADGPNKP

SEQ ID NO: 1135518 - protein, 30 aa, Mycobacterium
VSGLALLVVFLFWPWEYQPYGSEGEFLYSL

SEQ ID NO: 1135519 - protein, 17 aa, Mycobacterium
VSHMWVTKFLRTHGLIH

SEQ ID NO: 1135520 - protein, 26 aa, Mycobacterium
VSLMQTLIIPLIPELPTLLRTGPANA

SEQ ID NO: 1135521 - protein, 17 aa, Mycobacterium
VSLTSPLTIRDGCGYDI

SEQ ID NO: 1135522 - protein, 25 aa, Mycobacterium
VSLVRRRTHLTRRALAALLIGFPIA

SEQ ID NO: 1135523 - protein, 25 aa, Mycobacterium
VSNTCAMGMMLSKLPYNRGASCDAQ

SEQ ID NO: 1135524 - protein, 18 aa, Mycobacterium
VSSVFMVAALGAPAVVHA

SEQ ID NO: 1135525 - protein, 34 aa, Mycobacterium
VSTASVWMRLPTLLMALACWWVISREVIPRLGHA

SEQ ID NO: 1135526 - protein, 35 aa, Mycobacterium
VSTSSIWMRLPDLICAVVCWLLLSREVLPRLGPAV

SEQ ID NO: 1135527 - protein, 26 aa, Mycobacterium
VSVAHRPFIPWLGWTMVAVVVASTVV

SEQ ID NO: 1135528 - protein, 24 aa, Mycobacterium
VSVGLLFVWQNTAAIFLAFVVAEM

SEQ ID NO: 1135529 - protein, 24 aa, Mycobacterium
VTAAILVFIFAWNDLLLALSLTAT

SEQ ID NO: 1135530 - protein, 30 aa, Mycobacterium
VTAALTALAWRNRSRWLPAARTHRASAGLS

SEQ ID NO: 1135531 - protein, 23 aa, Mycobacterium
VTAGHVIGWATIALMACFMGSIG

SEQ ID NO: 1135532 - protein, 17 aa, Mycobacterium
VTFHRIWRDSPVPAYVA

SEQ ID NO: 1135533 - protein, 30 aa, Mycobacterium
VTFIVVSLYLGALLRLPQWLLDASPVGQTT

SEQ ID NO: 1135534 - protein, 18 aa, Mycobacterium
VTGALWSVLAPPVHGVVA

SEQ ID NO: 1135535 - protein, 23 aa, Mycobacterium
VTGGPLRWGSALAGALNPAPVAF

SEQ ID NO: 1135536 - protein, 23 aa, Mycobacterium
VTGPRLTLVIGCAIISVSYLAGL

SEQ ID NO: 1135537 - protein, 32 aa, Mycobacterium
VTGTAVKALLTFQPWWTAMRSGSRTAPSAPVA

SEQ ID NO: 1135538 - protein, 23 aa, Mycobacterium
VTHITLLIVFSFVAGASADLSKF

SEQ ID NO: 1135539 - protein, 30 aa, Mycobacterium
VTLAALPVLRWAWTPPLFAGSLLTLMPLAL

SEQ ID NO: 1135540 - protein, 22 aa, Mycobacterium
VTLFAFILIANWLSVLPVQYSD

SEQ ID NO: 1135541 - protein, 17 aa, Mycobacterium
VTLVLLGLWHLSNRRHP

SEQ ID NO: 1135542 - protein, 30 aa, Mycobacterium
VTRWVIALAALAFTLWVALAAFFGPQNAEN

SEQ ID NO: 1135543 - protein, 24 aa, Mycobacterium
VVAALFGLGLLLLVATRPAHARPK

SEQ ID NO: 1135544 - protein, 40 aa, Mycobacterium
VVAAVFVLLVLPALLRLFGKKLFWPLIPKEGAAPLTDSGL

SEQ ID NO: 1135545 - protein, 27 aa, Mycobacterium
VVAFAVLVVFLLPALRDGASAVPVALV

SEQ ID NO: 1135546 - protein, 41 aa, Mycobacterium
VVAFSTMFAMLIGYRLPDFPGARWIAPLLGTVMYAVGGRPF

SEQ ID NO: 1135547 - protein, 21 aa, Mycobacterium
VVALDFVARTWSPLPDMTGPR

SEQ ID NO: 1135548 - protein, 18 aa, Mycobacterium
VVALIYFFNQITNVGIVF

SEQ ID NO: 1135549 - protein, 20 aa, Mycobacterium
VVALLLVLGAPFLDARWGFP

SEQ ID NO: 1135550 - protein, 25 aa, Mycobacterium
VVALVVWVIALNQPTDVREAAVCNP

SEQ ID NO: 1135551 - protein, 27 aa, Mycobacterium
VVAVLMALTWRRLPWQPLPDGDPPAMP

SEQ ID NO: 1135552 - protein, 24 aa, Mycobacterium
VVAVLVFVVLLSFVLPHAGGARGF

SEQ ID NO: 1135553 - protein, 22 aa, Mycobacterium
VVDIDVLRRLWPPVVIGALVLV

SEQ ID NO: 1135554 - protein, 35 aa, Mycobacterium
VVDWRSAVIVLIALPLIPIFMILIGLVTRDRSAAA

SEQ ID NO: 1135555 - protein, 25 aa, Mycobacterium
VVETLMRDGVIAHPTLGLTAQSVSD

SEQ ID NO: 1135556 - protein, 19 aa, Mycobacterium
VVGDALQHLILPAVVIAIG

SEQ ID NO: 1135557 - protein, 29 aa, Mycobacterium
VVGGAIALYLLFDLPLLIGGVITGAVSLA

SEQ ID NO: 1135558 - protein, 18 aa, Mycobacterium
VVGLVSSVFMVAALGAPA

SEQ ID NO: 1135559 - protein, 24 aa, Mycobacterium
VVLDGRLHKHWGFGGGPHRCLGAH

SEQ ID NO: 1135560 - protein, 20 aa, Mycobacterium
VVLFIVCSGLLQGIYWIRQG

SEQ ID NO: 1135561 - protein, 18 aa, Mycobacterium
VVLLVLLHRAKGGGLSTL

SEQ ID NO: 1135562 - protein, 18 aa, Mycobacterium
VVLVLVGVVLFGVGSVLF

SEQ ID NO: 1135563 - protein, 18 aa, Mycobacterium
VVPLLPGTLLVFGAIAVW

SEQ ID NO: 1135564 - protein, 23 aa, Mycobacterium
VVPVGLILWRTFSPGIGAFVASI

SEQ ID NO: 1135565 - protein, 18 aa, Mycobacterium
VVQDLLTIVIYFGAVTVL

SEQ ID NO: 1135566 - protein, 22 aa, Mycobacterium
VVVAWEVLWLRTGLFRRPAYWI

SEQ ID NO: 1135567 - protein, 18 aa, Mycobacterium
VVVYFLYGRRHSLVGRRE

SEQ ID NO: 1135568 - protein, 27 aa, Mycobacterium
VVWAIALIGAFYLFTLALGYGAAALVG

SEQ ID NO: 1135569 - protein, 27 aa, Mycobacterium
VVYTGAVMMLFLFVLMLVGVDNSESLV

SEQ ID NO: 1135570 - protein, 19 aa, Mycobacterium
VWFFAIVSVLFLAQALLGA

SEQ ID NO: 1135571 - protein, 25 aa, Mycobacterium
VWGAALTLILIIAALYLGAAFINRY

SEQ ID NO: 1135572 - protein, 25 aa, Mycobacterium
VWKLRPLQLVLTFAALLGAALVAFM

SEQ ID NO: 1135573 - protein, 20 aa, Mycobacterium
VWSALSLIALLGGTGILFAV

SEQ ID NO: 1135574 - protein, 18 aa, Mycobacterium
VWSPQFSLWLVPLAVLAL

SEQ ID NO: 1135575 - protein, 17 aa, Mycobacterium
VYAWLMPASTVAQAVIG

SEQ ID NO: 1135576 - protein, 40 aa, Mycobacterium
VYRTGLGSVPLLFALGDLVIGWLLLWQAKVANDALLQAHS

SEQ ID NO: 1135577 - protein, 20 aa, Mycobacterium
VYSAIFLATTMIALAVLYIA

SEQ ID NO: 1135578 - protein, 26 aa, Mycobacterium
VYTDIFRGLPEVVIILLIGLGVGPIV

SEQ ID NO: 1135579 - protein, 20 aa, Mycobacterium
VYVGVTFAGALWFGERWCAR

SEQ ID NO: 1135580 - protein, 20 aa, Mycobacterium
VYVQLVFWGLFPTLYQNIRI

SEQ ID NO: 1135581 - protein, 27 aa, Mycobacterium
VYVVMFILCGYLLWKSGWHVSLSLGGE

SEQ ID NO: 1135582 - protein, 24 aa, Mycobacterium
WAADGLLAVFFLVVGLELKREFVA

SEQ ID NO: 1135583 - protein, 25 aa, Mycobacterium
WAETTVIIRFWLLTAIACGLGVALF

SEQ ID NO: 1135584 - protein, 30 aa, Mycobacterium
WAIAGSFAVLFLPYSLLGPFAGALLDRWDR

SEQ ID NO: 1135585 - protein, 26 aa, Mycobacterium
WALGYVYFVMCWLWYPPRVSPAAETP

SEQ ID NO: 1135586 - protein, 17 aa, Mycobacterium
WAPLIVLAAAAATLVVL

SEQ ID NO: 1135587 - protein, 34 aa, Mycobacterium
WAQQMRAFVALRWWPLVLLVAVTVALVALAAYLE

SEQ ID NO: 1135588 - protein, 20 aa, Mycobacterium
WARWYPMAMLLAGTVLIAMS

SEQ ID NO: 1135589 - protein, 24 aa, Mycobacterium
WATALIPLALLVLAAAVAVLAVRG

SEQ ID NO: 1135590 - protein, 21 aa, Mycobacterium
WAYISGPFLAALAFTGWSILG

SEQ ID NO: 1135591 - protein, 24 aa, Mycobacterium
WDALGFLQDFFAVAVLLGIITFAI

SEQ ID NO: 1135592 - protein, 26 aa, Mycobacterium
WDERRLVLPCTYFTNTPFQNWTRNAT

SEQ ID NO: 1135593 - protein, 26 aa, Mycobacterium
WEISRPWYLAWAEMVYIVASLSTLAW

SEQ ID NO: 1135594 - protein, 21 aa, Mycobacterium
WESKPWTWPMSLRPVLYAIDN

SEQ ID NO: 1135595 - protein, 18 aa, Mycobacterium
WFGPVFYSKLLLGHAGAA

SEQ ID NO: 1135596 - protein, 17 aa, Mycobacterium
WFVFAGLGALTLEGQAV

SEQ ID NO: 1135597 - protein, 18 aa, Mycobacterium
WGAFLFMMSIYLQGERGL

SEQ ID NO: 1135598 - protein, 48 aa, Mycobacterium
WGDPHARLLKPWARIVVTVWVVVVVPLLLATLALAVWTLPRLVGTAWA

SEQ ID NO: 1135599 - protein, 25 aa, Mycobacterium
WGFLGWGMALYLWSGVLYLVQVVMV

SEQ ID NO: 1135600 - protein, 18 aa, Mycobacterium
WGIALLALAVRRVGRRPE

SEQ ID NO: 1135601 - protein, 19 aa, Mycobacterium
WHLVDLLWIVLFALLYLVS

SEQ ID NO: 1135602 - protein, 18 aa, Mycobacterium
WIHHFGLFAAVGAAVAAL

SEQ ID NO: 1135603 - protein, 22 aa, Mycobacterium
WKAVQLLLESFAFLLIGLQLPK

SEQ ID NO: 1135604 - protein, 21 aa, Mycobacterium
WKCPTDQWLWPTSFDPNNRVM

SEQ ID NO: 1135605 - protein, 18 aa, Mycobacterium
WLAARAWRRPLSLTPTGV

SEQ ID NO: 1135606 - protein, 31 aa, Mycobacterium
WLDLTRPQWFLLPSLLLIGIRLWYGHRRGYY

SEQ ID NO: 1135607 - protein, 17 aa, Mycobacterium
WLIFGGLWLALGYAVAG

SEQ ID NO: 1135608 - protein, 29 aa, Mycobacterium
WLLLHLPEKVFIAIVPVLLIAALILVIVG

SEQ ID NO: 1135609 - protein, 26 aa, Mycobacterium
WNEAHPYLPFVFTGSAAASGGGLGML

SEQ ID NO: 1135610 - protein, 23 aa, Mycobacterium
WNRHLIGLVLGFGAGALVAGISF

SEQ ID NO: 1135611 - protein, 27 aa, Mycobacterium
WPALVMFAIIFFWTPPHTWALAMRYKD

SEQ ID NO: 1135612 - protein, 22 aa, Mycobacterium
WQADADRWLFFGTMPTVWLQER

SEQ ID NO: 1135613 - protein, 24 aa, Mycobacterium
WRAVFWINLPICAAAIILTAVFVP

SEQ ID NO: 1135614 - protein, 21 aa, Mycobacterium
WRNRPVWRWFAFGAAVGVAAG

SEQ ID NO: 1135615 - protein, 18 aa, Mycobacterium
WRQLAGGSYVWWALLVIA

SEQ ID NO: 1135616 - protein, 29 aa, Mycobacterium
WRVQILVYGIVIFLLLLTAGSALVTARIR

SEQ ID NO: 1135617 - protein, 17 aa, Mycobacterium
WSIWSVMVLFMPEAVYG

SEQ ID NO: 1135618 - protein, 32 aa, Mycobacterium
WSLAVSMVVLVLIPVIATFTGVLGASGFMITE

SEQ ID NO: 1135619 - protein, 24 aa, Mycobacterium
WSSPFWQTWDLLLLWLAQLHGGNG

SEQ ID NO: 1135620 - protein, 17 aa, Mycobacterium
WSVLAPPVHGVVALTRA

SEQ ID NO: 1135621 - protein, 20 aa, Mycobacterium
WTMQILKAVPNFALTPLLII

SEQ ID NO: 1135622 - protein, 30 aa, Mycobacterium
WTPTADPGWKWLWWQYALADTRYVSGNPWI

SEQ ID NO: 1135623 - protein, 23 aa, Mycobacterium
WTQLAYGKPWTWAALAAAVVALL

SEQ ID NO: 1135624 - protein, 26 aa, Mycobacterium
WTTVPARFRPFLKQQVRWKKSFIRNL

SEQ ID NO: 1135625 - protein, 31 aa, Mycobacterium
WTYGNIQALWKHRAMLFRPRYGALGLVALPY

SEQ ID NO: 1135626 - protein, 18 aa, Mycobacterium
WVALALLVPVAALGVVMV

SEQ ID NO: 1135627 - protein, 29 aa, Mycobacterium
WVAVLYALPFAMWFFLGIEELPLAAEEAH

SEQ ID NO: 1135628 - protein, 30 aa, Mycobacterium
WVDLIRGSLRILLPLSIIGAIILVSGGVIQ

SEQ ID NO: 1135629 - protein, 18 aa, Mycobacterium
WVLGRPDAIGPLFPPVTY

SEQ ID NO: 1135630 - protein, 20 aa, Mycobacterium
WWGAGYNLIAVPLAAGVLAP

SEQ ID NO: 1135631 - protein, 18 aa, Mycobacterium
WWTVAVALALFVYTFVQA

SEQ ID NO: 1135632 - protein, 18 aa, Mycobacterium
WYVVVAVAAGAVLRARVW

SEQ ID NO: 1135633 - protein, 17 aa, Mycobacterium
WYYDLLALWSQVSTASV

SEQ ID NO: 1135634 - protein, 28 aa, Mycobacterium
YAAIIAVLLPPVFVLAWSGLRAEGRGWG

SEQ ID NO: 1135635 - protein, 18 aa, Mycobacterium
YAARARRLLPAAALVLVA

SEQ ID NO: 1135636 - protein, 24 aa, Mycobacterium
YAFGAFGVPLWQMAVGAFIGSVPR

SEQ ID NO: 1135637 - protein, 17 aa, Mycobacterium
YAGLPLKVFLSSLFAVM

SEQ ID NO: 1135638 - protein, 20 aa, Mycobacterium
YATNLVNLLKLLTPNKDGQL

SEQ ID NO: 1135639 - protein, 20 aa, Mycobacterium
YAVRHTARLALLVRAERNDE

SEQ ID NO: 1135640 - protein, 17 aa, Mycobacterium
YAWWPDEAAYRPIQPWE

SEQ ID NO: 1135641 - protein, 20 aa, Mycobacterium
YAYVAPWQLPSNQWYTWVIA

SEQ ID NO: 1135642 - protein, 26 aa, Mycobacterium
YDLRWRRLPNWLTLPGATVILVGAVL

SEQ ID NO: 1135643 - protein, 17 aa, Mycobacterium
YEIPGIIAEYLALHHGK

SEQ ID NO: 1135644 - protein, 29 aa, Mycobacterium
YEPKAAMRILFVSLPLGVATALIFGLWLL

SEQ ID NO: 1135645 - protein, 26 aa, Mycobacterium
YGALPFVYLAWIVLGIGLLIYTLRRR

SEQ ID NO: 1135646 - protein, 25 aa, Mycobacterium
YGEIDGRLYLDMRLIEGRNLGTILE

SEQ ID NO: 1135647 - protein, 25 aa, Mycobacterium
YGPKAPRLWLPPLDEPIRLVEVLQR

SEQ ID NO: 1135648 - protein, 23 aa, Mycobacterium
YGQIGYWAPALLVALRFIQGFAV

SEQ ID NO: 1135649 - protein, 28 aa, Mycobacterium
YGRERLGPFWGYLAGWGFVAGKTASCAA

SEQ ID NO: 1135650 - protein, 40 aa, Mycobacterium
YGRIKRQQRFLSSLLRSLISKEVFFSLSKLNNVVNMFIDD

SEQ ID NO: 1135651 - protein, 25 aa, Mycobacterium
YGSLLLVQPVLVSALLFALPLSARL

SEQ ID NO: 1135652 - protein, 26 aa, Mycobacterium
YGTAAVYYWVICLVLSFGQGRIERRL

SEQ ID NO: 1135653 - protein, 31 aa, Mycobacterium
YGTLAGVIIFLLWLWITNLALLFGAELDAEL

SEQ ID NO: 1135654 - protein, 19 aa, Mycobacterium
YGWTFIGAYLVFSAAGFAV

SEQ ID NO: 1135655 - protein, 30 aa, Mycobacterium; identical to SEQ ID NO: 375484

SEQ ID NO: 1135656 - protein, 19 aa, Mycobacterium
YHISYDAMWLLVPTAFAIA

SEQ ID NO: 1135657 - protein, 50 aa, Mycobacterium
YHTLRLMEKAPGAVLGFLFWLGMGSLTVMSLLYLILALVCQYRQNRLRWN

SEQ ID NO: 1135658 - protein, 24 aa, Mycobacterium
YIGIRYERWMAIAAMATLLFDLVV

SEQ ID NO: 1135659 - protein, 19 aa, Mycobacterium
YLFYWVVIGVDPTPRRIPQ

SEQ ID NO: 1135660 - protein, 19 aa, Mycobacterium
YLLAKVCIYAVFAILQSTI

SEQ ID NO: 1135661 - protein, 18 aa, Mycobacterium
YLLIIEPPLYFPSAFGID

SEQ ID NO: 1135662 - protein, 18 aa, Mycobacterium
YLLISKWPVDLLSARHDL

SEQ ID NO: 1135663 - protein, 21 aa, Mycobacterium
YLSLRLLIPVIRWQRRDTLLA

SEQ ID NO: 1135664 - protein, 22 aa, Mycobacterium
YMANYYRWFGTPEAPFGWYYDL

SEQ ID NO: 1135665 - protein, 18 aa, Mycobacterium
YMQLIPANVLADISATTV

SEQ ID NO: 1135666 - protein, 23 aa, Mycobacterium
YNDGIVSPLFIFALVLADQDTRA

SEQ ID NO: 1135667 - protein, 24 aa, Mycobacterium
YPEARFAVITFAPGPTLMWPLSQD

SEQ ID NO: 1135668 - protein, 17 aa, Mycobacterium
YPLLLVLSGVALGVSGL

SEQ ID NO: 1135669 - protein, 26 aa, Mycobacterium
YPVKADTRTGLYWVPGSRGYDDAVAE

SEQ ID NO: 1135670 - protein, 21 aa, Mycobacterium
YQWPLYEGLMWGGVQAGLCCL

SEQ ID NO: 1135671 - protein, 18 aa, Mycobacterium
YRLPGPGSLLFTIPVRYL

SEQ ID NO: 1135672 - protein, 17 aa, Mycobacterium
YRLQKLIGRGGMGEVYQ

SEQ ID NO: 1135673 - protein, 19 aa, Mycobacterium
YRLWDHIRFNTTITEACFD

SEQ ID NO: 1135674 - protein, 17 aa, Mycobacterium
YRMPMIPLLVGGQATLW

SEQ ID NO: 1135675 - protein, 25 aa, Mycobacterium
YRTTIFAFPVFGFGVIFGAIWAEEA

SEQ ID NO: 1135676 - protein, 22 aa, Mycobacterium
YSAPLLVLALLLATVAGVLLVL

SEQ ID NO: 1135677 - protein, 24 aa, Mycobacterium
YSDDTWRLWSYSWEAKEPGRYTMV

SEQ ID NO: 1135678 - protein, 27 aa, Mycobacterium
YSLALFPVWIRACYTAFLNVVFGRPLG

SEQ ID NO: 1135679 - protein, 17 aa, Mycobacterium
YSLVRLLERLLLSWRNG

SEQ ID NO: 1135680 - protein, 23 aa, Mycobacterium
YSPLRAGIGFIPFAIAMGIGLAV

SEQ ID NO: 1135681 - protein, 22 aa, Mycobacterium
YSPNLVAMPFDPTIGAALAGAG

SEQ ID NO: 1135682 - protein, 23 aa, Mycobacterium
YSSIFFATPLLVSLRERTQLVRD

SEQ ID NO: 1135683 - protein, 25 aa, Mycobacterium
YTDDLKLAPLAVAALLIAALAMVRR

SEQ ID NO: 1135684 - protein, 26 aa, Mycobacterium
YTENLRYYYLILPTVDGAIARRVAFL

SEQ ID NO: 1135685 - protein, 29 aa, Mycobacterium
YTEREKWLFAHIPLAKRVYRTRLWLRSER

SEQ ID NO: 1135686 - protein, 24 aa, Mycobacterium
YTIPQPVWIAVLMGLILGLLTVYP

SEQ ID NO: 1135687 - protein, 22 aa, Mycobacterium
YTQALRVDWVGLALAVAMGALS

SEQ ID NO: 1135688 - protein, 20 aa, Mycobacterium
YTYVLLTYLPQTTSPLTAFA

SEQ ID NO: 1135689 - protein, 29 aa, Mycobacterium
YVAYVGFLVGFIALGLFVYALAAGSVLAG

SEQ ID NO: 1135690 - protein, 28 aa, Mycobacterium
YVLIASLLLLLLFWQWRTMPQTVWDVSW

SEQ ID NO: 1135691 - protein, 19 aa, Mycobacterium
YVLITFWQYRNACATSPGL

SEQ ID NO: 1135692 - protein, 19 aa, Mycobacterium
YVLSFQVYLALPLQARDLF

SEQ ID NO: 1135693 - protein, 17 aa, Mycobacterium
YVLSRITLPGSIYLGLI

SEQ ID NO: 1135694 - protein, 23 aa, Mycobacterium
YVWWGLCPGFFLLLLPAGSLEIL

SEQ ID NO: 1135695 - protein, 20 aa, Mycobacterium
YWIRAISMLTTAPLFIGWWI

SEQ ID NO: 1135696 - protein, 18 aa, Mycobacterium
YWPALFLSLLVAVNILYR

SEQ ID NO: 1135697 - protein, 18 aa, Mycobacterium
YWVPGSRGYDDAVAEIYF

SEQ ID NO: 1135698 - protein, 17 aa, Mycobacterium
YYPVILTGFLLLTSIII

SEQ ID NO: 1135699 - protein, 21 aa, Mycobacterium
YYSMMLFPFLMTVVLPNSVLR

SEQ ID NO: 1135700 - protein, 21 aa, Mycobacterium
AAAGVLLLALLLTTGTDTLAH

SEQ ID NO: 1135701 - protein, 17 aa, Mycobacterium
AAALIVALVLFVIAGIA

SEQ ID NO: 1135702 - protein, 27 aa, Mycobacterium
AAALLLAFTVLAILWANSPWAQSYSIF

SEQ ID NO: 1135703 - protein, 24 aa, Mycobacterium
AAAVFIVAVVFFSGFFIGRATDGF

SEQ ID NO: 1135704 - protein, 25 aa, Mycobacterium
AAAVRTLWHLPYLSLGCGVLAVSLL

SEQ ID NO: 1135705 - protein, 29 aa, Mycobacterium
AAEIVFACFLYRAWNLPVAVLAGAAAGLA

SEQ ID NO: 1135706 - protein, 22 aa, Mycobacterium
AAFVVAAMRYGPWAAAVAVCAG

SEQ ID NO: 1135707 - protein, 21 aa, Mycobacterium
AAFWSEPFNVPFLVAIGATAL

SEQ ID NO: 1135708 - protein, 27 aa, Mycobacterium
AAGGIALVVLWRWRWVRLAAGAAVLGL

SEQ ID NO: 1135709 - protein, 25 aa, Mycobacterium
AAGILMLTGLGGLVGYRQARAGLAL

SEQ ID NO: 1135710 - protein, 33 aa, Mycobacterium
AAGITYFTVFALFPLLMLGFSIAGFVLASQPDV

SEQ ID NO: 1135711 - protein, 20 aa, Mycobacterium
AAGLFFAPLATADPATEAND

SEQ ID NO: 1135712 - protein, 18 aa, Mycobacterium
AAIAFLLFAAWTWREGRN

SEQ ID NO: 1135713 - protein, 23 aa, Mycobacterium
AAILVTAIFFGAYLLVTGVAQLV

SEQ ID NO: 1135714 - protein, 24 aa, Mycobacterium
AALAGVLLLAGLIVGWAGGPGPVT

SEQ ID NO: 1135715 - protein, 17 aa, Mycobacterium
AALIQRPSALDPAVDPE

SEQ ID NO: 1135716 - protein, 34 aa, Mycobacterium
AALNLREFVRLLRARWMAVCVTTLITFLGAVAVT

SEQ ID NO: 1135717 - protein, 33 aa, Mycobacterium
AALRGLGPVAYGDGWFYLTEREDVLAALRNPEE

SEQ ID NO: 1135718 - protein, 30 aa, Mycobacterium
AAPPPPPAPAPPPPPPPAPAPPVEPVPPPP

SEQ ID NO: 1135719 - protein, 18 aa, Mycobacterium
AAPVPAPVPVLPAPVFRP

SEQ ID NO: 1135720 - protein, 26 aa, Mycobacterium
AAPVPAPWSVLAQFAAGPTLSRDDAL

SEQ ID NO: 1135721 - protein, 27 aa, Mycobacterium
AASELLYPLLPIYLTSVLGAPAAVVGA

SEQ ID NO: 1135722 - protein, 20 aa, Mycobacterium
AATLVLVAFGLLASGIAVTS

SEQ ID NO: 1135723 - protein, 17 aa, Mycobacterium
AATMFRLLAGPSTLDRL

SEQ ID NO: 1135724 - protein, 27 aa, Mycobacterium
AATYFLVTPLIVLIGTAVAMALPGQRD

SEQ ID NO: 1135725 - protein, 30 aa, Mycobacterium
AAVALFSSVWLLALPLPGRWHVQRAYCRLM

SEQ ID NO: 1135726 - protein, 21 aa, Mycobacterium
AAVAYALWRKRWRLAAVTALC

SEQ ID NO: 1135727 - protein, 26 aa, Mycobacterium
AAVIAVIAALVWWTSDARATISQPAE

SEQ ID NO: 1135728 - protein, 25 aa, Mycobacterium
AAVIVVAIGLLIRAMMRGWHSRAQR

SEQ ID NO: 1135729 - protein, 19 aa, Mycobacterium
AAVLLAAAGALLRWAAPAT

SEQ ID NO: 1135730 - protein, 19 aa, Mycobacterium
AAVLLLLLPLDLETRTVVA

SEQ ID NO: 1135731 - protein, 25 aa, Mycobacterium
AAYFYVRLIVLMFFTDSPADAPTVV

SEQ ID NO: 1135732 - protein, 23 aa, Mycobacterium
ADAFTEMFGIPVLTSYAATEFGG

SEQ ID NO: 1135733 - protein, 26 aa, Mycobacterium
ADARQLDMLNLQSVWPLTRGAGQTVA

SEQ ID NO: 1135734 - protein, 18 aa, Mycobacterium
ADHPIWIAVPAFAPAIVV

SEQ ID NO: 1135735 - protein, 20 aa, Mycobacterium
ADQTAYFDTDFFDVLRDQFG

SEQ ID NO: 1135736 - protein, 17 aa, Mycobacterium
ADSILLSRGRIPEYVLV

SEQ ID NO: 1135737 - protein, 35 aa, Mycobacterium
ADTRNVLLYSWAFVPVLVLVLATRSLYKRKLNRSF

SEQ ID NO: 1135738 - protein, 17 aa, Mycobacterium
ADVRIAHPLISRAHLVL

SEQ ID NO: 1135739 - protein, 23 aa, Mycobacterium
ADWDGRLRPLLARQFELATGQRK

SEQ ID NO: 1135740 - protein, 23 aa, Mycobacterium
ADYPAPAGQYWVPRRLGGGAPTL

SEQ ID NO: 1135741 - protein, 18 aa, Mycobacterium
ADYPTVLLSGDWLSREQV

SEQ ID NO: 1135742 - protein, 19 aa, Mycobacterium
AEAFRKLRTNLQFLAVDNP

SEQ ID NO: 1135743 - protein, 23 aa, Mycobacterium
AEHDLLLISIATAGVIALILLIV

SEQ ID NO: 1135744 - protein, 29 aa, Mycobacterium
AEKPAEGDWLYFVTIDLQGTTLFTRDYNE

SEQ ID NO: 1135745 - protein, 19 aa, Mycobacterium
AEMLKKFGLGQRTGVGLPG

SEQ ID NO: 1135746 - protein, 21 aa, Mycobacterium
AENPAVRVLFGPPLALDDPGG

SEQ ID NO: 1135747 - protein, 24 aa, Mycobacterium
AFAVLAVLPLLALPLVPVHARVGR

SEQ ID NO: 1135748 - protein, 30 aa, Mycobacterium
AFGKIPVKQRPVLYLALEDGHRRLQDRFRT

SEQ ID NO: 1135749 - protein, 17 aa, Mycobacterium
AFGRWSDAVGRRPMLLA

SEQ ID NO: 1135750 - protein, 18 aa, Mycobacterium
AFSILAFIAGLGAMTGAA

SEQ ID NO: 1135751 - protein, 20 aa, Mycobacterium
AFVLLVLVLLFRPTGILGES

SEQ ID NO: 1135752 - protein, 19 aa, Mycobacterium
AFVMLRDGLVAPVAQDSPP

SEQ ID NO: 1135753 - protein, 20 aa, Mycobacterium
AFWIGRPIITLSFNNEKFNA

SEQ ID NO: 1135754 - protein, 38 aa, Mycobacterium
AGAISAMLIYRLVSWIFLAAIGWVVFFFVFRTEKDIDP

SEQ ID NO: 1135755 - protein, 20 aa, Mycobacterium
AGALLRWAAPATAHLPGRLL

SEQ ID NO: 1135756 - protein, 21 aa, Mycobacterium
AGAVWALTALTIVMTVTVAVP

SEQ ID NO: 1135757 - protein, 26 aa, Mycobacterium
AGAWLLLIGVTLSCAGLLWSDRITAG

SEQ ID NO: 1135758 - protein, 25 aa, Mycobacterium
AGAYPPPVYDTPYPTAPQPYSKGPS

SEQ ID NO: 1135759 - protein, 18 aa, Mycobacterium
AGGMLLSLYVVPSLKYPA

SEQ ID NO: 1135760 - protein, 27 aa, Mycobacterium
AGIRLNWLALGLLAYPLMYGVGRLYVR

SEQ ID NO: 1135761 - protein, 17 aa, Mycobacterium
AGLAWAFLIGVIVMIGA

SEQ ID NO: 1135762 - protein, 18 aa, Mycobacterium
AGLIAIAAAMLRAGKPVR

SEQ ID NO: 1135763 - protein, 32 aa, Mycobacterium
AGLSFTHFAALMTLPWLAAIVGEYILLRALFR

SEQ ID NO: 1135764 - protein, 17 aa, Mycobacterium
AGLSLAVLWLKRWPTRT

SEQ ID NO: 1135765 - protein, 37 aa, Mycobacterium
AGMIALILLIVYRSVFTALLPLLVIGLSLAVGRGVLS

SEQ ID NO: 1135766 - protein, 24 aa, Mycobacterium
AGPPVMVSPWMPSGAPYPGTQYGP

SEQ ID NO: 1135767 - protein, 20 aa, Mycobacterium
AGPQVIPPRGDAPRPPQQGR

SEQ ID NO: 1135768 - protein, 43 aa, Mycobacterium
AGRNIGRIVAYVVLPVAVLAMACGVGFLKWQANSIGTSQATAA

SEQ ID NO: 1135769 - protein, 34 aa, Mycobacterium
AGRSPVRKALLAGLALVVVLAAVTGWFGYQAYRS

SEQ ID NO: 1135770 - protein, 27 aa, Mycobacterium
AGSYPLLLVFGFFLGIAGTVFAVGIPF

SEQ ID NO: 1135771 - protein, 22 aa, Mycobacterium
AGVAVPVFAFFAAGVAIGGVSG

SEQ ID NO: 1135772 - protein, 37 aa, Mycobacterium; identical to SEQ ID NO: 349429

SEQ ID NO: 1135773 - protein, 20 aa, Mycobacterium
AGYLAGPLGLAAWAVGLVLG

SEQ ID NO: 1135774 - protein, 26 aa, Mycobacterium
AGYPKYWLLVILAAAIATSFLAERTI

SEQ ID NO: 1135775 - protein, 28 aa, Mycobacterium
AHDRRLASVLPFLMGLNSRPRLSRPRGR

SEQ ID NO: 1135776 - protein, 19 aa, Mycobacterium
AHDVTLVSWGALALLRAAG

SEQ ID NO: 1135777 - protein, 18 aa, Mycobacterium
AHHGLGLALVAQVAARHG

SEQ ID NO: 1135778 - protein, 22 aa, Mycobacterium
AHHYLRMIYDILATALALALLA

SEQ ID NO: 1135779 - protein, 26 aa, Mycobacterium
AHLPGRLLVVAVLAAALFGYGQFARW

SEQ ID NO: 1135780 - protein, 18 aa, Mycobacterium
AIALVVSAVLLILGGLGG

SEQ ID NO: 1135781 - protein, 38 aa, Mycobacterium
AIDLNLVLSAIINFLLIAAVVYFVILMPYKKLRERGKV

SEQ ID NO: 1135782 - protein, 34 aa, Mycobacterium
AIERFAPIIGGIRPGLFVSSNFLPGSPAYTFPES

SEQ ID NO: 1135783 - protein, 19 aa, Mycobacterium
AIFFFLFVHVVDTALVRVS

SEQ ID NO: 1135784 - protein, 26 aa, Mycobacterium
AIFFVLSGFLLFRPWVRAAATGMPGP

SEQ ID NO: 1135785 - protein, 31 aa, Mycobacterium
AIGPLFPPVTYYVCLLLLLICAPLSVFAGLI

SEQ ID NO: 1135786 - protein, 20 aa, Mycobacterium
AINVPIIASLVLAISHGPRV

SEQ ID NO: 1135787 - protein, 19 aa, Mycobacterium
AIREHSLGPYPFDPNLVSQ

SEQ ID NO: 1135788 - protein, 21 aa, Mycobacterium
AITLLFMASLDRIALGTATAL

SEQ ID NO: 1135789 - protein, 24 aa, Mycobacterium
AIVLTTIFGFFWYSHGILGFHSLG

SEQ ID NO: 1135790 - protein, 19 aa, Mycobacterium
AIVNAPLVHIGGVFRVLQC

SEQ ID NO: 1135791 - protein, 28 aa, Mycobacterium
AKLWSVIPRLFVWPPARSIAQLLERVSL

SEQ ID NO: 1135792 - protein, 34 aa, Mycobacterium
AKTTTFMIPEEHLPLVLPFKYLGVPKDTLMELDS

SEQ ID NO: 1135793 - protein, 30 aa, Mycobacterium
ALAARKRIAWWILLLYMVAAAGWNVADLLT

SEQ ID NO: 1135794 - protein, 31 aa, Mycobacterium
ALDGLGLPGWGALKLALPRSGNADASYLAAE

SEQ ID NO: 1135795 - protein, 19 aa, Mycobacterium
ALDLDVLLGGLKPVIRGLN

SEQ ID NO: 1135796 - protein, 32 aa, Mycobacterium
ALDVLLFYVFFEAMLIPMYFLIGGFGADRAAS

SEQ ID NO: 1135797 - protein, 18 aa, Mycobacterium
ALDVVLLKLFPGLAPYAD

SEQ ID NO: 1135798 - protein, 29 aa, Mycobacterium
ALGNAILVIPLALVPSWLALASTGFDVAL

SEQ ID NO: 1135799 - protein, 26 aa, Mycobacterium
ALGNAILVIPLGLVPSWLALASTGFD

SEQ ID NO: 1135800 - protein, 17 aa, Mycobacterium
ALGQILQSSPELATELL

SEQ ID NO: 1135801 - protein, 21 aa, Mycobacterium
ALGSYWGLVPMLAGVPVLAVR

SEQ ID NO: 1135802 - protein, 32 aa, Mycobacterium
ALGVGILFTWMFMYGMTPLLQGPVASALGGVD

SEQ ID NO: 1135803 - protein, 21 aa, Mycobacterium
ALIVFAYVLLFMPRALVNVRA

SEQ ID NO: 1135804 - protein, 19 aa, Mycobacterium
ALLAIVLSGQWLPAVSGAV

SEQ ID NO: 1135805 - protein, 19 aa, Mycobacterium
ALLFYPLHLLPFGVVAFAW

SEQ ID NO: 1135806 - protein, 28 aa, Mycobacterium
ALLPVPAIVPILLYIGLLIGAQAFQAVP

SEQ ID NO: 1135807 - protein, 51 aa, Mycobacterium
ALLRTLHVILGWRPVLLLPLTFALFTPLAVPGFAWWAAALNSLPMLAALAW

SEQ ID NO: 1135808 - protein, 22 aa, Mycobacterium
ALLVLFTLIFLLHGGRNIFGFI

SEQ ID NO: 1135809 - protein, 41 aa, Mycobacterium
ALNCGLAGMLPLAMAPPPPVPGVLLLDSFVLGTERYRYPQN

SEQ ID NO: 1135810 - protein, 17 aa, Mycobacterium
ALPEWQASWVEGYRSRR

SEQ ID NO: 1135811 - protein, 27 aa, Mycobacterium
ALPGRAPLWLLVTLVIVISVGGPGSMV

SEQ ID NO: 1135812 - protein, 33 aa, Mycobacterium
ALPITLAGILPAIALVLALRREVWTRLAAAVVF

SEQ ID NO: 1135813 - protein, 17 aa, Mycobacterium
ALPPPTASLAPETITTV

SEQ ID NO: 1135814 - protein, 18 aa, Mycobacterium
ALRELWSAASPKTRLPVV

SEQ ID NO: 1135815 - protein, 25 aa, Mycobacterium
ALSAVRVVALTPGWYDVAFKTPLMD

SEQ ID NO: 1135816 - protein, 30 aa, Mycobacterium
ALTALTLELLLILALRIPLRAVLIRGALLV

SEQ ID NO: 1135817 - protein, 17 aa, Mycobacterium
ALVLVAWGFDLMAKRAS

SEQ ID NO: 1135818 - protein, 19 aa, Mycobacterium
ALVLVLLAVPVTMILLKQS

SEQ ID NO: 1135819 - protein, 25 aa, Mycobacterium
ALVRSRWPHLTARQVMQRIEDTAHR

SEQ ID NO: 1135820 - protein, 28 aa, Mycobacterium
ALVVLFYSTFFFFFFAAELLDTWLWRWA

SEQ ID NO: 1135821 - protein, 25 aa, Mycobacterium
ALYSGGLVAFCPWATTVLVTALLDR

SEQ ID NO: 1135822 - protein, 33 aa, Mycobacterium
AMLVPIIMCGLLSLFLVAFACYFVWHVVKAAVQ

SEQ ID NO: 1135823 - protein, 23 aa, Mycobacterium
AMSTVILVIWFVIGAVSVRLFRF

SEQ ID NO: 1135824 - protein, 18 aa, Mycobacterium
ANAWIRRGVSPEKAAESA

SEQ ID NO: 1135825 - protein, 25 aa, Mycobacterium
ANLPTILYSLYWRRFNTRGALWSMY

SEQ ID NO: 1135826 - protein, 28 aa, Mycobacterium
ANRLQTLRWIVVPSLVPWLITGLRLSIG

SEQ ID NO: 1135827 - protein, 18 aa, Mycobacterium
APGVPLPPQPVAPGVPVP

SEQ ID NO: 1135828 - protein, 19 aa, Mycobacterium
APMLFGTRALVLVRLLVPS

SEQ ID NO: 1135829 - protein, 23 aa, Mycobacterium
APPPPPAPPMSRPQPRYPTGAQP

SEQ ID NO: 1135830 - protein, 21 aa, Mycobacterium
APPSFIIVTIACGVWAVVWAV

SEQ ID NO: 1135831 - protein, 35 aa, Mycobacterium
APPVVLPEVPSDLPLPALLSPDATPPATLPPSSTD

SEQ ID NO: 1135832 - protein, 27 aa, Mycobacterium
APSVKPSRFLGRLFARASRSVKPEPAE

SEQ ID NO: 1135833 - protein, 17 aa, Mycobacterium
APTLPEVPALPAAPAAE

SEQ ID NO: 1135834 - protein, 18 aa, Mycobacterium
APVVPRPAQRREVPKHVV

SEQ ID NO: 1135835 - protein, 25 aa, Mycobacterium
AQAIGRLGNYFNQELYGRATTVPWG

SEQ ID NO: 1135836 - protein, 19 aa, Mycobacterium
AQHAFDFFGSPRAHYTANA

SEQ ID NO: 1135837 - protein, 22 aa, Mycobacterium
ARAMFDPLLARLRDLGAMGLMM

SEQ ID NO: 1135838 - protein, 34 aa, Mycobacterium
ARATQSILAFIMVSYIPLIGVVALLVVNRPQPVN

SEQ ID NO: 1135839 - protein, 22 aa, Mycobacterium
ARIPMRRRLTRRAAAVTGVVLV

SEQ ID NO: 1135840 - protein, 32 aa, Mycobacterium
ARIQLVTLVGILILLKAFAYWLDRYELLSHTR

SEQ ID NO: 1135841 - protein, 19 aa, Mycobacterium
ARLAALSILIGAVGATGPG

SEQ ID NO: 1135842 - protein, 26 aa, Mycobacterium
ARNIVFGLGLGLLLGVGLAVLRDTLD

SEQ ID NO: 1135843 - protein, 30 aa, Mycobacterium
ARPDTALSRWLPDTATPTGPGWVAAVRADP

SEQ ID NO: 1135844 - protein, 25 aa, Mycobacterium
ARSFALLERFELQRWADAVRRHRPA

SEQ ID NO: 1135845 - protein, 19 aa, Mycobacterium
ARTVTVIVLILLAGVALRG

SEQ ID NO: 1135846 - protein, 23 aa, Mycobacterium
ARVELPLAVPYILAGMRTSLVLA

SEQ ID NO: 1135847 - protein, 18 aa, Mycobacterium
ARVLAALHRTPPAGLGLT

SEQ ID NO: 1135848 - protein, 22 aa, Mycobacterium
ARWGRWVARVLSVVGLAGLAVL

SEQ ID NO: 1135849 - protein, 17 aa, Mycobacterium
ARYYPPRPPAGHDHPGM

SEQ ID NO: 1135850 - protein, 17 aa, Mycobacterium
ASAFSILAFIAGLGAMT

SEQ ID NO: 1135851 - protein, 25 aa, Mycobacterium
ASIAGLAAIGLIVTGVMFASRSGES

SEQ ID NO: 1135852 - protein, 23 aa, Mycobacterium
ASLIAIVLVVLLASLALYGTDPN

SEQ ID NO: 1135853 - protein, 26 aa, Mycobacterium
ASMVPIIVFSLLFGLALRTQINKTGD

SEQ ID NO: 1135854 - protein, 21 aa, Mycobacterium
ASPPPATLKPLPPAPQQFGDA

SEQ ID NO: 1135855 - protein, 17 aa, Mycobacterium
ASPVVVWGALPFHRAAW

SEQ ID NO: 1135856 - protein, 43 aa, Mycobacterium
ASRSPTTPAHPRWFFLWTTPGRILTIGIVLAALAIASAFATST

SEQ ID NO: 1135857 - protein, 26 aa, Mycobacterium
ASRSWAQAPRQLPVAPLAGPNPARPP

SEQ ID NO: 1135858 - protein, 18 aa, Mycobacterium
ATGQMLFGPELWQWVDPE

SEQ ID NO: 1135859 - protein, 32 aa, Mycobacterium
ATIPTPHLWPRSWPFLLQVLAAILVADLGITV

SEQ ID NO: 1135860 - protein, 17 aa, Mycobacterium
ATLVKLFGRPESESHEF

SEQ ID NO: 1135861 - protein, 31 aa, Mycobacterium
ATLVRMVLVPAFMRVLGRWNWWSPKPLARLH

SEQ ID NO: 1135862 - protein, 31 aa, Mycobacterium
ATPAGAHLPPMPYMFVWVDEFSLLLKDHPEM

SEQ ID NO: 1135863 - protein, 21 aa, Mycobacterium
ATSIPPTWAAASRPPIRSLTA

SEQ ID NO: 1135864 - protein, 24 aa, Mycobacterium
ATTGGYIALFHTPGYMLYNFGVAL

SEQ ID NO: 1135865 - protein, 37 aa, Mycobacterium
ATTVIVGIILVLLLRALLAPIYLLGTVLLNYLASIGF

SEQ ID NO: 1135866 - protein, 18 aa, Mycobacterium
ATTVLVTALLDRGTDHDL

SEQ ID NO: 1135867 - protein, 27 aa, Mycobacterium
AVAALLRRLHFYAGVLVGPFLLIAAVS

SEQ ID NO: 1135868 - protein, 24 aa, Mycobacterium
AVAASVAILIFAPALDAIIDRWLL

SEQ ID NO: 1135869 - protein, 27 aa, Mycobacterium
AVAAWLITRAWQMPPVLDLSVAAVAVR

SEQ ID NO: 1135870 - protein, 27 aa, Mycobacterium
AVALAFLFGYALSTLPLLKAGLALGTA

SEQ ID NO: 1135871 - protein, 22 aa, Mycobacterium
AVAPPPVAPPRAAPAAAPVGRR

SEQ ID NO: 1135872 - protein, 25 aa, Mycobacterium
AVAVLSYWLLERPIRRWRPATVPQL

SEQ ID NO: 1135873 - protein, 17 aa, Mycobacterium
AVAWYGIQTYLASAALD

SEQ ID NO: 1135874 - protein, 24 aa, Mycobacterium
AVGYNVIALPIAAGVFVPSLGLVL

SEQ ID NO: 1135875 - protein, 21 aa, Mycobacterium
AVLLTIWLVGEFPGAAAADNV

SEQ ID NO: 1135876 - protein, 19 aa, Mycobacterium
AVRSLWHYTYAAYRFHSGL

SEQ ID NO: 1135877 - protein, 37 aa, Mycobacterium
AVTAAVVALLLIVTYRSPVLFLVPLLVIGFADRVAAV

SEQ ID NO: 1135878 - protein, 24 aa, Mycobacterium
AVTCLPLFRHLWSTQVIAPEHLPH

SEQ ID NO: 1135879 - protein, 28 aa, Mycobacterium
AVVAAPSYAWFVAAWVLAGVAMSAVFYA

SEQ ID NO: 1135880 - protein, 30 aa, Mycobacterium; identical to SEQ ID NO: 351666

SEQ ID NO: 1135881 - protein, 33 aa, Mycobacterium
AVVVSSIGMWLIRRRLMRQTHGLRPDELRVMYE

SEQ ID NO: 1135882 - protein, 19 aa, Mycobacterium
AVVVVAVARWRGLRALVGI

SEQ ID NO: 1135883 - protein, 17 aa, Mycobacterium
AWFAVLLELSRPPDTAR

SEQ ID NO: 1135884 - protein, 24 aa, Mycobacterium
AWWINMVVFLLYTAAFIMLLRRMI

SEQ ID NO: 1135885 - protein, 29 aa, Mycobacterium
AYAAAIDSRWKWIAGVAGAVLLVAVICTL

SEQ ID NO: 1135886 - protein, 36 aa, Mycobacterium
AYTRRGLAATGWPPVRWIPKIRPDPLRRLGLDAPDT

SEQ ID NO: 1135887 - protein, 27 aa, Mycobacterium
CAAVAVAGLGLWLLTRPRSADPRQQIL

SEQ ID NO: 1135888 - protein, 23 aa, Mycobacterium
CAVVYLLLTIAVTGSLSVAEIVD

SEQ ID NO: 1135889 - protein, 20 aa, Mycobacterium
CLKWALRWRRGLVAGGCAEH

SEQ ID NO: 1135890 - protein, 18 aa, Mycobacterium
CRAAFPMVEQLRAEYGDR

SEQ ID NO: 1135891 - protein, 23 aa, Mycobacterium
CSAGYAGWAWLQPGSFRAWVTEP

SEQ ID NO: 1135892 - protein, 23 aa, Mycobacterium
CSARRWVTTLGAFILAIGPGWLG

SEQ ID NO: 1135893 - protein, 23 aa, Mycobacterium
DAARLLTELLTPGSLFPADRTVV

SEQ ID NO: 1135894 - protein, 25 aa, Mycobacterium
DADALKIPIRLPALPDGWRSNSGGR

SEQ ID NO: 1135895 - protein, 21 aa, Mycobacterium
DAPVNWFPLYLGAAVVVELVA

SEQ ID NO: 1135896 - protein, 17 aa, Mycobacterium
DARGRVFGFHRAMDTFG

SEQ ID NO: 1135897 - protein, 32 aa, Mycobacterium
DASNKFFAFRDGAWVDLPPLQHARVAGAAAVV

SEQ ID NO: 1135898 - protein, 27 aa, Mycobacterium
DATTHLLQQSLYLFILGTGIGLCMQVL

SEQ ID NO: 1135899 - protein, 31 aa, Mycobacterium
DAVWGMLLWLPLSILLEFLIGWLWSETGSVW

SEQ ID NO: 1135900 - protein, 18 aa, Mycobacterium
DDELPSYLRSSAGPLFGG

SEQ ID NO: 1135901 - protein, 19 aa, Mycobacterium
DDFVHLLLGFASIGRTIEH

SEQ ID NO: 1135902 - protein, 28 aa, Mycobacterium
DDPAVRYAMLTLLHDLAWKATLPDHRAA

SEQ ID NO: 1135903 - protein, 22 aa, Mycobacterium
DDQVTVNFFTGPFGVYDALTSR

SEQ ID NO: 1135904 - protein, 17 aa, Mycobacterium
DEAILLPDSFRLSGPDM

SEQ ID NO: 1135905 - protein, 29 aa, Mycobacterium
DEATASFGAMPPFLLQHMTGHYTNIDIET

SEQ ID NO: 1135906 - protein, 24 aa, Mycobacterium
DEPGRPWRVPTVAAAVGVLGVGAV

SEQ ID NO: 1135907 - protein, 26 aa, Mycobacterium
DETWPLLTGFVWLGGLLIVASVVLTR

SEQ ID NO: 1135908 - protein, 18 aa, Mycobacterium
DFSIFFFSRYHELVREGM

SEQ ID NO: 1135909 - protein, 19 aa, Mycobacterium
DGARVLAPAPASRAAVEAV

SEQ ID NO: 1135910 - protein, 23 aa, Mycobacterium
DGDDWSWLKWLPHTDIPGEADGV

SEQ ID NO: 1135911 - protein, 19 aa, Mycobacterium
DGHLGVSWGLTAAAAIMVV

SEQ ID NO: 1135912 - protein, 26 aa, Mycobacterium
DGHTLRLGRPGWLDPGPLAGDVTRMQ

SEQ ID NO: 1135913 - protein, 20 aa, Mycobacterium
DGLIRLWPAWEFYIGNYTIP

SEQ ID NO: 1135914 - protein, 19 aa, Mycobacterium
DGNPLPQYFQGRPSAAGDG

SEQ ID NO: 1135915 - protein, 17 aa, Mycobacterium
DGPRTYFMGFQTNAEAR

SEQ ID NO: 1135916 - protein, 34 aa, Mycobacterium
DGRRPPRLGRGWLTAICAVLLLLGAGAGVGGYLA

SEQ ID NO: 1135917 - protein, 24 aa, Mycobacterium
DHERAILAALYNVDSFWPRRVVDS

SEQ ID NO: 1135918 - protein, 19 aa, Mycobacterium
DHYYWLTAFLAARGAQRGI

SEQ ID NO: 1135919 - protein, 25 aa, Mycobacterium
DIASGLFVFILMVSGATHLLGWVIL

SEQ ID NO: 1135920 - protein, 28 aa, Mycobacterium
DLARIDADGFLWILGRADQAIIRGGFKV

SEQ ID NO: 1135921 - protein, 17 aa, Mycobacterium
DLLYVWRHFPLERAHPR

SEQ ID NO: 1135922 - protein, 26 aa, Mycobacterium
DLRQRVITYAPLLLTAETAITGSARG

SEQ ID NO: 1135923 - protein, 21 aa, Mycobacterium
DLTANPLRFLARAANLWNSEL

SEQ ID NO: 1135924 - protein, 20 aa, Mycobacterium
DLWIFTPFVAILVLAGIRSL

SEQ ID NO: 1135925 - protein, 24 aa, Mycobacterium
DLYSKKRVLLGVLVVVLIGSVLAA

SEQ ID NO: 1135926 - protein, 17 aa, Mycobacterium
DMPAPQRHNGIRLAVAF

SEQ ID NO: 1135927 - protein, 25 aa, Mycobacterium
DMRRPMLHKYLGLVGPVGFSTVLSG

SEQ ID NO: 1135928 - protein, 21 aa, Mycobacterium
DNPAWYRLTRFFGKLFLINFA

SEQ ID NO: 1135929 - protein, 25 aa, Mycobacterium
DNRKERIMLAIKYLNQYTMGLGETV

SEQ ID NO: 1135930 - protein, 28 aa, Mycobacterium
DPALAVGLLLLVLVLNVAVPFAVQAIVH

SEQ ID NO: 1135931 - protein, 26 aa, Mycobacterium
DPGVPPPLPYYAPPDQLVPPYGRPAP

SEQ ID NO: 1135932 - protein, 29 aa, Mycobacterium
DPLRKSVLALKEAGWWRLGIPEDIGGTLA

SEQ ID NO: 1135933 - protein, 25 aa, Mycobacterium
DPLTGLLNRRAFYAHSAKLLTGGPS

SEQ ID NO: 1135934 - protein, 20 aa, Mycobacterium
DPREVQFYGLDLGGGALAAM

SEQ ID NO: 1135935 - protein, 17 aa, Mycobacterium
DPRRAVPAPTNTSSFFA

SEQ ID NO: 1135936 - protein, 33 aa, Mycobacterium
DPRVVSLIFIPWQALMWVLPVALAVALLAFPRL

SEQ ID NO: 1135937 - protein, 17 aa, Mycobacterium
DPTLTVGLALFPAAVKV

SEQ ID NO: 1135938 - protein, 21 aa, Mycobacterium
DQIGWFIVYVTVVIGVSLSVY

SEQ ID NO: 1135939 - protein, 27 aa, Mycobacterium
DQVLQSYLNIIYFGRGAYGVAAASRAY

SEQ ID NO: 1135940 - protein, 23 aa, Mycobacterium
DRDIDRLLRRIGPGDIVVIDALD

SEQ ID NO: 1135941 - protein, 26 aa, Mycobacterium
DRIARPLVPAIMGLAALIAALGALFG

SEQ ID NO: 1135942 - protein, 22 aa, Mycobacterium
DRLSHTLLPKRIALPVFASDAM

SEQ ID NO: 1135943 - protein, 19 aa, Mycobacterium
DRNYLLFKGLRMSSLVTVS

SEQ ID NO: 1135944 - protein, 41 aa, Mycobacterium
DRRFNLGHGRLFALYVAGYCLGRFWIELLRSDMATELAGIR

SEQ ID NO: 1135945 - protein, 28 aa, Mycobacterium
DRTGQSLWWALALAVLGLGLLGGSLLAQ

SEQ ID NO: 1135946 - protein, 32 aa, Mycobacterium
DSLRKAFGWFVLAMSWVILGQEIHLGVGIAGA

SEQ ID NO: 1135947 - protein, 25 aa, Mycobacterium
DSLRSRLLISLVLTVPVIAMSMIPA

SEQ ID NO: 1135948 - protein, 28 aa, Mycobacterium
DTFLNPIDLLWSFLQAVLMAITILLVHT

SEQ ID NO: 1135949 - protein, 18 aa, Mycobacterium
DTFNTWGVWLGSQRPKQF

SEQ ID NO: 1135950 - protein, 22 aa, Mycobacterium
DTGRQPHLPPTAPPQAAAPARH

SEQ ID NO: 1135951 - protein, 33 aa, Mycobacterium
DTLISLGTVSAFLWSLYALFFGTAGTAGMTHPF

SEQ ID NO: 1135952 - protein, 17 aa, Mycobacterium
DTSAALPPPTASLAPET

SEQ ID NO: 1135953 - protein, 17 aa, Mycobacterium
DVIAPRGAFMLIALALA

SEQ ID NO: 1135954 - protein, 20 aa, Mycobacterium
DWLWASVVVFLVMAAALSHI

SEQ ID NO: 1135955 - protein, 18 aa, Mycobacterium
DYAVFLISRYHDYLRSGS

SEQ ID NO: 1135956 - protein, 34 aa, Mycobacterium
EAAESWRWIVLGAVAVVAIFGYAKGWPAAQRFLY

SEQ ID NO: 1135957 - protein, 32 aa, Mycobacterium
EALDRDVKVFGFLLLGLVVAAAVVALLNELVF

SEQ ID NO: 1135958 - protein, 18 aa, Mycobacterium
EATPIPRRAVRGLKVLVW

SEQ ID NO: 1135959 - protein, 23 aa, Mycobacterium
EDKAALLRRIAAGKPIAMVGDGV

SEQ ID NO: 1135960 - protein, 23 aa, Mycobacterium
EEAGRWDLLLAGPLRTVDAAARC

SEQ ID NO: 1135961 - protein, 20 aa, Mycobacterium
EFAFRHPLVRAVAYESQLRS

SEQ ID NO: 1135962 - protein, 41 aa, Mycobacterium
EFYWARQRAKRALLFWVVAVITLAGLLAAGAWTLGSNLVNL

SEQ ID NO: 1135963 - protein, 17 aa, Mycobacterium
EHDLLLISIATAGMIAL

SEQ ID NO: 1135964 - protein, 23 aa, Mycobacterium
EHIKEALRRLPPYATTLGEVVGS

SEQ ID NO: 1135965 - protein, 19 aa, Mycobacterium
EHVPFKTPTYARDLLQTPI

SEQ ID NO: 1135966 - protein, 29 aa, Mycobacterium
EIGALLVGLAWLAGLLILAGIILARGSKS

SEQ ID NO: 1135967 - protein, 27 aa, Mycobacterium
EISLPPGYLPLRVPIEVHFTQRVAVDV

SEQ ID NO: 1135968 - protein, 22 aa, Mycobacterium
EISWRGPFFGVSALMVVAVVVT

SEQ ID NO: 1135969 - protein, 18 aa, Mycobacterium
ELFRLVAQMSLGVGALAV

SEQ ID NO: 1135970 - protein, 20 aa, Mycobacterium
ELSGYWTAAFAMAGPNTRIV

SEQ ID NO: 1135971 - protein, 18 aa, Mycobacterium
EMHLLLTVTAPDGALTGP

SEQ ID NO: 1135972 - protein, 33 aa, Mycobacterium
EMTPDTPIWRLVLPFLVMGIGMAFIWSPLAATA

SEQ ID NO: 1135973 - protein, 25 aa, Mycobacterium
EPHCFNIPICWAFRSLFDGLDNIDA

SEQ ID NO: 1135974 - protein, 24 aa, Mycobacterium
EPVKYRGFMLPDRYEPPTTINRRV

SEQ ID NO: 1135975 - protein, 24 aa, Mycobacterium
ERDRLPIEIAIAVLVLGVLLLVYR

SEQ ID NO: 1135976 - protein, 34 aa, Mycobacterium
ERFPSEWIYAQGLLFIVVVGFFPAGLAGLGVLLK

SEQ ID NO: 1135977 - protein, 23 aa, Mycobacterium
ERRLGTFRWLVVGAAAHVAGTYL

SEQ ID NO: 1135978 - protein, 32 aa, Mycobacterium
ESFMSWGWRVPFLVSLLLLGLGIYVRLSITES

SEQ ID NO: 1135979 - protein, 24 aa, Mycobacterium
ETARPADLLVLLDSLQQREAALNT

SEQ ID NO: 1135980 - protein, 18 aa, Mycobacterium
ETATFLRNLADPDNNRRP

SEQ ID NO: 1135981 - protein, 24 aa, Mycobacterium
EVGEAAMLAFLFAISEGLEEYSIT

SEQ ID NO: 1135982 - protein, 24 aa, Mycobacterium
EVGEAAMLAFLFSISEGLEEYSLA

SEQ ID NO: 1135983 - protein, 24 aa, Mycobacterium
EVGEAAMLAFLFSISEGLEEYSVA

SEQ ID NO: 1135984 - protein, 24 aa, Mycobacterium
EVSFYLVLPLLALSVRRVPVRARI

SEQ ID NO: 1135985 - protein, 18 aa, Mycobacterium
EVVVVVVAALMAMAYRRD

SEQ ID NO: 1135986 - protein, 21 aa, Mycobacterium
EWEWLKWTPHHRSSGGHTLLI

SEQ ID NO: 1135987 - protein, 17 aa, Mycobacterium
EWRPFTIAGLGIGVFGT

SEQ ID NO: 1135988 - protein, 26 aa, Mycobacterium
EYGDRVNFVIRYFPIQSHFNAERAAR

SEQ ID NO: 1135989 - protein, 24 aa, Mycobacterium
EYVIPLPRAWLLTSAMLVGAAIGL

SEQ ID NO: 1135990 - protein, 24 aa, Mycobacterium
FAAVRDMFGWIGPVLMALNGNAVC

SEQ ID NO: 1135991 - protein, 17 aa, Mycobacterium
FAGWVLLLVASIALTVG

SEQ ID NO: 1135992 - protein, 21 aa, Mycobacterium
FAIIFGGALLGLFLGKILPNQ

SEQ ID NO: 1135993 - protein, 17 aa, Mycobacterium
FALAWRDSWEYWTETVR

SEQ ID NO: 1135994 - protein, 21 aa, Mycobacterium
FALFFLFPLYAMADFSTRDLI

SEQ ID NO: 1135995 - protein, 24 aa, Mycobacterium
FALSWWLGLYLLARNPRKPVLLSA

SEQ ID NO: 1135996 - protein, 28 aa, Mycobacterium
FAWHHNRFPLSMLLMLVLLGTLIVIYRL

SEQ ID NO: 1135997 - protein, 22 aa, Mycobacterium
FDYWQAWVFIAVFVVTTLVPSS

SEQ ID NO: 1135998 - protein, 18 aa, Mycobacterium
FECEACRAAFPMVEQLRA

SEQ ID NO: 1135999 - protein, 17 aa, Mycobacterium
FEKVLILPLMIAPVIAG

SEQ ID NO: 1136000 - protein, 22 aa, Mycobacterium
FFHTARYMLMNFVLAVGVGAWQ

SEQ ID NO: 1136001 - protein, 19 aa, Mycobacterium
FFIAALVVLFYSTFFFFFF

SEQ ID NO: 1136002 - protein, 41 aa, Mycobacterium
FFLAGDLLGLPGWVTQRLWWALLLTVGFWGVVRVAEALGLG

SEQ ID NO: 1136003 - protein, 21 aa, Mycobacterium
FFSPNPWSALLTGLIAGVFFG

SEQ ID NO: 1136004 - protein, 23 aa, Mycobacterium
FGEYVPLRPLFGWATRHTKAAAE

SEQ ID NO: 1136005 - protein, 18 aa, Mycobacterium
FGIGLGVAMWVLLNGANP

SEQ ID NO: 1136006 - protein, 26 aa, Mycobacterium
FGIKAAVFPLSTWLPDSYPTAPAPVT

SEQ ID NO: 1136007 - protein, 17 aa, Mycobacterium
FHLLSGNLSFQIEHHLF

SEQ ID NO: 1136008 - protein, 26 aa, Mycobacterium
FIEPVIRLLQPVTKLLIDLGYDRTTN

SEQ ID NO: 1136009 - protein, 18 aa, Mycobacterium
FIIVYLPNRLLGVHFLGI

SEQ ID NO: 1136010 - protein, 26 aa, Mycobacterium
FKIHLNDPPTCSVGFLPPTSIRSPAD

SEQ ID NO: 1136011 - protein, 22 aa, Mycobacterium
FLAAAVLYFLAVGQVKGFAFTL

SEQ ID NO: 1136012 - protein, 25 aa, Mycobacterium
FLAPALTVVFLLLPLDLPPQQQTLA

SEQ ID NO: 1136013 - protein, 18 aa, Mycobacterium
FLGSKLWHNMFGGNSNDF

SEQ ID NO: 1136014 - protein, 19 aa, Mycobacterium
FLPIIMTVARRFGGSLLLY

SEQ ID NO: 1136015 - protein, 18 aa, Mycobacterium
FLVLAVAFVAAVSGWRSG

SEQ ID NO: 1136016 - protein, 19 aa, Mycobacterium
FLVVWLIPVVLGVAYARGL

SEQ ID NO: 1136017 - protein, 30 aa, Mycobacterium
FMAGMFVMLGWGLFQIYMLGEPLQAESAGF

SEQ ID NO: 1136018 - protein, 26 aa, Mycobacterium
FMQNDKRVWPRYMPGGRVRTSTLGLI

SEQ ID NO: 1136019 - protein, 24 aa, Mycobacterium
FNQELYGRATTVPWGLEIYERVDA

SEQ ID NO: 1136020 - protein, 18 aa, Mycobacterium
FPGWANYFPVTKAVPEPP

SEQ ID NO: 1136021 - protein, 17 aa, Mycobacterium
FQHYFFLTSIHCIHVLI

SEQ ID NO: 1136022 - protein, 25 aa, Mycobacterium
FSSPVYRALWIAQFVSNLGTWMQTV

SEQ ID NO: 1136023 - protein, 24 aa, Mycobacterium
FTLRIAPRTFLCANGFRNRNHVGS

SEQ ID NO: 1136024 - protein, 20 aa, Mycobacterium
FTMAGPWVGIAAPGEQITSL

SEQ ID NO: 1136025 - protein, 17 aa, Mycobacterium
FTVAFMTAILLGAGTDY

SEQ ID NO: 1136026 - protein, 33 aa, Mycobacterium
FVDDYIFNFPDTSFAWAFVLALLAGALAARKRI

SEQ ID NO: 1136027 - protein, 17 aa, Mycobacterium
FVDIDRQMYFFYAAVMA

SEQ ID NO: 1136028 - protein, 17 aa, Mycobacterium
FVGLMLIGLIWLLVFQL

SEQ ID NO: 1136029 - protein, 25 aa, Mycobacterium
FVILAYPLFLLLNSGSLAAAITAHC

SEQ ID NO: 1136030 - protein, 27 aa, Mycobacterium
FVLIPQRGTLPIFMPLVDLGNATGTSA

SEQ ID NO: 1136031 - protein, 20 aa, Mycobacterium
FVMLPVVWALNQQGWHAAAA

SEQ ID NO: 1136032 - protein, 33 aa, Mycobacterium
FVSGFRQMNPLYLIFMAMMGIALFQSMQQQGGN

SEQ ID NO: 1136033 - protein, 18 aa, Mycobacterium
FVVAVRQLKINEPAPIEV

SEQ ID NO: 1136034 - protein, 18 aa, Mycobacterium
FVVGIAVATLLLSVAAGA

SEQ ID NO: 1136035 - protein, 27 aa, Mycobacterium
FYGKRPPQLWSPPLDDPIPLDSVLRQA

SEQ ID NO: 1136036 - protein, 19 aa, Mycobacterium
FYRTLIPVIDARLAEHALG

SEQ ID NO: 1136037 - protein, 19 aa, Mycobacterium
GAAPLLWSILVGLGLSVFS

SEQ ID NO: 1136038 - protein, 27 aa, Mycobacterium
GAEYAWTSPVIIGLFVASALALAVFIQ

SEQ ID NO: 1136039 - protein, 20 aa, Mycobacterium
GAFLVMVGLILVVLAVVSFL

SEQ ID NO: 1136040 - protein, 21 aa, Mycobacterium
GAGLYYWWVGDLDPDKTWPVY

SEQ ID NO: 1136041 - protein, 31 aa, Mycobacterium
GAGQARSPMFGFFPVMMVMSLVGTLAFGARG

SEQ ID NO: 1136042 - protein, 24 aa, Mycobacterium
GAIAWLLLLICSPATRAAARLRTP

SEQ ID NO: 1136043 - protein, 23 aa, Mycobacterium
GALLSFWGWFLDHAHIIAAVAFF

SEQ ID NO: 1136044 - protein, 25 aa, Mycobacterium
GALVHHVRWPMWLRTVVSVVALAAI

SEQ ID NO: 1136045 - protein, 33 aa, Mycobacterium
GAPLALALAIRCTAAWWLGRPGWRRDFDRAVAM

SEQ ID NO: 1136046 - protein, 23 aa, Mycobacterium
GARPPRDLLPGLSGFHGMHRRVA

SEQ ID NO: 1136047 - protein, 27 aa, Mycobacterium
GATSYTFYDYARGWPLALLAAAFAVVV

SEQ ID NO: 1136048 - protein, 29 aa, Mycobacterium
GAVAAAVLWAGSWAFGPHSALAGLLAVAV

SEQ ID NO: 1136049 - protein, 28 aa, Mycobacterium
GAVFGDPMLWLERALVVLVAASPCALAI

SEQ ID NO: 1136050 - protein, 31 aa, Mycobacterium
GAVLFPVGFCLLYLLGFDLLTGVFTLVPLAL

SEQ ID NO: 1136051 - protein, 31 aa, Mycobacterium
GAVLVGVSLFLALWLVWAPALFRSLDDVGTP

SEQ ID NO: 1136052 - protein, 20 aa, Mycobacterium
GAVVLLLTLATRGGPRKRAE

SEQ ID NO: 1136053 - protein, 23 aa, Mycobacterium
GAWIVGQCIIAVAFGAGLFIAFD

SEQ ID NO: 1136054 - protein, 25 aa, Mycobacterium
GAYGSFFNIFYCSTRLKINGPAGSD

SEQ ID NO: 1136055 - protein, 24 aa, Mycobacterium
GCYYSDVYWITFAGMATVDDPRYV

SEQ ID NO: 1136056 - protein, 24 aa, Mycobacterium
GDADYHRVFWLTTGFTVVVLAIVV

SEQ ID NO: 1136057 - protein, 40 aa, Mycobacterium
GDGARFTWRMVLVMVGALLVWLLVVLTLMRISGWLDVSVD

SEQ ID NO: 1136058 - protein, 23 aa, Mycobacterium
GDLVHLLAELLDNALRYSPPTSQ

SEQ ID NO: 1136059 - protein, 25 aa, Mycobacterium
GDPDFYWFTAGLAVFWTAGAFLSGP

SEQ ID NO: 1136060 - protein, 23 aa, Mycobacterium
GDPRVWIERALVVLVAASPCALA

SEQ ID NO: 1136061 - protein, 26 aa, Mycobacterium
GEAELAYLLAGWRDEIRQPPMASVVT

SEQ ID NO: 1136062 - protein, 31 aa, Mycobacterium
GEALAGLLRRWAWLVLIVGFAVIVTYTMDED

SEQ ID NO: 1136063 - protein, 18 aa, Mycobacterium
GELLARHLATGPDTGFCV

SEQ ID NO: 1136064 - protein, 33 aa, Mycobacterium
GFFTDHLSWRWAFWINVPVGIVVFFVAAAAIPA

SEQ ID NO: 1136065 - protein, 76 aa, Mycobacterium
GGERGVIYDIALWAVPFGLIGGRLYHVITDWQTYFGPDGAGLIAAFRIWEGGLGIWGAVALGGVGAWIACRRRGIP

SEQ ID NO: 1136066 - protein, 31 aa, Mycobacterium
GGGLIAILLFAPYLWLALVAAAVAVSTYEVS

SEQ ID NO: 1136067 - protein, 31 aa, Mycobacterium
GGKIVLWIATIGLIALGLWRLAEAFIGAKPG

SEQ ID NO: 1136068 - protein, 24 aa, Mycobacterium
GGMFGWVRNPIFTAMLVFGAGVAL

SEQ ID NO: 1136069 - protein, 23 aa, Mycobacterium
GGRGRIALLVTAVAWALLGVIIR

SEQ ID NO: 1136070 - protein, 27 aa, Mycobacterium
GGRLLGPMERLLILGLGLAGQLAAATA

SEQ ID NO: 1136071 - protein, 24 aa, Mycobacterium
GGRTRWRWAVANYGYLLAATALIR

SEQ ID NO: 1136072 - protein, 25 aa, Mycobacterium
GGTAFVRRLVTLATTLLLAATVLSV

SEQ ID NO: 1136073 - protein, 18 aa, Mycobacterium
GGTPLWPGVPPAPAPAPA

SEQ ID NO: 1136074 - protein, 32 aa, Mycobacterium
GGVGAWIACRRRGIPLPAFGDAIAPGIILAQA

SEQ ID NO: 1136075 - protein, 18 aa, Mycobacterium
GGVWLTSFLIVAANTAVA

SEQ ID NO: 1136076 - protein, 26 aa, Mycobacterium
GGWILMTVLMVLFWAAVITAVVLAIR

SEQ ID NO: 1136077 - protein, 23 aa, Mycobacterium
GGYSFESFRWAWTAQYAVWTLAT

SEQ ID NO: 1136078 - protein, 43 aa, Mycobacterium
GHAAALRALLVLTVAVGLAYPVLIWLVAQLPGLRDQADGSLLE

SEQ ID NO: 1136079 - protein, 20 aa, Mycobacterium
GHFMAYTFVVVVIRDVVGVP

SEQ ID NO: 1136080 - protein, 23 aa, Mycobacterium
GHVSWLDIFAIGAVLPGSFVARA

SEQ ID NO: 1136081 - protein, 35 aa, Mycobacterium
GIATVGLWLESLWINAVYPLTWPTSIWPEALAMSV

SEQ ID NO: 1136082 - protein, 25 aa, Mycobacterium
GIAVLMLLGLPFLGVRWGLPDDRVL

SEQ ID NO: 1136083 - protein, 19 aa, Mycobacterium
GIAVVFVGAVLLLMCIVLR

SEQ ID NO: 1136084 - protein, 25 aa, Mycobacterium
GINLGFYMLMPYLAGYLAGPLGLAA

SEQ ID NO: 1136085 - protein, 32 aa, Mycobacterium
GINYIVWRWFGSINWAAWWIAVPLVIAETYSV

SEQ ID NO: 1136086 - protein, 33 aa, Mycobacterium
GIVGYLAALLAYPRYFPPISLWTGLSLLGVAVA

SEQ ID NO: 1136087 - protein, 31 aa, Mycobacterium
GIYYGLPPLLILALRILFLALTIGSLVLLYR

SEQ ID NO: 1136088 - protein, 18 aa, Mycobacterium
GKHHLYVVSAQRGGSDSS

SEQ ID NO: 1136089 - protein, 18 aa, Mycobacterium
GLFTAVIQPPLLLFITVP

SEQ ID NO: 1136090 - protein, 19 aa, Mycobacterium
GLGITLWLSTGAAERSYQL

SEQ ID NO: 1136091 - protein, 23 aa, Mycobacterium
GLGRVLWPGLAAIGVLLMTQPWT

SEQ ID NO: 1136092 - protein, 24 aa, Mycobacterium
GLILLALLLALLSAPPVGAIEPPS

SEQ ID NO: 1136093 - protein, 31 aa, Mycobacterium; identical to SEQ ID NO: 1119925

SEQ ID NO: 1136094 - protein, 27 aa, Mycobacterium
GLLLGRHLRVLLIVLLSALTTASFVYA

SEQ ID NO: 1136095 - protein, 24 aa, Mycobacterium
GLLVGFLWALLFNGFFGPRLGVFY

SEQ ID NO: 1136096 - protein, 27 aa, Mycobacterium
GLMCVALVVYFLLLGRIAFAFIKTGEL

SEQ ID NO: 1136097 - protein, 34 aa, Mycobacterium
GLPLRAIVMVLLFLGIVFLLVGFQALRSDDSSAD

SEQ ID NO: 1136098 - protein, 19 aa, Mycobacterium
GLSFILLTIAIHTTAVVLM

SEQ ID NO: 1136099 - protein, 29 aa, Mycobacterium
GLSLLGWCSFMLLWVLQACVFWRGMESIR

SEQ ID NO: 1136100 - protein, 27 aa, Mycobacterium
GLVNPVFWLGMMIALAAAFLAAYPVNR

SEQ ID NO: 1136101 - protein, 17 aa, Mycobacterium
GMAFLFGLVFVLIEGPG

SEQ ID NO: 1136102 - protein, 26 aa, Mycobacterium
GMHDWPFAEQAFATALPWLAGRLRTP

SEQ ID NO: 1136103 - protein, 20 aa, Mycobacterium
GMRLSPVPMLSWLGTAYVNV

SEQ ID NO: 1136104 - protein, 30 aa, Mycobacterium
GMTAEPLPIPWSVLSLFAPGPTLSKADALV

SEQ ID NO: 1136105 - protein, 29 aa, Mycobacterium
GNEAPAQLWVFWIAPLLGAAIAGAAYPYL

SEQ ID NO: 1136106 - protein, 23 aa, Mycobacterium
GNKLDYYLRRQIEYVADGCDAET

SEQ ID NO: 1136107 - protein, 23 aa, Mycobacterium
GNPLWRYRLLMAVLGSMLLSWLL

SEQ ID NO: 1136108 - protein, 32 aa, Mycobacterium
GPACAIAVLFGFLATVTLLPPVLALAAKRGIG

SEQ ID NO: 1136109 - protein, 49 aa, Mycobacterium
GPAPMTAPPKRPSRWSPANWPVRWKVLAIVLVPLVLAGVFGGARIAANV

SEQ ID NO: 1136110 - protein, 34 aa, Mycobacterium
GPEGAAWLRLAWAGLLFLVFLRPRRADFTGRSLT

SEQ ID NO: 1136111 - protein, 35 aa, Mycobacterium
GPESAAMLLIPVYLVYIRAARPLIAFYNWCANATL

SEQ ID NO: 1136112 - protein, 25 aa, Mycobacterium
GPGFQVNLYGLPPAPLAEVLLDTYF

SEQ ID NO: 1136113 - protein, 24 aa, Mycobacterium
GPGTALVVLLFTSLALAIAVNVLA

SEQ ID NO: 1136114 - protein, 25 aa, Mycobacterium
GPLLPALIFMIIVTQIPFLFTLYYS

SEQ ID NO: 1136115 - protein, 28 aa, Mycobacterium
GPRRLEAFALFNVFYQAGILAGPLVGLA

SEQ ID NO: 1136116 - protein, 25 aa, Mycobacterium
GPVLGLMVFAYITARLILFATAWAA

SEQ ID NO: 1136117 - protein, 28 aa, Mycobacterium
GQLKQGKSLLLNSLLNMPVARVGDDEST

SEQ ID NO: 1136118 - protein, 18 aa, Mycobacterium
GQLVQPFIDAAFSDLGLD

SEQ ID NO: 1136119 - protein, 33 aa, Mycobacterium
GQMQVGSLIAFLSYFMQILMAVLMATFMLIIIP

SEQ ID NO: 1136120 - protein, 24 aa, Mycobacterium
GQMTPWNTYVRPGLPATPICSPSQ

SEQ ID NO: 1136121 - protein, 17 aa, Mycobacterium
GQYKLYAELPRSGGLYE

SEQ ID NO: 1136122 - protein, 30 aa, Mycobacterium
GRAVAFLAPWLFFMFIDLFDSDRAGMAGLC

SEQ ID NO: 1136123 - protein, 28 aa, Mycobacterium
GRGEILLATRFKPSMVSLPMAAVAAMHA

SEQ ID NO: 1136124 - protein, 17 aa, Mycobacterium
GRQNAYPIALYTALPLQ

SEQ ID NO: 1136125 - protein, 20 aa, Mycobacterium
GRRDLTVVGLAREPNRYLAT

SEQ ID NO: 1136126 - protein, 26 aa, Mycobacterium
GRRPDLFWITTAHGRLWLSTRLTDDA

SEQ ID NO: 1136127 - protein, 31 aa, Mycobacterium
GRSRRILTAVLLALLALLFAALILPRVIGVR

SEQ ID NO: 1136128 - protein, 25 aa, Mycobacterium
GSALPRWIYVPAVAGALFVGLPVVS

SEQ ID NO: 1136129 - protein, 23 aa, Mycobacterium
GSGPFFKAYLANLPGQLVQPFID

SEQ ID NO: 1136130 - protein, 17 aa, Mycobacterium
GSIDWLGAVGLAAGLSA

SEQ ID NO: 1136131 - protein, 18 aa, Mycobacterium
GSIPFLDMLFVDLRVYIL

SEQ ID NO: 1136132 - protein, 26 aa, Mycobacterium
GSQPDFYMMWTDGLIRLWPAWEFYIG

SEQ ID NO: 1136133 - protein, 27 aa, Mycobacterium
GSRFPWAFFMVVVAWLAVIFASFGLFA

SEQ ID NO: 1136134 - protein, 26 aa, Mycobacterium
GSVFCDLTLLRFRALLSRLRGDETVY

SEQ ID NO: 1136135 - protein, 20 aa, Mycobacterium
GSYVWWALLVIAAAGTLSAR

SEQ ID NO: 1136136 - protein, 29 aa, Mycobacterium
GTAAAALCWLWPAGAGLLIRFTGPPLWWL

SEQ ID NO: 1136137 - protein, 21 aa, Mycobacterium
GTIFLITMVVLVVLVIWPPTG

SEQ ID NO: 1136138 - protein, 24 aa, Mycobacterium
GTRALVLVRLLVPSAHLLDLHREV

SEQ ID NO: 1136139 - protein, 23 aa, Mycobacterium
GTRYPVFAVIGVNPLPTPTSPGA

SEQ ID NO: 1136140 - protein, 25 aa, Mycobacterium
GTVAYAVLILVLRMSGKRTLAKLNA

SEQ ID NO: 1136141 - protein, 21 aa, Mycobacterium
GTVEFYAVIFLSIGASVGATI

SEQ ID NO: 1136142 - protein, 29 aa, Mycobacterium
GVAACVAFWFLWPLLRAVIRLARRHRHRR

SEQ ID NO: 1136143 - protein, 24 aa, Mycobacterium
GVAAPLLLLFLRCLQGFSAGGEYG

SEQ ID NO: 1136144 - protein, 20 aa, Mycobacterium
GVAGWLGYRIVDDRRAQAEL

SEQ ID NO: 1136145 - protein, 27 aa, Mycobacterium
GVFFVSIAVFQLIWAFAAPGRATTEVL

SEQ ID NO: 1136146 - protein, 26 aa, Mycobacterium
GVFVAFLIPFLDLGIIQSPMLRPVPQ

SEQ ID NO: 1136147 - protein, 30 aa, Mycobacterium
GVFVPIVIAIAVITLGAWLGAGFSVAAAFT

SEQ ID NO: 1136148 - protein, 29 aa, Mycobacterium
GVGITEAVLWFIRRWLVSRATMGVEADIR

SEQ ID NO: 1136149 - protein, 26 aa, Mycobacterium
GVGMVLFWALLILGIVTLIRLSTDGD

SEQ ID NO: 1136150 - protein, 17 aa, Mycobacterium
GVGSSPVPAPWPVLARL

SEQ ID NO: 1136151 - protein, 24 aa, Mycobacterium
GVIAVLVTVFTMWRDDPPPVVAAK

SEQ ID NO: 1136152 - protein, 17 aa, Mycobacterium
GVLMFALALPFVLAWPF

SEQ ID NO: 1136153 - protein, 32 aa, Mycobacterium
GVLTFQVLLGQELHWSVPPLAFVVLVAVGADY

SEQ ID NO: 1136154 - protein, 31 aa, Mycobacterium
GVLTGAWLGLFIGLILGFFSPNPWSALLTGL

SEQ ID NO: 1136155 - protein, 24 aa, Mycobacterium
GVQAGLYGGLLVDAYRAAQVQVQV

SEQ ID NO: 1136156 - protein, 42 aa, Mycobacterium
GVRESGWFAWPGYLWFGMAAYLLLTLLVLEPVRLILRVRLRR

SEQ ID NO: 1136157 - protein, 25 aa, Mycobacterium
GVVAFTVLLAIHIWQWTPFAVLIAF

SEQ ID NO: 1136158 - protein, 23 aa, Mycobacterium
GWGAFLFMMSLYLQGERGYSAME

SEQ ID NO: 1136159 - protein, 30 aa, Mycobacterium
GWGAGVGALLGLFAPPILASVVVGAAAAAI

SEQ ID NO: 1136160 - protein, 28 aa, Mycobacterium
GWGVKAAMAVVLVVLGMCIGWGLYGNTS

SEQ ID NO: 1136161 - protein, 36 aa, Mycobacterium
GWHAAAAVPFWIGPILLYLLLPALDLRFGPDGQNPP

SEQ ID NO: 1136162 - protein, 21 aa, Mycobacterium
GWLKLPTFDWPTDPAWLYRLT

SEQ ID NO: 1136163 - protein, 18 aa, Mycobacterium
GWLSTRRRIRELVLPIVT

SEQ ID NO: 1136164 - protein, 33 aa, Mycobacterium
GYGFLYGLAFYVPLLPWISGLVGAVPWLALAAV

SEQ ID NO: 1136165 - protein, 20 aa, Mycobacterium
GYGWQYWVPAGAVAFGLIVL

SEQ ID NO: 1136166 - protein, 35 aa, Mycobacterium
GYVELPPERLNKAGPAPFLLEQWAELSAAALEDAG

SEQ ID NO: 1136167 - protein, 20 aa, Mycobacterium
HAVLLATNFLGINTIPIAVN

SEQ ID NO: 1136168 - protein, 18 aa, Mycobacterium
HDGRPRRVAMAGAGICVA

SEQ ID NO: 1136169 - protein, 39 aa, Mycobacterium
HDSSGQWLIGVFLGGLLGGSVAVAILLARGRRSGRAAMT

SEQ ID NO: 1136170 - protein, 30 aa, Mycobacterium
HISGPRTKLFAALFLILALVVIGEIAGVVL

SEQ ID NO: 1136171 - protein, 26 aa, Mycobacterium
HKSLEQALVIFPALLAALNTVAGGVP

SEQ ID NO: 1136172 - protein, 20 aa, Mycobacterium
HLNLTLGTWAADGLLAVFFL

SEQ ID NO: 1136173 - protein, 19 aa, Mycobacterium
HLNRELWIGSMIAALVVGG

SEQ ID NO: 1136174 - protein, 35 aa, Mycobacterium
HPARYLSLFLVLLVGAFLLVFLTGDKKADPKLGID

SEQ ID NO: 1136175 - protein, 18 aa, Mycobacterium
HPVHPLLVTLPIGTWMTS

SEQ ID NO: 1136176 - protein, 18 aa, Mycobacterium
HRRDGIALALLGIAVVVA

SEQ ID NO: 1136177 - protein, 24 aa, Mycobacterium
HRVAMLWTAAGIWFEPIRTILTCS

SEQ ID NO: 1136178 - protein, 25 aa, Mycobacterium
HSAGLLLYPVLFVGLLELPRYMHWT

SEQ ID NO: 1136179 - protein, 20 aa, Mycobacterium
HVQWRHRALLVAAIATMLAT

SEQ ID NO: 1136180 - protein, 50 aa, Mycobacterium
HVYRYVLDGLKRPYRIRRLARALNQFARLSYMILLSVPLVAPVLVRAFIA

SEQ ID NO: 1136181 - protein, 17 aa, Mycobacterium
HWFGFRFTTGFGYGAAF

SEQ ID NO: 1136182 - protein, 18 aa, Mycobacterium
IAAPKRVIAAAVAVLIGC

SEQ ID NO: 1136183 - protein, 25 aa, Mycobacterium
IAAQALRWWCITTLGWQWNTRVIVV

SEQ ID NO: 1136184 - protein, 20 aa, Mycobacterium
IALLIVFACLLVWLFADLLI

SEQ ID NO: 1136185 - protein, 18 aa, Mycobacterium
IALYLAHVHPTLAGVAVA

SEQ ID NO: 1136186 - protein, 51 aa, Mycobacterium
IAMAMIPVLQFTYWQWASLTLAAPVIVWAAWPFHRAAWTNLRHGTATMDTL

SEQ ID NO: 1136187 - protein, 22 aa, Mycobacterium
IAPRGAFMLIALALAAAVTVAP

SEQ ID NO: 1136188 - protein, 38 aa, Mycobacterium
IAVLVLGVLLLVYRSVVTMLLPLVTIGSSLMIAQGVVA

SEQ ID NO: 1136189 - protein, 35 aa, Mycobacterium
IDAAPGLPVVVPMAPIAVPVLAVPPVGLPSVLGVG

SEQ ID NO: 1136190 - protein, 17 aa, Mycobacterium
IDALMFVNSRPLGTRQA

SEQ ID NO: 1136191 - protein, 19 aa, Mycobacterium
IEDIPGLRWGLRAASLLVA

SEQ ID NO: 1136192 - protein, 38 aa, Mycobacterium
IEHRVLDDVYLPLWVRRVAWVATIVLLMTGITAWVVGV

SEQ ID NO: 1136193 - protein, 33 aa, Mycobacterium
IELNPKALIARVPFVVLVIGSLGLGLGITLWLS

SEQ ID NO: 1136194 - protein, 30 aa, Mycobacterium
IFPVVGWWLYDIFYITPFLAIPYLHSVNRE

SEQ ID NO: 1136195 - protein, 29 aa, Mycobacterium
IGAAIGVVWFWIPLGLLVLGTSSIPSVIG

SEQ ID NO: 1136196 - protein, 19 aa, Mycobacterium
IGADPVRLLLGGGAGAWLL

SEQ ID NO: 1136197 - protein, 22 aa, Mycobacterium
IGAWALACSIPVVLAGALVIRL

SEQ ID NO: 1136198 - protein, 23 aa, Mycobacterium
IGGILIGNILSGGMRGGFGGGGF

SEQ ID NO: 1136199 - protein, 18 aa, Mycobacterium
IGKLPPLPDTVSQAVIPP

SEQ ID NO: 1136200 - protein, 17 aa, Mycobacterium
IGLIFFGWGVALAFTSV

SEQ ID NO: 1136201 - protein, 25 aa, Mycobacterium
IGLPVLAIILIGFFTNVRLPGNIPV

SEQ ID NO: 1136202 - protein, 19 aa, Mycobacterium
IGMVVLPVIVYYVTYRWAV

SEQ ID NO: 1136203 - protein, 28 aa, Mycobacterium
IGSDGTAWLRLAWAGVLLLVVVRPRPSA

SEQ ID NO: 1136204 - protein, 21 aa, Mycobacterium
IGVVVFQWGLGHEIAWPVPLL

SEQ ID NO: 1136205 - protein, 28 aa, Mycobacterium
IHQDAGLSWLLLVSIPVLAVANYWIVSH

SEQ ID NO: 1136206 - protein, 18 aa, Mycobacterium
IIALPFFGIVSEIFPVFS

SEQ ID NO: 1136207 - protein, 47 aa, Mycobacterium
IIAVAFGAGLFIAFDQLWKWNNIVALVLSVLVILGLVVGVRVVRKTE

SEQ ID NO: 1136208 - protein, 23 aa, Mycobacterium
IIGLVITVAILAVLRTAVRDVFR

SEQ ID NO: 1136209 - protein, 17 aa, Mycobacterium
IISWLLTPNLALVMAIY

SEQ ID NO: 1136210 - protein, 33 aa, Mycobacterium
IIVVALAALVLVAALVWAARNKRNQSRHDEAET

SEQ ID NO: 1136211 - protein, 34 aa, Mycobacterium
IKFLIFGVIMVVLTAFLFLVFSDSRTGATEKYSA

SEQ ID NO: 1136212 - protein, 26 aa, Mycobacterium
IKKHKRWPWIAGAVVAVLAVTGGVVY

SEQ ID NO: 1136213 - protein, 18 aa, Mycobacterium
ILAIPYPGPGWAIVFIGL

SEQ ID NO: 1136214 - protein, 20 aa, Mycobacterium
ILALIHLYLWKRLVKDTTGP

SEQ ID NO: 1136215 - protein, 18 aa, Mycobacterium
ILVDLWIFTPFVAILVLA

SEQ ID NO: 1136216 - protein, 20 aa, Mycobacterium
INFEYLPVFGAAAAIYLALN

SEQ ID NO: 1136217 - protein, 23 aa, Mycobacterium
IPVRAFLLVMVTSVAWSLDTNFW

SEQ ID NO: 1136218 - protein, 26 aa, Mycobacterium
IRAWSPAVLLRWCGRHRLITTLAAAG

SEQ ID NO: 1136219 - protein, 24 aa, Mycobacterium
IRGGFWRSGPLIRGLTALGRALSL

SEQ ID NO: 1136220 - protein, 17 aa, Mycobacterium
IRTLLELAPPVAVVLRD

SEQ ID NO: 1136221 - protein, 32 aa, Mycobacterium
IRVNSFTSMFVFIGAVVYLMAAPRGREDPATL

SEQ ID NO: 1136222 - protein, 22 aa, Mycobacterium
IRYSMILFNWFGVGLIPLVMLI

SEQ ID NO: 1136223 - protein, 28 aa, Mycobacterium
ISADLKNRFRAFTLPHARPDRPSGVPVE

SEQ ID NO: 1136224 - protein, 19 aa, Mycobacterium
ISMLFTIAAALTLGPAILT

SEQ ID NO: 1136225 - protein, 21 aa, Mycobacterium
ISSVALIWFGGLRIDAGQMQV

SEQ ID NO: 1136226 - protein, 24 aa, Mycobacterium
ISTPSYWQPYVLSVASLTPEGQPS

SEQ ID NO: 1136227 - protein, 20 aa, Mycobacterium
ISWLLFTWMISRLPRESVSF

SEQ ID NO: 1136228 - protein, 27 aa, Mycobacterium
ITETRHWWQVPLLGHHVLIAGATGAGK

SEQ ID NO: 1136229 - protein, 18 aa, Mycobacterium
ITGLLLAGFIIGSLGVLN

SEQ ID NO: 1136230 - protein, 21 aa, Mycobacterium
ITLLLLIVAVLIVLTRLDVWT

SEQ ID NO: 1136231 - protein, 25 aa, Mycobacterium
ITQRFIMRWRIWLSRNLIDDWLDHH

SEQ ID NO: 1136232 - protein, 18 aa, Mycobacterium
ITRWFSARWGAGHSLVVG

SEQ ID NO: 1136233 - protein, 36 aa, Mycobacterium
ITSRLPLVLGLIAVSTFCLLFLLTASVVLPLKALLL

SEQ ID NO: 1136234 - protein, 25 aa, Mycobacterium
IVAAAAVFTYLSYTAAFTSTDTVTV

SEQ ID NO: 1136235 - protein, 30 aa, Mycobacterium; identical to SEQ ID NO: 359362

SEQ ID NO: 1136236 - protein, 22 aa, Mycobacterium
IVAVNALMLKRLKLPVPASAEA

SEQ ID NO: 1136237 - protein, 20 aa, Mycobacterium
IVCLLLAYPLAYVIAFKAGR

SEQ ID NO: 1136238 - protein, 17 aa, Mycobacterium
IVDPLVFAEAADLIADH

SEQ ID NO: 1136239 - protein, 26 aa, Mycobacterium
IVLAALWSMLLALSNHRARAGHMGSV

SEQ ID NO: 1136240 - protein, 20 aa, Mycobacterium
IVSMLFKLNIARGYLMIALP

SEQ ID NO: 1136241 - protein, 18 aa, Mycobacterium
IVTLVPLAYLLSLAVRPA

SEQ ID NO: 1136242 - protein, 36 aa, Mycobacterium
KALFRPFQWREFILQAWFLFRVSFLPTVAVSVPLTV

SEQ ID NO: 1136243 - protein, 20 aa, Mycobacterium
KAPRLVRRFIRNQAAKTLPD

SEQ ID NO: 1136244 - protein, 18 aa, Mycobacterium
KDLLTMELIAIPLSFAVL

SEQ ID NO: 1136245 - protein, 26 aa, Mycobacterium
KELWFAWWVMVVFYQLYGVLFFLVTR

SEQ ID NO: 1136246 - protein, 18 aa, Mycobacterium
KFGLGQRTGVGLPGESAG

SEQ ID NO: 1136247 - protein, 18 aa, Mycobacterium
KFPFIPPQVDPDPGPPVV

SEQ ID NO: 1136248 - protein, 17 aa, Mycobacterium
KLAVMTLGVLCVIASII

SEQ ID NO: 1136249 - protein, 21 aa, Mycobacterium
KLFTLDLAAFLGLSGTVWLSA

SEQ ID NO: 1136250 - protein, 29 aa, Mycobacterium
KLKRKITGPLLFLFILGDVLGAGIYALMG

SEQ ID NO: 1136251 - protein, 38 aa, Mycobacterium
KMFRHLRRRHIAFAGLFLLVVVVGFGSWLALRAVEAKA

SEQ ID NO: 1136252 - protein, 20 aa, Mycobacterium
KMKQNLWWGAGYNLISVPLA

SEQ ID NO: 1136253 - protein, 25 aa, Mycobacterium
KPPMSLAPIGGILSHVPFKSGEVTL

SEQ ID NO: 1136254 - protein, 22 aa, Mycobacterium
KRQPPPGLGWEERRAWRFEGPI

SEQ ID NO: 1136255 - protein, 33 aa, Mycobacterium
KRRGHVWVRLWTLFGSMFVIVAASFGWAMIQSG

SEQ ID NO: 1136256 - protein, 28 aa, Mycobacterium
KSAGVARWWRLLVIAAMGSWLVAEMVWF

SEQ ID NO: 1136257 - protein, 23 aa, Mycobacterium
KSTDLDWKSVWDHGWSAAAAADE

SEQ ID NO: 1136258 - protein, 20 aa, Mycobacterium
KTVTGFFTGTLSYTAPEVLS

SEQ ID NO: 1136259 - protein, 25 aa, Mycobacterium
KTWPVYVVLVYLLGCTVAGLIVAMV

SEQ ID NO: 1136260 - protein, 21 aa, Mycobacterium
KVGLRRWLDGLPDGLSTVLVG

SEQ ID NO: 1136261 - protein, 22 aa, Mycobacterium
KVYRANYFRSLLTKRTPRVVDV

SEQ ID NO: 1136262 - protein, 18 aa, Mycobacterium
KWEPFLTPNLWTTYVLPG

SEQ ID NO: 1136263 - protein, 26 aa, Mycobacterium
KYPSPWLRLLILCTALLGINYIVWRW

SEQ ID NO: 1136264 - protein, 24 aa, Mycobacterium
LAAAVGWFVPMLGLSLVGFLVVDA

SEQ ID NO: 1136265 - protein, 25 aa, Mycobacterium
LAAGLWAGLLWGADGTVPLLISGLA

SEQ ID NO: 1136266 - protein, 36 aa, Mycobacterium
LAALIAALGALFGDPMLWLERGLVVLVAASPCALAI

SEQ ID NO: 1136267 - protein, 22 aa, Mycobacterium
LAALVLLLLTAISTVLPHAAAG

SEQ ID NO: 1136268 - protein, 24 aa, Mycobacterium
LAASWLWVITLAGVCLWVTRARRG

SEQ ID NO: 1136269 - protein, 17 aa, Mycobacterium
LAGALVHHVRWPMWLRT

SEQ ID NO: 1136270 - protein, 33 aa, Mycobacterium
LAINCGYPLIERFPLMFFTSAAVLLIGMGRWYL

SEQ ID NO: 1136271 - protein, 26 aa, Mycobacterium
LAITAGIGLFILFIGLVDAGFVNSTG

SEQ ID NO: 1136272 - protein, 19 aa, Mycobacterium
LAIWIGVGFIFRGVATAMS

SEQ ID NO: 1136273 - protein, 20 aa, Mycobacterium
LALFAVATLLTRRPFTLAYA

SEQ ID NO: 1136274 - protein, 18 aa, Mycobacterium
LALLFPQLETVVRQQSVD

SEQ ID NO: 1136275 - protein, 20 aa, Mycobacterium
LALMLLDFRTTAAAAAVVFA

SEQ ID NO: 1136276 - protein, 28 aa, Mycobacterium
LALPFLVLWPFWLVTKWLGGRWTILVER

SEQ ID NO: 1136277 - protein, 21 aa, Mycobacterium
LANPDVYRPAALLPTPRETAT

SEQ ID NO: 1136278 - protein, 29 aa, Mycobacterium
LARVGSYGAFFPYYICGITFRASDLEGRT

SEQ ID NO: 1136279 - protein, 29 aa, Mycobacterium
LAVMLPMFPFALELLALRRLSAAAFGTLM

SEQ ID NO: 1136280 - protein, 20 aa, Mycobacterium
LAVSLFYLLAQMAGAGVLVA

SEQ ID NO: 1136281 - protein, 22 aa, Mycobacterium
LAYTLYVLIRWVSGPYFEPVAG

SEQ ID NO: 1136282 - protein, 26 aa, Mycobacterium
LDAQTIELALAWRSGEDDPLVEAVVG

SEQ ID NO: 1136283 - protein, 23 aa, Mycobacterium
LDDALRWIDVFGVALLAGIGFTV

SEQ ID NO: 1136284 - protein, 21 aa, Mycobacterium
LDPAAAWRSPPQDRFLRVPIG

SEQ ID NO: 1136285 - protein, 21 aa, Mycobacterium
LDQVLLWAALLTMVVGILGAI

SEQ ID NO: 1136286 - protein, 37 aa, Mycobacterium
LDRRAVAWALFAVLTVFSVVWAVAYLRGFGRTPVWVA

SEQ ID NO: 1136287 - protein, 17 aa, Mycobacterium
LDTLVTIPRRPFAWREF

SEQ ID NO: 1136288 - protein, 21 aa, Mycobacterium
LEEMLQRPLAGVLAALDAALE

SEQ ID NO: 1136289 - protein, 17 aa, Mycobacterium
LEHCYAYSDSITDLPML

SEQ ID NO: 1136290 - protein, 28 aa, Mycobacterium
LELLRRRELPVLPVPAPLALQFVHADDV

SEQ ID NO: 1136291 - protein, 22 aa, Mycobacterium
LEVAPGITIPFGPPTTVPVGPP

SEQ ID NO: 1136292 - protein, 21 aa, Mycobacterium
LFSLAMFVLYLAFLPSGRAEA

SEQ ID NO: 1136293 - protein, 20 aa, Mycobacterium
LFVVMMLLAGALRTLIQRHR

SEQ ID NO: 1136294 - protein, 33 aa, Mycobacterium; identical to SEQ ID NO: 360889

SEQ ID NO: 1136295 - protein, 25 aa, Mycobacterium
LGAYGSFFNIFYCSVRIKVNGPAGS

SEQ ID NO: 1136296 - protein, 18 aa, Mycobacterium
LGCLLAVLAVRQAGLFTA

SEQ ID NO: 1136297 - protein, 33 aa, Mycobacterium
LGDALTFISVLRLVPHWFTPKQVPLVTQLTGIC

SEQ ID NO: 1136298 - protein, 28 aa, Mycobacterium
LGDNDNFWFSWIVPLAAIIFAGAFTDHY

SEQ ID NO: 1136299 - protein, 28 aa, Mycobacterium
LGEIAEGALLLFLFSVGHALEGYAMGRA

SEQ ID NO: 1136300 - protein, 17 aa, Mycobacterium
LGFKFIAENVPFIVLPP

SEQ ID NO: 1136301 - protein, 22 aa, Mycobacterium
LGFYMLMPYLAGYLAGPLGLAA

SEQ ID NO: 1136302 - protein, 20 aa, Mycobacterium
LGGFLWATVGGAIAWLLLLI

SEQ ID NO: 1136303 - protein, 32 aa, Mycobacterium
LGLLHHELEFWWELALLIVIMLLGHWVEMRSL

SEQ ID NO: 1136304 - protein, 36 aa, Mycobacterium; identical to SEQ ID NO: 347832

SEQ ID NO: 1136305 - protein, 17 aa, Mycobacterium
LGLRFRYAVTDPDRTRR

SEQ ID NO: 1136306 - protein, 19 aa, Mycobacterium
LGLVAATLVLVAFGLLASG

SEQ ID NO: 1136307 - protein, 19 aa, Mycobacterium
LGLVFLCAAPIAAVGFLVA

SEQ ID NO: 1136308 - protein, 17 aa, Mycobacterium
LGLYPNPRVFAVLNTIV

SEQ ID NO: 1136309 - protein, 18 aa, Mycobacterium
LGMAFLFGLVFVLIEGPG

SEQ ID NO: 1136310 - protein, 26 aa, Mycobacterium
LGMAVPGFPNFFMLYGPNTNVGSNSV

SEQ ID NO: 1136311 - protein, 20 aa, Mycobacterium
LGNLYYTFLARRLARRENRD

SEQ ID NO: 1136312 - protein, 17 aa, Mycobacterium
LGQPLAIEYVWGRQIGE

SEQ ID NO: 1136313 - protein, 24 aa, Mycobacterium
LGREFIDMYGFTNPTTDFRNSNLS

SEQ ID NO: 1136314 - protein, 26 aa, Mycobacterium
LGRGDWSALPLLRASIDALYSGGLVA

SEQ ID NO: 1136315 - protein, 21 aa, Mycobacterium
LGVIHLLARIPLPGSAPRPVW

SEQ ID NO: 1136316 - protein, 18 aa, Mycobacterium
LGVPVWTILRWLHIGGAE

SEQ ID NO: 1136317 - protein, 29 aa, Mycobacterium
LGWEERRAWRFEGPIIYLVVDDLETIPAQ

SEQ ID NO: 1136318 - protein, 17 aa, Mycobacterium
LIAVLPDLAFGVGGQMR

SEQ ID NO: 1136319 - protein, 17 aa, Mycobacterium
LIGLYVQDILGYSPLRA

SEQ ID NO: 1136320 - protein, 17 aa, Mycobacterium
LIGVFYKNLYVEALLNE

SEQ ID NO: 1136321 - protein, 20 aa, Mycobacterium
LIGVPWLLSFAQPTIWEIGR

SEQ ID NO: 1136322 - protein, 23 aa, Mycobacterium
LILVVAALFLLRMFGVVDSIGVG

SEQ ID NO: 1136323 - protein, 17 aa, Mycobacterium
LIMTVIGLTIAYVFKPQ

SEQ ID NO: 1136324 - protein, 17 aa, Mycobacterium
LIVIYRLQAARPPVSTV

SEQ ID NO: 1136325 - protein, 19 aa, Mycobacterium
LLAALAAAFLVLCFYVVAR

SEQ ID NO: 1136326 - protein, 17 aa, Mycobacterium
LLAALIQRPSALDPAVD

SEQ ID NO: 1136327 - protein, 18 aa, Mycobacterium
LLAFTPFPLDMSAQQIGL

SEQ ID NO: 1136328 - protein, 18 aa, Mycobacterium
LLAGGVALLGVWFYRAGS

SEQ ID NO: 1136329 - protein, 26 aa, Mycobacterium
LLAWGALGVYLLWRSGFRLPDIGLAR

SEQ ID NO: 1136330 - protein, 18 aa, Mycobacterium
LLFIGWNVSMSQAINPLP

SEQ ID NO: 1136331 - protein, 20 aa, Mycobacterium
LLGFALVLLVSMFSPAGPTG

SEQ ID NO: 1136332 - protein, 20 aa, Mycobacterium
LLGGLPMPIAVGTSLIVIAM

SEQ ID NO: 1136333 - protein, 17 aa, Mycobacterium
LLGLMMRRFGLPVLPLI

SEQ ID NO: 1136334 - protein, 25 aa, Mycobacterium
LLGSRLIFAHLFVVAAIVWWVRQGL

SEQ ID NO: 1136335 - protein, 36 aa, Mycobacterium
LLGWAALLPAGRQPLWWHYAVAAALILAFLGSWHGQ

SEQ ID NO: 1136336 - protein, 30 aa, Mycobacterium
LLIVAIAAFVLIFLIMMTLTRSLVAAIVIP

SEQ ID NO: 1136337 - protein, 26 aa, Mycobacterium
LLLQIYVVMGASWVWYRGLQGEPVPV

SEQ ID NO: 1136338 - protein, 20 aa, Mycobacterium
LLLVGLLTIALVIGAVWAPQ

SEQ ID NO: 1136339 - protein, 21 aa, Mycobacterium
LLLVPQLLLVLLSTGLAPLEA

SEQ ID NO: 1136340 - protein, 21 aa, Mycobacterium
LLPLVLIYQGWTYWVFRQRIS

SEQ ID NO: 1136341 - protein, 17 aa, Mycobacterium
LLSATIPTPHLWPRSWP

SEQ ID NO: 1136342 - protein, 22 aa, Mycobacterium
LLSTLLLTVIVYRTLDARDAAV

SEQ ID NO: 1136343 - protein, 24 aa, Mycobacterium
LLSVFGWPPLARLTTFMLTVYFVL

SEQ ID NO: 1136344 - protein, 21 aa, Mycobacterium
LLTGIFLLVILGATDTRAPKG

SEQ ID NO: 1136345 - protein, 17 aa, Mycobacterium
LLTRPRSADPRQQILRA

SEQ ID NO: 1136346 - protein, 20 aa, Mycobacterium
LLVAVGISWLLFTWMISRLP

SEQ ID NO: 1136347 - protein, 20 aa, Mycobacterium
LLVLAPFWLLPTSFYVRLEM

SEQ ID NO: 1136348 - protein, 26 aa, Mycobacterium
LMAVLMATFMLIIIPRAAVCAERIDE

SEQ ID NO: 1136349 - protein, 19 aa, Mycobacterium
LMFLGFMFAFAVKAPLWPL

SEQ ID NO: 1136350 - protein, 24 aa, Mycobacterium
LNARQMLLVNMLTDALPAAALAVS

SEQ ID NO: 1136351 - protein, 24 aa, Mycobacterium
LNSTDIIWSFFQAIAMAIVIMLVH

SEQ ID NO: 1136352 - protein, 23 aa, Mycobacterium
LNVALTNLRCMLSRSCIADAYRS

SEQ ID NO: 1136353 - protein, 17 aa, Mycobacterium
LPAFVALIGVVAAIFLR

SEQ ID NO: 1136354 - protein, 29 aa, Mycobacterium
LPGSYQFLKRWVFALVLSAVWVVAAAVGA

SEQ ID NO: 1136355 - protein, 20 aa, Mycobacterium
LPHVFERFYRADVARDRSHG

SEQ ID NO: 1136356 - protein, 17 aa, Mycobacterium
LPIIMTVARRFGGSLLL

SEQ ID NO: 1136357 - protein, 26 aa, Mycobacterium
LPLISVAVFFGLWQLAAASGIWNQTF

SEQ ID NO: 1136358 - protein, 45 aa, Mycobacterium
LPQLGRFIVRHPVLIIVAWVAAAAVLFLLIPPLAVVSQKNPPEFL

SEQ ID NO: 1136359 - protein, 27 aa, Mycobacterium
LPRHAKPVAPRRWPRALPIAAAVTVAV

SEQ ID NO: 1136360 - protein, 20 aa, Mycobacterium
LPTGILPAGGPFTEAGARTW

SEQ ID NO: 1136361 - protein, 17 aa, Mycobacterium
LPTMVDPPLAFPEVTRA

SEQ ID NO: 1136362 - protein, 24 aa, Mycobacterium
LPVQLGKDWLWLHAARTAAVTLPL

SEQ ID NO: 1136363 - protein, 28 aa, Mycobacterium
LQKLDPVLRLPLALGVIHLLARIPLPGS

SEQ ID NO: 1136364 - protein, 35 aa, Mycobacterium; identical to SEQ ID NO: 362096

SEQ ID NO: 1136365 - protein, 24 aa, Mycobacterium
LRASLPLLTRGLIGRRRPRGLQVA

SEQ ID NO: 1136366 - protein, 30 aa, Mycobacterium
LRDGSGPWWPLPFWIALAGLTPTGLLLAAV

SEQ ID NO: 1136367 - protein, 17 aa, Mycobacterium
LREVIVPRTAVFRLNGE

SEQ ID NO: 1136368 - protein, 17 aa, Mycobacterium
LRGGDWAGGAIAAADGL

SEQ ID NO: 1136369 - protein, 29 aa, Mycobacterium
LRGVDYPASFWPIPLPGWCPGLTCDTWNK

SEQ ID NO: 1136370 - protein, 26 aa, Mycobacterium
LRQRTLLYLLLVVVSAALLVGAVYLG

SEQ ID NO: 1136371 - protein, 26 aa, Mycobacterium
LRRGRSQVLFGALGALLCVLLGVAIV

SEQ ID NO: 1136372 - protein, 23 aa, Mycobacterium
LRRRRFRWCVAAAYLSGVSTVAG

SEQ ID NO: 1136373 - protein, 24 aa, Mycobacterium
LRTNLEILFDADLAHRPALEHDRT

SEQ ID NO: 1136374 - protein, 20 aa, Mycobacterium
LSAALYPLPGDSRLLDLFPP

SEQ ID NO: 1136375 - protein, 29 aa, Mycobacterium
LSAVLSGLLLNYFLINPRHTFTIAEPDSA

SEQ ID NO: 1136376 - protein, 21 aa, Mycobacterium
LSEAVAEPALVALLLGKTAQA

SEQ ID NO: 1136377 - protein, 29 aa, Mycobacterium
LSGDQYFGFLINLLLVFGFSFEFPLLIVM

SEQ ID NO: 1136378 - protein, 17 aa, Mycobacterium
LSGWALTGATAGALIVT

SEQ ID NO: 1136379 - protein, 27 aa, Mycobacterium
LSIVLANPRWFAVLLVIPVVASVFIMR

SEQ ID NO: 1136380 - protein, 26 aa, Mycobacterium
LSLIASVSPLVRWIIRVPREFVDDYI

SEQ ID NO: 1136381 - protein, 25 aa, Mycobacterium
LSTPLPVVLFAVLALTVALGNLFPR

SEQ ID NO: 1136382 - protein, 25 aa, Mycobacterium
LSVAAVVLAVMIWSGHREASAERAY

SEQ ID NO: 1136383 - protein, 29 aa, Mycobacterium
LSVGEQFWLVWPLLLLLVGLLKARKAAVA

SEQ ID NO: 1136384 - protein, 36 aa, Mycobacterium
LSVLVWQHLIGLHLHWLVLPLTFIILVAVGSDYNLL

SEQ ID NO: 1136385 - protein, 42 aa, Mycobacterium
LSYEVYLCVIATALWLIKFVLDFQWMSLFTVPFQTIGRGVDE

SEQ ID NO: 1136386 - protein, 25 aa, Mycobacterium
LTARTGFWIGVLPIALYSLLPVLAS

SEQ ID NO: 1136387 - protein, 23 aa, Mycobacterium
LTDSRNWRLRYSTADLPGGRVPS

SEQ ID NO: 1136388 - protein, 32 aa, Mycobacterium
LTEVSWRLAFLVNAPIGLLIVYLAHTALRETH

SEQ ID NO: 1136389 - protein, 20 aa, Mycobacterium
LTFSLTLITLQLASSQYSPR

SEQ ID NO: 1136390 - protein, 26 aa, Mycobacterium
LTFSQNLRMILLPQAFRSVVIPLGSV

SEQ ID NO: 1136391 - protein, 21 aa, Mycobacterium
LTGGKLFHLLSGNLSFQIEHH

SEQ ID NO: 1136392 - protein, 18 aa, Mycobacterium
LTGNWLYAFPGLHHEDWR

SEQ ID NO: 1136393 - protein, 25 aa, Mycobacterium
LTLMWALVFALIALLGLLAAQIPHT

SEQ ID NO: 1136394 - protein, 17 aa, Mycobacterium
LTMELIAIPLSFAVLVW

SEQ ID NO: 1136395 - protein, 17 aa, Mycobacterium
LTPLGLFGGFIDASGGG

SEQ ID NO: 1136396 - protein, 22 aa, Mycobacterium
LTVFAVITMIIGVGVYLSAQDK

SEQ ID NO: 1136397 - protein, 21 aa, Mycobacterium
LTVIVVVFSVLFLVAVAQHVG

SEQ ID NO: 1136398 - protein, 19 aa, Mycobacterium
LTVLLLATVAVFFTIQFRE

SEQ ID NO: 1136399 - protein, 19 aa, Mycobacterium
LTWAQLYRRTVNLAHELSE

SEQ ID NO: 1136400 - protein, 17 aa, Mycobacterium
LTWLALVVVLLIARPRD

SEQ ID NO: 1136401 - protein, 17 aa, Mycobacterium
LVAFGLLASGIAVTSIM

SEQ ID NO: 1136402 - protein, 17 aa, Mycobacterium
LVAGYALALVLVAWGFD

SEQ ID NO: 1136403 - protein, 30 aa, Mycobacterium
LVALVIGILGTLFALPRLGQPLLTALFGIT

SEQ ID NO: 1136404 - protein, 25 aa, Mycobacterium
LVEIPVLTLADWWPALKTHGLAGVV

SEQ ID NO: 1136405 - protein, 22 aa, Mycobacterium
LVGFLVVLAITALTGYFVAQEF

SEQ ID NO: 1136406 - protein, 25 aa, Mycobacterium
LVGIPLLALWVFFRRRHHQAVLPVT

SEQ ID NO: 1136407 - protein, 22 aa, Mycobacterium
LVGLALLVLDFRVAAAAATAVF

SEQ ID NO: 1136408 - protein, 24 aa, Mycobacterium
LVLIVRFTTWGSQFWRVTRGYFTG

SEQ ID NO: 1136409 - protein, 18 aa, Mycobacterium
LVMAAALSHIMWLLVRRR

SEQ ID NO: 1136410 - protein, 20 aa, Mycobacterium
LVPLAYLLSLAVRPAEDVLN

SEQ ID NO: 1136411 - protein, 26 aa, Mycobacterium
LVPPYGRPAPAPPPPPPSLAPPPPAD

SEQ ID NO: 1136412 - protein, 23 aa, Mycobacterium
LVRLTASWPRRRTLLLTLVCLTA

SEQ ID NO: 1136413 - protein, 20 aa, Mycobacterium
LVVAVPLLTAAAPRFVLGAI

SEQ ID NO: 1136414 - protein, 28 aa, Mycobacterium
LVVGGIVYFLIFWVSAFHRKKASDTELP

SEQ ID NO: 1136415 - protein, 17 aa, Mycobacterium
LVVMLRRAWTPGAFSLG

SEQ ID NO: 1136416 - protein, 18 aa, Mycobacterium
LVVQLFGLTASPISWAHH

SEQ ID NO: 1136417 - protein, 18 aa, Mycobacterium
LVVVFGEFRFASGNSYHA

SEQ ID NO: 1136418 - protein, 42 aa, Mycobacterium
LVYLAYGISILALPFVILVGLIIVRQWRLLGAFAAAGVIAIL

SEQ ID NO: 1136419 - protein, 23 aa, Mycobacterium
LWGRLPLYIVAIYPMMATVSFEI

SEQ ID NO: 1136420 - protein, 18 aa, Mycobacterium
LWPGVPPAPAPAPAPSGP

SEQ ID NO: 1136421 - protein, 18 aa, Mycobacterium
LYMKIPLIANAVVLWVGL

SEQ ID NO: 1136422 - protein, 20 aa, Mycobacterium
MAFLLRGLLLGRHLRVLLIV

SEQ ID NO: 1136423 - protein, 47 aa, Mycobacterium
MAGYILATQYWLLPSAGPLLLVLAVGLGALWLPWGAATYLLLREPNT

SEQ ID NO: 1136424 - protein, 27 aa, Mycobacterium
MAQGFGYLLAGLGPFLFGLLHDVTDGW

SEQ ID NO: 1136425 - protein, 24 aa, Mycobacterium
MDGWLAHVGVPLFVSHRRLSRRKT

SEQ ID NO: 1136426 - protein, 30 aa, Mycobacterium
MESIAIPFSFLVLVWVFGGLLAAAVPVGVG

SEQ ID NO: 1136427 - protein, 24 aa, Mycobacterium
METGLIYLPIAIGALLFSPLSGRL

SEQ ID NO: 1136428 - protein, 17 aa, Mycobacterium
MFPVLVYVYARLARSEE

SEQ ID NO: 1136429 - protein, 23 aa, Mycobacterium
MGALLEGLNYYVGQLNPKLPTLQ

SEQ ID NO: 1136430 - protein, 18 aa, Mycobacterium
MGALTSWLGFQTHQAHQA

SEQ ID NO: 1136431 - protein, 17 aa, Mycobacterium
MGLLARVELPLAVPYIL

SEQ ID NO: 1136432 - protein, 20 aa, Mycobacterium
MGLLIWMVLTHGLAIEEGMG

SEQ ID NO: 1136433 - protein, 23 aa, Mycobacterium
MGNYGFPFLGHTLSALAEPLDFA

SEQ ID NO: 1136434 - protein, 28 aa, Mycobacterium
MHLLFNMWALYVVGPPLEMWLGRLRFGA

SEQ ID NO: 1136435 - protein, 17 aa, Mycobacterium
MITLLLPLPPVPVEGRV

SEQ ID NO: 1136436 - protein, 17 aa, Mycobacterium
MLGLVALLVGVVGLLTP

SEQ ID NO: 1136437 - protein, 19 aa, Mycobacterium
MLIAAAVLTAFFVLELVTA

SEQ ID NO: 1136438 - protein, 23 aa, Mycobacterium
MLLGGSWLTWILAAVSSALIDRV

SEQ ID NO: 1136439 - protein, 22 aa, Mycobacterium
MLLSLYVVPSLKYPASPPALSL

SEQ ID NO: 1136440 - protein, 17 aa, Mycobacterium
MLRIGVFHWFRHGVLGA

SEQ ID NO: 1136441 - protein, 32 aa, Mycobacterium
MMLAHALAAVALGLLICLVGHLYRVCVSVLCW

SEQ ID NO: 1136442 - protein, 17 aa, Mycobacterium
MPKLTRRSRVLIGVALA

SEQ ID NO: 1136443 - protein, 30 aa, Mycobacterium
MRIWDSAIPALWFLAAPFLTVAALTVSFTA

SEQ ID NO: 1136444 - protein, 33 aa, Mycobacterium
MRMTRLLALLATFLTAGVLLAPVAAAAPPFRLP

SEQ ID NO: 1136445 - protein, 20 aa, Mycobacterium
MRPMLLTALWVIVIAAVFVP

SEQ ID NO: 1136446 - protein, 33 aa, Mycobacterium
MSFSGFEHPWFFLFLIVVLALAGLYVIVALARQ

SEQ ID NO: 1136447 - protein, 30 aa, Mycobacterium
MSTSAYDIALFYRYAWRNPTFTEIVATRTY

SEQ ID NO: 1136448 - protein, 31 aa, Mycobacterium; identical to SEQ ID NO: 363650

SEQ ID NO: 1136449 - protein, 24 aa, Mycobacterium
MTGNVIFLGFWFVPHSGVDLTAAL

SEQ ID NO: 1136450 - protein, 17 aa, Mycobacterium
MVDPPLAFPEVTRASVR

SEQ ID NO: 1136451 - protein, 28 aa, Mycobacterium
MVELIWQWTPFMMLLILAGLQSMPRDIL

SEQ ID NO: 1136452 - protein, 34 aa, Mycobacterium
MVGALADWFAVTALFKHPLGIPIPHTAIIKRKKD

SEQ ID NO: 1136453 - protein, 24 aa, Mycobacterium
MVSELDRFETLLSDLLEISRHDAG

SEQ ID NO: 1136454 - protein, 22 aa, Mycobacterium
MWARFPLPVIPAPGDPTPSAQP

SEQ ID NO: 1136455 - protein, 17 aa, Mycobacterium
MWEAAWIGLPVLAIILI

SEQ ID NO: 1136456 - protein, 41 aa, Mycobacterium
NAYPIALYTALPLQAISVLLTPISRLLVLIGNALTPGRGFR

SEQ ID NO: 1136457 - protein, 21 aa, Mycobacterium
NDTPCHRLTTTPSLSVLQCGD

SEQ ID NO: 1136458 - protein, 17 aa, Mycobacterium
NEQLLLRILGLTLIVAA

SEQ ID NO: 1136459 - protein, 31 aa, Mycobacterium
NGFGDTWPGDLGERPALWIPASGVSAARLEA

SEQ ID NO: 1136460 - protein, 22 aa, Mycobacterium
NGILMLAFAAVAFIVAFRAEVT

SEQ ID NO: 1136461 - protein, 23 aa, Mycobacterium
NGIPRLPVVAALLVEPLVAAVIG

SEQ ID NO: 1136462 - protein, 23 aa, Mycobacterium
NGRMPLPNRLLATKPFVSLGAMA

SEQ ID NO: 1136463 - protein, 18 aa, Mycobacterium
NIAMIALHLPAPAHHHGG

SEQ ID NO: 1136464 - protein, 34 aa, Mycobacterium
NKPRTPPYKLAGLILLVVFAVIATLVAFQFRGDF

SEQ ID NO: 1136465 - protein, 20 aa, Mycobacterium
NLGYALQWPMFAGFCVYAYY

SEQ ID NO: 1136466 - protein, 26 aa, Mycobacterium
NLLILMDLILVLVLGLVLYAISARDP

SEQ ID NO: 1136467 - protein, 44 aa, Mycobacterium
NLREYYNGDIRFIIGFTLLVVFLVLCLLLRAVVAPIYLVASVVL

SEQ ID NO: 1136468 - protein, 18 aa, Mycobacterium
NLSPYQVLTVASLVQRES

SEQ ID NO: 1136469 - protein, 19 aa, Mycobacterium
NLSSHFPYAAQIWKSMWAE

SEQ ID NO: 1136470 - protein, 23 aa, Mycobacterium
NMSIFALFVLVTLFIVIKASKKN

SEQ ID NO: 1136471 - protein, 19 aa, Mycobacterium
NPGFSFTGFARAFKNNLFG

SEQ ID NO: 1136472 - protein, 19 aa, Mycobacterium
NPIQSIFLTALVLAFGFAV

SEQ ID NO: 1136473 - protein, 32 aa, Mycobacterium
NPQGLWSRLSFLRYIPLLDVSFGPQLPTDIGV

SEQ ID NO: 1136474 - protein, 25 aa, Mycobacterium
NPSKIWLLVVLLTGIGWVGYIGVRA

SEQ ID NO: 1136475 - protein, 24 aa, Mycobacterium
NQGIQFAVFLLLGGSAVVSSVYYL

SEQ ID NO: 1136476 - protein, 26 aa, Mycobacterium
NRLTVTALLLLTFATGLIDAVSVLVL

SEQ ID NO: 1136477 - protein, 17 aa, Mycobacterium
NSTSQFPAPWAALPVLS

SEQ ID NO: 1136478 - protein, 21 aa, Mycobacterium
NTPAYVLNPFAMANSLATYFD

SEQ ID NO: 1136479 - protein, 18 aa, Mycobacterium
NVDSFWPRRVVDSALRNY

SEQ ID NO: 1136480 - protein, 26 aa, Mycobacterium
NVGIFTVAMLLVAAMLVVVFGEFRFA

SEQ ID NO: 1136481 - protein, 19 aa, Mycobacterium
NVPDLLLPAYGETWLMVGI

SEQ ID NO: 1136482 - protein, 31 aa, Mycobacterium
NVTIVTIFLIIGMLLLVYRSVSSVFMPLATV

SEQ ID NO: 1136483 - protein, 17 aa, Mycobacterium
NVWGYFGFLISIAFLVS

SEQ ID NO: 1136484 - protein, 17 aa, Mycobacterium
NYFPVTKAVPEPPRVRH

SEQ ID NO: 1136485 - protein, 32 aa, Mycobacterium
PAAALFRRVFLINGLIFTLGTLVLAVSPASVS

SEQ ID NO: 1136486 - protein, 17 aa, Mycobacterium
PAAAPPAPPQRTEQRAE

SEQ ID NO: 1136487 - protein, 20 aa, Mycobacterium
PAAGPWDPLLPKVASAGAPG

SEQ ID NO: 1136488 - protein, 20 aa, Mycobacterium
PAGAPLPEPSSAPPPPVVTV

SEQ ID NO: 1136489 - protein, 22 aa, Mycobacterium
PAGYAFTLWGLITVLSAVTAAC

SEQ ID NO: 1136490 - protein, 22 aa, Mycobacterium
PALDLDALLGGLRPVLKGLDGA

SEQ ID NO: 1136491 - protein, 23 aa, Mycobacterium
PALWAAGFVLLGAWMPFNNGLRP

SEQ ID NO: 1136492 - protein, 17 aa, Mycobacterium
PAPAPAPGVPLPPQPVA

SEQ ID NO: 1136493 - protein, 28 aa, Mycobacterium
PAPLAEVLLDTYFQPGKLPDSLSDYLRG

SEQ ID NO: 1136494 - protein, 17 aa, Mycobacterium
PAPQRHNGIRLAVAFSV

SEQ ID NO: 1136495 - protein, 45 aa, Mycobacterium
PAPVPVLPAPVFRPPVVLPPPVIRLPRPQLPPIFRDDDEPERPSW

SEQ ID NO: 1136496 - protein, 17 aa, Mycobacterium
PARLPVASLIPDIVRLA

SEQ ID NO: 1136497 - protein, 17 aa, Mycobacterium
PATAHLPGRLLVVAVLA

SEQ ID NO: 1136498 - protein, 23 aa, Mycobacterium
PATGDLPIVILPGGPSGGGGAVA

SEQ ID NO: 1136499 - protein, 18 aa, Mycobacterium
PAYHALTYGWLVSGLARA

SEQ ID NO: 1136500 - protein, 31 aa, Mycobacterium
PCLLRIMGPWFWWPTLVRTRPLRQVSDFGVK

SEQ ID NO: 1136501 - protein, 35 aa, Mycobacterium
PDFFAVSPRRPRRWGLPLIATVAALLLAAALTVST

SEQ ID NO: 1136502 - protein, 26 aa, Mycobacterium
PDFPLPFTYPPFAALLFYPLHLLPFG

SEQ ID NO: 1136503 - protein, 39 aa, Mycobacterium
PDPVLMRRHLMLYMALMGITWLLDVPARIGNRLPDADVH

SEQ ID NO: 1136504 - protein, 25 aa, Mycobacterium
PDQSRLPLAAAVATAVLVLLAVLVA

SEQ ID NO: 1136505 - protein, 25 aa, Mycobacterium
PDRGPITWVVVIGAGLTLVLGIAAL

SEQ ID NO: 1136506 - protein, 27 aa, Mycobacterium
PEGAADRWNWVLDGMVEIGALSEADRA

SEQ ID NO: 1136507 - protein, 25 aa, Mycobacterium
PETPTTVTPPPPPPSPTVTALPPPP

SEQ ID NO: 1136508 - protein, 27 aa, Mycobacterium
PEVANPALWILAGAVAGLIAIAAAMLR

SEQ ID NO: 1136509 - protein, 17 aa, Mycobacterium
PFLLGLSYALIAVGLTA

SEQ ID NO: 1136510 - protein, 40 aa, Mycobacterium
PFRVLFRTWVVLPALAAFAAVCWWVFFEKGLASAAHDAFE

SEQ ID NO: 1136511 - protein, 22 aa, Mycobacterium
PFTPVLGFPMLALVIAAQALRW

SEQ ID NO: 1136512 - protein, 21 aa, Mycobacterium
PGALSAIVLWSVTSVGVVLAA

SEQ ID NO: 1136513 - protein, 20 aa, Mycobacterium
PGGAPYGAPLYGPGGTPLWP

SEQ ID NO: 1136514 - protein, 52 aa, Mycobacterium
PGGHPHWRERVNWRWVRRGLIAAAVVLIVLPLVTFGMAYMIVDVPNPGDIRT

SEQ ID NO: 1136515 - protein, 17 aa, Mycobacterium
PGIARNLSILPFNPFAF

SEQ ID NO: 1136516 - protein, 21 aa, Mycobacterium
PGNTESGWKLGFYAASRASQL

SEQ ID NO: 1136517 - protein, 33 aa, Mycobacterium
PGNVNMVRLWWDKPWPMRIAAIARLPLQIPMIT

SEQ ID NO: 1136518 - protein, 29 aa, Mycobacterium
PGPAPHAPFPLPVPPNDPGVPPPLPYYAP

SEQ ID NO: 1136519 - protein, 30 aa, Mycobacterium
PGSPALVVMVMPAVLRSLGFLATPAPPPPG

SEQ ID NO: 1136520 - protein, 17 aa, Mycobacterium
PIAIPHPRFGDYHAGTG

SEQ ID NO: 1136521 - protein, 19 aa, Mycobacterium
PIPLLMVAATWYLAITSVL

SEQ ID NO: 1136522 - protein, 19 aa, Mycobacterium
PLIVLLAVQAPLLSHGALL

SEQ ID NO: 1136523 - protein, 26 aa, Mycobacterium
PLPLALRNDLPVPIRVRLAVDAPPGM

SEQ ID NO: 1136524 - protein, 39 aa, Mycobacterium
PLRTAFLVTVLVVVLILTLVWMQFRGAFTPEVKLRMIAE

SEQ ID NO: 1136525 - protein, 17 aa, Mycobacterium
PLRVVYYYEGAPRVSII

SEQ ID NO: 1136526 - protein, 19 aa, Mycobacterium
PMIFVLFCVVLVSAWSNAV

SEQ ID NO: 1136527 - protein, 17 aa, Mycobacterium
PMPPKRALEVIADACQA

SEQ ID NO: 1136528 - protein, 23 aa, Mycobacterium
PMSAAFLIWYTTYVLLSTFATDF

SEQ ID NO: 1136529 - protein, 31 aa, Mycobacterium
PMTSALNVIFWFTLFVWVLGRPDAIGPLFPP

SEQ ID NO: 1136530 - protein, 31 aa, Mycobacterium
PPAFMTVLGVLLLPFVLISFNTVLDTLMTAG

SEQ ID NO: 1136531 - protein, 24 aa, Mycobacterium
PPDELNLILVDFKGGATFLGLERT

SEQ ID NO: 1136532 - protein, 43 aa, Mycobacterium
PPEEPVPWYRTPAAMFAAGVLLTLVLVLLVWAVFGSSSDEADT

SEQ ID NO: 1136533 - protein, 19 aa, Mycobacterium
PPLEMWLGRLRFGALYALS

SEQ ID NO: 1136534 - protein, 21 aa, Mycobacterium
PPPPRPVVPPPPPPAPRVPRE

SEQ ID NO: 1136535 - protein, 25 aa, Mycobacterium
PPPPSPTVTALPPPPPQPGTTCRAA

SEQ ID NO: 1136536 - protein, 20 aa, Mycobacterium
PPQPIPVPDLPGPSLRSRRL

SEQ ID NO: 1136537 - protein, 24 aa, Mycobacterium
PPSWASWLRIVIGAALIVFGLVRF

SEQ ID NO: 1136538 - protein, 18 aa, Mycobacterium
PPVWPFIVGACVAVGAAA

SEQ ID NO: 1136539 - protein, 20 aa, Mycobacterium
PPVYVPPAPAYVPPPAPVAP

SEQ ID NO: 1136540 - protein, 21 aa, Mycobacterium
PQIRVVIAGQLKQGKSLLLNS

SEQ ID NO: 1136541 - protein, 27 aa, Mycobacterium
PQPAPQPFYLPPPPPPPRPVVPPPPPP

SEQ ID NO: 1136542 - protein, 23 aa, Mycobacterium
PQPLDLVFAVHIAMAVLAGVAVF

SEQ ID NO: 1136543 - protein, 36 aa, Mycobacterium
PQPVAQWRTLPDAPTARLMMAWTVLGDTVWVAGGMS

SEQ ID NO: 1136544 - protein, 25 aa, Mycobacterium
PQRRNLIFVAVLLGMLLAALDQTIV

SEQ ID NO: 1136545 - protein, 21 aa, Mycobacterium
PQVGILLRNRPPQVAAVLGVL

SEQ ID NO: 1136546 - protein, 21 aa, Mycobacterium
PRLGVRWWRFGAGVLLGLACA

SEQ ID NO: 1136547 - protein, 22 aa, Mycobacterium
PRQLNHGLLAYSLSEGNVSLLG

SEQ ID NO: 1136548 - protein, 17 aa, Mycobacterium
PRRGIAIVNAPLVHIGG

SEQ ID NO: 1136549 - protein, 33 aa, Mycobacterium
PRRLALRAWVLCWLTLVWVLLWGTLSAANVVSG

SEQ ID NO: 1136550 - protein, 28 aa, Mycobacterium
PRTYRSRFLFFGTGYYNYDEPYRPEFPG

SEQ ID NO: 1136551 - protein, 24 aa, Mycobacterium
PRWPLLVRLFDRGPLVRPTDRFEA

SEQ ID NO: 1136552 - protein, 23 aa, Mycobacterium
PSDLLWSFLQAIVMSIAVMLVHT

SEQ ID NO: 1136553 - protein, 22 aa, Mycobacterium
PSLFCMIRNWHDAEPAFTEFNG

SEQ ID NO: 1136554 - protein, 37 aa, Mycobacterium
PSLGPFALPTVLLLGGLALGLLLRIVVRPFVAVGAAR

SEQ ID NO: 1136555 - protein, 39 aa, Mycobacterium
PSPDPLYVVAGVGVGWFWILFIAVPAVAIVLAALWSMLL

SEQ ID NO: 1136556 - protein, 30 aa, Mycobacterium
PTAIPYRVKQLPPPVYVPPPDRGPITWVVV

SEQ ID NO: 1136557 - protein, 32 aa, Mycobacterium
PTGGHPLARLMPFAMLVAAGGMMLLYFSSGAG

SEQ ID NO: 1136558 - protein, 39 aa, Mycobacterium
PTHWQEWMPAGLFFASFALFQLLWARLVLIRTTTPVLAA

SEQ ID NO: 1136559 - protein, 18 aa, Mycobacterium
PVAAAAPPFRLPGYVTDQ

SEQ ID NO: 1136560 - protein, 17 aa, Mycobacterium
PVAVLAALGATLCGGWP

SEQ ID NO: 1136561 - protein, 24 aa, Mycobacterium
PVDLEPLLQVPIGLQPSGAPLTID

SEQ ID NO: 1136562 - protein, 19 aa, Mycobacterium
PVDPALAPVPPPLPAPAPD

SEQ ID NO: 1136563 - protein, 19 aa, Mycobacterium
PVDQAAMLPALVLGDTATV

SEQ ID NO: 1136564 - protein, 25 aa, Mycobacterium
PVLAYLLWVVWCRRTWRPVRLLGGL

SEQ ID NO: 1136565 - protein, 20 aa, Mycobacterium
PVSIFLPTYLVLSAGVCTAF

SEQ ID NO: 1136566 - protein, 27 aa, Mycobacterium
PVVLAGALVIRLARTWSLAVSMVVLVL

SEQ ID NO: 1136567 - protein, 19 aa, Mycobacterium
PVWELLVVFAVFGIGFSMV

SEQ ID NO: 1136568 - protein, 26 aa, Mycobacterium
PYQVPWLLVVLVGAGISFLLAGRDIR

SEQ ID NO: 1136569 - protein, 24 aa, Mycobacterium
QADAAPRRPGGPWWPLGEIDRPRQ

SEQ ID NO: 1136570 - protein, 20 aa, Mycobacterium
QAFTHARRARRIMLQNVGLS

SEQ ID NO: 1136571 - protein, 27 aa, Mycobacterium
QALGAKIPRGVLLYGPPGTGKTLLARA

SEQ ID NO: 1136572 - protein, 23 aa, Mycobacterium
QDARLNMVMKKLTGWAAIIAVPT

SEQ ID NO: 1136573 - protein, 17 aa, Mycobacterium
QGALTFLSPTAELFVVM

SEQ ID NO: 1136574 - protein, 21 aa, Mycobacterium
QGHFFVHSLIVAGLVAAICGF

SEQ ID NO: 1136575 - protein, 22 aa, Mycobacterium
QGKPFRLMVMLMLITAFASPVL

SEQ ID NO: 1136576 - protein, 26 aa, Mycobacterium
QGVLPTLVILLDFLQQELPALFVPGS

SEQ ID NO: 1136577 - protein, 18 aa, Mycobacterium
QHFNFGRGEILLATRFKP

SEQ ID NO: 1136578 - protein, 18 aa, Mycobacterium
QHLILPTVTLALAAIAGF

SEQ ID NO: 1136579 - protein, 24 aa, Mycobacterium
QIANLEDFFRPLKNYFYWEPHCFN

SEQ ID NO: 1136580 - protein, 18 aa, Mycobacterium
QKAAGPQVIPPRGDAPRP

SEQ ID NO: 1136581 - protein, 31 aa, Mycobacterium
QKRWRPAVALMLALWLVAVGFEWTQPGAGHP

SEQ ID NO: 1136582 - protein, 20 aa, Mycobacterium
QLARNTLIDRKADAGSGPAG

SEQ ID NO: 1136583 - protein, 19 aa, Mycobacterium
QLIIFTIASIVGVSVMIFA

SEQ ID NO: 1136584 - protein, 39 aa, Mycobacterium
QLIIFTVLTVIALVALGWYYLRVPSLMGIGQYKLYAELP

SEQ ID NO: 1136585 - protein, 22 aa, Mycobacterium
QLLLLPVTWYVAVGSHQWFYGI

SEQ ID NO: 1136586 - protein, 20 aa, Mycobacterium
QLLLRILGLTLIVAALAEFI

SEQ ID NO: 1136587 - protein, 37 aa, Mycobacterium
QLSGPLTLFGLTLPRALFWIVIAYVVVVTYVAVVVGR

SEQ ID NO: 1136588 - protein, 19 aa, Mycobacterium
QPLLRHFGNAVDRGLRVIV

SEQ ID NO: 1136589 - protein, 20 aa, Mycobacterium
QPTALASTAWWPVAGIAVGL

SEQ ID NO: 1136590 - protein, 22 aa, Mycobacterium
QQLRTRSWWSGPEIYVVIDDYD

SEQ ID NO: 1136591 - protein, 23 aa, Mycobacterium
QQRIAFARILLARPTAVFLDEST

SEQ ID NO: 1136592 - protein, 26 aa, Mycobacterium
QQSTAPWYLSLAMLAALVLVGAVGGR

SEQ ID NO: 1136593 - protein, 25 aa, Mycobacterium
QRFMLRWRTWLTDRLTGDWLDGKAY

SEQ ID NO: 1136594 - protein, 26 aa, Mycobacterium
QRRERTRFVAWLNRRLAPLDPSPDQP

SEQ ID NO: 1136595 - protein, 33 aa, Mycobacterium
QRREVPKHVVWLWAVAIVLMVLAGVLITMVVRR

SEQ ID NO: 1136596 - protein, 30 aa, Mycobacterium
QRRRALVGALLAFWIVIVGAEWALPGTEPP

SEQ ID NO: 1136597 - protein, 22 aa, Mycobacterium
QRRRFSLAVVGSVAAAVLCLGG

SEQ ID NO: 1136598 - protein, 21 aa, Mycobacterium
QRRRLLLARALISPFPVVLLD

SEQ ID NO: 1136599 - protein, 27 aa, Mycobacterium
QRTRLVAWVLLLLMLPMVVGCVRVRAS

SEQ ID NO: 1136600 - protein, 29 aa, Mycobacterium
QSAIRNLFTLLPIIPFIGGLLGVIAIVVI

SEQ ID NO: 1136601 - protein, 26 aa, Mycobacterium
QSHGWQPWIWVVIVAGVAVMAGFVYW

SEQ ID NO: 1136602 - protein, 26 aa, Mycobacterium
QSLLAYVMMGWLPEVFIDSGVSKSTA

SEQ ID NO: 1136603 - protein, 29 aa, Mycobacterium
QSPRWARLLQFLPVLAIPAVVLFFSVFEY

SEQ ID NO: 1136604 - protein, 20 aa, Mycobacterium
QSWFVARVSLVPTLMLAIPF

SEQ ID NO: 1136605 - protein, 24 aa, Mycobacterium
QTEVFPLTMFAVAGMLLFPASDDL

SEQ ID NO: 1136606 - protein, 18 aa, Mycobacterium
QTGIAFITIMAPDGVRFT

SEQ ID NO: 1136607 - protein, 34 aa, Mycobacterium
QTGVVVLVVVVLGLLVFGVGVAIYFAKAGPRDGA

SEQ ID NO: 1136608 - protein, 30 aa, Mycobacterium
QTTYISYRRDGLPLLQPLRTYGGEAGNRFA

SEQ ID NO: 1136609 - protein, 21 aa, Mycobacterium
QVSGWRFLIRRISNGVALRDT

SEQ ID NO: 1136610 - protein, 26 aa, Mycobacterium
QVVLTMIRLVMYIAPIGVFCLLAALA

SEQ ID NO: 1136611 - protein, 29 aa, Mycobacterium
RAGESFIDTLWFPGLLLIALGVIGLAAIV

SEQ ID NO: 1136612 - protein, 17 aa, Mycobacterium
RAITWTILNNKTLLDNI

SEQ ID NO: 1136613 - protein, 28 aa, Mycobacterium
RAKRRPVWIKGFGEHVPFKTPTYARDLL

SEQ ID NO: 1136614 - protein, 37 aa, Mycobacterium
RALSIGVMLGVVLLGGAFILSILRPAGLAGNRPVLAD

SEQ ID NO: 1136615 - protein, 25 aa, Mycobacterium
RAMPDLLFAVLFVRALGIGVLPGIL

SEQ ID NO: 1136616 - protein, 26 aa, Mycobacterium
RAQRLCRPVFWYLAAWAAGLLVVRLL

SEQ ID NO: 1136617 - protein, 23 aa, Mycobacterium
RASPLARALATCAAVGLAAALFT

SEQ ID NO: 1136618 - protein, 36 aa, Mycobacterium
RASSDLWRLLPYLMPYRVRWIAMFVVAIASLGATIS

SEQ ID NO: 1136619 - protein, 23 aa, Mycobacterium
RAVLTGALILITGLAGCFVFSLI

SEQ ID NO: 1136620 - protein, 29 aa, Mycobacterium
RAVRPVILLPLVLPPVVGGIALLYAFGRL

SEQ ID NO: 1136621 - protein, 23 aa, Mycobacterium
RAVRRFRPHLWRGPFVHEGAGQR

SEQ ID NO: 1136622 - protein, 33 aa, Mycobacterium
RCIDADTRLYLPMPFFWVGGFGSGVLSALVAGA

SEQ ID NO: 1136623 - protein, 39 aa, Mycobacterium; identical to SEQ ID NO: 367095

SEQ ID NO: 1136624 - protein, 19 aa, Mycobacterium
RDGGWLLAGDLPLDEAERT

SEQ ID NO: 1136625 - protein, 17 aa, Mycobacterium
RDRTSFIIAHRLSTIRD

SEQ ID NO: 1136626 - protein, 35 aa, Mycobacterium
REGGALINEYPGDPWKWWAVLSSAVGVAVAIAAVV

SEQ ID NO: 1136627 - protein, 42 aa, Mycobacterium; identical to SEQ ID NO: 367243

SEQ ID NO: 1136628 - protein, 17 aa, Mycobacterium
RFGARRWLARIAVSWGL

SEQ ID NO: 1136629 - protein, 25 aa, Mycobacterium
RFGETLFGLLDLRGRIFNETGNQIK

SEQ ID NO: 1136630 - protein, 40 aa, Mycobacterium
RFGRKPVLLVGWLLAIPVPLLLIWAPSWTWVIVANVLLGI

SEQ ID NO: 1136631 - protein, 31 aa, Mycobacterium; identical to SEQ ID NO: 367284

SEQ ID NO: 1136632 - protein, 20 aa, Mycobacterium
RFWKTFAHHYLRMIYDILAT

SEQ ID NO: 1136633 - protein, 19 aa, Mycobacterium
RGRKRLLWAVAVAVVVATL

SEQ ID NO: 1136634 - protein, 34 aa, Mycobacterium
RGRRKRRMAGALSLALLIVVVVGAVFLGSKLWHN

SEQ ID NO: 1136635 - protein, 30 aa, Mycobacterium
RGRRMLFVLRDWLPFALVLLAYDLSRGAAT

SEQ ID NO: 1136636 - protein, 29 aa, Mycobacterium
RGRVLARWQPAWLRYSPLSFTGLAMIAAA

SEQ ID NO: 1136637 - protein, 24 aa, Mycobacterium
RGRYRGRLWISMDFVDGTDVGRLL

SEQ ID NO: 1136638 - protein, 23 aa, Mycobacterium
RGVGWFLILAFAGAWIPWFGVHL

SEQ ID NO: 1136639 - protein, 30 aa, Mycobacterium
RHDVDFKVWVPLLAIALDVVVLVPFVILTA

SEQ ID NO: 1136640 - protein, 27 aa, Mycobacterium
RHFPISQSIPQYILVQSPRDLRTPQAL

SEQ ID NO: 1136641 - protein, 19 aa, Mycobacterium
RHHFEGFIVFAIALGITSG

SEQ ID NO: 1136642 - protein, 20 aa, Mycobacterium
RHRWRQIPTRTRMGVVVAVV

SEQ ID NO: 1136643 - protein, 19 aa, Mycobacterium
RIADPAVAALLIAKTTLAA

SEQ ID NO: 1136644 - protein, 27 aa, Mycobacterium
RIALKLVASTFFLLAGYVTIEGIRSLI

SEQ ID NO: 1136645 - protein, 23 aa, Mycobacterium
RIARPLVPAIMALAAAIAAVGAV

SEQ ID NO: 1136646 - protein, 25 aa, Mycobacterium
RILFDWRFDLILGSAAIILALVYLA

SEQ ID NO: 1136647 - protein, 23 aa, Mycobacterium
RIRWSTRIAVILLAVAIVAAVVT

SEQ ID NO: 1136648 - protein, 28 aa, Mycobacterium
RIVQPFGEYLPWRGFFSKLSPYAERAGY

SEQ ID NO: 1136649 - protein, 24 aa, Mycobacterium
RIVRRSNALLGYAYGRRLEYSEVM

SEQ ID NO: 1136650 - protein, 32 aa, Mycobacterium
RLADKAAGWLFWFALITAAITAAAWTIVGNPD

SEQ ID NO: 1136651 - protein, 20 aa, Mycobacterium
RLDDARFLLPVLGVPSEPGA

SEQ ID NO: 1136652 - protein, 18 aa, Mycobacterium
RLDLLLNGLADLAPLLGT

SEQ ID NO: 1136653 - protein, 17 aa, Mycobacterium
RLKGGRLLGPMERLLIL

SEQ ID NO: 1136654 - protein, 21 aa, Mycobacterium
RLKGRLLFMPNVMVTSVPWQL

SEQ ID NO: 1136655 - protein, 21 aa, Mycobacterium
RLMVFAVVAVLAWVNALAIFG

SEQ ID NO: 1136656 - protein, 21 aa, Mycobacterium
RLPAPNRLLATRPFVTLGSMA

SEQ ID NO: 1136657 - protein, 20 aa, Mycobacterium
RLPRWYWSGLAVGTLLGTVF

SEQ ID NO: 1136658 - protein, 19 aa, Mycobacterium
RLRPIRWIASAAAAVLALV

SEQ ID NO: 1136659 - protein, 33 aa, Mycobacterium
RLSRRTLATIKTNLFWAFAYNVAAIPVAALGML

SEQ ID NO: 1136660 - protein, 32 aa, Mycobacterium
RLTLDLLRPRLGRLLLAIGLGVLSLGSALALA

SEQ ID NO: 1136661 - protein, 21 aa, Mycobacterium
RLTPWVAIVFTTLIAFGLIFY

SEQ ID NO: 1136662 - protein, 20 aa, Mycobacterium
RLVRRLTPQRTLTASVIGLG

SEQ ID NO: 1136663 - protein, 17 aa, Mycobacterium
RLWWLSPTAVTVTVAAI

SEQ ID NO: 1136664 - protein, 21 aa, Mycobacterium
RMWALQRSFMYRDMGTIGVDV

SEQ ID NO: 1136665 - protein, 18 aa, Mycobacterium
RNGVLLVLLVIVPAAFVL

SEQ ID NO: 1136666 - protein, 26 aa, Mycobacterium
RNPVNLIMLVLVPLVFVLVAAGSIAD

SEQ ID NO: 1136667 - protein, 17 aa, Mycobacterium
RPAAFRAGIGRPTRRDL

SEQ ID NO: 1136668 - protein, 17 aa, Mycobacterium
RPFGLQGSAILVPVLAV

SEQ ID NO: 1136669 - protein, 25 aa, Mycobacterium
RPGEEKLVFSRFWRSDPSRVRRSGG

SEQ ID NO: 1136670 - protein, 32 aa, Mycobacterium
RPNLFVTYWAFRAMIGLLLVPVAFALVTVWLT

SEQ ID NO: 1136671 - protein, 17 aa, Mycobacterium
RPPLRERLLIKLSTIEL

SEQ ID NO: 1136672 - protein, 36 aa, Mycobacterium
RPTAAPFMIALVIIVLVVIGIWLVNLFEGDEPTPEQ

SEQ ID NO: 1136673 - protein, 23 aa, Mycobacterium
RPTDRFEALVVTLAIVVVLLAVP

SEQ ID NO: 1136674 - protein, 27 aa, Mycobacterium
RPTVYQAQLLPTSTLLLGGRGVGLAAV

SEQ ID NO: 1136675 - protein, 17 aa, Mycobacterium
RQKWFTVGYQTGDPTKC

SEQ ID NO: 1136676 - protein, 18 aa, Mycobacterium
RQPALDAAVGAALFAAYS

SEQ ID NO: 1136677 - protein, 17 aa, Mycobacterium
RQPDHFDWITGYLAARG

SEQ ID NO: 1136678 - protein, 24 aa, Mycobacterium
RQTVAPWFRSIWILQPRGDLMAAA

SEQ ID NO: 1136679 - protein, 17 aa, Mycobacterium
RRIAHVLDLCPEGNAVE

SEQ ID NO: 1136680 - protein, 37 aa, Mycobacterium
RRIMVQNIAFSLAIIAVLIPLAAFGVLGLATVVFIHE

SEQ ID NO: 1136681 - protein, 18 aa, Mycobacterium
RRIWPVRLMQIQVSVIYV

SEQ ID NO: 1136682 - protein, 25 aa, Mycobacterium
RRKLTPTHPLGCKRLVFATDYLQAL

SEQ ID NO: 1136683 - protein, 23 aa, Mycobacterium
RRLADLGLFVFRSYGSTEHPSIT

SEQ ID NO: 1136684 - protein, 20 aa, Mycobacterium
RRLEGLIAPGSWNIDPSATP

SEQ ID NO: 1136685 - protein, 22 aa, Mycobacterium
RRLIRRLFPALVVVLTACAGLT

SEQ ID NO: 1136686 - protein, 23 aa, Mycobacterium
RRQRFFLSLYVPVVMRVLCQAII

SEQ ID NO: 1136687 - protein, 21 aa, Mycobacterium
RRRPRFLDRLRAESGYIAITI

SEQ ID NO: 1136688 - protein, 20 aa, Mycobacterium
RRWWHSTARRAAVVATIVAV

SEQ ID NO: 1136689 - protein, 29 aa, Mycobacterium
RSDIYSLGCTLFRLLTGRQPFSQADGVVG

SEQ ID NO: 1136690 - protein, 29 aa, Mycobacterium
RSFTTAAIWLTVATLVVAAIIGGLAWSSR

SEQ ID NO: 1136691 - protein, 22 aa, Mycobacterium
RSMDGAFTATLAYSAPEVITGE

SEQ ID NO: 1136692 - protein, 40 aa, Mycobacterium
RSNTLYRAGLIGGLALLPLLALLVWLPARRRRDDEPGRPW

SEQ ID NO: 1136693 - protein, 17 aa, Mycobacterium
RSPTWILPKPDRPYTER

SEQ ID NO: 1136694 - protein, 29 aa, Mycobacterium
RSRKPGMMLLIGLAITVAFFASWGASLGL

SEQ ID NO: 1136695 - protein, 35 aa, Mycobacterium
RSSSFVFRHRAGTAVMLVLLLVAAAQLFNLQVPRA

SEQ ID NO: 1136696 - protein, 20 aa, Mycobacterium
RTILVTIAASLLAGLLAHVA

SEQ ID NO: 1136697 - protein, 20 aa, Mycobacterium
RTLALDGLGRYRVIALPARG

SEQ ID NO: 1136698 - protein, 18 aa, Mycobacterium
RTLLLGLVVIIAGAGLAG

SEQ ID NO: 1136699 - protein, 26 aa, Mycobacterium
RTLTVPAIATLLREASWWPTKPNTST

SEQ ID NO: 1136700 - protein, 27 aa, Mycobacterium
RTRRGLRSLLSLVPPKASVLRHGTETT

SEQ ID NO: 1136701 - protein, 18 aa, Mycobacterium
RTWRPVRLLGGLAAMAAV

SEQ ID NO: 1136702 - protein, 18 aa, Mycobacterium
RVAAIVHSIVLLGVVYLL

SEQ ID NO: 1136703 - protein, 23 aa, Mycobacterium
RVASPLVPAVMVAAAIIAVAGSV

SEQ ID NO: 1136704 - protein, 25 aa, Mycobacterium
RVCVSVLCWLTLTLVHRGRPSAPRR

SEQ ID NO: 1136705 - protein, 25 aa, Mycobacterium
RVHPLWWTAALFGTVIGLVVVCSLT

SEQ ID NO: 1136706 - protein, 44 aa, Mycobacterium
RVLAGIIVTFFVTALALAILARSALVRPLSALAASCRRITEGHF

SEQ ID NO: 1136707 - protein, 34 aa, Mycobacterium
RVLQDGRDMFWSLAPLVVACVVLAGLLGMCSFQG

SEQ ID NO: 1136708 - protein, 18 aa, Mycobacterium
RVMGPGLLLLFVVGDILG

SEQ ID NO: 1136709 - protein, 17 aa, Mycobacterium
RVVIIRSSFAELLALVC

SEQ ID NO: 1136710 - protein, 17 aa, Mycobacterium
RVVVANRSFLLFAAAMI

SEQ ID NO: 1136711 - protein, 17 aa, Mycobacterium
RWDSEHLGLLVLVPLIA

SEQ ID NO: 1136712 - protein, 19 aa, Mycobacterium
RWRSQVPTIAAVTLAAVVV

SEQ ID NO: 1136713 - protein, 20 aa, Mycobacterium
RWRWFYRHLFDLAIVVLPLL

SEQ ID NO: 1136714 - protein, 18 aa, Mycobacterium
RYLLRNRERLLDRFTLGV

SEQ ID NO: 1136715 - protein, 23 aa, Mycobacterium
SAGLVPPIHQWSGSTFSNLPIGQ

SEQ ID NO: 1136716 - protein, 26 aa, Mycobacterium
SAKFWTLLEIIPNLTLIVVLGFGAYA

SEQ ID NO: 1136717 - protein, 25 aa, Mycobacterium
SARAWRRFWFSYDSAYPLGFIRIAF

SEQ ID NO: 1136718 - protein, 19 aa, Mycobacterium
SARFFARTALPGISAIRAA

SEQ ID NO: 1136719 - protein, 34 aa, Mycobacterium
SARRAMMLPLLLFGLLIFGLFRESFPGLHPERLL

SEQ ID NO: 1136720 - protein, 19 aa, Mycobacterium
SAVEPYRQLVQRLQTRTRG

SEQ ID NO: 1136721 - protein, 27 aa, Mycobacterium
SDGVAALTWTAWLTPFGLLGRVAPYAH

SEQ ID NO: 1136722 - protein, 18 aa, Mycobacterium
SDILIPFGGPPDPSKGRC

SEQ ID NO: 1136723 - protein, 27 aa, Mycobacterium
SDIVIAVWVLIWLFVGMAVHSAVATIA

SEQ ID NO: 1136724 - protein, 24 aa, Mycobacterium
SDPVACTVGFLPPSQWRSPEDMTT

SEQ ID NO: 1136725 - protein, 26 aa, Mycobacterium
SEPPPPPPPPPPPPPPPPSAEAPVNT

SEQ ID NO: 1136726 - protein, 49 aa, Mycobacterium
SEPYPSVWQLLSGAGERLVLYLGLAAALGLVASWLLSRRIKRHTRGLEV

SEQ ID NO: 1136727 - protein, 20 aa, Mycobacterium
SFFILPYVIAGVLWLRNREE

SEQ ID NO: 1136728 - protein, 33 aa, Mycobacterium
SFHVVGTLLVLGLLIAPPATALLWVRSIPRVMT

SEQ ID NO: 1136729 - protein, 19 aa, Mycobacterium
SFRAGYGEYLRTAGVMQVA

SEQ ID NO: 1136730 - protein, 19 aa, Mycobacterium
SGAVTWQWSGWPERTRAPR

SEQ ID NO: 1136731 - protein, 20 aa, Mycobacterium
SGIISALHRPVPLSGDGSDT

SEQ ID NO: 1136732 - protein, 20 aa, Mycobacterium
SGIPYFPNLVIPLVVGGIGI

SEQ ID NO: 1136733 - protein, 21 aa, Mycobacterium
SGLQFYYLVSASLVVLVLGIE

SEQ ID NO: 1136734 - protein, 24 aa, Mycobacterium
SGLSAHLLGWPPGTVMALVVAVPL

SEQ ID NO: 1136735 - protein, 23 aa, Mycobacterium
SGRSLVIGMLILAVSFLPLVALP

SEQ ID NO: 1136736 - protein, 19 aa, Mycobacterium
SGRTVVLTWLACAALLAVA

SEQ ID NO: 1136737 - protein, 23 aa, Mycobacterium
SGTMGWLAGLWQDVLAAPVDGPE

SEQ ID NO: 1136738 - protein, 19 aa, Mycobacterium
SHIWRRATARRSWTPVHGP

SEQ ID NO: 1136739 - protein, 17 aa, Mycobacterium
SHQAQVLFTMRVAPARG

SEQ ID NO: 1136740 - protein, 36 aa, Mycobacterium
SHWEHTASAWWFDMGMLALLSIAYVGFVRWKIRLST

SEQ ID NO: 1136741 - protein, 35 aa, Mycobacterium
SIDRSLLNLIPESPPLVVPFLANAGDPPRFVWPVR

SEQ ID NO: 1136742 - protein, 30 aa, Mycobacterium
SIPVLAVANYWIVSHLLPIFRRMQQLIDNI

SEQ ID NO: 1136743 - protein, 21 aa, Mycobacterium
SITLLPSLIVLAGRRGWVNPR

SEQ ID NO: 1136744 - protein, 23 aa, Mycobacterium
SLALTLFLVIVGNAAAAGPVGRP

SEQ ID NO: 1136745 - protein, 22 aa, Mycobacterium
SLAPLLLLPLLNRQWRSLVTAV

SEQ ID NO: 1136746 - protein, 20 aa, Mycobacterium
SLATIWLRTGLMPRPLVYVT

SEQ ID NO: 1136747 - protein, 26 aa, Mycobacterium
SLLGDPATWIERALVVLVAASPCALA

SEQ ID NO: 1136748 - protein, 29 aa, Mycobacterium
SLRSRRLETRLMMLLGAGFGLGVALAVSR

SEQ ID NO: 1136749 - protein, 32 aa, Mycobacterium
SLSIEEQFYFVWPWVLIALFALTRKVKRRGHV

SEQ ID NO: 1136750 - protein, 20 aa, Mycobacterium
SLSTLWGAPLLGAVFGLGWT

SEQ ID NO: 1136751 - protein, 25 aa, Mycobacterium
SLVLTVGPQLAAFYGKRPPQLWSPP

SEQ ID NO: 1136752 - protein, 34 aa, Mycobacterium
SLVPTLMLAIPFTVLLIFTFNILLLEFGAADFAG

SEQ ID NO: 1136753 - protein, 19 aa, Mycobacterium
SMAMVWLSVLLFVKIGEPD

SEQ ID NO: 1136754 - protein, 24 aa, Mycobacterium
SMDYEVFLMSRIREFWLASGRTAA

SEQ ID NO: 1136755 - protein, 29 aa, Mycobacterium
SMDYEVFLMSRIREFWLKSGRTRQDGTVP

SEQ ID NO: 1136756 - protein, 24 aa, Mycobacterium
SMYAFTSILWNLSGPVTLPFVGVE

SEQ ID NO: 1136757 - protein, 21 aa, Mycobacterium
SNAVLGYFAAAAALFVLLSVI

SEQ ID NO: 1136758 - protein, 24 aa, Mycobacterium
SPAMLVLVLIMIIDGFVVGRKVNR

SEQ ID NO: 1136759 - protein, 21 aa, Mycobacterium
SPDRLLMVVAVILLQLVTGNQ

SEQ ID NO: 1136760 - protein, 33 aa, Mycobacterium
SPFGLLIVAALLVAVFLLVWSMNRHLKRLPESF

SEQ ID NO: 1136761 - protein, 31 aa, Mycobacterium
SPISWAHHWVWVVPLTIWLLHGPWRGRAGAR

SEQ ID NO: 1136762 - protein, 28 aa, Mycobacterium
SPVSKNVPSLRYLSYRLTMERDGADWLI

SEQ ID NO: 1136763 - protein, 25 aa, Mycobacterium
SQRHRAFVLTYYWGLVLSSQALLTP

SEQ ID NO: 1136764 - protein, 24 aa, Mycobacterium
SRAARLFAVMMLIGVLAPITAPIL

SEQ ID NO: 1136765 - protein, 18 aa, Mycobacterium
SRFHLFSVLEAVNGVLLF

SEQ ID NO: 1136766 - protein, 41 aa, Mycobacterium
SRGRIPEYVLVGLVTVLIAGGLGWVLAGPAIRPLRKLTEQT

SEQ ID NO: 1136767 - protein, 19 aa, Mycobacterium
SRIRLTEIPVLVVGLAVIL

SEQ ID NO: 1136768 - protein, 19 aa, Mycobacterium
SRLRPLIEPALVVLTVAAL

SEQ ID NO: 1136769 - protein, 21 aa, Mycobacterium
SRYFNRLPRKLVDRVLPAPGT

SEQ ID NO: 1136770 - protein, 33 aa, Mycobacterium
SSAAPLFHNIASWLLQRQNVPLSPPGAPLTLQA

SEQ ID NO: 1136771 - protein, 45 aa, Mycobacterium
SSAIRDAVLILLVFVAALVLVLLVARSLVRPLRRLRDSALKVAHE

SEQ ID NO: 1136772 - protein, 31 aa, Mycobacterium
SSETLPMMLAPWVLLPVILALRGEGSARRLA

SEQ ID NO: 1136773 - protein, 32 aa, Mycobacterium
SSFYDAYWSVVPPLLLAYWWTQTPDADTVRVA

SEQ ID NO: 1136774 - protein, 27 aa, Mycobacterium
SSGPIGIWTWPIAVVGQLAVAFVLGAL

SEQ ID NO: 1136775 - protein, 24 aa, Mycobacterium
SSLLRFIAHPWTALTLLVVGVYGL

SEQ ID NO: 1136776 - protein, 33 aa, Mycobacterium
SSPQMDPFNPTQFPIALLLNVTNPLRAEFGNDR

SEQ ID NO: 1136777 - protein, 23 aa, Mycobacterium
STGTLFLVGIAVGAAAALGLAVL

SEQ ID NO: 1136778 - protein, 28 aa, Mycobacterium
STLAFSKPFFDQGLLNRRAVLKSTYAQF

SEQ ID NO: 1136779 - protein, 31 aa, Mycobacterium
STLGLIVAFIALFWLYQVYEPPVRPAQNPAQ

SEQ ID NO: 1136780 - protein, 17 aa, Mycobacterium
STWLPSRRFFAAVIAIA

SEQ ID NO: 1136781 - protein, 24 aa, Mycobacterium
SVARTRRGLRALLSLVPDEATVLR

SEQ ID NO: 1136782 - protein, 24 aa, Mycobacterium
SVDDIAYGFALYGSAGVLIDSGSG

SEQ ID NO: 1136783 - protein, 24 aa, Mycobacterium
SVFAAAMRAWIAQLVCWHTPNDTA

SEQ ID NO: 1136784 - protein, 17 aa, Mycobacterium
SVIAVGLLLPWTRPMFM

SEQ ID NO: 1136785 - protein, 18 aa, Mycobacterium
SVIYLGPPTLRAADEQRP

SEQ ID NO: 1136786 - protein, 21 aa, Mycobacterium
SVLAPLVVSWFDAAAHIASVS

SEQ ID NO: 1136787 - protein, 25 aa, Mycobacterium
SVLTAFVLLGHWFEMRARGGANDAI

SEQ ID NO: 1136788 - protein, 25 aa, Mycobacterium
SVLTTFVLLGHWFEMRARGGANDAI

SEQ ID NO: 1136789 - protein, 21 aa, Mycobacterium
SVPPELLFATTLADLGHRDGI

SEQ ID NO: 1136790 - protein, 18 aa, Mycobacterium
SVPWNIASAVPLVGDPFT

SEQ ID NO: 1136791 - protein, 17 aa, Mycobacterium
SVQRSPTWILPKPDRPY

SEQ ID NO: 1136792 - protein, 26 aa, Mycobacterium
SVRQGRFEIDFLMLVSAAGAAALGEI

SEQ ID NO: 1136793 - protein, 24 aa, Mycobacterium
SVVVMTLLGFALAWRDSWEYWTET

SEQ ID NO: 1136794 - protein, 26 aa, Mycobacterium
SWARVFDWLPIFVVITGIVGWVSDST

SEQ ID NO: 1136795 - protein, 21 aa, Mycobacterium
SWLVAEMVWFFGGAGRGGDEA

SEQ ID NO: 1136796 - protein, 18 aa, Mycobacterium
SWVWYRGLQGEPVPVFGS

SEQ ID NO: 1136797 - protein, 25 aa, Mycobacterium
SYQDNWWQILTSAFMRNALLGGTIV

SEQ ID NO: 1136798 - protein, 32 aa, Mycobacterium
SYVSAIGIGVLFFQFILGQELAWTVPGMAFLV

SEQ ID NO: 1136799 - protein, 24 aa, Mycobacterium
TAAYVVAAILFILALAGLSKHETS

SEQ ID NO: 1136800 - protein, 31 aa, Mycobacterium
TADAPRSWLTWRIPALTSVLVAAVVTFVVSL

SEQ ID NO: 1136801 - protein, 26 aa, Mycobacterium
TALGRALSLVWRRSLQVRVVSLTLGL

SEQ ID NO: 1136802 - protein, 20 aa, Mycobacterium
TAMLWTAIGIWLEPLRSTFD

SEQ ID NO: 1136803 - protein, 22 aa, Mycobacterium
TARGWPVLTFTRPVSLRDRIPA

SEQ ID NO: 1136804 - protein, 17 aa, Mycobacterium
TASGFVVFVLWLALGRY

SEQ ID NO: 1136805 - protein, 28 aa, Mycobacterium
TASVVLPLKALLLNVLSLSAAFGAMVWI

SEQ ID NO: 1136806 - protein, 28 aa, Mycobacterium
TAVIQPPLLLFITVPGAYFLFHGSEIHG

SEQ ID NO: 1136807 - protein, 17 aa, Mycobacterium
TCTMLITAPIMSVGGIF

SEQ ID NO: 1136808 - protein, 21 aa, Mycobacterium
TCVLYECLTGVRPYPADSLEE

SEQ ID NO: 1136809 - protein, 30 aa, Mycobacterium
TDAERPRLRIPLWSLLLLGAAALVVSMAGI

SEQ ID NO: 1136810 - protein, 25 aa, Mycobacterium
TDANRDAWMVGFTPSLSTAVWVGTV

SEQ ID NO: 1136811 - protein, 25 aa, Mycobacterium
TDDQLPWRFITGWLNRYGVRADVLT

SEQ ID NO: 1136812 - protein, 17 aa, Mycobacterium
TDPFRVLFRTWVVLPAL

SEQ ID NO: 1136813 - protein, 35 aa, Mycobacterium
TDTDWWLLGVAIAVVVLLFAWWRGLFVTEMVRRRF

SEQ ID NO: 1136814 - protein, 21 aa, Mycobacterium
TESLSIPWWTRGDLNAFFGLG

SEQ ID NO: 1136815 - protein, 17 aa, Mycobacterium
TEVNVSLPWSKTVVLDP

SEQ ID NO: 1136816 - protein, 17 aa, Mycobacterium
TFLSPTAELFVVMAATT

SEQ ID NO: 1136817 - protein, 18 aa, Mycobacterium
TFLVPSDLLWSFLQAIVM

SEQ ID NO: 1136818 - protein, 18 aa, Mycobacterium
TFSRPWYLAVAAAVYVPM

SEQ ID NO: 1136819 - protein, 23 aa, Mycobacterium
TFVSLPFLVIALEGAARTAGTDY

SEQ ID NO: 1136820 - protein, 18 aa, Mycobacterium
TFWELLQQGLIITLVVIV

SEQ ID NO: 1136821 - protein, 20 aa, Mycobacterium
TGEQYPSGPLILAGAAVLLA

SEQ ID NO: 1136822 - protein, 26 aa, Mycobacterium
TGGVVLLGLLAAIALLVARQIVLPVR

SEQ ID NO: 1136823 - protein, 27 aa, Mycobacterium
TGLIWGLWHWPLPWVGYFGGDAPVSDA

SEQ ID NO: 1136824 - protein, 19 aa, Mycobacterium
TGNPWWAVAALVGTVGVGI

SEQ ID NO: 1136825 - protein, 34 aa, Mycobacterium
TGPSRRLFFAYLNLFLAAMLLLVLADNYLGLYVG

SEQ ID NO: 1136826 - protein, 25 aa, Mycobacterium
TGQPATPALPVPFPRTGQGGEPRLT

SEQ ID NO: 1136827 - protein, 43 aa, Mycobacterium
TGRVIEIVHPTFLYELVWNLLVFAVLIWADRRFNLGHGRLFAL

SEQ ID NO: 1136828 - protein, 24 aa, Mycobacterium
TGSSFKVFALVAALQQGIGLGYQV

SEQ ID NO: 1136829 - protein, 32 aa, Mycobacterium
TGSVLVLWLPAAPALLAWWLVVATITVTVLRM

SEQ ID NO: 1136830 - protein, 21 aa, Mycobacterium
TGWTGWRLLIARCAATLAVAV

SEQ ID NO: 1136831 - protein, 27 aa, Mycobacterium
THHWVWVLPLMIWLWHGPLRRRAGARA

SEQ ID NO: 1136832 - protein, 22 aa, Mycobacterium
THSMVLLTHRPDFHGALSRVPG

SEQ ID NO: 1136833 - protein, 28 aa, Mycobacterium
TIRRFMSFGLVFLILNGLQIVVVTAILL

SEQ ID NO: 1136834 - protein, 19 aa, Mycobacterium
TLALTMFLMGGATALMGVL

SEQ ID NO: 1136835 - protein, 32 aa, Mycobacterium
TLARYVPLARRPIVWWLHWLAEKTQKTKTRAE

SEQ ID NO: 1136836 - protein, 22 aa, Mycobacterium
TLAVVYIAAIVALAVGLFNGSF

SEQ ID NO: 1136837 - protein, 27 aa, Mycobacterium
TLGLLACGLPILGFGSLFGRVGLACGA

SEQ ID NO: 1136838 - protein, 17 aa, Mycobacterium
TLKPLPPAPQQFGDADF

SEQ ID NO: 1136839 - protein, 22 aa, Mycobacterium
TLLITIVPAMLWLVGLVSLIRN

SEQ ID NO: 1136840 - protein, 18 aa, Mycobacterium
TLPEVPALPAAPAAEVKP

SEQ ID NO: 1136841 - protein, 19 aa, Mycobacterium
TLTGLLVAAVPLATAPEVS

SEQ ID NO: 1136842 - protein, 22 aa, Mycobacterium
TLTSLLLAAVLSWGAIEIAHLT

SEQ ID NO: 1136843 - protein, 29 aa, Mycobacterium
TLVSTPVVLAVRPELKPALAQQNWGTLPD

SEQ ID NO: 1136844 - protein, 20 aa, Mycobacterium
TMLETEFALALIDLRKRGHT

SEQ ID NO: 1136845 - protein, 32 aa, Mycobacterium
TPLWRAAQVFRLLSWVYALGFQLSVNDDLDRR

SEQ ID NO: 1136846 - protein, 17 aa, Mycobacterium
TQKPTFYKDFPTSVSPL

SEQ ID NO: 1136847 - protein, 17 aa, Mycobacterium
TQPALDLDALLGGLRPV

SEQ ID NO: 1136848 - protein, 23 aa, Mycobacterium
TRADITALALPVLIGEPDDLAAL

SEQ ID NO: 1136849 - protein, 22 aa, Mycobacterium
TREFHVGIIARLALSGLPVAVY

SEQ ID NO: 1136850 - protein, 17 aa, Mycobacterium
TRFDEQDVLLFEDLLEI

SEQ ID NO: 1136851 - protein, 20 aa, Mycobacterium
TRKPIAFAGIRQLGLGAIAI

SEQ ID NO: 1136852 - protein, 19 aa, Mycobacterium
TRLDRPVAIKILHPAMNAQ

SEQ ID NO: 1136853 - protein, 18 aa, Mycobacterium
TRLLIMTVIGLTIAYVFK

SEQ ID NO: 1136854 - protein, 29 aa, Mycobacterium
TRLPTSVSLWLPYLPLLVGGTVATVVVLD

SEQ ID NO: 1136855 - protein, 26 aa, Mycobacterium
TRRGLRSLLSLVPPTASVLRGGTEIT

SEQ ID NO: 1136856 - protein, 35 aa, Mycobacterium
TRVLAASLFWLDGKRWWPYVPPFAAVLAPAERRLG

SEQ ID NO: 1136857 - protein, 19 aa, Mycobacterium
TRWFARRWGSGRSLVIGML

SEQ ID NO: 1136858 - protein, 21 aa, Mycobacterium
TRYLPVFGLWAAVALVVIPPA

SEQ ID NO: 1136859 - protein, 32 aa, Mycobacterium; identical to SEQ ID NO: 371626

SEQ ID NO: 1136860 - protein, 25 aa, Mycobacterium
TSLLLKYDPIYTCLLQGAKFALDNG

SEQ ID NO: 1136861 - protein, 32 aa, Mycobacterium
TTILDVVVVFLVTWPLVYLASKTTWAAKPKFN

SEQ ID NO: 1136862 - protein, 25 aa, Mycobacterium
TTLAAAGLMLLILGAARAWADPGTG

SEQ ID NO: 1136863 - protein, 25 aa, Mycobacterium
TTVHPLLMRLGPRQAYWSGLSVFAA

SEQ ID NO: 1136864 - protein, 33 aa, Mycobacterium
TVAAAFRRVVLPLLWPGIVAALLVVFFLSYNDF

SEQ ID NO: 1136865 - protein, 20 aa, Mycobacterium
TVAFFASWGASLGLLHHELE

SEQ ID NO: 1136866 - protein, 24 aa, Mycobacterium
TVAVLAAAGVFWFVKRDGTTTNAA

SEQ ID NO: 1136867 - protein, 23 aa, Mycobacterium
TVENRPWYRAFHAYKMAVICLIG

SEQ ID NO: 1136868 - protein, 49 aa, Mycobacterium
TVLLNYLASIGFGVLVFQWIFGQEIAWPVPLLAFIILVAVGADYNMLLV

SEQ ID NO: 1136869 - protein, 25 aa, Mycobacterium
TVLTPLRDLFAAIFFLAIGVSVDPA

SEQ ID NO: 1136870 - protein, 26 aa, Mycobacterium
TVQDAIPLFGSFLNGVSTNPSAGTIE

SEQ ID NO: 1136871 - protein, 29 aa, Mycobacterium
TVRRLPGWPLWFAALWVAQEWLKSSVPFG

SEQ ID NO: 1136872 - protein, 18 aa, Mycobacterium
TVTLPALGQILQSSPELA

SEQ ID NO: 1136873 - protein, 17 aa, Mycobacterium
TVVGLAREPNRYLATIQ

SEQ ID NO: 1136874 - protein, 22 aa, Mycobacterium
TVVIAFLLLFVVNAIVTAVGFE

SEQ ID NO: 1136875 - protein, 25 aa, Mycobacterium
TYGLPNLVLALNTLARIVPLVAGGG

SEQ ID NO: 1136876 - protein, 37 aa, Mycobacterium
VAAEFSLVSWAVPLNWWVMLAGFVLFVSPVGRMGIAV

SEQ ID NO: 1136877 - protein, 26 aa, Mycobacterium
VAAMHALLWFSAWATVGRLRRWRRPT

SEQ ID NO: 1136878 - protein, 17 aa, Mycobacterium
VAAVLGYLVFAPGKQEP

SEQ ID NO: 1136879 - protein, 25 aa, Mycobacterium
VAFGAYFLRGFFILIVVAAVGAYLF

SEQ ID NO: 1136880 - protein, 26 aa, Mycobacterium
VAFITMMLSLVWPIASLGFLLSMMQE

SEQ ID NO: 1136881 - protein, 19 aa, Mycobacterium
VAFLALGAAALAVGWLPSA

SEQ ID NO: 1136882 - protein, 24 aa, Mycobacterium
VAFSTMFAMLLGYDVPDFPGARWI

SEQ ID NO: 1136883 - protein, 25 aa, Mycobacterium
VAGAVLLVAVICTLVILGGGDSGSV

SEQ ID NO: 1136884 - protein, 27 aa, Mycobacterium
VAGFHEGFFFFAIVLSALSVIPLGSGI

SEQ ID NO: 1136885 - protein, 19 aa, Mycobacterium
VAGVLWALVAIAIGASQRQ

SEQ ID NO: 1136886 - protein, 21 aa, Mycobacterium
VAIPLAVLLFLVVSTPVAGEM

SEQ ID NO: 1136887 - protein, 19 aa, Mycobacterium
VAIVGLGGVAGWLGYRIVD

SEQ ID NO: 1136888 - protein, 29 aa, Mycobacterium
VALPMLTMVLFPMYFLKSFAYAGVATVVF

SEQ ID NO: 1136889 - protein, 22 aa, Mycobacterium
VAMVFNLFFINLVIAGLHSYAG

SEQ ID NO: 1136890 - protein, 26 aa, Mycobacterium
VAPPPAPVYVPPAPPVYVPPAPAYVP

SEQ ID NO: 1136891 - protein, 25 aa, Mycobacterium
VAPTTVAILMLLPLSAFEATTALPA

SEQ ID NO: 1136892 - protein, 28 aa, Mycobacterium
VASGAMVFAILVLLGRYINYTLDLAGIA

SEQ ID NO: 1136893 - protein, 19 aa, Mycobacterium
VAVAGFWLAGLGFGWAMTG

SEQ ID NO: 1136894 - protein, 18 aa, Mycobacterium
VCTGFLFTQRTLRPLMAV

SEQ ID NO: 1136895 - protein, 19 aa, Mycobacterium
VCVAMFGLVVSPVSWSHHW

SEQ ID NO: 1136896 - protein, 17 aa, Mycobacterium
VDAAHVCVFPLAAPQSV

SEQ ID NO: 1136897 - protein, 21 aa, Mycobacterium
VDDAFLPAAAPPAPPQRTEQR

SEQ ID NO: 1136898 - protein, 19 aa, Mycobacterium
VDFIFQVGPLSLVVALLAG

SEQ ID NO: 1136899 - protein, 27 aa, Mycobacterium
VDLKWGPRREPMVKLLMALAVASTNHR

SEQ ID NO: 1136900 - protein, 29 aa, Mycobacterium
VDSRRNVLGLFMPAALALIFVMLAVPSIE

SEQ ID NO: 1136901 - protein, 17 aa, Mycobacterium
VDTKYMQLIPANVLADI

SEQ ID NO: 1136902 - protein, 23 aa, Mycobacterium
VDVFFVLSGFFITGLLLKERSQT

SEQ ID NO: 1136903 - protein, 42 aa, Mycobacterium
VEAFSEVNIWFLVQFLERPFVPLIPTLGIPGDIADALGAEKA

SEQ ID NO: 1136904 - protein, 46 aa, Mycobacterium
VFDILAPVAAIAGLLYIGLALGWPLWWVSVCSVLCLLIVQGVIVNV

SEQ ID NO: 1136905 - protein, 31 aa, Mycobacterium
VFPARIAFHLVRLYNLAFIVSTYALSRKAPR

SEQ ID NO: 1136906 - protein, 20 aa, Mycobacterium
VFTTLIAFGLIFYVSVFASS

SEQ ID NO: 1136907 - protein, 26 aa, Mycobacterium
VFVEARWLSVLLLSAGLAGFCVHATL

SEQ ID NO: 1136908 - protein, 23 aa, Mycobacterium
VGAIFVWLGMVLAISFLEAPLKF

SEQ ID NO: 1136909 - protein, 33 aa, Mycobacterium
VGDRAPFVWDGAPGVRPFLLFGDAPAGVDVPVR

SEQ ID NO: 1136910 - protein, 31 aa, Mycobacterium
VGLAAVLLYSLLYYRLLGVLIALSLVASGAM

SEQ ID NO: 1136911 - protein, 17 aa, Mycobacterium
VGLGLILIPVVLAKLWS

SEQ ID NO: 1136912 - protein, 21 aa, Mycobacterium
VGMVVMMFVSGFRQMNPLYLI

SEQ ID NO: 1136913 - protein, 19 aa, Mycobacterium
VGQPVPAPAPAPGVPLPPQ

SEQ ID NO: 1136914 - protein, 28 aa, Mycobacterium
VGSGPGFQINLYGLPPAPIAEVLLDTYF

SEQ ID NO: 1136915 - protein, 37 aa, Mycobacterium
VGTILAILLVVYRSIIGMLIPLLTIGLALGVANQAVA

SEQ ID NO: 1136916 - protein, 24 aa, Mycobacterium
VIACGALLVWFWPRLLADGMAVPV

SEQ ID NO: 1136917 - protein, 29 aa, Mycobacterium
VIDTGVARHRLLPRLMPGGDYVSTGDGTD

SEQ ID NO: 1136918 - protein, 17 aa, Mycobacterium
VIFLVIGGIWLVLVGWL

SEQ ID NO: 1136919 - protein, 35 aa, Mycobacterium
VILNVLIVMFPLISSFAIWALTGWVVSGELFATLS

SEQ ID NO: 1136920 - protein, 24 aa, Mycobacterium
VISSLLLIIAIGFLTSVFVEPPPV

SEQ ID NO: 1136921 - protein, 23 aa, Mycobacterium
VITTVGPYTKYGLPLVAACAAAG

SEQ ID NO: 1136922 - protein, 19 aa, Mycobacterium
VIVLFVLRPALDSAHFTLP

SEQ ID NO: 1136923 - protein, 29 aa, Mycobacterium
VIVSLIATVGLWLASTFAAAIAFGAIALI

SEQ ID NO: 1136924 - protein, 26 aa, Mycobacterium
VKAAVQAMLFASLAPPAFAIGVIPGG

SEQ ID NO: 1136925 - protein, 39 aa, Mycobacterium
VLADATLIRMLLVPAFMHLMGRWNWWAPKPLARLHERFG

SEQ ID NO: 1136926 - protein, 17 aa, Mycobacterium
VLAGVFGGARIAANVDQ

SEQ ID NO: 1136927 - protein, 17 aa, Mycobacterium
VLAIALIASVGATAWLY

SEQ ID NO: 1136928 - protein, 20 aa, Mycobacterium
VLALTLLFGFALAAVSYACV

SEQ ID NO: 1136929 - protein, 19 aa, Mycobacterium
VLAVVIVVALTAAGLLGGE

SEQ ID NO: 1136930 - protein, 21 aa, Mycobacterium
VLCALPARYLTPTSDKKPAPL

SEQ ID NO: 1136931 - protein, 24 aa, Mycobacterium
VLDNVTIILLIAPVTLVICDRLRI

SEQ ID NO: 1136932 - protein, 19 aa, Mycobacterium
VLFFSVFEYFRSWEFFRTT

SEQ ID NO: 1136933 - protein, 18 aa, Mycobacterium
VLGRFRRGSTAAPGGSGL

SEQ ID NO: 1136934 - protein, 27 aa, Mycobacterium
VLGWSMRWRSPLAWAAAIVLVAVGVGS

SEQ ID NO: 1136935 - protein, 17 aa, Mycobacterium
VLGYLVFAPGKQEPAPE

SEQ ID NO: 1136936 - protein, 26 aa, Mycobacterium
VLKSTYAQFFFLMSGADHDQMDRMRS

SEQ ID NO: 1136937 - protein, 30 aa, Mycobacterium
VLLAAACLLAWALLLLVLTSTWVATYTAII

SEQ ID NO: 1136938 - protein, 17 aa, Mycobacterium
VLLAFTAGGRRFGLAFL

SEQ ID NO: 1136939 - protein, 33 aa, Mycobacterium
VLLEFAGLVTLGVLLLVARRRLASARKQVVRRS

SEQ ID NO: 1136940 - protein, 18 aa, Mycobacterium
VLLGRVTGLPLPAVLVPP

SEQ ID NO: 1136941 - protein, 23 aa, Mycobacterium
VLRLPARFVLGALAGLRTVGLLR

SEQ ID NO: 1136942 - protein, 21 aa, Mycobacterium
VLVALLAFGRWSDAVGRRPML

SEQ ID NO: 1136943 - protein, 20 aa, Mycobacterium
VLVGPFLLIAAVSGGLYAIA

SEQ ID NO: 1136944 - protein, 17 aa, Mycobacterium
VMLLFYATPIVFGFANL

SEQ ID NO: 1136945 - protein, 34 aa, Mycobacterium
VNDEARRLLGLPPGPIDRAALPPFLRTSDPGVRD

SEQ ID NO: 1136946 - protein, 22 aa, Mycobacterium
VNDLLHGLLMYSGNDAAHALAR

SEQ ID NO: 1136947 - protein, 24 aa, Mycobacterium
VNFADIWRRSDLPRDGRAPVLLQV

SEQ ID NO: 1136948 - protein, 23 aa, Mycobacterium
VNGALLIFVALSSLTLLLGTVQA

SEQ ID NO: 1136949 - protein, 26 aa, Mycobacterium
VNGAVIILLIWMIDVFVGPAGSGGDY

SEQ ID NO: 1136950 - protein, 39 aa, Mycobacterium
VNQGSVLGSLLIYMLPLLLLVALFVFFSRMQTGGRMGFG

SEQ ID NO: 1136951 - protein, 18 aa, Mycobacterium
VNVSLPWSKTVVLDPGVE

SEQ ID NO: 1136952 - protein, 17 aa, Mycobacterium
VPAPTNTSSFFASRAQA

SEQ ID NO: 1136953 - protein, 21 aa, Mycobacterium
VPAVLLLLPLVAGAGPAAVLA

SEQ ID NO: 1136954 - protein, 19 aa, Mycobacterium
VPFTFAYPIRAADGPSLRI

SEQ ID NO: 1136955 - protein, 23 aa, Mycobacterium
VPHLFIVVFVVMLPVYLNTDDPI

SEQ ID NO: 1136956 - protein, 17 aa, Mycobacterium
VPIGNWLTRSLFAAKFA

SEQ ID NO: 1136957 - protein, 26 aa, Mycobacterium
VPLSQWFLLVMAFGSLFMAAGKRYAE

SEQ ID NO: 1136958 - protein, 20 aa, Mycobacterium
VPVAFALVTVWLTRRGRIPH

SEQ ID NO: 1136959 - protein, 23 aa, Mycobacterium
VPWWWWLPGLGLAGLIAYEVNLG

SEQ ID NO: 1136960 - protein, 27 aa, Mycobacterium
VQREAAWLIKSLYLGPLVPRSVLELLR

SEQ ID NO: 1136961 - protein, 27 aa, Mycobacterium
VQRTLALFLATFVYALTVLRTIRSNDE

SEQ ID NO: 1136962 - protein, 18 aa, Mycobacterium
VQTWQPLLRHFGNAVDRG

SEQ ID NO: 1136963 - protein, 26 aa, Mycobacterium
VRAVTWRLPLVLLTASVVLLTVSDIA

SEQ ID NO: 1136964 - protein, 23 aa, Mycobacterium
VRLLFQPVLVVWALWSTGAWAAW

SEQ ID NO: 1136965 - protein, 31 aa, Mycobacterium
VRQPRAVLYLPEYLLFRIVRSYFTLAAVLSL

SEQ ID NO: 1136966 - protein, 30 aa, Mycobacterium
VRRLSGVIAIVVLLFLACAPVASAQPAAGP

SEQ ID NO: 1136967 - protein, 23 aa, Mycobacterium
VRRPVPLLIVSLVTLLALSAVAV

SEQ ID NO: 1136968 - protein, 20 aa, Mycobacterium
VRRSPVLTLFPHRPPEVGVP

SEQ ID NO: 1136969 - protein, 18 aa, Mycobacterium
VRSFVVPCLLRIMGPWFW

SEQ ID NO: 1136970 - protein, 36 aa, Mycobacterium
VRWPWVVIGVWVAMAVALPLSFPSLGEMAQKHPLAI

SEQ ID NO: 1136971 - protein, 18 aa, Mycobacterium
VSFGLYLGWSSIAVFANV

SEQ ID NO: 1136972 - protein, 21 aa, Mycobacterium
VSLVASMYFLIGDLGRPERFH

SEQ ID NO: 1136973 - protein, 19 aa, Mycobacterium
VSMIPFTIAILRYAVDVDG

SEQ ID NO: 1136974 - protein, 17 aa, Mycobacterium
VSVWRRGIRLWVPALAV

SEQ ID NO: 1136975 - protein, 32 aa, Mycobacterium
VTAAAIHWHTAAAVLVLLGGIAATAAAAVWGG

SEQ ID NO: 1136976 - protein, 23 aa, Mycobacterium
VTIPRRPFAWREFLEQSWFVARV

SEQ ID NO: 1136977 - protein, 31 aa, Mycobacterium
VTQVLLTYNPALEQLLVIFPGIIAAQQSFGL

SEQ ID NO: 1136978 - protein, 22 aa, Mycobacterium
VTVAPTRWRDGGVGPIRGPPRI

SEQ ID NO: 1136979 - protein, 20 aa, Mycobacterium
VTVTLTPRQLKKAQWGPVGA

SEQ ID NO: 1136980 - protein, 29 aa, Mycobacterium
VVATVFTAPPIWLWAVWAVLAVCCALLAA

SEQ ID NO: 1136981 - protein, 26 aa, Mycobacterium
VVFIVAVIFFSGFFIGRHSDGNFRGG

SEQ ID NO: 1136982 - protein, 36 aa, Mycobacterium
VVGALPALAFPAPSWWWLAWIGVVPLLLVVRAAPTA

SEQ ID NO: 1136983 - protein, 24 aa, Mycobacterium
VVGFLVIATLFFALGNAILVIPLA

SEQ ID NO: 1136984 - protein, 25 aa, Mycobacterium
VVGKAWVILLPVVLALVVCTVLWPP

SEQ ID NO: 1136985 - protein, 25 aa, Mycobacterium
VVGLVFFGVLLFGPAGTFDYWQAWV

SEQ ID NO: 1136986 - protein, 33 aa, Mycobacterium
VVIGIIWMGRRLVSPWWALGLGLILGGAMGNLI

SEQ ID NO: 1136987 - protein, 20 aa, Mycobacterium
VVIGILCFIGLFGVLDALLP

SEQ ID NO: 1136988 - protein, 17 aa, Mycobacterium
VVIVGMVVMMFVSGFRQ

SEQ ID NO: 1136989 - protein, 20 aa, Mycobacterium
VVKVLLVAGLWAAGWGAARL

SEQ ID NO: 1136990 - protein, 18 aa, Mycobacterium
VVLAKLWSVIPRLFVWPP

SEQ ID NO: 1136991 - protein, 29 aa, Mycobacterium
VVLALVVCTVLWPPVRWLRGKGVPPAAAV

SEQ ID NO: 1136992 - protein, 23 aa, Mycobacterium
VVLAVMGILVLAGAFAGAILMNR

SEQ ID NO: 1136993 - protein, 17 aa, Mycobacterium
VVLCRRAWRPGVLLVGL

SEQ ID NO: 1136994 - protein, 19 aa, Mycobacterium
VVLLVLFAATDRFDAAWWA

SEQ ID NO: 1136995 - protein, 17 aa, Mycobacterium
VVLSLFGFDFDTVGRRQ

SEQ ID NO: 1136996 - protein, 28 aa, Mycobacterium
VVLWVGLPIALWFFIIRPWVRERRITLD

SEQ ID NO: 1136997 - protein, 17 aa, Mycobacterium
VVSWFDAAAHIASVSVD

SEQ ID NO: 1136998 - protein, 19 aa, Mycobacterium
VVTGSWAFELTVSGTGTPG

SEQ ID NO: 1136999 - protein, 17 aa, Mycobacterium
VVTLAIVVVLLAVPVAA

SEQ ID NO: 1137000 - protein, 17 aa, Mycobacterium
VVTPLIALLLVLGVYPK

SEQ ID NO: 1137001 - protein, 30 aa, Mycobacterium
VVVTAILLSMYWPLGVVVLVSIVPITLTVL

SEQ ID NO: 1137002 - protein, 18 aa, Mycobacterium
VVWALNQQGWHAAAAVPF

SEQ ID NO: 1137003 - protein, 25 aa, Mycobacterium
VWIAIAVIAVLLVVALVVGLVRYRR

SEQ ID NO: 1137004 - protein, 18 aa, Mycobacterium
VWTILRWLHIGGAEVWAF

SEQ ID NO: 1137005 - protein, 27 aa, Mycobacterium
VYVTNAFFNGFVPPFPTRSTFPGVFSD

SEQ ID NO: 1137006 - protein, 19 aa, Mycobacterium
WAGVLVQILPQRGALRAAG

SEQ ID NO: 1137007 - protein, 17 aa, Mycobacterium
WALLISLATFVLGLALA

SEQ ID NO: 1137008 - protein, 25 aa, Mycobacterium
WARRPVEFLCLLPLTIPALVIVVGL

SEQ ID NO: 1137009 - protein, 27 aa, Mycobacterium
WAVAALVCAFLFAPLGIVFGHLSLSQI

SEQ ID NO: 1137010 - protein, 17 aa, Mycobacterium
WCVGYINASWTLRADLT

SEQ ID NO: 1137011 - protein, 25 aa, Mycobacterium
WEIGRPWYLAWAGLIYIVATLVTLA

SEQ ID NO: 1137012 - protein, 18 aa, Mycobacterium
WELLLGALAGALVHHVRW

SEQ ID NO: 1137013 - protein, 20 aa, Mycobacterium
WERLALLTLLAATAVLYLWG

SEQ ID NO: 1137014 - protein, 33 aa, Mycobacterium
WFGDISYTLYLWHWPVIILLLAVIPEGLVFSAV

SEQ ID NO: 1137015 - protein, 24 aa, Mycobacterium
WGAANVSLLLTYLDATGGDDPVAT

SEQ ID NO: 1137016 - protein, 24 aa, Mycobacterium
WGGALMMLALLTGWLLIGAGARVA

SEQ ID NO: 1137017 - protein, 17 aa, Mycobacterium
WGYFGFLISIAFLVSYI

SEQ ID NO: 1137018 - protein, 18 aa, Mycobacterium
WHAWVRLAVPLAVAFVAA

SEQ ID NO: 1137019 - protein, 23 aa, Mycobacterium
WINLIIAIPVVAFSTMFAMLLGY

SEQ ID NO: 1137020 - protein, 24 aa, Mycobacterium
WIPIVVVVVVLIAGFTVHRIRGFF

SEQ ID NO: 1137021 - protein, 18 aa, Mycobacterium
WLALCGTYGWAPGVMGAS

SEQ ID NO: 1137022 - protein, 17 aa, Mycobacterium
WNGVFAFYIPGLVLVVW

SEQ ID NO: 1137023 - protein, 18 aa, Mycobacterium
WPMFAGFCVYAYYKFVRY

SEQ ID NO: 1137024 - protein, 18 aa, Mycobacterium
WPVYEGLMWGGVQAALCC

SEQ ID NO: 1137025 - protein, 22 aa, Mycobacterium
WRAVFWINVPICALAVLLTAIF

SEQ ID NO: 1137026 - protein, 19 aa, Mycobacterium
WRDPNAPVALGTPAVEAPA

SEQ ID NO: 1137027 - protein, 22 aa, Mycobacterium
WRQPEHFYWLTSFLAAREAQSA

SEQ ID NO: 1137028 - protein, 17 aa, Mycobacterium
WRRGLIFALFVFAAFFT

SEQ ID NO: 1137029 - protein, 18 aa, Mycobacterium
WRVAFWLSAVVVLIGYYI

SEQ ID NO: 1137030 - protein, 17 aa, Mycobacterium
WSPRRLALRAWVLCWLT

SEQ ID NO: 1137031 - protein, 28 aa, Mycobacterium
WSSELWTSLLWIGRAWVVAAVITLVILV

SEQ ID NO: 1137032 - protein, 24 aa, Mycobacterium
WTVPWAMVLVVYLVQMTMGALAGR

SEQ ID NO: 1137033 - protein, 19 aa, Mycobacterium
WVIVIAVFVLLFGAKKLPD

SEQ ID NO: 1137034 - protein, 19 aa, Mycobacterium
WVSRADAAVIEWIQQYWNQ

SEQ ID NO: 1137035 - protein, 29 aa, Mycobacterium
WVVRRRPAARPLLILAAAAVLFPAVMATG

SEQ ID NO: 1137036 - protein, 18 aa, Mycobacterium
WYYAWTPGTGYLANLLPE

SEQ ID NO: 1137037 - protein, 26 aa, Mycobacterium
YAEGLRALYLFTAVHQDAVPQLARSV

SEQ ID NO: 1137038 - protein, 23 aa, Mycobacterium
YAKGWPAAQRFLYQPSPARDYVL

SEQ ID NO: 1137039 - protein, 27 aa, Mycobacterium
YDGFLLVMLGFLLQWPTIPTLMMFPVL

SEQ ID NO: 1137040 - protein, 31 aa, Mycobacterium
YDILATALALALLAFGFLAPAAALAIDHSDD

SEQ ID NO: 1137041 - protein, 28 aa, Mycobacterium
YDVPDFPGARWIAPLLGTVMYVVGGRPF

SEQ ID NO: 1137042 - protein, 22 aa, Mycobacterium
YEHYFRTFLRPDDVAWSFVQAI

SEQ ID NO: 1137043 - protein, 20 aa, Mycobacterium
YELFLLHVLVMAVLIHTLDW

SEQ ID NO: 1137044 - protein, 17 aa, Mycobacterium
YFGFLISIAFLVSYIFT

SEQ ID NO: 1137045 - protein, 19 aa, Mycobacterium
YGAPLYGPGGTPLWPGVPP

SEQ ID NO: 1137046 - protein, 45 aa, Mycobacterium
YGDHLPFIYPPFAALLFYPLHFLPFPVVAWIWQLAVVAGLYGLVR

SEQ ID NO: 1137047 - protein, 22 aa, Mycobacterium
YGFSMALMVRAGLGLDPWDVFH

SEQ ID NO: 1137048 - protein, 23 aa, Mycobacterium
YGGVLMFGMLTSFAGLGMFNPLS

SEQ ID NO: 1137049 - protein, 18 aa, Mycobacterium
YGLLWVAAVAVLVGGAAL

SEQ ID NO: 1137050 - protein, 20 aa, Mycobacterium
YGLVRLAYGLFLPDIQADLH

SEQ ID NO: 1137051 - protein, 18 aa, Mycobacterium
YIAAIQRLRAPLKVAGEY

SEQ ID NO: 1137052 - protein, 17 aa, Mycobacterium
YIAFFHSTALVVYNFAV

SEQ ID NO: 1137053 - protein, 27 aa, Mycobacterium
YIDLQDPALLQFIYVRAFASVVDASFP

SEQ ID NO: 1137054 - protein, 28 aa, Mycobacterium
YLALLAIELTWWPARRRELLLNSALAAA

SEQ ID NO: 1137055 - protein, 28 aa, Mycobacterium
YLINGILHLLIAYIIFRIAIGSGHGDAD

SEQ ID NO: 1137056 - protein, 17 aa, Mycobacterium
YMSFFILPYVIAGVLWL

SEQ ID NO: 1137057 - protein, 31 aa, Mycobacterium
YNMPLELVLTVIPFLIISVLFYFTVVVQEQM

SEQ ID NO: 1137058 - protein, 17 aa, Mycobacterium
YPLHLLPFGVVAFAWQI

SEQ ID NO: 1137059 - protein, 17 aa, Mycobacterium
YPPPPAYPRTTNAWAVA

SEQ ID NO: 1137060 - protein, 24 aa, Mycobacterium
YRTTIFAFPVFGFGVIFGAIWAEE

SEQ ID NO: 1137061 - protein, 24 aa, Mycobacterium
YTAHYFGAWVFIAGFLVHIAIKIP

SEQ ID NO: 1137062 - protein, 17 aa, Mycobacterium
YTFLARRLARRENRDDV

SEQ ID NO: 1137063 - protein, 21 aa, Mycobacterium
YTISAVLVAALGLLMLGRTPT

SEQ ID NO: 1137064 - protein, 18 aa, Mycobacterium
YVDWRAVFWINVPICALA

SEQ ID NO: 1137065 - protein, 29 aa, Mycobacterium
YVGDLSYALYLVHWPVIVLLAALMDRGPY

SEQ ID NO: 1137066 - protein, 25 aa, Mycobacterium
YVLWWAVLFPAINVPIIASLVLAIS

SEQ ID NO: 1137067 - protein, 25 aa, Mycobacterium
AAAAGAGLYYWWYHSPDKAVPVFAV

SEQ ID NO: 1137068 - protein, 28 aa, Mycobacterium
AAAAIGIAAYWLGTRRRATGGGSPGDSD

SEQ ID NO: 1137069 - protein, 26 aa, Mycobacterium
AAAARPLWFVCMALGLVILGLGLFAT

SEQ ID NO: 1137070 - protein, 25 aa, Mycobacterium
AAAAVAGVIGYLIGRRRRRGPAAVL

SEQ ID NO: 1137071 - protein, 29 aa, Mycobacterium
AAAFRRVVLPLLLPGIVAALLVVFFLSYN

SEQ ID NO: 1137072 - protein, 23 aa, Mycobacterium
AAAGFWWFVMPVPSGQVLLLVVI

SEQ ID NO: 1137073 - protein, 22 aa, Mycobacterium
AAAGLVALGLWRIAEAVIGGKP

SEQ ID NO: 1137074 - protein, 17 aa, Mycobacterium
AAALAPLGLLGSRLIFA

SEQ ID NO: 1137075 - protein, 22 aa, Mycobacterium
AAALAPLGLLGSRLIFAHLFVV

SEQ ID NO: 1137076 - protein, 23 aa, Mycobacterium
AAALAPLGLLGSRLIFAHLFVVA

SEQ ID NO: 1137077 - protein, 23 aa, Mycobacterium
AAALFLLFGFYMVFDNLLPTAPT

SEQ ID NO: 1137078 - protein, 25 aa, Mycobacterium
AAALLLAFTVLAILWANSPWAQSYS

SEQ ID NO: 1137079 - protein, 26 aa, Mycobacterium
AAALLLTFTVIAILWANSPWAQSYST

SEQ ID NO: 1137080 - protein, 23 aa, Mycobacterium
AAAMAKLFLFDLGTLDGIFRVAV

SEQ ID NO: 1137081 - protein, 23 aa, Mycobacterium
AAAPNFAFELAAERGLPPAGDTL

SEQ ID NO: 1137082 - protein, 30 aa, Mycobacterium
AAASALAASLLWLFRWPSRAQSLAYSTVCS

SEQ ID NO: 1137083 - protein, 23 aa, Mycobacterium
AAATLLFTGWVAVSTFVGPQDSG

SEQ ID NO: 1137084 - protein, 24 aa, Mycobacterium
AAAVHWILGMDWQLALLLGAVVSS

SEQ ID NO: 1137085 - protein, 25 aa, Mycobacterium
AAAVILCIFIYWGWDACLAVGEETK

SEQ ID NO: 1137086 - protein, 30 aa, Mycobacterium
AAAVPFWIGPILLYVLLPALDLRFGPDGQN

SEQ ID NO: 1137087 - protein, 30 aa, Mycobacterium
AAAWLEAASWWKALLALVVAVALIIGVNYA

SEQ ID NO: 1137088 - protein, 18 aa, Mycobacterium
AAAWLLVAVLLLSVIVSV

SEQ ID NO: 1137089 - protein, 24 aa, Mycobacterium
AACAALLVWFWPRLLEQGMALPVT

SEQ ID NO: 1137090 - protein, 26 aa, Mycobacterium
AACGLALLMVLMFPANVYAARMPDAP

SEQ ID NO: 1137091 - protein, 20 aa, Mycobacterium
AACWAVILFEIGFVAALFVD

SEQ ID NO: 1137092 - protein, 41 aa, Mycobacterium
AADAGWWPWVLAAAGIVLIVLALRWLLIHTPKARVKAVPLV

SEQ ID NO: 1137093 - protein, 22 aa, Mycobacterium
AAEPIYLLFDLAVIGRLGALNL

SEQ ID NO: 1137094 - protein, 31 aa, Mycobacterium; identical to SEQ ID NO: 348216

SEQ ID NO: 1137095 - protein, 23 aa, Mycobacterium
AAEWGFQLFQMPGALYVVVAVTI

SEQ ID NO: 1137096 - protein, 27 aa, Mycobacterium
AAFAGAIFMLLPRWLFGAGDSGASVII

SEQ ID NO: 1137097 - protein, 29 aa, Mycobacterium
AAFGLTMVLLTAGLFVIFGEYRSGSTHGY

SEQ ID NO: 1137098 - protein, 21 aa, Mycobacterium
AAFGPWLLREAFGAQYHADGT

SEQ ID NO: 1137099 - protein, 24 aa, Mycobacterium
AAGAPKFWLVAILAVAIATGFLVE

SEQ ID NO: 1137100 - protein, 25 aa, Mycobacterium
AAGAPKYWLVAILAVAIATGFLVER

SEQ ID NO: 1137101 - protein, 25 aa, Mycobacterium
AAGCLALAWWQWTRWESTTGSFQNL

SEQ ID NO: 1137102 - protein, 26 aa, Mycobacterium
AAGDYLLAMPWWEPSFVLGLAAFLVA

SEQ ID NO: 1137103 - protein, 24 aa, Mycobacterium
AAGFVFTWLRRRSGSLIAPIALHW

SEQ ID NO: 1137104 - protein, 22 aa, Mycobacterium
AAGGPWWFHVAALSACGFSLGL

SEQ ID NO: 1137105 - protein, 32 aa, Mycobacterium
AAGITYFTIFALFPLLMLGFSVGGFVLASQPE

SEQ ID NO: 1137106 - protein, 27 aa, Mycobacterium
AAGLVLAWFSAPWLIAVGAVCIAGAWL

SEQ ID NO: 1137107 - protein, 20 aa, Mycobacterium
AAGLVLLAAWMPFNNGLRPE

SEQ ID NO: 1137108 - protein, 23 aa, Mycobacterium
AAGSLLFGLWHIATSLGLTASNV

SEQ ID NO: 1137109 - protein, 23 aa, Mycobacterium
AAGSVLIALLRPDPYLVARQIDA

SEQ ID NO: 1137110 - protein, 26 aa, Mycobacterium
AAGTLLAYWCGPAIIAFVRDPGKPML

SEQ ID NO: 1137111 - protein, 22 aa, Mycobacterium
AAGVFEPAFGLILRPEIAALSM

SEQ ID NO: 1137112 - protein, 21 aa, Mycobacterium
AAGVFQPAFGLVLRPEIAALS

SEQ ID NO: 1137113 - protein, 23 aa, Mycobacterium
AAGVLLLALFLRLGGETLAHANA

SEQ ID NO: 1137114 - protein, 20 aa, Mycobacterium
AAGVLLLALLLTTGTDTLAH

SEQ ID NO: 1137115 - protein, 21 aa, Mycobacterium
AAGWLLVRAWRRPTSLIPTGL

SEQ ID NO: 1137116 - protein, 23 aa, Mycobacterium
AAHTPYLAWLAQQSAAGAAAAAQ

SEQ ID NO: 1137117 - protein, 19 aa, Mycobacterium
AAIAFLLFAAWTWREGRNA

SEQ ID NO: 1137118 - protein, 32 aa, Mycobacterium
AAIDRLYNEERIRLWVVFVDDFSGQDAQTWTQ

SEQ ID NO: 1137119 - protein, 19 aa, Mycobacterium
AAIIVLVGLFLYGAATNPA

SEQ ID NO: 1137120 - protein, 22 aa, Mycobacterium
AAILTVFFIVELSTALAINSIA

SEQ ID NO: 1137121 - protein, 28 aa, Mycobacterium
AAILVAIGAYVLLRFSLRTPLTLVRGSS

SEQ ID NO: 1137122 - protein, 27 aa, Mycobacterium
AAIPLVAVVLFFVFGGVIAATLPAIIG

SEQ ID NO: 1137123 - protein, 21 aa, Mycobacterium
AAIVGPPLFHDHLHQAGISAG

SEQ ID NO: 1137124 - protein, 24 aa, Mycobacterium
AAKKWAIWAALGAVAVWIIYAILY

SEQ ID NO: 1137125 - protein, 24 aa, Mycobacterium
AALAAYPLWCVFATALSTRIWQLN

SEQ ID NO: 1137126 - protein, 24 aa, Mycobacterium
AALATLVFDLLVTAGVYALVGFEV

SEQ ID NO: 1137127 - protein, 21 aa, Mycobacterium
AALAVPGLAGILILTGVGGYV

SEQ ID NO: 1137128 - protein, 17 aa, Mycobacterium
AALFAGYGRGAETATVA

SEQ ID NO: 1137129 - protein, 23 aa, Mycobacterium
AALFLVLLTAPPASAIEPPIVDP

SEQ ID NO: 1137130 - protein, 30 aa, Mycobacterium
AALFRRVFLINGLIFTLGTLVLAVSPASVS

SEQ ID NO: 1137131 - protein, 18 aa, Mycobacterium
AALGAWSLMRRPSTDYVQ

SEQ ID NO: 1137132 - protein, 25 aa, Mycobacterium
AALGFIPAYLLSLLLKKVGLLRIPA

SEQ ID NO: 1137133 - protein, 25 aa, Mycobacterium
AALGYITLWIRRRLANPALETVQGL

SEQ ID NO: 1137134 - protein, 36 aa, Mycobacterium
AALIPACILVFARLELLWLGITLGVLIGLASVVTIR

SEQ ID NO: 1137135 - protein, 17 aa, Mycobacterium
AALIQRPSVLDPAVDPD

SEQ ID NO: 1137136 - protein, 25 aa, Mycobacterium
AALKRRLLICVALSVPVIAMAMVPV

SEQ ID NO: 1137137 - protein, 24 aa, Mycobacterium
AALLFYPLHLLPFGVVAFAWQIGI

SEQ ID NO: 1137138 - protein, 22 aa, Mycobacterium
AALLSVLGLATLIAGAVAALAL

SEQ ID NO: 1137139 - protein, 22 aa, Mycobacterium
AALLVVFFLSYNDFLFAVYLAV

SEQ ID NO: 1137140 - protein, 21 aa, Mycobacterium
AALLYPLLLVAFPEPADAFGP

SEQ ID NO: 1137141 - protein, 18 aa, Mycobacterium
AALPHRALSILLAGVVLG

SEQ ID NO: 1137142 - protein, 34 aa, Mycobacterium
AALRGLGPVAFGDGWFYLTEREDVLAALRNPEVF

SEQ ID NO: 1137143 - protein, 27 aa, Mycobacterium
AALTYLLHGRWRSRVDLRHPAVVRALR

SEQ ID NO: 1137144 - protein, 19 aa, Mycobacterium
AALVGVLWVLFGFSMTFGS

SEQ ID NO: 1137145 - protein, 17 aa, Mycobacterium
AALVIGDRRWVARGGES

SEQ ID NO: 1137146 - protein, 23 aa, Mycobacterium
AALVLAIVGLLLCWTVAGGVLLG

SEQ ID NO: 1137147 - protein, 26 aa, Mycobacterium
AALVRSRWPHLTARQVMQRIEDTAHR

SEQ ID NO: 1137148 - protein, 22 aa, Mycobacterium
AAMVFNLFFINLVIAGLHSYAG

SEQ ID NO: 1137149 - protein, 25 aa, Mycobacterium
AANAAPTLPLPLAPVAPRDDRDEPP

SEQ ID NO: 1137150 - protein, 22 aa, Mycobacterium
AANGLLVDSWMCAISGRAKQFG

SEQ ID NO: 1137151 - protein, 26 aa, Mycobacterium
AANLPTILYSLYWRRFNTRGALWSMY

SEQ ID NO: 1137152 - protein, 18 aa, Mycobacterium
AAPLLWSILVGLGLSVFS

SEQ ID NO: 1137153 - protein, 30 aa, Mycobacterium
AAPPPPPAPALPPPPPPAPAPPVEPVPPPP

SEQ ID NO: 1137154 - protein, 26 aa, Mycobacterium
AAPTTVAILMLLPLAAFEATGALPGA

SEQ ID NO: 1137155 - protein, 17 aa, Mycobacterium
AAPVALLGFLVALTLKQ

SEQ ID NO: 1137156 - protein, 17 aa, Mycobacterium
AAPVVVWGAWPFHQAAW

SEQ ID NO: 1137157 - protein, 20 aa, Mycobacterium
AAPWHELLVDVDPSRIVLEI

SEQ ID NO: 1137158 - protein, 19 aa, Mycobacterium
AAQARERLGFVMPGEIPYQ

SEQ ID NO: 1137159 - protein, 20 aa, Mycobacterium
AAQFRLELRLLLRNGEQLLL

SEQ ID NO: 1137160 - protein, 23 aa, Mycobacterium
AAQGLRWWCITTLGHQWNTRVVV

SEQ ID NO: 1137161 - protein, 22 aa, Mycobacterium
AAQLDELLRWLNDDPRGWSRLR

SEQ ID NO: 1137162 - protein, 23 aa, Mycobacterium
AAQLPFSFWLSRAMSGPSPVSAL

SEQ ID NO: 1137163 - protein, 22 aa, Mycobacterium
AAQLVVEALESMAALAGAQAPS

SEQ ID NO: 1137164 - protein, 20 aa, Mycobacterium
AAQNLSPRPPADPATRLLVE

SEQ ID NO: 1137165 - protein, 19 aa, Mycobacterium
AAQPLLWSVLIGIGMSAFS

SEQ ID NO: 1137166 - protein, 26 aa, Mycobacterium
AAQVFRLLSCIYAFGFQLAVNPDLEH

SEQ ID NO: 1137167 - protein, 31 aa, Mycobacterium
AAQVPLWIGPILLYILLPALDLKFGPDGQNP

SEQ ID NO: 1137168 - protein, 17 aa, Mycobacterium
AARGRVFGFHRAMDTFG

SEQ ID NO: 1137169 - protein, 21 aa, Mycobacterium
AARGWPVRTFSKPVSLRDRLP

SEQ ID NO: 1137170 - protein, 30 aa, Mycobacterium
AARIQLIALVGFLMLLKAVAYWLDRYELLS

SEQ ID NO: 1137171 - protein, 39 aa, Mycobacterium
AARLGLFTMACAAGTFALIMIFAQLRFAPSNHYDAQFVN

SEQ ID NO: 1137172 - protein, 19 aa, Mycobacterium
AARLLTWRASWMAATGVPF

SEQ ID NO: 1137173 - protein, 23 aa, Mycobacterium
AARQSVVTLMSLDFNKAEEDVQR

SEQ ID NO: 1137174 - protein, 34 aa, Mycobacterium
AARRAMMLPLLLFGLLIFGLFQKTYPGLSEPRLW

SEQ ID NO: 1137175 - protein, 34 aa, Mycobacterium
AARRAMMLPLLLFGLLIFGLFRESFPGLHPERLL

SEQ ID NO: 1137176 - protein, 25 aa, Mycobacterium
AARRQWPVLVGRWLFHGALGAVVAV

SEQ ID NO: 1137177 - protein, 31 aa, Mycobacterium
AASAVLPFLPMLPGQILLNNLLYDTSQLAIP

SEQ ID NO: 1137178 - protein, 17 aa, Mycobacterium
AASGFVVFVLWLALGRY

SEQ ID NO: 1137179 - protein, 36 aa, Mycobacterium
AASIPDFWFAITGVWLFAVLLGWLPTSGTDAGMLSW

SEQ ID NO: 1137180 - protein, 31 aa, Mycobacterium
AASPRRPRRWGLPLIATVAALLLAAALTVST

SEQ ID NO: 1137181 - protein, 21 aa, Mycobacterium
AASVSFMRMFGLGLTLAVLVD

SEQ ID NO: 1137182 - protein, 19 aa, Mycobacterium
AASWLWVITLAGVCLWGAR

SEQ ID NO: 1137183 - protein, 21 aa, Mycobacterium
AASYLVRWLASVDGRTFTVVW

SEQ ID NO: 1137184 - protein, 31 aa, Mycobacterium
AATFGGWLLAAFAVRPFKRLAQQTRQIEAGG

SEQ ID NO: 1137185 - protein, 21 aa, Mycobacterium
AATIAILVVALAAVNYLSADV

SEQ ID NO: 1137186 - protein, 32 aa, Mycobacterium
AATLITVLVAWDLIGHLPLPLGVAGHEGSTIV

SEQ ID NO: 1137187 - protein, 22 aa, Mycobacterium
AATLVLVAFGLLASGIAVTSIM

SEQ ID NO: 1137188 - protein, 25 aa, Mycobacterium
AATMAAWLMLWVGLPLMARRGTRAD

SEQ ID NO: 1137189 - protein, 20 aa, Mycobacterium
AATMWLSLIVLLPLAAILWQ

SEQ ID NO: 1137190 - protein, 24 aa, Mycobacterium
AATNALYWPSFVGAALIVMSNPVS

SEQ ID NO: 1137191 - protein, 20 aa, Mycobacterium
AATYFLVTPLIVLTGTAVAM

SEQ ID NO: 1137192 - protein, 25 aa, Mycobacterium
AAVAALTQLTMTRAMFAGNVGVNGT

SEQ ID NO: 1137193 - protein, 28 aa, Mycobacterium
AAVAAWLITRAWQMPPVLDLSVAAVAVR

SEQ ID NO: 1137194 - protein, 26 aa, Mycobacterium
AAVATVWLLAARRFSRWQRVAHLSAL

SEQ ID NO: 1137195 - protein, 19 aa, Mycobacterium
AAVCFIGFLCPLWDRRRQT

SEQ ID NO: 1137196 - protein, 19 aa, Mycobacterium
AAVGAALFAGYGRGAETAT

SEQ ID NO: 1137197 - protein, 26 aa, Mycobacterium
AAVGFCLLPLLLRWDTRRAAGTLLAY

SEQ ID NO: 1137198 - protein, 31 aa, Mycobacterium
AAVGFCMGGGMVWRLLAAGEPRLAAAVPFYG

SEQ ID NO: 1137199 - protein, 26 aa, Mycobacterium
AAVIAVTAALVWWTSDARATISQPAE

SEQ ID NO: 1137200 - protein, 20 aa, Mycobacterium
AAVILVWVYAFESAAGYLPS

SEQ ID NO: 1137201 - protein, 28 aa, Mycobacterium
AAVIVVAIGLLIRAMMRGWHSRAQRQVK

SEQ ID NO: 1137202 - protein, 17 aa, Mycobacterium
AAVNGDRRALLAGAAPA

SEQ ID NO: 1137203 - protein, 20 aa, Mycobacterium
AAVPASFRAGYGEYLRTAGV

SEQ ID NO: 1137204 - protein, 21 aa, Mycobacterium
AAVRDMFGWIGPVLAALHGNA

SEQ ID NO: 1137205 - protein, 23 aa, Mycobacterium
AAVTLLTTPLYQANTRLFVSTSS

SEQ ID NO: 1137206 - protein, 26 aa, Mycobacterium
AAVVAIIVIGVIVFLARRARNQRRAQ

SEQ ID NO: 1137207 - protein, 33 aa, Mycobacterium
AAVVIAAVLVLGFWKPGFFVTTKLDVNAAQNGV

SEQ ID NO: 1137208 - protein, 20 aa, Mycobacterium
AAVVWVFMPALFGVALSAAV

SEQ ID NO: 1137209 - protein, 22 aa, Mycobacterium
AAWALLYLIHRRNVAAQPYFED

SEQ ID NO: 1137210 - protein, 38 aa, Mycobacterium
AAWSWRLLLILGAIVTLLWLILRLEIIVVPVALATILA

SEQ ID NO: 1137211 - protein, 17 aa, Mycobacterium
AAYDAAYAEYLRLQQSA

SEQ ID NO: 1137212 - protein, 23 aa, Mycobacterium
AAYVVAAILFILALAGLSKHETS

SEQ ID NO: 1137213 - protein, 27 aa, Mycobacterium
ACAFAETYWQLLLFRSLGGIGSAMFTV

SEQ ID NO: 1137214 - protein, 23 aa, Mycobacterium
ACASLYVAHLLGGGLTFTAIAVG

SEQ ID NO: 1137215 - protein, 27 aa, Mycobacterium
ACEKGASRWWLIAAGVAIGFGFLTKML

SEQ ID NO: 1137216 - protein, 26 aa, Mycobacterium
ACLCSLVGCWVLLRGNVFLGEAMTHG

SEQ ID NO: 1137217 - protein, 18 aa, Mycobacterium
ACLGLFVVFFVGMIVSGA

SEQ ID NO: 1137218 - protein, 20 aa, Mycobacterium
ACLRAGLIALVLLGVLALII

SEQ ID NO: 1137219 - protein, 18 aa, Mycobacterium
ACLVALILILPLAALSDR

SEQ ID NO: 1137220 - protein, 27 aa, Mycobacterium
ADDVVHPGWVDAYWRAFQSGAHTAGGS

SEQ ID NO: 1137221 - protein, 24 aa, Mycobacterium
ADELFNIFLIIALVTAMLGALREM

SEQ ID NO: 1137222 - protein, 31 aa, Mycobacterium
ADEQFPLLTFGSPLRRLYARNFPAYFGRKSL

SEQ ID NO: 1137223 - protein, 22 aa, Mycobacterium
ADFISLLPHTRAVSQRRQLLAA

SEQ ID NO: 1137224 - protein, 25 aa, Mycobacterium
ADFQLWQLLVFIPIAAVLGAQVGYW

SEQ ID NO: 1137225 - protein, 22 aa, Mycobacterium
ADGARVLAPAPASRAAVEAVAG

SEQ ID NO: 1137226 - protein, 25 aa, Mycobacterium
ADGDYDRPIIRPGLRETAEIADAVE

SEQ ID NO: 1137227 - protein, 25 aa, Mycobacterium
ADGIVFLLVSVLLLVGVRPALRRRL

SEQ ID NO: 1137228 - protein, 30 aa, Mycobacterium
ADGSPSWPLTLLVVLSYPSGIDVGLQDTLV

SEQ ID NO: 1137229 - protein, 20 aa, Mycobacterium
ADIWRRADLPRDGKAPVLLQ

SEQ ID NO: 1137230 - protein, 25 aa, Mycobacterium
ADLLPPLWHLVGWTVGVAAASYLVR

SEQ ID NO: 1137231 - protein, 23 aa, Mycobacterium
ADNKREFKPALEKLNLVLDNLLE

SEQ ID NO: 1137232 - protein, 25 aa, Mycobacterium
ADPDEPRVLLLVDAIGPFREQYEHV

SEQ ID NO: 1137233 - protein, 30 aa, Mycobacterium
ADQQPVPPPPPFPQGAPPSAPGPGAEPPKE

SEQ ID NO: 1137234 - protein, 19 aa, Mycobacterium
ADQTAYFDTDFFDVLRDQF

SEQ ID NO: 1137235 - protein, 27 aa, Mycobacterium
ADRTGRFWTWTIGGYFLTVVTVPFLGA

SEQ ID NO: 1137236 - protein, 29 aa, Mycobacterium
ADRVFVEARWLSVLLLSAGLAGFCVHATL

SEQ ID NO: 1137237 - protein, 18 aa, Mycobacterium
ADRWGWQLFVMYGATEAT

SEQ ID NO: 1137238 - protein, 25 aa, Mycobacterium
ADSGTPWVLYTIIGISAAVIVAAVP

SEQ ID NO: 1137239 - protein, 18 aa, Mycobacterium
ADSILLSRGRIPEYVLVG

SEQ ID NO: 1137240 - protein, 22 aa, Mycobacterium
ADTAYLGRPLSVGGGLAGFDFR

SEQ ID NO: 1137241 - protein, 27 aa, Mycobacterium
ADVFVPDLLSVWRILHSLPTARAVTAR

SEQ ID NO: 1137242 - protein, 23 aa, Mycobacterium
ADVLRRQRLWADKPLLVCDRTRL

SEQ ID NO: 1137243 - protein, 23 aa, Mycobacterium
ADVPFLIFVLCLGVVVAAVMRNG

SEQ ID NO: 1137244 - protein, 18 aa, Mycobacterium
ADVRIAHPLISRAHLVLR

SEQ ID NO: 1137245 - protein, 27 aa, Mycobacterium
ADVVVAVLVALWVLPRAISLARAALRI

SEQ ID NO: 1137246 - protein, 19 aa, Mycobacterium
ADYPAPAGQYWVPRRLGGG

SEQ ID NO: 1137247 - protein, 23 aa, Mycobacterium
AEAISLLKRLGLTPIMVTGDNEA

SEQ ID NO: 1137248 - protein, 30 aa, Mycobacterium
AEASIGWGLYLVIAFILLQAAVSVVVLLFD

SEQ ID NO: 1137249 - protein, 22 aa, Mycobacterium
AEASLFIYLTHYQVYPLFGDQR

SEQ ID NO: 1137250 - protein, 31 aa, Mycobacterium
AEAYGLRPAPFLLGLAFAALGLGLSAVFVRE

SEQ ID NO: 1137251 - protein, 25 aa, Mycobacterium
AEDLLLLVAGYFLASIPLYGLVGLA

SEQ ID NO: 1137252 - protein, 17 aa, Mycobacterium
AEDSVDFVLLLEDLRDW

SEQ ID NO: 1137253 - protein, 21 aa, Mycobacterium
AEEPSFFEKLFANKTPTLDHR

SEQ ID NO: 1137254 - protein, 25 aa, Mycobacterium
AEFAFLGWHWSLPLGVAILFAAVAG

SEQ ID NO: 1137255 - protein, 18 aa, Mycobacterium
AEIQQLFARAFTDGLRDP

SEQ ID NO: 1137256 - protein, 26 aa, Mycobacterium
AELNDTWWRIPLLLLLSFGNGWAEEV

SEQ ID NO: 1137257 - protein, 23 aa, Mycobacterium
AEMLKMFGLGQRTGVGLPGESSG

SEQ ID NO: 1137258 - protein, 22 aa, Mycobacterium
AENPAVRVLFGPPLALDDPGGF

SEQ ID NO: 1137259 - protein, 27 aa, Mycobacterium
AENPEPGDWLYFVTVDMQGTTLFTREY

SEQ ID NO: 1137260 - protein, 18 aa, Mycobacterium
AENYLRLNALGAYGSFFN

SEQ ID NO: 1137261 - protein, 17 aa, Mycobacterium
AEPTRVLARWQPSWLRY

SEQ ID NO: 1137262 - protein, 20 aa, Mycobacterium
AEPYLLWVPAVLLILTGVVL

SEQ ID NO: 1137263 - protein, 22 aa, Mycobacterium
AEQIMPLLVVAIMSQLVFSGGM

SEQ ID NO: 1137264 - protein, 36 aa, Mycobacterium
AERMKFGTWLLFGGIWVTLVYFPLSHMVWGGGLLSN

SEQ ID NO: 1137265 - protein, 18 aa, Mycobacterium
AERNPFVIGLAGITVTAG

SEQ ID NO: 1137266 - protein, 25 aa, Mycobacterium
AERRLGTFRWLVVGAAAHVTGTYLG

SEQ ID NO: 1137267 - protein, 17 aa, Mycobacterium
AERRYVWVPDATGSLFF

SEQ ID NO: 1137268 - protein, 23 aa, Mycobacterium
AESPELPLPRLPIAEYDPATGTY

SEQ ID NO: 1137269 - protein, 23 aa, Mycobacterium
AETELFAPFQRLGDQDTSSGVGL

SEQ ID NO: 1137270 - protein, 24 aa, Mycobacterium
AETLPILIVGFTAQVLMGALTQLL

SEQ ID NO: 1137271 - protein, 20 aa, Mycobacterium
AETNLRFLLGRAATIEVPLI

SEQ ID NO: 1137272 - protein, 18 aa, Mycobacterium
AEVLWPHTWDRVLGRSVD

SEQ ID NO: 1137273 - protein, 30 aa, Mycobacterium
AEWAPATLLIVATLTILAPGALLSAVTPMV

SEQ ID NO: 1137274 - protein, 18 aa, Mycobacterium
AEWFTLSKVALSWCIIIY

SEQ ID NO: 1137275 - protein, 27 aa, Mycobacterium
AEYGDRVNFVLRYFPLRSHFNAERAAR

SEQ ID NO: 1137276 - protein, 17 aa, Mycobacterium
AFAMLRFSTFTTAIFEQ

SEQ ID NO: 1137277 - protein, 24 aa, Mycobacterium
AFAVLAVLPLLALPLVPVHARAGR

SEQ ID NO: 1137278 - protein, 18 aa, Mycobacterium
AFCGCLYAGAIAVPAALP

SEQ ID NO: 1137279 - protein, 44 aa, Mycobacterium
AFDVLAPVAAVAALLYIGVALGWPLWWVSVCSVLCVLVAEGVVV

SEQ ID NO: 1137280 - protein, 19 aa, Mycobacterium
AFGALVWIFQDGHLSGLGT

SEQ ID NO: 1137281 - protein, 19 aa, Mycobacterium
AFGALVWIFQDGNLGALGT

SEQ ID NO: 1137282 - protein, 19 aa, Mycobacterium
AFGGYFYWDDLILVGRAGT

SEQ ID NO: 1137283 - protein, 26 aa, Mycobacterium
AFGIGPLVQLFLRLTPNRVLAVSGWA

SEQ ID NO: 1137284 - protein, 30 aa, Mycobacterium; identical to SEQ ID NO: 348989

SEQ ID NO: 1137285 - protein, 18 aa, Mycobacterium
AFGLILAGAALSQNPWRS

SEQ ID NO: 1137286 - protein, 28 aa, Mycobacterium
AFGRDTSSGWLPWALGGLFVAGLAGLAP

SEQ ID NO: 1137287 - protein, 26 aa, Mycobacterium
AFGRGPLKWIYLTLGGLMAATMVDMY

SEQ ID NO: 1137288 - protein, 26 aa, Mycobacterium
AFIAWGLITALFIEQGWLQGIFAELK

SEQ ID NO: 1137289 - protein, 19 aa, Mycobacterium
AFIIVYLPNRLLGVHFLGI

SEQ ID NO: 1137290 - protein, 22 aa, Mycobacterium
AFLPPALAWPLAVVAVAASVAI

SEQ ID NO: 1137291 - protein, 23 aa, Mycobacterium
AFLPPHVIPYFGLIPLALGLWAA

SEQ ID NO: 1137292 - protein, 31 aa, Mycobacterium
AFLPPHVIPYFGLIPLALGLWAAWRAWRGND

SEQ ID NO: 1137293 - protein, 26 aa, Mycobacterium
AFLVMPGLALAFLVAAPVGLWRRIGT

SEQ ID NO: 1137294 - protein, 26 aa, Mycobacterium
AFSHARRARRIMLQNVGLSLALIIVL

SEQ ID NO: 1137295 - protein, 23 aa, Mycobacterium
AFVIGRLLTLRSGLIKGAAEWPA

SEQ ID NO: 1137296 - protein, 21 aa, Mycobacterium
AFVLLVLVLLFRPTGILGESL

SEQ ID NO: 1137297 - protein, 17 aa, Mycobacterium
AFVRLFVALSFTALVIY

SEQ ID NO: 1137298 - protein, 25 aa, Mycobacterium
AGAGLALGGLIAFWQSRRHRRKNAA

SEQ ID NO: 1137299 - protein, 23 aa, Mycobacterium
AGAKAWYLVASRKPIRRFLSGGA

SEQ ID NO: 1137300 - protein, 17 aa, Mycobacterium
AGALFVFTFAQAYLGEG

SEQ ID NO: 1137301 - protein, 23 aa, Mycobacterium
AGAMLCLSFTRLPYFQTMGVPCA

SEQ ID NO: 1137302 - protein, 24 aa, Mycobacterium
AGAQPLNPITRLSSLFTTREIGVV

SEQ ID NO: 1137303 - protein, 20 aa, Mycobacterium
AGAVWALTALTIVMTVTVAV

SEQ ID NO: 1137304 - protein, 28 aa, Mycobacterium
AGAYVMWGLFPAFFPLLKPAGAVEILAH

SEQ ID NO: 1137305 - protein, 25 aa, Mycobacterium
AGCLILTATLPWPSVLAGAAMFAIG

SEQ ID NO: 1137306 - protein, 25 aa, Mycobacterium
AGFGLSAPFLIYGAALLVAATVVFV

SEQ ID NO: 1137307 - protein, 26 aa, Mycobacterium
AGFHDGFFFFAIVLSALSVIPLGSGI

SEQ ID NO: 1137308 - protein, 21 aa, Mycobacterium
AGFTTLVFAQFFNVFNSRSET

SEQ ID NO: 1137309 - protein, 24 aa, Mycobacterium
AGFVLFALTFIVNALARAAAGGRV

SEQ ID NO: 1137310 - protein, 20 aa, Mycobacterium
AGGAVTFSIVRRSTQPEPSP

SEQ ID NO: 1137311 - protein, 26 aa, Mycobacterium
AGGCLALAWWQWTRWESTTGSFQNLG

SEQ ID NO: 1137312 - protein, 30 aa, Mycobacterium
AGGFYLAFLFPLIGFLVVVLRKVWKPASFS

SEQ ID NO: 1137313 - protein, 24 aa, Mycobacterium
AGGGPAVLLLPKDVQQAALGRNGV

SEQ ID NO: 1137314 - protein, 32 aa, Mycobacterium
AGGLLFNYFLGMPYWLGVVLIAAIAVAYTGTG

SEQ ID NO: 1137315 - protein, 23 aa, Mycobacterium
AGGLLIALGFLFAGYEIADTGND

SEQ ID NO: 1137316 - protein, 26 aa, Mycobacterium
AGGMLLSLYVVPSLKYPASPPALSLD

SEQ ID NO: 1137317 - protein, 20 aa, Mycobacterium
AGGVAWLLGASRVADLCWVA

SEQ ID NO: 1137318 - protein, 25 aa, Mycobacterium
AGGVSWLVAIFTLVKALSGAGVGLA

SEQ ID NO: 1137319 - protein, 26 aa, Mycobacterium
AGGWLLLIGVTLSCAGLLWSDRITAG

SEQ ID NO: 1137320 - protein, 30 aa, Mycobacterium
AGHLGFTPLPWQFFAALVALTIGYLVLVDV

SEQ ID NO: 1137321 - protein, 17 aa, Mycobacterium
AGIAFFTRIVENSLRSV

SEQ ID NO: 1137322 - protein, 22 aa, Mycobacterium
AGIAFIFRPLLFTSVNSKVAEA

SEQ ID NO: 1137323 - protein, 23 aa, Mycobacterium
AGIAIPVFAFFAAGVSIGGLSGL

SEQ ID NO: 1137324 - protein, 29 aa, Mycobacterium
AGIAVLMLLGLPFLGVRWGLPDDRVLPQS

SEQ ID NO: 1137325 - protein, 37 aa, Mycobacterium
AGICALLALPALRGRPWIPVWLNLATLAGVMLTQMTL

SEQ ID NO: 1137326 - protein, 23 aa, Mycobacterium
AGIGFIPFVIALGIGLGLSSALV

SEQ ID NO: 1137327 - protein, 28 aa, Mycobacterium
AGILGLILAVFGFFGIGPIVSSFTRAAG

SEQ ID NO: 1137328 - protein, 17 aa, Mycobacterium
AGILLLVMIGGCLYCAH

SEQ ID NO: 1137329 - protein, 18 aa, Mycobacterium
AGIMLVLGIVGPGGLAGA

SEQ ID NO: 1137330 - protein, 29 aa, Mycobacterium
AGISKSRWLRWPARIYTDIFRGLPEVVII

SEQ ID NO: 1137331 - protein, 24 aa, Mycobacterium
AGITYFTVFALFPLTMVGFSIGGF

SEQ ID NO: 1137332 - protein, 27 aa, Mycobacterium
AGKLAVLVVPIWWAAGHSALMVAFALL

SEQ ID NO: 1137333 - protein, 30 aa, Mycobacterium
AGLALKTLLGVPVWLGPLAVGAIVIMNVVA

SEQ ID NO: 1137334 - protein, 19 aa, Mycobacterium
AGLAPALVWSSRAGRRPQP

SEQ ID NO: 1137335 - protein, 18 aa, Mycobacterium
AGLAWAFLIGVIVMIGAF

SEQ ID NO: 1137336 - protein, 32 aa, Mycobacterium
AGLFTAVIQPPLLLFVTVPGAYFLFHGSEIHG

SEQ ID NO: 1137337 - protein, 30 aa, Mycobacterium; identical to SEQ ID NO: 349278

SEQ ID NO: 1137338 - protein, 24 aa, Mycobacterium
AGLLGFAAFWIFLSANSSAAVTAR

SEQ ID NO: 1137339 - protein, 33 aa, Mycobacterium
AGLLLCASFPPIGWWFTAILAFAVFGWVLTRNS

SEQ ID NO: 1137340 - protein, 22 aa, Mycobacterium
AGLLLVVALSILTVPIAGAVGT

SEQ ID NO: 1137341 - protein, 43 aa, Mycobacterium
AGLSFLHFAAAMSLPWLAAIAVEFVLLRWFFAKDLAVEPRRAA

SEQ ID NO: 1137342 - protein, 30 aa, Mycobacterium
AGLSFTHFAALMTLPWLAAIIGEYILLRAL

SEQ ID NO: 1137343 - protein, 30 aa, Mycobacterium
AGLSLLGWCSFLLLWVLQACVFWRGMESIR

SEQ ID NO: 1137344 - protein, 21 aa, Mycobacterium
AGLTRMFFDVPAQRIAIVMLM

SEQ ID NO: 1137345 - protein, 30 aa, Mycobacterium
AGLVMSIGYMGLPSLLFGIGRYQVAMELPT

SEQ ID NO: 1137346 - protein, 28 aa, Mycobacterium
AGLVNPVFWLGMMIALAAAFLAAYPVNR

SEQ ID NO: 1137347 - protein, 19 aa, Mycobacterium
AGLVTMLCGFRSRLYAERW

SEQ ID NO: 1137348 - protein, 19 aa, Mycobacterium
AGLYYWWVGDLDPDKTWPV

SEQ ID NO: 1137349 - protein, 25 aa, Mycobacterium
AGMFVMLGWGLFQIYVLGEPLQAES

SEQ ID NO: 1137350 - protein, 22 aa, Mycobacterium
AGMVPPLAMALATTIRPGLFSE

SEQ ID NO: 1137351 - protein, 53 aa, Mycobacterium
AGPAAALRIWDGGLGIWGAVALGGIGAWIACRRRGIPLPAFGDAIAPGIVLAQ

SEQ ID NO: 1137352 - protein, 17 aa, Mycobacterium
AGPLLAGLLVQYAPQPL

SEQ ID NO: 1137353 - protein, 24 aa, Mycobacterium
AGPPVMVSPWMPSGAPYPGAQYGP

SEQ ID NO: 1137354 - protein, 25 aa, Mycobacterium
AGPRAQLPFPVNSLPQPGDLPNDGN

SEQ ID NO: 1137355 - protein, 32 aa, Mycobacterium
AGPSRRYLTFALLLLVWMFSLLVIAMTLIPDG

SEQ ID NO: 1137356 - protein, 23 aa, Mycobacterium
AGQFLASQLVVVAVVLVAVAAVS

SEQ ID NO: 1137357 - protein, 22 aa, Mycobacterium
AGQLIFAWTVLSVRLLAARPHA

SEQ ID NO: 1137358 - protein, 20 aa, Mycobacterium
AGQLLLGIAVMALLAVVLAL

SEQ ID NO: 1137359 - protein, 24 aa, Mycobacterium
AGQRRRLLLARALISPFPVVLLDE

SEQ ID NO: 1137360 - protein, 30 aa, Mycobacterium
AGREMWVCGPLGWLTVLLAGLCGALAVPGA

SEQ ID NO: 1137361 - protein, 24 aa, Mycobacterium
AGRGWTMILIALTMPALSIAIFAN

SEQ ID NO: 1137362 - protein, 19 aa, Mycobacterium
AGRKLVIAAAVASAVFVGA

SEQ ID NO: 1137363 - protein, 25 aa, Mycobacterium
AGRMAVAWLITLPAAGIVGALSFWL

SEQ ID NO: 1137364 - protein, 24 aa, Mycobacterium
AGSGWLWTLFVPVALGLPLTITFV

SEQ ID NO: 1137365 - protein, 19 aa, Mycobacterium
AGSIAVVGWLVAGGALGGT

SEQ ID NO: 1137366 - protein, 26 aa, Mycobacterium
AGSMAIGLFFAFWSWVGFETTAVYGE

SEQ ID NO: 1137367 - protein, 25 aa, Mycobacterium
AGSPGWIMGLLIVAALTSLAALVLT

SEQ ID NO: 1137368 - protein, 26 aa, Mycobacterium
AGSSFLLNWPIWADGIVFLLVSVLLL

SEQ ID NO: 1137369 - protein, 25 aa, Mycobacterium
AGSTAWLLMMLVSPATRAAARLLTP

SEQ ID NO: 1137370 - protein, 26 aa, Mycobacterium
AGSYPLLLVFGFFLGIAGTVFAVGIP

SEQ ID NO: 1137371 - protein, 31 aa, Mycobacterium
AGTMLLRLCMLPGLALLIWAVPRVARHVGAS

SEQ ID NO: 1137372 - protein, 18 aa, Mycobacterium
AGTTILLLALSVAATLLG

SEQ ID NO: 1137373 - protein, 39 aa, Mycobacterium
AGVALKMLWPSSPRWLGVPLYILLGWVAVWFIGPIAHGA

SEQ ID NO: 1137374 - protein, 33 aa, Mycobacterium
AGVFTFLIAPMFVRLLKFFPPVVTGTLITIIGL

SEQ ID NO: 1137375 - protein, 33 aa, Mycobacterium
AGVIFPVVGWWLYDIFYITPFLAIPYLHSVNRE

SEQ ID NO: 1137376 - protein, 21 aa, Mycobacterium
AGVIVVIPLYCIAVLAAFAAT

SEQ ID NO: 1137377 - protein, 22 aa, Mycobacterium
AGVIVVIPLYCVAVMMAFLAAR

SEQ ID NO: 1137378 - protein, 18 aa, Mycobacterium
AGVLAFVAGMPQLGVAIF

SEQ ID NO: 1137379 - protein, 34 aa, Mycobacterium
AGVLFMAIRRQRVSLRPLWGIDARLKKFGMMAVA

SEQ ID NO: 1137380 - protein, 20 aa, Mycobacterium
AGVLTVAVLLLATRGLHIDG

SEQ ID NO: 1137381 - protein, 25 aa, Mycobacterium
AGVMTILFGVVARLPFALAAGLGIN

SEQ ID NO: 1137382 - protein, 23 aa, Mycobacterium
AGVPLLIRRRTALPLLVVAAAAV

SEQ ID NO: 1137383 - protein, 21 aa, Mycobacterium
AGWAFSWLYAKSGSLVAPMLA

SEQ ID NO: 1137384 - protein, 18 aa, Mycobacterium
AGWFIYPGVGFIGLLFVV

SEQ ID NO: 1137385 - protein, 31 aa, Mycobacterium
AGWVVAVPVPLLLIWAPSWSWVLAANVLLGV

SEQ ID NO: 1137386 - protein, 20 aa, Mycobacterium
AGYLAGPLGLAAWAIGLVLG

SEQ ID NO: 1137387 - protein, 24 aa, Mycobacterium
AHESNFVLMFLTAVPALLVLIEFG

SEQ ID NO: 1137388 - protein, 23 aa, Mycobacterium
AHGTFFFHFPSKEHVLLELERRE

SEQ ID NO: 1137389 - protein, 19 aa, Mycobacterium
AHHGLGLALVAQVAARHGG

SEQ ID NO: 1137390 - protein, 32 aa, Mycobacterium
AHLLDTLAVFVGWLWPLWDRRRRTFADLLAGT

SEQ ID NO: 1137391 - protein, 24 aa, Mycobacterium
AHPGARFAVIAFASRPAIEWPLSE

SEQ ID NO: 1137392 - protein, 22 aa, Mycobacterium
AHYFTPVIHVLIALTVYSAARI

SEQ ID NO: 1137393 - protein, 17 aa, Mycobacterium
AHYTYWYDHPPAGWLQL

SEQ ID NO: 1137394 - protein, 28 aa, Mycobacterium
AIAAAFAVLFLPYSLLGPFAGALLDRWD

SEQ ID NO: 1137395 - protein, 23 aa, Mycobacterium
AIAAPRRVLVVALLIMVGCGIFG

SEQ ID NO: 1137396 - protein, 17 aa, Mycobacterium
AIAGPALLGFAYGESIR

SEQ ID NO: 1137397 - protein, 17 aa, Mycobacterium
AIALVVSAVLLILGGLG

SEQ ID NO: 1137398 - protein, 21 aa, Mycobacterium
AIALWALSRTVGAPFGPSAGE

SEQ ID NO: 1137399 - protein, 38 aa, Mycobacterium
AIATIIIVGVILVLLLRALLAPLYLLGTVVLNYLASLG

SEQ ID NO: 1137400 - protein, 22 aa, Mycobacterium
AIATWLLDRFGTWVPIAVYLAG

SEQ ID NO: 1137401 - protein, 19 aa, Mycobacterium
AIAVSTVVQMLFGELFPKN

SEQ ID NO: 1137402 - protein, 17 aa, Mycobacterium
AIAWLLLLVCSPATRAA

SEQ ID NO: 1137403 - protein, 25 aa, Mycobacterium
AIFDNIKKFLRYLLSSNMGEVFTVF

SEQ ID NO: 1137404 - protein, 27 aa, Mycobacterium
AIFFVLSGFLLFRPWVRAAAPGMPGPS

SEQ ID NO: 1137405 - protein, 18 aa, Mycobacterium
AIFLPIMVLVIGSFQPYL

SEQ ID NO: 1137406 - protein, 32 aa, Mycobacterium
AIGAALVLLVVVVAFGLWLGVRALDAKSSLEQ

SEQ ID NO: 1137407 - protein, 21 aa, Mycobacterium
AIGAILLWVYVIETAVGYLPG

SEQ ID NO: 1137408 - protein, 20 aa, Mycobacterium
AIGALMLIPGVIGRGPESIN

SEQ ID NO: 1137409 - protein, 23 aa, Mycobacterium
AIGGWILLLTFLFAVQNVDDVTA

SEQ ID NO: 1137410 - protein, 22 aa, Mycobacterium
AIGIFVFFLVVAAPFREASSLA

SEQ ID NO: 1137411 - protein, 17 aa, Mycobacterium
AIGRPLIRLSYLNELRN

SEQ ID NO: 1137412 - protein, 30 aa, Mycobacterium
AIGWRTRRWRLLWIPWAVVVGGAFAVTAYE

SEQ ID NO: 1137413 - protein, 32 aa, Mycobacterium; identical to SEQ ID NO: 349613

SEQ ID NO: 1137414 - protein, 21 aa, Mycobacterium
AILASLWLWFTVNGYLSARRR

SEQ ID NO: 1137415 - protein, 26 aa, Mycobacterium
AILGSIAAPKLKWLAAGVGGGLTFAA

SEQ ID NO: 1137416 - protein, 17 aa, Mycobacterium
AIMSVVLALGVRRMAAR

SEQ ID NO: 1137417 - protein, 23 aa, Mycobacterium
AINFWAWNMIGPLSTTYAGDLSL

SEQ ID NO: 1137418 - protein, 21 aa, Mycobacterium
AINFWAWNMIGPLSTTYAGDM

SEQ ID NO: 1137419 - protein, 18 aa, Mycobacterium
AINTYFLFAVAGSVCLMV

SEQ ID NO: 1137420 - protein, 21 aa, Mycobacterium
AIPFTLFFEVPMLQLGLYQYY

SEQ ID NO: 1137421 - protein, 19 aa, Mycobacterium
AIPLKHPWRWLAAAAIIVL

SEQ ID NO: 1137422 - protein, 26 aa, Mycobacterium
AIPLLAAIVPAPRLWPHSWPFVAQVL

SEQ ID NO: 1137423 - protein, 30 aa, Mycobacterium
AIPLSFVVLVWVFGGLLAAALPLAVGAFAI

SEQ ID NO: 1137424 - protein, 26 aa, Mycobacterium
AIPVAALGMLNPMLAGAAMAFSSVFV

SEQ ID NO: 1137425 - protein, 27 aa, Mycobacterium
AIQTILVIVWVLLNLGAFAWQWDPYPF

SEQ ID NO: 1137426 - protein, 17 aa, Mycobacterium
AIRKVFPARLAFHLVRL

SEQ ID NO: 1137427 - protein, 21 aa, Mycobacterium
AIRNWLVDYLVTNIGCSPDEI

SEQ ID NO: 1137428 - protein, 19 aa, Mycobacterium
AIRTLLELAPPMAVVLRDG

SEQ ID NO: 1137429 - protein, 18 aa, Mycobacterium
AISFVILFILRAIGARAA

SEQ ID NO: 1137430 - protein, 17 aa, Mycobacterium
AISPQLSWLWPSGLDVS

SEQ ID NO: 1137431 - protein, 28 aa, Mycobacterium
AISYGVYLWHWPIFLVLNGERTGIEGWE

SEQ ID NO: 1137432 - protein, 21 aa, Mycobacterium
AITLFMGMILLARATGVQVAE

SEQ ID NO: 1137433 - protein, 22 aa, Mycobacterium
AITLLFMAALARIPLGTASALE

SEQ ID NO: 1137434 - protein, 20 aa, Mycobacterium
AITTWVVAAIVGPPLFREHL

SEQ ID NO: 1137435 - protein, 31 aa, Mycobacterium
AIVHSIVLLGVVYLLSGPVSQIPLAALAGVL

SEQ ID NO: 1137436 - protein, 32 aa, Mycobacterium
AIVHSIVLLGVVYLLSGPVSQIPLAALAGVLM

SEQ ID NO: 1137437 - protein, 19 aa, Mycobacterium
AIVLALWIPEREPAPYGRH

SEQ ID NO: 1137438 - protein, 36 aa, Mycobacterium
AIVLRDLRIPAIGVVLLLLSSLIVGAGWPLVVEQIS

SEQ ID NO: 1137439 - protein, 28 aa, Mycobacterium
AIVPAHQLWPHSWPFVAQVLTAILVADF

SEQ ID NO: 1137440 - protein, 23 aa, Mycobacterium
AIVSMQYSFLPSWLSFLVDKENA

SEQ ID NO: 1137441 - protein, 17 aa, Mycobacterium
AIWLGMASLVVAGIIGW

SEQ ID NO: 1137442 - protein, 19 aa, Mycobacterium
AIWNPYVAERLLQGHWSLL

SEQ ID NO: 1137443 - protein, 22 aa, Mycobacterium
AIYAVGLILLALALIQTRRIVR

SEQ ID NO: 1137444 - protein, 17 aa, Mycobacterium
AIYGFLATYIAEKFFPP

SEQ ID NO: 1137445 - protein, 17 aa, Mycobacterium
AIYLYNFLGLDSLAESV

SEQ ID NO: 1137446 - protein, 27 aa, Mycobacterium
AKDFYLPGIWMYLAMAVLFTGSIVVGR

SEQ ID NO: 1137447 - protein, 24 aa, Mycobacterium
AKFWTLLEIIPNLTLIVVLGFGAY

SEQ ID NO: 1137448 - protein, 25 aa, Mycobacterium
AKFWTLLEIIPNLTLIVVLGFGAYA

SEQ ID NO: 1137449 - protein, 31 aa, Mycobacterium
AKGVGLHVHLPQPLPPLWADEQRLSQVLGNL

SEQ ID NO: 1137450 - protein, 33 aa, Mycobacterium
AKHPWPDHRPPRAPVWVFVYGVTSVLLGALPLA

SEQ ID NO: 1137451 - protein, 17 aa, Mycobacterium
AKLFLFDLGTLDGIFRV

SEQ ID NO: 1137452 - protein, 18 aa, Mycobacterium
AKLFLFDLGTLDGIFRVT

SEQ ID NO: 1137453 - protein, 27 aa, Mycobacterium
AKLWSVIPRLFVWPPARSIAQLLERVS

SEQ ID NO: 1137454 - protein, 25 aa, Mycobacterium
AKPVEQMFWYRSTKFVMRRSIPIGV

SEQ ID NO: 1137455 - protein, 26 aa, Mycobacterium
AKTNDPWYTSLWHTIADAPHGVSPMA

SEQ ID NO: 1137456 - protein, 30 aa, Mycobacterium
AKVDYADILYYSAPWMLILGLAMSGITSYV

SEQ ID NO: 1137457 - protein, 30 aa, Mycobacterium
ALAARKRIAWWILLLYMVAAVGWNVADLLT

SEQ ID NO: 1137458 - protein, 30 aa, Mycobacterium
ALAARKRIAWWILVGYMIAAAGWNIAGLAE

SEQ ID NO: 1137459 - protein, 20 aa, Mycobacterium
ALAGLLFALQGFGAVSGSPM

SEQ ID NO: 1137460 - protein, 28 aa, Mycobacterium
ALAIIKPKFPARVRLFLLTLAVVDDVGA

SEQ ID NO: 1137461 - protein, 21 aa, Mycobacterium
ALAIPVLLLVVHGPLATNILN

SEQ ID NO: 1137462 - protein, 26 aa, Mycobacterium
ALAISTLIFLVILYVATPSVCHALVH

SEQ ID NO: 1137463 - protein, 17 aa, Mycobacterium
ALALARHIEPLGLALLV

SEQ ID NO: 1137464 - protein, 25 aa, Mycobacterium
ALANCSWLFAWHYNLFPLSMLLMVV

SEQ ID NO: 1137465 - protein, 20 aa, Mycobacterium
ALAPLGLLGSRLIFAHLFVV

SEQ ID NO: 1137466 - protein, 27 aa, Mycobacterium
ALARAAYLSLPVFALGAVVLLVRSSGG

SEQ ID NO: 1137467 - protein, 17 aa, Mycobacterium
ALARFTLRHKALVIGVW

SEQ ID NO: 1137468 - protein, 23 aa, Mycobacterium
ALATSIVPTWKAASRPPIRSLAS

SEQ ID NO: 1137469 - protein, 31 aa, Mycobacterium
ALAVIALLSLFYLFPTLLGVFSRLYVPQLLI

SEQ ID NO: 1137470 - protein, 18 aa, Mycobacterium
ALAVLCTGLLFTPIGLTQ

SEQ ID NO: 1137471 - protein, 19 aa, Mycobacterium
ALAVLCTGLLFTPIGLTQT

SEQ ID NO: 1137472 - protein, 20 aa, Mycobacterium
ALAVLCTGLLFTPIGLTQTE

SEQ ID NO: 1137473 - protein, 33 aa, Mycobacterium
ALAVSLLGGWGIRRRLMRQTRGLRPEELRVMYD

SEQ ID NO: 1137474 - protein, 21 aa, Mycobacterium
ALAWWQWTRWESTTGSFQNLG

SEQ ID NO: 1137475 - protein, 26 aa, Mycobacterium
ALAYLAIFFVVPFYSLARTSLSETAG

SEQ ID NO: 1137476 - protein, 30 aa, Mycobacterium
ALDGLGLPGWGALKLALPRSGNADASYLAA

SEQ ID NO: 1137477 - protein, 19 aa, Mycobacterium
ALDLDALIGGFRPVFQSLE

SEQ ID NO: 1137478 - protein, 32 aa, Mycobacterium
ALDVLLFYVFFEAMLIPMYFLIGGFGSGPSQD

SEQ ID NO: 1137479 - protein, 27 aa, Mycobacterium
ALDYTAPLFAFLFLVALGVDYTIFLVT

SEQ ID NO: 1137480 - protein, 20 aa, Mycobacterium
ALEHCYAYSDSITDLPMLEA

SEQ ID NO: 1137481 - protein, 19 aa, Mycobacterium
ALELFAYLTEAINARRADP

SEQ ID NO: 1137482 - protein, 25 aa, Mycobacterium
ALFGRNIMFLAVLFAIGMNAYVYFN

SEQ ID NO: 1137483 - protein, 17 aa, Mycobacterium
ALFLQGTILLVAVLGIL

SEQ ID NO: 1137484 - protein, 18 aa, Mycobacterium
ALFLQGTILLVAVLGILL

SEQ ID NO: 1137485 - protein, 18 aa, Mycobacterium
ALFVFTFAQAYLGEGTTL

SEQ ID NO: 1137486 - protein, 47 aa, Mycobacterium
ALFVIPAVMTYPWQTVAQRWLLGVAIAVVVVLFASWRGRFVTAIFGR

SEQ ID NO: 1137487 - protein, 21 aa, Mycobacterium
ALFVLFFASWGLHALGGAAAF

SEQ ID NO: 1137488 - protein, 18 aa, Mycobacterium
ALGARWLPVSGHPSLIVA

SEQ ID NO: 1137489 - protein, 23 aa, Mycobacterium
ALGGFLIGAGIGWLVQRRRGDAG

SEQ ID NO: 1137490 - protein, 25 aa, Mycobacterium
ALGLALAWLTTLWATAMLAGPRRIW

SEQ ID NO: 1137491 - protein, 17 aa, Mycobacterium
ALGPLTIDMYLPALPKI

SEQ ID NO: 1137492 - protein, 23 aa, Mycobacterium
ALGRLRFVALYLFSALGGSVLVY

SEQ ID NO: 1137493 - protein, 20 aa, Mycobacterium
ALGSWLPAVLWGVAFAILLR

SEQ ID NO: 1137494 - protein, 25 aa, Mycobacterium
ALGVATLILIWRLARKESAQPAISG

SEQ ID NO: 1137495 - protein, 23 aa, Mycobacterium
ALGVPVWTILRWLHIGGAEVWAF

SEQ ID NO: 1137496 - protein, 24 aa, Mycobacterium
ALGVPVWTIVRWLWIGGSDVWTLG

SEQ ID NO: 1137497 - protein, 25 aa, Mycobacterium
ALGVYLLMWVGYVQGWVWLAGIDAD

SEQ ID NO: 1137498 - protein, 20 aa, Mycobacterium
ALGWRPPLAGLALGAVIIAL

SEQ ID NO: 1137499 - protein, 29 aa, Mycobacterium
ALHPAWWTLILLVVLVTIVMVTSAMFAGT

SEQ ID NO: 1137500 - protein, 20 aa, Mycobacterium
ALHSTFRWLLSAAAALWIVA

SEQ ID NO: 1137501 - protein, 19 aa, Mycobacterium
ALIAVLPDLAFGVGGQMRA

SEQ ID NO: 1137502 - protein, 17 aa, Mycobacterium
ALIDGDLRRPTLHKYLD

SEQ ID NO: 1137503 - protein, 35 aa, Mycobacterium
ALIGAALLVWRLRWAAQPFWLSPAIFAVTAGILLA

SEQ ID NO: 1137504 - protein, 24 aa, Mycobacterium
ALIGAFYLFTLVLGYGAAALVGPD

SEQ ID NO: 1137505 - protein, 20 aa, Mycobacterium
ALILAIAVAVLLPKPGDDGL

SEQ ID NO: 1137506 - protein, 27 aa, Mycobacterium
ALILVAIGIVLFFINRLINRRLGVRDT

SEQ ID NO: 1137507 - protein, 17 aa, Mycobacterium
ALIMFLAALSMGRLSVR

SEQ ID NO: 1137508 - protein, 26 aa, Mycobacterium
ALIPLILIAFGVLWPVVFHGGSSASE

SEQ ID NO: 1137509 - protein, 22 aa, Mycobacterium
ALIVFAYVLLFMPRALVNVRAG

SEQ ID NO: 1137510 - protein, 22 aa, Mycobacterium
ALIVFGPRETLFTSDWVLLAYP

SEQ ID NO: 1137511 - protein, 26 aa, Mycobacterium
ALLLAPEVFWPLRRVGAAFHSAQDGK

SEQ ID NO: 1137512 - protein, 32 aa, Mycobacterium
ALLLDATIIRMFLVPAIMKLLGDDCWWAPRWM

SEQ ID NO: 1137513 - protein, 21 aa, Mycobacterium
ALLLLVPTVHRRNVPGWLAAV

SEQ ID NO: 1137514 - protein, 26 aa, Mycobacterium
ALLLQIYVVMGAGWVWHRGLQGEPVP

SEQ ID NO: 1137515 - protein, 18 aa, Mycobacterium
ALLLSPAAVLAAALLMAT

SEQ ID NO: 1137516 - protein, 50 aa, Mycobacterium
ALLRTLHVILGWRPVLLLPLTFALFTPLAVPGFAWWAAALNSLPMLAALA

SEQ ID NO: 1137517 - protein, 20 aa, Mycobacterium
ALLSFWDWFLDHAHIIAAVA

SEQ ID NO: 1137518 - protein, 28 aa, Mycobacterium
ALLSLFSFMFLLFGLLLIFTAVQLFRHR

SEQ ID NO: 1137519 - protein, 19 aa, Mycobacterium
ALLTFLLLAGAGASLPLLS

SEQ ID NO: 1137520 - protein, 23 aa, Mycobacterium
ALLVLFTLIFLLHGGRNIFGFIT

SEQ ID NO: 1137521 - protein, 17 aa, Mycobacterium
ALLVTVCILPALQFGFW

SEQ ID NO: 1137522 - protein, 20 aa, Mycobacterium
ALLVVFFLSYNDFLFAVYLA

SEQ ID NO: 1137523 - protein, 21 aa, Mycobacterium
ALLVVFFLSYNDFLFAVYLAV

SEQ ID NO: 1137524 - protein, 17 aa, Mycobacterium
ALLVWFWPRLLADGMAV

SEQ ID NO: 1137525 - protein, 17 aa, Mycobacterium
ALMILTVIGIPLLALLV

SEQ ID NO: 1137526 - protein, 17 aa, Mycobacterium
ALMLLGIPPLLAGTYSG

SEQ ID NO: 1137527 - protein, 21 aa, Mycobacterium
ALMLMAWLWLGRRVVDRTATE

SEQ ID NO: 1137528 - protein, 18 aa, Mycobacterium
ALMSWRARPKLAITDGSL

SEQ ID NO: 1137529 - protein, 17 aa, Mycobacterium
ALMWAFLGAGIGSVARP

SEQ ID NO: 1137530 - protein, 22 aa, Mycobacterium
ALMWGEWGFVLLFGVLAVAPVS

SEQ ID NO: 1137531 - protein, 31 aa, Mycobacterium
ALNWQPLTLLIDTLLRWPNISIGLSQVALVA

SEQ ID NO: 1137532 - protein, 20 aa, Mycobacterium
ALPGFTPMLLPDVGRTNIVP

SEQ ID NO: 1137533 - protein, 28 aa, Mycobacterium
ALPGVFYVLLWVGLVALSVLLGPVWRVL

SEQ ID NO: 1137534 - protein, 19 aa, Mycobacterium
ALPITLAGILPAIALVLAL

SEQ ID NO: 1137535 - protein, 17 aa, Mycobacterium
ALPKAAPKPAAPPPPPE

SEQ ID NO: 1137536 - protein, 19 aa, Mycobacterium
ALPLTDFAPVVIPLDSVEV

SEQ ID NO: 1137537 - protein, 24 aa, Mycobacterium
ALPLVAVIGALWWLGREETTREPE

SEQ ID NO: 1137538 - protein, 25 aa, Mycobacterium
ALPMRGFMFVTRPLLRGLNAAANWC

SEQ ID NO: 1137539 - protein, 47 aa, Mycobacterium
ALPWVMGGCMLGMIAILIFGGMRNFSPYMLMMPMMVVMGAVGMMAGG

SEQ ID NO: 1137540 - protein, 31 aa, Mycobacterium; identical to SEQ ID NO: 350080

SEQ ID NO: 1137541 - protein, 28 aa, Mycobacterium
ALREYRVWFFHRLLLVTPVVTLYFWGLA

SEQ ID NO: 1137542 - protein, 40 aa, Mycobacterium
ALREYRVWFFHRLLWITPVVTLYFWVLAVALGLFVLPDIP

SEQ ID NO: 1137543 - protein, 18 aa, Mycobacterium
ALRTFKWMLGFSAVAAVL

SEQ ID NO: 1137544 - protein, 23 aa, Mycobacterium
ALRVDPAKVTVLPSAARGTEIAS

SEQ ID NO: 1137545 - protein, 19 aa, Mycobacterium
ALRVPRVMELLAVVPTMAA

SEQ ID NO: 1137546 - protein, 38 aa, Mycobacterium
ALSALLIQRLRPYALGLLILVVTVLRPGYLPVPFVIAA

SEQ ID NO: 1137547 - protein, 31 aa, Mycobacterium
ALSAVLSGLLLNYFLIAPRHTFTIAEPDSAL

SEQ ID NO: 1137548 - protein, 24 aa, Mycobacterium
ALSIAALGLLPAALILGSYGAQGL

SEQ ID NO: 1137549 - protein, 17 aa, Mycobacterium
ALSTTFARPGHRAHHAT

SEQ ID NO: 1137550 - protein, 31 aa, Mycobacterium
ALSVGEQFWLVWPLLFLLVGLLKARKAAVAA

SEQ ID NO: 1137551 - protein, 25 aa, Mycobacterium
ALSVLLGIPFWVAVLIVLGVQGVVG

SEQ ID NO: 1137552 - protein, 17 aa, Mycobacterium
ALTAALWVFIALAGLWL

SEQ ID NO: 1137553 - protein, 37 aa, Mycobacterium
ALTAFSIMAFNYMKLPNLLFGIGRYSVTLQLPEAGGL

SEQ ID NO: 1137554 - protein, 22 aa, Mycobacterium
ALTGVVCFVGFLASYLFNVYFQ

SEQ ID NO: 1137555 - protein, 20 aa, Mycobacterium
ALTHEGILAIRWRLPSGTEI

SEQ ID NO: 1137556 - protein, 26 aa, Mycobacterium
ALTIYTQLFTTDAGWRRAVLAMVGAL

SEQ ID NO: 1137557 - protein, 26 aa, Mycobacterium
ALTMTIPLTIISFVIGLVIALGVALA

SEQ ID NO: 1137558 - protein, 17 aa, Mycobacterium
ALTQLLPMLVGRGPAEH

SEQ ID NO: 1137559 - protein, 19 aa, Mycobacterium
ALTTIPALRRGGRPVIDYA

SEQ ID NO: 1137560 - protein, 21 aa, Mycobacterium
ALTTMFRMLLGPTTLDRLVAL

SEQ ID NO: 1137561 - protein, 20 aa, Mycobacterium
ALTVLYLGIAMLFAMLVSGG

SEQ ID NO: 1137562 - protein, 28 aa, Mycobacterium
ALTVQGWQYLVLSVMGFVVLTGGIMVAV

SEQ ID NO: 1137563 - protein, 17 aa, Mycobacterium
ALTYFPPLWRHVMDHRV

SEQ ID NO: 1137564 - protein, 31 aa, Mycobacterium
ALVAIVITGLWLWLRYDALLLVVATQILQML

SEQ ID NO: 1137565 - protein, 18 aa, Mycobacterium
ALVELLRNPSLAATLGAA

SEQ ID NO: 1137566 - protein, 17 aa, Mycobacterium
ALVGFMFIGRMTGDRLV

SEQ ID NO: 1137567 - protein, 19 aa, Mycobacterium
ALVGLAAGLALHRLDRRGH

SEQ ID NO: 1137568 - protein, 17 aa, Mycobacterium
ALVGVLVLVNGLLSGSE

SEQ ID NO: 1137569 - protein, 20 aa, Mycobacterium
ALVITLLLPLPPVPVEGRLH

SEQ ID NO: 1137570 - protein, 19 aa, Mycobacterium
ALVLHLAFTAAVFAVTYWL

SEQ ID NO: 1137571 - protein, 20 aa, Mycobacterium
ALVLLMVLATRGGPRRRAEV

SEQ ID NO: 1137572 - protein, 20 aa, Mycobacterium
ALVLVLLAVPVTMILLKQST

SEQ ID NO: 1137573 - protein, 17 aa, Mycobacterium
ALVPVGATILLILSAAN

SEQ ID NO: 1137574 - protein, 20 aa, Mycobacterium
ALVTLLGGLIVLLAGVTGLG

SEQ ID NO: 1137575 - protein, 24 aa, Mycobacterium
ALVTLLVCLYPILPVRIGAGGGGY

SEQ ID NO: 1137576 - protein, 22 aa, Mycobacterium
ALVVAALIGVVLFTAGDDQDGT

SEQ ID NO: 1137577 - protein, 24 aa, Mycobacterium
ALVVLAPAWSRRLTGRGWPKPVAD

SEQ ID NO: 1137578 - protein, 20 aa, Mycobacterium
ALVVVFGEFRFASGNSYHAN

SEQ ID NO: 1137579 - protein, 19 aa, Mycobacterium
ALWFTGLGFGAKRLRHLFA

SEQ ID NO: 1137580 - protein, 28 aa, Mycobacterium
ALWGKSLIGSVIFLVDFLGNFFQYHLPG

SEQ ID NO: 1137581 - protein, 34 aa, Mycobacterium
ALWTLSLIHLRLSLIPILLGLLIAVPLGALVQRT

SEQ ID NO: 1137582 - protein, 19 aa, Mycobacterium
AMAFAFLVYAVVQAVRAGG

SEQ ID NO: 1137583 - protein, 20 aa, Mycobacterium
AMAKLFLFDLGTLDGIFRVT

SEQ ID NO: 1137584 - protein, 23 aa, Mycobacterium
AMATMRIAFLSALVLELLATLGV

SEQ ID NO: 1137585 - protein, 27 aa, Mycobacterium
AMATTLFHWTLHPWAIYAVVGLAIAYG

SEQ ID NO: 1137586 - protein, 27 aa, Mycobacterium
AMFAVCWAWINFSWFASAYDTDDWPYR

SEQ ID NO: 1137587 - protein, 25 aa, Mycobacterium
AMFKPPFQWREFLLQTWFVARVSMV

SEQ ID NO: 1137588 - protein, 17 aa, Mycobacterium
AMKAYLMGALFGILLML

SEQ ID NO: 1137589 - protein, 17 aa, Mycobacterium
AMLLFYATPIVFGFANL

SEQ ID NO: 1137590 - protein, 27 aa, Mycobacterium
AMMVMLVLYPTVMLLSRFLGPVLDGWS

SEQ ID NO: 1137591 - protein, 24 aa, Mycobacterium
AMSVTWQDTPVVLGGWRSEGADTK

SEQ ID NO: 1137592 - protein, 27 aa, Mycobacterium
AMTDWLFSHTLYRHPKLKIGLSEGGIG

SEQ ID NO: 1137593 - protein, 18 aa, Mycobacterium
AMTFLNPHVYLDTVILLG

SEQ ID NO: 1137594 - protein, 17 aa, Mycobacterium
AMTLVVLAYLWLDRWEP

SEQ ID NO: 1137595 - protein, 24 aa, Mycobacterium
AMTLYLWHIVAIAIAAFGLHALGV

SEQ ID NO: 1137596 - protein, 20 aa, Mycobacterium
AMVFNLFFINLVTVGLHSYA

SEQ ID NO: 1137597 - protein, 23 aa, Mycobacterium
AMVLFPMHFLKSFAYAGVATVAF

SEQ ID NO: 1137598 - protein, 23 aa, Mycobacterium
AMWARFPLPVIPAPGDPTPSAQP

SEQ ID NO: 1137599 - protein, 34 aa, Mycobacterium
ANAVVLWIGLPFALWFFLIRPWVREKRITLDGML

SEQ ID NO: 1137600 - protein, 28 aa, Mycobacterium
ANFDDFFRPIRNYFYWEPHCYNIPVCWA

SEQ ID NO: 1137601 - protein, 28 aa, Mycobacterium
ANIRRRPARFMLAVLGIALAIACVTVVR

SEQ ID NO: 1137602 - protein, 28 aa, Mycobacterium
ANIRRRPARFVLAVLGIALAIACVTVVR

SEQ ID NO: 1137603 - protein, 24 aa, Mycobacterium
ANLLPGQFLQPFIDSAFSDLGVDP

SEQ ID NO: 1137604 - protein, 25 aa, Mycobacterium
ANPILGWIIGWISFTFLAVVVCAVD

SEQ ID NO: 1137605 - protein, 20 aa, Mycobacterium
ANPLPEVWVDPLRLAQVIGN

SEQ ID NO: 1137606 - protein, 23 aa, Mycobacterium
ANRDAWMVGFTPSLSTAVWVGTT

SEQ ID NO: 1137607 - protein, 17 aa, Mycobacterium
ANRIAHRWMFTGAVPSG

SEQ ID NO: 1137608 - protein, 19 aa, Mycobacterium
ANRLVLPVATGWTLGRALF

SEQ ID NO: 1137609 - protein, 40 aa, Mycobacterium
ANSGWWPLLWFTVKVWLFLFFFMWLRATLPRMRYDQFMAL

SEQ ID NO: 1137610 - protein, 19 aa, Mycobacterium
ANYYRWFGTPEAPFGWYYD

SEQ ID NO: 1137611 - protein, 23 aa, Mycobacterium
APAARILSIRVSSPRYAPRDAGE

SEQ ID NO: 1137612 - protein, 25 aa, Mycobacterium
APADDPPVWPFIVGACVAVGAAALW

SEQ ID NO: 1137613 - protein, 22 aa, Mycobacterium
APAGPTQAAAPLGKLGVRDVLF

SEQ ID NO: 1137614 - protein, 19 aa, Mycobacterium
APAGQYWVPRRLGGGAPTL

SEQ ID NO: 1137615 - protein, 26 aa, Mycobacterium
APARDKPIPVAPRPQAPALAMDGRGF

SEQ ID NO: 1137616 - protein, 39 aa, Mycobacterium
APATIRVRSPRPAAPPPRRQPHRRLVAAVALGGLAVVLA

SEQ ID NO: 1137617 - protein, 28 aa, Mycobacterium
APAYVPPPPPANYLPPAPAAPAYVPPAQ

SEQ ID NO: 1137618 - protein, 17 aa, Mycobacterium
APDAALLGIRQSSNKFG

SEQ ID NO: 1137619 - protein, 27 aa, Mycobacterium
APDGTPLWPGLPPAPPPMAPRDPGPTP

SEQ ID NO: 1137620 - protein, 21 aa, Mycobacterium
APELLWVLLCAIGAVSALALY

SEQ ID NO: 1137621 - protein, 31 aa, Mycobacterium
APGNYRKLVRLGAYGSWLNQYLCGLSVRVTD

SEQ ID NO: 1137622 - protein, 19 aa, Mycobacterium
APGPIPYPGAPPYGAPLYG

SEQ ID NO: 1137623 - protein, 25 aa, Mycobacterium
APGTFGYLIGFYGAAGIMLASGAVL

SEQ ID NO: 1137624 - protein, 23 aa, Mycobacterium
APHPLRTPYAVVAVICLVVGVGV

SEQ ID NO: 1137625 - protein, 26 aa, Mycobacterium
APHSLWVWIGVFGIAVVVLVVGWRGA

SEQ ID NO: 1137626 - protein, 27 aa, Mycobacterium
APIAEVLLDTYFQPGKLPDSLSDMLRG

SEQ ID NO: 1137627 - protein, 26 aa, Mycobacterium
APKTGLPIFPASLLLGLIAVGFALRD

SEQ ID NO: 1137628 - protein, 19 aa, Mycobacterium
APLAERACMLYAGTTLVAG

SEQ ID NO: 1137629 - protein, 17 aa, Mycobacterium
APLGITPAGVFMVTGPP

SEQ ID NO: 1137630 - protein, 29 aa, Mycobacterium
APLGVCYLPAFLCLGIVPVVVGLAGDVLQ

SEQ ID NO: 1137631 - protein, 20 aa, Mycobacterium
APLILIGLPVDVASALALTV

SEQ ID NO: 1137632 - protein, 17 aa, Mycobacterium
APLLAIGALWGTLFVGC

SEQ ID NO: 1137633 - protein, 18 aa, Mycobacterium
APMLFGTRALVLVRLLVP

SEQ ID NO: 1137634 - protein, 22 aa, Mycobacterium
APMLTHFFWGLVMVLALPPIFG

SEQ ID NO: 1137635 - protein, 22 aa, Mycobacterium
APNPLALIGFVLLLTSIELQVR

SEQ ID NO: 1137636 - protein, 18 aa, Mycobacterium
APNSSVFAVAFHGILRAG

SEQ ID NO: 1137637 - protein, 17 aa, Mycobacterium
APPFRLPGYVTDQAGAL

SEQ ID NO: 1137638 - protein, 28 aa, Mycobacterium
APPILALMMPWLFLRVRFFRRKWTAVTL

SEQ ID NO: 1137639 - protein, 26 aa, Mycobacterium
APPPAPATPPPPLSPGGRTAVRVLLI

SEQ ID NO: 1137640 - protein, 30 aa, Mycobacterium
APPTTPVPPYPYPPYAQYGSPYYAPPQRVV

SEQ ID NO: 1137641 - protein, 19 aa, Mycobacterium
APPVVAPVVVPPPVIVLPR

SEQ ID NO: 1137642 - protein, 33 aa, Mycobacterium
APPVVLPEVPSDLPLPALLSPDATPPSDGTSPA

SEQ ID NO: 1137643 - protein, 21 aa, Mycobacterium
APPVYVPPAPAYVPPPAPVAP

SEQ ID NO: 1137644 - protein, 24 aa, Mycobacterium
APQPLDLVFAVHIAMAVLAGVAVF

SEQ ID NO: 1137645 - protein, 18 aa, Mycobacterium
APQPPFAWREFIFQMWFV

SEQ ID NO: 1137646 - protein, 20 aa, Mycobacterium
APRRWVVRVVLLGVATISGV

SEQ ID NO: 1137647 - protein, 26 aa, Mycobacterium
APRSLWVWIGVFGVAVVVLMVGWRGA

SEQ ID NO: 1137648 - protein, 38 aa, Mycobacterium
APRSPMSHVKVALIAGLVGVLALAGLTAWMGYRTYEAN

SEQ ID NO: 1137649 - protein, 20 aa, Mycobacterium
APSPLLKGGLAFIDTPGVGG

SEQ ID NO: 1137650 - protein, 29 aa, Mycobacterium
APSRVAQMLLLFWGFGAALLTLLYGLQDS

SEQ ID NO: 1137651 - protein, 20 aa, Mycobacterium
APTLPEVPALPAAPAAEVKP

SEQ ID NO: 1137652 - protein, 24 aa, Mycobacterium
APTTPAPLLPAPQAAPPPASAAPG

SEQ ID NO: 1137653 - protein, 19 aa, Mycobacterium
APVLAHWRPVVAFAFFEII

SEQ ID NO: 1137654 - protein, 20 aa, Mycobacterium
APVNWFPLYLGAAVVVELVA

SEQ ID NO: 1137655 - protein, 26 aa, Mycobacterium
APYAAFGAFYFLMSALWLAVSAARRR

SEQ ID NO: 1137656 - protein, 17 aa, Mycobacterium
APYALVLVLLAVPVTMI

SEQ ID NO: 1137657 - protein, 23 aa, Mycobacterium
APYHLRLDWMMWFAALSPAYARD

SEQ ID NO: 1137658 - protein, 18 aa, Mycobacterium
APYRPAYPAYPAYPPASA

SEQ ID NO: 1137659 - protein, 27 aa, Mycobacterium
AQAEKWNFPIVLVILLAVFGSLAAAAM

SEQ ID NO: 1137660 - protein, 18 aa, Mycobacterium
AQAIGRLGNYFNQELYGR

SEQ ID NO: 1137661 - protein, 18 aa, Mycobacterium
AQALRWWCITTLGRQWNT

SEQ ID NO: 1137662 - protein, 23 aa, Mycobacterium
AQAPRRRGRVSEMAWQVVAAVLV

SEQ ID NO: 1137663 - protein, 19 aa, Mycobacterium
AQDPAVRTLLPDGAAAAEE

SEQ ID NO: 1137664 - protein, 20 aa, Mycobacterium
AQEALQHTALWQQVLNDGIA

SEQ ID NO: 1137665 - protein, 21 aa, Mycobacterium
AQFGSWRWAFGVLVGLTVAMG

SEQ ID NO: 1137666 - protein, 28 aa, Mycobacterium
AQGTALIDIMAWIVVFVAGVALLNTLML

SEQ ID NO: 1137667 - protein, 18 aa, Mycobacterium
AQLCVSVWFTAGPALRPG

SEQ ID NO: 1137668 - protein, 23 aa, Mycobacterium
AQLTPWNTYVRPGLPATPICSPS

SEQ ID NO: 1137669 - protein, 20 aa, Mycobacterium
AQMQPTPLPPVPLPREAAPS

SEQ ID NO: 1137670 - protein, 26 aa, Mycobacterium
AQNDTWYIVLLLPSFLVYVTAMVGET

SEQ ID NO: 1137671 - protein, 24 aa, Mycobacterium
AQNQAYGYLFPHGTFFLAGDVLGV

SEQ ID NO: 1137672 - protein, 19 aa, Mycobacterium
AQPFPLSGPELLTALDAAP

SEQ ID NO: 1137673 - protein, 22 aa, Mycobacterium
AQPPATSWWRPHVAVFAVMAAC

SEQ ID NO: 1137674 - protein, 32 aa, Mycobacterium
AQQMRPFVELRWWPLALLSALSLTLVAIAAAL

SEQ ID NO: 1137675 - protein, 31 aa, Mycobacterium
AQQPSPEPQFPWLPPAPPPRPQPRTPEPAPT

SEQ ID NO: 1137676 - protein, 18 aa, Mycobacterium
AQRPYPSAPRPSAPPTYP

SEQ ID NO: 1137677 - protein, 23 aa, Mycobacterium
AQTVKVPLRICSLRDLAKFAETQ

SEQ ID NO: 1137678 - protein, 28 aa, Mycobacterium
AQVVRILLMLFAAPFLARAVVWAGRRFG

SEQ ID NO: 1137679 - protein, 17 aa, Mycobacterium
ARAIVRDGRQRLAGAAI

SEQ ID NO: 1137680 - protein, 22 aa, Mycobacterium
ARALLRAMVCQLAAFHSPADLQ

SEQ ID NO: 1137681 - protein, 18 aa, Mycobacterium
ARARVHAARRARTGSRRR

SEQ ID NO: 1137682 - protein, 28 aa, Mycobacterium
ARASTLWGYAWPLAYLAGIGILTAIVGP

SEQ ID NO: 1137683 - protein, 34 aa, Mycobacterium
ARCIDADTRLYLPMPFFWVGGFGSGVLSALVAGA

SEQ ID NO: 1137684 - protein, 21 aa, Mycobacterium
ARDGGWLLAGDLPLDEAERTL

SEQ ID NO: 1137685 - protein, 27 aa, Mycobacterium
ARDLGQPWLLWVLLSAIGLASAAALFR

SEQ ID NO: 1137686 - protein, 19 aa, Mycobacterium
ARDLLRVAFGPSLVALVII

SEQ ID NO: 1137687 - protein, 23 aa, Mycobacterium
ARFTTFMLTVYFVLAVGSHVRAR

SEQ ID NO: 1137688 - protein, 21 aa, Mycobacterium
ARFWKTVAHHYLRMAYDALVT

SEQ ID NO: 1137689 - protein, 30 aa, Mycobacterium
ARGDTGPPWPLWAVIFITSGMVLGAAIVYG

SEQ ID NO: 1137690 - protein, 28 aa, Mycobacterium
ARGLLRLHQVFIGCFSLLYGLTALLTVV

SEQ ID NO: 1137691 - protein, 23 aa, Mycobacterium
ARGPLLRLALVEAVLFGATFGIA

SEQ ID NO: 1137692 - protein, 24 aa, Mycobacterium
ARHQAKVYGLPPLGAPPMSVPHLD

SEQ ID NO: 1137693 - protein, 51 aa, Mycobacterium
ARIDGLHWRVFWICAGVILSTLLIGWVIGLIMVNPFRLLARQARAINAQSN

SEQ ID NO: 1137694 - protein, 18 aa, Mycobacterium
ARKCFLPVMAGLVLSTLF

SEQ ID NO: 1137695 - protein, 23 aa, Mycobacterium
ARLASSGAPLWSLYPGEIPHPTG

SEQ ID NO: 1137696 - protein, 19 aa, Mycobacterium
ARLLSLYIAGGMLLSLYVV

SEQ ID NO: 1137697 - protein, 24 aa, Mycobacterium
ARMGAWLVGMGILHFAAPKPFDSI

SEQ ID NO: 1137698 - protein, 26 aa, Mycobacterium
ARNRMAFLAGVLFILALCFASTNGWW

SEQ ID NO: 1137699 - protein, 17 aa, Mycobacterium
ARQPVPPPVPAAAPYAA

SEQ ID NO: 1137700 - protein, 21 aa, Mycobacterium
ARQVALLLAPVVDVGAAVEDA

SEQ ID NO: 1137701 - protein, 20 aa, Mycobacterium
ARRFKRPPWVALPIAMFIAS

SEQ ID NO: 1137702 - protein, 17 aa, Mycobacterium
ARRGVQRRSLRTPHQHL

SEQ ID NO: 1137703 - protein, 17 aa, Mycobacterium
ARRIERWLNGSWVPFVD

SEQ ID NO: 1137704 - protein, 17 aa, Mycobacterium
ARRLVVLDFVAVVLAVG

SEQ ID NO: 1137705 - protein, 23 aa, Mycobacterium
ARRPVEFLCLLPLTIPALVIVVG

SEQ ID NO: 1137706 - protein, 26 aa, Mycobacterium
ARRQDAIGALLWRSLNPDIGPRTQIV

SEQ ID NO: 1137707 - protein, 38 aa, Mycobacterium
ARRQIRLVISDRGYFAFLMLLPFIMGVLSLSVPGDVGF

SEQ ID NO: 1137708 - protein, 21 aa, Mycobacterium
ARRRFLLRNRVRLGNGQKNLL

SEQ ID NO: 1137709 - protein, 33 aa, Mycobacterium
ARRRWTLTLIGATLFLIAVYWLAVRTATGQAVE

SEQ ID NO: 1137710 - protein, 23 aa, Mycobacterium
ARRVLHQLYLGFPDSAAARGITQ

SEQ ID NO: 1137711 - protein, 27 aa, Mycobacterium
ARSALKFFLYTFLGSLALLVGFIGLYI

SEQ ID NO: 1137712 - protein, 30 aa, Mycobacterium
ARSFTTAAIWLTVATLVVAAIIGGLAWSSR

SEQ ID NO: 1137713 - protein, 29 aa, Mycobacterium
ARVAPYLAPRWIILGAGLLVPCAMLYGST

SEQ ID NO: 1137714 - protein, 19 aa, Mycobacterium
ARVAWRRHEPRLAAYPPEG

SEQ ID NO: 1137715 - protein, 24 aa, Mycobacterium
ARVELPLAVPYILAGMRTSLVLAV

SEQ ID NO: 1137716 - protein, 34 aa, Mycobacterium
ARVLHQWRWSLTALWFTAVILLILVRFWDYWSTL

SEQ ID NO: 1137717 - protein, 20 aa, Mycobacterium
ARVLPRFSQLSLGCVAALLA

SEQ ID NO: 1137718 - protein, 21 aa, Mycobacterium
ARWMPNFIDLLQRNLTQISDP

SEQ ID NO: 1137719 - protein, 27 aa, Mycobacterium
ASADGRFYILCGYPLVAVAAYWLTTAP

SEQ ID NO: 1137720 - protein, 20 aa, Mycobacterium
ASAFSILAFIAGLGAMTGAA

SEQ ID NO: 1137721 - protein, 38 aa, Mycobacterium
ASAISAMLIYRLISWIFISAIGWVVFFFMFRTAHDVEP

SEQ ID NO: 1137722 - protein, 38 aa, Mycobacterium
ASAISAMLIYRLVSWIFLAAIGWVVFFFVFRTEKDIDP

SEQ ID NO: 1137723 - protein, 24 aa, Mycobacterium
ASALGQFIPVVWLGALGASLATLS

SEQ ID NO: 1137724 - protein, 23 aa, Mycobacterium
ASALLGSPFDAALVGGVLLANAA

SEQ ID NO: 1137725 - protein, 38 aa, Mycobacterium
ASALLPFGLLGIWAAIPFAIWFFLAIEGVPLAAEETAE

SEQ ID NO: 1137726 - protein, 19 aa, Mycobacterium
ASATPLLDGVRWTERTDAW

SEQ ID NO: 1137727 - protein, 25 aa, Mycobacterium
ASAVVLLIVLVIRPLSVFAMFGRGV

SEQ ID NO: 1137728 - protein, 30 aa, Mycobacterium
ASDVYSLACLLYESLTGRAPFEAADVRQVW

SEQ ID NO: 1137729 - protein, 43 aa, Mycobacterium
ASENSESSGLKWTWWWLLAIVPVLLLAGLAAFAVLRTRGRRGG

SEQ ID NO: 1137730 - protein, 39 aa, Mycobacterium
ASESLFFKMIPYILLTLLFGSIAVALYLRKARPDLYARI

SEQ ID NO: 1137731 - protein, 20 aa, Mycobacterium
ASFAVNWLLQWAAGGPNEPL

SEQ ID NO: 1137732 - protein, 29 aa, Mycobacterium
ASFVVAMIPLVWLIYTVLAKGVAAIVSST

SEQ ID NO: 1137733 - protein, 28 aa, Mycobacterium
ASGAMVFAILVLLGRYISYTLDLAGIAG

SEQ ID NO: 1137734 - protein, 46 aa, Mycobacterium
ASGAVMLFGLMLPWLGAVAILGAVIFGTVWLAQRRKTPAAVPVATD

SEQ ID NO: 1137735 - protein, 27 aa, Mycobacterium
ASGLIFGWLAFLIVFGFFTRKVWEIVV

SEQ ID NO: 1137736 - protein, 30 aa, Mycobacterium; identical to SEQ ID NO: 350885

SEQ ID NO: 1137737 - protein, 30 aa, Mycobacterium
ASGPRYLLSSWPWRALVWTMFGGVLSAVLL

SEQ ID NO: 1137738 - protein, 34 aa, Mycobacterium
ASGVAPAGRWLLTGVLLWSLLRTVTRSQSYAVTL

SEQ ID NO: 1137739 - protein, 26 aa, Mycobacterium
ASGVLHLLVGFIIAQLAFVGGSGNAD

SEQ ID NO: 1137740 - protein, 25 aa, Mycobacterium
ASIAGLAAIGLIVTGVMFASRGGES

SEQ ID NO: 1137741 - protein, 33 aa, Mycobacterium
ASIWMRLPDLVCALVCWLLLSREVLPRLGPAVS

SEQ ID NO: 1137742 - protein, 29 aa, Mycobacterium
ASKGYFLLGIWMSLFWAVVFTLSIVIRRP

SEQ ID NO: 1137743 - protein, 24 aa, Mycobacterium
ASLALTLFLVIVGNAAAAGPVGRP

SEQ ID NO: 1137744 - protein, 26 aa, Mycobacterium
ASLHQWLNYTLIAGGALVLLGVTAAV

SEQ ID NO: 1137745 - protein, 22 aa, Mycobacterium
ASLIAIVLVVLLASLALYGTDP

SEQ ID NO: 1137746 - protein, 22 aa, Mycobacterium
ASLIVVVFVTLVISLSVYGQSG

SEQ ID NO: 1137747 - protein, 24 aa, Mycobacterium
ASLSVCLLVLLRFDGPQDTVPVAM

SEQ ID NO: 1137748 - protein, 34 aa, Mycobacterium
ASLTLQDFAKILRARWITVAVTLVLAVLGAAAVT

SEQ ID NO: 1137749 - protein, 26 aa, Mycobacterium
ASLVVFPFVILRHARLPKPVDLPPVG

SEQ ID NO: 1137750 - protein, 25 aa, Mycobacterium
ASMYAFTAILWNLSGPVTLPFVGVE

SEQ ID NO: 1137751 - protein, 25 aa, Mycobacterium
ASPFGLIIVVLLLIAVFGLVWSMNK

SEQ ID NO: 1137752 - protein, 33 aa, Mycobacterium
ASPISWAHHWVWVVPLTIWLLHGPWRGRAGARV

SEQ ID NO: 1137753 - protein, 25 aa, Mycobacterium
ASQIVALLLSLWPFAFTGQVASTLD

SEQ ID NO: 1137754 - protein, 36 aa, Mycobacterium
ASRLLGRMCALPLTVGMLMSAALWSGTPGSADTENV

SEQ ID NO: 1137755 - protein, 28 aa, Mycobacterium
ASRLQTLRWIVVPSLVPWLITGLRLSIG

SEQ ID NO: 1137756 - protein, 21 aa, Mycobacterium
ASRLRPIRMIAAAAAAAMALL

SEQ ID NO: 1137757 - protein, 33 aa, Mycobacterium
ASRSPTAPSHPRWWFLWTTPGRILSIGMVLAAL

SEQ ID NO: 1137758 - protein, 43 aa, Mycobacterium
ASRSPTTPAHPRWFFLWTTPGRILTIGIVLAALAISSAFATST

SEQ ID NO: 1137759 - protein, 26 aa, Mycobacterium
ASSAGVLLFPQGFLKALTYAIIASVM

SEQ ID NO: 1137760 - protein, 26 aa, Mycobacterium
ASTIGFGWTVLLLAGAFLLGLALAGS

SEQ ID NO: 1137761 - protein, 28 aa, Mycobacterium
ASTLCPLLVLGIWWRGLTATGAMAGLAV

SEQ ID NO: 1137762 - protein, 25 aa, Mycobacterium
ASTPRSPLSLGPINDLLFAAFREFE

SEQ ID NO: 1137763 - protein, 29 aa, Mycobacterium
ASTVVALCLPWLLHRLGRDPAFGSGPLAT

SEQ ID NO: 1137764 - protein, 46 aa, Mycobacterium
ASVGFGVFQLTFGGPLWWLGAVNIGCGVVFLAIPRLCPLGELIAPL

SEQ ID NO: 1137765 - protein, 19 aa, Mycobacterium
ASVQSPPLMQRLRDMMNFS

SEQ ID NO: 1137766 - protein, 22 aa, Mycobacterium
ASVVAVIPLYVLCLAVSYLTTQ

SEQ ID NO: 1137767 - protein, 21 aa, Mycobacterium
ASVVRWPVPILAASTAVVMLG

SEQ ID NO: 1137768 - protein, 22 aa, Mycobacterium
ASVVRWPVPILAASTAVVMLGA

SEQ ID NO: 1137769 - protein, 26 aa, Mycobacterium
ASWSTPVWALFIPAPIAVGAGFLATL

SEQ ID NO: 1137770 - protein, 24 aa, Mycobacterium
ATAAPWAIALALLLCGIYLTQSRG

SEQ ID NO: 1137771 - protein, 30 aa, Mycobacterium
ATACLHFTRLPYFQSMGFPLAVGMIIVVAA

SEQ ID NO: 1137772 - protein, 27 aa, Mycobacterium
ATAGACIGFLWWNAAPAKIFMGDTGSL

SEQ ID NO: 1137773 - protein, 24 aa, Mycobacterium
ATALFGAWLGVVAGAWLVVGRAAA

SEQ ID NO: 1137774 - protein, 25 aa, Mycobacterium
ATALFGAWLGVVAGAWLVVGRAAAE

SEQ ID NO: 1137775 - protein, 24 aa, Mycobacterium
ATALFGAWLGVVAGSWLVVGRAAA

SEQ ID NO: 1137776 - protein, 25 aa, Mycobacterium
ATALIAFGFTIYQIFRYLSTAERLR

SEQ ID NO: 1137777 - protein, 20 aa, Mycobacterium
ATAMLAAQLLFVRPALTQRS

SEQ ID NO: 1137778 - protein, 26 aa, Mycobacterium
ATAPDRFIPVVMLPFWDVEASVKEIH

SEQ ID NO: 1137779 - protein, 18 aa, Mycobacterium
ATAYLQGFGRRPAWVLAE

SEQ ID NO: 1137780 - protein, 28 aa, Mycobacterium
ATENGFTLVIPPVLVRPEIMSGTGFLGA

SEQ ID NO: 1137781 - protein, 26 aa, Mycobacterium
ATFCLSFTRLPYFQSLGVPLALGMLV

SEQ ID NO: 1137782 - protein, 41 aa, Mycobacterium
ATFGTGFAPFFMPLALFIGALIIWMLLTPLQSRPIVNGLGA

SEQ ID NO: 1137783 - protein, 28 aa, Mycobacterium
ATGAAIVWSWVLPAAFITATIGFLVIRR

SEQ ID NO: 1137784 - protein, 30 aa, Mycobacterium
ATGADPMMRWMFWTGLLVTAIDVLIALVMT

SEQ ID NO: 1137785 - protein, 22 aa, Mycobacterium
ATGDLPIVILPGGPSGGGGAVA

SEQ ID NO: 1137786 - protein, 29 aa, Mycobacterium
ATGGVVLLGLLAAIALLVARQIVLPVRSA

SEQ ID NO: 1137787 - protein, 25 aa, Mycobacterium
ATGTPVMNLWLRALGAKIGRGVWCE

SEQ ID NO: 1137788 - protein, 33 aa, Mycobacterium
ATHSVPWNIASVIPWLGSPFKTGQQISDVVLGL

SEQ ID NO: 1137789 - protein, 26 aa, Mycobacterium
ATIVASFFFVGWFLYNAMPTGFIEFS

SEQ ID NO: 1137790 - protein, 19 aa, Mycobacterium
ATLAWSMGRLTGTPRRAST

SEQ ID NO: 1137791 - protein, 20 aa, Mycobacterium
ATLIIGVIVVVLAVVGAVLG

SEQ ID NO: 1137792 - protein, 20 aa, Mycobacterium
ATLIMLATLVTLIVVVRERE

SEQ ID NO: 1137793 - protein, 25 aa, Mycobacterium
ATLQLAFTYAPPMNAFFGSTPLGHV

SEQ ID NO: 1137794 - protein, 20 aa, Mycobacterium
ATLSAQYRRAYVSALTTYQP

SEQ ID NO: 1137795 - protein, 28 aa, Mycobacterium
ATLTTLAIFLGLANWIGAFYIVRCSECR

SEQ ID NO: 1137796 - protein, 26 aa, Mycobacterium
ATNKWVFLGIVVLAAVWWATGLKSRL

SEQ ID NO: 1137797 - protein, 17 aa, Mycobacterium
ATNWLLGSVVFIVASWP

SEQ ID NO: 1137798 - protein, 29 aa, Mycobacterium
ATPAWGESALRWLLFAGLAAAVGGLIGRH

SEQ ID NO: 1137799 - protein, 17 aa, Mycobacterium
ATPIPRRAVRGLKVLVW

SEQ ID NO: 1137800 - protein, 23 aa, Mycobacterium
ATPPRFRRPSLLTLVIVLVVGGL

SEQ ID NO: 1137801 - protein, 26 aa, Mycobacterium
ATPQLSAWFVLVNLALALVTVEIIHY

SEQ ID NO: 1137802 - protein, 20 aa, Mycobacterium
ATPVFRWGFGIWSDKYTDVN

SEQ ID NO: 1137803 - protein, 25 aa, Mycobacterium
ATSVLIDVPAGVAPLPPAVCARLRQ

SEQ ID NO: 1137804 - protein, 26 aa, Mycobacterium
ATSYTFYDYSRGWPLALLAAAFAVVV

SEQ ID NO: 1137805 - protein, 27 aa, Mycobacterium
ATTGGYIALFHTPGYMLYNFGVALYVG

SEQ ID NO: 1137806 - protein, 39 aa, Mycobacterium
ATTIMLGFAPGTWWLTWILFIPALFQVIFEIVLDFQINK

SEQ ID NO: 1137807 - protein, 23 aa, Mycobacterium
ATTIPWAVLLLAVAVAIVAGWWS

SEQ ID NO: 1137808 - protein, 23 aa, Mycobacterium
ATTLLLLGVIAITLFMGMILLAR

SEQ ID NO: 1137809 - protein, 19 aa, Mycobacterium
ATVAVFFTIQFRESARRMD

SEQ ID NO: 1137810 - protein, 17 aa, Mycobacterium
ATVLCLLLAFPLAYVIA

SEQ ID NO: 1137811 - protein, 23 aa, Mycobacterium
ATVLFLLGIFAFGGTFDPGYAGI

SEQ ID NO: 1137812 - protein, 18 aa, Mycobacterium
ATVPFILAQPAQAPPPAP

SEQ ID NO: 1137813 - protein, 20 aa, Mycobacterium
ATVVMFTAALVLAAVLVFSG

SEQ ID NO: 1137814 - protein, 21 aa, Mycobacterium
ATYIVLFTIYGAVLELSGGAR

SEQ ID NO: 1137815 - protein, 27 aa, Mycobacterium
ATYTTVVLLFLVFMVALIGGVDLGLGK

SEQ ID NO: 1137816 - protein, 23 aa, Mycobacterium
AVAAAGLFFAPLATADPATEAND

SEQ ID NO: 1137817 - protein, 28 aa, Mycobacterium
AVAAAVLWAGSWAFGPHSALAGLLAVAV

SEQ ID NO: 1137818 - protein, 20 aa, Mycobacterium
AVAALLRRLHFYAGVFVGPF

SEQ ID NO: 1137819 - protein, 25 aa, Mycobacterium
AVAAPALQWAGLVAPLLTATGIHVA

SEQ ID NO: 1137820 - protein, 23 aa, Mycobacterium
AVAASVAILIFAPALDAIIDRWL

SEQ ID NO: 1137821 - protein, 24 aa, Mycobacterium
AVACLLFPVFSPPLSPAMPPEEVA

SEQ ID NO: 1137822 - protein, 24 aa, Mycobacterium
AVADLIWLVCEYVLRVEPFPSPAD

SEQ ID NO: 1137823 - protein, 26 aa, Mycobacterium
AVAELLLVAWAVVMAMLYEPGRPYRK

SEQ ID NO: 1137824 - protein, 18 aa, Mycobacterium
AVAILGTVLLTRGSGSSV

SEQ ID NO: 1137825 - protein, 30 aa, Mycobacterium
AVAIRRLPGWPLWFAGLWSAQEWLKSAVPF

SEQ ID NO: 1137826 - protein, 29 aa, Mycobacterium
AVALADRLPHVAALFTAGLITDLLVRAIV

SEQ ID NO: 1137827 - protein, 30 aa, Mycobacterium
AVALAMASTVLWFDELRKLALRALRRSGTP

SEQ ID NO: 1137828 - protein, 28 aa, Mycobacterium
AVALCTVMYGLLLAWRRGGIGHVKLTPA

SEQ ID NO: 1137829 - protein, 22 aa, Mycobacterium
AVALQFMVMFGVAYLIVQYVQL

SEQ ID NO: 1137830 - protein, 31 aa, Mycobacterium
AVALRQSWIGWLAVTFVVASLYLGALLRLPG

SEQ ID NO: 1137831 - protein, 22 aa, Mycobacterium
AVALSLLLIVLAAGIVIATTGR

SEQ ID NO: 1137832 - protein, 18 aa, Mycobacterium
AVAMVLYVLISQVGFIVG

SEQ ID NO: 1137833 - protein, 28 aa, Mycobacterium
AVASLGLPLLFVLYLRESDVFRDLPRSA

SEQ ID NO: 1137834 - protein, 29 aa, Mycobacterium
AVASLILIFLIMVILTRAVAAAAVIVGTV

SEQ ID NO: 1137835 - protein, 25 aa, Mycobacterium
AVASLTVLRWSWTPALLAGGLMTLM

SEQ ID NO: 1137836 - protein, 24 aa, Mycobacterium
AVASLTVLRWSWTPALLAGGLVTL

SEQ ID NO: 1137837 - protein, 32 aa, Mycobacterium
AVAVGTFTPWMINLPDYWITELPRIGSATDDV

SEQ ID NO: 1137838 - protein, 26 aa, Mycobacterium
AVAVLSYWLLERPIRRWRPATVPQLP

SEQ ID NO: 1137839 - protein, 30 aa, Mycobacterium
AVAVLVLVSARLWYAALAALLVVGAGVVAQ

SEQ ID NO: 1137840 - protein, 24 aa, Mycobacterium
AVAVPAVLLYRILTCWLPVFLGWP

SEQ ID NO: 1137841 - protein, 26 aa, Mycobacterium
AVAVTAVLLVALPLMGAGVASAHAAV

SEQ ID NO: 1137842 - protein, 26 aa, Mycobacterium
AVAVTTVLLVALPLMGAGVASAHAAV

SEQ ID NO: 1137843 - protein, 27 aa, Mycobacterium
AVAVYIAMRLIVVAVLILLGRSTPDLP

SEQ ID NO: 1137844 - protein, 23 aa, Mycobacterium
AVAWYGIQTFLASAALDIVLIKL

SEQ ID NO: 1137845 - protein, 18 aa, Mycobacterium
AVCIAMASTVLWVSEIRK

SEQ ID NO: 1137846 - protein, 18 aa, Mycobacterium
AVCRVIVGVALVPRVPPL

SEQ ID NO: 1137847 - protein, 47 aa, Mycobacterium
AVDATIVRLVLVPALMAMFDEWNWWLPRWLDRILPSVDFEKPLPKAD

SEQ ID NO: 1137848 - protein, 23 aa, Mycobacterium
AVDERLLPAPGPVAPAHPTVQHD

SEQ ID NO: 1137849 - protein, 25 aa, Mycobacterium
AVDFVGWYNAHPYFEGMAPDLSGGR

SEQ ID NO: 1137850 - protein, 22 aa, Mycobacterium
AVDLAWVLWTTGTLGALFTAMT

SEQ ID NO: 1137851 - protein, 20 aa, Mycobacterium
AVDLTGFLFGDVFAVRTADL

SEQ ID NO: 1137852 - protein, 24 aa, Mycobacterium
AVDSKWYRRLRKPGFQPPRAAFPI

SEQ ID NO: 1137853 - protein, 22 aa, Mycobacterium
AVDVTVPLLVPLIVVAQLGTEM

SEQ ID NO: 1137854 - protein, 25 aa, Mycobacterium
AVEDRPVLLAFLVAALVQCDVPHPV

SEQ ID NO: 1137855 - protein, 34 aa, Mycobacterium
AVERFAPIIGGIRPGLFVSSNFLPGSPAYTYPES

SEQ ID NO: 1137856 - protein, 24 aa, Mycobacterium
AVESYGLFVFRDAIAAAGASTVPI

SEQ ID NO: 1137857 - protein, 21 aa, Mycobacterium
AVFEKLPSYAVPLFVRVVQEL

SEQ ID NO: 1137858 - protein, 24 aa, Mycobacterium
AVFGWALIPYILISAVFGFTLLEA

SEQ ID NO: 1137859 - protein, 18 aa, Mycobacterium
AVFLVWYAVYVLLGAFAT

SEQ ID NO: 1137860 - protein, 20 aa, Mycobacterium
AVFYSLSYLGFAVPAVLAFA

SEQ ID NO: 1137861 - protein, 21 aa, Mycobacterium
AVGGLIGTALWFTRPPAKAHD

SEQ ID NO: 1137862 - protein, 25 aa, Mycobacterium
AVGIFLFVPKLRRWLATAVRPRVKE

SEQ ID NO: 1137863 - protein, 33 aa, Mycobacterium
AVGLAAVLLYSLLYYRLLGVLIALSLVASGAMV

SEQ ID NO: 1137864 - protein, 18 aa, Mycobacterium
AVGLFRGSFTKTVPVTVL

SEQ ID NO: 1137865 - protein, 23 aa, Mycobacterium
AVGLLSVFRRPALARFTTFMLTV

SEQ ID NO: 1137866 - protein, 25 aa, Mycobacterium
AVGMALWLPWLIVAGVCFILTTVAG

SEQ ID NO: 1137867 - protein, 24 aa, Mycobacterium
AVGSLAIAALWLRDHWPTRVQSLV

SEQ ID NO: 1137868 - protein, 25 aa, Mycobacterium
AVGSPYVVLVALLGLVVAMLNRLKV

SEQ ID NO: 1137869 - protein, 26 aa, Mycobacterium
AVGYGAACYLLFLAVFLYAIGFVGDV

SEQ ID NO: 1137870 - protein, 20 aa, Mycobacterium
AVHHAITPLIRDLGAPAWAA

SEQ ID NO: 1137871 - protein, 43 aa, Mycobacterium
AVHQDAGLSWLLLVSVPLLALTNYWIVSHLLPIFRRVQRQIDG

SEQ ID NO: 1137872 - protein, 28 aa, Mycobacterium
AVIAAITFVLLFLLTGSVVLPLKALVLN

SEQ ID NO: 1137873 - protein, 34 aa, Mycobacterium
AVIAAVWLILVGWLSIWPFLNWWTTHFVITDRRV

SEQ ID NO: 1137874 - protein, 24 aa, Mycobacterium
AVIALLIFASLFVAGANLPALVYA

SEQ ID NO: 1137875 - protein, 31 aa, Mycobacterium
AVIDTGVARHRLLPRLMPGGDYVSTGDGTDD

SEQ ID NO: 1137876 - protein, 25 aa, Mycobacterium
AVIQPPLVLFVTVPAAYFLMHSSDI

SEQ ID NO: 1137877 - protein, 18 aa, Mycobacterium
AVIVLLKGKVWTGLVGMF

SEQ ID NO: 1137878 - protein, 26 aa, Mycobacterium
AVKAPLWPFHRWLPDAAVEATPASAV

SEQ ID NO: 1137879 - protein, 34 aa, Mycobacterium
AVLAFALLLLFGFGMIWFGILIGSLLRTVEAVNG

SEQ ID NO: 1137880 - protein, 17 aa, Mycobacterium
AVLAGYIAFFHTPKMMA

SEQ ID NO: 1137881 - protein, 19 aa, Mycobacterium
AVLAIALIASVGATAWLYF

SEQ ID NO: 1137882 - protein, 17 aa, Mycobacterium
AVLASLLPDATQPADAE

SEQ ID NO: 1137883 - protein, 18 aa, Mycobacterium
AVLCPLLVYGWLGAPELG

SEQ ID NO: 1137884 - protein, 30 aa, Mycobacterium
AVLFPVGFCLLYLLGFDLLTGVFTLVPLAL

SEQ ID NO: 1137885 - protein, 30 aa, Mycobacterium
AVLFPVGFCLLYLMGFDLLTGVFTLVPLAL

SEQ ID NO: 1137886 - protein, 28 aa, Mycobacterium
AVLGVVVFGVVVWLLVPSGDGGSTAASP

SEQ ID NO: 1137887 - protein, 28 aa, Mycobacterium
AVLGVVVIGVVVWLLVPSGDGGSTAASP

SEQ ID NO: 1137888 - protein, 17 aa, Mycobacterium
AVLIALVIVVGLQPQQL

SEQ ID NO: 1137889 - protein, 18 aa, Mycobacterium
AVLIVRPSLRWLDSGRPP

SEQ ID NO: 1137890 - protein, 19 aa, Mycobacterium
AVLLAIHIWQWTPFAVLIA

SEQ ID NO: 1137891 - protein, 31 aa, Mycobacterium
AVLLARPTGLPLPALLVPPMALSRLVLGVHY

SEQ ID NO: 1137892 - protein, 19 aa, Mycobacterium
AVLLATNFLGINTIPIAVN

SEQ ID NO: 1137893 - protein, 17 aa, Mycobacterium
AVLLFTSLGIAIAINVL

SEQ ID NO: 1137894 - protein, 24 aa, Mycobacterium
AVLLHGSWHWVFAALVVVAGALLV

SEQ ID NO: 1137895 - protein, 20 aa, Mycobacterium
AVLQFLNIAWPRVAFEQRYL

SEQ ID NO: 1137896 - protein, 26 aa, Mycobacterium
AVLRPLSRYAFALLAYAFAVTMVGTT

SEQ ID NO: 1137897 - protein, 17 aa, Mycobacterium
AVLRRVVLPQLRLAVLG

SEQ ID NO: 1137898 - protein, 19 aa, Mycobacterium
AVLSLVGTLLVGEYLAGAL

SEQ ID NO: 1137899 - protein, 18 aa, Mycobacterium
AVLVATVFGLAWTQARDT

SEQ ID NO: 1137900 - protein, 37 aa, Mycobacterium
AVLVLGVLLLVYRSAVTMLLPLVTIGSSLVIAQAVVA

SEQ ID NO: 1137901 - protein, 17 aa, Mycobacterium
AVLVPTAYLVFIVYMLL

SEQ ID NO: 1137902 - protein, 21 aa, Mycobacterium
AVLVTLAVLLPWNIATGITIA

SEQ ID NO: 1137903 - protein, 24 aa, Mycobacterium
AVLYPFFSFMTFLIAVPTGIKFFN

SEQ ID NO: 1137904 - protein, 23 aa, Mycobacterium
AVMLALFVFVVGPTVFILNLLPT

SEQ ID NO: 1137905 - protein, 28 aa, Mycobacterium
AVMLPMFPFALELLALRRLSAAAFGTLM

SEQ ID NO: 1137906 - protein, 22 aa, Mycobacterium
AVMTWPMILLAIGSVTAGGALA

SEQ ID NO: 1137907 - protein, 23 aa, Mycobacterium
AVMVLMWPLLLASAWICGISGCG

SEQ ID NO: 1137908 - protein, 28 aa, Mycobacterium
AVNNGFFYNGFASNLLPGPAIQPFLDYA

SEQ ID NO: 1137909 - protein, 19 aa, Mycobacterium
AVPASFRAGYGEYLRTAGV

SEQ ID NO: 1137910 - protein, 26 aa, Mycobacterium
AVPGIAWFAVLLELSRPRDTWRSRAG

SEQ ID NO: 1137911 - protein, 24 aa, Mycobacterium
AVPGLPPGAVPPGAPPGAVPGLPP

SEQ ID NO: 1137912 - protein, 17 aa, Mycobacterium
AVPLYLVDRGRSGSVAG

SEQ ID NO: 1137913 - protein, 21 aa, Mycobacterium
AVPPWLIAAAAGLAALTLGSV

SEQ ID NO: 1137914 - protein, 21 aa, Mycobacterium
AVPRRARLVVGVVGVGLVAVA

SEQ ID NO: 1137915 - protein, 25 aa, Mycobacterium
AVRAVGGGWWKTLFAAVIPQALPAM

SEQ ID NO: 1137916 - protein, 24 aa, Mycobacterium
AVREIPWWRRLLPGKPKPAPEPAK

SEQ ID NO: 1137917 - protein, 24 aa, Mycobacterium
AVRGYLITADLRFLKPYDEGRAAE

SEQ ID NO: 1137918 - protein, 24 aa, Mycobacterium
AVRLLFQPVLVVWALWSTGAWAAW

SEQ ID NO: 1137919 - protein, 18 aa, Mycobacterium
AVRTLLPDGAAAAEESRK

SEQ ID NO: 1137920 - protein, 20 aa, Mycobacterium
AVRVAEGLPPLWADEQRLAQ

SEQ ID NO: 1137921 - protein, 24 aa, Mycobacterium
AVSALAALAVSFYVSRRLQRSITE

SEQ ID NO: 1137922 - protein, 25 aa, Mycobacterium
AVSALAALAVSWYISRRLQRSVTEV

SEQ ID NO: 1137923 - protein, 24 aa, Mycobacterium
AVSALVAFTVSWYVSRRLQRSITE

SEQ ID NO: 1137924 - protein, 24 aa, Mycobacterium
AVSILLTPVLIRLFTRQGFGHEIR

SEQ ID NO: 1137925 - protein, 23 aa, Mycobacterium
AVSLSTHLPTIQLPPLCGDEQRL

SEQ ID NO: 1137926 - protein, 18 aa, Mycobacterium
AVSMLLWPRGATASVTRA

SEQ ID NO: 1137927 - protein, 25 aa, Mycobacterium
AVSNTCAMGMLLSKLPYNRGTATCD

SEQ ID NO: 1137928 - protein, 24 aa, Mycobacterium
AVSSWLVVVPLTFATALVLGAVVA

SEQ ID NO: 1137929 - protein, 28 aa, Mycobacterium
AVSTPGVLLLRGPFLMQGYYGRAREDCF

SEQ ID NO: 1137930 - protein, 23 aa, Mycobacterium
AVSVLLFLSVVGIAWIFIKVFKT

SEQ ID NO: 1137931 - protein, 18 aa, Mycobacterium
AVSVLVSWSLFTWMIARL

SEQ ID NO: 1137932 - protein, 36 aa, Mycobacterium
AVTAAVVALLLIVTYRSPVLWLVPLLVIGFADRVAA

SEQ ID NO: 1137933 - protein, 20 aa, Mycobacterium
AVTAFLAMALIAVSHPRSAK

SEQ ID NO: 1137934 - protein, 23 aa, Mycobacterium
AVTCLPLFRHLWSTQVIAPEHLP

SEQ ID NO: 1137935 - protein, 24 aa, Mycobacterium
AVTHLFPVEHGFWVVLGALSVLRS

SEQ ID NO: 1137936 - protein, 18 aa, Mycobacterium
AVTLTQFDPAFSGAVLII

SEQ ID NO: 1137937 - protein, 27 aa, Mycobacterium
AVTRSMLAVVFIALSPVLMVGMYIDTK

SEQ ID NO: 1137938 - protein, 26 aa, Mycobacterium
AVTRWANIWFPVRRGGIRGDWFGGVL

SEQ ID NO: 1137939 - protein, 19 aa, Mycobacterium
AVTVAYLLAMASVLALVLF

SEQ ID NO: 1137940 - protein, 24 aa, Mycobacterium
AVTVCAVLAFIRPGGELGDAPLVV

SEQ ID NO: 1137941 - protein, 31 aa, Mycobacterium
AVTVVALAVLLRRALVRPLSRLAASCRRIAE

SEQ ID NO: 1137942 - protein, 20 aa, Mycobacterium
AVTVVRRPKPLLAGSLVVLL

SEQ ID NO: 1137943 - protein, 24 aa, Mycobacterium
AVVALTLSVLLFTTVVVATARPSG

SEQ ID NO: 1137944 - protein, 24 aa, Mycobacterium
AVVFYPLHLLPFGFVAFAWQVGII

SEQ ID NO: 1137945 - protein, 20 aa, Mycobacterium
AVVGPPLFREHLHMAGVAVD

SEQ ID NO: 1137946 - protein, 28 aa, Mycobacterium
AVVGVIAVLVTVFTMWRDDPPPVVAAKL

SEQ ID NO: 1137947 - protein, 22 aa, Mycobacterium
AVVIAFYDWKSALIVTIALPLI

SEQ ID NO: 1137948 - protein, 21 aa, Mycobacterium
AVVLAVMIWSGHREASAERAY

SEQ ID NO: 1137949 - protein, 18 aa, Mycobacterium
AVVLIGPAVMWLRKRMYL

SEQ ID NO: 1137950 - protein, 21 aa, Mycobacterium
AVVLLLIGPRFIDTYVNWLWF

SEQ ID NO: 1137951 - protein, 29 aa, Mycobacterium
AVVLWIGLPIALWFFIIRPWVRERRITLD

SEQ ID NO: 1137952 - protein, 18 aa, Mycobacterium
AVVRWPGPILVATLAITL

SEQ ID NO: 1137953 - protein, 47 aa, Mycobacterium
AVVTGAHAPLWREFTRFWTVSFPVVVYRSWRWWVASGVVFYAVAAVI

SEQ ID NO: 1137954 - protein, 24 aa, Mycobacterium
AVVVMTVLYWRVAHIRPSLGFDSR

SEQ ID NO: 1137955 - protein, 20 aa, Mycobacterium
AVWALFWLGWAIVLAATFMI

SEQ ID NO: 1137956 - protein, 29 aa, Mycobacterium
AVWGMLLWLPLSILLEFLIGWLWSETGSV

SEQ ID NO: 1137957 - protein, 22 aa, Mycobacterium
AVWGYPLWMAFSNTAAIFVVSL

SEQ ID NO: 1137958 - protein, 19 aa, Mycobacterium
AVYAYLHLEGRDSLAPALI

SEQ ID NO: 1137959 - protein, 22 aa, Mycobacterium
AVYPAAGLAFGYLGWSSKHQAH

SEQ ID NO: 1137960 - protein, 28 aa, Mycobacterium
AWARIALALMRFGAVVVPLSTLLTAREL

SEQ ID NO: 1137961 - protein, 19 aa, Mycobacterium
AWFAVLLELSRPPDTARGR

SEQ ID NO: 1137962 - protein, 18 aa, Mycobacterium
AWFTGFIALMGWVCGMTG

SEQ ID NO: 1137963 - protein, 19 aa, Mycobacterium
AWGAFLFLMSLYLQGERGF

SEQ ID NO: 1137964 - protein, 18 aa, Mycobacterium
AWGLLSLFVVFPMTFYAA

SEQ ID NO: 1137965 - protein, 19 aa, Mycobacterium
AWLALCGTYGWAPGVMGAS

SEQ ID NO: 1137966 - protein, 20 aa, Mycobacterium
AWMVQYVVWALAVVGILITR

SEQ ID NO: 1137967 - protein, 19 aa, Mycobacterium
AWPIGRVVAWLLGCLVLLL

SEQ ID NO: 1137968 - protein, 19 aa, Mycobacterium
AWQWLVTEVPQRSLHNWQN

SEQ ID NO: 1137969 - protein, 28 aa, Mycobacterium
AWRDIDAFQFFYLVLPLIRGAYESTAVF

SEQ ID NO: 1137970 - protein, 18 aa, Mycobacterium
AWRRLDVAFVLGPRTRDL

SEQ ID NO: 1137971 - protein, 27 aa, Mycobacterium
AWTAAGLFLAFWLPLNNGLRPEPIIAL

SEQ ID NO: 1137972 - protein, 19 aa, Mycobacterium
AWVLRLGCLTPFVNLFWAP

SEQ ID NO: 1137973 - protein, 24 aa, Mycobacterium
AWWINMVVFLLYTAAFIMLLRKMI

SEQ ID NO: 1137974 - protein, 40 aa, Mycobacterium
AYAATIDSRWKWIAGVAGAVLLVAVICTLVILGGGDSGSV

SEQ ID NO: 1137975 - protein, 18 aa, Mycobacterium
AYAWWPQEGRYQPIQPWE

SEQ ID NO: 1137976 - protein, 20 aa, Mycobacterium
AYFYVRVIMLMFFTDRPDDA

SEQ ID NO: 1137977 - protein, 21 aa, Mycobacterium
AYFYVRVIVLMFFTDPPADAP

SEQ ID NO: 1137978 - protein, 68 aa, Mycobacterium
AYGEPRRMSSFVHGLWIVGQCIIAVIFGAGLFVAFDQLWKWNNIIALVLSVLVILGLVVGVRVVRKTE

SEQ ID NO: 1137979 - protein, 17 aa, Mycobacterium
AYHALTYGWLVSGLARA

SEQ ID NO: 1137980 - protein, 19 aa, Mycobacterium
AYLLIIEPPLYFPGAFGIA

SEQ ID NO: 1137981 - protein, 27 aa, Mycobacterium
AYLMGALFGILLMLGVTILYGLTGATR

SEQ ID NO: 1137982 - protein, 20 aa, Mycobacterium
AYLVLLFSTLGYFFPSFEGG

SEQ ID NO: 1137983 - protein, 17 aa, Mycobacterium
AYPLLSHLADHGWICVS

SEQ ID NO: 1137984 - protein, 26 aa, Mycobacterium
AYQPALEQLLVLLPPFVEGAQGGTMA

SEQ ID NO: 1137985 - protein, 18 aa, Mycobacterium
AYRTLAVAYLRLQRADPP

SEQ ID NO: 1137986 - protein, 26 aa, Mycobacterium
AYSGDTWRLWSFPWDARETGFHTITV

SEQ ID NO: 1137987 - protein, 17 aa, Mycobacterium
AYSLLEVVVVVVAALMA

SEQ ID NO: 1137988 - protein, 24 aa, Mycobacterium
AYSTSPQMLILTRALLGMAGATLT

SEQ ID NO: 1137989 - protein, 19 aa, Mycobacterium
AYYNALIPNIQPAQLLQPF

SEQ ID NO: 1137990 - protein, 17 aa, Mycobacterium
CAAAALCPLWPAGAELL

SEQ ID NO: 1137991 - protein, 29 aa, Mycobacterium
CAAVAVAGLGLWLLTRPRSADPRQQILRA

SEQ ID NO: 1137992 - protein, 26 aa, Mycobacterium
CAFKRARPRWVAFAMAAIALGYLLLN

SEQ ID NO: 1137993 - protein, 33 aa, Mycobacterium
CALLLQIYIVMGASWVWYRGLQGQPVPVFGSAL

SEQ ID NO: 1137994 - protein, 27 aa, Mycobacterium
CALLLQIYVVMGAGWVWHRGLQGEPVP

SEQ ID NO: 1137995 - protein, 33 aa, Mycobacterium
CAMALIVVNLSWPWWAALLVGIACGALIGLAIG

SEQ ID NO: 1137996 - protein, 20 aa, Mycobacterium
CAPEHRWLTSVPDELVNVLG

SEQ ID NO: 1137997 - protein, 22 aa, Mycobacterium
CARHPLPMPAALAKVLTAAAAA

SEQ ID NO: 1137998 - protein, 19 aa, Mycobacterium
CARRGFNVVWIDPKGFDSP

SEQ ID NO: 1137999 - protein, 20 aa, Mycobacterium
CARRGFNVVWIDPKGFDSPG

SEQ ID NO: 1138000 - protein, 17 aa, Mycobacterium
CATKWSGLYFVMFFGVM

SEQ ID NO: 1138001 - protein, 21 aa, Mycobacterium
CAVVYLLLTIAVTGSLSVAEI

SEQ ID NO: 1138002 - protein, 19 aa, Mycobacterium
CDDMFKVRGATVYPSEVEQ

SEQ ID NO: 1138003 - protein, 30 aa, Mycobacterium
CFSDLPFFPLPWLLDVAMWVLALSSVVTVG

SEQ ID NO: 1138004 - protein, 30 aa, Mycobacterium
CGIMGLGAALLIAALLLSTYTQGKIAKIPL

SEQ ID NO: 1138005 - protein, 20 aa, Mycobacterium
CGNPLAPPAALAAPVSKLRF

SEQ ID NO: 1138006 - protein, 46 aa, Mycobacterium
CIALLFGVAFLFFGPREALFPAVLELTLFPVAVVILAVYALQDQVL

SEQ ID NO: 1138007 - protein, 33 aa, Mycobacterium
CKDGDKDCEPGWPWPWPWPDDPDDRPKPDDGYG

SEQ ID NO: 1138008 - protein, 22 aa, Mycobacterium
CLTMGVFWPFAPLFPALVAGVA

SEQ ID NO: 1138009 - protein, 26 aa, Mycobacterium
CLYCAYELWRFDTVRSWVLVAVMNIA

SEQ ID NO: 1138010 - protein, 18 aa, Mycobacterium
CTKRFVLLCGGAATAGCV

SEQ ID NO: 1138011 - protein, 18 aa, Mycobacterium
CVAMFGLVVSPVSWSHHW

SEQ ID NO: 1138012 - protein, 19 aa, Mycobacterium
CVGLFCCIGSIAGIAMGVI

SEQ ID NO: 1138013 - protein, 18 aa, Mycobacterium
CVLGVIWVFGPWPTERQS

SEQ ID NO: 1138014 - protein, 17 aa, Mycobacterium
CVLYECLTGVRPYPADS

SEQ ID NO: 1138015 - protein, 19 aa, Mycobacterium
CWAASLITATWLAASIYVG

SEQ ID NO: 1138016 - protein, 25 aa, Mycobacterium
DAADDLGTVLGWPGGLRLAVDNLVR

SEQ ID NO: 1138017 - protein, 35 aa, Mycobacterium
DAALSNYFRRGNLTALRELALLWLADQVDSALEKY

SEQ ID NO: 1138018 - protein, 32 aa, Mycobacterium
DAAPGLPVVVPMAPIAVPVLVVPPVGLPSVLG

SEQ ID NO: 1138019 - protein, 33 aa, Mycobacterium
DADADAELAPPPRWPWVVGIVAIVAAIALVVSV

SEQ ID NO: 1138020 - protein, 26 aa, Mycobacterium
DADALKIPIRLPALPDGWRSNSGGRS

SEQ ID NO: 1138021 - protein, 26 aa, Mycobacterium
DADARIHWWVWRVGALNTVAVAFPGV

SEQ ID NO: 1138022 - protein, 26 aa, Mycobacterium
DADGFLYYHGRCDDMFKVRGATVYPS

SEQ ID NO: 1138023 - protein, 18 aa, Mycobacterium
DADQILTDLLTPGTLFSP

SEQ ID NO: 1138024 - protein, 21 aa, Mycobacterium
DAEPSEFLQWGRAGEITLVLP

SEQ ID NO: 1138025 - protein, 21 aa, Mycobacterium
DAFLGILAFLVPLGLLQAAVA

SEQ ID NO: 1138026 - protein, 26 aa, Mycobacterium
DAFLSWGWRVAFWLSAVVVLVGYYIR

SEQ ID NO: 1138027 - protein, 25 aa, Mycobacterium
DAFQADALLDRLLGRPVHAIGLTWT

SEQ ID NO: 1138028 - protein, 24 aa, Mycobacterium
DAGMLSWILPIATLMIRPLGVLTQ

SEQ ID NO: 1138029 - protein, 20 aa, Mycobacterium
DAIRALLELAPPLAVVLRDG

SEQ ID NO: 1138030 - protein, 39 aa, Mycobacterium
DALLGWAHLLLWAMFTCIELLPVLIKLLMNMGASSAYDR

SEQ ID NO: 1138031 - protein, 26 aa, Mycobacterium
DALRRLFGWFVLLMASVILAQETTPA

SEQ ID NO: 1138032 - protein, 30 aa, Mycobacterium
DALTGHIWQVFGALWLYSMAVAGAVTGVAA

SEQ ID NO: 1138033 - protein, 27 aa, Mycobacterium
DAPPRVTAPLLLPDPPLRARRLETRLM

SEQ ID NO: 1138034 - protein, 31 aa, Mycobacterium
DAPSDGLPVWPFVAAATVIVAAGALWAVRRR

SEQ ID NO: 1138035 - protein, 24 aa, Mycobacterium
DAPSVWDWTKWLPHIQHHSKRDGC

SEQ ID NO: 1138036 - protein, 25 aa, Mycobacterium
DAQTIELALAWRSGEDDPLVEAVVG

SEQ ID NO: 1138037 - protein, 31 aa, Mycobacterium
DAQVQPVLMGLQLALTELWRSYDVHPDAVIG

SEQ ID NO: 1138038 - protein, 23 aa, Mycobacterium
DARNLFLTLLGVSGIGPSIALGA

SEQ ID NO: 1138039 - protein, 23 aa, Mycobacterium
DARPVWARALGLRLPPTGASDRL

SEQ ID NO: 1138040 - protein, 27 aa, Mycobacterium
DASRSWAQAPRQLPVAPLAGPNPARPP

SEQ ID NO: 1138041 - protein, 27 aa, Mycobacterium
DASSGPPTWVLFAAGLGALVVVGGGVL

SEQ ID NO: 1138042 - protein, 25 aa, Mycobacterium
DATASFGVLPPFLMQHVSGHYTNIR

SEQ ID NO: 1138043 - protein, 35 aa, Mycobacterium
DATLVRMVLLPAFMHLMGRWNWWAPAPLARWHARR

SEQ ID NO: 1138044 - protein, 28 aa, Mycobacterium
DATTHLLQQSLYLFILGTGIGLCMQVLV

SEQ ID NO: 1138045 - protein, 19 aa, Mycobacterium
DAVACARRLARYRPGAGAR

SEQ ID NO: 1138046 - protein, 22 aa, Mycobacterium
DAVRLFVIALGFGAAFPLLKLF

SEQ ID NO: 1138047 - protein, 28 aa, Mycobacterium
DCRTSFYPNWFYFIVEAVAAAALFMSVD

SEQ ID NO: 1138048 - protein, 48 aa, Mycobacterium
DDAAGWPQWLLYIVMTVISLLLFIVAATTLWWMLHAWRSPESLHSTGF

SEQ ID NO: 1138049 - protein, 25 aa, Mycobacterium
DDAARLLTELLTPGSLFPADRTVVV

SEQ ID NO: 1138050 - protein, 26 aa, Mycobacterium
DDGTNMVWIWFWDVLSIGGSIVFVAW

SEQ ID NO: 1138051 - protein, 27 aa, Mycobacterium
DDPAVRYAMLTLLHDLAWKATLPDHRA

SEQ ID NO: 1138052 - protein, 27 aa, Mycobacterium
DDPEDPAWAWLKWLPHLQHETDTDAAG

SEQ ID NO: 1138053 - protein, 37 aa, Mycobacterium
DDTYTDELAPLPWYKRPPVLFGVAAAAALLAAGGLAV

SEQ ID NO: 1138054 - protein, 26 aa, Mycobacterium
DDVVHPGWVDAYWRAFQSGAHTAGGS

SEQ ID NO: 1138055 - protein, 27 aa, Mycobacterium
DEALPQVRDLLTLLPKRLRDMEDLLNE

SEQ ID NO: 1138056 - protein, 26 aa, Mycobacterium
DEARALFDRLQPTLPIVLANLVSIEP

SEQ ID NO: 1138057 - protein, 20 aa, Mycobacterium
DECWWAPQWMKRIQQRIGLG

SEQ ID NO: 1138058 - protein, 17 aa, Mycobacterium
DEEPGGEPVAWACAPIG

SEQ ID NO: 1138059 - protein, 20 aa, Mycobacterium
DEFVVAVRQLKINEPAPIEV

SEQ ID NO: 1138060 - protein, 17 aa, Mycobacterium
DEIPPFAAFLTQKEESH

SEQ ID NO: 1138061 - protein, 23 aa, Mycobacterium
DELDDPWRNPGAAAALGTPALAP

SEQ ID NO: 1138062 - protein, 20 aa, Mycobacterium
DELDRFLEWEHDILHAGGSD

SEQ ID NO: 1138063 - protein, 26 aa, Mycobacterium
DELNWSPLPMFHLNVLAMTLIGTMLV

SEQ ID NO: 1138064 - protein, 26 aa, Mycobacterium
DELQTLFQRFQPTLPVLMANLVTVGQ

SEQ ID NO: 1138065 - protein, 38 aa, Mycobacterium
DEQAVWRGWLDHALILALIATLTWVLVSLVRVVERQVI

SEQ ID NO: 1138066 - protein, 19 aa, Mycobacterium
DEQGRVRRVKKGEPGLLLS

SEQ ID NO: 1138067 - protein, 37 aa, Mycobacterium
DERDRVSLWGRILPITFTALGLVALVGGALLGTFSLR

SEQ ID NO: 1138068 - protein, 32 aa, Mycobacterium
DESFLSWGWRIPFLVSLLLLAVGIYVRLSVTE

SEQ ID NO: 1138069 - protein, 23 aa, Mycobacterium
DESGRVLTFALLSNDAGPTGRTA

SEQ ID NO: 1138070 - protein, 22 aa, Mycobacterium
DETMFVPQLPYFPIGDLRTAVS

SEQ ID NO: 1138071 - protein, 17 aa, Mycobacterium
DFATRFPTTIFLEMMGL

SEQ ID NO: 1138072 - protein, 25 aa, Mycobacterium
DFELGGEWLGLHLNLTLGAWAADGL

SEQ ID NO: 1138073 - protein, 17 aa, Mycobacterium
DFGFILCPIFSCLALVQ

SEQ ID NO: 1138074 - protein, 18 aa, Mycobacterium
DFKIHLQDPPPCSTGFVP

SEQ ID NO: 1138075 - protein, 18 aa, Mycobacterium
DFLTYTAQGWLYKTLVEV

SEQ ID NO: 1138076 - protein, 18 aa, Mycobacterium
DFPPGRGVLIERGKGVWM

SEQ ID NO: 1138077 - protein, 18 aa, Mycobacterium
DFVHLLLGFASIGRTIEH

SEQ ID NO: 1138078 - protein, 24 aa, Mycobacterium
DGAKRMQILINDLLTFSRVGRLNA

SEQ ID NO: 1138079 - protein, 28 aa, Mycobacterium
DGAPAQLWVFWLAPLIDAAIAGVAYPYL

SEQ ID NO: 1138080 - protein, 23 aa, Mycobacterium
DGDLRIAIGCQSTPGLDAAVEDV

SEQ ID NO: 1138081 - protein, 20 aa, Mycobacterium
DGDVLLLSPALSRVPRFDRP

SEQ ID NO: 1138082 - protein, 31 aa, Mycobacterium; identical to SEQ ID NO: 352256

SEQ ID NO: 1138083 - protein, 20 aa, Mycobacterium
DGFTMLALVGIIDPLRPEAV

SEQ ID NO: 1138084 - protein, 20 aa, Mycobacterium
DGFWMSMAVFTILAVLNVAI

SEQ ID NO: 1138085 - protein, 33 aa, Mycobacterium
DGGAAFIRRLLTLATTLLLVVTIISTVAAPLLV

SEQ ID NO: 1138086 - protein, 56 aa, Mycobacterium
DGGAAPSRRRRIPRPGWKAAVATVVALATVALLGASGYMVWTHRGAEKLRQQNAEY

SEQ ID NO: 1138087 - protein, 24 aa, Mycobacterium
DGGFTLFYLGINLGAFIGPLITGL

SEQ ID NO: 1138088 - protein, 31 aa, Mycobacterium
DGGFYAGHMAATICWIAMAAALFGYAARLPR

SEQ ID NO: 1138089 - protein, 27 aa, Mycobacterium
DGGPKYWLLIILAVAIGTAFLVERTIP

SEQ ID NO: 1138090 - protein, 26 aa, Mycobacterium
DGHTIRLGRPGWLDPGPLAGDVARMQ

SEQ ID NO: 1138091 - protein, 25 aa, Mycobacterium
DGIFRVAVFIVVGLILLGMGAGYAR

SEQ ID NO: 1138092 - protein, 21 aa, Mycobacterium
DGKVHRHWGFGGGPHRCLGSH

SEQ ID NO: 1138093 - protein, 17 aa, Mycobacterium
DGLIGAPMLFGTRALVL

SEQ ID NO: 1138094 - protein, 22 aa, Mycobacterium
DGLMTFWFAMALYVPWQIIVYL

SEQ ID NO: 1138095 - protein, 25 aa, Mycobacterium
DGMGTTLTAILFAGNRLGLVHIGDS

SEQ ID NO: 1138096 - protein, 22 aa, Mycobacterium
DGPAWLTGGTYLVARRIRMLIE

SEQ ID NO: 1138097 - protein, 19 aa, Mycobacterium
DGPLRLGHWVMFAAVSLPS

SEQ ID NO: 1138098 - protein, 19 aa, Mycobacterium
DGPRYRDELVRRATAPLVS

SEQ ID NO: 1138099 - protein, 21 aa, Mycobacterium
DGRAVLLGRLRLLADRSHEIP

SEQ ID NO: 1138100 - protein, 17 aa, Mycobacterium
DGRGFLAAYRIAADEPL

SEQ ID NO: 1138101 - protein, 23 aa, Mycobacterium
DGRTFTVVWLAAAPQLVALLLAR

SEQ ID NO: 1138102 - protein, 30 aa, Mycobacterium
DGRVEYYWAFTMLAALLLLIEIFLTTRDLL

SEQ ID NO: 1138103 - protein, 28 aa, Mycobacterium
DGRWSIASAAPVRFLRNKKLTGAMTAPH

SEQ ID NO: 1138104 - protein, 35 aa, Mycobacterium
DGSLTRRFSVLILLLCLFGVLMVLLRRGSLPGAVN

SEQ ID NO: 1138105 - protein, 34 aa, Mycobacterium
DGTPLRNLHKLDPLLRLPLALGLAHLLGRIPLPG

SEQ ID NO: 1138106 - protein, 26 aa, Mycobacterium
DGVAALAWTAWLTPFGLLGRVAPYAH

SEQ ID NO: 1138107 - protein, 20 aa, Mycobacterium
DGVGWLLAGDLPLDEAERTL

SEQ ID NO: 1138108 - protein, 17 aa, Mycobacterium
DGWLTGAWVIMLAAVAL

SEQ ID NO: 1138109 - protein, 23 aa, Mycobacterium
DHKVWFAVIAILVLASLNLRGIR

SEQ ID NO: 1138110 - protein, 18 aa, Mycobacterium
DHRTLSRYGYVCGLTGLV

SEQ ID NO: 1138111 - protein, 32 aa, Mycobacterium
DHYFNTFLIPTDLLWSFLQAIAMSIAVMLVHT

SEQ ID NO: 1138112 - protein, 18 aa, Mycobacterium
DIADSIIVLILCAVLVAD

SEQ ID NO: 1138113 - protein, 18 aa, Mycobacterium
DIDAVLASLLPDATQPAD

SEQ ID NO: 1138114 - protein, 28 aa, Mycobacterium
DIIYYPVSAIMWVWYKAFAFLIGLIPGV

SEQ ID NO: 1138115 - protein, 25 aa, Mycobacterium
DIKPENVLLTPDDFAYLVDFGIAHG

SEQ ID NO: 1138116 - protein, 19 aa, Mycobacterium
DILAIPIGSLVAPAAVIGA

SEQ ID NO: 1138117 - protein, 30 aa, Mycobacterium
DILATALALALLAFGFLAPAAALAIDHSDD

SEQ ID NO: 1138118 - protein, 27 aa, Mycobacterium
DIRALTRPILLTLLALVLAAGAFRSVL

SEQ ID NO: 1138119 - protein, 23 aa, Mycobacterium
DIRIMLPIEFAILQYAQLEAIDT

SEQ ID NO: 1138120 - protein, 26 aa, Mycobacterium
DIVVFICAILFTIVWWHVEHTRSNWL

SEQ ID NO: 1138121 - protein, 28 aa, Mycobacterium
DIYVPGGAGLYWLVRHYWKHPGDREELV

SEQ ID NO: 1138122 - protein, 18 aa, Mycobacterium
DKERWLIRHKRGVDYFDP

SEQ ID NO: 1138123 - protein, 48 aa, Mycobacterium
DKHGRPFRRRNFLPGAALFACLAIAALLVWVIALSRPPEVQQAAVCNP

SEQ ID NO: 1138124 - protein, 24 aa, Mycobacterium
DKKRYLWLMGLIAPTALFVMLPLI

SEQ ID NO: 1138125 - protein, 24 aa, Mycobacterium
DKLALGLAFFYPVADMVILAVAVA

SEQ ID NO: 1138126 - protein, 17 aa, Mycobacterium
DKYYRYCTYLYIPFQYA

SEQ ID NO: 1138127 - protein, 25 aa, Mycobacterium
DLASRWHGFWRGDIGVWILDRGVRI

SEQ ID NO: 1138128 - protein, 26 aa, Mycobacterium
DLCALLLQIYVVMGASWVCYRGLQGE

SEQ ID NO: 1138129 - protein, 21 aa, Mycobacterium
DLGGLYFNALVAIVITGLWLW

SEQ ID NO: 1138130 - protein, 19 aa, Mycobacterium
DLGGWLTFAAAMASTLILS

SEQ ID NO: 1138131 - protein, 26 aa, Mycobacterium
DLGRFRLPLYVTALSVFLGVAVALLL

SEQ ID NO: 1138132 - protein, 20 aa, Mycobacterium
DLIKLRMTVKVRPNAQWAVQ

SEQ ID NO: 1138133 - protein, 20 aa, Mycobacterium
DLIPVLKHTGLTMLVWAVAV

SEQ ID NO: 1138134 - protein, 20 aa, Mycobacterium
DLLGDRPFELALTHSPIGMA

SEQ ID NO: 1138135 - protein, 17 aa, Mycobacterium
DLPKFPNEKIDPARSGG

SEQ ID NO: 1138136 - protein, 19 aa, Mycobacterium
DLPRSVSYLTLAGTRMASD

SEQ ID NO: 1138137 - protein, 23 aa, Mycobacterium
DLRGFWIRRARRLLPALLAMVAA

SEQ ID NO: 1138138 - protein, 24 aa, Mycobacterium
DLRGFWIRRARRLLPALLAMVAAV

SEQ ID NO: 1138139 - protein, 25 aa, Mycobacterium
DLRGFWIRRARRLLPALLAMVAAVV

SEQ ID NO: 1138140 - protein, 27 aa, Mycobacterium
DLRQRVITYAPLLLTAETAITGSARGD

SEQ ID NO: 1138141 - protein, 20 aa, Mycobacterium
DLTANPLRFLARAANLWNSE

SEQ ID NO: 1138142 - protein, 24 aa, Mycobacterium
DLTANPQRFLARAFNLWNSELPFG

SEQ ID NO: 1138143 - protein, 31 aa, Mycobacterium
DLTATRPPAHTLPKPRLRPSGRIAVVGRVAA

SEQ ID NO: 1138144 - protein, 35 aa, Mycobacterium
DLVGADLQRAPLLASYRSVARFPRFAGNVPVAESV

SEQ ID NO: 1138145 - protein, 18 aa, Mycobacterium
DLYSKKRVLLGVLVVVLI

SEQ ID NO: 1138146 - protein, 24 aa, Mycobacterium
DMIGMWAPFLLVLLRMIQGFSTGG

SEQ ID NO: 1138147 - protein, 37 aa, Mycobacterium
DMRNRFLVALALSIPIMLWSPMGRDMFGFTVPAPFGL

SEQ ID NO: 1138148 - protein, 26 aa, Mycobacterium
DMRRPMLSKYLDLVAPVGFSTVLSGA

SEQ ID NO: 1138149 - protein, 23 aa, Mycobacterium
DMTWQMWLAFVGAAILIAVSPGA

SEQ ID NO: 1138150 - protein, 25 aa, Mycobacterium
DNLEQLLVLLPQATSIMQAIGVPNR

SEQ ID NO: 1138151 - protein, 20 aa, Mycobacterium
DNLGWFFLFSEGNVSLAGGG

SEQ ID NO: 1138152 - protein, 24 aa, Mycobacterium
DNLSAVARLLLTSATLDKHLAEPT

SEQ ID NO: 1138153 - protein, 25 aa, Mycobacterium
DNMLVLYVFWEITTVLSFLLVGHYA

SEQ ID NO: 1138154 - protein, 34 aa, Mycobacterium
DNRNVLLYSWAFVPVLVLVLATRSLYKRKLNRSF

SEQ ID NO: 1138155 - protein, 23 aa, Mycobacterium
DPAASWLLLRIPFGTVWSEEATF

SEQ ID NO: 1138156 - protein, 23 aa, Mycobacterium
DPAFEHLDYVPFSRHYDLPRAAG

SEQ ID NO: 1138157 - protein, 28 aa, Mycobacterium
DPALAISTLIFLVILYVATPSVCHALVH

SEQ ID NO: 1138158 - protein, 23 aa, Mycobacterium
DPAQIWVLVFSMTMMGGLLVSLV

SEQ ID NO: 1138159 - protein, 27 aa, Mycobacterium
DPDASAVRWSWVLDGMVEIGALSPEDR

SEQ ID NO: 1138160 - protein, 37 aa, Mycobacterium
DPDIQSVSWLPLFHDMGLLMIMFPAVAGGHLTLMSPV

SEQ ID NO: 1138161 - protein, 19 aa, Mycobacterium
DPDNWLRWYRLARAYDYAG

SEQ ID NO: 1138162 - protein, 33 aa, Mycobacterium
DPDRRRFFAYLNLFLAAMLLLVLADNYLGLYVG

SEQ ID NO: 1138163 - protein, 25 aa, Mycobacterium
DPGKPMLVFLGLSLAGALIPQMFAT

SEQ ID NO: 1138164 - protein, 27 aa, Mycobacterium
DPGRWPWPTFTVNIVGALLLGVFVTRL

SEQ ID NO: 1138165 - protein, 27 aa, Mycobacterium
DPKSLCIVALIWYLAEAVGIAFLAPVL

SEQ ID NO: 1138166 - protein, 31 aa, Mycobacterium
DPLDWAYHLVLPWFTLAVLFIGFYSRVLRSN

SEQ ID NO: 1138167 - protein, 25 aa, Mycobacterium
DPLRKSVLALKEAGWWRLGIPEDIG

SEQ ID NO: 1138168 - protein, 24 aa, Mycobacterium
DPLTGLLNRRAFYAHSAKLLTGGP

SEQ ID NO: 1138169 - protein, 19 aa, Mycobacterium
DPQLLRFAIRADATLCAGV

SEQ ID NO: 1138170 - protein, 22 aa, Mycobacterium
DPQPRTVELPGLGWYRMESRAG

SEQ ID NO: 1138171 - protein, 21 aa, Mycobacterium
DPRFPLLYFSVNSAVLAAVAA

SEQ ID NO: 1138172 - protein, 22 aa, Mycobacterium
DPRRAVPAPTNTSSFFASRAQA

SEQ ID NO: 1138173 - protein, 34 aa, Mycobacterium
DPRVVSLIFIPWQALMWVLPVALAVALLAFPRLG

SEQ ID NO: 1138174 - protein, 36 aa, Mycobacterium
DPTPVARWIRRLAIPIILGWVLLVAALNLLVPQLEV

SEQ ID NO: 1138175 - protein, 23 aa, Mycobacterium
DPVACTVGFLPPSQWRSPEDMTT

SEQ ID NO: 1138176 - protein, 25 aa, Mycobacterium
DPVAEPLWEPLADPVADSGPDELSE

SEQ ID NO: 1138177 - protein, 27 aa, Mycobacterium
DPVALRLLWTVPLLSFFAAGAGVGVGA

SEQ ID NO: 1138178 - protein, 23 aa, Mycobacterium
DPVLLDWLVGLAFPCQRPFGHRN

SEQ ID NO: 1138179 - protein, 29 aa, Mycobacterium
DQATFAPAVFLWFFGIGALTVAMSGGITP

SEQ ID NO: 1138180 - protein, 25 aa, Mycobacterium
DQLNDLLVKLPDALAIIGRSGGVYG

SEQ ID NO: 1138181 - protein, 27 aa, Mycobacterium
DQVLQSYLNIIYFGRGAYGVAAAAQAY

SEQ ID NO: 1138182 - protein, 23 aa, Mycobacterium
DQVVAMLSLVPWGGNGVSLDLMR

SEQ ID NO: 1138183 - protein, 25 aa, Mycobacterium
DRAEAYWTRLGWSARGPIKTESRID

SEQ ID NO: 1138184 - protein, 23 aa, Mycobacterium
DRAVMFRAFAVLGLAEAAVALSA

SEQ ID NO: 1138185 - protein, 23 aa, Mycobacterium
DRDFYSNPGFSFTGFLRAAKNNI

SEQ ID NO: 1138186 - protein, 18 aa, Mycobacterium
DRFGARPVLVVAALAGIA

SEQ ID NO: 1138187 - protein, 23 aa, Mycobacterium
DRFGRRPLMLPAPVLAAVGSAIL

SEQ ID NO: 1138188 - protein, 19 aa, Mycobacterium
DRFLPLWIGAAMVAGLLLG

SEQ ID NO: 1138189 - protein, 21 aa, Mycobacterium
DRFQRMLLIAPATAVFAGLVG

SEQ ID NO: 1138190 - protein, 25 aa, Mycobacterium
DRFSALIFGLALIALGAGMLAWGSD

SEQ ID NO: 1138191 - protein, 25 aa, Mycobacterium
DRFSALIFGLALIALGAGMLVWGSD

SEQ ID NO: 1138192 - protein, 33 aa, Mycobacterium
DRGLQFGFISDAAGFMTVWARMYAPDGAAFEQR

SEQ ID NO: 1138193 - protein, 17 aa, Mycobacterium
DRHTTVIPPVRDGAPPP

SEQ ID NO: 1138194 - protein, 26 aa, Mycobacterium
DRIAKPLLPGIMIVAALIAVIGSLLG

SEQ ID NO: 1138195 - protein, 29 aa, Mycobacterium
DRIVLDQMSWFTPARWGFAASASTVDLIR

SEQ ID NO: 1138196 - protein, 42 aa, Mycobacterium
DRKRNLLVQIGLTAVVVIFAVTLVLYIVLSADDKPTAGESRA

SEQ ID NO: 1138197 - protein, 18 aa, Mycobacterium
DRLKGGRLLGPMERLLIL

SEQ ID NO: 1138198 - protein, 20 aa, Mycobacterium
DRLRPIRWIASAAAAVLALV

SEQ ID NO: 1138199 - protein, 23 aa, Mycobacterium
DRLSEAVAEPALVALLLGKTAQA

SEQ ID NO: 1138200 - protein, 22 aa, Mycobacterium
DRLSHTLLPKRIALPVFASDAL

SEQ ID NO: 1138201 - protein, 18 aa, Mycobacterium
DRNYLLFKGLRMSSLVTV

SEQ ID NO: 1138202 - protein, 21 aa, Mycobacterium
DRPFQYWGWANFASVVCAIGL

SEQ ID NO: 1138203 - protein, 46 aa, Mycobacterium
DRPNRLNRIAALVGIVAGVVFIIAAIFFSGFVLGAHSGGDFGRDHR

SEQ ID NO: 1138204 - protein, 18 aa, Mycobacterium
DRPRALLLGSTVAAVVVV

SEQ ID NO: 1138205 - protein, 27 aa, Mycobacterium
DRRAVAWALFAVLTVFNVVWAVAYLRG

SEQ ID NO: 1138206 - protein, 20 aa, Mycobacterium
DRRDALKWVWLGVGAAIALT

SEQ ID NO: 1138207 - protein, 17 aa, Mycobacterium
DRRLWTITVAVVGALAM

SEQ ID NO: 1138208 - protein, 27 aa, Mycobacterium
DRSALYRFVGLILPLAAFMVACVAILS

SEQ ID NO: 1138209 - protein, 29 aa, Mycobacterium
DRSRGKYWWLRWALIALAVIVLTVELALV

SEQ ID NO: 1138210 - protein, 27 aa, Mycobacterium
DRTASMRWYPIITFWQVAADMTNAVSV

SEQ ID NO: 1138211 - protein, 27 aa, Mycobacterium
DRTEPALDLDLLLGGLKPVIRGLNPED

SEQ ID NO: 1138212 - protein, 27 aa, Mycobacterium
DRTGQSLWWALALAVLGLGLLGGSLLA

SEQ ID NO: 1138213 - protein, 27 aa, Mycobacterium
DRTPDWQPWLRWVVLIGSIVAAAVIAV

SEQ ID NO: 1138214 - protein, 27 aa, Mycobacterium
DRTRASLILWAGWLVVTALVFSYMNGI

SEQ ID NO: 1138215 - protein, 45 aa, Mycobacterium
DRVLAGIIVTFFVTALALAILARSALVRPLSALAASCRRITEGHF

SEQ ID NO: 1138216 - protein, 24 aa, Mycobacterium
DSAQRWIRHLTARVAHRVADSPAT

SEQ ID NO: 1138217 - protein, 22 aa, Mycobacterium
DSIIVLILCAVLVADPVREIRL

SEQ ID NO: 1138218 - protein, 25 aa, Mycobacterium
DSKDKLAAWIPPGPTATADFPTVLL

SEQ ID NO: 1138219 - protein, 25 aa, Mycobacterium
DSLPLLPFLTVVVIFLIIPTATVVV

SEQ ID NO: 1138220 - protein, 30 aa, Mycobacterium
DSLPLLVTALVLLGLGWNFGIISGTAFVVD

SEQ ID NO: 1138221 - protein, 34 aa, Mycobacterium
DSPTARWVIALMALLFALWVLAAAIWGPDGSDSA

SEQ ID NO: 1138222 - protein, 33 aa, Mycobacterium
DSRTPFDVLLYAALLVMLLFALFSDGTGPIPEL

SEQ ID NO: 1138223 - protein, 20 aa, Mycobacterium
DSTFYFRVAGIVGLIVLALM

SEQ ID NO: 1138224 - protein, 21 aa, Mycobacterium
DSVDFVLLLEDLRDWDNADHL

SEQ ID NO: 1138225 - protein, 32 aa, Mycobacterium
DSVDLLKVVAVPMAKRYAPVLAAAAVAGVIGY

SEQ ID NO: 1138226 - protein, 27 aa, Mycobacterium
DSWARVFDWLPIFVVITGIVGWVSDST

SEQ ID NO: 1138227 - protein, 18 aa, Mycobacterium
DTAFWLWVAALPLLAIGY

SEQ ID NO: 1138228 - protein, 26 aa, Mycobacterium
DTDRLQRWFAYLVFAVAAYVLVDTII

SEQ ID NO: 1138229 - protein, 18 aa, Mycobacterium
DTGFSLVLIGLTGGVDSP

SEQ ID NO: 1138230 - protein, 27 aa, Mycobacterium
DTGGVRDWRFIALTPPATVSKLLIRVA

SEQ ID NO: 1138231 - protein, 23 aa, Mycobacterium
DTGVPVVRCACGNPLAPPAALAA

SEQ ID NO: 1138232 - protein, 23 aa, Mycobacterium
DTLEASAILSPGGSRPRLIPDSE

SEQ ID NO: 1138233 - protein, 33 aa, Mycobacterium
DTLRQLLVLTGLALLIWLPAVRCPAGIAVVAGV

SEQ ID NO: 1138234 - protein, 21 aa, Mycobacterium
DTLVWCDIYSPDHAILKDLAQ

SEQ ID NO: 1138235 - protein, 22 aa, Mycobacterium
DTPAWRLALPLTMVGAAGAFTW

SEQ ID NO: 1138236 - protein, 20 aa, Mycobacterium
DTPCHRLTTTPSLSVLQCGD

SEQ ID NO: 1138237 - protein, 21 aa, Mycobacterium
DTSAALPPPTASLAPETITTV

SEQ ID NO: 1138238 - protein, 23 aa, Mycobacterium
DTSDILWWLLAAHAVHFLVVPQV

SEQ ID NO: 1138239 - protein, 29 aa, Mycobacterium
DTTRPVGLTVFWPLADRPRLAAGAPGGTT

SEQ ID NO: 1138240 - protein, 33 aa, Mycobacterium
DVAFPRLNAFSFWLFLFGALIALSGFITPGGAA

SEQ ID NO: 1138241 - protein, 23 aa, Mycobacterium
DVAISVPSYWSPATTAALADTLE

SEQ ID NO: 1138242 - protein, 27 aa, Mycobacterium
DVDDTLFWVAVIFGAVGAVALVAAGTA

SEQ ID NO: 1138243 - protein, 18 aa, Mycobacterium
DVDFIFQVGPVSFVVALL

SEQ ID NO: 1138244 - protein, 21 aa, Mycobacterium
DVGAPLLGAVFAMMPSRGSNS

SEQ ID NO: 1138245 - protein, 32 aa, Mycobacterium
DVKLGLMCLAAFPILVLLVMWFRRESSKTYRE

SEQ ID NO: 1138246 - protein, 32 aa, Mycobacterium
DVLFGGKVSYVALVVLGLVALVIGVAGGWVGR

SEQ ID NO: 1138247 - protein, 21 aa, Mycobacterium
DVNFGLFTLVWDHLMRTYAYD

SEQ ID NO: 1138248 - protein, 35 aa, Mycobacterium
DVVAAQNLPPNAAPPPPLAIAPGEPVPFVATPEVV

SEQ ID NO: 1138249 - protein, 31 aa, Mycobacterium
DVVYRPSPLAMLFACAAFGLTLLGAVPPAVR

SEQ ID NO: 1138250 - protein, 23 aa, Mycobacterium
DVYSLGCVLYEVLTGEPPFVGDS

SEQ ID NO: 1138251 - protein, 26 aa, Mycobacterium
DWATSVGSWFPLAFFAAHVVVTVFPF

SEQ ID NO: 1138252 - protein, 26 aa, Mycobacterium
DWGNELWTSLWWIAQGWAYAAVATIV

SEQ ID NO: 1138253 - protein, 17 aa, Mycobacterium
DWLVISTLAIGILALAA

SEQ ID NO: 1138254 - protein, 19 aa, Mycobacterium
DWLWASVVVFLVMAAALSH

SEQ ID NO: 1138255 - protein, 19 aa, Mycobacterium
DYAVFLISRYHDYLRSGSG

SEQ ID NO: 1138256 - protein, 17 aa, Mycobacterium
DYEVFLVSRIREFWLET

SEQ ID NO: 1138257 - protein, 18 aa, Mycobacterium
DYVIVDSTPLLAVTDAAI

SEQ ID NO: 1138258 - protein, 20 aa, Mycobacterium
DYWVFAVLIFLNGVGGGIFT

SEQ ID NO: 1138259 - protein, 28 aa, Mycobacterium
DYYERDIRFIIIAALIVVLVTLSVLLRS

SEQ ID NO: 1138260 - protein, 28 aa, Mycobacterium
EAAARGFYSPLFYRDLIGDPTGLSLPMF

SEQ ID NO: 1138261 - protein, 17 aa, Mycobacterium
EAAMWRAIGVRGAATTL

SEQ ID NO: 1138262 - protein, 22 aa, Mycobacterium
EAAPPPLRLVFARFVGGVLAIG

SEQ ID NO: 1138263 - protein, 24 aa, Mycobacterium
EAAVTFWASAFLGAVVVPIVHFYG

SEQ ID NO: 1138264 - protein, 25 aa, Mycobacterium
EAFAQLRDLLINAPSRLDTLTQQMV

SEQ ID NO: 1138265 - protein, 24 aa, Mycobacterium
EAFRAQMMALYFFSVGLGTSMSGV

SEQ ID NO: 1138266 - protein, 17 aa, Mycobacterium
EAGIILNGKPDSGIGGG

SEQ ID NO: 1138267 - protein, 31 aa, Mycobacterium
EAGLFIGIIALALWLMKMTVSTYWLTVIGEI

SEQ ID NO: 1138268 - protein, 30 aa, Mycobacterium
EAGLSFLPTPLAWLLALVALAAAAALVAFA

SEQ ID NO: 1138269 - protein, 35 aa, Mycobacterium
EAGRSPVRKALLAGLALVVVLAAVTGWFGYQAYRS

SEQ ID NO: 1138270 - protein, 18 aa, Mycobacterium
EAGWWRLGIPEDIGSTLA

SEQ ID NO: 1138271 - protein, 20 aa, Mycobacterium
EAIIYACGSIGRVILASAAT

SEQ ID NO: 1138272 - protein, 19 aa, Mycobacterium
EAKLWPLVLGRLVAAAVVL

SEQ ID NO: 1138273 - protein, 19 aa, Mycobacterium
EALARFPCEPFRPDAFFQQ

SEQ ID NO: 1138274 - protein, 25 aa, Mycobacterium
EALAVPIWWAYAASLLLITAGLFFG

SEQ ID NO: 1138275 - protein, 25 aa, Mycobacterium
EALAVPIWWAYATSLLLITAGLLFG

SEQ ID NO: 1138276 - protein, 17 aa, Mycobacterium
EALRRRLAHGNVYAPER

SEQ ID NO: 1138277 - protein, 28 aa, Mycobacterium
EALVFIGLALLIWLPAIRCPSAFTTTAG

SEQ ID NO: 1138278 - protein, 22 aa, Mycobacterium
EAPFIVLALLLPFAEGGERVVV

SEQ ID NO: 1138279 - protein, 21 aa, Mycobacterium
EAPKITLLALAALPPAAVATT

SEQ ID NO: 1138280 - protein, 22 aa, Mycobacterium
EAQGLWLLERAGLITLNPAVDK

SEQ ID NO: 1138281 - protein, 22 aa, Mycobacterium
EAQPGWRPIADSRIPLAAAAAT

SEQ ID NO: 1138282 - protein, 17 aa, Mycobacterium
EARAKRRAGAALRALLE

SEQ ID NO: 1138283 - protein, 19 aa, Mycobacterium
EASLKYFLLGAFSSAIFLY

SEQ ID NO: 1138284 - protein, 25 aa, Mycobacterium
EATARGWPVLTFTRPVSLRDRIPAP

SEQ ID NO: 1138285 - protein, 24 aa, Mycobacterium
EATASFGAMPPFLLQHMTGHYTNI

SEQ ID NO: 1138286 - protein, 20 aa, Mycobacterium
EAVIAALALWSVASGTGLAG

SEQ ID NO: 1138287 - protein, 17 aa, Mycobacterium
ECGHMWVARATGMKVRR

SEQ ID NO: 1138288 - protein, 21 aa, Mycobacterium
EDERPLRRRGLAVGGAIAAVL

SEQ ID NO: 1138289 - protein, 23 aa, Mycobacterium
EDKFFSTVFLGSGLLFLAMIFAS

SEQ ID NO: 1138290 - protein, 23 aa, Mycobacterium
EDKPVIFWTPDHGAVIVRGAMNA

SEQ ID NO: 1138291 - protein, 23 aa, Mycobacterium
EDKVHRLPLRYFDSRQRGEVLSR

SEQ ID NO: 1138292 - protein, 23 aa, Mycobacterium
EDRFFASVFFGSGLLFVAMTAVS

SEQ ID NO: 1138293 - protein, 30 aa, Mycobacterium
EDVLGQMVPILIGFLASAIGLGGIGQKIRE

SEQ ID NO: 1138294 - protein, 21 aa, Mycobacterium
EDYRLGQLVPLRGSASAVPAV

SEQ ID NO: 1138295 - protein, 25 aa, Mycobacterium
EEEAGRWDLLLAGPLRTVDAAARCL

SEQ ID NO: 1138296 - protein, 24 aa, Mycobacterium
EEGRSTFFNIRRFLTYHLSDNVAE

SEQ ID NO: 1138297 - protein, 23 aa, Mycobacterium
EEQFLLVWPVLIVAITLIAVRGA

SEQ ID NO: 1138298 - protein, 28 aa, Mycobacterium
EERLDRRWMWIAGVAGAILFVAVITASM

SEQ ID NO: 1138299 - protein, 25 aa, Mycobacterium
EFKSLAQLEAKPLKFGHKVVTGMRG

SEQ ID NO: 1138300 - protein, 17 aa, Mycobacterium
EFLLPRNAPEGDAAGPD

SEQ ID NO: 1138301 - protein, 41 aa, Mycobacterium
EFLRQSWFVARVSLLPTLLLAIPFSVLLVFTFNILLTEFGA

SEQ ID NO: 1138302 - protein, 18 aa, Mycobacterium
EFLTGRPLLGLAACWAVI

SEQ ID NO: 1138303 - protein, 26 aa, Mycobacterium
EFLWGRLPLYIVAIYPMMATVAFEIV

SEQ ID NO: 1138304 - protein, 18 aa, Mycobacterium
EFMCLLPLTIPALVIVVG

SEQ ID NO: 1138305 - protein, 17 aa, Mycobacterium
EFRPERFLGSRPHPYAW

SEQ ID NO: 1138306 - protein, 19 aa, Mycobacterium
EFRTYRFRAHSMFDPELYR

SEQ ID NO: 1138307 - protein, 29 aa, Mycobacterium
EFTILLERGLFVGLWILAAVCFIVIWRRH

SEQ ID NO: 1138308 - protein, 17 aa, Mycobacterium
EFWARVRRGALLKAAAT

SEQ ID NO: 1138309 - protein, 41 aa, Mycobacterium
EFYWARQRAKRALLFWVVAVITLAGLLAAGAWALGSNLVNL

SEQ ID NO: 1138310 - protein, 27 aa, Mycobacterium
EGFPADVLYYFRLYALGTLRGTRLVVQ

SEQ ID NO: 1138311 - protein, 21 aa, Mycobacterium
EGHDLPPLPTLFVVADEFTLM

SEQ ID NO: 1138312 - protein, 27 aa, Mycobacterium
EGIVALILLAALQYVAAIVASRLRIGR

SEQ ID NO: 1138313 - protein, 30 aa, Mycobacterium
EGLAALIFTKYLWAFELTGALLITAALGAM

SEQ ID NO: 1138314 - protein, 24 aa, Mycobacterium
EGLASIIVVWRFTGAWTLSETAER

SEQ ID NO: 1138315 - protein, 23 aa, Mycobacterium
EGPDRIYLPPEGTPLPPGAVRAG

SEQ ID NO: 1138316 - protein, 32 aa, Mycobacterium
EGRDSLAPALIIFLTLALLTNALVGQARLRAA

SEQ ID NO: 1138317 - protein, 33 aa, Mycobacterium
EGRKPFLLVGSALTSLFVIGVAALVVSLAISIR

SEQ ID NO: 1138318 - protein, 31 aa, Mycobacterium
EGRQRWLHRPIVVWWLFWVASTTVTTFAFAT

SEQ ID NO: 1138319 - protein, 34 aa, Mycobacterium
EGTAFLRVAQRQPRQFRFFYSSADFVPQTGPDDS

SEQ ID NO: 1138320 - protein, 27 aa, Mycobacterium
EGTDAAWLLAERYPHGMPPALVIRIVT

SEQ ID NO: 1138321 - protein, 24 aa, Mycobacterium
EGTRFRFTLPMTLDDTATPLLEGS

SEQ ID NO: 1138322 - protein, 49 aa, Mycobacterium
EGYPSTWALLTRAGEGLLVYLGLGAMLGLVASWLLSRRIKRHTRGLEVA

SEQ ID NO: 1138323 - protein, 27 aa, Mycobacterium
EHAPHMLMIGYFLLSGALFFTAVGGVE

SEQ ID NO: 1138324 - protein, 21 aa, Mycobacterium
EHLGLLVLVPLIGLAPIVTDG

SEQ ID NO: 1138325 - protein, 22 aa, Mycobacterium
EHLPRLFERFYRADTARDREHG

SEQ ID NO: 1138326 - protein, 18 aa, Mycobacterium
EHRCTIAFIAPPVAVALA

SEQ ID NO: 1138327 - protein, 28 aa, Mycobacterium
EHTRSNWLLMFILLLVLTVIVGIYAARG

SEQ ID NO: 1138328 - protein, 17 aa, Mycobacterium
EHVLFPVVLIALGIFIL

SEQ ID NO: 1138329 - protein, 21 aa, Mycobacterium
EHYFRTFLRPDDVAWSFVQAI

SEQ ID NO: 1138330 - protein, 26 aa, Mycobacterium
EHYFRTFLRPDDVFWSFIQAVIISVI

SEQ ID NO: 1138331 - protein, 31 aa, Mycobacterium
EIAAVALPGLAGLIFLTFSGGVIGYRQANST

SEQ ID NO: 1138332 - protein, 25 aa, Mycobacterium
EIAMYSFIVLLLTGVWLTLFFDPSM

SEQ ID NO: 1138333 - protein, 27 aa, Mycobacterium
EIAWKPVLVLIVLIYAIVAIPLGWMFW

SEQ ID NO: 1138334 - protein, 17 aa, Mycobacterium
EIFKLIATGGVAALWQM

SEQ ID NO: 1138335 - protein, 23 aa, Mycobacterium
EIGILVAAFFALHSVARRSSVVR

SEQ ID NO: 1138336 - protein, 18 aa, Mycobacterium
EIIAAWLLLSDAERHITS

SEQ ID NO: 1138337 - protein, 18 aa, Mycobacterium
EILFDADLAHRPALEHDR

SEQ ID NO: 1138338 - protein, 26 aa, Mycobacterium
EINPLSLFTWVWPALEVFTRMVPPNF

SEQ ID NO: 1138339 - protein, 25 aa, Mycobacterium
EITSWGVLYYAFSVLSPAICADTGW

SEQ ID NO: 1138340 - protein, 25 aa, Mycobacterium
EKAPAMFVLAFIPMLLVAFAYKELS

SEQ ID NO: 1138341 - protein, 22 aa, Mycobacterium
EKTSLDPRFRFFGNVDVGEHVH

SEQ ID NO: 1138342 - protein, 25 aa, Mycobacterium
EKVFTRVVPVLLVLALALVVVGPKI

SEQ ID NO: 1138343 - protein, 22 aa, Mycobacterium
EKYAWLFMRFSGMALVFLALGH

SEQ ID NO: 1138344 - protein, 24 aa, Mycobacterium
ELAAAFPFYGPTPDNPDFAASKDV

SEQ ID NO: 1138345 - protein, 27 aa, Mycobacterium
ELAASWLWVVASGGLYLWVLKAAGDRR

SEQ ID NO: 1138346 - protein, 26 aa, Mycobacterium
ELADLLFRPRAFAALLVAKLAAGLSV

SEQ ID NO: 1138347 - protein, 24 aa, Mycobacterium
ELADTIARRLGLTGALGTVAESID

SEQ ID NO: 1138348 - protein, 19 aa, Mycobacterium
ELANQRLFYDRLAHALTLS

SEQ ID NO: 1138349 - protein, 26 aa, Mycobacterium
ELGAMTAMFLGFRERELILSVFETIT

SEQ ID NO: 1138350 - protein, 19 aa, Mycobacterium
ELGQPLAIEYVWGRQIGEN

SEQ ID NO: 1138351 - protein, 20 aa, Mycobacterium
ELGQPLLTEYVWGRQVGEHT

SEQ ID NO: 1138352 - protein, 22 aa, Mycobacterium
ELHWMVLPMAVIILLAVGADYN

SEQ ID NO: 1138353 - protein, 18 aa, Mycobacterium
ELNWWDLTVFGVSVVIGA

SEQ ID NO: 1138354 - protein, 24 aa, Mycobacterium
ELPKPAVELPKPPPVDLPDPVIEL

SEQ ID NO: 1138355 - protein, 19 aa, Mycobacterium
ELQFAALSGVFLLTAVIAG

SEQ ID NO: 1138356 - protein, 19 aa, Mycobacterium
ELRKWFARKSFYGSSAAPL

SEQ ID NO: 1138357 - protein, 18 aa, Mycobacterium
ELTRFDRAEAYWTRLGWS

SEQ ID NO: 1138358 - protein, 28 aa, Mycobacterium
ELTTTHFPWTPFSIVVVSAVVLAVVATR

SEQ ID NO: 1138359 - protein, 21 aa, Mycobacterium
ELVDFVTYLEAGTQWARRPGT

SEQ ID NO: 1138360 - protein, 18 aa, Mycobacterium
ELVMLITADLFTCGIASI

SEQ ID NO: 1138361 - protein, 39 aa, Mycobacterium
EMHRPELGFLIPPAILAAAGLLFGLWPKPLDTVLRNYSD

SEQ ID NO: 1138362 - protein, 30 aa, Mycobacterium
EMLVLVIAGLVILGPERLPGAIRWTAGAVR

SEQ ID NO: 1138363 - protein, 18 aa, Mycobacterium
EMTHFTGVGALIMFLAAL

SEQ ID NO: 1138364 - protein, 34 aa, Mycobacterium
EMTPDTPIWRLVLPFLVMGIGMAFIWSPLAATAT

SEQ ID NO: 1138365 - protein, 19 aa, Mycobacterium
ENDFGWRIIFGFPGIVLAS

SEQ ID NO: 1138366 - protein, 32 aa, Mycobacterium
ENGLVLAYLGLLWWMMVRWSQGLRGRPTSRSF

SEQ ID NO: 1138367 - protein, 25 aa, Mycobacterium
ENGTVLIRLMALTLPAVGLMTIFTA

SEQ ID NO: 1138368 - protein, 25 aa, Mycobacterium
ENQLSFLDCLYYATVSLSTTGYGDI

SEQ ID NO: 1138369 - protein, 20 aa, Mycobacterium
ENRRLILASLAPRTTTRPAR

SEQ ID NO: 1138370 - protein, 22 aa, Mycobacterium
EPAWLRRCWLAAAIVAPAVLYL

SEQ ID NO: 1138371 - protein, 26 aa, Mycobacterium
EPDPTNLRWVLYALGTIAVIVAIQRL

SEQ ID NO: 1138372 - protein, 27 aa, Mycobacterium
EPFPSPADFFYLAFSVLVVPAVLGMAQ

SEQ ID NO: 1138373 - protein, 24 aa, Mycobacterium
EPGLGAGFWGTSFSAAYVSGVVAL

SEQ ID NO: 1138374 - protein, 26 aa, Mycobacterium
EPGRVPLWQRGYARRLVVLDFAAVVL

SEQ ID NO: 1138375 - protein, 29 aa, Mycobacterium
EPGRVPLWQRGYARRLVVLDFVAVVLAVG

SEQ ID NO: 1138376 - protein, 25 aa, Mycobacterium
EPHCYNIPMCWALRSVFDSLDGIST

SEQ ID NO: 1138377 - protein, 23 aa, Mycobacterium
EPHCYNIPVCWALRSVFDTLDGI

SEQ ID NO: 1138378 - protein, 17 aa, Mycobacterium
EPLFSLLNPRDADNLTQ

SEQ ID NO: 1138379 - protein, 21 aa, Mycobacterium
EPPLRLPTYLTDNAGALDTAG

SEQ ID NO: 1138380 - protein, 27 aa, Mycobacterium
EPRGEQMFWYRSTKFVMRRALPVGLAG

SEQ ID NO: 1138381 - protein, 26 aa, Mycobacterium
EPRLRALGWTGVLDKGADVPNSGQRT

SEQ ID NO: 1138382 - protein, 17 aa, Mycobacterium
EPRPEPRRDGVFSAYGI

SEQ ID NO: 1138383 - protein, 26 aa, Mycobacterium
EPRPLTKVLAAPLPPSAAYPAPAPRR

SEQ ID NO: 1138384 - protein, 21 aa, Mycobacterium
EPVVLALEAVALLAGAYTFVP

SEQ ID NO: 1138385 - protein, 25 aa, Mycobacterium
EPVVLFFGVWAKYKGIEVLLDAFAR

SEQ ID NO: 1138386 - protein, 30 aa, Mycobacterium
EQAPADRRVLWRRRIWLPFAGIAGRTPAEK

SEQ ID NO: 1138387 - protein, 29 aa, Mycobacterium
EQDPQAFLKLMLRWLNAFVPKPGQTIPGV

SEQ ID NO: 1138388 - protein, 24 aa, Mycobacterium
EQDRPFIVMPYHARGSLADQVRRE

SEQ ID NO: 1138389 - protein, 23 aa, Mycobacterium
EQKLFFPRYYLKVEPYIRLEMNH

SEQ ID NO: 1138390 - protein, 23 aa, Mycobacterium
EQLLSFFALLVLTAAGIAFIFRP

SEQ ID NO: 1138391 - protein, 18 aa, Mycobacterium
EQTPLAHIVPDDAAPYAG

SEQ ID NO: 1138392 - protein, 25 aa, Mycobacterium
EQVSANWWDILRKPSYLAIVAGAAS

SEQ ID NO: 1138393 - protein, 20 aa, Mycobacterium
EQYVALTPRAAAPPLRDGDV

SEQ ID NO: 1138394 - protein, 23 aa, Mycobacterium
ERDGMVLLWIVWAGALAGVALKM

SEQ ID NO: 1138395 - protein, 48 aa, Mycobacterium
ERDRLPIEIAIAVLVLGVLLLVYRSVVTMLLPLVTIGSSLMIAQGVVA

SEQ ID NO: 1138396 - protein, 19 aa, Mycobacterium
ERFLGSRPHPYAWIPFGGG

SEQ ID NO: 1138397 - protein, 23 aa, Mycobacterium
ERLLVDYFRALNDGYYATAWGLM

SEQ ID NO: 1138398 - protein, 24 aa, Mycobacterium
ERLVFYAFVVIVVTLLLQGLSLPT

SEQ ID NO: 1138399 - protein, 24 aa, Mycobacterium
ERLVFYAFVVIVVTLLLQGLTLPT

SEQ ID NO: 1138400 - protein, 26 aa, Mycobacterium
ERQDTLRAMLTWSFVSLGVVGVVAGG

SEQ ID NO: 1138401 - protein, 22 aa, Mycobacterium
ERRHAVRRWIPGGAAVILVIIL

SEQ ID NO: 1138402 - protein, 37 aa, Mycobacterium
ERRRALRRMKLVALGFLLGASVIFLICTWAQSRGAAS

SEQ ID NO: 1138403 - protein, 26 aa, Mycobacterium
ERRTTVIAWYFGVGFAVAAPLPAIGG

SEQ ID NO: 1138404 - protein, 25 aa, Mycobacterium
ERTEPALNLDLLLGGLKPVIQGLNP

SEQ ID NO: 1138405 - protein, 21 aa, Mycobacterium
ERTFLAWIRTALALIAGGIAV

SEQ ID NO: 1138406 - protein, 23 aa, Mycobacterium
ERTLLYVLMVVLSGALLIGAVVL

SEQ ID NO: 1138407 - protein, 17 aa, Mycobacterium
ERTRPVWERLRPVWRWV

SEQ ID NO: 1138408 - protein, 24 aa, Mycobacterium
ERTRPVWERLRPVWRWVLRTRDRL

SEQ ID NO: 1138409 - protein, 18 aa, Mycobacterium
ERVLANVIDNALRYAPDG

SEQ ID NO: 1138410 - protein, 33 aa, Mycobacterium
ESESRRMGLLVEDLLLLARLDAQRPLDRHRVDL

SEQ ID NO: 1138411 - protein, 31 aa, Mycobacterium
ESFMSWGWRVPFLVSLLLLGLGIYVRLSITE

SEQ ID NO: 1138412 - protein, 30 aa, Mycobacterium; identical to SEQ ID NO: 162251

SEQ ID NO: 1138413 - protein, 17 aa, Mycobacterium
ESLLIDPGLDDTGGRFF

SEQ ID NO: 1138414 - protein, 27 aa, Mycobacterium
ESLLSRYFMWRVVMVSVLMAGGALTMF

SEQ ID NO: 1138415 - protein, 23 aa, Mycobacterium
ESPEVLGLLLIPATVLAAVAATT

SEQ ID NO: 1138416 - protein, 28 aa, Mycobacterium
ESRKLVERLRPSLPVLLANLTGIADVAL

SEQ ID NO: 1138417 - protein, 25 aa, Mycobacterium
ESRSARVWRRIRIGIVVAACLVTLQ

SEQ ID NO: 1138418 - protein, 17 aa, Mycobacterium
ESTAYIRFPTDTVARKN

SEQ ID NO: 1138419 - protein, 23 aa, Mycobacterium
ESVDAFRRFHAALYAQQPSEAGS

SEQ ID NO: 1138420 - protein, 26 aa, Mycobacterium
ESVRNRLWHRVPWLVVGLLGAMVSAV

SEQ ID NO: 1138421 - protein, 38 aa, Mycobacterium
ESVSAGPFFKPYITNLLPGQFIQPFIEAAFSDLGLDPN

SEQ ID NO: 1138422 - protein, 24 aa, Mycobacterium
ESYGWRIPFLIAGPLGLVGLYIRL

SEQ ID NO: 1138423 - protein, 20 aa, Mycobacterium
ETAIVRRVLSMIPQLPDDVF

SEQ ID NO: 1138424 - protein, 24 aa, Mycobacterium
ETERIWLPFTVWLVASTALLPPRS

SEQ ID NO: 1138425 - protein, 26 aa, Mycobacterium
ETFERTAVVLLIVSIVTIPAAVMLAR

SEQ ID NO: 1138426 - protein, 27 aa, Mycobacterium
ETKDIFRSVWLWVLLGVGIGAVIHGWV

SEQ ID NO: 1138427 - protein, 25 aa, Mycobacterium
ETKQVWLELTYFSGLGALIVFLAAL

SEQ ID NO: 1138428 - protein, 26 aa, Mycobacterium
ETLFTSDWVLLAYPLFVVVIAVFILQ

SEQ ID NO: 1138429 - protein, 19 aa, Mycobacterium
ETLLAALRRAGVDASYSCQ

SEQ ID NO: 1138430 - protein, 20 aa, Mycobacterium
ETMFQTGLRRFSYLLLRVAL

SEQ ID NO: 1138431 - protein, 17 aa, Mycobacterium
ETPALQPAIRLVTADET

SEQ ID NO: 1138432 - protein, 21 aa, Mycobacterium
ETPVPYLQWQNAPGVTPPQIA

SEQ ID NO: 1138433 - protein, 19 aa, Mycobacterium
ETTLTLIYSTVSLPSWAAG

SEQ ID NO: 1138434 - protein, 31 aa, Mycobacterium
ETVEHGIWVAFWFFLAQLNFVLGAVNLIPLL

SEQ ID NO: 1138435 - protein, 23 aa, Mycobacterium
ETVSPWFRSIWVLQPRGDLMVDA

SEQ ID NO: 1138436 - protein, 22 aa, Mycobacterium
EVAAFLAVIALALTIAAVAFGY

SEQ ID NO: 1138437 - protein, 29 aa, Mycobacterium
EVADQPFLPRLLILLVVAVVITAAVYGVV

SEQ ID NO: 1138438 - protein, 18 aa, Mycobacterium
EVAIPLLTPAFLGSALLL

SEQ ID NO: 1138439 - protein, 18 aa, Mycobacterium
EVDDVAPPWLKSVPTRLS

SEQ ID NO: 1138440 - protein, 20 aa, Mycobacterium
EVDDVAPPWLKSVPTRLSGL

SEQ ID NO: 1138441 - protein, 17 aa, Mycobacterium
EVDSVAPSWLRSVPNRL

SEQ ID NO: 1138442 - protein, 23 aa, Mycobacterium
EVEDQLFRFGRVLDAQSQLSRLL

SEQ ID NO: 1138443 - protein, 17 aa, Mycobacterium
EVFTVFFGVVFAGFIGI

SEQ ID NO: 1138444 - protein, 25 aa, Mycobacterium
EVFVQAWTLLKVTTMPALLMAIPIG

SEQ ID NO: 1138445 - protein, 25 aa, Mycobacterium
EVGVAPRWIPYLAGLKLAGAAGLLL

SEQ ID NO: 1138446 - protein, 23 aa, Mycobacterium
EVHDLHVWTLVPGKDMVTAHLTS

SEQ ID NO: 1138447 - protein, 25 aa, Mycobacterium
EVIGLAFHLAAIAFLLLARKEFWAR

SEQ ID NO: 1138448 - protein, 22 aa, Mycobacterium
EVKPTLPVLLANLTTIGQVGVT

SEQ ID NO: 1138449 - protein, 20 aa, Mycobacterium
EVPFTFAYPIRAADGPSLRI

SEQ ID NO: 1138450 - protein, 18 aa, Mycobacterium
EVPGRIATRLRELGIRSA

SEQ ID NO: 1138451 - protein, 28 aa, Mycobacterium
EVSGWGQAWLLAQPFKTARRGMLLWPSG

SEQ ID NO: 1138452 - protein, 23 aa, Mycobacterium
EVSPGWYFLPVCLIALIGGMSTG

SEQ ID NO: 1138453 - protein, 18 aa, Mycobacterium
EVTNLELYLIFPLNNEES

SEQ ID NO: 1138454 - protein, 26 aa, Mycobacterium
EVTPLWAAIYMLPITVGFLLAGPIAG

SEQ ID NO: 1138455 - protein, 21 aa, Mycobacterium
EVTRLIRRLLPALVVVLAVSA

SEQ ID NO: 1138456 - protein, 23 aa, Mycobacterium
EWAQRLPGPGWLVPMGVVAACAT

SEQ ID NO: 1138457 - protein, 19 aa, Mycobacterium
EWKFGFTTMLLGLSVVALL

SEQ ID NO: 1138458 - protein, 20 aa, Mycobacterium
EYGPLTRQMFVRYAGASGDL

SEQ ID NO: 1138459 - protein, 26 aa, Mycobacterium
EYTAPILVVGWLWATTRRRPTTMTLA

SEQ ID NO: 1138460 - protein, 19 aa, Mycobacterium
EYVPGRPVLPGLDLVIPAG

SEQ ID NO: 1138461 - protein, 19 aa, Mycobacterium
FAALLGLVVLVLTAYLVGA

SEQ ID NO: 1138462 - protein, 34 aa, Mycobacterium
FAALWISNLKVPQWFRGLMPVVIVPLGASLFVGL

SEQ ID NO: 1138463 - protein, 18 aa, Mycobacterium
FAALWPMSLALCVQFFVG

SEQ ID NO: 1138464 - protein, 25 aa, Mycobacterium
FAAVAGVFLLAGLIAGGAGAPPTVV

SEQ ID NO: 1138465 - protein, 25 aa, Mycobacterium
FAAVRDMFGWIGPVLMALNGNAVCD

SEQ ID NO: 1138466 - protein, 18 aa, Mycobacterium
FACPPGIPEGDKSTFWGS

SEQ ID NO: 1138467 - protein, 25 aa, Mycobacterium
FADIDRQMYFFYAATMAPFLVMIIA

SEQ ID NO: 1138468 - protein, 18 aa, Mycobacterium
FAFAVKAPLWPFHRWLPD

SEQ ID NO: 1138469 - protein, 18 aa, Mycobacterium
FAFKAMGIVLPIAGFFFI

SEQ ID NO: 1138470 - protein, 22 aa, Mycobacterium
FAGQRPWTALIGLLAQASDLGL

SEQ ID NO: 1138471 - protein, 36 aa, Mycobacterium
FAIPTYAFMIGMYAMLAWGFLQILVLGRDLRAESAG

SEQ ID NO: 1138472 - protein, 23 aa, Mycobacterium
FAIVIVAVARWRGLRALVGIVIA

SEQ ID NO: 1138473 - protein, 21 aa, Mycobacterium
FALFVFWLLLIARVVVEFIRS

SEQ ID NO: 1138474 - protein, 25 aa, Mycobacterium
FALSWWLGLYLLARDPRKAVLVLAA

SEQ ID NO: 1138475 - protein, 18 aa, Mycobacterium
FALVLLVSMFSPAGPTGL

SEQ ID NO: 1138476 - protein, 27 aa, Mycobacterium
FALVVWVLSALWLLVLIFATFAHWLRN

SEQ ID NO: 1138477 - protein, 21 aa, Mycobacterium
FAMLGAYWGFSIGTLALTAAF

SEQ ID NO: 1138478 - protein, 20 aa, Mycobacterium
FAPDRFDIPPGGSTAAWLSV

SEQ ID NO: 1138479 - protein, 18 aa, Mycobacterium
FAPWPIQHDGFVADTAYL

SEQ ID NO: 1138480 - protein, 19 aa, Mycobacterium
FAQSGWAAVFIAVVAGRVA

SEQ ID NO: 1138481 - protein, 23 aa, Mycobacterium
FAQVGSWRWAFGVLVGLTVAMGV

SEQ ID NO: 1138482 - protein, 21 aa, Mycobacterium
FAQYSSWRWAFGILVVMTTAM

SEQ ID NO: 1138483 - protein, 31 aa, Mycobacterium
FARYDELRQQFPWYRNEFGPGFWTVCNYEGI

SEQ ID NO: 1138484 - protein, 23 aa, Mycobacterium
FASAFFNVRLIVPGTTAVALSAT

SEQ ID NO: 1138485 - protein, 23 aa, Mycobacterium
FASAFFNVRLIVPGTTSVALSAT

SEQ ID NO: 1138486 - protein, 28 aa, Mycobacterium
FASGFGIFGIMMLIGMAGMLFRGRGAAQ

SEQ ID NO: 1138487 - protein, 19 aa, Mycobacterium
FASVPMLFATPTYYAQFSD

SEQ ID NO: 1138488 - protein, 25 aa, Mycobacterium
FATFLSPIDLLWSFAQAVLMAVAIL

SEQ ID NO: 1138489 - protein, 25 aa, Mycobacterium
FAVGKRLWEIVGLVAPGRGGHEDDK

SEQ ID NO: 1138490 - protein, 22 aa, Mycobacterium
FAVKRVLWLTTLIRSGQPMSEG

SEQ ID NO: 1138491 - protein, 25 aa, Mycobacterium
FAVLGYPLFLLLTSGSLVAAITAHC

SEQ ID NO: 1138492 - protein, 29 aa, Mycobacterium
FAVLYGVPVWGFAVLWIALAAALTVRTLR

SEQ ID NO: 1138493 - protein, 29 aa, Mycobacterium
FAVQDALFWLAFIVAISAAAFVIPPDGRS

SEQ ID NO: 1138494 - protein, 44 aa, Mycobacterium
FAVVPAHWQEWMPAGLFFAAIALFQLLWARLVLTRTTTPVLALG

SEQ ID NO: 1138495 - protein, 43 aa, Mycobacterium
FAVVPAHWQEWMPAGLFFAAIALFQLSWARLVLTRTTTPVLAL

SEQ ID NO: 1138496 - protein, 26 aa, Mycobacterium
FAWALSVMFLVFTLRAILYKPFVRQI

SEQ ID NO: 1138497 - protein, 29 aa, Mycobacterium
FAWHHNRFPLSMLLMLVLLGALIVIYRLQ

SEQ ID NO: 1138498 - protein, 19 aa, Mycobacterium
FCKSCDAFLDPQPAPEPGP

SEQ ID NO: 1138499 - protein, 18 aa, Mycobacterium
FCLWPFTRLVHAFSAPIG

SEQ ID NO: 1138500 - protein, 17 aa, Mycobacterium
FCVYAYYKFVRYEEAPP

SEQ ID NO: 1138501 - protein, 19 aa, Mycobacterium
FDAGYFWHYNELWLGGAAG

SEQ ID NO: 1138502 - protein, 34 aa, Mycobacterium
FDDAWRHYRFAVAYLMVLPVITLIGWDTLPERSR

SEQ ID NO: 1138503 - protein, 18 aa, Mycobacterium
FDFSTAPLTMKPGETARR

SEQ ID NO: 1138504 - protein, 24 aa, Mycobacterium
FDKEPLLIWTLIASLFIGNFLLLV

SEQ ID NO: 1138505 - protein, 19 aa, Mycobacterium
FDLVPYYPLVVTGLLLLTS

SEQ ID NO: 1138506 - protein, 28 aa, Mycobacterium
FDQNNPLPPPWYPQPGPPPAPAPGVVQG

SEQ ID NO: 1138507 - protein, 18 aa, Mycobacterium
FDRICRVGRSLRVHLLLA

SEQ ID NO: 1138508 - protein, 17 aa, Mycobacterium
FDSVIGVGLQIGAVLLA

SEQ ID NO: 1138509 - protein, 18 aa, Mycobacterium
FDTELLVLAERSGLRIHE

SEQ ID NO: 1138510 - protein, 33 aa, Mycobacterium
FDTFLNPIDLLWSFLQAVLMAIAILLVHTYFGY

SEQ ID NO: 1138511 - protein, 22 aa, Mycobacterium
FDYWQAWVFLAVFIVTTLGPTF

SEQ ID NO: 1138512 - protein, 32 aa, Mycobacterium
FEAWRDIDAFQFFYLVLPLLRGAYEATAVFYF

SEQ ID NO: 1138513 - protein, 31 aa, Mycobacterium
FELKKRPTWIWIAESLVLVVAVLVAGRFLFF

SEQ ID NO: 1138514 - protein, 24 aa, Mycobacterium
FELPKAMFVIGIVYILFATVVAFV

SEQ ID NO: 1138515 - protein, 21 aa, Mycobacterium
FFEHQPFLNDAIAANGFELTL

SEQ ID NO: 1138516 - protein, 23 aa, Mycobacterium
FFESTFIGLWIFGWNRLPRVVHL

SEQ ID NO: 1138517 - protein, 18 aa, Mycobacterium
FFFLMSGADHDQMDRMRS

SEQ ID NO: 1138518 - protein, 18 aa, Mycobacterium
FFGGLLFFEKSAIIPFVA

SEQ ID NO: 1138519 - protein, 21 aa, Mycobacterium
FFHTARYMLMNFVLAVGVGAW

SEQ ID NO: 1138520 - protein, 18 aa, Mycobacterium
FFIAALVVLFYSTFFFFF

SEQ ID NO: 1138521 - protein, 18 aa, Mycobacterium
FFIGALVVLFYSTFFFFF

SEQ ID NO: 1138522 - protein, 17 aa, Mycobacterium
FFILHGRDDSIIPVPEG

SEQ ID NO: 1138523 - protein, 40 aa, Mycobacterium
FFLAGDLLGLPGWVTQRLWWALLLTVGFWGVVRVAEALGL

SEQ ID NO: 1138524 - protein, 24 aa, Mycobacterium
FFQAIAMAIVIMLVHTYYGFTATG

SEQ ID NO: 1138525 - protein, 18 aa, Mycobacterium
FFQHYFFLTSIHCIHVLI

SEQ ID NO: 1138526 - protein, 18 aa, Mycobacterium
FFQNFLSSQFGFDIHWLI

SEQ ID NO: 1138527 - protein, 31 aa, Mycobacterium
FFRAVPVLIMMIFAYFLYAFYDVFPSKHLAL

SEQ ID NO: 1138528 - protein, 19 aa, Mycobacterium
FFSPNPWSALITGLVAGVF

SEQ ID NO: 1138529 - protein, 17 aa, Mycobacterium
FFSVFEYFRSWEFFRTT

SEQ ID NO: 1138530 - protein, 22 aa, Mycobacterium
FGAFGVPLWQMAAGALIGSAPK

SEQ ID NO: 1138531 - protein, 22 aa, Mycobacterium
FGAIVWWMWGAEFAAQYYAGYV

SEQ ID NO: 1138532 - protein, 18 aa, Mycobacterium
FGALVWIFQDGHLGALGT

SEQ ID NO: 1138533 - protein, 23 aa, Mycobacterium
FGAMLRLFYVALPGLRDDWRPVL

SEQ ID NO: 1138534 - protein, 18 aa, Mycobacterium
FGAQFLSGLVSPATIFIG

SEQ ID NO: 1138535 - protein, 18 aa, Mycobacterium
FGFLAPGFQARVVDPDTG

SEQ ID NO: 1138536 - protein, 18 aa, Mycobacterium
FGFLTKMLQALLVLPAFA

SEQ ID NO: 1138537 - protein, 21 aa, Mycobacterium
FGGRNWTVISALLLLIPCLGL

SEQ ID NO: 1138538 - protein, 24 aa, Mycobacterium
FGHDPWWLVLAKSLGIFAFLLLTV

SEQ ID NO: 1138539 - protein, 21 aa, Mycobacterium
FGIDLPWLVYAMIGVVVIATL

SEQ ID NO: 1138540 - protein, 26 aa, Mycobacterium
FGIDWAPLIWLPAAAAFFPLWLLLQI

SEQ ID NO: 1138541 - protein, 17 aa, Mycobacterium
FGIFVALKTLASLSFVL

SEQ ID NO: 1138542 - protein, 21 aa, Mycobacterium
FGIILALIMRAIFIAVGAALL

SEQ ID NO: 1138543 - protein, 27 aa, Mycobacterium
FGIKAAVFPLSTWLPDSYPTAPAPVTA

SEQ ID NO: 1138544 - protein, 24 aa, Mycobacterium
FGITTVYHFIFVPLTIGLAPLIAI

SEQ ID NO: 1138545 - protein, 22 aa, Mycobacterium
FGLFFLFPLYAMADFSTRNLIA

SEQ ID NO: 1138546 - protein, 17 aa, Mycobacterium
FGLFRVSRSIWLRAIGT

SEQ ID NO: 1138547 - protein, 19 aa, Mycobacterium
FGLIPLALGLWAAWGAWRG

SEQ ID NO: 1138548 - protein, 17 aa, Mycobacterium
FGLRRWYTLTLAMGTFF

SEQ ID NO: 1138549 - protein, 26 aa, Mycobacterium
FGLSVLFWQHILGTELHWMVLAMAVI

SEQ ID NO: 1138550 - protein, 17 aa, Mycobacterium
FGLYPNPRVFAVLNTIV

SEQ ID NO: 1138551 - protein, 37 aa, Mycobacterium
FGQFLPDVWWLPYAALSLPFLLLFRLTCYYYRGAYYR

SEQ ID NO: 1138552 - protein, 21 aa, Mycobacterium
FGQIRMVHAVPFPPALQEIWR

SEQ ID NO: 1138553 - protein, 19 aa, Mycobacterium
FGQSYRLELMLAIARSEDG

SEQ ID NO: 1138554 - protein, 40 aa, Mycobacterium
FGQTRLLRWSVPGIAHFFTMWGFFVLATVYIEAFGQLVDH

SEQ ID NO: 1138555 - protein, 33 aa, Mycobacterium
FGRIGVIYHKSLEHALVVFPALLAALNTVAGGV

SEQ ID NO: 1138556 - protein, 17 aa, Mycobacterium
FGRLLRDGRWWVGSGTA

SEQ ID NO: 1138557 - protein, 25 aa, Mycobacterium
FGSVRMVLALLPHWRERRFGHVVNV

SEQ ID NO: 1138558 - protein, 26 aa, Mycobacterium
FGTRALVLVRLLVPSAHLLDLHREVD

SEQ ID NO: 1138559 - protein, 27 aa, Mycobacterium
FGVAPFLAPLYFAFGVVAALLGELAVA

SEQ ID NO: 1138560 - protein, 26 aa, Mycobacterium
FGVQAGLYGGLLVDAYRAANVQVQVS

SEQ ID NO: 1138561 - protein, 27 aa, Mycobacterium
FGVSIRITVVWWLVFTAIATWVLFKTK

SEQ ID NO: 1138562 - protein, 22 aa, Mycobacterium
FGVVALMLLNLVLGLFGVGGGA

SEQ ID NO: 1138563 - protein, 22 aa, Mycobacterium
FGWVRNPIFTAVLTAFLGLALM

SEQ ID NO: 1138564 - protein, 33 aa, Mycobacterium
FGYGLLFGLAFYLPLLPWVANLVGPAPWVALAF

SEQ ID NO: 1138565 - protein, 19 aa, Mycobacterium
FHRRRPAVVIAGDGSFFMH

SEQ ID NO: 1138566 - protein, 17 aa, Mycobacterium
FHTPLKATLLYFCLAQL

SEQ ID NO: 1138567 - protein, 17 aa, Mycobacterium
FHTPPPPGGPPPGWPPQ

SEQ ID NO: 1138568 - protein, 31 aa, Mycobacterium
FHVVGTLLVLGLLIAPPATALLWVRSIPRVM

SEQ ID NO: 1138569 - protein, 17 aa, Mycobacterium
FIFQVGPLSLVVALLAG

SEQ ID NO: 1138570 - protein, 17 aa, Mycobacterium
FIFSVYFQNVTPGAFAA

SEQ ID NO: 1138571 - protein, 19 aa, Mycobacterium
FIGFLVVLAITALTGYFVA

SEQ ID NO: 1138572 - protein, 19 aa, Mycobacterium
FIGHAGMPGMRMAFSLLPD

SEQ ID NO: 1138573 - protein, 17 aa, Mycobacterium
FILGLYWRRGTVKAAMA

SEQ ID NO: 1138574 - protein, 17 aa, Mycobacterium
FILPYVVAAVLWLRNRD

SEQ ID NO: 1138575 - protein, 18 aa, Mycobacterium
FISLLLLAGLVQVPEDMQ

SEQ ID NO: 1138576 - protein, 18 aa, Mycobacterium
FIVASWPVASKSAPVVAV

SEQ ID NO: 1138577 - protein, 19 aa, Mycobacterium
FKIHLNDPPTCSVGFLPPT

SEQ ID NO: 1138578 - protein, 38 aa, Mycobacterium
FKLNIARGYLMIALPIGLVALILFRWIARRVVASVREK

SEQ ID NO: 1138579 - protein, 29 aa, Mycobacterium
FKRIAMNYPPLLFHPINSITAYKGQIIYD

SEQ ID NO: 1138580 - protein, 25 aa, Mycobacterium
FKTPTALPVIGFLASLFLVTPLSGR

SEQ ID NO: 1138581 - protein, 17 aa, Mycobacterium
FLAAFINVRIAAPVVAG

SEQ ID NO: 1138582 - protein, 17 aa, Mycobacterium
FLAAFINVRISAPVVAG

SEQ ID NO: 1138583 - protein, 17 aa, Mycobacterium
FLAAYRIAADEPLDGLF

SEQ ID NO: 1138584 - protein, 28 aa, Mycobacterium
FLAKILRRFVLANRRWWPPPPKVLYASK

SEQ ID NO: 1138585 - protein, 17 aa, Mycobacterium
FLALLGYAALYAYVAPW

SEQ ID NO: 1138586 - protein, 17 aa, Mycobacterium
FLALLSASGWSVAYASA

SEQ ID NO: 1138587 - protein, 23 aa, Mycobacterium
FLASGLLFILPILSTGPLPVRQS

SEQ ID NO: 1138588 - protein, 24 aa, Mycobacterium
FLASYLFNVYFQNGAPGSFVATFA

SEQ ID NO: 1138589 - protein, 18 aa, Mycobacterium
FLAVFLYAIGFVGDVVVP

SEQ ID NO: 1138590 - protein, 24 aa, Mycobacterium
FLAYTLYVFIRWVSGPYFEPVAGG

SEQ ID NO: 1138591 - protein, 23 aa, Mycobacterium
FLAYTLYVLIRWVSGPYFEPVAG

SEQ ID NO: 1138592 - protein, 23 aa, Mycobacterium
FLEQSWFVARVSLMPTLLVAIPF

SEQ ID NO: 1138593 - protein, 19 aa, Mycobacterium
FLHRGLPLVLTRRVRARKL

SEQ ID NO: 1138594 - protein, 17 aa, Mycobacterium
FLICTWAQSRGAASGGA

SEQ ID NO: 1138595 - protein, 17 aa, Mycobacterium
FLLGAFSSAFFLYGVAM

SEQ ID NO: 1138596 - protein, 18 aa, Mycobacterium
FLLGAFSSAIFLYGAAML

SEQ ID NO: 1138597 - protein, 26 aa, Mycobacterium
FLLVAAAWIIYSTLSGRGAFIVPDMQ

SEQ ID NO: 1138598 - protein, 24 aa, Mycobacterium
FLLVMIGFLLQWPTIPTLIMFPIL

SEQ ID NO: 1138599 - protein, 18 aa, Mycobacterium
FLLVMVTSVAWSLDTNFW

SEQ ID NO: 1138600 - protein, 20 aa, Mycobacterium
FLPPALAWPLAVVAVAASVA

SEQ ID NO: 1138601 - protein, 26 aa, Mycobacterium
FLQPSDILWSLFQAVLMGFVVMLVHT

SEQ ID NO: 1138602 - protein, 17 aa, Mycobacterium
FLRTLILSLAATHHPDQ

SEQ ID NO: 1138603 - protein, 24 aa, Mycobacterium
FLVGGRMLPFWLVGGALMGAAVDT

SEQ ID NO: 1138604 - protein, 17 aa, Mycobacterium
FLVIALEGAARTAGTDY

SEQ ID NO: 1138605 - protein, 17 aa, Mycobacterium
FLVIRRESRRRTGAPAL

SEQ ID NO: 1138606 - protein, 19 aa, Mycobacterium
FLVMAAALSHIMWLLVRRR

SEQ ID NO: 1138607 - protein, 18 aa, Mycobacterium
FLVVWLIPVVLGVAYARG

SEQ ID NO: 1138608 - protein, 24 aa, Mycobacterium
FLWGRLPLYIVAIYPMMATVSFEI

SEQ ID NO: 1138609 - protein, 20 aa, Mycobacterium
FMALGWKILIPVSLGWIMIV

SEQ ID NO: 1138610 - protein, 17 aa, Mycobacterium
FMASLDRIALGTATALE

SEQ ID NO: 1138611 - protein, 21 aa, Mycobacterium
FMAYIVMGWLPQVLVDNGVDQ

SEQ ID NO: 1138612 - protein, 18 aa, Mycobacterium
FMFVGFCAWFVGMHLLFA

SEQ ID NO: 1138613 - protein, 23 aa, Mycobacterium
FMHGRVLLTPLFCLLAPVSVVPL

SEQ ID NO: 1138614 - protein, 18 aa, Mycobacterium
FMLLTAGTAVFVAAEFSL

SEQ ID NO: 1138615 - protein, 21 aa, Mycobacterium
FMVLRLVFVGWRALSGRWLVP

SEQ ID NO: 1138616 - protein, 17 aa, Mycobacterium
FMVSRLNCSITTSDGTV

SEQ ID NO: 1138617 - protein, 18 aa, Mycobacterium
FNALPNAGPWRLPDIPAG

SEQ ID NO: 1138618 - protein, 17 aa, Mycobacterium
FNAMSMAITQRRPAISL

SEQ ID NO: 1138619 - protein, 19 aa, Mycobacterium
FNLASARLILGTAAEPRMV

SEQ ID NO: 1138620 - protein, 19 aa, Mycobacterium
FNLFEVLGVDRLLDDGCYG

SEQ ID NO: 1138621 - protein, 20 aa, Mycobacterium
FNLFEVLGVDRLLDDGCYGD

SEQ ID NO: 1138622 - protein, 26 aa, Mycobacterium
FNRQTVPLLAIIVVAVLVGGVAGAEL

SEQ ID NO: 1138623 - protein, 17 aa, Mycobacterium
FNTFLVPSDLLWSFLQA

SEQ ID NO: 1138624 - protein, 20 aa, Mycobacterium
FNTFLVPSDLLWSFLQAIVM

SEQ ID NO: 1138625 - protein, 20 aa, Mycobacterium
FNVVLLKRFAPQQIMVWALV

SEQ ID NO: 1138626 - protein, 20 aa, Mycobacterium
FNVWGYFGFLISIAFLVSYI

SEQ ID NO: 1138627 - protein, 17 aa, Mycobacterium
FNWVIPIVGGLVILLAI

SEQ ID NO: 1138628 - protein, 32 aa, Mycobacterium
FNYIIGIASLLFFFVYILQTIGLLVGYRRGTI

SEQ ID NO: 1138629 - protein, 21 aa, Mycobacterium
FPADVLYYFRLYALGTQVVIY

SEQ ID NO: 1138630 - protein, 21 aa, Mycobacterium
FPCEPFRPDAFFQQAAQLGLD

SEQ ID NO: 1138631 - protein, 20 aa, Mycobacterium
FPIAIPHPRFGDFHAGTGTG

SEQ ID NO: 1138632 - protein, 34 aa, Mycobacterium
FPIAVLPIIYAILILCIFLNFLIRQKKNKLDWLV

SEQ ID NO: 1138633 - protein, 18 aa, Mycobacterium
FPRWVAHFNIAIAALLIP

SEQ ID NO: 1138634 - protein, 17 aa, Mycobacterium
FPVLSVLTAVGIVAILV

SEQ ID NO: 1138635 - protein, 23 aa, Mycobacterium
FQAIAMAIVIMLVHTYYGFTATG

SEQ ID NO: 1138636 - protein, 26 aa, Mycobacterium
FRGTPLLVQAFFIYFGVPSALDFRMT

SEQ ID NO: 1138637 - protein, 23 aa, Mycobacterium
FRGVAMFFALTWAVGIGAYTVIA

SEQ ID NO: 1138638 - protein, 25 aa, Mycobacterium
FRHRGELVYLPPAWYATNPPPRLPA

SEQ ID NO: 1138639 - protein, 26 aa, Mycobacterium
FRHRGELVYLPPAWYATNPPPRLPAV

SEQ ID NO: 1138640 - protein, 19 aa, Mycobacterium
FRKILQPFFSPHTLSEALP

SEQ ID NO: 1138641 - protein, 17 aa, Mycobacterium
FRPALEKLNLVMDNLLE

SEQ ID NO: 1138642 - protein, 20 aa, Mycobacterium
FRRLLRFFPRAVDTVGEQAL

SEQ ID NO: 1138643 - protein, 27 aa, Mycobacterium
FRTGWFIESLATQTLIIFAIRTRKVPF

SEQ ID NO: 1138644 - protein, 21 aa, Mycobacterium
FRVSRSIWLRAIGTTYVDIFR

SEQ ID NO: 1138645 - protein, 24 aa, Mycobacterium
FRVVKDSMPLPRTLTSVVIDTGSV

SEQ ID NO: 1138646 - protein, 26 aa, Mycobacterium
FRVYMYALLGCALLIAPALIAAVDGV

SEQ ID NO: 1138647 - protein, 19 aa, Mycobacterium
FRYLGLLPAVGAVAAYFGE

SEQ ID NO: 1138648 - protein, 26 aa, Mycobacterium
FSAADNPVIFWTPATGARVVRGPINA

SEQ ID NO: 1138649 - protein, 25 aa, Mycobacterium
FSALRRPRMQLPMSGFYVVGAAYYV

SEQ ID NO: 1138650 - protein, 27 aa, Mycobacterium
FSALTVDLLLFAYVLGIVPALLIGGPL

SEQ ID NO: 1138651 - protein, 20 aa, Mycobacterium
FSAVRLTLARFLVLGLEFQL

SEQ ID NO: 1138652 - protein, 30 aa, Mycobacterium
FSDPISIVLVVVIVLALVFAGLLGAELYAR

SEQ ID NO: 1138653 - protein, 27 aa, Mycobacterium
FSIAAGVLYFFFVLPRTPELVGDTSPT

SEQ ID NO: 1138654 - protein, 25 aa, Mycobacterium
FSQTLYLPVVLVSGLLAVAIIRALV

SEQ ID NO: 1138655 - protein, 17 aa, Mycobacterium
FSRRLQHSIAEVASAAT

SEQ ID NO: 1138656 - protein, 27 aa, Mycobacterium
FSSFGVLLYYAIANASAWTLGARLIPA

SEQ ID NO: 1138657 - protein, 19 aa, Mycobacterium
FSSLLYRLHLTGGDGLPAT

SEQ ID NO: 1138658 - protein, 21 aa, Mycobacterium
FSWSLFNWIADVACLLFACFA

SEQ ID NO: 1138659 - protein, 23 aa, Mycobacterium
FTAAVFAVTYWLAIAQATAPVSV

SEQ ID NO: 1138660 - protein, 26 aa, Mycobacterium
FTAGAPFVWTLLLAGAVFALWAFIAA

SEQ ID NO: 1138661 - protein, 28 aa, Mycobacterium
FTAMGVIWGIPYLLIKVAVEGLSVPVLV

SEQ ID NO: 1138662 - protein, 31 aa, Mycobacterium
FTGPESLIVWLWLAVILLLVILSVRLSVLFS

SEQ ID NO: 1138663 - protein, 35 aa, Mycobacterium
FTGTAVGFVFLWLSLTPSLLPRGPLFQGLVSGGAG

SEQ ID NO: 1138664 - protein, 18 aa, Mycobacterium
FTILAVAGLPILAGGRTG

SEQ ID NO: 1138665 - protein, 24 aa, Mycobacterium
FTILTKVILPALLPALLSGAGLAF

SEQ ID NO: 1138666 - protein, 28 aa, Mycobacterium
FTLRHKALVIGAWLGVAVILAVVFPQLE

SEQ ID NO: 1138667 - protein, 26 aa, Mycobacterium
FTLRHKALVIGVWLGAAVVLALLFPQ

SEQ ID NO: 1138668 - protein, 17 aa, Mycobacterium
FTLVYLLSPRHGLVTAW

SEQ ID NO: 1138669 - protein, 19 aa, Mycobacterium
FTMAGPWVGIAAPGEDITS

SEQ ID NO: 1138670 - protein, 24 aa, Mycobacterium
FTPPFAFGMPRFDIVAIITMIIVM

SEQ ID NO: 1138671 - protein, 24 aa, Mycobacterium
FTRINAILGVLLIIVLATGSVING

SEQ ID NO: 1138672 - protein, 27 aa, Mycobacterium
FTRNQLIQMVLLVALVYVAYPFISSVP

SEQ ID NO: 1138673 - protein, 20 aa, Mycobacterium
FTSLTGLIAIPFFSALSDHV

SEQ ID NO: 1138674 - protein, 32 aa, Mycobacterium
FTTVLFTRVVVFLVVSLLIGAIVFAGLALAYR

SEQ ID NO: 1138675 - protein, 30 aa, Mycobacterium
FTVPVDRALPGPVYLPEARVACTPYRGGLR

SEQ ID NO: 1138676 - protein, 27 aa, Mycobacterium
FVAADLILFFVFFDLSIVAMYFVIAGW

SEQ ID NO: 1138677 - protein, 19 aa, Mycobacterium
FVAPTARLAQVPWSLLAIP

SEQ ID NO: 1138678 - protein, 20 aa, Mycobacterium
FVDGWFYLTRRDDVLAALRN

SEQ ID NO: 1138679 - protein, 30 aa, Mycobacterium
FVDNPFVLFGLPLLMGWLLIRRRQGRPAFT

SEQ ID NO: 1138680 - protein, 26 aa, Mycobacterium
FVFPMSAAFLIWYTTYVLLSTFATDF

SEQ ID NO: 1138681 - protein, 18 aa, Mycobacterium
FVFPMTAVFLVWYAVYVL

SEQ ID NO: 1138682 - protein, 17 aa, Mycobacterium
FVGPLFDFAFTPDRPWA

SEQ ID NO: 1138683 - protein, 17 aa, Mycobacterium
FVIAALAAFAGFAVTGL

SEQ ID NO: 1138684 - protein, 18 aa, Mycobacterium
FVILPLFALVNAGVLLDG

SEQ ID NO: 1138685 - protein, 17 aa, Mycobacterium
FVLLLGDIDLSAGVAGG

SEQ ID NO: 1138686 - protein, 18 aa, Mycobacterium
FVMLRDGLVAPVAQDSPP

SEQ ID NO: 1138687 - protein, 27 aa, Mycobacterium
FVMPTRPVPILLAVLGAALAGACLTIA

SEQ ID NO: 1138688 - protein, 26 aa, Mycobacterium
FVMPTRPVPILLAVLGAALAGACLTV

SEQ ID NO: 1138689 - protein, 27 aa, Mycobacterium
FVMPTRPVPILLAVLGAALAGACLTVA

SEQ ID NO: 1138690 - protein, 18 aa, Mycobacterium
FVMVVLVLVQVTARPWTV

SEQ ID NO: 1138691 - protein, 33 aa, Mycobacterium
FVNDYIFNFPDTSFAWAFVLALLAGALAARKRI

SEQ ID NO: 1138692 - protein, 22 aa, Mycobacterium
FVPALLFPQFFLGVAAYRPEQR

SEQ ID NO: 1138693 - protein, 18 aa, Mycobacterium
FVPMLPLAAATAATAAVV

SEQ ID NO: 1138694 - protein, 27 aa, Mycobacterium
FVQRTLALFLATFVYALTVLRTVRNDN

SEQ ID NO: 1138695 - protein, 23 aa, Mycobacterium
FVRDLESVWRILHALPAARSVAV

SEQ ID NO: 1138696 - protein, 26 aa, Mycobacterium
FVRMTPVPWWSYAVWVLTAVLSGILV

SEQ ID NO: 1138697 - protein, 19 aa, Mycobacterium
FVSLPFLVVSLEGALRSAG

SEQ ID NO: 1138698 - protein, 19 aa, Mycobacterium
FVVFVLYLALGRYGTIPLG

SEQ ID NO: 1138699 - protein, 24 aa, Mycobacterium
FVVYGILTLTIFVSGLLFAVNNGS

SEQ ID NO: 1138700 - protein, 19 aa, Mycobacterium
FVYIGEICTYLLNQPEKPT

SEQ ID NO: 1138701 - protein, 17 aa, Mycobacterium
FWFPEVHAGAMAPIGIG

SEQ ID NO: 1138702 - protein, 18 aa, Mycobacterium
FWGRHLVMGLPMAAALMT

SEQ ID NO: 1138703 - protein, 20 aa, Mycobacterium
FWHLVDLLWIFLFALLYLVS

SEQ ID NO: 1138704 - protein, 19 aa, Mycobacterium
FWIGRPIITLSFNNEKFNA

SEQ ID NO: 1138705 - protein, 19 aa, Mycobacterium
FWSEPFNVPFLVAIGATAL

SEQ ID NO: 1138706 - protein, 25 aa, Mycobacterium
FWSLAPLVVACVVLAGLLGMCSFQG

SEQ ID NO: 1138707 - protein, 19 aa, Mycobacterium
FYCPVDKTAYFDTGFFDVL

SEQ ID NO: 1138708 - protein, 25 aa, Mycobacterium
FYENKVRMIFLLPPNPEPAQFQRWL

SEQ ID NO: 1138709 - protein, 35 aa, Mycobacterium
FYGNTSQTTLSFPVAPGLRPATLNATLNLPFAMRS

SEQ ID NO: 1138710 - protein, 19 aa, Mycobacterium
FYISVIRGTPLLVQLFIVF

SEQ ID NO: 1138711 - protein, 18 aa, Mycobacterium
FYLTRRDDVLAALRNPEL

SEQ ID NO: 1138712 - protein, 25 aa, Mycobacterium
FYLVLPLLALLVRRVPVRARIPVIV

SEQ ID NO: 1138713 - protein, 25 aa, Mycobacterium
FYSINDLLHGLLMYSGNDAAHALAM

SEQ ID NO: 1138714 - protein, 26 aa, Mycobacterium
GAAAALGTPALAPAGPTQAAAPLGKL

SEQ ID NO: 1138715 - protein, 22 aa, Mycobacterium
GAAALAGLGPDLARLVKGSTTL

SEQ ID NO: 1138716 - protein, 22 aa, Mycobacterium
GAAFPLLKLFEYVPEVTAGLTP

SEQ ID NO: 1138717 - protein, 24 aa, Mycobacterium
GAAGLVEWPVLVTVGGAALVMHQL

SEQ ID NO: 1138718 - protein, 34 aa, Mycobacterium
GAAIDAVVDPILRLFGFGALAAAPLAAVEAVAGD

SEQ ID NO: 1138719 - protein, 25 aa, Mycobacterium
GAAILVTAIFFGAYLLVTGVAQLVL

SEQ ID NO: 1138720 - protein, 19 aa, Mycobacterium
GAALGVLIGMRSIGALPAA

SEQ ID NO: 1138721 - protein, 25 aa, Mycobacterium
GAALLTLFLDLSWPAGYTTILLSHI

SEQ ID NO: 1138722 - protein, 17 aa, Mycobacterium
GAALLWPSGGKADIPLP

SEQ ID NO: 1138723 - protein, 24 aa, Mycobacterium
GADLQPTLLRAMTFMIVASPCALV

SEQ ID NO: 1138724 - protein, 35 aa, Mycobacterium
GAELLIRFTGPEVWWLLGVARWAAGLPIAAVPVPS

SEQ ID NO: 1138725 - protein, 25 aa, Mycobacterium
GAELSFPMLQFTLLGALCLLGTAWL

SEQ ID NO: 1138726 - protein, 21 aa, Mycobacterium
GAEVIKLYRDGTVGVVPDATQ

SEQ ID NO: 1138727 - protein, 27 aa, Mycobacterium
GAEVVPPVIPVLPPITEYLPEITDILP

SEQ ID NO: 1138728 - protein, 23 aa, Mycobacterium
GAEYAHITGLRYTPVEIGTVTTS

SEQ ID NO: 1138729 - protein, 26 aa, Mycobacterium
GAEYAWTSPVIIGLFVASALALAVFI

SEQ ID NO: 1138730 - protein, 18 aa, Mycobacterium
GAFLQRFMPVLNGVYATG

SEQ ID NO: 1138731 - protein, 27 aa, Mycobacterium
GAGLIAAFRIWEGGLGIWGAVALGGIG

SEQ ID NO: 1138732 - protein, 23 aa, Mycobacterium
GAGPFLFGLLHDVSHGWTVPWMM

SEQ ID NO: 1138733 - protein, 26 aa, Mycobacterium
GAIASVWFWVPLGILVIAVSSIPSVI

SEQ ID NO: 1138734 - protein, 39 aa, Mycobacterium
GAKVSGSRFYFLTGFGALLQLGLFQLAVRTATENGFTLV

SEQ ID NO: 1138735 - protein, 26 aa, Mycobacterium
GALAMGYVVWLLWDNRAFAAGYAANS

SEQ ID NO: 1138736 - protein, 31 aa, Mycobacterium
GALGRALSLAWRRSLQLRVVSLTLGLSLAVI

SEQ ID NO: 1138737 - protein, 22 aa, Mycobacterium
GALLEGLNYYVARLNPKLPTLQ

SEQ ID NO: 1138738 - protein, 25 aa, Mycobacterium
GALLITKMPILWGQAALFAGASGWG

SEQ ID NO: 1138739 - protein, 18 aa, Mycobacterium
GALRRLVRHRSVVAGVPV

SEQ ID NO: 1138740 - protein, 25 aa, Mycobacterium
GALRVVLASYWPGLLVAVCQVVVMY

SEQ ID NO: 1138741 - protein, 22 aa, Mycobacterium
GALWAGGLFALLGHALRRGGHT

SEQ ID NO: 1138742 - protein, 25 aa, Mycobacterium
GAMALRRIALPATGLYPLATFGLGM

SEQ ID NO: 1138743 - protein, 25 aa, Mycobacterium
GAMTLYLWHIPLLLGMHLTFDYLGH

SEQ ID NO: 1138744 - protein, 30 aa, Mycobacterium
GAMVFVYLQAPVLFGFGRIAVKLHLPATGG

SEQ ID NO: 1138745 - protein, 17 aa, Mycobacterium
GANDAIRALLELAPPLA

SEQ ID NO: 1138746 - protein, 25 aa, Mycobacterium
GANDFYLYYFILTGLHLFHVCLGLG

SEQ ID NO: 1138747 - protein, 25 aa, Mycobacterium
GANIPAIIRGLIAVAWYGIQTFLAS

SEQ ID NO: 1138748 - protein, 24 aa, Mycobacterium
GANQEPRTWRLSVSLKREDGQIKM

SEQ ID NO: 1138749 - protein, 20 aa, Mycobacterium
GAPLAERACMLYAGSTLVAG

SEQ ID NO: 1138750 - protein, 24 aa, Mycobacterium
GAPPTVVLTLEALALVVGAYTFVP

SEQ ID NO: 1138751 - protein, 32 aa, Mycobacterium
GARAYLLVGGLLYLGLWLYGVLVEFGSDAHVI

SEQ ID NO: 1138752 - protein, 18 aa, Mycobacterium
GARLLAPGWPPMSSAVPC

SEQ ID NO: 1138753 - protein, 33 aa, Mycobacterium
GARTHIYAYGLRNPFRLTFTPTGQLLVADVGAA

SEQ ID NO: 1138754 - protein, 23 aa, Mycobacterium
GASLYALLVNRWPLPETGEPSGL

SEQ ID NO: 1138755 - protein, 21 aa, Mycobacterium
GATAVLYLWGLGSAGWANQYY

SEQ ID NO: 1138756 - protein, 24 aa, Mycobacterium
GATGVWLLAGLLFLSATGITWSTY

SEQ ID NO: 1138757 - protein, 20 aa, Mycobacterium
GATLLAVPLYLVDRGRSGSV

SEQ ID NO: 1138758 - protein, 18 aa, Mycobacterium
GATLLLFPVVQPWYVLWA

SEQ ID NO: 1138759 - protein, 28 aa, Mycobacterium
GAVATAGYLGWLLWQQNQVSRAGEQAQA

SEQ ID NO: 1138760 - protein, 24 aa, Mycobacterium
GAVAWFIGIFYKNLYVEGLINELT

SEQ ID NO: 1138761 - protein, 18 aa, Mycobacterium
GAVGLLYPPTRAAAACGL

SEQ ID NO: 1138762 - protein, 26 aa, Mycobacterium
GAVLICLMYVFLQQSLHNRPAGAQGV

SEQ ID NO: 1138763 - protein, 17 aa, Mycobacterium
GAVPWLALAAVEALFPA

SEQ ID NO: 1138764 - protein, 18 aa, Mycobacterium
GAVTPQWIDPRAAIVTTV

SEQ ID NO: 1138765 - protein, 27 aa, Mycobacterium
GAVVGALLMRIHIAVPFGLAAATTAAV

SEQ ID NO: 1138766 - protein, 19 aa, Mycobacterium
GAVVLLLTLATRGGPRKRA

SEQ ID NO: 1138767 - protein, 25 aa, Mycobacterium
GAWRSAALMWIVDLLLVVPSFLLIA

SEQ ID NO: 1138768 - protein, 18 aa, Mycobacterium
GAYFAILSQALAAALAIL

SEQ ID NO: 1138769 - protein, 24 aa, Mycobacterium
GAYPPPVYDTPYPTAPQPYSKGPS

SEQ ID NO: 1138770 - protein, 24 aa, Mycobacterium
GAYTFVPSTLKRLVKGKIGVGTLM

SEQ ID NO: 1138771 - protein, 19 aa, Mycobacterium
GCAVWRWRRKRPVFALGIL

SEQ ID NO: 1138772 - protein, 22 aa, Mycobacterium
GCGSGCYFARPAWRDGDNVLTL

SEQ ID NO: 1138773 - protein, 44 aa, Mycobacterium
GCGSVLGVLVLIAVVPKPVWITLGILVAVAALVVFVSWAVNEND

SEQ ID NO: 1138774 - protein, 24 aa, Mycobacterium
GCLTPFVNLFWAPVYVMELADAEG

SEQ ID NO: 1138775 - protein, 20 aa, Mycobacterium
GCVALLAAAPLLLGILGPGY

SEQ ID NO: 1138776 - protein, 23 aa, Mycobacterium
GDADYHRVFWLTTGFTVVVLAIV

SEQ ID NO: 1138777 - protein, 28 aa, Mycobacterium
GDAGYHRVFWLTTVFTLLVIAIVVTLVP

SEQ ID NO: 1138778 - protein, 17 aa, Mycobacterium
GDAVTFISVLRLVPHWF

SEQ ID NO: 1138779 - protein, 18 aa, Mycobacterium
GDDGWWTVKAPAGQKNRR

SEQ ID NO: 1138780 - protein, 19 aa, Mycobacterium
GDDLLYVWRHFPLERAHPR

SEQ ID NO: 1138781 - protein, 20 aa, Mycobacterium
GDFDIILFGLGRFGSHLADR

SEQ ID NO: 1138782 - protein, 27 aa, Mycobacterium
GDHEPDRYWVLRPVDNLSPLTTRHVSE

SEQ ID NO: 1138783 - protein, 26 aa, Mycobacterium
GDLGVYLDGQLYITGRIKDLVIVDGR

SEQ ID NO: 1138784 - protein, 19 aa, Mycobacterium
GDLLLIRPGAKIPVDGTVE

SEQ ID NO: 1138785 - protein, 24 aa, Mycobacterium
GDLVHLLAELLDNALRYSPPTSQV

SEQ ID NO: 1138786 - protein, 24 aa, Mycobacterium
GDLVHLLAELLDNALRYSPPTTEV

SEQ ID NO: 1138787 - protein, 25 aa, Mycobacterium
GDPPACSVGFLPPSSWRSPADLTDV

SEQ ID NO: 1138788 - protein, 17 aa, Mycobacterium
GDPPPPPAAPPVSGPAP

SEQ ID NO: 1138789 - protein, 29 aa, Mycobacterium
GDPTGLSLPMFMEELFWGCAGIGLAVVMP

SEQ ID NO: 1138790 - protein, 28 aa, Mycobacterium
GDSEPALRPLVDLLPIAGGSGTLSNRYL

SEQ ID NO: 1138791 - protein, 41 aa, Mycobacterium
GDVLGVPGWVTQRLWWALLLVVGFWGMLRLAEALGIGSTTS

SEQ ID NO: 1138792 - protein, 22 aa, Mycobacterium
GDVSFYCLDYGGGQLRALENLA

SEQ ID NO: 1138793 - protein, 25 aa, Mycobacterium
GEAELAHLLAGWRDDVRETPMGHVM

SEQ ID NO: 1138794 - protein, 17 aa, Mycobacterium
GEALRRLPPYATALGEV

SEQ ID NO: 1138795 - protein, 17 aa, Mycobacterium
GEAWRRLRPRLWALIGF

SEQ ID NO: 1138796 - protein, 23 aa, Mycobacterium
GEGVPTWWIAGGVVAAAAIGIAA

SEQ ID NO: 1138797 - protein, 24 aa, Mycobacterium
GEHSLGWLAVAALGAVLSPRRRRD

SEQ ID NO: 1138798 - protein, 20 aa, Mycobacterium
GEIAFALITTVLTGRSVLNA

SEQ ID NO: 1138799 - protein, 24 aa, Mycobacterium
GEIDGRLYLDMRLIEGRNLGTMLQ

SEQ ID NO: 1138800 - protein, 24 aa, Mycobacterium
GEILMWIPLPLLGVPPWMVFFAFS

SEQ ID NO: 1138801 - protein, 28 aa, Mycobacterium
GEISLPPGYLPLRVPIEVHFTQRVAVDV

SEQ ID NO: 1138802 - protein, 19 aa, Mycobacterium
GEITWPPPPVQVSAAPVAA

SEQ ID NO: 1138803 - protein, 41 aa, Mycobacterium
GELIQVVHPTFLYELLWNLLVFAVLILVDRRFKIGHGRLFA

SEQ ID NO: 1138804 - protein, 23 aa, Mycobacterium
GEPHIQLPTTPWHHTHHWAIRKH

SEQ ID NO: 1138805 - protein, 29 aa, Mycobacterium
GEPMPPMRWLGFALIWLALLVFTGDALRR

SEQ ID NO: 1138806 - protein, 25 aa, Mycobacterium
GESAMFFIGVLVVALLGGVAPAALS

SEQ ID NO: 1138807 - protein, 25 aa, Mycobacterium
GESRGWPTYLLGGRIRASTAGLILA

SEQ ID NO: 1138808 - protein, 29 aa, Mycobacterium
GETARRTLVFPAGTYWRTTEMFTGAPQLV

SEQ ID NO: 1138809 - protein, 31 aa, Mycobacterium
GEVLAGLLRRWAWLVLIVGFAVIVTYTMDED

SEQ ID NO: 1138810 - protein, 23 aa, Mycobacterium
GEWAITLFNILLVSGSFACGMAF

SEQ ID NO: 1138811 - protein, 28 aa, Mycobacterium
GFALGIAMLLGGTWLTCILAAGTSVLID

SEQ ID NO: 1138812 - protein, 24 aa, Mycobacterium
GFATLLTMDIFLPGGLVEGSDSLD

SEQ ID NO: 1138813 - protein, 29 aa, Mycobacterium
GFATLWAVLVYFPVAHWVFAFDGVVTEDS

SEQ ID NO: 1138814 - protein, 19 aa, Mycobacterium
GFCVYAYYKFVRYEEAPPE

SEQ ID NO: 1138815 - protein, 29 aa, Mycobacterium
GFEHPWFFLFLIVVLALAGLYVIVALARQ

SEQ ID NO: 1138816 - protein, 25 aa, Mycobacterium
GFEHSVVNMFLFPSGLMLGGDFSIA

SEQ ID NO: 1138817 - protein, 23 aa, Mycobacterium
GFELSLRTLTFPAPVIVAATGPA

SEQ ID NO: 1138818 - protein, 19 aa, Mycobacterium
GFFHVATWLLVWAGTTMTV

SEQ ID NO: 1138819 - protein, 17 aa, Mycobacterium
GFFRLARPALLPEDLRY

SEQ ID NO: 1138820 - protein, 32 aa, Mycobacterium
GFFTDHLSWRWAFWINVPVGIVVFFVAAAAIP

SEQ ID NO: 1138821 - protein, 18 aa, Mycobacterium
GFGAKRLRHLFASPKTWR

SEQ ID NO: 1138822 - protein, 20 aa, Mycobacterium
GFGRRPAWVLAEIVVVVALM

SEQ ID NO: 1138823 - protein, 25 aa, Mycobacterium
GFGYLNAPATWLGVGRYTVIVELPD

SEQ ID NO: 1138824 - protein, 29 aa, Mycobacterium
GFHIHGAAGLLNLFTFGLLGSSGHRSTQT

SEQ ID NO: 1138825 - protein, 27 aa, Mycobacterium
GFIGLLFVVVWLLIAYLRAEVLRRQKR

SEQ ID NO: 1138826 - protein, 18 aa, Mycobacterium
GFIIGCGLLLDTFVVRTL

SEQ ID NO: 1138827 - protein, 25 aa, Mycobacterium
GFIVGVEALLRWPHPRLGMLSPDAF

SEQ ID NO: 1138828 - protein, 25 aa, Mycobacterium
GFPADLLYEFRLQSALTAAVMWMVL

SEQ ID NO: 1138829 - protein, 18 aa, Mycobacterium
GFPAPWALLPVAGAALVV

SEQ ID NO: 1138830 - protein, 18 aa, Mycobacterium
GFPGWANYFPVTRGVPEP

SEQ ID NO: 1138831 - protein, 46 aa, Mycobacterium
GFPQLGRFIVRHPVLIIVAWVAAAAVLFLLIPPLAVVSQKNPPEFL

SEQ ID NO: 1138832 - protein, 28 aa, Mycobacterium
GFRHRQEWVYLPPAWYASDPPPALPTVM

SEQ ID NO: 1138833 - protein, 19 aa, Mycobacterium
GFTTITAILILGLAQTVLS

SEQ ID NO: 1138834 - protein, 29 aa, Mycobacterium
GFTVLKTLALIVWFGVVLLIVVLAVAVID

SEQ ID NO: 1138835 - protein, 18 aa, Mycobacterium
GFVPWWVVALLLGRDLVL

SEQ ID NO: 1138836 - protein, 20 aa, Mycobacterium
GFVRATLILIAVVVVVIYAS

SEQ ID NO: 1138837 - protein, 18 aa, Mycobacterium
GFVYAFFVGFVVSSMWGQ

SEQ ID NO: 1138838 - protein, 19 aa, Mycobacterium
GFWFAFVMLRIVRGRGPLR

SEQ ID NO: 1138839 - protein, 27 aa, Mycobacterium
GGAAAKWVLGGLALLVVVVITVVATIL

SEQ ID NO: 1138840 - protein, 18 aa, Mycobacterium
GGAAIPLVTQRLSERLRA

SEQ ID NO: 1138841 - protein, 22 aa, Mycobacterium
GGAAWLPFLVAFAIATVTAFSY

SEQ ID NO: 1138842 - protein, 22 aa, Mycobacterium
GGAGVLRRLVARVPRHVPPVTM

SEQ ID NO: 1138843 - protein, 27 aa, Mycobacterium
GGAIALLVLAMLIAVIAALWVSRADAA

SEQ ID NO: 1138844 - protein, 26 aa, Mycobacterium
GGALARYGLVVVIAWIGALKFTEYEA

SEQ ID NO: 1138845 - protein, 26 aa, Mycobacterium
GGASLKAFWYHFAIMFEALFILTTVD

SEQ ID NO: 1138846 - protein, 31 aa, Mycobacterium
GGDANYGTWWFWLGLILIVGILLLVGNLERS

SEQ ID NO: 1138847 - protein, 42 aa, Mycobacterium
GGEGAPFTWRMVLVMVGALLVWLLVVLTLMRISGWLDVSVDQ

SEQ ID NO: 1138848 - protein, 32 aa, Mycobacterium
GGERGVIYDIALWAVPFGLIGGRLYHVITDWQ

SEQ ID NO: 1138849 - protein, 47 aa, Mycobacterium
GGESGVIYDIALWAVPFGLIGGRLYHVITDWPTYFGEGGAGPAAALR

SEQ ID NO: 1138850 - protein, 30 aa, Mycobacterium
GGFIADAWGWRWVFVPLVPVALAGLIGTLR

SEQ ID NO: 1138851 - protein, 25 aa, Mycobacterium
GGFVLALLIVTFLHLVVGEMAPKSW

SEQ ID NO: 1138852 - protein, 26 aa, Mycobacterium
GGGFLLVPALALLAGLPMSGAVGTSL

SEQ ID NO: 1138853 - protein, 21 aa, Mycobacterium
GGGFPVPALQLAISPSAGGPD

SEQ ID NO: 1138854 - protein, 25 aa, Mycobacterium
GGGGITAGYLALRANARAAEVARSD

SEQ ID NO: 1138855 - protein, 26 aa, Mycobacterium
GGGLGGLLIVVVALFLGVDPSTVLPQ

SEQ ID NO: 1138856 - protein, 29 aa, Mycobacterium
GGGLIAILLFAPYLWLALVAAAVAVSTHE

SEQ ID NO: 1138857 - protein, 18 aa, Mycobacterium
GGGLLAGAIFGQIWKRIG

SEQ ID NO: 1138858 - protein, 25 aa, Mycobacterium
GGGTLGWLAGLWREVLAAPVDGPEA

SEQ ID NO: 1138859 - protein, 39 aa, Mycobacterium
GGGTSNFLIPNGTFFVVLLIFLIVLGVIAKWVVPPVSKV

SEQ ID NO: 1138860 - protein, 21 aa, Mycobacterium
GGILIGNILSGGMRGGFGGGG

SEQ ID NO: 1138861 - protein, 25 aa, Mycobacterium
GGITVLTGLLWWTVAIHLLVSMAMV

SEQ ID NO: 1138862 - protein, 26 aa, Mycobacterium
GGITVLTGLLWWTVAIHLLVSMAMVW

SEQ ID NO: 1138863 - protein, 32 aa, Mycobacterium
GGKIVLWIATIGLIALGLWRLAEAFIGAKPGE

SEQ ID NO: 1138864 - protein, 36 aa, Mycobacterium
GGLAQLVGAPPWLYWTLYLACYVTGGWEPGWAGLQA

SEQ ID NO: 1138865 - protein, 24 aa, Mycobacterium
GGLELPFTYPPLAAVAFAPFALLS

SEQ ID NO: 1138866 - protein, 42 aa, Mycobacterium
GGLGIWGAVALGGIGAWIACRRRGIPLPAFGDAIAPGIILAQ

SEQ ID NO: 1138867 - protein, 20 aa, Mycobacterium
GGLIAFVLLLIRTKMSKFTP

SEQ ID NO: 1138868 - protein, 26 aa, Mycobacterium
GGLLFFVLVYVWLTSALWFFQTTGLT

SEQ ID NO: 1138869 - protein, 26 aa, Mycobacterium
GGLTYNWIIFMILPLYVSLEKIDPRL

SEQ ID NO: 1138870 - protein, 23 aa, Mycobacterium
GGLWARFGLPRWITRRVPHEHST

SEQ ID NO: 1138871 - protein, 24 aa, Mycobacterium
GGMTGVFINVLFGSGLRAPAAPGS

SEQ ID NO: 1138872 - protein, 32 aa, Mycobacterium
GGNALPWLLPLLYVLMALSLVVWAGLRHSNRT

SEQ ID NO: 1138873 - protein, 27 aa, Mycobacterium
GGPFLPLAIILYWFANNIWTFGQQHYV

SEQ ID NO: 1138874 - protein, 35 aa, Mycobacterium
GGPNEPLWFGLDAWRWMFLAMALPAVLYGVLAFTI

SEQ ID NO: 1138875 - protein, 17 aa, Mycobacterium
GGPTQPDYGAPAGWHAP

SEQ ID NO: 1138876 - protein, 26 aa, Mycobacterium
GGPVDYFAVDLPRIIGNALKPATPAL

SEQ ID NO: 1138877 - protein, 27 aa, Mycobacterium
GGPVDYFAVDLPRIIGNALKPATPALA

SEQ ID NO: 1138878 - protein, 24 aa, Mycobacterium
GGQAIGSLLWGLLAGATNSVTSLL

SEQ ID NO: 1138879 - protein, 33 aa, Mycobacterium
GGQDRWLQHRVVTRLQYIFLNGNVVSDIFTQDT

SEQ ID NO: 1138880 - protein, 29 aa, Mycobacterium
GGRALLFGGIFPPFWLAGTAMLGLSKIID

SEQ ID NO: 1138881 - protein, 22 aa, Mycobacterium
GGRGRIALLVTAVAWALLGVII

SEQ ID NO: 1138882 - protein, 25 aa, Mycobacterium
GGRTRWRWAVANYGYLLAATALIRY

SEQ ID NO: 1138883 - protein, 25 aa, Mycobacterium
GGSTYPWSSPVIIGLFVGSGVALAL

SEQ ID NO: 1138884 - protein, 18 aa, Mycobacterium
GGSYLWWALAVIVVSATV

SEQ ID NO: 1138885 - protein, 22 aa, Mycobacterium
GGTIFLITMVVLVVLVIWPPTG

SEQ ID NO: 1138886 - protein, 23 aa, Mycobacterium
GGTLMAVYALGMAAPLFVLALLW

SEQ ID NO: 1138887 - protein, 23 aa, Mycobacterium
GGTLPRLPLFATAPHRVGELLEM

SEQ ID NO: 1138888 - protein, 22 aa, Mycobacterium
GGTLREPLLVRLFGGARLDAVM

SEQ ID NO: 1138889 - protein, 27 aa, Mycobacterium
GGVAGVMLWLWHWPSRLQSAAFATVTA

SEQ ID NO: 1138890 - protein, 24 aa, Mycobacterium
GGVAVLIAWWFWERRAARPLVSTR

SEQ ID NO: 1138891 - protein, 25 aa, Mycobacterium
GGVLLWQHLFWYFGHPEVYVIALPF

SEQ ID NO: 1138892 - protein, 42 aa, Mycobacterium
GGVLTGAWLGLFIGLILGFFSPNPWSALLTGLIAGVFFGLIT

SEQ ID NO: 1138893 - protein, 41 aa, Mycobacterium
GGVVGFVLVWIFWLSTGIPLGFLVLLPAMWVALRYSTTVST

SEQ ID NO: 1138894 - protein, 26 aa, Mycobacterium
GGWAGGWWLDPVIGLVIAAWSIWEGI

SEQ ID NO: 1138895 - protein, 27 aa, Mycobacterium
GGWTAIPMWVLGILTFLIPAGMAVVEL

SEQ ID NO: 1138896 - protein, 21 aa, Mycobacterium
GGWWFTLFTAILGSVILLWIV

SEQ ID NO: 1138897 - protein, 19 aa, Mycobacterium
GGYFFSVFVQDVNPGAFAA

SEQ ID NO: 1138898 - protein, 26 aa, Mycobacterium
GHAAGLLLYPVLFVGLLELPRYMHWT

SEQ ID NO: 1138899 - protein, 23 aa, Mycobacterium
GHDGYGVLFCDIERFKSVNDWCG

SEQ ID NO: 1138900 - protein, 21 aa, Mycobacterium
GHFMAYTFVVVVIRDVVGVPG

SEQ ID NO: 1138901 - protein, 28 aa, Mycobacterium
GHGNIAITALAFAAILLASINIFGGFAV

SEQ ID NO: 1138902 - protein, 20 aa, Mycobacterium
GHHLPPARRGVQRRSLRTPH

SEQ ID NO: 1138903 - protein, 23 aa, Mycobacterium
GHLRRRRLLTPPLHGELLGSYVP

SEQ ID NO: 1138904 - protein, 26 aa, Mycobacterium
GHNLWNWPPAFFSWFAAGMVLAELTV

SEQ ID NO: 1138905 - protein, 21 aa, Mycobacterium
GHRRDGIALALLGLAVVVAAS

SEQ ID NO: 1138906 - protein, 29 aa, Mycobacterium
GHSHRRVVLLIYLWVGIAALGAASSIFFD

SEQ ID NO: 1138907 - protein, 21 aa, Mycobacterium
GHTPVWVAWDGAVRGVIVVAD

SEQ ID NO: 1138908 - protein, 35 aa, Mycobacterium
GHVPDQMFGIWRAVWLVLLVPLAVLLVLLVVGGYF

SEQ ID NO: 1138909 - protein, 28 aa, Mycobacterium
GIAAVTLIFVIMLIITRSVVAAAVIVGT

SEQ ID NO: 1138910 - protein, 25 aa, Mycobacterium
GIAFLAPVLLRWNRYWRRHSARQVV

SEQ ID NO: 1138911 - protein, 24 aa, Mycobacterium
GIAGFLFIAFAHSAPWQVVTASIL

SEQ ID NO: 1138912 - protein, 18 aa, Mycobacterium
GIALAAIALGSWAGGRLA

SEQ ID NO: 1138913 - protein, 19 aa, Mycobacterium
GIALAAIALGSWAGGRLAD

SEQ ID NO: 1138914 - protein, 30 aa, Mycobacterium
GIALPLLATQILWINLLTDSGPALAMGVDR

SEQ ID NO: 1138915 - protein, 30 aa, Mycobacterium
GIASTLAYILLFMLLQGWAGAQLANLIALL

SEQ ID NO: 1138916 - protein, 33 aa, Mycobacterium
GIATVGLWLESLWINAVYPLTWPTSIWLEALAM

SEQ ID NO: 1138917 - protein, 18 aa, Mycobacterium
GIAVVQLAASWWAIAPGS

SEQ ID NO: 1138918 - protein, 24 aa, Mycobacterium
GIDPQLLPHLFERFVRADRSRSRQ

SEQ ID NO: 1138919 - protein, 19 aa, Mycobacterium
GIFSLFVVVTMIVVIRASK

SEQ ID NO: 1138920 - protein, 17 aa, Mycobacterium
GIGAGVAIWVLLNGTNP

SEQ ID NO: 1138921 - protein, 24 aa, Mycobacterium
GIGHPWYVNYFPVTRAVPEPPSIR

SEQ ID NO: 1138922 - protein, 28 aa, Mycobacterium
GIGITPILPMLGLARRLGVDWSMVYTGR

SEQ ID NO: 1138923 - protein, 24 aa, Mycobacterium
GIGLKFVQYLAFAGVLIGASVYQI

SEQ ID NO: 1138924 - protein, 33 aa, Mycobacterium
GIGLLATLWVLMRFVLPWLMPQIARSQELLVLF

SEQ ID NO: 1138925 - protein, 40 aa, Mycobacterium
GIGVLVFQYGFGQAIAWPVPLLAFILLVAVGADYNMLLIS

SEQ ID NO: 1138926 - protein, 27 aa, Mycobacterium
GIHDGFFMFVIFLTVLSFIPLGGGIVT

SEQ ID NO: 1138927 - protein, 24 aa, Mycobacterium
GILVASLSYFPFVYVPAAATLRRL

SEQ ID NO: 1138928 - protein, 26 aa, Mycobacterium
GINLGFYMLMPYLAGYLAGPLGLAAW

SEQ ID NO: 1138929 - protein, 22 aa, Mycobacterium
GINTLFPLFGIANQLLAAIALT

SEQ ID NO: 1138930 - protein, 19 aa, Mycobacterium
GIPVGRWLDRHGPRWIMTG

SEQ ID NO: 1138931 - protein, 19 aa, Mycobacterium
GIPYFPNLVIPLVVGGIGI

SEQ ID NO: 1138932 - protein, 25 aa, Mycobacterium
GIRAHMGFLFGLVNQLLLLGIAVGL

SEQ ID NO: 1138933 - protein, 27 aa, Mycobacterium
GIRGDWFGGVLRPLFGPGIREIAVSGN

SEQ ID NO: 1138934 - protein, 25 aa, Mycobacterium
GIRLNWLALGLLAYPLMYGVGRLYV

SEQ ID NO: 1138935 - protein, 18 aa, Mycobacterium
GIRPIPYLVTTRLMASVV

SEQ ID NO: 1138936 - protein, 29 aa, Mycobacterium
GISALGLIFIIMLILTRAIVAAAVIVGTV

SEQ ID NO: 1138937 - protein, 25 aa, Mycobacterium
GITPQQIPHYLNTLTAVVLLSDTWV

SEQ ID NO: 1138938 - protein, 17 aa, Mycobacterium
GITVLTGLLWLTVAIHL

SEQ ID NO: 1138939 - protein, 24 aa, Mycobacterium
GITWAQGFCLSRPKPHAHGFPPSF

SEQ ID NO: 1138940 - protein, 20 aa, Mycobacterium
GIVAAIAMYFCAKGIRSRRR

SEQ ID NO: 1138941 - protein, 21 aa, Mycobacterium
GIVAAIVMYDATRSALMVGMV

SEQ ID NO: 1138942 - protein, 28 aa, Mycobacterium
GIVAGALFIVFLVFLAGVLLGRQSAGDD

SEQ ID NO: 1138943 - protein, 25 aa, Mycobacterium
GIVALILLAALQYVAAIVASRLRIG

SEQ ID NO: 1138944 - protein, 25 aa, Mycobacterium
GIVALILLAALQYVAAIVASRPRIG

SEQ ID NO: 1138945 - protein, 25 aa, Mycobacterium
GIVGPMITYLLPVLIGYTGGRMVHG

SEQ ID NO: 1138946 - protein, 34 aa, Mycobacterium
GIVGYLAALLAYPRYFPPISLWTGLSLLGVAVAI

SEQ ID NO: 1138947 - protein, 17 aa, Mycobacterium
GIVLPIAGFFFIGNGDF

SEQ ID NO: 1138948 - protein, 24 aa, Mycobacterium
GIVYFLIFWVSAFHRKKASDTELP

SEQ ID NO: 1138949 - protein, 40 aa, Mycobacterium
GKAVALVWLWAAILIPLGRLLWLWYRRYQFRRNVLSAPTL

SEQ ID NO: 1138950 - protein, 20 aa, Mycobacterium
GKFFTYTGVFLILVAAGILS

SEQ ID NO: 1138951 - protein, 22 aa, Mycobacterium
GKSEFLQSWIMGMAAAHSPDRV

SEQ ID NO: 1138952 - protein, 27 aa, Mycobacterium
GKSNLLLAMIYALALRYSPDELEMLLI

SEQ ID NO: 1138953 - protein, 24 aa, Mycobacterium
GKSTDLDWKSVWDHGWSAAAAADE

SEQ ID NO: 1138954 - protein, 19 aa, Mycobacterium
GKVHFWLTFIGFHATFLVQ

SEQ ID NO: 1138955 - protein, 32 aa, Mycobacterium
GLAAALFTMRWELVAFVAPLLGVLCSVGWQPR

SEQ ID NO: 1138956 - protein, 26 aa, Mycobacterium
GLAAAVGWFVPLLGLSLVGFLVVDAV

SEQ ID NO: 1138957 - protein, 33 aa, Mycobacterium
GLADEVLYFFLVESAIVFLAAYVVGIAAAGIAV

SEQ ID NO: 1138958 - protein, 21 aa, Mycobacterium
GLAFALTVFAFLAPAAAIAIG

SEQ ID NO: 1138959 - protein, 19 aa, Mycobacterium
GLAFGFLVPALAGYISFAI

SEQ ID NO: 1138960 - protein, 17 aa, Mycobacterium
GLALPPDLALLAGTAFV

SEQ ID NO: 1138961 - protein, 22 aa, Mycobacterium
GLALTIGIVLVSLNYDRLPFLQ

SEQ ID NO: 1138962 - protein, 23 aa, Mycobacterium
GLARVLWPGLAAIGVLLMTQPWT

SEQ ID NO: 1138963 - protein, 25 aa, Mycobacterium
GLAVALMITLLLPLPPVPVEGRVHL

SEQ ID NO: 1138964 - protein, 26 aa, Mycobacterium
GLCAVLSGLFVWRWVMETKGVSLEDM

SEQ ID NO: 1138965 - protein, 24 aa, Mycobacterium
GLDGGFLRTNRALRAMLGYSRGTL

SEQ ID NO: 1138966 - protein, 23 aa, Mycobacterium
GLDRRGVAVLLDFGGGGTSITLV

SEQ ID NO: 1138967 - protein, 27 aa, Mycobacterium
GLDTVSVTLGWMFLHLARNDGDREQIL

SEQ ID NO: 1138968 - protein, 18 aa, Mycobacterium
GLFALAIPFTLFFEVPML

SEQ ID NO: 1138969 - protein, 26 aa, Mycobacterium
GLFDKLPLMLLVLITTTTLLMLLAFG

SEQ ID NO: 1138970 - protein, 23 aa, Mycobacterium
GLFSLAMFVLYLAFLPSGRAEAL

SEQ ID NO: 1138971 - protein, 32 aa, Mycobacterium
GLFVLPGIPFTFLLALLPLFIVRSFIGTYQVR

SEQ ID NO: 1138972 - protein, 22 aa, Mycobacterium
GLGAFWWCRTGSAGPILTTSTG

SEQ ID NO: 1138973 - protein, 18 aa, Mycobacterium
GLGGWAGWRFFVMYGATE

SEQ ID NO: 1138974 - protein, 23 aa, Mycobacterium
GLGRAVLNLLDNAAKWSPPGGRV

SEQ ID NO: 1138975 - protein, 36 aa, Mycobacterium
GLHDMTYIGLPPFYPPGWFWIGGRLAALTGTPAWEM

SEQ ID NO: 1138976 - protein, 23 aa, Mycobacterium
GLHGYVALWPLIYETREQVELMD

SEQ ID NO: 1138977 - protein, 18 aa, Mycobacterium
GLHMAYFRTFGVVLALVG

SEQ ID NO: 1138978 - protein, 17 aa, Mycobacterium
GLIAQNYWQRVQLFLHG

SEQ ID NO: 1138979 - protein, 25 aa, Mycobacterium
GLIAVSLVPFLVYPANPPGVGQEET

SEQ ID NO: 1138980 - protein, 17 aa, Mycobacterium
GLIIGYVMTALTVIVVV

SEQ ID NO: 1138981 - protein, 17 aa, Mycobacterium
GLISTIVLIVFSPAVSG

SEQ ID NO: 1138982 - protein, 21 aa, Mycobacterium
GLIVPAIVFLAFNPSGDNAHA

SEQ ID NO: 1138983 - protein, 26 aa, Mycobacterium
GLLGFAAFQLWMARGLALIVTHSGGG

SEQ ID NO: 1138984 - protein, 18 aa, Mycobacterium
GLLGLMMRRFGLPVLPLI

SEQ ID NO: 1138985 - protein, 33 aa, Mycobacterium
GLLGTSITALLYNFGFFTLLAFTPFPLDMSAQQ

SEQ ID NO: 1138986 - protein, 36 aa, Mycobacterium
GLLGTSITALLYNFGFFTLLAFTPFPLDMSAQQIGL

SEQ ID NO: 1138987 - protein, 26 aa, Mycobacterium
GLLIRLDALHRIGERDALLGWAHLLL

SEQ ID NO: 1138988 - protein, 17 aa, Mycobacterium
GLLLALLLDRAFLGRGV

SEQ ID NO: 1138989 - protein, 18 aa, Mycobacterium
GLLLGRWIPGLNTALESV

SEQ ID NO: 1138990 - protein, 19 aa, Mycobacterium
GLLNFLRITALATVLLGLG

SEQ ID NO: 1138991 - protein, 17 aa, Mycobacterium
GLLSRREALRRLSLIGI

SEQ ID NO: 1138992 - protein, 24 aa, Mycobacterium
GLLVSLLTGLALAAPWPAGIELNY

SEQ ID NO: 1138993 - protein, 17 aa, Mycobacterium
GLLWVAAVAVLVGGAAL

SEQ ID NO: 1138994 - protein, 27 aa, Mycobacterium
GLMCVALVVYFLLLGRIAFAFIETGEL

SEQ ID NO: 1138995 - protein, 21 aa, Mycobacterium
GLNAYIPLLTLGLLARFTDLV

SEQ ID NO: 1138996 - protein, 18 aa, Mycobacterium
GLNLLMFALQMASPDLDR

SEQ ID NO: 1138997 - protein, 17 aa, Mycobacterium
GLPKPEVGLPKPAVELP

SEQ ID NO: 1138998 - protein, 23 aa, Mycobacterium
GLPPLVGSLPRATAAPLLHVTGR

SEQ ID NO: 1138999 - protein, 17 aa, Mycobacterium
GLPPLWADEQRLAQVVG

SEQ ID NO: 1139000 - protein, 17 aa, Mycobacterium
GLPTAPPVIPAPEVVPP

SEQ ID NO: 1139001 - protein, 30 aa, Mycobacterium
GLQVRWRMATFVFTVLLVAVPVVMVGSPAG

SEQ ID NO: 1139002 - protein, 41 aa, Mycobacterium
GLRDDVFALILSLPVVFYSAWIFFDGAYRALRARTLDMMVL

SEQ ID NO: 1139003 - protein, 20 aa, Mycobacterium
GLRFTTGHALWAAALIPACI

SEQ ID NO: 1139004 - protein, 25 aa, Mycobacterium
GLRLLWTVPILAFFAAALGVGVGAL

SEQ ID NO: 1139005 - protein, 25 aa, Mycobacterium
GLRPPMLWRGLQWGSAAVAPVALSV

SEQ ID NO: 1139006 - protein, 21 aa, Mycobacterium
GLRRFSYLLLRVALTLTVVIV

SEQ ID NO: 1139007 - protein, 20 aa, Mycobacterium
GLRVLAVAERRLTVAQAAAA

SEQ ID NO: 1139008 - protein, 32 aa, Mycobacterium
GLSLFMVVAVTLTWLVYVTLRRDVAGSTAPYA

SEQ ID NO: 1139009 - protein, 27 aa, Mycobacterium
GLSLLGWCSFMLLWVLQACVFWRGMES

SEQ ID NO: 1139010 - protein, 33 aa, Mycobacterium
GLSPIVGLWAALPPLLIYAILGSSRQLSVGPES

SEQ ID NO: 1139011 - protein, 31 aa, Mycobacterium
GLTAGLVIFRSRWARWVAWSLPAVGLVVLFS

SEQ ID NO: 1139012 - protein, 25 aa, Mycobacterium
GLTALLMAPIIWLEPVRLSLQLGQI

SEQ ID NO: 1139013 - protein, 18 aa, Mycobacterium
GLTFPRYLAATRPGTRNV

SEQ ID NO: 1139014 - protein, 30 aa, Mycobacterium
GLTLGVAAALLFMFGLGSLFGRAGLAVGSL

SEQ ID NO: 1139015 - protein, 26 aa, Mycobacterium
GLTVLGTMLTLWPTTLRARIGSDTHT

SEQ ID NO: 1139016 - protein, 24 aa, Mycobacterium
GLVAVLVLGLLLFLPVRAPHRRDP

SEQ ID NO: 1139017 - protein, 17 aa, Mycobacterium
GLVFLCAAPIAAVGFLV

SEQ ID NO: 1139018 - protein, 24 aa, Mycobacterium
GLVGMFITPLLFVGAIRLSRPHAP

SEQ ID NO: 1139019 - protein, 18 aa, Mycobacterium
GLVLVVWLFSTTAVMLKS

SEQ ID NO: 1139020 - protein, 18 aa, Mycobacterium
GLVPSWLALASTGFDVAL

SEQ ID NO: 1139021 - protein, 25 aa, Mycobacterium
GLVQAFGVWWFYAALGSGPISVVSP

SEQ ID NO: 1139022 - protein, 19 aa, Mycobacterium
GLVRLAYGLFLPDIQADLH

SEQ ID NO: 1139023 - protein, 20 aa, Mycobacterium
GLVTALFTLPLSYVAHRQIE

SEQ ID NO: 1139024 - protein, 24 aa, Mycobacterium
GLVVIAPVWSRRLTGRGWPKPVAD

SEQ ID NO: 1139025 - protein, 27 aa, Mycobacterium
GLVVTYIYFILPLYVLLVLPAMSVLRP

SEQ ID NO: 1139026 - protein, 25 aa, Mycobacterium
GLWTQLAYGKPWTWLALAVAVVALL

SEQ ID NO: 1139027 - protein, 26 aa, Mycobacterium
GMAAPLFVLALLWKRFDLSRRGWLRG

SEQ ID NO: 1139028 - protein, 20 aa, Mycobacterium
GMAFIPFALALGVGTVVAAR

SEQ ID NO: 1139029 - protein, 24 aa, Mycobacterium
GMAVFRAVFYFAVERDFAAGMAQA

SEQ ID NO: 1139030 - protein, 25 aa, Mycobacterium
GMAVPGFPNFFMLYGPNTNVGSNSV

SEQ ID NO: 1139031 - protein, 23 aa, Mycobacterium
GMGLAFLCFVPLAGITAVPALLV

SEQ ID NO: 1139032 - protein, 23 aa, Mycobacterium
GMGLIFDTLVIRSFMTPSIAALL

SEQ ID NO: 1139033 - protein, 27 aa, Mycobacterium
GMHDWPFAEQAFATALPWLAGRLRTPE

SEQ ID NO: 1139034 - protein, 20 aa, Mycobacterium
GMIRYCLPLFPDSASYFSGL

SEQ ID NO: 1139035 - protein, 28 aa, Mycobacterium
GMNFDHMPELHWTFGYPAVLMVMISVCL

SEQ ID NO: 1139036 - protein, 37 aa, Mycobacterium
GMPKASVMTHYRWLRALAGFGGLGLRLNSSDTLYCCL

SEQ ID NO: 1139037 - protein, 18 aa, Mycobacterium
GMRRMYVAGLLGTIAFGV

SEQ ID NO: 1139038 - protein, 21 aa, Mycobacterium
GMVVFWALIIGGIVVLVRLST

SEQ ID NO: 1139039 - protein, 28 aa, Mycobacterium
GNGLYYGLPMWLIMSLRIAFVVLGAAAL

SEQ ID NO: 1139040 - protein, 24 aa, Mycobacterium
GNKLDYYLRRQIEYVADGCSADTR

SEQ ID NO: 1139041 - protein, 32 aa, Mycobacterium
GNLSPLVAAGLFYLALTIPLTHLVNFIDTRLR

SEQ ID NO: 1139042 - protein, 33 aa, Mycobacterium
GNPDTMLFIYTPFSALCFLPLIGLSQPGVLVLG

SEQ ID NO: 1139043 - protein, 20 aa, Mycobacterium
GNRLLTFLVVLTAAAAVLAV

SEQ ID NO: 1139044 - protein, 27 aa, Mycobacterium
GNSFGTWLFFILAVVLFVGFFVRMIQH

SEQ ID NO: 1139045 - protein, 24 aa, Mycobacterium
GNVDIGMLILTGMFTMITAPVIAN

SEQ ID NO: 1139046 - protein, 22 aa, Mycobacterium
GNWRSRILLGPVDRLTELGWTA

SEQ ID NO: 1139047 - protein, 32 aa, Mycobacterium
GPACAIAVLFGFLATVTLLPPVLSLAAERGIG

SEQ ID NO: 1139048 - protein, 26 aa, Mycobacterium
GPACAIAVLIGFLATVTLLPPVMALA

SEQ ID NO: 1139049 - protein, 23 aa, Mycobacterium
GPAPAPGPLPLPVGPPPPPQDTS

SEQ ID NO: 1139050 - protein, 37 aa, Mycobacterium; identical to SEQ ID NO: 356572

SEQ ID NO: 1139051 - protein, 23 aa, Mycobacterium
GPAYAVLGVALWVALYLAGIHPT

SEQ ID NO: 1139052 - protein, 25 aa, Mycobacterium
GPDGLPFLSLTSMSAGLLGAGTGGL

SEQ ID NO: 1139053 - protein, 24 aa, Mycobacterium
GPEFTDMYGFTNPLSDFRNSNLSS

SEQ ID NO: 1139054 - protein, 34 aa, Mycobacterium
GPEGAAWLRLAWAGLLFLVFLRPRRADFTGRSLM

SEQ ID NO: 1139055 - protein, 36 aa, Mycobacterium
GPESAAMLLIPVYLVYIRAARPLIAFYNWCANATLR

SEQ ID NO: 1139056 - protein, 26 aa, Mycobacterium
GPFLSYGIQWIAFGIIAPIGVGYFVY

SEQ ID NO: 1139057 - protein, 29 aa, Mycobacterium
GPGCYPYREPLPAPPPGGPPPGPPAEAQP

SEQ ID NO: 1139058 - protein, 24 aa, Mycobacterium
GPGDALYGLRTMLFGEQAQTRDDA

SEQ ID NO: 1139059 - protein, 22 aa, Mycobacterium
GPGPAPHAPFPLPVPPNEQGPP

SEQ ID NO: 1139060 - protein, 18 aa, Mycobacterium
GPGRALFTLAFIDVWQWT

SEQ ID NO: 1139061 - protein, 25 aa, Mycobacterium
GPGTALVVLLFTSLALAIAVNVLAD

SEQ ID NO: 1139062 - protein, 29 aa, Mycobacterium
GPHPPQPQGYWYPPPPPSGWQGAPQAPAY

SEQ ID NO: 1139063 - protein, 22 aa, Mycobacterium
GPLLPALIFMIVVTQIPFLFTL

SEQ ID NO: 1139064 - protein, 21 aa, Mycobacterium
GPPRIPVWHQSGRDMLVRLCI

SEQ ID NO: 1139065 - protein, 37 aa, Mycobacterium
GPPSYSTVWLWLGLGLLLLVLLWYATVFAATMPSRSL

SEQ ID NO: 1139066 - protein, 17 aa, Mycobacterium
GPRALVLHLAFTAAVFA

SEQ ID NO: 1139067 - protein, 26 aa, Mycobacterium
GPRAPQLWLPPLDEPIPLRDVLERAG

SEQ ID NO: 1139068 - protein, 38 aa, Mycobacterium
GPRERAAAPKRLALVAGLSLVIVLGALSGWLGYQAYQS

SEQ ID NO: 1139069 - protein, 22 aa, Mycobacterium
GPRLGVRWWRFGAGVLLGLACA

SEQ ID NO: 1139070 - protein, 22 aa, Mycobacterium
GPRLTLAVGPERLTNGLYTVSY

SEQ ID NO: 1139071 - protein, 25 aa, Mycobacterium
GPRRATWLVVVVALLVDLICGATGW

SEQ ID NO: 1139072 - protein, 28 aa, Mycobacterium
GPRRLEAFALFNVFYQGGILAGPLVGLA

SEQ ID NO: 1139073 - protein, 27 aa, Mycobacterium
GPRTQIVMPPLMWNLAPADAQAVLTAV

SEQ ID NO: 1139074 - protein, 20 aa, Mycobacterium
GPSFWWGFALVFAGQFLVAL

SEQ ID NO: 1139075 - protein, 26 aa, Mycobacterium
GPVTAALPRRVLASRVNVVVLQTSRP

SEQ ID NO: 1139076 - protein, 19 aa, Mycobacterium
GQFVQPFIDAAFSDLGLDP

SEQ ID NO: 1139077 - protein, 25 aa, Mycobacterium
GQGSRFRVSLPRIADAGPDAGPDAE

SEQ ID NO: 1139078 - protein, 17 aa, Mycobacterium
GQITQKALIALAVFLVL

SEQ ID NO: 1139079 - protein, 27 aa, Mycobacterium
GQLKQGKSLLLNSLLNMPVARVGDDES

SEQ ID NO: 1139080 - protein, 24 aa, Mycobacterium
GQMGAVIGGILIGNVLSGALRGGF

SEQ ID NO: 1139081 - protein, 44 aa, Mycobacterium
GQMQVGSLIAFLSYFMQILMAVLMATFMLIIIPRAAVCAERIDE

SEQ ID NO: 1139082 - protein, 26 aa, Mycobacterium
GQPGTPALPVPFPRTGQGGPPMLNLP

SEQ ID NO: 1139083 - protein, 17 aa, Mycobacterium
GQRLLTPALTSSLFPHL

SEQ ID NO: 1139084 - protein, 23 aa, Mycobacterium
GQRQFYRILDVMLAAGEFDATTG

SEQ ID NO: 1139085 - protein, 24 aa, Mycobacterium
GQRVPFRLAYPLRSGVPSSMRIDN

SEQ ID NO: 1139086 - protein, 23 aa, Mycobacterium
GQWAIVVFEWLMVGGSFACALAI

SEQ ID NO: 1139087 - protein, 22 aa, Mycobacterium
GQWFSLVIIFTAIVSAFGCHLA

SEQ ID NO: 1139088 - protein, 18 aa, Mycobacterium
GQYISFNLNINLPPPCTT

SEQ ID NO: 1139089 - protein, 40 aa, Mycobacterium
GRAVAPFLGALSIIVAVVIGIWLFNLFSGDGLTDEQLIAR

SEQ ID NO: 1139090 - protein, 27 aa, Mycobacterium
GRAVTFIPWPVIEGFTLGIAAIIFLQQ

SEQ ID NO: 1139091 - protein, 19 aa, Mycobacterium
GRFYVLCGYPLVAVAAYAL

SEQ ID NO: 1139092 - protein, 31 aa, Mycobacterium
GRGGLQFMLIIWLQGIWLPLRGYDFEVTPLW

SEQ ID NO: 1139093 - protein, 21 aa, Mycobacterium
GRGIGLALVRLVTAQHGGTIE

SEQ ID NO: 1139094 - protein, 26 aa, Mycobacterium
GRGLALAGLIIGYVMTALTVIVVVFS

SEQ ID NO: 1139095 - protein, 28 aa, Mycobacterium
GRGLARWRPYLEPALVVLTFGALGAGGV

SEQ ID NO: 1139096 - protein, 29 aa, Mycobacterium
GRGMWVCGPLGWLTVLLAGLCGALAVPGA

SEQ ID NO: 1139097 - protein, 26 aa, Mycobacterium
GRIGLKGFWIRRARRLLPALLVMVLA

SEQ ID NO: 1139098 - protein, 24 aa, Mycobacterium
GRKKLLQFAILLVGAVTFLMGCLP

SEQ ID NO: 1139099 - protein, 26 aa, Mycobacterium
GRLLGPMERLLILGLGLAGQLAAATA

SEQ ID NO: 1139100 - protein, 18 aa, Mycobacterium
GRLRLLADRSHEIPSELE

SEQ ID NO: 1139101 - protein, 18 aa, Mycobacterium
GRLWPLIIAHTLIDAVAF

SEQ ID NO: 1139102 - protein, 31 aa, Mycobacterium
GRMAFYPLALVPLGSLFWVVLNWPAKGQSHT

SEQ ID NO: 1139103 - protein, 18 aa, Mycobacterium
GRNWLPHASVVCLESDKV

SEQ ID NO: 1139104 - protein, 23 aa, Mycobacterium
GRQPLLAGLLTLSGATTPAHGLA

SEQ ID NO: 1139105 - protein, 24 aa, Mycobacterium
GRQPLLAGLLTLSGATTPAHGLAA

SEQ ID NO: 1139106 - protein, 24 aa, Mycobacterium
GRQTAWNYLIFALSKSSTLLMTIV

SEQ ID NO: 1139107 - protein, 18 aa, Mycobacterium
GRRALLLPAGALVYIAVP

SEQ ID NO: 1139108 - protein, 19 aa, Mycobacterium
GRRDLTVVGLAREPNRYLA

SEQ ID NO: 1139109 - protein, 22 aa, Mycobacterium
GRRFADVLGLPYATLTVGGGAT

SEQ ID NO: 1139110 - protein, 26 aa, Mycobacterium
GRRHKRFLPNRWWSVSALDGLVAAVL

SEQ ID NO: 1139111 - protein, 17 aa, Mycobacterium
GRRKLMIFGLTLAAAST

SEQ ID NO: 1139112 - protein, 20 aa, Mycobacterium
GRRLSLVTLGLLGAGVASGA

SEQ ID NO: 1139113 - protein, 22 aa, Mycobacterium
GRSLVIGMLILAASFLPLIVLP

SEQ ID NO: 1139114 - protein, 19 aa, Mycobacterium
GRSPRSGAVLWLPATEPLA

SEQ ID NO: 1139115 - protein, 17 aa, Mycobacterium
GRTAHFPWVIQNTGRCA

SEQ ID NO: 1139116 - protein, 31 aa, Mycobacterium
GRTRRILTAVLLGLLALLFAALILPRVIGVR

SEQ ID NO: 1139117 - protein, 29 aa, Mycobacterium
GRTVSPVEFWQYPTINALAKFLTGGEVEP

SEQ ID NO: 1139118 - protein, 41 aa, Mycobacterium
GRVIEIVHPTFLYELVWNLLVFAVLIWADRRFNLGHGRLFA

SEQ ID NO: 1139119 - protein, 28 aa, Mycobacterium
GRVLASWQPAWLRYSPLSFTGLAMIAAA

SEQ ID NO: 1139120 - protein, 26 aa, Mycobacterium
GRVVTLAFLMLQLVSAGGIYPVETTA

SEQ ID NO: 1139121 - protein, 25 aa, Mycobacterium
GRWSYGLFVWHLAALAMVFPIIGAF

SEQ ID NO: 1139122 - protein, 17 aa, Mycobacterium
GRYAWLAVVVFVNTLVS

SEQ ID NO: 1139123 - protein, 23 aa, Mycobacterium
GRYRGRLWISMDFVDGTDVGRLL

SEQ ID NO: 1139124 - protein, 27 aa, Mycobacterium
GSAARRAAILAAVICVLTLTIAGPVRT

SEQ ID NO: 1139125 - protein, 17 aa, Mycobacterium
GSAIAVLLILRSRNWLL

SEQ ID NO: 1139126 - protein, 20 aa, Mycobacterium
GSFVLGSYYIVPSILAVRGA

SEQ ID NO: 1139127 - protein, 30 aa, Mycobacterium
GSGAPPGRIPFWSLLLLGAAALLVSVAGIP

SEQ ID NO: 1139128 - protein, 25 aa, Mycobacterium
GSGQWYVRLWSAHVHLTLLGWVGLT

SEQ ID NO: 1139129 - protein, 18 aa, Mycobacterium
GSIAPVPLQLRDVRFRYP

SEQ ID NO: 1139130 - protein, 29 aa, Mycobacterium
GSIGFAVFAYPLFLLLNTGSLAAAIAAHA

SEQ ID NO: 1139131 - protein, 29 aa, Mycobacterium
GSKDDPEEFWLLLAGRRLDARDRRVLGAV

SEQ ID NO: 1139132 - protein, 33 aa, Mycobacterium
GSKGPMIALLAGAAVIILVLAGLGIWLVVKPDS

SEQ ID NO: 1139133 - protein, 22 aa, Mycobacterium
GSLDWFAGVGFLVAIAVAVAAP

SEQ ID NO: 1139134 - protein, 30 aa, Mycobacterium
GSLFAGFPALLIVVALLIGSALLSHPEPAA

SEQ ID NO: 1139135 - protein, 18 aa, Mycobacterium
GSLGLGLGITLWLSTGAA

SEQ ID NO: 1139136 - protein, 29 aa, Mycobacterium
GSLIGGAWLAFIGWFLLTAARDENAAVRA

SEQ ID NO: 1139137 - protein, 27 aa, Mycobacterium
GSLLADPAVWIERALVVLVAASPCALA

SEQ ID NO: 1139138 - protein, 27 aa, Mycobacterium
GSLLGDPAVWIERALVVLVAASPCALA

SEQ ID NO: 1139139 - protein, 26 aa, Mycobacterium
GSLRNKIVFILPAALLLSQFVPWLLT

SEQ ID NO: 1139140 - protein, 22 aa, Mycobacterium
GSLVQLLFFMTPIIWNESTLQA

SEQ ID NO: 1139141 - protein, 24 aa, Mycobacterium
GSPVAIDYLWRLSDSFAGTLAIES

SEQ ID NO: 1139142 - protein, 31 aa, Mycobacterium
GSQPDFYMMWTDGLIRLWPAWEFYIGNYTIP

SEQ ID NO: 1139143 - protein, 34 aa, Mycobacterium; identical to SEQ ID NO: 347756

SEQ ID NO: 1139144 - protein, 17 aa, Mycobacterium
GSRKDYLLSPVKGSIML

SEQ ID NO: 1139145 - protein, 23 aa, Mycobacterium
GSTMGILTWMFVDGHGSGLMNYT

SEQ ID NO: 1139146 - protein, 37 aa, Mycobacterium
GSVSWTGVLVVLAVIALALAALVLWQRRRRRKRREAE

SEQ ID NO: 1139147 - protein, 21 aa, Mycobacterium
GSVVLPLKALVLNVLSLTAAF

SEQ ID NO: 1139148 - protein, 22 aa, Mycobacterium
GSWLVAEMVWFFGGAGRGGDEA

SEQ ID NO: 1139149 - protein, 27 aa, Mycobacterium
GSWPVGVRLLVGALPLVAVIGALWWLG

SEQ ID NO: 1139150 - protein, 23 aa, Mycobacterium
GSYPLLVVFGFFLGVAGTVFAVG

SEQ ID NO: 1139151 - protein, 24 aa, Mycobacterium
GSYPTAVFFLLLAASPLPVAVGMA

SEQ ID NO: 1139152 - protein, 24 aa, Mycobacterium
GSYVAMFFVLRRALPALAALPSRS

SEQ ID NO: 1139153 - protein, 22 aa, Mycobacterium
GTAAILVFTSSAAVLVVEITAL

SEQ ID NO: 1139154 - protein, 24 aa, Mycobacterium
GTAFVRRLVTLATTLLLAATVLSV

SEQ ID NO: 1139155 - protein, 18 aa, Mycobacterium
GTANWILRRLGIEPAEEL

SEQ ID NO: 1139156 - protein, 26 aa, Mycobacterium
GTARRHSDLLLGRLTRGYLHRRWEHG

SEQ ID NO: 1139157 - protein, 32 aa, Mycobacterium
GTDQWAKHRIVTKLEVWFPKDLRRDPVTIDTG

SEQ ID NO: 1139158 - protein, 27 aa, Mycobacterium
GTFLSPTDLIWSFFQCVAMTVVIMLVH

SEQ ID NO: 1139159 - protein, 23 aa, Mycobacterium
GTGFWGPPFRVFAPSEITVLTLR

SEQ ID NO: 1139160 - protein, 36 aa, Mycobacterium
GTGLAAPVQGLWWALYLVFIALLSGALSVLLEREHQ

SEQ ID NO: 1139161 - protein, 33 aa, Mycobacterium
GTGLGKAAWFTMLAFWFFAIGWAASKSSTVWQR

SEQ ID NO: 1139162 - protein, 26 aa, Mycobacterium
GTGSGLQFYFLVAASLVVLVLGIERI

SEQ ID NO: 1139163 - protein, 25 aa, Mycobacterium
GTIRILLPISVIAAILLITGGAIQN

SEQ ID NO: 1139164 - protein, 31 aa, Mycobacterium
GTISYGVYLWHWPIFLFLNGERTGWTGWRLL

SEQ ID NO: 1139165 - protein, 19 aa, Mycobacterium
GTIVIVGFLTMSAGALIAV

SEQ ID NO: 1139166 - protein, 28 aa, Mycobacterium
GTIVMGLSALFFYLVLKALSENALLDSV

SEQ ID NO: 1139167 - protein, 19 aa, Mycobacterium
GTKAFGPWIGWIGGWGLAV

SEQ ID NO: 1139168 - protein, 24 aa, Mycobacterium
GTLASLLLAAVLSWAAIELAHLTG

SEQ ID NO: 1139169 - protein, 22 aa, Mycobacterium
GTLAVGYALRPAPTPSTAEQVF

SEQ ID NO: 1139170 - protein, 28 aa, Mycobacterium
GTLLLQGWTLPLLIRRLKLSADADQAYT

SEQ ID NO: 1139171 - protein, 24 aa, Mycobacterium
GTMLIVRAVWLRAATRRRTGAVDD

SEQ ID NO: 1139172 - protein, 23 aa, Mycobacterium
GTNAFFMFYYVMTGLHLCHVLLG

SEQ ID NO: 1139173 - protein, 24 aa, Mycobacterium
GTPGMKHPFAFTLAPSHGAANIYL

SEQ ID NO: 1139174 - protein, 29 aa, Mycobacterium
GTPLLVQLFIVFFALPEFGVRIDPFPAAV

SEQ ID NO: 1139175 - protein, 34 aa, Mycobacterium
GTPVVLHLFYVVKILLYILVAWLIVLTTSGIDGF

SEQ ID NO: 1139176 - protein, 22 aa, Mycobacterium
GTQILWIGDIYSFVLAALLISM

SEQ ID NO: 1139177 - protein, 31 aa, Mycobacterium
GTQPGHLWQARLAPQAKPYPQPHKFAGVEIV

SEQ ID NO: 1139178 - protein, 24 aa, Mycobacterium
GTRDIGLLILRLGVGAALVQAGLI

SEQ ID NO: 1139179 - protein, 26 aa, Mycobacterium
GTRWQYWRRVGLPVLFPFLLSGWVLT

SEQ ID NO: 1139180 - protein, 26 aa, Mycobacterium
GTTLLSFRLQPTLTILLAAAGAFGFI

SEQ ID NO: 1139181 - protein, 22 aa, Mycobacterium
GTVEFYAVIFLSIGASVGATIL

SEQ ID NO: 1139182 - protein, 20 aa, Mycobacterium
GTVIALVVAVPLLAAAAPRF

SEQ ID NO: 1139183 - protein, 25 aa, Mycobacterium
GTVLVIFAVFLIFGGRLFSGGDQSG

SEQ ID NO: 1139184 - protein, 24 aa, Mycobacterium
GTVPAIVWVAFQLTFAVITVALIS

SEQ ID NO: 1139185 - protein, 42 aa, Mycobacterium
GTVRGLKVLMWTALTAVLVVALGLLLYFTPIMSARSIVVTGV

SEQ ID NO: 1139186 - protein, 24 aa, Mycobacterium
GTVSLIALGLMAALAVLPLVWHQA

SEQ ID NO: 1139187 - protein, 19 aa, Mycobacterium
GTWLLLFHRQNSLSVLFEG

SEQ ID NO: 1139188 - protein, 19 aa, Mycobacterium
GTWPYWWAGLLEIVLGLLI

SEQ ID NO: 1139189 - protein, 31 aa, Mycobacterium
GVAALLIPLVLLPMSFLVYGSFQSAPPGQAG

SEQ ID NO: 1139190 - protein, 30 aa, Mycobacterium; identical to SEQ ID NO: 357220

SEQ ID NO: 1139191 - protein, 21 aa, Mycobacterium
GVALQIAVVQLPLLQTAFGTV

SEQ ID NO: 1139192 - protein, 23 aa, Mycobacterium
GVAPLILIGLPVDVASVLALAVA

SEQ ID NO: 1139193 - protein, 18 aa, Mycobacterium
GVARRWRVVGWSATIAAL

SEQ ID NO: 1139194 - protein, 29 aa, Mycobacterium
GVASALLAIPFLWVCLRIPKTLRGMGIEV

SEQ ID NO: 1139195 - protein, 30 aa, Mycobacterium
GVASALLAIPFLWVCLRIPKTLRGMGIEVD

SEQ ID NO: 1139196 - protein, 23 aa, Mycobacterium
GVAVLVVLGIAGYAVVHRSLRPL

SEQ ID NO: 1139197 - protein, 21 aa, Mycobacterium
GVAVPVFAFFAAGVAIGGVSG

SEQ ID NO: 1139198 - protein, 22 aa, Mycobacterium
GVDIPWLVFAVAAVVAIAALCH

SEQ ID NO: 1139199 - protein, 23 aa, Mycobacterium
GVDLLFYVYHRMAHRVRIVWATH

SEQ ID NO: 1139200 - protein, 19 aa, Mycobacterium
GVDRDFLRRMLFGHICLKG

SEQ ID NO: 1139201 - protein, 25 aa, Mycobacterium
GVDSRLWIAIAVLAGLLVASLAASA

SEQ ID NO: 1139202 - protein, 21 aa, Mycobacterium
GVEYVVGFFAAILAGAIAVPL

SEQ ID NO: 1139203 - protein, 23 aa, Mycobacterium
GVFAFYIPGLVLVVWLFSTTAVM

SEQ ID NO: 1139204 - protein, 27 aa, Mycobacterium
GVFFVSIAVFQLIWAFAALGRATTEVL

SEQ ID NO: 1139205 - protein, 26 aa, Mycobacterium
GVFGRKLFWPFIPQVGAKPLTDSGVW

SEQ ID NO: 1139206 - protein, 34 aa, Mycobacterium
GVFHESLNMAALWRLPVLFCCENNLYAMGTALER

SEQ ID NO: 1139207 - protein, 22 aa, Mycobacterium
GVFSRLYVPQLLITGTADAAVL

SEQ ID NO: 1139208 - protein, 24 aa, Mycobacterium
GVGAFLRLPYTFAVPVFGGRNWTV

SEQ ID NO: 1139209 - protein, 18 aa, Mycobacterium
GVGALIMFLAALSMGRLS

SEQ ID NO: 1139210 - protein, 20 aa, Mycobacterium
GVGALIMFLAALSMGRLSVR

SEQ ID NO: 1139211 - protein, 24 aa, Mycobacterium
GVGMVLFWGLIIVGIVALIRYTTG

SEQ ID NO: 1139212 - protein, 27 aa, Mycobacterium
GVIAVMLLLVFRSVATMVLILFMVFAE

SEQ ID NO: 1139213 - protein, 25 aa, Mycobacterium
GVILLALLLALLSAPPVGAIEPPSI

SEQ ID NO: 1139214 - protein, 20 aa, Mycobacterium
GVIVLFVLRPALDSAHFTLP

SEQ ID NO: 1139215 - protein, 17 aa, Mycobacterium
GVIWVFGPWPTERQSVA

SEQ ID NO: 1139216 - protein, 20 aa, Mycobacterium
GVLAPIGIVLPMSVGALLMS

SEQ ID NO: 1139217 - protein, 18 aa, Mycobacterium
GVLAVRKGGKLPPPVIGA

SEQ ID NO: 1139218 - protein, 17 aa, Mycobacterium
GVLGILARRLPIQDLLG

SEQ ID NO: 1139219 - protein, 28 aa, Mycobacterium
GVLLAGLGWQWIFFVNAPIGAIGIALAV

SEQ ID NO: 1139220 - protein, 24 aa, Mycobacterium
GVLQAAGLLFFAFAGYARIATLGE

SEQ ID NO: 1139221 - protein, 27 aa, Mycobacterium
GVLTGAWLGLFIGLVLGFFSPNPWSAL

SEQ ID NO: 1139222 - protein, 25 aa, Mycobacterium
GVLVALLAFGRWSDAVGRRPMLLAG

SEQ ID NO: 1139223 - protein, 22 aa, Mycobacterium
GVLYIDMRLVEGASLKDVLRAE

SEQ ID NO: 1139224 - protein, 21 aa, Mycobacterium
GVMGFGVYLVWPAFYTDVTDS

SEQ ID NO: 1139225 - protein, 22 aa, Mycobacterium
GVNHALAWSGIAAAAVFIVAVV

SEQ ID NO: 1139226 - protein, 31 aa, Mycobacterium
GVNPQPIFWWIGIYLFFVPLNMMGVDAYLNW

SEQ ID NO: 1139227 - protein, 26 aa, Mycobacterium
GVPANPAPPAFPPPPTITATATVTAP

SEQ ID NO: 1139228 - protein, 18 aa, Mycobacterium
GVPLLWDLVITMTASWQK

SEQ ID NO: 1139229 - protein, 25 aa, Mycobacterium
GVPPPPLNAPLPEPAPPAPPAPRVI

SEQ ID NO: 1139230 - protein, 24 aa, Mycobacterium
GVPSVRPLPGGVIRPGIEPPVAEP

SEQ ID NO: 1139231 - protein, 29 aa, Mycobacterium
GVQAGWGIKAAIAGVLVVLGIAIGWGLYG

SEQ ID NO: 1139232 - protein, 18 aa, Mycobacterium
GVRAGRAKPLPLAPADQP

SEQ ID NO: 1139233 - protein, 41 aa, Mycobacterium
GVRESRWFAWPGYLWFGMAAYLLLTLLVLEPVRPAVRAWLR

SEQ ID NO: 1139234 - protein, 27 aa, Mycobacterium
GVSIPDFWMGILLIALFSTVLGWLPTS

SEQ ID NO: 1139235 - protein, 17 aa, Mycobacterium
GVSLQEPYLLGCLNARN

SEQ ID NO: 1139236 - protein, 33 aa, Mycobacterium
GVSMPHFPNFLSLASPFAFLGLNFFNTVEYQMR

SEQ ID NO: 1139237 - protein, 26 aa, Mycobacterium
GVTAGWLAWLLALAVAAPPILALMMP

SEQ ID NO: 1139238 - protein, 27 aa, Mycobacterium
GVTEAVLWFIRRWLVARATMGVEADIR

SEQ ID NO: 1139239 - protein, 26 aa, Mycobacterium
GVTNPTVLAAFLRRARLRTIQHPGNA

SEQ ID NO: 1139240 - protein, 24 aa, Mycobacterium
GVTVLTGLLWWTVAIHLLVSMAMV

SEQ ID NO: 1139241 - protein, 20 aa, Mycobacterium
GVVAFLGWHEIIGLSLFATN

SEQ ID NO: 1139242 - protein, 32 aa, Mycobacterium; identical to SEQ ID NO: 357457

SEQ ID NO: 1139243 - protein, 34 aa, Mycobacterium
GVVIGIIWMGRRLVSPWWALGLGLILGGAMGNLI

SEQ ID NO: 1139244 - protein, 19 aa, Mycobacterium
GVVLLIVDALRDRSKRNAD

SEQ ID NO: 1139245 - protein, 27 aa, Mycobacterium
GVVVKALLMLGLWLAGWGAARLVATVL

SEQ ID NO: 1139246 - protein, 35 aa, Mycobacterium
GVVVRLCLWYPERAWLLLAIYTALALLAVIVIGAS

SEQ ID NO: 1139247 - protein, 26 aa, Mycobacterium
GVYDHYFYTFLNPTDLIYSFLQAISM

SEQ ID NO: 1139248 - protein, 24 aa, Mycobacterium
GVYEHYFYTFLNPDSVVWSFLLAV

SEQ ID NO: 1139249 - protein, 19 aa, Mycobacterium
GVYNGRFRAYVPVSLTSDR

SEQ ID NO: 1139250 - protein, 37 aa, Mycobacterium
GVYPWARRLWGRRYAWMTGWVYLVALLVTIASVAYGS

SEQ ID NO: 1139251 - protein, 29 aa, Mycobacterium
GWAATRWDLAAVFPWFAGVVAAACMGAAI

SEQ ID NO: 1139252 - protein, 20 aa, Mycobacterium
GWALPVVCAMFLAYGYYGGL

SEQ ID NO: 1139253 - protein, 21 aa, Mycobacterium
GWASFGLRIALVPLFIVEVLG

SEQ ID NO: 1139254 - protein, 26 aa, Mycobacterium
GWDPDWFKFFLGAMLLFAVIANNAFR

SEQ ID NO: 1139255 - protein, 24 aa, Mycobacterium
GWGAFLFMMSLYLQGERGYSAMET

SEQ ID NO: 1139256 - protein, 30 aa, Mycobacterium
GWGGCLLAIVMLLAFWGAVIAALAALLGAN

SEQ ID NO: 1139257 - protein, 18 aa, Mycobacterium
GWHEIIGLSLFATNLLVT

SEQ ID NO: 1139258 - protein, 18 aa, Mycobacterium
GWLMPVVPPMVAAATGSL

SEQ ID NO: 1139259 - protein, 20 aa, Mycobacterium
GWQYLLMAAVFYLVGTALYV

SEQ ID NO: 1139260 - protein, 19 aa, Mycobacterium
GWRAALLVTPALAAVALAL

SEQ ID NO: 1139261 - protein, 19 aa, Mycobacterium
GWSVGLFAAGLAFGSMTKS

SEQ ID NO: 1139262 - protein, 42 aa, Mycobacterium
GWSVQPWLALWLSQVASVVLMQWWLMPAATGLFRRWLDPVDG

SEQ ID NO: 1139263 - protein, 34 aa, Mycobacterium
GYGFLYGLAFYVPLLPWISGLVGAVPWLALAAVE

SEQ ID NO: 1139264 - protein, 38 aa, Mycobacterium
GYGRVLSLKIALTLVLIALAWRNRELWLPAARTHRSTA

SEQ ID NO: 1139265 - protein, 22 aa, Mycobacterium
GYPPPPPGGYPPPPPPGGYQPP

SEQ ID NO: 1139266 - protein, 17 aa, Mycobacterium
GYRFLAHALGYELPLMF

SEQ ID NO: 1139267 - protein, 18 aa, Mycobacterium
GYRKYTAQFLQAAALQPG

SEQ ID NO: 1139268 - protein, 25 aa, Mycobacterium
GYRLRLGKPSWVTPGPLAGDIERLQ

SEQ ID NO: 1139269 - protein, 24 aa, Mycobacterium
HAAADLKALKPFIKEYQPVLVGVG

SEQ ID NO: 1139270 - protein, 41 aa, Mycobacterium
HAAALRALLVLTVVVGLAYPVLIWLVAQLPGLRDNADGSLL

SEQ ID NO: 1139271 - protein, 22 aa, Mycobacterium
HADGTLLGWLTAAAVAIALLTL

SEQ ID NO: 1139272 - protein, 23 aa, Mycobacterium
HADTWIMSLLYIGTFGSFIGYSA

SEQ ID NO: 1139273 - protein, 18 aa, Mycobacterium
HALPWRGAVFTGKWVFYG

SEQ ID NO: 1139274 - protein, 25 aa, Mycobacterium
HAPFGYLDWLGWFGYTVVGNIAGGL

SEQ ID NO: 1139275 - protein, 20 aa, Mycobacterium
HAQHAFDFFGSPRAHYTANA

SEQ ID NO: 1139276 - protein, 19 aa, Mycobacterium
HARARLVIMPSFDLGEFLG

SEQ ID NO: 1139277 - protein, 26 aa, Mycobacterium
HARRHPLRMLALPIGLTVTTVGYLLG

SEQ ID NO: 1139278 - protein, 26 aa, Mycobacterium
HASHMLMIGYFLLSGALFFTAVGGVE

SEQ ID NO: 1139279 - protein, 20 aa, Mycobacterium
HATGQMLFGPELWQWVDPEN

SEQ ID NO: 1139280 - protein, 48 aa, Mycobacterium
HATGVSWLPVFHDMGLIAGVLLPIWSARPQFLMAPATFVRNPLSWLEA

SEQ ID NO: 1139281 - protein, 22 aa, Mycobacterium
HATRLLAVPWSFGAVVLGVLFA

SEQ ID NO: 1139282 - protein, 21 aa, Mycobacterium
HAVIRPKLTRLHRAGLLIGAC

SEQ ID NO: 1139283 - protein, 17 aa, Mycobacterium
HAWVRLAVPLAVAFVAA

SEQ ID NO: 1139284 - protein, 30 aa, Mycobacterium
HDAGAGPRFPLSVIGVVAALALLAVGGAAI

SEQ ID NO: 1139285 - protein, 26 aa, Mycobacterium
HDGALVLVVPTWWPSGRADVVAAAGR

SEQ ID NO: 1139286 - protein, 19 aa, Mycobacterium
HDIVDPLVFAEAAELIADH

SEQ ID NO: 1139287 - protein, 37 aa, Mycobacterium
HDSSGQWLIGVFLGGLLGGSVAVAILLARGRRSGRAA

SEQ ID NO: 1139288 - protein, 28 aa, Mycobacterium
HDVDFKVWVPLLAIALDVVVLVPFVILT

SEQ ID NO: 1139289 - protein, 19 aa, Mycobacterium
HEFTAPRPPQPPEPARFPI

SEQ ID NO: 1139290 - protein, 18 aa, Mycobacterium
HEGLTYRFPFDTEKKTYQ

SEQ ID NO: 1139291 - protein, 28 aa, Mycobacterium
HEHRSGIVWLLLVPVALLAFIVPPAIGP

SEQ ID NO: 1139292 - protein, 18 aa, Mycobacterium
HFPYAAQIWKSMWAEQTG

SEQ ID NO: 1139293 - protein, 20 aa, Mycobacterium
HFQIAWQFVSALYLTIHLVV

SEQ ID NO: 1139294 - protein, 25 aa, Mycobacterium
HGAQTYGFILAFFGLGSALGALGVS

SEQ ID NO: 1139295 - protein, 21 aa, Mycobacterium
HGLDYLIAAVILAGVLQLLLG

SEQ ID NO: 1139296 - protein, 21 aa, Mycobacterium
HGVNLPLLLSVLVLAAGIGVY

SEQ ID NO: 1139297 - protein, 17 aa, Mycobacterium
HGWICVSIDYRVSPRNT

SEQ ID NO: 1139298 - protein, 18 aa, Mycobacterium
HHFEGLIVFAIALGITSG

SEQ ID NO: 1139299 - protein, 19 aa, Mycobacterium
HHLVEPPTRIARSRQFVAL

SEQ ID NO: 1139300 - protein, 17 aa, Mycobacterium
HIGDSRGYLLRDGELTQ

SEQ ID NO: 1139301 - protein, 26 aa, Mycobacterium
HIVGIELHWMVLALSIIALIAVGSDY

SEQ ID NO: 1139302 - protein, 17 aa, Mycobacterium
HKAFGIHFITFLVAFVV

SEQ ID NO: 1139303 - protein, 19 aa, Mycobacterium
HKLDLIHRDIKPSNILITG

SEQ ID NO: 1139304 - protein, 20 aa, Mycobacterium
HKLWIRFGVSGALLSAVLAL

SEQ ID NO: 1139305 - protein, 33 aa, Mycobacterium
HLFDLAIVVLPLLRPLRLLRLVTLVAVLQRAVG

SEQ ID NO: 1139306 - protein, 17 aa, Mycobacterium
HLGVSWGLTAAAAIMVV

SEQ ID NO: 1139307 - protein, 22 aa, Mycobacterium
HLILGSTLFLLFGAAPAAVGLA

SEQ ID NO: 1139308 - protein, 26 aa, Mycobacterium
HLLFNMWALYVVGPPLEMWLGRLRFG

SEQ ID NO: 1139309 - protein, 25 aa, Mycobacterium
HLLGRIPLPGSVPRPVWRDAFAHPE

SEQ ID NO: 1139310 - protein, 17 aa, Mycobacterium
HLLRWIALTYVAVLVIV

SEQ ID NO: 1139311 - protein, 17 aa, Mycobacterium
HLNLTLGAWAADGLLAI

SEQ ID NO: 1139312 - protein, 19 aa, Mycobacterium
HLNRELWIGSVIAALVVGA

SEQ ID NO: 1139313 - protein, 17 aa, Mycobacterium
HLRAILVVLLSALTIAS

SEQ ID NO: 1139314 - protein, 19 aa, Mycobacterium
HLVGIELHWMVLPMAVIIL

SEQ ID NO: 1139315 - protein, 29 aa, Mycobacterium
HLVPPYGRPPPAPPPPPPSLAPPPPADAP

SEQ ID NO: 1139316 - protein, 17 aa, Mycobacterium
HLVVAIALALTAVLCLL

SEQ ID NO: 1139317 - protein, 22 aa, Mycobacterium
HLYAVCSSVLCWLRLFARRTPR

SEQ ID NO: 1139318 - protein, 29 aa, Mycobacterium
HMAPIVLIIFALFVVFTRVLFRKDLRTDD

SEQ ID NO: 1139319 - protein, 24 aa, Mycobacterium
HNDVIRFTYGFIGFVYAFFVGFVV

SEQ ID NO: 1139320 - protein, 37 aa, Mycobacterium
HPAWWTLILVILTVVALWLTYSLFFGTFRAHETVTLT

SEQ ID NO: 1139321 - protein, 24 aa, Mycobacterium
HPDFRPEHLRRFKTVGLGGSTVPA

SEQ ID NO: 1139322 - protein, 18 aa, Mycobacterium
HPDPSTFWGVPAGGGDTG

SEQ ID NO: 1139323 - protein, 26 aa, Mycobacterium
HPEPPYPLPSWRWALELDRISATLAA

SEQ ID NO: 1139324 - protein, 22 aa, Mycobacterium
HPETANWWRTLAAPVIGGAGMV

SEQ ID NO: 1139325 - protein, 21 aa, Mycobacterium
HPGLLPPHVRTPGFLARLGEE

SEQ ID NO: 1139326 - protein, 22 aa, Mycobacterium
HPHYKWIVLSNTTLGTLLATIN

SEQ ID NO: 1139327 - protein, 19 aa, Mycobacterium
HPRLPRYDALKVLSTTVCA

SEQ ID NO: 1139328 - protein, 32 aa, Mycobacterium
HPRRLTPWVAILFTTLIAFGLIFYVSVFASSS

SEQ ID NO: 1139329 - protein, 27 aa, Mycobacterium
HPSGRLLLILLGLWSVYRLATRSQLWQ

SEQ ID NO: 1139330 - protein, 25 aa, Mycobacterium
HPSSAHWFKTFLAPLLGGIGMLYVV

SEQ ID NO: 1139331 - protein, 31 aa, Mycobacterium
HPTRRSPWVAILFTTLIAFGLIIYVSTFASS

SEQ ID NO: 1139332 - protein, 25 aa, Mycobacterium
HQIAPLLWVAVIPAVLSVALVFCVR

SEQ ID NO: 1139333 - protein, 17 aa, Mycobacterium
HQYYLAAGVLLVAGFVL

SEQ ID NO: 1139334 - protein, 22 aa, Mycobacterium
HRALDLPGLALAAVALLALVFG

SEQ ID NO: 1139335 - protein, 29 aa, Mycobacterium
HRALLRWTTTTVAMLLLLVAAARPGSGAA

SEQ ID NO: 1139336 - protein, 24 aa, Mycobacterium
HRNAPPITQLPPLVHRHDLAAAES

SEQ ID NO: 1139337 - protein, 18 aa, Mycobacterium
HRNRVRMIFLLPPDPAHE

SEQ ID NO: 1139338 - protein, 24 aa, Mycobacterium
HRNVLQWTIYPPYKDLVAHRTSQS

SEQ ID NO: 1139339 - protein, 18 aa, Mycobacterium
HRRELFLQVGRQGALNLT

SEQ ID NO: 1139340 - protein, 24 aa, Mycobacterium
HRSAPPITQLPTLVHRHDLAAAES

SEQ ID NO: 1139341 - protein, 27 aa, Mycobacterium
HSLADRRLLGRIWRFAARHHRRLAVFV

SEQ ID NO: 1139342 - protein, 21 aa, Mycobacterium
HSSLLIAYLSLLVALGFALLA

SEQ ID NO: 1139343 - protein, 18 aa, Mycobacterium
HSSLLVAYLALLVGLGFG

SEQ ID NO: 1139344 - protein, 21 aa, Mycobacterium
HSVPWNIASAVPWLGDPFTTG

SEQ ID NO: 1139345 - protein, 32 aa, Mycobacterium
HTAGAVTVLLLWPLLIEPLLANLPGRGWQIGP

SEQ ID NO: 1139346 - protein, 23 aa, Mycobacterium
HTEPALDLDALLGGLKPVVKGLD

SEQ ID NO: 1139347 - protein, 25 aa, Mycobacterium
HTFIENPLLLFAYSAVLGPLVGAAL

SEQ ID NO: 1139348 - protein, 24 aa, Mycobacterium
HTHGGQLCLPFYGAIVTNCDLDRS

SEQ ID NO: 1139349 - protein, 18 aa, Mycobacterium
HTLLLGLVVIIAGAGLAG

SEQ ID NO: 1139350 - protein, 18 aa, Mycobacterium
HTSIALRDACAGLSAPLI

SEQ ID NO: 1139351 - protein, 28 aa, Mycobacterium
HTVDLDGLGRYRVVAFPAHIPGQVVVAG

SEQ ID NO: 1139352 - protein, 27 aa, Mycobacterium
HTYRTRFLFFATGYYDYDHPYRPDFPG

SEQ ID NO: 1139353 - protein, 20 aa, Mycobacterium
HTYSSLWRFINATDIHPPGS

SEQ ID NO: 1139354 - protein, 20 aa, Mycobacterium
HVIKIRDGRWSIASAAPVRF

SEQ ID NO: 1139355 - protein, 25 aa, Mycobacterium
HVLLVALTTLGLLAGALGYAAAAWA

SEQ ID NO: 1139356 - protein, 17 aa, Mycobacterium
HVPPPDRGPITWVVVIG

SEQ ID NO: 1139357 - protein, 22 aa, Mycobacterium
HVSLMHGWLPVVVQAAAVVALV

SEQ ID NO: 1139358 - protein, 23 aa, Mycobacterium
HVVTGSWAFELTVSGTGTPGPSA

SEQ ID NO: 1139359 - protein, 18 aa, Mycobacterium
HWDWLKWLPHRCDTPSAR

SEQ ID NO: 1139360 - protein, 31 aa, Mycobacterium
HWQEWMLAGVFFAGIALFQLIWAGLVLTRPT

SEQ ID NO: 1139361 - protein, 22 aa, Mycobacterium
HWSLLVGYGCLPWVATAVLRLR

SEQ ID NO: 1139362 - protein, 22 aa, Mycobacterium
HYFNTFLIPSDLLWSFLQAIVM

SEQ ID NO: 1139363 - protein, 28 aa, Mycobacterium
IAAGAVALLLFLIIKVKLHAFIALVLVS

SEQ ID NO: 1139364 - protein, 26 aa, Mycobacterium
IAAGVLLVIGLFTPIAAAGALGYLIT

SEQ ID NO: 1139365 - protein, 17 aa, Mycobacterium
IAAKVAFMRMFGVGLTL

SEQ ID NO: 1139366 - protein, 25 aa, Mycobacterium
IAALGALLALLLGVSRTTLAMARDR

SEQ ID NO: 1139367 - protein, 18 aa, Mycobacterium
IAALLVDWLVSYGLAALA

SEQ ID NO: 1139368 - protein, 27 aa, Mycobacterium
IAANGFELTLAAPTFTWDQATYSDKYD

SEQ ID NO: 1139369 - protein, 23 aa, Mycobacterium
IAAPTFEFFALYGTAAVYYWVIC

SEQ ID NO: 1139370 - protein, 21 aa, Mycobacterium
IAATFVWLGMVLAISFLEAPL

SEQ ID NO: 1139371 - protein, 28 aa, Mycobacterium
IAAVGLIFIIMLILTRAIVAAAVIVGTV

SEQ ID NO: 1139372 - protein, 24 aa, Mycobacterium
IAAVLLAVIVAAVGFLMTRSSTGD

SEQ ID NO: 1139373 - protein, 21 aa, Mycobacterium
IADGWFPLVGPGPALDEAKGA

SEQ ID NO: 1139374 - protein, 17 aa, Mycobacterium
IADKIWPGTRALAQMHL

SEQ ID NO: 1139375 - protein, 36 aa, Mycobacterium
IADLIRAYGELLRFLFEPIFDFLRDPLGNTIKLITD

SEQ ID NO: 1139376 - protein, 32 aa, Mycobacterium
IADRFLEWQLPPIWMMFFFAPTVVALSAMRGL

SEQ ID NO: 1139377 - protein, 29 aa, Mycobacterium
IADTNNLHRRVLIICTLAVGAATFGGWLL

SEQ ID NO: 1139378 - protein, 30 aa, Mycobacterium
IAFALPSIFLLPWLARVFGLPDAVAGAWIG

SEQ ID NO: 1139379 - protein, 19 aa, Mycobacterium
IAFFTRIVENSLRSVPPSV

SEQ ID NO: 1139380 - protein, 24 aa, Mycobacterium
IAFQTIKWLGVGYLLYLAWITWRD

SEQ ID NO: 1139381 - protein, 34 aa, Mycobacterium
IAGAKVLDELFPPGSLDFLYLAASAGAVFGIPGQ

SEQ ID NO: 1139382 - protein, 26 aa, Mycobacterium
IAGDSIWIPILIIGLVYVPYMARPLR

SEQ ID NO: 1139383 - protein, 24 aa, Mycobacterium
IAGGFLFMATFVGGVVGAAIDAVV

SEQ ID NO: 1139384 - protein, 21 aa, Mycobacterium
IAGIYLVAVYRLSRRGAPWST

SEQ ID NO: 1139385 - protein, 19 aa, Mycobacterium
IAGLAGAFFFCVFVQNVSA

SEQ ID NO: 1139386 - protein, 18 aa, Mycobacterium
IAHYLRITSQPVPDLRHL

SEQ ID NO: 1139387 - protein, 18 aa, Mycobacterium
IAIAYRMYGRRAVPAEAP

SEQ ID NO: 1139388 - protein, 25 aa, Mycobacterium
IAIGFSLLCIALAAFSFLIDFDAAD

SEQ ID NO: 1139389 - protein, 22 aa, Mycobacterium
IAKPLVPGVMIVSALIAVIGSL

SEQ ID NO: 1139390 - protein, 32 aa, Mycobacterium
IALALGLVVVVLPLLWCQAAKAPIRGPPRNAR

SEQ ID NO: 1139391 - protein, 31 aa, Mycobacterium
IALLVAPAPIPVVWLAFYAVSVLGAAEVFGL

SEQ ID NO: 1139392 - protein, 19 aa, Mycobacterium
IALPLAGAAILLLSGRRSD

SEQ ID NO: 1139393 - protein, 23 aa, Mycobacterium
IALPLIPVFMVLIGLATADRSAA

SEQ ID NO: 1139394 - protein, 18 aa, Mycobacterium
IALVPLFIVEVLGQSPGA

SEQ ID NO: 1139395 - protein, 19 aa, Mycobacterium
IALWALSRTVGAPFGPSAG

SEQ ID NO: 1139396 - protein, 35 aa, Mycobacterium
IAMAMVPVLQFTYWQWLSLTLAAPVVVWGAWPFHQ

SEQ ID NO: 1139397 - protein, 20 aa, Mycobacterium
IAMAYIIVLNPIILSSSADV

SEQ ID NO: 1139398 - protein, 25 aa, Mycobacterium
IAMVVVFALVVTRAIRWAAERVSRR

SEQ ID NO: 1139399 - protein, 23 aa, Mycobacterium
IANRVSYYFDLRGPSVTIDTACS

SEQ ID NO: 1139400 - protein, 30 aa, Mycobacterium
IAPENAFGALLLLGVLVVSAGWGFGLSIAT

SEQ ID NO: 1139401 - protein, 21 aa, Mycobacterium
IAPLYLLTALANCSWLFAWHY

SEQ ID NO: 1139402 - protein, 24 aa, Mycobacterium
IAPPLNQWFFGAVYWLFELSGVPP

SEQ ID NO: 1139403 - protein, 34 aa, Mycobacterium
IARNYQSFTMWLIIGVIYFIVIMALTKLSDRLER

SEQ ID NO: 1139404 - protein, 43 aa, Mycobacterium
IARPEPLARWLAWSTTLYLKVFGWLIWLFDQSSNLLLRALRIE

SEQ ID NO: 1139405 - protein, 18 aa, Mycobacterium
IARRLLGGWGLLLALVAI

SEQ ID NO: 1139406 - protein, 22 aa, Mycobacterium
IARVFFEWRFDLIFGTAAVVMA

SEQ ID NO: 1139407 - protein, 17 aa, Mycobacterium
IARVSLVPTLLVAIPFT

SEQ ID NO: 1139408 - protein, 24 aa, Mycobacterium
IASGLFVFILMVSGATHLLGWVIL

SEQ ID NO: 1139409 - protein, 36 aa, Mycobacterium
IASLFIGNFLLLVLNLPLAPLWARLLRTPRPYLYAG

SEQ ID NO: 1139410 - protein, 37 aa, Mycobacterium
IATIIIVGVILVLLLRALLAPLYLLGTVVLNYLASLG

SEQ ID NO: 1139411 - protein, 26 aa, Mycobacterium
IATLLGRWFWWPLVVRSRPLRLPPRT

SEQ ID NO: 1139412 - protein, 45 aa, Mycobacterium
IAVAFGAGLFIAFDQLWKWNNIVALVLSVLVILGLVVGVRVVRKT

SEQ ID NO: 1139413 - protein, 32 aa, Mycobacterium
IAVIAVLLLVALVVGLVRYRRRRISLSAPDTA

SEQ ID NO: 1139414 - protein, 19 aa, Mycobacterium
IAVMFGFHVLIGRQLNPFV

SEQ ID NO: 1139415 - protein, 20 aa, Mycobacterium
IAVTVLSPIAPLAPRLRRGY

SEQ ID NO: 1139416 - protein, 29 aa, Mycobacterium
IAVWVAMAVALPLSFPSLGEMAQKHPLVI

SEQ ID NO: 1139417 - protein, 23 aa, Mycobacterium
IAWGWPIVAVFILLIGLCMSELV

SEQ ID NO: 1139418 - protein, 20 aa, Mycobacterium
IAWTLMRYLPETPGLDFADY

SEQ ID NO: 1139419 - protein, 18 aa, Mycobacterium
ICRPRRSHVMFQGYWRRP

SEQ ID NO: 1139420 - protein, 24 aa, Mycobacterium
ICSAVSLRRHRFGWCVAAAYLSGV

SEQ ID NO: 1139421 - protein, 23 aa, Mycobacterium
ICSPLRFIEYLSVKILVLTGVSL

SEQ ID NO: 1139422 - protein, 19 aa, Mycobacterium
ICVAMFGLVVSPVSWSHHW

SEQ ID NO: 1139423 - protein, 19 aa, Mycobacterium
ICVLTLTIAGPVRTYFAQR

SEQ ID NO: 1139424 - protein, 28 aa, Mycobacterium
IDAATEWQLFLSAQWLAAAGSIFAALLF

SEQ ID NO: 1139425 - protein, 33 aa, Mycobacterium
IDAVLSRVLDVIWAFPVLLLGIALGTALAIGGL

SEQ ID NO: 1139426 - protein, 25 aa, Mycobacterium
IDDMAKVIWLQRFAGVSFIGDMDEA

SEQ ID NO: 1139427 - protein, 20 aa, Mycobacterium
IDDRWGLDALTKFAGQITAA

SEQ ID NO: 1139428 - protein, 24 aa, Mycobacterium
IDDSQLHDLLLDPPQLMGVESIEL

SEQ ID NO: 1139429 - protein, 17 aa, Mycobacterium
IDILYDTARRYPDAPAI

SEQ ID NO: 1139430 - protein, 18 aa, Mycobacterium
IDKLLFNVLGSWVYVKIF

SEQ ID NO: 1139431 - protein, 17 aa, Mycobacterium
IDMLAIFATLFGSAASL

SEQ ID NO: 1139432 - protein, 26 aa, Mycobacterium
IDPGVRALFLAILVFVLLATLLLPHT

SEQ ID NO: 1139433 - protein, 27 aa, Mycobacterium
IDREMWRGIVFIGLVMGFATLLTMDIF

SEQ ID NO: 1139434 - protein, 25 aa, Mycobacterium
IDVAGRPGVLLLLPGASAGQIVAVA

SEQ ID NO: 1139435 - protein, 22 aa, Mycobacterium
IDVGMRWLRRSAPDLLRVPIGV

SEQ ID NO: 1139436 - protein, 26 aa, Mycobacterium
IDVWQWTPFMVLLLLAGLESIPKEPL

SEQ ID NO: 1139437 - protein, 37 aa, Mycobacterium
IDWGRVLIFGALPGLALVLTLVAGFLKWQDTAATQAE

SEQ ID NO: 1139438 - protein, 23 aa, Mycobacterium
IDYSLFILMRFREELRAGREPED

SEQ ID NO: 1139439 - protein, 30 aa, Mycobacterium
IEAEAQRMHALVADLLLLARLDEGQDRQTT

SEQ ID NO: 1139440 - protein, 17 aa, Mycobacterium
IEAIKALWTAEPAEYHG

SEQ ID NO: 1139441 - protein, 33 aa, Mycobacterium
IEAVPPAAKLFFVSALLMLLGLVGGLTLDSSLG

SEQ ID NO: 1139442 - protein, 23 aa, Mycobacterium
IEIAGAWRWTALLAVLVTVVSIP

SEQ ID NO: 1139443 - protein, 19 aa, Mycobacterium
IEIFLTTRDLLRARATRRE

SEQ ID NO: 1139444 - protein, 17 aa, Mycobacterium
IEQGWLQGIFAELKNPD

SEQ ID NO: 1139445 - protein, 18 aa, Mycobacterium
IESIYLLKREVVELRRAV

SEQ ID NO: 1139446 - protein, 29 aa, Mycobacterium
IEVLGWPLWTAYVVVFVLTLMIGARLIVS

SEQ ID NO: 1139447 - protein, 17 aa, Mycobacterium
IFAASMAGLLFASIGIV

SEQ ID NO: 1139448 - protein, 24 aa, Mycobacterium
IFDAANPLPEVWVDPLRLAQVIGN

SEQ ID NO: 1139449 - protein, 18 aa, Mycobacterium
IFEKVLILPLMIAPVIAG

SEQ ID NO: 1139450 - protein, 20 aa, Mycobacterium
IFMVAVPVSVALWLSMRFPP

SEQ ID NO: 1139451 - protein, 19 aa, Mycobacterium
IFNAVVIIALIPLSLRGVR

SEQ ID NO: 1139452 - protein, 17 aa, Mycobacterium
IFVVGLPLRRVVRRHLR

SEQ ID NO: 1139453 - protein, 44 aa, Mycobacterium
IGAVWSTILAFLEPSWFAWLIVVWLWLTVLFANLAEAVAEGRGK

SEQ ID NO: 1139454 - protein, 25 aa, Mycobacterium
IGDRRVWRTPYWLTELPGGRVPREV

SEQ ID NO: 1139455 - protein, 30 aa, Mycobacterium
IGFAVIVFILVKWVVPPIKGLMQKQQEAVR

SEQ ID NO: 1139456 - protein, 17 aa, Mycobacterium
IGFSSFGVLLYYAIANA

SEQ ID NO: 1139457 - protein, 25 aa, Mycobacterium
IGGLWGFVIPVWAILAAMGLVIPNA

SEQ ID NO: 1139458 - protein, 19 aa, Mycobacterium
IGHPCWANYFPVTRANPEP

SEQ ID NO: 1139459 - protein, 35 aa, Mycobacterium
IGIGVLTFQLLLGQQLHWSVPPLAFVVLVAVGADY

SEQ ID NO: 1139460 - protein, 22 aa, Mycobacterium
IGIIGYAWPFYALVDMRSQAYL

SEQ ID NO: 1139461 - protein, 36 aa, Mycobacterium
IGIRADSILLSRARIPFYVGVGVVTVLIAGVLGWLL

SEQ ID NO: 1139462 - protein, 19 aa, Mycobacterium
IGKLPPLPDTVSQAVIPPM

SEQ ID NO: 1139463 - protein, 18 aa, Mycobacterium
IGLGYLANLLSKPVLVGY

SEQ ID NO: 1139464 - protein, 19 aa, Mycobacterium
IGLIISLLGALIAWVLLCV

SEQ ID NO: 1139465 - protein, 29 aa, Mycobacterium
IGLPVLAIILIGFFTDVKLPGGVPIGLVA

SEQ ID NO: 1139466 - protein, 18 aa, Mycobacterium
IGLVLGMVFLFGLVFVLI

SEQ ID NO: 1139467 - protein, 22 aa, Mycobacterium
IGLVLGMVFLFGLVFVLIEGPG

SEQ ID NO: 1139468 - protein, 19 aa, Mycobacterium
IGLVWLIVFQLAGSGPDVP

SEQ ID NO: 1139469 - protein, 17 aa, Mycobacterium
IGMGLGVLLFSLAVGAL

SEQ ID NO: 1139470 - protein, 23 aa, Mycobacterium
IGMIYIWMPLAMGKLAGWAMRRA

SEQ ID NO: 1139471 - protein, 18 aa, Mycobacterium
IGMVVLPVIVYYVTYRWA

SEQ ID NO: 1139472 - protein, 22 aa, Mycobacterium
IGPKLLVHITADGGAPRLAIAA

SEQ ID NO: 1139473 - protein, 23 aa, Mycobacterium
IGPKLLVRITADGGAPRLAIAAW

SEQ ID NO: 1139474 - protein, 30 aa, Mycobacterium
IGPLFPPVTYYVCLLLLLICAPLSVFAGLI

SEQ ID NO: 1139475 - protein, 17 aa, Mycobacterium
IGQVHWPTLMMAAAVLL

SEQ ID NO: 1139476 - protein, 32 aa, Mycobacterium
IGRIIHLLAVPIVLGWIALTVLTNVAVPSLEK

SEQ ID NO: 1139477 - protein, 17 aa, Mycobacterium
IGRPFRRMTQYTGFQGW

SEQ ID NO: 1139478 - protein, 29 aa, Mycobacterium
IGRRTRRWRLVWVPWSALIGVVLAVAAYC

SEQ ID NO: 1139479 - protein, 35 aa, Mycobacterium
IGSGVYWMLLGIVAFLVIVTFGLALARYVPLARRP

SEQ ID NO: 1139480 - protein, 31 aa, Mycobacterium
IGSGVYWMLLGIVAFLVIVTFGLTLARYVPL

SEQ ID NO: 1139481 - protein, 32 aa, Mycobacterium
IGSGVYWMLLGIVAFLVIVTFGLTLARYVPLA

SEQ ID NO: 1139482 - protein, 34 aa, Mycobacterium
IGSIEPIWIIVLSPLFALMWTRLGKRAPTTPRKF

SEQ ID NO: 1139483 - protein, 19 aa, Mycobacterium
IGSLGLGLGITLWLSTGAA

SEQ ID NO: 1139484 - protein, 28 aa, Mycobacterium
IGSRFPWAFFMVVVAWLAVIFASFGLFA

SEQ ID NO: 1139485 - protein, 48 aa, Mycobacterium
IGTAAAALCWLWPAGAGLLIRFTGPPLWWLLRVADWAAAVPGASVPVP

SEQ ID NO: 1139486 - protein, 36 aa, Mycobacterium
IGVAVLWSVQYLAVTFGWIWAGLAAGPILLTAGAVA

SEQ ID NO: 1139487 - protein, 33 aa, Mycobacterium
IGVLTFQVLLGQELHWSVPPLAFVVLVAVGADY

SEQ ID NO: 1139488 - protein, 24 aa, Mycobacterium
IGVWAPILLVVLRFMQGFAVGGEW

SEQ ID NO: 1139489 - protein, 29 aa, Mycobacterium
IGVWILDRGVRIALLLIGGLLAARFINWA

SEQ ID NO: 1139490 - protein, 18 aa, Mycobacterium
IGWGITWLGYAGDYSRFV

SEQ ID NO: 1139491 - protein, 28 aa, Mycobacterium
IGWIAGPAILWVAFALLVTDDYAASNLL

SEQ ID NO: 1139492 - protein, 17 aa, Mycobacterium
IGWRIRNGVAEAVLAFA

SEQ ID NO: 1139493 - protein, 24 aa, Mycobacterium
IGYLPTMRKVILPQAIRTMIPSYV

SEQ ID NO: 1139494 - protein, 18 aa, Mycobacterium
IHDCPKLVQLKTFPTIAV

SEQ ID NO: 1139495 - protein, 18 aa, Mycobacterium
IHGFWVPEFLFKRDVMPN

SEQ ID NO: 1139496 - protein, 17 aa, Mycobacterium
IHHFGLFAAVGGAMAAL

SEQ ID NO: 1139497 - protein, 18 aa, Mycobacterium
IHHLPARRDGRFLVALGM

SEQ ID NO: 1139498 - protein, 18 aa, Mycobacterium
IHLLLMAGNHPFMRGIWT

SEQ ID NO: 1139499 - protein, 43 aa, Mycobacterium
IHQDAGLSWLLLVSIPVLAVANYWIVSHLLPIFRRMQQLIDNI

SEQ ID NO: 1139500 - protein, 22 aa, Mycobacterium
IIEGLRFVWRNKVLRTLALVDL

SEQ ID NO: 1139501 - protein, 17 aa, Mycobacterium
IIFAVSMFGLMTGSVHI

SEQ ID NO: 1139502 - protein, 18 aa, Mycobacterium
IIGALPPLPDTVGPALVP

SEQ ID NO: 1139503 - protein, 23 aa, Mycobacterium
IIGLVITVAILAVLRTAVRDIFR

SEQ ID NO: 1139504 - protein, 25 aa, Mycobacterium
IIGNLLQMAFRFWAFRRFVFPDEFA

SEQ ID NO: 1139505 - protein, 21 aa, Mycobacterium
IIILNLVFTFVYPLISGQGIS

SEQ ID NO: 1139506 - protein, 23 aa, Mycobacterium
IIISIIVMLNHCYYGYYASGGPV

SEQ ID NO: 1139507 - protein, 20 aa, Mycobacterium
IILNLVFTFVYPLISGQGIS

SEQ ID NO: 1139508 - protein, 23 aa, Mycobacterium
IINPLLDVLWGTDPLGLKRRDDG

SEQ ID NO: 1139509 - protein, 22 aa, Mycobacterium
IIRDLREVIFNLDHAVSPLGRP

SEQ ID NO: 1139510 - protein, 24 aa, Mycobacterium
IISLFGWFLLLRGLALLTVPQLIV

SEQ ID NO: 1139511 - protein, 25 aa, Mycobacterium
IITASIGLLMVRWSRRARFAPPLAV

SEQ ID NO: 1139512 - protein, 26 aa, Mycobacterium
IITAVNTILALVGRSIPPIPTGTREA

SEQ ID NO: 1139513 - protein, 31 aa, Mycobacterium
IIVVALAALVLVAALVWAARNKRNQSRHDEA

SEQ ID NO: 1139514 - protein, 34 aa, Mycobacterium
IKFIIFGVIMVVLTAFLFLVFSDSRTGATEKYSA

SEQ ID NO: 1139515 - protein, 26 aa, Mycobacterium
IKKRKRWPWIAGAVVAVLAVTGGIVY

SEQ ID NO: 1139516 - protein, 17 aa, Mycobacterium
IKQNLWASLGIVAVLIP

SEQ ID NO: 1139517 - protein, 24 aa, Mycobacterium
IKSDFWRVFGIWLLAAIVAQFIAG

SEQ ID NO: 1139518 - protein, 26 aa, Mycobacterium
ILAAGLWAGLLWGADGTVPLLISGLA

SEQ ID NO: 1139519 - protein, 26 aa, Mycobacterium
ILAAVCFIVIWRRHGAPWGFAVLAFS

SEQ ID NO: 1139520 - protein, 21 aa, Mycobacterium
ILALIHLYLWKRLVKDTTGPG

SEQ ID NO: 1139521 - protein, 17 aa, Mycobacterium
ILALYDPAPTFGQMVVV

SEQ ID NO: 1139522 - protein, 23 aa, Mycobacterium
ILFTLGIVILYRVGAQIPSPGVN

SEQ ID NO: 1139523 - protein, 17 aa, Mycobacterium
ILGAVGPVRMPDGEVIT

SEQ ID NO: 1139524 - protein, 44 aa, Mycobacterium
ILGLRAMYFLLADLMHRFIYLKLGLALVLVWVGVKMLLLEIYKI

SEQ ID NO: 1139525 - protein, 24 aa, Mycobacterium
ILGNLYYTFLARRLAKRENRSDVT

SEQ ID NO: 1139526 - protein, 21 aa, Mycobacterium
ILIAIVVTLIPLLRRGNSAAA

SEQ ID NO: 1139527 - protein, 40 aa, Mycobacterium
ILISLTAIWLTYLGFGSIALWAFRFAWVQLGALGTLMSRA

SEQ ID NO: 1139528 - protein, 18 aa, Mycobacterium
ILLPAIRPAVLSSALIVF

SEQ ID NO: 1139529 - protein, 17 aa, Mycobacterium
ILNLVFTFVYPLISGQG

SEQ ID NO: 1139530 - protein, 18 aa, Mycobacterium
ILPMSFHGRWQSGQLLSR

SEQ ID NO: 1139531 - protein, 30 aa, Mycobacterium
ILQQSLADRWQAQWPAIAAVGLGALAVSLL

SEQ ID NO: 1139532 - protein, 20 aa, Mycobacterium
ILRAYLWHRHGDPVRAAIGA

SEQ ID NO: 1139533 - protein, 20 aa, Mycobacterium
ILSMLFKLEIARGYLMIALP

SEQ ID NO: 1139534 - protein, 20 aa, Mycobacterium
ILSPGPWRRNADPTAPAGTL

SEQ ID NO: 1139535 - protein, 28 aa, Mycobacterium
ILSQLGVIILVLTLGVWVWVGVTNDQYD

SEQ ID NO: 1139536 - protein, 19 aa, Mycobacterium
ILSVLAIYTALYSASFHAG

SEQ ID NO: 1139537 - protein, 18 aa, Mycobacterium
ILTDLLTPGTLFSPQQTV

SEQ ID NO: 1139538 - protein, 18 aa, Mycobacterium
ILTLPLGLLFGWLGKRMA

SEQ ID NO: 1139539 - protein, 23 aa, Mycobacterium
ILVDLWIFTPFVAILVLAGIRSL

SEQ ID NO: 1139540 - protein, 21 aa, Mycobacterium
ILVIHENKGLNDWVRSVAGRL

SEQ ID NO: 1139541 - protein, 17 aa, Mycobacterium
ILVLIAFPILTAALFGL

SEQ ID NO: 1139542 - protein, 18 aa, Mycobacterium
ILVNLAVIALWSVSRTAG

SEQ ID NO: 1139543 - protein, 25 aa, Mycobacterium
ILYGYLVILAIILAYVIHIPFAMRT

SEQ ID NO: 1139544 - protein, 25 aa, Mycobacterium
IMLAAFPFFEWLVHVCILHWRPRKI

SEQ ID NO: 1139545 - protein, 30 aa, Mycobacterium
IMLPFMLMWPFWLLAKWLGVPWTILVERDG

SEQ ID NO: 1139546 - protein, 18 aa, Mycobacterium
IMTTGLHIAMVVVFALVV

SEQ ID NO: 1139547 - protein, 35 aa, Mycobacterium; identical to SEQ ID NO: 359019

SEQ ID NO: 1139548 - protein, 27 aa, Mycobacterium
INAGVFSALWLGFRSGTSIFEDAPPEP

SEQ ID NO: 1139549 - protein, 42 aa, Mycobacterium
INCGYPLIERFPLMFFTSAAVLMIGLARWYFAKSGHQFGAQA

SEQ ID NO: 1139550 - protein, 29 aa, Mycobacterium
INEKSWLLFGPFAGWSPKFLKQGKVTDLP

SEQ ID NO: 1139551 - protein, 23 aa, Mycobacterium
INEPVFLGRRWGVGYMWTEAAVY

SEQ ID NO: 1139552 - protein, 21 aa, Mycobacterium
INFEYLPVFGAAAAIYLALNT

SEQ ID NO: 1139553 - protein, 24 aa, Mycobacterium
INLGFYMLMPYLAGYLAGPLGLAA

SEQ ID NO: 1139554 - protein, 18 aa, Mycobacterium
INVALWLIDTPGEAWFAA

SEQ ID NO: 1139555 - protein, 17 aa, Mycobacterium
INWAAQRITRRIDAEYQ

SEQ ID NO: 1139556 - protein, 27 aa, Mycobacterium
IPGRAIWRPLFVAPLAVPAFINSYAWV

SEQ ID NO: 1139557 - protein, 22 aa, Mycobacterium
IPHRRLPFWVALALSVALVGPT

SEQ ID NO: 1139558 - protein, 18 aa, Mycobacterium
IPIDRARLRRLPAVVAAV

SEQ ID NO: 1139559 - protein, 17 aa, Mycobacterium
IPKGVLLYGPPGTGKTL

SEQ ID NO: 1139560 - protein, 19 aa, Mycobacterium
IPLFVANAVFWSLFQQIFT

SEQ ID NO: 1139561 - protein, 18 aa, Mycobacterium
IPLLMVAATWYLAITSVL

SEQ ID NO: 1139562 - protein, 26 aa, Mycobacterium
IPLSQWFLLVMTFGSLFMVAGKRYAE

SEQ ID NO: 1139563 - protein, 30 aa, Mycobacterium
IPNIQPAQLLQPFLDYAFGFRNGVDIGQPP

SEQ ID NO: 1139564 - protein, 17 aa, Mycobacterium
IPPLFVMSLVEGESFEP

SEQ ID NO: 1139565 - protein, 34 aa, Mycobacterium
IPQLVQMWLIELFFALPLTFFIAKVIDIRGAFGV

SEQ ID NO: 1139566 - protein, 19 aa, Mycobacterium
IPRMGFSSVLWVGPPNASP

SEQ ID NO: 1139567 - protein, 43 aa, Mycobacterium
IPSPSQGVWHLGPFPVRAYALFIIVGIIAALVIGDRRWVARGG

SEQ ID NO: 1139568 - protein, 17 aa, Mycobacterium
IPSVIGFLLAGVVFIYL

SEQ ID NO: 1139569 - protein, 18 aa, Mycobacterium
IPVIFSHLSFVLPVVTWF

SEQ ID NO: 1139570 - protein, 22 aa, Mycobacterium
IQDGRNILPPNKFPMIPPQVDP

SEQ ID NO: 1139571 - protein, 29 aa, Mycobacterium
IQHPQPWFDWPTRPVWLYRFTQGLHVASG

SEQ ID NO: 1139572 - protein, 52 aa, Mycobacterium
IQLAIFAVIALAAMAIMVFQFMKLPAQLFGVGRYTVIMQLSKTGGLYSTGNV

SEQ ID NO: 1139573 - protein, 24 aa, Mycobacterium
IQLALFMAVTLGAFGVLGFGYLNA

SEQ ID NO: 1139574 - protein, 23 aa, Mycobacterium
IQLGVFLAVALTAFSIMAFNYMK

SEQ ID NO: 1139575 - protein, 20 aa, Mycobacterium
IQLLVFAVASLIAGLVMSIG

SEQ ID NO: 1139576 - protein, 25 aa, Mycobacterium
IQQFSWVFYIFGAFLLYTAVKLVKD

SEQ ID NO: 1139577 - protein, 29 aa, Mycobacterium
IQWPALVMFLIIFFWTPPHTWALAMRYKE

SEQ ID NO: 1139578 - protein, 18 aa, Mycobacterium
IREHSLGPYPFDPNLVSQ

SEQ ID NO: 1139579 - protein, 22 aa, Mycobacterium
IRELPGYWAPFASPLVTLIAIV

SEQ ID NO: 1139580 - protein, 18 aa, Mycobacterium
IRGFAELYRQGAARDVEM

SEQ ID NO: 1139581 - protein, 28 aa, Mycobacterium
IRGIPYVLPLMLVLLIAMTVVLRRTSYG

SEQ ID NO: 1139582 - protein, 20 aa, Mycobacterium
IRGIRPPALDLGLGPAIHTL

SEQ ID NO: 1139583 - protein, 20 aa, Mycobacterium
IRGRVALGIIGVIIGFGALC

SEQ ID NO: 1139584 - protein, 17 aa, Mycobacterium
IRHLDPWSALFASAGLV

SEQ ID NO: 1139585 - protein, 18 aa, Mycobacterium
IRLARTWSLAVSMVVLVL

SEQ ID NO: 1139586 - protein, 19 aa, Mycobacterium
IRNYFYWEPHCYNIPLCWS

SEQ ID NO: 1139587 - protein, 17 aa, Mycobacterium
IRPISFLVSTRLIAGMV

SEQ ID NO: 1139588 - protein, 19 aa, Mycobacterium
IRRLAWLGDRSRPLLIVGC

SEQ ID NO: 1139589 - protein, 17 aa, Mycobacterium
IRTLLELAPPMAVVLRD

SEQ ID NO: 1139590 - protein, 31 aa, Mycobacterium
IRVNSFTSMFVFIGAVVYLMAAPRGREDPAT

SEQ ID NO: 1139591 - protein, 17 aa, Mycobacterium
ISAFLGLLLALLLDRAF

SEQ ID NO: 1139592 - protein, 31 aa, Mycobacterium
ISALERRFGPLLFKELLALHFSPTRPSTDEW

SEQ ID NO: 1139593 - protein, 18 aa, Mycobacterium
ISALLGIPVGRWLDRHGP

SEQ ID NO: 1139594 - protein, 28 aa, Mycobacterium
ISALVGFLPLIWLSLAFGWGLLGIWAGL

SEQ ID NO: 1139595 - protein, 24 aa, Mycobacterium
ISATLLVAVFGITGSITGSSDRLA

SEQ ID NO: 1139596 - protein, 24 aa, Mycobacterium
ISDGAVFCGLLWWAAFGLHSTGLV

SEQ ID NO: 1139597 - protein, 28 aa, Mycobacterium
ISDIVIAVWVLIWLFVGMAVHSAVATIA

SEQ ID NO: 1139598 - protein, 18 aa, Mycobacterium
ISDPAVAALLIAKTSLAA

SEQ ID NO: 1139599 - protein, 20 aa, Mycobacterium
ISEALKRLPAYATALGEVVG

SEQ ID NO: 1139600 - protein, 18 aa, Mycobacterium
ISEGLFNALPNAGPWRLP

SEQ ID NO: 1139601 - protein, 23 aa, Mycobacterium
ISGAAIFFFLFVHVVDTALVRVS

SEQ ID NO: 1139602 - protein, 24 aa, Mycobacterium
ISGATIFFFLFVHVLDTALVRVSP

SEQ ID NO: 1139603 - protein, 18 aa, Mycobacterium
ISGMLWLVVLLPMPQHLR

SEQ ID NO: 1139604 - protein, 27 aa, Mycobacterium
ISGVFVPIVIALSVATLGFWIGSGFPV

SEQ ID NO: 1139605 - protein, 25 aa, Mycobacterium
ISILALALIAAISGWRSGAPGSLLA

SEQ ID NO: 1139606 - protein, 20 aa, Mycobacterium
ISLATIWIRTGLMPRWTAVI

SEQ ID NO: 1139607 - protein, 20 aa, Mycobacterium
ISLVAFPWLVLQRTGSALDA

SEQ ID NO: 1139608 - protein, 23 aa, Mycobacterium
ISQAWFVARVSILPTLLLTIPYT

SEQ ID NO: 1139609 - protein, 26 aa, Mycobacterium
ISRTIPDLVWGLIFVIAVGLGPEAGV

SEQ ID NO: 1139610 - protein, 26 aa, Mycobacterium
ISTFGHLVTVLLLGVSLAVAAVPEGL

SEQ ID NO: 1139611 - protein, 19 aa, Mycobacterium
ISTIGLILGFVIAVSSFLA

SEQ ID NO: 1139612 - protein, 20 aa, Mycobacterium
ISWRGPFFGVSALMVVAVVV

SEQ ID NO: 1139613 - protein, 27 aa, Mycobacterium
ITAGALMYRPERVQFYCIAASGPQLAA

SEQ ID NO: 1139614 - protein, 22 aa, Mycobacterium
ITAIVLNIVFFHIVKKGPRVAG

SEQ ID NO: 1139615 - protein, 27 aa, Mycobacterium
ITEMRHWWQVPLLGHHVLIAGATGAGK

SEQ ID NO: 1139616 - protein, 17 aa, Mycobacterium
ITGTAEFLLPRNAPEGD

SEQ ID NO: 1139617 - protein, 26 aa, Mycobacterium
ITPLLAVLLRIDWPNFLPLITSESSR

SEQ ID NO: 1139618 - protein, 23 aa, Mycobacterium
ITSARFFARTALPGILAIRAAVE

SEQ ID NO: 1139619 - protein, 37 aa, Mycobacterium
ITSRLPLVLGLIAVSTFCLLFLLTASVVLPLKALLLN

SEQ ID NO: 1139620 - protein, 29 aa, Mycobacterium
ITVDAVYVDLLWPLLLMGSGLGLCMAPAT

SEQ ID NO: 1139621 - protein, 24 aa, Mycobacterium
ITVPAHFFGLRRPWPHIEHHHLVE

SEQ ID NO: 1139622 - protein, 20 aa, Mycobacterium
ITVRLLVLLPTVIGVPVIVQ

SEQ ID NO: 1139623 - protein, 30 aa, Mycobacterium
ITVVTAILLAMYWPLGVVVLVSIVPITLTV

SEQ ID NO: 1139624 - protein, 30 aa, Mycobacterium
IVAGLVLLLLARPLSVVLSLIGFRVPWREQ

SEQ ID NO: 1139625 - protein, 23 aa, Mycobacterium
IVAITALLALVAIAFALPAARSG

SEQ ID NO: 1139626 - protein, 19 aa, Mycobacterium
IVAVNALMLKRLKVPAGKG

SEQ ID NO: 1139627 - protein, 19 aa, Mycobacterium
IVCLLLAYPLAYVIAFKAG

SEQ ID NO: 1139628 - protein, 20 aa, Mycobacterium
IVDIAFLFAAGLASALMILT

SEQ ID NO: 1139629 - protein, 22 aa, Mycobacterium
IVDIAFWCFIAGAVIMIVGGLM

SEQ ID NO: 1139630 - protein, 26 aa, Mycobacterium
IVFACFLYRAWNLPVAVLAGAAAGLA

SEQ ID NO: 1139631 - protein, 17 aa, Mycobacterium
IVFGFFTRKVWEIVVGV

SEQ ID NO: 1139632 - protein, 27 aa, Mycobacterium
IVFGLWGIFVLAPWLTPVATFLNDNLG

SEQ ID NO: 1139633 - protein, 18 aa, Mycobacterium
IVGLAFGVGLAVIRDLLD

SEQ ID NO: 1139634 - protein, 19 aa, Mycobacterium
IVGQCIIAVAFGAGLFIAF

SEQ ID NO: 1139635 - protein, 25 aa, Mycobacterium
IVGVAVMLFAYMQVPTLLGVGRLVV

SEQ ID NO: 1139636 - protein, 18 aa, Mycobacterium
IVGWALACSVPVVLVGAA

SEQ ID NO: 1139637 - protein, 19 aa, Mycobacterium
IVIGSAVVLVPIVLATIGV

SEQ ID NO: 1139638 - protein, 20 aa, Mycobacterium
IVLLGVTWFFYMRKGTRMAQ

SEQ ID NO: 1139639 - protein, 23 aa, Mycobacterium
IVLTTIFGFFWYSHGILGFHSLG

SEQ ID NO: 1139640 - protein, 17 aa, Mycobacterium
IVNDRPLIAPPTGLSAT

SEQ ID NO: 1139641 - protein, 25 aa, Mycobacterium
IVNNLPAVLLLLPLVAGVGPAAVLA

SEQ ID NO: 1139642 - protein, 26 aa, Mycobacterium
IVQPFGEYLPWRDFFSKLSPYADRAG

SEQ ID NO: 1139643 - protein, 19 aa, Mycobacterium
IVSMLFKLNIARGYLMIAL

SEQ ID NO: 1139644 - protein, 24 aa, Mycobacterium
IVSTVIALLALWRLDRLDGRRMHR

SEQ ID NO: 1139645 - protein, 23 aa, Mycobacterium
IVTLVPLAYLLSLAVRPAEDVLN

SEQ ID NO: 1139646 - protein, 33 aa, Mycobacterium
IVTTTVLMFLAFGSIVLPIKAALMSALTLGSTM

SEQ ID NO: 1139647 - protein, 18 aa, Mycobacterium
IVTVLAFALILWLHAADT

SEQ ID NO: 1139648 - protein, 28 aa, Mycobacterium
IVVPLLATQILWINLVTDSGPALAMGVD

SEQ ID NO: 1139649 - protein, 17 aa, Mycobacterium
IVVSYYWHFVDIVWIAL

SEQ ID NO: 1139650 - protein, 27 aa, Mycobacterium
IVVTNLLLGRPLIESALFGLAIAVGIT

SEQ ID NO: 1139651 - protein, 27 aa, Mycobacterium
IWEIGRPWYLAWAGLIYIVATLVTLAW

SEQ ID NO: 1139652 - protein, 17 aa, Mycobacterium
IWGVALFAALSALYFTV

SEQ ID NO: 1139653 - protein, 38 aa, Mycobacterium
IWRLAIFVTVCGLTLFGLYAVFGQWRFQAEKKYNAEFT

SEQ ID NO: 1139654 - protein, 17 aa, Mycobacterium
IWTPLLAITLNPLQQNL

SEQ ID NO: 1139655 - protein, 26 aa, Mycobacterium
IWVTSAYLLAYAVPLLVSGRLGDRYG

SEQ ID NO: 1139656 - protein, 27 aa, Mycobacterium
IYGRERLGPWWGFIAGWGFVVGKTASC

SEQ ID NO: 1139657 - protein, 20 aa, Mycobacterium
IYLLKREVVELRRAVGPLAT

SEQ ID NO: 1139658 - protein, 20 aa, Mycobacterium
IYPRYSCDYGTPRLPPSSAD

SEQ ID NO: 1139659 - protein, 24 aa, Mycobacterium
IYSVPVIYLSLRPALLSIGKSLEE

SEQ ID NO: 1139660 - protein, 25 aa, Mycobacterium
IYTDIFRGLPEVVIILLIGLGVGPV

SEQ ID NO: 1139661 - protein, 30 aa, Mycobacterium
IYYGLPPLLILALRILFLALTIGSLVLLYR

SEQ ID NO: 1139662 - protein, 21 aa, Mycobacterium
KAPRLVRRFIRNQAAKTLPEG

SEQ ID NO: 1139663 - protein, 30 aa, Mycobacterium
KAQEDLNALFLPPAPAAPAAPPPPGNSLNG

SEQ ID NO: 1139664 - protein, 24 aa, Mycobacterium
KARARAARLRRQALAADVAAKPEV

SEQ ID NO: 1139665 - protein, 18 aa, Mycobacterium
KAWKSLVSADWLWVLAAA

SEQ ID NO: 1139666 - protein, 25 aa, Mycobacterium
KCLCRKHHLLKTFWTGENGWRDEQF

SEQ ID NO: 1139667 - protein, 35 aa, Mycobacterium
KDLAINCGYPLIERFPLMFFTSAAVLLIGMGRWYL

SEQ ID NO: 1139668 - protein, 30 aa, Mycobacterium
KDNILTHLRKGLMGWLFGALAEGGVELPDT

SEQ ID NO: 1139669 - protein, 25 aa, Mycobacterium
KEDKRLLPYMIGAFVLIVAASVAVG

SEQ ID NO: 1139670 - protein, 20 aa, Mycobacterium
KFVTALFFDLGVYLIVVGLV

SEQ ID NO: 1139671 - protein, 31 aa, Mycobacterium
KGFGDTWPGDLGERPALWIPASGVSAARLEA

SEQ ID NO: 1139672 - protein, 21 aa, Mycobacterium
KGGRFRCTFGFTFDVTEGQDR

SEQ ID NO: 1139673 - protein, 19 aa, Mycobacterium
KGHPGFLTTYYFSPEDITT

SEQ ID NO: 1139674 - protein, 24 aa, Mycobacterium
KGMRVALLMPNGVAWARIALALMR

SEQ ID NO: 1139675 - protein, 17 aa, Mycobacterium
KGRSFRIHLLFASQTLD

SEQ ID NO: 1139676 - protein, 18 aa, Mycobacterium
KGVALTVLYLGIAMLFAM

SEQ ID NO: 1139677 - protein, 23 aa, Mycobacterium
KGVGWLLFVLPIAAILTQYTITG

SEQ ID NO: 1139678 - protein, 19 aa, Mycobacterium
KHGFFVRLYTGTGAFEVMG

SEQ ID NO: 1139679 - protein, 17 aa, Mycobacterium
KHHLYVVSGQRGGSDSS

SEQ ID NO: 1139680 - protein, 17 aa, Mycobacterium
KHPWRWLAAAAIIVLVG

SEQ ID NO: 1139681 - protein, 17 aa, Mycobacterium
KIGIKLVILLILGGLLG

SEQ ID NO: 1139682 - protein, 21 aa, Mycobacterium
KIHYFRLEAGLIVYEICVTAQ

SEQ ID NO: 1139683 - protein, 34 aa, Mycobacterium
KIQLFVLLCGIVGPIFLVIYFATGADPMMRWMFW

SEQ ID NO: 1139684 - protein, 27 aa, Mycobacterium
KIVQPFGEYLPWRGFFRHFSGYADRAG

SEQ ID NO: 1139685 - protein, 27 aa, Mycobacterium
KKELWFAWWVMVVFYQLYGVLFFLVTR

SEQ ID NO: 1139686 - protein, 24 aa, Mycobacterium
KKRRRRPWIAGAAAAVVVIAGGVT

SEQ ID NO: 1139687 - protein, 27 aa, Mycobacterium
KLAITAGIGLFILFIGLVDAGFISSTG

SEQ ID NO: 1139688 - protein, 22 aa, Mycobacterium
KLALDGLVVPTIEWAKETLGRV

SEQ ID NO: 1139689 - protein, 37 aa, Mycobacterium
KLEIARGYLMIALPAGLLFLGFFRWVARQMVARAREK

SEQ ID NO: 1139690 - protein, 40 aa, Mycobacterium
KLFGSDPLLFPFQPIHVTIAAWFTIGIPAFVLSLAPNNER

SEQ ID NO: 1139691 - protein, 26 aa, Mycobacterium
KLGAFSLVLLMFTAIIIVVFGQMRFD

SEQ ID NO: 1139692 - protein, 29 aa, Mycobacterium
KLIATGGVAALWQMLIEKLGDIKEMILEQ

SEQ ID NO: 1139693 - protein, 36 aa, Mycobacterium
KLNIARGYLMIALPIGLVALILFRWIARRVVASVRE

SEQ ID NO: 1139694 - protein, 37 aa, Mycobacterium
KLNIARGYLMIALPIGLVALILFRWIARRVVASVREK

SEQ ID NO: 1139695 - protein, 19 aa, Mycobacterium
KLSVLSLPTTFIFDADGRQ

SEQ ID NO: 1139696 - protein, 24 aa, Mycobacterium
KLTKPVWLVILGVGVLLALVLGIT

SEQ ID NO: 1139697 - protein, 26 aa, Mycobacterium
KLTPAVFLLYFLLRRDVRALLVTAAS

SEQ ID NO: 1139698 - protein, 18 aa, Mycobacterium
KLTRLHRAGLLIGACAVA

SEQ ID NO: 1139699 - protein, 26 aa, Mycobacterium
KLVAAVALGVLALALAAVTTLVGVWS

SEQ ID NO: 1139700 - protein, 24 aa, Mycobacterium
KLVLIACLAMVFAIQNATARQFGV

SEQ ID NO: 1139701 - protein, 17 aa, Mycobacterium
KMVAGLVLLYLFLPIFV

SEQ ID NO: 1139702 - protein, 19 aa, Mycobacterium
KPEVGLPKPAVELPKPAVE

SEQ ID NO: 1139703 - protein, 20 aa, Mycobacterium
KPFRLMVMLMLITAFASPVL

SEQ ID NO: 1139704 - protein, 17 aa, Mycobacterium
KPLRQLTVLSALTLAAV

SEQ ID NO: 1139705 - protein, 20 aa, Mycobacterium
KPPLLALFFGTVAFGIMIIG

SEQ ID NO: 1139706 - protein, 25 aa, Mycobacterium
KPPLSLAPIGGILSHVPFKSGEVTL

SEQ ID NO: 1139707 - protein, 25 aa, Mycobacterium
KPPSWASWLRIVIGAALIVFGLVRF

SEQ ID NO: 1139708 - protein, 23 aa, Mycobacterium
KPVNKAIDFVIKQGLKLAGPIIR

SEQ ID NO: 1139709 - protein, 23 aa, Mycobacterium
KPVQVLFVIGFLASFLALQTSAS

SEQ ID NO: 1139710 - protein, 17 aa, Mycobacterium
KPWVAHFNLLVAAALAP

SEQ ID NO: 1139711 - protein, 28 aa, Mycobacterium
KQRISAFVLPRGLITVRLSNGFDIDEVS

SEQ ID NO: 1139712 - protein, 44 aa, Mycobacterium
KRAERTVAYWFLLAGFSGLALLLIFLFWPWEYKPFGDEGEFLYS

SEQ ID NO: 1139713 - protein, 20 aa, Mycobacterium
KRAISRLLALIRNTWRTLTS

SEQ ID NO: 1139714 - protein, 38 aa, Mycobacterium
KRDGKWARLTAFVLLPALALVLALGAGYLKWQDTTFRS

SEQ ID NO: 1139715 - protein, 19 aa, Mycobacterium
KREIISRCYNLILKSTLSA

SEQ ID NO: 1139716 - protein, 22 aa, Mycobacterium
KRFDTFAAATYVSGPSSSYVTA

SEQ ID NO: 1139717 - protein, 18 aa, Mycobacterium
KRGRIAMLLFALSQFVIA

SEQ ID NO: 1139718 - protein, 22 aa, Mycobacterium
KRGRKRLLWAVVVAVVVATLVG

SEQ ID NO: 1139719 - protein, 36 aa, Mycobacterium
KRHTIDEWLRLDPVLPLLAAPIALSALLIQRLRPYA

SEQ ID NO: 1139720 - protein, 17 aa, Mycobacterium
KRITMNFPPLLAHPINS

SEQ ID NO: 1139721 - protein, 27 aa, Mycobacterium
KRKITGSLLFLFILGDVLGAGIYALMG

SEQ ID NO: 1139722 - protein, 26 aa, Mycobacterium
KRLGRPVAVKLLYPSVSAHPDTRRRF

SEQ ID NO: 1139723 - protein, 18 aa, Mycobacterium
KRLILWAAVLTLANVLAD

SEQ ID NO: 1139724 - protein, 32 aa, Mycobacterium
KRMELLALPLVAIVLFFVFGGVVAATLPVLVG

SEQ ID NO: 1139725 - protein, 25 aa, Mycobacterium
KRPFTPVLGFPMLALVIAAQALRWW

SEQ ID NO: 1139726 - protein, 27 aa, Mycobacterium
KRRWALRLGVFFTLSTVLWVGVTALLA

SEQ ID NO: 1139727 - protein, 21 aa, Mycobacterium
KRVWLPVLVIAAVAVGAVTVA

SEQ ID NO: 1139728 - protein, 29 aa, Mycobacterium
KSAGVARWWRLLVIAAMGSWLVAEMVWFF

SEQ ID NO: 1139729 - protein, 18 aa, Mycobacterium
KSEFLRTLILSLAATHHP

SEQ ID NO: 1139730 - protein, 19 aa, Mycobacterium
KSILFLLEANPGPGLGLLL

SEQ ID NO: 1139731 - protein, 22 aa, Mycobacterium
KSQTLMAILLSLLTTHPADRLI

SEQ ID NO: 1139732 - protein, 32 aa, Mycobacterium
KSTFPILMEGLRLTLILTVVSIAIALVLGVMF

SEQ ID NO: 1139733 - protein, 23 aa, Mycobacterium
KSTLAWIMAGLTVPTVGACLLDG

SEQ ID NO: 1139734 - protein, 29 aa, Mycobacterium
KSWVITAYVLAFGGLLLLGGRIGDAVGHK

SEQ ID NO: 1139735 - protein, 19 aa, Mycobacterium
KTFKLLAVFMPGVKLVGNL

SEQ ID NO: 1139736 - protein, 18 aa, Mycobacterium
KTFLNPTDLMWSFGQCIA

SEQ ID NO: 1139737 - protein, 35 aa, Mycobacterium
KTPSTSLFRRMFLINGLIFTLGTLALALSPASVSS

SEQ ID NO: 1139738 - protein, 23 aa, Mycobacterium
KTPVGAMGLLAEALLASADDPET

SEQ ID NO: 1139739 - protein, 22 aa, Mycobacterium
KTQVTVLRRLVVALVVVLGAAA

SEQ ID NO: 1139740 - protein, 19 aa, Mycobacterium
KTRIFILVLAVVCVAVLAV

SEQ ID NO: 1139741 - protein, 21 aa, Mycobacterium
KTVTGFFTGTLSYTAPEVLSG

SEQ ID NO: 1139742 - protein, 23 aa, Mycobacterium
KTVTGFFTGTLSYTAPEVLTGKP

SEQ ID NO: 1139743 - protein, 31 aa, Mycobacterium
KVAAIGFCMGGGLVWRLLAAGSPELAAAFPF

SEQ ID NO: 1139744 - protein, 28 aa, Mycobacterium
KVFAGQWPILLVGLFLVAAFILVAAGYW

SEQ ID NO: 1139745 - protein, 32 aa, Mycobacterium
KVFPARLAFHLVRLYNLAFIVSTYALSRKAPR

SEQ ID NO: 1139746 - protein, 24 aa, Mycobacterium
KVGGLAFLYFLVMSTFALAIGLVV

SEQ ID NO: 1139747 - protein, 22 aa, Mycobacterium
KVGLRRWLDGLPDGLSTVLVGG

SEQ ID NO: 1139748 - protein, 25 aa, Mycobacterium
KVLFDWRFDLIFGTAAIVFALVYLA

SEQ ID NO: 1139749 - protein, 24 aa, Mycobacterium
KVLKRLGTVLLIVGGLGVAVAAIA

SEQ ID NO: 1139750 - protein, 25 aa, Mycobacterium
KVNFADIWRRADLPRDGRAPVLLQV

SEQ ID NO: 1139751 - protein, 20 aa, Mycobacterium
KVPTVWLLLDSQDGVPRGAT

SEQ ID NO: 1139752 - protein, 39 aa, Mycobacterium; identical to SEQ ID NO: 1124906

SEQ ID NO: 1139753 - protein, 20 aa, Mycobacterium
KVTTMPALLMAIPIGAITTI

SEQ ID NO: 1139754 - protein, 19 aa, Mycobacterium
KWEPFLTPNLWTTYVLPGV

SEQ ID NO: 1139755 - protein, 19 aa, Mycobacterium
KYTAQFLQAAALQPGNPVT

SEQ ID NO: 1139756 - protein, 17 aa, Mycobacterium
LAAAILFASALQASIGF

SEQ ID NO: 1139757 - protein, 36 aa, Mycobacterium
LAAALFTLRWELVAFVAPMLGVLCSVGWQPRPPGVS

SEQ ID NO: 1139758 - protein, 27 aa, Mycobacterium
LAAAPQLVALLLARRRHWPAYLVTFAF

SEQ ID NO: 1139759 - protein, 26 aa, Mycobacterium
LAAAVAIEVIWWVQGRVLGEHRRLWR

SEQ ID NO: 1139760 - protein, 21 aa, Mycobacterium
LAAAVLYFLAVGQVKGFAFTL

SEQ ID NO: 1139761 - protein, 18 aa, Mycobacterium
LAAAWYIDFAPAALIDGF

SEQ ID NO: 1139762 - protein, 29 aa, Mycobacterium
LAAESGWVGLLGWMVVILGFLTITVLGNL

SEQ ID NO: 1139763 - protein, 23 aa, Mycobacterium
LAAEVLAVFALKKIAPENAFGAL

SEQ ID NO: 1139764 - protein, 25 aa, Mycobacterium
LAAFAVVCWWVFFEKGLASAAHDAF

SEQ ID NO: 1139765 - protein, 28 aa, Mycobacterium
LAAGLIFIWALILGVWKYRQMATSPDHL

SEQ ID NO: 1139766 - protein, 24 aa, Mycobacterium
LAAIRTWLLIYALVMGVGAGVFGA

SEQ ID NO: 1139767 - protein, 26 aa, Mycobacterium
LAALGWSIYALFWGTAGIPGMTHPFE

SEQ ID NO: 1139768 - protein, 30 aa, Mycobacterium
LAALLPVPAIVPILLYIGLLIGAQAFQAVP

SEQ ID NO: 1139769 - protein, 20 aa, Mycobacterium
LAALPLWTWLATVLLCMVFK

SEQ ID NO: 1139770 - protein, 20 aa, Mycobacterium
LAARFINWAAQRITRRIDAE

SEQ ID NO: 1139771 - protein, 30 aa, Mycobacterium
LAARPHAVLWSQWRFAFEPMFVVAVSTLLR

SEQ ID NO: 1139772 - protein, 24 aa, Mycobacterium
LAASFLDWDLYKQAIPDLFKTGLP

SEQ ID NO: 1139773 - protein, 24 aa, Mycobacterium
LAASMIAALPWLVASAVGGGWAAA

SEQ ID NO: 1139774 - protein, 28 aa, Mycobacterium
LAATYFLVTPLIVLIGTAVAMALPGQRD

SEQ ID NO: 1139775 - protein, 26 aa, Mycobacterium
LAAVDLFLVVQINIAVPLAIRILLHA

SEQ ID NO: 1139776 - protein, 22 aa, Mycobacterium
LAAVVLLLIGPRFIDTYVNWLW

SEQ ID NO: 1139777 - protein, 23 aa, Mycobacterium
LAAVVLLLIGPRFIDTYVNWLWF

SEQ ID NO: 1139778 - protein, 35 aa, Mycobacterium
LAAVVVSSIGMWLIRRRLMRQTHGLRPDELRVMYE

SEQ ID NO: 1139779 - protein, 25 aa, Mycobacterium
LAAYGFLTMDRWLLWQLPTTGRALE

SEQ ID NO: 1139780 - protein, 26 aa, Mycobacterium
LACPVWLYQLWAFITPGLYAKERRFA

SEQ ID NO: 1139781 - protein, 37 aa, Mycobacterium
LADATLIRMLLVPAFMHLMGRWNWWAPKPLARLHERF

SEQ ID NO: 1139782 - protein, 37 aa, Mycobacterium
LADATLVRMLLVPAFMHVLGRWNWWAPKPLARLHERI

SEQ ID NO: 1139783 - protein, 26 aa, Mycobacterium
LAENGGRTWLLWDGKRSPIDLADRAV

SEQ ID NO: 1139784 - protein, 30 aa, Mycobacterium
LAFAAYFLRTYLLLIAISAVLAYLFTPLNN

SEQ ID NO: 1139785 - protein, 26 aa, Mycobacterium
LAFGWGLLGIWAGLSAFMVLRLVFVG

SEQ ID NO: 1139786 - protein, 25 aa, Mycobacterium
LAFSNGILFLAFGAIAFVVAFQAEV

SEQ ID NO: 1139787 - protein, 18 aa, Mycobacterium
LAFYLAFVAELPPPPPKP

SEQ ID NO: 1139788 - protein, 19 aa, Mycobacterium
LAGAIFGQIWKRIGENDAE

SEQ ID NO: 1139789 - protein, 24 aa, Mycobacterium
LAGAPSLIAPAWAGAQPDGGSNTR

SEQ ID NO: 1139790 - protein, 23 aa, Mycobacterium
LAGAWIAILAMSALFGLMKLIHK

SEQ ID NO: 1139791 - protein, 34 aa, Mycobacterium
LAGDGLIFLLLCGLSFYLWWRAQQQKVDHSNVNA

SEQ ID NO: 1139792 - protein, 17 aa, Mycobacterium
LAGLAPEFATAALTAGA

SEQ ID NO: 1139793 - protein, 25 aa, Mycobacterium
LAGLSLAVLWLKRWPTRTESVLFAA

SEQ ID NO: 1139794 - protein, 26 aa, Mycobacterium
LAGNRWSWFYRHLFDLAIVVLPLLRP

SEQ ID NO: 1139795 - protein, 21 aa, Mycobacterium
LAGYFLLRLFNFTLASVAAPA

SEQ ID NO: 1139796 - protein, 25 aa, Mycobacterium
LAHYRLDGEQWPAFSLQTVVAVKYA

SEQ ID NO: 1139797 - protein, 18 aa, Mycobacterium
LAIMFLFGTVFTLIEGPV

SEQ ID NO: 1139798 - protein, 27 aa, Mycobacterium
LAIPLSFLVLVWVFGGLVAAALPVAIG

SEQ ID NO: 1139799 - protein, 17 aa, Mycobacterium
LAIPYPGPGWAIVFIGL

SEQ ID NO: 1139800 - protein, 26 aa, Mycobacterium
LAITAGIGLFILFIGLVDAGFVSSTG

SEQ ID NO: 1139801 - protein, 33 aa, Mycobacterium
LAIVTYVISLFFWPTPAVPLVGAVLIPVAIRAG

SEQ ID NO: 1139802 - protein, 20 aa, Mycobacterium
LALAAVALLALVFGIARLET

SEQ ID NO: 1139803 - protein, 26 aa, Mycobacterium
LALARRARRLVIANLTIAATLITVLV

SEQ ID NO: 1139804 - protein, 33 aa, Mycobacterium
LALARYVPLARRPIVWWLHWLAEKTQKTKTRAE

SEQ ID NO: 1139805 - protein, 21 aa, Mycobacterium
LALAWWQWTRYESTSGSFQNL

SEQ ID NO: 1139806 - protein, 21 aa, Mycobacterium
LALDPIRFKYAKTALTVLLLA

SEQ ID NO: 1139807 - protein, 29 aa, Mycobacterium
LALENLYALFRSLMILGVVVIAVVTNSVK

SEQ ID NO: 1139808 - protein, 17 aa, Mycobacterium
LALGLTALNLCVIAVLV

SEQ ID NO: 1139809 - protein, 18 aa, Mycobacterium
LALGWHLVASIGGGDMPV

SEQ ID NO: 1139810 - protein, 24 aa, Mycobacterium
LALIVRFTTWGRQFWRVTRGYFTG

SEQ ID NO: 1139811 - protein, 50 aa, Mycobacterium
LALLRALYVILGWRPVLLVPLTFALFTPLAVPGFAWWAAGLNSLPMLAAM

SEQ ID NO: 1139812 - protein, 20 aa, Mycobacterium
LALLVLALGYRRSRQITDSP

SEQ ID NO: 1139813 - protein, 26 aa, Mycobacterium
LALMVPNLIALIGWVLALSGIQTQVR

SEQ ID NO: 1139814 - protein, 17 aa, Mycobacterium
LALSGFFFGGRLLRMLL

SEQ ID NO: 1139815 - protein, 26 aa, Mycobacterium
LALSVLSFFWLWWTTNMLSAHLAGAT

SEQ ID NO: 1139816 - protein, 17 aa, Mycobacterium
LALWCFAAMAVSGFVNA

SEQ ID NO: 1139817 - protein, 17 aa, Mycobacterium
LALYLLGWVMIGISRVH

SEQ ID NO: 1139818 - protein, 19 aa, Mycobacterium
LAMPFTLVGALGGLALVLI

SEQ ID NO: 1139819 - protein, 25 aa, Mycobacterium
LAMVFGRFLPIILALALAGSLAQQG

SEQ ID NO: 1139820 - protein, 25 aa, Mycobacterium
LANLLSKPVLVGYLFGIAIAMVTGQ

SEQ ID NO: 1139821 - protein, 22 aa, Mycobacterium
LANPAHYFILIGLFGIFVAGCT

SEQ ID NO: 1139822 - protein, 26 aa, Mycobacterium
LANTRVLLTVFVIAVAMVGTVVFLSV

SEQ ID NO: 1139823 - protein, 17 aa, Mycobacterium
LAPIALHWSLNGMGALA

SEQ ID NO: 1139824 - protein, 29 aa, Mycobacterium
LAPKRLGMQYARRWAALVAPVLRALAIAA

SEQ ID NO: 1139825 - protein, 24 aa, Mycobacterium
LAPMAAIAFLWFIGVMRDVLGDFE

SEQ ID NO: 1139826 - protein, 30 aa, Mycobacterium
LAPTVWGWRKVPVWRWFVLGAGVGVAGAWV

SEQ ID NO: 1139827 - protein, 18 aa, Mycobacterium
LAPVLTVAVLLRGLDALR

SEQ ID NO: 1139828 - protein, 23 aa, Mycobacterium
LAQRWRSQVPTIAAVTLAAVVVS

SEQ ID NO: 1139829 - protein, 38 aa, Mycobacterium
LARAGFIGVVLIILVIAVGLQPERLLSWATAIRYQALF

SEQ ID NO: 1139830 - protein, 29 aa, Mycobacterium
LARFRRSELVLALLTTFAVAVFGVLYGVL

SEQ ID NO: 1139831 - protein, 30 aa, Mycobacterium
LARVGSYGAFFPYYICGITFRASDLEGRTV

SEQ ID NO: 1139832 - protein, 36 aa, Mycobacterium; identical to SEQ ID NO: 360435

SEQ ID NO: 1139833 - protein, 39 aa, Mycobacterium
LASIELDPRRLIARVPFVVLVIGALGLGLGVTLWLSTDA

SEQ ID NO: 1139834 - protein, 17 aa, Mycobacterium
LASLLPDATQPADAELL

SEQ ID NO: 1139835 - protein, 22 aa, Mycobacterium
LASYLLIGFWSHKPSAATAAKK

SEQ ID NO: 1139836 - protein, 25 aa, Mycobacterium
LATLNRLRITLNCPMLAMAFAFLVY

SEQ ID NO: 1139837 - protein, 40 aa, Mycobacterium
LATLPDAYRVLGRQGIYGDFFAFYLCDLVLKVNGKGGQPV

SEQ ID NO: 1139838 - protein, 19 aa, Mycobacterium
LATLWLWFTLNGYRQARRR

SEQ ID NO: 1139839 - protein, 20 aa, Mycobacterium
LATRLTMITLIPIVAMMTVG

SEQ ID NO: 1139840 - protein, 37 aa, Mycobacterium
LAVAAPVAMLLLMLGRRWILTLVAVALTVALMWVHVP

SEQ ID NO: 1139841 - protein, 18 aa, Mycobacterium
LAVALHFSSLPGLIAAAV

SEQ ID NO: 1139842 - protein, 31 aa, Mycobacterium
LAVCVLLLRRLPILLLLRRPLRLSVPDALYL

SEQ ID NO: 1139843 - protein, 30 aa, Mycobacterium
LAVEEQFYVLWPLLIAAVLAGLAALAYRRG

SEQ ID NO: 1139844 - protein, 20 aa, Mycobacterium
LAVFIPVTVLLFTGWALLAA

SEQ ID NO: 1139845 - protein, 18 aa, Mycobacterium
LAVFNLLPGAPLDGGRIL

SEQ ID NO: 1139846 - protein, 28 aa, Mycobacterium
LAVFRQMRPWWLPVVYLTMLAVYVVPRL

SEQ ID NO: 1139847 - protein, 20 aa, Mycobacterium
LAVGLIVGLAFGVGLAVIRD

SEQ ID NO: 1139848 - protein, 24 aa, Mycobacterium
LAVGVNILWTGYRLLRGSMSSLLS

SEQ ID NO: 1139849 - protein, 17 aa, Mycobacterium
LAVISWSATLFFQLQAH

SEQ ID NO: 1139850 - protein, 20 aa, Mycobacterium
LAVKRWMGLFALAIPFTLFF

SEQ ID NO: 1139851 - protein, 20 aa, Mycobacterium
LAVLPLVWHQAALAAIRGPP

SEQ ID NO: 1139852 - protein, 21 aa, Mycobacterium
LAVMGILVLAGAFAGAILMNR

SEQ ID NO: 1139853 - protein, 28 aa, Mycobacterium
LAVPGVGVLALLAWLRVRVPEPARYEVE

SEQ ID NO: 1139854 - protein, 18 aa, Mycobacterium
LAVRGWPLRVLAVLVAAA

SEQ ID NO: 1139855 - protein, 19 aa, Mycobacterium
LAVSAAVWLLTELVRMVVV

SEQ ID NO: 1139856 - protein, 26 aa, Mycobacterium
LAVSIPLTVLLIFTLNILLAEFGAAD

SEQ ID NO: 1139857 - protein, 21 aa, Mycobacterium
LAVSLFYLLAQMAGAGVLVAL

SEQ ID NO: 1139858 - protein, 30 aa, Mycobacterium
LAVVCTSLAFILFFALIREVGAPRALVITY

SEQ ID NO: 1139859 - protein, 21 aa, Mycobacterium
LAWPVLIAVFAVISMTLGNLA

SEQ ID NO: 1139860 - protein, 28 aa, Mycobacterium
LCAQYLGPILDAIKFNYLPFGANQLQTA

SEQ ID NO: 1139861 - protein, 54 aa, Mycobacterium
LCAVVWLLCHRPNRTWWRFVAWWLPCVALAVTWWVVALLHLGRISPPFLDFIES

SEQ ID NO: 1139862 - protein, 17 aa, Mycobacterium
LCFRYWPQLAACYLLGL

SEQ ID NO: 1139863 - protein, 17 aa, Mycobacterium
LCIFIVASGTASAFLMA

SEQ ID NO: 1139864 - protein, 23 aa, Mycobacterium
LCRVLSKVLRLVGRPNPPLASVS

SEQ ID NO: 1139865 - protein, 27 aa, Mycobacterium
LDAAGEPFFWMADTAWSLPINLTRDEV

SEQ ID NO: 1139866 - protein, 25 aa, Mycobacterium
LDAGIPYFPNLVLPITIGGFGIGMI

SEQ ID NO: 1139867 - protein, 24 aa, Mycobacterium
LDAPLNWFPLYLGAALVVEILALT

SEQ ID NO: 1139868 - protein, 22 aa, Mycobacterium
LDDALRWIDVFGVALLAGIGFT

SEQ ID NO: 1139869 - protein, 19 aa, Mycobacterium
LDDQIWIAGGIREGETLDT

SEQ ID NO: 1139870 - protein, 24 aa, Mycobacterium
LDEGKQLWRRVQSAVSMLLGGNTG

SEQ ID NO: 1139871 - protein, 25 aa, Mycobacterium
LDEGQQLWRRVQSAVSMLLGGNTGE

SEQ ID NO: 1139872 - protein, 24 aa, Mycobacterium
LDEPSWPGPLPPPVASYQPTDQGV

SEQ ID NO: 1139873 - protein, 22 aa, Mycobacterium
LDGLGLQGWGGLRLALPLGDDS

SEQ ID NO: 1139874 - protein, 30 aa, Mycobacterium
LDGLRVYFTTYLPSLFLAAVLTPATAVVIA

SEQ ID NO: 1139875 - protein, 26 aa, Mycobacterium
LDHQIPPLLWVAVIPAVLSVALVFCV

SEQ ID NO: 1139876 - protein, 27 aa, Mycobacterium
LDHQIPPLLWVAVIPAVLSVALVFCVR

SEQ ID NO: 1139877 - protein, 19 aa, Mycobacterium
LDLDAVIGGFRPLLNALDP

SEQ ID NO: 1139878 - protein, 17 aa, Mycobacterium
LDPNMLWKSLPSALRKL

SEQ ID NO: 1139879 - protein, 24 aa, Mycobacterium
LDPQQWWPKVAWLAQRPVLIPGTV

SEQ ID NO: 1139880 - protein, 22 aa, Mycobacterium
LDQVLLWAALLTMVVGVLGAIA

SEQ ID NO: 1139881 - protein, 23 aa, Mycobacterium
LDRIGPRRVLRTGLLLMAAGQVG

SEQ ID NO: 1139882 - protein, 20 aa, Mycobacterium
LDRLTLFVTGIWIVSIVGMA

SEQ ID NO: 1139883 - protein, 42 aa, Mycobacterium
LDSHILLSVVLPPLLYSAALDFSFPTFLRNIKPILGLGVGLV

SEQ ID NO: 1139884 - protein, 25 aa, Mycobacterium
LDSSRLPIVAALVAGVLALVVILLA

SEQ ID NO: 1139885 - protein, 17 aa, Mycobacterium
LDTLIVRSFVVPCLLRI

SEQ ID NO: 1139886 - protein, 18 aa, Mycobacterium
LECNFGRVGALLFWIALA

SEQ ID NO: 1139887 - protein, 24 aa, Mycobacterium
LEDALAVPVFSPDAAQLALARGAA

SEQ ID NO: 1139888 - protein, 20 aa, Mycobacterium
LEEMLQRPLAGVLAALDAAL

SEQ ID NO: 1139889 - protein, 18 aa, Mycobacterium
LEHLIESGDYRAIATMWG

SEQ ID NO: 1139890 - protein, 27 aa, Mycobacterium
LEHPVGGWVLFAVLIGWSAACATAYLQ

SEQ ID NO: 1139891 - protein, 18 aa, Mycobacterium
LEKPFGLVGIPDAVLHTV

SEQ ID NO: 1139892 - protein, 17 aa, Mycobacterium
LELFGRLLRDGRWWVGS

SEQ ID NO: 1139893 - protein, 17 aa, Mycobacterium
LELLGAVGLLYPPTRAA

SEQ ID NO: 1139894 - protein, 23 aa, Mycobacterium
LELLLILALRIPLRAVLIRGALL

SEQ ID NO: 1139895 - protein, 24 aa, Mycobacterium
LEPRKLMRRVIAPQAFRSMVPALG

SEQ ID NO: 1139896 - protein, 17 aa, Mycobacterium
LERHFPISQSIPQYILV

SEQ ID NO: 1139897 - protein, 29 aa, Mycobacterium
LERHFPISQSIPQYILVQSPRDLRTPQAL

SEQ ID NO: 1139898 - protein, 25 aa, Mycobacterium
LERRHPFALAIGFLAFGMALRYGVV

SEQ ID NO: 1139899 - protein, 24 aa, Mycobacterium
LERYDKMLFLVLKTVTYVEHDSIA

SEQ ID NO: 1139900 - protein, 22 aa, Mycobacterium
LESGRVFDRLRTELRALAAHTD

SEQ ID NO: 1139901 - protein, 18 aa, Mycobacterium
LEVLFFRWLLDGNRSHEW

SEQ ID NO: 1139902 - protein, 19 aa, Mycobacterium
LEVVVVVVAALMAMAYRRD

SEQ ID NO: 1139903 - protein, 18 aa, Mycobacterium
LFDRLRADHPLLFEIRSL

SEQ ID NO: 1139904 - protein, 19 aa, Mycobacterium
LFGIGLGVAMWVLLNGANP

SEQ ID NO: 1139905 - protein, 20 aa, Mycobacterium
LFGILGLFVTIPAALLWVQI

SEQ ID NO: 1139906 - protein, 26 aa, Mycobacterium
LFGITDGWWVYLAAYAIFIGIHLSGV

SEQ ID NO: 1139907 - protein, 17 aa, Mycobacterium
LFGPELWQWVDPENVSR

SEQ ID NO: 1139908 - protein, 25 aa, Mycobacterium
LFKLTPWIVVGLFALGAAMALYFKF

SEQ ID NO: 1139909 - protein, 26 aa, Mycobacterium
LFLAPALTVVFLLLPLDLPPQQQTLA

SEQ ID NO: 1139910 - protein, 20 aa, Mycobacterium
LFTFAIVMGTLWLLGALAFV

SEQ ID NO: 1139911 - protein, 20 aa, Mycobacterium
LFTLDLAAFLGLSGTVWLSA

SEQ ID NO: 1139912 - protein, 20 aa, Mycobacterium
LFVIGRLNDVIVIRGVNYYP

SEQ ID NO: 1139913 - protein, 30 aa, Mycobacterium
LFVWELARPPLWLLLVFAVGAYAAYGLAAL

SEQ ID NO: 1139914 - protein, 23 aa, Mycobacterium
LGAAVAYALWRKRWRLAAVTALC

SEQ ID NO: 1139915 - protein, 36 aa, Mycobacterium; identical to SEQ ID NO: 360871

SEQ ID NO: 1139916 - protein, 22 aa, Mycobacterium
LGALGPRWLVVVGVSCFSLVVS

SEQ ID NO: 1139917 - protein, 32 aa, Mycobacterium
LGAMAYSLYLWHWPLLIFYLAHTGNSRVTFVE

SEQ ID NO: 1139918 - protein, 23 aa, Mycobacterium
LGAMLIVVLLFAPKVWVGVVSVA

SEQ ID NO: 1139919 - protein, 20 aa, Mycobacterium
LGAPALWLSIPIATLVYSVG

SEQ ID NO: 1139920 - protein, 25 aa, Mycobacterium
LGAQWWQTFWRITLPSIRWGLTYGI

SEQ ID NO: 1139921 - protein, 44 aa, Mycobacterium; identical to SEQ ID NO: 360896

SEQ ID NO: 1139922 - protein, 24 aa, Mycobacterium
LGAVFVHWLIFQSLYRIGALCPYC

SEQ ID NO: 1139923 - protein, 28 aa, Mycobacterium
LGDLSYALYLVHWPVIVLLAVVMAPNVY

SEQ ID NO: 1139924 - protein, 28 aa, Mycobacterium
LGDNDNFWFSWIVPLAAIIFAGAFTDYY

SEQ ID NO: 1139925 - protein, 22 aa, Mycobacterium
LGEFLEALQIVPSPAPPPGPAI

SEQ ID NO: 1139926 - protein, 19 aa, Mycobacterium
LGFGGMSEVHLARDLRLHR

SEQ ID NO: 1139927 - protein, 32 aa, Mycobacterium
LGFLVVHAGLAWWWAPVFAAVIYAGSLEFLMV

SEQ ID NO: 1139928 - protein, 30 aa, Mycobacterium
LGFYMLMPYLAGYLAGPLGLAAWAVGLVLG

SEQ ID NO: 1139929 - protein, 20 aa, Mycobacterium
LGGFLWATVGGAIAWLLLLV

SEQ ID NO: 1139930 - protein, 30 aa, Mycobacterium
LGGLTLPRALFWIVIVYVLVATIVAFAIGR

SEQ ID NO: 1139931 - protein, 27 aa, Mycobacterium
LGGVVSMSLTLLREWYARPGSTVLAVN

SEQ ID NO: 1139932 - protein, 21 aa, Mycobacterium
LGGVWLTSFLIVAANTAVAGV

SEQ ID NO: 1139933 - protein, 22 aa, Mycobacterium
LGGYFFSIFIQGVNPGAFAAGI

SEQ ID NO: 1139934 - protein, 27 aa, Mycobacterium
LGHVALAFPFFLWPVDGAMAAAGVRNL

SEQ ID NO: 1139935 - protein, 23 aa, Mycobacterium
LGIAAIIFLQQVPAAFSATSPPG

SEQ ID NO: 1139936 - protein, 36 aa, Mycobacterium
LGIGTVGLWLESLWIGAVYPYPWPTSIWPEALAMSV

SEQ ID NO: 1139937 - protein, 19 aa, Mycobacterium
LGILARRLPIQDLLGFVSQ

SEQ ID NO: 1139938 - protein, 34 aa, Mycobacterium
LGINYIVWRWFGSINWAAWWIAVPLVIAETYSVI

SEQ ID NO: 1139939 - protein, 25 aa, Mycobacterium
LGIPSFVVTLAFFLGLQGVTLKLIG

SEQ ID NO: 1139940 - protein, 18 aa, Mycobacterium
LGIWLFAPLRRRANESIA

SEQ ID NO: 1139941 - protein, 18 aa, Mycobacterium
LGLAHLLGRIPLPGSVPR

SEQ ID NO: 1139942 - protein, 22 aa, Mycobacterium
LGLAVAFYYGITAFACVWYFRR

SEQ ID NO: 1139943 - protein, 27 aa, Mycobacterium
LGLAWMLAISIWLFGMSAPIEGDFAPV

SEQ ID NO: 1139944 - protein, 18 aa, Mycobacterium
LGLLMADWLADRGARRVV

SEQ ID NO: 1139945 - protein, 20 aa, Mycobacterium
LGLLMAFWSWVGFESTAIYG

SEQ ID NO: 1139946 - protein, 17 aa, Mycobacterium
LGLSLGNTGDPRPLPAG

SEQ ID NO: 1139947 - protein, 31 aa, Mycobacterium
LGLTAPAVPAPWPVLATLPRGPELGRDDASV

SEQ ID NO: 1139948 - protein, 23 aa, Mycobacterium
LGLVLFLPVFLTGVDWIRWWATI

SEQ ID NO: 1139949 - protein, 18 aa, Mycobacterium
LGLYLLARNPRKPVLLSA

SEQ ID NO: 1139950 - protein, 18 aa, Mycobacterium
LGMHIIAAADIKLWSFQA

SEQ ID NO: 1139951 - protein, 28 aa, Mycobacterium
LGMLCSGLLLQWWSWESIFIGFAAAGCT

SEQ ID NO: 1139952 - protein, 26 aa, Mycobacterium
LGNYFNQELFGRETTVPWGLEIYERV

SEQ ID NO: 1139953 - protein, 33 aa, Mycobacterium
LGPACAIAVLFGFLATVTLLPPVLSLAAKRGIG

SEQ ID NO: 1139954 - protein, 24 aa, Mycobacterium
LGPRIGLRLLTVPGFLLVAAGLYL

SEQ ID NO: 1139955 - protein, 24 aa, Mycobacterium
LGPRWAYLLGLTVFGLGSLVCAVA

SEQ ID NO: 1139956 - protein, 24 aa, Mycobacterium
LGPTPRYLSIPRWGLVERFDVPVE

SEQ ID NO: 1139957 - protein, 18 aa, Mycobacterium
LGPVWRVLSPVRALHRFS

SEQ ID NO: 1139958 - protein, 30 aa, Mycobacterium
LGRVTKPPRRRLSLAVIGSAAAAVLAIGGV

SEQ ID NO: 1139959 - protein, 17 aa, Mycobacterium
LGRYRVIALPARGPAEV

SEQ ID NO: 1139960 - protein, 18 aa, Mycobacterium
LGRYWRPILQLGGLVVAL

SEQ ID NO: 1139961 - protein, 32 aa, Mycobacterium
LGSMAYSLYLWHWPLLIFWLSHSGRSRVDFWQ

SEQ ID NO: 1139962 - protein, 32 aa, Mycobacterium
LGSMAYSLYLWHWPLLIFWLSYSGRSRVDFWQ

SEQ ID NO: 1139963 - protein, 33 aa, Mycobacterium
LGSMAYSLYLWHWPLLIFWLSYSGRSRVDFWQG

SEQ ID NO: 1139964 - protein, 27 aa, Mycobacterium
LGSVLLVQALLVTSLLFALPISARLSH

SEQ ID NO: 1139965 - protein, 20 aa, Mycobacterium
LGVAKLMRFVPRSVMVGFVN

SEQ ID NO: 1139966 - protein, 26 aa, Mycobacterium
LGVAPPIWLDRGAILPTVLRVTKRLA

SEQ ID NO: 1139967 - protein, 20 aa, Mycobacterium
LGVDLIAVLSLVGTLLVGEY

SEQ ID NO: 1139968 - protein, 20 aa, Mycobacterium
LGVFVTRLLERLPVSSYRRP

SEQ ID NO: 1139969 - protein, 31 aa, Mycobacterium
LGVGILFTWMFMFGMTPLLQGPVASALGGVD

SEQ ID NO: 1139970 - protein, 29 aa, Mycobacterium
LGVGLTEMGLLKYLIGQLLLSESARVENL

SEQ ID NO: 1139971 - protein, 18 aa, Mycobacterium
LGVLAAGVLWAGSWAFGD

SEQ ID NO: 1139972 - protein, 31 aa, Mycobacterium
LGVRTLLRVPFFRNWKPMRVYLEWLAEKTQK

SEQ ID NO: 1139973 - protein, 26 aa, Mycobacterium
LGVTGLFYTLLLAYAAFTLTVMAVLL

SEQ ID NO: 1139974 - protein, 17 aa, Mycobacterium
LGVWFALHRRSGIAKAG

SEQ ID NO: 1139975 - protein, 24 aa, Mycobacterium
LGYAYFVACLLLVWPSVPVIERAE

SEQ ID NO: 1139976 - protein, 19 aa, Mycobacterium
LHAKLTAMLYGIEAAPDTT

SEQ ID NO: 1139977 - protein, 24 aa, Mycobacterium
LHAPATVFVVLTTALLFGAIATVS

SEQ ID NO: 1139978 - protein, 21 aa, Mycobacterium
LHDIVDPLVFAEAADLIADHK

SEQ ID NO: 1139979 - protein, 21 aa, Mycobacterium
LHEWRPFTIAGLGIGVFGTSI

SEQ ID NO: 1139980 - protein, 20 aa, Mycobacterium
LHFLVSGYLFYWVVIGIDPT

SEQ ID NO: 1139981 - protein, 19 aa, Mycobacterium
LHFYAGVFVGPFLLIAAVS

SEQ ID NO: 1139982 - protein, 23 aa, Mycobacterium
LHGASLSVLTFAMAAACLYCAYE

SEQ ID NO: 1139983 - protein, 26 aa, Mycobacterium
LHKYSPVYTCWLQGTTWFLDNGGFDV

SEQ ID NO: 1139984 - protein, 18 aa, Mycobacterium
LHPAVLSRGGLKPAMRNL

SEQ ID NO: 1139985 - protein, 23 aa, Mycobacterium
LHRMMLYFGWNVSVSQTINPLPW

SEQ ID NO: 1139986 - protein, 18 aa, Mycobacterium
LHSMIVAGLVTMLCGFRS

SEQ ID NO: 1139987 - protein, 23 aa, Mycobacterium
LHSSLLIAYLSLLVALGFALWAV

SEQ ID NO: 1139988 - protein, 24 aa, Mycobacterium
LHSSLLIAYLSLLVALGFALWAVR

SEQ ID NO: 1139989 - protein, 40 aa, Mycobacterium
LHTALSWAISIGRSLPFLILMAAIMPFTRFITGTNIGIAA

SEQ ID NO: 1139990 - protein, 25 aa, Mycobacterium
LIAAGGFLLISKWPVDLLAARHDLG

SEQ ID NO: 1139991 - protein, 17 aa, Mycobacterium
LIAGLPCLPWFIDSAWN

SEQ ID NO: 1139992 - protein, 24 aa, Mycobacterium
LIAKGWIYALITLGLIIAVQQLEG

SEQ ID NO: 1139993 - protein, 25 aa, Mycobacterium
LIALFSTVLGWLPTSGYRPLTEDPA

SEQ ID NO: 1139994 - protein, 17 aa, Mycobacterium
LIALVIPALFTDSDLRG

SEQ ID NO: 1139995 - protein, 25 aa, Mycobacterium
LIAMFPWYVQWLPNAIWKTFDLFVG

SEQ ID NO: 1139996 - protein, 22 aa, Mycobacterium
LIAPIALHWSLNGLGALAAALV

SEQ ID NO: 1139997 - protein, 20 aa, Mycobacterium
LIAVFAQLRFEREQRYTAVF

SEQ ID NO: 1139998 - protein, 23 aa, Mycobacterium
LIAVIVLWLLFAVLRGRLHPVGG

SEQ ID NO: 1139999 - protein, 26 aa, Mycobacterium
LICLGAVLLAYFKPLGKRGGDTLLVD

SEQ ID NO: 1140000 - protein, 20 aa, Mycobacterium
LIFVAVLLGMLLAALDQTIV

SEQ ID NO: 1140001 - protein, 18 aa, Mycobacterium
LIFVVGLPLRRVVRRHLR

SEQ ID NO: 1140002 - protein, 19 aa, Mycobacterium
LIGAMLLIKGADVGYRKYT

SEQ ID NO: 1140003 - protein, 30 aa, Mycobacterium
LIGGLALLPLLLVLAFVPARRPGPAAQPVH

SEQ ID NO: 1140004 - protein, 27 aa, Mycobacterium
LIGGRLYHVITDWQTYFGPDGAGLIAA

SEQ ID NO: 1140005 - protein, 18 aa, Mycobacterium
LIGLVNIVLLTAAATIGA

SEQ ID NO: 1140006 - protein, 27 aa, Mycobacterium
LIGSAAVYLGLLISWYAGTAGGATIAG

SEQ ID NO: 1140007 - protein, 18 aa, Mycobacterium
LIGVFYKNLYVEALLNEL

SEQ ID NO: 1140008 - protein, 23 aa, Mycobacterium
LIGVPWLLSFAQPTIWEIGRPWY

SEQ ID NO: 1140009 - protein, 19 aa, Mycobacterium
LIGVVWAWMTGRDDTWRRT

SEQ ID NO: 1140010 - protein, 34 aa, Mycobacterium
LIHRDIKPSNILITGRDFVYLIDFGLARTAGEKG

SEQ ID NO: 1140011 - protein, 17 aa, Mycobacterium
LIIGGIVVLVRLSTGGT

SEQ ID NO: 1140012 - protein, 17 aa, Mycobacterium
LIILIPAVVMLVCRHFN

SEQ ID NO: 1140013 - protein, 29 aa, Mycobacterium
LIIVLLAVTGLRRLVFDAVPMQLKLAITA

SEQ ID NO: 1140014 - protein, 21 aa, Mycobacterium
LILQAFVISTLLRVAQGSATV

SEQ ID NO: 1140015 - protein, 17 aa, Mycobacterium
LILVAIGIVLFFINRLI

SEQ ID NO: 1140016 - protein, 24 aa, Mycobacterium
LILVAIGIVLFFINRLINRRLGVR

SEQ ID NO: 1140017 - protein, 17 aa, Mycobacterium
LILVRALFLEKALDQFY

SEQ ID NO: 1140018 - protein, 23 aa, Mycobacterium
LILVVAALFLLRLFGVVDSIGVG

SEQ ID NO: 1140019 - protein, 19 aa, Mycobacterium
LIPAPIYMRLEMTAPIYIW

SEQ ID NO: 1140020 - protein, 25 aa, Mycobacterium
LIPERLFTRIVLPLVALAAGALLGG

SEQ ID NO: 1140021 - protein, 29 aa, Mycobacterium
LIPQTLRSFPIAALLWSGAALGAPILALY

SEQ ID NO: 1140022 - protein, 26 aa, Mycobacterium
LIPRLYALHILLIPGIILALIGVHLA

SEQ ID NO: 1140023 - protein, 20 aa, Mycobacterium
LIPYIVQFPRFFSGEITLGQ

SEQ ID NO: 1140024 - protein, 20 aa, Mycobacterium
LIQAMMRGWRRRVERQAKII

SEQ ID NO: 1140025 - protein, 25 aa, Mycobacterium
LIQGAVLLIAALFLVINLLVDVLYA

SEQ ID NO: 1140026 - protein, 17 aa, Mycobacterium
LIQLYIVGVFVSFTFSQ

SEQ ID NO: 1140027 - protein, 17 aa, Mycobacterium
LISNGRFVFGVGAGWNL

SEQ ID NO: 1140028 - protein, 20 aa, Mycobacterium
LISTIGLILGFVIAVSSFLA

SEQ ID NO: 1140029 - protein, 21 aa, Mycobacterium
LISTIGLILGFVIAVSSFLAA

SEQ ID NO: 1140030 - protein, 17 aa, Mycobacterium
LISVAVFTGLWQLAAAS

SEQ ID NO: 1140031 - protein, 26 aa, Mycobacterium
LITTTTLLMLLAFGSLVLTAYPLKWT

SEQ ID NO: 1140032 - protein, 18 aa, Mycobacterium
LIVVLGFGAYAAGNGYVT

SEQ ID NO: 1140033 - protein, 20 aa, Mycobacterium
LIVWFYRLYVYSPVSAGYGL

SEQ ID NO: 1140034 - protein, 26 aa, Mycobacterium
LIYTDLLVIFLYTLVAMGFRFWSLRV

SEQ ID NO: 1140035 - protein, 17 aa, Mycobacterium
LKVIAEHTEWPAPAGRP

SEQ ID NO: 1140036 - protein, 28 aa, Mycobacterium
LKVPVPLTLLSFLPLAPTLVTVAVEAAA

SEQ ID NO: 1140037 - protein, 30 aa, Mycobacterium; identical to SEQ ID NO: 361449

SEQ ID NO: 1140038 - protein, 17 aa, Mycobacterium
LLAALIQRPSVLDPAVD

SEQ ID NO: 1140039 - protein, 17 aa, Mycobacterium
LLAFLYTALRLHAREPQ

SEQ ID NO: 1140040 - protein, 18 aa, Mycobacterium
LLAGLPMSGAVGTSLVVI

SEQ ID NO: 1140041 - protein, 19 aa, Mycobacterium
LLAISVGYLAFVRWRIRLK

SEQ ID NO: 1140042 - protein, 17 aa, Mycobacterium
LLAIVLFGERLPGVAGV

SEQ ID NO: 1140043 - protein, 20 aa, Mycobacterium
LLAIWIGVGFIFRGVATAMS

SEQ ID NO: 1140044 - protein, 39 aa, Mycobacterium
LLALTAPADGWVRWMFIVALAVTFFLMAANRLVLPVATG

SEQ ID NO: 1140045 - protein, 18 aa, Mycobacterium
LLALVPMLNRALARGAWP

SEQ ID NO: 1140046 - protein, 26 aa, Mycobacterium
LLAMAAAALGWLPPAAGALLQEAIDV

SEQ ID NO: 1140047 - protein, 23 aa, Mycobacterium
LLAPLLLLPLLNRQWRALVTAFA

SEQ ID NO: 1140048 - protein, 28 aa, Mycobacterium
LLARYIPGTILLIGFALMMIATAIAMLR

SEQ ID NO: 1140049 - protein, 28 aa, Mycobacterium
LLARYIPGTILLIGFAVMMIATAIAMLR

SEQ ID NO: 1140050 - protein, 24 aa, Mycobacterium
LLATVVRFVLLRGWVFHPRRTHTE

SEQ ID NO: 1140051 - protein, 26 aa, Mycobacterium
LLAWGALGVYLLWRSGFRLPEIGLAR

SEQ ID NO: 1140052 - protein, 20 aa, Mycobacterium
LLCVVPLMHLVAIGCYLLAS

SEQ ID NO: 1140053 - protein, 25 aa, Mycobacterium
LLDLMGPWPVYLLVGFTLVAAVWAL

SEQ ID NO: 1140054 - protein, 33 aa, Mycobacterium
LLDTFVVRTVIIPALFTLIGPRIWWPALREDGP

SEQ ID NO: 1140055 - protein, 24 aa, Mycobacterium
LLELRRRVFRHFGRLDIAFHDRYT

SEQ ID NO: 1140056 - protein, 19 aa, Mycobacterium
LLERLPVSSYRRPFLGTGL

SEQ ID NO: 1140057 - protein, 17 aa, Mycobacterium
LLFIGWNVSMSQAINPL

SEQ ID NO: 1140058 - protein, 28 aa, Mycobacterium
LLFPVVQPWYVLWAIIPLAAWATRPRFR

SEQ ID NO: 1140059 - protein, 28 aa, Mycobacterium
LLGAAWVLFVWSVLGQLFEVVLLAAGVA

SEQ ID NO: 1140060 - protein, 18 aa, Mycobacterium
LLGFAYGESIRGAGLLLV

SEQ ID NO: 1140061 - protein, 33 aa, Mycobacterium
LLGGYFTDHLTWRWAFWINVPIGIVVLIVALTT

SEQ ID NO: 1140062 - protein, 17 aa, Mycobacterium
LLGIRQSSNKFGAADDP

SEQ ID NO: 1140063 - protein, 17 aa, Mycobacterium
LLGRVTGLPLPAVLVPP

SEQ ID NO: 1140064 - protein, 17 aa, Mycobacterium
LLGTAWLVIYARSSTRA

SEQ ID NO: 1140065 - protein, 31 aa, Mycobacterium
LLGTSITALLYNFGFFTLLAFTPFPLDMSAQ

SEQ ID NO: 1140066 - protein, 27 aa, Mycobacterium
LLGTVPMGLLAYRYRLRVLLAATVAGG

SEQ ID NO: 1140067 - protein, 20 aa, Mycobacterium
LLGVAGYNFGRFCLTPLPRA

SEQ ID NO: 1140068 - protein, 25 aa, Mycobacterium
LLGVAGYNFGRFCLTPLPRPVRIRH

SEQ ID NO: 1140069 - protein, 20 aa, Mycobacterium
LLIAVLFLGFLVLEGFDFGV

SEQ ID NO: 1140070 - protein, 22 aa, Mycobacterium
LLIIMGAFMYFASRRQKKAMQA

SEQ ID NO: 1140071 - protein, 18 aa, Mycobacterium
LLILAKLVALVTLGGLGW

SEQ ID NO: 1140072 - protein, 19 aa, Mycobacterium
LLIPDVPLTFDTLRIIAPY

SEQ ID NO: 1140073 - protein, 22 aa, Mycobacterium
LLIVSPVVWLVTGEPFISLVEP

SEQ ID NO: 1140074 - protein, 25 aa, Mycobacterium
LLKLAVILALWAAVVAAFVSVIYRR

SEQ ID NO: 1140075 - protein, 36 aa, Mycobacterium
LLLAASFPPLSWWICAIAGLALLAWVLADPFTRAVG

SEQ ID NO: 1140076 - protein, 22 aa, Mycobacterium
LLLAIWIGIGFVFRGVATAVSA

SEQ ID NO: 1140077 - protein, 27 aa, Mycobacterium
LLLDATVIRMFLVPALMKWLGDECWWA

SEQ ID NO: 1140078 - protein, 20 aa, Mycobacterium
LLLGVLTPLAGSAALGAMLC

SEQ ID NO: 1140079 - protein, 26 aa, Mycobacterium
LLLGWAVFLNYGLVLMAFPAVAVLLG

SEQ ID NO: 1140080 - protein, 18 aa, Mycobacterium
LLLIEIFLTTRDLLRARA

SEQ ID NO: 1140081 - protein, 21 aa, Mycobacterium
LLLLPVTWYVAVGSHQWFYGI

SEQ ID NO: 1140082 - protein, 18 aa, Mycobacterium
LLLLVCSPATRAAARLRT

SEQ ID NO: 1140083 - protein, 18 aa, Mycobacterium
LLLNGLVCLIGLSGGYVF

SEQ ID NO: 1140084 - protein, 20 aa, Mycobacterium
LLLQWWRQRDEYQWRIGFLR

SEQ ID NO: 1140085 - protein, 18 aa, Mycobacterium
LLLSKSLAPTGKVLKRLG

SEQ ID NO: 1140086 - protein, 21 aa, Mycobacterium
LLLSSLLLNWVLGPALMFALA

SEQ ID NO: 1140087 - protein, 25 aa, Mycobacterium
LLLTIPVLLTHQWQLVFVAAALLGA

SEQ ID NO: 1140088 - protein, 19 aa, Mycobacterium
LLLYCIRALLILRTDPRSR

SEQ ID NO: 1140089 - protein, 20 aa, Mycobacterium
LLNGYEPLFSLLNPRDADNL

SEQ ID NO: 1140090 - protein, 18 aa, Mycobacterium
LLNWVLGPALMFALAWLL

SEQ ID NO: 1140091 - protein, 21 aa, Mycobacterium
LLPAFVALFGVIAALFLVGLG

SEQ ID NO: 1140092 - protein, 25 aa, Mycobacterium
LLRARWITLCVALIVAVLGAVAVSM

SEQ ID NO: 1140093 - protein, 17 aa, Mycobacterium
LLRQAQIIAAPTFEFFA

SEQ ID NO: 1140094 - protein, 25 aa, Mycobacterium
LLSASPLPGWLPDAFRAAAAGVLAL

SEQ ID NO: 1140095 - protein, 33 aa, Mycobacterium
LLSFAQPTIWVIPRPWYLAWAGLVYIVATLATL

SEQ ID NO: 1140096 - protein, 23 aa, Mycobacterium
LLSLGLPVLFIALGGIGLPGGAV

SEQ ID NO: 1140097 - protein, 27 aa, Mycobacterium
LLSPCSALLLPSFFAYAFDRVQRLVQR

SEQ ID NO: 1140098 - protein, 19 aa, Mycobacterium
LLSRFWVVPVHRAAGLLAR

SEQ ID NO: 1140099 - protein, 17 aa, Mycobacterium
LLSRLDGDVPDDLAGAV

SEQ ID NO: 1140100 - protein, 17 aa, Mycobacterium
LLSTLLLTVIVYRTLDA

SEQ ID NO: 1140101 - protein, 23 aa, Mycobacterium
LLSVFGWPPLARITTFMLTVYFV

SEQ ID NO: 1140102 - protein, 24 aa, Mycobacterium
LLTAAVAVWWLLRPGSPGAAEVGV

SEQ ID NO: 1140103 - protein, 17 aa, Mycobacterium
LLTALVVAALIGVVLFT

SEQ ID NO: 1140104 - protein, 26 aa, Mycobacterium
LLTARTGFWIGVLPIALYSLLPVLAS

SEQ ID NO: 1140105 - protein, 20 aa, Mycobacterium
LLTGIFLLVILGATDTRAPK

SEQ ID NO: 1140106 - protein, 30 aa, Mycobacterium
LLTGTVGWRWIFWLNVPLALASFVLGARHI

SEQ ID NO: 1140107 - protein, 17 aa, Mycobacterium
LLTIAVTGSLSVAEIVD

SEQ ID NO: 1140108 - protein, 19 aa, Mycobacterium
LLTLVIVLVVGGLLAHGWT

SEQ ID NO: 1140109 - protein, 18 aa, Mycobacterium
LLVCLIPTTIGALLSAIG

SEQ ID NO: 1140110 - protein, 23 aa, Mycobacterium
LLVGFLWALLFNGFFGPRLGVFY

SEQ ID NO: 1140111 - protein, 19 aa, Mycobacterium
LLVGLLTIALVIGAVWAPQ

SEQ ID NO: 1140112 - protein, 17 aa, Mycobacterium
LLVSRFKEELAGGLKTG

SEQ ID NO: 1140113 - protein, 18 aa, Mycobacterium
LLVTFGVGLILQQVARDI

SEQ ID NO: 1140114 - protein, 27 aa, Mycobacterium
LLVTPVVTLYFWGLAVVLGLFVLPGIP

SEQ ID NO: 1140115 - protein, 26 aa, Mycobacterium
LMADDLRALPFAVSLSRRCSRVIKQN

SEQ ID NO: 1140116 - protein, 25 aa, Mycobacterium
LMADDLRALPFAVSLSRRSSRVIKQ

SEQ ID NO: 1140117 - protein, 22 aa, Mycobacterium
LMAGLALVLRYLAGGRYELGET

SEQ ID NO: 1140118 - protein, 33 aa, Mycobacterium
LMALMLGFYLTCAIFVFGVLGALLRVVSGVSIF

SEQ ID NO: 1140119 - protein, 18 aa, Mycobacterium
LMAVAVFAVTSRALYDDI

SEQ ID NO: 1140120 - protein, 19 aa, Mycobacterium
LMAVFFLPLRLGPVPLPIS

SEQ ID NO: 1140121 - protein, 20 aa, Mycobacterium
LMFLGFMFAFAVKAPLWPLH

SEQ ID NO: 1140122 - protein, 30 aa, Mycobacterium
LMKYNPSYTCMLLGATWFLDNGGRHALGEG

SEQ ID NO: 1140123 - protein, 18 aa, Mycobacterium
LMLAAAALTFALGGLSRL

SEQ ID NO: 1140124 - protein, 17 aa, Mycobacterium
LMLTIVVPVLLVQGAPV

SEQ ID NO: 1140125 - protein, 19 aa, Mycobacterium
LMPTWLVIVTYVVALCVLV

SEQ ID NO: 1140126 - protein, 26 aa, Mycobacterium
LMPWTQWITWGFQVVPVFFAVAGYAS

SEQ ID NO: 1140127 - protein, 31 aa, Mycobacterium
LNAVSFIGIVLVLISWRRPAVQRDFPPERAL

SEQ ID NO: 1140128 - protein, 22 aa, Mycobacterium
LNDPPTCSVGFLPPTAIRTPAD

SEQ ID NO: 1140129 - protein, 23 aa, Mycobacterium
LNDTWWRIPILILVSFANAWAEE

SEQ ID NO: 1140130 - protein, 21 aa, Mycobacterium
LNDVFWLWFIGIVGTIIVQNI

SEQ ID NO: 1140131 - protein, 31 aa, Mycobacterium
LNGFSGQWPGDLGERPALWIPASSVSGARLE

SEQ ID NO: 1140132 - protein, 26 aa, Mycobacterium
LNIAQWYVFGFFFTTAHYAMAYVAVG

SEQ ID NO: 1140133 - protein, 23 aa, Mycobacterium
LNINVPPPCLTGYLPPTQQRSFA

SEQ ID NO: 1140134 - protein, 18 aa, Mycobacterium
LNKAALWVGIVAGSVFIV

SEQ ID NO: 1140135 - protein, 17 aa, Mycobacterium
LNLPVMIVCGFLLGAAG

SEQ ID NO: 1140136 - protein, 18 aa, Mycobacterium
LNNLLYDTSQLAIPADRV

SEQ ID NO: 1140137 - protein, 26 aa, Mycobacterium
LNPSKIWLLVVLLTGIGWVGYIGVRA

SEQ ID NO: 1140138 - protein, 18 aa, Mycobacterium
LNRQLPVRLVAAAVALAC

SEQ ID NO: 1140139 - protein, 21 aa, Mycobacterium
LNSLIWVATTFALTTLCLLVV

SEQ ID NO: 1140140 - protein, 41 aa, Mycobacterium
LNTLPDTYRVMLRQGLYGNYFTFYLCDLLLKVNGKGGQPVY

SEQ ID NO: 1140141 - protein, 18 aa, Mycobacterium
LNTSYYRLMLQLENGPQD

SEQ ID NO: 1140142 - protein, 19 aa, Mycobacterium
LNVWAPIQPLLAGVSLAVL

SEQ ID NO: 1140143 - protein, 17 aa, Mycobacterium
LPAFRFPDPNGVGFENG

SEQ ID NO: 1140144 - protein, 26 aa, Mycobacterium
LPAKLILMVIAVICAAAVFSAIVLRD

SEQ ID NO: 1140145 - protein, 23 aa, Mycobacterium
LPARRELFHFFASSYAINAVDVT

SEQ ID NO: 1140146 - protein, 22 aa, Mycobacterium
LPDLLDLVAGQPLLYGASDPAV

SEQ ID NO: 1140147 - protein, 20 aa, Mycobacterium
LPDLSRPRRPRLPLKAGWGV

SEQ ID NO: 1140148 - protein, 22 aa, Mycobacterium
LPDRWMAVFGFVSLLAFIATAV

SEQ ID NO: 1140149 - protein, 35 aa, Mycobacterium
LPDTFDLKGIIKLLASLFGLTWANIRNRLVKQIGE

SEQ ID NO: 1140150 - protein, 24 aa, Mycobacterium
LPDVRSFLNPIPHVSFVTGADNVQ

SEQ ID NO: 1140151 - protein, 20 aa, Mycobacterium
LPDWVPFAVLLPVAAVVLAW

SEQ ID NO: 1140152 - protein, 24 aa, Mycobacterium
LPGLAELLHRCWLALHAGPPGQVD

SEQ ID NO: 1140153 - protein, 25 aa, Mycobacterium
LPGPAIQPFLDYALGYRRGVDAGQP

SEQ ID NO: 1140154 - protein, 26 aa, Mycobacterium
LPGRAPLWLLVTLVIVISVGGPGSMV

SEQ ID NO: 1140155 - protein, 30 aa, Mycobacterium
LPIEHGYPARLVVPGLYGYVSATKWVTDLE

SEQ ID NO: 1140156 - protein, 17 aa, Mycobacterium
LPITLAGILPAIALVLA

SEQ ID NO: 1140157 - protein, 26 aa, Mycobacterium
LPLAMPSYLLAYLWVSAYPTITGFWG

SEQ ID NO: 1140158 - protein, 20 aa, Mycobacterium
LPLASLVFLGAFIPLVGAVV

SEQ ID NO: 1140159 - protein, 26 aa, Mycobacterium
LPLGLAVVVLLLVLGAPFLGVKWGFP

SEQ ID NO: 1140160 - protein, 22 aa, Mycobacterium
LPLHHPVLATVLWSLALTAVFA

SEQ ID NO: 1140161 - protein, 22 aa, Mycobacterium
LPPSQLTLTIGFGPSFFVKDGV

SEQ ID NO: 1140162 - protein, 26 aa, Mycobacterium
LPRHAKPVAPRRWPRALPIAAAAVTV

SEQ ID NO: 1140163 - protein, 22 aa, Mycobacterium
LPRWIYVPAVAGALFVGLPVVS

SEQ ID NO: 1140164 - protein, 17 aa, Mycobacterium
LPRWYWSGLAVGTLLGT

SEQ ID NO: 1140165 - protein, 19 aa, Mycobacterium
LPTPLLFGGLAGALLYALV

SEQ ID NO: 1140166 - protein, 18 aa, Mycobacterium
LPTYLLLKRLDDIAYGLG

SEQ ID NO: 1140167 - protein, 17 aa, Mycobacterium
LPVIIGSGLTIAGAGFC

SEQ ID NO: 1140168 - protein, 19 aa, Mycobacterium
LPVMIVCGFLLGAAGQVVK

SEQ ID NO: 1140169 - protein, 20 aa, Mycobacterium
LPVMLLTVLVFFNGPVWTMA

SEQ ID NO: 1140170 - protein, 29 aa, Mycobacterium
LPVQLGKDWIWLHAARIAAAALPVLTALL

SEQ ID NO: 1140171 - protein, 19 aa, Mycobacterium
LPVTTFPDRGGVTAAPVIC

SEQ ID NO: 1140172 - protein, 17 aa, Mycobacterium
LPVVWALNHQGWHAAAA

SEQ ID NO: 1140173 - protein, 41 aa, Mycobacterium
LQDGRDMFWSMAPLVVACVVLAGLLGMCSFAPTGPGPGPAP

SEQ ID NO: 1140174 - protein, 17 aa, Mycobacterium
LQDTWLFAGTVYENIAY

SEQ ID NO: 1140175 - protein, 27 aa, Mycobacterium
LQFAALSGVFLLAALITGVLDAAEPVV

SEQ ID NO: 1140176 - protein, 21 aa, Mycobacterium
LQFEIILIRGLTNYAFWVPNG

SEQ ID NO: 1140177 - protein, 22 aa, Mycobacterium
LQFEIILIRGLTNYAFWVPNGS

SEQ ID NO: 1140178 - protein, 23 aa, Mycobacterium
LQFEIILIRGLTNYAFWVPNGSP

SEQ ID NO: 1140179 - protein, 34 aa, Mycobacterium
LQKLDPVLRLPLALGVIHLLARIPLPGSAPRPVW

SEQ ID NO: 1140180 - protein, 36 aa, Mycobacterium
LQNVGLSLALIIVLIPLALLGVLGLAAVVLVHELAE

SEQ ID NO: 1140181 - protein, 26 aa, Mycobacterium
LQRGVPLWRILLAKNLAMAALVTLAG

SEQ ID NO: 1140182 - protein, 18 aa, Mycobacterium
LQRKLRVGFAKAGRLMDL

SEQ ID NO: 1140183 - protein, 27 aa, Mycobacterium
LQRPESQWWIAILGLAVAYSPYLVFFA

SEQ ID NO: 1140184 - protein, 24 aa, Mycobacterium
LQSPWPILLFAAVAGTVVIGNLFP

SEQ ID NO: 1140185 - protein, 24 aa, Mycobacterium
LRADLARDPSFYLRFRREAQNAAA

SEQ ID NO: 1140186 - protein, 17 aa, Mycobacterium
LRAFIPLFVANAVFWSL

SEQ ID NO: 1140187 - protein, 30 aa, Mycobacterium
LRAGSLDALLPPRLRSRPGARARLFGMTES

SEQ ID NO: 1140188 - protein, 19 aa, Mycobacterium
LRAGVIALVLLAILALIVL

SEQ ID NO: 1140189 - protein, 18 aa, Mycobacterium
LRALFFLVKGLLDRLVYL

SEQ ID NO: 1140190 - protein, 25 aa, Mycobacterium
LRASLPLLTRGLIGRRRPRGLRVAD

SEQ ID NO: 1140191 - protein, 17 aa, Mycobacterium
LRDDAVAAFFWVANWAF

SEQ ID NO: 1140192 - protein, 30 aa, Mycobacterium
LRDGSGPWWPLPFWIAVAGLTPTGLLLAAV

SEQ ID NO: 1140193 - protein, 17 aa, Mycobacterium
LREDAVAAFFWMSNWVF

SEQ ID NO: 1140194 - protein, 26 aa, Mycobacterium
LREFGNIVFHFSLLGLLVAIAAGKMF

SEQ ID NO: 1140195 - protein, 20 aa, Mycobacterium
LREWLLARDELPNSSLVAIC

SEQ ID NO: 1140196 - protein, 24 aa, Mycobacterium
LRFIAFSFFALACYVAVDAALSLV

SEQ ID NO: 1140197 - protein, 32 aa, Mycobacterium
LRGDAVVLATGAWLPALTGRRIRVGLQAGRGY

SEQ ID NO: 1140198 - protein, 19 aa, Mycobacterium
LRHLFASPKTWRLLDGVIA

SEQ ID NO: 1140199 - protein, 22 aa, Mycobacterium
LRLKGRLLFMPNVMVTSVPWQL

SEQ ID NO: 1140200 - protein, 18 aa, Mycobacterium
LRLLAAQAIVLVAGAVTT

SEQ ID NO: 1140201 - protein, 21 aa, Mycobacterium
LRLLGLLIGWGFFTAALTKVM

SEQ ID NO: 1140202 - protein, 22 aa, Mycobacterium
LRLPARFVLGALAGLRTVGLLR

SEQ ID NO: 1140203 - protein, 21 aa, Mycobacterium
LRLVRRLTPQRTLTASVIGLG

SEQ ID NO: 1140204 - protein, 37 aa, Mycobacterium
LRPPFQWREFILQSWFLMRVAFLPTLAVSIPLTVLLI

SEQ ID NO: 1140205 - protein, 29 aa, Mycobacterium
LRPQLAIPVLTMLMAVAMVASFHVVGTLL

SEQ ID NO: 1140206 - protein, 18 aa, Mycobacterium
LRQLTVLSALTLAAVLVT

SEQ ID NO: 1140207 - protein, 19 aa, Mycobacterium
LRRDAEVLHLSHGLLRVRE

SEQ ID NO: 1140208 - protein, 19 aa, Mycobacterium
LRRDMIAIVPPRLPAPAAL

SEQ ID NO: 1140209 - protein, 17 aa, Mycobacterium
LRRLLPSRRDYADLPRS

SEQ ID NO: 1140210 - protein, 17 aa, Mycobacterium
LRRPTIVLGLVVTLLGG

SEQ ID NO: 1140211 - protein, 29 aa, Mycobacterium
LRRRVTAALLLLSGLVMAGGLAATLTPSP

SEQ ID NO: 1140212 - protein, 20 aa, Mycobacterium
LRRVVLPQLRLAVLGGGLLI

SEQ ID NO: 1140213 - protein, 24 aa, Mycobacterium
LRSWRRFVLYGVIVAPAFAGTVGA

SEQ ID NO: 1140214 - protein, 17 aa, Mycobacterium
LRTKLSDLLALVSTFLA

SEQ ID NO: 1140215 - protein, 22 aa, Mycobacterium
LRVIPSMMFGGAITGALCMAFG

SEQ ID NO: 1140216 - protein, 27 aa, Mycobacterium
LSAADPRWLLWLVAAMTATLIPFSTLG

SEQ ID NO: 1140217 - protein, 21 aa, Mycobacterium
LSAAFDFTFPPTSMLDHPSIA

SEQ ID NO: 1140218 - protein, 36 aa, Mycobacterium
LSAFFTPRFVNWFGLFTTHLVIAIALALTAVLCLLA

SEQ ID NO: 1140219 - protein, 30 aa, Mycobacterium
LSAFFTPRFVNWFGLFTTHLVVAIALALTA

SEQ ID NO: 1140220 - protein, 30 aa, Mycobacterium
LSAGYGIQWVVPGLFFVLVSGFLAIQVKAA

SEQ ID NO: 1140221 - protein, 18 aa, Mycobacterium
LSAIISALRRVDGPVTII

SEQ ID NO: 1140222 - protein, 19 aa, Mycobacterium
LSALDHRFGWSSAPAWVVV

SEQ ID NO: 1140223 - protein, 19 aa, Mycobacterium
LSALGLSMTGPRPGGFGAL

SEQ ID NO: 1140224 - protein, 26 aa, Mycobacterium
LSATAFLALLVLYFLGFDQGATSVFG

SEQ ID NO: 1140225 - protein, 22 aa, Mycobacterium
LSAWRFVTTFGVVSLLADIVYE

SEQ ID NO: 1140226 - protein, 26 aa, Mycobacterium
LSEPRLWAVFLGLPMLVAIAVCLSRQ

SEQ ID NO: 1140227 - protein, 17 aa, Mycobacterium
LSFILVFGLAKAATNYF

SEQ ID NO: 1140228 - protein, 27 aa, Mycobacterium
LSGDQYFGFLINLLLVFGISFEFPLLI

SEQ ID NO: 1140229 - protein, 36 aa, Mycobacterium
LSGPLTLFGLTLPRALFWIVIAYVVVVTYVAVVVGR

SEQ ID NO: 1140230 - protein, 28 aa, Mycobacterium
LSGRLFGFSPFTMLLPQALMGVASVAVL

SEQ ID NO: 1140231 - protein, 24 aa, Mycobacterium
LSGTSAIFLGIILGLMMCFDLGGP

SEQ ID NO: 1140232 - protein, 25 aa, Mycobacterium
LSHSTDLNWKSVWDHGWSAAEAAEA

SEQ ID NO: 1140233 - protein, 18 aa, Mycobacterium
LSIPFTVLSVFIFNILLV

SEQ ID NO: 1140234 - protein, 23 aa, Mycobacterium
LSITAFLALVVLYFIGMDQGATS

SEQ ID NO: 1140235 - protein, 27 aa, Mycobacterium
LSIVLANPRWFAVLLVIPVVASVYIMR

SEQ ID NO: 1140236 - protein, 22 aa, Mycobacterium
LSLAVLWLKRWPTRTESVLFAA

SEQ ID NO: 1140237 - protein, 21 aa, Mycobacterium
LSLGSILLLAALGLALTFGQM

SEQ ID NO: 1140238 - protein, 26 aa, Mycobacterium
LSLIASVSPLVRWIIRVPREFVNDYI

SEQ ID NO: 1140239 - protein, 26 aa, Mycobacterium
LSLLLSGLAVAIWLAAVPGLPGVDAS

SEQ ID NO: 1140240 - protein, 19 aa, Mycobacterium
LSLLVFGVVWQFAAASGVW

SEQ ID NO: 1140241 - protein, 18 aa, Mycobacterium
LSLRDKFLIGLAGTLGAL

SEQ ID NO: 1140242 - protein, 31 aa, Mycobacterium
LSMAAMLLFPMYFLKSFAYAGLATVALCAVA

SEQ ID NO: 1140243 - protein, 19 aa, Mycobacterium
LSMCFVLLITGVGSLIHVY

SEQ ID NO: 1140244 - protein, 26 aa, Mycobacterium
LSMDYEVFLLARIREFWLAGGRRDND

SEQ ID NO: 1140245 - protein, 27 aa, Mycobacterium
LSMGILLAAVMWPLVAMMTANFALALA

SEQ ID NO: 1140246 - protein, 19 aa, Mycobacterium
LSMTLLQMTGIYQTIANDG

SEQ ID NO: 1140247 - protein, 27 aa, Mycobacterium
LSMVAMVLFPMYFLKSFAYAGIAVVGF

SEQ ID NO: 1140248 - protein, 18 aa, Mycobacterium
LSMVVFTALLWVVPLVEA

SEQ ID NO: 1140249 - protein, 20 aa, Mycobacterium
LSPAMLVLVLIMVVDGFFLG

SEQ ID NO: 1140250 - protein, 18 aa, Mycobacterium
LSPFFLKMASRYASAFLG

SEQ ID NO: 1140251 - protein, 19 aa, Mycobacterium
LSPGPWRRNADPTAPAGTL

SEQ ID NO: 1140252 - protein, 39 aa, Mycobacterium
LSPGWTFGQLWRTDRRRTLWLLWVLRHAIFRSVRRVILR

SEQ ID NO: 1140253 - protein, 26 aa, Mycobacterium
LSPVKGSIMLFWAPRGSKVIADLADA

SEQ ID NO: 1140254 - protein, 38 aa, Mycobacterium
LSPVVRLWVIAAAVAVGWFLPLLGLSLAAFVAVDLCIG

SEQ ID NO: 1140255 - protein, 18 aa, Mycobacterium
LSRFIFATAIVWIVGGVG

SEQ ID NO: 1140256 - protein, 17 aa, Mycobacterium
LSSFKVPTVWLLLDSQD

SEQ ID NO: 1140257 - protein, 35 aa, Mycobacterium
LSSVAWVFLWIFRGTPIYVQLAFWGLFPTIYQNIQ

SEQ ID NO: 1140258 - protein, 17 aa, Mycobacterium
LSTPLPVVLFAVLALTV

SEQ ID NO: 1140259 - protein, 18 aa, Mycobacterium
LSTTAYLLAKVCIYAVFA

SEQ ID NO: 1140260 - protein, 19 aa, Mycobacterium
LSVAAVVLAVMIWSGHREA

SEQ ID NO: 1140261 - protein, 18 aa, Mycobacterium
LSVIAVGLLLPWTRPMFM

SEQ ID NO: 1140262 - protein, 24 aa, Mycobacterium
LSVLSFGPILWRLSEPVTLGGLTL

SEQ ID NO: 1140263 - protein, 19 aa, Mycobacterium
LSWATAIRYQALFAEAGGL

SEQ ID NO: 1140264 - protein, 19 aa, Mycobacterium
LSWCIIIYGLAASVLPVWL

SEQ ID NO: 1140265 - protein, 27 aa, Mycobacterium
LSWDIGFLIFGALLVAAGWALYRRGAR

SEQ ID NO: 1140266 - protein, 21 aa, Mycobacterium
LSWFAPALLTASASAGAHPRL

SEQ ID NO: 1140267 - protein, 28 aa, Mycobacterium
LTAAPVPAPWSVLAQFAAGPTLSRDDAL

SEQ ID NO: 1140268 - protein, 38 aa, Mycobacterium
LTADDRLFCNSPFFWIGGFAFGLLATLVAGATLICSNA

SEQ ID NO: 1140269 - protein, 26 aa, Mycobacterium
LTAGSWYFWPVWPILGAGVGVLAHAL

SEQ ID NO: 1140270 - protein, 33 aa, Mycobacterium
LTAIGIPDRFVGGLALTLAILIATSISMVFGEL

SEQ ID NO: 1140271 - protein, 19 aa, Mycobacterium
LTAMFLPAMAIVGALVPVH

SEQ ID NO: 1140272 - protein, 30 aa, Mycobacterium
LTASVVLPLKALLLNVLSLSAAFGAMVWIF

SEQ ID NO: 1140273 - protein, 35 aa, Mycobacterium
LTATPVGHFIGMLGAFLIPVLEGAPIDLCDVWDPG

SEQ ID NO: 1140274 - protein, 18 aa, Mycobacterium
LTAYAIIGLATAAPPIAA

SEQ ID NO: 1140275 - protein, 28 aa, Mycobacterium
LTDPFRVLFRPWVAVPALAAFAVVCWWV

SEQ ID NO: 1140276 - protein, 23 aa, Mycobacterium
LTEGVALLLVSFMLALSAATLPV

SEQ ID NO: 1140277 - protein, 23 aa, Mycobacterium
LTEGVTLLLVSFMLALSAATLPV

SEQ ID NO: 1140278 - protein, 19 aa, Mycobacterium
LTERALATRRLWPYAVAIV

SEQ ID NO: 1140279 - protein, 25 aa, Mycobacterium
LTFDTLRIIAPYALAMALVGLLESL

SEQ ID NO: 1140280 - protein, 19 aa, Mycobacterium
LTFLSPTAELFVVMAATTV

SEQ ID NO: 1140281 - protein, 17 aa, Mycobacterium
LTFPRYLAATRPGSHNV

SEQ ID NO: 1140282 - protein, 19 aa, Mycobacterium
LTFSLTLITLQLASSQYSP

SEQ ID NO: 1140283 - protein, 25 aa, Mycobacterium
LTFSQNLRMILLPQAFRSVIIPLGS

SEQ ID NO: 1140284 - protein, 20 aa, Mycobacterium
LTFVLLGANAFFVASEFALI

SEQ ID NO: 1140285 - protein, 18 aa, Mycobacterium
LTGFPGFREPGDTRRSLI

SEQ ID NO: 1140286 - protein, 20 aa, Mycobacterium
LTGNIFFGAFFGLGLGLGLV

SEQ ID NO: 1140287 - protein, 25 aa, Mycobacterium
LTGNNPFPLGIAALGLMAAAYVGEI

SEQ ID NO: 1140288 - protein, 23 aa, Mycobacterium
LTGPPAHLFTIGSSLLAAQLCVS

SEQ ID NO: 1140289 - protein, 27 aa, Mycobacterium
LTIGLERPGWPPPWGADVFVPDLLSVW

SEQ ID NO: 1140290 - protein, 26 aa, Mycobacterium
LTIIPAYIPAFVGAIAWSFLLSPQSG

SEQ ID NO: 1140291 - protein, 24 aa, Mycobacterium
LTIRRALLLYRLKGLRAMLARFLF

SEQ ID NO: 1140292 - protein, 29 aa, Mycobacterium
LTKETMLLFLPMVAWLVWTKTAPATRRYA

SEQ ID NO: 1140293 - protein, 26 aa, Mycobacterium
LTLGLSLAVILVLGFVLTSQITDRIL

SEQ ID NO: 1140294 - protein, 17 aa, Mycobacterium
LTLIVVLGFGAYAAGHG

SEQ ID NO: 1140295 - protein, 50 aa, Mycobacterium
LTLLLGLLLLTLLLGLLLLTLLLGLLLRSLLLLTLLLLELPLRIGVFFNL

SEQ ID NO: 1140296 - protein, 26 aa, Mycobacterium
LTLMVPNLVALIGWVLALVGIETQVR

SEQ ID NO: 1140297 - protein, 25 aa, Mycobacterium
LTLMWALVFALIALLGLLSAQIPHT

SEQ ID NO: 1140298 - protein, 22 aa, Mycobacterium
LTLPYSVLLVFTFNILLKEFGA

SEQ ID NO: 1140299 - protein, 41 aa, Mycobacterium
LTLTLAVMLSISWQITLAALVVLPLFLIPARRIGTAMARLS

SEQ ID NO: 1140300 - protein, 23 aa, Mycobacterium
LTPLPVLVPMLAAAATLIAGRRP

SEQ ID NO: 1140301 - protein, 25 aa, Mycobacterium
LTQRFIMRWRIWLSRNLIDDWLDHH

SEQ ID NO: 1140302 - protein, 25 aa, Mycobacterium
LTRAQKWVFGIILFAGIALSPLFTP

SEQ ID NO: 1140303 - protein, 18 aa, Mycobacterium
LTRIIVALVLAVLAMVVV

SEQ ID NO: 1140304 - protein, 31 aa, Mycobacterium
LTSAALILLLKPLLTMLFLRAGAAGGLLTPA

SEQ ID NO: 1140305 - protein, 26 aa, Mycobacterium
LTSGFSPLFVAVATLWCFGASMLWAL

SEQ ID NO: 1140306 - protein, 26 aa, Mycobacterium
LTSHPSYVLLLLLTAPIPAVMVLATA

SEQ ID NO: 1140307 - protein, 26 aa, Mycobacterium
LTSTSQLLYLRVPALNALFPAHRTSV

SEQ ID NO: 1140308 - protein, 22 aa, Mycobacterium
LTTALAFPFAWIAVRHRGFYAR

SEQ ID NO: 1140309 - protein, 29 aa, Mycobacterium
LTVAFGILALLWFRSVLERSPGFPLQYAP

SEQ ID NO: 1140310 - protein, 43 aa, Mycobacterium
LTVIAVLVMMLTISPLLTLLTVVTVPLSLWVTRSIAKRSRTLF

SEQ ID NO: 1140311 - protein, 19 aa, Mycobacterium
LTVLGLMLLLAACGKSAQV

SEQ ID NO: 1140312 - protein, 18 aa, Mycobacterium
LTVPLLAYVGGLETKQAI

SEQ ID NO: 1140313 - protein, 20 aa, Mycobacterium
LTVSLFYLLAQMAGAGGLVA

SEQ ID NO: 1140314 - protein, 24 aa, Mycobacterium
LTVVLFVTFLVFTAKLVAGHEIVV

SEQ ID NO: 1140315 - protein, 29 aa, Mycobacterium
LTVVSWRLAFLINVPIGIAIIAIAVFRLA

SEQ ID NO: 1140316 - protein, 18 aa, Mycobacterium
LTWAQLYRRTVNLAHELS

SEQ ID NO: 1140317 - protein, 18 aa, Mycobacterium
LVAAGWWLNGRPGGRVGA

SEQ ID NO: 1140318 - protein, 19 aa, Mycobacterium
LVAALLTLVPFFDGAAVPP

SEQ ID NO: 1140319 - protein, 31 aa, Mycobacterium
LVAALVGIGLWVWAPWRHDAGAPLPDGAVEA

SEQ ID NO: 1140320 - protein, 18 aa, Mycobacterium
LVAALVQCDVPHPVLALF

SEQ ID NO: 1140321 - protein, 18 aa, Mycobacterium
LVAATVVMFTAALVLAAV

SEQ ID NO: 1140322 - protein, 17 aa, Mycobacterium
LVAGVIMTIQVAIAWFG

SEQ ID NO: 1140323 - protein, 19 aa, Mycobacterium
LVAIPFTVLVSFTLNILLR

SEQ ID NO: 1140324 - protein, 25 aa, Mycobacterium
LVAMVQWFGMPWYFITHLGIDNGIG

SEQ ID NO: 1140325 - protein, 36 aa, Mycobacterium
LVATGLRMISPTMLFFPFVLLLAATALYRGTDNKMR

SEQ ID NO: 1140326 - protein, 17 aa, Mycobacterium
LVATPAAVGVALLVSRR

SEQ ID NO: 1140327 - protein, 26 aa, Mycobacterium
LVAWGFLAVYLLWRSGFGPGAIGLGR

SEQ ID NO: 1140328 - protein, 17 aa, Mycobacterium
LVDLPKFPNEKIDPARS

SEQ ID NO: 1140329 - protein, 28 aa, Mycobacterium
LVDSLGWQWIFIVNLPVGVLGFALAVWL

SEQ ID NO: 1140330 - protein, 27 aa, Mycobacterium
LVDVARLPQLWQLALHLTLTGIALFAL

SEQ ID NO: 1140331 - protein, 23 aa, Mycobacterium
LVEIPLLCYLVAPDRTRAALSSL

SEQ ID NO: 1140332 - protein, 19 aa, Mycobacterium
LVEMLLFMVIVFVAYGYVW

SEQ ID NO: 1140333 - protein, 32 aa, Mycobacterium
LVERFVDQGVLRLEWRDMPIFGEQSMRAARAG

SEQ ID NO: 1140334 - protein, 22 aa, Mycobacterium
LVFATYIVVMFLVLLRIVNRQG

SEQ ID NO: 1140335 - protein, 17 aa, Mycobacterium
LVFLTGDKKADPKLGID

SEQ ID NO: 1140336 - protein, 26 aa, Mycobacterium
LVFSVVMFALFRLLAPLERHPLPWWD

SEQ ID NO: 1140337 - protein, 20 aa, Mycobacterium
LVFVINYLKEVVGELRKVIW

SEQ ID NO: 1140338 - protein, 23 aa, Mycobacterium
LVGAAVVRLARAWSLAVSMVALV

SEQ ID NO: 1140339 - protein, 25 aa, Mycobacterium
LVGCLVLAFTLPLTSVLAGAAVVLV

SEQ ID NO: 1140340 - protein, 19 aa, Mycobacterium
LVGDRYLELLDAPGSTKLQ

SEQ ID NO: 1140341 - protein, 27 aa, Mycobacterium
LVGGQAMIWLTWPFGAAGALGAFGGTV

SEQ ID NO: 1140342 - protein, 25 aa, Mycobacterium
LVGIIEPFLMKPVIDMFGYRGVFVA

SEQ ID NO: 1140343 - protein, 19 aa, Mycobacterium
LVGLFVMLIVLVEPLGWAI

SEQ ID NO: 1140344 - protein, 22 aa, Mycobacterium
LVGTLLVGEYLAGALIAVMLSG

SEQ ID NO: 1140345 - protein, 27 aa, Mycobacterium
LVGTVLFLLFVYWNVSVKHWFTGPIKQ

SEQ ID NO: 1140346 - protein, 30 aa, Mycobacterium
LVGVNPVLLWLLMPVVVFGSAYVPEIASFT

SEQ ID NO: 1140347 - protein, 18 aa, Mycobacterium
LVHSPTLPRREVLKVLQP

SEQ ID NO: 1140348 - protein, 24 aa, Mycobacterium
LVIAAVFVLLVLPPALGVFGRKLF

SEQ ID NO: 1140349 - protein, 26 aa, Mycobacterium
LVIAYCLGLGIPFVLLAFGSARAVAG

SEQ ID NO: 1140350 - protein, 18 aa, Mycobacterium
LVIAYGLARWFTTTYRIG

SEQ ID NO: 1140351 - protein, 17 aa, Mycobacterium
LVILLMSASTLAIGLVP

SEQ ID NO: 1140352 - protein, 17 aa, Mycobacterium
LVLAIAGPALLGFAYGE

SEQ ID NO: 1140353 - protein, 18 aa, Mycobacterium
LVLAVVMAVITIPAHFFG

SEQ ID NO: 1140354 - protein, 23 aa, Mycobacterium
LVLIACLAMVFAIQNATARQFGV

SEQ ID NO: 1140355 - protein, 17 aa, Mycobacterium
LVLPPELARRLTVTTQQ

SEQ ID NO: 1140356 - protein, 18 aa, Mycobacterium
LVLSAILGSIAAPKLKWL

SEQ ID NO: 1140357 - protein, 31 aa, Mycobacterium
LVLSLPVVFYSAWIFFDGAFRALRARTLDMM

SEQ ID NO: 1140358 - protein, 18 aa, Mycobacterium
LVMLKYLAFGLLTALLLD

SEQ ID NO: 1140359 - protein, 25 aa, Mycobacterium
LVNDALMTFFFFIVGLEVTREFTIG

SEQ ID NO: 1140360 - protein, 18 aa, Mycobacterium
LVPNFLKPFFSWFANINF

SEQ ID NO: 1140361 - protein, 23 aa, Mycobacterium
LVPRKKELWLRAANVAAFVLMIC

SEQ ID NO: 1140362 - protein, 17 aa, Mycobacterium
LVPSWLALASTGFDVAL

SEQ ID NO: 1140363 - protein, 29 aa, Mycobacterium
LVPTTALLDKYSPSFFCMIRNYHDVEPKI

SEQ ID NO: 1140364 - protein, 20 aa, Mycobacterium
LVPVAFALLSLWLTRRGRIP

SEQ ID NO: 1140365 - protein, 18 aa, Mycobacterium
LVQGAPVTLALKALRAAD

SEQ ID NO: 1140366 - protein, 17 aa, Mycobacterium
LVQKGIDDGIPPLLAGE

SEQ ID NO: 1140367 - protein, 17 aa, Mycobacterium
LVQQLFVIITASIGLLM

SEQ ID NO: 1140368 - protein, 17 aa, Mycobacterium
LVRALFLEKALDQFYQA

SEQ ID NO: 1140369 - protein, 24 aa, Mycobacterium
LVRLTASWPRRRTLLLTLVCLTAS

SEQ ID NO: 1140370 - protein, 28 aa, Mycobacterium
LVRMVLVPAFMRVLGRWNWWSPKPLARL

SEQ ID NO: 1140371 - protein, 30 aa, Mycobacterium
LVRPTDRFEALVVTLAIVVVLLAVPVAAAI

SEQ ID NO: 1140372 - protein, 19 aa, Mycobacterium
LVSADWLWVLAAAAAAMAS

SEQ ID NO: 1140373 - protein, 24 aa, Mycobacterium
LVSGWRGARWWRRTAATLAVPLCV

SEQ ID NO: 1140374 - protein, 18 aa, Mycobacterium
LVSKVALPLTDFAPVVIP

SEQ ID NO: 1140375 - protein, 25 aa, Mycobacterium
LVSLSVPIIALLLGAPIPGARVAFR

SEQ ID NO: 1140376 - protein, 19 aa, Mycobacterium
LVSWSLFTWMIARLPRESV

SEQ ID NO: 1140377 - protein, 17 aa, Mycobacterium
LVTRVMKRPLIYAIPII

SEQ ID NO: 1140378 - protein, 20 aa, Mycobacterium
LVVAVPLLAAAAPRFVLGAI

SEQ ID NO: 1140379 - protein, 24 aa, Mycobacterium
LVVCALSSLWWPLHAGTGNLDLTP

SEQ ID NO: 1140380 - protein, 19 aa, Mycobacterium
LVVFGAVMLLLYPLALVWP

SEQ ID NO: 1140381 - protein, 17 aa, Mycobacterium
LVVGWFDAERRGLVMGI

SEQ ID NO: 1140382 - protein, 27 aa, Mycobacterium
LVVLFYSTFFFFFFAAELLDTWLWRWA

SEQ ID NO: 1140383 - protein, 39 aa, Mycobacterium
LVVLFYSTFFFFFFLAELLDNWLWKWASYLIVFGIMVVL

SEQ ID NO: 1140384 - protein, 18 aa, Mycobacterium
LVVLSLFGFDFDTVGRRQ

SEQ ID NO: 1140385 - protein, 30 aa, Mycobacterium
LVVLTALGSFVLLAALISVPVLSQVFGCTP

SEQ ID NO: 1140386 - protein, 22 aa, Mycobacterium
LVVNLWVGYFPTVQTAWNQLTA

SEQ ID NO: 1140387 - protein, 19 aa, Mycobacterium
LVVQLFGLTASPISWAHHW

SEQ ID NO: 1140388 - protein, 20 aa, Mycobacterium
LVVTVIQLVRRKTAWPFAVG

SEQ ID NO: 1140389 - protein, 20 aa, Mycobacterium
LVVVFGEFRFASEDKYHATF

SEQ ID NO: 1140390 - protein, 18 aa, Mycobacterium
LVVVGAVIALLIFASLFV

SEQ ID NO: 1140391 - protein, 26 aa, Mycobacterium
LVVVGGGVLAFLYMRRNREPALAGVG

SEQ ID NO: 1140392 - protein, 17 aa, Mycobacterium
LVVVVICIFYLVPQYQG

SEQ ID NO: 1140393 - protein, 42 aa, Mycobacterium
LVYLAYGVSILALPFVILVGLIIVRQWRLLGAFAAAGVIAIL

SEQ ID NO: 1140394 - protein, 21 aa, Mycobacterium
LVYPRALGIVLVILVIIAAME

SEQ ID NO: 1140395 - protein, 19 aa, Mycobacterium
LWFGAIAYLLIIEPPLYFP

SEQ ID NO: 1140396 - protein, 34 aa, Mycobacterium
LWGPPLAQRLPWRWLPWLSWTVSCAWAFSLAMVD

SEQ ID NO: 1140397 - protein, 17 aa, Mycobacterium
LWISMDFVDGHDAARLL

SEQ ID NO: 1140398 - protein, 21 aa, Mycobacterium
LWLLTTIALAAAVPTVWAQTH

SEQ ID NO: 1140399 - protein, 25 aa, Mycobacterium
LWLVFALFFLFPLYAMADFSTRDLI

SEQ ID NO: 1140400 - protein, 17 aa, Mycobacterium
LWNFGQVVDRVGGCGAA

SEQ ID NO: 1140401 - protein, 20 aa, Mycobacterium
LWNPRTWWQSIAVWFAAAVV

SEQ ID NO: 1140402 - protein, 20 aa, Mycobacterium
LWPHSWPFVAQVLTAILVAD

SEQ ID NO: 1140403 - protein, 21 aa, Mycobacterium
LWPLPMFALAAALACGIAMPE

SEQ ID NO: 1140404 - protein, 19 aa, Mycobacterium
LWQVRELQFAVLAAVLLSV

SEQ ID NO: 1140405 - protein, 33 aa, Mycobacterium; identical to SEQ ID NO: 363081

SEQ ID NO: 1140406 - protein, 17 aa, Mycobacterium
LWRFINATDIHPPGSYL

SEQ ID NO: 1140407 - protein, 17 aa, Mycobacterium
LWRIHLTSVLLVVPQVM

SEQ ID NO: 1140408 - protein, 21 aa, Mycobacterium
LWRLGIFVVVCALGAFALIAV

SEQ ID NO: 1140409 - protein, 18 aa, Mycobacterium
LWRQLVGGSYLWWALAVI

SEQ ID NO: 1140410 - protein, 31 aa, Mycobacterium
LWSVASGTGLAGWLLLRMRLNRMRFQAWDRE

SEQ ID NO: 1140411 - protein, 24 aa, Mycobacterium
LWTIGLMCFWPNLIAYWAGKPPVR

SEQ ID NO: 1140412 - protein, 20 aa, Mycobacterium
LWVEGDWRSLLLPATTAVAA

SEQ ID NO: 1140413 - protein, 18 aa, Mycobacterium
LWVTLVFPAWVGAVSLMV

SEQ ID NO: 1140414 - protein, 27 aa, Mycobacterium
LYAGGFTMFMLIPLGIVLGALVAFIIF

SEQ ID NO: 1140415 - protein, 18 aa, Mycobacterium
LYECLTGVRPYPADSLEE

SEQ ID NO: 1140416 - protein, 18 aa, Mycobacterium
LYGSALAWWAPPVLRRMT

SEQ ID NO: 1140417 - protein, 24 aa, Mycobacterium
LYLPEYLVFRIVRSYFTLAAVLSL

SEQ ID NO: 1140418 - protein, 17 aa, Mycobacterium
LYPLICAAGLYRLARVM

SEQ ID NO: 1140419 - protein, 17 aa, Mycobacterium
LYVLRRVTLPLLAPVLV

SEQ ID NO: 1140420 - protein, 17 aa, Mycobacterium
MAAAIVGPPLFRDHLHQ

SEQ ID NO: 1140421 - protein, 25 aa, Mycobacterium
MAGGALTMFLWELRLGTSVETARTM

SEQ ID NO: 1140422 - protein, 22 aa, Mycobacterium
MAGIYLAAVYRLSRRGSPWSTR

SEQ ID NO: 1140423 - protein, 25 aa, Mycobacterium
MALQYQKLPFLNPGKQYSAYFADAG

SEQ ID NO: 1140424 - protein, 49 aa, Mycobacterium
MAMIPALQFTYWQWASLTLAAPVVVWAAWPFHRAAWANLRHGTATMDTL

SEQ ID NO: 1140425 - protein, 26 aa, Mycobacterium
MAQGFGYLLAGLGPFLFGLLHDVTDG

SEQ ID NO: 1140426 - protein, 36 aa, Mycobacterium
MARIPRGVLPTIPAWLWFLLLLGAVTAAFAGGDPVI

SEQ ID NO: 1140427 - protein, 22 aa, Mycobacterium
MARLRLVGIGVPVAVGLLAGLI

SEQ ID NO: 1140428 - protein, 20 aa, Mycobacterium
MARPFIAFYNWCANATLRAF

SEQ ID NO: 1140429 - protein, 23 aa, Mycobacterium
MARRKLLLALMALFTIGNLASML

SEQ ID NO: 1140430 - protein, 28 aa, Mycobacterium
MASIIVAAAVFTYLSYTAAFTSTDTVTV

SEQ ID NO: 1140431 - protein, 29 aa, Mycobacterium
MASTVLWVSEIRKLLLRVLDHRRHVAAHA

SEQ ID NO: 1140432 - protein, 23 aa, Mycobacterium
MAVALPLSFPSLGEMAQKHPLAI

SEQ ID NO: 1140433 - protein, 17 aa, Mycobacterium
MAVLAVTAFLIAASPLA

SEQ ID NO: 1140434 - protein, 31 aa, Mycobacterium
MAVVVLFVPAALPWYYTWPLAVVAALATSRR

SEQ ID NO: 1140435 - protein, 22 aa, Mycobacterium
MCVALVVYFVLLGRAALMLITS

SEQ ID NO: 1140436 - protein, 36 aa, Mycobacterium
MDAARNYLFPIYAGLLTPWWLRLLGAKVGKGTEIST

SEQ ID NO: 1140437 - protein, 25 aa, Mycobacterium
MDFEGAFLAFNLNVNIPPPCTTGFL

SEQ ID NO: 1140438 - protein, 28 aa, Mycobacterium
MDKIDGPYYFFGVLSALAALPGFTPMLL

SEQ ID NO: 1140439 - protein, 29 aa, Mycobacterium
MDPFNPTEFPIALLLNVTNPLRAEFGNDR

SEQ ID NO: 1140440 - protein, 36 aa, Mycobacterium
MDRVDTPWLYLSFIGIGWLVGYLMRIQQELLLEQRE

SEQ ID NO: 1140441 - protein, 34 aa, Mycobacterium
MDTLISLGTVSAFLWSLYALFLGSAGTPGMKHPF

SEQ ID NO: 1140442 - protein, 22 aa, Mycobacterium
MDYEVFLMSRIREFWLASGRTA

SEQ ID NO: 1140443 - protein, 28 aa, Mycobacterium
MDYEVFLMSRIREFWLKSGRTRQDNDES

SEQ ID NO: 1140444 - protein, 18 aa, Mycobacterium
MEIVGWRALWGLGNALFI

SEQ ID NO: 1140445 - protein, 29 aa, Mycobacterium
MELLARLGLAVLLFLVGLRLDLHMIRNTG

SEQ ID NO: 1140446 - protein, 26 aa, Mycobacterium
MENSTAPWYLSLAVMVALVVVGALGG

SEQ ID NO: 1140447 - protein, 17 aa, Mycobacterium
MEPLAWALCLFPVVIGM

SEQ ID NO: 1140448 - protein, 17 aa, Mycobacterium
MERWLQPLSNAGIFLVA

SEQ ID NO: 1140449 - protein, 31 aa, Mycobacterium
MESIAIPFSFLVLVWVFGGLLAAAVPVGVGL

SEQ ID NO: 1140450 - protein, 25 aa, Mycobacterium
METGLIYLPIAIGALLFSPLSGRLV

SEQ ID NO: 1140451 - protein, 25 aa, Mycobacterium
MFIASIICALFGFIWDVSLHIGNGR

SEQ ID NO: 1140452 - protein, 24 aa, Mycobacterium
MFKPPFQWREFLLQTWFVARVSMV

SEQ ID NO: 1140453 - protein, 22 aa, Mycobacterium
MFRMPIFTWNILVTSILVLIAF

SEQ ID NO: 1140454 - protein, 36 aa, Mycobacterium
MFRMPIFTWNILVTSILVLLAFPLLTAALFALAADR

SEQ ID NO: 1140455 - protein, 37 aa, Mycobacterium; identical to SEQ ID NO: 363294

SEQ ID NO: 1140456 - protein, 26 aa, Mycobacterium
MFSDPLSIVLAVVIVVALTAAGLLGG

SEQ ID NO: 1140457 - protein, 27 aa, Mycobacterium
MFSMHMIAHMLLSMLAPILLVLGAPVT

SEQ ID NO: 1140458 - protein, 19 aa, Mycobacterium
MFVAQRQGRRLAWTAAVCA

SEQ ID NO: 1140459 - protein, 26 aa, Mycobacterium
MGAASYALIGFWWREQYRVSDGLTAF

SEQ ID NO: 1140460 - protein, 21 aa, Mycobacterium
MGAFLVMVGLILVVLAVVSFL

SEQ ID NO: 1140461 - protein, 20 aa, Mycobacterium
MGLGVLLFSLAVGALFAVVF

SEQ ID NO: 1140462 - protein, 25 aa, Mycobacterium
MGNLKYLFFGLALVVLMIFRPQGLF

SEQ ID NO: 1140463 - protein, 30 aa, Mycobacterium
MGVGITEAVLWFIRRWLVSRATMGVEADIR

SEQ ID NO: 1140464 - protein, 17 aa, Mycobacterium
MGYLAISLWVMADDAVR

SEQ ID NO: 1140465 - protein, 21 aa, Mycobacterium
MGYRDALIGGMLLAAALRGQD

SEQ ID NO: 1140466 - protein, 34 aa, Mycobacterium
MHAPAHWNIAFIRRFMLTFGPVSSLFDFLTFGLM

SEQ ID NO: 1140467 - protein, 17 aa, Mycobacterium
MHPVFNLASARLILGTA

SEQ ID NO: 1140468 - protein, 25 aa, Mycobacterium
MHTGLIYLPIAIGALLFSPLSGRLV

SEQ ID NO: 1140469 - protein, 17 aa, Mycobacterium
MILVLGLLVALGPLTID

SEQ ID NO: 1140470 - protein, 18 aa, Mycobacterium
MIRYAIPPLLILAPLWLI

SEQ ID NO: 1140471 - protein, 23 aa, Mycobacterium
MISFTTILWNLSGPVTLPFVGFE

SEQ ID NO: 1140472 - protein, 18 aa, Mycobacterium
MKAAIMVALLFRTLDAWR

SEQ ID NO: 1140473 - protein, 24 aa, Mycobacterium
MKVYGYIFAAVTLLAMGLLLPSVQ

SEQ ID NO: 1140474 - protein, 20 aa, Mycobacterium
MLAAVLLLRLFDENTSLTVV

SEQ ID NO: 1140475 - protein, 22 aa, Mycobacterium
MLALGIVAVFLPALRDLDRPAA

SEQ ID NO: 1140476 - protein, 24 aa, Mycobacterium
MLARFLFHCWVALTVLIAVLTVVS

SEQ ID NO: 1140477 - protein, 17 aa, Mycobacterium
MLARYQARRMVWEAEIR

SEQ ID NO: 1140478 - protein, 21 aa, Mycobacterium
MLGLTLFCLWPFTRLVHAFSA

SEQ ID NO: 1140479 - protein, 18 aa, Mycobacterium
MLGLYWCALGLVIAVALS

SEQ ID NO: 1140480 - protein, 17 aa, Mycobacterium
MLHTVAALAMWLGSAVT

SEQ ID NO: 1140481 - protein, 20 aa, Mycobacterium
MLLGGSWLTWILAAVSSTLI

SEQ ID NO: 1140482 - protein, 23 aa, Mycobacterium
MLLSLYVVPTLKYPASPPALSLD

SEQ ID NO: 1140483 - protein, 26 aa, Mycobacterium
MLLVAAWFAVFALPLLISPPPVLAQT

SEQ ID NO: 1140484 - protein, 30 aa, Mycobacterium
MLPGVALAALLGISLLIGGLVAALVMAVGV

SEQ ID NO: 1140485 - protein, 19 aa, Mycobacterium
MLRELAWVVVLPEHHRAIA

SEQ ID NO: 1140486 - protein, 19 aa, Mycobacterium
MLSIPFTVLTVFTLNVLLL

SEQ ID NO: 1140487 - protein, 21 aa, Mycobacterium
MLTGMQWVVWLAVANNVAAEL

SEQ ID NO: 1140488 - protein, 18 aa, Mycobacterium
MLTMPYSVLLVFTFNILL

SEQ ID NO: 1140489 - protein, 17 aa, Mycobacterium
MLVLIAVAMTFGPAMVT

SEQ ID NO: 1140490 - protein, 17 aa, Mycobacterium
MLVNIPANRKRVVAVSF

SEQ ID NO: 1140491 - protein, 19 aa, Mycobacterium
MLWALGANPGLIGAASAAL

SEQ ID NO: 1140492 - protein, 25 aa, Mycobacterium
MMFALRYRWWVVLSAITAATAVVHV

SEQ ID NO: 1140493 - protein, 30 aa, Mycobacterium
MMGMGPLGPLLLLVAFGLLGFAAFQLWMAR

SEQ ID NO: 1140494 - protein, 32 aa, Mycobacterium
MMLAHALAAVALGLLICLVGHLYRVCASVLCW

SEQ ID NO: 1140495 - protein, 17 aa, Mycobacterium
MMLLRYIRADLSAERPG

SEQ ID NO: 1140496 - protein, 25 aa, Mycobacterium
MNATQLVLGTSRRSRWARIFDEGIG

SEQ ID NO: 1140497 - protein, 25 aa, Mycobacterium
MNFVIGLVLIYAIALIWGLPNITAP

SEQ ID NO: 1140498 - protein, 17 aa, Mycobacterium
MNQLLAVVRFPLLLAGR

SEQ ID NO: 1140499 - protein, 23 aa, Mycobacterium
MNSFGWRIPFLIAGALGAVGLYI

SEQ ID NO: 1140500 - protein, 24 aa, Mycobacterium
MNSLTLMSALALALVYGLGGALAL

SEQ ID NO: 1140501 - protein, 29 aa, Mycobacterium
MPFAYAVYWTVHALVIFWLGQLLVKKLGW

SEQ ID NO: 1140502 - protein, 23 aa, Mycobacterium
MPGEIPYQVQLPPGAAQPAAPPD

SEQ ID NO: 1140503 - protein, 17 aa, Mycobacterium
MPLGIAYGIWAAAGVAL

SEQ ID NO: 1140504 - protein, 22 aa, Mycobacterium
MPRWTAVITYLVAALLIVVVSL

SEQ ID NO: 1140505 - protein, 17 aa, Mycobacterium
MPVAVNLFAPFLRDAQL

SEQ ID NO: 1140506 - protein, 27 aa, Mycobacterium
MPVSQFTVIFLVGILLGAGTDYSVFFI

SEQ ID NO: 1140507 - protein, 24 aa, Mycobacterium
MRAAMAGHMFTFIPGPALIGAVVH

SEQ ID NO: 1140508 - protein, 19 aa, Mycobacterium
MRIFAEFMPVHFFAQPVVT

SEQ ID NO: 1140509 - protein, 20 aa, Mycobacterium
MRKIHTFAIPPNMVAPLLAL

SEQ ID NO: 1140510 - protein, 40 aa, Mycobacterium
MRMTRLLALLATFLTAGVLLAPVTAAAPPFRLPGYVTDQA

SEQ ID NO: 1140511 - protein, 20 aa, Mycobacterium
MRPLRYVIFGFAVSAVLCPL

SEQ ID NO: 1140512 - protein, 29 aa, Mycobacterium
MRQRWEAALPGIFGGLLNLAATVHYLLET

SEQ ID NO: 1140513 - protein, 26 aa, Mycobacterium
MRQYWRQPEHFYWLTSFLAAREAQSA

SEQ ID NO: 1140514 - protein, 32 aa, Mycobacterium
MRRQAAITLAPWLLTAAILVPLNLHAPATVFV

SEQ ID NO: 1140515 - protein, 18 aa, Mycobacterium
MRRWSMLAIGLLATLCAN

SEQ ID NO: 1140516 - protein, 18 aa, Mycobacterium
MSEVHLARDLRLHRDVAI

SEQ ID NO: 1140517 - protein, 27 aa, Mycobacterium
MSFVLQQFVLFILPKLIPGYGGPNAQQ

SEQ ID NO: 1140518 - protein, 17 aa, Mycobacterium
MSGPWVGIAAPGENITS

SEQ ID NO: 1140519 - protein, 25 aa, Mycobacterium
MSLDTFILMFQRPFAFREYVIQTWF

SEQ ID NO: 1140520 - protein, 33 aa, Mycobacterium
MSLSGFEHPWFFLFFLVVLGLVALYVIVQMGRH

SEQ ID NO: 1140521 - protein, 32 aa, Mycobacterium
MSMIPALQFTNWQWLALTLASPVVVWGALPFH

SEQ ID NO: 1140522 - protein, 17 aa, Mycobacterium
MSPYQILTVASLVQREA

SEQ ID NO: 1140523 - protein, 31 aa, Mycobacterium
MSTSAYDIGLFYRYAWQNPVFTDIVATRSSN

SEQ ID NO: 1140524 - protein, 20 aa, Mycobacterium
MSVWKFLALLGYAALYAYVA

SEQ ID NO: 1140525 - protein, 24 aa, Mycobacterium
MTAVVALLTLLVGVGVGVALTPRV

SEQ ID NO: 1140526 - protein, 19 aa, Mycobacterium
MTFWELLQQGLIITLVVIV

SEQ ID NO: 1140527 - protein, 25 aa, Mycobacterium
MTGNVIFLGFWFVPHSGVDLTAALV

SEQ ID NO: 1140528 - protein, 28 aa, Mycobacterium
MTIGTLAAFLLYLRMFFEPMQEISQFFN

SEQ ID NO: 1140529 - protein, 18 aa, Mycobacterium
MTILSMSFVPLLVVPNSG

SEQ ID NO: 1140530 - protein, 25 aa, Mycobacterium
MTLASRGRWALVPLAVVIAADGIRS

SEQ ID NO: 1140531 - protein, 28 aa, Mycobacterium
MTPAVAALLGRWFWWPQKVRSHASQRRL

SEQ ID NO: 1140532 - protein, 27 aa, Mycobacterium
MTQHRTTQWPVVVGGSLSFAVASAGVL

SEQ ID NO: 1140533 - protein, 19 aa, Mycobacterium
MTRSEMIARLVFAMGGRAA

SEQ ID NO: 1140534 - protein, 22 aa, Mycobacterium
MTRYYAAQRTFWVDPVSGTIVK

SEQ ID NO: 1140535 - protein, 30 aa, Mycobacterium
MTSALNVIFWFTLFVWVLGRPDAIGPLFPP

SEQ ID NO: 1140536 - protein, 36 aa, Mycobacterium
MTTGRRLGVTFAVAAALFVLIALSPAALQVHLTVFA

SEQ ID NO: 1140537 - protein, 23 aa, Mycobacterium
MTVAFPIWVLIVSLLLLVRAGVI

SEQ ID NO: 1140538 - protein, 28 aa, Mycobacterium
MTVIAFLPPLPIILVLCAIVGFVYGPIA

SEQ ID NO: 1140539 - protein, 34 aa, Mycobacterium
MVADDVVLAVLPFFHIYGMTVLLNAALHARARLV

SEQ ID NO: 1140540 - protein, 24 aa, Mycobacterium
MVAMGGFLLLRTQPLLAATGWAAT

SEQ ID NO: 1140541 - protein, 17 aa, Mycobacterium
MVAPAAQPLLWSVLIGI

SEQ ID NO: 1140542 - protein, 26 aa, Mycobacterium
MVDAPLWFHIHVMLGLTLFCLWPFTR

SEQ ID NO: 1140543 - protein, 17 aa, Mycobacterium
MVDGRLHPALNLMSARL

SEQ ID NO: 1140544 - protein, 25 aa, Mycobacterium
MVDSCRNLWFHTGDLGRIDDAGYFY

SEQ ID NO: 1140545 - protein, 29 aa, Mycobacterium
MVELIWQWTPFMMLLILAGLQSMPRDILE

SEQ ID NO: 1140546 - protein, 17 aa, Mycobacterium
MVFSLTVLVLALALFRD

SEQ ID NO: 1140547 - protein, 31 aa, Mycobacterium; identical to SEQ ID NO: 347885

SEQ ID NO: 1140548 - protein, 33 aa, Mycobacterium
MVGALADWFAVTALFKHPLGIPIPHTAIIKRKK

SEQ ID NO: 1140549 - protein, 18 aa, Mycobacterium
MVLATRGGPRRRAEVAAF

SEQ ID NO: 1140550 - protein, 17 aa, Mycobacterium
MVLFTRPGPHRGAVGHR

SEQ ID NO: 1140551 - protein, 19 aa, Mycobacterium
MVPTHIVMLPSLPRNERGK

SEQ ID NO: 1140552 - protein, 25 aa, Mycobacterium
MVSELDRFETLLSDLLEISRHDAGV

SEQ ID NO: 1140553 - protein, 18 aa, Mycobacterium
MVSLLVCLIPTTIGALLS

SEQ ID NO: 1140554 - protein, 25 aa, Mycobacterium
MVTALILFIYVFLALLTNGTKVLDL

SEQ ID NO: 1140555 - protein, 18 aa, Mycobacterium
MVTKLRLIKLAQTGTIVG

SEQ ID NO: 1140556 - protein, 17 aa, Mycobacterium
MVTSVRLLATTGATLIS

SEQ ID NO: 1140557 - protein, 26 aa, Mycobacterium
MWGGWGWGGWILMGVVMVLLSGALIT

SEQ ID NO: 1140558 - protein, 24 aa, Mycobacterium
MWGGWGWSGWILMGAVMVLSSAAL

SEQ ID NO: 1140559 - protein, 25 aa, Mycobacterium
MWGGWGWSGWILMSAVMVLFSAALI

SEQ ID NO: 1140560 - protein, 17 aa, Mycobacterium
MWLPAHLAWFAGGMALA

SEQ ID NO: 1140561 - protein, 20 aa, Mycobacterium
MWQALRYAAPAFLVPIAFVL

SEQ ID NO: 1140562 - protein, 18 aa, Mycobacterium
MWRNPVMFIVEIGAVWST

SEQ ID NO: 1140563 - protein, 18 aa, Mycobacterium
MYATRRIYRPLWSRFAPT

SEQ ID NO: 1140564 - protein, 19 aa, Mycobacterium
MYGAYLIGAGALIGAAGGL

SEQ ID NO: 1140565 - protein, 24 aa, Mycobacterium
MYGDFFSFYLCDLIVKVNGKGGQP

SEQ ID NO: 1140566 - protein, 18 aa, Mycobacterium
MYLTQRFMMRWRVWLSRR

SEQ ID NO: 1140567 - protein, 29 aa, Mycobacterium
MYTGLMRMRWFALAMLGISLIWTAAHYRR

SEQ ID NO: 1140568 - protein, 18 aa, Mycobacterium
NAALPWSKTIVLNPGVTL

SEQ ID NO: 1140569 - protein, 25 aa, Mycobacterium
NAFACRSADMPVWRVSVRTNWLLVV

SEQ ID NO: 1140570 - protein, 25 aa, Mycobacterium
NAGAAPWLGLWISQVVSVSAMQWWL

SEQ ID NO: 1140571 - protein, 22 aa, Mycobacterium
NAGTDEPRTVRWTLRLDVTDVD

SEQ ID NO: 1140572 - protein, 17 aa, Mycobacterium
NAHFQIAWQFVSALYLT

SEQ ID NO: 1140573 - protein, 19 aa, Mycobacterium
NAIIFAAAGFWWFVMPVPS

SEQ ID NO: 1140574 - protein, 25 aa, Mycobacterium
NAKSRPAVQVGALLAAGAGIGLVVW

SEQ ID NO: 1140575 - protein, 26 aa, Mycobacterium
NALAALAFWATIYLPAADFYPNQEHF

SEQ ID NO: 1140576 - protein, 17 aa, Mycobacterium
NALAILIFMSQVPHLLG

SEQ ID NO: 1140577 - protein, 22 aa, Mycobacterium
NAPPSFIIVTIACGVWAVVWAV

SEQ ID NO: 1140578 - protein, 29 aa, Mycobacterium
NARDFLRIDIIIFGLIVYALLGIGTDAVV

SEQ ID NO: 1140579 - protein, 22 aa, Mycobacterium
NARPIRGVLALHLRLQRGQTLG

SEQ ID NO: 1140580 - protein, 20 aa, Mycobacterium
NARYLARMTALLGDSLFTNG

SEQ ID NO: 1140581 - protein, 37 aa, Mycobacterium
NAVVWTVVLALPGPAPLWLLIVLIVVISVGGPGSMVG

SEQ ID NO: 1140582 - protein, 40 aa, Mycobacterium
NAYPIALYTALPLQAISVLLTPISRLLVLIGNALTPGRGF

SEQ ID NO: 1140583 - protein, 30 aa, Mycobacterium; identical to SEQ ID NO: 363860

SEQ ID NO: 1140584 - protein, 26 aa, Mycobacterium
NDGLAWGLFPILFASAGLSVGRIGVL

SEQ ID NO: 1140585 - protein, 28 aa, Mycobacterium
NDIAKYFAIIPALFVGLFPGLDLLNVMR

SEQ ID NO: 1140586 - protein, 19 aa, Mycobacterium
NDRVIQRVFGLGLGLTAAS

SEQ ID NO: 1140587 - protein, 25 aa, Mycobacterium
NEAAFLLLRFLIALPVGALLGGWLA

SEQ ID NO: 1140588 - protein, 27 aa, Mycobacterium
NEAPAQLWVFWIAPLLGAAIAGAAYPY

SEQ ID NO: 1140589 - protein, 23 aa, Mycobacterium
NEDQPFNFITPVSGFKELLGQAN

SEQ ID NO: 1140590 - protein, 25 aa, Mycobacterium
NEIALNILLASLTIIFVFAVTTLQP

SEQ ID NO: 1140591 - protein, 29 aa, Mycobacterium
NEQGPPPPPWPYFAPPDQVVPPYGRPPLA

SEQ ID NO: 1140592 - protein, 22 aa, Mycobacterium
NEQLLLRILGLTLIVAALAEFI

SEQ ID NO: 1140593 - protein, 20 aa, Mycobacterium
NETLVLCVIALFAVNVVLTT

SEQ ID NO: 1140594 - protein, 24 aa, Mycobacterium
NFALHSTFRWPLSAAAALWIVATL

SEQ ID NO: 1140595 - protein, 20 aa, Mycobacterium
NFASGRMFFTPATGAHFMQG

SEQ ID NO: 1140596 - protein, 24 aa, Mycobacterium
NFEKYAWLFMRFSGIVLVFLALGH

SEQ ID NO: 1140597 - protein, 17 aa, Mycobacterium
NFFAWALSVMFLVFTLR

SEQ ID NO: 1140598 - protein, 17 aa, Mycobacterium
NFGLFTLVWDHLMRTFS

SEQ ID NO: 1140599 - protein, 17 aa, Mycobacterium
NFGLFTLVWDHLMRTYA

SEQ ID NO: 1140600 - protein, 18 aa, Mycobacterium
NFGLFTLVWDHLMRTYSY

SEQ ID NO: 1140601 - protein, 28 aa, Mycobacterium
NFGRVGALLFWIALAGLTPTGLMLAATI

SEQ ID NO: 1140602 - protein, 19 aa, Mycobacterium
NFKNGVGLMLQLPEPAKIG

SEQ ID NO: 1140603 - protein, 28 aa, Mycobacterium
NGEQLLLTMFIPITLLVGLTLLPLGSFG

SEQ ID NO: 1140604 - protein, 29 aa, Mycobacterium
NGGNFIVGPLPLMQRLMGRVGMIDSVLVV

SEQ ID NO: 1140605 - protein, 23 aa, Mycobacterium
NGILMLAFAAIAFIVAFRAEVTA

SEQ ID NO: 1140606 - protein, 23 aa, Mycobacterium
NGIPRLPVVAALLVEPLVAAVLG

SEQ ID NO: 1140607 - protein, 24 aa, Mycobacterium
NGIWSRYPLTPLSPTRYWNSGMVA

SEQ ID NO: 1140608 - protein, 23 aa, Mycobacterium
NGLRPAIWDAFTERFGIKRVCEF

SEQ ID NO: 1140609 - protein, 17 aa, Mycobacterium
NGLVCLIGLSGGYVFSV

SEQ ID NO: 1140610 - protein, 19 aa, Mycobacterium
NGPDLAWFTGFIALMGWVC

SEQ ID NO: 1140611 - protein, 25 aa, Mycobacterium
NGSLLLVQPILVSALLFALPLSARL

SEQ ID NO: 1140612 - protein, 25 aa, Mycobacterium
NHDWPFASTAFTSALPWLAGRIGTP

SEQ ID NO: 1140613 - protein, 21 aa, Mycobacterium
NHKITWLAGLADWSARRFKRP

SEQ ID NO: 1140614 - protein, 17 aa, Mycobacterium
NHMIFLLMAAHDTTAIA

SEQ ID NO: 1140615 - protein, 39 aa, Mycobacterium
NHYFTTFLNPRDLLWSFLQAILMAMAVLLVHTYFGYFAT

SEQ ID NO: 1140616 - protein, 22 aa, Mycobacterium
NIEQLLVLLPQAVAVSQAGILA

SEQ ID NO: 1140617 - protein, 17 aa, Mycobacterium
NIHMPLVRTPMIAPSGR

SEQ ID NO: 1140618 - protein, 18 aa, Mycobacterium
NIKEIPPPVYVPPPDRSP

SEQ ID NO: 1140619 - protein, 19 aa, Mycobacterium
NILLILGVTCLVSSSGVIL

SEQ ID NO: 1140620 - protein, 22 aa, Mycobacterium
NISSVALIWFGGLRIDAGQMQV

SEQ ID NO: 1140621 - protein, 24 aa, Mycobacterium
NITGPDAYWRFLMEGRSAVRQVPE

SEQ ID NO: 1140622 - protein, 24 aa, Mycobacterium
NIVEAVLFHRLVVLLGVGLIVWAT

SEQ ID NO: 1140623 - protein, 21 aa, Mycobacterium
NIVGQRYLGLSLGNTGDPRPL

SEQ ID NO: 1140624 - protein, 35 aa, Mycobacterium
NKPRTPPYKIAGLVLLVIFAVVATLVAFQFRGDFA

SEQ ID NO: 1140625 - protein, 25 aa, Mycobacterium
NKSLEQALVIFPALLAALNTVAGGV

SEQ ID NO: 1140626 - protein, 26 aa, Mycobacterium
NLALNAGWSWVFFNRRMLGPAAVVAA

SEQ ID NO: 1140627 - protein, 25 aa, Mycobacterium
NLARLFQLLAWGALAVYLLWRSGDG

SEQ ID NO: 1140628 - protein, 20 aa, Mycobacterium
NLELYLIFPLNNEESTISLV

SEQ ID NO: 1140629 - protein, 18 aa, Mycobacterium
NLEYIGMSQLAGAPGDDP

SEQ ID NO: 1140630 - protein, 18 aa, Mycobacterium
NLFEVLGVDRLLDDGCYG

SEQ ID NO: 1140631 - protein, 18 aa, Mycobacterium
NLFVTYWAFRAMIGLLLV

SEQ ID NO: 1140632 - protein, 26 aa, Mycobacterium
NLGYALQWPMFAGFCVYAYYKFVRYE

SEQ ID NO: 1140633 - protein, 20 aa, Mycobacterium
NLGYAMQWPLFAGFCVYAYF

SEQ ID NO: 1140634 - protein, 17 aa, Mycobacterium
NLIFVAVVLGMLLAALD

SEQ ID NO: 1140635 - protein, 19 aa, Mycobacterium
NLIPLLPLDGGHISIALYE

SEQ ID NO: 1140636 - protein, 26 aa, Mycobacterium
NLLCFVGSWFFTTAAWMQLTLSDRAA

SEQ ID NO: 1140637 - protein, 20 aa, Mycobacterium
NLLLVAFINETGLEPADEAT

SEQ ID NO: 1140638 - protein, 17 aa, Mycobacterium
NLLLVSRFKEELAGGLK

SEQ ID NO: 1140639 - protein, 19 aa, Mycobacterium
NLPPPCTTGFLPAQQRRVP

SEQ ID NO: 1140640 - protein, 19 aa, Mycobacterium
NLPPPCVTGFLPPQQRRNP

SEQ ID NO: 1140641 - protein, 18 aa, Mycobacterium
NLPRWYWAGLSVGTLLGA

SEQ ID NO: 1140642 - protein, 21 aa, Mycobacterium
NLPTGILPAGGPFTEAGARTW

SEQ ID NO: 1140643 - protein, 24 aa, Mycobacterium
NLPTIIYSLYWRRFNTRGALWSMY

SEQ ID NO: 1140644 - protein, 26 aa, Mycobacterium
NLQPLDLVLLLIFGLMGLMMRRFGLP

SEQ ID NO: 1140645 - protein, 49 aa, Mycobacterium
NLREYYNGDIRFIIIFTLLVVFLVLCILLRAVIAPIYLVASVVLSYVSA

SEQ ID NO: 1140646 - protein, 18 aa, Mycobacterium
NLTLIVVLGFGAYAAGNG

SEQ ID NO: 1140647 - protein, 22 aa, Mycobacterium
NLTRMLLGLLLISNAINLLILN

SEQ ID NO: 1140648 - protein, 18 aa, Mycobacterium
NLVAVWFGLALSAMFNAP

SEQ ID NO: 1140649 - protein, 17 aa, Mycobacterium
NLVFTFVYPLISGQGIS

SEQ ID NO: 1140650 - protein, 27 aa, Mycobacterium
NLVGGWVLMWLIMTALPRLRAQTIESA

SEQ ID NO: 1140651 - protein, 24 aa, Mycobacterium
NLVSLVHSYPWWKGSPDNGRIVKS

SEQ ID NO: 1140652 - protein, 25 aa, Mycobacterium
NLWASLGIVAVLIPATVFGLGIGPA

SEQ ID NO: 1140653 - protein, 17 aa, Mycobacterium
NLWSLTDPIGSWVFVTR

SEQ ID NO: 1140654 - protein, 21 aa, Mycobacterium
NMAGAPWLVYYARALGNNVGK

SEQ ID NO: 1140655 - protein, 29 aa, Mycobacterium
NMPLELTLTVIPFIIISVLFYFTVVVQEK

SEQ ID NO: 1140656 - protein, 23 aa, Mycobacterium
NMSIFAVFVLVTLFIVIKASKKN

SEQ ID NO: 1140657 - protein, 28 aa, Mycobacterium
NNEFFYWMSIALMMLIHAGFLAYEIGAS

SEQ ID NO: 1140658 - protein, 17 aa, Mycobacterium
NNFTILTKVILPALLPA

SEQ ID NO: 1140659 - protein, 23 aa, Mycobacterium
NNLPAVLVLLPLVTPIGPAAVLA

SEQ ID NO: 1140660 - protein, 23 aa, Mycobacterium
NNPDALLVLLLVVAAYLTVRAIQ

SEQ ID NO: 1140661 - protein, 31 aa, Mycobacterium
NNRFFPPMGSILYWLRPRTIRLPPWPNRVPL

SEQ ID NO: 1140662 - protein, 26 aa, Mycobacterium
NPAKQWGFFILLILLIAPPLNQWFFG

SEQ ID NO: 1140663 - protein, 27 aa, Mycobacterium
NPAPHTLWVWIALSGFAFGVLVSGWRG

SEQ ID NO: 1140664 - protein, 25 aa, Mycobacterium
NPAQALITWGPFLAAVAYQAVSWVG

SEQ ID NO: 1140665 - protein, 23 aa, Mycobacterium
NPDFQEEAATPVFRWGFGIWSDK

SEQ ID NO: 1140666 - protein, 21 aa, Mycobacterium
NPLARLMPVAMLAAMGGMTAM

SEQ ID NO: 1140667 - protein, 20 aa, Mycobacterium
NPLLGLRFRYAVTDADRTRR

SEQ ID NO: 1140668 - protein, 17 aa, Mycobacterium
NPRLLGATLLGLLALTA

SEQ ID NO: 1140669 - protein, 19 aa, Mycobacterium
NQELYGRATTVPWGLEIYE

SEQ ID NO: 1140670 - protein, 27 aa, Mycobacterium
NQGIRALPGWLPYAVLLPVAAVVLLGL

SEQ ID NO: 1140671 - protein, 24 aa, Mycobacterium
NQVKPTLPILLANLSTVGQTLLTY

SEQ ID NO: 1140672 - protein, 18 aa, Mycobacterium
NRAFPDWTVAAAARRHLG

SEQ ID NO: 1140673 - protein, 20 aa, Mycobacterium
NRTLRLFDSVIGVGLQIGAV

SEQ ID NO: 1140674 - protein, 19 aa, Mycobacterium
NRTLRLFDSVVGVGLQIGA

SEQ ID NO: 1140675 - protein, 22 aa, Mycobacterium
NRTLRLFDSVVGVGLQIGAVLL

SEQ ID NO: 1140676 - protein, 36 aa, Mycobacterium
NRTRESRRAAREAELLALFAGAVLRGADLNTLLERV

SEQ ID NO: 1140677 - protein, 24 aa, Mycobacterium
NSILAFTVIKWIGVAYLAYLAVRQ

SEQ ID NO: 1140678 - protein, 23 aa, Mycobacterium
NSPEPILLMLAAVKCGAISGMLN

SEQ ID NO: 1140679 - protein, 21 aa, Mycobacterium
NTAWTPLFFGLGWRGIAFAEL

SEQ ID NO: 1140680 - protein, 24 aa, Mycobacterium
NTDLAFGFGFWAGATLPLGLALCL

SEQ ID NO: 1140681 - protein, 19 aa, Mycobacterium
NTESGWKLGFYAASRASQL

SEQ ID NO: 1140682 - protein, 35 aa, Mycobacterium
NTRRQPPYKLAGLVLAILTVIAVTLVYLQFRGDFM

SEQ ID NO: 1140683 - protein, 21 aa, Mycobacterium
NTVFENLVLLLRQIDPAKLNA

SEQ ID NO: 1140684 - protein, 23 aa, Mycobacterium
NTVLLALLVIVPAAFVLLAKATT

SEQ ID NO: 1140685 - protein, 44 aa, Mycobacterium
NVAAFVLMICGFFRWGFPATMWALPFAAFFLFSAGSWRDGVGTR

SEQ ID NO: 1140686 - protein, 46 aa, Mycobacterium
NVGALVVFIALTVWFVIDPQLWLLVVVTVLALALGWHLVASIGGGD

SEQ ID NO: 1140687 - protein, 26 aa, Mycobacterium
NVGIFTVVMLLVAAALVVVFGEFRFA

SEQ ID NO: 1140688 - protein, 34 aa, Mycobacterium
NVGLSLGLIVALMPLALFGVLGLAAVVLVHELAE

SEQ ID NO: 1140689 - protein, 34 aa, Mycobacterium
NVGLSLGLIVVLMPLALFGVLGLAAVVLVHELAE

SEQ ID NO: 1140690 - protein, 31 aa, Mycobacterium
NVGRSLPFLILMAAIIPVTRFLVGTTIGIAA

SEQ ID NO: 1140691 - protein, 21 aa, Mycobacterium
NVIALPIAAGVFEPAFGLILR

SEQ ID NO: 1140692 - protein, 19 aa, Mycobacterium
NVLTCVLGLVYWGATARVF

SEQ ID NO: 1140693 - protein, 24 aa, Mycobacterium
NVPGWLAAVRRWRRSRRGKYPAAA

SEQ ID NO: 1140694 - protein, 32 aa, Mycobacterium
NVWLQSWTIFYWAWWVSWTPFVGMFIARISRG

SEQ ID NO: 1140695 - protein, 23 aa, Mycobacterium
NWALVILMVMLLIAAIAGVVVAL

SEQ ID NO: 1140696 - protein, 22 aa, Mycobacterium
NWDTAWDPTLPAIPSAFVSGDP

SEQ ID NO: 1140697 - protein, 18 aa, Mycobacterium
NWSIFGWTAPSNWIGSIE

SEQ ID NO: 1140698 - protein, 22 aa, Mycobacterium
NYADRFLPAVLAEPIREELALT

SEQ ID NO: 1140699 - protein, 31 aa, Mycobacterium
PAALLLSQFVPWLLTPILMLGATYLCYEGAE

SEQ ID NO: 1140700 - protein, 21 aa, Mycobacterium
PAALSAIVLWSVTSVGVVMAA

SEQ ID NO: 1140701 - protein, 50 aa, Mycobacterium
PAAPVPAPVPVLPAPAFRPPVVLPPPVIRLPRPQLPPIFRDDDEPERPSW

SEQ ID NO: 1140702 - protein, 27 aa, Mycobacterium
PADRLITTILLLSIVALVIGLSSTVLV

SEQ ID NO: 1140703 - protein, 25 aa, Mycobacterium
PAEFSKILLLIFFAAVLVSKRDLFT

SEQ ID NO: 1140704 - protein, 22 aa, Mycobacterium
PAETMTSAWQRAFRARAAFEAT

SEQ ID NO: 1140705 - protein, 19 aa, Mycobacterium
PAGAPLPEPSSAPPPPVVT

SEQ ID NO: 1140706 - protein, 23 aa, Mycobacterium
PAGFSVFGVFWGAFGLASGAAFG

SEQ ID NO: 1140707 - protein, 20 aa, Mycobacterium
PAGYAFTLWGLITVLSAVTA

SEQ ID NO: 1140708 - protein, 19 aa, Mycobacterium
PAHPWRVPAVAAAGGVLAV

SEQ ID NO: 1140709 - protein, 19 aa, Mycobacterium
PAIAMGSFLLLSTDHRVGQ

SEQ ID NO: 1140710 - protein, 19 aa, Mycobacterium
PAIAPFLNRAGWFISGDST

SEQ ID NO: 1140711 - protein, 23 aa, Mycobacterium
PAISPPHIPALGSPGPSTLREHP

SEQ ID NO: 1140712 - protein, 22 aa, Mycobacterium
PAKKQVPPPKRTPAVSPLGKAA

SEQ ID NO: 1140713 - protein, 20 aa, Mycobacterium
PAKYKMTVVFNDGKEVPANL

SEQ ID NO: 1140714 - protein, 21 aa, Mycobacterium
PAKYKMTVVFNDGKEVPANLV

SEQ ID NO: 1140715 - protein, 22 aa, Mycobacterium
PAKYKMTVVFNDGKEVPANLVG

SEQ ID NO: 1140716 - protein, 27 aa, Mycobacterium
PALAISTLIFLVILYVATPSVCHALVH

SEQ ID NO: 1140717 - protein, 29 aa, Mycobacterium
PALALVSPWPALTAALWVLIGLAGLWLGL

SEQ ID NO: 1140718 - protein, 17 aa, Mycobacterium
PALDAAVGAALFAGYGR

SEQ ID NO: 1140719 - protein, 31 aa, Mycobacterium
PALDLDALVGGFRPLFKALDPTQVNALSAQL

SEQ ID NO: 1140720 - protein, 20 aa, Mycobacterium
PALDLDVLLGGLKPVIRGLN

SEQ ID NO: 1140721 - protein, 18 aa, Mycobacterium
PALFFTVVLALGILGLAG

SEQ ID NO: 1140722 - protein, 20 aa, Mycobacterium
PALLRRVAISSLLGTAIEYY

SEQ ID NO: 1140723 - protein, 19 aa, Mycobacterium
PALLVFGFAVMTLTDSAFA

SEQ ID NO: 1140724 - protein, 20 aa, Mycobacterium
PALMNQFISLLKASSLVYFL

SEQ ID NO: 1140725 - protein, 23 aa, Mycobacterium
PALQPAIRLVTADETPAAPPTPQ

SEQ ID NO: 1140726 - protein, 22 aa, Mycobacterium
PALWAAGFVLLGAWMPFNNGLR

SEQ ID NO: 1140727 - protein, 22 aa, Mycobacterium
PAMLVLVLIMIIDGFVVGRKVN

SEQ ID NO: 1140728 - protein, 28 aa, Mycobacterium
PANISYLLWMLMGYLVVTAVLVVPFGRL

SEQ ID NO: 1140729 - protein, 26 aa, Mycobacterium
PAPAVPAPAPAAPPPAPAPAAPPVVA

SEQ ID NO: 1140730 - protein, 17 aa, Mycobacterium
PAPNRLLATRPFVTLGS

SEQ ID NO: 1140731 - protein, 20 aa, Mycobacterium
PAPPAPPAAAPLPIAVAEYD

SEQ ID NO: 1140732 - protein, 24 aa, Mycobacterium
PAPPPPPPPPPPPPPPPPAQQPPP

SEQ ID NO: 1140733 - protein, 24 aa, Mycobacterium
PAPSRRWWQFWGSTLETSVALRAV

SEQ ID NO: 1140734 - protein, 27 aa, Mycobacterium
PAPWVALAFVCALFPGVFAVAAVLLRG

SEQ ID NO: 1140735 - protein, 21 aa, Mycobacterium
PAPYGPLFLWIGRGISRLTGE

SEQ ID NO: 1140736 - protein, 28 aa, Mycobacterium
PARGRLVTMLLVGVVLLAAGYSGGLGSP

SEQ ID NO: 1140737 - protein, 23 aa, Mycobacterium
PARLDDARFLLPVLGVPSEPGAE

SEQ ID NO: 1140738 - protein, 33 aa, Mycobacterium
PARRITVRVIYALAALFAAVLIVYMDRDGYRDS

SEQ ID NO: 1140739 - protein, 34 aa, Mycobacterium
PARYLALFLAMLIGAYLLVFLTGDKKPDPKLGID

SEQ ID NO: 1140740 - protein, 19 aa, Mycobacterium
PARYLATEPAALHALLAPA

SEQ ID NO: 1140741 - protein, 17 aa, Mycobacterium
PATVLLASSAGFCMSVL

SEQ ID NO: 1140742 - protein, 18 aa, Mycobacterium
PAVLTRLLSMLRELAWVV

SEQ ID NO: 1140743 - protein, 19 aa, Mycobacterium
PAVLTVGCGFLAFDRARSL

SEQ ID NO: 1140744 - protein, 19 aa, Mycobacterium
PAVLVFPFLTMAYALRLTD

SEQ ID NO: 1140745 - protein, 27 aa, Mycobacterium
PAYNLAIFLGYLFISFTVASYVTLRML

SEQ ID NO: 1140746 - protein, 34 aa, Mycobacterium
PCGCALFVGCDRTRRLRLLGAHQVGLSAERQIAP

SEQ ID NO: 1140747 - protein, 23 aa, Mycobacterium
PDALRSLWHYTYAAYRFHSGLTN

SEQ ID NO: 1140748 - protein, 19 aa, Mycobacterium
PDALYLGWFGPVGVSALFY

SEQ ID NO: 1140749 - protein, 34 aa, Mycobacterium
PDASGYVTRLIPDFTRWSPCQVLALVGNMRLLSQ

SEQ ID NO: 1140750 - protein, 34 aa, Mycobacterium
PDAWQRARTRYRWLFAFGFLLIGFGLEYAVSAAV

SEQ ID NO: 1140751 - protein, 19 aa, Mycobacterium
PDDFAYLVDFGIAHGGGEA

SEQ ID NO: 1140752 - protein, 17 aa, Mycobacterium
PDDLAPFEPAAFVDALL

SEQ ID NO: 1140753 - protein, 18 aa, Mycobacterium
PDFPLPFTYPPFAAVVFY

SEQ ID NO: 1140754 - protein, 24 aa, Mycobacterium
PDGTPLYPGLPPAPPPGAPRDPGP

SEQ ID NO: 1140755 - protein, 23 aa, Mycobacterium
PDILDPALLRPGRFDRQIPVSNP

SEQ ID NO: 1140756 - protein, 42 aa, Mycobacterium
PDLKRGFRTPWVPLLPILAIAACVWLMLNLTGLTWIRFLIWM

SEQ ID NO: 1140757 - protein, 22 aa, Mycobacterium
PDLPSFELPELPFGGGLFGSGS

SEQ ID NO: 1140758 - protein, 31 aa, Mycobacterium
PDLRDPNPPLPPWLSPSPPVPGTANPALVPV

SEQ ID NO: 1140759 - protein, 40 aa, Mycobacterium
PDPESRPRLILGFAMVALPALGLWHLWSGAPQDPTARQHA

SEQ ID NO: 1140760 - protein, 26 aa, Mycobacterium
PDQSRLPLAAAVATAVLVLLAVLVAR

SEQ ID NO: 1140761 - protein, 20 aa, Mycobacterium
PDRLLMVVAVILLQLVTGNQ

SEQ ID NO: 1140762 - protein, 24 aa, Mycobacterium
PDSAITIVVLLVVAVAVAALVDGA

SEQ ID NO: 1140763 - protein, 23 aa, Mycobacterium
PDSAKLFHLLSGNLSFQIEHHLF

SEQ ID NO: 1140764 - protein, 27 aa, Mycobacterium
PDSRLSYLFVFLALALAPVATAVGLVF

SEQ ID NO: 1140765 - protein, 18 aa, Mycobacterium
PDTLAWPVLIAVFAVISM

SEQ ID NO: 1140766 - protein, 26 aa, Mycobacterium
PDWHCGSAPSWFPPEFGWVVGCDYRG

SEQ ID NO: 1140767 - protein, 17 aa, Mycobacterium
PEAFMYTYCRDDHPGVL

SEQ ID NO: 1140768 - protein, 24 aa, Mycobacterium
PEAPFGWYYDLLAVWAQVSTASVW

SEQ ID NO: 1140769 - protein, 20 aa, Mycobacterium
PEAPISVPILVTVPTGGGAS

SEQ ID NO: 1140770 - protein, 27 aa, Mycobacterium
PEELRGRIMALWLVGFLGSRPIAAAVL

SEQ ID NO: 1140771 - protein, 29 aa, Mycobacterium
PEFASYAPALWRYWAQHLDPDRARRDDPA

SEQ ID NO: 1140772 - protein, 21 aa, Mycobacterium
PEKLWQIKELQFAALSGVFLL

SEQ ID NO: 1140773 - protein, 38 aa, Mycobacterium
PELPRVIPPSLLRRALPYLIVILIVGMIVALVATGLRM

SEQ ID NO: 1140774 - protein, 19 aa, Mycobacterium
PEMTFIRQALEVCPVALIV

SEQ ID NO: 1140775 - protein, 17 aa, Mycobacterium
PEPDLVPPPGFGGAHRR

SEQ ID NO: 1140776 - protein, 24 aa, Mycobacterium
PEPEPVVLVPHRPAGRKLVIAAAV

SEQ ID NO: 1140777 - protein, 18 aa, Mycobacterium
PEQEPRAWRMRISVEKIG

SEQ ID NO: 1140778 - protein, 32 aa, Mycobacterium
PEQVWSVLAVYYFALQWVTASLIRAMLLHVAG

SEQ ID NO: 1140779 - protein, 20 aa, Mycobacterium
PERLWQIKELQFAALSGVFL

SEQ ID NO: 1140780 - protein, 19 aa, Mycobacterium
PERLWQIKELQFAAVSGVF

SEQ ID NO: 1140781 - protein, 32 aa, Mycobacterium
PESTAMLLIPVYLVYIRMARPFIAFYNWCANA

SEQ ID NO: 1140782 - protein, 35 aa, Mycobacterium
PETPTTVTPPPPPPSPTVTALPPPPPQPGTTCRAA

SEQ ID NO: 1140783 - protein, 26 aa, Mycobacterium
PEVDAFYSAAFFLLGIYGVLTTVARG

SEQ ID NO: 1140784 - protein, 23 aa, Mycobacterium
PFANMFRFLDVQWLFPEFAMHWG

SEQ ID NO: 1140785 - protein, 17 aa, Mycobacterium
PFFAMLSQLASDGRMLG

SEQ ID NO: 1140786 - protein, 18 aa, Mycobacterium
PFFKAYVANLLPGQFVQP

SEQ ID NO: 1140787 - protein, 25 aa, Mycobacterium
PFGEYVPLRPLFGWATRHTKAAAED

SEQ ID NO: 1140788 - protein, 21 aa, Mycobacterium
PFGFVAFAWQVGIIAALYGVV

SEQ ID NO: 1140789 - protein, 25 aa, Mycobacterium
PFIGFVPWIIYWVVADGPSTWMFGA

SEQ ID NO: 1140790 - protein, 17 aa, Mycobacterium
PFLFTLYYSTLSWNLVR

SEQ ID NO: 1140791 - protein, 25 aa, Mycobacterium
PFLVLWPFWLVTKWLGGRWTILVER

SEQ ID NO: 1140792 - protein, 24 aa, Mycobacterium
PFRALWVMMVGFFLIVVDSTVIAV

SEQ ID NO: 1140793 - protein, 27 aa, Mycobacterium
PGADFAWFPLANPGIVSIPLAFILGIV

SEQ ID NO: 1140794 - protein, 23 aa, Mycobacterium
PGAFYVLLWVGLVALSVCVGPVW

SEQ ID NO: 1140795 - protein, 28 aa, Mycobacterium
PGAICAATVLLLDRFLGIGGESAMFFIG

SEQ ID NO: 1140796 - protein, 24 aa, Mycobacterium
PGAMKPLTHLIGQAPGNIVVLIQN

SEQ ID NO: 1140797 - protein, 31 aa, Mycobacterium
PGAPPPAQPPILPPAPLLPGQGPLLPGQAVP

SEQ ID NO: 1140798 - protein, 30 aa, Mycobacterium
PGCGCYYDDVYWITFAGMAPADEPRYVIGV

SEQ ID NO: 1140799 - protein, 23 aa, Mycobacterium
PGDKVTLTYLDPSGKPQSVQVTL

SEQ ID NO: 1140800 - protein, 30 aa, Mycobacterium
PGDPRYPYREPLPAPAPGGPPPGPPAIAPP

SEQ ID NO: 1140801 - protein, 38 aa, Mycobacterium
PGDPRYPYREPLPAPPPGGPPPGPPAPWPTGQQPTAQP

SEQ ID NO: 1140802 - protein, 39 aa, Mycobacterium
PGDPRYPYREPLPAPPPGGPPPGPPAPWPTGQQPTAQPT

SEQ ID NO: 1140803 - protein, 23 aa, Mycobacterium
PGEGTRILLGPPGSLEEAGWTPV

SEQ ID NO: 1140804 - protein, 20 aa, Mycobacterium
PGFLPLKVPIEVHFTQRVAV

SEQ ID NO: 1140805 - protein, 26 aa, Mycobacterium
PGGAAVILVIILALVAVFILVRPGWF

SEQ ID NO: 1140806 - protein, 25 aa, Mycobacterium
PGGWTLWAVLIAEIVLTFTFLLVIL

SEQ ID NO: 1140807 - protein, 27 aa, Mycobacterium
PGHRIHGEPLPWQDLRAAFTERGWLDM

SEQ ID NO: 1140808 - protein, 26 aa, Mycobacterium
PGIAHPWWGNFLPVTRAVPEPPSLRG

SEQ ID NO: 1140809 - protein, 33 aa, Mycobacterium
PGKTAPLVISGWTLVVWMLVAIGSGIGYFASIA

SEQ ID NO: 1140810 - protein, 32 aa, Mycobacterium
PGLGGYLDLLFSRTMLIWLSAAIVVSVIPAHV

SEQ ID NO: 1140811 - protein, 20 aa, Mycobacterium
PGMEWIPVVTFLQVSADMAV

SEQ ID NO: 1140812 - protein, 17 aa, Mycobacterium
PGMRMAFSLLPDAGSET

SEQ ID NO: 1140813 - protein, 24 aa, Mycobacterium
PGNPLWRYRLLMAVLGSMLLSWLL

SEQ ID NO: 1140814 - protein, 21 aa, Mycobacterium
PGNTETGWKLGFYAASRASQL

SEQ ID NO: 1140815 - protein, 30 aa, Mycobacterium
PGNVNMVRLWWDKPWPMRIAAIARLPLQIP

SEQ ID NO: 1140816 - protein, 27 aa, Mycobacterium
PGPAPHAPFPLPVPPSDPGVPVPLPYY

SEQ ID NO: 1140817 - protein, 27 aa, Mycobacterium
PGPGLGLLLAYMAFGRGLARASAPGAA

SEQ ID NO: 1140818 - protein, 17 aa, Mycobacterium
PGPIPYPGAPPYGAPQY

SEQ ID NO: 1140819 - protein, 17 aa, Mycobacterium
PGPWALVPVGATLLFIL

SEQ ID NO: 1140820 - protein, 22 aa, Mycobacterium
PGPWWRSLQAASTRRALLLTAL

SEQ ID NO: 1140821 - protein, 23 aa, Mycobacterium
PGRGWQIGPYLPFANMFRFLDVQ

SEQ ID NO: 1140822 - protein, 21 aa, Mycobacterium
PGRLFTVWFAPQVNMSGVFTG

SEQ ID NO: 1140823 - protein, 31 aa, Mycobacterium
PGRRRFFGYLNLFLAAMLLLVLADNYLGLYM

SEQ ID NO: 1140824 - protein, 17 aa, Mycobacterium
PGSHQPFGPPPGGFGGP

SEQ ID NO: 1140825 - protein, 26 aa, Mycobacterium
PGTNGSQFFLVYKDSQLPPQYTVFGT

SEQ ID NO: 1140826 - protein, 18 aa, Mycobacterium
PGVGFIGLLFVVVWLLIA

SEQ ID NO: 1140827 - protein, 24 aa, Mycobacterium
PGVNLIFAVLLLALTRLLYDPAHS

SEQ ID NO: 1140828 - protein, 25 aa, Mycobacterium
PGVRVRLVLTWVVCTALPGSAIAVL

SEQ ID NO: 1140829 - protein, 23 aa, Mycobacterium
PHDGRPRRVAMAGAGICVAITVL

SEQ ID NO: 1140830 - protein, 38 aa, Mycobacterium
PHHRRRARRWAPRGALAFLALSVVLVVVFVVARPDWFD

SEQ ID NO: 1140831 - protein, 39 aa, Mycobacterium
PHHRRRARRWAPRGALAFLTLSVVLVVVFVVARPDWFDG

SEQ ID NO: 1140832 - protein, 31 aa, Mycobacterium
PHNIPFVMLGAAILWFGWFGFNVGSEGAADM

SEQ ID NO: 1140833 - protein, 30 aa, Mycobacterium
PHNLPLTMLGLFLIFTGFFGFLMGCVIYGA

SEQ ID NO: 1140834 - protein, 27 aa, Mycobacterium
PHQHLESARWWWLRNRRHAGNRIERSG

SEQ ID NO: 1140835 - protein, 26 aa, Mycobacterium
PHQVPWLLVVLVGAGISFLLAGRDIR

SEQ ID NO: 1140836 - protein, 24 aa, Mycobacterium
PHSLWVWIGVFGIAVVVLVVGWRG

SEQ ID NO: 1140837 - protein, 25 aa, Mycobacterium
PHSRRRMIIAAAVLVLVVLTGLAVG

SEQ ID NO: 1140838 - protein, 17 aa, Mycobacterium
PHYQFLGFWAIHLLVVW

SEQ ID NO: 1140839 - protein, 17 aa, Mycobacterium
PIAAGLFNAIPEAPPLA

SEQ ID NO: 1140840 - protein, 21 aa, Mycobacterium
PIAEAFRKLRTNLQFLAVDNP

SEQ ID NO: 1140841 - protein, 25 aa, Mycobacterium
PIAEVLLDTYFQPGKLPDSLSDLLR

SEQ ID NO: 1140842 - protein, 29 aa, Mycobacterium
PIAILLALWVFRALAQWRQGRLGQHGASA

SEQ ID NO: 1140843 - protein, 20 aa, Mycobacterium
PIAPLAPRLRRGYNVSISSV

SEQ ID NO: 1140844 - protein, 22 aa, Mycobacterium
PIAQPVLLSVLWAAGIAAVCAV

SEQ ID NO: 1140845 - protein, 18 aa, Mycobacterium
PIDTLVLATGFDLWEANF

SEQ ID NO: 1140846 - protein, 20 aa, Mycobacterium
PIELALVVLALVAVVLGLRS

SEQ ID NO: 1140847 - protein, 28 aa, Mycobacterium
PIFFVLSGFLLFLPWVSAAAAGGPPPSV

SEQ ID NO: 1140848 - protein, 29 aa, Mycobacterium
PIGVVVVTLLLLLGAPFLGANWGFPDDRV

SEQ ID NO: 1140849 - protein, 36 aa, Mycobacterium
PILRILMRRRQLVGLWPLLAPLLAAGTVVLAVVFAD

SEQ ID NO: 1140850 - protein, 17 aa, Mycobacterium
PILVHRAIDASPGLTKV

SEQ ID NO: 1140851 - protein, 18 aa, Mycobacterium
PIPVAAGFMVLFMVASMA

SEQ ID NO: 1140852 - protein, 20 aa, Mycobacterium
PIRNYFYWEPHCYNIPVCHS

SEQ ID NO: 1140853 - protein, 17 aa, Mycobacterium
PISWTHHWVWVLPLMIW

SEQ ID NO: 1140854 - protein, 21 aa, Mycobacterium
PITLVTHHFRWTRLALMADEP

SEQ ID NO: 1140855 - protein, 17 aa, Mycobacterium
PITLWSPMGRDMFGFTL

SEQ ID NO: 1140856 - protein, 25 aa, Mycobacterium
PIVRPRRRSIFFPHYNYDEGDEVRE

SEQ ID NO: 1140857 - protein, 24 aa, Mycobacterium
PKLTIFFFAFLPQFVDPARPPVLQ

SEQ ID NO: 1140858 - protein, 24 aa, Mycobacterium
PKRVYRMFRAVRPHVWLVIMVAMT

SEQ ID NO: 1140859 - protein, 28 aa, Mycobacterium
PLADPIIGLVITVAILAVLRTAVRDVFR

SEQ ID NO: 1140860 - protein, 35 aa, Mycobacterium
PLALFALCVQRRIRSWWLLLPLGVATWVLMHESGV

SEQ ID NO: 1140861 - protein, 17 aa, Mycobacterium
PLALFTVCAQRGVQKWW

SEQ ID NO: 1140862 - protein, 18 aa, Mycobacterium
PLALGMLVLIAVAMTFGP

SEQ ID NO: 1140863 - protein, 30 aa, Mycobacterium
PLARDGYLTIPVFAFGWPTSEVSPLYMAGS

SEQ ID NO: 1140864 - protein, 19 aa, Mycobacterium
PLAVITLAIPLASAASLIG

SEQ ID NO: 1140865 - protein, 39 aa, Mycobacterium
PLDMPYLRASPWHLWRKRIGWLLLLFVAEAYTGTVLRHF

SEQ ID NO: 1140866 - protein, 18 aa, Mycobacterium
PLEAGTWFEPRAFTAEEA

SEQ ID NO: 1140867 - protein, 17 aa, Mycobacterium
PLEMWLGRLRFGALYAL

SEQ ID NO: 1140868 - protein, 25 aa, Mycobacterium
PLERSRPMWMAYLIDGLADGRFVYY

SEQ ID NO: 1140869 - protein, 20 aa, Mycobacterium
PLEWNVFMMFSVLALFVGNA

SEQ ID NO: 1140870 - protein, 17 aa, Mycobacterium
PLFREHLHMAGVAVDSL

SEQ ID NO: 1140871 - protein, 31 aa, Mycobacterium
PLGASLFVGLIMFFLVGRPLALINSGLTNWL

SEQ ID NO: 1140872 - protein, 26 aa, Mycobacterium
PLGELIAPLTFVVFAYTSVGFICYTI

SEQ ID NO: 1140873 - protein, 19 aa, Mycobacterium
PLILIGLPVNVASLLALAV

SEQ ID NO: 1140874 - protein, 19 aa, Mycobacterium
PLKNYFYWEPHCFNIPICW

SEQ ID NO: 1140875 - protein, 39 aa, Mycobacterium
PLKTAFLVTVLVVVLILTLVWMQFRGAFTPEVKLRMIAE

SEQ ID NO: 1140876 - protein, 20 aa, Mycobacterium
PLLAALAFSVGFLALLLGRS

SEQ ID NO: 1140877 - protein, 18 aa, Mycobacterium
PLLAGSLVVLLALTGVAA

SEQ ID NO: 1140878 - protein, 29 aa, Mycobacterium
PLLGLVTLVLLVAALAFFRGMIGRLAIFV

SEQ ID NO: 1140879 - protein, 26 aa, Mycobacterium
PLLGVPPWMVFFAFSVSLIYQFWIHT

SEQ ID NO: 1140880 - protein, 20 aa, Mycobacterium
PLLMFLAVFDQVSLAPWQVG

SEQ ID NO: 1140881 - protein, 20 aa, Mycobacterium
PLLTPAFLGSALLLFANAFA

SEQ ID NO: 1140882 - protein, 22 aa, Mycobacterium
PLMAPMIGLIIAVIWGLSTDYE

SEQ ID NO: 1140883 - protein, 19 aa, Mycobacterium
PLMQRLRDMMNFSDNVMAE

SEQ ID NO: 1140884 - protein, 17 aa, Mycobacterium
PLPGPGCYPYREPLPAP

SEQ ID NO: 1140885 - protein, 26 aa, Mycobacterium
PLPLALRNDLPVPIRVRLAVNAPPGM

SEQ ID NO: 1140886 - protein, 26 aa, Mycobacterium
PLPRQIYWRRRALALGIAALVIGIVV

SEQ ID NO: 1140887 - protein, 21 aa, Mycobacterium
PLPSHRLLLGSVLAAAVFLIA

SEQ ID NO: 1140888 - protein, 17 aa, Mycobacterium
PLPVLIPTIAAALTLFA

SEQ ID NO: 1140889 - protein, 26 aa, Mycobacterium
PLPVQRPIPLWIGAAAPRGYARAGRI

SEQ ID NO: 1140890 - protein, 21 aa, Mycobacterium
PLRNYFYWEPHCYNIPMCWAL

SEQ ID NO: 1140891 - protein, 44 aa, Mycobacterium
PLRTGIFGIALVTCLVLVSFGYTSLPFWPQGKSYEAYFADAGGI

SEQ ID NO: 1140892 - protein, 25 aa, Mycobacterium
PLSQWFLLVMAFGSLFMAAGKRYAE

SEQ ID NO: 1140893 - protein, 22 aa, Mycobacterium
PLSRYAFALLAYAFAVTMVGTT

SEQ ID NO: 1140894 - protein, 17 aa, Mycobacterium
PLSWLEAISRYGGTHQG

SEQ ID NO: 1140895 - protein, 24 aa, Mycobacterium
PLVGLALLVLDFRVAAAAATAVFA

SEQ ID NO: 1140896 - protein, 19 aa, Mycobacterium
PLVICVALAFWQPGARRAV

SEQ ID NO: 1140897 - protein, 24 aa, Mycobacterium
PLVSFAVVLLAFSLAALVFAVADW

SEQ ID NO: 1140898 - protein, 18 aa, Mycobacterium
PLVTQRLSERLRAPVVTT

SEQ ID NO: 1140899 - protein, 26 aa, Mycobacterium
PLVVVKLWSVWPKLFDRPVIGGPVRA

SEQ ID NO: 1140900 - protein, 21 aa, Mycobacterium
PLYMKIPLIANAVVLWIGLPI

SEQ ID NO: 1140901 - protein, 22 aa, Mycobacterium
PLYMKIPLMANAVVLWIGLPFA

SEQ ID NO: 1140902 - protein, 25 aa, Mycobacterium
PMALSRLVLGVHYPSDVLAGVVVGA

SEQ ID NO: 1140903 - protein, 29 aa, Mycobacterium
PMDMLYDWIEQLLYRLTASAAKFPGGWYT

SEQ ID NO: 1140904 - protein, 20 aa, Mycobacterium
PMFHALGFLHATIAMMLGTT

SEQ ID NO: 1140905 - protein, 20 aa, Mycobacterium
PMIVNMVGALLITKMPILWG

SEQ ID NO: 1140906 - protein, 18 aa, Mycobacterium
PMPPKRALEVIADACQAL

SEQ ID NO: 1140907 - protein, 17 aa, Mycobacterium
PMRIAAIARLPLQIPMI

SEQ ID NO: 1140908 - protein, 17 aa, Mycobacterium
PMSLALCVQFFVGRHVD

SEQ ID NO: 1140909 - protein, 25 aa, Mycobacterium
PNFTPFGWLVLVVETLLPVLLLTGT

SEQ ID NO: 1140910 - protein, 20 aa, Mycobacterium
PNPLALIGFVLLLTSIELQV

SEQ ID NO: 1140911 - protein, 25 aa, Mycobacterium
PNPRFPRLFPGGDFVQGLPDGGLTD

SEQ ID NO: 1140912 - protein, 21 aa, Mycobacterium
PNRLSALWETAGLHDVLKPFG

SEQ ID NO: 1140913 - protein, 24 aa, Mycobacterium
PNSKLRVFLARALDGGLRSDVAKL

SEQ ID NO: 1140914 - protein, 26 aa, Mycobacterium
PPAALEDLRRLLPSGYPADACTPAPS

SEQ ID NO: 1140915 - protein, 17 aa, Mycobacterium
PPAEPPPGGPPPGGPPP

SEQ ID NO: 1140916 - protein, 18 aa, Mycobacterium
PPAVDDAFLPAAAPPAPP

SEQ ID NO: 1140917 - protein, 27 aa, Mycobacterium
PPDFTPGIAPLPPALTGPPPPAGPGPA

SEQ ID NO: 1140918 - protein, 26 aa, Mycobacterium
PPDRGPITWVVVIGAGLTLVLGIAAL

SEQ ID NO: 1140919 - protein, 22 aa, Mycobacterium
PPDTTLSRWLPASAPGGPSALM

SEQ ID NO: 1140920 - protein, 29 aa, Mycobacterium
PPDVIPYFGLIPLALGLWAAWQAWRDDDD

SEQ ID NO: 1140921 - protein, 22 aa, Mycobacterium
PPELLNLVLVDFKGGATFLGKK

SEQ ID NO: 1140922 - protein, 36 aa, Mycobacterium
PPEPARFPIISVLAPLIMGLILFAVTRSMLAVVFIA

SEQ ID NO: 1140923 - protein, 27 aa, Mycobacterium
PPFAWREFIFQMWFVARVSIFPTVMLS

SEQ ID NO: 1140924 - protein, 17 aa, Mycobacterium
PPFYAFVVVGYVAAFTL

SEQ ID NO: 1140925 - protein, 32 aa, Mycobacterium
PPGGFLEYLGAILFSLGGLAFGFLVPALAGYI

SEQ ID NO: 1140926 - protein, 23 aa, Mycobacterium
PPGGPPPGWPPQPPQSSGGGGGS

SEQ ID NO: 1140927 - protein, 20 aa, Mycobacterium
PPGTGYFVDSAGSLFWISDT

SEQ ID NO: 1140928 - protein, 17 aa, Mycobacterium
PPITVIGTAAAALCWLW

SEQ ID NO: 1140929 - protein, 17 aa, Mycobacterium
PPLAIGAILLWVYVIET

SEQ ID NO: 1140930 - protein, 19 aa, Mycobacterium
PPLLALWLARWLLFRVEFG

SEQ ID NO: 1140931 - protein, 23 aa, Mycobacterium
PPLLVLAPFWLLPTSFYVRLEMT

SEQ ID NO: 1140932 - protein, 24 aa, Mycobacterium
PPLRQRILVRLASIELDPRRLIAR

SEQ ID NO: 1140933 - protein, 21 aa, Mycobacterium
PPLVLALTFGLSMDYEIFLLT

SEQ ID NO: 1140934 - protein, 34 aa, Mycobacterium
PPPAPPAPPAGPLPPAPPGAPLPPAPPAEVVPPP

SEQ ID NO: 1140935 - protein, 21 aa, Mycobacterium
PPPDGTPPRWKRILQAPLAIA

SEQ ID NO: 1140936 - protein, 46 aa, Mycobacterium
PPPEEPQPWYRKPGALIALGAIAALLVAVIVWLVVQLVSGDDSGES

SEQ ID NO: 1140937 - protein, 20 aa, Mycobacterium
PPPLAPVFGGLYAAAFGMGG

SEQ ID NO: 1140938 - protein, 27 aa, Mycobacterium
PPPPDNRLPRFIAFGVGIVAIAAAIIA

SEQ ID NO: 1140939 - protein, 28 aa, Mycobacterium
PPPPDNRLPRFIAFGVGIVAIAAAIIAV

SEQ ID NO: 1140940 - protein, 19 aa, Mycobacterium
PPPPLPYQGGPGQPYYPPP

SEQ ID NO: 1140941 - protein, 25 aa, Mycobacterium
PPPPPPPPPPPPPPPPPSAEAPVNT

SEQ ID NO: 1140942 - protein, 20 aa, Mycobacterium
PPPTFLPAEIQQLFARAFTD

SEQ ID NO: 1140943 - protein, 17 aa, Mycobacterium
PPPVHVPPPDRGPITWV

SEQ ID NO: 1140944 - protein, 28 aa, Mycobacterium
PPPVPILPVLAIVLAVWYLLAVRVVRSR

SEQ ID NO: 1140945 - protein, 17 aa, Mycobacterium
PPPYGTMPGGYPPAGGY

SEQ ID NO: 1140946 - protein, 25 aa, Mycobacterium
PPQPGTVYQMWLVDADGSHSAGTMD

SEQ ID NO: 1140947 - protein, 27 aa, Mycobacterium
PPQQKKPVWLIAAAVLGVVVFGVVVWL

SEQ ID NO: 1140948 - protein, 27 aa, Mycobacterium
PPQQKKPVWLIAAAVLGVVVIGVVVWL

SEQ ID NO: 1140949 - protein, 21 aa, Mycobacterium
PPRAALIASLIVAVGGLVAVL

SEQ ID NO: 1140950 - protein, 17 aa, Mycobacterium
PPSLAPIGGILSSVPFK

SEQ ID NO: 1140951 - protein, 22 aa, Mycobacterium
PPSWASWLRIVVGVGLIGFGGY

SEQ ID NO: 1140952 - protein, 32 aa, Mycobacterium
PPTRRPVRGLVTAILLAVALLASAGMAGWLYL

SEQ ID NO: 1140953 - protein, 17 aa, Mycobacterium
PPVLQMLYLSAIFMAMT

SEQ ID NO: 1140954 - protein, 27 aa, Mycobacterium
PPVPNPPPVPNPPPAPPPPPEKRRAGF

SEQ ID NO: 1140955 - protein, 20 aa, Mycobacterium
PPWVALPIAMFIASIICALF

SEQ ID NO: 1140956 - protein, 52 aa, Mycobacterium
PQFGIDLGFYAFDLPFYRLMLTYLFAATFLAFIANLLGHYLFGGIRLAGRSG

SEQ ID NO: 1140957 - protein, 23 aa, Mycobacterium
PQLQAALFLFLQSVSLGLFVAAD

SEQ ID NO: 1140958 - protein, 22 aa, Mycobacterium
PQMFATLFISWAARAARDARAE

SEQ ID NO: 1140959 - protein, 22 aa, Mycobacterium
PQNDLLSLATPYALHALSHAEA

SEQ ID NO: 1140960 - protein, 35 aa, Mycobacterium; identical to SEQ ID NO: 365502

SEQ ID NO: 1140961 - protein, 32 aa, Mycobacterium
PQPHKFAGVEIVPLSVLLQTLSLAAAESGARA

SEQ ID NO: 1140962 - protein, 18 aa, Mycobacterium
PQPPLGSGAWWLARLEWE

SEQ ID NO: 1140963 - protein, 30 aa, Mycobacterium
PQPVAQWRTLPDAPTARLMMAWTVLGDTIW

SEQ ID NO: 1140964 - protein, 25 aa, Mycobacterium
PQQKKPVWLIAAAVLGVVVIGVVVW

SEQ ID NO: 1140965 - protein, 25 aa, Mycobacterium
PQRWGYWPAAFGLFAFVWLELASPD

SEQ ID NO: 1140966 - protein, 18 aa, Mycobacterium
PQTVGQLIKLGYQVVVES

SEQ ID NO: 1140967 - protein, 27 aa, Mycobacterium
PQVMVWTFTLVWLISEHRWSPESAGLL

SEQ ID NO: 1140968 - protein, 19 aa, Mycobacterium
PQWAPPPAPAPPPPPPPPP

SEQ ID NO: 1140969 - protein, 29 aa, Mycobacterium
PRAFTAIAALLLLFLQPATIAAGSACLLG

SEQ ID NO: 1140970 - protein, 19 aa, Mycobacterium
PRATVALLALGLLAAMVAV

SEQ ID NO: 1140971 - protein, 19 aa, Mycobacterium
PRAWRLSVDIVRDAGRLKM

SEQ ID NO: 1140972 - protein, 33 aa, Mycobacterium
PREIALIFIPWQALLWVLPVALGIALLAFPRTA

SEQ ID NO: 1140973 - protein, 37 aa, Mycobacterium
PRGDAPRPPKKKRNWGWVVAIVLVVAALAAVAILGTV

SEQ ID NO: 1140974 - protein, 19 aa, Mycobacterium
PRGPFRYLGLLPAVGAVAA

SEQ ID NO: 1140975 - protein, 25 aa, Mycobacterium
PRIGPWALYGLLFTIVILFALQGDQ

SEQ ID NO: 1140976 - protein, 20 aa, Mycobacterium
PRKVSFLPGMRYYAGNWDTT

SEQ ID NO: 1140977 - protein, 20 aa, Mycobacterium
PRLGVRWWRFGAGVLLGLAC

SEQ ID NO: 1140978 - protein, 18 aa, Mycobacterium
PRLLLVIDEFQVLFDGND

SEQ ID NO: 1140979 - protein, 26 aa, Mycobacterium
PRLVDTYVNWLWFGELGYRSVFTTQI

SEQ ID NO: 1140980 - protein, 18 aa, Mycobacterium
PRMLLSIGYGVLFVLAVC

SEQ ID NO: 1140981 - protein, 30 aa, Mycobacterium
PRPAPLNRLGPWSPLALLVPAAVLAAAVAV

SEQ ID NO: 1140982 - protein, 22 aa, Mycobacterium
PRPRNPRLLTLAALTLLGVTGH

SEQ ID NO: 1140983 - protein, 19 aa, Mycobacterium
PRRGRIAMLLFALSQFVIA

SEQ ID NO: 1140984 - protein, 24 aa, Mycobacterium
PRRQRFFLSLYVPVVMRVLCQAII

SEQ ID NO: 1140985 - protein, 35 aa, Mycobacterium
PRRREARSLLYLLLRPYRWVVLALAVVVVVENAAR

SEQ ID NO: 1140986 - protein, 20 aa, Mycobacterium
PRRVWATLMTVLIAVSITVQ

SEQ ID NO: 1140987 - protein, 31 aa, Mycobacterium; identical to SEQ ID NO: 347910

SEQ ID NO: 1140988 - protein, 32 aa, Mycobacterium; identical to SEQ ID NO: 365627

SEQ ID NO: 1140989 - protein, 26 aa, Mycobacterium
PRSALRLVLDNLWPLARAALTMTIPL

SEQ ID NO: 1140990 - protein, 22 aa, Mycobacterium
PRTLTLDGLGRYRVIALPARGP

SEQ ID NO: 1140991 - protein, 27 aa, Mycobacterium
PRTYRSRFLFFGTGYYNYDEPYRPEFP

SEQ ID NO: 1140992 - protein, 27 aa, Mycobacterium
PRVVAALLRSTWLATLTVLIVAAVVLP

SEQ ID NO: 1140993 - protein, 17 aa, Mycobacterium
PRYMPGGRVRTSTLGLI

SEQ ID NO: 1140994 - protein, 36 aa, Mycobacterium
PSAPKPLSPLAKLLQLPGRLINAFLQVFDLTSSAST

SEQ ID NO: 1140995 - protein, 25 aa, Mycobacterium
PSDITLFVLVVITLVFGGFGVISVF

SEQ ID NO: 1140996 - protein, 40 aa, Mycobacterium
PSEDDGRRPPRLGRGWLTAICAVLLLLGAGAGVGGYLALR

SEQ ID NO: 1140997 - protein, 20 aa, Mycobacterium
PSEFSLAGPWVDVAAPGEHV

SEQ ID NO: 1140998 - protein, 20 aa, Mycobacterium
PSGMWHARRHPLRMLALPIG

SEQ ID NO: 1140999 - protein, 29 aa, Mycobacterium
PSIAALLGPWFWWPQRVRTRPVPAPWPRP

SEQ ID NO: 1141000 - protein, 23 aa, Mycobacterium
PSLFCMIRNWHDAEPAFTEFNGG

SEQ ID NO: 1141001 - protein, 37 aa, Mycobacterium
PSLGPFALPTVLLLGGLALGLFLRIVVRPFVAVGAAR

SEQ ID NO: 1141002 - protein, 17 aa, Mycobacterium
PSLLIPDVPLTFDTLRI

SEQ ID NO: 1141003 - protein, 17 aa, Mycobacterium
PSLLTLVIVLVVGGLLA

SEQ ID NO: 1141004 - protein, 34 aa, Mycobacterium
PSLSAMLGWLPPPVPILPVSAIVLAVWYLLAVRV

SEQ ID NO: 1141005 - protein, 25 aa, Mycobacterium
PSPPPPPPAPPMSRPQPRYPTGAQP

SEQ ID NO: 1141006 - protein, 22 aa, Mycobacterium
PSPPQRRLALGLTALNLCVIAV

SEQ ID NO: 1141007 - protein, 20 aa, Mycobacterium
PSRNPLVFVINYLKEVVGEL

SEQ ID NO: 1141008 - protein, 37 aa, Mycobacterium
PSRPKLPRFIRTFAVPIVLAWVAIVALLNTVVPQLEE

SEQ ID NO: 1141009 - protein, 28 aa, Mycobacterium
PSRRRPATYRGWYALPERIADTLTDVAR

SEQ ID NO: 1141010 - protein, 17 aa, Mycobacterium
PSTLRITVIERVPVVLK

SEQ ID NO: 1141011 - protein, 18 aa, Mycobacterium
PSTLTRLVKGKIGVGTLM

SEQ ID NO: 1141012 - protein, 25 aa, Mycobacterium
PSTVADFLPPVLRTVTIGLPETPTQ

SEQ ID NO: 1141013 - protein, 30 aa, Mycobacterium
PSVTGAVVPALLWLAPATAAALVVYALFTV

SEQ ID NO: 1141014 - protein, 19 aa, Mycobacterium
PSWVLYPCALGMMVLSKSF

SEQ ID NO: 1141015 - protein, 21 aa, Mycobacterium
PSYDVQLLPTSSLVLGGPGAG

SEQ ID NO: 1141016 - protein, 19 aa, Mycobacterium
PTALASTAWWPVAGIAVGL

SEQ ID NO: 1141017 - protein, 27 aa, Mycobacterium
PTALFVMLPLIWALNQFGWHVAAQVPL

SEQ ID NO: 1141018 - protein, 33 aa, Mycobacterium
PTARLVNVLVITPLRVAFLIVLIGTTVETLTTQ

SEQ ID NO: 1141019 - protein, 22 aa, Mycobacterium
PTARRPLLRLALTEAALFGVAI

SEQ ID NO: 1141020 - protein, 30 aa, Mycobacterium
PTDFWLNLYWLMLCGMLIYLLLYCIRALLI

SEQ ID NO: 1141021 - protein, 23 aa, Mycobacterium
PTFGQMVVVPWLCVQLAAAPVVA

SEQ ID NO: 1141022 - protein, 23 aa, Mycobacterium
PTFPRWYGYLNLWVATLSLPGCV

SEQ ID NO: 1141023 - protein, 24 aa, Mycobacterium
PTFTLSVLPMFLPAVIALIAENIG

SEQ ID NO: 1141024 - protein, 23 aa, Mycobacterium
PTGFKVLGDQTLLVAALANLVSN

SEQ ID NO: 1141025 - protein, 19 aa, Mycobacterium
PTGLLPQPPLGSGAWWLAR

SEQ ID NO: 1141026 - protein, 23 aa, Mycobacterium
PTGPLPYIVMEYVDGVTLRDIVH

SEQ ID NO: 1141027 - protein, 19 aa, Mycobacterium
PTHWHLWCAAALSGSAAVG

SEQ ID NO: 1141028 - protein, 39 aa, Mycobacterium
PTHWQEWMPAGLFFATIALFQLLWARLVLARTTTPVLAA

SEQ ID NO: 1141029 - protein, 19 aa, Mycobacterium
PTKSLPMRVAAVARLPLQV

SEQ ID NO: 1141030 - protein, 27 aa, Mycobacterium
PTLGVLLLGVLLWGLGLIPPTVALMLL

SEQ ID NO: 1141031 - protein, 17 aa, Mycobacterium
PTPVKSVAILRDGQLRT

SEQ ID NO: 1141032 - protein, 31 aa, Mycobacterium
PTRGPRWRRPGIGLRLLAAQAIVLAAGAATT

SEQ ID NO: 1141033 - protein, 18 aa, Mycobacterium
PTRLLRLAPAAQTMLHGG

SEQ ID NO: 1141034 - protein, 24 aa, Mycobacterium
PTRPELPDVLLPQNYQPPADLKPP

SEQ ID NO: 1141035 - protein, 36 aa, Mycobacterium
PTRVLAASLFWLDGKRWWPYVPPFAAVLAPAERRLG

SEQ ID NO: 1141036 - protein, 33 aa, Mycobacterium
PTRVLARWQPSWLRYSPLTFTGLLMIAAALGLL

SEQ ID NO: 1141037 - protein, 31 aa, Mycobacterium
PTTWTNWIEIFLLLVIAFSLPRTFGRMVGNK

SEQ ID NO: 1141038 - protein, 18 aa, Mycobacterium
PTVLAVIAAITFVLLFLL

SEQ ID NO: 1141039 - protein, 31 aa, Mycobacterium
PTVPAPELVWLPLFLVFGVLTGFLGAGYNLV

SEQ ID NO: 1141040 - protein, 25 aa, Mycobacterium
PTVWGAMIWFVAIAGLTVALPVLGY

SEQ ID NO: 1141041 - protein, 25 aa, Mycobacterium
PTWFGYLPMSTWLDGLHRHLNLGEP

SEQ ID NO: 1141042 - protein, 23 aa, Mycobacterium
PVAALMFRYNNPDALLVLLLVVA

SEQ ID NO: 1141043 - protein, 30 aa, Mycobacterium
PVAEAIWSMVWWLPLSILLEFLIGLLWSAT

SEQ ID NO: 1141044 - protein, 24 aa, Mycobacterium
PVAEPLWEPLADPVADSGPDELSE

SEQ ID NO: 1141045 - protein, 26 aa, Mycobacterium
PVAFVRRPYRWIKELGATDAPTFAAA

SEQ ID NO: 1141046 - protein, 29 aa, Mycobacterium
PVAIAVPAHWGPGTVGALRGALRAAPRLS

SEQ ID NO: 1141047 - protein, 30 aa, Mycobacterium
PVATERPRWMWPALLALLGATAVLYLWGLG

SEQ ID NO: 1141048 - protein, 19 aa, Mycobacterium
PVATRRRWTRAMLAPAAVV

SEQ ID NO: 1141049 - protein, 20 aa, Mycobacterium
PVAVAGFWLAGLGFGWAMTG

SEQ ID NO: 1141050 - protein, 30 aa, Mycobacterium
PVAVTIGVLWGVVILLIDRALVVGMGNQPA

SEQ ID NO: 1141051 - protein, 19 aa, Mycobacterium
PVDGLAAQLAPLAAAASLL

SEQ ID NO: 1141052 - protein, 25 aa, Mycobacterium
PVDLPDPVIELPKPSPKIPERVLEA

SEQ ID NO: 1141053 - protein, 18 aa, Mycobacterium
PVFALGILAFSSFGLLFG

SEQ ID NO: 1141054 - protein, 19 aa, Mycobacterium
PVFTLGMLQADIIGALLVL

SEQ ID NO: 1141055 - protein, 25 aa, Mycobacterium
PVGAVLLRDPLRRQAPRTMRRLRKA

SEQ ID NO: 1141056 - protein, 24 aa, Mycobacterium
PVGIWTWPIAVIGQLAVAFVLGAL

SEQ ID NO: 1141057 - protein, 21 aa, Mycobacterium
PVGLILWRTFSPGVGDFFASV

SEQ ID NO: 1141058 - protein, 17 aa, Mycobacterium
PVHPLLVTLPIGTWMTS

SEQ ID NO: 1141059 - protein, 20 aa, Mycobacterium
PVHPWRPRPLAIAAGTAAAA

SEQ ID NO: 1141060 - protein, 19 aa, Mycobacterium
PVIGFWFGFELFARVLVVV

SEQ ID NO: 1141061 - protein, 25 aa, Mycobacterium
PVIGPWALYGLLFTIVILFALQGDQ

SEQ ID NO: 1141062 - protein, 18 aa, Mycobacterium
PVIYLFDDSFSALDVHTD

SEQ ID NO: 1141063 - protein, 17 aa, Mycobacterium
PVLAIPAVVLFFSVFEY

SEQ ID NO: 1141064 - protein, 23 aa, Mycobacterium
PVLFAIPFFLLLLTIEWTAARKL

SEQ ID NO: 1141065 - protein, 25 aa, Mycobacterium
PVLFPFLLSGWVLTFAWSLGQFSVP

SEQ ID NO: 1141066 - protein, 24 aa, Mycobacterium
PVLGLMVFAYITSRLILFATAWAA

SEQ ID NO: 1141067 - protein, 24 aa, Mycobacterium
PVLGLMVFAYITSRLILFSAAWAA

SEQ ID NO: 1141068 - protein, 18 aa, Mycobacterium
PVLIPTIAAALTLFAGRR

SEQ ID NO: 1141069 - protein, 18 aa, Mycobacterium
PVLLQVPGGAWAIGMRRP

SEQ ID NO: 1141070 - protein, 24 aa, Mycobacterium
PVMIQTLVRRPLWWAGTASAVAGF

SEQ ID NO: 1141071 - protein, 20 aa, Mycobacterium
PVNFLLFSVLVVVTASLTLP

SEQ ID NO: 1141072 - protein, 28 aa, Mycobacterium
PVNGAVIILLIWMIDVFVGPAGSGGDYV

SEQ ID NO: 1141073 - protein, 22 aa, Mycobacterium
PVNYLKLMPVTYVVIIVMVGFT

SEQ ID NO: 1141074 - protein, 22 aa, Mycobacterium
PVPGAPPAPGAPPPAGAPGAPV

SEQ ID NO: 1141075 - protein, 17 aa, Mycobacterium
PVPPRALSHYTGFQRWA

SEQ ID NO: 1141076 - protein, 19 aa, Mycobacterium
PVRAFLLVMVTSVAWSLDT

SEQ ID NO: 1141077 - protein, 23 aa, Mycobacterium
PVRDFIRKLPRDRRPRIIAVDAV

SEQ ID NO: 1141078 - protein, 19 aa, Mycobacterium
PVRLLIVCVALTALALLAS

SEQ ID NO: 1141079 - protein, 18 aa, Mycobacterium
PVRLLVICVALAAVAAVA

SEQ ID NO: 1141080 - protein, 18 aa, Mycobacterium
PVRRLVHGVITWGTAGLL

SEQ ID NO: 1141081 - protein, 18 aa, Mycobacterium
PVRVFLLLIASAVALSLA

SEQ ID NO: 1141082 - protein, 19 aa, Mycobacterium
PVRYALRRFGALRRWGRLS

SEQ ID NO: 1141083 - protein, 25 aa, Mycobacterium
PVRYATYAAILAILVGVLCLAAGII

SEQ ID NO: 1141084 - protein, 27 aa, Mycobacterium
PVSSLFDFLTFGLMLGVLHAGPAEFRT

SEQ ID NO: 1141085 - protein, 25 aa, Mycobacterium
PVSVALWLSMRFPPRLLGPDDSARA

SEQ ID NO: 1141086 - protein, 24 aa, Mycobacterium
PVTAAAILAWRDANGRFSSVEQLG

SEQ ID NO: 1141087 - protein, 26 aa, Mycobacterium
PVTALALPGILLTAALFLRALQRVFT

SEQ ID NO: 1141088 - protein, 21 aa, Mycobacterium
PVTLSYILGAVGPVRMPDGEV

SEQ ID NO: 1141089 - protein, 17 aa, Mycobacterium
PVTYVVIIVMVGFTLLT

SEQ ID NO: 1141090 - protein, 24 aa, Mycobacterium
PVVDKLPVSFYPATRLRLVDTAVN

SEQ ID NO: 1141091 - protein, 28 aa, Mycobacterium
PVVGWWLYDIFYITPFLAIPYLHSVNRE

SEQ ID NO: 1141092 - protein, 19 aa, Mycobacterium
PVVIVPLGASLFVGLIMFF

SEQ ID NO: 1141093 - protein, 19 aa, Mycobacterium
PVVLSYPPGLDFVSAFCGC

SEQ ID NO: 1141094 - protein, 36 aa, Mycobacterium
PVVRLADRYAAYFLPLALLMAGSAWLASGSAVRAVA

SEQ ID NO: 1141095 - protein, 18 aa, Mycobacterium
PVVTWFLIGFFEAVPRSL

SEQ ID NO: 1141096 - protein, 28 aa, Mycobacterium
PVVVWGAWPFHQAAWTNLRHGTATMDTL

SEQ ID NO: 1141097 - protein, 28 aa, Mycobacterium
PVYIAIYFGLIVFFTYFYVSITFNPDER

SEQ ID NO: 1141098 - protein, 18 aa, Mycobacterium
PWAYAMMLGIHLVLLLAP

SEQ ID NO: 1141099 - protein, 20 aa, Mycobacterium
PWGAWLFTRAQRLYRPVFWY

SEQ ID NO: 1141100 - protein, 22 aa, Mycobacterium
PWIVYWVLVGNVPFHAAVLIAL

SEQ ID NO: 1141101 - protein, 23 aa, Mycobacterium
PWLALSFAEALFPALFGMAAVAI

SEQ ID NO: 1141102 - protein, 19 aa, Mycobacterium
PWLALVISSLLRGLYHLYQ

SEQ ID NO: 1141103 - protein, 31 aa, Mycobacterium
PWLPARWRHWWWALLLAFVPIHLVVSAVVPA

SEQ ID NO: 1141104 - protein, 17 aa, Mycobacterium
PWLPKALFVLVVAGALL

SEQ ID NO: 1141105 - protein, 20 aa, Mycobacterium
PWRDPHAPVALGTPAVHAPA

SEQ ID NO: 1141106 - protein, 19 aa, Mycobacterium
PYEWWRVALVAVSGLAYVV

SEQ ID NO: 1141107 - protein, 21 aa, Mycobacterium
PYPSQVFLTLFGLPLEDRERL

SEQ ID NO: 1141108 - protein, 23 aa, Mycobacterium
PYRGRWIVMIVVALASLAATISI

SEQ ID NO: 1141109 - protein, 23 aa, Mycobacterium
PYTARHMGLFVVGRLAASHGLVV

SEQ ID NO: 1141110 - protein, 28 aa, Mycobacterium
QAAFTMMVLIFFNLIAPTGWQVGLIRVE

SEQ ID NO: 1141111 - protein, 22 aa, Mycobacterium
QAAFWCALSLPPLLLGMLGSLA

SEQ ID NO: 1141112 - protein, 24 aa, Mycobacterium
QAAGWTLLALMVLSVVLSLPSLPW

SEQ ID NO: 1141113 - protein, 25 aa, Mycobacterium
QAALGAALRYAAIDKDIVVIAAAGN

SEQ ID NO: 1141114 - protein, 26 aa, Mycobacterium
QAALGAALRYAAIDKDIVVIAAAGNI

SEQ ID NO: 1141115 - protein, 18 aa, Mycobacterium
QAARLLDYGFATAPGTKV

SEQ ID NO: 1141116 - protein, 26 aa, Mycobacterium
QAASTRRALLLTALGGLLIAGVITAL

SEQ ID NO: 1141117 - protein, 21 aa, Mycobacterium
QACGLPGLPLPGPGCYPYREP

SEQ ID NO: 1141118 - protein, 27 aa, Mycobacterium
QADIIGALLVLGFLRFGLPPEDRIQLQ

SEQ ID NO: 1141119 - protein, 29 aa, Mycobacterium
QAEYPLATVAFLVLIAATFLAMIQAFNAV

SEQ ID NO: 1141120 - protein, 36 aa, Mycobacterium
QAGKTLGVIAFVAALMLLLPRIHRAIPESLAAVIAA

SEQ ID NO: 1141121 - protein, 32 aa, Mycobacterium
QAGQIVALALLLTRLYAPLTALANARVEIATA

SEQ ID NO: 1141122 - protein, 26 aa, Mycobacterium
QAKNMPVFFIAFMFLFVATGIGNGST

SEQ ID NO: 1141123 - protein, 29 aa, Mycobacterium
QAKWVERSLYPWVILLQTVPILAIVPVIG

SEQ ID NO: 1141124 - protein, 27 aa, Mycobacterium
QAPKMTVIAGRRLPLPPSALSTGIDQI

SEQ ID NO: 1141125 - protein, 20 aa, Mycobacterium
QAQVLFTMRVTPAGGSSRNQ

SEQ ID NO: 1141126 - protein, 25 aa, Mycobacterium
QARWRLILTVLIAAASVGLAVVLYV

SEQ ID NO: 1141127 - protein, 19 aa, Mycobacterium
QASPPVRWFLLNAEANVEV

SEQ ID NO: 1141128 - protein, 18 aa, Mycobacterium
QASSLFMVSRLNCSITTS

SEQ ID NO: 1141129 - protein, 29 aa, Mycobacterium
QATGAAPPRQLWLPPLGAPPAADDLVARL

SEQ ID NO: 1141130 - protein, 25 aa, Mycobacterium
QAVAIGLFVLPLSDGWLTGAWVIML

SEQ ID NO: 1141131 - protein, 27 aa, Mycobacterium
QAVLMAVAILLIHTYFGYNATGGPAGV

SEQ ID NO: 1141132 - protein, 19 aa, Mycobacterium
QAVLMGFVVMLVHTYYGFT

SEQ ID NO: 1141133 - protein, 24 aa, Mycobacterium
QDARLNMVMKKLTGWAAIIAVPTA

SEQ ID NO: 1141134 - protein, 20 aa, Mycobacterium
QDGLRGILATELRLPESDVH

SEQ ID NO: 1141135 - protein, 32 aa, Mycobacterium
QDHATLWIYGITVLIVLVVFVAFTFRPRIPKR

SEQ ID NO: 1141136 - protein, 23 aa, Mycobacterium
QDLGLLVLRVAVGVLLIGHGLQK

SEQ ID NO: 1141137 - protein, 17 aa, Mycobacterium
QDLPAYNLAIFLGYLFI

SEQ ID NO: 1141138 - protein, 21 aa, Mycobacterium
QDNWLHILGSSFMRNAWAGGT

SEQ ID NO: 1141139 - protein, 24 aa, Mycobacterium
QEALLQLLADRAFQWSLNAGEVIE

SEQ ID NO: 1141140 - protein, 22 aa, Mycobacterium
QEPRAWRMRLTVQKVGEDMKVS

SEQ ID NO: 1141141 - protein, 21 aa, Mycobacterium
QEPYLLGCLNARNELSLISAG

SEQ ID NO: 1141142 - protein, 30 aa, Mycobacterium
QFFGGIHEIYFPYVLMKPKLIVATILGGMT

SEQ ID NO: 1141143 - protein, 20 aa, Mycobacterium
QFGSWRWAFGVLVGLTVAMG

SEQ ID NO: 1141144 - protein, 28 aa, Mycobacterium
QFNVVLLRRFAPQQIMVWALAVASLAGV

SEQ ID NO: 1141145 - protein, 29 aa, Mycobacterium
QFNVVLLRRFAPQQIMVWALAVASLAGVV

SEQ ID NO: 1141146 - protein, 19 aa, Mycobacterium
QFPWLKSQFARVADPWNHI

SEQ ID NO: 1141147 - protein, 20 aa, Mycobacterium
QFRMPIVLVPSNTALWAPYV

SEQ ID NO: 1141148 - protein, 32 aa, Mycobacterium
QFTSTTFGWFRFYLLAIPLVICVALAFWQPGA

SEQ ID NO: 1141149 - protein, 36 aa, Mycobacterium
QFTSTTFGWFRFYLLAIPLVICVALAFWQPGARRAV

SEQ ID NO: 1141150 - protein, 37 aa, Mycobacterium
QFTSTTFGWFRFYLLAIPLVICVALAFWQPGARRAVT

SEQ ID NO: 1141151 - protein, 29 aa, Mycobacterium
QFVMPDLRGQFWADAEPRLRALGWTGVLD

SEQ ID NO: 1141152 - protein, 19 aa, Mycobacterium
QGAALTAMFLPAMAIVGAL

SEQ ID NO: 1141153 - protein, 27 aa, Mycobacterium
QGFVTMAWWMAVFPGAAIFVIVLAFNL

SEQ ID NO: 1141154 - protein, 20 aa, Mycobacterium
QGHFFVHSLIVAGLVAAICG

SEQ ID NO: 1141155 - protein, 22 aa, Mycobacterium
QGHTPVWVAWDGAVRGVIVVAD

SEQ ID NO: 1141156 - protein, 27 aa, Mycobacterium
QGHWSLLVGYGCLPWVAAAVLRLRDGS

SEQ ID NO: 1141157 - protein, 24 aa, Mycobacterium
QGHWSLLVGYGCLPWVALCFAPKL

SEQ ID NO: 1141158 - protein, 24 aa, Mycobacterium
QGLLFIVVVGFFPAGLAGLGVLLK

SEQ ID NO: 1141159 - protein, 22 aa, Mycobacterium
QGLPIWIIASCALAIGLGTYLG

SEQ ID NO: 1141160 - protein, 17 aa, Mycobacterium
QGPLLMFLAVFDQVSLA

SEQ ID NO: 1141161 - protein, 23 aa, Mycobacterium
QGPTNWIVTFVVLVDGRGPTTGP

SEQ ID NO: 1141162 - protein, 36 aa, Mycobacterium
QGQFYIAFLALIMLSAWLFRRLLGKRARAGFVVLLG

SEQ ID NO: 1141163 - protein, 17 aa, Mycobacterium
QGRAIFDNIKKFLRYLL

SEQ ID NO: 1141164 - protein, 17 aa, Mycobacterium
QGRAYGIHLILSSQTLS

SEQ ID NO: 1141165 - protein, 18 aa, Mycobacterium
QGRRLAWTAAVCALMGAF

SEQ ID NO: 1141166 - protein, 28 aa, Mycobacterium
QGRTYLHSAWWLSFIPGLAIVITTVSAT

SEQ ID NO: 1141167 - protein, 17 aa, Mycobacterium
QHDGFVADTAYLGRPLS

SEQ ID NO: 1141168 - protein, 25 aa, Mycobacterium
QHERWSWWIWVAIAGGLVSITAFLR

SEQ ID NO: 1141169 - protein, 24 aa, Mycobacterium
QHGIRLRTKLRLFGFDTVETVSEE

SEQ ID NO: 1141170 - protein, 17 aa, Mycobacterium
QHLILPTVTLALAAIAG

SEQ ID NO: 1141171 - protein, 38 aa, Mycobacterium
QHMVSIEPQLAFTGANLPLLLKGFARITGEGAYANAYA

SEQ ID NO: 1141172 - protein, 24 aa, Mycobacterium
QHSPALYGLGLLASALSAAYAAKM

SEQ ID NO: 1141173 - protein, 17 aa, Mycobacterium
QIRLFAEARFRALNLTI

SEQ ID NO: 1141174 - protein, 20 aa, Mycobacterium
QIRVVIAGQLKQGKSLLLNS

SEQ ID NO: 1141175 - protein, 23 aa, Mycobacterium
QIVESTPPRQLSPAPAGRDFAVP

SEQ ID NO: 1141176 - protein, 17 aa, Mycobacterium
QIVPSPAPPPGPAIRTQ

SEQ ID NO: 1141177 - protein, 23 aa, Mycobacterium
QKAAGPQVIPPRGDAPRPPQQGR

SEQ ID NO: 1141178 - protein, 27 aa, Mycobacterium
QKLVFKVLVMILWLAPIGAFGAIANVV

SEQ ID NO: 1141179 - protein, 27 aa, Mycobacterium
QKLVHFFDIQWPWSTGIYSVIVVAWAA

SEQ ID NO: 1141180 - protein, 24 aa, Mycobacterium
QKPAAPQMIPPRGDAPRPPKKKRN

SEQ ID NO: 1141181 - protein, 30 aa, Mycobacterium
QKRWRPAVALMLALWLVAVGFEWTQPGAGH

SEQ ID NO: 1141182 - protein, 22 aa, Mycobacterium
QLAATSLAILPTLRPGTTQTDS

SEQ ID NO: 1141183 - protein, 18 aa, Mycobacterium
QLALQRVVLLRPGGMPKT

SEQ ID NO: 1141184 - protein, 21 aa, Mycobacterium
QLARNTLIDRKADAGAGLAGT

SEQ ID NO: 1141185 - protein, 21 aa, Mycobacterium
QLARNTLIDRKADAGSGPAGA

SEQ ID NO: 1141186 - protein, 21 aa, Mycobacterium
QLDTTLRRALTPLSGLLSQVQ

SEQ ID NO: 1141187 - protein, 23 aa, Mycobacterium
QLGLPIASLVAPAAVLGAALGFG

SEQ ID NO: 1141188 - protein, 19 aa, Mycobacterium
QLIIFTIASIVGVAVMLFA

SEQ ID NO: 1141189 - protein, 18 aa, Mycobacterium
QLIIFTIASIVGVSVMIF

SEQ ID NO: 1141190 - protein, 35 aa, Mycobacterium
QLIIFTVLTVIALAVLGWYYLRVPSLVGIGQYTLH

SEQ ID NO: 1141191 - protein, 18 aa, Mycobacterium
QLISLLNDMAWFFFIAPV

SEQ ID NO: 1141192 - protein, 17 aa, Mycobacterium
QLIVFTIASVVGVGAMV

SEQ ID NO: 1141193 - protein, 19 aa, Mycobacterium
QLLVQLTCTMLITAPIMCV

SEQ ID NO: 1141194 - protein, 20 aa, Mycobacterium
QLMIFAIVTVLSVGAVSLFY

SEQ ID NO: 1141195 - protein, 22 aa, Mycobacterium
QLPDLSRPRRPRLPLKAGWGVK

SEQ ID NO: 1141196 - protein, 23 aa, Mycobacterium
QLPDLSRPRRPRLPLKAGWGVKA

SEQ ID NO: 1141197 - protein, 17 aa, Mycobacterium
QLPVRLVAAAVALACAA

SEQ ID NO: 1141198 - protein, 17 aa, Mycobacterium
QLSWLWPSGLDVSSIAA

SEQ ID NO: 1141199 - protein, 38 aa, Mycobacterium
QLVDHDFHIPLVGRWDALGFLQDFFAVAVLLGIITFAI

SEQ ID NO: 1141200 - protein, 33 aa, Mycobacterium
QMFRPPFAWREFLLQTWFVARVALFPTIMLAIP

SEQ ID NO: 1141201 - protein, 17 aa, Mycobacterium
QMGYLPGTIWIIIGAVV

SEQ ID NO: 1141202 - protein, 26 aa, Mycobacterium
QMHAWGWRLPFLVAAPLGLIGLYLRS

SEQ ID NO: 1141203 - protein, 17 aa, Mycobacterium
QMHLGRLPKIVRGQRKP

SEQ ID NO: 1141204 - protein, 20 aa, Mycobacterium
QMQWVIDIYTLMVASLLLLS

SEQ ID NO: 1141205 - protein, 32 aa, Mycobacterium
QMVRALPHLGLIPLFIIWFGIGELPKVLLVAL

SEQ ID NO: 1141206 - protein, 20 aa, Mycobacterium
QMWEVAWIGLPVLAIILIGF

SEQ ID NO: 1141207 - protein, 27 aa, Mycobacterium
QNLWASLGIVAVLIPATVFGLGIGPAV

SEQ ID NO: 1141208 - protein, 34 aa, Mycobacterium; identical to SEQ ID NO: 366524

SEQ ID NO: 1141209 - protein, 35 aa, Mycobacterium
QNVGLSLGLIIALVPLALFGVLGLAAVVLVHELAE

SEQ ID NO: 1141210 - protein, 23 aa, Mycobacterium
QNWGTLPRLQTDPAALDGLGLQG

SEQ ID NO: 1141211 - protein, 25 aa, Mycobacterium
QPAAGPWDPLLPKLPSAGAPGDPVA

SEQ ID NO: 1141212 - protein, 26 aa, Mycobacterium
QPALQFYVGFFIVLLGVTWFFYMRKG

SEQ ID NO: 1141213 - protein, 17 aa, Mycobacterium
QPDFPVRMPLDGPLLPA

SEQ ID NO: 1141214 - protein, 19 aa, Mycobacterium
QPDPTLRWMYWWGLLITAA

SEQ ID NO: 1141215 - protein, 40 aa, Mycobacterium
QPHRPFIPRMIRLFAVPIILGWIALIVILNVTVPQLEAVG

SEQ ID NO: 1141216 - protein, 25 aa, Mycobacterium
QPIDIFVQKAWRNLRFPLEWAPPEA

SEQ ID NO: 1141217 - protein, 43 aa, Mycobacterium
QPSDGAVFCAFLLLLLAVGFVIKYIWWFVGGAVLVGVFAGIYW

SEQ ID NO: 1141218 - protein, 26 aa, Mycobacterium
QPTLEIAPGITIPWGPPTTVPVAPPV

SEQ ID NO: 1141219 - protein, 17 aa, Mycobacterium
QPTLPILMANLVSIGQV

SEQ ID NO: 1141220 - protein, 21 aa, Mycobacterium
QPVSIFLPTYLVLSAGVCTAF

SEQ ID NO: 1141221 - protein, 26 aa, Mycobacterium
QPVSIFLPTYLVLSAGVFMAFLAGDL

SEQ ID NO: 1141222 - protein, 21 aa, Mycobacterium
QPYRLRVIVHEDDNGHMTGYD

SEQ ID NO: 1141223 - protein, 23 aa, Mycobacterium
QQAVAVSFWLLAPYVAIESVHDL

SEQ ID NO: 1141224 - protein, 19 aa, Mycobacterium
QQRRYAIVNLLASTTAVAQ

SEQ ID NO: 1141225 - protein, 17 aa, Mycobacterium
QRAGVTAPLIPVSSTLR

SEQ ID NO: 1141226 - protein, 24 aa, Mycobacterium
QRATLLTFVLPACTPAGPVGERLL

SEQ ID NO: 1141227 - protein, 24 aa, Mycobacterium
QRFMLRWRTWLTDRLTGDWLDGKA

SEQ ID NO: 1141228 - protein, 19 aa, Mycobacterium
QRHRAYVLTYYWGLVLSSQ

SEQ ID NO: 1141229 - protein, 22 aa, Mycobacterium
QRIAFARILLARPTAVFLDEST

SEQ ID NO: 1141230 - protein, 46 aa, Mycobacterium
QRINPVVNLLRRVPPRKLGYRLAWLYNVLFIVSVYGIARKAPRFSR

SEQ ID NO: 1141231 - protein, 19 aa, Mycobacterium
QRMAIYGILVAVIALGAAG

SEQ ID NO: 1141232 - protein, 22 aa, Mycobacterium
QRQFYRILDVLLAAGDFDATTG

SEQ ID NO: 1141233 - protein, 22 aa, Mycobacterium
QRQRLGLVRVLGSAAPLLLFDE

SEQ ID NO: 1141234 - protein, 25 aa, Mycobacterium
QRQWAFALTYYWGLVLSLQALISPV

SEQ ID NO: 1141235 - protein, 20 aa, Mycobacterium
QRRIWPVRLMQIQVSVIYVS

SEQ ID NO: 1141236 - protein, 23 aa, Mycobacterium
QRRRFSLAVVGSVAAAVLCLGGF

SEQ ID NO: 1141237 - protein, 24 aa, Mycobacterium
QRTLLYLAIVVLSAALLIGAVYLG

SEQ ID NO: 1141238 - protein, 24 aa, Mycobacterium
QRVAHRLDWQPWTPAADAGPDTGS

SEQ ID NO: 1141239 - protein, 22 aa, Mycobacterium
QRWAHQLWLDLSSARFWKTVAH

SEQ ID NO: 1141240 - protein, 19 aa, Mycobacterium
QRWYGFGWESLLLEAGFLA

SEQ ID NO: 1141241 - protein, 24 aa, Mycobacterium
QSATLPLKLRLQPSKLRVEDCPVA

SEQ ID NO: 1141242 - protein, 24 aa, Mycobacterium
QSGSIGLGFAIPVDQAKRIADELI

SEQ ID NO: 1141243 - protein, 24 aa, Mycobacterium
QSGSNWIPIVRAVLTLLGGIAVAV

SEQ ID NO: 1141244 - protein, 25 aa, Mycobacterium
QSHGWQPWIWVVIVAGVAVMAGFVY

SEQ ID NO: 1141245 - protein, 34 aa, Mycobacterium
QSKRSLTISILGFAIVLLLLLPRIDEFIKKLKRL

SEQ ID NO: 1141246 - protein, 26 aa, Mycobacterium
QSLLAYVMMGWLPEVFIDSGVSKSAA

SEQ ID NO: 1141247 - protein, 27 aa, Mycobacterium
QSPRWARLLQFLPVLAIPAVVLFFSVF

SEQ ID NO: 1141248 - protein, 24 aa, Mycobacterium
QSRASWQWLEWMPHTGSIHSPLSG

SEQ ID NO: 1141249 - protein, 37 aa, Mycobacterium
QSRSVLVGALILVTGLIGCFLFSLIRPSGAAGTDAVL

SEQ ID NO: 1141250 - protein, 25 aa, Mycobacterium
QSTAPWYLSLAVLAALVLVGAAGGR

SEQ ID NO: 1141251 - protein, 17 aa, Mycobacterium
QSVLLVLGAWRNDRQIE

SEQ ID NO: 1141252 - protein, 36 aa, Mycobacterium
QTDTDWWLLGVAIAVVVLLFAWWRGLFVTEMVRRRF

SEQ ID NO: 1141253 - protein, 26 aa, Mycobacterium
QTEVFPLTLFAIGGMLLFPAANDLLT

SEQ ID NO: 1141254 - protein, 25 aa, Mycobacterium
QTEVFPLTMFAVAGMLLFPAADDLL

SEQ ID NO: 1141255 - protein, 21 aa, Mycobacterium
QTFFPHLIIEPFHSGLVVVFV

SEQ ID NO: 1141256 - protein, 22 aa, Mycobacterium
QTGGTIILWAAAAGLVALGLWR

SEQ ID NO: 1141257 - protein, 20 aa, Mycobacterium
QTGIAFITIMAPDGVRFTHT

SEQ ID NO: 1141258 - protein, 21 aa, Mycobacterium
QTGITLVLILAFFAAGMDPYI

SEQ ID NO: 1141259 - protein, 44 aa, Mycobacterium
QTGKLGVRDVLFGRKVSYVGLAILLLTALMVGALGGWVGNKTAE

SEQ ID NO: 1141260 - protein, 19 aa, Mycobacterium
QTHPLAPPPTFLPAEIQQL

SEQ ID NO: 1141261 - protein, 20 aa, Mycobacterium
QTIVLGQERYRYPQNLPKVA

SEQ ID NO: 1141262 - protein, 23 aa, Mycobacterium
QTLIIFAIRTRKVPFLRSRPAAA

SEQ ID NO: 1141263 - protein, 25 aa, Mycobacterium
QTLKDYVAFPLLAGPFAPWVFAGNM

SEQ ID NO: 1141264 - protein, 27 aa, Mycobacterium
QTLMVVAFTLTLLLMLATPWCAVGLVA

SEQ ID NO: 1141265 - protein, 21 aa, Mycobacterium
QTLRYLPDLVVVLALLAAVGL

SEQ ID NO: 1141266 - protein, 25 aa, Mycobacterium
QTQSFILVTLVLLPLGVLALGARDR

SEQ ID NO: 1141267 - protein, 23 aa, Mycobacterium
QTSWPLIGLITGVLIAGAIAFGI

SEQ ID NO: 1141268 - protein, 19 aa, Mycobacterium
QTVPLLRRVSVLAPRTGEG

SEQ ID NO: 1141269 - protein, 44 aa, Mycobacterium
QTYPPLGATYPGTLPPPVQYPKRRRPWIIAVVAAVAVLAVVGVV

SEQ ID NO: 1141270 - protein, 25 aa, Mycobacterium
QVCALLPFALPFVVLAYGIKRLAGA

SEQ ID NO: 1141271 - protein, 24 aa, Mycobacterium
QVDARGLVYIVDRLKELIKYKGYQ

SEQ ID NO: 1141272 - protein, 22 aa, Mycobacterium
QVEPLLRTGDWAGAAVAAAEGL

SEQ ID NO: 1141273 - protein, 25 aa, Mycobacterium
QVFDGALLIVIFATSGALEAVATKR

SEQ ID NO: 1141274 - protein, 24 aa, Mycobacterium
QVFMFAVLGWFYLSVLPGWLGLEQ

SEQ ID NO: 1141275 - protein, 23 aa, Mycobacterium
QVGLPVWVYLPAALGALFVITPL

SEQ ID NO: 1141276 - protein, 24 aa, Mycobacterium
QVGPYRLRRLLGKGGMGEVYEAED

SEQ ID NO: 1141277 - protein, 17 aa, Mycobacterium
QVGSLIAFLSYFMQILV

SEQ ID NO: 1141278 - protein, 52 aa, Mycobacterium
QVKDFVITRIITAGITWLIGLLNPAAAFIKACKLIYDIVMFFVNNAERIMKF

SEQ ID NO: 1141279 - protein, 17 aa, Mycobacterium
QVLMGALTQLLPMLVGR

SEQ ID NO: 1141280 - protein, 32 aa, Mycobacterium
QVVEAIHRLGPLLWTHRPEHPAFLTVRLGLGD

SEQ ID NO: 1141281 - protein, 26 aa, Mycobacterium
QVVLTMIRLAMYIAPIGVFCLLAALA

SEQ ID NO: 1141282 - protein, 25 aa, Mycobacterium
QVWSAHMFAPPPRPSIMRRGVSRTF

SEQ ID NO: 1141283 - protein, 32 aa, Mycobacterium
QWGLGHEIAWPVPLLAFIILVAVGADYNMLLV

SEQ ID NO: 1141284 - protein, 19 aa, Mycobacterium
QWPVYEGLMWGGVQAALCC

SEQ ID NO: 1141285 - protein, 25 aa, Mycobacterium
QYLTPLIVLQAIWFAAISAAFRSAT

SEQ ID NO: 1141286 - protein, 24 aa, Mycobacterium
QYQRLYFFCARRHLHPYLGRPGRE

SEQ ID NO: 1141287 - protein, 25 aa, Mycobacterium
QYRDGYGEVFLLIDNLYAFSRDNTD

SEQ ID NO: 1141288 - protein, 23 aa, Mycobacterium
QYSWFIGCGVAFAIYYLVAKRDT

SEQ ID NO: 1141289 - protein, 24 aa, Mycobacterium
QYTSFGWAFLISGVILAVAAVGWI

SEQ ID NO: 1141290 - protein, 39 aa, Mycobacterium
QYWLLPSAGPLLLVLAVGLGALWLPWGAATYLLLREPNT

SEQ ID NO: 1141291 - protein, 18 aa, Mycobacterium
RAAIAPRAISAPGLRYHG

SEQ ID NO: 1141292 - protein, 20 aa, Mycobacterium
RAAMALLTAAGVLPVLCVSL

SEQ ID NO: 1141293 - protein, 41 aa, Mycobacterium
RAAPRLSPNGIPPALIPDATAALAALRVTPGLPSQGVVVLV

SEQ ID NO: 1141294 - protein, 28 aa, Mycobacterium
RAARAPLRNIIRVLRQWMRKSKNKDPQA

SEQ ID NO: 1141295 - protein, 27 aa, Mycobacterium
RAARQARLLAWVSLVWMGAEGAIGLWQ

SEQ ID NO: 1141296 - protein, 32 aa, Mycobacterium
RAATQHLRIPLPRRPWLPPLQATYALEDLAPQ

SEQ ID NO: 1141297 - protein, 25 aa, Mycobacterium
RAAVKFLLYNLFGGLIMLASVVGLY

SEQ ID NO: 1141298 - protein, 17 aa, Mycobacterium
RACMLYAGTTLVAGTAL

SEQ ID NO: 1141299 - protein, 33 aa, Mycobacterium
RADAPTRIPVPSLLRSLLTEHLDPGYAAAAQAP

SEQ ID NO: 1141300 - protein, 18 aa, Mycobacterium
RADFWFSALGAMASWSVL

SEQ ID NO: 1141301 - protein, 19 aa, Mycobacterium
RADIRIAHPLISRAHLVLR

SEQ ID NO: 1141302 - protein, 28 aa, Mycobacterium
RADVYSLACTLFRLLTGEHPYPTDAGVG

SEQ ID NO: 1141303 - protein, 17 aa, Mycobacterium
RADWAPEALVLVGSAED

SEQ ID NO: 1141304 - protein, 19 aa, Mycobacterium
RADWDRRLRPMLARQFELA

SEQ ID NO: 1141305 - protein, 35 aa, Mycobacterium
RAEEPVLPIRLFASPVFTVCCILSFIVGFAMLGAL

SEQ ID NO: 1141306 - protein, 24 aa, Mycobacterium
RAEWAWAVLLTLALAVFVVLAKAS

SEQ ID NO: 1141307 - protein, 22 aa, Mycobacterium
RAGDRWLGAIGLMDLPRPEASA

SEQ ID NO: 1141308 - protein, 19 aa, Mycobacterium
RAGEITLVLPPELARRLTV

SEQ ID NO: 1141309 - protein, 31 aa, Mycobacterium
RAGRVVAYLLIGLGLVEFLLGSLIGGAWLAF

SEQ ID NO: 1141310 - protein, 22 aa, Mycobacterium
RAHLVLRFDQGRWLAIDNGSLN

SEQ ID NO: 1141311 - protein, 22 aa, Mycobacterium
RAISAPGLRYHGCGSPGGGWSY

SEQ ID NO: 1141312 - protein, 25 aa, Mycobacterium
RAKTFLLLVLFSGLIVGVGALFGRN

SEQ ID NO: 1141313 - protein, 17 aa, Mycobacterium
RALFLEKALDQFYQANL

SEQ ID NO: 1141314 - protein, 17 aa, Mycobacterium
RALNDGYYATAWGLMGE

SEQ ID NO: 1141315 - protein, 23 aa, Mycobacterium
RALNLTIAFSAVLFALVWIDANP

SEQ ID NO: 1141316 - protein, 29 aa, Mycobacterium
RALNLTIVFSGLLFLLVWIDVNPASDLVE

SEQ ID NO: 1141317 - protein, 19 aa, Mycobacterium
RALREVVVPRPRVFRLRAD

SEQ ID NO: 1141318 - protein, 17 aa, Mycobacterium
RALSHYTGFQRWAHQLW

SEQ ID NO: 1141319 - protein, 18 aa, Mycobacterium
RALTFQPVKVRKQLEEAF

SEQ ID NO: 1141320 - protein, 23 aa, Mycobacterium
RAMGSSRRFALRTVLAEAAGIGV

SEQ ID NO: 1141321 - protein, 18 aa, Mycobacterium
RAPKPLRQLTVLSALTLA

SEQ ID NO: 1141322 - protein, 25 aa, Mycobacterium
RAQRLCRPVFWYLAAWAAVLLVVRL

SEQ ID NO: 1141323 - protein, 25 aa, Mycobacterium
RARWGRWVARLLSVVGLAGLAVLAH

SEQ ID NO: 1141324 - protein, 26 aa, Mycobacterium
RASDLYPRALLKPIPSWFKELTHEPA

SEQ ID NO: 1141325 - protein, 22 aa, Mycobacterium
RASLLLWGGWVLVTGVVFSFMD

SEQ ID NO: 1141326 - protein, 21 aa, Mycobacterium
RATFLGADFRPVGLTAGSRAL

SEQ ID NO: 1141327 - protein, 29 aa, Mycobacterium
RAVAFLAPWLFFMFIDLFDSDRAGMAGLC

SEQ ID NO: 1141328 - protein, 20 aa, Mycobacterium
RAVLTGALILITGLAGCFAF

SEQ ID NO: 1141329 - protein, 17 aa, Mycobacterium
RAVQIVLGLQRLSVVPL

SEQ ID NO: 1141330 - protein, 25 aa, Mycobacterium
RAVRVGVVFGLMALAAVVVIAGWLK

SEQ ID NO: 1141331 - protein, 20 aa, Mycobacterium
RAWPLLGSRAPRIALAVMFG

SEQ ID NO: 1141332 - protein, 17 aa, Mycobacterium
RCPFCAKFSRDTEPDLV

SEQ ID NO: 1141333 - protein, 33 aa, Mycobacterium
RCVDADTRLYLPMPFFWIGGLGGGLLSALTAGA

SEQ ID NO: 1141334 - protein, 42 aa, Mycobacterium
RDAALVGAAILVALILVTLVARSMVRPLRTLRDSALKVAHED

SEQ ID NO: 1141335 - protein, 21 aa, Mycobacterium
RDDHRYLWPGLILLACTAACG

SEQ ID NO: 1141336 - protein, 19 aa, Mycobacterium
RDDRVNRLLRLPLPAPYVP

SEQ ID NO: 1141337 - protein, 24 aa, Mycobacterium
RDGDGVFYFIGRTGTMIKTAGANV

SEQ ID NO: 1141338 - protein, 20 aa, Mycobacterium
RDIDRLLRRVTPGDIVVLDA

SEQ ID NO: 1141339 - protein, 18 aa, Mycobacterium
RDLQLVVNSLWVSGAEAI

SEQ ID NO: 1141340 - protein, 36 aa, Mycobacterium
RDLRDGWVFMLRTPWLLWTLLFASLFVLVVLGPIEV

SEQ ID NO: 1141341 - protein, 38 aa, Mycobacterium; identical to SEQ ID NO: 367140

SEQ ID NO: 1141342 - protein, 38 aa, Mycobacterium
RDMRNRFLVALLLSIPIMLWSPMGRDMFGFGVPAPFGL

SEQ ID NO: 1141343 - protein, 24 aa, Mycobacterium
RDPHDPDFLVLRAGLHDQPLATAL

SEQ ID NO: 1141344 - protein, 24 aa, Mycobacterium
RDRRLLGVAAFRDLVLADPGRHVS

SEQ ID NO: 1141345 - protein, 18 aa, Mycobacterium
RDRTSFIIAHRLSTIRDA

SEQ ID NO: 1141346 - protein, 25 aa, Mycobacterium
RDVFALLSPFLLVVAVMFVPALDML

SEQ ID NO: 1141347 - protein, 17 aa, Mycobacterium
RDVSGLLRRHAPALRTL

SEQ ID NO: 1141348 - protein, 20 aa, Mycobacterium
RDWAWPIIAVGVVSVIYGAL

SEQ ID NO: 1141349 - protein, 25 aa, Mycobacterium
RDWGALQRLLPFYPNAEPARLDLGT

SEQ ID NO: 1141350 - protein, 27 aa, Mycobacterium
RDWGDKFRSLFWRIMRQGRAYHMFLQL

SEQ ID NO: 1141351 - protein, 40 aa, Mycobacterium
REAAILISIALVLYYVMLTFIARPYLIPSESMEPTLHGCN

SEQ ID NO: 1141352 - protein, 23 aa, Mycobacterium
REFILQTWFVARVSLVPTLMLSI

SEQ ID NO: 1141353 - protein, 35 aa, Mycobacterium
REGGALVNEYPGDPWKWWAVLSSAVGVAVAIAAVV

SEQ ID NO: 1141354 - protein, 31 aa, Mycobacterium
REGRGIFSNIRKFLRYLLSSNMGEVLTVFLG

SEQ ID NO: 1141355 - protein, 29 aa, Mycobacterium
RELQFAVLAAVLLSVGWIVGRFGGYEDVV

SEQ ID NO: 1141356 - protein, 18 aa, Mycobacterium
RELQNLPAPSRRWWQFWG

SEQ ID NO: 1141357 - protein, 24 aa, Mycobacterium
RELTARFWRRSGIRIVRRPVPHLV

SEQ ID NO: 1141358 - protein, 17 aa, Mycobacterium
RELWLPAARTHRSTAAV

SEQ ID NO: 1141359 - protein, 25 aa, Mycobacterium
RENPLSLIFSLGGFVALILLAQAVA

SEQ ID NO: 1141360 - protein, 25 aa, Mycobacterium
RERKRRLYTIIGSAVAAVVVIAAVV

SEQ ID NO: 1141361 - protein, 25 aa, Mycobacterium
RERLVFYAFVVIVVTLLLQGLSLPT

SEQ ID NO: 1141362 - protein, 24 aa, Mycobacterium
RERLWQTIGFLSIVALVFMIATIR

SEQ ID NO: 1141363 - protein, 17 aa, Mycobacterium
RERTSFIIAHRLSTIRD

SEQ ID NO: 1141364 - protein, 27 aa, Mycobacterium
RESGTILWLILLLSAFSWMISARIVRG

SEQ ID NO: 1141365 - protein, 17 aa, Mycobacterium
RETPAPYGPLFLWIGRG

SEQ ID NO: 1141366 - protein, 21 aa, Mycobacterium
REWRPAFVPMLPLAAATAATA

SEQ ID NO: 1141367 - protein, 26 aa, Mycobacterium
RFAVLPLFVLLGAALPWHSWADLGWS

SEQ ID NO: 1141368 - protein, 18 aa, Mycobacterium
RFGARRWLARIAVSWGLV

SEQ ID NO: 1141369 - protein, 24 aa, Mycobacterium
RFGFLLAIPAVFASGLFSLPDAFE

SEQ ID NO: 1141370 - protein, 39 aa, Mycobacterium
RFGRKPVLLVGWLLAIPVPLLLIWAPSWTWVIVANVLLG

SEQ ID NO: 1141371 - protein, 19 aa, Mycobacterium
RFLLVVVPVAPWVFGAGAT

SEQ ID NO: 1141372 - protein, 18 aa, Mycobacterium
RFLRSASLRTRVAIAAAA

SEQ ID NO: 1141373 - protein, 25 aa, Mycobacterium
RFLTPLRVMMIIALVFLALGYSTKA

SEQ ID NO: 1141374 - protein, 22 aa, Mycobacterium
RFMMRWRVWLSRRFIDDWLGDL

SEQ ID NO: 1141375 - protein, 39 aa, Mycobacterium
RFNLGHGRLFALYVAGYCLGRFWIELLRSDMATELAGIR

SEQ ID NO: 1141376 - protein, 23 aa, Mycobacterium
RFQKRFFDIAFSSAVLIFGMPLL

SEQ ID NO: 1141377 - protein, 26 aa, Mycobacterium
RFTDVLLLVSYWIPAFVAVVVVDWWR

SEQ ID NO: 1141378 - protein, 19 aa, Mycobacterium
RFTTWGSQFWRVTRGYFTG

SEQ ID NO: 1141379 - protein, 17 aa, Mycobacterium
RFVAWVTTVVLVATLLV

SEQ ID NO: 1141380 - protein, 23 aa, Mycobacterium
RFVFVRPFQWREFLEQCWFVARV

SEQ ID NO: 1141381 - protein, 17 aa, Mycobacterium
RFYAWVTTVYLVGSVMA

SEQ ID NO: 1141382 - protein, 22 aa, Mycobacterium
RGAAAGLLTAALTLAAHGVGGG

SEQ ID NO: 1141383 - protein, 31 aa, Mycobacterium
RGADPWPALWALLIGFFMILVDATIVPVANP

SEQ ID NO: 1141384 - protein, 26 aa, Mycobacterium
RGARGRIALLLTAAAWALLYLIHRRN

SEQ ID NO: 1141385 - protein, 17 aa, Mycobacterium
RGFLAAYRIAADEPLDG

SEQ ID NO: 1141386 - protein, 17 aa, Mycobacterium
RGHRFARLPVGRAMLLD

SEQ ID NO: 1141387 - protein, 20 aa, Mycobacterium
RGHVVDFLSIGWWPVFNVAD

SEQ ID NO: 1141388 - protein, 25 aa, Mycobacterium
RGIALTYLELLRDVRFVILVFVGAL

SEQ ID NO: 1141389 - protein, 30 aa, Mycobacterium
RGIDWAQLVLPYLGFLGIAVMFGFHVLIGR

SEQ ID NO: 1141390 - protein, 19 aa, Mycobacterium
RGLLTLTDLLYRLLPTEAA

SEQ ID NO: 1141391 - protein, 41 aa, Mycobacterium
RGLMPRIALITIILMPLLYGAMYLWAFWNPFAEVNKVPVAL

SEQ ID NO: 1141392 - protein, 25 aa, Mycobacterium
RGLMRRILKWLAIPELPGLSIGLRI

SEQ ID NO: 1141393 - protein, 21 aa, Mycobacterium
RGNEYPPLYSTLLADRPAAGQ

SEQ ID NO: 1141394 - protein, 22 aa, Mycobacterium
RGPPRIPVWHQSGRDMLVRLCI

SEQ ID NO: 1141395 - protein, 26 aa, Mycobacterium
RGQVGRIFVGNFFPFQGYTGGGGKQI

SEQ ID NO: 1141396 - protein, 21 aa, Mycobacterium
RGQWDRLRWQIPASFLGAGCG

SEQ ID NO: 1141397 - protein, 26 aa, Mycobacterium
RGRCGLRPYYLPVYGPLGHAVFSDPA

SEQ ID NO: 1141398 - protein, 19 aa, Mycobacterium
RGRFHGLMLVFAAAAILTV

SEQ ID NO: 1141399 - protein, 29 aa, Mycobacterium
RGRRLTGWVAALFAWRRRHRQPPPTPSEP

SEQ ID NO: 1141400 - protein, 32 aa, Mycobacterium
RGRRMLFVLRDWLPFALVLLAYDLSRGAATLV

SEQ ID NO: 1141401 - protein, 18 aa, Mycobacterium
RGRVPADVLVYPGQEAAA

SEQ ID NO: 1141402 - protein, 18 aa, Mycobacterium
RGSPMLWRIHLTSVLLVV

SEQ ID NO: 1141403 - protein, 33 aa, Mycobacterium
RGTPLILQLVFVFTALPHIGITLPPVAAGSVAL

SEQ ID NO: 1141404 - protein, 25 aa, Mycobacterium
RGVQKWWLLVPLSVATWVLVHESGV

SEQ ID NO: 1141405 - protein, 23 aa, Mycobacterium
RGVRWFLAIAFLGAWIPWAAVHS

SEQ ID NO: 1141406 - protein, 25 aa, Mycobacterium
RGWARRPFVGSFAALLLGIGAGVAI

SEQ ID NO: 1141407 - protein, 22 aa, Mycobacterium
RGWLRLVFIVLGGYAVATGTLT

SEQ ID NO: 1141408 - protein, 19 aa, Mycobacterium
RGYSFTVPVDRALPGPVYL

SEQ ID NO: 1141409 - protein, 18 aa, Mycobacterium
RHAIEVLVYIIFVSVMGL

SEQ ID NO: 1141410 - protein, 19 aa, Mycobacterium
RHAVSWLAALAVPGAICAA

SEQ ID NO: 1141411 - protein, 26 aa, Mycobacterium
RHDPFLDLRFFRSIPFTTATVIAISA

SEQ ID NO: 1141412 - protein, 21 aa, Mycobacterium
RHEGRYFVGGQPTDLIRDGGV

SEQ ID NO: 1141413 - protein, 26 aa, Mycobacterium
RHFPISQSIPQYILVQSPRDLRSPQA

SEQ ID NO: 1141414 - protein, 18 aa, Mycobacterium
RHGAPWGFAVLAFSPAMI

SEQ ID NO: 1141415 - protein, 20 aa, Mycobacterium
RHLGSRPRHWLSVALGVEVV

SEQ ID NO: 1141416 - protein, 18 aa, Mycobacterium
RHLRAILVVLLSALTIAS

SEQ ID NO: 1141417 - protein, 20 aa, Mycobacterium
RHLRAILVVLLSALTIASFV

SEQ ID NO: 1141418 - protein, 26 aa, Mycobacterium
RHLRTTIAWIAIPSALWVAFALVVTD

SEQ ID NO: 1141419 - protein, 20 aa, Mycobacterium
RHRLLALFAAGAVGLVVVLI

SEQ ID NO: 1141420 - protein, 24 aa, Mycobacterium
RHRNELVYLPPAWYATNPPPRLPA

SEQ ID NO: 1141421 - protein, 20 aa, Mycobacterium
RHVRWRHRICLTAAITAMLA

SEQ ID NO: 1141422 - protein, 18 aa, Mycobacterium
RIADPAVAALLIAKTTLA

SEQ ID NO: 1141423 - protein, 23 aa, Mycobacterium
RIAKPLVPAVMIAAALIAVIGSL

SEQ ID NO: 1141424 - protein, 24 aa, Mycobacterium
RIAKPLVPGIMIVAGLIAVIGSLL

SEQ ID NO: 1141425 - protein, 23 aa, Mycobacterium
RIAKPLVPGVMIAAALIAVIGSL

SEQ ID NO: 1141426 - protein, 21 aa, Mycobacterium
RIALAVMFGVLALGSALGLTA

SEQ ID NO: 1141427 - protein, 32 aa, Mycobacterium
RIAMGWPIFLVTSTLIYLAIRTAMRTLPKGAE

SEQ ID NO: 1141428 - protein, 24 aa, Mycobacterium
RIAMPMLPQAWRDWAWPIIAVGVV

SEQ ID NO: 1141429 - protein, 17 aa, Mycobacterium
RIAVILLAVAIVAAVVT

SEQ ID NO: 1141430 - protein, 19 aa, Mycobacterium
RIDMLFNGLADLAPLLGTA

SEQ ID NO: 1141431 - protein, 20 aa, Mycobacterium
RIDTALSVPQLSRQDWRLRI

SEQ ID NO: 1141432 - protein, 27 aa, Mycobacterium
RIHNAWWTAILLVMVAVFLVVTAGVYN

SEQ ID NO: 1141433 - protein, 17 aa, Mycobacterium
RILERLIAVQDPLARRK

SEQ ID NO: 1141434 - protein, 26 aa, Mycobacterium
RILFDWRFDLILGSAAIILALVYLAG

SEQ ID NO: 1141435 - protein, 24 aa, Mycobacterium
RIMAGFVVIIPLYAMAIIMSFLSA

SEQ ID NO: 1141436 - protein, 18 aa, Mycobacterium
RIMKVIPIDRARLRRLPA

SEQ ID NO: 1141437 - protein, 36 aa, Mycobacterium; identical to SEQ ID NO: 367547

SEQ ID NO: 1141438 - protein, 20 aa, Mycobacterium
RIPAPNRLLASKPFVALGAM

SEQ ID NO: 1141439 - protein, 31 aa, Mycobacterium
RIQLVTLVGILILLKAFAYWLDRYELLSHTR

SEQ ID NO: 1141440 - protein, 25 aa, Mycobacterium
RIRGGMMGIIILVLVIGVGQSFASV

SEQ ID NO: 1141441 - protein, 19 aa, Mycobacterium
RIRGWRKIGAAVVRWPGPI

SEQ ID NO: 1141442 - protein, 29 aa, Mycobacterium
RIRIQVILTFLLLFTNILGIAVSLLLNTV

SEQ ID NO: 1141443 - protein, 19 aa, Mycobacterium
RIRNGVAEAVLAFALLLLF

SEQ ID NO: 1141444 - protein, 21 aa, Mycobacterium
RIRWSTRIAVILLAVAIVAAV

SEQ ID NO: 1141445 - protein, 23 aa, Mycobacterium
RIRYSMILFNWFGVGLIPLVMLI

SEQ ID NO: 1141446 - protein, 17 aa, Mycobacterium
RISLARAILADPRILVL

SEQ ID NO: 1141447 - protein, 19 aa, Mycobacterium
RITRWFSARWGAGHSLVVG

SEQ ID NO: 1141448 - protein, 17 aa, Mycobacterium
RITVIERVPVVLKDYPD

SEQ ID NO: 1141449 - protein, 29 aa, Mycobacterium
RIVQPFGEYLPWRGFFSKLSPYADRAGYF

SEQ ID NO: 1141450 - protein, 17 aa, Mycobacterium
RKEFFNESVKLALDGLV

SEQ ID NO: 1141451 - protein, 35 aa, Mycobacterium
RKFVEQFRDPLIYLLFVAIVISLIVWAVDGASGWP

SEQ ID NO: 1141452 - protein, 18 aa, Mycobacterium
RKPIAFAGIRQLGLGAIA

SEQ ID NO: 1141453 - protein, 27 aa, Mycobacterium
RKTRNLLFAGIAVLVVVGLAIGLTLFL

SEQ ID NO: 1141454 - protein, 33 aa, Mycobacterium
RKVVRQFQDPLIYLLLVAVAISTAAWLAEGATG

SEQ ID NO: 1141455 - protein, 63 aa, Mycobacterium
RKYRFRARTIAVMAVLLLASAVAAFTWSPSMWYICGAVGTVTALYLAYLRRQTRIEEQVRRRR

SEQ ID NO: 1141456 - protein, 20 aa, Mycobacterium
RLAAAVPFYGPTPENPDFSG

SEQ ID NO: 1141457 - protein, 42 aa, Mycobacterium
RLADRAAFWLVLVALIGGTATFLVWWAVGAGVQTALLFAITV

SEQ ID NO: 1141458 - protein, 43 aa, Mycobacterium
RLADRAAFWLVLVALIGGTATFLVWWAVGAGVQTALLFAITVV

SEQ ID NO: 1141459 - protein, 43 aa, Mycobacterium
RLADRAAFWLVLVALLGGTATFLVWWAVGAGVQSALLFAITVV

SEQ ID NO: 1141460 - protein, 24 aa, Mycobacterium
RLAKRLLIGFLSAGALILAAGSIA

SEQ ID NO: 1141461 - protein, 18 aa, Mycobacterium
RLALPGKQPIGMLVTILV

SEQ ID NO: 1141462 - protein, 49 aa, Mycobacterium; identical to SEQ ID NO: 367661

SEQ ID NO: 1141463 - protein, 50 aa, Mycobacterium
RLARSTLRTIKGNLFWAFAYNVAALPLAALGLLNPLIAGAAMAFSSVFVV

SEQ ID NO: 1141464 - protein, 24 aa, Mycobacterium
RLDDSRFLLPVLGVPPEGDSDSAS

SEQ ID NO: 1141465 - protein, 18 aa, Mycobacterium
RLDHLAARMRRNGANLLV

SEQ ID NO: 1141466 - protein, 20 aa, Mycobacterium
RLDRPVALKIMDSRYAGDQD

SEQ ID NO: 1141467 - protein, 18 aa, Mycobacterium
RLEGLIAPGSWNIDPSAQ

SEQ ID NO: 1141468 - protein, 17 aa, Mycobacterium
RLELMLAIARSEDGLVT

SEQ ID NO: 1141469 - protein, 35 aa, Mycobacterium
RLEVAKPQSAVWRLLRQFHNVLIYLMCAAAAVTAV

SEQ ID NO: 1141470 - protein, 20 aa, Mycobacterium
RLFGFNPWSVLVPQALMGVA

SEQ ID NO: 1141471 - protein, 24 aa, Mycobacterium
RLGDVLFLTLGIVVGILAGLQIAA

SEQ ID NO: 1141472 - protein, 19 aa, Mycobacterium
RLGNYFNQELYGRATTVPW

SEQ ID NO: 1141473 - protein, 18 aa, Mycobacterium
RLGRIGALPTGCEETLMG

SEQ ID NO: 1141474 - protein, 18 aa, Mycobacterium
RLHRDVAIKVLRADLARD

SEQ ID NO: 1141475 - protein, 19 aa, Mycobacterium
RLHRYLSESVPFPARITIA

SEQ ID NO: 1141476 - protein, 19 aa, Mycobacterium
RLIRLPGAGLLGPLALTVA

SEQ ID NO: 1141477 - protein, 18 aa, Mycobacterium
RLLADMYLTQRFMMRWRV

SEQ ID NO: 1141478 - protein, 24 aa, Mycobacterium
RLLAGMIVVIPLYCVAVLMSFVAA

SEQ ID NO: 1141479 - protein, 17 aa, Mycobacterium
RLLDRFTLGVTAGGLTL

SEQ ID NO: 1141480 - protein, 29 aa, Mycobacterium
RLLGWQRQMLGLIEVPYRVIDIAAGDLGS

SEQ ID NO: 1141481 - protein, 22 aa, Mycobacterium
RLLPAALGLIVFIGVATAGLGI

SEQ ID NO: 1141482 - protein, 20 aa, Mycobacterium
RLLPALLVMVLAVVALRELF

SEQ ID NO: 1141483 - protein, 20 aa, Mycobacterium
RLMMAWTVLGDTIWVAGGMS

SEQ ID NO: 1141484 - protein, 20 aa, Mycobacterium
RLMVTPFRRVMRAGTSSFVV

SEQ ID NO: 1141485 - protein, 21 aa, Mycobacterium
RLPIEIAIAVLVLGVLLLVYR

SEQ ID NO: 1141486 - protein, 24 aa, Mycobacterium
RLPQRWNPLPQTMFGAGVAALAGA

SEQ ID NO: 1141487 - protein, 35 aa, Mycobacterium
RLQAFDVFSSFWFTAIYVLLFVSLVGCLTPRMVEH

SEQ ID NO: 1141488 - protein, 19 aa, Mycobacterium
RLQLRLPLIGEEARWMVQI

SEQ ID NO: 1141489 - protein, 17 aa, Mycobacterium
RLQPTLPILMANLVSIG

SEQ ID NO: 1141490 - protein, 26 aa, Mycobacterium
RLRRKMLLINLGLLSAVYALAVVQAL

SEQ ID NO: 1141491 - protein, 22 aa, Mycobacterium
RLSDLGLFVFRSYGSTEHPSIT

SEQ ID NO: 1141492 - protein, 27 aa, Mycobacterium
RLSRRTRRWIAIGLTALVVVTGVALAT

SEQ ID NO: 1141493 - protein, 21 aa, Mycobacterium
RLSVPLLVQKGIDDGIPPLLA

SEQ ID NO: 1141494 - protein, 19 aa, Mycobacterium
RLSWEIAWKPVLVLIVLIY

SEQ ID NO: 1141495 - protein, 22 aa, Mycobacterium
RLTDLGLFVFRSYGSTEHPSIT

SEQ ID NO: 1141496 - protein, 18 aa, Mycobacterium
RLTIPALILIIASAAAAF

SEQ ID NO: 1141497 - protein, 18 aa, Mycobacterium
RLTLYLFSAVIGSVVCTN

SEQ ID NO: 1141498 - protein, 36 aa, Mycobacterium
RLTRDFATALHYWPYLFFAVGVLSITFVSLVGWWAL

SEQ ID NO: 1141499 - protein, 17 aa, Mycobacterium
RLVIMPSFDLGEFLGNI

SEQ ID NO: 1141500 - protein, 29 aa, Mycobacterium
RLVSLRDFLLFFFFLNLGAGLDFSEAAGQ

SEQ ID NO: 1141501 - protein, 19 aa, Mycobacterium
RMAPRPVERPPVDPAAQRA

SEQ ID NO: 1141502 - protein, 19 aa, Mycobacterium
RMARTQQAALRRVATLVAR

SEQ ID NO: 1141503 - protein, 18 aa, Mycobacterium
RMLLVRRENLLPVGRPPG

SEQ ID NO: 1141504 - protein, 17 aa, Mycobacterium
RMLYTDELTVTRILGVA

SEQ ID NO: 1141505 - protein, 22 aa, Mycobacterium
RMMPYLLPYRGRWIVMIVVALA

SEQ ID NO: 1141506 - protein, 24 aa, Mycobacterium
RMTQLVEDMLLLARLDSGRPLDRE

SEQ ID NO: 1141507 - protein, 33 aa, Mycobacterium
RNALGLMFDPVFGALFWGKIFAVVAVWTHGIVA

SEQ ID NO: 1141508 - protein, 25 aa, Mycobacterium
RNCLEYYFWFRSRLHFHADQRFIPL

SEQ ID NO: 1141509 - protein, 17 aa, Mycobacterium
RNERLIDGLLVLASSDQ

SEQ ID NO: 1141510 - protein, 28 aa, Mycobacterium
RNGINKILQFITYLLVPAGALTIYTQLF

SEQ ID NO: 1141511 - protein, 27 aa, Mycobacterium
RNLLILMDLILVLVLGLVLYAISARDP

SEQ ID NO: 1141512 - protein, 26 aa, Mycobacterium
RNPWYLAWLRLRRNKVALGCGLLFVL

SEQ ID NO: 1141513 - protein, 21 aa, Mycobacterium
RNRPHLAMLLRGGRAGLRADL

SEQ ID NO: 1141514 - protein, 23 aa, Mycobacterium
RNSAFLLPLVYFGISISLDRIRS

SEQ ID NO: 1141515 - protein, 33 aa, Mycobacterium
RNVTPHPWCHWAARGWILLVRSVPELILAVVFV

SEQ ID NO: 1141516 - protein, 21 aa, Mycobacterium
RPAISLLRALGAKRRQIVADL

SEQ ID NO: 1141517 - protein, 42 aa, Mycobacterium
RPAPLALSNWPVRVKVLAIVVVPLLLACVFGGLRIYSSATEA

SEQ ID NO: 1141518 - protein, 27 aa, Mycobacterium
RPAYLWAWRLLRLDFIGVAFGALFFCL

SEQ ID NO: 1141519 - protein, 23 aa, Mycobacterium
RPEQGMLVSFRDQNWLVTEAGRH

SEQ ID NO: 1141520 - protein, 32 aa, Mycobacterium; identical to SEQ ID NO: 1127494

SEQ ID NO: 1141521 - protein, 32 aa, Mycobacterium
RPGCWQPITRDLWPAPFLVLDTGASIAPYNHM

SEQ ID NO: 1141522 - protein, 25 aa, Mycobacterium
RPGEEKLVFSRFWRADPSRVRRSGG

SEQ ID NO: 1141523 - protein, 26 aa, Mycobacterium
RPGEEKLVFSRFWRSDPSRVRRSGGT

SEQ ID NO: 1141524 - protein, 32 aa, Mycobacterium
RPGIGMRLLIAQTMVLLAGAITTWVVAAIVGP

SEQ ID NO: 1141525 - protein, 19 aa, Mycobacterium
RPGRRWWVAVRTGVRVCAA

SEQ ID NO: 1141526 - protein, 21 aa, Mycobacterium
RPGRRWWVAVRTGVRVCAAVA

SEQ ID NO: 1141527 - protein, 24 aa, Mycobacterium
RPHPYAWIPFGGGVKRCIGAAFAM

SEQ ID NO: 1141528 - protein, 27 aa, Mycobacterium
RPILLMQLCFHLLWVTGATIGGLVGEA

SEQ ID NO: 1141529 - protein, 17 aa, Mycobacterium
RPITPATTVLLALVAAA

SEQ ID NO: 1141530 - protein, 20 aa, Mycobacterium
RPLIGLATVLAVAAVIAVAV

SEQ ID NO: 1141531 - protein, 21 aa, Mycobacterium
RPLKNYFYWEPHCFNIPICWA

SEQ ID NO: 1141532 - protein, 17 aa, Mycobacterium
RPLTAFIPVAVFDRAQQ

SEQ ID NO: 1141533 - protein, 32 aa, Mycobacterium
RPLTTAFAYLLLPQIIFYGLSSVFMAILNTRN

SEQ ID NO: 1141534 - protein, 22 aa, Mycobacterium
RPPALLLLPAALVAAGTLIPLV

SEQ ID NO: 1141535 - protein, 22 aa, Mycobacterium
RPPVDPAAQRAFGRPSGVRGSF

SEQ ID NO: 1141536 - protein, 34 aa, Mycobacterium
RPQWLALFVVVLAFAYLCFTVLAPWQLGKNTKTS

SEQ ID NO: 1141537 - protein, 27 aa, Mycobacterium
RPQYRALWVFVLVPVLILLAVSGRWLY

SEQ ID NO: 1141538 - protein, 27 aa, Mycobacterium
RPQYRSLWVFVLVPVLILLTVSGKWLY

SEQ ID NO: 1141539 - protein, 21 aa, Mycobacterium
RPRPVLQLLSFLAGGFVMGTA

SEQ ID NO: 1141540 - protein, 25 aa, Mycobacterium
RPRYINLIVLLRITCEVSATVLLAA

SEQ ID NO: 1141541 - protein, 19 aa, Mycobacterium
RPSLRTRAHWWWENLRPQV

SEQ ID NO: 1141542 - protein, 38 aa, Mycobacterium
RPTAAPFMIALVIIVLVVIGIWLVNLFEGDEPTPEQLI

SEQ ID NO: 1141543 - protein, 22 aa, Mycobacterium
RPTGLAFLVGWLVGLAALTAIF

SEQ ID NO: 1141544 - protein, 20 aa, Mycobacterium
RPVVAFAFFEIIAAWLLLSD

SEQ ID NO: 1141545 - protein, 25 aa, Mycobacterium
RQFNDLLRVLPPLPSAATGQPVARR

SEQ ID NO: 1141546 - protein, 26 aa, Mycobacterium
RQLADWLRQELSISDLTWSTPLTELG

SEQ ID NO: 1141547 - protein, 29 aa, Mycobacterium
RQLLACGVALLVIALVVSGALLVKSTGRM

SEQ ID NO: 1141548 - protein, 32 aa, Mycobacterium
RQLVVPRFLALLLISPLLCIFIVASGTASAFL

SEQ ID NO: 1141549 - protein, 17 aa, Mycobacterium
RQPALDAAVGAALFAAY

SEQ ID NO: 1141550 - protein, 17 aa, Mycobacterium
RQPVIRRSVLTLYGHSA

SEQ ID NO: 1141551 - protein, 23 aa, Mycobacterium
RQQRLWGASPLVASWQLVMSGAL

SEQ ID NO: 1141552 - protein, 24 aa, Mycobacterium
RQRRLAPTWPFQVGLLLAGWGIFN

SEQ ID NO: 1141553 - protein, 24 aa, Mycobacterium
RQRTLLYLLMVVVSAALLVGAVYL

SEQ ID NO: 1141554 - protein, 19 aa, Mycobacterium
RQRVLALVILLMSASTLAI

SEQ ID NO: 1141555 - protein, 24 aa, Mycobacterium
RQTVSPWFRSIWILQPRGDLMAAA

SEQ ID NO: 1141556 - protein, 17 aa, Mycobacterium
RRALPVTFVTFGLGYLA

SEQ ID NO: 1141557 - protein, 19 aa, Mycobacterium
RRARRIMLQNVGLSLALIT

SEQ ID NO: 1141558 - protein, 20 aa, Mycobacterium
RRARRIMLQNVGLSLGLIIA

SEQ ID NO: 1141559 - protein, 19 aa, Mycobacterium
RRARRIMLQNVGLSLGLIV

SEQ ID NO: 1141560 - protein, 20 aa, Mycobacterium
RRARRIMLQNVGLSLGLIVV

SEQ ID NO: 1141561 - protein, 25 aa, Mycobacterium
RRATIALLIGFPVAMGITALLTLAG

SEQ ID NO: 1141562 - protein, 32 aa, Mycobacterium
RRCTRLYRPVFYYLAFWAVALVVLRLLLPVHV

SEQ ID NO: 1141563 - protein, 17 aa, Mycobacterium
RRDMRVGFAEFSRAGLV

SEQ ID NO: 1141564 - protein, 23 aa, Mycobacterium
RRERSFWFGYVHIVVFASIVGTG

SEQ ID NO: 1141565 - protein, 42 aa, Mycobacterium
RRFKIGHGRLFALYVAGYCVGRFWIELMRSDTATLLAGIRVN

SEQ ID NO: 1141566 - protein, 33 aa, Mycobacterium
RRGLRRVLVLIGLMPLIVLLAVQAPLLSHGALL

SEQ ID NO: 1141567 - protein, 23 aa, Mycobacterium
RRGPLLLILFAALMAGAGNGISL

SEQ ID NO: 1141568 - protein, 24 aa, Mycobacterium
RRGRALFVFTVGIVLIVLASAFFL

SEQ ID NO: 1141569 - protein, 34 aa, Mycobacterium
RRGSIIAAAVLILLPLLTFGMAYMIVDVPKPGDI

SEQ ID NO: 1141570 - protein, 22 aa, Mycobacterium
RRHWDPLLRLLTIAVISGLIAL

SEQ ID NO: 1141571 - protein, 35 aa, Mycobacterium
RRHWPAYLVTFAFFQYVPAWVLLDRPPELAALSTV

SEQ ID NO: 1141572 - protein, 22 aa, Mycobacterium
RRIPNPLSLARVALRGLTGGIE

SEQ ID NO: 1141573 - protein, 20 aa, Mycobacterium
RRIVHLIDIVLLTVFMAYIG

SEQ ID NO: 1141574 - protein, 25 aa, Mycobacterium
RRKLTPTHPLGCKRLVFATDYLQTL

SEQ ID NO: 1141575 - protein, 28 aa, Mycobacterium
RRLDEAAGFAIPLLPRSLDEIPKSPNGQ

SEQ ID NO: 1141576 - protein, 25 aa, Mycobacterium
RRLFALVLLLLVVAPSLIGCVRIRA

SEQ ID NO: 1141577 - protein, 18 aa, Mycobacterium
RRLRPMLARQFELATGQR

SEQ ID NO: 1141578 - protein, 27 aa, Mycobacterium
RRLVGRLTIGLLGVATALLLAPHATAQ

SEQ ID NO: 1141579 - protein, 32 aa, Mycobacterium; identical to SEQ ID NO: 347951

SEQ ID NO: 1141580 - protein, 33 aa, Mycobacterium
RRPQFRALWVFVLIPVLILLAVSGKWLYADAAP

SEQ ID NO: 1141581 - protein, 34 aa, Mycobacterium
RRPSRLGTGWVATICVVLLLLGGGGITAGYLALR

SEQ ID NO: 1141582 - protein, 25 aa, Mycobacterium
RRQDLAMAWLLAGLFAGVVSGAVAW

SEQ ID NO: 1141583 - protein, 25 aa, Mycobacterium
RRRAAKALRWSAVVLGALLGVIVLV

SEQ ID NO: 1141584 - protein, 24 aa, Mycobacterium
RRRACLTYALWITIAQIGWVVAIF

SEQ ID NO: 1141585 - protein, 19 aa, Mycobacterium
RRRAIVAALIAFWTVIVGA

SEQ ID NO: 1141586 - protein, 36 aa, Mycobacterium
RRRARWWTTTALAAAAVLLAVALVLAIRPATFGLGT

SEQ ID NO: 1141587 - protein, 25 aa, Mycobacterium
RRRPERFVLAVLGIALAIACVTIVR

SEQ ID NO: 1141588 - protein, 22 aa, Mycobacterium
RRRRLTWGLLFLVNSMLVYWME

SEQ ID NO: 1141589 - protein, 22 aa, Mycobacterium
RRRTGLWTWLTDAAVVGSLLIW

SEQ ID NO: 1141590 - protein, 26 aa, Mycobacterium
RRRVRARRGVMRIAVAVLGAAAAAAV

SEQ ID NO: 1141591 - protein, 27 aa, Mycobacterium
RRSLREQINWKWVRRGSIIAAAVLILL

SEQ ID NO: 1141592 - protein, 19 aa, Mycobacterium
RRSPVLTLFPHRPPEVGVP

SEQ ID NO: 1141593 - protein, 33 aa, Mycobacterium
RRVAFLFTALCLFSSLFIMLRRKRVPGVARGPA

SEQ ID NO: 1141594 - protein, 17 aa, Mycobacterium
RRVKKGEPGLLLSKVSN

SEQ ID NO: 1141595 - protein, 18 aa, Mycobacterium
RRVLGVPSLVLFGLVYMV

SEQ ID NO: 1141596 - protein, 25 aa, Mycobacterium
RRVVLAGRTPLPPRRDWDDESIDAD

SEQ ID NO: 1141597 - protein, 18 aa, Mycobacterium
RRWDSEHLGLLVLVPLIA

SEQ ID NO: 1141598 - protein, 18 aa, Mycobacterium
RRWDSEHLGLLVLVPLIG

SEQ ID NO: 1141599 - protein, 18 aa, Mycobacterium
RRWGEFGMIPALNARRYP

SEQ ID NO: 1141600 - protein, 17 aa, Mycobacterium
RRWPFGVAAAFLALGMA

SEQ ID NO: 1141601 - protein, 23 aa, Mycobacterium
RRWWPPPPKVLYASKAVIVVVAA

SEQ ID NO: 1141602 - protein, 22 aa, Mycobacterium
RRWYRTFPAVVGFVAVAVVIIA

SEQ ID NO: 1141603 - protein, 25 aa, Mycobacterium
RSADYWLGWWVIIGTIPISVVGLLF

SEQ ID NO: 1141604 - protein, 24 aa, Mycobacterium
RSAMATWPVGRPMRMLDAARELTL

SEQ ID NO: 1141605 - protein, 20 aa, Mycobacterium
RSAPWPATVLLASSAGFCMS

SEQ ID NO: 1141606 - protein, 24 aa, Mycobacterium
RSARIPMRRRLPRRAAAVTGVVLV

SEQ ID NO: 1141607 - protein, 35 aa, Mycobacterium
RSASFVFRHRAGNAVIFLLLVVAAAQLFTLQVPRA

SEQ ID NO: 1141608 - protein, 29 aa, Mycobacterium
RSAVVLAVMLLLFGVPWSTLVVGGAAWPT

SEQ ID NO: 1141609 - protein, 23 aa, Mycobacterium
RSDRFLYALNRVSAFAGADAASF

SEQ ID NO: 1141610 - protein, 20 aa, Mycobacterium
RSEVAAFFSPRPQPTETNGH

SEQ ID NO: 1141611 - protein, 19 aa, Mycobacterium
RSHVMFQGYWRRPDAMVDS

SEQ ID NO: 1141612 - protein, 19 aa, Mycobacterium
RSLGLHLVLATQRPAGVIR

SEQ ID NO: 1141613 - protein, 40 aa, Mycobacterium
RSNTLYRAGLIGGLALLPLLALLVWLPARRRRDDEPAHPW

SEQ ID NO: 1141614 - protein, 31 aa, Mycobacterium
RSQAATMMAPLPPPPPPPPPSTPGGPLPYGG

SEQ ID NO: 1141615 - protein, 25 aa, Mycobacterium
RSQQAPWPLIRAFAPGPALTRADAL

SEQ ID NO: 1141616 - protein, 17 aa, Mycobacterium
RSQWLASTRRALGGAPT

SEQ ID NO: 1141617 - protein, 35 aa, Mycobacterium
RSQWLQANLFAWDQERMMRFSFAPDRFDIPPGGST

SEQ ID NO: 1141618 - protein, 17 aa, Mycobacterium
RSRLLDRFTLGVTAGGL

SEQ ID NO: 1141619 - protein, 38 aa, Mycobacterium
RSRWLRTALVGVLVATLAIGAYLVWPNRAGHKVTAYFT

SEQ ID NO: 1141620 - protein, 39 aa, Mycobacterium
RSSVIFELGPPPPPGMRPPPMPPPGAMVAPPPPGQGHRI

SEQ ID NO: 1141621 - protein, 33 aa, Mycobacterium
RSTIRWRLTVLYGSAFFIAGAVLICLMYVFLQQ

SEQ ID NO: 1141622 - protein, 30 aa, Mycobacterium
RSVFTTQIVTRLLLFLAVAVVFGAVVFAAM

SEQ ID NO: 1141623 - protein, 31 aa, Mycobacterium
RSVGATRWYTQLPFLLEAMLAALIGVVIAIV

SEQ ID NO: 1141624 - protein, 25 aa, Mycobacterium
RSVGGGWWKTLFAAVIPQSMPALVG

SEQ ID NO: 1141625 - protein, 27 aa, Mycobacterium
RSVTTFPWVFLFPAGVLVLIVFCANLV

SEQ ID NO: 1141626 - protein, 31 aa, Mycobacterium
RTAAALASRWRLLAVSVLIASAAVLTTLYLT

SEQ ID NO: 1141627 - protein, 21 aa, Mycobacterium
RTAMLWTAIGIWLEPLRSTFD

SEQ ID NO: 1141628 - protein, 32 aa, Mycobacterium
RTAPAFITVLGVLLLPFVLISFNTVVDTLMTA

SEQ ID NO: 1141629 - protein, 18 aa, Mycobacterium
RTATVLVFTSSAAVLVVE

SEQ ID NO: 1141630 - protein, 24 aa, Mycobacterium
RTELQADCYAGIWAHYASITKQEG

SEQ ID NO: 1141631 - protein, 31 aa, Mycobacterium
RTELVFAGLAGALLLTGWLLAAFADTPRSAE

SEQ ID NO: 1141632 - protein, 31 aa, Mycobacterium
RTELVFAGLAGSLLLTGWLLAAFADTPRSAE

SEQ ID NO: 1141633 - protein, 23 aa, Mycobacterium
RTGSRRRSRWQTAAGVVAVLCSV

SEQ ID NO: 1141634 - protein, 19 aa, Mycobacterium
RTIFAAAVVFFLIGSVLCG

SEQ ID NO: 1141635 - protein, 26 aa, Mycobacterium
RTIPRAILIALFITVGVYLIVGVAAL

SEQ ID NO: 1141636 - protein, 22 aa, Mycobacterium
RTLLYVLMVVLSGALLIGAVVL

SEQ ID NO: 1141637 - protein, 42 aa, Mycobacterium
RTLMTPNWKSAMLVLLVLYPTVMLLSRFLGPILDNAGAAPWL

SEQ ID NO: 1141638 - protein, 25 aa, Mycobacterium
RTLTVPAIATLLREASWWPTKATNP

SEQ ID NO: 1141639 - protein, 26 aa, Mycobacterium
RTLTVPAIATLLREASWWPTKATNPR

SEQ ID NO: 1141640 - protein, 17 aa, Mycobacterium
RTNLEILFDADLAHRPA

SEQ ID NO: 1141641 - protein, 23 aa, Mycobacterium
RTPDAPWYDNWIVALSAAVVIGI

SEQ ID NO: 1141642 - protein, 18 aa, Mycobacterium
RTPGFPIAIPHPRFGDFH

SEQ ID NO: 1141643 - protein, 27 aa, Mycobacterium
RTPRGRLRRAVLPAAFSGVIVASVVAA

SEQ ID NO: 1141644 - protein, 27 aa, Mycobacterium
RTPRGRLRRAVLPAAFSSVIVASVVAA

SEQ ID NO: 1141645 - protein, 27 aa, Mycobacterium
RTQPAIRAAILFMAVMMTIGLAGRGGK

SEQ ID NO: 1141646 - protein, 26 aa, Mycobacterium
RTSGFLILTVFVGSVLWIIGASWGWH

SEQ ID NO: 1141647 - protein, 22 aa, Mycobacterium
RTTAFWVGLCVVLVPLGAGVSA

SEQ ID NO: 1141648 - protein, 20 aa, Mycobacterium
RTTMLVRAGDRWLGAIGLMD

SEQ ID NO: 1141649 - protein, 24 aa, Mycobacterium
RTTNQLFIVLPDSGQLRPVYNLTS

SEQ ID NO: 1141650 - protein, 17 aa, Mycobacterium
RTVAVAVLLLLAVVALR

SEQ ID NO: 1141651 - protein, 19 aa, Mycobacterium
RTWLLVYLAVTVAGALWCG

SEQ ID NO: 1141652 - protein, 17 aa, Mycobacterium
RVAFWLSAVVVLIGYYI

SEQ ID NO: 1141653 - protein, 27 aa, Mycobacterium
RVARIPLAWILPRMLIEAPFIVLALLL

SEQ ID NO: 1141654 - protein, 25 aa, Mycobacterium
RVCASVLCWLTLTLVHRGRPSAPRR

SEQ ID NO: 1141655 - protein, 19 aa, Mycobacterium
RVDAAHRAVPALLVFGFAV

SEQ ID NO: 1141656 - protein, 18 aa, Mycobacterium
RVETPIAMPLILGGLRTA

SEQ ID NO: 1141657 - protein, 32 aa, Mycobacterium
RVFYAREEPWTPILLIIVITIVKIAASLAAPH

SEQ ID NO: 1141658 - protein, 29 aa, Mycobacterium
RVGGAARWWRLLYVAALVSWVSGQILWWT

SEQ ID NO: 1141659 - protein, 22 aa, Mycobacterium
RVHRTVWPKIAGAKVLDELFPP

SEQ ID NO: 1141660 - protein, 28 aa, Mycobacterium
RVIAGFLVVIPLYCVGVLMAFWAARFGT

SEQ ID NO: 1141661 - protein, 31 aa, Mycobacterium
RVIRRASIPIILSWIALAAFLNISVPQLEEV

SEQ ID NO: 1141662 - protein, 32 aa, Mycobacterium
RVLHQWRWSLTALWFTAVILLILVRFWDYWST

SEQ ID NO: 1141663 - protein, 24 aa, Mycobacterium
RVLIVVALLLVYTAPSADAVGPPA

SEQ ID NO: 1141664 - protein, 17 aa, Mycobacterium
RVLNEVYVPLWARRVAR

SEQ ID NO: 1141665 - protein, 22 aa, Mycobacterium
RVLPSNLVAIAALVGWAIALRY

SEQ ID NO: 1141666 - protein, 25 aa, Mycobacterium
RVLRGLYYFFLGVVVLQFSGALGAA

SEQ ID NO: 1141667 - protein, 18 aa, Mycobacterium
RVMELLAVVPTMAANVPQ

SEQ ID NO: 1141668 - protein, 21 aa, Mycobacterium
RVNPAFERALGYSAAELAARP

SEQ ID NO: 1141669 - protein, 29 aa, Mycobacterium
RVNSFTSTFVFIGAVVYIMAAPKGREDPS

SEQ ID NO: 1141670 - protein, 18 aa, Mycobacterium
RVPTLWIVLGPLGQSITV

SEQ ID NO: 1141671 - protein, 25 aa, Mycobacterium
RVQPNGFVVLTWPSGLLLEGDRPIG

SEQ ID NO: 1141672 - protein, 17 aa, Mycobacterium
RVRFFRRKWTAVTLSST

SEQ ID NO: 1141673 - protein, 23 aa, Mycobacterium
RVRRPLIDLSLFRAGRFTILVVA

SEQ ID NO: 1141674 - protein, 25 aa, Mycobacterium
RVRVLEIVPFFSLLGGVVSMSLTLL

SEQ ID NO: 1141675 - protein, 27 aa, Mycobacterium
RVVLAGAGLVLALIAVAAAVFLARFER

SEQ ID NO: 1141676 - protein, 17 aa, Mycobacterium
RVVSGRQPGLYGATGQM

SEQ ID NO: 1141677 - protein, 17 aa, Mycobacterium
RVVTQWPRSARAFWLMT

SEQ ID NO: 1141678 - protein, 18 aa, Mycobacterium
RVVVANRSFLLFAAAMIG

SEQ ID NO: 1141679 - protein, 19 aa, Mycobacterium
RVWMRRLVARSPIVRGTDR

SEQ ID NO: 1141680 - protein, 26 aa, Mycobacterium
RWAVFAVWLLLLVPSIYLALNQSSHL

SEQ ID NO: 1141681 - protein, 24 aa, Mycobacterium
RWEHVLFPIVLIALGIFILVSGLA

SEQ ID NO: 1141682 - protein, 24 aa, Mycobacterium
RWEHVLFPIVLIALGLFILVSGLA

SEQ ID NO: 1141683 - protein, 19 aa, Mycobacterium
RWGAFLRDLDAFDAEFFEI

SEQ ID NO: 1141684 - protein, 18 aa, Mycobacterium
RWGNLLTLPMGQGGLLYV

SEQ ID NO: 1141685 - protein, 24 aa, Mycobacterium
RWGRKWMIAGGMWLQAIALAMIAN

SEQ ID NO: 1141686 - protein, 19 aa, Mycobacterium
RWHAWVRLIVPLVVAFVLA

SEQ ID NO: 1141687 - protein, 18 aa, Mycobacterium
RWLDLTLPPIVTGAIVAL

SEQ ID NO: 1141688 - protein, 22 aa, Mycobacterium
RWPHPRLGMLSPDAFLPLVRQH

SEQ ID NO: 1141689 - protein, 20 aa, Mycobacterium
RWRFVLVVAGMWIVAAAAGA

SEQ ID NO: 1141690 - protein, 17 aa, Mycobacterium
RWTLRLDVTDVDGRLAV

SEQ ID NO: 1141691 - protein, 17 aa, Mycobacterium
RWWVAVRTGVRVCAAVA

SEQ ID NO: 1141692 - protein, 30 aa, Mycobacterium
RYAEGAYGFWIPLTVLMVLRPETAHTYTRC

SEQ ID NO: 1141693 - protein, 20 aa, Mycobacterium
RYAWLVSLLDTGFSLVLIGL

SEQ ID NO: 1141694 - protein, 17 aa, Mycobacterium
RYIPRDTPPWKPMAAAF

SEQ ID NO: 1141695 - protein, 19 aa, Mycobacterium
RYMTPAFGTIVMGLSALFF

SEQ ID NO: 1141696 - protein, 22 aa, Mycobacterium
RYPGELLRLIAQMGLGTGALAV

SEQ ID NO: 1141697 - protein, 28 aa, Mycobacterium
RYRERLTVPLWWWLPGLGVAALIALEIN

SEQ ID NO: 1141698 - protein, 20 aa, Mycobacterium
RYVIGVMLDAPHRAADGSPG

SEQ ID NO: 1141699 - protein, 20 aa, Mycobacterium
RYWNRIAVTVVRRPKPLLAG

SEQ ID NO: 1141700 - protein, 20 aa, Mycobacterium
SAAFIMFAGIFYGGMYGGST

SEQ ID NO: 1141701 - protein, 25 aa, Mycobacterium
SAALDIVLIKLFPALAPYAVVEDFG

SEQ ID NO: 1141702 - protein, 33 aa, Mycobacterium
SAALIAIILLLVYRSVVTALLPLLVVGVSVAVA

SEQ ID NO: 1141703 - protein, 37 aa, Mycobacterium
SAALILGVMFTLLAMALMFVLSWFKPAGQVGQSAILA

SEQ ID NO: 1141704 - protein, 17 aa, Mycobacterium
SAAVIVAAVPLLLRARR

SEQ ID NO: 1141705 - protein, 23 aa, Mycobacterium
SADPFLRLLTATATLWILSQVFI

SEQ ID NO: 1141706 - protein, 19 aa, Mycobacterium
SAFAFAFAFISPIVALYGI

SEQ ID NO: 1141707 - protein, 28 aa, Mycobacterium
SAFFTPRFVKWFGLFTTHVIIAAALAVT

SEQ ID NO: 1141708 - protein, 29 aa, Mycobacterium
SAFFTPRFVNWFGLFTTHLVIAIALALTA

SEQ ID NO: 1141709 - protein, 25 aa, Mycobacterium
SAFLFGPMYFFAKGMWRKGLTLLGV

SEQ ID NO: 1141710 - protein, 22 aa, Mycobacterium
SAFLRTMMHSVMAHYSPDEATI

SEQ ID NO: 1141711 - protein, 27 aa, Mycobacterium
SAGFCMSVLLLRLVADRALLTAFTAAG

SEQ ID NO: 1141712 - protein, 20 aa, Mycobacterium
SAGHFPLAIGVLQVLALDIG

SEQ ID NO: 1141713 - protein, 19 aa, Mycobacterium
SAGKVHIFSDWPGAHRMNF

SEQ ID NO: 1141714 - protein, 20 aa, Mycobacterium
SAGMAGWLYLNDYRPDQQTD

SEQ ID NO: 1141715 - protein, 25 aa, Mycobacterium
SAGQRRRLLLARALVSAAPTVLLDE

SEQ ID NO: 1141716 - protein, 28 aa, Mycobacterium
SAHPNIAGIPWWGAILTAVIASAIGFAF

SEQ ID NO: 1141717 - protein, 32 aa, Mycobacterium
SAIAWWHDPLINWFQPVLFYNAGLVNFGNWME

SEQ ID NO: 1141718 - protein, 28 aa, Mycobacterium
SAICRHYWPIALIAALVSRRSRRVVVVA

SEQ ID NO: 1141719 - protein, 21 aa, Mycobacterium
SAIVLIFFGGVFAAIDAALST

SEQ ID NO: 1141720 - protein, 26 aa, Mycobacterium
SALEIMRMRLTPAAFERGAALAATFA

SEQ ID NO: 1141721 - protein, 32 aa, Mycobacterium
SALFALAVGIVFTWLFMYGMVPVMQGPIAIAL

SEQ ID NO: 1141722 - protein, 21 aa, Mycobacterium
SALLGSPLDAALVGGVLLANA

SEQ ID NO: 1141723 - protein, 32 aa, Mycobacterium
SALLQVAVVHLPFLQHAFSTEPLSLAQWAVCI

SEQ ID NO: 1141724 - protein, 19 aa, Mycobacterium
SALRELWSAASPKTRLPVV

SEQ ID NO: 1141725 - protein, 23 aa, Mycobacterium
SALRLFRRLTPQRGMTVAVMLLG

SEQ ID NO: 1141726 - protein, 34 aa, Mycobacterium
SALSFTVGALLPLIAILLPPTTWRVPVTVISVLI

SEQ ID NO: 1141727 - protein, 17 aa, Mycobacterium
SALTAAVMWMVLGTAFA

SEQ ID NO: 1141728 - protein, 17 aa, Mycobacterium
SAPAPWPQPVSVPSPVP

SEQ ID NO: 1141729 - protein, 25 aa, Mycobacterium
SAQHDLWFVVWMPVAFVAYCLGVLA

SEQ ID NO: 1141730 - protein, 23 aa, Mycobacterium
SAQTPLFTIFGSTALLVFSDFPG

SEQ ID NO: 1141731 - protein, 26 aa, Mycobacterium
SARIPTPVILVVVATLLFGVFANRWL

SEQ ID NO: 1141732 - protein, 17 aa, Mycobacterium
SARKLSVLSLPTTFIFD

SEQ ID NO: 1141733 - protein, 20 aa, Mycobacterium
SASPWAWLLVGATALGAVLR

SEQ ID NO: 1141734 - protein, 24 aa, Mycobacterium
SATAFLALLVLYFLGFDQGATSVF

SEQ ID NO: 1141735 - protein, 25 aa, Mycobacterium
SATHWFRGDPWLTFDMIQGGHCLRY

SEQ ID NO: 1141736 - protein, 19 aa, Mycobacterium
SATWIERALVVLVAASPCA

SEQ ID NO: 1141737 - protein, 35 aa, Mycobacterium
SAVGADYFLVSPKPPVRWGLPLVSVIVAVVMTAAV

SEQ ID NO: 1141738 - protein, 23 aa, Mycobacterium
SAVLIFGMPLLIPVAIAIKLTSK

SEQ ID NO: 1141739 - protein, 24 aa, Mycobacterium
SAVLILMLGSFLFSLISGNRAPDG

SEQ ID NO: 1141740 - protein, 21 aa, Mycobacterium
SAVLMLYTIVIIRGLRTAIAV

SEQ ID NO: 1141741 - protein, 27 aa, Mycobacterium
SAVLSGVLLNFFLVEPRHTFTISEPDS

SEQ ID NO: 1141742 - protein, 21 aa, Mycobacterium
SAVVDFGLYVALLAAGLHVNI

SEQ ID NO: 1141743 - protein, 20 aa, Mycobacterium
SAWGFSKWWVAVGTVIVLAF

SEQ ID NO: 1141744 - protein, 29 aa, Mycobacterium
SAWSLPEVRWALIATVLFVVGGLAQLVGA

SEQ ID NO: 1141745 - protein, 20 aa, Mycobacterium
SAWTLGARLIPAIGLVGCLV

SEQ ID NO: 1141746 - protein, 18 aa, Mycobacterium
SAYYPVLVAIFTALVIIS

SEQ ID NO: 1141747 - protein, 23 aa, Mycobacterium
SCAAAAWYWLYKAPEGTAEAVST

SEQ ID NO: 1141748 - protein, 27 aa, Mycobacterium
SDALTAVPLWIAFALSTKAATRRYTYG

SEQ ID NO: 1141749 - protein, 20 aa, Mycobacterium
SDDGLIQTYRITPDTHAVTT

SEQ ID NO: 1141750 - protein, 34 aa, Mycobacterium
SDGVTPWIAAPLLFIGVLFGLLLVTGTTIREVPA

SEQ ID NO: 1141751 - protein, 24 aa, Mycobacterium
SDIFGKRRILTGTLLLAGVGAVVC

SEQ ID NO: 1141752 - protein, 18 aa, Mycobacterium
SDLLWSFLQAIVMSIAVM

SEQ ID NO: 1141753 - protein, 22 aa, Mycobacterium
SDLLWSFLQAIVMSIAVMLVHT

SEQ ID NO: 1141754 - protein, 25 aa, Mycobacterium
SDNAPLLFAALFIYGAGTATNLQAR

SEQ ID NO: 1141755 - protein, 41 aa, Mycobacterium; identical to SEQ ID NO: 369033

SEQ ID NO: 1141756 - protein, 29 aa, Mycobacterium
SDPALAVGLLLLVLVLNVAVPFAVQAIVH

SEQ ID NO: 1141757 - protein, 24 aa, Mycobacterium
SDPGVPVPLPYYGPPDHLVPPYGR

SEQ ID NO: 1141758 - protein, 25 aa, Mycobacterium
SDPIAWWNPDLLFARPDWLHEPRGY

SEQ ID NO: 1141759 - protein, 25 aa, Mycobacterium
SDPNPCTVGFLPSTQWRSPEDETTI

SEQ ID NO: 1141760 - protein, 29 aa, Mycobacterium
SDQWALDNQSWPTTLWATNATISAAILSG

SEQ ID NO: 1141761 - protein, 24 aa, Mycobacterium
SDSDIFTLSFPWEPWTRPENVADG

SEQ ID NO: 1141762 - protein, 17 aa, Mycobacterium
SDTVMLVNIPANRKRVV

SEQ ID NO: 1141763 - protein, 23 aa, Mycobacterium
SEDQWFAFTPPRVPVLQTAQDFL

SEQ ID NO: 1141764 - protein, 25 aa, Mycobacterium
SEFARFMRKPEQLGELAKAGFRVEG

SEQ ID NO: 1141765 - protein, 21 aa, Mycobacterium
SELLGHTYVTPFDSLIVAAGA

SEQ ID NO: 1141766 - protein, 25 aa, Mycobacterium
SELLYPLLPIYLTSVLGAPAAVVGA

SEQ ID NO: 1141767 - protein, 20 aa, Mycobacterium
SELQRLRGMTPRAALTKHLL

SEQ ID NO: 1141768 - protein, 17 aa, Mycobacterium
SEPPPPDGGWSAAGYGA

SEQ ID NO: 1141769 - protein, 49 aa, Mycobacterium
SEPYPSVWQLLSVAGERLVLYLGLAAALGLVASWLLSRRIKRHTRGLEV

SEQ ID NO: 1141770 - protein, 28 aa, Mycobacterium
SEQPHPYPRWIATAGWAGFALGIAMLLG

SEQ ID NO: 1141771 - protein, 35 aa, Mycobacterium
SERFPSEWIYAQGLLFIVVVGFFPAGLAGLGVLLK

SEQ ID NO: 1141772 - protein, 29 aa, Mycobacterium
SERKLQLALLIPILPFGFAFGLFSARTDL

SEQ ID NO: 1141773 - protein, 36 aa, Mycobacterium
SETGTAFRRLFANPWLWVAIAVSALLQVAVVHLPFL

SEQ ID NO: 1141774 - protein, 30 aa, Mycobacterium
SETTSAFRHLFSNGWLWASVGLGVALQIAV

SEQ ID NO: 1141775 - protein, 22 aa, Mycobacterium
SETVIATALTFDVDDREIVATV

SEQ ID NO: 1141776 - protein, 24 aa, Mycobacterium
SEVTNLELYLIFPLNNEESTISLV

SEQ ID NO: 1141777 - protein, 25 aa, Mycobacterium
SEVTNLELYLIFPLNNEESTISLVR

SEQ ID NO: 1141778 - protein, 17 aa, Mycobacterium
SEWMAHPITVTVLTIFA

SEQ ID NO: 1141779 - protein, 17 aa, Mycobacterium
SFALQVWVNNAWVTAQC

SEQ ID NO: 1141780 - protein, 20 aa, Mycobacterium
SFEFPLLIIMLNLVGILTYE

SEQ ID NO: 1141781 - protein, 23 aa, Mycobacterium
SFGLSVLLWQHVVGIPLGWMVLP

SEQ ID NO: 1141782 - protein, 27 aa, Mycobacterium
SFHVVGTLLVLGLLVAPPAAALAWSRS

SEQ ID NO: 1141783 - protein, 22 aa, Mycobacterium
SFLPPALAWPLAVVAVAASVAI

SEQ ID NO: 1141784 - protein, 20 aa, Mycobacterium
SFRIHLLFASQTLDVGRIKD

SEQ ID NO: 1141785 - protein, 21 aa, Mycobacterium
SFSYPAMFGFGAFAAAVCLLV

SEQ ID NO: 1141786 - protein, 22 aa, Mycobacterium
SGALLPVTLALAADLWAARNRA

SEQ ID NO: 1141787 - protein, 23 aa, Mycobacterium
SGAPGSLLALVGVALGAAAGILL

SEQ ID NO: 1141788 - protein, 23 aa, Mycobacterium
SGAYFFVVYIQDVSPGAFAAGLT

SEQ ID NO: 1141789 - protein, 30 aa, Mycobacterium
SGAYTRYVKPSLQPWLLASAALLITLAVVS

SEQ ID NO: 1141790 - protein, 27 aa, Mycobacterium
SGDQYFGFLINLLLVFGFSFEFPLLIV

SEQ ID NO: 1141791 - protein, 28 aa, Mycobacterium
SGDVVFQRGFQLPPLPPGTDTVMVNGVE

SEQ ID NO: 1141792 - protein, 27 aa, Mycobacterium
SGEAELAYLLAGWRDEIRQPPMAGVVT

SEQ ID NO: 1141793 - protein, 18 aa, Mycobacterium
SGFFIITEKQYGFGDLVA

SEQ ID NO: 1141794 - protein, 23 aa, Mycobacterium
SGGALVLALLLCATVAALFGSLR

SEQ ID NO: 1141795 - protein, 28 aa, Mycobacterium
SGKVITMWMPIMLFFYMGFEHSVVNMFL

SEQ ID NO: 1141796 - protein, 17 aa, Mycobacterium
SGLALWCFAAMAVSGFV

SEQ ID NO: 1141797 - protein, 19 aa, Mycobacterium
SGLALWCFAAMAVSGIVNA

SEQ ID NO: 1141798 - protein, 21 aa, Mycobacterium
SGLGAALRYAAVDRDVVIVAA

SEQ ID NO: 1141799 - protein, 17 aa, Mycobacterium
SGLLFILPILSTGPLPV

SEQ ID NO: 1141800 - protein, 21 aa, Mycobacterium
SGLLLIIAIGFLTSVFVEPPP

SEQ ID NO: 1141801 - protein, 26 aa, Mycobacterium
SGLNSPVDFRFLPDGRILVAEKAGAI

SEQ ID NO: 1141802 - protein, 20 aa, Mycobacterium
SGLQFYYLVSASLVVLVLGI

SEQ ID NO: 1141803 - protein, 25 aa, Mycobacterium
SGLSAHLLGWPPGTVIALVVAVPLL

SEQ ID NO: 1141804 - protein, 21 aa, Mycobacterium
SGPASNWDRAPGAPAPAAGNW

SEQ ID NO: 1141805 - protein, 29 aa, Mycobacterium
SGPRTKLFVTLFLILALVVIGEIAGVVLG

SEQ ID NO: 1141806 - protein, 18 aa, Mycobacterium
SGRTVVLTWLACAALLAV

SEQ ID NO: 1141807 - protein, 27 aa, Mycobacterium
SGSALSLMAIPLHYGLSAPASATVSVA

SEQ ID NO: 1141808 - protein, 23 aa, Mycobacterium
SGSYALYVAILATLATGAAYVPV

SEQ ID NO: 1141809 - protein, 23 aa, Mycobacterium
SGTHLAFAMLDLDRFKVLNDTLG

SEQ ID NO: 1141810 - protein, 30 aa, Mycobacterium
SGTIPLWVLFMYPVFWGPAILYLVTRLETG

SEQ ID NO: 1141811 - protein, 22 aa, Mycobacterium
SGTLITFPTLVTLGFPPVTATM

SEQ ID NO: 1141812 - protein, 23 aa, Mycobacterium
SGTMGWLAGLWHDVLAAPVDGPE

SEQ ID NO: 1141813 - protein, 26 aa, Mycobacterium
SGTVEFYAVIFLSIGASLGAALLGRL

SEQ ID NO: 1141814 - protein, 32 aa, Mycobacterium
SGVFVPIVIAIAVITLGAWLGAGFSVAAAFTA

SEQ ID NO: 1141815 - protein, 25 aa, Mycobacterium
SGVFYGTRWILLAAYVALLLPYSMR

SEQ ID NO: 1141816 - protein, 27 aa, Mycobacterium
SGVLAFWVCGLLLCLFIGPTLSSARTL

SEQ ID NO: 1141817 - protein, 21 aa, Mycobacterium
SGVRLVSSAQWTTFSSADFWV

SEQ ID NO: 1141818 - protein, 24 aa, Mycobacterium
SHAAMRLWALFDLIPRAAEFERTD

SEQ ID NO: 1141819 - protein, 23 aa, Mycobacterium
SHDWAPWIWATIGIGIAVMAAFL

SEQ ID NO: 1141820 - protein, 33 aa, Mycobacterium
SHGRWMRVGLAALLVVTLAVGIYLVWPSRTGNK

SEQ ID NO: 1141821 - protein, 27 aa, Mycobacterium
SHRRVTRWELLWAAVLAGAVAVIVTVG

SEQ ID NO: 1141822 - protein, 26 aa, Mycobacterium
SHRVAMLWTAAGIWFEPIRTILTCSQ

SEQ ID NO: 1141823 - protein, 33 aa, Mycobacterium
SHTGGAWLILFMIFNVIWTYALVRGAGANTGAL

SEQ ID NO: 1141824 - protein, 35 aa, Mycobacterium
SHWEHTASAWWFDMGMLALLSIAYVGFVRWRIRLS

SEQ ID NO: 1141825 - protein, 26 aa, Mycobacterium
SIAALMGKWFWWPTHVRRRPKPKPWP

SEQ ID NO: 1141826 - protein, 28 aa, Mycobacterium
SIAMTIPIALFMGLYLRFLRPGRVSEVS

SEQ ID NO: 1141827 - protein, 25 aa, Mycobacterium
SIDRNLAVFIPLTVLLFTGWALLAA

SEQ ID NO: 1141828 - protein, 18 aa, Mycobacterium
SIFYSAIGGWILLLTFLF

SEQ ID NO: 1141829 - protein, 18 aa, Mycobacterium
SIHSLFDKLPLMVLVLIV

SEQ ID NO: 1141830 - protein, 24 aa, Mycobacterium
SILGVQLFALMFDGLMRDAAADVH

SEQ ID NO: 1141831 - protein, 26 aa, Mycobacterium
SILPTLLLTIPYTVLLTFIETILLTE

SEQ ID NO: 1141832 - protein, 37 aa, Mycobacterium
SIMARLPIVLGIIAVITFVLLFLLTGSLVLPVKALVL

SEQ ID NO: 1141833 - protein, 22 aa, Mycobacterium
SITLLPSLIVLAGRRGWLTPRK

SEQ ID NO: 1141834 - protein, 21 aa, Mycobacterium
SITVFALMWGLPYLTEAQGLS

SEQ ID NO: 1141835 - protein, 20 aa, Mycobacterium
SIVAPLVMPGIVAGATIVLY

SEQ ID NO: 1141836 - protein, 21 aa, Mycobacterium
SIVFTIPSLALFVVLPLIIPT

SEQ ID NO: 1141837 - protein, 26 aa, Mycobacterium
SIVVPFMAVVYIVLALIIVLMNAAEI

SEQ ID NO: 1141838 - protein, 24 aa, Mycobacterium
SKDGKAWNLPVSLTGYMGAPNGQA

SEQ ID NO: 1141839 - protein, 25 aa, Mycobacterium
SKERVPYFALPRYVEFRTELPTSPL

SEQ ID NO: 1141840 - protein, 21 aa, Mycobacterium
SKKRVLLGVLVVVLIGSVLAA

SEQ ID NO: 1141841 - protein, 25 aa, Mycobacterium
SKLLSRNLYIFGLGGIIAPFVGIKA

SEQ ID NO: 1141842 - protein, 18 aa, Mycobacterium
SKPVSLRDRLPAPSGAAV

SEQ ID NO: 1141843 - protein, 17 aa, Mycobacterium
SKQTLLCAYLSAVLLVG

SEQ ID NO: 1141844 - protein, 23 aa, Mycobacterium
SKSAIVPMHFWLPGAMAAPTPVS

SEQ ID NO: 1141845 - protein, 19 aa, Mycobacterium
SLAGLFYIPFTVAAAVCAF

SEQ ID NO: 1141846 - protein, 19 aa, Mycobacterium
SLAGLIRDAKLGAGHRAAS

SEQ ID NO: 1141847 - protein, 27 aa, Mycobacterium
SLAILWGFAGIVFISFYSANLSATLTV

SEQ ID NO: 1141848 - protein, 19 aa, Mycobacterium
SLALFVVLPLIIPTRILDE

SEQ ID NO: 1141849 - protein, 23 aa, Mycobacterium
SLAPLLLLPLLNRQWRSLVTAVA

SEQ ID NO: 1141850 - protein, 24 aa, Mycobacterium
SLARTRRGLRALLSLVPDEATVLR

SEQ ID NO: 1141851 - protein, 23 aa, Mycobacterium
SLARTRRGLRALLSLVPDQATVL

SEQ ID NO: 1141852 - protein, 19 aa, Mycobacterium
SLATIWLRTGLMPRPLVYV

SEQ ID NO: 1141853 - protein, 21 aa, Mycobacterium
SLAVLWLKRWPTRTESVLFAA

SEQ ID NO: 1141854 - protein, 31 aa, Mycobacterium
SLAVQFLTDNPWWIGIPLGLMLVITGTLGDL

SEQ ID NO: 1141855 - protein, 26 aa, Mycobacterium
SLAWAARWAFLPWPTARESAVLVGCV

SEQ ID NO: 1141856 - protein, 32 aa, Mycobacterium
SLDILLFYVFFEAMLIPMYFLIGGFGGADRSR

SEQ ID NO: 1141857 - protein, 25 aa, Mycobacterium
SLDYALFHGTGFYDLLRGWWGLLIS

SEQ ID NO: 1141858 - protein, 17 aa, Mycobacterium
SLFSLFQALFAAITVAL

SEQ ID NO: 1141859 - protein, 19 aa, Mycobacterium
SLFTTLFALGVWFALHRRS

SEQ ID NO: 1141860 - protein, 17 aa, Mycobacterium
SLGIRPIPYLVTTRLMA

SEQ ID NO: 1141861 - protein, 20 aa, Mycobacterium
SLGVFAVWLVRFMRSKDTSP

SEQ ID NO: 1141862 - protein, 18 aa, Mycobacterium
SLIAAVFVILFASLAIYG

SEQ ID NO: 1141863 - protein, 27 aa, Mycobacterium
SLIAFLSYFMQILVAVLMATFILVIIP

SEQ ID NO: 1141864 - protein, 25 aa, Mycobacterium
SLIIGAMMYIPLLNRALDEIVAMGL

SEQ ID NO: 1141865 - protein, 17 aa, Mycobacterium
SLLAVTALAGAPSLIAP

SEQ ID NO: 1141866 - protein, 24 aa, Mycobacterium
SLLGALIAWVLLCVEILRLPALEN

SEQ ID NO: 1141867 - protein, 23 aa, Mycobacterium
SLLGLAVGWFVGALVVLVVGTPA

SEQ ID NO: 1141868 - protein, 23 aa, Mycobacterium
SLLLWGGVALMLMAWLWLGRRVV

SEQ ID NO: 1141869 - protein, 19 aa, Mycobacterium
SLLTQRLYWAQRGLAYQVH

SEQ ID NO: 1141870 - protein, 30 aa, Mycobacterium
SLLVSLLVSWLLFTWIIARLPRESITLRSS

SEQ ID NO: 1141871 - protein, 24 aa, Mycobacterium
SLMPTLLVAIPFTVLVSFTLNILL

SEQ ID NO: 1141872 - protein, 17 aa, Mycobacterium
SLPVYVTNAFFNGFVPP

SEQ ID NO: 1141873 - protein, 24 aa, Mycobacterium
SLRRRRFRWCVAAAYLSGVSTVAG

SEQ ID NO: 1141874 - protein, 25 aa, Mycobacterium
SLRSRLIVIQVLLLAAACAGIAVAT

SEQ ID NO: 1141875 - protein, 28 aa, Mycobacterium
SLRSRRLETRLMMLLGAGFGLGVALAVS

SEQ ID NO: 1141876 - protein, 27 aa, Mycobacterium
SLSQTLRLGWMALPDNLIDAVLAAAGG

SEQ ID NO: 1141877 - protein, 43 aa, Mycobacterium
SLTDLIPAQVYWMVLQLILAVALLAWWKGRRVGPLVAEALPVV

SEQ ID NO: 1141878 - protein, 35 aa, Mycobacterium
SLTIGAIVLWSSFIASILPPLLKKCRLDPALVSAP

SEQ ID NO: 1141879 - protein, 20 aa, Mycobacterium
SLTIIFVFAVTTLQPLAIYS

SEQ ID NO: 1141880 - protein, 26 aa, Mycobacterium
SLTPSLLPRDWLFQGLIGGLNAAIGY

SEQ ID NO: 1141881 - protein, 18 aa, Mycobacterium
SLTTAVLLLGWRAVVQVA

SEQ ID NO: 1141882 - protein, 17 aa, Mycobacterium
SLTVALLTLKRAIDRAP

SEQ ID NO: 1141883 - protein, 24 aa, Mycobacterium
SLTVLVLALALFRDSRMRLIGQLE

SEQ ID NO: 1141884 - protein, 18 aa, Mycobacterium
SLVALTDWYPLDPIVALA

SEQ ID NO: 1141885 - protein, 20 aa, Mycobacterium
SLVASMYFLIGDLGRPERFH

SEQ ID NO: 1141886 - protein, 31 aa, Mycobacterium
SLVLTAILGSIAAPKLKWLAAGVGGGLTFAA

SEQ ID NO: 1141887 - protein, 26 aa, Mycobacterium
SLVPAPTVIIVGLPAGLRLAVDNAIA

SEQ ID NO: 1141888 - protein, 25 aa, Mycobacterium
SLVPTLLVAIPFTVLVAFTLNILLR

SEQ ID NO: 1141889 - protein, 21 aa, Mycobacterium
SLVVVFQWGWLADLGFKQISS

SEQ ID NO: 1141890 - protein, 18 aa, Mycobacterium
SLWQVRELQFAAVAGVFL

SEQ ID NO: 1141891 - protein, 19 aa, Mycobacterium
SLYERFLPLAGASTQRLVR

SEQ ID NO: 1141892 - protein, 28 aa, Mycobacterium
SLYGPDGLPLWAAPPPGMPPPPVPGVPN

SEQ ID NO: 1141893 - protein, 24 aa, Mycobacterium
SMARDPRWRFATADQMLACLDGPA

SEQ ID NO: 1141894 - protein, 23 aa, Mycobacterium
SMDYEVFLVSRIREYWLASGGAG

SEQ ID NO: 1141895 - protein, 22 aa, Mycobacterium
SMGRLTGTPRRASTVALIGLVY

SEQ ID NO: 1141896 - protein, 31 aa, Mycobacterium; identical to SEQ ID NO: 369699

SEQ ID NO: 1141897 - protein, 25 aa, Mycobacterium
SMLALLTRRWTLAWIALAGSTVAAF

SEQ ID NO: 1141898 - protein, 20 aa, Mycobacterium
SMLLMVVPALVTRLSWRGTR

SEQ ID NO: 1141899 - protein, 20 aa, Mycobacterium
SMQVILDRDLQLVVNSLWVS

SEQ ID NO: 1141900 - protein, 32 aa, Mycobacterium
SMTAGRLWFVEVLVWTLIALAVLFCIPAVDRL

SEQ ID NO: 1141901 - protein, 30 aa, Mycobacterium; identical to SEQ ID NO: 369717

SEQ ID NO: 1141902 - protein, 27 aa, Mycobacterium
SMVALVLIPVLATLAGVLGASGFMITE

SEQ ID NO: 1141903 - protein, 25 aa, Mycobacterium
SNATMLLLAPSIAVTVLSPIAPLAP

SEQ ID NO: 1141904 - protein, 17 aa, Mycobacterium
SNDAFLSWGWRVAFWLS

SEQ ID NO: 1141905 - protein, 19 aa, Mycobacterium
SNFYNIYNPAQGTVGGLLT

SEQ ID NO: 1141906 - protein, 30 aa, Mycobacterium
SNKVFAFRDGAWVDLPPLQHARVAGAAAVV

SEQ ID NO: 1141907 - protein, 18 aa, Mycobacterium
SNTCAMGTLLSKLPYNRG

SEQ ID NO: 1141908 - protein, 31 aa, Mycobacterium
SNTVYLIYGVAILALPFVILIGLIVSRQWKL

SEQ ID NO: 1141909 - protein, 17 aa, Mycobacterium
SPADAVACARRLARYRP

SEQ ID NO: 1141910 - protein, 25 aa, Mycobacterium
SPALIALGLVWWLLGAGWAAVLLTV

SEQ ID NO: 1141911 - protein, 24 aa, Mycobacterium
SPARPLGLGIAVAAGFLAAEVLAV

SEQ ID NO: 1141912 - protein, 25 aa, Mycobacterium
SPDRVSFLLVDYKGGTAFADCVGLP

SEQ ID NO: 1141913 - protein, 27 aa, Mycobacterium
SPFENSITLPFIRLPSAGEIPMGSWPT

SEQ ID NO: 1141914 - protein, 32 aa, Mycobacterium
SPFGLLIVAALLVAVFLLVWSMNRHLKRLPES

SEQ ID NO: 1141915 - protein, 17 aa, Mycobacterium
SPGFPLQYAPPPGLGPV

SEQ ID NO: 1141916 - protein, 29 aa, Mycobacterium
SPGGRTAVRVLLILAAAALVLGTVAALTT

SEQ ID NO: 1141917 - protein, 31 aa, Mycobacterium
SPISWTHHWVWLIPLMIWLLHGPLRAQLGAR

SEQ ID NO: 1141918 - protein, 23 aa, Mycobacterium
SPITVKHRIIFAVVALLGAVSWA

SEQ ID NO: 1141919 - protein, 24 aa, Mycobacterium
SPKLVIMNLRDHLFAKAPYILGDK

SEQ ID NO: 1141920 - protein, 18 aa, Mycobacterium
SPLAWTITVFFGSQAFMA

SEQ ID NO: 1141921 - protein, 25 aa, Mycobacterium
SPPPVMPPQLAWWATTLALSGLSPS

SEQ ID NO: 1141922 - protein, 27 aa, Mycobacterium
SPPSLWAMLGWLPPPVPILPVLAIVLA

SEQ ID NO: 1141923 - protein, 25 aa, Mycobacterium
SPRKPHFYGIARVIRRASIPIILSW

SEQ ID NO: 1141924 - protein, 29 aa, Mycobacterium
SPSNSPPITPWPVAPPPYPASVAPAKNRK

SEQ ID NO: 1141925 - protein, 27 aa, Mycobacterium
SPTEMLSRQFWTGRKIFVFADDVTSWN

SEQ ID NO: 1141926 - protein, 28 aa, Mycobacterium
SPTPPPPPPTVTALPPPPPEPGTNCREV

SEQ ID NO: 1141927 - protein, 22 aa, Mycobacterium
SPTRHVPPYALLLAAVVPAVII

SEQ ID NO: 1141928 - protein, 27 aa, Mycobacterium
SPVSKNVPSLRYLSYRLTMERDGADWL

SEQ ID NO: 1141929 - protein, 29 aa, Mycobacterium
SPVTKNIPSLRYLSYRLSLQRDGGDWRIV

SEQ ID NO: 1141930 - protein, 26 aa, Mycobacterium
SPVTNLELYLIFPLNNEDSTIALVRG

SEQ ID NO: 1141931 - protein, 23 aa, Mycobacterium
SPVYRALWIAQFVSNLGTWMQTV

SEQ ID NO: 1141932 - protein, 23 aa, Mycobacterium
SPWAAVMLVHWFGVARRQVDAAT

SEQ ID NO: 1141933 - protein, 22 aa, Mycobacterium
SQGLAFILFFIGVKLVLHALHE

SEQ ID NO: 1141934 - protein, 35 aa, Mycobacterium
SQGSQYYLIVFLAGSLPLVFLAYRSGIRSSRSSQQ

SEQ ID NO: 1141935 - protein, 24 aa, Mycobacterium
SQLDRTLLLWALPLLIAPPMYSKD

SEQ ID NO: 1141936 - protein, 18 aa, Mycobacterium
SQLSLGCVAALLAGGIAA

SEQ ID NO: 1141937 - protein, 22 aa, Mycobacterium
SQRGLVHLLEDLRRRTRLTVVV

SEQ ID NO: 1141938 - protein, 24 aa, Mycobacterium
SQRLRVPVVTTPQPALDAAVGAAL

SEQ ID NO: 1141939 - protein, 31 aa, Mycobacterium
SQSAIRNLFTLLPIIPFIGGLLGVIAIVVIA

SEQ ID NO: 1141940 - protein, 24 aa, Mycobacterium
SQTINPLPWLVQAQGLFAQRITFG

SEQ ID NO: 1141941 - protein, 25 aa, Mycobacterium
SRAARLFAVMMLIGVLAPITAPILG

SEQ ID NO: 1141942 - protein, 24 aa, Mycobacterium
SRERIIMTTFLIGGLLAGAAALLY

SEQ ID NO: 1141943 - protein, 20 aa, Mycobacterium
SRFHLFSVLEAVNGVLLFGI

SEQ ID NO: 1141944 - protein, 19 aa, Mycobacterium
SRGQWYFRQVLGSANLTGL

SEQ ID NO: 1141945 - protein, 43 aa, Mycobacterium
SRGRIPEYVLVGLVTVLIAGGLGWLLAGPAIRPLRKLTEQTSK

SEQ ID NO: 1141946 - protein, 28 aa, Mycobacterium
SRGWRRIGVSVVRWPGPVLAATLALALV

SEQ ID NO: 1141947 - protein, 56 aa, Mycobacterium
SRIKPTLLGVLPWRWGDPQARQLKWWARAVVTLWVILVVPLLLATVAIAVWALPRV

SEQ ID NO: 1141948 - protein, 20 aa, Mycobacterium
SRIRLTEIPVLVVGLAVILS

SEQ ID NO: 1141949 - protein, 34 aa, Mycobacterium
SRKAPLVWAIGAAIPWMFAVAAQAVWFMVDGRVP

SEQ ID NO: 1141950 - protein, 29 aa, Mycobacterium
SRLPLVCCLVAFILTFFITRTIVRYIRSH

SEQ ID NO: 1141951 - protein, 38 aa, Mycobacterium
SRMFRHLRRRHIALGGLFVLLVFVAFGCWLAVRAVQAK

SEQ ID NO: 1141952 - protein, 24 aa, Mycobacterium
SRNEYVVGWIKRGPTGVIGSNKKD

SEQ ID NO: 1141953 - protein, 25 aa, Mycobacterium
SRQLGGHWVGRPGCRRLGSIDGALS

SEQ ID NO: 1141954 - protein, 17 aa, Mycobacterium
SRQWKLLGAYAAAGLIA

SEQ ID NO: 1141955 - protein, 20 aa, Mycobacterium
SRRGSFGFLAPGFQARVVDP

SEQ ID NO: 1141956 - protein, 17 aa, Mycobacterium
SRRREARHAAREAELLA

SEQ ID NO: 1141957 - protein, 29 aa, Mycobacterium
SRSGKWSLLVSGWRLIGKCLRPLPDKWKG

SEQ ID NO: 1141958 - protein, 33 aa, Mycobacterium
SSAAPLFHNIASWLLRRENVPLSPDPGAPLTLQ

SEQ ID NO: 1141959 - protein, 46 aa, Mycobacterium
SSAIRDAVLILLVFVAALVLVLLVARSLVRPLRRLRDSALKVAHED

SEQ ID NO: 1141960 - protein, 22 aa, Mycobacterium
SSAVGEPALVALLLGKTAQADE

SEQ ID NO: 1141961 - protein, 23 aa, Mycobacterium
SSDHIGWFIVYVTVVIGVSLSVY

SEQ ID NO: 1141962 - protein, 37 aa, Mycobacterium
SSDQKWRPYYLGNPVYAFLLMVLFQYGVALHEMESEK

SEQ ID NO: 1141963 - protein, 26 aa, Mycobacterium
SSELWTSLLWIGRAWVVAAVITLVIL

SEQ ID NO: 1141964 - protein, 30 aa, Mycobacterium
SSETLPMMLAPWVLLPVILALRGEGSVRRL

SEQ ID NO: 1141965 - protein, 31 aa, Mycobacterium
SSETLPMMLAPWVLLPVVLVLQGGSGGVGET

SEQ ID NO: 1141966 - protein, 21 aa, Mycobacterium
SSFYDAYWSVVPPLLLAYWWT

SEQ ID NO: 1141967 - protein, 26 aa, Mycobacterium
SSGPIGIWTWPIAVVGQLAVAFVLGA

SEQ ID NO: 1141968 - protein, 27 aa, Mycobacterium
SSGQRALLWAAGVLGALAIVIAILIVL

SEQ ID NO: 1141969 - protein, 18 aa, Mycobacterium
SSIFFATPLLVSLRERTE

SEQ ID NO: 1141970 - protein, 26 aa, Mycobacterium
SSLVAPYFVKVLWPPENSAWPEASPG

SEQ ID NO: 1141971 - protein, 40 aa, Mycobacterium
SSMALILLVTFVVIIVLLLFFYRSITTVVLLLIMVGVQMS

SEQ ID NO: 1141972 - protein, 29 aa, Mycobacterium
SSPIVRRILLRTVLFIAPASALWGLLPVI

SEQ ID NO: 1141973 - protein, 26 aa, Mycobacterium
SSQFGFDIHWLIPALLMLALNCILTY

SEQ ID NO: 1141974 - protein, 17 aa, Mycobacterium
SSQPFWFPEVHAGAMAP

SEQ ID NO: 1141975 - protein, 25 aa, Mycobacterium
SSRCPHIMTWLRCALIACAIAVQTS

SEQ ID NO: 1141976 - protein, 22 aa, Mycobacterium
SSREAMWWISDQGVRYGIELSD

SEQ ID NO: 1141977 - protein, 25 aa, Mycobacterium
SSVKPSRFLGRLFARASHSVKPEPA

SEQ ID NO: 1141978 - protein, 29 aa, Mycobacterium
SSVPVFFSELRSANWWWALAGLAVSALKY

SEQ ID NO: 1141979 - protein, 25 aa, Mycobacterium
STALIPLALLVLAAAGAALAVRGWP

SEQ ID NO: 1141980 - protein, 25 aa, Mycobacterium
STASIRYLNLIGDRYLELARGESNT

SEQ ID NO: 1141981 - protein, 30 aa, Mycobacterium
STDSPRNPMFLFFPAMMLVSSIGTLAYGAG

SEQ ID NO: 1141982 - protein, 18 aa, Mycobacterium
STFAVLIVTCTAPWMVVM

SEQ ID NO: 1141983 - protein, 30 aa, Mycobacterium
STGLTDLPPLRALSQAGTWSWHLTRDFVAE

SEQ ID NO: 1141984 - protein, 24 aa, Mycobacterium
STGRDWWWAVALGVLGAGLMGGSV

SEQ ID NO: 1141985 - protein, 30 aa, Mycobacterium
STIKGNLFWAFAYNVAALPLAAAGLLNPMI

SEQ ID NO: 1141986 - protein, 27 aa, Mycobacterium
STIKTNLFWAFAYNVAAIPVAALGMLN

SEQ ID NO: 1141987 - protein, 24 aa, Mycobacterium
STIPLFASDPFWLVAARTVAGAGA

SEQ ID NO: 1141988 - protein, 27 aa, Mycobacterium
STIRRFMSFGLIFLMLNVLQITVVTAI

SEQ ID NO: 1141989 - protein, 22 aa, Mycobacterium
STLAAFAFMFGLGATLLAVPLY

SEQ ID NO: 1141990 - protein, 17 aa, Mycobacterium
STLDRFLPLWIGAAMVA

SEQ ID NO: 1141991 - protein, 17 aa, Mycobacterium
STLFYLFAYGFSTVGAF

SEQ ID NO: 1141992 - protein, 21 aa, Mycobacterium
STLLALWGVFLALPVAATMLY

SEQ ID NO: 1141993 - protein, 20 aa, Mycobacterium
STLLLTVIVYRTLDARDAAV

SEQ ID NO: 1141994 - protein, 18 aa, Mycobacterium
STRWQGNPIAPWHPSRKK

SEQ ID NO: 1141995 - protein, 29 aa, Mycobacterium
STSAYDVALFYRYAWRNPTFTEIVATRTY

SEQ ID NO: 1141996 - protein, 25 aa, Mycobacterium
STSRIGWIVVLLYAVCIVLRLARFN

SEQ ID NO: 1141997 - protein, 21 aa, Mycobacterium
STTYAFYDFERAWPLTVLAAV

SEQ ID NO: 1141998 - protein, 26 aa, Mycobacterium
STTYGKVLLIKLGLVVAASAAALASR

SEQ ID NO: 1141999 - protein, 26 aa, Mycobacterium
STVSIVLLVWVVLAVLNVLGVNIAPF

SEQ ID NO: 1142000 - protein, 24 aa, Mycobacterium
STVVALIAFYFLAFDQGAVSVFGA

SEQ ID NO: 1142001 - protein, 24 aa, Mycobacterium
STVWLLSGFFFLIPVVVARKKYAD

SEQ ID NO: 1142002 - protein, 23 aa, Mycobacterium
STVWSYLMYLGGLVAGPARLEYV

SEQ ID NO: 1142003 - protein, 31 aa, Mycobacterium
STYLVVGVSVLLLVVVVVVAAAALVATRQPA

SEQ ID NO: 1142004 - protein, 20 aa, Mycobacterium
SVAGLFAFLGLATVIAAAVA

SEQ ID NO: 1142005 - protein, 18 aa, Mycobacterium
SVALLWFLGVYVVTLAFV

SEQ ID NO: 1142006 - protein, 27 aa, Mycobacterium
SVAPTTVAILMLLPLSAFEATTALPAA

SEQ ID NO: 1142007 - protein, 23 aa, Mycobacterium
SVARRFAVLTLLLALVVAIAMTL

SEQ ID NO: 1142008 - protein, 24 aa, Mycobacterium
SVASGPFFKTYVANLLPGQFLQPF

SEQ ID NO: 1142009 - protein, 26 aa, Mycobacterium
SVATLGFWIGSGFPVAAAFTAAVAVL

SEQ ID NO: 1142010 - protein, 22 aa, Mycobacterium
SVDFAPVTLVSPTGAFLGLIGP

SEQ ID NO: 1142011 - protein, 22 aa, Mycobacterium
SVDNLFIFLIIMASFKVPRIYQ

SEQ ID NO: 1142012 - protein, 18 aa, Mycobacterium
SVFAVAFHGILRAGATAT

SEQ ID NO: 1142013 - protein, 34 aa, Mycobacterium
SVFTTVLLTRVVVFLVVSLLIGAIVFAGLALAYR

SEQ ID NO: 1142014 - protein, 29 aa, Mycobacterium
SVGLAFIAILLPVLVLVVAGALAWAAVRL

SEQ ID NO: 1142015 - protein, 22 aa, Mycobacterium
SVGWLRIGSLVLALAALGALLI

SEQ ID NO: 1142016 - protein, 31 aa, Mycobacterium
SVHLDPFNPVQFPIALLLNVTNPIRAEFGTD

SEQ ID NO: 1142017 - protein, 17 aa, Mycobacterium
SVHRLHRYLSESVPFPA

SEQ ID NO: 1142018 - protein, 30 aa, Mycobacterium
SVHSNAYGKVLFFITLTGGAVLVLLVGRRL

SEQ ID NO: 1142019 - protein, 21 aa, Mycobacterium
SVIGFLLAGVVFIYLIRGVDH

SEQ ID NO: 1142020 - protein, 18 aa, Mycobacterium
SVIIFMVAVPVSVALWLS

SEQ ID NO: 1142021 - protein, 29 aa, Mycobacterium
SVIRLVLVPVFLYLLLAAGATGWAVAILM

SEQ ID NO: 1142022 - protein, 30 aa, Mycobacterium
SVKAIYTTVILLPTLWLGAIPGAPQRRATA

SEQ ID NO: 1142023 - protein, 17 aa, Mycobacterium
SVKFLAPLGLFGGFIDA

SEQ ID NO: 1142024 - protein, 24 aa, Mycobacterium
SVLAFVFGWAIFRITDWLSPPEPV

SEQ ID NO: 1142025 - protein, 26 aa, Mycobacterium
SVLAKKLLIGFLTAGALILAVGAIAV

SEQ ID NO: 1142026 - protein, 26 aa, Mycobacterium
SVLAKKLLIGFLTAGALILAVGAVAV

SEQ ID NO: 1142027 - protein, 25 aa, Mycobacterium
SVLGDLPWWVTVVILVRELGVTLLR

SEQ ID NO: 1142028 - protein, 25 aa, Mycobacterium
SVLGLSGLVFFLSQYFQLVHGYGPL

SEQ ID NO: 1142029 - protein, 25 aa, Mycobacterium
SVLLGIPIPYILFQNSANLGVNAGL

SEQ ID NO: 1142030 - protein, 21 aa, Mycobacterium
SVLLVVLIVWFYRLYVYSPVS

SEQ ID NO: 1142031 - protein, 21 aa, Mycobacterium
SVLQALFIALLVGFALQGLGT

SEQ ID NO: 1142032 - protein, 23 aa, Mycobacterium
SVLRALVLLPLVLPPVVAGIALL

SEQ ID NO: 1142033 - protein, 23 aa, Mycobacterium
SVLSWFSPIAWAQQMRPFVELRW

SEQ ID NO: 1142034 - protein, 26 aa, Mycobacterium
SVLTTFVLLGHWFEMRARGGANDAIR

SEQ ID NO: 1142035 - protein, 27 aa, Mycobacterium
SVPVLLVQAGYMLIGWQAGLAFTRESL

SEQ ID NO: 1142036 - protein, 17 aa, Mycobacterium
SVQLLWFLGAYVLVLAA

SEQ ID NO: 1142037 - protein, 18 aa, Mycobacterium
SVRPILVHRAIDASPGLT

SEQ ID NO: 1142038 - protein, 23 aa, Mycobacterium
SVRRIHRMVPSLQALLAAACDRE

SEQ ID NO: 1142039 - protein, 25 aa, Mycobacterium
SVSATTLGALMLIPGVPGSGPESVS

SEQ ID NO: 1142040 - protein, 17 aa, Mycobacterium
SVTIWLLDWDDVIDRTA

SEQ ID NO: 1142041 - protein, 19 aa, Mycobacterium
SVVALCMPVSFAAGLNVLI

SEQ ID NO: 1142042 - protein, 32 aa, Mycobacterium
SVVALMFGLILMWLLSWLIATPVRVVRSALKH

SEQ ID NO: 1142043 - protein, 20 aa, Mycobacterium
SVVARPYEWWRVALVAVSGL

SEQ ID NO: 1142044 - protein, 29 aa, Mycobacterium
SVVLPPIPAAAPPASPPAPPPPPPPDMFA

SEQ ID NO: 1142045 - protein, 25 aa, Mycobacterium
SVVRDLLVPAFAPGWQIYRDKSGAA

SEQ ID NO: 1142046 - protein, 23 aa, Mycobacterium
SVVVAPLWRYRVHRWDLDATAVY

SEQ ID NO: 1142047 - protein, 41 aa, Mycobacterium
SVVVTWLLAVAGGLLQVWVISLWPPLRWRNQRKALVAAYRS

SEQ ID NO: 1142048 - protein, 25 aa, Mycobacterium
SVVWSFLLAVTMAVVIMLVHTYYGF

SEQ ID NO: 1142049 - protein, 19 aa, Mycobacterium
SWLKQVLLTQLWFQPYFDG

SEQ ID NO: 1142050 - protein, 18 aa, Mycobacterium
SWLRFGHGLVVSSLLLWG

SEQ ID NO: 1142051 - protein, 29 aa, Mycobacterium
SWPQAIDAWLKLCQAYGWAPGVMGASAAG

SEQ ID NO: 1142052 - protein, 19 aa, Mycobacterium
SWSWLFFNRHKLAVSAVAA

SEQ ID NO: 1142053 - protein, 19 aa, Mycobacterium
SWVIGCLALLFATSSGLGM

SEQ ID NO: 1142054 - protein, 19 aa, Mycobacterium
SWVVALLVVLVSGGLMGVL

SEQ ID NO: 1142055 - protein, 20 aa, Mycobacterium
SWVVLGLALFAAGSVAAYYL

SEQ ID NO: 1142056 - protein, 24 aa, Mycobacterium
SWWAKFVVLGLILFAGVAAALLYH

SEQ ID NO: 1142057 - protein, 17 aa, Mycobacterium
SYAVPLFVRVVQELAHT

SEQ ID NO: 1142058 - protein, 18 aa, Mycobacterium
SYFTLAAVLSLNFPPLHP

SEQ ID NO: 1142059 - protein, 18 aa, Mycobacterium
SYGLLWVAAVAVIVGGAA

SEQ ID NO: 1142060 - protein, 25 aa, Mycobacterium
SYGVNPPFLWQHLTGRYTNITVHTA

SEQ ID NO: 1142061 - protein, 25 aa, Mycobacterium
SYHSAWLGFAAVAVVAVLIGAMLLI

SEQ ID NO: 1142062 - protein, 21 aa, Mycobacterium
SYVLSFQVYLALPLQARDLFP

SEQ ID NO: 1142063 - protein, 31 aa, Mycobacterium
SYVSAIGIGVLFFQFILGQELSWTVPGMAFL

SEQ ID NO: 1142064 - protein, 42 aa, Mycobacterium
TAADAGWWPWVLAAAGIVLIVLALRWLLIHTPKARVKAVALV

SEQ ID NO: 1142065 - protein, 23 aa, Mycobacterium
TAAGMLAAVVWLTAAGLLCYAVG

SEQ ID NO: 1142066 - protein, 21 aa, Mycobacterium
TAALITLLVAGVWVLSVVARP

SEQ ID NO: 1142067 - protein, 26 aa, Mycobacterium
TAALLIAVKPWWPKLSIIGSVIAVGL

SEQ ID NO: 1142068 - protein, 19 aa, Mycobacterium
TAALVLAAVLVFSGGDTGS

SEQ ID NO: 1142069 - protein, 23 aa, Mycobacterium
TAAMAFVAIFQPPPDIWSAATFI

SEQ ID NO: 1142070 - protein, 20 aa, Mycobacterium
TAAPPRLWRMRIGVQQVGQS

SEQ ID NO: 1142071 - protein, 18 aa, Mycobacterium
TAAVAVLVIACPCALGLA

SEQ ID NO: 1142072 - protein, 19 aa, Mycobacterium
TAAVIAGRPAPHDAFIGVA

SEQ ID NO: 1142073 - protein, 25 aa, Mycobacterium
TAAYVVAALLFILALAGLSRHETSR

SEQ ID NO: 1142074 - protein, 32 aa, Mycobacterium
TADAPRSWLTWRIPALTSVLVAAVVTFVVSLS

SEQ ID NO: 1142075 - protein, 20 aa, Mycobacterium
TADFPTVLLAGDWLSQEQVT

SEQ ID NO: 1142076 - protein, 24 aa, Mycobacterium
TAFACVWYFRRTLFESTRNLFFRG

SEQ ID NO: 1142077 - protein, 23 aa, Mycobacterium
TAGFTVLVLAQLFNSLNARSETG

SEQ ID NO: 1142078 - protein, 28 aa, Mycobacterium
TAGLILAFLALFWVNQNYQPELPAPTPD

SEQ ID NO: 1142079 - protein, 19 aa, Mycobacterium
TAGLITDLLVRAIVTRTAL

SEQ ID NO: 1142080 - protein, 22 aa, Mycobacterium
TAHYFGAWVFIAGFLVHIAIKI

SEQ ID NO: 1142081 - protein, 22 aa, Mycobacterium
TAIGFLFGAVLISLVGVNPVLL

SEQ ID NO: 1142082 - protein, 26 aa, Mycobacterium
TALARFLLRFAANCRPSAWERAVRAN

SEQ ID NO: 1142083 - protein, 17 aa, Mycobacterium
TALIGLLAQASDLGLRV

SEQ ID NO: 1142084 - protein, 22 aa, Mycobacterium
TALIGVAAWLRLRDVRWTRPRL

SEQ ID NO: 1142085 - protein, 17 aa, Mycobacterium
TALLWVRSIPRVMTVSA

SEQ ID NO: 1142086 - protein, 22 aa, Mycobacterium
TAPAKPGLLTRGMRASGRAAAA

SEQ ID NO: 1142087 - protein, 32 aa, Mycobacterium
TAPALDLDALIGGFRPLFRALDPHQVNTLTRQ

SEQ ID NO: 1142088 - protein, 30 aa, Mycobacterium
TAPEPIPLSRPLFDALPATDPLVSPAIPGA

SEQ ID NO: 1142089 - protein, 26 aa, Mycobacterium
TAPTLELLILWRCLGGLAASALGPAV

SEQ ID NO: 1142090 - protein, 17 aa, Mycobacterium
TAQNLPPLWADEQRLSQ

SEQ ID NO: 1142091 - protein, 20 aa, Mycobacterium
TARHIAPHMVLAYGAARADV

SEQ ID NO: 1142092 - protein, 19 aa, Mycobacterium
TARLLLRSMGYRDALIGGM

SEQ ID NO: 1142093 - protein, 32 aa, Mycobacterium
TASAAKFPGGWYTVAVLLVLLVVAVVVAVRIA

SEQ ID NO: 1142094 - protein, 24 aa, Mycobacterium
TASAIFLFFSAILGSVGPLVTGLI

SEQ ID NO: 1142095 - protein, 31 aa, Mycobacterium
TASAVFFTLFGVAALWAFWLHLRNKQDSRVV

SEQ ID NO: 1142096 - protein, 27 aa, Mycobacterium
TASMVPIIVFSLLFGLALRTQINKTGD

SEQ ID NO: 1142097 - protein, 23 aa, Mycobacterium
TASYLRFVWTVAATAMVVCYSLW

SEQ ID NO: 1142098 - protein, 17 aa, Mycobacterium
TATIGFLVIRRESRRRT

SEQ ID NO: 1142099 - protein, 33 aa, Mycobacterium
TATIWNLPVWVLFLAWASFFFVGSGMPGLLKSV

SEQ ID NO: 1142100 - protein, 24 aa, Mycobacterium
TATVVLIGALIYFFRAPKGREDLG

SEQ ID NO: 1142101 - protein, 27 aa, Mycobacterium
TAVAAAALIGWWAARRRLRGGADRRAL

SEQ ID NO: 1142102 - protein, 18 aa, Mycobacterium
TAVLLWIGWQHRNHKITW

SEQ ID NO: 1142103 - protein, 26 aa, Mycobacterium
TAVSAWLITRAWEMPPVLHLTVAAVT

SEQ ID NO: 1142104 - protein, 23 aa, Mycobacterium
TAWDQLTFGPLPDQITLATLSSL

SEQ ID NO: 1142105 - protein, 24 aa, Mycobacterium
TAWDQLTFGPLPDQITLATLSSLQ

SEQ ID NO: 1142106 - protein, 17 aa, Mycobacterium
TAYIRFPTDTVARKNYL

SEQ ID NO: 1142107 - protein, 24 aa, Mycobacterium
TAYLINRRWTFQAAPSKARFIAVV

SEQ ID NO: 1142108 - protein, 23 aa, Mycobacterium
TAYLVFIVYMLLGKFTTAVPPLK

SEQ ID NO: 1142109 - protein, 20 aa, Mycobacterium
TAYQWNWKFGYQKVDFADGT

SEQ ID NO: 1142110 - protein, 25 aa, Mycobacterium
TAYSDMNAMFYIPGRSKYTANQQGQ

SEQ ID NO: 1142111 - protein, 24 aa, Mycobacterium
TAYVLTFGGLMLLGGRLGDTIGRK

SEQ ID NO: 1142112 - protein, 17 aa, Mycobacterium
TCILAAGTSVLIDRSGR

SEQ ID NO: 1142113 - protein, 18 aa, Mycobacterium
TCTMLITAPIMSVGGIFM

SEQ ID NO: 1142114 - protein, 31 aa, Mycobacterium
TDAERPRLRIPLWSLLLLGAAALIVSMAGIP

SEQ ID NO: 1142115 - protein, 21 aa, Mycobacterium
TDGGFIVFPLTYVIGDVLSEV

SEQ ID NO: 1142116 - protein, 22 aa, Mycobacterium
TDGISLLLVGFMLALAAVSLPV

SEQ ID NO: 1142117 - protein, 21 aa, Mycobacterium
TDGNLLPQYFQGRPSAAGNGY

SEQ ID NO: 1142118 - protein, 26 aa, Mycobacterium
TDIDIDLFILVDLLTGDWFDRPTGTD

SEQ ID NO: 1142119 - protein, 22 aa, Mycobacterium
TDNPAWYRLTRFFGKLFLINFA

SEQ ID NO: 1142120 - protein, 42 aa, Mycobacterium
TDPFRVLFRTWVVLPALAAFAAVCWWVFFEKGLASAAHDAFE

SEQ ID NO: 1142121 - protein, 34 aa, Mycobacterium
TDQVWRVVNSRWVQLPPLLQPRAAAAAAVVGDRI

SEQ ID NO: 1142122 - protein, 22 aa, Mycobacterium
TDRWRGLRWALAAVVAIVAVAA

SEQ ID NO: 1142123 - protein, 24 aa, Mycobacterium
TDTGRQPHLPPTAPPQAAAPARHH

SEQ ID NO: 1142124 - protein, 18 aa, Mycobacterium
TDVFPALALGAEPPDRRT

SEQ ID NO: 1142125 - protein, 17 aa, Mycobacterium
TDWYPLDPIVALAVGVN

SEQ ID NO: 1142126 - protein, 46 aa, Mycobacterium
TEADSATPWYRKPVALVSFGAVGALLIALVVFGLARAITGDSTSDT

SEQ ID NO: 1142127 - protein, 26 aa, Mycobacterium
TEALAVPIWWAYAASLLLITAGLFFG

SEQ ID NO: 1142128 - protein, 27 aa, Mycobacterium
TEALAVPIWWAYAASLLLITAGLFFGR

SEQ ID NO: 1142129 - protein, 25 aa, Mycobacterium
TEFQAVQFMPLVIAPQLLLCGIVVP

SEQ ID NO: 1142130 - protein, 31 aa, Mycobacterium
TEGFTRLWPTLACLLLYGAAFMLLAQSISHG

SEQ ID NO: 1142131 - protein, 22 aa, Mycobacterium
TEGVALLLVSFMLALSAATLPV

SEQ ID NO: 1142132 - protein, 30 aa, Mycobacterium
TEIHTALQYRLPITFCLFDNHAHAMCVTRE

SEQ ID NO: 1142133 - protein, 17 aa, Mycobacterium
TEKPTFYKDFPTSVSPL

SEQ ID NO: 1142134 - protein, 40 aa, Mycobacterium
TELLEALVKAIIITALIALAVLIWRSLPEGGIEAPSGGAP

SEQ ID NO: 1142135 - protein, 22 aa, Mycobacterium
TELQFDAPSTLQFLFNGAFAEK

SEQ ID NO: 1142136 - protein, 19 aa, Mycobacterium
TEMLRGTGAWTPYVAPTAT

SEQ ID NO: 1142137 - protein, 26 aa, Mycobacterium
TEMNAYFSMCWLVVNTLGVLVGATAA

SEQ ID NO: 1142138 - protein, 18 aa, Mycobacterium
TERFSWVVLGLALFAAGS

SEQ ID NO: 1142139 - protein, 33 aa, Mycobacterium
TERRRVRIWRGWPLWGALLWILSQMVLIRHLDP

SEQ ID NO: 1142140 - protein, 23 aa, Mycobacterium
TERVLAPVDLLGDRPFELALTHS

SEQ ID NO: 1142141 - protein, 22 aa, Mycobacterium
TESPLLPLAYVGGAPLVSFAVV

SEQ ID NO: 1142142 - protein, 26 aa, Mycobacterium
TEVARMRALKMPFYRSLISATNWLLG

SEQ ID NO: 1142143 - protein, 20 aa, Mycobacterium
TEVNVSLPWSKTVVLDPGVE

SEQ ID NO: 1142144 - protein, 30 aa, Mycobacterium
TEVSWRLAFLVNAPIGLLIVYLAHTALRET

SEQ ID NO: 1142145 - protein, 29 aa, Mycobacterium
TEVSWRLAFLVNVPIGLIMIYLARKTLRE

SEQ ID NO: 1142146 - protein, 24 aa, Mycobacterium
TFDALFAFFFVANWHFAAAGTDIP

SEQ ID NO: 1142147 - protein, 24 aa, Mycobacterium
TFDYFSIYFATAVMYLALTAVLSI

SEQ ID NO: 1142148 - protein, 17 aa, Mycobacterium
TFFFCWNDFLFAISLTS

SEQ ID NO: 1142149 - protein, 21 aa, Mycobacterium
TFGLGYLAIIGIPPLAGFFSK

SEQ ID NO: 1142150 - protein, 23 aa, Mycobacterium
TFGQNLRIVLLPQAFRAVLIPLG

SEQ ID NO: 1142151 - protein, 24 aa, Mycobacterium
TFHEPLVMFGYLAAVTTTLELVTG

SEQ ID NO: 1142152 - protein, 26 aa, Mycobacterium
TFISVLRLVPHWFAPRQIPVVTQLTG

SEQ ID NO: 1142153 - protein, 21 aa, Mycobacterium
TFIWLTLALAGVWAAGAFASG

SEQ ID NO: 1142154 - protein, 23 aa, Mycobacterium
TFLAAAVLYFLAVGQVKGFAFTL

SEQ ID NO: 1142155 - protein, 27 aa, Mycobacterium
TFLNPIDLLWSFLQAVLMAITILLVHT

SEQ ID NO: 1142156 - protein, 30 aa, Mycobacterium
TFMIPEEHLPLVLPFKYLGVPKDTLMELDS

SEQ ID NO: 1142157 - protein, 20 aa, Mycobacterium
TFMVWTWVVIWPYDPAETAS

SEQ ID NO: 1142158 - protein, 17 aa, Mycobacterium
TFNTWGVWLGSQRPKQF

SEQ ID NO: 1142159 - protein, 22 aa, Mycobacterium
TFSLHHPLLVAHVLLATVAMVA

SEQ ID NO: 1142160 - protein, 19 aa, Mycobacterium
TFSRPWYLAVAAAVYVPMT

SEQ ID NO: 1142161 - protein, 17 aa, Mycobacterium
TFTIALPITPIRSEHHP

SEQ ID NO: 1142162 - protein, 18 aa, Mycobacterium
TFTNIHMPLVRTPMIAPS

SEQ ID NO: 1142163 - protein, 22 aa, Mycobacterium
TFVITAFAVMRLVGAPPAGMLV

SEQ ID NO: 1142164 - protein, 20 aa, Mycobacterium
TFVQAFQYWLKLTAVAIPAL

SEQ ID NO: 1142165 - protein, 18 aa, Mycobacterium
TFVRNPLSWLEAISRYGG

SEQ ID NO: 1142166 - protein, 21 aa, Mycobacterium
TFVSLPFLVIALEGAARTAGT

SEQ ID NO: 1142167 - protein, 18 aa, Mycobacterium
TFVTFGLGYLAIIGIPPL

SEQ ID NO: 1142168 - protein, 19 aa, Mycobacterium
TGAFLVVLVFGMSDGIRAQ

SEQ ID NO: 1142169 - protein, 32 aa, Mycobacterium
TGAGVFWWSGPALMFLVIPTLDYLVGPDADNP

SEQ ID NO: 1142170 - protein, 19 aa, Mycobacterium
TGAVVEWAVPLQPVGHLDA

SEQ ID NO: 1142171 - protein, 17 aa, Mycobacterium
TGDPWHALWAMMVGFFM

SEQ ID NO: 1142172 - protein, 26 aa, Mycobacterium
TGEFSPRLAALGRFTLRHKALVIGAW

SEQ ID NO: 1142173 - protein, 22 aa, Mycobacterium
TGEIAFALITSLLTGRSVLNAR

SEQ ID NO: 1142174 - protein, 24 aa, Mycobacterium
TGEVSLPWSLTLETTLPSVMPNIM

SEQ ID NO: 1142175 - protein, 20 aa, Mycobacterium
TGFFDVLKTQFGSSGGPLAE

SEQ ID NO: 1142176 - protein, 26 aa, Mycobacterium
TGFISAFFNVRLIGPLIAGIALAATI

SEQ ID NO: 1142177 - protein, 26 aa, Mycobacterium
TGGAVLVLLVGRRLWHRFRGQPDPAD

SEQ ID NO: 1142178 - protein, 20 aa, Mycobacterium
TGGKLFHILSGNLSFQIEHH

SEQ ID NO: 1142179 - protein, 25 aa, Mycobacterium
TGGLIATWLGLGTLSAAIVALVSGV

SEQ ID NO: 1142180 - protein, 25 aa, Mycobacterium
TGGVVLLGLLAAIALLVARQIVLPV

SEQ ID NO: 1142181 - protein, 34 aa, Mycobacterium
TGGWFTAIAVAIPTLIFVGLGLQSGVSAKTDGPV

SEQ ID NO: 1142182 - protein, 25 aa, Mycobacterium
TGGYSFESFRWAWTAQYVIWTLATV

SEQ ID NO: 1142183 - protein, 23 aa, Mycobacterium
TGHALRKFLLEQEYIDDMAKVIW

SEQ ID NO: 1142184 - protein, 20 aa, Mycobacterium
TGHALWAAALIPACILVFAR

SEQ ID NO: 1142185 - protein, 23 aa, Mycobacterium
TGIRMALVPVFLFALFAGDGQET

SEQ ID NO: 1142186 - protein, 42 aa, Mycobacterium
TGKLGVRDVLFGRKVSYVGLAILLLTALMVGALGGWVGNKTA

SEQ ID NO: 1142187 - protein, 25 aa, Mycobacterium
TGKMNAYFRYRLRYALLVDGMTFVV

SEQ ID NO: 1142188 - protein, 20 aa, Mycobacterium
TGLIIYFWIAHLTLAQLQGL

SEQ ID NO: 1142189 - protein, 26 aa, Mycobacterium
TGLIWGLWHWPLPWVGYFGGDAPVSD

SEQ ID NO: 1142190 - protein, 27 aa, Mycobacterium
TGLIWGVWHWPLPWVGYFGGETPVAEA

SEQ ID NO: 1142191 - protein, 28 aa, Mycobacterium
TGLTFGMWWIYYVLPQADILHLRRERSF

SEQ ID NO: 1142192 - protein, 22 aa, Mycobacterium
TGLTIIFAGLIGGILWNLLTWL

SEQ ID NO: 1142193 - protein, 28 aa, Mycobacterium
TGLTVLTWLMRVGFLGAPLIVGVVADAT

SEQ ID NO: 1142194 - protein, 17 aa, Mycobacterium
TGLYPLATFGLGMLAFA

SEQ ID NO: 1142195 - protein, 20 aa, Mycobacterium
TGNPWWAVAALVGTVGVGIA

SEQ ID NO: 1142196 - protein, 23 aa, Mycobacterium
TGNYGFPFLGHTLSALAEPLDFA

SEQ ID NO: 1142197 - protein, 26 aa, Mycobacterium
TGQPATPALPVPYPRTGQAGDPHLTL

SEQ ID NO: 1142198 - protein, 30 aa, Mycobacterium
TGRNIMFGVALGLLLGFGVAIVRDLLDNTV

SEQ ID NO: 1142199 - protein, 17 aa, Mycobacterium
TGRRSAAAWLLVAVLLL

SEQ ID NO: 1142200 - protein, 26 aa, Mycobacterium
TGRYDAAWWTLGAFAVLAAAWVVAAL

SEQ ID NO: 1142201 - protein, 22 aa, Mycobacterium
TGSALLDRIAAAAAAWTTDAAE

SEQ ID NO: 1142202 - protein, 23 aa, Mycobacterium
TGSALYLILGAYSFPGADPTRVA

SEQ ID NO: 1142203 - protein, 23 aa, Mycobacterium
TGSSFKVFALVAALQQGMGLGYQ

SEQ ID NO: 1142204 - protein, 22 aa, Mycobacterium
TGTLFLVGIAVGAVAALGLGVL

SEQ ID NO: 1142205 - protein, 20 aa, Mycobacterium
TGVDWIRWWATITYNLGIVF

SEQ ID NO: 1142206 - protein, 17 aa, Mycobacterium
TGVFLFLGGMAAASSNT

SEQ ID NO: 1142207 - protein, 19 aa, Mycobacterium
TGVRDAALAALPRPGRRPG

SEQ ID NO: 1142208 - protein, 33 aa, Mycobacterium
TGVVVLVVVVLGLLVFGVGVAIYFAKAGPRDGA

SEQ ID NO: 1142209 - protein, 32 aa, Mycobacterium
THISGPRTKLFAALFLILALVVIGEIAGVVLG

SEQ ID NO: 1142210 - protein, 27 aa, Mycobacterium
THQLTPFWVVGVTFLLCAFKRARPRWV

SEQ ID NO: 1142211 - protein, 20 aa, Mycobacterium
THTDIAFITIMAPDRTRFTH

SEQ ID NO: 1142212 - protein, 38 aa, Mycobacterium
THWQEWMPAGLFFATIALFQLLWARLVLARTTTPVLAA

SEQ ID NO: 1142213 - protein, 18 aa, Mycobacterium
TIALFRRAVATPTGRTLD

SEQ ID NO: 1142214 - protein, 38 aa, Mycobacterium
TIDLNLVLSAIINFLLIAAVVYFVILMPYKKLRERGKV

SEQ ID NO: 1142215 - protein, 24 aa, Mycobacterium
TIGFGPSFFVKDGVDRFGIADKKP

SEQ ID NO: 1142216 - protein, 32 aa, Mycobacterium
TILDIVVVFLVTWPLVYMASKSTLWAKPSLNG

SEQ ID NO: 1142217 - protein, 19 aa, Mycobacterium
TILVTIAASLLAGLLAHVA

SEQ ID NO: 1142218 - protein, 20 aa, Mycobacterium
TIQRRLVLRLASDDDYVLAG

SEQ ID NO: 1142219 - protein, 27 aa, Mycobacterium
TIRRFMSFGLVFLILNGLQIVVVTAIL

SEQ ID NO: 1142220 - protein, 30 aa, Mycobacterium
TISYGVYLWHWPIFLFLNGERTGWTGWPLL

SEQ ID NO: 1142221 - protein, 30 aa, Mycobacterium
TISYGVYLWHWPIFLFLNGERTGWTGWRLL

SEQ ID NO: 1142222 - protein, 30 aa, Mycobacterium
TITRPRLWVALLFLMLIAVTFLVSSTLSLV

SEQ ID NO: 1142223 - protein, 19 aa, Mycobacterium
TIWLLDWDDVIDRTALGFD

SEQ ID NO: 1142224 - protein, 19 aa, Mycobacterium
TKFWLNTLLALSMAFTLVL

SEQ ID NO: 1142225 - protein, 25 aa, Mycobacterium
TKLVLIACLAMVFAIQNATARQFGV

SEQ ID NO: 1142226 - protein, 26 aa, Mycobacterium
TKMLQALLVLPAFAAAYLLAGHRPVG

SEQ ID NO: 1142227 - protein, 22 aa, Mycobacterium
TKQILIYTWLTVAATLALALAT

SEQ ID NO: 1142228 - protein, 17 aa, Mycobacterium
TLAFIDVWQWTPFMVLL

SEQ ID NO: 1142229 - protein, 25 aa, Mycobacterium
TLAGDRLPRWFPGAHLDVHLPSGRV

SEQ ID NO: 1142230 - protein, 28 aa, Mycobacterium
TLAGILPAIALVLALRREVWTGFAAAVV

SEQ ID NO: 1142231 - protein, 29 aa, Mycobacterium
TLAGILPAIALVLALRREVWTRLAAAVVF

SEQ ID NO: 1142232 - protein, 32 aa, Mycobacterium
TLALLAHIAIMLVFLLIVLHSKHLHIGLAPIN

SEQ ID NO: 1142233 - protein, 20 aa, Mycobacterium
TLALTMFLMGGATALMGVLP

SEQ ID NO: 1142234 - protein, 18 aa, Mycobacterium
TLARLPTPLLFGGLAGAL

SEQ ID NO: 1142235 - protein, 17 aa, Mycobacterium
TLFALGVWFALHRRSGI

SEQ ID NO: 1142236 - protein, 25 aa, Mycobacterium
TLFSALYLPLLAILFGMILRIVGIE

SEQ ID NO: 1142237 - protein, 21 aa, Mycobacterium
TLGFLILIVLLIFIAQNTESA

SEQ ID NO: 1142238 - protein, 25 aa, Mycobacterium
TLGLLACGLPILGLGSLFGRVGLAC

SEQ ID NO: 1142239 - protein, 37 aa, Mycobacterium
TLGLLHHELEFWWELALLIVIMLLGHWVEMRSLAQTT

SEQ ID NO: 1142240 - protein, 18 aa, Mycobacterium
TLHALVPTVPLIAAIALG

SEQ ID NO: 1142241 - protein, 24 aa, Mycobacterium
TLIGWGLLELFPGSLARSDRFLYA

SEQ ID NO: 1142242 - protein, 18 aa, Mycobacterium
TLIMFPILACIYARLART

SEQ ID NO: 1142243 - protein, 33 aa, Mycobacterium
TLISLGVSAAYLWSLWALFIGHAGMPGMRMAFS

SEQ ID NO: 1142244 - protein, 37 aa, Mycobacterium; identical to SEQ ID NO: 371179

SEQ ID NO: 1142245 - protein, 18 aa, Mycobacterium
TLLAGIRVNSFTSTFVFI

SEQ ID NO: 1142246 - protein, 17 aa, Mycobacterium
TLLAMGLLLPSVQSNSM

SEQ ID NO: 1142247 - protein, 21 aa, Mycobacterium
TLLAPLLVYRWGRMAFYPLAL

SEQ ID NO: 1142248 - protein, 35 aa, Mycobacterium
TLLCAYLSAVLLVGLVLHALLGWTWADPVAALGIA

SEQ ID NO: 1142249 - protein, 23 aa, Mycobacterium
TLLLAMHCLWMSCLFVAAAGAIG

SEQ ID NO: 1142250 - protein, 20 aa, Mycobacterium
TLLLLIVAVLIVLTRLDVWT

SEQ ID NO: 1142251 - protein, 22 aa, Mycobacterium
TLLPLVLIYQGWTYWVFRQRIS

SEQ ID NO: 1142252 - protein, 22 aa, Mycobacterium
TLLVQSLAFAQSGWAAVFIAVV

SEQ ID NO: 1142253 - protein, 35 aa, Mycobacterium
TLLVVGIVLVLLLRAIVAPLYLLGTVVLNYAAALG

SEQ ID NO: 1142254 - protein, 17 aa, Mycobacterium
TLLYFCLAQLILAIFAR

SEQ ID NO: 1142255 - protein, 17 aa, Mycobacterium
TLMSPVAFVRRPYRWIK

SEQ ID NO: 1142256 - protein, 18 aa, Mycobacterium
TLPMRKIHTFAIPPNMVA

SEQ ID NO: 1142257 - protein, 26 aa, Mycobacterium
TLPVQLGKDWLWLHAARTAAVTLPLL

SEQ ID NO: 1142258 - protein, 17 aa, Mycobacterium
TLPVRSSSRRRAAAVLS

SEQ ID NO: 1142259 - protein, 39 aa, Mycobacterium
TLPWLIDGMLFTLQLTLYGFTGGLFLGVLLAALQLTRSR

SEQ ID NO: 1142260 - protein, 42 aa, Mycobacterium
TLRDVLLMEAIAIPLTFLVLVWVFKGLLAAALPVAVGGLAIV

SEQ ID NO: 1142261 - protein, 18 aa, Mycobacterium
TLRMLIPVMRWQRREMLL

SEQ ID NO: 1142262 - protein, 26 aa, Mycobacterium
TLRRGMPFALTWWSLTFPVGTFVTGT

SEQ ID NO: 1142263 - protein, 28 aa, Mycobacterium
TLSAFTLIPYTLVLLQLRVFYAREEPWT

SEQ ID NO: 1142264 - protein, 31 aa, Mycobacterium
TLSMGVILLGLLWYAGLPLRVFLSSLGAVLI

SEQ ID NO: 1142265 - protein, 29 aa, Mycobacterium
TLSTIKTNLFWAFAYNVAAIPVAALGMLN

SEQ ID NO: 1142266 - protein, 25 aa, Mycobacterium
TLSVTFMTFLTLACLLAAIGAVTDS

SEQ ID NO: 1142267 - protein, 17 aa, Mycobacterium
TLTAWMLIGVYGLFTAC

SEQ ID NO: 1142268 - protein, 23 aa, Mycobacterium
TLTSLLLAAVLSWGAIEIAHLTG

SEQ ID NO: 1142269 - protein, 31 aa, Mycobacterium
TLTVIAVVLLLGWSFFYFSDDTRGYKPVDTS

SEQ ID NO: 1142270 - protein, 18 aa, Mycobacterium
TLTVPAIATLLREKSWWP

SEQ ID NO: 1142271 - protein, 28 aa, Mycobacterium
TLVSPTGAFLGLIGPGGLLIGNGVLPGQ

SEQ ID NO: 1142272 - protein, 25 aa, Mycobacterium
TLVSRLTGFARIVLLAAILGAALSS

SEQ ID NO: 1142273 - protein, 32 aa, Mycobacterium
TLVSTPVVLAVRPELKPALAQQNWGTLPGLQT

SEQ ID NO: 1142274 - protein, 23 aa, Mycobacterium
TLVVLAYLWLDRWEPEPPRLLVF

SEQ ID NO: 1142275 - protein, 21 aa, Mycobacterium
TLVVVPLYCVALISAFVAAKV

SEQ ID NO: 1142276 - protein, 22 aa, Mycobacterium
TLWCFGASMLWALGANPGLIGA

SEQ ID NO: 1142277 - protein, 17 aa, Mycobacterium
TLWFYGNTSQTTLSFPV

SEQ ID NO: 1142278 - protein, 24 aa, Mycobacterium
TLYCCLPLYHNNALTVALSSVINS

SEQ ID NO: 1142279 - protein, 25 aa, Mycobacterium
TMAVEHFLFAAPATESIPALNARYP

SEQ ID NO: 1142280 - protein, 20 aa, Mycobacterium
TMDWILPDFASVFAAGGLAV

SEQ ID NO: 1142281 - protein, 19 aa, Mycobacterium
TMGALTSWLGFQTHQAHQA

SEQ ID NO: 1142282 - protein, 23 aa, Mycobacterium
TMGLPHVLVRFYTNPDGRAARRT

SEQ ID NO: 1142283 - protein, 17 aa, Mycobacterium
TMLLGLSVVALLIAAWL

SEQ ID NO: 1142284 - protein, 23 aa, Mycobacterium
TMVLILFMVFAELGAARGIVAFL

SEQ ID NO: 1142285 - protein, 25 aa, Mycobacterium
TMVLLALFPPLWRRVMDGRVLAHYG

SEQ ID NO: 1142286 - protein, 18 aa, Mycobacterium
TNADGVAEPPRSWQLRVE

SEQ ID NO: 1142287 - protein, 22 aa, Mycobacterium
TNDILRLALAGVFLVVIVTSSL

SEQ ID NO: 1142288 - protein, 25 aa, Mycobacterium
TNGALFANLLPRYPEIKADLAMSNA

SEQ ID NO: 1142289 - protein, 20 aa, Mycobacterium
TNIPPTWAAASRPPIRSLTA

SEQ ID NO: 1142290 - protein, 32 aa, Mycobacterium
TNIWVGLVFVVVALLLGAFMVLSGWAVLKVSV

SEQ ID NO: 1142291 - protein, 21 aa, Mycobacterium
TNKMLTAAAALLTLDRDARLT

SEQ ID NO: 1142292 - protein, 30 aa, Mycobacterium
TNLIYLATSLILLPYLWSAAYQVLLAVRGE

SEQ ID NO: 1142293 - protein, 23 aa, Mycobacterium
TNPKGLLFFLAVMPQFVVPTTPL

SEQ ID NO: 1142294 - protein, 23 aa, Mycobacterium
TNPLAILLVSLLGPIAATVIRLA

SEQ ID NO: 1142295 - protein, 25 aa, Mycobacterium
TNQVLTLMWALVFALIAVLGFLAAT

SEQ ID NO: 1142296 - protein, 22 aa, Mycobacterium
TNSLLIHVFAGALWAGGLFALL

SEQ ID NO: 1142297 - protein, 22 aa, Mycobacterium
TPAMWFIAVPVLGWAVWRAFVK

SEQ ID NO: 1142298 - protein, 19 aa, Mycobacterium
TPARRLTGWAPGTPGREEA

SEQ ID NO: 1142299 - protein, 27 aa, Mycobacterium
TPDFPLPFTYPPFAALLFYPLHLLPFG

SEQ ID NO: 1142300 - protein, 23 aa, Mycobacterium
TPDPALLRRVAISSLLGTAIEYY

SEQ ID NO: 1142301 - protein, 19 aa, Mycobacterium
TPLELLFDLTFVIAFGIAA

SEQ ID NO: 1142302 - protein, 20 aa, Mycobacterium
TPLLTYLPHARDVGLHVIVA

SEQ ID NO: 1142303 - protein, 23 aa, Mycobacterium
TPLPVVLFAVLALTVALGNLFPR

SEQ ID NO: 1142304 - protein, 21 aa, Mycobacterium
TPLTKIQGWSELYFQRPPTAV

SEQ ID NO: 1142305 - protein, 26 aa, Mycobacterium
TPLVRLGHMLVFFVRALHGLPVALRH

SEQ ID NO: 1142306 - protein, 33 aa, Mycobacterium
TPLWRAAQVFRLLSWVYALGFQLSVNDDLDRRA

SEQ ID NO: 1142307 - protein, 32 aa, Mycobacterium
TPPAFMTVLGVLLLPFVLISFNTVLDTLMTAG

SEQ ID NO: 1142308 - protein, 22 aa, Mycobacterium
TPPPPPITTPPPSPAPAVTAAT

SEQ ID NO: 1142309 - protein, 27 aa, Mycobacterium
TPRAVVTFVALGLFVALFAATGVYLVV

SEQ ID NO: 1142310 - protein, 22 aa, Mycobacterium
TPRPYLYAGILFFATLGAFAVN

SEQ ID NO: 1142311 - protein, 24 aa, Mycobacterium
TPSAPPLRVLEDLPRRIRASDAHQ

SEQ ID NO: 1142312 - protein, 29 aa, Mycobacterium
TPSIAALLGRWFWWPQQIRTRPAPSPWPA

SEQ ID NO: 1142313 - protein, 17 aa, Mycobacterium
TPSPLLRHIKTGLVVTG

SEQ ID NO: 1142314 - protein, 22 aa, Mycobacterium
TPSTPIWRLVVPLTAMGVAMAF

SEQ ID NO: 1142315 - protein, 17 aa, Mycobacterium
TPTALLVGTGRGAQIGV

SEQ ID NO: 1142316 - protein, 26 aa, Mycobacterium
TPVAALMFRFNNPDALLVLLLVIAEY

SEQ ID NO: 1142317 - protein, 18 aa, Mycobacterium
TPVLFAGSLLTLLPLALS

SEQ ID NO: 1142318 - protein, 21 aa, Mycobacterium
TPVLYLLALLGVVATLLQQSA

SEQ ID NO: 1142319 - protein, 24 aa, Mycobacterium
TPVQRRFWYRCATTVMRRALPLGL

SEQ ID NO: 1142320 - protein, 35 aa, Mycobacterium
TPVTARTGPRWWIVTAAVLALLALVGAGVGAYAYL

SEQ ID NO: 1142321 - protein, 20 aa, Mycobacterium
TPVWELLVVFAVFGIGFSMV

SEQ ID NO: 1142322 - protein, 26 aa, Mycobacterium
TPYQAPWLLIVVIGAVISFLLSGRDI

SEQ ID NO: 1142323 - protein, 24 aa, Mycobacterium
TQEPYLGRWLLLVAAMFTLSAAVY

SEQ ID NO: 1142324 - protein, 31 aa, Mycobacterium
TQFNVVLLRRFAPQQIMVWALAVASLAGVVF

SEQ ID NO: 1142325 - protein, 18 aa, Mycobacterium
TQGALTFLSPTAELFVVM

SEQ ID NO: 1142326 - protein, 27 aa, Mycobacterium
TQKALIALAVFLVLAAIYITVRYERYM

SEQ ID NO: 1142327 - protein, 19 aa, Mycobacterium
TQMLLGGHQFVLLATAGLL

SEQ ID NO: 1142328 - protein, 25 aa, Mycobacterium
TQPALDLDALLGGLRPVLKGLDGAK

SEQ ID NO: 1142329 - protein, 20 aa, Mycobacterium
TQPDYGAPAGWHAPGWPPQA

SEQ ID NO: 1142330 - protein, 25 aa, Mycobacterium
TQPELLFYEQGASWLWVLAGPAAGA

SEQ ID NO: 1142331 - protein, 26 aa, Mycobacterium
TQRFMLRWRTWLTDRLTGDWLDGKAY

SEQ ID NO: 1142332 - protein, 24 aa, Mycobacterium
TQRSPLFAALFVWELARPPLWLLL

SEQ ID NO: 1142333 - protein, 18 aa, Mycobacterium
TQRWAYPLLLVLSGVALG

SEQ ID NO: 1142334 - protein, 25 aa, Mycobacterium
TQSKFWSRWTGWVMRRPWVSATAAA

SEQ ID NO: 1142335 - protein, 18 aa, Mycobacterium
TQTAAVIGTAQYLSPEQA

SEQ ID NO: 1142336 - protein, 24 aa, Mycobacterium
TQWPRSARAFWLMTRRFRPRDYTF

SEQ ID NO: 1142337 - protein, 30 aa, Mycobacterium
TRAQRLYRPVFWYLAAWSVGLLAAWAALGA

SEQ ID NO: 1142338 - protein, 18 aa, Mycobacterium
TRGQWYFRQVLGSANLTG

SEQ ID NO: 1142339 - protein, 24 aa, Mycobacterium
TRHGVVILTGFWLAAAAVEVGRYP

SEQ ID NO: 1142340 - protein, 20 aa, Mycobacterium
TRLDRPVAIKILHPAMNAQP

SEQ ID NO: 1142341 - protein, 25 aa, Mycobacterium
TRLESDAWSWLKWLPHTDVPGQNDG

SEQ ID NO: 1142342 - protein, 20 aa, Mycobacterium
TRLLIMTVIGLTIAYVFKPQ

SEQ ID NO: 1142343 - protein, 19 aa, Mycobacterium
TRMALFAVLLVAFGIKAAV

SEQ ID NO: 1142344 - protein, 20 aa, Mycobacterium
TRMLKIELPLALPVLIASLR

SEQ ID NO: 1142345 - protein, 22 aa, Mycobacterium
TRPVWERLRPVWRWVLRTRDRL

SEQ ID NO: 1142346 - protein, 37 aa, Mycobacterium
TRQFSTVYPTPPPMPPMPAVAPPARRFSRGQVGLVAA

SEQ ID NO: 1142347 - protein, 18 aa, Mycobacterium
TRQLAFNQGFYNLFLGVV

SEQ ID NO: 1142348 - protein, 17 aa, Mycobacterium
TRRLWPYAVAIVVAVFS

SEQ ID NO: 1142349 - protein, 24 aa, Mycobacterium
TRSTLRFLWLRLARVWPVYLVTMH

SEQ ID NO: 1142350 - protein, 27 aa, Mycobacterium
TRTPLSFLCYWVVPFSLLGVAALLTRI

SEQ ID NO: 1142351 - protein, 30 aa, Mycobacterium; identical to SEQ ID NO: 371614

SEQ ID NO: 1142352 - protein, 34 aa, Mycobacterium
TRVLHQWRWSLTALWFTAVILLILVRFWDYWSTL

SEQ ID NO: 1142353 - protein, 37 aa, Mycobacterium
TRVMKRPLIYAIPIIVGMVLLILPLGKITLGGISEKY

SEQ ID NO: 1142354 - protein, 18 aa, Mycobacterium
TRVMTYAPLLITSETAIT

SEQ ID NO: 1142355 - protein, 23 aa, Mycobacterium
TSAALIMIAVFIGFAFAGMPLVA

SEQ ID NO: 1142356 - protein, 17 aa, Mycobacterium
TSALPWLAGRIGTPGVP

SEQ ID NO: 1142357 - protein, 21 aa, Mycobacterium
TSGIISALHRPVPLSGDGSDT

SEQ ID NO: 1142358 - protein, 26 aa, Mycobacterium
TSGYLLAFAAFLLIGGRLGDRFGSKP

SEQ ID NO: 1142359 - protein, 27 aa, Mycobacterium
TSIILQLVILWTVIGLALAKLAANQKI

SEQ ID NO: 1142360 - protein, 22 aa, Mycobacterium
TSILVLLAFPLLTAALFALAAD

SEQ ID NO: 1142361 - protein, 19 aa, Mycobacterium
TSIVMCIALLFGVAFLFFG

SEQ ID NO: 1142362 - protein, 35 aa, Mycobacterium
TSKLPIVLGLIAVIMFALLFLLTGSIVVPLKALVL

SEQ ID NO: 1142363 - protein, 24 aa, Mycobacterium
TSLIAAVLVVLFLSLAIYGQSGNF

SEQ ID NO: 1142364 - protein, 25 aa, Mycobacterium
TSLIAAVLVVLFLSLAIYGQSGNFH

SEQ ID NO: 1142365 - protein, 43 aa, Mycobacterium
TSMRFVEALTFLVITIMLVLFFRSIVTTLLILVMVGLSLMTVR

SEQ ID NO: 1142366 - protein, 26 aa, Mycobacterium
TSQMGRSFLQKIGLLPTPTGYTNAAI

SEQ ID NO: 1142367 - protein, 31 aa, Mycobacterium
TSRHWLIEVPIRIVAYLTVALVIRFVVHRMI

SEQ ID NO: 1142368 - protein, 32 aa, Mycobacterium
TSRKATRALWLLFLPFSLINLAHWMLPPVSRP

SEQ ID NO: 1142369 - protein, 19 aa, Mycobacterium
TSRPGLLGGVILAVGIVAA

SEQ ID NO: 1142370 - protein, 21 aa, Mycobacterium
TSRRPLLRLALTEAALFGVAI

SEQ ID NO: 1142371 - protein, 33 aa, Mycobacterium
TSTLGLIVAFIALFWLYQVYEPPVRPAQNPAQQ

SEQ ID NO: 1142372 - protein, 26 aa, Mycobacterium
TTAGVYIPARLLIHTAPAQYGGRDDE

SEQ ID NO: 1142373 - protein, 20 aa, Mycobacterium
TTAILTFFFCWNDFLFAISL

SEQ ID NO: 1142374 - protein, 23 aa, Mycobacterium
TTAKPFQIIHPFDPMTYAVNGLR

SEQ ID NO: 1142375 - protein, 18 aa, Mycobacterium
TTAMLIDLARRPASTVRG

SEQ ID NO: 1142376 - protein, 18 aa, Mycobacterium
TTAPLPIPSSVLSQFAVG

SEQ ID NO: 1142377 - protein, 25 aa, Mycobacterium
TTATTLSWLIDLLLHHPRALARVRA

SEQ ID NO: 1142378 - protein, 29 aa, Mycobacterium
TTDLRGQFWIWAGANIAPINWILGALGVT

SEQ ID NO: 1142379 - protein, 23 aa, Mycobacterium
TTGLFLIVTAIIALAFALASWGL

SEQ ID NO: 1142380 - protein, 20 aa, Mycobacterium
TTHLVIAIALALTAVLCLLA

SEQ ID NO: 1142381 - protein, 33 aa, Mycobacterium
TTILDVVVVFLVTWPLVYLASKTTWAAKPKFNG

SEQ ID NO: 1142382 - protein, 27 aa, Mycobacterium
TTMLVRAGERWLGAIGLMDLPRPEASA

SEQ ID NO: 1142383 - protein, 22 aa, Mycobacterium
TTPTVLLMLLFVIGCGQALTAP

SEQ ID NO: 1142384 - protein, 23 aa, Mycobacterium
TTPVWSLLMVFAVFGIGFSMVNA

SEQ ID NO: 1142385 - protein, 21 aa, Mycobacterium
TTQLGLLAIAIPIGVFAGVVT

SEQ ID NO: 1142386 - protein, 19 aa, Mycobacterium
TTRILPSGMWHARRHPLRM

SEQ ID NO: 1142387 - protein, 30 aa, Mycobacterium
TTRLPTSVSLWLPYLPLLVGGTVATVVVLD

SEQ ID NO: 1142388 - protein, 22 aa, Mycobacterium
TTTYLEVPFVPVPIPIPVPDTP

SEQ ID NO: 1142389 - protein, 28 aa, Mycobacterium
TTVHPLLMRLGPRRAYWSGLSVFAAGSL

SEQ ID NO: 1142390 - protein, 19 aa, Mycobacterium
TTVIPPVRDGAPPPLRDPI

SEQ ID NO: 1142391 - protein, 21 aa, Mycobacterium
TTYSYFFEPNPNWSRLFSTGA

SEQ ID NO: 1142392 - protein, 25 aa, Mycobacterium
TVAATLLLLLPLDLEVRTVVALLCG

SEQ ID NO: 1142393 - protein, 30 aa, Mycobacterium
TVALPMLTMVLFPMYFLKSFAYAGVATVVF

SEQ ID NO: 1142394 - protein, 25 aa, Mycobacterium
TVAVLAAAGVFWFVKRDGTTTNAAP

SEQ ID NO: 1142395 - protein, 24 aa, Mycobacterium
TVCIYGFRFMLLVNKVAVVAATVL

SEQ ID NO: 1142396 - protein, 19 aa, Mycobacterium
TVCTGFLFTQRTLRPLMAV

SEQ ID NO: 1142397 - protein, 21 aa, Mycobacterium
TVDLIRLVPGPLTPQDRHWQH

SEQ ID NO: 1142398 - protein, 27 aa, Mycobacterium
TVEHQRVLAIRLASGNTLLLSKSLAPT

SEQ ID NO: 1142399 - protein, 23 aa, Mycobacterium
TVFLATWVPLFASFGVLLIYPDD

SEQ ID NO: 1142400 - protein, 18 aa, Mycobacterium
TVFLGVVLARANGLTDGH

SEQ ID NO: 1142401 - protein, 24 aa, Mycobacterium
TVFNVVWAVAYLRGFGRTPVWVAA

SEQ ID NO: 1142402 - protein, 21 aa, Mycobacterium
TVGDLLLIRPGAKIPVDGTVE

SEQ ID NO: 1142403 - protein, 28 aa, Mycobacterium
TVHFELPIMALAAGLLWLLASDGVLSRL

SEQ ID NO: 1142404 - protein, 17 aa, Mycobacterium
TVHYLLETISVEDPPRM

SEQ ID NO: 1142405 - protein, 18 aa, Mycobacterium
TVILVCTYVLVAFALQSF

SEQ ID NO: 1142406 - protein, 17 aa, Mycobacterium
TVIRFVHVLGAIIWVGG

SEQ ID NO: 1142407 - protein, 20 aa, Mycobacterium
TVIVPFFAIYLAWKLFAEDW

SEQ ID NO: 1142408 - protein, 22 aa, Mycobacterium
TVLLAAHTVWLAALGAGLIAML

SEQ ID NO: 1142409 - protein, 18 aa, Mycobacterium
TVLLASSAGFCMSVLLLR

SEQ ID NO: 1142410 - protein, 21 aa, Mycobacterium
TVLSFVVLLWVIELFDSLTGH

SEQ ID NO: 1142411 - protein, 26 aa, Mycobacterium
TVLTPLRDLFAAIFFLAIGVSVDPAA

SEQ ID NO: 1142412 - protein, 17 aa, Mycobacterium
TVLVFTSSAAVLVVEIT

SEQ ID NO: 1142413 - protein, 34 aa, Mycobacterium
TVMFSLAVFTLLYGALAVVWFYLLRRYVVEGPQE

SEQ ID NO: 1142414 - protein, 23 aa, Mycobacterium
TVNDLLHGLLMYSGNDAAHALAR

SEQ ID NO: 1142415 - protein, 22 aa, Mycobacterium
TVPFLGAVGVLWAAAALIIAER

SEQ ID NO: 1142416 - protein, 24 aa, Mycobacterium
TVPTVIFVFTLLLTGVLVAKRVRG

SEQ ID NO: 1142417 - protein, 23 aa, Mycobacterium
TVPWAMVLVVYLVQMTMGALAGR

SEQ ID NO: 1142418 - protein, 24 aa, Mycobacterium
TVQIPLYGPILWSLVLSSSGALMF

SEQ ID NO: 1142419 - protein, 24 aa, Mycobacterium
TVRLLAVPIVVFWALLAVSTNTFM

SEQ ID NO: 1142420 - protein, 17 aa, Mycobacterium
TVRLLTRLGLTVAMLTG

SEQ ID NO: 1142421 - protein, 19 aa, Mycobacterium
TVSFGLYLGWSSIAVFANV

SEQ ID NO: 1142422 - protein, 24 aa, Mycobacterium
TVSWLIGCLALLFATSSGLGMYMA

SEQ ID NO: 1142423 - protein, 20 aa, Mycobacterium
TVVAAPVHAPWLCACAAVLC

SEQ ID NO: 1142424 - protein, 31 aa, Mycobacterium
TVVFELAILLALPWWRAFRSTLAIATLFHLG

SEQ ID NO: 1142425 - protein, 18 aa, Mycobacterium
TVVGLAREPNRYLATIQL

SEQ ID NO: 1142426 - protein, 17 aa, Mycobacterium
TVVIVVTNLLLGRPLIE

SEQ ID NO: 1142427 - protein, 19 aa, Mycobacterium
TVVLALPGRAPLWLLVTLV

SEQ ID NO: 1142428 - protein, 18 aa, Mycobacterium
TVVSPAWYSPLVLTVGSI

SEQ ID NO: 1142429 - protein, 18 aa, Mycobacterium
TVVTVPFLGAVGVLWAAA

SEQ ID NO: 1142430 - protein, 31 aa, Mycobacterium
TVVTVPIWVVFLAWASFFFVGGGPAGWVRSV

SEQ ID NO: 1142431 - protein, 28 aa, Mycobacterium
TVVVIKRGLLKWAWIPGVPLLWDLVITM

SEQ ID NO: 1142432 - protein, 20 aa, Mycobacterium
TVVVWLVTALATVVLPVLVL

SEQ ID NO: 1142433 - protein, 33 aa, Mycobacterium
TVYHTDAVPFVWSSPFWFPILVGAATASLAELR

SEQ ID NO: 1142434 - protein, 27 aa, Mycobacterium
TVYQRTPIWVVPKIDFRFSERAKQLFA

SEQ ID NO: 1142435 - protein, 29 aa, Mycobacterium
TWAPLGSPIFRALWIAQFVSNLGTWMQTV

SEQ ID NO: 1142436 - protein, 18 aa, Mycobacterium
TWGFFAFPMMNSGDYLLI

SEQ ID NO: 1142437 - protein, 19 aa, Mycobacterium
TWIGSLPVLSVIGFIVMFG

SEQ ID NO: 1142438 - protein, 28 aa, Mycobacterium
TWLENDRFYRWATYLYLPAQYVSLMLAC

SEQ ID NO: 1142439 - protein, 23 aa, Mycobacterium
TWPVYVVLVYLLGCTVAGLIVAM

SEQ ID NO: 1142440 - protein, 17 aa, Mycobacterium
TWSPRWVDHLVGDRIHR

SEQ ID NO: 1142441 - protein, 24 aa, Mycobacterium
TWSRLYTDWVPRAVPPGWKPGSKA

SEQ ID NO: 1142442 - protein, 22 aa, Mycobacterium
TWWRQPHEFDWTARYFRARGLL

SEQ ID NO: 1142443 - protein, 23 aa, Mycobacterium
TYCLSFTRLPYFQTLGVPLAIGM

SEQ ID NO: 1142444 - protein, 19 aa, Mycobacterium
TYPALLLAGLPPVAANVTN

SEQ ID NO: 1142445 - protein, 20 aa, Mycobacterium
TYQVRLFAEGQFRALNLTIA

SEQ ID NO: 1142446 - protein, 25 aa, Mycobacterium
TYRDPLLVMLVLAPAIWTIGTAVVV

SEQ ID NO: 1142447 - protein, 20 aa, Mycobacterium
TYSLLWVAAVSVLVGAAALF

SEQ ID NO: 1142448 - protein, 19 aa, Mycobacterium
VAAARWLFASFAVLAVLAT

SEQ ID NO: 1142449 - protein, 21 aa, Mycobacterium
VAAATFALAWGLGGYLWATVA

SEQ ID NO: 1142450 - protein, 35 aa, Mycobacterium
VAAEFSLVSWAVPLNWWVVLAGFVLFVSPVGRMGI

SEQ ID NO: 1142451 - protein, 40 aa, Mycobacterium
VAAELSLVDWVKPIDWWWILGGFLLFVTPPGRMSIAVFGA

SEQ ID NO: 1142452 - protein, 17 aa, Mycobacterium
VAAFFWMSNWVFVAQHT

SEQ ID NO: 1142453 - protein, 30 aa, Mycobacterium
VAAGGIALVVLWRWRWVRLAAGAAVLGLVA

SEQ ID NO: 1142454 - protein, 25 aa, Mycobacterium
VAAGYASALLLYRLARRGRDDVAVP

SEQ ID NO: 1142455 - protein, 24 aa, Mycobacterium
VAAKLYPLLLLVPLTLLAVRTGRL

SEQ ID NO: 1142456 - protein, 18 aa, Mycobacterium
VAALALAALLGVALPAVR

SEQ ID NO: 1142457 - protein, 29 aa, Mycobacterium
VAALALALPVWLSAVIVAVVVFAAAGIAA

SEQ ID NO: 1142458 - protein, 17 aa, Mycobacterium
VAALALLAVGGAAIALT

SEQ ID NO: 1142459 - protein, 18 aa, Mycobacterium
VAALIAFWTVIVGAEWAL

SEQ ID NO: 1142460 - protein, 18 aa, Mycobacterium
VAALPFVLVMVGLAVALV

SEQ ID NO: 1142461 - protein, 25 aa, Mycobacterium
VAALTALVVTWYFSRRLQHSIAEVA

SEQ ID NO: 1142462 - protein, 23 aa, Mycobacterium
VAAPLLLLFLRCLQGFSAGGEYG

SEQ ID NO: 1142463 - protein, 30 aa, Mycobacterium
VAAQAVWFMVDGRVPWLHMLVAAGTVVGAV

SEQ ID NO: 1142464 - protein, 26 aa, Mycobacterium
VAASLSMLPLLPRLVFLVVGPAVDIK

SEQ ID NO: 1142465 - protein, 26 aa, Mycobacterium
VAASSYAWFVAAWVLAGVAMSAVFYA

SEQ ID NO: 1142466 - protein, 25 aa, Mycobacterium
VAAVIYFVIVVPFKKLKERDKKVES

SEQ ID NO: 1142467 - protein, 20 aa, Mycobacterium
VAAVLLLLLPLDLETRTVVA

SEQ ID NO: 1142468 - protein, 29 aa, Mycobacterium
VAAVTLFAGVWLLALPLPGRSHLQRGYCR

SEQ ID NO: 1142469 - protein, 28 aa, Mycobacterium
VADADEFIVAVRQLAIGQPAPIEVLRDG

SEQ ID NO: 1142470 - protein, 23 aa, Mycobacterium
VADELLGVLGIIRGRVALGIIGV

SEQ ID NO: 1142471 - protein, 24 aa, Mycobacterium
VADPVLAVLFGGALALIAHVVLPD

SEQ ID NO: 1142472 - protein, 27 aa, Mycobacterium
VAELAPFIVWALSAGHFPLAIGVLQVL

SEQ ID NO: 1142473 - protein, 19 aa, Mycobacterium
VAEPPRSWQLRVELQRDAD

SEQ ID NO: 1142474 - protein, 27 aa, Mycobacterium
VAFGAYFLRGFFILIVVAAVGAYLFAP

SEQ ID NO: 1142475 - protein, 27 aa, Mycobacterium
VAFITMMLSLVWPIASLGFLLSMMQES

SEQ ID NO: 1142476 - protein, 25 aa, Mycobacterium
VAFITMMLSLVWPIASLGFLLSMTQ

SEQ ID NO: 1142477 - protein, 18 aa, Mycobacterium
VAFLALGAAGLAVGWLPS

SEQ ID NO: 1142478 - protein, 18 aa, Mycobacterium
VAFLAWSLPPYLTGGTRV

SEQ ID NO: 1142479 - protein, 19 aa, Mycobacterium
VAFLDSDVLPRRGWLEALL

SEQ ID NO: 1142480 - protein, 17 aa, Mycobacterium
VAFRPVRLLVICVALAA

SEQ ID NO: 1142481 - protein, 27 aa, Mycobacterium
VAFVAVWIWLQIWQGLTGNTFGKAMLG

SEQ ID NO: 1142482 - protein, 27 aa, Mycobacterium
VAFVIFAYPLFLLLNSGSLAAAITAHC

SEQ ID NO: 1142483 - protein, 18 aa, Mycobacterium
VAGFLIFNAMSMAITQRR

SEQ ID NO: 1142484 - protein, 27 aa, Mycobacterium
VAGGLAVLIMLMWVGTALVISTSDSRS

SEQ ID NO: 1142485 - protein, 31 aa, Mycobacterium
VAGLAGLAYLVLWLSRWPTRNQSIGFALTIC

SEQ ID NO: 1142486 - protein, 25 aa, Mycobacterium
VAGLGGWLGWLVPLLTVRCWMHRRR

SEQ ID NO: 1142487 - protein, 26 aa, Mycobacterium
VAGLHDFHLILVLALVPVLPTSLGDE

SEQ ID NO: 1142488 - protein, 30 aa, Mycobacterium; identical to SEQ ID NO: 372201

SEQ ID NO: 1142489 - protein, 17 aa, Mycobacterium
VAGVLALVVILLAARRN

SEQ ID NO: 1142490 - protein, 24 aa, Mycobacterium
VAGVLIVALSVWLIGRGSDPPDTA

SEQ ID NO: 1142491 - protein, 18 aa, Mycobacterium
VAGVLWALVAIAIGASQR

SEQ ID NO: 1142492 - protein, 30 aa, Mycobacterium
VAGVPDSWRLLNIVFILVVLFTVIQGPSLR

SEQ ID NO: 1142493 - protein, 23 aa, Mycobacterium
VAIFVFILISNWLAVLPLQYGGS

SEQ ID NO: 1142494 - protein, 22 aa, Mycobacterium
VAIGHFLFAAFLVPPQASGVLD

SEQ ID NO: 1142495 - protein, 23 aa, Mycobacterium
VAIGHFLFAAFLVPPQPSGVLDV

SEQ ID NO: 1142496 - protein, 20 aa, Mycobacterium
VAIGIVLFFINRLINRRLGV

SEQ ID NO: 1142497 - protein, 25 aa, Mycobacterium
VAIITYVLMILLLAAPLVLRLMHRS

SEQ ID NO: 1142498 - protein, 28 aa, Mycobacterium
VAILARNHRWFLVSVYAAGKVGARIILL

SEQ ID NO: 1142499 - protein, 23 aa, Mycobacterium
VAIPLAILLFLVVSTPVAGEMTM

SEQ ID NO: 1142500 - protein, 18 aa, Mycobacterium
VAIVGSGPSGFFAAASLL

SEQ ID NO: 1142501 - protein, 17 aa, Mycobacterium
VAIVLLTAAAIGFGWSV

SEQ ID NO: 1142502 - protein, 52 aa, Mycobacterium
VAKIGPLEFEGFVAWLAWLVLHLVYLVGFKTKIVTLLSWTVTFLSTKRGQLT

SEQ ID NO: 1142503 - protein, 25 aa, Mycobacterium
VALAFLFGYALSTLPLLKAGLALGT

SEQ ID NO: 1142504 - protein, 22 aa, Mycobacterium
VALALLRLLRRIKRLIWAAVVV

SEQ ID NO: 1142505 - protein, 23 aa, Mycobacterium
VALALLRLLRRIKRLIWAAVVVA

SEQ ID NO: 1142506 - protein, 30 aa, Mycobacterium
VALGYLLFGGVCVAFWFLPGAKEPVVVDEA

SEQ ID NO: 1142507 - protein, 17 aa, Mycobacterium
VALLALGLLAAMVAVAV

SEQ ID NO: 1142508 - protein, 18 aa, Mycobacterium
VALLTLKRAIDRAPAGPQ

SEQ ID NO: 1142509 - protein, 19 aa, Mycobacterium
VALLVVCSPPPQAAALTIP

SEQ ID NO: 1142510 - protein, 18 aa, Mycobacterium
VALMWVHVPRYLGSSGPD

SEQ ID NO: 1142511 - protein, 28 aa, Mycobacterium
VALPLLAYLLWVVWCRRTWRPVRLLGGL

SEQ ID NO: 1142512 - protein, 29 aa, Mycobacterium
VALSAFTASFLAAGWRPGEPFPGGAVMWS

SEQ ID NO: 1142513 - protein, 22 aa, Mycobacterium
VALYLGNGQMLEAPYTGSVVKV

SEQ ID NO: 1142514 - protein, 23 aa, Mycobacterium
VAMFQPPFAWREFISQAWFVARV

SEQ ID NO: 1142515 - protein, 22 aa, Mycobacterium
VAMHLWFLAVYLMVVTLTPVAV

SEQ ID NO: 1142516 - protein, 22 aa, Mycobacterium
VAMQLPNWREAAVTFWASAFLG

SEQ ID NO: 1142517 - protein, 22 aa, Mycobacterium
VANALRLLGMPMQSVTPAAPRV

SEQ ID NO: 1142518 - protein, 22 aa, Mycobacterium
VANVVFFDFKLKSAAGVLEQFP

SEQ ID NO: 1142519 - protein, 36 aa, Mycobacterium
VAPKRPSRWRHLPAVLLILSLMSFTVAMAGPTHDVR

SEQ ID NO: 1142520 - protein, 27 aa, Mycobacterium
VAPPPAPVYVPPAPPVYVPPAPAYVPP

SEQ ID NO: 1142521 - protein, 35 aa, Mycobacterium
VAPVVVPPPVIVLPRPQWTPPKPAWTWPTQTVEPD

SEQ ID NO: 1142522 - protein, 19 aa, Mycobacterium
VAQGILSPFFLKMASRYAS

SEQ ID NO: 1142523 - protein, 25 aa, Mycobacterium
VARFIPATVLLIAFAAIMIAAGGAM

SEQ ID NO: 1142524 - protein, 31 aa, Mycobacterium
VARVSFLRSLPRSFWTYAGFSAATMLGFTTF

SEQ ID NO: 1142525 - protein, 29 aa, Mycobacterium
VASGAMVFAILVLLGRYINYTLDLAGIAG

SEQ ID NO: 1142526 - protein, 19 aa, Mycobacterium
VASPAWYDDLVLTVGSVRT

SEQ ID NO: 1142527 - protein, 29 aa, Mycobacterium
VASTAILLILLALTYRRLPWRVRPGEPPD

SEQ ID NO: 1142528 - protein, 25 aa, Mycobacterium
VASVISWVSVALLFVMVAVQITDIL

SEQ ID NO: 1142529 - protein, 22 aa, Mycobacterium
VATGDLLLIRPGAKIPVDGTVE

SEQ ID NO: 1142530 - protein, 29 aa, Mycobacterium
VATHQLTPFWLFFVLAALAVFRQMRPWWL

SEQ ID NO: 1142531 - protein, 18 aa, Mycobacterium
VATLIGAALLWPSGGKAD

SEQ ID NO: 1142532 - protein, 23 aa, Mycobacterium
VATQILQMLRQLAPLVRFDGYHV

SEQ ID NO: 1142533 - protein, 28 aa, Mycobacterium
VATVLTAPPIWLWAVWAVLAVCCALLAA

SEQ ID NO: 1142534 - protein, 24 aa, Mycobacterium
VAVAAAVLALVVWTGHRDEADELR

SEQ ID NO: 1142535 - protein, 23 aa, Mycobacterium
VAVAAVLAYLVFAPGKQEPAPEP

SEQ ID NO: 1142536 - protein, 27 aa, Mycobacterium
VAVFAAAGFWWFDGYLLVQERYWQGIA

SEQ ID NO: 1142537 - protein, 27 aa, Mycobacterium
VAVFFVLSGFLLFRPWVRAAAAGRRAP

SEQ ID NO: 1142538 - protein, 17 aa, Mycobacterium
VAVFPLVEWVVHVCILH

SEQ ID NO: 1142539 - protein, 25 aa, Mycobacterium
VAVGNFLFVWLIPVALGVAYARRLI

SEQ ID NO: 1142540 - protein, 17 aa, Mycobacterium
VAVIVGPPLFREHLNRA

SEQ ID NO: 1142541 - protein, 23 aa, Mycobacterium
VAVIVGPPLFREHLNRAGLPHSS

SEQ ID NO: 1142542 - protein, 21 aa, Mycobacterium
VAVLALLLAVAPVAASPVAAA

SEQ ID NO: 1142543 - protein, 18 aa, Mycobacterium
VAVLCSVAMVAASGLILF

SEQ ID NO: 1142544 - protein, 24 aa, Mycobacterium
VAVLIFFASTLLSFGRGNWKRMSV

SEQ ID NO: 1142545 - protein, 19 aa, Mycobacterium
VAVLLIGRVLSGLSAGVFT

SEQ ID NO: 1142546 - protein, 25 aa, Mycobacterium
VAVLQYLRLLVVLVTMPLVVTLVFG

SEQ ID NO: 1142547 - protein, 20 aa, Mycobacterium
VAVLVAGRFLFFGKAQSANE

SEQ ID NO: 1142548 - protein, 25 aa, Mycobacterium
VAVLVALALVRFLPVARGPAYAVLG

SEQ ID NO: 1142549 - protein, 26 aa, Mycobacterium
VAVLVVATPCPLLLAAPVAIVSGLSR

SEQ ID NO: 1142550 - protein, 28 aa, Mycobacterium
VAVMALTMHLVLGWPLFTGSMPGLIAAT

SEQ ID NO: 1142551 - protein, 34 aa, Mycobacterium
VAVPLVAGNWPDPLPLLGWVLAAAAVATFVVQAL

SEQ ID NO: 1142552 - protein, 25 aa, Mycobacterium
VAVVLTFLFLMRQGYRWARTLLTGG

SEQ ID NO: 1142553 - protein, 26 aa, Mycobacterium
VAVVMAWLEFWYPVPSCLIVAALVAL

SEQ ID NO: 1142554 - protein, 24 aa, Mycobacterium
VAVVPAVLWVLVALRSGRLGVDLI

SEQ ID NO: 1142555 - protein, 19 aa, Mycobacterium
VAWLAYPAAYLALALLVLN

SEQ ID NO: 1142556 - protein, 18 aa, Mycobacterium
VAWWQPVAWLAYPAAYLA

SEQ ID NO: 1142557 - protein, 17 aa, Mycobacterium
VAYFWQHLPKAFFPIEN

SEQ ID NO: 1142558 - protein, 18 aa, Mycobacterium
VCLGFLPHNFHKARIFMG

SEQ ID NO: 1142559 - protein, 17 aa, Mycobacterium
VCLIGLSGGYVFSVFLQ

SEQ ID NO: 1142560 - protein, 29 aa, Mycobacterium
VCLVAPTLWIFLVGRFLQGAAFAAVFLTV

SEQ ID NO: 1142561 - protein, 26 aa, Mycobacterium
VCSAAYAVWAWLQPGSFRAWVTEPVR

SEQ ID NO: 1142562 - protein, 17 aa, Mycobacterium
VDALRDRSKRNADENPS

SEQ ID NO: 1142563 - protein, 23 aa, Mycobacterium
VDARGFLLGGAVAVTLGIGVLAV

SEQ ID NO: 1142564 - protein, 17 aa, Mycobacterium
VDDVAPPWLKSVPTRLS

SEQ ID NO: 1142565 - protein, 30 aa, Mycobacterium
VDEGRDAWFSMLAFWFFAAGWAASKASTVW

SEQ ID NO: 1142566 - protein, 17 aa, Mycobacterium
VDFIFQVGPLSLVVALL

SEQ ID NO: 1142567 - protein, 24 aa, Mycobacterium
VDGDDWSWLKWLPHTDIPGEADGV

SEQ ID NO: 1142568 - protein, 22 aa, Mycobacterium
VDGLLFVDMRLIDGTDLRKLLK

SEQ ID NO: 1142569 - protein, 19 aa, Mycobacterium
VDGLLTRREAMRRLALLGV

SEQ ID NO: 1142570 - protein, 18 aa, Mycobacterium
VDGLPLTVKVTEPGLICV

SEQ ID NO: 1142571 - protein, 27 aa, Mycobacterium
VDGLRSRLWPVPALGVVAAVLAGISIP

SEQ ID NO: 1142572 - protein, 17 aa, Mycobacterium
VDHKLWIRFGVSGALLS

SEQ ID NO: 1142573 - protein, 30 aa, Mycobacterium
VDKRSHTTALWLIPLVVVGAIVAGAVAVVV

SEQ ID NO: 1142574 - protein, 24 aa, Mycobacterium
VDLALWMIPAPTSLPVRVALMFAA

SEQ ID NO: 1142575 - protein, 24 aa, Mycobacterium
VDPIPARVVSFRPLGQGDVALLKV

SEQ ID NO: 1142576 - protein, 17 aa, Mycobacterium
VDPLLILNTLVGGLLAA

SEQ ID NO: 1142577 - protein, 40 aa, Mycobacterium
VDPWSTLKVSLLLSVVLFFVWMIAVAFLYLVLGGMGVWSK

SEQ ID NO: 1142578 - protein, 27 aa, Mycobacterium
VDRAVRRWALILIPLGVAVFAVPGVGN

SEQ ID NO: 1142579 - protein, 34 aa, Mycobacterium
VDSRRNLLGLFMPSALFLIFVMLAAPSVKVQAFL

SEQ ID NO: 1142580 - protein, 26 aa, Mycobacterium
VDSRRNVLGLFMPAALALIFVMLAVP

SEQ ID NO: 1142581 - protein, 18 aa, Mycobacterium
VDTKYMQLIPANVLADIS

SEQ ID NO: 1142582 - protein, 24 aa, Mycobacterium
VDVFFVLSGFLITSLLLDEVGRTG

SEQ ID NO: 1142583 - protein, 21 aa, Mycobacterium
VDVNRLITVLGVVAVAALVTR

SEQ ID NO: 1142584 - protein, 23 aa, Mycobacterium
VEAFAVFNVFYQAGILAGPLVGL

SEQ ID NO: 1142585 - protein, 26 aa, Mycobacterium
VEGAAWLRLAWAGILFLVIVRPRRKA

SEQ ID NO: 1142586 - protein, 24 aa, Mycobacterium
VEIPVLTLADWWPALKTHGLAGVV

SEQ ID NO: 1142587 - protein, 21 aa, Mycobacterium
VEITALRLLAPYLGLTLETST

SEQ ID NO: 1142588 - protein, 22 aa, Mycobacterium
VEITALRLLAPYLGLTLETSTL

SEQ ID NO: 1142589 - protein, 19 aa, Mycobacterium
VELLRQLWTQRTVTFDGRH

SEQ ID NO: 1142590 - protein, 24 aa, Mycobacterium
VESFDGFEYLFWVGCAGAYEDRAK

SEQ ID NO: 1142591 - protein, 20 aa, Mycobacterium
VETFRFVPVVVTFAIGVAVL

SEQ ID NO: 1142592 - protein, 17 aa, Mycobacterium
VEWFDFAIYGFLATFIA

SEQ ID NO: 1142593 - protein, 25 aa, Mycobacterium
VEYVIPLPRAWLLTSAMLVGAAIGL

SEQ ID NO: 1142594 - protein, 27 aa, Mycobacterium
VFAGPAWFILLFLIPLLLSIFVMRYRT

SEQ ID NO: 1142595 - protein, 19 aa, Mycobacterium
VFAGWVLLLVASIALTVGW

SEQ ID NO: 1142596 - protein, 20 aa, Mycobacterium
VFALIFLAIAVVMVLNMTGV

SEQ ID NO: 1142597 - protein, 46 aa, Mycobacterium
VFDILSPVAAIAGLLYIGLALGWPLWWVSVCSVLCLLIVQGVIVNV

SEQ ID NO: 1142598 - protein, 18 aa, Mycobacterium
VFFGVVFAGFIGITTTSG

SEQ ID NO: 1142599 - protein, 25 aa, Mycobacterium
VFGCTPVGPLGWGQALLATAIAGVA

SEQ ID NO: 1142600 - protein, 17 aa, Mycobacterium
VFGIPGQGAYAAGNAYL

SEQ ID NO: 1142601 - protein, 18 aa, Mycobacterium
VFGSKFVELVPPADPSAQ

SEQ ID NO: 1142602 - protein, 24 aa, Mycobacterium
VFHDFPLGLYLIAGVTALILVLAA

SEQ ID NO: 1142603 - protein, 19 aa, Mycobacterium
VFIGVLAIVFIFIGRFAFN

SEQ ID NO: 1142604 - protein, 17 aa, Mycobacterium
VFLFALFAGDGQETSWR

SEQ ID NO: 1142605 - protein, 29 aa, Mycobacterium
VFNFLTGGLVLLFAFYLVTVRGESPEVLG

SEQ ID NO: 1142606 - protein, 27 aa, Mycobacterium
VFQALTWLFQIMPLFFFAGVAASVQSW

SEQ ID NO: 1142607 - protein, 31 aa, Mycobacterium
VFSDLVMMKYLAFGLLIALLLDATIIRMFLV

SEQ ID NO: 1142608 - protein, 22 aa, Mycobacterium
VFTPVAPYLPLGVALFVVGVGL

SEQ ID NO: 1142609 - protein, 33 aa, Mycobacterium
VFTTVLLTRVVVFLVVSLLIGAIVFAGLALAYR

SEQ ID NO: 1142610 - protein, 25 aa, Mycobacterium
VFVAFLIPFLDLGIIQSPMLRPIPQ

SEQ ID NO: 1142611 - protein, 24 aa, Mycobacterium
VFVAFLIPFLDLGIIQSPMLRPVS

SEQ ID NO: 1142612 - protein, 19 aa, Mycobacterium
VFVEWRFDLIFGTAAFVIA

SEQ ID NO: 1142613 - protein, 22 aa, Mycobacterium
VFVGMGLYFAFLGLTQFVQIDR

SEQ ID NO: 1142614 - protein, 20 aa, Mycobacterium
VFVGPFLLIAAVSGGLYAIA

SEQ ID NO: 1142615 - protein, 17 aa, Mycobacterium
VFVNALLGLFGAVALMV

SEQ ID NO: 1142616 - protein, 28 aa, Mycobacterium
VFVNTLVSLFYYLRWIIPAFGRPHETGD

SEQ ID NO: 1142617 - protein, 35 aa, Mycobacterium
VGAAAYLAFAVPSLLFTIPLQLLTGQRSAIVTSLN

SEQ ID NO: 1142618 - protein, 31 aa, Mycobacterium
VGAGFLATLAFLRYRWLRGEPLPPQRSRAAR

SEQ ID NO: 1142619 - protein, 17 aa, Mycobacterium
VGAIAWSFLLSPQSGYL

SEQ ID NO: 1142620 - protein, 17 aa, Mycobacterium
VGALRGALRAAPRLSPN

SEQ ID NO: 1142621 - protein, 19 aa, Mycobacterium
VGAMVLAIGPGWFGALTAI

SEQ ID NO: 1142622 - protein, 20 aa, Mycobacterium
VGAPLLGAILTMMPTRGTGS

SEQ ID NO: 1142623 - protein, 27 aa, Mycobacterium
VGASLFLAVWLVWAPALFRSLDDVGTP

SEQ ID NO: 1142624 - protein, 29 aa, Mycobacterium
VGAVVPHVRWPMWLRTLLAVVALAAILSC

SEQ ID NO: 1142625 - protein, 24 aa, Mycobacterium
VGDIIKHPVAFLSNLIEGVKGGIL

SEQ ID NO: 1142626 - protein, 23 aa, Mycobacterium
VGFDCSGLMLYAFAGVGIKLDHY

SEQ ID NO: 1142627 - protein, 18 aa, Mycobacterium
VGGLLTLPNFGNPVQFIC

SEQ ID NO: 1142628 - protein, 26 aa, Mycobacterium
VGGVLGVRYLLRNRSRLLDRFTLGVT

SEQ ID NO: 1142629 - protein, 24 aa, Mycobacterium
VGIPLGWMVLPMSVIVLLAVGADY

SEQ ID NO: 1142630 - protein, 31 aa, Mycobacterium
VGISMPVFWLAAILLYFLSFKVQLFPTGSYV

SEQ ID NO: 1142631 - protein, 42 aa, Mycobacterium
VGKLGVRDVLFGRKVSYAGLAILLLTALMVGALGGWVGNKTA

SEQ ID NO: 1142632 - protein, 21 aa, Mycobacterium
VGLCVYVLILRFTAAQLVKAA

SEQ ID NO: 1142633 - protein, 20 aa, Mycobacterium
VGLGYALWLRRARPEVYAEI

SEQ ID NO: 1142634 - protein, 28 aa, Mycobacterium
VGLLAAHSWLGLPGWVAVHALLLGAVTN

SEQ ID NO: 1142635 - protein, 18 aa, Mycobacterium
VGLLAGLIAQNYWQRVQL

SEQ ID NO: 1142636 - protein, 17 aa, Mycobacterium
VGLLLVGLLTIALVIGA

SEQ ID NO: 1142637 - protein, 27 aa, Mycobacterium
VGLTVNLMIYWRLWAKYKASTELAGGA

SEQ ID NO: 1142638 - protein, 30 aa, Mycobacterium
VGLVTLTALWCWLPFQLKFMRATSPLTELG

SEQ ID NO: 1142639 - protein, 23 aa, Mycobacterium
VGMGLIFTLLAAYPFIEKKLSGD

SEQ ID NO: 1142640 - protein, 25 aa, Mycobacterium
VGMVLFWGLIIVGIVALIRYTTGSP

SEQ ID NO: 1142641 - protein, 18 aa, Mycobacterium
VGNLTWVLILAALVARYV

SEQ ID NO: 1142642 - protein, 19 aa, Mycobacterium
VGNVAYLVLLFSTLGYFFP

SEQ ID NO: 1142643 - protein, 17 aa, Mycobacterium
VGPARYLATEPAALHAL

SEQ ID NO: 1142644 - protein, 21 aa, Mycobacterium
VGPVLLTWLASVAVVFVGALL

SEQ ID NO: 1142645 - protein, 32 aa, Mycobacterium
VGQTLLTYNPAIEQLLVLFPGIIAAQQSFGLP

SEQ ID NO: 1142646 - protein, 20 aa, Mycobacterium
VGRPPVTRRSILNLYTDRAP

SEQ ID NO: 1142647 - protein, 39 aa, Mycobacterium
VGRTLALALALYLVAALMVWLQALLLNIVVQRTMVALRA

SEQ ID NO: 1142648 - protein, 28 aa, Mycobacterium
VGRVAAALVAVLALVLTGGAWQWQSAKN

SEQ ID NO: 1142649 - protein, 20 aa, Mycobacterium
VGSIPFLDMLFVDLRVYILG

SEQ ID NO: 1142650 - protein, 23 aa, Mycobacterium
VGSKIILVIVLISFLSCAMSLQA

SEQ ID NO: 1142651 - protein, 37 aa, Mycobacterium
VGTILTILLVVYRSIIGMLIPLLTIGLALGVANQAVA

SEQ ID NO: 1142652 - protein, 19 aa, Mycobacterium
VGTLLLFALVVTPAAAAIM

SEQ ID NO: 1142653 - protein, 24 aa, Mycobacterium
VGTPAMWFLAVPVLAWAVWRAFVK

SEQ ID NO: 1142654 - protein, 24 aa, Mycobacterium
VGTRPLLAGLLALAGHRPPVAEGL

SEQ ID NO: 1142655 - protein, 24 aa, Mycobacterium
VGTRPLLAGLLALAGHRPPVTEGL

SEQ ID NO: 1142656 - protein, 28 aa, Mycobacterium
VGTTIALGLLFDTLIVRSFMTPAVAALL

SEQ ID NO: 1142657 - protein, 28 aa, Mycobacterium
VGTTIGLGLLFDTLIVRSLMTPSIAALM

SEQ ID NO: 1142658 - protein, 25 aa, Mycobacterium
VGVAQPLILLGLLPVLIGALLLVQP

SEQ ID NO: 1142659 - protein, 25 aa, Mycobacterium
VGVFTVAMLLVAAMLVVVFGEFRFA

SEQ ID NO: 1142660 - protein, 17 aa, Mycobacterium
VGVPWLLSFAQPTIWVI

SEQ ID NO: 1142661 - protein, 20 aa, Mycobacterium
VGWCVLLQVLPMRTRHGVVI

SEQ ID NO: 1142662 - protein, 28 aa, Mycobacterium
VGYKVMATPATLATLRRGAEARLITAMI

SEQ ID NO: 1142663 - protein, 18 aa, Mycobacterium
VGYLAFALTVAVSVAYLV

SEQ ID NO: 1142664 - protein, 22 aa, Mycobacterium
VGYLLLRARLDPPGGRLLDNAV

SEQ ID NO: 1142665 - protein, 17 aa, Mycobacterium
VGYNVIALPIAAGVFQP

SEQ ID NO: 1142666 - protein, 18 aa, Mycobacterium
VHAARRARTGSRRRSRWQ

SEQ ID NO: 1142667 - protein, 17 aa, Mycobacterium
VHDLHVWTLVPGKDVVT

SEQ ID NO: 1142668 - protein, 27 aa, Mycobacterium
VHFFLYDTVKIFLLLTGLMFVVGMLRA

SEQ ID NO: 1142669 - protein, 19 aa, Mycobacterium
VHGTWLSDWILHRDRFGIV

SEQ ID NO: 1142670 - protein, 20 aa, Mycobacterium
VHLAAPWPMPIGAWQSDLAL

SEQ ID NO: 1142671 - protein, 19 aa, Mycobacterium
VHLLSLLRLVATVAYYLVV

SEQ ID NO: 1142672 - protein, 24 aa, Mycobacterium
VHSLVLLGVVYLATGPVSAIPLAA

SEQ ID NO: 1142673 - protein, 30 aa, Mycobacterium
VHSVVLLGVVYLLSGPVSQIPLAALAGVLM

SEQ ID NO: 1142674 - protein, 26 aa, Mycobacterium
VIAFGVLVVFLLPALRDGAPAVPVSL

SEQ ID NO: 1142675 - protein, 25 aa, Mycobacterium
VIAIMSVMRYPVRVGFLVGLPLAQI

SEQ ID NO: 1142676 - protein, 19 aa, Mycobacterium
VIALAIALPAGIYAALREG

SEQ ID NO: 1142677 - protein, 17 aa, Mycobacterium
VIALLLGVIGYLVGGQA

SEQ ID NO: 1142678 - protein, 18 aa, Mycobacterium
VIAVGIAIAYRMYGRRAV

SEQ ID NO: 1142679 - protein, 21 aa, Mycobacterium
VIDILLGWLLAAVVLAALWLF

SEQ ID NO: 1142680 - protein, 23 aa, Mycobacterium
VIDLVNRLTLAPPPRGTGELMVV

SEQ ID NO: 1142681 - protein, 19 aa, Mycobacterium
VIDPRMLYTDELTVTRILG

SEQ ID NO: 1142682 - protein, 17 aa, Mycobacterium
VIEFLMYVVYVLAIKDP

SEQ ID NO: 1142683 - protein, 17 aa, Mycobacterium
VIFLRDHRTLSRYGYVC

SEQ ID NO: 1142684 - protein, 26 aa, Mycobacterium
VIFTRTTPWAFHDALYFAKRVQIRAA

SEQ ID NO: 1142685 - protein, 25 aa, Mycobacterium
VIGYILTLVGFISLGSFTAALAFGS

SEQ ID NO: 1142686 - protein, 19 aa, Mycobacterium
VIKQNLWASLGIVAVLIPA

SEQ ID NO: 1142687 - protein, 35 aa, Mycobacterium
VILNVLIVMFPLISAFAIWALTGWVVSGELFATLS

SEQ ID NO: 1142688 - protein, 18 aa, Mycobacterium
VIMTIQVAIAWFGYRVIA

SEQ ID NO: 1142689 - protein, 32 aa, Mycobacterium
VIPAILVVVLLVLYLLLRSALAPLVLVGVTVL

SEQ ID NO: 1142690 - protein, 49 aa, Mycobacterium
VIPGAKPAKPRSFRRLWLLLTAPFAVLAGLYLGDLILSSDRVPRGVTAA

SEQ ID NO: 1142691 - protein, 28 aa, Mycobacterium
VISALCLVLMIMLVLTRSLVAALVIVGT

SEQ ID NO: 1142692 - protein, 24 aa, Mycobacterium
VITNFAWLYPILTGLPISQHTWNM

SEQ ID NO: 1142693 - protein, 19 aa, Mycobacterium
VIVAIQRLFRGFMSTIAVL

SEQ ID NO: 1142694 - protein, 20 aa, Mycobacterium
VIVGPPLFREHLNRAGLPHS

SEQ ID NO: 1142695 - protein, 20 aa, Mycobacterium
VIVMLNHCYYGFYASGGPVG

SEQ ID NO: 1142696 - protein, 18 aa, Mycobacterium
VIVVGLQPQQLWSMATSV

SEQ ID NO: 1142697 - protein, 17 aa, Mycobacterium
VIYLGPPTLRAADEQRP

SEQ ID NO: 1142698 - protein, 17 aa, Mycobacterium
VIYSFVPMLWMISLAFK

SEQ ID NO: 1142699 - protein, 27 aa, Mycobacterium
VKFGVFAVVMVLFTAALVAIFGQYRAG

SEQ ID NO: 1142700 - protein, 29 aa, Mycobacterium
VKGDPTLLTMLWQNLIGNAVKFRREGVAP

SEQ ID NO: 1142701 - protein, 18 aa, Mycobacterium
VLAEAFGRPPYSGGDSLQ

SEQ ID NO: 1142702 - protein, 17 aa, Mycobacterium
VLAERSGLRIHEVPVDW

SEQ ID NO: 1142703 - protein, 22 aa, Mycobacterium
VLAFALILWLHAADTATRFTDV

SEQ ID NO: 1142704 - protein, 19 aa, Mycobacterium
VLAFALLRPHRWPEAVIAV

SEQ ID NO: 1142705 - protein, 19 aa, Mycobacterium
VLAFLFARIFVEPQIQLAI

SEQ ID NO: 1142706 - protein, 29 aa, Mycobacterium
VLAFSAVSLLFLFILQLVQGRLPSALTDP

SEQ ID NO: 1142707 - protein, 24 aa, Mycobacterium
VLAGAIVHFSSPGPAPAAPEAPQA

SEQ ID NO: 1142708 - protein, 25 aa, Mycobacterium
VLAIDPIALSYLLGAVGPVTMPDGE

SEQ ID NO: 1142709 - protein, 25 aa, Mycobacterium
VLAKKLLIGFLTAGALILAVGAVAV

SEQ ID NO: 1142710 - protein, 23 aa, Mycobacterium
VLALANLLWFVFAGLGALTLEAG

SEQ ID NO: 1142711 - protein, 26 aa, Mycobacterium
VLALGWGFLIWGLAMYLWSGALYLVQ

SEQ ID NO: 1142712 - protein, 18 aa, Mycobacterium
VLAPIGIVLPMSVGAIFM

SEQ ID NO: 1142713 - protein, 22 aa, Mycobacterium
VLAPILLLLLRCLQGFSAGGEY

SEQ ID NO: 1142714 - protein, 19 aa, Mycobacterium
VLAVTVIVAYLLLPAYRAK

SEQ ID NO: 1142715 - protein, 20 aa, Mycobacterium
VLAVTVIVAYLLLPAYRAKE

SEQ ID NO: 1142716 - protein, 18 aa, Mycobacterium
VLCGVAYAWWPQEGRYQP

SEQ ID NO: 1142717 - protein, 19 aa, Mycobacterium
VLCLLLAFPLAYVIAFKAG

SEQ ID NO: 1142718 - protein, 35 aa, Mycobacterium
VLDDVYLPLWVRRVAWVATIVLLMTGITAWVVGVG

SEQ ID NO: 1142719 - protein, 23 aa, Mycobacterium
VLDNVTIILLIAPVTLVICDRLR

SEQ ID NO: 1142720 - protein, 28 aa, Mycobacterium
VLDQIGVPWWFLVAQLPVAGIVFAIDGV

SEQ ID NO: 1142721 - protein, 18 aa, Mycobacterium
VLDRLLRLAQPPATSWWR

SEQ ID NO: 1142722 - protein, 39 aa, Mycobacterium
VLDTVVDRLAGFGAPAHRVWLPPLSRAPALDAVLSRAPT

SEQ ID NO: 1142723 - protein, 36 aa, Mycobacterium
VLDTVVDRLAGFGAPAHRVWLPPLSRASALDAVLSR

SEQ ID NO: 1142724 - protein, 17 aa, Mycobacterium
VLFFSVFEYFRSWEFFR

SEQ ID NO: 1142725 - protein, 18 aa, Mycobacterium
VLFVLAVCRVIVGVALVP

SEQ ID NO: 1142726 - protein, 19 aa, Mycobacterium
VLFVLLDQYAPAGLTVLVL

SEQ ID NO: 1142727 - protein, 26 aa, Mycobacterium
VLGAAYFVAVLFWPAGTFDYWQAWVF

SEQ ID NO: 1142728 - protein, 19 aa, Mycobacterium
VLGCLLAVLAVRQAGLFTA

SEQ ID NO: 1142729 - protein, 17 aa, Mycobacterium
VLGFAFLTKMLQAFLVM

SEQ ID NO: 1142730 - protein, 18 aa, Mycobacterium
VLGFALAVWLVPSLPTAR

SEQ ID NO: 1142731 - protein, 19 aa, Mycobacterium
VLGMVFLFGLVFVLIEGPG

SEQ ID NO: 1142732 - protein, 26 aa, Mycobacterium
VLGSFPIIFGLSFRDALLATLLGVVA

SEQ ID NO: 1142733 - protein, 25 aa, Mycobacterium
VLGVGMLVLGIPLMLACFAFGTKRF

SEQ ID NO: 1142734 - protein, 26 aa, Mycobacterium
VLGVVVIGVVVWLLVPSGDGGSTAAS

SEQ ID NO: 1142735 - protein, 25 aa, Mycobacterium
VLGWAMIPTVLYYLGILLAVEIDAR

SEQ ID NO: 1142736 - protein, 23 aa, Mycobacterium
VLGWGWLALTLVGVPWLLSFAQP

SEQ ID NO: 1142737 - protein, 26 aa, Mycobacterium
VLIASFAWILYIFGAFLVATGIQMAL

SEQ ID NO: 1142738 - protein, 28 aa, Mycobacterium
VLISPLFLTLMLLVRLSSPGPIFFGQPR

SEQ ID NO: 1142739 - protein, 18 aa, Mycobacterium
VLIVTCTAPWMVVMTTGW

SEQ ID NO: 1142740 - protein, 28 aa, Mycobacterium
VLLALVAAAITLWLGLVGQFGELVGDQA

SEQ ID NO: 1142741 - protein, 27 aa, Mycobacterium
VLLASLALALLFWQWRKIPFVVWDVTY

SEQ ID NO: 1142742 - protein, 23 aa, Mycobacterium
VLLEFAGLVTLGVLLLVARRRLA

SEQ ID NO: 1142743 - protein, 24 aa, Mycobacterium
VLLEVFVFAYIGLHLRFVLEDLQQ

SEQ ID NO: 1142744 - protein, 18 aa, Mycobacterium
VLLLLTAISTVLPHAAAG

SEQ ID NO: 1142745 - protein, 30 aa, Mycobacterium
VLLRGLTGWPLWWAAWWAAVEWLKSVIPFG

SEQ ID NO: 1142746 - protein, 18 aa, Mycobacterium
VLLRIEPWLPKALFVLVV

SEQ ID NO: 1142747 - protein, 18 aa, Mycobacterium
VLLVHTYFGYFATGGPSG

SEQ ID NO: 1142748 - protein, 18 aa, Mycobacterium
VLLVLFAATDRFDAAWWA

SEQ ID NO: 1142749 - protein, 18 aa, Mycobacterium
VLLVPTMIWVRLRAPWAK

SEQ ID NO: 1142750 - protein, 36 aa, Mycobacterium
VLMRQHLMLYMALMGITWLLDVPARIGNRLPDAGAH

SEQ ID NO: 1142751 - protein, 31 aa, Mycobacterium
VLMRVVDVMFAFPVLLLALAVVAILGPGVTT

SEQ ID NO: 1142752 - protein, 20 aa, Mycobacterium
VLNERRYAITSLLANISAVS

SEQ ID NO: 1142753 - protein, 30 aa, Mycobacterium
VLNMVSVGAFIFAPMLSIYASMKAAMMSFT

SEQ ID NO: 1142754 - protein, 19 aa, Mycobacterium
VLNSWLMTAALFAVLVAGF

SEQ ID NO: 1142755 - protein, 29 aa, Mycobacterium
VLPDIPFTFLLALLPLFLVRSLIGTYQIR

SEQ ID NO: 1142756 - protein, 30 aa, Mycobacterium
VLPGSYQFLKRWLFALVLSAVWVVAAAVGA

SEQ ID NO: 1142757 - protein, 17 aa, Mycobacterium
VLPQWEPTHPPEWLSRV

SEQ ID NO: 1142758 - protein, 19 aa, Mycobacterium
VLPSWGLPVLIAAAVAAVA

SEQ ID NO: 1142759 - protein, 18 aa, Mycobacterium
VLQMLYLSAIFMAMTLVV

SEQ ID NO: 1142760 - protein, 23 aa, Mycobacterium
VLQSAGLLFFAFAGYARIATMGE

SEQ ID NO: 1142761 - protein, 38 aa, Mycobacterium
VLRARVWDSASCKAWLLAQPFLMSAVLLGIFAVTGRYD

SEQ ID NO: 1142762 - protein, 32 aa, Mycobacterium
VLRPGYLPVPFVIAALPLIALLAAGLGEEGVR

SEQ ID NO: 1142763 - protein, 21 aa, Mycobacterium
VLRVTLLWAAGISVLFPIVWI

SEQ ID NO: 1142764 - protein, 23 aa, Mycobacterium
VLSAIYVLWMYQRMMTGPAPLSL

SEQ ID NO: 1142765 - protein, 27 aa, Mycobacterium
VLSEWHWQAIFWVGVPIGLAGTVWSLR

SEQ ID NO: 1142766 - protein, 26 aa, Mycobacterium
VLSGNFAWLNWLTILLAFSAVDQSVF

SEQ ID NO: 1142767 - protein, 20 aa, Mycobacterium
VLSIFRIVFGLLFTLHGAQK

SEQ ID NO: 1142768 - protein, 30 aa, Mycobacterium; identical to SEQ ID NO: 1129145

SEQ ID NO: 1142769 - protein, 32 aa, Mycobacterium
VLSLPVVFYSAWIFFDGAFRALRARTLDMMVL

SEQ ID NO: 1142770 - protein, 17 aa, Mycobacterium
VLSLWHLRNRRHPGWLA

SEQ ID NO: 1142771 - protein, 17 aa, Mycobacterium
VLSVIGFIVMFGGVVFA

SEQ ID NO: 1142772 - protein, 23 aa, Mycobacterium
VLTAMQAINDLPLHKVIPGTEED

SEQ ID NO: 1142773 - protein, 21 aa, Mycobacterium
VLTGFVFVSRMPVSVILIGLG

SEQ ID NO: 1142774 - protein, 26 aa, Mycobacterium
VLTGFVLVSRIPVSVILIGLGSILVL

SEQ ID NO: 1142775 - protein, 27 aa, Mycobacterium
VLTGGAVFLAAWLPFNNGLRPEPLIAF

SEQ ID NO: 1142776 - protein, 20 aa, Mycobacterium
VLVAPFLLVAAVTGGLYALA

SEQ ID NO: 1142777 - protein, 17 aa, Mycobacterium
VLVIADTVKPASAQAIS

SEQ ID NO: 1142778 - protein, 21 aa, Mycobacterium
VLVIHENKGLNDYIRSVAGRF

SEQ ID NO: 1142779 - protein, 18 aa, Mycobacterium
VLVLAIAGPALLGFAYGE

SEQ ID NO: 1142780 - protein, 17 aa, Mycobacterium
VLVLRRDGTLSAYEVNA

SEQ ID NO: 1142781 - protein, 17 aa, Mycobacterium
VLVPLIGLAPIVTDGIS

SEQ ID NO: 1142782 - protein, 22 aa, Mycobacterium
VLVPLVLAGVFGGARIAANVDQ

SEQ ID NO: 1142783 - protein, 31 aa, Mycobacterium
VLVPSNTALWAPYVPLLLAGTIGPPLVMSGL

SEQ ID NO: 1142784 - protein, 17 aa, Mycobacterium
VLVVLGMCIGWGLYGNT

SEQ ID NO: 1142785 - protein, 17 aa, Mycobacterium
VLVYGFVGVFVNAVAPG

SEQ ID NO: 1142786 - protein, 20 aa, Mycobacterium
VLVYLLTFNALTAGASGAVF

SEQ ID NO: 1142787 - protein, 36 aa, Mycobacterium
VMAAIVFQITLPLTPAQVLWINLATSSTLGLALAFE

SEQ ID NO: 1142788 - protein, 27 aa, Mycobacterium
VMALATLLTIDLYLPGGLIAGDESLDT

SEQ ID NO: 1142789 - protein, 22 aa, Mycobacterium
VMALYLWQMLPVIVVTLIGYPT

SEQ ID NO: 1142790 - protein, 20 aa, Mycobacterium
VMDGTLLLSLRTVEHQRVLA

SEQ ID NO: 1142791 - protein, 19 aa, Mycobacterium
VMDLSARLFGFNPWSVLVP

SEQ ID NO: 1142792 - protein, 19 aa, Mycobacterium
VMFADYRCPFCAKFSRDTE

SEQ ID NO: 1142793 - protein, 22 aa, Mycobacterium
VMFAVLGWFYLSVLPGWLGLEQ

SEQ ID NO: 1142794 - protein, 18 aa, Mycobacterium
VMGFVVLTGGIMVAVLLN

SEQ ID NO: 1142795 - protein, 17 aa, Mycobacterium
VMGKRKLWYTVSAVIIL

SEQ ID NO: 1142796 - protein, 18 aa, Mycobacterium
VMGLVFGYTWQRTGRLWP

SEQ ID NO: 1142797 - protein, 19 aa, Mycobacterium
VMLLLYPLALVWPSGWAWH

SEQ ID NO: 1142798 - protein, 17 aa, Mycobacterium
VMLPVVWALNHQGWHAA

SEQ ID NO: 1142799 - protein, 18 aa, Mycobacterium
VMPLLPVLVMIYGTARTT

SEQ ID NO: 1142800 - protein, 17 aa, Mycobacterium
VMRRPWVAATSAALVLL

SEQ ID NO: 1142801 - protein, 27 aa, Mycobacterium
VMTALTVIVVVFSVLFLVAVAQHVGEL

SEQ ID NO: 1142802 - protein, 38 aa, Mycobacterium
VNAIVVAEMFYLLNNRFLLEPVLNRIGLFGNKIALATV

SEQ ID NO: 1142803 - protein, 34 aa, Mycobacterium
VNDEARRLLGLPPGPIDRAALPPFLQTSDPGVRD

SEQ ID NO: 1142804 - protein, 27 aa, Mycobacterium
VNDLRTWFLIFAFVAIGLEFSLRGLRE

SEQ ID NO: 1142805 - protein, 19 aa, Mycobacterium
VNFLIVAAVIYFVIVVPFK

SEQ ID NO: 1142806 - protein, 17 aa, Mycobacterium
VNGEWLDAQVFPPLEWA

SEQ ID NO: 1142807 - protein, 18 aa, Mycobacterium
VNLFAPFLRDAQLPSALC

SEQ ID NO: 1142808 - protein, 17 aa, Mycobacterium
VNLVLNPAIDWLTSRHK

SEQ ID NO: 1142809 - protein, 34 aa, Mycobacterium
VNQSSILGTLLIYMLPLLLLVGLFVMFSRMQTGG

SEQ ID NO: 1142810 - protein, 17 aa, Mycobacterium
VNRLLRLPLPAPYVPTR

SEQ ID NO: 1142811 - protein, 38 aa, Mycobacterium
VNVVMKRPIAFAAPILIVMILLVIPLGQLALGGISEKY

SEQ ID NO: 1142812 - protein, 28 aa, Mycobacterium
VPAFMHLMGGLNWWAPGWLRRVHERLGF

SEQ ID NO: 1142813 - protein, 30 aa, Mycobacterium
VPALLVLIEFGIAAAFWQMAVGAAVVLGTT

SEQ ID NO: 1142814 - protein, 26 aa, Mycobacterium
VPETPMQRRDLLTRVIVAAAKADREL

SEQ ID NO: 1142815 - protein, 21 aa, Mycobacterium
VPGARPPLPPAPPGARTVPLE

SEQ ID NO: 1142816 - protein, 18 aa, Mycobacterium
VPGFLLVAAGLYLTSRIT

SEQ ID NO: 1142817 - protein, 19 aa, Mycobacterium
VPGMWTVFALAPVAWWGMW

SEQ ID NO: 1142818 - protein, 23 aa, Mycobacterium
VPGVIGFLLSLIGQGALLLNMAV

SEQ ID NO: 1142819 - protein, 26 aa, Mycobacterium
VPHLLGVPWLVYPMVAVGILVIVALP

SEQ ID NO: 1142820 - protein, 25 aa, Mycobacterium
VPHLVASVLVLILLAGCAAFATFNY

SEQ ID NO: 1142821 - protein, 21 aa, Mycobacterium
VPHMFIVVFVVMLPVYLATDD

SEQ ID NO: 1142822 - protein, 36 aa, Mycobacterium
VPLALFALCVQRRIRSWWLLLPLGVATWVLMHESGV

SEQ ID NO: 1142823 - protein, 36 aa, Mycobacterium
VPLALFALCVQRRIRSWWLLLPLGVATWVLVHESGV

SEQ ID NO: 1142824 - protein, 20 aa, Mycobacterium
VPLILIGLPVDVASALALAV

SEQ ID NO: 1142825 - protein, 17 aa, Mycobacterium
VPLLVIGFADRVAAVAG

SEQ ID NO: 1142826 - protein, 20 aa, Mycobacterium
VPMFLGAMIMGPLGGWCMKK

SEQ ID NO: 1142827 - protein, 26 aa, Mycobacterium
VPPGSPLPTFPDVPVAVLDPGTSSET

SEQ ID NO: 1142828 - protein, 26 aa, Mycobacterium
VPSIVAALFIFALWIATLGFEQSAFA

SEQ ID NO: 1142829 - protein, 24 aa, Mycobacterium
VPSLVSLIWFAVFGGSAINLQQNG

SEQ ID NO: 1142830 - protein, 35 aa, Mycobacterium
VPTARWSAPLQLMFSFLFTPLIRLTNGTANWILRR

SEQ ID NO: 1142831 - protein, 43 aa, Mycobacterium
VPTLAHFRGWLQPMSFVWDGLPSDRPFFLFGNPPSGVDVPVRL

SEQ ID NO: 1142832 - protein, 19 aa, Mycobacterium
VPVAFALVTVWLTRRGRIP

SEQ ID NO: 1142833 - protein, 25 aa, Mycobacterium
VPVLGILLLAIFTLSLRNLSATQFA

SEQ ID NO: 1142834 - protein, 19 aa, Mycobacterium
VPVLILLTVSGKWLYSHAA

SEQ ID NO: 1142835 - protein, 26 aa, Mycobacterium
VQALITMVIVLLFFGFTAVQVPDATG

SEQ ID NO: 1142836 - protein, 27 aa, Mycobacterium
VQAVGAVMLVLSVIGAVIAVRCLLTRP

SEQ ID NO: 1142837 - protein, 24 aa, Mycobacterium
VQDAIPLFGSFLNGVSTNPSAGTI

SEQ ID NO: 1142838 - protein, 20 aa, Mycobacterium
VQESLKLLHPFMLSLGESVS

SEQ ID NO: 1142839 - protein, 21 aa, Mycobacterium
VQLAASWWAIAPGSGSQWPSI

SEQ ID NO: 1142840 - protein, 25 aa, Mycobacterium
VQMLFGELFPKNLAIARPEPLARWL

SEQ ID NO: 1142841 - protein, 26 aa, Mycobacterium
VQQPSLPSFELPKLEIPTFAPEPEAP

SEQ ID NO: 1142842 - protein, 26 aa, Mycobacterium
VQRKLRLQLFMTFVWTLTVVGGSLIA

SEQ ID NO: 1142843 - protein, 38 aa, Mycobacterium
VQRSRPWWRVLAAEMVHFFAVLFWAAGVLAFVAGMPQL

SEQ ID NO: 1142844 - protein, 26 aa, Mycobacterium
VQRTLALFLATFVYALTVLRTIRSND

SEQ ID NO: 1142845 - protein, 17 aa, Mycobacterium
VRALYLSLGALCGALAL

SEQ ID NO: 1142846 - protein, 26 aa, Mycobacterium
VRATALAMLLLGWSLAAPRLPQRWNP

SEQ ID NO: 1142847 - protein, 17 aa, Mycobacterium
VRAVGYRGLPTPGLPFD

SEQ ID NO: 1142848 - protein, 30 aa, Mycobacterium
VRAVRPVILLPLVLPPVVGGIALLYAFGRL

SEQ ID NO: 1142849 - protein, 24 aa, Mycobacterium
VRAVSLVVFILIGPGAAVLTWVRI

SEQ ID NO: 1142850 - protein, 27 aa, Mycobacterium
VRAVTWRLPLVLLTASVVLLTVSDIAF

SEQ ID NO: 1142851 - protein, 26 aa, Mycobacterium
VRDLMGVPRLTFWDYPLAAAISVVTL

SEQ ID NO: 1142852 - protein, 48 aa, Mycobacterium
VRDLREPWPGLRWRPLLIAAAALLVWSVLMLLLMRWASPGVVDDAPPP

SEQ ID NO: 1142853 - protein, 20 aa, Mycobacterium
VRDWLPFALVLIAYDFSRGA

SEQ ID NO: 1142854 - protein, 17 aa, Mycobacterium
VRELIEITLVKNPGMRY

SEQ ID NO: 1142855 - protein, 24 aa, Mycobacterium
VRERPAYLVLLVPSFIIGVGVTTI

SEQ ID NO: 1142856 - protein, 24 aa, Mycobacterium
VRKYLTLMSFRIPALILAAVAYGI

SEQ ID NO: 1142857 - protein, 33 aa, Mycobacterium
VRLATRAVMTTLMALAFWLSGVGVAAAHTSLVG

SEQ ID NO: 1142858 - protein, 17 aa, Mycobacterium
VRLLLVRPGFVVGRMTQ

SEQ ID NO: 1142859 - protein, 21 aa, Mycobacterium
VRLTCNWLYAFPGLHHEDWRY

SEQ ID NO: 1142860 - protein, 17 aa, Mycobacterium
VRMPLDGPLLPADWTVE

SEQ ID NO: 1142861 - protein, 18 aa, Mycobacterium
VRMVLVPAFMHLMGGLNW

SEQ ID NO: 1142862 - protein, 24 aa, Mycobacterium
VRNLFGYRLFPWDQVIDVSFHKGA

SEQ ID NO: 1142863 - protein, 27 aa, Mycobacterium
VRNPVNLIMLILVPLVFVLVAAGSIAD

SEQ ID NO: 1142864 - protein, 23 aa, Mycobacterium
VRPELQPVYLEEAVPRALLGISR

SEQ ID NO: 1142865 - protein, 24 aa, Mycobacterium
VRPHLTPYFAYGAAALIVAAHVIV

SEQ ID NO: 1142866 - protein, 23 aa, Mycobacterium
VRRPRLLIAGLSVVVLTVAVLQT

SEQ ID NO: 1142867 - protein, 23 aa, Mycobacterium
VRRREPVVFLGQNFAPWPIQHDG

SEQ ID NO: 1142868 - protein, 18 aa, Mycobacterium
VRSIAYLASTRLLAGMIV

SEQ ID NO: 1142869 - protein, 17 aa, Mycobacterium
VRSLWHYTYAAYRFHSG

SEQ ID NO: 1142870 - protein, 26 aa, Mycobacterium
VRSPLPAAPPPRRQPHRKLVAAVALG

SEQ ID NO: 1142871 - protein, 26 aa, Mycobacterium
VRTVQYFLLDLFSGRFQWQEFIRQGA

SEQ ID NO: 1142872 - protein, 25 aa, Mycobacterium
VRVDMLEMLPTPWGLVRSGVAPDHP

SEQ ID NO: 1142873 - protein, 17 aa, Mycobacterium
VRWWEYPTLIAMGILTT

SEQ ID NO: 1142874 - protein, 23 aa, Mycobacterium
VSALAALAVSFYVSRRLQRSVTE

SEQ ID NO: 1142875 - protein, 18 aa, Mycobacterium
VSALPWLVAAAVSGSLAV

SEQ ID NO: 1142876 - protein, 26 aa, Mycobacterium
VSAMQWWLMPAASRPFRKWLDPVDGA

SEQ ID NO: 1142877 - protein, 17 aa, Mycobacterium
VSATKWVTDLELTRFDR

SEQ ID NO: 1142878 - protein, 34 aa, Mycobacterium
VSAVFVPIVLALSVATLAAWLLTGHSATVAFTAA

SEQ ID NO: 1142879 - protein, 35 aa, Mycobacterium; identical to SEQ ID NO: 374001

SEQ ID NO: 1142880 - protein, 24 aa, Mycobacterium
VSEVLILLALAFTVIFSGGGPDGF

SEQ ID NO: 1142881 - protein, 20 aa, Mycobacterium
VSGAVTWQWSGWPERTRAPR

SEQ ID NO: 1142882 - protein, 29 aa, Mycobacterium
VSGLAYVVIFSIPLARELFILDPSNTALT

SEQ ID NO: 1142883 - protein, 18 aa, Mycobacterium
VSGLWRDVLAVVAGGHDG

SEQ ID NO: 1142884 - protein, 26 aa, Mycobacterium
VSHGWTVPWMMFLAVYAVQIVAGALA

SEQ ID NO: 1142885 - protein, 20 aa, Mycobacterium
VSHMWVTKFLRTHGLIHDCP

SEQ ID NO: 1142886 - protein, 18 aa, Mycobacterium
VSITLACLVALILILPLA

SEQ ID NO: 1142887 - protein, 22 aa, Mycobacterium
VSLDWVAWQGLGFGSEAQVVVS

SEQ ID NO: 1142888 - protein, 39 aa, Mycobacterium
VSLFTAAGYVLWWAVLFPAISLPIIASLVLAISHGPRVG

SEQ ID NO: 1142889 - protein, 20 aa, Mycobacterium
VSLFYLHVPSAVGIGAYNVT

SEQ ID NO: 1142890 - protein, 20 aa, Mycobacterium
VSLGLPFLGVSWGLPDDRVL

SEQ ID NO: 1142891 - protein, 21 aa, Mycobacterium
VSLLALMVWIPATGRHRGAWA

SEQ ID NO: 1142892 - protein, 23 aa, Mycobacterium
VSLLGAPLKLIQIAAGTALLAGD

SEQ ID NO: 1142893 - protein, 17 aa, Mycobacterium
VSLLTRWLSSTIGEGLI

SEQ ID NO: 1142894 - protein, 21 aa, Mycobacterium
VSMAMVWLAVLLFVKIGEPDG

SEQ ID NO: 1142895 - protein, 21 aa, Mycobacterium
VSMAMVWLAVLLYVKIGEPDN

SEQ ID NO: 1142896 - protein, 18 aa, Mycobacterium
VSMIPFTIAILRYAVDVD

SEQ ID NO: 1142897 - protein, 20 aa, Mycobacterium
VSMLFLVVELNAGVPLAIQI

SEQ ID NO: 1142898 - protein, 22 aa, Mycobacterium
VSNAALGYFAAAAALFVLLSVI

SEQ ID NO: 1142899 - protein, 23 aa, Mycobacterium
VSPLLHYWPLSIEEQFLLVWPVL

SEQ ID NO: 1142900 - protein, 33 aa, Mycobacterium
VSQTQPLVFVFVALIAFVMLLVSIRSVFLAFKG

SEQ ID NO: 1142901 - protein, 22 aa, Mycobacterium
VSQVATTLFNAAYFAGMELVEH

SEQ ID NO: 1142902 - protein, 18 aa, Mycobacterium
VSRADAAVIEWIQQYWNQ

SEQ ID NO: 1142903 - protein, 20 aa, Mycobacterium
VSRLRPLIEPALVVLTVAAL

SEQ ID NO: 1142904 - protein, 17 aa, Mycobacterium
VSRMPVSVILIGLGSIL

SEQ ID NO: 1142905 - protein, 23 aa, Mycobacterium
VSRVRFWLPAPLIFEVLLVVTLV

SEQ ID NO: 1142906 - protein, 32 aa, Mycobacterium
VSTASVWMRLPTLLMGLACWWVISREVIPRLG

SEQ ID NO: 1142907 - protein, 31 aa, Mycobacterium
VSTAVRWVLASYVRLALVTYLVAVATGVISA

SEQ ID NO: 1142908 - protein, 29 aa, Mycobacterium
VSTVLHLVFAFFLLAVRFPAPPERRAGTD

SEQ ID NO: 1142909 - protein, 27 aa, Mycobacterium
VSVNLLYRVSLPKPLPSHRLLLGSVLA

SEQ ID NO: 1142910 - protein, 42 aa, Mycobacterium
VSVRTNWLLVVAVVIELALLLMLLYVPPVAALLTHAAPSPAG

SEQ ID NO: 1142911 - protein, 22 aa, Mycobacterium
VSWHIGFLFRGAVDRCRLAALP

SEQ ID NO: 1142912 - protein, 36 aa, Mycobacterium
VTAAVVALLLIVTYRSPVLFLVPLLVIGFADRVAAV

SEQ ID NO: 1142913 - protein, 24 aa, Mycobacterium
VTAIFGRRTAILLRRGRIRDAAPS

SEQ ID NO: 1142914 - protein, 18 aa, Mycobacterium
VTALAFTLLNAALLWMRI

SEQ ID NO: 1142915 - protein, 33 aa, Mycobacterium
VTALPLQAISVLLLPVSRLLVLIGNALTPGRGF

SEQ ID NO: 1142916 - protein, 27 aa, Mycobacterium
VTDEDLLSFCLLMFMAGLDTVSVTLGW

SEQ ID NO: 1142917 - protein, 23 aa, Mycobacterium
VTDELWRRIGVSLRLVIIGSIVG

SEQ ID NO: 1142918 - protein, 30 aa, Mycobacterium
VTFAVIIVMLLLVYRSIVTVLLTLVMVVLS

SEQ ID NO: 1142919 - protein, 22 aa, Mycobacterium
VTHGIVSALHRPVPLSGDGSDT

SEQ ID NO: 1142920 - protein, 27 aa, Mycobacterium
VTIGIIIVMLLIIYRSVITTVVTMSMV

SEQ ID NO: 1142921 - protein, 18 aa, Mycobacterium
VTIIPITIAILRYAVDVD

SEQ ID NO: 1142922 - protein, 25 aa, Mycobacterium
VTLAPLIFVLFCVVLVSAWSNAVNF

SEQ ID NO: 1142923 - protein, 17 aa, Mycobacterium
VTLGIGVLAVRKGGKLP

SEQ ID NO: 1142924 - protein, 25 aa, Mycobacterium
VTLGVLLLVARRRLASARKQVVRRS

SEQ ID NO: 1142925 - protein, 22 aa, Mycobacterium
VTLPAGWAWLENGWVMAIVAVL

SEQ ID NO: 1142926 - protein, 17 aa, Mycobacterium
VTPPAVDDAFLPAAAPP

SEQ ID NO: 1142927 - protein, 20 aa, Mycobacterium
VTPPAVDDAFLPAAAPPAPP

SEQ ID NO: 1142928 - protein, 32 aa, Mycobacterium
VTQVLLTYNPALEQLLVIFPGIIAAQQSFGLP

SEQ ID NO: 1142929 - protein, 19 aa, Mycobacterium
VTRFLAGLAPEFATAALTA

SEQ ID NO: 1142930 - protein, 27 aa, Mycobacterium
VTRHQVTGWRFVMRRIASGVALHDTRM

SEQ ID NO: 1142931 - protein, 19 aa, Mycobacterium
VTRMDYLSPFFNETAYCLG

SEQ ID NO: 1142932 - protein, 23 aa, Mycobacterium
VTTVTLLVLMFSAGNIRQARGRF

SEQ ID NO: 1142933 - protein, 29 aa, Mycobacterium
VTVALCSFLLAWIFALDRVYEAYRDDKLA

SEQ ID NO: 1142934 - protein, 25 aa, Mycobacterium
VTVCILPALQFGFWLLQGSSKQSLT

SEQ ID NO: 1142935 - protein, 25 aa, Mycobacterium
VTVENRPWYRAFNAYKMAVICLIGA

SEQ ID NO: 1142936 - protein, 30 aa, Mycobacterium
VTVHWSVVVIVWLFAWSLASTLPGSAPGYP

SEQ ID NO: 1142937 - protein, 31 aa, Mycobacterium
VTVLIAGVLGWLLAGPAIRPLRKLTEHTKRL

SEQ ID NO: 1142938 - protein, 30 aa, Mycobacterium
VTVRRLPGWPLWFAALWAAQEWLKSSVPFG

SEQ ID NO: 1142939 - protein, 26 aa, Mycobacterium
VTVVSIPVLRWSWTPVLFAGSLLTLL

SEQ ID NO: 1142940 - protein, 21 aa, Mycobacterium
VTWEMSFLYAVVFGGFVAFSN

SEQ ID NO: 1142941 - protein, 29 aa, Mycobacterium
VTYHPSLEQLLVLLPPYLAATQSYGSSLN

SEQ ID NO: 1142942 - protein, 28 aa, Mycobacterium
VVAAAGVIMILLGFLPKVAAIVASIPNP

SEQ ID NO: 1142943 - protein, 19 aa, Mycobacterium
VVAAWILTERALATRRLWP

SEQ ID NO: 1142944 - protein, 22 aa, Mycobacterium
VVALAFFIPLLIGTGGNTGTQI

SEQ ID NO: 1142945 - protein, 44 aa, Mycobacterium
VVALEVVALVAFIGLPPARFGWWPAAVITAVALLLLVPTVHRRN

SEQ ID NO: 1142946 - protein, 26 aa, Mycobacterium
VVALVYAVWLLYAGGWQYLLMAAVFY

SEQ ID NO: 1142947 - protein, 29 aa, Mycobacterium
VVASHNPWTALLVLFLIGLTGSAVGPALQ

SEQ ID NO: 1142948 - protein, 29 aa, Mycobacterium
VVASLYLGALLRLPGWLLDLSPVAQTSYP

SEQ ID NO: 1142949 - protein, 36 aa, Mycobacterium
VVATPRELFWPFGLYGLIILAVWRVARIPLAWILPR

SEQ ID NO: 1142950 - protein, 19 aa, Mycobacterium
VVAVWLFLNSSGKAAPRML

SEQ ID NO: 1142951 - protein, 25 aa, Mycobacterium
VVCATLSCWLVLIGWSLMGDAVSHA

SEQ ID NO: 1142952 - protein, 26 aa, Mycobacterium
VVEGPYTLPPLDLLVAGDPPKRLTSA

SEQ ID NO: 1142953 - protein, 19 aa, Mycobacterium
VVETLLPVLLLTGTAVRLA

SEQ ID NO: 1142954 - protein, 27 aa, Mycobacterium
VVFGWWLAVVVYLLPRRATLRVAAEDT

SEQ ID NO: 1142955 - protein, 17 aa, Mycobacterium
VVFLVMAAALSHIMWLL

SEQ ID NO: 1142956 - protein, 20 aa, Mycobacterium
VVFSAVVLALAARPAVRGSG

SEQ ID NO: 1142957 - protein, 22 aa, Mycobacterium
VVFTALLWVVPLVEAFRAGDDR

SEQ ID NO: 1142958 - protein, 26 aa, Mycobacterium
VVGAIVYVLLFWTMAFHRKKKGDTEL

SEQ ID NO: 1142959 - protein, 24 aa, Mycobacterium
VVGFLVIATLFFALGNAILVIPLG

SEQ ID NO: 1142960 - protein, 40 aa, Mycobacterium
VVGGVLLEHFWWGSVFLINIPVMVILLVGGVLLLPEHRNP

SEQ ID NO: 1142961 - protein, 21 aa, Mycobacterium
VVGIYTLFAFALATGGPPMIW

SEQ ID NO: 1142962 - protein, 18 aa, Mycobacterium
VVGLLRKCVDEHPDTLFL

SEQ ID NO: 1142963 - protein, 32 aa, Mycobacterium
VVGLVAVLLYSLLYYRVLGVLIALSLTASGAM

SEQ ID NO: 1142964 - protein, 18 aa, Mycobacterium
VVGLVVLAGSFFVGGRTA

SEQ ID NO: 1142965 - protein, 24 aa, Mycobacterium
VVGLYLCFAVPIYLRWRMGDDFEV

SEQ ID NO: 1142966 - protein, 25 aa, Mycobacterium
VVGPTIPWYQEFLRYYFLTVEESVD

SEQ ID NO: 1142967 - protein, 18 aa, Mycobacterium
VVGTWWRYRYDKFGWTTR

SEQ ID NO: 1142968 - protein, 30 aa, Mycobacterium; identical to SEQ ID NO: 374409

SEQ ID NO: 1142969 - protein, 49 aa, Mycobacterium
VVGVARFGYRRRAWLSTAALIMTLVVASAYLFFGALQVNPLASSYRVTV

SEQ ID NO: 1142970 - protein, 25 aa, Mycobacterium
VVHGWVYFVYLLFTANLAVKVRWPI

SEQ ID NO: 1142971 - protein, 30 aa, Mycobacterium
VVHPTFLYESLWNVLVFGMLIWVDRRFRIG

SEQ ID NO: 1142972 - protein, 20 aa, Mycobacterium
VVIAFLLLFVVNAIVTAVGF

SEQ ID NO: 1142973 - protein, 21 aa, Mycobacterium
VVIAFLLLFVVNAIVTAVGFE

SEQ ID NO: 1142974 - protein, 21 aa, Mycobacterium
VVICIFYLVPQYQGAGLALKT

SEQ ID NO: 1142975 - protein, 19 aa, Mycobacterium
VVIGVWPLTTVGIALTLGT

SEQ ID NO: 1142976 - protein, 22 aa, Mycobacterium
VVIIALFPLIINPLQGLLGADR

SEQ ID NO: 1142977 - protein, 19 aa, Mycobacterium
VVISLPPPGPYFVDATTGM

SEQ ID NO: 1142978 - protein, 32 aa, Mycobacterium
VVKDLVFIGGLLILAVALIVYLVMGSEEVSDA

SEQ ID NO: 1142979 - protein, 22 aa, Mycobacterium
VVLAGVLVLVLRPRGNVIPRSA

SEQ ID NO: 1142980 - protein, 29 aa, Mycobacterium
VVLALIVCTVLWPPVRWLRGKGVPPAAAV

SEQ ID NO: 1142981 - protein, 18 aa, Mycobacterium
VVLALLFPQLETVVRQQS

SEQ ID NO: 1142982 - protein, 17 aa, Mycobacterium
VVLAVPVTVVLFQQSSR

SEQ ID NO: 1142983 - protein, 32 aa, Mycobacterium
VVLGIIWMGRRLVSPWWALGLGLILGGAMGNL

SEQ ID NO: 1142984 - protein, 19 aa, Mycobacterium
VVLLLLGPRLVDTYVNWLW

SEQ ID NO: 1142985 - protein, 24 aa, Mycobacterium
VVLPGLCITLVLLAATLAWPNVRK

SEQ ID NO: 1142986 - protein, 21 aa, Mycobacterium
VVLQLWNFLALVLDSLAIAAQ

SEQ ID NO: 1142987 - protein, 17 aa, Mycobacterium
VVLSLFGFDFDSVGRRQ

SEQ ID NO: 1142988 - protein, 32 aa, Mycobacterium
VVLSLIGFRVPWREQLFLSWAGLRGAVPIVLC

SEQ ID NO: 1142989 - protein, 18 aa, Mycobacterium
VVLVLVGIVLFAVGSVLF

SEQ ID NO: 1142990 - protein, 35 aa, Mycobacterium
VVLVTLSVLLRSLVAPLYLVGSVVVSYFAAIGIGV

SEQ ID NO: 1142991 - protein, 25 aa, Mycobacterium
VVMGLVFGYTWRRTGRLWPLIIAHG

SEQ ID NO: 1142992 - protein, 40 aa, Mycobacterium
VVNQGSVLGSLLIYMLPLLLLVALFVFFSRMQTGGRMGFG

SEQ ID NO: 1142993 - protein, 17 aa, Mycobacterium
VVNYLAFILALSTVLTG

SEQ ID NO: 1142994 - protein, 30 aa, Mycobacterium
VVPAPQLWPRTWALPLQVLAAIMIADLGIT

SEQ ID NO: 1142995 - protein, 23 aa, Mycobacterium
VVPFALELLALRRLTAAAFGTLM

SEQ ID NO: 1142996 - protein, 26 aa, Mycobacterium
VVPPYGRPPLAPPPAPPAPAPAPAEG

SEQ ID NO: 1142997 - protein, 18 aa, Mycobacterium
VVPTVALAVPWLTELQRL

SEQ ID NO: 1142998 - protein, 29 aa, Mycobacterium
VVRALYTWRWSLVTLWFTGVALLILERFW

SEQ ID NO: 1142999 - protein, 19 aa, Mycobacterium
VVRRRRVWVRLAPGAAGTV

SEQ ID NO: 1143000 - protein, 27 aa, Mycobacterium
VVSAGWYLLLVELWPKESRPYIGGSQT

SEQ ID NO: 1143001 - protein, 17 aa, Mycobacterium
VVSAIVLALWIPEREPA

SEQ ID NO: 1143002 - protein, 24 aa, Mycobacterium
VVSGVSIFKLVRYLAREYLLIVST

SEQ ID NO: 1143003 - protein, 17 aa, Mycobacterium
VVSVIPAHVFWLIERRD

SEQ ID NO: 1143004 - protein, 18 aa, Mycobacterium
VVSVWRRGIRLWVPALAV

SEQ ID NO: 1143005 - protein, 26 aa, Mycobacterium
VVTAALGWFLLSIPFVAAALLGAALC

SEQ ID NO: 1143006 - protein, 26 aa, Mycobacterium
VVTAERVRAPARWPRTPAADRAATAG

SEQ ID NO: 1143007 - protein, 25 aa, Mycobacterium
VVTAGLLCLLYWGRRLFAAPVPTFN

SEQ ID NO: 1143008 - protein, 29 aa, Mycobacterium
VVTALSTVAIVRFALRPLRRVAATAAEVA

SEQ ID NO: 1143009 - protein, 29 aa, Mycobacterium
VVTEEDLIGWLSSVFARADWAPEALVLVG

SEQ ID NO: 1143010 - protein, 23 aa, Mycobacterium
VVTILMGLVFIGLVPVLQRDTRF

SEQ ID NO: 1143011 - protein, 19 aa, Mycobacterium
VVTLLASFSPLCIVLAAVA

SEQ ID NO: 1143012 - protein, 33 aa, Mycobacterium
VVTLSMLVVVVLVAVFLGSKMWHSLFGGPGDDF

SEQ ID NO: 1143013 - protein, 18 aa, Mycobacterium
VVTPLIALLLVLGVYPKP

SEQ ID NO: 1143014 - protein, 30 aa, Mycobacterium
VVVAVVGTGLLWLLARRIGMTRPAAAAAVT

SEQ ID NO: 1143015 - protein, 19 aa, Mycobacterium
VVVHRRIALGAAGSVSLLA

SEQ ID NO: 1143016 - protein, 23 aa, Mycobacterium
VVVKVLLVAGLWAAGWGAARLAS

SEQ ID NO: 1143017 - protein, 18 aa, Mycobacterium
VVVLLFDAGIITPPVPRP

SEQ ID NO: 1143018 - protein, 22 aa, Mycobacterium
VVVMTLLGFALAWRDSWEYWTE

SEQ ID NO: 1143019 - protein, 21 aa, Mycobacterium
VVVPIVHFYGRRELAHIMATA

SEQ ID NO: 1143020 - protein, 18 aa, Mycobacterium
VVVPVAPWVFGAGATAYA

SEQ ID NO: 1143021 - protein, 29 aa, Mycobacterium
VVVTAILLSMYWPLGVVVLVSIVPITLTV

SEQ ID NO: 1143022 - protein, 18 aa, Mycobacterium
VVVVAVARWRGLRALVGI

SEQ ID NO: 1143023 - protein, 23 aa, Mycobacterium
VVVVLLRLLALSFTLTLLLSMAV

SEQ ID NO: 1143024 - protein, 26 aa, Mycobacterium
VVVVVATVIVWRFVGDALSGRSDVAA

SEQ ID NO: 1143025 - protein, 20 aa, Mycobacterium
VVVWGALPFHRAAWANARHR

SEQ ID NO: 1143026 - protein, 21 aa, Mycobacterium
VVVWGALPFHRAAWANARHRA

SEQ ID NO: 1143027 - protein, 19 aa, Mycobacterium
VVWALNHQGWHAAAAVPFW

SEQ ID NO: 1143028 - protein, 23 aa, Mycobacterium
VVWFWIPLGLLVLGTSSIPSVIG

SEQ ID NO: 1143029 - protein, 28 aa, Mycobacterium
VVYTGAVMMLFLFVLMLIGVDSSESLVE

SEQ ID NO: 1143030 - protein, 18 aa, Mycobacterium
VWAIALIGAFYLFTLVLG

SEQ ID NO: 1143031 - protein, 17 aa, Mycobacterium
VWCLLATSLSAPTVATA

SEQ ID NO: 1143032 - protein, 18 aa, Mycobacterium
VWDVFTDVERVAPCLPGA

SEQ ID NO: 1143033 - protein, 17 aa, Mycobacterium
VWFVFAAICTYVIGFRF

SEQ ID NO: 1143034 - protein, 25 aa, Mycobacterium
VWGAALTLILIIAALYIGAAFINRY

SEQ ID NO: 1143035 - protein, 19 aa, Mycobacterium
VWLSRRFIDDWLGDLAYYR

SEQ ID NO: 1143036 - protein, 17 aa, Mycobacterium
VWPLTRGAGQTVAVIDT

SEQ ID NO: 1143037 - protein, 22 aa, Mycobacterium
VWSPQFSLWLVPLAVLALPHRR

SEQ ID NO: 1143038 - protein, 19 aa, Mycobacterium
VWVADGDGPAWLTGGTYLV

SEQ ID NO: 1143039 - protein, 17 aa, Mycobacterium
VYAMPLLPAASIVLAAL

SEQ ID NO: 1143040 - protein, 17 aa, Mycobacterium
VYAWLMPASTVAQAIIG

SEQ ID NO: 1143041 - protein, 31 aa, Mycobacterium
VYDHYFTTFLNPLDLVWSFVQAIAMAVTVMV

SEQ ID NO: 1143042 - protein, 19 aa, Mycobacterium
VYKPYPYILAIVDELADLM

SEQ ID NO: 1143043 - protein, 29 aa, Mycobacterium
VYLALLAIELTWWPARRRELLLNSALAAA

SEQ ID NO: 1143044 - protein, 19 aa, Mycobacterium
VYLDNLAVAWMLAGLVLVC

SEQ ID NO: 1143045 - protein, 20 aa, Mycobacterium
VYLVWPAFYTDVTDSYRLGR

SEQ ID NO: 1143046 - protein, 23 aa, Mycobacterium
VYMSFFILPYVIAGVLWLRNREE

SEQ ID NO: 1143047 - protein, 27 aa, Mycobacterium
VYQIQRWRSRLRNHIIIVGYGTKGRTA

SEQ ID NO: 1143048 - protein, 20 aa, Mycobacterium
VYRANYFRSLLTKRTPRVVD

SEQ ID NO: 1143049 - protein, 49 aa, Mycobacterium
VYRYVLDGLKRPYRIRRLARALNQFARLSYMILLSVPLVAPVLVRAFIA

SEQ ID NO: 1143050 - protein, 24 aa, Mycobacterium
VYSTAAYWVAALVAVALSLCPKVG

SEQ ID NO: 1143051 - protein, 26 aa, Mycobacterium
VYSVGILVYELLTGRTPFTGDTALAV

SEQ ID NO: 1143052 - protein, 20 aa, Mycobacterium
VYSVLLAVLVGLGGLSAKLF

SEQ ID NO: 1143053 - protein, 17 aa, Mycobacterium
VYVKIFAGLLTAGALAI

SEQ ID NO: 1143054 - protein, 24 aa, Mycobacterium
WAADGLLAIFFLVVGLELKREFVA

SEQ ID NO: 1143055 - protein, 26 aa, Mycobacterium
WAAGISVLFPIVWIALASLKTPEQLN

SEQ ID NO: 1143056 - protein, 39 aa, Mycobacterium
WAALRALLFFTVVLGLAYPLLIWLIAQAPFLSDKADGSV

SEQ ID NO: 1143057 - protein, 17 aa, Mycobacterium
WAARNKRNQSRHDEAET

SEQ ID NO: 1143058 - protein, 26 aa, Mycobacterium
WAETTVIIRFWLLTAIACGLGVALFY

SEQ ID NO: 1143059 - protein, 24 aa, Mycobacterium
WAGEVPVLDPLPRWVRADVLSTGD

SEQ ID NO: 1143060 - protein, 19 aa, Mycobacterium
WAGVLVQVLPQRGALRAAG

SEQ ID NO: 1143061 - protein, 25 aa, Mycobacterium
WAGVRTIVTPAWFSDYVLTVGAVTP

SEQ ID NO: 1143062 - protein, 29 aa, Mycobacterium
WALIRLASPFILLAVWQLGSAVGLIPQDV

SEQ ID NO: 1143063 - protein, 19 aa, Mycobacterium
WALVLGFGLLGLLLASPRS

SEQ ID NO: 1143064 - protein, 25 aa, Mycobacterium
WAMEKEHILPFAVGKRLWEIVGLVA

SEQ ID NO: 1143065 - protein, 32 aa, Mycobacterium
WARQRSRRVLFFWVVAVITLAALAAAGAWTLG

SEQ ID NO: 1143066 - protein, 19 aa, Mycobacterium
WAYPLLLVLSGVALGVSGL

SEQ ID NO: 1143067 - protein, 23 aa, Mycobacterium
WDGRAGVLLLIETGGLLTAMTLA

SEQ ID NO: 1143068 - protein, 27 aa, Mycobacterium
WDQVRLVLGAFPYQLLLAAAAVRSVWR

SEQ ID NO: 1143069 - protein, 29 aa, Mycobacterium
WDSSVRWYAYFNPIFAVSLAILLFAGLSL

SEQ ID NO: 1143070 - protein, 25 aa, Mycobacterium
WEPHCYNIPLCWSFRSLFDSMDGIS

SEQ ID NO: 1143071 - protein, 18 aa, Mycobacterium
WERFSFYGMLTILGYYLY

SEQ ID NO: 1143072 - protein, 21 aa, Mycobacterium
WESKPWTWPMSLRPVLYAIDT

SEQ ID NO: 1143073 - protein, 17 aa, Mycobacterium
WFVTRWVVASALGGPVL

SEQ ID NO: 1143074 - protein, 28 aa, Mycobacterium
WGAAGSLLRLLALGLVMVPIIAAVMLTA

SEQ ID NO: 1143075 - protein, 29 aa, Mycobacterium
WGAGVGALLGLFAPPILASVVVGAAAAAI

SEQ ID NO: 1143076 - protein, 23 aa, Mycobacterium
WGGALMMLALLTGWLLIGAGARV

SEQ ID NO: 1143077 - protein, 31 aa, Mycobacterium
WGLGHEIAWPVPLLAFIILVAVGADYNMLLV

SEQ ID NO: 1143078 - protein, 17 aa, Mycobacterium
WGPLALLGSWPVGVRLL

SEQ ID NO: 1143079 - protein, 18 aa, Mycobacterium
WGVKAAMAVVLVVLGMCI

SEQ ID NO: 1143080 - protein, 24 aa, Mycobacterium
WGVPEPRWAASWLGLQRAAHLLVG

SEQ ID NO: 1143081 - protein, 18 aa, Mycobacterium
WGWHGAGWMLTKLGFHDV

SEQ ID NO: 1143082 - protein, 23 aa, Mycobacterium
WHALWAMMVGFFMILVDATIVAV

SEQ ID NO: 1143083 - protein, 24 aa, Mycobacterium
WHALWAMMVGFFMILVDATIVAVA

SEQ ID NO: 1143084 - protein, 19 aa, Mycobacterium
WIALYLAHVHPTLAGVAVA

SEQ ID NO: 1143085 - protein, 26 aa, Mycobacterium
WIPAPLVLLAFAFRTMPRFVWRRLPR

SEQ ID NO: 1143086 - protein, 19 aa, Mycobacterium
WKLLARFGYHFSSLVAIVV

SEQ ID NO: 1143087 - protein, 28 aa, Mycobacterium
WKPTLAWRLFQLLTFAALAAAAWRLLGH

SEQ ID NO: 1143088 - protein, 20 aa, Mycobacterium
WKTTPFISLLLLAGLVQVPE

SEQ ID NO: 1143089 - protein, 22 aa, Mycobacterium
WLAFELALFRDASFKEAWSYVI

SEQ ID NO: 1143090 - protein, 19 aa, Mycobacterium
WLAHVWWKVPPDFGEARRT

SEQ ID NO: 1143091 - protein, 19 aa, Mycobacterium
WLARWLLFRVEFGAGLIKM

SEQ ID NO: 1143092 - protein, 18 aa, Mycobacterium
WLAVAAATFAIAWGGNEF

SEQ ID NO: 1143093 - protein, 18 aa, Mycobacterium
WLAYLLFGGLVLIIFRIA

SEQ ID NO: 1143094 - protein, 24 aa, Mycobacterium
WLEYLGYALIVPFAAWAIGLLQYI

SEQ ID NO: 1143095 - protein, 20 aa, Mycobacterium
WLFASFAVLAVLATVASTRS

SEQ ID NO: 1143096 - protein, 26 aa, Mycobacterium
WLIVVRGMLLLFIPDSFMSLADNMIG

SEQ ID NO: 1143097 - protein, 19 aa, Mycobacterium
WLKLPTFDWPTDPAWLYRL

SEQ ID NO: 1143098 - protein, 20 aa, Mycobacterium
WLLGSVVFIVASWPVASKSA

SEQ ID NO: 1143099 - protein, 17 aa, Mycobacterium
WLLTGRSPRSGAVLWLP

SEQ ID NO: 1143100 - protein, 18 aa, Mycobacterium
WLMFNERPTFGFGPATFP

SEQ ID NO: 1143101 - protein, 18 aa, Mycobacterium
WLTNLCVQALLLWTLANE

SEQ ID NO: 1143102 - protein, 22 aa, Mycobacterium
WLVFGGLWLALGYLLAAIICFV

SEQ ID NO: 1143103 - protein, 17 aa, Mycobacterium
WLVYAMIGVVVIATLSH

SEQ ID NO: 1143104 - protein, 17 aa, Mycobacterium
WNMIGPLSTTYAGDMSL

SEQ ID NO: 1143105 - protein, 19 aa, Mycobacterium
WPHNWPFVAQVLAAILIAD

SEQ ID NO: 1143106 - protein, 25 aa, Mycobacterium
WPLFAGFCVYAYFKFVRYEEAPPEP

SEQ ID NO: 1143107 - protein, 18 aa, Mycobacterium
WPTIPTLIMFPILACIYA

SEQ ID NO: 1143108 - protein, 25 aa, Mycobacterium
WPVFGYLNLTMWLIPGMFGVAYRRG

SEQ ID NO: 1143109 - protein, 28 aa, Mycobacterium
WQHTTGAWLFDMGMLLAISVGYLAFVRW

SEQ ID NO: 1143110 - protein, 18 aa, Mycobacterium
WQLFVMYGATEATARMAY

SEQ ID NO: 1143111 - protein, 17 aa, Mycobacterium
WQPVAWLAYPAAYLALA

SEQ ID NO: 1143112 - protein, 19 aa, Mycobacterium
WQRPDQFDWFSAYLRDRGL

SEQ ID NO: 1143113 - protein, 22 aa, Mycobacterium
WQRWYPLTMLITGAVLITLSSQ

SEQ ID NO: 1143114 - protein, 20 aa, Mycobacterium
WQVVAAVLVATVFGLAWTQA

SEQ ID NO: 1143115 - protein, 22 aa, Mycobacterium
WQWDPYPFILLNLAFSTQAAYA

SEQ ID NO: 1143116 - protein, 32 aa, Mycobacterium
WRIGFLRSRGLLPVLRWLIAGIGATMGVLSAV

SEQ ID NO: 1143117 - protein, 18 aa, Mycobacterium
WRPNPGIGFPAWANYLPT

SEQ ID NO: 1143118 - protein, 25 aa, Mycobacterium
WRQGRLARNWSFHLGLLSLGWGVFN

SEQ ID NO: 1143119 - protein, 17 aa, Mycobacterium
WRRFNTRGALWSMYGGL

SEQ ID NO: 1143120 - protein, 24 aa, Mycobacterium
WRSVFWINLPICAAAILLTAIFVP

SEQ ID NO: 1143121 - protein, 28 aa, Mycobacterium
WRTRRWRLVWIPWAVVVGGAFAVAAYEF

SEQ ID NO: 1143122 - protein, 19 aa, Mycobacterium
WRWFYRHLFDLAIVVLPLL

SEQ ID NO: 1143123 - protein, 24 aa, Mycobacterium
WSAATFITLALFLGIGTGGVFAWV

SEQ ID NO: 1143124 - protein, 22 aa, Mycobacterium
WSGLYFVMFFGVMTVAFDIAAR

SEQ ID NO: 1143125 - protein, 29 aa, Mycobacterium
WSGVTAVAIPAWWQQYVLSVGSLAPDGTP

SEQ ID NO: 1143126 - protein, 21 aa, Mycobacterium
WSLLVGYGCLPWVATAVLRLR

SEQ ID NO: 1143127 - protein, 17 aa, Mycobacterium
WSPKFLKQGKVTDLPFS

SEQ ID NO: 1143128 - protein, 25 aa, Mycobacterium
WSPMGRDMFGFTLPAPFGLRDDVFT

SEQ ID NO: 1143129 - protein, 24 aa, Mycobacterium
WSRSIPRVMLLSALIGSAAVYLGL

SEQ ID NO: 1143130 - protein, 26 aa, Mycobacterium
WSSPFWQTWDLLLLWLAQLHGGNGMR

SEQ ID NO: 1143131 - protein, 26 aa, Mycobacterium
WSVVPLMFVAIFIRTWHSATTARVVV

SEQ ID NO: 1143132 - protein, 17 aa, Mycobacterium
WTDPLVLALFGGGTLAT

SEQ ID NO: 1143133 - protein, 27 aa, Mycobacterium
WTGVVVVLALWVLAVRALLRIDAVSGP

SEQ ID NO: 1143134 - protein, 28 aa, Mycobacterium
WTHHWVWVLPLMIWLWHGPLRRRAGARA

SEQ ID NO: 1143135 - protein, 17 aa, Mycobacterium
WTTFSSADFWVTVVGAP

SEQ ID NO: 1143136 - protein, 21 aa, Mycobacterium
WVAHFNIAIAALLIPGAFSIL

SEQ ID NO: 1143137 - protein, 17 aa, Mycobacterium
WVAHFNLLVAAALAPAA

SEQ ID NO: 1143138 - protein, 21 aa, Mycobacterium
WVALVPLIYFATEWVVSASWR

SEQ ID NO: 1143139 - protein, 18 aa, Mycobacterium
WVARATGMKVRRYFVGFG

SEQ ID NO: 1143140 - protein, 34 aa, Mycobacterium
WVDDYIFNFPDTSFAWAFVLALLAAALAARKRIA

SEQ ID NO: 1143141 - protein, 17 aa, Mycobacterium
WVDPLRLAQVIGNLLDN

SEQ ID NO: 1143142 - protein, 17 aa, Mycobacterium
WVFGPWPTERQSVAFAV

SEQ ID NO: 1143143 - protein, 31 aa, Mycobacterium
WVGASILYPSLLLLPLVATTLAIVLGVGAYL

SEQ ID NO: 1143144 - protein, 19 aa, Mycobacterium
WVGLLLGMYFKYLGSPRTE

SEQ ID NO: 1143145 - protein, 17 aa, Mycobacterium
WVPVILNAASSPAVVLQ

SEQ ID NO: 1143146 - protein, 17 aa, Mycobacterium
WVVAAGFAVYFARTPLE

SEQ ID NO: 1143147 - protein, 25 aa, Mycobacterium
WVVGKAWVILLPVVLALIVCTVLWP

SEQ ID NO: 1143148 - protein, 18 aa, Mycobacterium
WVVLFHFRPLLAEAAPGF

SEQ ID NO: 1143149 - protein, 29 aa, Mycobacterium
WVVRHRPAARPLLILAAAAVLFPAVMATG

SEQ ID NO: 1143150 - protein, 26 aa, Mycobacterium
WVVVNLPIMVLFPRGWSEFFRLNTRR

SEQ ID NO: 1143151 - protein, 22 aa, Mycobacterium
WWFWIGFALVTLVVAGGVSYLA

SEQ ID NO: 1143152 - protein, 19 aa, Mycobacterium
WWQILTSAFMRNALVGGTI

SEQ ID NO: 1143153 - protein, 18 aa, Mycobacterium
WWSHAHHYEWMSDYLVAR

SEQ ID NO: 1143154 - protein, 26 aa, Mycobacterium
WWTENLRYYYLVLPTTDGAIARRVAF

SEQ ID NO: 1143155 - protein, 17 aa, Mycobacterium
WYRDAKLYTIFEGTSEI

SEQ ID NO: 1143156 - protein, 17 aa, Mycobacterium
WYTVSAVIILVSLGAML

SEQ ID NO: 1143157 - protein, 17 aa, Mycobacterium
WYYAWTPGTGYLANLLP

SEQ ID NO: 1143158 - protein, 17 aa, Mycobacterium
WYYNLLALMTQVSTASI

SEQ ID NO: 1143159 - protein, 29 aa, Mycobacterium
YAAIIAVLLPPVFVLAWSGLKGRTRPGEP

SEQ ID NO: 1143160 - protein, 28 aa, Mycobacterium
YAAVAWFLRFLVRHSMYWFVGYRIVLGT

SEQ ID NO: 1143161 - protein, 18 aa, Mycobacterium
YACDLNIQGFFPGLNDVV

SEQ ID NO: 1143162 - protein, 25 aa, Mycobacterium
YAEGLRALYLFTAVHQDAVPQLARS

SEQ ID NO: 1143163 - protein, 35 aa, Mycobacterium
YAEPERGGSLGRWLIAVAILAVLTVVVTIGINMFG

SEQ ID NO: 1143164 - protein, 31 aa, Mycobacterium
YAFGKIPVKQRPVLYLALEDGHRRLQDRFRT

SEQ ID NO: 1143165 - protein, 18 aa, Mycobacterium
YAGIVLIGLGASGLTLAT

SEQ ID NO: 1143166 - protein, 24 aa, Mycobacterium
YAGSALPLLLLFSVANRSLGDVLT

SEQ ID NO: 1143167 - protein, 26 aa, Mycobacterium
YAIPPLLILAPLWLIPAPIYMRLEMT

SEQ ID NO: 1143168 - protein, 19 aa, Mycobacterium
YAIVAIPLGWMFWQDKRTI

SEQ ID NO: 1143169 - protein, 20 aa, Mycobacterium
YALALVLVAWGFDLMARRAS

SEQ ID NO: 1143170 - protein, 24 aa, Mycobacterium
YALEHCYAYSDSITDLPMLATVGH

SEQ ID NO: 1143171 - protein, 26 aa, Mycobacterium
YAQWTAFFAVWAWFCEATGLPAITAA

SEQ ID NO: 1143172 - protein, 21 aa, Mycobacterium
YAVLILVLRMSGKRTLAKLNA

SEQ ID NO: 1143173 - protein, 19 aa, Mycobacterium
YAWPYRRLLSVVAALQVIS

SEQ ID NO: 1143174 - protein, 18 aa, Mycobacterium
YCLSFARMPYFQSMGVPC

SEQ ID NO: 1143175 - protein, 17 aa, Mycobacterium
YDDFQKRAEPFLQVVKE

SEQ ID NO: 1143176 - protein, 18 aa, Mycobacterium
YDHPYRPDFPGLDSFSGT

SEQ ID NO: 1143177 - protein, 32 aa, Mycobacterium
YDHYFNTFLNPTDLVWSFLQSVAITVVVMLVH

SEQ ID NO: 1143178 - protein, 25 aa, Mycobacterium
YDLLHGWWGLLIAVVLGLAGGIGQL

SEQ ID NO: 1143179 - protein, 25 aa, Mycobacterium
YDNIRKFILFMLPTNGGEALVVMAA

SEQ ID NO: 1143180 - protein, 49 aa, Mycobacterium
YDQPPPGEPQPWYRKPGALIALGAIAALLVAVIVWLVVQLVSGDDSGES

SEQ ID NO: 1143181 - protein, 26 aa, Mycobacterium
YDTWLGLIIPYLTFALPLSIWTMSAF

SEQ ID NO: 1143182 - protein, 21 aa, Mycobacterium
YEKPNPHIPFDNLRLKVIAEH

SEQ ID NO: 1143183 - protein, 19 aa, Mycobacterium
YELFLLHVLVMAVLIHALD

SEQ ID NO: 1143184 - protein, 23 aa, Mycobacterium
YEPGRPYRKNYLLLAGGLVMMAA

SEQ ID NO: 1143185 - protein, 25 aa, Mycobacterium
YERIDLTIPVLIGAAVLVLTVAVLL

SEQ ID NO: 1143186 - protein, 26 aa, Mycobacterium
YETRTEYILPGYAIPVALAACVVVSV

SEQ ID NO: 1143187 - protein, 17 aa, Mycobacterium
YFEARAKRRAGAALRAL

SEQ ID NO: 1143188 - protein, 19 aa, Mycobacterium
YFFCWAAIYQLGIAWHGAL

SEQ ID NO: 1143189 - protein, 18 aa, Mycobacterium
YFGFLISIAFLVSYIFTN

SEQ ID NO: 1143190 - protein, 19 aa, Mycobacterium
YFGPDGAGLIAAFRIWEGG

SEQ ID NO: 1143191 - protein, 25 aa, Mycobacterium
YFGTYVFWMMPVFGLAIALAVDSRR

SEQ ID NO: 1143192 - protein, 19 aa, Mycobacterium
YFQIPLMVIVFVPALEGLR

SEQ ID NO: 1143193 - protein, 18 aa, Mycobacterium
YFTYQDLARFALAQAKFQ

SEQ ID NO: 1143194 - protein, 18 aa, Mycobacterium
YFVDSAGSLFWISDTGVR

SEQ ID NO: 1143195 - protein, 46 aa, Mycobacterium
YGDHLPFIYPPFAALLFYPLHFLPFPVVAWIWQLAVVAGLYGLVRI

SEQ ID NO: 1143196 - protein, 24 aa, Mycobacterium
YGDWPSFFALMAWFSSVSGVDSLT

SEQ ID NO: 1143197 - protein, 23 aa, Mycobacterium
YGFSMALMVRAGLGLDPWDVFHQ

SEQ ID NO: 1143198 - protein, 17 aa, Mycobacterium
YGFYGLCAVLSGLFVWR

SEQ ID NO: 1143199 - protein, 22 aa, Mycobacterium
YGGVLMFGMLTSFAGLGMFNPL

SEQ ID NO: 1143200 - protein, 37 aa, Mycobacterium
YGGVLMFGMLTSFAGLGMFNPLSLGAGFVLGRKAYKE

SEQ ID NO: 1143201 - protein, 17 aa, Mycobacterium
YGILRMSSDQKWRPYYL

SEQ ID NO: 1143202 - protein, 29 aa, Mycobacterium
YGISLVWLFGHWQSVFWVNVPLAVIAMVM

SEQ ID NO: 1143203 - protein, 33 aa, Mycobacterium
YGLLFGVAFYVPLLPWISGLVGAVPWLALSFAE

SEQ ID NO: 1143204 - protein, 30 aa, Mycobacterium
YGNYIPALIVIALLMIALNFTLSWLATRLE

SEQ ID NO: 1143205 - protein, 23 aa, Mycobacterium
YGPYVLRIWNYPLVIGVLEGTQV

SEQ ID NO: 1143206 - protein, 37 aa, Mycobacterium
YGRIKRQQLFLSSLLRSLISKETFFSLSKLNNVVNMF

SEQ ID NO: 1143207 - protein, 26 aa, Mycobacterium
YGTAAVYYWVICLVLSFGQARFERRL

SEQ ID NO: 1143208 - protein, 19 aa, Mycobacterium
YGTNLVNLLKLLTPEKDGQ

SEQ ID NO: 1143209 - protein, 25 aa, Mycobacterium
YGVTSVLLGALPLAALAAGLAVIGW

SEQ ID NO: 1143210 - protein, 19 aa, Mycobacterium
YGWQYWVPAGAVAFGLIVL

SEQ ID NO: 1143211 - protein, 34 aa, Mycobacterium; identical to SEQ ID NO: 375485

SEQ ID NO: 1143212 - protein, 26 aa, Mycobacterium
YHASVEQLLVLLPQSVSVLNSALVPN

SEQ ID NO: 1143213 - protein, 20 aa, Mycobacterium
YIENWSVLLDWKILAMTVGA

SEQ ID NO: 1143214 - protein, 17 aa, Mycobacterium
YIVLERLPGQSLADVLA

SEQ ID NO: 1143215 - protein, 28 aa, Mycobacterium
YKKDRYSGWLGGWRWAKDKLFGMPDKVN

SEQ ID NO: 1143216 - protein, 17 aa, Mycobacterium
YLAIMLFALVAVTAVLG

SEQ ID NO: 1143217 - protein, 17 aa, Mycobacterium
YLALHHGKQPLIILDTL

SEQ ID NO: 1143218 - protein, 20 aa, Mycobacterium
YLALPLLALLARRLPVRARI

SEQ ID NO: 1143219 - protein, 25 aa, Mycobacterium
YLAMVVIVLTVWLAVGLTAGSWYFW

SEQ ID NO: 1143220 - protein, 35 aa, Mycobacterium
YLANFNQPYLLWAPAVLLIGLAIMVRLLCGRPAGV

SEQ ID NO: 1143221 - protein, 23 aa, Mycobacterium
YLAYLAVVLALFLRPAQAPKSKT

SEQ ID NO: 1143222 - protein, 17 aa, Mycobacterium
YLGFPDSAAARGITQDR

SEQ ID NO: 1143223 - protein, 31 aa, Mycobacterium
YLGWWTAILLVVIVALMLLSAGLFKGSFRSF

SEQ ID NO: 1143224 - protein, 28 aa, Mycobacterium
YLINGILHLLIAYIIFRIAIGSGHNDAD

SEQ ID NO: 1143225 - protein, 20 aa, Mycobacterium
YLLAGGVALLGVWFYRAGSG

SEQ ID NO: 1143226 - protein, 26 aa, Mycobacterium
YLLAMASVLALVLFLGHLVRQIRIET

SEQ ID NO: 1143227 - protein, 18 aa, Mycobacterium
YLLGTVVLNYAAALGIGV

SEQ ID NO: 1143228 - protein, 22 aa, Mycobacterium
YLRFVLSRITLPGSIYLGIIAV

SEQ ID NO: 1143229 - protein, 17 aa, Mycobacterium
YLRMIYDILATALALAL

SEQ ID NO: 1143230 - protein, 30 aa, Mycobacterium
YLTHPRWGRPLLVLGVLHTLALLATVTAPT

SEQ ID NO: 1143231 - protein, 26 aa, Mycobacterium
YLVARRIRMLIEQWDRTTLLEQERVI

SEQ ID NO: 1143232 - protein, 22 aa, Mycobacterium
YLYVHLVSVLAIVDIAFLFAAG

SEQ ID NO: 1143233 - protein, 18 aa, Mycobacterium
YMLYNFGVALYVGVLQTV

SEQ ID NO: 1143234 - protein, 29 aa, Mycobacterium
YMSSPPPDQWPAPPPPPTGPPQGATQWGP

SEQ ID NO: 1143235 - protein, 23 aa, Mycobacterium
YNAPLLTLSLLLATAAGVLTVLG

SEQ ID NO: 1143236 - protein, 24 aa, Mycobacterium
YNLFPLSMLLMVVLLGTLIVIYRV

SEQ ID NO: 1143237 - protein, 20 aa, Mycobacterium
YNLHLNLWVGALLALILSLT

SEQ ID NO: 1143238 - protein, 19 aa, Mycobacterium
YNLVVLWALDHVAAIRRIP

SEQ ID NO: 1143239 - protein, 32 aa, Mycobacterium
YNMPLELVLTVIPFLIISVLFYFTVVVQEQMV

SEQ ID NO: 1143240 - protein, 26 aa, Mycobacterium
YNQRRLTDPSLPPVPVLWVIADEYQE

SEQ ID NO: 1143241 - protein, 33 aa, Mycobacterium
YNVIALPIAAGVFEPAFGLILRPEIAALSMSGS

SEQ ID NO: 1143242 - protein, 22 aa, Mycobacterium
YNVIALPIAAGVFQPAFGLVLR

SEQ ID NO: 1143243 - protein, 25 aa, Mycobacterium
YPGAPPYGAPLYGPGGVPLFPGVAP

SEQ ID NO: 1143244 - protein, 17 aa, Mycobacterium
YPGPGWAIVFVGLAILA

SEQ ID NO: 1143245 - protein, 25 aa, Mycobacterium
YPGPLPRTTVFFSPGNEEAAATVAS

SEQ ID NO: 1143246 - protein, 26 aa, Mycobacterium
YPGRSAPPVRLLPTDLSPSAFPTLYP

SEQ ID NO: 1143247 - protein, 23 aa, Mycobacterium
YPPEGGFPDRGTLEWDYGPSERY

SEQ ID NO: 1143248 - protein, 22 aa, Mycobacterium
YPTSMRLVVVPQGVRRVLPALM

SEQ ID NO: 1143249 - protein, 24 aa, Mycobacterium
YPVAFAVCALFPLLAIPSVPLTVK

SEQ ID NO: 1143250 - protein, 25 aa, Mycobacterium
YPVTTIFLVLAIACGLLAGWLHFRM

SEQ ID NO: 1143251 - protein, 23 aa, Mycobacterium
YQFLGFWAIHLLVVWAAIYLTWG

SEQ ID NO: 1143252 - protein, 24 aa, Mycobacterium
YQIFRMGYYGLLFPGTALAKDATG

SEQ ID NO: 1143253 - protein, 23 aa, Mycobacterium
YQREPLLILAYTVLFVPMAIGSI

SEQ ID NO: 1143254 - protein, 20 aa, Mycobacterium
YQSMLSEWLVDPTDLGKSTD

SEQ ID NO: 1143255 - protein, 31 aa, Mycobacterium
YQVDDLLACLYGLYALLRLHFVQEEENYFTL

SEQ ID NO: 1143256 - protein, 22 aa, Mycobacterium
YRFYQIGGLLAAGFLLLMTHGN

SEQ ID NO: 1143257 - protein, 26 aa, Mycobacterium
YRGSSLVRAGFIGAVLIALVIVVGLQ

SEQ ID NO: 1143258 - protein, 21 aa, Mycobacterium
YRLRLGKPSWVTPGPLADDIE

SEQ ID NO: 1143259 - protein, 33 aa, Mycobacterium
YRPNLFVTYWAFRAMIGLLLVPVAFALVTVWLT

SEQ ID NO: 1143260 - protein, 18 aa, Mycobacterium
YRRRRISLSAPDTATPVD

SEQ ID NO: 1143261 - protein, 18 aa, Mycobacterium
YRTRELLPWGNLRRLLRT

SEQ ID NO: 1143262 - protein, 22 aa, Mycobacterium
YRVERVLAVTAMATVYLVHSPT

SEQ ID NO: 1143263 - protein, 26 aa, Mycobacterium
YSDSLGLVFLYAAPVALLGFLVALTL

SEQ ID NO: 1143264 - protein, 31 aa, Mycobacterium
YSIGMVLATIALFTIPLVLGADLQPTLLRAM

SEQ ID NO: 1143265 - protein, 24 aa, Mycobacterium
YSNTGPLWLIVFITVINGVAEEMF

SEQ ID NO: 1143266 - protein, 17 aa, Mycobacterium
YSPYLVFFAVDISVSPA

SEQ ID NO: 1143267 - protein, 27 aa, Mycobacterium
YSQQQPYDWRYAAQPQQQFRAPYDPYR

SEQ ID NO: 1143268 - protein, 23 aa, Mycobacterium
YSVLKTVIFVWIASTIQCYYGFY

SEQ ID NO: 1143269 - protein, 25 aa, Mycobacterium
YTAGFVALLGWLLGGTFSAGVGLWT

SEQ ID NO: 1143270 - protein, 19 aa, Mycobacterium
YTAPLREDLLRALSLSVPP

SEQ ID NO: 1143271 - protein, 22 aa, Mycobacterium
YTLALACLLLPAGALGDRHGRR

SEQ ID NO: 1143272 - protein, 19 aa, Mycobacterium
YTMVSVGLAVLWMAALSIN

SEQ ID NO: 1143273 - protein, 35 aa, Mycobacterium
YTRRGLAATGWPPVRWIPKIRPDPLRRLGLDAPDT

SEQ ID NO: 1143274 - protein, 23 aa, Mycobacterium
YTSALPLIIVLLGVFLLARLTGD

SEQ ID NO: 1143275 - protein, 28 aa, Mycobacterium
YTTRPGSALLFPTLCTPTAEAPIQPTET

SEQ ID NO: 1143276 - protein, 28 aa, Mycobacterium
YTYWYDHPPAGWLQLAGWMLLTGPGFGG

SEQ ID NO: 1143277 - protein, 20 aa, Mycobacterium
YVAAFTLLWASLRQGMPLGI

SEQ ID NO: 1143278 - protein, 17 aa, Mycobacterium
YVAAVLAIGPKLLVHIT

SEQ ID NO: 1143279 - protein, 24 aa, Mycobacterium
YVAGLAVSWLLQRLGRRSAVMHDV

SEQ ID NO: 1143280 - protein, 24 aa, Mycobacterium
YVASFVFLALVLKRGMGLGVAYGI

SEQ ID NO: 1143281 - protein, 23 aa, Mycobacterium
YVAWVVCYDIPWTYRLWRLNAEA

SEQ ID NO: 1143282 - protein, 25 aa, Mycobacterium
YVDWRAVFWINVPICALAVLLTAIF

SEQ ID NO: 1143283 - protein, 18 aa, Mycobacterium
YVFRRPFQWREFLEQSWF

SEQ ID NO: 1143284 - protein, 30 aa, Mycobacterium
YVGDLSYALYLVHWPVIVLLAALMDRGPYF

SEQ ID NO: 1143285 - protein, 27 aa, Mycobacterium
YVGSLANLLWRSVVRRDMRVGFAEFSR

SEQ ID NO: 1143286 - protein, 23 aa, Mycobacterium
YVIALPFFGIISEVIPVFSRKPI

SEQ ID NO: 1143287 - protein, 26 aa, Mycobacterium
YVLALTVLIGALLLAPPAAAQPDADP

SEQ ID NO: 1143288 - protein, 19 aa, Mycobacterium
YVLITFWQFRNACATSPGV

SEQ ID NO: 1143289 - protein, 18 aa, Mycobacterium
YVLTYYWGLVLSSQALLT

SEQ ID NO: 1143290 - protein, 17 aa, Mycobacterium
YVPLWARRVARVAATVL

SEQ ID NO: 1143291 - protein, 20 aa, Mycobacterium
YVVMFLLCGYLISEAGWGAI

SEQ ID NO: 1143292 - protein, 26 aa, Mycobacterium
YVWVPDATGSLFFLISGALAMMAVTA

SEQ ID NO: 1143293 - protein, 17 aa, Mycobacterium
YVWWALLVIAAAGTLSA

SEQ ID NO: 1143294 - protein, 24 aa, Mycobacterium
YWAFRAMIGLLLVPVAFALLSLWL

SEQ ID NO: 1143295 - protein, 19 aa, Mycobacterium
YWHTVDFLWVLIFASLYVV

SEQ ID NO: 1143296 - protein, 26 aa, Mycobacterium
YWSVVPPLLLAYWWTQTPDADTVRVA

SEQ ID NO: 1143297 - protein, 25 aa, Mycobacterium
YWVARGWILLVRAVPELILAVVFVA

SEQ ID NO: 1143298 - protein, 27 aa, Mycobacterium
YYPPPRRTNWWAVVSLIFGVIGGVLIS

SEQ ID NO: 1143299 - protein, 19 aa, Mycobacterium
YYRYCTYLYIPFQYASVIM

SEQ ID NO: 1143300 - protein, 24 aa, Mycobacterium
YYVVFTFLPTYFIKTLRFSKSEAF

SEQ ID NO: 1143301 - protein, 17 aa, Mycobacterium
AVLVYFPVAHWVFAFDG

SEQ ID NO: 1143302 - protein, 21 aa, Mycobacterium
GACIGFLWWNAAPAKIFMGDT

SEQ ID NO: 1143303 - protein, 23 aa, Mycobacterium
GLTWIRFLIWMAIGVVVYFLYGR

SEQ ID NO: 1143304 - protein, 27 aa, Mycobacterium
TRVGFLLLLWLFIWSVLRILRTDIYAP

SEQ ID NO: 1143305 - protein, 26 aa, Mycobacterium
TSMGTALVLLFLLALAAIPGALLPQR

SEQ ID NO: 1143306 - protein, 23 aa, Mycobacterium
VGRKPLWWFSLIGLFVAGVPMFL

SEQ ID NO: 1143307 - protein, 22 aa, Mycobacterium
VPAPTVIIVGLPAGLRLAVDNA

SEQ ID NO: 1143308 - protein, 23 aa, Mycobacterium
AAAAVLFLLIPPLAVVSQKNPPE

SEQ ID NO: 1143309 - protein, 25 aa, Mycobacterium
AAGMLLLVPLFMHLPRRPRPAGPVE

SEQ ID NO: 1143310 - protein, 25 aa, Mycobacterium
AALSLIVPLLFMPLTIVAAGMSLAA

SEQ ID NO: 1143311 - protein, 21 aa, Mycobacterium
AAWLRLAWAGLLFLVFLRPRR

SEQ ID NO: 1143312 - protein, 22 aa, Mycobacterium
AAYLVAPWAWWLCGAVGAVTVL

SEQ ID NO: 1143313 - protein, 45 aa, Mycobacterium
ACHRPNRLWWRFTAWWFGCAALAVLWWVVPLLLLGRISPPFLDFI

SEQ ID NO: 1143314 - protein, 21 aa, Mycobacterium
ADEIPPFAPFLAAGPPAAPDP

SEQ ID NO: 1143315 - protein, 23 aa, Mycobacterium
ADISWLLPLIYVLLAMSLVMWSG

SEQ ID NO: 1143316 - protein, 39 aa, Mycobacterium
AEDDGEWLSWRWNWWWLLALIPVLLVVGLIVGAALWRRR

SEQ ID NO: 1143317 - protein, 19 aa, Mycobacterium
AEPILPMRLFASPVFTVCC

SEQ ID NO: 1143318 - protein, 18 aa, Mycobacterium
AFFLLLDEPEVYGLPPDP

SEQ ID NO: 1143319 - protein, 22 aa, Mycobacterium
AFTLIPYALVLLQLRVFYAREQ

SEQ ID NO: 1143320 - protein, 20 aa, Mycobacterium
AGMFLAFWLPLNNGLRPEPI

SEQ ID NO: 1143321 - protein, 24 aa, Mycobacterium
AGRLWFVEVLVWTLVALAVLMAVP

SEQ ID NO: 1143322 - protein, 27 aa, Mycobacterium
AHWDFYMGLAYFKLAIIAAGIAFRARM

SEQ ID NO: 1143323 - protein, 32 aa, Mycobacterium
AIAGLLYIGLALGWPLWWVSVCSVLCLLIVQG

SEQ ID NO: 1143324 - protein, 23 aa, Mycobacterium
ALAYVVIFSIPWAQELFILDPTN

SEQ ID NO: 1143325 - protein, 23 aa, Mycobacterium
ALGLYLVAALLVWIQARLLNVVV

SEQ ID NO: 1143326 - protein, 21 aa, Mycobacterium
ALIFIIMLLITRSVVASAVIV

SEQ ID NO: 1143327 - protein, 24 aa, Mycobacterium
ALNVIFWFTLFVWVLGRPDAIGPL

SEQ ID NO: 1143328 - protein, 26 aa, Mycobacterium
ALRYAMFIILLMVIFYFSYRSARFST

SEQ ID NO: 1143329 - protein, 25 aa, Mycobacterium
ALSLIFIIMLILTRALVAAAVIVGT

SEQ ID NO: 1143330 - protein, 17 aa, Mycobacterium
ALYLLFDLPLLIGGVIT

SEQ ID NO: 1143331 - protein, 18 aa, Mycobacterium
ANYWIVSHLLPIFRRMQQ

SEQ ID NO: 1143332 - protein, 26 aa, Mycobacterium
APCKAWLLAHPLLLGVVLLVLFAATD

SEQ ID NO: 1143333 - protein, 22 aa, Mycobacterium
APLLVVAWLWLTTRRRPSNRTL

SEQ ID NO: 1143334 - protein, 28 aa, Mycobacterium
APRQIAWGGLLFALGVIVLAVFVLWVWA

SEQ ID NO: 1143335 - protein, 24 aa, Mycobacterium
AQFRRLFWVNLVIAIPVVAFSTMF

SEQ ID NO: 1143336 - protein, 19 aa, Mycobacterium
AQLLQPFLDYAFGFRRGMD

SEQ ID NO: 1143337 - protein, 24 aa, Mycobacterium
ARFLDALFPVWRYHPFFTDSDEPV

SEQ ID NO: 1143338 - protein, 19 aa, Mycobacterium
ARNHRWFLVAVYGAARTGA

SEQ ID NO: 1143339 - protein, 24 aa, Mycobacterium
ARTELYWLLCLLAAGLLLGEIWLS

SEQ ID NO: 1143340 - protein, 21 aa, Mycobacterium
ASGFLLILLGLWGALIPFLGP

SEQ ID NO: 1143341 - protein, 25 aa, Mycobacterium
ASIGWALYALIVLSLLQAGSAVAAL

SEQ ID NO: 1143342 - protein, 26 aa, Mycobacterium
ATGPDPMLEWMFWTGLLVTAADVLIA

SEQ ID NO: 1143343 - protein, 22 aa, Mycobacterium
ATTALFQWGWFQQLIGLSATGP

SEQ ID NO: 1143344 - protein, 18 aa, Mycobacterium
AVIGLLGLLVCFALAVLL

SEQ ID NO: 1143345 - protein, 25 aa, Mycobacterium
AVKALLTFQPWWTAMRSGSRTAPSA

SEQ ID NO: 1143346 - protein, 17 aa, Mycobacterium
AVLPMFLPAVVALIAEN

SEQ ID NO: 1143347 - protein, 22 aa, Mycobacterium
AVPFAIWFFLAIEGVPLAAEEA

SEQ ID NO: 1143348 - protein, 20 aa, Mycobacterium
AVPIILVWIAIVAVLNVIVP

SEQ ID NO: 1143349 - protein, 21 aa, Mycobacterium
AWFLRFLVRHGMYWFVGYRVV

SEQ ID NO: 1143350 - protein, 18 aa, Mycobacterium
AWGALGVYLLWRSGFRLP

SEQ ID NO: 1143351 - protein, 22 aa, Mycobacterium
AWSWRLLIIFGALVAVLWLVAR

SEQ ID NO: 1143352 - protein, 29 aa, Mycobacterium
CIDADTRLYLPMPFFWVGGFGSGVLSALV

SEQ ID NO: 1143353 - protein, 17 aa, Mycobacterium
CTVLFTVVWWHVSHSRS

SEQ ID NO: 1143354 - protein, 25 aa, Mycobacterium
DAPRSWLTWRIPALTSVLVAAVVTF

SEQ ID NO: 1143355 - protein, 23 aa, Mycobacterium
DEIAPWVPTLWRRELRAGHWSPM

SEQ ID NO: 1143356 - protein, 18 aa, Mycobacterium
DFATALDYWPLVIGGSGI

SEQ ID NO: 1143357 - protein, 28 aa, Mycobacterium
DLGRDAWFTMLTFWFFAAGWAAAKATAP

SEQ ID NO: 1143358 - protein, 33 aa, Mycobacterium
DLLGLPGWVTQRLWWALLLTVGFWGVVRVAEAL

SEQ ID NO: 1143359 - protein, 25 aa, Mycobacterium
DRVALWGRILPITFTAVGLVLLVGG

SEQ ID NO: 1143360 - protein, 25 aa, Mycobacterium
DSSGQWLIGVFLGGLLGGSVAVAIL

SEQ ID NO: 1143361 - protein, 27 aa, Mycobacterium
EANYGTWWFWLGLLLIVGILLLVGNLE

SEQ ID NO: 1143362 - protein, 25 aa, Mycobacterium
EEQFYLVWPLLIVGTAWLIARRFGP

SEQ ID NO: 1143363 - protein, 23 aa, Mycobacterium
EEQFYLVWPLLLIAVVGVLAIRR

SEQ ID NO: 1143364 - protein, 24 aa, Mycobacterium
EGPKSPMWLWVLAGAVVLLVVALV

SEQ ID NO: 1143365 - protein, 26 aa, Mycobacterium
EHTASAWWFDMGMLALLSIAYVGFVR

SEQ ID NO: 1143366 - protein, 23 aa, Mycobacterium
EKWLFAHIPLAKRVYRTRLWLRS

SEQ ID NO: 1143367 - protein, 20 aa, Mycobacterium
ELTRLYRPMPVRIDLDTSGA

SEQ ID NO: 1143368 - protein, 24 aa, Mycobacterium
EPAVMWLLLPVVAFGSAYVPEIAS

SEQ ID NO: 1143369 - protein, 24 aa, Mycobacterium
EPIQDPRMILPQNKFPFIPPQVDP

SEQ ID NO: 1143370 - protein, 17 aa, Mycobacterium
EQLLVLLPPYVAATQTV

SEQ ID NO: 1143371 - protein, 23 aa, Mycobacterium
ERRWPFLFAVVFLAAGLALRYDI

SEQ ID NO: 1143372 - protein, 20 aa, Mycobacterium
FAETYWQLLLFRSLGGVGSA

SEQ ID NO: 1143373 - protein, 28 aa, Mycobacterium
FAFGPPPPPLMLPAPRFPPPPGFPHRRI

SEQ ID NO: 1143374 - protein, 25 aa, Mycobacterium
FALGDLVIGWLLLWQAKVANDALLQ

SEQ ID NO: 1143375 - protein, 17 aa, Mycobacterium
FEPNPYWSRLHAPGAEL

SEQ ID NO: 1143376 - protein, 18 aa, Mycobacterium
FGGLTVAWLWLTVVFANL

SEQ ID NO: 1143377 - protein, 25 aa, Mycobacterium
FGGPGALFWMWAVAFLGASTSFVEC

SEQ ID NO: 1143378 - protein, 21 aa, Mycobacterium
FHRPWHVIAGWIVLIAVVAGV

SEQ ID NO: 1143379 - protein, 23 aa, Mycobacterium
FLFSLFPIFWMLMLALKNAEQQT

SEQ ID NO: 1143380 - protein, 19 aa, Mycobacterium
FLVRTVIIPALFTLIGPKI

SEQ ID NO: 1143381 - protein, 17 aa, Mycobacterium
FMHLMGRWNWWAPKPLA

SEQ ID NO: 1143382 - protein, 19 aa, Mycobacterium
FPPMGSILYWLRPGTIRLP

SEQ ID NO: 1143383 - protein, 26 aa, Mycobacterium
FPVVQPWYLLWAIIPLATWATRPGFR

SEQ ID NO: 1143384 - protein, 19 aa, Mycobacterium
FQRTPIYCLPKPDFPIPTW

SEQ ID NO: 1143385 - protein, 20 aa, Mycobacterium
FRRRLSAAVLLLVGLGVAGG

SEQ ID NO: 1143386 - protein, 26 aa, Mycobacterium
FSVGWLYWYFWVIVVGFEAIAGAKII

SEQ ID NO: 1143387 - protein, 24 aa, Mycobacterium
FTDHLSWRWAFWINVPVGIVVFFV

SEQ ID NO: 1143388 - protein, 19 aa, Mycobacterium
FTPLTILMLLVLLVAFAAA

SEQ ID NO: 1143389 - protein, 22 aa, Mycobacterium
FVIAMIPLVWLLYTVVAKGVRA

SEQ ID NO: 1143390 - protein, 17 aa, Mycobacterium
FWLFVFGALIALAGFIT

SEQ ID NO: 1143391 - protein, 23 aa, Mycobacterium
GAEYLLNLFHLPGALYVIVAATI

SEQ ID NO: 1143392 - protein, 31 aa, Mycobacterium
GALVLLIVIVVLVLGFWKPGFFVTTKLDVNA

SEQ ID NO: 1143393 - protein, 24 aa, Mycobacterium
GALVPYIRWPMWLRSIVATVALAA

SEQ ID NO: 1143394 - protein, 24 aa, Mycobacterium
GAVLGFLFWLGMGSLTVMSLLYLI

SEQ ID NO: 1143395 - protein, 17 aa, Mycobacterium
GAVWWKALLAFVVAVAL

SEQ ID NO: 1143396 - protein, 18 aa, Mycobacterium
GCLLLAFALPWTSVLAGV

SEQ ID NO: 1143397 - protein, 18 aa, Mycobacterium
GDGAFFLLLDEPEVYGLP

SEQ ID NO: 1143398 - protein, 24 aa, Mycobacterium
GGAIFFVIVLIAMVPKPVWIAIGI

SEQ ID NO: 1143399 - protein, 20 aa, Mycobacterium
GGFIFLGPGFFPGSPSGGSG

SEQ ID NO: 1143400 - protein, 25 aa, Mycobacterium
GGVLWAPLLVALLLALLTAGSYAEL

SEQ ID NO: 1143401 - protein, 25 aa, Mycobacterium
GKPQLWWAALLAPLYWMLQSVAAVK

SEQ ID NO: 1143402 - protein, 23 aa, Mycobacterium
GLAVLIMVLWVGTALTISTTDSR

SEQ ID NO: 1143403 - protein, 26 aa, Mycobacterium
GLIVAFIALFWLYQVYEPPVRPAQNP

SEQ ID NO: 1143404 - protein, 21 aa, Mycobacterium
GLLRRWAWLVLIVGFAVIVTY

SEQ ID NO: 1143405 - protein, 22 aa, Mycobacterium
GLSLPMFMEELFWGCAGIGLAI

SEQ ID NO: 1143406 - protein, 29 aa, Mycobacterium
GLTAWIAAPLLFIGVLFGLLLVTGTTIRE

SEQ ID NO: 1143407 - protein, 20 aa, Mycobacterium
GLWGIFVLAPWLTPVATFLN

SEQ ID NO: 1143408 - protein, 27 aa, Mycobacterium
GMLLCVSFPPFGWWYCAFISAALLAWV

SEQ ID NO: 1143409 - protein, 28 aa, Mycobacterium
GPTPYSPWWLWAAILLVLLVIAWYAVVF

SEQ ID NO: 1143410 - protein, 19 aa, Mycobacterium
GRIMALWLVGFLGSRPIAA

SEQ ID NO: 1143411 - protein, 26 aa, Mycobacterium
GRVSYSWYLWHWPVLILAPAMFGTDL

SEQ ID NO: 1143412 - protein, 21 aa, Mycobacterium
GSFAVLFLPYSLLGPFAGALL

SEQ ID NO: 1143413 - protein, 19 aa, Mycobacterium
GSVPLLFALGDLVIGWLLL

SEQ ID NO: 1143414 - protein, 23 aa, Mycobacterium
GTLTAFLLYLRMFFEPMQEISQF

SEQ ID NO: 1143415 - protein, 24 aa, Mycobacterium
GVIIFLLWLWITNLALLFGAELDA

SEQ ID NO: 1143416 - protein, 21 aa, Mycobacterium
GVLLLVYRSVVTMLLPLVTIG

SEQ ID NO: 1143417 - protein, 23 aa, Mycobacterium
GVMTILFGLIARLPFAFAAGLGI

SEQ ID NO: 1143418 - protein, 17 aa, Mycobacterium
GVPGGWLTISVLVLLIL

SEQ ID NO: 1143419 - protein, 17 aa, Mycobacterium
GVPLYLLLGWVAAWFIG

SEQ ID NO: 1143420 - protein, 17 aa, Mycobacterium
GVPWWFLVGQLPVAGVV

SEQ ID NO: 1143421 - protein, 17 aa, Mycobacterium
GWKWLWWQYALADTRYV

SEQ ID NO: 1143422 - protein, 20 aa, Mycobacterium
GWRVPFLVSLLLLGLGIYVR

SEQ ID NO: 1143423 - protein, 17 aa, Mycobacterium
GWSFFYFSDDTRGFKPV

SEQ ID NO: 1143424 - protein, 18 aa, Mycobacterium
GYLDWLRWFGYTLVGNIV

SEQ ID NO: 1143425 - protein, 18 aa, Mycobacterium
HGLTLPWLIRRLGVQGDE

SEQ ID NO: 1143426 - protein, 24 aa, Mycobacterium
HGRPFRRRNYVPGLLTIGALAVVA

SEQ ID NO: 1143427 - protein, 19 aa, Mycobacterium
HHWAWVVPLVLWLLSGPWR

SEQ ID NO: 1143428 - protein, 17 aa, Mycobacterium
HHWVWVIPLIIWLIHGP

SEQ ID NO: 1143429 - protein, 17 aa, Mycobacterium
HRRRRIILAGRAAAALL

SEQ ID NO: 1143430 - protein, 23 aa, Mycobacterium
HTFRRLFVAFYFVMYMLLARTAR

SEQ ID NO: 1143431 - protein, 27 aa, Mycobacterium
HTGGAWLILFMIFNVIWTYALVRGAAA

SEQ ID NO: 1143432 - protein, 19 aa, Mycobacterium
HVILGWRPVLLLPLTFALF

SEQ ID NO: 1143433 - protein, 27 aa, Mycobacterium
HVVRMWPLWIFAASFVSPLPWILVTAA

SEQ ID NO: 1143434 - protein, 17 aa, Mycobacterium
HWRALLLCFLITAGGTV

SEQ ID NO: 1143435 - protein, 21 aa, Mycobacterium
IALFPPWIMWAPNAIWKSFDL

SEQ ID NO: 1143436 - protein, 21 aa, Mycobacterium
IALLILAMLVAVIAALWVSRA

SEQ ID NO: 1143437 - protein, 26 aa, Mycobacterium
IDPQLWLLVVVTVLALLLGWHLVASI

SEQ ID NO: 1143438 - protein, 24 aa, Mycobacterium
IEADVPILPLIVWGAHRLWTKDHP

SEQ ID NO: 1143439 - protein, 28 aa, Mycobacterium
IEVLGWPLWLLYVVVFALTLLIGVRLIV

SEQ ID NO: 1143440 - protein, 19 aa, Mycobacterium
IFLAIYFATGPDPMLEWMF

SEQ ID NO: 1143441 - protein, 22 aa, Mycobacterium
IGFAVIVFLLVRFVVPPVRRMM

SEQ ID NO: 1143442 - protein, 21 aa, Mycobacterium
IGLIWLAIGFLWLLGVTRGFR

SEQ ID NO: 1143443 - protein, 21 aa, Mycobacterium
IGNLAFFFLVPALAGYIAFAI

SEQ ID NO: 1143444 - protein, 24 aa, Mycobacterium
IGRSLPFLILMAAIIPVTRFIVGT

SEQ ID NO: 1143445 - protein, 23 aa, Mycobacterium
IGVLPLWQIWTILGLLAVLGLRD

SEQ ID NO: 1143446 - protein, 23 aa, Mycobacterium
IIALMVIAVWLLGVGTLMDLALV

SEQ ID NO: 1143447 - protein, 24 aa, Mycobacterium
IIVAVVVALLIIAALAMMARKRRN

SEQ ID NO: 1143448 - protein, 18 aa, Mycobacterium
IIVVALAALVLVAALVWA

SEQ ID NO: 1143449 - protein, 19 aa, Mycobacterium
ILMFLAFGSLVLPIKAALM

SEQ ID NO: 1143450 - protein, 26 aa, Mycobacterium
ILVLAGFLLLIWLPALRCPPGLTVIA

SEQ ID NO: 1143451 - protein, 20 aa, Mycobacterium
ILVYGIVIFLLLLTAGSALV

SEQ ID NO: 1143452 - protein, 26 aa, Mycobacterium
INAFAWVFYLFALILLLTAGQLIKPD

SEQ ID NO: 1143453 - protein, 23 aa, Mycobacterium
IPFSFLVLVWVFGGLLAAAVPVG

SEQ ID NO: 1143454 - protein, 19 aa, Mycobacterium
ITLLLIAAGLLWPLLFDGG

SEQ ID NO: 1143455 - protein, 28 aa, Mycobacterium
IVSDRGYFIFLALLPFIMGVLSLSVPGT

SEQ ID NO: 1143456 - protein, 24 aa, Mycobacterium
IVSKIIYYALLLIVLQLAFGVFGP

SEQ ID NO: 1143457 - protein, 18 aa, Mycobacterium
IVTFFVTALALAILARSA

SEQ ID NO: 1143458 - protein, 20 aa, Mycobacterium
IVVITPLRVAFLIVLIGTTV

SEQ ID NO: 1143459 - protein, 24 aa, Mycobacterium
IYNYTWLVLMLPFGMIGVTVLTVV

SEQ ID NO: 1143460 - protein, 25 aa, Mycobacterium
KLGAFSLVLLLFTAIIIVVFGQMRF

SEQ ID NO: 1143461 - protein, 24 aa, Mycobacterium
KLVFKILVMILWLAPIGAFGAIAN

SEQ ID NO: 1143462 - protein, 23 aa, Mycobacterium
KPGTVYQMWLVGSDGPHSAGTMD

SEQ ID NO: 1143463 - protein, 23 aa, Mycobacterium
KPVRLTMFWPLADKPRLAAGIPG

SEQ ID NO: 1143464 - protein, 19 aa, Mycobacterium
KVVAVPLAKRFAPVVAGVA

SEQ ID NO: 1143465 - protein, 19 aa, Mycobacterium
KYFAIIPALFVGLFPGLDL

SEQ ID NO: 1143466 - protein, 22 aa, Mycobacterium
LAALPVLRWAWTPPLFAGSLLT

SEQ ID NO: 1143467 - protein, 20 aa, Mycobacterium
LAATGWPPVRWIPKIRPDPL

SEQ ID NO: 1143468 - protein, 22 aa, Mycobacterium
LAGRFLVFQLLVVAVVLPAVAA

SEQ ID NO: 1143469 - protein, 23 aa, Mycobacterium
LDATIIRMFLVPAIMKMLGDDCW

SEQ ID NO: 1143470 - protein, 20 aa, Mycobacterium
LDLDALIGGFRPLFRALDPE

SEQ ID NO: 1143471 - protein, 20 aa, Mycobacterium
LDLPAWWRQIAWLPHRPVLV

SEQ ID NO: 1143472 - protein, 24 aa, Mycobacterium
LFIAFDQLWKWNNIVALVLSVLVI

SEQ ID NO: 1143473 - protein, 17 aa, Mycobacterium
LFTTDTGWRRAVLAMVG

SEQ ID NO: 1143474 - protein, 22 aa, Mycobacterium
LGLKFVLYLAFAGVLIGASVYQ

SEQ ID NO: 1143475 - protein, 18 aa, Mycobacterium
LGLWWALYMVFIAVLSGG

SEQ ID NO: 1143476 - protein, 18 aa, Mycobacterium
LGVLLLGVLLWGLGLVGP

SEQ ID NO: 1143477 - protein, 19 aa, Mycobacterium
LHLPTHWPWAQQWLTLWRN

SEQ ID NO: 1143478 - protein, 22 aa, Mycobacterium
LIALALLLVWLALYAGVCLPIN

SEQ ID NO: 1143479 - protein, 24 aa, Mycobacterium
LIASLLLLLLFWQWRTMPQTVWDV

SEQ ID NO: 1143480 - protein, 18 aa, Mycobacterium
LIAVAVAGGVWLGALAVL

SEQ ID NO: 1143481 - protein, 22 aa, Mycobacterium
LIAVSIVWWPFYARLVRGEITR

SEQ ID NO: 1143482 - protein, 24 aa, Mycobacterium
LIFTRYLWAFELTGALLITAALGA

SEQ ID NO: 1143483 - protein, 18 aa, Mycobacterium
LIMMIFAYFLYAFYDVFP

SEQ ID NO: 1143484 - protein, 24 aa, Mycobacterium
LIPACIAIFVPLDLLWVGVTVSVL

SEQ ID NO: 1143485 - protein, 25 aa, Mycobacterium
LISPTMLFFPFVLLLAATAMYRGTD

SEQ ID NO: 1143486 - protein, 24 aa, Mycobacterium
LLCLFGLIVLLLRRGRLPGTFGGP

SEQ ID NO: 1143487 - protein, 18 aa, Mycobacterium
LLGWLLAAFAVRPLKRLA

SEQ ID NO: 1143488 - protein, 21 aa, Mycobacterium
LLHIAVMLVFLLIVLHSKHLH

SEQ ID NO: 1143489 - protein, 17 aa, Mycobacterium
LLIFIFVELLYAVRTCL

SEQ ID NO: 1143490 - protein, 18 aa, Mycobacterium
LLIIMGAFMFFASRRQKK

SEQ ID NO: 1143491 - protein, 19 aa, Mycobacterium
LLIVYRSVFTALLPLLVIG

SEQ ID NO: 1143492 - protein, 20 aa, Mycobacterium
LLLGVLLWGLGLVGPTVALM

SEQ ID NO: 1143493 - protein, 19 aa, Mycobacterium
LLTIPVLLSHQWPLVFVAA

SEQ ID NO: 1143494 - protein, 18 aa, Mycobacterium
LLTMLWQNLIGNAVKFRK

SEQ ID NO: 1143495 - protein, 17 aa, Mycobacterium
LLVLLPPYVAATQTVGV

SEQ ID NO: 1143496 - protein, 26 aa, Mycobacterium
LLVLPALLRLFGKKLFWPLIPKEGAA

SEQ ID NO: 1143497 - protein, 21 aa, Mycobacterium
LLYLFIPIFVIVLFSFNDPKG

SEQ ID NO: 1143498 - protein, 26 aa, Mycobacterium
LMAMFDRWNWWLPKWLDRVLPSVDFE

SEQ ID NO: 1143499 - protein, 17 aa, Mycobacterium
LMSRIREFWLKSGRTRQ

SEQ ID NO: 1143500 - protein, 17 aa, Mycobacterium
LNAFSFWLFLFGALIAL

SEQ ID NO: 1143501 - protein, 26 aa, Mycobacterium
LPAAPTRWLILRIPLGTVWAEELAYR

SEQ ID NO: 1143502 - protein, 24 aa, Mycobacterium
LPTSVSLWLPYLPLLVGGTVATVV

SEQ ID NO: 1143503 - protein, 21 aa, Mycobacterium
LPWLVLVVAQVAWWVTDPASG

SEQ ID NO: 1143504 - protein, 18 aa, Mycobacterium
LQGWTLPPLIRWLQPSFE

SEQ ID NO: 1143505 - protein, 18 aa, Mycobacterium
LRFFRSIPFASATAIAVC

SEQ ID NO: 1143506 - protein, 19 aa, Mycobacterium
LRIALLSLIIAWPAGLLLA

SEQ ID NO: 1143507 - protein, 26 aa, Mycobacterium
LRQFHHPLIYVLLVAGIVTALLREYV

SEQ ID NO: 1143508 - protein, 17 aa, Mycobacterium
LRQLLLVQLWFEPYFDG

SEQ ID NO: 1143509 - protein, 23 aa, Mycobacterium
LSLLTLAGWLLVGGPVSAAFTAA

SEQ ID NO: 1143510 - protein, 25 aa, Mycobacterium
LSMPGWVWWLILYAIFVGLNSWGAA

SEQ ID NO: 1143511 - protein, 18 aa, Mycobacterium
LSQWFLLVMAFGSLFMAA

SEQ ID NO: 1143512 - protein, 17 aa, Mycobacterium
LSVLLLSAGLAGFCVHA

SEQ ID NO: 1143513 - protein, 19 aa, Mycobacterium
LSYLFVATFLAFIANLLGH

SEQ ID NO: 1143514 - protein, 19 aa, Mycobacterium
LTCWLPVFFGWQVMRWLTR

SEQ ID NO: 1143515 - protein, 25 aa, Mycobacterium
LTIVTWLLRIGFLASPPLVGLIADW

SEQ ID NO: 1143516 - protein, 21 aa, Mycobacterium
LTVTLVWLYIEILRLLSYFQN

SEQ ID NO: 1143517 - protein, 25 aa, Mycobacterium
LVAAGLFYLLLTIPLTHLVNYVDAR

SEQ ID NO: 1143518 - protein, 20 aa, Mycobacterium
LVAFLVILIIGWILAKLIAK

SEQ ID NO: 1143519 - protein, 21 aa, Mycobacterium
LVFGFVALIAFLMLLISIRSV

SEQ ID NO: 1143520 - protein, 19 aa, Mycobacterium
LVLAYLGLLWWMLVCWSQG

SEQ ID NO: 1143521 - protein, 21 aa, Mycobacterium
LVLYVVLPPLLWSAGLESSYV

SEQ ID NO: 1143522 - protein, 19 aa, Mycobacterium
LVPAFMHLMGRWNWWAPKP

SEQ ID NO: 1143523 - protein, 18 aa, Mycobacterium
LVPHRPAGRRLLIAAAAA

SEQ ID NO: 1143524 - protein, 28 aa, Mycobacterium
LVPNGTFFFVLLIFLIVLGVIAKWVVPP

SEQ ID NO: 1143525 - protein, 23 aa, Mycobacterium
LVVIYALLPVLWILSLSLKPTSS

SEQ ID NO: 1143526 - protein, 23 aa, Mycobacterium
LWFGVDAWRWMFLAMAVPAVVYG

SEQ ID NO: 1143527 - protein, 19 aa, Mycobacterium
LWHRLPWLVLGLLGAMVSA

SEQ ID NO: 1143528 - protein, 18 aa, Mycobacterium
LWLLTTVLLAAAVPAVWA

SEQ ID NO: 1143529 - protein, 19 aa, Mycobacterium
MAFLGWRWNLPLGVAILLA

SEQ ID NO: 1143530 - protein, 19 aa, Mycobacterium
MFTAILIGGWWRITVPALQ

SEQ ID NO: 1143531 - protein, 20 aa, Mycobacterium
MFTGLAIQVFCPGAVAALAY

SEQ ID NO: 1143532 - protein, 22 aa, Mycobacterium
MIGLQPIRLLSWATALRYQALF

SEQ ID NO: 1143533 - protein, 17 aa, Mycobacterium
MIVLLPKVTTAIPAPLV

SEQ ID NO: 1143534 - protein, 25 aa, Mycobacterium
MLASFVFLRRLLLLAWMGTHSHSKE

SEQ ID NO: 1143535 - protein, 19 aa, Mycobacterium
MLRTPWLLSTLLFASMFVL

SEQ ID NO: 1143536 - protein, 24 aa, Mycobacterium
MLTTAPLFIGWWIAGARYLMKNDP

SEQ ID NO: 1143537 - protein, 32 aa, Mycobacterium
MSRSPRWWRFFGALQWLLIAVAVAGGVWLGAL

SEQ ID NO: 1143538 - protein, 18 aa, Mycobacterium
MVALPRLHPGAPASLLAV

SEQ ID NO: 1143539 - protein, 18 aa, Mycobacterium
MVGFLFLYPAFVAKSHDA

SEQ ID NO: 1143540 - protein, 17 aa, Mycobacterium
MVPKPVWIAIGIGVAVI

SEQ ID NO: 1143541 - protein, 17 aa, Mycobacterium
MYTLIPLGIVLGALVAF

SEQ ID NO: 1143542 - protein, 20 aa, Mycobacterium
NALAIWSLVASLIGFVCCLG

SEQ ID NO: 1143543 - protein, 24 aa, Mycobacterium
NDPPACTVGFLPPSSWRSPDDESD

SEQ ID NO: 1143544 - protein, 23 aa, Mycobacterium
NLFWAFAYNVAALPLAAFGLLNP

SEQ ID NO: 1143545 - protein, 19 aa, Mycobacterium
NLTALRELALLWLADQVDA

SEQ ID NO: 1143546 - protein, 35 aa, Mycobacterium
NLVGWPTWAMIFASPFLLAALIPLGIAGLVLIIDA

SEQ ID NO: 1143547 - protein, 21 aa, Mycobacterium
NNGFYYNAFIGNLIPGGALQP

SEQ ID NO: 1143548 - protein, 27 aa, Mycobacterium
NPELILPLVLPPLLFAAARRTSWREFL

SEQ ID NO: 1143549 - protein, 21 aa, Mycobacterium
NQILRFITYLLVPAGLLTIYT

SEQ ID NO: 1143550 - protein, 18 aa, Mycobacterium
NRGGFPVLPMAFTPDFDV

SEQ ID NO: 1143551 - protein, 18 aa, Mycobacterium
NRMAFLAALLFVLALCFA

SEQ ID NO: 1143552 - protein, 17 aa, Mycobacterium
NRPFIVMPYHARGSLAQ

SEQ ID NO: 1143553 - protein, 24 aa, Mycobacterium
NTNGSQFFLVYKDSQLPPGYTVFG

SEQ ID NO: 1143554 - protein, 24 aa, Mycobacterium
NTWTFRPPPPPWYRTRQAVTALMI

SEQ ID NO: 1143555 - protein, 18 aa, Mycobacterium
PALAWLPLFVVFGLLTGC

SEQ ID NO: 1143556 - protein, 21 aa, Mycobacterium
PAQLWVFWIAPLLGAAIAGAA

SEQ ID NO: 1143557 - protein, 22 aa, Mycobacterium
PATLLLLRYRWLRAEPLPPARS

SEQ ID NO: 1143558 - protein, 19 aa, Mycobacterium
PAVFLLYFLLRRDTRALLV

SEQ ID NO: 1143559 - protein, 25 aa, Mycobacterium
PDARLLWSGDWKTFDGRNFWITIVG

SEQ ID NO: 1143560 - protein, 17 aa, Mycobacterium
PDLICAVVCWLLLSREV

SEQ ID NO: 1143561 - protein, 24 aa, Mycobacterium
PEEHLPLVLPFKYLGVPKDTLMEL

SEQ ID NO: 1143562 - protein, 21 aa, Mycobacterium
PEVALPWRTLGLPGDITLVGA

SEQ ID NO: 1143563 - protein, 23 aa, Mycobacterium
PFVMLGAALLWFGWFGFNVGSEG

SEQ ID NO: 1143564 - protein, 22 aa, Mycobacterium
PGGWLTISVLVLLILVAVVVAV

SEQ ID NO: 1143565 - protein, 21 aa, Mycobacterium
PGIGWSWWVLTAVAAVALLAV

SEQ ID NO: 1143566 - protein, 19 aa, Mycobacterium
PGLPLWPYLLCAALAGFGG

SEQ ID NO: 1143567 - protein, 23 aa, Mycobacterium
PHLLDVPWLVYPLVAVGIAMIVL

SEQ ID NO: 1143568 - protein, 19 aa, Mycobacterium
PIYCLPKPDFPIPTWGGRL

SEQ ID NO: 1143569 - protein, 20 aa, Mycobacterium
PLSFLPFMPLVWVAIRLTTR

SEQ ID NO: 1143570 - protein, 19 aa, Mycobacterium
PLSFLVLVWVFGGLFAAML

SEQ ID NO: 1143571 - protein, 17 aa, Mycobacterium
PLWPLHRWLPDAAVEAT

SEQ ID NO: 1143572 - protein, 22 aa, Mycobacterium
PMPELPWFMALACFKSAATWSL

SEQ ID NO: 1143573 - protein, 23 aa, Mycobacterium
PMRGFMFLTRPLLRGLNHAANWC

SEQ ID NO: 1143574 - protein, 24 aa, Mycobacterium
PQYRALWVFVLVPVLILLTVSGRW

SEQ ID NO: 1143575 - protein, 22 aa, Mycobacterium
PRWARLLQFLPVLAIPAVVLFF

SEQ ID NO: 1143576 - protein, 22 aa, Mycobacterium
PSIPAFLWGLLFIGGLTATFGG

SEQ ID NO: 1143577 - protein, 18 aa, Mycobacterium
PTRRALLLTALGGLLIAG

SEQ ID NO: 1143578 - protein, 27 aa, Mycobacterium
PTTPAHPRWFFLWTTPGRILTIGIVLA

SEQ ID NO: 1143579 - protein, 19 aa, Mycobacterium
PVAALTWRVPSATAAAAVA

SEQ ID NO: 1143580 - protein, 19 aa, Mycobacterium
PVILVVLATLLFGLFANRW

SEQ ID NO: 1143581 - protein, 22 aa, Mycobacterium
PVTFVFYWVIPFLLVAAGALAS

SEQ ID NO: 1143582 - protein, 25 aa, Mycobacterium
PWYIGIYFALIIFFTYFYVSITFNP

SEQ ID NO: 1143583 - protein, 24 aa, Mycobacterium
QLSPYMLMMPLMMVMATVGFMAGG

SEQ ID NO: 1143584 - protein, 23 aa, Mycobacterium
QPITRDLWPAPYLVLDTGASLAP

SEQ ID NO: 1143585 - protein, 17 aa, Mycobacterium
QTFWRITLPSIRWGLTY

SEQ ID NO: 1143586 - protein, 21 aa, Mycobacterium
QVARMLLLFWGVGTALLTLLY

SEQ ID NO: 1143587 - protein, 18 aa, Mycobacterium
QVPWLLVVLVGAGISFLL

SEQ ID NO: 1143588 - protein, 22 aa, Mycobacterium
RAAGWLFWFALATAAVTAVVWT

SEQ ID NO: 1143589 - protein, 21 aa, Mycobacterium
RAPLLILLPAKFVGGVLSIGS

SEQ ID NO: 1143590 - protein, 18 aa, Mycobacterium
RAWHLLVVPVYRIIYEPL

SEQ ID NO: 1143591 - protein, 20 aa, Mycobacterium
RDFWRVLGIWILAALAAAVI

SEQ ID NO: 1143592 - protein, 22 aa, Mycobacterium
RDPLLVMIVFAPVIWTSAVALL

SEQ ID NO: 1143593 - protein, 24 aa, Mycobacterium
RDTYDAMFDLFFPAALGGKTVLAD

SEQ ID NO: 1143594 - protein, 18 aa, Mycobacterium
RFKTFLLLVGMSALIVFV

SEQ ID NO: 1143595 - protein, 21 aa, Mycobacterium
RGRLITMLLVGVALLAAGYAG

SEQ ID NO: 1143596 - protein, 17 aa, Mycobacterium
RGRLVLMWTVCTALPGA

SEQ ID NO: 1143597 - protein, 17 aa, Mycobacterium
RIILAGRAAAALLAVLA

SEQ ID NO: 1143598 - protein, 20 aa, Mycobacterium
RKPIIVWWILWVLSTVVSVS

SEQ ID NO: 1143599 - protein, 30 aa, Mycobacterium
RLADRYAAWFLPLTLVLAGAAWLVSGSAVR

SEQ ID NO: 1143600 - protein, 33 aa, Mycobacterium
RLVPPSLLRRVLPYLIVLLIVGMIVALIATGMR

SEQ ID NO: 1143601 - protein, 23 aa, Mycobacterium
RNLSYFLQQWWIPVMPGLGVLVL

SEQ ID NO: 1143602 - protein, 20 aa, Mycobacterium
RNRMPPQRLALVMGSVAAVT

SEQ ID NO: 1143603 - protein, 24 aa, Mycobacterium
RPALALLGVLALAVGLAGGWMGSK

SEQ ID NO: 1143604 - protein, 23 aa, Mycobacterium
RPAVVPWYRRTPVALAIGAAAVL

SEQ ID NO: 1143605 - protein, 18 aa, Mycobacterium
RPAWLALFVVVLAFAYLC

SEQ ID NO: 1143606 - protein, 21 aa, Mycobacterium
RRLSLVTLGLFAAGGLAGAAG

SEQ ID NO: 1143607 - protein, 17 aa, Mycobacterium
RRRIILAGRAAAALLAV

SEQ ID NO: 1143608 - protein, 20 aa, Mycobacterium
RRWWMLPDHFDWVTGYLRSR

SEQ ID NO: 1143609 - protein, 22 aa, Mycobacterium
RSIIGMLIPLLTIGLALGVANQ

SEQ ID NO: 1143610 - protein, 27 aa, Mycobacterium
RTPDWLPWLRWVVLALAILVAAILVVG

SEQ ID NO: 1143611 - protein, 20 aa, Mycobacterium
RWAVFGAWVLLLVPAIYLAL

SEQ ID NO: 1143612 - protein, 17 aa, Mycobacterium
RWLSVLLLSAGLAGFCV

SEQ ID NO: 1143613 - protein, 30 aa, Mycobacterium
RWSIPGIAHFFTMWGFFILASVYLEAYGLL

SEQ ID NO: 1143614 - protein, 22 aa, Mycobacterium
SAAMLLIPVYLVYIRAARPLIA

SEQ ID NO: 1143615 - protein, 24 aa, Mycobacterium
SAGLHLIFAIFLLVVRFPAPPVRR

SEQ ID NO: 1143616 - protein, 19 aa, Mycobacterium
SAKAPLLWAASAALPWLVL

SEQ ID NO: 1143617 - protein, 17 aa, Mycobacterium
SFWALPSRFLTGAAAAG

SEQ ID NO: 1143618 - protein, 19 aa, Mycobacterium
SFWLFLFGALIALAGFITP

SEQ ID NO: 1143619 - protein, 27 aa, Mycobacterium
SGLALLVVFLFWPWEYQPYGSEGEFLY

SEQ ID NO: 1143620 - protein, 23 aa, Mycobacterium
SGTILWLILLLAAFSWMISSRIV

SEQ ID NO: 1143621 - protein, 19 aa, Mycobacterium
SIELPVLVLALVAVLLGLR

SEQ ID NO: 1143622 - protein, 24 aa, Mycobacterium
SITMVTLIGWWALSRVLGRLVNIP

SEQ ID NO: 1143623 - protein, 24 aa, Mycobacterium
SLALLLTRLYAPLTALANARVEIA

SEQ ID NO: 1143624 - protein, 17 aa, Mycobacterium
SLIIAWPAGLLLALISD

SEQ ID NO: 1143625 - protein, 18 aa, Mycobacterium
SMGRRLGITFAAAAALFV

SEQ ID NO: 1143626 - protein, 24 aa, Mycobacterium
SMLGDRAWWLPKRLARVLPDLDIE

SEQ ID NO: 1143627 - protein, 17 aa, Mycobacterium
SRDFPFTPVGAALLCDW

SEQ ID NO: 1143628 - protein, 22 aa, Mycobacterium
SRWQIARILLVLLLASMPILGI

SEQ ID NO: 1143629 - protein, 21 aa, Mycobacterium
SSLPWAVPPSAPPPAPGPPPD

SEQ ID NO: 1143630 - protein, 25 aa, Mycobacterium
STTFGWFRFYLLAIPLVICVALAFW

SEQ ID NO: 1143631 - protein, 17 aa, Mycobacterium
SVPDFWLGILLIALFSS

SEQ ID NO: 1143632 - protein, 17 aa, Mycobacterium
SVPLTVLIIFTLNILLA

SEQ ID NO: 1143633 - protein, 23 aa, Mycobacterium
SVRAGFIGLVLIVLVIVVGLQPQ

SEQ ID NO: 1143634 - protein, 21 aa, Mycobacterium
SVRALPLEGLVFRDLLDAQTI

SEQ ID NO: 1143635 - protein, 23 aa, Mycobacterium
TATGLVFVWFSLTPSLLPRGPLF

SEQ ID NO: 1143636 - protein, 19 aa, Mycobacterium
TDGWWVYLAVYLLFIGIHL

SEQ ID NO: 1143637 - protein, 18 aa, Mycobacterium
TDTSWFADWPPAAKLAAW

SEQ ID NO: 1143638 - protein, 18 aa, Mycobacterium
TFIGLWIFGWSRLPRLVH

SEQ ID NO: 1143639 - protein, 20 aa, Mycobacterium
TFLLLVGMSALIVFVGSLFG

SEQ ID NO: 1143640 - protein, 20 aa, Mycobacterium
TFPWVFLFPAGVLVLIILCA

SEQ ID NO: 1143641 - protein, 26 aa, Mycobacterium
TGPPWSLWAVILLTSSLLLGCAIIYG

SEQ ID NO: 1143642 - protein, 18 aa, Mycobacterium
TIELALAWRSGEDDPLVE

SEQ ID NO: 1143643 - protein, 19 aa, Mycobacterium
TILTRIILPALLPSLLSGA

SEQ ID NO: 1143644 - protein, 24 aa, Mycobacterium
TLCPLLVLGIWWRGLTAVGASCGL

SEQ ID NO: 1143645 - protein, 22 aa, Mycobacterium
TPILLQLIFLYNVLPQWGWQLS

SEQ ID NO: 1143646 - protein, 28 aa, Mycobacterium
TQPPPVIPTLPYTTIPGLPFVPAPPGFG

SEQ ID NO: 1143647 - protein, 21 aa, Mycobacterium
TRPQWFLLPSLLLIGIRLWYG

SEQ ID NO: 1143648 - protein, 20 aa, Mycobacterium
TRRFSVLILLLCLFGLIVLL

SEQ ID NO: 1143649 - protein, 19 aa, Mycobacterium
TRWEWLWAALLAGAVAVIV

SEQ ID NO: 1143650 - protein, 25 aa, Mycobacterium
TTVATFFPPVLQRLTIYAPIDADDA

SEQ ID NO: 1143651 - protein, 26 aa, Mycobacterium
TVALFVGWLWPLWDRRNRTFADLLLR

SEQ ID NO: 1143652 - protein, 25 aa, Mycobacterium
TVIIVMLLLVYRSIVTVLLMLVTVV

SEQ ID NO: 1143653 - protein, 27 aa, Mycobacterium
TVVVGWVMWLIMINPFRLLAQQARAIN

SEQ ID NO: 1143654 - protein, 20 aa, Mycobacterium
TYSYWFEPNPYWSRLHAPGA

SEQ ID NO: 1143655 - protein, 25 aa, Mycobacterium
VAITGLWLWIGYDALLLIVATQILQ

SEQ ID NO: 1143656 - protein, 27 aa, Mycobacterium
VALLFGLILMWLLSWLIATPVRVVRAA

SEQ ID NO: 1143657 - protein, 19 aa, Mycobacterium
VALYLLITIAPFAVIAPLI

SEQ ID NO: 1143658 - protein, 17 aa, Mycobacterium
VATFLAFIANLLGHYLF

SEQ ID NO: 1143659 - protein, 17 aa, Mycobacterium
VAVFQWGWLEPLGFEPI

SEQ ID NO: 1143660 - protein, 26 aa, Mycobacterium
VDAGLWVAFWFFLAQLNFVLGAVNLV

SEQ ID NO: 1143661 - protein, 17 aa, Mycobacterium
VFQWGWLEPLGFEPIPS

SEQ ID NO: 1143662 - protein, 27 aa, Mycobacterium
VFSSFWFTAIYVLLFISLVGCLTPRLV

SEQ ID NO: 1143663 - protein, 29 aa, Mycobacterium
VFYPLHLLPFGLLAFLWQIALIAAIYASI

SEQ ID NO: 1143664 - protein, 23 aa, Mycobacterium
VFYVLIWVGLVALSWAIGPVWRV

SEQ ID NO: 1143665 - protein, 25 aa, Mycobacterium
VGALALLWFVIVLNAVIPFGVQTIV

SEQ ID NO: 1143666 - protein, 26 aa, Mycobacterium
VGGLLWPFLLLPHLGMIRGAAATGVI

SEQ ID NO: 1143667 - protein, 31 aa, Mycobacterium
VGPLEFGGFIAWLAWLALHLVYLVGFKTKIV

SEQ ID NO: 1143668 - protein, 20 aa, Mycobacterium
VGTWPLLAPLLAAGTVVLAV

SEQ ID NO: 1143669 - protein, 18 aa, Mycobacterium
VIAGFWWFDGYQLVQERY

SEQ ID NO: 1143670 - protein, 17 aa, Mycobacterium
VIIPLFASLVVGLLMFL

SEQ ID NO: 1143671 - protein, 24 aa, Mycobacterium
VISGWTLVVWVLMAMGSCIGYLAS

SEQ ID NO: 1143672 - protein, 23 aa, Mycobacterium
VKQWGFFILLILLLAPALNQWFF

SEQ ID NO: 1143673 - protein, 23 aa, Mycobacterium
VLAPILLLLLRIAQGFALGGEWA

SEQ ID NO: 1143674 - protein, 18 aa, Mycobacterium
VLAVFVLWVWAQRRRRKR

SEQ ID NO: 1143675 - protein, 27 aa, Mycobacterium
VLGSLLIYMLPLLLLVALFVFFSRMQT

SEQ ID NO: 1143676 - protein, 17 aa, Mycobacterium
VLLLPLTFALFTPLAVP

SEQ ID NO: 1143677 - protein, 21 aa, Mycobacterium
VLMALTWRRLPWQPLPDGDPP

SEQ ID NO: 1143678 - protein, 18 aa, Mycobacterium
VLRLPLALGVIHLLARIP

SEQ ID NO: 1143679 - protein, 25 aa, Mycobacterium
VLSVALFFVWMIAVAFLYLVLGGMG

SEQ ID NO: 1143680 - protein, 24 aa, Mycobacterium
VLTGAWLGLFIGLILGFFSPNPWS

SEQ ID NO: 1143681 - protein, 24 aa, Mycobacterium
VMKLIWRLLGLLPPQRRIASLTGP

SEQ ID NO: 1143682 - protein, 26 aa, Mycobacterium
VMVGALLVWLLVVLTLMRISGWLDVS

SEQ ID NO: 1143683 - protein, 26 aa, Mycobacterium
VPASWRRWWWALLLAFVPIHLVVSAV

SEQ ID NO: 1143684 - protein, 18 aa, Mycobacterium
VPFILGLVWRKGTSTAAL

SEQ ID NO: 1143685 - protein, 22 aa, Mycobacterium
VRIVWVYLFAYLPRLVSPALRY

SEQ ID NO: 1143686 - protein, 19 aa, Mycobacterium
VSIPSWWQPYVLSVGSLTS

SEQ ID NO: 1143687 - protein, 25 aa, Mycobacterium
VSLGIILLALLWYAGLPLKVFLSSL

SEQ ID NO: 1143688 - protein, 25 aa, Mycobacterium
VTAAYLWSLWALFFTHAGMPGMTMS

SEQ ID NO: 1143689 - protein, 17 aa, Mycobacterium
VTTFPWVFLFPAGVLVL

SEQ ID NO: 1143690 - protein, 20 aa, Mycobacterium
VTVFLWILPGIIALAFGNDS

SEQ ID NO: 1143691 - protein, 19 aa, Mycobacterium
VVAVIFAFQLLFTDWQRAL

SEQ ID NO: 1143692 - protein, 17 aa, Mycobacterium
VVFGVIVVAVWWAARIP

SEQ ID NO: 1143693 - protein, 20 aa, Mycobacterium
VVLLLGWSFFYFSDDTRGFK

SEQ ID NO: 1143694 - protein, 17 aa, Mycobacterium
VVLLLYFANKHFLKRRP

SEQ ID NO: 1143695 - protein, 24 aa, Mycobacterium
VVVLFVPAALPWYYTWPLAVVSAL

SEQ ID NO: 1143696 - protein, 25 aa, Mycobacterium
VVVVGGVILWRFFGDALSERSDAAS

SEQ ID NO: 1143697 - protein, 17 aa, Mycobacterium
VWRPMIIILGLATMLLA

SEQ ID NO: 1143698 - protein, 18 aa, Mycobacterium
WAELPPLLQPRAAASAAV

SEQ ID NO: 1143699 - protein, 20 aa, Mycobacterium
WFLLVMAFGSLFMAAGKRYA

SEQ ID NO: 1143700 - protein, 17 aa, Mycobacterium
WLGILLIALFSSTLGWL

SEQ ID NO: 1143701 - protein, 24 aa, Mycobacterium
WLQSWTIFYWAWWISWTPFVGMFI

SEQ ID NO: 1143702 - protein, 17 aa, Mycobacterium
WRAYALPILAVLTVVVI

SEQ ID NO: 1143703 - protein, 19 aa, Mycobacterium
WTVFSAFVLLIPTLGTMVL

SEQ ID NO: 1143704 - protein, 17 aa, Mycobacterium
WWQTFWRITLPSIRWGL

SEQ ID NO: 1143705 - protein, 17 aa, Mycobacterium
YFFQFRPDQETDSEAAK

SEQ ID NO: 1143706 - protein, 26 aa, Mycobacterium
YGLPPFYPPGWFWLGGRLAALTGTPA

SEQ ID NO: 1143707 - protein, 31 aa, Mycobacterium
YLDLPRLWQILLIVGLFLWIAIVWRGLRSSL

SEQ ID NO: 1143708 - protein, 25 aa, Mycobacterium
YLFPLYASLLTPWWLRVLGAQVGSG

SEQ ID NO: 1143709 - protein, 17 aa, Mycobacterium
YLPGIWMYLGLAVVFTL

SEQ ID NO: 1143710 - protein, 17 aa, Mycobacterium
YLWRMWVSRGRPGGVAA

SEQ ID NO: 1143711 - protein, 20 aa, Mycobacterium
YNWIIFMILPLYVSLEKIDP

SEQ ID NO: 1143712 - protein, 23 aa, Mycobacterium
YPGDPWKWWAVLSSAVGVAVAIA

SEQ ID NO: 1143713 - protein, 25 aa, Mycobacterium
YPLIERFPLMFFTSAAVLLIGMGRW

SEQ ID NO: 1143714 - protein, 17 aa, Mycobacterium
YVNWLWFGELGYRSVFT

SEQ ID NO: 1143715 - protein, 19 aa, Mycobacterium
YVYFVMCWLWYPPRVSPAA

SEQ ID NO: 1143716 - protein, 24 aa, Mycobacterium
AAGVLLTLVLVLLVWAVFGSSSDE

SEQ ID NO: 1143717 - protein, 22 aa, Mycobacterium
AALSLVLPVWAAALIVALVLFV

SEQ ID NO: 1143718 - protein, 19 aa, Mycobacterium
AALTWTAWLTPFGLLGRVA

SEQ ID NO: 1143719 - protein, 26 aa, Mycobacterium
AARKRIAWWILLLYMVAAAGWNVADL

SEQ ID NO: 1143720 - protein, 24 aa, Mycobacterium
ACAALGPAWFWLGPAPPAGSTVRV

SEQ ID NO: 1143721 - protein, 24 aa, Mycobacterium
ACVAFWFLWPLLRAVIRLARRHRH

SEQ ID NO: 1143722 - protein, 27 aa, Mycobacterium
ADKAAGWLFWFALITAAITAAAWTIVG

SEQ ID NO: 1143723 - protein, 24 aa, Mycobacterium
AERPRLRIPLWSLLLLGAAALVVS

SEQ ID NO: 1143724 - protein, 24 aa, Mycobacterium
AFAYLLLPQVLFYGLSSVFMAILN

SEQ ID NO: 1143725 - protein, 17 aa, Mycobacterium
AFFPYYICGITFRASDL

SEQ ID NO: 1143726 - protein, 24 aa, Mycobacterium
AFPIIVVMILLIIPLGQLSLGGIS

SEQ ID NO: 1143727 - protein, 36 aa, Mycobacterium
AFSEVNIWFLVQFLERPFVPLIPTLGIPGDIADALG

SEQ ID NO: 1143728 - protein, 17 aa, Mycobacterium
AFWLVLVALIGGTATFL

SEQ ID NO: 1143729 - protein, 23 aa, Mycobacterium
AGIVLIVLALRWLLIHTPKARVK

SEQ ID NO: 1143730 - protein, 25 aa, Mycobacterium
AGQARSPMFGFFPVMMVMSLVGTLA

SEQ ID NO: 1143731 - protein, 24 aa, Mycobacterium
AHLPPMPYMFVWVDEFSLLLKDHP

SEQ ID NO: 1143732 - protein, 23 aa, Mycobacterium
AIAALLVAVIVWLVVQLVSGDDS

SEQ ID NO: 1143733 - protein, 21 aa, Mycobacterium
AILLSMYWPLGVVVLVSIVPI

SEQ ID NO: 1143734 - protein, 26 aa, Mycobacterium
AIRDAVLILLVFVAALVLVLLVARSL

SEQ ID NO: 1143735 - protein, 19 aa, Mycobacterium
AIVLYYVMLTFVARPYLIP

SEQ ID NO: 1143736 - protein, 17 aa, Mycobacterium
AKKLLIGFLTAGALILA

SEQ ID NO: 1143737 - protein, 17 aa, Mycobacterium
ALAGLLRRWAWLVLIVG

SEQ ID NO: 1143738 - protein, 21 aa, Mycobacterium
ALAIRCTAAWWLGRPGWRRDF

SEQ ID NO: 1143739 - protein, 17 aa, Mycobacterium
ALAWWQWTRWESTTGSF

SEQ ID NO: 1143740 - protein, 17 aa, Mycobacterium
ALMTLPWLAAIVGEYIL

SEQ ID NO: 1143741 - protein, 18 aa, Mycobacterium
ALPRWIYVPAVAGALFVG

SEQ ID NO: 1143742 - protein, 22 aa, Mycobacterium
ALPVDIPWLPLAAPVALLVGYV

SEQ ID NO: 1143743 - protein, 17 aa, Mycobacterium
ALQWVVWLALLNNVAAE

SEQ ID NO: 1143744 - protein, 22 aa, Mycobacterium
ALRPLLGMLPFDGLIGAPMLFG

SEQ ID NO: 1143745 - protein, 29 aa, Mycobacterium
ALSTTIYLKLFGWLIWLFDQSSNMLLRLL

SEQ ID NO: 1143746 - protein, 27 aa, Mycobacterium
AMAYSLYLWHWPLLIFWLAYSGHTQAN

SEQ ID NO: 1143747 - protein, 24 aa, Mycobacterium
AQNFNWHVLFWFAAGLGAAALICF

SEQ ID NO: 1143748 - protein, 32 aa, Mycobacterium
AQQMRAFVALRWWPLVLLVAVTVALVALAAYL

SEQ ID NO: 1143749 - protein, 20 aa, Mycobacterium
ATAWLYFFQFRPDQETDSEA

SEQ ID NO: 1143750 - protein, 20 aa, Mycobacterium
AVGLLLLVLVLNVAVPFAVQ

SEQ ID NO: 1143751 - protein, 19 aa, Mycobacterium
AVIAALVWWTSDARATISQ

SEQ ID NO: 1143752 - protein, 24 aa, Mycobacterium
AVLLYSLLYYRLLGVLIALSLVAS

SEQ ID NO: 1143753 - protein, 17 aa, Mycobacterium
AVPFWIGPILLYLLLPA

SEQ ID NO: 1143754 - protein, 17 aa, Mycobacterium
AVRYAMLTLLHDLAWKA

SEQ ID NO: 1143755 - protein, 19 aa, Mycobacterium
AYPRYFPPISLWTGLSLLG

SEQ ID NO: 1143756 - protein, 20 aa, Mycobacterium
CIIAGIIVALVLGDRRWEAR

SEQ ID NO: 1143757 - protein, 17 aa, Mycobacterium
CTVLWPPVRWLRGKGVP

SEQ ID NO: 1143758 - protein, 22 aa, Mycobacterium
DCGFGWFFYDFGTAVSFIEDDP

SEQ ID NO: 1143759 - protein, 23 aa, Mycobacterium
DHLPFIYPPFAALLFYPLHFLPF

SEQ ID NO: 1143760 - protein, 26 aa, Mycobacterium
DISYTLYLWHWPVIILLLAVIPEGLV

SEQ ID NO: 1143761 - protein, 24 aa, Mycobacterium
DIYSLGCTLFRLLTGRQPFSQADG

SEQ ID NO: 1143762 - protein, 19 aa, Mycobacterium
DLRWWHPWAWLAYPGCYVV

SEQ ID NO: 1143763 - protein, 24 aa, Mycobacterium
DNDNFWFSWIVPLAAIIFAGAFTD

SEQ ID NO: 1143764 - protein, 21 aa, Mycobacterium
DPMLWLERALVVLVAASPCAL

SEQ ID NO: 1143765 - protein, 17 aa, Mycobacterium
EARWLSVLLLSAGLAGF

SEQ ID NO: 1143766 - protein, 24 aa, Mycobacterium
EEQFYFVWPWVLIALFALTRKVKR

SEQ ID NO: 1143767 - protein, 22 aa, Mycobacterium
EGDWLYFVTIDLQGTTLFTRDY

SEQ ID NO: 1143768 - protein, 25 aa, Mycobacterium
EIAEGALLLFLFSVGHALEGYAMGR

SEQ ID NO: 1143769 - protein, 35 aa, Mycobacterium
EIVHPTFLYELVWNLLVFAVLIWADRRFNLGHGRL

SEQ ID NO: 1143770 - protein, 26 aa, Mycobacterium
ELLKLAVILALWAAVAAAFVSVIYRR

SEQ ID NO: 1143771 - protein, 24 aa, Mycobacterium
ERDIRFIIIVTLIVVLLTLAVLLR

SEQ ID NO: 1143772 - protein, 23 aa, Mycobacterium
ETWPLLTGFVWLGGLLIVASVVL

SEQ ID NO: 1143773 - protein, 20 aa, Mycobacterium
FAFRDGAWVDLPPLQHARVA

SEQ ID NO: 1143774 - protein, 23 aa, Mycobacterium
FALSWWLGLYLLARNPRKPVLLS

SEQ ID NO: 1143775 - protein, 17 aa, Mycobacterium
FARLSYMILLSVPLVAP

SEQ ID NO: 1143776 - protein, 25 aa, Mycobacterium
FFASFALFQLLWARLVLIRTTTPVL

SEQ ID NO: 1143777 - protein, 17 aa, Mycobacterium
FFPVMMVMSLVGTLAFG

SEQ ID NO: 1143778 - protein, 22 aa, Mycobacterium
FGLYVFWMMPIFGLAIVLAVRS

SEQ ID NO: 1143779 - protein, 18 aa, Mycobacterium
FIDTLWFPGLLLIALGVI

SEQ ID NO: 1143780 - protein, 22 aa, Mycobacterium
FLAPWLFFMFIDLFDSDRAGMA

SEQ ID NO: 1143781 - protein, 18 aa, Mycobacterium
FQWREFILQAWFLFRVSF

SEQ ID NO: 1143782 - protein, 34 aa, Mycobacterium
FRHLRRRHIAFAGLFLLVVVVGFGSWLALRAVEA

SEQ ID NO: 1143783 - protein, 18 aa, Mycobacterium
FTAPPIWLWAVWAVLAVC

SEQ ID NO: 1143784 - protein, 20 aa, Mycobacterium
FTHFAALMTLPWLAAIVGEY

SEQ ID NO: 1143785 - protein, 18 aa, Mycobacterium
FVAALVLVLLVARSLVRP

SEQ ID NO: 1143786 - protein, 26 aa, Mycobacterium
FVMFAIGAIIPLIPYLLGYESLWVGL

SEQ ID NO: 1143787 - protein, 19 aa, Mycobacterium
FVTLAWWMAVFPGAAIFVI

SEQ ID NO: 1143788 - protein, 17 aa, Mycobacterium
FVVAFVILPLLPDRPMG

SEQ ID NO: 1143789 - protein, 17 aa, Mycobacterium
GALLAFWIVIVGAEWAL

SEQ ID NO: 1143790 - protein, 22 aa, Mycobacterium
GDPMLWLERGLVVLVAASPCAL

SEQ ID NO: 1143791 - protein, 20 aa, Mycobacterium
GLAFYVPLLPWISGLVGAVP

SEQ ID NO: 1143792 - protein, 19 aa, Mycobacterium
GLILLALLLALLSAPPVGA

SEQ ID NO: 1143793 - protein, 31 aa, Mycobacterium
GLPLRAIVMVLLFLGIVFLLVGFQALRSDDS

SEQ ID NO: 1143794 - protein, 25 aa, Mycobacterium
GLVFALSLFLLAWVLVLRGVYESFR

SEQ ID NO: 1143795 - protein, 17 aa, Mycobacterium
GMLLWLPLSILLEFLIG

SEQ ID NO: 1143796 - protein, 22 aa, Mycobacterium
GPPLWWLLRVADWAAAVPGASV

SEQ ID NO: 1143797 - protein, 20 aa, Mycobacterium
GQEIAWPVPLLAFIILVAVG

SEQ ID NO: 1143798 - protein, 23 aa, Mycobacterium
GRIVAYVVLPVAVLAMACGVGFL

SEQ ID NO: 1143799 - protein, 27 aa, Mycobacterium
GRKVSYVGLAILLLTALMVGALGGWVG

SEQ ID NO: 1143800 - protein, 21 aa, Mycobacterium
GVIAIVVLLFLACAPVASAQP

SEQ ID NO: 1143801 - protein, 28 aa, Mycobacterium
GWFAWPGYLWFGMAAYLLLTLLVLEPVR

SEQ ID NO: 1143802 - protein, 18 aa, Mycobacterium
GWQWIFFVNVPVGVAGLA

SEQ ID NO: 1143803 - protein, 19 aa, Mycobacterium
HEGFFFFAIVLSALSVIPL

SEQ ID NO: 1143804 - protein, 27 aa, Mycobacterium
HGRLFALYVAGYCLGRFWIELLRSDMA

SEQ ID NO: 1143805 - protein, 26 aa, Mycobacterium
HPARYLSLFLVLLVGAFLLVFLTGDK

SEQ ID NO: 1143806 - protein, 21 aa, Mycobacterium
HPLARLMPFAMLVAAGGMMLL

SEQ ID NO: 1143807 - protein, 18 aa, Mycobacterium
HTLRLGRPGWLDPGPLAG

SEQ ID NO: 1143808 - protein, 17 aa, Mycobacterium
HWRERVNWRWVRRGLIA

SEQ ID NO: 1143809 - protein, 17 aa, Mycobacterium
IAAFRIWEGGLGIWGAV

SEQ ID NO: 1143810 - protein, 25 aa, Mycobacterium
IAFSLAIIAVLIPLAAFGVLGLATV

SEQ ID NO: 1143811 - protein, 26 aa, Mycobacterium
IAFSLAIIAVLIPLAAFGVLGLATVV

SEQ ID NO: 1143812 - protein, 17 aa, Mycobacterium
IALGAIAALLVAVIVWL

SEQ ID NO: 1143813 - protein, 21 aa, Mycobacterium
IALVALGWYYLRVPSLMGIGQ

SEQ ID NO: 1143814 - protein, 21 aa, Mycobacterium
IALVVLWRWRWVRLAAGAAVL

SEQ ID NO: 1143815 - protein, 24 aa, Mycobacterium
IAPTLLTPLLPLVPRLRTGYNLPI

SEQ ID NO: 1143816 - protein, 17 aa, Mycobacterium
IARPLVPAIMGLAALIA

SEQ ID NO: 1143817 - protein, 18 aa, Mycobacterium
IGSLLWRGLQPDTGPRTQ

SEQ ID NO: 1143818 - protein, 17 aa, Mycobacterium
IGVLFFQFILGQELAWT

SEQ ID NO: 1143819 - protein, 24 aa, Mycobacterium
IGVVWFWIPLGLLVLGTSSIPSVI

SEQ ID NO: 1143820 - protein, 29 aa, Mycobacterium
IIGFTLLVVFLVLCLLLRAVVAPIYLVAS

SEQ ID NO: 1143821 - protein, 28 aa, Mycobacterium
IIVGVILVLLLRALLAPLYLLGTVVLNY

SEQ ID NO: 1143822 - protein, 20 aa, Mycobacterium
IKFLIFGVIMVVLTAFLFLV

SEQ ID NO: 1143823 - protein, 19 aa, Mycobacterium
IRGGFWRSGPLIRGLTALG

SEQ ID NO: 1143824 - protein, 22 aa, Mycobacterium
KTPVWNWMIAAYLFSGGLSAGS

SEQ ID NO: 1143825 - protein, 25 aa, Mycobacterium
LAAFPILVALVWWFRNESAKTYRKV

SEQ ID NO: 1143826 - protein, 19 aa, Mycobacterium
LAALVLLLLTAISTVLPHA

SEQ ID NO: 1143827 - protein, 27 aa, Mycobacterium
LAFPAPSWWWLAWIGVVPLLLVVRAAP

SEQ ID NO: 1143828 - protein, 20 aa, Mycobacterium
LAGMLPLAMAPPPPVPGVLL

SEQ ID NO: 1143829 - protein, 24 aa, Mycobacterium
LALLPLLALLVWLPARRRRDDEPG

SEQ ID NO: 1143830 - protein, 18 aa, Mycobacterium
LEHFWWGSVFLINAPVMA

SEQ ID NO: 1143831 - protein, 19 aa, Mycobacterium
LFAALFLILALVVIGEIAG

SEQ ID NO: 1143832 - protein, 18 aa, Mycobacterium
LFFAYLNLFLAAMLLLVL

SEQ ID NO: 1143833 - protein, 19 aa, Mycobacterium
LFLPWLLQRLGMDPAFGAG

SEQ ID NO: 1143834 - protein, 19 aa, Mycobacterium
LFWAFAYNVAAIPVAALGM

SEQ ID NO: 1143835 - protein, 28 aa, Mycobacterium
LGFYAFDLPFYRLVLSYLFVATFLAFIA

SEQ ID NO: 1143836 - protein, 18 aa, Mycobacterium
LGLFAPPILASVVVGAAA

SEQ ID NO: 1143837 - protein, 22 aa, Mycobacterium
LGRGWLTAICAVLLLLGAGAGV

SEQ ID NO: 1143838 - protein, 18 aa, Mycobacterium
LIAPLYLVGSVVLSYFAA

SEQ ID NO: 1143839 - protein, 17 aa, Mycobacterium
LLAGWRDEIRQPPMASV

SEQ ID NO: 1143840 - protein, 17 aa, Mycobacterium
LLERFELQRWADAVRRH

SEQ ID NO: 1143841 - protein, 20 aa, Mycobacterium
LLFYPLHFLPFPVVAWIWQL

SEQ ID NO: 1143842 - protein, 19 aa, Mycobacterium
LLIVVVALFLGVDPGTVLP

SEQ ID NO: 1143843 - protein, 26 aa, Mycobacterium
LLRIMGPWFWWPTLVRTRPLRQVSDF

SEQ ID NO: 1143844 - protein, 18 aa, Mycobacterium
LLVVLVGAGISFLLAGRD

SEQ ID NO: 1143845 - protein, 26 aa, Mycobacterium
LMLYMALMGITWLLDVPARIGNRLPD

SEQ ID NO: 1143846 - protein, 23 aa, Mycobacterium
LPGWPLWFAALWVAQEWLKSSVP

SEQ ID NO: 1143847 - protein, 25 aa, Mycobacterium
LPMMLAPWVLLPVILALRGEGSARR

SEQ ID NO: 1143848 - protein, 24 aa, Mycobacterium
LPVVFYSAWIFFDGAWRALRARTL

SEQ ID NO: 1143849 - protein, 22 aa, Mycobacterium
LQFMLIIWLQGIWLPLRGYDFE

SEQ ID NO: 1143850 - protein, 22 aa, Mycobacterium
LQFTYWQWASLTLAAPVIVWAA

SEQ ID NO: 1143851 - protein, 18 aa, Mycobacterium
LSGLLLNYFLINPRHTFT

SEQ ID NO: 1143852 - protein, 23 aa, Mycobacterium
LTGCLAAVLWWACHRPNRLWWRF

SEQ ID NO: 1143853 - protein, 18 aa, Mycobacterium
LVSGLLVAGSWWLFEWEL

SEQ ID NO: 1143854 - protein, 26 aa, Mycobacterium
LVTVLVVVLILTLVWMQFRGAFTPEV

SEQ ID NO: 1143855 - protein, 24 aa, Mycobacterium
LWLIKFVLDFQWMSLFTVPFQTIG

SEQ ID NO: 1143856 - protein, 18 aa, Mycobacterium
LWRAAQVFRLLSWVYALG

SEQ ID NO: 1143857 - protein, 25 aa, Mycobacterium
MAYSLYLWHWPLLIFWLSYSGRSRV

SEQ ID NO: 1143858 - protein, 18 aa, Mycobacterium
MCVALVVYFLLLGRIAFA

SEQ ID NO: 1143859 - protein, 27 aa, Mycobacterium
MLLAAAWFLLFALPLLLTVPPHLPGAD

SEQ ID NO: 1143860 - protein, 23 aa, Mycobacterium
MMLPLLLFGLLIFGLFRESFPGL

SEQ ID NO: 1143861 - protein, 26 aa, Mycobacterium
MRMTRLLALLATFLTAGVLLAPVAAA

SEQ ID NO: 1143862 - protein, 17 aa, Mycobacterium
MSLLYLILALVCQYRQN

SEQ ID NO: 1143863 - protein, 24 aa, Mycobacterium
MVLVPAFMRVLGRWNWWSPKPLAR

SEQ ID NO: 1143864 - protein, 18 aa, Mycobacterium
MVVLTAFLFLVFSDSRTG

SEQ ID NO: 1143865 - protein, 30 aa, Mycobacterium; identical to SEQ ID NO: 378629

SEQ ID NO: 1143866 - protein, 20 aa, Mycobacterium
NPVFWLGMMIALAAAFLAAY

SEQ ID NO: 1143867 - protein, 20 aa, Mycobacterium
NVNMVRLWWDKPWPMRIAAI

SEQ ID NO: 1143868 - protein, 18 aa, Mycobacterium
NWRWVRRGLIAAAVVLIV

SEQ ID NO: 1143869 - protein, 17 aa, Mycobacterium
NWVLDGMVEIGALSEAD

SEQ ID NO: 1143870 - protein, 26 aa, Mycobacterium
PAAALFRRVFLINGLIFTLGTLVLAV

SEQ ID NO: 1143871 - protein, 26 aa, Mycobacterium
PAGRQPLWWHYAVAAALILAFLGSWH

SEQ ID NO: 1143872 - protein, 24 aa, Mycobacterium
PARIAFHLVRLYNLAFIVSTYALS

SEQ ID NO: 1143873 - protein, 25 aa, Mycobacterium
PEVPSDLPLPALLSPDATPPATLPP

SEQ ID NO: 1143874 - protein, 18 aa, Mycobacterium
PFLVAFLIATITAFSYLE

SEQ ID NO: 1143875 - protein, 21 aa, Mycobacterium
PFMIALVIIVLVVIGIWLVNL

SEQ ID NO: 1143876 - protein, 25 aa, Mycobacterium
PFWIGPILLYLLLPALDLRFGPDGQ

SEQ ID NO: 1143877 - protein, 20 aa, Mycobacterium
PGRAFWRPLFVAPLAVPAFV

SEQ ID NO: 1143878 - protein, 23 aa, Mycobacterium
PKKSKLWLILGLVALTVVVIAIA

SEQ ID NO: 1143879 - protein, 17 aa, Mycobacterium
PLAYFFLLVIWLGIDEA

SEQ ID NO: 1143880 - protein, 20 aa, Mycobacterium
PLPIPWSVLSLFAPGPTLSK

SEQ ID NO: 1143881 - protein, 17 aa, Mycobacterium
PLTVLIIFTLNILLAEF

SEQ ID NO: 1143882 - protein, 19 aa, Mycobacterium
PLVPAIMGLAALIAALGAL

SEQ ID NO: 1143883 - protein, 18 aa, Mycobacterium
PMTAPPKRPSRWSPANWP

SEQ ID NO: 1143884 - protein, 25 aa, Mycobacterium
PQFRALWVFVLIPVLILLAVSGKWL

SEQ ID NO: 1143885 - protein, 26 aa, Mycobacterium
PQGVWELGPFPLRAYALCIIAGIIVA

SEQ ID NO: 1143886 - protein, 19 aa, Mycobacterium
PRRWGLPLIATVAALLLAA

SEQ ID NO: 1143887 - protein, 17 aa, Mycobacterium
PSPWLRLLILCTALLGI

SEQ ID NO: 1143888 - protein, 20 aa, Mycobacterium
PTLVILLDFLQQELPALFVP

SEQ ID NO: 1143889 - protein, 17 aa, Mycobacterium
PTQFPIALLLNVTNPLR

SEQ ID NO: 1143890 - protein, 20 aa, Mycobacterium
QATLWLTWPFGPAGALGGFA

SEQ ID NO: 1143891 - protein, 17 aa, Mycobacterium
QDGRDMFWSLAPLVVAC

SEQ ID NO: 1143892 - protein, 23 aa, Mycobacterium
QFDNWQWLALTLASPVVVWGAWP

SEQ ID NO: 1143893 - protein, 18 aa, Mycobacterium
QFLKRWVFALVLSAVWVV

SEQ ID NO: 1143894 - protein, 23 aa, Mycobacterium
QFTNWQWLALTLASPVVVWGALP

SEQ ID NO: 1143895 - protein, 19 aa, Mycobacterium
QLIIFTVLTVIALVALGWY

SEQ ID NO: 1143896 - protein, 25 aa, Mycobacterium
QMNPLYLIFMAMMGIALFQSMQQQG

SEQ ID NO: 1143897 - protein, 27 aa, Mycobacterium
QRAKRALLFWVVAVITLAGLLAAGAWT

SEQ ID NO: 1143898 - protein, 26 aa, Mycobacterium
QRTRLVAWVLLLLMLPMVVGCVRVRA

SEQ ID NO: 1143899 - protein, 25 aa, Mycobacterium
QVLQSYLNIIYFGRGAYGVAAASRA

SEQ ID NO: 1143900 - protein, 22 aa, Mycobacterium
RDMFWSLAPLVVACVVLAGLLG

SEQ ID NO: 1143901 - protein, 22 aa, Mycobacterium
REFILQAWFLFRVSFLPTVAVS

SEQ ID NO: 1143902 - protein, 17 aa, Mycobacterium
REPYWIALTVLLVLRPE

SEQ ID NO: 1143903 - protein, 28 aa, Mycobacterium
REVPKHVVWLWAVAIVLMVLAGVLITMV

SEQ ID NO: 1143904 - protein, 19 aa, Mycobacterium
RFMSFGLVFLILNGLQIVV

SEQ ID NO: 1143905 - protein, 17 aa, Mycobacterium
RHLMLYMALMGITWLLD

SEQ ID NO: 1143906 - protein, 25 aa, Mycobacterium
RHRAGTAVMLVLLLVAAAQLFNLQV

SEQ ID NO: 1143907 - protein, 17 aa, Mycobacterium
RIRRLARALNQFARLSY

SEQ ID NO: 1143908 - protein, 18 aa, Mycobacterium
RLGRLLLAIGLGVLSLGS

SEQ ID NO: 1143909 - protein, 17 aa, Mycobacterium
RLPDLICAVVCWLLLSR

SEQ ID NO: 1143910 - protein, 17 aa, Mycobacterium
RLSYMILLSVPLVAPVL

SEQ ID NO: 1143911 - protein, 24 aa, Mycobacterium
RNLFTLLPIIPFIGGLLGVIAIVV

SEQ ID NO: 1143912 - protein, 18 aa, Mycobacterium
RQGRFEIDFLMLVSAAGA

SEQ ID NO: 1143913 - protein, 17 aa, Mycobacterium
RQNAIGSLLWRGLQPDT

SEQ ID NO: 1143914 - protein, 21 aa, Mycobacterium
RRVVLPLLWPGIVAALLVVFF

SEQ ID NO: 1143915 - protein, 27 aa, Mycobacterium
RTPPYKLAGLILLVVFAVIATLVAFQF

SEQ ID NO: 1143916 - protein, 23 aa, Mycobacterium
RVHPLWWTAALFGTVIGLVVVCS

SEQ ID NO: 1143917 - protein, 25 aa, Mycobacterium
RWPWVVIGVWVAMAVALPLSFPSLG

SEQ ID NO: 1143918 - protein, 24 aa, Mycobacterium
SDGTAWLRLAWAGVLLLVVVRPRP

SEQ ID NO: 1143919 - protein, 22 aa, Mycobacterium
SDLWRLLPYLMPYRVRWIAMFV

SEQ ID NO: 1143920 - protein, 30 aa, Mycobacterium
SFSGFEHPWFFLFLIVVLALAGLYVIVALA

SEQ ID NO: 1143921 - protein, 24 aa, Mycobacterium
SGPWWPLPFWIALAGLTPTGLLLA

SEQ ID NO: 1143922 - protein, 19 aa, Mycobacterium
SLFLALWLVWAPALFRSLD

SEQ ID NO: 1143923 - protein, 17 aa, Mycobacterium
SLRILLPLSIIGAIILV

SEQ ID NO: 1143924 - protein, 26 aa, Mycobacterium
SLVVGLLMFLLLGRPLAWLTTSLTDW

SEQ ID NO: 1143925 - protein, 29 aa, Mycobacterium
SPANWPVRWKVLAIVLVPLVLAGVFGGAR

SEQ ID NO: 1143926 - protein, 25 aa, Mycobacterium
SVGEQFWLVWPLLLLLVGLLKARKA

SEQ ID NO: 1143927 - protein, 20 aa, Mycobacterium
SVLVTGPWLAGVSSLIAVLR

SEQ ID NO: 1143928 - protein, 22 aa, Mycobacterium
SVRAWLVVALMNIAMIALHLPA

SEQ ID NO: 1143929 - protein, 24 aa, Mycobacterium
SWAVPLNWWVMLAGFVLFVSPVGR

SEQ ID NO: 1143930 - protein, 18 aa, Mycobacterium
SYGAFFPYYICGITFRAS

SEQ ID NO: 1143931 - protein, 17 aa, Mycobacterium
SYMILLSVPLVAPVLVR

SEQ ID NO: 1143932 - protein, 17 aa, Mycobacterium
TAEPLPIPWSVLSLFAP

SEQ ID NO: 1143933 - protein, 24 aa, Mycobacterium
TAKVWVFLFVYIWLRGTLPRLRYD

SEQ ID NO: 1143934 - protein, 22 aa, Mycobacterium
TDRLWPLRWLRNAALLFTFLNA

SEQ ID NO: 1143935 - protein, 23 aa, Mycobacterium
TGPAKWIRRFAIPIILGWILLVA

SEQ ID NO: 1143936 - protein, 18 aa, Mycobacterium
TMVLFPMYFLKSFAYAGV

SEQ ID NO: 1143937 - protein, 23 aa, Mycobacterium
TSMFVFIGAVVYLMAAPRGREDP

SEQ ID NO: 1143938 - protein, 22 aa, Mycobacterium
TSSAIIVLLVAILYVMFKRRDW

SEQ ID NO: 1143939 - protein, 32 aa, Mycobacterium
TVIVGIILVLLLRALLAPIYLLGTVLLNYLAS

SEQ ID NO: 1143940 - protein, 18 aa, Mycobacterium
TVLIIFTLNILLAEFGAA

SEQ ID NO: 1143941 - protein, 24 aa, Mycobacterium
VAAPSYAWFVAAWVLAGVAMSAVF

SEQ ID NO: 1143942 - protein, 28 aa, Mycobacterium
VAGVGVGWFWILFIAVPAVAIVLAALWS

SEQ ID NO: 1143943 - protein, 17 aa, Mycobacterium
VARHRLLPRLMPGGDYV

SEQ ID NO: 1143944 - protein, 25 aa, Mycobacterium
VARLWRWLLVFFSRWWQLETLYRSN

SEQ ID NO: 1143945 - protein, 28 aa, Mycobacterium
VAVGLAYPVLIWLVAQLPGLRDQADGSL

SEQ ID NO: 1143946 - protein, 23 aa, Mycobacterium
VGGIVYFLIFWVSAFHRKKASDT

SEQ ID NO: 1143947 - protein, 18 aa, Mycobacterium
VIPLLLWIASVYDVLRNL

SEQ ID NO: 1143948 - protein, 24 aa, Mycobacterium
VIQPPLLLFITVPGAYFLFHGSEI

SEQ ID NO: 1143949 - protein, 24 aa, Mycobacterium
VKVFGFLLLGLVVAAAVVALLNEL

SEQ ID NO: 1143950 - protein, 24 aa, Mycobacterium
VLEPWLTFLRALPPLAYFFLLVIW

SEQ ID NO: 1143951 - protein, 18 aa, Mycobacterium
VLIAGGLGWVLAGPAIRP

SEQ ID NO: 1143952 - protein, 30 aa, Mycobacterium
VLLVGWLLAIPVPLLLIWAPSWTWVIVANV

SEQ ID NO: 1143953 - protein, 17 aa, Mycobacterium
VLPTLVILLDFLQQELP

SEQ ID NO: 1143954 - protein, 18 aa, Mycobacterium
VLTVIALVALGWYYLRVP

SEQ ID NO: 1143955 - protein, 27 aa, Mycobacterium
VPVLPAPVFRPPVVLPPPVIRLPRPQL

SEQ ID NO: 1143956 - protein, 19 aa, Mycobacterium
VPWWWWLPGLGLAGLIAYE

SEQ ID NO: 1143957 - protein, 24 aa, Mycobacterium
VQGQFYIAFLLLVFGMAFLLRGLL

SEQ ID NO: 1143958 - protein, 22 aa, Mycobacterium
VQPFGEYLPWRGFFSKLSPYAE

SEQ ID NO: 1143959 - protein, 24 aa, Mycobacterium
VRLLRARWMAVCVTTLITFLGAVA

SEQ ID NO: 1143960 - protein, 17 aa, Mycobacterium
VRPFLLFGDAPAGVDVP

SEQ ID NO: 1143961 - protein, 23 aa, Mycobacterium
VSAFLWSLYALFFGTAGTAGMTH

SEQ ID NO: 1143962 - protein, 23 aa, Mycobacterium
VTIFLIIGMLLLVYRSVSSVFMP

SEQ ID NO: 1143963 - protein, 21 aa, Mycobacterium
VVFIVAVIFFSGFFVGKQYGG

SEQ ID NO: 1143964 - protein, 19 aa, Mycobacterium
VVFLVTWPLVYLASKTTWA

SEQ ID NO: 1143965 - protein, 19 aa, Mycobacterium
VVIVVRFLWIFPVATIDER

SEQ ID NO: 1143966 - protein, 20 aa, Mycobacterium
VVLIVLPLVTFGMAYMIVDV

SEQ ID NO: 1143967 - protein, 25 aa, Mycobacterium
VVSTLAYLLLFMLTRGWLGAQAANL

SEQ ID NO: 1143968 - protein, 23 aa, Mycobacterium
VVYGLAFFFGAFFTVQEAFASVR

SEQ ID NO: 1143969 - protein, 17 aa, Mycobacterium
VWIAIAVIAVLLVVALV

SEQ ID NO: 1143970 - protein, 23 aa, Mycobacterium
VYLWHWPIFLFLNGERTGWTGWR

SEQ ID NO: 1143971 - protein, 18 aa, Mycobacterium
WFADWPPAAKLAAWGIQL

SEQ ID NO: 1143972 - protein, 19 aa, Mycobacterium
WINLIIAIPVVAFSTMFAM

SEQ ID NO: 1143973 - protein, 19 aa, Mycobacterium
WLIRRRLMRQTHGLRPDEL

SEQ ID NO: 1143974 - protein, 21 aa, Mycobacterium
WLQAFLPYIGFLCIIGLLSYH

SEQ ID NO: 1143975 - protein, 17 aa, Mycobacterium
WVIVIAVFVLLFGAKKL

SEQ ID NO: 1143976 - protein, 18 aa, Mycobacterium
WWPLLWFTAKVWVFLFVY

SEQ ID NO: 1143977 - protein, 21 aa, Mycobacterium
YDIALFYRYAWRNPTFTEIVA

SEQ ID NO: 1143978 - protein, 19 aa, Mycobacterium
YFFLLVIWLGIDEAPKITL

SEQ ID NO: 1143979 - protein, 20 aa, Mycobacterium
YILATQYWLLPSAGPLLLVL

SEQ ID NO: 1143980 - protein, 19 aa, Mycobacterium
YINLIVLLRIACEVTATVL

SEQ ID NO: 1143981 - protein, 20 aa, Mycobacterium
YLAALLAYPRYFPPISLWTG

SEQ ID NO: 1143982 - protein, 19 aa, Mycobacterium
YPYREPLPAPPPGGPPPGP

SEQ ID NO: 1143983 - protein, 23 aa, Mycobacterium
YVLWWAVLFPAINVPIIASLVLA

SEQ ID NO: 1143984 - protein, 18 aa, Mycobacterium
YWLLVILAAAIATSFLAE

SEQ ID NO: 1143985 - protein, 20 aa, Mycobacterium
YYVMLTFVARPYLIPSESME

SEQ ID NO: 1143986 - protein, 21 aa, Mycobacterium
AAAALIGWWAARRRLRGGADR

SEQ ID NO: 1143987 - protein, 22 aa, Mycobacterium
AAALCWLWPAGAGLLIRFTGPP

SEQ ID NO: 1143988 - protein, 19 aa, Mycobacterium
AAALFVLIALSPAALQVHL

SEQ ID NO: 1143989 - protein, 23 aa, Mycobacterium
AAARPLWFVCMALGLVILGLGLF

SEQ ID NO: 1143990 - protein, 25 aa, Mycobacterium
AAAVLILLPLLTFGMAYMIVDVPKP

SEQ ID NO: 1143991 - protein, 23 aa, Mycobacterium
AADLILFFVFFDLSIVAMYFVIA

SEQ ID NO: 1143992 - protein, 25 aa, Mycobacterium
AAEMVHFFAVLFWAAGVLAFVAGMP

SEQ ID NO: 1143993 - protein, 22 aa, Mycobacterium
AAFGLTMVLLTAGLFVIFGEYR

SEQ ID NO: 1143994 - protein, 20 aa, Mycobacterium
AAFWLVLVALIGGTATFLVW

SEQ ID NO: 1143995 - protein, 21 aa, Mycobacterium
AAFWLVLVALLGGTATFLVWW

SEQ ID NO: 1143996 - protein, 21 aa, Mycobacterium
AAGLFLAFWLPLNNGLRPEPI

SEQ ID NO: 1143997 - protein, 26 aa, Mycobacterium
AAGYVLWWAVLFPAISLPIIASLVLA

SEQ ID NO: 1143998 - protein, 18 aa, Mycobacterium
AAHSWLGLPGWVAVHALL

SEQ ID NO: 1143999 - protein, 23 aa, Mycobacterium
AAIPFAIWFFLAIEGVPLAAEET

SEQ ID NO: 1144000 - protein, 22 aa, Mycobacterium
AAITFVLLFLLTGSVVLPLKAL

SEQ ID NO: 1144001 - protein, 17 aa, Mycobacterium
AAITLAPWLLTAAILVP

SEQ ID NO: 1144002 - protein, 17 aa, Mycobacterium
AAIWLTVATLVVAAIIG

SEQ ID NO: 1144003 - protein, 23 aa, Mycobacterium
AAKLFFVSALLMLLGLVGGLTLD

SEQ ID NO: 1144004 - protein, 24 aa, Mycobacterium
AALFRRVFLINGLIFTLGTLVLAV

SEQ ID NO: 1144005 - protein, 24 aa, Mycobacterium
AALLVWSVLMLLLMRWASPGVVDD

SEQ ID NO: 1144006 - protein, 20 aa, Mycobacterium
AALMLLLPRIHRAIPESLAA

SEQ ID NO: 1144007 - protein, 20 aa, Mycobacterium
AALPPLLIYAILGSSRQLSV

SEQ ID NO: 1144008 - protein, 24 aa, Mycobacterium
AALVALVPLAFWVSGIYGLVRQLS

SEQ ID NO: 1144009 - protein, 22 aa, Mycobacterium
AALVLLVVVVAFGLWLGVRALD

SEQ ID NO: 1144010 - protein, 19 aa, Mycobacterium
AALWRLPVLFCCENNLYAM

SEQ ID NO: 1144011 - protein, 21 aa, Mycobacterium
AAMLLFPMYFLKSFAYAGLAT

SEQ ID NO: 1144012 - protein, 25 aa, Mycobacterium
AAPILIVMILLVIPLGQLALGGISE

SEQ ID NO: 1144013 - protein, 20 aa, Mycobacterium
AAPPRQLWLPPLGAPPAADD

SEQ ID NO: 1144014 - protein, 30 aa, Mycobacterium
AAPVQGLWWALYLVFIALLSGALSVLLERE

SEQ ID NO: 1144015 - protein, 27 aa, Mycobacterium
AARKRIAWWILLLYMVAAVGWNVADLL

SEQ ID NO: 1144016 - protein, 25 aa, Mycobacterium
AARKRIAWWILVGYMIAAAGWNIAG

SEQ ID NO: 1144017 - protein, 23 aa, Mycobacterium
AASWLWVVASGGLYLWVLKAAGD

SEQ ID NO: 1144018 - protein, 23 aa, Mycobacterium
AASYALIGFWWREQYRVSDGLTA

SEQ ID NO: 1144019 - protein, 27 aa, Mycobacterium
AATQHLRIPLPRRPWLPPLQATYALED

SEQ ID NO: 1144020 - protein, 25 aa, Mycobacterium
AAVLLYSLLYYRLLGVLIALSLVAS

SEQ ID NO: 1144021 - protein, 17 aa, Mycobacterium
ACYLLFLAVFLYAIGFV

SEQ ID NO: 1144022 - protein, 26 aa, Mycobacterium
ADAELAPPPRWPWVVGIVAIVAAIAL

SEQ ID NO: 1144023 - protein, 22 aa, Mycobacterium
ADAWGWRWVFVPLVPVALAGLI

SEQ ID NO: 1144024 - protein, 22 aa, Mycobacterium
ADRRVLWRRRIWLPFAGIAGRT

SEQ ID NO: 1144025 - protein, 24 aa, Mycobacterium
ADSATPWYRKPVALVSFGAVGALL

SEQ ID NO: 1144026 - protein, 25 aa, Mycobacterium
AERPRLRIPLWSLLLLGAAALIVSM

SEQ ID NO: 1144027 - protein, 24 aa, Mycobacterium
AEVVPPVIPVLPPITEYLPEITDI

SEQ ID NO: 1144028 - protein, 20 aa, Mycobacterium
AFAVLFLPYSLLGPFAGALL

SEQ ID NO: 1144029 - protein, 23 aa, Mycobacterium
AFPIIVVMILLIIPLGQLSLGGI

SEQ ID NO: 1144030 - protein, 19 aa, Mycobacterium
AFQFFYLVLPLLRGAYEAT

SEQ ID NO: 1144031 - protein, 19 aa, Mycobacterium
AFRDGAWVDLPPLQHARVA

SEQ ID NO: 1144032 - protein, 24 aa, Mycobacterium
AFSIMAFNYMKLPNLLFGIGRYSV

SEQ ID NO: 1144033 - protein, 21 aa, Mycobacterium
AFTASFLAAGWRPGEPFPGGA

SEQ ID NO: 1144034 - protein, 18 aa, Mycobacterium
AFVAALMLLLPRIHRAIP

SEQ ID NO: 1144035 - protein, 18 aa, Mycobacterium
AGAPFVWTLLLAGAVFAL

SEQ ID NO: 1144036 - protein, 17 aa, Mycobacterium
AGFLVVIPLYCVGVLMA

SEQ ID NO: 1144037 - protein, 17 aa, Mycobacterium
AGGFTMFMLIPLGIVLG

SEQ ID NO: 1144038 - protein, 25 aa, Mycobacterium
AGGIALVVLWRWRWVRLAAGAAVLG

SEQ ID NO: 1144039 - protein, 23 aa, Mycobacterium
AGPAWFILLFLIPLLLSIFVMRY

SEQ ID NO: 1144040 - protein, 23 aa, Mycobacterium
AGRLWFVEVLVWVLVGLALLCAT

SEQ ID NO: 1144041 - protein, 26 aa, Mycobacterium
AGSIFAALLFWWTWYRLETKRRSDLT

SEQ ID NO: 1144042 - protein, 25 aa, Mycobacterium
AGVVFIIAAIFFSGFVLGAHSGGDF

SEQ ID NO: 1144043 - protein, 22 aa, Mycobacterium
AIAVPAHWGPGTVGALRGALRA

SEQ ID NO: 1144044 - protein, 21 aa, Mycobacterium
AILLAMYWPLGVVVLVSIVPI

SEQ ID NO: 1144045 - protein, 30 aa, Mycobacterium
AIRDAVLILLVFVAALVLVLLVARSLVRPL

SEQ ID NO: 1144046 - protein, 24 aa, Mycobacterium
AIVLYYVMLTFVARPYLIPSESME

SEQ ID NO: 1144047 - protein, 20 aa, Mycobacterium
AIVMLLAFWGAVIAALAALL

SEQ ID NO: 1144048 - protein, 23 aa, Mycobacterium
AIVVLPLLRPLRLLRLVTLVAVL

SEQ ID NO: 1144049 - protein, 24 aa, Mycobacterium
AIYNYTWLILQLPFGIVGVTVLTV

SEQ ID NO: 1144050 - protein, 25 aa, Mycobacterium
AIYTTVILLPTLWLGAIPGAPQRRA

SEQ ID NO: 1144051 - protein, 35 aa, Mycobacterium
AKPAKPRSFRRLWLLLTAPFAVLAGLYLGDLILSS

SEQ ID NO: 1144052 - protein, 24 aa, Mycobacterium
ALAASLLWLFRWPSRAQSLAYSTV

SEQ ID NO: 1144053 - protein, 23 aa, Mycobacterium
ALALLLTRLYAPLTALANARVEI

SEQ ID NO: 1144054 - protein, 23 aa, Mycobacterium
ALAVLLRRALVRPLSRLAASCRR

SEQ ID NO: 1144055 - protein, 17 aa, Mycobacterium
ALCAALALIIFICWSLF

SEQ ID NO: 1144056 - protein, 24 aa, Mycobacterium
ALGLIFIIMLILTRAIVAAAVIVG

SEQ ID NO: 1144057 - protein, 19 aa, Mycobacterium
ALGLVVVVLPLLWCQAAKA

SEQ ID NO: 1144058 - protein, 26 aa, Mycobacterium
ALHPAWWTLILLVVLVTIVMVTSAMF

SEQ ID NO: 1144059 - protein, 22 aa, Mycobacterium
ALILLLKPLLTMLFLRAGAAGG

SEQ ID NO: 1144060 - protein, 24 aa, Mycobacterium
ALIPLILIAFGVLWPVVFHGGSSA

SEQ ID NO: 1144061 - protein, 20 aa, Mycobacterium
ALLFALWVLAAAIWGPDGSD

SEQ ID NO: 1144062 - protein, 20 aa, Mycobacterium
ALLFMFGLGSLFGRAGLAVG

SEQ ID NO: 1144063 - protein, 21 aa, Mycobacterium
ALLSLFYLFPTLLGVFSRLYV

SEQ ID NO: 1144064 - protein, 26 aa, Mycobacterium
ALMFGLILMWLLSWLIATPVRVVRSA

SEQ ID NO: 1144065 - protein, 18 aa, Mycobacterium
ALQWVVWLALLNNVAAEF

SEQ ID NO: 1144066 - protein, 26 aa, Mycobacterium
ALRGRPWIPVWLNLATLAGVMLTQMT

SEQ ID NO: 1144067 - protein, 19 aa, Mycobacterium
ALTALFVTWYFSRRLQHSI

SEQ ID NO: 1144068 - protein, 17 aa, Mycobacterium
ALTALVVTWYFSRRLQH

SEQ ID NO: 1144069 - protein, 18 aa, Mycobacterium
ALTLVLIALAWRNRELWL

SEQ ID NO: 1144070 - protein, 22 aa, Mycobacterium
ALVAAAITLWLGLVGQFGELVG

SEQ ID NO: 1144071 - protein, 18 aa, Mycobacterium
ALVAFIGLPPARFGWWPA

SEQ ID NO: 1144072 - protein, 20 aa, Mycobacterium
ALYRFVGLILPLAAFMVACV

SEQ ID NO: 1144073 - protein, 24 aa, Mycobacterium
AMLLLMLGRRWILTLVAVALTVAL

SEQ ID NO: 1144074 - protein, 30 aa, Mycobacterium
AMVPVLQFTYWQWLSLTLAAPVVVWGAWPF

SEQ ID NO: 1144075 - protein, 23 aa, Mycobacterium
APHMLMIGYFLLSGALFFTAVGG

SEQ ID NO: 1144076 - protein, 23 aa, Mycobacterium
APHTLWVWIALSGFAFGVLVSGW

SEQ ID NO: 1144077 - protein, 23 aa, Mycobacterium
APLVISGWTLVVWMLVAIGSGIG

SEQ ID NO: 1144078 - protein, 20 aa, Mycobacterium
APLWPFHRWLPDAAVEATPA

SEQ ID NO: 1144079 - protein, 23 aa, Mycobacterium
APSDGLPVWPFVAAATVIVAAGA

SEQ ID NO: 1144080 - protein, 31 aa, Mycobacterium
AQQMRAFVALRWWPLVLLVAVTVALVALAAY

SEQ ID NO: 1144081 - protein, 20 aa, Mycobacterium
ARLELLWLGITLGVLIGLAS

SEQ ID NO: 1144082 - protein, 23 aa, Mycobacterium
ARPHAVLWSQWRFAFEPMFVVAV

SEQ ID NO: 1144083 - protein, 20 aa, Mycobacterium
ARRWAPRGALAFLTLSVVLV

SEQ ID NO: 1144084 - protein, 18 aa, Mycobacterium
ASALLLYRLARRGRDDVA

SEQ ID NO: 1144085 - protein, 17 aa, Mycobacterium
ASFPPLSWWICAIAGLA

SEQ ID NO: 1144086 - protein, 24 aa, Mycobacterium
ASHMLMIGYFLLSGALFFTAVGGV

SEQ ID NO: 1144087 - protein, 17 aa, Mycobacterium
ASLALALLFWQWRKIPF

SEQ ID NO: 1144088 - protein, 23 aa, Mycobacterium
ASLGLPLLFVLYLRESDVFRDLP

SEQ ID NO: 1144089 - protein, 24 aa, Mycobacterium
ASSGPPTWVLFAAGLGALVVVGGG

SEQ ID NO: 1144090 - protein, 21 aa, Mycobacterium
ASSYAWFVAAWVLAGVAMSAV

SEQ ID NO: 1144091 - protein, 23 aa, Mycobacterium
ASVVLMQWWLMPAATGLFRRWLD

SEQ ID NO: 1144092 - protein, 24 aa, Mycobacterium
ATAGYLGWLLWQQNQVSRAGEQAQ

SEQ ID NO: 1144093 - protein, 19 aa, Mycobacterium
ATLWLTWPFGPAGALGGFA

SEQ ID NO: 1144094 - protein, 19 aa, Mycobacterium
AVAIEVIWWVQGRVLGEHR

SEQ ID NO: 1144095 - protein, 25 aa, Mycobacterium
AVALVWLWAAILIPLGRLLWLWYRR

SEQ ID NO: 1144096 - protein, 19 aa, Mycobacterium
AVFCAFLLLLLAVGFVIKY

SEQ ID NO: 1144097 - protein, 18 aa, Mycobacterium
AVFLNYGLVLMAFPAVAV

SEQ ID NO: 1144098 - protein, 25 aa, Mycobacterium
AVGADYFLVSPKPPVRWGLPLVSVI

SEQ ID NO: 1144099 - protein, 24 aa, Mycobacterium
AVGLIFIIMLILTRAIVAAAVIVG

SEQ ID NO: 1144100 - protein, 22 aa, Mycobacterium
AVGLLLLVLVLNVAVPFAVQAI

SEQ ID NO: 1144101 - protein, 20 aa, Mycobacterium
AVGWFLPLLGLSLAAFVAVD

SEQ ID NO: 1144102 - protein, 19 aa, Mycobacterium
AVLLYSLLYYRVLGVLIAL

SEQ ID NO: 1144103 - protein, 19 aa, Mycobacterium
AVLWFIRRWLVSRATMGVE

SEQ ID NO: 1144104 - protein, 22 aa, Mycobacterium
AVRRWALILIPLGVAVFAVPGV

SEQ ID NO: 1144105 - protein, 25 aa, Mycobacterium
AVTVLLLWPLLIEPLLANLPGRGWQ

SEQ ID NO: 1144106 - protein, 23 aa, Mycobacterium
AVVPHVRWPMWLRTLLAVVALAA

SEQ ID NO: 1144107 - protein, 17 aa, Mycobacterium
AVWRLLRQFHNVLIYLM

SEQ ID NO: 1144108 - protein, 19 aa, Mycobacterium
AWDLIGHLPLPLGVAGHEG

SEQ ID NO: 1144109 - protein, 18 aa, Mycobacterium
AWFLRFLVRHSMYWFVGY

SEQ ID NO: 1144110 - protein, 24 aa, Mycobacterium
AWGESALRWLLFAGLAAAVGGLIG

SEQ ID NO: 1144111 - protein, 21 aa, Mycobacterium
AYGKVLFFITLTGGAVLVLLV

SEQ ID NO: 1144112 - protein, 25 aa, Mycobacterium
AYLAFAVPSLLFTIPLQLLTGQRSA

SEQ ID NO: 1144113 - protein, 20 aa, Mycobacterium
AYLAIFFVVPFYSLARTSLS

SEQ ID NO: 1144114 - protein, 18 aa, Mycobacterium
CALFVGCDRTRRLRLLGA

SEQ ID NO: 1144115 - protein, 25 aa, Mycobacterium
CALILFMMFWLVLPLSMRDGAPKPP

SEQ ID NO: 1144116 - protein, 17 aa, Mycobacterium
CFHLLWVTGATIGGLVG

SEQ ID NO: 1144117 - protein, 23 aa, Mycobacterium
CGDFLLAIPWWEPSFVLGLASFL

SEQ ID NO: 1144118 - protein, 19 aa, Mycobacterium
CIIAGIIVALVLGDRRWEA

SEQ ID NO: 1144119 - protein, 21 aa, Mycobacterium
CSGLLLQWWSWESIFIGFAAA

SEQ ID NO: 1144120 - protein, 30 aa, Mycobacterium
CVDADTRLYLPMPFFWIGGLGGGLLSALTA

SEQ ID NO: 1144121 - protein, 21 aa, Mycobacterium
DAGLFFIAFVRNPVTQFVPMQ

SEQ ID NO: 1144122 - protein, 21 aa, Mycobacterium
DALFWLAFIVAISAAAFVIPP

SEQ ID NO: 1144123 - protein, 19 aa, Mycobacterium
DALLPPRLRSRPGARARLF

SEQ ID NO: 1144124 - protein, 27 aa, Mycobacterium
DANYGTWWFWLGLILIVGILLLVGNLE

SEQ ID NO: 1144125 - protein, 17 aa, Mycobacterium
DATVIRMFLVPALMKWL

SEQ ID NO: 1144126 - protein, 28 aa, Mycobacterium
DAVVDPILRLFGFGALAAAPLAAVEAVA

SEQ ID NO: 1144127 - protein, 25 aa, Mycobacterium
DCEPGWPWPWPWPDDPDDRPKPDDG

SEQ ID NO: 1144128 - protein, 21 aa, Mycobacterium
DCGFGWFFYDFGTAVSFIEDD

SEQ ID NO: 1144129 - protein, 24 aa, Mycobacterium
DDPEEFWLLLAGRRLDARDRRVLG

SEQ ID NO: 1144130 - protein, 20 aa, Mycobacterium
DDVYLPLWVRRVAWVATIVL

SEQ ID NO: 1144131 - protein, 20 aa, Mycobacterium
DFLLAIPWWEPSFVLGLASF

SEQ ID NO: 1144132 - protein, 24 aa, Mycobacterium
DGALVLVVPTWWPSGRADVVAAAG

SEQ ID NO: 1144133 - protein, 26 aa, Mycobacterium
DGLVFALSLFLLAWVLVLRGVYESFR

SEQ ID NO: 1144134 - protein, 22 aa, Mycobacterium
DGPYYFFGVLSALAALPGFTPM

SEQ ID NO: 1144135 - protein, 23 aa, Mycobacterium
DGWVRWMFIVALAVTFFLMAANR

SEQ ID NO: 1144136 - protein, 20 aa, Mycobacterium
DHMPELHWTFGYPAVLMVMI

SEQ ID NO: 1144137 - protein, 18 aa, Mycobacterium
DILWSLFQAVLMGFVVML

SEQ ID NO: 1144138 - protein, 18 aa, Mycobacterium
DILYYSAPWMLILGLAMS

SEQ ID NO: 1144139 - protein, 23 aa, Mycobacterium
DIVVVFLVTWPLVYMASKSTLWA

SEQ ID NO: 1144140 - protein, 17 aa, Mycobacterium
DLDLYLRIAPELYLKRL

SEQ ID NO: 1144141 - protein, 33 aa, Mycobacterium
DLGFYAFDLPFYRLMLTYLFAATFLAFIANLLG

SEQ ID NO: 1144142 - protein, 23 aa, Mycobacterium
DLPFFPLPWLLDVAMWVLALSSV

SEQ ID NO: 1144143 - protein, 26 aa, Mycobacterium
DLREPWPGLRWRPLLIAAAALLVWSV

SEQ ID NO: 1144144 - protein, 17 aa, Mycobacterium
DMRALFTAIINDDPLPG

SEQ ID NO: 1144145 - protein, 23 aa, Mycobacterium
DNDNFWFSWIVPLAAIIFAGAFT

SEQ ID NO: 1144146 - protein, 25 aa, Mycobacterium
DPEDPAWAWLKWLPHLQHETDTDAA

SEQ ID NO: 1144147 - protein, 26 aa, Mycobacterium
DQNNPLPPPWYPQPGPPPAPAPGVVQ

SEQ ID NO: 1144148 - protein, 18 aa, Mycobacterium
DSLPLLPFLTVVVIFLII

SEQ ID NO: 1144149 - protein, 17 aa, Mycobacterium
DSRLWIAIAVLAGLLVA

SEQ ID NO: 1144150 - protein, 22 aa, Mycobacterium
DSVLVTGPWLAGVSSLIAVLRD

SEQ ID NO: 1144151 - protein, 18 aa, Mycobacterium
DTSSGWLPWALGGLFVAG

SEQ ID NO: 1144152 - protein, 30 aa, Mycobacterium
DTYTDELAPLPWYKRPPVLFGVAAAAALLA

SEQ ID NO: 1144153 - protein, 19 aa, Mycobacterium
DVYLPLWVRRVAWVATIVL

SEQ ID NO: 1144154 - protein, 23 aa, Mycobacterium
DVYSLACTLFRLLTGEHPYPTDA

SEQ ID NO: 1144155 - protein, 24 aa, Mycobacterium
DWAYHLVLPWFTLAVLFIGFYSRV

SEQ ID NO: 1144156 - protein, 23 aa, Mycobacterium
DWLQAFLPYIGFLCIIGLLSYHL

SEQ ID NO: 1144157 - protein, 19 aa, Mycobacterium
EAASWWKALLALVVAVALI

SEQ ID NO: 1144158 - protein, 20 aa, Mycobacterium
EAVLWFIRRWLVSRATMGVE

SEQ ID NO: 1144159 - protein, 22 aa, Mycobacterium
EAVLWFIRRWLVSRATMGVEAD

SEQ ID NO: 1144160 - protein, 20 aa, Mycobacterium
EDLLLLARLDAQRPLDRHRV

SEQ ID NO: 1144161 - protein, 24 aa, Mycobacterium
EEPQPWYRKPGALIALGAIAALLV

SEQ ID NO: 1144162 - protein, 20 aa, Mycobacterium
EFILQAWFLFRVSFLPTVAV

SEQ ID NO: 1144163 - protein, 26 aa, Mycobacterium
EGRDAWFSMLAFWFFAAGWAASKAST

SEQ ID NO: 1144164 - protein, 34 aa, Mycobacterium
EIVHPTFLYELVWNLLVFAVLIWADRRFNLGHGR

SEQ ID NO: 1144165 - protein, 18 aa, Mycobacterium
ELLALFAGAVLRGADLNT

SEQ ID NO: 1144166 - protein, 20 aa, Mycobacterium
ELWTSLWWIAQGWAYAAVAT

SEQ ID NO: 1144167 - protein, 21 aa, Mycobacterium
EPALRPLVDLLPIAGGSGTLS

SEQ ID NO: 1144168 - protein, 17 aa, Mycobacterium
ERWSWWIWVAIAGGLVS

SEQ ID NO: 1144169 - protein, 24 aa, Mycobacterium
ESGTILWLILLLSAFSWMISARIV

SEQ ID NO: 1144170 - protein, 18 aa, Mycobacterium
EWQLFLSAQWLAAAGSIF

SEQ ID NO: 1144171 - protein, 22 aa, Mycobacterium
EYRVWFFHRLLWITPVVTLYFW

SEQ ID NO: 1144172 - protein, 22 aa, Mycobacterium
FAIGAIIPLIPYLLGYESLWVG

SEQ ID NO: 1144173 - protein, 17 aa, Mycobacterium
FAKILRARWITVAVTLV

SEQ ID NO: 1144174 - protein, 18 aa, Mycobacterium
FALFPLLMLGFSVGGFVL

SEQ ID NO: 1144175 - protein, 20 aa, Mycobacterium
FALIMIFAQLRFAPSNHYDA

SEQ ID NO: 1144176 - protein, 24 aa, Mycobacterium
FALSWWLGLYLLARDPRKAVLVLA

SEQ ID NO: 1144177 - protein, 17 aa, Mycobacterium
FATIALFQLLWARLVLA

SEQ ID NO: 1144178 - protein, 21 aa, Mycobacterium
FAVCWAWINFSWFASAYDTDD

SEQ ID NO: 1144179 - protein, 17 aa, Mycobacterium
FAVLLELSRPRDTWRSR

SEQ ID NO: 1144180 - protein, 23 aa, Mycobacterium
FAYLLLPQIIFYGLSSVFMAILN

SEQ ID NO: 1144181 - protein, 23 aa, Mycobacterium
FAYLLLPQVLFYGLSSVFMAILN

SEQ ID NO: 1144182 - protein, 20 aa, Mycobacterium
FDLKGIIKLLASLFGLTWAN

SEQ ID NO: 1144183 - protein, 22 aa, Mycobacterium
FDNWQWLALTLASPVVVWGAWP

SEQ ID NO: 1144184 - protein, 19 aa, Mycobacterium
FDVLLYAALLVMLLFALFS

SEQ ID NO: 1144185 - protein, 20 aa, Mycobacterium
FFATIALFQLLWARLVLART

SEQ ID NO: 1144186 - protein, 18 aa, Mycobacterium
FFDIQWPWSTGIYSVIVV

SEQ ID NO: 1144187 - protein, 18 aa, Mycobacterium
FFVLSGFLLFRPWVRAAA

SEQ ID NO: 1144188 - protein, 23 aa, Mycobacterium
FGAPAHRVWLPPLSRASALDAVL

SEQ ID NO: 1144189 - protein, 26 aa, Mycobacterium
FGAVGALLIALVVFGLARAITGDSTS

SEQ ID NO: 1144190 - protein, 18 aa, Mycobacterium
FGGVCVAFWFLPGAKEPV

SEQ ID NO: 1144191 - protein, 26 aa, Mycobacterium
FGQAIAWPVPLLAFILLVAVGADYNM

SEQ ID NO: 1144192 - protein, 18 aa, Mycobacterium
FGQLWRTDRRRTLWLLWV

SEQ ID NO: 1144193 - protein, 28 aa, Mycobacterium
FGRKVSYAGLAILLLTALMVGALGGWVG

SEQ ID NO: 1144194 - protein, 17 aa, Mycobacterium
FGVLLYYAIANASAWTL

SEQ ID NO: 1144195 - protein, 22 aa, Mycobacterium
FGYTSLPFWPQGKSYEAYFADA

SEQ ID NO: 1144196 - protein, 18 aa, Mycobacterium
FLAPLYFAFGVVAALLGE

SEQ ID NO: 1144197 - protein, 21 aa, Mycobacterium
FLAPWLFFMFIDLFDSDRAGM

SEQ ID NO: 1144198 - protein, 17 aa, Mycobacterium
FLIAVYWLAVRTATGQA

SEQ ID NO: 1144199 - protein, 17 aa, Mycobacterium
FLIFAFVAIGLEFSLRG

SEQ ID NO: 1144200 - protein, 30 aa, Mycobacterium
FLIPNGTFFVVLLIFLIVLGVIAKWVVPPV

SEQ ID NO: 1144201 - protein, 24 aa, Mycobacterium
FLSWGWRIPFLVSLLLLAVGIYVR

SEQ ID NO: 1144202 - protein, 27 aa, Mycobacterium
FLVTVLVVVLILTLVWMQFRGAFTPEV

SEQ ID NO: 1144203 - protein, 17 aa, Mycobacterium
FLVVIPLYCVGVLMAFW

SEQ ID NO: 1144204 - protein, 17 aa, Mycobacterium
FLVWWAVGAGVQSALLF

SEQ ID NO: 1144205 - protein, 20 aa, Mycobacterium
FPALLIVVALLIGSALLSHP

SEQ ID NO: 1144206 - protein, 17 aa, Mycobacterium
FPFFLWPVDGAMAAAGV

SEQ ID NO: 1144207 - protein, 17 aa, Mycobacterium
FPYVLMKPKLIVATILG

SEQ ID NO: 1144208 - protein, 17 aa, Mycobacterium
FPYYICGITFRASDLEG

SEQ ID NO: 1144209 - protein, 19 aa, Mycobacterium
FRHLRRRHIALGGLFVLLV

SEQ ID NO: 1144210 - protein, 24 aa, Mycobacterium
FRQMRPWWLPVVYLTMLAVYVVPR

SEQ ID NO: 1144211 - protein, 27 aa, Mycobacterium
FSGLALLLIFLFWPWEYKPFGDEGEFL

SEQ ID NO: 1144212 - protein, 25 aa, Mycobacterium
FTAKVWVFLFVYIWLRGTLPRLRYD

SEQ ID NO: 1144213 - protein, 24 aa, Mycobacterium
FTDHLTWRWAFWINVPIGIVVLIV

SEQ ID NO: 1144214 - protein, 19 aa, Mycobacterium
FTFLLALLPLFIVRSFIGT

SEQ ID NO: 1144215 - protein, 20 aa, Mycobacterium
FTLIPYTLVLLQLRVFYARE

SEQ ID NO: 1144216 - protein, 17 aa, Mycobacterium
FTTYLPSLFLAAVLTPA

SEQ ID NO: 1144217 - protein, 29 aa, Mycobacterium
FVFRHRAGNAVIFLLLVVAAAQLFTLQVP

SEQ ID NO: 1144218 - protein, 18 aa, Mycobacterium
FVLALLWKRFDLSRRGWL

SEQ ID NO: 1144219 - protein, 17 aa, Mycobacterium
FVLPFLTAYFAWKRQMS

SEQ ID NO: 1144220 - protein, 24 aa, Mycobacterium
FVLSGFLLFLPWVSAAAAGGPPPS

SEQ ID NO: 1144221 - protein, 18 aa, Mycobacterium
FVTLAWWMAVFPGAAIFV

SEQ ID NO: 1144222 - protein, 17 aa, Mycobacterium
FVVLTWPSGLLLEGDRP

SEQ ID NO: 1144223 - protein, 18 aa, Mycobacterium
FWSLAPLVVACVVLAGLL

SEQ ID NO: 1144224 - protein, 18 aa, Mycobacterium
FYVLLWVGLVALSVLLGP

SEQ ID NO: 1144225 - protein, 18 aa, Mycobacterium
GAAWLPFLVAFLIATITA

SEQ ID NO: 1144226 - protein, 20 aa, Mycobacterium
GAAWLPFLVAFLIATITAFS

SEQ ID NO: 1144227 - protein, 23 aa, Mycobacterium
GAAWLPFLVAFLIATITAFSYLE

SEQ ID NO: 1144228 - protein, 19 aa, Mycobacterium
GALAFLTLSVVLVVVFVVA

SEQ ID NO: 1144229 - protein, 20 aa, Mycobacterium
GALLLLGVLVVSAGWGFGLS

SEQ ID NO: 1144230 - protein, 25 aa, Mycobacterium
GALLPLIAILLPPTTWRVPVTVISV

SEQ ID NO: 1144231 - protein, 21 aa, Mycobacterium
GATAWLYFFQFRPDQETDSEA

SEQ ID NO: 1144232 - protein, 26 aa, Mycobacterium
GAVMLFGLMLPWLGAVAILGAVIFGT

SEQ ID NO: 1144233 - protein, 17 aa, Mycobacterium
GCMLGMIAILIFGGMRN

SEQ ID NO: 1144234 - protein, 22 aa, Mycobacterium
GDFLLAIPWWEPSFVLGLASFL

SEQ ID NO: 1144235 - protein, 24 aa, Mycobacterium
GDHLPFIYPPFAALLFYPLHFLPF

SEQ ID NO: 1144236 - protein, 22 aa, Mycobacterium
GDRVNFVLRYFPLRSHFNAERA

SEQ ID NO: 1144237 - protein, 26 aa, Mycobacterium
GDTGPPWPLWAVIFITSGMVLGAAIV

SEQ ID NO: 1144238 - protein, 20 aa, Mycobacterium
GESRGWPTYLLGGRIRASTA

SEQ ID NO: 1144239 - protein, 27 aa, Mycobacterium
GFEHPWFFLFLIVVLALAGLYVIVALA

SEQ ID NO: 1144240 - protein, 25 aa, Mycobacterium
GFGAPAHRVWLPPLSRAPALDAVLS

SEQ ID NO: 1144241 - protein, 22 aa, Mycobacterium
GFRVPWREQLFLSWAGLRGAVP

SEQ ID NO: 1144242 - protein, 22 aa, Mycobacterium
GFTPLPWQFFAALVALTIGYLV

SEQ ID NO: 1144243 - protein, 27 aa, Mycobacterium
GFYAFDLPFYRLVLSYLFVATFLAFIA

SEQ ID NO: 1144244 - protein, 24 aa, Mycobacterium
GGLAVLIMLMWVGTALVISTSDSR

SEQ ID NO: 1144245 - protein, 25 aa, Mycobacterium
GGLQFMLIIWLQGIWLPLRGYDFEV

SEQ ID NO: 1144246 - protein, 24 aa, Mycobacterium
GGPGALFWMWAVAFLGASTSFVEC

SEQ ID NO: 1144247 - protein, 19 aa, Mycobacterium
GGRTWLLWDGKRSPIDLAD

SEQ ID NO: 1144248 - protein, 18 aa, Mycobacterium
GGWGIRRRLMRQTRGLRP

SEQ ID NO: 1144249 - protein, 19 aa, Mycobacterium
GHEIAWPVPLLAFIILVAV

SEQ ID NO: 1144250 - protein, 18 aa, Mycobacterium
GHMAATICWIAMAAALFG

SEQ ID NO: 1144251 - protein, 17 aa, Mycobacterium
GIIFATIFFLMFTPTKW

SEQ ID NO: 1144252 - protein, 21 aa, Mycobacterium
GIVYFLIFWVSAFHRKKASDT

SEQ ID NO: 1144253 - protein, 21 aa, Mycobacterium
GLAFYVPLLPWISGLVGAVPW

SEQ ID NO: 1144254 - protein, 25 aa, Mycobacterium
GLALLPLLLVLAFVPARRPGPAAQP

SEQ ID NO: 1144255 - protein, 19 aa, Mycobacterium
GLARWRPYLEPALVVLTFG

SEQ ID NO: 1144256 - protein, 22 aa, Mycobacterium
GLAWGLFPILFASAGLSVGRIG

SEQ ID NO: 1144257 - protein, 19 aa, Mycobacterium
GLGPVAFGDGWFYLTERED

SEQ ID NO: 1144258 - protein, 23 aa, Mycobacterium
GLHVHLPQPLPPLWADEQRLSQV

SEQ ID NO: 1144259 - protein, 22 aa, Mycobacterium
GLIIALVPLALFGVLGLAAVVL

SEQ ID NO: 1144260 - protein, 23 aa, Mycobacterium
GLIVALMPLALFGVLGLAAVVLV

SEQ ID NO: 1144261 - protein, 26 aa, Mycobacterium
GLLFGLAFYLPLLPWVANLVGPAPWV

SEQ ID NO: 1144262 - protein, 20 aa, Mycobacterium
GLLIVVVALFLGVDPGTVLP

SEQ ID NO: 1144263 - protein, 24 aa, Mycobacterium
GLLQVWVISLWPPLRWRNQRKALV

SEQ ID NO: 1144264 - protein, 18 aa, Mycobacterium
GLLVEDLLLLARLDAQRP

SEQ ID NO: 1144265 - protein, 17 aa, Mycobacterium
GLPMWLIMSLRIAFVVL

SEQ ID NO: 1144266 - protein, 24 aa, Mycobacterium
GLSFLPTPLAWLLALVALAAAAAL

SEQ ID NO: 1144267 - protein, 24 aa, Mycobacterium
GLSLFMVVAVTLTWLVYVTLRRDV

SEQ ID NO: 1144268 - protein, 19 aa, Mycobacterium
GLSLGLIIALVPLALFGVL

SEQ ID NO: 1144269 - protein, 22 aa, Mycobacterium
GLSLPMFMEELFWGCAGIGLAV

SEQ ID NO: 1144270 - protein, 24 aa, Mycobacterium
GLTVNLMIYWRLWAKYKASTELAG

SEQ ID NO: 1144271 - protein, 28 aa, Mycobacterium
GLVLAYLGLLWWMMVRWSQGLRGRPTSR

SEQ ID NO: 1144272 - protein, 19 aa, Mycobacterium
GLWGIFVLAPWLTPVATFL

SEQ ID NO: 1144273 - protein, 21 aa, Mycobacterium
GLYVFWMMPIFGLAIVLAVRS

SEQ ID NO: 1144274 - protein, 25 aa, Mycobacterium
GMGPLGPLLLLVAFGLLGFAAFQLW

SEQ ID NO: 1144275 - protein, 17 aa, Mycobacterium
GMLNPMLAGAAMAFSSV

SEQ ID NO: 1144276 - protein, 20 aa, Mycobacterium
GPIFLVIYFATGADPMMRWM

SEQ ID NO: 1144277 - protein, 17 aa, Mycobacterium
GPLWWLGAVNIGCGVVF

SEQ ID NO: 1144278 - protein, 31 aa, Mycobacterium
GPNEPLWFGLDAWRWMFLAMALPAVLYGVLA

SEQ ID NO: 1144279 - protein, 19 aa, Mycobacterium
GPRFPLSVIGVVAALALLA

SEQ ID NO: 1144280 - protein, 24 aa, Mycobacterium
GQMVPILIGFLASAIGLGGIGQKI

SEQ ID NO: 1144281 - protein, 17 aa, Mycobacterium
GRIPFWSLLLLGAAALL

SEQ ID NO: 1144282 - protein, 23 aa, Mycobacterium
GRLFALYVAGYCLGRFWIELLRS

SEQ ID NO: 1144283 - protein, 23 aa, Mycobacterium
GRTAVRVLLILAAAALVLGTVAA

SEQ ID NO: 1144284 - protein, 18 aa, Mycobacterium
GSLRILLPLSIIGAIILV

SEQ ID NO: 1144285 - protein, 24 aa, Mycobacterium
GSVRAWLVVALMNIAMIALHLPAP

SEQ ID NO: 1144286 - protein, 31 aa, Mycobacterium
GTAFRRLFANPWLWVAIAVSALLQVAVVHLP

SEQ ID NO: 1144287 - protein, 26 aa, Mycobacterium
GTAVGFVFLWLSLTPSLLPRGPLFQG

SEQ ID NO: 1144288 - protein, 32 aa, Mycobacterium
GTGFAPFFMPLALFIGALIIWMLLTPLQSRPI

SEQ ID NO: 1144289 - protein, 23 aa, Mycobacterium
GTNGSQFFLVYKDSQLPPQYTVF

SEQ ID NO: 1144290 - protein, 24 aa, Mycobacterium
GTVLFLLFVYWNVSVKHWFTGPIK

SEQ ID NO: 1144291 - protein, 20 aa, Mycobacterium
GVARHRLLPRLMPGGDYVST

SEQ ID NO: 1144292 - protein, 19 aa, Mycobacterium
GVILLALLLALLSAPPVGA

SEQ ID NO: 1144293 - protein, 21 aa, Mycobacterium
GVLLLVYRSAVTMLLPLVTIG

SEQ ID NO: 1144294 - protein, 28 aa, Mycobacterium
GVMFTLLAMALMFVLSWFKPAGQVGQSA

SEQ ID NO: 1144295 - protein, 19 aa, Mycobacterium
GVPVWGFAVLWIALAAALT

SEQ ID NO: 1144296 - protein, 20 aa, Mycobacterium
GVRDVLFGRKVSYAGLAILL

SEQ ID NO: 1144297 - protein, 23 aa, Mycobacterium
GVSWLPVFHDMGLIAGVLLPIWS

SEQ ID NO: 1144298 - protein, 18 aa, Mycobacterium
GVSWLVAIFTLVKALSGA

SEQ ID NO: 1144299 - protein, 28 aa, Mycobacterium
GVTPWIAAPLLFIGVLFGLLLVTGTTIR

SEQ ID NO: 1144300 - protein, 27 aa, Mycobacterium
GVVGFVLVWIFWLSTGIPLGFLVLLPA

SEQ ID NO: 1144301 - protein, 22 aa, Mycobacterium
GVWELGPFPLRAYALCIIAGII

SEQ ID NO: 1144302 - protein, 18 aa, Mycobacterium
GVYLLMWVGYVQGWVWLA

SEQ ID NO: 1144303 - protein, 19 aa, Mycobacterium
GWQWIFFVNVPVGVAGLAL

SEQ ID NO: 1144304 - protein, 19 aa, Mycobacterium
GWQWIFIVNLPVGVLGFAL

SEQ ID NO: 1144305 - protein, 29 aa, Mycobacterium
GWVFMLRTPWLLWTLLFASLFVLVVLGPI

SEQ ID NO: 1144306 - protein, 23 aa, Mycobacterium
GWVIGLIMVNPFRLLARQARAIN

SEQ ID NO: 1144307 - protein, 21 aa, Mycobacterium
GYHRVFWLTTVFTLLVIAIVV

SEQ ID NO: 1144308 - protein, 22 aa, Mycobacterium
GYLLAFAAFLLIGGRLGDRFGS

SEQ ID NO: 1144309 - protein, 19 aa, Mycobacterium
HAGLAWWWAPVFAAVIYAG

SEQ ID NO: 1144310 - protein, 18 aa, Mycobacterium
HCYNIPMCWALRSVFDSL

SEQ ID NO: 1144311 - protein, 18 aa, Mycobacterium
HDGFFFFAIVLSALSVIP

SEQ ID NO: 1144312 - protein, 17 aa, Mycobacterium
HDPWWLVLAKSLGIFAF

SEQ ID NO: 1144313 - protein, 18 aa, Mycobacterium
HEIAWPVPLLAFIILVAV

SEQ ID NO: 1144314 - protein, 17 aa, Mycobacterium
HEPDRYWVLRPVDNLSP

SEQ ID NO: 1144315 - protein, 23 aa, Mycobacterium
HGIWVAFWFFLAQLNFVLGAVNL

SEQ ID NO: 1144316 - protein, 19 aa, Mycobacterium
HIWQVFGALWLYSMAVAGA

SEQ ID NO: 1144317 - protein, 19 aa, Mycobacterium
HLHWLVLPLTFIILVAVGS

SEQ ID NO: 1144318 - protein, 20 aa, Mycobacterium
HLHWLVLPLTFIILVAVGSD

SEQ ID NO: 1144319 - protein, 18 aa, Mycobacterium
HLIGLHLHWLVLPLTFII

SEQ ID NO: 1144320 - protein, 19 aa, Mycobacterium
HLIGLHLHWLVLPLTFIIL

SEQ ID NO: 1144321 - protein, 25 aa, Mycobacterium
HPAWWTLILVILTVVALWLTYSLFF

SEQ ID NO: 1144322 - protein, 24 aa, Mycobacterium
HQLTPFWLFFVLAALAVFRQMRPW

SEQ ID NO: 1144323 - protein, 33 aa, Mycobacterium
HRPNRTWWRFVAWWLPCVALAVTWWVVALLHLG

SEQ ID NO: 1144324 - protein, 27 aa, Mycobacterium
HTGGAWLILFMIFNVIWTYALVRGAGA

SEQ ID NO: 1144325 - protein, 18 aa, Mycobacterium
HTIRLGRPGWLDPGPLAG

SEQ ID NO: 1144326 - protein, 17 aa, Mycobacterium
HVAALFTAGLITDLLVR

SEQ ID NO: 1144327 - protein, 20 aa, Mycobacterium
HWVWLIPLMIWLLHGPLRAQ

SEQ ID NO: 1144328 - protein, 23 aa, Mycobacterium
IAALLGPWFWWPQRVRTRPVPAP

SEQ ID NO: 1144329 - protein, 23 aa, Mycobacterium
IAALLGRWFWWPQQIRTRPAPSP

SEQ ID NO: 1144330 - protein, 22 aa, Mycobacterium
IAALLVWVIALSRPPEVQQAAV

SEQ ID NO: 1144331 - protein, 22 aa, Mycobacterium
IAGGFLFMATFVGGVVGAAIDA

SEQ ID NO: 1144332 - protein, 24 aa, Mycobacterium
IAIILLLVYRSVVTALLPLLVVGV

SEQ ID NO: 1144333 - protein, 17 aa, Mycobacterium
IALPLAGAAILLLSGRR

SEQ ID NO: 1144334 - protein, 25 aa, Mycobacterium
IAPTLLTPLLPLVPRLRTGYNLPIS

SEQ ID NO: 1144335 - protein, 24 aa, Mycobacterium
IAVITFVLLFLLTGSLVLPVKALV

SEQ ID NO: 1144336 - protein, 20 aa, Mycobacterium
IAVWVAMAVALPLSFPSLGE

SEQ ID NO: 1144337 - protein, 18 aa, Mycobacterium
IDWGRVLIFGALPGLALV

SEQ ID NO: 1144338 - protein, 18 aa, Mycobacterium
IFTKYLWAFELTGALLIT

SEQ ID NO: 1144339 - protein, 25 aa, Mycobacterium
IGAALLVWRLRWAAQPFWLSPAIFA

SEQ ID NO: 1144340 - protein, 20 aa, Mycobacterium
IGATLFLIAVYWLAVRTATG

SEQ ID NO: 1144341 - protein, 25 aa, Mycobacterium
IGFAVIVFILVKWVVPPIKGLMQKQ

SEQ ID NO: 1144342 - protein, 24 aa, Mycobacterium
IGFCMGGGLVWRLLAAGSPELAAA

SEQ ID NO: 1144343 - protein, 24 aa, Mycobacterium
IGGAWLAFIGWFLLTAARDENAAV

SEQ ID NO: 1144344 - protein, 17 aa, Mycobacterium
IGIIALALWLMKMTVST

SEQ ID NO: 1144345 - protein, 19 aa, Mycobacterium
IGLFFAFWSWVGFETTAVY

SEQ ID NO: 1144346 - protein, 17 aa, Mycobacterium
IGLFILFIGLVDAGFIS

SEQ ID NO: 1144347 - protein, 22 aa, Mycobacterium
IGLPFALWFFLIRPWVREKRIT

SEQ ID NO: 1144348 - protein, 25 aa, Mycobacterium
IGLPPFYPPGWFWIGGRLAALTGTP

SEQ ID NO: 1144349 - protein, 17 aa, Mycobacterium
IGPLVQLFLRLTPNRVL

SEQ ID NO: 1144350 - protein, 17 aa, Mycobacterium
IGSLLWRGLQPDTGPRT

SEQ ID NO: 1144351 - protein, 24 aa, Mycobacterium
IGTLAAFLLYLRMFFEPMQEISQF

SEQ ID NO: 1144352 - protein, 20 aa, Mycobacterium
IGVPWWFLVAQLPVAGIVFA

SEQ ID NO: 1144353 - protein, 24 aa, Mycobacterium
IGWGLYLVIAFILLQAAVSVVVLL

SEQ ID NO: 1144354 - protein, 23 aa, Mycobacterium
IHDGFFMFVIFLTVLSFIPLGGG

SEQ ID NO: 1144355 - protein, 22 aa, Mycobacterium
IIALMVIAVWLLGVGTLMDLAL

SEQ ID NO: 1144356 - protein, 21 aa, Mycobacterium
IIKLLASLFGLTWANIRNRLV

SEQ ID NO: 1144357 - protein, 20 aa, Mycobacterium
IKFIIFGVIMVVLTAFLFLV

SEQ ID NO: 1144358 - protein, 23 aa, Mycobacterium
IKTNLFWAFAYNVAAIPVAALGM

SEQ ID NO: 1144359 - protein, 20 aa, Mycobacterium
ILAFLALFWVNQNYQPELPA

SEQ ID NO: 1144360 - protein, 19 aa, Mycobacterium
ILDVVVVFLVTWPLVYLAS

SEQ ID NO: 1144361 - protein, 18 aa, Mycobacterium
ILILCIFLNFLIRQKKNK

SEQ ID NO: 1144362 - protein, 21 aa, Mycobacterium
ILLMQLCFHLLWVTGATIGGL

SEQ ID NO: 1144363 - protein, 19 aa, Mycobacterium
ILLSMYWPLGVVVLVSIVP

SEQ ID NO: 1144364 - protein, 23 aa, Mycobacterium
ILQSWFLMRVAFLPTLAVSIPLT

SEQ ID NO: 1144365 - protein, 19 aa, Mycobacterium
ILRARWITVAVTLVLAVLG

SEQ ID NO: 1144366 - protein, 18 aa, Mycobacterium
IMTLVVASAYLFFGALQV

SEQ ID NO: 1144367 - protein, 17 aa, Mycobacterium
INLIVLLRIACEVTATV

SEQ ID NO: 1144368 - protein, 18 aa, Mycobacterium
IPIALFMGLYLRFLRPGR

SEQ ID NO: 1144369 - protein, 26 aa, Mycobacterium
IPLTFLVLVWVFKGLLAAALPVAVGG

SEQ ID NO: 1144370 - protein, 20 aa, Mycobacterium
IQLALFMAVTLGAFGVLGFG

SEQ ID NO: 1144371 - protein, 17 aa, Mycobacterium
IQLGVFLAVALTAFSIM

SEQ ID NO: 1144372 - protein, 17 aa, Mycobacterium
IRAAILFMAVMMTIGLA

SEQ ID NO: 1144373 - protein, 26 aa, Mycobacterium
IRFTGPEVWWLLGVARWAAGLPIAAV

SEQ ID NO: 1144374 - protein, 19 aa, Mycobacterium
IRGGMMGIIILVLVIGVGQ

SEQ ID NO: 1144375 - protein, 25 aa, Mycobacterium
IRNLFTLLPIIPFIGGLLGVIAIVV

SEQ ID NO: 1144376 - protein, 26 aa, Mycobacterium
ISIGRSLPFLILMAAIMPFTRFITGT

SEQ ID NO: 1144377 - protein, 18 aa, Mycobacterium
ISLFFWPTPAVPLVGAVL

SEQ ID NO: 1144378 - protein, 26 aa, Mycobacterium
ITAGITWLIGLLNPAAAFIKACKLIY

SEQ ID NO: 1144379 - protein, 25 aa, Mycobacterium
ITALIALAVLIWRSLPEGGIEAPSG

SEQ ID NO: 1144380 - protein, 20 aa, Mycobacterium
ITLAPWLLTAAILVPLNLHA

SEQ ID NO: 1144381 - protein, 24 aa, Mycobacterium
ITRPRLWVALLFLMLIAVTFLVSS

SEQ ID NO: 1144382 - protein, 18 aa, Mycobacterium
IVVRGMLLLFIPDSFMSL

SEQ ID NO: 1144383 - protein, 20 aa, Mycobacterium
IWGIPYLLIKVAVEGLSVPV

SEQ ID NO: 1144384 - protein, 17 aa, Mycobacterium
IWRLAIFVTVCGLTLFG

SEQ ID NO: 1144385 - protein, 20 aa, Mycobacterium
IWVIPRPWYLAWAGLVYIVA

SEQ ID NO: 1144386 - protein, 19 aa, Mycobacterium
IYFILPLYVLLVLPAMSVL

SEQ ID NO: 1144387 - protein, 18 aa, Mycobacterium
IYGVAILALPFVILIGLI

SEQ ID NO: 1144388 - protein, 25 aa, Mycobacterium
KATRALWLLFLPFSLINLAHWMLPP

SEQ ID NO: 1144389 - protein, 25 aa, Mycobacterium
KDLVFIGGLLILAVALIVYLVMGSE

SEQ ID NO: 1144390 - protein, 25 aa, Mycobacterium
KDRYSGWLGGWRWAKDKLFGMPDKV

SEQ ID NO: 1144391 - protein, 21 aa, Mycobacterium
KFGTWLLFGGIWVTLVYFPLS

SEQ ID NO: 1144392 - protein, 17 aa, Mycobacterium
KGNLFWAFAYNVAALPL

SEQ ID NO: 1144393 - protein, 32 aa, Mycobacterium
KIGPLEFEGFVAWLAWLVLHLVYLVGFKTKIV

SEQ ID NO: 1144394 - protein, 23 aa, Mycobacterium
KLDPLLRLPLALGLAHLLGRIPL

SEQ ID NO: 1144395 - protein, 22 aa, Mycobacterium
KRNWGWVVAIVLVVAALAAVAI

SEQ ID NO: 1144396 - protein, 17 aa, Mycobacterium
KRRRPWIIAVVAAVAVL

SEQ ID NO: 1144397 - protein, 22 aa, Mycobacterium
KSRWLRWPARIYTDIFRGLPEV

SEQ ID NO: 1144398 - protein, 21 aa, Mycobacterium
KTPVWNWMIAAYLFSGGLSAG

SEQ ID NO: 1144399 - protein, 23 aa, Mycobacterium
KWARLTAFVLLPALALVLALGAG

SEQ ID NO: 1144400 - protein, 20 aa, Mycobacterium
KYWLLIILAVAIGTAFLVER

SEQ ID NO: 1144401 - protein, 24 aa, Mycobacterium
LAAFPILVALVWWFRNESAKTYRK

SEQ ID NO: 1144402 - protein, 17 aa, Mycobacterium
LAAGWRPGEPFPGGAVM

SEQ ID NO: 1144403 - protein, 19 aa, Mycobacterium
LAALLGISLLIGGLVAALV

SEQ ID NO: 1144404 - protein, 24 aa, Mycobacterium
LAAMAIMVFQFMKLPAQLFGVGRY

SEQ ID NO: 1144405 - protein, 26 aa, Mycobacterium
LACAALGPAWFWLGPAPPAGSTVRVA

SEQ ID NO: 1144406 - protein, 20 aa, Mycobacterium
LADRWQAQWPAIAAVGLGAL

SEQ ID NO: 1144407 - protein, 32 aa, Mycobacterium
LAFLEPSWFAWLIVVWLWLTVLFANLAEAVAE

SEQ ID NO: 1144408 - protein, 17 aa, Mycobacterium
LAFLFPLIGFLVVVLRK

SEQ ID NO: 1144409 - protein, 20 aa, Mycobacterium
LAFWVCGLLLCLFIGPTLSS

SEQ ID NO: 1144410 - protein, 20 aa, Mycobacterium
LAGALLLTGWLLAAFADTPR

SEQ ID NO: 1144411 - protein, 24 aa, Mycobacterium
LAHFRGWLQPMSFVWDGLPSDRPF

SEQ ID NO: 1144412 - protein, 22 aa, Mycobacterium
LAHIAIMLVFLLIVLHSKHLHI

SEQ ID NO: 1144413 - protein, 19 aa, Mycobacterium
LAIPFLWVCLRIPKTLRGM

SEQ ID NO: 1144414 - protein, 17 aa, Mycobacterium
LALALLFWQWRKIPFVV

SEQ ID NO: 1144415 - protein, 21 aa, Mycobacterium
LALIIFICWSLFAGTFRSYVP

SEQ ID NO: 1144416 - protein, 23 aa, Mycobacterium
LALIVCTVLWPPVRWLRGKGVPP

SEQ ID NO: 1144417 - protein, 22 aa, Mycobacterium
LALLPLLALLVWLPARRRRDDE

SEQ ID NO: 1144418 - protein, 31 aa, Mycobacterium
LALSTTIYLKLFGWLIWLFDQSSNMLLRLLR

SEQ ID NO: 1144419 - protein, 24 aa, Mycobacterium
LALYLVAALMVWLQALLLNIVVQR

SEQ ID NO: 1144420 - protein, 21 aa, Mycobacterium
LARLGLAVLLFLVGLRLDLHM

SEQ ID NO: 1144421 - protein, 20 aa, Mycobacterium
LARYGLVVVIAWIGALKFTE

SEQ ID NO: 1144422 - protein, 20 aa, Mycobacterium
LATLAFLRYRWLRGEPLPPQ

SEQ ID NO: 1144423 - protein, 23 aa, Mycobacterium
LATLLTIDLYLPGGLIAGDESLD

SEQ ID NO: 1144424 - protein, 17 aa, Mycobacterium
LAVGLGALWLPWGAATY

SEQ ID NO: 1144425 - protein, 18 aa, Mycobacterium
LAVYYFALQWVTASLIRA

SEQ ID NO: 1144426 - protein, 23 aa, Mycobacterium
LAYILLFMLLQGWAGAQLANLIA

SEQ ID NO: 1144427 - protein, 20 aa, Mycobacterium
LAYLLAGWRDEIRQPPMAGV

SEQ ID NO: 1144428 - protein, 18 aa, Mycobacterium
LCLPWLLHRLGRDPAFGS

SEQ ID NO: 1144429 - protein, 17 aa, Mycobacterium
LCSFLLAWIFALDRVYE

SEQ ID NO: 1144430 - protein, 23 aa, Mycobacterium
LCSLVGCWVLLRGNVFLGEAMTH

SEQ ID NO: 1144431 - protein, 17 aa, Mycobacterium
LDNQSWPTTLWATNATI

SEQ ID NO: 1144432 - protein, 23 aa, Mycobacterium
LDRRWMWIAGVAGAILFVAVITA

SEQ ID NO: 1144433 - protein, 27 aa, Mycobacterium
LDTLAVFVGWLWPLWDRRRRTFADLLA

SEQ ID NO: 1144434 - protein, 21 aa, Mycobacterium
LEHFWWGSVFLINIPVMVILL

SEQ ID NO: 1144435 - protein, 18 aa, Mycobacterium
LEQLLVLLPPFVEGAQGG

SEQ ID NO: 1144436 - protein, 18 aa, Mycobacterium
LERGLFVGLWILAAVCFI

SEQ ID NO: 1144437 - protein, 26 aa, Mycobacterium
LFCNSPFFWIGGFAFGLLATLVAGAT

SEQ ID NO: 1144438 - protein, 19 aa, Mycobacterium
LFDFLTFGLMLGVLHAGPA

SEQ ID NO: 1144439 - protein, 18 aa, Mycobacterium
LFGGIWVTLVYFPLSHMV

SEQ ID NO: 1144440 - protein, 17 aa, Mycobacterium
LFGLLIFGLFRESFPGL

SEQ ID NO: 1144441 - protein, 17 aa, Mycobacterium
LFLPWLLQRLGMDPAFG

SEQ ID NO: 1144442 - protein, 17 aa, Mycobacterium
LFTWVWPALEVFTRMVP

SEQ ID NO: 1144443 - protein, 25 aa, Mycobacterium
LFVAFDQLWKWNNIIALVLSVLVIL

SEQ ID NO: 1144444 - protein, 20 aa, Mycobacterium
LFWAFAYNVAALPLAAAGLL

SEQ ID NO: 1144445 - protein, 22 aa, Mycobacterium
LGAFSLVLLMFTAIIIVVFGQM

SEQ ID NO: 1144446 - protein, 30 aa, Mycobacterium
LGFAPGTWWLTWILFIPALFQVIFEIVLDF

SEQ ID NO: 1144447 - protein, 27 aa, Mycobacterium
LGKAAWFTMLAFWFFAIGWAASKSSTV

SEQ ID NO: 1144448 - protein, 17 aa, Mycobacterium
LGLFAPPILASVVVGAA

SEQ ID NO: 1144449 - protein, 23 aa, Mycobacterium
LGLTVTLVWLYLEILRLLSYFNN

SEQ ID NO: 1144450 - protein, 20 aa, Mycobacterium
LGLVASWLLSRRIKRHTRGL

SEQ ID NO: 1144451 - protein, 17 aa, Mycobacterium
LGLYLLARNPRKPVLLS

SEQ ID NO: 1144452 - protein, 18 aa, Mycobacterium
LGRALSLAWRRSLQLRVV

SEQ ID NO: 1144453 - protein, 25 aa, Mycobacterium
LGTVSAFLWSLYALFLGSAGTPGMK

SEQ ID NO: 1144454 - protein, 23 aa, Mycobacterium
LGVLLLGVLLWGLGLIPPTVALM

SEQ ID NO: 1144455 - protein, 33 aa, Mycobacterium
LGVPGWVTQRLWWALLLVVGFWGMLRLAEALGI

SEQ ID NO: 1144456 - protein, 21 aa, Mycobacterium
LGWCSFLLLWVLQACVFWRGM

SEQ ID NO: 1144457 - protein, 23 aa, Mycobacterium
LIAGVLGWLLAGPAIRPLRKLTE

SEQ ID NO: 1144458 - protein, 30 aa, Mycobacterium
LIAGVLLPIWSARPQFLMAPATFVRNPLSW

SEQ ID NO: 1144459 - protein, 18 aa, Mycobacterium
LIERFPLMFFTSAAVLMI

SEQ ID NO: 1144460 - protein, 23 aa, Mycobacterium
LILIFLIMVILTRAVAAAAVIVG

SEQ ID NO: 1144461 - protein, 28 aa, Mycobacterium
LIRFTGPPLWWLLRVADWAAAVPGASVP

SEQ ID NO: 1144462 - protein, 24 aa, Mycobacterium
LKKRPTWIWIAESLVLVVAVLVAG

SEQ ID NO: 1144463 - protein, 22 aa, Mycobacterium
LKTLLGVPVWLGPLAVGAIVIM

SEQ ID NO: 1144464 - protein, 23 aa, Mycobacterium
LLATQILWINLLTDSGPALAMGV

SEQ ID NO: 1144465 - protein, 24 aa, Mycobacterium
LLCASFPPIGWWFTAILAFAVFGW

SEQ ID NO: 1144466 - protein, 25 aa, Mycobacterium
LLDATIIRMFLVPAIMKLLGDDCWW

SEQ ID NO: 1144467 - protein, 19 aa, Mycobacterium
LLEHFWWGSVFLINAPVMA

SEQ ID NO: 1144468 - protein, 17 aa, Mycobacterium
LLFLIIKVKLHAFIALV

SEQ ID NO: 1144469 - protein, 22 aa, Mycobacterium
LLFYPLHFLPFPVVAWIWQLAV

SEQ ID NO: 1144470 - protein, 19 aa, Mycobacterium
LLHGRWRSRVDLRHPAVVR

SEQ ID NO: 1144471 - protein, 17 aa, Mycobacterium
LLIIMGAFMYFASRRQK

SEQ ID NO: 1144472 - protein, 17 aa, Mycobacterium
LLIIVITIVKIAASLAA

SEQ ID NO: 1144473 - protein, 18 aa, Mycobacterium
LLILLALTYRRLPWRVRP

SEQ ID NO: 1144474 - protein, 17 aa, Mycobacterium
LLIVSLVILLALSAAAA

SEQ ID NO: 1144475 - protein, 20 aa, Mycobacterium
LLIVYRSVFTALLPLLVIGL

SEQ ID NO: 1144476 - protein, 25 aa, Mycobacterium
LLKLAVILALWAAVAAAFVSVIYRR

SEQ ID NO: 1144477 - protein, 17 aa, Mycobacterium
LLLGRPLIESALFGLAI

SEQ ID NO: 1144478 - protein, 22 aa, Mycobacterium
LLLISIVFGFTWWLGGRLGLED

SEQ ID NO: 1144479 - protein, 17 aa, Mycobacterium
LLLLLAVGFVIKYIWWF

SEQ ID NO: 1144480 - protein, 17 aa, Mycobacterium
LLPYLWSAAYQVLLAVR

SEQ ID NO: 1144481 - protein, 25 aa, Mycobacterium
LLRALYVILGWRPVLLVPLTFALFT

SEQ ID NO: 1144482 - protein, 23 aa, Mycobacterium
LLRARWITLCVALIVAVLGAVAV

SEQ ID NO: 1144483 - protein, 19 aa, Mycobacterium
LLRRLPILLLLRRPLRLSV

SEQ ID NO: 1144484 - protein, 18 aa, Mycobacterium
LLRTVLFIAPASALWGLL

SEQ ID NO: 1144485 - protein, 17 aa, Mycobacterium
LLSLIIAWPAGLLLALI

SEQ ID NO: 1144486 - protein, 17 aa, Mycobacterium
LLTLLVLEPVRPAVRAW

SEQ ID NO: 1144487 - protein, 18 aa, Mycobacterium
LLTMLWQNLIGNAVKFRR

SEQ ID NO: 1144488 - protein, 27 aa, Mycobacterium
LLYIGVALGWPLWWVSVCSVLCVLVAE

SEQ ID NO: 1144489 - protein, 17 aa, Mycobacterium
LMLLAFGSLVLTAYPLK

SEQ ID NO: 1144490 - protein, 20 aa, Mycobacterium
LNALFLPPAPAAPAAPPPPG

SEQ ID NO: 1144491 - protein, 17 aa, Mycobacterium
LNLDLLLGGLKPVIQGL

SEQ ID NO: 1144492 - protein, 23 aa, Mycobacterium
LPAPAFRPPVVLPPPVIRLPRPQ

SEQ ID NO: 1144493 - protein, 20 aa, Mycobacterium
LPGWPLWFAALWAAQEWLKS

SEQ ID NO: 1144494 - protein, 25 aa, Mycobacterium
LPMMLAPWVLLPVILALRGEGSVRR

SEQ ID NO: 1144495 - protein, 19 aa, Mycobacterium
LPNLLFGIGRYSVTLQLPE

SEQ ID NO: 1144496 - protein, 22 aa, Mycobacterium
LPRALFWIVIVYVLVATIVAFA

SEQ ID NO: 1144497 - protein, 19 aa, Mycobacterium
LPRQIYWRRRALALGIAAL

SEQ ID NO: 1144498 - protein, 17 aa, Mycobacterium
LPRWIYVPAVAGALFVG

SEQ ID NO: 1144499 - protein, 20 aa, Mycobacterium
LPVDIPWLPLAAPVALLVGY

SEQ ID NO: 1144500 - protein, 21 aa, Mycobacterium
LPVVFYSAWIFFDGAFRALRA

SEQ ID NO: 1144501 - protein, 20 aa, Mycobacterium
LPVVFYSAWIFFDGAYRALR

SEQ ID NO: 1144502 - protein, 17 aa, Mycobacterium
LPWLLQRLGMDPAFGAG

SEQ ID NO: 1144503 - protein, 23 aa, Mycobacterium
LQAISVLLLPVSRLLVLIGNALT

SEQ ID NO: 1144504 - protein, 24 aa, Mycobacterium
LQFTYWQWASLTLAAPVVVWAAWP

SEQ ID NO: 1144505 - protein, 18 aa, Mycobacterium
LQGWTLPLLIRRLKLSAD

SEQ ID NO: 1144506 - protein, 21 aa, Mycobacterium
LQYRLPITFCLFDNHAHAMCV

SEQ ID NO: 1144507 - protein, 17 aa, Mycobacterium
LRFLVRHSMYWFVGYRI

SEQ ID NO: 1144508 - protein, 17 aa, Mycobacterium
LRPLLGMLPFDGLIGAP

SEQ ID NO: 1144509 - protein, 18 aa, Mycobacterium
LRQFHNVLIYLMCAAAAV

SEQ ID NO: 1144510 - protein, 17 aa, Mycobacterium
LRWWHPWAWLAYPGCYV

SEQ ID NO: 1144511 - protein, 19 aa, Mycobacterium
LSLAWRRSLQLRVVSLTLG

SEQ ID NO: 1144512 - protein, 33 aa, Mycobacterium
LSLVDWVKPIDWWWILGGFLLFVTPPGRMSIAV

SEQ ID NO: 1144513 - protein, 23 aa, Mycobacterium
LSRRTRRWIAIGLTALVVVTGVA

SEQ ID NO: 1144514 - protein, 17 aa, Mycobacterium
LSSVLFYLFAYGFSTLG

SEQ ID NO: 1144515 - protein, 17 aa, Mycobacterium
LSVLLWQHIIGLALHWM

SEQ ID NO: 1144516 - protein, 22 aa, Mycobacterium
LSVLSFFWLWWTTNMLSAHLAG

SEQ ID NO: 1144517 - protein, 17 aa, Mycobacterium
LSVVLPPLLYSAALDFS

SEQ ID NO: 1144518 - protein, 18 aa, Mycobacterium
LTAPPIWLWAVWAVLAVC

SEQ ID NO: 1144519 - protein, 19 aa, Mycobacterium
LTCGLWLPIWLLIEIIRAI

SEQ ID NO: 1144520 - protein, 20 aa, Mycobacterium
LTCWLPVFLGWPIMRWLTRK

SEQ ID NO: 1144521 - protein, 22 aa, Mycobacterium
LTGAWLGLFIGLVLGFFSPNPW

SEQ ID NO: 1144522 - protein, 22 aa, Mycobacterium
LTGCLAAVLWWACHRPNRLWWR

SEQ ID NO: 1144523 - protein, 27 aa, Mycobacterium
LTGTVGWRWIFWLNVPLALASFVLGAR

SEQ ID NO: 1144524 - protein, 23 aa, Mycobacterium
LTGWPLWWAAWWAAVEWLKSVIP

SEQ ID NO: 1144525 - protein, 21 aa, Mycobacterium
LTHLRKGLMGWLFGALAEGGV

SEQ ID NO: 1144526 - protein, 17 aa, Mycobacterium
LTIPVFAFGWPTSEVSP

SEQ ID NO: 1144527 - protein, 18 aa, Mycobacterium
LTIYTQLFTTDAGWRRAV

SEQ ID NO: 1144528 - protein, 20 aa, Mycobacterium
LTMVLFPMYFLKSFAYAGVA

SEQ ID NO: 1144529 - protein, 25 aa, Mycobacterium
LTVLTWLMRVGFLGAPLIVGVVADA

SEQ ID NO: 1144530 - protein, 18 aa, Mycobacterium
LVALLLSIPIMLWSPMGR

SEQ ID NO: 1144531 - protein, 18 aa, Mycobacterium
LVFALFFLFPLYAMADFS

SEQ ID NO: 1144532 - protein, 26 aa, Mycobacterium
LVGAPPWLYWTLYLACYVTGGWEPGW

SEQ ID NO: 1144533 - protein, 24 aa, Mycobacterium
LVGGLLYLGLWLYGVLVEFGSDAH

SEQ ID NO: 1144534 - protein, 17 aa, Mycobacterium
LVIMIGLQPIRLLSWAT

SEQ ID NO: 1144535 - protein, 20 aa, Mycobacterium
LVLLLRAIVAPLYLLGTVVL

SEQ ID NO: 1144536 - protein, 17 aa, Mycobacterium
LVLLPQATSIMQAIGVP

SEQ ID NO: 1144537 - protein, 17 aa, Mycobacterium
LVLPVWAAALIVALVLF

SEQ ID NO: 1144538 - protein, 18 aa, Mycobacterium
LVLTGLALLIWLPAVRCP

SEQ ID NO: 1144539 - protein, 22 aa, Mycobacterium
LVLVSARLWYAALAALLVVGAG

SEQ ID NO: 1144540 - protein, 18 aa, Mycobacterium
LVLWLSRWPTRNQSIGFA

SEQ ID NO: 1144541 - protein, 24 aa, Mycobacterium
LVLYYVMLTFIARPYLIPSESMEP

SEQ ID NO: 1144542 - protein, 22 aa, Mycobacterium
LVPAFMHVLGRWNWWAPKPLAR

SEQ ID NO: 1144543 - protein, 21 aa, Mycobacterium
LVQLFIVFFALPEFGVRIDPF

SEQ ID NO: 1144544 - protein, 19 aa, Mycobacterium
LVSGLLVAGSWWLFEWELA

SEQ ID NO: 1144545 - protein, 18 aa, Mycobacterium
LVSLFYYLRWIIPAFGRP

SEQ ID NO: 1144546 - protein, 30 aa, Mycobacterium
LVTFVVIIVLLLFFYRSITTVVLLLIMVGV

SEQ ID NO: 1144547 - protein, 26 aa, Mycobacterium
LVTLTALWCWLPFQLKFMRATSPLTE

SEQ ID NO: 1144548 - protein, 25 aa, Mycobacterium
LVVGLLMFLLLGRPLAWLTTSLTDW

SEQ ID NO: 1144549 - protein, 18 aa, Mycobacterium
LWLLTTIALAAAVPTVWA

SEQ ID NO: 1144550 - protein, 19 aa, Mycobacterium
LWPLPMFALAAALACGIAM

SEQ ID NO: 1144551 - protein, 18 aa, Mycobacterium
LWQARLAPQAKPYPQPHK

SEQ ID NO: 1144552 - protein, 19 aa, Mycobacterium
LWVFVLVPVLILLTVSGKW

SEQ ID NO: 1144553 - protein, 21 aa, Mycobacterium
LWVLFMYPVFWGPAILYLVTR

SEQ ID NO: 1144554 - protein, 17 aa, Mycobacterium
LYEFRLQSALTAAVMWM

SEQ ID NO: 1144555 - protein, 18 aa, Mycobacterium
LYIVMTVISLLLFIVAAT

SEQ ID NO: 1144556 - protein, 20 aa, Mycobacterium
LYLFLPIFVIVLFSFNKPAG

SEQ ID NO: 1144557 - protein, 18 aa, Mycobacterium
MAAPLFVLALLWKRFDLS

SEQ ID NO: 1144558 - protein, 25 aa, Mycobacterium
MAFYPLALVPLGSLFWVVLNWPAKG

SEQ ID NO: 1144559 - protein, 17 aa, Mycobacterium
MALWLPWLIVAGVCFIL

SEQ ID NO: 1144560 - protein, 19 aa, Mycobacterium
MASTVLWFDELRKLALRAL

SEQ ID NO: 1144561 - protein, 25 aa, Mycobacterium
MAYSLYLWHWPLLIFWLSHSGRSRV

SEQ ID NO: 1144562 - protein, 25 aa, Mycobacterium
MAYSLYLWHWPLLIFYLAHTGNSRV

SEQ ID NO: 1144563 - protein, 25 aa, Mycobacterium
MCALPLTVGMLMSAALWSGTPGSAD

SEQ ID NO: 1144564 - protein, 19 aa, Mycobacterium
MCVALVVYFLLLGRIAFAF

SEQ ID NO: 1144565 - protein, 21 aa, Mycobacterium
MLGAAILWFGWFGFNVGSEGA

SEQ ID NO: 1144566 - protein, 26 aa, Mycobacterium
MLLAAAWFLLFALPLLLTVPPHLPGA

SEQ ID NO: 1144567 - protein, 23 aa, Mycobacterium
MLPLLLFGLLIFGLFQKTYPGLS

SEQ ID NO: 1144568 - protein, 25 aa, Mycobacterium
MLYMALMGITWLLDVPARIGNRLPD

SEQ ID NO: 1144569 - protein, 21 aa, Mycobacterium
MMLPLLLFGLLIFGLFRESFP

SEQ ID NO: 1144570 - protein, 22 aa, Mycobacterium
MNAYFSMCWLVVNTLGVLVGAT

SEQ ID NO: 1144571 - protein, 25 aa, Mycobacterium
MPAGLFFAAIALFQLLWARLVLTRT

SEQ ID NO: 1144572 - protein, 29 aa, Mycobacterium
MPRIALITIILMPLLYGAMYLWAFWNPFA

SEQ ID NO: 1144573 - protein, 26 aa, Mycobacterium
MRMTRLLALLATFLTAGVLLAPVTAA

SEQ ID NO: 1144574 - protein, 18 aa, Mycobacterium
MRNRFLVALLLSIPIMLW

SEQ ID NO: 1144575 - protein, 19 aa, Mycobacterium
MTAVVALLTLLVGVGVGVA

SEQ ID NO: 1144576 - protein, 21 aa, Mycobacterium
MTVIAGRRLPLPPSALSTGID

SEQ ID NO: 1144577 - protein, 18 aa, Mycobacterium
MVMISVCLLLYRNFRRNN

SEQ ID NO: 1144578 - protein, 19 aa, Mycobacterium
MVVLTAFLFLVFSDSRTGA

SEQ ID NO: 1144579 - protein, 20 aa, Mycobacterium
MWLIRRRLMRQTHGLRPDEL

SEQ ID NO: 1144580 - protein, 24 aa, Mycobacterium
NALPWLLPLLYVLMALSLVVWAGL

SEQ ID NO: 1144581 - protein, 17 aa, Mycobacterium
NHRWFLVSVYAAGKVGA

SEQ ID NO: 1144582 - protein, 19 aa, Mycobacterium
NIAGIPWWGAILTAVIASA

SEQ ID NO: 1144583 - protein, 19 aa, Mycobacterium
NILITGRDFVYLIDFGLAR

SEQ ID NO: 1144584 - protein, 17 aa, Mycobacterium
NIPMCWALRSVFDSLDG

SEQ ID NO: 1144585 - protein, 20 aa, Mycobacterium
NKILQFITYLLVPAGALTIY

SEQ ID NO: 1144586 - protein, 21 aa, Mycobacterium
NLFWAFAYNVAALPLAALGLL

SEQ ID NO: 1144587 - protein, 22 aa, Mycobacterium
NLFWAFAYNVAALPLAALGLLN

SEQ ID NO: 1144588 - protein, 23 aa, Mycobacterium
NLPVWVLFLAWASFFFVGSGMPG

SEQ ID NO: 1144589 - protein, 19 aa, Mycobacterium
NLTALRELALLWLADQVDS

SEQ ID NO: 1144590 - protein, 22 aa, Mycobacterium
NMVSVGAFIFAPMLSIYASMKA

SEQ ID NO: 1144591 - protein, 21 aa, Mycobacterium
NPVFWLGMMIALAAAFLAAYP

SEQ ID NO: 1144592 - protein, 18 aa, Mycobacterium
NRMAFLAGVLFILALCFA

SEQ ID NO: 1144593 - protein, 35 aa, Mycobacterium
NSESSGLKWTWWWLLAIVPVLLLAGLAAFAVLRTR

SEQ ID NO: 1144594 - protein, 17 aa, Mycobacterium
NTCAMGMLLSKLPYNRG

SEQ ID NO: 1144595 - protein, 21 aa, Mycobacterium
NVGIFTVVMLLVAAALVVVFG

SEQ ID NO: 1144596 - protein, 29 aa, Mycobacterium
NVGLSLALIIVLIPLALLGVLGLAAVVLV

SEQ ID NO: 1144597 - protein, 22 aa, Mycobacterium
NVNMVRLWWDKPWPMRIAAIAR

SEQ ID NO: 1144598 - protein, 21 aa, Mycobacterium
NWIEIFLLLVIAFSLPRTFGR

SEQ ID NO: 1144599 - protein, 19 aa, Mycobacterium
NWIIFMILPLYVSLEKIDP

SEQ ID NO: 1144600 - protein, 25 aa, Mycobacterium
NWPDPLPLLGWVLAAAAVATFVVQA

SEQ ID NO: 1144601 - protein, 18 aa, Mycobacterium
NWSPLPMFHLNVLAMTLI

SEQ ID NO: 1144602 - protein, 20 aa, Mycobacterium
NYFTFYLCDLLLKVNGKGGQ

SEQ ID NO: 1144603 - protein, 25 aa, Mycobacterium
NYQSFTMWLIIGVIYFIVIMALTKL

SEQ ID NO: 1144604 - protein, 18 aa, Mycobacterium
PAGLFFAAIALFQLSWAR

SEQ ID NO: 1144605 - protein, 23 aa, Mycobacterium
PAGLLFLGFFRWVARQMVARARE

SEQ ID NO: 1144606 - protein, 17 aa, Mycobacterium
PALFTLIGPRIWWPALR

SEQ ID NO: 1144607 - protein, 25 aa, Mycobacterium
PALVMFLIIFFWTPPHTWALAMRYK

SEQ ID NO: 1144608 - protein, 25 aa, Mycobacterium
PAQVYWMVLQLILAVALLAWWKGRR

SEQ ID NO: 1144609 - protein, 24 aa, Mycobacterium
PARLAFHLVRLYNLAFIVSTYALS

SEQ ID NO: 1144610 - protein, 25 aa, Mycobacterium
PARWRHWWWALLLAFVPIHLVVSAV

SEQ ID NO: 1144611 - protein, 23 aa, Mycobacterium
PDLRGQFWADAEPRLRALGWTGV

SEQ ID NO: 1144612 - protein, 22 aa, Mycobacterium
PDSWRLLNIVFILVVLFTVIQG

SEQ ID NO: 1144613 - protein, 23 aa, Mycobacterium
PELVWLPLFLVFGVLTGFLGAGY

SEQ ID NO: 1144614 - protein, 19 aa, Mycobacterium
PEVRWALIATVLFVVGGLA

SEQ ID NO: 1144615 - protein, 18 aa, Mycobacterium
PFFKPYITNLLPGQFIQP

SEQ ID NO: 1144616 - protein, 23 aa, Mycobacterium
PFMIALVIIVLVVIGIWLVNLFE

SEQ ID NO: 1144617 - protein, 23 aa, Mycobacterium
PFVELRWWPLALLSALSLTLVAI

SEQ ID NO: 1144618 - protein, 25 aa, Mycobacterium
PGAALFACLAIAALLVWVIALSRPP

SEQ ID NO: 1144619 - protein, 17 aa, Mycobacterium
PGLAGLIFLTFSGGVIG

SEQ ID NO: 1144620 - protein, 21 aa, Mycobacterium
PGRAFWRPLFVAPLAVPAFVN

SEQ ID NO: 1144621 - protein, 19 aa, Mycobacterium
PHLGLIPLFIIWFGIGELP

SEQ ID NO: 1144622 - protein, 19 aa, Mycobacterium
PIILSWIALAAFLNISVPQ

SEQ ID NO: 1144623 - protein, 17 aa, Mycobacterium
PILLLLRRPLRLSVPDA

SEQ ID NO: 1144624 - protein, 18 aa, Mycobacterium
PIPVVWLAFYAVSVLGAA

SEQ ID NO: 1144625 - protein, 24 aa, Mycobacterium
PKASVMTHYRWLRALAGFGGLGLR

SEQ ID NO: 1144626 - protein, 24 aa, Mycobacterium
PKKSKLWLILGLVALTVVVIAIAV

SEQ ID NO: 1144627 - protein, 22 aa, Mycobacterium
PKPVWITLGILVAVAALVVFVS

SEQ ID NO: 1144628 - protein, 17 aa, Mycobacterium
PKRLALVAGLSLVIVLG

SEQ ID NO: 1144629 - protein, 17 aa, Mycobacterium
PLLFHPINSITAYKGQI

SEQ ID NO: 1144630 - protein, 19 aa, Mycobacterium
PLLGMLPFDGLIGAPMLFG

SEQ ID NO: 1144631 - protein, 18 aa, Mycobacterium
PLLLILFAALMAGAGNGI

SEQ ID NO: 1144632 - protein, 20 aa, Mycobacterium
PLLMRLGPRRAYWSGLSVFA

SEQ ID NO: 1144633 - protein, 24 aa, Mycobacterium
PLSQWFLLVMTFGSLFMVAGKRYA

SEQ ID NO: 1144634 - protein, 20 aa, Mycobacterium
PLTVLLIFTLNILLAEFGAA

SEQ ID NO: 1144635 - protein, 23 aa, Mycobacterium
PLVFVFVALIAFVMLLVSIRSVF

SEQ ID NO: 1144636 - protein, 19 aa, Mycobacterium
PLVQLFLRLTPNRVLAVSG

SEQ ID NO: 1144637 - protein, 23 aa, Mycobacterium
PMMLAPWVLLPVVLVLQGGSGGV

SEQ ID NO: 1144638 - protein, 19 aa, Mycobacterium
PPACSVGFLPPSSWRSPAD

SEQ ID NO: 1144639 - protein, 26 aa, Mycobacterium
PPGEPQPWYRKPGALIALGAIAALLV

SEQ ID NO: 1144640 - protein, 17 aa, Mycobacterium
PPKKKRNWGWVVAIVLV

SEQ ID NO: 1144641 - protein, 23 aa, Mycobacterium
PPLAYFFLLVIWLGIDEAPKITL

SEQ ID NO: 1144642 - protein, 22 aa, Mycobacterium
PPPAQPPILPPAPLLPGQGPLL

SEQ ID NO: 1144643 - protein, 20 aa, Mycobacterium
PPPPPWPYFAPPDQVVPPYG

SEQ ID NO: 1144644 - protein, 26 aa, Mycobacterium
PPRLGRGWLTAICAVLLLLGAGAGVG

SEQ ID NO: 1144645 - protein, 27 aa, Mycobacterium
PPYKIAGLVLLVIFAVVATLVAFQFRG

SEQ ID NO: 1144646 - protein, 19 aa, Mycobacterium
PQFPWLPPAPPPRPQPRTP

SEQ ID NO: 1144647 - protein, 18 aa, Mycobacterium
PQLWLLVVVTVLALALGW

SEQ ID NO: 1144648 - protein, 23 aa, Mycobacterium
PQPQGYWYPPPPPSGWQGAPQAP

SEQ ID NO: 1144649 - protein, 24 aa, Mycobacterium
PQYRALWVFVLVPVLILLAVSGRW

SEQ ID NO: 1144650 - protein, 24 aa, Mycobacterium
PRTKLFAALFLILALVVIGEIAGV

SEQ ID NO: 1144651 - protein, 24 aa, Mycobacterium
PRTKLFVTLFLILALVVIGEIAGV

SEQ ID NO: 1144652 - protein, 21 aa, Mycobacterium
PRVTAPLLLPDPPLRARRLET

SEQ ID NO: 1144653 - protein, 18 aa, Mycobacterium
PSAHYVLPPPPPSRWRQL

SEQ ID NO: 1144654 - protein, 25 aa, Mycobacterium
PSGRLLLILLGLWSVYRLATRSQLW

SEQ ID NO: 1144655 - protein, 26 aa, Mycobacterium
PSTSLFRRMFLINGLIFTLGTLALAL

SEQ ID NO: 1144656 - protein, 24 aa, Mycobacterium
PSWPLTLLVVLSYPSGIDVGLQDT

SEQ ID NO: 1144657 - protein, 19 aa, Mycobacterium
PTNLRWVLYALGTIAVIVA

SEQ ID NO: 1144658 - protein, 19 aa, Mycobacterium
PVAALGMLNPMLAGAAMAF

SEQ ID NO: 1144659 - protein, 19 aa, Mycobacterium
PVEFWQYPTINALAKFLTG

SEQ ID NO: 1144660 - protein, 20 aa, Mycobacterium
PVLIMMIFAYFLYAFYDVFP

SEQ ID NO: 1144661 - protein, 18 aa, Mycobacterium
PVPVLPAPAFRPPVVLPP

SEQ ID NO: 1144662 - protein, 21 aa, Mycobacterium
PVRAYALFIIVGIIAALVIGD

SEQ ID NO: 1144663 - protein, 20 aa, Mycobacterium
PVVFYSAWIFFDGAFRALRA

SEQ ID NO: 1144664 - protein, 19 aa, Mycobacterium
PVVNLLRRVPPRKLGYRLA

SEQ ID NO: 1144665 - protein, 23 aa, Mycobacterium
PVVQPWYVLWAIIPLAAWATRPR

SEQ ID NO: 1144666 - protein, 30 aa, Mycobacterium
PVVVPPPVIVLPRPQWTPPKPAWTWPTQTV

SEQ ID NO: 1144667 - protein, 18 aa, Mycobacterium
PWMVFFAFSVSLIYQFWI

SEQ ID NO: 1144668 - protein, 24 aa, Mycobacterium
PWPALWALLIGFFMILVDATIVPV

SEQ ID NO: 1144669 - protein, 18 aa, Mycobacterium
PWVAILFTTLIAFGLIFY

SEQ ID NO: 1144670 - protein, 17 aa, Mycobacterium
PWWLVLAKSLGIFAFLL

SEQ ID NO: 1144671 - protein, 21 aa, Mycobacterium
QAMIWLTWPFGAAGALGAFGG

SEQ ID NO: 1144672 - protein, 23 aa, Mycobacterium
QARWRLILTVLIAAASVGLAVVL

SEQ ID NO: 1144673 - protein, 17 aa, Mycobacterium
QDRPFIVMPYHARGSLA

SEQ ID NO: 1144674 - protein, 21 aa, Mycobacterium
QFMLIIWLQGIWLPLRGYDFE

SEQ ID NO: 1144675 - protein, 23 aa, Mycobacterium
QGSQYYLIVFLAGSLPLVFLAYR

SEQ ID NO: 1144676 - protein, 22 aa, Mycobacterium
QGVWHLGPFPVRAYALFIIVGI

SEQ ID NO: 1144677 - protein, 20 aa, Mycobacterium
QHRVVTRLQYIFLNGNVVSD

SEQ ID NO: 1144678 - protein, 17 aa, Mycobacterium
QIYVVMGAGWVWHRGLQ

SEQ ID NO: 1144679 - protein, 18 aa, Mycobacterium
QLFTTDAGWRRAVLAMVG

SEQ ID NO: 1144680 - protein, 18 aa, Mycobacterium
QLIIFTVLTVIALAVLGW

SEQ ID NO: 1144681 - protein, 17 aa, Mycobacterium
QLLQPFLDYAFGFRNGV

SEQ ID NO: 1144682 - protein, 17 aa, Mycobacterium
QLLVLLPQATSIMQAIG

SEQ ID NO: 1144683 - protein, 18 aa, Mycobacterium
QLMIFAIVTVLSVGAVSL

SEQ ID NO: 1144684 - protein, 18 aa, Mycobacterium
QLVFVFTALPHIGITLPP

SEQ ID NO: 1144685 - protein, 17 aa, Mycobacterium
QLWLPPLGAPPAADDLV

SEQ ID NO: 1144686 - protein, 18 aa, Mycobacterium
QLWVFWLAPLIDAAIAGV

SEQ ID NO: 1144687 - protein, 25 aa, Mycobacterium
QMFGIWRAVWLVLLVPLAVLLVLLV

SEQ ID NO: 1144688 - protein, 18 aa, Mycobacterium
QNDTWYIVLLLPSFLVYV

SEQ ID NO: 1144689 - protein, 23 aa, Mycobacterium
QNFNWHVLFWFAAGLGAAALICF

SEQ ID NO: 1144690 - protein, 17 aa, Mycobacterium
QPAWLRYSPLSFTGLAM

SEQ ID NO: 1144691 - protein, 24 aa, Mycobacterium
QPITRDLWPAPFLVLDTGASIAPY

SEQ ID NO: 1144692 - protein, 27 aa, Mycobacterium
QRAKRALLFWVVAVITLAGLLAAGAWA

SEQ ID NO: 1144693 - protein, 18 aa, Mycobacterium
QRMHALVADLLLLARLDE

SEQ ID NO: 1144694 - protein, 31 aa, Mycobacterium
QSVSWLPLFHDMGLLMIMFPAVAGGHLTLMS

SEQ ID NO: 1144695 - protein, 33 aa, Mycobacterium
QVVHPTFLYELLWNLLVFAVLILVDRRFKIGHG

SEQ ID NO: 1144696 - protein, 24 aa, Mycobacterium
RAGEGLLVYLGLGAMLGLVASWLL

SEQ ID NO: 1144697 - protein, 23 aa, Mycobacterium
RAKTFLLLVLFSGLIVGVGALFG

SEQ ID NO: 1144698 - protein, 18 aa, Mycobacterium
RALSQAGTWSWHLTRDFV

SEQ ID NO: 1144699 - protein, 20 aa, Mycobacterium
RARTIAVMAVLLLASAVAAF

SEQ ID NO: 1144700 - protein, 25 aa, Mycobacterium
RARTRYRWLFAFGFLLIGFGLEYAV

SEQ ID NO: 1144701 - protein, 22 aa, Mycobacterium
RASLILWAGWLVVTALVFSYMN

SEQ ID NO: 1144702 - protein, 26 aa, Mycobacterium
RAVMTTLMALAFWLSGVGVAAAHTSL

SEQ ID NO: 1144703 - protein, 24 aa, Mycobacterium
RAYGELLRFLFEPIFDFLRDPLGN

SEQ ID NO: 1144704 - protein, 21 aa, Mycobacterium
RDIRFIIIAALIVVLVTLSVL

SEQ ID NO: 1144705 - protein, 17 aa, Mycobacterium
RDMFWSMAPLVVACVVL

SEQ ID NO: 1144706 - protein, 25 aa, Mycobacterium
RDPNPPLPPWLSPSPPVPGTANPAL

SEQ ID NO: 1144707 - protein, 29 aa, Mycobacterium
RDRVSLWGRILPITFTALGLVALVGGALL

SEQ ID NO: 1144708 - protein, 18 aa, Mycobacterium
REPYWIALTVLLVLRPES

SEQ ID NO: 1144709 - protein, 19 aa, Mycobacterium
RFFAYLNLFLAAMLLLVLA

SEQ ID NO: 1144710 - protein, 20 aa, Mycobacterium
RFFPPMGSILYWLRPRTIRL

SEQ ID NO: 1144711 - protein, 17 aa, Mycobacterium
RFLRSASLRTRVAIAAA

SEQ ID NO: 1144712 - protein, 21 aa, Mycobacterium
RFPIISVLAPLIMGLILFAVT

SEQ ID NO: 1144713 - protein, 26 aa, Mycobacterium
RGGSLGRWLIAVAILAVLTVVVTIGI

SEQ ID NO: 1144714 - protein, 25 aa, Mycobacterium
RGKYWWLRWALIALAVIVLTVELAL

SEQ ID NO: 1144715 - protein, 18 aa, Mycobacterium
RGQFWIWAGANIAPINWI

SEQ ID NO: 1144716 - protein, 20 aa, Mycobacterium
RGRIMALWLVGFLGSRPIAA

SEQ ID NO: 1144717 - protein, 17 aa, Mycobacterium
RGWPLWGALLWILSQMV

SEQ ID NO: 1144718 - protein, 22 aa, Mycobacterium
RIHNAWWTAILLVMVAVFLVVT

SEQ ID NO: 1144719 - protein, 17 aa, Mycobacterium
RILRQFHHPLIYVLLVA

SEQ ID NO: 1144720 - protein, 22 aa, Mycobacterium
RIRSWWLLLPLGVATWVLMHES

SEQ ID NO: 1144721 - protein, 21 aa, Mycobacterium
RIRSWWLLLPLGVATWVLVHE

SEQ ID NO: 1144722 - protein, 28 aa, Mycobacterium
RKLGYRLAWLYNVLFIVSVYGIARKAPR

SEQ ID NO: 1144723 - protein, 18 aa, Mycobacterium
RLADRYAAYFLPLALLMA

SEQ ID NO: 1144724 - protein, 18 aa, Mycobacterium
RLAFLINVPIGIAIIAIA

SEQ ID NO: 1144725 - protein, 29 aa, Mycobacterium
RLCLWYPERAWLLLAIYTALALLAVIVIG

SEQ ID NO: 1144726 - protein, 22 aa, Mycobacterium
RLIPDFTRWSPCQVLALVGNMR

SEQ ID NO: 1144727 - protein, 18 aa, Mycobacterium
RLLLFLAVAVVFGAVVFA

SEQ ID NO: 1144728 - protein, 23 aa, Mycobacterium
RLPWRWLPWLSWTVSCAWAFSLA

SEQ ID NO: 1144729 - protein, 24 aa, Mycobacterium
RLWPTLACLLLYGAAFMLLAQSIS

SEQ ID NO: 1144730 - protein, 17 aa, Mycobacterium
RLYALHILLIPGIILAL

SEQ ID NO: 1144731 - protein, 27 aa, Mycobacterium
RMISPTMLFFPFVLLLAATALYRGTDN

SEQ ID NO: 1144732 - protein, 17 aa, Mycobacterium
RMSSFVHGLWIVGQCII

SEQ ID NO: 1144733 - protein, 38 aa, Mycobacterium
RPEPLARWLAWSTTLYLKVFGWLIWLFDQSSNLLLRAL

SEQ ID NO: 1144734 - protein, 21 aa, Mycobacterium
RPFRRRNFLPGAALFACLAIA

SEQ ID NO: 1144735 - protein, 20 aa, Mycobacterium
RPQWLALFVVVLAFAYLCFT

SEQ ID NO: 1144736 - protein, 21 aa, Mycobacterium
RPRRWGLPLIATVAALLLAAA

SEQ ID NO: 1144737 - protein, 24 aa, Mycobacterium
RPVRGLVTAILLAVALLASAGMAG

SEQ ID NO: 1144738 - protein, 20 aa, Mycobacterium
RQEWVYLPPAWYASDPPPAL

SEQ ID NO: 1144739 - protein, 26 aa, Mycobacterium
RQFQDPLIYLLLVAVAISTAAWLAEG

SEQ ID NO: 1144740 - protein, 19 aa, Mycobacterium
RQPPYKLAGLVLAILTVIA

SEQ ID NO: 1144741 - protein, 23 aa, Mycobacterium
RQQLFLSSLLRSLISKETFFSLS

SEQ ID NO: 1144742 - protein, 29 aa, Mycobacterium
RREARSLLYLLLRPYRWVVLALAVVVVVE

SEQ ID NO: 1144743 - protein, 22 aa, Mycobacterium
RRFMSFGLVFLILNGLQIVVVT

SEQ ID NO: 1144744 - protein, 24 aa, Mycobacterium
RRIRSWWLLLPLGVATWVLMHESG

SEQ ID NO: 1144745 - protein, 24 aa, Mycobacterium
RRLFALVLLLLVVAPSLIGCVRIR

SEQ ID NO: 1144746 - protein, 20 aa, Mycobacterium
RRLVGRLTIGLLGVATALLL

SEQ ID NO: 1144747 - protein, 23 aa, Mycobacterium
RRNLLGLFMPSALFLIFVMLAAP

SEQ ID NO: 1144748 - protein, 18 aa, Mycobacterium
RRQNAIGSLLWRGLQPDT

SEQ ID NO: 1144749 - protein, 28 aa, Mycobacterium
RRRHIALGGLFVLLVFVAFGCWLAVRAV

SEQ ID NO: 1144750 - protein, 25 aa, Mycobacterium
RRRQLVGLWPLLAPLLAAGTVVLAV

SEQ ID NO: 1144751 - protein, 25 aa, Mycobacterium
RRTRRWRLVWVPWSALIGVVLAVAA

SEQ ID NO: 1144752 - protein, 17 aa, Mycobacterium
RRVPPRKLGYRLAWLYN

SEQ ID NO: 1144753 - protein, 19 aa, Mycobacterium
RRWAPRGALAFLALSVVLV

SEQ ID NO: 1144754 - protein, 22 aa, Mycobacterium
RSRGLLPVLRWLIAGIGATMGV

SEQ ID NO: 1144755 - protein, 24 aa, Mycobacterium
RSRRVLFFWVVAVITLAALAAAGA

SEQ ID NO: 1144756 - protein, 17 aa, Mycobacterium
RSVFTALLPLLVIGLSL

SEQ ID NO: 1144757 - protein, 24 aa, Mycobacterium
RTYLHSAWWLSFIPGLAIVITTVS

SEQ ID NO: 1144758 - protein, 21 aa, Mycobacterium
RVLIVVALLLVYTAPSADAVG

SEQ ID NO: 1144759 - protein, 25 aa, Mycobacterium
RVVNSRWVQLPPLLQPRAAAAAAVV

SEQ ID NO: 1144760 - protein, 23 aa, Mycobacterium
RWAVFAVWLLLLVPSIYLALNQS

SEQ ID NO: 1144761 - protein, 32 aa, Mycobacterium
RWFAWPGYLWFGMAAYLLLTLLVLEPVRPAVR

SEQ ID NO: 1144762 - protein, 26 aa, Mycobacterium
RYAAYFLPLALLMAGSAWLASGSAVR

SEQ ID NO: 1144763 - protein, 19 aa, Mycobacterium
RYWVLRPVDNLSPLTTRHV

SEQ ID NO: 1144764 - protein, 23 aa, Mycobacterium
SAFRHLFSNGWLWASVGLGVALQ

SEQ ID NO: 1144765 - protein, 20 aa, Mycobacterium
SAIIVVFVAVLYWAFKRRDW

SEQ ID NO: 1144766 - protein, 23 aa, Mycobacterium
SAVSLLFLFILQLVQGRLPSALT

SEQ ID NO: 1144767 - protein, 24 aa, Mycobacterium
SCKAWLLAQPFLMSAVLLGIFAVT

SEQ ID NO: 1144768 - protein, 24 aa, Mycobacterium
SFTHFAALMTLPWLAAIIGEYILL

SEQ ID NO: 1144769 - protein, 19 aa, Mycobacterium
SFWLFLFGALIALSGFITP

SEQ ID NO: 1144770 - protein, 24 aa, Mycobacterium
SGPWWPLPFWIAVAGLTPTGLLLA

SEQ ID NO: 1144771 - protein, 23 aa, Mycobacterium
SGPYFKVMLANLAPYWILQPFVD

SEQ ID NO: 1144772 - protein, 34 aa, Mycobacterium
SGSRFYFLTGFGALLQLGLFQLAVRTATENGFTL

SEQ ID NO: 1144773 - protein, 22 aa, Mycobacterium
SHNPWTALLVLFLIGLTGSAVG

SEQ ID NO: 1144774 - protein, 25 aa, Mycobacterium
SHTTALWLIPLVVVGAIVAGAVAVV

SEQ ID NO: 1144775 - protein, 19 aa, Mycobacterium
SIFLLPWLARVFGLPDAVA

SEQ ID NO: 1144776 - protein, 17 aa, Mycobacterium
SIFLPTYLVLSAGVFMA

SEQ ID NO: 1144777 - protein, 25 aa, Mycobacterium
SILYPSLLLLPLVATTLAIVLGVGA

SEQ ID NO: 1144778 - protein, 25 aa, Mycobacterium
SLAPALIIFLTLALLTNALVGQARL

SEQ ID NO: 1144779 - protein, 23 aa, Mycobacterium
SLFFKMIPYILLTLLFGSIAVAL

SEQ ID NO: 1144780 - protein, 25 aa, Mycobacterium
SLFVGLIMFFLVGRPLALINSGLTN

SEQ ID NO: 1144781 - protein, 19 aa, Mycobacterium
SLIAPLYLVGSVVLSYFAA

SEQ ID NO: 1144782 - protein, 20 aa, Mycobacterium
SLLFFFVYILQTIGLLVGYR

SEQ ID NO: 1144783 - protein, 27 aa, Mycobacterium
SLLLSVVLFFVWMIAVAFLYLVLGGMG

SEQ ID NO: 1144784 - protein, 17 aa, Mycobacterium
SLMAIPLHYGLSAPASA

SEQ ID NO: 1144785 - protein, 20 aa, Mycobacterium
SLPFLILMAAIIPVTRFLVG

SEQ ID NO: 1144786 - protein, 30 aa, Mycobacterium
SLSGFEHPWFFLFFLVVLGLVALYVIVQMG

SEQ ID NO: 1144787 - protein, 21 aa, Mycobacterium
SMFVFIGAVVYLMAAPRGRED

SEQ ID NO: 1144788 - protein, 24 aa, Mycobacterium
SMGVILLGLLWYAGLPLRVFLSSL

SEQ ID NO: 1144789 - protein, 19 aa, Mycobacterium
SPPITPWPVAPPPYPASVA

SEQ ID NO: 1144790 - protein, 28 aa, Mycobacterium
SPTAPSHPRWWFLWTTPGRILSIGMVLA

SEQ ID NO: 1144791 - protein, 23 aa, Mycobacterium
SPTGAFLGLIGPGGLLIGNGVLP

SEQ ID NO: 1144792 - protein, 29 aa, Mycobacterium
SPWHLWRKRIGWLLLLFVAEAYTGTVLRH

SEQ ID NO: 1144793 - protein, 27 aa, Mycobacterium
SRLGTGWVATICVVLLLLGGGGITAGY

SEQ ID NO: 1144794 - protein, 24 aa, Mycobacterium
SRRYLTFALLLLVWMFSLLVIAMT

SEQ ID NO: 1144795 - protein, 21 aa, Mycobacterium
SSAVIVLLVAILYVMFKRRDW

SEQ ID NO: 1144796 - protein, 25 aa, Mycobacterium
SSFWFTAIYVLLFVSLVGCLTPRMV

SEQ ID NO: 1144797 - protein, 29 aa, Mycobacterium
SSILGTLLIYMLPLLLLVGLFVMFSRMQT

SEQ ID NO: 1144798 - protein, 22 aa, Mycobacterium
SVAWVFLWIFRGTPIYVQLAFW

SEQ ID NO: 1144799 - protein, 26 aa, Mycobacterium
SVGEQFWLVWPLLFLLVGLLKARKAA

SEQ ID NO: 1144800 - protein, 25 aa, Mycobacterium
SVLEPWLTFLRALPPLAYFFLLVIW

SEQ ID NO: 1144801 - protein, 17 aa, Mycobacterium
SVLLLRLVADRALLTAF

SEQ ID NO: 1144802 - protein, 17 aa, Mycobacterium
SVLPMFLPAVIALIAEN

SEQ ID NO: 1144803 - protein, 24 aa, Mycobacterium
SWAVPLNWWVVLAGFVLFVSPVGR

SEQ ID NO: 1144804 - protein, 19 aa, Mycobacterium
SWFADWPPAAKLAAWGIQL

SEQ ID NO: 1144805 - protein, 19 aa, Mycobacterium
SWIGWLAVTFVVASLYLGA

SEQ ID NO: 1144806 - protein, 20 aa, Mycobacterium
SYGAFFPYYICGITFRASDL

SEQ ID NO: 1144807 - protein, 33 aa, Mycobacterium
SYSTVWLWLGLGLLLLVLLWYATVFAATMPSRS

SEQ ID NO: 1144808 - protein, 19 aa, Mycobacterium
SYTCMLLGATWFLDNGGRH

SEQ ID NO: 1144809 - protein, 25 aa, Mycobacterium
TAAALASRWRLLAVSVLIASAAVLT

SEQ ID NO: 1144810 - protein, 17 aa, Mycobacterium
TAFLALLVLYFLGFDQG

SEQ ID NO: 1144811 - protein, 25 aa, Mycobacterium
TAGRLWFVEVLVWTLIALAVLFCIP

SEQ ID NO: 1144812 - protein, 24 aa, Mycobacterium
TAIAALLLLFLQPATIAAGSACLL

SEQ ID NO: 1144813 - protein, 27 aa, Mycobacterium
TALHYWPYLFFAVGVLSITFVSLVGWW

SEQ ID NO: 1144814 - protein, 23 aa, Mycobacterium
TAMLLIPVYLVYIRMARPFIAFY

SEQ ID NO: 1144815 - protein, 27 aa, Mycobacterium
TARTGPRWWIVTAAVLALLALVGAGVG

SEQ ID NO: 1144816 - protein, 21 aa, Mycobacterium
TDLPPLRALSQAGTWSWHLTR

SEQ ID NO: 1144817 - protein, 24 aa, Mycobacterium
TDRLWPLRWLRNAALLFTFLNAFV

SEQ ID NO: 1144818 - protein, 26 aa, Mycobacterium
TDRRRTLWLLWVLRHAIFRSVRRVIL

SEQ ID NO: 1144819 - protein, 23 aa, Mycobacterium
TDSPRNPMFLFFPAMMLVSSIGT

SEQ ID NO: 1144820 - protein, 19 aa, Mycobacterium
TDVLLLVSYWIPAFVAVVV

SEQ ID NO: 1144821 - protein, 19 aa, Mycobacterium
TEMGLLKYLIGQLLLSESA

SEQ ID NO: 1144822 - protein, 22 aa, Mycobacterium
TEPALDLDLLLGGLKPVIRGLN

SEQ ID NO: 1144823 - protein, 23 aa, Mycobacterium
TFAPAVFLWFFGIGALTVAMSGG

SEQ ID NO: 1144824 - protein, 21 aa, Mycobacterium
TFGHLVTVLLLGVSLAVAAVP

SEQ ID NO: 1144825 - protein, 18 aa, Mycobacterium
TFLVWWAVGAGVQTALLF

SEQ ID NO: 1144826 - protein, 25 aa, Mycobacterium
TGADPMMRWMFWTGLLVTAIDVLIA

SEQ ID NO: 1144827 - protein, 23 aa, Mycobacterium
TGAVVPALLWLAPATAAALVVYA

SEQ ID NO: 1144828 - protein, 24 aa, Mycobacterium
TGPAKWIRRFAIPIILGWILLVAV

SEQ ID NO: 1144829 - protein, 29 aa, Mycobacterium
TGPESLIVWLWLAVILLLVILSVRLSVLF

SEQ ID NO: 1144830 - protein, 19 aa, Mycobacterium
TGVWLFAVLLGWLPTSGTD

SEQ ID NO: 1144831 - protein, 23 aa, Mycobacterium
TIPAWLWFLLLLGAVTAAFAGGD

SEQ ID NO: 1144832 - protein, 21 aa, Mycobacterium
TKNIPSLRYLSYRLSLQRDGG

SEQ ID NO: 1144833 - protein, 24 aa, Mycobacterium
TLCPLLVLGIWWRGLTATGAMAGL

SEQ ID NO: 1144834 - protein, 17 aa, Mycobacterium
TLLMLLAFGSLVLTAYP

SEQ ID NO: 1144835 - protein, 20 aa, Mycobacterium
TLPWLIDGMLFTLQLTLYGF

SEQ ID NO: 1144836 - protein, 19 aa, Mycobacterium
TMFMLIPLGIVLGALVAFI

SEQ ID NO: 1144837 - protein, 20 aa, Mycobacterium
TMMVLIFFNLIAPTGWQVGL

SEQ ID NO: 1144838 - protein, 21 aa, Mycobacterium
TNLFWAFAYNVAAIPVAALGM

SEQ ID NO: 1144839 - protein, 17 aa, Mycobacterium
TNLLLGRPLIESALFGL

SEQ ID NO: 1144840 - protein, 23 aa, Mycobacterium
TNNLHRRVLIICTLAVGAATFGG

SEQ ID NO: 1144841 - protein, 18 aa, Mycobacterium
TPILLIIVITIVKIAASL

SEQ ID NO: 1144842 - protein, 24 aa, Mycobacterium
TPRELFWPFGLYGLIILAVWRVAR

SEQ ID NO: 1144843 - protein, 22 aa, Mycobacterium
TRRSPWVAILFTTLIAFGLIIY

SEQ ID NO: 1144844 - protein, 17 aa, Mycobacterium
TSMLLLALSIAPTLLTP

SEQ ID NO: 1144845 - protein, 24 aa, Mycobacterium
TSTSQLLYLRVPALNALFPAHRTS

SEQ ID NO: 1144846 - protein, 17 aa, Mycobacterium
TTTLLMLLAFGSLVLTA

SEQ ID NO: 1144847 - protein, 18 aa, Mycobacterium
TVEFYAVIFLSIGASLGA

SEQ ID NO: 1144848 - protein, 17 aa, Mycobacterium
TVIRMFLVPALMKWLGD

SEQ ID NO: 1144849 - protein, 24 aa, Mycobacterium
TVLHLVFAFFLLAVRFPAPPERRA

SEQ ID NO: 1144850 - protein, 17 aa, Mycobacterium
TVLIIFTLNILLAEFGA

SEQ ID NO: 1144851 - protein, 17 aa, Mycobacterium
TVLYGSAFFIAGAVLIC

SEQ ID NO: 1144852 - protein, 19 aa, Mycobacterium
TVPLWWWLPGLGVAALIAL

SEQ ID NO: 1144853 - protein, 18 aa, Mycobacterium
TVTALYLAYLRRQTRIEE

SEQ ID NO: 1144854 - protein, 17 aa, Mycobacterium
TVWFVIDPQLWLLVVVT

SEQ ID NO: 1144855 - protein, 17 aa, Mycobacterium
TWFLIFAFVAIGLEFSL

SEQ ID NO: 1144856 - protein, 20 aa, Mycobacterium
TWYIVLLLPSFLVYVTAMVG

SEQ ID NO: 1144857 - protein, 21 aa, Mycobacterium
VAAGLFYLALTIPLTHLVNFI

SEQ ID NO: 1144858 - protein, 18 aa, Mycobacterium
VAALLYIGVALGWPLWWV

SEQ ID NO: 1144859 - protein, 24 aa, Mycobacterium
VAGALFIVFLVFLAGVLLGRQSAG

SEQ ID NO: 1144860 - protein, 26 aa, Mycobacterium
VAIVITGLWLWLRYDALLLVVATQIL

SEQ ID NO: 1144861 - protein, 17 aa, Mycobacterium
VALIGMAIGWWREGWPS

SEQ ID NO: 1144862 - protein, 19 aa, Mycobacterium
VAMIPLVWLIYTVLAKGVA

SEQ ID NO: 1144863 - protein, 28 aa, Mycobacterium
VAPAGRWLLTGVLLWSLLRTVTRSQSYA

SEQ ID NO: 1144864 - protein, 23 aa, Mycobacterium
VAPTLWIFLVGRFLQGAAFAAVF

SEQ ID NO: 1144865 - protein, 25 aa, Mycobacterium
VAPYLAPRWIILGAGLLVPCAMLYG

SEQ ID NO: 1144866 - protein, 21 aa, Mycobacterium
VAQMLLLFWGFGAALLTLLYG

SEQ ID NO: 1144867 - protein, 24 aa, Mycobacterium
VARLWRWLLVFFSRWWQLETLYRS

SEQ ID NO: 1144868 - protein, 26 aa, Mycobacterium
VARLWRWLLVFFSRWWQLETLYRSNM

SEQ ID NO: 1144869 - protein, 25 aa, Mycobacterium
VDTPWLYLSFIGIGWLVGYLMRIQQ

SEQ ID NO: 1144870 - protein, 18 aa, Mycobacterium
VEARWLSVLLLSAGLAGF

SEQ ID NO: 1144871 - protein, 24 aa, Mycobacterium
VEEQFYVLWPLLIAAVLAGLAALA

SEQ ID NO: 1144872 - protein, 27 aa, Mycobacterium
VEQFRDPLIYLLFVAIVISLIVWAVDG

SEQ ID NO: 1144873 - protein, 25 aa, Mycobacterium
VFELAILLALPWWRAFRSTLAIATL

SEQ ID NO: 1144874 - protein, 20 aa, Mycobacterium
VFIALTVWFVIDPQLWLLVV

SEQ ID NO: 1144875 - protein, 17 aa, Mycobacterium
VFKVLVMILWLAPIGAF

SEQ ID NO: 1144876 - protein, 18 aa, Mycobacterium
VFLLARIREFWLAGGRRD

SEQ ID NO: 1144877 - protein, 20 aa, Mycobacterium
VFQLTFGGPLWWLGAVNIGC

SEQ ID NO: 1144878 - protein, 23 aa, Mycobacterium
VGFCMGGGMVWRLLAAGEPRLAA

SEQ ID NO: 1144879 - protein, 23 aa, Mycobacterium
VGFVIKYIWWFVGGAVLVGVFAG

SEQ ID NO: 1144880 - protein, 24 aa, Mycobacterium
VGGAARWWRLLYVAALVSWVSGQI

SEQ ID NO: 1144881 - protein, 24 aa, Mycobacterium
VGIGLWVWAPWRHDAGAPLPDGAV

SEQ ID NO: 1144882 - protein, 19 aa, Mycobacterium
VGIVFTWLFMYGMVPVMQG

SEQ ID NO: 1144883 - protein, 27 aa, Mycobacterium
VGLSLALITVLIPLALLGVLGLAAVVL

SEQ ID NO: 1144884 - protein, 27 aa, Mycobacterium
VGLSLGLIVVLMPLALFGVLGLAAVVL

SEQ ID NO: 1144885 - protein, 24 aa, Mycobacterium
VGTFTPWMINLPDYWITELPRIGS

SEQ ID NO: 1144886 - protein, 21 aa, Mycobacterium
VGTGLLWLLARRIGMTRPAAA

SEQ ID NO: 1144887 - protein, 26 aa, Mycobacterium
VIELALLLMLLYVPPVAALLTHAAPS

SEQ ID NO: 1144888 - protein, 20 aa, Mycobacterium
VIGIWLFNLFSGDGLTDEQL

SEQ ID NO: 1144889 - protein, 22 aa, Mycobacterium
VIIVMLLLVYRSIVTVLLTLVM

SEQ ID NO: 1144890 - protein, 31 aa, Mycobacterium
VIPPSLLRRALPYLIVILIVGMIVALVATGL

SEQ ID NO: 1144891 - protein, 24 aa, Mycobacterium
VIQPPLLLFVTVPGAYFLFHGSEI

SEQ ID NO: 1144892 - protein, 29 aa, Mycobacterium
VISDRGYFAFLMLLPFIMGVLSLSVPGDV

SEQ ID NO: 1144893 - protein, 23 aa, Mycobacterium
VITIMLVLFFRSIVTTLLILVMV

SEQ ID NO: 1144894 - protein, 17 aa, Mycobacterium
VLAGLLRRWAWLVLIVG

SEQ ID NO: 1144895 - protein, 18 aa, Mycobacterium
VLAGLYLGDLILSSDRVP

SEQ ID NO: 1144896 - protein, 26 aa, Mycobacterium
VLAVLPFFHIYGMTVLLNAALHARAR

SEQ ID NO: 1144897 - protein, 23 aa, Mycobacterium
VLEPWLTFLRALPPLAYFFLLVI

SEQ ID NO: 1144898 - protein, 24 aa, Mycobacterium
VLIAGGLGWLLAGPAIRPLRKLTE

SEQ ID NO: 1144899 - protein, 23 aa, Mycobacterium
VLLPAFMHLMGRWNWWAPAPLAR

SEQ ID NO: 1144900 - protein, 18 aa, Mycobacterium
VLLPPVFVLAWSGLKGRT

SEQ ID NO: 1144901 - protein, 29 aa, Mycobacterium
VLLVGWLLAIPVPLLLIWAPSWTWVIVAN

SEQ ID NO: 1144902 - protein, 23 aa, Mycobacterium
VLQSYLNIIYFGRGAYGVAAAAQ

SEQ ID NO: 1144903 - protein, 18 aa, Mycobacterium
VLVITPLRVAFLIVLIGT

SEQ ID NO: 1144904 - protein, 17 aa, Mycobacterium
VLVMILWLAPIGAFGAI

SEQ ID NO: 1144905 - protein, 19 aa, Mycobacterium
VLVVPIWWAAGHSALMVAF

SEQ ID NO: 1144906 - protein, 18 aa, Mycobacterium
VLWFIRRWLVARATMGVE

SEQ ID NO: 1144907 - protein, 17 aa, Mycobacterium
VMFAIGAIIPLIPYLLG

SEQ ID NO: 1144908 - protein, 17 aa, Mycobacterium
VMLPLIWALNQFGWHVA

SEQ ID NO: 1144909 - protein, 19 aa, Mycobacterium
VMLWLWHWPSRLQSAAFAT

SEQ ID NO: 1144910 - protein, 21 aa, Mycobacterium
VMVGFLFLYPAFVAKAHDASG

SEQ ID NO: 1144911 - protein, 25 aa, Mycobacterium
VNPVLLWLLMPVVVFGSAYVPEIAS

SEQ ID NO: 1144912 - protein, 17 aa, Mycobacterium
VPAPWPVLATLPRGPEL

SEQ ID NO: 1144913 - protein, 20 aa, Mycobacterium
VPSLLRSLLTEHLDPGYAAA

SEQ ID NO: 1144914 - protein, 21 aa, Mycobacterium
VPVPLLLIWAPSWSWVLAANV

SEQ ID NO: 1144915 - protein, 22 aa, Mycobacterium
VQPFGEYLPWRGFFSKLSPYAD

SEQ ID NO: 1144916 - protein, 17 aa, Mycobacterium
VRDVLFGRKVSYVGLAI

SEQ ID NO: 1144917 - protein, 18 aa, Mycobacterium
VRDVLFGRKVSYVGLAIL

SEQ ID NO: 1144918 - protein, 17 aa, Mycobacterium
VRSPLPAAPPPRRQPHR

SEQ ID NO: 1144919 - protein, 19 aa, Mycobacterium
VRSRWPHLTARQVMQRIED

SEQ ID NO: 1144920 - protein, 18 aa, Mycobacterium
VSIPLTVLLIFTLNILLA

SEQ ID NO: 1144921 - protein, 26 aa, Mycobacterium
VSLRDFLLFFFFLNLGAGLDFSEAAG

SEQ ID NO: 1144922 - protein, 23 aa, Mycobacterium
VSTLAYLLLFMLTRGWLGAQAAN

SEQ ID NO: 1144923 - protein, 18 aa, Mycobacterium
VSWLLFTWIIARLPRESI

SEQ ID NO: 1144924 - protein, 23 aa, Mycobacterium
VTKPPRRRLSLAVIGSAAAAVLA

SEQ ID NO: 1144925 - protein, 22 aa, Mycobacterium
VTLIFVIMLIITRSVVAAAVIV

SEQ ID NO: 1144926 - protein, 17 aa, Mycobacterium
VTMAWWMAVFPGAAIFV

SEQ ID NO: 1144927 - protein, 22 aa, Mycobacterium
VTTFPWVFLFPAGVLVLIVFCA

SEQ ID NO: 1144928 - protein, 25 aa, Mycobacterium
VTVPIWVVFLAWASFFFVGGGPAGW

SEQ ID NO: 1144929 - protein, 19 aa, Mycobacterium
VVAYLLIGLGLVEFLLGSL

SEQ ID NO: 1144930 - protein, 17 aa, Mycobacterium
VVFGVVVWLLVPSGDGG

SEQ ID NO: 1144931 - protein, 17 aa, Mycobacterium
VVFLLPALRDGASAVPV

SEQ ID NO: 1144932 - protein, 26 aa, Mycobacterium
VVIAAVLVLGFWKPGFFVTTKLDVNA

SEQ ID NO: 1144933 - protein, 23 aa, Mycobacterium
VVIVVRFLWIFPVATIDERMHRR

SEQ ID NO: 1144934 - protein, 22 aa, Mycobacterium
VVKALLMLGLWLAGWGAARLVA

SEQ ID NO: 1144935 - protein, 19 aa, Mycobacterium
VVLATGAWLPALTGRRIRV

SEQ ID NO: 1144936 - protein, 20 aa, Mycobacterium
VVLLLGWSFFYFSDDTRGYK

SEQ ID NO: 1144937 - protein, 28 aa, Mycobacterium
VVLPEVPSDLPLPALLSPDATPPSDGTS

SEQ ID NO: 1144938 - protein, 22 aa, Mycobacterium
VVNLSWPWWAALLVGIACGALI

SEQ ID NO: 1144939 - protein, 25 aa, Mycobacterium
VVPRFLALLLISPLLCIFIVASGTA

SEQ ID NO: 1144940 - protein, 17 aa, Mycobacterium
VVQDLLSILFYFAAVTA

SEQ ID NO: 1144941 - protein, 18 aa, Mycobacterium
VVTLYFWVLAVALGLFVL

SEQ ID NO: 1144942 - protein, 20 aa, Mycobacterium
VVVFLVTWPLVYLASKTTWA

SEQ ID NO: 1144943 - protein, 28 aa, Mycobacterium
VVVGLAYPVLIWLVAQLPGLRDNADGSL

SEQ ID NO: 1144944 - protein, 20 aa, Mycobacterium
VVVIVWLFAWSLASTLPGSA

SEQ ID NO: 1144945 - protein, 25 aa, Mycobacterium
VVVLFVPAALPWYYTWPLAVVAALA

SEQ ID NO: 1144946 - protein, 18 aa, Mycobacterium
VVVLLVLYLLLRSALAPL

SEQ ID NO: 1144947 - protein, 19 aa, Mycobacterium
VVVLPLLWCQAAKAPIRGP

SEQ ID NO: 1144948 - protein, 21 aa, Mycobacterium
VVWFWIPLGLLVLGTSSIPSV

SEQ ID NO: 1144949 - protein, 17 aa, Mycobacterium
VWFVIDPQLWLLVVVTV

SEQ ID NO: 1144950 - protein, 19 aa, Mycobacterium
VYLPLWVRRVAWVATIVLL

SEQ ID NO: 1144951 - protein, 22 aa, Mycobacterium
VYLWHWPIFLFLNGERTGWTGW

SEQ ID NO: 1144952 - protein, 22 aa, Mycobacterium
VYVDLLWPLLLMGSGLGLCMAP

SEQ ID NO: 1144953 - protein, 38 aa, Mycobacterium
WAALRALLFFTVVLGLAYPLLIWLIAQAPFLSDKADGS

SEQ ID NO: 1144954 - protein, 17 aa, Mycobacterium
WALPFAAFFLFSAGSWR

SEQ ID NO: 1144955 - protein, 24 aa, Mycobacterium
WAMFTCIELLPVLIKLLMNMGASS

SEQ ID NO: 1144956 - protein, 17 aa, Mycobacterium
WCHWAARGWILLVRSVP

SEQ ID NO: 1144957 - protein, 17 aa, Mycobacterium
WCSFMLLWVLQACVFWR

SEQ ID NO: 1144958 - protein, 17 aa, Mycobacterium
WFAVFALPLLISPPPVL

SEQ ID NO: 1144959 - protein, 18 aa, Mycobacterium
WFHIHVMLGLTLFCLWPF

SEQ ID NO: 1144960 - protein, 27 aa, Mycobacterium
WFTVKVWLFLFFFMWLRATLPRMRYDQ

SEQ ID NO: 1144961 - protein, 19 aa, Mycobacterium
WGQAWLLAQPFKTARRGML

SEQ ID NO: 1144962 - protein, 17 aa, Mycobacterium
WIGIYLFFVPLNMMGVD

SEQ ID NO: 1144963 - protein, 18 aa, Mycobacterium
WIRRLAIPIILGWVLLVA

SEQ ID NO: 1144964 - protein, 19 aa, Mycobacterium
WLAVVVYLLPRRATLRVAA

SEQ ID NO: 1144965 - protein, 19 aa, Mycobacterium
WLHRPIVVWWLFWVASTTV

SEQ ID NO: 1144966 - protein, 18 aa, Mycobacterium
WLLIVLIVVISVGGPGSM

SEQ ID NO: 1144967 - protein, 19 aa, Mycobacterium
WLLVVLVGAGISFLLAGRD

SEQ ID NO: 1144968 - protein, 17 aa, Mycobacterium
WLPFLVAFLIATITAFS

SEQ ID NO: 1144969 - protein, 18 aa, Mycobacterium
WLPRWLDRILPSVDFEKP

SEQ ID NO: 1144970 - protein, 18 aa, Mycobacterium
WNFPIVLVILLAVFGSLA

SEQ ID NO: 1144971 - protein, 17 aa, Mycobacterium
WNIAFIRRFMLTFGPVS

SEQ ID NO: 1144972 - protein, 19 aa, Mycobacterium
WPQWLLYIVMTVISLLLFI

SEQ ID NO: 1144973 - protein, 23 aa, Mycobacterium
WQLPPIWMMFFFAPTVVALSAMR

SEQ ID NO: 1144974 - protein, 17 aa, Mycobacterium
WRHLPAVLLILSLMSFT

SEQ ID NO: 1144975 - protein, 17 aa, Mycobacterium
WRRVGLPVLFPFLLSGW

SEQ ID NO: 1144976 - protein, 25 aa, Mycobacterium
WRTRRWRLLWIPWAVVVGGAFAVTA

SEQ ID NO: 1144977 - protein, 23 aa, Mycobacterium
WRTRRWRLVWIPWAVVVGGAFAV

SEQ ID NO: 1144978 - protein, 26 aa, Mycobacterium
WSAPLQLMFSFLFTPLIRLTNGTANW

SEQ ID NO: 1144979 - protein, 18 aa, Mycobacterium
WSMAPLVVACVVLAGLLG

SEQ ID NO: 1144980 - protein, 18 aa, Mycobacterium
WSMVWWLPLSILLEFLIG

SEQ ID NO: 1144981 - protein, 28 aa, Mycobacterium
WSVPGIAHFFTMWGFFVLATVYIEAFGQ

SEQ ID NO: 1144982 - protein, 21 aa, Mycobacterium
WTIFYWAWWVSWTPFVGMFIA

SEQ ID NO: 1144983 - protein, 21 aa, Mycobacterium
WWFWIGFALVTLVVAGGVSYL

SEQ ID NO: 1144984 - protein, 19 aa, Mycobacterium
WWPLLWFTAKVWVFLFVYI

SEQ ID NO: 1144985 - protein, 21 aa, Mycobacterium
YAPALWRYWAQHLDPDRARRD

SEQ ID NO: 1144986 - protein, 23 aa, Mycobacterium
YDIGLFYRYAWQNPVFTDIVATR

SEQ ID NO: 1144987 - protein, 20 aa, Mycobacterium
YDVALFYRYAWRNPTFTEIV

SEQ ID NO: 1144988 - protein, 20 aa, Mycobacterium
YDWIEQLLYRLTASAAKFPG

SEQ ID NO: 1144989 - protein, 25 aa, Mycobacterium
YERDIRFIIIVTLIVVLLTLAVLLR

SEQ ID NO: 1144990 - protein, 19 aa, Mycobacterium
YHPSLEQLLVLLPPYLAAT

SEQ ID NO: 1144991 - protein, 17 aa, Mycobacterium
YHVITDWPTYFGEGGAG

SEQ ID NO: 1144992 - protein, 21 aa, Mycobacterium
YIAMRLIVVAVLILLGRSTPD

SEQ ID NO: 1144993 - protein, 25 aa, Mycobacterium
YLAALLAYPRYFPPISLWTGLSLLG

SEQ ID NO: 1144994 - protein, 22 aa, Mycobacterium
YLATSLILLPYLWSAAYQVLLA

SEQ ID NO: 1144995 - protein, 26 aa, Mycobacterium
YLFPIYAGLLTPWWLRLLGAKVGKGT

SEQ ID NO: 1144996 - protein, 26 aa, Mycobacterium
YLGWWTAILLVVIVALMLLSAGLFKG

SEQ ID NO: 1144997 - protein, 18 aa, Mycobacterium
YLLWMLMGYLVVTAVLVV

SEQ ID NO: 1144998 - protein, 17 aa, Mycobacterium
YLYVHLVSVLAIVDIAF

SEQ ID NO: 1144999 - protein, 18 aa, Mycobacterium
YMMWTDGLIRLWPAWEFY

SEQ ID NO: 1145000 - protein, 20 aa, Mycobacterium
YPYREPLPAPAPGGPPPGPP

SEQ ID NO: 1145001 - protein, 19 aa, Mycobacterium
YRPVFWYLAAWSVGLLAAW

SEQ ID NO: 1145002 - protein, 19 aa, Mycobacterium
YRPVFYYLAFWAVALVVLR

SEQ ID NO: 1145003 - protein, 19 aa, Mycobacterium
YRVWFFHRLLLVTPVVTLY

SEQ ID NO: 1145004 - protein, 22 aa, Mycobacterium
YSLACLLYESLTGRAPFEAADV

SEQ ID NO: 1145005 - protein, 19 aa, Mycobacterium
YSLLYYRVLGVLIALSLTA

SEQ ID NO: 1145006 - protein, 18 aa, Mycobacterium
YVVKILLYILVAWLIVLT

SEQ ID NO: 1145007 - protein, 35 aa, Mycobacterium
YYNGDIRFIIIFTLLVVFLVLCILLRAVIAPIYLV

SEQ ID NO: 1145008 - protein, 8 aa, Mycobacterium
MKANEAKR

SEQ ID NO: 1145009 - protein, 11 aa, Mycobacterium
VPQRRRKKRLT

SEQ ID NO: 1145010 - protein, 4 aa, Mycobacterium
AGKT

SEQ ID NO: 1145011 - protein, 4 aa, Mycobacterium
GAGQ

SEQ ID NO: 1145012 - protein, 5 aa, Mycobacterium
PGSPW

SEQ ID NO: 1145013 - protein, 5 aa, Mycobacterium
TDRPR

SEQ ID NO: 1145014 - protein, 15 aa, Mycobacterium
YNANRPHSAHGELTP

SEQ ID NO: 1145015 - protein, 8 aa, Mycobacterium
RQQADGMS

SEQ ID NO: 1145016 - protein, 4 aa, Mycobacterium
AAAA

SEQ ID NO: 1145017 - protein, 8 aa, Mycobacterium
AARGQGRA

SEQ ID NO: 1145018 - protein, 4 aa, Mycobacterium
AGAD

SEQ ID NO: 1145019 - protein, 5 aa, Mycobacterium
EAENA

SEQ ID NO: 1145020 - protein, 4 aa, Mycobacterium
LPDG

SEQ ID NO: 1145021 - protein, 4 aa, Mycobacterium
SGIT

SEQ ID NO: 1145022 - protein, 7 aa, Mycobacterium
TTADGRT

SEQ ID NO: 1145023 - protein, 4 aa, Mycobacterium
GPGG

SEQ ID NO: 1145024 - protein, 8 aa, Mycobacterium
LDSENLSE

SEQ ID NO: 1145025 - protein, 4 aa, Mycobacterium
PTTG

SEQ ID NO: 1145026 - protein, 4 aa, Mycobacterium
RTRT

SEQ ID NO: 1145027 - protein, 8 aa, Mycobacterium
AAQPSQDR

SEQ ID NO: 1145028 - protein, 4 aa, Mycobacterium
AEGA

SEQ ID NO: 1145029 - protein, 8 aa, Mycobacterium
AGVRNAAS

SEQ ID NO: 1145030 - protein, 8 aa, Mycobacterium
GYRESTES

SEQ ID NO: 1145031 - protein, 9 aa, Mycobacterium
IKTTDADIE

SEQ ID NO: 1145032 - protein, 5 aa, Mycobacterium
PALIG

SEQ ID NO: 1145033 - protein, 4 aa, Mycobacterium
RDET

SEQ ID NO: 1145034 - protein, 11 aa, Mycobacterium
RPKAIRQSGVS

SEQ ID NO: 1145035 - protein, 6 aa, Mycobacterium
TNPIES

SEQ ID NO: 1145036 - protein, 5 aa, Mycobacterium
ADGRK

SEQ ID NO: 1145037 - protein, 9 aa, Mycobacterium
AESPRSRTR

SEQ ID NO: 1145038 - protein, 4 aa, Mycobacterium
AGLP

SEQ ID NO: 1145039 - protein, 4 aa, Mycobacterium
AGPR

SEQ ID NO: 1145040 - protein, 9 aa, Mycobacterium
APSGNPITA

SEQ ID NO: 1145041 - protein, 5 aa, Mycobacterium
ARRAG

SEQ ID NO: 1145042 - protein, 16 aa, Mycobacterium
ATYRGGEAKTDAKDAR

SEQ ID NO: 1145043 - protein, 5 aa, Mycobacterium
GCTHP

SEQ ID NO: 1145044 - protein, 4 aa, Mycobacterium
GGLG

SEQ ID NO: 1145045 - protein, 5 aa, Mycobacterium
KYPKA

SEQ ID NO: 1145046 - protein, 4 aa, Mycobacterium
LGPA

SEQ ID NO: 1145047 - protein, 8 aa, Mycobacterium
PSGSGKST

SEQ ID NO: 1145048 - protein, 6 aa, Mycobacterium
RGDSGR

SEQ ID NO: 1145049 - protein, 5 aa, Mycobacterium
RRGMT

SEQ ID NO: 1145050 - protein, 9 aa, Mycobacterium
SGAGLSAST

SEQ ID NO: 1145051 - protein, 4 aa, Mycobacterium
TDDS

SEQ ID NO: 1145052 - protein, 8 aa, Mycobacterium
TTREDSAG

SEQ ID NO: 1145053 - protein, 4 aa, Mycobacterium
AASA

SEQ ID NO: 1145054 - protein, 4 aa, Mycobacterium
AGAR

SEQ ID NO: 1145055 - protein, 4 aa, Mycobacterium
AGGQ

SEQ ID NO: 1145056 - protein, 4 aa, Mycobacterium
AGTG

SEQ ID NO: 1145057 - protein, 8 aa, Mycobacterium
DPHELGAT

SEQ ID NO: 1145058 - protein, 4 aa, Mycobacterium
FPTP

SEQ ID NO: 1145059 - protein, 11 aa, Mycobacterium
GPDPEPHYRPS

SEQ ID NO: 1145060 - protein, 6 aa, Mycobacterium
GTTGMP

SEQ ID NO: 1145061 - protein, 4 aa, Mycobacterium
IGPD

SEQ ID NO: 1145062 - protein, 4 aa, Mycobacterium
IPAG

SEQ ID NO: 1145063 - protein, 4 aa, Mycobacterium
LEPG

SEQ ID NO: 1145064 - protein, 4 aa, Mycobacterium
NSTV

SEQ ID NO: 1145065 - protein, 4 aa, Mycobacterium
PAAA

SEQ ID NO: 1145066 - protein, 8 aa, Mycobacterium
PSGCGKTT

SEQ ID NO: 1145067 - protein, 9 aa, Mycobacterium
SATEGGLSR

SEQ ID NO: 1145068 - protein, 9 aa, Mycobacterium
SEPEAGSDL

SEQ ID NO: 1145069 - protein, 4 aa, Mycobacterium
TARG

SEQ ID NO: 1145070 - protein, 4 aa, Mycobacterium
VPPG

SEQ ID NO: 1145071 - protein, 7 aa, Mycobacterium
WKANNKR

SEQ ID NO: 1145072 - protein, 4 aa, Mycobacterium
AAGA

SEQ ID NO: 1145073 - protein, 6 aa, Mycobacterium
AALRGS

SEQ ID NO: 1145074 - protein, 14 aa, Mycobacterium
ADGRAARRAADEAL

SEQ ID NO: 1145075 - protein, 4 aa, Mycobacterium
AEAG

SEQ ID NO: 1145076 - protein, 4 aa, Mycobacterium
AGPA

SEQ ID NO: 1145077 - protein, 6 aa, Mycobacterium
AGQRNA

SEQ ID NO: 1145078 - protein, 4 aa, Mycobacterium
AGVT

SEQ ID NO: 1145079 - protein, 10 aa, Mycobacterium
AHTGGGNKIP

SEQ ID NO: 1145080 - protein, 5 aa, Mycobacterium
APRAA

SEQ ID NO: 1145081 - protein, 11 aa, Mycobacterium
AVGSSADNALA

SEQ ID NO: 1145082 - protein, 21 aa, Mycobacterium
CDPDSKAYYQRKRDEGKRPIP

SEQ ID NO: 1145083 - protein, 5 aa, Mycobacterium
CGATR

SEQ ID NO: 1145084 - protein, 10 aa, Mycobacterium
DEDNTYGAPR

SEQ ID NO: 1145085 - protein, 4 aa, Mycobacterium
DELT

SEQ ID NO: 1145086 - protein, 7 aa, Mycobacterium
DGGATDL

SEQ ID NO: 1145087 - protein, 4 aa, Mycobacterium
DPDL

SEQ ID NO: 1145088 - protein, 7 aa, Mycobacterium
DTEGATI

SEQ ID NO: 1145089 - protein, 11 aa, Mycobacterium
EGAGAGSDEHY

SEQ ID NO: 1145090 - protein, 4 aa, Mycobacterium
EIPP

SEQ ID NO: 1145091 - protein, 4 aa, Mycobacterium
GGAG

SEQ ID NO: 1145092 - protein, 9 aa, Mycobacterium
GPPGTGKTT

SEQ ID NO: 1145093 - protein, 7 aa, Mycobacterium
GPTGCGK

SEQ ID NO: 1145094 - protein, 7 aa, Mycobacterium
GSQYTSR

SEQ ID NO: 1145095 - protein, 4 aa, Mycobacterium
GTGT

SEQ ID NO: 1145096 - protein, 5 aa, Mycobacterium
HGRGG

SEQ ID NO: 1145097 - protein, 6 aa, Mycobacterium
KRASGQ

SEQ ID NO: 1145098 - protein, 4 aa, Mycobacterium
LASG

SEQ ID NO: 1145099 - protein, 15 aa, Mycobacterium
LESRAGVGTTGGGTV

SEQ ID NO: 1145100 - protein, 8 aa, Mycobacterium
LGGITGAK

SEQ ID NO: 1145101 - protein, 11 aa, Mycobacterium
NDGAPEGQRVN

SEQ ID NO: 1145102 - protein, 5 aa, Mycobacterium
NTTRR

SEQ ID NO: 1145103 - protein, 4 aa, Mycobacterium
PATV

SEQ ID NO: 1145104 - protein, 4 aa, Mycobacterium
PERA

SEQ ID NO: 1145105 - protein, 12 aa, Mycobacterium
PVPGAESPEQEL

SEQ ID NO: 1145106 - protein, 21 aa, Mycobacterium
PVSRDSGKRTGRLHTPKRYSR

SEQ ID NO: 1145107 - protein, 13 aa, Mycobacterium
QDGTEPDHHTHQR

SEQ ID NO: 1145108 - protein, 4 aa, Mycobacterium
RDGV

SEQ ID NO: 1145109 - protein, 4 aa, Mycobacterium
RGGA

SEQ ID NO: 1145110 - protein, 4 aa, Mycobacterium
RMRG

SEQ ID NO: 1145111 - protein, 4 aa, Mycobacterium
RPGG

SEQ ID NO: 1145112 - protein, 18 aa, Mycobacterium
SSPATYERNLTPATLPEA

SEQ ID NO: 1145113 - protein, 10 aa, Mycobacterium
TGSSSRNGKT

SEQ ID NO: 1145114 - protein, 12 aa, Mycobacterium
TTVADPANQKVP

SEQ ID NO: 1145115 - protein, 12 aa, Mycobacterium
TWQPDSPPVTAA

SEQ ID NO: 1145116 - protein, 11 aa, Mycobacterium
VTKGPGSRAAG

SEQ ID NO: 1145117 - protein, 9 aa, Mycobacterium
AARGQGRSH

SEQ ID NO: 1145118 - protein, 4 aa, Mycobacterium
ADAA

SEQ ID NO: 1145119 - protein, 4 aa, Mycobacterium
ADGR

SEQ ID NO: 1145120 - protein, 4 aa, Mycobacterium
ADPA

SEQ ID NO: 1145121 - protein, 4 aa, Mycobacterium
AEAP

SEQ ID NO: 1145122 - protein, 4 aa, Mycobacterium
AERL

SEQ ID NO: 1145123 - protein, 5 aa, Mycobacterium
AGLPA

SEQ ID NO: 1145124 - protein, 4 aa, Mycobacterium
AGTP

SEQ ID NO: 1145125 - protein, 4 aa, Mycobacterium
ARPD

SEQ ID NO: 1145126 - protein, 5 aa, Mycobacterium
ATAGR

SEQ ID NO: 1145127 - protein, 9 aa, Mycobacterium
DEQSPDGTV

SEQ ID NO: 1145128 - protein, 4 aa, Mycobacterium
DGDA

SEQ ID NO: 1145129 - protein, 7 aa, Mycobacterium
DGGPTDL

SEQ ID NO: 1145130 - protein, 26 aa, Mycobacterium
DGPEPDDTERARKRGVSRSKQRPDGM

SEQ ID NO: 1145131 - protein, 12 aa, Mycobacterium
DNDPRSVGERRS

SEQ ID NO: 1145132 - protein, 4 aa, Mycobacterium
DPAT

SEQ ID NO: 1145133 - protein, 4 aa, Mycobacterium
DPDA

SEQ ID NO: 1145134 - protein, 4 aa, Mycobacterium
DPDG

SEQ ID NO: 1145135 - protein, 9 aa, Mycobacterium
FGRRDLSGS

SEQ ID NO: 1145136 - protein, 4 aa, Mycobacterium
GAHS

SEQ ID NO: 1145137 - protein, 9 aa, Mycobacterium
GEAVTGDAR

SEQ ID NO: 1145138 - protein, 4 aa, Mycobacterium
GEVR

SEQ ID NO: 1145139 - protein, 4 aa, Mycobacterium
GGAA

SEQ ID NO: 1145140 - protein, 4 aa, Mycobacterium
GGGV

SEQ ID NO: 1145141 - protein, 7 aa, Mycobacterium
GHPLGAT

SEQ ID NO: 1145142 - protein, 4 aa, Mycobacterium
GPDG

SEQ ID NO: 1145143 - protein, 10 aa, Mycobacterium
GPNGAGKTTT

SEQ ID NO: 1145144 - protein, 6 aa, Mycobacterium
GPTHAS

SEQ ID NO: 1145145 - protein, 10 aa, Mycobacterium
GQPIGAGRTT

SEQ ID NO: 1145146 - protein, 4 aa, Mycobacterium
GRSG

SEQ ID NO: 1145147 - protein, 4 aa, Mycobacterium
GVPA

SEQ ID NO: 1145148 - protein, 6 aa, Mycobacterium
HGRGGF

SEQ ID NO: 1145149 - protein, 4 aa, Mycobacterium
IDKA

SEQ ID NO: 1145150 - protein, 20 aa, Mycobacterium
KAPRVNDKRVDPDTGERKRF

SEQ ID NO: 1145151 - protein, 7 aa, Mycobacterium
KSAHASA

SEQ ID NO: 1145152 - protein, 4 aa, Mycobacterium
LAEQ

SEQ ID NO: 1145153 - protein, 5 aa, Mycobacterium
LDEKG

SEQ ID NO: 1145154 - protein, 4 aa, Mycobacterium
NVNG

SEQ ID NO: 1145155 - protein, 4 aa, Mycobacterium
PATK

SEQ ID NO: 1145156 - protein, 4 aa, Mycobacterium
PGAP

SEQ ID NO: 1145157 - protein, 4 aa, Mycobacterium
PGPH

SEQ ID NO: 1145158 - protein, 4 aa, Mycobacterium
PGVA

SEQ ID NO: 1145159 - protein, 4 aa, Mycobacterium
PSGR

SEQ ID NO: 1145160 - protein, 7 aa, Mycobacterium
RKSPQMS

SEQ ID NO: 1145161 - protein, 4 aa, Mycobacterium
RPET

SEQ ID NO: 1145162 - protein, 5 aa, Mycobacterium
SDFTP

SEQ ID NO: 1145163 - protein, 4 aa, Mycobacterium
SGAT

SEQ ID NO: 1145164 - protein, 8 aa, Mycobacterium
VDGAADSL

SEQ ID NO: 1145165 - protein, 4 aa, Mycobacterium
VPGT

SEQ ID NO: 1145166 - protein, 4 aa, Mycobacterium
WQDE

SEQ ID NO: 1145167 - protein, 14 aa, Mycobacterium
WTTPTGKRHTTVPG

SEQ ID NO: 1145168 - protein, 4 aa, Mycobacterium
ADGD

SEQ ID NO: 1145169 - protein, 4 aa, Mycobacterium
AEAH

SEQ ID NO: 1145170 - protein, 4 aa, Mycobacterium
AGAA

SEQ ID NO: 1145171 - protein, 4 aa, Mycobacterium
AGGE

SEQ ID NO: 1145172 - protein, 4 aa, Mycobacterium
AGGR

SEQ ID NO: 1145173 - protein, 6 aa, Mycobacterium
AGQETT

SEQ ID NO: 1145174 - protein, 6 aa, Mycobacterium
ANAVSE

SEQ ID NO: 1145175 - protein, 4 aa, Mycobacterium
APAQ

SEQ ID NO: 1145176 - protein, 13 aa, Mycobacterium
AQQAAKRPKPAKL

SEQ ID NO: 1145177 - protein, 4 aa, Mycobacterium
ATDG

SEQ ID NO: 1145178 - protein, 4 aa, Mycobacterium
ATGS

SEQ ID NO: 1145179 - protein, 6 aa, Mycobacterium
DAPATR

SEQ ID NO: 1145180 - protein, 4 aa, Mycobacterium
DDES

SEQ ID NO: 1145181 - protein, 5 aa, Mycobacterium
DEAGV

SEQ ID NO: 1145182 - protein, 4 aa, Mycobacterium
DEPL

SEQ ID NO: 1145183 - protein, 6 aa, Mycobacterium
DEPTGR

SEQ ID NO: 1145184 - protein, 8 aa, Mycobacterium
DGQPRTLD

SEQ ID NO: 1145185 - protein, 32 aa, Mycobacterium
DGSVRGPDGTAVAGPQTKAWNGRNKPHRQDRR

SEQ ID NO: 1145186 - protein, 11 aa, Mycobacterium
DWSDGGNTNVD

SEQ ID NO: 1145187 - protein, 4 aa, Mycobacterium
EEPA

SEQ ID NO: 1145188 - protein, 4 aa, Mycobacterium
EGAE

SEQ ID NO: 1145189 - protein, 23 aa, Mycobacterium
ERPTEITPPTPPSDGDQQAGTEV

SEQ ID NO: 1145190 - protein, 4 aa, Mycobacterium
ERSS

SEQ ID NO: 1145191 - protein, 4 aa, Mycobacterium
ESNT

SEQ ID NO: 1145192 - protein, 6 aa, Mycobacterium
ESPDAK

SEQ ID NO: 1145193 - protein, 4 aa, Mycobacterium
GAAS

SEQ ID NO: 1145194 - protein, 7 aa, Mycobacterium
GAGAETV

SEQ ID NO: 1145195 - protein, 4 aa, Mycobacterium
GAGV

SEQ ID NO: 1145196 - protein, 6 aa, Mycobacterium
GATGSA

SEQ ID NO: 1145197 - protein, 8 aa, Mycobacterium
GCDTATDR

SEQ ID NO: 1145198 - protein, 4 aa, Mycobacterium
GEDH

SEQ ID NO: 1145199 - protein, 5 aa, Mycobacterium
GGCTK

SEQ ID NO: 1145200 - protein, 8 aa, Mycobacterium
GGDTGADC

SEQ ID NO: 1145201 - protein, 4 aa, Mycobacterium
GGPM

SEQ ID NO: 1145202 - protein, 6 aa, Mycobacterium
GGRGGS

SEQ ID NO: 1145203 - protein, 4 aa, Mycobacterium
GNGL

SEQ ID NO: 1145204 - protein, 4 aa, Mycobacterium
GNIG

SEQ ID NO: 1145205 - protein, 4 aa, Mycobacterium
GPER

SEQ ID NO: 1145206 - protein, 9 aa, Mycobacterium
GSEANRRLT

SEQ ID NO: 1145207 - protein, 5 aa, Mycobacterium
GSQWA

SEQ ID NO: 1145208 - protein, 4 aa, Mycobacterium
GTGI

SEQ ID NO: 1145209 - protein, 5 aa, Mycobacterium
GTTAI

SEQ ID NO: 1145210 - protein, 5 aa, Mycobacterium
GVSGT

SEQ ID NO: 1145211 - protein, 4 aa, Mycobacterium
GVTA

SEQ ID NO: 1145212 - protein, 10 aa, Mycobacterium
GYSSPEPGHV

SEQ ID NO: 1145213 - protein, 11 aa, Mycobacterium
HDYSRGGRTDI

SEQ ID NO: 1145214 - protein, 10 aa, Mycobacterium
HGTGTPLGDP

SEQ ID NO: 1145215 - protein, 6 aa, Mycobacterium
KGTDLS

SEQ ID NO: 1145216 - protein, 10 aa, Mycobacterium
KRDPSTVSRE

SEQ ID NO: 1145217 - protein, 13 aa, Mycobacterium
KRPAEAADRAVPG

SEQ ID NO: 1145218 - protein, 4 aa, Mycobacterium
LPAD

SEQ ID NO: 1145219 - protein, 4 aa, Mycobacterium
LPDD

SEQ ID NO: 1145220 - protein, 9 aa, Mycobacterium
NGEPIGASG

SEQ ID NO: 1145221 - protein, 5 aa, Mycobacterium
NGLRP

SEQ ID NO: 1145222 - protein, 5 aa, Mycobacterium
NGPAV

SEQ ID NO: 1145223 - protein, 5 aa, Mycobacterium
NNRPR

SEQ ID NO: 1145224 - protein, 4 aa, Mycobacterium
PAAD

SEQ ID NO: 1145225 - protein, 4 aa, Mycobacterium
PAAV

SEQ ID NO: 1145226 - protein, 8 aa, Mycobacterium
PDEKGSTC

SEQ ID NO: 1145227 - protein, 5 aa, Mycobacterium
PDGAA

SEQ ID NO: 1145228 - protein, 5 aa, Mycobacterium
PDGNG

SEQ ID NO: 1145229 - protein, 4 aa, Mycobacterium
PDLA

SEQ ID NO: 1145230 - protein, 4 aa, Mycobacterium
PGEL

SEQ ID NO: 1145231 - protein, 9 aa, Mycobacterium
PGSFRPGRA

SEQ ID NO: 1145232 - protein, 4 aa, Mycobacterium
PGTT

SEQ ID NO: 1145233 - protein, 4 aa, Mycobacterium
PNPH

SEQ ID NO: 1145234 - protein, 5 aa, Mycobacterium
PPGCG

SEQ ID NO: 1145235 - protein, 15 aa, Mycobacterium
PPVKNGPALSGYGAE

SEQ ID NO: 1145236 - protein, 8 aa, Mycobacterium
PRLDTGQA

SEQ ID NO: 1145237 - protein, 7 aa, Mycobacterium
PTSALDP

SEQ ID NO: 1145238 - protein, 4 aa, Mycobacterium
QARK

SEQ ID NO: 1145239 - protein, 13 aa, Mycobacterium
QGAKPGEGGQLPG

SEQ ID NO: 1145240 - protein, 6 aa, Mycobacterium
QLTRAG

SEQ ID NO: 1145241 - protein, 12 aa, Mycobacterium
RARTQNKPQGHV

SEQ ID NO: 1145242 - protein, 11 aa, Mycobacterium
RATEARLSTER

SEQ ID NO: 1145243 - protein, 12 aa, Mycobacterium
RRNAATRSGTQV

SEQ ID NO: 1145244 - protein, 4 aa, Mycobacterium
SATG

SEQ ID NO: 1145245 - protein, 4 aa, Mycobacterium
SDGA

SEQ ID NO: 1145246 - protein, 10 aa, Mycobacterium
SGSTGSPKAV

SEQ ID NO: 1145247 - protein, 9 aa, Mycobacterium
SGTTGRPKG

SEQ ID NO: 1145248 - protein, 5 aa, Mycobacterium
SPPPH

SEQ ID NO: 1145249 - protein, 13 aa, Mycobacterium
SPSGQTYTTRPGS

SEQ ID NO: 1145250 - protein, 4 aa, Mycobacterium
SPTR

SEQ ID NO: 1145251 - protein, 13 aa, Mycobacterium
SPWQRPTNENTNG

SEQ ID NO: 1145252 - protein, 4 aa, Mycobacterium
TAGR

SEQ ID NO: 1145253 - protein, 4 aa, Mycobacterium
TAGT

SEQ ID NO: 1145254 - protein, 5 aa, Mycobacterium
TCRTP

SEQ ID NO: 1145255 - protein, 6 aa, Mycobacterium
TEEDCA

SEQ ID NO: 1145256 - protein, 4 aa, Mycobacterium
TEVP

SEQ ID NO: 1145257 - protein, 4 aa, Mycobacterium
TGGL

SEQ ID NO: 1145258 - protein, 4 aa, Mycobacterium
TGVD

SEQ ID NO: 1145259 - protein, 7 aa, Mycobacterium
THDPGAL

SEQ ID NO: 1145260 - protein, 5 aa, Mycobacterium
TLAQR

SEQ ID NO: 1145261 - protein, 4 aa, Mycobacterium
TLGS

SEQ ID NO: 1145262 - protein, 6 aa, Mycobacterium
TNPPLD

SEQ ID NO: 1145263 - protein, 4 aa, Mycobacterium
TPDR

SEQ ID NO: 1145264 - protein, 5 aa, Mycobacterium
TPLGP

SEQ ID NO: 1145265 - protein, 5 aa, Mycobacterium
VDPDG

SEQ ID NO: 1145266 - protein, 5 aa, Mycobacterium
VEGEA

SEQ ID NO: 1145267 - protein, 4 aa, Mycobacterium
VPDA

SEQ ID NO: 1145268 - protein, 4 aa, Mycobacterium
VSEP

SEQ ID NO: 1145269 - protein, 15 aa, Mycobacterium
VSTDDAAAEVGVSTP

SEQ ID NO: 1145270 - protein, 12 aa, Mycobacterium
VTPPGPGAPGVP

SEQ ID NO: 1145271 - protein, 10 aa, Mycobacterium
VTRRPHGQRT

SEQ ID NO: 1145272 - protein, 5 aa, Mycobacterium
AAAAG

SEQ ID NO: 1145273 - protein, 4 aa, Mycobacterium
AAAG

SEQ ID NO: 1145274 - protein, 4 aa, Mycobacterium
AADR

SEQ ID NO: 1145275 - protein, 4 aa, Mycobacterium
AAQR

SEQ ID NO: 1145276 - protein, 21 aa, Mycobacterium
AARQTLNESRGRIAQRTTLSP

SEQ ID NO: 1145277 - protein, 8 aa, Mycobacterium
AASFPPDR

SEQ ID NO: 1145278 - protein, 4 aa, Mycobacterium
ADAG

SEQ ID NO: 1145279 - protein, 4 aa, Mycobacterium
ADEF

SEQ ID NO: 1145280 - protein, 4 aa, Mycobacterium
ADEL

SEQ ID NO: 1145281 - protein, 4 aa, Mycobacterium
ADGS

SEQ ID NO: 1145282 - protein, 15 aa, Mycobacterium
ADNRSVDKDGGWSTR

SEQ ID NO: 1145283 - protein, 6 aa, Mycobacterium
AEENRH

SEQ ID NO: 1145284 - protein, 4 aa, Mycobacterium
AGGV

SEQ ID NO: 1145285 - protein, 4 aa, Mycobacterium
AGRL

SEQ ID NO: 1145286 - protein, 6 aa, Mycobacterium
AGSESL

SEQ ID NO: 1145287 - protein, 16 aa, Mycobacterium
AHAPGTGTPEAGGMTS

SEQ ID NO: 1145288 - protein, 4 aa, Mycobacterium
AKPY

SEQ ID NO: 1145289 - protein, 15 aa, Mycobacterium
AKTREAGPDHDPSSL

SEQ ID NO: 1145290 - protein, 6 aa, Mycobacterium
ALPPAA

SEQ ID NO: 1145291 - protein, 6 aa, Mycobacterium
APDPTW

SEQ ID NO: 1145292 - protein, 4 aa, Mycobacterium
APVG

SEQ ID NO: 1145293 - protein, 4 aa, Mycobacterium
ARGL

SEQ ID NO: 1145294 - protein, 4 aa, Mycobacterium
ARNR

SEQ ID NO: 1145295 - protein, 4 aa, Mycobacterium
ARPG

SEQ ID NO: 1145296 - protein, 5 aa, Mycobacterium
ARQDT

SEQ ID NO: 1145297 - protein, 4 aa, Mycobacterium
ARTP

SEQ ID NO: 1145298 - protein, 4 aa, Mycobacterium
ATTG

SEQ ID NO: 1145299 - protein, 4 aa, Mycobacterium
ATVG

SEQ ID NO: 1145300 - protein, 5 aa, Mycobacterium
CDKGN

SEQ ID NO: 1145301 - protein, 4 aa, Mycobacterium
DAEA

SEQ ID NO: 1145302 - protein, 5 aa, Mycobacterium
DARAA

SEQ ID NO: 1145303 - protein, 4 aa, Mycobacterium
DATT

SEQ ID NO: 1145304 - protein, 4 aa, Mycobacterium
DDVP

SEQ ID NO: 1145305 - protein, 14 aa, Mycobacterium
DEDPRTADERRNDA

SEQ ID NO: 1145306 - protein, 4 aa, Mycobacterium
DEGA

SEQ ID NO: 1145307 - protein, 4 aa, Mycobacterium
DGDL

SEQ ID NO: 1145308 - protein, 4 aa, Mycobacterium
DGDR

SEQ ID NO: 1145309 - protein, 4 aa, Mycobacterium
DGDV

SEQ ID NO: 1145310 - protein, 4 aa, Mycobacterium
DGER

SEQ ID NO: 1145311 - protein, 5 aa, Mycobacterium
DGSSV

SEQ ID NO: 1145312 - protein, 5 aa, Mycobacterium
DKLPS

SEQ ID NO: 1145313 - protein, 4 aa, Mycobacterium
DLSS

SEQ ID NO: 1145314 - protein, 4 aa, Mycobacterium
DPAD

SEQ ID NO: 1145315 - protein, 5 aa, Mycobacterium
DPDGA

SEQ ID NO: 1145316 - protein, 4 aa, Mycobacterium
DPRL

SEQ ID NO: 1145317 - protein, 5 aa, Mycobacterium
DPSGL

SEQ ID NO: 1145318 - protein, 9 aa, Mycobacterium
DRGSQYTSH

SEQ ID NO: 1145319 - protein, 13 aa, Mycobacterium
DTPAERLRDLLLT

SEQ ID NO: 1145320 - protein, 6 aa, Mycobacterium
EAPGLA

SEQ ID NO: 1145321 - protein, 7 aa, Mycobacterium
EARKPGS

SEQ ID NO: 1145322 - protein, 4 aa, Mycobacterium
EASG

SEQ ID NO: 1145323 - protein, 5 aa, Mycobacterium
EASSG

SEQ ID NO: 1145324 - protein, 5 aa, Mycobacterium
EDVEP

SEQ ID NO: 1145325 - protein, 5 aa, Mycobacterium
EEGLS

SEQ ID NO: 1145326 - protein, 4 aa, Mycobacterium
EENA

SEQ ID NO: 1145327 - protein, 5 aa, Mycobacterium
EERPD

SEQ ID NO: 1145328 - protein, 5 aa, Mycobacterium
EEYGG

SEQ ID NO: 1145329 - protein, 4 aa, Mycobacterium
ELGP

SEQ ID NO: 1145330 - protein, 4 aa, Mycobacterium
EPAL

SEQ ID NO: 1145331 - protein, 4 aa, Mycobacterium
EPEV

SEQ ID NO: 1145332 - protein, 8 aa, Mycobacterium
EPGAGSDL

SEQ ID NO: 1145333 - protein, 7 aa, Mycobacterium
EPTSGLD

SEQ ID NO: 1145334 - protein, 4 aa, Mycobacterium
EQGT

SEQ ID NO: 1145335 - protein, 4 aa, Mycobacterium
ERAR

SEQ ID NO: 1145336 - protein, 4 aa, Mycobacterium
ERRT

SEQ ID NO: 1145337 - protein, 4 aa, Mycobacterium
ERTR

SEQ ID NO: 1145338 - protein, 4 aa, Mycobacterium
ETTA

SEQ ID NO: 1145339 - protein, 4 aa, Mycobacterium
FGGG

SEQ ID NO: 1145340 - protein, 4 aa, Mycobacterium
GAAG

SEQ ID NO: 1145341 - protein, 4 aa, Mycobacterium
GAGD

SEQ ID NO: 1145342 - protein, 4 aa, Mycobacterium
GAPQ

SEQ ID NO: 1145343 - protein, 5 aa, Mycobacterium
GEPIP

SEQ ID NO: 1145344 - protein, 6 aa, Mycobacterium
GEPQPE

SEQ ID NO: 1145345 - protein, 4 aa, Mycobacterium
GGDP

SEQ ID NO: 1145346 - protein, 4 aa, Mycobacterium
GGEL

SEQ ID NO: 1145347 - protein, 4 aa, Mycobacterium
GGGG

SEQ ID NO: 1145348 - protein, 13 aa, Mycobacterium
GGGWGSGALAILR

SEQ ID NO: 1145349 - protein, 7 aa, Mycobacterium
GGLKKEV

SEQ ID NO: 1145350 - protein, 5 aa, Mycobacterium
GGTNE

SEQ ID NO: 1145351 - protein, 4 aa, Mycobacterium
GKPP

SEQ ID NO: 1145352 - protein, 4 aa, Mycobacterium
GNAI

SEQ ID NO: 1145353 - protein, 6 aa, Mycobacterium
GPALAA

SEQ ID NO: 1145354 - protein, 4 aa, Mycobacterium
GPAP

SEQ ID NO: 1145355 - protein, 4 aa, Mycobacterium
GPRL

SEQ ID NO: 1145356 - protein, 11 aa, Mycobacterium
GSVRSTGPGLG

SEQ ID NO: 1145357 - protein, 4 aa, Mycobacterium
GTDL

SEQ ID NO: 1145358 - protein, 8 aa, Mycobacterium
GTGGHSAG

SEQ ID NO: 1145359 - protein, 8 aa, Mycobacterium
GTGSSGIQ

SEQ ID NO: 1145360 - protein, 7 aa, Mycobacterium
GTPEQQQ

SEQ ID NO: 1145361 - protein, 9 aa, Mycobacterium
GTTGRPKGA

SEQ ID NO: 1145362 - protein, 9 aa, Mycobacterium
GVSPANAKT

SEQ ID NO: 1145363 - protein, 5 aa, Mycobacterium
GVSRP

SEQ ID NO: 1145364 - protein, 4 aa, Mycobacterium
HAGP

SEQ ID NO: 1145365 - protein, 10 aa, Mycobacterium
IPWGKPEAKR

SEQ ID NO: 1145366 - protein, 4 aa, Mycobacterium
IRPG

SEQ ID NO: 1145367 - protein, 6 aa, Mycobacterium
ISPTET

SEQ ID NO: 1145368 - protein, 5 aa, Mycobacterium
KKGDQ

SEQ ID NO: 1145369 - protein, 8 aa, Mycobacterium
KLSPEQIS

SEQ ID NO: 1145370 - protein, 8 aa, Mycobacterium
KNVSTVSR

SEQ ID NO: 1145371 - protein, 6 aa, Mycobacterium
KPFSPR

SEQ ID NO: 1145372 - protein, 6 aa, Mycobacterium
LAEKDR

SEQ ID NO: 1145373 - protein, 5 aa, Mycobacterium
LDTGV

SEQ ID NO: 1145374 - protein, 8 aa, Mycobacterium
LNGRPRKT

SEQ ID NO: 1145375 - protein, 4 aa, Mycobacterium
LNGT

SEQ ID NO: 1145376 - protein, 4 aa, Mycobacterium
LPAG

SEQ ID NO: 1145377 - protein, 4 aa, Mycobacterium
LRDD

SEQ ID NO: 1145378 - protein, 19 aa, Mycobacterium
LRTGRTRRKPHRKEGERYQ

SEQ ID NO: 1145379 - protein, 4 aa, Mycobacterium
LSGG

SEQ ID NO: 1145380 - protein, 6 aa, Mycobacterium
NAPDDV

SEQ ID NO: 1145381 - protein, 4 aa, Mycobacterium
NLPS

SEQ ID NO: 1145382 - protein, 4 aa, Mycobacterium
PAAL

SEQ ID NO: 1145383 - protein, 4 aa, Mycobacterium
PAVT

SEQ ID NO: 1145384 - protein, 5 aa, Mycobacterium
PFSPR

SEQ ID NO: 1145385 - protein, 4 aa, Mycobacterium
PGGV

SEQ ID NO: 1145386 - protein, 16 aa, Mycobacterium
PGRPLASGYAEQNQRE

SEQ ID NO: 1145387 - protein, 7 aa, Mycobacterium
PKTRSGK

SEQ ID NO: 1145388 - protein, 5 aa, Mycobacterium
PLPSL

SEQ ID NO: 1145389 - protein, 4 aa, Mycobacterium
PTNR

SEQ ID NO: 1145390 - protein, 4 aa, Mycobacterium
QADP

SEQ ID NO: 1145391 - protein, 4 aa, Mycobacterium
QEEA

SEQ ID NO: 1145392 - protein, 5 aa, Mycobacterium
QEEAL

SEQ ID NO: 1145393 - protein, 4 aa, Mycobacterium
QGVR

SEQ ID NO: 1145394 - protein, 4 aa, Mycobacterium
QPRV

SEQ ID NO: 1145395 - protein, 11 aa, Mycobacterium
QRRTEPTARQQ

SEQ ID NO: 1145396 - protein, 7 aa, Mycobacterium
QRSSGRG

SEQ ID NO: 1145397 - protein, 13 aa, Mycobacterium
RAAASARARPKQS

SEQ ID NO: 1145398 - protein, 5 aa, Mycobacterium
RAGTV

SEQ ID NO: 1145399 - protein, 6 aa, Mycobacterium
RAVRDG

SEQ ID NO: 1145400 - protein, 4 aa, Mycobacterium
RDEA

SEQ ID NO: 1145401 - protein, 8 aa, Mycobacterium
RDRTEAQN

SEQ ID NO: 1145402 - protein, 4 aa, Mycobacterium
REGT

SEQ ID NO: 1145403 - protein, 4 aa, Mycobacterium
RGEG

SEQ ID NO: 1145404 - protein, 5 aa, Mycobacterium
RGGSV

SEQ ID NO: 1145405 - protein, 4 aa, Mycobacterium
RGKR

SEQ ID NO: 1145406 - protein, 4 aa, Mycobacterium
RGRR

SEQ ID NO: 1145407 - protein, 11 aa, Mycobacterium
RHTNNTRVHPD

SEQ ID NO: 1145408 - protein, 5 aa, Mycobacterium
RLKEN

SEQ ID NO: 1145409 - protein, 4 aa, Mycobacterium
RNPE

SEQ ID NO: 1145410 - protein, 12 aa, Mycobacterium
RPAEVDDRAVPG

SEQ ID NO: 1145411 - protein, 4 aa, Mycobacterium
RPDA

SEQ ID NO: 1145412 - protein, 4 aa, Mycobacterium
RPEL

SEQ ID NO: 1145413 - protein, 6 aa, Mycobacterium
RQGNQF

SEQ ID NO: 1145414 - protein, 5 aa, Mycobacterium
RRADA

SEQ ID NO: 1145415 - protein, 11 aa, Mycobacterium
RRDHPDDESMQ

SEQ ID NO: 1145416 - protein, 4 aa, Mycobacterium
RRHS

SEQ ID NO: 1145417 - protein, 6 aa, Mycobacterium
RRSSAR

SEQ ID NO: 1145418 - protein, 8 aa, Mycobacterium
RRTASTAQ

SEQ ID NO: 1145419 - protein, 4 aa, Mycobacterium
RSAA

SEQ ID NO: 1145420 - protein, 4 aa, Mycobacterium
RSSW

SEQ ID NO: 1145421 - protein, 25 aa, Mycobacterium
RVRDGAASDARHGPPEGDLTARDNA

SEQ ID NO: 1145422 - protein, 5 aa, Mycobacterium
SASVT

SEQ ID NO: 1145423 - protein, 8 aa, Mycobacterium
SATESDDV

SEQ ID NO: 1145424 - protein, 4 aa, Mycobacterium
SDHG

SEQ ID NO: 1145425 - protein, 5 aa, Mycobacterium
SGADD

SEQ ID NO: 1145426 - protein, 9 aa, Mycobacterium
SGGADLPTQ

SEQ ID NO: 1145427 - protein, 4 aa, Mycobacterium
SGGV

SEQ ID NO: 1145428 - protein, 12 aa, Mycobacterium
SGPGGMTEQDDM

SEQ ID NO: 1145429 - protein, 5 aa, Mycobacterium
SGPGS

SEQ ID NO: 1145430 - protein, 10 aa, Mycobacterium
SKRTYGSPRI

SEQ ID NO: 1145431 - protein, 6 aa, Mycobacterium
SPLRDA

SEQ ID NO: 1145432 - protein, 13 aa, Mycobacterium
SPWQRGSNENTNG

SEQ ID NO: 1145433 - protein, 5 aa, Mycobacterium
SRYDE

SEQ ID NO: 1145434 - protein, 4 aa, Mycobacterium
STAD

SEQ ID NO: 1145435 - protein, 5 aa, Mycobacterium
STGRR

SEQ ID NO: 1145436 - protein, 6 aa, Mycobacterium
SVGATA

SEQ ID NO: 1145437 - protein, 4 aa, Mycobacterium
TAPA

SEQ ID NO: 1145438 - protein, 7 aa, Mycobacterium
TAVRDGD

SEQ ID NO: 1145439 - protein, 4 aa, Mycobacterium
TDGQ

SEQ ID NO: 1145440 - protein, 4 aa, Mycobacterium
TDPY

SEQ ID NO: 1145441 - protein, 9 aa, Mycobacterium
TGEKNQTAI

SEQ ID NO: 1145442 - protein, 5 aa, Mycobacterium
TGEPL

SEQ ID NO: 1145443 - protein, 4 aa, Mycobacterium
TGER

SEQ ID NO: 1145444 - protein, 7 aa, Mycobacterium
TGQRNAI

SEQ ID NO: 1145445 - protein, 7 aa, Mycobacterium
TGRPAID

SEQ ID NO: 1145446 - protein, 4 aa, Mycobacterium
TPDE

SEQ ID NO: 1145447 - protein, 4 aa, Mycobacterium
TPDQ

SEQ ID NO: 1145448 - protein, 6 aa, Mycobacterium
TQASQG

SEQ ID NO: 1145449 - protein, 12 aa, Mycobacterium
TTLRNDPKYATQ

SEQ ID NO: 1145450 - protein, 5 aa, Mycobacterium
TTTLG

SEQ ID NO: 1145451 - protein, 5 aa, Mycobacterium
TVRDP

SEQ ID NO: 1145452 - protein, 10 aa, Mycobacterium
VAGPEADELT

SEQ ID NO: 1145453 - protein, 6 aa, Mycobacterium
VDQTGL

SEQ ID NO: 1145454 - protein, 9 aa, Mycobacterium
VGAAGDNAA

SEQ ID NO: 1145455 - protein, 6 aa, Mycobacterium
VGADGA

SEQ ID NO: 1145456 - protein, 9 aa, Mycobacterium
VGPKELKDA

SEQ ID NO: 1145457 - protein, 7 aa, Mycobacterium
VNTDPHP

SEQ ID NO: 1145458 - protein, 4 aa, Mycobacterium
VPEG

SEQ ID NO: 1145459 - protein, 4 aa, Mycobacterium
VPGS

SEQ ID NO: 1145460 - protein, 6 aa, Mycobacterium
VSHSTA

SEQ ID NO: 1145461 - protein, 4 aa, Mycobacterium
VTED

SEQ ID NO: 1145462 - protein, 8 aa, Mycobacterium
VTINSGGE

SEQ ID NO: 1145463 - protein, 5 aa, Mycobacterium
VTNPT

SEQ ID NO: 1145464 - protein, 9 aa, Mycobacterium
WSTGAAARE

SEQ ID NO: 1145465 - protein, 4 aa, Mycobacterium
YRSS

SEQ ID NO: 1145466 - protein, 9 aa, Mycobacterium
AAAAPEKSN

SEQ ID NO: 1145467 - protein, 4 aa, Mycobacterium
AAAD

SEQ ID NO: 1145468 - protein, 4 aa, Mycobacterium
AAAL

SEQ ID NO: 1145469 - protein, 4 aa, Mycobacterium
AADP

SEQ ID NO: 1145470 - protein, 4 aa, Mycobacterium
AAET

SEQ ID NO: 1145471 - protein, 4 aa, Mycobacterium
AAGG

SEQ ID NO: 1145472 - protein, 6 aa, Mycobacterium
AALTEQ

SEQ ID NO: 1145473 - protein, 21 aa, Mycobacterium
AANADPPPPAPHPDYGDDPPP

SEQ ID NO: 1145474 - protein, 4 aa, Mycobacterium
AAPG

SEQ ID NO: 1145475 - protein, 5 aa, Mycobacterium
AAPGR

SEQ ID NO: 1145476 - protein, 4 aa, Mycobacterium
AARE

SEQ ID NO: 1145477 - protein, 4 aa, Mycobacterium
AART

SEQ ID NO: 1145478 - protein, 4 aa, Mycobacterium
AAVG

SEQ ID NO: 1145479 - protein, 6 aa, Mycobacterium
ADEAAA

SEQ ID NO: 1145480 - protein, 5 aa, Mycobacterium
ADGAT

SEQ ID NO: 1145481 - protein, 4 aa, Mycobacterium
ADPD

SEQ ID NO: 1145482 - protein, 4 aa, Mycobacterium
ADRD

SEQ ID NO: 1145483 - protein, 6 aa, Mycobacterium
ADSPVG

SEQ ID NO: 1145484 - protein, 7 aa, Mycobacterium
ADTRSHS

SEQ ID NO: 1145485 - protein, 4 aa, Mycobacterium
AEAA

SEQ ID NO: 1145486 - protein, 5 aa, Mycobacterium
AEAFT

SEQ ID NO: 1145487 - protein, 4 aa, Mycobacterium
AENA

SEQ ID NO: 1145488 - protein, 4 aa, Mycobacterium
AEPE

SEQ ID NO: 1145489 - protein, 5 aa, Mycobacterium
AETDE

SEQ ID NO: 1145490 - protein, 8 aa, Mycobacterium
AGADGADV

SEQ ID NO: 1145491 - protein, 4 aa, Mycobacterium
AGDG

SEQ ID NO: 1145492 - protein, 5 aa, Mycobacterium
AGEGR

SEQ ID NO: 1145493 - protein, 5 aa, Mycobacterium
AGGST

SEQ ID NO: 1145494 - protein, 4 aa, Mycobacterium
AGRS

SEQ ID NO: 1145495 - protein, 5 aa, Mycobacterium
AGRSQ

SEQ ID NO: 1145496 - protein, 4 aa, Mycobacterium
AGRT

SEQ ID NO: 1145497 - protein, 7 aa, Mycobacterium
AIRQSPD

SEQ ID NO: 1145498 - protein, 4 aa, Mycobacterium
ALAA

SEQ ID NO: 1145499 - protein, 4 aa, Mycobacterium
ALAP

SEQ ID NO: 1145500 - protein, 4 aa, Mycobacterium
ALPI

SEQ ID NO: 1145501 - protein, 5 aa, Mycobacterium
APADV

SEQ ID NO: 1145502 - protein, 4 aa, Mycobacterium
APDA

SEQ ID NO: 1145503 - protein, 4 aa, Mycobacterium
APDE

SEQ ID NO: 1145504 - protein, 11 aa, Mycobacterium
APDHRVQGEEM

SEQ ID NO: 1145505 - protein, 6 aa, Mycobacterium
APEEFK

SEQ ID NO: 1145506 - protein, 14 aa, Mycobacterium
APGDPNFASAPAEI

SEQ ID NO: 1145507 - protein, 4 aa, Mycobacterium
APGG

SEQ ID NO: 1145508 - protein, 9 aa, Mycobacterium
APGGTRTPR

SEQ ID NO: 1145509 - protein, 10 aa, Mycobacterium
APGRPQGRGK

SEQ ID NO: 1145510 - protein, 4 aa, Mycobacterium
APGT

SEQ ID NO: 1145511 - protein, 6 aa, Mycobacterium
APPEAA

SEQ ID NO: 1145512 - protein, 7 aa, Mycobacterium
APQAADA

SEQ ID NO: 1145513 - protein, 4 aa, Mycobacterium
APTT

SEQ ID NO: 1145514 - protein, 4 aa, Mycobacterium
AQAT

SEQ ID NO: 1145515 - protein, 5 aa, Mycobacterium
AQGQL

SEQ ID NO: 1145516 - protein, 7 aa, Mycobacterium
AQPPPFD

SEQ ID NO: 1145517 - protein, 4 aa, Mycobacterium
ARGA

SEQ ID NO: 1145518 - protein, 6 aa, Mycobacterium
ARGDIG

SEQ ID NO: 1145519 - protein, 5 aa, Mycobacterium
ARGLG

SEQ ID NO: 1145520 - protein, 4 aa, Mycobacterium
ARID

SEQ ID NO: 1145521 - protein, 7 aa, Mycobacterium
ARNKSSV

SEQ ID NO: 1145522 - protein, 4 aa, Mycobacterium
ARPP

SEQ ID NO: 1145523 - protein, 5 aa, Mycobacterium
ARSRP

SEQ ID NO: 1145524 - protein, 5 aa, Mycobacterium
ARTSG

SEQ ID NO: 1145525 - protein, 4 aa, Mycobacterium
ASGL

SEQ ID NO: 1145526 - protein, 4 aa, Mycobacterium
ASGV

SEQ ID NO: 1145527 - protein, 4 aa, Mycobacterium
ASQV

SEQ ID NO: 1145528 - protein, 4 aa, Mycobacterium
ASRE

SEQ ID NO: 1145529 - protein, 4 aa, Mycobacterium
ASSL

SEQ ID NO: 1145530 - protein, 4 aa, Mycobacterium
ASSR

SEQ ID NO: 1145531 - protein, 5 aa, Mycobacterium
ATAAA

SEQ ID NO: 1145532 - protein, 17 aa, Mycobacterium
ATAKAPAPRPKPDPPSF

SEQ ID NO: 1145533 - protein, 8 aa, Mycobacterium
ATARDGGY

SEQ ID NO: 1145534 - protein, 5 aa, Mycobacterium
ATHAP

SEQ ID NO: 1145535 - protein, 18 aa, Mycobacterium
ATIPLSDSSTYPSTERTL

SEQ ID NO: 1145536 - protein, 4 aa, Mycobacterium
ATRG

SEQ ID NO: 1145537 - protein, 4 aa, Mycobacterium
AVDP

SEQ ID NO: 1145538 - protein, 4 aa, Mycobacterium
AVEA

SEQ ID NO: 1145539 - protein, 4 aa, Mycobacterium
AVGE

SEQ ID NO: 1145540 - protein, 4 aa, Mycobacterium
AVPD

SEQ ID NO: 1145541 - protein, 5 aa, Mycobacterium
CATTA

SEQ ID NO: 1145542 - protein, 4 aa, Mycobacterium
DAAR

SEQ ID NO: 1145543 - protein, 5 aa, Mycobacterium
DADSA

SEQ ID NO: 1145544 - protein, 4 aa, Mycobacterium
DAGD

SEQ ID NO: 1145545 - protein, 4 aa, Mycobacterium
DAMP

SEQ ID NO: 1145546 - protein, 4 aa, Mycobacterium
DAPA

SEQ ID NO: 1145547 - protein, 11 aa, Mycobacterium
DARSSGATVTT

SEQ ID NO: 1145548 - protein, 8 aa, Mycobacterium
DDPTGSAN

SEQ ID NO: 1145549 - protein, 4 aa, Mycobacterium
DELG

SEQ ID NO: 1145550 - protein, 4 aa, Mycobacterium
DEPT

SEQ ID NO: 1145551 - protein, 7 aa, Mycobacterium
DEPTTAL

SEQ ID NO: 1145552 - protein, 4 aa, Mycobacterium
DEQL

SEQ ID NO: 1145553 - protein, 4 aa, Mycobacterium
DERR

SEQ ID NO: 1145554 - protein, 4 aa, Mycobacterium
DEYP

SEQ ID NO: 1145555 - protein, 4 aa, Mycobacterium
DGAR

SEQ ID NO: 1145556 - protein, 8 aa, Mycobacterium
DGCRPTAG

SEQ ID NO: 1145557 - protein, 4 aa, Mycobacterium
DGDE

SEQ ID NO: 1145558 - protein, 4 aa, Mycobacterium
DGEA

SEQ ID NO: 1145559 - protein, 4 aa, Mycobacterium
DGGA

SEQ ID NO: 1145560 - protein, 6 aa, Mycobacterium
DGIPPK

SEQ ID NO: 1145561 - protein, 4 aa, Mycobacterium
DGPL

SEQ ID NO: 1145562 - protein, 5 aa, Mycobacterium
DGVRT

SEQ ID NO: 1145563 - protein, 7 aa, Mycobacterium
DNTYPGA

SEQ ID NO: 1145564 - protein, 9 aa, Mycobacterium
DPKAPSLTD

SEQ ID NO: 1145565 - protein, 5 aa, Mycobacterium
DPSTD

SEQ ID NO: 1145566 - protein, 4 aa, Mycobacterium
DPVD

SEQ ID NO: 1145567 - protein, 4 aa, Mycobacterium
DRPD

SEQ ID NO: 1145568 - protein, 6 aa, Mycobacterium
DRRDGA

SEQ ID NO: 1145569 - protein, 6 aa, Mycobacterium
DSADPL

SEQ ID NO: 1145570 - protein, 4 aa, Mycobacterium
DSPE

SEQ ID NO: 1145571 - protein, 4 aa, Mycobacterium
DSVR

SEQ ID NO: 1145572 - protein, 19 aa, Mycobacterium
DWPGPGEALPSGYAEQNQR

SEQ ID NO: 1145573 - protein, 4 aa, Mycobacterium
EALR

SEQ ID NO: 1145574 - protein, 4 aa, Mycobacterium
EDAQ

SEQ ID NO: 1145575 - protein, 5 aa, Mycobacterium
EDEGH

SEQ ID NO: 1145576 - protein, 14 aa, Mycobacterium
EDGGRRSPQANQRV

SEQ ID NO: 1145577 - protein, 4 aa, Mycobacterium
EDPD

SEQ ID NO: 1145578 - protein, 8 aa, Mycobacterium
EDPGSGDM

SEQ ID NO: 1145579 - protein, 11 aa, Mycobacterium
EDRPVQHDGRW

SEQ ID NO: 1145580 - protein, 4 aa, Mycobacterium
EEAG

SEQ ID NO: 1145581 - protein, 4 aa, Mycobacterium
EEDY

SEQ ID NO: 1145582 - protein, 7 aa, Mycobacterium
EEISEEQ

SEQ ID NO: 1145583 - protein, 4 aa, Mycobacterium
EGPQ

SEQ ID NO: 1145584 - protein, 6 aa, Mycobacterium
ELAKSG

SEQ ID NO: 1145585 - protein, 6 aa, Mycobacterium
ELTEGG

SEQ ID NO: 1145586 - protein, 4 aa, Mycobacterium
EQLP

SEQ ID NO: 1145587 - protein, 11 aa, Mycobacterium
ERATTGSDDHY

SEQ ID NO: 1145588 - protein, 9 aa, Mycobacterium
ESAYGPQFD

SEQ ID NO: 1145589 - protein, 5 aa, Mycobacterium
ETRPD

SEQ ID NO: 1145590 - protein, 7 aa, Mycobacterium
EVGAGKT

SEQ ID NO: 1145591 - protein, 7 aa, Mycobacterium
EYEGYPD

SEQ ID NO: 1145592 - protein, 4 aa, Mycobacterium
FGTT

SEQ ID NO: 1145593 - protein, 4 aa, Mycobacterium
FREE

SEQ ID NO: 1145594 - protein, 10 aa, Mycobacterium
FSGKPTNAGW

SEQ ID NO: 1145595 - protein, 7 aa, Mycobacterium
FTGEAAR

SEQ ID NO: 1145596 - protein, 4 aa, Mycobacterium
GADA

SEQ ID NO: 1145597 - protein, 8 aa, Mycobacterium
GAGNETTT

SEQ ID NO: 1145598 - protein, 4 aa, Mycobacterium
GALP

SEQ ID NO: 1145599 - protein, 6 aa, Mycobacterium
GATTVP

SEQ ID NO: 1145600 - protein, 4 aa, Mycobacterium
GDRG

SEQ ID NO: 1145601 - protein, 8 aa, Mycobacterium
GDRGDAAP

SEQ ID NO: 1145602 - protein, 4 aa, Mycobacterium
GDTA

SEQ ID NO: 1145603 - protein, 7 aa, Mycobacterium
GEATANP

SEQ ID NO: 1145604 - protein, 8 aa, Mycobacterium
GEKTSDEA

SEQ ID NO: 1145605 - protein, 4 aa, Mycobacterium
GELG

SEQ ID NO: 1145606 - protein, 4 aa, Mycobacterium
GENT

SEQ ID NO: 1145607 - protein, 4 aa, Mycobacterium
GEPV

SEQ ID NO: 1145608 - protein, 4 aa, Mycobacterium
GEQK

SEQ ID NO: 1145609 - protein, 4 aa, Mycobacterium
GERA

SEQ ID NO: 1145610 - protein, 6 aa, Mycobacterium
GGDAVG

SEQ ID NO: 1145611 - protein, 6 aa, Mycobacterium
GGEPVD

SEQ ID NO: 1145612 - protein, 5 aa, Mycobacterium
GGGLA

SEQ ID NO: 1145613 - protein, 7 aa, Mycobacterium
GGIDTGR

SEQ ID NO: 1145614 - protein, 5 aa, Mycobacterium
GGNDP

SEQ ID NO: 1145615 - protein, 4 aa, Mycobacterium
GGQQ

SEQ ID NO: 1145616 - protein, 5 aa, Mycobacterium
GGSGN

SEQ ID NO: 1145617 - protein, 4 aa, Mycobacterium
GGVG

SEQ ID NO: 1145618 - protein, 9 aa, Mycobacterium
GHPDRPPTH

SEQ ID NO: 1145619 - protein, 6 aa, Mycobacterium
GHPENV

SEQ ID NO: 1145620 - protein, 5 aa, Mycobacterium
GLDPR

SEQ ID NO: 1145621 - protein, 8 aa, Mycobacterium
GLSTRQRG

SEQ ID NO: 1145622 - protein, 9 aa, Mycobacterium
GMTPADTAD

SEQ ID NO: 1145623 - protein, 9 aa, Mycobacterium
GNVRPQISE

SEQ ID NO: 1145624 - protein, 4 aa, Mycobacterium
GPAI

SEQ ID NO: 1145625 - protein, 5 aa, Mycobacterium
GPEIG

SEQ ID NO: 1145626 - protein, 9 aa, Mycobacterium
GPGDDPRVT

SEQ ID NO: 1145627 - protein, 4 aa, Mycobacterium
GPLA

SEQ ID NO: 1145628 - protein, 7 aa, Mycobacterium
GPRVGDR

SEQ ID NO: 1145629 - protein, 4 aa, Mycobacterium
GPTG

SEQ ID NO: 1145630 - protein, 15 aa, Mycobacterium
GQIGPESAKPGYGRV

SEQ ID NO: 1145631 - protein, 4 aa, Mycobacterium
GQPE

SEQ ID NO: 1145632 - protein, 10 aa, Mycobacterium
GQPIGTGRTT

SEQ ID NO: 1145633 - protein, 4 aa, Mycobacterium
GQSG

SEQ ID NO: 1145634 - protein, 4 aa, Mycobacterium
GRLD

SEQ ID NO: 1145635 - protein, 4 aa, Mycobacterium
GRPG

SEQ ID NO: 1145636 - protein, 4 aa, Mycobacterium
GRPL

SEQ ID NO: 1145637 - protein, 4 aa, Mycobacterium
GRRA

SEQ ID NO: 1145638 - protein, 5 aa, Mycobacterium
GRRSH

SEQ ID NO: 1145639 - protein, 4 aa, Mycobacterium
GRTG

SEQ ID NO: 1145640 - protein, 8 aa, Mycobacterium
GSGDDPDE

SEQ ID NO: 1145641 - protein, 6 aa, Mycobacterium
GSGGEF

SEQ ID NO: 1145642 - protein, 8 aa, Mycobacterium
GSNTSTLP

SEQ ID NO: 1145643 - protein, 4 aa, Mycobacterium
GSPL

SEQ ID NO: 1145644 - protein, 4 aa, Mycobacterium
GSSG

SEQ ID NO: 1145645 - protein, 14 aa, Mycobacterium
GSVSALSKAGQTAR

SEQ ID NO: 1145646 - protein, 7 aa, Mycobacterium
GTDLTDT

SEQ ID NO: 1145647 - protein, 4 aa, Mycobacterium
GTLS

SEQ ID NO: 1145648 - protein, 4 aa, Mycobacterium
GVGG

SEQ ID NO: 1145649 - protein, 5 aa, Mycobacterium
GVNPR

SEQ ID NO: 1145650 - protein, 4 aa, Mycobacterium
HAPE

SEQ ID NO: 1145651 - protein, 4 aa, Mycobacterium
HDGG

SEQ ID NO: 1145652 - protein, 10 aa, Mycobacterium
HGTGTALGDP

SEQ ID NO: 1145653 - protein, 15 aa, Mycobacterium
HRPAPTPADLPHGTS

SEQ ID NO: 1145654 - protein, 4 aa, Mycobacterium
IAGR

SEQ ID NO: 1145655 - protein, 4 aa, Mycobacterium
IDGA

SEQ ID NO: 1145656 - protein, 4 aa, Mycobacterium
IPAT

SEQ ID NO: 1145657 - protein, 8 aa, Mycobacterium
IPKPGDFR

SEQ ID NO: 1145658 - protein, 9 aa, Mycobacterium
IRKTSDEQY

SEQ ID NO: 1145659 - protein, 9 aa, Mycobacterium
KDAPTETDS

SEQ ID NO: 1145660 - protein, 4 aa, Mycobacterium
KEGL

SEQ ID NO: 1145661 - protein, 4 aa, Mycobacterium
KESR

SEQ ID NO: 1145662 - protein, 5 aa, Mycobacterium
KGGLE

SEQ ID NO: 1145663 - protein, 9 aa, Mycobacterium
KGTRGELAG

SEQ ID NO: 1145664 - protein, 5 aa, Mycobacterium
KIQGI

SEQ ID NO: 1145665 - protein, 7 aa, Mycobacterium
KITAADL

SEQ ID NO: 1145666 - protein, 6 aa, Mycobacterium
KTAGGL

SEQ ID NO: 1145667 - protein, 14 aa, Mycobacterium
KTFDAGADGYVRSE

SEQ ID NO: 1145668 - protein, 6 aa, Mycobacterium
LAAGDA

SEQ ID NO: 1145669 - protein, 7 aa, Mycobacterium
LATSPVQ

SEQ ID NO: 1145670 - protein, 4 aa, Mycobacterium
LDPD

SEQ ID NO: 1145671 - protein, 4 aa, Mycobacterium
LESN

SEQ ID NO: 1145672 - protein, 4 aa, Mycobacterium
LGAG

SEQ ID NO: 1145673 - protein, 4 aa, Mycobacterium
LGEG

SEQ ID NO: 1145674 - protein, 4 aa, Mycobacterium
LGGT

SEQ ID NO: 1145675 - protein, 4 aa, Mycobacterium
LGSP

SEQ ID NO: 1145676 - protein, 8 aa, Mycobacterium
LNNAQQKN

SEQ ID NO: 1145677 - protein, 4 aa, Mycobacterium
LRPG

SEQ ID NO: 1145678 - protein, 7 aa, Mycobacterium
LRRRRGA

SEQ ID NO: 1145679 - protein, 4 aa, Mycobacterium
LRSR

SEQ ID NO: 1145680 - protein, 4 aa, Mycobacterium
LSAE

SEQ ID NO: 1145681 - protein, 5 aa, Mycobacterium
LSAGE

SEQ ID NO: 1145682 - protein, 8 aa, Mycobacterium
LSGGQRRR

SEQ ID NO: 1145683 - protein, 5 aa, Mycobacterium
LSPET

SEQ ID NO: 1145684 - protein, 4 aa, Mycobacterium
LTNK

SEQ ID NO: 1145685 - protein, 7 aa, Mycobacterium
MGDDSRA

SEQ ID NO: 1145686 - protein, 5 aa, Mycobacterium
NATEA

SEQ ID NO: 1145687 - protein, 10 aa, Mycobacterium
NESTGGAGRS

SEQ ID NO: 1145688 - protein, 7 aa, Mycobacterium
NGGGLGQ

SEQ ID NO: 1145689 - protein, 17 aa, Mycobacterium
NGRPRGPHPKTTQTSPK

SEQ ID NO: 1145690 - protein, 4 aa, Mycobacterium
NPVD

SEQ ID NO: 1145691 - protein, 6 aa, Mycobacterium
NQAQES

SEQ ID NO: 1145692 - protein, 9 aa, Mycobacterium
NRTPPKTQA

SEQ ID NO: 1145693 - protein, 4 aa, Mycobacterium
NSGR

SEQ ID NO: 1145694 - protein, 6 aa, Mycobacterium
NSGRIQ

SEQ ID NO: 1145695 - protein, 8 aa, Mycobacterium
NSGSSSAR

SEQ ID NO: 1145696 - protein, 8 aa, Mycobacterium
PAAGQSAE

SEQ ID NO: 1145697 - protein, 6 aa, Mycobacterium
PAANSP

SEQ ID NO: 1145698 - protein, 4 aa, Mycobacterium
PAGG

SEQ ID NO: 1145699 - protein, 4 aa, Mycobacterium
PALT

SEQ ID NO: 1145700 - protein, 4 aa, Mycobacterium
PEPV

SEQ ID NO: 1145701 - protein, 9 aa, Mycobacterium
PGGVSDPDG

SEQ ID NO: 1145702 - protein, 27 aa, Mycobacterium
PGMCNPDDPEPCTSGTPSQEQIDNDHR

SEQ ID NO: 1145703 - protein, 7 aa, Mycobacterium
PHDPGTT

SEQ ID NO: 1145704 - protein, 4 aa, Mycobacterium
PIAE

SEQ ID NO: 1145705 - protein, 4 aa, Mycobacterium
PITT

SEQ ID NO: 1145706 - protein, 4 aa, Mycobacterium
PKPE

SEQ ID NO: 1145707 - protein, 20 aa, Mycobacterium
PKRRRTRAQNRARRIQEERR

SEQ ID NO: 1145708 - protein, 14 aa, Mycobacterium
PLDGSRDAPPDEKK

SEQ ID NO: 1145709 - protein, 5 aa, Mycobacterium
PLPDD

SEQ ID NO: 1145710 - protein, 14 aa, Mycobacterium
PPAGGITDPTEEEQ

SEQ ID NO: 1145711 - protein, 4 aa, Mycobacterium
PPEL

SEQ ID NO: 1145712 - protein, 13 aa, Mycobacterium
PPLGESPEGRLQA

SEQ ID NO: 1145713 - protein, 25 aa, Mycobacterium
PRAPFGGAKASGLGREFSPASLDSY

SEQ ID NO: 1145714 - protein, 10 aa, Mycobacterium
PREAAAMDPQ

SEQ ID NO: 1145715 - protein, 7 aa, Mycobacterium
PRRRTDR

SEQ ID NO: 1145716 - protein, 4 aa, Mycobacterium
PSIT

SEQ ID NO: 1145717 - protein, 5 aa, Mycobacterium
PTAEQ

SEQ ID NO: 1145718 - protein, 5 aa, Mycobacterium
PTNDL

SEQ ID NO: 1145719 - protein, 4 aa, Mycobacterium
PVTT

SEQ ID NO: 1145720 - protein, 7 aa, Mycobacterium
QAETLGT

SEQ ID NO: 1145721 - protein, 5 aa, Mycobacterium
QAGAD

SEQ ID NO: 1145722 - protein, 23 aa, Mycobacterium
QAPPGRHPSPYTVPQGYREEAAV

SEQ ID NO: 1145723 - protein, 7 aa, Mycobacterium
QGGGGSI

SEQ ID NO: 1145724 - protein, 8 aa, Mycobacterium
QGSQYPGM

SEQ ID NO: 1145725 - protein, 9 aa, Mycobacterium
QIRDTGGTT

SEQ ID NO: 1145726 - protein, 4 aa, Mycobacterium
QRDG

SEQ ID NO: 1145727 - protein, 4 aa, Mycobacterium
QRGG

SEQ ID NO: 1145728 - protein, 13 aa, Mycobacterium
QSAREEAQAGARK

SEQ ID NO: 1145729 - protein, 4 aa, Mycobacterium
RAAG

SEQ ID NO: 1145730 - protein, 4 aa, Mycobacterium
RAEA

SEQ ID NO: 1145731 - protein, 6 aa, Mycobacterium
RARDAG

SEQ ID NO: 1145732 - protein, 5 aa, Mycobacterium
RATAE

SEQ ID NO: 1145733 - protein, 4 aa, Mycobacterium
RDGN

SEQ ID NO: 1145734 - protein, 4 aa, Mycobacterium
RDGQ

SEQ ID NO: 1145735 - protein, 5 aa, Mycobacterium
RERHP

SEQ ID NO: 1145736 - protein, 6 aa, Mycobacterium
RFAGAP

SEQ ID NO: 1145737 - protein, 5 aa, Mycobacterium
RGAGG

SEQ ID NO: 1145738 - protein, 5 aa, Mycobacterium
RGARE

SEQ ID NO: 1145739 - protein, 4 aa, Mycobacterium
RGAT

SEQ ID NO: 1145740 - protein, 4 aa, Mycobacterium
RGGP

SEQ ID NO: 1145741 - protein, 4 aa, Mycobacterium
RGLG

SEQ ID NO: 1145742 - protein, 4 aa, Mycobacterium
RGTT

SEQ ID NO: 1145743 - protein, 5 aa, Mycobacterium
RGYSQ

SEQ ID NO: 1145744 - protein, 11 aa, Mycobacterium
RLEPKKKPRSA

SEQ ID NO: 1145745 - protein, 5 aa, Mycobacterium
RLGGG

SEQ ID NO: 1145746 - protein, 4 aa, Mycobacterium
RLPG

SEQ ID NO: 1145747 - protein, 6 aa, Mycobacterium
RLQDER

SEQ ID NO: 1145748 - protein, 5 aa, Mycobacterium
RNPEA

SEQ ID NO: 1145749 - protein, 4 aa, Mycobacterium
RPDD

SEQ ID NO: 1145750 - protein, 4 aa, Mycobacterium
RPDG

SEQ ID NO: 1145751 - protein, 4 aa, Mycobacterium
RPDQ

SEQ ID NO: 1145752 - protein, 8 aa, Mycobacterium
RPEARNAL

SEQ ID NO: 1145753 - protein, 4 aa, Mycobacterium
RPLP

SEQ ID NO: 1145754 - protein, 14 aa, Mycobacterium
RPLSESSQNDEVAN

SEQ ID NO: 1145755 - protein, 7 aa, Mycobacterium
RPSRLKG

SEQ ID NO: 1145756 - protein, 4 aa, Mycobacterium
RPTL

SEQ ID NO: 1145757 - protein, 21 aa, Mycobacterium
RPWPTSELRSTSGPVLNQGPH

SEQ ID NO: 1145758 - protein, 16 aa, Mycobacterium
RQSAAGLVTPDDHENF

SEQ ID NO: 1145759 - protein, 9 aa, Mycobacterium
RRSGPRKDG

SEQ ID NO: 1145760 - protein, 7 aa, Mycobacterium
RRTESRG

SEQ ID NO: 1145761 - protein, 8 aa, Mycobacterium
RSGQPKCR

SEQ ID NO: 1145762 - protein, 4 aa, Mycobacterium
RTPV

SEQ ID NO: 1145763 - protein, 5 aa, Mycobacterium
SAADI

SEQ ID NO: 1145764 - protein, 8 aa, Mycobacterium
SAGGGGRG

SEQ ID NO: 1145765 - protein, 7 aa, Mycobacterium
SAPPLEE

SEQ ID NO: 1145766 - protein, 6 aa, Mycobacterium
SAPRAV

SEQ ID NO: 1145767 - protein, 9 aa, Mycobacterium
SAYSASKGG

SEQ ID NO: 1145768 - protein, 6 aa, Mycobacterium
SDSEDF

SEQ ID NO: 1145769 - protein, 9 aa, Mycobacterium
SEATPQQMG

SEQ ID NO: 1145770 - protein, 6 aa, Mycobacterium
SEDDRG

SEQ ID NO: 1145771 - protein, 10 aa, Mycobacterium
SEPEAGSDLA

SEQ ID NO: 1145772 - protein, 6 aa, Mycobacterium
SETAKE

SEQ ID NO: 1145773 - protein, 5 aa, Mycobacterium
SGAGI

SEQ ID NO: 1145774 - protein, 4 aa, Mycobacterium
SGEG

SEQ ID NO: 1145775 - protein, 6 aa, Mycobacterium
SGGGPY

SEQ ID NO: 1145776 - protein, 4 aa, Mycobacterium
SGLP

SEQ ID NO: 1145777 - protein, 6 aa, Mycobacterium
SGREPE

SEQ ID NO: 1145778 - protein, 7 aa, Mycobacterium
SGSGISS

SEQ ID NO: 1145779 - protein, 7 aa, Mycobacterium
SNDGGAS

SEQ ID NO: 1145780 - protein, 12 aa, Mycobacterium
SNNGLGERNYTE

SEQ ID NO: 1145781 - protein, 4 aa, Mycobacterium
SPAC

SEQ ID NO: 1145782 - protein, 4 aa, Mycobacterium
SPYD

SEQ ID NO: 1145783 - protein, 5 aa, Mycobacterium
SQASY

SEQ ID NO: 1145784 - protein, 4 aa, Mycobacterium
SQYG

SEQ ID NO: 1145785 - protein, 4 aa, Mycobacterium
SRAG

SEQ ID NO: 1145786 - protein, 4 aa, Mycobacterium
SRED

SEQ ID NO: 1145787 - protein, 7 aa, Mycobacterium
SRGHPRA

SEQ ID NO: 1145788 - protein, 7 aa, Mycobacterium
SSNLLGP

SEQ ID NO: 1145789 - protein, 7 aa, Mycobacterium
STHEDGS

SEQ ID NO: 1145790 - protein, 8 aa, Mycobacterium
SVQGPFAG

SEQ ID NO: 1145791 - protein, 6 aa, Mycobacterium
SYGAGN

SEQ ID NO: 1145792 - protein, 4 aa, Mycobacterium
TAAA

SEQ ID NO: 1145793 - protein, 4 aa, Mycobacterium
TAAD

SEQ ID NO: 1145794 - protein, 5 aa, Mycobacterium
TALDP

SEQ ID NO: 1145795 - protein, 6 aa, Mycobacterium
TDAEAA

SEQ ID NO: 1145796 - protein, 5 aa, Mycobacterium
TDDAQ

SEQ ID NO: 1145797 - protein, 4 aa, Mycobacterium
TGAI

SEQ ID NO: 1145798 - protein, 5 aa, Mycobacterium
TGDGY

SEQ ID NO: 1145799 - protein, 4 aa, Mycobacterium
TGGS

SEQ ID NO: 1145800 - protein, 16 aa, Mycobacterium
TGKPYKPTTQGKNERF

SEQ ID NO: 1145801 - protein, 25 aa, Mycobacterium
TGQDTKPYRGGKGIYRSTDRGSSWV

SEQ ID NO: 1145802 - protein, 4 aa, Mycobacterium
TGRT

SEQ ID NO: 1145803 - protein, 4 aa, Mycobacterium
TGVP

SEQ ID NO: 1145804 - protein, 4 aa, Mycobacterium
TGWG

SEQ ID NO: 1145805 - protein, 15 aa, Mycobacterium
TGYSEQQSTRPQTVG

SEQ ID NO: 1145806 - protein, 4 aa, Mycobacterium
TKMG

SEQ ID NO: 1145807 - protein, 7 aa, Mycobacterium
TQMGRNR

SEQ ID NO: 1145808 - protein, 6 aa, Mycobacterium
TQRRHS

SEQ ID NO: 1145809 - protein, 7 aa, Mycobacterium
TRPAPGI

SEQ ID NO: 1145810 - protein, 10 aa, Mycobacterium
TRSRNSSAAA

SEQ ID NO: 1145811 - protein, 4 aa, Mycobacterium
TSDE

SEQ ID NO: 1145812 - protein, 10 aa, Mycobacterium
TSSTSGPTID

SEQ ID NO: 1145813 - protein, 7 aa, Mycobacterium
TSYPSPV

SEQ ID NO: 1145814 - protein, 6 aa, Mycobacterium
TTIPAG

SEQ ID NO: 1145815 - protein, 6 aa, Mycobacterium
TYGTPV

SEQ ID NO: 1145816 - protein, 5 aa, Mycobacterium
VAAGR

SEQ ID NO: 1145817 - protein, 4 aa, Mycobacterium
VDAA

SEQ ID NO: 1145818 - protein, 7 aa, Mycobacterium
VDGRRSL

SEQ ID NO: 1145819 - protein, 5 aa, Mycobacterium
VESAG

SEQ ID NO: 1145820 - protein, 7 aa, Mycobacterium
VGDGAND

SEQ ID NO: 1145821 - protein, 10 aa, Mycobacterium
VGGDSAGGNL

SEQ ID NO: 1145822 - protein, 4 aa, Mycobacterium
VGRS

SEQ ID NO: 1145823 - protein, 8 aa, Mycobacterium
VKTEGPAA

SEQ ID NO: 1145824 - protein, 7 aa, Mycobacterium
VNPRDRR

SEQ ID NO: 1145825 - protein, 4 aa, Mycobacterium
VPGP

SEQ ID NO: 1145826 - protein, 5 aa, Mycobacterium
VQPGD

SEQ ID NO: 1145827 - protein, 4 aa, Mycobacterium
VSKA

SEQ ID NO: 1145828 - protein, 12 aa, Mycobacterium
VSPSPVSDTYLS

SEQ ID NO: 1145829 - protein, 4 aa, Mycobacterium
VTDG

SEQ ID NO: 1145830 - protein, 5 aa, Mycobacterium
VTGTD

SEQ ID NO: 1145831 - protein, 26 aa, Mycobacterium
YAAPGTNLPHDDAHTGRDDRTTGQRH

SEQ ID NO: 1145832 - protein, 9 aa, Mycobacterium
YGAQGGDWG

SEQ ID NO: 1145833 - protein, 5 aa, Mycobacterium
YPGAR

SEQ ID NO: 1145834 - protein, 14 aa, Mycobacterium
YRAGTAAAARGGHA

SEQ ID NO: 1145835 - protein, 11 aa, Mycobacterium
YTAPSGNPITA

SEQ ID NO: 1145836 - protein, 4 aa, Mycobacterium
AADA

SEQ ID NO: 1145837 - protein, 4 aa, Mycobacterium
AADG

SEQ ID NO: 1145838 - protein, 6 aa, Mycobacterium
AADPNE

SEQ ID NO: 1145839 - protein, 5 aa, Mycobacterium
AADTG

SEQ ID NO: 1145840 - protein, 4 aa, Mycobacterium
AAED

SEQ ID NO: 1145841 - protein, 5 aa, Mycobacterium
AAGTD

SEQ ID NO: 1145842 - protein, 10 aa, Mycobacterium
AALPGYTGAA

SEQ ID NO: 1145843 - protein, 5 aa, Mycobacterium
AAPAA

SEQ ID NO: 1145844 - protein, 5 aa, Mycobacterium
AAPGP

SEQ ID NO: 1145845 - protein, 4 aa, Mycobacterium
AAQE

SEQ ID NO: 1145846 - protein, 5 aa, Mycobacterium
AASEV

SEQ ID NO: 1145847 - protein, 4 aa, Mycobacterium
AATA

SEQ ID NO: 1145848 - protein, 4 aa, Mycobacterium
AATS

SEQ ID NO: 1145849 - protein, 4 aa, Mycobacterium
ADDS

SEQ ID NO: 1145850 - protein, 4 aa, Mycobacterium
ADGA

SEQ ID NO: 1145851 - protein, 13 aa, Mycobacterium
ADGSIPNASGSLH

SEQ ID NO: 1145852 - protein, 5 aa, Mycobacterium
ADPAG

SEQ ID NO: 1145853 - protein, 4 aa, Mycobacterium
ADPS

SEQ ID NO: 1145854 - protein, 5 aa, Mycobacterium
ADRGG

SEQ ID NO: 1145855 - protein, 4 aa, Mycobacterium
ADRT

SEQ ID NO: 1145856 - protein, 7 aa, Mycobacterium
ADTTPKG

SEQ ID NO: 1145857 - protein, 5 aa, Mycobacterium
AEAAA

SEQ ID NO: 1145858 - protein, 4 aa, Mycobacterium
AEEA

SEQ ID NO: 1145859 - protein, 8 aa, Mycobacterium
AEIRQGAK

SEQ ID NO: 1145860 - protein, 4 aa, Mycobacterium
AESG

SEQ ID NO: 1145861 - protein, 4 aa, Mycobacterium
AETN

SEQ ID NO: 1145862 - protein, 6 aa, Mycobacterium
AGAPQK

SEQ ID NO: 1145863 - protein, 6 aa, Mycobacterium
AGDKSF

SEQ ID NO: 1145864 - protein, 5 aa, Mycobacterium
AGDRI

SEQ ID NO: 1145865 - protein, 5 aa, Mycobacterium
AGGRY

SEQ ID NO: 1145866 - protein, 5 aa, Mycobacterium
AGGYG

SEQ ID NO: 1145867 - protein, 6 aa, Mycobacterium
AGLPPG

SEQ ID NO: 1145868 - protein, 4 aa, Mycobacterium
AGPD

SEQ ID NO: 1145869 - protein, 4 aa, Mycobacterium
AGSL

SEQ ID NO: 1145870 - protein, 4 aa, Mycobacterium
AGSV

SEQ ID NO: 1145871 - protein, 5 aa, Mycobacterium
AGTEP

SEQ ID NO: 1145872 - protein, 12 aa, Mycobacterium
AGYGRAGAARPP

SEQ ID NO: 1145873 - protein, 9 aa, Mycobacterium
AHTGGGNRL

SEQ ID NO: 1145874 - protein, 18 aa, Mycobacterium
AIGGQPPVTRLTNLPGHH

SEQ ID NO: 1145875 - protein, 7 aa, Mycobacterium
AIGTPDG

SEQ ID NO: 1145876 - protein, 7 aa, Mycobacterium
AKEAPGW

SEQ ID NO: 1145877 - protein, 7 aa, Mycobacterium
ALAARGV

SEQ ID NO: 1145878 - protein, 7 aa, Mycobacterium
ALPSTLG

SEQ ID NO: 1145879 - protein, 6 aa, Mycobacterium
ALPTAA

SEQ ID NO: 1145880 - protein, 6 aa, Mycobacterium
ALTEPT

SEQ ID NO: 1145881 - protein, 12 aa, Mycobacterium
ANDYVGKGLSGG

SEQ ID NO: 1145882 - protein, 8 aa, Mycobacterium
ANGAGKST

SEQ ID NO: 1145883 - protein, 4 aa, Mycobacterium
APAG

SEQ ID NO: 1145884 - protein, 4 aa, Mycobacterium
APAP

SEQ ID NO: 1145885 - protein, 6 aa, Mycobacterium
APEAAS

SEQ ID NO: 1145886 - protein, 15 aa, Mycobacterium
AQDRLAELESGLDID

SEQ ID NO: 1145887 - protein, 4 aa, Mycobacterium
AQPL

SEQ ID NO: 1145888 - protein, 4 aa, Mycobacterium
ARAA

SEQ ID NO: 1145889 - protein, 4 aa, Mycobacterium
ARAD

SEQ ID NO: 1145890 - protein, 4 aa, Mycobacterium
ARAE

SEQ ID NO: 1145891 - protein, 10 aa, Mycobacterium
AREAGEPMAE

SEQ ID NO: 1145892 - protein, 4 aa, Mycobacterium
ARGP

SEQ ID NO: 1145893 - protein, 4 aa, Mycobacterium
ARIS

SEQ ID NO: 1145894 - protein, 4 aa, Mycobacterium
ARRQ

SEQ ID NO: 1145895 - protein, 4 aa, Mycobacterium
ARRS

SEQ ID NO: 1145896 - protein, 6 aa, Mycobacterium
ARTQSI

SEQ ID NO: 1145897 - protein, 6 aa, Mycobacterium
ASDEEA

SEQ ID NO: 1145898 - protein, 4 aa, Mycobacterium
ASSG

SEQ ID NO: 1145899 - protein, 8 aa, Mycobacterium
ASTPLDRS

SEQ ID NO: 1145900 - protein, 4 aa, Mycobacterium
ATDA

SEQ ID NO: 1145901 - protein, 4 aa, Mycobacterium
ATEA

SEQ ID NO: 1145902 - protein, 7 aa, Mycobacterium
ATGARSI

SEQ ID NO: 1145903 - protein, 4 aa, Mycobacterium
ATGD

SEQ ID NO: 1145904 - protein, 5 aa, Mycobacterium
ATGRR

SEQ ID NO: 1145905 - protein, 8 aa, Mycobacterium
CRPAPDTM

SEQ ID NO: 1145906 - protein, 16 aa, Mycobacterium
DAATIARRAGADGNPV

SEQ ID NO: 1145907 - protein, 4 aa, Mycobacterium
DAGR

SEQ ID NO: 1145908 - protein, 15 aa, Mycobacterium
DAGSSPNSKTGAAIR

SEQ ID NO: 1145909 - protein, 7 aa, Mycobacterium
DANDQVS

SEQ ID NO: 1145910 - protein, 5 aa, Mycobacterium
DANSA

SEQ ID NO: 1145911 - protein, 6 aa, Mycobacterium
DAPGVT

SEQ ID NO: 1145912 - protein, 12 aa, Mycobacterium
DASRSGQPLVEI

SEQ ID NO: 1145913 - protein, 7 aa, Mycobacterium
DAVRDGD

SEQ ID NO: 1145914 - protein, 9 aa, Mycobacterium
DCPNKGGRH

SEQ ID NO: 1145915 - protein, 4 aa, Mycobacterium
DDAR

SEQ ID NO: 1145916 - protein, 4 aa, Mycobacterium
DDER

SEQ ID NO: 1145917 - protein, 4 aa, Mycobacterium
DDGE

SEQ ID NO: 1145918 - protein, 5 aa, Mycobacterium
DDPAL

SEQ ID NO: 1145919 - protein, 5 aa, Mycobacterium
DEGIE

SEQ ID NO: 1145920 - protein, 5 aa, Mycobacterium
DEHTN

SEQ ID NO: 1145921 - protein, 7 aa, Mycobacterium
DEKAATA

SEQ ID NO: 1145922 - protein, 6 aa, Mycobacterium
DETTGR

SEQ ID NO: 1145923 - protein, 4 aa, Mycobacterium
DGEV

SEQ ID NO: 1145924 - protein, 4 aa, Mycobacterium
DGLD

SEQ ID NO: 1145925 - protein, 4 aa, Mycobacterium
DGNE

SEQ ID NO: 1145926 - protein, 4 aa, Mycobacterium
DGRL

SEQ ID NO: 1145927 - protein, 4 aa, Mycobacterium
DGRP

SEQ ID NO: 1145928 - protein, 5 aa, Mycobacterium
DGSAA

SEQ ID NO: 1145929 - protein, 6 aa, Mycobacterium
DGTAKL

SEQ ID NO: 1145930 - protein, 6 aa, Mycobacterium
DGYVRG

SEQ ID NO: 1145931 - protein, 7 aa, Mycobacterium
DNRDSWR

SEQ ID NO: 1145932 - protein, 5 aa, Mycobacterium
DPAQL

SEQ ID NO: 1145933 - protein, 7 aa, Mycobacterium
DPDTATT

SEQ ID NO: 1145934 - protein, 4 aa, Mycobacterium
DPEV

SEQ ID NO: 1145935 - protein, 5 aa, Mycobacterium
DPGPG

SEQ ID NO: 1145936 - protein, 6 aa, Mycobacterium
DPPAAT

SEQ ID NO: 1145937 - protein, 5 aa, Mycobacterium
DPSLP

SEQ ID NO: 1145938 - protein, 5 aa, Mycobacterium
DRAEE

SEQ ID NO: 1145939 - protein, 4 aa, Mycobacterium
DRDS

SEQ ID NO: 1145940 - protein, 7 aa, Mycobacterium
DRDTREA

SEQ ID NO: 1145941 - protein, 5 aa, Mycobacterium
DREPV

SEQ ID NO: 1145942 - protein, 7 aa, Mycobacterium
DRGQTWE

SEQ ID NO: 1145943 - protein, 5 aa, Mycobacterium
DRPGV

SEQ ID NO: 1145944 - protein, 5 aa, Mycobacterium
DRTGR

SEQ ID NO: 1145945 - protein, 5 aa, Mycobacterium
DSGFG

SEQ ID NO: 1145946 - protein, 4 aa, Mycobacterium
DTEM

SEQ ID NO: 1145947 - protein, 7 aa, Mycobacterium
DTIRNGY

SEQ ID NO: 1145948 - protein, 9 aa, Mycobacterium
DTTAEDLTA

SEQ ID NO: 1145949 - protein, 4 aa, Mycobacterium
DVAG

SEQ ID NO: 1145950 - protein, 4 aa, Mycobacterium
EAAG

SEQ ID NO: 1145951 - protein, 7 aa, Mycobacterium
EDAGDDL

SEQ ID NO: 1145952 - protein, 4 aa, Mycobacterium
EEGA

SEQ ID NO: 1145953 - protein, 4 aa, Mycobacterium
EETS

SEQ ID NO: 1145954 - protein, 7 aa, Mycobacterium
EETSDRT

SEQ ID NO: 1145955 - protein, 17 aa, Mycobacterium
EGHGGGSSTLPHKNNPV

SEQ ID NO: 1145956 - protein, 4 aa, Mycobacterium
EGLR

SEQ ID NO: 1145957 - protein, 4 aa, Mycobacterium
EGLS

SEQ ID NO: 1145958 - protein, 8 aa, Mycobacterium
EGQPPAPS

SEQ ID NO: 1145959 - protein, 4 aa, Mycobacterium
EGTK

SEQ ID NO: 1145960 - protein, 8 aa, Mycobacterium
EHAERGRN

SEQ ID NO: 1145961 - protein, 23 aa, Mycobacterium
EHGGRNRRRTAHRTGDRGDRTKN

SEQ ID NO: 1145962 - protein, 4 aa, Mycobacterium
EHGP

SEQ ID NO: 1145963 - protein, 7 aa, Mycobacterium
ELDPAKP

SEQ ID NO: 1145964 - protein, 4 aa, Mycobacterium
ELGT

SEQ ID NO: 1145965 - protein, 9 aa, Mycobacterium
ELGTEQGTV

SEQ ID NO: 1145966 - protein, 7 aa, Mycobacterium
ENEDDLR

SEQ ID NO: 1145967 - protein, 4 aa, Mycobacterium
EPGR

SEQ ID NO: 1145968 - protein, 4 aa, Mycobacterium
EPGT

SEQ ID NO: 1145969 - protein, 4 aa, Mycobacterium
EPHP

SEQ ID NO: 1145970 - protein, 9 aa, Mycobacterium
EPTSKADAA

SEQ ID NO: 1145971 - protein, 4 aa, Mycobacterium
EQRG

SEQ ID NO: 1145972 - protein, 8 aa, Mycobacterium
EQRSMTEL

SEQ ID NO: 1145973 - protein, 6 aa, Mycobacterium
ERENRE

SEQ ID NO: 1145974 - protein, 8 aa, Mycobacterium
ERHESRRI

SEQ ID NO: 1145975 - protein, 4 aa, Mycobacterium
ESGE

SEQ ID NO: 1145976 - protein, 4 aa, Mycobacterium
ESGQ

SEQ ID NO: 1145977 - protein, 7 aa, Mycobacterium
ESTSGTL

SEQ ID NO: 1145978 - protein, 4 aa, Mycobacterium
ETAA

SEQ ID NO: 1145979 - protein, 6 aa, Mycobacterium
ETADRA

SEQ ID NO: 1145980 - protein, 12 aa, Mycobacterium
ETHATDEPPLEL

SEQ ID NO: 1145981 - protein, 8 aa, Mycobacterium
ETHRDTSA

SEQ ID NO: 1145982 - protein, 4 aa, Mycobacterium
FGDP

SEQ ID NO: 1145983 - protein, 9 aa, Mycobacterium
FNPGGMKDR

SEQ ID NO: 1145984 - protein, 4 aa, Mycobacterium
FTPR

SEQ ID NO: 1145985 - protein, 4 aa, Mycobacterium
GAAA

SEQ ID NO: 1145986 - protein, 4 aa, Mycobacterium
GAAD

SEQ ID NO: 1145987 - protein, 9 aa, Mycobacterium
GAGAGNAPV

SEQ ID NO: 1145988 - protein, 5 aa, Mycobacterium
GAGKT

SEQ ID NO: 1145989 - protein, 7 aa, Mycobacterium
GAGRPVR

SEQ ID NO: 1145990 - protein, 5 aa, Mycobacterium
GAPRE

SEQ ID NO: 1145991 - protein, 4 aa, Mycobacterium
GARE

SEQ ID NO: 1145992 - protein, 4 aa, Mycobacterium
GASE

SEQ ID NO: 1145993 - protein, 4 aa, Mycobacterium
GATP

SEQ ID NO: 1145994 - protein, 11 aa, Mycobacterium
GATVDERSDGA

SEQ ID NO: 1145995 - protein, 9 aa, Mycobacterium
GDGLGGSSF

SEQ ID NO: 1145996 - protein, 4 aa, Mycobacterium
GDRV

SEQ ID NO: 1145997 - protein, 7 aa, Mycobacterium
GEEEGIG

SEQ ID NO: 1145998 - protein, 5 aa, Mycobacterium
GEEGE

SEQ ID NO: 1145999 - protein, 6 aa, Mycobacterium
GERVGP

SEQ ID NO: 1146000 - protein, 4 aa, Mycobacterium
GESV

SEQ ID NO: 1146001 - protein, 5 aa, Mycobacterium
GFGGT

SEQ ID NO: 1146002 - protein, 4 aa, Mycobacterium
GGAR

SEQ ID NO: 1146003 - protein, 8 aa, Mycobacterium
GGDPEPAV

SEQ ID NO: 1146004 - protein, 5 aa, Mycobacterium
GGGGV

SEQ ID NO: 1146005 - protein, 9 aa, Mycobacterium
GGGHDIGET

SEQ ID NO: 1146006 - protein, 4 aa, Mycobacterium
GGHT

SEQ ID NO: 1146007 - protein, 5 aa, Mycobacterium
GGKSA

SEQ ID NO: 1146008 - protein, 4 aa, Mycobacterium
GGPI

SEQ ID NO: 1146009 - protein, 5 aa, Mycobacterium
GGPTL

SEQ ID NO: 1146010 - protein, 4 aa, Mycobacterium
GGRK

SEQ ID NO: 1146011 - protein, 4 aa, Mycobacterium
GGSD

SEQ ID NO: 1146012 - protein, 4 aa, Mycobacterium
GGTV

SEQ ID NO: 1146013 - protein, 4 aa, Mycobacterium
GIDP

SEQ ID NO: 1146014 - protein, 5 aa, Mycobacterium
GKEGR

SEQ ID NO: 1146015 - protein, 8 aa, Mycobacterium
GKLGDTAT

SEQ ID NO: 1146016 - protein, 7 aa, Mycobacterium
GKQLEND

SEQ ID NO: 1146017 - protein, 4 aa, Mycobacterium
GLAG

SEQ ID NO: 1146018 - protein, 4 aa, Mycobacterium
GLPA

SEQ ID NO: 1146019 - protein, 4 aa, Mycobacterium
GLPD

SEQ ID NO: 1146020 - protein, 5 aa, Mycobacterium
GLPPG

SEQ ID NO: 1146021 - protein, 7 aa, Mycobacterium
GLSDTTV

SEQ ID NO: 1146022 - protein, 8 aa, Mycobacterium
GNETTRNA

SEQ ID NO: 1146023 - protein, 9 aa, Mycobacterium
GNETTRNSI

SEQ ID NO: 1146024 - protein, 8 aa, Mycobacterium
GNTAETTT

SEQ ID NO: 1146025 - protein, 4 aa, Mycobacterium
GPAA

SEQ ID NO: 1146026 - protein, 4 aa, Mycobacterium
GPAG

SEQ ID NO: 1146027 - protein, 9 aa, Mycobacterium
GPAGVGKTE

SEQ ID NO: 1146028 - protein, 4 aa, Mycobacterium
GPDL

SEQ ID NO: 1146029 - protein, 4 aa, Mycobacterium
GPGD

SEQ ID NO: 1146030 - protein, 4 aa, Mycobacterium
GPRG

SEQ ID NO: 1146031 - protein, 8 aa, Mycobacterium
GPSGCGKT

SEQ ID NO: 1146032 - protein, 4 aa, Mycobacterium
GPVP

SEQ ID NO: 1146033 - protein, 7 aa, Mycobacterium
GPVRPPV

SEQ ID NO: 1146034 - protein, 6 aa, Mycobacterium
GQPAST

SEQ ID NO: 1146035 - protein, 4 aa, Mycobacterium
GRDD

SEQ ID NO: 1146036 - protein, 8 aa, Mycobacterium
GRRGTTTD

SEQ ID NO: 1146037 - protein, 8 aa, Mycobacterium
GSEEALEA

SEQ ID NO: 1146038 - protein, 4 aa, Mycobacterium
GSLR

SEQ ID NO: 1146039 - protein, 8 aa, Mycobacterium
GSPGRNNP

SEQ ID NO: 1146040 - protein, 10 aa, Mycobacterium
GSPPRTPDVE

SEQ ID NO: 1146041 - protein, 5 aa, Mycobacterium
GTAGI

SEQ ID NO: 1146042 - protein, 4 aa, Mycobacterium
GTGV

SEQ ID NO: 1146043 - protein, 4 aa, Mycobacterium
GTGY

SEQ ID NO: 1146044 - protein, 6 aa, Mycobacterium
GTNEIQ

SEQ ID NO: 1146045 - protein, 9 aa, Mycobacterium
GTSGEPKAV

SEQ ID NO: 1146046 - protein, 9 aa, Mycobacterium
GVATTSEEM

SEQ ID NO: 1146047 - protein, 4 aa, Mycobacterium
GVDH

SEQ ID NO: 1146048 - protein, 4 aa, Mycobacterium
GVDP

SEQ ID NO: 1146049 - protein, 6 aa, Mycobacterium
GVGKST

SEQ ID NO: 1146050 - protein, 6 aa, Mycobacterium
GVQPAL

SEQ ID NO: 1146051 - protein, 7 aa, Mycobacterium
GWAPSES

SEQ ID NO: 1146052 - protein, 9 aa, Mycobacterium
GYSKERRVD

SEQ ID NO: 1146053 - protein, 4 aa, Mycobacterium
HAAG

SEQ ID NO: 1146054 - protein, 6 aa, Mycobacterium
HADPEG

SEQ ID NO: 1146055 - protein, 4 aa, Mycobacterium
HAEG

SEQ ID NO: 1146056 - protein, 4 aa, Mycobacterium
HAVT

SEQ ID NO: 1146057 - protein, 5 aa, Mycobacterium
HDEPG

SEQ ID NO: 1146058 - protein, 4 aa, Mycobacterium
HDPE

SEQ ID NO: 1146059 - protein, 5 aa, Mycobacterium
HEGAG

SEQ ID NO: 1146060 - protein, 5 aa, Mycobacterium
HGTGT

SEQ ID NO: 1146061 - protein, 4 aa, Mycobacterium
HPEL

SEQ ID NO: 1146062 - protein, 18 aa, Mycobacterium
HPKARPETRGEAPPAATG

SEQ ID NO: 1146063 - protein, 4 aa, Mycobacterium
HPTL

SEQ ID NO: 1146064 - protein, 5 aa, Mycobacterium
HPTNV

SEQ ID NO: 1146065 - protein, 5 aa, Mycobacterium
HRGQR

SEQ ID NO: 1146066 - protein, 7 aa, Mycobacterium
HSGEPIG

SEQ ID NO: 1146067 - protein, 7 aa, Mycobacterium
HTDAESY

SEQ ID NO: 1146068 - protein, 6 aa, Mycobacterium
HTGGGQ

SEQ ID NO: 1146069 - protein, 6 aa, Mycobacterium
IAAEDQ

SEQ ID NO: 1146070 - protein, 7 aa, Mycobacterium
IAPRQAR

SEQ ID NO: 1146071 - protein, 13 aa, Mycobacterium
IATDSTAVVPAPE

SEQ ID NO: 1146072 - protein, 21 aa, Mycobacterium
IDDGHAPGVTSTESAKVKELE

SEQ ID NO: 1146073 - protein, 7 aa, Mycobacterium
IDPRDTR

SEQ ID NO: 1146074 - protein, 4 aa, Mycobacterium
IGRS

SEQ ID NO: 1146075 - protein, 5 aa, Mycobacterium
IPPGD

SEQ ID NO: 1146076 - protein, 5 aa, Mycobacterium
IRGGA

SEQ ID NO: 1146077 - protein, 6 aa, Mycobacterium
IRRGSD

SEQ ID NO: 1146078 - protein, 7 aa, Mycobacterium
ITNGPDA

SEQ ID NO: 1146079 - protein, 7 aa, Mycobacterium
KAAEGHD

SEQ ID NO: 1146080 - protein, 9 aa, Mycobacterium
KAKSNRYRE

SEQ ID NO: 1146081 - protein, 6 aa, Mycobacterium
KATGAK

SEQ ID NO: 1146082 - protein, 8 aa, Mycobacterium
KDAENDRG

SEQ ID NO: 1146083 - protein, 4 aa, Mycobacterium
KDAG

SEQ ID NO: 1146084 - protein, 6 aa, Mycobacterium
KDTVKT

SEQ ID NO: 1146085 - protein, 14 aa, Mycobacterium
KKRGKNGKPGPPVH

SEQ ID NO: 1146086 - protein, 7 aa, Mycobacterium
KPGPYPW

SEQ ID NO: 1146087 - protein, 9 aa, Mycobacterium
KRARRDQKT

SEQ ID NO: 1146088 - protein, 13 aa, Mycobacterium
KSSGVGSEESTEE

SEQ ID NO: 1146089 - protein, 4 aa, Mycobacterium
LANA

SEQ ID NO: 1146090 - protein, 5 aa, Mycobacterium
LDAGD

SEQ ID NO: 1146091 - protein, 6 aa, Mycobacterium
LEAENA

SEQ ID NO: 1146092 - protein, 4 aa, Mycobacterium
LEAG

SEQ ID NO: 1146093 - protein, 13 aa, Mycobacterium
LEKGAGVAVTGGG

SEQ ID NO: 1146094 - protein, 18 aa, Mycobacterium
LEPGGRTGASADHEGEVS

SEQ ID NO: 1146095 - protein, 4 aa, Mycobacterium
LGEK

SEQ ID NO: 1146096 - protein, 4 aa, Mycobacterium
LGEM

SEQ ID NO: 1146097 - protein, 4 aa, Mycobacterium
LGGG

SEQ ID NO: 1146098 - protein, 5 aa, Mycobacterium
LGGGL

SEQ ID NO: 1146099 - protein, 7 aa, Mycobacterium
LIGGQED

SEQ ID NO: 1146100 - protein, 6 aa, Mycobacterium
LKTDDD

SEQ ID NO: 1146101 - protein, 6 aa, Mycobacterium
LNPNTG

SEQ ID NO: 1146102 - protein, 4 aa, Mycobacterium
LPAT

SEQ ID NO: 1146103 - protein, 8 aa, Mycobacterium
LPDTTGGV

SEQ ID NO: 1146104 - protein, 5 aa, Mycobacterium
LPEGG

SEQ ID NO: 1146105 - protein, 4 aa, Mycobacterium
LPGG

SEQ ID NO: 1146106 - protein, 5 aa, Mycobacterium
LPPAE

SEQ ID NO: 1146107 - protein, 8 aa, Mycobacterium
LQRRADGQ

SEQ ID NO: 1146108 - protein, 7 aa, Mycobacterium
LRRDEDS

SEQ ID NO: 1146109 - protein, 7 aa, Mycobacterium
LSAPERE

SEQ ID NO: 1146110 - protein, 6 aa, Mycobacterium
LSPAQL

SEQ ID NO: 1146111 - protein, 6 aa, Mycobacterium
LTETSS

SEQ ID NO: 1146112 - protein, 6 aa, Mycobacterium
LTGRRP

SEQ ID NO: 1146113 - protein, 7 aa, Mycobacterium
LTPERRD

SEQ ID NO: 1146114 - protein, 6 aa, Mycobacterium
MAGRGT

SEQ ID NO: 1146115 - protein, 5 aa, Mycobacterium
MDSGA

SEQ ID NO: 1146116 - protein, 4 aa, Mycobacterium
MEGG

SEQ ID NO: 1146117 - protein, 7 aa, Mycobacterium
METPSAL

SEQ ID NO: 1146118 - protein, 7 aa, Mycobacterium
MSETAGG

SEQ ID NO: 1146119 - protein, 4 aa, Mycobacterium
NDPR

SEQ ID NO: 1146120 - protein, 10 aa, Mycobacterium
NGERAAKSTR

SEQ ID NO: 1146121 - protein, 5 aa, Mycobacterium
NGKPE

SEQ ID NO: 1146122 - protein, 15 aa, Mycobacterium
NGTTETFPPQVPEAQ

SEQ ID NO: 1146123 - protein, 8 aa, Mycobacterium
NIPDGGGH

SEQ ID NO: 1146124 - protein, 10 aa, Mycobacterium
NNAGNGDTGL

SEQ ID NO: 1146125 - protein, 8 aa, Mycobacterium
NNCSTGST

SEQ ID NO: 1146126 - protein, 15 aa, Mycobacterium
NPDCPGHRDTQPTKD

SEQ ID NO: 1146127 - protein, 6 aa, Mycobacterium
NPSPHI

SEQ ID NO: 1146128 - protein, 4 aa, Mycobacterium
NPTV

SEQ ID NO: 1146129 - protein, 16 aa, Mycobacterium
NRYAPPPPYPSPDPFE

SEQ ID NO: 1146130 - protein, 4 aa, Mycobacterium
NSDD

SEQ ID NO: 1146131 - protein, 4 aa, Mycobacterium
NSDI

SEQ ID NO: 1146132 - protein, 4 aa, Mycobacterium
PADS

SEQ ID NO: 1146133 - protein, 4 aa, Mycobacterium
PAEQ

SEQ ID NO: 1146134 - protein, 9 aa, Mycobacterium
PAPNSVVPS

SEQ ID NO: 1146135 - protein, 8 aa, Mycobacterium
PARSGPWK

SEQ ID NO: 1146136 - protein, 10 aa, Mycobacterium
PDAAPGQVDE

SEQ ID NO: 1146137 - protein, 4 aa, Mycobacterium
PDGG

SEQ ID NO: 1146138 - protein, 4 aa, Mycobacterium
PDGT

SEQ ID NO: 1146139 - protein, 4 aa, Mycobacterium
PDGV

SEQ ID NO: 1146140 - protein, 4 aa, Mycobacterium
PDLP

SEQ ID NO: 1146141 - protein, 8 aa, Mycobacterium
PDQKARSR

SEQ ID NO: 1146142 - protein, 4 aa, Mycobacterium
PDQR

SEQ ID NO: 1146143 - protein, 4 aa, Mycobacterium
PDRY

SEQ ID NO: 1146144 - protein, 4 aa, Mycobacterium
PDYG

SEQ ID NO: 1146145 - protein, 4 aa, Mycobacterium
PEAQ

SEQ ID NO: 1146146 - protein, 10 aa, Mycobacterium
PEGAGPGTKG

SEQ ID NO: 1146147 - protein, 4 aa, Mycobacterium
PELP

SEQ ID NO: 1146148 - protein, 4 aa, Mycobacterium
PERD

SEQ ID NO: 1146149 - protein, 4 aa, Mycobacterium
PESV

SEQ ID NO: 1146150 - protein, 4 aa, Mycobacterium
PGFE

SEQ ID NO: 1146151 - protein, 4 aa, Mycobacterium
PGGE

SEQ ID NO: 1146152 - protein, 5 aa, Mycobacterium
PGHSE

SEQ ID NO: 1146153 - protein, 4 aa, Mycobacterium
PGPF

SEQ ID NO: 1146154 - protein, 5 aa, Mycobacterium
PGQRI

SEQ ID NO: 1146155 - protein, 4 aa, Mycobacterium
PHDV

SEQ ID NO: 1146156 - protein, 5 aa, Mycobacterium
PHTPN

SEQ ID NO: 1146157 - protein, 18 aa, Mycobacterium
PKPYKRTTIAGESATAVP

SEQ ID NO: 1146158 - protein, 15 aa, Mycobacterium
PKRTRPYRPQTNGKI

SEQ ID NO: 1146159 - protein, 4 aa, Mycobacterium
PPDV

SEQ ID NO: 1146160 - protein, 4 aa, Mycobacterium
PQRA

SEQ ID NO: 1146161 - protein, 4 aa, Mycobacterium
PQRD

SEQ ID NO: 1146162 - protein, 6 aa, Mycobacterium
PQRVSS

SEQ ID NO: 1146163 - protein, 4 aa, Mycobacterium
PRHD

SEQ ID NO: 1146164 - protein, 6 aa, Mycobacterium
PRTGTT

SEQ ID NO: 1146165 - protein, 6 aa, Mycobacterium
PSGVRA

SEQ ID NO: 1146166 - protein, 10 aa, Mycobacterium
PSIGTVGDSF

SEQ ID NO: 1146167 - protein, 4 aa, Mycobacterium
PTAD

SEQ ID NO: 1146168 - protein, 6 aa, Mycobacterium
PTFSQP

SEQ ID NO: 1146169 - protein, 6 aa, Mycobacterium
PTKPHR

SEQ ID NO: 1146170 - protein, 7 aa, Mycobacterium
PTKTSQQ

SEQ ID NO: 1146171 - protein, 4 aa, Mycobacterium
PTLR

SEQ ID NO: 1146172 - protein, 6 aa, Mycobacterium
PTPPWH

SEQ ID NO: 1146173 - protein, 4 aa, Mycobacterium
PTRK

SEQ ID NO: 1146174 - protein, 8 aa, Mycobacterium
QDRSYGPA

SEQ ID NO: 1146175 - protein, 4 aa, Mycobacterium
QERT

SEQ ID NO: 1146176 - protein, 4 aa, Mycobacterium
QETV

SEQ ID NO: 1146177 - protein, 18 aa, Mycobacterium
QGTPDKPETVFLRYPGHQ

SEQ ID NO: 1146178 - protein, 6 aa, Mycobacterium
QKSIAE

SEQ ID NO: 1146179 - protein, 5 aa, Mycobacterium
QRGDW

SEQ ID NO: 1146180 - protein, 6 aa, Mycobacterium
QRPGAV

SEQ ID NO: 1146181 - protein, 7 aa, Mycobacterium
QSERYGV

SEQ ID NO: 1146182 - protein, 4 aa, Mycobacterium
QSRR

SEQ ID NO: 1146183 - protein, 5 aa, Mycobacterium
QTEAM

SEQ ID NO: 1146184 - protein, 4 aa, Mycobacterium
QTGQ

SEQ ID NO: 1146185 - protein, 4 aa, Mycobacterium
QTPG

SEQ ID NO: 1146186 - protein, 4 aa, Mycobacterium
RAGR

SEQ ID NO: 1146187 - protein, 5 aa, Mycobacterium
RAPRE

SEQ ID NO: 1146188 - protein, 10 aa, Mycobacterium
RATTDEAGRY

SEQ ID NO: 1146189 - protein, 4 aa, Mycobacterium
RDAE

SEQ ID NO: 1146190 - protein, 4 aa, Mycobacterium
RDAG

SEQ ID NO: 1146191 - protein, 8 aa, Mycobacterium
RDDLPDGG

SEQ ID NO: 1146192 - protein, 4 aa, Mycobacterium
RDGR

SEQ ID NO: 1146193 - protein, 4 aa, Mycobacterium
RDGT

SEQ ID NO: 1146194 - protein, 4 aa, Mycobacterium
RDRA

SEQ ID NO: 1146195 - protein, 4 aa, Mycobacterium
REAS

SEQ ID NO: 1146196 - protein, 8 aa, Mycobacterium
REPGTASA

SEQ ID NO: 1146197 - protein, 4 aa, Mycobacterium
REQG

SEQ ID NO: 1146198 - protein, 4 aa, Mycobacterium
RGAI

SEQ ID NO: 1146199 - protein, 4 aa, Mycobacterium
RGEI

SEQ ID NO: 1146200 - protein, 5 aa, Mycobacterium
RGGVR

SEQ ID NO: 1146201 - protein, 4 aa, Mycobacterium
RGPG

SEQ ID NO: 1146202 - protein, 6 aa, Mycobacterium
RGPLDR

SEQ ID NO: 1146203 - protein, 4 aa, Mycobacterium
RGRA

SEQ ID NO: 1146204 - protein, 4 aa, Mycobacterium
RGSV

SEQ ID NO: 1146205 - protein, 9 aa, Mycobacterium
RGTQYTSTD

SEQ ID NO: 1146206 - protein, 8 aa, Mycobacterium
RKKARADI

SEQ ID NO: 1146207 - protein, 6 aa, Mycobacterium
RNGGGA

SEQ ID NO: 1146208 - protein, 4 aa, Mycobacterium
RPAA

SEQ ID NO: 1146209 - protein, 4 aa, Mycobacterium
RPDL

SEQ ID NO: 1146210 - protein, 8 aa, Mycobacterium
RPEARNAM

SEQ ID NO: 1146211 - protein, 4 aa, Mycobacterium
RPGQ

SEQ ID NO: 1146212 - protein, 4 aa, Mycobacterium
RPGR

SEQ ID NO: 1146213 - protein, 4 aa, Mycobacterium
RPGT

SEQ ID NO: 1146214 - protein, 7 aa, Mycobacterium
RPLEERQ

SEQ ID NO: 1146215 - protein, 5 aa, Mycobacterium
RPRSG

SEQ ID NO: 1146216 - protein, 4 aa, Mycobacterium
RPTE

SEQ ID NO: 1146217 - protein, 10 aa, Mycobacterium
RQALTGPSLP

SEQ ID NO: 1146218 - protein, 4 aa, Mycobacterium
RQPP

SEQ ID NO: 1146219 - protein, 9 aa, Mycobacterium
RRNGLSNDE

SEQ ID NO: 1146220 - protein, 5 aa, Mycobacterium
RRPEA

SEQ ID NO: 1146221 - protein, 4 aa, Mycobacterium
RRSG

SEQ ID NO: 1146222 - protein, 15 aa, Mycobacterium
RSADTTFDDRSRGQV

SEQ ID NO: 1146223 - protein, 7 aa, Mycobacterium
RSAEPTA

SEQ ID NO: 1146224 - protein, 4 aa, Mycobacterium
RSAG

SEQ ID NO: 1146225 - protein, 4 aa, Mycobacterium
RSGA

SEQ ID NO: 1146226 - protein, 9 aa, Mycobacterium
RSGRMSDDD

SEQ ID NO: 1146227 - protein, 5 aa, Mycobacterium
RSLPE

SEQ ID NO: 1146228 - protein, 8 aa, Mycobacterium
RSSQTHPD

SEQ ID NO: 1146229 - protein, 4 aa, Mycobacterium
RTAD

SEQ ID NO: 1146230 - protein, 6 aa, Mycobacterium
RTASAA

SEQ ID NO: 1146231 - protein, 4 aa, Mycobacterium
RTDP

SEQ ID NO: 1146232 - protein, 8 aa, Mycobacterium
RTGEGQEV

SEQ ID NO: 1146233 - protein, 4 aa, Mycobacterium
RTGF

SEQ ID NO: 1146234 - protein, 11 aa, Mycobacterium
RTHTETGQSPL

SEQ ID NO: 1146235 - protein, 5 aa, Mycobacterium
RTPDD

SEQ ID NO: 1146236 - protein, 4 aa, Mycobacterium
RVTR

SEQ ID NO: 1146237 - protein, 5 aa, Mycobacterium
SAGPR

SEQ ID NO: 1146238 - protein, 6 aa, Mycobacterium
SAHTDA

SEQ ID NO: 1146239 - protein, 14 aa, Mycobacterium
SARTPIENLGRGAH

SEQ ID NO: 1146240 - protein, 5 aa, Mycobacterium
SDDEL

SEQ ID NO: 1146241 - protein, 4 aa, Mycobacterium
SDGG

SEQ ID NO: 1146242 - protein, 5 aa, Mycobacterium
SDGHR

SEQ ID NO: 1146243 - protein, 9 aa, Mycobacterium
SDNGSAYRS

SEQ ID NO: 1146244 - protein, 6 aa, Mycobacterium
SDVKDG

SEQ ID NO: 1146245 - protein, 6 aa, Mycobacterium
SEGGTG

SEQ ID NO: 1146246 - protein, 5 aa, Mycobacterium
SERGD

SEQ ID NO: 1146247 - protein, 6 aa, Mycobacterium
SGCGKS

SEQ ID NO: 1146248 - protein, 12 aa, Mycobacterium
SGDGKARAWPEL

SEQ ID NO: 1146249 - protein, 4 aa, Mycobacterium
SGGL

SEQ ID NO: 1146250 - protein, 4 aa, Mycobacterium
SGGT

SEQ ID NO: 1146251 - protein, 7 aa, Mycobacterium
SKTPEQE

SEQ ID NO: 1146252 - protein, 21 aa, Mycobacterium
SLSPGGPKGAPVPAGRTAATH

SEQ ID NO: 1146253 - protein, 4 aa, Mycobacterium
SPES

SEQ ID NO: 1146254 - protein, 4 aa, Mycobacterium
SPSI

SEQ ID NO: 1146255 - protein, 10 aa, Mycobacterium
SQAAAAQARA

SEQ ID NO: 1146256 - protein, 4 aa, Mycobacterium
SQDV

SEQ ID NO: 1146257 - protein, 8 aa, Mycobacterium
SQSPASDD

SEQ ID NO: 1146258 - protein, 4 aa, Mycobacterium
SRGV

SEQ ID NO: 1146259 - protein, 7 aa, Mycobacterium
SSDDSAA

SEQ ID NO: 1146260 - protein, 8 aa, Mycobacterium
SSKNAKTI

SEQ ID NO: 1146261 - protein, 4 aa, Mycobacterium
SSRT

SEQ ID NO: 1146262 - protein, 8 aa, Mycobacterium
STEQRNTA

SEQ ID NO: 1146263 - protein, 10 aa, Mycobacterium
SVPDPAPQDG

SEQ ID NO: 1146264 - protein, 6 aa, Mycobacterium
TAAAQA

SEQ ID NO: 1146265 - protein, 4 aa, Mycobacterium
TADP

SEQ ID NO: 1146266 - protein, 6 aa, Mycobacterium
TADRPG

SEQ ID NO: 1146267 - protein, 4 aa, Mycobacterium
TAEG

SEQ ID NO: 1146268 - protein, 4 aa, Mycobacterium
TAET

SEQ ID NO: 1146269 - protein, 4 aa, Mycobacterium
TAFG

SEQ ID NO: 1146270 - protein, 5 aa, Mycobacterium
TAGPL

SEQ ID NO: 1146271 - protein, 4 aa, Mycobacterium
TAQR

SEQ ID NO: 1146272 - protein, 4 aa, Mycobacterium
TAQS

SEQ ID NO: 1146273 - protein, 4 aa, Mycobacterium
TARD

SEQ ID NO: 1146274 - protein, 5 aa, Mycobacterium
TATDD

SEQ ID NO: 1146275 - protein, 9 aa, Mycobacterium
TDPDAPKHK

SEQ ID NO: 1146276 - protein, 8 aa, Mycobacterium
TDPEAGHK

SEQ ID NO: 1146277 - protein, 4 aa, Mycobacterium
TEDG

SEQ ID NO: 1146278 - protein, 17 aa, Mycobacterium
TERPHQGLPGRVTPRTA

SEQ ID NO: 1146279 - protein, 5 aa, Mycobacterium
TERQR

SEQ ID NO: 1146280 - protein, 4 aa, Mycobacterium
TETV

SEQ ID NO: 1146281 - protein, 10 aa, Mycobacterium
TGAPDAIPAV

SEQ ID NO: 1146282 - protein, 13 aa, Mycobacterium
TGEESDDESLGGA

SEQ ID NO: 1146283 - protein, 7 aa, Mycobacterium
TGPAGEK

SEQ ID NO: 1146284 - protein, 8 aa, Mycobacterium
TGQIDPET

SEQ ID NO: 1146285 - protein, 4 aa, Mycobacterium
TIDT

SEQ ID NO: 1146286 - protein, 7 aa, Mycobacterium
TKAPGDL

SEQ ID NO: 1146287 - protein, 11 aa, Mycobacterium
TMGNRGNSTGP

SEQ ID NO: 1146288 - protein, 5 aa, Mycobacterium
TNAGG

SEQ ID NO: 1146289 - protein, 4 aa, Mycobacterium
TPEL

SEQ ID NO: 1146290 - protein, 4 aa, Mycobacterium
TPLT

SEQ ID NO: 1146291 - protein, 17 aa, Mycobacterium
TPRHANSTVNDAAHRAE

SEQ ID NO: 1146292 - protein, 4 aa, Mycobacterium
TPVG

SEQ ID NO: 1146293 - protein, 14 aa, Mycobacterium
TQAATDDTAGDDQV

SEQ ID NO: 1146294 - protein, 6 aa, Mycobacterium
TRDRTG

SEQ ID NO: 1146295 - protein, 11 aa, Mycobacterium
TRRYSSEEKAA

SEQ ID NO: 1146296 - protein, 5 aa, Mycobacterium
TSDGA

SEQ ID NO: 1146297 - protein, 11 aa, Mycobacterium
TSLRDGSHHKR

SEQ ID NO: 1146298 - protein, 4 aa, Mycobacterium
TSQR

SEQ ID NO: 1146299 - protein, 6 aa, Mycobacterium
TSTTWP

SEQ ID NO: 1146300 - protein, 11 aa, Mycobacterium
TTAGPEADELT

SEQ ID NO: 1146301 - protein, 7 aa, Mycobacterium
TTGCRPE

SEQ ID NO: 1146302 - protein, 16 aa, Mycobacterium
TTGSAGESHTLSDDEY

SEQ ID NO: 1146303 - protein, 4 aa, Mycobacterium
TTHR

SEQ ID NO: 1146304 - protein, 25 aa, Mycobacterium
TTHRPGNGRTEWTPPKEQDTGQPRI

SEQ ID NO: 1146305 - protein, 5 aa, Mycobacterium
TVGQT

SEQ ID NO: 1146306 - protein, 16 aa, Mycobacterium
VAGRPKEEYGLEPQGL

SEQ ID NO: 1146307 - protein, 7 aa, Mycobacterium
VAGTTDL

SEQ ID NO: 1146308 - protein, 7 aa, Mycobacterium
VARGDIG

SEQ ID NO: 1146309 - protein, 9 aa, Mycobacterium
VDPPRAAAN

SEQ ID NO: 1146310 - protein, 4 aa, Mycobacterium
VEPA

SEQ ID NO: 1146311 - protein, 4 aa, Mycobacterium
VEPY

SEQ ID NO: 1146312 - protein, 4 aa, Mycobacterium
VETD

SEQ ID NO: 1146313 - protein, 4 aa, Mycobacterium
VGSG

SEQ ID NO: 1146314 - protein, 4 aa, Mycobacterium
VPTA

SEQ ID NO: 1146315 - protein, 4 aa, Mycobacterium
VRAG

SEQ ID NO: 1146316 - protein, 5 aa, Mycobacterium
VRAGG

SEQ ID NO: 1146317 - protein, 9 aa, Mycobacterium
VSPPPPAAP

SEQ ID NO: 1146318 - protein, 5 aa, Mycobacterium
VSRGS

SEQ ID NO: 1146319 - protein, 10 aa, Mycobacterium
VTDKRSKATL

SEQ ID NO: 1146320 - protein, 8 aa, Mycobacterium
VTSGSLGQ

SEQ ID NO: 1146321 - protein, 6 aa, Mycobacterium
YAQEAR

SEQ ID NO: 1146322 - protein, 8 aa, Mycobacterium
YGPTHPSN

SEQ ID NO: 1146323 - protein, 6 aa, Mycobacterium
YGPVPA

SEQ ID NO: 1146324 - protein, 4 aa, Mycobacterium
YPQE

SEQ ID NO: 1146325 - protein, 19 aa, Mycobacterium
YQRAGVEETQPRLSYPPYR

SEQ ID NO: 1146326 - protein, 6 aa, Mycobacterium
AAAAEG

SEQ ID NO: 1146327 - protein, 8 aa, Mycobacterium
AAAAEGIA

SEQ ID NO: 1146328 - protein, 7 aa, Mycobacterium
AAAAGQT

SEQ ID NO: 1146329 - protein, 8 aa, Mycobacterium
AAAARREY

SEQ ID NO: 1146330 - protein, 5 aa, Mycobacterium
AAAAT

SEQ ID NO: 1146331 - protein, 8 aa, Mycobacterium
AAADEAGF

SEQ ID NO: 1146332 - protein, 5 aa, Mycobacterium
AAAEA

SEQ ID NO: 1146333 - protein, 10 aa, Mycobacterium
AAAEDPRDLD

SEQ ID NO: 1146334 - protein, 6 aa, Mycobacterium
AAAEGK

SEQ ID NO: 1146335 - protein, 6 aa, Mycobacterium
AAAEMR

SEQ ID NO: 1146336 - protein, 5 aa, Mycobacterium
AAAGL

SEQ ID NO: 1146337 - protein, 5 aa, Mycobacterium
AAAGV

SEQ ID NO: 1146338 - protein, 8 aa, Mycobacterium
AAAGVGKG

SEQ ID NO: 1146339 - protein, 4 aa, Mycobacterium
AAAK

SEQ ID NO: 1146340 - protein, 10 aa, Mycobacterium
AAALGDDPDT

SEQ ID NO: 1146341 - protein, 4 aa, Mycobacterium
AAAP

SEQ ID NO: 1146342 - protein, 6 aa, Mycobacterium
AAAPGA

SEQ ID NO: 1146343 - protein, 7 aa, Mycobacterium
AAAPGAR

SEQ ID NO: 1146344 - protein, 7 aa, Mycobacterium
AAARGTA

SEQ ID NO: 1146345 - protein, 4 aa, Mycobacterium
AAAS

SEQ ID NO: 1146346 - protein, 5 aa, Mycobacterium
AAATG

SEQ ID NO: 1146347 - protein, 12 aa, Mycobacterium
AAAYGASRDADR

SEQ ID NO: 1146348 - protein, 6 aa, Mycobacterium
AADAGD

SEQ ID NO: 1146349 - protein, 12 aa, Mycobacterium
AADDDSATGGPD

SEQ ID NO: 1146350 - protein, 4 aa, Mycobacterium
AADL

SEQ ID NO: 1146351 - protein, 7 aa, Mycobacterium
AADPDAP

SEQ ID NO: 1146352 - protein, 8 aa, Mycobacterium
AADPEARY

SEQ ID NO: 1146353 - protein, 5 aa, Mycobacterium
AADPN

SEQ ID NO: 1146354 - protein, 13 aa, Mycobacterium
AADTTFDGRPRGQ

SEQ ID NO: 1146355 - protein, 5 aa, Mycobacterium
AADVP

SEQ ID NO: 1146356 - protein, 4 aa, Mycobacterium
AAEA

SEQ ID NO: 1146357 - protein, 6 aa, Mycobacterium
AAEAGA

SEQ ID NO: 1146358 - protein, 9 aa, Mycobacterium
AAEAGPRGV

SEQ ID NO: 1146359 - protein, 6 aa, Mycobacterium
AAEKEL

SEQ ID NO: 1146360 - protein, 7 aa, Mycobacterium
AAEPATV

SEQ ID NO: 1146361 - protein, 6 aa, Mycobacterium
AAETPL

SEQ ID NO: 1146362 - protein, 5 aa, Mycobacterium
AAFGG

SEQ ID NO: 1146363 - protein, 7 aa, Mycobacterium
AAGANPI

SEQ ID NO: 1146364 - protein, 9 aa, Mycobacterium
AAGASDSDI

SEQ ID NO: 1146365 - protein, 10 aa, Mycobacterium
AAGATGSVAG

SEQ ID NO: 1146366 - protein, 4 aa, Mycobacterium
AAGD

SEQ ID NO: 1146367 - protein, 11 aa, Mycobacterium
AAGDGRSDDVA

SEQ ID NO: 1146368 - protein, 5 aa, Mycobacterium
AAGEQ

SEQ ID NO: 1146369 - protein, 7 aa, Mycobacterium
AAGERVR

SEQ ID NO: 1146370 - protein, 8 aa, Mycobacterium
AAGHDAEQ

SEQ ID NO: 1146371 - protein, 4 aa, Mycobacterium
AAGL

SEQ ID NO: 1146372 - protein, 7 aa, Mycobacterium
AAGMDKE

SEQ ID NO: 1146373 - protein, 5 aa, Mycobacterium
AAGRD

SEQ ID NO: 1146374 - protein, 10 aa, Mycobacterium
AAGRDAGAEV

SEQ ID NO: 1146375 - protein, 7 aa, Mycobacterium
AAGRPVD

SEQ ID NO: 1146376 - protein, 5 aa, Mycobacterium
AAGRT

SEQ ID NO: 1146377 - protein, 10 aa, Mycobacterium
AAHGANRTGR

SEQ ID NO: 1146378 - protein, 5 aa, Mycobacterium
AAHPE

SEQ ID NO: 1146379 - protein, 4 aa, Mycobacterium
AAIE

SEQ ID NO: 1146380 - protein, 4 aa, Mycobacterium
AAIG

SEQ ID NO: 1146381 - protein, 5 aa, Mycobacterium
AAIRD

SEQ ID NO: 1146382 - protein, 5 aa, Mycobacterium
AAKAA

SEQ ID NO: 1146383 - protein, 10 aa, Mycobacterium
AAKAAGHPGI

SEQ ID NO: 1146384 - protein, 7 aa, Mycobacterium
AAKPKIA

SEQ ID NO: 1146385 - protein, 6 aa, Mycobacterium
AALGGG

SEQ ID NO: 1146386 - protein, 6 aa, Mycobacterium
AANRPG

SEQ ID NO: 1146387 - protein, 5 aa, Mycobacterium
AANSR

SEQ ID NO: 1146388 - protein, 7 aa, Mycobacterium
AAPASDT

SEQ ID NO: 1146389 - protein, 10 aa, Mycobacterium
AAPDTGEQDL

SEQ ID NO: 1146390 - protein, 7 aa, Mycobacterium
AAPKSAG

SEQ ID NO: 1146391 - protein, 11 aa, Mycobacterium
AAPLKPGKGPI

SEQ ID NO: 1146392 - protein, 16 aa, Mycobacterium
AAPTSSGAAAGDDQSL

SEQ ID NO: 1146393 - protein, 4 aa, Mycobacterium
AAPV

SEQ ID NO: 1146394 - protein, 8 aa, Mycobacterium
AAQATTLG

SEQ ID NO: 1146395 - protein, 8 aa, Mycobacterium
AAQGTTGP

SEQ ID NO: 1146396 - protein, 5 aa, Mycobacterium
AAQLG

SEQ ID NO: 1146397 - protein, 7 aa, Mycobacterium
AARANDI

SEQ ID NO: 1146398 - protein, 8 aa, Mycobacterium
AARARSGR

SEQ ID NO: 1146399 - protein, 7 aa, Mycobacterium
AARDVAN

SEQ ID NO: 1146400 - protein, 14 aa, Mycobacterium
AARENARGAREVTS

SEQ ID NO: 1146401 - protein, 8 aa, Mycobacterium
AARGDLEA

SEQ ID NO: 1146402 - protein, 6 aa, Mycobacterium
AARGIG

SEQ ID NO: 1146403 - protein, 7 aa, Mycobacterium
AARKAGH

SEQ ID NO: 1146404 - protein, 4 aa, Mycobacterium
AARN

SEQ ID NO: 1146405 - protein, 6 aa, Mycobacterium
AARPDI

SEQ ID NO: 1146406 - protein, 6 aa, Mycobacterium
AARQGA

SEQ ID NO: 1146407 - protein, 4 aa, Mycobacterium
AARR

SEQ ID NO: 1146408 - protein, 7 aa, Mycobacterium
AASDIDA

SEQ ID NO: 1146409 - protein, 4 aa, Mycobacterium
AASE

SEQ ID NO: 1146410 - protein, 6 aa, Mycobacterium
AASFKE

SEQ ID NO: 1146411 - protein, 5 aa, Mycobacterium
AASGG

SEQ ID NO: 1146412 - protein, 4 aa, Mycobacterium
AASH

SEQ ID NO: 1146413 - protein, 6 aa, Mycobacterium
AASKGG

SEQ ID NO: 1146414 - protein, 9 aa, Mycobacterium
AASPDPAAV

SEQ ID NO: 1146415 - protein, 9 aa, Mycobacterium
AASSEKHPD

SEQ ID NO: 1146416 - protein, 11 aa, Mycobacterium
AASSPEGGEID

SEQ ID NO: 1146417 - protein, 16 aa, Mycobacterium
AATAAPAGYALGGGDP

SEQ ID NO: 1146418 - protein, 7 aa, Mycobacterium
AATAEFD

SEQ ID NO: 1146419 - protein, 4 aa, Mycobacterium
AATD

SEQ ID NO: 1146420 - protein, 10 aa, Mycobacterium
AATPARKRGE

SEQ ID NO: 1146421 - protein, 15 aa, Mycobacterium
AATRSSGQDSAGYGR

SEQ ID NO: 1146422 - protein, 5 aa, Mycobacterium
AATRT

SEQ ID NO: 1146423 - protein, 6 aa, Mycobacterium
AATSID

SEQ ID NO: 1146424 - protein, 6 aa, Mycobacterium
AAVKAE

SEQ ID NO: 1146425 - protein, 14 aa, Mycobacterium
AAVTGNGRADKAQV

SEQ ID NO: 1146426 - protein, 13 aa, Mycobacterium
AAYERGRPSYPPE

SEQ ID NO: 1146427 - protein, 10 aa, Mycobacterium
AAYGDQDRAD

SEQ ID NO: 1146428 - protein, 6 aa, Mycobacterium
ACESGT

SEQ ID NO: 1146429 - protein, 8 aa, Mycobacterium
ACGSSQQA

SEQ ID NO: 1146430 - protein, 5 aa, Mycobacterium
ACGTP

SEQ ID NO: 1146431 - protein, 4 aa, Mycobacterium
ACSR

SEQ ID NO: 1146432 - protein, 7 aa, Mycobacterium
ADAAPMA

SEQ ID NO: 1146433 - protein, 5 aa, Mycobacterium
ADAAT

SEQ ID NO: 1146434 - protein, 10 aa, Mycobacterium
ADADVAGTQT

SEQ ID NO: 1146435 - protein, 7 aa, Mycobacterium
ADAEGVT

SEQ ID NO: 1146436 - protein, 12 aa, Mycobacterium
ADAGMPWKEVPR

SEQ ID NO: 1146437 - protein, 8 aa, Mycobacterium
ADAGSGVA

SEQ ID NO: 1146438 - protein, 16 aa, Mycobacterium
ADARREKESAIDAQDF

SEQ ID NO: 1146439 - protein, 5 aa, Mycobacterium
ADDGP

SEQ ID NO: 1146440 - protein, 6 aa, Mycobacterium
ADDPRF

SEQ ID NO: 1146441 - protein, 8 aa, Mycobacterium
ADDRGDPV

SEQ ID NO: 1146442 - protein, 8 aa, Mycobacterium
ADEDTARQ

SEQ ID NO: 1146443 - protein, 4 aa, Mycobacterium
ADEP

SEQ ID NO: 1146444 - protein, 6 aa, Mycobacterium
ADEPPY

SEQ ID NO: 1146445 - protein, 8 aa, Mycobacterium
ADERAAEG

SEQ ID NO: 1146446 - protein, 7 aa, Mycobacterium
ADGADTA

SEQ ID NO: 1146447 - protein, 5 aa, Mycobacterium
ADGDN

SEQ ID NO: 1146448 - protein, 4 aa, Mycobacterium
ADGE

SEQ ID NO: 1146449 - protein, 7 aa, Mycobacterium
ADGEQEK

SEQ ID NO: 1146450 - protein, 10 aa, Mycobacterium
ADGGTRTAAI

SEQ ID NO: 1146451 - protein, 8 aa, Mycobacterium
ADGPADAL

SEQ ID NO: 1146452 - protein, 7 aa, Mycobacterium
ADGPSAL

SEQ ID NO: 1146453 - protein, 5 aa, Mycobacterium
ADGQA

SEQ ID NO: 1146454 - protein, 7 aa, Mycobacterium
ADGRGLP

SEQ ID NO: 1146455 - protein, 5 aa, Mycobacterium
ADGSI

SEQ ID NO: 1146456 - protein, 4 aa, Mycobacterium
ADGT

SEQ ID NO: 1146457 - protein, 9 aa, Mycobacterium
ADGTLTAGP

SEQ ID NO: 1146458 - protein, 6 aa, Mycobacterium
ADGTTV

SEQ ID NO: 1146459 - protein, 11 aa, Mycobacterium
ADIGSGAGLPG

SEQ ID NO: 1146460 - protein, 5 aa, Mycobacterium
ADKGI

SEQ ID NO: 1146461 - protein, 7 aa, Mycobacterium
ADKVSVN

SEQ ID NO: 1146462 - protein, 12 aa, Mycobacterium
ADLAGSNNTTIK

SEQ ID NO: 1146463 - protein, 5 aa, Mycobacterium
ADLDE

SEQ ID NO: 1146464 - protein, 6 aa, Mycobacterium
ADLPPA

SEQ ID NO: 1146465 - protein, 4 aa, Mycobacterium
ADLS

SEQ ID NO: 1146466 - protein, 7 aa, Mycobacterium
ADLSGEE

SEQ ID NO: 1146467 - protein, 6 aa, Mycobacterium
ADNAEY

SEQ ID NO: 1146468 - protein, 8 aa, Mycobacterium
ADNASSAG

SEQ ID NO: 1146469 - protein, 8 aa, Mycobacterium
ADNIDPQQ

SEQ ID NO: 1146470 - protein, 6 aa, Mycobacterium
ADNPHA

SEQ ID NO: 1146471 - protein, 6 aa, Mycobacterium
ADNQPT

SEQ ID NO: 1146472 - protein, 6 aa, Mycobacterium
ADNQRA

SEQ ID NO: 1146473 - protein, 7 aa, Mycobacterium
ADNSRAV

SEQ ID NO: 1146474 - protein, 7 aa, Mycobacterium
ADPAAEY

SEQ ID NO: 1146475 - protein, 5 aa, Mycobacterium
ADPDL

SEQ ID NO: 1146476 - protein, 5 aa, Mycobacterium
ADPEA

SEQ ID NO: 1146477 - protein, 5 aa, Mycobacterium
ADPEK

SEQ ID NO: 1146478 - protein, 4 aa, Mycobacterium
ADPL

SEQ ID NO: 1146479 - protein, 5 aa, Mycobacterium
ADPLD

SEQ ID NO: 1146480 - protein, 8 aa, Mycobacterium
ADPPMTKD

SEQ ID NO: 1146481 - protein, 4 aa, Mycobacterium
ADPR

SEQ ID NO: 1146482 - protein, 6 aa, Mycobacterium
ADPSGA

SEQ ID NO: 1146483 - protein, 7 aa, Mycobacterium
ADPSQQL

SEQ ID NO: 1146484 - protein, 18 aa, Mycobacterium
ADQRRTDTTTTLAPGATV

SEQ ID NO: 1146485 - protein, 6 aa, Mycobacterium
ADRAGR

SEQ ID NO: 1146486 - protein, 4 aa, Mycobacterium
ADTR

SEQ ID NO: 1146487 - protein, 10 aa, Mycobacterium
ADVPPRDAAE

SEQ ID NO: 1146488 - protein, 5 aa, Mycobacterium
ADWPD

SEQ ID NO: 1146489 - protein, 5 aa, Mycobacterium
ADYDQ

SEQ ID NO: 1146490 - protein, 8 aa, Mycobacterium
AEAAGSDR

SEQ ID NO: 1146491 - protein, 6 aa, Mycobacterium
AEAAGV

SEQ ID NO: 1146492 - protein, 5 aa, Mycobacterium
AEAAI

SEQ ID NO: 1146493 - protein, 5 aa, Mycobacterium
AEAGK

SEQ ID NO: 1146494 - protein, 6 aa, Mycobacterium
AEAGKQ

SEQ ID NO: 1146495 - protein, 6 aa, Mycobacterium
AEAGPN

SEQ ID NO: 1146496 - protein, 6 aa, Mycobacterium
AEAPED

SEQ ID NO: 1146497 - protein, 6 aa, Mycobacterium
AEAQAE

SEQ ID NO: 1146498 - protein, 4 aa, Mycobacterium
AEAS

SEQ ID NO: 1146499 - protein, 5 aa, Mycobacterium
AEDDD

SEQ ID NO: 1146500 - protein, 6 aa, Mycobacterium
AEDPRA

SEQ ID NO: 1146501 - protein, 7 aa, Mycobacterium
AEDPTKD

SEQ ID NO: 1146502 - protein, 8 aa, Mycobacterium
AEDSDPHV

SEQ ID NO: 1146503 - protein, 11 aa, Mycobacterium
AEEAPSGRTPV

SEQ ID NO: 1146504 - protein, 6 aa, Mycobacterium
AEEDKQ

SEQ ID NO: 1146505 - protein, 6 aa, Mycobacterium
AEEDPT

SEQ ID NO: 1146506 - protein, 6 aa, Mycobacterium
AEEPRL

SEQ ID NO: 1146507 - protein, 19 aa, Mycobacterium
AEEQASADASADRASQIRT

SEQ ID NO: 1146508 - protein, 16 aa, Mycobacterium
AEERGYTATKHQREVG

SEQ ID NO: 1146509 - protein, 6 aa, Mycobacterium
AEGADT

SEQ ID NO: 1146510 - protein, 9 aa, Mycobacterium
AEGDTGRVY

SEQ ID NO: 1146511 - protein, 10 aa, Mycobacterium
AEGGEPAAGR

SEQ ID NO: 1146512 - protein, 6 aa, Mycobacterium
AEHDEM

SEQ ID NO: 1146513 - protein, 6 aa, Mycobacterium
AEINGR

SEQ ID NO: 1146514 - protein, 4 aa, Mycobacterium
AEIP

SEQ ID NO: 1146515 - protein, 7 aa, Mycobacterium
AEKVDKT

SEQ ID NO: 1146516 - protein, 13 aa, Mycobacterium
AENAARKAQEHGV

SEQ ID NO: 1146517 - protein, 7 aa, Mycobacterium
AENGRSW

SEQ ID NO: 1146518 - protein, 9 aa, Mycobacterium
AENPPKKYQ

SEQ ID NO: 1146519 - protein, 4 aa, Mycobacterium
AEPA

SEQ ID NO: 1146520 - protein, 4 aa, Mycobacterium
AEPD

SEQ ID NO: 1146521 - protein, 9 aa, Mycobacterium
AEPDADAPH

SEQ ID NO: 1146522 - protein, 6 aa, Mycobacterium
AEPDAL

SEQ ID NO: 1146523 - protein, 4 aa, Mycobacterium
AEPG

SEQ ID NO: 1146524 - protein, 6 aa, Mycobacterium
AEPGDT

SEQ ID NO: 1146525 - protein, 6 aa, Mycobacterium
AEPGPY

SEQ ID NO: 1146526 - protein, 7 aa, Mycobacterium
AEPTREN

SEQ ID NO: 1146527 - protein, 17 aa, Mycobacterium
AEQAGQVETVKRSEAGM

SEQ ID NO: 1146528 - protein, 5 aa, Mycobacterium
AEQDG

SEQ ID NO: 1146529 - protein, 5 aa, Mycobacterium
AEQFA

SEQ ID NO: 1146530 - protein, 9 aa, Mycobacterium
AEQKGTGRW

SEQ ID NO: 1146531 - protein, 10 aa, Mycobacterium
AEQKHSIDDP

SEQ ID NO: 1146532 - protein, 5 aa, Mycobacterium
AEQLG

SEQ ID NO: 1146533 - protein, 7 aa, Mycobacterium
AEQPDGG

SEQ ID NO: 1146534 - protein, 6 aa, Mycobacterium
AEQVDP

SEQ ID NO: 1146535 - protein, 12 aa, Mycobacterium
AEQVPGERYEHG

SEQ ID NO: 1146536 - protein, 4 aa, Mycobacterium
AERA

SEQ ID NO: 1146537 - protein, 6 aa, Mycobacterium
AERDPQ

SEQ ID NO: 1146538 - protein, 20 aa, Mycobacterium
AERLPRGADPNTHTKLGRGG

SEQ ID NO: 1146539 - protein, 7 aa, Mycobacterium
AERNPEL

SEQ ID NO: 1146540 - protein, 6 aa, Mycobacterium
AERQEA

SEQ ID NO: 1146541 - protein, 11 aa, Mycobacterium
AERRANPTEDL

SEQ ID NO: 1146542 - protein, 5 aa, Mycobacterium
AERTR

SEQ ID NO: 1146543 - protein, 4 aa, Mycobacterium
AESA

SEQ ID NO: 1146544 - protein, 8 aa, Mycobacterium
AESDGTVT

SEQ ID NO: 1146545 - protein, 4 aa, Mycobacterium
AESE

SEQ ID NO: 1146546 - protein, 9 aa, Mycobacterium
AESGPDALE

SEQ ID NO: 1146547 - protein, 4 aa, Mycobacterium
AETA

SEQ ID NO: 1146548 - protein, 7 aa, Mycobacterium
AETAKEA

SEQ ID NO: 1146549 - protein, 4 aa, Mycobacterium
AETG

SEQ ID NO: 1146550 - protein, 8 aa, Mycobacterium
AETGDANG

SEQ ID NO: 1146551 - protein, 4 aa, Mycobacterium
AETT

SEQ ID NO: 1146552 - protein, 4 aa, Mycobacterium
AEVG

SEQ ID NO: 1146553 - protein, 5 aa, Mycobacterium
AEVGR

SEQ ID NO: 1146554 - protein, 12 aa, Mycobacterium
AEVRGDDAREAK

SEQ ID NO: 1146555 - protein, 10 aa, Mycobacterium
AFDGDQQVAG

SEQ ID NO: 1146556 - protein, 8 aa, Mycobacterium
AFGPTGPW

SEQ ID NO: 1146557 - protein, 5 aa, Mycobacterium
AGAAG

SEQ ID NO: 1146558 - protein, 9 aa, Mycobacterium
AGAASNNIE

SEQ ID NO: 1146559 - protein, 5 aa, Mycobacterium
AGADD

SEQ ID NO: 1146560 - protein, 8 aa, Mycobacterium
AGAGGTSW

SEQ ID NO: 1146561 - protein, 9 aa, Mycobacterium
AGAGKTETM

SEQ ID NO: 1146562 - protein, 8 aa, Mycobacterium
AGAGSGAL

SEQ ID NO: 1146563 - protein, 8 aa, Mycobacterium
AGAHARSA

SEQ ID NO: 1146564 - protein, 7 aa, Mycobacterium
AGANPLG

SEQ ID NO: 1146565 - protein, 14 aa, Mycobacterium
AGAPGRASANGTSM

SEQ ID NO: 1146566 - protein, 9 aa, Mycobacterium
AGAPPDEFN

SEQ ID NO: 1146567 - protein, 5 aa, Mycobacterium
AGATG

SEQ ID NO: 1146568 - protein, 11 aa, Mycobacterium
AGDADAVAERR

SEQ ID NO: 1146569 - protein, 7 aa, Mycobacterium
AGDARRA

SEQ ID NO: 1146570 - protein, 5 aa, Mycobacterium
AGDED

SEQ ID NO: 1146571 - protein, 7 aa, Mycobacterium
AGDGNTH

SEQ ID NO: 1146572 - protein, 6 aa, Mycobacterium
AGDNKF

SEQ ID NO: 1146573 - protein, 4 aa, Mycobacterium
AGDP

SEQ ID NO: 1146574 - protein, 5 aa, Mycobacterium
AGDRP

SEQ ID NO: 1146575 - protein, 9 aa, Mycobacterium
AGDSAGGNL

SEQ ID NO: 1146576 - protein, 6 aa, Mycobacterium
AGDSGV

SEQ ID NO: 1146577 - protein, 10 aa, Mycobacterium
AGEGESTTDL

SEQ ID NO: 1146578 - protein, 4 aa, Mycobacterium
AGEQ

SEQ ID NO: 1146579 - protein, 7 aa, Mycobacterium
AGERGTD

SEQ ID NO: 1146580 - protein, 10 aa, Mycobacterium
AGETPDEHRR

SEQ ID NO: 1146581 - protein, 9 aa, Mycobacterium
AGGDTASAL

SEQ ID NO: 1146582 - protein, 8 aa, Mycobacterium
AGGEGPAT

SEQ ID NO: 1146583 - protein, 7 aa, Mycobacterium
AGGGIGR

SEQ ID NO: 1146584 - protein, 8 aa, Mycobacterium
AGGGPDDV

SEQ ID NO: 1146585 - protein, 7 aa, Mycobacterium
AGGIGTS

SEQ ID NO: 1146586 - protein, 9 aa, Mycobacterium
AGGREAGKN

SEQ ID NO: 1146587 - protein, 4 aa, Mycobacterium
AGGT

SEQ ID NO: 1146588 - protein, 10 aa, Mycobacterium
AGGTSEITRN

SEQ ID NO: 1146589 - protein, 5 aa, Mycobacterium
AGGYA

SEQ ID NO: 1146590 - protein, 12 aa, Mycobacterium
AGHDTTKDAISG

SEQ ID NO: 1146591 - protein, 11 aa, Mycobacterium
AGHDTTSAAIS

SEQ ID NO: 1146592 - protein, 6 aa, Mycobacterium
AGHSRE

SEQ ID NO: 1146593 - protein, 5 aa, Mycobacterium
AGHTI

SEQ ID NO: 1146594 - protein, 10 aa, Mycobacterium
AGIQRAKRTR

SEQ ID NO: 1146595 - protein, 4 aa, Mycobacterium
AGIS

SEQ ID NO: 1146596 - protein, 10 aa, Mycobacterium
AGKPLASSNR

SEQ ID NO: 1146597 - protein, 8 aa, Mycobacterium
AGKTTTTE

SEQ ID NO: 1146598 - protein, 9 aa, Mycobacterium
AGLDGEKET

SEQ ID NO: 1146599 - protein, 6 aa, Mycobacterium
AGLGAS

SEQ ID NO: 1146600 - protein, 8 aa, Mycobacterium
AGLGGQTP

SEQ ID NO: 1146601 - protein, 4 aa, Mycobacterium
AGLS

SEQ ID NO: 1146602 - protein, 6 aa, Mycobacterium
AGLTDD

SEQ ID NO: 1146603 - protein, 6 aa, Mycobacterium
AGMQTS

SEQ ID NO: 1146604 - protein, 23 aa, Mycobacterium
AGMSTDSGIPDYRGPDSPPSNPM

SEQ ID NO: 1146605 - protein, 6 aa, Mycobacterium
AGNDAN

SEQ ID NO: 1146606 - protein, 11 aa, Mycobacterium
AGNDTTKQTTT

SEQ ID NO: 1146607 - protein, 5 aa, Mycobacterium
AGNGG

SEQ ID NO: 1146608 - protein, 12 aa, Mycobacterium
AGNMSKRQSATG

SEQ ID NO: 1146609 - protein, 9 aa, Mycobacterium
AGNPTGAMG

SEQ ID NO: 1146610 - protein, 8 aa, Mycobacterium
AGPAEPAT

SEQ ID NO: 1146611 - protein, 9 aa, Mycobacterium
AGPERATEA

SEQ ID NO: 1146612 - protein, 9 aa, Mycobacterium
AGPGAPIDT

SEQ ID NO: 1146613 - protein, 8 aa, Mycobacterium
AGPGTNGS

SEQ ID NO: 1146614 - protein, 5 aa, Mycobacterium
AGPHP

SEQ ID NO: 1146615 - protein, 10 aa, Mycobacterium
AGPIDKTENS

SEQ ID NO: 1146616 - protein, 7 aa, Mycobacterium
AGPSGLS

SEQ ID NO: 1146617 - protein, 9 aa, Mycobacterium
AGPTESLNA

SEQ ID NO: 1146618 - protein, 5 aa, Mycobacterium
AGPVA

SEQ ID NO: 1146619 - protein, 14 aa, Mycobacterium
AGQANPAPPVGPAL

SEQ ID NO: 1146620 - protein, 6 aa, Mycobacterium
AGQGQP

SEQ ID NO: 1146621 - protein, 4 aa, Mycobacterium
AGQM

SEQ ID NO: 1146622 - protein, 4 aa, Mycobacterium
AGRA

SEQ ID NO: 1146623 - protein, 6 aa, Mycobacterium
AGRDDT

SEQ ID NO: 1146624 - protein, 4 aa, Mycobacterium
AGRG

SEQ ID NO: 1146625 - protein, 9 aa, Mycobacterium
AGRPTRANF

SEQ ID NO: 1146626 - protein, 4 aa, Mycobacterium
AGRQ

SEQ ID NO: 1146627 - protein, 8 aa, Mycobacterium
AGRRGPQA

SEQ ID NO: 1146628 - protein, 11 aa, Mycobacterium
AGSENGSAKTV

SEQ ID NO: 1146629 - protein, 6 aa, Mycobacterium
AGSEVS

SEQ ID NO: 1146630 - protein, 7 aa, Mycobacterium
AGSGKTA

SEQ ID NO: 1146631 - protein, 12 aa, Mycobacterium
AGSKPIDLFGAP

SEQ ID NO: 1146632 - protein, 10 aa, Mycobacterium
AGSVDDGKST

SEQ ID NO: 1146633 - protein, 7 aa, Mycobacterium
AGSVSER

SEQ ID NO: 1146634 - protein, 8 aa, Mycobacterium
AGTAGQRC

SEQ ID NO: 1146635 - protein, 6 aa, Mycobacterium
AGTDGA

SEQ ID NO: 1146636 - protein, 6 aa, Mycobacterium
AGTGAR

SEQ ID NO: 1146637 - protein, 10 aa, Mycobacterium
AGTGGTSATI

SEQ ID NO: 1146638 - protein, 5 aa, Mycobacterium
AGTGI

SEQ ID NO: 1146639 - protein, 11 aa, Mycobacterium
AGTGIGSTTAR

SEQ ID NO: 1146640 - protein, 10 aa, Mycobacterium
AGTGKTRTIT

SEQ ID NO: 1146641 - protein, 9 aa, Mycobacterium
AGTGNDHAR

SEQ ID NO: 1146642 - protein, 8 aa, Mycobacterium
AGTGTGKS

SEQ ID NO: 1146643 - protein, 6 aa, Mycobacterium
AGTKGV

SEQ ID NO: 1146644 - protein, 5 aa, Mycobacterium
AGTNE

SEQ ID NO: 1146645 - protein, 5 aa, Mycobacterium
AGVAT

SEQ ID NO: 1146646 - protein, 5 aa, Mycobacterium
AGVGD

SEQ ID NO: 1146647 - protein, 6 aa, Mycobacterium
AGVGGR

SEQ ID NO: 1146648 - protein, 5 aa, Mycobacterium
AGVTP

SEQ ID NO: 1146649 - protein, 14 aa, Mycobacterium
AGWGRAENAAAARK

SEQ ID NO: 1146650 - protein, 15 aa, Mycobacterium
AHAPGTGTPEPGGIT

SEQ ID NO: 1146651 - protein, 12 aa, Mycobacterium
AHGAGSACGKNL

SEQ ID NO: 1146652 - protein, 7 aa, Mycobacterium
AHHTNAS

SEQ ID NO: 1146653 - protein, 13 aa, Mycobacterium
AHPELKSRPTRPH

SEQ ID NO: 1146654 - protein, 7 aa, Mycobacterium
AHPSLPR

SEQ ID NO: 1146655 - protein, 13 aa, Mycobacterium
AIAPTRPHPGVES

SEQ ID NO: 1146656 - protein, 6 aa, Mycobacterium
AIGRPR

SEQ ID NO: 1146657 - protein, 4 aa, Mycobacterium
AIND

SEQ ID NO: 1146658 - protein, 5 aa, Mycobacterium
AIPDD

SEQ ID NO: 1146659 - protein, 9 aa, Mycobacterium
AIPGELDDA

SEQ ID NO: 1146660 - protein, 14 aa, Mycobacterium
AIQTRRDDLDSRRT

SEQ ID NO: 1146661 - protein, 5 aa, Mycobacterium
AISRG

SEQ ID NO: 1146662 - protein, 5 aa, Mycobacterium
AKAAA

SEQ ID NO: 1146663 - protein, 9 aa, Mycobacterium
AKAAGDAGI

SEQ ID NO: 1146664 - protein, 6 aa, Mycobacterium
AKAAGI

SEQ ID NO: 1146665 - protein, 17 aa, Mycobacterium
AKAEGRDVDTAIMEASR

SEQ ID NO: 1146666 - protein, 17 aa, Mycobacterium
AKAERASGFDPRAGWAG

SEQ ID NO: 1146667 - protein, 4 aa, Mycobacterium
AKAG

SEQ ID NO: 1146668 - protein, 6 aa, Mycobacterium
AKAGAT

SEQ ID NO: 1146669 - protein, 8 aa, Mycobacterium
AKANTGDG

SEQ ID NO: 1146670 - protein, 7 aa, Mycobacterium
AKATRKL

SEQ ID NO: 1146671 - protein, 9 aa, Mycobacterium
AKDSRTTAE

SEQ ID NO: 1146672 - protein, 14 aa, Mycobacterium
AKDVGKRAERATAE

SEQ ID NO: 1146673 - protein, 9 aa, Mycobacterium
AKEAPGWTV

SEQ ID NO: 1146674 - protein, 6 aa, Mycobacterium
AKENDL

SEQ ID NO: 1146675 - protein, 6 aa, Mycobacterium
AKEQQL

SEQ ID NO: 1146676 - protein, 8 aa, Mycobacterium
AKGAGISR

SEQ ID NO: 1146677 - protein, 9 aa, Mycobacterium
AKGDLHGGG

SEQ ID NO: 1146678 - protein, 5 aa, Mycobacterium
AKGMR

SEQ ID NO: 1146679 - protein, 10 aa, Mycobacterium
AKGPGVNPFG

SEQ ID NO: 1146680 - protein, 11 aa, Mycobacterium
AKGSGDTSGYG

SEQ ID NO: 1146681 - protein, 7 aa, Mycobacterium
AKIGYPP

SEQ ID NO: 1146682 - protein, 16 aa, Mycobacterium
AKKTDDVAGDGTTTAT

SEQ ID NO: 1146683 - protein, 6 aa, Mycobacterium
AKLTNT

SEQ ID NO: 1146684 - protein, 6 aa, Mycobacterium
AKMPAD

SEQ ID NO: 1146685 - protein, 6 aa, Mycobacterium
AKNHPS

SEQ ID NO: 1146686 - protein, 9 aa, Mycobacterium
AKNRGGTPD

SEQ ID NO: 1146687 - protein, 15 aa, Mycobacterium
AKNTDTREHDIADSD

SEQ ID NO: 1146688 - protein, 9 aa, Mycobacterium
AKPAPRGHS

SEQ ID NO: 1146689 - protein, 18 aa, Mycobacterium
AKPGEPSWPTPWGRGRPG

SEQ ID NO: 1146690 - protein, 7 aa, Mycobacterium
AKQGTNI

SEQ ID NO: 1146691 - protein, 10 aa, Mycobacterium
AKQTAKTGAT

SEQ ID NO: 1146692 - protein, 7 aa, Mycobacterium
AKRFARD

SEQ ID NO: 1146693 - protein, 6 aa, Mycobacterium
AKRGAQ

SEQ ID NO: 1146694 - protein, 8 aa, Mycobacterium
AKRGGGAI

SEQ ID NO: 1146695 - protein, 10 aa, Mycobacterium
AKSDPALASP

SEQ ID NO: 1146696 - protein, 11 aa, Mycobacterium
AKTEHLGDRSP

SEQ ID NO: 1146697 - protein, 14 aa, Mycobacterium
AKTGGEVGVTTGRA

SEQ ID NO: 1146698 - protein, 4 aa, Mycobacterium
ALER

SEQ ID NO: 1146699 - protein, 14 aa, Mycobacterium
ALERGRTTKEKSDA

SEQ ID NO: 1146700 - protein, 4 aa, Mycobacterium
ALES

SEQ ID NO: 1146701 - protein, 7 aa, Mycobacterium
ALGGGAE

SEQ ID NO: 1146702 - protein, 5 aa, Mycobacterium
ALGGT

SEQ ID NO: 1146703 - protein, 13 aa, Mycobacterium
ALGPGGLSRERAG

SEQ ID NO: 1146704 - protein, 5 aa, Mycobacterium
ALKEH

SEQ ID NO: 1146705 - protein, 6 aa, Mycobacterium
ALKETS

SEQ ID NO: 1146706 - protein, 13 aa, Mycobacterium
ALPEDVNAPSGEA

SEQ ID NO: 1146707 - protein, 4 aa, Mycobacterium
ALPG

SEQ ID NO: 1146708 - protein, 8 aa, Mycobacterium
ALPRDGEK

SEQ ID NO: 1146709 - protein, 7 aa, Mycobacterium
ALPRGGV

SEQ ID NO: 1146710 - protein, 6 aa, Mycobacterium
ALRDGD

SEQ ID NO: 1146711 - protein, 7 aa, Mycobacterium
ALRPEDL

SEQ ID NO: 1146712 - protein, 7 aa, Mycobacterium
ALRPGDT

SEQ ID NO: 1146713 - protein, 7 aa, Mycobacterium
ALSEPAW

SEQ ID NO: 1146714 - protein, 4 aa, Mycobacterium
ALSG

SEQ ID NO: 1146715 - protein, 9 aa, Mycobacterium
ALSHRGDDA

SEQ ID NO: 1146716 - protein, 5 aa, Mycobacterium
ALTEA

SEQ ID NO: 1146717 - protein, 18 aa, Mycobacterium
AMAGATGKAYGGAGGTLG

SEQ ID NO: 1146718 - protein, 5 aa, Mycobacterium
AMENA

SEQ ID NO: 1146719 - protein, 6 aa, Mycobacterium
AMPDQG

SEQ ID NO: 1146720 - protein, 9 aa, Mycobacterium
AMRTSGDDI

SEQ ID NO: 1146721 - protein, 5 aa, Mycobacterium
AMSAE

SEQ ID NO: 1146722 - protein, 8 aa, Mycobacterium
ANAALNPT

SEQ ID NO: 1146723 - protein, 4 aa, Mycobacterium
ANAG

SEQ ID NO: 1146724 - protein, 6 aa, Mycobacterium
ANARPG

SEQ ID NO: 1146725 - protein, 9 aa, Mycobacterium
ANDGGGSIR

SEQ ID NO: 1146726 - protein, 7 aa, Mycobacterium
ANEAVEQ

SEQ ID NO: 1146727 - protein, 4 aa, Mycobacterium
ANER

SEQ ID NO: 1146728 - protein, 7 aa, Mycobacterium
ANESGVE

SEQ ID NO: 1146729 - protein, 7 aa, Mycobacterium
ANEVGAA

SEQ ID NO: 1146730 - protein, 5 aa, Mycobacterium
ANGDK

SEQ ID NO: 1146731 - protein, 8 aa, Mycobacterium
ANGLGGTG

SEQ ID NO: 1146732 - protein, 9 aa, Mycobacterium
ANGSSPAVE

SEQ ID NO: 1146733 - protein, 7 aa, Mycobacterium
ANKVPGA

SEQ ID NO: 1146734 - protein, 5 aa, Mycobacterium
ANLET

SEQ ID NO: 1146735 - protein, 13 aa, Mycobacterium
ANLTRNTADFGGS

SEQ ID NO: 1146736 - protein, 6 aa, Mycobacterium
ANNRVR

SEQ ID NO: 1146737 - protein, 7 aa, Mycobacterium
ANPDMEA

SEQ ID NO: 1146738 - protein, 9 aa, Mycobacterium
ANPEDYTNR

SEQ ID NO: 1146739 - protein, 8 aa, Mycobacterium
ANPGTITG

SEQ ID NO: 1146740 - protein, 5 aa, Mycobacterium
ANPQA

SEQ ID NO: 1146741 - protein, 7 aa, Mycobacterium
ANPTGPI

SEQ ID NO: 1146742 - protein, 18 aa, Mycobacterium
ANQADKYPAQLSGGQQQR

SEQ ID NO: 1146743 - protein, 5 aa, Mycobacterium
ANQGE

SEQ ID NO: 1146744 - protein, 6 aa, Mycobacterium
ANQLPD

SEQ ID NO: 1146745 - protein, 7 aa, Mycobacterium
ANRDPKV

SEQ ID NO: 1146746 - protein, 9 aa, Mycobacterium
ANRDPRAFD

SEQ ID NO: 1146747 - protein, 8 aa, Mycobacterium
ANRNAAGQ

SEQ ID NO: 1146748 - protein, 7 aa, Mycobacterium
ANSAGQA

SEQ ID NO: 1146749 - protein, 6 aa, Mycobacterium
ANSAYH

SEQ ID NO: 1146750 - protein, 4 aa, Mycobacterium
ANSP

SEQ ID NO: 1146751 - protein, 4 aa, Mycobacterium
ANTA

SEQ ID NO: 1146752 - protein, 14 aa, Mycobacterium
ANTLEATQTQIGTR

SEQ ID NO: 1146753 - protein, 5 aa, Mycobacterium
ANYGA

SEQ ID NO: 1146754 - protein, 8 aa, Mycobacterium
APAAAAAT

SEQ ID NO: 1146755 - protein, 5 aa, Mycobacterium
APAAV

SEQ ID NO: 1146756 - protein, 5 aa, Mycobacterium
APAKV

SEQ ID NO: 1146757 - protein, 9 aa, Mycobacterium
APALSEKDI

SEQ ID NO: 1146758 - protein, 6 aa, Mycobacterium
APAQGA

SEQ ID NO: 1146759 - protein, 7 aa, Mycobacterium
APASDED

SEQ ID NO: 1146760 - protein, 4 aa, Mycobacterium
APAT

SEQ ID NO: 1146761 - protein, 5 aa, Mycobacterium
APDDV

SEQ ID NO: 1146762 - protein, 11 aa, Mycobacterium
APDGREDAGSK

SEQ ID NO: 1146763 - protein, 6 aa, Mycobacterium
APDHPE

SEQ ID NO: 1146764 - protein, 4 aa, Mycobacterium
APDS

SEQ ID NO: 1146765 - protein, 7 aa, Mycobacterium
APDTGNA

SEQ ID NO: 1146766 - protein, 8 aa, Mycobacterium
APDTPEIA

SEQ ID NO: 1146767 - protein, 6 aa, Mycobacterium
APEHTR

SEQ ID NO: 1146768 - protein, 4 aa, Mycobacterium
APEL

SEQ ID NO: 1146769 - protein, 5 aa, Mycobacterium
APFQP

SEQ ID NO: 1146770 - protein, 4 aa, Mycobacterium
APFT

SEQ ID NO: 1146771 - protein, 7 aa, Mycobacterium
APGAALT

SEQ ID NO: 1146772 - protein, 6 aa, Mycobacterium
APGEPF

SEQ ID NO: 1146773 - protein, 7 aa, Mycobacterium
APGFGDR

SEQ ID NO: 1146774 - protein, 17 aa, Mycobacterium
APGPIDTEANRTTTPQE

SEQ ID NO: 1146775 - protein, 7 aa, Mycobacterium
APGPQEW

SEQ ID NO: 1146776 - protein, 11 aa, Mycobacterium
APGQVGSSAMP

SEQ ID NO: 1146777 - protein, 6 aa, Mycobacterium
APGSAD

SEQ ID NO: 1146778 - protein, 6 aa, Mycobacterium
APGSLQ

SEQ ID NO: 1146779 - protein, 8 aa, Mycobacterium
APGSRPAA

SEQ ID NO: 1146780 - protein, 7 aa, Mycobacterium
APGVGKS

SEQ ID NO: 1146781 - protein, 5 aa, Mycobacterium
APHEN

SEQ ID NO: 1146782 - protein, 7 aa, Mycobacterium
APIQGSA

SEQ ID NO: 1146783 - protein, 10 aa, Mycobacterium
APKGSGTDVT

SEQ ID NO: 1146784 - protein, 7 aa, Mycobacterium
APKPMLP

SEQ ID NO: 1146785 - protein, 10 aa, Mycobacterium
APKSAGAEAY

SEQ ID NO: 1146786 - protein, 8 aa, Mycobacterium
APKSALGH

SEQ ID NO: 1146787 - protein, 5 aa, Mycobacterium
APLNR

SEQ ID NO: 1146788 - protein, 4 aa, Mycobacterium
APNS

SEQ ID NO: 1146789 - protein, 8 aa, Mycobacterium
APNTGGES

SEQ ID NO: 1146790 - protein, 6 aa, Mycobacterium
APNTGN

SEQ ID NO: 1146791 - protein, 7 aa, Mycobacterium
APPAAKT

SEQ ID NO: 1146792 - protein, 4 aa, Mycobacterium
APPD

SEQ ID NO: 1146793 - protein, 6 aa, Mycobacterium
APPDAR

SEQ ID NO: 1146794 - protein, 5 aa, Mycobacterium
APPDL

SEQ ID NO: 1146795 - protein, 10 aa, Mycobacterium
APPGPSTSDI

SEQ ID NO: 1146796 - protein, 8 aa, Mycobacterium
APPGSFNN

SEQ ID NO: 1146797 - protein, 10 aa, Mycobacterium
APPGTPTGTA

SEQ ID NO: 1146798 - protein, 8 aa, Mycobacterium
APPGTVGS

SEQ ID NO: 1146799 - protein, 6 aa, Mycobacterium
APPGYV

SEQ ID NO: 1146800 - protein, 6 aa, Mycobacterium
APPHGG

SEQ ID NO: 1146801 - protein, 8 aa, Mycobacterium
APRDGARL

SEQ ID NO: 1146802 - protein, 4 aa, Mycobacterium
APRS

SEQ ID NO: 1146803 - protein, 7 aa, Mycobacterium
APRSPSD

SEQ ID NO: 1146804 - protein, 4 aa, Mycobacterium
APSF

SEQ ID NO: 1146805 - protein, 5 aa, Mycobacterium
APSKR

SEQ ID NO: 1146806 - protein, 6 aa, Mycobacterium
APSPSS

SEQ ID NO: 1146807 - protein, 7 aa, Mycobacterium
APSSPIA

SEQ ID NO: 1146808 - protein, 4 aa, Mycobacterium
APTD

SEQ ID NO: 1146809 - protein, 5 aa, Mycobacterium
APTQA

SEQ ID NO: 1146810 - protein, 7 aa, Mycobacterium
APTRRQA

SEQ ID NO: 1146811 - protein, 8 aa, Mycobacterium
APVPELRS

SEQ ID NO: 1146812 - protein, 8 aa, Mycobacterium
APYETTNR

SEQ ID NO: 1146813 - protein, 6 aa, Mycobacterium
AQAAGG

SEQ ID NO: 1146814 - protein, 6 aa, Mycobacterium
AQAANT

SEQ ID NO: 1146815 - protein, 8 aa, Mycobacterium
AQAESEGL

SEQ ID NO: 1146816 - protein, 6 aa, Mycobacterium
AQAKDA

SEQ ID NO: 1146817 - protein, 5 aa, Mycobacterium
AQAMG

SEQ ID NO: 1146818 - protein, 4 aa, Mycobacterium
AQAR

SEQ ID NO: 1146819 - protein, 7 aa, Mycobacterium
AQAYSSA

SEQ ID NO: 1146820 - protein, 14 aa, Mycobacterium
AQDISDTDLAGRYE

SEQ ID NO: 1146821 - protein, 5 aa, Mycobacterium
AQDTR

SEQ ID NO: 1146822 - protein, 7 aa, Mycobacterium
AQEAGRD

SEQ ID NO: 1146823 - protein, 5 aa, Mycobacterium
AQETP

SEQ ID NO: 1146824 - protein, 5 aa, Mycobacterium
AQHRG

SEQ ID NO: 1146825 - protein, 18 aa, Mycobacterium
AQKEQGRYGAATTTEESQ

SEQ ID NO: 1146826 - protein, 4 aa, Mycobacterium
AQNG

SEQ ID NO: 1146827 - protein, 4 aa, Mycobacterium
AQNH

SEQ ID NO: 1146828 - protein, 10 aa, Mycobacterium
AQPGTGDAGG

SEQ ID NO: 1146829 - protein, 6 aa, Mycobacterium
AQPQYV

SEQ ID NO: 1146830 - protein, 6 aa, Mycobacterium
AQPTEP

SEQ ID NO: 1146831 - protein, 6 aa, Mycobacterium
AQRDGA

SEQ ID NO: 1146832 - protein, 4 aa, Mycobacterium
AQRG

SEQ ID NO: 1146833 - protein, 4 aa, Mycobacterium
AQRK

SEQ ID NO: 1146834 - protein, 12 aa, Mycobacterium
AQRQATKEAGQI

SEQ ID NO: 1146835 - protein, 7 aa, Mycobacterium
AQRQKNK

SEQ ID NO: 1146836 - protein, 9 aa, Mycobacterium
AQSTDKRVN

SEQ ID NO: 1146837 - protein, 6 aa, Mycobacterium
AQTAGV

SEQ ID NO: 1146838 - protein, 6 aa, Mycobacterium
AQTDPE

SEQ ID NO: 1146839 - protein, 4 aa, Mycobacterium
AQTF

SEQ ID NO: 1146840 - protein, 9 aa, Mycobacterium
AQTGTGKTA

SEQ ID NO: 1146841 - protein, 6 aa, Mycobacterium
AQVGGA

SEQ ID NO: 1146842 - protein, 4 aa, Mycobacterium
AQWN

SEQ ID NO: 1146843 - protein, 9 aa, Mycobacterium
ARAERGEGN

SEQ ID NO: 1146844 - protein, 4 aa, Mycobacterium
ARAG

SEQ ID NO: 1146845 - protein, 6 aa, Mycobacterium
ARAGAS

SEQ ID NO: 1146846 - protein, 5 aa, Mycobacterium
ARAGE

SEQ ID NO: 1146847 - protein, 10 aa, Mycobacterium
ARAKATVGEI

SEQ ID NO: 1146848 - protein, 4 aa, Mycobacterium
ARAP

SEQ ID NO: 1146849 - protein, 6 aa, Mycobacterium
ARAQRA

SEQ ID NO: 1146850 - protein, 17 aa, Mycobacterium
ARARSGDLKPDELSGGT

SEQ ID NO: 1146851 - protein, 5 aa, Mycobacterium
ARASE

SEQ ID NO: 1146852 - protein, 4 aa, Mycobacterium
ARDA

SEQ ID NO: 1146853 - protein, 5 aa, Mycobacterium
ARDAT

SEQ ID NO: 1146854 - protein, 7 aa, Mycobacterium
ARDPATG

SEQ ID NO: 1146855 - protein, 15 aa, Mycobacterium
ARDRAKAAGAENIEE

SEQ ID NO: 1146856 - protein, 5 aa, Mycobacterium
ARERG

SEQ ID NO: 1146857 - protein, 7 aa, Mycobacterium
AREVRDT

SEQ ID NO: 1146858 - protein, 8 aa, Mycobacterium
ARGKSGRL

SEQ ID NO: 1146859 - protein, 10 aa, Mycobacterium
ARGTKYPDEV

SEQ ID NO: 1146860 - protein, 4 aa, Mycobacterium
ARGV

SEQ ID NO: 1146861 - protein, 11 aa, Mycobacterium
ARGYKDVRANT

SEQ ID NO: 1146862 - protein, 20 aa, Mycobacterium
ARHGGGAFSGKDPSKVDRSA

SEQ ID NO: 1146863 - protein, 6 aa, Mycobacterium
ARHGGS

SEQ ID NO: 1146864 - protein, 6 aa, Mycobacterium
ARHSSG

SEQ ID NO: 1146865 - protein, 5 aa, Mycobacterium
ARITE

SEQ ID NO: 1146866 - protein, 9 aa, Mycobacterium
ARITTDEEI

SEQ ID NO: 1146867 - protein, 5 aa, Mycobacterium
ARLAE

SEQ ID NO: 1146868 - protein, 7 aa, Mycobacterium
ARPDPST

SEQ ID NO: 1146869 - protein, 10 aa, Mycobacterium
ARPDPSYDPN

SEQ ID NO: 1146870 - protein, 13 aa, Mycobacterium
ARPITERKEAAVI

SEQ ID NO: 1146871 - protein, 4 aa, Mycobacterium
ARPV

SEQ ID NO: 1146872 - protein, 5 aa, Mycobacterium
ARQLP

SEQ ID NO: 1146873 - protein, 4 aa, Mycobacterium
ARQR

SEQ ID NO: 1146874 - protein, 7 aa, Mycobacterium
ARQTPQQ

SEQ ID NO: 1146875 - protein, 6 aa, Mycobacterium
ARRAGV

SEQ ID NO: 1146876 - protein, 12 aa, Mycobacterium
ARRAGWKANNKR

SEQ ID NO: 1146877 - protein, 4 aa, Mycobacterium
ARRD

SEQ ID NO: 1146878 - protein, 8 aa, Mycobacterium
ARRDDEAR

SEQ ID NO: 1146879 - protein, 9 aa, Mycobacterium
ARRDQVRAT

SEQ ID NO: 1146880 - protein, 6 aa, Mycobacterium
ARREKT

SEQ ID NO: 1146881 - protein, 8 aa, Mycobacterium
ARRERGDL

SEQ ID NO: 1146882 - protein, 11 aa, Mycobacterium
ARRGSVTDLSP

SEQ ID NO: 1146883 - protein, 14 aa, Mycobacterium
ARRKAPADQSVDTD

SEQ ID NO: 1146884 - protein, 9 aa, Mycobacterium
ARRSGASWT

SEQ ID NO: 1146885 - protein, 9 aa, Mycobacterium
ARSAPAASS

SEQ ID NO: 1146886 - protein, 5 aa, Mycobacterium
ARSKS

SEQ ID NO: 1146887 - protein, 4 aa, Mycobacterium
ARSR

SEQ ID NO: 1146888 - protein, 8 aa, Mycobacterium
ARSRESAK

SEQ ID NO: 1146889 - protein, 6 aa, Mycobacterium
ARSSEV

SEQ ID NO: 1146890 - protein, 6 aa, Mycobacterium
ARSTGI

SEQ ID NO: 1146891 - protein, 4 aa, Mycobacterium
ARTD

SEQ ID NO: 1146892 - protein, 5 aa, Mycobacterium
ARTDA

SEQ ID NO: 1146893 - protein, 8 aa, Mycobacterium
ARTDGGGH

SEQ ID NO: 1146894 - protein, 5 aa, Mycobacterium
ARTDP

SEQ ID NO: 1146895 - protein, 14 aa, Mycobacterium
ARTKETDLSVPTRR

SEQ ID NO: 1146896 - protein, 8 aa, Mycobacterium
ARTPEETA

SEQ ID NO: 1146897 - protein, 7 aa, Mycobacterium
ARTPEWQ

SEQ ID NO: 1146898 - protein, 6 aa, Mycobacterium
ARTPTA

SEQ ID NO: 1146899 - protein, 12 aa, Mycobacterium
ARTSGSIEAREM

SEQ ID NO: 1146900 - protein, 8 aa, Mycobacterium
ARTTESQV

SEQ ID NO: 1146901 - protein, 6 aa, Mycobacterium
ASAASI

SEQ ID NO: 1146902 - protein, 9 aa, Mycobacterium
ASADLERQV

SEQ ID NO: 1146903 - protein, 8 aa, Mycobacterium
ASAGTGKT

SEQ ID NO: 1146904 - protein, 8 aa, Mycobacterium
ASAPSYRF

SEQ ID NO: 1146905 - protein, 9 aa, Mycobacterium
ASARETAAR

SEQ ID NO: 1146906 - protein, 7 aa, Mycobacterium
ASARSGS

SEQ ID NO: 1146907 - protein, 4 aa, Mycobacterium
ASAS

SEQ ID NO: 1146908 - protein, 8 aa, Mycobacterium
ASASKHTR

SEQ ID NO: 1146909 - protein, 7 aa, Mycobacterium
ASATNLP

SEQ ID NO: 1146910 - protein, 8 aa, Mycobacterium
ASATRRGL

SEQ ID NO: 1146911 - protein, 8 aa, Mycobacterium
ASDAAQQL

SEQ ID NO: 1146912 - protein, 7 aa, Mycobacterium
ASDGTRV

SEQ ID NO: 1146913 - protein, 7 aa, Mycobacterium
ASDRPNR

SEQ ID NO: 1146914 - protein, 7 aa, Mycobacterium
ASDSPHG

SEQ ID NO: 1146915 - protein, 6 aa, Mycobacterium
ASEKAA

SEQ ID NO: 1146916 - protein, 7 aa, Mycobacterium
ASERPGH

SEQ ID NO: 1146917 - protein, 6 aa, Mycobacterium
ASFTAK

SEQ ID NO: 1146918 - protein, 7 aa, Mycobacterium
ASGAAQQ

SEQ ID NO: 1146919 - protein, 10 aa, Mycobacterium
ASGDDPASDW

SEQ ID NO: 1146920 - protein, 7 aa, Mycobacterium
ASGDHNP

SEQ ID NO: 1146921 - protein, 5 aa, Mycobacterium
ASGGE

SEQ ID NO: 1146922 - protein, 8 aa, Mycobacterium
ASGGSVGY

SEQ ID NO: 1146923 - protein, 5 aa, Mycobacterium
ASGGV

SEQ ID NO: 1146924 - protein, 7 aa, Mycobacterium
ASGIGRA

SEQ ID NO: 1146925 - protein, 6 aa, Mycobacterium
ASGIGT

SEQ ID NO: 1146926 - protein, 5 aa, Mycobacterium
ASGNN

SEQ ID NO: 1146927 - protein, 4 aa, Mycobacterium
ASGR

SEQ ID NO: 1146928 - protein, 6 aa, Mycobacterium
ASGRPV

SEQ ID NO: 1146929 - protein, 6 aa, Mycobacterium
ASGTPI

SEQ ID NO: 1146930 - protein, 6 aa, Mycobacterium
ASHGTP

SEQ ID NO: 1146931 - protein, 8 aa, Mycobacterium
ASKGGYEA

SEQ ID NO: 1146932 - protein, 15 aa, Mycobacterium
ASKSTAVRYERGRPG

SEQ ID NO: 1146933 - protein, 9 aa, Mycobacterium
ASLEKGPRL

SEQ ID NO: 1146934 - protein, 13 aa, Mycobacterium
ASLNEATSDSDGY

SEQ ID NO: 1146935 - protein, 4 aa, Mycobacterium
ASLP

SEQ ID NO: 1146936 - protein, 5 aa, Mycobacterium
ASLPA

SEQ ID NO: 1146937 - protein, 7 aa, Mycobacterium
ASLRPRS

SEQ ID NO: 1146938 - protein, 5 aa, Mycobacterium
ASLSD

SEQ ID NO: 1146939 - protein, 7 aa, Mycobacterium
ASLSTGA

SEQ ID NO: 1146940 - protein, 6 aa, Mycobacterium
ASNPRF

SEQ ID NO: 1146941 - protein, 7 aa, Mycobacterium
ASNTSSI

SEQ ID NO: 1146942 - protein, 5 aa, Mycobacterium
ASPAL

SEQ ID NO: 1146943 - protein, 10 aa, Mycobacterium
ASPDSTDNRP

SEQ ID NO: 1146944 - protein, 15 aa, Mycobacterium
ASPGGTGAAKFGGNY

SEQ ID NO: 1146945 - protein, 5 aa, Mycobacterium
ASPGI

SEQ ID NO: 1146946 - protein, 5 aa, Mycobacterium
ASPGY

SEQ ID NO: 1146947 - protein, 5 aa, Mycobacterium
ASPID

SEQ ID NO: 1146948 - protein, 6 aa, Mycobacterium
ASPRAS

SEQ ID NO: 1146949 - protein, 12 aa, Mycobacterium
ASPSSGGTRMQE

SEQ ID NO: 1146950 - protein, 20 aa, Mycobacterium
ASQRESMGNTSFADAFGANT

SEQ ID NO: 1146951 - protein, 4 aa, Mycobacterium
ASRD

SEQ ID NO: 1146952 - protein, 6 aa, Mycobacterium
ASRDGL

SEQ ID NO: 1146953 - protein, 7 aa, Mycobacterium
ASRETVN

SEQ ID NO: 1146954 - protein, 7 aa, Mycobacterium
ASRPTFQ

SEQ ID NO: 1146955 - protein, 7 aa, Mycobacterium
ASRPWAT

SEQ ID NO: 1146956 - protein, 7 aa, Mycobacterium
ASRQHPQ

SEQ ID NO: 1146957 - protein, 4 aa, Mycobacterium
ASRR

SEQ ID NO: 1146958 - protein, 8 aa, Mycobacterium
ASRVGAPL

SEQ ID NO: 1146959 - protein, 9 aa, Mycobacterium
ASSEAHGST

SEQ ID NO: 1146960 - protein, 7 aa, Mycobacterium
ASSGIGA

SEQ ID NO: 1146961 - protein, 10 aa, Mycobacterium
ASSGPGVEPL

SEQ ID NO: 1146962 - protein, 7 aa, Mycobacterium
ASSSRDV

SEQ ID NO: 1146963 - protein, 6 aa, Mycobacterium
ASSVDE

SEQ ID NO: 1146964 - protein, 11 aa, Mycobacterium
ASTAPEDKAWT

SEQ ID NO: 1146965 - protein, 8 aa, Mycobacterium
ASTPGCTK

SEQ ID NO: 1146966 - protein, 12 aa, Mycobacterium
ASVTQGMETGET

SEQ ID NO: 1146967 - protein, 13 aa, Mycobacterium
ASYGAEYQHESTS

SEQ ID NO: 1146968 - protein, 7 aa, Mycobacterium
ATAAAQA

SEQ ID NO: 1146969 - protein, 5 aa, Mycobacterium
ATAAK

SEQ ID NO: 1146970 - protein, 6 aa, Mycobacterium
ATADTE

SEQ ID NO: 1146971 - protein, 7 aa, Mycobacterium
ATAEDAV

SEQ ID NO: 1146972 - protein, 5 aa, Mycobacterium
ATAER

SEQ ID NO: 1146973 - protein, 6 aa, Mycobacterium
ATAETF

SEQ ID NO: 1146974 - protein, 11 aa, Mycobacterium
ATAKQRLTDSV

SEQ ID NO: 1146975 - protein, 5 aa, Mycobacterium
ATAPA

SEQ ID NO: 1146976 - protein, 7 aa, Mycobacterium
ATAPPAA

SEQ ID NO: 1146977 - protein, 6 aa, Mycobacterium
ATARPP

SEQ ID NO: 1146978 - protein, 6 aa, Mycobacterium
ATARRP

SEQ ID NO: 1146979 - protein, 10 aa, Mycobacterium
ATASRTPPGL

SEQ ID NO: 1146980 - protein, 5 aa, Mycobacterium
ATATG

SEQ ID NO: 1146981 - protein, 14 aa, Mycobacterium
ATATPIGDTAEANA

SEQ ID NO: 1146982 - protein, 9 aa, Mycobacterium
ATDARRHVR

SEQ ID NO: 1146983 - protein, 8 aa, Mycobacterium
ATDGRTAA

SEQ ID NO: 1146984 - protein, 14 aa, Mycobacterium
ATDPLRSSARNRAD

SEQ ID NO: 1146985 - protein, 10 aa, Mycobacterium
ATDPPPGKER

SEQ ID NO: 1146986 - protein, 6 aa, Mycobacterium
ATDSVG

SEQ ID NO: 1146987 - protein, 5 aa, Mycobacterium
ATEDR

SEQ ID NO: 1146988 - protein, 8 aa, Mycobacterium
ATELAGSV

SEQ ID NO: 1146989 - protein, 7 aa, Mycobacterium
ATEQPAS

SEQ ID NO: 1146990 - protein, 5 aa, Mycobacterium
ATETL

SEQ ID NO: 1146991 - protein, 7 aa, Mycobacterium
ATEYGSP

SEQ ID NO: 1146992 - protein, 4 aa, Mycobacterium
ATGA

SEQ ID NO: 1146993 - protein, 11 aa, Mycobacterium
ATGEGKTLSGA

SEQ ID NO: 1146994 - protein, 7 aa, Mycobacterium
ATGKPGR

SEQ ID NO: 1146995 - protein, 6 aa, Mycobacterium
ATGREP

SEQ ID NO: 1146996 - protein, 10 aa, Mycobacterium
ATGTGKSATT

SEQ ID NO: 1146997 - protein, 5 aa, Mycobacterium
ATHGS

SEQ ID NO: 1146998 - protein, 8 aa, Mycobacterium
ATKDSDGR

SEQ ID NO: 1146999 - protein, 16 aa, Mycobacterium
ATKTNDVAGDGTTTAT

SEQ ID NO: 1147000 - protein, 11 aa, Mycobacterium
ATLEDPVGGGE

SEQ ID NO: 1147001 - protein, 5 aa, Mycobacterium
ATLGN

SEQ ID NO: 1147002 - protein, 4 aa, Mycobacterium
ATPA

SEQ ID NO: 1147003 - protein, 6 aa, Mycobacterium
ATPAVE

SEQ ID NO: 1147004 - protein, 6 aa, Mycobacterium
ATPDQM

SEQ ID NO: 1147005 - protein, 12 aa, Mycobacterium
ATPPPVRGGKQP

SEQ ID NO: 1147006 - protein, 9 aa, Mycobacterium
ATQGHTQSL

SEQ ID NO: 1147007 - protein, 10 aa, Mycobacterium
ATQPNYPAEI

SEQ ID NO: 1147008 - protein, 9 aa, Mycobacterium
ATRAEPDRV

SEQ ID NO: 1147009 - protein, 5 aa, Mycobacterium
ATRAL

SEQ ID NO: 1147010 - protein, 4 aa, Mycobacterium
ATRE

SEQ ID NO: 1147011 - protein, 11 aa, Mycobacterium
ATREPEKFGMP

SEQ ID NO: 1147012 - protein, 5 aa, Mycobacterium
ATRER

SEQ ID NO: 1147013 - protein, 4 aa, Mycobacterium
ATRR

SEQ ID NO: 1147014 - protein, 7 aa, Mycobacterium
ATRTPTI

SEQ ID NO: 1147015 - protein, 4 aa, Mycobacterium
ATSA

SEQ ID NO: 1147016 - protein, 6 aa, Mycobacterium
ATSAST

SEQ ID NO: 1147017 - protein, 4 aa, Mycobacterium
ATSD

SEQ ID NO: 1147018 - protein, 10 aa, Mycobacterium
ATSREGKAQV

SEQ ID NO: 1147019 - protein, 9 aa, Mycobacterium
ATSRPSPLS

SEQ ID NO: 1147020 - protein, 6 aa, Mycobacterium
ATSSQA

SEQ ID NO: 1147021 - protein, 7 aa, Mycobacterium
ATTRNGR

SEQ ID NO: 1147022 - protein, 9 aa, Mycobacterium
ATVKGGTYY

SEQ ID NO: 1147023 - protein, 5 aa, Mycobacterium
ATYDG

SEQ ID NO: 1147024 - protein, 5 aa, Mycobacterium
AVEGR

SEQ ID NO: 1147025 - protein, 5 aa, Mycobacterium
AVGEG

SEQ ID NO: 1147026 - protein, 4 aa, Mycobacterium
AVGG

SEQ ID NO: 1147027 - protein, 9 aa, Mycobacterium
AVGKSTTAR

SEQ ID NO: 1147028 - protein, 4 aa, Mycobacterium
AVGT

SEQ ID NO: 1147029 - protein, 13 aa, Mycobacterium
AVNPQGAAGNGVA

SEQ ID NO: 1147030 - protein, 4 aa, Mycobacterium
AVPH

SEQ ID NO: 1147031 - protein, 7 aa, Mycobacterium
AVPPTGS

SEQ ID NO: 1147032 - protein, 17 aa, Mycobacterium
AVPQAAGRGLGHTGGTL

SEQ ID NO: 1147033 - protein, 6 aa, Mycobacterium
AVRDGD

SEQ ID NO: 1147034 - protein, 5 aa, Mycobacterium
AVRPS

SEQ ID NO: 1147035 - protein, 11 aa, Mycobacterium
AVRQGDPLDTE

SEQ ID NO: 1147036 - protein, 6 aa, Mycobacterium
AVSEPV

SEQ ID NO: 1147037 - protein, 10 aa, Mycobacterium
AVSSGDNSNI

SEQ ID NO: 1147038 - protein, 5 aa, Mycobacterium
AYAPY

SEQ ID NO: 1147039 - protein, 10 aa, Mycobacterium
AYDDTGGDGP

SEQ ID NO: 1147040 - protein, 5 aa, Mycobacterium
AYEPG

SEQ ID NO: 1147041 - protein, 11 aa, Mycobacterium
AYGAQKAGVDK

SEQ ID NO: 1147042 - protein, 8 aa, Mycobacterium
AYGKNGAD

SEQ ID NO: 1147043 - protein, 9 aa, Mycobacterium
AYGREGEPC

SEQ ID NO: 1147044 - protein, 16 aa, Mycobacterium
AYNGPNTVLSGPGEDL

SEQ ID NO: 1147045 - protein, 9 aa, Mycobacterium
AYPENPTER

SEQ ID NO: 1147046 - protein, 9 aa, Mycobacterium
AYPGGFDKS

SEQ ID NO: 1147047 - protein, 7 aa, Mycobacterium
AYPSTLG

SEQ ID NO: 1147048 - protein, 7 aa, Mycobacterium
AYTPEQL

SEQ ID NO: 1147049 - protein, 8 aa, Mycobacterium
CAEARGKD

SEQ ID NO: 1147050 - protein, 5 aa, Mycobacterium
CAEEG

SEQ ID NO: 1147051 - protein, 10 aa, Mycobacterium
CAQRTDHRRG

SEQ ID NO: 1147052 - protein, 5 aa, Mycobacterium
CARGR

SEQ ID NO: 1147053 - protein, 12 aa, Mycobacterium
CASGSQALQSAR

SEQ ID NO: 1147054 - protein, 6 aa, Mycobacterium
CASPDA

SEQ ID NO: 1147055 - protein, 10 aa, Mycobacterium
CERRDPKGLY

SEQ ID NO: 1147056 - protein, 4 aa, Mycobacterium
CESG

SEQ ID NO: 1147057 - protein, 8 aa, Mycobacterium
CFPPPPGY

SEQ ID NO: 1147058 - protein, 6 aa, Mycobacterium
CGPEEI

SEQ ID NO: 1147059 - protein, 4 aa, Mycobacterium
CGPG

SEQ ID NO: 1147060 - protein, 6 aa, Mycobacterium
CGPGRV

SEQ ID NO: 1147061 - protein, 4 aa, Mycobacterium
CGPQ

SEQ ID NO: 1147062 - protein, 4 aa, Mycobacterium
CGSG

SEQ ID NO: 1147063 - protein, 5 aa, Mycobacterium
CGSNS

SEQ ID NO: 1147064 - protein, 4 aa, Mycobacterium
CGTG

SEQ ID NO: 1147065 - protein, 6 aa, Mycobacterium
CHGGPG

SEQ ID NO: 1147066 - protein, 7 aa, Mycobacterium
CPEHTEK

SEQ ID NO: 1147067 - protein, 6 aa, Mycobacterium
CPGPEA

SEQ ID NO: 1147068 - protein, 8 aa, Mycobacterium
CPPPDEPV

SEQ ID NO: 1147069 - protein, 5 aa, Mycobacterium
CPPRP

SEQ ID NO: 1147070 - protein, 4 aa, Mycobacterium
CPTT

SEQ ID NO: 1147071 - protein, 12 aa, Mycobacterium
CRPDASPGSPEW

SEQ ID NO: 1147072 - protein, 4 aa, Mycobacterium
CRPV

SEQ ID NO: 1147073 - protein, 10 aa, Mycobacterium
CRSTDPSKSE

SEQ ID NO: 1147074 - protein, 5 aa, Mycobacterium
CSAPV

SEQ ID NO: 1147075 - protein, 11 aa, Mycobacterium
CSPTSDGSGAA

SEQ ID NO: 1147076 - protein, 9 aa, Mycobacterium
CTGKGNDQV

SEQ ID NO: 1147077 - protein, 5 aa, Mycobacterium
CTPCR

SEQ ID NO: 1147078 - protein, 10 aa, Mycobacterium
CTTAKRGRKL

SEQ ID NO: 1147079 - protein, 6 aa, Mycobacterium
DAAAAD

SEQ ID NO: 1147080 - protein, 7 aa, Mycobacterium
DAAGLAE

SEQ ID NO: 1147081 - protein, 8 aa, Mycobacterium
DAAGLSSP

SEQ ID NO: 1147082 - protein, 7 aa, Mycobacterium
DAAGQAA

SEQ ID NO: 1147083 - protein, 7 aa, Mycobacterium
DAAHAGE

SEQ ID NO: 1147084 - protein, 10 aa, Mycobacterium
DAAPDRAREL

SEQ ID NO: 1147085 - protein, 6 aa, Mycobacterium
DAATAR

SEQ ID NO: 1147086 - protein, 8 aa, Mycobacterium
DACTPSHT

SEQ ID NO: 1147087 - protein, 7 aa, Mycobacterium
DADAADK

SEQ ID NO: 1147088 - protein, 10 aa, Mycobacterium
DADDAANYGG

SEQ ID NO: 1147089 - protein, 12 aa, Mycobacterium
DADEEFKQQSYE

SEQ ID NO: 1147090 - protein, 5 aa, Mycobacterium
DADGR

SEQ ID NO: 1147091 - protein, 10 aa, Mycobacterium
DADPDGGNIN

SEQ ID NO: 1147092 - protein, 8 aa, Mycobacterium
DADRNGTL

SEQ ID NO: 1147093 - protein, 5 aa, Mycobacterium
DADTE

SEQ ID NO: 1147094 - protein, 8 aa, Mycobacterium
DAEAGPTE

SEQ ID NO: 1147095 - protein, 5 aa, Mycobacterium
DAEND

SEQ ID NO: 1147096 - protein, 16 aa, Mycobacterium
DAENEKNYGEFSAREG

SEQ ID NO: 1147097 - protein, 4 aa, Mycobacterium
DAEP

SEQ ID NO: 1147098 - protein, 6 aa, Mycobacterium
DAEQTH

SEQ ID NO: 1147099 - protein, 6 aa, Mycobacterium
DAESMT

SEQ ID NO: 1147100 - protein, 6 aa, Mycobacterium
DAESYL

SEQ ID NO: 1147101 - protein, 7 aa, Mycobacterium
DAETDEV

SEQ ID NO: 1147102 - protein, 7 aa, Mycobacterium
DAGANAV

SEQ ID NO: 1147103 - protein, 9 aa, Mycobacterium
DAGEADGAK

SEQ ID NO: 1147104 - protein, 8 aa, Mycobacterium
DAGEALGD

SEQ ID NO: 1147105 - protein, 14 aa, Mycobacterium
DAGGDGSAAREPTF

SEQ ID NO: 1147106 - protein, 14 aa, Mycobacterium
DAGLTSSSWARGPH

SEQ ID NO: 1147107 - protein, 8 aa, Mycobacterium
DAGSDKPL

SEQ ID NO: 1147108 - protein, 5 aa, Mycobacterium
DAGVT

SEQ ID NO: 1147109 - protein, 8 aa, Mycobacterium
DAHPGTSE

SEQ ID NO: 1147110 - protein, 5 aa, Mycobacterium
DALTP

SEQ ID NO: 1147111 - protein, 11 aa, Mycobacterium
DANASIPTPQP

SEQ ID NO: 1147112 - protein, 5 aa, Mycobacterium
DAPAR

SEQ ID NO: 1147113 - protein, 6 aa, Mycobacterium
DAPSNA

SEQ ID NO: 1147114 - protein, 6 aa, Mycobacterium
DAQETR

SEQ ID NO: 1147115 - protein, 6 aa, Mycobacterium
DAQGGV

SEQ ID NO: 1147116 - protein, 7 aa, Mycobacterium
DARANAR

SEQ ID NO: 1147117 - protein, 5 aa, Mycobacterium
DARAT

SEQ ID NO: 1147118 - protein, 12 aa, Mycobacterium
DARDTKLGAEEI

SEQ ID NO: 1147119 - protein, 8 aa, Mycobacterium
DARPERDP

SEQ ID NO: 1147120 - protein, 7 aa, Mycobacterium
DARTDGH

SEQ ID NO: 1147121 - protein, 10 aa, Mycobacterium
DASADGYVRS

SEQ ID NO: 1147122 - protein, 4 aa, Mycobacterium
DATH

SEQ ID NO: 1147123 - protein, 6 aa, Mycobacterium
DAVAAG

SEQ ID NO: 1147124 - protein, 17 aa, Mycobacterium
DAVSTSTADNPNALATR

SEQ ID NO: 1147125 - protein, 5 aa, Mycobacterium
DAYGG

SEQ ID NO: 1147126 - protein, 6 aa, Mycobacterium
DCQRGQ

SEQ ID NO: 1147127 - protein, 9 aa, Mycobacterium
DDAARDKAV

SEQ ID NO: 1147128 - protein, 4 aa, Mycobacterium
DDAG

SEQ ID NO: 1147129 - protein, 7 aa, Mycobacterium
DDASAND

SEQ ID NO: 1147130 - protein, 7 aa, Mycobacterium
DDDDAVR

SEQ ID NO: 1147131 - protein, 6 aa, Mycobacterium
DDDGNV

SEQ ID NO: 1147132 - protein, 4 aa, Mycobacterium
DDDI

SEQ ID NO: 1147133 - protein, 10 aa, Mycobacterium
DDDPRRVSDR

SEQ ID NO: 1147134 - protein, 6 aa, Mycobacterium
DDECPG

SEQ ID NO: 1147135 - protein, 7 aa, Mycobacterium
DDEMGQS

SEQ ID NO: 1147136 - protein, 4 aa, Mycobacterium
DDGD

SEQ ID NO: 1147137 - protein, 5 aa, Mycobacterium
DDGLK

SEQ ID NO: 1147138 - protein, 9 aa, Mycobacterium
DDGSGRTYQ

SEQ ID NO: 1147139 - protein, 5 aa, Mycobacterium
DDKSY

SEQ ID NO: 1147140 - protein, 9 aa, Mycobacterium
DDKYDGSQN

SEQ ID NO: 1147141 - protein, 5 aa, Mycobacterium
DDLGG

SEQ ID NO: 1147142 - protein, 12 aa, Mycobacterium
DDLGGSPEIVPG

SEQ ID NO: 1147143 - protein, 7 aa, Mycobacterium
DDLKSTV

SEQ ID NO: 1147144 - protein, 4 aa, Mycobacterium
DDMT

SEQ ID NO: 1147145 - protein, 4 aa, Mycobacterium
DDPA

SEQ ID NO: 1147146 - protein, 6 aa, Mycobacterium
DDPAAD

SEQ ID NO: 1147147 - protein, 9 aa, Mycobacterium
DDPADAEVP

SEQ ID NO: 1147148 - protein, 8 aa, Mycobacterium
DDPADLET

SEQ ID NO: 1147149 - protein, 8 aa, Mycobacterium
DDPAGDHD

SEQ ID NO: 1147150 - protein, 7 aa, Mycobacterium
DDPAPEA

SEQ ID NO: 1147151 - protein, 4 aa, Mycobacterium
DDPF

SEQ ID NO: 1147152 - protein, 7 aa, Mycobacterium
DDPGDEL

SEQ ID NO: 1147153 - protein, 7 aa, Mycobacterium
DDPGNTT

SEQ ID NO: 1147154 - protein, 5 aa, Mycobacterium
DDPKA

SEQ ID NO: 1147155 - protein, 4 aa, Mycobacterium
DDPN

SEQ ID NO: 1147156 - protein, 5 aa, Mycobacterium
DDPTD

SEQ ID NO: 1147157 - protein, 5 aa, Mycobacterium
DDQAE

SEQ ID NO: 1147158 - protein, 14 aa, Mycobacterium
DDRAHRYAPTHGRD

SEQ ID NO: 1147159 - protein, 5 aa, Mycobacterium
DDRAY

SEQ ID NO: 1147160 - protein, 8 aa, Mycobacterium
DDRRPLKQ

SEQ ID NO: 1147161 - protein, 8 aa, Mycobacterium
DDSGNELL

SEQ ID NO: 1147162 - protein, 6 aa, Mycobacterium
DDSVPD

SEQ ID NO: 1147163 - protein, 4 aa, Mycobacterium
DDTL

SEQ ID NO: 1147164 - protein, 21 aa, Mycobacterium
DDTWKGPGRPLSSGYAERNQR

SEQ ID NO: 1147165 - protein, 12 aa, Mycobacterium
DDVGTGADARGP

SEQ ID NO: 1147166 - protein, 6 aa, Mycobacterium
DDYGPE

SEQ ID NO: 1147167 - protein, 4 aa, Mycobacterium
DDYQ

SEQ ID NO: 1147168 - protein, 11 aa, Mycobacterium
DDYTDPAPATT

SEQ ID NO: 1147169 - protein, 4 aa, Mycobacterium
DEAE

SEQ ID NO: 1147170 - protein, 8 aa, Mycobacterium
DEAETGVN

SEQ ID NO: 1147171 - protein, 6 aa, Mycobacterium
DEDVER

SEQ ID NO: 1147172 - protein, 9 aa, Mycobacterium
DEETRRRAE

SEQ ID NO: 1147173 - protein, 6 aa, Mycobacterium
DEEWED

SEQ ID NO: 1147174 - protein, 6 aa, Mycobacterium
DEFTKR

SEQ ID NO: 1147175 - protein, 5 aa, Mycobacterium
DEGAV

SEQ ID NO: 1147176 - protein, 7 aa, Mycobacterium
DEGIPEE

SEQ ID NO: 1147177 - protein, 15 aa, Mycobacterium
DEGPKGVKAQIQGDE

SEQ ID NO: 1147178 - protein, 10 aa, Mycobacterium
DEGRMSRPRP

SEQ ID NO: 1147179 - protein, 5 aa, Mycobacterium
DEHAE

SEQ ID NO: 1147180 - protein, 13 aa, Mycobacterium
DEKAVKDKAKRLE

SEQ ID NO: 1147181 - protein, 9 aa, Mycobacterium
DEKPTASDD

SEQ ID NO: 1147182 - protein, 4 aa, Mycobacterium
DEKQ

SEQ ID NO: 1147183 - protein, 4 aa, Mycobacterium
DENA

SEQ ID NO: 1147184 - protein, 7 aa, Mycobacterium
DEPPGTR

SEQ ID NO: 1147185 - protein, 6 aa, Mycobacterium
DEPRKG

SEQ ID NO: 1147186 - protein, 13 aa, Mycobacterium
DEPTANLDHRTGE

SEQ ID NO: 1147187 - protein, 4 aa, Mycobacterium
DEPV

SEQ ID NO: 1147188 - protein, 6 aa, Mycobacterium
DEPYGN

SEQ ID NO: 1147189 - protein, 7 aa, Mycobacterium
DEQRAEL

SEQ ID NO: 1147190 - protein, 5 aa, Mycobacterium
DEREQ

SEQ ID NO: 1147191 - protein, 7 aa, Mycobacterium
DERVGAE

SEQ ID NO: 1147192 - protein, 11 aa, Mycobacterium
DESDPTKRDPE

SEQ ID NO: 1147193 - protein, 8 aa, Mycobacterium
DESEPGTC

SEQ ID NO: 1147194 - protein, 8 aa, Mycobacterium
DESERDAA

SEQ ID NO: 1147195 - protein, 4 aa, Mycobacterium
DESP

SEQ ID NO: 1147196 - protein, 8 aa, Mycobacterium
DESRYATG

SEQ ID NO: 1147197 - protein, 5 aa, Mycobacterium
DESYQ

SEQ ID NO: 1147198 - protein, 14 aa, Mycobacterium
DETTRHTLSGGTEQ

SEQ ID NO: 1147199 - protein, 4 aa, Mycobacterium
DEVG

SEQ ID NO: 1147200 - protein, 5 aa, Mycobacterium
DEVGL

SEQ ID NO: 1147201 - protein, 5 aa, Mycobacterium
DEYGR

SEQ ID NO: 1147202 - protein, 7 aa, Mycobacterium
DFGDDKD

SEQ ID NO: 1147203 - protein, 11 aa, Mycobacterium
DFGSDDDNYRE

SEQ ID NO: 1147204 - protein, 7 aa, Mycobacterium
DFGTPDA

SEQ ID NO: 1147205 - protein, 4 aa, Mycobacterium
DFPA

SEQ ID NO: 1147206 - protein, 7 aa, Mycobacterium
DFSGSDL

SEQ ID NO: 1147207 - protein, 9 aa, Mycobacterium
DGAEKFTKT

SEQ ID NO: 1147208 - protein, 4 aa, Mycobacterium
DGAG

SEQ ID NO: 1147209 - protein, 7 aa, Mycobacterium
DGAYSPI

SEQ ID NO: 1147210 - protein, 9 aa, Mycobacterium
DGDARGGAA

SEQ ID NO: 1147211 - protein, 7 aa, Mycobacterium
DGDDDAV

SEQ ID NO: 1147212 - protein, 5 aa, Mycobacterium
DGDTE

SEQ ID NO: 1147213 - protein, 6 aa, Mycobacterium
DGEAAR

SEQ ID NO: 1147214 - protein, 6 aa, Mycobacterium
DGEIGS

SEQ ID NO: 1147215 - protein, 7 aa, Mycobacterium
DGEPAPD

SEQ ID NO: 1147216 - protein, 4 aa, Mycobacterium
DGGD

SEQ ID NO: 1147217 - protein, 5 aa, Mycobacterium
DGGDA

SEQ ID NO: 1147218 - protein, 11 aa, Mycobacterium
DGGGPSGQAGA

SEQ ID NO: 1147219 - protein, 5 aa, Mycobacterium
DGGRG

SEQ ID NO: 1147220 - protein, 6 aa, Mycobacterium
DGGRKK

SEQ ID NO: 1147221 - protein, 4 aa, Mycobacterium
DGGS

SEQ ID NO: 1147222 - protein, 7 aa, Mycobacterium
DGHDEHA

SEQ ID NO: 1147223 - protein, 4 aa, Mycobacterium
DGID

SEQ ID NO: 1147224 - protein, 5 aa, Mycobacterium
DGIPS

SEQ ID NO: 1147225 - protein, 8 aa, Mycobacterium
DGKLSNKL

SEQ ID NO: 1147226 - protein, 10 aa, Mycobacterium
DGKRTDEMPM

SEQ ID NO: 1147227 - protein, 9 aa, Mycobacterium
DGLPGPTDS

SEQ ID NO: 1147228 - protein, 11 aa, Mycobacterium
DGLTTRARRNA

SEQ ID NO: 1147229 - protein, 9 aa, Mycobacterium
DGNALDSND

SEQ ID NO: 1147230 - protein, 4 aa, Mycobacterium
DGPD

SEQ ID NO: 1147231 - protein, 26 aa, Mycobacterium
DGPEPDERERARKRAVTKHKQREDGM

SEQ ID NO: 1147232 - protein, 6 aa, Mycobacterium
DGPLSA

SEQ ID NO: 1147233 - protein, 8 aa, Mycobacterium
DGPTEVHK

SEQ ID NO: 1147234 - protein, 8 aa, Mycobacterium
DGPVRGNG

SEQ ID NO: 1147235 - protein, 7 aa, Mycobacterium
DGQKRLK

SEQ ID NO: 1147236 - protein, 6 aa, Mycobacterium
DGQPSI

SEQ ID NO: 1147237 - protein, 4 aa, Mycobacterium
DGRA

SEQ ID NO: 1147238 - protein, 4 aa, Mycobacterium
DGRE

SEQ ID NO: 1147239 - protein, 9 aa, Mycobacterium
DGRGEPRDD

SEQ ID NO: 1147240 - protein, 7 aa, Mycobacterium
DGRPETL

SEQ ID NO: 1147241 - protein, 6 aa, Mycobacterium
DGRYGP

SEQ ID NO: 1147242 - protein, 10 aa, Mycobacterium
DGSDVGGGAS

SEQ ID NO: 1147243 - protein, 6 aa, Mycobacterium
DGSGSR

SEQ ID NO: 1147244 - protein, 8 aa, Mycobacterium
DGSLPTNL

SEQ ID NO: 1147245 - protein, 7 aa, Mycobacterium
DGSNLAT

SEQ ID NO: 1147246 - protein, 5 aa, Mycobacterium
DGSPI

SEQ ID NO: 1147247 - protein, 5 aa, Mycobacterium
DGTAL

SEQ ID NO: 1147248 - protein, 5 aa, Mycobacterium
DGTAW

SEQ ID NO: 1147249 - protein, 5 aa, Mycobacterium
DGTIT

SEQ ID NO: 1147250 - protein, 6 aa, Mycobacterium
DGTPAV

SEQ ID NO: 1147251 - protein, 11 aa, Mycobacterium
DGTPDKSRLGA

SEQ ID NO: 1147252 - protein, 6 aa, Mycobacterium
DGTREF

SEQ ID NO: 1147253 - protein, 6 aa, Mycobacterium
DGTRHT

SEQ ID NO: 1147254 - protein, 6 aa, Mycobacterium
DGTRLK

SEQ ID NO: 1147255 - protein, 5 aa, Mycobacterium
DGVPD

SEQ ID NO: 1147256 - protein, 5 aa, Mycobacterium
DGVPR

SEQ ID NO: 1147257 - protein, 4 aa, Mycobacterium
DGVQ

SEQ ID NO: 1147258 - protein, 5 aa, Mycobacterium
DHAAA

SEQ ID NO: 1147259 - protein, 22 aa, Mycobacterium
DHDTPTDTPAGTPAGGRPPMPA

SEQ ID NO: 1147260 - protein, 4 aa, Mycobacterium
DHEV

SEQ ID NO: 1147261 - protein, 22 aa, Mycobacterium
DHGDHGDTDHKDARGFGRPPMP

SEQ ID NO: 1147262 - protein, 5 aa, Mycobacterium
DHNVP

SEQ ID NO: 1147263 - protein, 7 aa, Mycobacterium
DHPAPTQ

SEQ ID NO: 1147264 - protein, 4 aa, Mycobacterium
DHPD

SEQ ID NO: 1147265 - protein, 8 aa, Mycobacterium
DHPSAKAS

SEQ ID NO: 1147266 - protein, 9 aa, Mycobacterium
DHRASDGHR

SEQ ID NO: 1147267 - protein, 6 aa, Mycobacterium
DIARPR

SEQ ID NO: 1147268 - protein, 7 aa, Mycobacterium
DIEAGDR

SEQ ID NO: 1147269 - protein, 7 aa, Mycobacterium
DIGQGEQ

SEQ ID NO: 1147270 - protein, 7 aa, Mycobacterium
DIHTSGD

SEQ ID NO: 1147271 - protein, 5 aa, Mycobacterium
DIKNT

SEQ ID NO: 1147272 - protein, 8 aa, Mycobacterium
DIPAADRY

SEQ ID NO: 1147273 - protein, 8 aa, Mycobacterium
DISGETPF

SEQ ID NO: 1147274 - protein, 9 aa, Mycobacterium
DISGPPRAH

SEQ ID NO: 1147275 - protein, 4 aa, Mycobacterium
DKEA

SEQ ID NO: 1147276 - protein, 5 aa, Mycobacterium
DKEGT

SEQ ID NO: 1147277 - protein, 6 aa, Mycobacterium
DKENNV

SEQ ID NO: 1147278 - protein, 8 aa, Mycobacterium
DKESDPRY

SEQ ID NO: 1147279 - protein, 6 aa, Mycobacterium
DKFGGD

SEQ ID NO: 1147280 - protein, 7 aa, Mycobacterium
DKGEKEQ

SEQ ID NO: 1147281 - protein, 5 aa, Mycobacterium
DKGKL

SEQ ID NO: 1147282 - protein, 6 aa, Mycobacterium
DKGRLT

SEQ ID NO: 1147283 - protein, 7 aa, Mycobacterium
DKGTATF

SEQ ID NO: 1147284 - protein, 4 aa, Mycobacterium
DKGV

SEQ ID NO: 1147285 - protein, 7 aa, Mycobacterium
DKHGNPV

SEQ ID NO: 1147286 - protein, 4 aa, Mycobacterium
DKLT

SEQ ID NO: 1147287 - protein, 7 aa, Mycobacterium
DKPPGVA

SEQ ID NO: 1147288 - protein, 7 aa, Mycobacterium
DKPTGAV

SEQ ID NO: 1147289 - protein, 7 aa, Mycobacterium
DKSKLAT

SEQ ID NO: 1147290 - protein, 10 aa, Mycobacterium
DKSKNSSAAY

SEQ ID NO: 1147291 - protein, 7 aa, Mycobacterium
DKTARDQ

SEQ ID NO: 1147292 - protein, 5 aa, Mycobacterium
DKTAV

SEQ ID NO: 1147293 - protein, 4 aa, Mycobacterium
DKTR

SEQ ID NO: 1147294 - protein, 7 aa, Mycobacterium
DLAPAEP

SEQ ID NO: 1147295 - protein, 7 aa, Mycobacterium
DLGQGQD

SEQ ID NO: 1147296 - protein, 8 aa, Mycobacterium
DLPKPGDW

SEQ ID NO: 1147297 - protein, 5 aa, Mycobacterium
DLPPR

SEQ ID NO: 1147298 - protein, 9 aa, Mycobacterium
DLQEDKEPV

SEQ ID NO: 1147299 - protein, 10 aa, Mycobacterium
DLQPGSSIMP

SEQ ID NO: 1147300 - protein, 11 aa, Mycobacterium
DLRGGGPVPDK

SEQ ID NO: 1147301 - protein, 5 aa, Mycobacterium
DLSEG

SEQ ID NO: 1147302 - protein, 7 aa, Mycobacterium
DLTDRRN

SEQ ID NO: 1147303 - protein, 6 aa, Mycobacterium
DMPTTC

SEQ ID NO: 1147304 - protein, 5 aa, Mycobacterium
DMSRK

SEQ ID NO: 1147305 - protein, 10 aa, Mycobacterium
DNAPEERQRG

SEQ ID NO: 1147306 - protein, 6 aa, Mycobacterium
DNCPQR

SEQ ID NO: 1147307 - protein, 5 aa, Mycobacterium
DNDPR

SEQ ID NO: 1147308 - protein, 4 aa, Mycobacterium
DNDR

SEQ ID NO: 1147309 - protein, 11 aa, Mycobacterium
DNDSARRTPDL

SEQ ID NO: 1147310 - protein, 9 aa, Mycobacterium
DNEASDKAA

SEQ ID NO: 1147311 - protein, 7 aa, Mycobacterium
DNEHDEA

SEQ ID NO: 1147312 - protein, 4 aa, Mycobacterium
DNGV

SEQ ID NO: 1147313 - protein, 9 aa, Mycobacterium
DNLGSGADL

SEQ ID NO: 1147314 - protein, 5 aa, Mycobacterium
DNPAL

SEQ ID NO: 1147315 - protein, 4 aa, Mycobacterium
DNPD

SEQ ID NO: 1147316 - protein, 4 aa, Mycobacterium
DNPE

SEQ ID NO: 1147317 - protein, 15 aa, Mycobacterium
DNPNATGSCACGDSF

SEQ ID NO: 1147318 - protein, 5 aa, Mycobacterium
DNQPG

SEQ ID NO: 1147319 - protein, 4 aa, Mycobacterium
DNRG

SEQ ID NO: 1147320 - protein, 8 aa, Mycobacterium
DNSDNALP

SEQ ID NO: 1147321 - protein, 6 aa, Mycobacterium
DNTGAK

SEQ ID NO: 1147322 - protein, 7 aa, Mycobacterium
DNTYGGR

SEQ ID NO: 1147323 - protein, 4 aa, Mycobacterium
DPAA

SEQ ID NO: 1147324 - protein, 9 aa, Mycobacterium
DPADKTYRL

SEQ ID NO: 1147325 - protein, 7 aa, Mycobacterium
DPADTRT

SEQ ID NO: 1147326 - protein, 6 aa, Mycobacterium
DPAETR

SEQ ID NO: 1147327 - protein, 7 aa, Mycobacterium
DPAYQTE

SEQ ID NO: 1147328 - protein, 5 aa, Mycobacterium
DPDAI

SEQ ID NO: 1147329 - protein, 8 aa, Mycobacterium
DPDPAEPL

SEQ ID NO: 1147330 - protein, 12 aa, Mycobacterium
DPDPDAAGKTYT

SEQ ID NO: 1147331 - protein, 5 aa, Mycobacterium
DPDRD

SEQ ID NO: 1147332 - protein, 5 aa, Mycobacterium
DPDRG

SEQ ID NO: 1147333 - protein, 6 aa, Mycobacterium
DPDRIA

SEQ ID NO: 1147334 - protein, 4 aa, Mycobacterium
DPDV

SEQ ID NO: 1147335 - protein, 8 aa, Mycobacterium
DPEAQRHK

SEQ ID NO: 1147336 - protein, 8 aa, Mycobacterium
DPEDSEDV

SEQ ID NO: 1147337 - protein, 5 aa, Mycobacterium
DPELR

SEQ ID NO: 1147338 - protein, 13 aa, Mycobacterium
DPGEGTQAKRRAH

SEQ ID NO: 1147339 - protein, 13 aa, Mycobacterium
DPGPRTSSATTIT

SEQ ID NO: 1147340 - protein, 7 aa, Mycobacterium
DPGSRGA

SEQ ID NO: 1147341 - protein, 9 aa, Mycobacterium
DPGYSGDTA

SEQ ID NO: 1147342 - protein, 5 aa, Mycobacterium
DPKIS

SEQ ID NO: 1147343 - protein, 7 aa, Mycobacterium
DPLGNPV

SEQ ID NO: 1147344 - protein, 6 aa, Mycobacterium
DPLRDE

SEQ ID NO: 1147345 - protein, 4 aa, Mycobacterium
DPLS

SEQ ID NO: 1147346 - protein, 9 aa, Mycobacterium
DPNGRLTPL

SEQ ID NO: 1147347 - protein, 5 aa, Mycobacterium
DPPES

SEQ ID NO: 1147348 - protein, 6 aa, Mycobacterium
DPPPEL

SEQ ID NO: 1147349 - protein, 7 aa, Mycobacterium
DPPPRTG

SEQ ID NO: 1147350 - protein, 4 aa, Mycobacterium
DPPV

SEQ ID NO: 1147351 - protein, 9 aa, Mycobacterium
DPQGNASTA

SEQ ID NO: 1147352 - protein, 5 aa, Mycobacterium
DPRAV

SEQ ID NO: 1147353 - protein, 4 aa, Mycobacterium
DPRF

SEQ ID NO: 1147354 - protein, 5 aa, Mycobacterium
DPRHQ

SEQ ID NO: 1147355 - protein, 8 aa, Mycobacterium
DPRKADQM

SEQ ID NO: 1147356 - protein, 5 aa, Mycobacterium
DPRRT

SEQ ID NO: 1147357 - protein, 5 aa, Mycobacterium
DPSAA

SEQ ID NO: 1147358 - protein, 5 aa, Mycobacterium
DPSLR

SEQ ID NO: 1147359 - protein, 11 aa, Mycobacterium
DPSSTRTGGSI

SEQ ID NO: 1147360 - protein, 5 aa, Mycobacterium
DPTAI

SEQ ID NO: 1147361 - protein, 7 aa, Mycobacterium
DPTAPSL

SEQ ID NO: 1147362 - protein, 4 aa, Mycobacterium
DPTD

SEQ ID NO: 1147363 - protein, 4 aa, Mycobacterium
DPTP

SEQ ID NO: 1147364 - protein, 6 aa, Mycobacterium
DPTPVA

SEQ ID NO: 1147365 - protein, 12 aa, Mycobacterium
DPTVKGGTSNPW

SEQ ID NO: 1147366 - protein, 5 aa, Mycobacterium
DPTVS

SEQ ID NO: 1147367 - protein, 5 aa, Mycobacterium
DPVEQ

SEQ ID NO: 1147368 - protein, 5 aa, Mycobacterium
DPVPA

SEQ ID NO: 1147369 - protein, 6 aa, Mycobacterium
DPVSEK

SEQ ID NO: 1147370 - protein, 11 aa, Mycobacterium
DPYERADITSN

SEQ ID NO: 1147371 - protein, 8 aa, Mycobacterium
DPYPTPGH

SEQ ID NO: 1147372 - protein, 11 aa, Mycobacterium
DPYSAAKAIGT

SEQ ID NO: 1147373 - protein, 5 aa, Mycobacterium
DQAQR

SEQ ID NO: 1147374 - protein, 6 aa, Mycobacterium
DQASDR

SEQ ID NO: 1147375 - protein, 4 aa, Mycobacterium
DQDD

SEQ ID NO: 1147376 - protein, 6 aa, Mycobacterium
DQDELA

SEQ ID NO: 1147377 - protein, 6 aa, Mycobacterium
DQDTGE

SEQ ID NO: 1147378 - protein, 11 aa, Mycobacterium
DQERGLSAGEK

SEQ ID NO: 1147379 - protein, 8 aa, Mycobacterium
DQLPSTHP

SEQ ID NO: 1147380 - protein, 4 aa, Mycobacterium
DQPW

SEQ ID NO: 1147381 - protein, 14 aa, Mycobacterium
DQRPGTKKCGHQGG

SEQ ID NO: 1147382 - protein, 26 aa, Mycobacterium
DQYYSPDFGQATGAAVPLDDYGYSDY

SEQ ID NO: 1147383 - protein, 6 aa, Mycobacterium
DRAGER

SEQ ID NO: 1147384 - protein, 7 aa, Mycobacterium
DRAGVSK

SEQ ID NO: 1147385 - protein, 7 aa, Mycobacterium
DRAQREL

SEQ ID NO: 1147386 - protein, 4 aa, Mycobacterium
DRDG

SEQ ID NO: 1147387 - protein, 6 aa, Mycobacterium
DRDGER

SEQ ID NO: 1147388 - protein, 5 aa, Mycobacterium
DRDGG

SEQ ID NO: 1147389 - protein, 7 aa, Mycobacterium
DREKHGA

SEQ ID NO: 1147390 - protein, 5 aa, Mycobacterium
DRFTS

SEQ ID NO: 1147391 - protein, 16 aa, Mycobacterium
DRGDRSVTLRPEGTAG

SEQ ID NO: 1147392 - protein, 7 aa, Mycobacterium
DRGSQFR

SEQ ID NO: 1147393 - protein, 4 aa, Mycobacterium
DRGY

SEQ ID NO: 1147394 - protein, 6 aa, Mycobacterium
DRHYTN

SEQ ID NO: 1147395 - protein, 23 aa, Mycobacterium
DRKAKQDGIPDTESAVTPDLLED

SEQ ID NO: 1147396 - protein, 6 aa, Mycobacterium
DRLGGD

SEQ ID NO: 1147397 - protein, 8 aa, Mycobacterium
DRLTEGAA

SEQ ID NO: 1147398 - protein, 7 aa, Mycobacterium
DRNRTIA

SEQ ID NO: 1147399 - protein, 4 aa, Mycobacterium
DRPA

SEQ ID NO: 1147400 - protein, 9 aa, Mycobacterium
DRPGKAKAL

SEQ ID NO: 1147401 - protein, 5 aa, Mycobacterium
DRPGR

SEQ ID NO: 1147402 - protein, 7 aa, Mycobacterium
DRPHPRG

SEQ ID NO: 1147403 - protein, 8 aa, Mycobacterium
DRPNRGRR

SEQ ID NO: 1147404 - protein, 17 aa, Mycobacterium
DRQEVDNALNQAAKELS

SEQ ID NO: 1147405 - protein, 8 aa, Mycobacterium
DRRARKGE

SEQ ID NO: 1147406 - protein, 8 aa, Mycobacterium
DRRATQGN

SEQ ID NO: 1147407 - protein, 8 aa, Mycobacterium
DRRRDRPP

SEQ ID NO: 1147408 - protein, 5 aa, Mycobacterium
DRRRG

SEQ ID NO: 1147409 - protein, 6 aa, Mycobacterium
DRRSGY

SEQ ID NO: 1147410 - protein, 5 aa, Mycobacterium
DRRTT

SEQ ID NO: 1147411 - protein, 5 aa, Mycobacterium
DRVSP

SEQ ID NO: 1147412 - protein, 5 aa, Mycobacterium
DRVTG

SEQ ID NO: 1147413 - protein, 4 aa, Mycobacterium
DRYP

SEQ ID NO: 1147414 - protein, 5 aa, Mycobacterium
DRYPT

SEQ ID NO: 1147415 - protein, 7 aa, Mycobacterium
DSAADYA

SEQ ID NO: 1147416 - protein, 6 aa, Mycobacterium
DSAGGY

SEQ ID NO: 1147417 - protein, 8 aa, Mycobacterium
DSDRKGLS

SEQ ID NO: 1147418 - protein, 5 aa, Mycobacterium
DSEID

SEQ ID NO: 1147419 - protein, 14 aa, Mycobacterium
DSGDDASETEPKPQ

SEQ ID NO: 1147420 - protein, 5 aa, Mycobacterium
DSGIG

SEQ ID NO: 1147421 - protein, 13 aa, Mycobacterium
DSHEVTRGGDPIT

SEQ ID NO: 1147422 - protein, 9 aa, Mycobacterium
DSLATGPGV

SEQ ID NO: 1147423 - protein, 7 aa, Mycobacterium
DSLDAEY

SEQ ID NO: 1147424 - protein, 9 aa, Mycobacterium
DSLPSPLPT

SEQ ID NO: 1147425 - protein, 6 aa, Mycobacterium
DSLQDK

SEQ ID NO: 1147426 - protein, 6 aa, Mycobacterium
DSNKTQ

SEQ ID NO: 1147427 - protein, 5 aa, Mycobacterium
DSNPP

SEQ ID NO: 1147428 - protein, 9 aa, Mycobacterium
DSPFRRGPL

SEQ ID NO: 1147429 - protein, 4 aa, Mycobacterium
DSPH

SEQ ID NO: 1147430 - protein, 8 aa, Mycobacterium
DSPLAERR

SEQ ID NO: 1147431 - protein, 6 aa, Mycobacterium
DSPNSA

SEQ ID NO: 1147432 - protein, 8 aa, Mycobacterium
DSPTPSGL

SEQ ID NO: 1147433 - protein, 5 aa, Mycobacterium
DSQKG

SEQ ID NO: 1147434 - protein, 8 aa, Mycobacterium
DSRGNPTV

SEQ ID NO: 1147435 - protein, 8 aa, Mycobacterium
DSSKVGRE

SEQ ID NO: 1147436 - protein, 4 aa, Mycobacterium
DSTA

SEQ ID NO: 1147437 - protein, 6 aa, Mycobacterium
DSTDYG

SEQ ID NO: 1147438 - protein, 9 aa, Mycobacterium
DSTLSRDDG

SEQ ID NO: 1147439 - protein, 20 aa, Mycobacterium
DSTTLSQSAIDAARNQARQL

SEQ ID NO: 1147440 - protein, 7 aa, Mycobacterium
DSTVPDA

SEQ ID NO: 1147441 - protein, 6 aa, Mycobacterium
DSVEDR

SEQ ID NO: 1147442 - protein, 6 aa, Mycobacterium
DSVSER

SEQ ID NO: 1147443 - protein, 15 aa, Mycobacterium
DSVTKSKFDNKYGTR

SEQ ID NO: 1147444 - protein, 6 aa, Mycobacterium
DSYADD

SEQ ID NO: 1147445 - protein, 10 aa, Mycobacterium
DTADGAALDG

SEQ ID NO: 1147446 - protein, 7 aa, Mycobacterium
DTAGKGG

SEQ ID NO: 1147447 - protein, 11 aa, Mycobacterium
DTAKEKPQEGT

SEQ ID NO: 1147448 - protein, 5 aa, Mycobacterium
DTAQA

SEQ ID NO: 1147449 - protein, 6 aa, Mycobacterium
DTDAGA

SEQ ID NO: 1147450 - protein, 7 aa, Mycobacterium
DTDGAGV

SEQ ID NO: 1147451 - protein, 5 aa, Mycobacterium
DTDGK

SEQ ID NO: 1147452 - protein, 5 aa, Mycobacterium
DTDTQ

SEQ ID NO: 1147453 - protein, 4 aa, Mycobacterium
DTEF

SEQ ID NO: 1147454 - protein, 10 aa, Mycobacterium
DTEGKPSLGW

SEQ ID NO: 1147455 - protein, 7 aa, Mycobacterium
DTEPYRK

SEQ ID NO: 1147456 - protein, 4 aa, Mycobacterium
DTER

SEQ ID NO: 1147457 - protein, 4 aa, Mycobacterium
DTGE

SEQ ID NO: 1147458 - protein, 7 aa, Mycobacterium
DTGGGPL

SEQ ID NO: 1147459 - protein, 9 aa, Mycobacterium
DTGHGGDPH

SEQ ID NO: 1147460 - protein, 9 aa, Mycobacterium
DTGLYKDSD

SEQ ID NO: 1147461 - protein, 6 aa, Mycobacterium
DTHGGD

SEQ ID NO: 1147462 - protein, 5 aa, Mycobacterium
DTIGA

SEQ ID NO: 1147463 - protein, 7 aa, Mycobacterium
DTIPGTA

SEQ ID NO: 1147464 - protein, 8 aa, Mycobacterium
DTPDPDAG

SEQ ID NO: 1147465 - protein, 4 aa, Mycobacterium
DTPE

SEQ ID NO: 1147466 - protein, 10 aa, Mycobacterium
DTPGEADYYR

SEQ ID NO: 1147467 - protein, 6 aa, Mycobacterium
DTPGVD

SEQ ID NO: 1147468 - protein, 9 aa, Mycobacterium
DTPHTRPVP

SEQ ID NO: 1147469 - protein, 6 aa, Mycobacterium
DTQSED

SEQ ID NO: 1147470 - protein, 10 aa, Mycobacterium
DTRQSGGGED

SEQ ID NO: 1147471 - protein, 7 aa, Mycobacterium
DTSGTVD

SEQ ID NO: 1147472 - protein, 6 aa, Mycobacterium
DTTARS

SEQ ID NO: 1147473 - protein, 5 aa, Mycobacterium
DTTTA

SEQ ID NO: 1147474 - protein, 7 aa, Mycobacterium
DTTTPDW

SEQ ID NO: 1147475 - protein, 5 aa, Mycobacterium
DTVND

SEQ ID NO: 1147476 - protein, 5 aa, Mycobacterium
DTVTE

SEQ ID NO: 1147477 - protein, 13 aa, Mycobacterium
DTYIEKDSSINDD

SEQ ID NO: 1147478 - protein, 9 aa, Mycobacterium
DVAKPGSDR

SEQ ID NO: 1147479 - protein, 14 aa, Mycobacterium
DVEPVEGSDGTDGH

SEQ ID NO: 1147480 - protein, 7 aa, Mycobacterium
DVGAGRS

SEQ ID NO: 1147481 - protein, 8 aa, Mycobacterium
DVGGSGLR

SEQ ID NO: 1147482 - protein, 11 aa, Mycobacterium
DVKGAAADADY

SEQ ID NO: 1147483 - protein, 13 aa, Mycobacterium
DVPEPKKVKPPRT

SEQ ID NO: 1147484 - protein, 6 aa, Mycobacterium
DVPEPV

SEQ ID NO: 1147485 - protein, 7 aa, Mycobacterium
DVTGEDV

SEQ ID NO: 1147486 - protein, 8 aa, Mycobacterium
DVTPGTLA

SEQ ID NO: 1147487 - protein, 7 aa, Mycobacterium
DWDPSQV

SEQ ID NO: 1147488 - protein, 5 aa, Mycobacterium
DYADP

SEQ ID NO: 1147489 - protein, 7 aa, Mycobacterium
DYEQHPL

SEQ ID NO: 1147490 - protein, 4 aa, Mycobacterium
DYKK

SEQ ID NO: 1147491 - protein, 8 aa, Mycobacterium
DYPGVGPE

SEQ ID NO: 1147492 - protein, 4 aa, Mycobacterium
DYPL

SEQ ID NO: 1147493 - protein, 4 aa, Mycobacterium
DYSS

SEQ ID NO: 1147494 - protein, 10 aa, Mycobacterium
DYTDAGKPAI

SEQ ID NO: 1147495 - protein, 10 aa, Mycobacterium
DYTDETTELP

SEQ ID NO: 1147496 - protein, 8 aa, Mycobacterium
DYTREPGV

SEQ ID NO: 1147497 - protein, 4 aa, Mycobacterium
EAAD

SEQ ID NO: 1147498 - protein, 7 aa, Mycobacterium
EAADPGE

SEQ ID NO: 1147499 - protein, 18 aa, Mycobacterium
EAAEKAKIELSSSQSTSI

SEQ ID NO: 1147500 - protein, 14 aa, Mycobacterium
EAAGGVSTPATQDA

SEQ ID NO: 1147501 - protein, 17 aa, Mycobacterium
EAAKAKSQNKTRDAEQA

SEQ ID NO: 1147502 - protein, 4 aa, Mycobacterium
EAAN

SEQ ID NO: 1147503 - protein, 4 aa, Mycobacterium
EAAT

SEQ ID NO: 1147504 - protein, 7 aa, Mycobacterium
EADGRRP

SEQ ID NO: 1147505 - protein, 4 aa, Mycobacterium
EADP

SEQ ID NO: 1147506 - protein, 7 aa, Mycobacterium
EADSDRD

SEQ ID NO: 1147507 - protein, 6 aa, Mycobacterium
EAEAVE

SEQ ID NO: 1147508 - protein, 4 aa, Mycobacterium
EAEE

SEQ ID NO: 1147509 - protein, 6 aa, Mycobacterium
EAEGRK

SEQ ID NO: 1147510 - protein, 5 aa, Mycobacterium
EAEKR

SEQ ID NO: 1147511 - protein, 7 aa, Mycobacterium
EAEPPGD

SEQ ID NO: 1147512 - protein, 4 aa, Mycobacterium
EAER

SEQ ID NO: 1147513 - protein, 9 aa, Mycobacterium
EAESRRGRR

SEQ ID NO: 1147514 - protein, 7 aa, Mycobacterium
EAGADDY

SEQ ID NO: 1147515 - protein, 7 aa, Mycobacterium
EAGATAD

SEQ ID NO: 1147516 - protein, 9 aa, Mycobacterium
EAGDGQEAV

SEQ ID NO: 1147517 - protein, 7 aa, Mycobacterium
EAGNGDR

SEQ ID NO: 1147518 - protein, 9 aa, Mycobacterium
EAGPAFQGT

SEQ ID NO: 1147519 - protein, 8 aa, Mycobacterium
EAGPRART

SEQ ID NO: 1147520 - protein, 4 aa, Mycobacterium
EAGR

SEQ ID NO: 1147521 - protein, 7 aa, Mycobacterium
EAGRGRT

SEQ ID NO: 1147522 - protein, 5 aa, Mycobacterium
EAGTA

SEQ ID NO: 1147523 - protein, 6 aa, Mycobacterium
EAGTQK

SEQ ID NO: 1147524 - protein, 4 aa, Mycobacterium
EAGV

SEQ ID NO: 1147525 - protein, 7 aa, Mycobacterium
EAGVGAA

SEQ ID NO: 1147526 - protein, 6 aa, Mycobacterium
EAHRAG

SEQ ID NO: 1147527 - protein, 6 aa, Mycobacterium
EAIGTR

SEQ ID NO: 1147528 - protein, 7 aa, Mycobacterium
EAIREAE

SEQ ID NO: 1147529 - protein, 14 aa, Mycobacterium
EALRPMGRATSGVQ

SEQ ID NO: 1147530 - protein, 6 aa, Mycobacterium
EAPARA

SEQ ID NO: 1147531 - protein, 5 aa, Mycobacterium
EAPGG

SEQ ID NO: 1147532 - protein, 10 aa, Mycobacterium
EAPQEGTPPF

SEQ ID NO: 1147533 - protein, 7 aa, Mycobacterium
EAPTFAD

SEQ ID NO: 1147534 - protein, 8 aa, Mycobacterium
EAPTRANA

SEQ ID NO: 1147535 - protein, 4 aa, Mycobacterium
EARE

SEQ ID NO: 1147536 - protein, 9 aa, Mycobacterium
EARPPGKKI

SEQ ID NO: 1147537 - protein, 8 aa, Mycobacterium
EARRREQQ

SEQ ID NO: 1147538 - protein, 9 aa, Mycobacterium
EASANGLGR

SEQ ID NO: 1147539 - protein, 5 aa, Mycobacterium
EASKR

SEQ ID NO: 1147540 - protein, 5 aa, Mycobacterium
EATGR

SEQ ID NO: 1147541 - protein, 7 aa, Mycobacterium
EATHEPG

SEQ ID NO: 1147542 - protein, 6 aa, Mycobacterium
EATRQG

SEQ ID NO: 1147543 - protein, 5 aa, Mycobacterium
EAVTQ

SEQ ID NO: 1147544 - protein, 7 aa, Mycobacterium
ECNGSDV

SEQ ID NO: 1147545 - protein, 5 aa, Mycobacterium
ECNLG

SEQ ID NO: 1147546 - protein, 6 aa, Mycobacterium
EDAGGQ

SEQ ID NO: 1147547 - protein, 6 aa, Mycobacterium
EDAMEG

SEQ ID NO: 1147548 - protein, 10 aa, Mycobacterium
EDDHPHREQR

SEQ ID NO: 1147549 - protein, 4 aa, Mycobacterium
EDEQ

SEQ ID NO: 1147550 - protein, 8 aa, Mycobacterium
EDGAETDL

SEQ ID NO: 1147551 - protein, 11 aa, Mycobacterium
EDGQPVPQGEV

SEQ ID NO: 1147552 - protein, 8 aa, Mycobacterium
EDGQTIES

SEQ ID NO: 1147553 - protein, 7 aa, Mycobacterium
EDGREGD

SEQ ID NO: 1147554 - protein, 9 aa, Mycobacterium
EDHARASRN

SEQ ID NO: 1147555 - protein, 9 aa, Mycobacterium
EDHTTTDST

SEQ ID NO: 1147556 - protein, 5 aa, Mycobacterium
EDIDA

SEQ ID NO: 1147557 - protein, 5 aa, Mycobacterium
EDMTS

SEQ ID NO: 1147558 - protein, 5 aa, Mycobacterium
EDPAR

SEQ ID NO: 1147559 - protein, 7 aa, Mycobacterium
EDPGYTT

SEQ ID NO: 1147560 - protein, 4 aa, Mycobacterium
EDPR

SEQ ID NO: 1147561 - protein, 5 aa, Mycobacterium
EDPYE

SEQ ID NO: 1147562 - protein, 6 aa, Mycobacterium
EDQPLG

SEQ ID NO: 1147563 - protein, 7 aa, Mycobacterium
EDQSRTA

SEQ ID NO: 1147564 - protein, 7 aa, Mycobacterium
EDRENEG

SEQ ID NO: 1147565 - protein, 7 aa, Mycobacterium
EDRPALK

SEQ ID NO: 1147566 - protein, 8 aa, Mycobacterium
EDSDDVQD

SEQ ID NO: 1147567 - protein, 12 aa, Mycobacterium
EDSRPTTHDDPT

SEQ ID NO: 1147568 - protein, 6 aa, Mycobacterium
EDTELG

SEQ ID NO: 1147569 - protein, 4 aa, Mycobacterium
EDTH

SEQ ID NO: 1147570 - protein, 11 aa, Mycobacterium
EDTSAYDTGHI

SEQ ID NO: 1147571 - protein, 6 aa, Mycobacterium
EDVERG

SEQ ID NO: 1147572 - protein, 8 aa, Mycobacterium
EDVNRSQE

SEQ ID NO: 1147573 - protein, 5 aa, Mycobacterium
EDYDT

SEQ ID NO: 1147574 - protein, 9 aa, Mycobacterium
EEAETAPHT

SEQ ID NO: 1147575 - protein, 9 aa, Mycobacterium
EEAGTAKPK

SEQ ID NO: 1147576 - protein, 12 aa, Mycobacterium
EEAQRQHQALTQ

SEQ ID NO: 1147577 - protein, 6 aa, Mycobacterium
EEDGGL

SEQ ID NO: 1147578 - protein, 5 aa, Mycobacterium
EEDGL

SEQ ID NO: 1147579 - protein, 5 aa, Mycobacterium
EEDPV

SEQ ID NO: 1147580 - protein, 5 aa, Mycobacterium
EEETT

SEQ ID NO: 1147581 - protein, 7 aa, Mycobacterium
EEGGPAT

SEQ ID NO: 1147582 - protein, 9 aa, Mycobacterium
EEGGQLTEK

SEQ ID NO: 1147583 - protein, 9 aa, Mycobacterium
EEHGMDSAT

SEQ ID NO: 1147584 - protein, 6 aa, Mycobacterium
EEHQGP

SEQ ID NO: 1147585 - protein, 11 aa, Mycobacterium
EEKPATPKSHY

SEQ ID NO: 1147586 - protein, 8 aa, Mycobacterium
EENPNLQR

SEQ ID NO: 1147587 - protein, 4 aa, Mycobacterium
EEPP

SEQ ID NO: 1147588 - protein, 6 aa, Mycobacterium
EEPPPS

SEQ ID NO: 1147589 - protein, 8 aa, Mycobacterium
EEQAGAGA

SEQ ID NO: 1147590 - protein, 4 aa, Mycobacterium
EEQG

SEQ ID NO: 1147591 - protein, 10 aa, Mycobacterium
EERAKNPTED

SEQ ID NO: 1147592 - protein, 22 aa, Mycobacterium
EESEALRQARKDAELTASADSV

SEQ ID NO: 1147593 - protein, 11 aa, Mycobacterium
EEVGNGDGPDC

SEQ ID NO: 1147594 - protein, 9 aa, Mycobacterium
EEYGGGGAG

SEQ ID NO: 1147595 - protein, 8 aa, Mycobacterium
EFGGGGAS

SEQ ID NO: 1147596 - protein, 10 aa, Mycobacterium
EFGGQARPPM

SEQ ID NO: 1147597 - protein, 14 aa, Mycobacterium
EFGTRTETKNVNSL

SEQ ID NO: 1147598 - protein, 4 aa, Mycobacterium
EFTP

SEQ ID NO: 1147599 - protein, 13 aa, Mycobacterium
EGALPPPRKKSRR

SEQ ID NO: 1147600 - protein, 5 aa, Mycobacterium
EGAPE

SEQ ID NO: 1147601 - protein, 5 aa, Mycobacterium
EGDPH

SEQ ID NO: 1147602 - protein, 4 aa, Mycobacterium
EGEG

SEQ ID NO: 1147603 - protein, 8 aa, Mycobacterium
EGEKDNAP

SEQ ID NO: 1147604 - protein, 5 aa, Mycobacterium
EGEPD

SEQ ID NO: 1147605 - protein, 6 aa, Mycobacterium
EGEPGD

SEQ ID NO: 1147606 - protein, 13 aa, Mycobacterium
EGGGQANATILEL

SEQ ID NO: 1147607 - protein, 13 aa, Mycobacterium
EGGGTANVTIIER

SEQ ID NO: 1147608 - protein, 5 aa, Mycobacterium
EGGPG

SEQ ID NO: 1147609 - protein, 7 aa, Mycobacterium
EGGPGMY

SEQ ID NO: 1147610 - protein, 5 aa, Mycobacterium
EGGYQ

SEQ ID NO: 1147611 - protein, 7 aa, Mycobacterium
EGIDQRS

SEQ ID NO: 1147612 - protein, 4 aa, Mycobacterium
EGLP

SEQ ID NO: 1147613 - protein, 8 aa, Mycobacterium
EGPEVETE

SEQ ID NO: 1147614 - protein, 4 aa, Mycobacterium
EGPR

SEQ ID NO: 1147615 - protein, 5 aa, Mycobacterium
EGPST

SEQ ID NO: 1147616 - protein, 6 aa, Mycobacterium
EGQARG

SEQ ID NO: 1147617 - protein, 4 aa, Mycobacterium
EGRG

SEQ ID NO: 1147618 - protein, 5 aa, Mycobacterium
EGRGV

SEQ ID NO: 1147619 - protein, 7 aa, Mycobacterium
EGRKAVR

SEQ ID NO: 1147620 - protein, 4 aa, Mycobacterium
EGRL

SEQ ID NO: 1147621 - protein, 8 aa, Mycobacterium
EGRNATHQ

SEQ ID NO: 1147622 - protein, 8 aa, Mycobacterium
EGRPSTDA

SEQ ID NO: 1147623 - protein, 13 aa, Mycobacterium
EGRRGQPRLRPPF

SEQ ID NO: 1147624 - protein, 10 aa, Mycobacterium
EGRSLGDPET

SEQ ID NO: 1147625 - protein, 7 aa, Mycobacterium
EGSADPH

SEQ ID NO: 1147626 - protein, 8 aa, Mycobacterium
EGSEERRI

SEQ ID NO: 1147627 - protein, 4 aa, Mycobacterium
EGSG

SEQ ID NO: 1147628 - protein, 4 aa, Mycobacterium
EGTD

SEQ ID NO: 1147629 - protein, 11 aa, Mycobacterium
EGTDSDGVARG

SEQ ID NO: 1147630 - protein, 5 aa, Mycobacterium
EGTSE

SEQ ID NO: 1147631 - protein, 8 aa, Mycobacterium
EGTSTITN

SEQ ID NO: 1147632 - protein, 6 aa, Mycobacterium
EGVEQS

SEQ ID NO: 1147633 - protein, 16 aa, Mycobacterium
EGVPPQIQATPGMPER

SEQ ID NO: 1147634 - protein, 11 aa, Mycobacterium
EGVRRTGGSTV

SEQ ID NO: 1147635 - protein, 5 aa, Mycobacterium
EGYPS

SEQ ID NO: 1147636 - protein, 9 aa, Mycobacterium
EGYPTPTDQ

SEQ ID NO: 1147637 - protein, 18 aa, Mycobacterium
EHELGTKGPGQDGPGRET

SEQ ID NO: 1147638 - protein, 7 aa, Mycobacterium
EHGNERV

SEQ ID NO: 1147639 - protein, 15 aa, Mycobacterium
EHGRKMSKSRGNGID

SEQ ID NO: 1147640 - protein, 4 aa, Mycobacterium
EHPD

SEQ ID NO: 1147641 - protein, 7 aa, Mycobacterium
EHPLNDP

SEQ ID NO: 1147642 - protein, 11 aa, Mycobacterium
EIAPTDATEAT

SEQ ID NO: 1147643 - protein, 4 aa, Mycobacterium
EIDR

SEQ ID NO: 1147644 - protein, 5 aa, Mycobacterium
EIGTT

SEQ ID NO: 1147645 - protein, 4 aa, Mycobacterium
EIPE

SEQ ID NO: 1147646 - protein, 9 aa, Mycobacterium
EKAGVSNPY

SEQ ID NO: 1147647 - protein, 4 aa, Mycobacterium
EKGR

SEQ ID NO: 1147648 - protein, 8 aa, Mycobacterium
EKQRDKVD

SEQ ID NO: 1147649 - protein, 7 aa, Mycobacterium
EKSPSFH

SEQ ID NO: 1147650 - protein, 4 aa, Mycobacterium
ELDA

SEQ ID NO: 1147651 - protein, 7 aa, Mycobacterium
ELDSETQ

SEQ ID NO: 1147652 - protein, 5 aa, Mycobacterium
ELGDG

SEQ ID NO: 1147653 - protein, 4 aa, Mycobacterium
ELGE

SEQ ID NO: 1147654 - protein, 5 aa, Mycobacterium
ELKGA

SEQ ID NO: 1147655 - protein, 8 aa, Mycobacterium
ELPAGQGF

SEQ ID NO: 1147656 - protein, 8 aa, Mycobacterium
ELPDDKPR

SEQ ID NO: 1147657 - protein, 4 aa, Mycobacterium
ELPE

SEQ ID NO: 1147658 - protein, 7 aa, Mycobacterium
ELPKPAE

SEQ ID NO: 1147659 - protein, 9 aa, Mycobacterium
ELPRNPTGK

SEQ ID NO: 1147660 - protein, 7 aa, Mycobacterium
ELTPEAR

SEQ ID NO: 1147661 - protein, 4 aa, Mycobacterium
EMTP

SEQ ID NO: 1147662 - protein, 5 aa, Mycobacterium
ENETG

SEQ ID NO: 1147663 - protein, 8 aa, Mycobacterium
ENGPDSSH

SEQ ID NO: 1147664 - protein, 7 aa, Mycobacterium
ENGVGTV

SEQ ID NO: 1147665 - protein, 7 aa, Mycobacterium
ENIAPAE

SEQ ID NO: 1147666 - protein, 9 aa, Mycobacterium
ENIPEPGIP

SEQ ID NO: 1147667 - protein, 8 aa, Mycobacterium
ENISPKEV

SEQ ID NO: 1147668 - protein, 7 aa, Mycobacterium
ENLGTAP

SEQ ID NO: 1147669 - protein, 5 aa, Mycobacterium
ENPEL

SEQ ID NO: 1147670 - protein, 7 aa, Mycobacterium
ENPRPGL

SEQ ID NO: 1147671 - protein, 7 aa, Mycobacterium
ENQHDET

SEQ ID NO: 1147672 - protein, 4 aa, Mycobacterium
ENTH

SEQ ID NO: 1147673 - protein, 10 aa, Mycobacterium
ENVAESLTRG

SEQ ID NO: 1147674 - protein, 6 aa, Mycobacterium
ENYASP

SEQ ID NO: 1147675 - protein, 5 aa, Mycobacterium
ENYPG

SEQ ID NO: 1147676 - protein, 9 aa, Mycobacterium
ENYPGRPRV

SEQ ID NO: 1147677 - protein, 5 aa, Mycobacterium
EPAGA

SEQ ID NO: 1147678 - protein, 8 aa, Mycobacterium
EPANQGAW

SEQ ID NO: 1147679 - protein, 4 aa, Mycobacterium
EPAS

SEQ ID NO: 1147680 - protein, 6 aa, Mycobacterium
EPCTDS

SEQ ID NO: 1147681 - protein, 13 aa, Mycobacterium
EPDEHGRRRPESL

SEQ ID NO: 1147682 - protein, 4 aa, Mycobacterium
EPDI

SEQ ID NO: 1147683 - protein, 6 aa, Mycobacterium
EPDRRG

SEQ ID NO: 1147684 - protein, 9 aa, Mycobacterium
EPDSGLDPV

SEQ ID NO: 1147685 - protein, 5 aa, Mycobacterium
EPDTG

SEQ ID NO: 1147686 - protein, 5 aa, Mycobacterium
EPEEV

SEQ ID NO: 1147687 - protein, 5 aa, Mycobacterium
EPEHQ

SEQ ID NO: 1147688 - protein, 8 aa, Mycobacterium
EPEHSAYR

SEQ ID NO: 1147689 - protein, 10 aa, Mycobacterium
EPGAGLDTSR

SEQ ID NO: 1147690 - protein, 11 aa, Mycobacterium
EPGAGSDLAGL

SEQ ID NO: 1147691 - protein, 4 aa, Mycobacterium
EPGE

SEQ ID NO: 1147692 - protein, 9 aa, Mycobacterium
EPGPPRPGY

SEQ ID NO: 1147693 - protein, 8 aa, Mycobacterium
EPGTNGQH

SEQ ID NO: 1147694 - protein, 7 aa, Mycobacterium
EPGVGKT

SEQ ID NO: 1147695 - protein, 16 aa, Mycobacterium
EPKRRGRQGAATPPLR

SEQ ID NO: 1147696 - protein, 7 aa, Mycobacterium
EPKTGAV

SEQ ID NO: 1147697 - protein, 13 aa, Mycobacterium
EPKTKSDQEKLGT

SEQ ID NO: 1147698 - protein, 4 aa, Mycobacterium
EPLG

SEQ ID NO: 1147699 - protein, 8 aa, Mycobacterium
EPMTASKE

SEQ ID NO: 1147700 - protein, 4 aa, Mycobacterium
EPNE

SEQ ID NO: 1147701 - protein, 8 aa, Mycobacterium
EPNHGSDA

SEQ ID NO: 1147702 - protein, 6 aa, Mycobacterium
EPNLED

SEQ ID NO: 1147703 - protein, 7 aa, Mycobacterium
EPPAGLR

SEQ ID NO: 1147704 - protein, 6 aa, Mycobacterium
EPPDHT

SEQ ID NO: 1147705 - protein, 4 aa, Mycobacterium
EPPF

SEQ ID NO: 1147706 - protein, 5 aa, Mycobacterium
EPPVM

SEQ ID NO: 1147707 - protein, 5 aa, Mycobacterium
EPRGA

SEQ ID NO: 1147708 - protein, 11 aa, Mycobacterium
EPRPSWGNPKY

SEQ ID NO: 1147709 - protein, 11 aa, Mycobacterium
EPRRLATRTDT

SEQ ID NO: 1147710 - protein, 6 aa, Mycobacterium
EPRYGE

SEQ ID NO: 1147711 - protein, 4 aa, Mycobacterium
EPSA

SEQ ID NO: 1147712 - protein, 5 aa, Mycobacterium
EPSAA

SEQ ID NO: 1147713 - protein, 6 aa, Mycobacterium
EPSAVS

SEQ ID NO: 1147714 - protein, 8 aa, Mycobacterium
EPSGGSDL

SEQ ID NO: 1147715 - protein, 5 aa, Mycobacterium
EPTAA

SEQ ID NO: 1147716 - protein, 13 aa, Mycobacterium
EPTGNLDPETSKD

SEQ ID NO: 1147717 - protein, 6 aa, Mycobacterium
EPTNDL

SEQ ID NO: 1147718 - protein, 8 aa, Mycobacterium
EPTTVGNR

SEQ ID NO: 1147719 - protein, 5 aa, Mycobacterium
EPYEV

SEQ ID NO: 1147720 - protein, 7 aa, Mycobacterium
EQAGEAA

SEQ ID NO: 1147721 - protein, 5 aa, Mycobacterium
EQAPD

SEQ ID NO: 1147722 - protein, 10 aa, Mycobacterium
EQDLGPRAAE

SEQ ID NO: 1147723 - protein, 5 aa, Mycobacterium
EQGPV

SEQ ID NO: 1147724 - protein, 10 aa, Mycobacterium
EQGQADNLER

SEQ ID NO: 1147725 - protein, 4 aa, Mycobacterium
EQGR

SEQ ID NO: 1147726 - protein, 4 aa, Mycobacterium
EQGV

SEQ ID NO: 1147727 - protein, 4 aa, Mycobacterium
EQLH

SEQ ID NO: 1147728 - protein, 13 aa, Mycobacterium
EQMPRQQKGLRND

SEQ ID NO: 1147729 - protein, 7 aa, Mycobacterium
EQNCSTS

SEQ ID NO: 1147730 - protein, 7 aa, Mycobacterium
EQPAAVS

SEQ ID NO: 1147731 - protein, 10 aa, Mycobacterium
EQTDSEQMKE

SEQ ID NO: 1147732 - protein, 5 aa, Mycobacterium
EQTSR

SEQ ID NO: 1147733 - protein, 4 aa, Mycobacterium
ERAG

SEQ ID NO: 1147734 - protein, 8 aa, Mycobacterium
ERAGTTKT

SEQ ID NO: 1147735 - protein, 10 aa, Mycobacterium
ERAKAVTRGI

SEQ ID NO: 1147736 - protein, 10 aa, Mycobacterium
ERAKGAEVSA

SEQ ID NO: 1147737 - protein, 7 aa, Mycobacterium
ERASGFR

SEQ ID NO: 1147738 - protein, 5 aa, Mycobacterium
ERDGL

SEQ ID NO: 1147739 - protein, 4 aa, Mycobacterium
ERDL

SEQ ID NO: 1147740 - protein, 8 aa, Mycobacterium
ERELAEQH

SEQ ID NO: 1147741 - protein, 4 aa, Mycobacterium
ERER

SEQ ID NO: 1147742 - protein, 8 aa, Mycobacterium
ERGGEGLA

SEQ ID NO: 1147743 - protein, 4 aa, Mycobacterium
ERGY

SEQ ID NO: 1147744 - protein, 10 aa, Mycobacterium
ERHAQKNERP

SEQ ID NO: 1147745 - protein, 7 aa, Mycobacterium
ERNSPGS

SEQ ID NO: 1147746 - protein, 4 aa, Mycobacterium
ERPS

SEQ ID NO: 1147747 - protein, 7 aa, Mycobacterium
ERQGGRT

SEQ ID NO: 1147748 - protein, 9 aa, Mycobacterium
ERRANPGDD

SEQ ID NO: 1147749 - protein, 13 aa, Mycobacterium
ERRASRYGQPGKT

SEQ ID NO: 1147750 - protein, 6 aa, Mycobacterium
ERRAYT

SEQ ID NO: 1147751 - protein, 6 aa, Mycobacterium
ERRDGQ

SEQ ID NO: 1147752 - protein, 7 aa, Mycobacterium
ERRRCPA

SEQ ID NO: 1147753 - protein, 5 aa, Mycobacterium
ERRRL

SEQ ID NO: 1147754 - protein, 5 aa, Mycobacterium
ERRTT

SEQ ID NO: 1147755 - protein, 5 aa, Mycobacterium
ERSEH

SEQ ID NO: 1147756 - protein, 7 aa, Mycobacterium
ERSGATR

SEQ ID NO: 1147757 - protein, 8 aa, Mycobacterium
ERSGPERI

SEQ ID NO: 1147758 - protein, 4 aa, Mycobacterium
ERSI

SEQ ID NO: 1147759 - protein, 5 aa, Mycobacterium
ERSPT

SEQ ID NO: 1147760 - protein, 7 aa, Mycobacterium
ERTGEAV

SEQ ID NO: 1147761 - protein, 7 aa, Mycobacterium
ERTGGRY

SEQ ID NO: 1147762 - protein, 9 aa, Mycobacterium
ERTNVHGSG

SEQ ID NO: 1147763 - protein, 6 aa, Mycobacterium
ERTPGE

SEQ ID NO: 1147764 - protein, 5 aa, Mycobacterium
ERTRD

SEQ ID NO: 1147765 - protein, 6 aa, Mycobacterium
ERTREF

SEQ ID NO: 1147766 - protein, 5 aa, Mycobacterium
ERTRP

SEQ ID NO: 1147767 - protein, 7 aa, Mycobacterium
ERYPGDA

SEQ ID NO: 1147768 - protein, 6 aa, Mycobacterium
ERYRRS

SEQ ID NO: 1147769 - protein, 7 aa, Mycobacterium
ESAGATS

SEQ ID NO: 1147770 - protein, 7 aa, Mycobacterium
ESAGGGI

SEQ ID NO: 1147771 - protein, 8 aa, Mycobacterium
ESASGAAG

SEQ ID NO: 1147772 - protein, 8 aa, Mycobacterium
ESDIRRSA

SEQ ID NO: 1147773 - protein, 10 aa, Mycobacterium
ESDQAPSAST

SEQ ID NO: 1147774 - protein, 5 aa, Mycobacterium
ESDRP

SEQ ID NO: 1147775 - protein, 4 aa, Mycobacterium
ESET

SEQ ID NO: 1147776 - protein, 10 aa, Mycobacterium
ESGAGKSAGA

SEQ ID NO: 1147777 - protein, 14 aa, Mycobacterium
ESGFGREGGTEGIE

SEQ ID NO: 1147778 - protein, 11 aa, Mycobacterium
ESGGGSGTANI

SEQ ID NO: 1147779 - protein, 6 aa, Mycobacterium
ESGLSN

SEQ ID NO: 1147780 - protein, 6 aa, Mycobacterium
ESGQLD

SEQ ID NO: 1147781 - protein, 4 aa, Mycobacterium
ESGV

SEQ ID NO: 1147782 - protein, 6 aa, Mycobacterium
ESIGRS

SEQ ID NO: 1147783 - protein, 34 aa, Mycobacterium; identical to SEQ ID NO: 387977

SEQ ID NO: 1147784 - protein, 22 aa, Mycobacterium
ESMSRTPMGSSLANGGNPYGES

SEQ ID NO: 1147785 - protein, 5 aa, Mycobacterium
ESPRP

SEQ ID NO: 1147786 - protein, 6 aa, Mycobacterium
ESPSPL

SEQ ID NO: 1147787 - protein, 5 aa, Mycobacterium
ESQEA

SEQ ID NO: 1147788 - protein, 4 aa, Mycobacterium
ESQG

SEQ ID NO: 1147789 - protein, 4 aa, Mycobacterium
ESRP

SEQ ID NO: 1147790 - protein, 7 aa, Mycobacterium
ESRPEDR

SEQ ID NO: 1147791 - protein, 4 aa, Mycobacterium
ESRY

SEQ ID NO: 1147792 - protein, 4 aa, Mycobacterium
ESSR

SEQ ID NO: 1147793 - protein, 5 aa, Mycobacterium
ESTRG

SEQ ID NO: 1147794 - protein, 15 aa, Mycobacterium
ESTSWPGVTRPTNLG

SEQ ID NO: 1147795 - protein, 8 aa, Mycobacterium
ESVTEGTV

SEQ ID NO: 1147796 - protein, 5 aa, Mycobacterium
ESVTS

SEQ ID NO: 1147797 - protein, 5 aa, Mycobacterium
ESYGV

SEQ ID NO: 1147798 - protein, 6 aa, Mycobacterium
ETADDS

SEQ ID NO: 1147799 - protein, 4 aa, Mycobacterium
ETDG

SEQ ID NO: 1147800 - protein, 5 aa, Mycobacterium
ETDGG

SEQ ID NO: 1147801 - protein, 5 aa, Mycobacterium
ETDIP

SEQ ID NO: 1147802 - protein, 4 aa, Mycobacterium
ETDQ

SEQ ID NO: 1147803 - protein, 7 aa, Mycobacterium
ETDSGLD

SEQ ID NO: 1147804 - protein, 8 aa, Mycobacterium
ETGSTGDT

SEQ ID NO: 1147805 - protein, 4 aa, Mycobacterium
ETGV

SEQ ID NO: 1147806 - protein, 11 aa, Mycobacterium
ETHKEDPTGIG

SEQ ID NO: 1147807 - protein, 13 aa, Mycobacterium
ETIGRRQASRPGH

SEQ ID NO: 1147808 - protein, 5 aa, Mycobacterium
ETIKT

SEQ ID NO: 1147809 - protein, 10 aa, Mycobacterium
ETKIEPSTAR

SEQ ID NO: 1147810 - protein, 4 aa, Mycobacterium
ETMT

SEQ ID NO: 1147811 - protein, 5 aa, Mycobacterium
ETPAD

SEQ ID NO: 1147812 - protein, 6 aa, Mycobacterium
ETPLSS

SEQ ID NO: 1147813 - protein, 6 aa, Mycobacterium
ETPRGG

SEQ ID NO: 1147814 - protein, 4 aa, Mycobacterium
ETQV

SEQ ID NO: 1147815 - protein, 5 aa, Mycobacterium
ETRPM

SEQ ID NO: 1147816 - protein, 4 aa, Mycobacterium
ETRS

SEQ ID NO: 1147817 - protein, 6 aa, Mycobacterium
ETRSRS

SEQ ID NO: 1147818 - protein, 10 aa, Mycobacterium
ETSVAGEPIT

SEQ ID NO: 1147819 - protein, 5 aa, Mycobacterium
ETTAV

SEQ ID NO: 1147820 - protein, 11 aa, Mycobacterium
ETTSDLGGYKD

SEQ ID NO: 1147821 - protein, 4 aa, Mycobacterium
ETVG

SEQ ID NO: 1147822 - protein, 4 aa, Mycobacterium
ETYD

SEQ ID NO: 1147823 - protein, 9 aa, Mycobacterium
EVEEDRDED

SEQ ID NO: 1147824 - protein, 5 aa, Mycobacterium
EVERQ

SEQ ID NO: 1147825 - protein, 6 aa, Mycobacterium
EVERSG

SEQ ID NO: 1147826 - protein, 7 aa, Mycobacterium
EVGSGKT

SEQ ID NO: 1147827 - protein, 9 aa, Mycobacterium
EVGTAGQAE

SEQ ID NO: 1147828 - protein, 7 aa, Mycobacterium
EVNAEQQ

SEQ ID NO: 1147829 - protein, 4 aa, Mycobacterium
EVPA

SEQ ID NO: 1147830 - protein, 7 aa, Mycobacterium
EVPATSR

SEQ ID NO: 1147831 - protein, 4 aa, Mycobacterium
EVPT

SEQ ID NO: 1147832 - protein, 12 aa, Mycobacterium
EVTEDGSPQGAR

SEQ ID NO: 1147833 - protein, 5 aa, Mycobacterium
EVTGD

SEQ ID NO: 1147834 - protein, 9 aa, Mycobacterium
EWDDPQGVP

SEQ ID NO: 1147835 - protein, 8 aa, Mycobacterium
EWGRDPAG

SEQ ID NO: 1147836 - protein, 10 aa, Mycobacterium
EYEVGNPSAV

SEQ ID NO: 1147837 - protein, 4 aa, Mycobacterium
EYGG

SEQ ID NO: 1147838 - protein, 6 aa, Mycobacterium
EYGGMG

SEQ ID NO: 1147839 - protein, 4 aa, Mycobacterium
EYGT

SEQ ID NO: 1147840 - protein, 6 aa, Mycobacterium
EYKSPR

SEQ ID NO: 1147841 - protein, 8 aa, Mycobacterium
FADAGSDG

SEQ ID NO: 1147842 - protein, 4 aa, Mycobacterium
FADP

SEQ ID NO: 1147843 - protein, 9 aa, Mycobacterium
FAEDSPEAY

SEQ ID NO: 1147844 - protein, 11 aa, Mycobacterium
FAGEKSKDDPF

SEQ ID NO: 1147845 - protein, 4 aa, Mycobacterium
FAGQ

SEQ ID NO: 1147846 - protein, 9 aa, Mycobacterium
FAGQRDTID

SEQ ID NO: 1147847 - protein, 14 aa, Mycobacterium
FAPGTGTPEIGGMT

SEQ ID NO: 1147848 - protein, 4 aa, Mycobacterium
FAPP

SEQ ID NO: 1147849 - protein, 5 aa, Mycobacterium
FAPTR

SEQ ID NO: 1147850 - protein, 11 aa, Mycobacterium
FASGTSSRSSK

SEQ ID NO: 1147851 - protein, 9 aa, Mycobacterium
FATGEPIAD

SEQ ID NO: 1147852 - protein, 4 aa, Mycobacterium
FDGA

SEQ ID NO: 1147853 - protein, 4 aa, Mycobacterium
FDGD

SEQ ID NO: 1147854 - protein, 11 aa, Mycobacterium
FDGDEQARARP

SEQ ID NO: 1147855 - protein, 10 aa, Mycobacterium
FDGRSGEPFP

SEQ ID NO: 1147856 - protein, 8 aa, Mycobacterium
FDNDPDLP

SEQ ID NO: 1147857 - protein, 4 aa, Mycobacterium
FDPE

SEQ ID NO: 1147858 - protein, 8 aa, Mycobacterium
FDPQAKGL

SEQ ID NO: 1147859 - protein, 9 aa, Mycobacterium
FDTPYPPAR

SEQ ID NO: 1147860 - protein, 6 aa, Mycobacterium
FDTTTA

SEQ ID NO: 1147861 - protein, 4 aa, Mycobacterium
FENR

SEQ ID NO: 1147862 - protein, 10 aa, Mycobacterium
FEQPSPQPGV

SEQ ID NO: 1147863 - protein, 10 aa, Mycobacterium
FESGEEGREQ

SEQ ID NO: 1147864 - protein, 10 aa, Mycobacterium
FETARRRGSV

SEQ ID NO: 1147865 - protein, 8 aa, Mycobacterium
FGAEPNTQ

SEQ ID NO: 1147866 - protein, 9 aa, Mycobacterium
FGASGRNGG

SEQ ID NO: 1147867 - protein, 4 aa, Mycobacterium
FGDD

SEQ ID NO: 1147868 - protein, 11 aa, Mycobacterium
FGDGGPPDNGA

SEQ ID NO: 1147869 - protein, 10 aa, Mycobacterium
FGGEESAGAS

SEQ ID NO: 1147870 - protein, 7 aa, Mycobacterium
FGGGGRG

SEQ ID NO: 1147871 - protein, 8 aa, Mycobacterium
FGGPGNSY

SEQ ID NO: 1147872 - protein, 4 aa, Mycobacterium
FGGS

SEQ ID NO: 1147873 - protein, 4 aa, Mycobacterium
FGKP

SEQ ID NO: 1147874 - protein, 7 aa, Mycobacterium
FGQTETT

SEQ ID NO: 1147875 - protein, 10 aa, Mycobacterium
FGRNGADIER

SEQ ID NO: 1147876 - protein, 6 aa, Mycobacterium
FGSAGE

SEQ ID NO: 1147877 - protein, 8 aa, Mycobacterium
FGSGGGEA

SEQ ID NO: 1147878 - protein, 10 aa, Mycobacterium
FGTAEESNRR

SEQ ID NO: 1147879 - protein, 8 aa, Mycobacterium
FGTQEGGA

SEQ ID NO: 1147880 - protein, 5 aa, Mycobacterium
FHGPG

SEQ ID NO: 1147881 - protein, 9 aa, Mycobacterium
FKEETETDL

SEQ ID NO: 1147882 - protein, 14 aa, Mycobacterium
FKPDSDDVRDSPAL

SEQ ID NO: 1147883 - protein, 19 aa, Mycobacterium
FNASGDNTAAGSSAGRRTV

SEQ ID NO: 1147884 - protein, 9 aa, Mycobacterium
FPDSHPQNL

SEQ ID NO: 1147885 - protein, 6 aa, Mycobacterium
FPEETR

SEQ ID NO: 1147886 - protein, 6 aa, Mycobacterium
FPESYD

SEQ ID NO: 1147887 - protein, 8 aa, Mycobacterium
FPGGPPPR

SEQ ID NO: 1147888 - protein, 4 aa, Mycobacterium
FPKP

SEQ ID NO: 1147889 - protein, 9 aa, Mycobacterium
FPPKPARPA

SEQ ID NO: 1147890 - protein, 4 aa, Mycobacterium
FPPV

SEQ ID NO: 1147891 - protein, 7 aa, Mycobacterium
FPRPDDP

SEQ ID NO: 1147892 - protein, 4 aa, Mycobacterium
FPTA

SEQ ID NO: 1147893 - protein, 5 aa, Mycobacterium
FQETT

SEQ ID NO: 1147894 - protein, 5 aa, Mycobacterium
FRDPD

SEQ ID NO: 1147895 - protein, 9 aa, Mycobacterium
FRGRTTGPW

SEQ ID NO: 1147896 - protein, 5 aa, Mycobacterium
FRGTD

SEQ ID NO: 1147897 - protein, 17 aa, Mycobacterium
FRPDRGHAKSARSVAET

SEQ ID NO: 1147898 - protein, 9 aa, Mycobacterium
FRPGKAPRK

SEQ ID NO: 1147899 - protein, 5 aa, Mycobacterium
FRQDT

SEQ ID NO: 1147900 - protein, 4 aa, Mycobacterium
FRSH

SEQ ID NO: 1147901 - protein, 4 aa, Mycobacterium
FRTG

SEQ ID NO: 1147902 - protein, 4 aa, Mycobacterium
FSDS

SEQ ID NO: 1147903 - protein, 7 aa, Mycobacterium
FSGRAQI

SEQ ID NO: 1147904 - protein, 9 aa, Mycobacterium
FSGTSPDGH

SEQ ID NO: 1147905 - protein, 7 aa, Mycobacterium
FSPHRGP

SEQ ID NO: 1147906 - protein, 4 aa, Mycobacterium
FTGK

SEQ ID NO: 1147907 - protein, 11 aa, Mycobacterium
FTGQPGSTVPL

SEQ ID NO: 1147908 - protein, 5 aa, Mycobacterium
FTGSN

SEQ ID NO: 1147909 - protein, 18 aa, Mycobacterium
FTPGERRDAADKSSSAAR

SEQ ID NO: 1147910 - protein, 6 aa, Mycobacterium
FTPSGA

SEQ ID NO: 1147911 - protein, 4 aa, Mycobacterium
FTRG

SEQ ID NO: 1147912 - protein, 12 aa, Mycobacterium
FTTAEPDYRRDE

SEQ ID NO: 1147913 - protein, 9 aa, Mycobacterium
GAAAVSSAA

SEQ ID NO: 1147914 - protein, 7 aa, Mycobacterium
GAAEGAI

SEQ ID NO: 1147915 - protein, 10 aa, Mycobacterium
GAAGSGSQRL

SEQ ID NO: 1147916 - protein, 14 aa, Mycobacterium
GAAKSDFEMVEVAR

SEQ ID NO: 1147917 - protein, 7 aa, Mycobacterium
GAATEVE

SEQ ID NO: 1147918 - protein, 5 aa, Mycobacterium
GADAV

SEQ ID NO: 1147919 - protein, 17 aa, Mycobacterium
GADGRTKDTKAVNPEST

SEQ ID NO: 1147920 - protein, 5 aa, Mycobacterium
GADGS

SEQ ID NO: 1147921 - protein, 8 aa, Mycobacterium
GADPQQTL

SEQ ID NO: 1147922 - protein, 9 aa, Mycobacterium
GADTAATAR

SEQ ID NO: 1147923 - protein, 5 aa, Mycobacterium
GADTP

SEQ ID NO: 1147924 - protein, 8 aa, Mycobacterium
GADTVRRV

SEQ ID NO: 1147925 - protein, 8 aa, Mycobacterium
GAEAVESG

SEQ ID NO: 1147926 - protein, 6 aa, Mycobacterium
GAEDTN

SEQ ID NO: 1147927 - protein, 4 aa, Mycobacterium
GAEP

SEQ ID NO: 1147928 - protein, 9 aa, Mycobacterium
GAEPVEPAD

SEQ ID NO: 1147929 - protein, 6 aa, Mycobacterium
GAESGD

SEQ ID NO: 1147930 - protein, 7 aa, Mycobacterium
GAESRSE

SEQ ID NO: 1147931 - protein, 6 aa, Mycobacterium
GAGEHG

SEQ ID NO: 1147932 - protein, 10 aa, Mycobacterium
GAGGAPTASA

SEQ ID NO: 1147933 - protein, 10 aa, Mycobacterium
GAGGGGIGTT

SEQ ID NO: 1147934 - protein, 9 aa, Mycobacterium
GAGGGIGQA

SEQ ID NO: 1147935 - protein, 13 aa, Mycobacterium
GAGGQGDALILRR

SEQ ID NO: 1147936 - protein, 7 aa, Mycobacterium
GAGGTVS

SEQ ID NO: 1147937 - protein, 9 aa, Mycobacterium
GAGKGVGQG

SEQ ID NO: 1147938 - protein, 9 aa, Mycobacterium
GAGNETTGR

SEQ ID NO: 1147939 - protein, 16 aa, Mycobacterium
GAGPGSGAARKETVDR

SEQ ID NO: 1147940 - protein, 9 aa, Mycobacterium
GAGQMPARQ

SEQ ID NO: 1147941 - protein, 14 aa, Mycobacterium
GAGSTGSRLVTGNT

SEQ ID NO: 1147942 - protein, 7 aa, Mycobacterium
GAGTGAA

SEQ ID NO: 1147943 - protein, 8 aa, Mycobacterium
GAHADTGV

SEQ ID NO: 1147944 - protein, 4 aa, Mycobacterium
GAHD

SEQ ID NO: 1147945 - protein, 7 aa, Mycobacterium
GAHGGTV

SEQ ID NO: 1147946 - protein, 4 aa, Mycobacterium
GAHI

SEQ ID NO: 1147947 - protein, 6 aa, Mycobacterium
GAHPTA

SEQ ID NO: 1147948 - protein, 6 aa, Mycobacterium
GAIGRR

SEQ ID NO: 1147949 - protein, 14 aa, Mycobacterium
GAIPRTSSGKIGRR

SEQ ID NO: 1147950 - protein, 12 aa, Mycobacterium
GALNGQTATMTG

SEQ ID NO: 1147951 - protein, 10 aa, Mycobacterium
GALPITKASD

SEQ ID NO: 1147952 - protein, 4 aa, Mycobacterium
GALT

SEQ ID NO: 1147953 - protein, 10 aa, Mycobacterium
GAMGGSASEE

SEQ ID NO: 1147954 - protein, 10 aa, Mycobacterium
GANDGGGSIR

SEQ ID NO: 1147955 - protein, 7 aa, Mycobacterium
GANDLGG

SEQ ID NO: 1147956 - protein, 10 aa, Mycobacterium
GANGSGKSTL

SEQ ID NO: 1147957 - protein, 4 aa, Mycobacterium
GANN

SEQ ID NO: 1147958 - protein, 6 aa, Mycobacterium
GANQTF

SEQ ID NO: 1147959 - protein, 5 aa, Mycobacterium
GANRG

SEQ ID NO: 1147960 - protein, 7 aa, Mycobacterium
GAPAAVN

SEQ ID NO: 1147961 - protein, 7 aa, Mycobacterium
GAPDEEW

SEQ ID NO: 1147962 - protein, 6 aa, Mycobacterium
GAPGEG

SEQ ID NO: 1147963 - protein, 6 aa, Mycobacterium
GAPGHE

SEQ ID NO: 1147964 - protein, 4 aa, Mycobacterium
GAPL

SEQ ID NO: 1147965 - protein, 7 aa, Mycobacterium
GAPQVNA

SEQ ID NO: 1147966 - protein, 9 aa, Mycobacterium
GAPSALTVR

SEQ ID NO: 1147967 - protein, 9 aa, Mycobacterium
GAPTITNDG

SEQ ID NO: 1147968 - protein, 5 aa, Mycobacterium
GAPTV

SEQ ID NO: 1147969 - protein, 9 aa, Mycobacterium
GAQGGSNGG

SEQ ID NO: 1147970 - protein, 12 aa, Mycobacterium
GAQSGIGGGGRY

SEQ ID NO: 1147971 - protein, 8 aa, Mycobacterium
GARADSVP

SEQ ID NO: 1147972 - protein, 6 aa, Mycobacterium
GARAGE

SEQ ID NO: 1147973 - protein, 7 aa, Mycobacterium
GARDGRT

SEQ ID NO: 1147974 - protein, 6 aa, Mycobacterium
GAREVS

SEQ ID NO: 1147975 - protein, 4 aa, Mycobacterium
GARI

SEQ ID NO: 1147976 - protein, 18 aa, Mycobacterium
GARKGLADTALRTADSGY

SEQ ID NO: 1147977 - protein, 24 aa, Mycobacterium
GARTPSRLQPRQAARVQTGAPMPT

SEQ ID NO: 1147978 - protein, 4 aa, Mycobacterium
GASA

SEQ ID NO: 1147979 - protein, 10 aa, Mycobacterium
GASADRPEHT

SEQ ID NO: 1147980 - protein, 5 aa, Mycobacterium
GASEG

SEQ ID NO: 1147981 - protein, 10 aa, Mycobacterium
GASGSGKSSL

SEQ ID NO: 1147982 - protein, 8 aa, Mycobacterium
GASLDGEQ

SEQ ID NO: 1147983 - protein, 8 aa, Mycobacterium
GASPGGDL

SEQ ID NO: 1147984 - protein, 18 aa, Mycobacterium
GASSTGISRKLPDTERQR

SEQ ID NO: 1147985 - protein, 7 aa, Mycobacterium
GASYGGA

SEQ ID NO: 1147986 - protein, 4 aa, Mycobacterium
GATA

SEQ ID NO: 1147987 - protein, 10 aa, Mycobacterium
GATGTGKTKS

SEQ ID NO: 1147988 - protein, 5 aa, Mycobacterium
GATPV

SEQ ID NO: 1147989 - protein, 9 aa, Mycobacterium
GATQGHSGT

SEQ ID NO: 1147990 - protein, 8 aa, Mycobacterium
GATSRAPR

SEQ ID NO: 1147991 - protein, 5 aa, Mycobacterium
GAVDP

SEQ ID NO: 1147992 - protein, 5 aa, Mycobacterium
GAVPG

SEQ ID NO: 1147993 - protein, 12 aa, Mycobacterium
GAVPKDGPSAGV

SEQ ID NO: 1147994 - protein, 7 aa, Mycobacterium
GAVPRTS

SEQ ID NO: 1147995 - protein, 10 aa, Mycobacterium
GAVTEDPSAS

SEQ ID NO: 1147996 - protein, 4 aa, Mycobacterium
GAWE

SEQ ID NO: 1147997 - protein, 5 aa, Mycobacterium
GAYGD

SEQ ID NO: 1147998 - protein, 11 aa, Mycobacterium
GCRPNPGPGGW

SEQ ID NO: 1147999 - protein, 6 aa, Mycobacterium
GCSPGD

SEQ ID NO: 1148000 - protein, 8 aa, Mycobacterium
GDAARDAK

SEQ ID NO: 1148001 - protein, 4 aa, Mycobacterium
GDAL

SEQ ID NO: 1148002 - protein, 14 aa, Mycobacterium
GDANLSGHTYPDQS

SEQ ID NO: 1148003 - protein, 4 aa, Mycobacterium
GDAP

SEQ ID NO: 1148004 - protein, 5 aa, Mycobacterium
GDARE

SEQ ID NO: 1148005 - protein, 7 aa, Mycobacterium
GDCTEAD

SEQ ID NO: 1148006 - protein, 6 aa, Mycobacterium
GDDERR

SEQ ID NO: 1148007 - protein, 5 aa, Mycobacterium
GDDGE

SEQ ID NO: 1148008 - protein, 6 aa, Mycobacterium
GDDPEA

SEQ ID NO: 1148009 - protein, 9 aa, Mycobacterium
GDDPGSQAY

SEQ ID NO: 1148010 - protein, 7 aa, Mycobacterium
GDDTPFS

SEQ ID NO: 1148011 - protein, 4 aa, Mycobacterium
GDDV

SEQ ID NO: 1148012 - protein, 5 aa, Mycobacterium
GDDVH

SEQ ID NO: 1148013 - protein, 13 aa, Mycobacterium
GDEAKAETVSAER

SEQ ID NO: 1148014 - protein, 11 aa, Mycobacterium
GDEGKGKATDL

SEQ ID NO: 1148015 - protein, 4 aa, Mycobacterium
GDEP

SEQ ID NO: 1148016 - protein, 7 aa, Mycobacterium
GDEPLKR

SEQ ID NO: 1148017 - protein, 4 aa, Mycobacterium
GDGH

SEQ ID NO: 1148018 - protein, 7 aa, Mycobacterium
GDGTQAL

SEQ ID NO: 1148019 - protein, 12 aa, Mycobacterium
GDGTTRTANDEA

SEQ ID NO: 1148020 - protein, 6 aa, Mycobacterium
GDGTVN

SEQ ID NO: 1148021 - protein, 6 aa, Mycobacterium
GDGVPA

SEQ ID NO: 1148022 - protein, 4 aa, Mycobacterium
GDHT

SEQ ID NO: 1148023 - protein, 19 aa, Mycobacterium
GDIEEGVTSEASSLAGTQQ

SEQ ID NO: 1148024 - protein, 8 aa, Mycobacterium
GDLEKEKG

SEQ ID NO: 1148025 - protein, 7 aa, Mycobacterium
GDLTPTM

SEQ ID NO: 1148026 - protein, 8 aa, Mycobacterium
GDNGSGMH

SEQ ID NO: 1148027 - protein, 5 aa, Mycobacterium
GDNTD

SEQ ID NO: 1148028 - protein, 4 aa, Mycobacterium
GDPA

SEQ ID NO: 1148029 - protein, 6 aa, Mycobacterium
GDPDAF

SEQ ID NO: 1148030 - protein, 6 aa, Mycobacterium
GDPETQ

SEQ ID NO: 1148031 - protein, 7 aa, Mycobacterium
GDPGVGK

SEQ ID NO: 1148032 - protein, 7 aa, Mycobacterium
GDPRFSD

SEQ ID NO: 1148033 - protein, 5 aa, Mycobacterium
GDPSM

SEQ ID NO: 1148034 - protein, 5 aa, Mycobacterium
GDQGV

SEQ ID NO: 1148035 - protein, 14 aa, Mycobacterium
GDQHPSPIDPNFTG

SEQ ID NO: 1148036 - protein, 4 aa, Mycobacterium
GDQQ

SEQ ID NO: 1148037 - protein, 5 aa, Mycobacterium
GDQRA

SEQ ID NO: 1148038 - protein, 36 aa, Mycobacterium; identical to SEQ ID NO: 481701

SEQ ID NO: 1148039 - protein, 6 aa, Mycobacterium
GDRAKN

SEQ ID NO: 1148040 - protein, 14 aa, Mycobacterium
GDSAGGSAKSGRDS

SEQ ID NO: 1148041 - protein, 4 aa, Mycobacterium
GDSE

SEQ ID NO: 1148042 - protein, 9 aa, Mycobacterium
GDSGDGMQL

SEQ ID NO: 1148043 - protein, 7 aa, Mycobacterium
GDSPAGL

SEQ ID NO: 1148044 - protein, 10 aa, Mycobacterium
GDSPGSKYDK

SEQ ID NO: 1148045 - protein, 8 aa, Mycobacterium
GDTAPKAA

SEQ ID NO: 1148046 - protein, 5 aa, Mycobacterium
GDTKT

SEQ ID NO: 1148047 - protein, 4 aa, Mycobacterium
GDTY

SEQ ID NO: 1148048 - protein, 4 aa, Mycobacterium
GDVD

SEQ ID NO: 1148049 - protein, 4 aa, Mycobacterium
GEAD

SEQ ID NO: 1148050 - protein, 6 aa, Mycobacterium
GEAFGR

SEQ ID NO: 1148051 - protein, 8 aa, Mycobacterium
GEAGDPVD

SEQ ID NO: 1148052 - protein, 6 aa, Mycobacterium
GEAGFG

SEQ ID NO: 1148053 - protein, 6 aa, Mycobacterium
GEAGLD

SEQ ID NO: 1148054 - protein, 4 aa, Mycobacterium
GEAL

SEQ ID NO: 1148055 - protein, 9 aa, Mycobacterium
GEANPRADI

SEQ ID NO: 1148056 - protein, 7 aa, Mycobacterium
GEDAGRG

SEQ ID NO: 1148057 - protein, 7 aa, Mycobacterium
GEDTTSA

SEQ ID NO: 1148058 - protein, 10 aa, Mycobacterium
GEEESGSPSL

SEQ ID NO: 1148059 - protein, 5 aa, Mycobacterium
GEENA

SEQ ID NO: 1148060 - protein, 5 aa, Mycobacterium
GEGDP

SEQ ID NO: 1148061 - protein, 13 aa, Mycobacterium
GEGGGTGTGGAPV

SEQ ID NO: 1148062 - protein, 5 aa, Mycobacterium
GEGPA

SEQ ID NO: 1148063 - protein, 10 aa, Mycobacterium
GEGQHQDTGA

SEQ ID NO: 1148064 - protein, 5 aa, Mycobacterium
GEGTL

SEQ ID NO: 1148065 - protein, 5 aa, Mycobacterium
GEGTT

SEQ ID NO: 1148066 - protein, 4 aa, Mycobacterium
GEGV

SEQ ID NO: 1148067 - protein, 10 aa, Mycobacterium
GEGVAAKSLE

SEQ ID NO: 1148068 - protein, 8 aa, Mycobacterium
GEHPGPAN

SEQ ID NO: 1148069 - protein, 4 aa, Mycobacterium
GEIE

SEQ ID NO: 1148070 - protein, 9 aa, Mycobacterium
GEINTVTGN

SEQ ID NO: 1148071 - protein, 5 aa, Mycobacterium
GEIPT

SEQ ID NO: 1148072 - protein, 4 aa, Mycobacterium
GELP

SEQ ID NO: 1148073 - protein, 9 aa, Mycobacterium
GEMDEPESR

SEQ ID NO: 1148074 - protein, 5 aa, Mycobacterium
GENPE

SEQ ID NO: 1148075 - protein, 8 aa, Mycobacterium
GENPHQQA

SEQ ID NO: 1148076 - protein, 7 aa, Mycobacterium
GEPEPGQ

SEQ ID NO: 1148077 - protein, 6 aa, Mycobacterium
GEPGAL

SEQ ID NO: 1148078 - protein, 6 aa, Mycobacterium
GEPGDG

SEQ ID NO: 1148079 - protein, 6 aa, Mycobacterium
GEPINP

SEQ ID NO: 1148080 - protein, 10 aa, Mycobacterium
GEPQQNPDRP

SEQ ID NO: 1148081 - protein, 7 aa, Mycobacterium
GEPRYGD

SEQ ID NO: 1148082 - protein, 9 aa, Mycobacterium
GEPVSLSPT

SEQ ID NO: 1148083 - protein, 5 aa, Mycobacterium
GEQAA

SEQ ID NO: 1148084 - protein, 4 aa, Mycobacterium
GERH

SEQ ID NO: 1148085 - protein, 6 aa, Mycobacterium
GERRLK

SEQ ID NO: 1148086 - protein, 7 aa, Mycobacterium
GERRRAI

SEQ ID NO: 1148087 - protein, 5 aa, Mycobacterium
GERSL

SEQ ID NO: 1148088 - protein, 4 aa, Mycobacterium
GERT

SEQ ID NO: 1148089 - protein, 6 aa, Mycobacterium
GERTKR

SEQ ID NO: 1148090 - protein, 8 aa, Mycobacterium
GERTREGN

SEQ ID NO: 1148091 - protein, 11 aa, Mycobacterium
GERTTPAGAEA

SEQ ID NO: 1148092 - protein, 10 aa, Mycobacterium
GESDSGRAHA

SEQ ID NO: 1148093 - protein, 12 aa, Mycobacterium
GESEETSKLSRE

SEQ ID NO: 1148094 - protein, 11 aa, Mycobacterium
GESGSGKSTTL

SEQ ID NO: 1148095 - protein, 6 aa, Mycobacterium
GESGYF

SEQ ID NO: 1148096 - protein, 9 aa, Mycobacterium
GESHDTPKT

SEQ ID NO: 1148097 - protein, 8 aa, Mycobacterium
GETAEHPG

SEQ ID NO: 1148098 - protein, 8 aa, Mycobacterium
GETAEQTA

SEQ ID NO: 1148099 - protein, 9 aa, Mycobacterium
GETEAKTNA

SEQ ID NO: 1148100 - protein, 6 aa, Mycobacterium
GETGGK

SEQ ID NO: 1148101 - protein, 11 aa, Mycobacterium
GETGSGKTTQL

SEQ ID NO: 1148102 - protein, 11 aa, Mycobacterium
GETPPKTPCQN

SEQ ID NO: 1148103 - protein, 6 aa, Mycobacterium
GETPSG

SEQ ID NO: 1148104 - protein, 10 aa, Mycobacterium
GEVGNAEQAN

SEQ ID NO: 1148105 - protein, 7 aa, Mycobacterium
GEVSRGQ

SEQ ID NO: 1148106 - protein, 17 aa, Mycobacterium
GEWTRRRAGGDAGARRL

SEQ ID NO: 1148107 - protein, 6 aa, Mycobacterium
GEYDER

SEQ ID NO: 1148108 - protein, 6 aa, Mycobacterium
GEYSSY

SEQ ID NO: 1148109 - protein, 6 aa, Mycobacterium
GFEGNA

SEQ ID NO: 1148110 - protein, 5 aa, Mycobacterium
GFEHN

SEQ ID NO: 1148111 - protein, 5 aa, Mycobacterium
GFGPE

SEQ ID NO: 1148112 - protein, 6 aa, Mycobacterium
GFGTSG

SEQ ID NO: 1148113 - protein, 12 aa, Mycobacterium
GFKGSRKSTPFA

SEQ ID NO: 1148114 - protein, 4 aa, Mycobacterium
GFSG

SEQ ID NO: 1148115 - protein, 6 aa, Mycobacterium
GFTPGR

SEQ ID NO: 1148116 - protein, 7 aa, Mycobacterium
GGAAAAY

SEQ ID NO: 1148117 - protein, 6 aa, Mycobacterium
GGAAAR

SEQ ID NO: 1148118 - protein, 5 aa, Mycobacterium
GGAAH

SEQ ID NO: 1148119 - protein, 8 aa, Mycobacterium
GGAAPATW

SEQ ID NO: 1148120 - protein, 8 aa, Mycobacterium
GGAAYGPA

SEQ ID NO: 1148121 - protein, 7 aa, Mycobacterium
GGAEFAS

SEQ ID NO: 1148122 - protein, 5 aa, Mycobacterium
GGAGM

SEQ ID NO: 1148123 - protein, 5 aa, Mycobacterium
GGALD

SEQ ID NO: 1148124 - protein, 4 aa, Mycobacterium
GGAN

SEQ ID NO: 1148125 - protein, 8 aa, Mycobacterium
GGAPGASS

SEQ ID NO: 1148126 - protein, 14 aa, Mycobacterium
GGARDGTGAGSAMA

SEQ ID NO: 1148127 - protein, 7 aa, Mycobacterium
GGARLRE

SEQ ID NO: 1148128 - protein, 6 aa, Mycobacterium
GGARNA

SEQ ID NO: 1148129 - protein, 14 aa, Mycobacterium
GGARRDEEKARAKE

SEQ ID NO: 1148130 - protein, 6 aa, Mycobacterium
GGASAE

SEQ ID NO: 1148131 - protein, 10 aa, Mycobacterium
GGASAGGGLA

SEQ ID NO: 1148132 - protein, 8 aa, Mycobacterium
GGASGIGL

SEQ ID NO: 1148133 - protein, 9 aa, Mycobacterium
GGASGIGRG

SEQ ID NO: 1148134 - protein, 9 aa, Mycobacterium
GGASGLGLA

SEQ ID NO: 1148135 - protein, 5 aa, Mycobacterium
GGATG

SEQ ID NO: 1148136 - protein, 8 aa, Mycobacterium
GGCTKPGC

SEQ ID NO: 1148137 - protein, 4 aa, Mycobacterium
GGDA

SEQ ID NO: 1148138 - protein, 10 aa, Mycobacterium
GGDAEERAAD

SEQ ID NO: 1148139 - protein, 9 aa, Mycobacterium
GGDATGAEV

SEQ ID NO: 1148140 - protein, 16 aa, Mycobacterium
GGDDDELTRGKSPEEL

SEQ ID NO: 1148141 - protein, 14 aa, Mycobacterium
GGDKVPRKGGPGVT

SEQ ID NO: 1148142 - protein, 7 aa, Mycobacterium
GGDPVRA

SEQ ID NO: 1148143 - protein, 11 aa, Mycobacterium
GGDRDGNPNVT

SEQ ID NO: 1148144 - protein, 5 aa, Mycobacterium
GGDTG

SEQ ID NO: 1148145 - protein, 11 aa, Mycobacterium
GGEAGGHSGEV

SEQ ID NO: 1148146 - protein, 15 aa, Mycobacterium
GGEAPTAASWGAANR

SEQ ID NO: 1148147 - protein, 6 aa, Mycobacterium
GGECPL

SEQ ID NO: 1148148 - protein, 10 aa, Mycobacterium
GGEEDGVEAE

SEQ ID NO: 1148149 - protein, 5 aa, Mycobacterium
GGEKV

SEQ ID NO: 1148150 - protein, 5 aa, Mycobacterium
GGEPT

SEQ ID NO: 1148151 - protein, 7 aa, Mycobacterium
GGEPTVR

SEQ ID NO: 1148152 - protein, 5 aa, Mycobacterium
GGERL

SEQ ID NO: 1148153 - protein, 8 aa, Mycobacterium
GGEYAGTR

SEQ ID NO: 1148154 - protein, 8 aa, Mycobacterium
GGGAATDV

SEQ ID NO: 1148155 - protein, 6 aa, Mycobacterium
GGGDQW

SEQ ID NO: 1148156 - protein, 8 aa, Mycobacterium
GGGDSAAA

SEQ ID NO: 1148157 - protein, 7 aa, Mycobacterium
GGGEAVE

SEQ ID NO: 1148158 - protein, 10 aa, Mycobacterium
GGGELGYGSD

SEQ ID NO: 1148159 - protein, 8 aa, Mycobacterium
GGGGAMSG

SEQ ID NO: 1148160 - protein, 9 aa, Mycobacterium
GGGGPGVGP

SEQ ID NO: 1148161 - protein, 9 aa, Mycobacterium
GGGLGKGGT

SEQ ID NO: 1148162 - protein, 6 aa, Mycobacterium
GGGQVT

SEQ ID NO: 1148163 - protein, 9 aa, Mycobacterium
GGGRAKALA

SEQ ID NO: 1148164 - protein, 10 aa, Mycobacterium
GGGRPADRDT

SEQ ID NO: 1148165 - protein, 7 aa, Mycobacterium
GGGSGIG

SEQ ID NO: 1148166 - protein, 9 aa, Mycobacterium
GGGSGIGKG

SEQ ID NO: 1148167 - protein, 7 aa, Mycobacterium
GGGSNLA

SEQ ID NO: 1148168 - protein, 9 aa, Mycobacterium
GGGSPRDTL

SEQ ID NO: 1148169 - protein, 6 aa, Mycobacterium
GGGSTE

SEQ ID NO: 1148170 - protein, 5 aa, Mycobacterium
GGGSV

SEQ ID NO: 1148171 - protein, 6 aa, Mycobacterium
GGGTSV

SEQ ID NO: 1148172 - protein, 4 aa, Mycobacterium
GGHA

SEQ ID NO: 1148173 - protein, 5 aa, Mycobacterium
GGHDA

SEQ ID NO: 1148174 - protein, 8 aa, Mycobacterium
GGHDAESV

SEQ ID NO: 1148175 - protein, 5 aa, Mycobacterium
GGHDY

SEQ ID NO: 1148176 - protein, 4 aa, Mycobacterium
GGHG

SEQ ID NO: 1148177 - protein, 12 aa, Mycobacterium
GGHTRDHGKAPV

SEQ ID NO: 1148178 - protein, 5 aa, Mycobacterium
GGIGA

SEQ ID NO: 1148179 - protein, 6 aa, Mycobacterium
GGIGEK

SEQ ID NO: 1148180 - protein, 8 aa, Mycobacterium
GGIGSGQQ

SEQ ID NO: 1148181 - protein, 10 aa, Mycobacterium
GGKAGTGKSA

SEQ ID NO: 1148182 - protein, 5 aa, Mycobacterium
GGKEA

SEQ ID NO: 1148183 - protein, 7 aa, Mycobacterium
GGKNVAP

SEQ ID NO: 1148184 - protein, 6 aa, Mycobacterium
GGKSPN

SEQ ID NO: 1148185 - protein, 7 aa, Mycobacterium
GGKVQAA

SEQ ID NO: 1148186 - protein, 5 aa, Mycobacterium
GGLAG

SEQ ID NO: 1148187 - protein, 5 aa, Mycobacterium
GGLDS

SEQ ID NO: 1148188 - protein, 6 aa, Mycobacterium
GGLGPD

SEQ ID NO: 1148189 - protein, 9 aa, Mycobacterium
GGLGPTADD

SEQ ID NO: 1148190 - protein, 5 aa, Mycobacterium
GGLGR

SEQ ID NO: 1148191 - protein, 7 aa, Mycobacterium
GGLNPAG

SEQ ID NO: 1148192 - protein, 4 aa, Mycobacterium
GGLP

SEQ ID NO: 1148193 - protein, 7 aa, Mycobacterium
GGLPQRQ

SEQ ID NO: 1148194 - protein, 5 aa, Mycobacterium
GGLTP

SEQ ID NO: 1148195 - protein, 6 aa, Mycobacterium
GGMRTA

SEQ ID NO: 1148196 - protein, 6 aa, Mycobacterium
GGMSDN

SEQ ID NO: 1148197 - protein, 9 aa, Mycobacterium
GGNDTTTGM

SEQ ID NO: 1148198 - protein, 7 aa, Mycobacterium
GGNNAGH

SEQ ID NO: 1148199 - protein, 8 aa, Mycobacterium
GGNVPGKK

SEQ ID NO: 1148200 - protein, 5 aa, Mycobacterium
GGPAF

SEQ ID NO: 1148201 - protein, 6 aa, Mycobacterium
GGPAGL

SEQ ID NO: 1148202 - protein, 15 aa, Mycobacterium
GGPASVYADGAPQLD

SEQ ID NO: 1148203 - protein, 4 aa, Mycobacterium
GGPE

SEQ ID NO: 1148204 - protein, 4 aa, Mycobacterium
GGPF

SEQ ID NO: 1148205 - protein, 10 aa, Mycobacterium
GGPGASSWSN

SEQ ID NO: 1148206 - protein, 8 aa, Mycobacterium
GGPGTGKT

SEQ ID NO: 1148207 - protein, 4 aa, Mycobacterium
GGPP

SEQ ID NO: 1148208 - protein, 8 aa, Mycobacterium
GGPPEGRR

SEQ ID NO: 1148209 - protein, 4 aa, Mycobacterium
GGPS

SEQ ID NO: 1148210 - protein, 4 aa, Mycobacterium
GGPT

SEQ ID NO: 1148211 - protein, 5 aa, Mycobacterium
GGPTV

SEQ ID NO: 1148212 - protein, 4 aa, Mycobacterium
GGQE

SEQ ID NO: 1148213 - protein, 6 aa, Mycobacterium
GGQGGI

SEQ ID NO: 1148214 - protein, 6 aa, Mycobacterium
GGQQQR

SEQ ID NO: 1148215 - protein, 4 aa, Mycobacterium
GGQV

SEQ ID NO: 1148216 - protein, 13 aa, Mycobacterium
GGRGIRVDVVDTD

SEQ ID NO: 1148217 - protein, 6 aa, Mycobacterium
GGRGSG

SEQ ID NO: 1148218 - protein, 9 aa, Mycobacterium
GGRGVGSAE

SEQ ID NO: 1148219 - protein, 7 aa, Mycobacterium
GGRLSRQ

SEQ ID NO: 1148220 - protein, 11 aa, Mycobacterium
GGRPTAAHRPR

SEQ ID NO: 1148221 - protein, 7 aa, Mycobacterium
GGRQASA

SEQ ID NO: 1148222 - protein, 5 aa, Mycobacterium
GGRRR

SEQ ID NO: 1148223 - protein, 7 aa, Mycobacterium
GGRSQRV

SEQ ID NO: 1148224 - protein, 5 aa, Mycobacterium
GGRYT

SEQ ID NO: 1148225 - protein, 5 aa, Mycobacterium
GGSAG

SEQ ID NO: 1148226 - protein, 6 aa, Mycobacterium
GGSDQW

SEQ ID NO: 1148227 - protein, 10 aa, Mycobacterium
GGSGALAGHP

SEQ ID NO: 1148228 - protein, 7 aa, Mycobacterium
GGSRGLG

SEQ ID NO: 1148229 - protein, 5 aa, Mycobacterium
GGSTY

SEQ ID NO: 1148230 - protein, 4 aa, Mycobacterium
GGTD

SEQ ID NO: 1148231 - protein, 9 aa, Mycobacterium
GGTGAGKTT

SEQ ID NO: 1148232 - protein, 6 aa, Mycobacterium
GGTGDW

SEQ ID NO: 1148233 - protein, 16 aa, Mycobacterium
GGTGPAEGSKATTVTP

SEQ ID NO: 1148234 - protein, 5 aa, Mycobacterium
GGTMP

SEQ ID NO: 1148235 - protein, 7 aa, Mycobacterium
GGTNEIQ

SEQ ID NO: 1148236 - protein, 4 aa, Mycobacterium
GGTR

SEQ ID NO: 1148237 - protein, 13 aa, Mycobacterium
GGTVGRGGGPSYD

SEQ ID NO: 1148238 - protein, 6 aa, Mycobacterium
GGVDSA

SEQ ID NO: 1148239 - protein, 10 aa, Mycobacterium
GGVDSTALYP

SEQ ID NO: 1148240 - protein, 7 aa, Mycobacterium
GGVGKTA

SEQ ID NO: 1148241 - protein, 10 aa, Mycobacterium
GGVGKTTTAA

SEQ ID NO: 1148242 - protein, 7 aa, Mycobacterium
GGVSAGA

SEQ ID NO: 1148243 - protein, 5 aa, Mycobacterium
GGVTK

SEQ ID NO: 1148244 - protein, 8 aa, Mycobacterium
GHAGTLDP

SEQ ID NO: 1148245 - protein, 10 aa, Mycobacterium
GHASATGRFD

SEQ ID NO: 1148246 - protein, 6 aa, Mycobacterium
GHATPT

SEQ ID NO: 1148247 - protein, 4 aa, Mycobacterium
GHDQ

SEQ ID NO: 1148248 - protein, 5 aa, Mycobacterium
GHEGA

SEQ ID NO: 1148249 - protein, 6 aa, Mycobacterium
GHEPDN

SEQ ID NO: 1148250 - protein, 8 aa, Mycobacterium
GHGRGRRA

SEQ ID NO: 1148251 - protein, 13 aa, Mycobacterium
GHNEGDDPSMTQP

SEQ ID NO: 1148252 - protein, 13 aa, Mycobacterium
GHPDPSSGTIDAP

SEQ ID NO: 1148253 - protein, 7 aa, Mycobacterium
GHSYGGR

SEQ ID NO: 1148254 - protein, 7 aa, Mycobacterium
GHTQPRR

SEQ ID NO: 1148255 - protein, 7 aa, Mycobacterium
GIATPAD

SEQ ID NO: 1148256 - protein, 12 aa, Mycobacterium
GIEPSEVTPEKS

SEQ ID NO: 1148257 - protein, 5 aa, Mycobacterium
GIGDT

SEQ ID NO: 1148258 - protein, 4 aa, Mycobacterium
GIGG

SEQ ID NO: 1148259 - protein, 5 aa, Mycobacterium
GIGTA

SEQ ID NO: 1148260 - protein, 9 aa, Mycobacterium
GIGTPERAA

SEQ ID NO: 1148261 - protein, 4 aa, Mycobacterium
GIGY

SEQ ID NO: 1148262 - protein, 5 aa, Mycobacterium
GIHER

SEQ ID NO: 1148263 - protein, 4 aa, Mycobacterium
GIPA

SEQ ID NO: 1148264 - protein, 7 aa, Mycobacterium
GIPEAEK

SEQ ID NO: 1148265 - protein, 13 aa, Mycobacterium
GIPGSAGATPVQN

SEQ ID NO: 1148266 - protein, 9 aa, Mycobacterium
GIRRGGTVE

SEQ ID NO: 1148267 - protein, 14 aa, Mycobacterium
GISDSKFSRANDRR

SEQ ID NO: 1148268 - protein, 4 aa, Mycobacterium
GISI

SEQ ID NO: 1148269 - protein, 8 aa, Mycobacterium
GISPPEDD

SEQ ID NO: 1148270 - protein, 6 aa, Mycobacterium
GISSPL

SEQ ID NO: 1148271 - protein, 4 aa, Mycobacterium
GITR

SEQ ID NO: 1148272 - protein, 17 aa, Mycobacterium
GKANRLPAELSGGEQQR

SEQ ID NO: 1148273 - protein, 8 aa, Mycobacterium
GKAQPGQV

SEQ ID NO: 1148274 - protein, 5 aa, Mycobacterium
GKATL

SEQ ID NO: 1148275 - protein, 7 aa, Mycobacterium
GKATPEA

SEQ ID NO: 1148276 - protein, 7 aa, Mycobacterium
GKCGSCS

SEQ ID NO: 1148277 - protein, 9 aa, Mycobacterium
GKDKGAKGK

SEQ ID NO: 1148278 - protein, 7 aa, Mycobacterium
GKDPRDA

SEQ ID NO: 1148279 - protein, 9 aa, Mycobacterium
GKEGQNARL

SEQ ID NO: 1148280 - protein, 9 aa, Mycobacterium
GKFEEGAYQ

SEQ ID NO: 1148281 - protein, 20 aa, Mycobacterium
GKFTGSGGNLEQTVTRNNLE

SEQ ID NO: 1148282 - protein, 6 aa, Mycobacterium
GKGATN

SEQ ID NO: 1148283 - protein, 14 aa, Mycobacterium
GKGCAESLAGQGAR

SEQ ID NO: 1148284 - protein, 7 aa, Mycobacterium
GKGEAKD

SEQ ID NO: 1148285 - protein, 7 aa, Mycobacterium
GKGGKQR

SEQ ID NO: 1148286 - protein, 9 aa, Mycobacterium
GKGPGATSI

SEQ ID NO: 1148287 - protein, 9 aa, Mycobacterium
GKGRGGDHS

SEQ ID NO: 1148288 - protein, 4 aa, Mycobacterium
GKGS

SEQ ID NO: 1148289 - protein, 9 aa, Mycobacterium
GKGSSRPPR

SEQ ID NO: 1148290 - protein, 14 aa, Mycobacterium
GKKVESRQQEVSEF

SEQ ID NO: 1148291 - protein, 7 aa, Mycobacterium
GKLPELS

SEQ ID NO: 1148292 - protein, 5 aa, Mycobacterium
GKNTY

SEQ ID NO: 1148293 - protein, 9 aa, Mycobacterium
GKPAPSVSQ

SEQ ID NO: 1148294 - protein, 5 aa, Mycobacterium
GKPAR

SEQ ID NO: 1148295 - protein, 13 aa, Mycobacterium
GKPATRRHEPDGG

SEQ ID NO: 1148296 - protein, 6 aa, Mycobacterium
GKPHAR

SEQ ID NO: 1148297 - protein, 4 aa, Mycobacterium
GKPV

SEQ ID NO: 1148298 - protein, 6 aa, Mycobacterium
GKQGRF

SEQ ID NO: 1148299 - protein, 5 aa, Mycobacterium
GKRKG

SEQ ID NO: 1148300 - protein, 6 aa, Mycobacterium
GKRPTV

SEQ ID NO: 1148301 - protein, 4 aa, Mycobacterium
GKSP

SEQ ID NO: 1148302 - protein, 7 aa, Mycobacterium
GKSPGGI

SEQ ID NO: 1148303 - protein, 8 aa, Mycobacterium
GKTHGAAD

SEQ ID NO: 1148304 - protein, 6 aa, Mycobacterium
GKTQAK

SEQ ID NO: 1148305 - protein, 4 aa, Mycobacterium
GKTT

SEQ ID NO: 1148306 - protein, 6 aa, Mycobacterium
GKTTLT

SEQ ID NO: 1148307 - protein, 13 aa, Mycobacterium
GKTVPDAKGDIQR

SEQ ID NO: 1148308 - protein, 8 aa, Mycobacterium
GKYPSTEF

SEQ ID NO: 1148309 - protein, 4 aa, Mycobacterium
GKYT

SEQ ID NO: 1148310 - protein, 5 aa, Mycobacterium
GLAAG

SEQ ID NO: 1148311 - protein, 6 aa, Mycobacterium
GLAAGK

SEQ ID NO: 1148312 - protein, 8 aa, Mycobacterium
GLAKTTAA

SEQ ID NO: 1148313 - protein, 7 aa, Mycobacterium
GLASPAK

SEQ ID NO: 1148314 - protein, 5 aa, Mycobacterium
GLDGI

SEQ ID NO: 1148315 - protein, 5 aa, Mycobacterium
GLDPA

SEQ ID NO: 1148316 - protein, 4 aa, Mycobacterium
GLDT

SEQ ID NO: 1148317 - protein, 4 aa, Mycobacterium
GLEP

SEQ ID NO: 1148318 - protein, 7 aa, Mycobacterium
GLGGGEK

SEQ ID NO: 1148319 - protein, 10 aa, Mycobacterium
GLGGPGREHE

SEQ ID NO: 1148320 - protein, 11 aa, Mycobacterium
GLGGTYGGNPV

SEQ ID NO: 1148321 - protein, 8 aa, Mycobacterium
GLGRRRPD

SEQ ID NO: 1148322 - protein, 5 aa, Mycobacterium
GLGSP

SEQ ID NO: 1148323 - protein, 4 aa, Mycobacterium
GLHR

SEQ ID NO: 1148324 - protein, 7 aa, Mycobacterium
GLKPGQR

SEQ ID NO: 1148325 - protein, 4 aa, Mycobacterium
GLPE

SEQ ID NO: 1148326 - protein, 7 aa, Mycobacterium
GLPEDDP

SEQ ID NO: 1148327 - protein, 6 aa, Mycobacterium
GLPEEL

SEQ ID NO: 1148328 - protein, 9 aa, Mycobacterium
GLPGAEGTL

SEQ ID NO: 1148329 - protein, 7 aa, Mycobacterium
GLPRSSA

SEQ ID NO: 1148330 - protein, 5 aa, Mycobacterium
GLPTA

SEQ ID NO: 1148331 - protein, 6 aa, Mycobacterium
GLPTEA

SEQ ID NO: 1148332 - protein, 15 aa, Mycobacterium
GLPTGRGGKFTAGEI

SEQ ID NO: 1148333 - protein, 8 aa, Mycobacterium
GLRKPSAD

SEQ ID NO: 1148334 - protein, 5 aa, Mycobacterium
GLRPS

SEQ ID NO: 1148335 - protein, 9 aa, Mycobacterium
GLRTGPDGR

SEQ ID NO: 1148336 - protein, 11 aa, Mycobacterium
GLSHDPPVPTL

SEQ ID NO: 1148337 - protein, 8 aa, Mycobacterium
GLSPEDAF

SEQ ID NO: 1148338 - protein, 8 aa, Mycobacterium
GLTATRHG

SEQ ID NO: 1148339 - protein, 4 aa, Mycobacterium
GLTE

SEQ ID NO: 1148340 - protein, 5 aa, Mycobacterium
GLTGA

SEQ ID NO: 1148341 - protein, 8 aa, Mycobacterium
GMADQSRT

SEQ ID NO: 1148342 - protein, 9 aa, Mycobacterium
GMDNSPRWD

SEQ ID NO: 1148343 - protein, 7 aa, Mycobacterium
GMGGSQR

SEQ ID NO: 1148344 - protein, 6 aa, Mycobacterium
GMPATG

SEQ ID NO: 1148345 - protein, 7 aa, Mycobacterium
GMSPPKD

SEQ ID NO: 1148346 - protein, 10 aa, Mycobacterium
GMSSDQPLRR

SEQ ID NO: 1148347 - protein, 5 aa, Mycobacterium
GMTQD

SEQ ID NO: 1148348 - protein, 7 aa, Mycobacterium
GMTTEKA

SEQ ID NO: 1148349 - protein, 5 aa, Mycobacterium
GNAGG

SEQ ID NO: 1148350 - protein, 7 aa, Mycobacterium
GNAGKAG

SEQ ID NO: 1148351 - protein, 5 aa, Mycobacterium
GNAGN

SEQ ID NO: 1148352 - protein, 8 aa, Mycobacterium
GNAGTGVA

SEQ ID NO: 1148353 - protein, 7 aa, Mycobacterium
GNEDGAH

SEQ ID NO: 1148354 - protein, 10 aa, Mycobacterium
GNGPSAKDGG

SEQ ID NO: 1148355 - protein, 6 aa, Mycobacterium
GNIPTP

SEQ ID NO: 1148356 - protein, 12 aa, Mycobacterium
GNPDGKSKRELF

SEQ ID NO: 1148357 - protein, 11 aa, Mycobacterium
GNQAQGAQQRA

SEQ ID NO: 1148358 - protein, 11 aa, Mycobacterium
GNQHDAEDLTQ

SEQ ID NO: 1148359 - protein, 13 aa, Mycobacterium
GNRRGDKPYPAGT

SEQ ID NO: 1148360 - protein, 6 aa, Mycobacterium
GNSAVH

SEQ ID NO: 1148361 - protein, 10 aa, Mycobacterium
GNSSQISDGS

SEQ ID NO: 1148362 - protein, 8 aa, Mycobacterium
GNSYAKAA

SEQ ID NO: 1148363 - protein, 12 aa, Mycobacterium
GNTHESSTGYKT

SEQ ID NO: 1148364 - protein, 6 aa, Mycobacterium
GNTIGD

SEQ ID NO: 1148365 - protein, 7 aa, Mycobacterium
GNTYRNP

SEQ ID NO: 1148366 - protein, 5 aa, Mycobacterium
GNVGT

SEQ ID NO: 1148367 - protein, 6 aa, Mycobacterium
GPAGLT

SEQ ID NO: 1148368 - protein, 8 aa, Mycobacterium
GPAGVGKA

SEQ ID NO: 1148369 - protein, 8 aa, Mycobacterium
GPAIAGGT

SEQ ID NO: 1148370 - protein, 4 aa, Mycobacterium
GPDD

SEQ ID NO: 1148371 - protein, 5 aa, Mycobacterium
GPDEI

SEQ ID NO: 1148372 - protein, 5 aa, Mycobacterium
GPDGA

SEQ ID NO: 1148373 - protein, 5 aa, Mycobacterium
GPDRE

SEQ ID NO: 1148374 - protein, 4 aa, Mycobacterium
GPDY

SEQ ID NO: 1148375 - protein, 5 aa, Mycobacterium
GPEFD

SEQ ID NO: 1148376 - protein, 6 aa, Mycobacterium
GPEGYR

SEQ ID NO: 1148377 - protein, 9 aa, Mycobacterium
GPESSGKTT

SEQ ID NO: 1148378 - protein, 20 aa, Mycobacterium
GPGAEANGYAEGTETPPDLK

SEQ ID NO: 1148379 - protein, 6 aa, Mycobacterium
GPGAPA

SEQ ID NO: 1148380 - protein, 9 aa, Mycobacterium
GPGEAREAD

SEQ ID NO: 1148381 - protein, 11 aa, Mycobacterium
GPGGPEGLPSP

SEQ ID NO: 1148382 - protein, 5 aa, Mycobacterium
GPGGY

SEQ ID NO: 1148383 - protein, 4 aa, Mycobacterium
GPGL

SEQ ID NO: 1148384 - protein, 5 aa, Mycobacterium
GPGPF

SEQ ID NO: 1148385 - protein, 9 aa, Mycobacterium
GPGSGRETA

SEQ ID NO: 1148386 - protein, 4 aa, Mycobacterium
GPGT

SEQ ID NO: 1148387 - protein, 10 aa, Mycobacterium
GPHAGPVRDG

SEQ ID NO: 1148388 - protein, 11 aa, Mycobacterium
GPHGADPHHEC

SEQ ID NO: 1148389 - protein, 4 aa, Mycobacterium
GPIE

SEQ ID NO: 1148390 - protein, 5 aa, Mycobacterium
GPKNV

SEQ ID NO: 1148391 - protein, 8 aa, Mycobacterium
GPKTVRSA

SEQ ID NO: 1148392 - protein, 4 aa, Mycobacterium
GPLG

SEQ ID NO: 1148393 - protein, 9 aa, Mycobacterium
GPLHGGAPA

SEQ ID NO: 1148394 - protein, 5 aa, Mycobacterium
GPLPE

SEQ ID NO: 1148395 - protein, 5 aa, Mycobacterium
GPMDN

SEQ ID NO: 1148396 - protein, 4 aa, Mycobacterium
GPND

SEQ ID NO: 1148397 - protein, 10 aa, Mycobacterium
GPNGAGKSTT

SEQ ID NO: 1148398 - protein, 8 aa, Mycobacterium
GPNGAGKT

SEQ ID NO: 1148399 - protein, 9 aa, Mycobacterium
GPNGAGKTT

SEQ ID NO: 1148400 - protein, 10 aa, Mycobacterium
GPNGSGKSNV

SEQ ID NO: 1148401 - protein, 11 aa, Mycobacterium
GPNGSGKSTLS

SEQ ID NO: 1148402 - protein, 4 aa, Mycobacterium
GPNV

SEQ ID NO: 1148403 - protein, 4 aa, Mycobacterium
GPPG

SEQ ID NO: 1148404 - protein, 8 aa, Mycobacterium
GPPGLGKT

SEQ ID NO: 1148405 - protein, 14 aa, Mycobacterium
GPPGVGKTSLGESV

SEQ ID NO: 1148406 - protein, 6 aa, Mycobacterium
GPPREL

SEQ ID NO: 1148407 - protein, 4 aa, Mycobacterium
GPPT

SEQ ID NO: 1148408 - protein, 5 aa, Mycobacterium
GPQFP

SEQ ID NO: 1148409 - protein, 7 aa, Mycobacterium
GPQGRVT

SEQ ID NO: 1148410 - protein, 6 aa, Mycobacterium
GPQPAD

SEQ ID NO: 1148411 - protein, 4 aa, Mycobacterium
GPRE

SEQ ID NO: 1148412 - protein, 4 aa, Mycobacterium
GPRK

SEQ ID NO: 1148413 - protein, 12 aa, Mycobacterium
GPRTYSDQRGHP

SEQ ID NO: 1148414 - protein, 7 aa, Mycobacterium
GPSAGHG

SEQ ID NO: 1148415 - protein, 8 aa, Mycobacterium
GPSATSDI

SEQ ID NO: 1148416 - protein, 10 aa, Mycobacterium
GPSGAGKSTL

SEQ ID NO: 1148417 - protein, 9 aa, Mycobacterium
GPSGCGKST

SEQ ID NO: 1148418 - protein, 6 aa, Mycobacterium
GPSGNY

SEQ ID NO: 1148419 - protein, 10 aa, Mycobacterium
GPSGSGKSTL

SEQ ID NO: 1148420 - protein, 8 aa, Mycobacterium
GPSGTGKS

SEQ ID NO: 1148421 - protein, 6 aa, Mycobacterium
GPSKAA

SEQ ID NO: 1148422 - protein, 6 aa, Mycobacterium
GPTAAR

SEQ ID NO: 1148423 - protein, 6 aa, Mycobacterium
GPTGAT

SEQ ID NO: 1148424 - protein, 6 aa, Mycobacterium
GPTGFI

SEQ ID NO: 1148425 - protein, 9 aa, Mycobacterium
GPTGNQRDE

SEQ ID NO: 1148426 - protein, 4 aa, Mycobacterium
GPVN

SEQ ID NO: 1148427 - protein, 5 aa, Mycobacterium
GPVSG

SEQ ID NO: 1148428 - protein, 5 aa, Mycobacterium
GPYGT

SEQ ID NO: 1148429 - protein, 5 aa, Mycobacterium
GQAAE

SEQ ID NO: 1148430 - protein, 9 aa, Mycobacterium
GQAGPPLAG

SEQ ID NO: 1148431 - protein, 9 aa, Mycobacterium
GQAPSDYPD

SEQ ID NO: 1148432 - protein, 7 aa, Mycobacterium
GQDCTAA

SEQ ID NO: 1148433 - protein, 10 aa, Mycobacterium
GQDGHDRGQK

SEQ ID NO: 1148434 - protein, 9 aa, Mycobacterium
GQDGSYSED

SEQ ID NO: 1148435 - protein, 4 aa, Mycobacterium
GQEG

SEQ ID NO: 1148436 - protein, 7 aa, Mycobacterium
GQESMTQ

SEQ ID NO: 1148437 - protein, 14 aa, Mycobacterium
GQGEAGLRGAPSGD

SEQ ID NO: 1148438 - protein, 7 aa, Mycobacterium
GQGGEDM

SEQ ID NO: 1148439 - protein, 4 aa, Mycobacterium
GQID

SEQ ID NO: 1148440 - protein, 9 aa, Mycobacterium
GQKPEIRRA

SEQ ID NO: 1148441 - protein, 4 aa, Mycobacterium
GQNR

SEQ ID NO: 1148442 - protein, 5 aa, Mycobacterium
GQPVR

SEQ ID NO: 1148443 - protein, 5 aa, Mycobacterium
GQQDS

SEQ ID NO: 1148444 - protein, 10 aa, Mycobacterium
GQRSDGGTSR

SEQ ID NO: 1148445 - protein, 6 aa, Mycobacterium
GQRSGV

SEQ ID NO: 1148446 - protein, 7 aa, Mycobacterium
GQSCNAP

SEQ ID NO: 1148447 - protein, 4 aa, Mycobacterium
GQSE

SEQ ID NO: 1148448 - protein, 5 aa, Mycobacterium
GQSEA

SEQ ID NO: 1148449 - protein, 5 aa, Mycobacterium
GQSGT

SEQ ID NO: 1148450 - protein, 5 aa, Mycobacterium
GQSIR

SEQ ID NO: 1148451 - protein, 7 aa, Mycobacterium
GQTERGL

SEQ ID NO: 1148452 - protein, 9 aa, Mycobacterium
GQTGKTVSP

SEQ ID NO: 1148453 - protein, 13 aa, Mycobacterium
GQTGMGAGLPGGH

SEQ ID NO: 1148454 - protein, 7 aa, Mycobacterium
GQTQGYR

SEQ ID NO: 1148455 - protein, 5 aa, Mycobacterium
GQYEW

SEQ ID NO: 1148456 - protein, 10 aa, Mycobacterium
GRAPGSDPVT

SEQ ID NO: 1148457 - protein, 12 aa, Mycobacterium
GRCEACSGDGTI

SEQ ID NO: 1148458 - protein, 4 aa, Mycobacterium
GRDG

SEQ ID NO: 1148459 - protein, 6 aa, Mycobacterium
GRDGSV

SEQ ID NO: 1148460 - protein, 7 aa, Mycobacterium
GRDIPSS

SEQ ID NO: 1148461 - protein, 5 aa, Mycobacterium
GRDNP

SEQ ID NO: 1148462 - protein, 6 aa, Mycobacterium
GRDPNK

SEQ ID NO: 1148463 - protein, 7 aa, Mycobacterium
GRDPNKH

SEQ ID NO: 1148464 - protein, 4 aa, Mycobacterium
GRDR

SEQ ID NO: 1148465 - protein, 14 aa, Mycobacterium
GREARARTRLKEGD

SEQ ID NO: 1148466 - protein, 5 aa, Mycobacterium
GREDQ

SEQ ID NO: 1148467 - protein, 9 aa, Mycobacterium
GREPTPEEL

SEQ ID NO: 1148468 - protein, 12 aa, Mycobacterium
GRETESGRGPTD

SEQ ID NO: 1148469 - protein, 9 aa, Mycobacterium
GRETQPHIP

SEQ ID NO: 1148470 - protein, 9 aa, Mycobacterium
GRGAGPNKD

SEQ ID NO: 1148471 - protein, 8 aa, Mycobacterium
GRGEPADA

SEQ ID NO: 1148472 - protein, 14 aa, Mycobacterium
GRGEYTTGRGPTPF

SEQ ID NO: 1148473 - protein, 5 aa, Mycobacterium
GRGFN

SEQ ID NO: 1148474 - protein, 9 aa, Mycobacterium
GRGGRTATA

SEQ ID NO: 1148475 - protein, 4 aa, Mycobacterium
GRGI

SEQ ID NO: 1148476 - protein, 10 aa, Mycobacterium
GRGKTGSGKT

SEQ ID NO: 1148477 - protein, 6 aa, Mycobacterium
GRGPQL

SEQ ID NO: 1148478 - protein, 4 aa, Mycobacterium
GRGQ

SEQ ID NO: 1148479 - protein, 7 aa, Mycobacterium
GRGREAD

SEQ ID NO: 1148480 - protein, 7 aa, Mycobacterium
GRGSGEA

SEQ ID NO: 1148481 - protein, 4 aa, Mycobacterium
GRGV

SEQ ID NO: 1148482 - protein, 4 aa, Mycobacterium
GRID

SEQ ID NO: 1148483 - protein, 10 aa, Mycobacterium
GRIPDGGGWR

SEQ ID NO: 1148484 - protein, 9 aa, Mycobacterium
GRKGEASDI

SEQ ID NO: 1148485 - protein, 10 aa, Mycobacterium
GRLEGKSSLG

SEQ ID NO: 1148486 - protein, 4 aa, Mycobacterium
GRLG

SEQ ID NO: 1148487 - protein, 5 aa, Mycobacterium
GRLQP

SEQ ID NO: 1148488 - protein, 7 aa, Mycobacterium
GRNATTV

SEQ ID NO: 1148489 - protein, 8 aa, Mycobacterium
GRPADGAP

SEQ ID NO: 1148490 - protein, 7 aa, Mycobacterium
GRPAEAD

SEQ ID NO: 1148491 - protein, 5 aa, Mycobacterium
GRPAG

SEQ ID NO: 1148492 - protein, 5 aa, Mycobacterium
GRPED

SEQ ID NO: 1148493 - protein, 5 aa, Mycobacterium
GRPET

SEQ ID NO: 1148494 - protein, 5 aa, Mycobacterium
GRPIS

SEQ ID NO: 1148495 - protein, 5 aa, Mycobacterium
GRPPR

SEQ ID NO: 1148496 - protein, 7 aa, Mycobacterium
GRPSNIG

SEQ ID NO: 1148497 - protein, 5 aa, Mycobacterium
GRPTV

SEQ ID NO: 1148498 - protein, 4 aa, Mycobacterium
GRPV

SEQ ID NO: 1148499 - protein, 9 aa, Mycobacterium
GRQVRSDVG

SEQ ID NO: 1148500 - protein, 8 aa, Mycobacterium
GRRGGSAM

SEQ ID NO: 1148501 - protein, 7 aa, Mycobacterium
GRRPGAR

SEQ ID NO: 1148502 - protein, 6 aa, Mycobacterium
GRSAAH

SEQ ID NO: 1148503 - protein, 7 aa, Mycobacterium
GRSAEQR

SEQ ID NO: 1148504 - protein, 9 aa, Mycobacterium
GRSAPGEQV

SEQ ID NO: 1148505 - protein, 5 aa, Mycobacterium
GRSPD

SEQ ID NO: 1148506 - protein, 6 aa, Mycobacterium
GRSSEH

SEQ ID NO: 1148507 - protein, 16 aa, Mycobacterium
GRSTQLGREETLEDTG

SEQ ID NO: 1148508 - protein, 9 aa, Mycobacterium
GRSTVEDAT

SEQ ID NO: 1148509 - protein, 13 aa, Mycobacterium
GRSYGDNAQNGGG

SEQ ID NO: 1148510 - protein, 7 aa, Mycobacterium
GRTEETF

SEQ ID NO: 1148511 - protein, 8 aa, Mycobacterium
GRTGGAGF

SEQ ID NO: 1148512 - protein, 6 aa, Mycobacterium
GRTGRV

SEQ ID NO: 1148513 - protein, 7 aa, Mycobacterium
GRVQEPT

SEQ ID NO: 1148514 - protein, 5 aa, Mycobacterium
GRVTG

SEQ ID NO: 1148515 - protein, 17 aa, Mycobacterium
GRWATQRGLGRTEGHKM

SEQ ID NO: 1148516 - protein, 5 aa, Mycobacterium
GSAAT

SEQ ID NO: 1148517 - protein, 12 aa, Mycobacterium
GSADSPTPPESL

SEQ ID NO: 1148518 - protein, 16 aa, Mycobacterium
GSAPDIAGQGIADPTA

SEQ ID NO: 1148519 - protein, 7 aa, Mycobacterium
GSCSTND

SEQ ID NO: 1148520 - protein, 5 aa, Mycobacterium
GSDAY

SEQ ID NO: 1148521 - protein, 9 aa, Mycobacterium
GSDEGGHDA

SEQ ID NO: 1148522 - protein, 6 aa, Mycobacterium
GSDHPI

SEQ ID NO: 1148523 - protein, 4 aa, Mycobacterium
GSEE

SEQ ID NO: 1148524 - protein, 8 aa, Mycobacterium
GSEKSPGF

SEQ ID NO: 1148525 - protein, 6 aa, Mycobacterium
GSEVTN

SEQ ID NO: 1148526 - protein, 5 aa, Mycobacterium
GSGAL

SEQ ID NO: 1148527 - protein, 9 aa, Mycobacterium
GSGDNGGDA

SEQ ID NO: 1148528 - protein, 10 aa, Mycobacterium
GSGDPTEPRK

SEQ ID NO: 1148529 - protein, 9 aa, Mycobacterium
GSGEKKTIP

SEQ ID NO: 1148530 - protein, 6 aa, Mycobacterium
GSGIGA

SEQ ID NO: 1148531 - protein, 5 aa, Mycobacterium
GSGIT

SEQ ID NO: 1148532 - protein, 9 aa, Mycobacterium
GSGKSTIGR

SEQ ID NO: 1148533 - protein, 9 aa, Mycobacterium
GSGNGEQIA

SEQ ID NO: 1148534 - protein, 9 aa, Mycobacterium
GSGPAGLAA

SEQ ID NO: 1148535 - protein, 4 aa, Mycobacterium
GSGQ

SEQ ID NO: 1148536 - protein, 16 aa, Mycobacterium
GSGQIKTGAPARSERV

SEQ ID NO: 1148537 - protein, 9 aa, Mycobacterium
GSGRRTGKL

SEQ ID NO: 1148538 - protein, 6 aa, Mycobacterium
GSGSAS

SEQ ID NO: 1148539 - protein, 11 aa, Mycobacterium
GSGSLKSEIED

SEQ ID NO: 1148540 - protein, 9 aa, Mycobacterium
GSHQDAINK

SEQ ID NO: 1148541 - protein, 4 aa, Mycobacterium
GSID

SEQ ID NO: 1148542 - protein, 10 aa, Mycobacterium
GSIYAGSNEI

SEQ ID NO: 1148543 - protein, 8 aa, Mycobacterium
GSKAVATR

SEQ ID NO: 1148544 - protein, 7 aa, Mycobacterium
GSKEDAI

SEQ ID NO: 1148545 - protein, 5 aa, Mycobacterium
GSKER

SEQ ID NO: 1148546 - protein, 11 aa, Mycobacterium
GSLAQPGSGVE

SEQ ID NO: 1148547 - protein, 5 aa, Mycobacterium
GSLGH

SEQ ID NO: 1148548 - protein, 8 aa, Mycobacterium
GSLPPGRL

SEQ ID NO: 1148549 - protein, 4 aa, Mycobacterium
GSLT

SEQ ID NO: 1148550 - protein, 6 aa, Mycobacterium
GSMAAR

SEQ ID NO: 1148551 - protein, 6 aa, Mycobacterium
GSMGGA

SEQ ID NO: 1148552 - protein, 7 aa, Mycobacterium
GSNNSAH

SEQ ID NO: 1148553 - protein, 7 aa, Mycobacterium
GSPEDPG

SEQ ID NO: 1148554 - protein, 8 aa, Mycobacterium
GSPEVTNY

SEQ ID NO: 1148555 - protein, 27 aa, Mycobacterium
GSPGGASKVGQTDNDPQAVKDLPPQGE

SEQ ID NO: 1148556 - protein, 6 aa, Mycobacterium
GSPGYH

SEQ ID NO: 1148557 - protein, 7 aa, Mycobacterium
GSPNRGM

SEQ ID NO: 1148558 - protein, 7 aa, Mycobacterium
GSPPAEL

SEQ ID NO: 1148559 - protein, 12 aa, Mycobacterium
GSPSQARKHADA

SEQ ID NO: 1148560 - protein, 4 aa, Mycobacterium
GSPV

SEQ ID NO: 1148561 - protein, 4 aa, Mycobacterium
GSQE

SEQ ID NO: 1148562 - protein, 6 aa, Mycobacterium
GSQGHA

SEQ ID NO: 1148563 - protein, 11 aa, Mycobacterium
GSQGVQNGGID

SEQ ID NO: 1148564 - protein, 8 aa, Mycobacterium
GSQRAYEK

SEQ ID NO: 1148565 - protein, 4 aa, Mycobacterium
GSRI

SEQ ID NO: 1148566 - protein, 6 aa, Mycobacterium
GSRNAP

SEQ ID NO: 1148567 - protein, 8 aa, Mycobacterium
GSRNGTYL

SEQ ID NO: 1148568 - protein, 9 aa, Mycobacterium
GSRPLDKSR

SEQ ID NO: 1148569 - protein, 6 aa, Mycobacterium
GSSPEA

SEQ ID NO: 1148570 - protein, 7 aa, Mycobacterium
GSSPEAI

SEQ ID NO: 1148571 - protein, 7 aa, Mycobacterium
GSSRRYA

SEQ ID NO: 1148572 - protein, 7 aa, Mycobacterium
GSSSHQK

SEQ ID NO: 1148573 - protein, 8 aa, Mycobacterium
GSSSKGNE

SEQ ID NO: 1148574 - protein, 7 aa, Mycobacterium
GSSTYPG

SEQ ID NO: 1148575 - protein, 6 aa, Mycobacterium
GSSYNT

SEQ ID NO: 1148576 - protein, 7 aa, Mycobacterium
GSTATGR

SEQ ID NO: 1148577 - protein, 6 aa, Mycobacterium
GSTDFT

SEQ ID NO: 1148578 - protein, 5 aa, Mycobacterium
GSTHP

SEQ ID NO: 1148579 - protein, 4 aa, Mycobacterium
GSTP

SEQ ID NO: 1148580 - protein, 7 aa, Mycobacterium
GSTVEQA

SEQ ID NO: 1148581 - protein, 12 aa, Mycobacterium
GSVDGARSASAT

SEQ ID NO: 1148582 - protein, 8 aa, Mycobacterium
GSVGGSTA

SEQ ID NO: 1148583 - protein, 4 aa, Mycobacterium
GSVR

SEQ ID NO: 1148584 - protein, 9 aa, Mycobacterium
GTAAEGETI

SEQ ID NO: 1148585 - protein, 9 aa, Mycobacterium
GTAGEAPDH

SEQ ID NO: 1148586 - protein, 9 aa, Mycobacterium
GTALGGGTE

SEQ ID NO: 1148587 - protein, 7 aa, Mycobacterium
GTALGNP

SEQ ID NO: 1148588 - protein, 25 aa, Mycobacterium
GTARAGGKFSAHTDAASTGAGLNGI

SEQ ID NO: 1148589 - protein, 15 aa, Mycobacterium
GTAVGTGLNAPDGFG

SEQ ID NO: 1148590 - protein, 5 aa, Mycobacterium
GTDAA

SEQ ID NO: 1148591 - protein, 8 aa, Mycobacterium
GTDAAGRR

SEQ ID NO: 1148592 - protein, 7 aa, Mycobacterium
GTDEQKQ

SEQ ID NO: 1148593 - protein, 8 aa, Mycobacterium
GTDEQRRR

SEQ ID NO: 1148594 - protein, 9 aa, Mycobacterium
GTDSHTTME

SEQ ID NO: 1148595 - protein, 4 aa, Mycobacterium
GTDT

SEQ ID NO: 1148596 - protein, 9 aa, Mycobacterium
GTDTTRNQL

SEQ ID NO: 1148597 - protein, 7 aa, Mycobacterium
GTDVPHT

SEQ ID NO: 1148598 - protein, 9 aa, Mycobacterium
GTEAGGHCG

SEQ ID NO: 1148599 - protein, 6 aa, Mycobacterium
GTEEQK

SEQ ID NO: 1148600 - protein, 7 aa, Mycobacterium
GTEIRVP

SEQ ID NO: 1148601 - protein, 5 aa, Mycobacterium
GTELP

SEQ ID NO: 1148602 - protein, 4 aa, Mycobacterium
GTEQ

SEQ ID NO: 1148603 - protein, 9 aa, Mycobacterium
GTFGSGGEF

SEQ ID NO: 1148604 - protein, 12 aa, Mycobacterium
GTFGSRQEEAQR

SEQ ID NO: 1148605 - protein, 6 aa, Mycobacterium
GTGAGV

SEQ ID NO: 1148606 - protein, 6 aa, Mycobacterium
GTGDDI

SEQ ID NO: 1148607 - protein, 10 aa, Mycobacterium
GTGGTITGAG

SEQ ID NO: 1148608 - protein, 6 aa, Mycobacterium
GTGPFT

SEQ ID NO: 1148609 - protein, 6 aa, Mycobacterium
GTGSTG

SEQ ID NO: 1148610 - protein, 9 aa, Mycobacterium
GTGYGPDGA

SEQ ID NO: 1148611 - protein, 8 aa, Mycobacterium
GTITGEHG

SEQ ID NO: 1148612 - protein, 15 aa, Mycobacterium
GTKEDIKEAQNNGGS

SEQ ID NO: 1148613 - protein, 8 aa, Mycobacterium
GTKGKRYA

SEQ ID NO: 1148614 - protein, 8 aa, Mycobacterium
GTLSGNPV

SEQ ID NO: 1148615 - protein, 11 aa, Mycobacterium
GTNGKSTTTRM

SEQ ID NO: 1148616 - protein, 14 aa, Mycobacterium
GTNTSPLAGKVSGH

SEQ ID NO: 1148617 - protein, 5 aa, Mycobacterium
GTPAR

SEQ ID NO: 1148618 - protein, 5 aa, Mycobacterium
GTPDL

SEQ ID NO: 1148619 - protein, 5 aa, Mycobacterium
GTPED

SEQ ID NO: 1148620 - protein, 9 aa, Mycobacterium
GTPFPSTAR

SEQ ID NO: 1148621 - protein, 11 aa, Mycobacterium
GTPFRSDDSPI

SEQ ID NO: 1148622 - protein, 4 aa, Mycobacterium
GTPG

SEQ ID NO: 1148623 - protein, 7 aa, Mycobacterium
GTPPPTW

SEQ ID NO: 1148624 - protein, 6 aa, Mycobacterium
GTPPPV

SEQ ID NO: 1148625 - protein, 9 aa, Mycobacterium
GTPRRRPAR

SEQ ID NO: 1148626 - protein, 10 aa, Mycobacterium
GTQGALGHRK

SEQ ID NO: 1148627 - protein, 5 aa, Mycobacterium
GTSAA

SEQ ID NO: 1148628 - protein, 4 aa, Mycobacterium
GTSE

SEQ ID NO: 1148629 - protein, 6 aa, Mycobacterium
GTSEIQ

SEQ ID NO: 1148630 - protein, 10 aa, Mycobacterium
GTSGGLRTDE

SEQ ID NO: 1148631 - protein, 11 aa, Mycobacterium
GTSGMKSALNG

SEQ ID NO: 1148632 - protein, 7 aa, Mycobacterium
GTSGPQV

SEQ ID NO: 1148633 - protein, 4 aa, Mycobacterium
GTSN

SEQ ID NO: 1148634 - protein, 5 aa, Mycobacterium
GTSPG

SEQ ID NO: 1148635 - protein, 6 aa, Mycobacterium
GTTGFP

SEQ ID NO: 1148636 - protein, 7 aa, Mycobacterium
GTTGRPK

SEQ ID NO: 1148637 - protein, 9 aa, Mycobacterium
GTTGRSKGA

SEQ ID NO: 1148638 - protein, 6 aa, Mycobacterium
GTTGTL

SEQ ID NO: 1148639 - protein, 6 aa, Mycobacterium
GTTPAK

SEQ ID NO: 1148640 - protein, 6 aa, Mycobacterium
GTTVDP

SEQ ID NO: 1148641 - protein, 14 aa, Mycobacterium
GTVHSSPSTLTEAG

SEQ ID NO: 1148642 - protein, 4 aa, Mycobacterium
GTVQ

SEQ ID NO: 1148643 - protein, 9 aa, Mycobacterium
GTVTATTSV

SEQ ID NO: 1148644 - protein, 5 aa, Mycobacterium
GTWTP

SEQ ID NO: 1148645 - protein, 4 aa, Mycobacterium
GTYT

SEQ ID NO: 1148646 - protein, 10 aa, Mycobacterium
GVAPGGPGNF

SEQ ID NO: 1148647 - protein, 10 aa, Mycobacterium
GVDATGEFAP

SEQ ID NO: 1148648 - protein, 6 aa, Mycobacterium
GVEEAR

SEQ ID NO: 1148649 - protein, 4 aa, Mycobacterium
GVEG

SEQ ID NO: 1148650 - protein, 5 aa, Mycobacterium
GVEVD

SEQ ID NO: 1148651 - protein, 5 aa, Mycobacterium
GVGDP

SEQ ID NO: 1148652 - protein, 5 aa, Mycobacterium
GVGEN

SEQ ID NO: 1148653 - protein, 13 aa, Mycobacterium
GVGETRSCGTGTV

SEQ ID NO: 1148654 - protein, 8 aa, Mycobacterium
GVGGGSLN

SEQ ID NO: 1148655 - protein, 7 aa, Mycobacterium
GVGRETA

SEQ ID NO: 1148656 - protein, 6 aa, Mycobacterium
GVGRKT

SEQ ID NO: 1148657 - protein, 5 aa, Mycobacterium
GVIPS

SEQ ID NO: 1148658 - protein, 5 aa, Mycobacterium
GVKED

SEQ ID NO: 1148659 - protein, 5 aa, Mycobacterium
GVKRQ

SEQ ID NO: 1148660 - protein, 4 aa, Mycobacterium
GVMP

SEQ ID NO: 1148661 - protein, 9 aa, Mycobacterium
GVNPTNDGN

SEQ ID NO: 1148662 - protein, 5 aa, Mycobacterium
GVPQQ

SEQ ID NO: 1148663 - protein, 10 aa, Mycobacterium
GVQGDGRTYG

SEQ ID NO: 1148664 - protein, 7 aa, Mycobacterium
GVQPGDR

SEQ ID NO: 1148665 - protein, 15 aa, Mycobacterium
GVRGDGGVLKNSDGK

SEQ ID NO: 1148666 - protein, 13 aa, Mycobacterium
GVRPDKSRNRKGS

SEQ ID NO: 1148667 - protein, 9 aa, Mycobacterium
GVRRTRSKF

SEQ ID NO: 1148668 - protein, 5 aa, Mycobacterium
GVSHA

SEQ ID NO: 1148669 - protein, 21 aa, Mycobacterium
GVSQDTKDVTTLGRGGSDTTA

SEQ ID NO: 1148670 - protein, 4 aa, Mycobacterium
GVSV

SEQ ID NO: 1148671 - protein, 5 aa, Mycobacterium
GVTGA

SEQ ID NO: 1148672 - protein, 4 aa, Mycobacterium
GVTP

SEQ ID NO: 1148673 - protein, 8 aa, Mycobacterium
GVTSGASV

SEQ ID NO: 1148674 - protein, 6 aa, Mycobacterium
GVTSGR

SEQ ID NO: 1148675 - protein, 4 aa, Mycobacterium
GVVP

SEQ ID NO: 1148676 - protein, 6 aa, Mycobacterium
GVVTDD

SEQ ID NO: 1148677 - protein, 4 aa, Mycobacterium
GWPS

SEQ ID NO: 1148678 - protein, 4 aa, Mycobacterium
GYEE

SEQ ID NO: 1148679 - protein, 5 aa, Mycobacterium
GYENK

SEQ ID NO: 1148680 - protein, 13 aa, Mycobacterium
GYGGSDKPPRGYD

SEQ ID NO: 1148681 - protein, 5 aa, Mycobacterium
GYGPG

SEQ ID NO: 1148682 - protein, 6 aa, Mycobacterium
GYGPNG

SEQ ID NO: 1148683 - protein, 7 aa, Mycobacterium
GYGSAGE

SEQ ID NO: 1148684 - protein, 14 aa, Mycobacterium
GYKPNTKPHNRQIR

SEQ ID NO: 1148685 - protein, 5 aa, Mycobacterium
GYPQR

SEQ ID NO: 1148686 - protein, 5 aa, Mycobacterium
GYPRR

SEQ ID NO: 1148687 - protein, 8 aa, Mycobacterium
GYQAGADR

SEQ ID NO: 1148688 - protein, 6 aa, Mycobacterium
GYQPTL

SEQ ID NO: 1148689 - protein, 5 aa, Mycobacterium
GYSES

SEQ ID NO: 1148690 - protein, 6 aa, Mycobacterium
GYSGTL

SEQ ID NO: 1148691 - protein, 5 aa, Mycobacterium
GYSTE

SEQ ID NO: 1148692 - protein, 6 aa, Mycobacterium
GYTKEH

SEQ ID NO: 1148693 - protein, 8 aa, Mycobacterium
GYVEDSGM

SEQ ID NO: 1148694 - protein, 5 aa, Mycobacterium
GYYEQ

SEQ ID NO: 1148695 - protein, 7 aa, Mycobacterium
HAEADRL

SEQ ID NO: 1148696 - protein, 8 aa, Mycobacterium
HAEPDEEK

SEQ ID NO: 1148697 - protein, 10 aa, Mycobacterium
HAHGSPGHGA

SEQ ID NO: 1148698 - protein, 5 aa, Mycobacterium
HAKGE

SEQ ID NO: 1148699 - protein, 23 aa, Mycobacterium
HAPDSATHGATTKCHRPSAGPVP

SEQ ID NO: 1148700 - protein, 6 aa, Mycobacterium
HAPKTV

SEQ ID NO: 1148701 - protein, 7 aa, Mycobacterium
HARPGTV

SEQ ID NO: 1148702 - protein, 9 aa, Mycobacterium
HARSTGPYS

SEQ ID NO: 1148703 - protein, 6 aa, Mycobacterium
HARTPF

SEQ ID NO: 1148704 - protein, 5 aa, Mycobacterium
HASGT

SEQ ID NO: 1148705 - protein, 11 aa, Mycobacterium
HASTAGSQLEV

SEQ ID NO: 1148706 - protein, 5 aa, Mycobacterium
HATEY

SEQ ID NO: 1148707 - protein, 9 aa, Mycobacterium
HAVTESPSG

SEQ ID NO: 1148708 - protein, 7 aa, Mycobacterium
HAYTGDG

SEQ ID NO: 1148709 - protein, 6 aa, Mycobacterium
HCPKDK

SEQ ID NO: 1148710 - protein, 5 aa, Mycobacterium
HDDRD

SEQ ID NO: 1148711 - protein, 6 aa, Mycobacterium
HDGDAD

SEQ ID NO: 1148712 - protein, 11 aa, Mycobacterium
HDGGTGATPLT

SEQ ID NO: 1148713 - protein, 6 aa, Mycobacterium
HDHHSR

SEQ ID NO: 1148714 - protein, 7 aa, Mycobacterium
HDPEEAA

SEQ ID NO: 1148715 - protein, 5 aa, Mycobacterium
HDQYN

SEQ ID NO: 1148716 - protein, 13 aa, Mycobacterium
HDRDKAQAKGSKD

SEQ ID NO: 1148717 - protein, 8 aa, Mycobacterium
HDTPGGQL

SEQ ID NO: 1148718 - protein, 10 aa, Mycobacterium
HEAGGHTGEI

SEQ ID NO: 1148719 - protein, 5 aa, Mycobacterium
HEDQK

SEQ ID NO: 1148720 - protein, 9 aa, Mycobacterium
HEGAPGQQE

SEQ ID NO: 1148721 - protein, 8 aa, Mycobacterium
HEGPNAAR

SEQ ID NO: 1148722 - protein, 12 aa, Mycobacterium
HEGQGPDHTSGR

SEQ ID NO: 1148723 - protein, 13 aa, Mycobacterium
HEKAAAAQDSGAF

SEQ ID NO: 1148724 - protein, 10 aa, Mycobacterium
HELSGGQRQR

SEQ ID NO: 1148725 - protein, 8 aa, Mycobacterium
HERPGDQW

SEQ ID NO: 1148726 - protein, 8 aa, Mycobacterium
HERVPGET

SEQ ID NO: 1148727 - protein, 9 aa, Mycobacterium
HESDEALAE

SEQ ID NO: 1148728 - protein, 11 aa, Mycobacterium
HFTSPSPQRTP

SEQ ID NO: 1148729 - protein, 8 aa, Mycobacterium
HGARGNSG

SEQ ID NO: 1148730 - protein, 8 aa, Mycobacterium
HGATTHAS

SEQ ID NO: 1148731 - protein, 5 aa, Mycobacterium
HGDSE

SEQ ID NO: 1148732 - protein, 6 aa, Mycobacterium
HGDTNA

SEQ ID NO: 1148733 - protein, 12 aa, Mycobacterium
HGGFKSSGHGKD

SEQ ID NO: 1148734 - protein, 4 aa, Mycobacterium
HGHD

SEQ ID NO: 1148735 - protein, 4 aa, Mycobacterium
HGHQ

SEQ ID NO: 1148736 - protein, 5 aa, Mycobacterium
HGHRA

SEQ ID NO: 1148737 - protein, 9 aa, Mycobacterium
HGKAGRRAT

SEQ ID NO: 1148738 - protein, 5 aa, Mycobacterium
HGMNA

SEQ ID NO: 1148739 - protein, 11 aa, Mycobacterium
HGPDSEPVEEE

SEQ ID NO: 1148740 - protein, 7 aa, Mycobacterium
HGRSNPR

SEQ ID NO: 1148741 - protein, 8 aa, Mycobacterium
HGSGGKSF

SEQ ID NO: 1148742 - protein, 8 aa, Mycobacterium
HGSVSTIG

SEQ ID NO: 1148743 - protein, 10 aa, Mycobacterium
HGTPFRRASE

SEQ ID NO: 1148744 - protein, 7 aa, Mycobacterium
HGTPQGA

SEQ ID NO: 1148745 - protein, 4 aa, Mycobacterium
HGTR

SEQ ID NO: 1148746 - protein, 5 aa, Mycobacterium
HHPEE

SEQ ID NO: 1148747 - protein, 7 aa, Mycobacterium
HHSESTE

SEQ ID NO: 1148748 - protein, 5 aa, Mycobacterium
HIGPS

SEQ ID NO: 1148749 - protein, 6 aa, Mycobacterium
HKGQPT

SEQ ID NO: 1148750 - protein, 5 aa, Mycobacterium
HKGRL

SEQ ID NO: 1148751 - protein, 14 aa, Mycobacterium
HKKARTYSKGNRQK

SEQ ID NO: 1148752 - protein, 11 aa, Mycobacterium
HKPTFTPNVDG

SEQ ID NO: 1148753 - protein, 8 aa, Mycobacterium
HKYKDSRE

SEQ ID NO: 1148754 - protein, 7 aa, Mycobacterium
HKYPNET

SEQ ID NO: 1148755 - protein, 6 aa, Mycobacterium
HLDPQA

SEQ ID NO: 1148756 - protein, 4 aa, Mycobacterium
HLPD

SEQ ID NO: 1148757 - protein, 10 aa, Mycobacterium
HLPYDRPPLS

SEQ ID NO: 1148758 - protein, 11 aa, Mycobacterium
HMRPGSTVESL

SEQ ID NO: 1148759 - protein, 8 aa, Mycobacterium
HNAANPGC

SEQ ID NO: 1148760 - protein, 8 aa, Mycobacterium
HNDRGTAV

SEQ ID NO: 1148761 - protein, 8 aa, Mycobacterium
HNGAGKST

SEQ ID NO: 1148762 - protein, 8 aa, Mycobacterium
HNGAGKTT

SEQ ID NO: 1148763 - protein, 4 aa, Mycobacterium
HNGL

SEQ ID NO: 1148764 - protein, 7 aa, Mycobacterium
HNPAAYN

SEQ ID NO: 1148765 - protein, 9 aa, Mycobacterium
HNPDGSDTW

SEQ ID NO: 1148766 - protein, 7 aa, Mycobacterium
HNPMPDN

SEQ ID NO: 1148767 - protein, 4 aa, Mycobacterium
HNVA

SEQ ID NO: 1148768 - protein, 16 aa, Mycobacterium
HPATTTHRAMGPEGRA

SEQ ID NO: 1148769 - protein, 5 aa, Mycobacterium
HPDAD

SEQ ID NO: 1148770 - protein, 9 aa, Mycobacterium
HPDDARLGP

SEQ ID NO: 1148771 - protein, 8 aa, Mycobacterium
HPDDGGQH

SEQ ID NO: 1148772 - protein, 4 aa, Mycobacterium
HPEG

SEQ ID NO: 1148773 - protein, 7 aa, Mycobacterium
HPEPELA

SEQ ID NO: 1148774 - protein, 8 aa, Mycobacterium
HPERSWTT

SEQ ID NO: 1148775 - protein, 12 aa, Mycobacterium
HPEYSAPECTDP

SEQ ID NO: 1148776 - protein, 5 aa, Mycobacterium
HPGGG

SEQ ID NO: 1148777 - protein, 6 aa, Mycobacterium
HPGGPK

SEQ ID NO: 1148778 - protein, 4 aa, Mycobacterium
HPGR

SEQ ID NO: 1148779 - protein, 4 aa, Mycobacterium
HPGY

SEQ ID NO: 1148780 - protein, 7 aa, Mycobacterium
HPKEEPS

SEQ ID NO: 1148781 - protein, 9 aa, Mycobacterium
HPQRKDYPL

SEQ ID NO: 1148782 - protein, 4 aa, Mycobacterium
HPRK

SEQ ID NO: 1148783 - protein, 6 aa, Mycobacterium
HPSETV

SEQ ID NO: 1148784 - protein, 4 aa, Mycobacterium
HPTE

SEQ ID NO: 1148785 - protein, 8 aa, Mycobacterium
HPTETRRR

SEQ ID NO: 1148786 - protein, 5 aa, Mycobacterium
HPTQS

SEQ ID NO: 1148787 - protein, 6 aa, Mycobacterium
HPVTGG

SEQ ID NO: 1148788 - protein, 26 aa, Mycobacterium
HPYPPTPWNANPRDSYGTPGPYEDAV

SEQ ID NO: 1148789 - protein, 15 aa, Mycobacterium
HQGEGVATGKRDQRD

SEQ ID NO: 1148790 - protein, 5 aa, Mycobacterium
HRGDG

SEQ ID NO: 1148791 - protein, 8 aa, Mycobacterium
HRGTGARG

SEQ ID NO: 1148792 - protein, 6 aa, Mycobacterium
HRNPRV

SEQ ID NO: 1148793 - protein, 4 aa, Mycobacterium
HRRG

SEQ ID NO: 1148794 - protein, 15 aa, Mycobacterium
HRRPGSIGGCATPGR

SEQ ID NO: 1148795 - protein, 6 aa, Mycobacterium
HRRQDG

SEQ ID NO: 1148796 - protein, 4 aa, Mycobacterium
HRRR

SEQ ID NO: 1148797 - protein, 20 aa, Mycobacterium
HRSREAAGLPPAAANVAAAS

SEQ ID NO: 1148798 - protein, 6 aa, Mycobacterium
HSENAA

SEQ ID NO: 1148799 - protein, 11 aa, Mycobacterium
HSERSGEPIEP

SEQ ID NO: 1148800 - protein, 4 aa, Mycobacterium
HSET

SEQ ID NO: 1148801 - protein, 9 aa, Mycobacterium
HSGGNLPPD

SEQ ID NO: 1148802 - protein, 5 aa, Mycobacterium
HSGQS

SEQ ID NO: 1148803 - protein, 13 aa, Mycobacterium
HSNAGDNSGGEQE

SEQ ID NO: 1148804 - protein, 9 aa, Mycobacterium
HSPDTAGGL

SEQ ID NO: 1148805 - protein, 7 aa, Mycobacterium
HSQDTSE

SEQ ID NO: 1148806 - protein, 8 aa, Mycobacterium
HSQSHYAA

SEQ ID NO: 1148807 - protein, 7 aa, Mycobacterium
HSRPMPE

SEQ ID NO: 1148808 - protein, 8 aa, Mycobacterium
HSTGGVGD

SEQ ID NO: 1148809 - protein, 5 aa, Mycobacterium
HSTPG

SEQ ID NO: 1148810 - protein, 13 aa, Mycobacterium
HTAGTSSQISDGA

SEQ ID NO: 1148811 - protein, 7 aa, Mycobacterium
HTDSPNL

SEQ ID NO: 1148812 - protein, 5 aa, Mycobacterium
HTEEG

SEQ ID NO: 1148813 - protein, 6 aa, Mycobacterium
HTEVPS

SEQ ID NO: 1148814 - protein, 10 aa, Mycobacterium
HTGGNSSGIV

SEQ ID NO: 1148815 - protein, 6 aa, Mycobacterium
HTGPVY

SEQ ID NO: 1148816 - protein, 6 aa, Mycobacterium
HTKGPK

SEQ ID NO: 1148817 - protein, 13 aa, Mycobacterium
HTNPKPQKRDFDE

SEQ ID NO: 1148818 - protein, 6 aa, Mycobacterium
HTPGRT

SEQ ID NO: 1148819 - protein, 5 aa, Mycobacterium
HTPGS

SEQ ID NO: 1148820 - protein, 9 aa, Mycobacterium
HTSRTQEQV

SEQ ID NO: 1148821 - protein, 8 aa, Mycobacterium
HTSSGTSS

SEQ ID NO: 1148822 - protein, 6 aa, Mycobacterium
HTTEGW

SEQ ID NO: 1148823 - protein, 8 aa, Mycobacterium
HWGGTRNG

SEQ ID NO: 1148824 - protein, 6 aa, Mycobacterium
HYGGGD

SEQ ID NO: 1148825 - protein, 11 aa, Mycobacterium
HYGSPDKDPAV

SEQ ID NO: 1148826 - protein, 14 aa, Mycobacterium
HYRQGEGESCGTAV

SEQ ID NO: 1148827 - protein, 9 aa, Mycobacterium
IADGRHDDQ

SEQ ID NO: 1148828 - protein, 11 aa, Mycobacterium
IAEPDKDGGAL

SEQ ID NO: 1148829 - protein, 10 aa, Mycobacterium
IAESAPTAGL

SEQ ID NO: 1148830 - protein, 4 aa, Mycobacterium
IAGA

SEQ ID NO: 1148831 - protein, 4 aa, Mycobacterium
IAGH

SEQ ID NO: 1148832 - protein, 5 aa, Mycobacterium
IANGV

SEQ ID NO: 1148833 - protein, 9 aa, Mycobacterium
IAPPPQEAL

SEQ ID NO: 1148834 - protein, 8 aa, Mycobacterium
IAPRARTA

SEQ ID NO: 1148835 - protein, 10 aa, Mycobacterium
IAQAEAAGDG

SEQ ID NO: 1148836 - protein, 20 aa, Mycobacterium
IARKSENPSITRDVSGEGVQ

SEQ ID NO: 1148837 - protein, 7 aa, Mycobacterium
IASKDTR

SEQ ID NO: 1148838 - protein, 6 aa, Mycobacterium
IDAAAG

SEQ ID NO: 1148839 - protein, 15 aa, Mycobacterium
IDAGGRAGQTSEESE

SEQ ID NO: 1148840 - protein, 4 aa, Mycobacterium
IDAS

SEQ ID NO: 1148841 - protein, 5 aa, Mycobacterium
IDEDG

SEQ ID NO: 1148842 - protein, 7 aa, Mycobacterium
IDGESLG

SEQ ID NO: 1148843 - protein, 9 aa, Mycobacterium
IDKSTEKTL

SEQ ID NO: 1148844 - protein, 6 aa, Mycobacterium
IDPRNS

SEQ ID NO: 1148845 - protein, 16 aa, Mycobacterium
IDQKSTNRNPRSTVGT

SEQ ID NO: 1148846 - protein, 6 aa, Mycobacterium
IDRPRG

SEQ ID NO: 1148847 - protein, 7 aa, Mycobacterium
IDSGREP

SEQ ID NO: 1148848 - protein, 8 aa, Mycobacterium
IEADPANP

SEQ ID NO: 1148849 - protein, 6 aa, Mycobacterium
IEGEMG

SEQ ID NO: 1148850 - protein, 13 aa, Mycobacterium
IENSDSDYDREKL

SEQ ID NO: 1148851 - protein, 7 aa, Mycobacterium
IEPRTGR

SEQ ID NO: 1148852 - protein, 6 aa, Mycobacterium
IETADD

SEQ ID NO: 1148853 - protein, 4 aa, Mycobacterium
IETE

SEQ ID NO: 1148854 - protein, 7 aa, Mycobacterium
IGEAGAD

SEQ ID NO: 1148855 - protein, 4 aa, Mycobacterium
IGER

SEQ ID NO: 1148856 - protein, 5 aa, Mycobacterium
IGGAR

SEQ ID NO: 1148857 - protein, 6 aa, Mycobacterium
IGPESV

SEQ ID NO: 1148858 - protein, 5 aa, Mycobacterium
IGPGL

SEQ ID NO: 1148859 - protein, 5 aa, Mycobacterium
IGPKG

SEQ ID NO: 1148860 - protein, 6 aa, Mycobacterium
IGPPGW

SEQ ID NO: 1148861 - protein, 10 aa, Mycobacterium
IGPSGSGKTT

SEQ ID NO: 1148862 - protein, 7 aa, Mycobacterium
IGRGQDA

SEQ ID NO: 1148863 - protein, 8 aa, Mycobacterium
IGRPSTYS

SEQ ID NO: 1148864 - protein, 10 aa, Mycobacterium
IGRRSPDGRE

SEQ ID NO: 1148865 - protein, 4 aa, Mycobacterium
IGSA

SEQ ID NO: 1148866 - protein, 10 aa, Mycobacterium
IGSGRTTRAI

SEQ ID NO: 1148867 - protein, 7 aa, Mycobacterium
IGTASDA

SEQ ID NO: 1148868 - protein, 9 aa, Mycobacterium
IGTATPRRV

SEQ ID NO: 1148869 - protein, 8 aa, Mycobacterium
IGTGGGQG

SEQ ID NO: 1148870 - protein, 8 aa, Mycobacterium
IKGSPTTE

SEQ ID NO: 1148871 - protein, 4 aa, Mycobacterium
IKPP

SEQ ID NO: 1148872 - protein, 7 aa, Mycobacterium
IKTPEEV

SEQ ID NO: 1148873 - protein, 7 aa, Mycobacterium
ILDSGGR

SEQ ID NO: 1148874 - protein, 7 aa, Mycobacterium
INANPAS

SEQ ID NO: 1148875 - protein, 4 aa, Mycobacterium
INEG

SEQ ID NO: 1148876 - protein, 6 aa, Mycobacterium
INGLRG

SEQ ID NO: 1148877 - protein, 4 aa, Mycobacterium
INTR

SEQ ID NO: 1148878 - protein, 11 aa, Mycobacterium
INTVRGNRNRM

SEQ ID NO: 1148879 - protein, 12 aa, Mycobacterium
IPATADTSSQLT

SEQ ID NO: 1148880 - protein, 6 aa, Mycobacterium
IPEGTV

SEQ ID NO: 1148881 - protein, 6 aa, Mycobacterium
IPENEH

SEQ ID NO: 1148882 - protein, 8 aa, Mycobacterium
IPGENGEM

SEQ ID NO: 1148883 - protein, 6 aa, Mycobacterium
IPGNEE

SEQ ID NO: 1148884 - protein, 6 aa, Mycobacterium
IPGRNG

SEQ ID NO: 1148885 - protein, 8 aa, Mycobacterium
IPKTNPEL

SEQ ID NO: 1148886 - protein, 9 aa, Mycobacterium
IPPAEAEAR

SEQ ID NO: 1148887 - protein, 9 aa, Mycobacterium
IPPAPRGVP

SEQ ID NO: 1148888 - protein, 5 aa, Mycobacterium
IPPNR

SEQ ID NO: 1148889 - protein, 4 aa, Mycobacterium
IPQS

SEQ ID NO: 1148890 - protein, 4 aa, Mycobacterium
IPQT

SEQ ID NO: 1148891 - protein, 4 aa, Mycobacterium
IPVA

SEQ ID NO: 1148892 - protein, 9 aa, Mycobacterium
IQDKGEGKN

SEQ ID NO: 1148893 - protein, 9 aa, Mycobacterium
IQGEGGDRH

SEQ ID NO: 1148894 - protein, 6 aa, Mycobacterium
IQGGGS

SEQ ID NO: 1148895 - protein, 13 aa, Mycobacterium
IRAQGGVSRMSDP

SEQ ID NO: 1148896 - protein, 4 aa, Mycobacterium
IREG

SEQ ID NO: 1148897 - protein, 5 aa, Mycobacterium
IRGAG

SEQ ID NO: 1148898 - protein, 6 aa, Mycobacterium
IRPSTI

SEQ ID NO: 1148899 - protein, 17 aa, Mycobacterium
IRRTRAGLKDPKRPSGS

SEQ ID NO: 1148900 - protein, 5 aa, Mycobacterium
IRTNE

SEQ ID NO: 1148901 - protein, 6 aa, Mycobacterium
ISDPRN

SEQ ID NO: 1148902 - protein, 10 aa, Mycobacterium
ISETETRTQA

SEQ ID NO: 1148903 - protein, 6 aa, Mycobacterium
ISGGTD

SEQ ID NO: 1148904 - protein, 4 aa, Mycobacterium
ISGK

SEQ ID NO: 1148905 - protein, 8 aa, Mycobacterium
ISGKKGER

SEQ ID NO: 1148906 - protein, 9 aa, Mycobacterium
ISKAADAVS

SEQ ID NO: 1148907 - protein, 17 aa, Mycobacterium
ISSDQAKANYVKAAGKG

SEQ ID NO: 1148908 - protein, 13 aa, Mycobacterium
ISSPSDPTANPIL

SEQ ID NO: 1148909 - protein, 9 aa, Mycobacterium
ISTGGGASL

SEQ ID NO: 1148910 - protein, 9 aa, Mycobacterium
ISTPDAPSI

SEQ ID NO: 1148911 - protein, 12 aa, Mycobacterium
ITDASGRTLSGQ

SEQ ID NO: 1148912 - protein, 12 aa, Mycobacterium
ITDGEGGEVSPK

SEQ ID NO: 1148913 - protein, 9 aa, Mycobacterium
ITDRQQVGD

SEQ ID NO: 1148914 - protein, 10 aa, Mycobacterium
ITEDPTPRGH

SEQ ID NO: 1148915 - protein, 10 aa, Mycobacterium
ITGGDSGIGR

SEQ ID NO: 1148916 - protein, 4 aa, Mycobacterium
ITGP

SEQ ID NO: 1148917 - protein, 11 aa, Mycobacterium
ITGPNGAGKST

SEQ ID NO: 1148918 - protein, 7 aa, Mycobacterium
ITGSGIE

SEQ ID NO: 1148919 - protein, 8 aa, Mycobacterium
ITNSGTDI

SEQ ID NO: 1148920 - protein, 4 aa, Mycobacterium
ITPA

SEQ ID NO: 1148921 - protein, 6 aa, Mycobacterium
ITPDPG

SEQ ID NO: 1148922 - protein, 8 aa, Mycobacterium
ITPTGGHL

SEQ ID NO: 1148923 - protein, 6 aa, Mycobacterium
ITRNNP

SEQ ID NO: 1148924 - protein, 9 aa, Mycobacterium
ITSAGTAAG

SEQ ID NO: 1148925 - protein, 4 aa, Mycobacterium
IVPP

SEQ ID NO: 1148926 - protein, 5 aa, Mycobacterium
IVPPA

SEQ ID NO: 1148927 - protein, 4 aa, Mycobacterium
IYEA

SEQ ID NO: 1148928 - protein, 5 aa, Mycobacterium
IYPGN

SEQ ID NO: 1148929 - protein, 12 aa, Mycobacterium
KAAAARRARAEL

SEQ ID NO: 1148930 - protein, 8 aa, Mycobacterium
KAALKDSA

SEQ ID NO: 1148931 - protein, 6 aa, Mycobacterium
KAEFDG

SEQ ID NO: 1148932 - protein, 9 aa, Mycobacterium
KAGGPNLDK

SEQ ID NO: 1148933 - protein, 8 aa, Mycobacterium
KAGTGKST

SEQ ID NO: 1148934 - protein, 9 aa, Mycobacterium
KAHEENPDY

SEQ ID NO: 1148935 - protein, 5 aa, Mycobacterium
KAHGD

SEQ ID NO: 1148936 - protein, 4 aa, Mycobacterium
KAIR

SEQ ID NO: 1148937 - protein, 8 aa, Mycobacterium
KAKALGLK

SEQ ID NO: 1148938 - protein, 6 aa, Mycobacterium
KAKAQP

SEQ ID NO: 1148939 - protein, 8 aa, Mycobacterium
KAKSQKAV

SEQ ID NO: 1148940 - protein, 8 aa, Mycobacterium
KALGSQGG

SEQ ID NO: 1148941 - protein, 7 aa, Mycobacterium
KANGVKP

SEQ ID NO: 1148942 - protein, 9 aa, Mycobacterium
KANSEEMPK

SEQ ID NO: 1148943 - protein, 8 aa, Mycobacterium
KAPPELQA

SEQ ID NO: 1148944 - protein, 8 aa, Mycobacterium
KAREVRGS

SEQ ID NO: 1148945 - protein, 6 aa, Mycobacterium
KARGAA

SEQ ID NO: 1148946 - protein, 10 aa, Mycobacterium
KARRNEAQSA

SEQ ID NO: 1148947 - protein, 9 aa, Mycobacterium
KASGPDNHE

SEQ ID NO: 1148948 - protein, 8 aa, Mycobacterium
KASKVART

SEQ ID NO: 1148949 - protein, 7 aa, Mycobacterium
KASRATV

SEQ ID NO: 1148950 - protein, 5 aa, Mycobacterium
KATPE

SEQ ID NO: 1148951 - protein, 7 aa, Mycobacterium
KATQEDP

SEQ ID NO: 1148952 - protein, 7 aa, Mycobacterium
KATREDI

SEQ ID NO: 1148953 - protein, 7 aa, Mycobacterium
KAWTGGD

SEQ ID NO: 1148954 - protein, 12 aa, Mycobacterium
KAYGGQGLPDGT

SEQ ID NO: 1148955 - protein, 5 aa, Mycobacterium
KAYSA

SEQ ID NO: 1148956 - protein, 6 aa, Mycobacterium
KDAGLQ

SEQ ID NO: 1148957 - protein, 5 aa, Mycobacterium
KDDAI

SEQ ID NO: 1148958 - protein, 6 aa, Mycobacterium
KDEEAP

SEQ ID NO: 1148959 - protein, 8 aa, Mycobacterium
KDEGGRHT

SEQ ID NO: 1148960 - protein, 8 aa, Mycobacterium
KDELTPDE

SEQ ID NO: 1148961 - protein, 7 aa, Mycobacterium
KDFVPPD

SEQ ID NO: 1148962 - protein, 10 aa, Mycobacterium
KDGAIAGPRS

SEQ ID NO: 1148963 - protein, 9 aa, Mycobacterium
KDGEALARQ

SEQ ID NO: 1148964 - protein, 6 aa, Mycobacterium
KDGGVL

SEQ ID NO: 1148965 - protein, 7 aa, Mycobacterium
KDGKPVD

SEQ ID NO: 1148966 - protein, 6 aa, Mycobacterium
KDGQNK

SEQ ID NO: 1148967 - protein, 10 aa, Mycobacterium
KDGRPKPTPV

SEQ ID NO: 1148968 - protein, 7 aa, Mycobacterium
KDHADEL

SEQ ID NO: 1148969 - protein, 10 aa, Mycobacterium
KDIDAARAEK

SEQ ID NO: 1148970 - protein, 16 aa, Mycobacterium
KDNEVEDNSQTAGGDL

SEQ ID NO: 1148971 - protein, 9 aa, Mycobacterium
KDNTAGTDE

SEQ ID NO: 1148972 - protein, 7 aa, Mycobacterium
KDPERAA

SEQ ID NO: 1148973 - protein, 6 aa, Mycobacterium
KDPGYS

SEQ ID NO: 1148974 - protein, 7 aa, Mycobacterium
KDPKTKI

SEQ ID NO: 1148975 - protein, 6 aa, Mycobacterium
KDRTGF

SEQ ID NO: 1148976 - protein, 6 aa, Mycobacterium
KDSTRQ

SEQ ID NO: 1148977 - protein, 13 aa, Mycobacterium
KDVPDTPRPPLAE

SEQ ID NO: 1148978 - protein, 6 aa, Mycobacterium
KEDGID

SEQ ID NO: 1148979 - protein, 7 aa, Mycobacterium
KEDKEGR

SEQ ID NO: 1148980 - protein, 4 aa, Mycobacterium
KEDS

SEQ ID NO: 1148981 - protein, 4 aa, Mycobacterium
KEGD

SEQ ID NO: 1148982 - protein, 6 aa, Mycobacterium
KEGSYA

SEQ ID NO: 1148983 - protein, 9 aa, Mycobacterium
KEKDEAVKG

SEQ ID NO: 1148984 - protein, 10 aa, Mycobacterium
KELATDGELA

SEQ ID NO: 1148985 - protein, 6 aa, Mycobacterium
KELGRA

SEQ ID NO: 1148986 - protein, 7 aa, Mycobacterium
KEPIGSK

SEQ ID NO: 1148987 - protein, 9 aa, Mycobacterium
KERPETAAD

SEQ ID NO: 1148988 - protein, 4 aa, Mycobacterium
KETN

SEQ ID NO: 1148989 - protein, 4 aa, Mycobacterium
KETV

SEQ ID NO: 1148990 - protein, 5 aa, Mycobacterium
KFAGE

SEQ ID NO: 1148991 - protein, 4 aa, Mycobacterium
KFTG

SEQ ID NO: 1148992 - protein, 6 aa, Mycobacterium
KGAGLG

SEQ ID NO: 1148993 - protein, 10 aa, Mycobacterium
KGAHGSRSSV

SEQ ID NO: 1148994 - protein, 8 aa, Mycobacterium
KGAPMPAP

SEQ ID NO: 1148995 - protein, 10 aa, Mycobacterium
KGASEGAGLG

SEQ ID NO: 1148996 - protein, 8 aa, Mycobacterium
KGDVGEDI

SEQ ID NO: 1148997 - protein, 7 aa, Mycobacterium
KGEPAPV

SEQ ID NO: 1148998 - protein, 5 aa, Mycobacterium
KGGEV

SEQ ID NO: 1148999 - protein, 14 aa, Mycobacterium
KGGGSVKCCTLEVH

SEQ ID NO: 1149000 - protein, 12 aa, Mycobacterium
KGGVGKTTVSAS

SEQ ID NO: 1149001 - protein, 12 aa, Mycobacterium
KGHSTGRDPARN

SEQ ID NO: 1149002 - protein, 6 aa, Mycobacterium
KGISRD

SEQ ID NO: 1149003 - protein, 7 aa, Mycobacterium
KGKLTAR

SEQ ID NO: 1149004 - protein, 7 aa, Mycobacterium
KGKPPNV

SEQ ID NO: 1149005 - protein, 7 aa, Mycobacterium
KGNTVSA

SEQ ID NO: 1149006 - protein, 19 aa, Mycobacterium
KGPDQQKPAGVLSGGERNR

SEQ ID NO: 1149007 - protein, 7 aa, Mycobacterium
KGPMGTA

SEQ ID NO: 1149008 - protein, 6 aa, Mycobacterium
KGRMEE

SEQ ID NO: 1149009 - protein, 5 aa, Mycobacterium
KGSAL

SEQ ID NO: 1149010 - protein, 4 aa, Mycobacterium
KGSI

SEQ ID NO: 1149011 - protein, 7 aa, Mycobacterium
KGSLGGN

SEQ ID NO: 1149012 - protein, 8 aa, Mycobacterium
KGTGNAEL

SEQ ID NO: 1149013 - protein, 8 aa, Mycobacterium
KGTGSYDY

SEQ ID NO: 1149014 - protein, 7 aa, Mycobacterium
KGTMTAA

SEQ ID NO: 1149015 - protein, 4 aa, Mycobacterium
KGYD

SEQ ID NO: 1149016 - protein, 6 aa, Mycobacterium
KGYYGA

SEQ ID NO: 1149017 - protein, 4 aa, Mycobacterium
KHFS

SEQ ID NO: 1149018 - protein, 8 aa, Mycobacterium
KHIDGQGR

SEQ ID NO: 1149019 - protein, 13 aa, Mycobacterium
KHPRGAFTDDPAK

SEQ ID NO: 1149020 - protein, 5 aa, Mycobacterium
KIAES

SEQ ID NO: 1149021 - protein, 7 aa, Mycobacterium
KINEPRF

SEQ ID NO: 1149022 - protein, 8 aa, Mycobacterium
KKAAAGEI

SEQ ID NO: 1149023 - protein, 7 aa, Mycobacterium
KKAAGNV

SEQ ID NO: 1149024 - protein, 9 aa, Mycobacterium
KKDGRARSI

SEQ ID NO: 1149025 - protein, 9 aa, Mycobacterium
KKGDKDFSA

SEQ ID NO: 1149026 - protein, 10 aa, Mycobacterium
KKNRRNDPDR

SEQ ID NO: 1149027 - protein, 6 aa, Mycobacterium
KKPKFK

SEQ ID NO: 1149028 - protein, 13 aa, Mycobacterium
KKQAQESIAEEAT

SEQ ID NO: 1149029 - protein, 6 aa, Mycobacterium
KKRRTV

SEQ ID NO: 1149030 - protein, 8 aa, Mycobacterium
KKSEGQPF

SEQ ID NO: 1149031 - protein, 5 aa, Mycobacterium
KKSLA

SEQ ID NO: 1149032 - protein, 5 aa, Mycobacterium
KKSMP

SEQ ID NO: 1149033 - protein, 8 aa, Mycobacterium
KKTRRALD

SEQ ID NO: 1149034 - protein, 8 aa, Mycobacterium
KLASGDVN

SEQ ID NO: 1149035 - protein, 15 aa, Mycobacterium
KLGEDLPGLEPPYGK

SEQ ID NO: 1149036 - protein, 4 aa, Mycobacterium
KLGN

SEQ ID NO: 1149037 - protein, 4 aa, Mycobacterium
KLPT

SEQ ID NO: 1149038 - protein, 4 aa, Mycobacterium
KLQG

SEQ ID NO: 1149039 - protein, 15 aa, Mycobacterium
KLRPKIDPHDYETKK

SEQ ID NO: 1149040 - protein, 6 aa, Mycobacterium
KNAGEA

SEQ ID NO: 1149041 - protein, 5 aa, Mycobacterium
KNELR

SEQ ID NO: 1149042 - protein, 7 aa, Mycobacterium
KNFAGDG

SEQ ID NO: 1149043 - protein, 8 aa, Mycobacterium
KNGTDGNI

SEQ ID NO: 1149044 - protein, 6 aa, Mycobacterium
KNKGVQ

SEQ ID NO: 1149045 - protein, 8 aa, Mycobacterium
KNKLERSL

SEQ ID NO: 1149046 - protein, 5 aa, Mycobacterium
KNKSV

SEQ ID NO: 1149047 - protein, 6 aa, Mycobacterium
KNPESV

SEQ ID NO: 1149048 - protein, 5 aa, Mycobacterium
KNRNN

SEQ ID NO: 1149049 - protein, 15 aa, Mycobacterium
KNSITPRDALASAGK

SEQ ID NO: 1149050 - protein, 6 aa, Mycobacterium
KPAAYT

SEQ ID NO: 1149051 - protein, 6 aa, Mycobacterium
KPALRE

SEQ ID NO: 1149052 - protein, 5 aa, Mycobacterium
KPARE

SEQ ID NO: 1149053 - protein, 5 aa, Mycobacterium
KPEAI

SEQ ID NO: 1149054 - protein, 6 aa, Mycobacterium
KPERQR

SEQ ID NO: 1149055 - protein, 4 aa, Mycobacterium
KPFA

SEQ ID NO: 1149056 - protein, 5 aa, Mycobacterium
KPGAG

SEQ ID NO: 1149057 - protein, 8 aa, Mycobacterium
KPGKGPAF

SEQ ID NO: 1149058 - protein, 6 aa, Mycobacterium
KPNAEE

SEQ ID NO: 1149059 - protein, 8 aa, Mycobacterium
KPNVGKSS

SEQ ID NO: 1149060 - protein, 13 aa, Mycobacterium
KPPIGKRGYNEDE

SEQ ID NO: 1149061 - protein, 4 aa, Mycobacterium
KPRE

SEQ ID NO: 1149062 - protein, 5 aa, Mycobacterium
KPRQV

SEQ ID NO: 1149063 - protein, 10 aa, Mycobacterium
KPSEKDPSAS

SEQ ID NO: 1149064 - protein, 9 aa, Mycobacterium
KPSNPDGVP

SEQ ID NO: 1149065 - protein, 8 aa, Mycobacterium
KPSRGRLP

SEQ ID NO: 1149066 - protein, 4 aa, Mycobacterium
KPTQ

SEQ ID NO: 1149067 - protein, 11 aa, Mycobacterium
KPTRGEQGKGI

SEQ ID NO: 1149068 - protein, 7 aa, Mycobacterium
KPTYGTV

SEQ ID NO: 1149069 - protein, 4 aa, Mycobacterium
KPVP

SEQ ID NO: 1149070 - protein, 5 aa, Mycobacterium
KQAGS

SEQ ID NO: 1149071 - protein, 6 aa, Mycobacterium
KQHRQQ

SEQ ID NO: 1149072 - protein, 6 aa, Mycobacterium
KQKARV

SEQ ID NO: 1149073 - protein, 5 aa, Mycobacterium
KQPVK

SEQ ID NO: 1149074 - protein, 7 aa, Mycobacterium
KQSESNA

SEQ ID NO: 1149075 - protein, 6 aa, Mycobacterium
KRAVNQ

SEQ ID NO: 1149076 - protein, 6 aa, Mycobacterium
KRDTVG

SEQ ID NO: 1149077 - protein, 8 aa, Mycobacterium
KREAARAK

SEQ ID NO: 1149078 - protein, 8 aa, Mycobacterium
KRENADEK

SEQ ID NO: 1149079 - protein, 9 aa, Mycobacterium
KRENPARTV

SEQ ID NO: 1149080 - protein, 8 aa, Mycobacterium
KRGDIGST

SEQ ID NO: 1149081 - protein, 6 aa, Mycobacterium
KRGKRM

SEQ ID NO: 1149082 - protein, 4 aa, Mycobacterium
KRGR

SEQ ID NO: 1149083 - protein, 12 aa, Mycobacterium
KRGTDSRSLATE

SEQ ID NO: 1149084 - protein, 8 aa, Mycobacterium
KRGVRKSY

SEQ ID NO: 1149085 - protein, 11 aa, Mycobacterium
KRLPSARGRGR

SEQ ID NO: 1149086 - protein, 9 aa, Mycobacterium
KRLPTEDEV

SEQ ID NO: 1149087 - protein, 9 aa, Mycobacterium
KRPGMPDHG

SEQ ID NO: 1149088 - protein, 5 aa, Mycobacterium
KRPRE

SEQ ID NO: 1149089 - protein, 16 aa, Mycobacterium
KRPTDLATKQAAASVG

SEQ ID NO: 1149090 - protein, 5 aa, Mycobacterium
KRPTP

SEQ ID NO: 1149091 - protein, 5 aa, Mycobacterium
KRRDE

SEQ ID NO: 1149092 - protein, 20 aa, Mycobacterium
KRREDTHKMAEANRAFAHYR

SEQ ID NO: 1149093 - protein, 9 aa, Mycobacterium
KRTGAADDP

SEQ ID NO: 1149094 - protein, 7 aa, Mycobacterium
KRTPRLA

SEQ ID NO: 1149095 - protein, 7 aa, Mycobacterium
KRTRGGK

SEQ ID NO: 1149096 - protein, 7 aa, Mycobacterium
KRTTDQK

SEQ ID NO: 1149097 - protein, 6 aa, Mycobacterium
KRVSYG

SEQ ID NO: 1149098 - protein, 11 aa, Mycobacterium
KSATDIGGLPG

SEQ ID NO: 1149099 - protein, 4 aa, Mycobacterium
KSDR

SEQ ID NO: 1149100 - protein, 5 aa, Mycobacterium
KSGAA

SEQ ID NO: 1149101 - protein, 9 aa, Mycobacterium
KSGEGGEES

SEQ ID NO: 1149102 - protein, 6 aa, Mycobacterium
KSGEGI

SEQ ID NO: 1149103 - protein, 10 aa, Mycobacterium
KSGNPAERAA

SEQ ID NO: 1149104 - protein, 5 aa, Mycobacterium
KSGTL

SEQ ID NO: 1149105 - protein, 7 aa, Mycobacterium
KSGTTTY

SEQ ID NO: 1149106 - protein, 5 aa, Mycobacterium
KSGTV

SEQ ID NO: 1149107 - protein, 9 aa, Mycobacterium
KSKTPGHPE

SEQ ID NO: 1149108 - protein, 10 aa, Mycobacterium
KSKTQTAENI

SEQ ID NO: 1149109 - protein, 4 aa, Mycobacterium
KSLR

SEQ ID NO: 1149110 - protein, 9 aa, Mycobacterium
KSPTGSARM

SEQ ID NO: 1149111 - protein, 6 aa, Mycobacterium
KSQKQV

SEQ ID NO: 1149112 - protein, 7 aa, Mycobacterium
KSREQIP

SEQ ID NO: 1149113 - protein, 7 aa, Mycobacterium
KSSAGTL

SEQ ID NO: 1149114 - protein, 5 aa, Mycobacterium
KSVEE

SEQ ID NO: 1149115 - protein, 4 aa, Mycobacterium
KSYR

SEQ ID NO: 1149116 - protein, 7 aa, Mycobacterium
KTGKAEK

SEQ ID NO: 1149117 - protein, 10 aa, Mycobacterium
KTGKPGHVQP

SEQ ID NO: 1149118 - protein, 7 aa, Mycobacterium
KTGQGYA

SEQ ID NO: 1149119 - protein, 5 aa, Mycobacterium
KTNIG

SEQ ID NO: 1149120 - protein, 5 aa, Mycobacterium
KTPAS

SEQ ID NO: 1149121 - protein, 6 aa, Mycobacterium
KTPEGY

SEQ ID NO: 1149122 - protein, 7 aa, Mycobacterium
KTRRPSV

SEQ ID NO: 1149123 - protein, 5 aa, Mycobacterium
KTRSL

SEQ ID NO: 1149124 - protein, 12 aa, Mycobacterium
KTTEPKARALRP

SEQ ID NO: 1149125 - protein, 8 aa, Mycobacterium
KTVADPGS

SEQ ID NO: 1149126 - protein, 6 aa, Mycobacterium
KTVDRH

SEQ ID NO: 1149127 - protein, 8 aa, Mycobacterium
KTWATNGG

SEQ ID NO: 1149128 - protein, 6 aa, Mycobacterium
KTYNAG

SEQ ID NO: 1149129 - protein, 5 aa, Mycobacterium
KVGNE

SEQ ID NO: 1149130 - protein, 7 aa, Mycobacterium
KVPGSAM

SEQ ID NO: 1149131 - protein, 9 aa, Mycobacterium
KVPSEEVPA

SEQ ID NO: 1149132 - protein, 5 aa, Mycobacterium
KVRSG

SEQ ID NO: 1149133 - protein, 7 aa, Mycobacterium
KVSPISC

SEQ ID NO: 1149134 - protein, 6 aa, Mycobacterium
KWGSDR

SEQ ID NO: 1149135 - protein, 4 aa, Mycobacterium
KYDG

SEQ ID NO: 1149136 - protein, 7 aa, Mycobacterium
KYDGTRT

SEQ ID NO: 1149137 - protein, 4 aa, Mycobacterium
KYPA

SEQ ID NO: 1149138 - protein, 4 aa, Mycobacterium
KYRD

SEQ ID NO: 1149139 - protein, 5 aa, Mycobacterium
KYRDT

SEQ ID NO: 1149140 - protein, 9 aa, Mycobacterium
KYSSPQTDF

SEQ ID NO: 1149141 - protein, 4 aa, Mycobacterium
KYTE

SEQ ID NO: 1149142 - protein, 6 aa, Mycobacterium
LAAATT

SEQ ID NO: 1149143 - protein, 8 aa, Mycobacterium
LAAGASTA

SEQ ID NO: 1149144 - protein, 9 aa, Mycobacterium
LAASSESAV

SEQ ID NO: 1149145 - protein, 7 aa, Mycobacterium
LADEGIG

SEQ ID NO: 1149146 - protein, 4 aa, Mycobacterium
LADG

SEQ ID NO: 1149147 - protein, 4 aa, Mycobacterium
LADP

SEQ ID NO: 1149148 - protein, 7 aa, Mycobacterium
LADPDHA

SEQ ID NO: 1149149 - protein, 6 aa, Mycobacterium
LAETST

SEQ ID NO: 1149150 - protein, 6 aa, Mycobacterium
LAGISG

SEQ ID NO: 1149151 - protein, 11 aa, Mycobacterium
LAGPGDVDVEN

SEQ ID NO: 1149152 - protein, 8 aa, Mycobacterium
LAGSGSNV

SEQ ID NO: 1149153 - protein, 14 aa, Mycobacterium
LAKETSSKKQDATV

SEQ ID NO: 1149154 - protein, 4 aa, Mycobacterium
LAPA

SEQ ID NO: 1149155 - protein, 6 aa, Mycobacterium
LAPADR

SEQ ID NO: 1149156 - protein, 10 aa, Mycobacterium
LAPADTAGLD

SEQ ID NO: 1149157 - protein, 12 aa, Mycobacterium
LAPAKEGDADIR

SEQ ID NO: 1149158 - protein, 6 aa, Mycobacterium
LAPEGA

SEQ ID NO: 1149159 - protein, 8 aa, Mycobacterium
LAPGPHET

SEQ ID NO: 1149160 - protein, 7 aa, Mycobacterium
LAPKGTG

SEQ ID NO: 1149161 - protein, 13 aa, Mycobacterium
LAPPDPKFASEPA

SEQ ID NO: 1149162 - protein, 7 aa, Mycobacterium
LAPPSVR

SEQ ID NO: 1149163 - protein, 14 aa, Mycobacterium
LAPRRGQSFDSGVT

SEQ ID NO: 1149164 - protein, 5 aa, Mycobacterium
LAPRT

SEQ ID NO: 1149165 - protein, 4 aa, Mycobacterium
LAPS

SEQ ID NO: 1149166 - protein, 5 aa, Mycobacterium
LAPTA

SEQ ID NO: 1149167 - protein, 7 aa, Mycobacterium
LAREDED

SEQ ID NO: 1149168 - protein, 5 aa, Mycobacterium
LAREG

SEQ ID NO: 1149169 - protein, 6 aa, Mycobacterium
LARGEL

SEQ ID NO: 1149170 - protein, 7 aa, Mycobacterium
LARPTST

SEQ ID NO: 1149171 - protein, 9 aa, Mycobacterium
LARRNADGD

SEQ ID NO: 1149172 - protein, 8 aa, Mycobacterium
LARSTGDE

SEQ ID NO: 1149173 - protein, 10 aa, Mycobacterium
LASEKKCGHL

SEQ ID NO: 1149174 - protein, 7 aa, Mycobacterium
LDAATRG

SEQ ID NO: 1149175 - protein, 8 aa, Mycobacterium
LDAGADDY

SEQ ID NO: 1149176 - protein, 7 aa, Mycobacterium
LDAYERG

SEQ ID NO: 1149177 - protein, 6 aa, Mycobacterium
LDDEGQ

SEQ ID NO: 1149178 - protein, 6 aa, Mycobacterium
LDETGG

SEQ ID NO: 1149179 - protein, 8 aa, Mycobacterium
LDGGDDPA

SEQ ID NO: 1149180 - protein, 7 aa, Mycobacterium
LDGPGDV

SEQ ID NO: 1149181 - protein, 7 aa, Mycobacterium
LDGQGRV

SEQ ID NO: 1149182 - protein, 5 aa, Mycobacterium
LDGTY

SEQ ID NO: 1149183 - protein, 5 aa, Mycobacterium
LDGYS

SEQ ID NO: 1149184 - protein, 10 aa, Mycobacterium
LDPKADYGPL

SEQ ID NO: 1149185 - protein, 8 aa, Mycobacterium
LDPPGDGE

SEQ ID NO: 1149186 - protein, 6 aa, Mycobacterium
LDQDSA

SEQ ID NO: 1149187 - protein, 8 aa, Mycobacterium
LDQEGRDD

SEQ ID NO: 1149188 - protein, 11 aa, Mycobacterium
LDQSGPTVSQT

SEQ ID NO: 1149189 - protein, 9 aa, Mycobacterium
LDRDGRGDV

SEQ ID NO: 1149190 - protein, 6 aa, Mycobacterium
LDTPAS

SEQ ID NO: 1149191 - protein, 22 aa, Mycobacterium
LDTQGVKNRKQARSRYGAKKEK

SEQ ID NO: 1149192 - protein, 6 aa, Mycobacterium
LEAGAD

SEQ ID NO: 1149193 - protein, 8 aa, Mycobacterium
LEARGKKT

SEQ ID NO: 1149194 - protein, 4 aa, Mycobacterium
LEDA

SEQ ID NO: 1149195 - protein, 4 aa, Mycobacterium
LEGA

SEQ ID NO: 1149196 - protein, 6 aa, Mycobacterium
LEGEGI

SEQ ID NO: 1149197 - protein, 10 aa, Mycobacterium
LEGKSAGEYM

SEQ ID NO: 1149198 - protein, 6 aa, Mycobacterium
LEGTAD

SEQ ID NO: 1149199 - protein, 12 aa, Mycobacterium
LENATDEDRQRV

SEQ ID NO: 1149200 - protein, 4 aa, Mycobacterium
LENG

SEQ ID NO: 1149201 - protein, 8 aa, Mycobacterium
LENPGPED

SEQ ID NO: 1149202 - protein, 7 aa, Mycobacterium
LEQTQEG

SEQ ID NO: 1149203 - protein, 14 aa, Mycobacterium
LESRAGVGVTGGGT

SEQ ID NO: 1149204 - protein, 4 aa, Mycobacterium
LEST

SEQ ID NO: 1149205 - protein, 6 aa, Mycobacterium
LETSHE

SEQ ID NO: 1149206 - protein, 4 aa, Mycobacterium
LGAA

SEQ ID NO: 1149207 - protein, 9 aa, Mycobacterium
LGAEQSGHV

SEQ ID NO: 1149208 - protein, 8 aa, Mycobacterium
LGARQGAG

SEQ ID NO: 1149209 - protein, 5 aa, Mycobacterium
LGATG

SEQ ID NO: 1149210 - protein, 5 aa, Mycobacterium
LGDPA

SEQ ID NO: 1149211 - protein, 12 aa, Mycobacterium
LGDPPGGWPEPL

SEQ ID NO: 1149212 - protein, 9 aa, Mycobacterium
LGDPTTAVE

SEQ ID NO: 1149213 - protein, 4 aa, Mycobacterium
LGEA

SEQ ID NO: 1149214 - protein, 8 aa, Mycobacterium
LGEDGDPL

SEQ ID NO: 1149215 - protein, 5 aa, Mycobacterium
LGEHR

SEQ ID NO: 1149216 - protein, 10 aa, Mycobacterium
LGGAGGELGD

SEQ ID NO: 1149217 - protein, 5 aa, Mycobacterium
LGGDA

SEQ ID NO: 1149218 - protein, 14 aa, Mycobacterium
LGGDEEAVVYAGTG

SEQ ID NO: 1149219 - protein, 6 aa, Mycobacterium
LGGKGA

SEQ ID NO: 1149220 - protein, 5 aa, Mycobacterium
LGGLG

SEQ ID NO: 1149221 - protein, 5 aa, Mycobacterium
LGGPR

SEQ ID NO: 1149222 - protein, 8 aa, Mycobacterium
LGGRAGYY

SEQ ID NO: 1149223 - protein, 14 aa, Mycobacterium
LGGRSNSGEGGEDV

SEQ ID NO: 1149224 - protein, 9 aa, Mycobacterium
LGKDGTKGK

SEQ ID NO: 1149225 - protein, 4 aa, Mycobacterium
LGNE

SEQ ID NO: 1149226 - protein, 15 aa, Mycobacterium
LGNHANASSEVEYDG

SEQ ID NO: 1149227 - protein, 8 aa, Mycobacterium
LGPDRVRP

SEQ ID NO: 1149228 - protein, 5 aa, Mycobacterium
LGPEY

SEQ ID NO: 1149229 - protein, 4 aa, Mycobacterium
LGPG

SEQ ID NO: 1149230 - protein, 8 aa, Mycobacterium
LGPGDPEL

SEQ ID NO: 1149231 - protein, 10 aa, Mycobacterium
LGPSGSGKST

SEQ ID NO: 1149232 - protein, 8 aa, Mycobacterium
LGREQART

SEQ ID NO: 1149233 - protein, 4 aa, Mycobacterium
LGRG

SEQ ID NO: 1149234 - protein, 6 aa, Mycobacterium
LGRHTN

SEQ ID NO: 1149235 - protein, 5 aa, Mycobacterium
LGRPG

SEQ ID NO: 1149236 - protein, 5 aa, Mycobacterium
LGRPH

SEQ ID NO: 1149237 - protein, 4 aa, Mycobacterium
LGRT

SEQ ID NO: 1149238 - protein, 18 aa, Mycobacterium
LGSEQTAAAEGKVGTVRR

SEQ ID NO: 1149239 - protein, 6 aa, Mycobacterium
LGSPKQ

SEQ ID NO: 1149240 - protein, 8 aa, Mycobacterium
LGSPPKDV

SEQ ID NO: 1149241 - protein, 7 aa, Mycobacterium
LGTDGRQ

SEQ ID NO: 1149242 - protein, 6 aa, Mycobacterium
LGTGGL

SEQ ID NO: 1149243 - protein, 4 aa, Mycobacterium
LGTH

SEQ ID NO: 1149244 - protein, 4 aa, Mycobacterium
LGTS

SEQ ID NO: 1149245 - protein, 4 aa, Mycobacterium
LGVD

SEQ ID NO: 1149246 - protein, 9 aa, Mycobacterium
LHPHGGASM

SEQ ID NO: 1149247 - protein, 6 aa, Mycobacterium
LHQGGT

SEQ ID NO: 1149248 - protein, 6 aa, Mycobacterium
LHTNRG

SEQ ID NO: 1149249 - protein, 8 aa, Mycobacterium
LKAGKSTL

SEQ ID NO: 1149250 - protein, 6 aa, Mycobacterium
LKAGQR

SEQ ID NO: 1149251 - protein, 12 aa, Mycobacterium
LKDGTDAVGNRT

SEQ ID NO: 1149252 - protein, 11 aa, Mycobacterium
LKDSGERNDVA

SEQ ID NO: 1149253 - protein, 7 aa, Mycobacterium
LKESHPH

SEQ ID NO: 1149254 - protein, 7 aa, Mycobacterium
LKPEKDG

SEQ ID NO: 1149255 - protein, 8 aa, Mycobacterium
LKRGGTNL

SEQ ID NO: 1149256 - protein, 6 aa, Mycobacterium
LKSASD

SEQ ID NO: 1149257 - protein, 15 aa, Mycobacterium
LKVDSRDGSYLGRVN

SEQ ID NO: 1149258 - protein, 7 aa, Mycobacterium
LNGPDAA

SEQ ID NO: 1149259 - protein, 7 aa, Mycobacterium
LNHTGSH

SEQ ID NO: 1149260 - protein, 5 aa, Mycobacterium
LNPAQ

SEQ ID NO: 1149261 - protein, 10 aa, Mycobacterium
LNPGGSSKDR

SEQ ID NO: 1149262 - protein, 7 aa, Mycobacterium
LNPQQRQ

SEQ ID NO: 1149263 - protein, 7 aa, Mycobacterium
LNPRTRE

SEQ ID NO: 1149264 - protein, 8 aa, Mycobacterium
LNPSRRGH

SEQ ID NO: 1149265 - protein, 11 aa, Mycobacterium
LNVNGSSLAAG

SEQ ID NO: 1149266 - protein, 5 aa, Mycobacterium
LPADE

SEQ ID NO: 1149267 - protein, 5 aa, Mycobacterium
LPARG

SEQ ID NO: 1149268 - protein, 4 aa, Mycobacterium
LPDE

SEQ ID NO: 1149269 - protein, 5 aa, Mycobacterium
LPDGA

SEQ ID NO: 1149270 - protein, 5 aa, Mycobacterium
LPDPF

SEQ ID NO: 1149271 - protein, 9 aa, Mycobacterium
LPDPSPRAG

SEQ ID NO: 1149272 - protein, 5 aa, Mycobacterium
LPEGT

SEQ ID NO: 1149273 - protein, 5 aa, Mycobacterium
LPEQG

SEQ ID NO: 1149274 - protein, 4 aa, Mycobacterium
LPER

SEQ ID NO: 1149275 - protein, 7 aa, Mycobacterium
LPFPPEP

SEQ ID NO: 1149276 - protein, 8 aa, Mycobacterium
LPGLPPLS

SEQ ID NO: 1149277 - protein, 10 aa, Mycobacterium
LPGPPIPGEV

SEQ ID NO: 1149278 - protein, 11 aa, Mycobacterium
LPGSGTDTHAV

SEQ ID NO: 1149279 - protein, 9 aa, Mycobacterium
LPHGTGKTA

SEQ ID NO: 1149280 - protein, 4 aa, Mycobacterium
LPPA

SEQ ID NO: 1149281 - protein, 17 aa, Mycobacterium
LPPATSTQIADAAGLDE

SEQ ID NO: 1149282 - protein, 5 aa, Mycobacterium
LPPDH

SEQ ID NO: 1149283 - protein, 4 aa, Mycobacterium
LPPL

SEQ ID NO: 1149284 - protein, 5 aa, Mycobacterium
LPPNV

SEQ ID NO: 1149285 - protein, 4 aa, Mycobacterium
LPPP

SEQ ID NO: 1149286 - protein, 15 aa, Mycobacterium
LPPPGRDGTGSAEQL

SEQ ID NO: 1149287 - protein, 12 aa, Mycobacterium
LPQEQSQRAGHI

SEQ ID NO: 1149288 - protein, 5 aa, Mycobacterium
LPQPS

SEQ ID NO: 1149289 - protein, 5 aa, Mycobacterium
LPRPE

SEQ ID NO: 1149290 - protein, 4 aa, Mycobacterium
LPSE

SEQ ID NO: 1149291 - protein, 8 aa, Mycobacterium
LPSEESAT

SEQ ID NO: 1149292 - protein, 4 aa, Mycobacterium
LPSN

SEQ ID NO: 1149293 - protein, 8 aa, Mycobacterium
LPSPYTAR

SEQ ID NO: 1149294 - protein, 6 aa, Mycobacterium
LPSTPR

SEQ ID NO: 1149295 - protein, 11 aa, Mycobacterium
LPTDRVPTSKD

SEQ ID NO: 1149296 - protein, 4 aa, Mycobacterium
LPTG

SEQ ID NO: 1149297 - protein, 5 aa, Mycobacterium
LPTRS

SEQ ID NO: 1149298 - protein, 4 aa, Mycobacterium
LQAP

SEQ ID NO: 1149299 - protein, 15 aa, Mycobacterium
LQAQGRQLGGRGPAT

SEQ ID NO: 1149300 - protein, 6 aa, Mycobacterium
LQDESS

SEQ ID NO: 1149301 - protein, 4 aa, Mycobacterium
LQPA

SEQ ID NO: 1149302 - protein, 4 aa, Mycobacterium
LQPD

SEQ ID NO: 1149303 - protein, 12 aa, Mycobacterium
LQPNAGSQGEYA

SEQ ID NO: 1149304 - protein, 4 aa, Mycobacterium
LQSA

SEQ ID NO: 1149305 - protein, 6 aa, Mycobacterium
LQTPKA

SEQ ID NO: 1149306 - protein, 6 aa, Mycobacterium
LQYSGD

SEQ ID NO: 1149307 - protein, 7 aa, Mycobacterium
LRAGADG

SEQ ID NO: 1149308 - protein, 10 aa, Mycobacterium
LRANSSTERA

SEQ ID NO: 1149309 - protein, 4 aa, Mycobacterium
LRET

SEQ ID NO: 1149310 - protein, 4 aa, Mycobacterium
LRGD

SEQ ID NO: 1149311 - protein, 8 aa, Mycobacterium
LRGDSREP

SEQ ID NO: 1149312 - protein, 11 aa, Mycobacterium
LRGKSPYGAPQ

SEQ ID NO: 1149313 - protein, 6 aa, Mycobacterium
LRGNPT

SEQ ID NO: 1149314 - protein, 4 aa, Mycobacterium
LRGS

SEQ ID NO: 1149315 - protein, 5 aa, Mycobacterium
LRPED

SEQ ID NO: 1149316 - protein, 5 aa, Mycobacterium
LRPPK

SEQ ID NO: 1149317 - protein, 8 aa, Mycobacterium
LRRDTVGD

SEQ ID NO: 1149318 - protein, 8 aa, Mycobacterium
LRSDGTRI

SEQ ID NO: 1149319 - protein, 7 aa, Mycobacterium
LRSPSGV

SEQ ID NO: 1149320 - protein, 6 aa, Mycobacterium
LSAAPG

SEQ ID NO: 1149321 - protein, 6 aa, Mycobacterium
LSADPR

SEQ ID NO: 1149322 - protein, 8 aa, Mycobacterium
LSAPGSRL

SEQ ID NO: 1149323 - protein, 5 aa, Mycobacterium
LSDDP

SEQ ID NO: 1149324 - protein, 8 aa, Mycobacterium
LSDNETVD

SEQ ID NO: 1149325 - protein, 7 aa, Mycobacterium
LSEEELD

SEQ ID NO: 1149326 - protein, 11 aa, Mycobacterium
LSEPQAGSDAA

SEQ ID NO: 1149327 - protein, 7 aa, Mycobacterium
LSGGERQ

SEQ ID NO: 1149328 - protein, 8 aa, Mycobacterium
LSGGQQQR

SEQ ID NO: 1149329 - protein, 25 aa, Mycobacterium
LSGRHGERDTRRAGAAGELTGATRP

SEQ ID NO: 1149330 - protein, 11 aa, Mycobacterium
LSGSANVTTGQ

SEQ ID NO: 1149331 - protein, 6 aa, Mycobacterium
LSNQKH

SEQ ID NO: 1149332 - protein, 5 aa, Mycobacterium
LSPDE

SEQ ID NO: 1149333 - protein, 7 aa, Mycobacterium
LSQDEGV

SEQ ID NO: 1149334 - protein, 4 aa, Mycobacterium
LSRG

SEQ ID NO: 1149335 - protein, 5 aa, Mycobacterium
LSRPS

SEQ ID NO: 1149336 - protein, 4 aa, Mycobacterium
LSRR

SEQ ID NO: 1149337 - protein, 4 aa, Mycobacterium
LSSE

SEQ ID NO: 1149338 - protein, 8 aa, Mycobacterium
LSSSPRQA

SEQ ID NO: 1149339 - protein, 6 aa, Mycobacterium
LSTPAA

SEQ ID NO: 1149340 - protein, 10 aa, Mycobacterium
LSTPDSEEAA

SEQ ID NO: 1149341 - protein, 9 aa, Mycobacterium
LSTPENPID

SEQ ID NO: 1149342 - protein, 13 aa, Mycobacterium
LSYGPQSDGSLSP

SEQ ID NO: 1149343 - protein, 8 aa, Mycobacterium
LTAGGDDY

SEQ ID NO: 1149344 - protein, 6 aa, Mycobacterium
LTDDER

SEQ ID NO: 1149345 - protein, 6 aa, Mycobacterium
LTDEDA

SEQ ID NO: 1149346 - protein, 9 aa, Mycobacterium
LTDGTELTP

SEQ ID NO: 1149347 - protein, 5 aa, Mycobacterium
LTDNA

SEQ ID NO: 1149348 - protein, 7 aa, Mycobacterium
LTEERRR

SEQ ID NO: 1149349 - protein, 5 aa, Mycobacterium
LTETA

SEQ ID NO: 1149350 - protein, 5 aa, Mycobacterium
LTGEG

SEQ ID NO: 1149351 - protein, 5 aa, Mycobacterium
LTGKR

SEQ ID NO: 1149352 - protein, 9 aa, Mycobacterium
LTPDGPTAT

SEQ ID NO: 1149353 - protein, 6 aa, Mycobacterium
LTPDRA

SEQ ID NO: 1149354 - protein, 16 aa, Mycobacterium
LTPGGLATQYSSAGQF

SEQ ID NO: 1149355 - protein, 5 aa, Mycobacterium
LTPRE

SEQ ID NO: 1149356 - protein, 5 aa, Mycobacterium
LTRTT

SEQ ID NO: 1149357 - protein, 4 aa, Mycobacterium
LTSG

SEQ ID NO: 1149358 - protein, 5 aa, Mycobacterium
LTSSD

SEQ ID NO: 1149359 - protein, 7 aa, Mycobacterium
LTSTSSV

SEQ ID NO: 1149360 - protein, 11 aa, Mycobacterium
LTTETGAGQWG

SEQ ID NO: 1149361 - protein, 4 aa, Mycobacterium
LTTR

SEQ ID NO: 1149362 - protein, 8 aa, Mycobacterium
LVSSRRQG

SEQ ID NO: 1149363 - protein, 7 aa, Mycobacterium
LYPANSV

SEQ ID NO: 1149364 - protein, 8 aa, Mycobacterium
MADARGTT

SEQ ID NO: 1149365 - protein, 6 aa, Mycobacterium
MAGDNA

SEQ ID NO: 1149366 - protein, 6 aa, Mycobacterium
MAPGSQ

SEQ ID NO: 1149367 - protein, 5 aa, Mycobacterium
MASAA

SEQ ID NO: 1149368 - protein, 6 aa, Mycobacterium
MASGGT

SEQ ID NO: 1149369 - protein, 7 aa, Mycobacterium
MDPDDAA

SEQ ID NO: 1149370 - protein, 11 aa, Mycobacterium
MDRPGGRRFEP

SEQ ID NO: 1149371 - protein, 7 aa, Mycobacterium
MDSPDFA

SEQ ID NO: 1149372 - protein, 7 aa, Mycobacterium
MDTPEMA

SEQ ID NO: 1149373 - protein, 7 aa, Mycobacterium
MEEDTGK

SEQ ID NO: 1149374 - protein, 4 aa, Mycobacterium
MEGA

SEQ ID NO: 1149375 - protein, 7 aa, Mycobacterium
METDPGG

SEQ ID NO: 1149376 - protein, 4 aa, Mycobacterium
MGGA

SEQ ID NO: 1149377 - protein, 9 aa, Mycobacterium
MGQEPKDPD

SEQ ID NO: 1149378 - protein, 4 aa, Mycobacterium
MGRG

SEQ ID NO: 1149379 - protein, 7 aa, Mycobacterium
MGRNGGG

SEQ ID NO: 1149380 - protein, 8 aa, Mycobacterium
MGRSTEYA

SEQ ID NO: 1149381 - protein, 10 aa, Mycobacterium
MGSKRSTEKM

SEQ ID NO: 1149382 - protein, 13 aa, Mycobacterium
MGTKGGPRTDRDG

SEQ ID NO: 1149383 - protein, 4 aa, Mycobacterium
MGVS

SEQ ID NO: 1149384 - protein, 12 aa, Mycobacterium
MKEAEDALRDYQ

SEQ ID NO: 1149385 - protein, 7 aa, Mycobacterium
MKEGEEK

SEQ ID NO: 1149386 - protein, 10 aa, Mycobacterium
MNEGGPRKVS

SEQ ID NO: 1149387 - protein, 5 aa, Mycobacterium
MPCTP

SEQ ID NO: 1149388 - protein, 8 aa, Mycobacterium
MPGHNGGV

SEQ ID NO: 1149389 - protein, 7 aa, Mycobacterium
MPGPTGL

SEQ ID NO: 1149390 - protein, 14 aa, Mycobacterium
MPTPDRRRPIPWPA

SEQ ID NO: 1149391 - protein, 4 aa, Mycobacterium
MQAN

SEQ ID NO: 1149392 - protein, 6 aa, Mycobacterium
MQNTEG

SEQ ID NO: 1149393 - protein, 8 aa, Mycobacterium
MRATGSND

SEQ ID NO: 1149394 - protein, 12 aa, Mycobacterium
MRDGDDEDLERA

SEQ ID NO: 1149395 - protein, 7 aa, Mycobacterium
MRGATAP

SEQ ID NO: 1149396 - protein, 5 aa, Mycobacterium
MRGPS

SEQ ID NO: 1149397 - protein, 5 aa, Mycobacterium
MRQPN

SEQ ID NO: 1149398 - protein, 11 aa, Mycobacterium
MSAPSSGSSKV

SEQ ID NO: 1149399 - protein, 9 aa, Mycobacterium
MSDDRGRPC

SEQ ID NO: 1149400 - protein, 4 aa, Mycobacterium
MSDE

SEQ ID NO: 1149401 - protein, 5 aa, Mycobacterium
MSGAG

SEQ ID NO: 1149402 - protein, 5 aa, Mycobacterium
MSGTN

SEQ ID NO: 1149403 - protein, 4 aa, Mycobacterium
MSHG

SEQ ID NO: 1149404 - protein, 6 aa, Mycobacterium
MSKSRG

SEQ ID NO: 1149405 - protein, 6 aa, Mycobacterium
MSPARK

SEQ ID NO: 1149406 - protein, 11 aa, Mycobacterium
MSTSSNERGMS

SEQ ID NO: 1149407 - protein, 12 aa, Mycobacterium
MTAGEDPEYADV

SEQ ID NO: 1149408 - protein, 8 aa, Mycobacterium
MTGPRDDP

SEQ ID NO: 1149409 - protein, 7 aa, Mycobacterium
MTMPPST

SEQ ID NO: 1149410 - protein, 5 aa, Mycobacterium
MTPTE

SEQ ID NO: 1149411 - protein, 4 aa, Mycobacterium
MTTQ

SEQ ID NO: 1149412 - protein, 5 aa, Mycobacterium
NAAAR

SEQ ID NO: 1149413 - protein, 7 aa, Mycobacterium
NAAPTVK

SEQ ID NO: 1149414 - protein, 6 aa, Mycobacterium
NAAYSA

SEQ ID NO: 1149415 - protein, 5 aa, Mycobacterium
NADAK

SEQ ID NO: 1149416 - protein, 8 aa, Mycobacterium
NADSRGVE

SEQ ID NO: 1149417 - protein, 14 aa, Mycobacterium
NAERATDWRGNNNI

SEQ ID NO: 1149418 - protein, 12 aa, Mycobacterium
NAFHSPDDPLQL

SEQ ID NO: 1149419 - protein, 6 aa, Mycobacterium
NAGATV

SEQ ID NO: 1149420 - protein, 9 aa, Mycobacterium
NAIPQTGTL

SEQ ID NO: 1149421 - protein, 6 aa, Mycobacterium
NANPQA

SEQ ID NO: 1149422 - protein, 5 aa, Mycobacterium
NARRT

SEQ ID NO: 1149423 - protein, 6 aa, Mycobacterium
NARTTL

SEQ ID NO: 1149424 - protein, 4 aa, Mycobacterium
NARW

SEQ ID NO: 1149425 - protein, 4 aa, Mycobacterium
NASA

SEQ ID NO: 1149426 - protein, 8 aa, Mycobacterium
NASDTHPL

SEQ ID NO: 1149427 - protein, 6 aa, Mycobacterium
NASQHE

SEQ ID NO: 1149428 - protein, 4 aa, Mycobacterium
NATG

SEQ ID NO: 1149429 - protein, 6 aa, Mycobacterium
NATGHP

SEQ ID NO: 1149430 - protein, 8 aa, Mycobacterium
NATRELSE

SEQ ID NO: 1149431 - protein, 6 aa, Mycobacterium
NATTIQ

SEQ ID NO: 1149432 - protein, 12 aa, Mycobacterium
NAVQAGSLNRPG

SEQ ID NO: 1149433 - protein, 5 aa, Mycobacterium
NAVYP

SEQ ID NO: 1149434 - protein, 11 aa, Mycobacterium
NDAGDAASDAL

SEQ ID NO: 1149435 - protein, 5 aa, Mycobacterium
NDANI

SEQ ID NO: 1149436 - protein, 5 aa, Mycobacterium
NDAPV

SEQ ID NO: 1149437 - protein, 11 aa, Mycobacterium
NDAVDPDSLQP

SEQ ID NO: 1149438 - protein, 4 aa, Mycobacterium
NDDP

SEQ ID NO: 1149439 - protein, 5 aa, Mycobacterium
NDEET

SEQ ID NO: 1149440 - protein, 4 aa, Mycobacterium
NDEG

SEQ ID NO: 1149441 - protein, 5 aa, Mycobacterium
NDGGT

SEQ ID NO: 1149442 - protein, 9 aa, Mycobacterium
NDNDPRGTR

SEQ ID NO: 1149443 - protein, 6 aa, Mycobacterium
NDNGGG

SEQ ID NO: 1149444 - protein, 4 aa, Mycobacterium
NDPY

SEQ ID NO: 1149445 - protein, 7 aa, Mycobacterium
NDRPTGT

SEQ ID NO: 1149446 - protein, 28 aa, Mycobacterium
NDRREEGDLRENGGYHAAREQQGQEEAR

SEQ ID NO: 1149447 - protein, 7 aa, Mycobacterium
NDSEYGL

SEQ ID NO: 1149448 - protein, 7 aa, Mycobacterium
NDSPYGL

SEQ ID NO: 1149449 - protein, 8 aa, Mycobacterium
NDSPYGLS

SEQ ID NO: 1149450 - protein, 7 aa, Mycobacterium
NDTDRDA

SEQ ID NO: 1149451 - protein, 6 aa, Mycobacterium
NDTVAT

SEQ ID NO: 1149452 - protein, 8 aa, Mycobacterium
NEAEKAAD

SEQ ID NO: 1149453 - protein, 9 aa, Mycobacterium
NEAETTTAS

SEQ ID NO: 1149454 - protein, 6 aa, Mycobacterium
NEEETV

SEQ ID NO: 1149455 - protein, 4 aa, Mycobacterium
NEHE

SEQ ID NO: 1149456 - protein, 7 aa, Mycobacterium
NEIGGGS

SEQ ID NO: 1149457 - protein, 6 aa, Mycobacterium
NEIPSR

SEQ ID NO: 1149458 - protein, 12 aa, Mycobacterium
NEISQQFSGQGS

SEQ ID NO: 1149459 - protein, 4 aa, Mycobacterium
NEIT

SEQ ID NO: 1149460 - protein, 16 aa, Mycobacterium
NERPGLANHEPQPTAA

SEQ ID NO: 1149461 - protein, 10 aa, Mycobacterium
NERSQLQNKA

SEQ ID NO: 1149462 - protein, 6 aa, Mycobacterium
NESDAA

SEQ ID NO: 1149463 - protein, 5 aa, Mycobacterium
NETQI

SEQ ID NO: 1149464 - protein, 7 aa, Mycobacterium
NETSTGV

SEQ ID NO: 1149465 - protein, 7 aa, Mycobacterium
NETTRNA

SEQ ID NO: 1149466 - protein, 6 aa, Mycobacterium
NETTTK

SEQ ID NO: 1149467 - protein, 6 aa, Mycobacterium
NEYEDV

SEQ ID NO: 1149468 - protein, 11 aa, Mycobacterium
NGASAEGTPNG

SEQ ID NO: 1149469 - protein, 8 aa, Mycobacterium
NGASASAI

SEQ ID NO: 1149470 - protein, 14 aa, Mycobacterium
NGDELADQARAHPD

SEQ ID NO: 1149471 - protein, 6 aa, Mycobacterium
NGDIPQ

SEQ ID NO: 1149472 - protein, 6 aa, Mycobacterium
NGERTG

SEQ ID NO: 1149473 - protein, 6 aa, Mycobacterium
NGFGKT

SEQ ID NO: 1149474 - protein, 10 aa, Mycobacterium
NGGSAQESVV

SEQ ID NO: 1149475 - protein, 6 aa, Mycobacterium
NGGSST

SEQ ID NO: 1149476 - protein, 6 aa, Mycobacterium
NGGSTA

SEQ ID NO: 1149477 - protein, 4 aa, Mycobacterium
NGGY

SEQ ID NO: 1149478 - protein, 6 aa, Mycobacterium
NGLDPE

SEQ ID NO: 1149479 - protein, 14 aa, Mycobacterium
NGPIEGTSNFGVFR

SEQ ID NO: 1149480 - protein, 5 aa, Mycobacterium
NGPKV

SEQ ID NO: 1149481 - protein, 6 aa, Mycobacterium
NGQAGV

SEQ ID NO: 1149482 - protein, 9 aa, Mycobacterium
NGRDSAAQR

SEQ ID NO: 1149483 - protein, 17 aa, Mycobacterium
NGRRGRPVTGPGNRPLK

SEQ ID NO: 1149484 - protein, 8 aa, Mycobacterium
NGRRSQES

SEQ ID NO: 1149485 - protein, 9 aa, Mycobacterium
NGRSYAPTI

SEQ ID NO: 1149486 - protein, 5 aa, Mycobacterium
NGRTV

SEQ ID NO: 1149487 - protein, 6 aa, Mycobacterium
NGSGGI

SEQ ID NO: 1149488 - protein, 4 aa, Mycobacterium
NGVD

SEQ ID NO: 1149489 - protein, 10 aa, Mycobacterium
NHDPLDASSV

SEQ ID NO: 1149490 - protein, 8 aa, Mycobacterium
NHHSAGSF

SEQ ID NO: 1149491 - protein, 6 aa, Mycobacterium
NHPRYA

SEQ ID NO: 1149492 - protein, 6 aa, Mycobacterium
NHYPQD

SEQ ID NO: 1149493 - protein, 10 aa, Mycobacterium
NIEDQSSDRV

SEQ ID NO: 1149494 - protein, 7 aa, Mycobacterium
NIEEGGS

SEQ ID NO: 1149495 - protein, 8 aa, Mycobacterium
NIENQSSG

SEQ ID NO: 1149496 - protein, 6 aa, Mycobacterium
NIESRG

SEQ ID NO: 1149497 - protein, 5 aa, Mycobacterium
NIPDE

SEQ ID NO: 1149498 - protein, 5 aa, Mycobacterium
NKLGK

SEQ ID NO: 1149499 - protein, 6 aa, Mycobacterium
NKSTAT

SEQ ID NO: 1149500 - protein, 23 aa, Mycobacterium
NKTGYHKRQGHRQQLTVLKVTGI

SEQ ID NO: 1149501 - protein, 7 aa, Mycobacterium
NKTPIDK

SEQ ID NO: 1149502 - protein, 5 aa, Mycobacterium
NLGDA

SEQ ID NO: 1149503 - protein, 12 aa, Mycobacterium
NLNPSQAHGSGD

SEQ ID NO: 1149504 - protein, 5 aa, Mycobacterium
NLPRD

SEQ ID NO: 1149505 - protein, 7 aa, Mycobacterium
NLPTAPA

SEQ ID NO: 1149506 - protein, 6 aa, Mycobacterium
NLRKGA

SEQ ID NO: 1149507 - protein, 9 aa, Mycobacterium
NLRRSARAA

SEQ ID NO: 1149508 - protein, 6 aa, Mycobacterium
NLTAQR

SEQ ID NO: 1149509 - protein, 5 aa, Mycobacterium
NMPKG

SEQ ID NO: 1149510 - protein, 5 aa, Mycobacterium
NNGIA

SEQ ID NO: 1149511 - protein, 8 aa, Mycobacterium
NNGLTASE

SEQ ID NO: 1149512 - protein, 5 aa, Mycobacterium
NNGPL

SEQ ID NO: 1149513 - protein, 9 aa, Mycobacterium
NNPAKRVGL

SEQ ID NO: 1149514 - protein, 7 aa, Mycobacterium
NNPLSGL

SEQ ID NO: 1149515 - protein, 7 aa, Mycobacterium
NNRETGE

SEQ ID NO: 1149516 - protein, 8 aa, Mycobacterium
NNTGEIKS

SEQ ID NO: 1149517 - protein, 8 aa, Mycobacterium
NNWQDPAE

SEQ ID NO: 1149518 - protein, 4 aa, Mycobacterium
NPAA

SEQ ID NO: 1149519 - protein, 7 aa, Mycobacterium
NPAEAKT

SEQ ID NO: 1149520 - protein, 6 aa, Mycobacterium
NPAGWQ

SEQ ID NO: 1149521 - protein, 6 aa, Mycobacterium
NPAPFG

SEQ ID NO: 1149522 - protein, 4 aa, Mycobacterium
NPAV

SEQ ID NO: 1149523 - protein, 5 aa, Mycobacterium
NPDAV

SEQ ID NO: 1149524 - protein, 4 aa, Mycobacterium
NPDF

SEQ ID NO: 1149525 - protein, 4 aa, Mycobacterium
NPDR

SEQ ID NO: 1149526 - protein, 18 aa, Mycobacterium
NPDVTGPSAEGPLPATGS

SEQ ID NO: 1149527 - protein, 8 aa, Mycobacterium
NPEEGELR

SEQ ID NO: 1149528 - protein, 5 aa, Mycobacterium
NPEQA

SEQ ID NO: 1149529 - protein, 5 aa, Mycobacterium
NPEWQ

SEQ ID NO: 1149530 - protein, 5 aa, Mycobacterium
NPFPT

SEQ ID NO: 1149531 - protein, 15 aa, Mycobacterium
NPGAFKGKIGTPAYE

SEQ ID NO: 1149532 - protein, 6 aa, Mycobacterium
NPGDSV

SEQ ID NO: 1149533 - protein, 7 aa, Mycobacterium
NPGEARS

SEQ ID NO: 1149534 - protein, 4 aa, Mycobacterium
NPGN

SEQ ID NO: 1149535 - protein, 7 aa, Mycobacterium
NPHTKPP

SEQ ID NO: 1149536 - protein, 6 aa, Mycobacterium
NPIEQE

SEQ ID NO: 1149537 - protein, 5 aa, Mycobacterium
NPIEY

SEQ ID NO: 1149538 - protein, 7 aa, Mycobacterium
NPPPYDE

SEQ ID NO: 1149539 - protein, 6 aa, Mycobacterium
NPQLPK

SEQ ID NO: 1149540 - protein, 5 aa, Mycobacterium
NPQRR

SEQ ID NO: 1149541 - protein, 5 aa, Mycobacterium
NPQVR

SEQ ID NO: 1149542 - protein, 6 aa, Mycobacterium
NPRAED

SEQ ID NO: 1149543 - protein, 8 aa, Mycobacterium
NPSGTRKD

SEQ ID NO: 1149544 - protein, 4 aa, Mycobacterium
NPSP

SEQ ID NO: 1149545 - protein, 7 aa, Mycobacterium
NPSRSLQ

SEQ ID NO: 1149546 - protein, 12 aa, Mycobacterium
NPTGRMATPQEV

SEQ ID NO: 1149547 - protein, 12 aa, Mycobacterium
NPTTSPFGNPIP

SEQ ID NO: 1149548 - protein, 16 aa, Mycobacterium
NQSPTAYSKAAAEAGF

SEQ ID NO: 1149549 - protein, 7 aa, Mycobacterium
NQTQEST

SEQ ID NO: 1149550 - protein, 6 aa, Mycobacterium
NRAGSA

SEQ ID NO: 1149551 - protein, 7 aa, Mycobacterium
NRAPAKV

SEQ ID NO: 1149552 - protein, 5 aa, Mycobacterium
NREDM

SEQ ID NO: 1149553 - protein, 6 aa, Mycobacterium
NREPVD

SEQ ID NO: 1149554 - protein, 9 aa, Mycobacterium
NRGDRATAT

SEQ ID NO: 1149555 - protein, 13 aa, Mycobacterium
NRGPEQRTDKKPM

SEQ ID NO: 1149556 - protein, 21 aa, Mycobacterium
NRKESRGGHAREDYPNRDDTN

SEQ ID NO: 1149557 - protein, 6 aa, Mycobacterium
NRLGTN

SEQ ID NO: 1149558 - protein, 10 aa, Mycobacterium
NRQEGKKHPW

SEQ ID NO: 1149559 - protein, 5 aa, Mycobacterium
NRRRA

SEQ ID NO: 1149560 - protein, 10 aa, Mycobacterium
NRSSAKTQSA

SEQ ID NO: 1149561 - protein, 9 aa, Mycobacterium
NRSSGKQGY

SEQ ID NO: 1149562 - protein, 5 aa, Mycobacterium
NRTGT

SEQ ID NO: 1149563 - protein, 6 aa, Mycobacterium
NRTTRA

SEQ ID NO: 1149564 - protein, 5 aa, Mycobacterium
NSAAD

SEQ ID NO: 1149565 - protein, 13 aa, Mycobacterium
NSASKSKAVADSE

SEQ ID NO: 1149566 - protein, 10 aa, Mycobacterium
NSEGSRTTPS

SEQ ID NO: 1149567 - protein, 9 aa, Mycobacterium
NSEPRTGMS

SEQ ID NO: 1149568 - protein, 7 aa, Mycobacterium
NSGPALA

SEQ ID NO: 1149569 - protein, 4 aa, Mycobacterium
NSHE

SEQ ID NO: 1149570 - protein, 8 aa, Mycobacterium
NSLGGGTA

SEQ ID NO: 1149571 - protein, 10 aa, Mycobacterium
NSPDEVGPPE

SEQ ID NO: 1149572 - protein, 7 aa, Mycobacterium
NSQGYSR

SEQ ID NO: 1149573 - protein, 9 aa, Mycobacterium
NSQSGKGGV

SEQ ID NO: 1149574 - protein, 12 aa, Mycobacterium
NSRPERRDPPTR

SEQ ID NO: 1149575 - protein, 13 aa, Mycobacterium
NSRPTRAEASDVA

SEQ ID NO: 1149576 - protein, 7 aa, Mycobacterium
NSRRGQI

SEQ ID NO: 1149577 - protein, 7 aa, Mycobacterium
NSRTCPA

SEQ ID NO: 1149578 - protein, 7 aa, Mycobacterium
NSRVRAE

SEQ ID NO: 1149579 - protein, 13 aa, Mycobacterium
NSTNGTTVNNAPV

SEQ ID NO: 1149580 - protein, 6 aa, Mycobacterium
NSTRTR

SEQ ID NO: 1149581 - protein, 9 aa, Mycobacterium
NTADVSPGD

SEQ ID NO: 1149582 - protein, 7 aa, Mycobacterium
NTAGGSM

SEQ ID NO: 1149583 - protein, 8 aa, Mycobacterium
NTASTKSA

SEQ ID NO: 1149584 - protein, 10 aa, Mycobacterium
NTDSAGNSYG

SEQ ID NO: 1149585 - protein, 7 aa, Mycobacterium
NTGGRPL

SEQ ID NO: 1149586 - protein, 15 aa, Mycobacterium
NTGNNTYKAVQRSAG

SEQ ID NO: 1149587 - protein, 6 aa, Mycobacterium
NTLTNE

SEQ ID NO: 1149588 - protein, 6 aa, Mycobacterium
NTPPET

SEQ ID NO: 1149589 - protein, 4 aa, Mycobacterium
NTRQ

SEQ ID NO: 1149590 - protein, 7 aa, Mycobacterium
NTSEEEF

SEQ ID NO: 1149591 - protein, 22 aa, Mycobacterium
NTTIPTKRSETFTTADDNQPSV

SEQ ID NO: 1149592 - protein, 6 aa, Mycobacterium
NVAGDP

SEQ ID NO: 1149593 - protein, 12 aa, Mycobacterium
NVDGKGASYGSH

SEQ ID NO: 1149594 - protein, 4 aa, Mycobacterium
NVGS

SEQ ID NO: 1149595 - protein, 6 aa, Mycobacterium
NVQGKP

SEQ ID NO: 1149596 - protein, 6 aa, Mycobacterium
NVSGSR

SEQ ID NO: 1149597 - protein, 11 aa, Mycobacterium
NWGPQSEKKTL

SEQ ID NO: 1149598 - protein, 9 aa, Mycobacterium
NYPSLDPQG

SEQ ID NO: 1149599 - protein, 6 aa, Mycobacterium
NYQPGT

SEQ ID NO: 1149600 - protein, 5 aa, Mycobacterium
NYSGI

SEQ ID NO: 1149601 - protein, 6 aa, Mycobacterium
NYSSVT

SEQ ID NO: 1149602 - protein, 11 aa, Mycobacterium
PAARRPQPVDT

SEQ ID NO: 1149603 - protein, 4 aa, Mycobacterium
PAAS

SEQ ID NO: 1149604 - protein, 7 aa, Mycobacterium
PAATKAD

SEQ ID NO: 1149605 - protein, 9 aa, Mycobacterium
PADGPIGDS

SEQ ID NO: 1149606 - protein, 4 aa, Mycobacterium
PADI

SEQ ID NO: 1149607 - protein, 6 aa, Mycobacterium
PAEAKR

SEQ ID NO: 1149608 - protein, 9 aa, Mycobacterium
PAEAPTTRG

SEQ ID NO: 1149609 - protein, 10 aa, Mycobacterium
PAEGGSNTAV

SEQ ID NO: 1149610 - protein, 9 aa, Mycobacterium
PAEIGKNRH

SEQ ID NO: 1149611 - protein, 7 aa, Mycobacterium
PAEQTPA

SEQ ID NO: 1149612 - protein, 6 aa, Mycobacterium
PAERAA

SEQ ID NO: 1149613 - protein, 5 aa, Mycobacterium
PAGAG

SEQ ID NO: 1149614 - protein, 5 aa, Mycobacterium
PAGAY

SEQ ID NO: 1149615 - protein, 4 aa, Mycobacterium
PAGF

SEQ ID NO: 1149616 - protein, 4 aa, Mycobacterium
PAGP

SEQ ID NO: 1149617 - protein, 7 aa, Mycobacterium
PAGTGKT

SEQ ID NO: 1149618 - protein, 4 aa, Mycobacterium
PAGV

SEQ ID NO: 1149619 - protein, 8 aa, Mycobacterium
PALSTGYG

SEQ ID NO: 1149620 - protein, 4 aa, Mycobacterium
PAPA

SEQ ID NO: 1149621 - protein, 5 aa, Mycobacterium
PAPAR

SEQ ID NO: 1149622 - protein, 15 aa, Mycobacterium
PAPARRTGGHPAKRT

SEQ ID NO: 1149623 - protein, 7 aa, Mycobacterium
PAPDTAR

SEQ ID NO: 1149624 - protein, 9 aa, Mycobacterium
PAPGDGRTF

SEQ ID NO: 1149625 - protein, 8 aa, Mycobacterium
PAPGGREE

SEQ ID NO: 1149626 - protein, 6 aa, Mycobacterium
PAPSGT

SEQ ID NO: 1149627 - protein, 5 aa, Mycobacterium
PAQPE

SEQ ID NO: 1149628 - protein, 6 aa, Mycobacterium
PAQQRL

SEQ ID NO: 1149629 - protein, 4 aa, Mycobacterium
PAQR

SEQ ID NO: 1149630 - protein, 5 aa, Mycobacterium
PARAE

SEQ ID NO: 1149631 - protein, 9 aa, Mycobacterium
PARDGPPDI

SEQ ID NO: 1149632 - protein, 9 aa, Mycobacterium
PASDDRSET

SEQ ID NO: 1149633 - protein, 8 aa, Mycobacterium
PASPGTGV

SEQ ID NO: 1149634 - protein, 4 aa, Mycobacterium
PATT

SEQ ID NO: 1149635 - protein, 12 aa, Mycobacterium
PAVASSDARNIE

SEQ ID NO: 1149636 - protein, 9 aa, Mycobacterium
PAVHGGEHA

SEQ ID NO: 1149637 - protein, 17 aa, Mycobacterium
PAVTGKPSGDDLRSGKR

SEQ ID NO: 1149638 - protein, 21 aa, Mycobacterium
PAYNSGGPWGYTPKGGTGVPT

SEQ ID NO: 1149639 - protein, 6 aa, Mycobacterium
PAYRSS

SEQ ID NO: 1149640 - protein, 6 aa, Mycobacterium
PDAKPP

SEQ ID NO: 1149641 - protein, 4 aa, Mycobacterium
PDAL

SEQ ID NO: 1149642 - protein, 4 aa, Mycobacterium
PDAN

SEQ ID NO: 1149643 - protein, 4 aa, Mycobacterium
PDAP

SEQ ID NO: 1149644 - protein, 12 aa, Mycobacterium
PDATVADAEAAV

SEQ ID NO: 1149645 - protein, 4 aa, Mycobacterium
PDAV

SEQ ID NO: 1149646 - protein, 8 aa, Mycobacterium
PDDGGEEV

SEQ ID NO: 1149647 - protein, 8 aa, Mycobacterium
PDDPPGRR

SEQ ID NO: 1149648 - protein, 7 aa, Mycobacterium
PDDQTPL

SEQ ID NO: 1149649 - protein, 7 aa, Mycobacterium
PDENHEG

SEQ ID NO: 1149650 - protein, 7 aa, Mycobacterium
PDEQLDN

SEQ ID NO: 1149651 - protein, 7 aa, Mycobacterium
PDEQRAA

SEQ ID NO: 1149652 - protein, 10 aa, Mycobacterium
PDFGTGSSRE

SEQ ID NO: 1149653 - protein, 4 aa, Mycobacterium
PDGP

SEQ ID NO: 1149654 - protein, 5 aa, Mycobacterium
PDGRT

SEQ ID NO: 1149655 - protein, 9 aa, Mycobacterium
PDGSPSWAD

SEQ ID NO: 1149656 - protein, 6 aa, Mycobacterium
PDGSRQ

SEQ ID NO: 1149657 - protein, 5 aa, Mycobacterium
PDGTR

SEQ ID NO: 1149658 - protein, 7 aa, Mycobacterium
PDGTRAD

SEQ ID NO: 1149659 - protein, 5 aa, Mycobacterium
PDGTV

SEQ ID NO: 1149660 - protein, 10 aa, Mycobacterium
PDGTYSAFGS

SEQ ID NO: 1149661 - protein, 4 aa, Mycobacterium
PDHA

SEQ ID NO: 1149662 - protein, 4 aa, Mycobacterium
PDHT

SEQ ID NO: 1149663 - protein, 5 aa, Mycobacterium
PDIGA

SEQ ID NO: 1149664 - protein, 10 aa, Mycobacterium
PDKKSTVADL

SEQ ID NO: 1149665 - protein, 11 aa, Mycobacterium
PDLARRGRGTP

SEQ ID NO: 1149666 - protein, 7 aa, Mycobacterium
PDLPPSH

SEQ ID NO: 1149667 - protein, 7 aa, Mycobacterium
PDNTEVS

SEQ ID NO: 1149668 - protein, 5 aa, Mycobacterium
PDPFT

SEQ ID NO: 1149669 - protein, 7 aa, Mycobacterium
PDPGPGE

SEQ ID NO: 1149670 - protein, 6 aa, Mycobacterium
PDPGPM

SEQ ID NO: 1149671 - protein, 8 aa, Mycobacterium
PDPHTPWN

SEQ ID NO: 1149672 - protein, 7 aa, Mycobacterium
PDPTAEQ

SEQ ID NO: 1149673 - protein, 4 aa, Mycobacterium
PDQP

SEQ ID NO: 1149674 - protein, 7 aa, Mycobacterium
PDQRAEF

SEQ ID NO: 1149675 - protein, 4 aa, Mycobacterium
PDRI

SEQ ID NO: 1149676 - protein, 4 aa, Mycobacterium
PDRN

SEQ ID NO: 1149677 - protein, 8 aa, Mycobacterium
PDSHTRDL

SEQ ID NO: 1149678 - protein, 8 aa, Mycobacterium
PDSPNQPY

SEQ ID NO: 1149679 - protein, 8 aa, Mycobacterium
PDSSGNPY

SEQ ID NO: 1149680 - protein, 6 aa, Mycobacterium
PDTGVS

SEQ ID NO: 1149681 - protein, 6 aa, Mycobacterium
PDVNES

SEQ ID NO: 1149682 - protein, 4 aa, Mycobacterium
PDVP

SEQ ID NO: 1149683 - protein, 8 aa, Mycobacterium
PDVPDPTV

SEQ ID NO: 1149684 - protein, 8 aa, Mycobacterium
PDWTGPDD

SEQ ID NO: 1149685 - protein, 10 aa, Mycobacterium
PDYPEEGALR

SEQ ID NO: 1149686 - protein, 10 aa, Mycobacterium
PEAAAGPHDA

SEQ ID NO: 1149687 - protein, 7 aa, Mycobacterium
PEAEDEA

SEQ ID NO: 1149688 - protein, 9 aa, Mycobacterium
PEDGGGIPW

SEQ ID NO: 1149689 - protein, 6 aa, Mycobacterium
PEDGSA

SEQ ID NO: 1149690 - protein, 6 aa, Mycobacterium
PEDTDR

SEQ ID NO: 1149691 - protein, 8 aa, Mycobacterium
PEGAEAWD

SEQ ID NO: 1149692 - protein, 4 aa, Mycobacterium
PEGE

SEQ ID NO: 1149693 - protein, 4 aa, Mycobacterium
PEGI

SEQ ID NO: 1149694 - protein, 12 aa, Mycobacterium
PEGPEGKPDPLA

SEQ ID NO: 1149695 - protein, 7 aa, Mycobacterium
PEGVDPA

SEQ ID NO: 1149696 - protein, 7 aa, Mycobacterium
PEHPYPA

SEQ ID NO: 1149697 - protein, 4 aa, Mycobacterium
PEHQ

SEQ ID NO: 1149698 - protein, 10 aa, Mycobacterium
PEKGGSTREA

SEQ ID NO: 1149699 - protein, 11 aa, Mycobacterium
PEKQARKARET

SEQ ID NO: 1149700 - protein, 5 aa, Mycobacterium
PEPHR

SEQ ID NO: 1149701 - protein, 9 aa, Mycobacterium
PEPTASSAF

SEQ ID NO: 1149702 - protein, 11 aa, Mycobacterium
PEQARIAEGAG

SEQ ID NO: 1149703 - protein, 10 aa, Mycobacterium
PEQYGKPYRE

SEQ ID NO: 1149704 - protein, 4 aa, Mycobacterium
PERP

SEQ ID NO: 1149705 - protein, 9 aa, Mycobacterium
PERPSAPDI

SEQ ID NO: 1149706 - protein, 8 aa, Mycobacterium
PESEGLAR

SEQ ID NO: 1149707 - protein, 19 aa, Mycobacterium
PESVPGTTVDRQCGSSQQA

SEQ ID NO: 1149708 - protein, 5 aa, Mycobacterium
PETGE

SEQ ID NO: 1149709 - protein, 5 aa, Mycobacterium
PETSL

SEQ ID NO: 1149710 - protein, 13 aa, Mycobacterium
PEWSGSETGGRRY

SEQ ID NO: 1149711 - protein, 4 aa, Mycobacterium
PEWY

SEQ ID NO: 1149712 - protein, 7 aa, Mycobacterium
PFAATGG

SEQ ID NO: 1149713 - protein, 5 aa, Mycobacterium
PFATA

SEQ ID NO: 1149714 - protein, 8 aa, Mycobacterium
PFPDPGTP

SEQ ID NO: 1149715 - protein, 4 aa, Mycobacterium
PGAD

SEQ ID NO: 1149716 - protein, 12 aa, Mycobacterium
PGAGDAVQAAKA

SEQ ID NO: 1149717 - protein, 8 aa, Mycobacterium
PGAGHDGG

SEQ ID NO: 1149718 - protein, 7 aa, Mycobacterium
PGAPDPE

SEQ ID NO: 1149719 - protein, 11 aa, Mycobacterium
PGAPLARAETR

SEQ ID NO: 1149720 - protein, 4 aa, Mycobacterium
PGAW

SEQ ID NO: 1149721 - protein, 5 aa, Mycobacterium
PGDGG

SEQ ID NO: 1149722 - protein, 10 aa, Mycobacterium
PGDPGPIGGD

SEQ ID NO: 1149723 - protein, 11 aa, Mycobacterium
PGDREVDDKRL

SEQ ID NO: 1149724 - protein, 12 aa, Mycobacterium
PGDRPDGVYTTG

SEQ ID NO: 1149725 - protein, 4 aa, Mycobacterium
PGDS

SEQ ID NO: 1149726 - protein, 7 aa, Mycobacterium
PGEGHNL

SEQ ID NO: 1149727 - protein, 5 aa, Mycobacterium
PGEGV

SEQ ID NO: 1149728 - protein, 9 aa, Mycobacterium
PGEHNGTFR

SEQ ID NO: 1149729 - protein, 10 aa, Mycobacterium
PGESLPPERE

SEQ ID NO: 1149730 - protein, 4 aa, Mycobacterium
PGET

SEQ ID NO: 1149731 - protein, 8 aa, Mycobacterium
PGETEEDF

SEQ ID NO: 1149732 - protein, 16 aa, Mycobacterium
PGEYTQLTGRAGRRGI

SEQ ID NO: 1149733 - protein, 6 aa, Mycobacterium
PGFGEQ

SEQ ID NO: 1149734 - protein, 5 aa, Mycobacterium
PGFGG

SEQ ID NO: 1149735 - protein, 11 aa, Mycobacterium
PGGASQPRRTL

SEQ ID NO: 1149736 - protein, 4 aa, Mycobacterium
PGGC

SEQ ID NO: 1149737 - protein, 7 aa, Mycobacterium
PGGESTA

SEQ ID NO: 1149738 - protein, 5 aa, Mycobacterium
PGGFT

SEQ ID NO: 1149739 - protein, 5 aa, Mycobacterium
PGGQL

SEQ ID NO: 1149740 - protein, 9 aa, Mycobacterium
PGHADFSED

SEQ ID NO: 1149741 - protein, 9 aa, Mycobacterium
PGHTGKGAD

SEQ ID NO: 1149742 - protein, 7 aa, Mycobacterium
PGHTPGS

SEQ ID NO: 1149743 - protein, 9 aa, Mycobacterium
PGIGPKSAQ

SEQ ID NO: 1149744 - protein, 10 aa, Mycobacterium
PGINAAAAGT

SEQ ID NO: 1149745 - protein, 4 aa, Mycobacterium
PGLG

SEQ ID NO: 1149746 - protein, 4 aa, Mycobacterium
PGPG

SEQ ID NO: 1149747 - protein, 8 aa, Mycobacterium
PGPIQGGS

SEQ ID NO: 1149748 - protein, 6 aa, Mycobacterium
PGPPTI

SEQ ID NO: 1149749 - protein, 5 aa, Mycobacterium
PGPTD

SEQ ID NO: 1149750 - protein, 8 aa, Mycobacterium
PGQAPSYA

SEQ ID NO: 1149751 - protein, 13 aa, Mycobacterium
PGRTDASQEQTDV

SEQ ID NO: 1149752 - protein, 6 aa, Mycobacterium
PGTARI

SEQ ID NO: 1149753 - protein, 7 aa, Mycobacterium
PGTEAPA

SEQ ID NO: 1149754 - protein, 7 aa, Mycobacterium
PGTQENL

SEQ ID NO: 1149755 - protein, 5 aa, Mycobacterium
PGTSL

SEQ ID NO: 1149756 - protein, 4 aa, Mycobacterium
PGTV

SEQ ID NO: 1149757 - protein, 5 aa, Mycobacterium
PGVAP

SEQ ID NO: 1149758 - protein, 9 aa, Mycobacterium
PGVDPGSVD

SEQ ID NO: 1149759 - protein, 7 aa, Mycobacterium
PGVTRDR

SEQ ID NO: 1149760 - protein, 6 aa, Mycobacterium
PGYTSA

SEQ ID NO: 1149761 - protein, 8 aa, Mycobacterium
PHEDSDAA

SEQ ID NO: 1149762 - protein, 4 aa, Mycobacterium
PHGV

SEQ ID NO: 1149763 - protein, 6 aa, Mycobacterium
PHIGSP

SEQ ID NO: 1149764 - protein, 5 aa, Mycobacterium
PHPEG

SEQ ID NO: 1149765 - protein, 8 aa, Mycobacterium
PHPTDGRT

SEQ ID NO: 1149766 - protein, 9 aa, Mycobacterium
PHRSTAAEL

SEQ ID NO: 1149767 - protein, 10 aa, Mycobacterium
PHTEEPTNWS

SEQ ID NO: 1149768 - protein, 13 aa, Mycobacterium
PHYGGSTARSGGG

SEQ ID NO: 1149769 - protein, 11 aa, Mycobacterium
PIADPVSRTQV

SEQ ID NO: 1149770 - protein, 4 aa, Mycobacterium
PING

SEQ ID NO: 1149771 - protein, 10 aa, Mycobacterium
PIPGNDDAIR

SEQ ID NO: 1149772 - protein, 4 aa, Mycobacterium
PIPR

SEQ ID NO: 1149773 - protein, 5 aa, Mycobacterium
PITDG

SEQ ID NO: 1149774 - protein, 4 aa, Mycobacterium
PKAI

SEQ ID NO: 1149775 - protein, 6 aa, Mycobacterium
PKAVPS

SEQ ID NO: 1149776 - protein, 7 aa, Mycobacterium
PKDVGRT

SEQ ID NO: 1149777 - protein, 7 aa, Mycobacterium
PKDVQAV

SEQ ID NO: 1149778 - protein, 7 aa, Mycobacterium
PKEVGAD

SEQ ID NO: 1149779 - protein, 6 aa, Mycobacterium
PKGPGH

SEQ ID NO: 1149780 - protein, 9 aa, Mycobacterium
PKGTRSTLE

SEQ ID NO: 1149781 - protein, 4 aa, Mycobacterium
PKLR

SEQ ID NO: 1149782 - protein, 12 aa, Mycobacterium
PKLRTGPIRPGP

SEQ ID NO: 1149783 - protein, 9 aa, Mycobacterium
PKLSAGRVQ

SEQ ID NO: 1149784 - protein, 7 aa, Mycobacterium
PKNDAGK

SEQ ID NO: 1149785 - protein, 7 aa, Mycobacterium
PKNPKKQ

SEQ ID NO: 1149786 - protein, 8 aa, Mycobacterium
PKNPSGKL

SEQ ID NO: 1149787 - protein, 6 aa, Mycobacterium
PKNSYG

SEQ ID NO: 1149788 - protein, 9 aa, Mycobacterium
PKNTRQRLS

SEQ ID NO: 1149789 - protein, 4 aa, Mycobacterium
PKPD

SEQ ID NO: 1149790 - protein, 9 aa, Mycobacterium
PKSGYPGHA

SEQ ID NO: 1149791 - protein, 8 aa, Mycobacterium
PKTAETAA

SEQ ID NO: 1149792 - protein, 15 aa, Mycobacterium
PKTKRTKTGYTTDAD

SEQ ID NO: 1149793 - protein, 18 aa, Mycobacterium
PKVLPDPRSPRQPDGVHE

SEQ ID NO: 1149794 - protein, 7 aa, Mycobacterium
PLAGESL

SEQ ID NO: 1149795 - protein, 5 aa, Mycobacterium
PLDPE

SEQ ID NO: 1149796 - protein, 10 aa, Mycobacterium
PLEATKEGRG

SEQ ID NO: 1149797 - protein, 5 aa, Mycobacterium
PLGAD

SEQ ID NO: 1149798 - protein, 6 aa, Mycobacterium
PLGAGK

SEQ ID NO: 1149799 - protein, 6 aa, Mycobacterium
PLGGPR

SEQ ID NO: 1149800 - protein, 7 aa, Mycobacterium
PLGGSGA

SEQ ID NO: 1149801 - protein, 7 aa, Mycobacterium
PLGRQAE

SEQ ID NO: 1149802 - protein, 4 aa, Mycobacterium
PLPA

SEQ ID NO: 1149803 - protein, 8 aa, Mycobacterium
PLPAGTTR

SEQ ID NO: 1149804 - protein, 4 aa, Mycobacterium
PLPG

SEQ ID NO: 1149805 - protein, 5 aa, Mycobacterium
PLPGG

SEQ ID NO: 1149806 - protein, 12 aa, Mycobacterium
PLPNTAGCRGAA

SEQ ID NO: 1149807 - protein, 8 aa, Mycobacterium
PLRGSKAH

SEQ ID NO: 1149808 - protein, 6 aa, Mycobacterium
PMGGTD

SEQ ID NO: 1149809 - protein, 10 aa, Mycobacterium
PMRDPGDGTI

SEQ ID NO: 1149810 - protein, 5 aa, Mycobacterium
PMSSA

SEQ ID NO: 1149811 - protein, 5 aa, Mycobacterium
PNAPS

SEQ ID NO: 1149812 - protein, 7 aa, Mycobacterium
PNEPGHV

SEQ ID NO: 1149813 - protein, 8 aa, Mycobacterium
PNGAGKTS

SEQ ID NO: 1149814 - protein, 8 aa, Mycobacterium
PNGAGKTT

SEQ ID NO: 1149815 - protein, 4 aa, Mycobacterium
PNGE

SEQ ID NO: 1149816 - protein, 8 aa, Mycobacterium
PNGTITAG

SEQ ID NO: 1149817 - protein, 7 aa, Mycobacterium
PNGVGKT

SEQ ID NO: 1149818 - protein, 8 aa, Mycobacterium
PNNPTGAV

SEQ ID NO: 1149819 - protein, 10 aa, Mycobacterium
PNNPTSTVVD

SEQ ID NO: 1149820 - protein, 6 aa, Mycobacterium
PNPGLA

SEQ ID NO: 1149821 - protein, 8 aa, Mycobacterium
PNRGKRSV

SEQ ID NO: 1149822 - protein, 10 aa, Mycobacterium
PNRSVADGSA

SEQ ID NO: 1149823 - protein, 8 aa, Mycobacterium
PNSGPGHN

SEQ ID NO: 1149824 - protein, 5 aa, Mycobacterium
PNSPL

SEQ ID NO: 1149825 - protein, 4 aa, Mycobacterium
PNTV

SEQ ID NO: 1149826 - protein, 5 aa, Mycobacterium
PPAEL

SEQ ID NO: 1149827 - protein, 4 aa, Mycobacterium
PPAP

SEQ ID NO: 1149828 - protein, 11 aa, Mycobacterium
PPDHPARSEQD

SEQ ID NO: 1149829 - protein, 5 aa, Mycobacterium
PPEKL

SEQ ID NO: 1149830 - protein, 5 aa, Mycobacterium
PPFAN

SEQ ID NO: 1149831 - protein, 5 aa, Mycobacterium
PPGGL

SEQ ID NO: 1149832 - protein, 5 aa, Mycobacterium
PPGTG

SEQ ID NO: 1149833 - protein, 4 aa, Mycobacterium
PPGV

SEQ ID NO: 1149834 - protein, 9 aa, Mycobacterium
PPKDEQPEW

SEQ ID NO: 1149835 - protein, 5 aa, Mycobacterium
PPNVT

SEQ ID NO: 1149836 - protein, 6 aa, Mycobacterium
PPPIVP

SEQ ID NO: 1149837 - protein, 11 aa, Mycobacterium
PPPQGDPEAPL

SEQ ID NO: 1149838 - protein, 5 aa, Mycobacterium
PPRAV

SEQ ID NO: 1149839 - protein, 11 aa, Mycobacterium
PPRRTAPDGSN

SEQ ID NO: 1149840 - protein, 9 aa, Mycobacterium
PPSAEAALA

SEQ ID NO: 1149841 - protein, 11 aa, Mycobacterium
PPSAEPRATGH

SEQ ID NO: 1149842 - protein, 4 aa, Mycobacterium
PPTA

SEQ ID NO: 1149843 - protein, 5 aa, Mycobacterium
PQEDR

SEQ ID NO: 1149844 - protein, 7 aa, Mycobacterium
PQGALSA

SEQ ID NO: 1149845 - protein, 10 aa, Mycobacterium
PQGQQSFGQL

SEQ ID NO: 1149846 - protein, 4 aa, Mycobacterium
PQHT

SEQ ID NO: 1149847 - protein, 6 aa, Mycobacterium
PQPAPL

SEQ ID NO: 1149848 - protein, 4 aa, Mycobacterium
PQPD

SEQ ID NO: 1149849 - protein, 11 aa, Mycobacterium
PQPRPPRETWS

SEQ ID NO: 1149850 - protein, 10 aa, Mycobacterium
PQRDGGQRQY

SEQ ID NO: 1149851 - protein, 7 aa, Mycobacterium
PQTPAGV

SEQ ID NO: 1149852 - protein, 7 aa, Mycobacterium
PRAIERK

SEQ ID NO: 1149853 - protein, 8 aa, Mycobacterium
PRDPHDAD

SEQ ID NO: 1149854 - protein, 5 aa, Mycobacterium
PREAA

SEQ ID NO: 1149855 - protein, 8 aa, Mycobacterium
PREGRTYP

SEQ ID NO: 1149856 - protein, 4 aa, Mycobacterium
PREQ

SEQ ID NO: 1149857 - protein, 5 aa, Mycobacterium
PRERS

SEQ ID NO: 1149858 - protein, 11 aa, Mycobacterium
PRGCGKTSSAR

SEQ ID NO: 1149859 - protein, 7 aa, Mycobacterium
PRGFGEN

SEQ ID NO: 1149860 - protein, 4 aa, Mycobacterium
PRGG

SEQ ID NO: 1149861 - protein, 8 aa, Mycobacterium
PRGGGPSL

SEQ ID NO: 1149862 - protein, 7 aa, Mycobacterium
PRGMHST

SEQ ID NO: 1149863 - protein, 4 aa, Mycobacterium
PRKG

SEQ ID NO: 1149864 - protein, 7 aa, Mycobacterium
PRNPAGK

SEQ ID NO: 1149865 - protein, 5 aa, Mycobacterium
PRNPL

SEQ ID NO: 1149866 - protein, 6 aa, Mycobacterium
PRPDWP

SEQ ID NO: 1149867 - protein, 7 aa, Mycobacterium
PRPGTPF

SEQ ID NO: 1149868 - protein, 7 aa, Mycobacterium
PRQEDAD

SEQ ID NO: 1149869 - protein, 8 aa, Mycobacterium
PRRGIGDR

SEQ ID NO: 1149870 - protein, 5 aa, Mycobacterium
PRRSA

SEQ ID NO: 1149871 - protein, 5 aa, Mycobacterium
PRTKR

SEQ ID NO: 1149872 - protein, 5 aa, Mycobacterium
PRTTI

SEQ ID NO: 1149873 - protein, 8 aa, Mycobacterium
PRWGKPEE

SEQ ID NO: 1149874 - protein, 9 aa, Mycobacterium
PSAGKSSLV

SEQ ID NO: 1149875 - protein, 7 aa, Mycobacterium
PSANLDP

SEQ ID NO: 1149876 - protein, 5 aa, Mycobacterium
PSDEQ

SEQ ID NO: 1149877 - protein, 8 aa, Mycobacterium
PSDRTGSV

SEQ ID NO: 1149878 - protein, 7 aa, Mycobacterium
PSDTTPV

SEQ ID NO: 1149879 - protein, 9 aa, Mycobacterium
PSERDPSVP

SEQ ID NO: 1149880 - protein, 7 aa, Mycobacterium
PSERTPL

SEQ ID NO: 1149881 - protein, 10 aa, Mycobacterium
PSGAGKSTTQ

SEQ ID NO: 1149882 - protein, 7 aa, Mycobacterium
PSGCGKS

SEQ ID NO: 1149883 - protein, 9 aa, Mycobacterium
PSGCGKSTT

SEQ ID NO: 1149884 - protein, 13 aa, Mycobacterium
PSGELKTKPTQHS

SEQ ID NO: 1149885 - protein, 7 aa, Mycobacterium
PSGRTAD

SEQ ID NO: 1149886 - protein, 6 aa, Mycobacterium
PSGTEQ

SEQ ID NO: 1149887 - protein, 10 aa, Mycobacterium
PSGVGKTELS

SEQ ID NO: 1149888 - protein, 11 aa, Mycobacterium
PSHNPPRDGGF

SEQ ID NO: 1149889 - protein, 8 aa, Mycobacterium
PSKVPALA

SEQ ID NO: 1149890 - protein, 6 aa, Mycobacterium
PSNEAP

SEQ ID NO: 1149891 - protein, 6 aa, Mycobacterium
PSNPMQ

SEQ ID NO: 1149892 - protein, 5 aa, Mycobacterium
PSPHL

SEQ ID NO: 1149893 - protein, 11 aa, Mycobacterium
PSRETGRGSGA

SEQ ID NO: 1149894 - protein, 5 aa, Mycobacterium
PSRVA

SEQ ID NO: 1149895 - protein, 6 aa, Mycobacterium
PSSPMA

SEQ ID NO: 1149896 - protein, 7 aa, Mycobacterium
PSSRGKG

SEQ ID NO: 1149897 - protein, 5 aa, Mycobacterium
PSTPA

SEQ ID NO: 1149898 - protein, 9 aa, Mycobacterium
PSTRQPVGA

SEQ ID NO: 1149899 - protein, 4 aa, Mycobacterium
PSVA

SEQ ID NO: 1149900 - protein, 5 aa, Mycobacterium
PSVPE

SEQ ID NO: 1149901 - protein, 5 aa, Mycobacterium
PTADQ

SEQ ID NO: 1149902 - protein, 4 aa, Mycobacterium
PTAE

SEQ ID NO: 1149903 - protein, 5 aa, Mycobacterium
PTAEH

SEQ ID NO: 1149904 - protein, 6 aa, Mycobacterium
PTAGMD

SEQ ID NO: 1149905 - protein, 8 aa, Mycobacterium
PTAVPTDP

SEQ ID NO: 1149906 - protein, 7 aa, Mycobacterium
PTEGIQP

SEQ ID NO: 1149907 - protein, 6 aa, Mycobacterium
PTERGA

SEQ ID NO: 1149908 - protein, 8 aa, Mycobacterium
PTGAGKTV

SEQ ID NO: 1149909 - protein, 5 aa, Mycobacterium
PTGSC

SEQ ID NO: 1149910 - protein, 7 aa, Mycobacterium
PTGSGKT

SEQ ID NO: 1149911 - protein, 4 aa, Mycobacterium
PTHT

SEQ ID NO: 1149912 - protein, 6 aa, Mycobacterium
PTKGQI

SEQ ID NO: 1149913 - protein, 5 aa, Mycobacterium
PTNHL

SEQ ID NO: 1149914 - protein, 4 aa, Mycobacterium
PTNN

SEQ ID NO: 1149915 - protein, 12 aa, Mycobacterium
PTNNLDPASREQ

SEQ ID NO: 1149916 - protein, 4 aa, Mycobacterium
PTPA

SEQ ID NO: 1149917 - protein, 9 aa, Mycobacterium
PTPDEPGFA

SEQ ID NO: 1149918 - protein, 6 aa, Mycobacterium
PTPKTV

SEQ ID NO: 1149919 - protein, 5 aa, Mycobacterium
PTPRT

SEQ ID NO: 1149920 - protein, 5 aa, Mycobacterium
PTQIG

SEQ ID NO: 1149921 - protein, 4 aa, Mycobacterium
PTRA

SEQ ID NO: 1149922 - protein, 4 aa, Mycobacterium
PTRR

SEQ ID NO: 1149923 - protein, 12 aa, Mycobacterium
PTRSHTGAAQGG

SEQ ID NO: 1149924 - protein, 6 aa, Mycobacterium
PTSALD

SEQ ID NO: 1149925 - protein, 7 aa, Mycobacterium
PTSAPER

SEQ ID NO: 1149926 - protein, 5 aa, Mycobacterium
PTSGL

SEQ ID NO: 1149927 - protein, 5 aa, Mycobacterium
PTSGN

SEQ ID NO: 1149928 - protein, 7 aa, Mycobacterium
PTSNIHS

SEQ ID NO: 1149929 - protein, 6 aa, Mycobacterium
PTSPQY

SEQ ID NO: 1149930 - protein, 4 aa, Mycobacterium
PTSR

SEQ ID NO: 1149931 - protein, 8 aa, Mycobacterium
PTSTGAAK

SEQ ID NO: 1149932 - protein, 4 aa, Mycobacterium
PTTA

SEQ ID NO: 1149933 - protein, 11 aa, Mycobacterium
PTTGLDPRSRS

SEQ ID NO: 1149934 - protein, 15 aa, Mycobacterium
PTTKNRQGNDVGTSY

SEQ ID NO: 1149935 - protein, 4 aa, Mycobacterium
PTVN

SEQ ID NO: 1149936 - protein, 9 aa, Mycobacterium
PTVPAGTSR

SEQ ID NO: 1149937 - protein, 4 aa, Mycobacterium
PVDT

SEQ ID NO: 1149938 - protein, 8 aa, Mycobacterium
PVGAGAGG

SEQ ID NO: 1149939 - protein, 7 aa, Mycobacterium
PVGSTGA

SEQ ID NO: 1149940 - protein, 4 aa, Mycobacterium
PVKG

SEQ ID NO: 1149941 - protein, 5 aa, Mycobacterium
PVPAD

SEQ ID NO: 1149942 - protein, 5 aa, Mycobacterium
PVPAE

SEQ ID NO: 1149943 - protein, 7 aa, Mycobacterium
PVPGELG

SEQ ID NO: 1149944 - protein, 4 aa, Mycobacterium
PVPV

SEQ ID NO: 1149945 - protein, 8 aa, Mycobacterium
PVRSTDGR

SEQ ID NO: 1149946 - protein, 7 aa, Mycobacterium
PVTRTPD

SEQ ID NO: 1149947 - protein, 7 aa, Mycobacterium
PWSEDDE

SEQ ID NO: 1149948 - protein, 4 aa, Mycobacterium
PYGA

SEQ ID NO: 1149949 - protein, 8 aa, Mycobacterium
PYGEDGTI

SEQ ID NO: 1149950 - protein, 6 aa, Mycobacterium
PYGGPD

SEQ ID NO: 1149951 - protein, 4 aa, Mycobacterium
PYPA

SEQ ID NO: 1149952 - protein, 9 aa, Mycobacterium
PYQPEISQG

SEQ ID NO: 1149953 - protein, 8 aa, Mycobacterium
PYSGPTAA

SEQ ID NO: 1149954 - protein, 19 aa, Mycobacterium
PYSTGETGRVGSPKRREIG

SEQ ID NO: 1149955 - protein, 10 aa, Mycobacterium
QAADSGSREA

SEQ ID NO: 1149956 - protein, 12 aa, Mycobacterium
QAAGQAKKAVEQ

SEQ ID NO: 1149957 - protein, 7 aa, Mycobacterium
QAAQTGA

SEQ ID NO: 1149958 - protein, 8 aa, Mycobacterium
QAASSLGA

SEQ ID NO: 1149959 - protein, 6 aa, Mycobacterium
QAAYPL

SEQ ID NO: 1149960 - protein, 11 aa, Mycobacterium
QAAYSASKGGV

SEQ ID NO: 1149961 - protein, 5 aa, Mycobacterium
QACAA

SEQ ID NO: 1149962 - protein, 6 aa, Mycobacterium
QAESDA

SEQ ID NO: 1149963 - protein, 7 aa, Mycobacterium
QAFGSPS

SEQ ID NO: 1149964 - protein, 4 aa, Mycobacterium
QAGA

SEQ ID NO: 1149965 - protein, 5 aa, Mycobacterium
QAGGI

SEQ ID NO: 1149966 - protein, 10 aa, Mycobacterium
QAGTDDQRER

SEQ ID NO: 1149967 - protein, 6 aa, Mycobacterium
QAKPRD

SEQ ID NO: 1149968 - protein, 15 aa, Mycobacterium
QAKTAPLAGNSIATD

SEQ ID NO: 1149969 - protein, 6 aa, Mycobacterium
QAKYGA

SEQ ID NO: 1149970 - protein, 11 aa, Mycobacterium
QALGDKKGIRR

SEQ ID NO: 1149971 - protein, 7 aa, Mycobacterium
QALGGAK

SEQ ID NO: 1149972 - protein, 6 aa, Mycobacterium
QALTPD

SEQ ID NO: 1149973 - protein, 7 aa, Mycobacterium
QANYAAA

SEQ ID NO: 1149974 - protein, 7 aa, Mycobacterium
QAPEGRG

SEQ ID NO: 1149975 - protein, 10 aa, Mycobacterium
QARKDGYTST

SEQ ID NO: 1149976 - protein, 7 aa, Mycobacterium
QARSDRK

SEQ ID NO: 1149977 - protein, 7 aa, Mycobacterium
QARTGMG

SEQ ID NO: 1149978 - protein, 7 aa, Mycobacterium
QATEEVA

SEQ ID NO: 1149979 - protein, 5 aa, Mycobacterium
QATTT

SEQ ID NO: 1149980 - protein, 10 aa, Mycobacterium
QDAGDDTVDA

SEQ ID NO: 1149981 - protein, 7 aa, Mycobacterium
QDDAETW

SEQ ID NO: 1149982 - protein, 7 aa, Mycobacterium
QDDKDAE

SEQ ID NO: 1149983 - protein, 7 aa, Mycobacterium
QDEPDGL

SEQ ID NO: 1149984 - protein, 15 aa, Mycobacterium
QDGTEPDHHTQQRRR

SEQ ID NO: 1149985 - protein, 9 aa, Mycobacterium
QDKGKRYNS

SEQ ID NO: 1149986 - protein, 8 aa, Mycobacterium
QDKHGTAY

SEQ ID NO: 1149987 - protein, 9 aa, Mycobacterium
QDPKGEGQA

SEQ ID NO: 1149988 - protein, 7 aa, Mycobacterium
QDRTGGF

SEQ ID NO: 1149989 - protein, 7 aa, Mycobacterium
QDTAKRT

SEQ ID NO: 1149990 - protein, 7 aa, Mycobacterium
QDTDAGA

SEQ ID NO: 1149991 - protein, 5 aa, Mycobacterium
QDTDP

SEQ ID NO: 1149992 - protein, 7 aa, Mycobacterium
QDTGHAQ

SEQ ID NO: 1149993 - protein, 5 aa, Mycobacterium
QDTNH

SEQ ID NO: 1149994 - protein, 4 aa, Mycobacterium
QDYG

SEQ ID NO: 1149995 - protein, 5 aa, Mycobacterium
QEAGA

SEQ ID NO: 1149996 - protein, 7 aa, Mycobacterium
QEDGEDV

SEQ ID NO: 1149997 - protein, 4 aa, Mycobacterium
QEGA

SEQ ID NO: 1149998 - protein, 7 aa, Mycobacterium
QEGIKEQ

SEQ ID NO: 1149999 - protein, 7 aa, Mycobacterium
QEGVSAE

SEQ ID NO: 1150000 - protein, 6 aa, Mycobacterium
QEISGA

SEQ ID NO: 1150001 - protein, 10 aa, Mycobacterium
QELGGKSPNI

SEQ ID NO: 1150002 - protein, 5 aa, Mycobacterium
QEPGA

SEQ ID NO: 1150003 - protein, 8 aa, Mycobacterium
QEPGTAEE

SEQ ID NO: 1150004 - protein, 6 aa, Mycobacterium
QERSNG

SEQ ID NO: 1150005 - protein, 7 aa, Mycobacterium
QETGQTV

SEQ ID NO: 1150006 - protein, 4 aa, Mycobacterium
QFEK

SEQ ID NO: 1150007 - protein, 8 aa, Mycobacterium
QGASEERI

SEQ ID NO: 1150008 - protein, 7 aa, Mycobacterium
QGDATTV

SEQ ID NO: 1150009 - protein, 10 aa, Mycobacterium
QGDEGPAAKP

SEQ ID NO: 1150010 - protein, 7 aa, Mycobacterium
QGDGTYV

SEQ ID NO: 1150011 - protein, 4 aa, Mycobacterium
QGDR

SEQ ID NO: 1150012 - protein, 6 aa, Mycobacterium
QGEAPM

SEQ ID NO: 1150013 - protein, 6 aa, Mycobacterium
QGEGGL

SEQ ID NO: 1150014 - protein, 13 aa, Mycobacterium
QGEVGPGGGPAGD

SEQ ID NO: 1150015 - protein, 4 aa, Mycobacterium
QGFS

SEQ ID NO: 1150016 - protein, 4 aa, Mycobacterium
QGGA

SEQ ID NO: 1150017 - protein, 12 aa, Mycobacterium
QGGEGGGHTGPI

SEQ ID NO: 1150018 - protein, 5 aa, Mycobacterium
QGGGV

SEQ ID NO: 1150019 - protein, 11 aa, Mycobacterium
QGGPGATGRSF

SEQ ID NO: 1150020 - protein, 4 aa, Mycobacterium
QGGR

SEQ ID NO: 1150021 - protein, 8 aa, Mycobacterium
QGGTAATQ

SEQ ID NO: 1150022 - protein, 7 aa, Mycobacterium
QGITSGP

SEQ ID NO: 1150023 - protein, 5 aa, Mycobacterium
QGKGT

SEQ ID NO: 1150024 - protein, 8 aa, Mycobacterium
QGPGEVTA

SEQ ID NO: 1150025 - protein, 7 aa, Mycobacterium
QGQAGDN

SEQ ID NO: 1150026 - protein, 9 aa, Mycobacterium
QGQQAPSGH

SEQ ID NO: 1150027 - protein, 4 aa, Mycobacterium
QGRG

SEQ ID NO: 1150028 - protein, 11 aa, Mycobacterium
QGRGDAAEQTI

SEQ ID NO: 1150029 - protein, 5 aa, Mycobacterium
QGSEV

SEQ ID NO: 1150030 - protein, 7 aa, Mycobacterium
QGSGGPA

SEQ ID NO: 1150031 - protein, 10 aa, Mycobacterium
QGSGKTTLAG

SEQ ID NO: 1150032 - protein, 6 aa, Mycobacterium
QGYAYS

SEQ ID NO: 1150033 - protein, 4 aa, Mycobacterium
QGYE

SEQ ID NO: 1150034 - protein, 12 aa, Mycobacterium
QGYGRQKGHTEV

SEQ ID NO: 1150035 - protein, 9 aa, Mycobacterium
QGYNSGIRD

SEQ ID NO: 1150036 - protein, 9 aa, Mycobacterium
QHAAPPPKV

SEQ ID NO: 1150037 - protein, 5 aa, Mycobacterium
QHGGP

SEQ ID NO: 1150038 - protein, 7 aa, Mycobacterium
QHPDGSR

SEQ ID NO: 1150039 - protein, 10 aa, Mycobacterium
QIDGEGAHGP

SEQ ID NO: 1150040 - protein, 6 aa, Mycobacterium
QIPTGF

SEQ ID NO: 1150041 - protein, 10 aa, Mycobacterium
QKDEGAMAQT

SEQ ID NO: 1150042 - protein, 7 aa, Mycobacterium
QKGTTIA

SEQ ID NO: 1150043 - protein, 4 aa, Mycobacterium
QKRR

SEQ ID NO: 1150044 - protein, 5 aa, Mycobacterium
QKSID

SEQ ID NO: 1150045 - protein, 7 aa, Mycobacterium
QKTGERS

SEQ ID NO: 1150046 - protein, 16 aa, Mycobacterium
QLDQPAGTLSGGEKTR

SEQ ID NO: 1150047 - protein, 9 aa, Mycobacterium
QLGTKGPSL

SEQ ID NO: 1150048 - protein, 6 aa, Mycobacterium
QLKTGR

SEQ ID NO: 1150049 - protein, 7 aa, Mycobacterium
QLNARAD

SEQ ID NO: 1150050 - protein, 15 aa, Mycobacterium
QLRGRAGRQGDPGSS

SEQ ID NO: 1150051 - protein, 15 aa, Mycobacterium
QLRGRSGRQGDPGES

SEQ ID NO: 1150052 - protein, 10 aa, Mycobacterium
QLSTDDSPGF

SEQ ID NO: 1150053 - protein, 8 aa, Mycobacterium
QMAGRGTD

SEQ ID NO: 1150054 - protein, 10 aa, Mycobacterium
QMTDKTAPRV

SEQ ID NO: 1150055 - protein, 8 aa, Mycobacterium
QNARDRTF

SEQ ID NO: 1150056 - protein, 6 aa, Mycobacterium
QNDPDR

SEQ ID NO: 1150057 - protein, 5 aa, Mycobacterium
QNIKS

SEQ ID NO: 1150058 - protein, 10 aa, Mycobacterium
QNKASGAEIG

SEQ ID NO: 1150059 - protein, 6 aa, Mycobacterium
QNNELG

SEQ ID NO: 1150060 - protein, 8 aa, Mycobacterium
QNPGTNHP

SEQ ID NO: 1150061 - protein, 6 aa, Mycobacterium
QNTTTV

SEQ ID NO: 1150062 - protein, 4 aa, Mycobacterium
QPAA

SEQ ID NO: 1150063 - protein, 10 aa, Mycobacterium
QPAKNQAVTN

SEQ ID NO: 1150064 - protein, 13 aa, Mycobacterium
QPAPTLSGGEAQR

SEQ ID NO: 1150065 - protein, 6 aa, Mycobacterium
QPATPT

SEQ ID NO: 1150066 - protein, 6 aa, Mycobacterium
QPEKGL

SEQ ID NO: 1150067 - protein, 4 aa, Mycobacterium
QPER

SEQ ID NO: 1150068 - protein, 13 aa, Mycobacterium
QPFAASAPTIGAP

SEQ ID NO: 1150069 - protein, 7 aa, Mycobacterium
QPFPGPG

SEQ ID NO: 1150070 - protein, 5 aa, Mycobacterium
QPGSL

SEQ ID NO: 1150071 - protein, 4 aa, Mycobacterium
QPGV

SEQ ID NO: 1150072 - protein, 7 aa, Mycobacterium
QPKEYRD

SEQ ID NO: 1150073 - protein, 13 aa, Mycobacterium
QPLGGKAQFGGQR

SEQ ID NO: 1150074 - protein, 9 aa, Mycobacterium
QPPEFGGRN

SEQ ID NO: 1150075 - protein, 6 aa, Mycobacterium
QPPELE

SEQ ID NO: 1150076 - protein, 5 aa, Mycobacterium
QPPSA

SEQ ID NO: 1150077 - protein, 17 aa, Mycobacterium
QPQFEGQTKTKLGNTEV

SEQ ID NO: 1150078 - protein, 4 aa, Mycobacterium
QPTQ

SEQ ID NO: 1150079 - protein, 12 aa, Mycobacterium
QPTTSAGRHPDS

SEQ ID NO: 1150080 - protein, 10 aa, Mycobacterium
QQDGRRSYAG

SEQ ID NO: 1150081 - protein, 6 aa, Mycobacterium
QQEAGR

SEQ ID NO: 1150082 - protein, 9 aa, Mycobacterium
QQNASRDSW

SEQ ID NO: 1150083 - protein, 5 aa, Mycobacterium
QQTGV

SEQ ID NO: 1150084 - protein, 13 aa, Mycobacterium
QQVPSAVRQPNAT

SEQ ID NO: 1150085 - protein, 12 aa, Mycobacterium
QRAEREKQWRSG

SEQ ID NO: 1150086 - protein, 7 aa, Mycobacterium
QRAGDDE

SEQ ID NO: 1150087 - protein, 4 aa, Mycobacterium
QRDA

SEQ ID NO: 1150088 - protein, 4 aa, Mycobacterium
QRDN

SEQ ID NO: 1150089 - protein, 4 aa, Mycobacterium
QRDR

SEQ ID NO: 1150090 - protein, 13 aa, Mycobacterium
QRDRPDEAGYRGE

SEQ ID NO: 1150091 - protein, 7 aa, Mycobacterium
QREDGER

SEQ ID NO: 1150092 - protein, 7 aa, Mycobacterium
QRGNPIE

SEQ ID NO: 1150093 - protein, 6 aa, Mycobacterium
QRGQSD

SEQ ID NO: 1150094 - protein, 10 aa, Mycobacterium
QRKERSGSSF

SEQ ID NO: 1150095 - protein, 5 aa, Mycobacterium
QRNRS

SEQ ID NO: 1150096 - protein, 6 aa, Mycobacterium
QRPGVG

SEQ ID NO: 1150097 - protein, 5 aa, Mycobacterium
QRPNG

SEQ ID NO: 1150098 - protein, 4 aa, Mycobacterium
QRPQ

SEQ ID NO: 1150099 - protein, 5 aa, Mycobacterium
QRQTE

SEQ ID NO: 1150100 - protein, 7 aa, Mycobacterium
QRRLGRR

SEQ ID NO: 1150101 - protein, 4 aa, Mycobacterium
QRSP

SEQ ID NO: 1150102 - protein, 4 aa, Mycobacterium
QRTV

SEQ ID NO: 1150103 - protein, 6 aa, Mycobacterium
QSAKPV

SEQ ID NO: 1150104 - protein, 9 aa, Mycobacterium
QSEGGAAGA

SEQ ID NO: 1150105 - protein, 9 aa, Mycobacterium
QSGETADTL

SEQ ID NO: 1150106 - protein, 4 aa, Mycobacterium
QSGK

SEQ ID NO: 1150107 - protein, 17 aa, Mycobacterium
QSGLGRELGPDAPLSFT

SEQ ID NO: 1150108 - protein, 8 aa, Mycobacterium
QSGQGADE

SEQ ID NO: 1150109 - protein, 5 aa, Mycobacterium
QSGSD

SEQ ID NO: 1150110 - protein, 4 aa, Mycobacterium
QSLE

SEQ ID NO: 1150111 - protein, 4 aa, Mycobacterium
QSLG

SEQ ID NO: 1150112 - protein, 5 aa, Mycobacterium
QSMDN

SEQ ID NO: 1150113 - protein, 16 aa, Mycobacterium
QSPIGRTPRSNPATYT

SEQ ID NO: 1150114 - protein, 4 aa, Mycobacterium
QSPQ

SEQ ID NO: 1150115 - protein, 6 aa, Mycobacterium
QSRNGE

SEQ ID NO: 1150116 - protein, 5 aa, Mycobacterium
QSTDG

SEQ ID NO: 1150117 - protein, 8 aa, Mycobacterium
QSTDRDAL

SEQ ID NO: 1150118 - protein, 4 aa, Mycobacterium
QSTV

SEQ ID NO: 1150119 - protein, 4 aa, Mycobacterium
QSYS

SEQ ID NO: 1150120 - protein, 7 aa, Mycobacterium
QTGGCPH

SEQ ID NO: 1150121 - protein, 4 aa, Mycobacterium
QTKE

SEQ ID NO: 1150122 - protein, 11 aa, Mycobacterium
QTKGASHTSQM

SEQ ID NO: 1150123 - protein, 8 aa, Mycobacterium
QTNYSAAK

SEQ ID NO: 1150124 - protein, 7 aa, Mycobacterium
QTQSEVR

SEQ ID NO: 1150125 - protein, 5 aa, Mycobacterium
QTSIE

SEQ ID NO: 1150126 - protein, 6 aa, Mycobacterium
QTTLTH

SEQ ID NO: 1150127 - protein, 4 aa, Mycobacterium
QTVD

SEQ ID NO: 1150128 - protein, 10 aa, Mycobacterium
QVAGGTVQGI

SEQ ID NO: 1150129 - protein, 17 aa, Mycobacterium
QVDDGDRDGVSSEAAAE

SEQ ID NO: 1150130 - protein, 4 aa, Mycobacterium
QVGD

SEQ ID NO: 1150131 - protein, 7 aa, Mycobacterium
QVPDGED

SEQ ID NO: 1150132 - protein, 6 aa, Mycobacterium
QVRDGK

SEQ ID NO: 1150133 - protein, 11 aa, Mycobacterium
QVRKAGRQTKG

SEQ ID NO: 1150134 - protein, 7 aa, Mycobacterium
QVSAPGQ

SEQ ID NO: 1150135 - protein, 4 aa, Mycobacterium
QYED

SEQ ID NO: 1150136 - protein, 7 aa, Mycobacterium
QYEDPKT

SEQ ID NO: 1150137 - protein, 6 aa, Mycobacterium
QYGPGH

SEQ ID NO: 1150138 - protein, 12 aa, Mycobacterium
QYGSNTLERNRA

SEQ ID NO: 1150139 - protein, 4 aa, Mycobacterium
QYPE

SEQ ID NO: 1150140 - protein, 5 aa, Mycobacterium
RAAED

SEQ ID NO: 1150141 - protein, 6 aa, Mycobacterium
RAAGAQ

SEQ ID NO: 1150142 - protein, 11 aa, Mycobacterium
RAAGRVEGVRP

SEQ ID NO: 1150143 - protein, 6 aa, Mycobacterium
RADDTA

SEQ ID NO: 1150144 - protein, 8 aa, Mycobacterium
RADEIGAG

SEQ ID NO: 1150145 - protein, 8 aa, Mycobacterium
RADRQPEF

SEQ ID NO: 1150146 - protein, 5 aa, Mycobacterium
RAEGE

SEQ ID NO: 1150147 - protein, 7 aa, Mycobacterium
RAEGLTD

SEQ ID NO: 1150148 - protein, 5 aa, Mycobacterium
RAERD

SEQ ID NO: 1150149 - protein, 5 aa, Mycobacterium
RAESG

SEQ ID NO: 1150150 - protein, 4 aa, Mycobacterium
RAGA

SEQ ID NO: 1150151 - protein, 4 aa, Mycobacterium
RAGD

SEQ ID NO: 1150152 - protein, 9 aa, Mycobacterium
RAGERPVPP

SEQ ID NO: 1150153 - protein, 8 aa, Mycobacterium
RAGHADGN

SEQ ID NO: 1150154 - protein, 4 aa, Mycobacterium
RAGK

SEQ ID NO: 1150155 - protein, 10 aa, Mycobacterium
RAGNGGNGCA

SEQ ID NO: 1150156 - protein, 13 aa, Mycobacterium
RAGRNIRGVILHD

SEQ ID NO: 1150157 - protein, 4 aa, Mycobacterium
RAGS

SEQ ID NO: 1150158 - protein, 6 aa, Mycobacterium
RAGVGK

SEQ ID NO: 1150159 - protein, 6 aa, Mycobacterium
RAHGEN

SEQ ID NO: 1150160 - protein, 14 aa, Mycobacterium
RAIAGAEPGPEGNV

SEQ ID NO: 1150161 - protein, 8 aa, Mycobacterium
RAIAGPGT

SEQ ID NO: 1150162 - protein, 6 aa, Mycobacterium
RAIPSA

SEQ ID NO: 1150163 - protein, 4 aa, Mycobacterium
RAKD

SEQ ID NO: 1150164 - protein, 8 aa, Mycobacterium
RAKHDPAQ

SEQ ID NO: 1150165 - protein, 7 aa, Mycobacterium
RAKRGGS

SEQ ID NO: 1150166 - protein, 9 aa, Mycobacterium
RAKTGRNGA

SEQ ID NO: 1150167 - protein, 4 aa, Mycobacterium
RANG

SEQ ID NO: 1150168 - protein, 11 aa, Mycobacterium
RAPASAAGPDL

SEQ ID NO: 1150169 - protein, 6 aa, Mycobacterium
RAPEVS

SEQ ID NO: 1150170 - protein, 6 aa, Mycobacterium
RAPGAH

SEQ ID NO: 1150171 - protein, 9 aa, Mycobacterium
RAPQGTLPG

SEQ ID NO: 1150172 - protein, 7 aa, Mycobacterium
RAPSRDT

SEQ ID NO: 1150173 - protein, 6 aa, Mycobacterium
RAPTIA

SEQ ID NO: 1150174 - protein, 9 aa, Mycobacterium
RAQSRRRED

SEQ ID NO: 1150175 - protein, 6 aa, Mycobacterium
RAQYER

SEQ ID NO: 1150176 - protein, 8 aa, Mycobacterium
RARAEAGA

SEQ ID NO: 1150177 - protein, 6 aa, Mycobacterium
RAREQH

SEQ ID NO: 1150178 - protein, 6 aa, Mycobacterium
RARGPQ

SEQ ID NO: 1150179 - protein, 8 aa, Mycobacterium
RARQGHPV

SEQ ID NO: 1150180 - protein, 5 aa, Mycobacterium
RARQI

SEQ ID NO: 1150181 - protein, 5 aa, Mycobacterium
RARTR

SEQ ID NO: 1150182 - protein, 6 aa, Mycobacterium
RASRSE

SEQ ID NO: 1150183 - protein, 4 aa, Mycobacterium
RASS

SEQ ID NO: 1150184 - protein, 10 aa, Mycobacterium
RATAEGRKRE

SEQ ID NO: 1150185 - protein, 6 aa, Mycobacterium
RATEEA

SEQ ID NO: 1150186 - protein, 5 aa, Mycobacterium
RATGR

SEQ ID NO: 1150187 - protein, 7 aa, Mycobacterium
RATQHRL

SEQ ID NO: 1150188 - protein, 14 aa, Mycobacterium
RATSGDNHLGGDDW

SEQ ID NO: 1150189 - protein, 6 aa, Mycobacterium
RATSSV

SEQ ID NO: 1150190 - protein, 10 aa, Mycobacterium
RDAAGKGGTI

SEQ ID NO: 1150191 - protein, 11 aa, Mycobacterium
RDAATPSRAYA

SEQ ID NO: 1150192 - protein, 5 aa, Mycobacterium
RDAST

SEQ ID NO: 1150193 - protein, 5 aa, Mycobacterium
RDDGA

SEQ ID NO: 1150194 - protein, 7 aa, Mycobacterium
RDEAPSV

SEQ ID NO: 1150195 - protein, 7 aa, Mycobacterium
RDEGAAE

SEQ ID NO: 1150196 - protein, 4 aa, Mycobacterium
RDEQ

SEQ ID NO: 1150197 - protein, 8 aa, Mycobacterium
RDETDVNP

SEQ ID NO: 1150198 - protein, 5 aa, Mycobacterium
RDGNQ

SEQ ID NO: 1150199 - protein, 8 aa, Mycobacterium
RDGTAHRR

SEQ ID NO: 1150200 - protein, 6 aa, Mycobacterium
RDIAKS

SEQ ID NO: 1150201 - protein, 4 aa, Mycobacterium
RDIN

SEQ ID NO: 1150202 - protein, 8 aa, Mycobacterium
RDKSATAL

SEQ ID NO: 1150203 - protein, 8 aa, Mycobacterium
RDPDLTPA

SEQ ID NO: 1150204 - protein, 5 aa, Mycobacterium
RDPGG

SEQ ID NO: 1150205 - protein, 4 aa, Mycobacterium
RDPN

SEQ ID NO: 1150206 - protein, 6 aa, Mycobacterium
RDPRTK

SEQ ID NO: 1150207 - protein, 6 aa, Mycobacterium
RDPYGV

SEQ ID NO: 1150208 - protein, 7 aa, Mycobacterium
RDRGQAV

SEQ ID NO: 1150209 - protein, 6 aa, Mycobacterium
RDRGTG

SEQ ID NO: 1150210 - protein, 7 aa, Mycobacterium
RDRGYGH

SEQ ID NO: 1150211 - protein, 7 aa, Mycobacterium
RDRPPEL

SEQ ID NO: 1150212 - protein, 8 aa, Mycobacterium
RDRTRHQV

SEQ ID NO: 1150213 - protein, 6 aa, Mycobacterium
RDSAPS

SEQ ID NO: 1150214 - protein, 7 aa, Mycobacterium
RDSDRWG

SEQ ID NO: 1150215 - protein, 9 aa, Mycobacterium
RDSLRRAAA

SEQ ID NO: 1150216 - protein, 7 aa, Mycobacterium
RDTRGRE

SEQ ID NO: 1150217 - protein, 5 aa, Mycobacterium
RDTVR

SEQ ID NO: 1150218 - protein, 5 aa, Mycobacterium
RDVTG

SEQ ID NO: 1150219 - protein, 4 aa, Mycobacterium
REAG

SEQ ID NO: 1150220 - protein, 6 aa, Mycobacterium
REDAAE

SEQ ID NO: 1150221 - protein, 10 aa, Mycobacterium
REDDDELPAG

SEQ ID NO: 1150222 - protein, 4 aa, Mycobacterium
REDF

SEQ ID NO: 1150223 - protein, 9 aa, Mycobacterium
REDNAQTRG

SEQ ID NO: 1150224 - protein, 7 aa, Mycobacterium
REERPDL

SEQ ID NO: 1150225 - protein, 7 aa, Mycobacterium
REESARV

SEQ ID NO: 1150226 - protein, 7 aa, Mycobacterium
REEVDNN

SEQ ID NO: 1150227 - protein, 6 aa, Mycobacterium
REFTEG

SEQ ID NO: 1150228 - protein, 4 aa, Mycobacterium
REGR

SEQ ID NO: 1150229 - protein, 5 aa, Mycobacterium
REHPD

SEQ ID NO: 1150230 - protein, 9 aa, Mycobacterium
REKASEGTP

SEQ ID NO: 1150231 - protein, 4 aa, Mycobacterium
RELR

SEQ ID NO: 1150232 - protein, 9 aa, Mycobacterium
RENADNKLY

SEQ ID NO: 1150233 - protein, 7 aa, Mycobacterium
RENAELK

SEQ ID NO: 1150234 - protein, 15 aa, Mycobacterium
REPAGPWGRGRPVEA

SEQ ID NO: 1150235 - protein, 4 aa, Mycobacterium
REPF

SEQ ID NO: 1150236 - protein, 8 aa, Mycobacterium
REPGAGGL

SEQ ID NO: 1150237 - protein, 22 aa, Mycobacterium
REPGREYAEDIETGSAAAALGG

SEQ ID NO: 1150238 - protein, 11 aa, Mycobacterium
REPQSAGACSG

SEQ ID NO: 1150239 - protein, 7 aa, Mycobacterium
REQSRPE

SEQ ID NO: 1150240 - protein, 4 aa, Mycobacterium
RERD

SEQ ID NO: 1150241 - protein, 9 aa, Mycobacterium
RERRPDRAI

SEQ ID NO: 1150242 - protein, 7 aa, Mycobacterium
RESGTGL

SEQ ID NO: 1150243 - protein, 4 aa, Mycobacterium
REST

SEQ ID NO: 1150244 - protein, 7 aa, Mycobacterium
RETEDSA

SEQ ID NO: 1150245 - protein, 4 aa, Mycobacterium
RETG

SEQ ID NO: 1150246 - protein, 9 aa, Mycobacterium
RETQGPARI

SEQ ID NO: 1150247 - protein, 4 aa, Mycobacterium
RETT

SEQ ID NO: 1150248 - protein, 7 aa, Mycobacterium
REVSGAG

SEQ ID NO: 1150249 - protein, 6 aa, Mycobacterium
RFATSD

SEQ ID NO: 1150250 - protein, 7 aa, Mycobacterium
RFSGGTT

SEQ ID NO: 1150251 - protein, 7 aa, Mycobacterium
RFSTRAE

SEQ ID NO: 1150252 - protein, 4 aa, Mycobacterium
RGAD

SEQ ID NO: 1150253 - protein, 7 aa, Mycobacterium
RGADGGV

SEQ ID NO: 1150254 - protein, 4 aa, Mycobacterium
RGAE

SEQ ID NO: 1150255 - protein, 6 aa, Mycobacterium
RGAKAT

SEQ ID NO: 1150256 - protein, 4 aa, Mycobacterium
RGAL

SEQ ID NO: 1150257 - protein, 14 aa, Mycobacterium
RGAQGAEPNTGDGA

SEQ ID NO: 1150258 - protein, 4 aa, Mycobacterium
RGAR

SEQ ID NO: 1150259 - protein, 13 aa, Mycobacterium
RGCAPDRKRLRGN

SEQ ID NO: 1150260 - protein, 10 aa, Mycobacterium
RGCTRPGCTA

SEQ ID NO: 1150261 - protein, 5 aa, Mycobacterium
RGDEA

SEQ ID NO: 1150262 - protein, 9 aa, Mycobacterium
RGDPGERRR

SEQ ID NO: 1150263 - protein, 20 aa, Mycobacterium
RGDPSDNLPGIPGVGEKTAT

SEQ ID NO: 1150264 - protein, 8 aa, Mycobacterium
RGDTPLPV

SEQ ID NO: 1150265 - protein, 13 aa, Mycobacterium
RGDVGDGTSKANT

SEQ ID NO: 1150266 - protein, 4 aa, Mycobacterium
RGEA

SEQ ID NO: 1150267 - protein, 6 aa, Mycobacterium
RGEASE

SEQ ID NO: 1150268 - protein, 5 aa, Mycobacterium
RGEGA

SEQ ID NO: 1150269 - protein, 4 aa, Mycobacterium
RGEH

SEQ ID NO: 1150270 - protein, 6 aa, Mycobacterium
RGEIDG

SEQ ID NO: 1150271 - protein, 4 aa, Mycobacterium
RGEL

SEQ ID NO: 1150272 - protein, 4 aa, Mycobacterium
RGEQ

SEQ ID NO: 1150273 - protein, 5 aa, Mycobacterium
RGESL

SEQ ID NO: 1150274 - protein, 4 aa, Mycobacterium
RGFT

SEQ ID NO: 1150275 - protein, 11 aa, Mycobacterium
RGGAGQGSQRF

SEQ ID NO: 1150276 - protein, 6 aa, Mycobacterium
RGGAGR

SEQ ID NO: 1150277 - protein, 9 aa, Mycobacterium
RGGAGSGKT

SEQ ID NO: 1150278 - protein, 7 aa, Mycobacterium
RGGAGTA

SEQ ID NO: 1150279 - protein, 13 aa, Mycobacterium
RGGAYSAAKGGLT

SEQ ID NO: 1150280 - protein, 9 aa, Mycobacterium
RGGGEYGPT

SEQ ID NO: 1150281 - protein, 5 aa, Mycobacterium
RGGGI

SEQ ID NO: 1150282 - protein, 13 aa, Mycobacterium
RGGKAAGSVSKKT

SEQ ID NO: 1150283 - protein, 15 aa, Mycobacterium
RGGPSTGLPTKTEQA

SEQ ID NO: 1150284 - protein, 7 aa, Mycobacterium
RGGYDGR

SEQ ID NO: 1150285 - protein, 4 aa, Mycobacterium
RGHL

SEQ ID NO: 1150286 - protein, 4 aa, Mycobacterium
RGKI

SEQ ID NO: 1150287 - protein, 5 aa, Mycobacterium
RGLGS

SEQ ID NO: 1150288 - protein, 6 aa, Mycobacterium
RGLQNR

SEQ ID NO: 1150289 - protein, 4 aa, Mycobacterium
RGLT

SEQ ID NO: 1150290 - protein, 8 aa, Mycobacterium
RGNGSGPV

SEQ ID NO: 1150291 - protein, 5 aa, Mycobacterium
RGPDE

SEQ ID NO: 1150292 - protein, 7 aa, Mycobacterium
RGPNAGS

SEQ ID NO: 1150293 - protein, 5 aa, Mycobacterium
RGPSA

SEQ ID NO: 1150294 - protein, 6 aa, Mycobacterium
RGPTLD

SEQ ID NO: 1150295 - protein, 6 aa, Mycobacterium
RGQEAA

SEQ ID NO: 1150296 - protein, 6 aa, Mycobacterium
RGQSHS

SEQ ID NO: 1150297 - protein, 8 aa, Mycobacterium
RGRAGHGS

SEQ ID NO: 1150298 - protein, 8 aa, Mycobacterium
RGRGIPRE

SEQ ID NO: 1150299 - protein, 6 aa, Mycobacterium
RGRGPV

SEQ ID NO: 1150300 - protein, 5 aa, Mycobacterium
RGRMA

SEQ ID NO: 1150301 - protein, 4 aa, Mycobacterium
RGRN

SEQ ID NO: 1150302 - protein, 6 aa, Mycobacterium
RGRSYR

SEQ ID NO: 1150303 - protein, 6 aa, Mycobacterium
RGRYGG

SEQ ID NO: 1150304 - protein, 4 aa, Mycobacterium
RGSA

SEQ ID NO: 1150305 - protein, 6 aa, Mycobacterium
RGSAKR

SEQ ID NO: 1150306 - protein, 5 aa, Mycobacterium
RGSDV

SEQ ID NO: 1150307 - protein, 6 aa, Mycobacterium
RGSQFR

SEQ ID NO: 1150308 - protein, 9 aa, Mycobacterium
RGSRTGARV

SEQ ID NO: 1150309 - protein, 7 aa, Mycobacterium
RGSTGGQ

SEQ ID NO: 1150310 - protein, 7 aa, Mycobacterium
RGSTRGA

SEQ ID NO: 1150311 - protein, 11 aa, Mycobacterium
RGTDPSKHKQF

SEQ ID NO: 1150312 - protein, 7 aa, Mycobacterium
RGTDSLN

SEQ ID NO: 1150313 - protein, 8 aa, Mycobacterium
RGTEADRI

SEQ ID NO: 1150314 - protein, 7 aa, Mycobacterium
RGTGSKD

SEQ ID NO: 1150315 - protein, 11 aa, Mycobacterium
RGTGVSSDVET

SEQ ID NO: 1150316 - protein, 5 aa, Mycobacterium
RGTLG

SEQ ID NO: 1150317 - protein, 4 aa, Mycobacterium
RGVD

SEQ ID NO: 1150318 - protein, 8 aa, Mycobacterium
RGVGRPER

SEQ ID NO: 1150319 - protein, 6 aa, Mycobacterium
RGYDST

SEQ ID NO: 1150320 - protein, 10 aa, Mycobacterium
RHDLGNPGGY

SEQ ID NO: 1150321 - protein, 4 aa, Mycobacterium
RHDP

SEQ ID NO: 1150322 - protein, 9 aa, Mycobacterium
RHEAGPADL

SEQ ID NO: 1150323 - protein, 7 aa, Mycobacterium
RHGTGTS

SEQ ID NO: 1150324 - protein, 4 aa, Mycobacterium
RHKD

SEQ ID NO: 1150325 - protein, 5 aa, Mycobacterium
RHPDR

SEQ ID NO: 1150326 - protein, 7 aa, Mycobacterium
RHPGKRS

SEQ ID NO: 1150327 - protein, 5 aa, Mycobacterium
RHPGN

SEQ ID NO: 1150328 - protein, 5 aa, Mycobacterium
RHPRG

SEQ ID NO: 1150329 - protein, 13 aa, Mycobacterium
RHPSRSQVLRDYL

SEQ ID NO: 1150330 - protein, 5 aa, Mycobacterium
RHPYG

SEQ ID NO: 1150331 - protein, 6 aa, Mycobacterium
RHRKGE

SEQ ID NO: 1150332 - protein, 5 aa, Mycobacterium
RHRTP

SEQ ID NO: 1150333 - protein, 5 aa, Mycobacterium
RHTGS

SEQ ID NO: 1150334 - protein, 6 aa, Mycobacterium
RHTPEG

SEQ ID NO: 1150335 - protein, 5 aa, Mycobacterium
RIGPR

SEQ ID NO: 1150336 - protein, 5 aa, Mycobacterium
RIPKD

SEQ ID NO: 1150337 - protein, 4 aa, Mycobacterium
RIRP

SEQ ID NO: 1150338 - protein, 4 aa, Mycobacterium
RKAM

SEQ ID NO: 1150339 - protein, 7 aa, Mycobacterium
RKEEDVA

SEQ ID NO: 1150340 - protein, 7 aa, Mycobacterium
RKEGAEE

SEQ ID NO: 1150341 - protein, 7 aa, Mycobacterium
RKEIHES

SEQ ID NO: 1150342 - protein, 17 aa, Mycobacterium
RKISDGDKLAGRHGNKG

SEQ ID NO: 1150343 - protein, 8 aa, Mycobacterium
RKKLTDDL

SEQ ID NO: 1150344 - protein, 7 aa, Mycobacterium
RKLTPDY

SEQ ID NO: 1150345 - protein, 9 aa, Mycobacterium
RKNGPHPKN

SEQ ID NO: 1150346 - protein, 4 aa, Mycobacterium
RKPE

SEQ ID NO: 1150347 - protein, 6 aa, Mycobacterium
RKRGRR

SEQ ID NO: 1150348 - protein, 9 aa, Mycobacterium
RKRKEKAVR

SEQ ID NO: 1150349 - protein, 4 aa, Mycobacterium
RKSE

SEQ ID NO: 1150350 - protein, 6 aa, Mycobacterium
RKSHPL

SEQ ID NO: 1150351 - protein, 7 aa, Mycobacterium
RKTGKTA

SEQ ID NO: 1150352 - protein, 9 aa, Mycobacterium
RKTKLSRTV

SEQ ID NO: 1150353 - protein, 9 aa, Mycobacterium
RKVGQASGH

SEQ ID NO: 1150354 - protein, 6 aa, Mycobacterium
RKVNGR

SEQ ID NO: 1150355 - protein, 5 aa, Mycobacterium
RLDGQ

SEQ ID NO: 1150356 - protein, 7 aa, Mycobacterium
RLESGKR

SEQ ID NO: 1150357 - protein, 4 aa, Mycobacterium
RLGE

SEQ ID NO: 1150358 - protein, 6 aa, Mycobacterium
RLGEDS

SEQ ID NO: 1150359 - protein, 8 aa, Mycobacterium
RLGGAEMS

SEQ ID NO: 1150360 - protein, 4 aa, Mycobacterium
RLGP

SEQ ID NO: 1150361 - protein, 9 aa, Mycobacterium
RLGQPPSGY

SEQ ID NO: 1150362 - protein, 7 aa, Mycobacterium
RLKENED

SEQ ID NO: 1150363 - protein, 8 aa, Mycobacterium
RLNGAKNP

SEQ ID NO: 1150364 - protein, 7 aa, Mycobacterium
RLNNPDF

SEQ ID NO: 1150365 - protein, 8 aa, Mycobacterium
RLNPRDTA

SEQ ID NO: 1150366 - protein, 8 aa, Mycobacterium
RLSDQELR

SEQ ID NO: 1150367 - protein, 5 aa, Mycobacterium
RLSEP

SEQ ID NO: 1150368 - protein, 7 aa, Mycobacterium
RLSGSGI

SEQ ID NO: 1150369 - protein, 10 aa, Mycobacterium
RLTDGQGRTV

SEQ ID NO: 1150370 - protein, 19 aa, Mycobacterium
RLTGSSDLYEATGRRPSAS

SEQ ID NO: 1150371 - protein, 10 aa, Mycobacterium
RMPGGGTARR

SEQ ID NO: 1150372 - protein, 9 aa, Mycobacterium
RNAADSTAQ

SEQ ID NO: 1150373 - protein, 9 aa, Mycobacterium
RNAEESGGR

SEQ ID NO: 1150374 - protein, 6 aa, Mycobacterium
RNAELE

SEQ ID NO: 1150375 - protein, 9 aa, Mycobacterium
RNGAGKTTT

SEQ ID NO: 1150376 - protein, 13 aa, Mycobacterium
RNGERADRLRSYA

SEQ ID NO: 1150377 - protein, 11 aa, Mycobacterium
RNGGNMADPGS

SEQ ID NO: 1150378 - protein, 5 aa, Mycobacterium
RNGSY

SEQ ID NO: 1150379 - protein, 4 aa, Mycobacterium
RNKR

SEQ ID NO: 1150380 - protein, 6 aa, Mycobacterium
RNNTAA

SEQ ID NO: 1150381 - protein, 6 aa, Mycobacterium
RNPDLS

SEQ ID NO: 1150382 - protein, 10 aa, Mycobacterium
RNPLHSDPDF

SEQ ID NO: 1150383 - protein, 6 aa, Mycobacterium
RNPNPH

SEQ ID NO: 1150384 - protein, 4 aa, Mycobacterium
RNPR

SEQ ID NO: 1150385 - protein, 5 aa, Mycobacterium
RNRPL

SEQ ID NO: 1150386 - protein, 6 aa, Mycobacterium
RNSPQQ

SEQ ID NO: 1150387 - protein, 4 aa, Mycobacterium
RPAD

SEQ ID NO: 1150388 - protein, 5 aa, Mycobacterium
RPADI

SEQ ID NO: 1150389 - protein, 8 aa, Mycobacterium
RPANQRPR

SEQ ID NO: 1150390 - protein, 5 aa, Mycobacterium
RPAPN

SEQ ID NO: 1150391 - protein, 4 aa, Mycobacterium
RPAS

SEQ ID NO: 1150392 - protein, 7 aa, Mycobacterium
RPDGRPH

SEQ ID NO: 1150393 - protein, 6 aa, Mycobacterium
RPDPLP

SEQ ID NO: 1150394 - protein, 5 aa, Mycobacterium
RPDRS

SEQ ID NO: 1150395 - protein, 7 aa, Mycobacterium
RPDSPSV

SEQ ID NO: 1150396 - protein, 4 aa, Mycobacterium
RPEA

SEQ ID NO: 1150397 - protein, 6 aa, Mycobacterium
RPEARN

SEQ ID NO: 1150398 - protein, 7 aa, Mycobacterium
RPEEVTD

SEQ ID NO: 1150399 - protein, 4 aa, Mycobacterium
RPEP

SEQ ID NO: 1150400 - protein, 4 aa, Mycobacterium
RPER

SEQ ID NO: 1150401 - protein, 6 aa, Mycobacterium
RPERFE

SEQ ID NO: 1150402 - protein, 5 aa, Mycobacterium
RPERM

SEQ ID NO: 1150403 - protein, 4 aa, Mycobacterium
RPGA

SEQ ID NO: 1150404 - protein, 7 aa, Mycobacterium
RPGAQEE

SEQ ID NO: 1150405 - protein, 9 aa, Mycobacterium
RPGDPNETA

SEQ ID NO: 1150406 - protein, 13 aa, Mycobacterium
RPGEPPTKESAQT

SEQ ID NO: 1150407 - protein, 5 aa, Mycobacterium
RPGNQ

SEQ ID NO: 1150408 - protein, 7 aa, Mycobacterium
RPGPGRR

SEQ ID NO: 1150409 - protein, 7 aa, Mycobacterium
RPGRFGG

SEQ ID NO: 1150410 - protein, 8 aa, Mycobacterium
RPGRTITE

SEQ ID NO: 1150411 - protein, 6 aa, Mycobacterium
RPGYEL

SEQ ID NO: 1150412 - protein, 5 aa, Mycobacterium
RPIED

SEQ ID NO: 1150413 - protein, 4 aa, Mycobacterium
RPKA

SEQ ID NO: 1150414 - protein, 12 aa, Mycobacterium
RPKIGPRRAEAQ

SEQ ID NO: 1150415 - protein, 20 aa, Mycobacterium
RPLTKKPAETRMGSGKGSPE

SEQ ID NO: 1150416 - protein, 4 aa, Mycobacterium
RPND

SEQ ID NO: 1150417 - protein, 5 aa, Mycobacterium
RPNTA

SEQ ID NO: 1150418 - protein, 10 aa, Mycobacterium
RPNTGKSTLT

SEQ ID NO: 1150419 - protein, 4 aa, Mycobacterium
RPNV

SEQ ID NO: 1150420 - protein, 7 aa, Mycobacterium
RPNVGKS

SEQ ID NO: 1150421 - protein, 5 aa, Mycobacterium
RPPAP

SEQ ID NO: 1150422 - protein, 13 aa, Mycobacterium
RPPETRADSTPWP

SEQ ID NO: 1150423 - protein, 8 aa, Mycobacterium
RPPGREAF

SEQ ID NO: 1150424 - protein, 4 aa, Mycobacterium
RPPL

SEQ ID NO: 1150425 - protein, 7 aa, Mycobacterium
RPPTNAL

SEQ ID NO: 1150426 - protein, 7 aa, Mycobacterium
RPQAGRY

SEQ ID NO: 1150427 - protein, 7 aa, Mycobacterium
RPQGVSG

SEQ ID NO: 1150428 - protein, 6 aa, Mycobacterium
RPQVQE

SEQ ID NO: 1150429 - protein, 6 aa, Mycobacterium
RPSETA

SEQ ID NO: 1150430 - protein, 8 aa, Mycobacterium
RPSGRGAD

SEQ ID NO: 1150431 - protein, 7 aa, Mycobacterium
RPSGTED

SEQ ID NO: 1150432 - protein, 4 aa, Mycobacterium
RPSH

SEQ ID NO: 1150433 - protein, 11 aa, Mycobacterium
RPSPTSGTLGG

SEQ ID NO: 1150434 - protein, 6 aa, Mycobacterium
RPSSVQ

SEQ ID NO: 1150435 - protein, 5 aa, Mycobacterium
RPVRG

SEQ ID NO: 1150436 - protein, 6 aa, Mycobacterium
RPVRRP

SEQ ID NO: 1150437 - protein, 4 aa, Mycobacterium
RQAA

SEQ ID NO: 1150438 - protein, 6 aa, Mycobacterium
RQAREL

SEQ ID NO: 1150439 - protein, 5 aa, Mycobacterium
RQDEE

SEQ ID NO: 1150440 - protein, 6 aa, Mycobacterium
RQDEIG

SEQ ID NO: 1150441 - protein, 4 aa, Mycobacterium
RQEP

SEQ ID NO: 1150442 - protein, 6 aa, Mycobacterium
RQGLGN

SEQ ID NO: 1150443 - protein, 16 aa, Mycobacterium
RQGNSDRRAPKAVKEY

SEQ ID NO: 1150444 - protein, 10 aa, Mycobacterium
RQGVSEPLQT

SEQ ID NO: 1150445 - protein, 12 aa, Mycobacterium
RQLPSEGATRGA

SEQ ID NO: 1150446 - protein, 5 aa, Mycobacterium
RQNPL

SEQ ID NO: 1150447 - protein, 4 aa, Mycobacterium
RQPL

SEQ ID NO: 1150448 - protein, 4 aa, Mycobacterium
RQRG

SEQ ID NO: 1150449 - protein, 9 aa, Mycobacterium
RQSGEWKDG

SEQ ID NO: 1150450 - protein, 14 aa, Mycobacterium
RQVSEAAGQGNNAA

SEQ ID NO: 1150451 - protein, 8 aa, Mycobacterium
RRAGVSRT

SEQ ID NO: 1150452 - protein, 6 aa, Mycobacterium
RRAGYG

SEQ ID NO: 1150453 - protein, 6 aa, Mycobacterium
RRAQRG

SEQ ID NO: 1150454 - protein, 6 aa, Mycobacterium
RRASEI

SEQ ID NO: 1150455 - protein, 5 aa, Mycobacterium
RRDEA

SEQ ID NO: 1150456 - protein, 4 aa, Mycobacterium
RRDG

SEQ ID NO: 1150457 - protein, 6 aa, Mycobacterium
RRDGDD

SEQ ID NO: 1150458 - protein, 14 aa, Mycobacterium
RRDGIDAASEIASK

SEQ ID NO: 1150459 - protein, 9 aa, Mycobacterium
RRDKATSNI

SEQ ID NO: 1150460 - protein, 5 aa, Mycobacterium
RRDKI

SEQ ID NO: 1150461 - protein, 5 aa, Mycobacterium
RRDTL

SEQ ID NO: 1150462 - protein, 7 aa, Mycobacterium
RRDVTGR

SEQ ID NO: 1150463 - protein, 6 aa, Mycobacterium
RREGKR

SEQ ID NO: 1150464 - protein, 6 aa, Mycobacterium
RRFNGS

SEQ ID NO: 1150465 - protein, 5 aa, Mycobacterium
RRGLE

SEQ ID NO: 1150466 - protein, 5 aa, Mycobacterium
RRGPH

SEQ ID NO: 1150467 - protein, 5 aa, Mycobacterium
RRGPL

SEQ ID NO: 1150468 - protein, 16 aa, Mycobacterium
RRGTDPTPNVTSIATT

SEQ ID NO: 1150469 - protein, 12 aa, Mycobacterium
RRHRREQYEEFA

SEQ ID NO: 1150470 - protein, 6 aa, Mycobacterium
RRKTTV

SEQ ID NO: 1150471 - protein, 8 aa, Mycobacterium
RRLDEAQP

SEQ ID NO: 1150472 - protein, 9 aa, Mycobacterium
RRNEDEPAE

SEQ ID NO: 1150473 - protein, 8 aa, Mycobacterium
RRNLGGAG

SEQ ID NO: 1150474 - protein, 7 aa, Mycobacterium
RRNPGDD

SEQ ID NO: 1150475 - protein, 7 aa, Mycobacterium
RRPGETA

SEQ ID NO: 1150476 - protein, 8 aa, Mycobacterium
RRPGHTEA

SEQ ID NO: 1150477 - protein, 9 aa, Mycobacterium
RRPNATQDE

SEQ ID NO: 1150478 - protein, 8 aa, Mycobacterium
RRPPSPPT

SEQ ID NO: 1150479 - protein, 7 aa, Mycobacterium
RRPTDAE

SEQ ID NO: 1150480 - protein, 7 aa, Mycobacterium
RRRDAEL

SEQ ID NO: 1150481 - protein, 10 aa, Mycobacterium
RRRESDTALA

SEQ ID NO: 1150482 - protein, 4 aa, Mycobacterium
RRRG

SEQ ID NO: 1150483 - protein, 4 aa, Mycobacterium
RRRI

SEQ ID NO: 1150484 - protein, 8 aa, Mycobacterium
RRRNPQDD

SEQ ID NO: 1150485 - protein, 5 aa, Mycobacterium
RRSAR

SEQ ID NO: 1150486 - protein, 6 aa, Mycobacterium
RRSASV

SEQ ID NO: 1150487 - protein, 8 aa, Mycobacterium
RRSSDRVD

SEQ ID NO: 1150488 - protein, 4 aa, Mycobacterium
RRTE

SEQ ID NO: 1150489 - protein, 5 aa, Mycobacterium
RRTGA

SEQ ID NO: 1150490 - protein, 8 aa, Mycobacterium
RRTGGTDA

SEQ ID NO: 1150491 - protein, 7 aa, Mycobacterium
RRTHEQA

SEQ ID NO: 1150492 - protein, 7 aa, Mycobacterium
RRTKNNP

SEQ ID NO: 1150493 - protein, 4 aa, Mycobacterium
RRTQ

SEQ ID NO: 1150494 - protein, 7 aa, Mycobacterium
RRVGGAT

SEQ ID NO: 1150495 - protein, 8 aa, Mycobacterium
RSADGVPN

SEQ ID NO: 1150496 - protein, 10 aa, Mycobacterium
RSAGSIKKIT

SEQ ID NO: 1150497 - protein, 7 aa, Mycobacterium
RSAHGDS

SEQ ID NO: 1150498 - protein, 7 aa, Mycobacterium
RSALQNA

SEQ ID NO: 1150499 - protein, 5 aa, Mycobacterium
RSASL

SEQ ID NO: 1150500 - protein, 4 aa, Mycobacterium
RSCE

SEQ ID NO: 1150501 - protein, 9 aa, Mycobacterium
RSDNPNGAR

SEQ ID NO: 1150502 - protein, 7 aa, Mycobacterium
RSDSTLN

SEQ ID NO: 1150503 - protein, 8 aa, Mycobacterium
RSEEEREY

SEQ ID NO: 1150504 - protein, 6 aa, Mycobacterium
RSENAT

SEQ ID NO: 1150505 - protein, 4 aa, Mycobacterium
RSFE

SEQ ID NO: 1150506 - protein, 12 aa, Mycobacterium
RSFETREGEKRT

SEQ ID NO: 1150507 - protein, 10 aa, Mycobacterium
RSGETEDTTI

SEQ ID NO: 1150508 - protein, 10 aa, Mycobacterium
RSGSTTVSTK

SEQ ID NO: 1150509 - protein, 6 aa, Mycobacterium
RSGVGD

SEQ ID NO: 1150510 - protein, 7 aa, Mycobacterium
RSHEGTM

SEQ ID NO: 1150511 - protein, 9 aa, Mycobacterium
RSKTQGRAN

SEQ ID NO: 1150512 - protein, 6 aa, Mycobacterium
RSKTSL

SEQ ID NO: 1150513 - protein, 10 aa, Mycobacterium
RSNHGTCANQ

SEQ ID NO: 1150514 - protein, 4 aa, Mycobacterium
RSNT

SEQ ID NO: 1150515 - protein, 4 aa, Mycobacterium
RSPD

SEQ ID NO: 1150516 - protein, 7 aa, Mycobacterium
RSPDEFS

SEQ ID NO: 1150517 - protein, 5 aa, Mycobacterium
RSPFS

SEQ ID NO: 1150518 - protein, 9 aa, Mycobacterium
RSRGDRQRD

SEQ ID NO: 1150519 - protein, 24 aa, Mycobacterium
RSRGLTGETIHPDGGFSLGPPPQR

SEQ ID NO: 1150520 - protein, 5 aa, Mycobacterium
RSRQS

SEQ ID NO: 1150521 - protein, 5 aa, Mycobacterium
RSRYD

SEQ ID NO: 1150522 - protein, 20 aa, Mycobacterium
RSSATAEDLPTASFAGQQDS

SEQ ID NO: 1150523 - protein, 6 aa, Mycobacterium
RSSEVA

SEQ ID NO: 1150524 - protein, 8 aa, Mycobacterium
RSSGGLTD

SEQ ID NO: 1150525 - protein, 16 aa, Mycobacterium
RSSGPGGQSVNTTDSA

SEQ ID NO: 1150526 - protein, 7 aa, Mycobacterium
RSSVDDR

SEQ ID NO: 1150527 - protein, 6 aa, Mycobacterium
RSTGDD

SEQ ID NO: 1150528 - protein, 4 aa, Mycobacterium
RSTI

SEQ ID NO: 1150529 - protein, 13 aa, Mycobacterium
RSVDERVKRLIAS

SEQ ID NO: 1150530 - protein, 7 aa, Mycobacterium
RTADGYA

SEQ ID NO: 1150531 - protein, 4 aa, Mycobacterium
RTAE

SEQ ID NO: 1150532 - protein, 4 aa, Mycobacterium
RTAG

SEQ ID NO: 1150533 - protein, 13 aa, Mycobacterium
RTAHGDEEDHSGP

SEQ ID NO: 1150534 - protein, 8 aa, Mycobacterium
RTDFPGGN

SEQ ID NO: 1150535 - protein, 10 aa, Mycobacterium
RTDPDAPKHA

SEQ ID NO: 1150536 - protein, 9 aa, Mycobacterium
RTDSPFPGL

SEQ ID NO: 1150537 - protein, 6 aa, Mycobacterium
RTEESR

SEQ ID NO: 1150538 - protein, 4 aa, Mycobacterium
RTES

SEQ ID NO: 1150539 - protein, 7 aa, Mycobacterium
RTGDEIH

SEQ ID NO: 1150540 - protein, 4 aa, Mycobacterium
RTGE

SEQ ID NO: 1150541 - protein, 11 aa, Mycobacterium
RTGEPAPGSRV

SEQ ID NO: 1150542 - protein, 5 aa, Mycobacterium
RTGER

SEQ ID NO: 1150543 - protein, 9 aa, Mycobacterium
RTGGPGAGG

SEQ ID NO: 1150544 - protein, 4 aa, Mycobacterium
RTGI

SEQ ID NO: 1150545 - protein, 7 aa, Mycobacterium
RTGKIGD

SEQ ID NO: 1150546 - protein, 10 aa, Mycobacterium
RTGRAGRSGT

SEQ ID NO: 1150547 - protein, 4 aa, Mycobacterium
RTID

SEQ ID NO: 1150548 - protein, 10 aa, Mycobacterium
RTKDQAGEMS

SEQ ID NO: 1150549 - protein, 6 aa, Mycobacterium
RTKGEY

SEQ ID NO: 1150550 - protein, 8 aa, Mycobacterium
RTKTPIQP

SEQ ID NO: 1150551 - protein, 8 aa, Mycobacterium
RTNITGSA

SEQ ID NO: 1150552 - protein, 5 aa, Mycobacterium
RTNNN

SEQ ID NO: 1150553 - protein, 6 aa, Mycobacterium
RTPADG

SEQ ID NO: 1150554 - protein, 8 aa, Mycobacterium
RTPEGRID

SEQ ID NO: 1150555 - protein, 9 aa, Mycobacterium
RTPERDGYS

SEQ ID NO: 1150556 - protein, 9 aa, Mycobacterium
RTPGGGSHL

SEQ ID NO: 1150557 - protein, 5 aa, Mycobacterium
RTPGR

SEQ ID NO: 1150558 - protein, 7 aa, Mycobacterium
RTPGSDV

SEQ ID NO: 1150559 - protein, 6 aa, Mycobacterium
RTPGYD

SEQ ID NO: 1150560 - protein, 7 aa, Mycobacterium
RTPPGAA

SEQ ID NO: 1150561 - protein, 9 aa, Mycobacterium
RTPRGRVAT

SEQ ID NO: 1150562 - protein, 4 aa, Mycobacterium
RTRR

SEQ ID NO: 1150563 - protein, 6 aa, Mycobacterium
RTRRAG

SEQ ID NO: 1150564 - protein, 6 aa, Mycobacterium
RTRSQE

SEQ ID NO: 1150565 - protein, 4 aa, Mycobacterium
RTSD

SEQ ID NO: 1150566 - protein, 7 aa, Mycobacterium
RTSIKAA

SEQ ID NO: 1150567 - protein, 14 aa, Mycobacterium
RTTIPDPEAVRPPD

SEQ ID NO: 1150568 - protein, 4 aa, Mycobacterium
RVGA

SEQ ID NO: 1150569 - protein, 9 aa, Mycobacterium
RVGPSTGTN

SEQ ID NO: 1150570 - protein, 5 aa, Mycobacterium
RVNPL

SEQ ID NO: 1150571 - protein, 13 aa, Mycobacterium
RVQGGRGPRESKY

SEQ ID NO: 1150572 - protein, 5 aa, Mycobacterium
RVRGQ

SEQ ID NO: 1150573 - protein, 5 aa, Mycobacterium
RVSRP

SEQ ID NO: 1150574 - protein, 6 aa, Mycobacterium
RVTPSS

SEQ ID NO: 1150575 - protein, 11 aa, Mycobacterium
RVTRQSDTRHL

SEQ ID NO: 1150576 - protein, 5 aa, Mycobacterium
RWPSG

SEQ ID NO: 1150577 - protein, 17 aa, Mycobacterium
RYAGSKKIGTTGRGIGP

SEQ ID NO: 1150578 - protein, 8 aa, Mycobacterium
RYAGTRPD

SEQ ID NO: 1150579 - protein, 5 aa, Mycobacterium
RYDAP

SEQ ID NO: 1150580 - protein, 5 aa, Mycobacterium
RYPDG

SEQ ID NO: 1150581 - protein, 8 aa, Mycobacterium
RYSNTGEG

SEQ ID NO: 1150582 - protein, 7 aa, Mycobacterium
RYSRRTK

SEQ ID NO: 1150583 - protein, 5 aa, Mycobacterium
RYTGR

SEQ ID NO: 1150584 - protein, 6 aa, Mycobacterium
RYTGRG

SEQ ID NO: 1150585 - protein, 8 aa, Mycobacterium
SAADRQSD

SEQ ID NO: 1150586 - protein, 4 aa, Mycobacterium
SAAE

SEQ ID NO: 1150587 - protein, 4 aa, Mycobacterium
SAAF

SEQ ID NO: 1150588 - protein, 8 aa, Mycobacterium
SAAGAASL

SEQ ID NO: 1150589 - protein, 7 aa, Mycobacterium
SAAGEVD

SEQ ID NO: 1150590 - protein, 4 aa, Mycobacterium
SAAT

SEQ ID NO: 1150591 - protein, 9 aa, Mycobacterium
SAATGLGRG

SEQ ID NO: 1150592 - protein, 5 aa, Mycobacterium
SACGK

SEQ ID NO: 1150593 - protein, 4 aa, Mycobacterium
SADD

SEQ ID NO: 1150594 - protein, 10 aa, Mycobacterium
SADGLSPREQ

SEQ ID NO: 1150595 - protein, 11 aa, Mycobacterium
SADGSRTAHSE

SEQ ID NO: 1150596 - protein, 7 aa, Mycobacterium
SADPRRG

SEQ ID NO: 1150597 - protein, 7 aa, Mycobacterium
SAEETAK

SEQ ID NO: 1150598 - protein, 4 aa, Mycobacterium
SAEK

SEQ ID NO: 1150599 - protein, 10 aa, Mycobacterium
SAERTAVPGV

SEQ ID NO: 1150600 - protein, 5 aa, Mycobacterium
SAGAH

SEQ ID NO: 1150601 - protein, 5 aa, Mycobacterium
SAGAK

SEQ ID NO: 1150602 - protein, 6 aa, Mycobacterium
SAGAPV

SEQ ID NO: 1150603 - protein, 5 aa, Mycobacterium
SAGFD

SEQ ID NO: 1150604 - protein, 7 aa, Mycobacterium
SAGHPPP

SEQ ID NO: 1150605 - protein, 7 aa, Mycobacterium
SAGNHAQ

SEQ ID NO: 1150606 - protein, 7 aa, Mycobacterium
SAGRPPC

SEQ ID NO: 1150607 - protein, 6 aa, Mycobacterium
SAHRDE

SEQ ID NO: 1150608 - protein, 15 aa, Mycobacterium
SALGPRGEESVKGGY

SEQ ID NO: 1150609 - protein, 6 aa, Mycobacterium
SALGTI

SEQ ID NO: 1150610 - protein, 5 aa, Mycobacterium
SANPD

SEQ ID NO: 1150611 - protein, 6 aa, Mycobacterium
SANRDA

SEQ ID NO: 1150612 - protein, 4 aa, Mycobacterium
SAPA

SEQ ID NO: 1150613 - protein, 4 aa, Mycobacterium
SAPL

SEQ ID NO: 1150614 - protein, 8 aa, Mycobacterium
SAPPAEEV

SEQ ID NO: 1150615 - protein, 6 aa, Mycobacterium
SAPSSL

SEQ ID NO: 1150616 - protein, 5 aa, Mycobacterium
SAQRG

SEQ ID NO: 1150617 - protein, 4 aa, Mycobacterium
SARA

SEQ ID NO: 1150618 - protein, 9 aa, Mycobacterium
SARGDGRAL

SEQ ID NO: 1150619 - protein, 7 aa, Mycobacterium
SARPSDS

SEQ ID NO: 1150620 - protein, 6 aa, Mycobacterium
SARRAE

SEQ ID NO: 1150621 - protein, 6 aa, Mycobacterium
SARTAA

SEQ ID NO: 1150622 - protein, 4 aa, Mycobacterium
SASG

SEQ ID NO: 1150623 - protein, 4 aa, Mycobacterium
SASN

SEQ ID NO: 1150624 - protein, 7 aa, Mycobacterium
SASNENP

SEQ ID NO: 1150625 - protein, 9 aa, Mycobacterium
SASTASESI

SEQ ID NO: 1150626 - protein, 9 aa, Mycobacterium
SATSNAGGL

SEQ ID NO: 1150627 - protein, 5 aa, Mycobacterium
SATVR

SEQ ID NO: 1150628 - protein, 6 aa, Mycobacterium
SAVNGL

SEQ ID NO: 1150629 - protein, 6 aa, Mycobacterium
SAVRDG

SEQ ID NO: 1150630 - protein, 6 aa, Mycobacterium
SAVTSE

SEQ ID NO: 1150631 - protein, 11 aa, Mycobacterium
SAYGTGDARAA

SEQ ID NO: 1150632 - protein, 8 aa, Mycobacterium
SAYTAAGK

SEQ ID NO: 1150633 - protein, 8 aa, Mycobacterium
SCAGNDNL

SEQ ID NO: 1150634 - protein, 5 aa, Mycobacterium
SCPPG

SEQ ID NO: 1150635 - protein, 5 aa, Mycobacterium
SDADP

SEQ ID NO: 1150636 - protein, 7 aa, Mycobacterium
SDAEEHT

SEQ ID NO: 1150637 - protein, 10 aa, Mycobacterium
SDAQSGGPGA

SEQ ID NO: 1150638 - protein, 4 aa, Mycobacterium
SDDE

SEQ ID NO: 1150639 - protein, 7 aa, Mycobacterium
SDDTVGR

SEQ ID NO: 1150640 - protein, 4 aa, Mycobacterium
SDDY

SEQ ID NO: 1150641 - protein, 6 aa, Mycobacterium
SDEELD

SEQ ID NO: 1150642 - protein, 8 aa, Mycobacterium
SDEGYEGR

SEQ ID NO: 1150643 - protein, 9 aa, Mycobacterium
SDELGGGSM

SEQ ID NO: 1150644 - protein, 7 aa, Mycobacterium
SDERDDV

SEQ ID NO: 1150645 - protein, 5 aa, Mycobacterium
SDGAA

SEQ ID NO: 1150646 - protein, 9 aa, Mycobacterium
SDGEPTEDQ

SEQ ID NO: 1150647 - protein, 6 aa, Mycobacterium
SDGGLG

SEQ ID NO: 1150648 - protein, 6 aa, Mycobacterium
SDMNDP

SEQ ID NO: 1150649 - protein, 4 aa, Mycobacterium
SDPM

SEQ ID NO: 1150650 - protein, 5 aa, Mycobacterium
SDPNW

SEQ ID NO: 1150651 - protein, 9 aa, Mycobacterium
SDPSDVARV

SEQ ID NO: 1150652 - protein, 5 aa, Mycobacterium
SDQTH

SEQ ID NO: 1150653 - protein, 7 aa, Mycobacterium
SDRPMPA

SEQ ID NO: 1150654 - protein, 8 aa, Mycobacterium
SDRPPKQL

SEQ ID NO: 1150655 - protein, 9 aa, Mycobacterium
SDSNKDGGY

SEQ ID NO: 1150656 - protein, 6 aa, Mycobacterium
SDTAEF

SEQ ID NO: 1150657 - protein, 4 aa, Mycobacterium
SDTD

SEQ ID NO: 1150658 - protein, 4 aa, Mycobacterium
SDTT

SEQ ID NO: 1150659 - protein, 13 aa, Mycobacterium
SDVAGASAQRGLS

SEQ ID NO: 1150660 - protein, 4 aa, Mycobacterium
SDYL

SEQ ID NO: 1150661 - protein, 6 aa, Mycobacterium
SEEDRP

SEQ ID NO: 1150662 - protein, 6 aa, Mycobacterium
SEGKDG

SEQ ID NO: 1150663 - protein, 6 aa, Mycobacterium
SEGKGL

SEQ ID NO: 1150664 - protein, 7 aa, Mycobacterium
SEGPLPQ

SEQ ID NO: 1150665 - protein, 6 aa, Mycobacterium
SEHAGG

SEQ ID NO: 1150666 - protein, 4 aa, Mycobacterium
SEHS

SEQ ID NO: 1150667 - protein, 4 aa, Mycobacterium
SEKL

SEQ ID NO: 1150668 - protein, 11 aa, Mycobacterium
SELASAGDGGM

SEQ ID NO: 1150669 - protein, 5 aa, Mycobacterium
SENNT

SEQ ID NO: 1150670 - protein, 7 aa, Mycobacterium
SEPELGS

SEQ ID NO: 1150671 - protein, 21 aa, Mycobacterium
SEPESGSDLASLRSTATRTDG

SEQ ID NO: 1150672 - protein, 6 aa, Mycobacterium
SEPGDG

SEQ ID NO: 1150673 - protein, 12 aa, Mycobacterium
SEPGSGSDLASL

SEQ ID NO: 1150674 - protein, 8 aa, Mycobacterium
SEPGSTAK

SEQ ID NO: 1150675 - protein, 5 aa, Mycobacterium
SEPHA

SEQ ID NO: 1150676 - protein, 6 aa, Mycobacterium
SERDAY

SEQ ID NO: 1150677 - protein, 5 aa, Mycobacterium
SEREA

SEQ ID NO: 1150678 - protein, 6 aa, Mycobacterium
SERGRV

SEQ ID NO: 1150679 - protein, 4 aa, Mycobacterium
SERT

SEQ ID NO: 1150680 - protein, 8 aa, Mycobacterium
SERTQQIA

SEQ ID NO: 1150681 - protein, 15 aa, Mycobacterium
SERYTEKLATPDTSV

SEQ ID NO: 1150682 - protein, 5 aa, Mycobacterium
SESER

SEQ ID NO: 1150683 - protein, 10 aa, Mycobacterium
SESKGVERLT

SEQ ID NO: 1150684 - protein, 4 aa, Mycobacterium
SETD

SEQ ID NO: 1150685 - protein, 6 aa, Mycobacterium
SEVAPY

SEQ ID NO: 1150686 - protein, 10 aa, Mycobacterium
SEVDREPTRT

SEQ ID NO: 1150687 - protein, 9 aa, Mycobacterium
SFDETPSPD

SEQ ID NO: 1150688 - protein, 11 aa, Mycobacterium
SFGPPSISTDD

SEQ ID NO: 1150689 - protein, 4 aa, Mycobacterium
SFGT

SEQ ID NO: 1150690 - protein, 5 aa, Mycobacterium
SFRTG

SEQ ID NO: 1150691 - protein, 12 aa, Mycobacterium
SFTSGDNRLDSQ

SEQ ID NO: 1150692 - protein, 6 aa, Mycobacterium
SGAEGL

SEQ ID NO: 1150693 - protein, 6 aa, Mycobacterium
SGAENQ

SEQ ID NO: 1150694 - protein, 8 aa, Mycobacterium
SGAGGVDA

SEQ ID NO: 1150695 - protein, 9 aa, Mycobacterium
SGAGRGTAA

SEQ ID NO: 1150696 - protein, 7 aa, Mycobacterium
SGAGSSD

SEQ ID NO: 1150697 - protein, 7 aa, Mycobacterium
SGAHPGM

SEQ ID NO: 1150698 - protein, 4 aa, Mycobacterium
SGAL

SEQ ID NO: 1150699 - protein, 8 aa, Mycobacterium
SGAPRGSA

SEQ ID NO: 1150700 - protein, 6 aa, Mycobacterium
SGAPTH

SEQ ID NO: 1150701 - protein, 6 aa, Mycobacterium
SGASAT

SEQ ID NO: 1150702 - protein, 6 aa, Mycobacterium
SGCGKT

SEQ ID NO: 1150703 - protein, 7 aa, Mycobacterium
SGCGKTT

SEQ ID NO: 1150704 - protein, 8 aa, Mycobacterium
SGCGKTTS

SEQ ID NO: 1150705 - protein, 8 aa, Mycobacterium
SGDAEAQA

SEQ ID NO: 1150706 - protein, 6 aa, Mycobacterium
SGDARE

SEQ ID NO: 1150707 - protein, 8 aa, Mycobacterium
SGEAKWGQ

SEQ ID NO: 1150708 - protein, 7 aa, Mycobacterium
SGEGRYV

SEQ ID NO: 1150709 - protein, 17 aa, Mycobacterium
SGEHDSGRPHAIGRPEA

SEQ ID NO: 1150710 - protein, 6 aa, Mycobacterium
SGEQDA

SEQ ID NO: 1150711 - protein, 7 aa, Mycobacterium
SGERAQV

SEQ ID NO: 1150712 - protein, 4 aa, Mycobacterium
SGFG

SEQ ID NO: 1150713 - protein, 6 aa, Mycobacterium
SGGAGA

SEQ ID NO: 1150714 - protein, 9 aa, Mycobacterium
SGGDNLTAT

SEQ ID NO: 1150715 - protein, 7 aa, Mycobacterium
SGGEKSL

SEQ ID NO: 1150716 - protein, 7 aa, Mycobacterium
SGGGGMT

SEQ ID NO: 1150717 - protein, 9 aa, Mycobacterium
SGGGGRGMR

SEQ ID NO: 1150718 - protein, 5 aa, Mycobacterium
SGGGS

SEQ ID NO: 1150719 - protein, 5 aa, Mycobacterium
SGGGV

SEQ ID NO: 1150720 - protein, 6 aa, Mycobacterium
SGGHAE

SEQ ID NO: 1150721 - protein, 8 aa, Mycobacterium
SGGQQQRV

SEQ ID NO: 1150722 - protein, 7 aa, Mycobacterium
SGGQRQQ

SEQ ID NO: 1150723 - protein, 4 aa, Mycobacterium
SGGR

SEQ ID NO: 1150724 - protein, 6 aa, Mycobacterium
SGHGAQ

SEQ ID NO: 1150725 - protein, 8 aa, Mycobacterium
SGKGEELY

SEQ ID NO: 1150726 - protein, 9 aa, Mycobacterium
SGKKQRGEP

SEQ ID NO: 1150727 - protein, 4 aa, Mycobacterium
SGKP

SEQ ID NO: 1150728 - protein, 8 aa, Mycobacterium
SGLARTGR

SEQ ID NO: 1150729 - protein, 7 aa, Mycobacterium
SGLSISG

SEQ ID NO: 1150730 - protein, 4 aa, Mycobacterium
SGMN

SEQ ID NO: 1150731 - protein, 6 aa, Mycobacterium
SGNVSA

SEQ ID NO: 1150732 - protein, 9 aa, Mycobacterium
SGPAATVHP

SEQ ID NO: 1150733 - protein, 7 aa, Mycobacterium
SGPGVTG

SEQ ID NO: 1150734 - protein, 4 aa, Mycobacterium
SGPI

SEQ ID NO: 1150735 - protein, 4 aa, Mycobacterium
SGPQ

SEQ ID NO: 1150736 - protein, 5 aa, Mycobacterium
SGPVG

SEQ ID NO: 1150737 - protein, 6 aa, Mycobacterium
SGQDAG

SEQ ID NO: 1150738 - protein, 8 aa, Mycobacterium
SGQTYTNA

SEQ ID NO: 1150739 - protein, 11 aa, Mycobacterium
SGRGDKDVETA

SEQ ID NO: 1150740 - protein, 4 aa, Mycobacterium
SGRK

SEQ ID NO: 1150741 - protein, 8 aa, Mycobacterium
SGRPGELA

SEQ ID NO: 1150742 - protein, 5 aa, Mycobacterium
SGRQV

SEQ ID NO: 1150743 - protein, 8 aa, Mycobacterium
SGRTSNEA

SEQ ID NO: 1150744 - protein, 10 aa, Mycobacterium
SGSDGREESQ

SEQ ID NO: 1150745 - protein, 7 aa, Mycobacterium
SGSEASD

SEQ ID NO: 1150746 - protein, 8 aa, Mycobacterium
SGSGKSSL

SEQ ID NO: 1150747 - protein, 7 aa, Mycobacterium
SGSGKST

SEQ ID NO: 1150748 - protein, 7 aa, Mycobacterium
SGSGSSY

SEQ ID NO: 1150749 - protein, 17 aa, Mycobacterium
SGSSGTAAAKKEALEAA

SEQ ID NO: 1150750 - protein, 9 aa, Mycobacterium
SGSTRIPTG

SEQ ID NO: 1150751 - protein, 5 aa, Mycobacterium
SGSVS

SEQ ID NO: 1150752 - protein, 8 aa, Mycobacterium
SGSVTPPQ

SEQ ID NO: 1150753 - protein, 7 aa, Mycobacterium
SGTEATM

SEQ ID NO: 1150754 - protein, 10 aa, Mycobacterium
SGTTGKPKGI

SEQ ID NO: 1150755 - protein, 17 aa, Mycobacterium
SGTTGKPKGIVRDNGGH

SEQ ID NO: 1150756 - protein, 9 aa, Mycobacterium
SGTTGPPKG

SEQ ID NO: 1150757 - protein, 9 aa, Mycobacterium
SGTTSRPKA

SEQ ID NO: 1150758 - protein, 13 aa, Mycobacterium
SGTTYPGGGNPIG

SEQ ID NO: 1150759 - protein, 8 aa, Mycobacterium
SGVTEPFS

SEQ ID NO: 1150760 - protein, 12 aa, Mycobacterium
SGVTGPDGASHN

SEQ ID NO: 1150761 - protein, 4 aa, Mycobacterium
SGYA

SEQ ID NO: 1150762 - protein, 10 aa, Mycobacterium
SGYDESTGIP

SEQ ID NO: 1150763 - protein, 7 aa, Mycobacterium
SGYGGNA

SEQ ID NO: 1150764 - protein, 7 aa, Mycobacterium
SHEGGIA

SEQ ID NO: 1150765 - protein, 6 aa, Mycobacterium
SHPAQL

SEQ ID NO: 1150766 - protein, 10 aa, Mycobacterium
SHPEASQADV

SEQ ID NO: 1150767 - protein, 7 aa, Mycobacterium
SHPEYAT

SEQ ID NO: 1150768 - protein, 6 aa, Mycobacterium
SHPTRH

SEQ ID NO: 1150769 - protein, 7 aa, Mycobacterium
SHRQAPV

SEQ ID NO: 1150770 - protein, 4 aa, Mycobacterium
SHSE

SEQ ID NO: 1150771 - protein, 8 aa, Mycobacterium
SHTSTHGA

SEQ ID NO: 1150772 - protein, 5 aa, Mycobacterium
SIADE

SEQ ID NO: 1150773 - protein, 8 aa, Mycobacterium
SIAPESAC

SEQ ID NO: 1150774 - protein, 7 aa, Mycobacterium
SIDGARQ

SEQ ID NO: 1150775 - protein, 11 aa, Mycobacterium
SIEQGNNDSHA

SEQ ID NO: 1150776 - protein, 8 aa, Mycobacterium
SIGEPGTQ

SEQ ID NO: 1150777 - protein, 10 aa, Mycobacterium
SIGPGGNAKR

SEQ ID NO: 1150778 - protein, 8 aa, Mycobacterium
SIPAPGLG

SEQ ID NO: 1150779 - protein, 11 aa, Mycobacterium
SIPEPDPALNP

SEQ ID NO: 1150780 - protein, 10 aa, Mycobacterium
SIRKTSDEQY

SEQ ID NO: 1150781 - protein, 5 aa, Mycobacterium
SISGY

SEQ ID NO: 1150782 - protein, 20 aa, Mycobacterium
SIYGGSNEVQRTIIASTILG

SEQ ID NO: 1150783 - protein, 7 aa, Mycobacterium
SKAADRP

SEQ ID NO: 1150784 - protein, 5 aa, Mycobacterium
SKDAR

SEQ ID NO: 1150785 - protein, 8 aa, Mycobacterium
SKNSSNSV

SEQ ID NO: 1150786 - protein, 5 aa, Mycobacterium
SKPGL

SEQ ID NO: 1150787 - protein, 8 aa, Mycobacterium
SKPGTYGA

SEQ ID NO: 1150788 - protein, 6 aa, Mycobacterium
SKRGGG

SEQ ID NO: 1150789 - protein, 9 aa, Mycobacterium
SKRPRGSQL

SEQ ID NO: 1150790 - protein, 9 aa, Mycobacterium
SKSDPQFAQ

SEQ ID NO: 1150791 - protein, 6 aa, Mycobacterium
SKTQQD

SEQ ID NO: 1150792 - protein, 8 aa, Mycobacterium
SKTSSLAG

SEQ ID NO: 1150793 - protein, 5 aa, Mycobacterium
SKVSD

SEQ ID NO: 1150794 - protein, 6 aa, Mycobacterium
SLAGTQ

SEQ ID NO: 1150795 - protein, 8 aa, Mycobacterium
SLAPGARQ

SEQ ID NO: 1150796 - protein, 6 aa, Mycobacterium
SLAPGG

SEQ ID NO: 1150797 - protein, 6 aa, Mycobacterium
SLATDS

SEQ ID NO: 1150798 - protein, 8 aa, Mycobacterium
SLDQGGPC

SEQ ID NO: 1150799 - protein, 14 aa, Mycobacterium
SLGAGKPASGAGIS

SEQ ID NO: 1150800 - protein, 5 aa, Mycobacterium
SLGDE

SEQ ID NO: 1150801 - protein, 6 aa, Mycobacterium
SLGHPR

SEQ ID NO: 1150802 - protein, 8 aa, Mycobacterium
SLGPETSK

SEQ ID NO: 1150803 - protein, 8 aa, Mycobacterium
SLGRSDGA

SEQ ID NO: 1150804 - protein, 7 aa, Mycobacterium
SLGSDNA

SEQ ID NO: 1150805 - protein, 13 aa, Mycobacterium
SLPGAGGTAARTP

SEQ ID NO: 1150806 - protein, 7 aa, Mycobacterium
SLPGPDG

SEQ ID NO: 1150807 - protein, 7 aa, Mycobacterium
SLPPGVP

SEQ ID NO: 1150808 - protein, 10 aa, Mycobacterium
SLPRTSSGKL

SEQ ID NO: 1150809 - protein, 4 aa, Mycobacterium
SLQT

SEQ ID NO: 1150810 - protein, 10 aa, Mycobacterium
SMGQENDGLD

SEQ ID NO: 1150811 - protein, 10 aa, Mycobacterium
SNETVHGPLP

SEQ ID NO: 1150812 - protein, 8 aa, Mycobacterium
SNGAGKTT

SEQ ID NO: 1150813 - protein, 5 aa, Mycobacterium
SNGDR

SEQ ID NO: 1150814 - protein, 9 aa, Mycobacterium
SNGEAAQAA

SEQ ID NO: 1150815 - protein, 6 aa, Mycobacterium
SNGLGA

SEQ ID NO: 1150816 - protein, 13 aa, Mycobacterium
SNHGGNNLDGTPA

SEQ ID NO: 1150817 - protein, 6 aa, Mycobacterium
SNIYPR

SEQ ID NO: 1150818 - protein, 5 aa, Mycobacterium
SNLAA

SEQ ID NO: 1150819 - protein, 4 aa, Mycobacterium
SNPQ

SEQ ID NO: 1150820 - protein, 6 aa, Mycobacterium
SNPRLD

SEQ ID NO: 1150821 - protein, 7 aa, Mycobacterium
SNSAGLG

SEQ ID NO: 1150822 - protein, 10 aa, Mycobacterium
SNSTTTTPLV

SEQ ID NO: 1150823 - protein, 6 aa, Mycobacterium
SNVDTD

SEQ ID NO: 1150824 - protein, 8 aa, Mycobacterium
SNVQGDRT

SEQ ID NO: 1150825 - protein, 7 aa, Mycobacterium
SNVQTGA

SEQ ID NO: 1150826 - protein, 6 aa, Mycobacterium
SPAAAG

SEQ ID NO: 1150827 - protein, 7 aa, Mycobacterium
SPAISNR

SEQ ID NO: 1150828 - protein, 5 aa, Mycobacterium
SPAPC

SEQ ID NO: 1150829 - protein, 10 aa, Mycobacterium
SPDKVEGGMQ

SEQ ID NO: 1150830 - protein, 7 aa, Mycobacterium
SPDPGPV

SEQ ID NO: 1150831 - protein, 8 aa, Mycobacterium
SPDSARGR

SEQ ID NO: 1150832 - protein, 8 aa, Mycobacterium
SPEDEDRE

SEQ ID NO: 1150833 - protein, 6 aa, Mycobacterium
SPEFGS

SEQ ID NO: 1150834 - protein, 10 aa, Mycobacterium
SPEGDTGKST

SEQ ID NO: 1150835 - protein, 9 aa, Mycobacterium
SPETTTGGK

SEQ ID NO: 1150836 - protein, 5 aa, Mycobacterium
SPFDH

SEQ ID NO: 1150837 - protein, 21 aa, Mycobacterium
SPFGGTKQSGLGYRNGEEGYK

SEQ ID NO: 1150838 - protein, 6 aa, Mycobacterium
SPFGQG

SEQ ID NO: 1150839 - protein, 4 aa, Mycobacterium
SPGE

SEQ ID NO: 1150840 - protein, 11 aa, Mycobacterium
SPGGHTSRPHL

SEQ ID NO: 1150841 - protein, 6 aa, Mycobacterium
SPGGSF

SEQ ID NO: 1150842 - protein, 7 aa, Mycobacterium
SPGGSIS

SEQ ID NO: 1150843 - protein, 13 aa, Mycobacterium
SPGPGTPERAGAS

SEQ ID NO: 1150844 - protein, 5 aa, Mycobacterium
SPGPH

SEQ ID NO: 1150845 - protein, 6 aa, Mycobacterium
SPGVDT

SEQ ID NO: 1150846 - protein, 5 aa, Mycobacterium
SPGWA

SEQ ID NO: 1150847 - protein, 7 aa, Mycobacterium
SPHPAEF

SEQ ID NO: 1150848 - protein, 5 aa, Mycobacterium
SPHQE

SEQ ID NO: 1150849 - protein, 6 aa, Mycobacterium
SPIGKR

SEQ ID NO: 1150850 - protein, 6 aa, Mycobacterium
SPIGTG

SEQ ID NO: 1150851 - protein, 6 aa, Mycobacterium
SPKRLP

SEQ ID NO: 1150852 - protein, 4 aa, Mycobacterium
SPLG

SEQ ID NO: 1150853 - protein, 7 aa, Mycobacterium
SPNADEN

SEQ ID NO: 1150854 - protein, 4 aa, Mycobacterium
SPPF

SEQ ID NO: 1150855 - protein, 9 aa, Mycobacterium
SPPKAGKTT

SEQ ID NO: 1150856 - protein, 4 aa, Mycobacterium
SPPL

SEQ ID NO: 1150857 - protein, 4 aa, Mycobacterium
SPPM

SEQ ID NO: 1150858 - protein, 7 aa, Mycobacterium
SPQSIRD

SEQ ID NO: 1150859 - protein, 5 aa, Mycobacterium
SPRHV

SEQ ID NO: 1150860 - protein, 6 aa, Mycobacterium
SPRTPC

SEQ ID NO: 1150861 - protein, 4 aa, Mycobacterium
SPSA

SEQ ID NO: 1150862 - protein, 8 aa, Mycobacterium
SPSNPTGR

SEQ ID NO: 1150863 - protein, 5 aa, Mycobacterium
SPTFG

SEQ ID NO: 1150864 - protein, 8 aa, Mycobacterium
SPVEQGDE

SEQ ID NO: 1150865 - protein, 4 aa, Mycobacterium
SPVG

SEQ ID NO: 1150866 - protein, 6 aa, Mycobacterium
SPYPAD

SEQ ID NO: 1150867 - protein, 8 aa, Mycobacterium
SPYRTPQT

SEQ ID NO: 1150868 - protein, 5 aa, Mycobacterium
SQAAR

SEQ ID NO: 1150869 - protein, 4 aa, Mycobacterium
SQAG

SEQ ID NO: 1150870 - protein, 17 aa, Mycobacterium
SQASAAQRAGRSGRTAP

SEQ ID NO: 1150871 - protein, 5 aa, Mycobacterium
SQDHS

SEQ ID NO: 1150872 - protein, 9 aa, Mycobacterium
SQGQQDAWS

SEQ ID NO: 1150873 - protein, 6 aa, Mycobacterium
SQGQTL

SEQ ID NO: 1150874 - protein, 4 aa, Mycobacterium
SQIG

SEQ ID NO: 1150875 - protein, 6 aa, Mycobacterium
SQLGPA

SEQ ID NO: 1150876 - protein, 9 aa, Mycobacterium
SQLGPQAAN

SEQ ID NO: 1150877 - protein, 6 aa, Mycobacterium
SQLPTE

SEQ ID NO: 1150878 - protein, 7 aa, Mycobacterium
SQNPDQL

SEQ ID NO: 1150879 - protein, 7 aa, Mycobacterium
SQNPESP

SEQ ID NO: 1150880 - protein, 9 aa, Mycobacterium
SQNRAEEAI

SEQ ID NO: 1150881 - protein, 9 aa, Mycobacterium
SQPDTGEQA

SEQ ID NO: 1150882 - protein, 6 aa, Mycobacterium
SQPTMT

SEQ ID NO: 1150883 - protein, 9 aa, Mycobacterium
SQRGRPSIP

SEQ ID NO: 1150884 - protein, 8 aa, Mycobacterium
SQTTREER

SEQ ID NO: 1150885 - protein, 6 aa, Mycobacterium
SRAAVR

SEQ ID NO: 1150886 - protein, 8 aa, Mycobacterium
SRADERDQ

SEQ ID NO: 1150887 - protein, 6 aa, Mycobacterium
SRADGG

SEQ ID NO: 1150888 - protein, 4 aa, Mycobacterium
SRDA

SEQ ID NO: 1150889 - protein, 4 aa, Mycobacterium
SRDD

SEQ ID NO: 1150890 - protein, 5 aa, Mycobacterium
SRDPV

SEQ ID NO: 1150891 - protein, 4 aa, Mycobacterium
SREL

SEQ ID NO: 1150892 - protein, 8 aa, Mycobacterium
SRGPATVN

SEQ ID NO: 1150893 - protein, 11 aa, Mycobacterium
SRGPKATGALR

SEQ ID NO: 1150894 - protein, 5 aa, Mycobacterium
SRGRI

SEQ ID NO: 1150895 - protein, 4 aa, Mycobacterium
SRIG

SEQ ID NO: 1150896 - protein, 5 aa, Mycobacterium
SRPES

SEQ ID NO: 1150897 - protein, 6 aa, Mycobacterium
SRPLGP

SEQ ID NO: 1150898 - protein, 8 aa, Mycobacterium
SRQDHGLD

SEQ ID NO: 1150899 - protein, 5 aa, Mycobacterium
SRQVQ

SEQ ID NO: 1150900 - protein, 7 aa, Mycobacterium
SRRGLDP

SEQ ID NO: 1150901 - protein, 7 aa, Mycobacterium
SRRGQRL

SEQ ID NO: 1150902 - protein, 8 aa, Mycobacterium
SRRPGTGR

SEQ ID NO: 1150903 - protein, 13 aa, Mycobacterium
SRRTRSSKDVSTA

SEQ ID NO: 1150904 - protein, 9 aa, Mycobacterium
SRSATEEVS

SEQ ID NO: 1150905 - protein, 6 aa, Mycobacterium
SRSDTY

SEQ ID NO: 1150906 - protein, 5 aa, Mycobacterium
SRSGS

SEQ ID NO: 1150907 - protein, 5 aa, Mycobacterium
SRSVP

SEQ ID NO: 1150908 - protein, 7 aa, Mycobacterium
SRTFTGG

SEQ ID NO: 1150909 - protein, 9 aa, Mycobacterium
SRTPGNGQV

SEQ ID NO: 1150910 - protein, 4 aa, Mycobacterium
SRYG

SEQ ID NO: 1150911 - protein, 7 aa, Mycobacterium
SRYRGDF

SEQ ID NO: 1150912 - protein, 4 aa, Mycobacterium
SSAQ

SEQ ID NO: 1150913 - protein, 9 aa, Mycobacterium
SSATTRSRP

SEQ ID NO: 1150914 - protein, 4 aa, Mycobacterium
SSDA

SEQ ID NO: 1150915 - protein, 6 aa, Mycobacterium
SSDDHD

SEQ ID NO: 1150916 - protein, 4 aa, Mycobacterium
SSDL

SEQ ID NO: 1150917 - protein, 6 aa, Mycobacterium
SSEDAM

SEQ ID NO: 1150918 - protein, 8 aa, Mycobacterium
SSEEDEPV

SEQ ID NO: 1150919 - protein, 5 aa, Mycobacterium
SSEGA

SEQ ID NO: 1150920 - protein, 9 aa, Mycobacterium
SSEKQAATW

SEQ ID NO: 1150921 - protein, 7 aa, Mycobacterium
SSESQER

SEQ ID NO: 1150922 - protein, 7 aa, Mycobacterium
SSFYPGR

SEQ ID NO: 1150923 - protein, 6 aa, Mycobacterium
SSGDPG

SEQ ID NO: 1150924 - protein, 6 aa, Mycobacterium
SSGGTC

SEQ ID NO: 1150925 - protein, 15 aa, Mycobacterium
SSGKGGQGVNTTDSA

SEQ ID NO: 1150926 - protein, 7 aa, Mycobacterium
SSGNHAQ

SEQ ID NO: 1150927 - protein, 4 aa, Mycobacterium
SSGR

SEQ ID NO: 1150928 - protein, 5 aa, Mycobacterium
SSGTD

SEQ ID NO: 1150929 - protein, 8 aa, Mycobacterium
SSIAPGAW

SEQ ID NO: 1150930 - protein, 5 aa, Mycobacterium
SSITQ

SEQ ID NO: 1150931 - protein, 5 aa, Mycobacterium
SSPNA

SEQ ID NO: 1150932 - protein, 9 aa, Mycobacterium
SSPNTPGLR

SEQ ID NO: 1150933 - protein, 9 aa, Mycobacterium
SSQGGGSKD

SEQ ID NO: 1150934 - protein, 4 aa, Mycobacterium
SSRA

SEQ ID NO: 1150935 - protein, 6 aa, Mycobacterium
SSREPY

SEQ ID NO: 1150936 - protein, 6 aa, Mycobacterium
SSRRGE

SEQ ID NO: 1150937 - protein, 8 aa, Mycobacterium
SSTDGVGT

SEQ ID NO: 1150938 - protein, 8 aa, Mycobacterium
SSVGSGVR

SEQ ID NO: 1150939 - protein, 8 aa, Mycobacterium
STAAESNA

SEQ ID NO: 1150940 - protein, 6 aa, Mycobacterium
STAESH

SEQ ID NO: 1150941 - protein, 7 aa, Mycobacterium
STAGNVG

SEQ ID NO: 1150942 - protein, 11 aa, Mycobacterium
STAPPLPGPPV

SEQ ID NO: 1150943 - protein, 6 aa, Mycobacterium
STEERV

SEQ ID NO: 1150944 - protein, 6 aa, Mycobacterium
STEVGT

SEQ ID NO: 1150945 - protein, 8 aa, Mycobacterium
STFGGNPV

SEQ ID NO: 1150946 - protein, 6 aa, Mycobacterium
STGADV

SEQ ID NO: 1150947 - protein, 7 aa, Mycobacterium
STGAKND

SEQ ID NO: 1150948 - protein, 6 aa, Mycobacterium
STGERG

SEQ ID NO: 1150949 - protein, 11 aa, Mycobacterium
STGGIRPDQPG

SEQ ID NO: 1150950 - protein, 7 aa, Mycobacterium
STGGSPL

SEQ ID NO: 1150951 - protein, 6 aa, Mycobacterium
STGLTS

SEQ ID NO: 1150952 - protein, 16 aa, Mycobacterium
STGNTSASAAAYAARA

SEQ ID NO: 1150953 - protein, 17 aa, Mycobacterium
STGSSIMPQKKNPDIAE

SEQ ID NO: 1150954 - protein, 6 aa, Mycobacterium
STIPDY

SEQ ID NO: 1150955 - protein, 6 aa, Mycobacterium
STKAGL

SEQ ID NO: 1150956 - protein, 11 aa, Mycobacterium
STLAGAPSLSP

SEQ ID NO: 1150957 - protein, 8 aa, Mycobacterium
STMDSPVT

SEQ ID NO: 1150958 - protein, 6 aa, Mycobacterium
STNERL

SEQ ID NO: 1150959 - protein, 5 aa, Mycobacterium
STNLP

SEQ ID NO: 1150960 - protein, 6 aa, Mycobacterium
STPAYR

SEQ ID NO: 1150961 - protein, 8 aa, Mycobacterium
STPDAADV

SEQ ID NO: 1150962 - protein, 7 aa, Mycobacterium
STPLDRS

SEQ ID NO: 1150963 - protein, 9 aa, Mycobacterium
STPTGSTAY

SEQ ID NO: 1150964 - protein, 6 aa, Mycobacterium
STPVSE

SEQ ID NO: 1150965 - protein, 9 aa, Mycobacterium
STQGTGMGG

SEQ ID NO: 1150966 - protein, 5 aa, Mycobacterium
STQTL

SEQ ID NO: 1150967 - protein, 6 aa, Mycobacterium
STQVGA

SEQ ID NO: 1150968 - protein, 5 aa, Mycobacterium
STRMP

SEQ ID NO: 1150969 - protein, 5 aa, Mycobacterium
STRTF

SEQ ID NO: 1150970 - protein, 7 aa, Mycobacterium
STRTGQY

SEQ ID NO: 1150971 - protein, 5 aa, Mycobacterium
STRTR

SEQ ID NO: 1150972 - protein, 10 aa, Mycobacterium
STSDPDEGEA

SEQ ID NO: 1150973 - protein, 9 aa, Mycobacterium
STSPVSRDF

SEQ ID NO: 1150974 - protein, 8 aa, Mycobacterium
STTEGGIA

SEQ ID NO: 1150975 - protein, 10 aa, Mycobacterium
STTGSTTWEN

SEQ ID NO: 1150976 - protein, 11 aa, Mycobacterium
STYESAGTQTA

SEQ ID NO: 1150977 - protein, 6 aa, Mycobacterium
STYKRA

SEQ ID NO: 1150978 - protein, 7 aa, Mycobacterium
SVAPTGT

SEQ ID NO: 1150979 - protein, 15 aa, Mycobacterium
SVDGRSAAADGSSQW

SEQ ID NO: 1150980 - protein, 6 aa, Mycobacterium
SVDPYN

SEQ ID NO: 1150981 - protein, 7 aa, Mycobacterium
SVGRGRH

SEQ ID NO: 1150982 - protein, 6 aa, Mycobacterium
SVPGAA

SEQ ID NO: 1150983 - protein, 7 aa, Mycobacterium
SVPGAGD

SEQ ID NO: 1150984 - protein, 6 aa, Mycobacterium
SVPPSL

SEQ ID NO: 1150985 - protein, 6 aa, Mycobacterium
SVTGED

SEQ ID NO: 1150986 - protein, 7 aa, Mycobacterium
SVWTPEP

SEQ ID NO: 1150987 - protein, 11 aa, Mycobacterium
SWDNGKPIRET

SEQ ID NO: 1150988 - protein, 7 aa, Mycobacterium
SYAPMGA

SEQ ID NO: 1150989 - protein, 8 aa, Mycobacterium
SYESKPYR

SEQ ID NO: 1150990 - protein, 6 aa, Mycobacterium
SYGPIG

SEQ ID NO: 1150991 - protein, 11 aa, Mycobacterium
SYGSSTSSSGV

SEQ ID NO: 1150992 - protein, 6 aa, Mycobacterium
SYHSRT

SEQ ID NO: 1150993 - protein, 11 aa, Mycobacterium
SYNRPKLPGIP

SEQ ID NO: 1150994 - protein, 4 aa, Mycobacterium
SYPA

SEQ ID NO: 1150995 - protein, 6 aa, Mycobacterium
SYPGHH

SEQ ID NO: 1150996 - protein, 4 aa, Mycobacterium
SYSE

SEQ ID NO: 1150997 - protein, 4 aa, Mycobacterium
SYTG

SEQ ID NO: 1150998 - protein, 7 aa, Mycobacterium
TAAASDL

SEQ ID NO: 1150999 - protein, 4 aa, Mycobacterium
TAAG

SEQ ID NO: 1151000 - protein, 6 aa, Mycobacterium
TAAGVS

SEQ ID NO: 1151001 - protein, 12 aa, Mycobacterium
TAALKGSPQRRG

SEQ ID NO: 1151002 - protein, 4 aa, Mycobacterium
TAAR

SEQ ID NO: 1151003 - protein, 5 aa, Mycobacterium
TAATT

SEQ ID NO: 1151004 - protein, 4 aa, Mycobacterium
TADA

SEQ ID NO: 1151005 - protein, 7 aa, Mycobacterium
TADGDPW

SEQ ID NO: 1151006 - protein, 13 aa, Mycobacterium
TADGRDGYPVEPG

SEQ ID NO: 1151007 - protein, 7 aa, Mycobacterium
TADLADA

SEQ ID NO: 1151008 - protein, 5 aa, Mycobacterium
TADNN

SEQ ID NO: 1151009 - protein, 7 aa, Mycobacterium
TADTEVR

SEQ ID NO: 1151010 - protein, 6 aa, Mycobacterium
TADVPA

SEQ ID NO: 1151011 - protein, 9 aa, Mycobacterium
TAEGNHLGP

SEQ ID NO: 1151012 - protein, 11 aa, Mycobacterium
TAEPHPKLPGT

SEQ ID NO: 1151013 - protein, 8 aa, Mycobacterium
TAFTDGEQ

SEQ ID NO: 1151014 - protein, 8 aa, Mycobacterium
TAGATPVQ

SEQ ID NO: 1151015 - protein, 4 aa, Mycobacterium
TAGD

SEQ ID NO: 1151016 - protein, 5 aa, Mycobacterium
TAGDR

SEQ ID NO: 1151017 - protein, 5 aa, Mycobacterium
TAGGA

SEQ ID NO: 1151018 - protein, 8 aa, Mycobacterium
TAGPKEAR

SEQ ID NO: 1151019 - protein, 7 aa, Mycobacterium
TAGRTTL

SEQ ID NO: 1151020 - protein, 4 aa, Mycobacterium
TAGS

SEQ ID NO: 1151021 - protein, 9 aa, Mycobacterium
TAGSNPAPH

SEQ ID NO: 1151022 - protein, 6 aa, Mycobacterium
TAGTQG

SEQ ID NO: 1151023 - protein, 12 aa, Mycobacterium
TAHPRPVSTPHP

SEQ ID NO: 1151024 - protein, 8 aa, Mycobacterium
TAKFGQPE

SEQ ID NO: 1151025 - protein, 10 aa, Mycobacterium
TALGTGRGEE

SEQ ID NO: 1151026 - protein, 6 aa, Mycobacterium
TALKGP

SEQ ID NO: 1151027 - protein, 5 aa, Mycobacterium
TANGP

SEQ ID NO: 1151028 - protein, 9 aa, Mycobacterium
TAPEGKTMG

SEQ ID NO: 1151029 - protein, 6 aa, Mycobacterium
TAPGDL

SEQ ID NO: 1151030 - protein, 5 aa, Mycobacterium
TAPGG

SEQ ID NO: 1151031 - protein, 14 aa, Mycobacterium
TAPVDYTDSIDPEQ

SEQ ID NO: 1151032 - protein, 8 aa, Mycobacterium
TATAAGAR

SEQ ID NO: 1151033 - protein, 8 aa, Mycobacterium
TATAGTDA

SEQ ID NO: 1151034 - protein, 13 aa, Mycobacterium
TATGGQAGQSSRI

SEQ ID NO: 1151035 - protein, 6 aa, Mycobacterium
TATGVA

SEQ ID NO: 1151036 - protein, 7 aa, Mycobacterium
TATSGAD

SEQ ID NO: 1151037 - protein, 6 aa, Mycobacterium
TATTES

SEQ ID NO: 1151038 - protein, 8 aa, Mycobacterium
TATVDRRD

SEQ ID NO: 1151039 - protein, 10 aa, Mycobacterium
TAYDPASGRV

SEQ ID NO: 1151040 - protein, 7 aa, Mycobacterium
TAYEPGT

SEQ ID NO: 1151041 - protein, 5 aa, Mycobacterium
TDADG

SEQ ID NO: 1151042 - protein, 5 aa, Mycobacterium
TDAEG

SEQ ID NO: 1151043 - protein, 5 aa, Mycobacterium
TDAER

SEQ ID NO: 1151044 - protein, 10 aa, Mycobacterium
TDATSEESVN

SEQ ID NO: 1151045 - protein, 6 aa, Mycobacterium
TDDAGV

SEQ ID NO: 1151046 - protein, 4 aa, Mycobacterium
TDDV

SEQ ID NO: 1151047 - protein, 4 aa, Mycobacterium
TDEG

SEQ ID NO: 1151048 - protein, 11 aa, Mycobacterium
TDEGADKPHRN

SEQ ID NO: 1151049 - protein, 6 aa, Mycobacterium
TDEVPE

SEQ ID NO: 1151050 - protein, 12 aa, Mycobacterium
TDFSKNSGRSEL

SEQ ID NO: 1151051 - protein, 5 aa, Mycobacterium
TDGAE

SEQ ID NO: 1151052 - protein, 9 aa, Mycobacterium
TDGDREGEA

SEQ ID NO: 1151053 - protein, 8 aa, Mycobacterium
TDGPMPQT

SEQ ID NO: 1151054 - protein, 6 aa, Mycobacterium
TDGPPV

SEQ ID NO: 1151055 - protein, 5 aa, Mycobacterium
TDGVG

SEQ ID NO: 1151056 - protein, 5 aa, Mycobacterium
TDHPA

SEQ ID NO: 1151057 - protein, 6 aa, Mycobacterium
TDIPPG

SEQ ID NO: 1151058 - protein, 6 aa, Mycobacterium
TDKADI

SEQ ID NO: 1151059 - protein, 9 aa, Mycobacterium
TDPAAPKHQ

SEQ ID NO: 1151060 - protein, 9 aa, Mycobacterium
TDPAKSRQL

SEQ ID NO: 1151061 - protein, 5 aa, Mycobacterium
TDPAR

SEQ ID NO: 1151062 - protein, 10 aa, Mycobacterium
TDPDDRDARR

SEQ ID NO: 1151063 - protein, 10 aa, Mycobacterium
TDPDKGANGI

SEQ ID NO: 1151064 - protein, 5 aa, Mycobacterium
TDPDV

SEQ ID NO: 1151065 - protein, 9 aa, Mycobacterium
TDPEAAKHK

SEQ ID NO: 1151066 - protein, 4 aa, Mycobacterium
TDPH

SEQ ID NO: 1151067 - protein, 11 aa, Mycobacterium
TDPNTEGEATA

SEQ ID NO: 1151068 - protein, 5 aa, Mycobacterium
TDPQG

SEQ ID NO: 1151069 - protein, 7 aa, Mycobacterium
TDPSGAT

SEQ ID NO: 1151070 - protein, 5 aa, Mycobacterium
TDRAA

SEQ ID NO: 1151071 - protein, 6 aa, Mycobacterium
TDRDGQ

SEQ ID NO: 1151072 - protein, 7 aa, Mycobacterium
TDRPDAR

SEQ ID NO: 1151073 - protein, 8 aa, Mycobacterium
TDRPRHTQ

SEQ ID NO: 1151074 - protein, 4 aa, Mycobacterium
TDRR

SEQ ID NO: 1151075 - protein, 8 aa, Mycobacterium
TDSAEGAY

SEQ ID NO: 1151076 - protein, 4 aa, Mycobacterium
TDSM

SEQ ID NO: 1151077 - protein, 12 aa, Mycobacterium
TDTAGTAPPPLT

SEQ ID NO: 1151078 - protein, 5 aa, Mycobacterium
TDTGT

SEQ ID NO: 1151079 - protein, 4 aa, Mycobacterium
TDTK

SEQ ID NO: 1151080 - protein, 8 aa, Mycobacterium
TDTTAAQR

SEQ ID NO: 1151081 - protein, 8 aa, Mycobacterium
TDYTPPNK

SEQ ID NO: 1151082 - protein, 5 aa, Mycobacterium
TEAAG

SEQ ID NO: 1151083 - protein, 4 aa, Mycobacterium
TEAG

SEQ ID NO: 1151084 - protein, 7 aa, Mycobacterium
TEAGRRI

SEQ ID NO: 1151085 - protein, 11 aa, Mycobacterium
TEALTGPSDDG

SEQ ID NO: 1151086 - protein, 4 aa, Mycobacterium
TEAT

SEQ ID NO: 1151087 - protein, 12 aa, Mycobacterium
TEATGRNARPVA

SEQ ID NO: 1151088 - protein, 9 aa, Mycobacterium
TEDGANITK

SEQ ID NO: 1151089 - protein, 5 aa, Mycobacterium
TEDKY

SEQ ID NO: 1151090 - protein, 6 aa, Mycobacterium
TEDPLE

SEQ ID NO: 1151091 - protein, 7 aa, Mycobacterium
TEDPPSR

SEQ ID NO: 1151092 - protein, 4 aa, Mycobacterium
TEEF

SEQ ID NO: 1151093 - protein, 4 aa, Mycobacterium
TEEV

SEQ ID NO: 1151094 - protein, 10 aa, Mycobacterium
TEGAGGGHAP

SEQ ID NO: 1151095 - protein, 5 aa, Mycobacterium
TEGLQ

SEQ ID NO: 1151096 - protein, 5 aa, Mycobacterium
TEGVP

SEQ ID NO: 1151097 - protein, 12 aa, Mycobacterium
TEIKNGQRKQVN

SEQ ID NO: 1151098 - protein, 9 aa, Mycobacterium
TEKGSKRHA

SEQ ID NO: 1151099 - protein, 7 aa, Mycobacterium
TELGEQG

SEQ ID NO: 1151100 - protein, 7 aa, Mycobacterium
TELGGQN

SEQ ID NO: 1151101 - protein, 12 aa, Mycobacterium
TEPDSGSDAFGG

SEQ ID NO: 1151102 - protein, 4 aa, Mycobacterium
TEPE

SEQ ID NO: 1151103 - protein, 11 aa, Mycobacterium
TEPEGGSDVAT

SEQ ID NO: 1151104 - protein, 5 aa, Mycobacterium
TEPEK

SEQ ID NO: 1151105 - protein, 7 aa, Mycobacterium
TEPERYA

SEQ ID NO: 1151106 - protein, 4 aa, Mycobacterium
TEPG

SEQ ID NO: 1151107 - protein, 10 aa, Mycobacterium
TEPGGGSDVG

SEQ ID NO: 1151108 - protein, 4 aa, Mycobacterium
TEPH

SEQ ID NO: 1151109 - protein, 5 aa, Mycobacterium
TEPIT

SEQ ID NO: 1151110 - protein, 7 aa, Mycobacterium
TEPNPLE

SEQ ID NO: 1151111 - protein, 4 aa, Mycobacterium
TEPW

SEQ ID NO: 1151112 - protein, 7 aa, Mycobacterium
TEQAEPF

SEQ ID NO: 1151113 - protein, 5 aa, Mycobacterium
TEQLG

SEQ ID NO: 1151114 - protein, 6 aa, Mycobacterium
TERATA

SEQ ID NO: 1151115 - protein, 8 aa, Mycobacterium
TERPPRKP

SEQ ID NO: 1151116 - protein, 5 aa, Mycobacterium
TERQS

SEQ ID NO: 1151117 - protein, 6 aa, Mycobacterium
TETADG

SEQ ID NO: 1151118 - protein, 11 aa, Mycobacterium
TETKAAHPNSR

SEQ ID NO: 1151119 - protein, 6 aa, Mycobacterium
TETSPV

SEQ ID NO: 1151120 - protein, 11 aa, Mycobacterium
TFAQDGVGGLR

SEQ ID NO: 1151121 - protein, 15 aa, Mycobacterium
TFPDGTKLVTVHHPI

SEQ ID NO: 1151122 - protein, 5 aa, Mycobacterium
TFPEG

SEQ ID NO: 1151123 - protein, 4 aa, Mycobacterium
TFPN

SEQ ID NO: 1151124 - protein, 9 aa, Mycobacterium
TFPSSSPTE

SEQ ID NO: 1151125 - protein, 5 aa, Mycobacterium
TFTRP

SEQ ID NO: 1151126 - protein, 13 aa, Mycobacterium
TGAAPSGAGPRVK

SEQ ID NO: 1151127 - protein, 4 aa, Mycobacterium
TGAP

SEQ ID NO: 1151128 - protein, 7 aa, Mycobacterium
TGARTTA

SEQ ID NO: 1151129 - protein, 9 aa, Mycobacterium
TGASKGSIA

SEQ ID NO: 1151130 - protein, 9 aa, Mycobacterium
TGCPSGEVQ

SEQ ID NO: 1151131 - protein, 6 aa, Mycobacterium
TGDDER

SEQ ID NO: 1151132 - protein, 9 aa, Mycobacterium
TGDEATGAN

SEQ ID NO: 1151133 - protein, 8 aa, Mycobacterium
TGDEDPVP

SEQ ID NO: 1151134 - protein, 14 aa, Mycobacterium
TGDPRRWPNDHGNA

SEQ ID NO: 1151135 - protein, 7 aa, Mycobacterium
TGDQLQG

SEQ ID NO: 1151136 - protein, 5 aa, Mycobacterium
TGDRS

SEQ ID NO: 1151137 - protein, 8 aa, Mycobacterium
TGEPLGSM

SEQ ID NO: 1151138 - protein, 9 aa, Mycobacterium
TGETGAGKT

SEQ ID NO: 1151139 - protein, 7 aa, Mycobacterium
TGETRGA

SEQ ID NO: 1151140 - protein, 7 aa, Mycobacterium
TGETTTG

SEQ ID NO: 1151141 - protein, 4 aa, Mycobacterium
TGFA

SEQ ID NO: 1151142 - protein, 7 aa, Mycobacterium
TGFTDER

SEQ ID NO: 1151143 - protein, 5 aa, Mycobacterium
TGGAA

SEQ ID NO: 1151144 - protein, 11 aa, Mycobacterium
TGGAATNQRHQ

SEQ ID NO: 1151145 - protein, 5 aa, Mycobacterium
TGGCP

SEQ ID NO: 1151146 - protein, 4 aa, Mycobacterium
TGGE

SEQ ID NO: 1151147 - protein, 8 aa, Mycobacterium
TGGEGTKH

SEQ ID NO: 1151148 - protein, 8 aa, Mycobacterium
TGGGIPEN

SEQ ID NO: 1151149 - protein, 7 aa, Mycobacterium
TGGHLGP

SEQ ID NO: 1151150 - protein, 8 aa, Mycobacterium
TGGHTPGH

SEQ ID NO: 1151151 - protein, 4 aa, Mycobacterium
TGGQ

SEQ ID NO: 1151152 - protein, 4 aa, Mycobacterium
TGGR

SEQ ID NO: 1151153 - protein, 6 aa, Mycobacterium
TGGTGV

SEQ ID NO: 1151154 - protein, 6 aa, Mycobacterium
TGHEPV

SEQ ID NO: 1151155 - protein, 6 aa, Mycobacterium
TGHGNA

SEQ ID NO: 1151156 - protein, 4 aa, Mycobacterium
TGIP

SEQ ID NO: 1151157 - protein, 4 aa, Mycobacterium
TGLA

SEQ ID NO: 1151158 - protein, 4 aa, Mycobacterium
TGLD

SEQ ID NO: 1151159 - protein, 5 aa, Mycobacterium
TGLEQ

SEQ ID NO: 1151160 - protein, 4 aa, Mycobacterium
TGLP

SEQ ID NO: 1151161 - protein, 6 aa, Mycobacterium
TGLPAE

SEQ ID NO: 1151162 - protein, 9 aa, Mycobacterium
TGNNPKAKR

SEQ ID NO: 1151163 - protein, 5 aa, Mycobacterium
TGNTH

SEQ ID NO: 1151164 - protein, 44 aa, Mycobacterium
TGPADQLTVTDSTGRHLTSGSLARPPNHPPPTVAPYRGPSGERA

SEQ ID NO: 1151165 - protein, 8 aa, Mycobacterium
TGPGATSY

SEQ ID NO: 1151166 - protein, 11 aa, Mycobacterium
TGPGKGKSTAA

SEQ ID NO: 1151167 - protein, 12 aa, Mycobacterium
TGPTRPPYTEVP

SEQ ID NO: 1151168 - protein, 5 aa, Mycobacterium
TGQAK

SEQ ID NO: 1151169 - protein, 8 aa, Mycobacterium
TGRDAADT

SEQ ID NO: 1151170 - protein, 9 aa, Mycobacterium
TGREADDLT

SEQ ID NO: 1151171 - protein, 5 aa, Mycobacterium
TGRPA

SEQ ID NO: 1151172 - protein, 12 aa, Mycobacterium
TGRPAGSQKPEG

SEQ ID NO: 1151173 - protein, 5 aa, Mycobacterium
TGRPY

SEQ ID NO: 1151174 - protein, 8 aa, Mycobacterium
TGRQAESA

SEQ ID NO: 1151175 - protein, 4 aa, Mycobacterium
TGRR

SEQ ID NO: 1151176 - protein, 9 aa, Mycobacterium
TGRSDFPNQ

SEQ ID NO: 1151177 - protein, 5 aa, Mycobacterium
TGRVD

SEQ ID NO: 1151178 - protein, 7 aa, Mycobacterium
TGSATAA

SEQ ID NO: 1151179 - protein, 4 aa, Mycobacterium
TGSN

SEQ ID NO: 1151180 - protein, 8 aa, Mycobacterium
TGSTEVGK

SEQ ID NO: 1151181 - protein, 10 aa, Mycobacterium
TGSTPSQRYA

SEQ ID NO: 1151182 - protein, 5 aa, Mycobacterium
TGSVR

SEQ ID NO: 1151183 - protein, 9 aa, Mycobacterium
TGTAAGKRV

SEQ ID NO: 1151184 - protein, 9 aa, Mycobacterium
TGTASGKSL

SEQ ID NO: 1151185 - protein, 7 aa, Mycobacterium
TGTEEAE

SEQ ID NO: 1151186 - protein, 12 aa, Mycobacterium
TGTGNSLNAGHP

SEQ ID NO: 1151187 - protein, 11 aa, Mycobacterium
TGTGNSLNARH

SEQ ID NO: 1151188 - protein, 6 aa, Mycobacterium
TGTSTA

SEQ ID NO: 1151189 - protein, 8 aa, Mycobacterium
TGTTAVKP

SEQ ID NO: 1151190 - protein, 11 aa, Mycobacterium
TGVSGSGKSTL

SEQ ID NO: 1151191 - protein, 7 aa, Mycobacterium
TGYEGDW

SEQ ID NO: 1151192 - protein, 5 aa, Mycobacterium
TGYRA

SEQ ID NO: 1151193 - protein, 6 aa, Mycobacterium
THCGGQ

SEQ ID NO: 1151194 - protein, 5 aa, Mycobacterium
THDER

SEQ ID NO: 1151195 - protein, 11 aa, Mycobacterium
THDPTVADEAS

SEQ ID NO: 1151196 - protein, 11 aa, Mycobacterium
THDTKRGEDVR

SEQ ID NO: 1151197 - protein, 5 aa, Mycobacterium
THGAE

SEQ ID NO: 1151198 - protein, 10 aa, Mycobacterium
THGGRRGTGI

SEQ ID NO: 1151199 - protein, 8 aa, Mycobacterium
THGKTTTT

SEQ ID NO: 1151200 - protein, 5 aa, Mycobacterium
THGST

SEQ ID NO: 1151201 - protein, 4 aa, Mycobacterium
THRG

SEQ ID NO: 1151202 - protein, 9 aa, Mycobacterium
THSQTSGWS

SEQ ID NO: 1151203 - protein, 10 aa, Mycobacterium
TIGDEGDSQL

SEQ ID NO: 1151204 - protein, 5 aa, Mycobacterium
TIGSS

SEQ ID NO: 1151205 - protein, 6 aa, Mycobacterium
TINEEP

SEQ ID NO: 1151206 - protein, 7 aa, Mycobacterium
TIRTASR

SEQ ID NO: 1151207 - protein, 10 aa, Mycobacterium
TISERAGVAR

SEQ ID NO: 1151208 - protein, 9 aa, Mycobacterium
TKDADGNDT

SEQ ID NO: 1151209 - protein, 4 aa, Mycobacterium
TKDG

SEQ ID NO: 1151210 - protein, 9 aa, Mycobacterium
TKDGRISQR

SEQ ID NO: 1151211 - protein, 9 aa, Mycobacterium
TKDLTDDQV

SEQ ID NO: 1151212 - protein, 4 aa, Mycobacterium
TKGG

SEQ ID NO: 1151213 - protein, 5 aa, Mycobacterium
TKHAR

SEQ ID NO: 1151214 - protein, 7 aa, Mycobacterium
TKKAGND

SEQ ID NO: 1151215 - protein, 10 aa, Mycobacterium
TKMTPAPTKP

SEQ ID NO: 1151216 - protein, 9 aa, Mycobacterium
TKPGRQDDY

SEQ ID NO: 1151217 - protein, 8 aa, Mycobacterium
TLAGDDDE

SEQ ID NO: 1151218 - protein, 9 aa, Mycobacterium
TLDPPTHTN

SEQ ID NO: 1151219 - protein, 6 aa, Mycobacterium
TLGAER

SEQ ID NO: 1151220 - protein, 8 aa, Mycobacterium
TLGGPTSH

SEQ ID NO: 1151221 - protein, 8 aa, Mycobacterium
TLGPKGRN

SEQ ID NO: 1151222 - protein, 4 aa, Mycobacterium
TLNT

SEQ ID NO: 1151223 - protein, 8 aa, Mycobacterium
TLNTRDSI

SEQ ID NO: 1151224 - protein, 4 aa, Mycobacterium
TLPG

SEQ ID NO: 1151225 - protein, 9 aa, Mycobacterium
TLQDPPSDD

SEQ ID NO: 1151226 - protein, 8 aa, Mycobacterium
TLSGAPKV

SEQ ID NO: 1151227 - protein, 8 aa, Mycobacterium
TLTDSAEG

SEQ ID NO: 1151228 - protein, 6 aa, Mycobacterium
TLTGAQ

SEQ ID NO: 1151229 - protein, 4 aa, Mycobacterium
TLTP

SEQ ID NO: 1151230 - protein, 6 aa, Mycobacterium
TNADRP

SEQ ID NO: 1151231 - protein, 13 aa, Mycobacterium
TNADSASPGVSDA

SEQ ID NO: 1151232 - protein, 8 aa, Mycobacterium
TNAGKSSL

SEQ ID NO: 1151233 - protein, 5 aa, Mycobacterium
TNASR

SEQ ID NO: 1151234 - protein, 5 aa, Mycobacterium
TNATA

SEQ ID NO: 1151235 - protein, 10 aa, Mycobacterium
TNDGGAARRF

SEQ ID NO: 1151236 - protein, 6 aa, Mycobacterium
TNGNGV

SEQ ID NO: 1151237 - protein, 5 aa, Mycobacterium
TNGRI

SEQ ID NO: 1151238 - protein, 4 aa, Mycobacterium
TNHL

SEQ ID NO: 1151239 - protein, 6 aa, Mycobacterium
TNNLPD

SEQ ID NO: 1151240 - protein, 4 aa, Mycobacterium
TNPA

SEQ ID NO: 1151241 - protein, 9 aa, Mycobacterium
TNPEAKKHR

SEQ ID NO: 1151242 - protein, 9 aa, Mycobacterium
TNPGQGVPL

SEQ ID NO: 1151243 - protein, 7 aa, Mycobacterium
TNPGTIG

SEQ ID NO: 1151244 - protein, 5 aa, Mycobacterium
TNPPI

SEQ ID NO: 1151245 - protein, 7 aa, Mycobacterium
TNRGGRT

SEQ ID NO: 1151246 - protein, 6 aa, Mycobacterium
TNRPDL

SEQ ID NO: 1151247 - protein, 7 aa, Mycobacterium
TNRSDRV

SEQ ID NO: 1151248 - protein, 4 aa, Mycobacterium
TNRY

SEQ ID NO: 1151249 - protein, 8 aa, Mycobacterium
TNTDPNKV

SEQ ID NO: 1151250 - protein, 8 aa, Mycobacterium
TNTPEFGA

SEQ ID NO: 1151251 - protein, 10 aa, Mycobacterium
TPDASDSASF

SEQ ID NO: 1151252 - protein, 8 aa, Mycobacterium
TPDEKWGE

SEQ ID NO: 1151253 - protein, 6 aa, Mycobacterium
TPDSFY

SEQ ID NO: 1151254 - protein, 4 aa, Mycobacterium
TPDW

SEQ ID NO: 1151255 - protein, 7 aa, Mycobacterium
TPEERRA

SEQ ID NO: 1151256 - protein, 7 aa, Mycobacterium
TPEGPNI

SEQ ID NO: 1151257 - protein, 5 aa, Mycobacterium
TPEHQ

SEQ ID NO: 1151258 - protein, 4 aa, Mycobacterium
TPEQ

SEQ ID NO: 1151259 - protein, 4 aa, Mycobacterium
TPFP

SEQ ID NO: 1151260 - protein, 8 aa, Mycobacterium
TPGAGKTT

SEQ ID NO: 1151261 - protein, 5 aa, Mycobacterium
TPGCT

SEQ ID NO: 1151262 - protein, 5 aa, Mycobacterium
TPGFG

SEQ ID NO: 1151263 - protein, 12 aa, Mycobacterium
TPGHADFGGEVE

SEQ ID NO: 1151264 - protein, 7 aa, Mycobacterium
TPGHSPG

SEQ ID NO: 1151265 - protein, 7 aa, Mycobacterium
TPGYQAP

SEQ ID NO: 1151266 - protein, 5 aa, Mycobacterium
TPHEE

SEQ ID NO: 1151267 - protein, 5 aa, Mycobacterium
TPIPR

SEQ ID NO: 1151268 - protein, 4 aa, Mycobacterium
TPLD

SEQ ID NO: 1151269 - protein, 4 aa, Mycobacterium
TPLV

SEQ ID NO: 1151270 - protein, 6 aa, Mycobacterium
TPNMTD

SEQ ID NO: 1151271 - protein, 5 aa, Mycobacterium
TPPAA

SEQ ID NO: 1151272 - protein, 6 aa, Mycobacterium
TPPEER

SEQ ID NO: 1151273 - protein, 22 aa, Mycobacterium
TPPGTVGAVDGRGGAPGTRETD

SEQ ID NO: 1151274 - protein, 5 aa, Mycobacterium
TPQSY

SEQ ID NO: 1151275 - protein, 4 aa, Mycobacterium
TPRE

SEQ ID NO: 1151276 - protein, 5 aa, Mycobacterium
TPRIY

SEQ ID NO: 1151277 - protein, 4 aa, Mycobacterium
TPRR

SEQ ID NO: 1151278 - protein, 7 aa, Mycobacterium
TPSEFND

SEQ ID NO: 1151279 - protein, 14 aa, Mycobacterium
TPSIPTADQPGTAF

SEQ ID NO: 1151280 - protein, 7 aa, Mycobacterium
TPSRERV

SEQ ID NO: 1151281 - protein, 6 aa, Mycobacterium
TPSSKV

SEQ ID NO: 1151282 - protein, 4 aa, Mycobacterium
TPTK

SEQ ID NO: 1151283 - protein, 5 aa, Mycobacterium
TPTTV

SEQ ID NO: 1151284 - protein, 5 aa, Mycobacterium
TPVPG

SEQ ID NO: 1151285 - protein, 9 aa, Mycobacterium
TQAAAHPTA

SEQ ID NO: 1151286 - protein, 10 aa, Mycobacterium
TQAPSGAGYA

SEQ ID NO: 1151287 - protein, 15 aa, Mycobacterium
TQASVPPQGGRKHPH

SEQ ID NO: 1151288 - protein, 6 aa, Mycobacterium
TQDGRQ

SEQ ID NO: 1151289 - protein, 9 aa, Mycobacterium
TQDPPTDQI

SEQ ID NO: 1151290 - protein, 18 aa, Mycobacterium
TQDQNLQDGPHKDLRRAR

SEQ ID NO: 1151291 - protein, 4 aa, Mycobacterium
TQEE

SEQ ID NO: 1151292 - protein, 11 aa, Mycobacterium
TQGGGENNYER

SEQ ID NO: 1151293 - protein, 7 aa, Mycobacterium
TQGWNPD

SEQ ID NO: 1151294 - protein, 5 aa, Mycobacterium
TQHVD

SEQ ID NO: 1151295 - protein, 6 aa, Mycobacterium
TQNPEL

SEQ ID NO: 1151296 - protein, 16 aa, Mycobacterium
TQPHTSSGRVPTEKGY

SEQ ID NO: 1151297 - protein, 5 aa, Mycobacterium
TQQGV

SEQ ID NO: 1151298 - protein, 4 aa, Mycobacterium
TQSA

SEQ ID NO: 1151299 - protein, 5 aa, Mycobacterium
TQSVG

SEQ ID NO: 1151300 - protein, 6 aa, Mycobacterium
TQTPHE

SEQ ID NO: 1151301 - protein, 6 aa, Mycobacterium
TRDEFD

SEQ ID NO: 1151302 - protein, 12 aa, Mycobacterium
TRDEPHADADKY

SEQ ID NO: 1151303 - protein, 12 aa, Mycobacterium
TRDEPHADAEKY

SEQ ID NO: 1151304 - protein, 8 aa, Mycobacterium
TRDPDEHE

SEQ ID NO: 1151305 - protein, 5 aa, Mycobacterium
TRFPG

SEQ ID NO: 1151306 - protein, 8 aa, Mycobacterium
TRGAGLAS

SEQ ID NO: 1151307 - protein, 17 aa, Mycobacterium
TRGDGTTLTANGLDDPQ

SEQ ID NO: 1151308 - protein, 7 aa, Mycobacterium
TRGLGGQ

SEQ ID NO: 1151309 - protein, 4 aa, Mycobacterium
TRHS

SEQ ID NO: 1151310 - protein, 8 aa, Mycobacterium
TRHSTPGV

SEQ ID NO: 1151311 - protein, 7 aa, Mycobacterium
TRNGQSL

SEQ ID NO: 1151312 - protein, 9 aa, Mycobacterium
TRNPADAED

SEQ ID NO: 1151313 - protein, 7 aa, Mycobacterium
TRPDGSE

SEQ ID NO: 1151314 - protein, 5 aa, Mycobacterium
TRPPA

SEQ ID NO: 1151315 - protein, 4 aa, Mycobacterium
TRPR

SEQ ID NO: 1151316 - protein, 6 aa, Mycobacterium
TRPTIG

SEQ ID NO: 1151317 - protein, 6 aa, Mycobacterium
TRPTLR

SEQ ID NO: 1151318 - protein, 10 aa, Mycobacterium
TRQDNEEEGS

SEQ ID NO: 1151319 - protein, 5 aa, Mycobacterium
TRQLD

SEQ ID NO: 1151320 - protein, 9 aa, Mycobacterium
TRRAEARAI

SEQ ID NO: 1151321 - protein, 4 aa, Mycobacterium
TRRP

SEQ ID NO: 1151322 - protein, 17 aa, Mycobacterium
TRRPKSSPSKLSDEVKE

SEQ ID NO: 1151323 - protein, 5 aa, Mycobacterium
TRSEG

SEQ ID NO: 1151324 - protein, 8 aa, Mycobacterium
TRSGDVDP

SEQ ID NO: 1151325 - protein, 9 aa, Mycobacterium
TRSGGVARN

SEQ ID NO: 1151326 - protein, 6 aa, Mycobacterium
TRTDRI

SEQ ID NO: 1151327 - protein, 6 aa, Mycobacterium
TRTGAS

SEQ ID NO: 1151328 - protein, 8 aa, Mycobacterium
TRVEQRTD

SEQ ID NO: 1151329 - protein, 4 aa, Mycobacterium
TRVG

SEQ ID NO: 1151330 - protein, 10 aa, Mycobacterium
TRVGSGPFPT

SEQ ID NO: 1151331 - protein, 7 aa, Mycobacterium
TSADSDD

SEQ ID NO: 1151332 - protein, 4 aa, Mycobacterium
TSDG

SEQ ID NO: 1151333 - protein, 6 aa, Mycobacterium
TSDGGT

SEQ ID NO: 1151334 - protein, 4 aa, Mycobacterium
TSDP

SEQ ID NO: 1151335 - protein, 5 aa, Mycobacterium
TSDRR

SEQ ID NO: 1151336 - protein, 8 aa, Mycobacterium
TSEAHRRL

SEQ ID NO: 1151337 - protein, 7 aa, Mycobacterium
TSGEQRL

SEQ ID NO: 1151338 - protein, 9 aa, Mycobacterium
TSGGAIPDR

SEQ ID NO: 1151339 - protein, 15 aa, Mycobacterium
TSGGSQKAVNAEQRG

SEQ ID NO: 1151340 - protein, 7 aa, Mycobacterium
TSGGTSF

SEQ ID NO: 1151341 - protein, 7 aa, Mycobacterium
TSGLGEG

SEQ ID NO: 1151342 - protein, 8 aa, Mycobacterium
TSGPGATN

SEQ ID NO: 1151343 - protein, 12 aa, Mycobacterium
TSGTTGFPKGAT

SEQ ID NO: 1151344 - protein, 7 aa, Mycobacterium
TSHGSTL

SEQ ID NO: 1151345 - protein, 5 aa, Mycobacterium
TSIER

SEQ ID NO: 1151346 - protein, 9 aa, Mycobacterium
TSKAEPTAQ

SEQ ID NO: 1151347 - protein, 4 aa, Mycobacterium
TSLD

SEQ ID NO: 1151348 - protein, 9 aa, Mycobacterium
TSNAAAAGR

SEQ ID NO: 1151349 - protein, 10 aa, Mycobacterium
TSNRPQTTRH

SEQ ID NO: 1151350 - protein, 8 aa, Mycobacterium
TSPAGARY

SEQ ID NO: 1151351 - protein, 10 aa, Mycobacterium
TSPDEPKYDA

SEQ ID NO: 1151352 - protein, 6 aa, Mycobacterium
TSPEAT

SEQ ID NO: 1151353 - protein, 4 aa, Mycobacterium
TSPV

SEQ ID NO: 1151354 - protein, 6 aa, Mycobacterium
TSPWPE

SEQ ID NO: 1151355 - protein, 8 aa, Mycobacterium
TSRDLTEN

SEQ ID NO: 1151356 - protein, 8 aa, Mycobacterium
TSSAEEDI

SEQ ID NO: 1151357 - protein, 6 aa, Mycobacterium
TSSANL

SEQ ID NO: 1151358 - protein, 23 aa, Mycobacterium
TSSEAGLSGPVGQPNYGAAKAGI

SEQ ID NO: 1151359 - protein, 9 aa, Mycobacterium
TSSRAPLGR

SEQ ID NO: 1151360 - protein, 8 aa, Mycobacterium
TSTADANI

SEQ ID NO: 1151361 - protein, 7 aa, Mycobacterium
TSTGNKD

SEQ ID NO: 1151362 - protein, 12 aa, Mycobacterium
TSTRDDRVHPGH

SEQ ID NO: 1151363 - protein, 5 aa, Mycobacterium
TSTSG

SEQ ID NO: 1151364 - protein, 6 aa, Mycobacterium
TSTTKS

SEQ ID NO: 1151365 - protein, 5 aa, Mycobacterium
TSYAQ

SEQ ID NO: 1151366 - protein, 4 aa, Mycobacterium
TSYR

SEQ ID NO: 1151367 - protein, 5 aa, Mycobacterium
TTAAD

SEQ ID NO: 1151368 - protein, 5 aa, Mycobacterium
TTAGI

SEQ ID NO: 1151369 - protein, 6 aa, Mycobacterium
TTAPAN

SEQ ID NO: 1151370 - protein, 8 aa, Mycobacterium
TTDRPTQV

SEQ ID NO: 1151371 - protein, 6 aa, Mycobacterium
TTDTGS

SEQ ID NO: 1151372 - protein, 7 aa, Mycobacterium
TTEAAEG

SEQ ID NO: 1151373 - protein, 7 aa, Mycobacterium
TTENPSF

SEQ ID NO: 1151374 - protein, 9 aa, Mycobacterium
TTENSHDVE

SEQ ID NO: 1151375 - protein, 6 aa, Mycobacterium
TTGTSV

SEQ ID NO: 1151376 - protein, 5 aa, Mycobacterium
TTGYG

SEQ ID NO: 1151377 - protein, 8 aa, Mycobacterium
TTGYGSAV

SEQ ID NO: 1151378 - protein, 25 aa, Mycobacterium
TTHRPGNGRTQWTPPADHDTGQPRI

SEQ ID NO: 1151379 - protein, 10 aa, Mycobacterium
TTLSGGERQR

SEQ ID NO: 1151380 - protein, 6 aa, Mycobacterium
TTPEDY

SEQ ID NO: 1151381 - protein, 6 aa, Mycobacterium
TTQQAE

SEQ ID NO: 1151382 - protein, 4 aa, Mycobacterium
TTRD

SEQ ID NO: 1151383 - protein, 4 aa, Mycobacterium
TTST

SEQ ID NO: 1151384 - protein, 4 aa, Mycobacterium
TTTG

SEQ ID NO: 1151385 - protein, 5 aa, Mycobacterium
TTTGD

SEQ ID NO: 1151386 - protein, 11 aa, Mycobacterium
TTTPKKPNSAL

SEQ ID NO: 1151387 - protein, 4 aa, Mycobacterium
TTVD

SEQ ID NO: 1151388 - protein, 4 aa, Mycobacterium
TTVR

SEQ ID NO: 1151389 - protein, 11 aa, Mycobacterium
TVDDAAGEAYD

SEQ ID NO: 1151390 - protein, 9 aa, Mycobacterium
TVDGSGTTI

SEQ ID NO: 1151391 - protein, 5 aa, Mycobacterium
TVDRA

SEQ ID NO: 1151392 - protein, 7 aa, Mycobacterium
TVGRRKE

SEQ ID NO: 1151393 - protein, 6 aa, Mycobacterium
TVNQGA

SEQ ID NO: 1151394 - protein, 5 aa, Mycobacterium
TVPEH

SEQ ID NO: 1151395 - protein, 4 aa, Mycobacterium
TVPP

SEQ ID NO: 1151396 - protein, 7 aa, Mycobacterium
TVRPPEE

SEQ ID NO: 1151397 - protein, 4 aa, Mycobacterium
TWRT

SEQ ID NO: 1151398 - protein, 4 aa, Mycobacterium
TWSG

SEQ ID NO: 1151399 - protein, 4 aa, Mycobacterium
TYAG

SEQ ID NO: 1151400 - protein, 5 aa, Mycobacterium
TYASS

SEQ ID NO: 1151401 - protein, 11 aa, Mycobacterium
TYPGPGGTIGP

SEQ ID NO: 1151402 - protein, 5 aa, Mycobacterium
TYPGT

SEQ ID NO: 1151403 - protein, 12 aa, Mycobacterium
TYRGPATPGSAA

SEQ ID NO: 1151404 - protein, 6 aa, Mycobacterium
TYSPTG

SEQ ID NO: 1151405 - protein, 5 aa, Mycobacterium
TYSTN

SEQ ID NO: 1151406 - protein, 4 aa, Mycobacterium
TYTT

SEQ ID NO: 1151407 - protein, 4 aa, Mycobacterium
VAAG

SEQ ID NO: 1151408 - protein, 10 aa, Mycobacterium
VADDPKKRRK

SEQ ID NO: 1151409 - protein, 7 aa, Mycobacterium
VADDPRE

SEQ ID NO: 1151410 - protein, 5 aa, Mycobacterium
VAEGA

SEQ ID NO: 1151411 - protein, 5 aa, Mycobacterium
VAERA

SEQ ID NO: 1151412 - protein, 4 aa, Mycobacterium
VAET

SEQ ID NO: 1151413 - protein, 7 aa, Mycobacterium
VAGDANP

SEQ ID NO: 1151414 - protein, 8 aa, Mycobacterium
VAGEETAA

SEQ ID NO: 1151415 - protein, 10 aa, Mycobacterium
VAGESAKFGI

SEQ ID NO: 1151416 - protein, 11 aa, Mycobacterium
VAGSGKSSLID

SEQ ID NO: 1151417 - protein, 7 aa, Mycobacterium
VAKATRE

SEQ ID NO: 1151418 - protein, 4 aa, Mycobacterium
VAPG

SEQ ID NO: 1151419 - protein, 9 aa, Mycobacterium
VAPGGTLNT

SEQ ID NO: 1151420 - protein, 8 aa, Mycobacterium
VAPGGTVT

SEQ ID NO: 1151421 - protein, 4 aa, Mycobacterium
VAPT

SEQ ID NO: 1151422 - protein, 5 aa, Mycobacterium
VAQPG

SEQ ID NO: 1151423 - protein, 11 aa, Mycobacterium
VARNPRTGETV

SEQ ID NO: 1151424 - protein, 9 aa, Mycobacterium
VASGNGKGQ

SEQ ID NO: 1151425 - protein, 7 aa, Mycobacterium
VATAESL

SEQ ID NO: 1151426 - protein, 6 aa, Mycobacterium
VATPDG

SEQ ID NO: 1151427 - protein, 7 aa, Mycobacterium
VATQDTV

SEQ ID NO: 1151428 - protein, 5 aa, Mycobacterium
VDADE

SEQ ID NO: 1151429 - protein, 6 aa, Mycobacterium
VDADGG

SEQ ID NO: 1151430 - protein, 8 aa, Mycobacterium
VDAGAQDA

SEQ ID NO: 1151431 - protein, 6 aa, Mycobacterium
VDAGGR

SEQ ID NO: 1151432 - protein, 11 aa, Mycobacterium
VDDEITTTAGP

SEQ ID NO: 1151433 - protein, 18 aa, Mycobacterium
VDDGSGETDEDQKLRNES

SEQ ID NO: 1151434 - protein, 10 aa, Mycobacterium
VDDQGRRYSA

SEQ ID NO: 1151435 - protein, 7 aa, Mycobacterium
VDEPNAR

SEQ ID NO: 1151436 - protein, 8 aa, Mycobacterium
VDEYADPK

SEQ ID NO: 1151437 - protein, 6 aa, Mycobacterium
VDGAEV

SEQ ID NO: 1151438 - protein, 6 aa, Mycobacterium
VDGDRT

SEQ ID NO: 1151439 - protein, 5 aa, Mycobacterium
VDGQH

SEQ ID NO: 1151440 - protein, 5 aa, Mycobacterium
VDNGH

SEQ ID NO: 1151441 - protein, 8 aa, Mycobacterium
VDPDSEIA

SEQ ID NO: 1151442 - protein, 8 aa, Mycobacterium
VDPDSQVA

SEQ ID NO: 1151443 - protein, 6 aa, Mycobacterium
VDPEAA

SEQ ID NO: 1151444 - protein, 7 aa, Mycobacterium
VDPEARH

SEQ ID NO: 1151445 - protein, 5 aa, Mycobacterium
VDPED

SEQ ID NO: 1151446 - protein, 4 aa, Mycobacterium
VDPL

SEQ ID NO: 1151447 - protein, 5 aa, Mycobacterium
VDPNE

SEQ ID NO: 1151448 - protein, 6 aa, Mycobacterium
VDRPGT

SEQ ID NO: 1151449 - protein, 13 aa, Mycobacterium
VDSRETDEGQAIR

SEQ ID NO: 1151450 - protein, 7 aa, Mycobacterium
VDTPAEV

SEQ ID NO: 1151451 - protein, 5 aa, Mycobacterium
VDTPI

SEQ ID NO: 1151452 - protein, 17 aa, Mycobacterium
VDTSGGNGGGADGGGSL

SEQ ID NO: 1151453 - protein, 8 aa, Mycobacterium
VDTTGAGD

SEQ ID NO: 1151454 - protein, 5 aa, Mycobacterium
VDYSG

SEQ ID NO: 1151455 - protein, 5 aa, Mycobacterium
VEAEG

SEQ ID NO: 1151456 - protein, 5 aa, Mycobacterium
VEAGE

SEQ ID NO: 1151457 - protein, 6 aa, Mycobacterium
VEDTGY

SEQ ID NO: 1151458 - protein, 4 aa, Mycobacterium
VEEG

SEQ ID NO: 1151459 - protein, 6 aa, Mycobacterium
VEGGEN

SEQ ID NO: 1151460 - protein, 8 aa, Mycobacterium
VEGNTDAG

SEQ ID NO: 1151461 - protein, 6 aa, Mycobacterium
VEGSGG

SEQ ID NO: 1151462 - protein, 4 aa, Mycobacterium
VEGT

SEQ ID NO: 1151463 - protein, 5 aa, Mycobacterium
VEIPN

SEQ ID NO: 1151464 - protein, 5 aa, Mycobacterium
VEKAG

SEQ ID NO: 1151465 - protein, 9 aa, Mycobacterium
VEKDPENPQ

SEQ ID NO: 1151466 - protein, 8 aa, Mycobacterium
VEKGETQG

SEQ ID NO: 1151467 - protein, 9 aa, Mycobacterium
VENPVPPWK

SEQ ID NO: 1151468 - protein, 8 aa, Mycobacterium
VEPAPRRA

SEQ ID NO: 1151469 - protein, 10 aa, Mycobacterium
VEPPRSPAQM

SEQ ID NO: 1151470 - protein, 4 aa, Mycobacterium
VEQG

SEQ ID NO: 1151471 - protein, 11 aa, Mycobacterium
VERGRKEASSE

SEQ ID NO: 1151472 - protein, 5 aa, Mycobacterium
VERPA

SEQ ID NO: 1151473 - protein, 15 aa, Mycobacterium
VESGANADIKPGNNL

SEQ ID NO: 1151474 - protein, 5 aa, Mycobacterium
VESQD

SEQ ID NO: 1151475 - protein, 5 aa, Mycobacterium
VGADN

SEQ ID NO: 1151476 - protein, 4 aa, Mycobacterium
VGAE

SEQ ID NO: 1151477 - protein, 6 aa, Mycobacterium
VGANPG

SEQ ID NO: 1151478 - protein, 4 aa, Mycobacterium
VGAT

SEQ ID NO: 1151479 - protein, 4 aa, Mycobacterium
VGDD

SEQ ID NO: 1151480 - protein, 9 aa, Mycobacterium
VGDDKDKAA

SEQ ID NO: 1151481 - protein, 5 aa, Mycobacterium
VGDPK

SEQ ID NO: 1151482 - protein, 11 aa, Mycobacterium
VGEADGPRAGL

SEQ ID NO: 1151483 - protein, 7 aa, Mycobacterium
VGEDQRQ

SEQ ID NO: 1151484 - protein, 7 aa, Mycobacterium
VGEGDID

SEQ ID NO: 1151485 - protein, 4 aa, Mycobacterium
VGEP

SEQ ID NO: 1151486 - protein, 7 aa, Mycobacterium
VGERTDE

SEQ ID NO: 1151487 - protein, 7 aa, Mycobacterium
VGESTDV

SEQ ID NO: 1151488 - protein, 6 aa, Mycobacterium
VGGAAD

SEQ ID NO: 1151489 - protein, 11 aa, Mycobacterium
VGGEPDAPMKY

SEQ ID NO: 1151490 - protein, 6 aa, Mycobacterium
VGGGTD

SEQ ID NO: 1151491 - protein, 4 aa, Mycobacterium
VGGI

SEQ ID NO: 1151492 - protein, 14 aa, Mycobacterium
VGGKTGINTDAGKN

SEQ ID NO: 1151493 - protein, 5 aa, Mycobacterium
VGGQE

SEQ ID NO: 1151494 - protein, 8 aa, Mycobacterium
VGGSEDIG

SEQ ID NO: 1151495 - protein, 7 aa, Mycobacterium
VGGVTET

SEQ ID NO: 1151496 - protein, 14 aa, Mycobacterium
VGNGPKELKDSADR

SEQ ID NO: 1151497 - protein, 7 aa, Mycobacterium
VGNGVGD

SEQ ID NO: 1151498 - protein, 4 aa, Mycobacterium
VGNP

SEQ ID NO: 1151499 - protein, 5 aa, Mycobacterium
VGPDA

SEQ ID NO: 1151500 - protein, 8 aa, Mycobacterium
VGPEGKPL

SEQ ID NO: 1151501 - protein, 6 aa, Mycobacterium
VGPGGY

SEQ ID NO: 1151502 - protein, 11 aa, Mycobacterium
VGPGRGSAAGS

SEQ ID NO: 1151503 - protein, 10 aa, Mycobacterium
VGPNGAGKSS

SEQ ID NO: 1151504 - protein, 29 aa, Mycobacterium
VGRDSTRGLGAGADPEVGRKAAEDAKDDI

SEQ ID NO: 1151505 - protein, 8 aa, Mycobacterium
VGRGGDDT

SEQ ID NO: 1151506 - protein, 6 aa, Mycobacterium
VGRPRP

SEQ ID NO: 1151507 - protein, 8 aa, Mycobacterium
VGRSRERG

SEQ ID NO: 1151508 - protein, 9 aa, Mycobacterium
VGSDEEAPL

SEQ ID NO: 1151509 - protein, 6 aa, Mycobacterium
VGSEDA

SEQ ID NO: 1151510 - protein, 8 aa, Mycobacterium
VGSEEADK

SEQ ID NO: 1151511 - protein, 7 aa, Mycobacterium
VGSEQAY

SEQ ID NO: 1151512 - protein, 10 aa, Mycobacterium
VGSGPAGLAA

SEQ ID NO: 1151513 - protein, 10 aa, Mycobacterium
VGSQSPAVGQ

SEQ ID NO: 1151514 - protein, 9 aa, Mycobacterium
VGSSETGAQ

SEQ ID NO: 1151515 - protein, 13 aa, Mycobacterium
VGTTNRPGARFGP

SEQ ID NO: 1151516 - protein, 6 aa, Mycobacterium
VKAARK

SEQ ID NO: 1151517 - protein, 22 aa, Mycobacterium
VKEDPTLAYGPGRGAIGSPDTV

SEQ ID NO: 1151518 - protein, 7 aa, Mycobacterium
VKEETGL

SEQ ID NO: 1151519 - protein, 8 aa, Mycobacterium
VKEGPAAL

SEQ ID NO: 1151520 - protein, 9 aa, Mycobacterium
VKEPKPSKL

SEQ ID NO: 1151521 - protein, 8 aa, Mycobacterium
VKESNPYN

SEQ ID NO: 1151522 - protein, 5 aa, Mycobacterium
VKGGR

SEQ ID NO: 1151523 - protein, 8 aa, Mycobacterium
VKGRGGAG

SEQ ID NO: 1151524 - protein, 11 aa, Mycobacterium
VKGVTEETTTG

SEQ ID NO: 1151525 - protein, 7 aa, Mycobacterium
VKIPDED

SEQ ID NO: 1151526 - protein, 7 aa, Mycobacterium
VKKDDKV

SEQ ID NO: 1151527 - protein, 13 aa, Mycobacterium
VKNAQEAHEAIRP

SEQ ID NO: 1151528 - protein, 6 aa, Mycobacterium
VKPGRA

SEQ ID NO: 1151529 - protein, 6 aa, Mycobacterium
VKRAET

SEQ ID NO: 1151530 - protein, 9 aa, Mycobacterium
VKRPRGEGQ

SEQ ID NO: 1151531 - protein, 5 aa, Mycobacterium
VKRRD

SEQ ID NO: 1151532 - protein, 10 aa, Mycobacterium
VLGTKKAEAM

SEQ ID NO: 1151533 - protein, 8 aa, Mycobacterium
VMGGTSQI

SEQ ID NO: 1151534 - protein, 6 aa, Mycobacterium
VNAKNV

SEQ ID NO: 1151535 - protein, 8 aa, Mycobacterium
VNEGYEDM

SEQ ID NO: 1151536 - protein, 22 aa, Mycobacterium
VNGRGGGKADLAQGSGKGAAGI

SEQ ID NO: 1151537 - protein, 4 aa, Mycobacterium
VNGT

SEQ ID NO: 1151538 - protein, 13 aa, Mycobacterium
VNMSQSSNDTFPT

SEQ ID NO: 1151539 - protein, 15 aa, Mycobacterium
VNPDPDTWDEAADRV

SEQ ID NO: 1151540 - protein, 7 aa, Mycobacterium
VNQSSTA

SEQ ID NO: 1151541 - protein, 4 aa, Mycobacterium
VNQT

SEQ ID NO: 1151542 - protein, 5 aa, Mycobacterium
VNSGY

SEQ ID NO: 1151543 - protein, 6 aa, Mycobacterium
VPAAAQ

SEQ ID NO: 1151544 - protein, 7 aa, Mycobacterium
VPAHNPR

SEQ ID NO: 1151545 - protein, 15 aa, Mycobacterium
VPANVSKEIIAKATG

SEQ ID NO: 1151546 - protein, 9 aa, Mycobacterium
VPAPESTHA

SEQ ID NO: 1151547 - protein, 9 aa, Mycobacterium
VPAPGGRRE

SEQ ID NO: 1151548 - protein, 4 aa, Mycobacterium
VPDG

SEQ ID NO: 1151549 - protein, 5 aa, Mycobacterium
VPDPH

SEQ ID NO: 1151550 - protein, 4 aa, Mycobacterium
VPDQ

SEQ ID NO: 1151551 - protein, 4 aa, Mycobacterium
VPDR

SEQ ID NO: 1151552 - protein, 9 aa, Mycobacterium
VPDSGEVDE

SEQ ID NO: 1151553 - protein, 4 aa, Mycobacterium
VPED

SEQ ID NO: 1151554 - protein, 5 aa, Mycobacterium
VPEEV

SEQ ID NO: 1151555 - protein, 6 aa, Mycobacterium
VPETLK

SEQ ID NO: 1151556 - protein, 4 aa, Mycobacterium
VPGA

SEQ ID NO: 1151557 - protein, 5 aa, Mycobacterium
VPGAC

SEQ ID NO: 1151558 - protein, 7 aa, Mycobacterium
VPGFRGP

SEQ ID NO: 1151559 - protein, 8 aa, Mycobacterium
VPGGDITP

SEQ ID NO: 1151560 - protein, 5 aa, Mycobacterium
VPGGR

SEQ ID NO: 1151561 - protein, 6 aa, Mycobacterium
VPGGSA

SEQ ID NO: 1151562 - protein, 5 aa, Mycobacterium
VPGKP

SEQ ID NO: 1151563 - protein, 5 aa, Mycobacterium
VPGPS

SEQ ID NO: 1151564 - protein, 4 aa, Mycobacterium
VPGV

SEQ ID NO: 1151565 - protein, 8 aa, Mycobacterium
VPHGESGK

SEQ ID NO: 1151566 - protein, 9 aa, Mycobacterium
VPKGTSDGR

SEQ ID NO: 1151567 - protein, 6 aa, Mycobacterium
VPLPTE

SEQ ID NO: 1151568 - protein, 8 aa, Mycobacterium
VPNDGKGA

SEQ ID NO: 1151569 - protein, 10 aa, Mycobacterium
VPPDAGPELE

SEQ ID NO: 1151570 - protein, 5 aa, Mycobacterium
VPPGR

SEQ ID NO: 1151571 - protein, 13 aa, Mycobacterium
VPPGTEGLSYTGN

SEQ ID NO: 1151572 - protein, 6 aa, Mycobacterium
VPPGVD

SEQ ID NO: 1151573 - protein, 5 aa, Mycobacterium
VPPIN

SEQ ID NO: 1151574 - protein, 4 aa, Mycobacterium
VPPT

SEQ ID NO: 1151575 - protein, 6 aa, Mycobacterium
VPQPLS

SEQ ID NO: 1151576 - protein, 11 aa, Mycobacterium
VPQPPSKSLED

SEQ ID NO: 1151577 - protein, 10 aa, Mycobacterium
VPQTEALATA

SEQ ID NO: 1151578 - protein, 4 aa, Mycobacterium
VPRP

SEQ ID NO: 1151579 - protein, 8 aa, Mycobacterium
VPSLDPRD

SEQ ID NO: 1151580 - protein, 5 aa, Mycobacterium
VPSTA

SEQ ID NO: 1151581 - protein, 11 aa, Mycobacterium
VPTDDSSLGAL

SEQ ID NO: 1151582 - protein, 9 aa, Mycobacterium
VPTGEQSSL

SEQ ID NO: 1151583 - protein, 10 aa, Mycobacterium
VPTGGDDPTK

SEQ ID NO: 1151584 - protein, 4 aa, Mycobacterium
VPWP

SEQ ID NO: 1151585 - protein, 5 aa, Mycobacterium
VQDGK

SEQ ID NO: 1151586 - protein, 4 aa, Mycobacterium
VQDQ

SEQ ID NO: 1151587 - protein, 10 aa, Mycobacterium
VQPTEEARAA

SEQ ID NO: 1151588 - protein, 7 aa, Mycobacterium
VQTADGA

SEQ ID NO: 1151589 - protein, 5 aa, Mycobacterium
VQWGP

SEQ ID NO: 1151590 - protein, 8 aa, Mycobacterium
VRAESAKR

SEQ ID NO: 1151591 - protein, 10 aa, Mycobacterium
VRDEAEIRGH

SEQ ID NO: 1151592 - protein, 6 aa, Mycobacterium
VRGADG

SEQ ID NO: 1151593 - protein, 7 aa, Mycobacterium
VRGGGGS

SEQ ID NO: 1151594 - protein, 6 aa, Mycobacterium
VRGNTQ

SEQ ID NO: 1151595 - protein, 10 aa, Mycobacterium
VRGPSGTRLE

SEQ ID NO: 1151596 - protein, 26 aa, Mycobacterium
VRGQRTKTNARTRKGPKRTIAGKKKA

SEQ ID NO: 1151597 - protein, 7 aa, Mycobacterium
VRGREDG

SEQ ID NO: 1151598 - protein, 4 aa, Mycobacterium
VRGY

SEQ ID NO: 1151599 - protein, 5 aa, Mycobacterium
VRHPR

SEQ ID NO: 1151600 - protein, 4 aa, Mycobacterium
VRIG

SEQ ID NO: 1151601 - protein, 8 aa, Mycobacterium
VRNTPGVT

SEQ ID NO: 1151602 - protein, 4 aa, Mycobacterium
VRPE

SEQ ID NO: 1151603 - protein, 14 aa, Mycobacterium
VRPHEPAYDPEPDA

SEQ ID NO: 1151604 - protein, 12 aa, Mycobacterium
VRRGAPSANARW

SEQ ID NO: 1151605 - protein, 4 aa, Mycobacterium
VRSE

SEQ ID NO: 1151606 - protein, 4 aa, Mycobacterium
VRSG

SEQ ID NO: 1151607 - protein, 4 aa, Mycobacterium
VRTD

SEQ ID NO: 1151608 - protein, 4 aa, Mycobacterium
VRTE

SEQ ID NO: 1151609 - protein, 9 aa, Mycobacterium
VRTTDRTGV

SEQ ID NO: 1151610 - protein, 10 aa, Mycobacterium
VRYDRDGDQH

SEQ ID NO: 1151611 - protein, 8 aa, Mycobacterium
VSAEAAAT

SEQ ID NO: 1151612 - protein, 6 aa, Mycobacterium
VSANTT

SEQ ID NO: 1151613 - protein, 18 aa, Mycobacterium
VSATTTDGLGLTGRGEGL

SEQ ID NO: 1151614 - protein, 7 aa, Mycobacterium
VSDIKGG

SEQ ID NO: 1151615 - protein, 6 aa, Mycobacterium
VSDLPR

SEQ ID NO: 1151616 - protein, 7 aa, Mycobacterium
VSEAPGY

SEQ ID NO: 1151617 - protein, 4 aa, Mycobacterium
VSEE

SEQ ID NO: 1151618 - protein, 6 aa, Mycobacterium
VSELPD

SEQ ID NO: 1151619 - protein, 4 aa, Mycobacterium
VSGA

SEQ ID NO: 1151620 - protein, 4 aa, Mycobacterium
VSGD

SEQ ID NO: 1151621 - protein, 7 aa, Mycobacterium
VSGDRSV

SEQ ID NO: 1151622 - protein, 4 aa, Mycobacterium
VSGG

SEQ ID NO: 1151623 - protein, 5 aa, Mycobacterium
VSGGR

SEQ ID NO: 1151624 - protein, 10 aa, Mycobacterium
VSGGRADPDM

SEQ ID NO: 1151625 - protein, 16 aa, Mycobacterium
VSGITDPTHERYKEAA

SEQ ID NO: 1151626 - protein, 5 aa, Mycobacterium
VSGRE

SEQ ID NO: 1151627 - protein, 8 aa, Mycobacterium
VSGSGKSS

SEQ ID NO: 1151628 - protein, 6 aa, Mycobacterium
VSKVSE

SEQ ID NO: 1151629 - protein, 5 aa, Mycobacterium
VSNDI

SEQ ID NO: 1151630 - protein, 6 aa, Mycobacterium
VSPNPD

SEQ ID NO: 1151631 - protein, 10 aa, Mycobacterium
VSPNPGGVGP

SEQ ID NO: 1151632 - protein, 7 aa, Mycobacterium
VSPSMGD

SEQ ID NO: 1151633 - protein, 6 aa, Mycobacterium
VSRGAT

SEQ ID NO: 1151634 - protein, 6 aa, Mycobacterium
VSSPGY

SEQ ID NO: 1151635 - protein, 7 aa, Mycobacterium
VSTPGDL

SEQ ID NO: 1151636 - protein, 4 aa, Mycobacterium
VTAA

SEQ ID NO: 1151637 - protein, 5 aa, Mycobacterium
VTAGE

SEQ ID NO: 1151638 - protein, 8 aa, Mycobacterium
VTASDRQR

SEQ ID NO: 1151639 - protein, 9 aa, Mycobacterium
VTCSPDNTL

SEQ ID NO: 1151640 - protein, 10 aa, Mycobacterium
VTDAANADER

SEQ ID NO: 1151641 - protein, 5 aa, Mycobacterium
VTDGD

SEQ ID NO: 1151642 - protein, 7 aa, Mycobacterium
VTEETSG

SEQ ID NO: 1151643 - protein, 7 aa, Mycobacterium
VTEGHPD

SEQ ID NO: 1151644 - protein, 11 aa, Mycobacterium
VTESQGRVHTS

SEQ ID NO: 1151645 - protein, 5 aa, Mycobacterium
VTGAA

SEQ ID NO: 1151646 - protein, 4 aa, Mycobacterium
VTGG

SEQ ID NO: 1151647 - protein, 7 aa, Mycobacterium
VTGGRIP

SEQ ID NO: 1151648 - protein, 9 aa, Mycobacterium
VTGGSPHAI

SEQ ID NO: 1151649 - protein, 9 aa, Mycobacterium
VTGGTRGIG

SEQ ID NO: 1151650 - protein, 4 aa, Mycobacterium
VTGH

SEQ ID NO: 1151651 - protein, 12 aa, Mycobacterium
VTGNSMKRAGAG

SEQ ID NO: 1151652 - protein, 7 aa, Mycobacterium
VTGPDEY

SEQ ID NO: 1151653 - protein, 10 aa, Mycobacterium
VTGSGAPTAG

SEQ ID NO: 1151654 - protein, 19 aa, Mycobacterium
VTGSGRVGIGPSGDEPGFQ

SEQ ID NO: 1151655 - protein, 13 aa, Mycobacterium
VTGTSKGKGFAGT

SEQ ID NO: 1151656 - protein, 7 aa, Mycobacterium
VTKPYSA

SEQ ID NO: 1151657 - protein, 7 aa, Mycobacterium
VTNPKGE

SEQ ID NO: 1151658 - protein, 9 aa, Mycobacterium
VTNPSGGLL

SEQ ID NO: 1151659 - protein, 9 aa, Mycobacterium
VTPAHDPND

SEQ ID NO: 1151660 - protein, 5 aa, Mycobacterium
VTPEM

SEQ ID NO: 1151661 - protein, 10 aa, Mycobacterium
VTPERTASGY

SEQ ID NO: 1151662 - protein, 6 aa, Mycobacterium
VTPGQR

SEQ ID NO: 1151663 - protein, 13 aa, Mycobacterium
VTPKGETELTPEE

SEQ ID NO: 1151664 - protein, 6 aa, Mycobacterium
VTPYGG

SEQ ID NO: 1151665 - protein, 7 aa, Mycobacterium
VTRQGEQ

SEQ ID NO: 1151666 - protein, 7 aa, Mycobacterium
VTSGGGA

SEQ ID NO: 1151667 - protein, 10 aa, Mycobacterium
VTSRGYPPSI

SEQ ID NO: 1151668 - protein, 6 aa, Mycobacterium
VTTETV

SEQ ID NO: 1151669 - protein, 7 aa, Mycobacterium
VTTSNDR

SEQ ID NO: 1151670 - protein, 4 aa, Mycobacterium
VTTT

SEQ ID NO: 1151671 - protein, 4 aa, Mycobacterium
VTVE

SEQ ID NO: 1151672 - protein, 5 aa, Mycobacterium
VWTTD

SEQ ID NO: 1151673 - protein, 7 aa, Mycobacterium
WAPNGAN

SEQ ID NO: 1151674 - protein, 10 aa, Mycobacterium
WAPPYAEAGA

SEQ ID NO: 1151675 - protein, 13 aa, Mycobacterium
WAQSAAEREPGVA

SEQ ID NO: 1151676 - protein, 7 aa, Mycobacterium
WDPPEEK

SEQ ID NO: 1151677 - protein, 9 aa, Mycobacterium
WDSQGRDSH

SEQ ID NO: 1151678 - protein, 10 aa, Mycobacterium
WGGPTVTNDG

SEQ ID NO: 1151679 - protein, 7 aa, Mycobacterium
WGPPPGE

SEQ ID NO: 1151680 - protein, 7 aa, Mycobacterium
WGTTPAA

SEQ ID NO: 1151681 - protein, 7 aa, Mycobacterium
WKRSTEE

SEQ ID NO: 1151682 - protein, 9 aa, Mycobacterium
WNEEESGAY

SEQ ID NO: 1151683 - protein, 9 aa, Mycobacterium
WPDNANLDK

SEQ ID NO: 1151684 - protein, 11 aa, Mycobacterium
WPHPEGLAEPT

SEQ ID NO: 1151685 - protein, 4 aa, Mycobacterium
WPPQ

SEQ ID NO: 1151686 - protein, 6 aa, Mycobacterium
WPTGSG

SEQ ID NO: 1151687 - protein, 12 aa, Mycobacterium
WQRDPKQLGRLG

SEQ ID NO: 1151688 - protein, 9 aa, Mycobacterium
WRGDTEEED

SEQ ID NO: 1151689 - protein, 8 aa, Mycobacterium
WSDGSAPI

SEQ ID NO: 1151690 - protein, 4 aa, Mycobacterium
WSPT

SEQ ID NO: 1151691 - protein, 7 aa, Mycobacterium
WTNRPGT

SEQ ID NO: 1151692 - protein, 9 aa, Mycobacterium
YAAESEAGR

SEQ ID NO: 1151693 - protein, 8 aa, Mycobacterium
YAAGEASV

SEQ ID NO: 1151694 - protein, 8 aa, Mycobacterium
YAEEAGIK

SEQ ID NO: 1151695 - protein, 10 aa, Mycobacterium
YAGAGATIGP

SEQ ID NO: 1151696 - protein, 9 aa, Mycobacterium
YAGDSGRTV

SEQ ID NO: 1151697 - protein, 5 aa, Mycobacterium
YAGDT

SEQ ID NO: 1151698 - protein, 4 aa, Mycobacterium
YAGG

SEQ ID NO: 1151699 - protein, 6 aa, Mycobacterium
YAGPRR

SEQ ID NO: 1151700 - protein, 5 aa, Mycobacterium
YAGTP

SEQ ID NO: 1151701 - protein, 5 aa, Mycobacterium
YAHPA

SEQ ID NO: 1151702 - protein, 22 aa, Mycobacterium
YAKDKKLLKDKDPNLTGDDIRE

SEQ ID NO: 1151703 - protein, 5 aa, Mycobacterium
YARSG

SEQ ID NO: 1151704 - protein, 4 aa, Mycobacterium
YASR

SEQ ID NO: 1151705 - protein, 5 aa, Mycobacterium
YATGT

SEQ ID NO: 1151706 - protein, 8 aa, Mycobacterium
YDEAENDD

SEQ ID NO: 1151707 - protein, 5 aa, Mycobacterium
YDEPK

SEQ ID NO: 1151708 - protein, 12 aa, Mycobacterium
YDPHPAIKAPVA

SEQ ID NO: 1151709 - protein, 7 aa, Mycobacterium
YDPNRTA

SEQ ID NO: 1151710 - protein, 4 aa, Mycobacterium
YDPR

SEQ ID NO: 1151711 - protein, 4 aa, Mycobacterium
YDRS

SEQ ID NO: 1151712 - protein, 7 aa, Mycobacterium
YDRTYDA

SEQ ID NO: 1151713 - protein, 7 aa, Mycobacterium
YDTDPEL

SEQ ID NO: 1151714 - protein, 4 aa, Mycobacterium
YEDR

SEQ ID NO: 1151715 - protein, 7 aa, Mycobacterium
YEGPQSA

SEQ ID NO: 1151716 - protein, 9 aa, Mycobacterium
YEKARGDQT

SEQ ID NO: 1151717 - protein, 5 aa, Mycobacterium
YEPDR

SEQ ID NO: 1151718 - protein, 6 aa, Mycobacterium
YEPPEA

SEQ ID NO: 1151719 - protein, 7 aa, Mycobacterium
YERNGER

SEQ ID NO: 1151720 - protein, 18 aa, Mycobacterium
YETAQKARESRKNQQQTV

SEQ ID NO: 1151721 - protein, 8 aa, Mycobacterium
YETPDPEI

SEQ ID NO: 1151722 - protein, 9 aa, Mycobacterium
YEVSNPDAV

SEQ ID NO: 1151723 - protein, 4 aa, Mycobacterium
YGAD

SEQ ID NO: 1151724 - protein, 6 aa, Mycobacterium
YGAGTP

SEQ ID NO: 1151725 - protein, 5 aa, Mycobacterium
YGEDG

SEQ ID NO: 1151726 - protein, 8 aa, Mycobacterium
YGGDQEHR

SEQ ID NO: 1151727 - protein, 11 aa, Mycobacterium
YGGGAAAATVQ

SEQ ID NO: 1151728 - protein, 7 aa, Mycobacterium
YGGTAEV

SEQ ID NO: 1151729 - protein, 9 aa, Mycobacterium
YGGTEIKYN

SEQ ID NO: 1151730 - protein, 7 aa, Mycobacterium
YGKGSNA

SEQ ID NO: 1151731 - protein, 4 aa, Mycobacterium
YGKT

SEQ ID NO: 1151732 - protein, 4 aa, Mycobacterium
YGNK

SEQ ID NO: 1151733 - protein, 4 aa, Mycobacterium
YGNP

SEQ ID NO: 1151734 - protein, 9 aa, Mycobacterium
YGPSRERSI

SEQ ID NO: 1151735 - protein, 8 aa, Mycobacterium
YGPTTGDR

SEQ ID NO: 1151736 - protein, 8 aa, Mycobacterium
YGSRAAKA

SEQ ID NO: 1151737 - protein, 9 aa, Mycobacterium
YGSSETGNM

SEQ ID NO: 1151738 - protein, 5 aa, Mycobacterium
YGSTE

SEQ ID NO: 1151739 - protein, 7 aa, Mycobacterium
YGSTEAG

SEQ ID NO: 1151740 - protein, 6 aa, Mycobacterium
YGSTTV

SEQ ID NO: 1151741 - protein, 5 aa, Mycobacterium
YGTAK

SEQ ID NO: 1151742 - protein, 6 aa, Mycobacterium
YGTVPE

SEQ ID NO: 1151743 - protein, 8 aa, Mycobacterium
YHGGTETA

SEQ ID NO: 1151744 - protein, 4 aa, Mycobacterium
YIGG

SEQ ID NO: 1151745 - protein, 4 aa, Mycobacterium
YKSS

SEQ ID NO: 1151746 - protein, 11 aa, Mycobacterium
YLSSGSNPWGE

SEQ ID NO: 1151747 - protein, 10 aa, Mycobacterium
YNANPDSMRA

SEQ ID NO: 1151748 - protein, 5 aa, Mycobacterium
YNGAN

SEQ ID NO: 1151749 - protein, 4 aa, Mycobacterium
YNGL

SEQ ID NO: 1151750 - protein, 11 aa, Mycobacterium
YNNASPASGRI

SEQ ID NO: 1151751 - protein, 9 aa, Mycobacterium
YNNYTDADA

SEQ ID NO: 1151752 - protein, 5 aa, Mycobacterium
YPDAE

SEQ ID NO: 1151753 - protein, 4 aa, Mycobacterium
YPDR

SEQ ID NO: 1151754 - protein, 7 aa, Mycobacterium
YPEEVPG

SEQ ID NO: 1151755 - protein, 9 aa, Mycobacterium
YPEPPPPGM

SEQ ID NO: 1151756 - protein, 5 aa, Mycobacterium
YPEQR

SEQ ID NO: 1151757 - protein, 8 aa, Mycobacterium
YPGADEAL

SEQ ID NO: 1151758 - protein, 5 aa, Mycobacterium
YPGAT

SEQ ID NO: 1151759 - protein, 9 aa, Mycobacterium
YPGEEVSGS

SEQ ID NO: 1151760 - protein, 4 aa, Mycobacterium
YPGP

SEQ ID NO: 1151761 - protein, 4 aa, Mycobacterium
YPKP

SEQ ID NO: 1151762 - protein, 5 aa, Mycobacterium
YPLPE

SEQ ID NO: 1151763 - protein, 8 aa, Mycobacterium
YPNGDPHV

SEQ ID NO: 1151764 - protein, 8 aa, Mycobacterium
YPPEEAQT

SEQ ID NO: 1151765 - protein, 11 aa, Mycobacterium
YPPGRGPHTSA

SEQ ID NO: 1151766 - protein, 9 aa, Mycobacterium
YPPPQPEPF

SEQ ID NO: 1151767 - protein, 8 aa, Mycobacterium
YPTPEEER

SEQ ID NO: 1151768 - protein, 5 aa, Mycobacterium
YPTRA

SEQ ID NO: 1151769 - protein, 6 aa, Mycobacterium
YPTRSG

SEQ ID NO: 1151770 - protein, 4 aa, Mycobacterium
YQAA

SEQ ID NO: 1151771 - protein, 7 aa, Mycobacterium
YQPEQTG

SEQ ID NO: 1151772 - protein, 5 aa, Mycobacterium
YQRRD

SEQ ID NO: 1151773 - protein, 10 aa, Mycobacterium
YRDEARPRAG

SEQ ID NO: 1151774 - protein, 4 aa, Mycobacterium
YRGE

SEQ ID NO: 1151775 - protein, 6 aa, Mycobacterium
YRGQET

SEQ ID NO: 1151776 - protein, 4 aa, Mycobacterium
YRGR

SEQ ID NO: 1151777 - protein, 4 aa, Mycobacterium
YRGV

SEQ ID NO: 1151778 - protein, 7 aa, Mycobacterium
YRGVKGG

SEQ ID NO: 1151779 - protein, 6 aa, Mycobacterium
YRSTPQ

SEQ ID NO: 1151780 - protein, 9 aa, Mycobacterium
YRTDNGEEF

SEQ ID NO: 1151781 - protein, 9 aa, Mycobacterium
YRTSGDSPI

SEQ ID NO: 1151782 - protein, 7 aa, Mycobacterium
YSAAKGG

SEQ ID NO: 1151783 - protein, 10 aa, Mycobacterium
YSARKTPIAT

SEQ ID NO: 1151784 - protein, 5 aa, Mycobacterium
YSGDD

SEQ ID NO: 1151785 - protein, 11 aa, Mycobacterium
YSPRLRPGTPV

SEQ ID NO: 1151786 - protein, 4 aa, Mycobacterium
YTAN

SEQ ID NO: 1151787 - protein, 11 aa, Mycobacterium
YTAPSGSPITA

SEQ ID NO: 1151788 - protein, 6 aa, Mycobacterium
YTASKA

SEQ ID NO: 1151789 - protein, 8 aa, Mycobacterium
YTDKPGHP

SEQ ID NO: 1151790 - protein, 10 aa, Mycobacterium
YTGGDADGGL

SEQ ID NO: 1151791 - protein, 18 aa, Mycobacterium
YTGGTTGKPKGVIGTTQS

SEQ ID NO: 1151792 - protein, 9 aa, Mycobacterium
YTPPVPAQG

SEQ ID NO: 1151793 - protein, 9 aa, Mycobacterium
YTSGQPDPD

SEQ ID NO: 1151794 - protein, 10 aa, Mycobacterium
YTSHGKDRTT

SEQ ID NO: 1151795 - protein, 4 aa, Mycobacterium
YTTE

SEQ ID NO: 1151796 - protein, 4 aa, Mycobacterium
YTTY

SEQ ID NO: 1151797 - protein, 6 aa, Mycobacterium
YVPGDD

SEQ ID NO: 1151798 - protein, 4 aa, Mycobacterium
YYGA

SEQ ID NO: 1151799 - protein, 14 aa, Mycobacterium
YYGPTGGLPSDDPR

SEQ ID NO: 1151800 - protein, 9 aa, Mycobacterium
AAAAAEAYR

SEQ ID NO: 1151801 - protein, 8 aa, Mycobacterium
AAAAAGHT

SEQ ID NO: 1151802 - protein, 14 aa, Mycobacterium
AAAAEAAAIGDGLP

SEQ ID NO: 1151803 - protein, 24 aa, Mycobacterium
AAAAERPDRLPGVGSAGQVPSLPG

SEQ ID NO: 1151804 - protein, 8 aa, Mycobacterium
AAAAGDME

SEQ ID NO: 1151805 - protein, 15 aa, Mycobacterium
AAAAGGDAALRAEYG

SEQ ID NO: 1151806 - protein, 8 aa, Mycobacterium
AAAAGRSG

SEQ ID NO: 1151807 - protein, 16 aa, Mycobacterium
AAAALPGSALPSPAQL

SEQ ID NO: 1151808 - protein, 10 aa, Mycobacterium
AAAAPEDREA

SEQ ID NO: 1151809 - protein, 43 aa, Mycobacterium
AAAAQQGQQPDQQQAPPPPPPPEPAARRSAQGSAMQQLRTITG

SEQ ID NO: 1151810 - protein, 6 aa, Mycobacterium
AAAASV

SEQ ID NO: 1151811 - protein, 13 aa, Mycobacterium
AAAATLGAAPAPE

SEQ ID NO: 1151812 - protein, 6 aa, Mycobacterium
AAAATT

SEQ ID NO: 1151813 - protein, 7 aa, Mycobacterium
AAACGQG

SEQ ID NO: 1151814 - protein, 16 aa, Mycobacterium
AAADAARARGAPAAAA

SEQ ID NO: 1151815 - protein, 8 aa, Mycobacterium
AAADAGHT

SEQ ID NO: 1151816 - protein, 7 aa, Mycobacterium
AAADAGV

SEQ ID NO: 1151817 - protein, 14 aa, Mycobacterium
AAADAGVAAGEAEL

SEQ ID NO: 1151818 - protein, 6 aa, Mycobacterium
AAADDA

SEQ ID NO: 1151819 - protein, 8 aa, Mycobacterium
AAADGAAT

SEQ ID NO: 1151820 - protein, 7 aa, Mycobacterium
AAADGPL

SEQ ID NO: 1151821 - protein, 8 aa, Mycobacterium
AAADGYRT

SEQ ID NO: 1151822 - protein, 10 aa, Mycobacterium
AAADPDRAPA

SEQ ID NO: 1151823 - protein, 6 aa, Mycobacterium
AAADPT

SEQ ID NO: 1151824 - protein, 9 aa, Mycobacterium
AAADPYSKA

SEQ ID NO: 1151825 - protein, 8 aa, Mycobacterium
AAADRDWP

SEQ ID NO: 1151826 - protein, 7 aa, Mycobacterium
AAADRPE

SEQ ID NO: 1151827 - protein, 16 aa, Mycobacterium
AAADRYEPSDDPASLN

SEQ ID NO: 1151828 - protein, 9 aa, Mycobacterium
AAADSTEEA

SEQ ID NO: 1151829 - protein, 6 aa, Mycobacterium
AAADTR

SEQ ID NO: 1151830 - protein, 5 aa, Mycobacterium
AAADV

SEQ ID NO: 1151831 - protein, 11 aa, Mycobacterium
AAAEAARAAEV

SEQ ID NO: 1151832 - protein, 10 aa, Mycobacterium
AAAEATTRAV

SEQ ID NO: 1151833 - protein, 6 aa, Mycobacterium
AAAEDG

SEQ ID NO: 1151834 - protein, 7 aa, Mycobacterium
AAAEDGL

SEQ ID NO: 1151835 - protein, 7 aa, Mycobacterium
AAAEEGL

SEQ ID NO: 1151836 - protein, 11 aa, Mycobacterium
AAAEEPADLSD

SEQ ID NO: 1151837 - protein, 6 aa, Mycobacterium
AAAEGI

SEQ ID NO: 1151838 - protein, 17 aa, Mycobacterium
AAAEKELKGTAAKLGND

SEQ ID NO: 1151839 - protein, 6 aa, Mycobacterium
AAAEPK

SEQ ID NO: 1151840 - protein, 12 aa, Mycobacterium
AAAEQQAAAEKT

SEQ ID NO: 1151841 - protein, 13 aa, Mycobacterium
AAAERTNASTTGL

SEQ ID NO: 1151842 - protein, 6 aa, Mycobacterium
AAAEVG

SEQ ID NO: 1151843 - protein, 7 aa, Mycobacterium
AAAGAAD

SEQ ID NO: 1151844 - protein, 14 aa, Mycobacterium
AAAGAAHGAAHDAE

SEQ ID NO: 1151845 - protein, 16 aa, Mycobacterium
AAAGADGIADDLVVEG

SEQ ID NO: 1151846 - protein, 11 aa, Mycobacterium
AAAGATSTAGE

SEQ ID NO: 1151847 - protein, 8 aa, Mycobacterium
AAAGDEDQ

SEQ ID NO: 1151848 - protein, 8 aa, Mycobacterium
AAAGDTDV

SEQ ID NO: 1151849 - protein, 14 aa, Mycobacterium
AAAGEAATTSGAEP

SEQ ID NO: 1151850 - protein, 10 aa, Mycobacterium
AAAGEARAAG

SEQ ID NO: 1151851 - protein, 5 aa, Mycobacterium
AAAGG

SEQ ID NO: 1151852 - protein, 6 aa, Mycobacterium
AAAGGF

SEQ ID NO: 1151853 - protein, 7 aa, Mycobacterium
AAAGGKA

SEQ ID NO: 1151854 - protein, 7 aa, Mycobacterium
AAAGGPR

SEQ ID NO: 1151855 - protein, 12 aa, Mycobacterium
AAAGGRGGLGNA

SEQ ID NO: 1151856 - protein, 10 aa, Mycobacterium
AAAGGTTSMA

SEQ ID NO: 1151857 - protein, 6 aa, Mycobacterium
AAAGLT

SEQ ID NO: 1151858 - protein, 7 aa, Mycobacterium
AAAGPGD

SEQ ID NO: 1151859 - protein, 16 aa, Mycobacterium
AAAGPPEAASPGDLTD

SEQ ID NO: 1151860 - protein, 10 aa, Mycobacterium
AAAGPSADRA

SEQ ID NO: 1151861 - protein, 8 aa, Mycobacterium
AAAGRDAA

SEQ ID NO: 1151862 - protein, 17 aa, Mycobacterium
AAAGTESEDLTVPAGTT

SEQ ID NO: 1151863 - protein, 7 aa, Mycobacterium
AAAGTTR

SEQ ID NO: 1151864 - protein, 11 aa, Mycobacterium
AAAKAEAAQAE

SEQ ID NO: 1151865 - protein, 6 aa, Mycobacterium
AAAKAK

SEQ ID NO: 1151866 - protein, 27 aa, Mycobacterium
AAAKAQEQTGQGAVATKERETPAPTLR

SEQ ID NO: 1151867 - protein, 9 aa, Mycobacterium
AAAKATDID

SEQ ID NO: 1151868 - protein, 8 aa, Mycobacterium
AAAKELKA

SEQ ID NO: 1151869 - protein, 10 aa, Mycobacterium
AAAKEYAADG

SEQ ID NO: 1151870 - protein, 25 aa, Mycobacterium
AAAKKPGKAASTAAGAASSEATLER

SEQ ID NO: 1151871 - protein, 14 aa, Mycobacterium
AAANAQNNEGLDPS

SEQ ID NO: 1151872 - protein, 5 aa, Mycobacterium
AAANP

SEQ ID NO: 1151873 - protein, 7 aa, Mycobacterium
AAANYAS

SEQ ID NO: 1151874 - protein, 7 aa, Mycobacterium
AAAPDGS

SEQ ID NO: 1151875 - protein, 7 aa, Mycobacterium
AAAPDGT

SEQ ID NO: 1151876 - protein, 9 aa, Mycobacterium
AAAPDSVAP

SEQ ID NO: 1151877 - protein, 17 aa, Mycobacterium
AAAPEPPLARRLLAGLL

SEQ ID NO: 1151878 - protein, 9 aa, Mycobacterium
AAAPGESGE

SEQ ID NO: 1151879 - protein, 6 aa, Mycobacterium
AAAPGL

SEQ ID NO: 1151880 - protein, 7 aa, Mycobacterium
AAAPPDQ

SEQ ID NO: 1151881 - protein, 7 aa, Mycobacterium
AAAPPSW

SEQ ID NO: 1151882 - protein, 11 aa, Mycobacterium
AAAPPTPDPVA

SEQ ID NO: 1151883 - protein, 7 aa, Mycobacterium
AAAPQGV

SEQ ID NO: 1151884 - protein, 10 aa, Mycobacterium
AAAPSAESDA

SEQ ID NO: 1151885 - protein, 8 aa, Mycobacterium
AAAPSGNM

SEQ ID NO: 1151886 - protein, 9 aa, Mycobacterium
AAAPSTGVN

SEQ ID NO: 1151887 - protein, 8 aa, Mycobacterium
AAAPYQSA

SEQ ID NO: 1151888 - protein, 9 aa, Mycobacterium
AAAQAGGAH

SEQ ID NO: 1151889 - protein, 15 aa, Mycobacterium
AAAQAKRDSAATAKA

SEQ ID NO: 1151890 - protein, 7 aa, Mycobacterium
AAAQEIA

SEQ ID NO: 1151891 - protein, 6 aa, Mycobacterium
AAAQGR

SEQ ID NO: 1151892 - protein, 11 aa, Mycobacterium
AAAQGRASGSY

SEQ ID NO: 1151893 - protein, 9 aa, Mycobacterium
AAAQQMGFD

SEQ ID NO: 1151894 - protein, 14 aa, Mycobacterium
AAAQTRAISTQDAT

SEQ ID NO: 1151895 - protein, 7 aa, Mycobacterium
AAARAAD

SEQ ID NO: 1151896 - protein, 10 aa, Mycobacterium
AAARAVKGDI

SEQ ID NO: 1151897 - protein, 11 aa, Mycobacterium
AAARDGAEGRI

SEQ ID NO: 1151898 - protein, 17 aa, Mycobacterium
AAARGDRAAFNRSADQT

SEQ ID NO: 1151899 - protein, 9 aa, Mycobacterium
AAARGGSTF

SEQ ID NO: 1151900 - protein, 5 aa, Mycobacterium
AAARH

SEQ ID NO: 1151901 - protein, 6 aa, Mycobacterium
AAARHG

SEQ ID NO: 1151902 - protein, 13 aa, Mycobacterium
AAARQWPDGPVPD

SEQ ID NO: 1151903 - protein, 6 aa, Mycobacterium
AAARRG

SEQ ID NO: 1151904 - protein, 8 aa, Mycobacterium
AAARSAGV

SEQ ID NO: 1151905 - protein, 17 aa, Mycobacterium
AAARTAEQLRRSNYSGP

SEQ ID NO: 1151906 - protein, 8 aa, Mycobacterium
AAARTGTR

SEQ ID NO: 1151907 - protein, 15 aa, Mycobacterium
AAARTQARIDSGAQT

SEQ ID NO: 1151908 - protein, 8 aa, Mycobacterium
AAASAKEG

SEQ ID NO: 1151909 - protein, 10 aa, Mycobacterium
AAASAPADVF

SEQ ID NO: 1151910 - protein, 8 aa, Mycobacterium
AAASDKAA

SEQ ID NO: 1151911 - protein, 13 aa, Mycobacterium
AAASDPASPITGE

SEQ ID NO: 1151912 - protein, 11 aa, Mycobacterium
AAASEDNERNS

SEQ ID NO: 1151913 - protein, 10 aa, Mycobacterium
AAASEKTGLD

SEQ ID NO: 1151914 - protein, 11 aa, Mycobacterium
AAASGTDPRDH

SEQ ID NO: 1151915 - protein, 10 aa, Mycobacterium
AAASNEADPT

SEQ ID NO: 1151916 - protein, 8 aa, Mycobacterium
AAASPGRL

SEQ ID NO: 1151917 - protein, 6 aa, Mycobacterium
AAASYE

SEQ ID NO: 1151918 - protein, 7 aa, Mycobacterium
AAATDDS

SEQ ID NO: 1151919 - protein, 15 aa, Mycobacterium
AAATGKAKVSERAKA

SEQ ID NO: 1151920 - protein, 7 aa, Mycobacterium
AAATNQV

SEQ ID NO: 1151921 - protein, 7 aa, Mycobacterium
AAATNSL

SEQ ID NO: 1151922 - protein, 4 aa, Mycobacterium
AAAV

SEQ ID NO: 1151923 - protein, 8 aa, Mycobacterium
AAAVAGNT

SEQ ID NO: 1151924 - protein, 14 aa, Mycobacterium
AAAVETDPSGGALR

SEQ ID NO: 1151925 - protein, 9 aa, Mycobacterium
AAAVGGQSA

SEQ ID NO: 1151926 - protein, 13 aa, Mycobacterium
AAAVGSPDTHAGE

SEQ ID NO: 1151927 - protein, 25 aa, Mycobacterium
AAAVPDLTQSGAITPPTAQHATRQG

SEQ ID NO: 1151928 - protein, 15 aa, Mycobacterium
AAAYDKGDERSAGKL

SEQ ID NO: 1151929 - protein, 11 aa, Mycobacterium
AACSSNSHGRD

SEQ ID NO: 1151930 - protein, 9 aa, Mycobacterium
AADAAAAGF

SEQ ID NO: 1151931 - protein, 18 aa, Mycobacterium
AADAAAAVAGTDRLQGTS

SEQ ID NO: 1151932 - protein, 7 aa, Mycobacterium
AADAAGI

SEQ ID NO: 1151933 - protein, 8 aa, Mycobacterium
AADADGAA

SEQ ID NO: 1151934 - protein, 11 aa, Mycobacterium
AADADTPQHRY

SEQ ID NO: 1151935 - protein, 6 aa, Mycobacterium
AADAEA

SEQ ID NO: 1151936 - protein, 10 aa, Mycobacterium
AADAEEGPPF

SEQ ID NO: 1151937 - protein, 16 aa, Mycobacterium
AADAELSAADPQPGNE

SEQ ID NO: 1151938 - protein, 10 aa, Mycobacterium
AADAETKREK

SEQ ID NO: 1151939 - protein, 6 aa, Mycobacterium
AADAEV

SEQ ID NO: 1151940 - protein, 6 aa, Mycobacterium
AADAGA

SEQ ID NO: 1151941 - protein, 14 aa, Mycobacterium
AADAGPEEKIERGE

SEQ ID NO: 1151942 - protein, 15 aa, Mycobacterium
AADAGSLPGLDRADG

SEQ ID NO: 1151943 - protein, 7 aa, Mycobacterium
AADAGVR

SEQ ID NO: 1151944 - protein, 8 aa, Mycobacterium
AADALRGS

SEQ ID NO: 1151945 - protein, 9 aa, Mycobacterium
AADAPDTKR

SEQ ID NO: 1151946 - protein, 5 aa, Mycobacterium
AADAS

SEQ ID NO: 1151947 - protein, 8 aa, Mycobacterium
AADATVEQ

SEQ ID NO: 1151948 - protein, 7 aa, Mycobacterium
AADDDRV

SEQ ID NO: 1151949 - protein, 8 aa, Mycobacterium
AADDEQRA

SEQ ID NO: 1151950 - protein, 7 aa, Mycobacterium
AADDGLG

SEQ ID NO: 1151951 - protein, 9 aa, Mycobacterium
AADDPAKLA

SEQ ID NO: 1151952 - protein, 7 aa, Mycobacterium
AADDPDV

SEQ ID NO: 1151953 - protein, 18 aa, Mycobacterium
AADDPKAAARRLKDALVS

SEQ ID NO: 1151954 - protein, 12 aa, Mycobacterium
AADDTGAPRPTV

SEQ ID NO: 1151955 - protein, 33 aa, Mycobacterium
AADEDQHAVPADRNGQRDPAVARGRRRREPGQL

SEQ ID NO: 1151956 - protein, 9 aa, Mycobacterium
AADEKESAL

SEQ ID NO: 1151957 - protein, 5 aa, Mycobacterium
AADEL

SEQ ID NO: 1151958 - protein, 30 aa, Mycobacterium
AADELSAAAGDGAGQVRYEPTDVTNEDEAA

SEQ ID NO: 1151959 - protein, 10 aa, Mycobacterium
AADELTGRDD

SEQ ID NO: 1151960 - protein, 7 aa, Mycobacterium
AADGDPM

SEQ ID NO: 1151961 - protein, 5 aa, Mycobacterium
AADGG

SEQ ID NO: 1151962 - protein, 6 aa, Mycobacterium
AADGGV

SEQ ID NO: 1151963 - protein, 7 aa, Mycobacterium
AADGHEA

SEQ ID NO: 1151964 - protein, 13 aa, Mycobacterium
AADGKRDVRASII

SEQ ID NO: 1151965 - protein, 9 aa, Mycobacterium
AADGPPAEA

SEQ ID NO: 1151966 - protein, 6 aa, Mycobacterium
AADGRR

SEQ ID NO: 1151967 - protein, 8 aa, Mycobacterium
AADGSRQR

SEQ ID NO: 1151968 - protein, 10 aa, Mycobacterium
AADGTRRPDG

SEQ ID NO: 1151969 - protein, 8 aa, Mycobacterium
AADIQASR

SEQ ID NO: 1151970 - protein, 5 aa, Mycobacterium
AADKG

SEQ ID NO: 1151971 - protein, 7 aa, Mycobacterium
AADLPNP

SEQ ID NO: 1151972 - protein, 5 aa, Mycobacterium
AADPA

SEQ ID NO: 1151973 - protein, 19 aa, Mycobacterium
AADPDRPAVIGPDGAATSF

SEQ ID NO: 1151974 - protein, 7 aa, Mycobacterium
AADPGAG

SEQ ID NO: 1151975 - protein, 13 aa, Mycobacterium
AADPGGKDYGVPS

SEQ ID NO: 1151976 - protein, 10 aa, Mycobacterium
AADPLTGSDT

SEQ ID NO: 1151977 - protein, 10 aa, Mycobacterium
AADPQDPGTI

SEQ ID NO: 1151978 - protein, 16 aa, Mycobacterium
AADQPAAGGGLGYDGG

SEQ ID NO: 1151979 - protein, 10 aa, Mycobacterium
AADQPAVAKA

SEQ ID NO: 1151980 - protein, 5 aa, Mycobacterium
AADRA

SEQ ID NO: 1151981 - protein, 12 aa, Mycobacterium
AADRAAQERSLA

SEQ ID NO: 1151982 - protein, 8 aa, Mycobacterium
AADRDGQT

SEQ ID NO: 1151983 - protein, 9 aa, Mycobacterium
AADRGEDPL

SEQ ID NO: 1151984 - protein, 9 aa, Mycobacterium
AADRGPDTA

SEQ ID NO: 1151985 - protein, 7 aa, Mycobacterium
AADRRSA

SEQ ID NO: 1151986 - protein, 15 aa, Mycobacterium
AADRSAAGDPSGDEY

SEQ ID NO: 1151987 - protein, 8 aa, Mycobacterium
AADSPDAL

SEQ ID NO: 1151988 - protein, 9 aa, Mycobacterium
AADTAGGNL

SEQ ID NO: 1151989 - protein, 11 aa, Mycobacterium
AADTAKFTEVP

SEQ ID NO: 1151990 - protein, 5 aa, Mycobacterium
AADTE

SEQ ID NO: 1151991 - protein, 7 aa, Mycobacterium
AADTEVR

SEQ ID NO: 1151992 - protein, 11 aa, Mycobacterium
AADTIGETDEY

SEQ ID NO: 1151993 - protein, 8 aa, Mycobacterium
AADTRSHQ

SEQ ID NO: 1151994 - protein, 10 aa, Mycobacterium
AADVDGDDKV

SEQ ID NO: 1151995 - protein, 6 aa, Mycobacterium
AADYAR

SEQ ID NO: 1151996 - protein, 7 aa, Mycobacterium
AAEAAGY

SEQ ID NO: 1151997 - protein, 37 aa, Mycobacterium
AAEADKKAKSGPEDAAEAPGKAPAAATASANASDAPL

SEQ ID NO: 1151998 - protein, 7 aa, Mycobacterium
AAEADQL

SEQ ID NO: 1151999 - protein, 5 aa, Mycobacterium
AAEAE

SEQ ID NO: 1152000 - protein, 31 aa, Mycobacterium
AAEAEEAARPVSNGSSRSEESTGGTLASDAQ

SEQ ID NO: 1152001 - protein, 12 aa, Mycobacterium
AAEAEENRSRAR

SEQ ID NO: 1152002 - protein, 10 aa, Mycobacterium
AAEAGAPSVI

SEQ ID NO: 1152003 - protein, 7 aa, Mycobacterium
AAEAGID

SEQ ID NO: 1152004 - protein, 8 aa, Mycobacterium
AAEAGKDA

SEQ ID NO: 1152005 - protein, 7 aa, Mycobacterium
AAEAKEY

SEQ ID NO: 1152006 - protein, 9 aa, Mycobacterium
AAEANRRRR

SEQ ID NO: 1152007 - protein, 11 aa, Mycobacterium
AAEAPDPRATS

SEQ ID NO: 1152008 - protein, 16 aa, Mycobacterium
AAEARGQVVDEDADAA

SEQ ID NO: 1152009 - protein, 12 aa, Mycobacterium
AAEDQGGEQTLD

SEQ ID NO: 1152010 - protein, 5 aa, Mycobacterium
AAEDR

SEQ ID NO: 1152011 - protein, 6 aa, Mycobacterium
AAEDTF

SEQ ID NO: 1152012 - protein, 21 aa, Mycobacterium
AAEEAFAKSAESNQDGKPSLA

SEQ ID NO: 1152013 - protein, 6 aa, Mycobacterium
AAEEEV

SEQ ID NO: 1152014 - protein, 7 aa, Mycobacterium
AAEEHGS

SEQ ID NO: 1152015 - protein, 6 aa, Mycobacterium
AAEEMG

SEQ ID NO: 1152016 - protein, 7 aa, Mycobacterium
AAEEPLS

SEQ ID NO: 1152017 - protein, 9 aa, Mycobacterium
AAEFDSDEG

SEQ ID NO: 1152018 - protein, 6 aa, Mycobacterium
AAEFGE

SEQ ID NO: 1152019 - protein, 7 aa, Mycobacterium
AAEGAET

SEQ ID NO: 1152020 - protein, 6 aa, Mycobacterium
AAEGID

SEQ ID NO: 1152021 - protein, 8 aa, Mycobacterium
AAEGPVER

SEQ ID NO: 1152022 - protein, 10 aa, Mycobacterium
AAEGTSLGPT

SEQ ID NO: 1152023 - protein, 10 aa, Mycobacterium
AAEHAAAESD

SEQ ID NO: 1152024 - protein, 7 aa, Mycobacterium
AAEHRAE

SEQ ID NO: 1152025 - protein, 4 aa, Mycobacterium
AAEI

SEQ ID NO: 1152026 - protein, 15 aa, Mycobacterium
AAEIADADRPAEAAR

SEQ ID NO: 1152027 - protein, 12 aa, Mycobacterium
AAEITAKKAGAA

SEQ ID NO: 1152028 - protein, 7 aa, Mycobacterium
AAEKGGY

SEQ ID NO: 1152029 - protein, 10 aa, Mycobacterium
AAEKKSNTAQ

SEQ ID NO: 1152030 - protein, 11 aa, Mycobacterium
AAEKSGANAIH

SEQ ID NO: 1152031 - protein, 10 aa, Mycobacterium
AAEKVGAATE

SEQ ID NO: 1152032 - protein, 7 aa, Mycobacterium
AAELAGS

SEQ ID NO: 1152033 - protein, 11 aa, Mycobacterium
AAELSATDPAV

SEQ ID NO: 1152034 - protein, 6 aa, Mycobacterium
AAEPAG

SEQ ID NO: 1152035 - protein, 5 aa, Mycobacterium
AAEPG

SEQ ID NO: 1152036 - protein, 9 aa, Mycobacterium
AAEPPTDQM

SEQ ID NO: 1152037 - protein, 11 aa, Mycobacterium
AAEPTQDSHRP

SEQ ID NO: 1152038 - protein, 7 aa, Mycobacterium
AAEPTSL

SEQ ID NO: 1152039 - protein, 16 aa, Mycobacterium
AAEQDLARAASAVPDT

SEQ ID NO: 1152040 - protein, 9 aa, Mycobacterium
AAEQGKSVD

SEQ ID NO: 1152041 - protein, 41 aa, Mycobacterium
AAEQQAAESDLRNAEQQLKREKRQMQEARERAGRRSNTAVR

SEQ ID NO: 1152042 - protein, 4 aa, Mycobacterium
AAER

SEQ ID NO: 1152043 - protein, 7 aa, Mycobacterium
AAERAEV

SEQ ID NO: 1152044 - protein, 13 aa, Mycobacterium
AAERAGAALPTRD

SEQ ID NO: 1152045 - protein, 7 aa, Mycobacterium
AAERAGV

SEQ ID NO: 1152046 - protein, 7 aa, Mycobacterium
AAERAPA

SEQ ID NO: 1152047 - protein, 17 aa, Mycobacterium
AAERASDPHRDTTLEKN

SEQ ID NO: 1152048 - protein, 9 aa, Mycobacterium
AAERDSGDF

SEQ ID NO: 1152049 - protein, 9 aa, Mycobacterium
AAERDVDGE

SEQ ID NO: 1152050 - protein, 7 aa, Mycobacterium
AAERERR

SEQ ID NO: 1152051 - protein, 9 aa, Mycobacterium
AAERGAQVS

SEQ ID NO: 1152052 - protein, 6 aa, Mycobacterium
AAERGN

SEQ ID NO: 1152053 - protein, 5 aa, Mycobacterium
AAERN

SEQ ID NO: 1152054 - protein, 7 aa, Mycobacterium
AAERRMS

SEQ ID NO: 1152055 - protein, 15 aa, Mycobacterium
AAERRSRLEGDERGR

SEQ ID NO: 1152056 - protein, 7 aa, Mycobacterium
AAESDGV

SEQ ID NO: 1152057 - protein, 7 aa, Mycobacterium
AAESDRV

SEQ ID NO: 1152058 - protein, 7 aa, Mycobacterium
AAESDTA

SEQ ID NO: 1152059 - protein, 5 aa, Mycobacterium
AAESG

SEQ ID NO: 1152060 - protein, 8 aa, Mycobacterium
AAESSPLH

SEQ ID NO: 1152061 - protein, 13 aa, Mycobacterium
AAESSTADSSRSH

SEQ ID NO: 1152062 - protein, 12 aa, Mycobacterium
AAESTLQNQGET

SEQ ID NO: 1152063 - protein, 14 aa, Mycobacterium
AAETAQRAWGDPDA

SEQ ID NO: 1152064 - protein, 8 aa, Mycobacterium
AAETGAQE

SEQ ID NO: 1152065 - protein, 8 aa, Mycobacterium
AAETGRTV

SEQ ID NO: 1152066 - protein, 22 aa, Mycobacterium
AAETNTDDAFPATTADRAEMPP

SEQ ID NO: 1152067 - protein, 23 aa, Mycobacterium
AAETPEGRTADEQYEERQRAAAE

SEQ ID NO: 1152068 - protein, 11 aa, Mycobacterium
AAEVDGGTDTI

SEQ ID NO: 1152069 - protein, 6 aa, Mycobacterium
AAEVTP

SEQ ID NO: 1152070 - protein, 4 aa, Mycobacterium
AAFG

SEQ ID NO: 1152071 - protein, 17 aa, Mycobacterium
AAFPGGATDPDDEGPVH

SEQ ID NO: 1152072 - protein, 6 aa, Mycobacterium
AAFPTA

SEQ ID NO: 1152073 - protein, 7 aa, Mycobacterium
AAGAASP

SEQ ID NO: 1152074 - protein, 14 aa, Mycobacterium
AAGAAVRAAEARGV

SEQ ID NO: 1152075 - protein, 7 aa, Mycobacterium
AAGADEG

SEQ ID NO: 1152076 - protein, 6 aa, Mycobacterium
AAGADI

SEQ ID NO: 1152077 - protein, 8 aa, Mycobacterium
AAGAGEGR

SEQ ID NO: 1152078 - protein, 6 aa, Mycobacterium
AAGAHT

SEQ ID NO: 1152079 - protein, 8 aa, Mycobacterium
AAGAKAPV

SEQ ID NO: 1152080 - protein, 9 aa, Mycobacterium
AAGANASEH

SEQ ID NO: 1152081 - protein, 7 aa, Mycobacterium
AAGAPDG

SEQ ID NO: 1152082 - protein, 7 aa, Mycobacterium
AAGAQHV

SEQ ID NO: 1152083 - protein, 7 aa, Mycobacterium
AAGARSA

SEQ ID NO: 1152084 - protein, 10 aa, Mycobacterium
AAGARYRGDR

SEQ ID NO: 1152085 - protein, 8 aa, Mycobacterium
AAGASTRQ

SEQ ID NO: 1152086 - protein, 9 aa, Mycobacterium
AAGATDDDD

SEQ ID NO: 1152087 - protein, 6 aa, Mycobacterium
AAGATF

SEQ ID NO: 1152088 - protein, 8 aa, Mycobacterium
AAGAYDTP

SEQ ID NO: 1152089 - protein, 10 aa, Mycobacterium
AAGDEERGEI

SEQ ID NO: 1152090 - protein, 8 aa, Mycobacterium
AAGDEPTL

SEQ ID NO: 1152091 - protein, 5 aa, Mycobacterium
AAGDG

SEQ ID NO: 1152092 - protein, 6 aa, Mycobacterium
AAGDGR

SEQ ID NO: 1152093 - protein, 6 aa, Mycobacterium
AAGDGV

SEQ ID NO: 1152094 - protein, 11 aa, Mycobacterium
AAGDGVETGRH

SEQ ID NO: 1152095 - protein, 8 aa, Mycobacterium
AAGDPSTV

SEQ ID NO: 1152096 - protein, 6 aa, Mycobacterium
AAGDQA

SEQ ID NO: 1152097 - protein, 5 aa, Mycobacterium
AAGDS

SEQ ID NO: 1152098 - protein, 7 aa, Mycobacterium
AAGDTPT

SEQ ID NO: 1152099 - protein, 11 aa, Mycobacterium
AAGDTRTDPSV

SEQ ID NO: 1152100 - protein, 7 aa, Mycobacterium
AAGDVDA

SEQ ID NO: 1152101 - protein, 4 aa, Mycobacterium
AAGE

SEQ ID NO: 1152102 - protein, 7 aa, Mycobacterium
AAGEGRG

SEQ ID NO: 1152103 - protein, 19 aa, Mycobacterium
AAGESHDEGPVVAALWPPT

SEQ ID NO: 1152104 - protein, 9 aa, Mycobacterium
AAGEVTGDS

SEQ ID NO: 1152105 - protein, 9 aa, Mycobacterium
AAGFNPAEK

SEQ ID NO: 1152106 - protein, 7 aa, Mycobacterium
AAGGADL

SEQ ID NO: 1152107 - protein, 7 aa, Mycobacterium
AAGGDEV

SEQ ID NO: 1152108 - protein, 6 aa, Mycobacterium
AAGGGH

SEQ ID NO: 1152109 - protein, 8 aa, Mycobacterium
AAGGHHGM

SEQ ID NO: 1152110 - protein, 5 aa, Mycobacterium
AAGGK

SEQ ID NO: 1152111 - protein, 11 aa, Mycobacterium
AAGGNPGSASS

SEQ ID NO: 1152112 - protein, 6 aa, Mycobacterium
AAGGQA

SEQ ID NO: 1152113 - protein, 11 aa, Mycobacterium
AAGGQARAKYG

SEQ ID NO: 1152114 - protein, 8 aa, Mycobacterium
AAGGQATA

SEQ ID NO: 1152115 - protein, 7 aa, Mycobacterium
AAGGQTV

SEQ ID NO: 1152116 - protein, 7 aa, Mycobacterium
AAGGRPI

SEQ ID NO: 1152117 - protein, 5 aa, Mycobacterium
AAGGS

SEQ ID NO: 1152118 - protein, 6 aa, Mycobacterium
AAGGSI

SEQ ID NO: 1152119 - protein, 5 aa, Mycobacterium
AAGGT

SEQ ID NO: 1152120 - protein, 15 aa, Mycobacterium
AAGHPLGEAASEQAA

SEQ ID NO: 1152121 - protein, 12 aa, Mycobacterium
AAGIDAAEANAK

SEQ ID NO: 1152122 - protein, 6 aa, Mycobacterium
AAGISR

SEQ ID NO: 1152123 - protein, 6 aa, Mycobacterium
AAGKRL

SEQ ID NO: 1152124 - protein, 10 aa, Mycobacterium
AAGLDLGGRE

SEQ ID NO: 1152125 - protein, 5 aa, Mycobacterium
AAGLG

SEQ ID NO: 1152126 - protein, 8 aa, Mycobacterium
AAGLPDDT

SEQ ID NO: 1152127 - protein, 7 aa, Mycobacterium
AAGLPGV

SEQ ID NO: 1152128 - protein, 13 aa, Mycobacterium
AAGLSANGGRHEA

SEQ ID NO: 1152129 - protein, 9 aa, Mycobacterium
AAGLTPESG

SEQ ID NO: 1152130 - protein, 7 aa, Mycobacterium
AAGMGTG

SEQ ID NO: 1152131 - protein, 7 aa, Mycobacterium
AAGNQNR

SEQ ID NO: 1152132 - protein, 7 aa, Mycobacterium
AAGNSTI

SEQ ID NO: 1152133 - protein, 9 aa, Mycobacterium
AAGPAAAPR

SEQ ID NO: 1152134 - protein, 18 aa, Mycobacterium
AAGPAGGAPAEAAEEQSE

SEQ ID NO: 1152135 - protein, 7 aa, Mycobacterium
AAGPALG

SEQ ID NO: 1152136 - protein, 8 aa, Mycobacterium
AAGPGEFH

SEQ ID NO: 1152137 - protein, 10 aa, Mycobacterium
AAGPGSAQRE

SEQ ID NO: 1152138 - protein, 7 aa, Mycobacterium
AAGPHKQ

SEQ ID NO: 1152139 - protein, 14 aa, Mycobacterium
AAGPIEGDPDEGVE

SEQ ID NO: 1152140 - protein, 19 aa, Mycobacterium
AAGPKHSNDVADRVGADHD

SEQ ID NO: 1152141 - protein, 5 aa, Mycobacterium
AAGPR

SEQ ID NO: 1152142 - protein, 8 aa, Mycobacterium
AAGPRSRV

SEQ ID NO: 1152143 - protein, 7 aa, Mycobacterium
AAGPRTS

SEQ ID NO: 1152144 - protein, 8 aa, Mycobacterium
AAGPSGPA

SEQ ID NO: 1152145 - protein, 10 aa, Mycobacterium
AAGPSGSPLR

SEQ ID NO: 1152146 - protein, 5 aa, Mycobacterium
AAGQR

SEQ ID NO: 1152147 - protein, 9 aa, Mycobacterium
AAGQSEAAG

SEQ ID NO: 1152148 - protein, 6 aa, Mycobacterium
AAGQSV

SEQ ID NO: 1152149 - protein, 10 aa, Mycobacterium
AAGQTGGANI

SEQ ID NO: 1152150 - protein, 6 aa, Mycobacterium
AAGQVE

SEQ ID NO: 1152151 - protein, 5 aa, Mycobacterium
AAGRA

SEQ ID NO: 1152152 - protein, 10 aa, Mycobacterium
AAGRAAKDVD

SEQ ID NO: 1152153 - protein, 10 aa, Mycobacterium
AAGRAKLGHT

SEQ ID NO: 1152154 - protein, 8 aa, Mycobacterium
AAGRDVGT

SEQ ID NO: 1152155 - protein, 5 aa, Mycobacterium
AAGRG

SEQ ID NO: 1152156 - protein, 7 aa, Mycobacterium
AAGRGPT

SEQ ID NO: 1152157 - protein, 8 aa, Mycobacterium
AAGRGTVE

SEQ ID NO: 1152158 - protein, 8 aa, Mycobacterium
AAGRPAPR

SEQ ID NO: 1152159 - protein, 8 aa, Mycobacterium
AAGRPDGA

SEQ ID NO: 1152160 - protein, 6 aa, Mycobacterium
AAGRPI

SEQ ID NO: 1152161 - protein, 7 aa, Mycobacterium
AAGRRLH

SEQ ID NO: 1152162 - protein, 6 aa, Mycobacterium
AAGRRN

SEQ ID NO: 1152163 - protein, 13 aa, Mycobacterium
AAGRTDAGVHATG

SEQ ID NO: 1152164 - protein, 5 aa, Mycobacterium
AAGSA

SEQ ID NO: 1152165 - protein, 8 aa, Mycobacterium
AAGSAGTM

SEQ ID NO: 1152166 - protein, 7 aa, Mycobacterium
AAGSALK

SEQ ID NO: 1152167 - protein, 10 aa, Mycobacterium
AAGSEDDKQR

SEQ ID NO: 1152168 - protein, 7 aa, Mycobacterium
AAGSHTL

SEQ ID NO: 1152169 - protein, 6 aa, Mycobacterium
AAGSLT

SEQ ID NO: 1152170 - protein, 7 aa, Mycobacterium
AAGSPSL

SEQ ID NO: 1152171 - protein, 7 aa, Mycobacterium
AAGTDRG

SEQ ID NO: 1152172 - protein, 6 aa, Mycobacterium
AAGTPP

SEQ ID NO: 1152173 - protein, 9 aa, Mycobacterium
AAGTSTAGS

SEQ ID NO: 1152174 - protein, 7 aa, Mycobacterium
AAGTSTS

SEQ ID NO: 1152175 - protein, 4 aa, Mycobacterium
AAGV

SEQ ID NO: 1152176 - protein, 17 aa, Mycobacterium
AAGYGADEISRIGQTMS

SEQ ID NO: 1152177 - protein, 4 aa, Mycobacterium
AAHG

SEQ ID NO: 1152178 - protein, 9 aa, Mycobacterium
AAHGPAGAR

SEQ ID NO: 1152179 - protein, 5 aa, Mycobacterium
AAHGW

SEQ ID NO: 1152180 - protein, 5 aa, Mycobacterium
AAHPD

SEQ ID NO: 1152181 - protein, 7 aa, Mycobacterium
AAHPGVA

SEQ ID NO: 1152182 - protein, 16 aa, Mycobacterium
AAHQHGASPLPELPPR

SEQ ID NO: 1152183 - protein, 17 aa, Mycobacterium
AAHRPEPTGARYAAGPI

SEQ ID NO: 1152184 - protein, 6 aa, Mycobacterium
AAHTRE

SEQ ID NO: 1152185 - protein, 7 aa, Mycobacterium
AAHTTAH

SEQ ID NO: 1152186 - protein, 7 aa, Mycobacterium
AAHTYSD

SEQ ID NO: 1152187 - protein, 12 aa, Mycobacterium
AAIRDSRIEPTR

SEQ ID NO: 1152188 - protein, 10 aa, Mycobacterium
AAKAAGGSIN

SEQ ID NO: 1152189 - protein, 10 aa, Mycobacterium
AAKAARALPV

SEQ ID NO: 1152190 - protein, 11 aa, Mycobacterium
AAKAGKDAAEL

SEQ ID NO: 1152191 - protein, 7 aa, Mycobacterium
AAKAGRT

SEQ ID NO: 1152192 - protein, 10 aa, Mycobacterium
AAKAQDAKAF

SEQ ID NO: 1152193 - protein, 27 aa, Mycobacterium
AAKDPEVSFPAPTVPPRISSRPANPVA

SEQ ID NO: 1152194 - protein, 8 aa, Mycobacterium
AAKDPGGF

SEQ ID NO: 1152195 - protein, 4 aa, Mycobacterium
AAKE

SEQ ID NO: 1152196 - protein, 12 aa, Mycobacterium
AAKEREAETDYA

SEQ ID NO: 1152197 - protein, 6 aa, Mycobacterium
AAKGAR

SEQ ID NO: 1152198 - protein, 8 aa, Mycobacterium
AAKGGINA

SEQ ID NO: 1152199 - protein, 16 aa, Mycobacterium
AAKGNLDQARAERDGF

SEQ ID NO: 1152200 - protein, 5 aa, Mycobacterium
AAKNM

SEQ ID NO: 1152201 - protein, 12 aa, Mycobacterium
AAKPAWEATPFD

SEQ ID NO: 1152202 - protein, 5 aa, Mycobacterium
AAKPK

SEQ ID NO: 1152203 - protein, 11 aa, Mycobacterium
AAKPPSATQGT

SEQ ID NO: 1152204 - protein, 5 aa, Mycobacterium
AAKQG

SEQ ID NO: 1152205 - protein, 4 aa, Mycobacterium
AAKS

SEQ ID NO: 1152206 - protein, 22 aa, Mycobacterium
AAKSGDREIAAGARRNSKKAAD

SEQ ID NO: 1152207 - protein, 12 aa, Mycobacterium
AAKSGRPEPERD

SEQ ID NO: 1152208 - protein, 9 aa, Mycobacterium
AAKSNAVTT

SEQ ID NO: 1152209 - protein, 9 aa, Mycobacterium
AAKSNTPVS

SEQ ID NO: 1152210 - protein, 8 aa, Mycobacterium
AAKTAEAF

SEQ ID NO: 1152211 - protein, 7 aa, Mycobacterium
AAKVPTS

SEQ ID NO: 1152212 - protein, 6 aa, Mycobacterium
AAKYAD

SEQ ID NO: 1152213 - protein, 7 aa, Mycobacterium
AAKYPTY

SEQ ID NO: 1152214 - protein, 7 aa, Mycobacterium
AALATYT

SEQ ID NO: 1152215 - protein, 8 aa, Mycobacterium
AALDAADS

SEQ ID NO: 1152216 - protein, 8 aa, Mycobacterium
AALDAPSA

SEQ ID NO: 1152217 - protein, 5 aa, Mycobacterium
AALDE

SEQ ID NO: 1152218 - protein, 15 aa, Mycobacterium
AALENAASNATSEDV

SEQ ID NO: 1152219 - protein, 9 aa, Mycobacterium
AALEQSGFK

SEQ ID NO: 1152220 - protein, 7 aa, Mycobacterium
AALGGNS

SEQ ID NO: 1152221 - protein, 7 aa, Mycobacterium
AALGTKD

SEQ ID NO: 1152222 - protein, 4 aa, Mycobacterium
AALP

SEQ ID NO: 1152223 - protein, 16 aa, Mycobacterium
AALPGSRTTTARGTAG

SEQ ID NO: 1152224 - protein, 6 aa, Mycobacterium
AALPGW

SEQ ID NO: 1152225 - protein, 13 aa, Mycobacterium
AALPTSTGWGTSR

SEQ ID NO: 1152226 - protein, 12 aa, Mycobacterium
AALQDNGFGPGD

SEQ ID NO: 1152227 - protein, 10 aa, Mycobacterium
AALQTPDGRV

SEQ ID NO: 1152228 - protein, 4 aa, Mycobacterium
AALS

SEQ ID NO: 1152229 - protein, 7 aa, Mycobacterium
AALSPAG

SEQ ID NO: 1152230 - protein, 17 aa, Mycobacterium
AALSPTARQAAAQAGLG

SEQ ID NO: 1152231 - protein, 8 aa, Mycobacterium
AALTADGS

SEQ ID NO: 1152232 - protein, 16 aa, Mycobacterium
AALTGADDDPTGDAMS

SEQ ID NO: 1152233 - protein, 9 aa, Mycobacterium
AAMAERAET

SEQ ID NO: 1152234 - protein, 11 aa, Mycobacterium
AAMDNARDATQ

SEQ ID NO: 1152235 - protein, 12 aa, Mycobacterium
AAMGEDRAMTEA

SEQ ID NO: 1152236 - protein, 7 aa, Mycobacterium
AAMPSRP

SEQ ID NO: 1152237 - protein, 6 aa, Mycobacterium
AAMTDS

SEQ ID NO: 1152238 - protein, 12 aa, Mycobacterium
AANAQGKPAPRI

SEQ ID NO: 1152239 - protein, 19 aa, Mycobacterium
AANASAADPGPRPAPTSAS

SEQ ID NO: 1152240 - protein, 14 aa, Mycobacterium
AANATATVTRAKRD

SEQ ID NO: 1152241 - protein, 7 aa, Mycobacterium
AANEEAA

SEQ ID NO: 1152242 - protein, 15 aa, Mycobacterium
AANGGHQPAYGEDRY

SEQ ID NO: 1152243 - protein, 32 aa, Mycobacterium
AANGRDDESEDESDESADEQSGAREDDTAEKV

SEQ ID NO: 1152244 - protein, 9 aa, Mycobacterium
AANLPADQR

SEQ ID NO: 1152245 - protein, 15 aa, Mycobacterium
AANPDGDVLWKPGTD

SEQ ID NO: 1152246 - protein, 5 aa, Mycobacterium
AANPG

SEQ ID NO: 1152247 - protein, 8 aa, Mycobacterium
AANPGQRG

SEQ ID NO: 1152248 - protein, 8 aa, Mycobacterium
AANPQGVK

SEQ ID NO: 1152249 - protein, 23 aa, Mycobacterium
AANRDPRRFEDPDTFDPQRKNAR

SEQ ID NO: 1152250 - protein, 11 aa, Mycobacterium
AANRKQAMVPD

SEQ ID NO: 1152251 - protein, 7 aa, Mycobacterium
AANVGAT

SEQ ID NO: 1152252 - protein, 9 aa, Mycobacterium
AANYPPERV

SEQ ID NO: 1152253 - protein, 8 aa, Mycobacterium
AAPAADLS

SEQ ID NO: 1152254 - protein, 8 aa, Mycobacterium
AAPAAPVQ

SEQ ID NO: 1152255 - protein, 8 aa, Mycobacterium
AAPADPRV

SEQ ID NO: 1152256 - protein, 9 aa, Mycobacterium
AAPADVDRA

SEQ ID NO: 1152257 - protein, 6 aa, Mycobacterium
AAPAGE

SEQ ID NO: 1152258 - protein, 9 aa, Mycobacterium
AAPAGRGLT

SEQ ID NO: 1152259 - protein, 25 aa, Mycobacterium
AAPAPAPLPPEAMPPAPVPPPPAPI

SEQ ID NO: 1152260 - protein, 12 aa, Mycobacterium
AAPAPDQPQPQN

SEQ ID NO: 1152261 - protein, 8 aa, Mycobacterium
AAPAPLPD

SEQ ID NO: 1152262 - protein, 7 aa, Mycobacterium
AAPATGA

SEQ ID NO: 1152263 - protein, 7 aa, Mycobacterium
AAPATVT

SEQ ID NO: 1152264 - protein, 4 aa, Mycobacterium
AAPD

SEQ ID NO: 1152265 - protein, 7 aa, Mycobacterium
AAPDADA

SEQ ID NO: 1152266 - protein, 6 aa, Mycobacterium
AAPDAR

SEQ ID NO: 1152267 - protein, 8 aa, Mycobacterium
AAPDDAAL

SEQ ID NO: 1152268 - protein, 9 aa, Mycobacterium
AAPDDDPHI

SEQ ID NO: 1152269 - protein, 6 aa, Mycobacterium
AAPDGV

SEQ ID NO: 1152270 - protein, 7 aa, Mycobacterium
AAPDSMA

SEQ ID NO: 1152271 - protein, 5 aa, Mycobacterium
AAPEI

SEQ ID NO: 1152272 - protein, 7 aa, Mycobacterium
AAPEQTQ

SEQ ID NO: 1152273 - protein, 6 aa, Mycobacterium
AAPEST

SEQ ID NO: 1152274 - protein, 6 aa, Mycobacterium
AAPFGG

SEQ ID NO: 1152275 - protein, 15 aa, Mycobacterium
AAPGEPDTSRFTIRV

SEQ ID NO: 1152276 - protein, 8 aa, Mycobacterium
AAPGGEPA

SEQ ID NO: 1152277 - protein, 25 aa, Mycobacterium
AAPGGTAAPPRRISRGTPDFAGETE

SEQ ID NO: 1152278 - protein, 6 aa, Mycobacterium
AAPGIT

SEQ ID NO: 1152279 - protein, 15 aa, Mycobacterium
AAPGPDGSPRPVARA

SEQ ID NO: 1152280 - protein, 11 aa, Mycobacterium
AAPGTTPSLDE

SEQ ID NO: 1152281 - protein, 9 aa, Mycobacterium
AAPGTVTAS

SEQ ID NO: 1152282 - protein, 9 aa, Mycobacterium
AAPHGAGGT

SEQ ID NO: 1152283 - protein, 17 aa, Mycobacterium
AAPHPAEVGAAEDHHRC

SEQ ID NO: 1152284 - protein, 6 aa, Mycobacterium
AAPISG

SEQ ID NO: 1152285 - protein, 6 aa, Mycobacterium
AAPLDA

SEQ ID NO: 1152286 - protein, 9 aa, Mycobacterium
AAPLGDAGT

SEQ ID NO: 1152287 - protein, 14 aa, Mycobacterium
AAPPAAHVSDDPAA

SEQ ID NO: 1152288 - protein, 8 aa, Mycobacterium
AAPPADVT

SEQ ID NO: 1152289 - protein, 8 aa, Mycobacterium
AAPPDRAR

SEQ ID NO: 1152290 - protein, 7 aa, Mycobacterium
AAPPERR

SEQ ID NO: 1152291 - protein, 6 aa, Mycobacterium
AAPPGP

SEQ ID NO: 1152292 - protein, 7 aa, Mycobacterium
AAPPHPV

SEQ ID NO: 1152293 - protein, 9 aa, Mycobacterium
AAPPLRPEQ

SEQ ID NO: 1152294 - protein, 9 aa, Mycobacterium
AAPPPASTR

SEQ ID NO: 1152295 - protein, 9 aa, Mycobacterium
AAPPPGHGP

SEQ ID NO: 1152296 - protein, 45 aa, Mycobacterium
AAPPPPPPPASYGAGYGSGYGYGPGWGHRGNKHYRKQGFGRLFFS

SEQ ID NO: 1152297 - protein, 5 aa, Mycobacterium
AAPPV

SEQ ID NO: 1152298 - protein, 11 aa, Mycobacterium
AAPQATTPALG

SEQ ID NO: 1152299 - protein, 6 aa, Mycobacterium
AAPRAF

SEQ ID NO: 1152300 - protein, 5 aa, Mycobacterium
AAPRI

SEQ ID NO: 1152301 - protein, 12 aa, Mycobacterium
AAPRLTAAGREA

SEQ ID NO: 1152302 - protein, 8 aa, Mycobacterium
AAPRSSSV

SEQ ID NO: 1152303 - protein, 9 aa, Mycobacterium
AAPSFTPGR

SEQ ID NO: 1152304 - protein, 9 aa, Mycobacterium
AAPTDALRR

SEQ ID NO: 1152305 - protein, 6 aa, Mycobacterium
AAPTEV

SEQ ID NO: 1152306 - protein, 7 aa, Mycobacterium
AAPTKYP

SEQ ID NO: 1152307 - protein, 7 aa, Mycobacterium
AAPTLDQ

SEQ ID NO: 1152308 - protein, 6 aa, Mycobacterium
AAQAAQ

SEQ ID NO: 1152309 - protein, 13 aa, Mycobacterium
AAQAELNSATERL

SEQ ID NO: 1152310 - protein, 9 aa, Mycobacterium
AAQAQETRR

SEQ ID NO: 1152311 - protein, 12 aa, Mycobacterium
AAQARADADKLG

SEQ ID NO: 1152312 - protein, 4 aa, Mycobacterium
AAQD

SEQ ID NO: 1152313 - protein, 5 aa, Mycobacterium
AAQDD

SEQ ID NO: 1152314 - protein, 8 aa, Mycobacterium
AAQDDAGV

SEQ ID NO: 1152315 - protein, 6 aa, Mycobacterium
AAQDDE

SEQ ID NO: 1152316 - protein, 8 aa, Mycobacterium
AAQDKGPW

SEQ ID NO: 1152317 - protein, 6 aa, Mycobacterium
AAQEGK

SEQ ID NO: 1152318 - protein, 7 aa, Mycobacterium
AAQGAKD

SEQ ID NO: 1152319 - protein, 7 aa, Mycobacterium
AAQGDGQ

SEQ ID NO: 1152320 - protein, 35 aa, Mycobacterium
AAQGIDPPPRTAAPAASTHTPTSPAGWTGARGEPT

SEQ ID NO: 1152321 - protein, 7 aa, Mycobacterium
AAQGMGA

SEQ ID NO: 1152322 - protein, 7 aa, Mycobacterium
AAQIGSG

SEQ ID NO: 1152323 - protein, 5 aa, Mycobacterium
AAQPK

SEQ ID NO: 1152324 - protein, 5 aa, Mycobacterium
AAQQA

SEQ ID NO: 1152325 - protein, 6 aa, Mycobacterium
AAQRAD

SEQ ID NO: 1152326 - protein, 23 aa, Mycobacterium
AAQRAQGAVQKGEQAAHQQPQDQ

SEQ ID NO: 1152327 - protein, 17 aa, Mycobacterium
AAQRCPQRRDSEALAAH

SEQ ID NO: 1152328 - protein, 10 aa, Mycobacterium
AAQRYSGTAD

SEQ ID NO: 1152329 - protein, 10 aa, Mycobacterium
AAQSGLRTDG

SEQ ID NO: 1152330 - protein, 8 aa, Mycobacterium
AAQSPTRA

SEQ ID NO: 1152331 - protein, 16 aa, Mycobacterium
AAQSTKAAGADRLSGR

SEQ ID NO: 1152332 - protein, 12 aa, Mycobacterium
AAQTANDPARSA

SEQ ID NO: 1152333 - protein, 6 aa, Mycobacterium
AAQTGA

SEQ ID NO: 1152334 - protein, 6 aa, Mycobacterium
AAQTRD

SEQ ID NO: 1152335 - protein, 10 aa, Mycobacterium
AAQTYSLPPT

SEQ ID NO: 1152336 - protein, 7 aa, Mycobacterium
AARAAHE

SEQ ID NO: 1152337 - protein, 11 aa, Mycobacterium
AARAASERTVT

SEQ ID NO: 1152338 - protein, 12 aa, Mycobacterium
AARADGRDPAAD

SEQ ID NO: 1152339 - protein, 22 aa, Mycobacterium
AARADGVRARGARWADSPADAI

SEQ ID NO: 1152340 - protein, 9 aa, Mycobacterium
AARADTTAE

SEQ ID NO: 1152341 - protein, 5 aa, Mycobacterium
AARAE

SEQ ID NO: 1152342 - protein, 6 aa, Mycobacterium
AARAER

SEQ ID NO: 1152343 - protein, 9 aa, Mycobacterium
AARAERDAI

SEQ ID NO: 1152344 - protein, 8 aa, Mycobacterium
AARAGGDV

SEQ ID NO: 1152345 - protein, 8 aa, Mycobacterium
AARAGLSA

SEQ ID NO: 1152346 - protein, 6 aa, Mycobacterium
AARAGV

SEQ ID NO: 1152347 - protein, 5 aa, Mycobacterium
AARAQ

SEQ ID NO: 1152348 - protein, 11 aa, Mycobacterium
AARARAGGGPT

SEQ ID NO: 1152349 - protein, 8 aa, Mycobacterium
AARARDAG

SEQ ID NO: 1152350 - protein, 8 aa, Mycobacterium
AARATART

SEQ ID NO: 1152351 - protein, 9 aa, Mycobacterium
AARCDTSAT

SEQ ID NO: 1152352 - protein, 10 aa, Mycobacterium
AARDAAGART

SEQ ID NO: 1152353 - protein, 14 aa, Mycobacterium
AARDAARTAERGGQ

SEQ ID NO: 1152354 - protein, 7 aa, Mycobacterium
AARDMPK

SEQ ID NO: 1152355 - protein, 6 aa, Mycobacterium
AARDQA

SEQ ID NO: 1152356 - protein, 7 aa, Mycobacterium
AARDSGI

SEQ ID NO: 1152357 - protein, 5 aa, Mycobacterium
AARED

SEQ ID NO: 1152358 - protein, 11 aa, Mycobacterium
AAREEAQAGAR

SEQ ID NO: 1152359 - protein, 10 aa, Mycobacterium
AAREIRSGRP

SEQ ID NO: 1152360 - protein, 7 aa, Mycobacterium
AAREPIK

SEQ ID NO: 1152361 - protein, 7 aa, Mycobacterium
AARERSA

SEQ ID NO: 1152362 - protein, 6 aa, Mycobacterium
AARFAS

SEQ ID NO: 1152363 - protein, 4 aa, Mycobacterium
AARG

SEQ ID NO: 1152364 - protein, 7 aa, Mycobacterium
AARGPED

SEQ ID NO: 1152365 - protein, 10 aa, Mycobacterium
AARGQGRAHA

SEQ ID NO: 1152366 - protein, 8 aa, Mycobacterium
AARGQGRS

SEQ ID NO: 1152367 - protein, 9 aa, Mycobacterium
AARGRGADH

SEQ ID NO: 1152368 - protein, 10 aa, Mycobacterium
AARGVDDAGA

SEQ ID NO: 1152369 - protein, 6 aa, Mycobacterium
AARHPE

SEQ ID NO: 1152370 - protein, 6 aa, Mycobacterium
AARHTE

SEQ ID NO: 1152371 - protein, 11 aa, Mycobacterium
AARKAKAQTSF

SEQ ID NO: 1152372 - protein, 8 aa, Mycobacterium
AARLGSAT

SEQ ID NO: 1152373 - protein, 12 aa, Mycobacterium
AARPAPSHDLSR

SEQ ID NO: 1152374 - protein, 5 aa, Mycobacterium
AARPE

SEQ ID NO: 1152375 - protein, 9 aa, Mycobacterium
AARPGNRLG

SEQ ID NO: 1152376 - protein, 7 aa, Mycobacterium
AARPGQT

SEQ ID NO: 1152377 - protein, 6 aa, Mycobacterium
AARPLS

SEQ ID NO: 1152378 - protein, 6 aa, Mycobacterium
AARPPA

SEQ ID NO: 1152379 - protein, 7 aa, Mycobacterium
AARPQDD

SEQ ID NO: 1152380 - protein, 14 aa, Mycobacterium
AARQGAKPEPNQCD

SEQ ID NO: 1152381 - protein, 9 aa, Mycobacterium
AARQSRRAH

SEQ ID NO: 1152382 - protein, 5 aa, Mycobacterium
AARRA

SEQ ID NO: 1152383 - protein, 16 aa, Mycobacterium
AARRAAAETSDANPEA

SEQ ID NO: 1152384 - protein, 6 aa, Mycobacterium
AARRDG

SEQ ID NO: 1152385 - protein, 9 aa, Mycobacterium
AARREGDEV

SEQ ID NO: 1152386 - protein, 5 aa, Mycobacterium
AARRG

SEQ ID NO: 1152387 - protein, 22 aa, Mycobacterium
AARRGEDVADELDSTPPTRITE

SEQ ID NO: 1152388 - protein, 9 aa, Mycobacterium
AARRGRADE

SEQ ID NO: 1152389 - protein, 24 aa, Mycobacterium
AARRPAGEPVAPDDDLADDTARAR

SEQ ID NO: 1152390 - protein, 7 aa, Mycobacterium
AARRRGA

SEQ ID NO: 1152391 - protein, 8 aa, Mycobacterium
AARRSGAR

SEQ ID NO: 1152392 - protein, 11 aa, Mycobacterium
AARRTGAQAVH

SEQ ID NO: 1152393 - protein, 6 aa, Mycobacterium
AARSGI

SEQ ID NO: 1152394 - protein, 20 aa, Mycobacterium
AARSPQSQDSATTHIGFRCV

SEQ ID NO: 1152395 - protein, 14 aa, Mycobacterium
AARSTRPQPGRDDK

SEQ ID NO: 1152396 - protein, 7 aa, Mycobacterium
AARTAER

SEQ ID NO: 1152397 - protein, 11 aa, Mycobacterium
AARTANGERPG

SEQ ID NO: 1152398 - protein, 19 aa, Mycobacterium
AARTDAAAAYESTASGEFT

SEQ ID NO: 1152399 - protein, 10 aa, Mycobacterium
AARTDDAGRP

SEQ ID NO: 1152400 - protein, 7 aa, Mycobacterium
AARTGAT

SEQ ID NO: 1152401 - protein, 5 aa, Mycobacterium
AARTH

SEQ ID NO: 1152402 - protein, 8 aa, Mycobacterium
AARTRPRS

SEQ ID NO: 1152403 - protein, 5 aa, Mycobacterium
AARTS

SEQ ID NO: 1152404 - protein, 13 aa, Mycobacterium
AARTSKDVRPADI

SEQ ID NO: 1152405 - protein, 6 aa, Mycobacterium
AARTST

SEQ ID NO: 1152406 - protein, 6 aa, Mycobacterium
AARVSR

SEQ ID NO: 1152407 - protein, 6 aa, Mycobacterium
AARWST

SEQ ID NO: 1152408 - protein, 5 aa, Mycobacterium
AASAA

SEQ ID NO: 1152409 - protein, 17 aa, Mycobacterium
AASAAPRERHPHRFVDT

SEQ ID NO: 1152410 - protein, 6 aa, Mycobacterium
AASAGV

SEQ ID NO: 1152411 - protein, 7 aa, Mycobacterium
AASASLA

SEQ ID NO: 1152412 - protein, 8 aa, Mycobacterium
AASASTQI

SEQ ID NO: 1152413 - protein, 14 aa, Mycobacterium
AASDASGGGSPLSA

SEQ ID NO: 1152414 - protein, 9 aa, Mycobacterium
AASDHTGRA

SEQ ID NO: 1152415 - protein, 11 aa, Mycobacterium
AASDLDGDART

SEQ ID NO: 1152416 - protein, 9 aa, Mycobacterium
AASEPADKR

SEQ ID NO: 1152417 - protein, 21 aa, Mycobacterium
AASESASRRRAMKSASDNADD

SEQ ID NO: 1152418 - protein, 9 aa, Mycobacterium
AASFGSAPR

SEQ ID NO: 1152419 - protein, 10 aa, Mycobacterium
AASGAPGTRV

SEQ ID NO: 1152420 - protein, 6 aa, Mycobacterium
AASGAT

SEQ ID NO: 1152421 - protein, 7 aa, Mycobacterium
AASGIGK

SEQ ID NO: 1152422 - protein, 8 aa, Mycobacterium
AASGIGQA

SEQ ID NO: 1152423 - protein, 8 aa, Mycobacterium
AASGIGRA

SEQ ID NO: 1152424 - protein, 6 aa, Mycobacterium
AASGPR

SEQ ID NO: 1152425 - protein, 7 aa, Mycobacterium
AASGWTA

SEQ ID NO: 1152426 - protein, 13 aa, Mycobacterium
AASHGGVDDTREL

SEQ ID NO: 1152427 - protein, 7 aa, Mycobacterium
AASHQSA

SEQ ID NO: 1152428 - protein, 11 aa, Mycobacterium
AASLGGGTTEI

SEQ ID NO: 1152429 - protein, 7 aa, Mycobacterium
AASLTEL

SEQ ID NO: 1152430 - protein, 7 aa, Mycobacterium
AASPAGW

SEQ ID NO: 1152431 - protein, 6 aa, Mycobacterium
AASPDV

SEQ ID NO: 1152432 - protein, 7 aa, Mycobacterium
AASQELR

SEQ ID NO: 1152433 - protein, 37 aa, Mycobacterium
AASQYSTVGTHDGSNAELRPFPGRRGAPRKPGRAVAG

SEQ ID NO: 1152434 - protein, 5 aa, Mycobacterium
AASRC

SEQ ID NO: 1152435 - protein, 11 aa, Mycobacterium
AASREAESAFG

SEQ ID NO: 1152436 - protein, 5 aa, Mycobacterium
AASRG

SEQ ID NO: 1152437 - protein, 10 aa, Mycobacterium
AASSAAMGQT

SEQ ID NO: 1152438 - protein, 8 aa, Mycobacterium
AASSAEGA

SEQ ID NO: 1152439 - protein, 7 aa, Mycobacterium
AASSPID

SEQ ID NO: 1152440 - protein, 7 aa, Mycobacterium
AASTDPV

SEQ ID NO: 1152441 - protein, 14 aa, Mycobacterium
AASTGEFDDDASAL

SEQ ID NO: 1152442 - protein, 7 aa, Mycobacterium
AASVDTV

SEQ ID NO: 1152443 - protein, 5 aa, Mycobacterium
AASVG

SEQ ID NO: 1152444 - protein, 14 aa, Mycobacterium
AASVQGAGDPPPVE

SEQ ID NO: 1152445 - protein, 5 aa, Mycobacterium
AASYI

SEQ ID NO: 1152446 - protein, 7 aa, Mycobacterium
AASYISG

SEQ ID NO: 1152447 - protein, 5 aa, Mycobacterium
AATAE

SEQ ID NO: 1152448 - protein, 7 aa, Mycobacterium
AATAEGA

SEQ ID NO: 1152449 - protein, 8 aa, Mycobacterium
AATAEHEP

SEQ ID NO: 1152450 - protein, 6 aa, Mycobacterium
AATAGW

SEQ ID NO: 1152451 - protein, 21 aa, Mycobacterium
AATAKPPGDSFKDGSYDPSRI

SEQ ID NO: 1152452 - protein, 5 aa, Mycobacterium
AATAR

SEQ ID NO: 1152453 - protein, 12 aa, Mycobacterium
AATATQGGTPIG

SEQ ID NO: 1152454 - protein, 7 aa, Mycobacterium
AATDDEE

SEQ ID NO: 1152455 - protein, 6 aa, Mycobacterium
AATDDV

SEQ ID NO: 1152456 - protein, 9 aa, Mycobacterium
AATDDYQSL

SEQ ID NO: 1152457 - protein, 13 aa, Mycobacterium
AATDISRDRITGN

SEQ ID NO: 1152458 - protein, 26 aa, Mycobacterium
AATDPDVRGGQYYGPDGIGEQRGHPK

SEQ ID NO: 1152459 - protein, 10 aa, Mycobacterium
AATDPTVRGG

SEQ ID NO: 1152460 - protein, 18 aa, Mycobacterium
AATDSAVDGVPDATLAQD

SEQ ID NO: 1152461 - protein, 21 aa, Mycobacterium
AATEDRYSDGTGSSSGSGSIS

SEQ ID NO: 1152462 - protein, 7 aa, Mycobacterium
AATENAV

SEQ ID NO: 1152463 - protein, 15 aa, Mycobacterium
AATEQDPARVVNTGS

SEQ ID NO: 1152464 - protein, 8 aa, Mycobacterium
AATEREYR

SEQ ID NO: 1152465 - protein, 9 aa, Mycobacterium
AATESQRGN

SEQ ID NO: 1152466 - protein, 6 aa, Mycobacterium
AATETD

SEQ ID NO: 1152467 - protein, 26 aa, Mycobacterium
AATETDLKKRKEAVEDAVSAAKAAVE

SEQ ID NO: 1152468 - protein, 6 aa, Mycobacterium
AATETR

SEQ ID NO: 1152469 - protein, 9 aa, Mycobacterium
AATFGTPDV

SEQ ID NO: 1152470 - protein, 8 aa, Mycobacterium
AATGGTDV

SEQ ID NO: 1152471 - protein, 9 aa, Mycobacterium
AATGGVARG

SEQ ID NO: 1152472 - protein, 6 aa, Mycobacterium
AATGQM

SEQ ID NO: 1152473 - protein, 5 aa, Mycobacterium
AATGR

SEQ ID NO: 1152474 - protein, 6 aa, Mycobacterium
AATGRL

SEQ ID NO: 1152475 - protein, 8 aa, Mycobacterium
AATGTVRP

SEQ ID NO: 1152476 - protein, 14 aa, Mycobacterium
AATGVSAADTAPLA

SEQ ID NO: 1152477 - protein, 8 aa, Mycobacterium
AATHTGAS

SEQ ID NO: 1152478 - protein, 8 aa, Mycobacterium
AATITPPG

SEQ ID NO: 1152479 - protein, 8 aa, Mycobacterium
AATKPDRL

SEQ ID NO: 1152480 - protein, 6 aa, Mycobacterium
AATKPY

SEQ ID NO: 1152481 - protein, 11 aa, Mycobacterium
AATLSGGEAQR

SEQ ID NO: 1152482 - protein, 8 aa, Mycobacterium
AATNHNTR

SEQ ID NO: 1152483 - protein, 10 aa, Mycobacterium
AATPALPSDT

SEQ ID NO: 1152484 - protein, 5 aa, Mycobacterium
AATPL

SEQ ID NO: 1152485 - protein, 17 aa, Mycobacterium
AATPPAASEAVRSPRRS

SEQ ID NO: 1152486 - protein, 17 aa, Mycobacterium
AATPTDAAKRVVPDAAA

SEQ ID NO: 1152487 - protein, 6 aa, Mycobacterium
AATQAT

SEQ ID NO: 1152488 - protein, 8 aa, Mycobacterium
AATRGGQR

SEQ ID NO: 1152489 - protein, 8 aa, Mycobacterium
AATRRGLD

SEQ ID NO: 1152490 - protein, 7 aa, Mycobacterium
AATRYGA

SEQ ID NO: 1152491 - protein, 11 aa, Mycobacterium
AATSAARRRGW

SEQ ID NO: 1152492 - protein, 13 aa, Mycobacterium
AATSEGRSPDGLV

SEQ ID NO: 1152493 - protein, 13 aa, Mycobacterium
AATSVAERVGGAQ

SEQ ID NO: 1152494 - protein, 8 aa, Mycobacterium
AATTQAAC

SEQ ID NO: 1152495 - protein, 6 aa, Mycobacterium
AATVEE

SEQ ID NO: 1152496 - protein, 5 aa, Mycobacterium
AATVP

SEQ ID NO: 1152497 - protein, 9 aa, Mycobacterium
AATVSSGSI

SEQ ID NO: 1152498 - protein, 7 aa, Mycobacterium
AAVDGSS

SEQ ID NO: 1152499 - protein, 12 aa, Mycobacterium
AAVEKAAKDAGY

SEQ ID NO: 1152500 - protein, 6 aa, Mycobacterium
AAVGAD

SEQ ID NO: 1152501 - protein, 15 aa, Mycobacterium
AAVGDGAMGVGEENG

SEQ ID NO: 1152502 - protein, 8 aa, Mycobacterium
AAVGETRP

SEQ ID NO: 1152503 - protein, 13 aa, Mycobacterium
AAVGGAPESMGSR

SEQ ID NO: 1152504 - protein, 6 aa, Mycobacterium
AAVGPG

SEQ ID NO: 1152505 - protein, 5 aa, Mycobacterium
AAVGR

SEQ ID NO: 1152506 - protein, 11 aa, Mycobacterium
AAVGRPAPTKA

SEQ ID NO: 1152507 - protein, 5 aa, Mycobacterium
AAVPP

SEQ ID NO: 1152508 - protein, 8 aa, Mycobacterium
AAVPPGSE

SEQ ID NO: 1152509 - protein, 6 aa, Mycobacterium
AAVSGS

SEQ ID NO: 1152510 - protein, 21 aa, Mycobacterium
AAVSPYGAGALAGSSLGLDPD

SEQ ID NO: 1152511 - protein, 5 aa, Mycobacterium
AAVSR

SEQ ID NO: 1152512 - protein, 9 aa, Mycobacterium
AAVSRGVGT

SEQ ID NO: 1152513 - protein, 14 aa, Mycobacterium
AAVTECERGTDLTT

SEQ ID NO: 1152514 - protein, 5 aa, Mycobacterium
AAVTG

SEQ ID NO: 1152515 - protein, 8 aa, Mycobacterium
AAWAESAT

SEQ ID NO: 1152516 - protein, 9 aa, Mycobacterium
AAWGGSGSR

SEQ ID NO: 1152517 - protein, 15 aa, Mycobacterium
AAWGNRQTVGADGGA

SEQ ID NO: 1152518 - protein, 12 aa, Mycobacterium
AAYEEKDKDRSV

SEQ ID NO: 1152519 - protein, 20 aa, Mycobacterium
AAYGNEEQTGRAIAQSGLDR

SEQ ID NO: 1152520 - protein, 14 aa, Mycobacterium
AAYRDGADAAARAG

SEQ ID NO: 1152521 - protein, 6 aa, Mycobacterium
ACDEGD

SEQ ID NO: 1152522 - protein, 15 aa, Mycobacterium
ACEPGQAPITVEAKR

SEQ ID NO: 1152523 - protein, 7 aa, Mycobacterium
ACERRSE

SEQ ID NO: 1152524 - protein, 4 aa, Mycobacterium
ACGT

SEQ ID NO: 1152525 - protein, 9 aa, Mycobacterium
ACPGPTGEV

SEQ ID NO: 1152526 - protein, 9 aa, Mycobacterium
ACSSGSEAI

SEQ ID NO: 1152527 - protein, 10 aa, Mycobacterium
ADAAAAPGEQ

SEQ ID NO: 1152528 - protein, 11 aa, Mycobacterium
ADAAEATARGL

SEQ ID NO: 1152529 - protein, 20 aa, Mycobacterium
ADAAEQTDAEVEDADSLPTT

SEQ ID NO: 1152530 - protein, 7 aa, Mycobacterium
ADAAETH

SEQ ID NO: 1152531 - protein, 9 aa, Mycobacterium
ADAAHSADL

SEQ ID NO: 1152532 - protein, 12 aa, Mycobacterium
ADAALGSGWASG

SEQ ID NO: 1152533 - protein, 6 aa, Mycobacterium
ADAALR

SEQ ID NO: 1152534 - protein, 8 aa, Mycobacterium
ADAAPTRF

SEQ ID NO: 1152535 - protein, 7 aa, Mycobacterium
ADAARAR

SEQ ID NO: 1152536 - protein, 13 aa, Mycobacterium
ADAARARETSRAP

SEQ ID NO: 1152537 - protein, 9 aa, Mycobacterium
ADAATALGL

SEQ ID NO: 1152538 - protein, 11 aa, Mycobacterium
ADAATALSDAS

SEQ ID NO: 1152539 - protein, 5 aa, Mycobacterium
ADADA

SEQ ID NO: 1152540 - protein, 13 aa, Mycobacterium
ADADDDDSDHDMG

SEQ ID NO: 1152541 - protein, 13 aa, Mycobacterium
ADADDRAKVAERL

SEQ ID NO: 1152542 - protein, 5 aa, Mycobacterium
ADADE

SEQ ID NO: 1152543 - protein, 15 aa, Mycobacterium
ADADGTPRQATAEDA

SEQ ID NO: 1152544 - protein, 10 aa, Mycobacterium
ADADSDDMGR

SEQ ID NO: 1152545 - protein, 6 aa, Mycobacterium
ADAEHT

SEQ ID NO: 1152546 - protein, 13 aa, Mycobacterium
ADAERRGETPYDP

SEQ ID NO: 1152547 - protein, 12 aa, Mycobacterium
ADAESRARLEQR

SEQ ID NO: 1152548 - protein, 7 aa, Mycobacterium
ADAGAAT

SEQ ID NO: 1152549 - protein, 10 aa, Mycobacterium
ADAGATALSA

SEQ ID NO: 1152550 - protein, 6 aa, Mycobacterium
ADAGEL

SEQ ID NO: 1152551 - protein, 7 aa, Mycobacterium
ADAHADG

SEQ ID NO: 1152552 - protein, 5 aa, Mycobacterium
ADAPA

SEQ ID NO: 1152553 - protein, 10 aa, Mycobacterium
ADAPAHGVAD

SEQ ID NO: 1152554 - protein, 8 aa, Mycobacterium
ADAPENYA

SEQ ID NO: 1152555 - protein, 14 aa, Mycobacterium
ADAPERMSAEGIRP

SEQ ID NO: 1152556 - protein, 5 aa, Mycobacterium
ADAPV

SEQ ID NO: 1152557 - protein, 4 aa, Mycobacterium
ADAQ

SEQ ID NO: 1152558 - protein, 7 aa, Mycobacterium
ADAQDAV

SEQ ID NO: 1152559 - protein, 17 aa, Mycobacterium
ADAQGNTGDFASADADP

SEQ ID NO: 1152560 - protein, 6 aa, Mycobacterium
ADARDE

SEQ ID NO: 1152561 - protein, 5 aa, Mycobacterium
ADARG

SEQ ID NO: 1152562 - protein, 4 aa, Mycobacterium
ADAS

SEQ ID NO: 1152563 - protein, 10 aa, Mycobacterium
ADASDEPSMT

SEQ ID NO: 1152564 - protein, 9 aa, Mycobacterium
ADASDPEAE

SEQ ID NO: 1152565 - protein, 5 aa, Mycobacterium
ADASP

SEQ ID NO: 1152566 - protein, 8 aa, Mycobacterium
ADASRAAY

SEQ ID NO: 1152567 - protein, 8 aa, Mycobacterium
ADASRADM

SEQ ID NO: 1152568 - protein, 9 aa, Mycobacterium
ADASTDEGI

SEQ ID NO: 1152569 - protein, 10 aa, Mycobacterium
ADATAEPPSC

SEQ ID NO: 1152570 - protein, 7 aa, Mycobacterium
ADATGSV

SEQ ID NO: 1152571 - protein, 8 aa, Mycobacterium
ADATGTAI

SEQ ID NO: 1152572 - protein, 13 aa, Mycobacterium
ADATKVEERPDDR

SEQ ID NO: 1152573 - protein, 8 aa, Mycobacterium
ADATTRGQ

SEQ ID NO: 1152574 - protein, 7 aa, Mycobacterium
ADAVDDE

SEQ ID NO: 1152575 - protein, 52 aa, Mycobacterium
ADAYASSTQVSGIDQGGMDTDADEVPPTDGTGTGTDTGTDGTGTTVDTSPAA

SEQ ID NO: 1152576 - protein, 6 aa, Mycobacterium
ADDAAV

SEQ ID NO: 1152577 - protein, 25 aa, Mycobacterium
ADDAEREEAVRRATAAAEDNAKALN

SEQ ID NO: 1152578 - protein, 6 aa, Mycobacterium
ADDATL

SEQ ID NO: 1152579 - protein, 15 aa, Mycobacterium
ADDATPPADWDKPLQ

SEQ ID NO: 1152580 - protein, 9 aa, Mycobacterium
ADDDAARAL

SEQ ID NO: 1152581 - protein, 11 aa, Mycobacterium
ADDDLKPASDM

SEQ ID NO: 1152582 - protein, 8 aa, Mycobacterium
ADDDLPGK

SEQ ID NO: 1152583 - protein, 9 aa, Mycobacterium
ADDEERTVG

SEQ ID NO: 1152584 - protein, 4 aa, Mycobacterium
ADDG

SEQ ID NO: 1152585 - protein, 11 aa, Mycobacterium
ADDGGSSGRLR

SEQ ID NO: 1152586 - protein, 7 aa, Mycobacterium
ADDGHSY

SEQ ID NO: 1152587 - protein, 8 aa, Mycobacterium
ADDGRPAV

SEQ ID NO: 1152588 - protein, 8 aa, Mycobacterium
ADDGSGEG

SEQ ID NO: 1152589 - protein, 5 aa, Mycobacterium
ADDGT

SEQ ID NO: 1152590 - protein, 13 aa, Mycobacterium
ADDGTVLGPGETG

SEQ ID NO: 1152591 - protein, 6 aa, Mycobacterium
ADDLAR

SEQ ID NO: 1152592 - protein, 7 aa, Mycobacterium
ADDNGRG

SEQ ID NO: 1152593 - protein, 5 aa, Mycobacterium
ADDNQ

SEQ ID NO: 1152594 - protein, 6 aa, Mycobacterium
ADDPAA

SEQ ID NO: 1152595 - protein, 7 aa, Mycobacterium
ADDPARL

SEQ ID NO: 1152596 - protein, 6 aa, Mycobacterium
ADDPEF

SEQ ID NO: 1152597 - protein, 7 aa, Mycobacterium
ADDPGFA

SEQ ID NO: 1152598 - protein, 7 aa, Mycobacterium
ADDPPLT

SEQ ID NO: 1152599 - protein, 10 aa, Mycobacterium
ADDPPPDPVG

SEQ ID NO: 1152600 - protein, 8 aa, Mycobacterium
ADDPQTSL

SEQ ID NO: 1152601 - protein, 8 aa, Mycobacterium
ADDPRGLT

SEQ ID NO: 1152602 - protein, 8 aa, Mycobacterium
ADDPRRRL

SEQ ID NO: 1152603 - protein, 8 aa, Mycobacterium
ADDRAALG

SEQ ID NO: 1152604 - protein, 6 aa, Mycobacterium
ADDRAG

SEQ ID NO: 1152605 - protein, 9 aa, Mycobacterium
ADDRPTPSV

SEQ ID NO: 1152606 - protein, 7 aa, Mycobacterium
ADDSGLE

SEQ ID NO: 1152607 - protein, 7 aa, Mycobacterium
ADEAAAA

SEQ ID NO: 1152608 - protein, 8 aa, Mycobacterium
ADEADSDV

SEQ ID NO: 1152609 - protein, 8 aa, Mycobacterium
ADEAHDDE

SEQ ID NO: 1152610 - protein, 6 aa, Mycobacterium
ADEANR

SEQ ID NO: 1152611 - protein, 12 aa, Mycobacterium
ADEARAAGREIP

SEQ ID NO: 1152612 - protein, 11 aa, Mycobacterium
ADEDGNTFSDQ

SEQ ID NO: 1152613 - protein, 11 aa, Mycobacterium
ADEDSDDTPLE

SEQ ID NO: 1152614 - protein, 46 aa, Mycobacterium
ADEEAQAERARRDEQRAAQLARKETLAAEAEDIATNSTQWKTAGDR

SEQ ID NO: 1152615 - protein, 6 aa, Mycobacterium
ADEEDR

SEQ ID NO: 1152616 - protein, 5 aa, Mycobacterium
ADEER

SEQ ID NO: 1152617 - protein, 8 aa, Mycobacterium
ADEERGLG

SEQ ID NO: 1152618 - protein, 6 aa, Mycobacterium
ADEETT

SEQ ID NO: 1152619 - protein, 9 aa, Mycobacterium
ADEEVAPDH

SEQ ID NO: 1152620 - protein, 5 aa, Mycobacterium
ADEGL

SEQ ID NO: 1152621 - protein, 16 aa, Mycobacterium
ADEGPTAKRIRPRAQG

SEQ ID NO: 1152622 - protein, 8 aa, Mycobacterium
ADEGWSSP

SEQ ID NO: 1152623 - protein, 4 aa, Mycobacterium
ADEH

SEQ ID NO: 1152624 - protein, 5 aa, Mycobacterium
ADEHR

SEQ ID NO: 1152625 - protein, 7 aa, Mycobacterium
ADEKERA

SEQ ID NO: 1152626 - protein, 9 aa, Mycobacterium
ADEKGAALE

SEQ ID NO: 1152627 - protein, 16 aa, Mycobacterium
ADELGQAAAALAEAAR

SEQ ID NO: 1152628 - protein, 9 aa, Mycobacterium
ADEPADGAV

SEQ ID NO: 1152629 - protein, 15 aa, Mycobacterium
ADEPAPDPADLARQA

SEQ ID NO: 1152630 - protein, 15 aa, Mycobacterium
ADEPAQAPAPEVPAP

SEQ ID NO: 1152631 - protein, 6 aa, Mycobacterium
ADEPDT

SEQ ID NO: 1152632 - protein, 7 aa, Mycobacterium
ADEPGEV

SEQ ID NO: 1152633 - protein, 7 aa, Mycobacterium
ADEPGTI

SEQ ID NO: 1152634 - protein, 8 aa, Mycobacterium
ADEPSREI

SEQ ID NO: 1152635 - protein, 7 aa, Mycobacterium
ADEPTRP

SEQ ID NO: 1152636 - protein, 6 aa, Mycobacterium
ADEPYS

SEQ ID NO: 1152637 - protein, 18 aa, Mycobacterium
ADESARSSGALHNVFLPT

SEQ ID NO: 1152638 - protein, 7 aa, Mycobacterium
ADESGRI

SEQ ID NO: 1152639 - protein, 4 aa, Mycobacterium
ADET

SEQ ID NO: 1152640 - protein, 7 aa, Mycobacterium
ADETDRW

SEQ ID NO: 1152641 - protein, 9 aa, Mycobacterium
ADETPQTSA

SEQ ID NO: 1152642 - protein, 11 aa, Mycobacterium
ADETSERSVRN

SEQ ID NO: 1152643 - protein, 11 aa, Mycobacterium
ADEVASALSGT

SEQ ID NO: 1152644 - protein, 5 aa, Mycobacterium
ADEVS

SEQ ID NO: 1152645 - protein, 6 aa, Mycobacterium
ADEVTD

SEQ ID NO: 1152646 - protein, 7 aa, Mycobacterium
ADFDDAD

SEQ ID NO: 1152647 - protein, 5 aa, Mycobacterium
ADFPA

SEQ ID NO: 1152648 - protein, 10 aa, Mycobacterium
ADGAAQLADA

SEQ ID NO: 1152649 - protein, 13 aa, Mycobacterium
ADGAAVDEDTPFN

SEQ ID NO: 1152650 - protein, 6 aa, Mycobacterium
ADGADA

SEQ ID NO: 1152651 - protein, 8 aa, Mycobacterium
ADGADFDR

SEQ ID NO: 1152652 - protein, 9 aa, Mycobacterium
ADGAGGTVT

SEQ ID NO: 1152653 - protein, 5 aa, Mycobacterium
ADGAP

SEQ ID NO: 1152654 - protein, 8 aa, Mycobacterium
ADGASLTQ

SEQ ID NO: 1152655 - protein, 9 aa, Mycobacterium
ADGASNRQL

SEQ ID NO: 1152656 - protein, 6 aa, Mycobacterium
ADGAVA

SEQ ID NO: 1152657 - protein, 6 aa, Mycobacterium
ADGAWT

SEQ ID NO: 1152658 - protein, 6 aa, Mycobacterium
ADGDAH

SEQ ID NO: 1152659 - protein, 15 aa, Mycobacterium
ADGDGSVLALRRTAR

SEQ ID NO: 1152660 - protein, 8 aa, Mycobacterium
ADGDPSGR

SEQ ID NO: 1152661 - protein, 6 aa, Mycobacterium
ADGDPT

SEQ ID NO: 1152662 - protein, 15 aa, Mycobacterium
ADGDTTLDELDGTGP

SEQ ID NO: 1152663 - protein, 5 aa, Mycobacterium
ADGDW

SEQ ID NO: 1152664 - protein, 7 aa, Mycobacterium
ADGEAGL

SEQ ID NO: 1152665 - protein, 8 aa, Mycobacterium
ADGEFGDD

SEQ ID NO: 1152666 - protein, 16 aa, Mycobacterium
ADGEHAIEAKSAAREL

SEQ ID NO: 1152667 - protein, 13 aa, Mycobacterium
ADGEKAAASAGRT

SEQ ID NO: 1152668 - protein, 7 aa, Mycobacterium
ADGEKLD

SEQ ID NO: 1152669 - protein, 7 aa, Mycobacterium
ADGELSG

SEQ ID NO: 1152670 - protein, 8 aa, Mycobacterium
ADGEPGEV

SEQ ID NO: 1152671 - protein, 6 aa, Mycobacterium
ADGESL

SEQ ID NO: 1152672 - protein, 18 aa, Mycobacterium
ADGETPYEPAVAKGERGP

SEQ ID NO: 1152673 - protein, 9 aa, Mycobacterium
ADGFDAESG

SEQ ID NO: 1152674 - protein, 6 aa, Mycobacterium
ADGGAA

SEQ ID NO: 1152675 - protein, 9 aa, Mycobacterium
ADGGEGTVD

SEQ ID NO: 1152676 - protein, 8 aa, Mycobacterium
ADGGEISA

SEQ ID NO: 1152677 - protein, 7 aa, Mycobacterium
ADGGGEG

SEQ ID NO: 1152678 - protein, 9 aa, Mycobacterium
ADGGGGSVE

SEQ ID NO: 1152679 - protein, 6 aa, Mycobacterium
ADGGPL

SEQ ID NO: 1152680 - protein, 18 aa, Mycobacterium
ADGGPRPVTSRRQGRTDV

SEQ ID NO: 1152681 - protein, 8 aa, Mycobacterium
ADGGRLQP

SEQ ID NO: 1152682 - protein, 14 aa, Mycobacterium
ADGHGKAARDCTAD

SEQ ID NO: 1152683 - protein, 6 aa, Mycobacterium
ADGIAE

SEQ ID NO: 1152684 - protein, 9 aa, Mycobacterium
ADGIDAERA

SEQ ID NO: 1152685 - protein, 7 aa, Mycobacterium
ADGKADR

SEQ ID NO: 1152686 - protein, 5 aa, Mycobacterium
ADGKV

SEQ ID NO: 1152687 - protein, 7 aa, Mycobacterium
ADGLRAG

SEQ ID NO: 1152688 - protein, 9 aa, Mycobacterium
ADGLTGAQA

SEQ ID NO: 1152689 - protein, 8 aa, Mycobacterium
ADGNPLSS

SEQ ID NO: 1152690 - protein, 48 aa, Mycobacterium
ADGPAALPPLPRSAPRRRPQTHSHTRNRRRDESSQTPPGRRTNGCGQG

SEQ ID NO: 1152691 - protein, 8 aa, Mycobacterium
ADGPAARE

SEQ ID NO: 1152692 - protein, 7 aa, Mycobacterium
ADGPLDA

SEQ ID NO: 1152693 - protein, 6 aa, Mycobacterium
ADGPLP

SEQ ID NO: 1152694 - protein, 6 aa, Mycobacterium
ADGPMT

SEQ ID NO: 1152695 - protein, 6 aa, Mycobacterium
ADGPRD

SEQ ID NO: 1152696 - protein, 7 aa, Mycobacterium
ADGQVDD

SEQ ID NO: 1152697 - protein, 5 aa, Mycobacterium
ADGRA

SEQ ID NO: 1152698 - protein, 13 aa, Mycobacterium
ADGRHTAGEDGLR

SEQ ID NO: 1152699 - protein, 6 aa, Mycobacterium
ADGRLT

SEQ ID NO: 1152700 - protein, 9 aa, Mycobacterium
ADGRSDALD

SEQ ID NO: 1152701 - protein, 7 aa, Mycobacterium
ADGSAQR

SEQ ID NO: 1152702 - protein, 8 aa, Mycobacterium
ADGSATAV

SEQ ID NO: 1152703 - protein, 9 aa, Mycobacterium
ADGSHAPEQ

SEQ ID NO: 1152704 - protein, 19 aa, Mycobacterium
ADGSLATADAADTAAQPCY

SEQ ID NO: 1152705 - protein, 18 aa, Mycobacterium
ADGSPSAQQRYSRDLPPE

SEQ ID NO: 1152706 - protein, 8 aa, Mycobacterium
ADGSRPRE

SEQ ID NO: 1152707 - protein, 15 aa, Mycobacterium
ADGSRPSLISAGPDG

SEQ ID NO: 1152708 - protein, 11 aa, Mycobacterium
ADGSSAAGYYP

SEQ ID NO: 1152709 - protein, 7 aa, Mycobacterium
ADGSVTA

SEQ ID NO: 1152710 - protein, 9 aa, Mycobacterium
ADGSYGRAE

SEQ ID NO: 1152711 - protein, 6 aa, Mycobacterium
ADGTAA

SEQ ID NO: 1152712 - protein, 7 aa, Mycobacterium
ADGTALS

SEQ ID NO: 1152713 - protein, 9 aa, Mycobacterium
ADGTKDPEF

SEQ ID NO: 1152714 - protein, 6 aa, Mycobacterium
ADGTLD

SEQ ID NO: 1152715 - protein, 5 aa, Mycobacterium
ADGTQ

SEQ ID NO: 1152716 - protein, 6 aa, Mycobacterium
ADGTRR

SEQ ID NO: 1152717 - protein, 5 aa, Mycobacterium
ADGTS

SEQ ID NO: 1152718 - protein, 6 aa, Mycobacterium
ADGTTM

SEQ ID NO: 1152719 - protein, 21 aa, Mycobacterium
ADGTTRVPGVAPNSLTSSDWR

SEQ ID NO: 1152720 - protein, 6 aa, Mycobacterium
ADGVAP

SEQ ID NO: 1152721 - protein, 18 aa, Mycobacterium
ADGVEVGAKDAKMGQEGA

SEQ ID NO: 1152722 - protein, 7 aa, Mycobacterium
ADGVPDW

SEQ ID NO: 1152723 - protein, 5 aa, Mycobacterium
ADGVT

SEQ ID NO: 1152724 - protein, 7 aa, Mycobacterium
ADGVTGE

SEQ ID NO: 1152725 - protein, 9 aa, Mycobacterium
ADGVTGGAV

SEQ ID NO: 1152726 - protein, 12 aa, Mycobacterium
ADGWADAPYRSD

SEQ ID NO: 1152727 - protein, 6 aa, Mycobacterium
ADGYQL

SEQ ID NO: 1152728 - protein, 4 aa, Mycobacterium
ADHA

SEQ ID NO: 1152729 - protein, 5 aa, Mycobacterium
ADHGD

SEQ ID NO: 1152730 - protein, 7 aa, Mycobacterium
ADHGGRG

SEQ ID NO: 1152731 - protein, 11 aa, Mycobacterium
ADHPDTDPVQA

SEQ ID NO: 1152732 - protein, 7 aa, Mycobacterium
ADHSAGR

SEQ ID NO: 1152733 - protein, 5 aa, Mycobacterium
ADIPA

SEQ ID NO: 1152734 - protein, 8 aa, Mycobacterium
ADIPAGAS

SEQ ID NO: 1152735 - protein, 15 aa, Mycobacterium
ADIPHAGGTLPRGTV

SEQ ID NO: 1152736 - protein, 7 aa, Mycobacterium
ADIPPEE

SEQ ID NO: 1152737 - protein, 5 aa, Mycobacterium
ADITA

SEQ ID NO: 1152738 - protein, 9 aa, Mycobacterium
ADKAGRDVG

SEQ ID NO: 1152739 - protein, 23 aa, Mycobacterium
ADKEFGPLTDTPPEPDTPLSPGW

SEQ ID NO: 1152740 - protein, 11 aa, Mycobacterium
ADKGASGKTIA

SEQ ID NO: 1152741 - protein, 7 aa, Mycobacterium
ADKGAWE

SEQ ID NO: 1152742 - protein, 7 aa, Mycobacterium
ADKGLSG

SEQ ID NO: 1152743 - protein, 4 aa, Mycobacterium
ADKL

SEQ ID NO: 1152744 - protein, 6 aa, Mycobacterium
ADKPAG

SEQ ID NO: 1152745 - protein, 8 aa, Mycobacterium
ADKPAVEG

SEQ ID NO: 1152746 - protein, 14 aa, Mycobacterium
ADKPDSTGGSPFTE

SEQ ID NO: 1152747 - protein, 22 aa, Mycobacterium
ADKPEKSAAPAGDPTGGMGGMD

SEQ ID NO: 1152748 - protein, 5 aa, Mycobacterium
ADKPL

SEQ ID NO: 1152749 - protein, 6 aa, Mycobacterium
ADKRAA

SEQ ID NO: 1152750 - protein, 11 aa, Mycobacterium
ADKYGDDRRTR

SEQ ID NO: 1152751 - protein, 6 aa, Mycobacterium
ADLAEK

SEQ ID NO: 1152752 - protein, 16 aa, Mycobacterium
ADLASPEWAQRSAPTY

SEQ ID NO: 1152753 - protein, 4 aa, Mycobacterium
ADLD

SEQ ID NO: 1152754 - protein, 4 aa, Mycobacterium
ADLE

SEQ ID NO: 1152755 - protein, 9 aa, Mycobacterium
ADLGESGTV

SEQ ID NO: 1152756 - protein, 10 aa, Mycobacterium
ADLGETDPGH

SEQ ID NO: 1152757 - protein, 13 aa, Mycobacterium
ADLGGKAGKVSGL

SEQ ID NO: 1152758 - protein, 6 aa, Mycobacterium
ADLGVD

SEQ ID NO: 1152759 - protein, 12 aa, Mycobacterium
ADLPDDAETLGP

SEQ ID NO: 1152760 - protein, 8 aa, Mycobacterium
ADLPDGAV

SEQ ID NO: 1152761 - protein, 6 aa, Mycobacterium
ADLPGT

SEQ ID NO: 1152762 - protein, 6 aa, Mycobacterium
ADLPNF

SEQ ID NO: 1152763 - protein, 5 aa, Mycobacterium
ADLPP

SEQ ID NO: 1152764 - protein, 6 aa, Mycobacterium
ADLPPG

SEQ ID NO: 1152765 - protein, 4 aa, Mycobacterium
ADLR

SEQ ID NO: 1152766 - protein, 5 aa, Mycobacterium
ADLSE

SEQ ID NO: 1152767 - protein, 5 aa, Mycobacterium
ADLST

SEQ ID NO: 1152768 - protein, 15 aa, Mycobacterium
ADLSTPVAENPEYPP

SEQ ID NO: 1152769 - protein, 6 aa, Mycobacterium
ADLTGK

SEQ ID NO: 1152770 - protein, 9 aa, Mycobacterium
ADMGPGDEW

SEQ ID NO: 1152771 - protein, 9 aa, Mycobacterium
ADNDRKPCG

SEQ ID NO: 1152772 - protein, 9 aa, Mycobacterium
ADNESDEYR

SEQ ID NO: 1152773 - protein, 9 aa, Mycobacterium
ADNRTRPGV

SEQ ID NO: 1152774 - protein, 4 aa, Mycobacterium
ADNV

SEQ ID NO: 1152775 - protein, 5 aa, Mycobacterium
ADPAA

SEQ ID NO: 1152776 - protein, 7 aa, Mycobacterium
ADPAART

SEQ ID NO: 1152777 - protein, 8 aa, Mycobacterium
ADPAESSD

SEQ ID NO: 1152778 - protein, 6 aa, Mycobacterium
ADPAGV

SEQ ID NO: 1152779 - protein, 5 aa, Mycobacterium
ADPAH

SEQ ID NO: 1152780 - protein, 8 aa, Mycobacterium
ADPANPYG

SEQ ID NO: 1152781 - protein, 8 aa, Mycobacterium
ADPARDAR

SEQ ID NO: 1152782 - protein, 6 aa, Mycobacterium
ADPARP

SEQ ID NO: 1152783 - protein, 9 aa, Mycobacterium
ADPASARGS

SEQ ID NO: 1152784 - protein, 6 aa, Mycobacterium
ADPATW

SEQ ID NO: 1152785 - protein, 6 aa, Mycobacterium
ADPDAF

SEQ ID NO: 1152786 - protein, 19 aa, Mycobacterium
ADPDAGNLADRAGRQSAAT

SEQ ID NO: 1152787 - protein, 20 aa, Mycobacterium
ADPDATTSSALRAALSMLGK

SEQ ID NO: 1152788 - protein, 6 aa, Mycobacterium
ADPDDG

SEQ ID NO: 1152789 - protein, 7 aa, Mycobacterium
ADPDELE

SEQ ID NO: 1152790 - protein, 5 aa, Mycobacterium
ADPDG

SEQ ID NO: 1152791 - protein, 8 aa, Mycobacterium
ADPDGGMS

SEQ ID NO: 1152792 - protein, 6 aa, Mycobacterium
ADPDGI

SEQ ID NO: 1152793 - protein, 13 aa, Mycobacterium
ADPDRAAAMGAAG

SEQ ID NO: 1152794 - protein, 14 aa, Mycobacterium
ADPDTGDELPTGQQ

SEQ ID NO: 1152795 - protein, 8 aa, Mycobacterium
ADPDTLEN

SEQ ID NO: 1152796 - protein, 7 aa, Mycobacterium
ADPDTQL

SEQ ID NO: 1152797 - protein, 5 aa, Mycobacterium
ADPDV

SEQ ID NO: 1152798 - protein, 6 aa, Mycobacterium
ADPDWC

SEQ ID NO: 1152799 - protein, 14 aa, Mycobacterium
ADPDYAEDPDGKRI

SEQ ID NO: 1152800 - protein, 4 aa, Mycobacterium
ADPE

SEQ ID NO: 1152801 - protein, 9 aa, Mycobacterium
ADPEEVPAE

SEQ ID NO: 1152802 - protein, 10 aa, Mycobacterium
ADPEEYGKEI

SEQ ID NO: 1152803 - protein, 5 aa, Mycobacterium
ADPEG

SEQ ID NO: 1152804 - protein, 8 aa, Mycobacterium
ADPELRGN

SEQ ID NO: 1152805 - protein, 8 aa, Mycobacterium
ADPEPLAP

SEQ ID NO: 1152806 - protein, 8 aa, Mycobacterium
ADPERSAE

SEQ ID NO: 1152807 - protein, 6 aa, Mycobacterium
ADPETG

SEQ ID NO: 1152808 - protein, 5 aa, Mycobacterium
ADPEV

SEQ ID NO: 1152809 - protein, 6 aa, Mycobacterium
ADPFGS

SEQ ID NO: 1152810 - protein, 9 aa, Mycobacterium
ADPGDYSDD

SEQ ID NO: 1152811 - protein, 8 aa, Mycobacterium
ADPGLGAS

SEQ ID NO: 1152812 - protein, 9 aa, Mycobacterium
ADPGPPKAL

SEQ ID NO: 1152813 - protein, 7 aa, Mycobacterium
ADPGPSD

SEQ ID NO: 1152814 - protein, 21 aa, Mycobacterium
ADPGQTAPPEVREHFLAFMLR

SEQ ID NO: 1152815 - protein, 5 aa, Mycobacterium
ADPGR

SEQ ID NO: 1152816 - protein, 15 aa, Mycobacterium
ADPGSAPEPQSDPSV

SEQ ID NO: 1152817 - protein, 10 aa, Mycobacterium
ADPKAYADEA

SEQ ID NO: 1152818 - protein, 5 aa, Mycobacterium
ADPKL

SEQ ID NO: 1152819 - protein, 8 aa, Mycobacterium
ADPLGGAS

SEQ ID NO: 1152820 - protein, 12 aa, Mycobacterium
ADPLPATPRRPL

SEQ ID NO: 1152821 - protein, 11 aa, Mycobacterium
ADPLPPTPRRP

SEQ ID NO: 1152822 - protein, 16 aa, Mycobacterium
ADPLTAPFSDRPAPEV

SEQ ID NO: 1152823 - protein, 5 aa, Mycobacterium
ADPMT

SEQ ID NO: 1152824 - protein, 7 aa, Mycobacterium
ADPNGLN

SEQ ID NO: 1152825 - protein, 5 aa, Mycobacterium
ADPPD

SEQ ID NO: 1152826 - protein, 7 aa, Mycobacterium
ADPPLED

SEQ ID NO: 1152827 - protein, 8 aa, Mycobacterium
ADPPLGQA

SEQ ID NO: 1152828 - protein, 7 aa, Mycobacterium
ADPPVNK

SEQ ID NO: 1152829 - protein, 9 aa, Mycobacterium
ADPQPDLPT

SEQ ID NO: 1152830 - protein, 7 aa, Mycobacterium
ADPQQMT

SEQ ID NO: 1152831 - protein, 6 aa, Mycobacterium
ADPQRD

SEQ ID NO: 1152832 - protein, 9 aa, Mycobacterium
ADPQTVTGA

SEQ ID NO: 1152833 - protein, 8 aa, Mycobacterium
ADPRFGER

SEQ ID NO: 1152834 - protein, 5 aa, Mycobacterium
ADPRQ

SEQ ID NO: 1152835 - protein, 8 aa, Mycobacterium
ADPRRGEQ

SEQ ID NO: 1152836 - protein, 6 aa, Mycobacterium
ADPRRT

SEQ ID NO: 1152837 - protein, 13 aa, Mycobacterium
ADPRTGTGSDAPD

SEQ ID NO: 1152838 - protein, 10 aa, Mycobacterium
ADPSAYADDQ

SEQ ID NO: 1152839 - protein, 6 aa, Mycobacterium
ADPSGG

SEQ ID NO: 1152840 - protein, 5 aa, Mycobacterium
ADPSR

SEQ ID NO: 1152841 - protein, 13 aa, Mycobacterium
ADPSRIDAQGRRP

SEQ ID NO: 1152842 - protein, 9 aa, Mycobacterium
ADPSSSIGS

SEQ ID NO: 1152843 - protein, 10 aa, Mycobacterium
ADPSTPTADL

SEQ ID NO: 1152844 - protein, 9 aa, Mycobacterium
ADPSTVASM

SEQ ID NO: 1152845 - protein, 4 aa, Mycobacterium
ADPT

SEQ ID NO: 1152846 - protein, 7 aa, Mycobacterium
ADPTAGP

SEQ ID NO: 1152847 - protein, 7 aa, Mycobacterium
ADPTEAV

SEQ ID NO: 1152848 - protein, 8 aa, Mycobacterium
ADPTEEEL

SEQ ID NO: 1152849 - protein, 7 aa, Mycobacterium
ADPTGFA

SEQ ID NO: 1152850 - protein, 6 aa, Mycobacterium
ADPTID

SEQ ID NO: 1152851 - protein, 7 aa, Mycobacterium
ADPVGNR

SEQ ID NO: 1152852 - protein, 7 aa, Mycobacterium
ADPVSAG

SEQ ID NO: 1152853 - protein, 4 aa, Mycobacterium
ADQA

SEQ ID NO: 1152854 - protein, 6 aa, Mycobacterium
ADQATA

SEQ ID NO: 1152855 - protein, 4 aa, Mycobacterium
ADQE

SEQ ID NO: 1152856 - protein, 12 aa, Mycobacterium
ADQGSPDAPGHA

SEQ ID NO: 1152857 - protein, 10 aa, Mycobacterium
ADQKSDPGAI

SEQ ID NO: 1152858 - protein, 10 aa, Mycobacterium
ADQPADRADS

SEQ ID NO: 1152859 - protein, 9 aa, Mycobacterium
ADQSPRSKS

SEQ ID NO: 1152860 - protein, 7 aa, Mycobacterium
ADQTEQD

SEQ ID NO: 1152861 - protein, 8 aa, Mycobacterium
ADQTGAAD

SEQ ID NO: 1152862 - protein, 11 aa, Mycobacterium
ADQTNDRTRRQ

SEQ ID NO: 1152863 - protein, 9 aa, Mycobacterium
ADRAAGAHP

SEQ ID NO: 1152864 - protein, 23 aa, Mycobacterium
ADRADGRPTAPPGFAESETPRYV

SEQ ID NO: 1152865 - protein, 10 aa, Mycobacterium
ADRADWSEQD

SEQ ID NO: 1152866 - protein, 16 aa, Mycobacterium
ADRAELEGVSAERAPQ

SEQ ID NO: 1152867 - protein, 10 aa, Mycobacterium
ADRAKPAVPF

SEQ ID NO: 1152868 - protein, 10 aa, Mycobacterium
ADRASATGGS

SEQ ID NO: 1152869 - protein, 6 aa, Mycobacterium
ADRASR

SEQ ID NO: 1152870 - protein, 9 aa, Mycobacterium
ADRDAARAH

SEQ ID NO: 1152871 - protein, 6 aa, Mycobacterium
ADRDAT

SEQ ID NO: 1152872 - protein, 10 aa, Mycobacterium
ADRDETAATA

SEQ ID NO: 1152873 - protein, 12 aa, Mycobacterium
ADRDGADQTVRD

SEQ ID NO: 1152874 - protein, 6 aa, Mycobacterium
ADRERM

SEQ ID NO: 1152875 - protein, 25 aa, Mycobacterium
ADRETDARTPAPAARTASRAQGRGL

SEQ ID NO: 1152876 - protein, 5 aa, Mycobacterium
ADRGD

SEQ ID NO: 1152877 - protein, 16 aa, Mycobacterium
ADRGKGVGKEFKPGTP

SEQ ID NO: 1152878 - protein, 14 aa, Mycobacterium
ADRGRQALKNSPSL

SEQ ID NO: 1152879 - protein, 12 aa, Mycobacterium
ADRHDDSRAQVA

SEQ ID NO: 1152880 - protein, 4 aa, Mycobacterium
ADRK

SEQ ID NO: 1152881 - protein, 7 aa, Mycobacterium
ADRKGGH

SEQ ID NO: 1152882 - protein, 4 aa, Mycobacterium
ADRM

SEQ ID NO: 1152883 - protein, 6 aa, Mycobacterium
ADRNGQ

SEQ ID NO: 1152884 - protein, 5 aa, Mycobacterium
ADRNR

SEQ ID NO: 1152885 - protein, 7 aa, Mycobacterium
ADRPADS

SEQ ID NO: 1152886 - protein, 9 aa, Mycobacterium
ADRPALGQR

SEQ ID NO: 1152887 - protein, 10 aa, Mycobacterium
ADRPERPRRS

SEQ ID NO: 1152888 - protein, 5 aa, Mycobacterium
ADRPH

SEQ ID NO: 1152889 - protein, 5 aa, Mycobacterium
ADRPT

SEQ ID NO: 1152890 - protein, 14 aa, Mycobacterium
ADRQVRPVSAGDTA

SEQ ID NO: 1152891 - protein, 6 aa, Mycobacterium
ADRRAD

SEQ ID NO: 1152892 - protein, 16 aa, Mycobacterium
ADRSSLRALHASIKAA

SEQ ID NO: 1152893 - protein, 9 aa, Mycobacterium
ADRTAADAL

SEQ ID NO: 1152894 - protein, 6 aa, Mycobacterium
ADRTAG

SEQ ID NO: 1152895 - protein, 8 aa, Mycobacterium
ADRTDAPV

SEQ ID NO: 1152896 - protein, 8 aa, Mycobacterium
ADRTGSGA

SEQ ID NO: 1152897 - protein, 12 aa, Mycobacterium
ADRTLAPSTSAM

SEQ ID NO: 1152898 - protein, 16 aa, Mycobacterium
ADRTPQSGGVVSGPPW

SEQ ID NO: 1152899 - protein, 12 aa, Mycobacterium
ADRVGGTQSSWG

SEQ ID NO: 1152900 - protein, 6 aa, Mycobacterium
ADRYPE

SEQ ID NO: 1152901 - protein, 4 aa, Mycobacterium
ADSA

SEQ ID NO: 1152902 - protein, 18 aa, Mycobacterium
ADSATGSGHPDHDEDERI

SEQ ID NO: 1152903 - protein, 5 aa, Mycobacterium
ADSAV

SEQ ID NO: 1152904 - protein, 6 aa, Mycobacterium
ADSDGS

SEQ ID NO: 1152905 - protein, 5 aa, Mycobacterium
ADSDI

SEQ ID NO: 1152906 - protein, 5 aa, Mycobacterium
ADSEQ

SEQ ID NO: 1152907 - protein, 47 aa, Mycobacterium
ADSESAAADDSDTADDGKSKELVGSSAGGSGRHRRNGRGSLTTSDLA

SEQ ID NO: 1152908 - protein, 14 aa, Mycobacterium
ADSGAAADNDPQAI

SEQ ID NO: 1152909 - protein, 6 aa, Mycobacterium
ADSGER

SEQ ID NO: 1152910 - protein, 10 aa, Mycobacterium
ADSGESAVED

SEQ ID NO: 1152911 - protein, 19 aa, Mycobacterium
ADSGNWPTGFPDSKRPSYT

SEQ ID NO: 1152912 - protein, 6 aa, Mycobacterium
ADSGST

SEQ ID NO: 1152913 - protein, 15 aa, Mycobacterium
ADSHSRANVGRSSME

SEQ ID NO: 1152914 - protein, 7 aa, Mycobacterium
ADSLGGL

SEQ ID NO: 1152915 - protein, 18 aa, Mycobacterium
ADSLRKDGAAVSIQDGPW

SEQ ID NO: 1152916 - protein, 4 aa, Mycobacterium
ADSP

SEQ ID NO: 1152917 - protein, 9 aa, Mycobacterium
ADSPDGAKL

SEQ ID NO: 1152918 - protein, 8 aa, Mycobacterium
ADSPGSKQ

SEQ ID NO: 1152919 - protein, 6 aa, Mycobacterium
ADSPKL

SEQ ID NO: 1152920 - protein, 7 aa, Mycobacterium
ADSPPGT

SEQ ID NO: 1152921 - protein, 16 aa, Mycobacterium
ADSPTTPRAVAPGEPG

SEQ ID NO: 1152922 - protein, 4 aa, Mycobacterium
ADSQ

SEQ ID NO: 1152923 - protein, 5 aa, Mycobacterium
ADSRG

SEQ ID NO: 1152924 - protein, 10 aa, Mycobacterium
ADSSDAGQIA

SEQ ID NO: 1152925 - protein, 8 aa, Mycobacterium
ADSSPQDI

SEQ ID NO: 1152926 - protein, 7 aa, Mycobacterium
ADSSYEK

SEQ ID NO: 1152927 - protein, 7 aa, Mycobacterium
ADTAAAA

SEQ ID NO: 1152928 - protein, 10 aa, Mycobacterium
ADTADTIEGN

SEQ ID NO: 1152929 - protein, 7 aa, Mycobacterium
ADTAETY

SEQ ID NO: 1152930 - protein, 5 aa, Mycobacterium
ADTAR

SEQ ID NO: 1152931 - protein, 6 aa, Mycobacterium
ADTATR

SEQ ID NO: 1152932 - protein, 6 aa, Mycobacterium
ADTDAQ

SEQ ID NO: 1152933 - protein, 10 aa, Mycobacterium
ADTDDEAHAK

SEQ ID NO: 1152934 - protein, 7 aa, Mycobacterium
ADTDRGL

SEQ ID NO: 1152935 - protein, 9 aa, Mycobacterium
ADTEEYGTA

SEQ ID NO: 1152936 - protein, 8 aa, Mycobacterium
ADTEPAHG

SEQ ID NO: 1152937 - protein, 8 aa, Mycobacterium
ADTEPLAD

SEQ ID NO: 1152938 - protein, 4 aa, Mycobacterium
ADTF

SEQ ID NO: 1152939 - protein, 8 aa, Mycobacterium
ADTFTDPK

SEQ ID NO: 1152940 - protein, 6 aa, Mycobacterium
ADTGAL

SEQ ID NO: 1152941 - protein, 7 aa, Mycobacterium
ADTGDIH

SEQ ID NO: 1152942 - protein, 15 aa, Mycobacterium
ADTGLSRNGVSPAEY

SEQ ID NO: 1152943 - protein, 6 aa, Mycobacterium
ADTGVG

SEQ ID NO: 1152944 - protein, 5 aa, Mycobacterium
ADTIS

SEQ ID NO: 1152945 - protein, 7 aa, Mycobacterium
ADTKERM

SEQ ID NO: 1152946 - protein, 4 aa, Mycobacterium
ADTL

SEQ ID NO: 1152947 - protein, 4 aa, Mycobacterium
ADTM

SEQ ID NO: 1152948 - protein, 11 aa, Mycobacterium
ADTPRVASGTE

SEQ ID NO: 1152949 - protein, 8 aa, Mycobacterium
ADTRAPEA

SEQ ID NO: 1152950 - protein, 8 aa, Mycobacterium
ADTSPGAH

SEQ ID NO: 1152951 - protein, 9 aa, Mycobacterium
ADTSPSPHR

SEQ ID NO: 1152952 - protein, 7 aa, Mycobacterium
ADTSRVA

SEQ ID NO: 1152953 - protein, 7 aa, Mycobacterium
ADTSVED

SEQ ID NO: 1152954 - protein, 5 aa, Mycobacterium
ADTTS

SEQ ID NO: 1152955 - protein, 7 aa, Mycobacterium
ADTVSGD

SEQ ID NO: 1152956 - protein, 4 aa, Mycobacterium
ADVA

SEQ ID NO: 1152957 - protein, 6 aa, Mycobacterium
ADVARE

SEQ ID NO: 1152958 - protein, 4 aa, Mycobacterium
ADVE

SEQ ID NO: 1152959 - protein, 16 aa, Mycobacterium
ADVEGVTDAEDRITEL

SEQ ID NO: 1152960 - protein, 9 aa, Mycobacterium
ADVGAPSAV

SEQ ID NO: 1152961 - protein, 9 aa, Mycobacterium
ADVGGAGTF

SEQ ID NO: 1152962 - protein, 14 aa, Mycobacterium
ADVGPQAAQIRGPL

SEQ ID NO: 1152963 - protein, 5 aa, Mycobacterium
ADVPG

SEQ ID NO: 1152964 - protein, 7 aa, Mycobacterium
ADVRDRA

SEQ ID NO: 1152965 - protein, 6 aa, Mycobacterium
ADVRPD

SEQ ID NO: 1152966 - protein, 7 aa, Mycobacterium
ADVSPRT

SEQ ID NO: 1152967 - protein, 19 aa, Mycobacterium
ADVTAADVEAARQTVRPSL

SEQ ID NO: 1152968 - protein, 9 aa, Mycobacterium
ADVTGPNVD

SEQ ID NO: 1152969 - protein, 8 aa, Mycobacterium
ADWDDDTA

SEQ ID NO: 1152970 - protein, 12 aa, Mycobacterium
ADWDGTDPIRVF

SEQ ID NO: 1152971 - protein, 8 aa, Mycobacterium
ADYGGADP

SEQ ID NO: 1152972 - protein, 11 aa, Mycobacterium
ADYPYTPDGSR

SEQ ID NO: 1152973 - protein, 6 aa, Mycobacterium
ADYTSR

SEQ ID NO: 1152974 - protein, 15 aa, Mycobacterium
AEAAAAALDAFESRV

SEQ ID NO: 1152975 - protein, 7 aa, Mycobacterium
AEAAARA

SEQ ID NO: 1152976 - protein, 9 aa, Mycobacterium
AEAAGATVR

SEQ ID NO: 1152977 - protein, 10 aa, Mycobacterium
AEAAGSDEEA

SEQ ID NO: 1152978 - protein, 10 aa, Mycobacterium
AEAAKYPAKP

SEQ ID NO: 1152979 - protein, 12 aa, Mycobacterium
AEAATERISETQ

SEQ ID NO: 1152980 - protein, 7 aa, Mycobacterium
AEAATGL

SEQ ID NO: 1152981 - protein, 12 aa, Mycobacterium
AEAATSGEYDEA

SEQ ID NO: 1152982 - protein, 4 aa, Mycobacterium
AEAC

SEQ ID NO: 1152983 - protein, 7 aa, Mycobacterium
AEADGAI

SEQ ID NO: 1152984 - protein, 14 aa, Mycobacterium
AEADGIERKYQRGA

SEQ ID NO: 1152985 - protein, 12 aa, Mycobacterium
AEADREAAERAV

SEQ ID NO: 1152986 - protein, 18 aa, Mycobacterium
AEADRSPTHLSAGQRRRA

SEQ ID NO: 1152987 - protein, 8 aa, Mycobacterium
AEADTLDG

SEQ ID NO: 1152988 - protein, 9 aa, Mycobacterium
AEAEADYAG

SEQ ID NO: 1152989 - protein, 5 aa, Mycobacterium
AEAEG

SEQ ID NO: 1152990 - protein, 9 aa, Mycobacterium
AEAEKSRKL

SEQ ID NO: 1152991 - protein, 6 aa, Mycobacterium
AEAEPI

SEQ ID NO: 1152992 - protein, 6 aa, Mycobacterium
AEAEQL

SEQ ID NO: 1152993 - protein, 18 aa, Mycobacterium
AEAESEGDVGDRANDPVR

SEQ ID NO: 1152994 - protein, 8 aa, Mycobacterium
AEAGDPEG

SEQ ID NO: 1152995 - protein, 12 aa, Mycobacterium
AEAGGTALYPAQ

SEQ ID NO: 1152996 - protein, 12 aa, Mycobacterium
AEAGGYAEAEDK

SEQ ID NO: 1152997 - protein, 6 aa, Mycobacterium
AEAGMA

SEQ ID NO: 1152998 - protein, 9 aa, Mycobacterium
AEAGREPDS

SEQ ID NO: 1152999 - protein, 6 aa, Mycobacterium
AEAGRR

SEQ ID NO: 1153000 - protein, 9 aa, Mycobacterium
AEAGYPPTR

SEQ ID NO: 1153001 - protein, 6 aa, Mycobacterium
AEAHPK

SEQ ID NO: 1153002 - protein, 7 aa, Mycobacterium
AEAKGSV

SEQ ID NO: 1153003 - protein, 17 aa, Mycobacterium
AEAKPAERESLAGPTLS

SEQ ID NO: 1153004 - protein, 5 aa, Mycobacterium
AEAPA

SEQ ID NO: 1153005 - protein, 6 aa, Mycobacterium
AEAPAI

SEQ ID NO: 1153006 - protein, 13 aa, Mycobacterium
AEAPAPTSAPRPA

SEQ ID NO: 1153007 - protein, 14 aa, Mycobacterium
AEAPARRGRHKNIP

SEQ ID NO: 1153008 - protein, 6 aa, Mycobacterium
AEAPGF

SEQ ID NO: 1153009 - protein, 8 aa, Mycobacterium
AEAPRGTE

SEQ ID NO: 1153010 - protein, 13 aa, Mycobacterium
AEAQLPDARGLSG

SEQ ID NO: 1153011 - protein, 4 aa, Mycobacterium
AEAR

SEQ ID NO: 1153012 - protein, 9 aa, Mycobacterium
AEARESGDH

SEQ ID NO: 1153013 - protein, 8 aa, Mycobacterium
AEARGQNR

SEQ ID NO: 1153014 - protein, 15 aa, Mycobacterium
AEARRKYQAKLKAAR

SEQ ID NO: 1153015 - protein, 9 aa, Mycobacterium
AEARTGVRA

SEQ ID NO: 1153016 - protein, 8 aa, Mycobacterium
AEASADER

SEQ ID NO: 1153017 - protein, 7 aa, Mycobacterium
AEASGFD

SEQ ID NO: 1153018 - protein, 8 aa, Mycobacterium
AEATGDRD

SEQ ID NO: 1153019 - protein, 9 aa, Mycobacterium
AEATRRTFP

SEQ ID NO: 1153020 - protein, 7 aa, Mycobacterium
AEAYDGP

SEQ ID NO: 1153021 - protein, 9 aa, Mycobacterium
AECPPHSAK

SEQ ID NO: 1153022 - protein, 5 aa, Mycobacterium
AEDAD

SEQ ID NO: 1153023 - protein, 10 aa, Mycobacterium
AEDAEGLDQR

SEQ ID NO: 1153024 - protein, 6 aa, Mycobacterium
AEDAEQ

SEQ ID NO: 1153025 - protein, 8 aa, Mycobacterium
AEDASSAG

SEQ ID NO: 1153026 - protein, 9 aa, Mycobacterium
AEDATPGDR

SEQ ID NO: 1153027 - protein, 7 aa, Mycobacterium
AEDDGAR

SEQ ID NO: 1153028 - protein, 8 aa, Mycobacterium
AEDDPSKF

SEQ ID NO: 1153029 - protein, 7 aa, Mycobacterium
AEDFESA

SEQ ID NO: 1153030 - protein, 7 aa, Mycobacterium
AEDGDKH

SEQ ID NO: 1153031 - protein, 5 aa, Mycobacterium
AEDGE

SEQ ID NO: 1153032 - protein, 7 aa, Mycobacterium
AEDGREY

SEQ ID NO: 1153033 - protein, 7 aa, Mycobacterium
AEDGSSV

SEQ ID NO: 1153034 - protein, 8 aa, Mycobacterium
AEDLPTGQ

SEQ ID NO: 1153035 - protein, 6 aa, Mycobacterium
AEDNEA

SEQ ID NO: 1153036 - protein, 7 aa, Mycobacterium
AEDNPDR

SEQ ID NO: 1153037 - protein, 13 aa, Mycobacterium
AEDPADDYRPCTG

SEQ ID NO: 1153038 - protein, 13 aa, Mycobacterium
AEDPAKNWQPQAG

SEQ ID NO: 1153039 - protein, 15 aa, Mycobacterium
AEDPARDYRPSTGTL

SEQ ID NO: 1153040 - protein, 13 aa, Mycobacterium
AEDPGRGFLPTGG

SEQ ID NO: 1153041 - protein, 9 aa, Mycobacterium
AEDPPAKAR

SEQ ID NO: 1153042 - protein, 5 aa, Mycobacterium
AEDQG

SEQ ID NO: 1153043 - protein, 5 aa, Mycobacterium
AEDRQ

SEQ ID NO: 1153044 - protein, 9 aa, Mycobacterium
AEDRRRRGH

SEQ ID NO: 1153045 - protein, 10 aa, Mycobacterium
AEDRWADERT

SEQ ID NO: 1153046 - protein, 6 aa, Mycobacterium
AEDSAV

SEQ ID NO: 1153047 - protein, 8 aa, Mycobacterium
AEEAESAH

SEQ ID NO: 1153048 - protein, 8 aa, Mycobacterium
AEEANNAG

SEQ ID NO: 1153049 - protein, 7 aa, Mycobacterium
AEEAPDP

SEQ ID NO: 1153050 - protein, 9 aa, Mycobacterium
AEEAYQKAR

SEQ ID NO: 1153051 - protein, 18 aa, Mycobacterium
AEEEGQDAENAGAEADAE

SEQ ID NO: 1153052 - protein, 17 aa, Mycobacterium
AEEEPENADYPTEEEAP

SEQ ID NO: 1153053 - protein, 11 aa, Mycobacterium
AEEHDAKEQLS

SEQ ID NO: 1153054 - protein, 6 aa, Mycobacterium
AEEHDS

SEQ ID NO: 1153055 - protein, 6 aa, Mycobacterium
AEEHGG

SEQ ID NO: 1153056 - protein, 6 aa, Mycobacterium
AEEHRA

SEQ ID NO: 1153057 - protein, 4 aa, Mycobacterium
AEEK

SEQ ID NO: 1153058 - protein, 6 aa, Mycobacterium
AEELGT

SEQ ID NO: 1153059 - protein, 7 aa, Mycobacterium
AEEPERH

SEQ ID NO: 1153060 - protein, 4 aa, Mycobacterium
AEEQ

SEQ ID NO: 1153061 - protein, 7 aa, Mycobacterium
AEEQRRG

SEQ ID NO: 1153062 - protein, 10 aa, Mycobacterium
AEERARRRNV

SEQ ID NO: 1153063 - protein, 16 aa, Mycobacterium
AEERHADQMRRSGDPY

SEQ ID NO: 1153064 - protein, 14 aa, Mycobacterium
AEETAEAVGSTAGA

SEQ ID NO: 1153065 - protein, 6 aa, Mycobacterium
AEETGA

SEQ ID NO: 1153066 - protein, 7 aa, Mycobacterium
AEETGLP

SEQ ID NO: 1153067 - protein, 6 aa, Mycobacterium
AEETSA

SEQ ID NO: 1153068 - protein, 10 aa, Mycobacterium
AEEYGQPGNY

SEQ ID NO: 1153069 - protein, 8 aa, Mycobacterium
AEEYGSHD

SEQ ID NO: 1153070 - protein, 18 aa, Mycobacterium
AEFDAEASARDAERQLPH

SEQ ID NO: 1153071 - protein, 8 aa, Mycobacterium
AEFGGDRS

SEQ ID NO: 1153072 - protein, 8 aa, Mycobacterium
AEFGPRGV

SEQ ID NO: 1153073 - protein, 8 aa, Mycobacterium
AEFPEADM

SEQ ID NO: 1153074 - protein, 6 aa, Mycobacterium
AEGAAA

SEQ ID NO: 1153075 - protein, 13 aa, Mycobacterium
AEGADAAGKNVDD

SEQ ID NO: 1153076 - protein, 13 aa, Mycobacterium
AEGAEKSGRSPQD

SEQ ID NO: 1153077 - protein, 13 aa, Mycobacterium
AEGAPAPNPVDAD

SEQ ID NO: 1153078 - protein, 15 aa, Mycobacterium
AEGAPTDDPESASAV

SEQ ID NO: 1153079 - protein, 8 aa, Mycobacterium
AEGCDGLT

SEQ ID NO: 1153080 - protein, 8 aa, Mycobacterium
AEGDAGDD

SEQ ID NO: 1153081 - protein, 4 aa, Mycobacterium
AEGE

SEQ ID NO: 1153082 - protein, 5 aa, Mycobacterium
AEGEG

SEQ ID NO: 1153083 - protein, 4 aa, Mycobacterium
AEGF

SEQ ID NO: 1153084 - protein, 6 aa, Mycobacterium
AEGFPS

SEQ ID NO: 1153085 - protein, 7 aa, Mycobacterium
AEGGAPA

SEQ ID NO: 1153086 - protein, 7 aa, Mycobacterium
AEGGPEA

SEQ ID NO: 1153087 - protein, 8 aa, Mycobacterium
AEGIPYDD

SEQ ID NO: 1153088 - protein, 19 aa, Mycobacterium
AEGKQSPNVYSADGPVTNG

SEQ ID NO: 1153089 - protein, 7 aa, Mycobacterium
AEGNPVR

SEQ ID NO: 1153090 - protein, 4 aa, Mycobacterium
AEGP

SEQ ID NO: 1153091 - protein, 6 aa, Mycobacterium
AEGPQI

SEQ ID NO: 1153092 - protein, 11 aa, Mycobacterium
AEGPRPVVSGS

SEQ ID NO: 1153093 - protein, 13 aa, Mycobacterium
AEGRAARKAADEA

SEQ ID NO: 1153094 - protein, 8 aa, Mycobacterium
AEGRDDDA

SEQ ID NO: 1153095 - protein, 5 aa, Mycobacterium
AEGRG

SEQ ID NO: 1153096 - protein, 6 aa, Mycobacterium
AEGRPE

SEQ ID NO: 1153097 - protein, 8 aa, Mycobacterium
AEGRPPAI

SEQ ID NO: 1153098 - protein, 5 aa, Mycobacterium
AEGRR

SEQ ID NO: 1153099 - protein, 8 aa, Mycobacterium
AEGRSSAP

SEQ ID NO: 1153100 - protein, 14 aa, Mycobacterium
AEGRTGDFYDGKRQ

SEQ ID NO: 1153101 - protein, 5 aa, Mycobacterium
AEGSA

SEQ ID NO: 1153102 - protein, 7 aa, Mycobacterium
AEGSDRE

SEQ ID NO: 1153103 - protein, 7 aa, Mycobacterium
AEGSEQI

SEQ ID NO: 1153104 - protein, 41 aa, Mycobacterium
AEGSPAVAGVTSEPEVGELDDEAAEVPVSESHTDVDPVPSP

SEQ ID NO: 1153105 - protein, 15 aa, Mycobacterium
AEGTADELKERTGGS

SEQ ID NO: 1153106 - protein, 6 aa, Mycobacterium
AEGTRV

SEQ ID NO: 1153107 - protein, 5 aa, Mycobacterium
AEGTS

SEQ ID NO: 1153108 - protein, 8 aa, Mycobacterium
AEGVDPSA

SEQ ID NO: 1153109 - protein, 5 aa, Mycobacterium
AEGVK

SEQ ID NO: 1153110 - protein, 5 aa, Mycobacterium
AEHAD

SEQ ID NO: 1153111 - protein, 6 aa, Mycobacterium
AEHKRR

SEQ ID NO: 1153112 - protein, 7 aa, Mycobacterium
AEHPEKL

SEQ ID NO: 1153113 - protein, 15 aa, Mycobacterium
AEHPELRAPDSPTQL

SEQ ID NO: 1153114 - protein, 5 aa, Mycobacterium
AEHPY

SEQ ID NO: 1153115 - protein, 15 aa, Mycobacterium
AEHRATIAEEFHAAD

SEQ ID NO: 1153116 - protein, 7 aa, Mycobacterium
AEHTETA

SEQ ID NO: 1153117 - protein, 11 aa, Mycobacterium
AEIDGEKLADE

SEQ ID NO: 1153118 - protein, 9 aa, Mycobacterium
AEIGEGNKL

SEQ ID NO: 1153119 - protein, 12 aa, Mycobacterium
AEIQRAGGGTGF

SEQ ID NO: 1153120 - protein, 12 aa, Mycobacterium
AEISRTDENTPL

SEQ ID NO: 1153121 - protein, 7 aa, Mycobacterium
AEISTGP

SEQ ID NO: 1153122 - protein, 6 aa, Mycobacterium
AEITSV

SEQ ID NO: 1153123 - protein, 7 aa, Mycobacterium
AEITTGA

SEQ ID NO: 1153124 - protein, 5 aa, Mycobacterium
AEKAA

SEQ ID NO: 1153125 - protein, 8 aa, Mycobacterium
AEKDPHRR

SEQ ID NO: 1153126 - protein, 8 aa, Mycobacterium
AEKEEAEE

SEQ ID NO: 1153127 - protein, 5 aa, Mycobacterium
AEKGG

SEQ ID NO: 1153128 - protein, 12 aa, Mycobacterium
AEKMPTARRRTA

SEQ ID NO: 1153129 - protein, 8 aa, Mycobacterium
AEKRASQE

SEQ ID NO: 1153130 - protein, 12 aa, Mycobacterium
AEKSGVADDGAE

SEQ ID NO: 1153131 - protein, 9 aa, Mycobacterium
AEKTDQGTA

SEQ ID NO: 1153132 - protein, 4 aa, Mycobacterium
AEKV

SEQ ID NO: 1153133 - protein, 11 aa, Mycobacterium
AELADKADEYR

SEQ ID NO: 1153134 - protein, 14 aa, Mycobacterium
AELAGSDLDHAPSR

SEQ ID NO: 1153135 - protein, 12 aa, Mycobacterium
AELEGEKSYAQE

SEQ ID NO: 1153136 - protein, 6 aa, Mycobacterium
AELPDG

SEQ ID NO: 1153137 - protein, 6 aa, Mycobacterium
AELPPG

SEQ ID NO: 1153138 - protein, 6 aa, Mycobacterium
AELREG

SEQ ID NO: 1153139 - protein, 8 aa, Mycobacterium
AELSPGEV

SEQ ID NO: 1153140 - protein, 4 aa, Mycobacterium
AELT

SEQ ID NO: 1153141 - protein, 6 aa, Mycobacterium
AELTRR

SEQ ID NO: 1153142 - protein, 19 aa, Mycobacterium
AELTSGESFGEVESTKSVS

SEQ ID NO: 1153143 - protein, 4 aa, Mycobacterium
AEMR

SEQ ID NO: 1153144 - protein, 7 aa, Mycobacterium
AENAAGR

SEQ ID NO: 1153145 - protein, 5 aa, Mycobacterium
AENAG

SEQ ID NO: 1153146 - protein, 15 aa, Mycobacterium
AENDDVNRYKASKQA

SEQ ID NO: 1153147 - protein, 5 aa, Mycobacterium
AENEG

SEQ ID NO: 1153148 - protein, 11 aa, Mycobacterium
AENGGSPAERR

SEQ ID NO: 1153149 - protein, 7 aa, Mycobacterium
AENHPNV

SEQ ID NO: 1153150 - protein, 7 aa, Mycobacterium
AENNTAV

SEQ ID NO: 1153151 - protein, 8 aa, Mycobacterium
AENPANRD

SEQ ID NO: 1153152 - protein, 5 aa, Mycobacterium
AENPP

SEQ ID NO: 1153153 - protein, 6 aa, Mycobacterium
AENQTL

SEQ ID NO: 1153154 - protein, 10 aa, Mycobacterium
AENSGRERTA

SEQ ID NO: 1153155 - protein, 9 aa, Mycobacterium
AENTPVQQA

SEQ ID NO: 1153156 - protein, 7 aa, Mycobacterium
AEPAAAP

SEQ ID NO: 1153157 - protein, 7 aa, Mycobacterium
AEPAAGA

SEQ ID NO: 1153158 - protein, 17 aa, Mycobacterium
AEPADGHTTLRTTAGDV

SEQ ID NO: 1153159 - protein, 6 aa, Mycobacterium
AEPANL

SEQ ID NO: 1153160 - protein, 8 aa, Mycobacterium
AEPAPDPA

SEQ ID NO: 1153161 - protein, 12 aa, Mycobacterium
AEPDDRDVSPAL

SEQ ID NO: 1153162 - protein, 6 aa, Mycobacterium
AEPDDY

SEQ ID NO: 1153163 - protein, 5 aa, Mycobacterium
AEPDR

SEQ ID NO: 1153164 - protein, 6 aa, Mycobacterium
AEPDTE

SEQ ID NO: 1153165 - protein, 6 aa, Mycobacterium
AEPEEI

SEQ ID NO: 1153166 - protein, 7 aa, Mycobacterium
AEPEPVD

SEQ ID NO: 1153167 - protein, 13 aa, Mycobacterium
AEPGAASVEGSVA

SEQ ID NO: 1153168 - protein, 16 aa, Mycobacterium
AEPGEAPAPVDIPNDA

SEQ ID NO: 1153169 - protein, 9 aa, Mycobacterium
AEPGETAGF

SEQ ID NO: 1153170 - protein, 7 aa, Mycobacterium
AEPGIRT

SEQ ID NO: 1153171 - protein, 7 aa, Mycobacterium
AEPGPGF

SEQ ID NO: 1153172 - protein, 20 aa, Mycobacterium
AEPGSAGRSVATGGRPGRAY

SEQ ID NO: 1153173 - protein, 9 aa, Mycobacterium
AEPGVNPDR

SEQ ID NO: 1153174 - protein, 18 aa, Mycobacterium
AEPHRQGGPTSARNGLGE

SEQ ID NO: 1153175 - protein, 4 aa, Mycobacterium
AEPL

SEQ ID NO: 1153176 - protein, 8 aa, Mycobacterium
AEPLDGPW

SEQ ID NO: 1153177 - protein, 5 aa, Mycobacterium
AEPLR

SEQ ID NO: 1153178 - protein, 7 aa, Mycobacterium
AEPPAEL

SEQ ID NO: 1153179 - protein, 6 aa, Mycobacterium
AEPPCP

SEQ ID NO: 1153180 - protein, 19 aa, Mycobacterium
AEPPGTGPGEEPKPTTIDS

SEQ ID NO: 1153181 - protein, 15 aa, Mycobacterium
AEPQRARAYGAAGRE

SEQ ID NO: 1153182 - protein, 6 aa, Mycobacterium
AEPQRR

SEQ ID NO: 1153183 - protein, 6 aa, Mycobacterium
AEPQRV

SEQ ID NO: 1153184 - protein, 4 aa, Mycobacterium
AEPR

SEQ ID NO: 1153185 - protein, 5 aa, Mycobacterium
AEPRV

SEQ ID NO: 1153186 - protein, 11 aa, Mycobacterium
AEPSDALSNVK

SEQ ID NO: 1153187 - protein, 8 aa, Mycobacterium
AEPSGGGA

SEQ ID NO: 1153188 - protein, 9 aa, Mycobacterium
AEPSLPGIP

SEQ ID NO: 1153189 - protein, 7 aa, Mycobacterium
AEPSPVS

SEQ ID NO: 1153190 - protein, 7 aa, Mycobacterium
AEPSRGR

SEQ ID NO: 1153191 - protein, 10 aa, Mycobacterium
AEPSSRKAWT

SEQ ID NO: 1153192 - protein, 6 aa, Mycobacterium
AEPSVR

SEQ ID NO: 1153193 - protein, 6 aa, Mycobacterium
AEPTAT

SEQ ID NO: 1153194 - protein, 8 aa, Mycobacterium
AEQAKGAD

SEQ ID NO: 1153195 - protein, 5 aa, Mycobacterium
AEQAP

SEQ ID NO: 1153196 - protein, 8 aa, Mycobacterium
AEQAQAGE

SEQ ID NO: 1153197 - protein, 9 aa, Mycobacterium
AEQDNAGHN

SEQ ID NO: 1153198 - protein, 11 aa, Mycobacterium
AEQDPAANAAQ

SEQ ID NO: 1153199 - protein, 4 aa, Mycobacterium
AEQE

SEQ ID NO: 1153200 - protein, 7 aa, Mycobacterium
AEQEGKF

SEQ ID NO: 1153201 - protein, 7 aa, Mycobacterium
AEQFSPE

SEQ ID NO: 1153202 - protein, 12 aa, Mycobacterium
AEQGYPTATMPG

SEQ ID NO: 1153203 - protein, 4 aa, Mycobacterium
AEQH

SEQ ID NO: 1153204 - protein, 4 aa, Mycobacterium
AEQP

SEQ ID NO: 1153205 - protein, 19 aa, Mycobacterium
AEQPDGTWRPTTSRAAAEE

SEQ ID NO: 1153206 - protein, 11 aa, Mycobacterium
AEQRDPGDRRY

SEQ ID NO: 1153207 - protein, 10 aa, Mycobacterium
AEQRDPRRGT

SEQ ID NO: 1153208 - protein, 6 aa, Mycobacterium
AEQRER

SEQ ID NO: 1153209 - protein, 10 aa, Mycobacterium
AEQRGRKGPW

SEQ ID NO: 1153210 - protein, 10 aa, Mycobacterium
AEQRTLAGQR

SEQ ID NO: 1153211 - protein, 8 aa, Mycobacterium
AEQSESTM

SEQ ID NO: 1153212 - protein, 10 aa, Mycobacterium
AEQSRAQVDG

SEQ ID NO: 1153213 - protein, 8 aa, Mycobacterium
AEQTGQDQ

SEQ ID NO: 1153214 - protein, 9 aa, Mycobacterium
AERAAENRQ

SEQ ID NO: 1153215 - protein, 9 aa, Mycobacterium
AERAAGEPV

SEQ ID NO: 1153216 - protein, 5 aa, Mycobacterium
AERAE

SEQ ID NO: 1153217 - protein, 13 aa, Mycobacterium
AERAEALRRYAEI

SEQ ID NO: 1153218 - protein, 31 aa, Mycobacterium
AERAERRAEQEADRARDAYERDDGLQRRTGE

SEQ ID NO: 1153219 - protein, 10 aa, Mycobacterium
AERAGRDPAD

SEQ ID NO: 1153220 - protein, 9 aa, Mycobacterium
AERAGTSVP

SEQ ID NO: 1153221 - protein, 8 aa, Mycobacterium
AERDGHTV

SEQ ID NO: 1153222 - protein, 11 aa, Mycobacterium
AERDPASLSDD

SEQ ID NO: 1153223 - protein, 7 aa, Mycobacterium
AEREALT

SEQ ID NO: 1153224 - protein, 5 aa, Mycobacterium
AEREG

SEQ ID NO: 1153225 - protein, 6 aa, Mycobacterium
AEREGA

SEQ ID NO: 1153226 - protein, 11 aa, Mycobacterium
AERERAAKRFG

SEQ ID NO: 1153227 - protein, 13 aa, Mycobacterium
AERGAAELGPNAS

SEQ ID NO: 1153228 - protein, 5 aa, Mycobacterium
AERGL

SEQ ID NO: 1153229 - protein, 5 aa, Mycobacterium
AERGQ

SEQ ID NO: 1153230 - protein, 7 aa, Mycobacterium
AERGREL

SEQ ID NO: 1153231 - protein, 5 aa, Mycobacterium
AERGT

SEQ ID NO: 1153232 - protein, 6 aa, Mycobacterium
AERHPE

SEQ ID NO: 1153233 - protein, 4 aa, Mycobacterium
AERI

SEQ ID NO: 1153234 - protein, 17 aa, Mycobacterium
AERLEVQGKKDQKLQKR

SEQ ID NO: 1153235 - protein, 5 aa, Mycobacterium
AERLS

SEQ ID NO: 1153236 - protein, 5 aa, Mycobacterium
AERMS

SEQ ID NO: 1153237 - protein, 7 aa, Mycobacterium
AERNGYP

SEQ ID NO: 1153238 - protein, 4 aa, Mycobacterium
AERP

SEQ ID NO: 1153239 - protein, 6 aa, Mycobacterium
AERPHQ

SEQ ID NO: 1153240 - protein, 12 aa, Mycobacterium
AERPMTQWSEPG

SEQ ID NO: 1153241 - protein, 9 aa, Mycobacterium
AERPPRGAT

SEQ ID NO: 1153242 - protein, 9 aa, Mycobacterium
AERQDPNKA

SEQ ID NO: 1153243 - protein, 5 aa, Mycobacterium
AERQL

SEQ ID NO: 1153244 - protein, 8 aa, Mycobacterium
AERRGQSL

SEQ ID NO: 1153245 - protein, 7 aa, Mycobacterium
AERRPGT

SEQ ID NO: 1153246 - protein, 5 aa, Mycobacterium
AERRY

SEQ ID NO: 1153247 - protein, 13 aa, Mycobacterium
AERSCPTQAITVE

SEQ ID NO: 1153248 - protein, 9 aa, Mycobacterium
AERSKQTMR

SEQ ID NO: 1153249 - protein, 6 aa, Mycobacterium
AERTEL

SEQ ID NO: 1153250 - protein, 6 aa, Mycobacterium
AERTGA

SEQ ID NO: 1153251 - protein, 6 aa, Mycobacterium
AERTRD

SEQ ID NO: 1153252 - protein, 6 aa, Mycobacterium
AERTVS

SEQ ID NO: 1153253 - protein, 10 aa, Mycobacterium
AERVAEDSVE

SEQ ID NO: 1153254 - protein, 9 aa, Mycobacterium
AERVSPDPQ

SEQ ID NO: 1153255 - protein, 7 aa, Mycobacterium
AERYGHS

SEQ ID NO: 1153256 - protein, 11 aa, Mycobacterium
AERYGTSRSSL

SEQ ID NO: 1153257 - protein, 5 aa, Mycobacterium
AERYR

SEQ ID NO: 1153258 - protein, 11 aa, Mycobacterium
AESAAAADGRV

SEQ ID NO: 1153259 - protein, 9 aa, Mycobacterium
AESAADRPH

SEQ ID NO: 1153260 - protein, 18 aa, Mycobacterium
AESADTTLYDSPDTERPV

SEQ ID NO: 1153261 - protein, 11 aa, Mycobacterium
AESAGLHRPDG

SEQ ID NO: 1153262 - protein, 7 aa, Mycobacterium
AESARAR

SEQ ID NO: 1153263 - protein, 17 aa, Mycobacterium
AESATSGVAKGKTTGVL

SEQ ID NO: 1153264 - protein, 7 aa, Mycobacterium
AESCTGG

SEQ ID NO: 1153265 - protein, 8 aa, Mycobacterium
AESDGDRL

SEQ ID NO: 1153266 - protein, 10 aa, Mycobacterium
AESDIRTTTR

SEQ ID NO: 1153267 - protein, 9 aa, Mycobacterium
AESDPAAGA

SEQ ID NO: 1153268 - protein, 15 aa, Mycobacterium
AESDPDDEVAETTTK

SEQ ID NO: 1153269 - protein, 8 aa, Mycobacterium
AESEDRSA

SEQ ID NO: 1153270 - protein, 8 aa, Mycobacterium
AESGTAIG

SEQ ID NO: 1153271 - protein, 9 aa, Mycobacterium
AESKGEVTY

SEQ ID NO: 1153272 - protein, 4 aa, Mycobacterium
AESL

SEQ ID NO: 1153273 - protein, 6 aa, Mycobacterium
AESRTA

SEQ ID NO: 1153274 - protein, 7 aa, Mycobacterium
AESSARM

SEQ ID NO: 1153275 - protein, 11 aa, Mycobacterium
AESSGHSEPTI

SEQ ID NO: 1153276 - protein, 16 aa, Mycobacterium
AESTEYPDEAEALSAK

SEQ ID NO: 1153277 - protein, 7 aa, Mycobacterium
AESTGAL

SEQ ID NO: 1153278 - protein, 6 aa, Mycobacterium
AESTVD

SEQ ID NO: 1153279 - protein, 5 aa, Mycobacterium
AESVA

SEQ ID NO: 1153280 - protein, 12 aa, Mycobacterium
AESVRDDVRRGP

SEQ ID NO: 1153281 - protein, 8 aa, Mycobacterium
AESVTGER

SEQ ID NO: 1153282 - protein, 10 aa, Mycobacterium
AETAAGGLDD

SEQ ID NO: 1153283 - protein, 8 aa, Mycobacterium
AETAGSEV

SEQ ID NO: 1153284 - protein, 8 aa, Mycobacterium
AETAPELR

SEQ ID NO: 1153285 - protein, 7 aa, Mycobacterium
AETARHR

SEQ ID NO: 1153286 - protein, 8 aa, Mycobacterium
AETDGAGA

SEQ ID NO: 1153287 - protein, 6 aa, Mycobacterium
AETDPV

SEQ ID NO: 1153288 - protein, 12 aa, Mycobacterium
AETPDAATVPVT

SEQ ID NO: 1153289 - protein, 7 aa, Mycobacterium
AETPEFT

SEQ ID NO: 1153290 - protein, 6 aa, Mycobacterium
AETPEL

SEQ ID NO: 1153291 - protein, 6 aa, Mycobacterium
AETPTL

SEQ ID NO: 1153292 - protein, 8 aa, Mycobacterium
AETQPTAD

SEQ ID NO: 1153293 - protein, 7 aa, Mycobacterium
AETRGNP

SEQ ID NO: 1153294 - protein, 9 aa, Mycobacterium
AETRSTLPP

SEQ ID NO: 1153295 - protein, 5 aa, Mycobacterium
AETSL

SEQ ID NO: 1153296 - protein, 7 aa, Mycobacterium
AETSPNY

SEQ ID NO: 1153297 - protein, 6 aa, Mycobacterium
AETTVG

SEQ ID NO: 1153298 - protein, 17 aa, Mycobacterium
AETTVSADEEASRNEGF

SEQ ID NO: 1153299 - protein, 5 aa, Mycobacterium
AETYG

SEQ ID NO: 1153300 - protein, 18 aa, Mycobacterium
AEVAKSRAGQLSGGQRQR

SEQ ID NO: 1153301 - protein, 12 aa, Mycobacterium
AEVDSPGRAESR

SEQ ID NO: 1153302 - protein, 6 aa, Mycobacterium
AEVGDD

SEQ ID NO: 1153303 - protein, 27 aa, Mycobacterium
AEVPDDTAGAAPADDSAPAGEVEPMPE

SEQ ID NO: 1153304 - protein, 7 aa, Mycobacterium
AEVQPGE

SEQ ID NO: 1153305 - protein, 16 aa, Mycobacterium
AEVRDGDPSPDGAGPL

SEQ ID NO: 1153306 - protein, 15 aa, Mycobacterium
AEVRPGTLSGGQQQR

SEQ ID NO: 1153307 - protein, 8 aa, Mycobacterium
AEVSSGDI

SEQ ID NO: 1153308 - protein, 13 aa, Mycobacterium
AEVTARSAADLAD

SEQ ID NO: 1153309 - protein, 8 aa, Mycobacterium
AEVTGDTP

SEQ ID NO: 1153310 - protein, 17 aa, Mycobacterium
AEVTGLDPDALAGDEAL

SEQ ID NO: 1153311 - protein, 10 aa, Mycobacterium
AEWDEREETP

SEQ ID NO: 1153312 - protein, 4 aa, Mycobacterium
AEWE

SEQ ID NO: 1153313 - protein, 17 aa, Mycobacterium
AEWTPDSKSVLAGSPQV

SEQ ID NO: 1153314 - protein, 10 aa, Mycobacterium
AEYADPPAEI

SEQ ID NO: 1153315 - protein, 7 aa, Mycobacterium
AEYAGTG

SEQ ID NO: 1153316 - protein, 5 aa, Mycobacterium
AEYDD

SEQ ID NO: 1153317 - protein, 5 aa, Mycobacterium
AEYDE

SEQ ID NO: 1153318 - protein, 6 aa, Mycobacterium
AEYENR

SEQ ID NO: 1153319 - protein, 4 aa, Mycobacterium
AEYG

SEQ ID NO: 1153320 - protein, 6 aa, Mycobacterium
AEYGGA

SEQ ID NO: 1153321 - protein, 6 aa, Mycobacterium
AEYPGS

SEQ ID NO: 1153322 - protein, 4 aa, Mycobacterium
AEYQ

SEQ ID NO: 1153323 - protein, 4 aa, Mycobacterium
AEYT

SEQ ID NO: 1153324 - protein, 6 aa, Mycobacterium
AFAEPE

SEQ ID NO: 1153325 - protein, 11 aa, Mycobacterium
AFAPDGRHARR

SEQ ID NO: 1153326 - protein, 9 aa, Mycobacterium
AFDGNPDGL

SEQ ID NO: 1153327 - protein, 11 aa, Mycobacterium
AFDGTEGGTEV

SEQ ID NO: 1153328 - protein, 13 aa, Mycobacterium
AFDPTPVRMIVTR

SEQ ID NO: 1153329 - protein, 10 aa, Mycobacterium
AFEGPNGPAT

SEQ ID NO: 1153330 - protein, 5 aa, Mycobacterium
AFGPD

SEQ ID NO: 1153331 - protein, 7 aa, Mycobacterium
AFGPGDT

SEQ ID NO: 1153332 - protein, 6 aa, Mycobacterium
AFGQPI

SEQ ID NO: 1153333 - protein, 11 aa, Mycobacterium
AFGSSATPIYD

SEQ ID NO: 1153334 - protein, 20 aa, Mycobacterium
AFGTPDANAVHRSGPGPMGP

SEQ ID NO: 1153335 - protein, 5 aa, Mycobacterium
AFPPD

SEQ ID NO: 1153336 - protein, 7 aa, Mycobacterium
AFPTAGS

SEQ ID NO: 1153337 - protein, 5 aa, Mycobacterium
AFPTP

SEQ ID NO: 1153338 - protein, 10 aa, Mycobacterium
AFQDDEQRAK

SEQ ID NO: 1153339 - protein, 13 aa, Mycobacterium
AFRPDADGDGTVR

SEQ ID NO: 1153340 - protein, 6 aa, Mycobacterium
AFRPSP

SEQ ID NO: 1153341 - protein, 8 aa, Mycobacterium
AFSEKGGL

SEQ ID NO: 1153342 - protein, 12 aa, Mycobacterium
AFSGETNATGDV

SEQ ID NO: 1153343 - protein, 9 aa, Mycobacterium
AFSGGDPRA

SEQ ID NO: 1153344 - protein, 14 aa, Mycobacterium
AFSGKKKPPTAGRC

SEQ ID NO: 1153345 - protein, 9 aa, Mycobacterium
AGAAEAQKE

SEQ ID NO: 1153346 - protein, 20 aa, Mycobacterium
AGAAGLAAGAAAADGASSAT

SEQ ID NO: 1153347 - protein, 12 aa, Mycobacterium
AGAAGREATPLK

SEQ ID NO: 1153348 - protein, 5 aa, Mycobacterium
AGAAP

SEQ ID NO: 1153349 - protein, 12 aa, Mycobacterium
AGAARTLFGRDP

SEQ ID NO: 1153350 - protein, 18 aa, Mycobacterium
AGAATTYPWGDDPQPGGR

SEQ ID NO: 1153351 - protein, 17 aa, Mycobacterium
AGAATYPAERLRNDIDP

SEQ ID NO: 1153352 - protein, 6 aa, Mycobacterium
AGADAV

SEQ ID NO: 1153353 - protein, 11 aa, Mycobacterium
AGADDVGRAEE

SEQ ID NO: 1153354 - protein, 10 aa, Mycobacterium
AGADEATGCA

SEQ ID NO: 1153355 - protein, 7 aa, Mycobacterium
AGADEVS

SEQ ID NO: 1153356 - protein, 8 aa, Mycobacterium
AGADSGAI

SEQ ID NO: 1153357 - protein, 6 aa, Mycobacterium
AGADSL

SEQ ID NO: 1153358 - protein, 5 aa, Mycobacterium
AGADT

SEQ ID NO: 1153359 - protein, 12 aa, Mycobacterium
AGADTEDLPPPR

SEQ ID NO: 1153360 - protein, 8 aa, Mycobacterium
AGADVDPG

SEQ ID NO: 1153361 - protein, 6 aa, Mycobacterium
AGAEAA

SEQ ID NO: 1153362 - protein, 16 aa, Mycobacterium
AGAEAGTRRVTSAPPL

SEQ ID NO: 1153363 - protein, 6 aa, Mycobacterium
AGAEAL

SEQ ID NO: 1153364 - protein, 15 aa, Mycobacterium
AGAEMPERDPSDSVE

SEQ ID NO: 1153365 - protein, 8 aa, Mycobacterium
AGAEPEAQ

SEQ ID NO: 1153366 - protein, 8 aa, Mycobacterium
AGAEPPRR

SEQ ID NO: 1153367 - protein, 5 aa, Mycobacterium
AGAEQ

SEQ ID NO: 1153368 - protein, 7 aa, Mycobacterium
AGAERKK

SEQ ID NO: 1153369 - protein, 6 aa, Mycobacterium
AGAERV

SEQ ID NO: 1153370 - protein, 6 aa, Mycobacterium
AGAETV

SEQ ID NO: 1153371 - protein, 13 aa, Mycobacterium
AGAGAGLAGTEEV

SEQ ID NO: 1153372 - protein, 11 aa, Mycobacterium
AGAGATGNTTA

SEQ ID NO: 1153373 - protein, 7 aa, Mycobacterium
AGAGEPR

SEQ ID NO: 1153374 - protein, 7 aa, Mycobacterium
AGAGIGA

SEQ ID NO: 1153375 - protein, 6 aa, Mycobacterium
AGAGPL

SEQ ID NO: 1153376 - protein, 11 aa, Mycobacterium
AGAGPRLTEQP

SEQ ID NO: 1153377 - protein, 7 aa, Mycobacterium
AGAGPVS

SEQ ID NO: 1153378 - protein, 13 aa, Mycobacterium
AGAGTLSVGTTPL

SEQ ID NO: 1153379 - protein, 8 aa, Mycobacterium
AGAHPGGG

SEQ ID NO: 1153380 - protein, 26 aa, Mycobacterium
AGAKAEAERIRQEADELAADADVPEQ

SEQ ID NO: 1153381 - protein, 10 aa, Mycobacterium
AGAPALPPLA

SEQ ID NO: 1153382 - protein, 9 aa, Mycobacterium
AGAPDIGPH

SEQ ID NO: 1153383 - protein, 9 aa, Mycobacterium
AGAPGYEAD

SEQ ID NO: 1153384 - protein, 8 aa, Mycobacterium
AGAPHNDP

SEQ ID NO: 1153385 - protein, 8 aa, Mycobacterium
AGAPKDPA

SEQ ID NO: 1153386 - protein, 8 aa, Mycobacterium
AGAPNRGN

SEQ ID NO: 1153387 - protein, 8 aa, Mycobacterium
AGAPPSAA

SEQ ID NO: 1153388 - protein, 10 aa, Mycobacterium
AGAPPTPGVT

SEQ ID NO: 1153389 - protein, 6 aa, Mycobacterium
AGAQAF

SEQ ID NO: 1153390 - protein, 6 aa, Mycobacterium
AGAQEA

SEQ ID NO: 1153391 - protein, 15 aa, Mycobacterium
AGARDRDRDDENPFD

SEQ ID NO: 1153392 - protein, 5 aa, Mycobacterium
AGARF

SEQ ID NO: 1153393 - protein, 6 aa, Mycobacterium
AGARRI

SEQ ID NO: 1153394 - protein, 7 aa, Mycobacterium
AGARTTL

SEQ ID NO: 1153395 - protein, 5 aa, Mycobacterium
AGASF

SEQ ID NO: 1153396 - protein, 5 aa, Mycobacterium
AGASG

SEQ ID NO: 1153397 - protein, 11 aa, Mycobacterium
AGASPAGHGSK

SEQ ID NO: 1153398 - protein, 16 aa, Mycobacterium
AGASRRLTETARSRGV

SEQ ID NO: 1153399 - protein, 11 aa, Mycobacterium
AGASSPPQPAI

SEQ ID NO: 1153400 - protein, 8 aa, Mycobacterium
AGASTPHL

SEQ ID NO: 1153401 - protein, 8 aa, Mycobacterium
AGASVYSA

SEQ ID NO: 1153402 - protein, 5 aa, Mycobacterium
AGASY

SEQ ID NO: 1153403 - protein, 10 aa, Mycobacterium
AGATAPDGRC

SEQ ID NO: 1153404 - protein, 21 aa, Mycobacterium
AGATCGDLGRAATAAAGGQKP

SEQ ID NO: 1153405 - protein, 37 aa, Mycobacterium
AGATPQTASQAPAQQSGGGQESAASGSSSGPTEPPEY

SEQ ID NO: 1153406 - protein, 11 aa, Mycobacterium
AGATVTQDDNG

SEQ ID NO: 1153407 - protein, 6 aa, Mycobacterium
AGAWTG

SEQ ID NO: 1153408 - protein, 4 aa, Mycobacterium
AGCA

SEQ ID NO: 1153409 - protein, 8 aa, Mycobacterium
AGCNTPVP

SEQ ID NO: 1153410 - protein, 4 aa, Mycobacterium
AGCQ

SEQ ID NO: 1153411 - protein, 8 aa, Mycobacterium
AGDAHRRA

SEQ ID NO: 1153412 - protein, 8 aa, Mycobacterium
AGDAPGGT

SEQ ID NO: 1153413 - protein, 11 aa, Mycobacterium
AGDARKIKTAA

SEQ ID NO: 1153414 - protein, 9 aa, Mycobacterium
AGDATAAAA

SEQ ID NO: 1153415 - protein, 13 aa, Mycobacterium
AGDDARAPADEAA

SEQ ID NO: 1153416 - protein, 6 aa, Mycobacterium
AGDDGN

SEQ ID NO: 1153417 - protein, 9 aa, Mycobacterium
AGDDPDNVH

SEQ ID NO: 1153418 - protein, 9 aa, Mycobacterium
AGDDPQVNE

SEQ ID NO: 1153419 - protein, 9 aa, Mycobacterium
AGDDRVTTN

SEQ ID NO: 1153420 - protein, 8 aa, Mycobacterium
AGDDTAAA

SEQ ID NO: 1153421 - protein, 6 aa, Mycobacterium
AGDERS

SEQ ID NO: 1153422 - protein, 5 aa, Mycobacterium
AGDGA

SEQ ID NO: 1153423 - protein, 10 aa, Mycobacterium
AGDGDHGRGM

SEQ ID NO: 1153424 - protein, 6 aa, Mycobacterium
AGDGGA

SEQ ID NO: 1153425 - protein, 9 aa, Mycobacterium
AGDGTEPYA

SEQ ID NO: 1153426 - protein, 9 aa, Mycobacterium
AGDHGAKSI

SEQ ID NO: 1153427 - protein, 9 aa, Mycobacterium
AGDIRPGDD

SEQ ID NO: 1153428 - protein, 8 aa, Mycobacterium
AGDLDDRA

SEQ ID NO: 1153429 - protein, 10 aa, Mycobacterium
AGDLDTHDGE

SEQ ID NO: 1153430 - protein, 13 aa, Mycobacterium
AGDMSEVGSRSEM

SEQ ID NO: 1153431 - protein, 6 aa, Mycobacterium
AGDPDI

SEQ ID NO: 1153432 - protein, 7 aa, Mycobacterium
AGDPDYV

SEQ ID NO: 1153433 - protein, 9 aa, Mycobacterium
AGDPEDNRA

SEQ ID NO: 1153434 - protein, 6 aa, Mycobacterium
AGDPEV

SEQ ID NO: 1153435 - protein, 5 aa, Mycobacterium
AGDPM

SEQ ID NO: 1153436 - protein, 7 aa, Mycobacterium
AGDPSAP

SEQ ID NO: 1153437 - protein, 4 aa, Mycobacterium
AGDR

SEQ ID NO: 1153438 - protein, 8 aa, Mycobacterium
AGDRAENI

SEQ ID NO: 1153439 - protein, 9 aa, Mycobacterium
AGDRDELAD

SEQ ID NO: 1153440 - protein, 6 aa, Mycobacterium
AGDRGV

SEQ ID NO: 1153441 - protein, 6 aa, Mycobacterium
AGDRIE

SEQ ID NO: 1153442 - protein, 5 aa, Mycobacterium
AGDRV

SEQ ID NO: 1153443 - protein, 4 aa, Mycobacterium
AGDS

SEQ ID NO: 1153444 - protein, 9 aa, Mycobacterium
AGDSAGSNF

SEQ ID NO: 1153445 - protein, 7 aa, Mycobacterium
AGDTAAA

SEQ ID NO: 1153446 - protein, 13 aa, Mycobacterium
AGDTAGAAALTPA

SEQ ID NO: 1153447 - protein, 8 aa, Mycobacterium
AGDTSGQL

SEQ ID NO: 1153448 - protein, 7 aa, Mycobacterium
AGDTTLA

SEQ ID NO: 1153449 - protein, 16 aa, Mycobacterium
AGDTTSPGVEITGDEA

SEQ ID NO: 1153450 - protein, 19 aa, Mycobacterium
AGDVASSTAEPCAPPSPRQ

SEQ ID NO: 1153451 - protein, 7 aa, Mycobacterium
AGDVEGA

SEQ ID NO: 1153452 - protein, 13 aa, Mycobacterium
AGDVPPTVDGDGA

SEQ ID NO: 1153453 - protein, 8 aa, Mycobacterium
AGDYLPPY

SEQ ID NO: 1153454 - protein, 4 aa, Mycobacterium
AGEA

SEQ ID NO: 1153455 - protein, 9 aa, Mycobacterium
AGEAEARDA

SEQ ID NO: 1153456 - protein, 8 aa, Mycobacterium
AGEAFDTA

SEQ ID NO: 1153457 - protein, 8 aa, Mycobacterium
AGEAKDFA

SEQ ID NO: 1153458 - protein, 10 aa, Mycobacterium
AGEAKNTYGT

SEQ ID NO: 1153459 - protein, 7 aa, Mycobacterium
AGEAQAK

SEQ ID NO: 1153460 - protein, 11 aa, Mycobacterium
AGEATYDGRNT

SEQ ID NO: 1153461 - protein, 6 aa, Mycobacterium
AGEDGL

SEQ ID NO: 1153462 - protein, 11 aa, Mycobacterium
AGEDGRTMTDR

SEQ ID NO: 1153463 - protein, 12 aa, Mycobacterium
AGEDLDAYPRTL

SEQ ID NO: 1153464 - protein, 5 aa, Mycobacterium
AGEEA

SEQ ID NO: 1153465 - protein, 15 aa, Mycobacterium
AGEEVPQTKEETRAR

SEQ ID NO: 1153466 - protein, 5 aa, Mycobacterium
AGEGA

SEQ ID NO: 1153467 - protein, 12 aa, Mycobacterium
AGEGADGRDPMS

SEQ ID NO: 1153468 - protein, 13 aa, Mycobacterium
AGEGAESLPTDRR

SEQ ID NO: 1153469 - protein, 8 aa, Mycobacterium
AGEGEPAQ

SEQ ID NO: 1153470 - protein, 5 aa, Mycobacterium
AGEGH

SEQ ID NO: 1153471 - protein, 6 aa, Mycobacterium
AGEGRT

SEQ ID NO: 1153472 - protein, 5 aa, Mycobacterium
AGEKK

SEQ ID NO: 1153473 - protein, 5 aa, Mycobacterium
AGEKL

SEQ ID NO: 1153474 - protein, 8 aa, Mycobacterium
AGELTAGG

SEQ ID NO: 1153475 - protein, 10 aa, Mycobacterium
AGENGAGKST

SEQ ID NO: 1153476 - protein, 7 aa, Mycobacterium
AGEPEAA

SEQ ID NO: 1153477 - protein, 8 aa, Mycobacterium
AGEPPEDV

SEQ ID NO: 1153478 - protein, 15 aa, Mycobacterium
AGEPPQDSSLAATYA

SEQ ID NO: 1153479 - protein, 7 aa, Mycobacterium
AGEPVRT

SEQ ID NO: 1153480 - protein, 6 aa, Mycobacterium
AGEPVT

SEQ ID NO: 1153481 - protein, 9 aa, Mycobacterium
AGEQPTPVS

SEQ ID NO: 1153482 - protein, 11 aa, Mycobacterium
AGEQSNRVSTG

SEQ ID NO: 1153483 - protein, 6 aa, Mycobacterium
AGERAD

SEQ ID NO: 1153484 - protein, 6 aa, Mycobacterium
AGERGA

SEQ ID NO: 1153485 - protein, 6 aa, Mycobacterium
AGERGL

SEQ ID NO: 1153486 - protein, 7 aa, Mycobacterium
AGERPRT

SEQ ID NO: 1153487 - protein, 17 aa, Mycobacterium
AGERSGTAWLLGRRTAS

SEQ ID NO: 1153488 - protein, 5 aa, Mycobacterium
AGERY

SEQ ID NO: 1153489 - protein, 15 aa, Mycobacterium
AGESPLAADAVTASP

SEQ ID NO: 1153490 - protein, 5 aa, Mycobacterium
AGETG

SEQ ID NO: 1153491 - protein, 5 aa, Mycobacterium
AGETV

SEQ ID NO: 1153492 - protein, 8 aa, Mycobacterium
AGEVSTSE

SEQ ID NO: 1153493 - protein, 7 aa, Mycobacterium
AGEYEKR

SEQ ID NO: 1153494 - protein, 12 aa, Mycobacterium
AGFAEGRPLPTG

SEQ ID NO: 1153495 - protein, 6 aa, Mycobacterium
AGFEPL

SEQ ID NO: 1153496 - protein, 8 aa, Mycobacterium
AGFGGGGV

SEQ ID NO: 1153497 - protein, 7 aa, Mycobacterium
AGGALGG

SEQ ID NO: 1153498 - protein, 7 aa, Mycobacterium
AGGANPE

SEQ ID NO: 1153499 - protein, 5 aa, Mycobacterium
AGGAP

SEQ ID NO: 1153500 - protein, 7 aa, Mycobacterium
AGGASIH

SEQ ID NO: 1153501 - protein, 5 aa, Mycobacterium
AGGDA

SEQ ID NO: 1153502 - protein, 16 aa, Mycobacterium
AGGDPGALGDPPRPYR

SEQ ID NO: 1153503 - protein, 6 aa, Mycobacterium
AGGDYR

SEQ ID NO: 1153504 - protein, 10 aa, Mycobacterium
AGGELGAESS

SEQ ID NO: 1153505 - protein, 5 aa, Mycobacterium
AGGEP

SEQ ID NO: 1153506 - protein, 9 aa, Mycobacterium
AGGESTASL

SEQ ID NO: 1153507 - protein, 4 aa, Mycobacterium
AGGF

SEQ ID NO: 1153508 - protein, 6 aa, Mycobacterium
AGGGDR

SEQ ID NO: 1153509 - protein, 8 aa, Mycobacterium
AGGGERAA

SEQ ID NO: 1153510 - protein, 7 aa, Mycobacterium
AGGGNRA

SEQ ID NO: 1153511 - protein, 21 aa, Mycobacterium
AGGGPDVPLGTPVAGRSEPEL

SEQ ID NO: 1153512 - protein, 12 aa, Mycobacterium
AGGGQGGAVVIE

SEQ ID NO: 1153513 - protein, 5 aa, Mycobacterium
AGGHL

SEQ ID NO: 1153514 - protein, 17 aa, Mycobacterium
AGGHNLEEEGFQSVGSG

SEQ ID NO: 1153515 - protein, 8 aa, Mycobacterium
AGGHRNKR

SEQ ID NO: 1153516 - protein, 7 aa, Mycobacterium
AGGLGEA

SEQ ID NO: 1153517 - protein, 8 aa, Mycobacterium
AGGLNPAG

SEQ ID NO: 1153518 - protein, 11 aa, Mycobacterium
AGGLTATDGPV

SEQ ID NO: 1153519 - protein, 15 aa, Mycobacterium
AGGMHGSNRLGGNSL

SEQ ID NO: 1153520 - protein, 4 aa, Mycobacterium
AGGN

SEQ ID NO: 1153521 - protein, 4 aa, Mycobacterium
AGGP

SEQ ID NO: 1153522 - protein, 10 aa, Mycobacterium
AGGPEERQQA

SEQ ID NO: 1153523 - protein, 5 aa, Mycobacterium
AGGQN

SEQ ID NO: 1153524 - protein, 10 aa, Mycobacterium
AGGRDDDTGE

SEQ ID NO: 1153525 - protein, 25 aa, Mycobacterium
AGGRPMYERPDGRRFSHDEPEKRQE

SEQ ID NO: 1153526 - protein, 5 aa, Mycobacterium
AGGRT

SEQ ID NO: 1153527 - protein, 8 aa, Mycobacterium
AGGRTVGR

SEQ ID NO: 1153528 - protein, 9 aa, Mycobacterium
AGGSGIPGQ

SEQ ID NO: 1153529 - protein, 17 aa, Mycobacterium
AGGSPYVPAAEASAKFS

SEQ ID NO: 1153530 - protein, 9 aa, Mycobacterium
AGGSQADPE

SEQ ID NO: 1153531 - protein, 20 aa, Mycobacterium
AGGSQATAPVTNPATGEVTG

SEQ ID NO: 1153532 - protein, 5 aa, Mycobacterium
AGGTA

SEQ ID NO: 1153533 - protein, 15 aa, Mycobacterium
AGGTDPVEKATPGTI

SEQ ID NO: 1153534 - protein, 7 aa, Mycobacterium
AGGTESY

SEQ ID NO: 1153535 - protein, 6 aa, Mycobacterium
AGGTFS

SEQ ID NO: 1153536 - protein, 5 aa, Mycobacterium
AGGTI

SEQ ID NO: 1153537 - protein, 12 aa, Mycobacterium
AGGTPGATTTHD

SEQ ID NO: 1153538 - protein, 6 aa, Mycobacterium
AGGTPV

SEQ ID NO: 1153539 - protein, 5 aa, Mycobacterium
AGGTT

SEQ ID NO: 1153540 - protein, 6 aa, Mycobacterium
AGGTVR

SEQ ID NO: 1153541 - protein, 5 aa, Mycobacterium
AGGVG

SEQ ID NO: 1153542 - protein, 7 aa, Mycobacterium
AGGVGTA

SEQ ID NO: 1153543 - protein, 21 aa, Mycobacterium
AGGVRGQPAIAPYSAAKGALE

SEQ ID NO: 1153544 - protein, 6 aa, Mycobacterium
AGGVRP

SEQ ID NO: 1153545 - protein, 8 aa, Mycobacterium
AGGVSRGG

SEQ ID NO: 1153546 - protein, 15 aa, Mycobacterium
AGGVTDGDVGAAESQ

SEQ ID NO: 1153547 - protein, 4 aa, Mycobacterium
AGGW

SEQ ID NO: 1153548 - protein, 6 aa, Mycobacterium
AGGWEA

SEQ ID NO: 1153549 - protein, 16 aa, Mycobacterium
AGGWQQAEQPDASDAA

SEQ ID NO: 1153550 - protein, 6 aa, Mycobacterium
AGGYQG

SEQ ID NO: 1153551 - protein, 14 aa, Mycobacterium
AGGYVGRDDAANLT

SEQ ID NO: 1153552 - protein, 6 aa, Mycobacterium
AGGYVT

SEQ ID NO: 1153553 - protein, 6 aa, Mycobacterium
AGHDPR

SEQ ID NO: 1153554 - protein, 9 aa, Mycobacterium
AGHDSSGHP

SEQ ID NO: 1153555 - protein, 8 aa, Mycobacterium
AGHNDPEL

SEQ ID NO: 1153556 - protein, 17 aa, Mycobacterium
AGHPGGDLAGDVPEGDV

SEQ ID NO: 1153557 - protein, 9 aa, Mycobacterium
AGHPLDDDD

SEQ ID NO: 1153558 - protein, 16 aa, Mycobacterium
AGHRRDAGWGDATDFG

SEQ ID NO: 1153559 - protein, 22 aa, Mycobacterium
AGHTAAGDDNDAFTEAVVGFVS

SEQ ID NO: 1153560 - protein, 14 aa, Mycobacterium
AGHTAEPPATDTER

SEQ ID NO: 1153561 - protein, 6 aa, Mycobacterium
AGHTED

SEQ ID NO: 1153562 - protein, 5 aa, Mycobacterium
AGHTG

SEQ ID NO: 1153563 - protein, 10 aa, Mycobacterium
AGIAAGSDTL

SEQ ID NO: 1153564 - protein, 9 aa, Mycobacterium
AGIAGPQRD

SEQ ID NO: 1153565 - protein, 10 aa, Mycobacterium
AGIAQRTSRA

SEQ ID NO: 1153566 - protein, 10 aa, Mycobacterium
AGIDDAQQAP

SEQ ID NO: 1153567 - protein, 8 aa, Mycobacterium
AGIDPGDV

SEQ ID NO: 1153568 - protein, 5 aa, Mycobacterium
AGIEG

SEQ ID NO: 1153569 - protein, 7 aa, Mycobacterium
AGIEPQD

SEQ ID NO: 1153570 - protein, 6 aa, Mycobacterium
AGIGRK

SEQ ID NO: 1153571 - protein, 7 aa, Mycobacterium
AGIGSDA

SEQ ID NO: 1153572 - protein, 4 aa, Mycobacterium
AGIP

SEQ ID NO: 1153573 - protein, 4 aa, Mycobacterium
AGIT

SEQ ID NO: 1153574 - protein, 8 aa, Mycobacterium
AGITPGER

SEQ ID NO: 1153575 - protein, 16 aa, Mycobacterium
AGKAQGGMASGRSQLG

SEQ ID NO: 1153576 - protein, 6 aa, Mycobacterium
AGKARQ

SEQ ID NO: 1153577 - protein, 9 aa, Mycobacterium
AGKGKRALA

SEQ ID NO: 1153578 - protein, 9 aa, Mycobacterium
AGKPAPDSF

SEQ ID NO: 1153579 - protein, 4 aa, Mycobacterium
AGKR

SEQ ID NO: 1153580 - protein, 8 aa, Mycobacterium
AGKRNAID

SEQ ID NO: 1153581 - protein, 8 aa, Mycobacterium
AGKYGTTV

SEQ ID NO: 1153582 - protein, 9 aa, Mycobacterium
AGLAADPRR

SEQ ID NO: 1153583 - protein, 8 aa, Mycobacterium
AGLAGGPN

SEQ ID NO: 1153584 - protein, 12 aa, Mycobacterium
AGLANPNGERAQ

SEQ ID NO: 1153585 - protein, 12 aa, Mycobacterium
AGLAPQRLSGRV

SEQ ID NO: 1153586 - protein, 8 aa, Mycobacterium
AGLAPSDV

SEQ ID NO: 1153587 - protein, 25 aa, Mycobacterium
AGLATPESRGRRRGAQQDDDTDPEL

SEQ ID NO: 1153588 - protein, 6 aa, Mycobacterium
AGLDAE

SEQ ID NO: 1153589 - protein, 5 aa, Mycobacterium
AGLDG

SEQ ID NO: 1153590 - protein, 17 aa, Mycobacterium
AGLDGGSDFRRDGYVGV

SEQ ID NO: 1153591 - protein, 6 aa, Mycobacterium
AGLGDG

SEQ ID NO: 1153592 - protein, 6 aa, Mycobacterium
AGLPAT

SEQ ID NO: 1153593 - protein, 13 aa, Mycobacterium
AGLPDAESPDLRG

SEQ ID NO: 1153594 - protein, 13 aa, Mycobacterium
AGLPGGVPPTGRF

SEQ ID NO: 1153595 - protein, 7 aa, Mycobacterium
AGLPPAT

SEQ ID NO: 1153596 - protein, 7 aa, Mycobacterium
AGLPPGT

SEQ ID NO: 1153597 - protein, 6 aa, Mycobacterium
AGLPPL

SEQ ID NO: 1153598 - protein, 7 aa, Mycobacterium
AGLQTSG

SEQ ID NO: 1153599 - protein, 5 aa, Mycobacterium
AGLSA

SEQ ID NO: 1153600 - protein, 15 aa, Mycobacterium
AGLSDELTVVETAMA

SEQ ID NO: 1153601 - protein, 15 aa, Mycobacterium
AGLSPQTVARASQIS

SEQ ID NO: 1153602 - protein, 10 aa, Mycobacterium
AGLSSGQKQR

SEQ ID NO: 1153603 - protein, 7 aa, Mycobacterium
AGLTGGD

SEQ ID NO: 1153604 - protein, 6 aa, Mycobacterium
AGLTPA

SEQ ID NO: 1153605 - protein, 6 aa, Mycobacterium
AGLTYE

SEQ ID NO: 1153606 - protein, 6 aa, Mycobacterium
AGLVDP

SEQ ID NO: 1153607 - protein, 6 aa, Mycobacterium
AGMDPA

SEQ ID NO: 1153608 - protein, 8 aa, Mycobacterium
AGMDTGGV

SEQ ID NO: 1153609 - protein, 5 aa, Mycobacterium
AGMTS

SEQ ID NO: 1153610 - protein, 4 aa, Mycobacterium
AGNA

SEQ ID NO: 1153611 - protein, 9 aa, Mycobacterium
AGNETTRNA

SEQ ID NO: 1153612 - protein, 6 aa, Mycobacterium
AGNFDA

SEQ ID NO: 1153613 - protein, 5 aa, Mycobacterium
AGNFE

SEQ ID NO: 1153614 - protein, 7 aa, Mycobacterium
AGNFGQP

SEQ ID NO: 1153615 - protein, 17 aa, Mycobacterium
AGNGAEVTVESDDAAAL

SEQ ID NO: 1153616 - protein, 10 aa, Mycobacterium
AGNGAVGNTA

SEQ ID NO: 1153617 - protein, 6 aa, Mycobacterium
AGNGGS

SEQ ID NO: 1153618 - protein, 11 aa, Mycobacterium
AGNGMAGHTTP

SEQ ID NO: 1153619 - protein, 7 aa, Mycobacterium
AGNGMGR

SEQ ID NO: 1153620 - protein, 4 aa, Mycobacterium
AGNP

SEQ ID NO: 1153621 - protein, 5 aa, Mycobacterium
AGNPH

SEQ ID NO: 1153622 - protein, 6 aa, Mycobacterium
AGNPRE

SEQ ID NO: 1153623 - protein, 7 aa, Mycobacterium
AGNRPLQ

SEQ ID NO: 1153624 - protein, 11 aa, Mycobacterium
AGNSSPLSDGS

SEQ ID NO: 1153625 - protein, 11 aa, Mycobacterium
AGNSSQISDGA

SEQ ID NO: 1153626 - protein, 6 aa, Mycobacterium
AGPAAP

SEQ ID NO: 1153627 - protein, 6 aa, Mycobacterium
AGPALT

SEQ ID NO: 1153628 - protein, 6 aa, Mycobacterium
AGPAPM

SEQ ID NO: 1153629 - protein, 7 aa, Mycobacterium
AGPATQG

SEQ ID NO: 1153630 - protein, 6 aa, Mycobacterium
AGPCRT

SEQ ID NO: 1153631 - protein, 9 aa, Mycobacterium
AGPDAGYVT

SEQ ID NO: 1153632 - protein, 6 aa, Mycobacterium
AGPDAV

SEQ ID NO: 1153633 - protein, 7 aa, Mycobacterium
AGPDEAA

SEQ ID NO: 1153634 - protein, 9 aa, Mycobacterium
AGPDHPEAD

SEQ ID NO: 1153635 - protein, 8 aa, Mycobacterium
AGPDRAEK

SEQ ID NO: 1153636 - protein, 15 aa, Mycobacterium
AGPDSTLQSQPANAI

SEQ ID NO: 1153637 - protein, 7 aa, Mycobacterium
AGPDVDA

SEQ ID NO: 1153638 - protein, 6 aa, Mycobacterium
AGPEEV

SEQ ID NO: 1153639 - protein, 11 aa, Mycobacterium
AGPEGSDRPER

SEQ ID NO: 1153640 - protein, 6 aa, Mycobacterium
AGPEIG

SEQ ID NO: 1153641 - protein, 7 aa, Mycobacterium
AGPEKGS

SEQ ID NO: 1153642 - protein, 5 aa, Mycobacterium
AGPET

SEQ ID NO: 1153643 - protein, 11 aa, Mycobacterium
AGPFDDDSERR

SEQ ID NO: 1153644 - protein, 10 aa, Mycobacterium
AGPGATADGH

SEQ ID NO: 1153645 - protein, 8 aa, Mycobacterium
AGPGEGRV

SEQ ID NO: 1153646 - protein, 7 aa, Mycobacterium
AGPGSES

SEQ ID NO: 1153647 - protein, 8 aa, Mycobacterium
AGPGSFRG

SEQ ID NO: 1153648 - protein, 6 aa, Mycobacterium
AGPGSR

SEQ ID NO: 1153649 - protein, 14 aa, Mycobacterium
AGPHPNPAKASLGQ

SEQ ID NO: 1153650 - protein, 11 aa, Mycobacterium
AGPIDAPDPRV

SEQ ID NO: 1153651 - protein, 6 aa, Mycobacterium
AGPKKI

SEQ ID NO: 1153652 - protein, 7 aa, Mycobacterium
AGPLGAR

SEQ ID NO: 1153653 - protein, 21 aa, Mycobacterium
AGPNHPHAAQQPIPFEIKQVA

SEQ ID NO: 1153654 - protein, 16 aa, Mycobacterium
AGPNRSAPLDASLPTG

SEQ ID NO: 1153655 - protein, 8 aa, Mycobacterium
AGPPAAVD

SEQ ID NO: 1153656 - protein, 7 aa, Mycobacterium
AGPPAEV

SEQ ID NO: 1153657 - protein, 17 aa, Mycobacterium
AGPPGGGRVAGQFAGGQ

SEQ ID NO: 1153658 - protein, 6 aa, Mycobacterium
AGPPHT

SEQ ID NO: 1153659 - protein, 6 aa, Mycobacterium
AGPPLY

SEQ ID NO: 1153660 - protein, 6 aa, Mycobacterium
AGPPRD

SEQ ID NO: 1153661 - protein, 9 aa, Mycobacterium
AGPQATLRD

SEQ ID NO: 1153662 - protein, 5 aa, Mycobacterium
AGPQR

SEQ ID NO: 1153663 - protein, 6 aa, Mycobacterium
AGPQVG

SEQ ID NO: 1153664 - protein, 5 aa, Mycobacterium
AGPRG

SEQ ID NO: 1153665 - protein, 8 aa, Mycobacterium
AGPRLGKD

SEQ ID NO: 1153666 - protein, 7 aa, Mycobacterium
AGPRRGW

SEQ ID NO: 1153667 - protein, 7 aa, Mycobacterium
AGPRRYA

SEQ ID NO: 1153668 - protein, 10 aa, Mycobacterium
AGPSEQQAAS

SEQ ID NO: 1153669 - protein, 9 aa, Mycobacterium
AGPTGIPST

SEQ ID NO: 1153670 - protein, 6 aa, Mycobacterium
AGPTGR

SEQ ID NO: 1153671 - protein, 9 aa, Mycobacterium
AGPTRRPPG

SEQ ID NO: 1153672 - protein, 5 aa, Mycobacterium
AGPTV

SEQ ID NO: 1153673 - protein, 7 aa, Mycobacterium
AGPVRGG

SEQ ID NO: 1153674 - protein, 14 aa, Mycobacterium
AGPWAASAQPGQPA

SEQ ID NO: 1153675 - protein, 6 aa, Mycobacterium
AGPYGV

SEQ ID NO: 1153676 - protein, 11 aa, Mycobacterium
AGPYQRDRGPS

SEQ ID NO: 1153677 - protein, 10 aa, Mycobacterium
AGQAAPGVVN

SEQ ID NO: 1153678 - protein, 7 aa, Mycobacterium
AGQAGVT

SEQ ID NO: 1153679 - protein, 19 aa, Mycobacterium
AGQAPSTVAEAAPLPSTDR

SEQ ID NO: 1153680 - protein, 6 aa, Mycobacterium
AGQDGM

SEQ ID NO: 1153681 - protein, 16 aa, Mycobacterium
AGQDSDLGRGRSAYDR

SEQ ID NO: 1153682 - protein, 6 aa, Mycobacterium
AGQETL

SEQ ID NO: 1153683 - protein, 6 aa, Mycobacterium
AGQEVR

SEQ ID NO: 1153684 - protein, 6 aa, Mycobacterium
AGQIGD

SEQ ID NO: 1153685 - protein, 5 aa, Mycobacterium
AGQKG

SEQ ID NO: 1153686 - protein, 8 aa, Mycobacterium
AGQKVGST

SEQ ID NO: 1153687 - protein, 6 aa, Mycobacterium
AGQLGG

SEQ ID NO: 1153688 - protein, 18 aa, Mycobacterium
AGQPAGPGPRQGALTARE

SEQ ID NO: 1153689 - protein, 6 aa, Mycobacterium
AGQPKF

SEQ ID NO: 1153690 - protein, 9 aa, Mycobacterium
AGQPNGASS

SEQ ID NO: 1153691 - protein, 8 aa, Mycobacterium
AGQPPELG

SEQ ID NO: 1153692 - protein, 10 aa, Mycobacterium
AGQPYPPSSA

SEQ ID NO: 1153693 - protein, 11 aa, Mycobacterium
AGQRDQARRAA

SEQ ID NO: 1153694 - protein, 5 aa, Mycobacterium
AGQRE

SEQ ID NO: 1153695 - protein, 21 aa, Mycobacterium
AGQRKKAAAKGAGEDKKANVN

SEQ ID NO: 1153696 - protein, 10 aa, Mycobacterium
AGQSRHVDGT

SEQ ID NO: 1153697 - protein, 4 aa, Mycobacterium
AGQT

SEQ ID NO: 1153698 - protein, 9 aa, Mycobacterium
AGQTEDKEL

SEQ ID NO: 1153699 - protein, 6 aa, Mycobacterium
AGQTGL

SEQ ID NO: 1153700 - protein, 11 aa, Mycobacterium
AGQTTDPAEGL

SEQ ID NO: 1153701 - protein, 7 aa, Mycobacterium
AGQTTVE

SEQ ID NO: 1153702 - protein, 9 aa, Mycobacterium
AGQTVQPQP

SEQ ID NO: 1153703 - protein, 17 aa, Mycobacterium
AGRAAGKRINADDGIQR

SEQ ID NO: 1153704 - protein, 5 aa, Mycobacterium
AGRAD

SEQ ID NO: 1153705 - protein, 6 aa, Mycobacterium
AGRAGD

SEQ ID NO: 1153706 - protein, 5 aa, Mycobacterium
AGRCQ

SEQ ID NO: 1153707 - protein, 7 aa, Mycobacterium
AGRDEQS

SEQ ID NO: 1153708 - protein, 8 aa, Mycobacterium
AGRDGAPE

SEQ ID NO: 1153709 - protein, 5 aa, Mycobacterium
AGREA

SEQ ID NO: 1153710 - protein, 18 aa, Mycobacterium
AGREIPADRLSPTLVVRT

SEQ ID NO: 1153711 - protein, 5 aa, Mycobacterium
AGREP

SEQ ID NO: 1153712 - protein, 11 aa, Mycobacterium
AGRFDAESRRP

SEQ ID NO: 1153713 - protein, 9 aa, Mycobacterium
AGRGAVGDE

SEQ ID NO: 1153714 - protein, 12 aa, Mycobacterium
AGRGFGPQVSEA

SEQ ID NO: 1153715 - protein, 19 aa, Mycobacterium
AGRGFSSGADHKSAGSVPH

SEQ ID NO: 1153716 - protein, 5 aa, Mycobacterium
AGRGG

SEQ ID NO: 1153717 - protein, 9 aa, Mycobacterium
AGRGGAGAS

SEQ ID NO: 1153718 - protein, 8 aa, Mycobacterium
AGRHADPV

SEQ ID NO: 1153719 - protein, 5 aa, Mycobacterium
AGRIR

SEQ ID NO: 1153720 - protein, 6 aa, Mycobacterium
AGRKGY

SEQ ID NO: 1153721 - protein, 5 aa, Mycobacterium
AGRKR

SEQ ID NO: 1153722 - protein, 5 aa, Mycobacterium
AGRLT

SEQ ID NO: 1153723 - protein, 6 aa, Mycobacterium
AGRLTG

SEQ ID NO: 1153724 - protein, 4 aa, Mycobacterium
AGRN

SEQ ID NO: 1153725 - protein, 9 aa, Mycobacterium
AGRNPKLGY

SEQ ID NO: 1153726 - protein, 4 aa, Mycobacterium
AGRP

SEQ ID NO: 1153727 - protein, 8 aa, Mycobacterium
AGRPAGEI

SEQ ID NO: 1153728 - protein, 6 aa, Mycobacterium
AGRPEH

SEQ ID NO: 1153729 - protein, 8 aa, Mycobacterium
AGRPEVDP

SEQ ID NO: 1153730 - protein, 6 aa, Mycobacterium
AGRPGD

SEQ ID NO: 1153731 - protein, 7 aa, Mycobacterium
AGRPGKT

SEQ ID NO: 1153732 - protein, 8 aa, Mycobacterium
AGRPGRNL

SEQ ID NO: 1153733 - protein, 8 aa, Mycobacterium
AGRPLTAG

SEQ ID NO: 1153734 - protein, 17 aa, Mycobacterium
AGRPPDEYGAEPTKLSE

SEQ ID NO: 1153735 - protein, 9 aa, Mycobacterium
AGRPRSVAD

SEQ ID NO: 1153736 - protein, 15 aa, Mycobacterium
AGRPVTSNSVPTAHR

SEQ ID NO: 1153737 - protein, 16 aa, Mycobacterium
AGRQPNETNDKWSTQG

SEQ ID NO: 1153738 - protein, 9 aa, Mycobacterium
AGRREQAQR

SEQ ID NO: 1153739 - protein, 7 aa, Mycobacterium
AGRRGLP

SEQ ID NO: 1153740 - protein, 6 aa, Mycobacterium
AGRRHR

SEQ ID NO: 1153741 - protein, 14 aa, Mycobacterium
AGRRSTASNCASRQ

SEQ ID NO: 1153742 - protein, 5 aa, Mycobacterium
AGRRT

SEQ ID NO: 1153743 - protein, 6 aa, Mycobacterium
AGRSAA

SEQ ID NO: 1153744 - protein, 6 aa, Mycobacterium
AGRSDN

SEQ ID NO: 1153745 - protein, 7 aa, Mycobacterium
AGRSGEL

SEQ ID NO: 1153746 - protein, 10 aa, Mycobacterium
AGRSGRRGQG

SEQ ID NO: 1153747 - protein, 9 aa, Mycobacterium
AGRSKSNRL

SEQ ID NO: 1153748 - protein, 9 aa, Mycobacterium
AGRSPDESI

SEQ ID NO: 1153749 - protein, 11 aa, Mycobacterium
AGRSPRGEGRS

SEQ ID NO: 1153750 - protein, 7 aa, Mycobacterium
AGRSRAS

SEQ ID NO: 1153751 - protein, 7 aa, Mycobacterium
AGRTEYR

SEQ ID NO: 1153752 - protein, 7 aa, Mycobacterium
AGRTPRL

SEQ ID NO: 1153753 - protein, 14 aa, Mycobacterium
AGRTPTPTREHTTY

SEQ ID NO: 1153754 - protein, 6 aa, Mycobacterium
AGRTQR

SEQ ID NO: 1153755 - protein, 5 aa, Mycobacterium
AGRVP

SEQ ID NO: 1153756 - protein, 15 aa, Mycobacterium
AGRYSGRAVVRVAGG

SEQ ID NO: 1153757 - protein, 12 aa, Mycobacterium
AGSADGSFREDV

SEQ ID NO: 1153758 - protein, 9 aa, Mycobacterium
AGSAPRSTE

SEQ ID NO: 1153759 - protein, 4 aa, Mycobacterium
AGSD

SEQ ID NO: 1153760 - protein, 18 aa, Mycobacterium
AGSDGDAPVEAPAPAEIA

SEQ ID NO: 1153761 - protein, 5 aa, Mycobacterium
AGSDL

SEQ ID NO: 1153762 - protein, 6 aa, Mycobacterium
AGSDLS

SEQ ID NO: 1153763 - protein, 8 aa, Mycobacterium
AGSDTYGG

SEQ ID NO: 1153764 - protein, 6 aa, Mycobacterium
AGSEFR

SEQ ID NO: 1153765 - protein, 8 aa, Mycobacterium
AGSEYTYT

SEQ ID NO: 1153766 - protein, 11 aa, Mycobacterium
AGSGAPPAEEL

SEQ ID NO: 1153767 - protein, 7 aa, Mycobacterium
AGSGMRA

SEQ ID NO: 1153768 - protein, 9 aa, Mycobacterium
AGSGNESAR

SEQ ID NO: 1153769 - protein, 7 aa, Mycobacterium
AGSGRVG

SEQ ID NO: 1153770 - protein, 12 aa, Mycobacterium
AGSGVGSQGPDH

SEQ ID NO: 1153771 - protein, 5 aa, Mycobacterium
AGSHT

SEQ ID NO: 1153772 - protein, 4 aa, Mycobacterium
AGSM

SEQ ID NO: 1153773 - protein, 7 aa, Mycobacterium
AGSNIQD

SEQ ID NO: 1153774 - protein, 13 aa, Mycobacterium
AGSPAPEDESTEI

SEQ ID NO: 1153775 - protein, 9 aa, Mycobacterium
AGSPDRPRT

SEQ ID NO: 1153776 - protein, 8 aa, Mycobacterium
AGSPEVDP

SEQ ID NO: 1153777 - protein, 8 aa, Mycobacterium
AGSPRPTV

SEQ ID NO: 1153778 - protein, 8 aa, Mycobacterium
AGSPSRWK

SEQ ID NO: 1153779 - protein, 6 aa, Mycobacterium
AGSPYD

SEQ ID NO: 1153780 - protein, 7 aa, Mycobacterium
AGSQDIN

SEQ ID NO: 1153781 - protein, 6 aa, Mycobacterium
AGSQFT

SEQ ID NO: 1153782 - protein, 10 aa, Mycobacterium
AGSRHPAHRR

SEQ ID NO: 1153783 - protein, 4 aa, Mycobacterium
AGSS

SEQ ID NO: 1153784 - protein, 9 aa, Mycobacterium
AGSSAGGAL

SEQ ID NO: 1153785 - protein, 8 aa, Mycobacterium
AGSSPRGV

SEQ ID NO: 1153786 - protein, 14 aa, Mycobacterium
AGSSPSLAIDPDGG

SEQ ID NO: 1153787 - protein, 10 aa, Mycobacterium
AGSSSAEHAE

SEQ ID NO: 1153788 - protein, 9 aa, Mycobacterium
AGSTRTPLY

SEQ ID NO: 1153789 - protein, 7 aa, Mycobacterium
AGSTSAA

SEQ ID NO: 1153790 - protein, 11 aa, Mycobacterium
AGSVDDGKSTL

SEQ ID NO: 1153791 - protein, 7 aa, Mycobacterium
AGSVPPL

SEQ ID NO: 1153792 - protein, 9 aa, Mycobacterium
AGSVPREEH

SEQ ID NO: 1153793 - protein, 6 aa, Mycobacterium
AGSVSE

SEQ ID NO: 1153794 - protein, 11 aa, Mycobacterium
AGSYDPKAGSP

SEQ ID NO: 1153795 - protein, 8 aa, Mycobacterium
AGSYPDDA

SEQ ID NO: 1153796 - protein, 9 aa, Mycobacterium
AGTDLDPDS

SEQ ID NO: 1153797 - protein, 14 aa, Mycobacterium
AGTDPVTVAFPGGN

SEQ ID NO: 1153798 - protein, 13 aa, Mycobacterium
AGTEMTPEDWGTG

SEQ ID NO: 1153799 - protein, 8 aa, Mycobacterium
AGTEPKAI

SEQ ID NO: 1153800 - protein, 28 aa, Mycobacterium
AGTEQPGQPAGEVKSDLPPAEADVDPGA

SEQ ID NO: 1153801 - protein, 6 aa, Mycobacterium
AGTETV

SEQ ID NO: 1153802 - protein, 5 aa, Mycobacterium
AGTEV

SEQ ID NO: 1153803 - protein, 7 aa, Mycobacterium
AGTEYAA

SEQ ID NO: 1153804 - protein, 7 aa, Mycobacterium
AGTGKLT

SEQ ID NO: 1153805 - protein, 11 aa, Mycobacterium
AGTHGQDAANS

SEQ ID NO: 1153806 - protein, 4 aa, Mycobacterium
AGTK

SEQ ID NO: 1153807 - protein, 22 aa, Mycobacterium
AGTKVTRSLESKWESEQSPTPN

SEQ ID NO: 1153808 - protein, 6 aa, Mycobacterium
AGTLGS

SEQ ID NO: 1153809 - protein, 6 aa, Mycobacterium
AGTLSV

SEQ ID NO: 1153810 - protein, 5 aa, Mycobacterium
AGTMP

SEQ ID NO: 1153811 - protein, 8 aa, Mycobacterium
AGTNGEVA

SEQ ID NO: 1153812 - protein, 6 aa, Mycobacterium
AGTPAA

SEQ ID NO: 1153813 - protein, 8 aa, Mycobacterium
AGTPAPGV

SEQ ID NO: 1153814 - protein, 7 aa, Mycobacterium
AGTPARA

SEQ ID NO: 1153815 - protein, 19 aa, Mycobacterium
AGTPASTLPRSRRVTAGRA

SEQ ID NO: 1153816 - protein, 8 aa, Mycobacterium
AGTPDIDP

SEQ ID NO: 1153817 - protein, 6 aa, Mycobacterium
AGTPGA

SEQ ID NO: 1153818 - protein, 7 aa, Mycobacterium
AGTPGSA

SEQ ID NO: 1153819 - protein, 5 aa, Mycobacterium
AGTPH

SEQ ID NO: 1153820 - protein, 7 aa, Mycobacterium
AGTPPVV

SEQ ID NO: 1153821 - protein, 21 aa, Mycobacterium
AGTPQISGGLTDAEPGQCCEL

SEQ ID NO: 1153822 - protein, 8 aa, Mycobacterium
AGTPVPAP

SEQ ID NO: 1153823 - protein, 7 aa, Mycobacterium
AGTRDGL

SEQ ID NO: 1153824 - protein, 5 aa, Mycobacterium
AGTRM

SEQ ID NO: 1153825 - protein, 7 aa, Mycobacterium
AGTSDPL

SEQ ID NO: 1153826 - protein, 11 aa, Mycobacterium
AGTSFATPDKL

SEQ ID NO: 1153827 - protein, 6 aa, Mycobacterium
AGTSFD

SEQ ID NO: 1153828 - protein, 10 aa, Mycobacterium
AGTSPRDYPE

SEQ ID NO: 1153829 - protein, 10 aa, Mycobacterium
AGTTAGAAVR

SEQ ID NO: 1153830 - protein, 8 aa, Mycobacterium
AGTTAGQR

SEQ ID NO: 1153831 - protein, 11 aa, Mycobacterium
AGTTEVRETTT

SEQ ID NO: 1153832 - protein, 12 aa, Mycobacterium
AGTTGDLDAQTA

SEQ ID NO: 1153833 - protein, 26 aa, Mycobacterium
AGTTTRDGNDAKYGASAPQSATPAGR

SEQ ID NO: 1153834 - protein, 25 aa, Mycobacterium
AGTVAAQAGSRPALRSNARPDGARD

SEQ ID NO: 1153835 - protein, 11 aa, Mycobacterium
AGTVESVGEGV

SEQ ID NO: 1153836 - protein, 4 aa, Mycobacterium
AGVA

SEQ ID NO: 1153837 - protein, 5 aa, Mycobacterium
AGVAE

SEQ ID NO: 1153838 - protein, 9 aa, Mycobacterium
AGVAGKTRS

SEQ ID NO: 1153839 - protein, 11 aa, Mycobacterium
AGVAPPAKSIP

SEQ ID NO: 1153840 - protein, 11 aa, Mycobacterium
AGVDGSNVDTT

SEQ ID NO: 1153841 - protein, 9 aa, Mycobacterium
AGVDPERLR

SEQ ID NO: 1153842 - protein, 4 aa, Mycobacterium
AGVE

SEQ ID NO: 1153843 - protein, 5 aa, Mycobacterium
AGVEQ

SEQ ID NO: 1153844 - protein, 7 aa, Mycobacterium
AGVGDGT

SEQ ID NO: 1153845 - protein, 7 aa, Mycobacterium
AGVGGAD

SEQ ID NO: 1153846 - protein, 6 aa, Mycobacterium
AGVGHG

SEQ ID NO: 1153847 - protein, 8 aa, Mycobacterium
AGVGHGDA

SEQ ID NO: 1153848 - protein, 6 aa, Mycobacterium
AGVGKT

SEQ ID NO: 1153849 - protein, 7 aa, Mycobacterium
AGVGPED

SEQ ID NO: 1153850 - protein, 16 aa, Mycobacterium
AGVGSPKPLHETDDES

SEQ ID NO: 1153851 - protein, 7 aa, Mycobacterium
AGVPAAG

SEQ ID NO: 1153852 - protein, 15 aa, Mycobacterium
AGVPEDRAAAVPSAH

SEQ ID NO: 1153853 - protein, 10 aa, Mycobacterium
AGVPGADPGQ

SEQ ID NO: 1153854 - protein, 8 aa, Mycobacterium
AGVPGSSA

SEQ ID NO: 1153855 - protein, 8 aa, Mycobacterium
AGVQTDER

SEQ ID NO: 1153856 - protein, 12 aa, Mycobacterium
AGVQTTQTRYPG

SEQ ID NO: 1153857 - protein, 5 aa, Mycobacterium
AGVRP

SEQ ID NO: 1153858 - protein, 4 aa, Mycobacterium
AGVS

SEQ ID NO: 1153859 - protein, 5 aa, Mycobacterium
AGVSA

SEQ ID NO: 1153860 - protein, 16 aa, Mycobacterium
AGVSADELARLRSTLR

SEQ ID NO: 1153861 - protein, 6 aa, Mycobacterium
AGVSRS

SEQ ID NO: 1153862 - protein, 17 aa, Mycobacterium
AGYAAAQNDAQAQRVGE

SEQ ID NO: 1153863 - protein, 11 aa, Mycobacterium
AGYAKRDPALG

SEQ ID NO: 1153864 - protein, 6 aa, Mycobacterium
AGYEGQ

SEQ ID NO: 1153865 - protein, 6 aa, Mycobacterium
AGYGSG

SEQ ID NO: 1153866 - protein, 4 aa, Mycobacterium
AGYI

SEQ ID NO: 1153867 - protein, 4 aa, Mycobacterium
AGYL

SEQ ID NO: 1153868 - protein, 12 aa, Mycobacterium
AGYRRAADGADA

SEQ ID NO: 1153869 - protein, 5 aa, Mycobacterium
AGYSE

SEQ ID NO: 1153870 - protein, 6 aa, Mycobacterium
AGYTKG

SEQ ID NO: 1153871 - protein, 7 aa, Mycobacterium
AGYTTDG

SEQ ID NO: 1153872 - protein, 8 aa, Mycobacterium
AHADGKDV

SEQ ID NO: 1153873 - protein, 7 aa, Mycobacterium
AHADTTT

SEQ ID NO: 1153874 - protein, 4 aa, Mycobacterium
AHAE

SEQ ID NO: 1153875 - protein, 13 aa, Mycobacterium
AHAEETEEAEREG

SEQ ID NO: 1153876 - protein, 6 aa, Mycobacterium
AHAPPE

SEQ ID NO: 1153877 - protein, 11 aa, Mycobacterium
AHAPSAQNAQP

SEQ ID NO: 1153878 - protein, 5 aa, Mycobacterium
AHDER

SEQ ID NO: 1153879 - protein, 10 aa, Mycobacterium
AHDESRKSFG

SEQ ID NO: 1153880 - protein, 11 aa, Mycobacterium
AHDNEADEISA

SEQ ID NO: 1153881 - protein, 7 aa, Mycobacterium
AHDPKVG

SEQ ID NO: 1153882 - protein, 8 aa, Mycobacterium
AHDQSASY

SEQ ID NO: 1153883 - protein, 13 aa, Mycobacterium
AHDRAAAGEVPQP

SEQ ID NO: 1153884 - protein, 15 aa, Mycobacterium
AHDSAADEYGEGERA

SEQ ID NO: 1153885 - protein, 6 aa, Mycobacterium
AHDTYR

SEQ ID NO: 1153886 - protein, 13 aa, Mycobacterium
AHDYPDDTRTAAE

SEQ ID NO: 1153887 - protein, 4 aa, Mycobacterium
AHED

SEQ ID NO: 1153888 - protein, 8 aa, Mycobacterium
AHEEGGER

SEQ ID NO: 1153889 - protein, 17 aa, Mycobacterium
AHEENFSAATDETLRDI

SEQ ID NO: 1153890 - protein, 7 aa, Mycobacterium
AHGDGEE

SEQ ID NO: 1153891 - protein, 5 aa, Mycobacterium
AHGDT

SEQ ID NO: 1153892 - protein, 5 aa, Mycobacterium
AHGGA

SEQ ID NO: 1153893 - protein, 16 aa, Mycobacterium
AHGGGQKSIQPTTVDA

SEQ ID NO: 1153894 - protein, 8 aa, Mycobacterium
AHGGHRET

SEQ ID NO: 1153895 - protein, 5 aa, Mycobacterium
AHGGL

SEQ ID NO: 1153896 - protein, 5 aa, Mycobacterium
AHGPV

SEQ ID NO: 1153897 - protein, 16 aa, Mycobacterium
AHGSPVAEAAQTASGF

SEQ ID NO: 1153898 - protein, 7 aa, Mycobacterium
AHGYTPE

SEQ ID NO: 1153899 - protein, 8 aa, Mycobacterium
AHHRGPDR

SEQ ID NO: 1153900 - protein, 5 aa, Mycobacterium
AHKDE

SEQ ID NO: 1153901 - protein, 9 aa, Mycobacterium
AHPAEDAVS

SEQ ID NO: 1153902 - protein, 4 aa, Mycobacterium
AHPE

SEQ ID NO: 1153903 - protein, 12 aa, Mycobacterium
AHPPAARPDPRV

SEQ ID NO: 1153904 - protein, 7 aa, Mycobacterium
AHPQRAD

SEQ ID NO: 1153905 - protein, 5 aa, Mycobacterium
AHPRE

SEQ ID NO: 1153906 - protein, 16 aa, Mycobacterium
AHPSAQQAAEGYDREE

SEQ ID NO: 1153907 - protein, 6 aa, Mycobacterium
AHPVDG

SEQ ID NO: 1153908 - protein, 6 aa, Mycobacterium
AHPYEE

SEQ ID NO: 1153909 - protein, 7 aa, Mycobacterium
AHQARHP

SEQ ID NO: 1153910 - protein, 5 aa, Mycobacterium
AHRAT

SEQ ID NO: 1153911 - protein, 5 aa, Mycobacterium
AHRDK

SEQ ID NO: 1153912 - protein, 10 aa, Mycobacterium
AHRDLDSSWD

SEQ ID NO: 1153913 - protein, 4 aa, Mycobacterium
AHRE

SEQ ID NO: 1153914 - protein, 14 aa, Mycobacterium
AHRKSGADIATGRL

SEQ ID NO: 1153915 - protein, 10 aa, Mycobacterium
AHRPDRPAFT

SEQ ID NO: 1153916 - protein, 9 aa, Mycobacterium
AHRQGAASV

SEQ ID NO: 1153917 - protein, 9 aa, Mycobacterium
AHRRPRPDL

SEQ ID NO: 1153918 - protein, 7 aa, Mycobacterium
AHSAART

SEQ ID NO: 1153919 - protein, 5 aa, Mycobacterium
AHSAP

SEQ ID NO: 1153920 - protein, 6 aa, Mycobacterium
AHSEGT

SEQ ID NO: 1153921 - protein, 7 aa, Mycobacterium
AHSNNKE

SEQ ID NO: 1153922 - protein, 7 aa, Mycobacterium
AHSQPRG

SEQ ID NO: 1153923 - protein, 8 aa, Mycobacterium
AHSVDSSD

SEQ ID NO: 1153924 - protein, 7 aa, Mycobacterium
AHTARAA

SEQ ID NO: 1153925 - protein, 7 aa, Mycobacterium
AHTPAQR

SEQ ID NO: 1153926 - protein, 7 aa, Mycobacterium
AHTPDAT

SEQ ID NO: 1153927 - protein, 4 aa, Mycobacterium
AHVD

SEQ ID NO: 1153928 - protein, 4 aa, Mycobacterium
AHVE

SEQ ID NO: 1153929 - protein, 19 aa, Mycobacterium
AIAAGKADGSRLSAAVKAR

SEQ ID NO: 1153930 - protein, 15 aa, Mycobacterium
AIAATKSELPQAVPE

SEQ ID NO: 1153931 - protein, 17 aa, Mycobacterium
AIADGTSRVHAGSTEVS

SEQ ID NO: 1153932 - protein, 7 aa, Mycobacterium
AIADTGR

SEQ ID NO: 1153933 - protein, 7 aa, Mycobacterium
AIAGPLT

SEQ ID NO: 1153934 - protein, 9 aa, Mycobacterium
AIANGSEPW

SEQ ID NO: 1153935 - protein, 11 aa, Mycobacterium
AIATEPTEQLS

SEQ ID NO: 1153936 - protein, 4 aa, Mycobacterium
AIDD

SEQ ID NO: 1153937 - protein, 8 aa, Mycobacterium
AIDPDHAS

SEQ ID NO: 1153938 - protein, 6 aa, Mycobacterium
AIEEGN

SEQ ID NO: 1153939 - protein, 6 aa, Mycobacterium
AIEEQS

SEQ ID NO: 1153940 - protein, 9 aa, Mycobacterium
AIEETTGRT

SEQ ID NO: 1153941 - protein, 14 aa, Mycobacterium
AIEGAARGEGADEL

SEQ ID NO: 1153942 - protein, 29 aa, Mycobacterium
AIEGAGGPGGPASGGGGANTAAGATGAIG

SEQ ID NO: 1153943 - protein, 6 aa, Mycobacterium
AIEGNV

SEQ ID NO: 1153944 - protein, 10 aa, Mycobacterium
AIEPGAPRPT

SEQ ID NO: 1153945 - protein, 10 aa, Mycobacterium
AIEPGSPGAT

SEQ ID NO: 1153946 - protein, 12 aa, Mycobacterium
AIGAGSGALDPT

SEQ ID NO: 1153947 - protein, 7 aa, Mycobacterium
AIGDSGQ

SEQ ID NO: 1153948 - protein, 6 aa, Mycobacterium
AIGPDT

SEQ ID NO: 1153949 - protein, 11 aa, Mycobacterium
AIGPGADPRKV

SEQ ID NO: 1153950 - protein, 19 aa, Mycobacterium
AIGPSEDDDLRPPESPEAR

SEQ ID NO: 1153951 - protein, 8 aa, Mycobacterium
AIGPSKAK

SEQ ID NO: 1153952 - protein, 6 aa, Mycobacterium
AIGQAR

SEQ ID NO: 1153953 - protein, 12 aa, Mycobacterium
AIGQGSGLATQG

SEQ ID NO: 1153954 - protein, 5 aa, Mycobacterium
AIGTS

SEQ ID NO: 1153955 - protein, 10 aa, Mycobacterium
AIKDAKNRLG

SEQ ID NO: 1153956 - protein, 8 aa, Mycobacterium
AIKPSYGL

SEQ ID NO: 1153957 - protein, 17 aa, Mycobacterium
AINQDGASGGLTVPNGV

SEQ ID NO: 1153958 - protein, 11 aa, Mycobacterium
AINQDGRSNGL

SEQ ID NO: 1153959 - protein, 12 aa, Mycobacterium
AIPAPNARGERV

SEQ ID NO: 1153960 - protein, 6 aa, Mycobacterium
AIPDVE

SEQ ID NO: 1153961 - protein, 5 aa, Mycobacterium
AIPEG

SEQ ID NO: 1153962 - protein, 11 aa, Mycobacterium
AIPGANVKRGD

SEQ ID NO: 1153963 - protein, 10 aa, Mycobacterium
AIPGPKSQQL

SEQ ID NO: 1153964 - protein, 7 aa, Mycobacterium
AIPSAGG

SEQ ID NO: 1153965 - protein, 12 aa, Mycobacterium
AIQESREACGGA

SEQ ID NO: 1153966 - protein, 7 aa, Mycobacterium
AISASYD

SEQ ID NO: 1153967 - protein, 15 aa, Mycobacterium
AISRSGAAIPADPAT

SEQ ID NO: 1153968 - protein, 8 aa, Mycobacterium
AITAPDAP

SEQ ID NO: 1153969 - protein, 6 aa, Mycobacterium
AITERQ

SEQ ID NO: 1153970 - protein, 9 aa, Mycobacterium
AITGSESDQ

SEQ ID NO: 1153971 - protein, 5 aa, Mycobacterium
AITNP

SEQ ID NO: 1153972 - protein, 6 aa, Mycobacterium
AITPAE

SEQ ID NO: 1153973 - protein, 18 aa, Mycobacterium
AITPDGEVTYSAGGREHR

SEQ ID NO: 1153974 - protein, 7 aa, Mycobacterium
AITSNGA

SEQ ID NO: 1153975 - protein, 7 aa, Mycobacterium
AIYEKDG

SEQ ID NO: 1153976 - protein, 4 aa, Mycobacterium
AIYG

SEQ ID NO: 1153977 - protein, 10 aa, Mycobacterium
AKAAGDAVRN

SEQ ID NO: 1153978 - protein, 8 aa, Mycobacterium
AKADGAPA

SEQ ID NO: 1153979 - protein, 8 aa, Mycobacterium
AKAGGADA

SEQ ID NO: 1153980 - protein, 7 aa, Mycobacterium
AKAGRDV

SEQ ID NO: 1153981 - protein, 4 aa, Mycobacterium
AKAI

SEQ ID NO: 1153982 - protein, 10 aa, Mycobacterium
AKAKGEDAKV

SEQ ID NO: 1153983 - protein, 4 aa, Mycobacterium
AKAL

SEQ ID NO: 1153984 - protein, 8 aa, Mycobacterium
AKALGEAA

SEQ ID NO: 1153985 - protein, 9 aa, Mycobacterium
AKALSDTVT

SEQ ID NO: 1153986 - protein, 5 aa, Mycobacterium
AKANG

SEQ ID NO: 1153987 - protein, 4 aa, Mycobacterium
AKAP

SEQ ID NO: 1153988 - protein, 8 aa, Mycobacterium
AKAPSAFA

SEQ ID NO: 1153989 - protein, 8 aa, Mycobacterium
AKAPSVPV

SEQ ID NO: 1153990 - protein, 8 aa, Mycobacterium
AKAQADRM

SEQ ID NO: 1153991 - protein, 38 aa, Mycobacterium
AKAQGKHSNIGYDAPKGMDETKSKIRLGTGDDPRVSTA

SEQ ID NO: 1153992 - protein, 7 aa, Mycobacterium
AKATGKN

SEQ ID NO: 1153993 - protein, 7 aa, Mycobacterium
AKATGLD

SEQ ID NO: 1153994 - protein, 7 aa, Mycobacterium
AKATPDD

SEQ ID NO: 1153995 - protein, 12 aa, Mycobacterium
AKATRPEVRGGL

SEQ ID NO: 1153996 - protein, 12 aa, Mycobacterium
AKATSSASGIIV

SEQ ID NO: 1153997 - protein, 10 aa, Mycobacterium
AKAVAEEATR

SEQ ID NO: 1153998 - protein, 7 aa, Mycobacterium
AKDGSIA

SEQ ID NO: 1153999 - protein, 4 aa, Mycobacterium
AKDL

SEQ ID NO: 1154000 - protein, 7 aa, Mycobacterium
AKDNPDR

SEQ ID NO: 1154001 - protein, 10 aa, Mycobacterium
AKDNPTGPVR

SEQ ID NO: 1154002 - protein, 7 aa, Mycobacterium
AKDPRMK

SEQ ID NO: 1154003 - protein, 7 aa, Mycobacterium
AKDPSRS

SEQ ID NO: 1154004 - protein, 9 aa, Mycobacterium
AKDTAKGWE

SEQ ID NO: 1154005 - protein, 10 aa, Mycobacterium
AKDTGEREEL

SEQ ID NO: 1154006 - protein, 7 aa, Mycobacterium
AKDYASL

SEQ ID NO: 1154007 - protein, 6 aa, Mycobacterium
AKEAGA

SEQ ID NO: 1154008 - protein, 6 aa, Mycobacterium
AKEAGF

SEQ ID NO: 1154009 - protein, 8 aa, Mycobacterium
AKEAGLTP

SEQ ID NO: 1154010 - protein, 6 aa, Mycobacterium
AKEHDA

SEQ ID NO: 1154011 - protein, 8 aa, Mycobacterium
AKEHSESM

SEQ ID NO: 1154012 - protein, 10 aa, Mycobacterium
AKELGGNSNS

SEQ ID NO: 1154013 - protein, 23 aa, Mycobacterium
AKEPGGEKAAAKRDAKGIPSPRA

SEQ ID NO: 1154014 - protein, 4 aa, Mycobacterium
AKER

SEQ ID NO: 1154015 - protein, 14 aa, Mycobacterium
AKEREAFGRTIGSN

SEQ ID NO: 1154016 - protein, 13 aa, Mycobacterium
AKERSDAHETGEI

SEQ ID NO: 1154017 - protein, 10 aa, Mycobacterium
AKESGTNALA

SEQ ID NO: 1154018 - protein, 23 aa, Mycobacterium
AKEVETKEQIAATAGISAGDQSI

SEQ ID NO: 1154019 - protein, 12 aa, Mycobacterium
AKGAAGPGGPGG

SEQ ID NO: 1154020 - protein, 15 aa, Mycobacterium
AKGAPPERIQHDPLT

SEQ ID NO: 1154021 - protein, 11 aa, Mycobacterium
AKGEEGPEAQD

SEQ ID NO: 1154022 - protein, 5 aa, Mycobacterium
AKGEL

SEQ ID NO: 1154023 - protein, 9 aa, Mycobacterium
AKGELDKPR

SEQ ID NO: 1154024 - protein, 14 aa, Mycobacterium
AKGEPTPEDGYAGS

SEQ ID NO: 1154025 - protein, 9 aa, Mycobacterium
AKGGNTNVD

SEQ ID NO: 1154026 - protein, 8 aa, Mycobacterium
AKGKAAKL

SEQ ID NO: 1154027 - protein, 14 aa, Mycobacterium
AKGKAALLRELTDL

SEQ ID NO: 1154028 - protein, 5 aa, Mycobacterium
AKGKE

SEQ ID NO: 1154029 - protein, 21 aa, Mycobacterium
AKGLMETATDGLRKRVLKVKG

SEQ ID NO: 1154030 - protein, 8 aa, Mycobacterium
AKGLSSQR

SEQ ID NO: 1154031 - protein, 8 aa, Mycobacterium
AKGPDAPT

SEQ ID NO: 1154032 - protein, 7 aa, Mycobacterium
AKGPYTA

SEQ ID NO: 1154033 - protein, 8 aa, Mycobacterium
AKGRGRDM

SEQ ID NO: 1154034 - protein, 7 aa, Mycobacterium
AKGRSDV

SEQ ID NO: 1154035 - protein, 4 aa, Mycobacterium
AKGV

SEQ ID NO: 1154036 - protein, 14 aa, Mycobacterium
AKGWPEDGIAPGTR

SEQ ID NO: 1154037 - protein, 25 aa, Mycobacterium
AKGYDLPDYPGDPKTDEEKENRARY

SEQ ID NO: 1154038 - protein, 5 aa, Mycobacterium
AKHPD

SEQ ID NO: 1154039 - protein, 7 aa, Mycobacterium
AKHSGAD

SEQ ID NO: 1154040 - protein, 4 aa, Mycobacterium
AKHV

SEQ ID NO: 1154041 - protein, 5 aa, Mycobacterium
AKIGE

SEQ ID NO: 1154042 - protein, 12 aa, Mycobacterium
AKKEKAENGVAS

SEQ ID NO: 1154043 - protein, 5 aa, Mycobacterium
AKKGI

SEQ ID NO: 1154044 - protein, 8 aa, Mycobacterium
AKKHPHSM

SEQ ID NO: 1154045 - protein, 6 aa, Mycobacterium
AKKQKA

SEQ ID NO: 1154046 - protein, 17 aa, Mycobacterium
AKKTRESLQATAQLTQT

SEQ ID NO: 1154047 - protein, 10 aa, Mycobacterium
AKKVTPDFAP

SEQ ID NO: 1154048 - protein, 7 aa, Mycobacterium
AKLAAAN

SEQ ID NO: 1154049 - protein, 27 aa, Mycobacterium
AKLEARLSAKNEARRYKSQQKAETRAL

SEQ ID NO: 1154050 - protein, 7 aa, Mycobacterium
AKLTPEE

SEQ ID NO: 1154051 - protein, 9 aa, Mycobacterium
AKNDFAERE

SEQ ID NO: 1154052 - protein, 9 aa, Mycobacterium
AKNNDVEID

SEQ ID NO: 1154053 - protein, 13 aa, Mycobacterium
AKNPYSSSPVERS

SEQ ID NO: 1154054 - protein, 17 aa, Mycobacterium
AKPAVQQPSWDADAAKA

SEQ ID NO: 1154055 - protein, 6 aa, Mycobacterium
AKPDDI

SEQ ID NO: 1154056 - protein, 12 aa, Mycobacterium
AKPGRLEGPDPS

SEQ ID NO: 1154057 - protein, 16 aa, Mycobacterium
AKPHPDREIPQAQSAH

SEQ ID NO: 1154058 - protein, 14 aa, Mycobacterium
AKPIEGADPRSGRW

SEQ ID NO: 1154059 - protein, 4 aa, Mycobacterium
AKPK

SEQ ID NO: 1154060 - protein, 7 aa, Mycobacterium
AKPLSDG

SEQ ID NO: 1154061 - protein, 8 aa, Mycobacterium
AKPPDLPD

SEQ ID NO: 1154062 - protein, 10 aa, Mycobacterium
AKPSASKGRY

SEQ ID NO: 1154063 - protein, 10 aa, Mycobacterium
AKPTPADAAD

SEQ ID NO: 1154064 - protein, 6 aa, Mycobacterium
AKPTSN

SEQ ID NO: 1154065 - protein, 7 aa, Mycobacterium
AKPYGVS

SEQ ID NO: 1154066 - protein, 6 aa, Mycobacterium
AKQAVA

SEQ ID NO: 1154067 - protein, 21 aa, Mycobacterium
AKQGERSDGGSKQERSDGGLS

SEQ ID NO: 1154068 - protein, 9 aa, Mycobacterium
AKQHPGQSR

SEQ ID NO: 1154069 - protein, 8 aa, Mycobacterium
AKRAVDAG

SEQ ID NO: 1154070 - protein, 9 aa, Mycobacterium
AKRDDGGRR

SEQ ID NO: 1154071 - protein, 9 aa, Mycobacterium
AKRDGDSYV

SEQ ID NO: 1154072 - protein, 4 aa, Mycobacterium
AKRG

SEQ ID NO: 1154073 - protein, 5 aa, Mycobacterium
AKRGG

SEQ ID NO: 1154074 - protein, 7 aa, Mycobacterium
AKRGLPA

SEQ ID NO: 1154075 - protein, 9 aa, Mycobacterium
AKRKSTQRL

SEQ ID NO: 1154076 - protein, 22 aa, Mycobacterium
AKRKSYEDRAQTALGVVESGDR

SEQ ID NO: 1154077 - protein, 9 aa, Mycobacterium
AKRLSSQPR

SEQ ID NO: 1154078 - protein, 11 aa, Mycobacterium
AKRQADTNTAV

SEQ ID NO: 1154079 - protein, 62 aa, Mycobacterium
AKRQGTHSTKTRGEVSGGGKKPYRQKGTGRARQGSTRAPQFTGGGTVHGPQPRDYSQRTPKK

SEQ ID NO: 1154080 - protein, 8 aa, Mycobacterium
AKRRYQSG

SEQ ID NO: 1154081 - protein, 4 aa, Mycobacterium
AKRT

SEQ ID NO: 1154082 - protein, 15 aa, Mycobacterium
AKRTTRLVAKQIKSV

SEQ ID NO: 1154083 - protein, 13 aa, Mycobacterium
AKRVSGAGDDAFE

SEQ ID NO: 1154084 - protein, 6 aa, Mycobacterium
AKSAFR

SEQ ID NO: 1154085 - protein, 11 aa, Mycobacterium
AKSEPLEEGGR

SEQ ID NO: 1154086 - protein, 6 aa, Mycobacterium
AKSGAA

SEQ ID NO: 1154087 - protein, 11 aa, Mycobacterium
AKSGLPSRAEI

SEQ ID NO: 1154088 - protein, 6 aa, Mycobacterium
AKSNVD

SEQ ID NO: 1154089 - protein, 5 aa, Mycobacterium
AKSRS

SEQ ID NO: 1154090 - protein, 6 aa, Mycobacterium
AKSSPF

SEQ ID NO: 1154091 - protein, 6 aa, Mycobacterium
AKSVTA

SEQ ID NO: 1154092 - protein, 4 aa, Mycobacterium
AKTA

SEQ ID NO: 1154093 - protein, 5 aa, Mycobacterium
AKTAG

SEQ ID NO: 1154094 - protein, 10 aa, Mycobacterium
AKTAPKDGGL

SEQ ID NO: 1154095 - protein, 6 aa, Mycobacterium
AKTAVG

SEQ ID NO: 1154096 - protein, 7 aa, Mycobacterium
AKTDDGD

SEQ ID NO: 1154097 - protein, 14 aa, Mycobacterium
AKTDRAALAGGTPY

SEQ ID NO: 1154098 - protein, 7 aa, Mycobacterium
AKTDTED

SEQ ID NO: 1154099 - protein, 9 aa, Mycobacterium
AKTEPINGE

SEQ ID NO: 1154100 - protein, 18 aa, Mycobacterium
AKTGQARSNTLSYARDGE

SEQ ID NO: 1154101 - protein, 8 aa, Mycobacterium
AKTLRGGK

SEQ ID NO: 1154102 - protein, 8 aa, Mycobacterium
AKTPDDRA

SEQ ID NO: 1154103 - protein, 10 aa, Mycobacterium
AKTPDRVDPA

SEQ ID NO: 1154104 - protein, 10 aa, Mycobacterium
AKTPKQKRDR

SEQ ID NO: 1154105 - protein, 5 aa, Mycobacterium
AKTVG

SEQ ID NO: 1154106 - protein, 4 aa, Mycobacterium
AKVA

SEQ ID NO: 1154107 - protein, 8 aa, Mycobacterium
AKVGDTTV

SEQ ID NO: 1154108 - protein, 8 aa, Mycobacterium
AKVGEEIA

SEQ ID NO: 1154109 - protein, 4 aa, Mycobacterium
AKYA

SEQ ID NO: 1154110 - protein, 7 aa, Mycobacterium
AKYKDDV

SEQ ID NO: 1154111 - protein, 11 aa, Mycobacterium
AKYPDGSTPEV

SEQ ID NO: 1154112 - protein, 6 aa, Mycobacterium
AKYPKA

SEQ ID NO: 1154113 - protein, 13 aa, Mycobacterium
ALAAEDSGAARAA

SEQ ID NO: 1154114 - protein, 5 aa, Mycobacterium
ALAAR

SEQ ID NO: 1154115 - protein, 6 aa, Mycobacterium
ALADGD

SEQ ID NO: 1154116 - protein, 17 aa, Mycobacterium
ALAEAGKAVAPGVTTDE

SEQ ID NO: 1154117 - protein, 13 aa, Mycobacterium
ALAEGDSPEPPLR

SEQ ID NO: 1154118 - protein, 18 aa, Mycobacterium
ALAEPESASIPDPAAAYS

SEQ ID NO: 1154119 - protein, 22 aa, Mycobacterium
ALAEQAKAATTTFGRPADDEDA

SEQ ID NO: 1154120 - protein, 4 aa, Mycobacterium
ALAG

SEQ ID NO: 1154121 - protein, 8 aa, Mycobacterium
ALAGGGAK

SEQ ID NO: 1154122 - protein, 8 aa, Mycobacterium
ALAGPRDV

SEQ ID NO: 1154123 - protein, 19 aa, Mycobacterium
ALAGRAPAKPVEELSAEDE

SEQ ID NO: 1154124 - protein, 6 aa, Mycobacterium
ALAGSE

SEQ ID NO: 1154125 - protein, 8 aa, Mycobacterium
ALANARED

SEQ ID NO: 1154126 - protein, 7 aa, Mycobacterium
ALANPGL

SEQ ID NO: 1154127 - protein, 8 aa, Mycobacterium
ALAPTGYS

SEQ ID NO: 1154128 - protein, 13 aa, Mycobacterium
ALASPTGRGRFTG

SEQ ID NO: 1154129 - protein, 11 aa, Mycobacterium
ALASRSRRAPG

SEQ ID NO: 1154130 - protein, 10 aa, Mycobacterium
ALDADGDDPV

SEQ ID NO: 1154131 - protein, 9 aa, Mycobacterium
ALDAGRLTT

SEQ ID NO: 1154132 - protein, 8 aa, Mycobacterium
ALDDDEVA

SEQ ID NO: 1154133 - protein, 7 aa, Mycobacterium
ALDDPPR

SEQ ID NO: 1154134 - protein, 8 aa, Mycobacterium
ALDETPEA

SEQ ID NO: 1154135 - protein, 7 aa, Mycobacterium
ALDGGPP

SEQ ID NO: 1154136 - protein, 8 aa, Mycobacterium
ALDGPDAP

SEQ ID NO: 1154137 - protein, 11 aa, Mycobacterium
ALDGPSGPAAD

SEQ ID NO: 1154138 - protein, 15 aa, Mycobacterium
ALDPAGYLNPAVLFG

SEQ ID NO: 1154139 - protein, 9 aa, Mycobacterium
ALDPNKLPA

SEQ ID NO: 1154140 - protein, 8 aa, Mycobacterium
ALDQGDHE

SEQ ID NO: 1154141 - protein, 14 aa, Mycobacterium
ALDQPAEADPADDN

SEQ ID NO: 1154142 - protein, 6 aa, Mycobacterium
ALDSAA

SEQ ID NO: 1154143 - protein, 6 aa, Mycobacterium
ALDSRR

SEQ ID NO: 1154144 - protein, 5 aa, Mycobacterium
ALDTD

SEQ ID NO: 1154145 - protein, 5 aa, Mycobacterium
ALEDA

SEQ ID NO: 1154146 - protein, 7 aa, Mycobacterium
ALEGGAT

SEQ ID NO: 1154147 - protein, 10 aa, Mycobacterium
ALEGGPHQVT

SEQ ID NO: 1154148 - protein, 7 aa, Mycobacterium
ALEKTRA

SEQ ID NO: 1154149 - protein, 9 aa, Mycobacterium
ALENGNDAL

SEQ ID NO: 1154150 - protein, 16 aa, Mycobacterium
ALEPGQPLDPQERTAV

SEQ ID NO: 1154151 - protein, 6 aa, Mycobacterium
ALEPGR

SEQ ID NO: 1154152 - protein, 5 aa, Mycobacterium
ALERG

SEQ ID NO: 1154153 - protein, 9 aa, Mycobacterium
ALGAAGPKR

SEQ ID NO: 1154154 - protein, 5 aa, Mycobacterium
ALGAE

SEQ ID NO: 1154155 - protein, 7 aa, Mycobacterium
ALGAPTP

SEQ ID NO: 1154156 - protein, 7 aa, Mycobacterium
ALGAQDG

SEQ ID NO: 1154157 - protein, 7 aa, Mycobacterium
ALGATRR

SEQ ID NO: 1154158 - protein, 6 aa, Mycobacterium
ALGEPS

SEQ ID NO: 1154159 - protein, 9 aa, Mycobacterium
ALGGAASAV

SEQ ID NO: 1154160 - protein, 7 aa, Mycobacterium
ALGGPAA

SEQ ID NO: 1154161 - protein, 30 aa, Mycobacterium
ALGGPVPQTPPGTLGDPRRLPGEETSPEDV

SEQ ID NO: 1154162 - protein, 18 aa, Mycobacterium
ALGGQPPASRVPNLSGQY

SEQ ID NO: 1154163 - protein, 5 aa, Mycobacterium
ALGGR

SEQ ID NO: 1154164 - protein, 10 aa, Mycobacterium
ALGGSGPLAE

SEQ ID NO: 1154165 - protein, 8 aa, Mycobacterium
ALGGSSSI

SEQ ID NO: 1154166 - protein, 6 aa, Mycobacterium
ALGNAG

SEQ ID NO: 1154167 - protein, 11 aa, Mycobacterium
ALGNPDGAAGL

SEQ ID NO: 1154168 - protein, 6 aa, Mycobacterium
ALGPDA

SEQ ID NO: 1154169 - protein, 18 aa, Mycobacterium
ALGPDEQDAHAGSAGRPV

SEQ ID NO: 1154170 - protein, 9 aa, Mycobacterium
ALGRASSPV

SEQ ID NO: 1154171 - protein, 8 aa, Mycobacterium
ALGRSGTS

SEQ ID NO: 1154172 - protein, 11 aa, Mycobacterium
ALGSTDLDTTA

SEQ ID NO: 1154173 - protein, 7 aa, Mycobacterium
ALGTGKE

SEQ ID NO: 1154174 - protein, 11 aa, Mycobacterium
ALHNRGASASW

SEQ ID NO: 1154175 - protein, 6 aa, Mycobacterium
ALKGHP

SEQ ID NO: 1154176 - protein, 5 aa, Mycobacterium
ALKPG

SEQ ID NO: 1154177 - protein, 11 aa, Mycobacterium
ALKTHSTAPGV

SEQ ID NO: 1154178 - protein, 10 aa, Mycobacterium
ALKTSRDPQI

SEQ ID NO: 1154179 - protein, 4 aa, Mycobacterium
ALNG

SEQ ID NO: 1154180 - protein, 12 aa, Mycobacterium
ALNSYADPQWAR

SEQ ID NO: 1154181 - protein, 5 aa, Mycobacterium
ALPAG

SEQ ID NO: 1154182 - protein, 19 aa, Mycobacterium
ALPAGRSGVAGTAVSVPGG

SEQ ID NO: 1154183 - protein, 7 aa, Mycobacterium
ALPAKPV

SEQ ID NO: 1154184 - protein, 13 aa, Mycobacterium
ALPAPIRPTAVPQ

SEQ ID NO: 1154185 - protein, 9 aa, Mycobacterium
ALPDDDAEN

SEQ ID NO: 1154186 - protein, 9 aa, Mycobacterium
ALPDTQSER

SEQ ID NO: 1154187 - protein, 7 aa, Mycobacterium
ALPEEDD

SEQ ID NO: 1154188 - protein, 27 aa, Mycobacterium
ALPEPGDDEPLQPAAADEGSHQPGDEE

SEQ ID NO: 1154189 - protein, 12 aa, Mycobacterium
ALPGGDAIGSRP

SEQ ID NO: 1154190 - protein, 9 aa, Mycobacterium
ALPGKGEPL

SEQ ID NO: 1154191 - protein, 13 aa, Mycobacterium
ALPGSSGSSRPER

SEQ ID NO: 1154192 - protein, 15 aa, Mycobacterium
ALPGTPPAPGTAVTK

SEQ ID NO: 1154193 - protein, 5 aa, Mycobacterium
ALPPG

SEQ ID NO: 1154194 - protein, 7 aa, Mycobacterium
ALPQAGQ

SEQ ID NO: 1154195 - protein, 5 aa, Mycobacterium
ALPRR

SEQ ID NO: 1154196 - protein, 10 aa, Mycobacterium
ALPRTSSGKL

SEQ ID NO: 1154197 - protein, 16 aa, Mycobacterium
ALPRYRDGTVGEQIER

SEQ ID NO: 1154198 - protein, 9 aa, Mycobacterium
ALPSDKEIR

SEQ ID NO: 1154199 - protein, 5 aa, Mycobacterium
ALPSG

SEQ ID NO: 1154200 - protein, 8 aa, Mycobacterium
ALPSPGRV

SEQ ID NO: 1154201 - protein, 10 aa, Mycobacterium
ALPTLPDETG

SEQ ID NO: 1154202 - protein, 15 aa, Mycobacterium
ALPVDAAGAAAGGGA

SEQ ID NO: 1154203 - protein, 8 aa, Mycobacterium
ALQDSGEL

SEQ ID NO: 1154204 - protein, 5 aa, Mycobacterium
ALQLE

SEQ ID NO: 1154205 - protein, 5 aa, Mycobacterium
ALQTK

SEQ ID NO: 1154206 - protein, 9 aa, Mycobacterium
ALRADADPR

SEQ ID NO: 1154207 - protein, 7 aa, Mycobacterium
ALRASSD

SEQ ID NO: 1154208 - protein, 7 aa, Mycobacterium
ALRDDGS

SEQ ID NO: 1154209 - protein, 24 aa, Mycobacterium
ALRDSGRDPREAEVRPADEVEGYL

SEQ ID NO: 1154210 - protein, 7 aa, Mycobacterium
ALREGKG

SEQ ID NO: 1154211 - protein, 8 aa, Mycobacterium
ALRSAGAA

SEQ ID NO: 1154212 - protein, 10 aa, Mycobacterium
ALRSDAEGSL

SEQ ID NO: 1154213 - protein, 12 aa, Mycobacterium
ALRTTDAVRDRA

SEQ ID NO: 1154214 - protein, 8 aa, Mycobacterium
ALSADGDN

SEQ ID NO: 1154215 - protein, 10 aa, Mycobacterium
ALSDDGHCRP

SEQ ID NO: 1154216 - protein, 11 aa, Mycobacterium
ALSGLTSKDKV

SEQ ID NO: 1154217 - protein, 11 aa, Mycobacterium
ALSGSAQAQRW

SEQ ID NO: 1154218 - protein, 9 aa, Mycobacterium
ALSPDQRNI

SEQ ID NO: 1154219 - protein, 9 aa, Mycobacterium
ALSPSRAAD

SEQ ID NO: 1154220 - protein, 18 aa, Mycobacterium
ALSPTSTVRGWDSMPAVV

SEQ ID NO: 1154221 - protein, 11 aa, Mycobacterium
ALSQRSGDVVP

SEQ ID NO: 1154222 - protein, 8 aa, Mycobacterium
ALSRRGVG

SEQ ID NO: 1154223 - protein, 4 aa, Mycobacterium
ALSS

SEQ ID NO: 1154224 - protein, 10 aa, Mycobacterium
ALSTRDRIGQ

SEQ ID NO: 1154225 - protein, 10 aa, Mycobacterium
ALSTSMGDTA

SEQ ID NO: 1154226 - protein, 6 aa, Mycobacterium
ALTAAQ

SEQ ID NO: 1154227 - protein, 6 aa, Mycobacterium
ALTADA

SEQ ID NO: 1154228 - protein, 16 aa, Mycobacterium
ALTAPDATGAPAAPLA

SEQ ID NO: 1154229 - protein, 9 aa, Mycobacterium
ALTASGSAG

SEQ ID NO: 1154230 - protein, 10 aa, Mycobacterium
ALTDRDESAA

SEQ ID NO: 1154231 - protein, 8 aa, Mycobacterium
ALTDSGDW

SEQ ID NO: 1154232 - protein, 11 aa, Mycobacterium
ALTGRTRQSIR

SEQ ID NO: 1154233 - protein, 6 aa, Mycobacterium
ALTGVS

SEQ ID NO: 1154234 - protein, 7 aa, Mycobacterium
ALTNAPS

SEQ ID NO: 1154235 - protein, 6 aa, Mycobacterium
ALTPPS

SEQ ID NO: 1154236 - protein, 23 aa, Mycobacterium
ALTPPSRSTTVSDNDTETDKEPA

SEQ ID NO: 1154237 - protein, 5 aa, Mycobacterium
ALTRD

SEQ ID NO: 1154238 - protein, 11 aa, Mycobacterium
ALTREQARTSF

SEQ ID NO: 1154239 - protein, 19 aa, Mycobacterium
ALTTGGRTVDADDPSAPER

SEQ ID NO: 1154240 - protein, 8 aa, Mycobacterium
AMAQGRAE

SEQ ID NO: 1154241 - protein, 11 aa, Mycobacterium
AMDDESQQAEV

SEQ ID NO: 1154242 - protein, 6 aa, Mycobacterium
AMDTSD

SEQ ID NO: 1154243 - protein, 9 aa, Mycobacterium
AMETATDGL

SEQ ID NO: 1154244 - protein, 7 aa, Mycobacterium
AMGQGDF

SEQ ID NO: 1154245 - protein, 6 aa, Mycobacterium
AMGRTP

SEQ ID NO: 1154246 - protein, 6 aa, Mycobacterium
AMGSRD

SEQ ID NO: 1154247 - protein, 8 aa, Mycobacterium
AMKETGAD

SEQ ID NO: 1154248 - protein, 8 aa, Mycobacterium
AMKGNLAK

SEQ ID NO: 1154249 - protein, 5 aa, Mycobacterium
AMPEP

SEQ ID NO: 1154250 - protein, 9 aa, Mycobacterium
AMPGEAGYE

SEQ ID NO: 1154251 - protein, 6 aa, Mycobacterium
AMPGSH

SEQ ID NO: 1154252 - protein, 8 aa, Mycobacterium
AMRDDDPN

SEQ ID NO: 1154253 - protein, 16 aa, Mycobacterium
AMRERSELARKGIARG

SEQ ID NO: 1154254 - protein, 11 aa, Mycobacterium
AMSNGRAETRF

SEQ ID NO: 1154255 - protein, 5 aa, Mycobacterium
AMSNT

SEQ ID NO: 1154256 - protein, 4 aa, Mycobacterium
AMTY

SEQ ID NO: 1154257 - protein, 13 aa, Mycobacterium
AMVPDTAVDLMSP

SEQ ID NO: 1154258 - protein, 7 aa, Mycobacterium
ANADAGK

SEQ ID NO: 1154259 - protein, 7 aa, Mycobacterium
ANADRSV

SEQ ID NO: 1154260 - protein, 6 aa, Mycobacterium
ANAGDT

SEQ ID NO: 1154261 - protein, 8 aa, Mycobacterium
ANAMGRPG

SEQ ID NO: 1154262 - protein, 8 aa, Mycobacterium
ANARADRL

SEQ ID NO: 1154263 - protein, 7 aa, Mycobacterium
ANARPLP

SEQ ID NO: 1154264 - protein, 21 aa, Mycobacterium
ANASADTGCDRAPIDPDARPA

SEQ ID NO: 1154265 - protein, 9 aa, Mycobacterium
ANATAGQPY

SEQ ID NO: 1154266 - protein, 5 aa, Mycobacterium
ANDDY

SEQ ID NO: 1154267 - protein, 9 aa, Mycobacterium
ANDDYQDKA

SEQ ID NO: 1154268 - protein, 8 aa, Mycobacterium
ANDGGEPF

SEQ ID NO: 1154269 - protein, 12 aa, Mycobacterium
ANDPKSKMSKAY

SEQ ID NO: 1154270 - protein, 7 aa, Mycobacterium
ANDSTNN

SEQ ID NO: 1154271 - protein, 10 aa, Mycobacterium
ANDTTRHASA

SEQ ID NO: 1154272 - protein, 11 aa, Mycobacterium
ANEAERAAPGL

SEQ ID NO: 1154273 - protein, 9 aa, Mycobacterium
ANEGGLNRS

SEQ ID NO: 1154274 - protein, 7 aa, Mycobacterium
ANEIGKS

SEQ ID NO: 1154275 - protein, 4 aa, Mycobacterium
ANEP

SEQ ID NO: 1154276 - protein, 11 aa, Mycobacterium
ANEPDGGPPAR

SEQ ID NO: 1154277 - protein, 6 aa, Mycobacterium
ANEPEP

SEQ ID NO: 1154278 - protein, 4 aa, Mycobacterium
ANEY

SEQ ID NO: 1154279 - protein, 4 aa, Mycobacterium
ANFT

SEQ ID NO: 1154280 - protein, 11 aa, Mycobacterium
ANGEEGEPASI

SEQ ID NO: 1154281 - protein, 10 aa, Mycobacterium
ANGELSEEEL

SEQ ID NO: 1154282 - protein, 6 aa, Mycobacterium
ANGFSE

SEQ ID NO: 1154283 - protein, 5 aa, Mycobacterium
ANGIS

SEQ ID NO: 1154284 - protein, 6 aa, Mycobacterium
ANGKEA

SEQ ID NO: 1154285 - protein, 7 aa, Mycobacterium
ANGLQGS

SEQ ID NO: 1154286 - protein, 9 aa, Mycobacterium
ANGNPTGET

SEQ ID NO: 1154287 - protein, 4 aa, Mycobacterium
ANGP

SEQ ID NO: 1154288 - protein, 10 aa, Mycobacterium
ANGPNARAPQ

SEQ ID NO: 1154289 - protein, 7 aa, Mycobacterium
ANGSNEV

SEQ ID NO: 1154290 - protein, 7 aa, Mycobacterium
ANGTAQA

SEQ ID NO: 1154291 - protein, 6 aa, Mycobacterium
ANGTRL

SEQ ID NO: 1154292 - protein, 6 aa, Mycobacterium
ANHDNA

SEQ ID NO: 1154293 - protein, 8 aa, Mycobacterium
ANHGGDPG

SEQ ID NO: 1154294 - protein, 19 aa, Mycobacterium
ANISGRPAAVSAADAREQL

SEQ ID NO: 1154295 - protein, 8 aa, Mycobacterium
ANKPDGRV

SEQ ID NO: 1154296 - protein, 8 aa, Mycobacterium
ANKSARTL

SEQ ID NO: 1154297 - protein, 11 aa, Mycobacterium
ANLSGGQRTRA

SEQ ID NO: 1154298 - protein, 13 aa, Mycobacterium
ANNCPNPACDGDD

SEQ ID NO: 1154299 - protein, 5 aa, Mycobacterium
ANNDD

SEQ ID NO: 1154300 - protein, 6 aa, Mycobacterium
ANNERS

SEQ ID NO: 1154301 - protein, 6 aa, Mycobacterium
ANPAAP

SEQ ID NO: 1154302 - protein, 7 aa, Mycobacterium
ANPDGSL

SEQ ID NO: 1154303 - protein, 5 aa, Mycobacterium
ANPDL

SEQ ID NO: 1154304 - protein, 12 aa, Mycobacterium
ANPDPPTPAQVS

SEQ ID NO: 1154305 - protein, 5 aa, Mycobacterium
ANPDV

SEQ ID NO: 1154306 - protein, 10 aa, Mycobacterium
ANPEAHTQPW

SEQ ID NO: 1154307 - protein, 8 aa, Mycobacterium
ANPENAEI

SEQ ID NO: 1154308 - protein, 8 aa, Mycobacterium
ANPGDRAT

SEQ ID NO: 1154309 - protein, 8 aa, Mycobacterium
ANPGDRPA

SEQ ID NO: 1154310 - protein, 16 aa, Mycobacterium
ANPGDVLAGSGPGPVR

SEQ ID NO: 1154311 - protein, 13 aa, Mycobacterium
ANPGFTPGLSAAA

SEQ ID NO: 1154312 - protein, 5 aa, Mycobacterium
ANPHT

SEQ ID NO: 1154313 - protein, 4 aa, Mycobacterium
ANPL

SEQ ID NO: 1154314 - protein, 9 aa, Mycobacterium
ANPLPGRPA

SEQ ID NO: 1154315 - protein, 17 aa, Mycobacterium
ANPPRPSLVDWLLPSRR

SEQ ID NO: 1154316 - protein, 5 aa, Mycobacterium
ANPRG

SEQ ID NO: 1154317 - protein, 5 aa, Mycobacterium
ANPRY

SEQ ID NO: 1154318 - protein, 6 aa, Mycobacterium
ANPSHL

SEQ ID NO: 1154319 - protein, 9 aa, Mycobacterium
ANPTEGSTV

SEQ ID NO: 1154320 - protein, 8 aa, Mycobacterium
ANPTSDAM

SEQ ID NO: 1154321 - protein, 7 aa, Mycobacterium
ANPTSNR

SEQ ID NO: 1154322 - protein, 4 aa, Mycobacterium
ANPV

SEQ ID NO: 1154323 - protein, 17 aa, Mycobacterium
ANPVPQRGRIEATNPCG

SEQ ID NO: 1154324 - protein, 13 aa, Mycobacterium
ANQAASGQIPAVP

SEQ ID NO: 1154325 - protein, 7 aa, Mycobacterium
ANQDGTL

SEQ ID NO: 1154326 - protein, 6 aa, Mycobacterium
ANQGAK

SEQ ID NO: 1154327 - protein, 24 aa, Mycobacterium
ANQSADADAPTGMAPAADAPTSMG

SEQ ID NO: 1154328 - protein, 11 aa, Mycobacterium
ANQTERERDPA

SEQ ID NO: 1154329 - protein, 9 aa, Mycobacterium
ANQTGATVD

SEQ ID NO: 1154330 - protein, 6 aa, Mycobacterium
ANRARP

SEQ ID NO: 1154331 - protein, 14 aa, Mycobacterium
ANRARVQAATDDVR

SEQ ID NO: 1154332 - protein, 6 aa, Mycobacterium
ANRDED

SEQ ID NO: 1154333 - protein, 7 aa, Mycobacterium
ANRDEDV

SEQ ID NO: 1154334 - protein, 12 aa, Mycobacterium
ANRDEREYPDPD

SEQ ID NO: 1154335 - protein, 8 aa, Mycobacterium
ANRDERRF

SEQ ID NO: 1154336 - protein, 10 aa, Mycobacterium
ANRDERRFDD

SEQ ID NO: 1154337 - protein, 12 aa, Mycobacterium
ANRDPAAFEDPD

SEQ ID NO: 1154338 - protein, 8 aa, Mycobacterium
ANRDPAIY

SEQ ID NO: 1154339 - protein, 8 aa, Mycobacterium
ANRDPRHF

SEQ ID NO: 1154340 - protein, 7 aa, Mycobacterium
ANRESGG

SEQ ID NO: 1154341 - protein, 5 aa, Mycobacterium
ANRGV

SEQ ID NO: 1154342 - protein, 5 aa, Mycobacterium
ANRLG

SEQ ID NO: 1154343 - protein, 9 aa, Mycobacterium
ANRPDSDSL

SEQ ID NO: 1154344 - protein, 9 aa, Mycobacterium
ANRPPGDGV

SEQ ID NO: 1154345 - protein, 12 aa, Mycobacterium
ANRQEERYPDPD

SEQ ID NO: 1154346 - protein, 4 aa, Mycobacterium
ANRT

SEQ ID NO: 1154347 - protein, 6 aa, Mycobacterium
ANSAEG

SEQ ID NO: 1154348 - protein, 10 aa, Mycobacterium
ANSKDAGEEE

SEQ ID NO: 1154349 - protein, 6 aa, Mycobacterium
ANSNSA

SEQ ID NO: 1154350 - protein, 5 aa, Mycobacterium
ANSPL

SEQ ID NO: 1154351 - protein, 12 aa, Mycobacterium
ANSPLDDEGHFT

SEQ ID NO: 1154352 - protein, 8 aa, Mycobacterium
ANSQSATM

SEQ ID NO: 1154353 - protein, 9 aa, Mycobacterium
ANSRAGDTR

SEQ ID NO: 1154354 - protein, 9 aa, Mycobacterium
ANSVPPGKQ

SEQ ID NO: 1154355 - protein, 11 aa, Mycobacterium
ANTAMGTAQAG

SEQ ID NO: 1154356 - protein, 5 aa, Mycobacterium
ANTDA

SEQ ID NO: 1154357 - protein, 12 aa, Mycobacterium
ANTDADLAARGA

SEQ ID NO: 1154358 - protein, 14 aa, Mycobacterium
ANTESAGVTGAGDA

SEQ ID NO: 1154359 - protein, 4 aa, Mycobacterium
ANTG

SEQ ID NO: 1154360 - protein, 7 aa, Mycobacterium
ANTGIGY

SEQ ID NO: 1154361 - protein, 7 aa, Mycobacterium
ANTGNRH

SEQ ID NO: 1154362 - protein, 7 aa, Mycobacterium
ANTLSSY

SEQ ID NO: 1154363 - protein, 5 aa, Mycobacterium
ANTRW

SEQ ID NO: 1154364 - protein, 5 aa, Mycobacterium
ANTSR

SEQ ID NO: 1154365 - protein, 7 aa, Mycobacterium
ANVEGVG

SEQ ID NO: 1154366 - protein, 4 aa, Mycobacterium
ANVG

SEQ ID NO: 1154367 - protein, 14 aa, Mycobacterium
ANVGGLARTPRRGD

SEQ ID NO: 1154368 - protein, 10 aa, Mycobacterium
ANVTSKAEDL

SEQ ID NO: 1154369 - protein, 17 aa, Mycobacterium
APAAAPPPAAGAPNAAA

SEQ ID NO: 1154370 - protein, 5 aa, Mycobacterium
APAAE

SEQ ID NO: 1154371 - protein, 14 aa, Mycobacterium
APAAPMEPSPYLPT

SEQ ID NO: 1154372 - protein, 4 aa, Mycobacterium
APAD

SEQ ID NO: 1154373 - protein, 9 aa, Mycobacterium
APADAAPQP

SEQ ID NO: 1154374 - protein, 5 aa, Mycobacterium
APADG

SEQ ID NO: 1154375 - protein, 6 aa, Mycobacterium
APADGL

SEQ ID NO: 1154376 - protein, 10 aa, Mycobacterium
APADTPAASA

SEQ ID NO: 1154377 - protein, 4 aa, Mycobacterium
APAE

SEQ ID NO: 1154378 - protein, 12 aa, Mycobacterium
APAEPEPEQATL

SEQ ID NO: 1154379 - protein, 6 aa, Mycobacterium
APAESA

SEQ ID NO: 1154380 - protein, 15 aa, Mycobacterium
APAETAEAIAGFARS

SEQ ID NO: 1154381 - protein, 5 aa, Mycobacterium
APAEV

SEQ ID NO: 1154382 - protein, 5 aa, Mycobacterium
APAGD

SEQ ID NO: 1154383 - protein, 8 aa, Mycobacterium
APAGDDET

SEQ ID NO: 1154384 - protein, 5 aa, Mycobacterium
APAGI

SEQ ID NO: 1154385 - protein, 14 aa, Mycobacterium
APAGPASHADEDVD

SEQ ID NO: 1154386 - protein, 13 aa, Mycobacterium
APAGPGGQATNKD

SEQ ID NO: 1154387 - protein, 13 aa, Mycobacterium
APAGRDWAPEDLA

SEQ ID NO: 1154388 - protein, 9 aa, Mycobacterium
APAGSRTTL

SEQ ID NO: 1154389 - protein, 8 aa, Mycobacterium
APAGVPGT

SEQ ID NO: 1154390 - protein, 4 aa, Mycobacterium
APAL

SEQ ID NO: 1154391 - protein, 26 aa, Mycobacterium
APANAADIAAPELPADDGRAPAATGW

SEQ ID NO: 1154392 - protein, 7 aa, Mycobacterium
APANGPA

SEQ ID NO: 1154393 - protein, 12 aa, Mycobacterium
APAPEPARWEPD

SEQ ID NO: 1154394 - protein, 7 aa, Mycobacterium
APAPGGF

SEQ ID NO: 1154395 - protein, 7 aa, Mycobacterium
APAPPVA

SEQ ID NO: 1154396 - protein, 6 aa, Mycobacterium
APAPVP

SEQ ID NO: 1154397 - protein, 11 aa, Mycobacterium
APAQSGPDSAT

SEQ ID NO: 1154398 - protein, 9 aa, Mycobacterium
APARGPAAD

SEQ ID NO: 1154399 - protein, 9 aa, Mycobacterium
APARSRSTL

SEQ ID NO: 1154400 - protein, 5 aa, Mycobacterium
APARY

SEQ ID NO: 1154401 - protein, 8 aa, Mycobacterium
APASDSAG

SEQ ID NO: 1154402 - protein, 8 aa, Mycobacterium
APASETEA

SEQ ID NO: 1154403 - protein, 6 aa, Mycobacterium
APASQV

SEQ ID NO: 1154404 - protein, 6 aa, Mycobacterium
APASRS

SEQ ID NO: 1154405 - protein, 15 aa, Mycobacterium
APASVRGVPQKPLDG

SEQ ID NO: 1154406 - protein, 6 aa, Mycobacterium
APASWA

SEQ ID NO: 1154407 - protein, 9 aa, Mycobacterium
APATPPAPH

SEQ ID NO: 1154408 - protein, 5 aa, Mycobacterium
APATS

SEQ ID NO: 1154409 - protein, 5 aa, Mycobacterium
APAVV

SEQ ID NO: 1154410 - protein, 4 aa, Mycobacterium
APAY

SEQ ID NO: 1154411 - protein, 23 aa, Mycobacterium
APAYDPVPPPTPRRRLEDVLEVR

SEQ ID NO: 1154412 - protein, 7 aa, Mycobacterium
APCPQQV

SEQ ID NO: 1154413 - protein, 5 aa, Mycobacterium
APDAA

SEQ ID NO: 1154414 - protein, 12 aa, Mycobacterium
APDAAARQHDPS

SEQ ID NO: 1154415 - protein, 8 aa, Mycobacterium
APDAEPSV

SEQ ID NO: 1154416 - protein, 5 aa, Mycobacterium
APDAN

SEQ ID NO: 1154417 - protein, 5 aa, Mycobacterium
APDAP

SEQ ID NO: 1154418 - protein, 4 aa, Mycobacterium
APDD

SEQ ID NO: 1154419 - protein, 6 aa, Mycobacterium
APDDEL

SEQ ID NO: 1154420 - protein, 8 aa, Mycobacterium
APDDERHL

SEQ ID NO: 1154421 - protein, 6 aa, Mycobacterium
APDDPA

SEQ ID NO: 1154422 - protein, 7 aa, Mycobacterium
APDDPEG

SEQ ID NO: 1154423 - protein, 8 aa, Mycobacterium
APDDRATR

SEQ ID NO: 1154424 - protein, 8 aa, Mycobacterium
APDENDRR

SEQ ID NO: 1154425 - protein, 18 aa, Mycobacterium
APDETENRRVLAVLRFLE

SEQ ID NO: 1154426 - protein, 6 aa, Mycobacterium
APDGAR

SEQ ID NO: 1154427 - protein, 10 aa, Mycobacterium
APDGFTDPRI

SEQ ID NO: 1154428 - protein, 8 aa, Mycobacterium
APDGGYQD

SEQ ID NO: 1154429 - protein, 7 aa, Mycobacterium
APDGKLT

SEQ ID NO: 1154430 - protein, 5 aa, Mycobacterium
APDGR

SEQ ID NO: 1154431 - protein, 7 aa, Mycobacterium
APDGSDR

SEQ ID NO: 1154432 - protein, 9 aa, Mycobacterium
APDHPAQRA

SEQ ID NO: 1154433 - protein, 4 aa, Mycobacterium
APDK

SEQ ID NO: 1154434 - protein, 6 aa, Mycobacterium
APDKTE

SEQ ID NO: 1154435 - protein, 17 aa, Mycobacterium
APDNAKRGAPSNRDTVG

SEQ ID NO: 1154436 - protein, 11 aa, Mycobacterium
APDSPAGKELR

SEQ ID NO: 1154437 - protein, 9 aa, Mycobacterium
APDTETGIA

SEQ ID NO: 1154438 - protein, 7 aa, Mycobacterium
APDTGNM

SEQ ID NO: 1154439 - protein, 6 aa, Mycobacterium
APDVGG

SEQ ID NO: 1154440 - protein, 5 aa, Mycobacterium
APDVP

SEQ ID NO: 1154441 - protein, 11 aa, Mycobacterium
APDVPGPEELP

SEQ ID NO: 1154442 - protein, 8 aa, Mycobacterium
APEADAAA

SEQ ID NO: 1154443 - protein, 10 aa, Mycobacterium
APEAERVTAP

SEQ ID NO: 1154444 - protein, 14 aa, Mycobacterium
APEAGGKSGADSDV

SEQ ID NO: 1154445 - protein, 5 aa, Mycobacterium
APEAI

SEQ ID NO: 1154446 - protein, 4 aa, Mycobacterium
APED

SEQ ID NO: 1154447 - protein, 10 aa, Mycobacterium
APEDPEERDA

SEQ ID NO: 1154448 - protein, 5 aa, Mycobacterium
APEGP

SEQ ID NO: 1154449 - protein, 7 aa, Mycobacterium
APEGPQV

SEQ ID NO: 1154450 - protein, 16 aa, Mycobacterium
APEGTRRMSDNPHANG

SEQ ID NO: 1154451 - protein, 5 aa, Mycobacterium
APEGV

SEQ ID NO: 1154452 - protein, 9 aa, Mycobacterium
APEKRDLST

SEQ ID NO: 1154453 - protein, 7 aa, Mycobacterium
APELPDD

SEQ ID NO: 1154454 - protein, 14 aa, Mycobacterium
APELSDDLGSSAQQ

SEQ ID NO: 1154455 - protein, 5 aa, Mycobacterium
APENV

SEQ ID NO: 1154456 - protein, 12 aa, Mycobacterium
APEPEDLDERTE

SEQ ID NO: 1154457 - protein, 8 aa, Mycobacterium
APEPHSSA

SEQ ID NO: 1154458 - protein, 5 aa, Mycobacterium
APEPK

SEQ ID NO: 1154459 - protein, 12 aa, Mycobacterium
APEPVRNADYTR

SEQ ID NO: 1154460 - protein, 15 aa, Mycobacterium
APEQAGSTATGYAQG

SEQ ID NO: 1154461 - protein, 9 aa, Mycobacterium
APEQPELSE

SEQ ID NO: 1154462 - protein, 20 aa, Mycobacterium
APEQPGSSPRQLEAANGTAR

SEQ ID NO: 1154463 - protein, 8 aa, Mycobacterium
APEQRDDY

SEQ ID NO: 1154464 - protein, 6 aa, Mycobacterium
APEQRE

SEQ ID NO: 1154465 - protein, 6 aa, Mycobacterium
APERGL

SEQ ID NO: 1154466 - protein, 6 aa, Mycobacterium
APERLA

SEQ ID NO: 1154467 - protein, 8 aa, Mycobacterium
APERRRRQ

SEQ ID NO: 1154468 - protein, 7 aa, Mycobacterium
APESAED

SEQ ID NO: 1154469 - protein, 7 aa, Mycobacterium
APESGHM

SEQ ID NO: 1154470 - protein, 17 aa, Mycobacterium
APESTVTPAATPEPGER

SEQ ID NO: 1154471 - protein, 14 aa, Mycobacterium
APETAAGPGMQAPA

SEQ ID NO: 1154472 - protein, 7 aa, Mycobacterium
APETIAR

SEQ ID NO: 1154473 - protein, 6 aa, Mycobacterium
APFEAG

SEQ ID NO: 1154474 - protein, 16 aa, Mycobacterium
APFGGYKKSGVGRELG

SEQ ID NO: 1154475 - protein, 13 aa, Mycobacterium
APFGGYKQSGIGR

SEQ ID NO: 1154476 - protein, 13 aa, Mycobacterium
APFGGYKSSGIGR

SEQ ID NO: 1154477 - protein, 14 aa, Mycobacterium
APFYSPGHKGGRTL

SEQ ID NO: 1154478 - protein, 11 aa, Mycobacterium
APGADPDADDL

SEQ ID NO: 1154479 - protein, 6 aa, Mycobacterium
APGAEH

SEQ ID NO: 1154480 - protein, 6 aa, Mycobacterium
APGDDR

SEQ ID NO: 1154481 - protein, 5 aa, Mycobacterium
APGDG

SEQ ID NO: 1154482 - protein, 12 aa, Mycobacterium
APGFGGQPGVVN

SEQ ID NO: 1154483 - protein, 5 aa, Mycobacterium
APGFT

SEQ ID NO: 1154484 - protein, 5 aa, Mycobacterium
APGGD

SEQ ID NO: 1154485 - protein, 8 aa, Mycobacterium
APGGDAAA

SEQ ID NO: 1154486 - protein, 8 aa, Mycobacterium
APGGDAKA

SEQ ID NO: 1154487 - protein, 24 aa, Mycobacterium
APGGEYAKGTEGPDGQYPGSDPDV

SEQ ID NO: 1154488 - protein, 9 aa, Mycobacterium
APGGIDTPE

SEQ ID NO: 1154489 - protein, 7 aa, Mycobacterium
APGGRRE

SEQ ID NO: 1154490 - protein, 7 aa, Mycobacterium
APGGRTD

SEQ ID NO: 1154491 - protein, 11 aa, Mycobacterium
APGHAEADPAQ

SEQ ID NO: 1154492 - protein, 5 aa, Mycobacterium
APGHE

SEQ ID NO: 1154493 - protein, 7 aa, Mycobacterium
APGKGTA

SEQ ID NO: 1154494 - protein, 5 aa, Mycobacterium
APGLP

SEQ ID NO: 1154495 - protein, 11 aa, Mycobacterium
APGNPGTAAVA

SEQ ID NO: 1154496 - protein, 7 aa, Mycobacterium
APGPCDT

SEQ ID NO: 1154497 - protein, 7 aa, Mycobacterium
APGPFPS

SEQ ID NO: 1154498 - protein, 6 aa, Mycobacterium
APGPLT

SEQ ID NO: 1154499 - protein, 6 aa, Mycobacterium
APGPVD

SEQ ID NO: 1154500 - protein, 5 aa, Mycobacterium
APGQI

SEQ ID NO: 1154501 - protein, 7 aa, Mycobacterium
APGQPAR

SEQ ID NO: 1154502 - protein, 6 aa, Mycobacterium
APGQQV

SEQ ID NO: 1154503 - protein, 12 aa, Mycobacterium
APGQSVQETSAA

SEQ ID NO: 1154504 - protein, 4 aa, Mycobacterium
APGR

SEQ ID NO: 1154505 - protein, 8 aa, Mycobacterium
APGRREVR

SEQ ID NO: 1154506 - protein, 7 aa, Mycobacterium
APGRSVS

SEQ ID NO: 1154507 - protein, 8 aa, Mycobacterium
APGSATGA

SEQ ID NO: 1154508 - protein, 5 aa, Mycobacterium
APGSL

SEQ ID NO: 1154509 - protein, 5 aa, Mycobacterium
APGSY

SEQ ID NO: 1154510 - protein, 7 aa, Mycobacterium
APGTIRT

SEQ ID NO: 1154511 - protein, 5 aa, Mycobacterium
APGTP

SEQ ID NO: 1154512 - protein, 9 aa, Mycobacterium
APGTPARST

SEQ ID NO: 1154513 - protein, 7 aa, Mycobacterium
APGTPLA

SEQ ID NO: 1154514 - protein, 7 aa, Mycobacterium
APGVTER

SEQ ID NO: 1154515 - protein, 23 aa, Mycobacterium
APGVTETAASATYVDQDPDRDRT

SEQ ID NO: 1154516 - protein, 13 aa, Mycobacterium
APGYPHPLLAPED

SEQ ID NO: 1154517 - protein, 4 aa, Mycobacterium
APHA

SEQ ID NO: 1154518 - protein, 4 aa, Mycobacterium
APHH

SEQ ID NO: 1154519 - protein, 5 aa, Mycobacterium
APHPA

SEQ ID NO: 1154520 - protein, 16 aa, Mycobacterium
APHPAMPDTPLAGGPQ

SEQ ID NO: 1154521 - protein, 7 aa, Mycobacterium
APHPEGG

SEQ ID NO: 1154522 - protein, 5 aa, Mycobacterium
APHPT

SEQ ID NO: 1154523 - protein, 22 aa, Mycobacterium
APHSAPEASVNKPRRARGATPR

SEQ ID NO: 1154524 - protein, 8 aa, Mycobacterium
APHSRTPI

SEQ ID NO: 1154525 - protein, 11 aa, Mycobacterium
APIDPQAKAGL

SEQ ID NO: 1154526 - protein, 6 aa, Mycobacterium
APIESP

SEQ ID NO: 1154527 - protein, 9 aa, Mycobacterium
APIKDPRTG

SEQ ID NO: 1154528 - protein, 6 aa, Mycobacterium
APIPDE

SEQ ID NO: 1154529 - protein, 12 aa, Mycobacterium
APITEGDTVRES

SEQ ID NO: 1154530 - protein, 8 aa, Mycobacterium
APKDATRT

SEQ ID NO: 1154531 - protein, 7 aa, Mycobacterium
APKNPLP

SEQ ID NO: 1154532 - protein, 6 aa, Mycobacterium
APKRAA

SEQ ID NO: 1154533 - protein, 9 aa, Mycobacterium
APLAQRATK

SEQ ID NO: 1154534 - protein, 13 aa, Mycobacterium
APLASGSYADATG

SEQ ID NO: 1154535 - protein, 9 aa, Mycobacterium
APLCSPSRG

SEQ ID NO: 1154536 - protein, 10 aa, Mycobacterium
APLDDASRNR

SEQ ID NO: 1154537 - protein, 9 aa, Mycobacterium
APLEGQPLD

SEQ ID NO: 1154538 - protein, 12 aa, Mycobacterium
APLEKKKDSMKR

SEQ ID NO: 1154539 - protein, 9 aa, Mycobacterium
APLEPGEKD

SEQ ID NO: 1154540 - protein, 12 aa, Mycobacterium
APLEPVSYGVFR

SEQ ID NO: 1154541 - protein, 5 aa, Mycobacterium
APLGG

SEQ ID NO: 1154542 - protein, 10 aa, Mycobacterium
APLNSPAELR

SEQ ID NO: 1154543 - protein, 6 aa, Mycobacterium
APLPAA

SEQ ID NO: 1154544 - protein, 9 aa, Mycobacterium
APLPAPKPG

SEQ ID NO: 1154545 - protein, 6 aa, Mycobacterium
APLPCT

SEQ ID NO: 1154546 - protein, 32 aa, Mycobacterium
APLQPAPAPPAPAPAPAPAPAPVAAPAPDPLA

SEQ ID NO: 1154547 - protein, 6 aa, Mycobacterium
APLSAG

SEQ ID NO: 1154548 - protein, 15 aa, Mycobacterium
APLSEAQKRLGDDAP

SEQ ID NO: 1154549 - protein, 4 aa, Mycobacterium
APLT

SEQ ID NO: 1154550 - protein, 6 aa, Mycobacterium
APLTRG

SEQ ID NO: 1154551 - protein, 15 aa, Mycobacterium
APLVPGTPDPVKDAD

SEQ ID NO: 1154552 - protein, 7 aa, Mycobacterium
APMAGED

SEQ ID NO: 1154553 - protein, 11 aa, Mycobacterium
APMPPAEGSLR

SEQ ID NO: 1154554 - protein, 21 aa, Mycobacterium
APMPYDRGTQERRAKLAEKEL

SEQ ID NO: 1154555 - protein, 5 aa, Mycobacterium
APNAQ

SEQ ID NO: 1154556 - protein, 4 aa, Mycobacterium
APNG

SEQ ID NO: 1154557 - protein, 7 aa, Mycobacterium
APNGMRA

SEQ ID NO: 1154558 - protein, 8 aa, Mycobacterium
APNGPGNM

SEQ ID NO: 1154559 - protein, 5 aa, Mycobacterium
APNHL

SEQ ID NO: 1154560 - protein, 5 aa, Mycobacterium
APNNE

SEQ ID NO: 1154561 - protein, 6 aa, Mycobacterium
APNPAA

SEQ ID NO: 1154562 - protein, 14 aa, Mycobacterium
APNRTVSCSSGRRY

SEQ ID NO: 1154563 - protein, 12 aa, Mycobacterium
APNYSPGHGAGA

SEQ ID NO: 1154564 - protein, 9 aa, Mycobacterium
APPADTDPV

SEQ ID NO: 1154565 - protein, 8 aa, Mycobacterium
APPAGEAE

SEQ ID NO: 1154566 - protein, 13 aa, Mycobacterium
APPANAPTPAERA

SEQ ID NO: 1154567 - protein, 10 aa, Mycobacterium
APPAVGRSGR

SEQ ID NO: 1154568 - protein, 5 aa, Mycobacterium
APPAY

SEQ ID NO: 1154569 - protein, 13 aa, Mycobacterium
APPEATVPAQPPI

SEQ ID NO: 1154570 - protein, 4 aa, Mycobacterium
APPG

SEQ ID NO: 1154571 - protein, 6 aa, Mycobacterium
APPGLL

SEQ ID NO: 1154572 - protein, 7 aa, Mycobacterium
APPGMPV

SEQ ID NO: 1154573 - protein, 5 aa, Mycobacterium
APPLP

SEQ ID NO: 1154574 - protein, 6 aa, Mycobacterium
APPLTG

SEQ ID NO: 1154575 - protein, 17 aa, Mycobacterium
APPPAEAPAGATMPPVS

SEQ ID NO: 1154576 - protein, 8 aa, Mycobacterium
APPPDGFG

SEQ ID NO: 1154577 - protein, 17 aa, Mycobacterium
APPPGAVPPGATLPTVS

SEQ ID NO: 1154578 - protein, 8 aa, Mycobacterium
APPPGTDR

SEQ ID NO: 1154579 - protein, 8 aa, Mycobacterium
APPPRGQL

SEQ ID NO: 1154580 - protein, 11 aa, Mycobacterium
APPPTPGPGQV

SEQ ID NO: 1154581 - protein, 4 aa, Mycobacterium
APPR

SEQ ID NO: 1154582 - protein, 8 aa, Mycobacterium
APPREDPR

SEQ ID NO: 1154583 - protein, 20 aa, Mycobacterium
APPRGPATRFAGNAASRTTA

SEQ ID NO: 1154584 - protein, 4 aa, Mycobacterium
APPS

SEQ ID NO: 1154585 - protein, 6 aa, Mycobacterium
APPSAC

SEQ ID NO: 1154586 - protein, 6 aa, Mycobacterium
APPTAR

SEQ ID NO: 1154587 - protein, 7 aa, Mycobacterium
APPVDPA

SEQ ID NO: 1154588 - protein, 20 aa, Mycobacterium
APPYGQGRVAADAGATAMTD

SEQ ID NO: 1154589 - protein, 9 aa, Mycobacterium
APPYNRRSK

SEQ ID NO: 1154590 - protein, 8 aa, Mycobacterium
APQEGSDR

SEQ ID NO: 1154591 - protein, 8 aa, Mycobacterium
APQIGNTG

SEQ ID NO: 1154592 - protein, 5 aa, Mycobacterium
APQPD

SEQ ID NO: 1154593 - protein, 9 aa, Mycobacterium
APQPPQPWR

SEQ ID NO: 1154594 - protein, 12 aa, Mycobacterium
APQQVGADSPSV

SEQ ID NO: 1154595 - protein, 9 aa, Mycobacterium
APQRPQPHL

SEQ ID NO: 1154596 - protein, 7 aa, Mycobacterium
APQRRNA

SEQ ID NO: 1154597 - protein, 8 aa, Mycobacterium
APQSDGSA

SEQ ID NO: 1154598 - protein, 14 aa, Mycobacterium
APQTAAAPGFAEQT

SEQ ID NO: 1154599 - protein, 7 aa, Mycobacterium
APQTPAM

SEQ ID NO: 1154600 - protein, 29 aa, Mycobacterium
APRFSRTTTTTPTPPGVPGADTEAVLNDW

SEQ ID NO: 1154601 - protein, 11 aa, Mycobacterium
APRGGGPGPHY

SEQ ID NO: 1154602 - protein, 10 aa, Mycobacterium
APRKRSEPQM

SEQ ID NO: 1154603 - protein, 7 aa, Mycobacterium
APRLPGT

SEQ ID NO: 1154604 - protein, 6 aa, Mycobacterium
APRPAA

SEQ ID NO: 1154605 - protein, 9 aa, Mycobacterium
APRPDATAR

SEQ ID NO: 1154606 - protein, 6 aa, Mycobacterium
APRQDL

SEQ ID NO: 1154607 - protein, 6 aa, Mycobacterium
APRRSG

SEQ ID NO: 1154608 - protein, 6 aa, Mycobacterium
APRSGG

SEQ ID NO: 1154609 - protein, 7 aa, Mycobacterium
APRSPFG

SEQ ID NO: 1154610 - protein, 5 aa, Mycobacterium
APRTA

SEQ ID NO: 1154611 - protein, 5 aa, Mycobacterium
APRTL

SEQ ID NO: 1154612 - protein, 5 aa, Mycobacterium
APRTR

SEQ ID NO: 1154613 - protein, 13 aa, Mycobacterium
APRVSSAEQSNTS

SEQ ID NO: 1154614 - protein, 7 aa, Mycobacterium
APRYEEA

SEQ ID NO: 1154615 - protein, 9 aa, Mycobacterium
APSAAAAGR

SEQ ID NO: 1154616 - protein, 40 aa, Mycobacterium
APSAEELESEGGGASLEEQAAEVAEAEASEEAAEAGEESA

SEQ ID NO: 1154617 - protein, 8 aa, Mycobacterium
APSARDSD

SEQ ID NO: 1154618 - protein, 8 aa, Mycobacterium
APSARTRM

SEQ ID NO: 1154619 - protein, 5 aa, Mycobacterium
APSAV

SEQ ID NO: 1154620 - protein, 7 aa, Mycobacterium
APSEQWR

SEQ ID NO: 1154621 - protein, 14 aa, Mycobacterium
APSGPAGKRAYGGQ

SEQ ID NO: 1154622 - protein, 6 aa, Mycobacterium
APSGWR

SEQ ID NO: 1154623 - protein, 4 aa, Mycobacterium
APSI

SEQ ID NO: 1154624 - protein, 12 aa, Mycobacterium
APSIISKGRGGS

SEQ ID NO: 1154625 - protein, 4 aa, Mycobacterium
APSK

SEQ ID NO: 1154626 - protein, 11 aa, Mycobacterium
APSPALEGHRG

SEQ ID NO: 1154627 - protein, 7 aa, Mycobacterium
APSPVKN

SEQ ID NO: 1154628 - protein, 7 aa, Mycobacterium
APSPVQA

SEQ ID NO: 1154629 - protein, 6 aa, Mycobacterium
APSSLD

SEQ ID NO: 1154630 - protein, 12 aa, Mycobacterium
APSSYDGDSPVD

SEQ ID NO: 1154631 - protein, 4 aa, Mycobacterium
APST

SEQ ID NO: 1154632 - protein, 7 aa, Mycobacterium
APSTANG

SEQ ID NO: 1154633 - protein, 6 aa, Mycobacterium
APSTLG

SEQ ID NO: 1154634 - protein, 5 aa, Mycobacterium
APSTS

SEQ ID NO: 1154635 - protein, 13 aa, Mycobacterium
APTATRTPRPPSG

SEQ ID NO: 1154636 - protein, 6 aa, Mycobacterium
APTDDD

SEQ ID NO: 1154637 - protein, 14 aa, Mycobacterium
APTDGSGEQVDGRD

SEQ ID NO: 1154638 - protein, 6 aa, Mycobacterium
APTEHE

SEQ ID NO: 1154639 - protein, 11 aa, Mycobacterium
APTERDPKKPC

SEQ ID NO: 1154640 - protein, 18 aa, Mycobacterium
APTESAEPVADRGDEDVA

SEQ ID NO: 1154641 - protein, 5 aa, Mycobacterium
APTGE

SEQ ID NO: 1154642 - protein, 21 aa, Mycobacterium
APTGGRDADVQAGQSPSTVSA

SEQ ID NO: 1154643 - protein, 14 aa, Mycobacterium
APTHPHAGVESATA

SEQ ID NO: 1154644 - protein, 4 aa, Mycobacterium
APTL

SEQ ID NO: 1154645 - protein, 6 aa, Mycobacterium
APTLGA

SEQ ID NO: 1154646 - protein, 5 aa, Mycobacterium
APTMT

SEQ ID NO: 1154647 - protein, 6 aa, Mycobacterium
APTPCS

SEQ ID NO: 1154648 - protein, 8 aa, Mycobacterium
APTQREAA

SEQ ID NO: 1154649 - protein, 5 aa, Mycobacterium
APTRG

SEQ ID NO: 1154650 - protein, 6 aa, Mycobacterium
APTRQV

SEQ ID NO: 1154651 - protein, 5 aa, Mycobacterium
APTRR

SEQ ID NO: 1154652 - protein, 7 aa, Mycobacterium
APTSAAR

SEQ ID NO: 1154653 - protein, 6 aa, Mycobacterium
APTTLG

SEQ ID NO: 1154654 - protein, 10 aa, Mycobacterium
APTVGPDAIG

SEQ ID NO: 1154655 - protein, 12 aa, Mycobacterium
APVDECKDKDMT

SEQ ID NO: 1154656 - protein, 8 aa, Mycobacterium
APVDPDHR

SEQ ID NO: 1154657 - protein, 10 aa, Mycobacterium
APVEKTRQAF

SEQ ID NO: 1154658 - protein, 5 aa, Mycobacterium
APVGA

SEQ ID NO: 1154659 - protein, 8 aa, Mycobacterium
APVGESPA

SEQ ID NO: 1154660 - protein, 4 aa, Mycobacterium
APVP

SEQ ID NO: 1154661 - protein, 13 aa, Mycobacterium
APVPARESYKPRQ

SEQ ID NO: 1154662 - protein, 6 aa, Mycobacterium
APVPGL

SEQ ID NO: 1154663 - protein, 16 aa, Mycobacterium
APVPGYRGTRSPGLPE

SEQ ID NO: 1154664 - protein, 9 aa, Mycobacterium
APVPPDPQA

SEQ ID NO: 1154665 - protein, 16 aa, Mycobacterium
APVPVGAGAAAGATVG

SEQ ID NO: 1154666 - protein, 8 aa, Mycobacterium
APVRDANS

SEQ ID NO: 1154667 - protein, 10 aa, Mycobacterium
APVSGGPHDI

SEQ ID NO: 1154668 - protein, 8 aa, Mycobacterium
APVTAEAA

SEQ ID NO: 1154669 - protein, 10 aa, Mycobacterium
APVTSDGPHY

SEQ ID NO: 1154670 - protein, 12 aa, Mycobacterium
APYDGRTGNAGH

SEQ ID NO: 1154671 - protein, 5 aa, Mycobacterium
APYEA

SEQ ID NO: 1154672 - protein, 9 aa, Mycobacterium
APYGVEPQS

SEQ ID NO: 1154673 - protein, 10 aa, Mycobacterium
APYPENSPRE

SEQ ID NO: 1154674 - protein, 6 aa, Mycobacterium
APYPRA

SEQ ID NO: 1154675 - protein, 11 aa, Mycobacterium
APYQIPTDGSC

SEQ ID NO: 1154676 - protein, 5 aa, Mycobacterium
APYTG

SEQ ID NO: 1154677 - protein, 8 aa, Mycobacterium
AQAAGADQ

SEQ ID NO: 1154678 - protein, 10 aa, Mycobacterium
AQACAPESHH

SEQ ID NO: 1154679 - protein, 8 aa, Mycobacterium
AQADVAED

SEQ ID NO: 1154680 - protein, 6 aa, Mycobacterium
AQAEAF

SEQ ID NO: 1154681 - protein, 7 aa, Mycobacterium
AQAERAA

SEQ ID NO: 1154682 - protein, 7 aa, Mycobacterium
AQAERFN

SEQ ID NO: 1154683 - protein, 8 aa, Mycobacterium
AQAERSRV

SEQ ID NO: 1154684 - protein, 12 aa, Mycobacterium
AQAGQAGDKDAL

SEQ ID NO: 1154685 - protein, 11 aa, Mycobacterium
AQAKELSPQAQ

SEQ ID NO: 1154686 - protein, 9 aa, Mycobacterium
AQAPGAPLS

SEQ ID NO: 1154687 - protein, 9 aa, Mycobacterium
AQAPHGGET

SEQ ID NO: 1154688 - protein, 5 aa, Mycobacterium
AQAPT

SEQ ID NO: 1154689 - protein, 4 aa, Mycobacterium
AQAQ

SEQ ID NO: 1154690 - protein, 14 aa, Mycobacterium
AQAQTAAPATREAQ

SEQ ID NO: 1154691 - protein, 6 aa, Mycobacterium
AQARPV

SEQ ID NO: 1154692 - protein, 21 aa, Mycobacterium
AQARSFTGSQAGVVTTGTHGN

SEQ ID NO: 1154693 - protein, 7 aa, Mycobacterium
AQASFDS

SEQ ID NO: 1154694 - protein, 5 aa, Mycobacterium
AQATD

SEQ ID NO: 1154695 - protein, 7 aa, Mycobacterium
AQATEHG

SEQ ID NO: 1154696 - protein, 7 aa, Mycobacterium
AQATGSE

SEQ ID NO: 1154697 - protein, 5 aa, Mycobacterium
AQDAA

SEQ ID NO: 1154698 - protein, 8 aa, Mycobacterium
AQDAKSAQ

SEQ ID NO: 1154699 - protein, 20 aa, Mycobacterium
AQDDDGVTATVSTDSEDRTV

SEQ ID NO: 1154700 - protein, 9 aa, Mycobacterium
AQDDSKDKF

SEQ ID NO: 1154701 - protein, 14 aa, Mycobacterium
AQDEGSVRSGEPRQ

SEQ ID NO: 1154702 - protein, 6 aa, Mycobacterium
AQDEHD

SEQ ID NO: 1154703 - protein, 15 aa, Mycobacterium
AQDEVWGDDPSVRVS

SEQ ID NO: 1154704 - protein, 8 aa, Mycobacterium
AQDGKADS

SEQ ID NO: 1154705 - protein, 4 aa, Mycobacterium
AQDH

SEQ ID NO: 1154706 - protein, 7 aa, Mycobacterium
AQDNGAE

SEQ ID NO: 1154707 - protein, 7 aa, Mycobacterium
AQDTEVR

SEQ ID NO: 1154708 - protein, 7 aa, Mycobacterium
AQDTTRY

SEQ ID NO: 1154709 - protein, 16 aa, Mycobacterium
AQDVSQHDSGAYTGEI

SEQ ID NO: 1154710 - protein, 11 aa, Mycobacterium
AQEAIRTSQRE

SEQ ID NO: 1154711 - protein, 7 aa, Mycobacterium
AQEGAAV

SEQ ID NO: 1154712 - protein, 8 aa, Mycobacterium
AQEGAKYN

SEQ ID NO: 1154713 - protein, 7 aa, Mycobacterium
AQENARL

SEQ ID NO: 1154714 - protein, 11 aa, Mycobacterium
AQERAEREARQ

SEQ ID NO: 1154715 - protein, 6 aa, Mycobacterium
AQESMR

SEQ ID NO: 1154716 - protein, 6 aa, Mycobacterium
AQETGG

SEQ ID NO: 1154717 - protein, 13 aa, Mycobacterium
AQETRGRGEMAPN

SEQ ID NO: 1154718 - protein, 11 aa, Mycobacterium
AQFDKTSGDPR

SEQ ID NO: 1154719 - protein, 6 aa, Mycobacterium
AQFPDG

SEQ ID NO: 1154720 - protein, 4 aa, Mycobacterium
AQGA

SEQ ID NO: 1154721 - protein, 14 aa, Mycobacterium
AQGADGVESTAGRV

SEQ ID NO: 1154722 - protein, 13 aa, Mycobacterium
AQGDIDWSDPSEE

SEQ ID NO: 1154723 - protein, 11 aa, Mycobacterium
AQGEEEDAADA

SEQ ID NO: 1154724 - protein, 11 aa, Mycobacterium
AQGEGGPLRPA

SEQ ID NO: 1154725 - protein, 7 aa, Mycobacterium
AQGERSY

SEQ ID NO: 1154726 - protein, 9 aa, Mycobacterium
AQGFGGTAT

SEQ ID NO: 1154727 - protein, 8 aa, Mycobacterium
AQGGEAVE

SEQ ID NO: 1154728 - protein, 5 aa, Mycobacterium
AQGGG

SEQ ID NO: 1154729 - protein, 5 aa, Mycobacterium
AQGGI

SEQ ID NO: 1154730 - protein, 5 aa, Mycobacterium
AQGGK

SEQ ID NO: 1154731 - protein, 16 aa, Mycobacterium
AQGIGEQTARRISAEG

SEQ ID NO: 1154732 - protein, 25 aa, Mycobacterium
AQGKLDDAADKAGNAAAKRAQADRV

SEQ ID NO: 1154733 - protein, 4 aa, Mycobacterium
AQGQ

SEQ ID NO: 1154734 - protein, 9 aa, Mycobacterium
AQGRGLGEG

SEQ ID NO: 1154735 - protein, 7 aa, Mycobacterium
AQGRSGS

SEQ ID NO: 1154736 - protein, 5 aa, Mycobacterium
AQGSD

SEQ ID NO: 1154737 - protein, 6 aa, Mycobacterium
AQGVRS

SEQ ID NO: 1154738 - protein, 5 aa, Mycobacterium
AQGWQ

SEQ ID NO: 1154739 - protein, 6 aa, Mycobacterium
AQGYGE

SEQ ID NO: 1154740 - protein, 11 aa, Mycobacterium
AQGYSDSKGIM

SEQ ID NO: 1154741 - protein, 16 aa, Mycobacterium
AQHNQQRTSQSITDDR

SEQ ID NO: 1154742 - protein, 17 aa, Mycobacterium
AQHPTVTASPSGDGPDL

SEQ ID NO: 1154743 - protein, 10 aa, Mycobacterium
AQKAEGKSTD

SEQ ID NO: 1154744 - protein, 5 aa, Mycobacterium
AQKDI

SEQ ID NO: 1154745 - protein, 7 aa, Mycobacterium
AQLEGPI

SEQ ID NO: 1154746 - protein, 13 aa, Mycobacterium
AQLGNATVERGTR

SEQ ID NO: 1154747 - protein, 8 aa, Mycobacterium
AQLGTTGA

SEQ ID NO: 1154748 - protein, 5 aa, Mycobacterium
AQLNS

SEQ ID NO: 1154749 - protein, 17 aa, Mycobacterium
AQLRTEAGKPMSAAEQG

SEQ ID NO: 1154750 - protein, 6 aa, Mycobacterium
AQNAET

SEQ ID NO: 1154751 - protein, 21 aa, Mycobacterium
AQNDGDTVGSMQGGDDPGYGR

SEQ ID NO: 1154752 - protein, 5 aa, Mycobacterium
AQNPV

SEQ ID NO: 1154753 - protein, 6 aa, Mycobacterium
AQNRGA

SEQ ID NO: 1154754 - protein, 9 aa, Mycobacterium
AQNVGDSAR

SEQ ID NO: 1154755 - protein, 10 aa, Mycobacterium
AQPDRTVRST

SEQ ID NO: 1154756 - protein, 7 aa, Mycobacterium
AQPEGDL

SEQ ID NO: 1154757 - protein, 19 aa, Mycobacterium
AQPEPGGAVRSAERIPGYT

SEQ ID NO: 1154758 - protein, 9 aa, Mycobacterium
AQPGVKRQA

SEQ ID NO: 1154759 - protein, 4 aa, Mycobacterium
AQPH

SEQ ID NO: 1154760 - protein, 14 aa, Mycobacterium
AQPIDEGDRANPGH

SEQ ID NO: 1154761 - protein, 6 aa, Mycobacterium
AQPPGF

SEQ ID NO: 1154762 - protein, 8 aa, Mycobacterium
AQPPTNHA

SEQ ID NO: 1154763 - protein, 5 aa, Mycobacterium
AQPRT

SEQ ID NO: 1154764 - protein, 12 aa, Mycobacterium
AQPSQGALPEGQ

SEQ ID NO: 1154765 - protein, 9 aa, Mycobacterium
AQPTPAANG

SEQ ID NO: 1154766 - protein, 12 aa, Mycobacterium
AQPVPGLPDNTN

SEQ ID NO: 1154767 - protein, 13 aa, Mycobacterium
AQPVTEGDRANPA

SEQ ID NO: 1154768 - protein, 5 aa, Mycobacterium
AQQAA

SEQ ID NO: 1154769 - protein, 7 aa, Mycobacterium
AQQAGRP

SEQ ID NO: 1154770 - protein, 9 aa, Mycobacterium
AQQALSRSD

SEQ ID NO: 1154771 - protein, 7 aa, Mycobacterium
AQQARDE

SEQ ID NO: 1154772 - protein, 25 aa, Mycobacterium
AQQGNPARKVYGRADNPSNPSPPEL

SEQ ID NO: 1154773 - protein, 12 aa, Mycobacterium
AQQPTSAHPGDE

SEQ ID NO: 1154774 - protein, 13 aa, Mycobacterium
AQQRARAGDITPE

SEQ ID NO: 1154775 - protein, 8 aa, Mycobacterium
AQQRPNEI

SEQ ID NO: 1154776 - protein, 4 aa, Mycobacterium
AQRA

SEQ ID NO: 1154777 - protein, 8 aa, Mycobacterium
AQRADTRL

SEQ ID NO: 1154778 - protein, 8 aa, Mycobacterium
AQRAGAAL

SEQ ID NO: 1154779 - protein, 10 aa, Mycobacterium
AQRAGTDALT

SEQ ID NO: 1154780 - protein, 12 aa, Mycobacterium
AQRAKGRKVSAS

SEQ ID NO: 1154781 - protein, 6 aa, Mycobacterium
AQRALD

SEQ ID NO: 1154782 - protein, 6 aa, Mycobacterium
AQRAQT

SEQ ID NO: 1154783 - protein, 5 aa, Mycobacterium
AQRAS

SEQ ID NO: 1154784 - protein, 8 aa, Mycobacterium
AQRASREI

SEQ ID NO: 1154785 - protein, 7 aa, Mycobacterium
AQRDGKL

SEQ ID NO: 1154786 - protein, 13 aa, Mycobacterium
AQRDRTSQRWPDG

SEQ ID NO: 1154787 - protein, 6 aa, Mycobacterium
AQRPAD

SEQ ID NO: 1154788 - protein, 17 aa, Mycobacterium
AQRPDTGDSAPTLTERE

SEQ ID NO: 1154789 - protein, 8 aa, Mycobacterium
AQRQQWRD

SEQ ID NO: 1154790 - protein, 7 aa, Mycobacterium
AQRRDHR

SEQ ID NO: 1154791 - protein, 8 aa, Mycobacterium
AQRRDPDS

SEQ ID NO: 1154792 - protein, 7 aa, Mycobacterium
AQRRRRL

SEQ ID NO: 1154793 - protein, 7 aa, Mycobacterium
AQRSGNA

SEQ ID NO: 1154794 - protein, 11 aa, Mycobacterium
AQRSLDEGCPL

SEQ ID NO: 1154795 - protein, 11 aa, Mycobacterium
AQRSPSPIADQ

SEQ ID NO: 1154796 - protein, 7 aa, Mycobacterium
AQRTPAL

SEQ ID NO: 1154797 - protein, 8 aa, Mycobacterium
AQRVPPGE

SEQ ID NO: 1154798 - protein, 4 aa, Mycobacterium
AQSA

SEQ ID NO: 1154799 - protein, 12 aa, Mycobacterium
AQSASNRSTSAT

SEQ ID NO: 1154800 - protein, 17 aa, Mycobacterium
AQSAYQNADDSGGQAVG

SEQ ID NO: 1154801 - protein, 8 aa, Mycobacterium
AQSDGDLR

SEQ ID NO: 1154802 - protein, 8 aa, Mycobacterium
AQSEKTRR

SEQ ID NO: 1154803 - protein, 4 aa, Mycobacterium
AQSG

SEQ ID NO: 1154804 - protein, 17 aa, Mycobacterium
AQSGDDFAPYARDPETL

SEQ ID NO: 1154805 - protein, 8 aa, Mycobacterium
AQSGDYDD

SEQ ID NO: 1154806 - protein, 5 aa, Mycobacterium
AQSGY

SEQ ID NO: 1154807 - protein, 7 aa, Mycobacterium
AQSLGPV

SEQ ID NO: 1154808 - protein, 5 aa, Mycobacterium
AQSRL

SEQ ID NO: 1154809 - protein, 20 aa, Mycobacterium
AQSSPATSVYSAERGRRTAE

SEQ ID NO: 1154810 - protein, 6 aa, Mycobacterium
AQSSVR

SEQ ID NO: 1154811 - protein, 14 aa, Mycobacterium
AQSTGELAQAAEAA

SEQ ID NO: 1154812 - protein, 14 aa, Mycobacterium
AQSTPTGTDGYPQR

SEQ ID NO: 1154813 - protein, 25 aa, Mycobacterium
AQTAEDAARATADLRPRVGRARPLA

SEQ ID NO: 1154814 - protein, 12 aa, Mycobacterium
AQTARTEKEGAS

SEQ ID NO: 1154815 - protein, 12 aa, Mycobacterium
AQTATDAATQRA

SEQ ID NO: 1154816 - protein, 6 aa, Mycobacterium
AQTGVA

SEQ ID NO: 1154817 - protein, 10 aa, Mycobacterium
AQTPIERKPP

SEQ ID NO: 1154818 - protein, 12 aa, Mycobacterium
AQTPPKKHGNIP

SEQ ID NO: 1154819 - protein, 7 aa, Mycobacterium
AQTPSEV

SEQ ID NO: 1154820 - protein, 12 aa, Mycobacterium
AQTRASDPTVAG

SEQ ID NO: 1154821 - protein, 14 aa, Mycobacterium
AQTRRRKAADPRHH

SEQ ID NO: 1154822 - protein, 28 aa, Mycobacterium
AQTRSETQLRQAQEKADALQADAERKHS

SEQ ID NO: 1154823 - protein, 6 aa, Mycobacterium
AQTSGG

SEQ ID NO: 1154824 - protein, 6 aa, Mycobacterium
AQTSTP

SEQ ID NO: 1154825 - protein, 8 aa, Mycobacterium
AQVQPRDA

SEQ ID NO: 1154826 - protein, 5 aa, Mycobacterium
AQVQR

SEQ ID NO: 1154827 - protein, 5 aa, Mycobacterium
AQYSQ

SEQ ID NO: 1154828 - protein, 9 aa, Mycobacterium
ARAAAPSDV

SEQ ID NO: 1154829 - protein, 9 aa, Mycobacterium
ARAADDSGA

SEQ ID NO: 1154830 - protein, 9 aa, Mycobacterium
ARAADGELA

SEQ ID NO: 1154831 - protein, 6 aa, Mycobacterium
ARAAGR

SEQ ID NO: 1154832 - protein, 7 aa, Mycobacterium
ARAAHGD

SEQ ID NO: 1154833 - protein, 8 aa, Mycobacterium
ARAARRPR

SEQ ID NO: 1154834 - protein, 9 aa, Mycobacterium
ARAASSKLA

SEQ ID NO: 1154835 - protein, 6 aa, Mycobacterium
ARAAVE

SEQ ID NO: 1154836 - protein, 7 aa, Mycobacterium
ARADAEG

SEQ ID NO: 1154837 - protein, 5 aa, Mycobacterium
ARADD

SEQ ID NO: 1154838 - protein, 8 aa, Mycobacterium
ARADGDPL

SEQ ID NO: 1154839 - protein, 8 aa, Mycobacterium
ARADGQLP

SEQ ID NO: 1154840 - protein, 6 aa, Mycobacterium
ARADGR

SEQ ID NO: 1154841 - protein, 9 aa, Mycobacterium
ARADIRPSQ

SEQ ID NO: 1154842 - protein, 15 aa, Mycobacterium
ARADPNRVRSGSERA

SEQ ID NO: 1154843 - protein, 8 aa, Mycobacterium
ARADYTGA

SEQ ID NO: 1154844 - protein, 10 aa, Mycobacterium
ARAEAEIEEN

SEQ ID NO: 1154845 - protein, 12 aa, Mycobacterium
ARAEAVSAATTA

SEQ ID NO: 1154846 - protein, 11 aa, Mycobacterium
ARAEDAGGTLT

SEQ ID NO: 1154847 - protein, 5 aa, Mycobacterium
ARAEE

SEQ ID NO: 1154848 - protein, 6 aa, Mycobacterium
ARAEEA

SEQ ID NO: 1154849 - protein, 7 aa, Mycobacterium
ARAEGGR

SEQ ID NO: 1154850 - protein, 7 aa, Mycobacterium
ARAEGIS

SEQ ID NO: 1154851 - protein, 12 aa, Mycobacterium
ARAESVTRTENG

SEQ ID NO: 1154852 - protein, 8 aa, Mycobacterium
ARAGAARP

SEQ ID NO: 1154853 - protein, 13 aa, Mycobacterium
ARAGAAVEDRREE

SEQ ID NO: 1154854 - protein, 11 aa, Mycobacterium
ARAGAPPRPSL

SEQ ID NO: 1154855 - protein, 10 aa, Mycobacterium
ARAGASGDLN

SEQ ID NO: 1154856 - protein, 7 aa, Mycobacterium
ARAGDDA

SEQ ID NO: 1154857 - protein, 11 aa, Mycobacterium
ARAGDGGFTDD

SEQ ID NO: 1154858 - protein, 8 aa, Mycobacterium
ARAGELKG

SEQ ID NO: 1154859 - protein, 6 aa, Mycobacterium
ARAGES

SEQ ID NO: 1154860 - protein, 8 aa, Mycobacterium
ARAGGARV

SEQ ID NO: 1154861 - protein, 16 aa, Mycobacterium
ARAGSLRSSEMSDPSI

SEQ ID NO: 1154862 - protein, 8 aa, Mycobacterium
ARAKDEFD

SEQ ID NO: 1154863 - protein, 8 aa, Mycobacterium
ARAKDKRL

SEQ ID NO: 1154864 - protein, 4 aa, Mycobacterium
ARAL

SEQ ID NO: 1154865 - protein, 5 aa, Mycobacterium
ARALG

SEQ ID NO: 1154866 - protein, 4 aa, Mycobacterium
ARAN

SEQ ID NO: 1154867 - protein, 8 aa, Mycobacterium
ARANPEVT

SEQ ID NO: 1154868 - protein, 8 aa, Mycobacterium
ARANRTPI

SEQ ID NO: 1154869 - protein, 15 aa, Mycobacterium
ARAPRGYGRGSHSDD

SEQ ID NO: 1154870 - protein, 18 aa, Mycobacterium
ARAQQIARTAREQGSGDF

SEQ ID NO: 1154871 - protein, 4 aa, Mycobacterium
ARAR

SEQ ID NO: 1154872 - protein, 5 aa, Mycobacterium
ARARE

SEQ ID NO: 1154873 - protein, 7 aa, Mycobacterium
ARARPAA

SEQ ID NO: 1154874 - protein, 13 aa, Mycobacterium
ARARPGRGADAAV

SEQ ID NO: 1154875 - protein, 12 aa, Mycobacterium
ARASGVDPQPGE

SEQ ID NO: 1154876 - protein, 39 aa, Mycobacterium
ARATDEQRRRRERANAEKKASALRTQAAKMGAKATKAVA

SEQ ID NO: 1154877 - protein, 7 aa, Mycobacterium
ARATGKS

SEQ ID NO: 1154878 - protein, 15 aa, Mycobacterium
ARATSRQSVKAATDG

SEQ ID NO: 1154879 - protein, 7 aa, Mycobacterium
ARATTAR

SEQ ID NO: 1154880 - protein, 21 aa, Mycobacterium
ARATTLDEEITDESQRPTPPC

SEQ ID NO: 1154881 - protein, 10 aa, Mycobacterium
ARDAARELAR

SEQ ID NO: 1154882 - protein, 9 aa, Mycobacterium
ARDAARRGV

SEQ ID NO: 1154883 - protein, 14 aa, Mycobacterium
ARDADPRDATRPLT

SEQ ID NO: 1154884 - protein, 13 aa, Mycobacterium
ARDAGAIRSDITE

SEQ ID NO: 1154885 - protein, 14 aa, Mycobacterium
ARDATGAAVGEGDL

SEQ ID NO: 1154886 - protein, 6 aa, Mycobacterium
ARDDAD

SEQ ID NO: 1154887 - protein, 9 aa, Mycobacterium
ARDDLKTPF

SEQ ID NO: 1154888 - protein, 12 aa, Mycobacterium
ARDEHRGIPPVT

SEQ ID NO: 1154889 - protein, 11 aa, Mycobacterium
ARDGKLTAEDF

SEQ ID NO: 1154890 - protein, 10 aa, Mycobacterium
ARDGRDDGAD

SEQ ID NO: 1154891 - protein, 12 aa, Mycobacterium
ARDGRRVAEHTP

SEQ ID NO: 1154892 - protein, 6 aa, Mycobacterium
ARDHAR

SEQ ID NO: 1154893 - protein, 10 aa, Mycobacterium
ARDKARALDG

SEQ ID NO: 1154894 - protein, 9 aa, Mycobacterium
ARDNDVEGR

SEQ ID NO: 1154895 - protein, 7 aa, Mycobacterium
ARDPRPV

SEQ ID NO: 1154896 - protein, 8 aa, Mycobacterium
ARDRGGPS

SEQ ID NO: 1154897 - protein, 6 aa, Mycobacterium
ARDRGQ

SEQ ID NO: 1154898 - protein, 8 aa, Mycobacterium
ARDRPYEN

SEQ ID NO: 1154899 - protein, 11 aa, Mycobacterium
ARDSSTFNPGT

SEQ ID NO: 1154900 - protein, 18 aa, Mycobacterium
ARDTATIGGMASTNAGGL

SEQ ID NO: 1154901 - protein, 5 aa, Mycobacterium
ARDTD

SEQ ID NO: 1154902 - protein, 9 aa, Mycobacterium
ARDTDDPRP

SEQ ID NO: 1154903 - protein, 9 aa, Mycobacterium
ARDTDDTHT

SEQ ID NO: 1154904 - protein, 10 aa, Mycobacterium
ARDTDDTHTF

SEQ ID NO: 1154905 - protein, 5 aa, Mycobacterium
ARDTL

SEQ ID NO: 1154906 - protein, 9 aa, Mycobacterium
ARDTTKAAG

SEQ ID NO: 1154907 - protein, 8 aa, Mycobacterium
ARDTVADE

SEQ ID NO: 1154908 - protein, 7 aa, Mycobacterium
AREAADA

SEQ ID NO: 1154909 - protein, 11 aa, Mycobacterium
AREAAQGRDVR

SEQ ID NO: 1154910 - protein, 8 aa, Mycobacterium
AREAEEAG

SEQ ID NO: 1154911 - protein, 5 aa, Mycobacterium
AREAG

SEQ ID NO: 1154912 - protein, 13 aa, Mycobacterium
AREAGVSLTGPGG

SEQ ID NO: 1154913 - protein, 10 aa, Mycobacterium
AREDPRGPDE

SEQ ID NO: 1154914 - protein, 19 aa, Mycobacterium
AREETRGLHRREDRPHTDH

SEQ ID NO: 1154915 - protein, 4 aa, Mycobacterium
AREF

SEQ ID NO: 1154916 - protein, 5 aa, Mycobacterium
AREFG

SEQ ID NO: 1154917 - protein, 6 aa, Mycobacterium
AREGGL

SEQ ID NO: 1154918 - protein, 8 aa, Mycobacterium
AREGISTD

SEQ ID NO: 1154919 - protein, 7 aa, Mycobacterium
AREGQTV

SEQ ID NO: 1154920 - protein, 7 aa, Mycobacterium
AREGSVD

SEQ ID NO: 1154921 - protein, 11 aa, Mycobacterium
AREGTAVTPAS

SEQ ID NO: 1154922 - protein, 7 aa, Mycobacterium
AREHKGG

SEQ ID NO: 1154923 - protein, 6 aa, Mycobacterium
AREHNN

SEQ ID NO: 1154924 - protein, 8 aa, Mycobacterium
AREKAAGH

SEQ ID NO: 1154925 - protein, 9 aa, Mycobacterium
AREKGSGDF

SEQ ID NO: 1154926 - protein, 8 aa, Mycobacterium
AREKRPTG

SEQ ID NO: 1154927 - protein, 11 aa, Mycobacterium
ARELGADDASF

SEQ ID NO: 1154928 - protein, 23 aa, Mycobacterium
ARELTRKAGAGLRARGSAPRLVS

SEQ ID NO: 1154929 - protein, 13 aa, Mycobacterium
AREPATAQRAQAS

SEQ ID NO: 1154930 - protein, 5 aa, Mycobacterium
AREPD

SEQ ID NO: 1154931 - protein, 5 aa, Mycobacterium
AREPG

SEQ ID NO: 1154932 - protein, 6 aa, Mycobacterium
AREPQH

SEQ ID NO: 1154933 - protein, 7 aa, Mycobacterium
AREPSDR

SEQ ID NO: 1154934 - protein, 4 aa, Mycobacterium
AREQ

SEQ ID NO: 1154935 - protein, 9 aa, Mycobacterium
AREQPIAGV

SEQ ID NO: 1154936 - protein, 4 aa, Mycobacterium
ARER

SEQ ID NO: 1154937 - protein, 8 aa, Mycobacterium
AREREQFE

SEQ ID NO: 1154938 - protein, 11 aa, Mycobacterium
ARERGAEGAWA

SEQ ID NO: 1154939 - protein, 10 aa, Mycobacterium
ARERGSELAE

SEQ ID NO: 1154940 - protein, 8 aa, Mycobacterium
ARERTEAE

SEQ ID NO: 1154941 - protein, 7 aa, Mycobacterium
ARESGDL

SEQ ID NO: 1154942 - protein, 7 aa, Mycobacterium
ARESRAS

SEQ ID NO: 1154943 - protein, 10 aa, Mycobacterium
ARETDPAQGD

SEQ ID NO: 1154944 - protein, 8 aa, Mycobacterium
ARETSEKF

SEQ ID NO: 1154945 - protein, 8 aa, Mycobacterium
AREYGPTG

SEQ ID NO: 1154946 - protein, 15 aa, Mycobacterium
AREYRSAGTPSSPGT

SEQ ID NO: 1154947 - protein, 6 aa, Mycobacterium
ARGAKR

SEQ ID NO: 1154948 - protein, 5 aa, Mycobacterium
ARGAT

SEQ ID NO: 1154949 - protein, 9 aa, Mycobacterium
ARGDGPLAG

SEQ ID NO: 1154950 - protein, 8 aa, Mycobacterium
ARGDNEPV

SEQ ID NO: 1154951 - protein, 5 aa, Mycobacterium
ARGDR

SEQ ID NO: 1154952 - protein, 7 aa, Mycobacterium
ARGDRNR

SEQ ID NO: 1154953 - protein, 7 aa, Mycobacterium
ARGDSQE

SEQ ID NO: 1154954 - protein, 4 aa, Mycobacterium
ARGE

SEQ ID NO: 1154955 - protein, 12 aa, Mycobacterium
ARGEAPARTDGA

SEQ ID NO: 1154956 - protein, 5 aa, Mycobacterium
ARGED

SEQ ID NO: 1154957 - protein, 5 aa, Mycobacterium
ARGEI

SEQ ID NO: 1154958 - protein, 5 aa, Mycobacterium
ARGER

SEQ ID NO: 1154959 - protein, 8 aa, Mycobacterium
ARGEYKSA

SEQ ID NO: 1154960 - protein, 4 aa, Mycobacterium
ARGG

SEQ ID NO: 1154961 - protein, 7 aa, Mycobacterium
ARGGATH

SEQ ID NO: 1154962 - protein, 8 aa, Mycobacterium
ARGGDAFE

SEQ ID NO: 1154963 - protein, 11 aa, Mycobacterium
ARGGDTPERTL

SEQ ID NO: 1154964 - protein, 11 aa, Mycobacterium
ARGGGYNAQKR

SEQ ID NO: 1154965 - protein, 9 aa, Mycobacterium
ARGGPVTDS

SEQ ID NO: 1154966 - protein, 8 aa, Mycobacterium
ARGGSIQR

SEQ ID NO: 1154967 - protein, 5 aa, Mycobacterium
ARGGT

SEQ ID NO: 1154968 - protein, 12 aa, Mycobacterium
ARGGVGDALTTE

SEQ ID NO: 1154969 - protein, 6 aa, Mycobacterium
ARGIEA

SEQ ID NO: 1154970 - protein, 5 aa, Mycobacterium
ARGIT

SEQ ID NO: 1154971 - protein, 12 aa, Mycobacterium
ARGLADAADPGA

SEQ ID NO: 1154972 - protein, 9 aa, Mycobacterium
ARGLPAEAD

SEQ ID NO: 1154973 - protein, 22 aa, Mycobacterium
ARGQRRRATPVGDGAPVLTAAG

SEQ ID NO: 1154974 - protein, 5 aa, Mycobacterium
ARGRG

SEQ ID NO: 1154975 - protein, 7 aa, Mycobacterium
ARGRGPV

SEQ ID NO: 1154976 - protein, 8 aa, Mycobacterium
ARGRKPAR

SEQ ID NO: 1154977 - protein, 8 aa, Mycobacterium
ARGRTPDD

SEQ ID NO: 1154978 - protein, 15 aa, Mycobacterium
ARGSANLPARRGENH

SEQ ID NO: 1154979 - protein, 9 aa, Mycobacterium
ARGSEFGGR

SEQ ID NO: 1154980 - protein, 18 aa, Mycobacterium
ARGTAPSSPLNTTVSRNR

SEQ ID NO: 1154981 - protein, 7 aa, Mycobacterium
ARGVGGA

SEQ ID NO: 1154982 - protein, 12 aa, Mycobacterium
ARGVPREGEPAL

SEQ ID NO: 1154983 - protein, 6 aa, Mycobacterium
ARHADR

SEQ ID NO: 1154984 - protein, 6 aa, Mycobacterium
ARHDGT

SEQ ID NO: 1154985 - protein, 7 aa, Mycobacterium
ARHEAER

SEQ ID NO: 1154986 - protein, 10 aa, Mycobacterium
ARHEDTTEAL

SEQ ID NO: 1154987 - protein, 7 aa, Mycobacterium
ARHKGIP

SEQ ID NO: 1154988 - protein, 23 aa, Mycobacterium
ARHNTDPPDSAEPPNGPPPPSRW

SEQ ID NO: 1154989 - protein, 8 aa, Mycobacterium
ARHPGARG

SEQ ID NO: 1154990 - protein, 4 aa, Mycobacterium
ARHR

SEQ ID NO: 1154991 - protein, 7 aa, Mycobacterium
ARHSTAT

SEQ ID NO: 1154992 - protein, 7 aa, Mycobacterium
ARIPNTE

SEQ ID NO: 1154993 - protein, 12 aa, Mycobacterium
ARIPPPDERRAY

SEQ ID NO: 1154994 - protein, 16 aa, Mycobacterium
ARKAADEYSTAEKPRY

SEQ ID NO: 1154995 - protein, 8 aa, Mycobacterium
ARKERAMP

SEQ ID NO: 1154996 - protein, 6 aa, Mycobacterium
ARKGGV

SEQ ID NO: 1154997 - protein, 9 aa, Mycobacterium
ARKGKRARE

SEQ ID NO: 1154998 - protein, 14 aa, Mycobacterium
ARKPKDLSGGQQQR

SEQ ID NO: 1154999 - protein, 6 aa, Mycobacterium
ARLPGA

SEQ ID NO: 1155000 - protein, 19 aa, Mycobacterium
ARLQTAPRVDGKPPYEVAD

SEQ ID NO: 1155001 - protein, 4 aa, Mycobacterium
ARLR

SEQ ID NO: 1155002 - protein, 5 aa, Mycobacterium
ARMPG

SEQ ID NO: 1155003 - protein, 4 aa, Mycobacterium
ARMS

SEQ ID NO: 1155004 - protein, 7 aa, Mycobacterium
ARMTSES

SEQ ID NO: 1155005 - protein, 5 aa, Mycobacterium
ARNDG

SEQ ID NO: 1155006 - protein, 10 aa, Mycobacterium
ARNGGPEQLR

SEQ ID NO: 1155007 - protein, 7 aa, Mycobacterium
ARNGPLE

SEQ ID NO: 1155008 - protein, 5 aa, Mycobacterium
ARNPR

SEQ ID NO: 1155009 - protein, 5 aa, Mycobacterium
ARNRP

SEQ ID NO: 1155010 - protein, 7 aa, Mycobacterium
ARNTDAQ

SEQ ID NO: 1155011 - protein, 9 aa, Mycobacterium
ARNTGSTVA

SEQ ID NO: 1155012 - protein, 6 aa, Mycobacterium
ARNVSG

SEQ ID NO: 1155013 - protein, 7 aa, Mycobacterium
ARPADLD

SEQ ID NO: 1155014 - protein, 11 aa, Mycobacterium
ARPAHRADATR

SEQ ID NO: 1155015 - protein, 14 aa, Mycobacterium
ARPAPTHRAQRTVE

SEQ ID NO: 1155016 - protein, 15 aa, Mycobacterium
ARPASETADGEGDDE

SEQ ID NO: 1155017 - protein, 7 aa, Mycobacterium
ARPDGPG

SEQ ID NO: 1155018 - protein, 9 aa, Mycobacterium
ARPDGSGGW

SEQ ID NO: 1155019 - protein, 6 aa, Mycobacterium
ARPDGY

SEQ ID NO: 1155020 - protein, 6 aa, Mycobacterium
ARPEAV

SEQ ID NO: 1155021 - protein, 17 aa, Mycobacterium
ARPGDRRTYEVPSGASV

SEQ ID NO: 1155022 - protein, 7 aa, Mycobacterium
ARPGEKI

SEQ ID NO: 1155023 - protein, 19 aa, Mycobacterium
ARPGLTGSRGPDGKPYASL

SEQ ID NO: 1155024 - protein, 6 aa, Mycobacterium
ARPGLV

SEQ ID NO: 1155025 - protein, 14 aa, Mycobacterium
ARPGRTGAARSGPM

SEQ ID NO: 1155026 - protein, 8 aa, Mycobacterium
ARPGRYGS

SEQ ID NO: 1155027 - protein, 6 aa, Mycobacterium
ARPGTG

SEQ ID NO: 1155028 - protein, 7 aa, Mycobacterium
ARPGYGA

SEQ ID NO: 1155029 - protein, 18 aa, Mycobacterium
ARPHRAGGPTSAANGLGE

SEQ ID NO: 1155030 - protein, 8 aa, Mycobacterium
ARPKPAGI

SEQ ID NO: 1155031 - protein, 15 aa, Mycobacterium
ARPPRSAKPRKRAAA

SEQ ID NO: 1155032 - protein, 11 aa, Mycobacterium
ARPPRWPAGDV

SEQ ID NO: 1155033 - protein, 22 aa, Mycobacterium
ARPQRTTQHSGRRSTAPAAGDV

SEQ ID NO: 1155034 - protein, 5 aa, Mycobacterium
ARPRA

SEQ ID NO: 1155035 - protein, 6 aa, Mycobacterium
ARPRLA

SEQ ID NO: 1155036 - protein, 6 aa, Mycobacterium
ARPRSD

SEQ ID NO: 1155037 - protein, 4 aa, Mycobacterium
ARPT

SEQ ID NO: 1155038 - protein, 9 aa, Mycobacterium
ARPTSAQAW

SEQ ID NO: 1155039 - protein, 14 aa, Mycobacterium
ARQAAGAAYPGAGQ

SEQ ID NO: 1155040 - protein, 6 aa, Mycobacterium
ARQGDR

SEQ ID NO: 1155041 - protein, 9 aa, Mycobacterium
ARQGNDAAQ

SEQ ID NO: 1155042 - protein, 7 aa, Mycobacterium
ARQPGRP

SEQ ID NO: 1155043 - protein, 34 aa, Mycobacterium
ARQPNAARRAVTAGRSWGEHTAEPTRTRSRRQAV

SEQ ID NO: 1155044 - protein, 9 aa, Mycobacterium
ARQRGEQPD

SEQ ID NO: 1155045 - protein, 5 aa, Mycobacterium
ARQRP

SEQ ID NO: 1155046 - protein, 9 aa, Mycobacterium
ARQRSADRV

SEQ ID NO: 1155047 - protein, 7 aa, Mycobacterium
ARQSGQH

SEQ ID NO: 1155048 - protein, 9 aa, Mycobacterium
ARQSTEVAS

SEQ ID NO: 1155049 - protein, 12 aa, Mycobacterium
ARQTGAAQRGQF

SEQ ID NO: 1155050 - protein, 5 aa, Mycobacterium
ARQTR

SEQ ID NO: 1155051 - protein, 7 aa, Mycobacterium
ARQYTRK

SEQ ID NO: 1155052 - protein, 8 aa, Mycobacterium
ARRAAKGL

SEQ ID NO: 1155053 - protein, 6 aa, Mycobacterium
ARRADD

SEQ ID NO: 1155054 - protein, 7 aa, Mycobacterium
ARRADGD

SEQ ID NO: 1155055 - protein, 10 aa, Mycobacterium
ARRADGEPCR

SEQ ID NO: 1155056 - protein, 13 aa, Mycobacterium
ARRADSADGREGV

SEQ ID NO: 1155057 - protein, 7 aa, Mycobacterium
ARRAPRE

SEQ ID NO: 1155058 - protein, 10 aa, Mycobacterium
ARRARAGKHR

SEQ ID NO: 1155059 - protein, 7 aa, Mycobacterium
ARRARVA

SEQ ID NO: 1155060 - protein, 5 aa, Mycobacterium
ARRDE

SEQ ID NO: 1155061 - protein, 5 aa, Mycobacterium
ARRDG

SEQ ID NO: 1155062 - protein, 8 aa, Mycobacterium
ARRDRPAS

SEQ ID NO: 1155063 - protein, 4 aa, Mycobacterium
ARRE

SEQ ID NO: 1155064 - protein, 6 aa, Mycobacterium
ARREDR

SEQ ID NO: 1155065 - protein, 10 aa, Mycobacterium
ARRGDARSIG

SEQ ID NO: 1155066 - protein, 7 aa, Mycobacterium
ARRGEDL

SEQ ID NO: 1155067 - protein, 6 aa, Mycobacterium
ARRGKN

SEQ ID NO: 1155068 - protein, 8 aa, Mycobacterium
ARRGPGRV

SEQ ID NO: 1155069 - protein, 10 aa, Mycobacterium
ARRGRPAGLS

SEQ ID NO: 1155070 - protein, 8 aa, Mycobacterium
ARRGRPEG

SEQ ID NO: 1155071 - protein, 9 aa, Mycobacterium
ARRGTSAPI

SEQ ID NO: 1155072 - protein, 5 aa, Mycobacterium
ARRGV

SEQ ID NO: 1155073 - protein, 7 aa, Mycobacterium
ARRGVPP

SEQ ID NO: 1155074 - protein, 10 aa, Mycobacterium
ARRGVPQSCQ

SEQ ID NO: 1155075 - protein, 5 aa, Mycobacterium
ARRHD

SEQ ID NO: 1155076 - protein, 5 aa, Mycobacterium
ARRNS

SEQ ID NO: 1155077 - protein, 4 aa, Mycobacterium
ARRP

SEQ ID NO: 1155078 - protein, 18 aa, Mycobacterium
ARRPAGDIGQGASPSADT

SEQ ID NO: 1155079 - protein, 7 aa, Mycobacterium
ARRPDGA

SEQ ID NO: 1155080 - protein, 12 aa, Mycobacterium
ARRPPGTSPDAA

SEQ ID NO: 1155081 - protein, 16 aa, Mycobacterium
ARRPSGDQFHAPPGGH

SEQ ID NO: 1155082 - protein, 5 aa, Mycobacterium
ARRRA

SEQ ID NO: 1155083 - protein, 10 aa, Mycobacterium
ARRRAGDPQA

SEQ ID NO: 1155084 - protein, 9 aa, Mycobacterium
ARRRAGRTH

SEQ ID NO: 1155085 - protein, 7 aa, Mycobacterium
ARRRDAA

SEQ ID NO: 1155086 - protein, 15 aa, Mycobacterium
ARRRDAAGAQPGPPA

SEQ ID NO: 1155087 - protein, 13 aa, Mycobacterium
ARRRDGSAPPAPV

SEQ ID NO: 1155088 - protein, 6 aa, Mycobacterium
ARRRDS

SEQ ID NO: 1155089 - protein, 6 aa, Mycobacterium
ARRREP

SEQ ID NO: 1155090 - protein, 10 aa, Mycobacterium
ARRRGGDPVT

SEQ ID NO: 1155091 - protein, 18 aa, Mycobacterium
ARRRGGRRTFDPREYTPP

SEQ ID NO: 1155092 - protein, 11 aa, Mycobacterium
ARRRKPPEDLP

SEQ ID NO: 1155093 - protein, 6 aa, Mycobacterium
ARRRRA

SEQ ID NO: 1155094 - protein, 6 aa, Mycobacterium
ARRSAG

SEQ ID NO: 1155095 - protein, 7 aa, Mycobacterium
ARRSDEP

SEQ ID NO: 1155096 - protein, 9 aa, Mycobacterium
ARRSGDSGA

SEQ ID NO: 1155097 - protein, 76 aa, Mycobacterium
ARRSGSPSRPINPAPHRPPEPPQGRPDVGRPGSAAPARPYAQRPEAGRPDGPPAARPDTARRTPPARNGHQSANFQ

SEQ ID NO: 1155098 - protein, 10 aa, Mycobacterium
ARRSKDDPYR

SEQ ID NO: 1155099 - protein, 13 aa, Mycobacterium
ARRSQGEIRPKGG

SEQ ID NO: 1155100 - protein, 12 aa, Mycobacterium
ARRSSGPADERG

SEQ ID NO: 1155101 - protein, 8 aa, Mycobacterium
ARRTAEEL

SEQ ID NO: 1155102 - protein, 8 aa, Mycobacterium
ARRTASPL

SEQ ID NO: 1155103 - protein, 5 aa, Mycobacterium
ARRTL

SEQ ID NO: 1155104 - protein, 7 aa, Mycobacterium
ARRTPDA

SEQ ID NO: 1155105 - protein, 8 aa, Mycobacterium
ARRTPGDD

SEQ ID NO: 1155106 - protein, 21 aa, Mycobacterium
ARRTSEGLAHQRGANPKNPRP

SEQ ID NO: 1155107 - protein, 14 aa, Mycobacterium
ARSARNEVPDPPGP

SEQ ID NO: 1155108 - protein, 7 aa, Mycobacterium
ARSDLGQ

SEQ ID NO: 1155109 - protein, 9 aa, Mycobacterium
ARSGDELPD

SEQ ID NO: 1155110 - protein, 10 aa, Mycobacterium
ARSGGGMNAA

SEQ ID NO: 1155111 - protein, 6 aa, Mycobacterium
ARSGIP

SEQ ID NO: 1155112 - protein, 5 aa, Mycobacterium
ARSGP

SEQ ID NO: 1155113 - protein, 33 aa, Mycobacterium
ARSGTDEDFHRGESAYDRYYGDPTNKPNPNLGE

SEQ ID NO: 1155114 - protein, 5 aa, Mycobacterium
ARSKG

SEQ ID NO: 1155115 - protein, 4 aa, Mycobacterium
ARSL

SEQ ID NO: 1155116 - protein, 6 aa, Mycobacterium
ARSPEA

SEQ ID NO: 1155117 - protein, 7 aa, Mycobacterium
ARSPQSV

SEQ ID NO: 1155118 - protein, 8 aa, Mycobacterium
ARSQGRKL

SEQ ID NO: 1155119 - protein, 8 aa, Mycobacterium
ARSRQQAA

SEQ ID NO: 1155120 - protein, 5 aa, Mycobacterium
ARSRS

SEQ ID NO: 1155121 - protein, 10 aa, Mycobacterium
ARSRTHRRTP

SEQ ID NO: 1155122 - protein, 10 aa, Mycobacterium
ARSSPSGQTL

SEQ ID NO: 1155123 - protein, 13 aa, Mycobacterium
ARSTGRSRANAVA

SEQ ID NO: 1155124 - protein, 8 aa, Mycobacterium
ARSVPSDS

SEQ ID NO: 1155125 - protein, 15 aa, Mycobacterium
ARTAAGRTLTSAQRE

SEQ ID NO: 1155126 - protein, 7 aa, Mycobacterium
ARTADRE

SEQ ID NO: 1155127 - protein, 7 aa, Mycobacterium
ARTAEEV

SEQ ID NO: 1155128 - protein, 15 aa, Mycobacterium
ARTAESLSGNQQLQE

SEQ ID NO: 1155129 - protein, 14 aa, Mycobacterium
ARTARTIPVFELHR

SEQ ID NO: 1155130 - protein, 8 aa, Mycobacterium
ARTATRDV

SEQ ID NO: 1155131 - protein, 8 aa, Mycobacterium
ARTDQKTF

SEQ ID NO: 1155132 - protein, 6 aa, Mycobacterium
ARTDRP

SEQ ID NO: 1155133 - protein, 5 aa, Mycobacterium
ARTEA

SEQ ID NO: 1155134 - protein, 13 aa, Mycobacterium
ARTEPPDPPAVDD

SEQ ID NO: 1155135 - protein, 6 aa, Mycobacterium
ARTFPK

SEQ ID NO: 1155136 - protein, 5 aa, Mycobacterium
ARTGA

SEQ ID NO: 1155137 - protein, 9 aa, Mycobacterium
ARTGAEALT

SEQ ID NO: 1155138 - protein, 5 aa, Mycobacterium
ARTGE

SEQ ID NO: 1155139 - protein, 8 aa, Mycobacterium
ARTGFTQS

SEQ ID NO: 1155140 - protein, 5 aa, Mycobacterium
ARTGG

SEQ ID NO: 1155141 - protein, 14 aa, Mycobacterium
ARTGGGDPGGNPTL

SEQ ID NO: 1155142 - protein, 7 aa, Mycobacterium
ARTGRPL

SEQ ID NO: 1155143 - protein, 7 aa, Mycobacterium
ARTGSMA

SEQ ID NO: 1155144 - protein, 5 aa, Mycobacterium
ARTGT

SEQ ID NO: 1155145 - protein, 6 aa, Mycobacterium
ARTGTP

SEQ ID NO: 1155146 - protein, 6 aa, Mycobacterium
ARTGTV

SEQ ID NO: 1155147 - protein, 5 aa, Mycobacterium
ARTGV

SEQ ID NO: 1155148 - protein, 6 aa, Mycobacterium
ARTHPD

SEQ ID NO: 1155149 - protein, 12 aa, Mycobacterium
ARTPDAEQTITE

SEQ ID NO: 1155150 - protein, 10 aa, Mycobacterium
ARTPGDPNAL

SEQ ID NO: 1155151 - protein, 9 aa, Mycobacterium
ARTPNADRR

SEQ ID NO: 1155152 - protein, 7 aa, Mycobacterium
ARTQPGD

SEQ ID NO: 1155153 - protein, 9 aa, Mycobacterium
ARTRGGPPI

SEQ ID NO: 1155154 - protein, 9 aa, Mycobacterium
ARTRRDGRS

SEQ ID NO: 1155155 - protein, 8 aa, Mycobacterium
ARTSASLS

SEQ ID NO: 1155156 - protein, 5 aa, Mycobacterium
ARTSL

SEQ ID NO: 1155157 - protein, 11 aa, Mycobacterium
ARTSQGRTLRE

SEQ ID NO: 1155158 - protein, 7 aa, Mycobacterium
ARTSRRT

SEQ ID NO: 1155159 - protein, 8 aa, Mycobacterium
ARTSTPYV

SEQ ID NO: 1155160 - protein, 6 aa, Mycobacterium
ARTTAV

SEQ ID NO: 1155161 - protein, 11 aa, Mycobacterium
ARTVGERCESS

SEQ ID NO: 1155162 - protein, 9 aa, Mycobacterium
ARVASNAVS

SEQ ID NO: 1155163 - protein, 6 aa, Mycobacterium
ARVGDG

SEQ ID NO: 1155164 - protein, 4 aa, Mycobacterium
ARVK

SEQ ID NO: 1155165 - protein, 7 aa, Mycobacterium
ARYANPD

SEQ ID NO: 1155166 - protein, 8 aa, Mycobacterium
ARYGSPRK

SEQ ID NO: 1155167 - protein, 4 aa, Mycobacterium
ARYI

SEQ ID NO: 1155168 - protein, 5 aa, Mycobacterium
ARYIT

SEQ ID NO: 1155169 - protein, 6 aa, Mycobacterium
ARYSGR

SEQ ID NO: 1155170 - protein, 12 aa, Mycobacterium
ARYSQTPNQGVG

SEQ ID NO: 1155171 - protein, 4 aa, Mycobacterium
ARYT

SEQ ID NO: 1155172 - protein, 10 aa, Mycobacterium
ASAADGQKGA

SEQ ID NO: 1155173 - protein, 6 aa, Mycobacterium
ASAAEE

SEQ ID NO: 1155174 - protein, 6 aa, Mycobacterium
ASAAGI

SEQ ID NO: 1155175 - protein, 14 aa, Mycobacterium
ASAAGQLREGINPK

SEQ ID NO: 1155176 - protein, 9 aa, Mycobacterium
ASAAGTAPP

SEQ ID NO: 1155177 - protein, 20 aa, Mycobacterium
ASAAPDEPGKGPGEKYTGPV

SEQ ID NO: 1155178 - protein, 12 aa, Mycobacterium
ASADPQGRPWSE

SEQ ID NO: 1155179 - protein, 7 aa, Mycobacterium
ASADTGK

SEQ ID NO: 1155180 - protein, 18 aa, Mycobacterium
ASADYETKAADLDDEQLR

SEQ ID NO: 1155181 - protein, 4 aa, Mycobacterium
ASAE

SEQ ID NO: 1155182 - protein, 6 aa, Mycobacterium
ASAEAL

SEQ ID NO: 1155183 - protein, 6 aa, Mycobacterium
ASAEGL

SEQ ID NO: 1155184 - protein, 8 aa, Mycobacterium
ASAEIDPG

SEQ ID NO: 1155185 - protein, 6 aa, Mycobacterium
ASAESR

SEQ ID NO: 1155186 - protein, 7 aa, Mycobacterium
ASAGAIS

SEQ ID NO: 1155187 - protein, 6 aa, Mycobacterium
ASAGGH

SEQ ID NO: 1155188 - protein, 13 aa, Mycobacterium
ASAGIGEATARTL

SEQ ID NO: 1155189 - protein, 5 aa, Mycobacterium
ASAGP

SEQ ID NO: 1155190 - protein, 8 aa, Mycobacterium
ASAGPARD

SEQ ID NO: 1155191 - protein, 7 aa, Mycobacterium
ASAGPLP

SEQ ID NO: 1155192 - protein, 5 aa, Mycobacterium
ASAGR

SEQ ID NO: 1155193 - protein, 9 aa, Mycobacterium
ASAIQQTAD

SEQ ID NO: 1155194 - protein, 23 aa, Mycobacterium
ASAKLGTRTRHESVSRARLLRLI

SEQ ID NO: 1155195 - protein, 8 aa, Mycobacterium
ASAPAGQT

SEQ ID NO: 1155196 - protein, 10 aa, Mycobacterium
ASAPGGDSYA

SEQ ID NO: 1155197 - protein, 8 aa, Mycobacterium
ASAPPRTA

SEQ ID NO: 1155198 - protein, 6 aa, Mycobacterium
ASAQTL

SEQ ID NO: 1155199 - protein, 7 aa, Mycobacterium
ASARQGL

SEQ ID NO: 1155200 - protein, 7 aa, Mycobacterium
ASARQRV

SEQ ID NO: 1155201 - protein, 7 aa, Mycobacterium
ASASRSA

SEQ ID NO: 1155202 - protein, 19 aa, Mycobacterium
ASASSFRGTDKRGGANGAR

SEQ ID NO: 1155203 - protein, 6 aa, Mycobacterium
ASASTR

SEQ ID NO: 1155204 - protein, 8 aa, Mycobacterium
ASATDRGY

SEQ ID NO: 1155205 - protein, 7 aa, Mycobacterium
ASATTGL

SEQ ID NO: 1155206 - protein, 6 aa, Mycobacterium
ASDAGV

SEQ ID NO: 1155207 - protein, 6 aa, Mycobacterium
ASDDEA

SEQ ID NO: 1155208 - protein, 7 aa, Mycobacterium
ASDDPGQ

SEQ ID NO: 1155209 - protein, 7 aa, Mycobacterium
ASDEDAG

SEQ ID NO: 1155210 - protein, 7 aa, Mycobacterium
ASDFPPS

SEQ ID NO: 1155211 - protein, 10 aa, Mycobacterium
ASDGATLPPW

SEQ ID NO: 1155212 - protein, 6 aa, Mycobacterium
ASDGRI

SEQ ID NO: 1155213 - protein, 7 aa, Mycobacterium
ASDGRPL

SEQ ID NO: 1155214 - protein, 6 aa, Mycobacterium
ASDLDD

SEQ ID NO: 1155215 - protein, 10 aa, Mycobacterium
ASDLGSHPRA

SEQ ID NO: 1155216 - protein, 7 aa, Mycobacterium
ASDPARL

SEQ ID NO: 1155217 - protein, 8 aa, Mycobacterium
ASDPDYRD

SEQ ID NO: 1155218 - protein, 14 aa, Mycobacterium
ASDPETGRSLSDDD

SEQ ID NO: 1155219 - protein, 7 aa, Mycobacterium
ASDRRAY

SEQ ID NO: 1155220 - protein, 7 aa, Mycobacterium
ASDTDTE

SEQ ID NO: 1155221 - protein, 20 aa, Mycobacterium
ASDTETGDRDELRPGVPERS

SEQ ID NO: 1155222 - protein, 8 aa, Mycobacterium
ASDVADGS

SEQ ID NO: 1155223 - protein, 17 aa, Mycobacterium
ASDVPTAEKADRANPDH

SEQ ID NO: 1155224 - protein, 9 aa, Mycobacterium
ASEADGARD

SEQ ID NO: 1155225 - protein, 6 aa, Mycobacterium
ASEAEL

SEQ ID NO: 1155226 - protein, 8 aa, Mycobacterium
ASEDPTVT

SEQ ID NO: 1155227 - protein, 6 aa, Mycobacterium
ASEDQL

SEQ ID NO: 1155228 - protein, 12 aa, Mycobacterium
ASEEPTGSSESA

SEQ ID NO: 1155229 - protein, 4 aa, Mycobacterium
ASEG

SEQ ID NO: 1155230 - protein, 6 aa, Mycobacterium
ASEGGI

SEQ ID NO: 1155231 - protein, 13 aa, Mycobacterium
ASEGVKEDDIRSD

SEQ ID NO: 1155232 - protein, 12 aa, Mycobacterium
ASEITPSQEELD

SEQ ID NO: 1155233 - protein, 5 aa, Mycobacterium
ASEKA

SEQ ID NO: 1155234 - protein, 8 aa, Mycobacterium
ASEKAGAL

SEQ ID NO: 1155235 - protein, 9 aa, Mycobacterium
ASEKGVTVS

SEQ ID NO: 1155236 - protein, 4 aa, Mycobacterium
ASEM

SEQ ID NO: 1155237 - protein, 6 aa, Mycobacterium
ASEPDA

SEQ ID NO: 1155238 - protein, 24 aa, Mycobacterium
ASEPGELTDATVAEPDNAVDSGPE

SEQ ID NO: 1155239 - protein, 5 aa, Mycobacterium
ASEPL

SEQ ID NO: 1155240 - protein, 13 aa, Mycobacterium
ASEPYDDDPRWEE

SEQ ID NO: 1155241 - protein, 7 aa, Mycobacterium
ASEQQRL

SEQ ID NO: 1155242 - protein, 7 aa, Mycobacterium
ASERSGR

SEQ ID NO: 1155243 - protein, 8 aa, Mycobacterium
ASERTDDP

SEQ ID NO: 1155244 - protein, 9 aa, Mycobacterium
ASETARHSF

SEQ ID NO: 1155245 - protein, 6 aa, Mycobacterium
ASEVKR

SEQ ID NO: 1155246 - protein, 10 aa, Mycobacterium
ASFPDGTMPE

SEQ ID NO: 1155247 - protein, 13 aa, Mycobacterium
ASFPGAATVDQDA

SEQ ID NO: 1155248 - protein, 4 aa, Mycobacterium
ASFV

SEQ ID NO: 1155249 - protein, 7 aa, Mycobacterium
ASGAAAI

SEQ ID NO: 1155250 - protein, 5 aa, Mycobacterium
ASGAD

SEQ ID NO: 1155251 - protein, 11 aa, Mycobacterium
ASGADTGGDGA

SEQ ID NO: 1155252 - protein, 5 aa, Mycobacterium
ASGAE

SEQ ID NO: 1155253 - protein, 18 aa, Mycobacterium
ASGAEPLGSMGTDTPSAV

SEQ ID NO: 1155254 - protein, 6 aa, Mycobacterium
ASGAFE

SEQ ID NO: 1155255 - protein, 7 aa, Mycobacterium
ASGCGKT

SEQ ID NO: 1155256 - protein, 9 aa, Mycobacterium
ASGDDPKKL

SEQ ID NO: 1155257 - protein, 15 aa, Mycobacterium
ASGDGAVVTDTDGRS

SEQ ID NO: 1155258 - protein, 14 aa, Mycobacterium
ASGDIDADGPETPF

SEQ ID NO: 1155259 - protein, 11 aa, Mycobacterium
ASGDPQIDETA

SEQ ID NO: 1155260 - protein, 6 aa, Mycobacterium
ASGDTS

SEQ ID NO: 1155261 - protein, 5 aa, Mycobacterium
ASGEF

SEQ ID NO: 1155262 - protein, 19 aa, Mycobacterium
ASGEPGGTPPWRPYRSDDR

SEQ ID NO: 1155263 - protein, 8 aa, Mycobacterium
ASGERTAG

SEQ ID NO: 1155264 - protein, 4 aa, Mycobacterium
ASGG

SEQ ID NO: 1155265 - protein, 5 aa, Mycobacterium
ASGGG

SEQ ID NO: 1155266 - protein, 7 aa, Mycobacterium
ASGGIGA

SEQ ID NO: 1155267 - protein, 14 aa, Mycobacterium
ASGGPRTRRGATRG

SEQ ID NO: 1155268 - protein, 7 aa, Mycobacterium
ASGHPDV

SEQ ID NO: 1155269 - protein, 13 aa, Mycobacterium
ASGHRERGVKQEI

SEQ ID NO: 1155270 - protein, 6 aa, Mycobacterium
ASGHRP

SEQ ID NO: 1155271 - protein, 5 aa, Mycobacterium
ASGIG

SEQ ID NO: 1155272 - protein, 6 aa, Mycobacterium
ASGIPR

SEQ ID NO: 1155273 - protein, 13 aa, Mycobacterium
ASGKESVKVSLIP

SEQ ID NO: 1155274 - protein, 10 aa, Mycobacterium
ASGLGHEGGY

SEQ ID NO: 1155275 - protein, 10 aa, Mycobacterium
ASGLSERDGA

SEQ ID NO: 1155276 - protein, 11 aa, Mycobacterium
ASGLTGGPALN

SEQ ID NO: 1155277 - protein, 13 aa, Mycobacterium
ASGNIDATRTNPS

SEQ ID NO: 1155278 - protein, 10 aa, Mycobacterium
ASGNSDRLAG

SEQ ID NO: 1155279 - protein, 11 aa, Mycobacterium
ASGPDKIGRDA

SEQ ID NO: 1155280 - protein, 7 aa, Mycobacterium
ASGPDRA

SEQ ID NO: 1155281 - protein, 12 aa, Mycobacterium
ASGPQRDAGAVP

SEQ ID NO: 1155282 - protein, 16 aa, Mycobacterium
ASGPVPPVDPQRLNSA

SEQ ID NO: 1155283 - protein, 14 aa, Mycobacterium
ASGQLRNSATTAGN

SEQ ID NO: 1155284 - protein, 10 aa, Mycobacterium
ASGRGSRTPA

SEQ ID NO: 1155285 - protein, 8 aa, Mycobacterium
ASGRNGGF

SEQ ID NO: 1155286 - protein, 9 aa, Mycobacterium
ASGRPAPHL

SEQ ID NO: 1155287 - protein, 9 aa, Mycobacterium
ASGSGKSTL

SEQ ID NO: 1155288 - protein, 10 aa, Mycobacterium
ASGSPSQFGA

SEQ ID NO: 1155289 - protein, 8 aa, Mycobacterium
ASGSRMRP

SEQ ID NO: 1155290 - protein, 10 aa, Mycobacterium
ASGSVNKSGV

SEQ ID NO: 1155291 - protein, 7 aa, Mycobacterium
ASGTADD

SEQ ID NO: 1155292 - protein, 6 aa, Mycobacterium
ASGVAA

SEQ ID NO: 1155293 - protein, 8 aa, Mycobacterium
ASGVSNRD

SEQ ID NO: 1155294 - protein, 4 aa, Mycobacterium
ASGY

SEQ ID NO: 1155295 - protein, 7 aa, Mycobacterium
ASGYAPR

SEQ ID NO: 1155296 - protein, 8 aa, Mycobacterium
ASGYPSDL

SEQ ID NO: 1155297 - protein, 13 aa, Mycobacterium
ASHRDAAAAGRGP

SEQ ID NO: 1155298 - protein, 16 aa, Mycobacterium
ASHSEDGGPGRRGTGA

SEQ ID NO: 1155299 - protein, 8 aa, Mycobacterium
ASISPETL

SEQ ID NO: 1155300 - protein, 6 aa, Mycobacterium
ASITSS

SEQ ID NO: 1155301 - protein, 7 aa, Mycobacterium
ASKAELS

SEQ ID NO: 1155302 - protein, 9 aa, Mycobacterium
ASKEGGETV

SEQ ID NO: 1155303 - protein, 10 aa, Mycobacterium
ASKGYQATTI

SEQ ID NO: 1155304 - protein, 10 aa, Mycobacterium
ASKGYRGQRS

SEQ ID NO: 1155305 - protein, 15 aa, Mycobacterium
ASKKDRPGADPGGMG

SEQ ID NO: 1155306 - protein, 17 aa, Mycobacterium
ASKPGSNGVTPLENDNV

SEQ ID NO: 1155307 - protein, 5 aa, Mycobacterium
ASKPI

SEQ ID NO: 1155308 - protein, 9 aa, Mycobacterium
ASKRAGETA

SEQ ID NO: 1155309 - protein, 8 aa, Mycobacterium
ASKRSAEF

SEQ ID NO: 1155310 - protein, 7 aa, Mycobacterium
ASKSLAP

SEQ ID NO: 1155311 - protein, 5 aa, Mycobacterium
ASLDE

SEQ ID NO: 1155312 - protein, 4 aa, Mycobacterium
ASLG

SEQ ID NO: 1155313 - protein, 8 aa, Mycobacterium
ASLGARDA

SEQ ID NO: 1155314 - protein, 11 aa, Mycobacterium
ASLGEGGEDGA

SEQ ID NO: 1155315 - protein, 8 aa, Mycobacterium
ASLGPATR

SEQ ID NO: 1155316 - protein, 7 aa, Mycobacterium
ASLPESD

SEQ ID NO: 1155317 - protein, 8 aa, Mycobacterium
ASLPPAAT

SEQ ID NO: 1155318 - protein, 14 aa, Mycobacterium
ASLQQAAKTAGLQS

SEQ ID NO: 1155319 - protein, 9 aa, Mycobacterium
ASLRSAARA

SEQ ID NO: 1155320 - protein, 10 aa, Mycobacterium
ASLRTDTRSR

SEQ ID NO: 1155321 - protein, 11 aa, Mycobacterium
ASLSSAAGARG

SEQ ID NO: 1155322 - protein, 11 aa, Mycobacterium
ASLTDDDLDTA

SEQ ID NO: 1155323 - protein, 46 aa, Mycobacterium
ASLTGKASKPAKSESSPASDSGSASESDSGSDSGSGSGSDSTSGDA

SEQ ID NO: 1155324 - protein, 13 aa, Mycobacterium
ASLTPTDAVPHGT

SEQ ID NO: 1155325 - protein, 11 aa, Mycobacterium
ASMGNTNPKDN

SEQ ID NO: 1155326 - protein, 7 aa, Mycobacterium
ASNERQV

SEQ ID NO: 1155327 - protein, 10 aa, Mycobacterium
ASNGAAATLD

SEQ ID NO: 1155328 - protein, 6 aa, Mycobacterium
ASNPDA

SEQ ID NO: 1155329 - protein, 9 aa, Mycobacterium
ASNPRRDRR

SEQ ID NO: 1155330 - protein, 9 aa, Mycobacterium
ASNYGGPRH

SEQ ID NO: 1155331 - protein, 4 aa, Mycobacterium
ASPA

SEQ ID NO: 1155332 - protein, 6 aa, Mycobacterium
ASPAAD

SEQ ID NO: 1155333 - protein, 6 aa, Mycobacterium
ASPAAG

SEQ ID NO: 1155334 - protein, 10 aa, Mycobacterium
ASPAPGHGGY

SEQ ID NO: 1155335 - protein, 4 aa, Mycobacterium
ASPD

SEQ ID NO: 1155336 - protein, 9 aa, Mycobacterium
ASPDGTRAV

SEQ ID NO: 1155337 - protein, 7 aa, Mycobacterium
ASPEATY

SEQ ID NO: 1155338 - protein, 7 aa, Mycobacterium
ASPERRK

SEQ ID NO: 1155339 - protein, 5 aa, Mycobacterium
ASPGL

SEQ ID NO: 1155340 - protein, 14 aa, Mycobacterium
ASPHEFPSDARKGG

SEQ ID NO: 1155341 - protein, 9 aa, Mycobacterium
ASPHLKGRN

SEQ ID NO: 1155342 - protein, 10 aa, Mycobacterium
ASPHRDRNSL

SEQ ID NO: 1155343 - protein, 8 aa, Mycobacterium
ASPLSRTL

SEQ ID NO: 1155344 - protein, 10 aa, Mycobacterium
ASPNGAKRAI

SEQ ID NO: 1155345 - protein, 4 aa, Mycobacterium
ASPQ

SEQ ID NO: 1155346 - protein, 6 aa, Mycobacterium
ASPSVN

SEQ ID NO: 1155347 - protein, 6 aa, Mycobacterium
ASPTLR

SEQ ID NO: 1155348 - protein, 13 aa, Mycobacterium
ASPVDPPRTTDPA

SEQ ID NO: 1155349 - protein, 14 aa, Mycobacterium
ASQAVRESAQGPSE

SEQ ID NO: 1155350 - protein, 8 aa, Mycobacterium
ASQEGKPD

SEQ ID NO: 1155351 - protein, 14 aa, Mycobacterium
ASQETLAMELHAPG

SEQ ID NO: 1155352 - protein, 13 aa, Mycobacterium
ASQGGIARGVPTG

SEQ ID NO: 1155353 - protein, 6 aa, Mycobacterium
ASQGRP

SEQ ID NO: 1155354 - protein, 4 aa, Mycobacterium
ASQP

SEQ ID NO: 1155355 - protein, 10 aa, Mycobacterium
ASQQSRPIAS

SEQ ID NO: 1155356 - protein, 5 aa, Mycobacterium
ASQRA

SEQ ID NO: 1155357 - protein, 13 aa, Mycobacterium
ASQRRVTPDPSPE

SEQ ID NO: 1155358 - protein, 8 aa, Mycobacterium
ASQSDEFG

SEQ ID NO: 1155359 - protein, 17 aa, Mycobacterium
ASQSNAPVGAPRQFGST

SEQ ID NO: 1155360 - protein, 11 aa, Mycobacterium
ASRAELGADPR

SEQ ID NO: 1155361 - protein, 18 aa, Mycobacterium
ASRASEAAREVEQGDADA

SEQ ID NO: 1155362 - protein, 14 aa, Mycobacterium
ASRAVASLATSGVA

SEQ ID NO: 1155363 - protein, 7 aa, Mycobacterium
ASRDRHP

SEQ ID NO: 1155364 - protein, 12 aa, Mycobacterium
ASRENAADALRS

SEQ ID NO: 1155365 - protein, 4 aa, Mycobacterium
ASRG

SEQ ID NO: 1155366 - protein, 11 aa, Mycobacterium
ASRGGLPRPAR

SEQ ID NO: 1155367 - protein, 7 aa, Mycobacterium
ASRLESS

SEQ ID NO: 1155368 - protein, 28 aa, Mycobacterium
ASRNRDTLAAERRQRAEALSKAREEVNE

SEQ ID NO: 1155369 - protein, 6 aa, Mycobacterium
ASRPQA

SEQ ID NO: 1155370 - protein, 16 aa, Mycobacterium
ASRQKARAARRLGFEV

SEQ ID NO: 1155371 - protein, 11 aa, Mycobacterium
ASRRENPTEDL

SEQ ID NO: 1155372 - protein, 7 aa, Mycobacterium
ASRSMQR

SEQ ID NO: 1155373 - protein, 7 aa, Mycobacterium
ASRSPAD

SEQ ID NO: 1155374 - protein, 6 aa, Mycobacterium
ASRVGD

SEQ ID NO: 1155375 - protein, 9 aa, Mycobacterium
ASRVPSVAP

SEQ ID NO: 1155376 - protein, 5 aa, Mycobacterium
ASSAG

SEQ ID NO: 1155377 - protein, 14 aa, Mycobacterium
ASSAGGAAARERAE

SEQ ID NO: 1155378 - protein, 6 aa, Mycobacterium
ASSAPD

SEQ ID NO: 1155379 - protein, 9 aa, Mycobacterium
ASSGIGEAA

SEQ ID NO: 1155380 - protein, 6 aa, Mycobacterium
ASSGLG

SEQ ID NO: 1155381 - protein, 19 aa, Mycobacterium
ASSGRTATTKAMGKGSTQH

SEQ ID NO: 1155382 - protein, 7 aa, Mycobacterium
ASSGSGV

SEQ ID NO: 1155383 - protein, 6 aa, Mycobacterium
ASSIEA

SEQ ID NO: 1155384 - protein, 7 aa, Mycobacterium
ASSPAEV

SEQ ID NO: 1155385 - protein, 5 aa, Mycobacterium
ASSRT

SEQ ID NO: 1155386 - protein, 8 aa, Mycobacterium
ASSSGRST

SEQ ID NO: 1155387 - protein, 4 aa, Mycobacterium
ASST

SEQ ID NO: 1155388 - protein, 7 aa, Mycobacterium
ASSYATP

SEQ ID NO: 1155389 - protein, 7 aa, Mycobacterium
ASTAADS

SEQ ID NO: 1155390 - protein, 9 aa, Mycobacterium
ASTAQGSVT

SEQ ID NO: 1155391 - protein, 6 aa, Mycobacterium
ASTCND

SEQ ID NO: 1155392 - protein, 6 aa, Mycobacterium
ASTDGA

SEQ ID NO: 1155393 - protein, 7 aa, Mycobacterium
ASTEQVG

SEQ ID NO: 1155394 - protein, 5 aa, Mycobacterium
ASTGH

SEQ ID NO: 1155395 - protein, 13 aa, Mycobacterium
ASTGLDPFGAEAA

SEQ ID NO: 1155396 - protein, 6 aa, Mycobacterium
ASTGNL

SEQ ID NO: 1155397 - protein, 16 aa, Mycobacterium
ASTLPNDGPRPQGDYD

SEQ ID NO: 1155398 - protein, 13 aa, Mycobacterium
ASTLSETAGYSRP

SEQ ID NO: 1155399 - protein, 10 aa, Mycobacterium
ASTPDQRTLS

SEQ ID NO: 1155400 - protein, 7 aa, Mycobacterium
ASTPERL

SEQ ID NO: 1155401 - protein, 7 aa, Mycobacterium
ASTPQEL

SEQ ID NO: 1155402 - protein, 15 aa, Mycobacterium
ASTPYDGPPPQPADL

SEQ ID NO: 1155403 - protein, 7 aa, Mycobacterium
ASTSSEH

SEQ ID NO: 1155404 - protein, 7 aa, Mycobacterium
ASTSTRH

SEQ ID NO: 1155405 - protein, 18 aa, Mycobacterium
ASTTGEVREASEAFRHRP

SEQ ID NO: 1155406 - protein, 15 aa, Mycobacterium
ASTTSLPETPQGERN

SEQ ID NO: 1155407 - protein, 12 aa, Mycobacterium
ASVDDASAPGGA

SEQ ID NO: 1155408 - protein, 5 aa, Mycobacterium
ASVNR

SEQ ID NO: 1155409 - protein, 7 aa, Mycobacterium
ASVPEGL

SEQ ID NO: 1155410 - protein, 20 aa, Mycobacterium
ASVPPDGWSRSGLRSNGSEF

SEQ ID NO: 1155411 - protein, 12 aa, Mycobacterium
ASVSGSSARPTI

SEQ ID NO: 1155412 - protein, 9 aa, Mycobacterium
ASWTDPKGG

SEQ ID NO: 1155413 - protein, 12 aa, Mycobacterium
ASYAPRAGGRAA

SEQ ID NO: 1155414 - protein, 7 aa, Mycobacterium
ASYEPKW

SEQ ID NO: 1155415 - protein, 6 aa, Mycobacterium
ASYGSG

SEQ ID NO: 1155416 - protein, 9 aa, Mycobacterium
ASYPGAARR

SEQ ID NO: 1155417 - protein, 27 aa, Mycobacterium
ASYRHGDSVASISSARSVSELREAGGP

SEQ ID NO: 1155418 - protein, 8 aa, Mycobacterium
ATAAAGSG

SEQ ID NO: 1155419 - protein, 8 aa, Mycobacterium
ATAADEAA

SEQ ID NO: 1155420 - protein, 14 aa, Mycobacterium
ATAAEARAAALAAL

SEQ ID NO: 1155421 - protein, 7 aa, Mycobacterium
ATAAGRR

SEQ ID NO: 1155422 - protein, 19 aa, Mycobacterium
ATAAGSSVARTRYATAGSD

SEQ ID NO: 1155423 - protein, 8 aa, Mycobacterium
ATAAGTTV

SEQ ID NO: 1155424 - protein, 5 aa, Mycobacterium
ATAAI

SEQ ID NO: 1155425 - protein, 11 aa, Mycobacterium
ATADAGPPVDE

SEQ ID NO: 1155426 - protein, 9 aa, Mycobacterium
ATADPDSVE

SEQ ID NO: 1155427 - protein, 7 aa, Mycobacterium
ATADTAQ

SEQ ID NO: 1155428 - protein, 5 aa, Mycobacterium
ATAEA

SEQ ID NO: 1155429 - protein, 7 aa, Mycobacterium
ATAELDG

SEQ ID NO: 1155430 - protein, 7 aa, Mycobacterium
ATAELSQ

SEQ ID NO: 1155431 - protein, 9 aa, Mycobacterium
ATAETGSHP

SEQ ID NO: 1155432 - protein, 5 aa, Mycobacterium
ATAGA

SEQ ID NO: 1155433 - protein, 18 aa, Mycobacterium
ATAGAARAEPARLGDPEP

SEQ ID NO: 1155434 - protein, 6 aa, Mycobacterium
ATAGEV

SEQ ID NO: 1155435 - protein, 7 aa, Mycobacterium
ATAGGKK

SEQ ID NO: 1155436 - protein, 22 aa, Mycobacterium
ATAGKLAGSGDPDQPEQVDPEV

SEQ ID NO: 1155437 - protein, 9 aa, Mycobacterium
ATAGPMPPG

SEQ ID NO: 1155438 - protein, 16 aa, Mycobacterium
ATAGSKSRYRGDDRMR

SEQ ID NO: 1155439 - protein, 16 aa, Mycobacterium
ATAGSVRIGGTTVGRR

SEQ ID NO: 1155440 - protein, 11 aa, Mycobacterium
ATAGTATDTEV

SEQ ID NO: 1155441 - protein, 18 aa, Mycobacterium
ATAHQRSLRPHPRQPDLA

SEQ ID NO: 1155442 - protein, 9 aa, Mycobacterium
ATAHSGGGI

SEQ ID NO: 1155443 - protein, 5 aa, Mycobacterium
ATAKA

SEQ ID NO: 1155444 - protein, 14 aa, Mycobacterium
ATALTTDADGIVNG

SEQ ID NO: 1155445 - protein, 8 aa, Mycobacterium
ATANGKRA

SEQ ID NO: 1155446 - protein, 17 aa, Mycobacterium
ATAPARHPQVGTRTPVL

SEQ ID NO: 1155447 - protein, 9 aa, Mycobacterium
ATAPASTWR

SEQ ID NO: 1155448 - protein, 8 aa, Mycobacterium
ATAPGALT

SEQ ID NO: 1155449 - protein, 8 aa, Mycobacterium
ATAPGGLT

SEQ ID NO: 1155450 - protein, 6 aa, Mycobacterium
ATAPLG

SEQ ID NO: 1155451 - protein, 5 aa, Mycobacterium
ATAPR

SEQ ID NO: 1155452 - protein, 12 aa, Mycobacterium
ATAPSATAYGRT

SEQ ID NO: 1155453 - protein, 8 aa, Mycobacterium
ATAPSRGR

SEQ ID NO: 1155454 - protein, 10 aa, Mycobacterium
ATAPSTAETD

SEQ ID NO: 1155455 - protein, 7 aa, Mycobacterium
ATAPTRK

SEQ ID NO: 1155456 - protein, 14 aa, Mycobacterium
ATAPVTADTARPTL

SEQ ID NO: 1155457 - protein, 6 aa, Mycobacterium
ATAQDT

SEQ ID NO: 1155458 - protein, 6 aa, Mycobacterium
ATARAA

SEQ ID NO: 1155459 - protein, 8 aa, Mycobacterium
ATAREAGN

SEQ ID NO: 1155460 - protein, 16 aa, Mycobacterium
ATAREPQVAGKPQPTL

SEQ ID NO: 1155461 - protein, 11 aa, Mycobacterium
ATASATNVTLS

SEQ ID NO: 1155462 - protein, 12 aa, Mycobacterium
ATASPLPGPSGN

SEQ ID NO: 1155463 - protein, 28 aa, Mycobacterium
ATASPTAAGAAPGTPEADIQTEPTAPQN

SEQ ID NO: 1155464 - protein, 9 aa, Mycobacterium
ATASREAEL

SEQ ID NO: 1155465 - protein, 6 aa, Mycobacterium
ATATPQ

SEQ ID NO: 1155466 - protein, 24 aa, Mycobacterium
ATATTQSLANSGRDPDAEDTHGRA

SEQ ID NO: 1155467 - protein, 13 aa, Mycobacterium
ATATTRPQGSWSR

SEQ ID NO: 1155468 - protein, 21 aa, Mycobacterium
ATATVSSIDQDAGRTIQGDSG

SEQ ID NO: 1155469 - protein, 23 aa, Mycobacterium
ATAVRPRRPPPPRPRPHPRPRRR

SEQ ID NO: 1155470 - protein, 9 aa, Mycobacterium
ATDAALSET

SEQ ID NO: 1155471 - protein, 9 aa, Mycobacterium
ATDADFSVG

SEQ ID NO: 1155472 - protein, 9 aa, Mycobacterium
ATDAETLSG

SEQ ID NO: 1155473 - protein, 9 aa, Mycobacterium
ATDAGRRHP

SEQ ID NO: 1155474 - protein, 5 aa, Mycobacterium
ATDAL

SEQ ID NO: 1155475 - protein, 15 aa, Mycobacterium
ATDDDGFTLSEADKI

SEQ ID NO: 1155476 - protein, 6 aa, Mycobacterium
ATDDGK

SEQ ID NO: 1155477 - protein, 5 aa, Mycobacterium
ATDDR

SEQ ID NO: 1155478 - protein, 5 aa, Mycobacterium
ATDDW

SEQ ID NO: 1155479 - protein, 13 aa, Mycobacterium
ATDEQHPDAQGRI

SEQ ID NO: 1155480 - protein, 8 aa, Mycobacterium
ATDGADGI

SEQ ID NO: 1155481 - protein, 6 aa, Mycobacterium
ATDGFG

SEQ ID NO: 1155482 - protein, 6 aa, Mycobacterium
ATDGRG

SEQ ID NO: 1155483 - protein, 10 aa, Mycobacterium
ATDGTPDSDG

SEQ ID NO: 1155484 - protein, 13 aa, Mycobacterium
ATDHRRDVPAEGR

SEQ ID NO: 1155485 - protein, 9 aa, Mycobacterium
ATDKSGREA

SEQ ID NO: 1155486 - protein, 5 aa, Mycobacterium
ATDLA

SEQ ID NO: 1155487 - protein, 6 aa, Mycobacterium
ATDNPI

SEQ ID NO: 1155488 - protein, 7 aa, Mycobacterium
ATDPADF

SEQ ID NO: 1155489 - protein, 7 aa, Mycobacterium
ATDPARV

SEQ ID NO: 1155490 - protein, 6 aa, Mycobacterium
ATDPAV

SEQ ID NO: 1155491 - protein, 8 aa, Mycobacterium
ATDPEEIE

SEQ ID NO: 1155492 - protein, 15 aa, Mycobacterium
ATDPSPAAQVRASAT

SEQ ID NO: 1155493 - protein, 12 aa, Mycobacterium
ATDRAVRGDSRE

SEQ ID NO: 1155494 - protein, 5 aa, Mycobacterium
ATDRP

SEQ ID NO: 1155495 - protein, 6 aa, Mycobacterium
ATDSDF

SEQ ID NO: 1155496 - protein, 9 aa, Mycobacterium
ATDTEREEI

SEQ ID NO: 1155497 - protein, 9 aa, Mycobacterium
ATDTINARS

SEQ ID NO: 1155498 - protein, 15 aa, Mycobacterium
ATDTRPDELKAQGVR

SEQ ID NO: 1155499 - protein, 9 aa, Mycobacterium
ATEAEAAQP

SEQ ID NO: 1155500 - protein, 11 aa, Mycobacterium
ATEAKPRGPSE

SEQ ID NO: 1155501 - protein, 10 aa, Mycobacterium
ATEATSGDNW

SEQ ID NO: 1155502 - protein, 5 aa, Mycobacterium
ATEDE

SEQ ID NO: 1155503 - protein, 15 aa, Mycobacterium
ATEDGAGLSERELQA

SEQ ID NO: 1155504 - protein, 10 aa, Mycobacterium
ATEDQKEGMA

SEQ ID NO: 1155505 - protein, 7 aa, Mycobacterium
ATEEVGK

SEQ ID NO: 1155506 - protein, 11 aa, Mycobacterium
ATEKNQGRSLA

SEQ ID NO: 1155507 - protein, 5 aa, Mycobacterium
ATEPG

SEQ ID NO: 1155508 - protein, 7 aa, Mycobacterium
ATEPTTT

SEQ ID NO: 1155509 - protein, 7 aa, Mycobacterium
ATERSIE

SEQ ID NO: 1155510 - protein, 21 aa, Mycobacterium
ATETRKATEAAGGTHDPHPAE

SEQ ID NO: 1155511 - protein, 6 aa, Mycobacterium
ATETRY

SEQ ID NO: 1155512 - protein, 10 aa, Mycobacterium
ATETTPGGRT

SEQ ID NO: 1155513 - protein, 7 aa, Mycobacterium
ATEVSER

SEQ ID NO: 1155514 - protein, 4 aa, Mycobacterium
ATFD

SEQ ID NO: 1155515 - protein, 8 aa, Mycobacterium
ATFDGPAR

SEQ ID NO: 1155516 - protein, 4 aa, Mycobacterium
ATFG

SEQ ID NO: 1155517 - protein, 4 aa, Mycobacterium
ATFP

SEQ ID NO: 1155518 - protein, 12 aa, Mycobacterium
ATFTDEAAKSAA

SEQ ID NO: 1155519 - protein, 14 aa, Mycobacterium
ATFTPSKPLGPGLD

SEQ ID NO: 1155520 - protein, 31 aa, Mycobacterium
ATGAAGAGESERAPVEENRDGGPDAPTPTQQ

SEQ ID NO: 1155521 - protein, 8 aa, Mycobacterium
ATGAERAE

SEQ ID NO: 1155522 - protein, 5 aa, Mycobacterium
ATGAG

SEQ ID NO: 1155523 - protein, 11 aa, Mycobacterium
ATGALRPDLTA

SEQ ID NO: 1155524 - protein, 9 aa, Mycobacterium
ATGAQGGGM

SEQ ID NO: 1155525 - protein, 21 aa, Mycobacterium
ATGDATAASANRIAKDAGATW

SEQ ID NO: 1155526 - protein, 8 aa, Mycobacterium
ATGDDIAA

SEQ ID NO: 1155527 - protein, 6 aa, Mycobacterium
ATGDER

SEQ ID NO: 1155528 - protein, 10 aa, Mycobacterium
ATGDKTSYLA

SEQ ID NO: 1155529 - protein, 10 aa, Mycobacterium
ATGDKTTMPS

SEQ ID NO: 1155530 - protein, 6 aa, Mycobacterium
ATGDVE

SEQ ID NO: 1155531 - protein, 5 aa, Mycobacterium
ATGES

SEQ ID NO: 1155532 - protein, 6 aa, Mycobacterium
ATGEVV

SEQ ID NO: 1155533 - protein, 7 aa, Mycobacterium
ATGFGTH

SEQ ID NO: 1155534 - protein, 4 aa, Mycobacterium
ATGG

SEQ ID NO: 1155535 - protein, 7 aa, Mycobacterium
ATGGAES

SEQ ID NO: 1155536 - protein, 8 aa, Mycobacterium
ATGGGGGI

SEQ ID NO: 1155537 - protein, 8 aa, Mycobacterium
ATGGGTME

SEQ ID NO: 1155538 - protein, 11 aa, Mycobacterium
ATGGVDGSYPE

SEQ ID NO: 1155539 - protein, 5 aa, Mycobacterium
ATGGY

SEQ ID NO: 1155540 - protein, 11 aa, Mycobacterium
ATGHGATGVGA

SEQ ID NO: 1155541 - protein, 5 aa, Mycobacterium
ATGKP

SEQ ID NO: 1155542 - protein, 20 aa, Mycobacterium
ATGKSAGPSYDGLSSTPPAV

SEQ ID NO: 1155543 - protein, 7 aa, Mycobacterium
ATGMPAS

SEQ ID NO: 1155544 - protein, 12 aa, Mycobacterium
ATGNDADSDRHG

SEQ ID NO: 1155545 - protein, 10 aa, Mycobacterium
ATGPERDEAF

SEQ ID NO: 1155546 - protein, 7 aa, Mycobacterium
ATGPFGE

SEQ ID NO: 1155547 - protein, 6 aa, Mycobacterium
ATGPGM

SEQ ID NO: 1155548 - protein, 7 aa, Mycobacterium
ATGPKAI

SEQ ID NO: 1155549 - protein, 7 aa, Mycobacterium
ATGPLTG

SEQ ID NO: 1155550 - protein, 11 aa, Mycobacterium
ATGQDHDDLPD

SEQ ID NO: 1155551 - protein, 5 aa, Mycobacterium
ATGQF

SEQ ID NO: 1155552 - protein, 12 aa, Mycobacterium
ATGQNADNIDEQ

SEQ ID NO: 1155553 - protein, 11 aa, Mycobacterium
ATGQSDNERVR

SEQ ID NO: 1155554 - protein, 7 aa, Mycobacterium
ATGQSRE

SEQ ID NO: 1155555 - protein, 7 aa, Mycobacterium
ATGRGTR

SEQ ID NO: 1155556 - protein, 5 aa, Mycobacterium
ATGRH

SEQ ID NO: 1155557 - protein, 8 aa, Mycobacterium
ATGRPRVD

SEQ ID NO: 1155558 - protein, 7 aa, Mycobacterium
ATGRTRD

SEQ ID NO: 1155559 - protein, 5 aa, Mycobacterium
ATGSA

SEQ ID NO: 1155560 - protein, 12 aa, Mycobacterium
ATGSAITQQSVA

SEQ ID NO: 1155561 - protein, 6 aa, Mycobacterium
ATGTAF

SEQ ID NO: 1155562 - protein, 7 aa, Mycobacterium
ATGTAGL

SEQ ID NO: 1155563 - protein, 7 aa, Mycobacterium
ATGTCPD

SEQ ID NO: 1155564 - protein, 7 aa, Mycobacterium
ATGTPAE

SEQ ID NO: 1155565 - protein, 9 aa, Mycobacterium
ATGTRRVPG

SEQ ID NO: 1155566 - protein, 23 aa, Mycobacterium
ATGTVAPQADSLTPAAEPEGGDA

SEQ ID NO: 1155567 - protein, 7 aa, Mycobacterium
ATGVRRG

SEQ ID NO: 1155568 - protein, 10 aa, Mycobacterium
ATGWDGPGLG

SEQ ID NO: 1155569 - protein, 19 aa, Mycobacterium
ATGYKQSLGADGPPGSYTD

SEQ ID NO: 1155570 - protein, 4 aa, Mycobacterium
ATHA

SEQ ID NO: 1155571 - protein, 5 aa, Mycobacterium
ATHER

SEQ ID NO: 1155572 - protein, 12 aa, Mycobacterium
ATHKKRKRAVSF

SEQ ID NO: 1155573 - protein, 4 aa, Mycobacterium
ATHR

SEQ ID NO: 1155574 - protein, 7 aa, Mycobacterium
ATHSPRD

SEQ ID NO: 1155575 - protein, 9 aa, Mycobacterium
ATIAGPDQL

SEQ ID NO: 1155576 - protein, 5 aa, Mycobacterium
ATIEG

SEQ ID NO: 1155577 - protein, 8 aa, Mycobacterium
ATINSGNV

SEQ ID NO: 1155578 - protein, 4 aa, Mycobacterium
ATIP

SEQ ID NO: 1155579 - protein, 7 aa, Mycobacterium
ATIPPDN

SEQ ID NO: 1155580 - protein, 6 aa, Mycobacterium
ATIPPT

SEQ ID NO: 1155581 - protein, 5 aa, Mycobacterium
ATKAL

SEQ ID NO: 1155582 - protein, 8 aa, Mycobacterium
ATKAQYEE

SEQ ID NO: 1155583 - protein, 8 aa, Mycobacterium
ATKEQDVQ

SEQ ID NO: 1155584 - protein, 4 aa, Mycobacterium
ATKG

SEQ ID NO: 1155585 - protein, 19 aa, Mycobacterium
ATKGQADAARVRELVLAAC

SEQ ID NO: 1155586 - protein, 4 aa, Mycobacterium
ATKL

SEQ ID NO: 1155587 - protein, 8 aa, Mycobacterium
ATKPAPEI

SEQ ID NO: 1155588 - protein, 6 aa, Mycobacterium
ATKRGA

SEQ ID NO: 1155589 - protein, 6 aa, Mycobacterium
ATKRRV

SEQ ID NO: 1155590 - protein, 7 aa, Mycobacterium
ATKTPSQ

SEQ ID NO: 1155591 - protein, 4 aa, Mycobacterium
ATLA

SEQ ID NO: 1155592 - protein, 16 aa, Mycobacterium
ATLGEGDPRVTGNPGA

SEQ ID NO: 1155593 - protein, 5 aa, Mycobacterium
ATLGG

SEQ ID NO: 1155594 - protein, 17 aa, Mycobacterium
ATLPGDRRLDGTATDID

SEQ ID NO: 1155595 - protein, 5 aa, Mycobacterium
ATLRE

SEQ ID NO: 1155596 - protein, 4 aa, Mycobacterium
ATLT

SEQ ID NO: 1155597 - protein, 13 aa, Mycobacterium
ATLTGEHLADYVG

SEQ ID NO: 1155598 - protein, 9 aa, Mycobacterium
ATNAATDTV

SEQ ID NO: 1155599 - protein, 10 aa, Mycobacterium
ATNAEGANMD

SEQ ID NO: 1155600 - protein, 9 aa, Mycobacterium
ATNPANGQQ

SEQ ID NO: 1155601 - protein, 21 aa, Mycobacterium
ATPADLRAAPDTAGTPADGTE

SEQ ID NO: 1155602 - protein, 7 aa, Mycobacterium
ATPAGGQ

SEQ ID NO: 1155603 - protein, 10 aa, Mycobacterium
ATPANNHESS

SEQ ID NO: 1155604 - protein, 22 aa, Mycobacterium
ATPAPRGHVPQMSDKKQGEASA

SEQ ID NO: 1155605 - protein, 6 aa, Mycobacterium
ATPARP

SEQ ID NO: 1155606 - protein, 14 aa, Mycobacterium
ATPASGDASTIGEQ

SEQ ID NO: 1155607 - protein, 7 aa, Mycobacterium
ATPASIP

SEQ ID NO: 1155608 - protein, 7 aa, Mycobacterium
ATPATAV

SEQ ID NO: 1155609 - protein, 15 aa, Mycobacterium
ATPDELAPIVEEYRA

SEQ ID NO: 1155610 - protein, 8 aa, Mycobacterium
ATPDGGDA

SEQ ID NO: 1155611 - protein, 5 aa, Mycobacterium
ATPEA

SEQ ID NO: 1155612 - protein, 7 aa, Mycobacterium
ATPEEAA

SEQ ID NO: 1155613 - protein, 5 aa, Mycobacterium
ATPEW

SEQ ID NO: 1155614 - protein, 6 aa, Mycobacterium
ATPGEF

SEQ ID NO: 1155615 - protein, 6 aa, Mycobacterium
ATPGGA

SEQ ID NO: 1155616 - protein, 7 aa, Mycobacterium
ATPGGAD

SEQ ID NO: 1155617 - protein, 6 aa, Mycobacterium
ATPGNE

SEQ ID NO: 1155618 - protein, 6 aa, Mycobacterium
ATPGPH

SEQ ID NO: 1155619 - protein, 14 aa, Mycobacterium
ATPGPYEMSQSGGE

SEQ ID NO: 1155620 - protein, 6 aa, Mycobacterium
ATPGVD

SEQ ID NO: 1155621 - protein, 20 aa, Mycobacterium
ATPHPDSAAPITGATEPCES

SEQ ID NO: 1155622 - protein, 6 aa, Mycobacterium
ATPLDP

SEQ ID NO: 1155623 - protein, 14 aa, Mycobacterium
ATPLGAGGDAGEAI

SEQ ID NO: 1155624 - protein, 6 aa, Mycobacterium
ATPLGG

SEQ ID NO: 1155625 - protein, 7 aa, Mycobacterium
ATPMGTG

SEQ ID NO: 1155626 - protein, 5 aa, Mycobacterium
ATPPF

SEQ ID NO: 1155627 - protein, 8 aa, Mycobacterium
ATPPNADD

SEQ ID NO: 1155628 - protein, 7 aa, Mycobacterium
ATPPPAG

SEQ ID NO: 1155629 - protein, 7 aa, Mycobacterium
ATPRLTQ

SEQ ID NO: 1155630 - protein, 5 aa, Mycobacterium
ATPRQ

SEQ ID NO: 1155631 - protein, 7 aa, Mycobacterium
ATPSARG

SEQ ID NO: 1155632 - protein, 15 aa, Mycobacterium
ATPSPEDDDPPPSPV

SEQ ID NO: 1155633 - protein, 8 aa, Mycobacterium
ATPSRNAQ

SEQ ID NO: 1155634 - protein, 8 aa, Mycobacterium
ATPSTPGR

SEQ ID NO: 1155635 - protein, 10 aa, Mycobacterium
ATPTDDSATL

SEQ ID NO: 1155636 - protein, 7 aa, Mycobacterium
ATPTTRA

SEQ ID NO: 1155637 - protein, 12 aa, Mycobacterium
ATPVDDKSGIAQ

SEQ ID NO: 1155638 - protein, 6 aa, Mycobacterium
ATPVDY

SEQ ID NO: 1155639 - protein, 14 aa, Mycobacterium
ATPVGPGPDGRPRT

SEQ ID NO: 1155640 - protein, 26 aa, Mycobacterium
ATQAEQAAGGGAGGADGSSSSSDDDV

SEQ ID NO: 1155641 - protein, 6 aa, Mycobacterium
ATQDVT

SEQ ID NO: 1155642 - protein, 7 aa, Mycobacterium
ATQNSGR

SEQ ID NO: 1155643 - protein, 7 aa, Mycobacterium
ATQRDAQ

SEQ ID NO: 1155644 - protein, 6 aa, Mycobacterium
ATQWEK

SEQ ID NO: 1155645 - protein, 6 aa, Mycobacterium
ATRAEA

SEQ ID NO: 1155646 - protein, 6 aa, Mycobacterium
ATRAHG

SEQ ID NO: 1155647 - protein, 6 aa, Mycobacterium
ATRDAI

SEQ ID NO: 1155648 - protein, 7 aa, Mycobacterium
ATREATA

SEQ ID NO: 1155649 - protein, 5 aa, Mycobacterium
ATRGA

SEQ ID NO: 1155650 - protein, 7 aa, Mycobacterium
ATRGAEM

SEQ ID NO: 1155651 - protein, 11 aa, Mycobacterium
ATRKELADQRD

SEQ ID NO: 1155652 - protein, 4 aa, Mycobacterium
ATRL

SEQ ID NO: 1155653 - protein, 5 aa, Mycobacterium
ATRLG

SEQ ID NO: 1155654 - protein, 10 aa, Mycobacterium
ATRNDFGVEP

SEQ ID NO: 1155655 - protein, 6 aa, Mycobacterium
ATRPAI

SEQ ID NO: 1155656 - protein, 6 aa, Mycobacterium
ATRPES

SEQ ID NO: 1155657 - protein, 10 aa, Mycobacterium
ATRQPDGGWG

SEQ ID NO: 1155658 - protein, 16 aa, Mycobacterium
ATRRSSEFAAAPPQGL

SEQ ID NO: 1155659 - protein, 19 aa, Mycobacterium
ATRSELTRRAGRHGLTGLY

SEQ ID NO: 1155660 - protein, 5 aa, Mycobacterium
ATRTR

SEQ ID NO: 1155661 - protein, 5 aa, Mycobacterium
ATRVG

SEQ ID NO: 1155662 - protein, 8 aa, Mycobacterium
ATSAASTI

SEQ ID NO: 1155663 - protein, 10 aa, Mycobacterium
ATSACTPTAM

SEQ ID NO: 1155664 - protein, 9 aa, Mycobacterium
ATSADGTKI

SEQ ID NO: 1155665 - protein, 17 aa, Mycobacterium
ATSAKGSTDEDPGPDLA

SEQ ID NO: 1155666 - protein, 20 aa, Mycobacterium
ATSAPGYSSIRPKDKAPISE

SEQ ID NO: 1155667 - protein, 5 aa, Mycobacterium
ATSAR

SEQ ID NO: 1155668 - protein, 7 aa, Mycobacterium
ATSASSW

SEQ ID NO: 1155669 - protein, 9 aa, Mycobacterium
ATSAVPDGD

SEQ ID NO: 1155670 - protein, 5 aa, Mycobacterium
ATSDA

SEQ ID NO: 1155671 - protein, 7 aa, Mycobacterium
ATSDAEF

SEQ ID NO: 1155672 - protein, 7 aa, Mycobacterium
ATSDDAI

SEQ ID NO: 1155673 - protein, 8 aa, Mycobacterium
ATSDPDGV

SEQ ID NO: 1155674 - protein, 15 aa, Mycobacterium
ATSHRSGNRGSIEGP

SEQ ID NO: 1155675 - protein, 8 aa, Mycobacterium
ATSNSEAH

SEQ ID NO: 1155676 - protein, 13 aa, Mycobacterium
ATSNTLPEQLGEG

SEQ ID NO: 1155677 - protein, 5 aa, Mycobacterium
ATSPM

SEQ ID NO: 1155678 - protein, 5 aa, Mycobacterium
ATSPP

SEQ ID NO: 1155679 - protein, 9 aa, Mycobacterium
ATSQDDDTL

SEQ ID NO: 1155680 - protein, 8 aa, Mycobacterium
ATSQGGHH

SEQ ID NO: 1155681 - protein, 19 aa, Mycobacterium
ATSRDTVRSAGRTGKPARQ

SEQ ID NO: 1155682 - protein, 9 aa, Mycobacterium
ATSRKNQAR

SEQ ID NO: 1155683 - protein, 8 aa, Mycobacterium
ATSSDTVR

SEQ ID NO: 1155684 - protein, 7 aa, Mycobacterium
ATSSERV

SEQ ID NO: 1155685 - protein, 6 aa, Mycobacterium
ATSSGC

SEQ ID NO: 1155686 - protein, 12 aa, Mycobacterium
ATSSVAADCEDD

SEQ ID NO: 1155687 - protein, 6 aa, Mycobacterium
ATSTEQ

SEQ ID NO: 1155688 - protein, 5 aa, Mycobacterium
ATSTP

SEQ ID NO: 1155689 - protein, 8 aa, Mycobacterium
ATSTPAAA

SEQ ID NO: 1155690 - protein, 4 aa, Mycobacterium
ATTA

SEQ ID NO: 1155691 - protein, 6 aa, Mycobacterium
ATTAKS

SEQ ID NO: 1155692 - protein, 7 aa, Mycobacterium
ATTAPSM

SEQ ID NO: 1155693 - protein, 42 aa, Mycobacterium
ATTATGTTGTTTAATGATATGAGTGTARTSRGGTRTGTGRTR

SEQ ID NO: 1155694 - protein, 6 aa, Mycobacterium
ATTDAD

SEQ ID NO: 1155695 - protein, 7 aa, Mycobacterium
ATTDHDS

SEQ ID NO: 1155696 - protein, 20 aa, Mycobacterium
ATTDMGTAREYGPNGLQAPR

SEQ ID NO: 1155697 - protein, 10 aa, Mycobacterium
ATTEAEESAR

SEQ ID NO: 1155698 - protein, 8 aa, Mycobacterium
ATTGATDH

SEQ ID NO: 1155699 - protein, 5 aa, Mycobacterium
ATTGP

SEQ ID NO: 1155700 - protein, 6 aa, Mycobacterium
ATTGWA

SEQ ID NO: 1155701 - protein, 8 aa, Mycobacterium
ATTIAKEN

SEQ ID NO: 1155702 - protein, 10 aa, Mycobacterium
ATTIYGGTSE

SEQ ID NO: 1155703 - protein, 6 aa, Mycobacterium
ATTNQQ

SEQ ID NO: 1155704 - protein, 6 aa, Mycobacterium
ATTPIT

SEQ ID NO: 1155705 - protein, 7 aa, Mycobacterium
ATTPREA

SEQ ID NO: 1155706 - protein, 4 aa, Mycobacterium
ATTR

SEQ ID NO: 1155707 - protein, 12 aa, Mycobacterium
ATTRAPRPGEVD

SEQ ID NO: 1155708 - protein, 9 aa, Mycobacterium
ATTSADPPV

SEQ ID NO: 1155709 - protein, 7 aa, Mycobacterium
ATTSPAV

SEQ ID NO: 1155710 - protein, 5 aa, Mycobacterium
ATTSR

SEQ ID NO: 1155711 - protein, 8 aa, Mycobacterium
ATTSRAHT

SEQ ID NO: 1155712 - protein, 31 aa, Mycobacterium
ATTSRRNTGESANDTKALDAGSWGKSGGGYW

SEQ ID NO: 1155713 - protein, 18 aa, Mycobacterium
ATTTQAAAAAAPPRAQSR

SEQ ID NO: 1155714 - protein, 6 aa, Mycobacterium
ATTTRR

SEQ ID NO: 1155715 - protein, 14 aa, Mycobacterium
ATTTVYPTTNAADT

SEQ ID NO: 1155716 - protein, 5 aa, Mycobacterium
ATTTW

SEQ ID NO: 1155717 - protein, 4 aa, Mycobacterium
ATTV

SEQ ID NO: 1155718 - protein, 5 aa, Mycobacterium
ATVAQ

SEQ ID NO: 1155719 - protein, 13 aa, Mycobacterium
ATVASGDRAERPG

SEQ ID NO: 1155720 - protein, 9 aa, Mycobacterium
ATVATDELT

SEQ ID NO: 1155721 - protein, 9 aa, Mycobacterium
ATVDPDNNR

SEQ ID NO: 1155722 - protein, 18 aa, Mycobacterium
ATVGDGGKVTAASVPDGA

SEQ ID NO: 1155723 - protein, 7 aa, Mycobacterium
ATVGNGR

SEQ ID NO: 1155724 - protein, 5 aa, Mycobacterium
ATVPL

SEQ ID NO: 1155725 - protein, 13 aa, Mycobacterium
ATVPPSKARGRGI

SEQ ID NO: 1155726 - protein, 28 aa, Mycobacterium
ATVSERGETRADDRTSVAAMEDRKREGY

SEQ ID NO: 1155727 - protein, 4 aa, Mycobacterium
ATVT

SEQ ID NO: 1155728 - protein, 24 aa, Mycobacterium
ATVTGSEDAAAQQQPPQAPADASN

SEQ ID NO: 1155729 - protein, 4 aa, Mycobacterium
ATWT

SEQ ID NO: 1155730 - protein, 18 aa, Mycobacterium
ATYAPAPQRFEAGTPMTS

SEQ ID NO: 1155731 - protein, 13 aa, Mycobacterium
ATYGDTAPARGPL

SEQ ID NO: 1155732 - protein, 18 aa, Mycobacterium
ATYGPALPEGAPDDGVER

SEQ ID NO: 1155733 - protein, 7 aa, Mycobacterium
ATYNNTP

SEQ ID NO: 1155734 - protein, 11 aa, Mycobacterium
ATYPDGSVPDV

SEQ ID NO: 1155735 - protein, 9 aa, Mycobacterium
ATYPNGPAT

SEQ ID NO: 1155736 - protein, 8 aa, Mycobacterium
AVAAQKNG

SEQ ID NO: 1155737 - protein, 14 aa, Mycobacterium
AVAARTAGDSAFDR

SEQ ID NO: 1155738 - protein, 4 aa, Mycobacterium
AVAD

SEQ ID NO: 1155739 - protein, 8 aa, Mycobacterium
AVADRGDR

SEQ ID NO: 1155740 - protein, 8 aa, Mycobacterium
AVAEGVPG

SEQ ID NO: 1155741 - protein, 13 aa, Mycobacterium
AVAESASPPDRAD

SEQ ID NO: 1155742 - protein, 8 aa, Mycobacterium
AVAESGRQ

SEQ ID NO: 1155743 - protein, 5 aa, Mycobacterium
AVAGA

SEQ ID NO: 1155744 - protein, 8 aa, Mycobacterium
AVAGSEAL

SEQ ID NO: 1155745 - protein, 9 aa, Mycobacterium
AVAGTDDAV

SEQ ID NO: 1155746 - protein, 17 aa, Mycobacterium
AVANGDAAKATEYNNAA

SEQ ID NO: 1155747 - protein, 22 aa, Mycobacterium
AVAPAPSVAEPQLDAQPVSHPV

SEQ ID NO: 1155748 - protein, 8 aa, Mycobacterium
AVAPDLPG

SEQ ID NO: 1155749 - protein, 7 aa, Mycobacterium
AVAPKDK

SEQ ID NO: 1155750 - protein, 8 aa, Mycobacterium
AVAQDGRT

SEQ ID NO: 1155751 - protein, 7 aa, Mycobacterium
AVAREDS

SEQ ID NO: 1155752 - protein, 10 aa, Mycobacterium
AVASQSEISA

SEQ ID NO: 1155753 - protein, 12 aa, Mycobacterium
AVATPAAPTVEP

SEQ ID NO: 1155754 - protein, 5 aa, Mycobacterium
AVDAE

SEQ ID NO: 1155755 - protein, 6 aa, Mycobacterium
AVDDPT

SEQ ID NO: 1155756 - protein, 11 aa, Mycobacterium
AVDGDKKAHSV

SEQ ID NO: 1155757 - protein, 6 aa, Mycobacterium
AVDNGE

SEQ ID NO: 1155758 - protein, 6 aa, Mycobacterium
AVDPGA

SEQ ID NO: 1155759 - protein, 11 aa, Mycobacterium
AVDPGDDAATH

SEQ ID NO: 1155760 - protein, 9 aa, Mycobacterium
AVDPGDRQR

SEQ ID NO: 1155761 - protein, 11 aa, Mycobacterium
AVDPGVTDDER

SEQ ID NO: 1155762 - protein, 10 aa, Mycobacterium
AVEATGRPVK

SEQ ID NO: 1155763 - protein, 17 aa, Mycobacterium
AVEDQRDADLEARAQKL

SEQ ID NO: 1155764 - protein, 15 aa, Mycobacterium
AVEEGDAADHTPPED

SEQ ID NO: 1155765 - protein, 14 aa, Mycobacterium
AVEGARQSRSAKQQ

SEQ ID NO: 1155766 - protein, 11 aa, Mycobacterium
AVEGKPPREVP

SEQ ID NO: 1155767 - protein, 9 aa, Mycobacterium
AVEPPGDAR

SEQ ID NO: 1155768 - protein, 10 aa, Mycobacterium
AVEPPPGARE

SEQ ID NO: 1155769 - protein, 8 aa, Mycobacterium
AVEQDPEA

SEQ ID NO: 1155770 - protein, 39 aa, Mycobacterium
AVESTDVDGRWGPSGGWQRSVPRGATRRRARGDGTAQAG

SEQ ID NO: 1155771 - protein, 14 aa, Mycobacterium
AVFGPQKGATPADV

SEQ ID NO: 1155772 - protein, 7 aa, Mycobacterium
AVGDSES

SEQ ID NO: 1155773 - protein, 6 aa, Mycobacterium
AVGGAA

SEQ ID NO: 1155774 - protein, 18 aa, Mycobacterium
AVGGADPDDWPAAGAVGR

SEQ ID NO: 1155775 - protein, 22 aa, Mycobacterium
AVGGGSEFASGIGPEGVSDQPV

SEQ ID NO: 1155776 - protein, 6 aa, Mycobacterium
AVGLPT

SEQ ID NO: 1155777 - protein, 6 aa, Mycobacterium
AVGPAG

SEQ ID NO: 1155778 - protein, 7 aa, Mycobacterium
AVGPDAE

SEQ ID NO: 1155779 - protein, 6 aa, Mycobacterium
AVGPDG

SEQ ID NO: 1155780 - protein, 7 aa, Mycobacterium
AVGPGAD

SEQ ID NO: 1155781 - protein, 11 aa, Mycobacterium
AVGPQSGLRSA

SEQ ID NO: 1155782 - protein, 7 aa, Mycobacterium
AVGQTRD

SEQ ID NO: 1155783 - protein, 5 aa, Mycobacterium
AVGSA

SEQ ID NO: 1155784 - protein, 7 aa, Mycobacterium
AVGSGEL

SEQ ID NO: 1155785 - protein, 9 aa, Mycobacterium
AVGTDDGVS

SEQ ID NO: 1155786 - protein, 13 aa, Mycobacterium
AVGTGRVDQSEPM

SEQ ID NO: 1155787 - protein, 13 aa, Mycobacterium
AVGVTTSGTFSPS

SEQ ID NO: 1155788 - protein, 21 aa, Mycobacterium
AVHEDRPDLSVTTEASETPVD

SEQ ID NO: 1155789 - protein, 8 aa, Mycobacterium
AVKASAMR

SEQ ID NO: 1155790 - protein, 5 aa, Mycobacterium
AVLGS

SEQ ID NO: 1155791 - protein, 4 aa, Mycobacterium
AVNA

SEQ ID NO: 1155792 - protein, 6 aa, Mycobacterium
AVNAGA

SEQ ID NO: 1155793 - protein, 7 aa, Mycobacterium
AVNEAGG

SEQ ID NO: 1155794 - protein, 9 aa, Mycobacterium
AVNGGTAQL

SEQ ID NO: 1155795 - protein, 10 aa, Mycobacterium
AVNKPSNSDV

SEQ ID NO: 1155796 - protein, 10 aa, Mycobacterium
AVNPGSVGAA

SEQ ID NO: 1155797 - protein, 20 aa, Mycobacterium
AVNQDGASSGQTVPNGPAQQ

SEQ ID NO: 1155798 - protein, 10 aa, Mycobacterium
AVNRGNAAQA

SEQ ID NO: 1155799 - protein, 7 aa, Mycobacterium
AVPAASD

SEQ ID NO: 1155800 - protein, 6 aa, Mycobacterium
AVPARD

SEQ ID NO: 1155801 - protein, 18 aa, Mycobacterium
AVPDGRSDTVAATTSLPE

SEQ ID NO: 1155802 - protein, 7 aa, Mycobacterium
AVPDPAA

SEQ ID NO: 1155803 - protein, 8 aa, Mycobacterium
AVPERARR

SEQ ID NO: 1155804 - protein, 16 aa, Mycobacterium
AVPGEPESLADDAPPD

SEQ ID NO: 1155805 - protein, 7 aa, Mycobacterium
AVPGRYT

SEQ ID NO: 1155806 - protein, 5 aa, Mycobacterium
AVPGV

SEQ ID NO: 1155807 - protein, 7 aa, Mycobacterium
AVPPEKL

SEQ ID NO: 1155808 - protein, 7 aa, Mycobacterium
AVPPEKV

SEQ ID NO: 1155809 - protein, 9 aa, Mycobacterium
AVPQPADGV

SEQ ID NO: 1155810 - protein, 4 aa, Mycobacterium
AVPR

SEQ ID NO: 1155811 - protein, 6 aa, Mycobacterium
AVPSAD

SEQ ID NO: 1155812 - protein, 8 aa, Mycobacterium
AVPSETGF

SEQ ID NO: 1155813 - protein, 12 aa, Mycobacterium
AVPSGASTGEHE

SEQ ID NO: 1155814 - protein, 11 aa, Mycobacterium
AVPSGGESASV

SEQ ID NO: 1155815 - protein, 4 aa, Mycobacterium
AVQD

SEQ ID NO: 1155816 - protein, 11 aa, Mycobacterium
AVQNAEDPDEG

SEQ ID NO: 1155817 - protein, 10 aa, Mycobacterium
AVQSGGKRLR

SEQ ID NO: 1155818 - protein, 7 aa, Mycobacterium
AVRDDAG

SEQ ID NO: 1155819 - protein, 5 aa, Mycobacterium
AVRDG

SEQ ID NO: 1155820 - protein, 9 aa, Mycobacterium
AVRDKDGIS

SEQ ID NO: 1155821 - protein, 8 aa, Mycobacterium
AVREADGS

SEQ ID NO: 1155822 - protein, 8 aa, Mycobacterium
AVRGGRPG

SEQ ID NO: 1155823 - protein, 4 aa, Mycobacterium
AVRH

SEQ ID NO: 1155824 - protein, 4 aa, Mycobacterium
AVRK

SEQ ID NO: 1155825 - protein, 9 aa, Mycobacterium
AVRPHSTPM

SEQ ID NO: 1155826 - protein, 12 aa, Mycobacterium
AVRPPDGRETAT

SEQ ID NO: 1155827 - protein, 11 aa, Mycobacterium
AVRTADTVTQG

SEQ ID NO: 1155828 - protein, 20 aa, Mycobacterium
AVSAERYDDPPDIAPLPEEE

SEQ ID NO: 1155829 - protein, 7 aa, Mycobacterium
AVSAGEV

SEQ ID NO: 1155830 - protein, 8 aa, Mycobacterium
AVSAPQPD

SEQ ID NO: 1155831 - protein, 16 aa, Mycobacterium
AVSATERAEGLPLPGA

SEQ ID NO: 1155832 - protein, 11 aa, Mycobacterium
AVSGDKLNNKY

SEQ ID NO: 1155833 - protein, 11 aa, Mycobacterium
AVSQSANGAYL

SEQ ID NO: 1155834 - protein, 4 aa, Mycobacterium
AVSR

SEQ ID NO: 1155835 - protein, 7 aa, Mycobacterium
AVSRASY

SEQ ID NO: 1155836 - protein, 10 aa, Mycobacterium
AVSRKPYRTF

SEQ ID NO: 1155837 - protein, 11 aa, Mycobacterium
AVSSAQARLAA

SEQ ID NO: 1155838 - protein, 9 aa, Mycobacterium
AVSSGAAGF

SEQ ID NO: 1155839 - protein, 6 aa, Mycobacterium
AVSSPH

SEQ ID NO: 1155840 - protein, 8 aa, Mycobacterium
AVSSQQEM

SEQ ID NO: 1155841 - protein, 7 aa, Mycobacterium
AVSSTTA

SEQ ID NO: 1155842 - protein, 8 aa, Mycobacterium
AVSTPDGW

SEQ ID NO: 1155843 - protein, 14 aa, Mycobacterium
AVTAQLGGVVHPAG

SEQ ID NO: 1155844 - protein, 8 aa, Mycobacterium
AVTEAPSG

SEQ ID NO: 1155845 - protein, 9 aa, Mycobacterium
AVTGDATDE

SEQ ID NO: 1155846 - protein, 6 aa, Mycobacterium
AVTGGA

SEQ ID NO: 1155847 - protein, 6 aa, Mycobacterium
AVTGGH

SEQ ID NO: 1155848 - protein, 12 aa, Mycobacterium
AVTGSNGSGKST

SEQ ID NO: 1155849 - protein, 4 aa, Mycobacterium
AVTK

SEQ ID NO: 1155850 - protein, 10 aa, Mycobacterium
AVTPARDGTR

SEQ ID NO: 1155851 - protein, 6 aa, Mycobacterium
AVTPGD

SEQ ID NO: 1155852 - protein, 9 aa, Mycobacterium
AVTPQTAAR

SEQ ID NO: 1155853 - protein, 6 aa, Mycobacterium
AVTSET

SEQ ID NO: 1155854 - protein, 11 aa, Mycobacterium
AVYPEPDRFDP

SEQ ID NO: 1155855 - protein, 7 aa, Mycobacterium
AWAPSAQ

SEQ ID NO: 1155856 - protein, 9 aa, Mycobacterium
AWDGPRGDA

SEQ ID NO: 1155857 - protein, 16 aa, Mycobacterium
AWEGGGAVAAAGEAST

SEQ ID NO: 1155858 - protein, 15 aa, Mycobacterium
AWGSPTWHRTRVLEA

SEQ ID NO: 1155859 - protein, 4 aa, Mycobacterium
AWPD

SEQ ID NO: 1155860 - protein, 5 aa, Mycobacterium
AWPGL

SEQ ID NO: 1155861 - protein, 5 aa, Mycobacterium
AWQEG

SEQ ID NO: 1155862 - protein, 5 aa, Mycobacterium
AWRAK

SEQ ID NO: 1155863 - protein, 11 aa, Mycobacterium
AWTGSPATAPA

SEQ ID NO: 1155864 - protein, 7 aa, Mycobacterium
AYAERAR

SEQ ID NO: 1155865 - protein, 21 aa, Mycobacterium
AYAKASSRDTVRSRSFTGKPA

SEQ ID NO: 1155866 - protein, 6 aa, Mycobacterium
AYAPSD

SEQ ID NO: 1155867 - protein, 7 aa, Mycobacterium
AYASGKT

SEQ ID NO: 1155868 - protein, 4 aa, Mycobacterium
AYDA

SEQ ID NO: 1155869 - protein, 7 aa, Mycobacterium
AYDEPAS

SEQ ID NO: 1155870 - protein, 4 aa, Mycobacterium
AYDQ

SEQ ID NO: 1155871 - protein, 6 aa, Mycobacterium
AYDQAE

SEQ ID NO: 1155872 - protein, 5 aa, Mycobacterium
AYEEN

SEQ ID NO: 1155873 - protein, 9 aa, Mycobacterium
AYEGPPGHV

SEQ ID NO: 1155874 - protein, 7 aa, Mycobacterium
AYGDRSL

SEQ ID NO: 1155875 - protein, 14 aa, Mycobacterium
AYGEDAAKEIASAL

SEQ ID NO: 1155876 - protein, 13 aa, Mycobacterium
AYGEDDKATTDTV

SEQ ID NO: 1155877 - protein, 7 aa, Mycobacterium
AYGESPY

SEQ ID NO: 1155878 - protein, 19 aa, Mycobacterium
AYGGTTTWASTEAAYDQLP

SEQ ID NO: 1155879 - protein, 17 aa, Mycobacterium
AYGPKKGADTFAEAQGR

SEQ ID NO: 1155880 - protein, 5 aa, Mycobacterium
AYGPT

SEQ ID NO: 1155881 - protein, 9 aa, Mycobacterium
AYPGYPSSS

SEQ ID NO: 1155882 - protein, 5 aa, Mycobacterium
AYPTR

SEQ ID NO: 1155883 - protein, 15 aa, Mycobacterium
AYQQASTDARRRGAL

SEQ ID NO: 1155884 - protein, 9 aa, Mycobacterium
AYSAPPAVR

SEQ ID NO: 1155885 - protein, 11 aa, Mycobacterium
AYSATKADQAH

SEQ ID NO: 1155886 - protein, 6 aa, Mycobacterium
AYSDGR

SEQ ID NO: 1155887 - protein, 8 aa, Mycobacterium
AYTEPPDI

SEQ ID NO: 1155888 - protein, 11 aa, Mycobacterium
AYTSAEANHTV

SEQ ID NO: 1155889 - protein, 9 aa, Mycobacterium
AYTSQGPSR

SEQ ID NO: 1155890 - protein, 4 aa, Mycobacterium
AYTV

SEQ ID NO: 1155891 - protein, 11 aa, Mycobacterium
CAAAGGDLDTV

SEQ ID NO: 1155892 - protein, 6 aa, Mycobacterium
CAAGDS

SEQ ID NO: 1155893 - protein, 17 aa, Mycobacterium
CAAGQAAVQSAAASIRA

SEQ ID NO: 1155894 - protein, 8 aa, Mycobacterium
CAAPSGEP

SEQ ID NO: 1155895 - protein, 8 aa, Mycobacterium
CADTESPV

SEQ ID NO: 1155896 - protein, 4 aa, Mycobacterium
CAGP

SEQ ID NO: 1155897 - protein, 10 aa, Mycobacterium
CAGSPADPEI

SEQ ID NO: 1155898 - protein, 14 aa, Mycobacterium
CANRDPGHLDSPSF

SEQ ID NO: 1155899 - protein, 8 aa, Mycobacterium
CANVPGSG

SEQ ID NO: 1155900 - protein, 9 aa, Mycobacterium
CASGSEGIA

SEQ ID NO: 1155901 - protein, 6 aa, Mycobacterium
CDETNA

SEQ ID NO: 1155902 - protein, 7 aa, Mycobacterium
CDGTRRA

SEQ ID NO: 1155903 - protein, 5 aa, Mycobacterium
CDNPH

SEQ ID NO: 1155904 - protein, 8 aa, Mycobacterium
CDRPTAAV

SEQ ID NO: 1155905 - protein, 7 aa, Mycobacterium
CDTARSV

SEQ ID NO: 1155906 - protein, 7 aa, Mycobacterium
CEDEEAR

SEQ ID NO: 1155907 - protein, 4 aa, Mycobacterium
CEGG

SEQ ID NO: 1155908 - protein, 5 aa, Mycobacterium
CEGTE

SEQ ID NO: 1155909 - protein, 11 aa, Mycobacterium
CEKGGRGASIG

SEQ ID NO: 1155910 - protein, 11 aa, Mycobacterium
CELDSGAAAAL

SEQ ID NO: 1155911 - protein, 5 aa, Mycobacterium
CEPGR

SEQ ID NO: 1155912 - protein, 11 aa, Mycobacterium
CEQGPTPTPCG

SEQ ID NO: 1155913 - protein, 10 aa, Mycobacterium
CESGEPVDPV

SEQ ID NO: 1155914 - protein, 6 aa, Mycobacterium
CESGRH

SEQ ID NO: 1155915 - protein, 6 aa, Mycobacterium
CESSGN

SEQ ID NO: 1155916 - protein, 7 aa, Mycobacterium
CESTHRN

SEQ ID NO: 1155917 - protein, 6 aa, Mycobacterium
CETERG

SEQ ID NO: 1155918 - protein, 6 aa, Mycobacterium
CGADTD

SEQ ID NO: 1155919 - protein, 5 aa, Mycobacterium
CGAGE

SEQ ID NO: 1155920 - protein, 20 aa, Mycobacterium
CGAHSDTPAPQLTGSPLYDP

SEQ ID NO: 1155921 - protein, 8 aa, Mycobacterium
CGDGDRPR

SEQ ID NO: 1155922 - protein, 5 aa, Mycobacterium
CGEGA

SEQ ID NO: 1155923 - protein, 6 aa, Mycobacterium
CGEGYG

SEQ ID NO: 1155924 - protein, 5 aa, Mycobacterium
CGETP

SEQ ID NO: 1155925 - protein, 5 aa, Mycobacterium
CGGYA

SEQ ID NO: 1155926 - protein, 8 aa, Mycobacterium
CGKGISAA

SEQ ID NO: 1155927 - protein, 12 aa, Mycobacterium
CGPPGSATVGGV

SEQ ID NO: 1155928 - protein, 5 aa, Mycobacterium
CGQWP

SEQ ID NO: 1155929 - protein, 6 aa, Mycobacterium
CGRGGV

SEQ ID NO: 1155930 - protein, 6 aa, Mycobacterium
CGSDSV

SEQ ID NO: 1155931 - protein, 5 aa, Mycobacterium
CGTDA

SEQ ID NO: 1155932 - protein, 8 aa, Mycobacterium
CGTGASTA

SEQ ID NO: 1155933 - protein, 9 aa, Mycobacterium
CGTSDMKSG

SEQ ID NO: 1155934 - protein, 11 aa, Mycobacterium
CKGTGVTTRTR

SEQ ID NO: 1155935 - protein, 6 aa, Mycobacterium
CKPGEA

SEQ ID NO: 1155936 - protein, 6 aa, Mycobacterium
CLDDPS

SEQ ID NO: 1155937 - protein, 15 aa, Mycobacterium
CMGPSGEDAEQDAED

SEQ ID NO: 1155938 - protein, 9 aa, Mycobacterium
CNPETGPGQ

SEQ ID NO: 1155939 - protein, 10 aa, Mycobacterium
CNTSKCNDEV

SEQ ID NO: 1155940 - protein, 6 aa, Mycobacterium
CPAERA

SEQ ID NO: 1155941 - protein, 7 aa, Mycobacterium
CPAPPAR

SEQ ID NO: 1155942 - protein, 12 aa, Mycobacterium
CPDAADPRPATL

SEQ ID NO: 1155943 - protein, 5 aa, Mycobacterium
CPDPD

SEQ ID NO: 1155944 - protein, 9 aa, Mycobacterium
CPDQTQPGF

SEQ ID NO: 1155945 - protein, 4 aa, Mycobacterium
CPGA

SEQ ID NO: 1155946 - protein, 12 aa, Mycobacterium
CPIPGRRAARVQ

SEQ ID NO: 1155947 - protein, 16 aa, Mycobacterium
CPKGSASKQLVTGPQR

SEQ ID NO: 1155948 - protein, 10 aa, Mycobacterium
CPKRSEITEQ

SEQ ID NO: 1155949 - protein, 8 aa, Mycobacterium
CPNTDARD

SEQ ID NO: 1155950 - protein, 6 aa, Mycobacterium
CPPERA

SEQ ID NO: 1155951 - protein, 14 aa, Mycobacterium
CPPEYKTAQGGKGV

SEQ ID NO: 1155952 - protein, 5 aa, Mycobacterium
CPPGT

SEQ ID NO: 1155953 - protein, 12 aa, Mycobacterium
CPSDAARAVGGD

SEQ ID NO: 1155954 - protein, 9 aa, Mycobacterium
CPTDHPARE

SEQ ID NO: 1155955 - protein, 13 aa, Mycobacterium
CQGTVEGRPDDGC

SEQ ID NO: 1155956 - protein, 6 aa, Mycobacterium
CQRSYE

SEQ ID NO: 1155957 - protein, 14 aa, Mycobacterium
CRDRSAAKRLRAAR

SEQ ID NO: 1155958 - protein, 21 aa, Mycobacterium
CRDTNVPTFKERRDEEDSLSA

SEQ ID NO: 1155959 - protein, 10 aa, Mycobacterium
CRGPRPPGRL

SEQ ID NO: 1155960 - protein, 12 aa, Mycobacterium
CRGSGPEGAREI

SEQ ID NO: 1155961 - protein, 9 aa, Mycobacterium
CRGSGSPAA

SEQ ID NO: 1155962 - protein, 20 aa, Mycobacterium
CRGSTGPSSIAPDGRPYGSR

SEQ ID NO: 1155963 - protein, 12 aa, Mycobacterium
CRGWTDEAARHD

SEQ ID NO: 1155964 - protein, 8 aa, Mycobacterium
CRPNSGTD

SEQ ID NO: 1155965 - protein, 7 aa, Mycobacterium
CRQADPD

SEQ ID NO: 1155966 - protein, 16 aa, Mycobacterium
CRQAKERLSADTATAV

SEQ ID NO: 1155967 - protein, 11 aa, Mycobacterium
CRRSSSEREPR

SEQ ID NO: 1155968 - protein, 6 aa, Mycobacterium
CSAEEA

SEQ ID NO: 1155969 - protein, 5 aa, Mycobacterium
CSASL

SEQ ID NO: 1155970 - protein, 9 aa, Mycobacterium
CSDDAQPGV

SEQ ID NO: 1155971 - protein, 14 aa, Mycobacterium
CSGGRGETRWRERS

SEQ ID NO: 1155972 - protein, 8 aa, Mycobacterium
CSPSKEAL

SEQ ID NO: 1155973 - protein, 11 aa, Mycobacterium
CSPSRTVGPQR

SEQ ID NO: 1155974 - protein, 6 aa, Mycobacterium
CSSAGS

SEQ ID NO: 1155975 - protein, 5 aa, Mycobacterium
CSSDI

SEQ ID NO: 1155976 - protein, 5 aa, Mycobacterium
CSSGT

SEQ ID NO: 1155977 - protein, 9 aa, Mycobacterium
CSTGPEDLG

SEQ ID NO: 1155978 - protein, 9 aa, Mycobacterium
CTAATQAME

SEQ ID NO: 1155979 - protein, 8 aa, Mycobacterium
CTASGPAL

SEQ ID NO: 1155980 - protein, 7 aa, Mycobacterium
CTEGDPA

SEQ ID NO: 1155981 - protein, 5 aa, Mycobacterium
CTEQD

SEQ ID NO: 1155982 - protein, 5 aa, Mycobacterium
CTLPP

SEQ ID NO: 1155983 - protein, 8 aa, Mycobacterium
CTNTSNPE

SEQ ID NO: 1155984 - protein, 5 aa, Mycobacterium
CTPDT

SEQ ID NO: 1155985 - protein, 21 aa, Mycobacterium
CTPPPADVDRPGGPAPPEGRA

SEQ ID NO: 1155986 - protein, 10 aa, Mycobacterium
CTPTDAAPDV

SEQ ID NO: 1155987 - protein, 10 aa, Mycobacterium
CTPTGDEYPQ

SEQ ID NO: 1155988 - protein, 17 aa, Mycobacterium
CTRDPERWTTTADEEAK

SEQ ID NO: 1155989 - protein, 4 aa, Mycobacterium
CTSH

SEQ ID NO: 1155990 - protein, 6 aa, Mycobacterium
CTSTRK

SEQ ID NO: 1155991 - protein, 11 aa, Mycobacterium
CTTRNKRRAAR

SEQ ID NO: 1155992 - protein, 8 aa, Mycobacterium
CYDPNERV

SEQ ID NO: 1155993 - protein, 18 aa, Mycobacterium
DAAAAGPAAAPETPTEAA

SEQ ID NO: 1155994 - protein, 6 aa, Mycobacterium
DAAADG

SEQ ID NO: 1155995 - protein, 11 aa, Mycobacterium
DAAADTAADQR

SEQ ID NO: 1155996 - protein, 7 aa, Mycobacterium
DAAAQAL

SEQ ID NO: 1155997 - protein, 6 aa, Mycobacterium
DAAARG

SEQ ID NO: 1155998 - protein, 9 aa, Mycobacterium
DAAARGIAE

SEQ ID NO: 1155999 - protein, 23 aa, Mycobacterium
DAAARRDSRCRTKDFVASLCAEF

SEQ ID NO: 1156000 - protein, 4 aa, Mycobacterium
DAAD

SEQ ID NO: 1156001 - protein, 8 aa, Mycobacterium
DAADEESM

SEQ ID NO: 1156002 - protein, 5 aa, Mycobacterium
DAADL

SEQ ID NO: 1156003 - protein, 26 aa, Mycobacterium
DAADRARSAIDTAPSDPKAAAARTEA

SEQ ID NO: 1156004 - protein, 13 aa, Mycobacterium
DAADYNGAGIGNY

SEQ ID NO: 1156005 - protein, 8 aa, Mycobacterium
DAAEGRTR

SEQ ID NO: 1156006 - protein, 6 aa, Mycobacterium
DAAERA

SEQ ID NO: 1156007 - protein, 14 aa, Mycobacterium
DAAFPKRLGRPEEY

SEQ ID NO: 1156008 - protein, 10 aa, Mycobacterium
DAAGGDARRG

SEQ ID NO: 1156009 - protein, 7 aa, Mycobacterium
DAAGNGA

SEQ ID NO: 1156010 - protein, 5 aa, Mycobacterium
DAAGP

SEQ ID NO: 1156011 - protein, 6 aa, Mycobacterium
DAAGPL

SEQ ID NO: 1156012 - protein, 10 aa, Mycobacterium
DAAGRDPATV

SEQ ID NO: 1156013 - protein, 4 aa, Mycobacterium
DAAH

SEQ ID NO: 1156014 - protein, 19 aa, Mycobacterium
DAAHGAATAWGKTSPGERA

SEQ ID NO: 1156015 - protein, 18 aa, Mycobacterium
DAAKGRSMDAELRKLLDQ

SEQ ID NO: 1156016 - protein, 11 aa, Mycobacterium
DAAKRKEYDET

SEQ ID NO: 1156017 - protein, 11 aa, Mycobacterium
DAAKTAKTFPT

SEQ ID NO: 1156018 - protein, 9 aa, Mycobacterium
DAALPDPHP

SEQ ID NO: 1156019 - protein, 7 aa, Mycobacterium
DAAMGER

SEQ ID NO: 1156020 - protein, 6 aa, Mycobacterium
DAANPG

SEQ ID NO: 1156021 - protein, 8 aa, Mycobacterium
DAAPDDVD

SEQ ID NO: 1156022 - protein, 8 aa, Mycobacterium
DAAPPEYV

SEQ ID NO: 1156023 - protein, 8 aa, Mycobacterium
DAAPQLTG

SEQ ID NO: 1156024 - protein, 8 aa, Mycobacterium
DAAPQPLR

SEQ ID NO: 1156025 - protein, 4 aa, Mycobacterium
DAAQ

SEQ ID NO: 1156026 - protein, 7 aa, Mycobacterium
DAAQNGM

SEQ ID NO: 1156027 - protein, 9 aa, Mycobacterium
DAARNRSDA

SEQ ID NO: 1156028 - protein, 7 aa, Mycobacterium
DAARPYL

SEQ ID NO: 1156029 - protein, 35 aa, Mycobacterium
DAARRAAVSAADNLRAEQKAASKKVGKASPEERPA

SEQ ID NO: 1156030 - protein, 6 aa, Mycobacterium
DAARRY

SEQ ID NO: 1156031 - protein, 8 aa, Mycobacterium
DAASAPGQ

SEQ ID NO: 1156032 - protein, 6 aa, Mycobacterium
DAASGA

SEQ ID NO: 1156033 - protein, 9 aa, Mycobacterium
DAASQRDAA

SEQ ID NO: 1156034 - protein, 8 aa, Mycobacterium
DAASSRVG

SEQ ID NO: 1156035 - protein, 9 aa, Mycobacterium
DAATAGPES

SEQ ID NO: 1156036 - protein, 8 aa, Mycobacterium
DAATPSGR

SEQ ID NO: 1156037 - protein, 5 aa, Mycobacterium
DAATR

SEQ ID NO: 1156038 - protein, 17 aa, Mycobacterium
DAAYEDAKRASREAGEV

SEQ ID NO: 1156039 - protein, 4 aa, Mycobacterium
DADA

SEQ ID NO: 1156040 - protein, 8 aa, Mycobacterium
DADADGVE

SEQ ID NO: 1156041 - protein, 13 aa, Mycobacterium
DADAFAKGAPGFQ

SEQ ID NO: 1156042 - protein, 10 aa, Mycobacterium
DADAGKDTLE

SEQ ID NO: 1156043 - protein, 6 aa, Mycobacterium
DADDDY

SEQ ID NO: 1156044 - protein, 9 aa, Mycobacterium
DADDEDRTA

SEQ ID NO: 1156045 - protein, 5 aa, Mycobacterium
DADEL

SEQ ID NO: 1156046 - protein, 7 aa, Mycobacterium
DADGKHI

SEQ ID NO: 1156047 - protein, 9 aa, Mycobacterium
DADGLETTV

SEQ ID NO: 1156048 - protein, 10 aa, Mycobacterium
DADGPQTDHR

SEQ ID NO: 1156049 - protein, 8 aa, Mycobacterium
DADGRPVM

SEQ ID NO: 1156050 - protein, 8 aa, Mycobacterium
DADGSPAY

SEQ ID NO: 1156051 - protein, 7 aa, Mycobacterium
DADLNGY

SEQ ID NO: 1156052 - protein, 6 aa, Mycobacterium
DADPAT

SEQ ID NO: 1156053 - protein, 6 aa, Mycobacterium
DADPDV

SEQ ID NO: 1156054 - protein, 7 aa, Mycobacterium
DADPEFR

SEQ ID NO: 1156055 - protein, 10 aa, Mycobacterium
DADPRKVGRA

SEQ ID NO: 1156056 - protein, 6 aa, Mycobacterium
DADPWQ

SEQ ID NO: 1156057 - protein, 4 aa, Mycobacterium
DADR

SEQ ID NO: 1156058 - protein, 8 aa, Mycobacterium
DADRGAPH

SEQ ID NO: 1156059 - protein, 6 aa, Mycobacterium
DADRPE

SEQ ID NO: 1156060 - protein, 9 aa, Mycobacterium
DADTDPAGF

SEQ ID NO: 1156061 - protein, 7 aa, Mycobacterium
DADTEEL

SEQ ID NO: 1156062 - protein, 11 aa, Mycobacterium
DADTRWRTAGE

SEQ ID NO: 1156063 - protein, 8 aa, Mycobacterium
DAEDGPDA

SEQ ID NO: 1156064 - protein, 8 aa, Mycobacterium
DAEDPTTA

SEQ ID NO: 1156065 - protein, 4 aa, Mycobacterium
DAEE

SEQ ID NO: 1156066 - protein, 4 aa, Mycobacterium
DAEG

SEQ ID NO: 1156067 - protein, 7 aa, Mycobacterium
DAEGADE

SEQ ID NO: 1156068 - protein, 6 aa, Mycobacterium
DAEGAR

SEQ ID NO: 1156069 - protein, 6 aa, Mycobacterium
DAEGRD

SEQ ID NO: 1156070 - protein, 6 aa, Mycobacterium
DAEGRP

SEQ ID NO: 1156071 - protein, 12 aa, Mycobacterium
DAEHERRISRWR

SEQ ID NO: 1156072 - protein, 5 aa, Mycobacterium
DAEHV

SEQ ID NO: 1156073 - protein, 24 aa, Mycobacterium
DAEKTESFGEQTPMGRAAQPDEIA

SEQ ID NO: 1156074 - protein, 10 aa, Mycobacterium
DAELGDRATA

SEQ ID NO: 1156075 - protein, 7 aa, Mycobacterium
DAELSGP

SEQ ID NO: 1156076 - protein, 7 aa, Mycobacterium
DAEPAKE

SEQ ID NO: 1156077 - protein, 6 aa, Mycobacterium
DAEPLE

SEQ ID NO: 1156078 - protein, 16 aa, Mycobacterium
DAEQAEATAAKIGSGE

SEQ ID NO: 1156079 - protein, 5 aa, Mycobacterium
DAEQQ

SEQ ID NO: 1156080 - protein, 5 aa, Mycobacterium
DAEQR

SEQ ID NO: 1156081 - protein, 7 aa, Mycobacterium
DAERRRN

SEQ ID NO: 1156082 - protein, 4 aa, Mycobacterium
DAES

SEQ ID NO: 1156083 - protein, 8 aa, Mycobacterium
DAESPHPV

SEQ ID NO: 1156084 - protein, 4 aa, Mycobacterium
DAET

SEQ ID NO: 1156085 - protein, 7 aa, Mycobacterium
DAETGTG

SEQ ID NO: 1156086 - protein, 5 aa, Mycobacterium
DAGAA

SEQ ID NO: 1156087 - protein, 7 aa, Mycobacterium
DAGAAAG

SEQ ID NO: 1156088 - protein, 7 aa, Mycobacterium
DAGADEV

SEQ ID NO: 1156089 - protein, 7 aa, Mycobacterium
DAGATMD

SEQ ID NO: 1156090 - protein, 8 aa, Mycobacterium
DAGDANDR

SEQ ID NO: 1156091 - protein, 5 aa, Mycobacterium
DAGDE

SEQ ID NO: 1156092 - protein, 16 aa, Mycobacterium
DAGDEKGRTEDAEAVA

SEQ ID NO: 1156093 - protein, 9 aa, Mycobacterium
DAGDKDKAA

SEQ ID NO: 1156094 - protein, 29 aa, Mycobacterium
DAGDPQPSGKTYKVNGTIKEGITSEQAKK

SEQ ID NO: 1156095 - protein, 6 aa, Mycobacterium
DAGDPV

SEQ ID NO: 1156096 - protein, 6 aa, Mycobacterium
DAGEDL

SEQ ID NO: 1156097 - protein, 5 aa, Mycobacterium
DAGEE

SEQ ID NO: 1156098 - protein, 14 aa, Mycobacterium
DAGEPAEEAARRGG

SEQ ID NO: 1156099 - protein, 9 aa, Mycobacterium
DAGEPFENC

SEQ ID NO: 1156100 - protein, 6 aa, Mycobacterium
DAGGEL

SEQ ID NO: 1156101 - protein, 8 aa, Mycobacterium
DAGGRPTL

SEQ ID NO: 1156102 - protein, 12 aa, Mycobacterium
DAGGRVAPVTEG

SEQ ID NO: 1156103 - protein, 4 aa, Mycobacterium
DAGH

SEQ ID NO: 1156104 - protein, 12 aa, Mycobacterium
DAGHRALNPSAT

SEQ ID NO: 1156105 - protein, 8 aa, Mycobacterium
DAGIDPSE

SEQ ID NO: 1156106 - protein, 4 aa, Mycobacterium
DAGL

SEQ ID NO: 1156107 - protein, 9 aa, Mycobacterium
DAGLKTYAE

SEQ ID NO: 1156108 - protein, 5 aa, Mycobacterium
DAGLN

SEQ ID NO: 1156109 - protein, 11 aa, Mycobacterium
DAGLPGRGAPD

SEQ ID NO: 1156110 - protein, 4 aa, Mycobacterium
DAGP

SEQ ID NO: 1156111 - protein, 16 aa, Mycobacterium
DAGPDAPSRTARGRAA

SEQ ID NO: 1156112 - protein, 7 aa, Mycobacterium
DAGPDPE

SEQ ID NO: 1156113 - protein, 8 aa, Mycobacterium
DAGPGQRL

SEQ ID NO: 1156114 - protein, 7 aa, Mycobacterium
DAGPTFE

SEQ ID NO: 1156115 - protein, 10 aa, Mycobacterium
DAGQSESELD

SEQ ID NO: 1156116 - protein, 10 aa, Mycobacterium
DAGRDPQTRF

SEQ ID NO: 1156117 - protein, 14 aa, Mycobacterium
DAGSADPASTAAVG

SEQ ID NO: 1156118 - protein, 5 aa, Mycobacterium
DAGSF

SEQ ID NO: 1156119 - protein, 6 aa, Mycobacterium
DAGSTN

SEQ ID NO: 1156120 - protein, 12 aa, Mycobacterium
DAGTLTARPGAQ

SEQ ID NO: 1156121 - protein, 11 aa, Mycobacterium
DAGTPDAGGTL

SEQ ID NO: 1156122 - protein, 5 aa, Mycobacterium
DAGTR

SEQ ID NO: 1156123 - protein, 13 aa, Mycobacterium
DAGTTDDRNFEGP

SEQ ID NO: 1156124 - protein, 7 aa, Mycobacterium
DAGVDAG

SEQ ID NO: 1156125 - protein, 7 aa, Mycobacterium
DAHANCA

SEQ ID NO: 1156126 - protein, 4 aa, Mycobacterium
DAHR

SEQ ID NO: 1156127 - protein, 12 aa, Mycobacterium
DAHSGRTQRRKL

SEQ ID NO: 1156128 - protein, 6 aa, Mycobacterium
DAIAPE

SEQ ID NO: 1156129 - protein, 6 aa, Mycobacterium
DAIGRE

SEQ ID NO: 1156130 - protein, 11 aa, Mycobacterium
DAIPNDSTNFD

SEQ ID NO: 1156131 - protein, 8 aa, Mycobacterium
DAIREGSR

SEQ ID NO: 1156132 - protein, 6 aa, Mycobacterium
DAISGA

SEQ ID NO: 1156133 - protein, 20 aa, Mycobacterium
DAITPAQRNRPLRRSEEDDS

SEQ ID NO: 1156134 - protein, 7 aa, Mycobacterium
DAKAFGD

SEQ ID NO: 1156135 - protein, 19 aa, Mycobacterium
DAKEGPRAFKEKRAPNFKM

SEQ ID NO: 1156136 - protein, 8 aa, Mycobacterium
DAKERLAK

SEQ ID NO: 1156137 - protein, 8 aa, Mycobacterium
DAKESGYT

SEQ ID NO: 1156138 - protein, 4 aa, Mycobacterium
DAKF

SEQ ID NO: 1156139 - protein, 6 aa, Mycobacterium
DAKFGL

SEQ ID NO: 1156140 - protein, 7 aa, Mycobacterium
DAKPGQA

SEQ ID NO: 1156141 - protein, 8 aa, Mycobacterium
DAKPGTLE

SEQ ID NO: 1156142 - protein, 11 aa, Mycobacterium
DAKRRSSRPSG

SEQ ID NO: 1156143 - protein, 4 aa, Mycobacterium
DAKT

SEQ ID NO: 1156144 - protein, 10 aa, Mycobacterium
DALAGSAPTA

SEQ ID NO: 1156145 - protein, 12 aa, Mycobacterium
DALESATGADQS

SEQ ID NO: 1156146 - protein, 6 aa, Mycobacterium
DALGDE

SEQ ID NO: 1156147 - protein, 9 aa, Mycobacterium
DALGTSTAA

SEQ ID NO: 1156148 - protein, 10 aa, Mycobacterium
DALPPEPNSR

SEQ ID NO: 1156149 - protein, 6 aa, Mycobacterium
DALRDG

SEQ ID NO: 1156150 - protein, 7 aa, Mycobacterium
DALRDGD

SEQ ID NO: 1156151 - protein, 6 aa, Mycobacterium
DALRDV

SEQ ID NO: 1156152 - protein, 8 aa, Mycobacterium
DALSGADA

SEQ ID NO: 1156153 - protein, 5 aa, Mycobacterium
DALTG

SEQ ID NO: 1156154 - protein, 8 aa, Mycobacterium
DANGAPER

SEQ ID NO: 1156155 - protein, 10 aa, Mycobacterium
DANGIGTKLD

SEQ ID NO: 1156156 - protein, 11 aa, Mycobacterium
DANPDRGTLSQ

SEQ ID NO: 1156157 - protein, 8 aa, Mycobacterium
DANPTTAR

SEQ ID NO: 1156158 - protein, 14 aa, Mycobacterium
DANPYTLSGGEQRR

SEQ ID NO: 1156159 - protein, 8 aa, Mycobacterium
DANTLEAT

SEQ ID NO: 1156160 - protein, 4 aa, Mycobacterium
DANY

SEQ ID NO: 1156161 - protein, 5 aa, Mycobacterium
DAPAD

SEQ ID NO: 1156162 - protein, 11 aa, Mycobacterium
DAPADREQKAR

SEQ ID NO: 1156163 - protein, 8 aa, Mycobacterium
DAPAPYRQ

SEQ ID NO: 1156164 - protein, 15 aa, Mycobacterium
DAPAQSAAPPAQKSK

SEQ ID NO: 1156165 - protein, 30 aa, Mycobacterium
DAPARDDVGATRRPSAPTVITTGGDADDGV

SEQ ID NO: 1156166 - protein, 7 aa, Mycobacterium
DAPDDPW

SEQ ID NO: 1156167 - protein, 12 aa, Mycobacterium
DAPDEMSPYAPR

SEQ ID NO: 1156168 - protein, 5 aa, Mycobacterium
DAPDG

SEQ ID NO: 1156169 - protein, 7 aa, Mycobacterium
DAPDQLS

SEQ ID NO: 1156170 - protein, 7 aa, Mycobacterium
DAPEGST

SEQ ID NO: 1156171 - protein, 14 aa, Mycobacterium
DAPELTPHREVGPD

SEQ ID NO: 1156172 - protein, 8 aa, Mycobacterium
DAPFPDDS

SEQ ID NO: 1156173 - protein, 9 aa, Mycobacterium
DAPGGVPPL

SEQ ID NO: 1156174 - protein, 5 aa, Mycobacterium
DAPGI

SEQ ID NO: 1156175 - protein, 6 aa, Mycobacterium
DAPGSS

SEQ ID NO: 1156176 - protein, 10 aa, Mycobacterium
DAPGTRGGEE

SEQ ID NO: 1156177 - protein, 6 aa, Mycobacterium
DAPGVE

SEQ ID NO: 1156178 - protein, 5 aa, Mycobacterium
DAPID

SEQ ID NO: 1156179 - protein, 6 aa, Mycobacterium
DAPKAQ

SEQ ID NO: 1156180 - protein, 6 aa, Mycobacterium
DAPLED

SEQ ID NO: 1156181 - protein, 5 aa, Mycobacterium
DAPLG

SEQ ID NO: 1156182 - protein, 15 aa, Mycobacterium
DAPPAAGSDSAVSGV

SEQ ID NO: 1156183 - protein, 16 aa, Mycobacterium
DAPPAPGDTGRVENDQ

SEQ ID NO: 1156184 - protein, 10 aa, Mycobacterium
DAPRTPSATL

SEQ ID NO: 1156185 - protein, 9 aa, Mycobacterium
DAPSPHDGP

SEQ ID NO: 1156186 - protein, 5 aa, Mycobacterium
DAPVA

SEQ ID NO: 1156187 - protein, 6 aa, Mycobacterium
DAPVAP

SEQ ID NO: 1156188 - protein, 13 aa, Mycobacterium
DAPVGRVSTTEAV

SEQ ID NO: 1156189 - protein, 5 aa, Mycobacterium
DAPVR

SEQ ID NO: 1156190 - protein, 13 aa, Mycobacterium
DAPVTMSTKTDEL

SEQ ID NO: 1156191 - protein, 4 aa, Mycobacterium
DAPW

SEQ ID NO: 1156192 - protein, 6 aa, Mycobacterium
DAPWPQ

SEQ ID NO: 1156193 - protein, 11 aa, Mycobacterium
DAPYDAEPQPT

SEQ ID NO: 1156194 - protein, 10 aa, Mycobacterium
DAPYEPPDAP

SEQ ID NO: 1156195 - protein, 20 aa, Mycobacterium
DAPYPGALPEPTSPPKKAFG

SEQ ID NO: 1156196 - protein, 4 aa, Mycobacterium
DAQD

SEQ ID NO: 1156197 - protein, 5 aa, Mycobacterium
DAQDA

SEQ ID NO: 1156198 - protein, 7 aa, Mycobacterium
DAQEEAM

SEQ ID NO: 1156199 - protein, 10 aa, Mycobacterium
DAQGNAAYTG

SEQ ID NO: 1156200 - protein, 7 aa, Mycobacterium
DAQPGTV

SEQ ID NO: 1156201 - protein, 8 aa, Mycobacterium
DAQPTAEA

SEQ ID NO: 1156202 - protein, 6 aa, Mycobacterium
DAQRAQ

SEQ ID NO: 1156203 - protein, 7 aa, Mycobacterium
DAQRDGD

SEQ ID NO: 1156204 - protein, 5 aa, Mycobacterium
DAQRR

SEQ ID NO: 1156205 - protein, 9 aa, Mycobacterium
DAQRTNAEG

SEQ ID NO: 1156206 - protein, 4 aa, Mycobacterium
DAQT

SEQ ID NO: 1156207 - protein, 5 aa, Mycobacterium
DAQTP

SEQ ID NO: 1156208 - protein, 7 aa, Mycobacterium
DAQTRAD

SEQ ID NO: 1156209 - protein, 8 aa, Mycobacterium
DARAQADA

SEQ ID NO: 1156210 - protein, 7 aa, Mycobacterium
DARATAQ

SEQ ID NO: 1156211 - protein, 8 aa, Mycobacterium
DARDLAPS

SEQ ID NO: 1156212 - protein, 5 aa, Mycobacterium
DAREA

SEQ ID NO: 1156213 - protein, 7 aa, Mycobacterium
DARERYR

SEQ ID NO: 1156214 - protein, 9 aa, Mycobacterium
DARESVATQ

SEQ ID NO: 1156215 - protein, 6 aa, Mycobacterium
DARGAR

SEQ ID NO: 1156216 - protein, 6 aa, Mycobacterium
DARGHG

SEQ ID NO: 1156217 - protein, 5 aa, Mycobacterium
DARGR

SEQ ID NO: 1156218 - protein, 6 aa, Mycobacterium
DARGTD

SEQ ID NO: 1156219 - protein, 9 aa, Mycobacterium
DARHRSDEF

SEQ ID NO: 1156220 - protein, 14 aa, Mycobacterium
DARNEPKGPQQPHP

SEQ ID NO: 1156221 - protein, 5 aa, Mycobacterium
DARPD

SEQ ID NO: 1156222 - protein, 13 aa, Mycobacterium
DARPQLAEASQLT

SEQ ID NO: 1156223 - protein, 13 aa, Mycobacterium
DARQTVRDAPEIG

SEQ ID NO: 1156224 - protein, 5 aa, Mycobacterium
DARRN

SEQ ID NO: 1156225 - protein, 7 aa, Mycobacterium
DARSRDD

SEQ ID NO: 1156226 - protein, 10 aa, Mycobacterium
DARSTEGSGI

SEQ ID NO: 1156227 - protein, 8 aa, Mycobacterium
DARTGERA

SEQ ID NO: 1156228 - protein, 4 aa, Mycobacterium
DASA

SEQ ID NO: 1156229 - protein, 6 aa, Mycobacterium
DASAAG

SEQ ID NO: 1156230 - protein, 8 aa, Mycobacterium
DASARAEK

SEQ ID NO: 1156231 - protein, 14 aa, Mycobacterium
DASGGSAVRDENPM

SEQ ID NO: 1156232 - protein, 14 aa, Mycobacterium
DASGPEPDDVDPAT

SEQ ID NO: 1156233 - protein, 8 aa, Mycobacterium
DASGRGEI

SEQ ID NO: 1156234 - protein, 6 aa, Mycobacterium
DASQNH

SEQ ID NO: 1156235 - protein, 22 aa, Mycobacterium
DASSGDAAAGAVAAKSTPTDPV

SEQ ID NO: 1156236 - protein, 23 aa, Mycobacterium
DASSTATTAGARAHARAQHGRTA

SEQ ID NO: 1156237 - protein, 8 aa, Mycobacterium
DASTPVAN

SEQ ID NO: 1156238 - protein, 13 aa, Mycobacterium
DASTRSVAAEADA

SEQ ID NO: 1156239 - protein, 14 aa, Mycobacterium
DASVSDPQATPPTF

SEQ ID NO: 1156240 - protein, 14 aa, Mycobacterium
DATAAGDVAVGSGA

SEQ ID NO: 1156241 - protein, 8 aa, Mycobacterium
DATADQAA

SEQ ID NO: 1156242 - protein, 8 aa, Mycobacterium
DATAEDAV

SEQ ID NO: 1156243 - protein, 6 aa, Mycobacterium
DATANS

SEQ ID NO: 1156244 - protein, 7 aa, Mycobacterium
DATARGR

SEQ ID NO: 1156245 - protein, 6 aa, Mycobacterium
DATDDA

SEQ ID NO: 1156246 - protein, 6 aa, Mycobacterium
DATDDE

SEQ ID NO: 1156247 - protein, 8 aa, Mycobacterium
DATDPLGN

SEQ ID NO: 1156248 - protein, 5 aa, Mycobacterium
DATEA

SEQ ID NO: 1156249 - protein, 16 aa, Mycobacterium
DATEAAAKRLGGPDVA

SEQ ID NO: 1156250 - protein, 7 aa, Mycobacterium
DATEAKR

SEQ ID NO: 1156251 - protein, 6 aa, Mycobacterium
DATEQA

SEQ ID NO: 1156252 - protein, 5 aa, Mycobacterium
DATER

SEQ ID NO: 1156253 - protein, 6 aa, Mycobacterium
DATFPG

SEQ ID NO: 1156254 - protein, 9 aa, Mycobacterium
DATGPDSDF

SEQ ID NO: 1156255 - protein, 6 aa, Mycobacterium
DATGRQ

SEQ ID NO: 1156256 - protein, 9 aa, Mycobacterium
DATGRSAGL

SEQ ID NO: 1156257 - protein, 11 aa, Mycobacterium
DATGTADPLAS

SEQ ID NO: 1156258 - protein, 8 aa, Mycobacterium
DATKGVDE

SEQ ID NO: 1156259 - protein, 6 aa, Mycobacterium
DATLAE

SEQ ID NO: 1156260 - protein, 16 aa, Mycobacterium
DATMTAGNSTPLTDGA

SEQ ID NO: 1156261 - protein, 7 aa, Mycobacterium
DATPDGM

SEQ ID NO: 1156262 - protein, 8 aa, Mycobacterium
DATPGADT

SEQ ID NO: 1156263 - protein, 4 aa, Mycobacterium
DATR

SEQ ID NO: 1156264 - protein, 6 aa, Mycobacterium
DATSAL

SEQ ID NO: 1156265 - protein, 6 aa, Mycobacterium
DATTIE

SEQ ID NO: 1156266 - protein, 7 aa, Mycobacterium
DAVDADG

SEQ ID NO: 1156267 - protein, 21 aa, Mycobacterium
DAVDATEPATAVAEETAAVEA

SEQ ID NO: 1156268 - protein, 5 aa, Mycobacterium
DAVDP

SEQ ID NO: 1156269 - protein, 8 aa, Mycobacterium
DAVDPVPV

SEQ ID NO: 1156270 - protein, 7 aa, Mycobacterium
DAVDTET

SEQ ID NO: 1156271 - protein, 11 aa, Mycobacterium
DAVGEAGELTR

SEQ ID NO: 1156272 - protein, 13 aa, Mycobacterium
DAVNDNDSKFPPD

SEQ ID NO: 1156273 - protein, 14 aa, Mycobacterium
DAVNDTGARRSDDA

SEQ ID NO: 1156274 - protein, 8 aa, Mycobacterium
DAVPGGAA

SEQ ID NO: 1156275 - protein, 6 aa, Mycobacterium
DAVQRG

SEQ ID NO: 1156276 - protein, 15 aa, Mycobacterium
DAVRASQRSRGEDPA

SEQ ID NO: 1156277 - protein, 8 aa, Mycobacterium
DAVRGPGS

SEQ ID NO: 1156278 - protein, 7 aa, Mycobacterium
DAVRPGD

SEQ ID NO: 1156279 - protein, 14 aa, Mycobacterium
DAVRTGRAATAGRL

SEQ ID NO: 1156280 - protein, 8 aa, Mycobacterium
DAVSRDPE

SEQ ID NO: 1156281 - protein, 5 aa, Mycobacterium
DAVTA

SEQ ID NO: 1156282 - protein, 13 aa, Mycobacterium
DAWDPRPAGAHGD

SEQ ID NO: 1156283 - protein, 8 aa, Mycobacterium
DAWGPDAR

SEQ ID NO: 1156284 - protein, 4 aa, Mycobacterium
DAWS

SEQ ID NO: 1156285 - protein, 8 aa, Mycobacterium
DAYEDSED

SEQ ID NO: 1156286 - protein, 5 aa, Mycobacterium
DAYPE

SEQ ID NO: 1156287 - protein, 5 aa, Mycobacterium
DAYRD

SEQ ID NO: 1156288 - protein, 12 aa, Mycobacterium
DAYRRDDGEGAV

SEQ ID NO: 1156289 - protein, 8 aa, Mycobacterium
DCRGQGLG

SEQ ID NO: 1156290 - protein, 12 aa, Mycobacterium
DCTNASSLQEQA

SEQ ID NO: 1156291 - protein, 11 aa, Mycobacterium
DDAAARGVADG

SEQ ID NO: 1156292 - protein, 8 aa, Mycobacterium
DDAAASLA

SEQ ID NO: 1156293 - protein, 6 aa, Mycobacterium
DDAADE

SEQ ID NO: 1156294 - protein, 6 aa, Mycobacterium
DDAAQR

SEQ ID NO: 1156295 - protein, 11 aa, Mycobacterium
DDAATAGEPDW

SEQ ID NO: 1156296 - protein, 20 aa, Mycobacterium
DDAAWDAADPPAVPPAQRAV

SEQ ID NO: 1156297 - protein, 5 aa, Mycobacterium
DDADA

SEQ ID NO: 1156298 - protein, 8 aa, Mycobacterium
DDADAQLA

SEQ ID NO: 1156299 - protein, 6 aa, Mycobacterium
DDADDL

SEQ ID NO: 1156300 - protein, 5 aa, Mycobacterium
DDADI

SEQ ID NO: 1156301 - protein, 6 aa, Mycobacterium
DDADLN

SEQ ID NO: 1156302 - protein, 10 aa, Mycobacterium
DDADTRAAVT

SEQ ID NO: 1156303 - protein, 7 aa, Mycobacterium
DDAEEVD

SEQ ID NO: 1156304 - protein, 6 aa, Mycobacterium
DDAEGR

SEQ ID NO: 1156305 - protein, 8 aa, Mycobacterium
DDAEIARR

SEQ ID NO: 1156306 - protein, 9 aa, Mycobacterium
DDAERAKVQ

SEQ ID NO: 1156307 - protein, 6 aa, Mycobacterium
DDAGRR

SEQ ID NO: 1156308 - protein, 8 aa, Mycobacterium
DDAGRTRS

SEQ ID NO: 1156309 - protein, 11 aa, Mycobacterium
DDAGRTTSVTQ

SEQ ID NO: 1156310 - protein, 14 aa, Mycobacterium
DDAHEREQRERYAR

SEQ ID NO: 1156311 - protein, 9 aa, Mycobacterium
DDALAAGAQ

SEQ ID NO: 1156312 - protein, 19 aa, Mycobacterium
DDALARDPMTGERDIRSED

SEQ ID NO: 1156313 - protein, 14 aa, Mycobacterium
DDANGDAVKAGPDI

SEQ ID NO: 1156314 - protein, 10 aa, Mycobacterium
DDAPGSATAS

SEQ ID NO: 1156315 - protein, 5 aa, Mycobacterium
DDAPI

SEQ ID NO: 1156316 - protein, 6 aa, Mycobacterium
DDAPRV

SEQ ID NO: 1156317 - protein, 5 aa, Mycobacterium
DDAPV

SEQ ID NO: 1156318 - protein, 13 aa, Mycobacterium
DDAPVSQDDPVDE

SEQ ID NO: 1156319 - protein, 4 aa, Mycobacterium
DDAQ

SEQ ID NO: 1156320 - protein, 7 aa, Mycobacterium
DDAQAPF

SEQ ID NO: 1156321 - protein, 20 aa, Mycobacterium
DDAQEGPTAFREKRAPQWKG

SEQ ID NO: 1156322 - protein, 6 aa, Mycobacterium
DDARPT

SEQ ID NO: 1156323 - protein, 12 aa, Mycobacterium
DDARRAKDEGVD

SEQ ID NO: 1156324 - protein, 14 aa, Mycobacterium
DDARVADAGTGQFV

SEQ ID NO: 1156325 - protein, 11 aa, Mycobacterium
DDASRADLARR

SEQ ID NO: 1156326 - protein, 4 aa, Mycobacterium
DDAT

SEQ ID NO: 1156327 - protein, 12 aa, Mycobacterium
DDATAAAARPAD

SEQ ID NO: 1156328 - protein, 25 aa, Mycobacterium
DDATALSGAAADRLTRTHASRTRPV

SEQ ID NO: 1156329 - protein, 8 aa, Mycobacterium
DDATGQTA

SEQ ID NO: 1156330 - protein, 7 aa, Mycobacterium
DDATSAR

SEQ ID NO: 1156331 - protein, 8 aa, Mycobacterium
DDATVNGL

SEQ ID NO: 1156332 - protein, 7 aa, Mycobacterium
DDAVEQG

SEQ ID NO: 1156333 - protein, 5 aa, Mycobacterium
DDAVT

SEQ ID NO: 1156334 - protein, 5 aa, Mycobacterium
DDAYP

SEQ ID NO: 1156335 - protein, 5 aa, Mycobacterium
DDDAA

SEQ ID NO: 1156336 - protein, 14 aa, Mycobacterium
DDDAGAVYRLAPPG

SEQ ID NO: 1156337 - protein, 8 aa, Mycobacterium
DDDARQRY

SEQ ID NO: 1156338 - protein, 6 aa, Mycobacterium
DDDAVT

SEQ ID NO: 1156339 - protein, 11 aa, Mycobacterium
DDDDRDVATDT

SEQ ID NO: 1156340 - protein, 7 aa, Mycobacterium
DDDGGAT

SEQ ID NO: 1156341 - protein, 5 aa, Mycobacterium
DDDGN

SEQ ID NO: 1156342 - protein, 18 aa, Mycobacterium
DDDGNQLPPGSDHGEQAN

SEQ ID NO: 1156343 - protein, 7 aa, Mycobacterium
DDDGSVV

SEQ ID NO: 1156344 - protein, 12 aa, Mycobacterium
DDDGTELPPGVP

SEQ ID NO: 1156345 - protein, 8 aa, Mycobacterium
DDDGTVQV

SEQ ID NO: 1156346 - protein, 6 aa, Mycobacterium
DDDLGQ

SEQ ID NO: 1156347 - protein, 10 aa, Mycobacterium
DDDLQQAARE

SEQ ID NO: 1156348 - protein, 4 aa, Mycobacterium
DDDP

SEQ ID NO: 1156349 - protein, 8 aa, Mycobacterium
DDDPEDTL

SEQ ID NO: 1156350 - protein, 9 aa, Mycobacterium
DDDPRRATT

SEQ ID NO: 1156351 - protein, 8 aa, Mycobacterium
DDDPTTGK

SEQ ID NO: 1156352 - protein, 5 aa, Mycobacterium
DDDRL

SEQ ID NO: 1156353 - protein, 8 aa, Mycobacterium
DDDRPTAL

SEQ ID NO: 1156354 - protein, 6 aa, Mycobacterium
DDDRPV

SEQ ID NO: 1156355 - protein, 8 aa, Mycobacterium
DDDSAVPG

SEQ ID NO: 1156356 - protein, 12 aa, Mycobacterium
DDDSDDPEFDPE

SEQ ID NO: 1156357 - protein, 6 aa, Mycobacterium
DDDSVK

SEQ ID NO: 1156358 - protein, 14 aa, Mycobacterium
DDDTARRGFGPYTP

SEQ ID NO: 1156359 - protein, 5 aa, Mycobacterium
DDDTQ

SEQ ID NO: 1156360 - protein, 5 aa, Mycobacterium
DDDVR

SEQ ID NO: 1156361 - protein, 6 aa, Mycobacterium
DDEAVR

SEQ ID NO: 1156362 - protein, 12 aa, Mycobacterium
DDEDEGGLDPAR

SEQ ID NO: 1156363 - protein, 36 aa, Mycobacterium
DDEDSDEDEDSDEDEDSDEDSDEDSDEDSDDEDEPE

SEQ ID NO: 1156364 - protein, 4 aa, Mycobacterium
DDEF

SEQ ID NO: 1156365 - protein, 4 aa, Mycobacterium
DDEG

SEQ ID NO: 1156366 - protein, 11 aa, Mycobacterium
DDEGDDAGADG

SEQ ID NO: 1156367 - protein, 6 aa, Mycobacterium
DDELEA

SEQ ID NO: 1156368 - protein, 12 aa, Mycobacterium
DDEPDAPERDRA

SEQ ID NO: 1156369 - protein, 6 aa, Mycobacterium
DDEPQL

SEQ ID NO: 1156370 - protein, 7 aa, Mycobacterium
DDEQGSI

SEQ ID NO: 1156371 - protein, 7 aa, Mycobacterium
DDERSAR

SEQ ID NO: 1156372 - protein, 12 aa, Mycobacterium
DDESAAADYEVG

SEQ ID NO: 1156373 - protein, 5 aa, Mycobacterium
DDESY

SEQ ID NO: 1156374 - protein, 6 aa, Mycobacterium
DDETRT

SEQ ID NO: 1156375 - protein, 5 aa, Mycobacterium
DDEVP

SEQ ID NO: 1156376 - protein, 12 aa, Mycobacterium
DDEVRDLLATPT

SEQ ID NO: 1156377 - protein, 7 aa, Mycobacterium
DDEWQQG

SEQ ID NO: 1156378 - protein, 5 aa, Mycobacterium
DDEYQ

SEQ ID NO: 1156379 - protein, 14 aa, Mycobacterium
DDEYSSIEERAADT

SEQ ID NO: 1156380 - protein, 32 aa, Mycobacterium
DDEYYEDDDRAERGAARGYARRPREDRFEEEG

SEQ ID NO: 1156381 - protein, 8 aa, Mycobacterium
DDFPTKSY

SEQ ID NO: 1156382 - protein, 6 aa, Mycobacterium
DDGADA

SEQ ID NO: 1156383 - protein, 8 aa, Mycobacterium
DDGAELDV

SEQ ID NO: 1156384 - protein, 13 aa, Mycobacterium
DDGAPTRLPGSQG

SEQ ID NO: 1156385 - protein, 5 aa, Mycobacterium
DDGAR

SEQ ID NO: 1156386 - protein, 6 aa, Mycobacterium
DDGAYL

SEQ ID NO: 1156387 - protein, 8 aa, Mycobacterium
DDGDDAAA

SEQ ID NO: 1156388 - protein, 5 aa, Mycobacterium
DDGDQ

SEQ ID NO: 1156389 - protein, 8 aa, Mycobacterium
DDGEHPGL

SEQ ID NO: 1156390 - protein, 6 aa, Mycobacterium
DDGELA

SEQ ID NO: 1156391 - protein, 11 aa, Mycobacterium
DDGGPGPEATA

SEQ ID NO: 1156392 - protein, 8 aa, Mycobacterium
DDGGRVTG

SEQ ID NO: 1156393 - protein, 10 aa, Mycobacterium
DDGKPGAALG

SEQ ID NO: 1156394 - protein, 9 aa, Mycobacterium
DDGNTCPPG

SEQ ID NO: 1156395 - protein, 8 aa, Mycobacterium
DDGPEKPV

SEQ ID NO: 1156396 - protein, 6 aa, Mycobacterium
DDGPGT

SEQ ID NO: 1156397 - protein, 6 aa, Mycobacterium
DDGPLS

SEQ ID NO: 1156398 - protein, 5 aa, Mycobacterium
DDGPQ

SEQ ID NO: 1156399 - protein, 11 aa, Mycobacterium
DDGPTAALRPY

SEQ ID NO: 1156400 - protein, 7 aa, Mycobacterium
DDGQRLD

SEQ ID NO: 1156401 - protein, 15 aa, Mycobacterium
DDGRAAAAKIETPPW

SEQ ID NO: 1156402 - protein, 5 aa, Mycobacterium
DDGRI

SEQ ID NO: 1156403 - protein, 8 aa, Mycobacterium
DDGRPLDP

SEQ ID NO: 1156404 - protein, 8 aa, Mycobacterium
DDGRPSQL

SEQ ID NO: 1156405 - protein, 4 aa, Mycobacterium
DDGS

SEQ ID NO: 1156406 - protein, 6 aa, Mycobacterium
DDGSAT

SEQ ID NO: 1156407 - protein, 20 aa, Mycobacterium
DDGSCPPGRPDGKPWTHTPP

SEQ ID NO: 1156408 - protein, 10 aa, Mycobacterium
DDGSCSPPPY

SEQ ID NO: 1156409 - protein, 7 aa, Mycobacterium
DDGSGLQ

SEQ ID NO: 1156410 - protein, 9 aa, Mycobacterium
DDGSPEVAS

SEQ ID NO: 1156411 - protein, 5 aa, Mycobacterium
DDGST

SEQ ID NO: 1156412 - protein, 5 aa, Mycobacterium
DDGTA

SEQ ID NO: 1156413 - protein, 8 aa, Mycobacterium
DDGTHSAE

SEQ ID NO: 1156414 - protein, 5 aa, Mycobacterium
DDGTR

SEQ ID NO: 1156415 - protein, 8 aa, Mycobacterium
DDGTTGLS

SEQ ID NO: 1156416 - protein, 5 aa, Mycobacterium
DDGTV

SEQ ID NO: 1156417 - protein, 6 aa, Mycobacterium
DDGTVD

SEQ ID NO: 1156418 - protein, 6 aa, Mycobacterium
DDGTVT

SEQ ID NO: 1156419 - protein, 10 aa, Mycobacterium
DDGVAKSPQW

SEQ ID NO: 1156420 - protein, 5 aa, Mycobacterium
DDGWL

SEQ ID NO: 1156421 - protein, 15 aa, Mycobacterium
DDHAAATKAMADTEI

SEQ ID NO: 1156422 - protein, 7 aa, Mycobacterium
DDHEPGR

SEQ ID NO: 1156423 - protein, 9 aa, Mycobacterium
DDHGDPSNI

SEQ ID NO: 1156424 - protein, 7 aa, Mycobacterium
DDHGPDF

SEQ ID NO: 1156425 - protein, 10 aa, Mycobacterium
DDHGTEAAQT

SEQ ID NO: 1156426 - protein, 6 aa, Mycobacterium
DDHPGR

SEQ ID NO: 1156427 - protein, 6 aa, Mycobacterium
DDHRVP

SEQ ID NO: 1156428 - protein, 7 aa, Mycobacterium
DDIDTDW

SEQ ID NO: 1156429 - protein, 6 aa, Mycobacterium
DDIEIG

SEQ ID NO: 1156430 - protein, 12 aa, Mycobacterium
DDIGRSKAEALA

SEQ ID NO: 1156431 - protein, 8 aa, Mycobacterium
DDIPEHGS

SEQ ID NO: 1156432 - protein, 13 aa, Mycobacterium
DDIPERGDMAGRS

SEQ ID NO: 1156433 - protein, 5 aa, Mycobacterium
DDIPR

SEQ ID NO: 1156434 - protein, 8 aa, Mycobacterium
DDKGSARY

SEQ ID NO: 1156435 - protein, 5 aa, Mycobacterium
DDKPD

SEQ ID NO: 1156436 - protein, 8 aa, Mycobacterium
DDKRQTRR

SEQ ID NO: 1156437 - protein, 20 aa, Mycobacterium
DDKSPAEADTVDTVRAFYEH

SEQ ID NO: 1156438 - protein, 9 aa, Mycobacterium
DDLDAETRA

SEQ ID NO: 1156439 - protein, 23 aa, Mycobacterium
DDLDGARSSLEGAVSTTELGGSA

SEQ ID NO: 1156440 - protein, 7 aa, Mycobacterium
DDLGETT

SEQ ID NO: 1156441 - protein, 9 aa, Mycobacterium
DDLNRSTAN

SEQ ID NO: 1156442 - protein, 5 aa, Mycobacterium
DDLNT

SEQ ID NO: 1156443 - protein, 7 aa, Mycobacterium
DDLPATS

SEQ ID NO: 1156444 - protein, 8 aa, Mycobacterium
DDLREPME

SEQ ID NO: 1156445 - protein, 17 aa, Mycobacterium
DDLRGEPASSDRKKNSY

SEQ ID NO: 1156446 - protein, 4 aa, Mycobacterium
DDLS

SEQ ID NO: 1156447 - protein, 11 aa, Mycobacterium
DDLSPGERTRA

SEQ ID NO: 1156448 - protein, 11 aa, Mycobacterium
DDLSSADARAL

SEQ ID NO: 1156449 - protein, 6 aa, Mycobacterium
DDLVPT

SEQ ID NO: 1156450 - protein, 8 aa, Mycobacterium
DDMPTPAD

SEQ ID NO: 1156451 - protein, 16 aa, Mycobacterium
DDNDLSAYNGKTRPGF

SEQ ID NO: 1156452 - protein, 8 aa, Mycobacterium
DDNEHSPN

SEQ ID NO: 1156453 - protein, 5 aa, Mycobacterium
DDNEW

SEQ ID NO: 1156454 - protein, 5 aa, Mycobacterium
DDNGR

SEQ ID NO: 1156455 - protein, 4 aa, Mycobacterium
DDNR

SEQ ID NO: 1156456 - protein, 17 aa, Mycobacterium
DDPAPLRDAKRDAQPAF

SEQ ID NO: 1156457 - protein, 15 aa, Mycobacterium
DDPARNAAVTEGGYY

SEQ ID NO: 1156458 - protein, 11 aa, Mycobacterium
DDPDDGLPESH

SEQ ID NO: 1156459 - protein, 6 aa, Mycobacterium
DDPDGV

SEQ ID NO: 1156460 - protein, 7 aa, Mycobacterium
DDPDLSQ

SEQ ID NO: 1156461 - protein, 8 aa, Mycobacterium
DDPDMPGA

SEQ ID NO: 1156462 - protein, 9 aa, Mycobacterium
DDPDPQAAG

SEQ ID NO: 1156463 - protein, 8 aa, Mycobacterium
DDPDTANP

SEQ ID NO: 1156464 - protein, 8 aa, Mycobacterium
DDPDTRGD

SEQ ID NO: 1156465 - protein, 11 aa, Mycobacterium
DDPELREGDRC

SEQ ID NO: 1156466 - protein, 10 aa, Mycobacterium
DDPEVAAQGR

SEQ ID NO: 1156467 - protein, 10 aa, Mycobacterium
DDPGKAGTQD

SEQ ID NO: 1156468 - protein, 13 aa, Mycobacterium
DDPGSAALAERTA

SEQ ID NO: 1156469 - protein, 9 aa, Mycobacterium
DDPGSSARI

SEQ ID NO: 1156470 - protein, 6 aa, Mycobacterium
DDPGYA

SEQ ID NO: 1156471 - protein, 8 aa, Mycobacterium
DDPGYGKD

SEQ ID NO: 1156472 - protein, 7 aa, Mycobacterium
DDPHLKR

SEQ ID NO: 1156473 - protein, 9 aa, Mycobacterium
DDPKPGWYD

SEQ ID NO: 1156474 - protein, 4 aa, Mycobacterium
DDPL

SEQ ID NO: 1156475 - protein, 8 aa, Mycobacterium
DDPLDTAA

SEQ ID NO: 1156476 - protein, 11 aa, Mycobacterium
DDPNLEPMAAT

SEQ ID NO: 1156477 - protein, 7 aa, Mycobacterium
DDPRDAA

SEQ ID NO: 1156478 - protein, 9 aa, Mycobacterium
DDPSDESFS

SEQ ID NO: 1156479 - protein, 7 aa, Mycobacterium
DDPSGNT

SEQ ID NO: 1156480 - protein, 8 aa, Mycobacterium
DDPSGPRV

SEQ ID NO: 1156481 - protein, 11 aa, Mycobacterium
DDPTADTDART

SEQ ID NO: 1156482 - protein, 11 aa, Mycobacterium
DDPTADVEEGR

SEQ ID NO: 1156483 - protein, 9 aa, Mycobacterium
DDPTASARE

SEQ ID NO: 1156484 - protein, 13 aa, Mycobacterium
DDPTPAGHPDPLN

SEQ ID NO: 1156485 - protein, 9 aa, Mycobacterium
DDPTRGKDR

SEQ ID NO: 1156486 - protein, 5 aa, Mycobacterium
DDPTV

SEQ ID NO: 1156487 - protein, 5 aa, Mycobacterium
DDPVA

SEQ ID NO: 1156488 - protein, 7 aa, Mycobacterium
DDPVATA

SEQ ID NO: 1156489 - protein, 4 aa, Mycobacterium
DDPY

SEQ ID NO: 1156490 - protein, 6 aa, Mycobacterium
DDPYAV

SEQ ID NO: 1156491 - protein, 8 aa, Mycobacterium
DDQATLDS

SEQ ID NO: 1156492 - protein, 7 aa, Mycobacterium
DDQGKTD

SEQ ID NO: 1156493 - protein, 4 aa, Mycobacterium
DDQY

SEQ ID NO: 1156494 - protein, 7 aa, Mycobacterium
DDRDGEA

SEQ ID NO: 1156495 - protein, 7 aa, Mycobacterium
DDREPGL

SEQ ID NO: 1156496 - protein, 6 aa, Mycobacterium
DDRNLQ

SEQ ID NO: 1156497 - protein, 6 aa, Mycobacterium
DDRPAE

SEQ ID NO: 1156498 - protein, 9 aa, Mycobacterium
DDRPAPGLV

SEQ ID NO: 1156499 - protein, 6 aa, Mycobacterium
DDRPAT

SEQ ID NO: 1156500 - protein, 4 aa, Mycobacterium
DDRR

SEQ ID NO: 1156501 - protein, 5 aa, Mycobacterium
DDRRA

SEQ ID NO: 1156502 - protein, 5 aa, Mycobacterium
DDRTA

SEQ ID NO: 1156503 - protein, 7 aa, Mycobacterium
DDRTGPD

SEQ ID NO: 1156504 - protein, 5 aa, Mycobacterium
DDSAR

SEQ ID NO: 1156505 - protein, 8 aa, Mycobacterium
DDSDEPAK

SEQ ID NO: 1156506 - protein, 10 aa, Mycobacterium
DDSDGGDDQA

SEQ ID NO: 1156507 - protein, 4 aa, Mycobacterium
DDSE

SEQ ID NO: 1156508 - protein, 7 aa, Mycobacterium
DDSEPFQ

SEQ ID NO: 1156509 - protein, 9 aa, Mycobacterium
DDSFSDGGQ

SEQ ID NO: 1156510 - protein, 8 aa, Mycobacterium
DDSGDERV

SEQ ID NO: 1156511 - protein, 6 aa, Mycobacterium
DDSLEG

SEQ ID NO: 1156512 - protein, 14 aa, Mycobacterium
DDSPAEQSDTSTDA

SEQ ID NO: 1156513 - protein, 11 aa, Mycobacterium
DDSPLRRGRPA

SEQ ID NO: 1156514 - protein, 5 aa, Mycobacterium
DDSSF

SEQ ID NO: 1156515 - protein, 5 aa, Mycobacterium
DDSST

SEQ ID NO: 1156516 - protein, 18 aa, Mycobacterium
DDSVDDPDVVRRSAWSGV

SEQ ID NO: 1156517 - protein, 4 aa, Mycobacterium
DDTA

SEQ ID NO: 1156518 - protein, 5 aa, Mycobacterium
DDTAG

SEQ ID NO: 1156519 - protein, 9 aa, Mycobacterium
DDTAPGGRA

SEQ ID NO: 1156520 - protein, 8 aa, Mycobacterium
DDTARAQL

SEQ ID NO: 1156521 - protein, 11 aa, Mycobacterium
DDTAVPPGHVP

SEQ ID NO: 1156522 - protein, 5 aa, Mycobacterium
DDTGL

SEQ ID NO: 1156523 - protein, 5 aa, Mycobacterium
DDTGT

SEQ ID NO: 1156524 - protein, 7 aa, Mycobacterium
DDTHDPT

SEQ ID NO: 1156525 - protein, 15 aa, Mycobacterium
DDTLDEAIRRLQVLR

SEQ ID NO: 1156526 - protein, 5 aa, Mycobacterium
DDTLR

SEQ ID NO: 1156527 - protein, 7 aa, Mycobacterium
DDTPEGF

SEQ ID NO: 1156528 - protein, 7 aa, Mycobacterium
DDTPFAS

SEQ ID NO: 1156529 - protein, 4 aa, Mycobacterium
DDTR

SEQ ID NO: 1156530 - protein, 5 aa, Mycobacterium
DDTRR

SEQ ID NO: 1156531 - protein, 18 aa, Mycobacterium
DDTVDGVTDTLDTTVDGL

SEQ ID NO: 1156532 - protein, 6 aa, Mycobacterium
DDTVGE

SEQ ID NO: 1156533 - protein, 5 aa, Mycobacterium
DDTVQ

SEQ ID NO: 1156534 - protein, 14 aa, Mycobacterium
DDTVTPGSGFETHP

SEQ ID NO: 1156535 - protein, 4 aa, Mycobacterium
DDVD

SEQ ID NO: 1156536 - protein, 9 aa, Mycobacterium
DDVDDGSLR

SEQ ID NO: 1156537 - protein, 10 aa, Mycobacterium
DDVDTAGERV

SEQ ID NO: 1156538 - protein, 4 aa, Mycobacterium
DDVE

SEQ ID NO: 1156539 - protein, 19 aa, Mycobacterium
DDVEKLSDAELRAKTDEFR

SEQ ID NO: 1156540 - protein, 14 aa, Mycobacterium
DDVGTSSLARGSTG

SEQ ID NO: 1156541 - protein, 6 aa, Mycobacterium
DDVPGD

SEQ ID NO: 1156542 - protein, 4 aa, Mycobacterium
DDVR

SEQ ID NO: 1156543 - protein, 6 aa, Mycobacterium
DDWDDE

SEQ ID NO: 1156544 - protein, 5 aa, Mycobacterium
DDYAE

SEQ ID NO: 1156545 - protein, 5 aa, Mycobacterium
DDYPA

SEQ ID NO: 1156546 - protein, 8 aa, Mycobacterium
DDYQGRGI

SEQ ID NO: 1156547 - protein, 11 aa, Mycobacterium
DDYSRGGRTDI

SEQ ID NO: 1156548 - protein, 4 aa, Mycobacterium
DEAA

SEQ ID NO: 1156549 - protein, 6 aa, Mycobacterium
DEAADQ

SEQ ID NO: 1156550 - protein, 5 aa, Mycobacterium
DEAAE

SEQ ID NO: 1156551 - protein, 7 aa, Mycobacterium
DEAERAQ

SEQ ID NO: 1156552 - protein, 6 aa, Mycobacterium
DEAGDV

SEQ ID NO: 1156553 - protein, 8 aa, Mycobacterium
DEAGEEAR

SEQ ID NO: 1156554 - protein, 7 aa, Mycobacterium
DEAGGDD

SEQ ID NO: 1156555 - protein, 5 aa, Mycobacterium
DEAGR

SEQ ID NO: 1156556 - protein, 4 aa, Mycobacterium
DEAI

SEQ ID NO: 1156557 - protein, 14 aa, Mycobacterium
DEAMARARKPEVYS

SEQ ID NO: 1156558 - protein, 21 aa, Mycobacterium
DEAMDTSRRRSARPRAKPPVR

SEQ ID NO: 1156559 - protein, 7 aa, Mycobacterium
DEAPHPR

SEQ ID NO: 1156560 - protein, 5 aa, Mycobacterium
DEAQE

SEQ ID NO: 1156561 - protein, 4 aa, Mycobacterium
DEAR

SEQ ID NO: 1156562 - protein, 5 aa, Mycobacterium
DEASA

SEQ ID NO: 1156563 - protein, 9 aa, Mycobacterium
DEASPNTVK

SEQ ID NO: 1156564 - protein, 4 aa, Mycobacterium
DEAT

SEQ ID NO: 1156565 - protein, 13 aa, Mycobacterium
DEATRYANERTTF

SEQ ID NO: 1156566 - protein, 13 aa, Mycobacterium
DEATSGLDPATTK

SEQ ID NO: 1156567 - protein, 23 aa, Mycobacterium
DEATSGSVSVDGRDVSRVPANKR

SEQ ID NO: 1156568 - protein, 7 aa, Mycobacterium
DEATTAD

SEQ ID NO: 1156569 - protein, 6 aa, Mycobacterium
DECSRH

SEQ ID NO: 1156570 - protein, 11 aa, Mycobacterium
DECTTAPPEPL

SEQ ID NO: 1156571 - protein, 9 aa, Mycobacterium
DEDAEDGMT

SEQ ID NO: 1156572 - protein, 9 aa, Mycobacterium
DEDAPEAER

SEQ ID NO: 1156573 - protein, 18 aa, Mycobacterium
DEDAPGPIPDVPQPSPQE

SEQ ID NO: 1156574 - protein, 7 aa, Mycobacterium
DEDAVRR

SEQ ID NO: 1156575 - protein, 17 aa, Mycobacterium
DEDGETYRVSAESPNQH

SEQ ID NO: 1156576 - protein, 7 aa, Mycobacterium
DEDGVTV

SEQ ID NO: 1156577 - protein, 7 aa, Mycobacterium
DEDLDQA

SEQ ID NO: 1156578 - protein, 7 aa, Mycobacterium
DEDPEAA

SEQ ID NO: 1156579 - protein, 5 aa, Mycobacterium
DEDPR

SEQ ID NO: 1156580 - protein, 8 aa, Mycobacterium
DEDPTLAA

SEQ ID NO: 1156581 - protein, 4 aa, Mycobacterium
DEDQ

SEQ ID NO: 1156582 - protein, 9 aa, Mycobacterium
DEDRRIAPS

SEQ ID NO: 1156583 - protein, 10 aa, Mycobacterium
DEDSDRKTAA

SEQ ID NO: 1156584 - protein, 18 aa, Mycobacterium
DEDTARGGFGDAPKFPPS

SEQ ID NO: 1156585 - protein, 10 aa, Mycobacterium
DEDTATDRPE

SEQ ID NO: 1156586 - protein, 6 aa, Mycobacterium
DEDTER

SEQ ID NO: 1156587 - protein, 4 aa, Mycobacterium
DEDV

SEQ ID NO: 1156588 - protein, 6 aa, Mycobacterium
DEEAEA

SEQ ID NO: 1156589 - protein, 15 aa, Mycobacterium
DEEKAQARATDPRAA

SEQ ID NO: 1156590 - protein, 5 aa, Mycobacterium
DEELA

SEQ ID NO: 1156591 - protein, 15 aa, Mycobacterium
DEENPGELKPQRANL

SEQ ID NO: 1156592 - protein, 15 aa, Mycobacterium
DEENRHSPPKKRRTL

SEQ ID NO: 1156593 - protein, 6 aa, Mycobacterium
DEEPRY

SEQ ID NO: 1156594 - protein, 6 aa, Mycobacterium
DEEQRE

SEQ ID NO: 1156595 - protein, 6 aa, Mycobacterium
DEERRQ

SEQ ID NO: 1156596 - protein, 6 aa, Mycobacterium
DEESGR

SEQ ID NO: 1156597 - protein, 8 aa, Mycobacterium
DEESVRAG

SEQ ID NO: 1156598 - protein, 17 aa, Mycobacterium
DEETGKKVRVSKRNGKD

SEQ ID NO: 1156599 - protein, 4 aa, Mycobacterium
DEEV

SEQ ID NO: 1156600 - protein, 8 aa, Mycobacterium
DEEVDTEL

SEQ ID NO: 1156601 - protein, 8 aa, Mycobacterium
DEFERNER

SEQ ID NO: 1156602 - protein, 4 aa, Mycobacterium
DEFT

SEQ ID NO: 1156603 - protein, 9 aa, Mycobacterium
DEGAAGGGF

SEQ ID NO: 1156604 - protein, 8 aa, Mycobacterium
DEGAEVRR

SEQ ID NO: 1156605 - protein, 6 aa, Mycobacterium
DEGDDL

SEQ ID NO: 1156606 - protein, 11 aa, Mycobacterium
DEGDGVDKRDR

SEQ ID NO: 1156607 - protein, 9 aa, Mycobacterium
DEGDPTTAE

SEQ ID NO: 1156608 - protein, 5 aa, Mycobacterium
DEGLA

SEQ ID NO: 1156609 - protein, 19 aa, Mycobacterium
DEGNGDRPITSASYVFASV

SEQ ID NO: 1156610 - protein, 8 aa, Mycobacterium
DEGPADGP

SEQ ID NO: 1156611 - protein, 20 aa, Mycobacterium
DEGPEIGGPYAPYRQSQRRD

SEQ ID NO: 1156612 - protein, 10 aa, Mycobacterium
DEGPVDPPQL

SEQ ID NO: 1156613 - protein, 11 aa, Mycobacterium
DEGQAVPEGTV

SEQ ID NO: 1156614 - protein, 6 aa, Mycobacterium
DEGQPW

SEQ ID NO: 1156615 - protein, 8 aa, Mycobacterium
DEGRIRPD

SEQ ID NO: 1156616 - protein, 6 aa, Mycobacterium
DEGRTL

SEQ ID NO: 1156617 - protein, 14 aa, Mycobacterium
DEGRTLAEAATAAL

SEQ ID NO: 1156618 - protein, 5 aa, Mycobacterium
DEGRY

SEQ ID NO: 1156619 - protein, 15 aa, Mycobacterium
DEGTRFRPDPETYTG

SEQ ID NO: 1156620 - protein, 6 aa, Mycobacterium
DEGVRA

SEQ ID NO: 1156621 - protein, 10 aa, Mycobacterium
DEGYKMSGNA

SEQ ID NO: 1156622 - protein, 14 aa, Mycobacterium
DEHANPMGSRGAGE

SEQ ID NO: 1156623 - protein, 6 aa, Mycobacterium
DEHARV

SEQ ID NO: 1156624 - protein, 5 aa, Mycobacterium
DEHEA

SEQ ID NO: 1156625 - protein, 5 aa, Mycobacterium
DEHER

SEQ ID NO: 1156626 - protein, 7 aa, Mycobacterium
DEHGATK

SEQ ID NO: 1156627 - protein, 13 aa, Mycobacterium
DEHGRPTRSRATV

SEQ ID NO: 1156628 - protein, 8 aa, Mycobacterium
DEHGTGGA

SEQ ID NO: 1156629 - protein, 19 aa, Mycobacterium
DEHHAAKDEPEPVPCPQDS

SEQ ID NO: 1156630 - protein, 7 aa, Mycobacterium
DEHHGTR

SEQ ID NO: 1156631 - protein, 10 aa, Mycobacterium
DEHPRRDTSI

SEQ ID NO: 1156632 - protein, 4 aa, Mycobacterium
DEHR

SEQ ID NO: 1156633 - protein, 5 aa, Mycobacterium
DEIGG

SEQ ID NO: 1156634 - protein, 11 aa, Mycobacterium
DEIPDPQDPQT

SEQ ID NO: 1156635 - protein, 10 aa, Mycobacterium
DEITTPGPGQ

SEQ ID NO: 1156636 - protein, 6 aa, Mycobacterium
DEKAQQ

SEQ ID NO: 1156637 - protein, 14 aa, Mycobacterium
DEKPFRRRGVGPDA

SEQ ID NO: 1156638 - protein, 7 aa, Mycobacterium
DEKTGKP

SEQ ID NO: 1156639 - protein, 10 aa, Mycobacterium
DEKTTTTSTS

SEQ ID NO: 1156640 - protein, 6 aa, Mycobacterium
DEKYGQ

SEQ ID NO: 1156641 - protein, 5 aa, Mycobacterium
DELAE

SEQ ID NO: 1156642 - protein, 8 aa, Mycobacterium
DELAEAER

SEQ ID NO: 1156643 - protein, 8 aa, Mycobacterium
DELDSDTS

SEQ ID NO: 1156644 - protein, 12 aa, Mycobacterium
DELEGRTPEQSA

SEQ ID NO: 1156645 - protein, 5 aa, Mycobacterium
DELGP

SEQ ID NO: 1156646 - protein, 7 aa, Mycobacterium
DELGRSN

SEQ ID NO: 1156647 - protein, 8 aa, Mycobacterium
DELPDRPV

SEQ ID NO: 1156648 - protein, 5 aa, Mycobacterium
DELPI

SEQ ID NO: 1156649 - protein, 6 aa, Mycobacterium
DELPPG

SEQ ID NO: 1156650 - protein, 5 aa, Mycobacterium
DELQA

SEQ ID NO: 1156651 - protein, 5 aa, Mycobacterium
DELQQ

SEQ ID NO: 1156652 - protein, 4 aa, Mycobacterium
DELR

SEQ ID NO: 1156653 - protein, 12 aa, Mycobacterium
DELRGEARAVTT

SEQ ID NO: 1156654 - protein, 8 aa, Mycobacterium
DELRGGEL

SEQ ID NO: 1156655 - protein, 8 aa, Mycobacterium
DELTRPET

SEQ ID NO: 1156656 - protein, 10 aa, Mycobacterium
DENATGTRRE

SEQ ID NO: 1156657 - protein, 16 aa, Mycobacterium
DENDEEAAGAVREDEV

SEQ ID NO: 1156658 - protein, 28 aa, Mycobacterium
DENGAEVKAAEGAAPADPAGDGKATCPP

SEQ ID NO: 1156659 - protein, 6 aa, Mycobacterium
DENGHV

SEQ ID NO: 1156660 - protein, 26 aa, Mycobacterium
DENGNDLPGVTTSDCDYKGGLPGVDN

SEQ ID NO: 1156661 - protein, 7 aa, Mycobacterium
DENPPYR

SEQ ID NO: 1156662 - protein, 6 aa, Mycobacterium
DEPDDV

SEQ ID NO: 1156663 - protein, 8 aa, Mycobacterium
DEPDTTAR

SEQ ID NO: 1156664 - protein, 5 aa, Mycobacterium
DEPDY

SEQ ID NO: 1156665 - protein, 7 aa, Mycobacterium
DEPGAVD

SEQ ID NO: 1156666 - protein, 11 aa, Mycobacterium
DEPGGGAETTV

SEQ ID NO: 1156667 - protein, 16 aa, Mycobacterium
DEPGPPVGGPTAYPAD

SEQ ID NO: 1156668 - protein, 5 aa, Mycobacterium
DEPLD

SEQ ID NO: 1156669 - protein, 15 aa, Mycobacterium
DEPPRDGAGYRRYGS

SEQ ID NO: 1156670 - protein, 5 aa, Mycobacterium
DEPPS

SEQ ID NO: 1156671 - protein, 5 aa, Mycobacterium
DEPPT

SEQ ID NO: 1156672 - protein, 7 aa, Mycobacterium
DEPRASR

SEQ ID NO: 1156673 - protein, 7 aa, Mycobacterium
DEPTGVV

SEQ ID NO: 1156674 - protein, 6 aa, Mycobacterium
DEPTTA

SEQ ID NO: 1156675 - protein, 23 aa, Mycobacterium
DEPVPQADPRQPWPGQLPEPSPA

SEQ ID NO: 1156676 - protein, 8 aa, Mycobacterium
DEQESDDD

SEQ ID NO: 1156677 - protein, 6 aa, Mycobacterium
DEQGRV

SEQ ID NO: 1156678 - protein, 13 aa, Mycobacterium
DEQHAADERASRR

SEQ ID NO: 1156679 - protein, 5 aa, Mycobacterium
DEQHH

SEQ ID NO: 1156680 - protein, 21 aa, Mycobacterium
DEQNAKDPDFKPMATDPDSSI

SEQ ID NO: 1156681 - protein, 6 aa, Mycobacterium
DEQPSH

SEQ ID NO: 1156682 - protein, 6 aa, Mycobacterium
DEQRKQ

SEQ ID NO: 1156683 - protein, 7 aa, Mycobacterium
DEQRPKL

SEQ ID NO: 1156684 - protein, 5 aa, Mycobacterium
DEQTT

SEQ ID NO: 1156685 - protein, 7 aa, Mycobacterium
DERATPP

SEQ ID NO: 1156686 - protein, 8 aa, Mycobacterium
DERDASIA

SEQ ID NO: 1156687 - protein, 7 aa, Mycobacterium
DERDDGV

SEQ ID NO: 1156688 - protein, 10 aa, Mycobacterium
DERDGAGVPR

SEQ ID NO: 1156689 - protein, 19 aa, Mycobacterium
DERDPRAPEDPGGLGDGAR

SEQ ID NO: 1156690 - protein, 13 aa, Mycobacterium
DERESSAPADELE

SEQ ID NO: 1156691 - protein, 9 aa, Mycobacterium
DERGNDATR

SEQ ID NO: 1156692 - protein, 10 aa, Mycobacterium
DERGNPDTTL

SEQ ID NO: 1156693 - protein, 18 aa, Mycobacterium
DERIDPDDGIAAVLRYAL

SEQ ID NO: 1156694 - protein, 8 aa, Mycobacterium
DERKETSA

SEQ ID NO: 1156695 - protein, 4 aa, Mycobacterium
DERL

SEQ ID NO: 1156696 - protein, 13 aa, Mycobacterium
DERLDDGTDSDTP

SEQ ID NO: 1156697 - protein, 9 aa, Mycobacterium
DERPDEDSF

SEQ ID NO: 1156698 - protein, 19 aa, Mycobacterium
DERPEVTTRRDDGRPVNGF

SEQ ID NO: 1156699 - protein, 9 aa, Mycobacterium
DERRGKLTP

SEQ ID NO: 1156700 - protein, 8 aa, Mycobacterium
DERSAGAV

SEQ ID NO: 1156701 - protein, 19 aa, Mycobacterium
DERSGTIPHTDGRIDGRRN

SEQ ID NO: 1156702 - protein, 7 aa, Mycobacterium
DERSRVG

SEQ ID NO: 1156703 - protein, 8 aa, Mycobacterium
DERTERAE

SEQ ID NO: 1156704 - protein, 6 aa, Mycobacterium
DERVPS

SEQ ID NO: 1156705 - protein, 7 aa, Mycobacterium
DESDEDN

SEQ ID NO: 1156706 - protein, 9 aa, Mycobacterium
DESDREALR

SEQ ID NO: 1156707 - protein, 8 aa, Mycobacterium
DESETAEN

SEQ ID NO: 1156708 - protein, 5 aa, Mycobacterium
DESGA

SEQ ID NO: 1156709 - protein, 10 aa, Mycobacterium
DESGASATHR

SEQ ID NO: 1156710 - protein, 10 aa, Mycobacterium
DESGREGTSV

SEQ ID NO: 1156711 - protein, 6 aa, Mycobacterium
DESLGG

SEQ ID NO: 1156712 - protein, 7 aa, Mycobacterium
DESQTAG

SEQ ID NO: 1156713 - protein, 15 aa, Mycobacterium
DESRAGHLNGKIVIV

SEQ ID NO: 1156714 - protein, 5 aa, Mycobacterium
DESRE

SEQ ID NO: 1156715 - protein, 10 aa, Mycobacterium
DESSPTVGGP

SEQ ID NO: 1156716 - protein, 16 aa, Mycobacterium
DESSTTRLVRLRLPAD

SEQ ID NO: 1156717 - protein, 4 aa, Mycobacterium
DETA

SEQ ID NO: 1156718 - protein, 6 aa, Mycobacterium
DETEDK

SEQ ID NO: 1156719 - protein, 7 aa, Mycobacterium
DETERDV

SEQ ID NO: 1156720 - protein, 9 aa, Mycobacterium
DETGGYPHP

SEQ ID NO: 1156721 - protein, 7 aa, Mycobacterium
DETGRSV

SEQ ID NO: 1156722 - protein, 6 aa, Mycobacterium
DETGTV

SEQ ID NO: 1156723 - protein, 5 aa, Mycobacterium
DETLT

SEQ ID NO: 1156724 - protein, 19 aa, Mycobacterium
DETNSELAEAKAAAGQELN

SEQ ID NO: 1156725 - protein, 6 aa, Mycobacterium
DETPGQ

SEQ ID NO: 1156726 - protein, 10 aa, Mycobacterium
DETRSTGRSR

SEQ ID NO: 1156727 - protein, 16 aa, Mycobacterium
DETTIVEGAGDAEAIQ

SEQ ID NO: 1156728 - protein, 12 aa, Mycobacterium
DEVADKVRQSDR

SEQ ID NO: 1156729 - protein, 8 aa, Mycobacterium
DEVASGAN

SEQ ID NO: 1156730 - protein, 13 aa, Mycobacterium
DEVELGSRNERPM

SEQ ID NO: 1156731 - protein, 15 aa, Mycobacterium
DEVEVSASAELESDV

SEQ ID NO: 1156732 - protein, 6 aa, Mycobacterium
DEVGAT

SEQ ID NO: 1156733 - protein, 7 aa, Mycobacterium
DEVGRGA

SEQ ID NO: 1156734 - protein, 5 aa, Mycobacterium
DEVPD

SEQ ID NO: 1156735 - protein, 4 aa, Mycobacterium
DEVR

SEQ ID NO: 1156736 - protein, 5 aa, Mycobacterium
DEVRR

SEQ ID NO: 1156737 - protein, 5 aa, Mycobacterium
DEVRT

SEQ ID NO: 1156738 - protein, 21 aa, Mycobacterium
DEVSGTLGSSRADAAVTDDAR

SEQ ID NO: 1156739 - protein, 6 aa, Mycobacterium
DEVSPA

SEQ ID NO: 1156740 - protein, 7 aa, Mycobacterium
DEVSSET

SEQ ID NO: 1156741 - protein, 6 aa, Mycobacterium
DEVTAA

SEQ ID NO: 1156742 - protein, 13 aa, Mycobacterium
DEVVPDSATAFDD

SEQ ID NO: 1156743 - protein, 9 aa, Mycobacterium
DEWDDGPRT

SEQ ID NO: 1156744 - protein, 4 aa, Mycobacterium
DEWK

SEQ ID NO: 1156745 - protein, 4 aa, Mycobacterium
DEYA

SEQ ID NO: 1156746 - protein, 13 aa, Mycobacterium
DEYDEANSMDDYD

SEQ ID NO: 1156747 - protein, 9 aa, Mycobacterium
DEYGPHPQG

SEQ ID NO: 1156748 - protein, 7 aa, Mycobacterium
DEYRTGV

SEQ ID NO: 1156749 - protein, 9 aa, Mycobacterium
DEYSARSHE

SEQ ID NO: 1156750 - protein, 5 aa, Mycobacterium
DFDAA

SEQ ID NO: 1156751 - protein, 6 aa, Mycobacterium
DFDEDA

SEQ ID NO: 1156752 - protein, 7 aa, Mycobacterium
DFDNDEA

SEQ ID NO: 1156753 - protein, 28 aa, Mycobacterium
DFDPDAPFTRADTQKLRGTGNRKPDVHG

SEQ ID NO: 1156754 - protein, 5 aa, Mycobacterium
DFGAR

SEQ ID NO: 1156755 - protein, 7 aa, Mycobacterium
DFGDDHS

SEQ ID NO: 1156756 - protein, 11 aa, Mycobacterium
DFGDGKPHTVN

SEQ ID NO: 1156757 - protein, 4 aa, Mycobacterium
DFGG

SEQ ID NO: 1156758 - protein, 7 aa, Mycobacterium
DFGGRTG

SEQ ID NO: 1156759 - protein, 6 aa, Mycobacterium
DFHPPE

SEQ ID NO: 1156760 - protein, 6 aa, Mycobacterium
DFPAPN

SEQ ID NO: 1156761 - protein, 6 aa, Mycobacterium
DFPEPG

SEQ ID NO: 1156762 - protein, 4 aa, Mycobacterium
DFPP

SEQ ID NO: 1156763 - protein, 8 aa, Mycobacterium
DFRAPADE

SEQ ID NO: 1156764 - protein, 4 aa, Mycobacterium
DFRE

SEQ ID NO: 1156765 - protein, 25 aa, Mycobacterium
DFSDGSDSTDAVDATNPSDRPTPNP

SEQ ID NO: 1156766 - protein, 5 aa, Mycobacterium
DFSER

SEQ ID NO: 1156767 - protein, 16 aa, Mycobacterium
DFSSGAGRHLYFYLER

SEQ ID NO: 1156768 - protein, 11 aa, Mycobacterium
DFTDEGERYRH

SEQ ID NO: 1156769 - protein, 4 aa, Mycobacterium
DFTE

SEQ ID NO: 1156770 - protein, 4 aa, Mycobacterium
DGAA

SEQ ID NO: 1156771 - protein, 10 aa, Mycobacterium
DGAADEATDD

SEQ ID NO: 1156772 - protein, 10 aa, Mycobacterium
DGAADLERGS

SEQ ID NO: 1156773 - protein, 7 aa, Mycobacterium
DGAADRP

SEQ ID NO: 1156774 - protein, 11 aa, Mycobacterium
DGAADTGHADD

SEQ ID NO: 1156775 - protein, 9 aa, Mycobacterium
DGAAEADLG

SEQ ID NO: 1156776 - protein, 7 aa, Mycobacterium
DGAAELD

SEQ ID NO: 1156777 - protein, 8 aa, Mycobacterium
DGAAQFGT

SEQ ID NO: 1156778 - protein, 7 aa, Mycobacterium
DGAASAV

SEQ ID NO: 1156779 - protein, 6 aa, Mycobacterium
DGADGA

SEQ ID NO: 1156780 - protein, 5 aa, Mycobacterium
DGADI

SEQ ID NO: 1156781 - protein, 7 aa, Mycobacterium
DGADKFD

SEQ ID NO: 1156782 - protein, 9 aa, Mycobacterium
DGADPELGA

SEQ ID NO: 1156783 - protein, 9 aa, Mycobacterium
DGAEEVTQE

SEQ ID NO: 1156784 - protein, 6 aa, Mycobacterium
DGAEFH

SEQ ID NO: 1156785 - protein, 5 aa, Mycobacterium
DGAEK

SEQ ID NO: 1156786 - protein, 10 aa, Mycobacterium
DGAESVNNRP

SEQ ID NO: 1156787 - protein, 10 aa, Mycobacterium
DGAGAPGEKT

SEQ ID NO: 1156788 - protein, 6 aa, Mycobacterium
DGAGAV

SEQ ID NO: 1156789 - protein, 9 aa, Mycobacterium
DGAGENAPA

SEQ ID NO: 1156790 - protein, 7 aa, Mycobacterium
DGAGNSV

SEQ ID NO: 1156791 - protein, 11 aa, Mycobacterium
DGAGPEGTDVP

SEQ ID NO: 1156792 - protein, 12 aa, Mycobacterium
DGAGTAATGSYA

SEQ ID NO: 1156793 - protein, 8 aa, Mycobacterium
DGAGVLDP

SEQ ID NO: 1156794 - protein, 7 aa, Mycobacterium
DGAHSTV

SEQ ID NO: 1156795 - protein, 5 aa, Mycobacterium
DGAKF

SEQ ID NO: 1156796 - protein, 10 aa, Mycobacterium
DGAPRHSTDA

SEQ ID NO: 1156797 - protein, 17 aa, Mycobacterium
DGAQKVADGIKGEGGNA

SEQ ID NO: 1156798 - protein, 7 aa, Mycobacterium
DGAREAM

SEQ ID NO: 1156799 - protein, 6 aa, Mycobacterium
DGARRA

SEQ ID NO: 1156800 - protein, 11 aa, Mycobacterium
DGASAYGNKMT

SEQ ID NO: 1156801 - protein, 13 aa, Mycobacterium
DGASTEHTPEAFD

SEQ ID NO: 1156802 - protein, 16 aa, Mycobacterium
DGATEIGGSIPVNTDG

SEQ ID NO: 1156803 - protein, 7 aa, Mycobacterium
DGATLRA

SEQ ID NO: 1156804 - protein, 9 aa, Mycobacterium
DGATSEGDV

SEQ ID NO: 1156805 - protein, 12 aa, Mycobacterium
DGAVDDAARECA

SEQ ID NO: 1156806 - protein, 10 aa, Mycobacterium
DGAYGEAKAS

SEQ ID NO: 1156807 - protein, 4 aa, Mycobacterium
DGCG

SEQ ID NO: 1156808 - protein, 7 aa, Mycobacterium
DGCGSTH

SEQ ID NO: 1156809 - protein, 7 aa, Mycobacterium
DGDAAAA

SEQ ID NO: 1156810 - protein, 7 aa, Mycobacterium
DGDAASD

SEQ ID NO: 1156811 - protein, 8 aa, Mycobacterium
DGDATAVN

SEQ ID NO: 1156812 - protein, 9 aa, Mycobacterium
DGDDADRVD

SEQ ID NO: 1156813 - protein, 8 aa, Mycobacterium
DGDDLPAA

SEQ ID NO: 1156814 - protein, 6 aa, Mycobacterium
DGDDRV

SEQ ID NO: 1156815 - protein, 8 aa, Mycobacterium
DGDEAHAE

SEQ ID NO: 1156816 - protein, 8 aa, Mycobacterium
DGDEKDTE

SEQ ID NO: 1156817 - protein, 5 aa, Mycobacterium
DGDFR

SEQ ID NO: 1156818 - protein, 20 aa, Mycobacterium
DGDGRVDDALADRDGDGLAE

SEQ ID NO: 1156819 - protein, 7 aa, Mycobacterium
DGDGRYI

SEQ ID NO: 1156820 - protein, 5 aa, Mycobacterium
DGDHP

SEQ ID NO: 1156821 - protein, 8 aa, Mycobacterium
DGDMPDGV

SEQ ID NO: 1156822 - protein, 4 aa, Mycobacterium
DGDP

SEQ ID NO: 1156823 - protein, 7 aa, Mycobacterium
DGDPKYA

SEQ ID NO: 1156824 - protein, 6 aa, Mycobacterium
DGDPLG

SEQ ID NO: 1156825 - protein, 7 aa, Mycobacterium
DGDPSNV

SEQ ID NO: 1156826 - protein, 8 aa, Mycobacterium
DGDPTPVR

SEQ ID NO: 1156827 - protein, 7 aa, Mycobacterium
DGDPVEA

SEQ ID NO: 1156828 - protein, 8 aa, Mycobacterium
DGDREIAG

SEQ ID NO: 1156829 - protein, 6 aa, Mycobacterium
DGDRGG

SEQ ID NO: 1156830 - protein, 5 aa, Mycobacterium
DGDRI

SEQ ID NO: 1156831 - protein, 6 aa, Mycobacterium
DGDRLT

SEQ ID NO: 1156832 - protein, 8 aa, Mycobacterium
DGDRLTDE

SEQ ID NO: 1156833 - protein, 9 aa, Mycobacterium
DGDRTSARA

SEQ ID NO: 1156834 - protein, 7 aa, Mycobacterium
DGDRVTT

SEQ ID NO: 1156835 - protein, 24 aa, Mycobacterium
DGDSGDPVRDEKGRVKKVRTGEPG

SEQ ID NO: 1156836 - protein, 5 aa, Mycobacterium
DGDSL

SEQ ID NO: 1156837 - protein, 9 aa, Mycobacterium
DGDTASARS

SEQ ID NO: 1156838 - protein, 20 aa, Mycobacterium
DGDTCRSRTLPSTYAKPREL

SEQ ID NO: 1156839 - protein, 11 aa, Mycobacterium
DGDTEVRSATA

SEQ ID NO: 1156840 - protein, 7 aa, Mycobacterium
DGDTRNV

SEQ ID NO: 1156841 - protein, 7 aa, Mycobacterium
DGDTYTA

SEQ ID NO: 1156842 - protein, 8 aa, Mycobacterium
DGDYRGGF

SEQ ID NO: 1156843 - protein, 9 aa, Mycobacterium
DGEAETGPL

SEQ ID NO: 1156844 - protein, 5 aa, Mycobacterium
DGEAG

SEQ ID NO: 1156845 - protein, 6 aa, Mycobacterium
DGEAGR

SEQ ID NO: 1156846 - protein, 10 aa, Mycobacterium
DGEGTADETV

SEQ ID NO: 1156847 - protein, 7 aa, Mycobacterium
DGEHSAE

SEQ ID NO: 1156848 - protein, 7 aa, Mycobacterium
DGEKQAA

SEQ ID NO: 1156849 - protein, 4 aa, Mycobacterium
DGEL

SEQ ID NO: 1156850 - protein, 5 aa, Mycobacterium
DGEPD

SEQ ID NO: 1156851 - protein, 6 aa, Mycobacterium
DGEPHS

SEQ ID NO: 1156852 - protein, 7 aa, Mycobacterium
DGEPMSD

SEQ ID NO: 1156853 - protein, 7 aa, Mycobacterium
DGEPVGD

SEQ ID NO: 1156854 - protein, 6 aa, Mycobacterium
DGEPVK

SEQ ID NO: 1156855 - protein, 9 aa, Mycobacterium
DGEPVPGTF

SEQ ID NO: 1156856 - protein, 7 aa, Mycobacterium
DGEQAYP

SEQ ID NO: 1156857 - protein, 19 aa, Mycobacterium
DGERARAKEKYAAALRGDG

SEQ ID NO: 1156858 - protein, 7 aa, Mycobacterium
DGERDTL

SEQ ID NO: 1156859 - protein, 13 aa, Mycobacterium
DGERGRARAQREM

SEQ ID NO: 1156860 - protein, 11 aa, Mycobacterium
DGETKNRTTIG

SEQ ID NO: 1156861 - protein, 5 aa, Mycobacterium
DGETL

SEQ ID NO: 1156862 - protein, 13 aa, Mycobacterium
DGETSDVPPDDVR

SEQ ID NO: 1156863 - protein, 6 aa, Mycobacterium
DGEVRR

SEQ ID NO: 1156864 - protein, 7 aa, Mycobacterium
DGEVSDE

SEQ ID NO: 1156865 - protein, 19 aa, Mycobacterium
DGFTTPHESGLSSEDAAEL

SEQ ID NO: 1156866 - protein, 14 aa, Mycobacterium
DGGAAGPLAGRHGA

SEQ ID NO: 1156867 - protein, 6 aa, Mycobacterium
DGGANR

SEQ ID NO: 1156868 - protein, 11 aa, Mycobacterium
DGGATGEDKAF

SEQ ID NO: 1156869 - protein, 19 aa, Mycobacterium
DGGATVAGRSGGLGAAGDR

SEQ ID NO: 1156870 - protein, 7 aa, Mycobacterium
DGGAVPT

SEQ ID NO: 1156871 - protein, 5 aa, Mycobacterium
DGGDD

SEQ ID NO: 1156872 - protein, 10 aa, Mycobacterium
DGGDRNTGTI

SEQ ID NO: 1156873 - protein, 6 aa, Mycobacterium
DGGEES

SEQ ID NO: 1156874 - protein, 5 aa, Mycobacterium
DGGFE

SEQ ID NO: 1156875 - protein, 7 aa, Mycobacterium
DGGGRRI

SEQ ID NO: 1156876 - protein, 5 aa, Mycobacterium
DGGGS

SEQ ID NO: 1156877 - protein, 15 aa, Mycobacterium
DGGGSADAIADRAKQ

SEQ ID NO: 1156878 - protein, 5 aa, Mycobacterium
DGGGT

SEQ ID NO: 1156879 - protein, 7 aa, Mycobacterium
DGGPADV

SEQ ID NO: 1156880 - protein, 10 aa, Mycobacterium
DGGPDEDAHF

SEQ ID NO: 1156881 - protein, 4 aa, Mycobacterium
DGGR

SEQ ID NO: 1156882 - protein, 8 aa, Mycobacterium
DGGRATNV

SEQ ID NO: 1156883 - protein, 10 aa, Mycobacterium
DGGRDDPRAG

SEQ ID NO: 1156884 - protein, 8 aa, Mycobacterium
DGGRSATR

SEQ ID NO: 1156885 - protein, 7 aa, Mycobacterium
DGGRSTV

SEQ ID NO: 1156886 - protein, 9 aa, Mycobacterium
DGGSEYEIN

SEQ ID NO: 1156887 - protein, 6 aa, Mycobacterium
DGGTDL

SEQ ID NO: 1156888 - protein, 8 aa, Mycobacterium
DGGTHAAG

SEQ ID NO: 1156889 - protein, 7 aa, Mycobacterium
DGGTRPY

SEQ ID NO: 1156890 - protein, 11 aa, Mycobacterium
DGGTSYRPGAR

SEQ ID NO: 1156891 - protein, 5 aa, Mycobacterium
DGGVG

SEQ ID NO: 1156892 - protein, 5 aa, Mycobacterium
DGGVR

SEQ ID NO: 1156893 - protein, 7 aa, Mycobacterium
DGGYSQR

SEQ ID NO: 1156894 - protein, 7 aa, Mycobacterium
DGGYVDD

SEQ ID NO: 1156895 - protein, 6 aa, Mycobacterium
DGHDEV

SEQ ID NO: 1156896 - protein, 6 aa, Mycobacterium
DGHEHA

SEQ ID NO: 1156897 - protein, 8 aa, Mycobacterium
DGHGATLQ

SEQ ID NO: 1156898 - protein, 16 aa, Mycobacterium
DGHGDLATARAAARTG

SEQ ID NO: 1156899 - protein, 6 aa, Mycobacterium
DGHPEN

SEQ ID NO: 1156900 - protein, 13 aa, Mycobacterium
DGHPNRPEPRKRP

SEQ ID NO: 1156901 - protein, 7 aa, Mycobacterium
DGHTETV

SEQ ID NO: 1156902 - protein, 5 aa, Mycobacterium
DGHTR

SEQ ID NO: 1156903 - protein, 15 aa, Mycobacterium
DGHWSASPREGETVR

SEQ ID NO: 1156904 - protein, 7 aa, Mycobacterium
DGIATGA

SEQ ID NO: 1156905 - protein, 6 aa, Mycobacterium
DGIDAT

SEQ ID NO: 1156906 - protein, 7 aa, Mycobacterium
DGIEGEE

SEQ ID NO: 1156907 - protein, 6 aa, Mycobacterium
DGIGPE

SEQ ID NO: 1156908 - protein, 5 aa, Mycobacterium
DGITP

SEQ ID NO: 1156909 - protein, 9 aa, Mycobacterium
DGKANVLSP

SEQ ID NO: 1156910 - protein, 9 aa, Mycobacterium
DGKATTHPI

SEQ ID NO: 1156911 - protein, 8 aa, Mycobacterium
DGKGEGHE

SEQ ID NO: 1156912 - protein, 8 aa, Mycobacterium
DGKGITSR

SEQ ID NO: 1156913 - protein, 11 aa, Mycobacterium
DGKPNAVTPAH

SEQ ID NO: 1156914 - protein, 7 aa, Mycobacterium
DGKPPVG

SEQ ID NO: 1156915 - protein, 7 aa, Mycobacterium
DGKTTFG

SEQ ID NO: 1156916 - protein, 13 aa, Mycobacterium
DGKVTGERETDDG

SEQ ID NO: 1156917 - protein, 4 aa, Mycobacterium
DGKW

SEQ ID NO: 1156918 - protein, 6 aa, Mycobacterium
DGLAAY

SEQ ID NO: 1156919 - protein, 12 aa, Mycobacterium
DGLADEARRDDL

SEQ ID NO: 1156920 - protein, 23 aa, Mycobacterium
DGLDDDDDLLDPDRAAATVRARA

SEQ ID NO: 1156921 - protein, 9 aa, Mycobacterium
DGLDDEEIE

SEQ ID NO: 1156922 - protein, 9 aa, Mycobacterium
DGLDGAGHT

SEQ ID NO: 1156923 - protein, 7 aa, Mycobacterium
DGLERSG

SEQ ID NO: 1156924 - protein, 5 aa, Mycobacterium
DGLES

SEQ ID NO: 1156925 - protein, 11 aa, Mycobacterium
DGLGDKAPVPV

SEQ ID NO: 1156926 - protein, 18 aa, Mycobacterium
DGLPQDVSDEELSAHPDL

SEQ ID NO: 1156927 - protein, 10 aa, Mycobacterium
DGLRAEREQG

SEQ ID NO: 1156928 - protein, 8 aa, Mycobacterium
DGLRPERK

SEQ ID NO: 1156929 - protein, 7 aa, Mycobacterium
DGLRRTV

SEQ ID NO: 1156930 - protein, 4 aa, Mycobacterium
DGLS

SEQ ID NO: 1156931 - protein, 18 aa, Mycobacterium
DGLSGSQLAERARRQAEK

SEQ ID NO: 1156932 - protein, 9 aa, Mycobacterium
DGLTEDEKR

SEQ ID NO: 1156933 - protein, 8 aa, Mycobacterium
DGLTNQEI

SEQ ID NO: 1156934 - protein, 8 aa, Mycobacterium
DGMSEQEA

SEQ ID NO: 1156935 - protein, 11 aa, Mycobacterium
DGNELPPGQAG

SEQ ID NO: 1156936 - protein, 19 aa, Mycobacterium
DGNGECAATVDTTGNLPGR

SEQ ID NO: 1156937 - protein, 6 aa, Mycobacterium
DGNPEA

SEQ ID NO: 1156938 - protein, 6 aa, Mycobacterium
DGNTLD

SEQ ID NO: 1156939 - protein, 12 aa, Mycobacterium
DGPADAAAAREA

SEQ ID NO: 1156940 - protein, 7 aa, Mycobacterium
DGPADGE

SEQ ID NO: 1156941 - protein, 6 aa, Mycobacterium
DGPAGL

SEQ ID NO: 1156942 - protein, 10 aa, Mycobacterium
DGPAPDPVTR

SEQ ID NO: 1156943 - protein, 9 aa, Mycobacterium
DGPCTQNGE

SEQ ID NO: 1156944 - protein, 8 aa, Mycobacterium
DGPDPECV

SEQ ID NO: 1156945 - protein, 9 aa, Mycobacterium
DGPEPGATD

SEQ ID NO: 1156946 - protein, 8 aa, Mycobacterium
DGPEPVGY

SEQ ID NO: 1156947 - protein, 5 aa, Mycobacterium
DGPEV

SEQ ID NO: 1156948 - protein, 10 aa, Mycobacterium
DGPFADTKER

SEQ ID NO: 1156949 - protein, 6 aa, Mycobacterium
DGPGAA

SEQ ID NO: 1156950 - protein, 12 aa, Mycobacterium
DGPGPSRRRGAD

SEQ ID NO: 1156951 - protein, 12 aa, Mycobacterium
DGPGQGTGPPVL

SEQ ID NO: 1156952 - protein, 5 aa, Mycobacterium
DGPGR

SEQ ID NO: 1156953 - protein, 7 aa, Mycobacterium
DGPGVGV

SEQ ID NO: 1156954 - protein, 4 aa, Mycobacterium
DGPH

SEQ ID NO: 1156955 - protein, 6 aa, Mycobacterium
DGPHGG

SEQ ID NO: 1156956 - protein, 5 aa, Mycobacterium
DGPKR

SEQ ID NO: 1156957 - protein, 7 aa, Mycobacterium
DGPLPRR

SEQ ID NO: 1156958 - protein, 9 aa, Mycobacterium
DGPNGPKLL

SEQ ID NO: 1156959 - protein, 5 aa, Mycobacterium
DGPQH

SEQ ID NO: 1156960 - protein, 5 aa, Mycobacterium
DGPQR

SEQ ID NO: 1156961 - protein, 16 aa, Mycobacterium
DGPQRTKSVVVLRPAT

SEQ ID NO: 1156962 - protein, 8 aa, Mycobacterium
DGPRAQGG

SEQ ID NO: 1156963 - protein, 7 aa, Mycobacterium
DGPRGAA

SEQ ID NO: 1156964 - protein, 6 aa, Mycobacterium
DGPTEV

SEQ ID NO: 1156965 - protein, 8 aa, Mycobacterium
DGPTPPQR

SEQ ID NO: 1156966 - protein, 7 aa, Mycobacterium
DGPTSTM

SEQ ID NO: 1156967 - protein, 4 aa, Mycobacterium
DGPV

SEQ ID NO: 1156968 - protein, 6 aa, Mycobacterium
DGPVDF

SEQ ID NO: 1156969 - protein, 8 aa, Mycobacterium
DGPVPDDD

SEQ ID NO: 1156970 - protein, 5 aa, Mycobacterium
DGQEG

SEQ ID NO: 1156971 - protein, 11 aa, Mycobacterium
DGQEQTQGGST

SEQ ID NO: 1156972 - protein, 7 aa, Mycobacterium
DGQEVTT

SEQ ID NO: 1156973 - protein, 8 aa, Mycobacterium
DGQGPDVS

SEQ ID NO: 1156974 - protein, 9 aa, Mycobacterium
DGQGRRDTF

SEQ ID NO: 1156975 - protein, 4 aa, Mycobacterium
DGQH

SEQ ID NO: 1156976 - protein, 5 aa, Mycobacterium
DGQIG

SEQ ID NO: 1156977 - protein, 11 aa, Mycobacterium
DGQKLGPDTSI

SEQ ID NO: 1156978 - protein, 4 aa, Mycobacterium
DGQL

SEQ ID NO: 1156979 - protein, 16 aa, Mycobacterium
DGQLADGENTETDQAG

SEQ ID NO: 1156980 - protein, 5 aa, Mycobacterium
DGQPV

SEQ ID NO: 1156981 - protein, 5 aa, Mycobacterium
DGQRF

SEQ ID NO: 1156982 - protein, 8 aa, Mycobacterium
DGQTDEEI

SEQ ID NO: 1156983 - protein, 10 aa, Mycobacterium
DGQTRETRSV

SEQ ID NO: 1156984 - protein, 8 aa, Mycobacterium
DGQVGPRP

SEQ ID NO: 1156985 - protein, 6 aa, Mycobacterium
DGQYAA

SEQ ID NO: 1156986 - protein, 26 aa, Mycobacterium
DGQYRRGKAASLKDAVDEAVDGQPSI

SEQ ID NO: 1156987 - protein, 9 aa, Mycobacterium
DGRAAEAQG

SEQ ID NO: 1156988 - protein, 8 aa, Mycobacterium
DGRAGGSY

SEQ ID NO: 1156989 - protein, 10 aa, Mycobacterium
DGRAGNRRTV

SEQ ID NO: 1156990 - protein, 6 aa, Mycobacterium
DGRAPA

SEQ ID NO: 1156991 - protein, 11 aa, Mycobacterium
DGRAPATEGQF

SEQ ID NO: 1156992 - protein, 8 aa, Mycobacterium
DGRATLDG

SEQ ID NO: 1156993 - protein, 5 aa, Mycobacterium
DGRAV

SEQ ID NO: 1156994 - protein, 18 aa, Mycobacterium
DGRDDRAVPPPADPARAE

SEQ ID NO: 1156995 - protein, 6 aa, Mycobacterium
DGRDHD

SEQ ID NO: 1156996 - protein, 14 aa, Mycobacterium
DGRDLTPRPGGGLR

SEQ ID NO: 1156997 - protein, 16 aa, Mycobacterium
DGRDPWAESMPAPQRL

SEQ ID NO: 1156998 - protein, 7 aa, Mycobacterium
DGRDREI

SEQ ID NO: 1156999 - protein, 6 aa, Mycobacterium
DGREEQ

SEQ ID NO: 1157000 - protein, 9 aa, Mycobacterium
DGRGGSREI

SEQ ID NO: 1157001 - protein, 6 aa, Mycobacterium
DGRGLS

SEQ ID NO: 1157002 - protein, 10 aa, Mycobacterium
DGRGPGTAPA

SEQ ID NO: 1157003 - protein, 7 aa, Mycobacterium
DGRGRAR

SEQ ID NO: 1157004 - protein, 7 aa, Mycobacterium
DGRGVED

SEQ ID NO: 1157005 - protein, 9 aa, Mycobacterium
DGRKNGKQL

SEQ ID NO: 1157006 - protein, 8 aa, Mycobacterium
DGRLPTAD

SEQ ID NO: 1157007 - protein, 10 aa, Mycobacterium
DGRLSPGTRL

SEQ ID NO: 1157008 - protein, 5 aa, Mycobacterium
DGRNW

SEQ ID NO: 1157009 - protein, 7 aa, Mycobacterium
DGRPAAD

SEQ ID NO: 1157010 - protein, 8 aa, Mycobacterium
DGRPEPVY

SEQ ID NO: 1157011 - protein, 6 aa, Mycobacterium
DGRPLG

SEQ ID NO: 1157012 - protein, 6 aa, Mycobacterium
DGRRAT

SEQ ID NO: 1157013 - protein, 11 aa, Mycobacterium
DGRRAVDAGAA

SEQ ID NO: 1157014 - protein, 12 aa, Mycobacterium
DGRSGDPRIPET

SEQ ID NO: 1157015 - protein, 6 aa, Mycobacterium
DGRSIG

SEQ ID NO: 1157016 - protein, 7 aa, Mycobacterium
DGRSSAT

SEQ ID NO: 1157017 - protein, 4 aa, Mycobacterium
DGRT

SEQ ID NO: 1157018 - protein, 7 aa, Mycobacterium
DGRTALP

SEQ ID NO: 1157019 - protein, 16 aa, Mycobacterium
DGRTTASRRVESRQAG

SEQ ID NO: 1157020 - protein, 12 aa, Mycobacterium
DGRVEEADTRGQ

SEQ ID NO: 1157021 - protein, 16 aa, Mycobacterium
DGRYRTQAARQSPDSE

SEQ ID NO: 1157022 - protein, 11 aa, Mycobacterium
DGSAADAEASL

SEQ ID NO: 1157023 - protein, 9 aa, Mycobacterium
DGSAAGKVA

SEQ ID NO: 1157024 - protein, 9 aa, Mycobacterium
DGSADCESA

SEQ ID NO: 1157025 - protein, 8 aa, Mycobacterium
DGSAESDA

SEQ ID NO: 1157026 - protein, 8 aa, Mycobacterium
DGSAGNSF

SEQ ID NO: 1157027 - protein, 5 aa, Mycobacterium
DGSAL

SEQ ID NO: 1157028 - protein, 8 aa, Mycobacterium
DGSARTVR

SEQ ID NO: 1157029 - protein, 19 aa, Mycobacterium
DGSATLSGSQIAVDRGVMK

SEQ ID NO: 1157030 - protein, 6 aa, Mycobacterium
DGSAYS

SEQ ID NO: 1157031 - protein, 8 aa, Mycobacterium
DGSDARPA

SEQ ID NO: 1157032 - protein, 10 aa, Mycobacterium
DGSDGTLSTD

SEQ ID NO: 1157033 - protein, 9 aa, Mycobacterium
DGSDSSLRA

SEQ ID NO: 1157034 - protein, 8 aa, Mycobacterium
DGSEEECA

SEQ ID NO: 1157035 - protein, 7 aa, Mycobacterium
DGSEERI

SEQ ID NO: 1157036 - protein, 9 aa, Mycobacterium
DGSGASADE

SEQ ID NO: 1157037 - protein, 11 aa, Mycobacterium
DGSGGARTALS

SEQ ID NO: 1157038 - protein, 8 aa, Mycobacterium
DGSGKHHS

SEQ ID NO: 1157039 - protein, 8 aa, Mycobacterium
DGSGQAVG

SEQ ID NO: 1157040 - protein, 8 aa, Mycobacterium
DGSGQTGR

SEQ ID NO: 1157041 - protein, 11 aa, Mycobacterium
DGSGSPEPAGA

SEQ ID NO: 1157042 - protein, 8 aa, Mycobacterium
DGSGSTPL

SEQ ID NO: 1157043 - protein, 7 aa, Mycobacterium
DGSIELT

SEQ ID NO: 1157044 - protein, 8 aa, Mycobacterium
DGSLDPRE

SEQ ID NO: 1157045 - protein, 17 aa, Mycobacterium
DGSLQSSPVTGGVDGEG

SEQ ID NO: 1157046 - protein, 10 aa, Mycobacterium
DGSPASEAAT

SEQ ID NO: 1157047 - protein, 8 aa, Mycobacterium
DGSPASEL

SEQ ID NO: 1157048 - protein, 11 aa, Mycobacterium
DGSPDGTGELA

SEQ ID NO: 1157049 - protein, 7 aa, Mycobacterium
DGSPEAV

SEQ ID NO: 1157050 - protein, 9 aa, Mycobacterium
DGSPLREVS

SEQ ID NO: 1157051 - protein, 8 aa, Mycobacterium
DGSRDTGT

SEQ ID NO: 1157052 - protein, 6 aa, Mycobacterium
DGSRLP

SEQ ID NO: 1157053 - protein, 10 aa, Mycobacterium
DGSRRETTAP

SEQ ID NO: 1157054 - protein, 10 aa, Mycobacterium
DGSSEDFSSY

SEQ ID NO: 1157055 - protein, 10 aa, Mycobacterium
DGSTAEGALT

SEQ ID NO: 1157056 - protein, 8 aa, Mycobacterium
DGSVGERN

SEQ ID NO: 1157057 - protein, 19 aa, Mycobacterium
DGSVSEATAATQHESVDPA

SEQ ID NO: 1157058 - protein, 7 aa, Mycobacterium
DGSVSVH

SEQ ID NO: 1157059 - protein, 10 aa, Mycobacterium
DGTADGQRRR

SEQ ID NO: 1157060 - protein, 5 aa, Mycobacterium
DGTAI

SEQ ID NO: 1157061 - protein, 5 aa, Mycobacterium
DGTAR

SEQ ID NO: 1157062 - protein, 12 aa, Mycobacterium
DGTASLAADAKP

SEQ ID NO: 1157063 - protein, 8 aa, Mycobacterium
DGTASPVN

SEQ ID NO: 1157064 - protein, 5 aa, Mycobacterium
DGTAV

SEQ ID NO: 1157065 - protein, 5 aa, Mycobacterium
DGTDA

SEQ ID NO: 1157066 - protein, 7 aa, Mycobacterium
DGTDAGD

SEQ ID NO: 1157067 - protein, 10 aa, Mycobacterium
DGTDARDGGP

SEQ ID NO: 1157068 - protein, 5 aa, Mycobacterium
DGTDP

SEQ ID NO: 1157069 - protein, 17 aa, Mycobacterium
DGTEDYWSEEYRELIEL

SEQ ID NO: 1157070 - protein, 12 aa, Mycobacterium
DGTETALEHGSK

SEQ ID NO: 1157071 - protein, 6 aa, Mycobacterium
DGTEVS

SEQ ID NO: 1157072 - protein, 8 aa, Mycobacterium
DGTGGYRG

SEQ ID NO: 1157073 - protein, 6 aa, Mycobacterium
DGTGKV

SEQ ID NO: 1157074 - protein, 8 aa, Mycobacterium
DGTGSGDY

SEQ ID NO: 1157075 - protein, 12 aa, Mycobacterium
DGTHGGTGGGNH

SEQ ID NO: 1157076 - protein, 15 aa, Mycobacterium
DGTHRTPHILLGRAA

SEQ ID NO: 1157077 - protein, 6 aa, Mycobacterium
DGTKAG

SEQ ID NO: 1157078 - protein, 5 aa, Mycobacterium
DGTLD

SEQ ID NO: 1157079 - protein, 14 aa, Mycobacterium
DGTLGDKENEKATF

SEQ ID NO: 1157080 - protein, 8 aa, Mycobacterium
DGTLGGPV

SEQ ID NO: 1157081 - protein, 9 aa, Mycobacterium
DGTPAGTAA

SEQ ID NO: 1157082 - protein, 10 aa, Mycobacterium
DGTPLGPGEV

SEQ ID NO: 1157083 - protein, 6 aa, Mycobacterium
DGTPVT

SEQ ID NO: 1157084 - protein, 5 aa, Mycobacterium
DGTRR

SEQ ID NO: 1157085 - protein, 36 aa, Mycobacterium
DGTRTEIPAASDTREPAPVDEPALPEPLPPGPTRRA

SEQ ID NO: 1157086 - protein, 7 aa, Mycobacterium
DGTSDDF

SEQ ID NO: 1157087 - protein, 12 aa, Mycobacterium
DGTSNLDPEDDA

SEQ ID NO: 1157088 - protein, 7 aa, Mycobacterium
DGTSVEA

SEQ ID NO: 1157089 - protein, 16 aa, Mycobacterium
DGTTCADSPRCVARIT

SEQ ID NO: 1157090 - protein, 6 aa, Mycobacterium
DGTTNY

SEQ ID NO: 1157091 - protein, 8 aa, Mycobacterium
DGTTQLGP

SEQ ID NO: 1157092 - protein, 7 aa, Mycobacterium
DGTTSPT

SEQ ID NO: 1157093 - protein, 18 aa, Mycobacterium
DGTVVSKDDGPRAGTTYE

SEQ ID NO: 1157094 - protein, 8 aa, Mycobacterium
DGVAAARR

SEQ ID NO: 1157095 - protein, 8 aa, Mycobacterium
DGVAPSDL

SEQ ID NO: 1157096 - protein, 10 aa, Mycobacterium
DGVEGTREVK

SEQ ID NO: 1157097 - protein, 10 aa, Mycobacterium
DGVGGPGTKG

SEQ ID NO: 1157098 - protein, 5 aa, Mycobacterium
DGVKD

SEQ ID NO: 1157099 - protein, 11 aa, Mycobacterium
DGVKDTPEAAR

SEQ ID NO: 1157100 - protein, 10 aa, Mycobacterium
DGVNDVPAEA

SEQ ID NO: 1157101 - protein, 8 aa, Mycobacterium
DGVNPDAV

SEQ ID NO: 1157102 - protein, 5 aa, Mycobacterium
DGVPA

SEQ ID NO: 1157103 - protein, 19 aa, Mycobacterium
DGVPPGISAEDHAEGMDSS

SEQ ID NO: 1157104 - protein, 5 aa, Mycobacterium
DGVRP

SEQ ID NO: 1157105 - protein, 6 aa, Mycobacterium
DGVRST

SEQ ID NO: 1157106 - protein, 4 aa, Mycobacterium
DGWG

SEQ ID NO: 1157107 - protein, 8 aa, Mycobacterium
DGWRSRSL

SEQ ID NO: 1157108 - protein, 8 aa, Mycobacterium
DGWSDDGM

SEQ ID NO: 1157109 - protein, 4 aa, Mycobacterium
DGYA

SEQ ID NO: 1157110 - protein, 13 aa, Mycobacterium
DGYADNRNRPDLD

SEQ ID NO: 1157111 - protein, 4 aa, Mycobacterium
DGYD

SEQ ID NO: 1157112 - protein, 7 aa, Mycobacterium
DGYEAAA

SEQ ID NO: 1157113 - protein, 8 aa, Mycobacterium
DGYGHGAT

SEQ ID NO: 1157114 - protein, 7 aa, Mycobacterium
DGYNGTM

SEQ ID NO: 1157115 - protein, 10 aa, Mycobacterium
DGYQSPEAAA

SEQ ID NO: 1157116 - protein, 13 aa, Mycobacterium
DGYTDEKESEKKL

SEQ ID NO: 1157117 - protein, 11 aa, Mycobacterium
DGYTHRGNSAV

SEQ ID NO: 1157118 - protein, 22 aa, Mycobacterium
DHAEAPKSAEEKSAEAAKPQKV

SEQ ID NO: 1157119 - protein, 5 aa, Mycobacterium
DHAGR

SEQ ID NO: 1157120 - protein, 6 aa, Mycobacterium
DHAGYA

SEQ ID NO: 1157121 - protein, 8 aa, Mycobacterium
DHAPTTHR

SEQ ID NO: 1157122 - protein, 14 aa, Mycobacterium
DHATADADSATAES

SEQ ID NO: 1157123 - protein, 8 aa, Mycobacterium
DHDGGRGV

SEQ ID NO: 1157124 - protein, 10 aa, Mycobacterium
DHDPAEGSHI

SEQ ID NO: 1157125 - protein, 6 aa, Mycobacterium
DHDPDL

SEQ ID NO: 1157126 - protein, 9 aa, Mycobacterium
DHDPGSRHG

SEQ ID NO: 1157127 - protein, 6 aa, Mycobacterium
DHDTEG

SEQ ID NO: 1157128 - protein, 18 aa, Mycobacterium
DHDTPTDTPAGGRPPMPA

SEQ ID NO: 1157129 - protein, 4 aa, Mycobacterium
DHEN

SEQ ID NO: 1157130 - protein, 10 aa, Mycobacterium
DHESFSSSRG

SEQ ID NO: 1157131 - protein, 10 aa, Mycobacterium
DHFDTPPRTL

SEQ ID NO: 1157132 - protein, 9 aa, Mycobacterium
DHGDERVGQ

SEQ ID NO: 1157133 - protein, 5 aa, Mycobacterium
DHGDV

SEQ ID NO: 1157134 - protein, 8 aa, Mycobacterium
DHGGDQPH

SEQ ID NO: 1157135 - protein, 5 aa, Mycobacterium
DHGKY

SEQ ID NO: 1157136 - protein, 10 aa, Mycobacterium
DHGVEPSAIG

SEQ ID NO: 1157137 - protein, 9 aa, Mycobacterium
DHGVSTPRS

SEQ ID NO: 1157138 - protein, 24 aa, Mycobacterium
DHHGTDAGQVSGTPEDGDSFFTVV

SEQ ID NO: 1157139 - protein, 7 aa, Mycobacterium
DHNPIHT

SEQ ID NO: 1157140 - protein, 11 aa, Mycobacterium
DHPDAEKLTPN

SEQ ID NO: 1157141 - protein, 7 aa, Mycobacterium
DHPDARP

SEQ ID NO: 1157142 - protein, 6 aa, Mycobacterium
DHPDGH

SEQ ID NO: 1157143 - protein, 16 aa, Mycobacterium
DHPDQRRELAADPSLI

SEQ ID NO: 1157144 - protein, 5 aa, Mycobacterium
DHPEV

SEQ ID NO: 1157145 - protein, 13 aa, Mycobacterium
DHPEYQNRDARAK

SEQ ID NO: 1157146 - protein, 10 aa, Mycobacterium
DHPLGTPDDL

SEQ ID NO: 1157147 - protein, 7 aa, Mycobacterium
DHPPEQL

SEQ ID NO: 1157148 - protein, 9 aa, Mycobacterium
DHPQASAAE

SEQ ID NO: 1157149 - protein, 4 aa, Mycobacterium
DHPR

SEQ ID NO: 1157150 - protein, 7 aa, Mycobacterium
DHPRGRH

SEQ ID NO: 1157151 - protein, 6 aa, Mycobacterium
DHPSDD

SEQ ID NO: 1157152 - protein, 6 aa, Mycobacterium
DHQGAP

SEQ ID NO: 1157153 - protein, 5 aa, Mycobacterium
DHQRR

SEQ ID NO: 1157154 - protein, 10 aa, Mycobacterium
DHRDARSACR

SEQ ID NO: 1157155 - protein, 9 aa, Mycobacterium
DHRPQPPKD

SEQ ID NO: 1157156 - protein, 4 aa, Mycobacterium
DHSA

SEQ ID NO: 1157157 - protein, 5 aa, Mycobacterium
DHTDG

SEQ ID NO: 1157158 - protein, 7 aa, Mycobacterium
DHTQTAE

SEQ ID NO: 1157159 - protein, 4 aa, Mycobacterium
DHTR

SEQ ID NO: 1157160 - protein, 5 aa, Mycobacterium
DHVSG

SEQ ID NO: 1157161 - protein, 12 aa, Mycobacterium
DIADGPDTIDRD

SEQ ID NO: 1157162 - protein, 8 aa, Mycobacterium
DIADGSRV

SEQ ID NO: 1157163 - protein, 10 aa, Mycobacterium
DIADTDDDVI

SEQ ID NO: 1157164 - protein, 4 aa, Mycobacterium
DIAS

SEQ ID NO: 1157165 - protein, 8 aa, Mycobacterium
DIATGQPA

SEQ ID NO: 1157166 - protein, 4 aa, Mycobacterium
DIDA

SEQ ID NO: 1157167 - protein, 6 aa, Mycobacterium
DIDPAD

SEQ ID NO: 1157168 - protein, 9 aa, Mycobacterium
DIDPDETSE

SEQ ID NO: 1157169 - protein, 11 aa, Mycobacterium
DIDTSGPGQAI

SEQ ID NO: 1157170 - protein, 17 aa, Mycobacterium
DIEADTRGHFTAPERKD

SEQ ID NO: 1157171 - protein, 7 aa, Mycobacterium
DIEPDDL

SEQ ID NO: 1157172 - protein, 6 aa, Mycobacterium
DIEPSA

SEQ ID NO: 1157173 - protein, 7 aa, Mycobacterium
DIETDSG

SEQ ID NO: 1157174 - protein, 7 aa, Mycobacterium
DIGDQPL

SEQ ID NO: 1157175 - protein, 10 aa, Mycobacterium
DIGEHSNIGA

SEQ ID NO: 1157176 - protein, 10 aa, Mycobacterium
DIGQPPSVRG

SEQ ID NO: 1157177 - protein, 6 aa, Mycobacterium
DIGTGT

SEQ ID NO: 1157178 - protein, 12 aa, Mycobacterium
DINESDAERIGY

SEQ ID NO: 1157179 - protein, 4 aa, Mycobacterium
DIPA

SEQ ID NO: 1157180 - protein, 10 aa, Mycobacterium
DIPAGERAAA

SEQ ID NO: 1157181 - protein, 4 aa, Mycobacterium
DIPD

SEQ ID NO: 1157182 - protein, 8 aa, Mycobacterium
DIPGRDAG

SEQ ID NO: 1157183 - protein, 7 aa, Mycobacterium
DIPGSPA

SEQ ID NO: 1157184 - protein, 4 aa, Mycobacterium
DIPL

SEQ ID NO: 1157185 - protein, 4 aa, Mycobacterium
DIPP

SEQ ID NO: 1157186 - protein, 7 aa, Mycobacterium
DIPPGRT

SEQ ID NO: 1157187 - protein, 10 aa, Mycobacterium
DIPPSGMSAT

SEQ ID NO: 1157188 - protein, 14 aa, Mycobacterium
DIPTTEDLEEMLDE

SEQ ID NO: 1157189 - protein, 10 aa, Mycobacterium
DIQRPDGSDG

SEQ ID NO: 1157190 - protein, 14 aa, Mycobacterium
DIQSKPEDASRDSR

SEQ ID NO: 1157191 - protein, 11 aa, Mycobacterium
DIRPQRATEGD

SEQ ID NO: 1157192 - protein, 8 aa, Mycobacterium
DISEPRPR

SEQ ID NO: 1157193 - protein, 7 aa, Mycobacterium
DISPGTA

SEQ ID NO: 1157194 - protein, 7 aa, Mycobacterium
DISPTGT

SEQ ID NO: 1157195 - protein, 11 aa, Mycobacterium
DISQRSTADEL

SEQ ID NO: 1157196 - protein, 16 aa, Mycobacterium
DITDDELEAAGKTVKQ

SEQ ID NO: 1157197 - protein, 8 aa, Mycobacterium
DITGRPQL

SEQ ID NO: 1157198 - protein, 7 aa, Mycobacterium
DITSGEA

SEQ ID NO: 1157199 - protein, 5 aa, Mycobacterium
DIYGD

SEQ ID NO: 1157200 - protein, 7 aa, Mycobacterium
DKAAAED

SEQ ID NO: 1157201 - protein, 5 aa, Mycobacterium
DKADA

SEQ ID NO: 1157202 - protein, 22 aa, Mycobacterium
DKAGATKMDRPEDFEANPKTGK

SEQ ID NO: 1157203 - protein, 8 aa, Mycobacterium
DKAPGEPT

SEQ ID NO: 1157204 - protein, 15 aa, Mycobacterium
DKATKETFDDDESER

SEQ ID NO: 1157205 - protein, 9 aa, Mycobacterium
DKATRWEPL

SEQ ID NO: 1157206 - protein, 12 aa, Mycobacterium
DKATTAPGVTDA

SEQ ID NO: 1157207 - protein, 8 aa, Mycobacterium
DKDGRYQR

SEQ ID NO: 1157208 - protein, 7 aa, Mycobacterium
DKDGVDA

SEQ ID NO: 1157209 - protein, 10 aa, Mycobacterium
DKDRNPKWSH

SEQ ID NO: 1157210 - protein, 7 aa, Mycobacterium
DKEGRQV

SEQ ID NO: 1157211 - protein, 4 aa, Mycobacterium
DKER

SEQ ID NO: 1157212 - protein, 7 aa, Mycobacterium
DKEVPRH

SEQ ID NO: 1157213 - protein, 6 aa, Mycobacterium
DKFTRE

SEQ ID NO: 1157214 - protein, 6 aa, Mycobacterium
DKGDLR

SEQ ID NO: 1157215 - protein, 10 aa, Mycobacterium
DKGGRTVKER

SEQ ID NO: 1157216 - protein, 4 aa, Mycobacterium
DKGI

SEQ ID NO: 1157217 - protein, 4 aa, Mycobacterium
DKGM

SEQ ID NO: 1157218 - protein, 7 aa, Mycobacterium
DKGNNSY

SEQ ID NO: 1157219 - protein, 4 aa, Mycobacterium
DKGQ

SEQ ID NO: 1157220 - protein, 5 aa, Mycobacterium
DKGRE

SEQ ID NO: 1157221 - protein, 10 aa, Mycobacterium
DKGSAGERRF

SEQ ID NO: 1157222 - protein, 17 aa, Mycobacterium
DKGSNLRSKGGDGFTPI

SEQ ID NO: 1157223 - protein, 6 aa, Mycobacterium
DKGVPS

SEQ ID NO: 1157224 - protein, 11 aa, Mycobacterium
DKHSRTDVGAT

SEQ ID NO: 1157225 - protein, 19 aa, Mycobacterium
DKIAPSSSEPATPQSSREA

SEQ ID NO: 1157226 - protein, 10 aa, Mycobacterium
DKIGRDAGEI

SEQ ID NO: 1157227 - protein, 4 aa, Mycobacterium
DKIS

SEQ ID NO: 1157228 - protein, 7 aa, Mycobacterium
DKKTRSG

SEQ ID NO: 1157229 - protein, 5 aa, Mycobacterium
DKLGG

SEQ ID NO: 1157230 - protein, 8 aa, Mycobacterium
DKLLGGPQ

SEQ ID NO: 1157231 - protein, 15 aa, Mycobacterium
DKLPPSINYTGPNPY

SEQ ID NO: 1157232 - protein, 5 aa, Mycobacterium
DKMGT

SEQ ID NO: 1157233 - protein, 4 aa, Mycobacterium
DKMP

SEQ ID NO: 1157234 - protein, 18 aa, Mycobacterium
DKPAEEEDHGHGHHHGHA

SEQ ID NO: 1157235 - protein, 10 aa, Mycobacterium
DKPAHAQSAA

SEQ ID NO: 1157236 - protein, 8 aa, Mycobacterium
DKPEAQNA

SEQ ID NO: 1157237 - protein, 9 aa, Mycobacterium
DKPEGESIA

SEQ ID NO: 1157238 - protein, 6 aa, Mycobacterium
DKPESA

SEQ ID NO: 1157239 - protein, 4 aa, Mycobacterium
DKPF

SEQ ID NO: 1157240 - protein, 9 aa, Mycobacterium
DKPIASASI

SEQ ID NO: 1157241 - protein, 8 aa, Mycobacterium
DKPKTHVS

SEQ ID NO: 1157242 - protein, 5 aa, Mycobacterium
DKPPA

SEQ ID NO: 1157243 - protein, 8 aa, Mycobacterium
DKPVKSSN

SEQ ID NO: 1157244 - protein, 15 aa, Mycobacterium
DKQAFSGAAGDQVDR

SEQ ID NO: 1157245 - protein, 7 aa, Mycobacterium
DKQKVGQ

SEQ ID NO: 1157246 - protein, 7 aa, Mycobacterium
DKQRPAL

SEQ ID NO: 1157247 - protein, 8 aa, Mycobacterium
DKRPVSVA

SEQ ID NO: 1157248 - protein, 19 aa, Mycobacterium
DKRYGGTNEDKRELAEPFG

SEQ ID NO: 1157249 - protein, 17 aa, Mycobacterium
DKSDGKDDDGKDDDDQS

SEQ ID NO: 1157250 - protein, 10 aa, Mycobacterium
DKSDRPGRNQ

SEQ ID NO: 1157251 - protein, 8 aa, Mycobacterium
DKSGDPEV

SEQ ID NO: 1157252 - protein, 5 aa, Mycobacterium
DKTFE

SEQ ID NO: 1157253 - protein, 13 aa, Mycobacterium
DKTGGRPHLTKRE

SEQ ID NO: 1157254 - protein, 6 aa, Mycobacterium
DKTGQR

SEQ ID NO: 1157255 - protein, 7 aa, Mycobacterium
DKTTGMC

SEQ ID NO: 1157256 - protein, 25 aa, Mycobacterium
DKTTVAQAPSVQSAVAEAEAALGDT

SEQ ID NO: 1157257 - protein, 13 aa, Mycobacterium
DKVDTEIPSPASG

SEQ ID NO: 1157258 - protein, 12 aa, Mycobacterium
DKVDTEIPSPVA

SEQ ID NO: 1157259 - protein, 11 aa, Mycobacterium
DKVPDDLREAA

SEQ ID NO: 1157260 - protein, 7 aa, Mycobacterium
DKVPTAD

SEQ ID NO: 1157261 - protein, 6 aa, Mycobacterium
DKVSTD

SEQ ID NO: 1157262 - protein, 10 aa, Mycobacterium
DKWSGQHPTV

SEQ ID NO: 1157263 - protein, 4 aa, Mycobacterium
DLAD

SEQ ID NO: 1157264 - protein, 14 aa, Mycobacterium
DLADNEETDPDDYL

SEQ ID NO: 1157265 - protein, 7 aa, Mycobacterium
DLADPSV

SEQ ID NO: 1157266 - protein, 5 aa, Mycobacterium
DLAEQ

SEQ ID NO: 1157267 - protein, 16 aa, Mycobacterium
DLAEQRDRLLAELAKE

SEQ ID NO: 1157268 - protein, 4 aa, Mycobacterium
DLAH

SEQ ID NO: 1157269 - protein, 8 aa, Mycobacterium
DLAPPERS

SEQ ID NO: 1157270 - protein, 13 aa, Mycobacterium
DLDATSKAQLDRG

SEQ ID NO: 1157271 - protein, 7 aa, Mycobacterium
DLDDDKR

SEQ ID NO: 1157272 - protein, 13 aa, Mycobacterium
DLDDEAQKAAEEA

SEQ ID NO: 1157273 - protein, 13 aa, Mycobacterium
DLDEPVDEDIPDT

SEQ ID NO: 1157274 - protein, 8 aa, Mycobacterium
DLDGKTDN

SEQ ID NO: 1157275 - protein, 7 aa, Mycobacterium
DLDGPAK

SEQ ID NO: 1157276 - protein, 10 aa, Mycobacterium
DLDPDDPRIE

SEQ ID NO: 1157277 - protein, 11 aa, Mycobacterium
DLDPGAATSNT

SEQ ID NO: 1157278 - protein, 6 aa, Mycobacterium
DLDPRR

SEQ ID NO: 1157279 - protein, 11 aa, Mycobacterium
DLDPSSEEAGE

SEQ ID NO: 1157280 - protein, 5 aa, Mycobacterium
DLDRM

SEQ ID NO: 1157281 - protein, 9 aa, Mycobacterium
DLEDGDRSA

SEQ ID NO: 1157282 - protein, 9 aa, Mycobacterium
DLEEQAAPA

SEQ ID NO: 1157283 - protein, 10 aa, Mycobacterium
DLEKPTRADA

SEQ ID NO: 1157284 - protein, 7 aa, Mycobacterium
DLGGGEI

SEQ ID NO: 1157285 - protein, 19 aa, Mycobacterium
DLGGPAAYPEEAPLSAFQL

SEQ ID NO: 1157286 - protein, 5 aa, Mycobacterium
DLGGY

SEQ ID NO: 1157287 - protein, 6 aa, Mycobacterium
DLGPGA

SEQ ID NO: 1157288 - protein, 16 aa, Mycobacterium
DLGPGTSTSSATTALA

SEQ ID NO: 1157289 - protein, 10 aa, Mycobacterium
DLGQGAREKA

SEQ ID NO: 1157290 - protein, 22 aa, Mycobacterium
DLGREPRSLAGEPASPLSPPTG

SEQ ID NO: 1157291 - protein, 8 aa, Mycobacterium
DLGRPEGF

SEQ ID NO: 1157292 - protein, 15 aa, Mycobacterium
DLGTKGGLRTDTSAR

SEQ ID NO: 1157293 - protein, 7 aa, Mycobacterium
DLGTRGQ

SEQ ID NO: 1157294 - protein, 4 aa, Mycobacterium
DLGY

SEQ ID NO: 1157295 - protein, 11 aa, Mycobacterium
DLKDGAGSVGT

SEQ ID NO: 1157296 - protein, 29 aa, Mycobacterium
DLKPTVAGGTYLDPEAAAAGAAAVASQGA

SEQ ID NO: 1157297 - protein, 15 aa, Mycobacterium
DLKTQNQPGTSDEYP

SEQ ID NO: 1157298 - protein, 7 aa, Mycobacterium
DLNGDAV

SEQ ID NO: 1157299 - protein, 6 aa, Mycobacterium
DLNTTD

SEQ ID NO: 1157300 - protein, 9 aa, Mycobacterium
DLNYDNPAV

SEQ ID NO: 1157301 - protein, 7 aa, Mycobacterium
DLPAKAR

SEQ ID NO: 1157302 - protein, 5 aa, Mycobacterium
DLPAL

SEQ ID NO: 1157303 - protein, 15 aa, Mycobacterium
DLPAPVRPGALPLAV

SEQ ID NO: 1157304 - protein, 8 aa, Mycobacterium
DLPDDAAP

SEQ ID NO: 1157305 - protein, 6 aa, Mycobacterium
DLPDPH

SEQ ID NO: 1157306 - protein, 6 aa, Mycobacterium
DLPEKV

SEQ ID NO: 1157307 - protein, 7 aa, Mycobacterium
DLPEPPA

SEQ ID NO: 1157308 - protein, 6 aa, Mycobacterium
DLPGDT

SEQ ID NO: 1157309 - protein, 6 aa, Mycobacterium
DLPGLS

SEQ ID NO: 1157310 - protein, 5 aa, Mycobacterium
DLPGS

SEQ ID NO: 1157311 - protein, 10 aa, Mycobacterium
DLPHDAEAED

SEQ ID NO: 1157312 - protein, 6 aa, Mycobacterium
DLPKDT

SEQ ID NO: 1157313 - protein, 12 aa, Mycobacterium
DLPPAPEPLTDA

SEQ ID NO: 1157314 - protein, 14 aa, Mycobacterium
DLPPDIGRIDGSDA

SEQ ID NO: 1157315 - protein, 7 aa, Mycobacterium
DLPPGGR

SEQ ID NO: 1157316 - protein, 11 aa, Mycobacterium
DLPPSSWGSGK

SEQ ID NO: 1157317 - protein, 5 aa, Mycobacterium
DLPPV

SEQ ID NO: 1157318 - protein, 4 aa, Mycobacterium
DLPR

SEQ ID NO: 1157319 - protein, 6 aa, Mycobacterium
DLPRGD

SEQ ID NO: 1157320 - protein, 8 aa, Mycobacterium
DLPTAADE

SEQ ID NO: 1157321 - protein, 7 aa, Mycobacterium
DLPTGTV

SEQ ID NO: 1157322 - protein, 9 aa, Mycobacterium
DLPTTAGFA

SEQ ID NO: 1157323 - protein, 5 aa, Mycobacterium
DLPTY

SEQ ID NO: 1157324 - protein, 6 aa, Mycobacterium
DLQGNA

SEQ ID NO: 1157325 - protein, 12 aa, Mycobacterium
DLQTSEALADID

SEQ ID NO: 1157326 - protein, 5 aa, Mycobacterium
DLRAG

SEQ ID NO: 1157327 - protein, 13 aa, Mycobacterium
DLSAGREDVTLEP

SEQ ID NO: 1157328 - protein, 10 aa, Mycobacterium
DLSDPSVSGR

SEQ ID NO: 1157329 - protein, 11 aa, Mycobacterium
DLSGENATPIG

SEQ ID NO: 1157330 - protein, 11 aa, Mycobacterium
DLSGQDEATMQ

SEQ ID NO: 1157331 - protein, 10 aa, Mycobacterium
DLSPKARDLA

SEQ ID NO: 1157332 - protein, 10 aa, Mycobacterium
DLSQGEVKGN

SEQ ID NO: 1157333 - protein, 7 aa, Mycobacterium
DLSTKGW

SEQ ID NO: 1157334 - protein, 6 aa, Mycobacterium
DLTDDD

SEQ ID NO: 1157335 - protein, 18 aa, Mycobacterium
DLTDDEHLGRPRADAGVG

SEQ ID NO: 1157336 - protein, 17 aa, Mycobacterium
DLTDEQRAAHRAEGRNP

SEQ ID NO: 1157337 - protein, 7 aa, Mycobacterium
DLTDESR

SEQ ID NO: 1157338 - protein, 10 aa, Mycobacterium
DLTDPAPAVE

SEQ ID NO: 1157339 - protein, 7 aa, Mycobacterium
DLTDPSD

SEQ ID NO: 1157340 - protein, 16 aa, Mycobacterium
DLTDRRRRERELAQEA

SEQ ID NO: 1157341 - protein, 4 aa, Mycobacterium
DLTE

SEQ ID NO: 1157342 - protein, 6 aa, Mycobacterium
DLTGGL

SEQ ID NO: 1157343 - protein, 14 aa, Mycobacterium
DLTGPGSGLHQRDE

SEQ ID NO: 1157344 - protein, 6 aa, Mycobacterium
DLTGRD

SEQ ID NO: 1157345 - protein, 7 aa, Mycobacterium
DLTPNTT

SEQ ID NO: 1157346 - protein, 9 aa, Mycobacterium
DLTPPEDHS

SEQ ID NO: 1157347 - protein, 8 aa, Mycobacterium
DLTPQTPE

SEQ ID NO: 1157348 - protein, 10 aa, Mycobacterium
DLTQPPPGTI

SEQ ID NO: 1157349 - protein, 11 aa, Mycobacterium
DLVDSAPKPIL

SEQ ID NO: 1157350 - protein, 6 aa, Mycobacterium
DMANNQ

SEQ ID NO: 1157351 - protein, 6 aa, Mycobacterium
DMAPTR

SEQ ID NO: 1157352 - protein, 6 aa, Mycobacterium
DMDEGT

SEQ ID NO: 1157353 - protein, 6 aa, Mycobacterium
DMGGTS

SEQ ID NO: 1157354 - protein, 5 aa, Mycobacterium
DMNDD

SEQ ID NO: 1157355 - protein, 10 aa, Mycobacterium
DMPGATEGVD

SEQ ID NO: 1157356 - protein, 7 aa, Mycobacterium
DMTDAGG

SEQ ID NO: 1157357 - protein, 9 aa, Mycobacterium
DMTETKQAL

SEQ ID NO: 1157358 - protein, 10 aa, Mycobacterium
DMVRGDPKAL

SEQ ID NO: 1157359 - protein, 10 aa, Mycobacterium
DNAETPESTV

SEQ ID NO: 1157360 - protein, 7 aa, Mycobacterium
DNAGTVE

SEQ ID NO: 1157361 - protein, 23 aa, Mycobacterium
DNAIPNSKEASMAKAKAARVGSD

SEQ ID NO: 1157362 - protein, 8 aa, Mycobacterium
DNAPTTAG

SEQ ID NO: 1157363 - protein, 10 aa, Mycobacterium
DNAPYDEEAA

SEQ ID NO: 1157364 - protein, 13 aa, Mycobacterium
DNARRNGNAQTRG

SEQ ID NO: 1157365 - protein, 5 aa, Mycobacterium
DNARY

SEQ ID NO: 1157366 - protein, 6 aa, Mycobacterium
DNASGV

SEQ ID NO: 1157367 - protein, 5 aa, Mycobacterium
DNATT

SEQ ID NO: 1157368 - protein, 11 aa, Mycobacterium
DNAVRAPTSTV

SEQ ID NO: 1157369 - protein, 4 aa, Mycobacterium
DNDA

SEQ ID NO: 1157370 - protein, 8 aa, Mycobacterium
DNDADGVV

SEQ ID NO: 1157371 - protein, 9 aa, Mycobacterium
DNDDTTYGG

SEQ ID NO: 1157372 - protein, 7 aa, Mycobacterium
DNDEADR

SEQ ID NO: 1157373 - protein, 18 aa, Mycobacterium
DNDKGPSRKTGELDNRGS

SEQ ID NO: 1157374 - protein, 8 aa, Mycobacterium
DNDPAAQV

SEQ ID NO: 1157375 - protein, 5 aa, Mycobacterium
DNDQW

SEQ ID NO: 1157376 - protein, 6 aa, Mycobacterium
DNEAVD

SEQ ID NO: 1157377 - protein, 20 aa, Mycobacterium
DNEVAGPELDDDRPRRLRPG

SEQ ID NO: 1157378 - protein, 7 aa, Mycobacterium
DNGAAVK

SEQ ID NO: 1157379 - protein, 9 aa, Mycobacterium
DNGAITDPG

SEQ ID NO: 1157380 - protein, 8 aa, Mycobacterium
DNGDGRAK

SEQ ID NO: 1157381 - protein, 7 aa, Mycobacterium
DNGDRDR

SEQ ID NO: 1157382 - protein, 5 aa, Mycobacterium
DNGFR

SEQ ID NO: 1157383 - protein, 4 aa, Mycobacterium
DNGG

SEQ ID NO: 1157384 - protein, 5 aa, Mycobacterium
DNGSC

SEQ ID NO: 1157385 - protein, 13 aa, Mycobacterium
DNGSTDGAPEQAV

SEQ ID NO: 1157386 - protein, 4 aa, Mycobacterium
DNGT

SEQ ID NO: 1157387 - protein, 8 aa, Mycobacterium
DNHEPRKR

SEQ ID NO: 1157388 - protein, 7 aa, Mycobacterium
DNHTGTD

SEQ ID NO: 1157389 - protein, 6 aa, Mycobacterium
DNNDAF

SEQ ID NO: 1157390 - protein, 5 aa, Mycobacterium
DNNID

SEQ ID NO: 1157391 - protein, 24 aa, Mycobacterium
DNNSNRYDAYQKRTTRPIPIVKLT

SEQ ID NO: 1157392 - protein, 7 aa, Mycobacterium
DNPASRI

SEQ ID NO: 1157393 - protein, 6 aa, Mycobacterium
DNPDDV

SEQ ID NO: 1157394 - protein, 6 aa, Mycobacterium
DNPDIQ

SEQ ID NO: 1157395 - protein, 14 aa, Mycobacterium
DNPDPSDEEIREGL

SEQ ID NO: 1157396 - protein, 4 aa, Mycobacterium
DNPG

SEQ ID NO: 1157397 - protein, 7 aa, Mycobacterium
DNPHTAR

SEQ ID NO: 1157398 - protein, 6 aa, Mycobacterium
DNPIAR

SEQ ID NO: 1157399 - protein, 5 aa, Mycobacterium
DNPLH

SEQ ID NO: 1157400 - protein, 13 aa, Mycobacterium
DNPPTWKPDPDDL

SEQ ID NO: 1157401 - protein, 4 aa, Mycobacterium
DNPR

SEQ ID NO: 1157402 - protein, 15 aa, Mycobacterium
DNPSPSTKGAKSLED

SEQ ID NO: 1157403 - protein, 12 aa, Mycobacterium
DNPTAPTGKETQ

SEQ ID NO: 1157404 - protein, 6 aa, Mycobacterium
DNPTSL

SEQ ID NO: 1157405 - protein, 14 aa, Mycobacterium
DNPVNRVRGGGAQL

SEQ ID NO: 1157406 - protein, 18 aa, Mycobacterium
DNPVPSPRRGQGLRQSQR

SEQ ID NO: 1157407 - protein, 16 aa, Mycobacterium
DNQAERPEQAGPPIHQ

SEQ ID NO: 1157408 - protein, 9 aa, Mycobacterium
DNRDDLDGV

SEQ ID NO: 1157409 - protein, 17 aa, Mycobacterium
DNRDQNDLMGTSRANAA

SEQ ID NO: 1157410 - protein, 6 aa, Mycobacterium
DNRTGG

SEQ ID NO: 1157411 - protein, 4 aa, Mycobacterium
DNSK

SEQ ID NO: 1157412 - protein, 5 aa, Mycobacterium
DNSPE

SEQ ID NO: 1157413 - protein, 6 aa, Mycobacterium
DNSPEM

SEQ ID NO: 1157414 - protein, 13 aa, Mycobacterium
DNSTHKVPAGVSD

SEQ ID NO: 1157415 - protein, 8 aa, Mycobacterium
DNSTTWNT

SEQ ID NO: 1157416 - protein, 7 aa, Mycobacterium
DNVGRGL

SEQ ID NO: 1157417 - protein, 11 aa, Mycobacterium
DNVRSTARSVA

SEQ ID NO: 1157418 - protein, 9 aa, Mycobacterium
DNWSTDRPA

SEQ ID NO: 1157419 - protein, 9 aa, Mycobacterium
DNYSEHERQ

SEQ ID NO: 1157420 - protein, 16 aa, Mycobacterium
DPAAADIAAEATESVA

SEQ ID NO: 1157421 - protein, 8 aa, Mycobacterium
DPAAAEKI

SEQ ID NO: 1157422 - protein, 20 aa, Mycobacterium
DPAAGQRRRYPWGSSAPTAH

SEQ ID NO: 1157423 - protein, 6 aa, Mycobacterium
DPAAHV

SEQ ID NO: 1157424 - protein, 5 aa, Mycobacterium
DPAAL

SEQ ID NO: 1157425 - protein, 6 aa, Mycobacterium
DPAAPG

SEQ ID NO: 1157426 - protein, 18 aa, Mycobacterium
DPAAQPATSGRDPTDGHT

SEQ ID NO: 1157427 - protein, 6 aa, Mycobacterium
DPAASV

SEQ ID NO: 1157428 - protein, 14 aa, Mycobacterium
DPAATGAVADATDD

SEQ ID NO: 1157429 - protein, 9 aa, Mycobacterium
DPADKRAQW

SEQ ID NO: 1157430 - protein, 10 aa, Mycobacterium
DPADPSESQA

SEQ ID NO: 1157431 - protein, 8 aa, Mycobacterium
DPADPSTY

SEQ ID NO: 1157432 - protein, 10 aa, Mycobacterium
DPADTAMATA

SEQ ID NO: 1157433 - protein, 4 aa, Mycobacterium
DPAE

SEQ ID NO: 1157434 - protein, 8 aa, Mycobacterium
DPAEPCSG

SEQ ID NO: 1157435 - protein, 19 aa, Mycobacterium
DPAERTPRPARRPRHRRRT

SEQ ID NO: 1157436 - protein, 8 aa, Mycobacterium
DPAEVGRA

SEQ ID NO: 1157437 - protein, 4 aa, Mycobacterium
DPAF

SEQ ID NO: 1157438 - protein, 8 aa, Mycobacterium
DPAGDGAP

SEQ ID NO: 1157439 - protein, 11 aa, Mycobacterium
DPAGLPDQNDM

SEQ ID NO: 1157440 - protein, 5 aa, Mycobacterium
DPAGM

SEQ ID NO: 1157441 - protein, 5 aa, Mycobacterium
DPAGN

SEQ ID NO: 1157442 - protein, 8 aa, Mycobacterium
DPAGYDPP

SEQ ID NO: 1157443 - protein, 6 aa, Mycobacterium
DPAHPR

SEQ ID NO: 1157444 - protein, 9 aa, Mycobacterium
DPAKQQDEL

SEQ ID NO: 1157445 - protein, 6 aa, Mycobacterium
DPALPS

SEQ ID NO: 1157446 - protein, 6 aa, Mycobacterium
DPANRR

SEQ ID NO: 1157447 - protein, 4 aa, Mycobacterium
DPAP

SEQ ID NO: 1157448 - protein, 9 aa, Mycobacterium
DPAPDDLQA

SEQ ID NO: 1157449 - protein, 7 aa, Mycobacterium
DPAQTDY

SEQ ID NO: 1157450 - protein, 7 aa, Mycobacterium
DPARDDR

SEQ ID NO: 1157451 - protein, 9 aa, Mycobacterium
DPARESLSG

SEQ ID NO: 1157452 - protein, 7 aa, Mycobacterium
DPARETV

SEQ ID NO: 1157453 - protein, 13 aa, Mycobacterium
DPARRDEVQRSAR

SEQ ID NO: 1157454 - protein, 5 aa, Mycobacterium
DPARS

SEQ ID NO: 1157455 - protein, 11 aa, Mycobacterium
DPARSPQRDAF

SEQ ID NO: 1157456 - protein, 6 aa, Mycobacterium
DPARST

SEQ ID NO: 1157457 - protein, 8 aa, Mycobacterium
DPARYGLS

SEQ ID NO: 1157458 - protein, 20 aa, Mycobacterium
DPASKSADKVEAICGYEPRT

SEQ ID NO: 1157459 - protein, 14 aa, Mycobacterium
DPASTAANKGPERA

SEQ ID NO: 1157460 - protein, 12 aa, Mycobacterium
DPATGKTVADDL

SEQ ID NO: 1157461 - protein, 10 aa, Mycobacterium
DPATQAPSAE

SEQ ID NO: 1157462 - protein, 7 aa, Mycobacterium
DPATQQA

SEQ ID NO: 1157463 - protein, 6 aa, Mycobacterium
DPATRE

SEQ ID NO: 1157464 - protein, 8 aa, Mycobacterium
DPATWTEP

SEQ ID NO: 1157465 - protein, 9 aa, Mycobacterium
DPAVEPDTS

SEQ ID NO: 1157466 - protein, 5 aa, Mycobacterium
DPAVP

SEQ ID NO: 1157467 - protein, 16 aa, Mycobacterium
DPDAAARYAADPAAAI

SEQ ID NO: 1157468 - protein, 14 aa, Mycobacterium
DPDAADRPEPPYAQ

SEQ ID NO: 1157469 - protein, 6 aa, Mycobacterium
DPDADR

SEQ ID NO: 1157470 - protein, 7 aa, Mycobacterium
DPDAEPL

SEQ ID NO: 1157471 - protein, 6 aa, Mycobacterium
DPDAGA

SEQ ID NO: 1157472 - protein, 12 aa, Mycobacterium
DPDAGPVEIPGE

SEQ ID NO: 1157473 - protein, 8 aa, Mycobacterium
DPDAPPYQ

SEQ ID NO: 1157474 - protein, 9 aa, Mycobacterium
DPDAPTGSG

SEQ ID NO: 1157475 - protein, 16 aa, Mycobacterium
DPDAVRRRKEAAARRE

SEQ ID NO: 1157476 - protein, 12 aa, Mycobacterium
DPDDPDKATGTQ

SEQ ID NO: 1157477 - protein, 5 aa, Mycobacterium
DPDEP

SEQ ID NO: 1157478 - protein, 8 aa, Mycobacterium
DPDEPVES

SEQ ID NO: 1157479 - protein, 5 aa, Mycobacterium
DPDER

SEQ ID NO: 1157480 - protein, 8 aa, Mycobacterium
DPDERTAM

SEQ ID NO: 1157481 - protein, 5 aa, Mycobacterium
DPDEY

SEQ ID NO: 1157482 - protein, 5 aa, Mycobacterium
DPDFR

SEQ ID NO: 1157483 - protein, 5 aa, Mycobacterium
DPDGG

SEQ ID NO: 1157484 - protein, 10 aa, Mycobacterium
DPDGNHGNPL

SEQ ID NO: 1157485 - protein, 17 aa, Mycobacterium
DPDGNNVEAVFHGGGPR

SEQ ID NO: 1157486 - protein, 8 aa, Mycobacterium
DPDGPLAE

SEQ ID NO: 1157487 - protein, 8 aa, Mycobacterium
DPDGSRYR

SEQ ID NO: 1157488 - protein, 9 aa, Mycobacterium
DPDGSVYPS

SEQ ID NO: 1157489 - protein, 5 aa, Mycobacterium
DPDGT

SEQ ID NO: 1157490 - protein, 6 aa, Mycobacterium
DPDGYD

SEQ ID NO: 1157491 - protein, 4 aa, Mycobacterium
DPDH

SEQ ID NO: 1157492 - protein, 6 aa, Mycobacterium
DPDKEV

SEQ ID NO: 1157493 - protein, 8 aa, Mycobacterium
DPDKPGKL

SEQ ID NO: 1157494 - protein, 10 aa, Mycobacterium
DPDKTAQAID

SEQ ID NO: 1157495 - protein, 15 aa, Mycobacterium
DPDNRRPVDYTQRRA

SEQ ID NO: 1157496 - protein, 10 aa, Mycobacterium
DPDPAAVGRQ

SEQ ID NO: 1157497 - protein, 13 aa, Mycobacterium
DPDPVRAAAASKA

SEQ ID NO: 1157498 - protein, 7 aa, Mycobacterium
DPDRADV

SEQ ID NO: 1157499 - protein, 8 aa, Mycobacterium
DPDRPNAR

SEQ ID NO: 1157500 - protein, 9 aa, Mycobacterium
DPDSELGQE

SEQ ID NO: 1157501 - protein, 7 aa, Mycobacterium
DPDSGAV

SEQ ID NO: 1157502 - protein, 8 aa, Mycobacterium
DPDTDERR

SEQ ID NO: 1157503 - protein, 8 aa, Mycobacterium
DPDTDFSN

SEQ ID NO: 1157504 - protein, 8 aa, Mycobacterium
DPDTEKLR

SEQ ID NO: 1157505 - protein, 15 aa, Mycobacterium
DPDTGETVERGEPGE

SEQ ID NO: 1157506 - protein, 8 aa, Mycobacterium
DPDTGLDD

SEQ ID NO: 1157507 - protein, 13 aa, Mycobacterium
DPDTGVAVPTGAR

SEQ ID NO: 1157508 - protein, 5 aa, Mycobacterium
DPDTW

SEQ ID NO: 1157509 - protein, 17 aa, Mycobacterium
DPDTYSSVTGGERPFGG

SEQ ID NO: 1157510 - protein, 9 aa, Mycobacterium
DPDVRGDRT

SEQ ID NO: 1157511 - protein, 12 aa, Mycobacterium
DPDYARSQGQRT

SEQ ID NO: 1157512 - protein, 11 aa, Mycobacterium
DPEAALDPSKD

SEQ ID NO: 1157513 - protein, 7 aa, Mycobacterium
DPEADPS

SEQ ID NO: 1157514 - protein, 6 aa, Mycobacterium
DPEAGL

SEQ ID NO: 1157515 - protein, 11 aa, Mycobacterium
DPEATAAAIDP

SEQ ID NO: 1157516 - protein, 7 aa, Mycobacterium
DPEDGSS

SEQ ID NO: 1157517 - protein, 20 aa, Mycobacterium
DPEDLARGQDVDPAAGPGYA

SEQ ID NO: 1157518 - protein, 6 aa, Mycobacterium
DPEDVS

SEQ ID NO: 1157519 - protein, 8 aa, Mycobacterium
DPEDWTPP

SEQ ID NO: 1157520 - protein, 6 aa, Mycobacterium
DPEFGT

SEQ ID NO: 1157521 - protein, 5 aa, Mycobacterium
DPEHR

SEQ ID NO: 1157522 - protein, 6 aa, Mycobacterium
DPEKAV

SEQ ID NO: 1157523 - protein, 7 aa, Mycobacterium
DPEKKKA

SEQ ID NO: 1157524 - protein, 11 aa, Mycobacterium
DPEKTAAAQHP

SEQ ID NO: 1157525 - protein, 11 aa, Mycobacterium
DPEKTASSRHP

SEQ ID NO: 1157526 - protein, 15 aa, Mycobacterium
DPELEAAASRYPSPL

SEQ ID NO: 1157527 - protein, 5 aa, Mycobacterium
DPEQF

SEQ ID NO: 1157528 - protein, 5 aa, Mycobacterium
DPEQP

SEQ ID NO: 1157529 - protein, 5 aa, Mycobacterium
DPERV

SEQ ID NO: 1157530 - protein, 6 aa, Mycobacterium
DPESIR

SEQ ID NO: 1157531 - protein, 6 aa, Mycobacterium
DPESQK

SEQ ID NO: 1157532 - protein, 4 aa, Mycobacterium
DPET

SEQ ID NO: 1157533 - protein, 6 aa, Mycobacterium
DPETAQ

SEQ ID NO: 1157534 - protein, 6 aa, Mycobacterium
DPETAR

SEQ ID NO: 1157535 - protein, 6 aa, Mycobacterium
DPETFS

SEQ ID NO: 1157536 - protein, 5 aa, Mycobacterium
DPFPE

SEQ ID NO: 1157537 - protein, 8 aa, Mycobacterium
DPGAAADY

SEQ ID NO: 1157538 - protein, 10 aa, Mycobacterium
DPGAAEALEP

SEQ ID NO: 1157539 - protein, 5 aa, Mycobacterium
DPGAV

SEQ ID NO: 1157540 - protein, 8 aa, Mycobacterium
DPGDPMSL

SEQ ID NO: 1157541 - protein, 25 aa, Mycobacterium
DPGEPVTDDASDWEASAGGAGERLP

SEQ ID NO: 1157542 - protein, 21 aa, Mycobacterium
DPGGVDTSRPGAATSSAWRRD

SEQ ID NO: 1157543 - protein, 7 aa, Mycobacterium
DPGKDKA

SEQ ID NO: 1157544 - protein, 8 aa, Mycobacterium
DPGKVPAA

SEQ ID NO: 1157545 - protein, 4 aa, Mycobacterium
DPGL

SEQ ID NO: 1157546 - protein, 9 aa, Mycobacterium
DPGPDDDEH

SEQ ID NO: 1157547 - protein, 7 aa, Mycobacterium
DPGPKDM

SEQ ID NO: 1157548 - protein, 5 aa, Mycobacterium
DPGQH

SEQ ID NO: 1157549 - protein, 21 aa, Mycobacterium
DPGQRDNTTYVPESSRRARSV

SEQ ID NO: 1157550 - protein, 21 aa, Mycobacterium
DPGQYADRYPRQLSGGQQQRV

SEQ ID NO: 1157551 - protein, 8 aa, Mycobacterium
DPGRAIPP

SEQ ID NO: 1157552 - protein, 9 aa, Mycobacterium
DPGRGGSDH

SEQ ID NO: 1157553 - protein, 7 aa, Mycobacterium
DPGRGGW

SEQ ID NO: 1157554 - protein, 8 aa, Mycobacterium
DPGSDAVE

SEQ ID NO: 1157555 - protein, 4 aa, Mycobacterium
DPGT

SEQ ID NO: 1157556 - protein, 5 aa, Mycobacterium
DPGTA

SEQ ID NO: 1157557 - protein, 7 aa, Mycobacterium
DPGTRRI

SEQ ID NO: 1157558 - protein, 20 aa, Mycobacterium
DPGYAAAAAARREGARRPRA

SEQ ID NO: 1157559 - protein, 10 aa, Mycobacterium
DPGYSEETTQ

SEQ ID NO: 1157560 - protein, 5 aa, Mycobacterium
DPHPA

SEQ ID NO: 1157561 - protein, 5 aa, Mycobacterium
DPHPE

SEQ ID NO: 1157562 - protein, 6 aa, Mycobacterium
DPHSPW

SEQ ID NO: 1157563 - protein, 27 aa, Mycobacterium
DPHVAGRSDSPAASLSLASGKEALDEA

SEQ ID NO: 1157564 - protein, 10 aa, Mycobacterium
DPIADAPRLD

SEQ ID NO: 1157565 - protein, 5 aa, Mycobacterium
DPIPR

SEQ ID NO: 1157566 - protein, 4 aa, Mycobacterium
DPIT

SEQ ID NO: 1157567 - protein, 7 aa, Mycobacterium
DPITAER

SEQ ID NO: 1157568 - protein, 4 aa, Mycobacterium
DPIW

SEQ ID NO: 1157569 - protein, 6 aa, Mycobacterium
DPKFGE

SEQ ID NO: 1157570 - protein, 15 aa, Mycobacterium
DPKITKAGERGDAAR

SEQ ID NO: 1157571 - protein, 19 aa, Mycobacterium
DPKKTAKKIRSAVTDSERE

SEQ ID NO: 1157572 - protein, 9 aa, Mycobacterium
DPKSGKQDF

SEQ ID NO: 1157573 - protein, 4 aa, Mycobacterium
DPKV

SEQ ID NO: 1157574 - protein, 28 aa, Mycobacterium
DPLASPAVEDTADDRVADSETDSVPEKV

SEQ ID NO: 1157575 - protein, 7 aa, Mycobacterium
DPLDPRF

SEQ ID NO: 1157576 - protein, 4 aa, Mycobacterium
DPLG

SEQ ID NO: 1157577 - protein, 5 aa, Mycobacterium
DPLGG

SEQ ID NO: 1157578 - protein, 19 aa, Mycobacterium
DPLGHPNSEVGADPARPYA

SEQ ID NO: 1157579 - protein, 4 aa, Mycobacterium
DPLN

SEQ ID NO: 1157580 - protein, 8 aa, Mycobacterium
DPLPQTVS

SEQ ID NO: 1157581 - protein, 4 aa, Mycobacterium
DPLR

SEQ ID NO: 1157582 - protein, 5 aa, Mycobacterium
DPLRP

SEQ ID NO: 1157583 - protein, 15 aa, Mycobacterium
DPLTGRPHRFVTGRT

SEQ ID NO: 1157584 - protein, 4 aa, Mycobacterium
DPLV

SEQ ID NO: 1157585 - protein, 9 aa, Mycobacterium
DPMADPRPA

SEQ ID NO: 1157586 - protein, 11 aa, Mycobacterium
DPNPPGPDADY

SEQ ID NO: 1157587 - protein, 4 aa, Mycobacterium
DPNV

SEQ ID NO: 1157588 - protein, 7 aa, Mycobacterium
DPPADQI

SEQ ID NO: 1157589 - protein, 6 aa, Mycobacterium
DPPAGV

SEQ ID NO: 1157590 - protein, 13 aa, Mycobacterium
DPPDYEPTPDRTV

SEQ ID NO: 1157591 - protein, 9 aa, Mycobacterium
DPPEHPDVS

SEQ ID NO: 1157592 - protein, 26 aa, Mycobacterium
DPPEPLELPGPTGSAVPTGWRSARTG

SEQ ID NO: 1157593 - protein, 19 aa, Mycobacterium
DPPGAPPSAPPAEPPADVP

SEQ ID NO: 1157594 - protein, 7 aa, Mycobacterium
DPPGRWK

SEQ ID NO: 1157595 - protein, 9 aa, Mycobacterium
DPPLGASDN

SEQ ID NO: 1157596 - protein, 24 aa, Mycobacterium
DPPPSLSKTRREAERPEHKHTPDE

SEQ ID NO: 1157597 - protein, 5 aa, Mycobacterium
DPPQC

SEQ ID NO: 1157598 - protein, 9 aa, Mycobacterium
DPPRAGAGR

SEQ ID NO: 1157599 - protein, 11 aa, Mycobacterium
DPPRRQGRSAY

SEQ ID NO: 1157600 - protein, 9 aa, Mycobacterium
DPPSTGVGG

SEQ ID NO: 1157601 - protein, 4 aa, Mycobacterium
DPPT

SEQ ID NO: 1157602 - protein, 7 aa, Mycobacterium
DPPTETD

SEQ ID NO: 1157603 - protein, 7 aa, Mycobacterium
DPPTGDI

SEQ ID NO: 1157604 - protein, 6 aa, Mycobacterium
DPPVTA

SEQ ID NO: 1157605 - protein, 10 aa, Mycobacterium
DPPVTPEEPL

SEQ ID NO: 1157606 - protein, 11 aa, Mycobacterium
DPPWETRSDYD

SEQ ID NO: 1157607 - protein, 6 aa, Mycobacterium
DPPWPE

SEQ ID NO: 1157608 - protein, 4 aa, Mycobacterium
DPQA

SEQ ID NO: 1157609 - protein, 8 aa, Mycobacterium
DPQATGEA

SEQ ID NO: 1157610 - protein, 6 aa, Mycobacterium
DPQFPG

SEQ ID NO: 1157611 - protein, 10 aa, Mycobacterium
DPQIARREAA

SEQ ID NO: 1157612 - protein, 5 aa, Mycobacterium
DPQIK

SEQ ID NO: 1157613 - protein, 4 aa, Mycobacterium
DPQL

SEQ ID NO: 1157614 - protein, 5 aa, Mycobacterium
DPQLR

SEQ ID NO: 1157615 - protein, 4 aa, Mycobacterium
DPQQ

SEQ ID NO: 1157616 - protein, 4 aa, Mycobacterium
DPQT

SEQ ID NO: 1157617 - protein, 4 aa, Mycobacterium
DPRA

SEQ ID NO: 1157618 - protein, 5 aa, Mycobacterium
DPRAA

SEQ ID NO: 1157619 - protein, 12 aa, Mycobacterium
DPRAGDGGRGYR

SEQ ID NO: 1157620 - protein, 7 aa, Mycobacterium
DPRAPEL

SEQ ID NO: 1157621 - protein, 5 aa, Mycobacterium
DPREE

SEQ ID NO: 1157622 - protein, 15 aa, Mycobacterium
DPRETSKDDGERRKL

SEQ ID NO: 1157623 - protein, 12 aa, Mycobacterium
DPRGDAEPQSYG

SEQ ID NO: 1157624 - protein, 6 aa, Mycobacterium
DPRLTG

SEQ ID NO: 1157625 - protein, 6 aa, Mycobacterium
DPRLTT

SEQ ID NO: 1157626 - protein, 6 aa, Mycobacterium
DPRRDA

SEQ ID NO: 1157627 - protein, 8 aa, Mycobacterium
DPRRPANT

SEQ ID NO: 1157628 - protein, 9 aa, Mycobacterium
DPRRRPDWG

SEQ ID NO: 1157629 - protein, 8 aa, Mycobacterium
DPRRRSAV

SEQ ID NO: 1157630 - protein, 4 aa, Mycobacterium
DPRS

SEQ ID NO: 1157631 - protein, 8 aa, Mycobacterium
DPRSAAHP

SEQ ID NO: 1157632 - protein, 7 aa, Mycobacterium
DPRSGAQ

SEQ ID NO: 1157633 - protein, 6 aa, Mycobacterium
DPRSHG

SEQ ID NO: 1157634 - protein, 8 aa, Mycobacterium
DPRSTPAL

SEQ ID NO: 1157635 - protein, 9 aa, Mycobacterium
DPRSVPPER

SEQ ID NO: 1157636 - protein, 7 aa, Mycobacterium
DPRTLKE

SEQ ID NO: 1157637 - protein, 6 aa, Mycobacterium
DPRTVN

SEQ ID NO: 1157638 - protein, 6 aa, Mycobacterium
DPRWTQ

SEQ ID NO: 1157639 - protein, 8 aa, Mycobacterium
DPSAGEGL

SEQ ID NO: 1157640 - protein, 7 aa, Mycobacterium
DPSANPY

SEQ ID NO: 1157641 - protein, 7 aa, Mycobacterium
DPSANRL

SEQ ID NO: 1157642 - protein, 5 aa, Mycobacterium
DPSDL

SEQ ID NO: 1157643 - protein, 7 aa, Mycobacterium
DPSFNEK

SEQ ID NO: 1157644 - protein, 6 aa, Mycobacterium
DPSGLT

SEQ ID NO: 1157645 - protein, 22 aa, Mycobacterium
DPSIPTDESGTRHRSAERTAIQ

SEQ ID NO: 1157646 - protein, 4 aa, Mycobacterium
DPSL

SEQ ID NO: 1157647 - protein, 8 aa, Mycobacterium
DPSLDEAQ

SEQ ID NO: 1157648 - protein, 7 aa, Mycobacterium
DPSLSQI

SEQ ID NO: 1157649 - protein, 7 aa, Mycobacterium
DPSPERI

SEQ ID NO: 1157650 - protein, 10 aa, Mycobacterium
DPSPGTPGGT

SEQ ID NO: 1157651 - protein, 10 aa, Mycobacterium
DPSRAPRTKF

SEQ ID NO: 1157652 - protein, 5 aa, Mycobacterium
DPSRP

SEQ ID NO: 1157653 - protein, 6 aa, Mycobacterium
DPSSDE

SEQ ID NO: 1157654 - protein, 10 aa, Mycobacterium
DPSSPYSGGA

SEQ ID NO: 1157655 - protein, 30 aa, Mycobacterium
DPSTGEEYGTAPVSNEADIDNAYAAASKAF

SEQ ID NO: 1157656 - protein, 8 aa, Mycobacterium
DPSTHAAI

SEQ ID NO: 1157657 - protein, 6 aa, Mycobacterium
DPSTLA

SEQ ID NO: 1157658 - protein, 8 aa, Mycobacterium
DPSTVGDN

SEQ ID NO: 1157659 - protein, 13 aa, Mycobacterium
DPSVPTPKAEHLP

SEQ ID NO: 1157660 - protein, 5 aa, Mycobacterium
DPSVR

SEQ ID NO: 1157661 - protein, 7 aa, Mycobacterium
DPSVRDS

SEQ ID NO: 1157662 - protein, 8 aa, Mycobacterium
DPSWGTDA

SEQ ID NO: 1157663 - protein, 14 aa, Mycobacterium
DPSYPADDDYVGRR

SEQ ID NO: 1157664 - protein, 7 aa, Mycobacterium
DPTAGAA

SEQ ID NO: 1157665 - protein, 15 aa, Mycobacterium
DPTEADDDTDAGAKI

SEQ ID NO: 1157666 - protein, 5 aa, Mycobacterium
DPTFD

SEQ ID NO: 1157667 - protein, 4 aa, Mycobacterium
DPTG

SEQ ID NO: 1157668 - protein, 6 aa, Mycobacterium
DPTGFR

SEQ ID NO: 1157669 - protein, 4 aa, Mycobacterium
DPTN

SEQ ID NO: 1157670 - protein, 10 aa, Mycobacterium
DPTNDQMEDE

SEQ ID NO: 1157671 - protein, 6 aa, Mycobacterium
DPTRFD

SEQ ID NO: 1157672 - protein, 12 aa, Mycobacterium
DPTSNADEFTKP

SEQ ID NO: 1157673 - protein, 9 aa, Mycobacterium
DPTTPLEET

SEQ ID NO: 1157674 - protein, 4 aa, Mycobacterium
DPVA

SEQ ID NO: 1157675 - protein, 13 aa, Mycobacterium
DPVAPQLISAEAV

SEQ ID NO: 1157676 - protein, 7 aa, Mycobacterium
DPVDPAE

SEQ ID NO: 1157677 - protein, 11 aa, Mycobacterium
DPVDRTAVGPA

SEQ ID NO: 1157678 - protein, 6 aa, Mycobacterium
DPVDTA

SEQ ID NO: 1157679 - protein, 11 aa, Mycobacterium
DPVGGELSEPA

SEQ ID NO: 1157680 - protein, 13 aa, Mycobacterium
DPVGSRAHRGTDR

SEQ ID NO: 1157681 - protein, 4 aa, Mycobacterium
DPVK

SEQ ID NO: 1157682 - protein, 5 aa, Mycobacterium
DPVKV

SEQ ID NO: 1157683 - protein, 13 aa, Mycobacterium
DPVPGERRDAVAG

SEQ ID NO: 1157684 - protein, 14 aa, Mycobacterium
DPVRTGYANEGQGD

SEQ ID NO: 1157685 - protein, 6 aa, Mycobacterium
DPVSSV

SEQ ID NO: 1157686 - protein, 4 aa, Mycobacterium
DPVT

SEQ ID NO: 1157687 - protein, 16 aa, Mycobacterium
DPVTAEREQWDDGNNT

SEQ ID NO: 1157688 - protein, 6 aa, Mycobacterium
DPVTSS

SEQ ID NO: 1157689 - protein, 4 aa, Mycobacterium
DPVV

SEQ ID NO: 1157690 - protein, 4 aa, Mycobacterium
DPWR

SEQ ID NO: 1157691 - protein, 9 aa, Mycobacterium
DPYATGPAR

SEQ ID NO: 1157692 - protein, 6 aa, Mycobacterium
DPYPTY

SEQ ID NO: 1157693 - protein, 9 aa, Mycobacterium
DPYYGTQDD

SEQ ID NO: 1157694 - protein, 16 aa, Mycobacterium
DQAALSAKSTGGSKTA

SEQ ID NO: 1157695 - protein, 5 aa, Mycobacterium
DQAAS

SEQ ID NO: 1157696 - protein, 39 aa, Mycobacterium
DQAASGAQKLSTSSEDRVIGRDGKSYPATKPKPEPEVSD

SEQ ID NO: 1157697 - protein, 5 aa, Mycobacterium
DQAER

SEQ ID NO: 1157698 - protein, 9 aa, Mycobacterium
DQAHSTGDV

SEQ ID NO: 1157699 - protein, 6 aa, Mycobacterium
DQARAV

SEQ ID NO: 1157700 - protein, 13 aa, Mycobacterium
DQASVEEVAERAG

SEQ ID NO: 1157701 - protein, 5 aa, Mycobacterium
DQATT

SEQ ID NO: 1157702 - protein, 12 aa, Mycobacterium
DQDGSQRVIASS

SEQ ID NO: 1157703 - protein, 5 aa, Mycobacterium
DQDHS

SEQ ID NO: 1157704 - protein, 7 aa, Mycobacterium
DQDRSRW

SEQ ID NO: 1157705 - protein, 12 aa, Mycobacterium
DQEAGGVGTGSV

SEQ ID NO: 1157706 - protein, 5 aa, Mycobacterium
DQEEV

SEQ ID NO: 1157707 - protein, 7 aa, Mycobacterium
DQEGNKA

SEQ ID NO: 1157708 - protein, 5 aa, Mycobacterium
DQELS

SEQ ID NO: 1157709 - protein, 10 aa, Mycobacterium
DQEQQRLADA

SEQ ID NO: 1157710 - protein, 6 aa, Mycobacterium
DQERRE

SEQ ID NO: 1157711 - protein, 6 aa, Mycobacterium
DQESKA

SEQ ID NO: 1157712 - protein, 6 aa, Mycobacterium
DQGDRW

SEQ ID NO: 1157713 - protein, 15 aa, Mycobacterium
DQGFGTSQDAARASL

SEQ ID NO: 1157714 - protein, 8 aa, Mycobacterium
DQHDRTRD

SEQ ID NO: 1157715 - protein, 7 aa, Mycobacterium
DQIGEGD

SEQ ID NO: 1157716 - protein, 7 aa, Mycobacterium
DQIRGEA

SEQ ID NO: 1157717 - protein, 21 aa, Mycobacterium
DQKTKGKYADKVNKAQSAAKD

SEQ ID NO: 1157718 - protein, 7 aa, Mycobacterium
DQLAPVD

SEQ ID NO: 1157719 - protein, 4 aa, Mycobacterium
DQLP

SEQ ID NO: 1157720 - protein, 7 aa, Mycobacterium
DQNPDTR

SEQ ID NO: 1157721 - protein, 8 aa, Mycobacterium
DQNTYAEK

SEQ ID NO: 1157722 - protein, 4 aa, Mycobacterium
DQNV

SEQ ID NO: 1157723 - protein, 8 aa, Mycobacterium
DQPAVDGS

SEQ ID NO: 1157724 - protein, 5 aa, Mycobacterium
DQPDL

SEQ ID NO: 1157725 - protein, 5 aa, Mycobacterium
DQPEI

SEQ ID NO: 1157726 - protein, 12 aa, Mycobacterium
DQPNLGGSGGYS

SEQ ID NO: 1157727 - protein, 5 aa, Mycobacterium
DQPNP

SEQ ID NO: 1157728 - protein, 9 aa, Mycobacterium
DQPTPKPRV

SEQ ID NO: 1157729 - protein, 10 aa, Mycobacterium
DQPTSGSVTF

SEQ ID NO: 1157730 - protein, 5 aa, Mycobacterium
DQPWE

SEQ ID NO: 1157731 - protein, 7 aa, Mycobacterium
DQQLPDG

SEQ ID NO: 1157732 - protein, 5 aa, Mycobacterium
DQRHD

SEQ ID NO: 1157733 - protein, 8 aa, Mycobacterium
DQRPPAEL

SEQ ID NO: 1157734 - protein, 6 aa, Mycobacterium
DQRQQR

SEQ ID NO: 1157735 - protein, 9 aa, Mycobacterium
DQRSEGNSW

SEQ ID NO: 1157736 - protein, 5 aa, Mycobacterium
DQRTR

SEQ ID NO: 1157737 - protein, 6 aa, Mycobacterium
DQSATA

SEQ ID NO: 1157738 - protein, 10 aa, Mycobacterium
DQSATSDERR

SEQ ID NO: 1157739 - protein, 6 aa, Mycobacterium
DQSERM

SEQ ID NO: 1157740 - protein, 10 aa, Mycobacterium
DQSGGSTPKA

SEQ ID NO: 1157741 - protein, 7 aa, Mycobacterium
DQSIADG

SEQ ID NO: 1157742 - protein, 7 aa, Mycobacterium
DQSINGD

SEQ ID NO: 1157743 - protein, 7 aa, Mycobacterium
DQSPVNA

SEQ ID NO: 1157744 - protein, 18 aa, Mycobacterium
DQSRAQKVTSELSHAQNE

SEQ ID NO: 1157745 - protein, 10 aa, Mycobacterium
DQTDVPESGD

SEQ ID NO: 1157746 - protein, 7 aa, Mycobacterium
DQTGDEE

SEQ ID NO: 1157747 - protein, 8 aa, Mycobacterium
DQTGEGLG

SEQ ID NO: 1157748 - protein, 5 aa, Mycobacterium
DQTGL

SEQ ID NO: 1157749 - protein, 6 aa, Mycobacterium
DQTGRS

SEQ ID NO: 1157750 - protein, 12 aa, Mycobacterium
DQTLDDPHEATD

SEQ ID NO: 1157751 - protein, 9 aa, Mycobacterium
DQVADYAKR

SEQ ID NO: 1157752 - protein, 16 aa, Mycobacterium
DQVDESTPAASQRHEG

SEQ ID NO: 1157753 - protein, 18 aa, Mycobacterium
DQVDESTPTAPESPYGET

SEQ ID NO: 1157754 - protein, 8 aa, Mycobacterium
DQVGDGGR

SEQ ID NO: 1157755 - protein, 22 aa, Mycobacterium
DQVGSGAWPVDDNPLRGAPHTA

SEQ ID NO: 1157756 - protein, 6 aa, Mycobacterium
DQVPSA

SEQ ID NO: 1157757 - protein, 13 aa, Mycobacterium
DQVSGASGSRFNR

SEQ ID NO: 1157758 - protein, 8 aa, Mycobacterium
DQWPPTRA

SEQ ID NO: 1157759 - protein, 9 aa, Mycobacterium
DQYGRPAPL

SEQ ID NO: 1157760 - protein, 19 aa, Mycobacterium
DRAAAEEKLDGVGGGSVSG

SEQ ID NO: 1157761 - protein, 8 aa, Mycobacterium
DRAADELT

SEQ ID NO: 1157762 - protein, 4 aa, Mycobacterium
DRAE

SEQ ID NO: 1157763 - protein, 20 aa, Mycobacterium
DRAEEARTDANSRVEESRAR

SEQ ID NO: 1157764 - protein, 10 aa, Mycobacterium
DRAEKDDSKA

SEQ ID NO: 1157765 - protein, 6 aa, Mycobacterium
DRAESQ

SEQ ID NO: 1157766 - protein, 4 aa, Mycobacterium
DRAF

SEQ ID NO: 1157767 - protein, 13 aa, Mycobacterium
DRAGKPQSESVEA

SEQ ID NO: 1157768 - protein, 6 aa, Mycobacterium
DRAGLA

SEQ ID NO: 1157769 - protein, 6 aa, Mycobacterium
DRAGLT

SEQ ID NO: 1157770 - protein, 7 aa, Mycobacterium
DRAHPKG

SEQ ID NO: 1157771 - protein, 9 aa, Mycobacterium
DRANPRDAG

SEQ ID NO: 1157772 - protein, 8 aa, Mycobacterium
DRAPRTPY

SEQ ID NO: 1157773 - protein, 13 aa, Mycobacterium
DRAPSGHEPAPIV

SEQ ID NO: 1157774 - protein, 5 aa, Mycobacterium
DRAQE

SEQ ID NO: 1157775 - protein, 8 aa, Mycobacterium
DRARELRE

SEQ ID NO: 1157776 - protein, 5 aa, Mycobacterium
DRARS

SEQ ID NO: 1157777 - protein, 6 aa, Mycobacterium
DRASAL

SEQ ID NO: 1157778 - protein, 5 aa, Mycobacterium
DRASF

SEQ ID NO: 1157779 - protein, 6 aa, Mycobacterium
DRASID

SEQ ID NO: 1157780 - protein, 7 aa, Mycobacterium
DRASYNP

SEQ ID NO: 1157781 - protein, 7 aa, Mycobacterium
DRATGRL

SEQ ID NO: 1157782 - protein, 9 aa, Mycobacterium
DRATTTDHG

SEQ ID NO: 1157783 - protein, 4 aa, Mycobacterium
DRAV

SEQ ID NO: 1157784 - protein, 13 aa, Mycobacterium
DRAYSNAAAQGKF

SEQ ID NO: 1157785 - protein, 12 aa, Mycobacterium
DRDATGVGPLPA

SEQ ID NO: 1157786 - protein, 10 aa, Mycobacterium
DRDDDRAGGS

SEQ ID NO: 1157787 - protein, 6 aa, Mycobacterium
DRDDSA

SEQ ID NO: 1157788 - protein, 7 aa, Mycobacterium
DRDLGDR

SEQ ID NO: 1157789 - protein, 7 aa, Mycobacterium
DRDPEAA

SEQ ID NO: 1157790 - protein, 17 aa, Mycobacterium
DRDPERGFSATALMESR

SEQ ID NO: 1157791 - protein, 5 aa, Mycobacterium
DRDPG

SEQ ID NO: 1157792 - protein, 7 aa, Mycobacterium
DRDQRKL

SEQ ID NO: 1157793 - protein, 5 aa, Mycobacterium
DRDRY

SEQ ID NO: 1157794 - protein, 9 aa, Mycobacterium
DRDSGIGAE

SEQ ID NO: 1157795 - protein, 13 aa, Mycobacterium
DRDSSGHRSYRPA

SEQ ID NO: 1157796 - protein, 13 aa, Mycobacterium
DRDTAKGRALRRD

SEQ ID NO: 1157797 - protein, 4 aa, Mycobacterium
DREA

SEQ ID NO: 1157798 - protein, 10 aa, Mycobacterium
DREADSGSQV

SEQ ID NO: 1157799 - protein, 8 aa, Mycobacterium
DREERPRS

SEQ ID NO: 1157800 - protein, 4 aa, Mycobacterium
DREF

SEQ ID NO: 1157801 - protein, 8 aa, Mycobacterium
DREGELTD

SEQ ID NO: 1157802 - protein, 5 aa, Mycobacterium
DREGV

SEQ ID NO: 1157803 - protein, 5 aa, Mycobacterium
DRERR

SEQ ID NO: 1157804 - protein, 9 aa, Mycobacterium
DRESGAASF

SEQ ID NO: 1157805 - protein, 8 aa, Mycobacterium
DRESIRTA

SEQ ID NO: 1157806 - protein, 6 aa, Mycobacterium
DRFGDA

SEQ ID NO: 1157807 - protein, 6 aa, Mycobacterium
DRFGPA

SEQ ID NO: 1157808 - protein, 18 aa, Mycobacterium
DRGAADAAASQAAGLGGG

SEQ ID NO: 1157809 - protein, 21 aa, Mycobacterium
DRGAGRPTKRDRRRLDRWLAG

SEQ ID NO: 1157810 - protein, 17 aa, Mycobacterium
DRGEELTDAEPDECPVA

SEQ ID NO: 1157811 - protein, 11 aa, Mycobacterium
DRGGAPPARYA

SEQ ID NO: 1157812 - protein, 7 aa, Mycobacterium
DRGGPSL

SEQ ID NO: 1157813 - protein, 11 aa, Mycobacterium
DRGGPTYTKDT

SEQ ID NO: 1157814 - protein, 5 aa, Mycobacterium
DRGIG

SEQ ID NO: 1157815 - protein, 5 aa, Mycobacterium
DRGIH

SEQ ID NO: 1157816 - protein, 7 aa, Mycobacterium
DRGLAGA

SEQ ID NO: 1157817 - protein, 4 aa, Mycobacterium
DRGP

SEQ ID NO: 1157818 - protein, 5 aa, Mycobacterium
DRGPD

SEQ ID NO: 1157819 - protein, 5 aa, Mycobacterium
DRGPV

SEQ ID NO: 1157820 - protein, 21 aa, Mycobacterium
DRGRATSATGPEASPVPPEID

SEQ ID NO: 1157821 - protein, 6 aa, Mycobacterium
DRGRLA

SEQ ID NO: 1157822 - protein, 5 aa, Mycobacterium
DRGSA

SEQ ID NO: 1157823 - protein, 10 aa, Mycobacterium
DRGSAAPTVQ

SEQ ID NO: 1157824 - protein, 9 aa, Mycobacterium
DRGSDGKWR

SEQ ID NO: 1157825 - protein, 5 aa, Mycobacterium
DRGSG

SEQ ID NO: 1157826 - protein, 9 aa, Mycobacterium
DRGSGSQAE

SEQ ID NO: 1157827 - protein, 5 aa, Mycobacterium
DRGSP

SEQ ID NO: 1157828 - protein, 30 aa, Mycobacterium
DRGSRDDAGHRGDPQPETSDDLYGATPARH

SEQ ID NO: 1157829 - protein, 9 aa, Mycobacterium
DRGTRSVAA

SEQ ID NO: 1157830 - protein, 5 aa, Mycobacterium
DRGTV

SEQ ID NO: 1157831 - protein, 11 aa, Mycobacterium
DRGWHGSSEQF

SEQ ID NO: 1157832 - protein, 6 aa, Mycobacterium
DRHGHP

SEQ ID NO: 1157833 - protein, 6 aa, Mycobacterium
DRHVRG

SEQ ID NO: 1157834 - protein, 6 aa, Mycobacterium
DRIDAA

SEQ ID NO: 1157835 - protein, 15 aa, Mycobacterium
DRIDGPTLRPLPTAD

SEQ ID NO: 1157836 - protein, 7 aa, Mycobacterium
DRIGGPD

SEQ ID NO: 1157837 - protein, 5 aa, Mycobacterium
DRINH

SEQ ID NO: 1157838 - protein, 6 aa, Mycobacterium
DRIPED

SEQ ID NO: 1157839 - protein, 7 aa, Mycobacterium
DRIPGPG

SEQ ID NO: 1157840 - protein, 13 aa, Mycobacterium
DRIPGTGALSETL

SEQ ID NO: 1157841 - protein, 7 aa, Mycobacterium
DRKPREL

SEQ ID NO: 1157842 - protein, 6 aa, Mycobacterium
DRKSGA

SEQ ID NO: 1157843 - protein, 8 aa, Mycobacterium
DRLGSGPF

SEQ ID NO: 1157844 - protein, 4 aa, Mycobacterium
DRLN

SEQ ID NO: 1157845 - protein, 13 aa, Mycobacterium
DRLNDAADDLRDG

SEQ ID NO: 1157846 - protein, 7 aa, Mycobacterium
DRLPDGV

SEQ ID NO: 1157847 - protein, 5 aa, Mycobacterium
DRLPG

SEQ ID NO: 1157848 - protein, 8 aa, Mycobacterium
DRLPSERA

SEQ ID NO: 1157849 - protein, 12 aa, Mycobacterium
DRLRAKARGGIT

SEQ ID NO: 1157850 - protein, 10 aa, Mycobacterium
DRLSRDGGTL

SEQ ID NO: 1157851 - protein, 6 aa, Mycobacterium
DRLTKG

SEQ ID NO: 1157852 - protein, 7 aa, Mycobacterium
DRNAPHE

SEQ ID NO: 1157853 - protein, 7 aa, Mycobacterium
DRNEAGL

SEQ ID NO: 1157854 - protein, 6 aa, Mycobacterium
DRNGDE

SEQ ID NO: 1157855 - protein, 6 aa, Mycobacterium
DRNKER

SEQ ID NO: 1157856 - protein, 6 aa, Mycobacterium
DRNPNS

SEQ ID NO: 1157857 - protein, 4 aa, Mycobacterium
DRNR

SEQ ID NO: 1157858 - protein, 5 aa, Mycobacterium
DRNRA

SEQ ID NO: 1157859 - protein, 6 aa, Mycobacterium
DRNTLR

SEQ ID NO: 1157860 - protein, 9 aa, Mycobacterium
DRPDDDGVG

SEQ ID NO: 1157861 - protein, 5 aa, Mycobacterium
DRPDG

SEQ ID NO: 1157862 - protein, 13 aa, Mycobacterium
DRPDGDPRPAVAH

SEQ ID NO: 1157863 - protein, 8 aa, Mycobacterium
DRPDPSPR

SEQ ID NO: 1157864 - protein, 7 aa, Mycobacterium
DRPDSDV

SEQ ID NO: 1157865 - protein, 5 aa, Mycobacterium
DRPEA

SEQ ID NO: 1157866 - protein, 7 aa, Mycobacterium
DRPEARW

SEQ ID NO: 1157867 - protein, 4 aa, Mycobacterium
DRPF

SEQ ID NO: 1157868 - protein, 5 aa, Mycobacterium
DRPGI

SEQ ID NO: 1157869 - protein, 7 aa, Mycobacterium
DRPHPQT

SEQ ID NO: 1157870 - protein, 5 aa, Mycobacterium
DRPIR

SEQ ID NO: 1157871 - protein, 5 aa, Mycobacterium
DRPLD

SEQ ID NO: 1157872 - protein, 6 aa, Mycobacterium
DRPLGE

SEQ ID NO: 1157873 - protein, 12 aa, Mycobacterium
DRPQSKGQEVAD

SEQ ID NO: 1157874 - protein, 15 aa, Mycobacterium
DRPRGLDARTESSGA

SEQ ID NO: 1157875 - protein, 9 aa, Mycobacterium
DRPSSTGKF

SEQ ID NO: 1157876 - protein, 20 aa, Mycobacterium
DRPTKGSVAVAGRDTRTLTE

SEQ ID NO: 1157877 - protein, 10 aa, Mycobacterium
DRPTPSQREF

SEQ ID NO: 1157878 - protein, 5 aa, Mycobacterium
DRQAE

SEQ ID NO: 1157879 - protein, 7 aa, Mycobacterium
DRQAKGG

SEQ ID NO: 1157880 - protein, 7 aa, Mycobacterium
DRQRVPE

SEQ ID NO: 1157881 - protein, 4 aa, Mycobacterium
DRRA

SEQ ID NO: 1157882 - protein, 8 aa, Mycobacterium
DRRAARTR

SEQ ID NO: 1157883 - protein, 10 aa, Mycobacterium
DRRAHPTDDL

SEQ ID NO: 1157884 - protein, 12 aa, Mycobacterium
DRRAVTDPTKRH

SEQ ID NO: 1157885 - protein, 5 aa, Mycobacterium
DRREL

SEQ ID NO: 1157886 - protein, 5 aa, Mycobacterium
DRRER

SEQ ID NO: 1157887 - protein, 8 aa, Mycobacterium
DRRGDQAP

SEQ ID NO: 1157888 - protein, 8 aa, Mycobacterium
DRRGRRTD

SEQ ID NO: 1157889 - protein, 8 aa, Mycobacterium
DRRKNLGD

SEQ ID NO: 1157890 - protein, 8 aa, Mycobacterium
DRRLGDRT

SEQ ID NO: 1157891 - protein, 10 aa, Mycobacterium
DRRPDLPSGK

SEQ ID NO: 1157892 - protein, 7 aa, Mycobacterium
DRRQPRR

SEQ ID NO: 1157893 - protein, 7 aa, Mycobacterium
DRRQTPT

SEQ ID NO: 1157894 - protein, 9 aa, Mycobacterium
DRRREPRDD

SEQ ID NO: 1157895 - protein, 8 aa, Mycobacterium
DRRRGTQH

SEQ ID NO: 1157896 - protein, 15 aa, Mycobacterium
DRRRNPITKQRRRQV

SEQ ID NO: 1157897 - protein, 22 aa, Mycobacterium
DRRRRGERGGEGGGGGDTEIRE

SEQ ID NO: 1157898 - protein, 18 aa, Mycobacterium
DRRSARKRNALAARSRKR

SEQ ID NO: 1157899 - protein, 6 aa, Mycobacterium
DRRSLD

SEQ ID NO: 1157900 - protein, 6 aa, Mycobacterium
DRRTHE

SEQ ID NO: 1157901 - protein, 6 aa, Mycobacterium
DRRTNQ

SEQ ID NO: 1157902 - protein, 7 aa, Mycobacterium
DRRYGGS

SEQ ID NO: 1157903 - protein, 5 aa, Mycobacterium
DRSDR

SEQ ID NO: 1157904 - protein, 5 aa, Mycobacterium
DRSDV

SEQ ID NO: 1157905 - protein, 5 aa, Mycobacterium
DRSER

SEQ ID NO: 1157906 - protein, 4 aa, Mycobacterium
DRSG

SEQ ID NO: 1157907 - protein, 17 aa, Mycobacterium
DRSGYHPAQLSGGQRQR

SEQ ID NO: 1157908 - protein, 4 aa, Mycobacterium
DRSI

SEQ ID NO: 1157909 - protein, 12 aa, Mycobacterium
DRSKDVIKSGGE

SEQ ID NO: 1157910 - protein, 11 aa, Mycobacterium
DRSRAKGASRW

SEQ ID NO: 1157911 - protein, 10 aa, Mycobacterium
DRSRKVAEGR

SEQ ID NO: 1157912 - protein, 6 aa, Mycobacterium
DRSSVL

SEQ ID NO: 1157913 - protein, 4 aa, Mycobacterium
DRSV

SEQ ID NO: 1157914 - protein, 5 aa, Mycobacterium
DRSVG

SEQ ID NO: 1157915 - protein, 12 aa, Mycobacterium
DRSWGGDADNDD

SEQ ID NO: 1157916 - protein, 4 aa, Mycobacterium
DRSY

SEQ ID NO: 1157917 - protein, 9 aa, Mycobacterium
DRTAAPDGR

SEQ ID NO: 1157918 - protein, 5 aa, Mycobacterium
DRTAR

SEQ ID NO: 1157919 - protein, 6 aa, Mycobacterium
DRTDPL

SEQ ID NO: 1157920 - protein, 8 aa, Mycobacterium
DRTEFGAR

SEQ ID NO: 1157921 - protein, 4 aa, Mycobacterium
DRTF

SEQ ID NO: 1157922 - protein, 5 aa, Mycobacterium
DRTGA

SEQ ID NO: 1157923 - protein, 7 aa, Mycobacterium
DRTGALR

SEQ ID NO: 1157924 - protein, 7 aa, Mycobacterium
DRTGARR

SEQ ID NO: 1157925 - protein, 7 aa, Mycobacterium
DRTGGNP

SEQ ID NO: 1157926 - protein, 11 aa, Mycobacterium
DRTINPGVPTP

SEQ ID NO: 1157927 - protein, 7 aa, Mycobacterium
DRTPGFE

SEQ ID NO: 1157928 - protein, 8 aa, Mycobacterium
DRTQTAKR

SEQ ID NO: 1157929 - protein, 11 aa, Mycobacterium
DRTRDQARSLR

SEQ ID NO: 1157930 - protein, 11 aa, Mycobacterium
DRTSGRDDTYF

SEQ ID NO: 1157931 - protein, 6 aa, Mycobacterium
DRTSQP

SEQ ID NO: 1157932 - protein, 5 aa, Mycobacterium
DRTVD

SEQ ID NO: 1157933 - protein, 5 aa, Mycobacterium
DRTWP

SEQ ID NO: 1157934 - protein, 8 aa, Mycobacterium
DRVAANER

SEQ ID NO: 1157935 - protein, 4 aa, Mycobacterium
DRVD

SEQ ID NO: 1157936 - protein, 11 aa, Mycobacterium
DRVGGRAYTTT

SEQ ID NO: 1157937 - protein, 7 aa, Mycobacterium
DRVGGTW

SEQ ID NO: 1157938 - protein, 7 aa, Mycobacterium
DRVGKRG

SEQ ID NO: 1157939 - protein, 5 aa, Mycobacterium
DRVGR

SEQ ID NO: 1157940 - protein, 7 aa, Mycobacterium
DRVSGRT

SEQ ID NO: 1157941 - protein, 7 aa, Mycobacterium
DRYDPDK

SEQ ID NO: 1157942 - protein, 4 aa, Mycobacterium
DRYG

SEQ ID NO: 1157943 - protein, 7 aa, Mycobacterium
DRYGNQN

SEQ ID NO: 1157944 - protein, 6 aa, Mycobacterium
DRYPDV

SEQ ID NO: 1157945 - protein, 12 aa, Mycobacterium
DRYPGEDAEPAN

SEQ ID NO: 1157946 - protein, 9 aa, Mycobacterium
DRYTPEQYP

SEQ ID NO: 1157947 - protein, 7 aa, Mycobacterium
DSAADEP

SEQ ID NO: 1157948 - protein, 7 aa, Mycobacterium
DSAAGTF

SEQ ID NO: 1157949 - protein, 12 aa, Mycobacterium
DSAARDESIREG

SEQ ID NO: 1157950 - protein, 11 aa, Mycobacterium
DSAATTAERAD

SEQ ID NO: 1157951 - protein, 10 aa, Mycobacterium
DSADADDTAI

SEQ ID NO: 1157952 - protein, 7 aa, Mycobacterium
DSAEGVP

SEQ ID NO: 1157953 - protein, 6 aa, Mycobacterium
DSAEGY

SEQ ID NO: 1157954 - protein, 18 aa, Mycobacterium
DSAGKRSAARRPVTGAER

SEQ ID NO: 1157955 - protein, 30 aa, Mycobacterium
DSAGPSRNPVVSPSAAATQPIAPGRAGKVA

SEQ ID NO: 1157956 - protein, 5 aa, Mycobacterium
DSAKA

SEQ ID NO: 1157957 - protein, 8 aa, Mycobacterium
DSALPGAA

SEQ ID NO: 1157958 - protein, 7 aa, Mycobacterium
DSAPEGV

SEQ ID NO: 1157959 - protein, 6 aa, Mycobacterium
DSAPNF

SEQ ID NO: 1157960 - protein, 7 aa, Mycobacterium
DSAPVED

SEQ ID NO: 1157961 - protein, 14 aa, Mycobacterium
DSAQLDSDEVSAAL

SEQ ID NO: 1157962 - protein, 9 aa, Mycobacterium
DSASTVRPM

SEQ ID NO: 1157963 - protein, 9 aa, Mycobacterium
DSATEESTQ

SEQ ID NO: 1157964 - protein, 7 aa, Mycobacterium
DSATGFA

SEQ ID NO: 1157965 - protein, 7 aa, Mycobacterium
DSATGVP

SEQ ID NO: 1157966 - protein, 6 aa, Mycobacterium
DSATPL

SEQ ID NO: 1157967 - protein, 5 aa, Mycobacterium
DSATV

SEQ ID NO: 1157968 - protein, 4 aa, Mycobacterium
DSAV

SEQ ID NO: 1157969 - protein, 9 aa, Mycobacterium
DSDAAAASE

SEQ ID NO: 1157970 - protein, 12 aa, Mycobacterium
DSDADGSGDLRG

SEQ ID NO: 1157971 - protein, 10 aa, Mycobacterium
DSDAERRDRI

SEQ ID NO: 1157972 - protein, 11 aa, Mycobacterium
DSDAHAGHTET

SEQ ID NO: 1157973 - protein, 13 aa, Mycobacterium
DSDARRPPGEGFA

SEQ ID NO: 1157974 - protein, 9 aa, Mycobacterium
DSDDADRDV

SEQ ID NO: 1157975 - protein, 5 aa, Mycobacterium
DSDDL

SEQ ID NO: 1157976 - protein, 11 aa, Mycobacterium
DSDEADGGARA

SEQ ID NO: 1157977 - protein, 10 aa, Mycobacterium
DSDEERHKER

SEQ ID NO: 1157978 - protein, 14 aa, Mycobacterium
DSDELLTDGGPTIA

SEQ ID NO: 1157979 - protein, 12 aa, Mycobacterium
DSDEVEVSQQRS

SEQ ID NO: 1157980 - protein, 12 aa, Mycobacterium
DSDGDGVGDLDG

SEQ ID NO: 1157981 - protein, 12 aa, Mycobacterium
DSDGHADKRTRS

SEQ ID NO: 1157982 - protein, 7 aa, Mycobacterium
DSDGLVR

SEQ ID NO: 1157983 - protein, 8 aa, Mycobacterium
DSDGNGLA

SEQ ID NO: 1157984 - protein, 9 aa, Mycobacterium
DSDGVTRKL

SEQ ID NO: 1157985 - protein, 5 aa, Mycobacterium
DSDGY

SEQ ID NO: 1157986 - protein, 16 aa, Mycobacterium
DSDPDESGKVPGTDLR

SEQ ID NO: 1157987 - protein, 6 aa, Mycobacterium
DSDPQV

SEQ ID NO: 1157988 - protein, 8 aa, Mycobacterium
DSDSGAEA

SEQ ID NO: 1157989 - protein, 16 aa, Mycobacterium
DSDVSPAWTLYAWEPA

SEQ ID NO: 1157990 - protein, 9 aa, Mycobacterium
DSEADGSAF

SEQ ID NO: 1157991 - protein, 9 aa, Mycobacterium
DSEAGEFDA

SEQ ID NO: 1157992 - protein, 7 aa, Mycobacterium
DSEAGTV

SEQ ID NO: 1157993 - protein, 5 aa, Mycobacterium
DSEAL

SEQ ID NO: 1157994 - protein, 5 aa, Mycobacterium
DSEAR

SEQ ID NO: 1157995 - protein, 12 aa, Mycobacterium
DSEDFQKDRVRQ

SEQ ID NO: 1157996 - protein, 5 aa, Mycobacterium
DSEGC

SEQ ID NO: 1157997 - protein, 16 aa, Mycobacterium
DSEGRLTETRSDLGSA

SEQ ID NO: 1157998 - protein, 5 aa, Mycobacterium
DSEIP

SEQ ID NO: 1157999 - protein, 8 aa, Mycobacterium
DSESSKIE

SEQ ID NO: 1158000 - protein, 6 aa, Mycobacterium
DSETIS

SEQ ID NO: 1158001 - protein, 5 aa, Mycobacterium
DSETN

SEQ ID NO: 1158002 - protein, 8 aa, Mycobacterium
DSFDPSGR

SEQ ID NO: 1158003 - protein, 5 aa, Mycobacterium
DSFSE

SEQ ID NO: 1158004 - protein, 10 aa, Mycobacterium
DSGADAKSVI

SEQ ID NO: 1158005 - protein, 9 aa, Mycobacterium
DSGADHATL

SEQ ID NO: 1158006 - protein, 6 aa, Mycobacterium
DSGAIT

SEQ ID NO: 1158007 - protein, 6 aa, Mycobacterium
DSGAPE

SEQ ID NO: 1158008 - protein, 4 aa, Mycobacterium
DSGD

SEQ ID NO: 1158009 - protein, 8 aa, Mycobacterium
DSGDEARA

SEQ ID NO: 1158010 - protein, 11 aa, Mycobacterium
DSGDKSDWRGP

SEQ ID NO: 1158011 - protein, 7 aa, Mycobacterium
DSGEGIV

SEQ ID NO: 1158012 - protein, 7 aa, Mycobacterium
DSGEPLG

SEQ ID NO: 1158013 - protein, 14 aa, Mycobacterium
DSGEVSGKVLLRVR

SEQ ID NO: 1158014 - protein, 7 aa, Mycobacterium
DSGGARI

SEQ ID NO: 1158015 - protein, 12 aa, Mycobacterium
DSGGIQEEAPSF

SEQ ID NO: 1158016 - protein, 8 aa, Mycobacterium
DSGGKKGL

SEQ ID NO: 1158017 - protein, 8 aa, Mycobacterium
DSGGRAKA

SEQ ID NO: 1158018 - protein, 4 aa, Mycobacterium
DSGH

SEQ ID NO: 1158019 - protein, 6 aa, Mycobacterium
DSGLEA

SEQ ID NO: 1158020 - protein, 7 aa, Mycobacterium
DSGLRGG

SEQ ID NO: 1158021 - protein, 4 aa, Mycobacterium
DSGP

SEQ ID NO: 1158022 - protein, 13 aa, Mycobacterium
DSGPASAEPWSPY

SEQ ID NO: 1158023 - protein, 5 aa, Mycobacterium
DSGPV

SEQ ID NO: 1158024 - protein, 5 aa, Mycobacterium
DSGRE

SEQ ID NO: 1158025 - protein, 5 aa, Mycobacterium
DSGRG

SEQ ID NO: 1158026 - protein, 15 aa, Mycobacterium
DSGRGAVVSTEGNED

SEQ ID NO: 1158027 - protein, 9 aa, Mycobacterium
DSGSGFNRP

SEQ ID NO: 1158028 - protein, 6 aa, Mycobacterium
DSGTAR

SEQ ID NO: 1158029 - protein, 6 aa, Mycobacterium
DSGTPF

SEQ ID NO: 1158030 - protein, 8 aa, Mycobacterium
DSGVEDGS

SEQ ID NO: 1158031 - protein, 5 aa, Mycobacterium
DSGYT

SEQ ID NO: 1158032 - protein, 7 aa, Mycobacterium
DSHAPGQ

SEQ ID NO: 1158033 - protein, 16 aa, Mycobacterium
DSHVTGPAGPDHPTPG

SEQ ID NO: 1158034 - protein, 5 aa, Mycobacterium
DSIQR

SEQ ID NO: 1158035 - protein, 10 aa, Mycobacterium
DSIRNGDTQV

SEQ ID NO: 1158036 - protein, 4 aa, Mycobacterium
DSIT

SEQ ID NO: 1158037 - protein, 11 aa, Mycobacterium
DSKATNPHAAR

SEQ ID NO: 1158038 - protein, 10 aa, Mycobacterium
DSKPRGSAPA

SEQ ID NO: 1158039 - protein, 10 aa, Mycobacterium
DSKSDQVTAL

SEQ ID NO: 1158040 - protein, 9 aa, Mycobacterium
DSKSLNEGA

SEQ ID NO: 1158041 - protein, 8 aa, Mycobacterium
DSKVTNDL

SEQ ID NO: 1158042 - protein, 5 aa, Mycobacterium
DSLEP

SEQ ID NO: 1158043 - protein, 7 aa, Mycobacterium
DSLGEGS

SEQ ID NO: 1158044 - protein, 6 aa, Mycobacterium
DSLGGT

SEQ ID NO: 1158045 - protein, 11 aa, Mycobacterium
DSLPDNDHVGA

SEQ ID NO: 1158046 - protein, 7 aa, Mycobacterium
DSMAAAD

SEQ ID NO: 1158047 - protein, 7 aa, Mycobacterium
DSMPTRV

SEQ ID NO: 1158048 - protein, 11 aa, Mycobacterium
DSNELDARTPL

SEQ ID NO: 1158049 - protein, 7 aa, Mycobacterium
DSNERLV

SEQ ID NO: 1158050 - protein, 8 aa, Mycobacterium
DSNGGGFP

SEQ ID NO: 1158051 - protein, 7 aa, Mycobacterium
DSNLPDT

SEQ ID NO: 1158052 - protein, 6 aa, Mycobacterium
DSPAGQ

SEQ ID NO: 1158053 - protein, 16 aa, Mycobacterium
DSPAQRQRLGAAGRRR

SEQ ID NO: 1158054 - protein, 10 aa, Mycobacterium
DSPDDDLTTG

SEQ ID NO: 1158055 - protein, 31 aa, Mycobacterium
DSPESADGGATDTETTVDLGSPAAEAIWVVA

SEQ ID NO: 1158056 - protein, 5 aa, Mycobacterium
DSPEV

SEQ ID NO: 1158057 - protein, 7 aa, Mycobacterium
DSPEYQQ

SEQ ID NO: 1158058 - protein, 4 aa, Mycobacterium
DSPF

SEQ ID NO: 1158059 - protein, 7 aa, Mycobacterium
DSPFPPS

SEQ ID NO: 1158060 - protein, 5 aa, Mycobacterium
DSPGV

SEQ ID NO: 1158061 - protein, 8 aa, Mycobacterium
DSPGVGAN

SEQ ID NO: 1158062 - protein, 15 aa, Mycobacterium
DSPISSSDDTTRSLA

SEQ ID NO: 1158063 - protein, 9 aa, Mycobacterium
DSPKPPPQR

SEQ ID NO: 1158064 - protein, 9 aa, Mycobacterium
DSPPDEAYD

SEQ ID NO: 1158065 - protein, 7 aa, Mycobacterium
DSPPNTM

SEQ ID NO: 1158066 - protein, 23 aa, Mycobacterium
DSPPPPRSDDESLGDARPGLSQA

SEQ ID NO: 1158067 - protein, 7 aa, Mycobacterium
DSPQAVS

SEQ ID NO: 1158068 - protein, 5 aa, Mycobacterium
DSPQM

SEQ ID NO: 1158069 - protein, 8 aa, Mycobacterium
DSPQNRNA

SEQ ID NO: 1158070 - protein, 5 aa, Mycobacterium
DSPRD

SEQ ID NO: 1158071 - protein, 7 aa, Mycobacterium
DSPRPDC

SEQ ID NO: 1158072 - protein, 6 aa, Mycobacterium
DSPSFH

SEQ ID NO: 1158073 - protein, 6 aa, Mycobacterium
DSPTYE

SEQ ID NO: 1158074 - protein, 12 aa, Mycobacterium
DSPVGSTDKAGV

SEQ ID NO: 1158075 - protein, 21 aa, Mycobacterium
DSPYQRPKNPDLRLTPDRDVD

SEQ ID NO: 1158076 - protein, 11 aa, Mycobacterium
DSQAKTAVSSR

SEQ ID NO: 1158077 - protein, 8 aa, Mycobacterium
DSQRTQVE

SEQ ID NO: 1158078 - protein, 10 aa, Mycobacterium
DSQTPIGRGQ

SEQ ID NO: 1158079 - protein, 15 aa, Mycobacterium
DSRANSTDPTTPDEM

SEQ ID NO: 1158080 - protein, 22 aa, Mycobacterium
DSRDAAGSGADRHANFGNGQID

SEQ ID NO: 1158081 - protein, 20 aa, Mycobacterium
DSRDLPAGDPKAVAEAATAI

SEQ ID NO: 1158082 - protein, 9 aa, Mycobacterium
DSRDPDPRA

SEQ ID NO: 1158083 - protein, 6 aa, Mycobacterium
DSRDPV

SEQ ID NO: 1158084 - protein, 6 aa, Mycobacterium
DSRFNP

SEQ ID NO: 1158085 - protein, 7 aa, Mycobacterium
DSRGDQV

SEQ ID NO: 1158086 - protein, 10 aa, Mycobacterium
DSRGRAGRRR

SEQ ID NO: 1158087 - protein, 7 aa, Mycobacterium
DSRSRDI

SEQ ID NO: 1158088 - protein, 5 aa, Mycobacterium
DSRYI

SEQ ID NO: 1158089 - protein, 7 aa, Mycobacterium
DSSALNP

SEQ ID NO: 1158090 - protein, 8 aa, Mycobacterium
DSSGPAVR

SEQ ID NO: 1158091 - protein, 7 aa, Mycobacterium
DSSGREA

SEQ ID NO: 1158092 - protein, 6 aa, Mycobacterium
DSTDAA

SEQ ID NO: 1158093 - protein, 8 aa, Mycobacterium
DSTGAESV

SEQ ID NO: 1158094 - protein, 11 aa, Mycobacterium
DSTGYGAIPRE

SEQ ID NO: 1158095 - protein, 9 aa, Mycobacterium
DSTKVRGER

SEQ ID NO: 1158096 - protein, 17 aa, Mycobacterium
DSTLDGGAEAAGYGAYS

SEQ ID NO: 1158097 - protein, 12 aa, Mycobacterium
DSTSIDRSQGGT

SEQ ID NO: 1158098 - protein, 5 aa, Mycobacterium
DSTTN

SEQ ID NO: 1158099 - protein, 12 aa, Mycobacterium
DSTYQPGRRSSA

SEQ ID NO: 1158100 - protein, 4 aa, Mycobacterium
DSVA

SEQ ID NO: 1158101 - protein, 7 aa, Mycobacterium
DSVGADD

SEQ ID NO: 1158102 - protein, 7 aa, Mycobacterium
DSVRDRA

SEQ ID NO: 1158103 - protein, 4 aa, Mycobacterium
DSVT

SEQ ID NO: 1158104 - protein, 8 aa, Mycobacterium
DSYGGKKI

SEQ ID NO: 1158105 - protein, 9 aa, Mycobacterium
DSYTENAEL

SEQ ID NO: 1158106 - protein, 12 aa, Mycobacterium
DSYTEPHREADS

SEQ ID NO: 1158107 - protein, 10 aa, Mycobacterium
DTAAATAADM

SEQ ID NO: 1158108 - protein, 7 aa, Mycobacterium
DTAADIT

SEQ ID NO: 1158109 - protein, 11 aa, Mycobacterium
DTAAPPGRTEI

SEQ ID NO: 1158110 - protein, 5 aa, Mycobacterium
DTADA

SEQ ID NO: 1158111 - protein, 7 aa, Mycobacterium
DTADPDT

SEQ ID NO: 1158112 - protein, 9 aa, Mycobacterium
DTADPTGHT

SEQ ID NO: 1158113 - protein, 8 aa, Mycobacterium
DTAEAKSL

SEQ ID NO: 1158114 - protein, 54 aa, Mycobacterium
DTAGKQVNDGLNQTRKNLEGAAEQTRKNLEGAANQTRKNLEGAANQTRKNLDGV

SEQ ID NO: 1158115 - protein, 23 aa, Mycobacterium
DTAHETRVEGAGDPLDLQGAGDQ

SEQ ID NO: 1158116 - protein, 5 aa, Mycobacterium
DTAKL

SEQ ID NO: 1158117 - protein, 10 aa, Mycobacterium
DTALSARRDQ

SEQ ID NO: 1158118 - protein, 16 aa, Mycobacterium
DTAPDEFASAADAAEH

SEQ ID NO: 1158119 - protein, 6 aa, Mycobacterium
DTAPTH

SEQ ID NO: 1158120 - protein, 11 aa, Mycobacterium
DTARTELAAQS

SEQ ID NO: 1158121 - protein, 8 aa, Mycobacterium
DTASHPDV

SEQ ID NO: 1158122 - protein, 6 aa, Mycobacterium
DTATAQ

SEQ ID NO: 1158123 - protein, 5 aa, Mycobacterium
DTATG

SEQ ID NO: 1158124 - protein, 5 aa, Mycobacterium
DTDAA

SEQ ID NO: 1158125 - protein, 6 aa, Mycobacterium
DTDAAL

SEQ ID NO: 1158126 - protein, 7 aa, Mycobacterium
DTDAARP

SEQ ID NO: 1158127 - protein, 6 aa, Mycobacterium
DTDAAV

SEQ ID NO: 1158128 - protein, 6 aa, Mycobacterium
DTDDKK

SEQ ID NO: 1158129 - protein, 9 aa, Mycobacterium
DTDDPKAIA

SEQ ID NO: 1158130 - protein, 7 aa, Mycobacterium
DTDERTI

SEQ ID NO: 1158131 - protein, 6 aa, Mycobacterium
DTDGDL

SEQ ID NO: 1158132 - protein, 9 aa, Mycobacterium
DTDHDLTDH

SEQ ID NO: 1158133 - protein, 5 aa, Mycobacterium
DTDPG

SEQ ID NO: 1158134 - protein, 6 aa, Mycobacterium
DTDRAA

SEQ ID NO: 1158135 - protein, 13 aa, Mycobacterium
DTDSARDSEESYQ

SEQ ID NO: 1158136 - protein, 9 aa, Mycobacterium
DTDSKNSTR

SEQ ID NO: 1158137 - protein, 11 aa, Mycobacterium
DTDTERGAAAY

SEQ ID NO: 1158138 - protein, 8 aa, Mycobacterium
DTDYTSRP

SEQ ID NO: 1158139 - protein, 4 aa, Mycobacterium
DTEE

SEQ ID NO: 1158140 - protein, 5 aa, Mycobacterium
DTEGC

SEQ ID NO: 1158141 - protein, 6 aa, Mycobacterium
DTEGNP

SEQ ID NO: 1158142 - protein, 11 aa, Mycobacterium
DTEGPGDTLSP

SEQ ID NO: 1158143 - protein, 7 aa, Mycobacterium
DTEHPDE

SEQ ID NO: 1158144 - protein, 9 aa, Mycobacterium
DTEKEARDT

SEQ ID NO: 1158145 - protein, 10 aa, Mycobacterium
DTEPDNADAT

SEQ ID NO: 1158146 - protein, 7 aa, Mycobacterium
DTEPEAM

SEQ ID NO: 1158147 - protein, 9 aa, Mycobacterium
DTEPTVDEQ

SEQ ID NO: 1158148 - protein, 7 aa, Mycobacterium
DTEVPAG

SEQ ID NO: 1158149 - protein, 8 aa, Mycobacterium
DTFDPDRS

SEQ ID NO: 1158150 - protein, 7 aa, Mycobacterium
DTFQQRG

SEQ ID NO: 1158151 - protein, 18 aa, Mycobacterium
DTFSGDESGAGRKKLPSV

SEQ ID NO: 1158152 - protein, 10 aa, Mycobacterium
DTGADGAPGF

SEQ ID NO: 1158153 - protein, 14 aa, Mycobacterium
DTGADLDKTNVNGG

SEQ ID NO: 1158154 - protein, 7 aa, Mycobacterium
DTGAEPI

SEQ ID NO: 1158155 - protein, 6 aa, Mycobacterium
DTGAGP

SEQ ID NO: 1158156 - protein, 15 aa, Mycobacterium
DTGAVTKLTDDDHTY

SEQ ID NO: 1158157 - protein, 14 aa, Mycobacterium
DTGEEFDSSWNRGQ

SEQ ID NO: 1158158 - protein, 7 aa, Mycobacterium
DTGEEIA

SEQ ID NO: 1158159 - protein, 11 aa, Mycobacterium
DTGFGDNPATL

SEQ ID NO: 1158160 - protein, 7 aa, Mycobacterium
DTGGTIA

SEQ ID NO: 1158161 - protein, 8 aa, Mycobacterium
DTGHGAEG

SEQ ID NO: 1158162 - protein, 10 aa, Mycobacterium
DTGNGPYGPL

SEQ ID NO: 1158163 - protein, 7 aa, Mycobacterium
DTGQGDW

SEQ ID NO: 1158164 - protein, 17 aa, Mycobacterium
DTGQPDDEVKTHTEDPV

SEQ ID NO: 1158165 - protein, 7 aa, Mycobacterium
DTGRPLT

SEQ ID NO: 1158166 - protein, 8 aa, Mycobacterium
DTGTLPDR

SEQ ID NO: 1158167 - protein, 5 aa, Mycobacterium
DTGTW

SEQ ID NO: 1158168 - protein, 7 aa, Mycobacterium
DTGVEGA

SEQ ID NO: 1158169 - protein, 8 aa, Mycobacterium
DTGVPRSG

SEQ ID NO: 1158170 - protein, 7 aa, Mycobacterium
DTGYTAS

SEQ ID NO: 1158171 - protein, 7 aa, Mycobacterium
DTHTRQA

SEQ ID NO: 1158172 - protein, 4 aa, Mycobacterium
DTHY

SEQ ID NO: 1158173 - protein, 6 aa, Mycobacterium
DTIDGN

SEQ ID NO: 1158174 - protein, 8 aa, Mycobacterium
DTKADLPS

SEQ ID NO: 1158175 - protein, 8 aa, Mycobacterium
DTKAEHRE

SEQ ID NO: 1158176 - protein, 12 aa, Mycobacterium
DTKQANRAAEDA

SEQ ID NO: 1158177 - protein, 6 aa, Mycobacterium
DTKSRV

SEQ ID NO: 1158178 - protein, 7 aa, Mycobacterium
DTLGEVD

SEQ ID NO: 1158179 - protein, 10 aa, Mycobacterium
DTLGPGTADV

SEQ ID NO: 1158180 - protein, 4 aa, Mycobacterium
DTLR

SEQ ID NO: 1158181 - protein, 12 aa, Mycobacterium
DTLTGTGPQGAV

SEQ ID NO: 1158182 - protein, 7 aa, Mycobacterium
DTLTVGD

SEQ ID NO: 1158183 - protein, 10 aa, Mycobacterium
DTLVEDPQRD

SEQ ID NO: 1158184 - protein, 6 aa, Mycobacterium
DTNGTV

SEQ ID NO: 1158185 - protein, 5 aa, Mycobacterium
DTPDD

SEQ ID NO: 1158186 - protein, 6 aa, Mycobacterium
DTPEEG

SEQ ID NO: 1158187 - protein, 5 aa, Mycobacterium
DTPEG

SEQ ID NO: 1158188 - protein, 11 aa, Mycobacterium
DTPEKALSGPM

SEQ ID NO: 1158189 - protein, 6 aa, Mycobacterium
DTPEYK

SEQ ID NO: 1158190 - protein, 14 aa, Mycobacterium
DTPGGPLDRTHPAR

SEQ ID NO: 1158191 - protein, 5 aa, Mycobacterium
DTPGL

SEQ ID NO: 1158192 - protein, 9 aa, Mycobacterium
DTPGSGVTV

SEQ ID NO: 1158193 - protein, 6 aa, Mycobacterium
DTPGSH

SEQ ID NO: 1158194 - protein, 14 aa, Mycobacterium
DTPGTSSLSRDVSE

SEQ ID NO: 1158195 - protein, 14 aa, Mycobacterium
DTPNNGDAYLAPGA

SEQ ID NO: 1158196 - protein, 12 aa, Mycobacterium
DTPRGEPPAERV

SEQ ID NO: 1158197 - protein, 16 aa, Mycobacterium
DTPRINGDDYPTPDGT

SEQ ID NO: 1158198 - protein, 14 aa, Mycobacterium
DTPRSGGLAADDPN

SEQ ID NO: 1158199 - protein, 10 aa, Mycobacterium
DTPSAPEVSF

SEQ ID NO: 1158200 - protein, 8 aa, Mycobacterium
DTPSAPGH

SEQ ID NO: 1158201 - protein, 9 aa, Mycobacterium
DTPSGNRMT

SEQ ID NO: 1158202 - protein, 7 aa, Mycobacterium
DTPTPID

SEQ ID NO: 1158203 - protein, 8 aa, Mycobacterium
DTPTSGDI

SEQ ID NO: 1158204 - protein, 7 aa, Mycobacterium
DTPVPDP

SEQ ID NO: 1158205 - protein, 5 aa, Mycobacterium
DTPYS

SEQ ID NO: 1158206 - protein, 6 aa, Mycobacterium
DTQPGD

SEQ ID NO: 1158207 - protein, 6 aa, Mycobacterium
DTQPGT

SEQ ID NO: 1158208 - protein, 6 aa, Mycobacterium
DTQRSD

SEQ ID NO: 1158209 - protein, 6 aa, Mycobacterium
DTRAGS

SEQ ID NO: 1158210 - protein, 8 aa, Mycobacterium
DTRAPDVA

SEQ ID NO: 1158211 - protein, 9 aa, Mycobacterium
DTRARRALR

SEQ ID NO: 1158212 - protein, 6 aa, Mycobacterium
DTRASP

SEQ ID NO: 1158213 - protein, 4 aa, Mycobacterium
DTRG

SEQ ID NO: 1158214 - protein, 7 aa, Mycobacterium
DTRGQFA

SEQ ID NO: 1158215 - protein, 13 aa, Mycobacterium
DTRHESSAGHAAD

SEQ ID NO: 1158216 - protein, 8 aa, Mycobacterium
DTRKPEHV

SEQ ID NO: 1158217 - protein, 4 aa, Mycobacterium
DTRL

SEQ ID NO: 1158218 - protein, 9 aa, Mycobacterium
DTRPGSSAE

SEQ ID NO: 1158219 - protein, 23 aa, Mycobacterium
DTRPPADSRVKTAHGEKTKAPVR

SEQ ID NO: 1158220 - protein, 9 aa, Mycobacterium
DTRPPGEAL

SEQ ID NO: 1158221 - protein, 5 aa, Mycobacterium
DTRPQ

SEQ ID NO: 1158222 - protein, 17 aa, Mycobacterium
DTRPRDEYDTREPRTRH

SEQ ID NO: 1158223 - protein, 9 aa, Mycobacterium
DTRRSFSTT

SEQ ID NO: 1158224 - protein, 8 aa, Mycobacterium
DTRYGTDA

SEQ ID NO: 1158225 - protein, 6 aa, Mycobacterium
DTSATY

SEQ ID NO: 1158226 - protein, 7 aa, Mycobacterium
DTSCSSA

SEQ ID NO: 1158227 - protein, 7 aa, Mycobacterium
DTSERPL

SEQ ID NO: 1158228 - protein, 7 aa, Mycobacterium
DTSGHHD

SEQ ID NO: 1158229 - protein, 4 aa, Mycobacterium
DTSL

SEQ ID NO: 1158230 - protein, 4 aa, Mycobacterium
DTSN

SEQ ID NO: 1158231 - protein, 7 aa, Mycobacterium
DTSPEGY

SEQ ID NO: 1158232 - protein, 4 aa, Mycobacterium
DTSR

SEQ ID NO: 1158233 - protein, 5 aa, Mycobacterium
DTSRE

SEQ ID NO: 1158234 - protein, 7 aa, Mycobacterium
DTSSSQL

SEQ ID NO: 1158235 - protein, 9 aa, Mycobacterium
DTSTAADRI

SEQ ID NO: 1158236 - protein, 8 aa, Mycobacterium
DTSTASRS

SEQ ID NO: 1158237 - protein, 10 aa, Mycobacterium
DTSTPAGRQQ

SEQ ID NO: 1158238 - protein, 7 aa, Mycobacterium
DTSTSTL

SEQ ID NO: 1158239 - protein, 4 aa, Mycobacterium
DTTA

SEQ ID NO: 1158240 - protein, 7 aa, Mycobacterium
DTTARRM

SEQ ID NO: 1158241 - protein, 5 aa, Mycobacterium
DTTAT

SEQ ID NO: 1158242 - protein, 6 aa, Mycobacterium
DTTATD

SEQ ID NO: 1158243 - protein, 5 aa, Mycobacterium
DTTEG

SEQ ID NO: 1158244 - protein, 13 aa, Mycobacterium
DTTGDDPKVTDDG

SEQ ID NO: 1158245 - protein, 16 aa, Mycobacterium
DTTPVAARTATPNTVR

SEQ ID NO: 1158246 - protein, 5 aa, Mycobacterium
DTTRP

SEQ ID NO: 1158247 - protein, 7 aa, Mycobacterium
DTTRPQN

SEQ ID NO: 1158248 - protein, 7 aa, Mycobacterium
DTTRPRE

SEQ ID NO: 1158249 - protein, 7 aa, Mycobacterium
DTTTSEQ

SEQ ID NO: 1158250 - protein, 4 aa, Mycobacterium
DTTV

SEQ ID NO: 1158251 - protein, 13 aa, Mycobacterium
DTTVGPDGLDDAL

SEQ ID NO: 1158252 - protein, 4 aa, Mycobacterium
DTVP

SEQ ID NO: 1158253 - protein, 9 aa, Mycobacterium
DTVSAGETI

SEQ ID NO: 1158254 - protein, 14 aa, Mycobacterium
DTVSAGPFTARTTV

SEQ ID NO: 1158255 - protein, 14 aa, Mycobacterium
DTVSPPPPRRDGPI

SEQ ID NO: 1158256 - protein, 9 aa, Mycobacterium
DTVTDPGRI

SEQ ID NO: 1158257 - protein, 12 aa, Mycobacterium
DTWSERKLSESD

SEQ ID NO: 1158258 - protein, 7 aa, Mycobacterium
DTWTPPA

SEQ ID NO: 1158259 - protein, 12 aa, Mycobacterium
DTYGGELGEPFT

SEQ ID NO: 1158260 - protein, 7 aa, Mycobacterium
DTYPGRV

SEQ ID NO: 1158261 - protein, 6 aa, Mycobacterium
DVAAGD

SEQ ID NO: 1158262 - protein, 7 aa, Mycobacterium
DVAAGRL

SEQ ID NO: 1158263 - protein, 8 aa, Mycobacterium
DVADPADC

SEQ ID NO: 1158264 - protein, 8 aa, Mycobacterium
DVAETTAR

SEQ ID NO: 1158265 - protein, 11 aa, Mycobacterium
DVAGSDALPEP

SEQ ID NO: 1158266 - protein, 9 aa, Mycobacterium
DVAKPGSDK

SEQ ID NO: 1158267 - protein, 6 aa, Mycobacterium
DVAPGD

SEQ ID NO: 1158268 - protein, 8 aa, Mycobacterium
DVDAADDP

SEQ ID NO: 1158269 - protein, 9 aa, Mycobacterium
DVDAEEAQR

SEQ ID NO: 1158270 - protein, 16 aa, Mycobacterium
DVDEGHKEGLSRDERA

SEQ ID NO: 1158271 - protein, 8 aa, Mycobacterium
DVDERDQP

SEQ ID NO: 1158272 - protein, 10 aa, Mycobacterium
DVDGSTPATW

SEQ ID NO: 1158273 - protein, 6 aa, Mycobacterium
DVDPTD

SEQ ID NO: 1158274 - protein, 7 aa, Mycobacterium
DVDQPDS

SEQ ID NO: 1158275 - protein, 4 aa, Mycobacterium
DVDS

SEQ ID NO: 1158276 - protein, 8 aa, Mycobacterium
DVDTSGWT

SEQ ID NO: 1158277 - protein, 12 aa, Mycobacterium
DVEAARSAAEQL

SEQ ID NO: 1158278 - protein, 10 aa, Mycobacterium
DVEGESTEVP

SEQ ID NO: 1158279 - protein, 12 aa, Mycobacterium
DVEPGTPSPQAR

SEQ ID NO: 1158280 - protein, 7 aa, Mycobacterium
DVETDGS

SEQ ID NO: 1158281 - protein, 18 aa, Mycobacterium
DVETRDAEEITAPEDDLE

SEQ ID NO: 1158282 - protein, 5 aa, Mycobacterium
DVGDR

SEQ ID NO: 1158283 - protein, 6 aa, Mycobacterium
DVGGQN

SEQ ID NO: 1158284 - protein, 7 aa, Mycobacterium
DVGKIDA

SEQ ID NO: 1158285 - protein, 8 aa, Mycobacterium
DVGKPNKV

SEQ ID NO: 1158286 - protein, 6 aa, Mycobacterium
DVGPAD

SEQ ID NO: 1158287 - protein, 9 aa, Mycobacterium
DVGPDTTLS

SEQ ID NO: 1158288 - protein, 12 aa, Mycobacterium
DVGPELQSQAAT

SEQ ID NO: 1158289 - protein, 5 aa, Mycobacterium
DVGPG

SEQ ID NO: 1158290 - protein, 5 aa, Mycobacterium
DVGRA

SEQ ID NO: 1158291 - protein, 5 aa, Mycobacterium
DVGRD

SEQ ID NO: 1158292 - protein, 15 aa, Mycobacterium
DVGRRAGSTKSAAEQ

SEQ ID NO: 1158293 - protein, 7 aa, Mycobacterium
DVGSDRV

SEQ ID NO: 1158294 - protein, 9 aa, Mycobacterium
DVKEVSRRS

SEQ ID NO: 1158295 - protein, 9 aa, Mycobacterium
DVKPTGSAA

SEQ ID NO: 1158296 - protein, 7 aa, Mycobacterium
DVKSNPY

SEQ ID NO: 1158297 - protein, 11 aa, Mycobacterium
DVLDDAAAEDF

SEQ ID NO: 1158298 - protein, 11 aa, Mycobacterium
DVNRGAEGGDL

SEQ ID NO: 1158299 - protein, 8 aa, Mycobacterium
DVPAARAA

SEQ ID NO: 1158300 - protein, 6 aa, Mycobacterium
DVPAGD

SEQ ID NO: 1158301 - protein, 5 aa, Mycobacterium
DVPDP

SEQ ID NO: 1158302 - protein, 13 aa, Mycobacterium
DVPDPATLPFPPE

SEQ ID NO: 1158303 - protein, 6 aa, Mycobacterium
DVPDTA

SEQ ID NO: 1158304 - protein, 6 aa, Mycobacterium
DVPEND

SEQ ID NO: 1158305 - protein, 5 aa, Mycobacterium
DVPGL

SEQ ID NO: 1158306 - protein, 7 aa, Mycobacterium
DVPGTGA

SEQ ID NO: 1158307 - protein, 5 aa, Mycobacterium
DVPGY

SEQ ID NO: 1158308 - protein, 8 aa, Mycobacterium
DVPLRPAS

SEQ ID NO: 1158309 - protein, 5 aa, Mycobacterium
DVPPA

SEQ ID NO: 1158310 - protein, 9 aa, Mycobacterium
DVPTATSVR

SEQ ID NO: 1158311 - protein, 5 aa, Mycobacterium
DVQQR

SEQ ID NO: 1158312 - protein, 18 aa, Mycobacterium
DVRAAGDGSGAPAGALDD

SEQ ID NO: 1158313 - protein, 5 aa, Mycobacterium
DVRES

SEQ ID NO: 1158314 - protein, 12 aa, Mycobacterium
DVRNGKAGQVPA

SEQ ID NO: 1158315 - protein, 5 aa, Mycobacterium
DVRRA

SEQ ID NO: 1158316 - protein, 6 aa, Mycobacterium
DVSDDG

SEQ ID NO: 1158317 - protein, 13 aa, Mycobacterium
DVSDIQGGTTSEG

SEQ ID NO: 1158318 - protein, 9 aa, Mycobacterium
DVSEEPSVE

SEQ ID NO: 1158319 - protein, 8 aa, Mycobacterium
DVSEPAQL

SEQ ID NO: 1158320 - protein, 7 aa, Mycobacterium
DVSHTSI

SEQ ID NO: 1158321 - protein, 5 aa, Mycobacterium
DVSPA

SEQ ID NO: 1158322 - protein, 6 aa, Mycobacterium
DVSPDL

SEQ ID NO: 1158323 - protein, 5 aa, Mycobacterium
DVSRE

SEQ ID NO: 1158324 - protein, 11 aa, Mycobacterium
DVSTTAEKDGA

SEQ ID NO: 1158325 - protein, 18 aa, Mycobacterium
DVTADERRRIAEAGFYAY

SEQ ID NO: 1158326 - protein, 13 aa, Mycobacterium
DVTDDASADQLSE

SEQ ID NO: 1158327 - protein, 7 aa, Mycobacterium
DVTDETV

SEQ ID NO: 1158328 - protein, 11 aa, Mycobacterium
DVTGGDYRPGR

SEQ ID NO: 1158329 - protein, 6 aa, Mycobacterium
DVTGPF

SEQ ID NO: 1158330 - protein, 14 aa, Mycobacterium
DVTPPESVRSTGVQ

SEQ ID NO: 1158331 - protein, 10 aa, Mycobacterium
DVTRATPRDR

SEQ ID NO: 1158332 - protein, 8 aa, Mycobacterium
DVTTARDR

SEQ ID NO: 1158333 - protein, 6 aa, Mycobacterium
DVTVSD

SEQ ID NO: 1158334 - protein, 10 aa, Mycobacterium
DVTYSGPDAV

SEQ ID NO: 1158335 - protein, 4 aa, Mycobacterium
DWAK

SEQ ID NO: 1158336 - protein, 8 aa, Mycobacterium
DWGSETGA

SEQ ID NO: 1158337 - protein, 4 aa, Mycobacterium
DWGT

SEQ ID NO: 1158338 - protein, 6 aa, Mycobacterium
DWPDTD

SEQ ID NO: 1158339 - protein, 15 aa, Mycobacterium
DWPSATAVGKTAVSS

SEQ ID NO: 1158340 - protein, 6 aa, Mycobacterium
DWSDSG

SEQ ID NO: 1158341 - protein, 10 aa, Mycobacterium
DWTAGQATHF

SEQ ID NO: 1158342 - protein, 12 aa, Mycobacterium
DWTGREAAEAEV

SEQ ID NO: 1158343 - protein, 6 aa, Mycobacterium
DYAGAG

SEQ ID NO: 1158344 - protein, 8 aa, Mycobacterium
DYAPPSDV

SEQ ID NO: 1158345 - protein, 12 aa, Mycobacterium
DYARGGEKTPEG

SEQ ID NO: 1158346 - protein, 5 aa, Mycobacterium
DYDDA

SEQ ID NO: 1158347 - protein, 9 aa, Mycobacterium
DYDGRREAL

SEQ ID NO: 1158348 - protein, 6 aa, Mycobacterium
DYDPDT

SEQ ID NO: 1158349 - protein, 15 aa, Mycobacterium
DYEGRTTAEIRESDP

SEQ ID NO: 1158350 - protein, 5 aa, Mycobacterium
DYENR

SEQ ID NO: 1158351 - protein, 4 aa, Mycobacterium
DYES

SEQ ID NO: 1158352 - protein, 7 aa, Mycobacterium
DYESATK

SEQ ID NO: 1158353 - protein, 9 aa, Mycobacterium
DYGLNSTEG

SEQ ID NO: 1158354 - protein, 14 aa, Mycobacterium
DYGRAGRPKTRYQW

SEQ ID NO: 1158355 - protein, 5 aa, Mycobacterium
DYGTV

SEQ ID NO: 1158356 - protein, 6 aa, Mycobacterium
DYGTWP

SEQ ID NO: 1158357 - protein, 16 aa, Mycobacterium
DYHPEQPGGSAAGRTC

SEQ ID NO: 1158358 - protein, 7 aa, Mycobacterium
DYHRTNR

SEQ ID NO: 1158359 - protein, 4 aa, Mycobacterium
DYKG

SEQ ID NO: 1158360 - protein, 7 aa, Mycobacterium
DYNGGEV

SEQ ID NO: 1158361 - protein, 14 aa, Mycobacterium
DYPATGKRTLQDNG

SEQ ID NO: 1158362 - protein, 10 aa, Mycobacterium
DYPDPSPPRG

SEQ ID NO: 1158363 - protein, 7 aa, Mycobacterium
DYPDRAS

SEQ ID NO: 1158364 - protein, 18 aa, Mycobacterium
DYQKKTDREIPVFVLTPV

SEQ ID NO: 1158365 - protein, 4 aa, Mycobacterium
DYRP

SEQ ID NO: 1158366 - protein, 5 aa, Mycobacterium
DYTGK

SEQ ID NO: 1158367 - protein, 5 aa, Mycobacterium
DYVTG

SEQ ID NO: 1158368 - protein, 4 aa, Mycobacterium
EAAA

SEQ ID NO: 1158369 - protein, 8 aa, Mycobacterium
EAAADKDV

SEQ ID NO: 1158370 - protein, 9 aa, Mycobacterium
EAAAGGPVA

SEQ ID NO: 1158371 - protein, 7 aa, Mycobacterium
EAAAKAG

SEQ ID NO: 1158372 - protein, 11 aa, Mycobacterium
EAAAQAETERA

SEQ ID NO: 1158373 - protein, 8 aa, Mycobacterium
EAAASGGL

SEQ ID NO: 1158374 - protein, 7 aa, Mycobacterium
EAADRDI

SEQ ID NO: 1158375 - protein, 7 aa, Mycobacterium
EAAEAGA

SEQ ID NO: 1158376 - protein, 8 aa, Mycobacterium
EAAEESGI

SEQ ID NO: 1158377 - protein, 5 aa, Mycobacterium
EAAEK

SEQ ID NO: 1158378 - protein, 19 aa, Mycobacterium
EAAEKAARRAERSGPGGAP

SEQ ID NO: 1158379 - protein, 8 aa, Mycobacterium
EAAERAGG

SEQ ID NO: 1158380 - protein, 6 aa, Mycobacterium
EAAERD

SEQ ID NO: 1158381 - protein, 10 aa, Mycobacterium
EAAERSTSLR

SEQ ID NO: 1158382 - protein, 7 aa, Mycobacterium
EAAESAM

SEQ ID NO: 1158383 - protein, 8 aa, Mycobacterium
EAAESGVD

SEQ ID NO: 1158384 - protein, 10 aa, Mycobacterium
EAAGATPPRF

SEQ ID NO: 1158385 - protein, 7 aa, Mycobacterium
EAAGCSR

SEQ ID NO: 1158386 - protein, 11 aa, Mycobacterium
EAAGDYGKAGT

SEQ ID NO: 1158387 - protein, 12 aa, Mycobacterium
EAAGGAAAGLSG

SEQ ID NO: 1158388 - protein, 9 aa, Mycobacterium
EAAGSDESW

SEQ ID NO: 1158389 - protein, 6 aa, Mycobacterium
EAAGVP

SEQ ID NO: 1158390 - protein, 9 aa, Mycobacterium
EAAKKQPDV

SEQ ID NO: 1158391 - protein, 10 aa, Mycobacterium
EAAKRPVDER

SEQ ID NO: 1158392 - protein, 5 aa, Mycobacterium
EAALQ

SEQ ID NO: 1158393 - protein, 10 aa, Mycobacterium
EAAPTRRDRW

SEQ ID NO: 1158394 - protein, 13 aa, Mycobacterium
EAAQKGKAYSEKI

SEQ ID NO: 1158395 - protein, 20 aa, Mycobacterium
EAAQQTFETAPSFEDEPGVD

SEQ ID NO: 1158396 - protein, 4 aa, Mycobacterium
EAAR

SEQ ID NO: 1158397 - protein, 10 aa, Mycobacterium
EAARADEPYR

SEQ ID NO: 1158398 - protein, 5 aa, Mycobacterium
EAARR

SEQ ID NO: 1158399 - protein, 7 aa, Mycobacterium
EAARSAT

SEQ ID NO: 1158400 - protein, 7 aa, Mycobacterium
EAARTDV

SEQ ID NO: 1158401 - protein, 6 aa, Mycobacterium
EAASGL

SEQ ID NO: 1158402 - protein, 11 aa, Mycobacterium
EAATDDNEYRQ

SEQ ID NO: 1158403 - protein, 13 aa, Mycobacterium
EAATFGRRDLSGT

SEQ ID NO: 1158404 - protein, 11 aa, Mycobacterium
EAATKKRRSEF

SEQ ID NO: 1158405 - protein, 8 aa, Mycobacterium
EAATPNAL

SEQ ID NO: 1158406 - protein, 7 aa, Mycobacterium
EAATSGR

SEQ ID NO: 1158407 - protein, 6 aa, Mycobacterium
EAATVK

SEQ ID NO: 1158408 - protein, 21 aa, Mycobacterium
EAATYADDAVERAEQVGGDNS

SEQ ID NO: 1158409 - protein, 8 aa, Mycobacterium
EACGPRRM

SEQ ID NO: 1158410 - protein, 14 aa, Mycobacterium
EADADDSTGEIAED

SEQ ID NO: 1158411 - protein, 7 aa, Mycobacterium
EADARRV

SEQ ID NO: 1158412 - protein, 7 aa, Mycobacterium
EADDDEA

SEQ ID NO: 1158413 - protein, 4 aa, Mycobacterium
EADE

SEQ ID NO: 1158414 - protein, 7 aa, Mycobacterium
EADEDRT

SEQ ID NO: 1158415 - protein, 7 aa, Mycobacterium
EADGDFD

SEQ ID NO: 1158416 - protein, 7 aa, Mycobacterium
EADGERM

SEQ ID NO: 1158417 - protein, 10 aa, Mycobacterium
EADGPDAVGA

SEQ ID NO: 1158418 - protein, 7 aa, Mycobacterium
EADGQPR

SEQ ID NO: 1158419 - protein, 4 aa, Mycobacterium
EADL

SEQ ID NO: 1158420 - protein, 8 aa, Mycobacterium
EADPAAPA

SEQ ID NO: 1158421 - protein, 8 aa, Mycobacterium
EADPGLAG

SEQ ID NO: 1158422 - protein, 12 aa, Mycobacterium
EADQLEENEPLR

SEQ ID NO: 1158423 - protein, 4 aa, Mycobacterium
EADR

SEQ ID NO: 1158424 - protein, 11 aa, Mycobacterium
EADRAKPGRPP

SEQ ID NO: 1158425 - protein, 7 aa, Mycobacterium
EADRAQF

SEQ ID NO: 1158426 - protein, 6 aa, Mycobacterium
EADRDR

SEQ ID NO: 1158427 - protein, 4 aa, Mycobacterium
EADS

SEQ ID NO: 1158428 - protein, 6 aa, Mycobacterium
EADSVA

SEQ ID NO: 1158429 - protein, 4 aa, Mycobacterium
EAEA

SEQ ID NO: 1158430 - protein, 5 aa, Mycobacterium
EAEAG

SEQ ID NO: 1158431 - protein, 7 aa, Mycobacterium
EAEARYG

SEQ ID NO: 1158432 - protein, 7 aa, Mycobacterium
EAEDPKL

SEQ ID NO: 1158433 - protein, 56 aa, Mycobacterium
EAEGGPSNEATQPKKKKAPAKKAASDIEATADPAGNADKSEPAAEGEDATVAGATE

SEQ ID NO: 1158434 - protein, 7 aa, Mycobacterium
EAEGHGG

SEQ ID NO: 1158435 - protein, 7 aa, Mycobacterium
EAEGRAV

SEQ ID NO: 1158436 - protein, 8 aa, Mycobacterium
EAEGTQFR

SEQ ID NO: 1158437 - protein, 4 aa, Mycobacterium
EAEN

SEQ ID NO: 1158438 - protein, 4 aa, Mycobacterium
EAEP

SEQ ID NO: 1158439 - protein, 12 aa, Mycobacterium
EAEPHNTERDTF

SEQ ID NO: 1158440 - protein, 9 aa, Mycobacterium
EAEQGGLAG

SEQ ID NO: 1158441 - protein, 27 aa, Mycobacterium
EAERDPTAAGRRHAAAASAARPQPAVK

SEQ ID NO: 1158442 - protein, 8 aa, Mycobacterium
EAERPTVT

SEQ ID NO: 1158443 - protein, 16 aa, Mycobacterium
EAERRRGAAPQTLPAR

SEQ ID NO: 1158444 - protein, 18 aa, Mycobacterium
EAERTGADKNEAIMAAAS

SEQ ID NO: 1158445 - protein, 7 aa, Mycobacterium
EAERYAK

SEQ ID NO: 1158446 - protein, 7 aa, Mycobacterium
EAESERF

SEQ ID NO: 1158447 - protein, 6 aa, Mycobacterium
EAESMG

SEQ ID NO: 1158448 - protein, 13 aa, Mycobacterium
EAEVSQGASRTLA

SEQ ID NO: 1158449 - protein, 12 aa, Mycobacterium
EAFDSYRNDPDL

SEQ ID NO: 1158450 - protein, 7 aa, Mycobacterium
EAFGANR

SEQ ID NO: 1158451 - protein, 9 aa, Mycobacterium
EAFGGRPGG

SEQ ID NO: 1158452 - protein, 4 aa, Mycobacterium
EAGA

SEQ ID NO: 1158453 - protein, 7 aa, Mycobacterium
EAGAAEH

SEQ ID NO: 1158454 - protein, 8 aa, Mycobacterium
EAGAAKAR

SEQ ID NO: 1158455 - protein, 6 aa, Mycobacterium
EAGAEA

SEQ ID NO: 1158456 - protein, 16 aa, Mycobacterium
EAGAEIARRSRGTPRI

SEQ ID NO: 1158457 - protein, 6 aa, Mycobacterium
EAGANW

SEQ ID NO: 1158458 - protein, 8 aa, Mycobacterium
EAGAQPMV

SEQ ID NO: 1158459 - protein, 6 aa, Mycobacterium
EAGATL

SEQ ID NO: 1158460 - protein, 14 aa, Mycobacterium
EAGDPDKPEQSEPV

SEQ ID NO: 1158461 - protein, 14 aa, Mycobacterium
EAGDVDSPAAGGMP

SEQ ID NO: 1158462 - protein, 10 aa, Mycobacterium
EAGGDSRVPS

SEQ ID NO: 1158463 - protein, 7 aa, Mycobacterium
EAGGGRP

SEQ ID NO: 1158464 - protein, 8 aa, Mycobacterium
EAGGTGDA

SEQ ID NO: 1158465 - protein, 6 aa, Mycobacterium
EAGHRS

SEQ ID NO: 1158466 - protein, 6 aa, Mycobacterium
EAGIGK

SEQ ID NO: 1158467 - protein, 8 aa, Mycobacterium
EAGIGPED

SEQ ID NO: 1158468 - protein, 4 aa, Mycobacterium
EAGL

SEQ ID NO: 1158469 - protein, 8 aa, Mycobacterium
EAGLPDAA

SEQ ID NO: 1158470 - protein, 5 aa, Mycobacterium
EAGNH

SEQ ID NO: 1158471 - protein, 14 aa, Mycobacterium
EAGNTFTDQNLTPT

SEQ ID NO: 1158472 - protein, 7 aa, Mycobacterium
EAGPQAN

SEQ ID NO: 1158473 - protein, 7 aa, Mycobacterium
EAGPQRV

SEQ ID NO: 1158474 - protein, 6 aa, Mycobacterium
EAGQHA

SEQ ID NO: 1158475 - protein, 6 aa, Mycobacterium
EAGRAP

SEQ ID NO: 1158476 - protein, 11 aa, Mycobacterium
EAGRDVAPAEL

SEQ ID NO: 1158477 - protein, 6 aa, Mycobacterium
EAGRRG

SEQ ID NO: 1158478 - protein, 9 aa, Mycobacterium
EAGRRGGSL

SEQ ID NO: 1158479 - protein, 10 aa, Mycobacterium
EAGSKTLKDA

SEQ ID NO: 1158480 - protein, 17 aa, Mycobacterium
EAGSMAAAKAAGKVRME

SEQ ID NO: 1158481 - protein, 8 aa, Mycobacterium
EAGSPDLA

SEQ ID NO: 1158482 - protein, 11 aa, Mycobacterium
EAGSYGKDTRG

SEQ ID NO: 1158483 - protein, 4 aa, Mycobacterium
EAGT

SEQ ID NO: 1158484 - protein, 11 aa, Mycobacterium
EAGTDPDSGAV

SEQ ID NO: 1158485 - protein, 18 aa, Mycobacterium
EAGTQSGKARKAQEYGKP

SEQ ID NO: 1158486 - protein, 5 aa, Mycobacterium
EAGVP

SEQ ID NO: 1158487 - protein, 7 aa, Mycobacterium
EAGVPHR

SEQ ID NO: 1158488 - protein, 4 aa, Mycobacterium
EAGY

SEQ ID NO: 1158489 - protein, 16 aa, Mycobacterium
EAGYATTTTRVSGPID

SEQ ID NO: 1158490 - protein, 20 aa, Mycobacterium
EAHADEDRKRREEADVRNQA

SEQ ID NO: 1158491 - protein, 7 aa, Mycobacterium
EAIGPGD

SEQ ID NO: 1158492 - protein, 11 aa, Mycobacterium
EAKARAKESGL

SEQ ID NO: 1158493 - protein, 13 aa, Mycobacterium
EAKEGIATTETGE

SEQ ID NO: 1158494 - protein, 8 aa, Mycobacterium
EAKETSRR

SEQ ID NO: 1158495 - protein, 16 aa, Mycobacterium
EAKGYERFTAQAASTG

SEQ ID NO: 1158496 - protein, 9 aa, Mycobacterium
EALADDKAV

SEQ ID NO: 1158497 - protein, 9 aa, Mycobacterium
EALADGGYR

SEQ ID NO: 1158498 - protein, 7 aa, Mycobacterium
EALARDR

SEQ ID NO: 1158499 - protein, 10 aa, Mycobacterium
EALEDARKRR

SEQ ID NO: 1158500 - protein, 13 aa, Mycobacterium
EALEPEASAVRQA

SEQ ID NO: 1158501 - protein, 7 aa, Mycobacterium
EALGGGY

SEQ ID NO: 1158502 - protein, 12 aa, Mycobacterium
EALPDAREWTPG

SEQ ID NO: 1158503 - protein, 8 aa, Mycobacterium
EALRNSAA

SEQ ID NO: 1158504 - protein, 12 aa, Mycobacterium
EALSSNGSTSMG

SEQ ID NO: 1158505 - protein, 11 aa, Mycobacterium
EALTSAGTAAD

SEQ ID NO: 1158506 - protein, 6 aa, Mycobacterium
EAMEPQ

SEQ ID NO: 1158507 - protein, 8 aa, Mycobacterium
EAMGGHRD

SEQ ID NO: 1158508 - protein, 22 aa, Mycobacterium
EAMSEDDVEKESVKVRKPAPKK

SEQ ID NO: 1158509 - protein, 6 aa, Mycobacterium
EANAAH

SEQ ID NO: 1158510 - protein, 13 aa, Mycobacterium
EANGPLEQQTPAG

SEQ ID NO: 1158511 - protein, 6 aa, Mycobacterium
EANQYY

SEQ ID NO: 1158512 - protein, 12 aa, Mycobacterium
EANRQPGKTGDN

SEQ ID NO: 1158513 - protein, 6 aa, Mycobacterium
EAPAGE

SEQ ID NO: 1158514 - protein, 6 aa, Mycobacterium
EAPASV

SEQ ID NO: 1158515 - protein, 6 aa, Mycobacterium
EAPDTA

SEQ ID NO: 1158516 - protein, 10 aa, Mycobacterium
EAPEDGTDAE

SEQ ID NO: 1158517 - protein, 7 aa, Mycobacterium
EAPERPL

SEQ ID NO: 1158518 - protein, 8 aa, Mycobacterium
EAPGAYET

SEQ ID NO: 1158519 - protein, 9 aa, Mycobacterium
EAPGEPNAE

SEQ ID NO: 1158520 - protein, 4 aa, Mycobacterium
EAPH

SEQ ID NO: 1158521 - protein, 5 aa, Mycobacterium
EAPLT

SEQ ID NO: 1158522 - protein, 7 aa, Mycobacterium
EAPPAEV

SEQ ID NO: 1158523 - protein, 10 aa, Mycobacterium
EAPPPVENTP

SEQ ID NO: 1158524 - protein, 5 aa, Mycobacterium
EAPRS

SEQ ID NO: 1158525 - protein, 8 aa, Mycobacterium
EAPSPLLD

SEQ ID NO: 1158526 - protein, 7 aa, Mycobacterium
EAPSPLV

SEQ ID NO: 1158527 - protein, 10 aa, Mycobacterium
EAPSPTSPAG

SEQ ID NO: 1158528 - protein, 7 aa, Mycobacterium
EAPSPVV

SEQ ID NO: 1158529 - protein, 6 aa, Mycobacterium
EAPSTY

SEQ ID NO: 1158530 - protein, 7 aa, Mycobacterium
EAPTEGT

SEQ ID NO: 1158531 - protein, 4 aa, Mycobacterium
EAPY

SEQ ID NO: 1158532 - protein, 5 aa, Mycobacterium
EAQAR

SEQ ID NO: 1158533 - protein, 8 aa, Mycobacterium
EAQGGRPL

SEQ ID NO: 1158534 - protein, 7 aa, Mycobacterium
EAQPPGV

SEQ ID NO: 1158535 - protein, 7 aa, Mycobacterium
EAQPPVV

SEQ ID NO: 1158536 - protein, 9 aa, Mycobacterium
EAQQQSDGR

SEQ ID NO: 1158537 - protein, 9 aa, Mycobacterium
EAQRDSSNS

SEQ ID NO: 1158538 - protein, 4 aa, Mycobacterium
EAQT

SEQ ID NO: 1158539 - protein, 6 aa, Mycobacterium
EAQVSK

SEQ ID NO: 1158540 - protein, 10 aa, Mycobacterium
EARANHPNVR

SEQ ID NO: 1158541 - protein, 5 aa, Mycobacterium
EARDE

SEQ ID NO: 1158542 - protein, 8 aa, Mycobacterium
EAREEASR

SEQ ID NO: 1158543 - protein, 5 aa, Mycobacterium
EARER

SEQ ID NO: 1158544 - protein, 8 aa, Mycobacterium
EARGRDMA

SEQ ID NO: 1158545 - protein, 10 aa, Mycobacterium
EARGSGLPHN

SEQ ID NO: 1158546 - protein, 12 aa, Mycobacterium
EARKGLSEGGIP

SEQ ID NO: 1158547 - protein, 6 aa, Mycobacterium
EARQEP

SEQ ID NO: 1158548 - protein, 8 aa, Mycobacterium
EARQHSER

SEQ ID NO: 1158549 - protein, 7 aa, Mycobacterium
EARQPSF

SEQ ID NO: 1158550 - protein, 7 aa, Mycobacterium
EARRGDP

SEQ ID NO: 1158551 - protein, 17 aa, Mycobacterium
EARSPDGDVRATVDGGG

SEQ ID NO: 1158552 - protein, 12 aa, Mycobacterium
EARSRLEGQGAA

SEQ ID NO: 1158553 - protein, 15 aa, Mycobacterium
EARVGRPPKVYAPAD

SEQ ID NO: 1158554 - protein, 14 aa, Mycobacterium
EARWRSSAGEEHAA

SEQ ID NO: 1158555 - protein, 4 aa, Mycobacterium
EASA

SEQ ID NO: 1158556 - protein, 20 aa, Mycobacterium
EASASGSSVIAGRKNKGSVA

SEQ ID NO: 1158557 - protein, 15 aa, Mycobacterium
EASDASSADAPALAT

SEQ ID NO: 1158558 - protein, 9 aa, Mycobacterium
EASEPAEVN

SEQ ID NO: 1158559 - protein, 9 aa, Mycobacterium
EASGAQTVA

SEQ ID NO: 1158560 - protein, 9 aa, Mycobacterium
EASGKSPAQ

SEQ ID NO: 1158561 - protein, 5 aa, Mycobacterium
EASHR

SEQ ID NO: 1158562 - protein, 9 aa, Mycobacterium
EASNAATRT

SEQ ID NO: 1158563 - protein, 4 aa, Mycobacterium
EASP

SEQ ID NO: 1158564 - protein, 16 aa, Mycobacterium
EASPGNMGAVPPEPGF

SEQ ID NO: 1158565 - protein, 9 aa, Mycobacterium
EASQRDPEL

SEQ ID NO: 1158566 - protein, 4 aa, Mycobacterium
EASR

SEQ ID NO: 1158567 - protein, 8 aa, Mycobacterium
EASRDERL

SEQ ID NO: 1158568 - protein, 6 aa, Mycobacterium
EASRQA

SEQ ID NO: 1158569 - protein, 7 aa, Mycobacterium
EASRRGA

SEQ ID NO: 1158570 - protein, 11 aa, Mycobacterium
EASRRPDRPGV

SEQ ID NO: 1158571 - protein, 7 aa, Mycobacterium
EASRTLG

SEQ ID NO: 1158572 - protein, 10 aa, Mycobacterium
EASSGSTAVS

SEQ ID NO: 1158573 - protein, 5 aa, Mycobacterium
EASSV

SEQ ID NO: 1158574 - protein, 7 aa, Mycobacterium
EASTGSI

SEQ ID NO: 1158575 - protein, 6 aa, Mycobacterium
EASVEE

SEQ ID NO: 1158576 - protein, 4 aa, Mycobacterium
EASY

SEQ ID NO: 1158577 - protein, 5 aa, Mycobacterium
EASYI

SEQ ID NO: 1158578 - protein, 6 aa, Mycobacterium
EASYTA

SEQ ID NO: 1158579 - protein, 7 aa, Mycobacterium
EATAAAE

SEQ ID NO: 1158580 - protein, 25 aa, Mycobacterium
EATAATAAIEQETPAPAEDTGLPDG

SEQ ID NO: 1158581 - protein, 9 aa, Mycobacterium
EATAGDGSP

SEQ ID NO: 1158582 - protein, 7 aa, Mycobacterium
EATATTL

SEQ ID NO: 1158583 - protein, 5 aa, Mycobacterium
EATDK

SEQ ID NO: 1158584 - protein, 12 aa, Mycobacterium
EATEETGLDTSR

SEQ ID NO: 1158585 - protein, 6 aa, Mycobacterium
EATGGN

SEQ ID NO: 1158586 - protein, 7 aa, Mycobacterium
EATGRGI

SEQ ID NO: 1158587 - protein, 5 aa, Mycobacterium
EATGT

SEQ ID NO: 1158588 - protein, 11 aa, Mycobacterium
EATGTDTYEAN

SEQ ID NO: 1158589 - protein, 13 aa, Mycobacterium
EATPHPDDTPEMA

SEQ ID NO: 1158590 - protein, 8 aa, Mycobacterium
EATRATRK

SEQ ID NO: 1158591 - protein, 5 aa, Mycobacterium
EATRQ

SEQ ID NO: 1158592 - protein, 9 aa, Mycobacterium
EATRTGGSS

SEQ ID NO: 1158593 - protein, 5 aa, Mycobacterium
EATSA

SEQ ID NO: 1158594 - protein, 8 aa, Mycobacterium
EATTVKDR

SEQ ID NO: 1158595 - protein, 4 aa, Mycobacterium
EAVD

SEQ ID NO: 1158596 - protein, 6 aa, Mycobacterium
EAVDGG

SEQ ID NO: 1158597 - protein, 5 aa, Mycobacterium
EAVEA

SEQ ID NO: 1158598 - protein, 8 aa, Mycobacterium
EAVEDDGG

SEQ ID NO: 1158599 - protein, 5 aa, Mycobacterium
EAVPD

SEQ ID NO: 1158600 - protein, 6 aa, Mycobacterium
EAVPPR

SEQ ID NO: 1158601 - protein, 14 aa, Mycobacterium
EAVTSSDVQPLGQP

SEQ ID NO: 1158602 - protein, 7 aa, Mycobacterium
EAWGGPL

SEQ ID NO: 1158603 - protein, 13 aa, Mycobacterium
EAYEAYSTAEEVE

SEQ ID NO: 1158604 - protein, 4 aa, Mycobacterium
EAYR

SEQ ID NO: 1158605 - protein, 13 aa, Mycobacterium
EAYSRDPRNVARK

SEQ ID NO: 1158606 - protein, 5 aa, Mycobacterium
ECGPK

SEQ ID NO: 1158607 - protein, 8 aa, Mycobacterium
ECTPETRD

SEQ ID NO: 1158608 - protein, 4 aa, Mycobacterium
EDAA

SEQ ID NO: 1158609 - protein, 7 aa, Mycobacterium
EDAAAEH

SEQ ID NO: 1158610 - protein, 7 aa, Mycobacterium
EDAADAV

SEQ ID NO: 1158611 - protein, 8 aa, Mycobacterium
EDAAPGTV

SEQ ID NO: 1158612 - protein, 8 aa, Mycobacterium
EDADDIER

SEQ ID NO: 1158613 - protein, 5 aa, Mycobacterium
EDADE

SEQ ID NO: 1158614 - protein, 6 aa, Mycobacterium
EDADPH

SEQ ID NO: 1158615 - protein, 9 aa, Mycobacterium
EDAEARAYQ

SEQ ID NO: 1158616 - protein, 5 aa, Mycobacterium
EDAEP

SEQ ID NO: 1158617 - protein, 10 aa, Mycobacterium
EDAERSLRDD

SEQ ID NO: 1158618 - protein, 7 aa, Mycobacterium
EDAGQPV

SEQ ID NO: 1158619 - protein, 9 aa, Mycobacterium
EDAGRDPAT

SEQ ID NO: 1158620 - protein, 7 aa, Mycobacterium
EDAGSRM

SEQ ID NO: 1158621 - protein, 5 aa, Mycobacterium
EDAGV

SEQ ID NO: 1158622 - protein, 8 aa, Mycobacterium
EDAGVGPI

SEQ ID NO: 1158623 - protein, 6 aa, Mycobacterium
EDANRM

SEQ ID NO: 1158624 - protein, 8 aa, Mycobacterium
EDANSDSN

SEQ ID NO: 1158625 - protein, 6 aa, Mycobacterium
EDAQGQ

SEQ ID NO: 1158626 - protein, 5 aa, Mycobacterium
EDARP

SEQ ID NO: 1158627 - protein, 9 aa, Mycobacterium
EDASPDTMS

SEQ ID NO: 1158628 - protein, 5 aa, Mycobacterium
EDASQ

SEQ ID NO: 1158629 - protein, 18 aa, Mycobacterium
EDASRYPAEFSGGQKQRI

SEQ ID NO: 1158630 - protein, 8 aa, Mycobacterium
EDATARWS

SEQ ID NO: 1158631 - protein, 9 aa, Mycobacterium
EDATRSVEH

SEQ ID NO: 1158632 - protein, 13 aa, Mycobacterium
EDAYEPGSSAEWT

SEQ ID NO: 1158633 - protein, 5 aa, Mycobacterium
EDCPP

SEQ ID NO: 1158634 - protein, 9 aa, Mycobacterium
EDDARRPVR

SEQ ID NO: 1158635 - protein, 8 aa, Mycobacterium
EDDDKLPR

SEQ ID NO: 1158636 - protein, 5 aa, Mycobacterium
EDDEA

SEQ ID NO: 1158637 - protein, 11 aa, Mycobacterium
EDDGEVDGGDL

SEQ ID NO: 1158638 - protein, 5 aa, Mycobacterium
EDDLG

SEQ ID NO: 1158639 - protein, 11 aa, Mycobacterium
EDDLGKQTPCS

SEQ ID NO: 1158640 - protein, 6 aa, Mycobacterium
EDDPHA

SEQ ID NO: 1158641 - protein, 15 aa, Mycobacterium
EDDPVQEPGGRGSGA

SEQ ID NO: 1158642 - protein, 9 aa, Mycobacterium
EDDRASDAR

SEQ ID NO: 1158643 - protein, 9 aa, Mycobacterium
EDDRPAGIG

SEQ ID NO: 1158644 - protein, 14 aa, Mycobacterium
EDDRSDDQPAPARV

SEQ ID NO: 1158645 - protein, 10 aa, Mycobacterium
EDDSDEGPAT

SEQ ID NO: 1158646 - protein, 5 aa, Mycobacterium
EDDTD

SEQ ID NO: 1158647 - protein, 8 aa, Mycobacterium
EDDTPVAT

SEQ ID NO: 1158648 - protein, 8 aa, Mycobacterium
EDDTVEVG

SEQ ID NO: 1158649 - protein, 14 aa, Mycobacterium
EDEGIRANTTAESL

SEQ ID NO: 1158650 - protein, 10 aa, Mycobacterium
EDEGSAAAYA

SEQ ID NO: 1158651 - protein, 18 aa, Mycobacterium
EDEKQAVDPPESSSGGLT

SEQ ID NO: 1158652 - protein, 5 aa, Mycobacterium
EDELG

SEQ ID NO: 1158653 - protein, 8 aa, Mycobacterium
EDEPQFSR

SEQ ID NO: 1158654 - protein, 7 aa, Mycobacterium
EDESQLP

SEQ ID NO: 1158655 - protein, 5 aa, Mycobacterium
EDETA

SEQ ID NO: 1158656 - protein, 7 aa, Mycobacterium
EDETGTV

SEQ ID NO: 1158657 - protein, 7 aa, Mycobacterium
EDETPAA

SEQ ID NO: 1158658 - protein, 6 aa, Mycobacterium
EDETRG

SEQ ID NO: 1158659 - protein, 12 aa, Mycobacterium
EDFESRPRYTDP

SEQ ID NO: 1158660 - protein, 5 aa, Mycobacterium
EDFGE

SEQ ID NO: 1158661 - protein, 5 aa, Mycobacterium
EDFSE

SEQ ID NO: 1158662 - protein, 12 aa, Mycobacterium
EDGADGARARSA

SEQ ID NO: 1158663 - protein, 6 aa, Mycobacterium
EDGAPL

SEQ ID NO: 1158664 - protein, 9 aa, Mycobacterium
EDGASEPTV

SEQ ID NO: 1158665 - protein, 4 aa, Mycobacterium
EDGE

SEQ ID NO: 1158666 - protein, 7 aa, Mycobacterium
EDGERDL

SEQ ID NO: 1158667 - protein, 7 aa, Mycobacterium
EDGEYGY

SEQ ID NO: 1158668 - protein, 9 aa, Mycobacterium
EDGGRMSDI

SEQ ID NO: 1158669 - protein, 12 aa, Mycobacterium
EDGHDERTSVDA

SEQ ID NO: 1158670 - protein, 7 aa, Mycobacterium
EDGKPVN

SEQ ID NO: 1158671 - protein, 6 aa, Mycobacterium
EDGPGI

SEQ ID NO: 1158672 - protein, 7 aa, Mycobacterium
EDGPRPT

SEQ ID NO: 1158673 - protein, 8 aa, Mycobacterium
EDGRGFDG

SEQ ID NO: 1158674 - protein, 5 aa, Mycobacterium
EDGRI

SEQ ID NO: 1158675 - protein, 9 aa, Mycobacterium
EDGRKTYAR

SEQ ID NO: 1158676 - protein, 15 aa, Mycobacterium
EDGSEGVLSDGDHVE

SEQ ID NO: 1158677 - protein, 6 aa, Mycobacterium
EDGSLV

SEQ ID NO: 1158678 - protein, 15 aa, Mycobacterium
EDGSPVRGVAGGTDR

SEQ ID NO: 1158679 - protein, 7 aa, Mycobacterium
EDGSYDV

SEQ ID NO: 1158680 - protein, 6 aa, Mycobacterium
EDGTTL

SEQ ID NO: 1158681 - protein, 7 aa, Mycobacterium
EDHTGGI

SEQ ID NO: 1158682 - protein, 8 aa, Mycobacterium
EDHTGGSV

SEQ ID NO: 1158683 - protein, 9 aa, Mycobacterium
EDIKDGKYE

SEQ ID NO: 1158684 - protein, 8 aa, Mycobacterium
EDITRRSG

SEQ ID NO: 1158685 - protein, 6 aa, Mycobacterium
EDKNNF

SEQ ID NO: 1158686 - protein, 11 aa, Mycobacterium
EDKVGKDAGEI

SEQ ID NO: 1158687 - protein, 10 aa, Mycobacterium
EDLAATPPAE

SEQ ID NO: 1158688 - protein, 18 aa, Mycobacterium
EDLASGGDPPRIDSRGHT

SEQ ID NO: 1158689 - protein, 6 aa, Mycobacterium
EDLDES

SEQ ID NO: 1158690 - protein, 5 aa, Mycobacterium
EDLDR

SEQ ID NO: 1158691 - protein, 16 aa, Mycobacterium
EDLGGGDLHSKTSGVT

SEQ ID NO: 1158692 - protein, 45 aa, Mycobacterium
EDLGGKAKETLGKATGDESTANEGKADQSKSSLKDAGEKVKDAFK

SEQ ID NO: 1158693 - protein, 9 aa, Mycobacterium
EDLNPEVKT

SEQ ID NO: 1158694 - protein, 10 aa, Mycobacterium
EDLPSGDELG

SEQ ID NO: 1158695 - protein, 7 aa, Mycobacterium
EDLSSTD

SEQ ID NO: 1158696 - protein, 5 aa, Mycobacterium
EDNPD

SEQ ID NO: 1158697 - protein, 9 aa, Mycobacterium
EDNTYGAPR

SEQ ID NO: 1158698 - protein, 5 aa, Mycobacterium
EDPAA

SEQ ID NO: 1158699 - protein, 6 aa, Mycobacterium
EDPDAI

SEQ ID NO: 1158700 - protein, 8 aa, Mycobacterium
EDPDGDHD

SEQ ID NO: 1158701 - protein, 5 aa, Mycobacterium
EDPDK

SEQ ID NO: 1158702 - protein, 7 aa, Mycobacterium
EDPDRHG

SEQ ID NO: 1158703 - protein, 7 aa, Mycobacterium
EDPDSAL

SEQ ID NO: 1158704 - protein, 9 aa, Mycobacterium
EDPDSDDLH

SEQ ID NO: 1158705 - protein, 9 aa, Mycobacterium
EDPDTAEAL

SEQ ID NO: 1158706 - protein, 4 aa, Mycobacterium
EDPI

SEQ ID NO: 1158707 - protein, 5 aa, Mycobacterium
EDPKL

SEQ ID NO: 1158708 - protein, 5 aa, Mycobacterium
EDPRR

SEQ ID NO: 1158709 - protein, 9 aa, Mycobacterium
EDPSRGTEL

SEQ ID NO: 1158710 - protein, 6 aa, Mycobacterium
EDPVEQ

SEQ ID NO: 1158711 - protein, 8 aa, Mycobacterium
EDQAGERR

SEQ ID NO: 1158712 - protein, 4 aa, Mycobacterium
EDQG

SEQ ID NO: 1158713 - protein, 8 aa, Mycobacterium
EDQGEARI

SEQ ID NO: 1158714 - protein, 15 aa, Mycobacterium
EDQPEAMARALREFV

SEQ ID NO: 1158715 - protein, 18 aa, Mycobacterium
EDRAGHTPTGYREPGGRV

SEQ ID NO: 1158716 - protein, 6 aa, Mycobacterium
EDREVR

SEQ ID NO: 1158717 - protein, 4 aa, Mycobacterium
EDRF

SEQ ID NO: 1158718 - protein, 4 aa, Mycobacterium
EDRH

SEQ ID NO: 1158719 - protein, 12 aa, Mycobacterium
EDRKGVSLDPQR

SEQ ID NO: 1158720 - protein, 11 aa, Mycobacterium
EDRRAKDAEGV

SEQ ID NO: 1158721 - protein, 6 aa, Mycobacterium
EDRRQQ

SEQ ID NO: 1158722 - protein, 7 aa, Mycobacterium
EDRRRSE

SEQ ID NO: 1158723 - protein, 12 aa, Mycobacterium
EDRSGGTGLAGD

SEQ ID NO: 1158724 - protein, 8 aa, Mycobacterium
EDRSTAER

SEQ ID NO: 1158725 - protein, 7 aa, Mycobacterium
EDRTGPP

SEQ ID NO: 1158726 - protein, 23 aa, Mycobacterium
EDSDRTAAELTPAEKDAASHRGR

SEQ ID NO: 1158727 - protein, 7 aa, Mycobacterium
EDSGPLS

SEQ ID NO: 1158728 - protein, 8 aa, Mycobacterium
EDSGRPIE

SEQ ID NO: 1158729 - protein, 7 aa, Mycobacterium
EDSGSRM

SEQ ID NO: 1158730 - protein, 9 aa, Mycobacterium
EDSLGERDA

SEQ ID NO: 1158731 - protein, 4 aa, Mycobacterium
EDSP

SEQ ID NO: 1158732 - protein, 6 aa, Mycobacterium
EDSRQA

SEQ ID NO: 1158733 - protein, 9 aa, Mycobacterium
EDSVPSDAE

SEQ ID NO: 1158734 - protein, 12 aa, Mycobacterium
EDSYDPAQPQFP

SEQ ID NO: 1158735 - protein, 4 aa, Mycobacterium
EDTA

SEQ ID NO: 1158736 - protein, 7 aa, Mycobacterium
EDTAPVV

SEQ ID NO: 1158737 - protein, 14 aa, Mycobacterium
EDTDDLIADLGAAL

SEQ ID NO: 1158738 - protein, 14 aa, Mycobacterium
EDTDDLIRDLDRAL

SEQ ID NO: 1158739 - protein, 8 aa, Mycobacterium
EDTDPPVV

SEQ ID NO: 1158740 - protein, 9 aa, Mycobacterium
EDTGELTPT

SEQ ID NO: 1158741 - protein, 8 aa, Mycobacterium
EDTPDTRL

SEQ ID NO: 1158742 - protein, 8 aa, Mycobacterium
EDTPSQLA

SEQ ID NO: 1158743 - protein, 16 aa, Mycobacterium
EDTTAMAEQSTGGETL

SEQ ID NO: 1158744 - protein, 20 aa, Mycobacterium
EDTVRKAQEGLHRSQSEGQK

SEQ ID NO: 1158745 - protein, 6 aa, Mycobacterium
EDVKTS

SEQ ID NO: 1158746 - protein, 15 aa, Mycobacterium
EDVQRAAEGWAPAAE

SEQ ID NO: 1158747 - protein, 10 aa, Mycobacterium
EDVRKSYDVS

SEQ ID NO: 1158748 - protein, 11 aa, Mycobacterium
EDVRSGMEKQQ

SEQ ID NO: 1158749 - protein, 5 aa, Mycobacterium
EDYDA

SEQ ID NO: 1158750 - protein, 5 aa, Mycobacterium
EDYSR

SEQ ID NO: 1158751 - protein, 5 aa, Mycobacterium
EEAAA

SEQ ID NO: 1158752 - protein, 28 aa, Mycobacterium
EEAAEASDNGSATPSDKAPATADATTAG

SEQ ID NO: 1158753 - protein, 5 aa, Mycobacterium
EEAAT

SEQ ID NO: 1158754 - protein, 8 aa, Mycobacterium
EEADVEKA

SEQ ID NO: 1158755 - protein, 10 aa, Mycobacterium
EEAGDQLTED

SEQ ID NO: 1158756 - protein, 5 aa, Mycobacterium
EEAGG

SEQ ID NO: 1158757 - protein, 10 aa, Mycobacterium
EEAGVTTYTT

SEQ ID NO: 1158758 - protein, 6 aa, Mycobacterium
EEAGYG

SEQ ID NO: 1158759 - protein, 5 aa, Mycobacterium
EEANK

SEQ ID NO: 1158760 - protein, 6 aa, Mycobacterium
EEANTR

SEQ ID NO: 1158761 - protein, 6 aa, Mycobacterium
EEARET

SEQ ID NO: 1158762 - protein, 9 aa, Mycobacterium
EEARRSALP

SEQ ID NO: 1158763 - protein, 9 aa, Mycobacterium
EEASAPPPV

SEQ ID NO: 1158764 - protein, 7 aa, Mycobacterium
EEATEPE

SEQ ID NO: 1158765 - protein, 12 aa, Mycobacterium
EECEKRDPKGLY

SEQ ID NO: 1158766 - protein, 4 aa, Mycobacterium
EEDE

SEQ ID NO: 1158767 - protein, 6 aa, Mycobacterium
EEDGAA

SEQ ID NO: 1158768 - protein, 9 aa, Mycobacterium
EEDSRGRTG

SEQ ID NO: 1158769 - protein, 8 aa, Mycobacterium
EEDTEAAA

SEQ ID NO: 1158770 - protein, 16 aa, Mycobacterium
EEEADSSGVFVPANAP

SEQ ID NO: 1158771 - protein, 16 aa, Mycobacterium
EEENPEAAAALRDKFS

SEQ ID NO: 1158772 - protein, 12 aa, Mycobacterium
EEEQSALRNAQR

SEQ ID NO: 1158773 - protein, 11 aa, Mycobacterium
EEEVENESRGG

SEQ ID NO: 1158774 - protein, 6 aa, Mycobacterium
EEFADP

SEQ ID NO: 1158775 - protein, 6 aa, Mycobacterium
EEFAER

SEQ ID NO: 1158776 - protein, 6 aa, Mycobacterium
EEFPPG

SEQ ID NO: 1158777 - protein, 9 aa, Mycobacterium
EEGAAEGTS

SEQ ID NO: 1158778 - protein, 10 aa, Mycobacterium
EEGAGGDGYD

SEQ ID NO: 1158779 - protein, 9 aa, Mycobacterium
EEGDELGGN

SEQ ID NO: 1158780 - protein, 12 aa, Mycobacterium
EEGFSKTSTTET

SEQ ID NO: 1158781 - protein, 6 aa, Mycobacterium
EEGIRR

SEQ ID NO: 1158782 - protein, 5 aa, Mycobacterium
EEGKE

SEQ ID NO: 1158783 - protein, 8 aa, Mycobacterium
EEGKPELK

SEQ ID NO: 1158784 - protein, 8 aa, Mycobacterium
EEGPVRAR

SEQ ID NO: 1158785 - protein, 8 aa, Mycobacterium
EEGQQVSA

SEQ ID NO: 1158786 - protein, 4 aa, Mycobacterium
EEGR

SEQ ID NO: 1158787 - protein, 8 aa, Mycobacterium
EEGRPLAG

SEQ ID NO: 1158788 - protein, 8 aa, Mycobacterium
EEGSMTAA

SEQ ID NO: 1158789 - protein, 14 aa, Mycobacterium
EEGSPVTTGERVSA

SEQ ID NO: 1158790 - protein, 16 aa, Mycobacterium
EEGSTQAINQIDAFLA

SEQ ID NO: 1158791 - protein, 8 aa, Mycobacterium
EEHGGTYG

SEQ ID NO: 1158792 - protein, 4 aa, Mycobacterium
EEHH

SEQ ID NO: 1158793 - protein, 11 aa, Mycobacterium
EEIDRDPATLE

SEQ ID NO: 1158794 - protein, 6 aa, Mycobacterium
EEIKAK

SEQ ID NO: 1158795 - protein, 9 aa, Mycobacterium
EEIPLTDPT

SEQ ID NO: 1158796 - protein, 10 aa, Mycobacterium
EEITPQTPAD

SEQ ID NO: 1158797 - protein, 10 aa, Mycobacterium
EEKGAPITPA

SEQ ID NO: 1158798 - protein, 5 aa, Mycobacterium
EEKIP

SEQ ID NO: 1158799 - protein, 14 aa, Mycobacterium
EELDETGRLAETHG

SEQ ID NO: 1158800 - protein, 5 aa, Mycobacterium
EELDQ

SEQ ID NO: 1158801 - protein, 4 aa, Mycobacterium
EELG

SEQ ID NO: 1158802 - protein, 6 aa, Mycobacterium
EELPTQ

SEQ ID NO: 1158803 - protein, 9 aa, Mycobacterium
EELSDRGRG

SEQ ID NO: 1158804 - protein, 13 aa, Mycobacterium
EELSGSREWGATS

SEQ ID NO: 1158805 - protein, 6 aa, Mycobacterium
EELTPG

SEQ ID NO: 1158806 - protein, 8 aa, Mycobacterium
EENQAQVG

SEQ ID NO: 1158807 - protein, 7 aa, Mycobacterium
EENSPAG

SEQ ID NO: 1158808 - protein, 8 aa, Mycobacterium
EEPDPADM

SEQ ID NO: 1158809 - protein, 4 aa, Mycobacterium
EEPR

SEQ ID NO: 1158810 - protein, 8 aa, Mycobacterium
EEPRDRAA

SEQ ID NO: 1158811 - protein, 4 aa, Mycobacterium
EEPV

SEQ ID NO: 1158812 - protein, 13 aa, Mycobacterium
EEPVPTAKQLTSA

SEQ ID NO: 1158813 - protein, 13 aa, Mycobacterium
EEQARAAAAGDDE

SEQ ID NO: 1158814 - protein, 9 aa, Mycobacterium
EEQGKLTDD

SEQ ID NO: 1158815 - protein, 4 aa, Mycobacterium
EEQH

SEQ ID NO: 1158816 - protein, 5 aa, Mycobacterium
EEQHG

SEQ ID NO: 1158817 - protein, 11 aa, Mycobacterium
EEQRAAAPPPV

SEQ ID NO: 1158818 - protein, 5 aa, Mycobacterium
EERAN

SEQ ID NO: 1158819 - protein, 10 aa, Mycobacterium
EERDALPGLQ

SEQ ID NO: 1158820 - protein, 17 aa, Mycobacterium
EERDPDFGRGASAYDGY

SEQ ID NO: 1158821 - protein, 5 aa, Mycobacterium
EEREI

SEQ ID NO: 1158822 - protein, 7 aa, Mycobacterium
EERGVDT

SEQ ID NO: 1158823 - protein, 19 aa, Mycobacterium
EERKGKGASDHAPVLVDLR

SEQ ID NO: 1158824 - protein, 4 aa, Mycobacterium
EERR

SEQ ID NO: 1158825 - protein, 7 aa, Mycobacterium
EERRDTA

SEQ ID NO: 1158826 - protein, 13 aa, Mycobacterium
EERSAAIRAAGGS

SEQ ID NO: 1158827 - protein, 4 aa, Mycobacterium
EERV

SEQ ID NO: 1158828 - protein, 5 aa, Mycobacterium
EERVA

SEQ ID NO: 1158829 - protein, 5 aa, Mycobacterium
EESAM

SEQ ID NO: 1158830 - protein, 6 aa, Mycobacterium
EESGAV

SEQ ID NO: 1158831 - protein, 5 aa, Mycobacterium
EESLP

SEQ ID NO: 1158832 - protein, 7 aa, Mycobacterium
EESQKAT

SEQ ID NO: 1158833 - protein, 8 aa, Mycobacterium
EESSTLNT

SEQ ID NO: 1158834 - protein, 5 aa, Mycobacterium
EESTE

SEQ ID NO: 1158835 - protein, 9 aa, Mycobacterium
EESTGRGRH

SEQ ID NO: 1158836 - protein, 4 aa, Mycobacterium
EESV

SEQ ID NO: 1158837 - protein, 7 aa, Mycobacterium
EETADGV

SEQ ID NO: 1158838 - protein, 13 aa, Mycobacterium
EETDDGLAGEEGT

SEQ ID NO: 1158839 - protein, 10 aa, Mycobacterium
EETFPGSDPV

SEQ ID NO: 1158840 - protein, 6 aa, Mycobacterium
EETGGR

SEQ ID NO: 1158841 - protein, 6 aa, Mycobacterium
EETGIR

SEQ ID NO: 1158842 - protein, 13 aa, Mycobacterium
EETGRVATAKNPR

SEQ ID NO: 1158843 - protein, 5 aa, Mycobacterium
EETGT

SEQ ID NO: 1158844 - protein, 7 aa, Mycobacterium
EETGTKV

SEQ ID NO: 1158845 - protein, 17 aa, Mycobacterium
EETGYSFDPDSPDLDGT

SEQ ID NO: 1158846 - protein, 6 aa, Mycobacterium
EETLAA

SEQ ID NO: 1158847 - protein, 5 aa, Mycobacterium
EETPA

SEQ ID NO: 1158848 - protein, 5 aa, Mycobacterium
EETSD

SEQ ID NO: 1158849 - protein, 4 aa, Mycobacterium
EEVR

SEQ ID NO: 1158850 - protein, 8 aa, Mycobacterium
EEVSGARR

SEQ ID NO: 1158851 - protein, 6 aa, Mycobacterium
EEVTDA

SEQ ID NO: 1158852 - protein, 12 aa, Mycobacterium
EEVTGTAGAAGR

SEQ ID NO: 1158853 - protein, 17 aa, Mycobacterium
EEWGDSPRAYRGGTVPG

SEQ ID NO: 1158854 - protein, 5 aa, Mycobacterium
EEWPG

SEQ ID NO: 1158855 - protein, 17 aa, Mycobacterium
EEWQDSPDGWPQRPTYS

SEQ ID NO: 1158856 - protein, 6 aa, Mycobacterium
EEYAKT

SEQ ID NO: 1158857 - protein, 9 aa, Mycobacterium
EEYGGAGID

SEQ ID NO: 1158858 - protein, 10 aa, Mycobacterium
EEYGGQGADS

SEQ ID NO: 1158859 - protein, 4 aa, Mycobacterium
EEYP

SEQ ID NO: 1158860 - protein, 7 aa, Mycobacterium
EFAGSGL

SEQ ID NO: 1158861 - protein, 9 aa, Mycobacterium
EFDPERAGS

SEQ ID NO: 1158862 - protein, 4 aa, Mycobacterium
EFEP

SEQ ID NO: 1158863 - protein, 6 aa, Mycobacterium
EFESRK

SEQ ID NO: 1158864 - protein, 11 aa, Mycobacterium
EFGDGSGPGDL

SEQ ID NO: 1158865 - protein, 5 aa, Mycobacterium
EFGEA

SEQ ID NO: 1158866 - protein, 9 aa, Mycobacterium
EFGGGGSDD

SEQ ID NO: 1158867 - protein, 6 aa, Mycobacterium
EFGPDE

SEQ ID NO: 1158868 - protein, 6 aa, Mycobacterium
EFGSRD

SEQ ID NO: 1158869 - protein, 5 aa, Mycobacterium
EFHTG

SEQ ID NO: 1158870 - protein, 10 aa, Mycobacterium
EFRPSDVAAE

SEQ ID NO: 1158871 - protein, 9 aa, Mycobacterium
EFSGPDTIG

SEQ ID NO: 1158872 - protein, 11 aa, Mycobacterium
EFSSRAENEPV

SEQ ID NO: 1158873 - protein, 4 aa, Mycobacterium
EFTE

SEQ ID NO: 1158874 - protein, 6 aa, Mycobacterium
EFTGDS

SEQ ID NO: 1158875 - protein, 7 aa, Mycobacterium
EFTPPDG

SEQ ID NO: 1158876 - protein, 8 aa, Mycobacterium
EFYGPRGA

SEQ ID NO: 1158877 - protein, 17 aa, Mycobacterium
EGAAGIPTYRDLLPGAF

SEQ ID NO: 1158878 - protein, 8 aa, Mycobacterium
EGAATGVD

SEQ ID NO: 1158879 - protein, 6 aa, Mycobacterium
EGADAD

SEQ ID NO: 1158880 - protein, 6 aa, Mycobacterium
EGADGV

SEQ ID NO: 1158881 - protein, 17 aa, Mycobacterium
EGADKPAAVAESIVRFI

SEQ ID NO: 1158882 - protein, 34 aa, Mycobacterium
EGAEDGTNSHTGPAPVAPQAPATDAEIEDLARRM

SEQ ID NO: 1158883 - protein, 10 aa, Mycobacterium
EGAEEGTQIT

SEQ ID NO: 1158884 - protein, 16 aa, Mycobacterium
EGAENSVLDGDPASET

SEQ ID NO: 1158885 - protein, 4 aa, Mycobacterium
EGAG

SEQ ID NO: 1158886 - protein, 10 aa, Mycobacterium
EGAGARSAQL

SEQ ID NO: 1158887 - protein, 8 aa, Mycobacterium
EGAGGRAG

SEQ ID NO: 1158888 - protein, 6 aa, Mycobacterium
EGAGRS

SEQ ID NO: 1158889 - protein, 8 aa, Mycobacterium
EGALPDRY

SEQ ID NO: 1158890 - protein, 5 aa, Mycobacterium
EGAPI

SEQ ID NO: 1158891 - protein, 5 aa, Mycobacterium
EGAQV

SEQ ID NO: 1158892 - protein, 8 aa, Mycobacterium
EGARDPVA

SEQ ID NO: 1158893 - protein, 6 aa, Mycobacterium
EGARSV

SEQ ID NO: 1158894 - protein, 10 aa, Mycobacterium
EGASATDEEL

SEQ ID NO: 1158895 - protein, 16 aa, Mycobacterium
EGASCSSSPSSVAKAA

SEQ ID NO: 1158896 - protein, 8 aa, Mycobacterium
EGASGMRK

SEQ ID NO: 1158897 - protein, 11 aa, Mycobacterium
EGASPAVGSVG

SEQ ID NO: 1158898 - protein, 6 aa, Mycobacterium
EGATAH

SEQ ID NO: 1158899 - protein, 9 aa, Mycobacterium
EGATRSRAP

SEQ ID NO: 1158900 - protein, 8 aa, Mycobacterium
EGATSDEW

SEQ ID NO: 1158901 - protein, 6 aa, Mycobacterium
EGATTI

SEQ ID NO: 1158902 - protein, 5 aa, Mycobacterium
EGAWS

SEQ ID NO: 1158903 - protein, 6 aa, Mycobacterium
EGDDDR

SEQ ID NO: 1158904 - protein, 9 aa, Mycobacterium
EGDDERTAR

SEQ ID NO: 1158905 - protein, 17 aa, Mycobacterium
EGDDNTADERYSPGERY

SEQ ID NO: 1158906 - protein, 7 aa, Mycobacterium
EGDDTVR

SEQ ID NO: 1158907 - protein, 10 aa, Mycobacterium
EGDEERAEKV

SEQ ID NO: 1158908 - protein, 13 aa, Mycobacterium
EGDEKKSKSRGFW

SEQ ID NO: 1158909 - protein, 7 aa, Mycobacterium
EGDGEAY

SEQ ID NO: 1158910 - protein, 6 aa, Mycobacterium
EGDGSY

SEQ ID NO: 1158911 - protein, 7 aa, Mycobacterium
EGDGTQL

SEQ ID NO: 1158912 - protein, 7 aa, Mycobacterium
EGDLAPL

SEQ ID NO: 1158913 - protein, 7 aa, Mycobacterium
EGDNDTV

SEQ ID NO: 1158914 - protein, 23 aa, Mycobacterium
EGDNSISAKWDPETGQVVRTAVG

SEQ ID NO: 1158915 - protein, 7 aa, Mycobacterium
EGDPDAL

SEQ ID NO: 1158916 - protein, 6 aa, Mycobacterium
EGDRTR

SEQ ID NO: 1158917 - protein, 10 aa, Mycobacterium
EGDSGASGLA

SEQ ID NO: 1158918 - protein, 6 aa, Mycobacterium
EGDSGD

SEQ ID NO: 1158919 - protein, 4 aa, Mycobacterium
EGDT

SEQ ID NO: 1158920 - protein, 9 aa, Mycobacterium
EGDTVEQDE

SEQ ID NO: 1158921 - protein, 8 aa, Mycobacterium
EGEEGDRG

SEQ ID NO: 1158922 - protein, 31 aa, Mycobacterium
EGEESATPKGDKKVTGGGQIKGGQLSKTIER

SEQ ID NO: 1158923 - protein, 13 aa, Mycobacterium
EGEETPDPTPTGF

SEQ ID NO: 1158924 - protein, 9 aa, Mycobacterium
EGEGEGESA

SEQ ID NO: 1158925 - protein, 6 aa, Mycobacterium
EGENTR

SEQ ID NO: 1158926 - protein, 15 aa, Mycobacterium
EGEPYAGTVTRSGEV

SEQ ID NO: 1158927 - protein, 6 aa, Mycobacterium
EGEQLR

SEQ ID NO: 1158928 - protein, 5 aa, Mycobacterium
EGERL

SEQ ID NO: 1158929 - protein, 9 aa, Mycobacterium
EGERQAAEK

SEQ ID NO: 1158930 - protein, 5 aa, Mycobacterium
EGETG

SEQ ID NO: 1158931 - protein, 8 aa, Mycobacterium
EGETVSAG

SEQ ID NO: 1158932 - protein, 4 aa, Mycobacterium
EGFS

SEQ ID NO: 1158933 - protein, 7 aa, Mycobacterium
EGFSPTS

SEQ ID NO: 1158934 - protein, 19 aa, Mycobacterium
EGFTPRASGVSLEDRPPMA

SEQ ID NO: 1158935 - protein, 8 aa, Mycobacterium
EGFTPTLP

SEQ ID NO: 1158936 - protein, 17 aa, Mycobacterium
EGGAGEINGAVSTTQGL

SEQ ID NO: 1158937 - protein, 4 aa, Mycobacterium
EGGD

SEQ ID NO: 1158938 - protein, 6 aa, Mycobacterium
EGGERV

SEQ ID NO: 1158939 - protein, 8 aa, Mycobacterium
EGGGAGSV

SEQ ID NO: 1158940 - protein, 8 aa, Mycobacterium
EGGGRQVA

SEQ ID NO: 1158941 - protein, 14 aa, Mycobacterium
EGGGTANATLVELI

SEQ ID NO: 1158942 - protein, 14 aa, Mycobacterium
EGGHGGAADNSQAA

SEQ ID NO: 1158943 - protein, 9 aa, Mycobacterium
EGGIETRTG

SEQ ID NO: 1158944 - protein, 8 aa, Mycobacterium
EGGKATHS

SEQ ID NO: 1158945 - protein, 5 aa, Mycobacterium
EGGLD

SEQ ID NO: 1158946 - protein, 9 aa, Mycobacterium
EGGPERQEE

SEQ ID NO: 1158947 - protein, 8 aa, Mycobacterium
EGGPQRVA

SEQ ID NO: 1158948 - protein, 10 aa, Mycobacterium
EGGPSKHHEH

SEQ ID NO: 1158949 - protein, 6 aa, Mycobacterium
EGGRHS

SEQ ID NO: 1158950 - protein, 13 aa, Mycobacterium
EGGRVSNNKGMSL

SEQ ID NO: 1158951 - protein, 10 aa, Mycobacterium
EGGTAADAAV

SEQ ID NO: 1158952 - protein, 6 aa, Mycobacterium
EGGTNA

SEQ ID NO: 1158953 - protein, 7 aa, Mycobacterium
EGGVDAQ

SEQ ID NO: 1158954 - protein, 5 aa, Mycobacterium
EGGYE

SEQ ID NO: 1158955 - protein, 5 aa, Mycobacterium
EGHDQ

SEQ ID NO: 1158956 - protein, 13 aa, Mycobacterium
EGHDSGAIGPADA

SEQ ID NO: 1158957 - protein, 8 aa, Mycobacterium
EGHKLSDD

SEQ ID NO: 1158958 - protein, 6 aa, Mycobacterium
EGHSTG

SEQ ID NO: 1158959 - protein, 7 aa, Mycobacterium
EGHTTDG

SEQ ID NO: 1158960 - protein, 6 aa, Mycobacterium
EGIDTR

SEQ ID NO: 1158961 - protein, 5 aa, Mycobacterium
EGIPD

SEQ ID NO: 1158962 - protein, 4 aa, Mycobacterium
EGIQ

SEQ ID NO: 1158963 - protein, 7 aa, Mycobacterium
EGKASLG

SEQ ID NO: 1158964 - protein, 11 aa, Mycobacterium
EGKHEKPTVAQ

SEQ ID NO: 1158965 - protein, 27 aa, Mycobacterium
EGKPPFANPRNSAAGSLRQKNPAVTAR

SEQ ID NO: 1158966 - protein, 4 aa, Mycobacterium
EGKQ

SEQ ID NO: 1158967 - protein, 13 aa, Mycobacterium
EGKRRAKARRTGG

SEQ ID NO: 1158968 - protein, 8 aa, Mycobacterium
EGKTAGQV

SEQ ID NO: 1158969 - protein, 11 aa, Mycobacterium
EGLAPAREVSG

SEQ ID NO: 1158970 - protein, 8 aa, Mycobacterium
EGLEQPRS

SEQ ID NO: 1158971 - protein, 7 aa, Mycobacterium
EGLGTTV

SEQ ID NO: 1158972 - protein, 13 aa, Mycobacterium
EGLGVGRAEAQRL

SEQ ID NO: 1158973 - protein, 7 aa, Mycobacterium
EGLPTPA

SEQ ID NO: 1158974 - protein, 5 aa, Mycobacterium
EGLQD

SEQ ID NO: 1158975 - protein, 6 aa, Mycobacterium
EGLRSR

SEQ ID NO: 1158976 - protein, 14 aa, Mycobacterium
EGLSAQQSDEEFNA

SEQ ID NO: 1158977 - protein, 4 aa, Mycobacterium
EGLT

SEQ ID NO: 1158978 - protein, 5 aa, Mycobacterium
EGLTD

SEQ ID NO: 1158979 - protein, 8 aa, Mycobacterium
EGLTGPEE

SEQ ID NO: 1158980 - protein, 4 aa, Mycobacterium
EGMT

SEQ ID NO: 1158981 - protein, 5 aa, Mycobacterium
EGNLE

SEQ ID NO: 1158982 - protein, 9 aa, Mycobacterium
EGNPPPPEV

SEQ ID NO: 1158983 - protein, 8 aa, Mycobacterium
EGNPSSTI

SEQ ID NO: 1158984 - protein, 9 aa, Mycobacterium
EGNVAGPNR

SEQ ID NO: 1158985 - protein, 6 aa, Mycobacterium
EGPAAL

SEQ ID NO: 1158986 - protein, 6 aa, Mycobacterium
EGPDGT

SEQ ID NO: 1158987 - protein, 7 aa, Mycobacterium
EGPDHTA

SEQ ID NO: 1158988 - protein, 14 aa, Mycobacterium
EGPDPDPVTSPPSV

SEQ ID NO: 1158989 - protein, 5 aa, Mycobacterium
EGPDT

SEQ ID NO: 1158990 - protein, 9 aa, Mycobacterium
EGPEAVPGA

SEQ ID NO: 1158991 - protein, 6 aa, Mycobacterium
EGPGLT

SEQ ID NO: 1158992 - protein, 9 aa, Mycobacterium
EGPGTSRPL

SEQ ID NO: 1158993 - protein, 6 aa, Mycobacterium
EGPHAA

SEQ ID NO: 1158994 - protein, 6 aa, Mycobacterium
EGPKNV

SEQ ID NO: 1158995 - protein, 6 aa, Mycobacterium
EGPRFS

SEQ ID NO: 1158996 - protein, 7 aa, Mycobacterium
EGPVTSP

SEQ ID NO: 1158997 - protein, 5 aa, Mycobacterium
EGQCG

SEQ ID NO: 1158998 - protein, 7 aa, Mycobacterium
EGQRSTH

SEQ ID NO: 1158999 - protein, 12 aa, Mycobacterium
EGQTPSTKSAKA

SEQ ID NO: 1159000 - protein, 4 aa, Mycobacterium
EGRA

SEQ ID NO: 1159001 - protein, 19 aa, Mycobacterium
EGRANLPHDTCSERVATLA

SEQ ID NO: 1159002 - protein, 5 aa, Mycobacterium
EGRAR

SEQ ID NO: 1159003 - protein, 6 aa, Mycobacterium
EGRDDA

SEQ ID NO: 1159004 - protein, 7 aa, Mycobacterium
EGRDKRI

SEQ ID NO: 1159005 - protein, 8 aa, Mycobacterium
EGRGSVSD

SEQ ID NO: 1159006 - protein, 8 aa, Mycobacterium
EGRHPTES

SEQ ID NO: 1159007 - protein, 4 aa, Mycobacterium
EGRI

SEQ ID NO: 1159008 - protein, 11 aa, Mycobacterium
EGRRQPHISTP

SEQ ID NO: 1159009 - protein, 7 aa, Mycobacterium
EGRRSRY

SEQ ID NO: 1159010 - protein, 13 aa, Mycobacterium
EGRSVGERVASGA

SEQ ID NO: 1159011 - protein, 6 aa, Mycobacterium
EGRTDE

SEQ ID NO: 1159012 - protein, 7 aa, Mycobacterium
EGRYRGE

SEQ ID NO: 1159013 - protein, 4 aa, Mycobacterium
EGSA

SEQ ID NO: 1159014 - protein, 13 aa, Mycobacterium
EGSAADVDRGPDW

SEQ ID NO: 1159015 - protein, 4 aa, Mycobacterium
EGSD

SEQ ID NO: 1159016 - protein, 9 aa, Mycobacterium
EGSGLSKEE

SEQ ID NO: 1159017 - protein, 8 aa, Mycobacterium
EGSGPDDS

SEQ ID NO: 1159018 - protein, 8 aa, Mycobacterium
EGSGTGAI

SEQ ID NO: 1159019 - protein, 7 aa, Mycobacterium
EGSPARR

SEQ ID NO: 1159020 - protein, 5 aa, Mycobacterium
EGSPL

SEQ ID NO: 1159021 - protein, 5 aa, Mycobacterium
EGSSE

SEQ ID NO: 1159022 - protein, 7 aa, Mycobacterium
EGSTPVP

SEQ ID NO: 1159023 - protein, 9 aa, Mycobacterium
EGSVAGGTV

SEQ ID NO: 1159024 - protein, 10 aa, Mycobacterium
EGSVEERAAE

SEQ ID NO: 1159025 - protein, 9 aa, Mycobacterium
EGTAADGAR

SEQ ID NO: 1159026 - protein, 5 aa, Mycobacterium
EGTEL

SEQ ID NO: 1159027 - protein, 11 aa, Mycobacterium
EGTGPDGLLPP

SEQ ID NO: 1159028 - protein, 7 aa, Mycobacterium
EGTLPST

SEQ ID NO: 1159029 - protein, 10 aa, Mycobacterium
EGTPTSPSEH

SEQ ID NO: 1159030 - protein, 12 aa, Mycobacterium
EGTRLDTTEVGE

SEQ ID NO: 1159031 - protein, 10 aa, Mycobacterium
EGTRSRTGKM

SEQ ID NO: 1159032 - protein, 5 aa, Mycobacterium
EGTRT

SEQ ID NO: 1159033 - protein, 8 aa, Mycobacterium
EGTTRGAL

SEQ ID NO: 1159034 - protein, 5 aa, Mycobacterium
EGTTV

SEQ ID NO: 1159035 - protein, 4 aa, Mycobacterium
EGTV

SEQ ID NO: 1159036 - protein, 7 aa, Mycobacterium
EGVDEPT

SEQ ID NO: 1159037 - protein, 4 aa, Mycobacterium
EGVE

SEQ ID NO: 1159038 - protein, 5 aa, Mycobacterium
EGVGA

SEQ ID NO: 1159039 - protein, 4 aa, Mycobacterium
EGVP

SEQ ID NO: 1159040 - protein, 9 aa, Mycobacterium
EGVRRGTSV

SEQ ID NO: 1159041 - protein, 5 aa, Mycobacterium
EGVTQ

SEQ ID NO: 1159042 - protein, 5 aa, Mycobacterium
EGVTT

SEQ ID NO: 1159043 - protein, 15 aa, Mycobacterium
EGWSSAATGIPAPTE

SEQ ID NO: 1159044 - protein, 4 aa, Mycobacterium
EGYG

SEQ ID NO: 1159045 - protein, 14 aa, Mycobacterium
EHAARGEDPDFHKQ

SEQ ID NO: 1159046 - protein, 13 aa, Mycobacterium
EHAATPPSKGLVT

SEQ ID NO: 1159047 - protein, 7 aa, Mycobacterium
EHAEAAQ

SEQ ID NO: 1159048 - protein, 8 aa, Mycobacterium
EHAGTRVA

SEQ ID NO: 1159049 - protein, 8 aa, Mycobacterium
EHAKARGA

SEQ ID NO: 1159050 - protein, 4 aa, Mycobacterium
EHAR

SEQ ID NO: 1159051 - protein, 9 aa, Mycobacterium
EHATPSSLR

SEQ ID NO: 1159052 - protein, 5 aa, Mycobacterium
EHDLG

SEQ ID NO: 1159053 - protein, 12 aa, Mycobacterium
EHDPIAGTQDNT

SEQ ID NO: 1159054 - protein, 7 aa, Mycobacterium
EHEDTAA

SEQ ID NO: 1159055 - protein, 5 aa, Mycobacterium
EHEYG

SEQ ID NO: 1159056 - protein, 8 aa, Mycobacterium
EHGAATDK

SEQ ID NO: 1159057 - protein, 5 aa, Mycobacterium
EHGAP

SEQ ID NO: 1159058 - protein, 6 aa, Mycobacterium
EHGEPL

SEQ ID NO: 1159059 - protein, 10 aa, Mycobacterium
EHGESNAAAR

SEQ ID NO: 1159060 - protein, 11 aa, Mycobacterium
EHGKGDVAVRG

SEQ ID NO: 1159061 - protein, 10 aa, Mycobacterium
EHGQPRPTGR

SEQ ID NO: 1159062 - protein, 5 aa, Mycobacterium
EHGRN

SEQ ID NO: 1159063 - protein, 8 aa, Mycobacterium
EHGSEGSF

SEQ ID NO: 1159064 - protein, 6 aa, Mycobacterium
EHHSSP

SEQ ID NO: 1159065 - protein, 12 aa, Mycobacterium
EHLPPGGTATLE

SEQ ID NO: 1159066 - protein, 7 aa, Mycobacterium
EHPADDL

SEQ ID NO: 1159067 - protein, 9 aa, Mycobacterium
EHPDAADEP

SEQ ID NO: 1159068 - protein, 7 aa, Mycobacterium
EHPDQRR

SEQ ID NO: 1159069 - protein, 8 aa, Mycobacterium
EHPDQRRE

SEQ ID NO: 1159070 - protein, 10 aa, Mycobacterium
EHPDQRREVY

SEQ ID NO: 1159071 - protein, 5 aa, Mycobacterium
EHPGD

SEQ ID NO: 1159072 - protein, 9 aa, Mycobacterium
EHPGGQKGF

SEQ ID NO: 1159073 - protein, 5 aa, Mycobacterium
EHPGY

SEQ ID NO: 1159074 - protein, 4 aa, Mycobacterium
EHPH

SEQ ID NO: 1159075 - protein, 12 aa, Mycobacterium
EHPRRDTTAEKL

SEQ ID NO: 1159076 - protein, 6 aa, Mycobacterium
EHPSSG

SEQ ID NO: 1159077 - protein, 7 aa, Mycobacterium
EHPTAGD

SEQ ID NO: 1159078 - protein, 7 aa, Mycobacterium
EHPTGAD

SEQ ID NO: 1159079 - protein, 14 aa, Mycobacterium
EHPTHENSVPGSVP

SEQ ID NO: 1159080 - protein, 7 aa, Mycobacterium
EHPYPTP

SEQ ID NO: 1159081 - protein, 7 aa, Mycobacterium
EHQDPEE

SEQ ID NO: 1159082 - protein, 14 aa, Mycobacterium
EHQPGERMTYSNST

SEQ ID NO: 1159083 - protein, 4 aa, Mycobacterium
EHRD

SEQ ID NO: 1159084 - protein, 7 aa, Mycobacterium
EHRDDTR

SEQ ID NO: 1159085 - protein, 9 aa, Mycobacterium
EHRDGHRVT

SEQ ID NO: 1159086 - protein, 8 aa, Mycobacterium
EHRDSSGV

SEQ ID NO: 1159087 - protein, 7 aa, Mycobacterium
EHRERRE

SEQ ID NO: 1159088 - protein, 5 aa, Mycobacterium
EHRGD

SEQ ID NO: 1159089 - protein, 6 aa, Mycobacterium
EHRSRD

SEQ ID NO: 1159090 - protein, 13 aa, Mycobacterium
EHRSTVSPYLVKQ

SEQ ID NO: 1159091 - protein, 13 aa, Mycobacterium
EHSHPGGGIPSYP

SEQ ID NO: 1159092 - protein, 6 aa, Mycobacterium
EHTGGP

SEQ ID NO: 1159093 - protein, 8 aa, Mycobacterium
EHTSRRPV

SEQ ID NO: 1159094 - protein, 7 aa, Mycobacterium
EHVQSRR

SEQ ID NO: 1159095 - protein, 6 aa, Mycobacterium
EHYPAD

SEQ ID NO: 1159096 - protein, 10 aa, Mycobacterium
EIAEATGRTA

SEQ ID NO: 1159097 - protein, 7 aa, Mycobacterium
EIAGAPA

SEQ ID NO: 1159098 - protein, 10 aa, Mycobacterium
EIAGGPGGPR

SEQ ID NO: 1159099 - protein, 5 aa, Mycobacterium
EIAPT

SEQ ID NO: 1159100 - protein, 11 aa, Mycobacterium
EIARDGDDATV

SEQ ID NO: 1159101 - protein, 12 aa, Mycobacterium
EIARGGDRRPRV

SEQ ID NO: 1159102 - protein, 10 aa, Mycobacterium
EIDAAKERAN

SEQ ID NO: 1159103 - protein, 10 aa, Mycobacterium
EIDESEEHQR

SEQ ID NO: 1159104 - protein, 12 aa, Mycobacterium
EIDRPDAHDEEA

SEQ ID NO: 1159105 - protein, 9 aa, Mycobacterium
EIEAAGGQA

SEQ ID NO: 1159106 - protein, 15 aa, Mycobacterium
EIEPSESVEADQQIP

SEQ ID NO: 1159107 - protein, 11 aa, Mycobacterium
EIESPESKQAQ

SEQ ID NO: 1159108 - protein, 5 aa, Mycobacterium
EIGAG

SEQ ID NO: 1159109 - protein, 13 aa, Mycobacterium
EIGASKKDGQRAK

SEQ ID NO: 1159110 - protein, 6 aa, Mycobacterium
EIGEEP

SEQ ID NO: 1159111 - protein, 6 aa, Mycobacterium
EIGEGR

SEQ ID NO: 1159112 - protein, 10 aa, Mycobacterium
EIGPSPAEAD

SEQ ID NO: 1159113 - protein, 11 aa, Mycobacterium
EIGRTQQGNNN

SEQ ID NO: 1159114 - protein, 6 aa, Mycobacterium
EIGSGS

SEQ ID NO: 1159115 - protein, 8 aa, Mycobacterium
EIGSQHGP

SEQ ID NO: 1159116 - protein, 5 aa, Mycobacterium
EIKAG

SEQ ID NO: 1159117 - protein, 6 aa, Mycobacterium
EIPDKG

SEQ ID NO: 1159118 - protein, 7 aa, Mycobacterium
EIPPGEL

SEQ ID NO: 1159119 - protein, 6 aa, Mycobacterium
EIPPGS

SEQ ID NO: 1159120 - protein, 16 aa, Mycobacterium
EIPSFTPPKDLQPGEY

SEQ ID NO: 1159121 - protein, 9 aa, Mycobacterium
EIRAGRTKT

SEQ ID NO: 1159122 - protein, 5 aa, Mycobacterium
EIRRR

SEQ ID NO: 1159123 - protein, 10 aa, Mycobacterium
EIRSNGHKGS

SEQ ID NO: 1159124 - protein, 7 aa, Mycobacterium
EISDDGF

SEQ ID NO: 1159125 - protein, 11 aa, Mycobacterium
EISEIGSKTTT

SEQ ID NO: 1159126 - protein, 7 aa, Mycobacterium
EISGGSD

SEQ ID NO: 1159127 - protein, 5 aa, Mycobacterium
EISPP

SEQ ID NO: 1159128 - protein, 7 aa, Mycobacterium
EISSTEL

SEQ ID NO: 1159129 - protein, 4 aa, Mycobacterium
EITQ

SEQ ID NO: 1159130 - protein, 10 aa, Mycobacterium
EITSSPGSRR

SEQ ID NO: 1159131 - protein, 5 aa, Mycobacterium
EITTR

SEQ ID NO: 1159132 - protein, 12 aa, Mycobacterium
EIYGGTKSAWDY

SEQ ID NO: 1159133 - protein, 12 aa, Mycobacterium
EKADAGDIEPGH

SEQ ID NO: 1159134 - protein, 5 aa, Mycobacterium
EKADR

SEQ ID NO: 1159135 - protein, 9 aa, Mycobacterium
EKAGLPADA

SEQ ID NO: 1159136 - protein, 15 aa, Mycobacterium
EKANGSGNISYEPKN

SEQ ID NO: 1159137 - protein, 24 aa, Mycobacterium
EKAPKDAADDAKAKLEAAGATVTV

SEQ ID NO: 1159138 - protein, 5 aa, Mycobacterium
EKAQS

SEQ ID NO: 1159139 - protein, 7 aa, Mycobacterium
EKARDLG

SEQ ID NO: 1159140 - protein, 8 aa, Mycobacterium
EKASEVAD

SEQ ID NO: 1159141 - protein, 10 aa, Mycobacterium
EKASGRDLSG

SEQ ID NO: 1159142 - protein, 14 aa, Mycobacterium
EKATDQLNRYPDNG

SEQ ID NO: 1159143 - protein, 13 aa, Mycobacterium
EKATGQRFSRSEG

SEQ ID NO: 1159144 - protein, 10 aa, Mycobacterium
EKATSSARRC

SEQ ID NO: 1159145 - protein, 11 aa, Mycobacterium
EKAYSQELQRA

SEQ ID NO: 1159146 - protein, 4 aa, Mycobacterium
EKDA

SEQ ID NO: 1159147 - protein, 7 aa, Mycobacterium
EKDGSAR

SEQ ID NO: 1159148 - protein, 8 aa, Mycobacterium
EKEAAPLR

SEQ ID NO: 1159149 - protein, 8 aa, Mycobacterium
EKEAGPKR

SEQ ID NO: 1159150 - protein, 14 aa, Mycobacterium
EKEEAERKNKLRGG

SEQ ID NO: 1159151 - protein, 16 aa, Mycobacterium
EKEQNGTTASKDTNGT

SEQ ID NO: 1159152 - protein, 7 aa, Mycobacterium
EKFARRG

SEQ ID NO: 1159153 - protein, 16 aa, Mycobacterium
EKGAGNRDGDGFDGAV

SEQ ID NO: 1159154 - protein, 5 aa, Mycobacterium
EKGNT

SEQ ID NO: 1159155 - protein, 8 aa, Mycobacterium
EKGQEPDL

SEQ ID NO: 1159156 - protein, 8 aa, Mycobacterium
EKGQKTRI

SEQ ID NO: 1159157 - protein, 9 aa, Mycobacterium
EKGRPGAPI

SEQ ID NO: 1159158 - protein, 5 aa, Mycobacterium
EKGTE

SEQ ID NO: 1159159 - protein, 6 aa, Mycobacterium
EKGVNA

SEQ ID NO: 1159160 - protein, 4 aa, Mycobacterium
EKGW

SEQ ID NO: 1159161 - protein, 6 aa, Mycobacterium
EKHGAG

SEQ ID NO: 1159162 - protein, 7 aa, Mycobacterium
EKIGSAA

SEQ ID NO: 1159163 - protein, 11 aa, Mycobacterium
EKLDDEPGSDL

SEQ ID NO: 1159164 - protein, 7 aa, Mycobacterium
EKLGADA

SEQ ID NO: 1159165 - protein, 9 aa, Mycobacterium
EKNDSWTLT

SEQ ID NO: 1159166 - protein, 9 aa, Mycobacterium
EKNTDADDD

SEQ ID NO: 1159167 - protein, 6 aa, Mycobacterium
EKPAYT

SEQ ID NO: 1159168 - protein, 12 aa, Mycobacterium
EKPGRDPRPAFS

SEQ ID NO: 1159169 - protein, 10 aa, Mycobacterium
EKPGSREGWD

SEQ ID NO: 1159170 - protein, 15 aa, Mycobacterium
EKPKAEDAPSPYAAA

SEQ ID NO: 1159171 - protein, 4 aa, Mycobacterium
EKPL

SEQ ID NO: 1159172 - protein, 11 aa, Mycobacterium
EKPNAFGTESR

SEQ ID NO: 1159173 - protein, 9 aa, Mycobacterium
EKPTDEEKS

SEQ ID NO: 1159174 - protein, 6 aa, Mycobacterium
EKPVKT

SEQ ID NO: 1159175 - protein, 11 aa, Mycobacterium
EKQKEGKKRMK

SEQ ID NO: 1159176 - protein, 7 aa, Mycobacterium
EKQPDTV

SEQ ID NO: 1159177 - protein, 8 aa, Mycobacterium
EKQRERVE

SEQ ID NO: 1159178 - protein, 8 aa, Mycobacterium
EKQTGLSL

SEQ ID NO: 1159179 - protein, 13 aa, Mycobacterium
EKRDPDWSAFPRY

SEQ ID NO: 1159180 - protein, 9 aa, Mycobacterium
EKRDQYPYQ

SEQ ID NO: 1159181 - protein, 12 aa, Mycobacterium
EKRESKSRPGEG

SEQ ID NO: 1159182 - protein, 16 aa, Mycobacterium
EKRQKSRQTRASRDAL

SEQ ID NO: 1159183 - protein, 5 aa, Mycobacterium
EKRRE

SEQ ID NO: 1159184 - protein, 9 aa, Mycobacterium
EKRSGDGGF

SEQ ID NO: 1159185 - protein, 7 aa, Mycobacterium
EKSDAGD

SEQ ID NO: 1159186 - protein, 14 aa, Mycobacterium
EKSGVPREKLTGTI

SEQ ID NO: 1159187 - protein, 8 aa, Mycobacterium
EKSHGKGS

SEQ ID NO: 1159188 - protein, 7 aa, Mycobacterium
EKSPLDD

SEQ ID NO: 1159189 - protein, 6 aa, Mycobacterium
EKSRTY

SEQ ID NO: 1159190 - protein, 7 aa, Mycobacterium
EKSSREV

SEQ ID NO: 1159191 - protein, 12 aa, Mycobacterium
EKSVEAQLDYLR

SEQ ID NO: 1159192 - protein, 19 aa, Mycobacterium
EKTAAEDSTAWSEGHPLSE

SEQ ID NO: 1159193 - protein, 7 aa, Mycobacterium
EKTAAKL

SEQ ID NO: 1159194 - protein, 5 aa, Mycobacterium
EKTDH

SEQ ID NO: 1159195 - protein, 8 aa, Mycobacterium
EKTGPFRN

SEQ ID NO: 1159196 - protein, 13 aa, Mycobacterium
EKTSGQPFSEDDE

SEQ ID NO: 1159197 - protein, 7 aa, Mycobacterium
EKTTYDL

SEQ ID NO: 1159198 - protein, 7 aa, Mycobacterium
EKVGGTA

SEQ ID NO: 1159199 - protein, 25 aa, Mycobacterium
EKVGRDAGELAGGGPIGVTATNDAD

SEQ ID NO: 1159200 - protein, 6 aa, Mycobacterium
EKVRQA

SEQ ID NO: 1159201 - protein, 4 aa, Mycobacterium
EKVT

SEQ ID NO: 1159202 - protein, 15 aa, Mycobacterium
EKVTRDEGAGKAADA

SEQ ID NO: 1159203 - protein, 7 aa, Mycobacterium
EKYGDDR

SEQ ID NO: 1159204 - protein, 11 aa, Mycobacterium
EKYGLTPQQYP

SEQ ID NO: 1159205 - protein, 7 aa, Mycobacterium
EKYYSTG

SEQ ID NO: 1159206 - protein, 7 aa, Mycobacterium
ELAAQRA

SEQ ID NO: 1159207 - protein, 12 aa, Mycobacterium
ELAARGDRLTDE

SEQ ID NO: 1159208 - protein, 9 aa, Mycobacterium
ELAATAGRP

SEQ ID NO: 1159209 - protein, 12 aa, Mycobacterium
ELADSGAIGTPN

SEQ ID NO: 1159210 - protein, 10 aa, Mycobacterium
ELADTSDGEL

SEQ ID NO: 1159211 - protein, 13 aa, Mycobacterium
ELAEKGEKLPVQQ

SEQ ID NO: 1159212 - protein, 5 aa, Mycobacterium
ELAGK

SEQ ID NO: 1159213 - protein, 9 aa, Mycobacterium
ELAGQAREF

SEQ ID NO: 1159214 - protein, 12 aa, Mycobacterium
ELANGGKGLVSG

SEQ ID NO: 1159215 - protein, 5 aa, Mycobacterium
ELAPQ

SEQ ID NO: 1159216 - protein, 9 aa, Mycobacterium
ELDADTARE

SEQ ID NO: 1159217 - protein, 7 aa, Mycobacterium
ELDDDGV

SEQ ID NO: 1159218 - protein, 9 aa, Mycobacterium
ELDDESAAE

SEQ ID NO: 1159219 - protein, 5 aa, Mycobacterium
ELDGS

SEQ ID NO: 1159220 - protein, 13 aa, Mycobacterium
ELDGSRQENLSRR

SEQ ID NO: 1159221 - protein, 8 aa, Mycobacterium
ELDGTGIG

SEQ ID NO: 1159222 - protein, 5 aa, Mycobacterium
ELDHS

SEQ ID NO: 1159223 - protein, 7 aa, Mycobacterium
ELDPDLR

SEQ ID NO: 1159224 - protein, 5 aa, Mycobacterium
ELDPQ

SEQ ID NO: 1159225 - protein, 5 aa, Mycobacterium
ELDRY

SEQ ID NO: 1159226 - protein, 4 aa, Mycobacterium
ELDS

SEQ ID NO: 1159227 - protein, 10 aa, Mycobacterium
ELEAGRTRTV

SEQ ID NO: 1159228 - protein, 8 aa, Mycobacterium
ELEEAGTL

SEQ ID NO: 1159229 - protein, 5 aa, Mycobacterium
ELEGE

SEQ ID NO: 1159230 - protein, 36 aa, Mycobacterium
ELESEINADEARRDSESDDPATAARGRARLRALGQI

SEQ ID NO: 1159231 - protein, 5 aa, Mycobacterium
ELGDA

SEQ ID NO: 1159232 - protein, 9 aa, Mycobacterium
ELGDDPKNL

SEQ ID NO: 1159233 - protein, 8 aa, Mycobacterium
ELGDGAAA

SEQ ID NO: 1159234 - protein, 5 aa, Mycobacterium
ELGDP

SEQ ID NO: 1159235 - protein, 6 aa, Mycobacterium
ELGEST

SEQ ID NO: 1159236 - protein, 12 aa, Mycobacterium
ELGGADAQAKYG

SEQ ID NO: 1159237 - protein, 17 aa, Mycobacterium
ELGGEAGLVGAAALAIA

SEQ ID NO: 1159238 - protein, 7 aa, Mycobacterium
ELGGRDA

SEQ ID NO: 1159239 - protein, 6 aa, Mycobacterium
ELGGRP

SEQ ID NO: 1159240 - protein, 6 aa, Mycobacterium
ELGGSK

SEQ ID NO: 1159241 - protein, 7 aa, Mycobacterium
ELGHTPA

SEQ ID NO: 1159242 - protein, 5 aa, Mycobacterium
ELGKA

SEQ ID NO: 1159243 - protein, 20 aa, Mycobacterium
ELGPPGKDAADTDSAAGHTT

SEQ ID NO: 1159244 - protein, 6 aa, Mycobacterium
ELGPRG

SEQ ID NO: 1159245 - protein, 12 aa, Mycobacterium
ELGPYGSSRTRY

SEQ ID NO: 1159246 - protein, 29 aa, Mycobacterium
ELGQRGSAAPVDSSANNDGGGFNQFNRGN

SEQ ID NO: 1159247 - protein, 12 aa, Mycobacterium
ELGQSKMSGSNI

SEQ ID NO: 1159248 - protein, 14 aa, Mycobacterium
ELGREKSPFAAAVC

SEQ ID NO: 1159249 - protein, 8 aa, Mycobacterium
ELGRSAAG

SEQ ID NO: 1159250 - protein, 10 aa, Mycobacterium
ELGRTQHGNN

SEQ ID NO: 1159251 - protein, 20 aa, Mycobacterium
ELGTGRGGPRCMSCPAARDP

SEQ ID NO: 1159252 - protein, 5 aa, Mycobacterium
ELGTS

SEQ ID NO: 1159253 - protein, 4 aa, Mycobacterium
ELPD

SEQ ID NO: 1159254 - protein, 15 aa, Mycobacterium
ELPDGEPDDPPEAET

SEQ ID NO: 1159255 - protein, 5 aa, Mycobacterium
ELPDP

SEQ ID NO: 1159256 - protein, 13 aa, Mycobacterium
ELPEASRTARGQH

SEQ ID NO: 1159257 - protein, 7 aa, Mycobacterium
ELPEPYA

SEQ ID NO: 1159258 - protein, 7 aa, Mycobacterium
ELPGDGE

SEQ ID NO: 1159259 - protein, 5 aa, Mycobacterium
ELPPA

SEQ ID NO: 1159260 - protein, 16 aa, Mycobacterium
ELPPAVNPARQKTWGQ

SEQ ID NO: 1159261 - protein, 17 aa, Mycobacterium
ELPPDEAASIPQAPTSL

SEQ ID NO: 1159262 - protein, 8 aa, Mycobacterium
ELPPGETG

SEQ ID NO: 1159263 - protein, 4 aa, Mycobacterium
ELPQ

SEQ ID NO: 1159264 - protein, 16 aa, Mycobacterium
ELPRNAPVEVEIVVEV

SEQ ID NO: 1159265 - protein, 7 aa, Mycobacterium
ELPTGAK

SEQ ID NO: 1159266 - protein, 9 aa, Mycobacterium
ELQEEAGLS

SEQ ID NO: 1159267 - protein, 5 aa, Mycobacterium
ELQPG

SEQ ID NO: 1159268 - protein, 9 aa, Mycobacterium
ELQRPKRGH

SEQ ID NO: 1159269 - protein, 17 aa, Mycobacterium
ELRDGNFGTAVQSTSPT

SEQ ID NO: 1159270 - protein, 11 aa, Mycobacterium
ELRSSGRPDDE

SEQ ID NO: 1159271 - protein, 9 aa, Mycobacterium
ELSAAQTRI

SEQ ID NO: 1159272 - protein, 8 aa, Mycobacterium
ELSDQGAT

SEQ ID NO: 1159273 - protein, 4 aa, Mycobacterium
ELSE

SEQ ID NO: 1159274 - protein, 14 aa, Mycobacterium
ELSETDDAGRPRQV

SEQ ID NO: 1159275 - protein, 11 aa, Mycobacterium
ELSGPPADGSV

SEQ ID NO: 1159276 - protein, 17 aa, Mycobacterium
ELSGQTALGRVGDPDDI

SEQ ID NO: 1159277 - protein, 6 aa, Mycobacterium
ELSGTD

SEQ ID NO: 1159278 - protein, 8 aa, Mycobacterium
ELSPPGSR

SEQ ID NO: 1159279 - protein, 7 aa, Mycobacterium
ELSRAGA

SEQ ID NO: 1159280 - protein, 17 aa, Mycobacterium
ELSRNGVTGKPSLATAE

SEQ ID NO: 1159281 - protein, 19 aa, Mycobacterium
ELSRSGIPGRAPLVPPGEQ

SEQ ID NO: 1159282 - protein, 4 aa, Mycobacterium
ELTD

SEQ ID NO: 1159283 - protein, 7 aa, Mycobacterium
ELTDGRG

SEQ ID NO: 1159284 - protein, 13 aa, Mycobacterium
ELTEAGPPAPLRE

SEQ ID NO: 1159285 - protein, 8 aa, Mycobacterium
ELTGAGPL

SEQ ID NO: 1159286 - protein, 15 aa, Mycobacterium
ELTGPVTGTKALPVD

SEQ ID NO: 1159287 - protein, 10 aa, Mycobacterium
ELTGRDEDRD

SEQ ID NO: 1159288 - protein, 10 aa, Mycobacterium
ELTPADGPSV

SEQ ID NO: 1159289 - protein, 6 aa, Mycobacterium
ELTPED

SEQ ID NO: 1159290 - protein, 9 aa, Mycobacterium
ELTPPGGVT

SEQ ID NO: 1159291 - protein, 8 aa, Mycobacterium
ELTPSGPD

SEQ ID NO: 1159292 - protein, 4 aa, Mycobacterium
ELTQ

SEQ ID NO: 1159293 - protein, 9 aa, Mycobacterium
ELTQDPATN

SEQ ID NO: 1159294 - protein, 5 aa, Mycobacterium
ELTRR

SEQ ID NO: 1159295 - protein, 9 aa, Mycobacterium
EMAGEGRRL

SEQ ID NO: 1159296 - protein, 4 aa, Mycobacterium
EMAT

SEQ ID NO: 1159297 - protein, 4 aa, Mycobacterium
EMDG

SEQ ID NO: 1159298 - protein, 7 aa, Mycobacterium
EMGDTTA

SEQ ID NO: 1159299 - protein, 6 aa, Mycobacterium
EMPPAP

SEQ ID NO: 1159300 - protein, 9 aa, Mycobacterium
EMRAQSEAE

SEQ ID NO: 1159301 - protein, 4 aa, Mycobacterium
EMRR

SEQ ID NO: 1159302 - protein, 8 aa, Mycobacterium
EMSEEARV

SEQ ID NO: 1159303 - protein, 5 aa, Mycobacterium
EMSSY

SEQ ID NO: 1159304 - protein, 6 aa, Mycobacterium
EMTRAR

SEQ ID NO: 1159305 - protein, 8 aa, Mycobacterium
ENAANLGG

SEQ ID NO: 1159306 - protein, 6 aa, Mycobacterium
ENADAV

SEQ ID NO: 1159307 - protein, 5 aa, Mycobacterium
ENAEN

SEQ ID NO: 1159308 - protein, 23 aa, Mycobacterium
ENAGGDLKHGGKSTEKGAAKAAK

SEQ ID NO: 1159309 - protein, 6 aa, Mycobacterium
ENAGQC

SEQ ID NO: 1159310 - protein, 11 aa, Mycobacterium
ENAPSTAGDGG

SEQ ID NO: 1159311 - protein, 6 aa, Mycobacterium
ENATSE

SEQ ID NO: 1159312 - protein, 36 aa, Mycobacterium
ENAVGGSKKPAGESTKKESADTSSKKKESASSSSAS

SEQ ID NO: 1159313 - protein, 9 aa, Mycobacterium
ENAVGTNAI

SEQ ID NO: 1159314 - protein, 9 aa, Mycobacterium
ENAYTEAQT

SEQ ID NO: 1159315 - protein, 4 aa, Mycobacterium
ENDK

SEQ ID NO: 1159316 - protein, 8 aa, Mycobacterium
ENDRVSTD

SEQ ID NO: 1159317 - protein, 7 aa, Mycobacterium
ENEAGGP

SEQ ID NO: 1159318 - protein, 10 aa, Mycobacterium
ENEARARGHR

SEQ ID NO: 1159319 - protein, 14 aa, Mycobacterium
ENEDLPNTTNPDDW

SEQ ID NO: 1159320 - protein, 12 aa, Mycobacterium
ENERDRDRARER

SEQ ID NO: 1159321 - protein, 8 aa, Mycobacterium
ENEYSSET

SEQ ID NO: 1159322 - protein, 15 aa, Mycobacterium
ENGAPVRRSAGAEAA

SEQ ID NO: 1159323 - protein, 8 aa, Mycobacterium
ENGATVRG

SEQ ID NO: 1159324 - protein, 13 aa, Mycobacterium
ENGNSAAHSNVDE

SEQ ID NO: 1159325 - protein, 7 aa, Mycobacterium
ENGREKF

SEQ ID NO: 1159326 - protein, 8 aa, Mycobacterium
ENGVDPTP

SEQ ID NO: 1159327 - protein, 9 aa, Mycobacterium
ENHEKPPQA

SEQ ID NO: 1159328 - protein, 6 aa, Mycobacterium
ENKEFG

SEQ ID NO: 1159329 - protein, 9 aa, Mycobacterium
ENKINAEAV

SEQ ID NO: 1159330 - protein, 22 aa, Mycobacterium
ENKQPTSERAPVSKDQGLRDTT

SEQ ID NO: 1159331 - protein, 15 aa, Mycobacterium
ENLPAHGEAVRRRFE

SEQ ID NO: 1159332 - protein, 5 aa, Mycobacterium
ENPAL

SEQ ID NO: 1159333 - protein, 6 aa, Mycobacterium
ENPAQR

SEQ ID NO: 1159334 - protein, 7 aa, Mycobacterium
ENPDDLD

SEQ ID NO: 1159335 - protein, 27 aa, Mycobacterium
ENPDYEPAASTSIAARAAARGVSPLEE

SEQ ID NO: 1159336 - protein, 7 aa, Mycobacterium
ENPLHPA

SEQ ID NO: 1159337 - protein, 6 aa, Mycobacterium
ENPRRA

SEQ ID NO: 1159338 - protein, 5 aa, Mycobacterium
ENPRS

SEQ ID NO: 1159339 - protein, 9 aa, Mycobacterium
ENPSGRDTA

SEQ ID NO: 1159340 - protein, 7 aa, Mycobacterium
ENPSTGM

SEQ ID NO: 1159341 - protein, 8 aa, Mycobacterium
ENPSTLGY

SEQ ID NO: 1159342 - protein, 6 aa, Mycobacterium
ENQERI

SEQ ID NO: 1159343 - protein, 6 aa, Mycobacterium
ENQKRH

SEQ ID NO: 1159344 - protein, 5 aa, Mycobacterium
ENQPA

SEQ ID NO: 1159345 - protein, 6 aa, Mycobacterium
ENQRAH

SEQ ID NO: 1159346 - protein, 4 aa, Mycobacterium
ENRA

SEQ ID NO: 1159347 - protein, 5 aa, Mycobacterium
ENREA

SEQ ID NO: 1159348 - protein, 8 aa, Mycobacterium
ENRRNGSW

SEQ ID NO: 1159349 - protein, 13 aa, Mycobacterium
ENRSAKGKVVIAV

SEQ ID NO: 1159350 - protein, 7 aa, Mycobacterium
ENSATAA

SEQ ID NO: 1159351 - protein, 8 aa, Mycobacterium
ENSDCSAD

SEQ ID NO: 1159352 - protein, 10 aa, Mycobacterium
ENSGGRSADE

SEQ ID NO: 1159353 - protein, 6 aa, Mycobacterium
ENSGTV

SEQ ID NO: 1159354 - protein, 6 aa, Mycobacterium
ENSYSG

SEQ ID NO: 1159355 - protein, 8 aa, Mycobacterium
ENTGASFN

SEQ ID NO: 1159356 - protein, 6 aa, Mycobacterium
ENTGEA

SEQ ID NO: 1159357 - protein, 5 aa, Mycobacterium
ENTRG

SEQ ID NO: 1159358 - protein, 4 aa, Mycobacterium
ENTS

SEQ ID NO: 1159359 - protein, 4 aa, Mycobacterium
ENVP

SEQ ID NO: 1159360 - protein, 10 aa, Mycobacterium
ENVSTRAGSI

SEQ ID NO: 1159361 - protein, 7 aa, Mycobacterium
ENVTDEP

SEQ ID NO: 1159362 - protein, 16 aa, Mycobacterium
EPAAGGGTCLSWTAPL

SEQ ID NO: 1159363 - protein, 18 aa, Mycobacterium
EPAAPPPPAVEAGPDTSL

SEQ ID NO: 1159364 - protein, 14 aa, Mycobacterium
EPAAQESTPAVTRA

SEQ ID NO: 1159365 - protein, 11 aa, Mycobacterium
EPAARSRAQLT

SEQ ID NO: 1159366 - protein, 11 aa, Mycobacterium
EPAATAEEIEA

SEQ ID NO: 1159367 - protein, 13 aa, Mycobacterium
EPADASDLQARAD

SEQ ID NO: 1159368 - protein, 126 aa, Mycobacterium
EPADEDDDEDEDDDVAASADSEDDDEDDQSERPAARRRRRGRRGRGRGRGEQSDDNGEPDAAEGTETKTDGQADSDQDTGDDSDEDGDEDTSGGDGSSRRRRRRRRRKSGASDDSDNGSPDDPPNT

SEQ ID NO: 1159369 - protein, 7 aa, Mycobacterium
EPADGLS

SEQ ID NO: 1159370 - protein, 4 aa, Mycobacterium
EPAE

SEQ ID NO: 1159371 - protein, 6 aa, Mycobacterium
EPAGAA

SEQ ID NO: 1159372 - protein, 9 aa, Mycobacterium
EPAGALRPA

SEQ ID NO: 1159373 - protein, 9 aa, Mycobacterium
EPAGDGRTI

SEQ ID NO: 1159374 - protein, 6 aa, Mycobacterium
EPAGPI

SEQ ID NO: 1159375 - protein, 13 aa, Mycobacterium
EPAGSSARYETRI

SEQ ID NO: 1159376 - protein, 7 aa, Mycobacterium
EPAGTPR

SEQ ID NO: 1159377 - protein, 8 aa, Mycobacterium
EPAKTPAL

SEQ ID NO: 1159378 - protein, 4 aa, Mycobacterium
EPAP

SEQ ID NO: 1159379 - protein, 8 aa, Mycobacterium
EPAPDTFP

SEQ ID NO: 1159380 - protein, 8 aa, Mycobacterium
EPAPPQHV

SEQ ID NO: 1159381 - protein, 12 aa, Mycobacterium
EPAPPSAPGSQV

SEQ ID NO: 1159382 - protein, 6 aa, Mycobacterium
EPAPPW

SEQ ID NO: 1159383 - protein, 8 aa, Mycobacterium
EPARADEL

SEQ ID NO: 1159384 - protein, 7 aa, Mycobacterium
EPAREAP

SEQ ID NO: 1159385 - protein, 13 aa, Mycobacterium
EPARGQPVPGSEE

SEQ ID NO: 1159386 - protein, 20 aa, Mycobacterium
EPARPAPVADPPPPEDDEES

SEQ ID NO: 1159387 - protein, 4 aa, Mycobacterium
EPAV

SEQ ID NO: 1159388 - protein, 8 aa, Mycobacterium
EPAWDPDH

SEQ ID NO: 1159389 - protein, 11 aa, Mycobacterium
EPDADTDGDGV

SEQ ID NO: 1159390 - protein, 7 aa, Mycobacterium
EPDAEPV

SEQ ID NO: 1159391 - protein, 22 aa, Mycobacterium
EPDAGSDVGAGRTRAVPNDDGT

SEQ ID NO: 1159392 - protein, 20 aa, Mycobacterium
EPDAGSNSHKITTTARRDGG

SEQ ID NO: 1159393 - protein, 21 aa, Mycobacterium
EPDAGSNSHNISTTAKRDGDD

SEQ ID NO: 1159394 - protein, 29 aa, Mycobacterium
EPDGPAPDWYSKSGDLGELGEKTGIDADG

SEQ ID NO: 1159395 - protein, 11 aa, Mycobacterium
EPDGRRTTTTY

SEQ ID NO: 1159396 - protein, 5 aa, Mycobacterium
EPDKG

SEQ ID NO: 1159397 - protein, 8 aa, Mycobacterium
EPDPATLD

SEQ ID NO: 1159398 - protein, 10 aa, Mycobacterium
EPDPETAPTV

SEQ ID NO: 1159399 - protein, 7 aa, Mycobacterium
EPDPGDF

SEQ ID NO: 1159400 - protein, 12 aa, Mycobacterium
EPDPSGVPAGDA

SEQ ID NO: 1159401 - protein, 7 aa, Mycobacterium
EPDRDTW

SEQ ID NO: 1159402 - protein, 12 aa, Mycobacterium
EPDRGPKARYKG

SEQ ID NO: 1159403 - protein, 10 aa, Mycobacterium
EPDSPRRMPS

SEQ ID NO: 1159404 - protein, 6 aa, Mycobacterium
EPEASV

SEQ ID NO: 1159405 - protein, 6 aa, Mycobacterium
EPEATL

SEQ ID NO: 1159406 - protein, 6 aa, Mycobacterium
EPEDES

SEQ ID NO: 1159407 - protein, 5 aa, Mycobacterium
EPEER

SEQ ID NO: 1159408 - protein, 6 aa, Mycobacterium
EPEFAG

SEQ ID NO: 1159409 - protein, 5 aa, Mycobacterium
EPEGL

SEQ ID NO: 1159410 - protein, 14 aa, Mycobacterium
EPEPWAGRPEFYEA

SEQ ID NO: 1159411 - protein, 5 aa, Mycobacterium
EPERR

SEQ ID NO: 1159412 - protein, 19 aa, Mycobacterium
EPEVEHDDDGTDWSRERDV

SEQ ID NO: 1159413 - protein, 6 aa, Mycobacterium
EPEVTP

SEQ ID NO: 1159414 - protein, 4 aa, Mycobacterium
EPEY

SEQ ID NO: 1159415 - protein, 18 aa, Mycobacterium
EPFTGGDPIDEEDTAPRQ

SEQ ID NO: 1159416 - protein, 9 aa, Mycobacterium
EPGAADDGI

SEQ ID NO: 1159417 - protein, 21 aa, Mycobacterium
EPGAGSDAAAVRTAAKRVDGG

SEQ ID NO: 1159418 - protein, 19 aa, Mycobacterium
EPGAGSDASALRTKAVREG

SEQ ID NO: 1159419 - protein, 22 aa, Mycobacterium
EPGAGSDLASLTTKATKVDGGW

SEQ ID NO: 1159420 - protein, 9 aa, Mycobacterium
EPGAVTPTT

SEQ ID NO: 1159421 - protein, 8 aa, Mycobacterium
EPGDAGPR

SEQ ID NO: 1159422 - protein, 8 aa, Mycobacterium
EPGEDPAR

SEQ ID NO: 1159423 - protein, 9 aa, Mycobacterium
EPGEEPKAG

SEQ ID NO: 1159424 - protein, 5 aa, Mycobacterium
EPGEP

SEQ ID NO: 1159425 - protein, 5 aa, Mycobacterium
EPGET

SEQ ID NO: 1159426 - protein, 19 aa, Mycobacterium
EPGFGSDSAAVSTTARLEG

SEQ ID NO: 1159427 - protein, 5 aa, Mycobacterium
EPGIA

SEQ ID NO: 1159428 - protein, 5 aa, Mycobacterium
EPGIR

SEQ ID NO: 1159429 - protein, 12 aa, Mycobacterium
EPGMGAAAAERQ

SEQ ID NO: 1159430 - protein, 22 aa, Mycobacterium
EPGMRGAGAKLSTTAAQQGDSW

SEQ ID NO: 1159431 - protein, 6 aa, Mycobacterium
EPGPRA

SEQ ID NO: 1159432 - protein, 6 aa, Mycobacterium
EPGQRY

SEQ ID NO: 1159433 - protein, 10 aa, Mycobacterium
EPGRTNTKRR

SEQ ID NO: 1159434 - protein, 7 aa, Mycobacterium
EPGSPEL

SEQ ID NO: 1159435 - protein, 7 aa, Mycobacterium
EPGTDKE

SEQ ID NO: 1159436 - protein, 6 aa, Mycobacterium
EPGTEG

SEQ ID NO: 1159437 - protein, 5 aa, Mycobacterium
EPGVA

SEQ ID NO: 1159438 - protein, 10 aa, Mycobacterium
EPHAGADPTL

SEQ ID NO: 1159439 - protein, 10 aa, Mycobacterium
EPHGGADPKV

SEQ ID NO: 1159440 - protein, 15 aa, Mycobacterium
EPHPDGGWQRARQDR

SEQ ID NO: 1159441 - protein, 6 aa, Mycobacterium
EPHPDS

SEQ ID NO: 1159442 - protein, 8 aa, Mycobacterium
EPHPTDGE

SEQ ID NO: 1159443 - protein, 5 aa, Mycobacterium
EPIGE

SEQ ID NO: 1159444 - protein, 4 aa, Mycobacterium
EPIP

SEQ ID NO: 1159445 - protein, 5 aa, Mycobacterium
EPIPD

SEQ ID NO: 1159446 - protein, 8 aa, Mycobacterium
EPIPGNDA

SEQ ID NO: 1159447 - protein, 6 aa, Mycobacterium
EPISAA

SEQ ID NO: 1159448 - protein, 8 aa, Mycobacterium
EPITPDEL

SEQ ID NO: 1159449 - protein, 4 aa, Mycobacterium
EPKN

SEQ ID NO: 1159450 - protein, 8 aa, Mycobacterium
EPKPDRAW

SEQ ID NO: 1159451 - protein, 8 aa, Mycobacterium
EPKPVQKP

SEQ ID NO: 1159452 - protein, 7 aa, Mycobacterium
EPKTTVT

SEQ ID NO: 1159453 - protein, 4 aa, Mycobacterium
EPKV

SEQ ID NO: 1159454 - protein, 5 aa, Mycobacterium
EPLGT

SEQ ID NO: 1159455 - protein, 8 aa, Mycobacterium
EPLPADDP

SEQ ID NO: 1159456 - protein, 5 aa, Mycobacterium
EPLPD

SEQ ID NO: 1159457 - protein, 10 aa, Mycobacterium
EPLPKPDTPL

SEQ ID NO: 1159458 - protein, 7 aa, Mycobacterium
EPLPSGR

SEQ ID NO: 1159459 - protein, 7 aa, Mycobacterium
EPLPVTP

SEQ ID NO: 1159460 - protein, 6 aa, Mycobacterium
EPLTEE

SEQ ID NO: 1159461 - protein, 6 aa, Mycobacterium
EPLTPA

SEQ ID NO: 1159462 - protein, 5 aa, Mycobacterium
EPLVS

SEQ ID NO: 1159463 - protein, 6 aa, Mycobacterium
EPMPDD

SEQ ID NO: 1159464 - protein, 14 aa, Mycobacterium
EPMPENAAAKVRAA

SEQ ID NO: 1159465 - protein, 7 aa, Mycobacterium
EPNAGYP

SEQ ID NO: 1159466 - protein, 4 aa, Mycobacterium
EPNG

SEQ ID NO: 1159467 - protein, 5 aa, Mycobacterium
EPNKY

SEQ ID NO: 1159468 - protein, 13 aa, Mycobacterium
EPNPGWTRTYSGS

SEQ ID NO: 1159469 - protein, 5 aa, Mycobacterium
EPNRV

SEQ ID NO: 1159470 - protein, 37 aa, Mycobacterium
EPNSPAPNGGPTGDFASSGEHFQAEGNTGMPASGDLP

SEQ ID NO: 1159471 - protein, 5 aa, Mycobacterium
EPNVG

SEQ ID NO: 1159472 - protein, 6 aa, Mycobacterium
EPPAAV

SEQ ID NO: 1159473 - protein, 9 aa, Mycobacterium
EPPAGPALG

SEQ ID NO: 1159474 - protein, 19 aa, Mycobacterium
EPPAPAGLGDDPDRRAAGS

SEQ ID NO: 1159475 - protein, 5 aa, Mycobacterium
EPPAT

SEQ ID NO: 1159476 - protein, 13 aa, Mycobacterium
EPPGGKVSTTAST

SEQ ID NO: 1159477 - protein, 29 aa, Mycobacterium
EPPPEKRRERPVRDESGPRKARDRTRSDL

SEQ ID NO: 1159478 - protein, 7 aa, Mycobacterium
EPPRKKA

SEQ ID NO: 1159479 - protein, 7 aa, Mycobacterium
EPPRPGY

SEQ ID NO: 1159480 - protein, 7 aa, Mycobacterium
EPPRQPL

SEQ ID NO: 1159481 - protein, 10 aa, Mycobacterium
EPPTTPADTT

SEQ ID NO: 1159482 - protein, 5 aa, Mycobacterium
EPPVG

SEQ ID NO: 1159483 - protein, 8 aa, Mycobacterium
EPQERGNS

SEQ ID NO: 1159484 - protein, 6 aa, Mycobacterium
EPQHFT

SEQ ID NO: 1159485 - protein, 9 aa, Mycobacterium
EPQHGTPPQ

SEQ ID NO: 1159486 - protein, 17 aa, Mycobacterium
EPQPPEEASFPPAVTPA

SEQ ID NO: 1159487 - protein, 8 aa, Mycobacterium
EPQRNPEL

SEQ ID NO: 1159488 - protein, 4 aa, Mycobacterium
EPQT

SEQ ID NO: 1159489 - protein, 7 aa, Mycobacterium
EPQTPRR

SEQ ID NO: 1159490 - protein, 11 aa, Mycobacterium
EPRAIDDPKDH

SEQ ID NO: 1159491 - protein, 12 aa, Mycobacterium
EPRGGYGDAYRT

SEQ ID NO: 1159492 - protein, 9 aa, Mycobacterium
EPRKGDNAP

SEQ ID NO: 1159493 - protein, 21 aa, Mycobacterium
EPRPAPEPDKDADGDPTPVPV

SEQ ID NO: 1159494 - protein, 7 aa, Mycobacterium
EPRPISS

SEQ ID NO: 1159495 - protein, 9 aa, Mycobacterium
EPRRGTSNS

SEQ ID NO: 1159496 - protein, 7 aa, Mycobacterium
EPRSLTE

SEQ ID NO: 1159497 - protein, 5 aa, Mycobacterium
EPRYA

SEQ ID NO: 1159498 - protein, 6 aa, Mycobacterium
EPRYPT

SEQ ID NO: 1159499 - protein, 20 aa, Mycobacterium
EPSAGSDLASLTTRATRVDG

SEQ ID NO: 1159500 - protein, 10 aa, Mycobacterium
EPSDDELIPT

SEQ ID NO: 1159501 - protein, 19 aa, Mycobacterium
EPSDTELVESPAPEPADGE

SEQ ID NO: 1159502 - protein, 8 aa, Mycobacterium
EPSEAGQV

SEQ ID NO: 1159503 - protein, 5 aa, Mycobacterium
EPSEV

SEQ ID NO: 1159504 - protein, 8 aa, Mycobacterium
EPSPPQAR

SEQ ID NO: 1159505 - protein, 6 aa, Mycobacterium
EPSRAR

SEQ ID NO: 1159506 - protein, 8 aa, Mycobacterium
EPSRPERL

SEQ ID NO: 1159507 - protein, 10 aa, Mycobacterium
EPTASAPFTD

SEQ ID NO: 1159508 - protein, 8 aa, Mycobacterium
EPTATGTR

SEQ ID NO: 1159509 - protein, 13 aa, Mycobacterium
EPTDQETRSTHTP

SEQ ID NO: 1159510 - protein, 23 aa, Mycobacterium
EPTEDTRAVERIPNDRRPTDDEI

SEQ ID NO: 1159511 - protein, 9 aa, Mycobacterium
EPTERRGLR

SEQ ID NO: 1159512 - protein, 7 aa, Mycobacterium
EPTESNP

SEQ ID NO: 1159513 - protein, 13 aa, Mycobacterium
EPTGAATGHLGTE

SEQ ID NO: 1159514 - protein, 5 aa, Mycobacterium
EPTGG

SEQ ID NO: 1159515 - protein, 8 aa, Mycobacterium
EPTPAQAQ

SEQ ID NO: 1159516 - protein, 7 aa, Mycobacterium
EPTPAYD

SEQ ID NO: 1159517 - protein, 6 aa, Mycobacterium
EPTPPH

SEQ ID NO: 1159518 - protein, 7 aa, Mycobacterium
EPTRTAV

SEQ ID NO: 1159519 - protein, 6 aa, Mycobacterium
EPTSAL

SEQ ID NO: 1159520 - protein, 5 aa, Mycobacterium
EPTSG

SEQ ID NO: 1159521 - protein, 4 aa, Mycobacterium
EPTT

SEQ ID NO: 1159522 - protein, 12 aa, Mycobacterium
EPTTRRGEFDDG

SEQ ID NO: 1159523 - protein, 14 aa, Mycobacterium
EPTYTDGDGDRNKV

SEQ ID NO: 1159524 - protein, 8 aa, Mycobacterium
EPVAETDR

SEQ ID NO: 1159525 - protein, 6 aa, Mycobacterium
EPVAPD

SEQ ID NO: 1159526 - protein, 4 aa, Mycobacterium
EPVD

SEQ ID NO: 1159527 - protein, 6 aa, Mycobacterium
EPVDAA

SEQ ID NO: 1159528 - protein, 9 aa, Mycobacterium
EPVFGEDDE

SEQ ID NO: 1159529 - protein, 5 aa, Mycobacterium
EPVGD

SEQ ID NO: 1159530 - protein, 9 aa, Mycobacterium
EPVGDSRSL

SEQ ID NO: 1159531 - protein, 37 aa, Mycobacterium
EPVHDRPSQPTPGAVSADDDANGDHADAVRDERMLPG

SEQ ID NO: 1159532 - protein, 4 aa, Mycobacterium
EPVP

SEQ ID NO: 1159533 - protein, 5 aa, Mycobacterium
EPVST

SEQ ID NO: 1159534 - protein, 41 aa, Mycobacterium
EPVTDAAATLSGLTGRPARTVAGEPAAAARGAQTTPGLPPG

SEQ ID NO: 1159535 - protein, 21 aa, Mycobacterium
EPWTTGPGLPWPGRPAPLHPN

SEQ ID NO: 1159536 - protein, 6 aa, Mycobacterium
EPYATR

SEQ ID NO: 1159537 - protein, 19 aa, Mycobacterium
EPYRDGGAGAEVSWLSRGV

SEQ ID NO: 1159538 - protein, 7 aa, Mycobacterium
EQADTEP

SEQ ID NO: 1159539 - protein, 7 aa, Mycobacterium
EQAGERL

SEQ ID NO: 1159540 - protein, 10 aa, Mycobacterium
EQAKERGEQV

SEQ ID NO: 1159541 - protein, 11 aa, Mycobacterium
EQAPAESRPAL

SEQ ID NO: 1159542 - protein, 7 aa, Mycobacterium
EQAQAAR

SEQ ID NO: 1159543 - protein, 12 aa, Mycobacterium
EQATAGGTARYV

SEQ ID NO: 1159544 - protein, 7 aa, Mycobacterium
EQATNRR

SEQ ID NO: 1159545 - protein, 7 aa, Mycobacterium
EQAVNDG

SEQ ID NO: 1159546 - protein, 11 aa, Mycobacterium
EQAYRDGTAPL

SEQ ID NO: 1159547 - protein, 6 aa, Mycobacterium
EQCGGT

SEQ ID NO: 1159548 - protein, 5 aa, Mycobacterium
EQCGP

SEQ ID NO: 1159549 - protein, 5 aa, Mycobacterium
EQDAV

SEQ ID NO: 1159550 - protein, 7 aa, Mycobacterium
EQDDAEA

SEQ ID NO: 1159551 - protein, 19 aa, Mycobacterium
EQDEGKTEELAYTPDKTTV

SEQ ID NO: 1159552 - protein, 7 aa, Mycobacterium
EQDERSE

SEQ ID NO: 1159553 - protein, 9 aa, Mycobacterium
EQDGNPQLA

SEQ ID NO: 1159554 - protein, 7 aa, Mycobacterium
EQDHPGP

SEQ ID NO: 1159555 - protein, 12 aa, Mycobacterium
EQDIAGSQARDF

SEQ ID NO: 1159556 - protein, 9 aa, Mycobacterium
EQDYPDAEE

SEQ ID NO: 1159557 - protein, 6 aa, Mycobacterium
EQEARR

SEQ ID NO: 1159558 - protein, 8 aa, Mycobacterium
EQEATADE

SEQ ID NO: 1159559 - protein, 8 aa, Mycobacterium
EQEPKTGE

SEQ ID NO: 1159560 - protein, 7 aa, Mycobacterium
EQESKPE

SEQ ID NO: 1159561 - protein, 4 aa, Mycobacterium
EQGF

SEQ ID NO: 1159562 - protein, 5 aa, Mycobacterium
EQGGL

SEQ ID NO: 1159563 - protein, 7 aa, Mycobacterium
EQGGWTD

SEQ ID NO: 1159564 - protein, 10 aa, Mycobacterium
EQGHDDPATR

SEQ ID NO: 1159565 - protein, 4 aa, Mycobacterium
EQGI

SEQ ID NO: 1159566 - protein, 4 aa, Mycobacterium
EQGL

SEQ ID NO: 1159567 - protein, 9 aa, Mycobacterium
EQGQSVNAS

SEQ ID NO: 1159568 - protein, 7 aa, Mycobacterium
EQHARTR

SEQ ID NO: 1159569 - protein, 14 aa, Mycobacterium
EQHHSSAHPGPDRY

SEQ ID NO: 1159570 - protein, 6 aa, Mycobacterium
EQHNRT

SEQ ID NO: 1159571 - protein, 12 aa, Mycobacterium
EQIDTSNPDAAR

SEQ ID NO: 1159572 - protein, 9 aa, Mycobacterium
EQIEQAPDS

SEQ ID NO: 1159573 - protein, 6 aa, Mycobacterium
EQIGDG

SEQ ID NO: 1159574 - protein, 6 aa, Mycobacterium
EQKAGV

SEQ ID NO: 1159575 - protein, 7 aa, Mycobacterium
EQKDRIT

SEQ ID NO: 1159576 - protein, 9 aa, Mycobacterium
EQKQRGREQ

SEQ ID NO: 1159577 - protein, 10 aa, Mycobacterium
EQLGQGKENA

SEQ ID NO: 1159578 - protein, 7 aa, Mycobacterium
EQLGSEP

SEQ ID NO: 1159579 - protein, 11 aa, Mycobacterium
EQLSRDPRPYP

SEQ ID NO: 1159580 - protein, 10 aa, Mycobacterium
EQLTGDEAHE

SEQ ID NO: 1159581 - protein, 7 aa, Mycobacterium
EQNPGVT

SEQ ID NO: 1159582 - protein, 6 aa, Mycobacterium
EQNPQT

SEQ ID NO: 1159583 - protein, 6 aa, Mycobacterium
EQPDLN

SEQ ID NO: 1159584 - protein, 7 aa, Mycobacterium
EQPDSGV

SEQ ID NO: 1159585 - protein, 8 aa, Mycobacterium
EQPEGYDV

SEQ ID NO: 1159586 - protein, 6 aa, Mycobacterium
EQPELP

SEQ ID NO: 1159587 - protein, 6 aa, Mycobacterium
EQPEQT

SEQ ID NO: 1159588 - protein, 5 aa, Mycobacterium
EQPGI

SEQ ID NO: 1159589 - protein, 8 aa, Mycobacterium
EQPRTGRT

SEQ ID NO: 1159590 - protein, 10 aa, Mycobacterium
EQPWEPKTER

SEQ ID NO: 1159591 - protein, 4 aa, Mycobacterium
EQRA

SEQ ID NO: 1159592 - protein, 9 aa, Mycobacterium
EQRAGRYRQ

SEQ ID NO: 1159593 - protein, 10 aa, Mycobacterium
EQRDDPALRG

SEQ ID NO: 1159594 - protein, 14 aa, Mycobacterium
EQREAEGGSKVPED

SEQ ID NO: 1159595 - protein, 8 aa, Mycobacterium
EQRGDAEV

SEQ ID NO: 1159596 - protein, 7 aa, Mycobacterium
EQRGGRY

SEQ ID NO: 1159597 - protein, 6 aa, Mycobacterium
EQRHAN

SEQ ID NO: 1159598 - protein, 11 aa, Mycobacterium
EQRPRTDQGLP

SEQ ID NO: 1159599 - protein, 6 aa, Mycobacterium
EQRREH

SEQ ID NO: 1159600 - protein, 4 aa, Mycobacterium
EQRS

SEQ ID NO: 1159601 - protein, 6 aa, Mycobacterium
EQRSRN

SEQ ID NO: 1159602 - protein, 6 aa, Mycobacterium
EQSESA

SEQ ID NO: 1159603 - protein, 8 aa, Mycobacterium
EQSGPKDL

SEQ ID NO: 1159604 - protein, 6 aa, Mycobacterium
EQSISE

SEQ ID NO: 1159605 - protein, 5 aa, Mycobacterium
EQSRT

SEQ ID NO: 1159606 - protein, 9 aa, Mycobacterium
EQTGIPVER

SEQ ID NO: 1159607 - protein, 13 aa, Mycobacterium
EQTPATSLETRGS

SEQ ID NO: 1159608 - protein, 5 aa, Mycobacterium
EQTRA

SEQ ID NO: 1159609 - protein, 4 aa, Mycobacterium
EQTT

SEQ ID NO: 1159610 - protein, 5 aa, Mycobacterium
EQTTA

SEQ ID NO: 1159611 - protein, 8 aa, Mycobacterium
EQVAENTS

SEQ ID NO: 1159612 - protein, 7 aa, Mycobacterium
EQVPAEE

SEQ ID NO: 1159613 - protein, 7 aa, Mycobacterium
EQWPDDV

SEQ ID NO: 1159614 - protein, 9 aa, Mycobacterium
ERAAAADHP

SEQ ID NO: 1159615 - protein, 5 aa, Mycobacterium
ERAAT

SEQ ID NO: 1159616 - protein, 11 aa, Mycobacterium
ERAATGSDDHY

SEQ ID NO: 1159617 - protein, 14 aa, Mycobacterium
ERAATRGDGRVGED

SEQ ID NO: 1159618 - protein, 5 aa, Mycobacterium
ERADE

SEQ ID NO: 1159619 - protein, 10 aa, Mycobacterium
ERAEFESENR

SEQ ID NO: 1159620 - protein, 11 aa, Mycobacterium
ERAEPDADRLG

SEQ ID NO: 1159621 - protein, 5 aa, Mycobacterium
ERAEQ

SEQ ID NO: 1159622 - protein, 5 aa, Mycobacterium
ERAEY

SEQ ID NO: 1159623 - protein, 5 aa, Mycobacterium
ERAGA

SEQ ID NO: 1159624 - protein, 12 aa, Mycobacterium
ERAGEKRASGKV

SEQ ID NO: 1159625 - protein, 5 aa, Mycobacterium
ERAGG

SEQ ID NO: 1159626 - protein, 6 aa, Mycobacterium
ERAGGG

SEQ ID NO: 1159627 - protein, 9 aa, Mycobacterium
ERAGVGKST

SEQ ID NO: 1159628 - protein, 5 aa, Mycobacterium
ERAHN

SEQ ID NO: 1159629 - protein, 10 aa, Mycobacterium
ERAKSASSVT

SEQ ID NO: 1159630 - protein, 4 aa, Mycobacterium
ERAN

SEQ ID NO: 1159631 - protein, 7 aa, Mycobacterium
ERAPRNH

SEQ ID NO: 1159632 - protein, 13 aa, Mycobacterium
ERARGKSTRSADY

SEQ ID NO: 1159633 - protein, 16 aa, Mycobacterium
ERARGPGEFTDPRGRS

SEQ ID NO: 1159634 - protein, 14 aa, Mycobacterium
ERARTRPEGSGTVA

SEQ ID NO: 1159635 - protein, 21 aa, Mycobacterium
ERASAESTLASRQPYQAASAG

SEQ ID NO: 1159636 - protein, 11 aa, Mycobacterium
ERASGDGEVHP

SEQ ID NO: 1159637 - protein, 10 aa, Mycobacterium
ERASRPPSSF

SEQ ID NO: 1159638 - protein, 10 aa, Mycobacterium
ERAYAERERE

SEQ ID NO: 1159639 - protein, 6 aa, Mycobacterium
ERCTAG

SEQ ID NO: 1159640 - protein, 9 aa, Mycobacterium
ERDAEGRRQ

SEQ ID NO: 1159641 - protein, 10 aa, Mycobacterium
ERDATGSGPV

SEQ ID NO: 1159642 - protein, 10 aa, Mycobacterium
ERDAVTKAEQ

SEQ ID NO: 1159643 - protein, 13 aa, Mycobacterium
ERDDIHPRAAAAT

SEQ ID NO: 1159644 - protein, 6 aa, Mycobacterium
ERDDLT

SEQ ID NO: 1159645 - protein, 6 aa, Mycobacterium
ERDDPD

SEQ ID NO: 1159646 - protein, 5 aa, Mycobacterium
ERDED

SEQ ID NO: 1159647 - protein, 17 aa, Mycobacterium
ERDESGTATGRLDPAGA

SEQ ID NO: 1159648 - protein, 6 aa, Mycobacterium
ERDGDC

SEQ ID NO: 1159649 - protein, 11 aa, Mycobacterium
ERDGVSPDGQP

SEQ ID NO: 1159650 - protein, 13 aa, Mycobacterium
ERDITGADKPAGD

SEQ ID NO: 1159651 - protein, 15 aa, Mycobacterium
ERDLEKARAAGTPDA

SEQ ID NO: 1159652 - protein, 6 aa, Mycobacterium
ERDNNV

SEQ ID NO: 1159653 - protein, 6 aa, Mycobacterium
ERDPAA

SEQ ID NO: 1159654 - protein, 9 aa, Mycobacterium
ERDSRPRER

SEQ ID NO: 1159655 - protein, 9 aa, Mycobacterium
ERDTTYAGA

SEQ ID NO: 1159656 - protein, 26 aa, Mycobacterium
EREATLPPETGVDPASLTEAQRTQAG

SEQ ID NO: 1159657 - protein, 7 aa, Mycobacterium
EREGEED

SEQ ID NO: 1159658 - protein, 6 aa, Mycobacterium
EREGNS

SEQ ID NO: 1159659 - protein, 12 aa, Mycobacterium
EREGPEHPPPDH

SEQ ID NO: 1159660 - protein, 10 aa, Mycobacterium
ERELPEPDDE

SEQ ID NO: 1159661 - protein, 9 aa, Mycobacterium
ERENGLAPA

SEQ ID NO: 1159662 - protein, 6 aa, Mycobacterium
ERENPA

SEQ ID NO: 1159663 - protein, 7 aa, Mycobacterium
EREPERK

SEQ ID NO: 1159664 - protein, 19 aa, Mycobacterium
EREPSLARTTTSDQQSISV

SEQ ID NO: 1159665 - protein, 12 aa, Mycobacterium
EREPSTLGYSAR

SEQ ID NO: 1159666 - protein, 4 aa, Mycobacterium
EREQ

SEQ ID NO: 1159667 - protein, 8 aa, Mycobacterium
EREQAGAL

SEQ ID NO: 1159668 - protein, 10 aa, Mycobacterium
ERESGEHGPL

SEQ ID NO: 1159669 - protein, 13 aa, Mycobacterium
ERFGGTTAYSGGG

SEQ ID NO: 1159670 - protein, 5 aa, Mycobacterium
ERFGP

SEQ ID NO: 1159671 - protein, 11 aa, Mycobacterium
ERFPKGERRSI

SEQ ID NO: 1159672 - protein, 11 aa, Mycobacterium
ERFSPENVKDR

SEQ ID NO: 1159673 - protein, 4 aa, Mycobacterium
ERGA

SEQ ID NO: 1159674 - protein, 7 aa, Mycobacterium
ERGADGI

SEQ ID NO: 1159675 - protein, 7 aa, Mycobacterium
ERGAEAA

SEQ ID NO: 1159676 - protein, 14 aa, Mycobacterium
ERGARNEPATPEDI

SEQ ID NO: 1159677 - protein, 9 aa, Mycobacterium
ERGDERSPL

SEQ ID NO: 1159678 - protein, 8 aa, Mycobacterium
ERGDESER

SEQ ID NO: 1159679 - protein, 5 aa, Mycobacterium
ERGEA

SEQ ID NO: 1159680 - protein, 10 aa, Mycobacterium
ERGEGTGKSD

SEQ ID NO: 1159681 - protein, 7 aa, Mycobacterium
ERGEIHP

SEQ ID NO: 1159682 - protein, 5 aa, Mycobacterium
ERGGA

SEQ ID NO: 1159683 - protein, 11 aa, Mycobacterium
ERGGDEGQTLD

SEQ ID NO: 1159684 - protein, 7 aa, Mycobacterium
ERGGGAN

SEQ ID NO: 1159685 - protein, 5 aa, Mycobacterium
ERGGR

SEQ ID NO: 1159686 - protein, 6 aa, Mycobacterium
ERGGRR

SEQ ID NO: 1159687 - protein, 9 aa, Mycobacterium
ERGGTAVRS

SEQ ID NO: 1159688 - protein, 23 aa, Mycobacterium
ERGLSSQHPRGTEPSTRELSEGQ

SEQ ID NO: 1159689 - protein, 9 aa, Mycobacterium
ERGPGRHGV

SEQ ID NO: 1159690 - protein, 13 aa, Mycobacterium
ERGPSGTRVTAAG

SEQ ID NO: 1159691 - protein, 7 aa, Mycobacterium
ERGQGKT

SEQ ID NO: 1159692 - protein, 6 aa, Mycobacterium
ERGQYE

SEQ ID NO: 1159693 - protein, 8 aa, Mycobacterium
ERGRAQAE

SEQ ID NO: 1159694 - protein, 6 aa, Mycobacterium
ERGRTD

SEQ ID NO: 1159695 - protein, 8 aa, Mycobacterium
ERGSTAAR

SEQ ID NO: 1159696 - protein, 5 aa, Mycobacterium
ERGTD

SEQ ID NO: 1159697 - protein, 9 aa, Mycobacterium
ERGTQRSKS

SEQ ID NO: 1159698 - protein, 8 aa, Mycobacterium
ERGTTTTP

SEQ ID NO: 1159699 - protein, 5 aa, Mycobacterium
ERGVD

SEQ ID NO: 1159700 - protein, 6 aa, Mycobacterium
ERGVTE

SEQ ID NO: 1159701 - protein, 6 aa, Mycobacterium
ERHGAS

SEQ ID NO: 1159702 - protein, 17 aa, Mycobacterium
ERIDPGSPAHVPERTPR

SEQ ID NO: 1159703 - protein, 4 aa, Mycobacterium
ERIP

SEQ ID NO: 1159704 - protein, 12 aa, Mycobacterium
ERKPDRPDARGA

SEQ ID NO: 1159705 - protein, 6 aa, Mycobacterium
ERKWGG

SEQ ID NO: 1159706 - protein, 8 aa, Mycobacterium
ERLDPDTY

SEQ ID NO: 1159707 - protein, 10 aa, Mycobacterium
ERLGAGGLGS

SEQ ID NO: 1159708 - protein, 8 aa, Mycobacterium
ERLGGDGV

SEQ ID NO: 1159709 - protein, 13 aa, Mycobacterium
ERLGPGGSVTGTA

SEQ ID NO: 1159710 - protein, 6 aa, Mycobacterium
ERLRED

SEQ ID NO: 1159711 - protein, 5 aa, Mycobacterium
ERMGG

SEQ ID NO: 1159712 - protein, 11 aa, Mycobacterium
ERMGRQQPGDG

SEQ ID NO: 1159713 - protein, 5 aa, Mycobacterium
ERNGV

SEQ ID NO: 1159714 - protein, 28 aa, Mycobacterium
ERNREASTDAEYAQKAARIARDDAAKEL

SEQ ID NO: 1159715 - protein, 7 aa, Mycobacterium
ERNREQR

SEQ ID NO: 1159716 - protein, 13 aa, Mycobacterium
ERNTETNARLADS

SEQ ID NO: 1159717 - protein, 13 aa, Mycobacterium
ERPAGEEAGAARD

SEQ ID NO: 1159718 - protein, 5 aa, Mycobacterium
ERPAL

SEQ ID NO: 1159719 - protein, 5 aa, Mycobacterium
ERPAR

SEQ ID NO: 1159720 - protein, 8 aa, Mycobacterium
ERPATAAD

SEQ ID NO: 1159721 - protein, 9 aa, Mycobacterium
ERPDAEAAQ

SEQ ID NO: 1159722 - protein, 12 aa, Mycobacterium
ERPEAAEDIEPA

SEQ ID NO: 1159723 - protein, 7 aa, Mycobacterium
ERPEESD

SEQ ID NO: 1159724 - protein, 5 aa, Mycobacterium
ERPEV

SEQ ID NO: 1159725 - protein, 17 aa, Mycobacterium
ERPGEPSWPSPFGPGRP

SEQ ID NO: 1159726 - protein, 17 aa, Mycobacterium
ERPGKGPGIPTKGSDQL

SEQ ID NO: 1159727 - protein, 6 aa, Mycobacterium
ERPGPG

SEQ ID NO: 1159728 - protein, 9 aa, Mycobacterium
ERPKPTDET

SEQ ID NO: 1159729 - protein, 19 aa, Mycobacterium
ERPLDPANYPDAPAQNLQP

SEQ ID NO: 1159730 - protein, 7 aa, Mycobacterium
ERPLHGT

SEQ ID NO: 1159731 - protein, 6 aa, Mycobacterium
ERPMPG

SEQ ID NO: 1159732 - protein, 5 aa, Mycobacterium
ERPPF

SEQ ID NO: 1159733 - protein, 9 aa, Mycobacterium
ERPPLDETS

SEQ ID NO: 1159734 - protein, 48 aa, Mycobacterium
ERPPRERGGKSGDSDDNEIQGISGSTRLEAKRQRRRDGRDAGRRRPPI

SEQ ID NO: 1159735 - protein, 22 aa, Mycobacterium
ERPRARTRSAPAESGGDGQPRG

SEQ ID NO: 1159736 - protein, 12 aa, Mycobacterium
ERPRNPEHGDYA

SEQ ID NO: 1159737 - protein, 5 aa, Mycobacterium
ERPSL

SEQ ID NO: 1159738 - protein, 9 aa, Mycobacterium
ERPSVPVRG

SEQ ID NO: 1159739 - protein, 23 aa, Mycobacterium
ERPTDITPPTPPSNGDESTGTEV

SEQ ID NO: 1159740 - protein, 8 aa, Mycobacterium
ERPTVEGK

SEQ ID NO: 1159741 - protein, 4 aa, Mycobacterium
ERPV

SEQ ID NO: 1159742 - protein, 6 aa, Mycobacterium
ERPVDD

SEQ ID NO: 1159743 - protein, 14 aa, Mycobacterium
ERPVGAAATAAEVR

SEQ ID NO: 1159744 - protein, 4 aa, Mycobacterium
ERQA

SEQ ID NO: 1159745 - protein, 5 aa, Mycobacterium
ERQGV

SEQ ID NO: 1159746 - protein, 7 aa, Mycobacterium
ERQKRGA

SEQ ID NO: 1159747 - protein, 8 aa, Mycobacterium
ERQPDGSL

SEQ ID NO: 1159748 - protein, 10 aa, Mycobacterium
ERQRELQDST

SEQ ID NO: 1159749 - protein, 7 aa, Mycobacterium
ERQRTHG

SEQ ID NO: 1159750 - protein, 6 aa, Mycobacterium
ERQSGR

SEQ ID NO: 1159751 - protein, 6 aa, Mycobacterium
ERQTTI

SEQ ID NO: 1159752 - protein, 7 aa, Mycobacterium
ERRAAGP

SEQ ID NO: 1159753 - protein, 7 aa, Mycobacterium
ERRADPE

SEQ ID NO: 1159754 - protein, 10 aa, Mycobacterium
ERRAKDSDEL

SEQ ID NO: 1159755 - protein, 8 aa, Mycobacterium
ERRAPDLA

SEQ ID NO: 1159756 - protein, 9 aa, Mycobacterium
ERRAPNAVT

SEQ ID NO: 1159757 - protein, 14 aa, Mycobacterium
ERRDDLEPTAGQEN

SEQ ID NO: 1159758 - protein, 15 aa, Mycobacterium
ERRDERSEEKDGRTL

SEQ ID NO: 1159759 - protein, 26 aa, Mycobacterium
ERRDGPWGDYSQAPPHRRPDPSHSID

SEQ ID NO: 1159760 - protein, 9 aa, Mycobacterium
ERRESPRDD

SEQ ID NO: 1159761 - protein, 6 aa, Mycobacterium
ERRGAK

SEQ ID NO: 1159762 - protein, 6 aa, Mycobacterium
ERRGAR

SEQ ID NO: 1159763 - protein, 166 aa, Mycobacterium
ERRGDGGAAKAESAAAPQTPPRRERRSASRQAGAAEAKAPEALEAKAPEVKAPEVKAPEVKADAPAEEAAAEPKTERPRNDRTKAEKPAAQQPDGEQPKGDQPKGEQSRGDQRRSDRPRGDQSDTRSDDRSDSDQQQGQGNRNNSNNSADGDDDGDGRGGRRGRRF

SEQ ID NO: 1159764 - protein, 30 aa, Mycobacterium
ERRGPGRARTRPNRLRGDKAYSSRATRQRL

SEQ ID NO: 1159765 - protein, 7 aa, Mycobacterium
ERRPAEV

SEQ ID NO: 1159766 - protein, 8 aa, Mycobacterium
ERRQAGET

SEQ ID NO: 1159767 - protein, 7 aa, Mycobacterium
ERRRDPR

SEQ ID NO: 1159768 - protein, 15 aa, Mycobacterium
ERRSQVGGTLSGGEQ

SEQ ID NO: 1159769 - protein, 4 aa, Mycobacterium
ERSD

SEQ ID NO: 1159770 - protein, 5 aa, Mycobacterium
ERSDP

SEQ ID NO: 1159771 - protein, 5 aa, Mycobacterium
ERSDQ

SEQ ID NO: 1159772 - protein, 6 aa, Mycobacterium
ERSERL

SEQ ID NO: 1159773 - protein, 20 aa, Mycobacterium
ERSGADHAVRAGDDAAGEIR

SEQ ID NO: 1159774 - protein, 7 aa, Mycobacterium
ERSGFGT

SEQ ID NO: 1159775 - protein, 7 aa, Mycobacterium
ERSHRDG

SEQ ID NO: 1159776 - protein, 13 aa, Mycobacterium
ERSIGTPDAGATS

SEQ ID NO: 1159777 - protein, 10 aa, Mycobacterium
ERSLSGEKLP

SEQ ID NO: 1159778 - protein, 7 aa, Mycobacterium
ERSPNTI

SEQ ID NO: 1159779 - protein, 6 aa, Mycobacterium
ERSPRL

SEQ ID NO: 1159780 - protein, 8 aa, Mycobacterium
ERSPTGVA

SEQ ID NO: 1159781 - protein, 4 aa, Mycobacterium
ERSQ

SEQ ID NO: 1159782 - protein, 9 aa, Mycobacterium
ERSRGGGQA

SEQ ID NO: 1159783 - protein, 13 aa, Mycobacterium
ERSTELHDHGGSL

SEQ ID NO: 1159784 - protein, 5 aa, Mycobacterium
ERSYR

SEQ ID NO: 1159785 - protein, 4 aa, Mycobacterium
ERTA

SEQ ID NO: 1159786 - protein, 27 aa, Mycobacterium
ERTAESPGAATQSGDTAASAGDPDAPF

SEQ ID NO: 1159787 - protein, 7 aa, Mycobacterium
ERTARRA

SEQ ID NO: 1159788 - protein, 10 aa, Mycobacterium
ERTATDEAVA

SEQ ID NO: 1159789 - protein, 7 aa, Mycobacterium
ERTATTA

SEQ ID NO: 1159790 - protein, 4 aa, Mycobacterium
ERTD

SEQ ID NO: 1159791 - protein, 11 aa, Mycobacterium
ERTDTDASPRG

SEQ ID NO: 1159792 - protein, 6 aa, Mycobacterium
ERTEED

SEQ ID NO: 1159793 - protein, 12 aa, Mycobacterium
ERTEREGEREAQ

SEQ ID NO: 1159794 - protein, 19 aa, Mycobacterium
ERTETRSNQRNGSRPRTLS

SEQ ID NO: 1159795 - protein, 6 aa, Mycobacterium
ERTGCT

SEQ ID NO: 1159796 - protein, 7 aa, Mycobacterium
ERTGDAR

SEQ ID NO: 1159797 - protein, 8 aa, Mycobacterium
ERTGEPSV

SEQ ID NO: 1159798 - protein, 9 aa, Mycobacterium
ERTGITQVG

SEQ ID NO: 1159799 - protein, 5 aa, Mycobacterium
ERTGK

SEQ ID NO: 1159800 - protein, 7 aa, Mycobacterium
ERTGKGT

SEQ ID NO: 1159801 - protein, 12 aa, Mycobacterium
ERTGRHRPDDGA

SEQ ID NO: 1159802 - protein, 10 aa, Mycobacterium
ERTPDDTRAN

SEQ ID NO: 1159803 - protein, 5 aa, Mycobacterium
ERTPG

SEQ ID NO: 1159804 - protein, 6 aa, Mycobacterium
ERTPGA

SEQ ID NO: 1159805 - protein, 9 aa, Mycobacterium
ERTPGADLG

SEQ ID NO: 1159806 - protein, 10 aa, Mycobacterium
ERTPPPDSGT

SEQ ID NO: 1159807 - protein, 7 aa, Mycobacterium
ERTPQGL

SEQ ID NO: 1159808 - protein, 6 aa, Mycobacterium
ERTPTD

SEQ ID NO: 1159809 - protein, 11 aa, Mycobacterium
ERTRDGRSFDT

SEQ ID NO: 1159810 - protein, 7 aa, Mycobacterium
ERTSGTA

SEQ ID NO: 1159811 - protein, 4 aa, Mycobacterium
ERTT

SEQ ID NO: 1159812 - protein, 4 aa, Mycobacterium
ERVA

SEQ ID NO: 1159813 - protein, 6 aa, Mycobacterium
ERVDRS

SEQ ID NO: 1159814 - protein, 6 aa, Mycobacterium
ERVEPA

SEQ ID NO: 1159815 - protein, 6 aa, Mycobacterium
ERVGDD

SEQ ID NO: 1159816 - protein, 13 aa, Mycobacterium
ERVNASGVAVKDD

SEQ ID NO: 1159817 - protein, 6 aa, Mycobacterium
ERVRPV

SEQ ID NO: 1159818 - protein, 11 aa, Mycobacterium
ERVSGKPANPE

SEQ ID NO: 1159819 - protein, 6 aa, Mycobacterium
ERWGTT

SEQ ID NO: 1159820 - protein, 4 aa, Mycobacterium
ERYA

SEQ ID NO: 1159821 - protein, 12 aa, Mycobacterium
ERYDSGERADME

SEQ ID NO: 1159822 - protein, 9 aa, Mycobacterium
ERYPDERRA

SEQ ID NO: 1159823 - protein, 9 aa, Mycobacterium
ERYPGRRGI

SEQ ID NO: 1159824 - protein, 6 aa, Mycobacterium
ERYREG

SEQ ID NO: 1159825 - protein, 19 aa, Mycobacterium
ESAARDAVANCPERAIIEI

SEQ ID NO: 1159826 - protein, 8 aa, Mycobacterium
ESAASGKQ

SEQ ID NO: 1159827 - protein, 7 aa, Mycobacterium
ESADHGG

SEQ ID NO: 1159828 - protein, 5 aa, Mycobacterium
ESADK

SEQ ID NO: 1159829 - protein, 11 aa, Mycobacterium
ESADRAKLAEE

SEQ ID NO: 1159830 - protein, 10 aa, Mycobacterium
ESADRSSVAA

SEQ ID NO: 1159831 - protein, 6 aa, Mycobacterium
ESAGAC

SEQ ID NO: 1159832 - protein, 9 aa, Mycobacterium
ESAGGLGGP

SEQ ID NO: 1159833 - protein, 7 aa, Mycobacterium
ESAGTEV

SEQ ID NO: 1159834 - protein, 8 aa, Mycobacterium
ESANKRYG

SEQ ID NO: 1159835 - protein, 7 aa, Mycobacterium
ESAPGRI

SEQ ID NO: 1159836 - protein, 8 aa, Mycobacterium
ESAPGSDH

SEQ ID NO: 1159837 - protein, 7 aa, Mycobacterium
ESAQKGA

SEQ ID NO: 1159838 - protein, 6 aa, Mycobacterium
ESARRA

SEQ ID NO: 1159839 - protein, 6 aa, Mycobacterium
ESAVGD

SEQ ID NO: 1159840 - protein, 14 aa, Mycobacterium
ESAVTPSGAHPYAV

SEQ ID NO: 1159841 - protein, 11 aa, Mycobacterium
ESAYEDRPQTY

SEQ ID NO: 1159842 - protein, 7 aa, Mycobacterium
ESCEDPR

SEQ ID NO: 1159843 - protein, 4 aa, Mycobacterium
ESDA

SEQ ID NO: 1159844 - protein, 15 aa, Mycobacterium
ESDANGPLRNSRTGS

SEQ ID NO: 1159845 - protein, 48 aa, Mycobacterium
ESDEVGVANAGSKVLSSTPKPPKTAGEKVTDEGEGGSKVAEYLVAQKI

SEQ ID NO: 1159846 - protein, 4 aa, Mycobacterium
ESDP

SEQ ID NO: 1159847 - protein, 14 aa, Mycobacterium
ESDSHAKEHSSALG

SEQ ID NO: 1159848 - protein, 9 aa, Mycobacterium
ESDSPRSKQ

SEQ ID NO: 1159849 - protein, 10 aa, Mycobacterium
ESDSTISDDT

SEQ ID NO: 1159850 - protein, 10 aa, Mycobacterium
ESDTGSPEAQ

SEQ ID NO: 1159851 - protein, 8 aa, Mycobacterium
ESEAIDDS

SEQ ID NO: 1159852 - protein, 7 aa, Mycobacterium
ESEDAEN

SEQ ID NO: 1159853 - protein, 6 aa, Mycobacterium
ESEDES

SEQ ID NO: 1159854 - protein, 14 aa, Mycobacterium
ESEEEARRELANEP

SEQ ID NO: 1159855 - protein, 6 aa, Mycobacterium
ESEGNG

SEQ ID NO: 1159856 - protein, 4 aa, Mycobacterium
ESEH

SEQ ID NO: 1159857 - protein, 8 aa, Mycobacterium
ESEHSRDA

SEQ ID NO: 1159858 - protein, 9 aa, Mycobacterium
ESEITDPDR

SEQ ID NO: 1159859 - protein, 8 aa, Mycobacterium
ESEQARAL

SEQ ID NO: 1159860 - protein, 24 aa, Mycobacterium
ESEQVSVRDANDANLRTKPGAPMK

SEQ ID NO: 1159861 - protein, 6 aa, Mycobacterium
ESERDD

SEQ ID NO: 1159862 - protein, 16 aa, Mycobacterium
ESETNARRAHARTRTT

SEQ ID NO: 1159863 - protein, 6 aa, Mycobacterium
ESEVTR

SEQ ID NO: 1159864 - protein, 5 aa, Mycobacterium
ESEWN

SEQ ID NO: 1159865 - protein, 8 aa, Mycobacterium
ESFTAEQG

SEQ ID NO: 1159866 - protein, 8 aa, Mycobacterium
ESGAIEQD

SEQ ID NO: 1159867 - protein, 8 aa, Mycobacterium
ESGDTAAF

SEQ ID NO: 1159868 - protein, 7 aa, Mycobacterium
ESGEMEP

SEQ ID NO: 1159869 - protein, 7 aa, Mycobacterium
ESGGGVD

SEQ ID NO: 1159870 - protein, 12 aa, Mycobacterium
ESGHSARKLQGG

SEQ ID NO: 1159871 - protein, 8 aa, Mycobacterium
ESGIAPGY

SEQ ID NO: 1159872 - protein, 8 aa, Mycobacterium
ESGPDTDR

SEQ ID NO: 1159873 - protein, 13 aa, Mycobacterium
ESGPFGEASGGPV

SEQ ID NO: 1159874 - protein, 6 aa, Mycobacterium
ESGRGV

SEQ ID NO: 1159875 - protein, 8 aa, Mycobacterium
ESGTQVGS

SEQ ID NO: 1159876 - protein, 10 aa, Mycobacterium
ESGTYDGGTY

SEQ ID NO: 1159877 - protein, 15 aa, Mycobacterium
ESGWPERTAPTTEDI

SEQ ID NO: 1159878 - protein, 8 aa, Mycobacterium
ESGYQETI

SEQ ID NO: 1159879 - protein, 18 aa, Mycobacterium
ESHDAAARTLAAKAGDRF

SEQ ID NO: 1159880 - protein, 5 aa, Mycobacterium
ESHGV

SEQ ID NO: 1159881 - protein, 23 aa, Mycobacterium
ESIDRGRVPDPGPGASRNRQQTR

SEQ ID NO: 1159882 - protein, 11 aa, Mycobacterium
ESIPDPVRDTD

SEQ ID NO: 1159883 - protein, 9 aa, Mycobacterium
ESIRKADDP

SEQ ID NO: 1159884 - protein, 4 aa, Mycobacterium
ESKE

SEQ ID NO: 1159885 - protein, 6 aa, Mycobacterium
ESKYNG

SEQ ID NO: 1159886 - protein, 7 aa, Mycobacterium
ESLADEP

SEQ ID NO: 1159887 - protein, 15 aa, Mycobacterium
ESLANSEVHGQAGGG

SEQ ID NO: 1159888 - protein, 13 aa, Mycobacterium
ESLDDLRAGGAPM

SEQ ID NO: 1159889 - protein, 7 aa, Mycobacterium
ESLGGAG

SEQ ID NO: 1159890 - protein, 15 aa, Mycobacterium
ESLPGHGDDHPSRRE

SEQ ID NO: 1159891 - protein, 12 aa, Mycobacterium
ESLPGKAIESGR

SEQ ID NO: 1159892 - protein, 10 aa, Mycobacterium
ESLSGGAKEQ

SEQ ID NO: 1159893 - protein, 8 aa, Mycobacterium
ESLSSGDR

SEQ ID NO: 1159894 - protein, 6 aa, Mycobacterium
ESLTEQ

SEQ ID NO: 1159895 - protein, 7 aa, Mycobacterium
ESMDPAR

SEQ ID NO: 1159896 - protein, 18 aa, Mycobacterium
ESMGQSRATRADGAPDTV

SEQ ID NO: 1159897 - protein, 10 aa, Mycobacterium
ESMPPETVQP

SEQ ID NO: 1159898 - protein, 5 aa, Mycobacterium
ESMSA

SEQ ID NO: 1159899 - protein, 19 aa, Mycobacterium
ESNGKSVRADGTPVSTDTG

SEQ ID NO: 1159900 - protein, 8 aa, Mycobacterium
ESNLDAPN

SEQ ID NO: 1159901 - protein, 4 aa, Mycobacterium
ESNP

SEQ ID NO: 1159902 - protein, 10 aa, Mycobacterium
ESNPPSKADY

SEQ ID NO: 1159903 - protein, 22 aa, Mycobacterium
ESPESRARHRALSSDGADEQTV

SEQ ID NO: 1159904 - protein, 12 aa, Mycobacterium
ESPGGSVTGSET

SEQ ID NO: 1159905 - protein, 17 aa, Mycobacterium
ESPGSIRNAGPAHPGQH

SEQ ID NO: 1159906 - protein, 4 aa, Mycobacterium
ESPL

SEQ ID NO: 1159907 - protein, 5 aa, Mycobacterium
ESPNP

SEQ ID NO: 1159908 - protein, 5 aa, Mycobacterium
ESPPI

SEQ ID NO: 1159909 - protein, 12 aa, Mycobacterium
ESPRTRGDEEPE

SEQ ID NO: 1159910 - protein, 7 aa, Mycobacterium
ESPTGAI

SEQ ID NO: 1159911 - protein, 7 aa, Mycobacterium
ESPYRDR

SEQ ID NO: 1159912 - protein, 12 aa, Mycobacterium
ESQALRRGATDH

SEQ ID NO: 1159913 - protein, 10 aa, Mycobacterium
ESQDQIADAK

SEQ ID NO: 1159914 - protein, 15 aa, Mycobacterium
ESQGETKLSAADRKS

SEQ ID NO: 1159915 - protein, 4 aa, Mycobacterium
ESQW

SEQ ID NO: 1159916 - protein, 18 aa, Mycobacterium
ESRADGRLPRHTITAQRG

SEQ ID NO: 1159917 - protein, 4 aa, Mycobacterium
ESRE

SEQ ID NO: 1159918 - protein, 6 aa, Mycobacterium
ESRERL

SEQ ID NO: 1159919 - protein, 8 aa, Mycobacterium
ESRGGTSR

SEQ ID NO: 1159920 - protein, 7 aa, Mycobacterium
ESRKDEA

SEQ ID NO: 1159921 - protein, 27 aa, Mycobacterium
ESRKRGEAAEVYTQNGRGELAANEHAE

SEQ ID NO: 1159922 - protein, 9 aa, Mycobacterium
ESRPTRTEL

SEQ ID NO: 1159923 - protein, 4 aa, Mycobacterium
ESRR

SEQ ID NO: 1159924 - protein, 10 aa, Mycobacterium
ESRRQPSDAP

SEQ ID NO: 1159925 - protein, 16 aa, Mycobacterium
ESRSASGAGRPPLVGR

SEQ ID NO: 1159926 - protein, 7 aa, Mycobacterium
ESRTRAA

SEQ ID NO: 1159927 - protein, 9 aa, Mycobacterium
ESSGAALTE

SEQ ID NO: 1159928 - protein, 12 aa, Mycobacterium
ESSGAERDDDGS

SEQ ID NO: 1159929 - protein, 8 aa, Mycobacterium
ESSNPDNI

SEQ ID NO: 1159930 - protein, 10 aa, Mycobacterium
ESSPAQTEAA

SEQ ID NO: 1159931 - protein, 6 aa, Mycobacterium
ESSPDL

SEQ ID NO: 1159932 - protein, 7 aa, Mycobacterium
ESSRKTG

SEQ ID NO: 1159933 - protein, 13 aa, Mycobacterium
ESSTHPVDDDDGL

SEQ ID NO: 1159934 - protein, 20 aa, Mycobacterium
ESTADTRSNWDPTIQHGSPP

SEQ ID NO: 1159935 - protein, 9 aa, Mycobacterium
ESTAEERRR

SEQ ID NO: 1159936 - protein, 5 aa, Mycobacterium
ESTAW

SEQ ID NO: 1159937 - protein, 11 aa, Mycobacterium
ESTDAYEAGRA

SEQ ID NO: 1159938 - protein, 7 aa, Mycobacterium
ESTEYTE

SEQ ID NO: 1159939 - protein, 9 aa, Mycobacterium
ESTGDPEAF

SEQ ID NO: 1159940 - protein, 7 aa, Mycobacterium
ESTGTDA

SEQ ID NO: 1159941 - protein, 6 aa, Mycobacterium
ESTHIT

SEQ ID NO: 1159942 - protein, 15 aa, Mycobacterium
ESTKVRAAPASYDDH

SEQ ID NO: 1159943 - protein, 14 aa, Mycobacterium
ESTPWERNGRPRIA

SEQ ID NO: 1159944 - protein, 5 aa, Mycobacterium
ESTVR

SEQ ID NO: 1159945 - protein, 4 aa, Mycobacterium
ESVG

SEQ ID NO: 1159946 - protein, 7 aa, Mycobacterium
ESVGGQG

SEQ ID NO: 1159947 - protein, 6 aa, Mycobacterium
ESVRQA

SEQ ID NO: 1159948 - protein, 15 aa, Mycobacterium
ESVRSADGPIPSGPL

SEQ ID NO: 1159949 - protein, 9 aa, Mycobacterium
ESVTGDIEP

SEQ ID NO: 1159950 - protein, 5 aa, Mycobacterium
ESWAA

SEQ ID NO: 1159951 - protein, 9 aa, Mycobacterium
ESYGGSPVS

SEQ ID NO: 1159952 - protein, 12 aa, Mycobacterium
ESYKATETTPGE

SEQ ID NO: 1159953 - protein, 4 aa, Mycobacterium
ESYQ

SEQ ID NO: 1159954 - protein, 6 aa, Mycobacterium
ETAAVT

SEQ ID NO: 1159955 - protein, 10 aa, Mycobacterium
ETADGHADRL

SEQ ID NO: 1159956 - protein, 7 aa, Mycobacterium
ETAEDVR

SEQ ID NO: 1159957 - protein, 4 aa, Mycobacterium
ETAG

SEQ ID NO: 1159958 - protein, 22 aa, Mycobacterium
ETAGAHDAVESGVTGKVLVRVS

SEQ ID NO: 1159959 - protein, 8 aa, Mycobacterium
ETAGDRPI

SEQ ID NO: 1159960 - protein, 7 aa, Mycobacterium
ETAKQPD

SEQ ID NO: 1159961 - protein, 9 aa, Mycobacterium
ETANAEGLQ

SEQ ID NO: 1159962 - protein, 7 aa, Mycobacterium
ETARIER

SEQ ID NO: 1159963 - protein, 9 aa, Mycobacterium
ETASGEALD

SEQ ID NO: 1159964 - protein, 5 aa, Mycobacterium
ETASV

SEQ ID NO: 1159965 - protein, 12 aa, Mycobacterium
ETATGPAADAGA

SEQ ID NO: 1159966 - protein, 9 aa, Mycobacterium
ETATGVASS

SEQ ID NO: 1159967 - protein, 5 aa, Mycobacterium
ETCEA

SEQ ID NO: 1159968 - protein, 6 aa, Mycobacterium
ETCGDG

SEQ ID NO: 1159969 - protein, 9 aa, Mycobacterium
ETDAAARVD

SEQ ID NO: 1159970 - protein, 6 aa, Mycobacterium
ETDAAY

SEQ ID NO: 1159971 - protein, 8 aa, Mycobacterium
ETDAEGGA

SEQ ID NO: 1159972 - protein, 8 aa, Mycobacterium
ETDAGETR

SEQ ID NO: 1159973 - protein, 8 aa, Mycobacterium
ETDARAPL

SEQ ID NO: 1159974 - protein, 11 aa, Mycobacterium
ETDDVSEDSLE

SEQ ID NO: 1159975 - protein, 9 aa, Mycobacterium
ETDEQAEDP

SEQ ID NO: 1159976 - protein, 5 aa, Mycobacterium
ETDGA

SEQ ID NO: 1159977 - protein, 6 aa, Mycobacterium
ETDKAT

SEQ ID NO: 1159978 - protein, 6 aa, Mycobacterium
ETDKTK

SEQ ID NO: 1159979 - protein, 7 aa, Mycobacterium
ETDPLTR

SEQ ID NO: 1159980 - protein, 7 aa, Mycobacterium
ETDRGPQ

SEQ ID NO: 1159981 - protein, 11 aa, Mycobacterium
ETDRPQSTPAL

SEQ ID NO: 1159982 - protein, 7 aa, Mycobacterium
ETDTTTE

SEQ ID NO: 1159983 - protein, 10 aa, Mycobacterium
ETDWSTNGEL

SEQ ID NO: 1159984 - protein, 9 aa, Mycobacterium
ETEAEQMAG

SEQ ID NO: 1159985 - protein, 16 aa, Mycobacterium
ETEFESTGVADGERYS

SEQ ID NO: 1159986 - protein, 6 aa, Mycobacterium
ETEGLH

SEQ ID NO: 1159987 - protein, 11 aa, Mycobacterium
ETEPARLGEGS

SEQ ID NO: 1159988 - protein, 10 aa, Mycobacterium
ETEPKSSPAD

SEQ ID NO: 1159989 - protein, 4 aa, Mycobacterium
ETEV

SEQ ID NO: 1159990 - protein, 15 aa, Mycobacterium
ETEWSRSGRHTSRTD

SEQ ID NO: 1159991 - protein, 5 aa, Mycobacterium
ETFGP

SEQ ID NO: 1159992 - protein, 5 aa, Mycobacterium
ETFPE

SEQ ID NO: 1159993 - protein, 5 aa, Mycobacterium
ETGAG

SEQ ID NO: 1159994 - protein, 11 aa, Mycobacterium
ETGAGQHGVAT

SEQ ID NO: 1159995 - protein, 7 aa, Mycobacterium
ETGARAR

SEQ ID NO: 1159996 - protein, 12 aa, Mycobacterium
ETGAVKAAADAA

SEQ ID NO: 1159997 - protein, 8 aa, Mycobacterium
ETGAVPSP

SEQ ID NO: 1159998 - protein, 5 aa, Mycobacterium
ETGCT

SEQ ID NO: 1159999 - protein, 8 aa, Mycobacterium
ETGEREEL

SEQ ID NO: 1160000 - protein, 7 aa, Mycobacterium
ETGGASR

SEQ ID NO: 1160001 - protein, 22 aa, Mycobacterium
ETGHGSDVQSLETTATYDPDTQ

SEQ ID NO: 1160002 - protein, 11 aa, Mycobacterium
ETGKSAVDAAQ

SEQ ID NO: 1160003 - protein, 6 aa, Mycobacterium
ETGLPA

SEQ ID NO: 1160004 - protein, 7 aa, Mycobacterium
ETGNAKR

SEQ ID NO: 1160005 - protein, 6 aa, Mycobacterium
ETGPDA

SEQ ID NO: 1160006 - protein, 9 aa, Mycobacterium
ETGQGKADI

SEQ ID NO: 1160007 - protein, 6 aa, Mycobacterium
ETGQKG

SEQ ID NO: 1160008 - protein, 7 aa, Mycobacterium
ETGQPQT

SEQ ID NO: 1160009 - protein, 5 aa, Mycobacterium
ETGRE

SEQ ID NO: 1160010 - protein, 6 aa, Mycobacterium
ETGRRE

SEQ ID NO: 1160011 - protein, 10 aa, Mycobacterium
ETGSGSDDDL

SEQ ID NO: 1160012 - protein, 7 aa, Mycobacterium
ETGSHAS

SEQ ID NO: 1160013 - protein, 6 aa, Mycobacterium
ETGTTP

SEQ ID NO: 1160014 - protein, 5 aa, Mycobacterium
ETGVP

SEQ ID NO: 1160015 - protein, 4 aa, Mycobacterium
ETHD

SEQ ID NO: 1160016 - protein, 9 aa, Mycobacterium
ETHGEKDSS

SEQ ID NO: 1160017 - protein, 9 aa, Mycobacterium
ETIDDETTD

SEQ ID NO: 1160018 - protein, 7 aa, Mycobacterium
ETIPSGQ

SEQ ID NO: 1160019 - protein, 6 aa, Mycobacterium
ETIRAG

SEQ ID NO: 1160020 - protein, 7 aa, Mycobacterium
ETIRAGE

SEQ ID NO: 1160021 - protein, 4 aa, Mycobacterium
ETIT

SEQ ID NO: 1160022 - protein, 5 aa, Mycobacterium
ETLED

SEQ ID NO: 1160023 - protein, 5 aa, Mycobacterium
ETLGE

SEQ ID NO: 1160024 - protein, 4 aa, Mycobacterium
ETLP

SEQ ID NO: 1160025 - protein, 6 aa, Mycobacterium
ETLPYT

SEQ ID NO: 1160026 - protein, 4 aa, Mycobacterium
ETLR

SEQ ID NO: 1160027 - protein, 10 aa, Mycobacterium
ETMAEPGDRR

SEQ ID NO: 1160028 - protein, 5 aa, Mycobacterium
ETMPG

SEQ ID NO: 1160029 - protein, 5 aa, Mycobacterium
ETNPG

SEQ ID NO: 1160030 - protein, 6 aa, Mycobacterium
ETNPSV

SEQ ID NO: 1160031 - protein, 4 aa, Mycobacterium
ETPA

SEQ ID NO: 1160032 - protein, 17 aa, Mycobacterium
ETPAERDRVLQRQERRA

SEQ ID NO: 1160033 - protein, 8 aa, Mycobacterium
ETPAGRAE

SEQ ID NO: 1160034 - protein, 8 aa, Mycobacterium
ETPANPGL

SEQ ID NO: 1160035 - protein, 7 aa, Mycobacterium
ETPDEVR

SEQ ID NO: 1160036 - protein, 7 aa, Mycobacterium
ETPDSGT

SEQ ID NO: 1160037 - protein, 6 aa, Mycobacterium
ETPDSN

SEQ ID NO: 1160038 - protein, 6 aa, Mycobacterium
ETPDVE

SEQ ID NO: 1160039 - protein, 4 aa, Mycobacterium
ETPG

SEQ ID NO: 1160040 - protein, 9 aa, Mycobacterium
ETPGIPPDR

SEQ ID NO: 1160041 - protein, 7 aa, Mycobacterium
ETPNGPV

SEQ ID NO: 1160042 - protein, 6 aa, Mycobacterium
ETPNVH

SEQ ID NO: 1160043 - protein, 9 aa, Mycobacterium
ETPPSVASG

SEQ ID NO: 1160044 - protein, 5 aa, Mycobacterium
ETPRI

SEQ ID NO: 1160045 - protein, 14 aa, Mycobacterium
ETPSAYRRRAATTA

SEQ ID NO: 1160046 - protein, 11 aa, Mycobacterium
ETPTPRGPQDA

SEQ ID NO: 1160047 - protein, 7 aa, Mycobacterium
ETPTSGA

SEQ ID NO: 1160048 - protein, 21 aa, Mycobacterium
ETPVRDAGPKALSPTATKGNT

SEQ ID NO: 1160049 - protein, 5 aa, Mycobacterium
ETPYT

SEQ ID NO: 1160050 - protein, 5 aa, Mycobacterium
ETREQ

SEQ ID NO: 1160051 - protein, 6 aa, Mycobacterium
ETRGSG

SEQ ID NO: 1160052 - protein, 4 aa, Mycobacterium
ETRP

SEQ ID NO: 1160053 - protein, 18 aa, Mycobacterium
ETRPGQGYPRTYEDQERW

SEQ ID NO: 1160054 - protein, 14 aa, Mycobacterium
ETRRSRGADRESCD

SEQ ID NO: 1160055 - protein, 10 aa, Mycobacterium
ETSADLSPDE

SEQ ID NO: 1160056 - protein, 8 aa, Mycobacterium
ETSATVES

SEQ ID NO: 1160057 - protein, 9 aa, Mycobacterium
ETSDREDQI

SEQ ID NO: 1160058 - protein, 10 aa, Mycobacterium
ETSEPGNAGT

SEQ ID NO: 1160059 - protein, 8 aa, Mycobacterium
ETSGGNPL

SEQ ID NO: 1160060 - protein, 18 aa, Mycobacterium
ETSGRKATAVGKPAPEGF

SEQ ID NO: 1160061 - protein, 6 aa, Mycobacterium
ETSKYN

SEQ ID NO: 1160062 - protein, 8 aa, Mycobacterium
ETSPDKLT

SEQ ID NO: 1160063 - protein, 7 aa, Mycobacterium
ETSPLAT

SEQ ID NO: 1160064 - protein, 9 aa, Mycobacterium
ETSPREKAT

SEQ ID NO: 1160065 - protein, 7 aa, Mycobacterium
ETSPTSV

SEQ ID NO: 1160066 - protein, 9 aa, Mycobacterium
ETSPWPTDA

SEQ ID NO: 1160067 - protein, 9 aa, Mycobacterium
ETSQAPQPR

SEQ ID NO: 1160068 - protein, 4 aa, Mycobacterium
ETST

SEQ ID NO: 1160069 - protein, 4 aa, Mycobacterium
ETSW

SEQ ID NO: 1160070 - protein, 11 aa, Mycobacterium
ETTDQRTGAAR

SEQ ID NO: 1160071 - protein, 4 aa, Mycobacterium
ETTG

SEQ ID NO: 1160072 - protein, 4 aa, Mycobacterium
ETTI

SEQ ID NO: 1160073 - protein, 8 aa, Mycobacterium
ETTITGPG

SEQ ID NO: 1160074 - protein, 6 aa, Mycobacterium
ETTKDF

SEQ ID NO: 1160075 - protein, 6 aa, Mycobacterium
ETTPAV

SEQ ID NO: 1160076 - protein, 8 aa, Mycobacterium
ETTSTDEG

SEQ ID NO: 1160077 - protein, 4 aa, Mycobacterium
ETTT

SEQ ID NO: 1160078 - protein, 8 aa, Mycobacterium
ETTTEKMR

SEQ ID NO: 1160079 - protein, 5 aa, Mycobacterium
ETTYR

SEQ ID NO: 1160080 - protein, 8 aa, Mycobacterium
ETTYRSSG

SEQ ID NO: 1160081 - protein, 7 aa, Mycobacterium
ETVADNR

SEQ ID NO: 1160082 - protein, 7 aa, Mycobacterium
ETVDGDA

SEQ ID NO: 1160083 - protein, 11 aa, Mycobacterium
ETVDPAQRSPF

SEQ ID NO: 1160084 - protein, 6 aa, Mycobacterium
ETVGDT

SEQ ID NO: 1160085 - protein, 6 aa, Mycobacterium
ETVPTA

SEQ ID NO: 1160086 - protein, 4 aa, Mycobacterium
ETVQ

SEQ ID NO: 1160087 - protein, 12 aa, Mycobacterium
ETVTPTGRREPT

SEQ ID NO: 1160088 - protein, 13 aa, Mycobacterium
ETYPGPGVQSDDQ

SEQ ID NO: 1160089 - protein, 7 aa, Mycobacterium
ETYRDDP

SEQ ID NO: 1160090 - protein, 5 aa, Mycobacterium
ETYTD

SEQ ID NO: 1160091 - protein, 5 aa, Mycobacterium
EVAAQ

SEQ ID NO: 1160092 - protein, 8 aa, Mycobacterium
EVADPTAV

SEQ ID NO: 1160093 - protein, 14 aa, Mycobacterium
EVADTDPAPEAAAA

SEQ ID NO: 1160094 - protein, 8 aa, Mycobacterium
EVAGGQAE

SEQ ID NO: 1160095 - protein, 23 aa, Mycobacterium
EVAGSEVDEEPTTAHTPISGDPI

SEQ ID NO: 1160096 - protein, 16 aa, Mycobacterium
EVAGTVRSEALPPGAE

SEQ ID NO: 1160097 - protein, 10 aa, Mycobacterium
EVAPPTPVDR

SEQ ID NO: 1160098 - protein, 7 aa, Mycobacterium
EVASPDA

SEQ ID NO: 1160099 - protein, 17 aa, Mycobacterium
EVATSRNKLAGTQPDVT

SEQ ID NO: 1160100 - protein, 4 aa, Mycobacterium
EVDD

SEQ ID NO: 1160101 - protein, 9 aa, Mycobacterium
EVDDGALPG

SEQ ID NO: 1160102 - protein, 15 aa, Mycobacterium
EVDEDTEARVSAEET

SEQ ID NO: 1160103 - protein, 7 aa, Mycobacterium
EVDEGLQ

SEQ ID NO: 1160104 - protein, 10 aa, Mycobacterium
EVDGARPGGI

SEQ ID NO: 1160105 - protein, 7 aa, Mycobacterium
EVDNPRD

SEQ ID NO: 1160106 - protein, 5 aa, Mycobacterium
EVDPE

SEQ ID NO: 1160107 - protein, 7 aa, Mycobacterium
EVDPEKI

SEQ ID NO: 1160108 - protein, 5 aa, Mycobacterium
EVDRR

SEQ ID NO: 1160109 - protein, 5 aa, Mycobacterium
EVDSS

SEQ ID NO: 1160110 - protein, 15 aa, Mycobacterium
EVEAQDRTIPGPAGD

SEQ ID NO: 1160111 - protein, 8 aa, Mycobacterium
EVEERARR

SEQ ID NO: 1160112 - protein, 7 aa, Mycobacterium
EVEPNTI

SEQ ID NO: 1160113 - protein, 9 aa, Mycobacterium
EVESGERPV

SEQ ID NO: 1160114 - protein, 4 aa, Mycobacterium
EVGD

SEQ ID NO: 1160115 - protein, 8 aa, Mycobacterium
EVGEAPGA

SEQ ID NO: 1160116 - protein, 5 aa, Mycobacterium
EVGEH

SEQ ID NO: 1160117 - protein, 4 aa, Mycobacterium
EVGG

SEQ ID NO: 1160118 - protein, 7 aa, Mycobacterium
EVGGEPE

SEQ ID NO: 1160119 - protein, 8 aa, Mycobacterium
EVGPPVRG

SEQ ID NO: 1160120 - protein, 7 aa, Mycobacterium
EVGRNPR

SEQ ID NO: 1160121 - protein, 13 aa, Mycobacterium
EVGSTSDHGAQSE

SEQ ID NO: 1160122 - protein, 9 aa, Mycobacterium
EVGTECQTA

SEQ ID NO: 1160123 - protein, 9 aa, Mycobacterium
EVGTTNRTH

SEQ ID NO: 1160124 - protein, 7 aa, Mycobacterium
EVHPDDD

SEQ ID NO: 1160125 - protein, 14 aa, Mycobacterium
EVKRRDRETGDNFD

SEQ ID NO: 1160126 - protein, 11 aa, Mycobacterium
EVNGETRQHSR

SEQ ID NO: 1160127 - protein, 19 aa, Mycobacterium
EVNQAARRKPHDQQGPYEN

SEQ ID NO: 1160128 - protein, 5 aa, Mycobacterium
EVPAD

SEQ ID NO: 1160129 - protein, 12 aa, Mycobacterium
EVPATVSAGSAR

SEQ ID NO: 1160130 - protein, 11 aa, Mycobacterium
EVPEPGEPVDG

SEQ ID NO: 1160131 - protein, 4 aa, Mycobacterium
EVPP

SEQ ID NO: 1160132 - protein, 6 aa, Mycobacterium
EVPPGS

SEQ ID NO: 1160133 - protein, 16 aa, Mycobacterium
EVPPQTASRVTTSSYT

SEQ ID NO: 1160134 - protein, 15 aa, Mycobacterium
EVPTIRKNPSARPSA

SEQ ID NO: 1160135 - protein, 8 aa, Mycobacterium
EVQANPKV

SEQ ID NO: 1160136 - protein, 6 aa, Mycobacterium
EVQGQD

SEQ ID NO: 1160137 - protein, 8 aa, Mycobacterium
EVQGRPSL

SEQ ID NO: 1160138 - protein, 6 aa, Mycobacterium
EVQRGR

SEQ ID NO: 1160139 - protein, 7 aa, Mycobacterium
EVREQAA

SEQ ID NO: 1160140 - protein, 5 aa, Mycobacterium
EVRRA

SEQ ID NO: 1160141 - protein, 11 aa, Mycobacterium
EVRSPATGAPV

SEQ ID NO: 1160142 - protein, 16 aa, Mycobacterium
EVRTGETVDVAFLAQR

SEQ ID NO: 1160143 - protein, 15 aa, Mycobacterium
EVRTSSSPAASNAGG

SEQ ID NO: 1160144 - protein, 11 aa, Mycobacterium
EVSDGRVRRPG

SEQ ID NO: 1160145 - protein, 6 aa, Mycobacterium
EVSGGK

SEQ ID NO: 1160146 - protein, 8 aa, Mycobacterium
EVSGKGPA

SEQ ID NO: 1160147 - protein, 9 aa, Mycobacterium
EVSRAANDR

SEQ ID NO: 1160148 - protein, 8 aa, Mycobacterium
EVSRDDPR

SEQ ID NO: 1160149 - protein, 10 aa, Mycobacterium
EVTADGRRAD

SEQ ID NO: 1160150 - protein, 12 aa, Mycobacterium
EVTADGRSDRGN

SEQ ID NO: 1160151 - protein, 4 aa, Mycobacterium
EVTG

SEQ ID NO: 1160152 - protein, 7 aa, Mycobacterium
EVTGAER

SEQ ID NO: 1160153 - protein, 4 aa, Mycobacterium
EVTP

SEQ ID NO: 1160154 - protein, 5 aa, Mycobacterium
EVTPA

SEQ ID NO: 1160155 - protein, 11 aa, Mycobacterium
EVTPENEEQIK

SEQ ID NO: 1160156 - protein, 9 aa, Mycobacterium
EVTRTGNAR

SEQ ID NO: 1160157 - protein, 13 aa, Mycobacterium
EVVTPKKSDPLNE

SEQ ID NO: 1160158 - protein, 5 aa, Mycobacterium
EWAGP

SEQ ID NO: 1160159 - protein, 4 aa, Mycobacterium
EWDA

SEQ ID NO: 1160160 - protein, 10 aa, Mycobacterium
EWGETNEELG

SEQ ID NO: 1160161 - protein, 18 aa, Mycobacterium
EWGGYGKSGNGRELGPAG

SEQ ID NO: 1160162 - protein, 6 aa, Mycobacterium
EWGTHT

SEQ ID NO: 1160163 - protein, 12 aa, Mycobacterium
EWHGAGGEIPVE

SEQ ID NO: 1160164 - protein, 8 aa, Mycobacterium
EWSSQGVR

SEQ ID NO: 1160165 - protein, 9 aa, Mycobacterium
EWTSPSGRR

SEQ ID NO: 1160166 - protein, 9 aa, Mycobacterium
EYADPTDRR

SEQ ID NO: 1160167 - protein, 8 aa, Mycobacterium
EYADQTDE

SEQ ID NO: 1160168 - protein, 7 aa, Mycobacterium
EYARAER

SEQ ID NO: 1160169 - protein, 10 aa, Mycobacterium
EYDESPERQA

SEQ ID NO: 1160170 - protein, 7 aa, Mycobacterium
EYEGGAS

SEQ ID NO: 1160171 - protein, 8 aa, Mycobacterium
EYETSPEL

SEQ ID NO: 1160172 - protein, 5 aa, Mycobacterium
EYGGG

SEQ ID NO: 1160173 - protein, 5 aa, Mycobacterium
EYGPE

SEQ ID NO: 1160174 - protein, 12 aa, Mycobacterium
EYGQGPGPGENI

SEQ ID NO: 1160175 - protein, 8 aa, Mycobacterium
EYGSGHTE

SEQ ID NO: 1160176 - protein, 5 aa, Mycobacterium
EYGSL

SEQ ID NO: 1160177 - protein, 12 aa, Mycobacterium
EYHTGPADGDEL

SEQ ID NO: 1160178 - protein, 13 aa, Mycobacterium
EYLGSKDNAQERM

SEQ ID NO: 1160179 - protein, 6 aa, Mycobacterium
EYNGSI

SEQ ID NO: 1160180 - protein, 7 aa, Mycobacterium
EYPDRTA

SEQ ID NO: 1160181 - protein, 4 aa, Mycobacterium
EYPP

SEQ ID NO: 1160182 - protein, 12 aa, Mycobacterium
EYPPGSRPTRSR

SEQ ID NO: 1160183 - protein, 5 aa, Mycobacterium
EYPPT

SEQ ID NO: 1160184 - protein, 6 aa, Mycobacterium
EYRPGE

SEQ ID NO: 1160185 - protein, 4 aa, Mycobacterium
EYSH

SEQ ID NO: 1160186 - protein, 10 aa, Mycobacterium
EYTEGAGTGI

SEQ ID NO: 1160187 - protein, 6 aa, Mycobacterium
EYTGTT

SEQ ID NO: 1160188 - protein, 7 aa, Mycobacterium
EYVRGED

SEQ ID NO: 1160189 - protein, 14 aa, Mycobacterium
EYYDPEPGVPGRSV

SEQ ID NO: 1160190 - protein, 12 aa, Mycobacterium
EYYSADTSVPGT

SEQ ID NO: 1160191 - protein, 4 aa, Mycobacterium
FADA

SEQ ID NO: 1160192 - protein, 4 aa, Mycobacterium
FADG

SEQ ID NO: 1160193 - protein, 14 aa, Mycobacterium
FADGADKKDRYAEI

SEQ ID NO: 1160194 - protein, 8 aa, Mycobacterium
FADTGLPV

SEQ ID NO: 1160195 - protein, 6 aa, Mycobacterium
FAEHTP

SEQ ID NO: 1160196 - protein, 7 aa, Mycobacterium
FAEPTSV

SEQ ID NO: 1160197 - protein, 10 aa, Mycobacterium
FAEQTSAKGA

SEQ ID NO: 1160198 - protein, 6 aa, Mycobacterium
FAGDDR

SEQ ID NO: 1160199 - protein, 10 aa, Mycobacterium
FAGREKEIGG

SEQ ID NO: 1160200 - protein, 9 aa, Mycobacterium
FAGRGTDTG

SEQ ID NO: 1160201 - protein, 10 aa, Mycobacterium
FAKRNATGIE

SEQ ID NO: 1160202 - protein, 5 aa, Mycobacterium
FAPAT

SEQ ID NO: 1160203 - protein, 8 aa, Mycobacterium
FAPDPDFP

SEQ ID NO: 1160204 - protein, 7 aa, Mycobacterium
FAPDSGA

SEQ ID NO: 1160205 - protein, 11 aa, Mycobacterium
FAPGASGNIAT

SEQ ID NO: 1160206 - protein, 13 aa, Mycobacterium
FAPGGDMGGGGAD

SEQ ID NO: 1160207 - protein, 13 aa, Mycobacterium
FAPGGPTAAVPPG

SEQ ID NO: 1160208 - protein, 14 aa, Mycobacterium
FAPGTGTPESGGLT

SEQ ID NO: 1160209 - protein, 6 aa, Mycobacterium
FAPPEQ

SEQ ID NO: 1160210 - protein, 11 aa, Mycobacterium
FAPPPPPPAPF

SEQ ID NO: 1160211 - protein, 5 aa, Mycobacterium
FAPPR

SEQ ID NO: 1160212 - protein, 13 aa, Mycobacterium
FAPRDADESPATF

SEQ ID NO: 1160213 - protein, 6 aa, Mycobacterium
FARATG

SEQ ID NO: 1160214 - protein, 6 aa, Mycobacterium
FARDGD

SEQ ID NO: 1160215 - protein, 7 aa, Mycobacterium
FARGPGN

SEQ ID NO: 1160216 - protein, 11 aa, Mycobacterium
FARPGARRRRE

SEQ ID NO: 1160217 - protein, 11 aa, Mycobacterium
FASPNELYDRP

SEQ ID NO: 1160218 - protein, 7 aa, Mycobacterium
FASQASA

SEQ ID NO: 1160219 - protein, 18 aa, Mycobacterium
FATAGGQERSDPGNGPSG

SEQ ID NO: 1160220 - protein, 10 aa, Mycobacterium
FATGPQRTAI

SEQ ID NO: 1160221 - protein, 10 aa, Mycobacterium
FATGRSRAVN

SEQ ID NO: 1160222 - protein, 5 aa, Mycobacterium
FATPR

SEQ ID NO: 1160223 - protein, 13 aa, Mycobacterium
FDAEDTGDRNRQD

SEQ ID NO: 1160224 - protein, 12 aa, Mycobacterium
FDAGGAAELARR

SEQ ID NO: 1160225 - protein, 10 aa, Mycobacterium
FDDDRKRPAR

SEQ ID NO: 1160226 - protein, 8 aa, Mycobacterium
FDDPASAH

SEQ ID NO: 1160227 - protein, 13 aa, Mycobacterium
FDDQGAKYDGDGN

SEQ ID NO: 1160228 - protein, 12 aa, Mycobacterium
FDEAPETGATFE

SEQ ID NO: 1160229 - protein, 6 aa, Mycobacterium
FDEGAD

SEQ ID NO: 1160230 - protein, 7 aa, Mycobacterium
FDEGDKN

SEQ ID NO: 1160231 - protein, 8 aa, Mycobacterium
FDEPSPES

SEQ ID NO: 1160232 - protein, 4 aa, Mycobacterium
FDEQ

SEQ ID NO: 1160233 - protein, 6 aa, Mycobacterium
FDETST

SEQ ID NO: 1160234 - protein, 6 aa, Mycobacterium
FDGAPG

SEQ ID NO: 1160235 - protein, 5 aa, Mycobacterium
FDGPV

SEQ ID NO: 1160236 - protein, 8 aa, Mycobacterium
FDGRDGHG

SEQ ID NO: 1160237 - protein, 5 aa, Mycobacterium
FDGRS

SEQ ID NO: 1160238 - protein, 15 aa, Mycobacterium
FDGSGTVGANIDAPA

SEQ ID NO: 1160239 - protein, 8 aa, Mycobacterium
FDKDGRGL

SEQ ID NO: 1160240 - protein, 11 aa, Mycobacterium
FDNQSRRQTSF

SEQ ID NO: 1160241 - protein, 7 aa, Mycobacterium
FDPATGD

SEQ ID NO: 1160242 - protein, 7 aa, Mycobacterium
FDPENGA

SEQ ID NO: 1160243 - protein, 5 aa, Mycobacterium
FDPER

SEQ ID NO: 1160244 - protein, 12 aa, Mycobacterium
FDPGPEELAAGE

SEQ ID NO: 1160245 - protein, 7 aa, Mycobacterium
FDPGPQI

SEQ ID NO: 1160246 - protein, 5 aa, Mycobacterium
FDPKN

SEQ ID NO: 1160247 - protein, 9 aa, Mycobacterium
FDPKNEKSL

SEQ ID NO: 1160248 - protein, 15 aa, Mycobacterium
FDPTAGTELGPGYRY

SEQ ID NO: 1160249 - protein, 8 aa, Mycobacterium
FDQRDDDG

SEQ ID NO: 1160250 - protein, 11 aa, Mycobacterium
FDRDDNGDWRR

SEQ ID NO: 1160251 - protein, 10 aa, Mycobacterium
FDRPPSDHTT

SEQ ID NO: 1160252 - protein, 10 aa, Mycobacterium
FDSENDTEVG

SEQ ID NO: 1160253 - protein, 7 aa, Mycobacterium
FDSPDEN

SEQ ID NO: 1160254 - protein, 8 aa, Mycobacterium
FDTAPDVD

SEQ ID NO: 1160255 - protein, 15 aa, Mycobacterium
FDTEGDPQKASAIAP

SEQ ID NO: 1160256 - protein, 23 aa, Mycobacterium
FEAPRQASAPAPRPAPAPPPSAH

SEQ ID NO: 1160257 - protein, 11 aa, Mycobacterium
FEDDEVAAAAN

SEQ ID NO: 1160258 - protein, 8 aa, Mycobacterium
FEDPTSAT

SEQ ID NO: 1160259 - protein, 11 aa, Mycobacterium
FEDRDATDPLE

SEQ ID NO: 1160260 - protein, 4 aa, Mycobacterium
FEET

SEQ ID NO: 1160261 - protein, 17 aa, Mycobacterium
FEGDPAAVQALRDAPKG

SEQ ID NO: 1160262 - protein, 18 aa, Mycobacterium
FEGTTARIRERQKAGDIE

SEQ ID NO: 1160263 - protein, 5 aa, Mycobacterium
FEPND

SEQ ID NO: 1160264 - protein, 11 aa, Mycobacterium
FEPQGDDITEQ

SEQ ID NO: 1160265 - protein, 11 aa, Mycobacterium
FERDDPRGGEA

SEQ ID NO: 1160266 - protein, 11 aa, Mycobacterium
FESENPDGKRI

SEQ ID NO: 1160267 - protein, 28 aa, Mycobacterium
FETAKQKRLEREAKMAEKKAGKVLASSA

SEQ ID NO: 1160268 - protein, 10 aa, Mycobacterium
FFGGPDGDGL

SEQ ID NO: 1160269 - protein, 4 aa, Mycobacterium
FGAD

SEQ ID NO: 1160270 - protein, 10 aa, Mycobacterium
FGADGYQRTT

SEQ ID NO: 1160271 - protein, 11 aa, Mycobacterium
FGAPTPSETEL

SEQ ID NO: 1160272 - protein, 8 aa, Mycobacterium
FGAQEAER

SEQ ID NO: 1160273 - protein, 5 aa, Mycobacterium
FGASA

SEQ ID NO: 1160274 - protein, 6 aa, Mycobacterium
FGDAGQ

SEQ ID NO: 1160275 - protein, 8 aa, Mycobacterium
FGDDPGLA

SEQ ID NO: 1160276 - protein, 11 aa, Mycobacterium
FGDDVAPTEEW

SEQ ID NO: 1160277 - protein, 4 aa, Mycobacterium
FGDG

SEQ ID NO: 1160278 - protein, 7 aa, Mycobacterium
FGDGSKL

SEQ ID NO: 1160279 - protein, 8 aa, Mycobacterium
FGDRTGSG

SEQ ID NO: 1160280 - protein, 15 aa, Mycobacterium
FGEPQELAGASAADV

SEQ ID NO: 1160281 - protein, 8 aa, Mycobacterium
FGESETVT

SEQ ID NO: 1160282 - protein, 5 aa, Mycobacterium
FGETP

SEQ ID NO: 1160283 - protein, 4 aa, Mycobacterium
FGGD

SEQ ID NO: 1160284 - protein, 6 aa, Mycobacterium
FGGDPA

SEQ ID NO: 1160285 - protein, 7 aa, Mycobacterium
FGGDPDN

SEQ ID NO: 1160286 - protein, 7 aa, Mycobacterium
FGGDPDR

SEQ ID NO: 1160287 - protein, 9 aa, Mycobacterium
FGGGRGPQL

SEQ ID NO: 1160288 - protein, 11 aa, Mycobacterium
FGGGSSHVETP

SEQ ID NO: 1160289 - protein, 4 aa, Mycobacterium
FGGH

SEQ ID NO: 1160290 - protein, 4 aa, Mycobacterium
FGGP

SEQ ID NO: 1160291 - protein, 7 aa, Mycobacterium
FGGPDAV

SEQ ID NO: 1160292 - protein, 6 aa, Mycobacterium
FGGPTG

SEQ ID NO: 1160293 - protein, 6 aa, Mycobacterium
FGGRDG

SEQ ID NO: 1160294 - protein, 10 aa, Mycobacterium
FGGYGERVGE

SEQ ID NO: 1160295 - protein, 13 aa, Mycobacterium
FGGYKRSGNGREW

SEQ ID NO: 1160296 - protein, 8 aa, Mycobacterium
FGKTRAVD

SEQ ID NO: 1160297 - protein, 15 aa, Mycobacterium
FGNAGQLPLSSRAAP

SEQ ID NO: 1160298 - protein, 8 aa, Mycobacterium
FGPDAGQV

SEQ ID NO: 1160299 - protein, 14 aa, Mycobacterium
FGPDDLARRAAGEK

SEQ ID NO: 1160300 - protein, 12 aa, Mycobacterium
FGPDEQAQEARK

SEQ ID NO: 1160301 - protein, 10 aa, Mycobacterium
FGPDSEGGFG

SEQ ID NO: 1160302 - protein, 6 aa, Mycobacterium
FGPEPE

SEQ ID NO: 1160303 - protein, 9 aa, Mycobacterium
FGPEPGVPF

SEQ ID NO: 1160304 - protein, 21 aa, Mycobacterium
FGPGPRGRRGGGRGRGRRGDV

SEQ ID NO: 1160305 - protein, 8 aa, Mycobacterium
FGPPAGEA

SEQ ID NO: 1160306 - protein, 7 aa, Mycobacterium
FGPPPDW

SEQ ID NO: 1160307 - protein, 5 aa, Mycobacterium
FGPSG

SEQ ID NO: 1160308 - protein, 7 aa, Mycobacterium
FGPTTDG

SEQ ID NO: 1160309 - protein, 12 aa, Mycobacterium
FGPYRSTPAEAR

SEQ ID NO: 1160310 - protein, 10 aa, Mycobacterium
FGQRGTASGE

SEQ ID NO: 1160311 - protein, 8 aa, Mycobacterium
FGQVGDGR

SEQ ID NO: 1160312 - protein, 11 aa, Mycobacterium
FGRAAARATQP

SEQ ID NO: 1160313 - protein, 7 aa, Mycobacterium
FGREAEP

SEQ ID NO: 1160314 - protein, 11 aa, Mycobacterium
FGRGGATDYQQ

SEQ ID NO: 1160315 - protein, 23 aa, Mycobacterium
FGRGRFNGGGGGFGGFGGADGGV

SEQ ID NO: 1160316 - protein, 8 aa, Mycobacterium
FGRGSNRE

SEQ ID NO: 1160317 - protein, 12 aa, Mycobacterium
FGRTADEATAMR

SEQ ID NO: 1160318 - protein, 9 aa, Mycobacterium
FGSGTGHSQ

SEQ ID NO: 1160319 - protein, 12 aa, Mycobacterium
FGSPGQANYATA

SEQ ID NO: 1160320 - protein, 11 aa, Mycobacterium
FGSPPEATAGY

SEQ ID NO: 1160321 - protein, 11 aa, Mycobacterium
FGSPTAEGNAE

SEQ ID NO: 1160322 - protein, 7 aa, Mycobacterium
FGSTEGG

SEQ ID NO: 1160323 - protein, 5 aa, Mycobacterium
FGSTQ

SEQ ID NO: 1160324 - protein, 14 aa, Mycobacterium
FGTATPAGSEEEAD

SEQ ID NO: 1160325 - protein, 4 aa, Mycobacterium
FGTD

SEQ ID NO: 1160326 - protein, 8 aa, Mycobacterium
FGTDEQKR

SEQ ID NO: 1160327 - protein, 11 aa, Mycobacterium
FGTDLDTAREL

SEQ ID NO: 1160328 - protein, 11 aa, Mycobacterium
FGTGEGSSVAE

SEQ ID NO: 1160329 - protein, 5 aa, Mycobacterium
FGTGR

SEQ ID NO: 1160330 - protein, 15 aa, Mycobacterium
FGTIPPNALMPHTSG

SEQ ID NO: 1160331 - protein, 4 aa, Mycobacterium
FGTP

SEQ ID NO: 1160332 - protein, 7 aa, Mycobacterium
FGTPDEV

SEQ ID NO: 1160333 - protein, 11 aa, Mycobacterium
FGTTPQDDTPM

SEQ ID NO: 1160334 - protein, 20 aa, Mycobacterium
FHPEKSGDAGAALLRNWVEE

SEQ ID NO: 1160335 - protein, 5 aa, Mycobacterium
FKGPE

SEQ ID NO: 1160336 - protein, 9 aa, Mycobacterium
FKGRSGRKR

SEQ ID NO: 1160337 - protein, 15 aa, Mycobacterium
FKQTDADVGSFDGGF

SEQ ID NO: 1160338 - protein, 6 aa, Mycobacterium
FKRKGS

SEQ ID NO: 1160339 - protein, 5 aa, Mycobacterium
FKRSR

SEQ ID NO: 1160340 - protein, 8 aa, Mycobacterium
FLPPPGPR

SEQ ID NO: 1160341 - protein, 6 aa, Mycobacterium
FNAPSR

SEQ ID NO: 1160342 - protein, 4 aa, Mycobacterium
FNEY

SEQ ID NO: 1160343 - protein, 4 aa, Mycobacterium
FNGS

SEQ ID NO: 1160344 - protein, 10 aa, Mycobacterium
FPADDPEPRL

SEQ ID NO: 1160345 - protein, 6 aa, Mycobacterium
FPASVG

SEQ ID NO: 1160346 - protein, 12 aa, Mycobacterium
FPDGMRPGRRPM

SEQ ID NO: 1160347 - protein, 8 aa, Mycobacterium
FPDGSTPE

SEQ ID NO: 1160348 - protein, 7 aa, Mycobacterium
FPDKSVR

SEQ ID NO: 1160349 - protein, 10 aa, Mycobacterium
FPDPESAVAQ

SEQ ID NO: 1160350 - protein, 8 aa, Mycobacterium
FPDPSDTN

SEQ ID NO: 1160351 - protein, 5 aa, Mycobacterium
FPEDY

SEQ ID NO: 1160352 - protein, 9 aa, Mycobacterium
FPEEPGGSE

SEQ ID NO: 1160353 - protein, 6 aa, Mycobacterium
FPEGEG

SEQ ID NO: 1160354 - protein, 5 aa, Mycobacterium
FPEPA

SEQ ID NO: 1160355 - protein, 5 aa, Mycobacterium
FPEPK

SEQ ID NO: 1160356 - protein, 9 aa, Mycobacterium
FPGAPPDGW

SEQ ID NO: 1160357 - protein, 30 aa, Mycobacterium
FPGERADGGESIAAPEDELASRRKHRDRKI

SEQ ID NO: 1160358 - protein, 15 aa, Mycobacterium
FPGNPHQVACIERKA

SEQ ID NO: 1160359 - protein, 11 aa, Mycobacterium
FPGPTGANSVE

SEQ ID NO: 1160360 - protein, 6 aa, Mycobacterium
FPGQGA

SEQ ID NO: 1160361 - protein, 10 aa, Mycobacterium
FPKSAADQET

SEQ ID NO: 1160362 - protein, 11 aa, Mycobacterium
FPNHEANPLDP

SEQ ID NO: 1160363 - protein, 6 aa, Mycobacterium
FPPAPA

SEQ ID NO: 1160364 - protein, 9 aa, Mycobacterium
FPPIRDGGR

SEQ ID NO: 1160365 - protein, 6 aa, Mycobacterium
FPPPQT

SEQ ID NO: 1160366 - protein, 9 aa, Mycobacterium
FPPRQEPAS

SEQ ID NO: 1160367 - protein, 7 aa, Mycobacterium
FPRPETQ

SEQ ID NO: 1160368 - protein, 7 aa, Mycobacterium
FPRPTTQ

SEQ ID NO: 1160369 - protein, 12 aa, Mycobacterium
FPRRDEVGGRRA

SEQ ID NO: 1160370 - protein, 5 aa, Mycobacterium
FPRSE

SEQ ID NO: 1160371 - protein, 11 aa, Mycobacterium
FPRSRGDEGFD

SEQ ID NO: 1160372 - protein, 10 aa, Mycobacterium
FPSAGARLGR

SEQ ID NO: 1160373 - protein, 8 aa, Mycobacterium
FPTATEIS

SEQ ID NO: 1160374 - protein, 13 aa, Mycobacterium
FPTDTAKASTMEA

SEQ ID NO: 1160375 - protein, 7 aa, Mycobacterium
FPTEKGT

SEQ ID NO: 1160376 - protein, 6 aa, Mycobacterium
FPTGTP

SEQ ID NO: 1160377 - protein, 5 aa, Mycobacterium
FPTPE

SEQ ID NO: 1160378 - protein, 9 aa, Mycobacterium
FPTSATVSR

SEQ ID NO: 1160379 - protein, 9 aa, Mycobacterium
FPVEPPRRR

SEQ ID NO: 1160380 - protein, 4 aa, Mycobacterium
FPVG

SEQ ID NO: 1160381 - protein, 17 aa, Mycobacterium
FPYDDGYEGRYAEADAH

SEQ ID NO: 1160382 - protein, 11 aa, Mycobacterium
FQDEDGSRWGR

SEQ ID NO: 1160383 - protein, 5 aa, Mycobacterium
FQGQQ

SEQ ID NO: 1160384 - protein, 16 aa, Mycobacterium
FQPDSVEAGLESNNGI

SEQ ID NO: 1160385 - protein, 8 aa, Mycobacterium
FQTAETGE

SEQ ID NO: 1160386 - protein, 11 aa, Mycobacterium
FQTDQSGIEHQ

SEQ ID NO: 1160387 - protein, 4 aa, Mycobacterium
FQTP

SEQ ID NO: 1160388 - protein, 11 aa, Mycobacterium
FRAEGPPTAAV

SEQ ID NO: 1160389 - protein, 17 aa, Mycobacterium
FRDAEDGPKGNVNGGNM

SEQ ID NO: 1160390 - protein, 10 aa, Mycobacterium
FREETRWPNY

SEQ ID NO: 1160391 - protein, 18 aa, Mycobacterium
FREGTRAFQERRSASFTD

SEQ ID NO: 1160392 - protein, 9 aa, Mycobacterium
FRGDPQATV

SEQ ID NO: 1160393 - protein, 18 aa, Mycobacterium
FRKDGTITAGSASQISDG

SEQ ID NO: 1160394 - protein, 10 aa, Mycobacterium
FRKEQAEALA

SEQ ID NO: 1160395 - protein, 8 aa, Mycobacterium
FRNDSNDA

SEQ ID NO: 1160396 - protein, 5 aa, Mycobacterium
FRPNG

SEQ ID NO: 1160397 - protein, 11 aa, Mycobacterium
FRSEKQGQVIQ

SEQ ID NO: 1160398 - protein, 21 aa, Mycobacterium
FRTPTGATYRSTAPPLPGPPV

SEQ ID NO: 1160399 - protein, 7 aa, Mycobacterium
FSDEDEA

SEQ ID NO: 1160400 - protein, 5 aa, Mycobacterium
FSDQH

SEQ ID NO: 1160401 - protein, 19 aa, Mycobacterium
FSDSAREKITAAGGSATEL

SEQ ID NO: 1160402 - protein, 8 aa, Mycobacterium
FSDTDEFG

SEQ ID NO: 1160403 - protein, 4 aa, Mycobacterium
FSEP

SEQ ID NO: 1160404 - protein, 5 aa, Mycobacterium
FSEPE

SEQ ID NO: 1160405 - protein, 9 aa, Mycobacterium
FSERPEYEH

SEQ ID NO: 1160406 - protein, 10 aa, Mycobacterium
FSGDDARAQA

SEQ ID NO: 1160407 - protein, 9 aa, Mycobacterium
FSGEAGPEQ

SEQ ID NO: 1160408 - protein, 10 aa, Mycobacterium
FSGEDGATYE

SEQ ID NO: 1160409 - protein, 21 aa, Mycobacterium
FSGEKREIGVDDAATEILATV

SEQ ID NO: 1160410 - protein, 27 aa, Mycobacterium
FSGGPKRSEPVEPDLAQAGAAGAPSAA

SEQ ID NO: 1160411 - protein, 7 aa, Mycobacterium
FSGGRSP

SEQ ID NO: 1160412 - protein, 4 aa, Mycobacterium
FSGT

SEQ ID NO: 1160413 - protein, 8 aa, Mycobacterium
FSGTENPF

SEQ ID NO: 1160414 - protein, 17 aa, Mycobacterium
FSNPTQKATEDYISGRF

SEQ ID NO: 1160415 - protein, 27 aa, Mycobacterium
FSNTRPPGFAGAGSPISDAEQARAQAG

SEQ ID NO: 1160416 - protein, 8 aa, Mycobacterium
FSPGPSEG

SEQ ID NO: 1160417 - protein, 9 aa, Mycobacterium
FSPPSQREL

SEQ ID NO: 1160418 - protein, 5 aa, Mycobacterium
FSQGA

SEQ ID NO: 1160419 - protein, 4 aa, Mycobacterium
FSRG

SEQ ID NO: 1160420 - protein, 5 aa, Mycobacterium
FSSAR

SEQ ID NO: 1160421 - protein, 12 aa, Mycobacterium
FSSATPDTGVTE

SEQ ID NO: 1160422 - protein, 11 aa, Mycobacterium
FSSNSEGACPA

SEQ ID NO: 1160423 - protein, 6 aa, Mycobacterium
FSTAEP

SEQ ID NO: 1160424 - protein, 4 aa, Mycobacterium
FTAA

SEQ ID NO: 1160425 - protein, 6 aa, Mycobacterium
FTAEEE

SEQ ID NO: 1160426 - protein, 10 aa, Mycobacterium
FTAPTTPGTY

SEQ ID NO: 1160427 - protein, 8 aa, Mycobacterium
FTASPDPL

SEQ ID NO: 1160428 - protein, 5 aa, Mycobacterium
FTATT

SEQ ID NO: 1160429 - protein, 31 aa, Mycobacterium
FTDAENAELAQDPPVTGARYADGDRPAGRAP

SEQ ID NO: 1160430 - protein, 17 aa, Mycobacterium
FTDDDDALRQANDTDYG

SEQ ID NO: 1160431 - protein, 14 aa, Mycobacterium
FTDDSDFLVAILRP

SEQ ID NO: 1160432 - protein, 10 aa, Mycobacterium
FTDEQKARNV

SEQ ID NO: 1160433 - protein, 9 aa, Mycobacterium
FTDGRPPFE

SEQ ID NO: 1160434 - protein, 6 aa, Mycobacterium
FTDPDR

SEQ ID NO: 1160435 - protein, 8 aa, Mycobacterium
FTDTAGER

SEQ ID NO: 1160436 - protein, 10 aa, Mycobacterium
FTDTKEREAS

SEQ ID NO: 1160437 - protein, 7 aa, Mycobacterium
FTEGRTA

SEQ ID NO: 1160438 - protein, 9 aa, Mycobacterium
FTENASTNV

SEQ ID NO: 1160439 - protein, 10 aa, Mycobacterium
FTEPRNEHKQ

SEQ ID NO: 1160440 - protein, 18 aa, Mycobacterium
FTERDNRELAERAAADRD

SEQ ID NO: 1160441 - protein, 14 aa, Mycobacterium
FTGDSNRKAPTAPR

SEQ ID NO: 1160442 - protein, 4 aa, Mycobacterium
FTGR

SEQ ID NO: 1160443 - protein, 5 aa, Mycobacterium
FTGRP

SEQ ID NO: 1160444 - protein, 12 aa, Mycobacterium
FTGRPLPVPPTL

SEQ ID NO: 1160445 - protein, 8 aa, Mycobacterium
FTGSRAGG

SEQ ID NO: 1160446 - protein, 11 aa, Mycobacterium
FTGSSAVGKEI

SEQ ID NO: 1160447 - protein, 11 aa, Mycobacterium
FTGSTAAGRAV

SEQ ID NO: 1160448 - protein, 8 aa, Mycobacterium
FTGTPAQT

SEQ ID NO: 1160449 - protein, 18 aa, Mycobacterium
FTKTTSKGVQTIGGAARG

SEQ ID NO: 1160450 - protein, 5 aa, Mycobacterium
FTNQR

SEQ ID NO: 1160451 - protein, 5 aa, Mycobacterium
FTNSP

SEQ ID NO: 1160452 - protein, 10 aa, Mycobacterium
FTPDDEKALR

SEQ ID NO: 1160453 - protein, 6 aa, Mycobacterium
FTPDSS

SEQ ID NO: 1160454 - protein, 5 aa, Mycobacterium
FTPED

SEQ ID NO: 1160455 - protein, 6 aa, Mycobacterium
FTPEGD

SEQ ID NO: 1160456 - protein, 10 aa, Mycobacterium
FTPESTAEAD

SEQ ID NO: 1160457 - protein, 6 aa, Mycobacterium
FTPGPG

SEQ ID NO: 1160458 - protein, 7 aa, Mycobacterium
FTPRATA

SEQ ID NO: 1160459 - protein, 12 aa, Mycobacterium
FTPRGNDFGPPP

SEQ ID NO: 1160460 - protein, 5 aa, Mycobacterium
FTPRN

SEQ ID NO: 1160461 - protein, 9 aa, Mycobacterium
FTPRPVPSV

SEQ ID NO: 1160462 - protein, 9 aa, Mycobacterium
FTPSGDGTH

SEQ ID NO: 1160463 - protein, 6 aa, Mycobacterium
FTSDER

SEQ ID NO: 1160464 - protein, 10 aa, Mycobacterium
FTSPTGESEN

SEQ ID NO: 1160465 - protein, 9 aa, Mycobacterium
FTSPTTGDL

SEQ ID NO: 1160466 - protein, 8 aa, Mycobacterium
FTTGPDGA

SEQ ID NO: 1160467 - protein, 11 aa, Mycobacterium
FTTRGRRADEQ

SEQ ID NO: 1160468 - protein, 11 aa, Mycobacterium
FTTRSTKKTGN

SEQ ID NO: 1160469 - protein, 11 aa, Mycobacterium
FTVGPKERKLG

SEQ ID NO: 1160470 - protein, 11 aa, Mycobacterium
FTVNGGARGER

SEQ ID NO: 1160471 - protein, 11 aa, Mycobacterium
FVGGSTARSGG

SEQ ID NO: 1160472 - protein, 4 aa, Mycobacterium
FVSG

SEQ ID NO: 1160473 - protein, 9 aa, Mycobacterium
GAAADEPLA

SEQ ID NO: 1160474 - protein, 18 aa, Mycobacterium
GAAAESSDPWNNAGTGHS

SEQ ID NO: 1160475 - protein, 7 aa, Mycobacterium
GAAAGAG

SEQ ID NO: 1160476 - protein, 13 aa, Mycobacterium
GAAAGGSLADSEF

SEQ ID NO: 1160477 - protein, 9 aa, Mycobacterium
GAAAGKPVG

SEQ ID NO: 1160478 - protein, 13 aa, Mycobacterium
GAAAGRPAITTAE

SEQ ID NO: 1160479 - protein, 6 aa, Mycobacterium
GAADAR

SEQ ID NO: 1160480 - protein, 5 aa, Mycobacterium
GAADP

SEQ ID NO: 1160481 - protein, 10 aa, Mycobacterium
GAADPGRPAN

SEQ ID NO: 1160482 - protein, 14 aa, Mycobacterium
GAADRLNKKPAKKS

SEQ ID NO: 1160483 - protein, 9 aa, Mycobacterium
GAADSVQES

SEQ ID NO: 1160484 - protein, 5 aa, Mycobacterium
GAAEA

SEQ ID NO: 1160485 - protein, 18 aa, Mycobacterium
GAAEDGFAKEHGGNGNVG

SEQ ID NO: 1160486 - protein, 8 aa, Mycobacterium
GAAESEDR

SEQ ID NO: 1160487 - protein, 8 aa, Mycobacterium
GAAGAADE

SEQ ID NO: 1160488 - protein, 19 aa, Mycobacterium
GAAGDSPEGSPSGSPVVTV

SEQ ID NO: 1160489 - protein, 9 aa, Mycobacterium
GAAGGELTE

SEQ ID NO: 1160490 - protein, 6 aa, Mycobacterium
GAAGPA

SEQ ID NO: 1160491 - protein, 10 aa, Mycobacterium
GAAGPHGGSV

SEQ ID NO: 1160492 - protein, 10 aa, Mycobacterium
GAAGRDDTDI

SEQ ID NO: 1160493 - protein, 6 aa, Mycobacterium
GAAHGG

SEQ ID NO: 1160494 - protein, 10 aa, Mycobacterium
GAAKAGVENM

SEQ ID NO: 1160495 - protein, 16 aa, Mycobacterium
GAALGGPAKSRERHVS

SEQ ID NO: 1160496 - protein, 7 aa, Mycobacterium
GAALSTA

SEQ ID NO: 1160497 - protein, 8 aa, Mycobacterium
GAAPDEDR

SEQ ID NO: 1160498 - protein, 16 aa, Mycobacterium
GAAPEPLNGDVDGRDP

SEQ ID NO: 1160499 - protein, 8 aa, Mycobacterium
GAAPGDKT

SEQ ID NO: 1160500 - protein, 9 aa, Mycobacterium
GAAPTEGTY

SEQ ID NO: 1160501 - protein, 8 aa, Mycobacterium
GAARGQGR

SEQ ID NO: 1160502 - protein, 12 aa, Mycobacterium
GAARGTGGKVLL

SEQ ID NO: 1160503 - protein, 6 aa, Mycobacterium
GAARQL

SEQ ID NO: 1160504 - protein, 7 aa, Mycobacterium
GAARRAQ

SEQ ID NO: 1160505 - protein, 10 aa, Mycobacterium
GAASAAAPLA

SEQ ID NO: 1160506 - protein, 9 aa, Mycobacterium
GAASPQETR

SEQ ID NO: 1160507 - protein, 10 aa, Mycobacterium
GAATEERLSD

SEQ ID NO: 1160508 - protein, 17 aa, Mycobacterium
GAATPAAVGAGGDDDSW

SEQ ID NO: 1160509 - protein, 8 aa, Mycobacterium
GAATPTAN

SEQ ID NO: 1160510 - protein, 13 aa, Mycobacterium
GAAVGSTAAFPGV

SEQ ID NO: 1160511 - protein, 17 aa, Mycobacterium
GAAVTQGTVLAEIKSDG

SEQ ID NO: 1160512 - protein, 9 aa, Mycobacterium
GAAYSPESA

SEQ ID NO: 1160513 - protein, 4 aa, Mycobacterium
GACG

SEQ ID NO: 1160514 - protein, 8 aa, Mycobacterium
GACGDTEK

SEQ ID NO: 1160515 - protein, 4 aa, Mycobacterium
GACR

SEQ ID NO: 1160516 - protein, 6 aa, Mycobacterium
GACSRQ

SEQ ID NO: 1160517 - protein, 5 aa, Mycobacterium
GADAE

SEQ ID NO: 1160518 - protein, 9 aa, Mycobacterium
GADAKDRGL

SEQ ID NO: 1160519 - protein, 7 aa, Mycobacterium
GADAPNK

SEQ ID NO: 1160520 - protein, 7 aa, Mycobacterium
GADAPRR

SEQ ID NO: 1160521 - protein, 8 aa, Mycobacterium
GADAQGLE

SEQ ID NO: 1160522 - protein, 13 aa, Mycobacterium
GADASGADGGAKE

SEQ ID NO: 1160523 - protein, 6 aa, Mycobacterium
GADAVS

SEQ ID NO: 1160524 - protein, 5 aa, Mycobacterium
GADCP

SEQ ID NO: 1160525 - protein, 5 aa, Mycobacterium
GADDL

SEQ ID NO: 1160526 - protein, 6 aa, Mycobacterium
GADDQA

SEQ ID NO: 1160527 - protein, 5 aa, Mycobacterium
GADED

SEQ ID NO: 1160528 - protein, 7 aa, Mycobacterium
GADEKRL

SEQ ID NO: 1160529 - protein, 13 aa, Mycobacterium
GADESKLNPNGGA

SEQ ID NO: 1160530 - protein, 9 aa, Mycobacterium
GADGGLRTV

SEQ ID NO: 1160531 - protein, 6 aa, Mycobacterium
GADGKL

SEQ ID NO: 1160532 - protein, 7 aa, Mycobacterium
GADGPSF

SEQ ID NO: 1160533 - protein, 8 aa, Mycobacterium
GADHESVT

SEQ ID NO: 1160534 - protein, 19 aa, Mycobacterium
GADKAATRYTGIGGNVPQS

SEQ ID NO: 1160535 - protein, 18 aa, Mycobacterium
GADLSGGQGVADELPDKA

SEQ ID NO: 1160536 - protein, 8 aa, Mycobacterium
GADLTQTG

SEQ ID NO: 1160537 - protein, 4 aa, Mycobacterium
GADP

SEQ ID NO: 1160538 - protein, 6 aa, Mycobacterium
GADPAR

SEQ ID NO: 1160539 - protein, 6 aa, Mycobacterium
GADPDD

SEQ ID NO: 1160540 - protein, 7 aa, Mycobacterium
GADPDTV

SEQ ID NO: 1160541 - protein, 16 aa, Mycobacterium
GADPEGSVYSGGTGRP

SEQ ID NO: 1160542 - protein, 6 aa, Mycobacterium
GADPEV

SEQ ID NO: 1160543 - protein, 8 aa, Mycobacterium
GADPGLAD

SEQ ID NO: 1160544 - protein, 7 aa, Mycobacterium
GADPKPD

SEQ ID NO: 1160545 - protein, 6 aa, Mycobacterium
GADPQV

SEQ ID NO: 1160546 - protein, 8 aa, Mycobacterium
GADPRARM

SEQ ID NO: 1160547 - protein, 9 aa, Mycobacterium
GADPSAGVR

SEQ ID NO: 1160548 - protein, 6 aa, Mycobacterium
GADPTL

SEQ ID NO: 1160549 - protein, 10 aa, Mycobacterium
GADRADALRT

SEQ ID NO: 1160550 - protein, 7 aa, Mycobacterium
GADRPAA

SEQ ID NO: 1160551 - protein, 6 aa, Mycobacterium
GADRPL

SEQ ID NO: 1160552 - protein, 12 aa, Mycobacterium
GADRSADLDRSA

SEQ ID NO: 1160553 - protein, 8 aa, Mycobacterium
GADRTESV

SEQ ID NO: 1160554 - protein, 11 aa, Mycobacterium
GADSGISKSEV

SEQ ID NO: 1160555 - protein, 5 aa, Mycobacterium
GADTM

SEQ ID NO: 1160556 - protein, 8 aa, Mycobacterium
GADTPRTR

SEQ ID NO: 1160557 - protein, 11 aa, Mycobacterium
GADTPTGDPDI

SEQ ID NO: 1160558 - protein, 4 aa, Mycobacterium
GADV

SEQ ID NO: 1160559 - protein, 4 aa, Mycobacterium
GADY

SEQ ID NO: 1160560 - protein, 4 aa, Mycobacterium
GAEA

SEQ ID NO: 1160561 - protein, 7 aa, Mycobacterium
GAEAGEQ

SEQ ID NO: 1160562 - protein, 9 aa, Mycobacterium
GAEAGGAEL

SEQ ID NO: 1160563 - protein, 6 aa, Mycobacterium
GAEASL

SEQ ID NO: 1160564 - protein, 11 aa, Mycobacterium
GAEATRVDDAD

SEQ ID NO: 1160565 - protein, 7 aa, Mycobacterium
GAECATD

SEQ ID NO: 1160566 - protein, 7 aa, Mycobacterium
GAEDYAQ

SEQ ID NO: 1160567 - protein, 8 aa, Mycobacterium
GAEEVTDL

SEQ ID NO: 1160568 - protein, 5 aa, Mycobacterium
GAEGL

SEQ ID NO: 1160569 - protein, 18 aa, Mycobacterium
GAEGVTPQNTDSPDAPPR

SEQ ID NO: 1160570 - protein, 4 aa, Mycobacterium
GAEI

SEQ ID NO: 1160571 - protein, 7 aa, Mycobacterium
GAEKHRA

SEQ ID NO: 1160572 - protein, 4 aa, Mycobacterium
GAEL

SEQ ID NO: 1160573 - protein, 5 aa, Mycobacterium
GAELG

SEQ ID NO: 1160574 - protein, 7 aa, Mycobacterium
GAELTDD

SEQ ID NO: 1160575 - protein, 12 aa, Mycobacterium
GAENPGKGRYSD

SEQ ID NO: 1160576 - protein, 6 aa, Mycobacterium
GAEPAR

SEQ ID NO: 1160577 - protein, 7 aa, Mycobacterium
GAEPGRA

SEQ ID NO: 1160578 - protein, 4 aa, Mycobacterium
GAER

SEQ ID NO: 1160579 - protein, 18 aa, Mycobacterium
GAERATPEEIERNPRSAP

SEQ ID NO: 1160580 - protein, 11 aa, Mycobacterium
GAERPGSNIGG

SEQ ID NO: 1160581 - protein, 29 aa, Mycobacterium
GAERSDADGVAPVSPSGVDGLGRPKGRAL

SEQ ID NO: 1160582 - protein, 13 aa, Mycobacterium
GAERTRGGSTLEQ

SEQ ID NO: 1160583 - protein, 5 aa, Mycobacterium
GAESM

SEQ ID NO: 1160584 - protein, 8 aa, Mycobacterium
GAESPKET

SEQ ID NO: 1160585 - protein, 8 aa, Mycobacterium
GAESPQET

SEQ ID NO: 1160586 - protein, 4 aa, Mycobacterium
GAET

SEQ ID NO: 1160587 - protein, 12 aa, Mycobacterium
GAETHTVDDDAA

SEQ ID NO: 1160588 - protein, 10 aa, Mycobacterium
GAETTRNSIA

SEQ ID NO: 1160589 - protein, 6 aa, Mycobacterium
GAETTT

SEQ ID NO: 1160590 - protein, 5 aa, Mycobacterium
GAEVD

SEQ ID NO: 1160591 - protein, 7 aa, Mycobacterium
GAEVGDH

SEQ ID NO: 1160592 - protein, 16 aa, Mycobacterium
GAEVTTEANPESSGPE

SEQ ID NO: 1160593 - protein, 5 aa, Mycobacterium
GAEYG

SEQ ID NO: 1160594 - protein, 6 aa, Mycobacterium
GAFDGE

SEQ ID NO: 1160595 - protein, 5 aa, Mycobacterium
GAFPA

SEQ ID NO: 1160596 - protein, 4 aa, Mycobacterium
GAGA

SEQ ID NO: 1160597 - protein, 8 aa, Mycobacterium
GAGAFTPE

SEQ ID NO: 1160598 - protein, 7 aa, Mycobacterium
GAGARIQ

SEQ ID NO: 1160599 - protein, 6 aa, Mycobacterium
GAGATV

SEQ ID NO: 1160600 - protein, 5 aa, Mycobacterium
GAGAV

SEQ ID NO: 1160601 - protein, 7 aa, Mycobacterium
GAGAWSQ

SEQ ID NO: 1160602 - protein, 10 aa, Mycobacterium
GAGCPDPATA

SEQ ID NO: 1160603 - protein, 9 aa, Mycobacterium
GAGDDGVNT

SEQ ID NO: 1160604 - protein, 12 aa, Mycobacterium
GAGDLPEGIEGG

SEQ ID NO: 1160605 - protein, 4 aa, Mycobacterium
GAGE

SEQ ID NO: 1160606 - protein, 9 aa, Mycobacterium
GAGEFDPAA

SEQ ID NO: 1160607 - protein, 5 aa, Mycobacterium
GAGGA

SEQ ID NO: 1160608 - protein, 13 aa, Mycobacterium
GAGGDSEADGPLT

SEQ ID NO: 1160609 - protein, 14 aa, Mycobacterium
GAGGGHSEPGPQEF

SEQ ID NO: 1160610 - protein, 8 aa, Mycobacterium
GAGGHTAA

SEQ ID NO: 1160611 - protein, 8 aa, Mycobacterium
GAGGNRDA

SEQ ID NO: 1160612 - protein, 10 aa, Mycobacterium
GAGGSDVSPQ

SEQ ID NO: 1160613 - protein, 4 aa, Mycobacterium
GAGH

SEQ ID NO: 1160614 - protein, 7 aa, Mycobacterium
GAGHSAA

SEQ ID NO: 1160615 - protein, 17 aa, Mycobacterium
GAGLPDAPEVRPPGVPE

SEQ ID NO: 1160616 - protein, 8 aa, Mycobacterium
GAGNETTA

SEQ ID NO: 1160617 - protein, 7 aa, Mycobacterium
GAGNGPL

SEQ ID NO: 1160618 - protein, 7 aa, Mycobacterium
GAGPEYD

SEQ ID NO: 1160619 - protein, 7 aa, Mycobacterium
GAGPGKL

SEQ ID NO: 1160620 - protein, 7 aa, Mycobacterium
GAGPGWS

SEQ ID NO: 1160621 - protein, 7 aa, Mycobacterium
GAGPNCD

SEQ ID NO: 1160622 - protein, 7 aa, Mycobacterium
GAGPRKD

SEQ ID NO: 1160623 - protein, 7 aa, Mycobacterium
GAGPSSL

SEQ ID NO: 1160624 - protein, 10 aa, Mycobacterium
GAGQATVRTT

SEQ ID NO: 1160625 - protein, 9 aa, Mycobacterium
GAGREPSRP

SEQ ID NO: 1160626 - protein, 23 aa, Mycobacterium
GAGRGFSSGAGISEDDQTKKAEI

SEQ ID NO: 1160627 - protein, 10 aa, Mycobacterium
GAGRGGKDSV

SEQ ID NO: 1160628 - protein, 6 aa, Mycobacterium
GAGRGL

SEQ ID NO: 1160629 - protein, 13 aa, Mycobacterium
GAGRPERRYRVSA

SEQ ID NO: 1160630 - protein, 7 aa, Mycobacterium
GAGRPHP

SEQ ID NO: 1160631 - protein, 6 aa, Mycobacterium
GAGRQL

SEQ ID NO: 1160632 - protein, 6 aa, Mycobacterium
GAGRTT

SEQ ID NO: 1160633 - protein, 4 aa, Mycobacterium
GAGS

SEQ ID NO: 1160634 - protein, 6 aa, Mycobacterium
GAGSDA

SEQ ID NO: 1160635 - protein, 7 aa, Mycobacterium
GAGSGIG

SEQ ID NO: 1160636 - protein, 8 aa, Mycobacterium
GAGSGIGR

SEQ ID NO: 1160637 - protein, 8 aa, Mycobacterium
GAGSPAEI

SEQ ID NO: 1160638 - protein, 10 aa, Mycobacterium
GAGSSSTESF

SEQ ID NO: 1160639 - protein, 9 aa, Mycobacterium
GAGSSTLTI

SEQ ID NO: 1160640 - protein, 5 aa, Mycobacterium
GAGTA

SEQ ID NO: 1160641 - protein, 8 aa, Mycobacterium
GAGTPEEL

SEQ ID NO: 1160642 - protein, 26 aa, Mycobacterium
GAGTPFPMPAPPGTANAPAPAPADYS

SEQ ID NO: 1160643 - protein, 8 aa, Mycobacterium
GAGTYDTA

SEQ ID NO: 1160644 - protein, 5 aa, Mycobacterium
GAGVD

SEQ ID NO: 1160645 - protein, 7 aa, Mycobacterium
GAGVGAR

SEQ ID NO: 1160646 - protein, 4 aa, Mycobacterium
GAHA

SEQ ID NO: 1160647 - protein, 21 aa, Mycobacterium
GAHAAAAESDARRARGRTLGP

SEQ ID NO: 1160648 - protein, 4 aa, Mycobacterium
GAHG

SEQ ID NO: 1160649 - protein, 11 aa, Mycobacterium
GAHGSMPQSSV

SEQ ID NO: 1160650 - protein, 5 aa, Mycobacterium
GAHIR

SEQ ID NO: 1160651 - protein, 9 aa, Mycobacterium
GAHQERDSL

SEQ ID NO: 1160652 - protein, 10 aa, Mycobacterium
GAIPEQPVRP

SEQ ID NO: 1160653 - protein, 15 aa, Mycobacterium
GAIRGSRRSNPATYT

SEQ ID NO: 1160654 - protein, 15 aa, Mycobacterium
GAISEAKTALAGTDI

SEQ ID NO: 1160655 - protein, 4 aa, Mycobacterium
GAKA

SEQ ID NO: 1160656 - protein, 9 aa, Mycobacterium
GAKAPKLVT

SEQ ID NO: 1160657 - protein, 8 aa, Mycobacterium
GAKAQARS

SEQ ID NO: 1160658 - protein, 15 aa, Mycobacterium
GAKARQAKNKARLGR

SEQ ID NO: 1160659 - protein, 16 aa, Mycobacterium
GAKIGSKGRALPGGGQ

SEQ ID NO: 1160660 - protein, 9 aa, Mycobacterium
GAKPAEGTM

SEQ ID NO: 1160661 - protein, 7 aa, Mycobacterium
GAKPGAV

SEQ ID NO: 1160662 - protein, 11 aa, Mycobacterium
GAKPGTTVPPV

SEQ ID NO: 1160663 - protein, 10 aa, Mycobacterium
GAKPVGRDTG

SEQ ID NO: 1160664 - protein, 10 aa, Mycobacterium
GAKSGKLRKT

SEQ ID NO: 1160665 - protein, 9 aa, Mycobacterium
GAKSVPAQR

SEQ ID NO: 1160666 - protein, 9 aa, Mycobacterium
GAKTGEQRV

SEQ ID NO: 1160667 - protein, 10 aa, Mycobacterium
GAKTGKARLS

SEQ ID NO: 1160668 - protein, 11 aa, Mycobacterium
GALDSTVSQRE

SEQ ID NO: 1160669 - protein, 27 aa, Mycobacterium
GALEDDPNVTDKKFPGNPTRSYRTREP

SEQ ID NO: 1160670 - protein, 8 aa, Mycobacterium
GALERGDD

SEQ ID NO: 1160671 - protein, 11 aa, Mycobacterium
GALESGLYSPE

SEQ ID NO: 1160672 - protein, 17 aa, Mycobacterium
GALGAAAADPARSRDRL

SEQ ID NO: 1160673 - protein, 7 aa, Mycobacterium
GALGPAD

SEQ ID NO: 1160674 - protein, 13 aa, Mycobacterium
GALPEGQRRDKAA

SEQ ID NO: 1160675 - protein, 8 aa, Mycobacterium
GALPGGSR

SEQ ID NO: 1160676 - protein, 8 aa, Mycobacterium
GALPVPGE

SEQ ID NO: 1160677 - protein, 8 aa, Mycobacterium
GALRPRPE

SEQ ID NO: 1160678 - protein, 19 aa, Mycobacterium
GALSKTGTLAKGLSATRGL

SEQ ID NO: 1160679 - protein, 9 aa, Mycobacterium
GALSNSGTT

SEQ ID NO: 1160680 - protein, 9 aa, Mycobacterium
GALSPDAQL

SEQ ID NO: 1160681 - protein, 6 aa, Mycobacterium
GALSPT

SEQ ID NO: 1160682 - protein, 6 aa, Mycobacterium
GAMPDD

SEQ ID NO: 1160683 - protein, 13 aa, Mycobacterium
GANAGPDRSKIRA

SEQ ID NO: 1160684 - protein, 7 aa, Mycobacterium
GANDALS

SEQ ID NO: 1160685 - protein, 14 aa, Mycobacterium
GANEYSGQRKPPAV

SEQ ID NO: 1160686 - protein, 6 aa, Mycobacterium
GANPGL

SEQ ID NO: 1160687 - protein, 6 aa, Mycobacterium
GANPGY

SEQ ID NO: 1160688 - protein, 6 aa, Mycobacterium
GANSGL

SEQ ID NO: 1160689 - protein, 6 aa, Mycobacterium
GANSRR

SEQ ID NO: 1160690 - protein, 13 aa, Mycobacterium
GANTEAPDDAGDP

SEQ ID NO: 1160691 - protein, 8 aa, Mycobacterium
GANTGLGL

SEQ ID NO: 1160692 - protein, 6 aa, Mycobacterium
GANVSP

SEQ ID NO: 1160693 - protein, 5 aa, Mycobacterium
GANWG

SEQ ID NO: 1160694 - protein, 8 aa, Mycobacterium
GAPAPSPA

SEQ ID NO: 1160695 - protein, 7 aa, Mycobacterium
GAPATAA

SEQ ID NO: 1160696 - protein, 4 aa, Mycobacterium
GAPD

SEQ ID NO: 1160697 - protein, 5 aa, Mycobacterium
GAPDA

SEQ ID NO: 1160698 - protein, 6 aa, Mycobacterium
GAPEAV

SEQ ID NO: 1160699 - protein, 10 aa, Mycobacterium
GAPEGRAAGH

SEQ ID NO: 1160700 - protein, 7 aa, Mycobacterium
GAPFSGA

SEQ ID NO: 1160701 - protein, 7 aa, Mycobacterium
GAPGEQR

SEQ ID NO: 1160702 - protein, 5 aa, Mycobacterium
GAPGG

SEQ ID NO: 1160703 - protein, 9 aa, Mycobacterium
GAPGLGTEA

SEQ ID NO: 1160704 - protein, 8 aa, Mycobacterium
GAPGNTIN

SEQ ID NO: 1160705 - protein, 22 aa, Mycobacterium
GAPGSGYRTPMEPGAGPPPSLG

SEQ ID NO: 1160706 - protein, 12 aa, Mycobacterium
GAPGTAAAMIVS

SEQ ID NO: 1160707 - protein, 6 aa, Mycobacterium
GAPGWD

SEQ ID NO: 1160708 - protein, 4 aa, Mycobacterium
GAPI

SEQ ID NO: 1160709 - protein, 17 aa, Mycobacterium
GAPKGPDERRWDPQHPA

SEQ ID NO: 1160710 - protein, 7 aa, Mycobacterium
GAPPAAG

SEQ ID NO: 1160711 - protein, 5 aa, Mycobacterium
GAPPI

SEQ ID NO: 1160712 - protein, 13 aa, Mycobacterium
GAPPLSPAQQTLS

SEQ ID NO: 1160713 - protein, 5 aa, Mycobacterium
GAPPM

SEQ ID NO: 1160714 - protein, 22 aa, Mycobacterium
GAPPSPLEAASDPGLPVVRSQV

SEQ ID NO: 1160715 - protein, 4 aa, Mycobacterium
GAPS

SEQ ID NO: 1160716 - protein, 16 aa, Mycobacterium
GAPSQRKAGYTPDPDA

SEQ ID NO: 1160717 - protein, 7 aa, Mycobacterium
GAPTPDA

SEQ ID NO: 1160718 - protein, 4 aa, Mycobacterium
GAPV

SEQ ID NO: 1160719 - protein, 5 aa, Mycobacterium
GAPVP

SEQ ID NO: 1160720 - protein, 9 aa, Mycobacterium
GAPVPDGDL

SEQ ID NO: 1160721 - protein, 5 aa, Mycobacterium
GAPVQ

SEQ ID NO: 1160722 - protein, 7 aa, Mycobacterium
GAPVQQR

SEQ ID NO: 1160723 - protein, 5 aa, Mycobacterium
GAPVS

SEQ ID NO: 1160724 - protein, 6 aa, Mycobacterium
GAPVSP

SEQ ID NO: 1160725 - protein, 14 aa, Mycobacterium
GAPYYDTYETSDGR

SEQ ID NO: 1160726 - protein, 8 aa, Mycobacterium
GAQAPTEA

SEQ ID NO: 1160727 - protein, 6 aa, Mycobacterium
GAQDVG

SEQ ID NO: 1160728 - protein, 6 aa, Mycobacterium
GAQEQK

SEQ ID NO: 1160729 - protein, 21 aa, Mycobacterium
GAQGGRPEALGGLGGARPGQL

SEQ ID NO: 1160730 - protein, 12 aa, Mycobacterium
GAQKNNDQPDGR

SEQ ID NO: 1160731 - protein, 4 aa, Mycobacterium
GAQL

SEQ ID NO: 1160732 - protein, 17 aa, Mycobacterium
GAQNDNSFTNEQAETLD

SEQ ID NO: 1160733 - protein, 7 aa, Mycobacterium
GAQNGGV

SEQ ID NO: 1160734 - protein, 6 aa, Mycobacterium
GAQNPK

SEQ ID NO: 1160735 - protein, 10 aa, Mycobacterium
GAQPDADEAQ

SEQ ID NO: 1160736 - protein, 7 aa, Mycobacterium
GAQPFPN

SEQ ID NO: 1160737 - protein, 10 aa, Mycobacterium
GAQRVDAPFS

SEQ ID NO: 1160738 - protein, 11 aa, Mycobacterium
GAQSPDIAQGV

SEQ ID NO: 1160739 - protein, 9 aa, Mycobacterium
GAQTAAETA

SEQ ID NO: 1160740 - protein, 6 aa, Mycobacterium
GARAIR

SEQ ID NO: 1160741 - protein, 8 aa, Mycobacterium
GARDAHGN

SEQ ID NO: 1160742 - protein, 8 aa, Mycobacterium
GARDGDDV

SEQ ID NO: 1160743 - protein, 11 aa, Mycobacterium
GARDLDDDDVA

SEQ ID NO: 1160744 - protein, 8 aa, Mycobacterium
GARDPDIE

SEQ ID NO: 1160745 - protein, 14 aa, Mycobacterium
GARELAEADQRVAP

SEQ ID NO: 1160746 - protein, 7 aa, Mycobacterium
GARENEL

SEQ ID NO: 1160747 - protein, 9 aa, Mycobacterium
GARERPRPA

SEQ ID NO: 1160748 - protein, 13 aa, Mycobacterium
GARGASYLGDGER

SEQ ID NO: 1160749 - protein, 9 aa, Mycobacterium
GARGLTDTQ

SEQ ID NO: 1160750 - protein, 6 aa, Mycobacterium
GARGSG

SEQ ID NO: 1160751 - protein, 8 aa, Mycobacterium
GARGVGEE

SEQ ID NO: 1160752 - protein, 22 aa, Mycobacterium
GARITQAPALGPKPGAGGAPMT

SEQ ID NO: 1160753 - protein, 4 aa, Mycobacterium
GARL

SEQ ID NO: 1160754 - protein, 10 aa, Mycobacterium
GARLAKRDGA

SEQ ID NO: 1160755 - protein, 10 aa, Mycobacterium
GARPAPNGSV

SEQ ID NO: 1160756 - protein, 7 aa, Mycobacterium
GARPPVP

SEQ ID NO: 1160757 - protein, 32 aa, Mycobacterium
GARPRALPPQTDIDESRLNESLPGREKTSGIK

SEQ ID NO: 1160758 - protein, 10 aa, Mycobacterium
GARPSAKTSI

SEQ ID NO: 1160759 - protein, 17 aa, Mycobacterium
GARPSVPAKDQFYDPPA

SEQ ID NO: 1160760 - protein, 10 aa, Mycobacterium
GARPVPGKTM

SEQ ID NO: 1160761 - protein, 13 aa, Mycobacterium
GARRGGRITGTAR

SEQ ID NO: 1160762 - protein, 7 aa, Mycobacterium
GARSEAV

SEQ ID NO: 1160763 - protein, 12 aa, Mycobacterium
GARSGAANTAAW

SEQ ID NO: 1160764 - protein, 12 aa, Mycobacterium
GARSGDKGGNAN

SEQ ID NO: 1160765 - protein, 12 aa, Mycobacterium
GARSGDKGGSAN

SEQ ID NO: 1160766 - protein, 9 aa, Mycobacterium
GARSHDDPR

SEQ ID NO: 1160767 - protein, 7 aa, Mycobacterium
GARTADR

SEQ ID NO: 1160768 - protein, 9 aa, Mycobacterium
GARTGKDGK

SEQ ID NO: 1160769 - protein, 18 aa, Mycobacterium
GARTPDEHPALPATPDEL

SEQ ID NO: 1160770 - protein, 14 aa, Mycobacterium
GARTVQRGAVDQAD

SEQ ID NO: 1160771 - protein, 6 aa, Mycobacterium
GARWDE

SEQ ID NO: 1160772 - protein, 5 aa, Mycobacterium
GARYA

SEQ ID NO: 1160773 - protein, 7 aa, Mycobacterium
GARYDAD

SEQ ID NO: 1160774 - protein, 21 aa, Mycobacterium
GASAAIGDRSFGDDPATVTEY

SEQ ID NO: 1160775 - protein, 10 aa, Mycobacterium
GASAASRTRN

SEQ ID NO: 1160776 - protein, 5 aa, Mycobacterium
GASAE

SEQ ID NO: 1160777 - protein, 9 aa, Mycobacterium
GASAGGGLA

SEQ ID NO: 1160778 - protein, 22 aa, Mycobacterium
GASAVDGAAAPLAGTTSQPALS

SEQ ID NO: 1160779 - protein, 8 aa, Mycobacterium
GASDDPDA

SEQ ID NO: 1160780 - protein, 9 aa, Mycobacterium
GASDEAAIR

SEQ ID NO: 1160781 - protein, 22 aa, Mycobacterium
GASDGIDGHPRVGSPDHQLPWR

SEQ ID NO: 1160782 - protein, 7 aa, Mycobacterium
GASDGLG

SEQ ID NO: 1160783 - protein, 11 aa, Mycobacterium
GASDGRPRQSV

SEQ ID NO: 1160784 - protein, 12 aa, Mycobacterium
GASEATGNKADA

SEQ ID NO: 1160785 - protein, 10 aa, Mycobacterium
GASERSRELG

SEQ ID NO: 1160786 - protein, 4 aa, Mycobacterium
GASG

SEQ ID NO: 1160787 - protein, 6 aa, Mycobacterium
GASGEG

SEQ ID NO: 1160788 - protein, 9 aa, Mycobacterium
GASGGIGEE

SEQ ID NO: 1160789 - protein, 8 aa, Mycobacterium
GASGGVGS

SEQ ID NO: 1160790 - protein, 6 aa, Mycobacterium
GASKEL

SEQ ID NO: 1160791 - protein, 7 aa, Mycobacterium
GASKSAQ

SEQ ID NO: 1160792 - protein, 5 aa, Mycobacterium
GASLD

SEQ ID NO: 1160793 - protein, 8 aa, Mycobacterium
GASLGKGD

SEQ ID NO: 1160794 - protein, 7 aa, Mycobacterium
GASPAGQ

SEQ ID NO: 1160795 - protein, 6 aa, Mycobacterium
GASPAT

SEQ ID NO: 1160796 - protein, 7 aa, Mycobacterium
GASPATA

SEQ ID NO: 1160797 - protein, 6 aa, Mycobacterium
GASPGD

SEQ ID NO: 1160798 - protein, 6 aa, Mycobacterium
GASPRA

SEQ ID NO: 1160799 - protein, 16 aa, Mycobacterium
GASPRVLPNAEPDGER

SEQ ID NO: 1160800 - protein, 16 aa, Mycobacterium
GASQSESLARQVEDNG

SEQ ID NO: 1160801 - protein, 10 aa, Mycobacterium
GASRGAGRGI

SEQ ID NO: 1160802 - protein, 6 aa, Mycobacterium
GASRPP

SEQ ID NO: 1160803 - protein, 11 aa, Mycobacterium
GASSAFGGPCR

SEQ ID NO: 1160804 - protein, 6 aa, Mycobacterium
GASSDY

SEQ ID NO: 1160805 - protein, 8 aa, Mycobacterium
GASSRSLA

SEQ ID NO: 1160806 - protein, 16 aa, Mycobacterium
GASTAEAQDRAGTDVA

SEQ ID NO: 1160807 - protein, 6 aa, Mycobacterium
GASTFN

SEQ ID NO: 1160808 - protein, 22 aa, Mycobacterium
GASTNARQRQGVSIPAERPAEV

SEQ ID NO: 1160809 - protein, 7 aa, Mycobacterium
GASTSTD

SEQ ID NO: 1160810 - protein, 6 aa, Mycobacterium
GASTVK

SEQ ID NO: 1160811 - protein, 9 aa, Mycobacterium
GASVPVPAP

SEQ ID NO: 1160812 - protein, 18 aa, Mycobacterium
GATAAQDTGFAAATSTLP

SEQ ID NO: 1160813 - protein, 10 aa, Mycobacterium
GATADQLSGG

SEQ ID NO: 1160814 - protein, 9 aa, Mycobacterium
GATAEGYAE

SEQ ID NO: 1160815 - protein, 7 aa, Mycobacterium
GATAEIN

SEQ ID NO: 1160816 - protein, 6 aa, Mycobacterium
GATALG

SEQ ID NO: 1160817 - protein, 7 aa, Mycobacterium
GATARYP

SEQ ID NO: 1160818 - protein, 6 aa, Mycobacterium
GATATT

SEQ ID NO: 1160819 - protein, 9 aa, Mycobacterium
GATDDHTGQ

SEQ ID NO: 1160820 - protein, 10 aa, Mycobacterium
GATDGEPGLQ

SEQ ID NO: 1160821 - protein, 20 aa, Mycobacterium
GATDGKRKPVADNSLSGRSG

SEQ ID NO: 1160822 - protein, 5 aa, Mycobacterium
GATEA

SEQ ID NO: 1160823 - protein, 14 aa, Mycobacterium
GATEIGGPLPINTD

SEQ ID NO: 1160824 - protein, 8 aa, Mycobacterium
GATEQKNM

SEQ ID NO: 1160825 - protein, 11 aa, Mycobacterium
GATGDFRPKPS

SEQ ID NO: 1160826 - protein, 5 aa, Mycobacterium
GATLD

SEQ ID NO: 1160827 - protein, 9 aa, Mycobacterium
GATLEDPHE

SEQ ID NO: 1160828 - protein, 6 aa, Mycobacterium
GATLPG

SEQ ID NO: 1160829 - protein, 5 aa, Mycobacterium
GATNK

SEQ ID NO: 1160830 - protein, 7 aa, Mycobacterium
GATNKEI

SEQ ID NO: 1160831 - protein, 14 aa, Mycobacterium
GATPADADEVSERL

SEQ ID NO: 1160832 - protein, 5 aa, Mycobacterium
GATPK

SEQ ID NO: 1160833 - protein, 11 aa, Mycobacterium
GATPLPDGRGG

SEQ ID NO: 1160834 - protein, 8 aa, Mycobacterium
GATPPFDS

SEQ ID NO: 1160835 - protein, 6 aa, Mycobacterium
GATRDK

SEQ ID NO: 1160836 - protein, 12 aa, Mycobacterium
GATREEALERSR

SEQ ID NO: 1160837 - protein, 5 aa, Mycobacterium
GATSG

SEQ ID NO: 1160838 - protein, 7 aa, Mycobacterium
GATTIGG

SEQ ID NO: 1160839 - protein, 7 aa, Mycobacterium
GATVEPG

SEQ ID NO: 1160840 - protein, 7 aa, Mycobacterium
GATVTSA

SEQ ID NO: 1160841 - protein, 10 aa, Mycobacterium
GATYDGAGTN

SEQ ID NO: 1160842 - protein, 11 aa, Mycobacterium
GATYPGAGATI

SEQ ID NO: 1160843 - protein, 15 aa, Mycobacterium
GATYSGSSTPGADGI

SEQ ID NO: 1160844 - protein, 5 aa, Mycobacterium
GAVAE

SEQ ID NO: 1160845 - protein, 12 aa, Mycobacterium
GAVDASPGEEPV

SEQ ID NO: 1160846 - protein, 9 aa, Mycobacterium
GAVDPGSEA

SEQ ID NO: 1160847 - protein, 4 aa, Mycobacterium
GAVE

SEQ ID NO: 1160848 - protein, 5 aa, Mycobacterium
GAVEG

SEQ ID NO: 1160849 - protein, 4 aa, Mycobacterium
GAVG

SEQ ID NO: 1160850 - protein, 8 aa, Mycobacterium
GAVGGPAD

SEQ ID NO: 1160851 - protein, 4 aa, Mycobacterium
GAVP

SEQ ID NO: 1160852 - protein, 11 aa, Mycobacterium
GAVPDGEDPRW

SEQ ID NO: 1160853 - protein, 6 aa, Mycobacterium
GAVPDP

SEQ ID NO: 1160854 - protein, 4 aa, Mycobacterium
GAVQ

SEQ ID NO: 1160855 - protein, 6 aa, Mycobacterium
GAVRPG

SEQ ID NO: 1160856 - protein, 8 aa, Mycobacterium
GAVSARSF

SEQ ID NO: 1160857 - protein, 10 aa, Mycobacterium
GAVSTRAAGV

SEQ ID NO: 1160858 - protein, 10 aa, Mycobacterium
GAVTASPGDV

SEQ ID NO: 1160859 - protein, 16 aa, Mycobacterium
GAVTEGADADPTDSVD

SEQ ID NO: 1160860 - protein, 10 aa, Mycobacterium
GAVTEGTTVC

SEQ ID NO: 1160861 - protein, 12 aa, Mycobacterium
GAVTGEMLVLRH

SEQ ID NO: 1160862 - protein, 6 aa, Mycobacterium
GAVTPA

SEQ ID NO: 1160863 - protein, 18 aa, Mycobacterium
GAVVGGSSRLGGQTPTQL

SEQ ID NO: 1160864 - protein, 7 aa, Mycobacterium
GAYPTPY

SEQ ID NO: 1160865 - protein, 12 aa, Mycobacterium
GAYQSSYAPGTL

SEQ ID NO: 1160866 - protein, 5 aa, Mycobacterium
GCAAP

SEQ ID NO: 1160867 - protein, 8 aa, Mycobacterium
GCAEPEVQ

SEQ ID NO: 1160868 - protein, 4 aa, Mycobacterium
GCDA

SEQ ID NO: 1160869 - protein, 9 aa, Mycobacterium
GCGGSTATA

SEQ ID NO: 1160870 - protein, 5 aa, Mycobacterium
GCGID

SEQ ID NO: 1160871 - protein, 4 aa, Mycobacterium
GCPN

SEQ ID NO: 1160872 - protein, 6 aa, Mycobacterium
GCPREP

SEQ ID NO: 1160873 - protein, 11 aa, Mycobacterium
GCSGEALSDEG

SEQ ID NO: 1160874 - protein, 9 aa, Mycobacterium
GDAAATDAA

SEQ ID NO: 1160875 - protein, 9 aa, Mycobacterium
GDAAGTYVA

SEQ ID NO: 1160876 - protein, 10 aa, Mycobacterium
GDAAQRVTED

SEQ ID NO: 1160877 - protein, 5 aa, Mycobacterium
GDAAR

SEQ ID NO: 1160878 - protein, 6 aa, Mycobacterium
GDAASY

SEQ ID NO: 1160879 - protein, 7 aa, Mycobacterium
GDAATRE

SEQ ID NO: 1160880 - protein, 7 aa, Mycobacterium
GDAAYRD

SEQ ID NO: 1160881 - protein, 4 aa, Mycobacterium
GDAD

SEQ ID NO: 1160882 - protein, 18 aa, Mycobacterium
GDADDVGDTMAAGDEASV

SEQ ID NO: 1160883 - protein, 6 aa, Mycobacterium
GDADLP

SEQ ID NO: 1160884 - protein, 5 aa, Mycobacterium
GDAEG

SEQ ID NO: 1160885 - protein, 6 aa, Mycobacterium
GDAERQ

SEQ ID NO: 1160886 - protein, 8 aa, Mycobacterium
GDAGDKRA

SEQ ID NO: 1160887 - protein, 9 aa, Mycobacterium
GDAGPALTE

SEQ ID NO: 1160888 - protein, 12 aa, Mycobacterium
GDAKGPGKWTDS

SEQ ID NO: 1160889 - protein, 22 aa, Mycobacterium
GDALRPAPVGAYPAGASAYGAE

SEQ ID NO: 1160890 - protein, 7 aa, Mycobacterium
GDAMPSA

SEQ ID NO: 1160891 - protein, 14 aa, Mycobacterium
GDANDYVGKGLSGG

SEQ ID NO: 1160892 - protein, 8 aa, Mycobacterium
GDAPGGIA

SEQ ID NO: 1160893 - protein, 8 aa, Mycobacterium
GDAPPFGF

SEQ ID NO: 1160894 - protein, 4 aa, Mycobacterium
GDAQ

SEQ ID NO: 1160895 - protein, 8 aa, Mycobacterium
GDAQATAA

SEQ ID NO: 1160896 - protein, 7 aa, Mycobacterium
GDARAPS

SEQ ID NO: 1160897 - protein, 5 aa, Mycobacterium
GDARI

SEQ ID NO: 1160898 - protein, 10 aa, Mycobacterium
GDARPLSSGE

SEQ ID NO: 1160899 - protein, 5 aa, Mycobacterium
GDARR

SEQ ID NO: 1160900 - protein, 8 aa, Mycobacterium
GDARTGTD

SEQ ID NO: 1160901 - protein, 9 aa, Mycobacterium
GDASAPSDL

SEQ ID NO: 1160902 - protein, 16 aa, Mycobacterium
GDASGYSEVVAPVALA

SEQ ID NO: 1160903 - protein, 8 aa, Mycobacterium
GDATPGAL

SEQ ID NO: 1160904 - protein, 9 aa, Mycobacterium
GDATRRGKR

SEQ ID NO: 1160905 - protein, 6 aa, Mycobacterium
GDATVT

SEQ ID NO: 1160906 - protein, 8 aa, Mycobacterium
GDAVGGGA

SEQ ID NO: 1160907 - protein, 7 aa, Mycobacterium
GDAVTGA

SEQ ID NO: 1160908 - protein, 9 aa, Mycobacterium
GDAWKGRTP

SEQ ID NO: 1160909 - protein, 9 aa, Mycobacterium
GDAWPSAAG

SEQ ID NO: 1160910 - protein, 4 aa, Mycobacterium
GDDA

SEQ ID NO: 1160911 - protein, 19 aa, Mycobacterium
GDDAAEDELAERSTPATMP

SEQ ID NO: 1160912 - protein, 5 aa, Mycobacterium
GDDAL

SEQ ID NO: 1160913 - protein, 27 aa, Mycobacterium
GDDALGRGKAAQSKRSLTLTPRTADAD

SEQ ID NO: 1160914 - protein, 7 aa, Mycobacterium
GDDDGLT

SEQ ID NO: 1160915 - protein, 10 aa, Mycobacterium
GDDDLDDNRT

SEQ ID NO: 1160916 - protein, 7 aa, Mycobacterium
GDDDNEA

SEQ ID NO: 1160917 - protein, 9 aa, Mycobacterium
GDDDRMRNT

SEQ ID NO: 1160918 - protein, 9 aa, Mycobacterium
GDDEGGALQ

SEQ ID NO: 1160919 - protein, 4 aa, Mycobacterium
GDDG

SEQ ID NO: 1160920 - protein, 13 aa, Mycobacterium
GDDGAPVPHDGET

SEQ ID NO: 1160921 - protein, 8 aa, Mycobacterium
GDDGETFE

SEQ ID NO: 1160922 - protein, 6 aa, Mycobacterium
GDDGFD

SEQ ID NO: 1160923 - protein, 9 aa, Mycobacterium
GDDGNVEQS

SEQ ID NO: 1160924 - protein, 15 aa, Mycobacterium
GDDGRQLRSSLQGPE

SEQ ID NO: 1160925 - protein, 5 aa, Mycobacterium
GDDGS

SEQ ID NO: 1160926 - protein, 6 aa, Mycobacterium
GDDGVG

SEQ ID NO: 1160927 - protein, 5 aa, Mycobacterium
GDDIS

SEQ ID NO: 1160928 - protein, 4 aa, Mycobacterium
GDDL

SEQ ID NO: 1160929 - protein, 5 aa, Mycobacterium
GDDLR

SEQ ID NO: 1160930 - protein, 8 aa, Mycobacterium
GDDPAAGQ

SEQ ID NO: 1160931 - protein, 8 aa, Mycobacterium
GDDPGRAA

SEQ ID NO: 1160932 - protein, 9 aa, Mycobacterium
GDDPGSLTQ

SEQ ID NO: 1160933 - protein, 7 aa, Mycobacterium
GDDPWPA

SEQ ID NO: 1160934 - protein, 6 aa, Mycobacterium
GDDRIG

SEQ ID NO: 1160935 - protein, 10 aa, Mycobacterium
GDDSISEHDS

SEQ ID NO: 1160936 - protein, 14 aa, Mycobacterium
GDDSLAEPRAPYPH

SEQ ID NO: 1160937 - protein, 9 aa, Mycobacterium
GDDSPDHAQ

SEQ ID NO: 1160938 - protein, 4 aa, Mycobacterium
GDDT

SEQ ID NO: 1160939 - protein, 11 aa, Mycobacterium
GDDTAEAPAAY

SEQ ID NO: 1160940 - protein, 8 aa, Mycobacterium
GDDTCRPQ

SEQ ID NO: 1160941 - protein, 7 aa, Mycobacterium
GDDTYEG

SEQ ID NO: 1160942 - protein, 7 aa, Mycobacterium
GDEATGT

SEQ ID NO: 1160943 - protein, 4 aa, Mycobacterium
GDED

SEQ ID NO: 1160944 - protein, 13 aa, Mycobacterium
GDEDELREQAGPL

SEQ ID NO: 1160945 - protein, 12 aa, Mycobacterium
GDEGDDDSGPDL

SEQ ID NO: 1160946 - protein, 7 aa, Mycobacterium
GDEGQDR

SEQ ID NO: 1160947 - protein, 14 aa, Mycobacterium
GDEGQSIDDVRSGV

SEQ ID NO: 1160948 - protein, 5 aa, Mycobacterium
GDEHA

SEQ ID NO: 1160949 - protein, 13 aa, Mycobacterium
GDELATQGRIDEE

SEQ ID NO: 1160950 - protein, 7 aa, Mycobacterium
GDELTDD

SEQ ID NO: 1160951 - protein, 8 aa, Mycobacterium
GDEPARRL

SEQ ID NO: 1160952 - protein, 16 aa, Mycobacterium
GDEPDNPTNDRQAQRL

SEQ ID NO: 1160953 - protein, 10 aa, Mycobacterium
GDEPEGPGHK

SEQ ID NO: 1160954 - protein, 11 aa, Mycobacterium
GDEPMTGPQRS

SEQ ID NO: 1160955 - protein, 21 aa, Mycobacterium
GDEPREGRATLRRKQARQAAR

SEQ ID NO: 1160956 - protein, 8 aa, Mycobacterium
GDEPSGED

SEQ ID NO: 1160957 - protein, 9 aa, Mycobacterium
GDEPVRDDV

SEQ ID NO: 1160958 - protein, 4 aa, Mycobacterium
GDER

SEQ ID NO: 1160959 - protein, 5 aa, Mycobacterium
GDERL

SEQ ID NO: 1160960 - protein, 6 aa, Mycobacterium
GDERQA

SEQ ID NO: 1160961 - protein, 8 aa, Mycobacterium
GDERSAAL

SEQ ID NO: 1160962 - protein, 5 aa, Mycobacterium
GDESL

SEQ ID NO: 1160963 - protein, 16 aa, Mycobacterium
GDETLPLTGERTIPGL

SEQ ID NO: 1160964 - protein, 14 aa, Mycobacterium
GDEVLDEDSSQGTG

SEQ ID NO: 1160965 - protein, 7 aa, Mycobacterium
GDEVPSD

SEQ ID NO: 1160966 - protein, 7 aa, Mycobacterium
GDEVTGY

SEQ ID NO: 1160967 - protein, 5 aa, Mycobacterium
GDEYA

SEQ ID NO: 1160968 - protein, 4 aa, Mycobacterium
GDFD

SEQ ID NO: 1160969 - protein, 5 aa, Mycobacterium
GDFGS

SEQ ID NO: 1160970 - protein, 9 aa, Mycobacterium
GDGAYTGAG

SEQ ID NO: 1160971 - protein, 8 aa, Mycobacterium
GDGDATRV

SEQ ID NO: 1160972 - protein, 11 aa, Mycobacterium
GDGDGPRATAR

SEQ ID NO: 1160973 - protein, 6 aa, Mycobacterium
GDGDGT

SEQ ID NO: 1160974 - protein, 7 aa, Mycobacterium
GDGDPGV

SEQ ID NO: 1160975 - protein, 9 aa, Mycobacterium
GDGDTDTAD

SEQ ID NO: 1160976 - protein, 8 aa, Mycobacterium
GDGDVPPE

SEQ ID NO: 1160977 - protein, 4 aa, Mycobacterium
GDGE

SEQ ID NO: 1160978 - protein, 7 aa, Mycobacterium
GDGEEGY

SEQ ID NO: 1160979 - protein, 7 aa, Mycobacterium
GDGEVKT

SEQ ID NO: 1160980 - protein, 4 aa, Mycobacterium
GDGF

SEQ ID NO: 1160981 - protein, 9 aa, Mycobacterium
GDGFTPSAS

SEQ ID NO: 1160982 - protein, 5 aa, Mycobacterium
GDGGG

SEQ ID NO: 1160983 - protein, 8 aa, Mycobacterium
GDGGLGDR

SEQ ID NO: 1160984 - protein, 8 aa, Mycobacterium
GDGKAEAV

SEQ ID NO: 1160985 - protein, 9 aa, Mycobacterium
GDGLPPAEP

SEQ ID NO: 1160986 - protein, 14 aa, Mycobacterium
GDGNKKLSKRDPQS

SEQ ID NO: 1160987 - protein, 5 aa, Mycobacterium
GDGPA

SEQ ID NO: 1160988 - protein, 9 aa, Mycobacterium
GDGPSSTTT

SEQ ID NO: 1160989 - protein, 10 aa, Mycobacterium
GDGQWSRQED

SEQ ID NO: 1160990 - protein, 4 aa, Mycobacterium
GDGR

SEQ ID NO: 1160991 - protein, 5 aa, Mycobacterium
GDGRC

SEQ ID NO: 1160992 - protein, 8 aa, Mycobacterium
GDGREAAR

SEQ ID NO: 1160993 - protein, 9 aa, Mycobacterium
GDGRGRGLG

SEQ ID NO: 1160994 - protein, 13 aa, Mycobacterium
GDGRGYDVRPDVT

SEQ ID NO: 1160995 - protein, 5 aa, Mycobacterium
GDGRM

SEQ ID NO: 1160996 - protein, 14 aa, Mycobacterium
GDGRPSTAPALDRD

SEQ ID NO: 1160997 - protein, 8 aa, Mycobacterium
GDGRSRLR

SEQ ID NO: 1160998 - protein, 7 aa, Mycobacterium
GDGSVSQ

SEQ ID NO: 1160999 - protein, 8 aa, Mycobacterium
GDGTQGGY

SEQ ID NO: 1161000 - protein, 7 aa, Mycobacterium
GDGTRTR

SEQ ID NO: 1161001 - protein, 12 aa, Mycobacterium
GDGTTKEPDPSR

SEQ ID NO: 1161002 - protein, 5 aa, Mycobacterium
GDGVA

SEQ ID NO: 1161003 - protein, 16 aa, Mycobacterium
GDGVEDDAAVLALGVP

SEQ ID NO: 1161004 - protein, 14 aa, Mycobacterium
GDGVGSGRAERRDG

SEQ ID NO: 1161005 - protein, 23 aa, Mycobacterium
GDGVRRRPKDRKAQIARASAEAF

SEQ ID NO: 1161006 - protein, 15 aa, Mycobacterium
GDGVTADSNGVPLAE

SEQ ID NO: 1161007 - protein, 4 aa, Mycobacterium
GDHE

SEQ ID NO: 1161008 - protein, 20 aa, Mycobacterium
GDHGTRVEHRQPGGDANPYL

SEQ ID NO: 1161009 - protein, 9 aa, Mycobacterium
GDHHRTTKD

SEQ ID NO: 1161010 - protein, 6 aa, Mycobacterium
GDINAA

SEQ ID NO: 1161011 - protein, 14 aa, Mycobacterium
GDIPRRSARRFPDK

SEQ ID NO: 1161012 - protein, 26 aa, Mycobacterium
GDIRPRGDVKSVPRAGRLGQPGGRRD

SEQ ID NO: 1161013 - protein, 4 aa, Mycobacterium
GDIT

SEQ ID NO: 1161014 - protein, 8 aa, Mycobacterium
GDKGEPCW

SEQ ID NO: 1161015 - protein, 24 aa, Mycobacterium
GDKGEYRPAATDQPEEGVYSSPAE

SEQ ID NO: 1161016 - protein, 9 aa, Mycobacterium
GDKPEDTEL

SEQ ID NO: 1161017 - protein, 7 aa, Mycobacterium
GDKQGLG

SEQ ID NO: 1161018 - protein, 8 aa, Mycobacterium
GDKQHQRG

SEQ ID NO: 1161019 - protein, 12 aa, Mycobacterium
GDKTTQTATNGG

SEQ ID NO: 1161020 - protein, 4 aa, Mycobacterium
GDLA

SEQ ID NO: 1161021 - protein, 4 aa, Mycobacterium
GDLD

SEQ ID NO: 1161022 - protein, 23 aa, Mycobacterium
GDLDEQKHRGRTGWKAVGLPWKQ

SEQ ID NO: 1161023 - protein, 5 aa, Mycobacterium
GDLDP

SEQ ID NO: 1161024 - protein, 15 aa, Mycobacterium
GDLGEAGTNAHHGSG

SEQ ID NO: 1161025 - protein, 14 aa, Mycobacterium
GDLGGDPQKVNPLA

SEQ ID NO: 1161026 - protein, 11 aa, Mycobacterium
GDLGSSAARKY

SEQ ID NO: 1161027 - protein, 10 aa, Mycobacterium
GDLPPGPPFS

SEQ ID NO: 1161028 - protein, 15 aa, Mycobacterium
GDLQPADHTNDNPSW

SEQ ID NO: 1161029 - protein, 14 aa, Mycobacterium
GDLSEEVSKGDKTF

SEQ ID NO: 1161030 - protein, 31 aa, Mycobacterium
GDLSGLARPGEPGEKVSERAADTGDAWTPTA

SEQ ID NO: 1161031 - protein, 9 aa, Mycobacterium
GDLSNPAEN

SEQ ID NO: 1161032 - protein, 19 aa, Mycobacterium
GDLTPTDLDPDATGGAGNM

SEQ ID NO: 1161033 - protein, 5 aa, Mycobacterium
GDLVP

SEQ ID NO: 1161034 - protein, 5 aa, Mycobacterium
GDMAR

SEQ ID NO: 1161035 - protein, 8 aa, Mycobacterium
GDNAGVMP

SEQ ID NO: 1161036 - protein, 7 aa, Mycobacterium
GDNDTAR

SEQ ID NO: 1161037 - protein, 5 aa, Mycobacterium
GDNEF

SEQ ID NO: 1161038 - protein, 8 aa, Mycobacterium
GDNLAHPR

SEQ ID NO: 1161039 - protein, 10 aa, Mycobacterium
GDPAPTDQLD

SEQ ID NO: 1161040 - protein, 6 aa, Mycobacterium
GDPAPV

SEQ ID NO: 1161041 - protein, 8 aa, Mycobacterium
GDPATLTG

SEQ ID NO: 1161042 - protein, 8 aa, Mycobacterium
GDPDPRHV

SEQ ID NO: 1161043 - protein, 15 aa, Mycobacterium
GDPDSRNDDDSADCM

SEQ ID NO: 1161044 - protein, 9 aa, Mycobacterium
GDPDTGGDE

SEQ ID NO: 1161045 - protein, 6 aa, Mycobacterium
GDPEDI

SEQ ID NO: 1161046 - protein, 11 aa, Mycobacterium
GDPEDPDTDLG

SEQ ID NO: 1161047 - protein, 7 aa, Mycobacterium
GDPEPLR

SEQ ID NO: 1161048 - protein, 4 aa, Mycobacterium
GDPF

SEQ ID NO: 1161049 - protein, 7 aa, Mycobacterium
GDPGNPP

SEQ ID NO: 1161050 - protein, 7 aa, Mycobacterium
GDPGYTE

SEQ ID NO: 1161051 - protein, 13 aa, Mycobacterium
GDPHNDDDIATAV

SEQ ID NO: 1161052 - protein, 18 aa, Mycobacterium
GDPLESAGASGGNGFGAG

SEQ ID NO: 1161053 - protein, 5 aa, Mycobacterium
GDPLP

SEQ ID NO: 1161054 - protein, 24 aa, Mycobacterium
GDPNDLAEHGKGAPIGRAADPREI

SEQ ID NO: 1161055 - protein, 10 aa, Mycobacterium
GDPNELSEER

SEQ ID NO: 1161056 - protein, 5 aa, Mycobacterium
GDPNH

SEQ ID NO: 1161057 - protein, 6 aa, Mycobacterium
GDPPAR

SEQ ID NO: 1161058 - protein, 7 aa, Mycobacterium
GDPPTEL

SEQ ID NO: 1161059 - protein, 10 aa, Mycobacterium
GDPQAPTPAL

SEQ ID NO: 1161060 - protein, 10 aa, Mycobacterium
GDPQDPRTEV

SEQ ID NO: 1161061 - protein, 19 aa, Mycobacterium
GDPSDGLPGVPGVGEKTAA

SEQ ID NO: 1161062 - protein, 16 aa, Mycobacterium
GDPSQKSDDVSGSGSY

SEQ ID NO: 1161063 - protein, 8 aa, Mycobacterium
GDPSRDRD

SEQ ID NO: 1161064 - protein, 9 aa, Mycobacterium
GDPSVPSGV

SEQ ID NO: 1161065 - protein, 6 aa, Mycobacterium
GDPTLP

SEQ ID NO: 1161066 - protein, 8 aa, Mycobacterium
GDPTRESF

SEQ ID NO: 1161067 - protein, 12 aa, Mycobacterium
GDPTTATGADGA

SEQ ID NO: 1161068 - protein, 5 aa, Mycobacterium
GDPYT

SEQ ID NO: 1161069 - protein, 7 aa, Mycobacterium
GDQAQEF

SEQ ID NO: 1161070 - protein, 14 aa, Mycobacterium
GDQDPEFAGNDAIG

SEQ ID NO: 1161071 - protein, 8 aa, Mycobacterium
GDQETALD

SEQ ID NO: 1161072 - protein, 5 aa, Mycobacterium
GDQHS

SEQ ID NO: 1161073 - protein, 16 aa, Mycobacterium
GDQKETNYALRAPDKA

SEQ ID NO: 1161074 - protein, 28 aa, Mycobacterium
GDQRIRGRSGYQYAAGETAETVDPARAG

SEQ ID NO: 1161075 - protein, 4 aa, Mycobacterium
GDRA

SEQ ID NO: 1161076 - protein, 11 aa, Mycobacterium
GDRAAQTGEQI

SEQ ID NO: 1161077 - protein, 5 aa, Mycobacterium
GDRAD

SEQ ID NO: 1161078 - protein, 6 aa, Mycobacterium
GDRAFS

SEQ ID NO: 1161079 - protein, 10 aa, Mycobacterium
GDRAPQTGAE

SEQ ID NO: 1161080 - protein, 7 aa, Mycobacterium
GDRDHRI

SEQ ID NO: 1161081 - protein, 5 aa, Mycobacterium
GDRDR

SEQ ID NO: 1161082 - protein, 6 aa, Mycobacterium
GDRDRN

SEQ ID NO: 1161083 - protein, 18 aa, Mycobacterium
GDRGPRTVAERTEELQNT

SEQ ID NO: 1161084 - protein, 10 aa, Mycobacterium
GDRGRRADDA

SEQ ID NO: 1161085 - protein, 7 aa, Mycobacterium
GDRNPLH

SEQ ID NO: 1161086 - protein, 9 aa, Mycobacterium
GDRNPPVFD

SEQ ID NO: 1161087 - protein, 6 aa, Mycobacterium
GDRNST

SEQ ID NO: 1161088 - protein, 8 aa, Mycobacterium
GDRQPEAE

SEQ ID NO: 1161089 - protein, 5 aa, Mycobacterium
GDRRD

SEQ ID NO: 1161090 - protein, 10 aa, Mycobacterium
GDRRDNDRGR

SEQ ID NO: 1161091 - protein, 8 aa, Mycobacterium
GDRRHRTR

SEQ ID NO: 1161092 - protein, 9 aa, Mycobacterium
GDRSGSQRF

SEQ ID NO: 1161093 - protein, 8 aa, Mycobacterium
GDSAGGGL

SEQ ID NO: 1161094 - protein, 9 aa, Mycobacterium
GDSAGGSLA

SEQ ID NO: 1161095 - protein, 18 aa, Mycobacterium
GDSAPPARPLIIDRITAT

SEQ ID NO: 1161096 - protein, 8 aa, Mycobacterium
GDSARAHQ

SEQ ID NO: 1161097 - protein, 8 aa, Mycobacterium
GDSATATA

SEQ ID NO: 1161098 - protein, 6 aa, Mycobacterium
GDSDMW

SEQ ID NO: 1161099 - protein, 6 aa, Mycobacterium
GDSDPY

SEQ ID NO: 1161100 - protein, 8 aa, Mycobacterium
GDSDSDQS

SEQ ID NO: 1161101 - protein, 9 aa, Mycobacterium
GDSEDDVAA

SEQ ID NO: 1161102 - protein, 7 aa, Mycobacterium
GDSEDGA

SEQ ID NO: 1161103 - protein, 6 aa, Mycobacterium
GDSGAP

SEQ ID NO: 1161104 - protein, 8 aa, Mycobacterium
GDSGDVER

SEQ ID NO: 1161105 - protein, 15 aa, Mycobacterium
GDSGRGSRNSSRADS

SEQ ID NO: 1161106 - protein, 7 aa, Mycobacterium
GDSGSAA

SEQ ID NO: 1161107 - protein, 11 aa, Mycobacterium
GDSHISGREVE

SEQ ID NO: 1161108 - protein, 11 aa, Mycobacterium
GDSLGNGQSHD

SEQ ID NO: 1161109 - protein, 6 aa, Mycobacterium
GDSPGA

SEQ ID NO: 1161110 - protein, 7 aa, Mycobacterium
GDSPRHD

SEQ ID NO: 1161111 - protein, 8 aa, Mycobacterium
GDSRDGQS

SEQ ID NO: 1161112 - protein, 9 aa, Mycobacterium
GDSTSGQAT

SEQ ID NO: 1161113 - protein, 6 aa, Mycobacterium
GDSVEV

SEQ ID NO: 1161114 - protein, 8 aa, Mycobacterium
GDSVGAKQ

SEQ ID NO: 1161115 - protein, 14 aa, Mycobacterium
GDTAHVDTDGDGRW

SEQ ID NO: 1161116 - protein, 6 aa, Mycobacterium
GDTDEF

SEQ ID NO: 1161117 - protein, 9 aa, Mycobacterium
GDTDGDRQT

SEQ ID NO: 1161118 - protein, 5 aa, Mycobacterium
GDTDL

SEQ ID NO: 1161119 - protein, 9 aa, Mycobacterium
GDTDQTPFG

SEQ ID NO: 1161120 - protein, 10 aa, Mycobacterium
GDTEDKPEVA

SEQ ID NO: 1161121 - protein, 9 aa, Mycobacterium
GDTGPDAGP

SEQ ID NO: 1161122 - protein, 12 aa, Mycobacterium
GDTIDGHPRSRS

SEQ ID NO: 1161123 - protein, 6 aa, Mycobacterium
GDTKPD

SEQ ID NO: 1161124 - protein, 12 aa, Mycobacterium
GDTPIDEAVAAG

SEQ ID NO: 1161125 - protein, 51 aa, Mycobacterium
GDTPQRDKAKPRQNAGAPRPQQKRNPKRDNDRREKAPSGSMAQALRDAGFG

SEQ ID NO: 1161126 - protein, 8 aa, Mycobacterium
GDTRNRGN

SEQ ID NO: 1161127 - protein, 16 aa, Mycobacterium
GDTSEQLDDWSPLAQA

SEQ ID NO: 1161128 - protein, 8 aa, Mycobacterium
GDTSGMDS

SEQ ID NO: 1161129 - protein, 6 aa, Mycobacterium
GDTTDD

SEQ ID NO: 1161130 - protein, 7 aa, Mycobacterium
GDTTKIA

SEQ ID NO: 1161131 - protein, 5 aa, Mycobacterium
GDTTT

SEQ ID NO: 1161132 - protein, 8 aa, Mycobacterium
GDTVSAGQ

SEQ ID NO: 1161133 - protein, 6 aa, Mycobacterium
GDVDGA

SEQ ID NO: 1161134 - protein, 11 aa, Mycobacterium
GDVDRAGHEAG

SEQ ID NO: 1161135 - protein, 14 aa, Mycobacterium
GDVERSDPLSGLSA

SEQ ID NO: 1161136 - protein, 8 aa, Mycobacterium
GDVGETTL

SEQ ID NO: 1161137 - protein, 12 aa, Mycobacterium
GDVGRARAEAQR

SEQ ID NO: 1161138 - protein, 6 aa, Mycobacterium
GDVNES

SEQ ID NO: 1161139 - protein, 7 aa, Mycobacterium
GDVPGGG

SEQ ID NO: 1161140 - protein, 4 aa, Mycobacterium
GDVR

SEQ ID NO: 1161141 - protein, 7 aa, Mycobacterium
GDVRDGV

SEQ ID NO: 1161142 - protein, 9 aa, Mycobacterium
GDVRGGAPA

SEQ ID NO: 1161143 - protein, 14 aa, Mycobacterium
GDVTSIGPAEDADV

SEQ ID NO: 1161144 - protein, 9 aa, Mycobacterium
GDWPGATAR

SEQ ID NO: 1161145 - protein, 4 aa, Mycobacterium
GDWT

SEQ ID NO: 1161146 - protein, 6 aa, Mycobacterium
GDYASS

SEQ ID NO: 1161147 - protein, 11 aa, Mycobacterium
GDYDSYRPTFA

SEQ ID NO: 1161148 - protein, 9 aa, Mycobacterium
GDYPDHEAN

SEQ ID NO: 1161149 - protein, 5 aa, Mycobacterium
GDYPR

SEQ ID NO: 1161150 - protein, 7 aa, Mycobacterium
GDYQAAA

SEQ ID NO: 1161151 - protein, 9 aa, Mycobacterium
GEAAEASGA

SEQ ID NO: 1161152 - protein, 6 aa, Mycobacterium
GEAALS

SEQ ID NO: 1161153 - protein, 8 aa, Mycobacterium
GEAATPAA

SEQ ID NO: 1161154 - protein, 5 aa, Mycobacterium
GEACG

SEQ ID NO: 1161155 - protein, 19 aa, Mycobacterium
GEADRKRRALTRDGDTYEP

SEQ ID NO: 1161156 - protein, 8 aa, Mycobacterium
GEAEIAPG

SEQ ID NO: 1161157 - protein, 14 aa, Mycobacterium
GEAEPAGRPADPPF

SEQ ID NO: 1161158 - protein, 10 aa, Mycobacterium
GEAFGSPDDL

SEQ ID NO: 1161159 - protein, 6 aa, Mycobacterium
GEAGAE

SEQ ID NO: 1161160 - protein, 11 aa, Mycobacterium
GEAGDRQVEGA

SEQ ID NO: 1161161 - protein, 9 aa, Mycobacterium
GEAGERFDT

SEQ ID NO: 1161162 - protein, 8 aa, Mycobacterium
GEAGLPPG

SEQ ID NO: 1161163 - protein, 7 aa, Mycobacterium
GEAGRIE

SEQ ID NO: 1161164 - protein, 7 aa, Mycobacterium
GEAGRPV

SEQ ID NO: 1161165 - protein, 8 aa, Mycobacterium
GEAHEQRA

SEQ ID NO: 1161166 - protein, 9 aa, Mycobacterium
GEAHRDGPQ

SEQ ID NO: 1161167 - protein, 32 aa, Mycobacterium
GEALPSGGATPAASPATPAANPAQQAPENPLS

SEQ ID NO: 1161168 - protein, 9 aa, Mycobacterium
GEANPRTRS

SEQ ID NO: 1161169 - protein, 26 aa, Mycobacterium
GEAPGPTELNPPDPVTTSTKPSDVDA

SEQ ID NO: 1161170 - protein, 8 aa, Mycobacterium
GEARPEPM

SEQ ID NO: 1161171 - protein, 21 aa, Mycobacterium
GEASDAQAQAQQQWEDGAEQM

SEQ ID NO: 1161172 - protein, 7 aa, Mycobacterium
GEASHRE

SEQ ID NO: 1161173 - protein, 6 aa, Mycobacterium
GEATDA

SEQ ID NO: 1161174 - protein, 9 aa, Mycobacterium
GEATPAGGM

SEQ ID NO: 1161175 - protein, 5 aa, Mycobacterium
GEAVE

SEQ ID NO: 1161176 - protein, 7 aa, Mycobacterium
GEAVGSG

SEQ ID NO: 1161177 - protein, 14 aa, Mycobacterium
GEAVTTDDDAVPGP

SEQ ID NO: 1161178 - protein, 30 aa, Mycobacterium
GEDAAPRSPDTGDPLTVTTTTSATDDRPPV

SEQ ID NO: 1161179 - protein, 9 aa, Mycobacterium
GEDAGTPVS

SEQ ID NO: 1161180 - protein, 4 aa, Mycobacterium
GEDE

SEQ ID NO: 1161181 - protein, 8 aa, Mycobacterium
GEDEAPAL

SEQ ID NO: 1161182 - protein, 10 aa, Mycobacterium
GEDGIRNSTS

SEQ ID NO: 1161183 - protein, 5 aa, Mycobacterium
GEDGK

SEQ ID NO: 1161184 - protein, 9 aa, Mycobacterium
GEDGSRLAG

SEQ ID NO: 1161185 - protein, 7 aa, Mycobacterium
GEDGVGS

SEQ ID NO: 1161186 - protein, 4 aa, Mycobacterium
GEDI

SEQ ID NO: 1161187 - protein, 9 aa, Mycobacterium
GEDLESGDL

SEQ ID NO: 1161188 - protein, 5 aa, Mycobacterium
GEDPC

SEQ ID NO: 1161189 - protein, 8 aa, Mycobacterium
GEDPDVDE

SEQ ID NO: 1161190 - protein, 6 aa, Mycobacterium
GEDPGN

SEQ ID NO: 1161191 - protein, 12 aa, Mycobacterium
GEDPPDDGVAEP

SEQ ID NO: 1161192 - protein, 9 aa, Mycobacterium
GEDSERLTG

SEQ ID NO: 1161193 - protein, 13 aa, Mycobacterium
GEDSGVHGTTESA

SEQ ID NO: 1161194 - protein, 4 aa, Mycobacterium
GEDV

SEQ ID NO: 1161195 - protein, 10 aa, Mycobacterium
GEDVASRPER

SEQ ID NO: 1161196 - protein, 5 aa, Mycobacterium
GEDVR

SEQ ID NO: 1161197 - protein, 11 aa, Mycobacterium
GEEAVKELGDR

SEQ ID NO: 1161198 - protein, 8 aa, Mycobacterium
GEEDADTL

SEQ ID NO: 1161199 - protein, 7 aa, Mycobacterium
GEEDDRI

SEQ ID NO: 1161200 - protein, 7 aa, Mycobacterium
GEEDRLR

SEQ ID NO: 1161201 - protein, 14 aa, Mycobacterium
GEEEGGAADAGAGQ

SEQ ID NO: 1161202 - protein, 13 aa, Mycobacterium
GEEGVEQDTPDFK

SEQ ID NO: 1161203 - protein, 8 aa, Mycobacterium
GEEITGEA

SEQ ID NO: 1161204 - protein, 6 aa, Mycobacterium
GEENKD

SEQ ID NO: 1161205 - protein, 7 aa, Mycobacterium
GEEPTTV

SEQ ID NO: 1161206 - protein, 7 aa, Mycobacterium
GEERDTA

SEQ ID NO: 1161207 - protein, 9 aa, Mycobacterium
GEEREAKST

SEQ ID NO: 1161208 - protein, 5 aa, Mycobacterium
GEERH

SEQ ID NO: 1161209 - protein, 8 aa, Mycobacterium
GEESAGQV

SEQ ID NO: 1161210 - protein, 9 aa, Mycobacterium
GEEYGGADI

SEQ ID NO: 1161211 - protein, 18 aa, Mycobacterium
GEFDRAERAQSRASADNA

SEQ ID NO: 1161212 - protein, 9 aa, Mycobacterium
GEFSSQPSG

SEQ ID NO: 1161213 - protein, 12 aa, Mycobacterium
GEFTGRAVITPN

SEQ ID NO: 1161214 - protein, 7 aa, Mycobacterium
GEGAGSV

SEQ ID NO: 1161215 - protein, 11 aa, Mycobacterium
GEGALTESGYP

SEQ ID NO: 1161216 - protein, 17 aa, Mycobacterium
GEGAPGRRSRARNRTGT

SEQ ID NO: 1161217 - protein, 15 aa, Mycobacterium
GEGDSTADTSRAGSP

SEQ ID NO: 1161218 - protein, 9 aa, Mycobacterium
GEGEAPKLI

SEQ ID NO: 1161219 - protein, 12 aa, Mycobacterium
GEGEGRGPHGDY

SEQ ID NO: 1161220 - protein, 8 aa, Mycobacterium
GEGEQAVQ

SEQ ID NO: 1161221 - protein, 77 aa, Mycobacterium
GEGGEDSGDSSDDSSSDEDEDEEPAEEAESETTSEESDSSEETDSSEETESEPEPEPEPKKESKPKPKSSGSATPVT

SEQ ID NO: 1161222 - protein, 25 aa, Mycobacterium
GEGGFGGERGPSTSVEPPERAPDAE

SEQ ID NO: 1161223 - protein, 25 aa, Mycobacterium
GEGGFGGQPGTRPQAPEIPEREPDA

SEQ ID NO: 1161224 - protein, 7 aa, Mycobacterium
GEGITPP

SEQ ID NO: 1161225 - protein, 7 aa, Mycobacterium
GEGLPAG

SEQ ID NO: 1161226 - protein, 4 aa, Mycobacterium
GEGN

SEQ ID NO: 1161227 - protein, 4 aa, Mycobacterium
GEGP

SEQ ID NO: 1161228 - protein, 6 aa, Mycobacterium
GEGRAA

SEQ ID NO: 1161229 - protein, 7 aa, Mycobacterium
GEGTGAA

SEQ ID NO: 1161230 - protein, 10 aa, Mycobacterium
GEGVDPGRVG

SEQ ID NO: 1161231 - protein, 14 aa, Mycobacterium
GEGVDSAAISATYE

SEQ ID NO: 1161232 - protein, 7 aa, Mycobacterium
GEGVSHT

SEQ ID NO: 1161233 - protein, 12 aa, Mycobacterium
GEHGSTFGGNPL

SEQ ID NO: 1161234 - protein, 7 aa, Mycobacterium
GEHGTDA

SEQ ID NO: 1161235 - protein, 7 aa, Mycobacterium
GEHPDWD

SEQ ID NO: 1161236 - protein, 7 aa, Mycobacterium
GEHPDWS

SEQ ID NO: 1161237 - protein, 6 aa, Mycobacterium
GEHRQR

SEQ ID NO: 1161238 - protein, 8 aa, Mycobacterium
GEHTNRPT

SEQ ID NO: 1161239 - protein, 5 aa, Mycobacterium
GEIDG

SEQ ID NO: 1161240 - protein, 7 aa, Mycobacterium
GEIEAAD

SEQ ID NO: 1161241 - protein, 20 aa, Mycobacterium
GEISDNYRGQFAERGVEVVV

SEQ ID NO: 1161242 - protein, 8 aa, Mycobacterium
GEITDAQS

SEQ ID NO: 1161243 - protein, 12 aa, Mycobacterium
GEKGTAKSTAVR

SEQ ID NO: 1161244 - protein, 9 aa, Mycobacterium
GEKHNGVKP

SEQ ID NO: 1161245 - protein, 8 aa, Mycobacterium
GEKMSKSI

SEQ ID NO: 1161246 - protein, 9 aa, Mycobacterium
GEKPPPDNL

SEQ ID NO: 1161247 - protein, 9 aa, Mycobacterium
GEKPQGNSL

SEQ ID NO: 1161248 - protein, 7 aa, Mycobacterium
GEKPRGA

SEQ ID NO: 1161249 - protein, 8 aa, Mycobacterium
GEKPVPNK

SEQ ID NO: 1161250 - protein, 7 aa, Mycobacterium
GEKRDYL

SEQ ID NO: 1161251 - protein, 12 aa, Mycobacterium
GELAPPDGTVPA

SEQ ID NO: 1161252 - protein, 8 aa, Mycobacterium
GELDESGR

SEQ ID NO: 1161253 - protein, 8 aa, Mycobacterium
GELGERNG

SEQ ID NO: 1161254 - protein, 9 aa, Mycobacterium
GELGGPGAA

SEQ ID NO: 1161255 - protein, 17 aa, Mycobacterium
GELGPDGEEGSDDYRSR

SEQ ID NO: 1161256 - protein, 8 aa, Mycobacterium
GELGRTAG

SEQ ID NO: 1161257 - protein, 6 aa, Mycobacterium
GELGSP

SEQ ID NO: 1161258 - protein, 7 aa, Mycobacterium
GELGTHN

SEQ ID NO: 1161259 - protein, 9 aa, Mycobacterium
GELNADKTN

SEQ ID NO: 1161260 - protein, 8 aa, Mycobacterium
GELPPGVS

SEQ ID NO: 1161261 - protein, 14 aa, Mycobacterium
GELPRDSVSDLVTL

SEQ ID NO: 1161262 - protein, 4 aa, Mycobacterium
GELS

SEQ ID NO: 1161263 - protein, 9 aa, Mycobacterium
GELSGGQRQ

SEQ ID NO: 1161264 - protein, 5 aa, Mycobacterium
GELTA

SEQ ID NO: 1161265 - protein, 16 aa, Mycobacterium
GELTAAEAAGAKYKAT

SEQ ID NO: 1161266 - protein, 8 aa, Mycobacterium
GELTGSGR

SEQ ID NO: 1161267 - protein, 8 aa, Mycobacterium
GEMPDGSR

SEQ ID NO: 1161268 - protein, 13 aa, Mycobacterium
GEMSPGQGIVLVH

SEQ ID NO: 1161269 - protein, 11 aa, Mycobacterium
GEMTPEQEQEF

SEQ ID NO: 1161270 - protein, 9 aa, Mycobacterium
GEMVPTGDD

SEQ ID NO: 1161271 - protein, 12 aa, Mycobacterium
GENDLDHPKRTS

SEQ ID NO: 1161272 - protein, 4 aa, Mycobacterium
GENG

SEQ ID NO: 1161273 - protein, 9 aa, Mycobacterium
GENPGRDSL

SEQ ID NO: 1161274 - protein, 6 aa, Mycobacterium
GENPHA

SEQ ID NO: 1161275 - protein, 4 aa, Mycobacterium
GEPA

SEQ ID NO: 1161276 - protein, 19 aa, Mycobacterium
GEPADGSEIGDGVRVAIAK

SEQ ID NO: 1161277 - protein, 6 aa, Mycobacterium
GEPAEV

SEQ ID NO: 1161278 - protein, 8 aa, Mycobacterium
GEPAKVSE

SEQ ID NO: 1161279 - protein, 6 aa, Mycobacterium
GEPATL

SEQ ID NO: 1161280 - protein, 11 aa, Mycobacterium
GEPDENGEEKI

SEQ ID NO: 1161281 - protein, 4 aa, Mycobacterium
GEPE

SEQ ID NO: 1161282 - protein, 7 aa, Mycobacterium
GEPEADD

SEQ ID NO: 1161283 - protein, 21 aa, Mycobacterium
GEPFEADGSANRGYKVRPKGG

SEQ ID NO: 1161284 - protein, 8 aa, Mycobacterium
GEPFEAST

SEQ ID NO: 1161285 - protein, 9 aa, Mycobacterium
GEPGAGKTA

SEQ ID NO: 1161286 - protein, 8 aa, Mycobacterium
GEPGAGTR

SEQ ID NO: 1161287 - protein, 15 aa, Mycobacterium
GEPGGPIATDESAKR

SEQ ID NO: 1161288 - protein, 18 aa, Mycobacterium
GEPGQPLDERRRPDSPMR

SEQ ID NO: 1161289 - protein, 5 aa, Mycobacterium
GEPGR

SEQ ID NO: 1161290 - protein, 6 aa, Mycobacterium
GEPGRG

SEQ ID NO: 1161291 - protein, 8 aa, Mycobacterium
GEPHPTRE

SEQ ID NO: 1161292 - protein, 8 aa, Mycobacterium
GEPIGPKA

SEQ ID NO: 1161293 - protein, 7 aa, Mycobacterium
GEPISPA

SEQ ID NO: 1161294 - protein, 4 aa, Mycobacterium
GEPL

SEQ ID NO: 1161295 - protein, 5 aa, Mycobacterium
GEPLD

SEQ ID NO: 1161296 - protein, 5 aa, Mycobacterium
GEPLN

SEQ ID NO: 1161297 - protein, 6 aa, Mycobacterium
GEPLNP

SEQ ID NO: 1161298 - protein, 13 aa, Mycobacterium
GEPLPAAAGKPRM

SEQ ID NO: 1161299 - protein, 14 aa, Mycobacterium
GEPLPADGVTPTGD

SEQ ID NO: 1161300 - protein, 9 aa, Mycobacterium
GEPLSQEEA

SEQ ID NO: 1161301 - protein, 7 aa, Mycobacterium
GEPLTGV

SEQ ID NO: 1161302 - protein, 6 aa, Mycobacterium
GEPPLE

SEQ ID NO: 1161303 - protein, 9 aa, Mycobacterium
GEPPLRADG

SEQ ID NO: 1161304 - protein, 6 aa, Mycobacterium
GEPQLQ

SEQ ID NO: 1161305 - protein, 6 aa, Mycobacterium
GEPRNN

SEQ ID NO: 1161306 - protein, 8 aa, Mycobacterium
GEPRSGTT

SEQ ID NO: 1161307 - protein, 6 aa, Mycobacterium
GEPSGG

SEQ ID NO: 1161308 - protein, 5 aa, Mycobacterium
GEPTV

SEQ ID NO: 1161309 - protein, 5 aa, Mycobacterium
GEPTY

SEQ ID NO: 1161310 - protein, 5 aa, Mycobacterium
GEPVA

SEQ ID NO: 1161311 - protein, 9 aa, Mycobacterium
GEPVTPTTT

SEQ ID NO: 1161312 - protein, 8 aa, Mycobacterium
GEQAPDAE

SEQ ID NO: 1161313 - protein, 5 aa, Mycobacterium
GEQEP

SEQ ID NO: 1161314 - protein, 9 aa, Mycobacterium
GEQFPTGRA

SEQ ID NO: 1161315 - protein, 7 aa, Mycobacterium
GEQRPGS

SEQ ID NO: 1161316 - protein, 6 aa, Mycobacterium
GEQSEV

SEQ ID NO: 1161317 - protein, 8 aa, Mycobacterium
GEQSSRPV

SEQ ID NO: 1161318 - protein, 6 aa, Mycobacterium
GEQTAV

SEQ ID NO: 1161319 - protein, 9 aa, Mycobacterium
GERDGRGTT

SEQ ID NO: 1161320 - protein, 21 aa, Mycobacterium
GERGAAVEAGKALARAESRHG

SEQ ID NO: 1161321 - protein, 9 aa, Mycobacterium
GERGEDARR

SEQ ID NO: 1161322 - protein, 6 aa, Mycobacterium
GERGRG

SEQ ID NO: 1161323 - protein, 4 aa, Mycobacterium
GERL

SEQ ID NO: 1161324 - protein, 5 aa, Mycobacterium
GERNP

SEQ ID NO: 1161325 - protein, 4 aa, Mycobacterium
GERR

SEQ ID NO: 1161326 - protein, 9 aa, Mycobacterium
GERRAGVTA

SEQ ID NO: 1161327 - protein, 5 aa, Mycobacterium
GERRE

SEQ ID NO: 1161328 - protein, 4 aa, Mycobacterium
GERS

SEQ ID NO: 1161329 - protein, 10 aa, Mycobacterium
GERSAADETA

SEQ ID NO: 1161330 - protein, 11 aa, Mycobacterium
GERSPNLPDAA

SEQ ID NO: 1161331 - protein, 6 aa, Mycobacterium
GERTDR

SEQ ID NO: 1161332 - protein, 15 aa, Mycobacterium
GERTVESLAGETGLS

SEQ ID NO: 1161333 - protein, 4 aa, Mycobacterium
GERV

SEQ ID NO: 1161334 - protein, 4 aa, Mycobacterium
GERY

SEQ ID NO: 1161335 - protein, 7 aa, Mycobacterium
GESAPRA

SEQ ID NO: 1161336 - protein, 6 aa, Mycobacterium
GESATG

SEQ ID NO: 1161337 - protein, 7 aa, Mycobacterium
GESATLD

SEQ ID NO: 1161338 - protein, 4 aa, Mycobacterium
GESD

SEQ ID NO: 1161339 - protein, 4 aa, Mycobacterium
GESF

SEQ ID NO: 1161340 - protein, 11 aa, Mycobacterium
GESGPARDLAA

SEQ ID NO: 1161341 - protein, 7 aa, Mycobacterium
GESGPVE

SEQ ID NO: 1161342 - protein, 9 aa, Mycobacterium
GESGSGKSM

SEQ ID NO: 1161343 - protein, 9 aa, Mycobacterium
GESGSGKST

SEQ ID NO: 1161344 - protein, 11 aa, Mycobacterium
GESGSGKSTVA

SEQ ID NO: 1161345 - protein, 9 aa, Mycobacterium
GESGSGKSV

SEQ ID NO: 1161346 - protein, 5 aa, Mycobacterium
GESID

SEQ ID NO: 1161347 - protein, 7 aa, Mycobacterium
GESKAPE

SEQ ID NO: 1161348 - protein, 8 aa, Mycobacterium
GESLGNDV

SEQ ID NO: 1161349 - protein, 11 aa, Mycobacterium
GESPKAAQQDS

SEQ ID NO: 1161350 - protein, 9 aa, Mycobacterium
GESPLQPLN

SEQ ID NO: 1161351 - protein, 7 aa, Mycobacterium
GESPREY

SEQ ID NO: 1161352 - protein, 10 aa, Mycobacterium
GESRSDSSSR

SEQ ID NO: 1161353 - protein, 7 aa, Mycobacterium
GESTENH

SEQ ID NO: 1161354 - protein, 8 aa, Mycobacterium
GESVPSAP

SEQ ID NO: 1161355 - protein, 8 aa, Mycobacterium
GETALGEK

SEQ ID NO: 1161356 - protein, 4 aa, Mycobacterium
GETD

SEQ ID NO: 1161357 - protein, 9 aa, Mycobacterium
GETDPREGG

SEQ ID NO: 1161358 - protein, 7 aa, Mycobacterium
GETEAGK

SEQ ID NO: 1161359 - protein, 22 aa, Mycobacterium
GETEDNEAGDGRESARSSFSAE

SEQ ID NO: 1161360 - protein, 8 aa, Mycobacterium
GETGEART

SEQ ID NO: 1161361 - protein, 7 aa, Mycobacterium
GETGRTD

SEQ ID NO: 1161362 - protein, 11 aa, Mycobacterium
GETHDGASTTD

SEQ ID NO: 1161363 - protein, 17 aa, Mycobacterium
GETKNTTRNIPTPKADR

SEQ ID NO: 1161364 - protein, 8 aa, Mycobacterium
GETRSYGD

SEQ ID NO: 1161365 - protein, 6 aa, Mycobacterium
GETRVA

SEQ ID NO: 1161366 - protein, 8 aa, Mycobacterium
GETSGHTQ

SEQ ID NO: 1161367 - protein, 8 aa, Mycobacterium
GETSVGKY

SEQ ID NO: 1161368 - protein, 5 aa, Mycobacterium
GETTE

SEQ ID NO: 1161369 - protein, 9 aa, Mycobacterium
GETTFGAGT

SEQ ID NO: 1161370 - protein, 16 aa, Mycobacterium
GETTKVSDLNAAEARR

SEQ ID NO: 1161371 - protein, 8 aa, Mycobacterium
GETTLRED

SEQ ID NO: 1161372 - protein, 6 aa, Mycobacterium
GETTSR

SEQ ID NO: 1161373 - protein, 7 aa, Mycobacterium
GETVRNG

SEQ ID NO: 1161374 - protein, 6 aa, Mycobacterium
GETYKT

SEQ ID NO: 1161375 - protein, 16 aa, Mycobacterium
GEVAGVGATQPPGGPH

SEQ ID NO: 1161376 - protein, 13 aa, Mycobacterium
GEVGNKKVYDPRS

SEQ ID NO: 1161377 - protein, 11 aa, Mycobacterium
GEVSDEAGKPV

SEQ ID NO: 1161378 - protein, 9 aa, Mycobacterium
GEVSGGDVD

SEQ ID NO: 1161379 - protein, 7 aa, Mycobacterium
GEVSPSA

SEQ ID NO: 1161380 - protein, 6 aa, Mycobacterium
GEYETA

SEQ ID NO: 1161381 - protein, 21 aa, Mycobacterium
GEYSAAYSGFEGSDASGTPLG

SEQ ID NO: 1161382 - protein, 12 aa, Mycobacterium
GFAEPKPRGPVT

SEQ ID NO: 1161383 - protein, 5 aa, Mycobacterium
GFARP

SEQ ID NO: 1161384 - protein, 6 aa, Mycobacterium
GFDGTT

SEQ ID NO: 1161385 - protein, 8 aa, Mycobacterium
GFDPARPS

SEQ ID NO: 1161386 - protein, 6 aa, Mycobacterium
GFDPGA

SEQ ID NO: 1161387 - protein, 8 aa, Mycobacterium
GFDPSRPT

SEQ ID NO: 1161388 - protein, 8 aa, Mycobacterium
GFDPTAPT

SEQ ID NO: 1161389 - protein, 8 aa, Mycobacterium
GFDRTEPS

SEQ ID NO: 1161390 - protein, 17 aa, Mycobacterium
GFDSEEEGVAAANDTEY

SEQ ID NO: 1161391 - protein, 6 aa, Mycobacterium
GFDTPS

SEQ ID NO: 1161392 - protein, 15 aa, Mycobacterium
GFEDDDTAAYTRYGS

SEQ ID NO: 1161393 - protein, 5 aa, Mycobacterium
GFEGR

SEQ ID NO: 1161394 - protein, 6 aa, Mycobacterium
GFENTT

SEQ ID NO: 1161395 - protein, 16 aa, Mycobacterium
GFEPVTPDELSRRMSS

SEQ ID NO: 1161396 - protein, 8 aa, Mycobacterium
GFEQNSRM

SEQ ID NO: 1161397 - protein, 8 aa, Mycobacterium
GFGAGKTT

SEQ ID NO: 1161398 - protein, 4 aa, Mycobacterium
GFGG

SEQ ID NO: 1161399 - protein, 6 aa, Mycobacterium
GFGGGA

SEQ ID NO: 1161400 - protein, 5 aa, Mycobacterium
GFGRT

SEQ ID NO: 1161401 - protein, 7 aa, Mycobacterium
GFGTPSD

SEQ ID NO: 1161402 - protein, 12 aa, Mycobacterium
GFKGQGAAHGAQ

SEQ ID NO: 1161403 - protein, 5 aa, Mycobacterium
GFKSS

SEQ ID NO: 1161404 - protein, 9 aa, Mycobacterium
GFNPGNEVA

SEQ ID NO: 1161405 - protein, 10 aa, Mycobacterium
GFPADSVTSQ

SEQ ID NO: 1161406 - protein, 4 aa, Mycobacterium
GFPD

SEQ ID NO: 1161407 - protein, 8 aa, Mycobacterium
GFPDDEAA

SEQ ID NO: 1161408 - protein, 23 aa, Mycobacterium
GFPDYKPELPGGRPGGGRSLSAA

SEQ ID NO: 1161409 - protein, 5 aa, Mycobacterium
GFPGT

SEQ ID NO: 1161410 - protein, 6 aa, Mycobacterium
GFPSGT

SEQ ID NO: 1161411 - protein, 5 aa, Mycobacterium
GFPSP

SEQ ID NO: 1161412 - protein, 5 aa, Mycobacterium
GFPTP

SEQ ID NO: 1161413 - protein, 5 aa, Mycobacterium
GFRDD

SEQ ID NO: 1161414 - protein, 20 aa, Mycobacterium
GFRDPSGNSVRLTQLAEVPV

SEQ ID NO: 1161415 - protein, 14 aa, Mycobacterium
GFRPSGEHYGRTPT

SEQ ID NO: 1161416 - protein, 13 aa, Mycobacterium
GFSDPTSGAQSGA

SEQ ID NO: 1161417 - protein, 5 aa, Mycobacterium
GFSGT

SEQ ID NO: 1161418 - protein, 13 aa, Mycobacterium
GFSPGQNGQGEEA

SEQ ID NO: 1161419 - protein, 11 aa, Mycobacterium
GFSPGQNQQGD

SEQ ID NO: 1161420 - protein, 9 aa, Mycobacterium
GFSRDEAKE

SEQ ID NO: 1161421 - protein, 6 aa, Mycobacterium
GFSRGN

SEQ ID NO: 1161422 - protein, 8 aa, Mycobacterium
GGAAAESV

SEQ ID NO: 1161423 - protein, 8 aa, Mycobacterium
GGAAGADI

SEQ ID NO: 1161424 - protein, 5 aa, Mycobacterium
GGAAT

SEQ ID NO: 1161425 - protein, 13 aa, Mycobacterium
GGACSKESNTLRY

SEQ ID NO: 1161426 - protein, 4 aa, Mycobacterium
GGAD

SEQ ID NO: 1161427 - protein, 9 aa, Mycobacterium
GGADDDAIE

SEQ ID NO: 1161428 - protein, 22 aa, Mycobacterium
GGADMTADPLPEQPPDPPACGP

SEQ ID NO: 1161429 - protein, 6 aa, Mycobacterium
GGADRP

SEQ ID NO: 1161430 - protein, 7 aa, Mycobacterium
GGADRPW

SEQ ID NO: 1161431 - protein, 6 aa, Mycobacterium
GGADSL

SEQ ID NO: 1161432 - protein, 10 aa, Mycobacterium
GGAEKTREVR

SEQ ID NO: 1161433 - protein, 5 aa, Mycobacterium
GGAEL

SEQ ID NO: 1161434 - protein, 10 aa, Mycobacterium
GGAESPPETT

SEQ ID NO: 1161435 - protein, 9 aa, Mycobacterium
GGAESPYES

SEQ ID NO: 1161436 - protein, 5 aa, Mycobacterium
GGAEV

SEQ ID NO: 1161437 - protein, 18 aa, Mycobacterium
GGAGANVNRNGVDYRGPN

SEQ ID NO: 1161438 - protein, 12 aa, Mycobacterium
GGAGDERTQRVN

SEQ ID NO: 1161439 - protein, 8 aa, Mycobacterium
GGAGDNTV

SEQ ID NO: 1161440 - protein, 6 aa, Mycobacterium
GGAGDS

SEQ ID NO: 1161441 - protein, 8 aa, Mycobacterium
GGAGSGYD

SEQ ID NO: 1161442 - protein, 6 aa, Mycobacterium
GGAGTE

SEQ ID NO: 1161443 - protein, 13 aa, Mycobacterium
GGAGTTAAGVRAG

SEQ ID NO: 1161444 - protein, 8 aa, Mycobacterium
GGAGVSDD

SEQ ID NO: 1161445 - protein, 10 aa, Mycobacterium
GGAHPDRGFT

SEQ ID NO: 1161446 - protein, 5 aa, Mycobacterium
GGAIV

SEQ ID NO: 1161447 - protein, 4 aa, Mycobacterium
GGAM

SEQ ID NO: 1161448 - protein, 11 aa, Mycobacterium
GGAPKPEQAAQ

SEQ ID NO: 1161449 - protein, 14 aa, Mycobacterium
GGAPLKLPDAGSYD

SEQ ID NO: 1161450 - protein, 12 aa, Mycobacterium
GGAPPRPAGPDE

SEQ ID NO: 1161451 - protein, 10 aa, Mycobacterium
GGAPQTGKST

SEQ ID NO: 1161452 - protein, 8 aa, Mycobacterium
GGAPRSPG

SEQ ID NO: 1161453 - protein, 6 aa, Mycobacterium
GGAPTL

SEQ ID NO: 1161454 - protein, 16 aa, Mycobacterium
GGAPTQLTVSPDGSRA

SEQ ID NO: 1161455 - protein, 8 aa, Mycobacterium
GGAPTVAG

SEQ ID NO: 1161456 - protein, 4 aa, Mycobacterium
GGAQ

SEQ ID NO: 1161457 - protein, 14 aa, Mycobacterium
GGAQQDRFPGGSQQ

SEQ ID NO: 1161458 - protein, 9 aa, Mycobacterium
GGAQTAYEK

SEQ ID NO: 1161459 - protein, 6 aa, Mycobacterium
GGARDW

SEQ ID NO: 1161460 - protein, 13 aa, Mycobacterium
GGARPGPTHRDNR

SEQ ID NO: 1161461 - protein, 7 aa, Mycobacterium
GGARPPR

SEQ ID NO: 1161462 - protein, 13 aa, Mycobacterium
GGARRDEERARAK

SEQ ID NO: 1161463 - protein, 6 aa, Mycobacterium
GGASTA

SEQ ID NO: 1161464 - protein, 8 aa, Mycobacterium
GGATDDGI

SEQ ID NO: 1161465 - protein, 7 aa, Mycobacterium
GGATETA

SEQ ID NO: 1161466 - protein, 10 aa, Mycobacterium
GGATLDNEEN

SEQ ID NO: 1161467 - protein, 6 aa, Mycobacterium
GGATLR

SEQ ID NO: 1161468 - protein, 7 aa, Mycobacterium
GGATQRG

SEQ ID NO: 1161469 - protein, 7 aa, Mycobacterium
GGAVEPR

SEQ ID NO: 1161470 - protein, 8 aa, Mycobacterium
GGAVPRTR

SEQ ID NO: 1161471 - protein, 5 aa, Mycobacterium
GGAVT

SEQ ID NO: 1161472 - protein, 10 aa, Mycobacterium
GGAVTTPGVR

SEQ ID NO: 1161473 - protein, 16 aa, Mycobacterium
GGDADLPHYPQPREQG

SEQ ID NO: 1161474 - protein, 7 aa, Mycobacterium
GGDADTS

SEQ ID NO: 1161475 - protein, 9 aa, Mycobacterium
GGDAKTWGD

SEQ ID NO: 1161476 - protein, 9 aa, Mycobacterium
GGDANPADN

SEQ ID NO: 1161477 - protein, 6 aa, Mycobacterium
GGDANT

SEQ ID NO: 1161478 - protein, 14 aa, Mycobacterium
GGDAPAVETPLSGR

SEQ ID NO: 1161479 - protein, 13 aa, Mycobacterium
GGDCTPGSSQIAT

SEQ ID NO: 1161480 - protein, 16 aa, Mycobacterium
GGDDDEYKRGATPEEQ

SEQ ID NO: 1161481 - protein, 9 aa, Mycobacterium
GGDDGGGEH

SEQ ID NO: 1161482 - protein, 14 aa, Mycobacterium
GGDDPLDASGVHPE

SEQ ID NO: 1161483 - protein, 5 aa, Mycobacterium
GGDEF

SEQ ID NO: 1161484 - protein, 9 aa, Mycobacterium
GGDEGEERA

SEQ ID NO: 1161485 - protein, 7 aa, Mycobacterium
GGDEMGG

SEQ ID NO: 1161486 - protein, 11 aa, Mycobacterium
GGDFAGESHRL

SEQ ID NO: 1161487 - protein, 5 aa, Mycobacterium
GGDGG

SEQ ID NO: 1161488 - protein, 9 aa, Mycobacterium
GGDGRVRAR

SEQ ID NO: 1161489 - protein, 12 aa, Mycobacterium
GGDISEAAYAGD

SEQ ID NO: 1161490 - protein, 9 aa, Mycobacterium
GGDLPQARA

SEQ ID NO: 1161491 - protein, 10 aa, Mycobacterium
GGDLTPGPAT

SEQ ID NO: 1161492 - protein, 25 aa, Mycobacterium
GGDNDGDIVSGDGAVLGDGNTMNNG

SEQ ID NO: 1161493 - protein, 7 aa, Mycobacterium
GGDNSDA

SEQ ID NO: 1161494 - protein, 7 aa, Mycobacterium
GGDPAAA

SEQ ID NO: 1161495 - protein, 7 aa, Mycobacterium
GGDPARE

SEQ ID NO: 1161496 - protein, 6 aa, Mycobacterium
GGDPDN

SEQ ID NO: 1161497 - protein, 15 aa, Mycobacterium
GGDPTGTGRGGPGYQ

SEQ ID NO: 1161498 - protein, 7 aa, Mycobacterium
GGDQRDL

SEQ ID NO: 1161499 - protein, 11 aa, Mycobacterium
GGDQYAEENNS

SEQ ID NO: 1161500 - protein, 7 aa, Mycobacterium
GGDSAME

SEQ ID NO: 1161501 - protein, 5 aa, Mycobacterium
GGDTD

SEQ ID NO: 1161502 - protein, 9 aa, Mycobacterium
GGDTDTAAA

SEQ ID NO: 1161503 - protein, 8 aa, Mycobacterium
GGDTPGRV

SEQ ID NO: 1161504 - protein, 6 aa, Mycobacterium
GGDVTE

SEQ ID NO: 1161505 - protein, 26 aa, Mycobacterium
GGEAPSLSKLGGSDWANTKTKARRAV

SEQ ID NO: 1161506 - protein, 19 aa, Mycobacterium
GGEAVASTDSVATPEGGRA

SEQ ID NO: 1161507 - protein, 5 aa, Mycobacterium
GGEEA

SEQ ID NO: 1161508 - protein, 6 aa, Mycobacterium
GGEEGG

SEQ ID NO: 1161509 - protein, 8 aa, Mycobacterium
GGEEQEEP

SEQ ID NO: 1161510 - protein, 7 aa, Mycobacterium
GGEEVRT

SEQ ID NO: 1161511 - protein, 6 aa, Mycobacterium
GGEGLP

SEQ ID NO: 1161512 - protein, 6 aa, Mycobacterium
GGEGLT

SEQ ID NO: 1161513 - protein, 6 aa, Mycobacterium
GGEGRP

SEQ ID NO: 1161514 - protein, 9 aa, Mycobacterium
GGEHRRSAA

SEQ ID NO: 1161515 - protein, 6 aa, Mycobacterium
GGEKVY

SEQ ID NO: 1161516 - protein, 8 aa, Mycobacterium
GGELTNGT

SEQ ID NO: 1161517 - protein, 10 aa, Mycobacterium
GGENVSSREV

SEQ ID NO: 1161518 - protein, 11 aa, Mycobacterium
GGEPGATSNNR

SEQ ID NO: 1161519 - protein, 8 aa, Mycobacterium
GGEPGRGF

SEQ ID NO: 1161520 - protein, 9 aa, Mycobacterium
GGEPPQVTA

SEQ ID NO: 1161521 - protein, 7 aa, Mycobacterium
GGEPTLH

SEQ ID NO: 1161522 - protein, 8 aa, Mycobacterium
GGEPVDAG

SEQ ID NO: 1161523 - protein, 7 aa, Mycobacterium
GGEPYAG

SEQ ID NO: 1161524 - protein, 6 aa, Mycobacterium
GGERGD

SEQ ID NO: 1161525 - protein, 10 aa, Mycobacterium
GGERKNDPDW

SEQ ID NO: 1161526 - protein, 16 aa, Mycobacterium
GGESTRPGATRVDPEV

SEQ ID NO: 1161527 - protein, 6 aa, Mycobacterium
GGETGY

SEQ ID NO: 1161528 - protein, 6 aa, Mycobacterium
GGETLS

SEQ ID NO: 1161529 - protein, 5 aa, Mycobacterium
GGETV

SEQ ID NO: 1161530 - protein, 4 aa, Mycobacterium
GGEV

SEQ ID NO: 1161531 - protein, 5 aa, Mycobacterium
GGEVR

SEQ ID NO: 1161532 - protein, 9 aa, Mycobacterium
GGEYDDSEG

SEQ ID NO: 1161533 - protein, 4 aa, Mycobacterium
GGFD

SEQ ID NO: 1161534 - protein, 5 aa, Mycobacterium
GGFET

SEQ ID NO: 1161535 - protein, 5 aa, Mycobacterium
GGFPR

SEQ ID NO: 1161536 - protein, 5 aa, Mycobacterium
GGFPS

SEQ ID NO: 1161537 - protein, 9 aa, Mycobacterium
GGGAPTLAE

SEQ ID NO: 1161538 - protein, 8 aa, Mycobacterium
GGGASRAV

SEQ ID NO: 1161539 - protein, 9 aa, Mycobacterium
GGGDDTVSA

SEQ ID NO: 1161540 - protein, 11 aa, Mycobacterium
GGGDEQAAATG

SEQ ID NO: 1161541 - protein, 18 aa, Mycobacterium
GGGDGTVATAAGIAKEAG

SEQ ID NO: 1161542 - protein, 9 aa, Mycobacterium
GGGDPEELD

SEQ ID NO: 1161543 - protein, 8 aa, Mycobacterium
GGGDPPRY

SEQ ID NO: 1161544 - protein, 6 aa, Mycobacterium
GGGDTA

SEQ ID NO: 1161545 - protein, 4 aa, Mycobacterium
GGGE

SEQ ID NO: 1161546 - protein, 12 aa, Mycobacterium
GGGFGSKGAPHA

SEQ ID NO: 1161547 - protein, 12 aa, Mycobacterium
GGGGRPGDTDFP

SEQ ID NO: 1161548 - protein, 11 aa, Mycobacterium
GGGGSDSNGLA

SEQ ID NO: 1161549 - protein, 18 aa, Mycobacterium
GGGGSRGPIGRVRPGSDS

SEQ ID NO: 1161550 - protein, 11 aa, Mycobacterium
GGGGYPAARAG

SEQ ID NO: 1161551 - protein, 4 aa, Mycobacterium
GGGH

SEQ ID NO: 1161552 - protein, 5 aa, Mycobacterium
GGGHA

SEQ ID NO: 1161553 - protein, 16 aa, Mycobacterium
GGGHANGPDPDAGGYV

SEQ ID NO: 1161554 - protein, 6 aa, Mycobacterium
GGGHGS

SEQ ID NO: 1161555 - protein, 6 aa, Mycobacterium
GGGIPT

SEQ ID NO: 1161556 - protein, 4 aa, Mycobacterium
GGGL

SEQ ID NO: 1161557 - protein, 4 aa, Mycobacterium
GGGM

SEQ ID NO: 1161558 - protein, 14 aa, Mycobacterium
GGGMGSATVIEVPA

SEQ ID NO: 1161559 - protein, 9 aa, Mycobacterium
GGGNPSDDA

SEQ ID NO: 1161560 - protein, 7 aa, Mycobacterium
GGGNVSA

SEQ ID NO: 1161561 - protein, 4 aa, Mycobacterium
GGGP

SEQ ID NO: 1161562 - protein, 10 aa, Mycobacterium
GGGPESGRAP

SEQ ID NO: 1161563 - protein, 5 aa, Mycobacterium
GGGPG

SEQ ID NO: 1161564 - protein, 8 aa, Mycobacterium
GGGPGDPE

SEQ ID NO: 1161565 - protein, 6 aa, Mycobacterium
GGGPVG

SEQ ID NO: 1161566 - protein, 12 aa, Mycobacterium
GGGQGNHLGGAY

SEQ ID NO: 1161567 - protein, 11 aa, Mycobacterium
GGGSDASKISI

SEQ ID NO: 1161568 - protein, 5 aa, Mycobacterium
GGGTA

SEQ ID NO: 1161569 - protein, 8 aa, Mycobacterium
GGGTETEA

SEQ ID NO: 1161570 - protein, 5 aa, Mycobacterium
GGGTG

SEQ ID NO: 1161571 - protein, 5 aa, Mycobacterium
GGGTL

SEQ ID NO: 1161572 - protein, 5 aa, Mycobacterium
GGGTP

SEQ ID NO: 1161573 - protein, 6 aa, Mycobacterium
GGGTRE

SEQ ID NO: 1161574 - protein, 5 aa, Mycobacterium
GGGTV

SEQ ID NO: 1161575 - protein, 8 aa, Mycobacterium
GGGVDTRI

SEQ ID NO: 1161576 - protein, 15 aa, Mycobacterium
GGGWGDPLDADPDEV

SEQ ID NO: 1161577 - protein, 9 aa, Mycobacterium
GGHDAESVR

SEQ ID NO: 1161578 - protein, 7 aa, Mycobacterium
GGHEGAG

SEQ ID NO: 1161579 - protein, 6 aa, Mycobacterium
GGHGGR

SEQ ID NO: 1161580 - protein, 8 aa, Mycobacterium
GGHGNPDG

SEQ ID NO: 1161581 - protein, 6 aa, Mycobacterium
GGHPRE

SEQ ID NO: 1161582 - protein, 5 aa, Mycobacterium
GGHRE

SEQ ID NO: 1161583 - protein, 7 aa, Mycobacterium
GGIDSPE

SEQ ID NO: 1161584 - protein, 20 aa, Mycobacterium
GGIGKSYKVTSNSWEYTGDG

SEQ ID NO: 1161585 - protein, 17 aa, Mycobacterium
GGIGTSSRVADTAAGRY

SEQ ID NO: 1161586 - protein, 7 aa, Mycobacterium
GGISDPD

SEQ ID NO: 1161587 - protein, 13 aa, Mycobacterium
GGITADSDPDREW

SEQ ID NO: 1161588 - protein, 7 aa, Mycobacterium
GGKAAYR

SEQ ID NO: 1161589 - protein, 9 aa, Mycobacterium
GGKDAKWGE

SEQ ID NO: 1161590 - protein, 7 aa, Mycobacterium
GGKDRVG

SEQ ID NO: 1161591 - protein, 19 aa, Mycobacterium
GGKEAEHRAASSVKERKDW

SEQ ID NO: 1161592 - protein, 6 aa, Mycobacterium
GGKERA

SEQ ID NO: 1161593 - protein, 10 aa, Mycobacterium
GGKLPPPVHS

SEQ ID NO: 1161594 - protein, 8 aa, Mycobacterium
GGKNASLG

SEQ ID NO: 1161595 - protein, 11 aa, Mycobacterium
GGKNPAVVGPR

SEQ ID NO: 1161596 - protein, 7 aa, Mycobacterium
GGKPQTE

SEQ ID NO: 1161597 - protein, 26 aa, Mycobacterium
GGKPRPKPGPYRSQDRNPTREAPSEA

SEQ ID NO: 1161598 - protein, 78 aa, Mycobacterium
GGKRELTAAAPAGADRPRRERPSGSRPRRSGASGTTATSTDAGRAASGTQEAPAAAEAAAGTEAAAGAAAETTTQNPG

SEQ ID NO: 1161599 - protein, 4 aa, Mycobacterium
GGKS

SEQ ID NO: 1161600 - protein, 6 aa, Mycobacterium
GGKSPA

SEQ ID NO: 1161601 - protein, 5 aa, Mycobacterium
GGKST

SEQ ID NO: 1161602 - protein, 10 aa, Mycobacterium
GGKSTEPSFA

SEQ ID NO: 1161603 - protein, 4 aa, Mycobacterium
GGLA

SEQ ID NO: 1161604 - protein, 31 aa, Mycobacterium
GGLAGAKEKAKDALKGVTGALTGKGGGGDKI

SEQ ID NO: 1161605 - protein, 4 aa, Mycobacterium
GGLD

SEQ ID NO: 1161606 - protein, 7 aa, Mycobacterium
GGLGDQQ

SEQ ID NO: 1161607 - protein, 12 aa, Mycobacterium
GGLGDTEPAPTI

SEQ ID NO: 1161608 - protein, 9 aa, Mycobacterium
GGLGGEKAQ

SEQ ID NO: 1161609 - protein, 7 aa, Mycobacterium
GGLGPQG

SEQ ID NO: 1161610 - protein, 18 aa, Mycobacterium
GGLPGRAPVHRATRRRAL

SEQ ID NO: 1161611 - protein, 10 aa, Mycobacterium
GGLPKGDALA

SEQ ID NO: 1161612 - protein, 12 aa, Mycobacterium
GGLPPISRLTPT

SEQ ID NO: 1161613 - protein, 8 aa, Mycobacterium
GGLPPKVD

SEQ ID NO: 1161614 - protein, 14 aa, Mycobacterium
GGLPPLTIDSDGTV

SEQ ID NO: 1161615 - protein, 7 aa, Mycobacterium
GGLPPQA

SEQ ID NO: 1161616 - protein, 5 aa, Mycobacterium
GGLPS

SEQ ID NO: 1161617 - protein, 7 aa, Mycobacterium
GGLPTNE

SEQ ID NO: 1161618 - protein, 13 aa, Mycobacterium
GGLSESAAREYKK

SEQ ID NO: 1161619 - protein, 17 aa, Mycobacterium
GGLTPCEPGTAANSAGT

SEQ ID NO: 1161620 - protein, 7 aa, Mycobacterium
GGLTPGE

SEQ ID NO: 1161621 - protein, 13 aa, Mycobacterium
GGLTPQSSDDEMR

SEQ ID NO: 1161622 - protein, 5 aa, Mycobacterium
GGLTR

SEQ ID NO: 1161623 - protein, 13 aa, Mycobacterium
GGLTRTPGTPSFD

SEQ ID NO: 1161624 - protein, 12 aa, Mycobacterium
GGLTSTVQMWRD

SEQ ID NO: 1161625 - protein, 4 aa, Mycobacterium
GGMA

SEQ ID NO: 1161626 - protein, 15 aa, Mycobacterium
GGMASSEAATANISA

SEQ ID NO: 1161627 - protein, 14 aa, Mycobacterium
GGMKNNVTIQLEPA

SEQ ID NO: 1161628 - protein, 6 aa, Mycobacterium
GGMPDA

SEQ ID NO: 1161629 - protein, 5 aa, Mycobacterium
GGMPG

SEQ ID NO: 1161630 - protein, 6 aa, Mycobacterium
GGMSAG

SEQ ID NO: 1161631 - protein, 7 aa, Mycobacterium
GGNAGMG

SEQ ID NO: 1161632 - protein, 8 aa, Mycobacterium
GGNAGVSA

SEQ ID NO: 1161633 - protein, 14 aa, Mycobacterium
GGNGLDEHDAPEEA

SEQ ID NO: 1161634 - protein, 14 aa, Mycobacterium
GGNIESALLREILA

SEQ ID NO: 1161635 - protein, 8 aa, Mycobacterium
GGNLGYGT

SEQ ID NO: 1161636 - protein, 11 aa, Mycobacterium
GGNNFPDDTPY

SEQ ID NO: 1161637 - protein, 7 aa, Mycobacterium
GGNQTVP

SEQ ID NO: 1161638 - protein, 5 aa, Mycobacterium
GGNRG

SEQ ID NO: 1161639 - protein, 8 aa, Mycobacterium
GGNRQGHK

SEQ ID NO: 1161640 - protein, 13 aa, Mycobacterium
GGNSRFTEDAPHA

SEQ ID NO: 1161641 - protein, 13 aa, Mycobacterium
GGNSTAARRNGGR

SEQ ID NO: 1161642 - protein, 7 aa, Mycobacterium
GGNSTAE

SEQ ID NO: 1161643 - protein, 6 aa, Mycobacterium
GGPAAT

SEQ ID NO: 1161644 - protein, 8 aa, Mycobacterium
GGPAGLTA

SEQ ID NO: 1161645 - protein, 6 aa, Mycobacterium
GGPDDG

SEQ ID NO: 1161646 - protein, 10 aa, Mycobacterium
GGPDDGRYSN

SEQ ID NO: 1161647 - protein, 9 aa, Mycobacterium
GGPDLPRST

SEQ ID NO: 1161648 - protein, 15 aa, Mycobacterium
GGPDPIPGRSAPALR

SEQ ID NO: 1161649 - protein, 8 aa, Mycobacterium
GGPEGPDQ

SEQ ID NO: 1161650 - protein, 10 aa, Mycobacterium
GGPEPYTGAP

SEQ ID NO: 1161651 - protein, 4 aa, Mycobacterium
GGPG

SEQ ID NO: 1161652 - protein, 11 aa, Mycobacterium
GGPGRASPASF

SEQ ID NO: 1161653 - protein, 6 aa, Mycobacterium
GGPGRS

SEQ ID NO: 1161654 - protein, 9 aa, Mycobacterium
GGPGTGKST

SEQ ID NO: 1161655 - protein, 17 aa, Mycobacterium
GGPGTGKTTLSGALGES

SEQ ID NO: 1161656 - protein, 6 aa, Mycobacterium
GGPKAA

SEQ ID NO: 1161657 - protein, 7 aa, Mycobacterium
GGPKPAG

SEQ ID NO: 1161658 - protein, 14 aa, Mycobacterium
GGPMRTGKPKGGRR

SEQ ID NO: 1161659 - protein, 8 aa, Mycobacterium
GGPPEEFA

SEQ ID NO: 1161660 - protein, 6 aa, Mycobacterium
GGPPLS

SEQ ID NO: 1161661 - protein, 13 aa, Mycobacterium
GGPPVAAATSDQL

SEQ ID NO: 1161662 - protein, 7 aa, Mycobacterium
GGPRGGV

SEQ ID NO: 1161663 - protein, 5 aa, Mycobacterium
GGPRL

SEQ ID NO: 1161664 - protein, 13 aa, Mycobacterium
GGPRPRVAELVAE

SEQ ID NO: 1161665 - protein, 18 aa, Mycobacterium
GGPRVPGGTAVHTTSRWH

SEQ ID NO: 1161666 - protein, 9 aa, Mycobacterium
GGPSGAAAA

SEQ ID NO: 1161667 - protein, 12 aa, Mycobacterium
GGPSGSGLAAPD

SEQ ID NO: 1161668 - protein, 8 aa, Mycobacterium
GGPSPAPA

SEQ ID NO: 1161669 - protein, 5 aa, Mycobacterium
GGPTG

SEQ ID NO: 1161670 - protein, 11 aa, Mycobacterium
GGPTSGEHARD

SEQ ID NO: 1161671 - protein, 19 aa, Mycobacterium
GGQAAMRDAERTQRSVTPR

SEQ ID NO: 1161672 - protein, 9 aa, Mycobacterium
GGQAGNIGR

SEQ ID NO: 1161673 - protein, 17 aa, Mycobacterium
GGQAKASTTARPEASVM

SEQ ID NO: 1161674 - protein, 15 aa, Mycobacterium
GGQERDVRSGTADVA

SEQ ID NO: 1161675 - protein, 4 aa, Mycobacterium
GGQK

SEQ ID NO: 1161676 - protein, 5 aa, Mycobacterium
GGQPE

SEQ ID NO: 1161677 - protein, 14 aa, Mycobacterium
GGQPGLSFGKPEEK

SEQ ID NO: 1161678 - protein, 16 aa, Mycobacterium
GGQPISSFQGPQPADQ

SEQ ID NO: 1161679 - protein, 5 aa, Mycobacterium
GGQRP

SEQ ID NO: 1161680 - protein, 14 aa, Mycobacterium
GGQRVNDKAPKDRD

SEQ ID NO: 1161681 - protein, 7 aa, Mycobacterium
GGQTSAE

SEQ ID NO: 1161682 - protein, 5 aa, Mycobacterium
GGQTV

SEQ ID NO: 1161683 - protein, 10 aa, Mycobacterium
GGRAAPQSNR

SEQ ID NO: 1161684 - protein, 5 aa, Mycobacterium
GGRAL

SEQ ID NO: 1161685 - protein, 7 aa, Mycobacterium
GGRATAT

SEQ ID NO: 1161686 - protein, 10 aa, Mycobacterium
GGRDRREKTT

SEQ ID NO: 1161687 - protein, 17 aa, Mycobacterium
GGRDTDFGRGDEPYDRA

SEQ ID NO: 1161688 - protein, 6 aa, Mycobacterium
GGREIS

SEQ ID NO: 1161689 - protein, 5 aa, Mycobacterium
GGREN

SEQ ID NO: 1161690 - protein, 10 aa, Mycobacterium
GGRERTRGEY

SEQ ID NO: 1161691 - protein, 4 aa, Mycobacterium
GGRG

SEQ ID NO: 1161692 - protein, 5 aa, Mycobacterium
GGRGM

SEQ ID NO: 1161693 - protein, 11 aa, Mycobacterium
GGRKLGDEWSQ

SEQ ID NO: 1161694 - protein, 17 aa, Mycobacterium
GGRLDAEPPPSRGSSVE

SEQ ID NO: 1161695 - protein, 12 aa, Mycobacterium
GGRLDPGETPVE

SEQ ID NO: 1161696 - protein, 10 aa, Mycobacterium
GGRLGGSFGK

SEQ ID NO: 1161697 - protein, 7 aa, Mycobacterium
GGRLGTG

SEQ ID NO: 1161698 - protein, 8 aa, Mycobacterium
GGRPAETP

SEQ ID NO: 1161699 - protein, 7 aa, Mycobacterium
GGRPPYG

SEQ ID NO: 1161700 - protein, 13 aa, Mycobacterium
GGRPVTDDSARAQ

SEQ ID NO: 1161701 - protein, 4 aa, Mycobacterium
GGRQ

SEQ ID NO: 1161702 - protein, 7 aa, Mycobacterium
GGRSAPL

SEQ ID NO: 1161703 - protein, 13 aa, Mycobacterium
GGRSNSGEGGEAV

SEQ ID NO: 1161704 - protein, 16 aa, Mycobacterium
GGRSSTGAVLAALRGR

SEQ ID NO: 1161705 - protein, 4 aa, Mycobacterium
GGRT

SEQ ID NO: 1161706 - protein, 7 aa, Mycobacterium
GGRTGRP

SEQ ID NO: 1161707 - protein, 14 aa, Mycobacterium
GGRTVGAGRVTKIH

SEQ ID NO: 1161708 - protein, 9 aa, Mycobacterium
GGSAAGYKP

SEQ ID NO: 1161709 - protein, 5 aa, Mycobacterium
GGSAQ

SEQ ID NO: 1161710 - protein, 6 aa, Mycobacterium
GGSARL

SEQ ID NO: 1161711 - protein, 7 aa, Mycobacterium
GGSAYGL

SEQ ID NO: 1161712 - protein, 8 aa, Mycobacterium
GGSEGVGA

SEQ ID NO: 1161713 - protein, 8 aa, Mycobacterium
GGSGERKT

SEQ ID NO: 1161714 - protein, 9 aa, Mycobacterium
GGSGGARDS

SEQ ID NO: 1161715 - protein, 11 aa, Mycobacterium
GGSGGGLAGSY

SEQ ID NO: 1161716 - protein, 6 aa, Mycobacterium
GGSGHY

SEQ ID NO: 1161717 - protein, 10 aa, Mycobacterium
GGSGPKRASA

SEQ ID NO: 1161718 - protein, 9 aa, Mycobacterium
GGSGSEAYQ

SEQ ID NO: 1161719 - protein, 17 aa, Mycobacterium
GGSGSSISLADAGANLD

SEQ ID NO: 1161720 - protein, 10 aa, Mycobacterium
GGSGTDAASR

SEQ ID NO: 1161721 - protein, 8 aa, Mycobacterium
GGSGVKGG

SEQ ID NO: 1161722 - protein, 4 aa, Mycobacterium
GGSH

SEQ ID NO: 1161723 - protein, 7 aa, Mycobacterium
GGSIATG

SEQ ID NO: 1161724 - protein, 16 aa, Mycobacterium
GGSLELSNGGDEEPEV

SEQ ID NO: 1161725 - protein, 17 aa, Mycobacterium
GGSPDNVDRTLRAWRAV

SEQ ID NO: 1161726 - protein, 8 aa, Mycobacterium
GGSPVDGD

SEQ ID NO: 1161727 - protein, 6 aa, Mycobacterium
GGSPVP

SEQ ID NO: 1161728 - protein, 9 aa, Mycobacterium
GGSRGAGAG

SEQ ID NO: 1161729 - protein, 7 aa, Mycobacterium
GGSRGGW

SEQ ID NO: 1161730 - protein, 6 aa, Mycobacterium
GGSRGI

SEQ ID NO: 1161731 - protein, 9 aa, Mycobacterium
GGSSGATRL

SEQ ID NO: 1161732 - protein, 9 aa, Mycobacterium
GGSSQYRHD

SEQ ID NO: 1161733 - protein, 10 aa, Mycobacterium
GGSSRGIGPN

SEQ ID NO: 1161734 - protein, 9 aa, Mycobacterium
GGSSYGPQM

SEQ ID NO: 1161735 - protein, 9 aa, Mycobacterium
GGSTGTVAD

SEQ ID NO: 1161736 - protein, 5 aa, Mycobacterium
GGTAE

SEQ ID NO: 1161737 - protein, 6 aa, Mycobacterium
GGTAGI

SEQ ID NO: 1161738 - protein, 14 aa, Mycobacterium
GGTAPYANGGGEFK

SEQ ID NO: 1161739 - protein, 5 aa, Mycobacterium
GGTAT

SEQ ID NO: 1161740 - protein, 10 aa, Mycobacterium
GGTDAEGSGF

SEQ ID NO: 1161741 - protein, 8 aa, Mycobacterium
GGTDAKSF

SEQ ID NO: 1161742 - protein, 8 aa, Mycobacterium
GGTDESIS

SEQ ID NO: 1161743 - protein, 7 aa, Mycobacterium
GGTDPRL

SEQ ID NO: 1161744 - protein, 12 aa, Mycobacterium
GGTEANGTCGCT

SEQ ID NO: 1161745 - protein, 5 aa, Mycobacterium
GGTEN

SEQ ID NO: 1161746 - protein, 6 aa, Mycobacterium
GGTFTN

SEQ ID NO: 1161747 - protein, 6 aa, Mycobacterium
GGTGAV

SEQ ID NO: 1161748 - protein, 5 aa, Mycobacterium
GGTGL

SEQ ID NO: 1161749 - protein, 4 aa, Mycobacterium
GGTI

SEQ ID NO: 1161750 - protein, 6 aa, Mycobacterium
GGTKNG

SEQ ID NO: 1161751 - protein, 4 aa, Mycobacterium
GGTP

SEQ ID NO: 1161752 - protein, 7 aa, Mycobacterium
GGTPEPI

SEQ ID NO: 1161753 - protein, 5 aa, Mycobacterium
GGTPG

SEQ ID NO: 1161754 - protein, 6 aa, Mycobacterium
GGTPGV

SEQ ID NO: 1161755 - protein, 6 aa, Mycobacterium
GGTPLS

SEQ ID NO: 1161756 - protein, 15 aa, Mycobacterium
GGTPPPYPGWPEMPA

SEQ ID NO: 1161757 - protein, 5 aa, Mycobacterium
GGTPR

SEQ ID NO: 1161758 - protein, 8 aa, Mycobacterium
GGTPSLLG

SEQ ID NO: 1161759 - protein, 6 aa, Mycobacterium
GGTQRI

SEQ ID NO: 1161760 - protein, 7 aa, Mycobacterium
GGTSFHG

SEQ ID NO: 1161761 - protein, 7 aa, Mycobacterium
GGTSGIG

SEQ ID NO: 1161762 - protein, 5 aa, Mycobacterium
GGTTE

SEQ ID NO: 1161763 - protein, 7 aa, Mycobacterium
GGTTGLP

SEQ ID NO: 1161764 - protein, 8 aa, Mycobacterium
GGTTPGVG

SEQ ID NO: 1161765 - protein, 8 aa, Mycobacterium
GGTTSADE

SEQ ID NO: 1161766 - protein, 8 aa, Mycobacterium
GGTVNPDK

SEQ ID NO: 1161767 - protein, 5 aa, Mycobacterium
GGTVS

SEQ ID NO: 1161768 - protein, 8 aa, Mycobacterium
GGTYSKPL

SEQ ID NO: 1161769 - protein, 6 aa, Mycobacterium
GGVADG

SEQ ID NO: 1161770 - protein, 5 aa, Mycobacterium
GGVAK

SEQ ID NO: 1161771 - protein, 12 aa, Mycobacterium
GGVANQENAGKI

SEQ ID NO: 1161772 - protein, 10 aa, Mycobacterium
GGVDDRDRNA

SEQ ID NO: 1161773 - protein, 12 aa, Mycobacterium
GGVGEAPAYDES

SEQ ID NO: 1161774 - protein, 12 aa, Mycobacterium
GGVGKSTLATAT

SEQ ID NO: 1161775 - protein, 10 aa, Mycobacterium
GGVGKTTITA

SEQ ID NO: 1161776 - protein, 5 aa, Mycobacterium
GGVGT

SEQ ID NO: 1161777 - protein, 13 aa, Mycobacterium
GGVITPERAGDTA

SEQ ID NO: 1161778 - protein, 7 aa, Mycobacterium
GGVNSPV

SEQ ID NO: 1161779 - protein, 8 aa, Mycobacterium
GGVPGDEL

SEQ ID NO: 1161780 - protein, 7 aa, Mycobacterium
GGVPTDD

SEQ ID NO: 1161781 - protein, 9 aa, Mycobacterium
GGVQETQDA

SEQ ID NO: 1161782 - protein, 13 aa, Mycobacterium
GGVVADSNGPYEF

SEQ ID NO: 1161783 - protein, 5 aa, Mycobacterium
GGWGP

SEQ ID NO: 1161784 - protein, 6 aa, Mycobacterium
GGYAGS

SEQ ID NO: 1161785 - protein, 8 aa, Mycobacterium
GGYDEPRF

SEQ ID NO: 1161786 - protein, 7 aa, Mycobacterium
GGYGGDS

SEQ ID NO: 1161787 - protein, 11 aa, Mycobacterium
GGYKQSGIGRE

SEQ ID NO: 1161788 - protein, 6 aa, Mycobacterium
GGYRDN

SEQ ID NO: 1161789 - protein, 17 aa, Mycobacterium
GGYSRDDANKKLAENSG

SEQ ID NO: 1161790 - protein, 6 aa, Mycobacterium
GGYTDA

SEQ ID NO: 1161791 - protein, 9 aa, Mycobacterium
GHAQRNSAF

SEQ ID NO: 1161792 - protein, 7 aa, Mycobacterium
GHCPPDR

SEQ ID NO: 1161793 - protein, 7 aa, Mycobacterium
GHDDPDV

SEQ ID NO: 1161794 - protein, 10 aa, Mycobacterium
GHDGGDADTI

SEQ ID NO: 1161795 - protein, 6 aa, Mycobacterium
GHDPGG

SEQ ID NO: 1161796 - protein, 12 aa, Mycobacterium
GHDRDGNGGMDG

SEQ ID NO: 1161797 - protein, 10 aa, Mycobacterium
GHDTTSATIS

SEQ ID NO: 1161798 - protein, 12 aa, Mycobacterium
GHEEDKQLPVAR

SEQ ID NO: 1161799 - protein, 11 aa, Mycobacterium
GHEERKGPSRV

SEQ ID NO: 1161800 - protein, 7 aa, Mycobacterium
GHEGAGT

SEQ ID NO: 1161801 - protein, 6 aa, Mycobacterium
GHETDR

SEQ ID NO: 1161802 - protein, 11 aa, Mycobacterium
GHETTDDGRDI

SEQ ID NO: 1161803 - protein, 12 aa, Mycobacterium
GHGAAELARDGD

SEQ ID NO: 1161804 - protein, 23 aa, Mycobacterium
GHGAGRGQGGGEKKRTPGLAPDE

SEQ ID NO: 1161805 - protein, 10 aa, Mycobacterium
GHGDTTTVGD

SEQ ID NO: 1161806 - protein, 14 aa, Mycobacterium
GHGGEAHQPGPPGQ

SEQ ID NO: 1161807 - protein, 5 aa, Mycobacterium
GHGGH

SEQ ID NO: 1161808 - protein, 5 aa, Mycobacterium
GHGGL

SEQ ID NO: 1161809 - protein, 20 aa, Mycobacterium
GHGINDPGFEQPSRPMSAIG

SEQ ID NO: 1161810 - protein, 14 aa, Mycobacterium
GHGNASGDSHTEGV

SEQ ID NO: 1161811 - protein, 4 aa, Mycobacterium
GHGQ

SEQ ID NO: 1161812 - protein, 14 aa, Mycobacterium
GHGRSGVPPRRGNY

SEQ ID NO: 1161813 - protein, 10 aa, Mycobacterium
GHIGSTAGDG

SEQ ID NO: 1161814 - protein, 5 aa, Mycobacterium
GHIPT

SEQ ID NO: 1161815 - protein, 6 aa, Mycobacterium
GHKSTL

SEQ ID NO: 1161816 - protein, 9 aa, Mycobacterium
GHLTASNTD

SEQ ID NO: 1161817 - protein, 8 aa, Mycobacterium
GHNNPALK

SEQ ID NO: 1161818 - protein, 7 aa, Mycobacterium
GHNPETA

SEQ ID NO: 1161819 - protein, 4 aa, Mycobacterium
GHPA

SEQ ID NO: 1161820 - protein, 7 aa, Mycobacterium
GHPAYEA

SEQ ID NO: 1161821 - protein, 10 aa, Mycobacterium
GHPDDSSISG

SEQ ID NO: 1161822 - protein, 8 aa, Mycobacterium
GHPGEDDI

SEQ ID NO: 1161823 - protein, 7 aa, Mycobacterium
GHPGRDV

SEQ ID NO: 1161824 - protein, 7 aa, Mycobacterium
GHPHDLP

SEQ ID NO: 1161825 - protein, 13 aa, Mycobacterium
GHPPYGHNGERAL

SEQ ID NO: 1161826 - protein, 8 aa, Mycobacterium
GHPRLSDG

SEQ ID NO: 1161827 - protein, 7 aa, Mycobacterium
GHPSPID

SEQ ID NO: 1161828 - protein, 4 aa, Mycobacterium
GHPT

SEQ ID NO: 1161829 - protein, 15 aa, Mycobacterium
GHPTPRSAAEDESRV

SEQ ID NO: 1161830 - protein, 15 aa, Mycobacterium
GHPVGREKHPSSSVQ

SEQ ID NO: 1161831 - protein, 9 aa, Mycobacterium
GHQLPSPEP

SEQ ID NO: 1161832 - protein, 10 aa, Mycobacterium
GHRDRPDGRV

SEQ ID NO: 1161833 - protein, 10 aa, Mycobacterium
GHRKPSGVST

SEQ ID NO: 1161834 - protein, 9 aa, Mycobacterium
GHRPAAGWD

SEQ ID NO: 1161835 - protein, 8 aa, Mycobacterium
GHRPSTAF

SEQ ID NO: 1161836 - protein, 4 aa, Mycobacterium
GHRT

SEQ ID NO: 1161837 - protein, 12 aa, Mycobacterium
GHSARAAAAYDE

SEQ ID NO: 1161838 - protein, 10 aa, Mycobacterium
GHSDYRGDPW

SEQ ID NO: 1161839 - protein, 13 aa, Mycobacterium
GHSGEGNERLGEE

SEQ ID NO: 1161840 - protein, 8 aa, Mycobacterium
GHSGTEPV

SEQ ID NO: 1161841 - protein, 8 aa, Mycobacterium
GHSQGAQV

SEQ ID NO: 1161842 - protein, 9 aa, Mycobacterium
GHSQPDAGL

SEQ ID NO: 1161843 - protein, 9 aa, Mycobacterium
GHSRSREDS

SEQ ID NO: 1161844 - protein, 9 aa, Mycobacterium
GHSSPVTAH

SEQ ID NO: 1161845 - protein, 5 aa, Mycobacterium
GHTEC

SEQ ID NO: 1161846 - protein, 11 aa, Mycobacterium
GHTEEAAQRDF

SEQ ID NO: 1161847 - protein, 7 aa, Mycobacterium
GHTRGEF

SEQ ID NO: 1161848 - protein, 6 aa, Mycobacterium
GHTSSL

SEQ ID NO: 1161849 - protein, 12 aa, Mycobacterium
GHTVTPSPHHPI

SEQ ID NO: 1161850 - protein, 10 aa, Mycobacterium
GHVPNKEDEL

SEQ ID NO: 1161851 - protein, 11 aa, Mycobacterium
GHYSGAAKLGN

SEQ ID NO: 1161852 - protein, 4 aa, Mycobacterium
GIAA

SEQ ID NO: 1161853 - protein, 9 aa, Mycobacterium
GIADEDVDA

SEQ ID NO: 1161854 - protein, 6 aa, Mycobacterium
GIAPAG

SEQ ID NO: 1161855 - protein, 6 aa, Mycobacterium
GIAPDA

SEQ ID NO: 1161856 - protein, 8 aa, Mycobacterium
GIAPGGIS

SEQ ID NO: 1161857 - protein, 15 aa, Mycobacterium
GIAPPSETVATIDPD

SEQ ID NO: 1161858 - protein, 6 aa, Mycobacterium
GIAPTD

SEQ ID NO: 1161859 - protein, 7 aa, Mycobacterium
GIASGRG

SEQ ID NO: 1161860 - protein, 4 aa, Mycobacterium
GIDE

SEQ ID NO: 1161861 - protein, 12 aa, Mycobacterium
GIDGGAASAEEA

SEQ ID NO: 1161862 - protein, 14 aa, Mycobacterium
GIDGTDPAETLRDG

SEQ ID NO: 1161863 - protein, 5 aa, Mycobacterium
GIDPA

SEQ ID NO: 1161864 - protein, 10 aa, Mycobacterium
GIDPDRGWGH

SEQ ID NO: 1161865 - protein, 6 aa, Mycobacterium
GIDQDR

SEQ ID NO: 1161866 - protein, 8 aa, Mycobacterium
GIDSETAV

SEQ ID NO: 1161867 - protein, 14 aa, Mycobacterium
GIDYDSADASFQPS

SEQ ID NO: 1161868 - protein, 9 aa, Mycobacterium
GIEDPAEAM

SEQ ID NO: 1161869 - protein, 7 aa, Mycobacterium
GIEEAKG

SEQ ID NO: 1161870 - protein, 13 aa, Mycobacterium
GIGAGGNRIGATS

SEQ ID NO: 1161871 - protein, 7 aa, Mycobacterium
GIGDTGS

SEQ ID NO: 1161872 - protein, 10 aa, Mycobacterium
GIGGGSDRSV

SEQ ID NO: 1161873 - protein, 5 aa, Mycobacterium
GIGKG

SEQ ID NO: 1161874 - protein, 6 aa, Mycobacterium
GIGKSR

SEQ ID NO: 1161875 - protein, 17 aa, Mycobacterium
GIGNGGETLDKTSDGDW

SEQ ID NO: 1161876 - protein, 17 aa, Mycobacterium
GIGNGGQTLDKTSEDDW

SEQ ID NO: 1161877 - protein, 27 aa, Mycobacterium
GIGPGGRNSRRHGERQDQGGFSKGRVK

SEQ ID NO: 1161878 - protein, 10 aa, Mycobacterium
GIGPGSGKGR

SEQ ID NO: 1161879 - protein, 9 aa, Mycobacterium
GIGSPGPLA

SEQ ID NO: 1161880 - protein, 8 aa, Mycobacterium
GIGTGKST

SEQ ID NO: 1161881 - protein, 7 aa, Mycobacterium
GIGTGRQ

SEQ ID NO: 1161882 - protein, 10 aa, Mycobacterium
GIGVDTPSAY

SEQ ID NO: 1161883 - protein, 8 aa, Mycobacterium
GIKDTTDQ

SEQ ID NO: 1161884 - protein, 6 aa, Mycobacterium
GINEDT

SEQ ID NO: 1161885 - protein, 4 aa, Mycobacterium
GINP

SEQ ID NO: 1161886 - protein, 13 aa, Mycobacterium
GINPAALTDPSQM

SEQ ID NO: 1161887 - protein, 8 aa, Mycobacterium
GINPDGVV

SEQ ID NO: 1161888 - protein, 21 aa, Mycobacterium
GIPATGDMSAPDRGVGDQPAT

SEQ ID NO: 1161889 - protein, 7 aa, Mycobacterium
GIPEEQA

SEQ ID NO: 1161890 - protein, 34 aa, Mycobacterium
GIPESKAVDDGQPAGIREGGVDGSAPPDGILLNY

SEQ ID NO: 1161891 - protein, 5 aa, Mycobacterium
GIPHG

SEQ ID NO: 1161892 - protein, 5 aa, Mycobacterium
GIPPD

SEQ ID NO: 1161893 - protein, 6 aa, Mycobacterium
GIPTEY

SEQ ID NO: 1161894 - protein, 12 aa, Mycobacterium
GIPTTAPDGYSG

SEQ ID NO: 1161895 - protein, 9 aa, Mycobacterium
GIQAGGGVP

SEQ ID NO: 1161896 - protein, 6 aa, Mycobacterium
GIRAGT

SEQ ID NO: 1161897 - protein, 8 aa, Mycobacterium
GIRGDNAE

SEQ ID NO: 1161898 - protein, 6 aa, Mycobacterium
GIRKGT

SEQ ID NO: 1161899 - protein, 10 aa, Mycobacterium
GIRKQQRSGL

SEQ ID NO: 1161900 - protein, 15 aa, Mycobacterium
GISGPATLPLAFDAG

SEQ ID NO: 1161901 - protein, 7 aa, Mycobacterium
GISGSEE

SEQ ID NO: 1161902 - protein, 7 aa, Mycobacterium
GISKEGS

SEQ ID NO: 1161903 - protein, 6 aa, Mycobacterium
GISRKA

SEQ ID NO: 1161904 - protein, 16 aa, Mycobacterium
GISTDTVDKQARFADT

SEQ ID NO: 1161905 - protein, 9 aa, Mycobacterium
GISTRTPRG

SEQ ID NO: 1161906 - protein, 7 aa, Mycobacterium
GITEPEG

SEQ ID NO: 1161907 - protein, 4 aa, Mycobacterium
GITG

SEQ ID NO: 1161908 - protein, 10 aa, Mycobacterium
GITGDRGGRA

SEQ ID NO: 1161909 - protein, 6 aa, Mycobacterium
GITGGA

SEQ ID NO: 1161910 - protein, 6 aa, Mycobacterium
GITGTG

SEQ ID NO: 1161911 - protein, 12 aa, Mycobacterium
GITIGDQTPELN

SEQ ID NO: 1161912 - protein, 5 aa, Mycobacterium
GITPT

SEQ ID NO: 1161913 - protein, 6 aa, Mycobacterium
GITRDA

SEQ ID NO: 1161914 - protein, 12 aa, Mycobacterium
GKAGSETEYGSA

SEQ ID NO: 1161915 - protein, 10 aa, Mycobacterium
GKAKADRLSR

SEQ ID NO: 1161916 - protein, 5 aa, Mycobacterium
GKAQI

SEQ ID NO: 1161917 - protein, 15 aa, Mycobacterium
GKAQRAGGTHAEAAA

SEQ ID NO: 1161918 - protein, 6 aa, Mycobacterium
GKASDL

SEQ ID NO: 1161919 - protein, 14 aa, Mycobacterium
GKAVVSAGSRESME

SEQ ID NO: 1161920 - protein, 9 aa, Mycobacterium
GKDGSPLDL

SEQ ID NO: 1161921 - protein, 16 aa, Mycobacterium
GKDHTGGTATGAAGSV

SEQ ID NO: 1161922 - protein, 6 aa, Mycobacterium
GKDPDV

SEQ ID NO: 1161923 - protein, 8 aa, Mycobacterium
GKDTRGLL

SEQ ID NO: 1161924 - protein, 23 aa, Mycobacterium
GKDVDPARYGQTPRPTTDEPDRI

SEQ ID NO: 1161925 - protein, 10 aa, Mycobacterium
GKDVTKRTAV

SEQ ID NO: 1161926 - protein, 9 aa, Mycobacterium
GKEEETQAT

SEQ ID NO: 1161927 - protein, 11 aa, Mycobacterium
GKEERNNRTDE

SEQ ID NO: 1161928 - protein, 10 aa, Mycobacterium
GKEVDRRPGD

SEQ ID NO: 1161929 - protein, 13 aa, Mycobacterium
GKEWAAKAGGTSG

SEQ ID NO: 1161930 - protein, 7 aa, Mycobacterium
GKFERSR

SEQ ID NO: 1161931 - protein, 4 aa, Mycobacterium
GKGD

SEQ ID NO: 1161932 - protein, 6 aa, Mycobacterium
GKGDMP

SEQ ID NO: 1161933 - protein, 7 aa, Mycobacterium
GKGQAEQ

SEQ ID NO: 1161934 - protein, 9 aa, Mycobacterium
GKGQGMAED

SEQ ID NO: 1161935 - protein, 18 aa, Mycobacterium
GKGRAAGMTRQGEPFRPP

SEQ ID NO: 1161936 - protein, 5 aa, Mycobacterium
GKGRL

SEQ ID NO: 1161937 - protein, 5 aa, Mycobacterium
GKGRR

SEQ ID NO: 1161938 - protein, 5 aa, Mycobacterium
GKGSV

SEQ ID NO: 1161939 - protein, 9 aa, Mycobacterium
GKGTQAAKL

SEQ ID NO: 1161940 - protein, 6 aa, Mycobacterium
GKGTVD

SEQ ID NO: 1161941 - protein, 4 aa, Mycobacterium
GKGV

SEQ ID NO: 1161942 - protein, 9 aa, Mycobacterium
GKGVGGTKY

SEQ ID NO: 1161943 - protein, 15 aa, Mycobacterium
GKGYPGDDAPARLST

SEQ ID NO: 1161944 - protein, 9 aa, Mycobacterium
GKHRHTPEI

SEQ ID NO: 1161945 - protein, 6 aa, Mycobacterium
GKHSDC

SEQ ID NO: 1161946 - protein, 8 aa, Mycobacterium
GKITSEAL

SEQ ID NO: 1161947 - protein, 7 aa, Mycobacterium
GKKDPLD

SEQ ID NO: 1161948 - protein, 8 aa, Mycobacterium
GKKGGPGW

SEQ ID NO: 1161949 - protein, 8 aa, Mycobacterium
GKLGGDPA

SEQ ID NO: 1161950 - protein, 6 aa, Mycobacterium
GKLTAR

SEQ ID NO: 1161951 - protein, 27 aa, Mycobacterium
GKNFSAGHDLGSEEAIAERGPGPAQHP

SEQ ID NO: 1161952 - protein, 5 aa, Mycobacterium
GKPAT

SEQ ID NO: 1161953 - protein, 5 aa, Mycobacterium
GKPCR

SEQ ID NO: 1161954 - protein, 4 aa, Mycobacterium
GKPE

SEQ ID NO: 1161955 - protein, 9 aa, Mycobacterium
GKPGTAEPL

SEQ ID NO: 1161956 - protein, 9 aa, Mycobacterium
GKPKGAPVE

SEQ ID NO: 1161957 - protein, 6 aa, Mycobacterium
GKPNID

SEQ ID NO: 1161958 - protein, 12 aa, Mycobacterium
GKPNYSPPVKKA

SEQ ID NO: 1161959 - protein, 16 aa, Mycobacterium
GKPQAQIDTAKFGGSR

SEQ ID NO: 1161960 - protein, 8 aa, Mycobacterium
GKPQPGQT

SEQ ID NO: 1161961 - protein, 12 aa, Mycobacterium
GKPTDQLPGPGR

SEQ ID NO: 1161962 - protein, 5 aa, Mycobacterium
GKPVG

SEQ ID NO: 1161963 - protein, 19 aa, Mycobacterium
GKQAHDKRQDLARRDAERE

SEQ ID NO: 1161964 - protein, 4 aa, Mycobacterium
GKQL

SEQ ID NO: 1161965 - protein, 7 aa, Mycobacterium
GKRLSAA

SEQ ID NO: 1161966 - protein, 8 aa, Mycobacterium
GKRREDGV

SEQ ID NO: 1161967 - protein, 14 aa, Mycobacterium
GKRSEGEGAAGAEM

SEQ ID NO: 1161968 - protein, 12 aa, Mycobacterium
GKRSRQPDLPAH

SEQ ID NO: 1161969 - protein, 11 aa, Mycobacterium
GKSCGREANTA

SEQ ID NO: 1161970 - protein, 8 aa, Mycobacterium
GKSDAESV

SEQ ID NO: 1161971 - protein, 10 aa, Mycobacterium
GKSDGAIPAS

SEQ ID NO: 1161972 - protein, 12 aa, Mycobacterium
GKSEERIASTAG

SEQ ID NO: 1161973 - protein, 9 aa, Mycobacterium
GKSPERIEA

SEQ ID NO: 1161974 - protein, 14 aa, Mycobacterium
GKSTVNSDPDAVRD

SEQ ID NO: 1161975 - protein, 5 aa, Mycobacterium
GKSVG

SEQ ID NO: 1161976 - protein, 7 aa, Mycobacterium
GKSVPLA

SEQ ID NO: 1161977 - protein, 6 aa, Mycobacterium
GKSVVT

SEQ ID NO: 1161978 - protein, 4 aa, Mycobacterium
GKTA

SEQ ID NO: 1161979 - protein, 8 aa, Mycobacterium
GKTNSAIA

SEQ ID NO: 1161980 - protein, 8 aa, Mycobacterium
GKTPQGSW

SEQ ID NO: 1161981 - protein, 14 aa, Mycobacterium
GKVARGESDSAALT

SEQ ID NO: 1161982 - protein, 4 aa, Mycobacterium
GKVP

SEQ ID NO: 1161983 - protein, 9 aa, Mycobacterium
GKVSADERT

SEQ ID NO: 1161984 - protein, 11 aa, Mycobacterium
GKYPPPKGASD

SEQ ID NO: 1161985 - protein, 7 aa, Mycobacterium
GLAASRA

SEQ ID NO: 1161986 - protein, 6 aa, Mycobacterium
GLAEAK

SEQ ID NO: 1161987 - protein, 8 aa, Mycobacterium
GLAEASDD

SEQ ID NO: 1161988 - protein, 5 aa, Mycobacterium
GLAEG

SEQ ID NO: 1161989 - protein, 20 aa, Mycobacterium
GLAETTRGEGGHGSSGGHAS

SEQ ID NO: 1161990 - protein, 13 aa, Mycobacterium
GLAGQKRQAAYGP

SEQ ID NO: 1161991 - protein, 4 aa, Mycobacterium
GLAP

SEQ ID NO: 1161992 - protein, 12 aa, Mycobacterium
GLAPAAEDSSGA

SEQ ID NO: 1161993 - protein, 11 aa, Mycobacterium
GLAPGETPRTI

SEQ ID NO: 1161994 - protein, 7 aa, Mycobacterium
GLAPPGA

SEQ ID NO: 1161995 - protein, 5 aa, Mycobacterium
GLAQR

SEQ ID NO: 1161996 - protein, 9 aa, Mycobacterium
GLARPQEGR

SEQ ID NO: 1161997 - protein, 11 aa, Mycobacterium
GLASGTDPAGL

SEQ ID NO: 1161998 - protein, 7 aa, Mycobacterium
GLATPAD

SEQ ID NO: 1161999 - protein, 14 aa, Mycobacterium
GLDEPTGVTATNDL

SEQ ID NO: 1162000 - protein, 6 aa, Mycobacterium
GLDGED

SEQ ID NO: 1162001 - protein, 9 aa, Mycobacterium
GLDGPPDGI

SEQ ID NO: 1162002 - protein, 13 aa, Mycobacterium
GLDGRPAADDMNR

SEQ ID NO: 1162003 - protein, 7 aa, Mycobacterium
GLDGSAP

SEQ ID NO: 1162004 - protein, 6 aa, Mycobacterium
GLDPHR

SEQ ID NO: 1162005 - protein, 20 aa, Mycobacterium
GLDPLSQTSTLSEAWVGVQK

SEQ ID NO: 1162006 - protein, 15 aa, Mycobacterium
GLDPREARRQARGNP

SEQ ID NO: 1162007 - protein, 4 aa, Mycobacterium
GLDQ

SEQ ID NO: 1162008 - protein, 7 aa, Mycobacterium
GLDREEY

SEQ ID NO: 1162009 - protein, 8 aa, Mycobacterium
GLDSDAQP

SEQ ID NO: 1162010 - protein, 6 aa, Mycobacterium
GLEEEG

SEQ ID NO: 1162011 - protein, 8 aa, Mycobacterium
GLEETRRA

SEQ ID NO: 1162012 - protein, 16 aa, Mycobacterium
GLEGTAGGSSYNASKG

SEQ ID NO: 1162013 - protein, 5 aa, Mycobacterium
GLEPR

SEQ ID NO: 1162014 - protein, 6 aa, Mycobacterium
GLEPSD

SEQ ID NO: 1162015 - protein, 8 aa, Mycobacterium
GLESDPRM

SEQ ID NO: 1162016 - protein, 6 aa, Mycobacterium
GLGADT

SEQ ID NO: 1162017 - protein, 7 aa, Mycobacterium
GLGAPEF

SEQ ID NO: 1162018 - protein, 7 aa, Mycobacterium
GLGATGT

SEQ ID NO: 1162019 - protein, 4 aa, Mycobacterium
GLGD

SEQ ID NO: 1162020 - protein, 10 aa, Mycobacterium
GLGDTVDSTL

SEQ ID NO: 1162021 - protein, 21 aa, Mycobacterium
GLGDTVDSTLDAASDADGVSD

SEQ ID NO: 1162022 - protein, 20 aa, Mycobacterium
GLGDVPPDAVGPITTQEPNG

SEQ ID NO: 1162023 - protein, 22 aa, Mycobacterium
GLGELTTAKDSFEAQAARDGLV

SEQ ID NO: 1162024 - protein, 5 aa, Mycobacterium
GLGER

SEQ ID NO: 1162025 - protein, 6 aa, Mycobacterium
GLGGGL

SEQ ID NO: 1162026 - protein, 6 aa, Mycobacterium
GLGPAS

SEQ ID NO: 1162027 - protein, 10 aa, Mycobacterium
GLGPEPPSCY

SEQ ID NO: 1162028 - protein, 5 aa, Mycobacterium
GLGPR

SEQ ID NO: 1162029 - protein, 7 aa, Mycobacterium
GLGPSQR

SEQ ID NO: 1162030 - protein, 10 aa, Mycobacterium
GLGRDDPRRA

SEQ ID NO: 1162031 - protein, 12 aa, Mycobacterium
GLGRRRKSWAKS

SEQ ID NO: 1162032 - protein, 5 aa, Mycobacterium
GLGSL

SEQ ID NO: 1162033 - protein, 6 aa, Mycobacterium
GLGSQD

SEQ ID NO: 1162034 - protein, 6 aa, Mycobacterium
GLGTAP

SEQ ID NO: 1162035 - protein, 9 aa, Mycobacterium
GLGTDEAGA

SEQ ID NO: 1162036 - protein, 10 aa, Mycobacterium
GLHGGIGSSV

SEQ ID NO: 1162037 - protein, 9 aa, Mycobacterium
GLHPGGKRN

SEQ ID NO: 1162038 - protein, 13 aa, Mycobacterium
GLKKARKAPQYSK

SEQ ID NO: 1162039 - protein, 11 aa, Mycobacterium
GLKRDPSDTSE

SEQ ID NO: 1162040 - protein, 7 aa, Mycobacterium
GLLPGNG

SEQ ID NO: 1162041 - protein, 15 aa, Mycobacterium
GLPADTPLTTGGDVE

SEQ ID NO: 1162042 - protein, 11 aa, Mycobacterium
GLPAPDGPAET

SEQ ID NO: 1162043 - protein, 15 aa, Mycobacterium
GLPAPKEAMRAALQT

SEQ ID NO: 1162044 - protein, 8 aa, Mycobacterium
GLPDGGRG

SEQ ID NO: 1162045 - protein, 5 aa, Mycobacterium
GLPDH

SEQ ID NO: 1162046 - protein, 6 aa, Mycobacterium
GLPDPT

SEQ ID NO: 1162047 - protein, 15 aa, Mycobacterium
GLPEEWSPDSESSRE

SEQ ID NO: 1162048 - protein, 12 aa, Mycobacterium
GLPEGDPLPPLP

SEQ ID NO: 1162049 - protein, 22 aa, Mycobacterium
GLPEGDTSTIESGSGSDTETVT

SEQ ID NO: 1162050 - protein, 7 aa, Mycobacterium
GLPEPGV

SEQ ID NO: 1162051 - protein, 9 aa, Mycobacterium
GLPGGTPGT

SEQ ID NO: 1162052 - protein, 6 aa, Mycobacterium
GLPGPQ

SEQ ID NO: 1162053 - protein, 7 aa, Mycobacterium
GLPGSTH

SEQ ID NO: 1162054 - protein, 9 aa, Mycobacterium
GLPGTATAT

SEQ ID NO: 1162055 - protein, 5 aa, Mycobacterium
GLPGV

SEQ ID NO: 1162056 - protein, 5 aa, Mycobacterium
GLPHR

SEQ ID NO: 1162057 - protein, 6 aa, Mycobacterium
GLPKGS

SEQ ID NO: 1162058 - protein, 10 aa, Mycobacterium
GLPKSTDPWV

SEQ ID NO: 1162059 - protein, 13 aa, Mycobacterium
GLPPTAVKPSYGI

SEQ ID NO: 1162060 - protein, 16 aa, Mycobacterium
GLPQAAYSASKAAIAG

SEQ ID NO: 1162061 - protein, 5 aa, Mycobacterium
GLPQS

SEQ ID NO: 1162062 - protein, 8 aa, Mycobacterium
GLPRPRTQ

SEQ ID NO: 1162063 - protein, 7 aa, Mycobacterium
GLPSPPE

SEQ ID NO: 1162064 - protein, 6 aa, Mycobacterium
GLPSSP

SEQ ID NO: 1162065 - protein, 15 aa, Mycobacterium
GLPSSPGVTGAATAD

SEQ ID NO: 1162066 - protein, 6 aa, Mycobacterium
GLPTAT

SEQ ID NO: 1162067 - protein, 7 aa, Mycobacterium
GLPTDPE

SEQ ID NO: 1162068 - protein, 19 aa, Mycobacterium
GLPTTAGCPGYATDPAEVD

SEQ ID NO: 1162069 - protein, 4 aa, Mycobacterium
GLPY

SEQ ID NO: 1162070 - protein, 7 aa, Mycobacterium
GLPYAAE

SEQ ID NO: 1162071 - protein, 29 aa, Mycobacterium
GLQDGPTSVAPKVPEETVKAAAADAPVKP

SEQ ID NO: 1162072 - protein, 14 aa, Mycobacterium
GLQPEDPYDGPRAA

SEQ ID NO: 1162073 - protein, 9 aa, Mycobacterium
GLRAETDDA

SEQ ID NO: 1162074 - protein, 7 aa, Mycobacterium
GLRDDEG

SEQ ID NO: 1162075 - protein, 6 aa, Mycobacterium
GLRERG

SEQ ID NO: 1162076 - protein, 9 aa, Mycobacterium
GLRKEADDM

SEQ ID NO: 1162077 - protein, 4 aa, Mycobacterium
GLRP

SEQ ID NO: 1162078 - protein, 6 aa, Mycobacterium
GLRPAP

SEQ ID NO: 1162079 - protein, 10 aa, Mycobacterium
GLRPEGRNGP

SEQ ID NO: 1162080 - protein, 13 aa, Mycobacterium
GLRPGRTEKQVRR

SEQ ID NO: 1162081 - protein, 10 aa, Mycobacterium
GLRRGDAVTG

SEQ ID NO: 1162082 - protein, 9 aa, Mycobacterium
GLRSQPSDL

SEQ ID NO: 1162083 - protein, 8 aa, Mycobacterium
GLSAEDKR

SEQ ID NO: 1162084 - protein, 9 aa, Mycobacterium
GLSGGEEAA

SEQ ID NO: 1162085 - protein, 5 aa, Mycobacterium
GLSGR

SEQ ID NO: 1162086 - protein, 9 aa, Mycobacterium
GLSKEDVAR

SEQ ID NO: 1162087 - protein, 12 aa, Mycobacterium
GLSPADLRGSRT

SEQ ID NO: 1162088 - protein, 10 aa, Mycobacterium
GLSPDGSASY

SEQ ID NO: 1162089 - protein, 9 aa, Mycobacterium
GLSPEAQQD

SEQ ID NO: 1162090 - protein, 19 aa, Mycobacterium
GLSPRSPLPGDDGLSPATS

SEQ ID NO: 1162091 - protein, 7 aa, Mycobacterium
GLSPSHD

SEQ ID NO: 1162092 - protein, 5 aa, Mycobacterium
GLSQR

SEQ ID NO: 1162093 - protein, 12 aa, Mycobacterium
GLSRGERAARTR

SEQ ID NO: 1162094 - protein, 15 aa, Mycobacterium
GLSSSPSNTPPPYDA

SEQ ID NO: 1162095 - protein, 5 aa, Mycobacterium
GLSTP

SEQ ID NO: 1162096 - protein, 8 aa, Mycobacterium
GLSTTVED

SEQ ID NO: 1162097 - protein, 5 aa, Mycobacterium
GLTDA

SEQ ID NO: 1162098 - protein, 10 aa, Mycobacterium
GLTDFGEDGF

SEQ ID NO: 1162099 - protein, 6 aa, Mycobacterium
GLTEDE

SEQ ID NO: 1162100 - protein, 4 aa, Mycobacterium
GLTG

SEQ ID NO: 1162101 - protein, 6 aa, Mycobacterium
GLTGDS

SEQ ID NO: 1162102 - protein, 6 aa, Mycobacterium
GLTGRS

SEQ ID NO: 1162103 - protein, 8 aa, Mycobacterium
GLTPGQTA

SEQ ID NO: 1162104 - protein, 5 aa, Mycobacterium
GLTPL

SEQ ID NO: 1162105 - protein, 6 aa, Mycobacterium
GLTPQY

SEQ ID NO: 1162106 - protein, 7 aa, Mycobacterium
GLTSEQI

SEQ ID NO: 1162107 - protein, 8 aa, Mycobacterium
GLTTKPAE

SEQ ID NO: 1162108 - protein, 5 aa, Mycobacterium
GMAGE

SEQ ID NO: 1162109 - protein, 10 aa, Mycobacterium
GMAGGSADAA

SEQ ID NO: 1162110 - protein, 5 aa, Mycobacterium
GMANG

SEQ ID NO: 1162111 - protein, 8 aa, Mycobacterium
GMASGDYP

SEQ ID NO: 1162112 - protein, 8 aa, Mycobacterium
GMATPDDL

SEQ ID NO: 1162113 - protein, 10 aa, Mycobacterium
GMEGGMTEGY

SEQ ID NO: 1162114 - protein, 8 aa, Mycobacterium
GMESGHAY

SEQ ID NO: 1162115 - protein, 12 aa, Mycobacterium
GMGDDERQTPLD

SEQ ID NO: 1162116 - protein, 8 aa, Mycobacterium
GMGGPERV

SEQ ID NO: 1162117 - protein, 12 aa, Mycobacterium
GMGQRTTASGTV

SEQ ID NO: 1162118 - protein, 10 aa, Mycobacterium
GMNPDDLRKA

SEQ ID NO: 1162119 - protein, 22 aa, Mycobacterium
GMPIGGAKGGSDFDPKGRSNGE

SEQ ID NO: 1162120 - protein, 12 aa, Mycobacterium
GMRAYKGTTIAG

SEQ ID NO: 1162121 - protein, 5 aa, Mycobacterium
GMRDG

SEQ ID NO: 1162122 - protein, 7 aa, Mycobacterium
GMSGGDV

SEQ ID NO: 1162123 - protein, 12 aa, Mycobacterium
GMSTEEREETGN

SEQ ID NO: 1162124 - protein, 11 aa, Mycobacterium
GMTGTAQTEAA

SEQ ID NO: 1162125 - protein, 8 aa, Mycobacterium
GNADRPGM

SEQ ID NO: 1162126 - protein, 11 aa, Mycobacterium
GNAGEAGDWDR

SEQ ID NO: 1162127 - protein, 8 aa, Mycobacterium
GNAMTDDT

SEQ ID NO: 1162128 - protein, 13 aa, Mycobacterium
GNASQSAGATGHG

SEQ ID NO: 1162129 - protein, 10 aa, Mycobacterium
GNASSLHGAG

SEQ ID NO: 1162130 - protein, 4 aa, Mycobacterium
GNAT

SEQ ID NO: 1162131 - protein, 9 aa, Mycobacterium
GNATGGDPA

SEQ ID NO: 1162132 - protein, 15 aa, Mycobacterium
GNATPIGRSATAAEV

SEQ ID NO: 1162133 - protein, 8 aa, Mycobacterium
GNDLSTAA

SEQ ID NO: 1162134 - protein, 8 aa, Mycobacterium
GNDPARIR

SEQ ID NO: 1162135 - protein, 5 aa, Mycobacterium
GNDSV

SEQ ID NO: 1162136 - protein, 7 aa, Mycobacterium
GNDTGGA

SEQ ID NO: 1162137 - protein, 13 aa, Mycobacterium
GNDTNVPPSESQQ

SEQ ID NO: 1162138 - protein, 7 aa, Mycobacterium
GNDYAGD

SEQ ID NO: 1162139 - protein, 9 aa, Mycobacterium
GNEAAVGRA

SEQ ID NO: 1162140 - protein, 5 aa, Mycobacterium
GNEET

SEQ ID NO: 1162141 - protein, 5 aa, Mycobacterium
GNERM

SEQ ID NO: 1162142 - protein, 10 aa, Mycobacterium
GNETTRNSIT

SEQ ID NO: 1162143 - protein, 6 aa, Mycobacterium
GNFDPA

SEQ ID NO: 1162144 - protein, 7 aa, Mycobacterium
GNFGASA

SEQ ID NO: 1162145 - protein, 7 aa, Mycobacterium
GNGAAEK

SEQ ID NO: 1162146 - protein, 4 aa, Mycobacterium
GNGF

SEQ ID NO: 1162147 - protein, 8 aa, Mycobacterium
GNGGDRSM

SEQ ID NO: 1162148 - protein, 8 aa, Mycobacterium
GNGGMTPK

SEQ ID NO: 1162149 - protein, 14 aa, Mycobacterium
GNGLKDPDTALKGM

SEQ ID NO: 1162150 - protein, 6 aa, Mycobacterium
GNGRRA

SEQ ID NO: 1162151 - protein, 9 aa, Mycobacterium
GNGSSGFDT

SEQ ID NO: 1162152 - protein, 16 aa, Mycobacterium
GNHAQGDESPTDGGRY

SEQ ID NO: 1162153 - protein, 4 aa, Mycobacterium
GNHD

SEQ ID NO: 1162154 - protein, 8 aa, Mycobacterium
GNHQTSRA

SEQ ID NO: 1162155 - protein, 4 aa, Mycobacterium
GNHT

SEQ ID NO: 1162156 - protein, 8 aa, Mycobacterium
GNIGARTA

SEQ ID NO: 1162157 - protein, 13 aa, Mycobacterium
GNKFSNTEAMKGE

SEQ ID NO: 1162158 - protein, 10 aa, Mycobacterium
GNKSRAIEAA

SEQ ID NO: 1162159 - protein, 5 aa, Mycobacterium
GNLSS

SEQ ID NO: 1162160 - protein, 14 aa, Mycobacterium
GNMAAGGAQSGPVN

SEQ ID NO: 1162161 - protein, 9 aa, Mycobacterium
GNNDTEKFD

SEQ ID NO: 1162162 - protein, 7 aa, Mycobacterium
GNNDVSR

SEQ ID NO: 1162163 - protein, 6 aa, Mycobacterium
GNNGYL

SEQ ID NO: 1162164 - protein, 9 aa, Mycobacterium
GNNKSPDEL

SEQ ID NO: 1162165 - protein, 6 aa, Mycobacterium
GNNNRT

SEQ ID NO: 1162166 - protein, 7 aa, Mycobacterium
GNNPVRE

SEQ ID NO: 1162167 - protein, 6 aa, Mycobacterium
GNNQRA

SEQ ID NO: 1162168 - protein, 5 aa, Mycobacterium
GNNTT

SEQ ID NO: 1162169 - protein, 15 aa, Mycobacterium
GNPANADAHYYGTGP

SEQ ID NO: 1162170 - protein, 7 aa, Mycobacterium
GNPAQRA

SEQ ID NO: 1162171 - protein, 10 aa, Mycobacterium
GNPDGADAFR

SEQ ID NO: 1162172 - protein, 9 aa, Mycobacterium
GNPDTAKNT

SEQ ID NO: 1162173 - protein, 12 aa, Mycobacterium
GNPQEATRSSMT

SEQ ID NO: 1162174 - protein, 12 aa, Mycobacterium
GNPQLGSVGGGV

SEQ ID NO: 1162175 - protein, 9 aa, Mycobacterium
GNPRLGAGR

SEQ ID NO: 1162176 - protein, 6 aa, Mycobacterium
GNPVPH

SEQ ID NO: 1162177 - protein, 6 aa, Mycobacterium
GNQPDG

SEQ ID NO: 1162178 - protein, 15 aa, Mycobacterium
GNRALDSGDHETAMT

SEQ ID NO: 1162179 - protein, 7 aa, Mycobacterium
GNREAER

SEQ ID NO: 1162180 - protein, 8 aa, Mycobacterium
GNRGIPPY

SEQ ID NO: 1162181 - protein, 9 aa, Mycobacterium
GNRNFEGRI

SEQ ID NO: 1162182 - protein, 9 aa, Mycobacterium
GNRPAIENR

SEQ ID NO: 1162183 - protein, 6 aa, Mycobacterium
GNRQVP

SEQ ID NO: 1162184 - protein, 19 aa, Mycobacterium
GNRSIGAAEAATEAGIGPS

SEQ ID NO: 1162185 - protein, 9 aa, Mycobacterium
GNRYERGEQ

SEQ ID NO: 1162186 - protein, 8 aa, Mycobacterium
GNSKQESV

SEQ ID NO: 1162187 - protein, 4 aa, Mycobacterium
GNSL

SEQ ID NO: 1162188 - protein, 10 aa, Mycobacterium
GNSPDAARRA

SEQ ID NO: 1162189 - protein, 5 aa, Mycobacterium
GNSSV

SEQ ID NO: 1162190 - protein, 7 aa, Mycobacterium
GNTDADM

SEQ ID NO: 1162191 - protein, 7 aa, Mycobacterium
GNTDPQY

SEQ ID NO: 1162192 - protein, 8 aa, Mycobacterium
GNTGDPVW

SEQ ID NO: 1162193 - protein, 5 aa, Mycobacterium
GNTNF

SEQ ID NO: 1162194 - protein, 17 aa, Mycobacterium
GNTPGQPVKPGSMGRPM

SEQ ID NO: 1162195 - protein, 9 aa, Mycobacterium
GNVAAPSRV

SEQ ID NO: 1162196 - protein, 6 aa, Mycobacterium
GNVATG

SEQ ID NO: 1162197 - protein, 6 aa, Mycobacterium
GNVSSP

SEQ ID NO: 1162198 - protein, 9 aa, Mycobacterium
GNYNPKTAR

SEQ ID NO: 1162199 - protein, 10 aa, Mycobacterium
GPAADAQRAV

SEQ ID NO: 1162200 - protein, 6 aa, Mycobacterium
GPAAGD

SEQ ID NO: 1162201 - protein, 8 aa, Mycobacterium
GPAAGVGA

SEQ ID NO: 1162202 - protein, 12 aa, Mycobacterium
GPAAPGAAPDAW

SEQ ID NO: 1162203 - protein, 14 aa, Mycobacterium
GPAAPGEAPDQSAL

SEQ ID NO: 1162204 - protein, 7 aa, Mycobacterium
GPAAQGT

SEQ ID NO: 1162205 - protein, 8 aa, Mycobacterium
GPADAASN

SEQ ID NO: 1162206 - protein, 8 aa, Mycobacterium
GPADDPYS

SEQ ID NO: 1162207 - protein, 16 aa, Mycobacterium
GPADPDPSVNQALKGG

SEQ ID NO: 1162208 - protein, 10 aa, Mycobacterium
GPADREQERY

SEQ ID NO: 1162209 - protein, 9 aa, Mycobacterium
GPADVGDRD

SEQ ID NO: 1162210 - protein, 5 aa, Mycobacterium
GPAGD

SEQ ID NO: 1162211 - protein, 6 aa, Mycobacterium
GPAGDY

SEQ ID NO: 1162212 - protein, 8 aa, Mycobacterium
GPAGSGKS

SEQ ID NO: 1162213 - protein, 18 aa, Mycobacterium
GPAIEAHKGQAANPVATG

SEQ ID NO: 1162214 - protein, 6 aa, Mycobacterium
GPALGT

SEQ ID NO: 1162215 - protein, 15 aa, Mycobacterium
GPALPRAKSTLYDAG

SEQ ID NO: 1162216 - protein, 10 aa, Mycobacterium
GPAPADPGPA

SEQ ID NO: 1162217 - protein, 8 aa, Mycobacterium
GPAPGGLR

SEQ ID NO: 1162218 - protein, 6 aa, Mycobacterium
GPAPGM

SEQ ID NO: 1162219 - protein, 9 aa, Mycobacterium
GPAPLSSSQ

SEQ ID NO: 1162220 - protein, 7 aa, Mycobacterium
GPAPMGG

SEQ ID NO: 1162221 - protein, 5 aa, Mycobacterium
GPAPW

SEQ ID NO: 1162222 - protein, 5 aa, Mycobacterium
GPAQA

SEQ ID NO: 1162223 - protein, 6 aa, Mycobacterium
GPARTE

SEQ ID NO: 1162224 - protein, 11 aa, Mycobacterium
GPATAQATPTQ

SEQ ID NO: 1162225 - protein, 10 aa, Mycobacterium
GPATGGFADE

SEQ ID NO: 1162226 - protein, 10 aa, Mycobacterium
GPATGSDDAV

SEQ ID NO: 1162227 - protein, 7 aa, Mycobacterium
GPATSRP

SEQ ID NO: 1162228 - protein, 7 aa, Mycobacterium
GPATYEP

SEQ ID NO: 1162229 - protein, 4 aa, Mycobacterium
GPAV

SEQ ID NO: 1162230 - protein, 7 aa, Mycobacterium
GPCGPSS

SEQ ID NO: 1162231 - protein, 5 aa, Mycobacterium
GPDAE

SEQ ID NO: 1162232 - protein, 10 aa, Mycobacterium
GPDAEGLTDR

SEQ ID NO: 1162233 - protein, 15 aa, Mycobacterium
GPDETPPDGWEQDPD

SEQ ID NO: 1162234 - protein, 7 aa, Mycobacterium
GPDEVAE

SEQ ID NO: 1162235 - protein, 5 aa, Mycobacterium
GPDFP

SEQ ID NO: 1162236 - protein, 9 aa, Mycobacterium
GPDGAGETL

SEQ ID NO: 1162237 - protein, 9 aa, Mycobacterium
GPDGDKYPG

SEQ ID NO: 1162238 - protein, 9 aa, Mycobacterium
GPDGPDNRA

SEQ ID NO: 1162239 - protein, 9 aa, Mycobacterium
GPDGPDRAE

SEQ ID NO: 1162240 - protein, 9 aa, Mycobacterium
GPDHVPETP

SEQ ID NO: 1162241 - protein, 8 aa, Mycobacterium
GPDLGPWA

SEQ ID NO: 1162242 - protein, 11 aa, Mycobacterium
GPDPESAQATY

SEQ ID NO: 1162243 - protein, 15 aa, Mycobacterium
GPDPLRRDADPAPAW

SEQ ID NO: 1162244 - protein, 18 aa, Mycobacterium
GPDPRSPESVEGWDRITT

SEQ ID NO: 1162245 - protein, 8 aa, Mycobacterium
GPDQPFGM

SEQ ID NO: 1162246 - protein, 4 aa, Mycobacterium
GPDR

SEQ ID NO: 1162247 - protein, 9 aa, Mycobacterium
GPDVGGTWR

SEQ ID NO: 1162248 - protein, 5 aa, Mycobacterium
GPDVN

SEQ ID NO: 1162249 - protein, 7 aa, Mycobacterium
GPEDPQW

SEQ ID NO: 1162250 - protein, 4 aa, Mycobacterium
GPEF

SEQ ID NO: 1162251 - protein, 7 aa, Mycobacterium
GPEGLPY

SEQ ID NO: 1162252 - protein, 12 aa, Mycobacterium
GPEGQSRPGYNE

SEQ ID NO: 1162253 - protein, 13 aa, Mycobacterium
GPEGRAAYDAAAT

SEQ ID NO: 1162254 - protein, 7 aa, Mycobacterium
GPELGPG

SEQ ID NO: 1162255 - protein, 6 aa, Mycobacterium
GPENDG

SEQ ID NO: 1162256 - protein, 15 aa, Mycobacterium
GPEPHGAALSNSGFR

SEQ ID NO: 1162257 - protein, 7 aa, Mycobacterium
GPEPSVG

SEQ ID NO: 1162258 - protein, 4 aa, Mycobacterium
GPEQ

SEQ ID NO: 1162259 - protein, 14 aa, Mycobacterium
GPERAGQKQIRNTA

SEQ ID NO: 1162260 - protein, 7 aa, Mycobacterium
GPERAQE

SEQ ID NO: 1162261 - protein, 5 aa, Mycobacterium
GPERG

SEQ ID NO: 1162262 - protein, 8 aa, Mycobacterium
GPERGPNW

SEQ ID NO: 1162263 - protein, 12 aa, Mycobacterium
GPERPAADRDRM

SEQ ID NO: 1162264 - protein, 15 aa, Mycobacterium
GPERSEVEADPEARR

SEQ ID NO: 1162265 - protein, 18 aa, Mycobacterium
GPESGWDRAADQPPPPLP

SEQ ID NO: 1162266 - protein, 12 aa, Mycobacterium
GPESSWHDRPDH

SEQ ID NO: 1162267 - protein, 6 aa, Mycobacterium
GPETGK

SEQ ID NO: 1162268 - protein, 4 aa, Mycobacterium
GPEV

SEQ ID NO: 1162269 - protein, 11 aa, Mycobacterium
GPFGRNAPAAF

SEQ ID NO: 1162270 - protein, 4 aa, Mycobacterium
GPGA

SEQ ID NO: 1162271 - protein, 13 aa, Mycobacterium
GPGAAADGHPNAA

SEQ ID NO: 1162272 - protein, 6 aa, Mycobacterium
GPGADY

SEQ ID NO: 1162273 - protein, 11 aa, Mycobacterium
GPGAGADGGQV

SEQ ID NO: 1162274 - protein, 8 aa, Mycobacterium
GPGAGELG

SEQ ID NO: 1162275 - protein, 10 aa, Mycobacterium
GPGAGTGGGE

SEQ ID NO: 1162276 - protein, 8 aa, Mycobacterium
GPGALPSD

SEQ ID NO: 1162277 - protein, 9 aa, Mycobacterium
GPGAPDYPS

SEQ ID NO: 1162278 - protein, 7 aa, Mycobacterium
GPGDDGV

SEQ ID NO: 1162279 - protein, 6 aa, Mycobacterium
GPGFAD

SEQ ID NO: 1162280 - protein, 6 aa, Mycobacterium
GPGGAP

SEQ ID NO: 1162281 - protein, 6 aa, Mycobacterium
GPGGEQ

SEQ ID NO: 1162282 - protein, 6 aa, Mycobacterium
GPGGKT

SEQ ID NO: 1162283 - protein, 9 aa, Mycobacterium
GPGHGGPGL

SEQ ID NO: 1162284 - protein, 9 aa, Mycobacterium
GPGKGNAMG

SEQ ID NO: 1162285 - protein, 8 aa, Mycobacterium
GPGPLRDT

SEQ ID NO: 1162286 - protein, 11 aa, Mycobacterium
GPGPVDVSDGD

SEQ ID NO: 1162287 - protein, 5 aa, Mycobacterium
GPGQT

SEQ ID NO: 1162288 - protein, 11 aa, Mycobacterium
GPGRARSGGRL

SEQ ID NO: 1162289 - protein, 6 aa, Mycobacterium
GPGSAV

SEQ ID NO: 1162290 - protein, 5 aa, Mycobacterium
GPGSK

SEQ ID NO: 1162291 - protein, 7 aa, Mycobacterium
GPGSPSV

SEQ ID NO: 1162292 - protein, 6 aa, Mycobacterium
GPGSTA

SEQ ID NO: 1162293 - protein, 6 aa, Mycobacterium
GPGTAG

SEQ ID NO: 1162294 - protein, 5 aa, Mycobacterium
GPGTY

SEQ ID NO: 1162295 - protein, 8 aa, Mycobacterium
GPGVDTDY

SEQ ID NO: 1162296 - protein, 12 aa, Mycobacterium
GPGVFGPPRDHD

SEQ ID NO: 1162297 - protein, 19 aa, Mycobacterium
GPHTTSDDPTRYRDQSEVD

SEQ ID NO: 1162298 - protein, 6 aa, Mycobacterium
GPIGNA

SEQ ID NO: 1162299 - protein, 7 aa, Mycobacterium
GPISPTD

SEQ ID NO: 1162300 - protein, 15 aa, Mycobacterium
GPKDQAVPWNRVHYT

SEQ ID NO: 1162301 - protein, 8 aa, Mycobacterium
GPKEHASS

SEQ ID NO: 1162302 - protein, 8 aa, Mycobacterium
GPKGGPGM

SEQ ID NO: 1162303 - protein, 8 aa, Mycobacterium
GPKGSGAF

SEQ ID NO: 1162304 - protein, 6 aa, Mycobacterium
GPKGTL

SEQ ID NO: 1162305 - protein, 8 aa, Mycobacterium
GPKTAKKL

SEQ ID NO: 1162306 - protein, 8 aa, Mycobacterium
GPLANASF

SEQ ID NO: 1162307 - protein, 4 aa, Mycobacterium
GPLE

SEQ ID NO: 1162308 - protein, 13 aa, Mycobacterium
GPLPAASDVSAEL

SEQ ID NO: 1162309 - protein, 7 aa, Mycobacterium
GPLPEPA

SEQ ID NO: 1162310 - protein, 9 aa, Mycobacterium
GPLPLPPSK

SEQ ID NO: 1162311 - protein, 11 aa, Mycobacterium
GPLPSHTDDDD

SEQ ID NO: 1162312 - protein, 4 aa, Mycobacterium
GPLR

SEQ ID NO: 1162313 - protein, 4 aa, Mycobacterium
GPLT

SEQ ID NO: 1162314 - protein, 5 aa, Mycobacterium
GPNEF

SEQ ID NO: 1162315 - protein, 10 aa, Mycobacterium
GPNGAGKSTA

SEQ ID NO: 1162316 - protein, 11 aa, Mycobacterium
GPNGAGKTTTV

SEQ ID NO: 1162317 - protein, 7 aa, Mycobacterium
GPNGGAD

SEQ ID NO: 1162318 - protein, 10 aa, Mycobacterium
GPNGSGKSTT

SEQ ID NO: 1162319 - protein, 8 aa, Mycobacterium
GPNPRQPS

SEQ ID NO: 1162320 - protein, 7 aa, Mycobacterium
GPNYNKP

SEQ ID NO: 1162321 - protein, 6 aa, Mycobacterium
GPPADL

SEQ ID NO: 1162322 - protein, 8 aa, Mycobacterium
GPPADPEC

SEQ ID NO: 1162323 - protein, 8 aa, Mycobacterium
GPPDAPQQ

SEQ ID NO: 1162324 - protein, 6 aa, Mycobacterium
GPPDTR

SEQ ID NO: 1162325 - protein, 7 aa, Mycobacterium
GPPDYPA

SEQ ID NO: 1162326 - protein, 7 aa, Mycobacterium
GPPELAT

SEQ ID NO: 1162327 - protein, 15 aa, Mycobacterium
GPPGAAAAGIGEDDH

SEQ ID NO: 1162328 - protein, 8 aa, Mycobacterium
GPPGAGEL

SEQ ID NO: 1162329 - protein, 7 aa, Mycobacterium
GPPGIGK

SEQ ID NO: 1162330 - protein, 18 aa, Mycobacterium
GPPGPAYGDTISGTNLAG

SEQ ID NO: 1162331 - protein, 7 aa, Mycobacterium
GPPGQGV

SEQ ID NO: 1162332 - protein, 5 aa, Mycobacterium
GPPGS

SEQ ID NO: 1162333 - protein, 8 aa, Mycobacterium
GPPGSGRS

SEQ ID NO: 1162334 - protein, 9 aa, Mycobacterium
GPPGTAETV

SEQ ID NO: 1162335 - protein, 6 aa, Mycobacterium
GPPKSM

SEQ ID NO: 1162336 - protein, 9 aa, Mycobacterium
GPPKSSRAL

SEQ ID NO: 1162337 - protein, 7 aa, Mycobacterium
GPPTPVE

SEQ ID NO: 1162338 - protein, 23 aa, Mycobacterium
GPPVVKESTGEDISKEDLGGPEV

SEQ ID NO: 1162339 - protein, 21 aa, Mycobacterium
GPQAASIESPEFARRLAAAKR

SEQ ID NO: 1162340 - protein, 8 aa, Mycobacterium
GPQATGGN

SEQ ID NO: 1162341 - protein, 9 aa, Mycobacterium
GPQDDKQVA

SEQ ID NO: 1162342 - protein, 8 aa, Mycobacterium
GPQDRVRE

SEQ ID NO: 1162343 - protein, 8 aa, Mycobacterium
GPQGDNTY

SEQ ID NO: 1162344 - protein, 7 aa, Mycobacterium
GPQHGPR

SEQ ID NO: 1162345 - protein, 5 aa, Mycobacterium
GPQIG

SEQ ID NO: 1162346 - protein, 9 aa, Mycobacterium
GPQIGEGRK

SEQ ID NO: 1162347 - protein, 6 aa, Mycobacterium
GPQLDG

SEQ ID NO: 1162348 - protein, 7 aa, Mycobacterium
GPQLKRG

SEQ ID NO: 1162349 - protein, 7 aa, Mycobacterium
GPQRSIT

SEQ ID NO: 1162350 - protein, 7 aa, Mycobacterium
GPRDPTF

SEQ ID NO: 1162351 - protein, 11 aa, Mycobacterium
GPREFERPAPR

SEQ ID NO: 1162352 - protein, 9 aa, Mycobacterium
GPRERSRDG

SEQ ID NO: 1162353 - protein, 6 aa, Mycobacterium
GPRETD

SEQ ID NO: 1162354 - protein, 14 aa, Mycobacterium
GPRGHAELTPQEDA

SEQ ID NO: 1162355 - protein, 5 aa, Mycobacterium
GPRGL

SEQ ID NO: 1162356 - protein, 25 aa, Mycobacterium
GPRGPDPAGGGEDTLRDTPKGVGPR

SEQ ID NO: 1162357 - protein, 5 aa, Mycobacterium
GPRIG

SEQ ID NO: 1162358 - protein, 4 aa, Mycobacterium
GPRP

SEQ ID NO: 1162359 - protein, 12 aa, Mycobacterium
GPRPPHPQWPGD

SEQ ID NO: 1162360 - protein, 11 aa, Mycobacterium
GPRQHPGGDAG

SEQ ID NO: 1162361 - protein, 6 aa, Mycobacterium
GPRSLQ

SEQ ID NO: 1162362 - protein, 12 aa, Mycobacterium
GPRVDDPPGSGR

SEQ ID NO: 1162363 - protein, 10 aa, Mycobacterium
GPRYQAPTRQ

SEQ ID NO: 1162364 - protein, 10 aa, Mycobacterium
GPSDTGSAGA

SEQ ID NO: 1162365 - protein, 6 aa, Mycobacterium
GPSFSG

SEQ ID NO: 1162366 - protein, 9 aa, Mycobacterium
GPSGAGKTT

SEQ ID NO: 1162367 - protein, 9 aa, Mycobacterium
GPSGGGKTT

SEQ ID NO: 1162368 - protein, 6 aa, Mycobacterium
GPSGVA

SEQ ID NO: 1162369 - protein, 6 aa, Mycobacterium
GPSHEP

SEQ ID NO: 1162370 - protein, 9 aa, Mycobacterium
GPSPNSPRE

SEQ ID NO: 1162371 - protein, 21 aa, Mycobacterium
GPSPSGWQVSKGSALNLLSAV

SEQ ID NO: 1162372 - protein, 8 aa, Mycobacterium
GPSQESLY

SEQ ID NO: 1162373 - protein, 7 aa, Mycobacterium
GPSRRQD

SEQ ID NO: 1162374 - protein, 14 aa, Mycobacterium
GPSRSAARIEGSKA

SEQ ID NO: 1162375 - protein, 6 aa, Mycobacterium
GPSSQW

SEQ ID NO: 1162376 - protein, 4 aa, Mycobacterium
GPSV

SEQ ID NO: 1162377 - protein, 10 aa, Mycobacterium
GPSYTRPPSW

SEQ ID NO: 1162378 - protein, 4 aa, Mycobacterium
GPTA

SEQ ID NO: 1162379 - protein, 6 aa, Mycobacterium
GPTADI

SEQ ID NO: 1162380 - protein, 6 aa, Mycobacterium
GPTAGY

SEQ ID NO: 1162381 - protein, 8 aa, Mycobacterium
GPTARAAE

SEQ ID NO: 1162382 - protein, 7 aa, Mycobacterium
GPTDTDI

SEQ ID NO: 1162383 - protein, 7 aa, Mycobacterium
GPTDVGD

SEQ ID NO: 1162384 - protein, 5 aa, Mycobacterium
GPTGA

SEQ ID NO: 1162385 - protein, 8 aa, Mycobacterium
GPTGLTAA

SEQ ID NO: 1162386 - protein, 17 aa, Mycobacterium
GPTHTRGNPPNVVETDP

SEQ ID NO: 1162387 - protein, 6 aa, Mycobacterium
GPTKEF

SEQ ID NO: 1162388 - protein, 7 aa, Mycobacterium
GPTLDPA

SEQ ID NO: 1162389 - protein, 6 aa, Mycobacterium
GPTLRD

SEQ ID NO: 1162390 - protein, 4 aa, Mycobacterium
GPTP

SEQ ID NO: 1162391 - protein, 8 aa, Mycobacterium
GPTPATKK

SEQ ID NO: 1162392 - protein, 5 aa, Mycobacterium
GPTPE

SEQ ID NO: 1162393 - protein, 19 aa, Mycobacterium
GPTPKVTANHRGGRRSNVP

SEQ ID NO: 1162394 - protein, 15 aa, Mycobacterium
GPTPTDSCEADGPCY

SEQ ID NO: 1162395 - protein, 8 aa, Mycobacterium
GPTPTGLA

SEQ ID NO: 1162396 - protein, 16 aa, Mycobacterium
GPTPTTTAGATPGEIT

SEQ ID NO: 1162397 - protein, 11 aa, Mycobacterium
GPTSAGSVPGP

SEQ ID NO: 1162398 - protein, 12 aa, Mycobacterium
GPTTGAPVSEAG

SEQ ID NO: 1162399 - protein, 7 aa, Mycobacterium
GPTTTPE

SEQ ID NO: 1162400 - protein, 6 aa, Mycobacterium
GPTVGP

SEQ ID NO: 1162401 - protein, 6 aa, Mycobacterium
GPTVSD

SEQ ID NO: 1162402 - protein, 12 aa, Mycobacterium
GPVAAAGAPVSA

SEQ ID NO: 1162403 - protein, 11 aa, Mycobacterium
GPVAAPPAPEL

SEQ ID NO: 1162404 - protein, 14 aa, Mycobacterium
GPVAPESAEPLAPG

SEQ ID NO: 1162405 - protein, 8 aa, Mycobacterium
GPVDPEHP

SEQ ID NO: 1162406 - protein, 6 aa, Mycobacterium
GPVEAA

SEQ ID NO: 1162407 - protein, 19 aa, Mycobacterium
GPVGKAGTTGARDRADDLA

SEQ ID NO: 1162408 - protein, 15 aa, Mycobacterium
GPVGPSALSERDTLE

SEQ ID NO: 1162409 - protein, 8 aa, Mycobacterium
GPVGSSEL

SEQ ID NO: 1162410 - protein, 6 aa, Mycobacterium
GPVGTE

SEQ ID NO: 1162411 - protein, 19 aa, Mycobacterium
GPVKRAGGISGWQTTPSVD

SEQ ID NO: 1162412 - protein, 4 aa, Mycobacterium
GPVL

SEQ ID NO: 1162413 - protein, 19 aa, Mycobacterium
GPVNGVAGGDLGKAEATLD

SEQ ID NO: 1162414 - protein, 5 aa, Mycobacterium
GPVPA

SEQ ID NO: 1162415 - protein, 5 aa, Mycobacterium
GPVPG

SEQ ID NO: 1162416 - protein, 8 aa, Mycobacterium
GPVPTEDD

SEQ ID NO: 1162417 - protein, 7 aa, Mycobacterium
GPVQSTA

SEQ ID NO: 1162418 - protein, 8 aa, Mycobacterium
GPVRAGDG

SEQ ID NO: 1162419 - protein, 13 aa, Mycobacterium
GPVRETLPDEHEQ

SEQ ID NO: 1162420 - protein, 6 aa, Mycobacterium
GPVRGA

SEQ ID NO: 1162421 - protein, 9 aa, Mycobacterium
GPVRPGTKT

SEQ ID NO: 1162422 - protein, 7 aa, Mycobacterium
GPVTADS

SEQ ID NO: 1162423 - protein, 5 aa, Mycobacterium
GPVTH

SEQ ID NO: 1162424 - protein, 5 aa, Mycobacterium
GPVTS

SEQ ID NO: 1162425 - protein, 5 aa, Mycobacterium
GPVYD

SEQ ID NO: 1162426 - protein, 5 aa, Mycobacterium
GPWGT

SEQ ID NO: 1162427 - protein, 6 aa, Mycobacterium
GPWRDN

SEQ ID NO: 1162428 - protein, 10 aa, Mycobacterium
GPWTDRPATE

SEQ ID NO: 1162429 - protein, 13 aa, Mycobacterium
GPYDPPNGQRCNP

SEQ ID NO: 1162430 - protein, 25 aa, Mycobacterium
GPYEPGYNSDSTRTYSLGEPDPEVA

SEQ ID NO: 1162431 - protein, 7 aa, Mycobacterium
GPYETSL

SEQ ID NO: 1162432 - protein, 5 aa, Mycobacterium
GPYGY

SEQ ID NO: 1162433 - protein, 5 aa, Mycobacterium
GPYRT

SEQ ID NO: 1162434 - protein, 12 aa, Mycobacterium
GPYRYDNTSAAR

SEQ ID NO: 1162435 - protein, 11 aa, Mycobacterium
GQAAQGAEDRL

SEQ ID NO: 1162436 - protein, 10 aa, Mycobacterium
GQAEQDEPTP

SEQ ID NO: 1162437 - protein, 8 aa, Mycobacterium
GQAGEAAQ

SEQ ID NO: 1162438 - protein, 17 aa, Mycobacterium
GQAPTRGRKGSTESLEG

SEQ ID NO: 1162439 - protein, 12 aa, Mycobacterium
GQATGRQVEGAK

SEQ ID NO: 1162440 - protein, 17 aa, Mycobacterium
GQATSGSPAHIPFIGAT

SEQ ID NO: 1162441 - protein, 4 aa, Mycobacterium
GQDC

SEQ ID NO: 1162442 - protein, 18 aa, Mycobacterium
GQDEDGRSWADTPEDDNL

SEQ ID NO: 1162443 - protein, 5 aa, Mycobacterium
GQDVN

SEQ ID NO: 1162444 - protein, 5 aa, Mycobacterium
GQDVS

SEQ ID NO: 1162445 - protein, 5 aa, Mycobacterium
GQEES

SEQ ID NO: 1162446 - protein, 5 aa, Mycobacterium
GQEPV

SEQ ID NO: 1162447 - protein, 6 aa, Mycobacterium
GQERPL

SEQ ID NO: 1162448 - protein, 6 aa, Mycobacterium
GQESLD

SEQ ID NO: 1162449 - protein, 7 aa, Mycobacterium
GQETTAK

SEQ ID NO: 1162450 - protein, 10 aa, Mycobacterium
GQFDPTTMGT

SEQ ID NO: 1162451 - protein, 4 aa, Mycobacterium
GQFE

SEQ ID NO: 1162452 - protein, 4 aa, Mycobacterium
GQFP

SEQ ID NO: 1162453 - protein, 7 aa, Mycobacterium
GQFTDGA

SEQ ID NO: 1162454 - protein, 5 aa, Mycobacterium
GQGDL

SEQ ID NO: 1162455 - protein, 7 aa, Mycobacterium
GQGERKT

SEQ ID NO: 1162456 - protein, 12 aa, Mycobacterium
GQGGKADSLGAA

SEQ ID NO: 1162457 - protein, 8 aa, Mycobacterium
GQGGLQRN

SEQ ID NO: 1162458 - protein, 7 aa, Mycobacterium
GQGHDPR

SEQ ID NO: 1162459 - protein, 9 aa, Mycobacterium
GQGLADEQE

SEQ ID NO: 1162460 - protein, 8 aa, Mycobacterium
GQGLAPIS

SEQ ID NO: 1162461 - protein, 8 aa, Mycobacterium
GQGRTRDD

SEQ ID NO: 1162462 - protein, 4 aa, Mycobacterium
GQGS

SEQ ID NO: 1162463 - protein, 8 aa, Mycobacterium
GQGTAEAL

SEQ ID NO: 1162464 - protein, 7 aa, Mycobacterium
GQGTAGL

SEQ ID NO: 1162465 - protein, 6 aa, Mycobacterium
GQGTRL

SEQ ID NO: 1162466 - protein, 9 aa, Mycobacterium
GQIAAGSGA

SEQ ID NO: 1162467 - protein, 14 aa, Mycobacterium
GQIASTEQTPPGAV

SEQ ID NO: 1162468 - protein, 7 aa, Mycobacterium
GQIGGGD

SEQ ID NO: 1162469 - protein, 9 aa, Mycobacterium
GQKATSRHI

SEQ ID NO: 1162470 - protein, 9 aa, Mycobacterium
GQKMAETAT

SEQ ID NO: 1162471 - protein, 9 aa, Mycobacterium
GQKSGDPCV

SEQ ID NO: 1162472 - protein, 4 aa, Mycobacterium
GQKV

SEQ ID NO: 1162473 - protein, 6 aa, Mycobacterium
GQKYSD

SEQ ID NO: 1162474 - protein, 8 aa, Mycobacterium
GQLEDRGY

SEQ ID NO: 1162475 - protein, 14 aa, Mycobacterium
GQLPKTGSVIGSNA

SEQ ID NO: 1162476 - protein, 7 aa, Mycobacterium
GQLPSDR

SEQ ID NO: 1162477 - protein, 7 aa, Mycobacterium
GQLSNNR

SEQ ID NO: 1162478 - protein, 13 aa, Mycobacterium
GQLTSATNTAMLR

SEQ ID NO: 1162479 - protein, 6 aa, Mycobacterium
GQPAAP

SEQ ID NO: 1162480 - protein, 5 aa, Mycobacterium
GQPAL

SEQ ID NO: 1162481 - protein, 5 aa, Mycobacterium
GQPDA

SEQ ID NO: 1162482 - protein, 7 aa, Mycobacterium
GQPDAAD

SEQ ID NO: 1162483 - protein, 16 aa, Mycobacterium
GQPDGRALGKAASQAD

SEQ ID NO: 1162484 - protein, 16 aa, Mycobacterium
GQPEWGSDSDGHEPDR

SEQ ID NO: 1162485 - protein, 6 aa, Mycobacterium
GQPGAE

SEQ ID NO: 1162486 - protein, 6 aa, Mycobacterium
GQPGLT

SEQ ID NO: 1162487 - protein, 7 aa, Mycobacterium
GQPGTAP

SEQ ID NO: 1162488 - protein, 15 aa, Mycobacterium
GQPHDDIALLAVTCG

SEQ ID NO: 1162489 - protein, 15 aa, Mycobacterium
GQPIDGRGEIETTDR

SEQ ID NO: 1162490 - protein, 6 aa, Mycobacterium
GQPIPR

SEQ ID NO: 1162491 - protein, 8 aa, Mycobacterium
GQPSDEEI

SEQ ID NO: 1162492 - protein, 4 aa, Mycobacterium
GQPT

SEQ ID NO: 1162493 - protein, 17 aa, Mycobacterium
GQPTPGGGARSAADPEF

SEQ ID NO: 1162494 - protein, 6 aa, Mycobacterium
GQPWQK

SEQ ID NO: 1162495 - protein, 9 aa, Mycobacterium
GQPYPEGLD

SEQ ID NO: 1162496 - protein, 6 aa, Mycobacterium
GQQHKV

SEQ ID NO: 1162497 - protein, 8 aa, Mycobacterium
GQQTSTGE

SEQ ID NO: 1162498 - protein, 10 aa, Mycobacterium
GQRAEWSEER

SEQ ID NO: 1162499 - protein, 8 aa, Mycobacterium
GQRAGTVR

SEQ ID NO: 1162500 - protein, 5 aa, Mycobacterium
GQRGI

SEQ ID NO: 1162501 - protein, 6 aa, Mycobacterium
GQRGIY

SEQ ID NO: 1162502 - protein, 5 aa, Mycobacterium
GQRLD

SEQ ID NO: 1162503 - protein, 5 aa, Mycobacterium
GQRPV

SEQ ID NO: 1162504 - protein, 12 aa, Mycobacterium
GQRRTGTGTTTF

SEQ ID NO: 1162505 - protein, 4 aa, Mycobacterium
GQRS

SEQ ID NO: 1162506 - protein, 7 aa, Mycobacterium
GQRVEAG

SEQ ID NO: 1162507 - protein, 13 aa, Mycobacterium
GQRVERRPLSQFD

SEQ ID NO: 1162508 - protein, 5 aa, Mycobacterium
GQRVN

SEQ ID NO: 1162509 - protein, 6 aa, Mycobacterium
GQRVTD

SEQ ID NO: 1162510 - protein, 8 aa, Mycobacterium
GQSAGGSL

SEQ ID NO: 1162511 - protein, 7 aa, Mycobacterium
GQSEGQG

SEQ ID NO: 1162512 - protein, 10 aa, Mycobacterium
GQSIAPAGTM

SEQ ID NO: 1162513 - protein, 7 aa, Mycobacterium
GQSLPSS

SEQ ID NO: 1162514 - protein, 5 aa, Mycobacterium
GQSNA

SEQ ID NO: 1162515 - protein, 11 aa, Mycobacterium
GQSPGSPEEDP

SEQ ID NO: 1162516 - protein, 14 aa, Mycobacterium
GQSPKGPQATGVRT

SEQ ID NO: 1162517 - protein, 6 aa, Mycobacterium
GQSPTV

SEQ ID NO: 1162518 - protein, 5 aa, Mycobacterium
GQTKY

SEQ ID NO: 1162519 - protein, 6 aa, Mycobacterium
GQTLSS

SEQ ID NO: 1162520 - protein, 26 aa, Mycobacterium
GQTTTTEDAEGDVVETTPATGITDEQ

SEQ ID NO: 1162521 - protein, 10 aa, Mycobacterium
GQVPPTLPAP

SEQ ID NO: 1162522 - protein, 18 aa, Mycobacterium
GQWRRSDTSNQKRSRGRG

SEQ ID NO: 1162523 - protein, 7 aa, Mycobacterium
GRAAAAG

SEQ ID NO: 1162524 - protein, 16 aa, Mycobacterium
GRAADRASLPPDAHRT

SEQ ID NO: 1162525 - protein, 13 aa, Mycobacterium
GRAAEIRDAAKSH

SEQ ID NO: 1162526 - protein, 5 aa, Mycobacterium
GRAAG

SEQ ID NO: 1162527 - protein, 6 aa, Mycobacterium
GRAAGT

SEQ ID NO: 1162528 - protein, 15 aa, Mycobacterium
GRAAGVEVTTPSGVE

SEQ ID NO: 1162529 - protein, 8 aa, Mycobacterium
GRAASAAE

SEQ ID NO: 1162530 - protein, 10 aa, Mycobacterium
GRADDDTVDA

SEQ ID NO: 1162531 - protein, 10 aa, Mycobacterium
GRADEAAAQF

SEQ ID NO: 1162532 - protein, 9 aa, Mycobacterium
GRADGGTAV

SEQ ID NO: 1162533 - protein, 14 aa, Mycobacterium
GRADRAVQRAEEAV

SEQ ID NO: 1162534 - protein, 6 aa, Mycobacterium
GRADRP

SEQ ID NO: 1162535 - protein, 13 aa, Mycobacterium
GRADSPPSSRDLD

SEQ ID NO: 1162536 - protein, 8 aa, Mycobacterium
GRAEADDQ

SEQ ID NO: 1162537 - protein, 12 aa, Mycobacterium
GRAEGRQVPGAD

SEQ ID NO: 1162538 - protein, 5 aa, Mycobacterium
GRAEP

SEQ ID NO: 1162539 - protein, 10 aa, Mycobacterium
GRAESAMESE

SEQ ID NO: 1162540 - protein, 8 aa, Mycobacterium
GRAGGHHS

SEQ ID NO: 1162541 - protein, 9 aa, Mycobacterium
GRAGHQVGE

SEQ ID NO: 1162542 - protein, 10 aa, Mycobacterium
GRAGRATSSA

SEQ ID NO: 1162543 - protein, 10 aa, Mycobacterium
GRAGRDGGDA

SEQ ID NO: 1162544 - protein, 8 aa, Mycobacterium
GRAGRRAR

SEQ ID NO: 1162545 - protein, 20 aa, Mycobacterium
GRAGTDLEPSLRPRPERDDK

SEQ ID NO: 1162546 - protein, 7 aa, Mycobacterium
GRAGTPI

SEQ ID NO: 1162547 - protein, 13 aa, Mycobacterium
GRAGVDDRTAAEV

SEQ ID NO: 1162548 - protein, 9 aa, Mycobacterium
GRAGVGRTT

SEQ ID NO: 1162549 - protein, 10 aa, Mycobacterium
GRAKVTGAAP

SEQ ID NO: 1162550 - protein, 7 aa, Mycobacterium
GRAMAQG

SEQ ID NO: 1162551 - protein, 9 aa, Mycobacterium
GRAPARPRK

SEQ ID NO: 1162552 - protein, 11 aa, Mycobacterium
GRAPRIAPQSP

SEQ ID NO: 1162553 - protein, 6 aa, Mycobacterium
GRAPRV

SEQ ID NO: 1162554 - protein, 6 aa, Mycobacterium
GRARDR

SEQ ID NO: 1162555 - protein, 14 aa, Mycobacterium
GRARSAAKTTRLSR

SEQ ID NO: 1162556 - protein, 7 aa, Mycobacterium
GRASAVE

SEQ ID NO: 1162557 - protein, 7 aa, Mycobacterium
GRASEND

SEQ ID NO: 1162558 - protein, 6 aa, Mycobacterium
GRASVA

SEQ ID NO: 1162559 - protein, 16 aa, Mycobacterium
GRATGGPDPLGRTREA

SEQ ID NO: 1162560 - protein, 12 aa, Mycobacterium
GRAYIGSQQREN

SEQ ID NO: 1162561 - protein, 10 aa, Mycobacterium
GRCDDADSVD

SEQ ID NO: 1162562 - protein, 4 aa, Mycobacterium
GRDA

SEQ ID NO: 1162563 - protein, 10 aa, Mycobacterium
GRDADGRPFT

SEQ ID NO: 1162564 - protein, 10 aa, Mycobacterium
GRDAERGAQA

SEQ ID NO: 1162565 - protein, 6 aa, Mycobacterium
GRDAGR

SEQ ID NO: 1162566 - protein, 16 aa, Mycobacterium
GRDAPLGAPGGSATVG

SEQ ID NO: 1162567 - protein, 15 aa, Mycobacterium
GRDAYRDSDGTDVRN

SEQ ID NO: 1162568 - protein, 6 aa, Mycobacterium
GRDDAE

SEQ ID NO: 1162569 - protein, 20 aa, Mycobacterium
GRDEPLGSPGGAAKVGPVQA

SEQ ID NO: 1162570 - protein, 9 aa, Mycobacterium
GRDLPEEYQ

SEQ ID NO: 1162571 - protein, 15 aa, Mycobacterium
GRDNVADPATGEVDP

SEQ ID NO: 1162572 - protein, 4 aa, Mycobacterium
GRDP

SEQ ID NO: 1162573 - protein, 6 aa, Mycobacterium
GRDPDQ

SEQ ID NO: 1162574 - protein, 6 aa, Mycobacterium
GRDPDT

SEQ ID NO: 1162575 - protein, 9 aa, Mycobacterium
GRDPGLEPG

SEQ ID NO: 1162576 - protein, 10 aa, Mycobacterium
GRDPLNHNDQ

SEQ ID NO: 1162577 - protein, 7 aa, Mycobacterium
GRDPYPV

SEQ ID NO: 1162578 - protein, 14 aa, Mycobacterium
GRDQVNPQAGRDAA

SEQ ID NO: 1162579 - protein, 8 aa, Mycobacterium
GRDRATGE

SEQ ID NO: 1162580 - protein, 9 aa, Mycobacterium
GRDRTPDPL

SEQ ID NO: 1162581 - protein, 6 aa, Mycobacterium
GRDSAY

SEQ ID NO: 1162582 - protein, 8 aa, Mycobacterium
GRDSPQTR

SEQ ID NO: 1162583 - protein, 15 aa, Mycobacterium
GRDTGARPGRLVRGA

SEQ ID NO: 1162584 - protein, 18 aa, Mycobacterium
GRDTTLDVPSRQTSGYPV

SEQ ID NO: 1162585 - protein, 4 aa, Mycobacterium
GRDY

SEQ ID NO: 1162586 - protein, 31 aa, Mycobacterium
GREALGGRPFGDGTPPGPAREGERVAAGHTP

SEQ ID NO: 1162587 - protein, 18 aa, Mycobacterium
GREATDEELAEESGIPAE

SEQ ID NO: 1162588 - protein, 9 aa, Mycobacterium
GREDATDVA

SEQ ID NO: 1162589 - protein, 9 aa, Mycobacterium
GREDQTRRF

SEQ ID NO: 1162590 - protein, 21 aa, Mycobacterium
GREDYADYAQSGGYRELPDPE

SEQ ID NO: 1162591 - protein, 12 aa, Mycobacterium
GREGDDDGPGGI

SEQ ID NO: 1162592 - protein, 14 aa, Mycobacterium
GREGPAAQNDAPGL

SEQ ID NO: 1162593 - protein, 9 aa, Mycobacterium
GREHPTVAA

SEQ ID NO: 1162594 - protein, 6 aa, Mycobacterium
GREQTL

SEQ ID NO: 1162595 - protein, 8 aa, Mycobacterium
GRERTRAE

SEQ ID NO: 1162596 - protein, 5 aa, Mycobacterium
GRESI

SEQ ID NO: 1162597 - protein, 8 aa, Mycobacterium
GRFNAGPD

SEQ ID NO: 1162598 - protein, 4 aa, Mycobacterium
GRFP

SEQ ID NO: 1162599 - protein, 15 aa, Mycobacterium
GRGAGSTSSSRAGDL

SEQ ID NO: 1162600 - protein, 11 aa, Mycobacterium
GRGEKGSGTVG

SEQ ID NO: 1162601 - protein, 18 aa, Mycobacterium
GRGENPGLSQVQDDPPTR

SEQ ID NO: 1162602 - protein, 10 aa, Mycobacterium
GRGGDDPVAT

SEQ ID NO: 1162603 - protein, 8 aa, Mycobacterium
GRGGDGSA

SEQ ID NO: 1162604 - protein, 5 aa, Mycobacterium
GRGGF

SEQ ID NO: 1162605 - protein, 7 aa, Mycobacterium
GRGGQVD

SEQ ID NO: 1162606 - protein, 12 aa, Mycobacterium
GRGIETAAPLGV

SEQ ID NO: 1162607 - protein, 5 aa, Mycobacterium
GRGKR

SEQ ID NO: 1162608 - protein, 5 aa, Mycobacterium
GRGLE

SEQ ID NO: 1162609 - protein, 6 aa, Mycobacterium
GRGPEE

SEQ ID NO: 1162610 - protein, 5 aa, Mycobacterium
GRGPL

SEQ ID NO: 1162611 - protein, 7 aa, Mycobacterium
GRGPLPS

SEQ ID NO: 1162612 - protein, 5 aa, Mycobacterium
GRGRA

SEQ ID NO: 1162613 - protein, 10 aa, Mycobacterium
GRGRAPKRSD

SEQ ID NO: 1162614 - protein, 16 aa, Mycobacterium
GRGRSEITPPGSYGLD

SEQ ID NO: 1162615 - protein, 8 aa, Mycobacterium
GRGRTSGA

SEQ ID NO: 1162616 - protein, 4 aa, Mycobacterium
GRGS

SEQ ID NO: 1162617 - protein, 9 aa, Mycobacterium
GRGSGDDGV

SEQ ID NO: 1162618 - protein, 20 aa, Mycobacterium
GRGSGGGGGTRAGLAAPEPL

SEQ ID NO: 1162619 - protein, 14 aa, Mycobacterium
GRGSHLGTGGMASK

SEQ ID NO: 1162620 - protein, 6 aa, Mycobacterium
GRGSLS

SEQ ID NO: 1162621 - protein, 9 aa, Mycobacterium
GRGSPDSRY

SEQ ID NO: 1162622 - protein, 9 aa, Mycobacterium
GRGTETPDV

SEQ ID NO: 1162623 - protein, 15 aa, Mycobacterium
GRGTPPGIFPGDGDR

SEQ ID NO: 1162624 - protein, 6 aa, Mycobacterium
GRGTRV

SEQ ID NO: 1162625 - protein, 7 aa, Mycobacterium
GRGYATA

SEQ ID NO: 1162626 - protein, 23 aa, Mycobacterium
GRHASTVGVPARNTPESDPTAAV

SEQ ID NO: 1162627 - protein, 15 aa, Mycobacterium
GRHDPSGFADWLTLA

SEQ ID NO: 1162628 - protein, 8 aa, Mycobacterium
GRHGNTGE

SEQ ID NO: 1162629 - protein, 25 aa, Mycobacterium
GRHGSVAGVPATNIPPADTAAAVPP

SEQ ID NO: 1162630 - protein, 4 aa, Mycobacterium
GRHN

SEQ ID NO: 1162631 - protein, 6 aa, Mycobacterium
GRHPED

SEQ ID NO: 1162632 - protein, 26 aa, Mycobacterium
GRHSPGGDDEFRDSVGDGLRDSVDDI

SEQ ID NO: 1162633 - protein, 9 aa, Mycobacterium
GRHTRPESF

SEQ ID NO: 1162634 - protein, 5 aa, Mycobacterium
GRIDA

SEQ ID NO: 1162635 - protein, 5 aa, Mycobacterium
GRIGG

SEQ ID NO: 1162636 - protein, 4 aa, Mycobacterium
GRIL

SEQ ID NO: 1162637 - protein, 16 aa, Mycobacterium
GRINTDALDNSAGVDC

SEQ ID NO: 1162638 - protein, 5 aa, Mycobacterium
GRIPG

SEQ ID NO: 1162639 - protein, 15 aa, Mycobacterium
GRIPGNAGYESPNPH

SEQ ID NO: 1162640 - protein, 18 aa, Mycobacterium
GRIPSNPASGHRLPTSER

SEQ ID NO: 1162641 - protein, 10 aa, Mycobacterium
GRKATRLSEG

SEQ ID NO: 1162642 - protein, 15 aa, Mycobacterium
GRKELAEAAAKQAET

SEQ ID NO: 1162643 - protein, 7 aa, Mycobacterium
GRKEPYE

SEQ ID NO: 1162644 - protein, 7 aa, Mycobacterium
GRKGGLM

SEQ ID NO: 1162645 - protein, 6 aa, Mycobacterium
GRKGQE

SEQ ID NO: 1162646 - protein, 11 aa, Mycobacterium
GRKIEGSEKGQ

SEQ ID NO: 1162647 - protein, 10 aa, Mycobacterium
GRKTDNKRAA

SEQ ID NO: 1162648 - protein, 9 aa, Mycobacterium
GRKTGEPRV

SEQ ID NO: 1162649 - protein, 7 aa, Mycobacterium
GRKTGRR

SEQ ID NO: 1162650 - protein, 8 aa, Mycobacterium
GRLADPTD

SEQ ID NO: 1162651 - protein, 6 aa, Mycobacterium
GRLAKG

SEQ ID NO: 1162652 - protein, 10 aa, Mycobacterium
GRLGPQKDPE

SEQ ID NO: 1162653 - protein, 5 aa, Mycobacterium
GRLPE

SEQ ID NO: 1162654 - protein, 13 aa, Mycobacterium
GRLPEVSAESGTA

SEQ ID NO: 1162655 - protein, 11 aa, Mycobacterium
GRLTDDPGTGR

SEQ ID NO: 1162656 - protein, 19 aa, Mycobacterium
GRNAEPLSRERQIDTEQPG

SEQ ID NO: 1162657 - protein, 8 aa, Mycobacterium
GRNGESPV

SEQ ID NO: 1162658 - protein, 5 aa, Mycobacterium
GRNHR

SEQ ID NO: 1162659 - protein, 4 aa, Mycobacterium
GRNM

SEQ ID NO: 1162660 - protein, 6 aa, Mycobacterium
GRNPEL

SEQ ID NO: 1162661 - protein, 4 aa, Mycobacterium
GRNR

SEQ ID NO: 1162662 - protein, 6 aa, Mycobacterium
GRPAFT

SEQ ID NO: 1162663 - protein, 9 aa, Mycobacterium
GRPAGSAEL

SEQ ID NO: 1162664 - protein, 7 aa, Mycobacterium
GRPAHLP

SEQ ID NO: 1162665 - protein, 13 aa, Mycobacterium
GRPALATAESGPA

SEQ ID NO: 1162666 - protein, 10 aa, Mycobacterium
GRPAPGWGDT

SEQ ID NO: 1162667 - protein, 10 aa, Mycobacterium
GRPAPVDDPE

SEQ ID NO: 1162668 - protein, 7 aa, Mycobacterium
GRPARTA

SEQ ID NO: 1162669 - protein, 7 aa, Mycobacterium
GRPATGA

SEQ ID NO: 1162670 - protein, 6 aa, Mycobacterium
GRPAVD

SEQ ID NO: 1162671 - protein, 8 aa, Mycobacterium
GRPDETRE

SEQ ID NO: 1162672 - protein, 11 aa, Mycobacterium
GRPDGAPAGMS

SEQ ID NO: 1162673 - protein, 13 aa, Mycobacterium
GRPDPNRDARAEY

SEQ ID NO: 1162674 - protein, 7 aa, Mycobacterium
GRPDPSI

SEQ ID NO: 1162675 - protein, 8 aa, Mycobacterium
GRPDPWAD

SEQ ID NO: 1162676 - protein, 16 aa, Mycobacterium
GRPDRVDDLEQPVFAW

SEQ ID NO: 1162677 - protein, 13 aa, Mycobacterium
GRPDVNDMGTTYG

SEQ ID NO: 1162678 - protein, 5 aa, Mycobacterium
GRPEA

SEQ ID NO: 1162679 - protein, 6 aa, Mycobacterium
GRPEAI

SEQ ID NO: 1162680 - protein, 10 aa, Mycobacterium
GRPEHPSQSI

SEQ ID NO: 1162681 - protein, 9 aa, Mycobacterium
GRPETPQDV

SEQ ID NO: 1162682 - protein, 4 aa, Mycobacterium
GRPF

SEQ ID NO: 1162683 - protein, 6 aa, Mycobacterium
GRPFGG

SEQ ID NO: 1162684 - protein, 6 aa, Mycobacterium
GRPFGS

SEQ ID NO: 1162685 - protein, 16 aa, Mycobacterium
GRPFPTERGLGGRKDA

SEQ ID NO: 1162686 - protein, 11 aa, Mycobacterium
GRPGADPKAPM

SEQ ID NO: 1162687 - protein, 12 aa, Mycobacterium
GRPGGPAFRPSE

SEQ ID NO: 1162688 - protein, 9 aa, Mycobacterium
GRPGQSDEV

SEQ ID NO: 1162689 - protein, 6 aa, Mycobacterium
GRPIDT

SEQ ID NO: 1162690 - protein, 13 aa, Mycobacterium
GRPIVTDGGGAGN

SEQ ID NO: 1162691 - protein, 13 aa, Mycobacterium
GRPKGGPDPKYSL

SEQ ID NO: 1162692 - protein, 14 aa, Mycobacterium
GRPLPPGSEGVDRI

SEQ ID NO: 1162693 - protein, 25 aa, Mycobacterium
GRPLSSEPANRPATSYTAKQPDTSI

SEQ ID NO: 1162694 - protein, 15 aa, Mycobacterium
GRPPEVRDPAYPPVD

SEQ ID NO: 1162695 - protein, 9 aa, Mycobacterium
GRPPGGLTK

SEQ ID NO: 1162696 - protein, 10 aa, Mycobacterium
GRPPGRKDAA

SEQ ID NO: 1162697 - protein, 7 aa, Mycobacterium
GRPPLTA

SEQ ID NO: 1162698 - protein, 5 aa, Mycobacterium
GRPPV

SEQ ID NO: 1162699 - protein, 9 aa, Mycobacterium
GRPQPPPWD

SEQ ID NO: 1162700 - protein, 6 aa, Mycobacterium
GRPRDD

SEQ ID NO: 1162701 - protein, 16 aa, Mycobacterium
GRPRTEPETTGETGDG

SEQ ID NO: 1162702 - protein, 8 aa, Mycobacterium
GRPSDRWG

SEQ ID NO: 1162703 - protein, 9 aa, Mycobacterium
GRPSGNEVL

SEQ ID NO: 1162704 - protein, 7 aa, Mycobacterium
GRPSNFP

SEQ ID NO: 1162705 - protein, 6 aa, Mycobacterium
GRPSPA

SEQ ID NO: 1162706 - protein, 12 aa, Mycobacterium
GRPTLDASGEAS

SEQ ID NO: 1162707 - protein, 14 aa, Mycobacterium
GRPVDDNPNHRGAS

SEQ ID NO: 1162708 - protein, 10 aa, Mycobacterium
GRPVERPAGT

SEQ ID NO: 1162709 - protein, 6 aa, Mycobacterium
GRPVPA

SEQ ID NO: 1162710 - protein, 6 aa, Mycobacterium
GRPVRR

SEQ ID NO: 1162711 - protein, 8 aa, Mycobacterium
GRPYEPQI

SEQ ID NO: 1162712 - protein, 8 aa, Mycobacterium
GRQDHYDN

SEQ ID NO: 1162713 - protein, 6 aa, Mycobacterium
GRQGTI

SEQ ID NO: 1162714 - protein, 4 aa, Mycobacterium
GRQQ

SEQ ID NO: 1162715 - protein, 15 aa, Mycobacterium
GRQRDVPKVAGDATR

SEQ ID NO: 1162716 - protein, 4 aa, Mycobacterium
GRQS

SEQ ID NO: 1162717 - protein, 8 aa, Mycobacterium
GRQTGRLN

SEQ ID NO: 1162718 - protein, 5 aa, Mycobacterium
GRQTR

SEQ ID NO: 1162719 - protein, 6 aa, Mycobacterium
GRQTSM

SEQ ID NO: 1162720 - protein, 10 aa, Mycobacterium
GRRDEPAGAV

SEQ ID NO: 1162721 - protein, 7 aa, Mycobacterium
GRRDGET

SEQ ID NO: 1162722 - protein, 19 aa, Mycobacterium
GRRFPTSNSLPSGHSASAA

SEQ ID NO: 1162723 - protein, 4 aa, Mycobacterium
GRRG

SEQ ID NO: 1162724 - protein, 7 aa, Mycobacterium
GRRGASV

SEQ ID NO: 1162725 - protein, 15 aa, Mycobacterium
GRRGPDRDLPAYDDT

SEQ ID NO: 1162726 - protein, 8 aa, Mycobacterium
GRRGTISP

SEQ ID NO: 1162727 - protein, 4 aa, Mycobacterium
GRRI

SEQ ID NO: 1162728 - protein, 8 aa, Mycobacterium
GRRPTRSD

SEQ ID NO: 1162729 - protein, 5 aa, Mycobacterium
GRRRD

SEQ ID NO: 1162730 - protein, 14 aa, Mycobacterium
GRRRGRRSTEDDVA

SEQ ID NO: 1162731 - protein, 14 aa, Mycobacterium
GRRRLTADEPRDDP

SEQ ID NO: 1162732 - protein, 6 aa, Mycobacterium
GRRTFG

SEQ ID NO: 1162733 - protein, 21 aa, Mycobacterium
GRRTPTTPTTAVRSQRVIDVE

SEQ ID NO: 1162734 - protein, 7 aa, Mycobacterium
GRRVRNS

SEQ ID NO: 1162735 - protein, 8 aa, Mycobacterium
GRSDAPGW

SEQ ID NO: 1162736 - protein, 6 aa, Mycobacterium
GRSDEQ

SEQ ID NO: 1162737 - protein, 10 aa, Mycobacterium
GRSESPMESE

SEQ ID NO: 1162738 - protein, 16 aa, Mycobacterium
GRSGGAPETVRDGETG

SEQ ID NO: 1162739 - protein, 11 aa, Mycobacterium
GRSGSGKSTLA

SEQ ID NO: 1162740 - protein, 8 aa, Mycobacterium
GRSSAVRR

SEQ ID NO: 1162741 - protein, 9 aa, Mycobacterium
GRSSNPELA

SEQ ID NO: 1162742 - protein, 7 aa, Mycobacterium
GRSTAGL

SEQ ID NO: 1162743 - protein, 20 aa, Mycobacterium
GRSVPAGRARAVTARARQKG

SEQ ID NO: 1162744 - protein, 12 aa, Mycobacterium
GRSVPAKSLSNF

SEQ ID NO: 1162745 - protein, 5 aa, Mycobacterium
GRSYI

SEQ ID NO: 1162746 - protein, 5 aa, Mycobacterium
GRTAA

SEQ ID NO: 1162747 - protein, 32 aa, Mycobacterium
GRTADEDAFAEAGRQAADACAPDSDMRGSADY

SEQ ID NO: 1162748 - protein, 6 aa, Mycobacterium
GRTDGL

SEQ ID NO: 1162749 - protein, 13 aa, Mycobacterium
GRTDRDVQAGGKQ

SEQ ID NO: 1162750 - protein, 6 aa, Mycobacterium
GRTDVE

SEQ ID NO: 1162751 - protein, 30 aa, Mycobacterium
GRTGAAELSDPARAGGAISDNATDTPRRRR

SEQ ID NO: 1162752 - protein, 9 aa, Mycobacterium
GRTGDPEEL

SEQ ID NO: 1162753 - protein, 4 aa, Mycobacterium
GRTP

SEQ ID NO: 1162754 - protein, 25 aa, Mycobacterium
GRTPEKRAAASDLGAATAAEPVDVA

SEQ ID NO: 1162755 - protein, 7 aa, Mycobacterium
GRTPNGV

SEQ ID NO: 1162756 - protein, 9 aa, Mycobacterium
GRTPQRGPV

SEQ ID NO: 1162757 - protein, 14 aa, Mycobacterium
GRTPVRRDGARPGD

SEQ ID NO: 1162758 - protein, 12 aa, Mycobacterium
GRTSGRPRTTPI

SEQ ID NO: 1162759 - protein, 8 aa, Mycobacterium
GRTSRAAE

SEQ ID NO: 1162760 - protein, 24 aa, Mycobacterium
GRTVDKEPKWRHPGTKLETGATRT

SEQ ID NO: 1162761 - protein, 5 aa, Mycobacterium
GRTVP

SEQ ID NO: 1162762 - protein, 15 aa, Mycobacterium
GRTVTAAGAGETITT

SEQ ID NO: 1162763 - protein, 6 aa, Mycobacterium
GRVDSA

SEQ ID NO: 1162764 - protein, 9 aa, Mycobacterium
GRVEGLDSA

SEQ ID NO: 1162765 - protein, 6 aa, Mycobacterium
GRVEGR

SEQ ID NO: 1162766 - protein, 17 aa, Mycobacterium
GRVEPPGTELPVVEVAL

SEQ ID NO: 1162767 - protein, 4 aa, Mycobacterium
GRVG

SEQ ID NO: 1162768 - protein, 18 aa, Mycobacterium
GRVGPRPPGRLRPHRTEQ

SEQ ID NO: 1162769 - protein, 4 aa, Mycobacterium
GRVI

SEQ ID NO: 1162770 - protein, 6 aa, Mycobacterium
GRVPPG

SEQ ID NO: 1162771 - protein, 6 aa, Mycobacterium
GRVRTR

SEQ ID NO: 1162772 - protein, 4 aa, Mycobacterium
GRVS

SEQ ID NO: 1162773 - protein, 14 aa, Mycobacterium
GRVSMSDAATQRFS

SEQ ID NO: 1162774 - protein, 5 aa, Mycobacterium
GRVTA

SEQ ID NO: 1162775 - protein, 11 aa, Mycobacterium
GRVTKGDGTPY

SEQ ID NO: 1162776 - protein, 17 aa, Mycobacterium
GRWKSSRSWPPPAEPRT

SEQ ID NO: 1162777 - protein, 10 aa, Mycobacterium
GRWRPGRNGV

SEQ ID NO: 1162778 - protein, 4 aa, Mycobacterium
GRYG

SEQ ID NO: 1162779 - protein, 11 aa, Mycobacterium
GRYGGTYAASK

SEQ ID NO: 1162780 - protein, 12 aa, Mycobacterium
GRYPSPADERRA

SEQ ID NO: 1162781 - protein, 7 aa, Mycobacterium
GRYRGTG

SEQ ID NO: 1162782 - protein, 11 aa, Mycobacterium
GRYTPSPAGTG

SEQ ID NO: 1162783 - protein, 5 aa, Mycobacterium
GSAAA

SEQ ID NO: 1162784 - protein, 8 aa, Mycobacterium
GSAAERLS

SEQ ID NO: 1162785 - protein, 17 aa, Mycobacterium
GSAAGNSPIPNNATYAA

SEQ ID NO: 1162786 - protein, 10 aa, Mycobacterium
GSAANQDGHT

SEQ ID NO: 1162787 - protein, 8 aa, Mycobacterium
GSAAPEGR

SEQ ID NO: 1162788 - protein, 8 aa, Mycobacterium
GSAAPPFG

SEQ ID NO: 1162789 - protein, 9 aa, Mycobacterium
GSAATDSGF

SEQ ID NO: 1162790 - protein, 6 aa, Mycobacterium
GSAATI

SEQ ID NO: 1162791 - protein, 8 aa, Mycobacterium
GSADDAGV

SEQ ID NO: 1162792 - protein, 12 aa, Mycobacterium
GSADPATQWGKR

SEQ ID NO: 1162793 - protein, 17 aa, Mycobacterium
GSADRTAAVAASGPAGL

SEQ ID NO: 1162794 - protein, 10 aa, Mycobacterium
GSAEDRAGAP

SEQ ID NO: 1162795 - protein, 7 aa, Mycobacterium
GSAEDVA

SEQ ID NO: 1162796 - protein, 7 aa, Mycobacterium
GSAESLN

SEQ ID NO: 1162797 - protein, 6 aa, Mycobacterium
GSAGAK

SEQ ID NO: 1162798 - protein, 8 aa, Mycobacterium
GSAGGRDL

SEQ ID NO: 1162799 - protein, 15 aa, Mycobacterium
GSAKGEDLASTPYAS

SEQ ID NO: 1162800 - protein, 9 aa, Mycobacterium
GSAKKSYAP

SEQ ID NO: 1162801 - protein, 16 aa, Mycobacterium
GSALGEDTYDRLTSSA

SEQ ID NO: 1162802 - protein, 4 aa, Mycobacterium
GSAP

SEQ ID NO: 1162803 - protein, 7 aa, Mycobacterium
GSAPDEA

SEQ ID NO: 1162804 - protein, 14 aa, Mycobacterium
GSAPDIAGRGVANP

SEQ ID NO: 1162805 - protein, 5 aa, Mycobacterium
GSAPG

SEQ ID NO: 1162806 - protein, 6 aa, Mycobacterium
GSAPGV

SEQ ID NO: 1162807 - protein, 28 aa, Mycobacterium
GSAPRFADPAADRASGAALADSAKNRHE

SEQ ID NO: 1162808 - protein, 14 aa, Mycobacterium
GSAPTGRAEDVAPD

SEQ ID NO: 1162809 - protein, 7 aa, Mycobacterium
GSAQQAN

SEQ ID NO: 1162810 - protein, 9 aa, Mycobacterium
GSAQSKDEL

SEQ ID NO: 1162811 - protein, 10 aa, Mycobacterium
GSAQTTPEDL

SEQ ID NO: 1162812 - protein, 9 aa, Mycobacterium
GSAQVEAGM

SEQ ID NO: 1162813 - protein, 8 aa, Mycobacterium
GSASEQEL

SEQ ID NO: 1162814 - protein, 11 aa, Mycobacterium
GSASPATAQTL

SEQ ID NO: 1162815 - protein, 8 aa, Mycobacterium
GSASSSAD

SEQ ID NO: 1162816 - protein, 5 aa, Mycobacterium
GSATA

SEQ ID NO: 1162817 - protein, 8 aa, Mycobacterium
GSATGGDG

SEQ ID NO: 1162818 - protein, 10 aa, Mycobacterium
GSATNDGGAG

SEQ ID NO: 1162819 - protein, 10 aa, Mycobacterium
GSAVASGTAR

SEQ ID NO: 1162820 - protein, 11 aa, Mycobacterium
GSAVPEPGEFT

SEQ ID NO: 1162821 - protein, 7 aa, Mycobacterium
GSAVTED

SEQ ID NO: 1162822 - protein, 16 aa, Mycobacterium
GSAYGDKGPERDVGGF

SEQ ID NO: 1162823 - protein, 7 aa, Mycobacterium
GSDAAIG

SEQ ID NO: 1162824 - protein, 8 aa, Mycobacterium
GSDANPLA

SEQ ID NO: 1162825 - protein, 12 aa, Mycobacterium
GSDAPLPPGGGA

SEQ ID NO: 1162826 - protein, 5 aa, Mycobacterium
GSDCG

SEQ ID NO: 1162827 - protein, 7 aa, Mycobacterium
GSDDGAD

SEQ ID NO: 1162828 - protein, 8 aa, Mycobacterium
GSDDIGDL

SEQ ID NO: 1162829 - protein, 7 aa, Mycobacterium
GSDELKA

SEQ ID NO: 1162830 - protein, 10 aa, Mycobacterium
GSDELPPDHP

SEQ ID NO: 1162831 - protein, 5 aa, Mycobacterium
GSDEP

SEQ ID NO: 1162832 - protein, 7 aa, Mycobacterium
GSDEQKH

SEQ ID NO: 1162833 - protein, 8 aa, Mycobacterium
GSDGERRI

SEQ ID NO: 1162834 - protein, 8 aa, Mycobacterium
GSDGSGRV

SEQ ID NO: 1162835 - protein, 7 aa, Mycobacterium
GSDGTHT

SEQ ID NO: 1162836 - protein, 5 aa, Mycobacterium
GSDKV

SEQ ID NO: 1162837 - protein, 6 aa, Mycobacterium
GSDKVS

SEQ ID NO: 1162838 - protein, 4 aa, Mycobacterium
GSDL

SEQ ID NO: 1162839 - protein, 7 aa, Mycobacterium
GSDNFNR

SEQ ID NO: 1162840 - protein, 5 aa, Mycobacterium
GSDPD

SEQ ID NO: 1162841 - protein, 4 aa, Mycobacterium
GSDT

SEQ ID NO: 1162842 - protein, 20 aa, Mycobacterium
GSDTATAASIADGRPDLAGP

SEQ ID NO: 1162843 - protein, 13 aa, Mycobacterium
GSDTVDEARQGLQ

SEQ ID NO: 1162844 - protein, 12 aa, Mycobacterium
GSDYEPGYRRPD

SEQ ID NO: 1162845 - protein, 5 aa, Mycobacterium
GSEAV

SEQ ID NO: 1162846 - protein, 10 aa, Mycobacterium
GSECGPNEEG

SEQ ID NO: 1162847 - protein, 6 aa, Mycobacterium
GSEFSD

SEQ ID NO: 1162848 - protein, 7 aa, Mycobacterium
GSEGQRR

SEQ ID NO: 1162849 - protein, 6 aa, Mycobacterium
GSENSP

SEQ ID NO: 1162850 - protein, 6 aa, Mycobacterium
GSEPGS

SEQ ID NO: 1162851 - protein, 5 aa, Mycobacterium
GSEPI

SEQ ID NO: 1162852 - protein, 8 aa, Mycobacterium
GSEQAAAE

SEQ ID NO: 1162853 - protein, 11 aa, Mycobacterium
GSERFGTMTDG

SEQ ID NO: 1162854 - protein, 7 aa, Mycobacterium
GSERRPV

SEQ ID NO: 1162855 - protein, 6 aa, Mycobacterium
GSETEI

SEQ ID NO: 1162856 - protein, 11 aa, Mycobacterium
GSETGQRATEH

SEQ ID NO: 1162857 - protein, 8 aa, Mycobacterium
GSETRSKT

SEQ ID NO: 1162858 - protein, 11 aa, Mycobacterium
GSFAGTGLRYP

SEQ ID NO: 1162859 - protein, 5 aa, Mycobacterium
GSFAP

SEQ ID NO: 1162860 - protein, 4 aa, Mycobacterium
GSFH

SEQ ID NO: 1162861 - protein, 6 aa, Mycobacterium
GSFSAA

SEQ ID NO: 1162862 - protein, 4 aa, Mycobacterium
GSFY

SEQ ID NO: 1162863 - protein, 5 aa, Mycobacterium
GSGAA

SEQ ID NO: 1162864 - protein, 7 aa, Mycobacterium
GSGADAE

SEQ ID NO: 1162865 - protein, 8 aa, Mycobacterium
GSGAGTSV

SEQ ID NO: 1162866 - protein, 5 aa, Mycobacterium
GSGAM

SEQ ID NO: 1162867 - protein, 12 aa, Mycobacterium
GSGARPGTSPKV

SEQ ID NO: 1162868 - protein, 10 aa, Mycobacterium
GSGATAGGHR

SEQ ID NO: 1162869 - protein, 9 aa, Mycobacterium
GSGAVPGPF

SEQ ID NO: 1162870 - protein, 11 aa, Mycobacterium
GSGAVQGARLA

SEQ ID NO: 1162871 - protein, 6 aa, Mycobacterium
GSGDVD

SEQ ID NO: 1162872 - protein, 14 aa, Mycobacterium
GSGEASNERITGQA

SEQ ID NO: 1162873 - protein, 7 aa, Mycobacterium
GSGEKRT

SEQ ID NO: 1162874 - protein, 25 aa, Mycobacterium
GSGERTTVADDPGADLGHPAISPDG

SEQ ID NO: 1162875 - protein, 6 aa, Mycobacterium
GSGGIY

SEQ ID NO: 1162876 - protein, 6 aa, Mycobacterium
GSGGLD

SEQ ID NO: 1162877 - protein, 6 aa, Mycobacterium
GSGGRS

SEQ ID NO: 1162878 - protein, 9 aa, Mycobacterium
GSGGTAPAA

SEQ ID NO: 1162879 - protein, 14 aa, Mycobacterium
GSGHTPFARAGDGL

SEQ ID NO: 1162880 - protein, 6 aa, Mycobacterium
GSGKTA

SEQ ID NO: 1162881 - protein, 7 aa, Mycobacterium
GSGMGRA

SEQ ID NO: 1162882 - protein, 6 aa, Mycobacterium
GSGNTI

SEQ ID NO: 1162883 - protein, 6 aa, Mycobacterium
GSGPRH

SEQ ID NO: 1162884 - protein, 10 aa, Mycobacterium
GSGRARFDEA

SEQ ID NO: 1162885 - protein, 7 aa, Mycobacterium
GSGRPTT

SEQ ID NO: 1162886 - protein, 5 aa, Mycobacterium
GSGRT

SEQ ID NO: 1162887 - protein, 5 aa, Mycobacterium
GSGRV

SEQ ID NO: 1162888 - protein, 10 aa, Mycobacterium
GSGSNITPFP

SEQ ID NO: 1162889 - protein, 16 aa, Mycobacterium
GSGTASRATAFICRPS

SEQ ID NO: 1162890 - protein, 10 aa, Mycobacterium
GSGTGEQGPM

SEQ ID NO: 1162891 - protein, 16 aa, Mycobacterium
GSGTLETVSPKGGDII

SEQ ID NO: 1162892 - protein, 8 aa, Mycobacterium
GSGTSEKT

SEQ ID NO: 1162893 - protein, 7 aa, Mycobacterium
GSGTYAD

SEQ ID NO: 1162894 - protein, 7 aa, Mycobacterium
GSHAGRE

SEQ ID NO: 1162895 - protein, 4 aa, Mycobacterium
GSHG

SEQ ID NO: 1162896 - protein, 20 aa, Mycobacterium
GSHGISIGGSTGEPGAQSVA

SEQ ID NO: 1162897 - protein, 6 aa, Mycobacterium
GSHGTH

SEQ ID NO: 1162898 - protein, 4 aa, Mycobacterium
GSHN

SEQ ID NO: 1162899 - protein, 5 aa, Mycobacterium
GSHPR

SEQ ID NO: 1162900 - protein, 8 aa, Mycobacterium
GSIEQPTV

SEQ ID NO: 1162901 - protein, 7 aa, Mycobacterium
GSIEQQR

SEQ ID NO: 1162902 - protein, 16 aa, Mycobacterium
GSIPGKRASGSVSGYT

SEQ ID NO: 1162903 - protein, 20 aa, Mycobacterium
GSIPKTSSGKLRRANSVSLV

SEQ ID NO: 1162904 - protein, 7 aa, Mycobacterium
GSIPTLG

SEQ ID NO: 1162905 - protein, 4 aa, Mycobacterium
GSIR

SEQ ID NO: 1162906 - protein, 10 aa, Mycobacterium
GSIRSQQGAY

SEQ ID NO: 1162907 - protein, 9 aa, Mycobacterium
GSITESGLG

SEQ ID NO: 1162908 - protein, 8 aa, Mycobacterium
GSKESRIA

SEQ ID NO: 1162909 - protein, 7 aa, Mycobacterium
GSKGGRE

SEQ ID NO: 1162910 - protein, 6 aa, Mycobacterium
GSKGQA

SEQ ID NO: 1162911 - protein, 26 aa, Mycobacterium
GSKWTASRDMPEPPTEAFRQWWSRTH

SEQ ID NO: 1162912 - protein, 5 aa, Mycobacterium
GSLAG

SEQ ID NO: 1162913 - protein, 5 aa, Mycobacterium
GSLDP

SEQ ID NO: 1162914 - protein, 4 aa, Mycobacterium
GSLP

SEQ ID NO: 1162915 - protein, 4 aa, Mycobacterium
GSLQ

SEQ ID NO: 1162916 - protein, 9 aa, Mycobacterium
GSLRDRGLK

SEQ ID NO: 1162917 - protein, 6 aa, Mycobacterium
GSLTAR

SEQ ID NO: 1162918 - protein, 13 aa, Mycobacterium
GSMRRQSAGDPVQ

SEQ ID NO: 1162919 - protein, 5 aa, Mycobacterium
GSMTD

SEQ ID NO: 1162920 - protein, 9 aa, Mycobacterium
GSNGAGKTT

SEQ ID NO: 1162921 - protein, 9 aa, Mycobacterium
GSPASEAAT

SEQ ID NO: 1162922 - protein, 9 aa, Mycobacterium
GSPASESAT

SEQ ID NO: 1162923 - protein, 7 aa, Mycobacterium
GSPATVQ

SEQ ID NO: 1162924 - protein, 13 aa, Mycobacterium
GSPAYPKSEDALR

SEQ ID NO: 1162925 - protein, 6 aa, Mycobacterium
GSPDCT

SEQ ID NO: 1162926 - protein, 6 aa, Mycobacterium
GSPDEV

SEQ ID NO: 1162927 - protein, 4 aa, Mycobacterium
GSPE

SEQ ID NO: 1162928 - protein, 14 aa, Mycobacterium
GSPELTAEPGEPGV

SEQ ID NO: 1162929 - protein, 10 aa, Mycobacterium
GSPGTDLARS

SEQ ID NO: 1162930 - protein, 7 aa, Mycobacterium
GSPIPGT

SEQ ID NO: 1162931 - protein, 5 aa, Mycobacterium
GSPPV

SEQ ID NO: 1162932 - protein, 6 aa, Mycobacterium
GSPRHE

SEQ ID NO: 1162933 - protein, 15 aa, Mycobacterium
GSPTDTRSLDDRDDL

SEQ ID NO: 1162934 - protein, 16 aa, Mycobacterium
GSPTFANGAGTPGARE

SEQ ID NO: 1162935 - protein, 9 aa, Mycobacterium
GSPTRAAAA

SEQ ID NO: 1162936 - protein, 9 aa, Mycobacterium
GSPTYPATD

SEQ ID NO: 1162937 - protein, 20 aa, Mycobacterium
GSPVGRTRDAAPGTPADRPV

SEQ ID NO: 1162938 - protein, 9 aa, Mycobacterium
GSQASNDQL

SEQ ID NO: 1162939 - protein, 12 aa, Mycobacterium
GSQASVVTGASS

SEQ ID NO: 1162940 - protein, 8 aa, Mycobacterium
GSQIESPI

SEQ ID NO: 1162941 - protein, 18 aa, Mycobacterium
GSQPSARALAQSSTPDQV

SEQ ID NO: 1162942 - protein, 6 aa, Mycobacterium
GSQTSI

SEQ ID NO: 1162943 - protein, 6 aa, Mycobacterium
GSQWAG

SEQ ID NO: 1162944 - protein, 4 aa, Mycobacterium
GSQY

SEQ ID NO: 1162945 - protein, 11 aa, Mycobacterium
GSRAAARRAAR

SEQ ID NO: 1162946 - protein, 9 aa, Mycobacterium
GSRATKTYR

SEQ ID NO: 1162947 - protein, 11 aa, Mycobacterium
GSRDPATPPAK

SEQ ID NO: 1162948 - protein, 5 aa, Mycobacterium
GSRDV

SEQ ID NO: 1162949 - protein, 4 aa, Mycobacterium
GSRE

SEQ ID NO: 1162950 - protein, 5 aa, Mycobacterium
GSRED

SEQ ID NO: 1162951 - protein, 7 aa, Mycobacterium
GSRGARL

SEQ ID NO: 1162952 - protein, 14 aa, Mycobacterium
GSRGSADTVRDTRG

SEQ ID NO: 1162953 - protein, 8 aa, Mycobacterium
GSRKASID

SEQ ID NO: 1162954 - protein, 9 aa, Mycobacterium
GSRKQLSAP

SEQ ID NO: 1162955 - protein, 14 aa, Mycobacterium
GSRNKYEVDHETGR

SEQ ID NO: 1162956 - protein, 14 aa, Mycobacterium
GSRPASRKPTTSIS

SEQ ID NO: 1162957 - protein, 6 aa, Mycobacterium
GSRPSP

SEQ ID NO: 1162958 - protein, 8 aa, Mycobacterium
GSRPSTDW

SEQ ID NO: 1162959 - protein, 7 aa, Mycobacterium
GSRREGF

SEQ ID NO: 1162960 - protein, 5 aa, Mycobacterium
GSRRK

SEQ ID NO: 1162961 - protein, 4 aa, Mycobacterium
GSRT

SEQ ID NO: 1162962 - protein, 15 aa, Mycobacterium
GSRTRGGQQADTKDD

SEQ ID NO: 1162963 - protein, 4 aa, Mycobacterium
GSSA

SEQ ID NO: 1162964 - protein, 8 aa, Mycobacterium
GSSAENTI

SEQ ID NO: 1162965 - protein, 5 aa, Mycobacterium
GSSAL

SEQ ID NO: 1162966 - protein, 8 aa, Mycobacterium
GSSATGAK

SEQ ID NO: 1162967 - protein, 8 aa, Mycobacterium
GSSEAPEP

SEQ ID NO: 1162968 - protein, 7 aa, Mycobacterium
GSSEELE

SEQ ID NO: 1162969 - protein, 8 aa, Mycobacterium
GSSGLPKA

SEQ ID NO: 1162970 - protein, 9 aa, Mycobacterium
GSSGPQGAF

SEQ ID NO: 1162971 - protein, 8 aa, Mycobacterium
GSSLPPAS

SEQ ID NO: 1162972 - protein, 21 aa, Mycobacterium
GSSLQGDRRTYQQDSGNAREA

SEQ ID NO: 1162973 - protein, 4 aa, Mycobacterium
GSSN

SEQ ID NO: 1162974 - protein, 9 aa, Mycobacterium
GSSPPSREA

SEQ ID NO: 1162975 - protein, 9 aa, Mycobacterium
GSSSPVSRD

SEQ ID NO: 1162976 - protein, 7 aa, Mycobacterium
GSSSSGL

SEQ ID NO: 1162977 - protein, 16 aa, Mycobacterium
GSSTENSAYGPTRNPW

SEQ ID NO: 1162978 - protein, 15 aa, Mycobacterium
GSSTTKDPGPWEGEQ

SEQ ID NO: 1162979 - protein, 8 aa, Mycobacterium
GSSTYTYD

SEQ ID NO: 1162980 - protein, 4 aa, Mycobacterium
GSTA

SEQ ID NO: 1162981 - protein, 10 aa, Mycobacterium
GSTAEPGTVG

SEQ ID NO: 1162982 - protein, 8 aa, Mycobacterium
GSTATDLA

SEQ ID NO: 1162983 - protein, 8 aa, Mycobacterium
GSTATGRA

SEQ ID NO: 1162984 - protein, 7 aa, Mycobacterium
GSTAVGQ

SEQ ID NO: 1162985 - protein, 10 aa, Mycobacterium
GSTDGRNQAA

SEQ ID NO: 1162986 - protein, 4 aa, Mycobacterium
GSTE

SEQ ID NO: 1162987 - protein, 7 aa, Mycobacterium
GSTGACS

SEQ ID NO: 1162988 - protein, 7 aa, Mycobacterium
GSTGGNI

SEQ ID NO: 1162989 - protein, 5 aa, Mycobacterium
GSTGT

SEQ ID NO: 1162990 - protein, 6 aa, Mycobacterium
GSTGTL

SEQ ID NO: 1162991 - protein, 9 aa, Mycobacterium
GSTGTPKGV

SEQ ID NO: 1162992 - protein, 10 aa, Mycobacterium
GSTKETGQMS

SEQ ID NO: 1162993 - protein, 5 aa, Mycobacterium
GSTKG

SEQ ID NO: 1162994 - protein, 7 aa, Mycobacterium
GSTRAGI

SEQ ID NO: 1162995 - protein, 11 aa, Mycobacterium
GSTRPAHCTST

SEQ ID NO: 1162996 - protein, 10 aa, Mycobacterium
GSTRQTASSR

SEQ ID NO: 1162997 - protein, 6 aa, Mycobacterium
GSTRSI

SEQ ID NO: 1162998 - protein, 11 aa, Mycobacterium
GSTSGVTTSDE

SEQ ID NO: 1162999 - protein, 10 aa, Mycobacterium
GSTSVDGLDA

SEQ ID NO: 1163000 - protein, 4 aa, Mycobacterium
GSTV

SEQ ID NO: 1163001 - protein, 9 aa, Mycobacterium
GSVADAEAA

SEQ ID NO: 1163002 - protein, 7 aa, Mycobacterium
GSVAPGT

SEQ ID NO: 1163003 - protein, 29 aa, Mycobacterium
GSVAQRQATTGLASGDLGEKPSDAEQFTE

SEQ ID NO: 1163004 - protein, 8 aa, Mycobacterium
GSVGNGAH

SEQ ID NO: 1163005 - protein, 7 aa, Mycobacterium
GSVIGST

SEQ ID NO: 1163006 - protein, 10 aa, Mycobacterium
GSVPSPVTPL

SEQ ID NO: 1163007 - protein, 8 aa, Mycobacterium
GSVQDRTQ

SEQ ID NO: 1163008 - protein, 10 aa, Mycobacterium
GSVRNDSAGA

SEQ ID NO: 1163009 - protein, 6 aa, Mycobacterium
GSVSGE

SEQ ID NO: 1163010 - protein, 4 aa, Mycobacterium
GSVT

SEQ ID NO: 1163011 - protein, 13 aa, Mycobacterium
GSWANDSVSCPRS

SEQ ID NO: 1163012 - protein, 4 aa, Mycobacterium
GSWE

SEQ ID NO: 1163013 - protein, 6 aa, Mycobacterium
GSWGTT

SEQ ID NO: 1163014 - protein, 14 aa, Mycobacterium
GSWKTKRINNTPRV

SEQ ID NO: 1163015 - protein, 7 aa, Mycobacterium
GSYLPGK

SEQ ID NO: 1163016 - protein, 5 aa, Mycobacterium
GSYLT

SEQ ID NO: 1163017 - protein, 5 aa, Mycobacterium
GSYPG

SEQ ID NO: 1163018 - protein, 11 aa, Mycobacterium
GSYSLGGEQSG

SEQ ID NO: 1163019 - protein, 8 aa, Mycobacterium
GTAAEVRE

SEQ ID NO: 1163020 - protein, 13 aa, Mycobacterium
GTAAGVASDTDRR

SEQ ID NO: 1163021 - protein, 12 aa, Mycobacterium
GTAANPLKAPPF

SEQ ID NO: 1163022 - protein, 8 aa, Mycobacterium
GTADVGTG

SEQ ID NO: 1163023 - protein, 4 aa, Mycobacterium
GTAE

SEQ ID NO: 1163024 - protein, 7 aa, Mycobacterium
GTAEAPG

SEQ ID NO: 1163025 - protein, 6 aa, Mycobacterium
GTAEEI

SEQ ID NO: 1163026 - protein, 5 aa, Mycobacterium
GTAGA

SEQ ID NO: 1163027 - protein, 14 aa, Mycobacterium
GTAGARGAARDATR

SEQ ID NO: 1163028 - protein, 17 aa, Mycobacterium
GTAGSTGIPRTAQLSPE

SEQ ID NO: 1163029 - protein, 12 aa, Mycobacterium
GTAGSTGTPRTV

SEQ ID NO: 1163030 - protein, 15 aa, Mycobacterium
GTAGTFPTVNPATEE

SEQ ID NO: 1163031 - protein, 23 aa, Mycobacterium
GTAGYGADTPFGGYKDSGVGRQN

SEQ ID NO: 1163032 - protein, 9 aa, Mycobacterium
GTALGAEGK

SEQ ID NO: 1163033 - protein, 4 aa, Mycobacterium
GTAM

SEQ ID NO: 1163034 - protein, 19 aa, Mycobacterium
GTAMPAQSDAVPDPDRDYG

SEQ ID NO: 1163035 - protein, 7 aa, Mycobacterium
GTANARR

SEQ ID NO: 1163036 - protein, 9 aa, Mycobacterium
GTAPASRSA

SEQ ID NO: 1163037 - protein, 8 aa, Mycobacterium
GTAPDDRR

SEQ ID NO: 1163038 - protein, 7 aa, Mycobacterium
GTAPEGR

SEQ ID NO: 1163039 - protein, 6 aa, Mycobacterium
GTAPKS

SEQ ID NO: 1163040 - protein, 9 aa, Mycobacterium
GTAPNTTLG

SEQ ID NO: 1163041 - protein, 6 aa, Mycobacterium
GTAPPH

SEQ ID NO: 1163042 - protein, 7 aa, Mycobacterium
GTAQNPD

SEQ ID NO: 1163043 - protein, 4 aa, Mycobacterium
GTAR

SEQ ID NO: 1163044 - protein, 5 aa, Mycobacterium
GTARI

SEQ ID NO: 1163045 - protein, 15 aa, Mycobacterium
GTARRDDGAIVSSGG

SEQ ID NO: 1163046 - protein, 8 aa, Mycobacterium
GTARSERA

SEQ ID NO: 1163047 - protein, 9 aa, Mycobacterium
GTARTESDI

SEQ ID NO: 1163048 - protein, 11 aa, Mycobacterium
GTASAANLGRT

SEQ ID NO: 1163049 - protein, 8 aa, Mycobacterium
GTASERAV

SEQ ID NO: 1163050 - protein, 8 aa, Mycobacterium
GTASERNH

SEQ ID NO: 1163051 - protein, 15 aa, Mycobacterium
GTASYEADPTPHVNE

SEQ ID NO: 1163052 - protein, 7 aa, Mycobacterium
GTATEPV

SEQ ID NO: 1163053 - protein, 6 aa, Mycobacterium
GTATFG

SEQ ID NO: 1163054 - protein, 8 aa, Mycobacterium
GTATPTPP

SEQ ID NO: 1163055 - protein, 4 aa, Mycobacterium
GTAV

SEQ ID NO: 1163056 - protein, 5 aa, Mycobacterium
GTAVS

SEQ ID NO: 1163057 - protein, 9 aa, Mycobacterium
GTAVSDGTH

SEQ ID NO: 1163058 - protein, 21 aa, Mycobacterium
GTAVTSSPIKGTLPSSADPLE

SEQ ID NO: 1163059 - protein, 4 aa, Mycobacterium
GTDA

SEQ ID NO: 1163060 - protein, 9 aa, Mycobacterium
GTDAGSTIA

SEQ ID NO: 1163061 - protein, 14 aa, Mycobacterium
GTDAPAIPHGRNAD

SEQ ID NO: 1163062 - protein, 8 aa, Mycobacterium
GTDEDGNP

SEQ ID NO: 1163063 - protein, 7 aa, Mycobacterium
GTDEQAI

SEQ ID NO: 1163064 - protein, 8 aa, Mycobacterium
GTDEQKER

SEQ ID NO: 1163065 - protein, 7 aa, Mycobacterium
GTDEQKK

SEQ ID NO: 1163066 - protein, 9 aa, Mycobacterium
GTDESAVRP

SEQ ID NO: 1163067 - protein, 8 aa, Mycobacterium
GTDHEKRG

SEQ ID NO: 1163068 - protein, 7 aa, Mycobacterium
GTDKPDL

SEQ ID NO: 1163069 - protein, 13 aa, Mycobacterium
GTDLPATKADTAE

SEQ ID NO: 1163070 - protein, 5 aa, Mycobacterium
GTDNV

SEQ ID NO: 1163071 - protein, 6 aa, Mycobacterium
GTDPAA

SEQ ID NO: 1163072 - protein, 6 aa, Mycobacterium
GTDPDL

SEQ ID NO: 1163073 - protein, 7 aa, Mycobacterium
GTDPPVT

SEQ ID NO: 1163074 - protein, 6 aa, Mycobacterium
GTDPQH

SEQ ID NO: 1163075 - protein, 6 aa, Mycobacterium
GTDPRG

SEQ ID NO: 1163076 - protein, 13 aa, Mycobacterium
GTDPTSYGLPPAN

SEQ ID NO: 1163077 - protein, 5 aa, Mycobacterium
GTDRP

SEQ ID NO: 1163078 - protein, 9 aa, Mycobacterium
GTDSHDTYA

SEQ ID NO: 1163079 - protein, 12 aa, Mycobacterium
GTDTAGSGRVPA

SEQ ID NO: 1163080 - protein, 14 aa, Mycobacterium
GTDTERARTILRNS

SEQ ID NO: 1163081 - protein, 12 aa, Mycobacterium
GTDTGGSIRQPA

SEQ ID NO: 1163082 - protein, 12 aa, Mycobacterium
GTDVDDPGVPDG

SEQ ID NO: 1163083 - protein, 5 aa, Mycobacterium
GTDVP

SEQ ID NO: 1163084 - protein, 9 aa, Mycobacterium
GTEAGRAAA

SEQ ID NO: 1163085 - protein, 6 aa, Mycobacterium
GTEANE

SEQ ID NO: 1163086 - protein, 7 aa, Mycobacterium
GTEAQKK

SEQ ID NO: 1163087 - protein, 13 aa, Mycobacterium
GTEARDDDGRPAA

SEQ ID NO: 1163088 - protein, 13 aa, Mycobacterium
GTEEPPHTTQPLS

SEQ ID NO: 1163089 - protein, 6 aa, Mycobacterium
GTEEQL

SEQ ID NO: 1163090 - protein, 8 aa, Mycobacterium
GTEEQQRR

SEQ ID NO: 1163091 - protein, 9 aa, Mycobacterium
GTEGFSGRE

SEQ ID NO: 1163092 - protein, 12 aa, Mycobacterium
GTEGPYTGTGGA

SEQ ID NO: 1163093 - protein, 21 aa, Mycobacterium
GTEGRQGQLDSAHGEREHAES

SEQ ID NO: 1163094 - protein, 5 aa, Mycobacterium
GTEIG

SEQ ID NO: 1163095 - protein, 4 aa, Mycobacterium
GTEL

SEQ ID NO: 1163096 - protein, 7 aa, Mycobacterium
GTELPGT

SEQ ID NO: 1163097 - protein, 9 aa, Mycobacterium
GTENLPAEG

SEQ ID NO: 1163098 - protein, 4 aa, Mycobacterium
GTEP

SEQ ID NO: 1163099 - protein, 7 aa, Mycobacterium
GTEPPQH

SEQ ID NO: 1163100 - protein, 5 aa, Mycobacterium
GTEPV

SEQ ID NO: 1163101 - protein, 10 aa, Mycobacterium
GTEQAGADRT

SEQ ID NO: 1163102 - protein, 5 aa, Mycobacterium
GTEQI

SEQ ID NO: 1163103 - protein, 7 aa, Mycobacterium
GTEQQKA

SEQ ID NO: 1163104 - protein, 6 aa, Mycobacterium
GTERGQ

SEQ ID NO: 1163105 - protein, 7 aa, Mycobacterium
GTERTNV

SEQ ID NO: 1163106 - protein, 7 aa, Mycobacterium
GTESDNL

SEQ ID NO: 1163107 - protein, 4 aa, Mycobacterium
GTEV

SEQ ID NO: 1163108 - protein, 12 aa, Mycobacterium
GTEVATTPLVTE

SEQ ID NO: 1163109 - protein, 13 aa, Mycobacterium
GTEVGGADDLTRV

SEQ ID NO: 1163110 - protein, 10 aa, Mycobacterium
GTEWSDGNPN

SEQ ID NO: 1163111 - protein, 6 aa, Mycobacterium
GTFEHG

SEQ ID NO: 1163112 - protein, 5 aa, Mycobacterium
GTFET

SEQ ID NO: 1163113 - protein, 9 aa, Mycobacterium
GTFSPNDEV

SEQ ID NO: 1163114 - protein, 8 aa, Mycobacterium
GTGAPSAI

SEQ ID NO: 1163115 - protein, 10 aa, Mycobacterium
GTGDATVNVP

SEQ ID NO: 1163116 - protein, 9 aa, Mycobacterium
GTGDESPAE

SEQ ID NO: 1163117 - protein, 16 aa, Mycobacterium
GTGDGAAAAAGVGPTQ

SEQ ID NO: 1163118 - protein, 6 aa, Mycobacterium
GTGDGD

SEQ ID NO: 1163119 - protein, 8 aa, Mycobacterium
GTGDGWDS

SEQ ID NO: 1163120 - protein, 5 aa, Mycobacterium
GTGDM

SEQ ID NO: 1163121 - protein, 8 aa, Mycobacterium
GTGEATVD

SEQ ID NO: 1163122 - protein, 25 aa, Mycobacterium
GTGEGPGDEQTVSAQPSDLPPRLTP

SEQ ID NO: 1163123 - protein, 8 aa, Mycobacterium
GTGEGSIR

SEQ ID NO: 1163124 - protein, 5 aa, Mycobacterium
GTGGL

SEQ ID NO: 1163125 - protein, 11 aa, Mycobacterium
GTGGQAADEAV

SEQ ID NO: 1163126 - protein, 6 aa, Mycobacterium
GTGGTV

SEQ ID NO: 1163127 - protein, 12 aa, Mycobacterium
GTGHTLADDHVG

SEQ ID NO: 1163128 - protein, 10 aa, Mycobacterium
GTGHTSAVPQ

SEQ ID NO: 1163129 - protein, 15 aa, Mycobacterium
GTGIDDAGWARKTAA

SEQ ID NO: 1163130 - protein, 4 aa, Mycobacterium
GTGK

SEQ ID NO: 1163131 - protein, 11 aa, Mycobacterium
GTGLSGGATAL

SEQ ID NO: 1163132 - protein, 12 aa, Mycobacterium
GTGLSRARRRER

SEQ ID NO: 1163133 - protein, 11 aa, Mycobacterium
GTGNANDTVTS

SEQ ID NO: 1163134 - protein, 11 aa, Mycobacterium
GTGNASIPAAK

SEQ ID NO: 1163135 - protein, 5 aa, Mycobacterium
GTGNG

SEQ ID NO: 1163136 - protein, 7 aa, Mycobacterium
GTGPAEI

SEQ ID NO: 1163137 - protein, 10 aa, Mycobacterium
GTGPAVGPGY

SEQ ID NO: 1163138 - protein, 9 aa, Mycobacterium
GTGPKRSLP

SEQ ID NO: 1163139 - protein, 4 aa, Mycobacterium
GTGQ

SEQ ID NO: 1163140 - protein, 6 aa, Mycobacterium
GTGQVE

SEQ ID NO: 1163141 - protein, 9 aa, Mycobacterium
GTGRGEAAT

SEQ ID NO: 1163142 - protein, 11 aa, Mycobacterium
GTGRPAGPAHL

SEQ ID NO: 1163143 - protein, 6 aa, Mycobacterium
GTGRRG

SEQ ID NO: 1163144 - protein, 12 aa, Mycobacterium
GTGRRLTDTDGR

SEQ ID NO: 1163145 - protein, 6 aa, Mycobacterium
GTGRSH

SEQ ID NO: 1163146 - protein, 17 aa, Mycobacterium
GTGSSDAVPIKDRPAMQ

SEQ ID NO: 1163147 - protein, 11 aa, Mycobacterium
GTGSVTDDALG

SEQ ID NO: 1163148 - protein, 15 aa, Mycobacterium
GTGVTPRDVTPEATR

SEQ ID NO: 1163149 - protein, 6 aa, Mycobacterium
GTGVYG

SEQ ID NO: 1163150 - protein, 18 aa, Mycobacterium
GTHDPYGAAEQLFAVRIE

SEQ ID NO: 1163151 - protein, 5 aa, Mycobacterium
GTHPG

SEQ ID NO: 1163152 - protein, 8 aa, Mycobacterium
GTHPRPGA

SEQ ID NO: 1163153 - protein, 10 aa, Mycobacterium
GTIAGGTSEI

SEQ ID NO: 1163154 - protein, 4 aa, Mycobacterium
GTID

SEQ ID NO: 1163155 - protein, 5 aa, Mycobacterium
GTIEV

SEQ ID NO: 1163156 - protein, 8 aa, Mycobacterium
GTIQRNEH

SEQ ID NO: 1163157 - protein, 6 aa, Mycobacterium
GTKATV

SEQ ID NO: 1163158 - protein, 9 aa, Mycobacterium
GTKNMRGAD

SEQ ID NO: 1163159 - protein, 6 aa, Mycobacterium
GTLDDA

SEQ ID NO: 1163160 - protein, 11 aa, Mycobacterium
GTLDHEGGSIP

SEQ ID NO: 1163161 - protein, 6 aa, Mycobacterium
GTLPEP

SEQ ID NO: 1163162 - protein, 15 aa, Mycobacterium
GTLPGLDAGARSRAD

SEQ ID NO: 1163163 - protein, 8 aa, Mycobacterium
GTLRDTDA

SEQ ID NO: 1163164 - protein, 5 aa, Mycobacterium
GTLTP

SEQ ID NO: 1163165 - protein, 4 aa, Mycobacterium
GTMD

SEQ ID NO: 1163166 - protein, 7 aa, Mycobacterium
GTMPTPR

SEQ ID NO: 1163167 - protein, 7 aa, Mycobacterium
GTMRGRD

SEQ ID NO: 1163168 - protein, 15 aa, Mycobacterium
GTNAKIRDTRKTLPG

SEQ ID NO: 1163169 - protein, 8 aa, Mycobacterium
GTNCENLP

SEQ ID NO: 1163170 - protein, 8 aa, Mycobacterium
GTNGKTSV

SEQ ID NO: 1163171 - protein, 10 aa, Mycobacterium
GTNGKTTTTS

SEQ ID NO: 1163172 - protein, 5 aa, Mycobacterium
GTNNR

SEQ ID NO: 1163173 - protein, 6 aa, Mycobacterium
GTNPAL

SEQ ID NO: 1163174 - protein, 11 aa, Mycobacterium
GTNWSSNPNAM

SEQ ID NO: 1163175 - protein, 17 aa, Mycobacterium
GTNYPGQGDIRGRQDRL

SEQ ID NO: 1163176 - protein, 5 aa, Mycobacterium
GTPAE

SEQ ID NO: 1163177 - protein, 15 aa, Mycobacterium
GTPAGSSVVAPGDTV

SEQ ID NO: 1163178 - protein, 10 aa, Mycobacterium
GTPAPGPAPA

SEQ ID NO: 1163179 - protein, 8 aa, Mycobacterium
GTPAQVAR

SEQ ID NO: 1163180 - protein, 8 aa, Mycobacterium
GTPARRLG

SEQ ID NO: 1163181 - protein, 15 aa, Mycobacterium
GTPDADDAAASGSLH

SEQ ID NO: 1163182 - protein, 5 aa, Mycobacterium
GTPDD

SEQ ID NO: 1163183 - protein, 5 aa, Mycobacterium
GTPDH

SEQ ID NO: 1163184 - protein, 6 aa, Mycobacterium
GTPDTA

SEQ ID NO: 1163185 - protein, 4 aa, Mycobacterium
GTPE

SEQ ID NO: 1163186 - protein, 6 aa, Mycobacterium
GTPEDH

SEQ ID NO: 1163187 - protein, 15 aa, Mycobacterium
GTPEGVSPIEDGDTV

SEQ ID NO: 1163188 - protein, 5 aa, Mycobacterium
GTPEL

SEQ ID NO: 1163189 - protein, 6 aa, Mycobacterium
GTPELS

SEQ ID NO: 1163190 - protein, 9 aa, Mycobacterium
GTPEPPGSS

SEQ ID NO: 1163191 - protein, 6 aa, Mycobacterium
GTPEQK

SEQ ID NO: 1163192 - protein, 6 aa, Mycobacterium
GTPEQL

SEQ ID NO: 1163193 - protein, 9 aa, Mycobacterium
GTPGAAPGF

SEQ ID NO: 1163194 - protein, 7 aa, Mycobacterium
GTPGDTK

SEQ ID NO: 1163195 - protein, 20 aa, Mycobacterium
GTPGETDDDLRRSADAAIGA

SEQ ID NO: 1163196 - protein, 10 aa, Mycobacterium
GTPGSSVYYS

SEQ ID NO: 1163197 - protein, 10 aa, Mycobacterium
GTPGTARTVQ

SEQ ID NO: 1163198 - protein, 6 aa, Mycobacterium
GTPGVA

SEQ ID NO: 1163199 - protein, 6 aa, Mycobacterium
GTPHEV

SEQ ID NO: 1163200 - protein, 5 aa, Mycobacterium
GTPIQ

SEQ ID NO: 1163201 - protein, 13 aa, Mycobacterium
GTPKSDRTGTGTR

SEQ ID NO: 1163202 - protein, 8 aa, Mycobacterium
GTPPPADL

SEQ ID NO: 1163203 - protein, 21 aa, Mycobacterium
GTPPSATLRTTRQRRDRERYG

SEQ ID NO: 1163204 - protein, 6 aa, Mycobacterium
GTPPTF

SEQ ID NO: 1163205 - protein, 8 aa, Mycobacterium
GTPRPVSE

SEQ ID NO: 1163206 - protein, 14 aa, Mycobacterium
GTPTRARGYPPYEG

SEQ ID NO: 1163207 - protein, 13 aa, Mycobacterium
GTPTTAHPTVTSR

SEQ ID NO: 1163208 - protein, 9 aa, Mycobacterium
GTQPSGYTE

SEQ ID NO: 1163209 - protein, 4 aa, Mycobacterium
GTRD

SEQ ID NO: 1163210 - protein, 8 aa, Mycobacterium
GTRDAGRY

SEQ ID NO: 1163211 - protein, 15 aa, Mycobacterium
GTREGSSVRGGSLGG

SEQ ID NO: 1163212 - protein, 9 aa, Mycobacterium
GTRGEHTAQ

SEQ ID NO: 1163213 - protein, 12 aa, Mycobacterium
GTRGGGGAPRFE

SEQ ID NO: 1163214 - protein, 9 aa, Mycobacterium
GTRGSRPAL

SEQ ID NO: 1163215 - protein, 8 aa, Mycobacterium
GTRGTTGL

SEQ ID NO: 1163216 - protein, 10 aa, Mycobacterium
GTRHPEPDTD

SEQ ID NO: 1163217 - protein, 9 aa, Mycobacterium
GTRISDRYT

SEQ ID NO: 1163218 - protein, 9 aa, Mycobacterium
GTRKPSPEV

SEQ ID NO: 1163219 - protein, 8 aa, Mycobacterium
GTRKSSGV

SEQ ID NO: 1163220 - protein, 6 aa, Mycobacterium
GTRLTP

SEQ ID NO: 1163221 - protein, 8 aa, Mycobacterium
GTRQRRSA

SEQ ID NO: 1163222 - protein, 6 aa, Mycobacterium
GTRQYQ

SEQ ID NO: 1163223 - protein, 5 aa, Mycobacterium
GTRRD

SEQ ID NO: 1163224 - protein, 7 aa, Mycobacterium
GTRRPAT

SEQ ID NO: 1163225 - protein, 10 aa, Mycobacterium
GTRSASVSGN

SEQ ID NO: 1163226 - protein, 28 aa, Mycobacterium
GTRSPHGAVRDARRPGHISGGSSSGSAV

SEQ ID NO: 1163227 - protein, 6 aa, Mycobacterium
GTSDIS

SEQ ID NO: 1163228 - protein, 15 aa, Mycobacterium
GTSGGPEAAARTARY

SEQ ID NO: 1163229 - protein, 10 aa, Mycobacterium
GTSGHRGSSL

SEQ ID NO: 1163230 - protein, 4 aa, Mycobacterium
GTSH

SEQ ID NO: 1163231 - protein, 5 aa, Mycobacterium
GTSLD

SEQ ID NO: 1163232 - protein, 6 aa, Mycobacterium
GTSNDE

SEQ ID NO: 1163233 - protein, 10 aa, Mycobacterium
GTSNNDHPAV

SEQ ID NO: 1163234 - protein, 5 aa, Mycobacterium
GTSPE

SEQ ID NO: 1163235 - protein, 7 aa, Mycobacterium
GTSTRKV

SEQ ID NO: 1163236 - protein, 12 aa, Mycobacterium
GTTAGLRTATAA

SEQ ID NO: 1163237 - protein, 6 aa, Mycobacterium
GTTAIP

SEQ ID NO: 1163238 - protein, 6 aa, Mycobacterium
GTTASA

SEQ ID NO: 1163239 - protein, 6 aa, Mycobacterium
GTTATW

SEQ ID NO: 1163240 - protein, 8 aa, Mycobacterium
GTTDGSVE

SEQ ID NO: 1163241 - protein, 13 aa, Mycobacterium
GTTDRPSTGDPVL

SEQ ID NO: 1163242 - protein, 20 aa, Mycobacterium
GTTERAAERARELQSEGIAA

SEQ ID NO: 1163243 - protein, 6 aa, Mycobacterium
GTTGDG

SEQ ID NO: 1163244 - protein, 9 aa, Mycobacterium
GTTGLPKGV

SEQ ID NO: 1163245 - protein, 7 aa, Mycobacterium
GTTGMPK

SEQ ID NO: 1163246 - protein, 21 aa, Mycobacterium
GTTGTPKGAKRSAGSGGAGDL

SEQ ID NO: 1163247 - protein, 7 aa, Mycobacterium
GTTPESV

SEQ ID NO: 1163248 - protein, 16 aa, Mycobacterium
GTTPVEPAKTPEQGYT

SEQ ID NO: 1163249 - protein, 6 aa, Mycobacterium
GTTRRR

SEQ ID NO: 1163250 - protein, 8 aa, Mycobacterium
GTTTAQRT

SEQ ID NO: 1163251 - protein, 4 aa, Mycobacterium
GTTV

SEQ ID NO: 1163252 - protein, 7 aa, Mycobacterium
GTTVPAG

SEQ ID NO: 1163253 - protein, 9 aa, Mycobacterium
GTVDNADPR

SEQ ID NO: 1163254 - protein, 5 aa, Mycobacterium
GTVEA

SEQ ID NO: 1163255 - protein, 5 aa, Mycobacterium
GTVEG

SEQ ID NO: 1163256 - protein, 20 aa, Mycobacterium
GTVESGSQVINSTKGKKERL

SEQ ID NO: 1163257 - protein, 5 aa, Mycobacterium
GTVGD

SEQ ID NO: 1163258 - protein, 10 aa, Mycobacterium
GTVGRAPAPE

SEQ ID NO: 1163259 - protein, 13 aa, Mycobacterium
GTVKSRCSRGRAK

SEQ ID NO: 1163260 - protein, 5 aa, Mycobacterium
GTVNG

SEQ ID NO: 1163261 - protein, 5 aa, Mycobacterium
GTVPA

SEQ ID NO: 1163262 - protein, 4 aa, Mycobacterium
GTVR

SEQ ID NO: 1163263 - protein, 9 aa, Mycobacterium
GTVRAKGPV

SEQ ID NO: 1163264 - protein, 14 aa, Mycobacterium
GTVTANSDAHGVSY

SEQ ID NO: 1163265 - protein, 14 aa, Mycobacterium
GTVTHTGTREYGRT

SEQ ID NO: 1163266 - protein, 20 aa, Mycobacterium
GTVTPERDEYTTCQPPTKSQ

SEQ ID NO: 1163267 - protein, 4 aa, Mycobacterium
GTWE

SEQ ID NO: 1163268 - protein, 5 aa, Mycobacterium
GTYGD

SEQ ID NO: 1163269 - protein, 7 aa, Mycobacterium
GTYPPAV

SEQ ID NO: 1163270 - protein, 22 aa, Mycobacterium
GTYPRGATERLDSDAFSPNTAV

SEQ ID NO: 1163271 - protein, 15 aa, Mycobacterium
GVADADLGRDPRQSL

SEQ ID NO: 1163272 - protein, 6 aa, Mycobacterium
GVADGD

SEQ ID NO: 1163273 - protein, 8 aa, Mycobacterium
GVAGAGPI

SEQ ID NO: 1163274 - protein, 13 aa, Mycobacterium
GVAGAGVSAYPAE

SEQ ID NO: 1163275 - protein, 6 aa, Mycobacterium
GVAGDE

SEQ ID NO: 1163276 - protein, 7 aa, Mycobacterium
GVAGGGP

SEQ ID NO: 1163277 - protein, 6 aa, Mycobacterium
GVAGGT

SEQ ID NO: 1163278 - protein, 12 aa, Mycobacterium
GVAGRREVEAAA

SEQ ID NO: 1163279 - protein, 4 aa, Mycobacterium
GVAK

SEQ ID NO: 1163280 - protein, 6 aa, Mycobacterium
GVAPDE

SEQ ID NO: 1163281 - protein, 7 aa, Mycobacterium
GVAPQDV

SEQ ID NO: 1163282 - protein, 6 aa, Mycobacterium
GVAPSD

SEQ ID NO: 1163283 - protein, 7 aa, Mycobacterium
GVAPSTV

SEQ ID NO: 1163284 - protein, 17 aa, Mycobacterium
GVARDEVTRRVGEAAER

SEQ ID NO: 1163285 - protein, 8 aa, Mycobacterium
GVASDDDL

SEQ ID NO: 1163286 - protein, 5 aa, Mycobacterium
GVDAG

SEQ ID NO: 1163287 - protein, 18 aa, Mycobacterium
GVDATTAVKRPRGGRIGA

SEQ ID NO: 1163288 - protein, 12 aa, Mycobacterium
GVDDAQVRTHAA

SEQ ID NO: 1163289 - protein, 5 aa, Mycobacterium
GVDGA

SEQ ID NO: 1163290 - protein, 7 aa, Mycobacterium
GVDGPGT

SEQ ID NO: 1163291 - protein, 6 aa, Mycobacterium
GVDGSE

SEQ ID NO: 1163292 - protein, 6 aa, Mycobacterium
GVDHAT

SEQ ID NO: 1163293 - protein, 6 aa, Mycobacterium
GVDPAE

SEQ ID NO: 1163294 - protein, 5 aa, Mycobacterium
GVDPE

SEQ ID NO: 1163295 - protein, 7 aa, Mycobacterium
GVDPKAL

SEQ ID NO: 1163296 - protein, 6 aa, Mycobacterium
GVDPSE

SEQ ID NO: 1163297 - protein, 12 aa, Mycobacterium
GVDPSVGSVGDA

SEQ ID NO: 1163298 - protein, 7 aa, Mycobacterium
GVDRQTA

SEQ ID NO: 1163299 - protein, 14 aa, Mycobacterium
GVDRSVPAEEGQRA

SEQ ID NO: 1163300 - protein, 7 aa, Mycobacterium
GVDSGAR

SEQ ID NO: 1163301 - protein, 14 aa, Mycobacterium
GVDSPIPDSDAGHF

SEQ ID NO: 1163302 - protein, 5 aa, Mycobacterium
GVDSR

SEQ ID NO: 1163303 - protein, 8 aa, Mycobacterium
GVDTPDPV

SEQ ID NO: 1163304 - protein, 8 aa, Mycobacterium
GVDVPTTD

SEQ ID NO: 1163305 - protein, 7 aa, Mycobacterium
GVEAGAE

SEQ ID NO: 1163306 - protein, 17 aa, Mycobacterium
GVEKKDYNSYGSRRGNH

SEQ ID NO: 1163307 - protein, 4 aa, Mycobacterium
GVEP

SEQ ID NO: 1163308 - protein, 7 aa, Mycobacterium
GVEPTRT

SEQ ID NO: 1163309 - protein, 5 aa, Mycobacterium
GVERG

SEQ ID NO: 1163310 - protein, 6 aa, Mycobacterium
GVETRP

SEQ ID NO: 1163311 - protein, 11 aa, Mycobacterium
GVGATENAEGF

SEQ ID NO: 1163312 - protein, 7 aa, Mycobacterium
GVGDPEA

SEQ ID NO: 1163313 - protein, 5 aa, Mycobacterium
GVGED

SEQ ID NO: 1163314 - protein, 11 aa, Mycobacterium
GVGEDITGGLP

SEQ ID NO: 1163315 - protein, 12 aa, Mycobacterium
GVGIPDNLTESG

SEQ ID NO: 1163316 - protein, 4 aa, Mycobacterium
GVGP

SEQ ID NO: 1163317 - protein, 6 aa, Mycobacterium
GVGPDQ

SEQ ID NO: 1163318 - protein, 8 aa, Mycobacterium
GVGPGDRV

SEQ ID NO: 1163319 - protein, 6 aa, Mycobacterium
GVGPGS

SEQ ID NO: 1163320 - protein, 7 aa, Mycobacterium
GVGPPPE

SEQ ID NO: 1163321 - protein, 6 aa, Mycobacterium
GVGPTI

SEQ ID NO: 1163322 - protein, 9 aa, Mycobacterium
GVGRPAELG

SEQ ID NO: 1163323 - protein, 5 aa, Mycobacterium
GVGSR

SEQ ID NO: 1163324 - protein, 15 aa, Mycobacterium
GVGTAVPATRETPDE

SEQ ID NO: 1163325 - protein, 10 aa, Mycobacterium
GVGTDEDTAY

SEQ ID NO: 1163326 - protein, 6 aa, Mycobacterium
GVGTGY

SEQ ID NO: 1163327 - protein, 7 aa, Mycobacterium
GVHSDPA

SEQ ID NO: 1163328 - protein, 6 aa, Mycobacterium
GVHTPD

SEQ ID NO: 1163329 - protein, 26 aa, Mycobacterium
GVHTPDLGGAATTTGFTEHVLSVLAS

SEQ ID NO: 1163330 - protein, 5 aa, Mycobacterium
GVKPG

SEQ ID NO: 1163331 - protein, 4 aa, Mycobacterium
GVLA

SEQ ID NO: 1163332 - protein, 5 aa, Mycobacterium
GVNAA

SEQ ID NO: 1163333 - protein, 10 aa, Mycobacterium
GVNNSDARGL

SEQ ID NO: 1163334 - protein, 6 aa, Mycobacterium
GVNPPF

SEQ ID NO: 1163335 - protein, 4 aa, Mycobacterium
GVNT

SEQ ID NO: 1163336 - protein, 9 aa, Mycobacterium
GVPAPGELG

SEQ ID NO: 1163337 - protein, 6 aa, Mycobacterium
GVPATS

SEQ ID NO: 1163338 - protein, 4 aa, Mycobacterium
GVPD

SEQ ID NO: 1163339 - protein, 11 aa, Mycobacterium
GVPDAAAALDG

SEQ ID NO: 1163340 - protein, 8 aa, Mycobacterium
GVPDGDSI

SEQ ID NO: 1163341 - protein, 4 aa, Mycobacterium
GVPG

SEQ ID NO: 1163342 - protein, 8 aa, Mycobacterium
GVPGDPGV

SEQ ID NO: 1163343 - protein, 5 aa, Mycobacterium
GVPGE

SEQ ID NO: 1163344 - protein, 4 aa, Mycobacterium
GVPR

SEQ ID NO: 1163345 - protein, 9 aa, Mycobacterium
GVPRPSRRN

SEQ ID NO: 1163346 - protein, 7 aa, Mycobacterium
GVPSEET

SEQ ID NO: 1163347 - protein, 5 aa, Mycobacterium
GVPSS

SEQ ID NO: 1163348 - protein, 4 aa, Mycobacterium
GVPT

SEQ ID NO: 1163349 - protein, 19 aa, Mycobacterium
GVPTAARPGKLVRGRQPAP

SEQ ID NO: 1163350 - protein, 9 aa, Mycobacterium
GVPTERYPR

SEQ ID NO: 1163351 - protein, 5 aa, Mycobacterium
GVPTG

SEQ ID NO: 1163352 - protein, 7 aa, Mycobacterium
GVPTPDG

SEQ ID NO: 1163353 - protein, 9 aa, Mycobacterium
GVPTPGLPF

SEQ ID NO: 1163354 - protein, 4 aa, Mycobacterium
GVPW

SEQ ID NO: 1163355 - protein, 7 aa, Mycobacterium
GVQDEDS

SEQ ID NO: 1163356 - protein, 34 aa, Mycobacterium
GVQELGRSGVGVGQSGASYAAGDAMNASAYMIAR

SEQ ID NO: 1163357 - protein, 4 aa, Mycobacterium
GVQI

SEQ ID NO: 1163358 - protein, 4 aa, Mycobacterium
GVQP

SEQ ID NO: 1163359 - protein, 7 aa, Mycobacterium
GVQPELA

SEQ ID NO: 1163360 - protein, 8 aa, Mycobacterium
GVQPGREV

SEQ ID NO: 1163361 - protein, 8 aa, Mycobacterium
GVRAKGQR

SEQ ID NO: 1163362 - protein, 5 aa, Mycobacterium
GVRAQ

SEQ ID NO: 1163363 - protein, 5 aa, Mycobacterium
GVRDG

SEQ ID NO: 1163364 - protein, 10 aa, Mycobacterium
GVREAGGQQV

SEQ ID NO: 1163365 - protein, 4 aa, Mycobacterium
GVRG

SEQ ID NO: 1163366 - protein, 9 aa, Mycobacterium
GVRPADPGV

SEQ ID NO: 1163367 - protein, 6 aa, Mycobacterium
GVRPGD

SEQ ID NO: 1163368 - protein, 12 aa, Mycobacterium
GVRPPTRTVRGL

SEQ ID NO: 1163369 - protein, 8 aa, Mycobacterium
GVRPSGYR

SEQ ID NO: 1163370 - protein, 10 aa, Mycobacterium
GVRPTGNPLT

SEQ ID NO: 1163371 - protein, 6 aa, Mycobacterium
GVRTAA

SEQ ID NO: 1163372 - protein, 9 aa, Mycobacterium
GVRTDENGV

SEQ ID NO: 1163373 - protein, 6 aa, Mycobacterium
GVRTRS

SEQ ID NO: 1163374 - protein, 8 aa, Mycobacterium
GVSDPAER

SEQ ID NO: 1163375 - protein, 9 aa, Mycobacterium
GVSESGGAK

SEQ ID NO: 1163376 - protein, 8 aa, Mycobacterium
GVSGGYSR

SEQ ID NO: 1163377 - protein, 9 aa, Mycobacterium
GVSGSGKST

SEQ ID NO: 1163378 - protein, 4 aa, Mycobacterium
GVSP

SEQ ID NO: 1163379 - protein, 9 aa, Mycobacterium
GVSPDSYPT

SEQ ID NO: 1163380 - protein, 10 aa, Mycobacterium
GVSPGNDGRG

SEQ ID NO: 1163381 - protein, 19 aa, Mycobacterium
GVSSGDGLAPRRPVLAPVI

SEQ ID NO: 1163382 - protein, 5 aa, Mycobacterium
GVSTG

SEQ ID NO: 1163383 - protein, 7 aa, Mycobacterium
GVSTQST

SEQ ID NO: 1163384 - protein, 5 aa, Mycobacterium
GVSTR

SEQ ID NO: 1163385 - protein, 16 aa, Mycobacterium
GVTAAKPGSAMTPLPG

SEQ ID NO: 1163386 - protein, 7 aa, Mycobacterium
GVTADAH

SEQ ID NO: 1163387 - protein, 7 aa, Mycobacterium
GVTASRA

SEQ ID NO: 1163388 - protein, 6 aa, Mycobacterium
GVTDHR

SEQ ID NO: 1163389 - protein, 18 aa, Mycobacterium
GVTDSGAPLSIPSDPARR

SEQ ID NO: 1163390 - protein, 5 aa, Mycobacterium
GVTDT

SEQ ID NO: 1163391 - protein, 15 aa, Mycobacterium
GVTGARDAVSSAAPE

SEQ ID NO: 1163392 - protein, 13 aa, Mycobacterium
GVTGITDATPDLD

SEQ ID NO: 1163393 - protein, 10 aa, Mycobacterium
GVTNPEGKRK

SEQ ID NO: 1163394 - protein, 6 aa, Mycobacterium
GVTPAT

SEQ ID NO: 1163395 - protein, 9 aa, Mycobacterium
GVTPQTESR

SEQ ID NO: 1163396 - protein, 4 aa, Mycobacterium
GVTR

SEQ ID NO: 1163397 - protein, 13 aa, Mycobacterium
GVTRPTAANAEAF

SEQ ID NO: 1163398 - protein, 5 aa, Mycobacterium
GVTSG

SEQ ID NO: 1163399 - protein, 9 aa, Mycobacterium
GVTTPERRE

SEQ ID NO: 1163400 - protein, 22 aa, Mycobacterium
GVVPNESGRVVDPASGRSVPGS

SEQ ID NO: 1163401 - protein, 9 aa, Mycobacterium
GVVTPDTPA

SEQ ID NO: 1163402 - protein, 6 aa, Mycobacterium
GWAPGD

SEQ ID NO: 1163403 - protein, 11 aa, Mycobacterium
GWDADGGYAEF

SEQ ID NO: 1163404 - protein, 10 aa, Mycobacterium
GWDNDDGGEF

SEQ ID NO: 1163405 - protein, 13 aa, Mycobacterium
GWPEPTGVTATDD

SEQ ID NO: 1163406 - protein, 6 aa, Mycobacterium
GWPGAG

SEQ ID NO: 1163407 - protein, 7 aa, Mycobacterium
GWPGDEV

SEQ ID NO: 1163408 - protein, 5 aa, Mycobacterium
GWPTQ

SEQ ID NO: 1163409 - protein, 5 aa, Mycobacterium
GWPVP

SEQ ID NO: 1163410 - protein, 9 aa, Mycobacterium
GWQQSGPKS

SEQ ID NO: 1163411 - protein, 26 aa, Mycobacterium
GWRTRKNGKNQTEWLPPPDLDTGQHR

SEQ ID NO: 1163412 - protein, 7 aa, Mycobacterium
GWSPTKS

SEQ ID NO: 1163413 - protein, 6 aa, Mycobacterium
GWSPTR

SEQ ID NO: 1163414 - protein, 4 aa, Mycobacterium
GYAD

SEQ ID NO: 1163415 - protein, 13 aa, Mycobacterium
GYAEADPTADVEG

SEQ ID NO: 1163416 - protein, 15 aa, Mycobacterium
GYAEATADGIPPDLE

SEQ ID NO: 1163417 - protein, 6 aa, Mycobacterium
GYANTT

SEQ ID NO: 1163418 - protein, 13 aa, Mycobacterium
GYAPDPRTGAVNT

SEQ ID NO: 1163419 - protein, 19 aa, Mycobacterium
GYARTGRAPLSETVTFIAD

SEQ ID NO: 1163420 - protein, 8 aa, Mycobacterium
GYATEGQA

SEQ ID NO: 1163421 - protein, 8 aa, Mycobacterium
GYATPIGA

SEQ ID NO: 1163422 - protein, 5 aa, Mycobacterium
GYDKE

SEQ ID NO: 1163423 - protein, 16 aa, Mycobacterium
GYDPAREHTVSPTDPA

SEQ ID NO: 1163424 - protein, 9 aa, Mycobacterium
GYDPQSEKL

SEQ ID NO: 1163425 - protein, 10 aa, Mycobacterium
GYEAFSSGDI

SEQ ID NO: 1163426 - protein, 4 aa, Mycobacterium
GYEN

SEQ ID NO: 1163427 - protein, 8 aa, Mycobacterium
GYENAPRP

SEQ ID NO: 1163428 - protein, 5 aa, Mycobacterium
GYEPD

SEQ ID NO: 1163429 - protein, 6 aa, Mycobacterium
GYEPED

SEQ ID NO: 1163430 - protein, 12 aa, Mycobacterium
GYERPHTEQPPY

SEQ ID NO: 1163431 - protein, 8 aa, Mycobacterium
GYETPSAI

SEQ ID NO: 1163432 - protein, 4 aa, Mycobacterium
GYGM

SEQ ID NO: 1163433 - protein, 23 aa, Mycobacterium
GYGQTGPDAHRAGYASVAEAASG

SEQ ID NO: 1163434 - protein, 13 aa, Mycobacterium
GYGRGDAGPEELR

SEQ ID NO: 1163435 - protein, 5 aa, Mycobacterium
GYGSP

SEQ ID NO: 1163436 - protein, 9 aa, Mycobacterium
GYGYPEAGQ

SEQ ID NO: 1163437 - protein, 6 aa, Mycobacterium
GYHRRE

SEQ ID NO: 1163438 - protein, 5 aa, Mycobacterium
GYKTP

SEQ ID NO: 1163439 - protein, 9 aa, Mycobacterium
GYLPDTATA

SEQ ID NO: 1163440 - protein, 4 aa, Mycobacterium
GYPA

SEQ ID NO: 1163441 - protein, 12 aa, Mycobacterium
GYPDNLSTGADG

SEQ ID NO: 1163442 - protein, 10 aa, Mycobacterium
GYPDTSSEEF

SEQ ID NO: 1163443 - protein, 4 aa, Mycobacterium
GYPK

SEQ ID NO: 1163444 - protein, 21 aa, Mycobacterium
GYPPPSSRARRQAMAEDARQA

SEQ ID NO: 1163445 - protein, 14 aa, Mycobacterium
GYPSGHEAAQVDDD

SEQ ID NO: 1163446 - protein, 6 aa, Mycobacterium
GYPTGF

SEQ ID NO: 1163447 - protein, 4 aa, Mycobacterium
GYPW

SEQ ID NO: 1163448 - protein, 17 aa, Mycobacterium
GYRADGTQSMAQDTGDN

SEQ ID NO: 1163449 - protein, 9 aa, Mycobacterium
GYRASEDHQ

SEQ ID NO: 1163450 - protein, 14 aa, Mycobacterium
GYREEEGVADDSQV

SEQ ID NO: 1163451 - protein, 7 aa, Mycobacterium
GYRPEDY

SEQ ID NO: 1163452 - protein, 8 aa, Mycobacterium
GYRPTDEQ

SEQ ID NO: 1163453 - protein, 15 aa, Mycobacterium
GYRRGALAGTDDDTD

SEQ ID NO: 1163454 - protein, 10 aa, Mycobacterium
GYRRRTDTKD

SEQ ID NO: 1163455 - protein, 4 aa, Mycobacterium
GYRT

SEQ ID NO: 1163456 - protein, 19 aa, Mycobacterium
GYSASGPADDVVAALRAAL

SEQ ID NO: 1163457 - protein, 9 aa, Mycobacterium
GYSASSGQR

SEQ ID NO: 1163458 - protein, 10 aa, Mycobacterium
GYSATSMGSI

SEQ ID NO: 1163459 - protein, 6 aa, Mycobacterium
GYSDGE

SEQ ID NO: 1163460 - protein, 6 aa, Mycobacterium
GYSEET

SEQ ID NO: 1163461 - protein, 4 aa, Mycobacterium
GYSP

SEQ ID NO: 1163462 - protein, 7 aa, Mycobacterium
GYSPAER

SEQ ID NO: 1163463 - protein, 6 aa, Mycobacterium
GYSTRE

SEQ ID NO: 1163464 - protein, 6 aa, Mycobacterium
GYSYGG

SEQ ID NO: 1163465 - protein, 6 aa, Mycobacterium
GYTDRD

SEQ ID NO: 1163466 - protein, 5 aa, Mycobacterium
GYTGA

SEQ ID NO: 1163467 - protein, 7 aa, Mycobacterium
GYTGEQG

SEQ ID NO: 1163468 - protein, 20 aa, Mycobacterium
GYTGGQNDHPTYRNHPGHAE

SEQ ID NO: 1163469 - protein, 10 aa, Mycobacterium
GYTGSPSIEA

SEQ ID NO: 1163470 - protein, 17 aa, Mycobacterium
GYTQRGDAFAAAVRADL

SEQ ID NO: 1163471 - protein, 7 aa, Mycobacterium
GYTSDDK

SEQ ID NO: 1163472 - protein, 14 aa, Mycobacterium
GYTSPGRSKETAED

SEQ ID NO: 1163473 - protein, 7 aa, Mycobacterium
GYTSSLA

SEQ ID NO: 1163474 - protein, 7 aa, Mycobacterium
GYTVDHS

SEQ ID NO: 1163475 - protein, 13 aa, Mycobacterium
GYTVRDDDDDDPV

SEQ ID NO: 1163476 - protein, 5 aa, Mycobacterium
GYTVT

SEQ ID NO: 1163477 - protein, 15 aa, Mycobacterium
GYYNNEGRGGAERNG

SEQ ID NO: 1163478 - protein, 16 aa, Mycobacterium
HAADAQASGTAASGLP

SEQ ID NO: 1163479 - protein, 6 aa, Mycobacterium
HAADPE

SEQ ID NO: 1163480 - protein, 6 aa, Mycobacterium
HAADRG

SEQ ID NO: 1163481 - protein, 25 aa, Mycobacterium
HAAEPKGGRPGPTDQGGEGGMASRE

SEQ ID NO: 1163482 - protein, 11 aa, Mycobacterium
HAAETDGRPGI

SEQ ID NO: 1163483 - protein, 10 aa, Mycobacterium
HAAGPANDAA

SEQ ID NO: 1163484 - protein, 6 aa, Mycobacterium
HAATRE

SEQ ID NO: 1163485 - protein, 13 aa, Mycobacterium
HADAGKARKAGRR

SEQ ID NO: 1163486 - protein, 9 aa, Mycobacterium
HADDKDMEA

SEQ ID NO: 1163487 - protein, 7 aa, Mycobacterium
HADEERE

SEQ ID NO: 1163488 - protein, 5 aa, Mycobacterium
HADPN

SEQ ID NO: 1163489 - protein, 7 aa, Mycobacterium
HADPRDR

SEQ ID NO: 1163490 - protein, 11 aa, Mycobacterium
HADTKGPKSLS

SEQ ID NO: 1163491 - protein, 4 aa, Mycobacterium
HAEA

SEQ ID NO: 1163492 - protein, 6 aa, Mycobacterium
HAERTK

SEQ ID NO: 1163493 - protein, 15 aa, Mycobacterium
HAESELDSRSEVGLP

SEQ ID NO: 1163494 - protein, 9 aa, Mycobacterium
HAESGLPRA

SEQ ID NO: 1163495 - protein, 11 aa, Mycobacterium
HAETGDTNGAA

SEQ ID NO: 1163496 - protein, 10 aa, Mycobacterium
HAGAATDSEW

SEQ ID NO: 1163497 - protein, 7 aa, Mycobacterium
HAGAGRP

SEQ ID NO: 1163498 - protein, 10 aa, Mycobacterium
HAGGTRYRDD

SEQ ID NO: 1163499 - protein, 7 aa, Mycobacterium
HAGKAGF

SEQ ID NO: 1163500 - protein, 16 aa, Mycobacterium
HAGPGEAAPLQCSPGG

SEQ ID NO: 1163501 - protein, 16 aa, Mycobacterium
HAGPVANSRTNKAKAL

SEQ ID NO: 1163502 - protein, 13 aa, Mycobacterium
HAGQTPDAATNAR

SEQ ID NO: 1163503 - protein, 8 aa, Mycobacterium
HAGSATLD

SEQ ID NO: 1163504 - protein, 5 aa, Mycobacterium
HAGSV

SEQ ID NO: 1163505 - protein, 6 aa, Mycobacterium
HAHGTE

SEQ ID NO: 1163506 - protein, 18 aa, Mycobacterium
HAKAGADDTMADRQSDLA

SEQ ID NO: 1163507 - protein, 5 aa, Mycobacterium
HALGA

SEQ ID NO: 1163508 - protein, 6 aa, Mycobacterium
HANEGG

SEQ ID NO: 1163509 - protein, 6 aa, Mycobacterium
HANGAR

SEQ ID NO: 1163510 - protein, 13 aa, Mycobacterium
HAPAAAPNSADDE

SEQ ID NO: 1163511 - protein, 6 aa, Mycobacterium
HAPDRQ

SEQ ID NO: 1163512 - protein, 19 aa, Mycobacterium
HAPEADREPVPSSVGPARA

SEQ ID NO: 1163513 - protein, 6 aa, Mycobacterium
HAPHAE

SEQ ID NO: 1163514 - protein, 6 aa, Mycobacterium
HAPMPA

SEQ ID NO: 1163515 - protein, 7 aa, Mycobacterium
HAPTTAT

SEQ ID NO: 1163516 - protein, 4 aa, Mycobacterium
HAPV

SEQ ID NO: 1163517 - protein, 7 aa, Mycobacterium
HAQNDDI

SEQ ID NO: 1163518 - protein, 10 aa, Mycobacterium
HAQSQGYGAE

SEQ ID NO: 1163519 - protein, 29 aa, Mycobacterium
HARGRDVESGPSATDFAPQSQTDDTLGPV

SEQ ID NO: 1163520 - protein, 4 aa, Mycobacterium
HARS

SEQ ID NO: 1163521 - protein, 18 aa, Mycobacterium
HARSETGTGAGSTADLSR

SEQ ID NO: 1163522 - protein, 6 aa, Mycobacterium
HARSTA

SEQ ID NO: 1163523 - protein, 5 aa, Mycobacterium
HARYG

SEQ ID NO: 1163524 - protein, 14 aa, Mycobacterium
HASAALRQSENDRI

SEQ ID NO: 1163525 - protein, 5 aa, Mycobacterium
HASGA

SEQ ID NO: 1163526 - protein, 7 aa, Mycobacterium
HASPAAV

SEQ ID NO: 1163527 - protein, 36 aa, Mycobacterium
HATGTSVGDVAEGKAINNAMGGHKPAVYAPKGALGH

SEQ ID NO: 1163528 - protein, 16 aa, Mycobacterium
HATPDRAGGPTSALNG

SEQ ID NO: 1163529 - protein, 11 aa, Mycobacterium
HATPQGIPTRR

SEQ ID NO: 1163530 - protein, 8 aa, Mycobacterium
HATTGKPF

SEQ ID NO: 1163531 - protein, 6 aa, Mycobacterium
HAVGPG

SEQ ID NO: 1163532 - protein, 6 aa, Mycobacterium
HAVGSG

SEQ ID NO: 1163533 - protein, 8 aa, Mycobacterium
HAYGGGSQ

SEQ ID NO: 1163534 - protein, 5 aa, Mycobacterium
HAYPD

SEQ ID NO: 1163535 - protein, 8 aa, Mycobacterium
HCEPDDPD

SEQ ID NO: 1163536 - protein, 7 aa, Mycobacterium
HDAADAI

SEQ ID NO: 1163537 - protein, 10 aa, Mycobacterium
HDAAGPQKIP

SEQ ID NO: 1163538 - protein, 6 aa, Mycobacterium
HDAEHS

SEQ ID NO: 1163539 - protein, 4 aa, Mycobacterium
HDAG

SEQ ID NO: 1163540 - protein, 6 aa, Mycobacterium
HDATTR

SEQ ID NO: 1163541 - protein, 4 aa, Mycobacterium
HDDN

SEQ ID NO: 1163542 - protein, 7 aa, Mycobacterium
HDDPEES

SEQ ID NO: 1163543 - protein, 6 aa, Mycobacterium
HDDPRA

SEQ ID NO: 1163544 - protein, 8 aa, Mycobacterium
HDDSASIT

SEQ ID NO: 1163545 - protein, 8 aa, Mycobacterium
HDDTTSEL

SEQ ID NO: 1163546 - protein, 5 aa, Mycobacterium
HDEAT

SEQ ID NO: 1163547 - protein, 6 aa, Mycobacterium
HDEVGG

SEQ ID NO: 1163548 - protein, 6 aa, Mycobacterium
HDGEPV

SEQ ID NO: 1163549 - protein, 6 aa, Mycobacterium
HDGESD

SEQ ID NO: 1163550 - protein, 11 aa, Mycobacterium
HDGGTGAAPLT

SEQ ID NO: 1163551 - protein, 8 aa, Mycobacterium
HDGPATGR

SEQ ID NO: 1163552 - protein, 9 aa, Mycobacterium
HDGTPGRID

SEQ ID NO: 1163553 - protein, 4 aa, Mycobacterium
HDGV

SEQ ID NO: 1163554 - protein, 4 aa, Mycobacterium
HDHM

SEQ ID NO: 1163555 - protein, 9 aa, Mycobacterium
HDLEPAGSF

SEQ ID NO: 1163556 - protein, 6 aa, Mycobacterium
HDLNDP

SEQ ID NO: 1163557 - protein, 8 aa, Mycobacterium
HDLPPTAG

SEQ ID NO: 1163558 - protein, 9 aa, Mycobacterium
HDNAGYPAP

SEQ ID NO: 1163559 - protein, 6 aa, Mycobacterium
HDPDAK

SEQ ID NO: 1163560 - protein, 6 aa, Mycobacterium
HDPDKL

SEQ ID NO: 1163561 - protein, 12 aa, Mycobacterium
HDPDRAEDDDYV

SEQ ID NO: 1163562 - protein, 10 aa, Mycobacterium
HDPEALPPLT

SEQ ID NO: 1163563 - protein, 7 aa, Mycobacterium
HDPESTT

SEQ ID NO: 1163564 - protein, 7 aa, Mycobacterium
HDPLRDD

SEQ ID NO: 1163565 - protein, 13 aa, Mycobacterium
HDPRDSTSVPAEV

SEQ ID NO: 1163566 - protein, 4 aa, Mycobacterium
HDQR

SEQ ID NO: 1163567 - protein, 4 aa, Mycobacterium
HDRA

SEQ ID NO: 1163568 - protein, 4 aa, Mycobacterium
HDRG

SEQ ID NO: 1163569 - protein, 4 aa, Mycobacterium
HDRS

SEQ ID NO: 1163570 - protein, 8 aa, Mycobacterium
HDRSESKV

SEQ ID NO: 1163571 - protein, 8 aa, Mycobacterium
HDRTGGRT

SEQ ID NO: 1163572 - protein, 5 aa, Mycobacterium
HDSPP

SEQ ID NO: 1163573 - protein, 9 aa, Mycobacterium
HDSRVGGGR

SEQ ID NO: 1163574 - protein, 12 aa, Mycobacterium
HDSTGKPPQYPI

SEQ ID NO: 1163575 - protein, 8 aa, Mycobacterium
HDTDGAGA

SEQ ID NO: 1163576 - protein, 8 aa, Mycobacterium
HDTDGDLD

SEQ ID NO: 1163577 - protein, 7 aa, Mycobacterium
HDTGLDD

SEQ ID NO: 1163578 - protein, 10 aa, Mycobacterium
HDTGRVPSTG

SEQ ID NO: 1163579 - protein, 14 aa, Mycobacterium
HDTPGAMAYPGGVE

SEQ ID NO: 1163580 - protein, 6 aa, Mycobacterium
HDTQAD

SEQ ID NO: 1163581 - protein, 7 aa, Mycobacterium
HDTTATG

SEQ ID NO: 1163582 - protein, 4 aa, Mycobacterium
HEAF

SEQ ID NO: 1163583 - protein, 6 aa, Mycobacterium
HEAGAQ

SEQ ID NO: 1163584 - protein, 5 aa, Mycobacterium
HEDDT

SEQ ID NO: 1163585 - protein, 15 aa, Mycobacterium
HEDEPLRDLELAGQS

SEQ ID NO: 1163586 - protein, 7 aa, Mycobacterium
HEDPGEL

SEQ ID NO: 1163587 - protein, 4 aa, Mycobacterium
HEEA

SEQ ID NO: 1163588 - protein, 7 aa, Mycobacterium
HEELPPE

SEQ ID NO: 1163589 - protein, 11 aa, Mycobacterium
HEENKKEFAGP

SEQ ID NO: 1163590 - protein, 10 aa, Mycobacterium
HEFRPDRKNV

SEQ ID NO: 1163591 - protein, 14 aa, Mycobacterium
HEGDTAAAVAVIEE

SEQ ID NO: 1163592 - protein, 8 aa, Mycobacterium
HEGEDTKN

SEQ ID NO: 1163593 - protein, 10 aa, Mycobacterium
HEKNRRQRKN

SEQ ID NO: 1163594 - protein, 11 aa, Mycobacterium
HEKTAALSSAY

SEQ ID NO: 1163595 - protein, 9 aa, Mycobacterium
HEKTETYPE

SEQ ID NO: 1163596 - protein, 4 aa, Mycobacterium
HENA

SEQ ID NO: 1163597 - protein, 10 aa, Mycobacterium
HENADEALRA

SEQ ID NO: 1163598 - protein, 4 aa, Mycobacterium
HEND

SEQ ID NO: 1163599 - protein, 7 aa, Mycobacterium
HENPSTA

SEQ ID NO: 1163600 - protein, 11 aa, Mycobacterium
HEPHRTADGRA

SEQ ID NO: 1163601 - protein, 7 aa, Mycobacterium
HEPPLSA

SEQ ID NO: 1163602 - protein, 8 aa, Mycobacterium
HEPPTPLE

SEQ ID NO: 1163603 - protein, 17 aa, Mycobacterium
HEQRADRRAQRSTRARL

SEQ ID NO: 1163604 - protein, 7 aa, Mycobacterium
HERAGSR

SEQ ID NO: 1163605 - protein, 6 aa, Mycobacterium
HERRGY

SEQ ID NO: 1163606 - protein, 14 aa, Mycobacterium
HERSAGQTAGRPRV

SEQ ID NO: 1163607 - protein, 5 aa, Mycobacterium
HESAG

SEQ ID NO: 1163608 - protein, 9 aa, Mycobacterium
HESGSDRLE

SEQ ID NO: 1163609 - protein, 7 aa, Mycobacterium
HETDPAQ

SEQ ID NO: 1163610 - protein, 7 aa, Mycobacterium
HETTAST

SEQ ID NO: 1163611 - protein, 6 aa, Mycobacterium
HETTSN

SEQ ID NO: 1163612 - protein, 4 aa, Mycobacterium
HEVP

SEQ ID NO: 1163613 - protein, 13 aa, Mycobacterium
HFDRTKAEAQDSD

SEQ ID NO: 1163614 - protein, 11 aa, Mycobacterium
HFGGSTALSGG

SEQ ID NO: 1163615 - protein, 12 aa, Mycobacterium
HFPSTDDRSRER

SEQ ID NO: 1163616 - protein, 9 aa, Mycobacterium
HFRPPRDGV

SEQ ID NO: 1163617 - protein, 11 aa, Mycobacterium
HGADGAVGTDI

SEQ ID NO: 1163618 - protein, 9 aa, Mycobacterium
HGADPEQVT

SEQ ID NO: 1163619 - protein, 7 aa, Mycobacterium
HGAGPRL

SEQ ID NO: 1163620 - protein, 7 aa, Mycobacterium
HGAHPRY

SEQ ID NO: 1163621 - protein, 13 aa, Mycobacterium
HGANRRSTSETRE

SEQ ID NO: 1163622 - protein, 4 aa, Mycobacterium
HGAR

SEQ ID NO: 1163623 - protein, 4 aa, Mycobacterium
HGAS

SEQ ID NO: 1163624 - protein, 6 aa, Mycobacterium
HGASDN

SEQ ID NO: 1163625 - protein, 7 aa, Mycobacterium
HGATAAT

SEQ ID NO: 1163626 - protein, 4 aa, Mycobacterium
HGDF

SEQ ID NO: 1163627 - protein, 11 aa, Mycobacterium
HGDGPEVVGPG

SEQ ID NO: 1163628 - protein, 5 aa, Mycobacterium
HGDNV

SEQ ID NO: 1163629 - protein, 6 aa, Mycobacterium
HGDPVT

SEQ ID NO: 1163630 - protein, 4 aa, Mycobacterium
HGDR

SEQ ID NO: 1163631 - protein, 22 aa, Mycobacterium
HGDTTTIADNRGSATARAGSHL

SEQ ID NO: 1163632 - protein, 6 aa, Mycobacterium
HGEDPT

SEQ ID NO: 1163633 - protein, 4 aa, Mycobacterium
HGEI

SEQ ID NO: 1163634 - protein, 5 aa, Mycobacterium
HGEMT

SEQ ID NO: 1163635 - protein, 5 aa, Mycobacterium
HGEQA

SEQ ID NO: 1163636 - protein, 7 aa, Mycobacterium
HGESRAA

SEQ ID NO: 1163637 - protein, 8 aa, Mycobacterium
HGEYEEDH

SEQ ID NO: 1163638 - protein, 5 aa, Mycobacterium
HGFGG

SEQ ID NO: 1163639 - protein, 38 aa, Mycobacterium
HGGAEPSGGDQSNAPGVSGTPGGSRVQESTAAEANTPL

SEQ ID NO: 1163640 - protein, 5 aa, Mycobacterium
HGGGA

SEQ ID NO: 1163641 - protein, 10 aa, Mycobacterium
HGGNTEALAG

SEQ ID NO: 1163642 - protein, 8 aa, Mycobacterium
HGGPDAGG

SEQ ID NO: 1163643 - protein, 6 aa, Mycobacterium
HGGPEA

SEQ ID NO: 1163644 - protein, 11 aa, Mycobacterium
HGGQLSHGRTH

SEQ ID NO: 1163645 - protein, 12 aa, Mycobacterium
HGGRDGRDVRSA

SEQ ID NO: 1163646 - protein, 11 aa, Mycobacterium
HGGRQANGGLP

SEQ ID NO: 1163647 - protein, 13 aa, Mycobacterium
HGGRSLGEGPAKA

SEQ ID NO: 1163648 - protein, 6 aa, Mycobacterium
HGGSKH

SEQ ID NO: 1163649 - protein, 12 aa, Mycobacterium
HGGVGASGFGKD

SEQ ID NO: 1163650 - protein, 5 aa, Mycobacterium
HGHAH

SEQ ID NO: 1163651 - protein, 5 aa, Mycobacterium
HGHGP

SEQ ID NO: 1163652 - protein, 6 aa, Mycobacterium
HGIDDD

SEQ ID NO: 1163653 - protein, 4 aa, Mycobacterium
HGIT

SEQ ID NO: 1163654 - protein, 23 aa, Mycobacterium
HGKGGRNAHGRITTRHKGGGHKR

SEQ ID NO: 1163655 - protein, 16 aa, Mycobacterium
HGKPDPYESGTWGPES

SEQ ID NO: 1163656 - protein, 5 aa, Mycobacterium
HGKPS

SEQ ID NO: 1163657 - protein, 6 aa, Mycobacterium
HGKRAA

SEQ ID NO: 1163658 - protein, 12 aa, Mycobacterium
HGKSDKPRADYS

SEQ ID NO: 1163659 - protein, 5 aa, Mycobacterium
HGKST

SEQ ID NO: 1163660 - protein, 6 aa, Mycobacterium
HGLPAT

SEQ ID NO: 1163661 - protein, 11 aa, Mycobacterium
HGMGDKSYPDL

SEQ ID NO: 1163662 - protein, 15 aa, Mycobacterium
HGMPAGAAHGDRDAS

SEQ ID NO: 1163663 - protein, 6 aa, Mycobacterium
HGNPLR

SEQ ID NO: 1163664 - protein, 15 aa, Mycobacterium
HGNTAGSQASIDPDA

SEQ ID NO: 1163665 - protein, 9 aa, Mycobacterium
HGPDGDTTV

SEQ ID NO: 1163666 - protein, 16 aa, Mycobacterium
HGPEAAETLRQTSYAQ

SEQ ID NO: 1163667 - protein, 5 aa, Mycobacterium
HGPIE

SEQ ID NO: 1163668 - protein, 10 aa, Mycobacterium
HGPPGTGKTF

SEQ ID NO: 1163669 - protein, 14 aa, Mycobacterium
HGPQVDKGARWDPA

SEQ ID NO: 1163670 - protein, 4 aa, Mycobacterium
HGPR

SEQ ID NO: 1163671 - protein, 6 aa, Mycobacterium
HGPRPL

SEQ ID NO: 1163672 - protein, 15 aa, Mycobacterium
HGPVTEDNAHPHNDC

SEQ ID NO: 1163673 - protein, 7 aa, Mycobacterium
HGQTEVS

SEQ ID NO: 1163674 - protein, 8 aa, Mycobacterium
HGRAARDA

SEQ ID NO: 1163675 - protein, 18 aa, Mycobacterium
HGRADSAVSADADTGDTV

SEQ ID NO: 1163676 - protein, 8 aa, Mycobacterium
HGRAQAES

SEQ ID NO: 1163677 - protein, 4 aa, Mycobacterium
HGRL

SEQ ID NO: 1163678 - protein, 8 aa, Mycobacterium
HGRRTDTP

SEQ ID NO: 1163679 - protein, 11 aa, Mycobacterium
HGRSAKPRTDY

SEQ ID NO: 1163680 - protein, 18 aa, Mycobacterium
HGRSSYQKDKTKDPDDFA

SEQ ID NO: 1163681 - protein, 6 aa, Mycobacterium
HGRTPP

SEQ ID NO: 1163682 - protein, 6 aa, Mycobacterium
HGSAAA

SEQ ID NO: 1163683 - protein, 19 aa, Mycobacterium
HGSDSPESAAREIDLWFPG

SEQ ID NO: 1163684 - protein, 9 aa, Mycobacterium
HGSEEHQPG

SEQ ID NO: 1163685 - protein, 8 aa, Mycobacterium
HGSEEQRK

SEQ ID NO: 1163686 - protein, 6 aa, Mycobacterium
HGSKEL

SEQ ID NO: 1163687 - protein, 7 aa, Mycobacterium
HGSPEQI

SEQ ID NO: 1163688 - protein, 9 aa, Mycobacterium
HGSQYTSTD

SEQ ID NO: 1163689 - protein, 9 aa, Mycobacterium
HGSSSSRVS

SEQ ID NO: 1163690 - protein, 6 aa, Mycobacterium
HGSTAE

SEQ ID NO: 1163691 - protein, 10 aa, Mycobacterium
HGSVSKEQRA

SEQ ID NO: 1163692 - protein, 8 aa, Mycobacterium
HGSYRGAP

SEQ ID NO: 1163693 - protein, 8 aa, Mycobacterium
HGTARSTT

SEQ ID NO: 1163694 - protein, 8 aa, Mycobacterium
HGTEAQKQ

SEQ ID NO: 1163695 - protein, 12 aa, Mycobacterium
HGTGTPTGDPVE

SEQ ID NO: 1163696 - protein, 10 aa, Mycobacterium
HGTGTPVGDP

SEQ ID NO: 1163697 - protein, 13 aa, Mycobacterium
HGTGTRLGDKTEL

SEQ ID NO: 1163698 - protein, 18 aa, Mycobacterium
HGTGTSLGDPIEAQAAGE

SEQ ID NO: 1163699 - protein, 11 aa, Mycobacterium
HGTVERDAEGL

SEQ ID NO: 1163700 - protein, 12 aa, Mycobacterium
HGVGDSIARAGG

SEQ ID NO: 1163701 - protein, 15 aa, Mycobacterium
HGVGTGISASDRATT

SEQ ID NO: 1163702 - protein, 4 aa, Mycobacterium
HGVP

SEQ ID NO: 1163703 - protein, 12 aa, Mycobacterium
HGVPTDDSDDNA

SEQ ID NO: 1163704 - protein, 8 aa, Mycobacterium
HGVSEAPR

SEQ ID NO: 1163705 - protein, 4 aa, Mycobacterium
HGVT

SEQ ID NO: 1163706 - protein, 5 aa, Mycobacterium
HGWYD

SEQ ID NO: 1163707 - protein, 6 aa, Mycobacterium
HHAPGT

SEQ ID NO: 1163708 - protein, 8 aa, Mycobacterium
HHATSRGQ

SEQ ID NO: 1163709 - protein, 8 aa, Mycobacterium
HHDGGVEE

SEQ ID NO: 1163710 - protein, 4 aa, Mycobacterium
HHDP

SEQ ID NO: 1163711 - protein, 16 aa, Mycobacterium
HHDQGKDSEFSDRLTR

SEQ ID NO: 1163712 - protein, 15 aa, Mycobacterium
HHGAPEKARERARRK

SEQ ID NO: 1163713 - protein, 4 aa, Mycobacterium
HHGG

SEQ ID NO: 1163714 - protein, 9 aa, Mycobacterium
HHGPAGERR

SEQ ID NO: 1163715 - protein, 6 aa, Mycobacterium
HHGSPS

SEQ ID NO: 1163716 - protein, 6 aa, Mycobacterium
HHNAGA

SEQ ID NO: 1163717 - protein, 7 aa, Mycobacterium
HHPADGD

SEQ ID NO: 1163718 - protein, 15 aa, Mycobacterium
HHPDDELLAAACERM

SEQ ID NO: 1163719 - protein, 8 aa, Mycobacterium
HHQKGNAV

SEQ ID NO: 1163720 - protein, 8 aa, Mycobacterium
HHTAGGMS

SEQ ID NO: 1163721 - protein, 6 aa, Mycobacterium
HIEPGE

SEQ ID NO: 1163722 - protein, 5 aa, Mycobacterium
HISEE

SEQ ID NO: 1163723 - protein, 6 aa, Mycobacterium
HKASPG

SEQ ID NO: 1163724 - protein, 7 aa, Mycobacterium
HKATAEQ

SEQ ID NO: 1163725 - protein, 10 aa, Mycobacterium
HKATGERSEE

SEQ ID NO: 1163726 - protein, 5 aa, Mycobacterium
HKGEQ

SEQ ID NO: 1163727 - protein, 7 aa, Mycobacterium
HKNRSRV

SEQ ID NO: 1163728 - protein, 12 aa, Mycobacterium
HKPARREGTREG

SEQ ID NO: 1163729 - protein, 6 aa, Mycobacterium
HKRTAD

SEQ ID NO: 1163730 - protein, 7 aa, Mycobacterium
HKRTPTD

SEQ ID NO: 1163731 - protein, 13 aa, Mycobacterium
HLAGPPDDPRIPE

SEQ ID NO: 1163732 - protein, 13 aa, Mycobacterium
HLDSTRAVSPLRA

SEQ ID NO: 1163733 - protein, 19 aa, Mycobacterium
HLEGKATAEYSGDHTSSIR

SEQ ID NO: 1163734 - protein, 7 aa, Mycobacterium
HLEPGGT

SEQ ID NO: 1163735 - protein, 14 aa, Mycobacterium
HLPDPAKRQVRRAQ

SEQ ID NO: 1163736 - protein, 6 aa, Mycobacterium
HLPEDH

SEQ ID NO: 1163737 - protein, 4 aa, Mycobacterium
HLPP

SEQ ID NO: 1163738 - protein, 5 aa, Mycobacterium
HLPSA

SEQ ID NO: 1163739 - protein, 5 aa, Mycobacterium
HLPST

SEQ ID NO: 1163740 - protein, 7 aa, Mycobacterium
HLRSGEE

SEQ ID NO: 1163741 - protein, 6 aa, Mycobacterium
HMSPPT

SEQ ID NO: 1163742 - protein, 7 aa, Mycobacterium
HMSPPTP

SEQ ID NO: 1163743 - protein, 9 aa, Mycobacterium
HNDDSADDI

SEQ ID NO: 1163744 - protein, 6 aa, Mycobacterium
HNDTGG

SEQ ID NO: 1163745 - protein, 10 aa, Mycobacterium
HNGASHQDPG

SEQ ID NO: 1163746 - protein, 10 aa, Mycobacterium
HNGGSTFDEP

SEQ ID NO: 1163747 - protein, 6 aa, Mycobacterium
HNGKNT

SEQ ID NO: 1163748 - protein, 6 aa, Mycobacterium
HNITDD

SEQ ID NO: 1163749 - protein, 14 aa, Mycobacterium
HNKKSDAHEPTFDG

SEQ ID NO: 1163750 - protein, 14 aa, Mycobacterium
HNKPEATAEAVTPD

SEQ ID NO: 1163751 - protein, 9 aa, Mycobacterium
HNLRRGPDM

SEQ ID NO: 1163752 - protein, 8 aa, Mycobacterium
HNPAASPV

SEQ ID NO: 1163753 - protein, 8 aa, Mycobacterium
HNPAGAAA

SEQ ID NO: 1163754 - protein, 9 aa, Mycobacterium
HNPDAEDRM

SEQ ID NO: 1163755 - protein, 4 aa, Mycobacterium
HNPH

SEQ ID NO: 1163756 - protein, 11 aa, Mycobacterium
HNPTGTVESAA

SEQ ID NO: 1163757 - protein, 12 aa, Mycobacterium
HNQDRLAHGSEE

SEQ ID NO: 1163758 - protein, 5 aa, Mycobacterium
HNRAA

SEQ ID NO: 1163759 - protein, 10 aa, Mycobacterium
HNSDPRYTRS

SEQ ID NO: 1163760 - protein, 12 aa, Mycobacterium
HNTGPVPDPPLS

SEQ ID NO: 1163761 - protein, 5 aa, Mycobacterium
HPADP

SEQ ID NO: 1163762 - protein, 20 aa, Mycobacterium
HPAEPQGPRDPVLPEGLLVR

SEQ ID NO: 1163763 - protein, 5 aa, Mycobacterium
HPAES

SEQ ID NO: 1163764 - protein, 8 aa, Mycobacterium
HPAGEKHD

SEQ ID NO: 1163765 - protein, 8 aa, Mycobacterium
HPAGGPPH

SEQ ID NO: 1163766 - protein, 22 aa, Mycobacterium
HPAGGVGARGHRPGDESAPVVR

SEQ ID NO: 1163767 - protein, 11 aa, Mycobacterium
HPAHPQAGEGP

SEQ ID NO: 1163768 - protein, 14 aa, Mycobacterium
HPAPCGASTTGATT

SEQ ID NO: 1163769 - protein, 8 aa, Mycobacterium
HPAPPGAP

SEQ ID NO: 1163770 - protein, 7 aa, Mycobacterium
HPATPMT

SEQ ID NO: 1163771 - protein, 16 aa, Mycobacterium
HPDAGARIGASSQRMA

SEQ ID NO: 1163772 - protein, 4 aa, Mycobacterium
HPDD

SEQ ID NO: 1163773 - protein, 10 aa, Mycobacterium
HPDDARAAGL

SEQ ID NO: 1163774 - protein, 6 aa, Mycobacterium
HPDDDR

SEQ ID NO: 1163775 - protein, 19 aa, Mycobacterium
HPDDPGLPAHRDVLVVTFA

SEQ ID NO: 1163776 - protein, 5 aa, Mycobacterium
HPDDR

SEQ ID NO: 1163777 - protein, 12 aa, Mycobacterium
HPDERTRLSRER

SEQ ID NO: 1163778 - protein, 4 aa, Mycobacterium
HPDG

SEQ ID NO: 1163779 - protein, 5 aa, Mycobacterium
HPDGV

SEQ ID NO: 1163780 - protein, 22 aa, Mycobacterium
HPDHREHAKEPRPLDDDELERR

SEQ ID NO: 1163781 - protein, 5 aa, Mycobacterium
HPDKE

SEQ ID NO: 1163782 - protein, 5 aa, Mycobacterium
HPDLG

SEQ ID NO: 1163783 - protein, 6 aa, Mycobacterium
HPDPDT

SEQ ID NO: 1163784 - protein, 11 aa, Mycobacterium
HPDQRERLSRE

SEQ ID NO: 1163785 - protein, 6 aa, Mycobacterium
HPDQRR

SEQ ID NO: 1163786 - protein, 11 aa, Mycobacterium
HPDRPAGTPYI

SEQ ID NO: 1163787 - protein, 5 aa, Mycobacterium
HPDTE

SEQ ID NO: 1163788 - protein, 4 aa, Mycobacterium
HPDV

SEQ ID NO: 1163789 - protein, 11 aa, Mycobacterium
HPEATQEYRKP

SEQ ID NO: 1163790 - protein, 5 aa, Mycobacterium
HPEGA

SEQ ID NO: 1163791 - protein, 5 aa, Mycobacterium
HPELS

SEQ ID NO: 1163792 - protein, 5 aa, Mycobacterium
HPEPA

SEQ ID NO: 1163793 - protein, 8 aa, Mycobacterium
HPERREGA

SEQ ID NO: 1163794 - protein, 11 aa, Mycobacterium
HPESTAGLAPA

SEQ ID NO: 1163795 - protein, 5 aa, Mycobacterium
HPEVE

SEQ ID NO: 1163796 - protein, 6 aa, Mycobacterium
HPEYAD

SEQ ID NO: 1163797 - protein, 6 aa, Mycobacterium
HPGADI

SEQ ID NO: 1163798 - protein, 7 aa, Mycobacterium
HPGDGPQ

SEQ ID NO: 1163799 - protein, 13 aa, Mycobacterium
HPGEHDDNSIDNP

SEQ ID NO: 1163800 - protein, 5 aa, Mycobacterium
HPGNG

SEQ ID NO: 1163801 - protein, 5 aa, Mycobacterium
HPGPR

SEQ ID NO: 1163802 - protein, 9 aa, Mycobacterium
HPGPTKTSM

SEQ ID NO: 1163803 - protein, 7 aa, Mycobacterium
HPGPTPP

SEQ ID NO: 1163804 - protein, 5 aa, Mycobacterium
HPGPV

SEQ ID NO: 1163805 - protein, 9 aa, Mycobacterium
HPGTSSTEL

SEQ ID NO: 1163806 - protein, 5 aa, Mycobacterium
HPGTV

SEQ ID NO: 1163807 - protein, 7 aa, Mycobacterium
HPGVSNT

SEQ ID NO: 1163808 - protein, 6 aa, Mycobacterium
HPGYSH

SEQ ID NO: 1163809 - protein, 36 aa, Mycobacterium; identical to SEQ ID NO: 503762

SEQ ID NO: 1163810 - protein, 9 aa, Mycobacterium
HPKKLARPK

SEQ ID NO: 1163811 - protein, 12 aa, Mycobacterium
HPKPQQQPGPPL

SEQ ID NO: 1163812 - protein, 14 aa, Mycobacterium
HPKYTVTSGSITLD

SEQ ID NO: 1163813 - protein, 15 aa, Mycobacterium
HPLAGGSGAGGGGGM

SEQ ID NO: 1163814 - protein, 10 aa, Mycobacterium
HPLPSQPWTQ

SEQ ID NO: 1163815 - protein, 4 aa, Mycobacterium
HPNA

SEQ ID NO: 1163816 - protein, 4 aa, Mycobacterium
HPNP

SEQ ID NO: 1163817 - protein, 7 aa, Mycobacterium
HPNPAVA

SEQ ID NO: 1163818 - protein, 15 aa, Mycobacterium
HPNVNASYNEDTKEI

SEQ ID NO: 1163819 - protein, 10 aa, Mycobacterium
HPNWRGDAAS

SEQ ID NO: 1163820 - protein, 21 aa, Mycobacterium
HPPDTSEAPAYAAAARRSELS

SEQ ID NO: 1163821 - protein, 8 aa, Mycobacterium
HPPEFGGR

SEQ ID NO: 1163822 - protein, 6 aa, Mycobacterium
HPPELG

SEQ ID NO: 1163823 - protein, 13 aa, Mycobacterium
HPPGSTDKFGADL

SEQ ID NO: 1163824 - protein, 7 aa, Mycobacterium
HPPTPAT

SEQ ID NO: 1163825 - protein, 6 aa, Mycobacterium
HPPTRP

SEQ ID NO: 1163826 - protein, 8 aa, Mycobacterium
HPQLDGRD

SEQ ID NO: 1163827 - protein, 13 aa, Mycobacterium
HPQPVIGSPTRHA

SEQ ID NO: 1163828 - protein, 5 aa, Mycobacterium
HPQVG

SEQ ID NO: 1163829 - protein, 7 aa, Mycobacterium
HPRGNYP

SEQ ID NO: 1163830 - protein, 5 aa, Mycobacterium
HPRPD

SEQ ID NO: 1163831 - protein, 9 aa, Mycobacterium
HPRRTAPER

SEQ ID NO: 1163832 - protein, 11 aa, Mycobacterium
HPRSAADEDAP

SEQ ID NO: 1163833 - protein, 10 aa, Mycobacterium
HPRVPDPAGV

SEQ ID NO: 1163834 - protein, 5 aa, Mycobacterium
HPSAS

SEQ ID NO: 1163835 - protein, 4 aa, Mycobacterium
HPSR

SEQ ID NO: 1163836 - protein, 8 aa, Mycobacterium
HPSTTGRY

SEQ ID NO: 1163837 - protein, 6 aa, Mycobacterium
HPTDRR

SEQ ID NO: 1163838 - protein, 6 aa, Mycobacterium
HPTDTT

SEQ ID NO: 1163839 - protein, 8 aa, Mycobacterium
HPTGPHNA

SEQ ID NO: 1163840 - protein, 6 aa, Mycobacterium
HPTGVG

SEQ ID NO: 1163841 - protein, 9 aa, Mycobacterium
HPTQLGPAR

SEQ ID NO: 1163842 - protein, 5 aa, Mycobacterium
HPTSG

SEQ ID NO: 1163843 - protein, 6 aa, Mycobacterium
HPTSGT

SEQ ID NO: 1163844 - protein, 6 aa, Mycobacterium
HPTTVG

SEQ ID NO: 1163845 - protein, 15 aa, Mycobacterium
HPVADSVGRADNEGM

SEQ ID NO: 1163846 - protein, 5 aa, Mycobacterium
HPWPA

SEQ ID NO: 1163847 - protein, 6 aa, Mycobacterium
HPWRRA

SEQ ID NO: 1163848 - protein, 5 aa, Mycobacterium
HQGAA

SEQ ID NO: 1163849 - protein, 6 aa, Mycobacterium
HQGERF

SEQ ID NO: 1163850 - protein, 5 aa, Mycobacterium
HQGKR

SEQ ID NO: 1163851 - protein, 10 aa, Mycobacterium
HQGPVPELPA

SEQ ID NO: 1163852 - protein, 9 aa, Mycobacterium
HQLSGGQRQ

SEQ ID NO: 1163853 - protein, 11 aa, Mycobacterium
HQNTARKRTWS

SEQ ID NO: 1163854 - protein, 7 aa, Mycobacterium
HQPDVRG

SEQ ID NO: 1163855 - protein, 9 aa, Mycobacterium
HQQAPGPTL

SEQ ID NO: 1163856 - protein, 9 aa, Mycobacterium
HQQGGEDGA

SEQ ID NO: 1163857 - protein, 9 aa, Mycobacterium
HQQPDGSVR

SEQ ID NO: 1163858 - protein, 7 aa, Mycobacterium
HQQQRTA

SEQ ID NO: 1163859 - protein, 8 aa, Mycobacterium
HQSADGEA

SEQ ID NO: 1163860 - protein, 8 aa, Mycobacterium
HQTGTARV

SEQ ID NO: 1163861 - protein, 10 aa, Mycobacterium
HRADRAEAEM

SEQ ID NO: 1163862 - protein, 9 aa, Mycobacterium
HRAGAGAGV

SEQ ID NO: 1163863 - protein, 5 aa, Mycobacterium
HRAGD

SEQ ID NO: 1163864 - protein, 5 aa, Mycobacterium
HRAQP

SEQ ID NO: 1163865 - protein, 11 aa, Mycobacterium
HRARGRNQDEL

SEQ ID NO: 1163866 - protein, 18 aa, Mycobacterium
HRASRRLAEDRGSFPAFP

SEQ ID NO: 1163867 - protein, 10 aa, Mycobacterium
HRASSDRDGR

SEQ ID NO: 1163868 - protein, 6 aa, Mycobacterium
HRDDEQ

SEQ ID NO: 1163869 - protein, 15 aa, Mycobacterium
HRDDTAQRRTARART

SEQ ID NO: 1163870 - protein, 9 aa, Mycobacterium
HRDEANPAL

SEQ ID NO: 1163871 - protein, 7 aa, Mycobacterium
HRDEPTE

SEQ ID NO: 1163872 - protein, 18 aa, Mycobacterium
HRDGAPDLYPEKHRDEID

SEQ ID NO: 1163873 - protein, 7 aa, Mycobacterium
HRDPDAF

SEQ ID NO: 1163874 - protein, 7 aa, Mycobacterium
HREDGSS

SEQ ID NO: 1163875 - protein, 5 aa, Mycobacterium
HREER

SEQ ID NO: 1163876 - protein, 13 aa, Mycobacterium
HREPGQEEMSPEG

SEQ ID NO: 1163877 - protein, 5 aa, Mycobacterium
HRGAE

SEQ ID NO: 1163878 - protein, 13 aa, Mycobacterium
HRGDEPGDQLAAG

SEQ ID NO: 1163879 - protein, 5 aa, Mycobacterium
HRGEM

SEQ ID NO: 1163880 - protein, 5 aa, Mycobacterium
HRGGG

SEQ ID NO: 1163881 - protein, 11 aa, Mycobacterium
HRGGPLADGLA

SEQ ID NO: 1163882 - protein, 13 aa, Mycobacterium
HRGGRGETTEESL

SEQ ID NO: 1163883 - protein, 9 aa, Mycobacterium
HRGSGAPEG

SEQ ID NO: 1163884 - protein, 10 aa, Mycobacterium
HRHGGYNPAG

SEQ ID NO: 1163885 - protein, 19 aa, Mycobacterium
HRKGPNNSVTAGPNDVGSP

SEQ ID NO: 1163886 - protein, 4 aa, Mycobacterium
HRKR

SEQ ID NO: 1163887 - protein, 9 aa, Mycobacterium
HRNGPTKTI

SEQ ID NO: 1163888 - protein, 7 aa, Mycobacterium
HRNTGAR

SEQ ID NO: 1163889 - protein, 8 aa, Mycobacterium
HRPDATAG

SEQ ID NO: 1163890 - protein, 6 aa, Mycobacterium
HRPDGA

SEQ ID NO: 1163891 - protein, 5 aa, Mycobacterium
HRPGR

SEQ ID NO: 1163892 - protein, 8 aa, Mycobacterium
HRPGTASS

SEQ ID NO: 1163893 - protein, 9 aa, Mycobacterium
HRPGTDPRA

SEQ ID NO: 1163894 - protein, 6 aa, Mycobacterium
HRPLSG

SEQ ID NO: 1163895 - protein, 7 aa, Mycobacterium
HRPPGLR

SEQ ID NO: 1163896 - protein, 10 aa, Mycobacterium
HRQRPATAQG

SEQ ID NO: 1163897 - protein, 7 aa, Mycobacterium
HRQTELP

SEQ ID NO: 1163898 - protein, 5 aa, Mycobacterium
HRREP

SEQ ID NO: 1163899 - protein, 5 aa, Mycobacterium
HRRRG

SEQ ID NO: 1163900 - protein, 6 aa, Mycobacterium
HRRTGV

SEQ ID NO: 1163901 - protein, 9 aa, Mycobacterium
HRSESLDDL

SEQ ID NO: 1163902 - protein, 5 aa, Mycobacterium
HRSPE

SEQ ID NO: 1163903 - protein, 9 aa, Mycobacterium
HRSPEPGHT

SEQ ID NO: 1163904 - protein, 5 aa, Mycobacterium
HRSTN

SEQ ID NO: 1163905 - protein, 8 aa, Mycobacterium
HRTATRER

SEQ ID NO: 1163906 - protein, 10 aa, Mycobacterium
HRTGTDGDVT

SEQ ID NO: 1163907 - protein, 5 aa, Mycobacterium
HRTPG

SEQ ID NO: 1163908 - protein, 8 aa, Mycobacterium
HRTSTSAP

SEQ ID NO: 1163909 - protein, 9 aa, Mycobacterium
HRVSGPKGD

SEQ ID NO: 1163910 - protein, 11 aa, Mycobacterium
HRVTGQGAAGD

SEQ ID NO: 1163911 - protein, 4 aa, Mycobacterium
HSAG

SEQ ID NO: 1163912 - protein, 5 aa, Mycobacterium
HSAGA

SEQ ID NO: 1163913 - protein, 6 aa, Mycobacterium
HSATAA

SEQ ID NO: 1163914 - protein, 8 aa, Mycobacterium
HSATSSLL

SEQ ID NO: 1163915 - protein, 9 aa, Mycobacterium
HSDAGSQYT

SEQ ID NO: 1163916 - protein, 6 aa, Mycobacterium
HSDDQH

SEQ ID NO: 1163917 - protein, 10 aa, Mycobacterium
HSDRPSDTMT

SEQ ID NO: 1163918 - protein, 12 aa, Mycobacterium
HSDTGRDFTPVQ

SEQ ID NO: 1163919 - protein, 9 aa, Mycobacterium
HSEDGSPPY

SEQ ID NO: 1163920 - protein, 4 aa, Mycobacterium
HSEN

SEQ ID NO: 1163921 - protein, 11 aa, Mycobacterium
HSEPEDEAARR

SEQ ID NO: 1163922 - protein, 7 aa, Mycobacterium
HSEPGDR

SEQ ID NO: 1163923 - protein, 17 aa, Mycobacterium
HSESEGVEPSRRVVVLA

SEQ ID NO: 1163924 - protein, 12 aa, Mycobacterium
HSETGIDAAGAS

SEQ ID NO: 1163925 - protein, 9 aa, Mycobacterium
HSGAADAVA

SEQ ID NO: 1163926 - protein, 7 aa, Mycobacterium
HSGAATA

SEQ ID NO: 1163927 - protein, 14 aa, Mycobacterium
HSGDHSAEADDFTD

SEQ ID NO: 1163928 - protein, 10 aa, Mycobacterium
HSGDPAYTGL

SEQ ID NO: 1163929 - protein, 7 aa, Mycobacterium
HSGDPSI

SEQ ID NO: 1163930 - protein, 8 aa, Mycobacterium
HSGDTTDL

SEQ ID NO: 1163931 - protein, 5 aa, Mycobacterium
HSGFA

SEQ ID NO: 1163932 - protein, 8 aa, Mycobacterium
HSGGGDPV

SEQ ID NO: 1163933 - protein, 7 aa, Mycobacterium
HSGGGFD

SEQ ID NO: 1163934 - protein, 9 aa, Mycobacterium
HSGKAEVKG

SEQ ID NO: 1163935 - protein, 8 aa, Mycobacterium
HSGPQSSV

SEQ ID NO: 1163936 - protein, 7 aa, Mycobacterium
HSGPVTG

SEQ ID NO: 1163937 - protein, 9 aa, Mycobacterium
HSGRDDLNS

SEQ ID NO: 1163938 - protein, 15 aa, Mycobacterium
HSGTAPTDLANSNTG

SEQ ID NO: 1163939 - protein, 8 aa, Mycobacterium
HSGYPGGL

SEQ ID NO: 1163940 - protein, 10 aa, Mycobacterium
HSHRRTSRRW

SEQ ID NO: 1163941 - protein, 7 aa, Mycobacterium
HSKARDA

SEQ ID NO: 1163942 - protein, 5 aa, Mycobacterium
HSNVP

SEQ ID NO: 1163943 - protein, 8 aa, Mycobacterium
HSPARSGR

SEQ ID NO: 1163944 - protein, 8 aa, Mycobacterium
HSPEHPPG

SEQ ID NO: 1163945 - protein, 6 aa, Mycobacterium
HSPEPR

SEQ ID NO: 1163946 - protein, 7 aa, Mycobacterium
HSPGRAV

SEQ ID NO: 1163947 - protein, 13 aa, Mycobacterium
HSPRAASDSVTAR

SEQ ID NO: 1163948 - protein, 5 aa, Mycobacterium
HSPTA

SEQ ID NO: 1163949 - protein, 15 aa, Mycobacterium
HSRGQERSDPGDKRG

SEQ ID NO: 1163950 - protein, 6 aa, Mycobacterium
HSRHAP

SEQ ID NO: 1163951 - protein, 4 aa, Mycobacterium
HSRT

SEQ ID NO: 1163952 - protein, 8 aa, Mycobacterium
HSRTAESQ

SEQ ID NO: 1163953 - protein, 6 aa, Mycobacterium
HSSAGA

SEQ ID NO: 1163954 - protein, 14 aa, Mycobacterium
HSTAPGAQQYSDDE

SEQ ID NO: 1163955 - protein, 8 aa, Mycobacterium
HSTGGGEV

SEQ ID NO: 1163956 - protein, 5 aa, Mycobacterium
HSTPE

SEQ ID NO: 1163957 - protein, 8 aa, Mycobacterium
HSTPEDLA

SEQ ID NO: 1163958 - protein, 10 aa, Mycobacterium
HSVDDPEPKY

SEQ ID NO: 1163959 - protein, 10 aa, Mycobacterium
HSYRGPGPRN

SEQ ID NO: 1163960 - protein, 10 aa, Mycobacterium
HTADGGSDTV

SEQ ID NO: 1163961 - protein, 8 aa, Mycobacterium
HTAPGGRT

SEQ ID NO: 1163962 - protein, 11 aa, Mycobacterium
HTARTAARSAG

SEQ ID NO: 1163963 - protein, 6 aa, Mycobacterium
HTATEG

SEQ ID NO: 1163964 - protein, 8 aa, Mycobacterium
HTDDADIA

SEQ ID NO: 1163965 - protein, 13 aa, Mycobacterium
HTDDYSRGGRTDI

SEQ ID NO: 1163966 - protein, 8 aa, Mycobacterium
HTDLTGRP

SEQ ID NO: 1163967 - protein, 7 aa, Mycobacterium
HTDPDAR

SEQ ID NO: 1163968 - protein, 5 aa, Mycobacterium
HTDPW

SEQ ID NO: 1163969 - protein, 13 aa, Mycobacterium
HTDRSDASGTGYF

SEQ ID NO: 1163970 - protein, 4 aa, Mycobacterium
HTDT

SEQ ID NO: 1163971 - protein, 5 aa, Mycobacterium
HTEDG

SEQ ID NO: 1163972 - protein, 8 aa, Mycobacterium
HTEGNPRD

SEQ ID NO: 1163973 - protein, 7 aa, Mycobacterium
HTEYDTG

SEQ ID NO: 1163974 - protein, 13 aa, Mycobacterium
HTGEVTSYGPPAS

SEQ ID NO: 1163975 - protein, 15 aa, Mycobacterium
HTGGEKRVSASGGTL

SEQ ID NO: 1163976 - protein, 17 aa, Mycobacterium
HTGKDPETIRKDTDRDK

SEQ ID NO: 1163977 - protein, 7 aa, Mycobacterium
HTGNDDT

SEQ ID NO: 1163978 - protein, 13 aa, Mycobacterium
HTGQSTAVVPPEN

SEQ ID NO: 1163979 - protein, 8 aa, Mycobacterium
HTGRAVDA

SEQ ID NO: 1163980 - protein, 10 aa, Mycobacterium
HTGRGRPAKR

SEQ ID NO: 1163981 - protein, 9 aa, Mycobacterium
HTGSTNPID

SEQ ID NO: 1163982 - protein, 24 aa, Mycobacterium
HTGTRRTGPGGSGTRLRPGNRPVN

SEQ ID NO: 1163983 - protein, 9 aa, Mycobacterium
HTKKKESEI

SEQ ID NO: 1163984 - protein, 12 aa, Mycobacterium
HTMPRATASTDA

SEQ ID NO: 1163985 - protein, 13 aa, Mycobacterium
HTPERTAERTGIP

SEQ ID NO: 1163986 - protein, 8 aa, Mycobacterium
HTPPAGPA

SEQ ID NO: 1163987 - protein, 8 aa, Mycobacterium
HTQNAQSR

SEQ ID NO: 1163988 - protein, 10 aa, Mycobacterium
HTRDDGGNTV

SEQ ID NO: 1163989 - protein, 6 aa, Mycobacterium
HTRTAE

SEQ ID NO: 1163990 - protein, 9 aa, Mycobacterium
HTSRDDTGC

SEQ ID NO: 1163991 - protein, 4 aa, Mycobacterium
HTST

SEQ ID NO: 1163992 - protein, 10 aa, Mycobacterium
HTTEPPPSQL

SEQ ID NO: 1163993 - protein, 6 aa, Mycobacterium
HTTGDG

SEQ ID NO: 1163994 - protein, 5 aa, Mycobacterium
HTTRV

SEQ ID NO: 1163995 - protein, 4 aa, Mycobacterium
HTTV

SEQ ID NO: 1163996 - protein, 11 aa, Mycobacterium
HVDADTEETAS

SEQ ID NO: 1163997 - protein, 16 aa, Mycobacterium
HVGDARATEVSSDGQL

SEQ ID NO: 1163998 - protein, 5 aa, Mycobacterium
HVGDD

SEQ ID NO: 1163999 - protein, 11 aa, Mycobacterium
HVGPGQSVTTA

SEQ ID NO: 1164000 - protein, 5 aa, Mycobacterium
HVGSS

SEQ ID NO: 1164001 - protein, 10 aa, Mycobacterium
HVPPSESPGM

SEQ ID NO: 1164002 - protein, 8 aa, Mycobacterium
HVQDERGH

SEQ ID NO: 1164003 - protein, 11 aa, Mycobacterium
HVSETAKRLPG

SEQ ID NO: 1164004 - protein, 8 aa, Mycobacterium
HVSGGTRR

SEQ ID NO: 1164005 - protein, 5 aa, Mycobacterium
HYAPP

SEQ ID NO: 1164006 - protein, 5 aa, Mycobacterium
HYPGA

SEQ ID NO: 1164007 - protein, 8 aa, Mycobacterium
HYQGDDSD

SEQ ID NO: 1164008 - protein, 11 aa, Mycobacterium
HYSEGAPAGWE

SEQ ID NO: 1164009 - protein, 9 aa, Mycobacterium
HYSPDSLPA

SEQ ID NO: 1164010 - protein, 5 aa, Mycobacterium
HYTGE

SEQ ID NO: 1164011 - protein, 8 aa, Mycobacterium
HYTPDSRR

SEQ ID NO: 1164012 - protein, 7 aa, Mycobacterium
HYTSGGW

SEQ ID NO: 1164013 - protein, 8 aa, Mycobacterium
IAAEEGAA

SEQ ID NO: 1164014 - protein, 6 aa, Mycobacterium
IAAGGA

SEQ ID NO: 1164015 - protein, 18 aa, Mycobacterium
IAAKSDLERQENKTKTGA

SEQ ID NO: 1164016 - protein, 5 aa, Mycobacterium
IAANG

SEQ ID NO: 1164017 - protein, 8 aa, Mycobacterium
IAASPDAL

SEQ ID NO: 1164018 - protein, 10 aa, Mycobacterium
IAATDEENYN

SEQ ID NO: 1164019 - protein, 8 aa, Mycobacterium
IADDPTQL

SEQ ID NO: 1164020 - protein, 7 aa, Mycobacterium
IADGSLR

SEQ ID NO: 1164021 - protein, 6 aa, Mycobacterium
IADGTL

SEQ ID NO: 1164022 - protein, 8 aa, Mycobacterium
IADPATAD

SEQ ID NO: 1164023 - protein, 10 aa, Mycobacterium
IADPKGNAES

SEQ ID NO: 1164024 - protein, 5 aa, Mycobacterium
IADTG

SEQ ID NO: 1164025 - protein, 10 aa, Mycobacterium
IAERGYRDTT

SEQ ID NO: 1164026 - protein, 5 aa, Mycobacterium
IAERR

SEQ ID NO: 1164027 - protein, 16 aa, Mycobacterium
IAETKKSDLNANDIDQ

SEQ ID NO: 1164028 - protein, 7 aa, Mycobacterium
IAEYDPE

SEQ ID NO: 1164029 - protein, 6 aa, Mycobacterium
IAGGAQ

SEQ ID NO: 1164030 - protein, 8 aa, Mycobacterium
IAGGTSEI

SEQ ID NO: 1164031 - protein, 14 aa, Mycobacterium
IAGNRGQTNYATTK

SEQ ID NO: 1164032 - protein, 11 aa, Mycobacterium
IAGPDGELSPV

SEQ ID NO: 1164033 - protein, 12 aa, Mycobacterium
IAGPGGGTELKP

SEQ ID NO: 1164034 - protein, 5 aa, Mycobacterium
IAGQN

SEQ ID NO: 1164035 - protein, 4 aa, Mycobacterium
IAKE

SEQ ID NO: 1164036 - protein, 4 aa, Mycobacterium
IAPG

SEQ ID NO: 1164037 - protein, 9 aa, Mycobacterium
IAPGQEADW

SEQ ID NO: 1164038 - protein, 5 aa, Mycobacterium
IAPRG

SEQ ID NO: 1164039 - protein, 4 aa, Mycobacterium
IAPY

SEQ ID NO: 1164040 - protein, 6 aa, Mycobacterium
IAQAAQ

SEQ ID NO: 1164041 - protein, 16 aa, Mycobacterium
IAQAPRAPHAPQGAYP

SEQ ID NO: 1164042 - protein, 11 aa, Mycobacterium
IAQKGTPEELY

SEQ ID NO: 1164043 - protein, 13 aa, Mycobacterium
IAQNAADAEAMGA

SEQ ID NO: 1164044 - protein, 6 aa, Mycobacterium
IAQPRE

SEQ ID NO: 1164045 - protein, 5 aa, Mycobacterium
IARPE

SEQ ID NO: 1164046 - protein, 6 aa, Mycobacterium
IARTEA

SEQ ID NO: 1164047 - protein, 15 aa, Mycobacterium
IASAGPIDLPTGTVS

SEQ ID NO: 1164048 - protein, 16 aa, Mycobacterium
IASAPKGEEAKRRGIA

SEQ ID NO: 1164049 - protein, 8 aa, Mycobacterium
IASDTAPL

SEQ ID NO: 1164050 - protein, 7 aa, Mycobacterium
IASEQAA

SEQ ID NO: 1164051 - protein, 9 aa, Mycobacterium
IASGTERRT

SEQ ID NO: 1164052 - protein, 4 aa, Mycobacterium
IASY

SEQ ID NO: 1164053 - protein, 6 aa, Mycobacterium
IATPTR

SEQ ID NO: 1164054 - protein, 9 aa, Mycobacterium
IATSGAPGV

SEQ ID NO: 1164055 - protein, 8 aa, Mycobacterium
IATTASRR

SEQ ID NO: 1164056 - protein, 8 aa, Mycobacterium
IATTGERI

SEQ ID NO: 1164057 - protein, 6 aa, Mycobacterium
IAVTEA

SEQ ID NO: 1164058 - protein, 5 aa, Mycobacterium
IDAAQ

SEQ ID NO: 1164059 - protein, 6 aa, Mycobacterium
IDAATA

SEQ ID NO: 1164060 - protein, 10 aa, Mycobacterium
IDAEDDVSAE

SEQ ID NO: 1164061 - protein, 11 aa, Mycobacterium
IDAEPADGAGE

SEQ ID NO: 1164062 - protein, 11 aa, Mycobacterium
IDAGAERDRAE

SEQ ID NO: 1164063 - protein, 8 aa, Mycobacterium
IDAGPTNN

SEQ ID NO: 1164064 - protein, 7 aa, Mycobacterium
IDAPDRA

SEQ ID NO: 1164065 - protein, 7 aa, Mycobacterium
IDAPPGS

SEQ ID NO: 1164066 - protein, 7 aa, Mycobacterium
IDARNEE

SEQ ID NO: 1164067 - protein, 9 aa, Mycobacterium
IDASASSQF

SEQ ID NO: 1164068 - protein, 9 aa, Mycobacterium
IDATNGRDL

SEQ ID NO: 1164069 - protein, 8 aa, Mycobacterium
IDDASGGH

SEQ ID NO: 1164070 - protein, 9 aa, Mycobacterium
IDDATLATY

SEQ ID NO: 1164071 - protein, 11 aa, Mycobacterium
IDDDGRVPPRT

SEQ ID NO: 1164072 - protein, 5 aa, Mycobacterium
IDDDP

SEQ ID NO: 1164073 - protein, 6 aa, Mycobacterium
IDDDRV

SEQ ID NO: 1164074 - protein, 5 aa, Mycobacterium
IDDPA

SEQ ID NO: 1164075 - protein, 5 aa, Mycobacterium
IDDPE

SEQ ID NO: 1164076 - protein, 13 aa, Mycobacterium
IDDSGKLTRKGAD

SEQ ID NO: 1164077 - protein, 6 aa, Mycobacterium
IDDSPV

SEQ ID NO: 1164078 - protein, 17 aa, Mycobacterium
IDEGAKPGKSTGESAEL

SEQ ID NO: 1164079 - protein, 6 aa, Mycobacterium
IDEGAT

SEQ ID NO: 1164080 - protein, 7 aa, Mycobacterium
IDEQPEA

SEQ ID NO: 1164081 - protein, 17 aa, Mycobacterium
IDESDKPQKEEQGPPPV

SEQ ID NO: 1164082 - protein, 6 aa, Mycobacterium
IDESGS

SEQ ID NO: 1164083 - protein, 38 aa, Mycobacterium
IDETAEGTQEPSTPELSDSESGNPEGSDSESDPDTFPR

SEQ ID NO: 1164084 - protein, 10 aa, Mycobacterium
IDETERRRAK

SEQ ID NO: 1164085 - protein, 17 aa, Mycobacterium
IDETGTHTAEFTTPTGA

SEQ ID NO: 1164086 - protein, 15 aa, Mycobacterium
IDGDGGGDTSQRAAT

SEQ ID NO: 1164087 - protein, 9 aa, Mycobacterium
IDGEKLSDD

SEQ ID NO: 1164088 - protein, 8 aa, Mycobacterium
IDGEKLTD

SEQ ID NO: 1164089 - protein, 6 aa, Mycobacterium
IDGEYS

SEQ ID NO: 1164090 - protein, 7 aa, Mycobacterium
IDGGEDL

SEQ ID NO: 1164091 - protein, 6 aa, Mycobacterium
IDGGPL

SEQ ID NO: 1164092 - protein, 9 aa, Mycobacterium
IDGPASRDV

SEQ ID NO: 1164093 - protein, 9 aa, Mycobacterium
IDGPKDSQV

SEQ ID NO: 1164094 - protein, 8 aa, Mycobacterium
IDGPTIGS

SEQ ID NO: 1164095 - protein, 8 aa, Mycobacterium
IDGSDDRM

SEQ ID NO: 1164096 - protein, 4 aa, Mycobacterium
IDGT

SEQ ID NO: 1164097 - protein, 6 aa, Mycobacterium
IDGYPE

SEQ ID NO: 1164098 - protein, 12 aa, Mycobacterium
IDKASQARPGQT

SEQ ID NO: 1164099 - protein, 14 aa, Mycobacterium
IDKEGADPQKIRGQ

SEQ ID NO: 1164100 - protein, 4 aa, Mycobacterium
IDKG

SEQ ID NO: 1164101 - protein, 9 aa, Mycobacterium
IDKTPQGTQ

SEQ ID NO: 1164102 - protein, 5 aa, Mycobacterium
IDKTS

SEQ ID NO: 1164103 - protein, 8 aa, Mycobacterium
IDLPGEVA

SEQ ID NO: 1164104 - protein, 10 aa, Mycobacterium
IDPAHTRSKL

SEQ ID NO: 1164105 - protein, 5 aa, Mycobacterium
IDPAQ

SEQ ID NO: 1164106 - protein, 6 aa, Mycobacterium
IDPDGP

SEQ ID NO: 1164107 - protein, 10 aa, Mycobacterium
IDPDLTNAGK

SEQ ID NO: 1164108 - protein, 6 aa, Mycobacterium
IDPDTA

SEQ ID NO: 1164109 - protein, 4 aa, Mycobacterium
IDPE

SEQ ID NO: 1164110 - protein, 14 aa, Mycobacterium
IDPGRTRHDETGIS

SEQ ID NO: 1164111 - protein, 4 aa, Mycobacterium
IDPL

SEQ ID NO: 1164112 - protein, 5 aa, Mycobacterium
IDPPN

SEQ ID NO: 1164113 - protein, 9 aa, Mycobacterium
IDPQEQIDS

SEQ ID NO: 1164114 - protein, 7 aa, Mycobacterium
IDPQPTV

SEQ ID NO: 1164115 - protein, 6 aa, Mycobacterium
IDPRDA

SEQ ID NO: 1164116 - protein, 9 aa, Mycobacterium
IDPSDGDAV

SEQ ID NO: 1164117 - protein, 9 aa, Mycobacterium
IDPSRRGET

SEQ ID NO: 1164118 - protein, 7 aa, Mycobacterium
IDQATEE

SEQ ID NO: 1164119 - protein, 9 aa, Mycobacterium
IDQPAESRV

SEQ ID NO: 1164120 - protein, 11 aa, Mycobacterium
IDRAPAPHDAA

SEQ ID NO: 1164121 - protein, 5 aa, Mycobacterium
IDRDG

SEQ ID NO: 1164122 - protein, 4 aa, Mycobacterium
IDSG

SEQ ID NO: 1164123 - protein, 17 aa, Mycobacterium
IDSGGNSGNEDAPAIAD

SEQ ID NO: 1164124 - protein, 7 aa, Mycobacterium
IDSQARS

SEQ ID NO: 1164125 - protein, 4 aa, Mycobacterium
IDST

SEQ ID NO: 1164126 - protein, 4 aa, Mycobacterium
IDTA

SEQ ID NO: 1164127 - protein, 9 aa, Mycobacterium
IDTEDGSLR

SEQ ID NO: 1164128 - protein, 11 aa, Mycobacterium
IDTERQREQDH

SEQ ID NO: 1164129 - protein, 6 aa, Mycobacterium
IDTGER

SEQ ID NO: 1164130 - protein, 9 aa, Mycobacterium
IDTQAGAKD

SEQ ID NO: 1164131 - protein, 6 aa, Mycobacterium
IDTQTA

SEQ ID NO: 1164132 - protein, 11 aa, Mycobacterium
IDTRSGGRQSP

SEQ ID NO: 1164133 - protein, 10 aa, Mycobacterium
IDTSAYPPMD

SEQ ID NO: 1164134 - protein, 7 aa, Mycobacterium
IDTSRSR

SEQ ID NO: 1164135 - protein, 7 aa, Mycobacterium
IDTTRSI

SEQ ID NO: 1164136 - protein, 6 aa, Mycobacterium
IDTVPT

SEQ ID NO: 1164137 - protein, 7 aa, Mycobacterium
IDYGPSG

SEQ ID NO: 1164138 - protein, 9 aa, Mycobacterium
IEAEPGGAH

SEQ ID NO: 1164139 - protein, 6 aa, Mycobacterium
IEAGDG

SEQ ID NO: 1164140 - protein, 8 aa, Mycobacterium
IEAGEASD

SEQ ID NO: 1164141 - protein, 7 aa, Mycobacterium
IEAGETA

SEQ ID NO: 1164142 - protein, 9 aa, Mycobacterium
IEATRDAQD

SEQ ID NO: 1164143 - protein, 16 aa, Mycobacterium
IECSTGSACTAGVAQP

SEQ ID NO: 1164144 - protein, 4 aa, Mycobacterium
IEDG

SEQ ID NO: 1164145 - protein, 7 aa, Mycobacterium
IEDGKTD

SEQ ID NO: 1164146 - protein, 4 aa, Mycobacterium
IEDP

SEQ ID NO: 1164147 - protein, 9 aa, Mycobacterium
IEDPSASPL

SEQ ID NO: 1164148 - protein, 7 aa, Mycobacterium
IEENGRL

SEQ ID NO: 1164149 - protein, 11 aa, Mycobacterium
IEGANGGYPRA

SEQ ID NO: 1164150 - protein, 7 aa, Mycobacterium
IEGNGDV

SEQ ID NO: 1164151 - protein, 4 aa, Mycobacterium
IEGR

SEQ ID NO: 1164152 - protein, 8 aa, Mycobacterium
IEKGAYPE

SEQ ID NO: 1164153 - protein, 17 aa, Mycobacterium
IEKRTTRPRPDATQEAT

SEQ ID NO: 1164154 - protein, 5 aa, Mycobacterium
IENDA

SEQ ID NO: 1164155 - protein, 6 aa, Mycobacterium
IENETG

SEQ ID NO: 1164156 - protein, 15 aa, Mycobacterium
IEPAPKRKPATRKRS

SEQ ID NO: 1164157 - protein, 9 aa, Mycobacterium
IEPDPRNGA

SEQ ID NO: 1164158 - protein, 4 aa, Mycobacterium
IEPE

SEQ ID NO: 1164159 - protein, 4 aa, Mycobacterium
IEPG

SEQ ID NO: 1164160 - protein, 6 aa, Mycobacterium
IEPGQV

SEQ ID NO: 1164161 - protein, 5 aa, Mycobacterium
IEPPR

SEQ ID NO: 1164162 - protein, 7 aa, Mycobacterium
IEPRSVS

SEQ ID NO: 1164163 - protein, 4 aa, Mycobacterium
IEQR

SEQ ID NO: 1164164 - protein, 10 aa, Mycobacterium
IEQTPRPRAE

SEQ ID NO: 1164165 - protein, 15 aa, Mycobacterium
IEQVGSPTEVYDTPA

SEQ ID NO: 1164166 - protein, 9 aa, Mycobacterium
IERAGGKGV

SEQ ID NO: 1164167 - protein, 9 aa, Mycobacterium
IEREDGRME

SEQ ID NO: 1164168 - protein, 8 aa, Mycobacterium
IESEREDL

SEQ ID NO: 1164169 - protein, 5 aa, Mycobacterium
IESGR

SEQ ID NO: 1164170 - protein, 12 aa, Mycobacterium
IESNNSPLPIPD

SEQ ID NO: 1164171 - protein, 7 aa, Mycobacterium
IESRDAR

SEQ ID NO: 1164172 - protein, 7 aa, Mycobacterium
IESTPDV

SEQ ID NO: 1164173 - protein, 6 aa, Mycobacterium
IESTPV

SEQ ID NO: 1164174 - protein, 5 aa, Mycobacterium
IETRY

SEQ ID NO: 1164175 - protein, 21 aa, Mycobacterium
IEVTDTADGPQWSLLDGDSKD

SEQ ID NO: 1164176 - protein, 24 aa, Mycobacterium
IFSTSGDRAVADAAERAKVTASRN

SEQ ID NO: 1164177 - protein, 8 aa, Mycobacterium
IGADEGLG

SEQ ID NO: 1164178 - protein, 5 aa, Mycobacterium
IGAED

SEQ ID NO: 1164179 - protein, 8 aa, Mycobacterium
IGAEDTVA

SEQ ID NO: 1164180 - protein, 10 aa, Mycobacterium
IGAEEAERSG

SEQ ID NO: 1164181 - protein, 7 aa, Mycobacterium
IGAEESE

SEQ ID NO: 1164182 - protein, 6 aa, Mycobacterium
IGAGAA

SEQ ID NO: 1164183 - protein, 8 aa, Mycobacterium
IGAGGFDD

SEQ ID NO: 1164184 - protein, 8 aa, Mycobacterium
IGAGGGSI

SEQ ID NO: 1164185 - protein, 6 aa, Mycobacterium
IGAPGA

SEQ ID NO: 1164186 - protein, 7 aa, Mycobacterium
IGAPGEA

SEQ ID NO: 1164187 - protein, 6 aa, Mycobacterium
IGASYG

SEQ ID NO: 1164188 - protein, 4 aa, Mycobacterium
IGDD

SEQ ID NO: 1164189 - protein, 6 aa, Mycobacterium
IGDGVA

SEQ ID NO: 1164190 - protein, 7 aa, Mycobacterium
IGDSAEH

SEQ ID NO: 1164191 - protein, 7 aa, Mycobacterium
IGEDADG

SEQ ID NO: 1164192 - protein, 6 aa, Mycobacterium
IGEDLD

SEQ ID NO: 1164193 - protein, 9 aa, Mycobacterium
IGEDSSSAS

SEQ ID NO: 1164194 - protein, 7 aa, Mycobacterium
IGEEAGD

SEQ ID NO: 1164195 - protein, 4 aa, Mycobacterium
IGEG

SEQ ID NO: 1164196 - protein, 5 aa, Mycobacterium
IGEIR

SEQ ID NO: 1164197 - protein, 6 aa, Mycobacterium
IGEPGG

SEQ ID NO: 1164198 - protein, 4 aa, Mycobacterium
IGES

SEQ ID NO: 1164199 - protein, 6 aa, Mycobacterium
IGGDDA

SEQ ID NO: 1164200 - protein, 10 aa, Mycobacterium
IGGDDADQLR

SEQ ID NO: 1164201 - protein, 10 aa, Mycobacterium
IGGEPLPGEV

SEQ ID NO: 1164202 - protein, 5 aa, Mycobacterium
IGGGF

SEQ ID NO: 1164203 - protein, 12 aa, Mycobacterium
IGGGSGAPTGFS

SEQ ID NO: 1164204 - protein, 8 aa, Mycobacterium
IGGGTDQI

SEQ ID NO: 1164205 - protein, 8 aa, Mycobacterium
IGGNGPQK

SEQ ID NO: 1164206 - protein, 7 aa, Mycobacterium
IGGPAQV

SEQ ID NO: 1164207 - protein, 5 aa, Mycobacterium
IGGPL

SEQ ID NO: 1164208 - protein, 8 aa, Mycobacterium
IGGPPEQV

SEQ ID NO: 1164209 - protein, 6 aa, Mycobacterium
IGGQES

SEQ ID NO: 1164210 - protein, 10 aa, Mycobacterium
IGGSGEQYSG

SEQ ID NO: 1164211 - protein, 6 aa, Mycobacterium
IGGSSS

SEQ ID NO: 1164212 - protein, 10 aa, Mycobacterium
IGGSTDESGV

SEQ ID NO: 1164213 - protein, 5 aa, Mycobacterium
IGGTG

SEQ ID NO: 1164214 - protein, 8 aa, Mycobacterium
IGGTPEGI

SEQ ID NO: 1164215 - protein, 6 aa, Mycobacterium
IGKDKP

SEQ ID NO: 1164216 - protein, 4 aa, Mycobacterium
IGKG

SEQ ID NO: 1164217 - protein, 6 aa, Mycobacterium
IGKNGD

SEQ ID NO: 1164218 - protein, 9 aa, Mycobacterium
IGLGGDPRR

SEQ ID NO: 1164219 - protein, 6 aa, Mycobacterium
IGLPDE

SEQ ID NO: 1164220 - protein, 12 aa, Mycobacterium
IGNDLSTPRPEY

SEQ ID NO: 1164221 - protein, 21 aa, Mycobacterium
IGNRNSKADTSSGRRNKYRTP

SEQ ID NO: 1164222 - protein, 7 aa, Mycobacterium
IGNTTAA

SEQ ID NO: 1164223 - protein, 5 aa, Mycobacterium
IGPAS

SEQ ID NO: 1164224 - protein, 95 aa, Mycobacterium
IGPDGVATTTVSQPPPPPPTTTQQTTTTTQPTTTTTTTTQQTTTTTQPTTTTTRPTTTQPPTTTQPPPTTTAAPPPTTVDPPDPPVTTVPVPDDG

SEQ ID NO: 1164225 - protein, 6 aa, Mycobacterium
IGPDSD

SEQ ID NO: 1164226 - protein, 9 aa, Mycobacterium
IGPDSPVRS

SEQ ID NO: 1164227 - protein, 9 aa, Mycobacterium
IGPDTEPGF

SEQ ID NO: 1164228 - protein, 23 aa, Mycobacterium
IGPDTPPANGRSAYAKTKGYADR

SEQ ID NO: 1164229 - protein, 4 aa, Mycobacterium
IGPE

SEQ ID NO: 1164230 - protein, 5 aa, Mycobacterium
IGPED

SEQ ID NO: 1164231 - protein, 5 aa, Mycobacterium
IGPEG

SEQ ID NO: 1164232 - protein, 16 aa, Mycobacterium
IGPEQAAAEASEAADD

SEQ ID NO: 1164233 - protein, 5 aa, Mycobacterium
IGPGD

SEQ ID NO: 1164234 - protein, 5 aa, Mycobacterium
IGPGE

SEQ ID NO: 1164235 - protein, 10 aa, Mycobacterium
IGPGGSDLEV

SEQ ID NO: 1164236 - protein, 7 aa, Mycobacterium
IGPGKGI

SEQ ID NO: 1164237 - protein, 7 aa, Mycobacterium
IGPGSSI

SEQ ID NO: 1164238 - protein, 8 aa, Mycobacterium
IGPHDADE

SEQ ID NO: 1164239 - protein, 13 aa, Mycobacterium
IGPMTSARTGIPT

SEQ ID NO: 1164240 - protein, 5 aa, Mycobacterium
IGPNT

SEQ ID NO: 1164241 - protein, 16 aa, Mycobacterium
IGPPDVPGTVAPSEVK

SEQ ID NO: 1164242 - protein, 5 aa, Mycobacterium
IGPRE

SEQ ID NO: 1164243 - protein, 4 aa, Mycobacterium
IGPS

SEQ ID NO: 1164244 - protein, 7 aa, Mycobacterium
IGPSDRS

SEQ ID NO: 1164245 - protein, 11 aa, Mycobacterium
IGPSGSGKSTL

SEQ ID NO: 1164246 - protein, 8 aa, Mycobacterium
IGPSTRAA

SEQ ID NO: 1164247 - protein, 4 aa, Mycobacterium
IGPT

SEQ ID NO: 1164248 - protein, 9 aa, Mycobacterium
IGPTDREAA

SEQ ID NO: 1164249 - protein, 5 aa, Mycobacterium
IGPTP

SEQ ID NO: 1164250 - protein, 7 aa, Mycobacterium
IGPTPAA

SEQ ID NO: 1164251 - protein, 23 aa, Mycobacterium
IGPTTRTASISPDVNDPGARNVS

SEQ ID NO: 1164252 - protein, 13 aa, Mycobacterium
IGPVTTGAGVTAV

SEQ ID NO: 1164253 - protein, 10 aa, Mycobacterium
IGQGGTGTSA

SEQ ID NO: 1164254 - protein, 8 aa, Mycobacterium
IGQNKAGQ

SEQ ID NO: 1164255 - protein, 11 aa, Mycobacterium
IGQPKAGATTA

SEQ ID NO: 1164256 - protein, 9 aa, Mycobacterium
IGQRGQDTS

SEQ ID NO: 1164257 - protein, 7 aa, Mycobacterium
IGRDPKE

SEQ ID NO: 1164258 - protein, 17 aa, Mycobacterium
IGRGSPQGLAASKALTT

SEQ ID NO: 1164259 - protein, 6 aa, Mycobacterium
IGRNER

SEQ ID NO: 1164260 - protein, 16 aa, Mycobacterium
IGRPARQRTTTYAPLA

SEQ ID NO: 1164261 - protein, 7 aa, Mycobacterium
IGRPGGG

SEQ ID NO: 1164262 - protein, 7 aa, Mycobacterium
IGRPPGH

SEQ ID NO: 1164263 - protein, 18 aa, Mycobacterium
IGRPPKDLANPTDEEQQT

SEQ ID NO: 1164264 - protein, 9 aa, Mycobacterium
IGRSGEREG

SEQ ID NO: 1164265 - protein, 7 aa, Mycobacterium
IGRSGRH

SEQ ID NO: 1164266 - protein, 5 aa, Mycobacterium
IGRSR

SEQ ID NO: 1164267 - protein, 7 aa, Mycobacterium
IGRTTAP

SEQ ID NO: 1164268 - protein, 16 aa, Mycobacterium
IGSARSYGAQQRRAEE

SEQ ID NO: 1164269 - protein, 4 aa, Mycobacterium
IGSG

SEQ ID NO: 1164270 - protein, 6 aa, Mycobacterium
IGSHQG

SEQ ID NO: 1164271 - protein, 8 aa, Mycobacterium
IGSPGEVS

SEQ ID NO: 1164272 - protein, 4 aa, Mycobacterium
IGTD

SEQ ID NO: 1164273 - protein, 10 aa, Mycobacterium
IGTDLSESQV

SEQ ID NO: 1164274 - protein, 10 aa, Mycobacterium
IGTGKHGGYA

SEQ ID NO: 1164275 - protein, 10 aa, Mycobacterium
IGTGQTGATY

SEQ ID NO: 1164276 - protein, 28 aa, Mycobacterium
IGTSGAEIGGAFGGEKQTGGGRESGSDA

SEQ ID NO: 1164277 - protein, 6 aa, Mycobacterium
IGTSPF

SEQ ID NO: 1164278 - protein, 7 aa, Mycobacterium
IHGTPGP

SEQ ID NO: 1164279 - protein, 9 aa, Mycobacterium
IHKTPSRTE

SEQ ID NO: 1164280 - protein, 14 aa, Mycobacterium
IHPPTGAQGMNTGI

SEQ ID NO: 1164281 - protein, 5 aa, Mycobacterium
IHPTG

SEQ ID NO: 1164282 - protein, 4 aa, Mycobacterium
IHRG

SEQ ID NO: 1164283 - protein, 24 aa, Mycobacterium
IHTSGTQYGSTDEDQAGTLASSMN

SEQ ID NO: 1164284 - protein, 7 aa, Mycobacterium
IKAGERA

SEQ ID NO: 1164285 - protein, 8 aa, Mycobacterium
IKAKDPQA

SEQ ID NO: 1164286 - protein, 5 aa, Mycobacterium
IKASD

SEQ ID NO: 1164287 - protein, 6 aa, Mycobacterium
IKASGA

SEQ ID NO: 1164288 - protein, 4 aa, Mycobacterium
IKDA

SEQ ID NO: 1164289 - protein, 12 aa, Mycobacterium
IKDEGDRQPPSY

SEQ ID NO: 1164290 - protein, 4 aa, Mycobacterium
IKEG

SEQ ID NO: 1164291 - protein, 5 aa, Mycobacterium
IKEGE

SEQ ID NO: 1164292 - protein, 7 aa, Mycobacterium
IKEPREN

SEQ ID NO: 1164293 - protein, 6 aa, Mycobacterium
IKGQVP

SEQ ID NO: 1164294 - protein, 18 aa, Mycobacterium
IKGSGEEPTPGSGAPLAP

SEQ ID NO: 1164295 - protein, 6 aa, Mycobacterium
IKKGEQ

SEQ ID NO: 1164296 - protein, 6 aa, Mycobacterium
IKPGDT

SEQ ID NO: 1164297 - protein, 12 aa, Mycobacterium
IKPQARTLANDR

SEQ ID NO: 1164298 - protein, 13 aa, Mycobacterium
IKPSIADPSGSGV

SEQ ID NO: 1164299 - protein, 7 aa, Mycobacterium
IKQPADD

SEQ ID NO: 1164300 - protein, 5 aa, Mycobacterium
IKRRT

SEQ ID NO: 1164301 - protein, 11 aa, Mycobacterium
IKRSADPGAVG

SEQ ID NO: 1164302 - protein, 7 aa, Mycobacterium
IKSRNQK

SEQ ID NO: 1164303 - protein, 7 aa, Mycobacterium
ILPTDGR

SEQ ID NO: 1164304 - protein, 4 aa, Mycobacterium
INAG

SEQ ID NO: 1164305 - protein, 4 aa, Mycobacterium
INDG

SEQ ID NO: 1164306 - protein, 7 aa, Mycobacterium
INGAGGV

SEQ ID NO: 1164307 - protein, 8 aa, Mycobacterium
INGERPTA

SEQ ID NO: 1164308 - protein, 14 aa, Mycobacterium
INGGGSRPDGIAKQ

SEQ ID NO: 1164309 - protein, 4 aa, Mycobacterium
INPA

SEQ ID NO: 1164310 - protein, 7 aa, Mycobacterium
INPGGGL

SEQ ID NO: 1164311 - protein, 10 aa, Mycobacterium
INPGQSPEEL

SEQ ID NO: 1164312 - protein, 6 aa, Mycobacterium
INSPID

SEQ ID NO: 1164313 - protein, 9 aa, Mycobacterium
INTHGGQLG

SEQ ID NO: 1164314 - protein, 4 aa, Mycobacterium
IPAA

SEQ ID NO: 1164315 - protein, 7 aa, Mycobacterium
IPADPDG

SEQ ID NO: 1164316 - protein, 10 aa, Mycobacterium
IPAGGAEPSF

SEQ ID NO: 1164317 - protein, 7 aa, Mycobacterium
IPAGRTD

SEQ ID NO: 1164318 - protein, 10 aa, Mycobacterium
IPANRPGRAI

SEQ ID NO: 1164319 - protein, 6 aa, Mycobacterium
IPAPGD

SEQ ID NO: 1164320 - protein, 8 aa, Mycobacterium
IPAPGDPY

SEQ ID NO: 1164321 - protein, 6 aa, Mycobacterium
IPAPPT

SEQ ID NO: 1164322 - protein, 11 aa, Mycobacterium
IPAQNLRGTQT

SEQ ID NO: 1164323 - protein, 5 aa, Mycobacterium
IPAST

SEQ ID NO: 1164324 - protein, 14 aa, Mycobacterium
IPATQKALKKSGLS

SEQ ID NO: 1164325 - protein, 4 aa, Mycobacterium
IPDA

SEQ ID NO: 1164326 - protein, 10 aa, Mycobacterium
IPDDTVAPQE

SEQ ID NO: 1164327 - protein, 16 aa, Mycobacterium
IPDPPERAGVTDPDTM

SEQ ID NO: 1164328 - protein, 7 aa, Mycobacterium
IPDPQTT

SEQ ID NO: 1164329 - protein, 19 aa, Mycobacterium
IPDPRERPADREDAARQKH

SEQ ID NO: 1164330 - protein, 12 aa, Mycobacterium
IPDQDDPASFGP

SEQ ID NO: 1164331 - protein, 6 aa, Mycobacterium
IPDTES

SEQ ID NO: 1164332 - protein, 8 aa, Mycobacterium
IPEDATPA

SEQ ID NO: 1164333 - protein, 4 aa, Mycobacterium
IPEG

SEQ ID NO: 1164334 - protein, 9 aa, Mycobacterium
IPEKHGPVA

SEQ ID NO: 1164335 - protein, 6 aa, Mycobacterium
IPEPAR

SEQ ID NO: 1164336 - protein, 6 aa, Mycobacterium
IPEPGN

SEQ ID NO: 1164337 - protein, 11 aa, Mycobacterium
IPERPGNKRVD

SEQ ID NO: 1164338 - protein, 7 aa, Mycobacterium
IPESAEN

SEQ ID NO: 1164339 - protein, 5 aa, Mycobacterium
IPESR

SEQ ID NO: 1164340 - protein, 5 aa, Mycobacterium
IPGAD

SEQ ID NO: 1164341 - protein, 10 aa, Mycobacterium
IPGAENVPST

SEQ ID NO: 1164342 - protein, 10 aa, Mycobacterium
IPGGPPGTKG

SEQ ID NO: 1164343 - protein, 5 aa, Mycobacterium
IPGKA

SEQ ID NO: 1164344 - protein, 4 aa, Mycobacterium
IPGQ

SEQ ID NO: 1164345 - protein, 4 aa, Mycobacterium
IPGR

SEQ ID NO: 1164346 - protein, 4 aa, Mycobacterium
IPGT

SEQ ID NO: 1164347 - protein, 6 aa, Mycobacterium
IPKPTV

SEQ ID NO: 1164348 - protein, 4 aa, Mycobacterium
IPNQ

SEQ ID NO: 1164349 - protein, 6 aa, Mycobacterium
IPPAAR

SEQ ID NO: 1164350 - protein, 6 aa, Mycobacterium
IPPDKD

SEQ ID NO: 1164351 - protein, 7 aa, Mycobacterium
IPPDSAA

SEQ ID NO: 1164352 - protein, 6 aa, Mycobacterium
IPPGDG

SEQ ID NO: 1164353 - protein, 6 aa, Mycobacterium
IPPGEL

SEQ ID NO: 1164354 - protein, 4 aa, Mycobacterium
IPPH

SEQ ID NO: 1164355 - protein, 6 aa, Mycobacterium
IPPTAG

SEQ ID NO: 1164356 - protein, 5 aa, Mycobacterium
IPPTE

SEQ ID NO: 1164357 - protein, 5 aa, Mycobacterium
IPPTR

SEQ ID NO: 1164358 - protein, 6 aa, Mycobacterium
IPQPET

SEQ ID NO: 1164359 - protein, 21 aa, Mycobacterium
IPQQGPSTQPAVPAGAGVAGG

SEQ ID NO: 1164360 - protein, 6 aa, Mycobacterium
IPQRDD

SEQ ID NO: 1164361 - protein, 6 aa, Mycobacterium
IPQTDS

SEQ ID NO: 1164362 - protein, 9 aa, Mycobacterium
IPRARTPDV

SEQ ID NO: 1164363 - protein, 14 aa, Mycobacterium
IPRATDSVGAPRIR

SEQ ID NO: 1164364 - protein, 9 aa, Mycobacterium
IPRGEEAGK

SEQ ID NO: 1164365 - protein, 11 aa, Mycobacterium
IPRTTSGKLAR

SEQ ID NO: 1164366 - protein, 4 aa, Mycobacterium
IPSA

SEQ ID NO: 1164367 - protein, 5 aa, Mycobacterium
IPSGA

SEQ ID NO: 1164368 - protein, 5 aa, Mycobacterium
IPSPH

SEQ ID NO: 1164369 - protein, 8 aa, Mycobacterium
IPSPSGRH

SEQ ID NO: 1164370 - protein, 7 aa, Mycobacterium
IPTEGTA

SEQ ID NO: 1164371 - protein, 4 aa, Mycobacterium
IPTG

SEQ ID NO: 1164372 - protein, 13 aa, Mycobacterium
IPTPDGVDDASAA

SEQ ID NO: 1164373 - protein, 14 aa, Mycobacterium
IPTPVYGLQEVHHL

SEQ ID NO: 1164374 - protein, 5 aa, Mycobacterium
IPTRH

SEQ ID NO: 1164375 - protein, 7 aa, Mycobacterium
IPTSRQG

SEQ ID NO: 1164376 - protein, 4 aa, Mycobacterium
IPVD

SEQ ID NO: 1164377 - protein, 6 aa, Mycobacterium
IPVPPE

SEQ ID NO: 1164378 - protein, 9 aa, Mycobacterium
IPVTETPGA

SEQ ID NO: 1164379 - protein, 6 aa, Mycobacterium
IQATPE

SEQ ID NO: 1164380 - protein, 7 aa, Mycobacterium
IQGGTYD

SEQ ID NO: 1164381 - protein, 10 aa, Mycobacterium
IQGSTKNAER

SEQ ID NO: 1164382 - protein, 10 aa, Mycobacterium
IQPGRRPRGP

SEQ ID NO: 1164383 - protein, 9 aa, Mycobacterium
IQRPEEVAA

SEQ ID NO: 1164384 - protein, 6 aa, Mycobacterium
IRAAGA

SEQ ID NO: 1164385 - protein, 11 aa, Mycobacterium
IRADGGKADSC

SEQ ID NO: 1164386 - protein, 38 aa, Mycobacterium
IRAEGTAESTERTPGDSTPEAPPAATSPAIDNALPEDR

SEQ ID NO: 1164387 - protein, 12 aa, Mycobacterium
IRAERAQHPDLG

SEQ ID NO: 1164388 - protein, 6 aa, Mycobacterium
IRAGAD

SEQ ID NO: 1164389 - protein, 17 aa, Mycobacterium
IRAGASVEQVANASGMP

SEQ ID NO: 1164390 - protein, 22 aa, Mycobacterium
IRDAGGRASTLGADISDEAEAA

SEQ ID NO: 1164391 - protein, 10 aa, Mycobacterium
IRDRTGVETR

SEQ ID NO: 1164392 - protein, 15 aa, Mycobacterium
IRDTQRSGRRRTEVP

SEQ ID NO: 1164393 - protein, 8 aa, Mycobacterium
IREDTAGY

SEQ ID NO: 1164394 - protein, 13 aa, Mycobacterium
IRESDEPASPASV

SEQ ID NO: 1164395 - protein, 6 aa, Mycobacterium
IRGEMA

SEQ ID NO: 1164396 - protein, 10 aa, Mycobacterium
IRGESENLAP

SEQ ID NO: 1164397 - protein, 9 aa, Mycobacterium
IRGKDKDLG

SEQ ID NO: 1164398 - protein, 5 aa, Mycobacterium
IRGSG

SEQ ID NO: 1164399 - protein, 10 aa, Mycobacterium
IRGTGGAALR

SEQ ID NO: 1164400 - protein, 5 aa, Mycobacterium
IRKGQ

SEQ ID NO: 1164401 - protein, 12 aa, Mycobacterium
IRNRQEDGSDLD

SEQ ID NO: 1164402 - protein, 16 aa, Mycobacterium
IRPGDDGTTVHLEAGI

SEQ ID NO: 1164403 - protein, 7 aa, Mycobacterium
IRPPQRL

SEQ ID NO: 1164404 - protein, 4 aa, Mycobacterium
IRRG

SEQ ID NO: 1164405 - protein, 6 aa, Mycobacterium
IRSDSD

SEQ ID NO: 1164406 - protein, 9 aa, Mycobacterium
IRSGDRSAL

SEQ ID NO: 1164407 - protein, 5 aa, Mycobacterium
IRSGE

SEQ ID NO: 1164408 - protein, 6 aa, Mycobacterium
IRSGSD

SEQ ID NO: 1164409 - protein, 4 aa, Mycobacterium
IRTD

SEQ ID NO: 1164410 - protein, 6 aa, Mycobacterium
IRTGAD

SEQ ID NO: 1164411 - protein, 5 aa, Mycobacterium
IRTGT

SEQ ID NO: 1164412 - protein, 8 aa, Mycobacterium
ISAETSPT

SEQ ID NO: 1164413 - protein, 9 aa, Mycobacterium
ISAKQNPDA

SEQ ID NO: 1164414 - protein, 5 aa, Mycobacterium
ISANG

SEQ ID NO: 1164415 - protein, 14 aa, Mycobacterium
ISATAEDDAADVKG

SEQ ID NO: 1164416 - protein, 10 aa, Mycobacterium
ISDGQLKRGD

SEQ ID NO: 1164417 - protein, 17 aa, Mycobacterium
ISDNKQRAKVATGFGKP

SEQ ID NO: 1164418 - protein, 10 aa, Mycobacterium
ISEPKTTRVG

SEQ ID NO: 1164419 - protein, 5 aa, Mycobacterium
ISEQK

SEQ ID NO: 1164420 - protein, 24 aa, Mycobacterium
ISERERAQSRSSRLQRRAAANDAL

SEQ ID NO: 1164421 - protein, 39 aa, Mycobacterium
ISETAQAAGVPDDDIAGAEAERPISAESAAAIEALIGVL

SEQ ID NO: 1164422 - protein, 11 aa, Mycobacterium
ISGDDPDTVTT

SEQ ID NO: 1164423 - protein, 8 aa, Mycobacterium
ISGGAPLG

SEQ ID NO: 1164424 - protein, 25 aa, Mycobacterium
ISGGEEGALNGPSIMPGGPAESYES

SEQ ID NO: 1164425 - protein, 8 aa, Mycobacterium
ISGGGGIK

SEQ ID NO: 1164426 - protein, 6 aa, Mycobacterium
ISGGRS

SEQ ID NO: 1164427 - protein, 9 aa, Mycobacterium
ISGSGKSSL

SEQ ID NO: 1164428 - protein, 8 aa, Mycobacterium
ISKASGIR

SEQ ID NO: 1164429 - protein, 6 aa, Mycobacterium
ISLGDG

SEQ ID NO: 1164430 - protein, 7 aa, Mycobacterium
ISNSTDI

SEQ ID NO: 1164431 - protein, 10 aa, Mycobacterium
ISPAPPEGFQ

SEQ ID NO: 1164432 - protein, 12 aa, Mycobacterium
ISPASGTRQTVY

SEQ ID NO: 1164433 - protein, 5 aa, Mycobacterium
ISPDA

SEQ ID NO: 1164434 - protein, 10 aa, Mycobacterium
ISPDKPAKLA

SEQ ID NO: 1164435 - protein, 6 aa, Mycobacterium
ISPDTA

SEQ ID NO: 1164436 - protein, 18 aa, Mycobacterium
ISPEAYPGAVAQAGRDIP

SEQ ID NO: 1164437 - protein, 6 aa, Mycobacterium
ISPEPT

SEQ ID NO: 1164438 - protein, 15 aa, Mycobacterium
ISPGNGAGDVREDEP

SEQ ID NO: 1164439 - protein, 17 aa, Mycobacterium
ISPMPDNAEVAFPESAK

SEQ ID NO: 1164440 - protein, 6 aa, Mycobacterium
ISPPNG

SEQ ID NO: 1164441 - protein, 9 aa, Mycobacterium
ISPPSPPLM

SEQ ID NO: 1164442 - protein, 7 aa, Mycobacterium
ISPPTVT

SEQ ID NO: 1164443 - protein, 8 aa, Mycobacterium
ISPQQQVN

SEQ ID NO: 1164444 - protein, 13 aa, Mycobacterium
ISPRKVNKPVTGQ

SEQ ID NO: 1164445 - protein, 4 aa, Mycobacterium
ISPS

SEQ ID NO: 1164446 - protein, 7 aa, Mycobacterium
ISQYTRG

SEQ ID NO: 1164447 - protein, 8 aa, Mycobacterium
ISREPAPA

SEQ ID NO: 1164448 - protein, 5 aa, Mycobacterium
ISRGS

SEQ ID NO: 1164449 - protein, 16 aa, Mycobacterium
ISRGTGPVAELPGRAA

SEQ ID NO: 1164450 - protein, 11 aa, Mycobacterium
ISSAADHTPFR

SEQ ID NO: 1164451 - protein, 7 aa, Mycobacterium
ISSANGR

SEQ ID NO: 1164452 - protein, 8 aa, Mycobacterium
ISTAGARA

SEQ ID NO: 1164453 - protein, 5 aa, Mycobacterium
ISTDG

SEQ ID NO: 1164454 - protein, 14 aa, Mycobacterium
ISTEDYDESAADDP

SEQ ID NO: 1164455 - protein, 7 aa, Mycobacterium
ISTEEAK

SEQ ID NO: 1164456 - protein, 6 aa, Mycobacterium
ISTEQF

SEQ ID NO: 1164457 - protein, 11 aa, Mycobacterium
ISTGPAPSAPQ

SEQ ID NO: 1164458 - protein, 7 aa, Mycobacterium
ISTPGLV

SEQ ID NO: 1164459 - protein, 7 aa, Mycobacterium
ISTPLQA

SEQ ID NO: 1164460 - protein, 14 aa, Mycobacterium
ISYSGGPDSDGIKV

SEQ ID NO: 1164461 - protein, 10 aa, Mycobacterium
ITAAGRDRST

SEQ ID NO: 1164462 - protein, 9 aa, Mycobacterium
ITADTPDPV

SEQ ID NO: 1164463 - protein, 11 aa, Mycobacterium
ITAEGTPLPEA

SEQ ID NO: 1164464 - protein, 6 aa, Mycobacterium
ITAESA

SEQ ID NO: 1164465 - protein, 4 aa, Mycobacterium
ITAG

SEQ ID NO: 1164466 - protein, 8 aa, Mycobacterium
ITANGNEA

SEQ ID NO: 1164467 - protein, 4 aa, Mycobacterium
ITAP

SEQ ID NO: 1164468 - protein, 5 aa, Mycobacterium
ITAPQ

SEQ ID NO: 1164469 - protein, 10 aa, Mycobacterium
ITASEEPSRL

SEQ ID NO: 1164470 - protein, 9 aa, Mycobacterium
ITDAEGNEV

SEQ ID NO: 1164471 - protein, 11 aa, Mycobacterium
ITDEGGRQPVS

SEQ ID NO: 1164472 - protein, 10 aa, Mycobacterium
ITDEREAAAR

SEQ ID NO: 1164473 - protein, 15 aa, Mycobacterium
ITEEYPEKPGPVAPR

SEQ ID NO: 1164474 - protein, 8 aa, Mycobacterium
ITEPADAV

SEQ ID NO: 1164475 - protein, 11 aa, Mycobacterium
ITETRSVAGGG

SEQ ID NO: 1164476 - protein, 4 aa, Mycobacterium
ITEV

SEQ ID NO: 1164477 - protein, 10 aa, Mycobacterium
ITGDSAAGIA

SEQ ID NO: 1164478 - protein, 8 aa, Mycobacterium
ITGEGSPA

SEQ ID NO: 1164479 - protein, 21 aa, Mycobacterium
ITGGQDRDASPEDSPLPPRAQ

SEQ ID NO: 1164480 - protein, 10 aa, Mycobacterium
ITGPTAPSWR

SEQ ID NO: 1164481 - protein, 9 aa, Mycobacterium
ITGPVTGYP

SEQ ID NO: 1164482 - protein, 9 aa, Mycobacterium
ITGSTADAT

SEQ ID NO: 1164483 - protein, 5 aa, Mycobacterium
ITKNP

SEQ ID NO: 1164484 - protein, 8 aa, Mycobacterium
ITNGGKSS

SEQ ID NO: 1164485 - protein, 5 aa, Mycobacterium
ITNGQ

SEQ ID NO: 1164486 - protein, 13 aa, Mycobacterium
ITNNTAEDRTTFS

SEQ ID NO: 1164487 - protein, 4 aa, Mycobacterium
ITPD

SEQ ID NO: 1164488 - protein, 5 aa, Mycobacterium
ITPDG

SEQ ID NO: 1164489 - protein, 10 aa, Mycobacterium
ITPDHRPGIP

SEQ ID NO: 1164490 - protein, 11 aa, Mycobacterium
ITPDRIRGSQT

SEQ ID NO: 1164491 - protein, 12 aa, Mycobacterium
ITPEDAAATRIT

SEQ ID NO: 1164492 - protein, 13 aa, Mycobacterium
ITPGNVASPGADA

SEQ ID NO: 1164493 - protein, 10 aa, Mycobacterium
ITPPSNRGFD

SEQ ID NO: 1164494 - protein, 4 aa, Mycobacterium
ITPQ

SEQ ID NO: 1164495 - protein, 10 aa, Mycobacterium
ITPSAKAGGG

SEQ ID NO: 1164496 - protein, 12 aa, Mycobacterium
ITPSPTGGTRPP

SEQ ID NO: 1164497 - protein, 24 aa, Mycobacterium
ITQGGGRAVASYDSVDSPEGGQSI

SEQ ID NO: 1164498 - protein, 10 aa, Mycobacterium
ITQPEGPSFT

SEQ ID NO: 1164499 - protein, 8 aa, Mycobacterium
ITRGDAEA

SEQ ID NO: 1164500 - protein, 6 aa, Mycobacterium
ITRGPD

SEQ ID NO: 1164501 - protein, 5 aa, Mycobacterium
ITRQP

SEQ ID NO: 1164502 - protein, 6 aa, Mycobacterium
ITRSTL

SEQ ID NO: 1164503 - protein, 21 aa, Mycobacterium
ITSETEAAGRKVKASKDEPQY

SEQ ID NO: 1164504 - protein, 5 aa, Mycobacterium
ITSGE

SEQ ID NO: 1164505 - protein, 8 aa, Mycobacterium
ITSPADPA

SEQ ID NO: 1164506 - protein, 10 aa, Mycobacterium
ITSPRKHGMD

SEQ ID NO: 1164507 - protein, 20 aa, Mycobacterium
ITSSGTGGSASEADVRAAMA

SEQ ID NO: 1164508 - protein, 10 aa, Mycobacterium
ITSTRGRSIT

SEQ ID NO: 1164509 - protein, 4 aa, Mycobacterium
ITSV

SEQ ID NO: 1164510 - protein, 7 aa, Mycobacterium
ITTEAKT

SEQ ID NO: 1164511 - protein, 8 aa, Mycobacterium
ITTEGGQA

SEQ ID NO: 1164512 - protein, 16 aa, Mycobacterium
ITTGKQPEALRAVDPL

SEQ ID NO: 1164513 - protein, 8 aa, Mycobacterium
ITTPGPGQ

SEQ ID NO: 1164514 - protein, 13 aa, Mycobacterium
ITTRAEPRDDGTY

SEQ ID NO: 1164515 - protein, 13 aa, Mycobacterium
IVPPTGSGTRGAL

SEQ ID NO: 1164516 - protein, 5 aa, Mycobacterium
IVRSE

SEQ ID NO: 1164517 - protein, 28 aa, Mycobacterium
IYPGPDGVVRSTNRAGGLEGGMTNGQPL

SEQ ID NO: 1164518 - protein, 9 aa, Mycobacterium
IYSQPSEDL

SEQ ID NO: 1164519 - protein, 4 aa, Mycobacterium
KAAA

SEQ ID NO: 1164520 - protein, 5 aa, Mycobacterium
KAAAA

SEQ ID NO: 1164521 - protein, 7 aa, Mycobacterium
KAAAAAR

SEQ ID NO: 1164522 - protein, 9 aa, Mycobacterium
KAAAAGGDA

SEQ ID NO: 1164523 - protein, 8 aa, Mycobacterium
KAAAESAG

SEQ ID NO: 1164524 - protein, 7 aa, Mycobacterium
KAAAGEC

SEQ ID NO: 1164525 - protein, 12 aa, Mycobacterium
KAAAGKAALTAA

SEQ ID NO: 1164526 - protein, 8 aa, Mycobacterium
KAAAHQAY

SEQ ID NO: 1164527 - protein, 8 aa, Mycobacterium
KAAAPRVK

SEQ ID NO: 1164528 - protein, 8 aa, Mycobacterium
KAAATAPY

SEQ ID NO: 1164529 - protein, 4 aa, Mycobacterium
KAAC

SEQ ID NO: 1164530 - protein, 8 aa, Mycobacterium
KAADAGRP

SEQ ID NO: 1164531 - protein, 6 aa, Mycobacterium
KAADRA

SEQ ID NO: 1164532 - protein, 8 aa, Mycobacterium
KAADRTGA

SEQ ID NO: 1164533 - protein, 8 aa, Mycobacterium
KAADVPAA

SEQ ID NO: 1164534 - protein, 14 aa, Mycobacterium
KAAEAAQADADRTF

SEQ ID NO: 1164535 - protein, 18 aa, Mycobacterium
KAAEDGIAVSPTGSAART

SEQ ID NO: 1164536 - protein, 6 aa, Mycobacterium
KAAGAA

SEQ ID NO: 1164537 - protein, 8 aa, Mycobacterium
KAAGYSKG

SEQ ID NO: 1164538 - protein, 5 aa, Mycobacterium
KAAIT

SEQ ID NO: 1164539 - protein, 8 aa, Mycobacterium
KAAKGLAK

SEQ ID NO: 1164540 - protein, 15 aa, Mycobacterium
KAANEDGTFKSDEDL

SEQ ID NO: 1164541 - protein, 12 aa, Mycobacterium
KAARDNGQFRTR

SEQ ID NO: 1164542 - protein, 12 aa, Mycobacterium
KAARRSGLHADG

SEQ ID NO: 1164543 - protein, 5 aa, Mycobacterium
KAASV

SEQ ID NO: 1164544 - protein, 15 aa, Mycobacterium
KAATEAGAEAASQVG

SEQ ID NO: 1164545 - protein, 6 aa, Mycobacterium
KAATED

SEQ ID NO: 1164546 - protein, 8 aa, Mycobacterium
KAATRGGY

SEQ ID NO: 1164547 - protein, 12 aa, Mycobacterium
KAAWNNDQTAIP

SEQ ID NO: 1164548 - protein, 5 aa, Mycobacterium
KADAD

SEQ ID NO: 1164549 - protein, 13 aa, Mycobacterium
KADAPSGTAARTA

SEQ ID NO: 1164550 - protein, 7 aa, Mycobacterium
KADDVGG

SEQ ID NO: 1164551 - protein, 4 aa, Mycobacterium
KADG

SEQ ID NO: 1164552 - protein, 19 aa, Mycobacterium
KADGAKTPAVQAVRTTPPA

SEQ ID NO: 1164553 - protein, 9 aa, Mycobacterium
KADGRSTPI

SEQ ID NO: 1164554 - protein, 7 aa, Mycobacterium
KADPEEQ

SEQ ID NO: 1164555 - protein, 13 aa, Mycobacterium
KADPEKVNPNGGA

SEQ ID NO: 1164556 - protein, 7 aa, Mycobacterium
KADPRGT

SEQ ID NO: 1164557 - protein, 25 aa, Mycobacterium
KADSAETPGYGDPQRRSTEAGRKNL

SEQ ID NO: 1164558 - protein, 12 aa, Mycobacterium
KADTEPLDPNQG

SEQ ID NO: 1164559 - protein, 5 aa, Mycobacterium
KADTV

SEQ ID NO: 1164560 - protein, 22 aa, Mycobacterium
KAEADSLNAQISGNSASIGPLQ

SEQ ID NO: 1164561 - protein, 12 aa, Mycobacterium
KAEAEEEADDVR

SEQ ID NO: 1164562 - protein, 5 aa, Mycobacterium
KAEAY

SEQ ID NO: 1164563 - protein, 6 aa, Mycobacterium
KAEDAW

SEQ ID NO: 1164564 - protein, 5 aa, Mycobacterium
KAEEL

SEQ ID NO: 1164565 - protein, 13 aa, Mycobacterium
KAEGKTPTREDAE

SEQ ID NO: 1164566 - protein, 10 aa, Mycobacterium
KAENAQAPHA

SEQ ID NO: 1164567 - protein, 17 aa, Mycobacterium
KAEPGQMKPIPGKRPRK

SEQ ID NO: 1164568 - protein, 20 aa, Mycobacterium
KAERRLTETALKDLKKRAEA

SEQ ID NO: 1164569 - protein, 8 aa, Mycobacterium
KAETDGNL

SEQ ID NO: 1164570 - protein, 7 aa, Mycobacterium
KAETSSL

SEQ ID NO: 1164571 - protein, 16 aa, Mycobacterium
KAFDEGPWPRMSPDER

SEQ ID NO: 1164572 - protein, 6 aa, Mycobacterium
KAFGTP

SEQ ID NO: 1164573 - protein, 5 aa, Mycobacterium
KAFPD

SEQ ID NO: 1164574 - protein, 9 aa, Mycobacterium
KAFTSAEGS

SEQ ID NO: 1164575 - protein, 6 aa, Mycobacterium
KAGAAG

SEQ ID NO: 1164576 - protein, 12 aa, Mycobacterium
KAGAGIDPANAC

SEQ ID NO: 1164577 - protein, 7 aa, Mycobacterium
KAGAQIA

SEQ ID NO: 1164578 - protein, 12 aa, Mycobacterium
KAGASGATGDGS

SEQ ID NO: 1164579 - protein, 7 aa, Mycobacterium
KAGEGVV

SEQ ID NO: 1164580 - protein, 5 aa, Mycobacterium
KAGFS

SEQ ID NO: 1164581 - protein, 12 aa, Mycobacterium
KAGHGIGSAGLP

SEQ ID NO: 1164582 - protein, 6 aa, Mycobacterium
KAGLNA

SEQ ID NO: 1164583 - protein, 7 aa, Mycobacterium
KAGMPEE

SEQ ID NO: 1164584 - protein, 7 aa, Mycobacterium
KAGNPDI

SEQ ID NO: 1164585 - protein, 5 aa, Mycobacterium
KAGNR

SEQ ID NO: 1164586 - protein, 9 aa, Mycobacterium
KAGPTRESR

SEQ ID NO: 1164587 - protein, 7 aa, Mycobacterium
KAGRRRY

SEQ ID NO: 1164588 - protein, 6 aa, Mycobacterium
KAGSRN

SEQ ID NO: 1164589 - protein, 9 aa, Mycobacterium
KAGTAVSER

SEQ ID NO: 1164590 - protein, 10 aa, Mycobacterium
KAGTTHRKRA

SEQ ID NO: 1164591 - protein, 6 aa, Mycobacterium
KAGTTV

SEQ ID NO: 1164592 - protein, 6 aa, Mycobacterium
KAGVTP

SEQ ID NO: 1164593 - protein, 4 aa, Mycobacterium
KAHE

SEQ ID NO: 1164594 - protein, 9 aa, Mycobacterium
KAHHGRAGT

SEQ ID NO: 1164595 - protein, 9 aa, Mycobacterium
KAHISGESL

SEQ ID NO: 1164596 - protein, 5 aa, Mycobacterium
KAHRS

SEQ ID NO: 1164597 - protein, 6 aa, Mycobacterium
KAKDLG

SEQ ID NO: 1164598 - protein, 8 aa, Mycobacterium
KAKEVPAA

SEQ ID NO: 1164599 - protein, 5 aa, Mycobacterium
KAKSL

SEQ ID NO: 1164600 - protein, 5 aa, Mycobacterium
KAKSM

SEQ ID NO: 1164601 - protein, 16 aa, Mycobacterium
KALAGPDVAELLWEKV

SEQ ID NO: 1164602 - protein, 8 aa, Mycobacterium
KALESGLA

SEQ ID NO: 1164603 - protein, 11 aa, Mycobacterium
KALGASRDAAL

SEQ ID NO: 1164604 - protein, 5 aa, Mycobacterium
KALGH

SEQ ID NO: 1164605 - protein, 4 aa, Mycobacterium
KALP

SEQ ID NO: 1164606 - protein, 5 aa, Mycobacterium
KANDI

SEQ ID NO: 1164607 - protein, 11 aa, Mycobacterium
KANKLADDAGM

SEQ ID NO: 1164608 - protein, 4 aa, Mycobacterium
KAPA

SEQ ID NO: 1164609 - protein, 7 aa, Mycobacterium
KAPAGER

SEQ ID NO: 1164610 - protein, 5 aa, Mycobacterium
KAPAL

SEQ ID NO: 1164611 - protein, 29 aa, Mycobacterium
KAPATTTASAKFPAATSAADSTVGRSGRA

SEQ ID NO: 1164612 - protein, 10 aa, Mycobacterium
KAPGQRIPRT

SEQ ID NO: 1164613 - protein, 10 aa, Mycobacterium
KAPGVTAGPT

SEQ ID NO: 1164614 - protein, 5 aa, Mycobacterium
KAPQT

SEQ ID NO: 1164615 - protein, 6 aa, Mycobacterium
KAPRLA

SEQ ID NO: 1164616 - protein, 12 aa, Mycobacterium
KAPTVGGTTAVS

SEQ ID NO: 1164617 - protein, 7 aa, Mycobacterium
KAQAEDA

SEQ ID NO: 1164618 - protein, 14 aa, Mycobacterium
KAQARVEAARPYDR

SEQ ID NO: 1164619 - protein, 5 aa, Mycobacterium
KAQGA

SEQ ID NO: 1164620 - protein, 10 aa, Mycobacterium
KAQGAGPSRD

SEQ ID NO: 1164621 - protein, 9 aa, Mycobacterium
KAQKQARRW

SEQ ID NO: 1164622 - protein, 9 aa, Mycobacterium
KAQSAMPPS

SEQ ID NO: 1164623 - protein, 7 aa, Mycobacterium
KARDAFR

SEQ ID NO: 1164624 - protein, 7 aa, Mycobacterium
KARDRAR

SEQ ID NO: 1164625 - protein, 8 aa, Mycobacterium
KAREKAAD

SEQ ID NO: 1164626 - protein, 5 aa, Mycobacterium
KARGN

SEQ ID NO: 1164627 - protein, 4 aa, Mycobacterium
KARK

SEQ ID NO: 1164628 - protein, 5 aa, Mycobacterium
KARKI

SEQ ID NO: 1164629 - protein, 9 aa, Mycobacterium
KARQSGAPI

SEQ ID NO: 1164630 - protein, 6 aa, Mycobacterium
KARRDA

SEQ ID NO: 1164631 - protein, 12 aa, Mycobacterium
KARTGPASPGAA

SEQ ID NO: 1164632 - protein, 9 aa, Mycobacterium
KASAGGSRD

SEQ ID NO: 1164633 - protein, 9 aa, Mycobacterium
KASAPQAIE

SEQ ID NO: 1164634 - protein, 9 aa, Mycobacterium
KASATAKME

SEQ ID NO: 1164635 - protein, 5 aa, Mycobacterium
KASDA

SEQ ID NO: 1164636 - protein, 5 aa, Mycobacterium
KASDE

SEQ ID NO: 1164637 - protein, 22 aa, Mycobacterium
KASDTDAASAESCVDTSGPNIK

SEQ ID NO: 1164638 - protein, 7 aa, Mycobacterium
KASEMST

SEQ ID NO: 1164639 - protein, 9 aa, Mycobacterium
KASGGIRTA

SEQ ID NO: 1164640 - protein, 8 aa, Mycobacterium
KASHQTWP

SEQ ID NO: 1164641 - protein, 7 aa, Mycobacterium
KASIAGA

SEQ ID NO: 1164642 - protein, 8 aa, Mycobacterium
KASSGIDL

SEQ ID NO: 1164643 - protein, 8 aa, Mycobacterium
KATADGRR

SEQ ID NO: 1164644 - protein, 16 aa, Mycobacterium
KATAYPAQLSGGQQQR

SEQ ID NO: 1164645 - protein, 9 aa, Mycobacterium
KATGVDPDA

SEQ ID NO: 1164646 - protein, 8 aa, Mycobacterium
KATHPDTA

SEQ ID NO: 1164647 - protein, 13 aa, Mycobacterium
KATLDGVGDDDAT

SEQ ID NO: 1164648 - protein, 6 aa, Mycobacterium
KATPMR

SEQ ID NO: 1164649 - protein, 14 aa, Mycobacterium
KATRGNIDVKLSAK

SEQ ID NO: 1164650 - protein, 9 aa, Mycobacterium
KATTGAPGP

SEQ ID NO: 1164651 - protein, 10 aa, Mycobacterium
KATYAERTGV

SEQ ID NO: 1164652 - protein, 11 aa, Mycobacterium
KAVASADPAVG

SEQ ID NO: 1164653 - protein, 15 aa, Mycobacterium
KAVGGQDPGAESSAR

SEQ ID NO: 1164654 - protein, 5 aa, Mycobacterium
KAVPR

SEQ ID NO: 1164655 - protein, 7 aa, Mycobacterium
KAVTDRP

SEQ ID NO: 1164656 - protein, 5 aa, Mycobacterium
KAYDA

SEQ ID NO: 1164657 - protein, 5 aa, Mycobacterium
KAYEE

SEQ ID NO: 1164658 - protein, 7 aa, Mycobacterium
KCNDEQF

SEQ ID NO: 1164659 - protein, 5 aa, Mycobacterium
KCTYG

SEQ ID NO: 1164660 - protein, 13 aa, Mycobacterium
KDAAIGDTVDGQS

SEQ ID NO: 1164661 - protein, 6 aa, Mycobacterium
KDAESV

SEQ ID NO: 1164662 - protein, 9 aa, Mycobacterium
KDAGINPRD

SEQ ID NO: 1164663 - protein, 6 aa, Mycobacterium
KDAGLS

SEQ ID NO: 1164664 - protein, 9 aa, Mycobacterium
KDAKDKVVE

SEQ ID NO: 1164665 - protein, 8 aa, Mycobacterium
KDAPPLPA

SEQ ID NO: 1164666 - protein, 5 aa, Mycobacterium
KDAPV

SEQ ID NO: 1164667 - protein, 7 aa, Mycobacterium
KDASTHS

SEQ ID NO: 1164668 - protein, 8 aa, Mycobacterium
KDDEIGPA

SEQ ID NO: 1164669 - protein, 8 aa, Mycobacterium
KDDGADTA

SEQ ID NO: 1164670 - protein, 14 aa, Mycobacterium
KDDGARTGATELAG

SEQ ID NO: 1164671 - protein, 6 aa, Mycobacterium
KDDGTE

SEQ ID NO: 1164672 - protein, 5 aa, Mycobacterium
KDDGV

SEQ ID NO: 1164673 - protein, 19 aa, Mycobacterium
KDDHPAHHDEAAAKESGYD

SEQ ID NO: 1164674 - protein, 6 aa, Mycobacterium
KDDPEF

SEQ ID NO: 1164675 - protein, 7 aa, Mycobacterium
KDDPGLM

SEQ ID NO: 1164676 - protein, 15 aa, Mycobacterium
KDEDGEDIVTFAFQP

SEQ ID NO: 1164677 - protein, 6 aa, Mycobacterium
KDEDGY

SEQ ID NO: 1164678 - protein, 20 aa, Mycobacterium
KDEGARVVTGGERAELGGDL

SEQ ID NO: 1164679 - protein, 8 aa, Mycobacterium
KDEIADAP

SEQ ID NO: 1164680 - protein, 9 aa, Mycobacterium
KDEYPATAA

SEQ ID NO: 1164681 - protein, 15 aa, Mycobacterium
KDFARKGKGAVETPL

SEQ ID NO: 1164682 - protein, 4 aa, Mycobacterium
KDFD

SEQ ID NO: 1164683 - protein, 6 aa, Mycobacterium
KDFDGI

SEQ ID NO: 1164684 - protein, 15 aa, Mycobacterium
KDGAEVARGKDLDTL

SEQ ID NO: 1164685 - protein, 5 aa, Mycobacterium
KDGGG

SEQ ID NO: 1164686 - protein, 7 aa, Mycobacterium
KDGGSVD

SEQ ID NO: 1164687 - protein, 6 aa, Mycobacterium
KDGLRK

SEQ ID NO: 1164688 - protein, 8 aa, Mycobacterium
KDGPDHEK

SEQ ID NO: 1164689 - protein, 6 aa, Mycobacterium
KDGTLR

SEQ ID NO: 1164690 - protein, 8 aa, Mycobacterium
KDGTTTTI

SEQ ID NO: 1164691 - protein, 11 aa, Mycobacterium
KDHNATSGAQR

SEQ ID NO: 1164692 - protein, 7 aa, Mycobacterium
KDKDGTI

SEQ ID NO: 1164693 - protein, 13 aa, Mycobacterium
KDKNGIAGIVDEA

SEQ ID NO: 1164694 - protein, 8 aa, Mycobacterium
KDKQTARV

SEQ ID NO: 1164695 - protein, 13 aa, Mycobacterium
KDKSQKQGADATT

SEQ ID NO: 1164696 - protein, 6 aa, Mycobacterium
KDKVGN

SEQ ID NO: 1164697 - protein, 6 aa, Mycobacterium
KDLGEA

SEQ ID NO: 1164698 - protein, 6 aa, Mycobacterium
KDLGED

SEQ ID NO: 1164699 - protein, 10 aa, Mycobacterium
KDLPDRSGDG

SEQ ID NO: 1164700 - protein, 5 aa, Mycobacterium
KDMNA

SEQ ID NO: 1164701 - protein, 23 aa, Mycobacterium
KDMPPNPDATSTGLEGARGADVD

SEQ ID NO: 1164702 - protein, 5 aa, Mycobacterium
KDNKV

SEQ ID NO: 1164703 - protein, 5 aa, Mycobacterium
KDNPR

SEQ ID NO: 1164704 - protein, 8 aa, Mycobacterium
KDNPSDDI

SEQ ID NO: 1164705 - protein, 8 aa, Mycobacterium
KDNPSDDL

SEQ ID NO: 1164706 - protein, 4 aa, Mycobacterium
KDNR

SEQ ID NO: 1164707 - protein, 6 aa, Mycobacterium
KDPAHY

SEQ ID NO: 1164708 - protein, 8 aa, Mycobacterium
KDPATPKI

SEQ ID NO: 1164709 - protein, 6 aa, Mycobacterium
KDPDEI

SEQ ID NO: 1164710 - protein, 11 aa, Mycobacterium
KDPEGAGYPAT

SEQ ID NO: 1164711 - protein, 7 aa, Mycobacterium
KDPSKLP

SEQ ID NO: 1164712 - protein, 9 aa, Mycobacterium
KDQNGQPVT

SEQ ID NO: 1164713 - protein, 9 aa, Mycobacterium
KDRDPAYAE

SEQ ID NO: 1164714 - protein, 6 aa, Mycobacterium
KDREDG

SEQ ID NO: 1164715 - protein, 7 aa, Mycobacterium
KDRERFS

SEQ ID NO: 1164716 - protein, 5 aa, Mycobacterium
KDRKW

SEQ ID NO: 1164717 - protein, 7 aa, Mycobacterium
KDRLSRG

SEQ ID NO: 1164718 - protein, 20 aa, Mycobacterium
KDRPGHLRSHGRPSKLAGKT

SEQ ID NO: 1164719 - protein, 7 aa, Mycobacterium
KDRQQSA

SEQ ID NO: 1164720 - protein, 19 aa, Mycobacterium
KDRSTKKEVKQVKPTHADV

SEQ ID NO: 1164721 - protein, 4 aa, Mycobacterium
KDSI

SEQ ID NO: 1164722 - protein, 13 aa, Mycobacterium
KDSIAPRYAADPH

SEQ ID NO: 1164723 - protein, 41 aa, Mycobacterium
KDSPATFDPSEVAGYDAATGTWNSDAGYDLEDNQDYAETEQ

SEQ ID NO: 1164724 - protein, 12 aa, Mycobacterium
KDTDRTSGVAEA

SEQ ID NO: 1164725 - protein, 8 aa, Mycobacterium
KDTITQDE

SEQ ID NO: 1164726 - protein, 8 aa, Mycobacterium
KDTPGVSF

SEQ ID NO: 1164727 - protein, 14 aa, Mycobacterium
KDTTTGDTLSDANQ

SEQ ID NO: 1164728 - protein, 6 aa, Mycobacterium
KDVAAG

SEQ ID NO: 1164729 - protein, 14 aa, Mycobacterium
KEAAEQAGRDPDSV

SEQ ID NO: 1164730 - protein, 10 aa, Mycobacterium
KEAAKDGQDV

SEQ ID NO: 1164731 - protein, 9 aa, Mycobacterium
KEAANGVEG

SEQ ID NO: 1164732 - protein, 6 aa, Mycobacterium
KEAPDR

SEQ ID NO: 1164733 - protein, 12 aa, Mycobacterium
KEARTHKDRKPV

SEQ ID NO: 1164734 - protein, 5 aa, Mycobacterium
KEATA

SEQ ID NO: 1164735 - protein, 8 aa, Mycobacterium
KEDEETLD

SEQ ID NO: 1164736 - protein, 4 aa, Mycobacterium
KEDG

SEQ ID NO: 1164737 - protein, 6 aa, Mycobacterium
KEDLQR

SEQ ID NO: 1164738 - protein, 6 aa, Mycobacterium
KEDLTD

SEQ ID NO: 1164739 - protein, 8 aa, Mycobacterium
KEDPDQAQ

SEQ ID NO: 1164740 - protein, 17 aa, Mycobacterium
KEDRRSKGRPGHEGRPE

SEQ ID NO: 1164741 - protein, 23 aa, Mycobacterium
KEEAQRARSQRAANPGDPKASAR

SEQ ID NO: 1164742 - protein, 5 aa, Mycobacterium
KEEQI

SEQ ID NO: 1164743 - protein, 4 aa, Mycobacterium
KEER

SEQ ID NO: 1164744 - protein, 5 aa, Mycobacterium
KEGAD

SEQ ID NO: 1164745 - protein, 8 aa, Mycobacterium
KEGREEAV

SEQ ID NO: 1164746 - protein, 7 aa, Mycobacterium
KEGVTAR

SEQ ID NO: 1164747 - protein, 10 aa, Mycobacterium
KEKRGSEGTD

SEQ ID NO: 1164748 - protein, 11 aa, Mycobacterium
KELEGDAATRI

SEQ ID NO: 1164749 - protein, 14 aa, Mycobacterium
KEMGGSGDGTNPEQ

SEQ ID NO: 1164750 - protein, 6 aa, Mycobacterium
KENPES

SEQ ID NO: 1164751 - protein, 7 aa, Mycobacterium
KENPQEL

SEQ ID NO: 1164752 - protein, 10 aa, Mycobacterium
KENPVERASA

SEQ ID NO: 1164753 - protein, 15 aa, Mycobacterium
KEPASPEKHVTIKST

SEQ ID NO: 1164754 - protein, 5 aa, Mycobacterium
KEPDR

SEQ ID NO: 1164755 - protein, 8 aa, Mycobacterium
KEPNPEEV

SEQ ID NO: 1164756 - protein, 10 aa, Mycobacterium
KEPPSPGPGQ

SEQ ID NO: 1164757 - protein, 5 aa, Mycobacterium
KEPTD

SEQ ID NO: 1164758 - protein, 19 aa, Mycobacterium
KEQTESRPADETHANHVGA

SEQ ID NO: 1164759 - protein, 11 aa, Mycobacterium
KERAQRAKPPL

SEQ ID NO: 1164760 - protein, 9 aa, Mycobacterium
KERDEWPAD

SEQ ID NO: 1164761 - protein, 15 aa, Mycobacterium
KEREQLRESRRRSYD

SEQ ID NO: 1164762 - protein, 6 aa, Mycobacterium
KERLGD

SEQ ID NO: 1164763 - protein, 8 aa, Mycobacterium
KERRGEYL

SEQ ID NO: 1164764 - protein, 9 aa, Mycobacterium
KERRRADGS

SEQ ID NO: 1164765 - protein, 8 aa, Mycobacterium
KESDGGRA

SEQ ID NO: 1164766 - protein, 6 aa, Mycobacterium
KESTRQ

SEQ ID NO: 1164767 - protein, 17 aa, Mycobacterium
KEYGSGSSRDWAAKGTS

SEQ ID NO: 1164768 - protein, 9 aa, Mycobacterium
KFETDDNGC

SEQ ID NO: 1164769 - protein, 5 aa, Mycobacterium
KFGEV

SEQ ID NO: 1164770 - protein, 14 aa, Mycobacterium
KFGGDSLTETRTNV

SEQ ID NO: 1164771 - protein, 4 aa, Mycobacterium
KFPT

SEQ ID NO: 1164772 - protein, 6 aa, Mycobacterium
KFRDGT

SEQ ID NO: 1164773 - protein, 5 aa, Mycobacterium
KFSPE

SEQ ID NO: 1164774 - protein, 7 aa, Mycobacterium
KFTERRD

SEQ ID NO: 1164775 - protein, 13 aa, Mycobacterium
KGAADDAVRSRRA

SEQ ID NO: 1164776 - protein, 4 aa, Mycobacterium
KGAP

SEQ ID NO: 1164777 - protein, 8 aa, Mycobacterium
KGAPGPVE

SEQ ID NO: 1164778 - protein, 7 aa, Mycobacterium
KGAPPMQ

SEQ ID NO: 1164779 - protein, 10 aa, Mycobacterium
KGDAAKTART

SEQ ID NO: 1164780 - protein, 7 aa, Mycobacterium
KGDATSA

SEQ ID NO: 1164781 - protein, 16 aa, Mycobacterium
KGDKQRTVPFGEPAEQ

SEQ ID NO: 1164782 - protein, 8 aa, Mycobacterium
KGDPAASV

SEQ ID NO: 1164783 - protein, 6 aa, Mycobacterium
KGDSVT

SEQ ID NO: 1164784 - protein, 10 aa, Mycobacterium
KGEDGRYRPA

SEQ ID NO: 1164785 - protein, 9 aa, Mycobacterium
KGEEPETEW

SEQ ID NO: 1164786 - protein, 14 aa, Mycobacterium
KGEESSGGADKSSI

SEQ ID NO: 1164787 - protein, 5 aa, Mycobacterium
KGENL

SEQ ID NO: 1164788 - protein, 5 aa, Mycobacterium
KGEPL

SEQ ID NO: 1164789 - protein, 13 aa, Mycobacterium
KGEYAPDEDPWTA

SEQ ID NO: 1164790 - protein, 5 aa, Mycobacterium
KGFGG

SEQ ID NO: 1164791 - protein, 8 aa, Mycobacterium
KGFQGKSS

SEQ ID NO: 1164792 - protein, 8 aa, Mycobacterium
KGGKERHV

SEQ ID NO: 1164793 - protein, 12 aa, Mycobacterium
KGGVGKTTSTIN

SEQ ID NO: 1164794 - protein, 6 aa, Mycobacterium
KGIAND

SEQ ID NO: 1164795 - protein, 12 aa, Mycobacterium
KGIDNDDTPPLT

SEQ ID NO: 1164796 - protein, 14 aa, Mycobacterium
KGIGESATVGSPPA

SEQ ID NO: 1164797 - protein, 15 aa, Mycobacterium
KGITEPDAWGPARNP

SEQ ID NO: 1164798 - protein, 13 aa, Mycobacterium
KGITTRPEPESRE

SEQ ID NO: 1164799 - protein, 7 aa, Mycobacterium
KGKADVV

SEQ ID NO: 1164800 - protein, 5 aa, Mycobacterium
KGKDR

SEQ ID NO: 1164801 - protein, 7 aa, Mycobacterium
KGKPHVS

SEQ ID NO: 1164802 - protein, 6 aa, Mycobacterium
KGKRSV

SEQ ID NO: 1164803 - protein, 6 aa, Mycobacterium
KGLEPQ

SEQ ID NO: 1164804 - protein, 7 aa, Mycobacterium
KGLGKKG

SEQ ID NO: 1164805 - protein, 6 aa, Mycobacterium
KGLPAD

SEQ ID NO: 1164806 - protein, 7 aa, Mycobacterium
KGLPRSC

SEQ ID NO: 1164807 - protein, 6 aa, Mycobacterium
KGLRRT

SEQ ID NO: 1164808 - protein, 7 aa, Mycobacterium
KGLSGGV

SEQ ID NO: 1164809 - protein, 9 aa, Mycobacterium
KGLTSGYSP

SEQ ID NO: 1164810 - protein, 6 aa, Mycobacterium
KGNALD

SEQ ID NO: 1164811 - protein, 15 aa, Mycobacterium
KGNPFGDGRAAERSA

SEQ ID NO: 1164812 - protein, 4 aa, Mycobacterium
KGNR

SEQ ID NO: 1164813 - protein, 39 aa, Mycobacterium
KGPDNAKDDVISDPAEGADDRVDWSSEGGATPSGPADTG

SEQ ID NO: 1164814 - protein, 8 aa, Mycobacterium
KGPPPTWG

SEQ ID NO: 1164815 - protein, 4 aa, Mycobacterium
KGPQ

SEQ ID NO: 1164816 - protein, 6 aa, Mycobacterium
KGPRSL

SEQ ID NO: 1164817 - protein, 10 aa, Mycobacterium
KGQAVSPSAV

SEQ ID NO: 1164818 - protein, 5 aa, Mycobacterium
KGQVR

SEQ ID NO: 1164819 - protein, 21 aa, Mycobacterium
KGQYSPTSEVGKVTKSTPMGS

SEQ ID NO: 1164820 - protein, 17 aa, Mycobacterium
KGRAVRAANEEEKRAAS

SEQ ID NO: 1164821 - protein, 5 aa, Mycobacterium
KGRRD

SEQ ID NO: 1164822 - protein, 6 aa, Mycobacterium
KGSDGV

SEQ ID NO: 1164823 - protein, 8 aa, Mycobacterium
KGSGEVTS

SEQ ID NO: 1164824 - protein, 12 aa, Mycobacterium
KGSGQRQAGSAV

SEQ ID NO: 1164825 - protein, 9 aa, Mycobacterium
KGSHAQAGR

SEQ ID NO: 1164826 - protein, 9 aa, Mycobacterium
KGSPLGQSL

SEQ ID NO: 1164827 - protein, 10 aa, Mycobacterium
KGSSISDPDN

SEQ ID NO: 1164828 - protein, 5 aa, Mycobacterium
KGSTH

SEQ ID NO: 1164829 - protein, 21 aa, Mycobacterium
KGTDFKKAKRLPAEQLAHWDA

SEQ ID NO: 1164830 - protein, 7 aa, Mycobacterium
KGTGSNT

SEQ ID NO: 1164831 - protein, 8 aa, Mycobacterium
KGTGSQDI

SEQ ID NO: 1164832 - protein, 9 aa, Mycobacterium
KGTGVGGRI

SEQ ID NO: 1164833 - protein, 19 aa, Mycobacterium
KGTHGGALGSADKALTKTP

SEQ ID NO: 1164834 - protein, 22 aa, Mycobacterium
KGTHGTSTPATCDTCGGRGEIQ

SEQ ID NO: 1164835 - protein, 7 aa, Mycobacterium
KGTPGFE

SEQ ID NO: 1164836 - protein, 25 aa, Mycobacterium
KGTPSDAAGQERSDSGMSKGAAVAS

SEQ ID NO: 1164837 - protein, 15 aa, Mycobacterium
KGTRLARPIDAVREI

SEQ ID NO: 1164838 - protein, 7 aa, Mycobacterium
KGTTLEP

SEQ ID NO: 1164839 - protein, 9 aa, Mycobacterium
KGVGDRRQI

SEQ ID NO: 1164840 - protein, 7 aa, Mycobacterium
KGVGPGY

SEQ ID NO: 1164841 - protein, 18 aa, Mycobacterium
KGVPAASVYSASKAALES

SEQ ID NO: 1164842 - protein, 6 aa, Mycobacterium
KGVPAG

SEQ ID NO: 1164843 - protein, 6 aa, Mycobacterium
KGVPSD

SEQ ID NO: 1164844 - protein, 5 aa, Mycobacterium
KGWTL

SEQ ID NO: 1164845 - protein, 6 aa, Mycobacterium
KGYANP

SEQ ID NO: 1164846 - protein, 9 aa, Mycobacterium
KGYASHGES

SEQ ID NO: 1164847 - protein, 15 aa, Mycobacterium
KGYDTVEPRDPGDDV

SEQ ID NO: 1164848 - protein, 12 aa, Mycobacterium
KGYSPEFPGADD

SEQ ID NO: 1164849 - protein, 9 aa, Mycobacterium
KGYSTPAHT

SEQ ID NO: 1164850 - protein, 9 aa, Mycobacterium
KGYTAGDTD

SEQ ID NO: 1164851 - protein, 4 aa, Mycobacterium
KHEG

SEQ ID NO: 1164852 - protein, 11 aa, Mycobacterium
KHGLGSSRQAI

SEQ ID NO: 1164853 - protein, 7 aa, Mycobacterium
KHGPGVA

SEQ ID NO: 1164854 - protein, 7 aa, Mycobacterium
KHGSEPG

SEQ ID NO: 1164855 - protein, 12 aa, Mycobacterium
KHHGKGKLDARA

SEQ ID NO: 1164856 - protein, 14 aa, Mycobacterium
KHKPPDYRPAPGAV

SEQ ID NO: 1164857 - protein, 21 aa, Mycobacterium
KHLSEAHPGREYDRDAILFMA

SEQ ID NO: 1164858 - protein, 12 aa, Mycobacterium
KHPAPQNYEEAA

SEQ ID NO: 1164859 - protein, 8 aa, Mycobacterium
KHPPADTP

SEQ ID NO: 1164860 - protein, 9 aa, Mycobacterium
KHPRGAFTE

SEQ ID NO: 1164861 - protein, 5 aa, Mycobacterium
KHSEI

SEQ ID NO: 1164862 - protein, 9 aa, Mycobacterium
KHSVNNPYA

SEQ ID NO: 1164863 - protein, 4 aa, Mycobacterium
KHYG

SEQ ID NO: 1164864 - protein, 6 aa, Mycobacterium
KIAEGA

SEQ ID NO: 1164865 - protein, 12 aa, Mycobacterium
KIAKDRGVGGPV

SEQ ID NO: 1164866 - protein, 11 aa, Mycobacterium
KIDEDSDVDSD

SEQ ID NO: 1164867 - protein, 7 aa, Mycobacterium
KIDPPVA

SEQ ID NO: 1164868 - protein, 9 aa, Mycobacterium
KIEGRYGSA

SEQ ID NO: 1164869 - protein, 9 aa, Mycobacterium
KIEPQAPVD

SEQ ID NO: 1164870 - protein, 77 aa, Mycobacterium
KIGDADQAEAEEPEPEPEPEPEPEPEPEPEPEPKQESKPEPKPEPKQESKQEAKPEPKKEPEPQQDAEPSDGSGPYV

SEQ ID NO: 1164871 - protein, 26 aa, Mycobacterium
KIGEPATQPTPEPVVEPAGEEDLEGP

SEQ ID NO: 1164872 - protein, 13 aa, Mycobacterium
KIGGDAGDGEGGQ

SEQ ID NO: 1164873 - protein, 6 aa, Mycobacterium
KITPRE

SEQ ID NO: 1164874 - protein, 5 aa, Mycobacterium
KKADS

SEQ ID NO: 1164875 - protein, 7 aa, Mycobacterium
KKAEAIA

SEQ ID NO: 1164876 - protein, 7 aa, Mycobacterium
KKAQSID

SEQ ID NO: 1164877 - protein, 8 aa, Mycobacterium
KKARGEAV

SEQ ID NO: 1164878 - protein, 8 aa, Mycobacterium
KKCCRSKP

SEQ ID NO: 1164879 - protein, 6 aa, Mycobacterium
KKDAEP

SEQ ID NO: 1164880 - protein, 25 aa, Mycobacterium
KKDGEAGEDEVSRAEKDLDKTTHTY

SEQ ID NO: 1164881 - protein, 31 aa, Mycobacterium
KKDPVANSRQGSQRERRSDEQAAKAVEASDR

SEQ ID NO: 1164882 - protein, 4 aa, Mycobacterium
KKDV

SEQ ID NO: 1164883 - protein, 11 aa, Mycobacterium
KKEDPQGREIG

SEQ ID NO: 1164884 - protein, 14 aa, Mycobacterium
KKEHDDKRLTSCGR

SEQ ID NO: 1164885 - protein, 6 aa, Mycobacterium
KKEVTT

SEQ ID NO: 1164886 - protein, 6 aa, Mycobacterium
KKEYGE

SEQ ID NO: 1164887 - protein, 9 aa, Mycobacterium
KKFTDQEKL

SEQ ID NO: 1164888 - protein, 5 aa, Mycobacterium
KKGDS

SEQ ID NO: 1164889 - protein, 18 aa, Mycobacterium
KKGQKTRRREKKNVPHGA

SEQ ID NO: 1164890 - protein, 9 aa, Mycobacterium
KKGTEEGAR

SEQ ID NO: 1164891 - protein, 7 aa, Mycobacterium
KKMAEGQ

SEQ ID NO: 1164892 - protein, 20 aa, Mycobacterium
KKMQPGAGASEATGDAYEPA

SEQ ID NO: 1164893 - protein, 9 aa, Mycobacterium
KKNAEHPIE

SEQ ID NO: 1164894 - protein, 11 aa, Mycobacterium
KKPDPQHHERP

SEQ ID NO: 1164895 - protein, 26 aa, Mycobacterium
KKPKPRKRGAHGGAATSGDSVTAPMQ

SEQ ID NO: 1164896 - protein, 6 aa, Mycobacterium
KKPVTT

SEQ ID NO: 1164897 - protein, 10 aa, Mycobacterium
KKQDAEARAK

SEQ ID NO: 1164898 - protein, 9 aa, Mycobacterium
KKQTGGSGQ

SEQ ID NO: 1164899 - protein, 10 aa, Mycobacterium
KKSANAAPYH

SEQ ID NO: 1164900 - protein, 33 aa, Mycobacterium
KKSGKSLKEKRAVKHAKSSAKLSSADALFNDKK

SEQ ID NO: 1164901 - protein, 9 aa, Mycobacterium
KKSIGPDKV

SEQ ID NO: 1164902 - protein, 4 aa, Mycobacterium
KKTG

SEQ ID NO: 1164903 - protein, 11 aa, Mycobacterium
KKTSDSNEPLL

SEQ ID NO: 1164904 - protein, 9 aa, Mycobacterium
KKYDGSRPE

SEQ ID NO: 1164905 - protein, 6 aa, Mycobacterium
KLAAPR

SEQ ID NO: 1164906 - protein, 6 aa, Mycobacterium
KLAEGK

SEQ ID NO: 1164907 - protein, 12 aa, Mycobacterium
KLAGTASRRDTR

SEQ ID NO: 1164908 - protein, 8 aa, Mycobacterium
KLDGPGLS

SEQ ID NO: 1164909 - protein, 6 aa, Mycobacterium
KLDPVQ

SEQ ID NO: 1164910 - protein, 7 aa, Mycobacterium
KLDQPLP

SEQ ID NO: 1164911 - protein, 5 aa, Mycobacterium
KLDRK

SEQ ID NO: 1164912 - protein, 6 aa, Mycobacterium
KLEGTA

SEQ ID NO: 1164913 - protein, 17 aa, Mycobacterium
KLENGTKAIYNPHYEIQ

SEQ ID NO: 1164914 - protein, 9 aa, Mycobacterium
KLGTESQAL

SEQ ID NO: 1164915 - protein, 10 aa, Mycobacterium
KLPAAQRRGV

SEQ ID NO: 1164916 - protein, 6 aa, Mycobacterium
KLPPEF

SEQ ID NO: 1164917 - protein, 9 aa, Mycobacterium
KLPPGPAFY

SEQ ID NO: 1164918 - protein, 6 aa, Mycobacterium
KLPPIG

SEQ ID NO: 1164919 - protein, 5 aa, Mycobacterium
KLRRN

SEQ ID NO: 1164920 - protein, 7 aa, Mycobacterium
KLSDPRP

SEQ ID NO: 1164921 - protein, 7 aa, Mycobacterium
KLSEETP

SEQ ID NO: 1164922 - protein, 11 aa, Mycobacterium
KLSPEQVTATE

SEQ ID NO: 1164923 - protein, 8 aa, Mycobacterium
KLSSPQLA

SEQ ID NO: 1164924 - protein, 34 aa, Mycobacterium
KLTKRPSKKAPAADNEKASAPEKDTSTDKAPAAS

SEQ ID NO: 1164925 - protein, 6 aa, Mycobacterium
KLTQGR

SEQ ID NO: 1164926 - protein, 12 aa, Mycobacterium
KMAPPGGGRTTS

SEQ ID NO: 1164927 - protein, 7 aa, Mycobacterium
KMGRPDT

SEQ ID NO: 1164928 - protein, 12 aa, Mycobacterium
KMPGGTPSSPGL

SEQ ID NO: 1164929 - protein, 5 aa, Mycobacterium
KMPPA

SEQ ID NO: 1164930 - protein, 4 aa, Mycobacterium
KMPS

SEQ ID NO: 1164931 - protein, 6 aa, Mycobacterium
KMPSQR

SEQ ID NO: 1164932 - protein, 13 aa, Mycobacterium
KMSSGSAQGMLSP

SEQ ID NO: 1164933 - protein, 8 aa, Mycobacterium
KNADESKM

SEQ ID NO: 1164934 - protein, 19 aa, Mycobacterium
KNAEATIPDPFGGPPRKPT

SEQ ID NO: 1164935 - protein, 8 aa, Mycobacterium
KNDAEEAR

SEQ ID NO: 1164936 - protein, 12 aa, Mycobacterium
KNDDHPREGLTP

SEQ ID NO: 1164937 - protein, 8 aa, Mycobacterium
KNEAGTPN

SEQ ID NO: 1164938 - protein, 5 aa, Mycobacterium
KNEDP

SEQ ID NO: 1164939 - protein, 12 aa, Mycobacterium
KNFRNGALNPNA

SEQ ID NO: 1164940 - protein, 5 aa, Mycobacterium
KNGPY

SEQ ID NO: 1164941 - protein, 11 aa, Mycobacterium
KNGTGSAGANG

SEQ ID NO: 1164942 - protein, 8 aa, Mycobacterium
KNKESRDD

SEQ ID NO: 1164943 - protein, 11 aa, Mycobacterium
KNLTDAERDGL

SEQ ID NO: 1164944 - protein, 7 aa, Mycobacterium
KNMDHSD

SEQ ID NO: 1164945 - protein, 5 aa, Mycobacterium
KNPDG

SEQ ID NO: 1164946 - protein, 7 aa, Mycobacterium
KNPDQLT

SEQ ID NO: 1164947 - protein, 5 aa, Mycobacterium
KNPNL

SEQ ID NO: 1164948 - protein, 6 aa, Mycobacterium
KNPRVE

SEQ ID NO: 1164949 - protein, 5 aa, Mycobacterium
KNQQA

SEQ ID NO: 1164950 - protein, 7 aa, Mycobacterium
KNQRSLG

SEQ ID NO: 1164951 - protein, 4 aa, Mycobacterium
KNRG

SEQ ID NO: 1164952 - protein, 8 aa, Mycobacterium
KNRRNDPD

SEQ ID NO: 1164953 - protein, 12 aa, Mycobacterium
KNVEAARNFGRD

SEQ ID NO: 1164954 - protein, 10 aa, Mycobacterium
KNVPTSRSEN

SEQ ID NO: 1164955 - protein, 9 aa, Mycobacterium
KNYDGSWTE

SEQ ID NO: 1164956 - protein, 15 aa, Mycobacterium
KPADPPGTPDNPDEA

SEQ ID NO: 1164957 - protein, 13 aa, Mycobacterium
KPAEGVPGTERTP

SEQ ID NO: 1164958 - protein, 5 aa, Mycobacterium
KPAGR

SEQ ID NO: 1164959 - protein, 6 aa, Mycobacterium
KPAKKA

SEQ ID NO: 1164960 - protein, 12 aa, Mycobacterium
KPAKLSGGQRQR

SEQ ID NO: 1164961 - protein, 5 aa, Mycobacterium
KPARI

SEQ ID NO: 1164962 - protein, 6 aa, Mycobacterium
KPATRQ

SEQ ID NO: 1164963 - protein, 9 aa, Mycobacterium
KPDETANAV

SEQ ID NO: 1164964 - protein, 12 aa, Mycobacterium
KPDGTLDTDAAA

SEQ ID NO: 1164965 - protein, 7 aa, Mycobacterium
KPDPEAY

SEQ ID NO: 1164966 - protein, 4 aa, Mycobacterium
KPDT

SEQ ID NO: 1164967 - protein, 8 aa, Mycobacterium
KPESVDTV

SEQ ID NO: 1164968 - protein, 8 aa, Mycobacterium
KPEYSNLP

SEQ ID NO: 1164969 - protein, 5 aa, Mycobacterium
KPFGL

SEQ ID NO: 1164970 - protein, 4 aa, Mycobacterium
KPGF

SEQ ID NO: 1164971 - protein, 5 aa, Mycobacterium
KPGNV

SEQ ID NO: 1164972 - protein, 6 aa, Mycobacterium
KPGRLD

SEQ ID NO: 1164973 - protein, 10 aa, Mycobacterium
KPGTTEPDAA

SEQ ID NO: 1164974 - protein, 11 aa, Mycobacterium
KPGTTTPHTEF

SEQ ID NO: 1164975 - protein, 6 aa, Mycobacterium
KPHTVS

SEQ ID NO: 1164976 - protein, 7 aa, Mycobacterium
KPIDDET

SEQ ID NO: 1164977 - protein, 8 aa, Mycobacterium
KPIRSADQ

SEQ ID NO: 1164978 - protein, 9 aa, Mycobacterium
KPKGMDEKM

SEQ ID NO: 1164979 - protein, 13 aa, Mycobacterium
KPKRRTKAQIARE

SEQ ID NO: 1164980 - protein, 6 aa, Mycobacterium
KPLAAR

SEQ ID NO: 1164981 - protein, 6 aa, Mycobacterium
KPLART

SEQ ID NO: 1164982 - protein, 13 aa, Mycobacterium
KPLGRVSDPEEQS

SEQ ID NO: 1164983 - protein, 23 aa, Mycobacterium
KPLLPTPAQPPGREPLRRRLTKP

SEQ ID NO: 1164984 - protein, 9 aa, Mycobacterium
KPLSEGGRL

SEQ ID NO: 1164985 - protein, 8 aa, Mycobacterium
KPLSSAER

SEQ ID NO: 1164986 - protein, 6 aa, Mycobacterium
KPMPNW

SEQ ID NO: 1164987 - protein, 7 aa, Mycobacterium
KPNPRWS

SEQ ID NO: 1164988 - protein, 6 aa, Mycobacterium
KPPAFD

SEQ ID NO: 1164989 - protein, 7 aa, Mycobacterium
KPPEPKQ

SEQ ID NO: 1164990 - protein, 8 aa, Mycobacterium
KPPLGPGA

SEQ ID NO: 1164991 - protein, 13 aa, Mycobacterium
KPPLGRRGYHDGE

SEQ ID NO: 1164992 - protein, 6 aa, Mycobacterium
KPRLPA

SEQ ID NO: 1164993 - protein, 6 aa, Mycobacterium
KPRPSD

SEQ ID NO: 1164994 - protein, 12 aa, Mycobacterium
KPRQLSGGQQQR

SEQ ID NO: 1164995 - protein, 7 aa, Mycobacterium
KPRSGLS

SEQ ID NO: 1164996 - protein, 11 aa, Mycobacterium
KPSAGTASGPW

SEQ ID NO: 1164997 - protein, 6 aa, Mycobacterium
KPSSCP

SEQ ID NO: 1164998 - protein, 7 aa, Mycobacterium
KPSSYTG

SEQ ID NO: 1164999 - protein, 6 aa, Mycobacterium
KPSVTA

SEQ ID NO: 1165000 - protein, 5 aa, Mycobacterium
KPTEL

SEQ ID NO: 1165001 - protein, 4 aa, Mycobacterium
KPTI

SEQ ID NO: 1165002 - protein, 28 aa, Mycobacterium
KPTKRTRRLAGRTQVSANDAPRINKMLN

SEQ ID NO: 1165003 - protein, 5 aa, Mycobacterium
KPTPE

SEQ ID NO: 1165004 - protein, 5 aa, Mycobacterium
KPTQQ

SEQ ID NO: 1165005 - protein, 5 aa, Mycobacterium
KPTVR

SEQ ID NO: 1165006 - protein, 8 aa, Mycobacterium
KPTYARGD

SEQ ID NO: 1165007 - protein, 9 aa, Mycobacterium
KPVGEGTGL

SEQ ID NO: 1165008 - protein, 5 aa, Mycobacterium
KPVSA

SEQ ID NO: 1165009 - protein, 4 aa, Mycobacterium
KPWP

SEQ ID NO: 1165010 - protein, 4 aa, Mycobacterium
KPYD

SEQ ID NO: 1165011 - protein, 6 aa, Mycobacterium
KPYTAI

SEQ ID NO: 1165012 - protein, 8 aa, Mycobacterium
KPYTSGGA

SEQ ID NO: 1165013 - protein, 8 aa, Mycobacterium
KQAAENAP

SEQ ID NO: 1165014 - protein, 7 aa, Mycobacterium
KQAAQKR

SEQ ID NO: 1165015 - protein, 7 aa, Mycobacterium
KQAEEAC

SEQ ID NO: 1165016 - protein, 9 aa, Mycobacterium
KQAETAGHS

SEQ ID NO: 1165017 - protein, 6 aa, Mycobacterium
KQAGGK

SEQ ID NO: 1165018 - protein, 5 aa, Mycobacterium
KQAGV

SEQ ID NO: 1165019 - protein, 7 aa, Mycobacterium
KQDGVAR

SEQ ID NO: 1165020 - protein, 20 aa, Mycobacterium
KQDPEATVTAGNASGQNDAA

SEQ ID NO: 1165021 - protein, 6 aa, Mycobacterium
KQEGAG

SEQ ID NO: 1165022 - protein, 4 aa, Mycobacterium
KQES

SEQ ID NO: 1165023 - protein, 6 aa, Mycobacterium
KQEWTG

SEQ ID NO: 1165024 - protein, 10 aa, Mycobacterium
KQGDTGVRPA

SEQ ID NO: 1165025 - protein, 4 aa, Mycobacterium
KQGI

SEQ ID NO: 1165026 - protein, 23 aa, Mycobacterium
KQGLSTGLGDEGGFAPDVAGTKA

SEQ ID NO: 1165027 - protein, 10 aa, Mycobacterium
KQGPAPAPVT

SEQ ID NO: 1165028 - protein, 6 aa, Mycobacterium
KQGQTV

SEQ ID NO: 1165029 - protein, 8 aa, Mycobacterium
KQGTRTVR

SEQ ID NO: 1165030 - protein, 16 aa, Mycobacterium
KQKDVSARFGSREPDK

SEQ ID NO: 1165031 - protein, 4 aa, Mycobacterium
KQLT

SEQ ID NO: 1165032 - protein, 4 aa, Mycobacterium
KQPA

SEQ ID NO: 1165033 - protein, 8 aa, Mycobacterium
KQQNDSIE

SEQ ID NO: 1165034 - protein, 7 aa, Mycobacterium
KQRAGAS

SEQ ID NO: 1165035 - protein, 7 aa, Mycobacterium
KQRGAKG

SEQ ID NO: 1165036 - protein, 20 aa, Mycobacterium
KQRNGKDSGASVGDLATDPD

SEQ ID NO: 1165037 - protein, 7 aa, Mycobacterium
KQRSTEN

SEQ ID NO: 1165038 - protein, 4 aa, Mycobacterium
KQRT

SEQ ID NO: 1165039 - protein, 19 aa, Mycobacterium
KQSGLGRELGPDALDEYTE

SEQ ID NO: 1165040 - protein, 6 aa, Mycobacterium
KQSGRI

SEQ ID NO: 1165041 - protein, 11 aa, Mycobacterium
KQSNGKLETAG

SEQ ID NO: 1165042 - protein, 5 aa, Mycobacterium
KQVTA

SEQ ID NO: 1165043 - protein, 5 aa, Mycobacterium
KQWPG

SEQ ID NO: 1165044 - protein, 9 aa, Mycobacterium
KQYGDRPPW

SEQ ID NO: 1165045 - protein, 14 aa, Mycobacterium
KQYSQMDRGAYQSA

SEQ ID NO: 1165046 - protein, 8 aa, Mycobacterium
KRAAAAQR

SEQ ID NO: 1165047 - protein, 7 aa, Mycobacterium
KRAAQLR

SEQ ID NO: 1165048 - protein, 7 aa, Mycobacterium
KRADDPL

SEQ ID NO: 1165049 - protein, 7 aa, Mycobacterium
KRAENSA

SEQ ID NO: 1165050 - protein, 8 aa, Mycobacterium
KRAEPGDD

SEQ ID NO: 1165051 - protein, 6 aa, Mycobacterium
KRAERA

SEQ ID NO: 1165052 - protein, 5 aa, Mycobacterium
KRAET

SEQ ID NO: 1165053 - protein, 32 aa, Mycobacterium
KRAGLNRDVPDPKGARFGRDADGELDGTAEET

SEQ ID NO: 1165054 - protein, 7 aa, Mycobacterium
KRARSGL

SEQ ID NO: 1165055 - protein, 10 aa, Mycobacterium
KRASPSRGAL

SEQ ID NO: 1165056 - protein, 8 aa, Mycobacterium
KRATGATV

SEQ ID NO: 1165057 - protein, 7 aa, Mycobacterium
KRDGAPQ

SEQ ID NO: 1165058 - protein, 6 aa, Mycobacterium
KRDGRE

SEQ ID NO: 1165059 - protein, 12 aa, Mycobacterium
KRDKAQGHLDAG

SEQ ID NO: 1165060 - protein, 5 aa, Mycobacterium
KRDNG

SEQ ID NO: 1165061 - protein, 10 aa, Mycobacterium
KRDTPDPIPG

SEQ ID NO: 1165062 - protein, 25 aa, Mycobacterium
KREHRADLTDTSPTDTIGPYPQWGE

SEQ ID NO: 1165063 - protein, 5 aa, Mycobacterium
KREIG

SEQ ID NO: 1165064 - protein, 6 aa, Mycobacterium
KREPGQ

SEQ ID NO: 1165065 - protein, 18 aa, Mycobacterium
KREYDASTGRAKSEADRL

SEQ ID NO: 1165066 - protein, 13 aa, Mycobacterium
KRFEPVDPKTSTE

SEQ ID NO: 1165067 - protein, 7 aa, Mycobacterium
KRFGGPG

SEQ ID NO: 1165068 - protein, 14 aa, Mycobacterium
KRFGPADAADAAKV

SEQ ID NO: 1165069 - protein, 11 aa, Mycobacterium
KRFRRTGTGKI

SEQ ID NO: 1165070 - protein, 8 aa, Mycobacterium
KRGAGNEI

SEQ ID NO: 1165071 - protein, 4 aa, Mycobacterium
KRGG

SEQ ID NO: 1165072 - protein, 10 aa, Mycobacterium
KRGGRPGPGI

SEQ ID NO: 1165073 - protein, 9 aa, Mycobacterium
KRGHSAEQI

SEQ ID NO: 1165074 - protein, 6 aa, Mycobacterium
KRGPGL

SEQ ID NO: 1165075 - protein, 11 aa, Mycobacterium
KRGSDDEHRER

SEQ ID NO: 1165076 - protein, 7 aa, Mycobacterium
KRGTPFP

SEQ ID NO: 1165077 - protein, 10 aa, Mycobacterium
KRIAGGTPAV

SEQ ID NO: 1165078 - protein, 14 aa, Mycobacterium
KRKPGQLSGGQQQR

SEQ ID NO: 1165079 - protein, 10 aa, Mycobacterium
KRLGESRKRD

SEQ ID NO: 1165080 - protein, 5 aa, Mycobacterium
KRLGR

SEQ ID NO: 1165081 - protein, 8 aa, Mycobacterium
KRLGTDKG

SEQ ID NO: 1165082 - protein, 6 aa, Mycobacterium
KRLKEN

SEQ ID NO: 1165083 - protein, 5 aa, Mycobacterium
KRNAD

SEQ ID NO: 1165084 - protein, 6 aa, Mycobacterium
KRNDGT

SEQ ID NO: 1165085 - protein, 7 aa, Mycobacterium
KRNPAAA

SEQ ID NO: 1165086 - protein, 7 aa, Mycobacterium
KRPALPE

SEQ ID NO: 1165087 - protein, 4 aa, Mycobacterium
KRPG

SEQ ID NO: 1165088 - protein, 7 aa, Mycobacterium
KRPGPDL

SEQ ID NO: 1165089 - protein, 31 aa, Mycobacterium
KRPGSAAARAAERASGEAAEQALGHHDDSQG

SEQ ID NO: 1165090 - protein, 14 aa, Mycobacterium
KRPGTPAADMPGQL

SEQ ID NO: 1165091 - protein, 5 aa, Mycobacterium
KRPHV

SEQ ID NO: 1165092 - protein, 16 aa, Mycobacterium
KRPRGRPRKTERDPAA

SEQ ID NO: 1165093 - protein, 6 aa, Mycobacterium
KRQQMS

SEQ ID NO: 1165094 - protein, 11 aa, Mycobacterium
KRQVGGDTADQ

SEQ ID NO: 1165095 - protein, 21 aa, Mycobacterium
KRRAAEAAAGVPANKRGRGLA

SEQ ID NO: 1165096 - protein, 4 aa, Mycobacterium
KRRN

SEQ ID NO: 1165097 - protein, 7 aa, Mycobacterium
KRRPEAS

SEQ ID NO: 1165098 - protein, 5 aa, Mycobacterium
KRSEL

SEQ ID NO: 1165099 - protein, 8 aa, Mycobacterium
KRTAQKVA

SEQ ID NO: 1165100 - protein, 7 aa, Mycobacterium
KRTDTRV

SEQ ID NO: 1165101 - protein, 5 aa, Mycobacterium
KRTGL

SEQ ID NO: 1165102 - protein, 9 aa, Mycobacterium
KRVEAEAKT

SEQ ID NO: 1165103 - protein, 14 aa, Mycobacterium
KRVSPGDGALRNPA

SEQ ID NO: 1165104 - protein, 10 aa, Mycobacterium
KRWPEERTTW

SEQ ID NO: 1165105 - protein, 6 aa, Mycobacterium
KRWPNG

SEQ ID NO: 1165106 - protein, 10 aa, Mycobacterium
KSAAETTGGL

SEQ ID NO: 1165107 - protein, 8 aa, Mycobacterium
KSAAGDVV

SEQ ID NO: 1165108 - protein, 20 aa, Mycobacterium
KSAAPPAGAPLPPPPPAAPG

SEQ ID NO: 1165109 - protein, 8 aa, Mycobacterium
KSAHPSAL

SEQ ID NO: 1165110 - protein, 9 aa, Mycobacterium
KSAKPGSPV

SEQ ID NO: 1165111 - protein, 10 aa, Mycobacterium
KSANGATYDA

SEQ ID NO: 1165112 - protein, 45 aa, Mycobacterium
KSAPRAEAATPAPPTPNRPRRRRRPPWRRDAAKDQQESDGPPTPA

SEQ ID NO: 1165113 - protein, 8 aa, Mycobacterium
KSAQSEAF

SEQ ID NO: 1165114 - protein, 14 aa, Mycobacterium
KSASQTRGSDKGEV

SEQ ID NO: 1165115 - protein, 6 aa, Mycobacterium
KSCAAQ

SEQ ID NO: 1165116 - protein, 7 aa, Mycobacterium
KSCPSSA

SEQ ID NO: 1165117 - protein, 15 aa, Mycobacterium
KSDIRESLDRFKTVF

SEQ ID NO: 1165118 - protein, 15 aa, Mycobacterium
KSDYPDGVDDHERPL

SEQ ID NO: 1165119 - protein, 4 aa, Mycobacterium
KSEA

SEQ ID NO: 1165120 - protein, 9 aa, Mycobacterium
KSEADGGFS

SEQ ID NO: 1165121 - protein, 19 aa, Mycobacterium
KSELPSTLKKSDAKAQRTF

SEQ ID NO: 1165122 - protein, 8 aa, Mycobacterium
KSESGNHL

SEQ ID NO: 1165123 - protein, 12 aa, Mycobacterium
KSFDQPVRDARA

SEQ ID NO: 1165124 - protein, 6 aa, Mycobacterium
KSGADY

SEQ ID NO: 1165125 - protein, 8 aa, Mycobacterium
KSGAPSFV

SEQ ID NO: 1165126 - protein, 21 aa, Mycobacterium
KSGAPSQAIGRATPVHGKPGR

SEQ ID NO: 1165127 - protein, 10 aa, Mycobacterium
KSGASSAEMA

SEQ ID NO: 1165128 - protein, 7 aa, Mycobacterium
KSGDDAI

SEQ ID NO: 1165129 - protein, 7 aa, Mycobacterium
KSGDNAL

SEQ ID NO: 1165130 - protein, 12 aa, Mycobacterium
KSGEPGESGEGQ

SEQ ID NO: 1165131 - protein, 6 aa, Mycobacterium
KSGEVE

SEQ ID NO: 1165132 - protein, 5 aa, Mycobacterium
KSGPV

SEQ ID NO: 1165133 - protein, 7 aa, Mycobacterium
KSGRVRD

SEQ ID NO: 1165134 - protein, 6 aa, Mycobacterium
KSGVTS

SEQ ID NO: 1165135 - protein, 11 aa, Mycobacterium
KSHPADDGGKA

SEQ ID NO: 1165136 - protein, 8 aa, Mycobacterium
KSHSGGGD

SEQ ID NO: 1165137 - protein, 6 aa, Mycobacterium
KSHSVT

SEQ ID NO: 1165138 - protein, 4 aa, Mycobacterium
KSIR

SEQ ID NO: 1165139 - protein, 7 aa, Mycobacterium
KSISRNG

SEQ ID NO: 1165140 - protein, 16 aa, Mycobacterium
KSITVGSQGSGTGEVS

SEQ ID NO: 1165141 - protein, 17 aa, Mycobacterium
KSLADDPFRAPDADTLG

SEQ ID NO: 1165142 - protein, 11 aa, Mycobacterium
KSLKNSVSPDE

SEQ ID NO: 1165143 - protein, 7 aa, Mycobacterium
KSLKSVG

SEQ ID NO: 1165144 - protein, 6 aa, Mycobacterium
KSLNTD

SEQ ID NO: 1165145 - protein, 7 aa, Mycobacterium
KSNGGTL

SEQ ID NO: 1165146 - protein, 7 aa, Mycobacterium
KSPEMTA

SEQ ID NO: 1165147 - protein, 9 aa, Mycobacterium
KSPGEARDQ

SEQ ID NO: 1165148 - protein, 8 aa, Mycobacterium
KSPLHDPD

SEQ ID NO: 1165149 - protein, 14 aa, Mycobacterium
KSPNAPYEAGRRGA

SEQ ID NO: 1165150 - protein, 8 aa, Mycobacterium
KSPPAAYA

SEQ ID NO: 1165151 - protein, 5 aa, Mycobacterium
KSPQM

SEQ ID NO: 1165152 - protein, 6 aa, Mycobacterium
KSPVPI

SEQ ID NO: 1165153 - protein, 6 aa, Mycobacterium
KSQGKK

SEQ ID NO: 1165154 - protein, 5 aa, Mycobacterium
KSQIR

SEQ ID NO: 1165155 - protein, 5 aa, Mycobacterium
KSQLP

SEQ ID NO: 1165156 - protein, 6 aa, Mycobacterium
KSQVGA

SEQ ID NO: 1165157 - protein, 6 aa, Mycobacterium
KSRNEI

SEQ ID NO: 1165158 - protein, 6 aa, Mycobacterium
KSRSVP

SEQ ID NO: 1165159 - protein, 8 aa, Mycobacterium
KSRVQGAD

SEQ ID NO: 1165160 - protein, 4 aa, Mycobacterium
KSSD

SEQ ID NO: 1165161 - protein, 5 aa, Mycobacterium
KSSDW

SEQ ID NO: 1165162 - protein, 8 aa, Mycobacterium
KSSERSTY

SEQ ID NO: 1165163 - protein, 14 aa, Mycobacterium
KSSGYGRELGREGI

SEQ ID NO: 1165164 - protein, 7 aa, Mycobacterium
KSSWQQT

SEQ ID NO: 1165165 - protein, 9 aa, Mycobacterium
KSTDASPVR

SEQ ID NO: 1165166 - protein, 8 aa, Mycobacterium
KSTGNGYP

SEQ ID NO: 1165167 - protein, 6 aa, Mycobacterium
KSVHSS

SEQ ID NO: 1165168 - protein, 5 aa, Mycobacterium
KSVKN

SEQ ID NO: 1165169 - protein, 4 aa, Mycobacterium
KSVN

SEQ ID NO: 1165170 - protein, 8 aa, Mycobacterium
KSVRQAQG

SEQ ID NO: 1165171 - protein, 6 aa, Mycobacterium
KSYGGA

SEQ ID NO: 1165172 - protein, 7 aa, Mycobacterium
KSYVGEH

SEQ ID NO: 1165173 - protein, 14 aa, Mycobacterium
KTAEEVAQLQAEGV

SEQ ID NO: 1165174 - protein, 6 aa, Mycobacterium
KTAGAA

SEQ ID NO: 1165175 - protein, 6 aa, Mycobacterium
KTANTY

SEQ ID NO: 1165176 - protein, 5 aa, Mycobacterium
KTAQA

SEQ ID NO: 1165177 - protein, 7 aa, Mycobacterium
KTARNHV

SEQ ID NO: 1165178 - protein, 7 aa, Mycobacterium
KTASYTV

SEQ ID NO: 1165179 - protein, 5 aa, Mycobacterium
KTDNR

SEQ ID NO: 1165180 - protein, 6 aa, Mycobacterium
KTDPTM

SEQ ID NO: 1165181 - protein, 6 aa, Mycobacterium
KTDVPV

SEQ ID NO: 1165182 - protein, 9 aa, Mycobacterium
KTEASGEPR

SEQ ID NO: 1165183 - protein, 8 aa, Mycobacterium
KTEFPSSE

SEQ ID NO: 1165184 - protein, 4 aa, Mycobacterium
KTEG

SEQ ID NO: 1165185 - protein, 16 aa, Mycobacterium
KTERSEKKESRGRSEF

SEQ ID NO: 1165186 - protein, 7 aa, Mycobacterium
KTGEPAP

SEQ ID NO: 1165187 - protein, 6 aa, Mycobacterium
KTGEQL

SEQ ID NO: 1165188 - protein, 7 aa, Mycobacterium
KTGKEFT

SEQ ID NO: 1165189 - protein, 5 aa, Mycobacterium
KTGQH

SEQ ID NO: 1165190 - protein, 5 aa, Mycobacterium
KTGQP

SEQ ID NO: 1165191 - protein, 4 aa, Mycobacterium
KTGR

SEQ ID NO: 1165192 - protein, 7 aa, Mycobacterium
KTGRPGA

SEQ ID NO: 1165193 - protein, 8 aa, Mycobacterium
KTGRSAEL

SEQ ID NO: 1165194 - protein, 7 aa, Mycobacterium
KTGRSYG

SEQ ID NO: 1165195 - protein, 6 aa, Mycobacterium
KTGSLA

SEQ ID NO: 1165196 - protein, 10 aa, Mycobacterium
KTKAGKGCGS

SEQ ID NO: 1165197 - protein, 22 aa, Mycobacterium
KTKATPADRAVEDYAQSARQLG

SEQ ID NO: 1165198 - protein, 5 aa, Mycobacterium
KTKTN

SEQ ID NO: 1165199 - protein, 9 aa, Mycobacterium
KTKTPAPDL

SEQ ID NO: 1165200 - protein, 4 aa, Mycobacterium
KTLA

SEQ ID NO: 1165201 - protein, 6 aa, Mycobacterium
KTLADA

SEQ ID NO: 1165202 - protein, 8 aa, Mycobacterium
KTLSDPTR

SEQ ID NO: 1165203 - protein, 10 aa, Mycobacterium
KTLSSPATLS

SEQ ID NO: 1165204 - protein, 5 aa, Mycobacterium
KTNEY

SEQ ID NO: 1165205 - protein, 6 aa, Mycobacterium
KTNGRI

SEQ ID NO: 1165206 - protein, 22 aa, Mycobacterium
KTNPQQPPAQQPPVNPQNPPLH

SEQ ID NO: 1165207 - protein, 8 aa, Mycobacterium
KTNTPRNF

SEQ ID NO: 1165208 - protein, 6 aa, Mycobacterium
KTPAAV

SEQ ID NO: 1165209 - protein, 6 aa, Mycobacterium
KTPEGA

SEQ ID NO: 1165210 - protein, 7 aa, Mycobacterium
KTPETAG

SEQ ID NO: 1165211 - protein, 8 aa, Mycobacterium
KTPPSRAE

SEQ ID NO: 1165212 - protein, 5 aa, Mycobacterium
KTPRS

SEQ ID NO: 1165213 - protein, 4 aa, Mycobacterium
KTRA

SEQ ID NO: 1165214 - protein, 12 aa, Mycobacterium
KTRLSSGDEYEQ

SEQ ID NO: 1165215 - protein, 16 aa, Mycobacterium
KTRNELEHEGQRHGVP

SEQ ID NO: 1165216 - protein, 6 aa, Mycobacterium
KTRRGL

SEQ ID NO: 1165217 - protein, 13 aa, Mycobacterium
KTSGGKYVAPPAI

SEQ ID NO: 1165218 - protein, 14 aa, Mycobacterium
KTSGIGARFGGPEG

SEQ ID NO: 1165219 - protein, 12 aa, Mycobacterium
KTSSGSPIPTYD

SEQ ID NO: 1165220 - protein, 8 aa, Mycobacterium
KTTPTHRA

SEQ ID NO: 1165221 - protein, 6 aa, Mycobacterium
KTTTDL

SEQ ID NO: 1165222 - protein, 10 aa, Mycobacterium
KTTTVPYRSG

SEQ ID NO: 1165223 - protein, 6 aa, Mycobacterium
KTVEAN

SEQ ID NO: 1165224 - protein, 8 aa, Mycobacterium
KTVRPEGD

SEQ ID NO: 1165225 - protein, 22 aa, Mycobacterium
KTVTQRWPSGIKDGAEFVIPTM

SEQ ID NO: 1165226 - protein, 76 aa, Mycobacterium
KTVTSEANRARRVGASKQTAPVAAAAAPQAAVEPEATEGPDADDSSALPEAEDTTASEASRSTETDDPTQDSDADK

SEQ ID NO: 1165227 - protein, 6 aa, Mycobacterium
KTWQEG

SEQ ID NO: 1165228 - protein, 6 aa, Mycobacterium
KTWSTS

SEQ ID NO: 1165229 - protein, 8 aa, Mycobacterium
KTYGRTSD

SEQ ID NO: 1165230 - protein, 5 aa, Mycobacterium
KVAAK

SEQ ID NO: 1165231 - protein, 5 aa, Mycobacterium
KVASW

SEQ ID NO: 1165232 - protein, 7 aa, Mycobacterium
KVDDPAI

SEQ ID NO: 1165233 - protein, 12 aa, Mycobacterium
KVDNDNASALRR

SEQ ID NO: 1165234 - protein, 10 aa, Mycobacterium
KVDPAADPAV

SEQ ID NO: 1165235 - protein, 8 aa, Mycobacterium
KVDPDAAA

SEQ ID NO: 1165236 - protein, 7 aa, Mycobacterium
KVDPKSD

SEQ ID NO: 1165237 - protein, 6 aa, Mycobacterium
KVDSGN

SEQ ID NO: 1165238 - protein, 8 aa, Mycobacterium
KVDSNHGT

SEQ ID NO: 1165239 - protein, 11 aa, Mycobacterium
KVDVTDSTVGA

SEQ ID NO: 1165240 - protein, 8 aa, Mycobacterium
KVEDDVAD

SEQ ID NO: 1165241 - protein, 14 aa, Mycobacterium
KVGDPAARDTEMGP

SEQ ID NO: 1165242 - protein, 20 aa, Mycobacterium
KVGDPGDKTAIGPVASKAQF

SEQ ID NO: 1165243 - protein, 4 aa, Mycobacterium
KVGE

SEQ ID NO: 1165244 - protein, 15 aa, Mycobacterium
KVGEAPKQSGVALPG

SEQ ID NO: 1165245 - protein, 21 aa, Mycobacterium
KVGGRGKAGGVKYAATADDAF

SEQ ID NO: 1165246 - protein, 23 aa, Mycobacterium
KVGNGDATVAPSGAGIHEVDVKV

SEQ ID NO: 1165247 - protein, 10 aa, Mycobacterium
KVGNGHPGTA

SEQ ID NO: 1165248 - protein, 10 aa, Mycobacterium
KVGPGDTAAA

SEQ ID NO: 1165249 - protein, 4 aa, Mycobacterium
KVGQ

SEQ ID NO: 1165250 - protein, 8 aa, Mycobacterium
KVMPGGTG

SEQ ID NO: 1165251 - protein, 5 aa, Mycobacterium
KVNDE

SEQ ID NO: 1165252 - protein, 4 aa, Mycobacterium
KVPG

SEQ ID NO: 1165253 - protein, 6 aa, Mycobacterium
KVPGRS

SEQ ID NO: 1165254 - protein, 6 aa, Mycobacterium
KVPPAS

SEQ ID NO: 1165255 - protein, 10 aa, Mycobacterium
KVPPKDFAPQ

SEQ ID NO: 1165256 - protein, 6 aa, Mycobacterium
KVPRER

SEQ ID NO: 1165257 - protein, 5 aa, Mycobacterium
KVQET

SEQ ID NO: 1165258 - protein, 22 aa, Mycobacterium
KVRAENRAKASVKGSGDGVTPA

SEQ ID NO: 1165259 - protein, 20 aa, Mycobacterium
KVRDAASSNWTDPEAQARAD

SEQ ID NO: 1165260 - protein, 6 aa, Mycobacterium
KVRPGE

SEQ ID NO: 1165261 - protein, 7 aa, Mycobacterium
KVRTRAG

SEQ ID NO: 1165262 - protein, 9 aa, Mycobacterium
KVSAEETAD

SEQ ID NO: 1165263 - protein, 9 aa, Mycobacterium
KVSGTAQRP

SEQ ID NO: 1165264 - protein, 6 aa, Mycobacterium
KVSSGS

SEQ ID NO: 1165265 - protein, 5 aa, Mycobacterium
KVSTR

SEQ ID NO: 1165266 - protein, 4 aa, Mycobacterium
KVTE

SEQ ID NO: 1165267 - protein, 7 aa, Mycobacterium
KVTENAE

SEQ ID NO: 1165268 - protein, 5 aa, Mycobacterium
KVTGR

SEQ ID NO: 1165269 - protein, 10 aa, Mycobacterium
KVTPKAPSRF

SEQ ID NO: 1165270 - protein, 6 aa, Mycobacterium
KWGRRG

SEQ ID NO: 1165271 - protein, 5 aa, Mycobacterium
KWQER

SEQ ID NO: 1165272 - protein, 10 aa, Mycobacterium
KWSPDSGETI

SEQ ID NO: 1165273 - protein, 4 aa, Mycobacterium
KYAN

SEQ ID NO: 1165274 - protein, 16 aa, Mycobacterium
KYAQERAKRLRPEGAD

SEQ ID NO: 1165275 - protein, 7 aa, Mycobacterium
KYDDAVE

SEQ ID NO: 1165276 - protein, 7 aa, Mycobacterium
KYGAPTY

SEQ ID NO: 1165277 - protein, 4 aa, Mycobacterium
KYGN

SEQ ID NO: 1165278 - protein, 6 aa, Mycobacterium
KYKEEA

SEQ ID NO: 1165279 - protein, 5 aa, Mycobacterium
KYPNV

SEQ ID NO: 1165280 - protein, 20 aa, Mycobacterium
KYSDGMSVRGEGESLDLEEG

SEQ ID NO: 1165281 - protein, 4 aa, Mycobacterium
KYTG

SEQ ID NO: 1165282 - protein, 4 aa, Mycobacterium
LAAD

SEQ ID NO: 1165283 - protein, 5 aa, Mycobacterium
LAADE

SEQ ID NO: 1165284 - protein, 7 aa, Mycobacterium
LAADPRA

SEQ ID NO: 1165285 - protein, 18 aa, Mycobacterium
LAADSPRTRHTSGITQPP

SEQ ID NO: 1165286 - protein, 4 aa, Mycobacterium
LAAE

SEQ ID NO: 1165287 - protein, 5 aa, Mycobacterium
LAAEG

SEQ ID NO: 1165288 - protein, 8 aa, Mycobacterium
LAAEPAVR

SEQ ID NO: 1165289 - protein, 21 aa, Mycobacterium
LAAERGVQSELTTASESPNHR

SEQ ID NO: 1165290 - protein, 10 aa, Mycobacterium
LAAESDAPVR

SEQ ID NO: 1165291 - protein, 11 aa, Mycobacterium
LAAGGPDTLPV

SEQ ID NO: 1165292 - protein, 7 aa, Mycobacterium
LAAGPDG

SEQ ID NO: 1165293 - protein, 7 aa, Mycobacterium
LAAGSGL

SEQ ID NO: 1165294 - protein, 4 aa, Mycobacterium
LAAP

SEQ ID NO: 1165295 - protein, 7 aa, Mycobacterium
LAAPPVA

SEQ ID NO: 1165296 - protein, 18 aa, Mycobacterium
LAAQAKSALDGTDDATLR

SEQ ID NO: 1165297 - protein, 6 aa, Mycobacterium
LAAQTG

SEQ ID NO: 1165298 - protein, 5 aa, Mycobacterium
LAARG

SEQ ID NO: 1165299 - protein, 8 aa, Mycobacterium
LAARSDEL

SEQ ID NO: 1165300 - protein, 6 aa, Mycobacterium
LAASGH

SEQ ID NO: 1165301 - protein, 12 aa, Mycobacterium
LAATELGEEDLT

SEQ ID NO: 1165302 - protein, 7 aa, Mycobacterium
LADAGQR

SEQ ID NO: 1165303 - protein, 7 aa, Mycobacterium
LADAPPE

SEQ ID NO: 1165304 - protein, 18 aa, Mycobacterium
LADDLGPGSVADLADSAR

SEQ ID NO: 1165305 - protein, 8 aa, Mycobacterium
LADGGAGV

SEQ ID NO: 1165306 - protein, 18 aa, Mycobacterium
LADGPLPTHYEPHESPVR

SEQ ID NO: 1165307 - protein, 8 aa, Mycobacterium
LADGSGSV

SEQ ID NO: 1165308 - protein, 9 aa, Mycobacterium
LADNGQGRA

SEQ ID NO: 1165309 - protein, 5 aa, Mycobacterium
LADPA

SEQ ID NO: 1165310 - protein, 5 aa, Mycobacterium
LADPD

SEQ ID NO: 1165311 - protein, 8 aa, Mycobacterium
LADPDDPT

SEQ ID NO: 1165312 - protein, 9 aa, Mycobacterium
LADPTRTET

SEQ ID NO: 1165313 - protein, 4 aa, Mycobacterium
LADQ

SEQ ID NO: 1165314 - protein, 8 aa, Mycobacterium
LADQPAGR

SEQ ID NO: 1165315 - protein, 8 aa, Mycobacterium
LADSDPYG

SEQ ID NO: 1165316 - protein, 8 aa, Mycobacterium
LADSGGDG

SEQ ID NO: 1165317 - protein, 11 aa, Mycobacterium
LADSPDIEGIP

SEQ ID NO: 1165318 - protein, 5 aa, Mycobacterium
LADTD

SEQ ID NO: 1165319 - protein, 10 aa, Mycobacterium
LADTGEADPV

SEQ ID NO: 1165320 - protein, 13 aa, Mycobacterium
LAEAAKAGTDGTD

SEQ ID NO: 1165321 - protein, 14 aa, Mycobacterium
LAEDRRAHPGDDLT

SEQ ID NO: 1165322 - protein, 9 aa, Mycobacterium
LAEEEPETA

SEQ ID NO: 1165323 - protein, 6 aa, Mycobacterium
LAEGGD

SEQ ID NO: 1165324 - protein, 7 aa, Mycobacterium
LAEGGRR

SEQ ID NO: 1165325 - protein, 7 aa, Mycobacterium
LAEGGTH

SEQ ID NO: 1165326 - protein, 8 aa, Mycobacterium
LAEGQRPT

SEQ ID NO: 1165327 - protein, 16 aa, Mycobacterium
LAEGRDEPLPSTIEDP

SEQ ID NO: 1165328 - protein, 9 aa, Mycobacterium
LAEKDPESL

SEQ ID NO: 1165329 - protein, 12 aa, Mycobacterium
LAEKKKQTGQPV

SEQ ID NO: 1165330 - protein, 6 aa, Mycobacterium
LAENYG

SEQ ID NO: 1165331 - protein, 23 aa, Mycobacterium
LAEQGSSREEFDANTRTEAEKAV

SEQ ID NO: 1165332 - protein, 6 aa, Mycobacterium
LAEQNR

SEQ ID NO: 1165333 - protein, 10 aa, Mycobacterium
LAERTGVPPE

SEQ ID NO: 1165334 - protein, 18 aa, Mycobacterium
LAERTNPAGRTGGVAEAL

SEQ ID NO: 1165335 - protein, 5 aa, Mycobacterium
LAESV

SEQ ID NO: 1165336 - protein, 18 aa, Mycobacterium
LAETEKEKRQQERAAKNG

SEQ ID NO: 1165337 - protein, 9 aa, Mycobacterium
LAGAGGTAY

SEQ ID NO: 1165338 - protein, 9 aa, Mycobacterium
LAGDSAPRS

SEQ ID NO: 1165339 - protein, 7 aa, Mycobacterium
LAGEPIT

SEQ ID NO: 1165340 - protein, 10 aa, Mycobacterium
LAGERGDDSV

SEQ ID NO: 1165341 - protein, 4 aa, Mycobacterium
LAGG

SEQ ID NO: 1165342 - protein, 42 aa, Mycobacterium
LAGGESDDAESRLPNLTQGQRVDAKELTPAGHQTSPPARYTE

SEQ ID NO: 1165343 - protein, 8 aa, Mycobacterium
LAGGKSTE

SEQ ID NO: 1165344 - protein, 6 aa, Mycobacterium
LAGGPA

SEQ ID NO: 1165345 - protein, 10 aa, Mycobacterium
LAGGPRRTEP

SEQ ID NO: 1165346 - protein, 26 aa, Mycobacterium
LAGGSDDLDPSDGVADDPWAPEDDWR

SEQ ID NO: 1165347 - protein, 5 aa, Mycobacterium
LAGGT

SEQ ID NO: 1165348 - protein, 6 aa, Mycobacterium
LAGGTD

SEQ ID NO: 1165349 - protein, 5 aa, Mycobacterium
LAGHP

SEQ ID NO: 1165350 - protein, 5 aa, Mycobacterium
LAGNT

SEQ ID NO: 1165351 - protein, 14 aa, Mycobacterium
LAGPAADAQRAQAT

SEQ ID NO: 1165352 - protein, 5 aa, Mycobacterium
LAGPD

SEQ ID NO: 1165353 - protein, 6 aa, Mycobacterium
LAGPDR

SEQ ID NO: 1165354 - protein, 5 aa, Mycobacterium
LAGQL

SEQ ID NO: 1165355 - protein, 4 aa, Mycobacterium
LAGR

SEQ ID NO: 1165356 - protein, 5 aa, Mycobacterium
LAGRA

SEQ ID NO: 1165357 - protein, 6 aa, Mycobacterium
LAGRGI

SEQ ID NO: 1165358 - protein, 13 aa, Mycobacterium
LAGRSGILDDLAE

SEQ ID NO: 1165359 - protein, 6 aa, Mycobacterium
LAGTSV

SEQ ID NO: 1165360 - protein, 6 aa, Mycobacterium
LAGTTR

SEQ ID NO: 1165361 - protein, 10 aa, Mycobacterium
LAKPGTAEEI

SEQ ID NO: 1165362 - protein, 8 aa, Mycobacterium
LAKSPNTA

SEQ ID NO: 1165363 - protein, 6 aa, Mycobacterium
LAKTKK

SEQ ID NO: 1165364 - protein, 10 aa, Mycobacterium
LANQSEQAQR

SEQ ID NO: 1165365 - protein, 7 aa, Mycobacterium
LAPAQWG

SEQ ID NO: 1165366 - protein, 8 aa, Mycobacterium
LAPDDSVS

SEQ ID NO: 1165367 - protein, 7 aa, Mycobacterium
LAPDGPV

SEQ ID NO: 1165368 - protein, 8 aa, Mycobacterium
LAPDGTAA

SEQ ID NO: 1165369 - protein, 9 aa, Mycobacterium
LAPDSRPAA

SEQ ID NO: 1165370 - protein, 9 aa, Mycobacterium
LAPDSSSEY

SEQ ID NO: 1165371 - protein, 9 aa, Mycobacterium
LAPEEPAQK

SEQ ID NO: 1165372 - protein, 4 aa, Mycobacterium
LAPG

SEQ ID NO: 1165373 - protein, 5 aa, Mycobacterium
LAPGA

SEQ ID NO: 1165374 - protein, 6 aa, Mycobacterium
LAPGAS

SEQ ID NO: 1165375 - protein, 12 aa, Mycobacterium
LAPGPDATTDDE

SEQ ID NO: 1165376 - protein, 6 aa, Mycobacterium
LAPGQR

SEQ ID NO: 1165377 - protein, 9 aa, Mycobacterium
LAPGTPLRD

SEQ ID NO: 1165378 - protein, 17 aa, Mycobacterium
LAPKDDEERQKAIDAGH

SEQ ID NO: 1165379 - protein, 10 aa, Mycobacterium
LAPNPDAQAE

SEQ ID NO: 1165380 - protein, 9 aa, Mycobacterium
LAPPAGPAS

SEQ ID NO: 1165381 - protein, 7 aa, Mycobacterium
LAPPPVD

SEQ ID NO: 1165382 - protein, 9 aa, Mycobacterium
LAPSGECKR

SEQ ID NO: 1165383 - protein, 7 aa, Mycobacterium
LAPSYGL

SEQ ID NO: 1165384 - protein, 13 aa, Mycobacterium
LAPVGGAGGGMGP

SEQ ID NO: 1165385 - protein, 5 aa, Mycobacterium
LAQAG

SEQ ID NO: 1165386 - protein, 8 aa, Mycobacterium
LAQDGDTS

SEQ ID NO: 1165387 - protein, 9 aa, Mycobacterium
LAQEKTGEH

SEQ ID NO: 1165388 - protein, 8 aa, Mycobacterium
LAQETGGH

SEQ ID NO: 1165389 - protein, 16 aa, Mycobacterium
LAQGDTDRPVAPSSPD

SEQ ID NO: 1165390 - protein, 12 aa, Mycobacterium
LAQHGDRRRATT

SEQ ID NO: 1165391 - protein, 5 aa, Mycobacterium
LAQNP

SEQ ID NO: 1165392 - protein, 7 aa, Mycobacterium
LAQNSVQ

SEQ ID NO: 1165393 - protein, 5 aa, Mycobacterium
LAQPG

SEQ ID NO: 1165394 - protein, 6 aa, Mycobacterium
LAQRGQ

SEQ ID NO: 1165395 - protein, 9 aa, Mycobacterium
LAQSAPEAV

SEQ ID NO: 1165396 - protein, 5 aa, Mycobacterium
LAQTA

SEQ ID NO: 1165397 - protein, 10 aa, Mycobacterium
LAQTAENNGF

SEQ ID NO: 1165398 - protein, 14 aa, Mycobacterium
LARDSNGTMICADC

SEQ ID NO: 1165399 - protein, 5 aa, Mycobacterium
LARPG

SEQ ID NO: 1165400 - protein, 7 aa, Mycobacterium
LARPGGT

SEQ ID NO: 1165401 - protein, 7 aa, Mycobacterium
LARRDDE

SEQ ID NO: 1165402 - protein, 13 aa, Mycobacterium
LARREGEKAEQPT

SEQ ID NO: 1165403 - protein, 11 aa, Mycobacterium
LARSQSADIGS

SEQ ID NO: 1165404 - protein, 8 aa, Mycobacterium
LASAAEAL

SEQ ID NO: 1165405 - protein, 7 aa, Mycobacterium
LASAGNA

SEQ ID NO: 1165406 - protein, 11 aa, Mycobacterium
LASASGTRVGA

SEQ ID NO: 1165407 - protein, 4 aa, Mycobacterium
LASD

SEQ ID NO: 1165408 - protein, 15 aa, Mycobacterium
LASEKNGVMICSDCA

SEQ ID NO: 1165409 - protein, 5 aa, Mycobacterium
LASGG

SEQ ID NO: 1165410 - protein, 9 aa, Mycobacterium
LASKQQAKA

SEQ ID NO: 1165411 - protein, 10 aa, Mycobacterium
LASNGTPQQI

SEQ ID NO: 1165412 - protein, 6 aa, Mycobacterium
LASPAG

SEQ ID NO: 1165413 - protein, 9 aa, Mycobacterium
LASPGPSDL

SEQ ID NO: 1165414 - protein, 10 aa, Mycobacterium
LASPPKEVRS

SEQ ID NO: 1165415 - protein, 7 aa, Mycobacterium
LASSSTI

SEQ ID NO: 1165416 - protein, 9 aa, Mycobacterium
LASVGTATL

SEQ ID NO: 1165417 - protein, 7 aa, Mycobacterium
LATESSG

SEQ ID NO: 1165418 - protein, 5 aa, Mycobacterium
LATGA

SEQ ID NO: 1165419 - protein, 9 aa, Mycobacterium
LATGATQRI

SEQ ID NO: 1165420 - protein, 5 aa, Mycobacterium
LATGG

SEQ ID NO: 1165421 - protein, 13 aa, Mycobacterium
LATGGEHYRRATP

SEQ ID NO: 1165422 - protein, 10 aa, Mycobacterium
LATNVDSADL

SEQ ID NO: 1165423 - protein, 15 aa, Mycobacterium
LATPDAAGRRPLDDT

SEQ ID NO: 1165424 - protein, 7 aa, Mycobacterium
LATPDDL

SEQ ID NO: 1165425 - protein, 8 aa, Mycobacterium
LATPPPRI

SEQ ID NO: 1165426 - protein, 5 aa, Mycobacterium
LATPR

SEQ ID NO: 1165427 - protein, 6 aa, Mycobacterium
LATQES

SEQ ID NO: 1165428 - protein, 9 aa, Mycobacterium
LATRGAPRD

SEQ ID NO: 1165429 - protein, 4 aa, Mycobacterium
LATS

SEQ ID NO: 1165430 - protein, 23 aa, Mycobacterium
LATYDGRNRVNPPLREAGDAEAL

SEQ ID NO: 1165431 - protein, 9 aa, Mycobacterium
LDAADQDRL

SEQ ID NO: 1165432 - protein, 10 aa, Mycobacterium
LDAAERRARV

SEQ ID NO: 1165433 - protein, 8 aa, Mycobacterium
LDAAGTPF

SEQ ID NO: 1165434 - protein, 11 aa, Mycobacterium
LDADGSPITVE

SEQ ID NO: 1165435 - protein, 9 aa, Mycobacterium
LDAETTSEF

SEQ ID NO: 1165436 - protein, 8 aa, Mycobacterium
LDAGDEPF

SEQ ID NO: 1165437 - protein, 9 aa, Mycobacterium
LDAGGSESL

SEQ ID NO: 1165438 - protein, 5 aa, Mycobacterium
LDAKY

SEQ ID NO: 1165439 - protein, 8 aa, Mycobacterium
LDAPADDL

SEQ ID NO: 1165440 - protein, 6 aa, Mycobacterium
LDAPQR

SEQ ID NO: 1165441 - protein, 23 aa, Mycobacterium
LDAQPDGALPPSAQPYSTPYPAP

SEQ ID NO: 1165442 - protein, 8 aa, Mycobacterium
LDARQGER

SEQ ID NO: 1165443 - protein, 6 aa, Mycobacterium
LDASPL

SEQ ID NO: 1165444 - protein, 7 aa, Mycobacterium
LDDDEVA

SEQ ID NO: 1165445 - protein, 5 aa, Mycobacterium
LDDDG

SEQ ID NO: 1165446 - protein, 7 aa, Mycobacterium
LDDDSAA

SEQ ID NO: 1165447 - protein, 7 aa, Mycobacterium
LDDEASL

SEQ ID NO: 1165448 - protein, 10 aa, Mycobacterium
LDDEGNGAMR

SEQ ID NO: 1165449 - protein, 6 aa, Mycobacterium
LDDGGA

SEQ ID NO: 1165450 - protein, 8 aa, Mycobacterium
LDDGPARV

SEQ ID NO: 1165451 - protein, 13 aa, Mycobacterium
LDDGSVPTASTPK

SEQ ID NO: 1165452 - protein, 5 aa, Mycobacterium
LDDHG

SEQ ID NO: 1165453 - protein, 6 aa, Mycobacterium
LDDKRT

SEQ ID NO: 1165454 - protein, 10 aa, Mycobacterium
LDDPERPEQD

SEQ ID NO: 1165455 - protein, 4 aa, Mycobacterium
LDDQ

SEQ ID NO: 1165456 - protein, 10 aa, Mycobacterium
LDDQTADRHR

SEQ ID NO: 1165457 - protein, 13 aa, Mycobacterium
LDDSKKLGEKERE

SEQ ID NO: 1165458 - protein, 10 aa, Mycobacterium
LDEAPASTLT

SEQ ID NO: 1165459 - protein, 5 aa, Mycobacterium
LDEDG

SEQ ID NO: 1165460 - protein, 7 aa, Mycobacterium
LDEDGDA

SEQ ID NO: 1165461 - protein, 17 aa, Mycobacterium
LDEEPDYAGAAAALEKA

SEQ ID NO: 1165462 - protein, 10 aa, Mycobacterium
LDEGKPDLAP

SEQ ID NO: 1165463 - protein, 8 aa, Mycobacterium
LDENHPDK

SEQ ID NO: 1165464 - protein, 6 aa, Mycobacterium
LDEPHE

SEQ ID NO: 1165465 - protein, 15 aa, Mycobacterium
LDEPIDSNAEYRDRQ

SEQ ID NO: 1165466 - protein, 5 aa, Mycobacterium
LDEPT

SEQ ID NO: 1165467 - protein, 7 aa, Mycobacterium
LDEQAAE

SEQ ID NO: 1165468 - protein, 10 aa, Mycobacterium
LDEQGRDATR

SEQ ID NO: 1165469 - protein, 71 aa, Mycobacterium
LDETATEVHQQAEANLESTREQAKREQMQAEQDREREIKESRETASERKQNAVQTAQKKAADAKQQADQIA

SEQ ID NO: 1165470 - protein, 15 aa, Mycobacterium
LDETETASPPPAGRG

SEQ ID NO: 1165471 - protein, 13 aa, Mycobacterium
LDGAMDQQKGAEI

SEQ ID NO: 1165472 - protein, 5 aa, Mycobacterium
LDGAP

SEQ ID NO: 1165473 - protein, 7 aa, Mycobacterium
LDGAQGA

SEQ ID NO: 1165474 - protein, 5 aa, Mycobacterium
LDGAR

SEQ ID NO: 1165475 - protein, 5 aa, Mycobacterium
LDGDD

SEQ ID NO: 1165476 - protein, 7 aa, Mycobacterium
LDGERPD

SEQ ID NO: 1165477 - protein, 7 aa, Mycobacterium
LDGESVG

SEQ ID NO: 1165478 - protein, 6 aa, Mycobacterium
LDGGAA

SEQ ID NO: 1165479 - protein, 16 aa, Mycobacterium
LDGGGSDVTAPKTVAT

SEQ ID NO: 1165480 - protein, 10 aa, Mycobacterium
LDGGPEHPSS

SEQ ID NO: 1165481 - protein, 12 aa, Mycobacterium
LDGGSTSQSAKV

SEQ ID NO: 1165482 - protein, 10 aa, Mycobacterium
LDGGTASGVA

SEQ ID NO: 1165483 - protein, 17 aa, Mycobacterium
LDGGTTYRSGARFGPSA

SEQ ID NO: 1165484 - protein, 4 aa, Mycobacterium
LDGH

SEQ ID NO: 1165485 - protein, 8 aa, Mycobacterium
LDGHDRGA

SEQ ID NO: 1165486 - protein, 5 aa, Mycobacterium
LDGLS

SEQ ID NO: 1165487 - protein, 6 aa, Mycobacterium
LDGNVT

SEQ ID NO: 1165488 - protein, 8 aa, Mycobacterium
LDGPDRDE

SEQ ID NO: 1165489 - protein, 9 aa, Mycobacterium
LDGPSSERH

SEQ ID NO: 1165490 - protein, 6 aa, Mycobacterium
LDGPYL

SEQ ID NO: 1165491 - protein, 9 aa, Mycobacterium
LDGQRTADV

SEQ ID NO: 1165492 - protein, 8 aa, Mycobacterium
LDGRADPG

SEQ ID NO: 1165493 - protein, 19 aa, Mycobacterium
LDGRARSAHSTVDKTEAER

SEQ ID NO: 1165494 - protein, 10 aa, Mycobacterium
LDGRPTDLPG

SEQ ID NO: 1165495 - protein, 9 aa, Mycobacterium
LDGRTYAGA

SEQ ID NO: 1165496 - protein, 7 aa, Mycobacterium
LDGSEWD

SEQ ID NO: 1165497 - protein, 15 aa, Mycobacterium
LDGSPAGGGSAAQSV

SEQ ID NO: 1165498 - protein, 9 aa, Mycobacterium
LDGTPLTAE

SEQ ID NO: 1165499 - protein, 10 aa, Mycobacterium
LDGTSTSLRE

SEQ ID NO: 1165500 - protein, 4 aa, Mycobacterium
LDIP

SEQ ID NO: 1165501 - protein, 9 aa, Mycobacterium
LDKEGAERA

SEQ ID NO: 1165502 - protein, 10 aa, Mycobacterium
LDKGDTEDGY

SEQ ID NO: 1165503 - protein, 8 aa, Mycobacterium
LDKPPGIA

SEQ ID NO: 1165504 - protein, 9 aa, Mycobacterium
LDKQSDGSW

SEQ ID NO: 1165505 - protein, 10 aa, Mycobacterium
LDLPPSPPKA

SEQ ID NO: 1165506 - protein, 4 aa, Mycobacterium
LDNA

SEQ ID NO: 1165507 - protein, 10 aa, Mycobacterium
LDNETREGAR

SEQ ID NO: 1165508 - protein, 14 aa, Mycobacterium
LDNRRTKYSIGSAA

SEQ ID NO: 1165509 - protein, 5 aa, Mycobacterium
LDPAA

SEQ ID NO: 1165510 - protein, 7 aa, Mycobacterium
LDPADGP

SEQ ID NO: 1165511 - protein, 9 aa, Mycobacterium
LDPATDAAA

SEQ ID NO: 1165512 - protein, 7 aa, Mycobacterium
LDPDATN

SEQ ID NO: 1165513 - protein, 7 aa, Mycobacterium
LDPDDAW

SEQ ID NO: 1165514 - protein, 13 aa, Mycobacterium
LDPDDDASARETM

SEQ ID NO: 1165515 - protein, 8 aa, Mycobacterium
LDPDEAAE

SEQ ID NO: 1165516 - protein, 17 aa, Mycobacterium
LDPDGTNSHLVDRFGEE

SEQ ID NO: 1165517 - protein, 6 aa, Mycobacterium
LDPDPG

SEQ ID NO: 1165518 - protein, 6 aa, Mycobacterium
LDPDSL

SEQ ID NO: 1165519 - protein, 5 aa, Mycobacterium
LDPDY

SEQ ID NO: 1165520 - protein, 4 aa, Mycobacterium
LDPE

SEQ ID NO: 1165521 - protein, 7 aa, Mycobacterium
LDPEDVE

SEQ ID NO: 1165522 - protein, 6 aa, Mycobacterium
LDPETL

SEQ ID NO: 1165523 - protein, 10 aa, Mycobacterium
LDPGGGDPAV

SEQ ID NO: 1165524 - protein, 6 aa, Mycobacterium
LDPHGL

SEQ ID NO: 1165525 - protein, 7 aa, Mycobacterium
LDPKLSH

SEQ ID NO: 1165526 - protein, 7 aa, Mycobacterium
LDPMDKN

SEQ ID NO: 1165527 - protein, 7 aa, Mycobacterium
LDPPGPD

SEQ ID NO: 1165528 - protein, 8 aa, Mycobacterium
LDPPGPGE

SEQ ID NO: 1165529 - protein, 6 aa, Mycobacterium
LDPQGQ

SEQ ID NO: 1165530 - protein, 4 aa, Mycobacterium
LDPR

SEQ ID NO: 1165531 - protein, 8 aa, Mycobacterium
LDPRKSGF

SEQ ID NO: 1165532 - protein, 14 aa, Mycobacterium
LDPSERAAATVYTS

SEQ ID NO: 1165533 - protein, 12 aa, Mycobacterium
LDPSGDRDRAAR

SEQ ID NO: 1165534 - protein, 13 aa, Mycobacterium
LDPSGNIVELFEN

SEQ ID NO: 1165535 - protein, 7 aa, Mycobacterium
LDPSGRV

SEQ ID NO: 1165536 - protein, 9 aa, Mycobacterium
LDPSNSVRH

SEQ ID NO: 1165537 - protein, 6 aa, Mycobacterium
LDPSPV

SEQ ID NO: 1165538 - protein, 12 aa, Mycobacterium
LDPSQPDDAPAR

SEQ ID NO: 1165539 - protein, 10 aa, Mycobacterium
LDPSSGGNTY

SEQ ID NO: 1165540 - protein, 9 aa, Mycobacterium
LDPTKGGVE

SEQ ID NO: 1165541 - protein, 5 aa, Mycobacterium
LDPVS

SEQ ID NO: 1165542 - protein, 9 aa, Mycobacterium
LDQAAGDPA

SEQ ID NO: 1165543 - protein, 10 aa, Mycobacterium
LDQPDTGTIT

SEQ ID NO: 1165544 - protein, 8 aa, Mycobacterium
LDQPTSDR

SEQ ID NO: 1165545 - protein, 4 aa, Mycobacterium
LDRE

SEQ ID NO: 1165546 - protein, 6 aa, Mycobacterium
LDRGGT

SEQ ID NO: 1165547 - protein, 8 aa, Mycobacterium
LDRKTDDA

SEQ ID NO: 1165548 - protein, 7 aa, Mycobacterium
LDRPDTT

SEQ ID NO: 1165549 - protein, 8 aa, Mycobacterium
LDRPGGSL

SEQ ID NO: 1165550 - protein, 8 aa, Mycobacterium
LDRRTATI

SEQ ID NO: 1165551 - protein, 8 aa, Mycobacterium
LDSDNLSE

SEQ ID NO: 1165552 - protein, 15 aa, Mycobacterium
LDSDTDPASLKSIVN

SEQ ID NO: 1165553 - protein, 9 aa, Mycobacterium
LDSEPGASV

SEQ ID NO: 1165554 - protein, 8 aa, Mycobacterium
LDSEPGRP

SEQ ID NO: 1165555 - protein, 7 aa, Mycobacterium
LDSPGDL

SEQ ID NO: 1165556 - protein, 7 aa, Mycobacterium
LDSSEAV

SEQ ID NO: 1165557 - protein, 15 aa, Mycobacterium
LDSSNRNVREAAERA

SEQ ID NO: 1165558 - protein, 5 aa, Mycobacterium
LDTAQ

SEQ ID NO: 1165559 - protein, 11 aa, Mycobacterium
LDTDRPASPLA

SEQ ID NO: 1165560 - protein, 8 aa, Mycobacterium
LDTEPFGG

SEQ ID NO: 1165561 - protein, 9 aa, Mycobacterium
LDTGKTASE

SEQ ID NO: 1165562 - protein, 10 aa, Mycobacterium
LDTKKYSPRL

SEQ ID NO: 1165563 - protein, 19 aa, Mycobacterium
LDTKPPRPLEDTSIPTGGI

SEQ ID NO: 1165564 - protein, 6 aa, Mycobacterium
LDTPIG

SEQ ID NO: 1165565 - protein, 19 aa, Mycobacterium
LDTPISDGDSVTILPAVAG

SEQ ID NO: 1165566 - protein, 5 aa, Mycobacterium
LDTPK

SEQ ID NO: 1165567 - protein, 7 aa, Mycobacterium
LDTPVPV

SEQ ID NO: 1165568 - protein, 14 aa, Mycobacterium
LDTPVTAQTARDFA

SEQ ID NO: 1165569 - protein, 8 aa, Mycobacterium
LDTSGGDV

SEQ ID NO: 1165570 - protein, 4 aa, Mycobacterium
LDTT

SEQ ID NO: 1165571 - protein, 6 aa, Mycobacterium
LDWPED

SEQ ID NO: 1165572 - protein, 5 aa, Mycobacterium
LEAEG

SEQ ID NO: 1165573 - protein, 22 aa, Mycobacterium
LEAEGAKSDVRRKVRDGGEREM

SEQ ID NO: 1165574 - protein, 7 aa, Mycobacterium
LEAGGAP

SEQ ID NO: 1165575 - protein, 18 aa, Mycobacterium
LEAGTRPEPDVTDAYDEA

SEQ ID NO: 1165576 - protein, 6 aa, Mycobacterium
LEANAP

SEQ ID NO: 1165577 - protein, 4 aa, Mycobacterium
LEAP

SEQ ID NO: 1165578 - protein, 7 aa, Mycobacterium
LEARGRG

SEQ ID NO: 1165579 - protein, 15 aa, Mycobacterium
LEASASRAQSRGGIA

SEQ ID NO: 1165580 - protein, 10 aa, Mycobacterium
LEASNDPQDL

SEQ ID NO: 1165581 - protein, 12 aa, Mycobacterium
LEASRPVGVSRL

SEQ ID NO: 1165582 - protein, 5 aa, Mycobacterium
LEDAE

SEQ ID NO: 1165583 - protein, 9 aa, Mycobacterium
LEDDPSRPR

SEQ ID NO: 1165584 - protein, 5 aa, Mycobacterium
LEDGP

SEQ ID NO: 1165585 - protein, 6 aa, Mycobacterium
LEDKGV

SEQ ID NO: 1165586 - protein, 10 aa, Mycobacterium
LEDKPADGYD

SEQ ID NO: 1165587 - protein, 8 aa, Mycobacterium
LEDPPPVK

SEQ ID NO: 1165588 - protein, 7 aa, Mycobacterium
LEDQGYD

SEQ ID NO: 1165589 - protein, 6 aa, Mycobacterium
LEDQQQ

SEQ ID NO: 1165590 - protein, 4 aa, Mycobacterium
LEEN

SEQ ID NO: 1165591 - protein, 5 aa, Mycobacterium
LEENP

SEQ ID NO: 1165592 - protein, 5 aa, Mycobacterium
LEENQ

SEQ ID NO: 1165593 - protein, 18 aa, Mycobacterium
LEEQPSAVRDRSAAITSD

SEQ ID NO: 1165594 - protein, 7 aa, Mycobacterium
LEESEEF

SEQ ID NO: 1165595 - protein, 12 aa, Mycobacterium
LEESSTAPSPGD

SEQ ID NO: 1165596 - protein, 5 aa, Mycobacterium
LEGAS

SEQ ID NO: 1165597 - protein, 6 aa, Mycobacterium
LEGDEK

SEQ ID NO: 1165598 - protein, 6 aa, Mycobacterium
LEGGRA

SEQ ID NO: 1165599 - protein, 16 aa, Mycobacterium
LEGKQGLTKPAGGPGT

SEQ ID NO: 1165600 - protein, 9 aa, Mycobacterium
LEGKQRASL

SEQ ID NO: 1165601 - protein, 13 aa, Mycobacterium
LEGLGDKRIEAEA

SEQ ID NO: 1165602 - protein, 4 aa, Mycobacterium
LEGP

SEQ ID NO: 1165603 - protein, 6 aa, Mycobacterium
LEGRDG

SEQ ID NO: 1165604 - protein, 69 aa, Mycobacterium
LEGSATAISNQDSEISQGDSDAGDTTGGTADAGTDSGTGGTSSADSGGSSDSGGSGSTGSSGDGGGSTA

SEQ ID NO: 1165605 - protein, 11 aa, Mycobacterium
LEGTDPAAAPR

SEQ ID NO: 1165606 - protein, 22 aa, Mycobacterium
LEHGTAGQERNDSGGGESGVEP

SEQ ID NO: 1165607 - protein, 9 aa, Mycobacterium
LEHPDGAES

SEQ ID NO: 1165608 - protein, 11 aa, Mycobacterium
LEHSDDLERAA

SEQ ID NO: 1165609 - protein, 14 aa, Mycobacterium
LENAQKGKAYSEKI

SEQ ID NO: 1165610 - protein, 7 aa, Mycobacterium
LENPGVD

SEQ ID NO: 1165611 - protein, 7 aa, Mycobacterium
LENQPTA

SEQ ID NO: 1165612 - protein, 11 aa, Mycobacterium
LENRSDDEAIT

SEQ ID NO: 1165613 - protein, 4 aa, Mycobacterium
LEPA

SEQ ID NO: 1165614 - protein, 4 aa, Mycobacterium
LEPD

SEQ ID NO: 1165615 - protein, 14 aa, Mycobacterium
LEPDARRGRGHSPH

SEQ ID NO: 1165616 - protein, 9 aa, Mycobacterium
LEPDPAAMA

SEQ ID NO: 1165617 - protein, 9 aa, Mycobacterium
LEPDSDGGF

SEQ ID NO: 1165618 - protein, 6 aa, Mycobacterium
LEPDTD

SEQ ID NO: 1165619 - protein, 6 aa, Mycobacterium
LEPEQR

SEQ ID NO: 1165620 - protein, 8 aa, Mycobacterium
LEPGAYSR

SEQ ID NO: 1165621 - protein, 15 aa, Mycobacterium
LEPGGRPDAPEPGPA

SEQ ID NO: 1165622 - protein, 5 aa, Mycobacterium
LEPGS

SEQ ID NO: 1165623 - protein, 5 aa, Mycobacterium
LEPMP

SEQ ID NO: 1165624 - protein, 6 aa, Mycobacterium
LEPMPD

SEQ ID NO: 1165625 - protein, 9 aa, Mycobacterium
LEPNGPTEK

SEQ ID NO: 1165626 - protein, 15 aa, Mycobacterium
LEPPAPTVTPAEPAV

SEQ ID NO: 1165627 - protein, 7 aa, Mycobacterium
LEPPTSG

SEQ ID NO: 1165628 - protein, 14 aa, Mycobacterium
LEPRADLPDPPRMP

SEQ ID NO: 1165629 - protein, 4 aa, Mycobacterium
LEPT

SEQ ID NO: 1165630 - protein, 10 aa, Mycobacterium
LEPTSGNTGI

SEQ ID NO: 1165631 - protein, 4 aa, Mycobacterium
LEQA

SEQ ID NO: 1165632 - protein, 11 aa, Mycobacterium
LEQEASDPNLW

SEQ ID NO: 1165633 - protein, 6 aa, Mycobacterium
LEQGTN

SEQ ID NO: 1165634 - protein, 14 aa, Mycobacterium
LEQPRAAVETAGGQ

SEQ ID NO: 1165635 - protein, 5 aa, Mycobacterium
LEQTP

SEQ ID NO: 1165636 - protein, 4 aa, Mycobacterium
LEQY

SEQ ID NO: 1165637 - protein, 5 aa, Mycobacterium
LERAQ

SEQ ID NO: 1165638 - protein, 12 aa, Mycobacterium
LERAQETAGPIA

SEQ ID NO: 1165639 - protein, 7 aa, Mycobacterium
LERDSAG

SEQ ID NO: 1165640 - protein, 19 aa, Mycobacterium
LERGVSAGKVTDREKSAAL

SEQ ID NO: 1165641 - protein, 8 aa, Mycobacterium
LERKPGQL

SEQ ID NO: 1165642 - protein, 5 aa, Mycobacterium
LERPD

SEQ ID NO: 1165643 - protein, 18 aa, Mycobacterium
LERTESRGGHTRDDYPSM

SEQ ID NO: 1165644 - protein, 6 aa, Mycobacterium
LERTSE

SEQ ID NO: 1165645 - protein, 5 aa, Mycobacterium
LESDG

SEQ ID NO: 1165646 - protein, 13 aa, Mycobacterium
LESEKPSPNGSAP

SEQ ID NO: 1165647 - protein, 17 aa, Mycobacterium
LESGGNGAERRTLGPST

SEQ ID NO: 1165648 - protein, 14 aa, Mycobacterium
LESGNLSVNSHSSV

SEQ ID NO: 1165649 - protein, 8 aa, Mycobacterium
LESGSPVR

SEQ ID NO: 1165650 - protein, 18 aa, Mycobacterium
LESGTDGWPPDGRAPQGC

SEQ ID NO: 1165651 - protein, 5 aa, Mycobacterium
LESPE

SEQ ID NO: 1165652 - protein, 5 aa, Mycobacterium
LESRD

SEQ ID NO: 1165653 - protein, 6 aa, Mycobacterium
LESSGV

SEQ ID NO: 1165654 - protein, 5 aa, Mycobacterium
LETEH

SEQ ID NO: 1165655 - protein, 14 aa, Mycobacterium
LETTPEDSRKDIHH

SEQ ID NO: 1165656 - protein, 9 aa, Mycobacterium
LEVPDSGPL

SEQ ID NO: 1165657 - protein, 13 aa, Mycobacterium
LEYPDGPRSVEPV

SEQ ID NO: 1165658 - protein, 7 aa, Mycobacterium
LFDTDDD

SEQ ID NO: 1165659 - protein, 7 aa, Mycobacterium
LFPPPDG

SEQ ID NO: 1165660 - protein, 16 aa, Mycobacterium
LGAAGATVDPDKRAQS

SEQ ID NO: 1165661 - protein, 4 aa, Mycobacterium
LGAD

SEQ ID NO: 1165662 - protein, 9 aa, Mycobacterium
LGADPGRIA

SEQ ID NO: 1165663 - protein, 6 aa, Mycobacterium
LGADRQ

SEQ ID NO: 1165664 - protein, 20 aa, Mycobacterium
LGAGGTGKGTAGTMRGATGA

SEQ ID NO: 1165665 - protein, 6 aa, Mycobacterium
LGAGQS

SEQ ID NO: 1165666 - protein, 9 aa, Mycobacterium
LGAGRSAAD

SEQ ID NO: 1165667 - protein, 9 aa, Mycobacterium
LGAPADSGA

SEQ ID NO: 1165668 - protein, 10 aa, Mycobacterium
LGAPGDVGNY

SEQ ID NO: 1165669 - protein, 10 aa, Mycobacterium
LGAPPSGNRL

SEQ ID NO: 1165670 - protein, 7 aa, Mycobacterium
LGAQRST

SEQ ID NO: 1165671 - protein, 11 aa, Mycobacterium
LGAQTDGERAA

SEQ ID NO: 1165672 - protein, 4 aa, Mycobacterium
LGAS

SEQ ID NO: 1165673 - protein, 9 aa, Mycobacterium
LGASPAAEL

SEQ ID NO: 1165674 - protein, 7 aa, Mycobacterium
LGATAEA

SEQ ID NO: 1165675 - protein, 8 aa, Mycobacterium
LGATTDTL

SEQ ID NO: 1165676 - protein, 6 aa, Mycobacterium
LGDAGR

SEQ ID NO: 1165677 - protein, 8 aa, Mycobacterium
LGDDAANP

SEQ ID NO: 1165678 - protein, 12 aa, Mycobacterium
LGDDADRAAQLD

SEQ ID NO: 1165679 - protein, 9 aa, Mycobacterium
LGDDATARQ

SEQ ID NO: 1165680 - protein, 12 aa, Mycobacterium
LGDDGEPTSDAE

SEQ ID NO: 1165681 - protein, 10 aa, Mycobacterium
LGDDPALARP

SEQ ID NO: 1165682 - protein, 10 aa, Mycobacterium
LGDDPSTLGA

SEQ ID NO: 1165683 - protein, 6 aa, Mycobacterium
LGDDYT

SEQ ID NO: 1165684 - protein, 9 aa, Mycobacterium
LGDEAGPAY

SEQ ID NO: 1165685 - protein, 5 aa, Mycobacterium
LGDEL

SEQ ID NO: 1165686 - protein, 5 aa, Mycobacterium
LGDET

SEQ ID NO: 1165687 - protein, 7 aa, Mycobacterium
LGDGALP

SEQ ID NO: 1165688 - protein, 9 aa, Mycobacterium
LGDGGQDRR

SEQ ID NO: 1165689 - protein, 5 aa, Mycobacterium
LGDGP

SEQ ID NO: 1165690 - protein, 21 aa, Mycobacterium
LGDGSPDTARDVSAAKVAASD

SEQ ID NO: 1165691 - protein, 12 aa, Mycobacterium
LGDGTSHWEGSA

SEQ ID NO: 1165692 - protein, 6 aa, Mycobacterium
LGDPQA

SEQ ID NO: 1165693 - protein, 9 aa, Mycobacterium
LGDQAAVDA

SEQ ID NO: 1165694 - protein, 7 aa, Mycobacterium
LGDQPEL

SEQ ID NO: 1165695 - protein, 10 aa, Mycobacterium
LGDQTQLPDI

SEQ ID NO: 1165696 - protein, 4 aa, Mycobacterium
LGDR

SEQ ID NO: 1165697 - protein, 15 aa, Mycobacterium
LGDRQRKALLEKFDQ

SEQ ID NO: 1165698 - protein, 7 aa, Mycobacterium
LGDRTTS

SEQ ID NO: 1165699 - protein, 10 aa, Mycobacterium
LGDTGADKKD

SEQ ID NO: 1165700 - protein, 12 aa, Mycobacterium
LGDTRARTRTGA

SEQ ID NO: 1165701 - protein, 5 aa, Mycobacterium
LGEAG

SEQ ID NO: 1165702 - protein, 9 aa, Mycobacterium
LGEATEDGL

SEQ ID NO: 1165703 - protein, 8 aa, Mycobacterium
LGEDGKPV

SEQ ID NO: 1165704 - protein, 11 aa, Mycobacterium
LGEDRVDPAPV

SEQ ID NO: 1165705 - protein, 5 aa, Mycobacterium
LGEER

SEQ ID NO: 1165706 - protein, 9 aa, Mycobacterium
LGENDTPAT

SEQ ID NO: 1165707 - protein, 15 aa, Mycobacterium
LGEPGDTVEVKDGYG

SEQ ID NO: 1165708 - protein, 12 aa, Mycobacterium
LGEPLNAEQTAR

SEQ ID NO: 1165709 - protein, 7 aa, Mycobacterium
LGEPQRL

SEQ ID NO: 1165710 - protein, 6 aa, Mycobacterium
LGERAG

SEQ ID NO: 1165711 - protein, 9 aa, Mycobacterium
LGERGTPPW

SEQ ID NO: 1165712 - protein, 7 aa, Mycobacterium
LGERPGQ

SEQ ID NO: 1165713 - protein, 7 aa, Mycobacterium
LGERPTM

SEQ ID NO: 1165714 - protein, 17 aa, Mycobacterium
LGESAGGGTLLRWCAPL

SEQ ID NO: 1165715 - protein, 11 aa, Mycobacterium
LGESRASARQL

SEQ ID NO: 1165716 - protein, 9 aa, Mycobacterium
LGETDAARR

SEQ ID NO: 1165717 - protein, 6 aa, Mycobacterium
LGEYQA

SEQ ID NO: 1165718 - protein, 7 aa, Mycobacterium
LGGAPKH

SEQ ID NO: 1165719 - protein, 8 aa, Mycobacterium
LGGAPPRT

SEQ ID NO: 1165720 - protein, 10 aa, Mycobacterium
LGGAQLPATV

SEQ ID NO: 1165721 - protein, 6 aa, Mycobacterium
LGGDEH

SEQ ID NO: 1165722 - protein, 9 aa, Mycobacterium
LGGDRAAGL

SEQ ID NO: 1165723 - protein, 7 aa, Mycobacterium
LGGDSAD

SEQ ID NO: 1165724 - protein, 6 aa, Mycobacterium
LGGEAL

SEQ ID NO: 1165725 - protein, 6 aa, Mycobacterium
LGGEGQ

SEQ ID NO: 1165726 - protein, 14 aa, Mycobacterium
LGGGDPGGADFDPD

SEQ ID NO: 1165727 - protein, 10 aa, Mycobacterium
LGGGDPSAAY

SEQ ID NO: 1165728 - protein, 6 aa, Mycobacterium
LGGGSR

SEQ ID NO: 1165729 - protein, 11 aa, Mycobacterium
LGGGSVSGNGV

SEQ ID NO: 1165730 - protein, 7 aa, Mycobacterium
LGGGTLR

SEQ ID NO: 1165731 - protein, 6 aa, Mycobacterium
LGGHGN

SEQ ID NO: 1165732 - protein, 5 aa, Mycobacterium
LGGKS

SEQ ID NO: 1165733 - protein, 7 aa, Mycobacterium
LGGPGYG

SEQ ID NO: 1165734 - protein, 6 aa, Mycobacterium
LGGPHT

SEQ ID NO: 1165735 - protein, 6 aa, Mycobacterium
LGGPNF

SEQ ID NO: 1165736 - protein, 10 aa, Mycobacterium
LGGPPVPEAV

SEQ ID NO: 1165737 - protein, 11 aa, Mycobacterium
LGGPTPADSPL

SEQ ID NO: 1165738 - protein, 17 aa, Mycobacterium
LGGPTQALATADEPAHS

SEQ ID NO: 1165739 - protein, 7 aa, Mycobacterium
LGGRGWQ

SEQ ID NO: 1165740 - protein, 11 aa, Mycobacterium
LGGRPVTTGTG

SEQ ID NO: 1165741 - protein, 12 aa, Mycobacterium
LGGRSPTVSPVA

SEQ ID NO: 1165742 - protein, 17 aa, Mycobacterium
LGGRTAAQAIEDGVEPR

SEQ ID NO: 1165743 - protein, 11 aa, Mycobacterium
LGGSEDGDEAG

SEQ ID NO: 1165744 - protein, 11 aa, Mycobacterium
LGGSPKGTPGA

SEQ ID NO: 1165745 - protein, 10 aa, Mycobacterium
LGGTDAPNSL

SEQ ID NO: 1165746 - protein, 13 aa, Mycobacterium
LGHKRKTKHHGEV

SEQ ID NO: 1165747 - protein, 27 aa, Mycobacterium
LGHPTRDPHGDPIPAADGRVPTPPARQ

SEQ ID NO: 1165748 - protein, 5 aa, Mycobacterium
LGHTG

SEQ ID NO: 1165749 - protein, 9 aa, Mycobacterium
LGKDAAREA

SEQ ID NO: 1165750 - protein, 9 aa, Mycobacterium
LGKPDKKAV

SEQ ID NO: 1165751 - protein, 8 aa, Mycobacterium
LGKSAPEI

SEQ ID NO: 1165752 - protein, 17 aa, Mycobacterium
LGLNTDKPITSSTLTEE

SEQ ID NO: 1165753 - protein, 7 aa, Mycobacterium
LGLPDDP

SEQ ID NO: 1165754 - protein, 5 aa, Mycobacterium
LGMPD

SEQ ID NO: 1165755 - protein, 8 aa, Mycobacterium
LGNPAAAR

SEQ ID NO: 1165756 - protein, 8 aa, Mycobacterium
LGNTPQRV

SEQ ID NO: 1165757 - protein, 8 aa, Mycobacterium
LGPAATLA

SEQ ID NO: 1165758 - protein, 23 aa, Mycobacterium
LGPAEKAPRGAKRQGAGATGRRQ

SEQ ID NO: 1165759 - protein, 7 aa, Mycobacterium
LGPAGAS

SEQ ID NO: 1165760 - protein, 7 aa, Mycobacterium
LGPAPDM

SEQ ID NO: 1165761 - protein, 9 aa, Mycobacterium
LGPATAGQI

SEQ ID NO: 1165762 - protein, 11 aa, Mycobacterium
LGPDGLGNSPA

SEQ ID NO: 1165763 - protein, 6 aa, Mycobacterium
LGPDQP

SEQ ID NO: 1165764 - protein, 4 aa, Mycobacterium
LGPE

SEQ ID NO: 1165765 - protein, 6 aa, Mycobacterium
LGPEDC

SEQ ID NO: 1165766 - protein, 6 aa, Mycobacterium
LGPEGK

SEQ ID NO: 1165767 - protein, 6 aa, Mycobacterium
LGPEHR

SEQ ID NO: 1165768 - protein, 5 aa, Mycobacterium
LGPEM

SEQ ID NO: 1165769 - protein, 7 aa, Mycobacterium
LGPEPDA

SEQ ID NO: 1165770 - protein, 9 aa, Mycobacterium
LGPERADRQ

SEQ ID NO: 1165771 - protein, 9 aa, Mycobacterium
LGPGPQPAV

SEQ ID NO: 1165772 - protein, 8 aa, Mycobacterium
LGPGRTRE

SEQ ID NO: 1165773 - protein, 6 aa, Mycobacterium
LGPGTL

SEQ ID NO: 1165774 - protein, 9 aa, Mycobacterium
LGPGTTEKA

SEQ ID NO: 1165775 - protein, 11 aa, Mycobacterium
LGPIRPPTTPA

SEQ ID NO: 1165776 - protein, 5 aa, Mycobacterium
LGPMG

SEQ ID NO: 1165777 - protein, 5 aa, Mycobacterium
LGPPI

SEQ ID NO: 1165778 - protein, 15 aa, Mycobacterium
LGPPREQLRRLETQV

SEQ ID NO: 1165779 - protein, 8 aa, Mycobacterium
LGPPSSLD

SEQ ID NO: 1165780 - protein, 8 aa, Mycobacterium
LGPQTGGA

SEQ ID NO: 1165781 - protein, 4 aa, Mycobacterium
LGPR

SEQ ID NO: 1165782 - protein, 5 aa, Mycobacterium
LGPRE

SEQ ID NO: 1165783 - protein, 6 aa, Mycobacterium
LGPRGR

SEQ ID NO: 1165784 - protein, 9 aa, Mycobacterium
LGPRPASPW

SEQ ID NO: 1165785 - protein, 9 aa, Mycobacterium
LGPSAPAES

SEQ ID NO: 1165786 - protein, 7 aa, Mycobacterium
LGPSARI

SEQ ID NO: 1165787 - protein, 10 aa, Mycobacterium
LGPSGKRPAY

SEQ ID NO: 1165788 - protein, 14 aa, Mycobacterium
LGPSLSDPGRRSVA

SEQ ID NO: 1165789 - protein, 19 aa, Mycobacterium
LGPTDAAYCGPEKRTRQTA

SEQ ID NO: 1165790 - protein, 11 aa, Mycobacterium
LGQDARAAAEE

SEQ ID NO: 1165791 - protein, 8 aa, Mycobacterium
LGQGGTSF

SEQ ID NO: 1165792 - protein, 11 aa, Mycobacterium
LGQGRSDDDPL

SEQ ID NO: 1165793 - protein, 10 aa, Mycobacterium
LGQQRSAVGP

SEQ ID NO: 1165794 - protein, 6 aa, Mycobacterium
LGRADS

SEQ ID NO: 1165795 - protein, 6 aa, Mycobacterium
LGRAGM

SEQ ID NO: 1165796 - protein, 10 aa, Mycobacterium
LGRAPTASEL

SEQ ID NO: 1165797 - protein, 7 aa, Mycobacterium
LGREPRG

SEQ ID NO: 1165798 - protein, 8 aa, Mycobacterium
LGRESEGQ

SEQ ID NO: 1165799 - protein, 6 aa, Mycobacterium
LGRGHT

SEQ ID NO: 1165800 - protein, 9 aa, Mycobacterium
LGRGKGAQA

SEQ ID NO: 1165801 - protein, 11 aa, Mycobacterium
LGRPGARDSAA

SEQ ID NO: 1165802 - protein, 10 aa, Mycobacterium
LGRPGTPEEI

SEQ ID NO: 1165803 - protein, 11 aa, Mycobacterium
LGRPPADDEFE

SEQ ID NO: 1165804 - protein, 10 aa, Mycobacterium
LGRPPTPTDL

SEQ ID NO: 1165805 - protein, 7 aa, Mycobacterium
LGRPTPC

SEQ ID NO: 1165806 - protein, 6 aa, Mycobacterium
LGRPVG

SEQ ID NO: 1165807 - protein, 7 aa, Mycobacterium
LGRQPEA

SEQ ID NO: 1165808 - protein, 6 aa, Mycobacterium
LGRRPA

SEQ ID NO: 1165809 - protein, 9 aa, Mycobacterium
LGRSENAVS

SEQ ID NO: 1165810 - protein, 9 aa, Mycobacterium
LGRSGQTKL

SEQ ID NO: 1165811 - protein, 9 aa, Mycobacterium
LGRSPTAQH

SEQ ID NO: 1165812 - protein, 10 aa, Mycobacterium
LGRSQAGAAA

SEQ ID NO: 1165813 - protein, 6 aa, Mycobacterium
LGSARD

SEQ ID NO: 1165814 - protein, 9 aa, Mycobacterium
LGSDPSVVR

SEQ ID NO: 1165815 - protein, 20 aa, Mycobacterium
LGSDTGRIAGATNSLADYNR

SEQ ID NO: 1165816 - protein, 11 aa, Mycobacterium
LGSEAQRERRK

SEQ ID NO: 1165817 - protein, 6 aa, Mycobacterium
LGSEHG

SEQ ID NO: 1165818 - protein, 33 aa, Mycobacterium
LGSGHNRRVQDDDPSVHAETDAFRNAGRQRDYR

SEQ ID NO: 1165819 - protein, 6 aa, Mycobacterium
LGSGQV

SEQ ID NO: 1165820 - protein, 8 aa, Mycobacterium
LGSGRSET

SEQ ID NO: 1165821 - protein, 6 aa, Mycobacterium
LGSLGD

SEQ ID NO: 1165822 - protein, 10 aa, Mycobacterium
LGSPQAAQTW

SEQ ID NO: 1165823 - protein, 6 aa, Mycobacterium
LGSQAD

SEQ ID NO: 1165824 - protein, 9 aa, Mycobacterium
LGSRTPGVM

SEQ ID NO: 1165825 - protein, 6 aa, Mycobacterium
LGSTGT

SEQ ID NO: 1165826 - protein, 7 aa, Mycobacterium
LGSVDED

SEQ ID NO: 1165827 - protein, 11 aa, Mycobacterium
LGTAPAQTLRA

SEQ ID NO: 1165828 - protein, 16 aa, Mycobacterium
LGTGEPPISGSTTVPA

SEQ ID NO: 1165829 - protein, 7 aa, Mycobacterium
LGTKPAG

SEQ ID NO: 1165830 - protein, 8 aa, Mycobacterium
LGTLDGQR

SEQ ID NO: 1165831 - protein, 6 aa, Mycobacterium
LGTLPG

SEQ ID NO: 1165832 - protein, 6 aa, Mycobacterium
LGTLTD

SEQ ID NO: 1165833 - protein, 18 aa, Mycobacterium
LGTNPRKSTKTGAGERDV

SEQ ID NO: 1165834 - protein, 13 aa, Mycobacterium
LGTNTDPYQRAEG

SEQ ID NO: 1165835 - protein, 7 aa, Mycobacterium
LGTPDAP

SEQ ID NO: 1165836 - protein, 7 aa, Mycobacterium
LGTPPAD

SEQ ID NO: 1165837 - protein, 7 aa, Mycobacterium
LGTPSGR

SEQ ID NO: 1165838 - protein, 8 aa, Mycobacterium
LGTSTADA

SEQ ID NO: 1165839 - protein, 9 aa, Mycobacterium
LGTTSTGLP

SEQ ID NO: 1165840 - protein, 12 aa, Mycobacterium
LGVDDPQYRHES

SEQ ID NO: 1165841 - protein, 5 aa, Mycobacterium
LGVDT

SEQ ID NO: 1165842 - protein, 6 aa, Mycobacterium
LGVGGR

SEQ ID NO: 1165843 - protein, 28 aa, Mycobacterium
LGVGSDSVRTNANADAWSANSPFTDEQQ

SEQ ID NO: 1165844 - protein, 4 aa, Mycobacterium
LGVP

SEQ ID NO: 1165845 - protein, 7 aa, Mycobacterium
LGVPGAA

SEQ ID NO: 1165846 - protein, 10 aa, Mycobacterium
LGYPGPDPVA

SEQ ID NO: 1165847 - protein, 15 aa, Mycobacterium
LGYPQPSNGDLSPWA

SEQ ID NO: 1165848 - protein, 16 aa, Mycobacterium
LHDAGDPGSGEASNMA

SEQ ID NO: 1165849 - protein, 5 aa, Mycobacterium
LHGPD

SEQ ID NO: 1165850 - protein, 14 aa, Mycobacterium
LHPDTNPDPSAAER

SEQ ID NO: 1165851 - protein, 13 aa, Mycobacterium
LHPPGKPDRARTE

SEQ ID NO: 1165852 - protein, 8 aa, Mycobacterium
LHPQDHGP

SEQ ID NO: 1165853 - protein, 8 aa, Mycobacterium
LHQGSDDE

SEQ ID NO: 1165854 - protein, 8 aa, Mycobacterium
LHSQERAH

SEQ ID NO: 1165855 - protein, 4 aa, Mycobacterium
LHTR

SEQ ID NO: 1165856 - protein, 11 aa, Mycobacterium
LIPAPRPGDPV

SEQ ID NO: 1165857 - protein, 8 aa, Mycobacterium
LKAKLDED

SEQ ID NO: 1165858 - protein, 14 aa, Mycobacterium
LKARPGDTAIEAGG

SEQ ID NO: 1165859 - protein, 7 aa, Mycobacterium
LKATGDP

SEQ ID NO: 1165860 - protein, 6 aa, Mycobacterium
LKDEPA

SEQ ID NO: 1165861 - protein, 4 aa, Mycobacterium
LKDG

SEQ ID NO: 1165862 - protein, 9 aa, Mycobacterium
LKDNPDELR

SEQ ID NO: 1165863 - protein, 7 aa, Mycobacterium
LKERTTD

SEQ ID NO: 1165864 - protein, 12 aa, Mycobacterium
LKGDGGSSWGNQ

SEQ ID NO: 1165865 - protein, 5 aa, Mycobacterium
LKGND

SEQ ID NO: 1165866 - protein, 10 aa, Mycobacterium
LKKSARGEYE

SEQ ID NO: 1165867 - protein, 10 aa, Mycobacterium
LKNQTYNTPA

SEQ ID NO: 1165868 - protein, 8 aa, Mycobacterium
LKPGDGEF

SEQ ID NO: 1165869 - protein, 14 aa, Mycobacterium
LKPGGHFDEVQPFA

SEQ ID NO: 1165870 - protein, 4 aa, Mycobacterium
LKQK

SEQ ID NO: 1165871 - protein, 5 aa, Mycobacterium
LKRDP

SEQ ID NO: 1165872 - protein, 9 aa, Mycobacterium
LKRSQSGQW

SEQ ID NO: 1165873 - protein, 5 aa, Mycobacterium
LKSGR

SEQ ID NO: 1165874 - protein, 9 aa, Mycobacterium
LKSTAYQYD

SEQ ID NO: 1165875 - protein, 12 aa, Mycobacterium
LKTAGPEDRRRA

SEQ ID NO: 1165876 - protein, 5 aa, Mycobacterium
LKTDR

SEQ ID NO: 1165877 - protein, 12 aa, Mycobacterium
LKTTTNRIAGRA

SEQ ID NO: 1165878 - protein, 13 aa, Mycobacterium
LLPGNKPQKSSKV

SEQ ID NO: 1165879 - protein, 9 aa, Mycobacterium
LMRPTGGKA

SEQ ID NO: 1165880 - protein, 13 aa, Mycobacterium
LNAAEGKADSDGA

SEQ ID NO: 1165881 - protein, 6 aa, Mycobacterium
LNAATK

SEQ ID NO: 1165882 - protein, 15 aa, Mycobacterium
LNANEQSKKDDNPLN

SEQ ID NO: 1165883 - protein, 4 aa, Mycobacterium
LNAP

SEQ ID NO: 1165884 - protein, 9 aa, Mycobacterium
LNASYNGYG

SEQ ID NO: 1165885 - protein, 4 aa, Mycobacterium
LNDA

SEQ ID NO: 1165886 - protein, 9 aa, Mycobacterium
LNDGPGESW

SEQ ID NO: 1165887 - protein, 7 aa, Mycobacterium
LNDPATG

SEQ ID NO: 1165888 - protein, 10 aa, Mycobacterium
LNEEKKPNSY

SEQ ID NO: 1165889 - protein, 9 aa, Mycobacterium
LNEPGAQAH

SEQ ID NO: 1165890 - protein, 14 aa, Mycobacterium
LNEQGQLAAPPAKE

SEQ ID NO: 1165891 - protein, 11 aa, Mycobacterium
LNESRGLDPAL

SEQ ID NO: 1165892 - protein, 11 aa, Mycobacterium
LNGARQVPGRH

SEQ ID NO: 1165893 - protein, 6 aa, Mycobacterium
LNGDGE

SEQ ID NO: 1165894 - protein, 5 aa, Mycobacterium
LNGDS

SEQ ID NO: 1165895 - protein, 5 aa, Mycobacterium
LNGPQ

SEQ ID NO: 1165896 - protein, 8 aa, Mycobacterium
LNGSGEMT

SEQ ID NO: 1165897 - protein, 8 aa, Mycobacterium
LNGSTPGG

SEQ ID NO: 1165898 - protein, 6 aa, Mycobacterium
LNGTGA

SEQ ID NO: 1165899 - protein, 8 aa, Mycobacterium
LNPAPTRE

SEQ ID NO: 1165900 - protein, 7 aa, Mycobacterium
LNPATGQ

SEQ ID NO: 1165901 - protein, 11 aa, Mycobacterium
LNPEQAQQAEW

SEQ ID NO: 1165902 - protein, 6 aa, Mycobacterium
LNPPAT

SEQ ID NO: 1165903 - protein, 6 aa, Mycobacterium
LNPQTG

SEQ ID NO: 1165904 - protein, 5 aa, Mycobacterium
LNQDQ

SEQ ID NO: 1165905 - protein, 21 aa, Mycobacterium
LNQPSGGTELATGAMRIDVGS

SEQ ID NO: 1165906 - protein, 14 aa, Mycobacterium
LNRAQRRASNGRSR

SEQ ID NO: 1165907 - protein, 4 aa, Mycobacterium
LNRE

SEQ ID NO: 1165908 - protein, 8 aa, Mycobacterium
LNRTPTGV

SEQ ID NO: 1165909 - protein, 11 aa, Mycobacterium
LNSRQSQHSEI

SEQ ID NO: 1165910 - protein, 11 aa, Mycobacterium
LNTGPGGRAQL

SEQ ID NO: 1165911 - protein, 15 aa, Mycobacterium
LNTPDPAETYSSSPH

SEQ ID NO: 1165912 - protein, 17 aa, Mycobacterium
LNTQPDPARDLPTVSAR

SEQ ID NO: 1165913 - protein, 7 aa, Mycobacterium
LPAAARE

SEQ ID NO: 1165914 - protein, 13 aa, Mycobacterium
LPAASRSEEERDG

SEQ ID NO: 1165915 - protein, 8 aa, Mycobacterium
LPADEAAA

SEQ ID NO: 1165916 - protein, 5 aa, Mycobacterium
LPADG

SEQ ID NO: 1165917 - protein, 7 aa, Mycobacterium
LPADGEW

SEQ ID NO: 1165918 - protein, 5 aa, Mycobacterium
LPADP

SEQ ID NO: 1165919 - protein, 10 aa, Mycobacterium
LPADPGRRGE

SEQ ID NO: 1165920 - protein, 9 aa, Mycobacterium
LPADQREHL

SEQ ID NO: 1165921 - protein, 9 aa, Mycobacterium
LPADTANLR

SEQ ID NO: 1165922 - protein, 13 aa, Mycobacterium
LPADYTETTTDTA

SEQ ID NO: 1165923 - protein, 9 aa, Mycobacterium
LPAEDPGPL

SEQ ID NO: 1165924 - protein, 7 aa, Mycobacterium
LPAGEAA

SEQ ID NO: 1165925 - protein, 8 aa, Mycobacterium
LPAGGGRF

SEQ ID NO: 1165926 - protein, 8 aa, Mycobacterium
LPAGQRDT

SEQ ID NO: 1165927 - protein, 19 aa, Mycobacterium
LPAGYERARRQRPVFANAA

SEQ ID NO: 1165928 - protein, 12 aa, Mycobacterium
LPANPPATQAEA

SEQ ID NO: 1165929 - protein, 10 aa, Mycobacterium
LPAPAAAPTL

SEQ ID NO: 1165930 - protein, 9 aa, Mycobacterium
LPAPPAPVA

SEQ ID NO: 1165931 - protein, 9 aa, Mycobacterium
LPAPPEDDV

SEQ ID NO: 1165932 - protein, 8 aa, Mycobacterium
LPAPPQPI

SEQ ID NO: 1165933 - protein, 10 aa, Mycobacterium
LPAREEDPYN

SEQ ID NO: 1165934 - protein, 8 aa, Mycobacterium
LPASQREE

SEQ ID NO: 1165935 - protein, 5 aa, Mycobacterium
LPASR

SEQ ID NO: 1165936 - protein, 4 aa, Mycobacterium
LPDA

SEQ ID NO: 1165937 - protein, 5 aa, Mycobacterium
LPDAE

SEQ ID NO: 1165938 - protein, 7 aa, Mycobacterium
LPDATQD

SEQ ID NO: 1165939 - protein, 8 aa, Mycobacterium
LPDDGVRE

SEQ ID NO: 1165940 - protein, 7 aa, Mycobacterium
LPDDPDY

SEQ ID NO: 1165941 - protein, 9 aa, Mycobacterium
LPDDPNAAI

SEQ ID NO: 1165942 - protein, 6 aa, Mycobacterium
LPDEGR

SEQ ID NO: 1165943 - protein, 6 aa, Mycobacterium
LPDETV

SEQ ID NO: 1165944 - protein, 9 aa, Mycobacterium
LPDGATLDG

SEQ ID NO: 1165945 - protein, 6 aa, Mycobacterium
LPDGGA

SEQ ID NO: 1165946 - protein, 6 aa, Mycobacterium
LPDGPH

SEQ ID NO: 1165947 - protein, 6 aa, Mycobacterium
LPDGSD

SEQ ID NO: 1165948 - protein, 11 aa, Mycobacterium
LPDGSEAPDNA

SEQ ID NO: 1165949 - protein, 10 aa, Mycobacterium
LPDGSLAERQ

SEQ ID NO: 1165950 - protein, 6 aa, Mycobacterium
LPDGSV

SEQ ID NO: 1165951 - protein, 28 aa, Mycobacterium
LPDGTPVSSGEGGRGVKVGGGGAHQPQF

SEQ ID NO: 1165952 - protein, 12 aa, Mycobacterium
LPDHDTAEREYA

SEQ ID NO: 1165953 - protein, 11 aa, Mycobacterium
LPDKTAETLTD

SEQ ID NO: 1165954 - protein, 4 aa, Mycobacterium
LPDP

SEQ ID NO: 1165955 - protein, 16 aa, Mycobacterium
LPDPAAGYPSSIPTIA

SEQ ID NO: 1165956 - protein, 5 aa, Mycobacterium
LPDPD

SEQ ID NO: 1165957 - protein, 7 aa, Mycobacterium
LPDPNHR

SEQ ID NO: 1165958 - protein, 8 aa, Mycobacterium
LPDPPQYA

SEQ ID NO: 1165959 - protein, 5 aa, Mycobacterium
LPDPV

SEQ ID NO: 1165960 - protein, 16 aa, Mycobacterium
LPDPVGTNVPTNPETV

SEQ ID NO: 1165961 - protein, 21 aa, Mycobacterium
LPDPVKGNAYTSGAERLPTTL

SEQ ID NO: 1165962 - protein, 6 aa, Mycobacterium
LPDSLA

SEQ ID NO: 1165963 - protein, 8 aa, Mycobacterium
LPDTKAGD

SEQ ID NO: 1165964 - protein, 5 aa, Mycobacterium
LPDTP

SEQ ID NO: 1165965 - protein, 6 aa, Mycobacterium
LPEAGS

SEQ ID NO: 1165966 - protein, 11 aa, Mycobacterium
LPEDAADTVTE

SEQ ID NO: 1165967 - protein, 12 aa, Mycobacterium
LPEDAGGIGGGA

SEQ ID NO: 1165968 - protein, 8 aa, Mycobacterium
LPEDQQRH

SEQ ID NO: 1165969 - protein, 26 aa, Mycobacterium
LPEEAQKSLGQQVPHPARLGDPDEYG

SEQ ID NO: 1165970 - protein, 7 aa, Mycobacterium
LPEEARA

SEQ ID NO: 1165971 - protein, 6 aa, Mycobacterium
LPEEPE

SEQ ID NO: 1165972 - protein, 9 aa, Mycobacterium
LPEETGLRP

SEQ ID NO: 1165973 - protein, 4 aa, Mycobacterium
LPEG

SEQ ID NO: 1165974 - protein, 5 aa, Mycobacterium
LPEGN

SEQ ID NO: 1165975 - protein, 14 aa, Mycobacterium
LPEGPRGWDAPTPA

SEQ ID NO: 1165976 - protein, 6 aa, Mycobacterium
LPEGRG

SEQ ID NO: 1165977 - protein, 9 aa, Mycobacterium
LPEGTPADK

SEQ ID NO: 1165978 - protein, 9 aa, Mycobacterium
LPEPDHAGD

SEQ ID NO: 1165979 - protein, 5 aa, Mycobacterium
LPEPF

SEQ ID NO: 1165980 - protein, 8 aa, Mycobacterium
LPEPGSYA

SEQ ID NO: 1165981 - protein, 8 aa, Mycobacterium
LPEPPLPG

SEQ ID NO: 1165982 - protein, 11 aa, Mycobacterium
LPEPQSTAQLR

SEQ ID NO: 1165983 - protein, 7 aa, Mycobacterium
LPEQDEL

SEQ ID NO: 1165984 - protein, 7 aa, Mycobacterium
LPESRAT

SEQ ID NO: 1165985 - protein, 4 aa, Mycobacterium
LPET

SEQ ID NO: 1165986 - protein, 11 aa, Mycobacterium
LPETLDKGARI

SEQ ID NO: 1165987 - protein, 11 aa, Mycobacterium
LPETSKAGARL

SEQ ID NO: 1165988 - protein, 5 aa, Mycobacterium
LPEYR

SEQ ID NO: 1165989 - protein, 6 aa, Mycobacterium
LPFTPG

SEQ ID NO: 1165990 - protein, 4 aa, Mycobacterium
LPGA

SEQ ID NO: 1165991 - protein, 14 aa, Mycobacterium
LPGAARAAAEASRP

SEQ ID NO: 1165992 - protein, 10 aa, Mycobacterium
LPGADLSGEE

SEQ ID NO: 1165993 - protein, 11 aa, Mycobacterium
LPGAEAVRAGR

SEQ ID NO: 1165994 - protein, 8 aa, Mycobacterium
LPGANADE

SEQ ID NO: 1165995 - protein, 5 aa, Mycobacterium
LPGAQ

SEQ ID NO: 1165996 - protein, 5 aa, Mycobacterium
LPGAR

SEQ ID NO: 1165997 - protein, 11 aa, Mycobacterium
LPGDPGYDSAA

SEQ ID NO: 1165998 - protein, 14 aa, Mycobacterium
LPGDRSDVRERSTT

SEQ ID NO: 1165999 - protein, 10 aa, Mycobacterium
LPGDVSDPDE

SEQ ID NO: 1166000 - protein, 8 aa, Mycobacterium
LPGESALG

SEQ ID NO: 1166001 - protein, 9 aa, Mycobacterium
LPGGAESGL

SEQ ID NO: 1166002 - protein, 5 aa, Mycobacterium
LPGGG

SEQ ID NO: 1166003 - protein, 6 aa, Mycobacterium
LPGGGF

SEQ ID NO: 1166004 - protein, 5 aa, Mycobacterium
LPGGK

SEQ ID NO: 1166005 - protein, 11 aa, Mycobacterium
LPGGSPRPYGG

SEQ ID NO: 1166006 - protein, 6 aa, Mycobacterium
LPGKPH

SEQ ID NO: 1166007 - protein, 19 aa, Mycobacterium
LPGLDSSRSTPPTSSTGPG

SEQ ID NO: 1166008 - protein, 27 aa, Mycobacterium
LPGLNSTSTLAAAAAPAVGGSDDPLTR

SEQ ID NO: 1166009 - protein, 6 aa, Mycobacterium
LPGPCG

SEQ ID NO: 1166010 - protein, 6 aa, Mycobacterium
LPGPEL

SEQ ID NO: 1166011 - protein, 5 aa, Mycobacterium
LPGPF

SEQ ID NO: 1166012 - protein, 6 aa, Mycobacterium
LPGPGA

SEQ ID NO: 1166013 - protein, 9 aa, Mycobacterium
LPGPGEPIE

SEQ ID NO: 1166014 - protein, 6 aa, Mycobacterium
LPGPRM

SEQ ID NO: 1166015 - protein, 5 aa, Mycobacterium
LPGRA

SEQ ID NO: 1166016 - protein, 7 aa, Mycobacterium
LPGRGPQ

SEQ ID NO: 1166017 - protein, 11 aa, Mycobacterium
LPGRGSTYSAS

SEQ ID NO: 1166018 - protein, 20 aa, Mycobacterium
LPGRPDAREGHRLLRPGIER

SEQ ID NO: 1166019 - protein, 8 aa, Mycobacterium
LPGRRGRA

SEQ ID NO: 1166020 - protein, 10 aa, Mycobacterium
LPGSASPVAI

SEQ ID NO: 1166021 - protein, 6 aa, Mycobacterium
LPGSEH

SEQ ID NO: 1166022 - protein, 11 aa, Mycobacterium
LPGSESDKMGP

SEQ ID NO: 1166023 - protein, 6 aa, Mycobacterium
LPGSGA

SEQ ID NO: 1166024 - protein, 9 aa, Mycobacterium
LPGSNPFGD

SEQ ID NO: 1166025 - protein, 15 aa, Mycobacterium
LPGSRNQLTDGVGEV

SEQ ID NO: 1166026 - protein, 9 aa, Mycobacterium
LPGSSAAET

SEQ ID NO: 1166027 - protein, 5 aa, Mycobacterium
LPGVD

SEQ ID NO: 1166028 - protein, 11 aa, Mycobacterium
LPHGPDEKNRV

SEQ ID NO: 1166029 - protein, 4 aa, Mycobacterium
LPHP

SEQ ID NO: 1166030 - protein, 7 aa, Mycobacterium
LPHPGDD

SEQ ID NO: 1166031 - protein, 6 aa, Mycobacterium
LPHTPD

SEQ ID NO: 1166032 - protein, 8 aa, Mycobacterium
LPIEGQPE

SEQ ID NO: 1166033 - protein, 9 aa, Mycobacterium
LPKGSTTEQ

SEQ ID NO: 1166034 - protein, 9 aa, Mycobacterium
LPKPGSGNV

SEQ ID NO: 1166035 - protein, 29 aa, Mycobacterium
LPKSAKANKVDKNADAQSAEQLQQQQQQQ

SEQ ID NO: 1166036 - protein, 10 aa, Mycobacterium
LPKSWDPGAV

SEQ ID NO: 1166037 - protein, 5 aa, Mycobacterium
LPLGA

SEQ ID NO: 1166038 - protein, 5 aa, Mycobacterium
LPLPE

SEQ ID NO: 1166039 - protein, 4 aa, Mycobacterium
LPLR

SEQ ID NO: 1166040 - protein, 6 aa, Mycobacterium
LPNAGH

SEQ ID NO: 1166041 - protein, 8 aa, Mycobacterium
LPNAPADV

SEQ ID NO: 1166042 - protein, 6 aa, Mycobacterium
LPNATE

SEQ ID NO: 1166043 - protein, 4 aa, Mycobacterium
LPNG

SEQ ID NO: 1166044 - protein, 4 aa, Mycobacterium
LPNI

SEQ ID NO: 1166045 - protein, 10 aa, Mycobacterium
LPNPEEPGAV

SEQ ID NO: 1166046 - protein, 16 aa, Mycobacterium
LPNQPGGSESTLPGPS

SEQ ID NO: 1166047 - protein, 4 aa, Mycobacterium
LPNR

SEQ ID NO: 1166048 - protein, 9 aa, Mycobacterium
LPNTTAVPT

SEQ ID NO: 1166049 - protein, 6 aa, Mycobacterium
LPPAAP

SEQ ID NO: 1166050 - protein, 11 aa, Mycobacterium
LPPAPSSTQGQ

SEQ ID NO: 1166051 - protein, 8 aa, Mycobacterium
LPPASDTS

SEQ ID NO: 1166052 - protein, 6 aa, Mycobacterium
LPPDRR

SEQ ID NO: 1166053 - protein, 6 aa, Mycobacterium
LPPDSW

SEQ ID NO: 1166054 - protein, 6 aa, Mycobacterium
LPPDTD

SEQ ID NO: 1166055 - protein, 6 aa, Mycobacterium
LPPDTP

SEQ ID NO: 1166056 - protein, 5 aa, Mycobacterium
LPPEA

SEQ ID NO: 1166057 - protein, 6 aa, Mycobacterium
LPPEGA

SEQ ID NO: 1166058 - protein, 5 aa, Mycobacterium
LPPEK

SEQ ID NO: 1166059 - protein, 7 aa, Mycobacterium
LPPEPQD

SEQ ID NO: 1166060 - protein, 5 aa, Mycobacterium
LPPGD

SEQ ID NO: 1166061 - protein, 7 aa, Mycobacterium
LPPGPPV

SEQ ID NO: 1166062 - protein, 14 aa, Mycobacterium
LPPGRRGERRDPEA

SEQ ID NO: 1166063 - protein, 9 aa, Mycobacterium
LPPGSEPHG

SEQ ID NO: 1166064 - protein, 6 aa, Mycobacterium
LPPGTL

SEQ ID NO: 1166065 - protein, 4 aa, Mycobacterium
LPPH

SEQ ID NO: 1166066 - protein, 5 aa, Mycobacterium
LPPHP

SEQ ID NO: 1166067 - protein, 9 aa, Mycobacterium
LPPIEEPDE

SEQ ID NO: 1166068 - protein, 6 aa, Mycobacterium
LPPKGQ

SEQ ID NO: 1166069 - protein, 5 aa, Mycobacterium
LPPLP

SEQ ID NO: 1166070 - protein, 6 aa, Mycobacterium
LPPLSP

SEQ ID NO: 1166071 - protein, 6 aa, Mycobacterium
LPPNQV

SEQ ID NO: 1166072 - protein, 29 aa, Mycobacterium
LPPNTNGRFARPPQHTSKAAAPKIPADQV

SEQ ID NO: 1166073 - protein, 6 aa, Mycobacterium
LPPPGY

SEQ ID NO: 1166074 - protein, 7 aa, Mycobacterium
LPPPQRD

SEQ ID NO: 1166075 - protein, 39 aa, Mycobacterium
LPPPSGPEPAEPADAADEQAGSTIPGGPDIRPALGDPAE

SEQ ID NO: 1166076 - protein, 11 aa, Mycobacterium
LPPQPDAPEED

SEQ ID NO: 1166077 - protein, 6 aa, Mycobacterium
LPPRDQ

SEQ ID NO: 1166078 - protein, 5 aa, Mycobacterium
LPPSD

SEQ ID NO: 1166079 - protein, 5 aa, Mycobacterium
LPPSE

SEQ ID NO: 1166080 - protein, 8 aa, Mycobacterium
LPPSGPVT

SEQ ID NO: 1166081 - protein, 6 aa, Mycobacterium
LPPSRT

SEQ ID NO: 1166082 - protein, 15 aa, Mycobacterium
LPPSYRSTSRDDGIS

SEQ ID NO: 1166083 - protein, 9 aa, Mycobacterium
LPPTAGNYS

SEQ ID NO: 1166084 - protein, 5 aa, Mycobacterium
LPPVS

SEQ ID NO: 1166085 - protein, 8 aa, Mycobacterium
LPQPIKDR

SEQ ID NO: 1166086 - protein, 5 aa, Mycobacterium
LPQRA

SEQ ID NO: 1166087 - protein, 17 aa, Mycobacterium
LPQRAPLSAPLGAPAAA

SEQ ID NO: 1166088 - protein, 11 aa, Mycobacterium
LPRADRVGSEI

SEQ ID NO: 1166089 - protein, 7 aa, Mycobacterium
LPRDGAE

SEQ ID NO: 1166090 - protein, 6 aa, Mycobacterium
LPREER

SEQ ID NO: 1166091 - protein, 8 aa, Mycobacterium
LPREERDE

SEQ ID NO: 1166092 - protein, 6 aa, Mycobacterium
LPRGLE

SEQ ID NO: 1166093 - protein, 10 aa, Mycobacterium
LPRGRQPITS

SEQ ID NO: 1166094 - protein, 7 aa, Mycobacterium
LPRKSDY

SEQ ID NO: 1166095 - protein, 4 aa, Mycobacterium
LPRL

SEQ ID NO: 1166096 - protein, 10 aa, Mycobacterium
LPRPGGDADL

SEQ ID NO: 1166097 - protein, 7 aa, Mycobacterium
LPRPGQT

SEQ ID NO: 1166098 - protein, 12 aa, Mycobacterium
LPRTPGDADPGG

SEQ ID NO: 1166099 - protein, 6 aa, Mycobacterium
LPRTPS

SEQ ID NO: 1166100 - protein, 7 aa, Mycobacterium
LPSAAAS

SEQ ID NO: 1166101 - protein, 12 aa, Mycobacterium
LPSAGGGGGGVV

SEQ ID NO: 1166102 - protein, 5 aa, Mycobacterium
LPSAV

SEQ ID NO: 1166103 - protein, 20 aa, Mycobacterium
LPSDTNGAVATKPGFSRPAS

SEQ ID NO: 1166104 - protein, 5 aa, Mycobacterium
LPSER

SEQ ID NO: 1166105 - protein, 7 aa, Mycobacterium
LPSGVDE

SEQ ID NO: 1166106 - protein, 8 aa, Mycobacterium
LPSHPGHD

SEQ ID NO: 1166107 - protein, 9 aa, Mycobacterium
LPSPGGRQE

SEQ ID NO: 1166108 - protein, 16 aa, Mycobacterium
LPSPPRGYTPAPPPEW

SEQ ID NO: 1166109 - protein, 6 aa, Mycobacterium
LPSPTE

SEQ ID NO: 1166110 - protein, 7 aa, Mycobacterium
LPSQEQV

SEQ ID NO: 1166111 - protein, 7 aa, Mycobacterium
LPSTATN

SEQ ID NO: 1166112 - protein, 5 aa, Mycobacterium
LPSTE

SEQ ID NO: 1166113 - protein, 7 aa, Mycobacterium
LPSTPKG

SEQ ID NO: 1166114 - protein, 7 aa, Mycobacterium
LPSTPSH

SEQ ID NO: 1166115 - protein, 10 aa, Mycobacterium
LPSTSPAQTM

SEQ ID NO: 1166116 - protein, 5 aa, Mycobacterium
LPTAE

SEQ ID NO: 1166117 - protein, 10 aa, Mycobacterium
LPTASTPQEA

SEQ ID NO: 1166118 - protein, 8 aa, Mycobacterium
LPTDGTGR

SEQ ID NO: 1166119 - protein, 8 aa, Mycobacterium
LPTDPAAQ

SEQ ID NO: 1166120 - protein, 6 aa, Mycobacterium
LPTDPG

SEQ ID NO: 1166121 - protein, 8 aa, Mycobacterium
LPTEKGRL

SEQ ID NO: 1166122 - protein, 19 aa, Mycobacterium
LPTGATEEWAGGTAPLGDR

SEQ ID NO: 1166123 - protein, 10 aa, Mycobacterium
LPTGDPEAAA

SEQ ID NO: 1166124 - protein, 6 aa, Mycobacterium
LPTGIR

SEQ ID NO: 1166125 - protein, 12 aa, Mycobacterium
LPTGPGASEDEW

SEQ ID NO: 1166126 - protein, 6 aa, Mycobacterium
LPTLAG

SEQ ID NO: 1166127 - protein, 8 aa, Mycobacterium
LPTNATGK

SEQ ID NO: 1166128 - protein, 10 aa, Mycobacterium
LPTPAGAVGG

SEQ ID NO: 1166129 - protein, 10 aa, Mycobacterium
LPTPEEARAH

SEQ ID NO: 1166130 - protein, 7 aa, Mycobacterium
LPTPETL

SEQ ID NO: 1166131 - protein, 5 aa, Mycobacterium
LPTPG

SEQ ID NO: 1166132 - protein, 5 aa, Mycobacterium
LPTPS

SEQ ID NO: 1166133 - protein, 9 aa, Mycobacterium
LPTPSGDTF

SEQ ID NO: 1166134 - protein, 8 aa, Mycobacterium
LPTQAEEW

SEQ ID NO: 1166135 - protein, 6 aa, Mycobacterium
LPTRED

SEQ ID NO: 1166136 - protein, 6 aa, Mycobacterium
LPTRPT

SEQ ID NO: 1166137 - protein, 9 aa, Mycobacterium
LPTSGGAAA

SEQ ID NO: 1166138 - protein, 20 aa, Mycobacterium
LPTTERPTGLRDALTLVGLE

SEQ ID NO: 1166139 - protein, 8 aa, Mycobacterium
LPTTPAGV

SEQ ID NO: 1166140 - protein, 11 aa, Mycobacterium
LPTYENDDTAT

SEQ ID NO: 1166141 - protein, 4 aa, Mycobacterium
LPVA

SEQ ID NO: 1166142 - protein, 7 aa, Mycobacterium
LPVDTTR

SEQ ID NO: 1166143 - protein, 8 aa, Mycobacterium
LPVPPRLG

SEQ ID NO: 1166144 - protein, 8 aa, Mycobacterium
LPVQPDPA

SEQ ID NO: 1166145 - protein, 12 aa, Mycobacterium
LPYTPAPEAPGY

SEQ ID NO: 1166146 - protein, 4 aa, Mycobacterium
LQAA

SEQ ID NO: 1166147 - protein, 11 aa, Mycobacterium
LQAAKDSQIRA

SEQ ID NO: 1166148 - protein, 4 aa, Mycobacterium
LQAG

SEQ ID NO: 1166149 - protein, 6 aa, Mycobacterium
LQDKKE

SEQ ID NO: 1166150 - protein, 17 aa, Mycobacterium
LQDPGGDIELGRQTDED

SEQ ID NO: 1166151 - protein, 4 aa, Mycobacterium
LQDQ

SEQ ID NO: 1166152 - protein, 4 aa, Mycobacterium
LQDR

SEQ ID NO: 1166153 - protein, 6 aa, Mycobacterium
LQDRGS

SEQ ID NO: 1166154 - protein, 5 aa, Mycobacterium
LQEAG

SEQ ID NO: 1166155 - protein, 5 aa, Mycobacterium
LQGAG

SEQ ID NO: 1166156 - protein, 7 aa, Mycobacterium
LQGASSV

SEQ ID NO: 1166157 - protein, 13 aa, Mycobacterium
LQGDPNSDKPDAH

SEQ ID NO: 1166158 - protein, 15 aa, Mycobacterium
LQGEPRPLLQLVAEP

SEQ ID NO: 1166159 - protein, 4 aa, Mycobacterium
LQGG

SEQ ID NO: 1166160 - protein, 5 aa, Mycobacterium
LQGNN

SEQ ID NO: 1166161 - protein, 8 aa, Mycobacterium
LQKRSTGR

SEQ ID NO: 1166162 - protein, 15 aa, Mycobacterium
LQNAREEVDDASHEP

SEQ ID NO: 1166163 - protein, 5 aa, Mycobacterium
LQNPA

SEQ ID NO: 1166164 - protein, 14 aa, Mycobacterium
LQPDSAAVAETARA

SEQ ID NO: 1166165 - protein, 5 aa, Mycobacterium
LQPDT

SEQ ID NO: 1166166 - protein, 5 aa, Mycobacterium
LQPGD

SEQ ID NO: 1166167 - protein, 9 aa, Mycobacterium
LQPPGEFPD

SEQ ID NO: 1166168 - protein, 8 aa, Mycobacterium
LQPSDTRD

SEQ ID NO: 1166169 - protein, 11 aa, Mycobacterium
LQQAGPPAVNT

SEQ ID NO: 1166170 - protein, 9 aa, Mycobacterium
LQQKAGPAR

SEQ ID NO: 1166171 - protein, 13 aa, Mycobacterium
LQRDRANQQPDAE

SEQ ID NO: 1166172 - protein, 20 aa, Mycobacterium
LQRGQAALTGPVARGDAPAI

SEQ ID NO: 1166173 - protein, 6 aa, Mycobacterium
LQRGSS

SEQ ID NO: 1166174 - protein, 14 aa, Mycobacterium
LQSATRAHDDGRSV

SEQ ID NO: 1166175 - protein, 11 aa, Mycobacterium
LQSDRTAARDA

SEQ ID NO: 1166176 - protein, 8 aa, Mycobacterium
LQSDSDGI

SEQ ID NO: 1166177 - protein, 8 aa, Mycobacterium
LQSERSYN

SEQ ID NO: 1166178 - protein, 8 aa, Mycobacterium
LQSGERTD

SEQ ID NO: 1166179 - protein, 11 aa, Mycobacterium
LQSGGSHMSST

SEQ ID NO: 1166180 - protein, 6 aa, Mycobacterium
LQSPDQ

SEQ ID NO: 1166181 - protein, 14 aa, Mycobacterium
LQTEQEQLQAYITR

SEQ ID NO: 1166182 - protein, 5 aa, Mycobacterium
LQTHG

SEQ ID NO: 1166183 - protein, 7 aa, Mycobacterium
LQTPDDV

SEQ ID NO: 1166184 - protein, 8 aa, Mycobacterium
LQTTEACG

SEQ ID NO: 1166185 - protein, 7 aa, Mycobacterium
LQTYTRD

SEQ ID NO: 1166186 - protein, 8 aa, Mycobacterium
LRAAGADE

SEQ ID NO: 1166187 - protein, 6 aa, Mycobacterium
LRAEGD

SEQ ID NO: 1166188 - protein, 4 aa, Mycobacterium
LRAG

SEQ ID NO: 1166189 - protein, 11 aa, Mycobacterium
LRAQRESDRAA

SEQ ID NO: 1166190 - protein, 13 aa, Mycobacterium
LRASSDTTPACTP

SEQ ID NO: 1166191 - protein, 8 aa, Mycobacterium
LRASTRKA

SEQ ID NO: 1166192 - protein, 4 aa, Mycobacterium
LRDA

SEQ ID NO: 1166193 - protein, 8 aa, Mycobacterium
LRDAERDL

SEQ ID NO: 1166194 - protein, 10 aa, Mycobacterium
LRDAGHDEVA

SEQ ID NO: 1166195 - protein, 10 aa, Mycobacterium
LRDDDPNSAI

SEQ ID NO: 1166196 - protein, 12 aa, Mycobacterium
LRDDRKDTFERR

SEQ ID NO: 1166197 - protein, 8 aa, Mycobacterium
LRDGPDGR

SEQ ID NO: 1166198 - protein, 10 aa, Mycobacterium
LRDGSDDVSV

SEQ ID NO: 1166199 - protein, 9 aa, Mycobacterium
LRDGTEERI

SEQ ID NO: 1166200 - protein, 15 aa, Mycobacterium
LRDPSDTPQYDESDG

SEQ ID NO: 1166201 - protein, 5 aa, Mycobacterium
LRDSP

SEQ ID NO: 1166202 - protein, 7 aa, Mycobacterium
LREAGGG

SEQ ID NO: 1166203 - protein, 7 aa, Mycobacterium
LREDPGL

SEQ ID NO: 1166204 - protein, 12 aa, Mycobacterium
LREETGLRAGTV

SEQ ID NO: 1166205 - protein, 19 aa, Mycobacterium
LREGDEVREGDPSRWNSAA

SEQ ID NO: 1166206 - protein, 12 aa, Mycobacterium
LRENGTAATGGR

SEQ ID NO: 1166207 - protein, 12 aa, Mycobacterium
LREPDPDRQRRI

SEQ ID NO: 1166208 - protein, 8 aa, Mycobacterium
LREPGDPF

SEQ ID NO: 1166209 - protein, 9 aa, Mycobacterium
LREPSDADA

SEQ ID NO: 1166210 - protein, 6 aa, Mycobacterium
LRERTR

SEQ ID NO: 1166211 - protein, 14 aa, Mycobacterium
LRESSSVDQRSGVS

SEQ ID NO: 1166212 - protein, 9 aa, Mycobacterium
LRGDADGAF

SEQ ID NO: 1166213 - protein, 8 aa, Mycobacterium
LRGDRDPL

SEQ ID NO: 1166214 - protein, 4 aa, Mycobacterium
LRGE

SEQ ID NO: 1166215 - protein, 13 aa, Mycobacterium
LRGPGKTRALAQS

SEQ ID NO: 1166216 - protein, 22 aa, Mycobacterium
LRGSADRATAPKGTAPGTNDEI

SEQ ID NO: 1166217 - protein, 4 aa, Mycobacterium
LRHR

SEQ ID NO: 1166218 - protein, 8 aa, Mycobacterium
LRNGNGPA

SEQ ID NO: 1166219 - protein, 11 aa, Mycobacterium
LRNKPGEPLPV

SEQ ID NO: 1166220 - protein, 5 aa, Mycobacterium
LRPDA

SEQ ID NO: 1166221 - protein, 12 aa, Mycobacterium
LRPDKTPDDVVW

SEQ ID NO: 1166222 - protein, 6 aa, Mycobacterium
LRPEDF

SEQ ID NO: 1166223 - protein, 8 aa, Mycobacterium
LRPEGKHG

SEQ ID NO: 1166224 - protein, 6 aa, Mycobacterium
LRPGDP

SEQ ID NO: 1166225 - protein, 6 aa, Mycobacterium
LRPGDT

SEQ ID NO: 1166226 - protein, 7 aa, Mycobacterium
LRPGGRA

SEQ ID NO: 1166227 - protein, 12 aa, Mycobacterium
LRPPADGELADE

SEQ ID NO: 1166228 - protein, 10 aa, Mycobacterium
LRPPDADSRV

SEQ ID NO: 1166229 - protein, 6 aa, Mycobacterium
LRPPPP

SEQ ID NO: 1166230 - protein, 8 aa, Mycobacterium
LRPQQRTA

SEQ ID NO: 1166231 - protein, 6 aa, Mycobacterium
LRPSDV

SEQ ID NO: 1166232 - protein, 10 aa, Mycobacterium
LRPSTTGADA

SEQ ID NO: 1166233 - protein, 6 aa, Mycobacterium
LRPTDP

SEQ ID NO: 1166234 - protein, 6 aa, Mycobacterium
LRQEDP

SEQ ID NO: 1166235 - protein, 10 aa, Mycobacterium
LRQESDPSIR

SEQ ID NO: 1166236 - protein, 8 aa, Mycobacterium
LRRDADSP

SEQ ID NO: 1166237 - protein, 5 aa, Mycobacterium
LRRDP

SEQ ID NO: 1166238 - protein, 11 aa, Mycobacterium
LRREGKSVPPH

SEQ ID NO: 1166239 - protein, 6 aa, Mycobacterium
LRRENG

SEQ ID NO: 1166240 - protein, 4 aa, Mycobacterium
LRRG

SEQ ID NO: 1166241 - protein, 6 aa, Mycobacterium
LRRGAT

SEQ ID NO: 1166242 - protein, 9 aa, Mycobacterium
LRRRESQAR

SEQ ID NO: 1166243 - protein, 4 aa, Mycobacterium
LRSA

SEQ ID NO: 1166244 - protein, 6 aa, Mycobacterium
LRSDPG

SEQ ID NO: 1166245 - protein, 8 aa, Mycobacterium
LRSGDSNL

SEQ ID NO: 1166246 - protein, 18 aa, Mycobacterium
LRSGPTPRPAHESTALQL

SEQ ID NO: 1166247 - protein, 8 aa, Mycobacterium
LRSRQTRE

SEQ ID NO: 1166248 - protein, 8 aa, Mycobacterium
LRSSAYSP

SEQ ID NO: 1166249 - protein, 5 aa, Mycobacterium
LRSTG

SEQ ID NO: 1166250 - protein, 6 aa, Mycobacterium
LRSTSA

SEQ ID NO: 1166251 - protein, 11 aa, Mycobacterium
LRTASNALPRR

SEQ ID NO: 1166252 - protein, 5 aa, Mycobacterium
LRTDA

SEQ ID NO: 1166253 - protein, 7 aa, Mycobacterium
LRTDDGA

SEQ ID NO: 1166254 - protein, 11 aa, Mycobacterium
LRTEDGDEFTA

SEQ ID NO: 1166255 - protein, 8 aa, Mycobacterium
LRTEPEAS

SEQ ID NO: 1166256 - protein, 6 aa, Mycobacterium
LRTGDA

SEQ ID NO: 1166257 - protein, 12 aa, Mycobacterium
LRTGSRTTPSFD

SEQ ID NO: 1166258 - protein, 14 aa, Mycobacterium
LRTPDKKVHAAPPE

SEQ ID NO: 1166259 - protein, 13 aa, Mycobacterium
LRTRASDAIADGA

SEQ ID NO: 1166260 - protein, 18 aa, Mycobacterium
LRTSPRSDEVAKTPAAQK

SEQ ID NO: 1166261 - protein, 4 aa, Mycobacterium
LRTT

SEQ ID NO: 1166262 - protein, 11 aa, Mycobacterium
LRTTTDNRQRL

SEQ ID NO: 1166263 - protein, 12 aa, Mycobacterium
LRVTSGPALERA

SEQ ID NO: 1166264 - protein, 19 aa, Mycobacterium
LSAAANAVAGVSGEQQDPE

SEQ ID NO: 1166265 - protein, 7 aa, Mycobacterium
LSAAGSR

SEQ ID NO: 1166266 - protein, 12 aa, Mycobacterium
LSAASAAVPGVG

SEQ ID NO: 1166267 - protein, 8 aa, Mycobacterium
LSAEEADA

SEQ ID NO: 1166268 - protein, 7 aa, Mycobacterium
LSAEQYR

SEQ ID NO: 1166269 - protein, 8 aa, Mycobacterium
LSAERGAA

SEQ ID NO: 1166270 - protein, 10 aa, Mycobacterium
LSAGEEAQAA

SEQ ID NO: 1166271 - protein, 10 aa, Mycobacterium
LSAGQTPGDV

SEQ ID NO: 1166272 - protein, 24 aa, Mycobacterium
LSAGTGEVASPEVTSTRIAPESRT

SEQ ID NO: 1166273 - protein, 9 aa, Mycobacterium
LSAKGAPTI

SEQ ID NO: 1166274 - protein, 8 aa, Mycobacterium
LSANAPVR

SEQ ID NO: 1166275 - protein, 9 aa, Mycobacterium
LSAPAAKER

SEQ ID NO: 1166276 - protein, 11 aa, Mycobacterium
LSAPEGADAVD

SEQ ID NO: 1166277 - protein, 8 aa, Mycobacterium
LSAPEVEH

SEQ ID NO: 1166278 - protein, 24 aa, Mycobacterium
LSAPGSRVAAETAGVQAEDRRQQM

SEQ ID NO: 1166279 - protein, 14 aa, Mycobacterium
LSAPKPAKPAGGEV

SEQ ID NO: 1166280 - protein, 9 aa, Mycobacterium
LSAPTTEAG

SEQ ID NO: 1166281 - protein, 5 aa, Mycobacterium
LSAQG

SEQ ID NO: 1166282 - protein, 7 aa, Mycobacterium
LSARPGL

SEQ ID NO: 1166283 - protein, 6 aa, Mycobacterium
LSASGG

SEQ ID NO: 1166284 - protein, 14 aa, Mycobacterium
LSATAGAALPIVAV

SEQ ID NO: 1166285 - protein, 8 aa, Mycobacterium
LSATQSAV

SEQ ID NO: 1166286 - protein, 7 aa, Mycobacterium
LSDASTE

SEQ ID NO: 1166287 - protein, 10 aa, Mycobacterium
LSDATSDEAV

SEQ ID NO: 1166288 - protein, 12 aa, Mycobacterium
LSDEAAQTGAQK

SEQ ID NO: 1166289 - protein, 7 aa, Mycobacterium
LSDEDVE

SEQ ID NO: 1166290 - protein, 4 aa, Mycobacterium
LSDK

SEQ ID NO: 1166291 - protein, 6 aa, Mycobacterium
LSDPAL

SEQ ID NO: 1166292 - protein, 5 aa, Mycobacterium
LSDPD

SEQ ID NO: 1166293 - protein, 19 aa, Mycobacterium
LSDPNADYGLEAPPRGESV

SEQ ID NO: 1166294 - protein, 6 aa, Mycobacterium
LSDSAV

SEQ ID NO: 1166295 - protein, 15 aa, Mycobacterium
LSDSTKINPSGGTLA

SEQ ID NO: 1166296 - protein, 6 aa, Mycobacterium
LSDTDH

SEQ ID NO: 1166297 - protein, 8 aa, Mycobacterium
LSDTPAGS

SEQ ID NO: 1166298 - protein, 6 aa, Mycobacterium
LSEAAE

SEQ ID NO: 1166299 - protein, 6 aa, Mycobacterium
LSEAGL

SEQ ID NO: 1166300 - protein, 6 aa, Mycobacterium
LSEANA

SEQ ID NO: 1166301 - protein, 4 aa, Mycobacterium
LSED

SEQ ID NO: 1166302 - protein, 6 aa, Mycobacterium
LSEDGT

SEQ ID NO: 1166303 - protein, 6 aa, Mycobacterium
LSEDPD

SEQ ID NO: 1166304 - protein, 8 aa, Mycobacterium
LSEDPELA

SEQ ID NO: 1166305 - protein, 6 aa, Mycobacterium
LSEDPR

SEQ ID NO: 1166306 - protein, 7 aa, Mycobacterium
LSEGERK

SEQ ID NO: 1166307 - protein, 12 aa, Mycobacterium
LSEGGPAAAEKA

SEQ ID NO: 1166308 - protein, 7 aa, Mycobacterium
LSELGRE

SEQ ID NO: 1166309 - protein, 9 aa, Mycobacterium
LSEPTGAGV

SEQ ID NO: 1166310 - protein, 5 aa, Mycobacterium
LSEPV

SEQ ID NO: 1166311 - protein, 7 aa, Mycobacterium
LSEQAQR

SEQ ID NO: 1166312 - protein, 11 aa, Mycobacterium
LSESAISGSVD

SEQ ID NO: 1166313 - protein, 10 aa, Mycobacterium
LSESDGEGVA

SEQ ID NO: 1166314 - protein, 6 aa, Mycobacterium
LSETFG

SEQ ID NO: 1166315 - protein, 12 aa, Mycobacterium
LSETRWDGEGLR

SEQ ID NO: 1166316 - protein, 17 aa, Mycobacterium
LSGAGADAAAPRAAGGA

SEQ ID NO: 1166317 - protein, 7 aa, Mycobacterium
LSGAPVD

SEQ ID NO: 1166318 - protein, 11 aa, Mycobacterium
LSGDDSPAGVE

SEQ ID NO: 1166319 - protein, 8 aa, Mycobacterium
LSGDEKDA

SEQ ID NO: 1166320 - protein, 6 aa, Mycobacterium
LSGETN

SEQ ID NO: 1166321 - protein, 8 aa, Mycobacterium
LSGGGEAL

SEQ ID NO: 1166322 - protein, 8 aa, Mycobacterium
LSGGGKEV

SEQ ID NO: 1166323 - protein, 5 aa, Mycobacterium
LSGGM

SEQ ID NO: 1166324 - protein, 8 aa, Mycobacterium
LSGGQAAR

SEQ ID NO: 1166325 - protein, 13 aa, Mycobacterium
LSGHGDSGTRQSY

SEQ ID NO: 1166326 - protein, 7 aa, Mycobacterium
LSGPDGL

SEQ ID NO: 1166327 - protein, 7 aa, Mycobacterium
LSGPGKR

SEQ ID NO: 1166328 - protein, 36 aa, Mycobacterium
LSGQAKEALGRGASEVGTSTTTGDGGMTPEERGQSK

SEQ ID NO: 1166329 - protein, 8 aa, Mycobacterium
LSGQTPSV

SEQ ID NO: 1166330 - protein, 7 aa, Mycobacterium
LSGRRGR

SEQ ID NO: 1166331 - protein, 6 aa, Mycobacterium
LSGRSE

SEQ ID NO: 1166332 - protein, 17 aa, Mycobacterium
LSGSASSTLVRSGRADW

SEQ ID NO: 1166333 - protein, 8 aa, Mycobacterium
LSGSGDIR

SEQ ID NO: 1166334 - protein, 8 aa, Mycobacterium
LSGSPGMS

SEQ ID NO: 1166335 - protein, 11 aa, Mycobacterium
LSGSVVPQQQG

SEQ ID NO: 1166336 - protein, 10 aa, Mycobacterium
LSGTTRSAAV

SEQ ID NO: 1166337 - protein, 9 aa, Mycobacterium
LSKATARTT

SEQ ID NO: 1166338 - protein, 6 aa, Mycobacterium
LSKSQV

SEQ ID NO: 1166339 - protein, 4 aa, Mycobacterium
LSNG

SEQ ID NO: 1166340 - protein, 8 aa, Mycobacterium
LSNGDEVQ

SEQ ID NO: 1166341 - protein, 8 aa, Mycobacterium
LSNSPQPT

SEQ ID NO: 1166342 - protein, 6 aa, Mycobacterium
LSPAGM

SEQ ID NO: 1166343 - protein, 10 aa, Mycobacterium
LSPASGKPLA

SEQ ID NO: 1166344 - protein, 9 aa, Mycobacterium
LSPASTWRD

SEQ ID NO: 1166345 - protein, 9 aa, Mycobacterium
LSPCPAPRD

SEQ ID NO: 1166346 - protein, 4 aa, Mycobacterium
LSPD

SEQ ID NO: 1166347 - protein, 7 aa, Mycobacterium
LSPDPRQ

SEQ ID NO: 1166348 - protein, 6 aa, Mycobacterium
LSPDRL

SEQ ID NO: 1166349 - protein, 4 aa, Mycobacterium
LSPE

SEQ ID NO: 1166350 - protein, 9 aa, Mycobacterium
LSPEDRQTL

SEQ ID NO: 1166351 - protein, 15 aa, Mycobacterium
LSPEEQADKFRMAWS

SEQ ID NO: 1166352 - protein, 6 aa, Mycobacterium
LSPEPV

SEQ ID NO: 1166353 - protein, 7 aa, Mycobacterium
LSPEQPA

SEQ ID NO: 1166354 - protein, 6 aa, Mycobacterium
LSPETA

SEQ ID NO: 1166355 - protein, 8 aa, Mycobacterium
LSPGADVE

SEQ ID NO: 1166356 - protein, 11 aa, Mycobacterium
LSPGASGGSRL

SEQ ID NO: 1166357 - protein, 8 aa, Mycobacterium
LSPGGTIR

SEQ ID NO: 1166358 - protein, 6 aa, Mycobacterium
LSPKRY

SEQ ID NO: 1166359 - protein, 5 aa, Mycobacterium
LSPLS

SEQ ID NO: 1166360 - protein, 6 aa, Mycobacterium
LSPNRD

SEQ ID NO: 1166361 - protein, 9 aa, Mycobacterium
LSPQETVTA

SEQ ID NO: 1166362 - protein, 12 aa, Mycobacterium
LSPREGAAIGTA

SEQ ID NO: 1166363 - protein, 11 aa, Mycobacterium
LSPSAGTVSVT

SEQ ID NO: 1166364 - protein, 11 aa, Mycobacterium
LSPSPAKAVQE

SEQ ID NO: 1166365 - protein, 8 aa, Mycobacterium
LSPSQRTE

SEQ ID NO: 1166366 - protein, 12 aa, Mycobacterium
LSPSRAAAEDVR

SEQ ID NO: 1166367 - protein, 12 aa, Mycobacterium
LSPTAPTSSAAI

SEQ ID NO: 1166368 - protein, 6 aa, Mycobacterium
LSPTEG

SEQ ID NO: 1166369 - protein, 19 aa, Mycobacterium
LSQESKSRARDAAQRATDI

SEQ ID NO: 1166370 - protein, 6 aa, Mycobacterium
LSQGTD

SEQ ID NO: 1166371 - protein, 9 aa, Mycobacterium
LSQGTIKGD

SEQ ID NO: 1166372 - protein, 9 aa, Mycobacterium
LSQNARERN

SEQ ID NO: 1166373 - protein, 7 aa, Mycobacterium
LSQQPRF

SEQ ID NO: 1166374 - protein, 10 aa, Mycobacterium
LSQSYAGATM

SEQ ID NO: 1166375 - protein, 6 aa, Mycobacterium
LSQTRR

SEQ ID NO: 1166376 - protein, 9 aa, Mycobacterium
LSRDTDDTV

SEQ ID NO: 1166377 - protein, 7 aa, Mycobacterium
LSRPEER

SEQ ID NO: 1166378 - protein, 13 aa, Mycobacterium
LSRPRRPDDPAEA

SEQ ID NO: 1166379 - protein, 5 aa, Mycobacterium
LSRQD

SEQ ID NO: 1166380 - protein, 5 aa, Mycobacterium
LSRRA

SEQ ID NO: 1166381 - protein, 8 aa, Mycobacterium
LSRTGRPD

SEQ ID NO: 1166382 - protein, 9 aa, Mycobacterium
LSSDTDTDP

SEQ ID NO: 1166383 - protein, 8 aa, Mycobacterium
LSSNPIGA

SEQ ID NO: 1166384 - protein, 8 aa, Mycobacterium
LSSPSGLG

SEQ ID NO: 1166385 - protein, 4 aa, Mycobacterium
LSSR

SEQ ID NO: 1166386 - protein, 21 aa, Mycobacterium
LSSRGDQELGTAAVGDRIVGL

SEQ ID NO: 1166387 - protein, 5 aa, Mycobacterium
LSSSA

SEQ ID NO: 1166388 - protein, 9 aa, Mycobacterium
LSSSKYAID

SEQ ID NO: 1166389 - protein, 8 aa, Mycobacterium
LSSSRETA

SEQ ID NO: 1166390 - protein, 6 aa, Mycobacterium
LSTDDL

SEQ ID NO: 1166391 - protein, 15 aa, Mycobacterium
LSTDQSSERITGNEI

SEQ ID NO: 1166392 - protein, 6 aa, Mycobacterium
LSTEAI

SEQ ID NO: 1166393 - protein, 5 aa, Mycobacterium
LSTED

SEQ ID NO: 1166394 - protein, 12 aa, Mycobacterium
LSTETKNRALRA

SEQ ID NO: 1166395 - protein, 7 aa, Mycobacterium
LSTGGTA

SEQ ID NO: 1166396 - protein, 5 aa, Mycobacterium
LSTGS

SEQ ID NO: 1166397 - protein, 9 aa, Mycobacterium
LSTGSLANL

SEQ ID NO: 1166398 - protein, 6 aa, Mycobacterium
LSTGTV

SEQ ID NO: 1166399 - protein, 4 aa, Mycobacterium
LSTL

SEQ ID NO: 1166400 - protein, 6 aa, Mycobacterium
LSTNPM

SEQ ID NO: 1166401 - protein, 4 aa, Mycobacterium
LSTP

SEQ ID NO: 1166402 - protein, 10 aa, Mycobacterium
LSTPDGRARA

SEQ ID NO: 1166403 - protein, 10 aa, Mycobacterium
LSTPEDLAET

SEQ ID NO: 1166404 - protein, 7 aa, Mycobacterium
LSTPGVP

SEQ ID NO: 1166405 - protein, 6 aa, Mycobacterium
LSTPTG

SEQ ID NO: 1166406 - protein, 7 aa, Mycobacterium
LSTRSEA

SEQ ID NO: 1166407 - protein, 5 aa, Mycobacterium
LSTSS

SEQ ID NO: 1166408 - protein, 14 aa, Mycobacterium
LSVNRPSGDTVQAA

SEQ ID NO: 1166409 - protein, 4 aa, Mycobacterium
LSYP

SEQ ID NO: 1166410 - protein, 7 aa, Mycobacterium
LSYPGGE

SEQ ID NO: 1166411 - protein, 10 aa, Mycobacterium
LTAAQEASDV

SEQ ID NO: 1166412 - protein, 10 aa, Mycobacterium
LTAEEAERTG

SEQ ID NO: 1166413 - protein, 7 aa, Mycobacterium
LTAGGGD

SEQ ID NO: 1166414 - protein, 11 aa, Mycobacterium
LTAGRDANTRA

SEQ ID NO: 1166415 - protein, 4 aa, Mycobacterium
LTAK

SEQ ID NO: 1166416 - protein, 6 aa, Mycobacterium
LTANTP

SEQ ID NO: 1166417 - protein, 5 aa, Mycobacterium
LTAPE

SEQ ID NO: 1166418 - protein, 7 aa, Mycobacterium
LTAPPPV

SEQ ID NO: 1166419 - protein, 8 aa, Mycobacterium
LTAPRASH

SEQ ID NO: 1166420 - protein, 10 aa, Mycobacterium
LTAPSERAQS

SEQ ID NO: 1166421 - protein, 16 aa, Mycobacterium
LTATNSSVTEELQRDN

SEQ ID NO: 1166422 - protein, 4 aa, Mycobacterium
LTDA

SEQ ID NO: 1166423 - protein, 17 aa, Mycobacterium
LTDAAGRVERGSALQGN

SEQ ID NO: 1166424 - protein, 6 aa, Mycobacterium
LTDDPY

SEQ ID NO: 1166425 - protein, 4 aa, Mycobacterium
LTDE

SEQ ID NO: 1166426 - protein, 11 aa, Mycobacterium
LTDESERIGRP

SEQ ID NO: 1166427 - protein, 6 aa, Mycobacterium
LTDGDT

SEQ ID NO: 1166428 - protein, 9 aa, Mycobacterium
LTDGEPDKS

SEQ ID NO: 1166429 - protein, 7 aa, Mycobacterium
LTDGHPD

SEQ ID NO: 1166430 - protein, 8 aa, Mycobacterium
LTDGSERE

SEQ ID NO: 1166431 - protein, 7 aa, Mycobacterium
LTDPDGN

SEQ ID NO: 1166432 - protein, 11 aa, Mycobacterium
LTDPGHELAPG

SEQ ID NO: 1166433 - protein, 7 aa, Mycobacterium
LTDPRQG

SEQ ID NO: 1166434 - protein, 7 aa, Mycobacterium
LTDPSSD

SEQ ID NO: 1166435 - protein, 11 aa, Mycobacterium
LTDSPDAETAL

SEQ ID NO: 1166436 - protein, 4 aa, Mycobacterium
LTDT

SEQ ID NO: 1166437 - protein, 10 aa, Mycobacterium
LTDTSAKDLK

SEQ ID NO: 1166438 - protein, 6 aa, Mycobacterium
LTEAGQ

SEQ ID NO: 1166439 - protein, 9 aa, Mycobacterium
LTEDATADR

SEQ ID NO: 1166440 - protein, 8 aa, Mycobacterium
LTEDPEQL

SEQ ID NO: 1166441 - protein, 5 aa, Mycobacterium
LTEEE

SEQ ID NO: 1166442 - protein, 10 aa, Mycobacterium
LTEGDASPRV

SEQ ID NO: 1166443 - protein, 4 aa, Mycobacterium
LTEN

SEQ ID NO: 1166444 - protein, 7 aa, Mycobacterium
LTEPDEL

SEQ ID NO: 1166445 - protein, 5 aa, Mycobacterium
LTEPG

SEQ ID NO: 1166446 - protein, 9 aa, Mycobacterium
LTEPGRSSA

SEQ ID NO: 1166447 - protein, 13 aa, Mycobacterium
LTERAEGTITADD

SEQ ID NO: 1166448 - protein, 26 aa, Mycobacterium
LTERGATRADDRISEAGMEDRKREGY

SEQ ID NO: 1166449 - protein, 19 aa, Mycobacterium
LTESASGARFDNHSPATGR

SEQ ID NO: 1166450 - protein, 6 aa, Mycobacterium
LTETRR

SEQ ID NO: 1166451 - protein, 6 aa, Mycobacterium
LTETSA

SEQ ID NO: 1166452 - protein, 4 aa, Mycobacterium
LTGA

SEQ ID NO: 1166453 - protein, 7 aa, Mycobacterium
LTGAREE

SEQ ID NO: 1166454 - protein, 11 aa, Mycobacterium
LTGDGPPPPIE

SEQ ID NO: 1166455 - protein, 10 aa, Mycobacterium
LTGDQLDART

SEQ ID NO: 1166456 - protein, 11 aa, Mycobacterium
LTGEDSPARTR

SEQ ID NO: 1166457 - protein, 7 aa, Mycobacterium
LTGEPAD

SEQ ID NO: 1166458 - protein, 8 aa, Mycobacterium
LTGEPPAA

SEQ ID NO: 1166459 - protein, 4 aa, Mycobacterium
LTGG

SEQ ID NO: 1166460 - protein, 5 aa, Mycobacterium
LTGGD

SEQ ID NO: 1166461 - protein, 7 aa, Mycobacterium
LTGGGSH

SEQ ID NO: 1166462 - protein, 7 aa, Mycobacterium
LTGGNGV

SEQ ID NO: 1166463 - protein, 12 aa, Mycobacterium
LTGKPGTPAAAR

SEQ ID NO: 1166464 - protein, 10 aa, Mycobacterium
LTGKSRDEVN

SEQ ID NO: 1166465 - protein, 12 aa, Mycobacterium
LTGPDGTYHQNE

SEQ ID NO: 1166466 - protein, 6 aa, Mycobacterium
LTGPDT

SEQ ID NO: 1166467 - protein, 14 aa, Mycobacterium
LTGQPSKQAPFEPL

SEQ ID NO: 1166468 - protein, 15 aa, Mycobacterium
LTGRKNPVIAGDSAD

SEQ ID NO: 1166469 - protein, 16 aa, Mycobacterium
LTGRQTAAGLAESERR

SEQ ID NO: 1166470 - protein, 18 aa, Mycobacterium
LTGRRRRRAKHGQRPPDE

SEQ ID NO: 1166471 - protein, 7 aa, Mycobacterium
LTGRSLP

SEQ ID NO: 1166472 - protein, 20 aa, Mycobacterium
LTGSATGDIDELRDGAEVGS

SEQ ID NO: 1166473 - protein, 7 aa, Mycobacterium
LTGSPAE

SEQ ID NO: 1166474 - protein, 6 aa, Mycobacterium
LTGTAK

SEQ ID NO: 1166475 - protein, 10 aa, Mycobacterium
LTGTASNGQH

SEQ ID NO: 1166476 - protein, 12 aa, Mycobacterium
LTGTDTGAGGDY

SEQ ID NO: 1166477 - protein, 9 aa, Mycobacterium
LTGTTAPYN

SEQ ID NO: 1166478 - protein, 10 aa, Mycobacterium
LTGTTPGSGI

SEQ ID NO: 1166479 - protein, 8 aa, Mycobacterium
LTHPDGRS

SEQ ID NO: 1166480 - protein, 10 aa, Mycobacterium
LTKGTGGAAV

SEQ ID NO: 1166481 - protein, 11 aa, Mycobacterium
LTKPDSGKATI

SEQ ID NO: 1166482 - protein, 5 aa, Mycobacterium
LTKTY

SEQ ID NO: 1166483 - protein, 11 aa, Mycobacterium
LTLPGSENPDL

SEQ ID NO: 1166484 - protein, 13 aa, Mycobacterium
LTNANTPADLPVT

SEQ ID NO: 1166485 - protein, 8 aa, Mycobacterium
LTNARSAH

SEQ ID NO: 1166486 - protein, 9 aa, Mycobacterium
LTNPDKPYF

SEQ ID NO: 1166487 - protein, 12 aa, Mycobacterium
LTNPTAHGGRAE

SEQ ID NO: 1166488 - protein, 18 aa, Mycobacterium
LTPATASGAAPSEQTRPQ

SEQ ID NO: 1166489 - protein, 6 aa, Mycobacterium
LTPATR

SEQ ID NO: 1166490 - protein, 7 aa, Mycobacterium
LTPDDDQ

SEQ ID NO: 1166491 - protein, 8 aa, Mycobacterium
LTPDERRA

SEQ ID NO: 1166492 - protein, 5 aa, Mycobacterium
LTPDG

SEQ ID NO: 1166493 - protein, 8 aa, Mycobacterium
LTPDLGPG

SEQ ID NO: 1166494 - protein, 9 aa, Mycobacterium
LTPEGDRTR

SEQ ID NO: 1166495 - protein, 7 aa, Mycobacterium
LTPEGTA

SEQ ID NO: 1166496 - protein, 5 aa, Mycobacterium
LTPEK

SEQ ID NO: 1166497 - protein, 13 aa, Mycobacterium
LTPEQRTYLQRYL

SEQ ID NO: 1166498 - protein, 4 aa, Mycobacterium
LTPG

SEQ ID NO: 1166499 - protein, 6 aa, Mycobacterium
LTPGRE

SEQ ID NO: 1166500 - protein, 6 aa, Mycobacterium
LTPGRT

SEQ ID NO: 1166501 - protein, 10 aa, Mycobacterium
LTPGSGEKRS

SEQ ID NO: 1166502 - protein, 5 aa, Mycobacterium
LTPIS

SEQ ID NO: 1166503 - protein, 20 aa, Mycobacterium
LTPPGEQRKAAARALATDAD

SEQ ID NO: 1166504 - protein, 7 aa, Mycobacterium
LTPQTPD

SEQ ID NO: 1166505 - protein, 4 aa, Mycobacterium
LTPR

SEQ ID NO: 1166506 - protein, 6 aa, Mycobacterium
LTPRNN

SEQ ID NO: 1166507 - protein, 6 aa, Mycobacterium
LTPRNQ

SEQ ID NO: 1166508 - protein, 6 aa, Mycobacterium
LTPSGL

SEQ ID NO: 1166509 - protein, 8 aa, Mycobacterium
LTPTHPDK

SEQ ID NO: 1166510 - protein, 6 aa, Mycobacterium
LTPTTK

SEQ ID NO: 1166511 - protein, 9 aa, Mycobacterium
LTPWSGSEY

SEQ ID NO: 1166512 - protein, 10 aa, Mycobacterium
LTQGANLGAG

SEQ ID NO: 1166513 - protein, 4 aa, Mycobacterium
LTQP

SEQ ID NO: 1166514 - protein, 16 aa, Mycobacterium
LTQRASVGSPTPRDTV

SEQ ID NO: 1166515 - protein, 4 aa, Mycobacterium
LTRE

SEQ ID NO: 1166516 - protein, 12 aa, Mycobacterium
LTRPEPTPVTAR

SEQ ID NO: 1166517 - protein, 4 aa, Mycobacterium
LTRQ

SEQ ID NO: 1166518 - protein, 15 aa, Mycobacterium
LTRQKAQSCVPGDGA

SEQ ID NO: 1166519 - protein, 5 aa, Mycobacterium
LTRRG

SEQ ID NO: 1166520 - protein, 7 aa, Mycobacterium
LTRRQGR

SEQ ID NO: 1166521 - protein, 4 aa, Mycobacterium
LTRT

SEQ ID NO: 1166522 - protein, 18 aa, Mycobacterium
LTRTGKVGADVDPDDAKD

SEQ ID NO: 1166523 - protein, 8 aa, Mycobacterium
LTRTTARD

SEQ ID NO: 1166524 - protein, 11 aa, Mycobacterium
LTSASGSPRAR

SEQ ID NO: 1166525 - protein, 7 aa, Mycobacterium
LTSETRA

SEQ ID NO: 1166526 - protein, 6 aa, Mycobacterium
LTSGAA

SEQ ID NO: 1166527 - protein, 7 aa, Mycobacterium
LTSGQQD

SEQ ID NO: 1166528 - protein, 7 aa, Mycobacterium
LTSGRTA

SEQ ID NO: 1166529 - protein, 4 aa, Mycobacterium
LTSL

SEQ ID NO: 1166530 - protein, 10 aa, Mycobacterium
LTSPDRPLDA

SEQ ID NO: 1166531 - protein, 5 aa, Mycobacterium
LTSPE

SEQ ID NO: 1166532 - protein, 10 aa, Mycobacterium
LTSPRGKRQF

SEQ ID NO: 1166533 - protein, 6 aa, Mycobacterium
LTSRGD

SEQ ID NO: 1166534 - protein, 4 aa, Mycobacterium
LTSS

SEQ ID NO: 1166535 - protein, 12 aa, Mycobacterium
LTSSPRSGGRTI

SEQ ID NO: 1166536 - protein, 11 aa, Mycobacterium
LTTATTPARLT

SEQ ID NO: 1166537 - protein, 5 aa, Mycobacterium
LTTGE

SEQ ID NO: 1166538 - protein, 5 aa, Mycobacterium
LTTND

SEQ ID NO: 1166539 - protein, 20 aa, Mycobacterium
LTTNGKIDKNRVRRLARSAL

SEQ ID NO: 1166540 - protein, 7 aa, Mycobacterium
LTTPSGT

SEQ ID NO: 1166541 - protein, 22 aa, Mycobacterium
LTTSPSTAASAQAATGGDAGSI

SEQ ID NO: 1166542 - protein, 7 aa, Mycobacterium
LTTTDAA

SEQ ID NO: 1166543 - protein, 8 aa, Mycobacterium
LTTTPAED

SEQ ID NO: 1166544 - protein, 4 aa, Mycobacterium
LTVD

SEQ ID NO: 1166545 - protein, 5 aa, Mycobacterium
LTVDG

SEQ ID NO: 1166546 - protein, 4 aa, Mycobacterium
LVDG

SEQ ID NO: 1166547 - protein, 6 aa, Mycobacterium
LVEPTA

SEQ ID NO: 1166548 - protein, 10 aa, Mycobacterium
LVGDDDEPGW

SEQ ID NO: 1166549 - protein, 13 aa, Mycobacterium
LVGSGRRDTPITE

SEQ ID NO: 1166550 - protein, 6 aa, Mycobacterium
LVPAAA

SEQ ID NO: 1166551 - protein, 5 aa, Mycobacterium
LVPED

SEQ ID NO: 1166552 - protein, 8 aa, Mycobacterium
LVPERGET

SEQ ID NO: 1166553 - protein, 8 aa, Mycobacterium
LVQDEGSQ

SEQ ID NO: 1166554 - protein, 9 aa, Mycobacterium
LVRGGSDRL

SEQ ID NO: 1166555 - protein, 15 aa, Mycobacterium
LYDGGDDAGAAEAAN

SEQ ID NO: 1166556 - protein, 11 aa, Mycobacterium
LYDPEHEKDSC

SEQ ID NO: 1166557 - protein, 6 aa, Mycobacterium
LYGPDR

SEQ ID NO: 1166558 - protein, 7 aa, Mycobacterium
MAAKQGR

SEQ ID NO: 1166559 - protein, 6 aa, Mycobacterium
MADDNR

SEQ ID NO: 1166560 - protein, 4 aa, Mycobacterium
MADP

SEQ ID NO: 1166561 - protein, 8 aa, Mycobacterium
MAEGTSED

SEQ ID NO: 1166562 - protein, 4 aa, Mycobacterium
MAEP

SEQ ID NO: 1166563 - protein, 14 aa, Mycobacterium
MAGADGNQEGDPVK

SEQ ID NO: 1166564 - protein, 5 aa, Mycobacterium
MAGDD

SEQ ID NO: 1166565 - protein, 10 aa, Mycobacterium
MAGGGDPRRM

SEQ ID NO: 1166566 - protein, 6 aa, Mycobacterium
MAGPEH

SEQ ID NO: 1166567 - protein, 6 aa, Mycobacterium
MAGQGT

SEQ ID NO: 1166568 - protein, 5 aa, Mycobacterium
MAPAT

SEQ ID NO: 1166569 - protein, 4 aa, Mycobacterium
MAPG

SEQ ID NO: 1166570 - protein, 11 aa, Mycobacterium
MAPKDPESVQW

SEQ ID NO: 1166571 - protein, 10 aa, Mycobacterium
MAPRSDGGAP

SEQ ID NO: 1166572 - protein, 6 aa, Mycobacterium
MAPTDR

SEQ ID NO: 1166573 - protein, 14 aa, Mycobacterium
MAQPSGSADDADNA

SEQ ID NO: 1166574 - protein, 7 aa, Mycobacterium
MARNPPE

SEQ ID NO: 1166575 - protein, 11 aa, Mycobacterium
MASGGSTGRPK

SEQ ID NO: 1166576 - protein, 9 aa, Mycobacterium
MASPGPRRA

SEQ ID NO: 1166577 - protein, 9 aa, Mycobacterium
MATAADGRP

SEQ ID NO: 1166578 - protein, 31 aa, Mycobacterium
MCNPDDPEPCTSGTPSQAQIDHDQRSLAQRQ

SEQ ID NO: 1166579 - protein, 13 aa, Mycobacterium
MDEGADKAAELAN

SEQ ID NO: 1166580 - protein, 9 aa, Mycobacterium
MDGSDGSVA

SEQ ID NO: 1166581 - protein, 6 aa, Mycobacterium
MDLPEP

SEQ ID NO: 1166582 - protein, 8 aa, Mycobacterium
MDNGGESS

SEQ ID NO: 1166583 - protein, 9 aa, Mycobacterium
MDPAGPRDY

SEQ ID NO: 1166584 - protein, 10 aa, Mycobacterium
MDPDGDDPHI

SEQ ID NO: 1166585 - protein, 20 aa, Mycobacterium
MDPHSDDSVDLENKVVALLK

SEQ ID NO: 1166586 - protein, 9 aa, Mycobacterium
MDQPDGSAE

SEQ ID NO: 1166587 - protein, 6 aa, Mycobacterium
MDSAHR

SEQ ID NO: 1166588 - protein, 5 aa, Mycobacterium
MDTGP

SEQ ID NO: 1166589 - protein, 5 aa, Mycobacterium
MEAGR

SEQ ID NO: 1166590 - protein, 4 aa, Mycobacterium
MEAQ

SEQ ID NO: 1166591 - protein, 6 aa, Mycobacterium
MEDAGA

SEQ ID NO: 1166592 - protein, 10 aa, Mycobacterium
MEDGKRGGIA

SEQ ID NO: 1166593 - protein, 9 aa, Mycobacterium
MEGNSVQGR

SEQ ID NO: 1166594 - protein, 9 aa, Mycobacterium
MEGSSPRRA

SEQ ID NO: 1166595 - protein, 12 aa, Mycobacterium
MEHTGTADDGRE

SEQ ID NO: 1166596 - protein, 5 aa, Mycobacterium
MEKPV

SEQ ID NO: 1166597 - protein, 9 aa, Mycobacterium
MEPGRDPIS

SEQ ID NO: 1166598 - protein, 13 aa, Mycobacterium
MEPSPQAPPPPVT

SEQ ID NO: 1166599 - protein, 55 aa, Mycobacterium
MEQAGESAETPDGDPDPEPPPDPPGGGVSGESPEPSRPQGNSSSAQTRSSGDPAA

SEQ ID NO: 1166600 - protein, 12 aa, Mycobacterium
MEQTGGFEGRTK

SEQ ID NO: 1166601 - protein, 8 aa, Mycobacterium
MERPREGL

SEQ ID NO: 1166602 - protein, 12 aa, Mycobacterium
MERRSGGVGADL

SEQ ID NO: 1166603 - protein, 7 aa, Mycobacterium
MESDLPD

SEQ ID NO: 1166604 - protein, 4 aa, Mycobacterium
META

SEQ ID NO: 1166605 - protein, 9 aa, Mycobacterium
MGAGEGNDF

SEQ ID NO: 1166606 - protein, 11 aa, Mycobacterium
MGDDRPADYPA

SEQ ID NO: 1166607 - protein, 5 aa, Mycobacterium
MGDGE

SEQ ID NO: 1166608 - protein, 15 aa, Mycobacterium
MGDPPDEEAAARGGR

SEQ ID NO: 1166609 - protein, 4 aa, Mycobacterium
MGEA

SEQ ID NO: 1166610 - protein, 7 aa, Mycobacterium
MGEGGVT

SEQ ID NO: 1166611 - protein, 5 aa, Mycobacterium
MGESA

SEQ ID NO: 1166612 - protein, 10 aa, Mycobacterium
MGGDPADRDE

SEQ ID NO: 1166613 - protein, 6 aa, Mycobacterium
MGGPAR

SEQ ID NO: 1166614 - protein, 9 aa, Mycobacterium
MGPGADDRR

SEQ ID NO: 1166615 - protein, 9 aa, Mycobacterium
MGPPADRRG

SEQ ID NO: 1166616 - protein, 6 aa, Mycobacterium
MGPSDH

SEQ ID NO: 1166617 - protein, 6 aa, Mycobacterium
MGPSYP

SEQ ID NO: 1166618 - protein, 5 aa, Mycobacterium
MGPWG

SEQ ID NO: 1166619 - protein, 9 aa, Mycobacterium
MGQGPGGIA

SEQ ID NO: 1166620 - protein, 5 aa, Mycobacterium
MGQPE

SEQ ID NO: 1166621 - protein, 5 aa, Mycobacterium
MGSFD

SEQ ID NO: 1166622 - protein, 4 aa, Mycobacterium
MGSP

SEQ ID NO: 1166623 - protein, 6 aa, Mycobacterium
MGSSAD

SEQ ID NO: 1166624 - protein, 13 aa, Mycobacterium
MGYAPAENDEAEQ

SEQ ID NO: 1166625 - protein, 5 aa, Mycobacterium
MHGPA

SEQ ID NO: 1166626 - protein, 12 aa, Mycobacterium
MHGPAGERKYEY

SEQ ID NO: 1166627 - protein, 7 aa, Mycobacterium
MHTSGRV

SEQ ID NO: 1166628 - protein, 15 aa, Mycobacterium
MIKTGGENVASREVE

SEQ ID NO: 1166629 - protein, 4 aa, Mycobacterium
MKAG

SEQ ID NO: 1166630 - protein, 20 aa, Mycobacterium
MKATSKRKVEVQRNKGLGEM

SEQ ID NO: 1166631 - protein, 5 aa, Mycobacterium
MKDDP

SEQ ID NO: 1166632 - protein, 8 aa, Mycobacterium
MKPGEEPL

SEQ ID NO: 1166633 - protein, 8 aa, Mycobacterium
MKPGRGPR

SEQ ID NO: 1166634 - protein, 8 aa, Mycobacterium
MKTGEGKT

SEQ ID NO: 1166635 - protein, 9 aa, Mycobacterium
MLSKPNPAV

SEQ ID NO: 1166636 - protein, 9 aa, Mycobacterium
MNDDDTAAM

SEQ ID NO: 1166637 - protein, 15 aa, Mycobacterium
MNDGTAGGFENNTAP

SEQ ID NO: 1166638 - protein, 8 aa, Mycobacterium
MNPSTGAV

SEQ ID NO: 1166639 - protein, 22 aa, Mycobacterium
MPAAPPPDDLPGFRSGKAFDDA

SEQ ID NO: 1166640 - protein, 9 aa, Mycobacterium
MPAPDGPNT

SEQ ID NO: 1166641 - protein, 6 aa, Mycobacterium
MPDSPF

SEQ ID NO: 1166642 - protein, 7 aa, Mycobacterium
MPEGAED

SEQ ID NO: 1166643 - protein, 8 aa, Mycobacterium
MPEHRDDT

SEQ ID NO: 1166644 - protein, 12 aa, Mycobacterium
MPEPDPGDGTST

SEQ ID NO: 1166645 - protein, 22 aa, Mycobacterium
MPESDDDDEDQDDDGGKSGDSK

SEQ ID NO: 1166646 - protein, 14 aa, Mycobacterium
MPESVGGGGGDGAD

SEQ ID NO: 1166647 - protein, 10 aa, Mycobacterium
MPGEDKGTQK

SEQ ID NO: 1166648 - protein, 9 aa, Mycobacterium
MPGGETGDE

SEQ ID NO: 1166649 - protein, 4 aa, Mycobacterium
MPGR

SEQ ID NO: 1166650 - protein, 8 aa, Mycobacterium
MPKQVTAT

SEQ ID NO: 1166651 - protein, 11 aa, Mycobacterium
MPNPKTGTVTA

SEQ ID NO: 1166652 - protein, 5 aa, Mycobacterium
MPPDA

SEQ ID NO: 1166653 - protein, 10 aa, Mycobacterium
MPPEADHDVA

SEQ ID NO: 1166654 - protein, 5 aa, Mycobacterium
MPPGI

SEQ ID NO: 1166655 - protein, 7 aa, Mycobacterium
MPPPGQG

SEQ ID NO: 1166656 - protein, 14 aa, Mycobacterium
MPPPPPGASPPPLW

SEQ ID NO: 1166657 - protein, 7 aa, Mycobacterium
MPPQQRA

SEQ ID NO: 1166658 - protein, 9 aa, Mycobacterium
MPPRPGERE

SEQ ID NO: 1166659 - protein, 9 aa, Mycobacterium
MPPSTGTGM

SEQ ID NO: 1166660 - protein, 20 aa, Mycobacterium
MPPTDPRYVDGGPGSEVPSV

SEQ ID NO: 1166661 - protein, 8 aa, Mycobacterium
MPQPQREE

SEQ ID NO: 1166662 - protein, 11 aa, Mycobacterium
MPRAPGRLEGR

SEQ ID NO: 1166663 - protein, 8 aa, Mycobacterium
MPRGGPRA

SEQ ID NO: 1166664 - protein, 10 aa, Mycobacterium
MPSSRYSEIA

SEQ ID NO: 1166665 - protein, 7 aa, Mycobacterium
MPTDHTG

SEQ ID NO: 1166666 - protein, 11 aa, Mycobacterium
MPTITSGNTNA

SEQ ID NO: 1166667 - protein, 7 aa, Mycobacterium
MPTSTKR

SEQ ID NO: 1166668 - protein, 6 aa, Mycobacterium
MPTTGA

SEQ ID NO: 1166669 - protein, 12 aa, Mycobacterium
MQGAARPGKQTT

SEQ ID NO: 1166670 - protein, 14 aa, Mycobacterium
MQGRGATGNLRGSF

SEQ ID NO: 1166671 - protein, 12 aa, Mycobacterium
MQRDGDTDFTGS

SEQ ID NO: 1166672 - protein, 12 aa, Mycobacterium
MRAASEAATGEH

SEQ ID NO: 1166673 - protein, 6 aa, Mycobacterium
MRAEGT

SEQ ID NO: 1166674 - protein, 8 aa, Mycobacterium
MREEPDET

SEQ ID NO: 1166675 - protein, 6 aa, Mycobacterium
MREGGY

SEQ ID NO: 1166676 - protein, 8 aa, Mycobacterium
MRERGSGS

SEQ ID NO: 1166677 - protein, 10 aa, Mycobacterium
MRETRGAVEG

SEQ ID NO: 1166678 - protein, 6 aa, Mycobacterium
MRNGTT

SEQ ID NO: 1166679 - protein, 7 aa, Mycobacterium
MRNPTGG

SEQ ID NO: 1166680 - protein, 6 aa, Mycobacterium
MRPNGG

SEQ ID NO: 1166681 - protein, 13 aa, Mycobacterium
MRRDPPSVAKREV

SEQ ID NO: 1166682 - protein, 14 aa, Mycobacterium
MRRRAADRAGARTE

SEQ ID NO: 1166683 - protein, 6 aa, Mycobacterium
MRSNQQ

SEQ ID NO: 1166684 - protein, 14 aa, Mycobacterium
MRTMTGGTDRPSNF

SEQ ID NO: 1166685 - protein, 4 aa, Mycobacterium
MRTT

SEQ ID NO: 1166686 - protein, 4 aa, Mycobacterium
MSAD

SEQ ID NO: 1166687 - protein, 5 aa, Mycobacterium
MSADE

SEQ ID NO: 1166688 - protein, 9 aa, Mycobacterium
MSAPEKVTG

SEQ ID NO: 1166689 - protein, 9 aa, Mycobacterium
MSAQQAVDA

SEQ ID NO: 1166690 - protein, 15 aa, Mycobacterium
MSDEAAATDPSAEEP

SEQ ID NO: 1166691 - protein, 37 aa, Mycobacterium
MSDGAGSGATVPSTAAKPRPHNSFGASTRGRRMPPRT

SEQ ID NO: 1166692 - protein, 11 aa, Mycobacterium
MSEPGAGSDLA

SEQ ID NO: 1166693 - protein, 6 aa, Mycobacterium
MSESRN

SEQ ID NO: 1166694 - protein, 6 aa, Mycobacterium
MSGDAD

SEQ ID NO: 1166695 - protein, 12 aa, Mycobacterium
MSGKPSVPTLPG

SEQ ID NO: 1166696 - protein, 38 aa, Mycobacterium
MSGRGTDTRLEQTDRVSAAERKIARRERRQSTDEPGGE

SEQ ID NO: 1166697 - protein, 12 aa, Mycobacterium
MSGRMGSDRVTT

SEQ ID NO: 1166698 - protein, 6 aa, Mycobacterium
MSKKKH

SEQ ID NO: 1166699 - protein, 11 aa, Mycobacterium
MSKNEPEDDER

SEQ ID NO: 1166700 - protein, 6 aa, Mycobacterium
MSPADQ

SEQ ID NO: 1166701 - protein, 4 aa, Mycobacterium
MSPG

SEQ ID NO: 1166702 - protein, 8 aa, Mycobacterium
MSPPTPAR

SEQ ID NO: 1166703 - protein, 8 aa, Mycobacterium
MSREERSA

SEQ ID NO: 1166704 - protein, 6 aa, Mycobacterium
MSRGEH

SEQ ID NO: 1166705 - protein, 8 aa, Mycobacterium
MSRPDGER

SEQ ID NO: 1166706 - protein, 11 aa, Mycobacterium
MSRSGNPAAAL

SEQ ID NO: 1166707 - protein, 7 aa, Mycobacterium
MSRSKRE

SEQ ID NO: 1166708 - protein, 6 aa, Mycobacterium
MSSEEI

SEQ ID NO: 1166709 - protein, 7 aa, Mycobacterium
MSTPPGL

SEQ ID NO: 1166710 - protein, 14 aa, Mycobacterium
MSTTVGPHPSARRS

SEQ ID NO: 1166711 - protein, 14 aa, Mycobacterium
MTAAGSSLRERTRA

SEQ ID NO: 1166712 - protein, 10 aa, Mycobacterium
MTADEQQAMA

SEQ ID NO: 1166713 - protein, 7 aa, Mycobacterium
MTAGSGA

SEQ ID NO: 1166714 - protein, 5 aa, Mycobacterium
MTEDE

SEQ ID NO: 1166715 - protein, 7 aa, Mycobacterium
MTETGGN

SEQ ID NO: 1166716 - protein, 24 aa, Mycobacterium
MTGEPDGPPTLPGYSSADNSTGLT

SEQ ID NO: 1166717 - protein, 15 aa, Mycobacterium
MTGGKEPNKGVNPDE

SEQ ID NO: 1166718 - protein, 9 aa, Mycobacterium
MTGGRGPDA

SEQ ID NO: 1166719 - protein, 4 aa, Mycobacterium
MTGR

SEQ ID NO: 1166720 - protein, 5 aa, Mycobacterium
MTIDR

SEQ ID NO: 1166721 - protein, 7 aa, Mycobacterium
MTPADAE

SEQ ID NO: 1166722 - protein, 10 aa, Mycobacterium
MTPSSAHGVT

SEQ ID NO: 1166723 - protein, 12 aa, Mycobacterium
MTPSSWSPAARE

SEQ ID NO: 1166724 - protein, 8 aa, Mycobacterium
MTRKREER

SEQ ID NO: 1166725 - protein, 8 aa, Mycobacterium
MTSERGYD

SEQ ID NO: 1166726 - protein, 15 aa, Mycobacterium
MTSGEDVDTAKPQPD

SEQ ID NO: 1166727 - protein, 6 aa, Mycobacterium
MTSSGR

SEQ ID NO: 1166728 - protein, 12 aa, Mycobacterium
MTTDPHTVTDDQ

SEQ ID NO: 1166729 - protein, 6 aa, Mycobacterium
MTTGDE

SEQ ID NO: 1166730 - protein, 14 aa, Mycobacterium
MTTSPGGKGGNQAI

SEQ ID NO: 1166731 - protein, 4 aa, Mycobacterium
MVTT

SEQ ID NO: 1166732 - protein, 6 aa, Mycobacterium
MYDGPG

SEQ ID NO: 1166733 - protein, 12 aa, Mycobacterium
MYETGAGGSAPK

SEQ ID NO: 1166734 - protein, 6 aa, Mycobacterium
MYPPSD

SEQ ID NO: 1166735 - protein, 10 aa, Mycobacterium
NAAAGGSPSR

SEQ ID NO: 1166736 - protein, 5 aa, Mycobacterium
NAAAL

SEQ ID NO: 1166737 - protein, 7 aa, Mycobacterium
NAAARGV

SEQ ID NO: 1166738 - protein, 8 aa, Mycobacterium
NAADYDRA

SEQ ID NO: 1166739 - protein, 5 aa, Mycobacterium
NAAPR

SEQ ID NO: 1166740 - protein, 10 aa, Mycobacterium
NAAPTPALRT

SEQ ID NO: 1166741 - protein, 8 aa, Mycobacterium
NAARHAKG

SEQ ID NO: 1166742 - protein, 7 aa, Mycobacterium
NAARSIT

SEQ ID NO: 1166743 - protein, 19 aa, Mycobacterium
NAATAERDAEFKANAAAKE

SEQ ID NO: 1166744 - protein, 9 aa, Mycobacterium
NACGANDGA

SEQ ID NO: 1166745 - protein, 5 aa, Mycobacterium
NADEL

SEQ ID NO: 1166746 - protein, 9 aa, Mycobacterium
NADGPVGTA

SEQ ID NO: 1166747 - protein, 13 aa, Mycobacterium
NADGQPVASAADA

SEQ ID NO: 1166748 - protein, 8 aa, Mycobacterium
NADPDEAE

SEQ ID NO: 1166749 - protein, 9 aa, Mycobacterium
NADPDGAAA

SEQ ID NO: 1166750 - protein, 6 aa, Mycobacterium
NADPER

SEQ ID NO: 1166751 - protein, 6 aa, Mycobacterium
NADRLA

SEQ ID NO: 1166752 - protein, 7 aa, Mycobacterium
NADVTAD

SEQ ID NO: 1166753 - protein, 7 aa, Mycobacterium
NAEAAQR

SEQ ID NO: 1166754 - protein, 17 aa, Mycobacterium
NAEAGDSTDEVNTDPDA

SEQ ID NO: 1166755 - protein, 10 aa, Mycobacterium
NAEDTDKAQL

SEQ ID NO: 1166756 - protein, 12 aa, Mycobacterium
NAEHSSTGLRSA

SEQ ID NO: 1166757 - protein, 9 aa, Mycobacterium
NAEPATDEV

SEQ ID NO: 1166758 - protein, 5 aa, Mycobacterium
NAEPE

SEQ ID NO: 1166759 - protein, 5 aa, Mycobacterium
NAEPG

SEQ ID NO: 1166760 - protein, 5 aa, Mycobacterium
NAEQI

SEQ ID NO: 1166761 - protein, 5 aa, Mycobacterium
NAETG

SEQ ID NO: 1166762 - protein, 13 aa, Mycobacterium
NAEVGDMARSSYA

SEQ ID NO: 1166763 - protein, 5 aa, Mycobacterium
NAGGA

SEQ ID NO: 1166764 - protein, 11 aa, Mycobacterium
NAGGARGLDPI

SEQ ID NO: 1166765 - protein, 5 aa, Mycobacterium
NAGGM

SEQ ID NO: 1166766 - protein, 10 aa, Mycobacterium
NAGKAPQRPP

SEQ ID NO: 1166767 - protein, 11 aa, Mycobacterium
NAGKTTRRPDG

SEQ ID NO: 1166768 - protein, 8 aa, Mycobacterium
NAGLPENS

SEQ ID NO: 1166769 - protein, 7 aa, Mycobacterium
NAGRTGR

SEQ ID NO: 1166770 - protein, 5 aa, Mycobacterium
NAHDR

SEQ ID NO: 1166771 - protein, 4 aa, Mycobacterium
NAHG

SEQ ID NO: 1166772 - protein, 30 aa, Mycobacterium
NAHPEAVSAADEVTSRNTDDGVARVLERWW

SEQ ID NO: 1166773 - protein, 12 aa, Mycobacterium
NAIEGPYGFTGN

SEQ ID NO: 1166774 - protein, 4 aa, Mycobacterium
NAIN

SEQ ID NO: 1166775 - protein, 7 aa, Mycobacterium
NAKASFA

SEQ ID NO: 1166776 - protein, 16 aa, Mycobacterium
NAKRGGASAWAGVSTP

SEQ ID NO: 1166777 - protein, 5 aa, Mycobacterium
NALAQ

SEQ ID NO: 1166778 - protein, 6 aa, Mycobacterium
NALPDA

SEQ ID NO: 1166779 - protein, 9 aa, Mycobacterium
NANDGGGRS

SEQ ID NO: 1166780 - protein, 6 aa, Mycobacterium
NANDRA

SEQ ID NO: 1166781 - protein, 4 aa, Mycobacterium
NANG

SEQ ID NO: 1166782 - protein, 8 aa, Mycobacterium
NANVPSPV

SEQ ID NO: 1166783 - protein, 5 aa, Mycobacterium
NAPAK

SEQ ID NO: 1166784 - protein, 5 aa, Mycobacterium
NAPGA

SEQ ID NO: 1166785 - protein, 8 aa, Mycobacterium
NAPKYTPE

SEQ ID NO: 1166786 - protein, 13 aa, Mycobacterium
NAPLTRPRPGHAD

SEQ ID NO: 1166787 - protein, 8 aa, Mycobacterium
NAPRGEGM

SEQ ID NO: 1166788 - protein, 15 aa, Mycobacterium
NAPSALREAKAGAER

SEQ ID NO: 1166789 - protein, 5 aa, Mycobacterium
NAQIQ

SEQ ID NO: 1166790 - protein, 6 aa, Mycobacterium
NAQPTA

SEQ ID NO: 1166791 - protein, 11 aa, Mycobacterium
NAQSERGPHPI

SEQ ID NO: 1166792 - protein, 7 aa, Mycobacterium
NAQTSCS

SEQ ID NO: 1166793 - protein, 7 aa, Mycobacterium
NAQTVRD

SEQ ID NO: 1166794 - protein, 4 aa, Mycobacterium
NARA

SEQ ID NO: 1166795 - protein, 10 aa, Mycobacterium
NARKAGTTVS

SEQ ID NO: 1166796 - protein, 4 aa, Mycobacterium
NARN

SEQ ID NO: 1166797 - protein, 7 aa, Mycobacterium
NARQPAV

SEQ ID NO: 1166798 - protein, 7 aa, Mycobacterium
NARSASE

SEQ ID NO: 1166799 - protein, 9 aa, Mycobacterium
NARTPGKGV

SEQ ID NO: 1166800 - protein, 19 aa, Mycobacterium
NASAGVDGLEGTPDKRTTT

SEQ ID NO: 1166801 - protein, 10 aa, Mycobacterium
NASASGGKKI

SEQ ID NO: 1166802 - protein, 16 aa, Mycobacterium
NASETLRKQSDDKPDA

SEQ ID NO: 1166803 - protein, 10 aa, Mycobacterium
NASHDDARAA

SEQ ID NO: 1166804 - protein, 9 aa, Mycobacterium
NASRSPGDV

SEQ ID NO: 1166805 - protein, 10 aa, Mycobacterium
NASTDDGEAA

SEQ ID NO: 1166806 - protein, 5 aa, Mycobacterium
NATAD

SEQ ID NO: 1166807 - protein, 6 aa, Mycobacterium
NATADI

SEQ ID NO: 1166808 - protein, 9 aa, Mycobacterium
NATIGAGTK

SEQ ID NO: 1166809 - protein, 4 aa, Mycobacterium
NATL

SEQ ID NO: 1166810 - protein, 6 aa, Mycobacterium
NATPTW

SEQ ID NO: 1166811 - protein, 20 aa, Mycobacterium
NATRARTSSVRGWAKLPVRT

SEQ ID NO: 1166812 - protein, 15 aa, Mycobacterium
NATRGNIDVTVTVTD

SEQ ID NO: 1166813 - protein, 8 aa, Mycobacterium
NATTPTEI

SEQ ID NO: 1166814 - protein, 7 aa, Mycobacterium
NATTTEA

SEQ ID NO: 1166815 - protein, 7 aa, Mycobacterium
NATVSGT

SEQ ID NO: 1166816 - protein, 5 aa, Mycobacterium
NATVT

SEQ ID NO: 1166817 - protein, 9 aa, Mycobacterium
NAVRPDGRR

SEQ ID NO: 1166818 - protein, 21 aa, Mycobacterium
NAWKSRTRAHPDVAELHHGIT

SEQ ID NO: 1166819 - protein, 7 aa, Mycobacterium
NCDGSQQ

SEQ ID NO: 1166820 - protein, 5 aa, Mycobacterium
NCGKS

SEQ ID NO: 1166821 - protein, 6 aa, Mycobacterium
NCGNRQ

SEQ ID NO: 1166822 - protein, 7 aa, Mycobacterium
NCSTGSS

SEQ ID NO: 1166823 - protein, 7 aa, Mycobacterium
NDAAALG

SEQ ID NO: 1166824 - protein, 9 aa, Mycobacterium
NDAARVARD

SEQ ID NO: 1166825 - protein, 8 aa, Mycobacterium
NDADRAAY

SEQ ID NO: 1166826 - protein, 11 aa, Mycobacterium
NDAGKPGTPLS

SEQ ID NO: 1166827 - protein, 6 aa, Mycobacterium
NDAGSQ

SEQ ID NO: 1166828 - protein, 5 aa, Mycobacterium
NDAPG

SEQ ID NO: 1166829 - protein, 6 aa, Mycobacterium
NDAPTA

SEQ ID NO: 1166830 - protein, 7 aa, Mycobacterium
NDARNDR

SEQ ID NO: 1166831 - protein, 5 aa, Mycobacterium
NDDDA

SEQ ID NO: 1166832 - protein, 5 aa, Mycobacterium
NDDEI

SEQ ID NO: 1166833 - protein, 10 aa, Mycobacterium
NDDGAYEDPW

SEQ ID NO: 1166834 - protein, 11 aa, Mycobacterium
NDEATRETIDD

SEQ ID NO: 1166835 - protein, 5 aa, Mycobacterium
NDEEL

SEQ ID NO: 1166836 - protein, 6 aa, Mycobacterium
NDEGRP

SEQ ID NO: 1166837 - protein, 6 aa, Mycobacterium
NDEQRK

SEQ ID NO: 1166838 - protein, 6 aa, Mycobacterium
NDEVGG

SEQ ID NO: 1166839 - protein, 6 aa, Mycobacterium
NDEYDN

SEQ ID NO: 1166840 - protein, 7 aa, Mycobacterium
NDGAARL

SEQ ID NO: 1166841 - protein, 14 aa, Mycobacterium
NDGDFARSYSTAGT

SEQ ID NO: 1166842 - protein, 7 aa, Mycobacterium
NDGGSSV

SEQ ID NO: 1166843 - protein, 14 aa, Mycobacterium
NDGQKMSKSLRNYP

SEQ ID NO: 1166844 - protein, 5 aa, Mycobacterium
NDGTL

SEQ ID NO: 1166845 - protein, 9 aa, Mycobacterium
NDGVQGPSV

SEQ ID NO: 1166846 - protein, 13 aa, Mycobacterium
NDHAPDGPAKGGE

SEQ ID NO: 1166847 - protein, 10 aa, Mycobacterium
NDHEDGNGQF

SEQ ID NO: 1166848 - protein, 8 aa, Mycobacterium
NDKKRGRI

SEQ ID NO: 1166849 - protein, 5 aa, Mycobacterium
NDLGR

SEQ ID NO: 1166850 - protein, 4 aa, Mycobacterium
NDLS

SEQ ID NO: 1166851 - protein, 27 aa, Mycobacterium
NDLSNETAKKNRNASQVVGGKGELNSV

SEQ ID NO: 1166852 - protein, 5 aa, Mycobacterium
NDMRD

SEQ ID NO: 1166853 - protein, 10 aa, Mycobacterium
NDNGDKGFGT

SEQ ID NO: 1166854 - protein, 4 aa, Mycobacterium
NDPD

SEQ ID NO: 1166855 - protein, 6 aa, Mycobacterium
NDPDTW

SEQ ID NO: 1166856 - protein, 14 aa, Mycobacterium
NDPEVDPETGNPWS

SEQ ID NO: 1166857 - protein, 6 aa, Mycobacterium
NDPFTD

SEQ ID NO: 1166858 - protein, 9 aa, Mycobacterium
NDPNATGDR

SEQ ID NO: 1166859 - protein, 12 aa, Mycobacterium
NDPRTTEQRRAD

SEQ ID NO: 1166860 - protein, 5 aa, Mycobacterium
NDPTG

SEQ ID NO: 1166861 - protein, 4 aa, Mycobacterium
NDPW

SEQ ID NO: 1166862 - protein, 6 aa, Mycobacterium
NDRAAL

SEQ ID NO: 1166863 - protein, 15 aa, Mycobacterium
NDRPLKREGTPDDVA

SEQ ID NO: 1166864 - protein, 7 aa, Mycobacterium
NDSDYGL

SEQ ID NO: 1166865 - protein, 7 aa, Mycobacterium
NDSESRV

SEQ ID NO: 1166866 - protein, 6 aa, Mycobacterium
NDSEYA

SEQ ID NO: 1166867 - protein, 11 aa, Mycobacterium
NDSVPDGERVN

SEQ ID NO: 1166868 - protein, 6 aa, Mycobacterium
NDTEYG

SEQ ID NO: 1166869 - protein, 17 aa, Mycobacterium
NDTGADYDSALADASAL

SEQ ID NO: 1166870 - protein, 4 aa, Mycobacterium
NDTK

SEQ ID NO: 1166871 - protein, 7 aa, Mycobacterium
NDTPPFD

SEQ ID NO: 1166872 - protein, 7 aa, Mycobacterium
NDTPYGL

SEQ ID NO: 1166873 - protein, 6 aa, Mycobacterium
NDTQYG

SEQ ID NO: 1166874 - protein, 9 aa, Mycobacterium
NDTTGAPAL

SEQ ID NO: 1166875 - protein, 10 aa, Mycobacterium
NDTTRNSMSG

SEQ ID NO: 1166876 - protein, 8 aa, Mycobacterium
NDVSTNTD

SEQ ID NO: 1166877 - protein, 14 aa, Mycobacterium
NDYADRKNGRQPIK

SEQ ID NO: 1166878 - protein, 6 aa, Mycobacterium
NEAAAR

SEQ ID NO: 1166879 - protein, 6 aa, Mycobacterium
NEAGSV

SEQ ID NO: 1166880 - protein, 12 aa, Mycobacterium
NEAPDDGQENTV

SEQ ID NO: 1166881 - protein, 11 aa, Mycobacterium
NEATDGAGGAV

SEQ ID NO: 1166882 - protein, 8 aa, Mycobacterium
NEATNKAK

SEQ ID NO: 1166883 - protein, 7 aa, Mycobacterium
NEDEKRS

SEQ ID NO: 1166884 - protein, 8 aa, Mycobacterium
NEDGKAEL

SEQ ID NO: 1166885 - protein, 5 aa, Mycobacterium
NEDGR

SEQ ID NO: 1166886 - protein, 10 aa, Mycobacterium
NEDPKSDLGG

SEQ ID NO: 1166887 - protein, 8 aa, Mycobacterium
NEDPPPHK

SEQ ID NO: 1166888 - protein, 7 aa, Mycobacterium
NEDQKRE

SEQ ID NO: 1166889 - protein, 14 aa, Mycobacterium
NEDQPETSGDPRVA

SEQ ID NO: 1166890 - protein, 7 aa, Mycobacterium
NEDTKDL

SEQ ID NO: 1166891 - protein, 9 aa, Mycobacterium
NEEETAKAF

SEQ ID NO: 1166892 - protein, 6 aa, Mycobacterium
NEEGSL

SEQ ID NO: 1166893 - protein, 6 aa, Mycobacterium
NEEQGI

SEQ ID NO: 1166894 - protein, 4 aa, Mycobacterium
NEET

SEQ ID NO: 1166895 - protein, 10 aa, Mycobacterium
NEETHEPTPY

SEQ ID NO: 1166896 - protein, 15 aa, Mycobacterium
NEFGPSATRGTGGPL

SEQ ID NO: 1166897 - protein, 8 aa, Mycobacterium
NEGAPRDL

SEQ ID NO: 1166898 - protein, 8 aa, Mycobacterium
NEGGTETL

SEQ ID NO: 1166899 - protein, 10 aa, Mycobacterium
NEGIDSTHSP

SEQ ID NO: 1166900 - protein, 9 aa, Mycobacterium
NEGKTPKTV

SEQ ID NO: 1166901 - protein, 18 aa, Mycobacterium
NEGRVKAAEAEKRAREQA

SEQ ID NO: 1166902 - protein, 9 aa, Mycobacterium
NEGSTDPVP

SEQ ID NO: 1166903 - protein, 18 aa, Mycobacterium
NEGYQDMRSGKNIRGLVR

SEQ ID NO: 1166904 - protein, 21 aa, Mycobacterium
NEKHNEDNGEDNNDGESHNRS

SEQ ID NO: 1166905 - protein, 8 aa, Mycobacterium
NEKSQLQN

SEQ ID NO: 1166906 - protein, 6 aa, Mycobacterium
NELGNP

SEQ ID NO: 1166907 - protein, 7 aa, Mycobacterium
NELGPRS

SEQ ID NO: 1166908 - protein, 11 aa, Mycobacterium
NELTSNRSADL

SEQ ID NO: 1166909 - protein, 7 aa, Mycobacterium
NEPDHPG

SEQ ID NO: 1166910 - protein, 6 aa, Mycobacterium
NEPDLA

SEQ ID NO: 1166911 - protein, 6 aa, Mycobacterium
NEPTLA

SEQ ID NO: 1166912 - protein, 6 aa, Mycobacterium
NEPTTA

SEQ ID NO: 1166913 - protein, 5 aa, Mycobacterium
NEQAN

SEQ ID NO: 1166914 - protein, 8 aa, Mycobacterium
NEQRPGDA

SEQ ID NO: 1166915 - protein, 4 aa, Mycobacterium
NERE

SEQ ID NO: 1166916 - protein, 10 aa, Mycobacterium
NESAGGAGRS

SEQ ID NO: 1166917 - protein, 10 aa, Mycobacterium
NESPSHTARR

SEQ ID NO: 1166918 - protein, 7 aa, Mycobacterium
NETFSSR

SEQ ID NO: 1166919 - protein, 6 aa, Mycobacterium
NETHAE

SEQ ID NO: 1166920 - protein, 5 aa, Mycobacterium
NETIT

SEQ ID NO: 1166921 - protein, 4 aa, Mycobacterium
NETP

SEQ ID NO: 1166922 - protein, 4 aa, Mycobacterium
NEVP

SEQ ID NO: 1166923 - protein, 8 aa, Mycobacterium
NFDAPSHQ

SEQ ID NO: 1166924 - protein, 12 aa, Mycobacterium
NFGHGQSASGAI

SEQ ID NO: 1166925 - protein, 10 aa, Mycobacterium
NFKTQGGLTT

SEQ ID NO: 1166926 - protein, 7 aa, Mycobacterium
NFNPPAA

SEQ ID NO: 1166927 - protein, 6 aa, Mycobacterium
NFPSPQ

SEQ ID NO: 1166928 - protein, 7 aa, Mycobacterium
NFTPREG

SEQ ID NO: 1166929 - protein, 11 aa, Mycobacterium
NFTSEPEGFQH

SEQ ID NO: 1166930 - protein, 14 aa, Mycobacterium
NGAARTASAPGPHL

SEQ ID NO: 1166931 - protein, 8 aa, Mycobacterium
NGAEDEDQ

SEQ ID NO: 1166932 - protein, 12 aa, Mycobacterium
NGAKEIADQHGK

SEQ ID NO: 1166933 - protein, 15 aa, Mycobacterium
NGARGLAGGTAATAA

SEQ ID NO: 1166934 - protein, 15 aa, Mycobacterium
NGASGEGGPDGSVNE

SEQ ID NO: 1166935 - protein, 5 aa, Mycobacterium
NGATR

SEQ ID NO: 1166936 - protein, 8 aa, Mycobacterium
NGAYADAD

SEQ ID NO: 1166937 - protein, 8 aa, Mycobacterium
NGDGKGGV

SEQ ID NO: 1166938 - protein, 5 aa, Mycobacterium
NGDGW

SEQ ID NO: 1166939 - protein, 23 aa, Mycobacterium
NGDPAATGPRNGDGALPTLTPQQ

SEQ ID NO: 1166940 - protein, 8 aa, Mycobacterium
NGDPKLAT

SEQ ID NO: 1166941 - protein, 6 aa, Mycobacterium
NGDPRG

SEQ ID NO: 1166942 - protein, 9 aa, Mycobacterium
NGDTASGDA

SEQ ID NO: 1166943 - protein, 9 aa, Mycobacterium
NGDVGAKAR

SEQ ID NO: 1166944 - protein, 5 aa, Mycobacterium
NGEAD

SEQ ID NO: 1166945 - protein, 7 aa, Mycobacterium
NGEPHSR

SEQ ID NO: 1166946 - protein, 13 aa, Mycobacterium
NGFHRPDDARRAF

SEQ ID NO: 1166947 - protein, 10 aa, Mycobacterium
NGFPGTSSTF

SEQ ID NO: 1166948 - protein, 10 aa, Mycobacterium
NGGAPLSPTV

SEQ ID NO: 1166949 - protein, 15 aa, Mycobacterium
NGGARPRLTGVCVSA

SEQ ID NO: 1166950 - protein, 8 aa, Mycobacterium
NGGAYNPV

SEQ ID NO: 1166951 - protein, 5 aa, Mycobacterium
NGGDI

SEQ ID NO: 1166952 - protein, 5 aa, Mycobacterium
NGGDT

SEQ ID NO: 1166953 - protein, 6 aa, Mycobacterium
NGGESA

SEQ ID NO: 1166954 - protein, 10 aa, Mycobacterium
NGGGAAPAGV

SEQ ID NO: 1166955 - protein, 12 aa, Mycobacterium
NGGGYTSAKHAQ

SEQ ID NO: 1166956 - protein, 4 aa, Mycobacterium
NGGQ

SEQ ID NO: 1166957 - protein, 10 aa, Mycobacterium
NGGSATSKAL

SEQ ID NO: 1166958 - protein, 10 aa, Mycobacterium
NGGSTGNSLE

SEQ ID NO: 1166959 - protein, 4 aa, Mycobacterium
NGGV

SEQ ID NO: 1166960 - protein, 5 aa, Mycobacterium
NGHGG

SEQ ID NO: 1166961 - protein, 4 aa, Mycobacterium
NGHN

SEQ ID NO: 1166962 - protein, 11 aa, Mycobacterium
NGHNVSTRGRI

SEQ ID NO: 1166963 - protein, 5 aa, Mycobacterium
NGIDA

SEQ ID NO: 1166964 - protein, 5 aa, Mycobacterium
NGIEP

SEQ ID NO: 1166965 - protein, 11 aa, Mycobacterium
NGKAHGMGAPG

SEQ ID NO: 1166966 - protein, 9 aa, Mycobacterium
NGKGAFTHT

SEQ ID NO: 1166967 - protein, 14 aa, Mycobacterium
NGKPGELGGGGLPQ

SEQ ID NO: 1166968 - protein, 7 aa, Mycobacterium
NGKSPQA

SEQ ID NO: 1166969 - protein, 10 aa, Mycobacterium
NGLDESATLG

SEQ ID NO: 1166970 - protein, 5 aa, Mycobacterium
NGLEE

SEQ ID NO: 1166971 - protein, 12 aa, Mycobacterium
NGLNGSAERFGA

SEQ ID NO: 1166972 - protein, 7 aa, Mycobacterium
NGLPDDY

SEQ ID NO: 1166973 - protein, 6 aa, Mycobacterium
NGLSED

SEQ ID NO: 1166974 - protein, 7 aa, Mycobacterium
NGPAYGG

SEQ ID NO: 1166975 - protein, 7 aa, Mycobacterium
NGPDYDL

SEQ ID NO: 1166976 - protein, 7 aa, Mycobacterium
NGPKMAG

SEQ ID NO: 1166977 - protein, 8 aa, Mycobacterium
NGPRDRRP

SEQ ID NO: 1166978 - protein, 9 aa, Mycobacterium
NGPVVGPDG

SEQ ID NO: 1166979 - protein, 12 aa, Mycobacterium
NGQGMDAEGVQR

SEQ ID NO: 1166980 - protein, 6 aa, Mycobacterium
NGQGVA

SEQ ID NO: 1166981 - protein, 5 aa, Mycobacterium
NGQPW

SEQ ID NO: 1166982 - protein, 4 aa, Mycobacterium
NGQR

SEQ ID NO: 1166983 - protein, 11 aa, Mycobacterium
NGRGGGEIDPT

SEQ ID NO: 1166984 - protein, 8 aa, Mycobacterium
NGRGTEQL

SEQ ID NO: 1166985 - protein, 8 aa, Mycobacterium
NGRPPRER

SEQ ID NO: 1166986 - protein, 6 aa, Mycobacterium
NGRRGG

SEQ ID NO: 1166987 - protein, 5 aa, Mycobacterium
NGRRP

SEQ ID NO: 1166988 - protein, 6 aa, Mycobacterium
NGRRPA

SEQ ID NO: 1166989 - protein, 10 aa, Mycobacterium
NGRSQAGVPE

SEQ ID NO: 1166990 - protein, 13 aa, Mycobacterium
NGRTPGAATTDSD

SEQ ID NO: 1166991 - protein, 6 aa, Mycobacterium
NGRVTG

SEQ ID NO: 1166992 - protein, 16 aa, Mycobacterium
NGSATSQISYTASKGG

SEQ ID NO: 1166993 - protein, 8 aa, Mycobacterium
NGSEPISA

SEQ ID NO: 1166994 - protein, 6 aa, Mycobacterium
NGSGPT

SEQ ID NO: 1166995 - protein, 8 aa, Mycobacterium
NGSGVSVS

SEQ ID NO: 1166996 - protein, 6 aa, Mycobacterium
NGSLGH

SEQ ID NO: 1166997 - protein, 12 aa, Mycobacterium
NGSLTGYGGGIE

SEQ ID NO: 1166998 - protein, 7 aa, Mycobacterium
NGSPRAL

SEQ ID NO: 1166999 - protein, 22 aa, Mycobacterium
NGSPRTASRLPPPEPDPPAAGD

SEQ ID NO: 1167000 - protein, 4 aa, Mycobacterium
NGSQ

SEQ ID NO: 1167001 - protein, 9 aa, Mycobacterium
NGSRVARAR

SEQ ID NO: 1167002 - protein, 10 aa, Mycobacterium
NGSSLYDSTI

SEQ ID NO: 1167003 - protein, 17 aa, Mycobacterium
NGSTGIGDAPDDRPQEE

SEQ ID NO: 1167004 - protein, 8 aa, Mycobacterium
NGSTRAAG

SEQ ID NO: 1167005 - protein, 10 aa, Mycobacterium
NGTASRETDA

SEQ ID NO: 1167006 - protein, 10 aa, Mycobacterium
NGTPGFERGR

SEQ ID NO: 1167007 - protein, 121 aa, Mycobacterium
NGTPSAPTTLTTPGLGATGLTSPGLTTPGLTSPGLTAPGLTTPGLTTPGLTTPGLTTPGLTTPSASVPPLTASAPGLGDAGLTNPALTNPALTSPTGDLPGLTAPGLSTPGLTTPTTGLDP

SEQ ID NO: 1167008 - protein, 6 aa, Mycobacterium
NGTPYG

SEQ ID NO: 1167009 - protein, 5 aa, Mycobacterium
NGTRR

SEQ ID NO: 1167010 - protein, 4 aa, Mycobacterium
NGVG

SEQ ID NO: 1167011 - protein, 14 aa, Mycobacterium
NGVGGEAYRSSPLD

SEQ ID NO: 1167012 - protein, 7 aa, Mycobacterium
NGVPPHP

SEQ ID NO: 1167013 - protein, 9 aa, Mycobacterium
NGYQPGGIT

SEQ ID NO: 1167014 - protein, 7 aa, Mycobacterium
NGYTRDY

SEQ ID NO: 1167015 - protein, 7 aa, Mycobacterium
NHAPRRN

SEQ ID NO: 1167016 - protein, 5 aa, Mycobacterium
NHARQ

SEQ ID NO: 1167017 - protein, 7 aa, Mycobacterium
NHASAER

SEQ ID NO: 1167018 - protein, 6 aa, Mycobacterium
NHDRTA

SEQ ID NO: 1167019 - protein, 10 aa, Mycobacterium
NHEDAESRDD

SEQ ID NO: 1167020 - protein, 6 aa, Mycobacterium
NHEGTP

SEQ ID NO: 1167021 - protein, 6 aa, Mycobacterium
NHGGTE

SEQ ID NO: 1167022 - protein, 6 aa, Mycobacterium
NHGRRE

SEQ ID NO: 1167023 - protein, 15 aa, Mycobacterium
NHHERLDGTGYPRGL

SEQ ID NO: 1167024 - protein, 8 aa, Mycobacterium
NHKERNDS

SEQ ID NO: 1167025 - protein, 7 aa, Mycobacterium
NHPEPEH

SEQ ID NO: 1167026 - protein, 7 aa, Mycobacterium
NHPGTSQ

SEQ ID NO: 1167027 - protein, 10 aa, Mycobacterium
NHPHPSGRPV

SEQ ID NO: 1167028 - protein, 7 aa, Mycobacterium
NHPRRTK

SEQ ID NO: 1167029 - protein, 5 aa, Mycobacterium
NHRPD

SEQ ID NO: 1167030 - protein, 7 aa, Mycobacterium
NHRPGVR

SEQ ID NO: 1167031 - protein, 5 aa, Mycobacterium
NHSGG

SEQ ID NO: 1167032 - protein, 5 aa, Mycobacterium
NHSPS

SEQ ID NO: 1167033 - protein, 10 aa, Mycobacterium
NHTKKDIAAA

SEQ ID NO: 1167034 - protein, 6 aa, Mycobacterium
NHTSSA

SEQ ID NO: 1167035 - protein, 5 aa, Mycobacterium
NIAPA

SEQ ID NO: 1167036 - protein, 5 aa, Mycobacterium
NIEGS

SEQ ID NO: 1167037 - protein, 12 aa, Mycobacterium
NIGHTQSAAGAL

SEQ ID NO: 1167038 - protein, 4 aa, Mycobacterium
NIGR

SEQ ID NO: 1167039 - protein, 10 aa, Mycobacterium
NIGRSSREDT

SEQ ID NO: 1167040 - protein, 9 aa, Mycobacterium
NIGSVDSDA

SEQ ID NO: 1167041 - protein, 9 aa, Mycobacterium
NIKTGTTDS

SEQ ID NO: 1167042 - protein, 6 aa, Mycobacterium
NIPGDL

SEQ ID NO: 1167043 - protein, 7 aa, Mycobacterium
NIRPGKR

SEQ ID NO: 1167044 - protein, 5 aa, Mycobacterium
NKAAL

SEQ ID NO: 1167045 - protein, 12 aa, Mycobacterium
NKAETKEKYGEE

SEQ ID NO: 1167046 - protein, 15 aa, Mycobacterium
NKALRATEARLSTER

SEQ ID NO: 1167047 - protein, 7 aa, Mycobacterium
NKAPGGV

SEQ ID NO: 1167048 - protein, 13 aa, Mycobacterium
NKDEINRKVEETA

SEQ ID NO: 1167049 - protein, 4 aa, Mycobacterium
NKDV

SEQ ID NO: 1167050 - protein, 7 aa, Mycobacterium
NKGDETL

SEQ ID NO: 1167051 - protein, 13 aa, Mycobacterium
NKIANGAPIADVL

SEQ ID NO: 1167052 - protein, 8 aa, Mycobacterium
NKLTPEQV

SEQ ID NO: 1167053 - protein, 7 aa, Mycobacterium
NKQYEQW

SEQ ID NO: 1167054 - protein, 10 aa, Mycobacterium
NKRERAETFD

SEQ ID NO: 1167055 - protein, 5 aa, Mycobacterium
NKRPE

SEQ ID NO: 1167056 - protein, 7 aa, Mycobacterium
NKRPRSV

SEQ ID NO: 1167057 - protein, 10 aa, Mycobacterium
NKSDGTQDEI

SEQ ID NO: 1167058 - protein, 13 aa, Mycobacterium
NKSEKADDPAAAE

SEQ ID NO: 1167059 - protein, 19 aa, Mycobacterium
NKSGTARERDPQEPVDDTE

SEQ ID NO: 1167060 - protein, 5 aa, Mycobacterium
NKVPG

SEQ ID NO: 1167061 - protein, 5 aa, Mycobacterium
NKVPN

SEQ ID NO: 1167062 - protein, 10 aa, Mycobacterium
NLAESDADVR

SEQ ID NO: 1167063 - protein, 4 aa, Mycobacterium
NLAG

SEQ ID NO: 1167064 - protein, 5 aa, Mycobacterium
NLAGR

SEQ ID NO: 1167065 - protein, 6 aa, Mycobacterium
NLAGSG

SEQ ID NO: 1167066 - protein, 12 aa, Mycobacterium
NLDEGEPHGMPG

SEQ ID NO: 1167067 - protein, 6 aa, Mycobacterium
NLDGTL

SEQ ID NO: 1167068 - protein, 8 aa, Mycobacterium
NLDTGGRA

SEQ ID NO: 1167069 - protein, 7 aa, Mycobacterium
NLEADEA

SEQ ID NO: 1167070 - protein, 16 aa, Mycobacterium
NLEASPDLVNSDPYGE

SEQ ID NO: 1167071 - protein, 6 aa, Mycobacterium
NLEPGE

SEQ ID NO: 1167072 - protein, 7 aa, Mycobacterium
NLERERT

SEQ ID NO: 1167073 - protein, 8 aa, Mycobacterium
NLGTERHH

SEQ ID NO: 1167074 - protein, 4 aa, Mycobacterium
NLKP

SEQ ID NO: 1167075 - protein, 9 aa, Mycobacterium
NLPDRPSEN

SEQ ID NO: 1167076 - protein, 7 aa, Mycobacterium
NLPKTGG

SEQ ID NO: 1167077 - protein, 14 aa, Mycobacterium
NLPPESATLERPRS

SEQ ID NO: 1167078 - protein, 5 aa, Mycobacterium
NLPSP

SEQ ID NO: 1167079 - protein, 12 aa, Mycobacterium
NLPSPNAMEVGP

SEQ ID NO: 1167080 - protein, 8 aa, Mycobacterium
NLPSSETR

SEQ ID NO: 1167081 - protein, 11 aa, Mycobacterium
NLPSTATPADV

SEQ ID NO: 1167082 - protein, 6 aa, Mycobacterium
NLQAEA

SEQ ID NO: 1167083 - protein, 11 aa, Mycobacterium
NLQGQSGRKLG

SEQ ID NO: 1167084 - protein, 8 aa, Mycobacterium
NLQRDADE

SEQ ID NO: 1167085 - protein, 11 aa, Mycobacterium
NLRADSSAEKL

SEQ ID NO: 1167086 - protein, 10 aa, Mycobacterium
NLSADPDRRL

SEQ ID NO: 1167087 - protein, 8 aa, Mycobacterium
NLSSAKGD

SEQ ID NO: 1167088 - protein, 5 aa, Mycobacterium
NLTAA

SEQ ID NO: 1167089 - protein, 7 aa, Mycobacterium
NLTETAA

SEQ ID NO: 1167090 - protein, 12 aa, Mycobacterium
NLTREQIERAGG

SEQ ID NO: 1167091 - protein, 5 aa, Mycobacterium
NMGTG

SEQ ID NO: 1167092 - protein, 10 aa, Mycobacterium
NMQSSNVSTA

SEQ ID NO: 1167093 - protein, 11 aa, Mycobacterium
NNAPDNDPDIP

SEQ ID NO: 1167094 - protein, 16 aa, Mycobacterium
NNARAKASTSIGTSSS

SEQ ID NO: 1167095 - protein, 5 aa, Mycobacterium
NNARV

SEQ ID NO: 1167096 - protein, 8 aa, Mycobacterium
NNAVGKVD

SEQ ID NO: 1167097 - protein, 27 aa, Mycobacterium
NNDERGASGEAPVDAANPRNDNKSGQV

SEQ ID NO: 1167098 - protein, 8 aa, Mycobacterium
NNDGDELR

SEQ ID NO: 1167099 - protein, 7 aa, Mycobacterium
NNDYGGD

SEQ ID NO: 1167100 - protein, 7 aa, Mycobacterium
NNELTPS

SEQ ID NO: 1167101 - protein, 12 aa, Mycobacterium
NNEVPGATERDH

SEQ ID NO: 1167102 - protein, 5 aa, Mycobacterium
NNGDN

SEQ ID NO: 1167103 - protein, 10 aa, Mycobacterium
NNGQSATAIS

SEQ ID NO: 1167104 - protein, 8 aa, Mycobacterium
NNLNNRSW

SEQ ID NO: 1167105 - protein, 10 aa, Mycobacterium
NNNPQSLRDE

SEQ ID NO: 1167106 - protein, 10 aa, Mycobacterium
NNPAAATARA

SEQ ID NO: 1167107 - protein, 12 aa, Mycobacterium
NNPATGQPMTTS

SEQ ID NO: 1167108 - protein, 6 aa, Mycobacterium
NNRPDA

SEQ ID NO: 1167109 - protein, 8 aa, Mycobacterium
NNRSDARS

SEQ ID NO: 1167110 - protein, 5 aa, Mycobacterium
NNSAA

SEQ ID NO: 1167111 - protein, 13 aa, Mycobacterium
NNSTDGTAEVARR

SEQ ID NO: 1167112 - protein, 6 aa, Mycobacterium
NNTRAY

SEQ ID NO: 1167113 - protein, 8 aa, Mycobacterium
NNTSMDAD

SEQ ID NO: 1167114 - protein, 8 aa, Mycobacterium
NPAARTTI

SEQ ID NO: 1167115 - protein, 9 aa, Mycobacterium
NPAATAATL

SEQ ID NO: 1167116 - protein, 7 aa, Mycobacterium
NPADETV

SEQ ID NO: 1167117 - protein, 6 aa, Mycobacterium
NPAFSS

SEQ ID NO: 1167118 - protein, 6 aa, Mycobacterium
NPAGEA

SEQ ID NO: 1167119 - protein, 7 aa, Mycobacterium
NPANGDA

SEQ ID NO: 1167120 - protein, 10 aa, Mycobacterium
NPARASKVTG

SEQ ID NO: 1167121 - protein, 11 aa, Mycobacterium
NPARDPDTGRR

SEQ ID NO: 1167122 - protein, 6 aa, Mycobacterium
NPARNE

SEQ ID NO: 1167123 - protein, 13 aa, Mycobacterium
NPASHADDSHSAG

SEQ ID NO: 1167124 - protein, 10 aa, Mycobacterium
NPASNAVTGN

SEQ ID NO: 1167125 - protein, 4 aa, Mycobacterium
NPAT

SEQ ID NO: 1167126 - protein, 8 aa, Mycobacterium
NPAVGSAH

SEQ ID NO: 1167127 - protein, 8 aa, Mycobacterium
NPDAPTRE

SEQ ID NO: 1167128 - protein, 12 aa, Mycobacterium
NPDNPNQPPYTP

SEQ ID NO: 1167129 - protein, 7 aa, Mycobacterium
NPDPEIH

SEQ ID NO: 1167130 - protein, 5 aa, Mycobacterium
NPDPM

SEQ ID NO: 1167131 - protein, 9 aa, Mycobacterium
NPDPSGDTV

SEQ ID NO: 1167132 - protein, 6 aa, Mycobacterium
NPDRAG

SEQ ID NO: 1167133 - protein, 4 aa, Mycobacterium
NPDT

SEQ ID NO: 1167134 - protein, 5 aa, Mycobacterium
NPDTA

SEQ ID NO: 1167135 - protein, 10 aa, Mycobacterium
NPEAPDDAGF

SEQ ID NO: 1167136 - protein, 6 aa, Mycobacterium
NPEDRP

SEQ ID NO: 1167137 - protein, 7 aa, Mycobacterium
NPELGRQ

SEQ ID NO: 1167138 - protein, 4 aa, Mycobacterium
NPEP

SEQ ID NO: 1167139 - protein, 6 aa, Mycobacterium
NPESLT

SEQ ID NO: 1167140 - protein, 8 aa, Mycobacterium
NPFSKDAQ

SEQ ID NO: 1167141 - protein, 6 aa, Mycobacterium
NPGDGG

SEQ ID NO: 1167142 - protein, 4 aa, Mycobacterium
NPGF

SEQ ID NO: 1167143 - protein, 11 aa, Mycobacterium
NPGKDDEGNIY

SEQ ID NO: 1167144 - protein, 4 aa, Mycobacterium
NPGL

SEQ ID NO: 1167145 - protein, 10 aa, Mycobacterium
NPGPNYAKTR

SEQ ID NO: 1167146 - protein, 8 aa, Mycobacterium
NPGRGGTL

SEQ ID NO: 1167147 - protein, 5 aa, Mycobacterium
NPGSA

SEQ ID NO: 1167148 - protein, 8 aa, Mycobacterium
NPGSAEGI

SEQ ID NO: 1167149 - protein, 11 aa, Mycobacterium
NPGSDGAPDTW

SEQ ID NO: 1167150 - protein, 7 aa, Mycobacterium
NPGSERY

SEQ ID NO: 1167151 - protein, 12 aa, Mycobacterium
NPGSPTDRRRQP

SEQ ID NO: 1167152 - protein, 7 aa, Mycobacterium
NPGTTFE

SEQ ID NO: 1167153 - protein, 6 aa, Mycobacterium
NPGTVG

SEQ ID NO: 1167154 - protein, 5 aa, Mycobacterium
NPGVR

SEQ ID NO: 1167155 - protein, 5 aa, Mycobacterium
NPGYQ

SEQ ID NO: 1167156 - protein, 4 aa, Mycobacterium
NPHA

SEQ ID NO: 1167157 - protein, 4 aa, Mycobacterium
NPHG

SEQ ID NO: 1167158 - protein, 5 aa, Mycobacterium
NPIGQ

SEQ ID NO: 1167159 - protein, 6 aa, Mycobacterium
NPIPKL

SEQ ID NO: 1167160 - protein, 8 aa, Mycobacterium
NPIPNPPP

SEQ ID NO: 1167161 - protein, 15 aa, Mycobacterium
NPIRERKKKTGAAAR

SEQ ID NO: 1167162 - protein, 9 aa, Mycobacterium
NPKATAEAF

SEQ ID NO: 1167163 - protein, 9 aa, Mycobacterium
NPKSRADLK

SEQ ID NO: 1167164 - protein, 8 aa, Mycobacterium
NPLPAEGF

SEQ ID NO: 1167165 - protein, 6 aa, Mycobacterium
NPLRGK

SEQ ID NO: 1167166 - protein, 8 aa, Mycobacterium
NPNGRGQF

SEQ ID NO: 1167167 - protein, 14 aa, Mycobacterium
NPPGSTAKGPGALA

SEQ ID NO: 1167168 - protein, 9 aa, Mycobacterium
NPPRTEDQL

SEQ ID NO: 1167169 - protein, 5 aa, Mycobacterium
NPQGF

SEQ ID NO: 1167170 - protein, 8 aa, Mycobacterium
NPQIDEAA

SEQ ID NO: 1167171 - protein, 11 aa, Mycobacterium
NPQKDQSQWVT

SEQ ID NO: 1167172 - protein, 5 aa, Mycobacterium
NPQLA

SEQ ID NO: 1167173 - protein, 7 aa, Mycobacterium
NPQRGYP

SEQ ID NO: 1167174 - protein, 16 aa, Mycobacterium
NPQTDRAKDFLGKILH

SEQ ID NO: 1167175 - protein, 17 aa, Mycobacterium
NPQTREPLAPYGASSAA

SEQ ID NO: 1167176 - protein, 4 aa, Mycobacterium
NPRA

SEQ ID NO: 1167177 - protein, 11 aa, Mycobacterium
NPRPTNPAGKL

SEQ ID NO: 1167178 - protein, 4 aa, Mycobacterium
NPRT

SEQ ID NO: 1167179 - protein, 9 aa, Mycobacterium
NPRTAETEQ

SEQ ID NO: 1167180 - protein, 8 aa, Mycobacterium
NPRTAPRL

SEQ ID NO: 1167181 - protein, 10 aa, Mycobacterium
NPRTPSWGEP

SEQ ID NO: 1167182 - protein, 8 aa, Mycobacterium
NPSGEPSL

SEQ ID NO: 1167183 - protein, 10 aa, Mycobacterium
NPSKRNELGS

SEQ ID NO: 1167184 - protein, 6 aa, Mycobacterium
NPTAES

SEQ ID NO: 1167185 - protein, 6 aa, Mycobacterium
NPTCGD

SEQ ID NO: 1167186 - protein, 8 aa, Mycobacterium
NPTNPTGV

SEQ ID NO: 1167187 - protein, 18 aa, Mycobacterium
NPTPGSEWDASPKPAERE

SEQ ID NO: 1167188 - protein, 12 aa, Mycobacterium
NPTQVVPKGPDL

SEQ ID NO: 1167189 - protein, 8 aa, Mycobacterium
NPTTTPDH

SEQ ID NO: 1167190 - protein, 13 aa, Mycobacterium
NPVSQGPAQEKTM

SEQ ID NO: 1167191 - protein, 12 aa, Mycobacterium
NPVTAHKDGTIT

SEQ ID NO: 1167192 - protein, 10 aa, Mycobacterium
NPVTGGSTMP

SEQ ID NO: 1167193 - protein, 18 aa, Mycobacterium
NPWDTDHTAGASSSGSGA

SEQ ID NO: 1167194 - protein, 13 aa, Mycobacterium
NPYGPPDWNPRQG

SEQ ID NO: 1167195 - protein, 12 aa, Mycobacterium
NPYPETAPPERP

SEQ ID NO: 1167196 - protein, 16 aa, Mycobacterium
NQAANKKSALSVALNK

SEQ ID NO: 1167197 - protein, 6 aa, Mycobacterium
NQAARE

SEQ ID NO: 1167198 - protein, 7 aa, Mycobacterium
NQAQNLA

SEQ ID NO: 1167199 - protein, 10 aa, Mycobacterium
NQDPEEGRRR

SEQ ID NO: 1167200 - protein, 4 aa, Mycobacterium
NQEK

SEQ ID NO: 1167201 - protein, 7 aa, Mycobacterium
NQGMTEP

SEQ ID NO: 1167202 - protein, 8 aa, Mycobacterium
NQGPAGAA

SEQ ID NO: 1167203 - protein, 4 aa, Mycobacterium
NQHA

SEQ ID NO: 1167204 - protein, 5 aa, Mycobacterium
NQHGP

SEQ ID NO: 1167205 - protein, 7 aa, Mycobacterium
NQLADSR

SEQ ID NO: 1167206 - protein, 19 aa, Mycobacterium
NQPDEADTAQRPRSSADLP

SEQ ID NO: 1167207 - protein, 7 aa, Mycobacterium
NQPEATR

SEQ ID NO: 1167208 - protein, 6 aa, Mycobacterium
NQPEHE

SEQ ID NO: 1167209 - protein, 15 aa, Mycobacterium
NQPHGPRPSTVYPQD

SEQ ID NO: 1167210 - protein, 5 aa, Mycobacterium
NQPLY

SEQ ID NO: 1167211 - protein, 7 aa, Mycobacterium
NQPPEKL

SEQ ID NO: 1167212 - protein, 7 aa, Mycobacterium
NQPRPVR

SEQ ID NO: 1167213 - protein, 4 aa, Mycobacterium
NQRE

SEQ ID NO: 1167214 - protein, 16 aa, Mycobacterium
NQRGYSPGARPRRRRD

SEQ ID NO: 1167215 - protein, 27 aa, Mycobacterium
NQRNATRDERGRVRNTEEVHDELRRLN

SEQ ID NO: 1167216 - protein, 8 aa, Mycobacterium
NQTGSTAI

SEQ ID NO: 1167217 - protein, 7 aa, Mycobacterium
NQVEPGT

SEQ ID NO: 1167218 - protein, 9 aa, Mycobacterium
NQYGEPYGG

SEQ ID NO: 1167219 - protein, 6 aa, Mycobacterium
NQYPPG

SEQ ID NO: 1167220 - protein, 5 aa, Mycobacterium
NRAAQ

SEQ ID NO: 1167221 - protein, 5 aa, Mycobacterium
NRADP

SEQ ID NO: 1167222 - protein, 9 aa, Mycobacterium
NRAGIDPKK

SEQ ID NO: 1167223 - protein, 8 aa, Mycobacterium
NRAPGGDV

SEQ ID NO: 1167224 - protein, 6 aa, Mycobacterium
NRATGI

SEQ ID NO: 1167225 - protein, 4 aa, Mycobacterium
NRDA

SEQ ID NO: 1167226 - protein, 11 aa, Mycobacterium
NRDAEKAGDWK

SEQ ID NO: 1167227 - protein, 6 aa, Mycobacterium
NRDEEV

SEQ ID NO: 1167228 - protein, 6 aa, Mycobacterium
NRDGDR

SEQ ID NO: 1167229 - protein, 6 aa, Mycobacterium
NRDPLK

SEQ ID NO: 1167230 - protein, 12 aa, Mycobacterium
NRDPRRYPDPDA

SEQ ID NO: 1167231 - protein, 4 aa, Mycobacterium
NRDR

SEQ ID NO: 1167232 - protein, 12 aa, Mycobacterium
NRDRRRFGETAE

SEQ ID NO: 1167233 - protein, 7 aa, Mycobacterium
NRDTGEI

SEQ ID NO: 1167234 - protein, 7 aa, Mycobacterium
NRDTVSA

SEQ ID NO: 1167235 - protein, 7 aa, Mycobacterium
NREGLSA

SEQ ID NO: 1167236 - protein, 12 aa, Mycobacterium
NRESARRRTVAN

SEQ ID NO: 1167237 - protein, 11 aa, Mycobacterium
NRFATDGYERT

SEQ ID NO: 1167238 - protein, 9 aa, Mycobacterium
NRGDNAGSA

SEQ ID NO: 1167239 - protein, 7 aa, Mycobacterium
NRGDRYG

SEQ ID NO: 1167240 - protein, 8 aa, Mycobacterium
NRGHATTA

SEQ ID NO: 1167241 - protein, 10 aa, Mycobacterium
NRGTGTEDRI

SEQ ID NO: 1167242 - protein, 7 aa, Mycobacterium
NRGTLGG

SEQ ID NO: 1167243 - protein, 5 aa, Mycobacterium
NRIPR

SEQ ID NO: 1167244 - protein, 30 aa, Mycobacterium
NRLGADPKNTNYAGGNTSAKGTETDPVTGA

SEQ ID NO: 1167245 - protein, 4 aa, Mycobacterium
NRLH

SEQ ID NO: 1167246 - protein, 7 aa, Mycobacterium
NRLPDKR

SEQ ID NO: 1167247 - protein, 12 aa, Mycobacterium
NRLRRSKDRRKI

SEQ ID NO: 1167248 - protein, 8 aa, Mycobacterium
NRNRAAGE

SEQ ID NO: 1167249 - protein, 10 aa, Mycobacterium
NRPADGQPGI

SEQ ID NO: 1167250 - protein, 5 aa, Mycobacterium
NRPAF

SEQ ID NO: 1167251 - protein, 7 aa, Mycobacterium
NRPAGTL

SEQ ID NO: 1167252 - protein, 5 aa, Mycobacterium
NRPAL

SEQ ID NO: 1167253 - protein, 4 aa, Mycobacterium
NRPD

SEQ ID NO: 1167254 - protein, 8 aa, Mycobacterium
NRPDATAD

SEQ ID NO: 1167255 - protein, 8 aa, Mycobacterium
NRPDSLNS

SEQ ID NO: 1167256 - protein, 4 aa, Mycobacterium
NRPE

SEQ ID NO: 1167257 - protein, 5 aa, Mycobacterium
NRPEA

SEQ ID NO: 1167258 - protein, 7 aa, Mycobacterium
NRPEAVG

SEQ ID NO: 1167259 - protein, 8 aa, Mycobacterium
NRPEKGNA

SEQ ID NO: 1167260 - protein, 5 aa, Mycobacterium
NRPFD

SEQ ID NO: 1167261 - protein, 9 aa, Mycobacterium
NRPHTPAIE

SEQ ID NO: 1167262 - protein, 12 aa, Mycobacterium
NRPMGAPPAPPA

SEQ ID NO: 1167263 - protein, 7 aa, Mycobacterium
NRPPHGI

SEQ ID NO: 1167264 - protein, 5 aa, Mycobacterium
NRPRR

SEQ ID NO: 1167265 - protein, 30 aa, Mycobacterium
NRQAAQSSRASGPSPQVPAARPASATLYRS

SEQ ID NO: 1167266 - protein, 5 aa, Mycobacterium
NRQPV

SEQ ID NO: 1167267 - protein, 13 aa, Mycobacterium
NRQRRSLGQRQTG

SEQ ID NO: 1167268 - protein, 8 aa, Mycobacterium
NRRGNAVE

SEQ ID NO: 1167269 - protein, 6 aa, Mycobacterium
NRRGRT

SEQ ID NO: 1167270 - protein, 9 aa, Mycobacterium
NRRPPRAPE

SEQ ID NO: 1167271 - protein, 4 aa, Mycobacterium
NRRT

SEQ ID NO: 1167272 - protein, 8 aa, Mycobacterium
NRSEYLDR

SEQ ID NO: 1167273 - protein, 19 aa, Mycobacterium
NRSRADTFGPDAHAPRGTD

SEQ ID NO: 1167274 - protein, 23 aa, Mycobacterium
NRTDPEWTTAADGPHKRERASAL

SEQ ID NO: 1167275 - protein, 7 aa, Mycobacterium
NRVEEGR

SEQ ID NO: 1167276 - protein, 12 aa, Mycobacterium
NRVSGGDHTRHP

SEQ ID NO: 1167277 - protein, 12 aa, Mycobacterium
NRYGPPERAPQA

SEQ ID NO: 1167278 - protein, 8 aa, Mycobacterium
NRYGRTRS

SEQ ID NO: 1167279 - protein, 5 aa, Mycobacterium
NSAAI

SEQ ID NO: 1167280 - protein, 4 aa, Mycobacterium
NSAD

SEQ ID NO: 1167281 - protein, 4 aa, Mycobacterium
NSAG

SEQ ID NO: 1167282 - protein, 6 aa, Mycobacterium
NSAPGV

SEQ ID NO: 1167283 - protein, 7 aa, Mycobacterium
NSARSQM

SEQ ID NO: 1167284 - protein, 13 aa, Mycobacterium
NSDAAVRTARDRI

SEQ ID NO: 1167285 - protein, 4 aa, Mycobacterium
NSDE

SEQ ID NO: 1167286 - protein, 5 aa, Mycobacterium
NSERD

SEQ ID NO: 1167287 - protein, 9 aa, Mycobacterium
NSESAEKAA

SEQ ID NO: 1167288 - protein, 6 aa, Mycobacterium
NSFTGT

SEQ ID NO: 1167289 - protein, 8 aa, Mycobacterium
NSGARQTI

SEQ ID NO: 1167290 - protein, 9 aa, Mycobacterium
NSGHPIGSA

SEQ ID NO: 1167291 - protein, 10 aa, Mycobacterium
NSGINPDDLA

SEQ ID NO: 1167292 - protein, 9 aa, Mycobacterium
NSGPLPEEI

SEQ ID NO: 1167293 - protein, 10 aa, Mycobacterium
NSGQDCTAAT

SEQ ID NO: 1167294 - protein, 9 aa, Mycobacterium
NSGSEAVEN

SEQ ID NO: 1167295 - protein, 4 aa, Mycobacterium
NSGT

SEQ ID NO: 1167296 - protein, 8 aa, Mycobacterium
NSGTREEL

SEQ ID NO: 1167297 - protein, 4 aa, Mycobacterium
NSGY

SEQ ID NO: 1167298 - protein, 12 aa, Mycobacterium
NSHADDDGRSDL

SEQ ID NO: 1167299 - protein, 4 aa, Mycobacterium
NSLS

SEQ ID NO: 1167300 - protein, 4 aa, Mycobacterium
NSMT

SEQ ID NO: 1167301 - protein, 14 aa, Mycobacterium
NSMTTNGESVSRST

SEQ ID NO: 1167302 - protein, 16 aa, Mycobacterium
NSNPARFDQKKADALN

SEQ ID NO: 1167303 - protein, 9 aa, Mycobacterium
NSNTFQDDD

SEQ ID NO: 1167304 - protein, 21 aa, Mycobacterium
NSPDLGADGEMPMRPDEQGTP

SEQ ID NO: 1167305 - protein, 12 aa, Mycobacterium
NSPEAVAPHGQA

SEQ ID NO: 1167306 - protein, 12 aa, Mycobacterium
NSPGTIDAGYRG

SEQ ID NO: 1167307 - protein, 4 aa, Mycobacterium
NSPH

SEQ ID NO: 1167308 - protein, 5 aa, Mycobacterium
NSPLY

SEQ ID NO: 1167309 - protein, 8 aa, Mycobacterium
NSPSFEEA

SEQ ID NO: 1167310 - protein, 5 aa, Mycobacterium
NSPYT

SEQ ID NO: 1167311 - protein, 11 aa, Mycobacterium
NSRADGYGGDL

SEQ ID NO: 1167312 - protein, 15 aa, Mycobacterium
NSRRRTADGSWEPGN

SEQ ID NO: 1167313 - protein, 9 aa, Mycobacterium
NSSADGTTL

SEQ ID NO: 1167314 - protein, 11 aa, Mycobacterium
NSSHSTLARRA

SEQ ID NO: 1167315 - protein, 4 aa, Mycobacterium
NSSM

SEQ ID NO: 1167316 - protein, 7 aa, Mycobacterium
NSSSEAV

SEQ ID NO: 1167317 - protein, 8 aa, Mycobacterium
NSSTLGLE

SEQ ID NO: 1167318 - protein, 8 aa, Mycobacterium
NSTAGGAY

SEQ ID NO: 1167319 - protein, 9 aa, Mycobacterium
NSTAGGAYV

SEQ ID NO: 1167320 - protein, 5 aa, Mycobacterium
NSTAY

SEQ ID NO: 1167321 - protein, 9 aa, Mycobacterium
NSTSQDARS

SEQ ID NO: 1167322 - protein, 7 aa, Mycobacterium
NSTTLSN

SEQ ID NO: 1167323 - protein, 5 aa, Mycobacterium
NSTWG

SEQ ID NO: 1167324 - protein, 5 aa, Mycobacterium
NSVGI

SEQ ID NO: 1167325 - protein, 11 aa, Mycobacterium
NSVKPGRPRTG

SEQ ID NO: 1167326 - protein, 9 aa, Mycobacterium
NSVTPPGQM

SEQ ID NO: 1167327 - protein, 7 aa, Mycobacterium
NTAADQL

SEQ ID NO: 1167328 - protein, 7 aa, Mycobacterium
NTAAGAG

SEQ ID NO: 1167329 - protein, 7 aa, Mycobacterium
NTAANAF

SEQ ID NO: 1167330 - protein, 14 aa, Mycobacterium
NTAEQNARNDGKGR

SEQ ID NO: 1167331 - protein, 14 aa, Mycobacterium
NTAKGDEAAATMTG

SEQ ID NO: 1167332 - protein, 6 aa, Mycobacterium
NTATRR

SEQ ID NO: 1167333 - protein, 5 aa, Mycobacterium
NTDDS

SEQ ID NO: 1167334 - protein, 12 aa, Mycobacterium
NTDKGGAAAERI

SEQ ID NO: 1167335 - protein, 4 aa, Mycobacterium
NTDL

SEQ ID NO: 1167336 - protein, 10 aa, Mycobacterium
NTDPAGVEEA

SEQ ID NO: 1167337 - protein, 6 aa, Mycobacterium
NTEARL

SEQ ID NO: 1167338 - protein, 6 aa, Mycobacterium
NTEGFY

SEQ ID NO: 1167339 - protein, 4 aa, Mycobacterium
NTEL

SEQ ID NO: 1167340 - protein, 11 aa, Mycobacterium
NTELASAAGLS

SEQ ID NO: 1167341 - protein, 34 aa, Mycobacterium
NTETSTASEGPAVTTTTAESAPTADVASGDRAAS

SEQ ID NO: 1167342 - protein, 10 aa, Mycobacterium
NTGAVGRDDT

SEQ ID NO: 1167343 - protein, 6 aa, Mycobacterium
NTGLGH

SEQ ID NO: 1167344 - protein, 15 aa, Mycobacterium
NTGTGPTAPHRTNWP

SEQ ID NO: 1167345 - protein, 6 aa, Mycobacterium
NTGVGG

SEQ ID NO: 1167346 - protein, 12 aa, Mycobacterium
NTHEGGTHEEGF

SEQ ID NO: 1167347 - protein, 7 aa, Mycobacterium
NTHPSAR

SEQ ID NO: 1167348 - protein, 9 aa, Mycobacterium
NTIEGGTSD
